United States Patent 11,369,692 (MATERIALS AND METHODS FOR TREATMENT OF DUCHENNE MUSCULAR DYSTROPHY) - sequence listing, part 20

SEQ ID NO: 652342 - DNA, 22 bp, Artificial Sequence
  chemically synthesized
atacccattagttattttcctg

SEQ ID NO: 652343 - DNA, 22 bp, Artificial Sequence
  chemically synthesized
agcctaatacccattagttatt

SEQ ID NO: 652344 - DNA, 22 bp, Artificial Sequence
  chemically synthesized
tcacccaagtattaagcctaat

SEQ ID NO: 652345 - DNA, 22 bp, Artificial Sequence
  chemically synthesized
gtcacccaagtattaagcctaa

SEQ ID NO: 652346 - DNA, 22 bp, Artificial Sequence
  chemically synthesized
tgtcacccaagtattaagccta

SEQ ID NO: 652347 - DNA, 22 bp, Artificial Sequence
  chemically synthesized
ttttgtcacccaagtattaagc

SEQ ID NO: 652348 - DNA, 22 bp, Artificial Sequence
  chemically synthesized
atgggtattaggcttaatactt

SEQ ID NO: 652349 - DNA, 22 bp, Artificial Sequence
  chemically synthesized
tacagattattttgtcacccaa

SEQ ID NO: 652350 - DNA, 22 bp, Artificial Sequence
  chemically synthesized
ggcttaatacttgggtgacaaa

SEQ ID NO: 652351 - DNA, 22 bp, Artificial Sequence
  chemically synthesized
ttgtacagattattttgtcacc

SEQ ID NO: 652352 - DNA, 22 bp, Artificial Sequence
  chemically synthesized
gttgtacagattattttgtcac

SEQ ID NO: 652353 - DNA, 22 bp, Artificial Sequence
  chemically synthesized
aatacttgggtgacaaaataat

SEQ ID NO: 652354 - DNA, 22 bp, Artificial Sequence
  chemically synthesized
atacttgggtgacaaaataatc

SEQ ID NO: 652355 - DNA, 22 bp, Artificial Sequence
  chemically synthesized
gggtgacaaaataatctgtaca

SEQ ID NO: 652356 - DNA, 22 bp, Artificial Sequence
  chemically synthesized
ggtgacaaaataatctgtacaa

SEQ ID NO: 652357 - DNA, 22 bp, Artificial Sequence
  chemically synthesized
tgtcatgggggtttgttgtaca

SEQ ID NO: 652358 - DNA, 22 bp, Artificial Sequence
  chemically synthesized
gtgtcatgggggtttgttgtac

SEQ ID NO: 652359 - DNA, 22 bp, Artificial Sequence
  chemically synthesized
tgaggtaaacttgtgtcatggg

SEQ ID NO: 652360 - DNA, 22 bp, Artificial Sequence
  chemically synthesized
tacaacaaacccccatgacaca

SEQ ID NO: 652361 - DNA, 22 bp, Artificial Sequence
  chemically synthesized
atgaggtaaacttgtgtcatgg

SEQ ID NO: 652362 - DNA, 22 bp, Artificial Sequence
  chemically synthesized
ttatgaggtaaacttgtgtcat

SEQ ID NO: 652363 - DNA, 22 bp, Artificial Sequence
  chemically synthesized
cttatgaggtaaacttgtgtca

SEQ ID NO: 652364 - DNA, 22 bp, Artificial Sequence
  chemically synthesized
ggtttcttatgaggtaaacttg

SEQ ID NO: 652365 - DNA, 22 bp, Artificial Sequence
  chemically synthesized
tctaggtttcttatgaggtaaa

SEQ ID NO: 652366 - DNA, 22 bp, Artificial Sequence
  chemically synthesized
aggggtacctgtctaggtttct

SEQ ID NO: 652367 - DNA, 22 bp, Artificial Sequence
  chemically synthesized
acctcataagaaacctagacag

SEQ ID NO: 652368 - DNA, 22 bp, Artificial Sequence
  chemically synthesized
cctcataagaaacctagacagg

SEQ ID NO: 652369 - DNA, 22 bp, Artificial Sequence
  chemically synthesized
taagttcaggggtacctgtcta

SEQ ID NO: 652370 - DNA, 22 bp, Artificial Sequence
  chemically synthesized
gtaagttcaggggtacctgtct

SEQ ID NO: 652371 - DNA, 22 bp, Artificial Sequence
  chemically synthesized
ataagaaacctagacaggtacc

SEQ ID NO: 652372 - DNA, 22 bp, Artificial Sequence
  chemically synthesized
acttgtaagttcaggggtacct

SEQ ID NO: 652373 - DNA, 22 bp, Artificial Sequence
  chemically synthesized
aacttgtaagttcaggggtacc

SEQ ID NO: 652374 - DNA, 22 bp, Artificial Sequence
  chemically synthesized
aaatttaacttgtaagttcagg

SEQ ID NO: 652375 - DNA, 22 bp, Artificial Sequence
  chemically synthesized
aaaatttaacttgtaagttcag

SEQ ID NO: 652376 - DNA, 22 bp, Artificial Sequence
  chemically synthesized
gacaggtacccctgaacttaca

SEQ ID NO: 652377 - DNA, 22 bp, Artificial Sequence
  chemically synthesized
taaaatttaacttgtaagttca

SEQ ID NO: 652378 - DNA, 22 bp, Artificial Sequence
  chemically synthesized
ttaaaatttaacttgtaagttc

SEQ ID NO: 652379 - DNA, 22 bp, Artificial Sequence
  chemically synthesized
tttaaaatttaacttgtaagtt

SEQ ID NO: 652380 - DNA, 22 bp, Artificial Sequence
  chemically synthesized
agcaacagctttttaaaattta

SEQ ID NO: 652381 - DNA, 22 bp, Artificial Sequence
  chemically synthesized
aacttacaagttaaattttaaa

SEQ ID NO: 652382 - DNA, 22 bp, Artificial Sequence
  chemically synthesized
acaagttaaattttaaaaagct

SEQ ID NO: 652383 - DNA, 22 bp, Artificial Sequence
  chemically synthesized
caagttaaattttaaaaagctg

SEQ ID NO: 652384 - DNA, 22 bp, Artificial Sequence
  chemically synthesized
aattttaaaaagctgttgctga

SEQ ID NO: 652385 - DNA, 22 bp, Artificial Sequence
  chemically synthesized
cacagagaaaagtgctcagcaa

SEQ ID NO: 652386 - DNA, 22 bp, Artificial Sequence
  chemically synthesized
taaaaagctgttgctgagcact

SEQ ID NO: 652387 - DNA, 22 bp, Artificial Sequence
  chemically synthesized
tacacagagaaaagtgctcagc

SEQ ID NO: 652388 - DNA, 22 bp, Artificial Sequence
  chemically synthesized
aaaaagctgttgctgagcactt

SEQ ID NO: 652389 - DNA, 22 bp, Artificial Sequence
  chemically synthesized
aaaagctgttgctgagcacttt

SEQ ID NO: 652390 - DNA, 22 bp, Artificial Sequence
  chemically synthesized
ttgctgagcacttttctctgtg

SEQ ID NO: 652391 - DNA, 22 bp, Artificial Sequence
  chemically synthesized
tgatggaactctacacagagaa

SEQ ID NO: 652392 - DNA, 22 bp, Artificial Sequence
  chemically synthesized
ctgagcacttttctctgtgtag

SEQ ID NO: 652393 - DNA, 22 bp, Artificial Sequence
  chemically synthesized
tgtgatggaactctacacagag

SEQ ID NO: 652394 - DNA, 22 bp, Artificial Sequence
  chemically synthesized
agcacttttctctgtgtagagt

SEQ ID NO: 652395 - DNA, 22 bp, Artificial Sequence
  chemically synthesized
ttctctgtgtagagttccatca

SEQ ID NO: 652396 - DNA, 22 bp, Artificial Sequence
  chemically synthesized
tctctgtgtagagttccatcac

SEQ ID NO: 652397 - DNA, 22 bp, Artificial Sequence
  chemically synthesized
ctctgtgtagagttccatcaca

SEQ ID NO: 652398 - DNA, 22 bp, Artificial Sequence
  chemically synthesized
tctgtgtagagttccatcacag

SEQ ID NO: 652399 - DNA, 22 bp, Artificial Sequence
  chemically synthesized
cacaaagtacctctgtgatgga

SEQ ID NO: 652400 - DNA, 22 bp, Artificial Sequence
  chemically synthesized
ccacaaagtacctctgtgatgg

SEQ ID NO: 652401 - DNA, 22 bp, Artificial Sequence
  chemically synthesized
tgtgtagagttccatcacagag

SEQ ID NO: 652402 - DNA, 22 bp, Artificial Sequence
  chemically synthesized
tccacaaagtacctctgtgatg

SEQ ID NO: 652403 - DNA, 22 bp, Artificial Sequence
  chemically synthesized
ttccacaaagtacctctgtgat

SEQ ID NO: 652404 - DNA, 22 bp, Artificial Sequence
  chemically synthesized
tgtagagttccatcacagaggt

SEQ ID NO: 652405 - DNA, 22 bp, Artificial Sequence
  chemically synthesized
tttccacaaagtacctctgtga

SEQ ID NO: 652406 - DNA, 22 bp, Artificial Sequence
  chemically synthesized
ttttccacaaagtacctctgtg

SEQ ID NO: 652407 - DNA, 22 bp, Artificial Sequence
  chemically synthesized
tttttccacaaagtacctctgt

SEQ ID NO: 652408 - DNA, 22 bp, Artificial Sequence
  chemically synthesized
ttttttccacaaagtacctctg

SEQ ID NO: 652409 - DNA, 22 bp, Artificial Sequence
  chemically synthesized
catcacagaggtactttgtgga

SEQ ID NO: 652410 - DNA, 22 bp, Artificial Sequence
  chemically synthesized
taaacttttttttccacaaagt

SEQ ID NO: 652411 - DNA, 22 bp, Artificial Sequence
  chemically synthesized
ataaacttttttttccacaaag

SEQ ID NO: 652412 - DNA, 22 bp, Artificial Sequence
  chemically synthesized
tataaacttttttttccacaaa

SEQ ID NO: 652413 - DNA, 22 bp, Artificial Sequence
  chemically synthesized
tttataaacttttttttccaca

SEQ ID NO: 652414 - DNA, 22 bp, Artificial Sequence
  chemically synthesized
cataattctttataaacttttt

SEQ ID NO: 652415 - DNA, 22 bp, Artificial Sequence
  chemically synthesized
tgtggaaaaaaaagtttataaa

SEQ ID NO: 652416 - DNA, 22 bp, Artificial Sequence
  chemically synthesized
gtggaaaaaaaagtttataaag

SEQ ID NO: 652417 - DNA, 22 bp, Artificial Sequence
  chemically synthesized
gattgcataattctttataaac

SEQ ID NO: 652418 - DNA, 22 bp, Artificial Sequence
  chemically synthesized
tggaaaaaaaagtttataaaga

SEQ ID NO: 652419 - DNA, 22 bp, Artificial Sequence
  chemically synthesized
agattgcataattctttataaa

SEQ ID NO: 652420 - DNA, 22 bp, Artificial Sequence
  chemically synthesized
tagattgcataattctttataa

SEQ ID NO: 652421 - DNA, 22 bp, Artificial Sequence
  chemically synthesized
ttagattgcataattctttata

SEQ ID NO: 652422 - DNA, 22 bp, Artificial Sequence
  chemically synthesized
atttttagattgcataattctt

SEQ ID NO: 652423 - DNA, 22 bp, Artificial Sequence
  chemically synthesized
catttttagattgcataattct

SEQ ID NO: 652424 - DNA, 22 bp, Artificial Sequence
  chemically synthesized
tcatttttagattgcataattc

SEQ ID NO: 652425 - DNA, 22 bp, Artificial Sequence
  chemically synthesized
ttcatttttagattgcataatt

SEQ ID NO: 652426 - DNA, 22 bp, Artificial Sequence
  chemically synthesized
tttcatttttagattgcataat

SEQ ID NO: 652427 - DNA, 22 bp, Artificial Sequence
  chemically synthesized
ataaagaattatgcaatctaaa

SEQ ID NO: 652428 - DNA, 22 bp, Artificial Sequence
  chemically synthesized
taaagaattatgcaatctaaaa

SEQ ID NO: 652429 - DNA, 22 bp, Artificial Sequence
  chemically synthesized
catgatctttttcatttttaga

SEQ ID NO: 652430 - DNA, 22 bp, Artificial Sequence
  chemically synthesized
gcatgatctttttcatttttag

SEQ ID NO: 652431 - DNA, 22 bp, Artificial Sequence
  chemically synthesized
tgcaatctaaaaatgaaaaaga

SEQ ID NO: 652432 - DNA, 22 bp, Artificial Sequence
  chemically synthesized
aaaatgaaaaagatcatgcaag

SEQ ID NO: 652433 - DNA, 22 bp, Artificial Sequence
  chemically synthesized
tggtgccatgccaaaaggatga

SEQ ID NO: 652434 - DNA, 22 bp, Artificial Sequence
  chemically synthesized
tgtggtgccatgccaaaaggat

SEQ ID NO: 652435 - DNA, 22 bp, Artificial Sequence
  chemically synthesized
cagctctgtggtgccatgccaa

SEQ ID NO: 652436 - DNA, 22 bp, Artificial Sequence
  chemically synthesized
acagctctgtggtgccatgcca

SEQ ID NO: 652437 - DNA, 22 bp, Artificial Sequence
  chemically synthesized
atccttttggcatggcaccaca

SEQ ID NO: 652438 - DNA, 22 bp, Artificial Sequence
  chemically synthesized
aaagtcttacagctctgtggtg

SEQ ID NO: 652439 - DNA, 22 bp, Artificial Sequence
  chemically synthesized
ttggcatggcaccacagagctg

SEQ ID NO: 652440 - DNA, 22 bp, Artificial Sequence
  chemically synthesized
tggcatggcaccacagagctgt

SEQ ID NO: 652441 - DNA, 22 bp, Artificial Sequence
  chemically synthesized
ggcatggcaccacagagctgta

SEQ ID NO: 652442 - DNA, 22 bp, Artificial Sequence
  chemically synthesized
gcatggcaccacagagctgtaa

SEQ ID NO: 652443 - DNA, 22 bp, Artificial Sequence
  chemically synthesized
agtgaatcctgaaagtcttaca

SEQ ID NO: 652444 - DNA, 22 bp, Artificial Sequence
  chemically synthesized
gactcagtgaatcctgaaagtc

SEQ ID NO: 652445 - DNA, 22 bp, Artificial Sequence
  chemically synthesized
ggactcagtgaatcctgaaagt

SEQ ID NO: 652446 - DNA, 22 bp, Artificial Sequence
  chemically synthesized
agtttggactcagtgaatcctg

SEQ ID NO: 652447 - DNA, 22 bp, Artificial Sequence
  chemically synthesized
taagactttcaggattcactga

SEQ ID NO: 652448 - DNA, 22 bp, Artificial Sequence
  chemically synthesized
tcaggattcactgagtccaaac

SEQ ID NO: 652449 - DNA, 22 bp, Artificial Sequence
  chemically synthesized
gatgaatgctgagtttggactc

SEQ ID NO: 652450 - DNA, 22 bp, Artificial Sequence
  chemically synthesized
caggattcactgagtccaaact

SEQ ID NO: 652451 - DNA, 22 bp, Artificial Sequence
  chemically synthesized
aggattcactgagtccaaactc

SEQ ID NO: 652452 - DNA, 22 bp, Artificial Sequence
  chemically synthesized
gactcgatgaatgctgagtttg

SEQ ID NO: 652453 - DNA, 22 bp, Artificial Sequence
  chemically synthesized
ggactcgatgaatgctgagttt

SEQ ID NO: 652454 - DNA, 22 bp, Artificial Sequence
  chemically synthesized
actgagtccaaactcagcattc

SEQ ID NO: 652455 - DNA, 22 bp, Artificial Sequence
  chemically synthesized
agtccaaactcagcattcatcg

SEQ ID NO: 652456 - DNA, 22 bp, Artificial Sequence
  chemically synthesized
gcatgggtaagagtttggactc

SEQ ID NO: 652457 - DNA, 22 bp, Artificial Sequence
  chemically synthesized
agcattcatcgagtccaaactc

SEQ ID NO: 652458 - DNA, 22 bp, Artificial Sequence
  chemically synthesized
atcgagtccaaactcttaccca

SEQ ID NO: 652459 - DNA, 22 bp, Artificial Sequence
  chemically synthesized
taagcacacactggcatgggta

SEQ ID NO: 652460 - DNA, 22 bp, Artificial Sequence
  chemically synthesized
ttacccatgccagtgtgtgctt

SEQ ID NO: 652461 - DNA, 22 bp, Artificial Sequence
  chemically synthesized
acccatgccagtgtgtgcttac

SEQ ID NO: 652462 - DNA, 22 bp, Artificial Sequence
  chemically synthesized
cccatgccagtgtgtgcttaca

SEQ ID NO: 652463 - DNA, 22 bp, Artificial Sequence
  chemically synthesized
acatgggtggtgtagtggctgt

SEQ ID NO: 652464 - DNA, 22 bp, Artificial Sequence
  chemically synthesized
tcacatgggtggtgtagtggct

SEQ ID NO: 652465 - DNA, 22 bp, Artificial Sequence
  chemically synthesized
tctcacatgggtggtgtagtgg

SEQ ID NO: 652466 - DNA, 22 bp, Artificial Sequence
  chemically synthesized
ccagctctctcacatgggtggt

SEQ ID NO: 652467 - DNA, 22 bp, Artificial Sequence
  chemically synthesized
acagccactacaccacccatgt

SEQ ID NO: 652468 - DNA, 22 bp, Artificial Sequence
  chemically synthesized
cccagctctctcacatgggtgg

SEQ ID NO: 652469 - DNA, 22 bp, Artificial Sequence
  chemically synthesized
cagccactacaccacccatgtg

SEQ ID NO: 652470 - DNA, 22 bp, Artificial Sequence
  chemically synthesized
aggatgtttcccagctctctca

SEQ ID NO: 652471 - DNA, 22 bp, Artificial Sequence
  chemically synthesized
caccacccatgtgagagagctg

SEQ ID NO: 652472 - DNA, 22 bp, Artificial Sequence
  chemically synthesized
taaggatgtttcccagctctct

SEQ ID NO: 652473 - DNA, 22 bp, Artificial Sequence
  chemically synthesized
ctaaggatgtttcccagctctc

SEQ ID NO: 652474 - DNA, 22 bp, Artificial Sequence
  chemically synthesized
aggatcaccttctaaggatgtt

SEQ ID NO: 652475 - DNA, 22 bp, Artificial Sequence
  chemically synthesized
ggaaacatccttagaaggtgat

SEQ ID NO: 652476 - DNA, 22 bp, Artificial Sequence
  chemically synthesized
gacacaggtgttcaggatcacc

SEQ ID NO: 652477 - DNA, 22 bp, Artificial Sequence
  chemically synthesized
agaaggtgatcctgaacacctg

SEQ ID NO: 652478 - DNA, 22 bp, Artificial Sequence
  chemically synthesized
gaaggtgatcctgaacacctgt

SEQ ID NO: 652479 - DNA, 22 bp, Artificial Sequence
  chemically synthesized
acaggggtatctggacacaggt

SEQ ID NO: 652480 - DNA, 22 bp, Artificial Sequence
  chemically synthesized
gacaggggtatctggacacagg

SEQ ID NO: 652481 - DNA, 22 bp, Artificial Sequence
  chemically synthesized
tgacaggggtatctggacacag

SEQ ID NO: 652482 - DNA, 22 bp, Artificial Sequence
  chemically synthesized
ttgacaggggtatctggacaca

SEQ ID NO: 652483 - DNA, 22 bp, Artificial Sequence
  chemically synthesized
aacacctgtgtccagatacccc

SEQ ID NO: 652484 - DNA, 22 bp, Artificial Sequence
  chemically synthesized
tgtccagatacccctgtcaaaa

SEQ ID NO: 652485 - DNA, 22 bp, Artificial Sequence
  chemically synthesized
aatgtgatgcagcacttttgac

SEQ ID NO: 652486 - DNA, 22 bp, Artificial Sequence
  chemically synthesized
agctcaatgtgatgcagcactt

SEQ ID NO: 652487 - DNA, 22 bp, Artificial Sequence
  chemically synthesized
cagctcaatgtgatgcagcact

SEQ ID NO: 652488 - DNA, 22 bp, Artificial Sequence
  chemically synthesized
tcaaaagtgctgcatcacattg

SEQ ID NO: 652489 - DNA, 22 bp, Artificial Sequence
  chemically synthesized
atggatttcagctcaatgtgat

SEQ ID NO: 652490 - DNA, 22 bp, Artificial Sequence
  chemically synthesized
tgctgatggatttcagctcaat

SEQ ID NO: 652491 - DNA, 22 bp, Artificial Sequence
  chemically synthesized
catcacattgagctgaaatcca

SEQ ID NO: 652492 - DNA, 22 bp, Artificial Sequence
  chemically synthesized
tatgctgtgctgatggatttca

SEQ ID NO: 652493 - DNA, 22 bp, Artificial Sequence
  chemically synthesized
tatatgctgtgctgatggattt

SEQ ID NO: 652494 - DNA, 22 bp, Artificial Sequence
  chemically synthesized
ctatatgctgtgctgatggatt

SEQ ID NO: 652495 - DNA, 22 bp, Artificial Sequence
  chemically synthesized
agctgaaatccatcagcacagc

SEQ ID NO: 652496 - DNA, 22 bp, Artificial Sequence
  chemically synthesized
gaacttctatatgctgtgctga

SEQ ID NO: 652497 - DNA, 22 bp, Artificial Sequence
  chemically synthesized
tggaacttctatatgctgtgct

SEQ ID NO: 652498 - DNA, 22 bp, Artificial Sequence
  chemically synthesized
aaatccatcagcacagcatata

SEQ ID NO: 652499 - DNA, 22 bp, Artificial Sequence
  chemically synthesized
actctggaacttctatatgctg

SEQ ID NO: 652500 - DNA, 22 bp, Artificial Sequence
  chemically synthesized
aactctggaacttctatatgct

SEQ ID NO: 652501 - DNA, 22 bp, Artificial Sequence
  chemically synthesized
cagtggtttaactctggaactt

SEQ ID NO: 652502 - DNA, 22 bp, Artificial Sequence
  chemically synthesized
cagagttaaaccactggagttc

SEQ ID NO: 652503 - DNA, 22 bp, Artificial Sequence
  chemically synthesized
aaccactggagttcaccactca

SEQ ID NO: 652504 - DNA, 22 bp, Artificial Sequence
  chemically synthesized
aggtcacacagccagtgagtgg

SEQ ID NO: 652505 - DNA, 22 bp, Artificial Sequence
  chemically synthesized
ctaaggtcacacagccagtgag

SEQ ID NO: 652506 - DNA, 22 bp, Artificial Sequence
  chemically synthesized
cctaaggtcacacagccagtga

SEQ ID NO: 652507 - DNA, 22 bp, Artificial Sequence
  chemically synthesized
gagttcaccactcactggctgt

SEQ ID NO: 652508 - DNA, 22 bp, Artificial Sequence
  chemically synthesized
tcctaaggtcacacagccagtg

SEQ ID NO: 652509 - DNA, 22 bp, Artificial Sequence
  chemically synthesized
ttttcctaaggtcacacagcca

SEQ ID NO: 652510 - DNA, 22 bp, Artificial Sequence
  chemically synthesized
accactcactggctgtgtgacc

SEQ ID NO: 652511 - DNA, 22 bp, Artificial Sequence
  chemically synthesized
actggctgtgtgaccttaggaa

SEQ ID NO: 652512 - DNA, 22 bp, Artificial Sequence
  chemically synthesized
gctgtgtgaccttaggaaaata

SEQ ID NO: 652513 - DNA, 22 bp, Artificial Sequence
  chemically synthesized
tgtgaccttaggaaaataactt

SEQ ID NO: 652514 - DNA, 22 bp, Artificial Sequence
  chemically synthesized
aggaaaataactttatctctct

SEQ ID NO: 652515 - DNA, 22 bp, Artificial Sequence
  chemically synthesized
ggaaaataactttatctctctg

SEQ ID NO: 652516 - DNA, 22 bp, Artificial Sequence
  chemically synthesized
tagcagagaaaaagtaagacac

SEQ ID NO: 652517 - DNA, 22 bp, Artificial Sequence
  chemically synthesized
gtagcagagaaaaagtaagaca

SEQ ID NO: 652518 - DNA, 22 bp, Artificial Sequence
  chemically synthesized
tatctctctgtgtcttactttt

SEQ ID NO: 652519 - DNA, 22 bp, Artificial Sequence
  chemically synthesized
atctctctgtgtcttacttttt

SEQ ID NO: 652520 - DNA, 22 bp, Artificial Sequence
  chemically synthesized
tctctctgtgtcttactttttc

SEQ ID NO: 652521 - DNA, 22 bp, Artificial Sequence
  chemically synthesized
cagtttgtagcagagaaaaagt

SEQ ID NO: 652522 - DNA, 22 bp, Artificial Sequence
  chemically synthesized
ccagtttgtagcagagaaaaag

SEQ ID NO: 652523 - DNA, 22 bp, Artificial Sequence
  chemically synthesized
tctgtgtcttactttttctctg

SEQ ID NO: 652524 - DNA, 22 bp, Artificial Sequence
  chemically synthesized
tgtgtcttactttttctctgct

SEQ ID NO: 652525 - DNA, 22 bp, Artificial Sequence
  chemically synthesized
tgtcttactttttctctgctac

SEQ ID NO: 652526 - DNA, 22 bp, Artificial Sequence
  chemically synthesized
atatttccagtttgtagcagag

SEQ ID NO: 652527 - DNA, 22 bp, Artificial Sequence
  chemically synthesized
ttaatatttccagtttgtagca

SEQ ID NO: 652528 - DNA, 22 bp, Artificial Sequence
  chemically synthesized
actttttctctgctacaaactg

SEQ ID NO: 652529 - DNA, 22 bp, Artificial Sequence
  chemically synthesized
ctttttctctgctacaaactgg

SEQ ID NO: 652530 - DNA, 22 bp, Artificial Sequence
  chemically synthesized
tttctctgctacaaactggaaa

SEQ ID NO: 652531 - DNA, 22 bp, Artificial Sequence
  chemically synthesized
ttctctgctacaaactggaaat

SEQ ID NO: 652532 - DNA, 22 bp, Artificial Sequence
  chemically synthesized
tctctgctacaaactggaaata

SEQ ID NO: 652533 - DNA, 22 bp, Artificial Sequence
  chemically synthesized
ctctgctacaaactggaaatat

SEQ ID NO: 652534 - DNA, 22 bp, Artificial Sequence
  chemically synthesized
tctgctacaaactggaaatatt

SEQ ID NO: 652535 - DNA, 22 bp, Artificial Sequence
  chemically synthesized
tgctacaaactggaaatattaa

SEQ ID NO: 652536 - DNA, 22 bp, Artificial Sequence
  chemically synthesized
ctacaaactggaaatattaata

SEQ ID NO: 652537 - DNA, 22 bp, Artificial Sequence
  chemically synthesized
tgaggtaggcactattaatatt

SEQ ID NO: 652538 - DNA, 22 bp, Artificial Sequence
  chemically synthesized
tatgaggtaggcactattaata

SEQ ID NO: 652539 - DNA, 22 bp, Artificial Sequence
  chemically synthesized
caaactggaaatattaatagtg

SEQ ID NO: 652540 - DNA, 22 bp, Artificial Sequence
  chemically synthesized
gaaatattaatagtgcctacct

SEQ ID NO: 652541 - DNA, 22 bp, Artificial Sequence
  chemically synthesized
atagtgcctacctcatagagtt

SEQ ID NO: 652542 - DNA, 22 bp, Artificial Sequence
  chemically synthesized
acgtaatcataaaataactcta

SEQ ID NO: 652543 - DNA, 22 bp, Artificial Sequence
  chemically synthesized
actcacgtaatcataaaataac

SEQ ID NO: 652544 - DNA, 22 bp, Artificial Sequence
  chemically synthesized
cctcatagagttattttatgat

SEQ ID NO: 652545 - DNA, 22 bp, Artificial Sequence
  chemically synthesized
ctgactcacgtaatcataaaat

SEQ ID NO: 652546 - DNA, 22 bp, Artificial Sequence
  chemically synthesized
gctgactcacgtaatcataaaa

SEQ ID NO: 652547 - DNA, 22 bp, Artificial Sequence
  chemically synthesized
atagagttattttatgattacg

SEQ ID NO: 652548 - DNA, 22 bp, Artificial Sequence
  chemically synthesized
atttgctgactcacgtaatcat

SEQ ID NO: 652549 - DNA, 22 bp, Artificial Sequence
  chemically synthesized
catttgctgactcacgtaatca

SEQ ID NO: 652550 - DNA, 22 bp, Artificial Sequence
  chemically synthesized
tcatttgctgactcacgtaatc

SEQ ID NO: 652551 - DNA, 22 bp, Artificial Sequence
  chemically synthesized
cctttcatttgctgactcacgt

SEQ ID NO: 652552 - DNA, 22 bp, Artificial Sequence
  chemically synthesized
ttttatgattacgtgagtcagc

SEQ ID NO: 652553 - DNA, 22 bp, Artificial Sequence
  chemically synthesized
tatgattacgtgagtcagcaaa

SEQ ID NO: 652554 - DNA, 22 bp, Artificial Sequence
  chemically synthesized
atgattacgtgagtcagcaaat

SEQ ID NO: 652555 - DNA, 22 bp, Artificial Sequence
  chemically synthesized
caattgcctttcatttgctgac

SEQ ID NO: 652556 - DNA, 22 bp, Artificial Sequence
  chemically synthesized
tgattacgtgagtcagcaaatg

SEQ ID NO: 652557 - DNA, 22 bp, Artificial Sequence
  chemically synthesized
cgtgagtcagcaaatgaaaggc

SEQ ID NO: 652558 - DNA, 22 bp, Artificial Sequence
  chemically synthesized
tgtgtcagacacggttccaatt

SEQ ID NO: 652559 - DNA, 22 bp, Artificial Sequence
  chemically synthesized
ctatgtgtcagacacggttcca

SEQ ID NO: 652560 - DNA, 22 bp, Artificial Sequence
  chemically synthesized
gctatgtgtcagacacggttcc

SEQ ID NO: 652561 - DNA, 22 bp, Artificial Sequence
  chemically synthesized
ttgctatgtgtcagacacggtt

SEQ ID NO: 652562 - DNA, 22 bp, Artificial Sequence
  chemically synthesized
gaaccgtgtctgacacatagca

SEQ ID NO: 652563 - DNA, 22 bp, Artificial Sequence
  chemically synthesized
acacatagcaagaatcatgttt

SEQ ID NO: 652564 - DNA, 22 bp, Artificial Sequence
  chemically synthesized
gctattgttattgtcattatta

SEQ ID NO: 652565 - DNA, 22 bp, Artificial Sequence
  chemically synthesized
ctattgttattgtcattattat

SEQ ID NO: 652566 - DNA, 22 bp, Artificial Sequence
  chemically synthesized
gtcagatggataataataatga

SEQ ID NO: 652567 - DNA, 22 bp, Artificial Sequence
  chemically synthesized
ttgttattgtcattattattat

SEQ ID NO: 652568 - DNA, 22 bp, Artificial Sequence
  chemically synthesized
ctggtcagatggataataataa

SEQ ID NO: 652569 - DNA, 22 bp, Artificial Sequence
  chemically synthesized
ttattgtcattattattatcca

SEQ ID NO: 652570 - DNA, 22 bp, Artificial Sequence
  chemically synthesized
ggttgctggtcagatggataat

SEQ ID NO: 652571 - DNA, 22 bp, Artificial Sequence
  chemically synthesized
ttgtcattattattatccatct

SEQ ID NO: 652572 - DNA, 22 bp, Artificial Sequence
  chemically synthesized
tgggttgctggtcagatggata

SEQ ID NO: 652573 - DNA, 22 bp, Artificial Sequence
  chemically synthesized
ctgggttgctggtcagatggat

SEQ ID NO: 652574 - DNA, 22 bp, Artificial Sequence
  chemically synthesized
tcattattattatccatctgac

SEQ ID NO: 652575 - DNA, 22 bp, Artificial Sequence
  chemically synthesized
ttattatccatctgaccagcaa

SEQ ID NO: 652576 - DNA, 22 bp, Artificial Sequence
  chemically synthesized
ttatccatctgaccagcaaccc

SEQ ID NO: 652577 - DNA, 22 bp, Artificial Sequence
  chemically synthesized
tccatctgaccagcaacccaga

SEQ ID NO: 652578 - DNA, 22 bp, Artificial Sequence
  chemically synthesized
aaagaccaagaacttctgggtt

SEQ ID NO: 652579 - DNA, 22 bp, Artificial Sequence
  chemically synthesized
ttcaaagaccaagaacttctgg

SEQ ID NO: 652580 - DNA, 22 bp, Artificial Sequence
  chemically synthesized
accagcaacccagaagttcttg

SEQ ID NO: 652581 - DNA, 22 bp, Artificial Sequence
  chemically synthesized
aagggctgttcaaagaccaaga

SEQ ID NO: 652582 - DNA, 22 bp, Artificial Sequence
  chemically synthesized
aaagggctgttcaaagaccaag

SEQ ID NO: 652583 - DNA, 22 bp, Artificial Sequence
  chemically synthesized
gtaaaatatttaaagggctgtt

SEQ ID NO: 652584 - DNA, 22 bp, Artificial Sequence
  chemically synthesized
ttggtctttgaacagcccttta

SEQ ID NO: 652585 - DNA, 22 bp, Artificial Sequence
  chemically synthesized
tggtaaaatatttaaagggctg

SEQ ID NO: 652586 - DNA, 22 bp, Artificial Sequence
  chemically synthesized
ggtctttgaacagccctttaaa

SEQ ID NO: 652587 - DNA, 22 bp, Artificial Sequence
  chemically synthesized
gtctttgaacagccctttaaat

SEQ ID NO: 652588 - DNA, 22 bp, Artificial Sequence
  chemically synthesized
tgaacagccctttaaatatttt

SEQ ID NO: 652589 - DNA, 22 bp, Artificial Sequence
  chemically synthesized
gaacagccctttaaatatttta

SEQ ID NO: 652590 - DNA, 22 bp, Artificial Sequence
  chemically synthesized
aacagccctttaaatattttac

SEQ ID NO: 652591 - DNA, 22 bp, Artificial Sequence
  chemically synthesized
taaatattttaccagagctgtc

SEQ ID NO: 652592 - DNA, 22 bp, Artificial Sequence
  chemically synthesized
aaatattttaccagagctgtct

SEQ ID NO: 652593 - DNA, 22 bp, Artificial Sequence
  chemically synthesized
aatattttaccagagctgtctt

SEQ ID NO: 652594 - DNA, 22 bp, Artificial Sequence
  chemically synthesized
taccagagctgtcttatctgtc

SEQ ID NO: 652595 - DNA, 22 bp, Artificial Sequence
  chemically synthesized
accagagctgtcttatctgtcc

SEQ ID NO: 652596 - DNA, 22 bp, Artificial Sequence
  chemically synthesized
ccagagctgtcttatctgtcca

SEQ ID NO: 652597 - DNA, 22 bp, Artificial Sequence
  chemically synthesized
tcttatctgtccatgcctcttc

SEQ ID NO: 652598 - DNA, 22 bp, Artificial Sequence
  chemically synthesized
atctgtccatgcctcttcattc

SEQ ID NO: 652599 - DNA, 22 bp, Artificial Sequence
  chemically synthesized
tctgtccatgcctcttcattcc

SEQ ID NO: 652600 - DNA, 22 bp, Artificial Sequence
  chemically synthesized
tccatgcctcttcattcctatt

SEQ ID NO: 652601 - DNA, 22 bp, Artificial Sequence
  chemically synthesized
ttcattcctattctttttactt

SEQ ID NO: 652602 - DNA, 22 bp, Artificial Sequence
  chemically synthesized
cattcctattctttttacttct

SEQ ID NO: 652603 - DNA, 22 bp, Artificial Sequence
  chemically synthesized
attcctattctttttacttctt

SEQ ID NO: 652604 - DNA, 22 bp, Artificial Sequence
  chemically synthesized
ctattctttttacttcttcttc

SEQ ID NO: 652605 - DNA, 22 bp, Artificial Sequence
  chemically synthesized
agccgtgtcatatgaagaagaa

SEQ ID NO: 652606 - DNA, 22 bp, Artificial Sequence
  chemically synthesized
ttctttttacttcttcttcata

SEQ ID NO: 652607 - DNA, 22 bp, Artificial Sequence
  chemically synthesized
tttttacttcttcttcatatga

SEQ ID NO: 652608 - DNA, 22 bp, Artificial Sequence
  chemically synthesized
tttacttcttcttcatatgaca

SEQ ID NO: 652609 - DNA, 22 bp, Artificial Sequence
  chemically synthesized
ttacttcttcttcatatgacac

SEQ ID NO: 652610 - DNA, 22 bp, Artificial Sequence
  chemically synthesized
tacttcttcttcatatgacacg

SEQ ID NO: 652611 - DNA, 22 bp, Artificial Sequence
  chemically synthesized
acttcttcttcatatgacacgg

SEQ ID NO: 652612 - DNA, 22 bp, Artificial Sequence
  chemically synthesized
cttcttcttcatatgacacggc

SEQ ID NO: 652613 - DNA, 22 bp, Artificial Sequence
  chemically synthesized
cttcttcatatgacacggctta

SEQ ID NO: 652614 - DNA, 22 bp, Artificial Sequence
  chemically synthesized
ttcttcatatgacacggcttag

SEQ ID NO: 652615 - DNA, 22 bp, Artificial Sequence
  chemically synthesized
cttcatatgacacggcttagtt

SEQ ID NO: 652616 - DNA, 22 bp, Artificial Sequence
  chemically synthesized
ttcatatgacacggcttagttt

SEQ ID NO: 652617 - DNA, 22 bp, Artificial Sequence
  chemically synthesized
aatgacaatggcaaactaagcc

SEQ ID NO: 652618 - DNA, 22 bp, Artificial Sequence
  chemically synthesized
catatgacacggcttagtttgc

SEQ ID NO: 652619 - DNA, 22 bp, Artificial Sequence
  chemically synthesized
taaatgacaatggcaaactaag

SEQ ID NO: 652620 - DNA, 22 bp, Artificial Sequence
  chemically synthesized
atatgacacggcttagtttgcc

SEQ ID NO: 652621 - DNA, 22 bp, Artificial Sequence
  chemically synthesized
ctaaatgacaatggcaaactaa

SEQ ID NO: 652622 - DNA, 22 bp, Artificial Sequence
  chemically synthesized
tctaaatgacaatggcaaacta

SEQ ID NO: 652623 - DNA, 22 bp, Artificial Sequence
  chemically synthesized
aagaatagttttctaaatgaca

SEQ ID NO: 652624 - DNA, 22 bp, Artificial Sequence
  chemically synthesized
gaagaatagttttctaaatgac

SEQ ID NO: 652625 - DNA, 22 bp, Artificial Sequence
  chemically synthesized
agtttgccattgtcatttagaa

SEQ ID NO: 652626 - DNA, 22 bp, Artificial Sequence
  chemically synthesized
gtttgccattgtcatttagaaa

SEQ ID NO: 652627 - DNA, 22 bp, Artificial Sequence
  chemically synthesized
gccattgtcatttagaaaacta

SEQ ID NO: 652628 - DNA, 22 bp, Artificial Sequence
  chemically synthesized
ccattgtcatttagaaaactat

SEQ ID NO: 652629 - DNA, 22 bp, Artificial Sequence
  chemically synthesized
tcatttagaaaactattcttca

SEQ ID NO: 652630 - DNA, 22 bp, Artificial Sequence
  chemically synthesized
cgcaatcatatttgaagaatag

SEQ ID NO: 652631 - DNA, 22 bp, Artificial Sequence
  chemically synthesized
tccgcaatcatatttgaagaat

SEQ ID NO: 652632 - DNA, 22 bp, Artificial Sequence
  chemically synthesized
agaaaactattcttcaaatatg

SEQ ID NO: 652633 - DNA, 22 bp, Artificial Sequence
  chemically synthesized
gaaaactattcttcaaatatga

SEQ ID NO: 652634 - DNA, 22 bp, Artificial Sequence
  chemically synthesized
ttcttcaaatatgattgcggag

SEQ ID NO: 652635 - DNA, 22 bp, Artificial Sequence
  chemically synthesized
ttcaaatatgattgcggagaat

SEQ ID NO: 652636 - DNA, 22 bp, Artificial Sequence
  chemically synthesized
caaatatgattgcggagaatgt

SEQ ID NO: 652637 - DNA, 22 bp, Artificial Sequence
  chemically synthesized
aaatatgattgcggagaatgta

SEQ ID NO: 652638 - DNA, 22 bp, Artificial Sequence
  chemically synthesized
gagaaatagaggtacattctcc

SEQ ID NO: 652639 - DNA, 22 bp, Artificial Sequence
  chemically synthesized
tctggagaaatagaggtacatt

SEQ ID NO: 652640 - DNA, 22 bp, Artificial Sequence
  chemically synthesized
cactgtctggagaaatagaggt

SEQ ID NO: 652641 - DNA, 22 bp, Artificial Sequence
  chemically synthesized
cggagaatgtacctctatttct

SEQ ID NO: 652642 - DNA, 22 bp, Artificial Sequence
  chemically synthesized
tatttctccagacagtgtaact

SEQ ID NO: 652643 - DNA, 22 bp, Artificial Sequence
  chemically synthesized
tttctccagacagtgtaactgg

SEQ ID NO: 652644 - DNA, 22 bp, Artificial Sequence
  chemically synthesized
ctccagacagtgtaactggatt

SEQ ID NO: 652645 - DNA, 22 bp, Artificial Sequence
  chemically synthesized
tccagacagtgtaactggatta

SEQ ID NO: 652646 - DNA, 22 bp, Artificial Sequence
  chemically synthesized
cagacagtgtaactggattact

SEQ ID NO: 652647 - DNA, 22 bp, Artificial Sequence
  chemically synthesized
cggtacagaacaaaagaaagta

SEQ ID NO: 652648 - DNA, 22 bp, Artificial Sequence
  chemically synthesized
gattactttcttttgttctgta

SEQ ID NO: 652649 - DNA, 22 bp, Artificial Sequence
  chemically synthesized
ctttcttttgttctgtaccgta

SEQ ID NO: 652650 - DNA, 22 bp, Artificial Sequence
  chemically synthesized
tcttttgttctgtaccgtaggc

SEQ ID NO: 652651 - DNA, 22 bp, Artificial Sequence
  chemically synthesized
cttttgttctgtaccgtaggct

SEQ ID NO: 652652 - DNA, 22 bp, Artificial Sequence
  chemically synthesized
ttttgttctgtaccgtaggctc

SEQ ID NO: 652653 - DNA, 22 bp, Artificial Sequence
  chemically synthesized
ttgttctgtaccgtaggctcac

SEQ ID NO: 652654 - DNA, 22 bp, Artificial Sequence
  chemically synthesized
tgttctgtaccgtaggctcaca

SEQ ID NO: 652655 - DNA, 22 bp, Artificial Sequence
  chemically synthesized
gttctgtaccgtaggctcacac

SEQ ID NO: 652656 - DNA, 22 bp, Artificial Sequence
  chemically synthesized
agtaggaaccgtgtgtgagcct

SEQ ID NO: 652657 - DNA, 22 bp, Artificial Sequence
  chemically synthesized
ttctgtaccgtaggctcacaca

SEQ ID NO: 652658 - DNA, 22 bp, Artificial Sequence
  chemically synthesized
tgtaccgtaggctcacacacgg

SEQ ID NO: 652659 - DNA, 22 bp, Artificial Sequence
  chemically synthesized
gttgagtaggaaccgtgtgtga

SEQ ID NO: 652660 - DNA, 22 bp, Artificial Sequence
  chemically synthesized
agttgagtaggaaccgtgtgtg

SEQ ID NO: 652661 - DNA, 22 bp, Artificial Sequence
  chemically synthesized
taccgtaggctcacacacggtt

SEQ ID NO: 652662 - DNA, 22 bp, Artificial Sequence
  chemically synthesized
tagttgagtaggaaccgtgtgt

SEQ ID NO: 652663 - DNA, 22 bp, Artificial Sequence
  chemically synthesized
agagattttagttgagtaggaa

SEQ ID NO: 652664 - DNA, 22 bp, Artificial Sequence
  chemically synthesized
acacacggttcctactcaacta

SEQ ID NO: 652665 - DNA, 22 bp, Artificial Sequence
  chemically synthesized
actcagagattttagttgagta

SEQ ID NO: 652666 - DNA, 22 bp, Artificial Sequence
  chemically synthesized
ggaaacactgactcagagattt

SEQ ID NO: 652667 - DNA, 22 bp, Artificial Sequence
  chemically synthesized
ctactcaactaaaatctctgag

SEQ ID NO: 652668 - DNA, 22 bp, Artificial Sequence
  chemically synthesized
ctcaactaaaatctctgagtca

SEQ ID NO: 652669 - DNA, 22 bp, Artificial Sequence
  chemically synthesized
aactaaaatctctgagtcagtg

SEQ ID NO: 652670 - DNA, 22 bp, Artificial Sequence
  chemically synthesized
gacatactgggaaacactgact

SEQ ID NO: 652671 - DNA, 22 bp, Artificial Sequence
  chemically synthesized
aaatctctgagtcagtgtttcc

SEQ ID NO: 652672 - DNA, 22 bp, Artificial Sequence
  chemically synthesized
ctggacatactgggaaacactg

SEQ ID NO: 652673 - DNA, 22 bp, Artificial Sequence
  chemically synthesized
atctgctggacatactgggaaa

SEQ ID NO: 652674 - DNA, 22 bp, Artificial Sequence
  chemically synthesized
tgagtcagtgtttcccagtatg

SEQ ID NO: 652675 - DNA, 22 bp, Artificial Sequence
  chemically synthesized
agtcagtgtttcccagtatgtc

SEQ ID NO: 652676 - DNA, 22 bp, Artificial Sequence
  chemically synthesized
gacgattgatctgctggacata

SEQ ID NO: 652677 - DNA, 22 bp, Artificial Sequence
  chemically synthesized
ctggacgattgatctgctggac

SEQ ID NO: 652678 - DNA, 22 bp, Artificial Sequence
  chemically synthesized
gctggacgattgatctgctgga

SEQ ID NO: 652679 - DNA, 22 bp, Artificial Sequence
  chemically synthesized
tgctggacgattgatctgctgg

SEQ ID NO: 652680 - DNA, 22 bp, Artificial Sequence
  chemically synthesized
cccagtatgtccagcagatcaa

SEQ ID NO: 652681 - DNA, 22 bp, Artificial Sequence
  chemically synthesized
ccagtatgtccagcagatcaat

SEQ ID NO: 652682 - DNA, 22 bp, Artificial Sequence
  chemically synthesized
gtgaagcattttgctggacgat

SEQ ID NO: 652683 - DNA, 22 bp, Artificial Sequence
  chemically synthesized
tcgtgaagcattttgctggacg

SEQ ID NO: 652684 - DNA, 22 bp, Artificial Sequence
  chemically synthesized
ctcgtgaagcattttgctggac

SEQ ID NO: 652685 - DNA, 22 bp, Artificial Sequence
  chemically synthesized
accttctcgtgaagcattttgc

SEQ ID NO: 652686 - DNA, 22 bp, Artificial Sequence
  chemically synthesized
gaccttctcgtgaagcattttg

SEQ ID NO: 652687 - DNA, 22 bp, Artificial Sequence
  chemically synthesized
atttgaccttctcgtgaagcat

SEQ ID NO: 652688 - DNA, 22 bp, Artificial Sequence
  chemically synthesized
attaatttgaccttctcgtgaa

SEQ ID NO: 652689 - DNA, 22 bp, Artificial Sequence
  chemically synthesized
cattaatttgaccttctcgtga

SEQ ID NO: 652690 - DNA, 22 bp, Artificial Sequence
  chemically synthesized
tcattaatttgaccttctcgtg

SEQ ID NO: 652691 - DNA, 22 bp, Artificial Sequence
  chemically synthesized
tttcattaatttgaccttctcg

SEQ ID NO: 652692 - DNA, 22 bp, Artificial Sequence
  chemically synthesized
ctttcattaatttgaccttctc

SEQ ID NO: 652693 - DNA, 22 bp, Artificial Sequence
  chemically synthesized
tttctttcattaatttgacctt

SEQ ID NO: 652694 - DNA, 22 bp, Artificial Sequence
  chemically synthesized
cacgagaaggtcaaattaatga

SEQ ID NO: 652695 - DNA, 22 bp, Artificial Sequence
  chemically synthesized
acgagaaggtcaaattaatgaa

SEQ ID NO: 652696 - DNA, 22 bp, Artificial Sequence
  chemically synthesized
agaggcagatataatgtgcact

SEQ ID NO: 652697 - DNA, 22 bp, Artificial Sequence
  chemically synthesized
atgaaagaaacagtgcacatta

SEQ ID NO: 652698 - DNA, 22 bp, Artificial Sequence
  chemically synthesized
aagaggcagatataatgtgcac

SEQ ID NO: 652699 - DNA, 22 bp, Artificial Sequence
  chemically synthesized
taagaggcagatataatgtgca

SEQ ID NO: 652700 - DNA, 22 bp, Artificial Sequence
  chemically synthesized
agaattttaagaggcagatata

SEQ ID NO: 652701 - DNA, 22 bp, Artificial Sequence
  chemically synthesized
taagaattttaagaggcagata

SEQ ID NO: 652702 - DNA, 22 bp, Artificial Sequence
  chemically synthesized
acgtgctctaagaattttaaga

SEQ ID NO: 652703 - DNA, 22 bp, Artificial Sequence
  chemically synthesized
tatctgcctcttaaaattctta

SEQ ID NO: 652704 - DNA, 22 bp, Artificial Sequence
  chemically synthesized
atatgttaacgtgctctaagaa

SEQ ID NO: 652705 - DNA, 22 bp, Artificial Sequence
  chemically synthesized
aatatgttaacgtgctctaaga

SEQ ID NO: 652706 - DNA, 22 bp, Artificial Sequence
  chemically synthesized
cctcttaaaattcttagagcac

SEQ ID NO: 652707 - DNA, 22 bp, Artificial Sequence
  chemically synthesized
taatatgttaacgtgctctaag

SEQ ID NO: 652708 - DNA, 22 bp, Artificial Sequence
  chemically synthesized
ttaatatgttaacgtgctctaa

SEQ ID NO: 652709 - DNA, 22 bp, Artificial Sequence
  chemically synthesized
ttaaaattcttagagcacgtta

SEQ ID NO: 652710 - DNA, 22 bp, Artificial Sequence
  chemically synthesized
aaaattcttagagcacgttaac

SEQ ID NO: 652711 - DNA, 22 bp, Artificial Sequence
  chemically synthesized
agcttttaatatgttaacgtgc

SEQ ID NO: 652712 - DNA, 22 bp, Artificial Sequence
  chemically synthesized
aaattcttagagcacgttaaca

SEQ ID NO: 652713 - DNA, 22 bp, Artificial Sequence
  chemically synthesized
tcagcttttaatatgttaacgt

SEQ ID NO: 652714 - DNA, 22 bp, Artificial Sequence
  chemically synthesized
ctcagcttttaatatgttaacg

SEQ ID NO: 652715 - DNA, 22 bp, Artificial Sequence
  chemically synthesized
ttagagcacgttaacatattaa

SEQ ID NO: 652716 - DNA, 22 bp, Artificial Sequence
  chemically synthesized
agagcacgttaacatattaaaa

SEQ ID NO: 652717 - DNA, 22 bp, Artificial Sequence
  chemically synthesized
gagcacgttaacatattaaaag

SEQ ID NO: 652718 - DNA, 22 bp, Artificial Sequence
  chemically synthesized
atgaccttctcagcttttaata

SEQ ID NO: 652719 - DNA, 22 bp, Artificial Sequence
  chemically synthesized
ctgatgaccttctcagctttta

SEQ ID NO: 652720 - DNA, 22 bp, Artificial Sequence
  chemically synthesized
actgatgaccttctcagctttt

SEQ ID NO: 652721 - DNA, 22 bp, Artificial Sequence
  chemically synthesized
tactgatgaccttctcagcttt

SEQ ID NO: 652722 - DNA, 22 bp, Artificial Sequence
  chemically synthesized
ctttactgatgaccttctcagc

SEQ ID NO: 652723 - DNA, 22 bp, Artificial Sequence
  chemically synthesized
acatattaaaagctgagaaggt

SEQ ID NO: 652724 - DNA, 22 bp, Artificial Sequence
  chemically synthesized
acatgttgctttactgatgacc

SEQ ID NO: 652725 - DNA, 22 bp, Artificial Sequence
  chemically synthesized
aaagctgagaaggtcatcagta

SEQ ID NO: 652726 - DNA, 22 bp, Artificial Sequence
  chemically synthesized
attaacatgttgctttactgat

SEQ ID NO: 652727 - DNA, 22 bp, Artificial Sequence
  chemically synthesized
agaaggtcatcagtaaagcaac

SEQ ID NO: 652728 - DNA, 22 bp, Artificial Sequence
  chemically synthesized
cagagctgattaacatgttgct

SEQ ID NO: 652729 - DNA, 22 bp, Artificial Sequence
  chemically synthesized
ggaagattccagagctgattaa

SEQ ID NO: 652730 - DNA, 22 bp, Artificial Sequence
  chemically synthesized
agaatctgggaagattccagag

SEQ ID NO: 652731 - DNA, 22 bp, Artificial Sequence
  chemically synthesized
tgagaatctgggaagattccag

SEQ ID NO: 652732 - DNA, 22 bp, Artificial Sequence
  chemically synthesized
tctgagaatctgggaagattcc

SEQ ID NO: 652733 - DNA, 22 bp, Artificial Sequence
  chemically synthesized
tctctgagaatctgggaagatt

SEQ ID NO: 652734 - DNA, 22 bp, Artificial Sequence
  chemically synthesized
atcagctctggaatcttcccag

SEQ ID NO: 652735 - DNA, 22 bp, Artificial Sequence
  chemically synthesized
tctctctgagaatctgggaaga

SEQ ID NO: 652736 - DNA, 22 bp, Artificial Sequence
  chemically synthesized
tctctctctgagaatctgggaa

SEQ ID NO: 652737 - DNA, 22 bp, Artificial Sequence
  chemically synthesized
tctctctctctgagaatctggg

SEQ ID NO: 652738 - DNA, 22 bp, Artificial Sequence
  chemically synthesized
tctctctctctctgagaatctg

SEQ ID NO: 652739 - DNA, 22 bp, Artificial Sequence
  chemically synthesized
tggaatcttcccagattctcag

SEQ ID NO: 652740 - DNA, 22 bp, Artificial Sequence
  chemically synthesized
tctctctctctctctgagaatc

SEQ ID NO: 652741 - DNA, 22 bp, Artificial Sequence
  chemically synthesized
gaatcttcccagattctcagag

SEQ ID NO: 652742 - DNA, 22 bp, Artificial Sequence
  chemically synthesized
tctctctctctctctctgagaa

SEQ ID NO: 652743 - DNA, 22 bp, Artificial Sequence
  chemically synthesized
tctctctctctctctctctgag

SEQ ID NO: 652744 - DNA, 22 bp, Artificial Sequence
  chemically synthesized
tctctctctctctctctctctg

SEQ ID NO: 652745 - DNA, 22 bp, Artificial Sequence
  chemically synthesized
cccagattctcagagagagaga

SEQ ID NO: 652746 - DNA, 22 bp, Artificial Sequence
  chemically synthesized
tctctctctctctctctctctc

SEQ ID NO: 652747 - DNA, 22 bp, Artificial Sequence
  chemically synthesized
ccagattctcagagagagagag

SEQ ID NO: 652748 - DNA, 22 bp, Artificial Sequence
  chemically synthesized
tctctctctctctctctctctc

SEQ ID NO: 652749 - DNA, 22 bp, Artificial Sequence
  chemically synthesized
tctctctctctctctctctctc

SEQ ID NO: 652750 - DNA, 22 bp, Artificial Sequence
  chemically synthesized
tctctctctctctctctctctc

SEQ ID NO: 652751 - DNA, 22 bp, Artificial Sequence
  chemically synthesized
tctctctctctctctctctctc

SEQ ID NO: 652752 - DNA, 22 bp, Artificial Sequence
  chemically synthesized
tcagagagagagagagagagag

SEQ ID NO: 652753 - DNA, 22 bp, Artificial Sequence
  chemically synthesized
tctctctctctctctctctctc

SEQ ID NO: 652754 - DNA, 22 bp, Artificial Sequence
  chemically synthesized
agagagagagagagagagagag

SEQ ID NO: 652755 - DNA, 22 bp, Artificial Sequence
  chemically synthesized
tctctctctctctctctctctc

SEQ ID NO: 652756 - DNA, 22 bp, Artificial Sequence
  chemically synthesized
tctctctctctctctctctctc

SEQ ID NO: 652757 - DNA, 22 bp, Artificial Sequence
  chemically synthesized
tctctctctctctctctctctc

SEQ ID NO: 652758 - DNA, 22 bp, Artificial Sequence
  chemically synthesized
tctctctctctctctctctctc

SEQ ID NO: 652759 - DNA, 22 bp, Artificial Sequence
  chemically synthesized
tctctctctctctctctctctc

SEQ ID NO: 652760 - DNA, 22 bp, Artificial Sequence
  chemically synthesized
tctctctctctctctctctctc

SEQ ID NO: 652761 - DNA, 22 bp, Artificial Sequence
  chemically synthesized
tctctctctctctctctctctc

SEQ ID NO: 652762 - DNA, 22 bp, Artificial Sequence
  chemically synthesized
tctctctctctctctctctctc

SEQ ID NO: 652763 - DNA, 22 bp, Artificial Sequence
  chemically synthesized
tctctctctctctctctctctc

SEQ ID NO: 652764 - DNA, 22 bp, Artificial Sequence
  chemically synthesized
tctctctctctctctctctctc

SEQ ID NO: 652765 - DNA, 22 bp, Artificial Sequence
  chemically synthesized
tctctctctctctctctctctc

SEQ ID NO: 652766 - DNA, 22 bp, Artificial Sequence
  chemically synthesized
tctctctctctctctctctctc

SEQ ID NO: 652767 - DNA, 22 bp, Artificial Sequence
  chemically synthesized
tctctctctctctctctctctc

SEQ ID NO: 652768 - DNA, 22 bp, Artificial Sequence
  chemically synthesized
tctctctctctctctctctctc

SEQ ID NO: 652769 - DNA, 22 bp, Artificial Sequence
  chemically synthesized
tctctctctctctctctctctc

SEQ ID NO: 652770 - DNA, 22 bp, Artificial Sequence
  chemically synthesized
tctctctctctctctctctctc

SEQ ID NO: 652771 - DNA, 22 bp, Artificial Sequence
  chemically synthesized
tctctctctctctctctctctc

SEQ ID NO: 652772 - DNA, 22 bp, Artificial Sequence
  chemically synthesized
tctctctctctctctctctctc

SEQ ID NO: 652773 - DNA, 22 bp, Artificial Sequence
  chemically synthesized
ttctctctctctctctctctct

SEQ ID NO: 652774 - DNA, 22 bp, Artificial Sequence
  chemically synthesized
gttctctctctctctctctctc

SEQ ID NO: 652775 - DNA, 22 bp, Artificial Sequence
  chemically synthesized
cttgttctctctctctctctct

SEQ ID NO: 652776 - DNA, 22 bp, Artificial Sequence
  chemically synthesized
gcttgttctctctctctctctc

SEQ ID NO: 652777 - DNA, 22 bp, Artificial Sequence
  chemically synthesized
ttgcttgttctctctctctctc

SEQ ID NO: 652778 - DNA, 22 bp, Artificial Sequence
  chemically synthesized
agaagtcactcttgcttgttct

SEQ ID NO: 652779 - DNA, 22 bp, Artificial Sequence
  chemically synthesized
cagaagtcactcttgcttgttc

SEQ ID NO: 652780 - DNA, 22 bp, Artificial Sequence
  chemically synthesized
aatcgccccttcagaagtcact

SEQ ID NO: 652781 - DNA, 22 bp, Artificial Sequence
  chemically synthesized
ttaaatcgccccttcagaagtc

SEQ ID NO: 652782 - DNA, 22 bp, Artificial Sequence
  chemically synthesized
ttattaaatcgccccttcagaa

SEQ ID NO: 652783 - DNA, 22 bp, Artificial Sequence
  chemically synthesized
aaaactgttattaaatcgcccc

SEQ ID NO: 652784 - DNA, 22 bp, Artificial Sequence
  chemically synthesized
ctgaaggggcgatttaataaca

SEQ ID NO: 652785 - DNA, 22 bp, Artificial Sequence
  chemically synthesized
tgaaggggcgatttaataacag

SEQ ID NO: 652786 - DNA, 22 bp, Artificial Sequence
  chemically synthesized
acataattgaaaactgttatta

SEQ ID NO: 652787 - DNA, 22 bp, Artificial Sequence
  chemically synthesized
aaggggcgatttaataacagtt

SEQ ID NO: 652788 - DNA, 22 bp, Artificial Sequence
  chemically synthesized
aataacagttttcaattatgtg

SEQ ID NO: 652789 - DNA, 22 bp, Artificial Sequence
  chemically synthesized
ataacagttttcaattatgtga

SEQ ID NO: 652790 - DNA, 22 bp, Artificial Sequence
  chemically synthesized
tgcgagagccattcacataatt

SEQ ID NO: 652791 - DNA, 22 bp, Artificial Sequence
  chemically synthesized
tcaattatgtgaatggctctcg

SEQ ID NO: 652792 - DNA, 22 bp, Artificial Sequence
  chemically synthesized
caattatgtgaatggctctcgc

SEQ ID NO: 652793 - DNA, 22 bp, Artificial Sequence
  chemically synthesized
aattatgtgaatggctctcgca

SEQ ID NO: 652794 - DNA, 22 bp, Artificial Sequence
  chemically synthesized
gtcacaggcccctatgcgagag

SEQ ID NO: 652795 - DNA, 22 bp, Artificial Sequence
  chemically synthesized
tgtgaatggctctcgcataggg

SEQ ID NO: 652796 - DNA, 22 bp, Artificial Sequence
  chemically synthesized
tcgcataggggcctgtgaccag

SEQ ID NO: 652797 - DNA, 22 bp, Artificial Sequence
  chemically synthesized
gcataggggcctgtgaccagct

SEQ ID NO: 652798 - DNA, 22 bp, Artificial Sequence
  chemically synthesized
agtggagagatcgaacagctgg

SEQ ID NO: 652799 - DNA, 22 bp, Artificial Sequence
  chemically synthesized
tcctcagtggagagatcgaaca

SEQ ID NO: 652800 - DNA, 22 bp, Artificial Sequence
  chemically synthesized
tgtcctcagtggagagatcgaa

SEQ ID NO: 652801 - DNA, 22 bp, Artificial Sequence
  chemically synthesized
tgaccagctgttcgatctctcc

SEQ ID NO: 652802 - DNA, 22 bp, Artificial Sequence
  chemically synthesized
ttctgtcctcagtggagagatc

SEQ ID NO: 652803 - DNA, 22 bp, Artificial Sequence
  chemically synthesized
gttctgtcctcagtggagagat

SEQ ID NO: 652804 - DNA, 22 bp, Artificial Sequence
  chemically synthesized
ttgttctgtcctcagtggagag

SEQ ID NO: 652805 - DNA, 22 bp, Artificial Sequence
  chemically synthesized
cttgttctgtcctcagtggaga

SEQ ID NO: 652806 - DNA, 22 bp, Artificial Sequence
  chemically synthesized
ttcttgttctgtcctcagtgga

SEQ ID NO: 652807 - DNA, 22 bp, Artificial Sequence
  chemically synthesized
cttcttgttctgtcctcagtgg

SEQ ID NO: 652808 - DNA, 22 bp, Artificial Sequence
  chemically synthesized
ttcgatctctccactgaggaca

SEQ ID NO: 652809 - DNA, 22 bp, Artificial Sequence
  chemically synthesized
tttcttcttgttctgtcctcag

SEQ ID NO: 652810 - DNA, 22 bp, Artificial Sequence
  chemically synthesized
gatctctccactgaggacagaa

SEQ ID NO: 652811 - DNA, 22 bp, Artificial Sequence
  chemically synthesized
agtctgtttcttcttgttctgt

SEQ ID NO: 652812 - DNA, 22 bp, Artificial Sequence
  chemically synthesized
aagtctgtttcttcttgttctg

SEQ ID NO: 652813 - DNA, 22 bp, Artificial Sequence
  chemically synthesized
tccactgaggacagaacaagaa

SEQ ID NO: 652814 - DNA, 22 bp, Artificial Sequence
  chemically synthesized
cactgaggacagaacaagaaga

SEQ ID NO: 652815 - DNA, 22 bp, Artificial Sequence
  chemically synthesized
cttaagtctgtttcttcttgtt

SEQ ID NO: 652816 - DNA, 22 bp, Artificial Sequence
  chemically synthesized
aggacagaacaagaagaaacag

SEQ ID NO: 652817 - DNA, 22 bp, Artificial Sequence
  chemically synthesized
atgctgcttaagtctgtttctt

SEQ ID NO: 652818 - DNA, 22 bp, Artificial Sequence
  chemically synthesized
catgctgcttaagtctgtttct

SEQ ID NO: 652819 - DNA, 22 bp, Artificial Sequence
  chemically synthesized
ttcatgctgcttaagtctgttt

SEQ ID NO: 652820 - DNA, 22 bp, Artificial Sequence
  chemically synthesized
aattcttcatgctgcttaagtc

SEQ ID NO: 652821 - DNA, 22 bp, Artificial Sequence
  chemically synthesized
cagcctaaattcttcatgctgc

SEQ ID NO: 652822 - DNA, 22 bp, Artificial Sequence
  chemically synthesized
aagcagcatgaagaatttaggc

SEQ ID NO: 652823 - DNA, 22 bp, Artificial Sequence
  chemically synthesized
agcagcatgaagaatttaggct

SEQ ID NO: 652824 - DNA, 22 bp, Artificial Sequence
  chemically synthesized
catatgagctacagcctaaatt

SEQ ID NO: 652825 - DNA, 22 bp, Artificial Sequence
  chemically synthesized
ccatatgagctacagcctaaat

SEQ ID NO: 652826 - DNA, 22 bp, Artificial Sequence
  chemically synthesized
ttccatatgagctacagcctaa

SEQ ID NO: 652827 - DNA, 22 bp, Artificial Sequence
  chemically synthesized
aggctgtagctcatatggaaga

SEQ ID NO: 652828 - DNA, 22 bp, Artificial Sequence
  chemically synthesized
ggctgtagctcatatggaagaa

SEQ ID NO: 652829 - DNA, 22 bp, Artificial Sequence
  chemically synthesized
agcatcaggaaattcttccata

SEQ ID NO: 652830 - DNA, 22 bp, Artificial Sequence
  chemically synthesized
cagcatcaggaaattcttccat

SEQ ID NO: 652831 - DNA, 22 bp, Artificial Sequence
  chemically synthesized
tcagcatcaggaaattcttcca

SEQ ID NO: 652832 - DNA, 22 bp, Artificial Sequence
  chemically synthesized
tagctcatatggaagaatttcc

SEQ ID NO: 652833 - DNA, 22 bp, Artificial Sequence
  chemically synthesized
acaactttcagcatcaggaaat

SEQ ID NO: 652834 - DNA, 22 bp, Artificial Sequence
  chemically synthesized
aacaactttcagcatcaggaaa

SEQ ID NO: 652835 - DNA, 22 bp, Artificial Sequence
  chemically synthesized
atatggaagaatttcctgatgc

SEQ ID NO: 652836 - DNA, 22 bp, Artificial Sequence
  chemically synthesized
taacaactttcagcatcaggaa

SEQ ID NO: 652837 - DNA, 22 bp, Artificial Sequence
  chemically synthesized
atgctttaacaactttcagcat

SEQ ID NO: 652838 - DNA, 22 bp, Artificial Sequence
  chemically synthesized
acactaatgctttaacaacttt

SEQ ID NO: 652839 - DNA, 22 bp, Artificial Sequence
  chemically synthesized
cctgatgctgaaagttgttaaa

SEQ ID NO: 652840 - DNA, 22 bp, Artificial Sequence
  chemically synthesized
ctgatgctgaaagttgttaaag

SEQ ID NO: 652841 - DNA, 22 bp, Artificial Sequence
  chemically synthesized
atgctgaaagttgttaaagcat

SEQ ID NO: 652842 - DNA, 22 bp, Artificial Sequence
  chemically synthesized
gtaattcacactaatgctttaa

SEQ ID NO: 652843 - DNA, 22 bp, Artificial Sequence
  chemically synthesized
ggtaattcacactaatgcttta

SEQ ID NO: 652844 - DNA, 22 bp, Artificial Sequence
  chemically synthesized
aaagttgttaaagcattagtgt

SEQ ID NO: 652845 - DNA, 22 bp, Artificial Sequence
  chemically synthesized
ccttggtaattcacactaatgc

SEQ ID NO: 652846 - DNA, 22 bp, Artificial Sequence
  chemically synthesized
ttaaagcattagtgtgaattac

SEQ ID NO: 652847 - DNA, 22 bp, Artificial Sequence
  chemically synthesized
cagcctcccttggtaattcaca

SEQ ID NO: 652848 - DNA, 22 bp, Artificial Sequence
  chemically synthesized
tacagcctcccttggtaattca

SEQ ID NO: 652849 - DNA, 22 bp, Artificial Sequence
  chemically synthesized
aagcattagtgtgaattaccaa

SEQ ID NO: 652850 - DNA, 22 bp, Artificial Sequence
  chemically synthesized
gtgtgaattaccaagggaggct

SEQ ID NO: 652851 - DNA, 22 bp, Artificial Sequence
  chemically synthesized
aaagagtagaacattctacagc

SEQ ID NO: 652852 - DNA, 22 bp, Artificial Sequence
  chemically synthesized
gaaagagtagaacattctacag

SEQ ID NO: 652853 - DNA, 22 bp, Artificial Sequence
  chemically synthesized
tgaaagagtagaacattctaca

SEQ ID NO: 652854 - DNA, 22 bp, Artificial Sequence
  chemically synthesized
ccaagggaggctgtagaatgtt

SEQ ID NO: 652855 - DNA, 22 bp, Artificial Sequence
  chemically synthesized
ttgaaagagtagaacattctac

SEQ ID NO: 652856 - DNA, 22 bp, Artificial Sequence
  chemically synthesized
tttgaaagagtagaacattcta

SEQ ID NO: 652857 - DNA, 22 bp, Artificial Sequence
  chemically synthesized
tagttttttgaaagagtagaac

SEQ ID NO: 652858 - DNA, 22 bp, Artificial Sequence
  chemically synthesized
tagaatgttctactctttcaaa

SEQ ID NO: 652859 - DNA, 22 bp, Artificial Sequence
  chemically synthesized
tactctttcaaaaaactataga

SEQ ID NO: 652860 - DNA, 22 bp, Artificial Sequence
  chemically synthesized
agcatagaagaatctatagttt

SEQ ID NO: 652861 - DNA, 22 bp, Artificial Sequence
  chemically synthesized
aagcatagaagaatctatagtt

SEQ ID NO: 652862 - DNA, 22 bp, Artificial Sequence
  chemically synthesized
ctctttcaaaaaactatagatt

SEQ ID NO: 652863 - DNA, 22 bp, Artificial Sequence
  chemically synthesized
taagcatagaagaatctatagt

SEQ ID NO: 652864 - DNA, 22 bp, Artificial Sequence
  chemically synthesized
tttcaaaaaactatagattctt

SEQ ID NO: 652865 - DNA, 22 bp, Artificial Sequence
  chemically synthesized
tcaaaaaactatagattcttct

SEQ ID NO: 652866 - DNA, 22 bp, Artificial Sequence
  chemically synthesized
caaaaaactatagattcttcta

SEQ ID NO: 652867 - DNA, 22 bp, Artificial Sequence
  chemically synthesized
aacctttaagcatagaagaatc

SEQ ID NO: 652868 - DNA, 22 bp, Artificial Sequence
  chemically synthesized
aaaaaactatagattcttctat

SEQ ID NO: 652869 - DNA, 22 bp, Artificial Sequence
  chemically synthesized
agaatgttcaacctttaagcat

SEQ ID NO: 652870 - DNA, 22 bp, Artificial Sequence
  chemically synthesized
tagattcttctatgcttaaagg

SEQ ID NO: 652871 - DNA, 22 bp, Artificial Sequence
  chemically synthesized
gagaatgttcaacctttaagca

SEQ ID NO: 652872 - DNA, 22 bp, Artificial Sequence
  chemically synthesized
ttctatgcttaaaggttgaaca

SEQ ID NO: 652873 - DNA, 22 bp, Artificial Sequence
  chemically synthesized
gaaatttgagaatgttcaacct

SEQ ID NO: 652874 - DNA, 22 bp, Artificial Sequence
  chemically synthesized
ctatgcttaaaggttgaacatt

SEQ ID NO: 652875 - DNA, 22 bp, Artificial Sequence
  chemically synthesized
tatgcttaaaggttgaacattc

SEQ ID NO: 652876 - DNA, 22 bp, Artificial Sequence
  chemically synthesized
tgcttaaaggttgaacattctc

SEQ ID NO: 652877 - DNA, 22 bp, Artificial Sequence
  chemically synthesized
ggggctagaaatttgagaatgt

SEQ ID NO: 652878 - DNA, 22 bp, Artificial Sequence
  chemically synthesized
aggggctagaaatttgagaatg

SEQ ID NO: 652879 - DNA, 22 bp, Artificial Sequence
  chemically synthesized
aaaggttgaacattctcaaatt

SEQ ID NO: 652880 - DNA, 22 bp, Artificial Sequence
  chemically synthesized
aaggttgaacattctcaaattt

SEQ ID NO: 652881 - DNA, 22 bp, Artificial Sequence
  chemically synthesized
catcttaggggctagaaatttg

SEQ ID NO: 652882 - DNA, 22 bp, Artificial Sequence
  chemically synthesized
gcatcttaggggctagaaattt

SEQ ID NO: 652883 - DNA, 22 bp, Artificial Sequence
  chemically synthesized
aacattctcaaatttctagccc

SEQ ID NO: 652884 - DNA, 22 bp, Artificial Sequence
  chemically synthesized
tcaaatttctagcccctaagat

SEQ ID NO: 652885 - DNA, 22 bp, Artificial Sequence
  chemically synthesized
aaatttctagcccctaagatgc

SEQ ID NO: 652886 - DNA, 22 bp, Artificial Sequence
  chemically synthesized
ctagcccctaagatgcaagatc

SEQ ID NO: 652887 - DNA, 22 bp, Artificial Sequence
  chemically synthesized
tagcccctaagatgcaagatcc

SEQ ID NO: 652888 - DNA, 22 bp, Artificial Sequence
  chemically synthesized
gcccctaagatgcaagatccat

SEQ ID NO: 652889 - DNA, 22 bp, Artificial Sequence
  chemically synthesized
aaagagccaacatgatggatct

SEQ ID NO: 652890 - DNA, 22 bp, Artificial Sequence
  chemically synthesized
aaaagagccaacatgatggatc

SEQ ID NO: 652891 - DNA, 22 bp, Artificial Sequence
  chemically synthesized
taaaagagccaacatgatggat

SEQ ID NO: 652892 - DNA, 22 bp, Artificial Sequence
  chemically synthesized
agatgcaagatccatcatgttg

SEQ ID NO: 652893 - DNA, 22 bp, Artificial Sequence
  chemically synthesized
gcgtaggtgagcagttttaaaa

SEQ ID NO: 652894 - DNA, 22 bp, Artificial Sequence
  chemically synthesized
tcagttggcgtaggtgagcagt

SEQ ID NO: 652895 - DNA, 22 bp, Artificial Sequence
  chemically synthesized
gctcttttaaaactgctcacct

SEQ ID NO: 652896 - DNA, 22 bp, Artificial Sequence
  chemically synthesized
ttttaaaactgctcacctacgc

SEQ ID NO: 652897 - DNA, 22 bp, Artificial Sequence
  chemically synthesized
agtctgtcagttggcgtaggtg

SEQ ID NO: 652898 - DNA, 22 bp, Artificial Sequence
  chemically synthesized
ttaaaactgctcacctacgcca

SEQ ID NO: 652899 - DNA, 22 bp, Artificial Sequence
  chemically synthesized
cagtctgtcagttggcgtaggt

SEQ ID NO: 652900 - DNA, 22 bp, Artificial Sequence
  chemically synthesized
taaaactgctcacctacgccaa

SEQ ID NO: 652901 - DNA, 22 bp, Artificial Sequence
  chemically synthesized
aaaactgctcacctacgccaac

SEQ ID NO: 652902 - DNA, 22 bp, Artificial Sequence
  chemically synthesized
aaactgctcacctacgccaact

SEQ ID NO: 652903 - DNA, 22 bp, Artificial Sequence
  chemically synthesized
tcttcagtctgtcagttggcgt

SEQ ID NO: 652904 - DNA, 22 bp, Artificial Sequence
  chemically synthesized
gtcttcagtctgtcagttggcg

SEQ ID NO: 652905 - DNA, 22 bp, Artificial Sequence
  chemically synthesized
ctcacctacgccaactgacaga

SEQ ID NO: 652906 - DNA, 22 bp, Artificial Sequence
  chemically synthesized
acctacgccaactgacagactg

SEQ ID NO: 652907 - DNA, 22 bp, Artificial Sequence
  chemically synthesized
cgccaactgacagactgaagac

SEQ ID NO: 652908 - DNA, 22 bp, Artificial Sequence
  chemically synthesized
acagactgaagacaaggtacgg

SEQ ID NO: 652909 - DNA, 22 bp, Artificial Sequence
  chemically synthesized
aagacaaggtacggggattcac

SEQ ID NO: 652910 - DNA, 22 bp, Artificial Sequence
  chemically synthesized
aaacagaatgagaacgtgaatc

SEQ ID NO: 652911 - DNA, 22 bp, Artificial Sequence
  chemically synthesized
acgttctcattctgtttcaatc

SEQ ID NO: 652912 - DNA, 22 bp, Artificial Sequence
  chemically synthesized
tcataaaaatgaaagattgaaa

SEQ ID NO: 652913 - DNA, 22 bp, Artificial Sequence
  chemically synthesized
gtcataaaaatgaaagattgaa

SEQ ID NO: 652914 - DNA, 22 bp, Artificial Sequence
  chemically synthesized
tcattctgtttcaatctttcat

SEQ ID NO: 652915 - DNA, 22 bp, Artificial Sequence
  chemically synthesized
attctgtttcaatctttcattt

SEQ ID NO: 652916 - DNA, 22 bp, Artificial Sequence
  chemically synthesized
tgtttcaatctttcatttttat

SEQ ID NO: 652917 - DNA, 22 bp, Artificial Sequence
  chemically synthesized
tttcaatctttcatttttatga

SEQ ID NO: 652918 - DNA, 22 bp, Artificial Sequence
  chemically synthesized
caatctttcatttttatgacaa

SEQ ID NO: 652919 - DNA, 22 bp, Artificial Sequence
  chemically synthesized
aatctttcatttttatgacaaa

SEQ ID NO: 652920 - DNA, 22 bp, Artificial Sequence
  chemically synthesized
ggatacagagtagtttgtcata

SEQ ID NO: 652921 - DNA, 22 bp, Artificial Sequence
  chemically synthesized
tcatttttatgacaaactactc

SEQ ID NO: 652922 - DNA, 22 bp, Artificial Sequence
  chemically synthesized
catttttatgacaaactactct

SEQ ID NO: 652923 - DNA, 22 bp, Artificial Sequence
  chemically synthesized
atttttatgacaaactactctg

SEQ ID NO: 652924 - DNA, 22 bp, Artificial Sequence
  chemically synthesized
ttatgacaaactactctgtatc

SEQ ID NO: 652925 - DNA, 22 bp, Artificial Sequence
  chemically synthesized
tatgacaaactactctgtatcc

SEQ ID NO: 652926 - DNA, 22 bp, Artificial Sequence
  chemically synthesized
atgacaaactactctgtatcct

SEQ ID NO: 652927 - DNA, 22 bp, Artificial Sequence
  chemically synthesized
tgacaaactactctgtatccta

SEQ ID NO: 652928 - DNA, 22 bp, Artificial Sequence
  chemically synthesized
ctctgtatcctagtggtatatt

SEQ ID NO: 652929 - DNA, 22 bp, Artificial Sequence
  chemically synthesized
tgtatcctagtggtatattccc

SEQ ID NO: 652930 - DNA, 22 bp, Artificial Sequence
  chemically synthesized
tatcctagtggtatattccctc

SEQ ID NO: 652931 - DNA, 22 bp, Artificial Sequence
  chemically synthesized
ccagacaaaaggagagggaata

SEQ ID NO: 652932 - DNA, 22 bp, Artificial Sequence
  chemically synthesized
attgccagacaaaaggagaggg

SEQ ID NO: 652933 - DNA, 22 bp, Artificial Sequence
  chemically synthesized
cattgccagacaaaaggagagg

SEQ ID NO: 652934 - DNA, 22 bp, Artificial Sequence
  chemically synthesized
gtggtatattccctctcctttt

SEQ ID NO: 652935 - DNA, 22 bp, Artificial Sequence
  chemically synthesized
ttcattgccagacaaaaggaga

SEQ ID NO: 652936 - DNA, 22 bp, Artificial Sequence
  chemically synthesized
cttcattgccagacaaaaggag

SEQ ID NO: 652937 - DNA, 22 bp, Artificial Sequence
  chemically synthesized
cttcttcattgccagacaaaag

SEQ ID NO: 652938 - DNA, 22 bp, Artificial Sequence
  chemically synthesized
ccttcttcattgccagacaaaa

SEQ ID NO: 652939 - DNA, 22 bp, Artificial Sequence
  chemically synthesized
tccttcttcattgccagacaaa

SEQ ID NO: 652940 - DNA, 22 bp, Artificial Sequence
  chemically synthesized
tttccttcttcattgccagaca

SEQ ID NO: 652941 - DNA, 22 bp, Artificial Sequence
  chemically synthesized
cctctccttttgtctggcaatg

SEQ ID NO: 652942 - DNA, 22 bp, Artificial Sequence
  chemically synthesized
attctttccttcttcattgcca

SEQ ID NO: 652943 - DNA, 22 bp, Artificial Sequence
  chemically synthesized
aattctttccttcttcattgcc

SEQ ID NO: 652944 - DNA, 22 bp, Artificial Sequence
  chemically synthesized
tccttttgtctggcaatgaaga

SEQ ID NO: 652945 - DNA, 22 bp, Artificial Sequence
  chemically synthesized
taattctttccttcttcattgc

SEQ ID NO: 652946 - DNA, 22 bp, Artificial Sequence
  chemically synthesized
ttaattctttccttcttcattg

SEQ ID NO: 652947 - DNA, 22 bp, Artificial Sequence
  chemically synthesized
cttttgtctggcaatgaagaag

SEQ ID NO: 652948 - DNA, 22 bp, Artificial Sequence
  chemically synthesized
ttgtctggcaatgaagaaggaa

SEQ ID NO: 652949 - DNA, 22 bp, Artificial Sequence
  chemically synthesized
gcttttaattctttccttcttc

SEQ ID NO: 652950 - DNA, 22 bp, Artificial Sequence
  chemically synthesized
tgtctggcaatgaagaaggaaa

SEQ ID NO: 652951 - DNA, 22 bp, Artificial Sequence
  chemically synthesized
gtctggcaatgaagaaggaaag

SEQ ID NO: 652952 - DNA, 22 bp, Artificial Sequence
  chemically synthesized
tctggcaatgaagaaggaaaga

SEQ ID NO: 652953 - DNA, 22 bp, Artificial Sequence
  chemically synthesized
cctggcttttaattctttcctt

SEQ ID NO: 652954 - DNA, 22 bp, Artificial Sequence
  chemically synthesized
gcctggcttttaattctttcct

SEQ ID NO: 652955 - DNA, 22 bp, Artificial Sequence
  chemically synthesized
gcaatgaagaaggaaagaatta

SEQ ID NO: 652956 - DNA, 22 bp, Artificial Sequence
  chemically synthesized
cagaagcttgcctggcttttaa

SEQ ID NO: 652957 - DNA, 22 bp, Artificial Sequence
  chemically synthesized
acagaagcttgcctggctttta

SEQ ID NO: 652958 - DNA, 22 bp, Artificial Sequence
  chemically synthesized
tacagaagcttgcctggctttt

SEQ ID NO: 652959 - DNA, 22 bp, Artificial Sequence
  chemically synthesized
ggtctttacagaagcttgcctg

SEQ ID NO: 652960 - DNA, 22 bp, Artificial Sequence
  chemically synthesized
ttaggtctttacagaagcttgc

SEQ ID NO: 652961 - DNA, 22 bp, Artificial Sequence
  chemically synthesized
tgttaggtctttacagaagctt

SEQ ID NO: 652962 - DNA, 22 bp, Artificial Sequence
  chemically synthesized
aaagccaggcaagcttctgtaa

SEQ ID NO: 652963 - DNA, 22 bp, Artificial Sequence
  chemically synthesized
gttctgttaggtctttacagaa

SEQ ID NO: 652964 - DNA, 22 bp, Artificial Sequence
  chemically synthesized
tagttctgttaggtctttacag

SEQ ID NO: 652965 - DNA, 22 bp, Artificial Sequence
  chemically synthesized
attctagttctgttaggtcttt

SEQ ID NO: 652966 - DNA, 22 bp, Artificial Sequence
  chemically synthesized
aattctagttctgttaggtctt

SEQ ID NO: 652967 - DNA, 22 bp, Artificial Sequence
  chemically synthesized
ggtttaattctagttctgttag

SEQ ID NO: 652968 - DNA, 22 bp, Artificial Sequence
  chemically synthesized
ctgtaaagacctaacagaacta

SEQ ID NO: 652969 - DNA, 22 bp, Artificial Sequence
  chemically synthesized
tgtaaagacctaacagaactag

SEQ ID NO: 652970 - DNA, 22 bp, Artificial Sequence
  chemically synthesized
gctgggtttaattctagttctg

SEQ ID NO: 652971 - DNA, 22 bp, Artificial Sequence
  chemically synthesized
taaagacctaacagaactagaa

SEQ ID NO: 652972 - DNA, 22 bp, Artificial Sequence
  chemically synthesized
agctgggtttaattctagttct

SEQ ID NO: 652973 - DNA, 22 bp, Artificial Sequence
  chemically synthesized
tagctgggtttaattctagttc

SEQ ID NO: 652974 - DNA, 22 bp, Artificial Sequence
  chemically synthesized
acagaactagaattaaacccag

SEQ ID NO: 652975 - DNA, 22 bp, Artificial Sequence
  chemically synthesized
gaattaaacccagctaaaatta

SEQ ID NO: 652976 - DNA, 22 bp, Artificial Sequence
  chemically synthesized
gaatgatcgaaatgtaatttta

SEQ ID NO: 652977 - DNA, 22 bp, Artificial Sequence
  chemically synthesized
tggaatgatcgaaatgtaattt

SEQ ID NO: 652978 - DNA, 22 bp, Artificial Sequence
  chemically synthesized
ctggaatgatcgaaatgtaatt

SEQ ID NO: 652979 - DNA, 22 bp, Artificial Sequence
  chemically synthesized
aacccagctaaaattacatttc

SEQ ID NO: 652980 - DNA, 22 bp, Artificial Sequence
  chemically synthesized
tctggaatgatcgaaatgtaat

SEQ ID NO: 652981 - DNA, 22 bp, Artificial Sequence
  chemically synthesized
ttctggaatgatcgaaatgtaa

SEQ ID NO: 652982 - DNA, 22 bp, Artificial Sequence
  chemically synthesized
tttctggaatgatcgaaatgta

SEQ ID NO: 652983 - DNA, 22 bp, Artificial Sequence
  chemically synthesized
ttttctggaatgatcgaaatgt

SEQ ID NO: 652984 - DNA, 22 bp, Artificial Sequence
  chemically synthesized
aaattacatttcgatcattcca

SEQ ID NO: 652985 - DNA, 22 bp, Artificial Sequence
  chemically synthesized
tatatttttttctggaatgatc

SEQ ID NO: 652986 - DNA, 22 bp, Artificial Sequence
  chemically synthesized
catttcgatcattccagaaaaa

SEQ ID NO: 652987 - DNA, 22 bp, Artificial Sequence
  chemically synthesized
tccctatatatttttttctgga

SEQ ID NO: 652988 - DNA, 22 bp, Artificial Sequence
  chemically synthesized
cgatcattccagaaaaaaatat

SEQ ID NO: 652989 - DNA, 22 bp, Artificial Sequence
  chemically synthesized
gatcattccagaaaaaaatata

SEQ ID NO: 652990 - DNA, 22 bp, Artificial Sequence
  chemically synthesized
caatctatccctatatattttt

SEQ ID NO: 652991 - DNA, 22 bp, Artificial Sequence
  chemically synthesized
ttccaatctatccctatatatt

SEQ ID NO: 652992 - DNA, 22 bp, Artificial Sequence
  chemically synthesized
ctattccaatctatccctatat

SEQ ID NO: 652993 - DNA, 22 bp, Artificial Sequence
  chemically synthesized
cagaaaaaaatatatagggata

SEQ ID NO: 652994 - DNA, 22 bp, Artificial Sequence
  chemically synthesized
ctgctattccaatctatcccta

SEQ ID NO: 652995 - DNA, 22 bp, Artificial Sequence
  chemically synthesized
cctgctattccaatctatccct

SEQ ID NO: 652996 - DNA, 22 bp, Artificial Sequence
  chemically synthesized
ataacttcctgctattccaatc

SEQ ID NO: 652997 - DNA, 22 bp, Artificial Sequence
  chemically synthesized
aataacttcctgctattccaat

SEQ ID NO: 652998 - DNA, 22 bp, Artificial Sequence
  chemically synthesized
accttaataacttcctgctatt

SEQ ID NO: 652999 - DNA, 22 bp, Artificial Sequence
  chemically synthesized
gaccttaataacttcctgctat

SEQ ID NO: 653000 - DNA, 22 bp, Artificial Sequence
  chemically synthesized
tgaccttaataacttcctgcta

SEQ ID NO: 653001 - DNA, 22 bp, Artificial Sequence
  chemically synthesized
ttgaccttaataacttcctgct

SEQ ID NO: 653002 - DNA, 22 bp, Artificial Sequence
  chemically synthesized
tcttttgaccttaataacttcc

SEQ ID NO: 653003 - DNA, 22 bp, Artificial Sequence
  chemically synthesized
atcttttgaccttaataacttc

SEQ ID NO: 653004 - DNA, 22 bp, Artificial Sequence
  chemically synthesized
gaatagcaggaagttattaagg

SEQ ID NO: 653005 - DNA, 22 bp, Artificial Sequence
  chemically synthesized
ttaaggtcaaaagataagtatg

SEQ ID NO: 653006 - DNA, 22 bp, Artificial Sequence
  chemically synthesized
aggtcaaaagataagtatgatg

SEQ ID NO: 653007 - DNA, 22 bp, Artificial Sequence
  chemically synthesized
agtccagtgaatgccatcatac

SEQ ID NO: 653008 - DNA, 22 bp, Artificial Sequence
  chemically synthesized
tctcagtccagtgaatgccatc

SEQ ID NO: 653009 - DNA, 22 bp, Artificial Sequence
  chemically synthesized
caaagattatctcagtccagtg

SEQ ID NO: 653010 - DNA, 22 bp, Artificial Sequence
  chemically synthesized
acaaagattatctcagtccagt

SEQ ID NO: 653011 - DNA, 22 bp, Artificial Sequence
  chemically synthesized
actggactgagataatctttgt

SEQ ID NO: 653012 - DNA, 22 bp, Artificial Sequence
  chemically synthesized
gactgagataatctttgtaagt

SEQ ID NO: 653013 - DNA, 22 bp, Artificial Sequence
  chemically synthesized
aacaaataatggtacttacaaa

SEQ ID NO: 653014 - DNA, 22 bp, Artificial Sequence
  chemically synthesized
agataatctttgtaagtaccat

SEQ ID NO: 653015 - DNA, 22 bp, Artificial Sequence
  chemically synthesized
tatgtatctcaacaaataatgg

SEQ ID NO: 653016 - DNA, 22 bp, Artificial Sequence
  chemically synthesized
atatgtatctcaacaaataatg

SEQ ID NO: 653017 - DNA, 22 bp, Artificial Sequence
  chemically synthesized
tgtaagtaccattatttgttga

SEQ ID NO: 653018 - DNA, 22 bp, Artificial Sequence
  chemically synthesized
gtaagtaccattatttgttgag

SEQ ID NO: 653019 - DNA, 22 bp, Artificial Sequence
  chemically synthesized
taagtaccattatttgttgaga

SEQ ID NO: 653020 - DNA, 22 bp, Artificial Sequence
  chemically synthesized
agacttatatgtatctcaacaa

SEQ ID NO: 653021 - DNA, 22 bp, Artificial Sequence
  chemically synthesized
tatctgagacttatatgtatct

SEQ ID NO: 653022 - DNA, 22 bp, Artificial Sequence
  chemically synthesized
tttgttgagatacatataagtc

SEQ ID NO: 653023 - DNA, 22 bp, Artificial Sequence
  chemically synthesized
gttgagatacatataagtctca

SEQ ID NO: 653024 - DNA, 22 bp, Artificial Sequence
  chemically synthesized
ttgagatacatataagtctcag

SEQ ID NO: 653025 - DNA, 22 bp, Artificial Sequence
  chemically synthesized
agaggggattatatctgagact

SEQ ID NO: 653026 - DNA, 22 bp, Artificial Sequence
  chemically synthesized
agatacatataagtctcagata

SEQ ID NO: 653027 - DNA, 22 bp, Artificial Sequence
  chemically synthesized
atactgagaggggattatatct

SEQ ID NO: 653028 - DNA, 22 bp, Artificial Sequence
  chemically synthesized
gatactgagaggggattatatc

SEQ ID NO: 653029 - DNA, 22 bp, Artificial Sequence
  chemically synthesized
agatataatcccctctcagtat

SEQ ID NO: 653030 - DNA, 22 bp, Artificial Sequence
  chemically synthesized
gagatgaggacaaggtcaccct

SEQ ID NO: 653031 - DNA, 22 bp, Artificial Sequence
  chemically synthesized
agagatgaggacaaggtcaccc

SEQ ID NO: 653032 - DNA, 22 bp, Artificial Sequence
  chemically synthesized
tcagtatcaagggtgaccttgt

SEQ ID NO: 653033 - DNA, 22 bp, Artificial Sequence
  chemically synthesized
agtatcaagggtgaccttgtcc

SEQ ID NO: 653034 - DNA, 22 bp, Artificial Sequence
  chemically synthesized
gtgtttagagatgaggacaagg

SEQ ID NO: 653035 - DNA, 22 bp, Artificial Sequence
  chemically synthesized
aaactggtgtttagagatgagg

SEQ ID NO: 653036 - DNA, 22 bp, Artificial Sequence
  chemically synthesized
gaaactggtgtttagagatgag

SEQ ID NO: 653037 - DNA, 22 bp, Artificial Sequence
  chemically synthesized
catggcttgaaactggtgttta

SEQ ID NO: 653038 - DNA, 22 bp, Artificial Sequence
  chemically synthesized
gtcctcatctctaaacaccagt

SEQ ID NO: 653039 - DNA, 22 bp, Artificial Sequence
  chemically synthesized
gcatggcttgaaactggtgttt

SEQ ID NO: 653040 - DNA, 22 bp, Artificial Sequence
  chemically synthesized
tcctcatctctaaacaccagtt

SEQ ID NO: 653041 - DNA, 22 bp, Artificial Sequence
  chemically synthesized
cttgcatggcttgaaactggtg

SEQ ID NO: 653042 - DNA, 22 bp, Artificial Sequence
  chemically synthesized
gcttgcatggcttgaaactggt

SEQ ID NO: 653043 - DNA, 22 bp, Artificial Sequence
  chemically synthesized
tgcttgcatggcttgaaactgg

SEQ ID NO: 653044 - DNA, 22 bp, Artificial Sequence
  chemically synthesized
atctctaaacaccagtttcaag

SEQ ID NO: 653045 - DNA, 22 bp, Artificial Sequence
  chemically synthesized
taaacaccagtttcaagccatg

SEQ ID NO: 653046 - DNA, 22 bp, Artificial Sequence
  chemically synthesized
aacaccagtttcaagccatgca

SEQ ID NO: 653047 - DNA, 22 bp, Artificial Sequence
  chemically synthesized
caagagattttgcttgcatggc

SEQ ID NO: 653048 - DNA, 22 bp, Artificial Sequence
  chemically synthesized
ccaagagattttgcttgcatgg

SEQ ID NO: 653049 - DNA, 22 bp, Artificial Sequence
  chemically synthesized
tccaagagattttgcttgcatg

SEQ ID NO: 653050 - DNA, 22 bp, Artificial Sequence
  chemically synthesized
caagccatgcaagcaaaatctc

SEQ ID NO: 653051 - DNA, 22 bp, Artificial Sequence
  chemically synthesized
aagccatgcaagcaaaatctct

SEQ ID NO: 653052 - DNA, 22 bp, Artificial Sequence
  chemically synthesized
aatgacctttccaagagatttt

SEQ ID NO: 653053 - DNA, 22 bp, Artificial Sequence
  chemically synthesized
ttggaaaggtcatttagccctg

SEQ ID NO: 653054 - DNA, 22 bp, Artificial Sequence
  chemically synthesized
ggaaaggtcatttagccctggg

SEQ ID NO: 653055 - DNA, 22 bp, Artificial Sequence
  chemically synthesized
gaaaggtcatttagccctgggt

SEQ ID NO: 653056 - DNA, 22 bp, Artificial Sequence
  chemically synthesized
agccctgggttttgttttgttt

SEQ ID NO: 653057 - DNA, 22 bp, Artificial Sequence
  chemically synthesized
gccctgggttttgttttgtttg

SEQ ID NO: 653058 - DNA, 22 bp, Artificial Sequence
  chemically synthesized
ggttttgttttgtttgttggct

SEQ ID NO: 653059 - DNA, 22 bp, Artificial Sequence
  chemically synthesized
tgttttgtttgttggctttgtt

SEQ ID NO: 653060 - DNA, 22 bp, Artificial Sequence
  chemically synthesized
gttttgtttgttggctttgttt

SEQ ID NO: 653061 - DNA, 22 bp, Artificial Sequence
  chemically synthesized
ttttgtttgttggctttgtttt

SEQ ID NO: 653062 - DNA, 22 bp, Artificial Sequence
  chemically synthesized
tgtttgttggctttgttttgct

SEQ ID NO: 653063 - DNA, 22 bp, Artificial Sequence
  chemically synthesized
gtttgttggctttgttttgctt

SEQ ID NO: 653064 - DNA, 22 bp, Artificial Sequence
  chemically synthesized
tttgttggctttgttttgcttt

SEQ ID NO: 653065 - DNA, 22 bp, Artificial Sequence
  chemically synthesized
ccaaaacaacagcaaaagcaaa

SEQ ID NO: 653066 - DNA, 22 bp, Artificial Sequence
  chemically synthesized
gttggctttgttttgcttttgc

SEQ ID NO: 653067 - DNA, 22 bp, Artificial Sequence
  chemically synthesized
ttggctttgttttgcttttgct

SEQ ID NO: 653068 - DNA, 22 bp, Artificial Sequence
  chemically synthesized
ttgccaaaacaacagcaaaagc

SEQ ID NO: 653069 - DNA, 22 bp, Artificial Sequence
  chemically synthesized
gctttgttttgcttttgctgtt

SEQ ID NO: 653070 - DNA, 22 bp, Artificial Sequence
  chemically synthesized
tgttttgcttttgctgttgttt

SEQ ID NO: 653071 - DNA, 22 bp, Artificial Sequence
  chemically synthesized
gttttgcttttgctgttgtttt

SEQ ID NO: 653072 - DNA, 22 bp, Artificial Sequence
  chemically synthesized
ttttgcttttgctgttgttttg

SEQ ID NO: 653073 - DNA, 22 bp, Artificial Sequence
  chemically synthesized
tgcttttgctgttgttttggca

SEQ ID NO: 653074 - DNA, 22 bp, Artificial Sequence
  chemically synthesized
gcttttgctgttgttttggcaa

SEQ ID NO: 653075 - DNA, 22 bp, Artificial Sequence
  chemically synthesized
cttttgctgttgttttggcaat

SEQ ID NO: 653076 - DNA, 22 bp, Artificial Sequence
  chemically synthesized
ttgctgttgttttggcaataac

SEQ ID NO: 653077 - DNA, 22 bp, Artificial Sequence
  chemically synthesized
tgctgttgttttggcaataact

SEQ ID NO: 653078 - DNA, 22 bp, Artificial Sequence
  chemically synthesized
gctgttgttttggcaataactc

SEQ ID NO: 653079 - DNA, 22 bp, Artificial Sequence
  chemically synthesized
ctgttgttttggcaataactcc

SEQ ID NO: 653080 - DNA, 22 bp, Artificial Sequence
  chemically synthesized
ttgttttggcaataactccatt

SEQ ID NO: 653081 - DNA, 22 bp, Artificial Sequence
  chemically synthesized
ttttggcaataactccattttc

SEQ ID NO: 653082 - DNA, 22 bp, Artificial Sequence
  chemically synthesized
tggcaataactccattttcccc

SEQ ID NO: 653083 - DNA, 22 bp, Artificial Sequence
  chemically synthesized
ggcaataactccattttcccct

SEQ ID NO: 653084 - DNA, 22 bp, Artificial Sequence
  chemically synthesized
gcaataactccattttcccctt

SEQ ID NO: 653085 - DNA, 22 bp, Artificial Sequence
  chemically synthesized
tgtgtgcatgacatagaagggg

SEQ ID NO: 653086 - DNA, 22 bp, Artificial Sequence
  chemically synthesized
tgtgtgtgcatgacatagaagg

SEQ ID NO: 653087 - DNA, 22 bp, Artificial Sequence
  chemically synthesized
ctgtgtgtgcatgacatagaag

SEQ ID NO: 653088 - DNA, 22 bp, Artificial Sequence
  chemically synthesized
tctgtgtgtgcatgacatagaa

SEQ ID NO: 653089 - DNA, 22 bp, Artificial Sequence
  chemically synthesized
cattttccccttctatgtcatg

SEQ ID NO: 653090 - DNA, 22 bp, Artificial Sequence
  chemically synthesized
ctttctgtgtgtgcatgacata

SEQ ID NO: 653091 - DNA, 22 bp, Artificial Sequence
  chemically synthesized
gctttctgtgtgtgcatgacat

SEQ ID NO: 653092 - DNA, 22 bp, Artificial Sequence
  chemically synthesized
tgctttctgtgtgtgcatgaca

SEQ ID NO: 653093 - DNA, 22 bp, Artificial Sequence
  chemically synthesized
tccccttctatgtcatgcacac

SEQ ID NO: 653094 - DNA, 22 bp, Artificial Sequence
  chemically synthesized
ccccttctatgtcatgcacaca

SEQ ID NO: 653095 - DNA, 22 bp, Artificial Sequence
  chemically synthesized
cccttctatgtcatgcacacac

SEQ ID NO: 653096 - DNA, 22 bp, Artificial Sequence
  chemically synthesized
ctatgtcatgcacacacagaaa

SEQ ID NO: 653097 - DNA, 22 bp, Artificial Sequence
  chemically synthesized
tgatagctttgctttctgtgtg

SEQ ID NO: 653098 - DNA, 22 bp, Artificial Sequence
  chemically synthesized
tatgtcatgcacacacagaaag

SEQ ID NO: 653099 - DNA, 22 bp, Artificial Sequence
  chemically synthesized
tgtcatgcacacacagaaagca

SEQ ID NO: 653100 - DNA, 22 bp, Artificial Sequence
  chemically synthesized
tgaccatcataatggaaggagc

SEQ ID NO: 653101 - DNA, 22 bp, Artificial Sequence
  chemically synthesized
tcacagctccttccattatgat

SEQ ID NO: 653102 - DNA, 22 bp, Artificial Sequence
  chemically synthesized
caaactgtgaccatcataatgg

SEQ ID NO: 653103 - DNA, 22 bp, Artificial Sequence
  chemically synthesized
cttccattatgatggtcacagt

SEQ ID NO: 653104 - DNA, 22 bp, Artificial Sequence
  chemically synthesized
ccattatgatggtcacagtttg

SEQ ID NO: 653105 - DNA, 22 bp, Artificial Sequence
  chemically synthesized
cattatgatggtcacagtttgg

SEQ ID NO: 653106 - DNA, 22 bp, Artificial Sequence
  chemically synthesized
tgatggtcacagtttggaatta

SEQ ID NO: 653107 - DNA, 22 bp, Artificial Sequence
  chemically synthesized
ggaattatgttgggtttctcct

SEQ ID NO: 653108 - DNA, 22 bp, Artificial Sequence
  chemically synthesized
gaattatgttgggtttctcctc

SEQ ID NO: 653109 - DNA, 22 bp, Artificial Sequence
  chemically synthesized
tgttgggtttctcctctttttc

SEQ ID NO: 653110 - DNA, 22 bp, Artificial Sequence
  chemically synthesized
ggtttctcctctttttctgttg

SEQ ID NO: 653111 - DNA, 22 bp, Artificial Sequence
  chemically synthesized
gcaggtgaggaccaacagaaaa

SEQ ID NO: 653112 - DNA, 22 bp, Artificial Sequence
  chemically synthesized
ctggcaggtgaggaccaacaga

SEQ ID NO: 653113 - DNA, 22 bp, Artificial Sequence
  chemically synthesized
ctcctctttttctgttggtcct

SEQ ID NO: 653114 - DNA, 22 bp, Artificial Sequence
  chemically synthesized
tcctctttttctgttggtcctc

SEQ ID NO: 653115 - DNA, 22 bp, Artificial Sequence
  chemically synthesized
ctctttttctgttggtcctcac

SEQ ID NO: 653116 - DNA, 22 bp, Artificial Sequence
  chemically synthesized
tttttctgttggtcctcacctg

SEQ ID NO: 653117 - DNA, 22 bp, Artificial Sequence
  chemically synthesized
tttctgttggtcctcacctgcc

SEQ ID NO: 653118 - DNA, 22 bp, Artificial Sequence
  chemically synthesized
tggatagttgctggcaggtgag

SEQ ID NO: 653119 - DNA, 22 bp, Artificial Sequence
  chemically synthesized
ttctgttggtcctcacctgcca

SEQ ID NO: 653120 - DNA, 22 bp, Artificial Sequence
  chemically synthesized
tctgttggtcctcacctgccag

SEQ ID NO: 653121 - DNA, 22 bp, Artificial Sequence
  chemically synthesized
ctgttggtcctcacctgccagc

SEQ ID NO: 653122 - DNA, 22 bp, Artificial Sequence
  chemically synthesized
ttatggatagttgctggcaggt

SEQ ID NO: 653123 - DNA, 22 bp, Artificial Sequence
  chemically synthesized
tgttggtcctcacctgccagca

SEQ ID NO: 653124 - DNA, 22 bp, Artificial Sequence
  chemically synthesized
tgttatggatagttgctggcag

SEQ ID NO: 653125 - DNA, 22 bp, Artificial Sequence
  chemically synthesized
ttggtcctcacctgccagcaac

SEQ ID NO: 653126 - DNA, 22 bp, Artificial Sequence
  chemically synthesized
ctgttatggatagttgctggca

SEQ ID NO: 653127 - DNA, 22 bp, Artificial Sequence
  chemically synthesized
tctgttatggatagttgctggc

SEQ ID NO: 653128 - DNA, 22 bp, Artificial Sequence
  chemically synthesized
ttctgttatggatagttgctgg

SEQ ID NO: 653129 - DNA, 22 bp, Artificial Sequence
  chemically synthesized
gtcctcacctgccagcaactat

SEQ ID NO: 653130 - DNA, 22 bp, Artificial Sequence
  chemically synthesized
gcttttctgttatggatagttg

SEQ ID NO: 653131 - DNA, 22 bp, Artificial Sequence
  chemically synthesized
acctgccagcaactatccataa

SEQ ID NO: 653132 - DNA, 22 bp, Artificial Sequence
  chemically synthesized
ccctagcttttctgttatggat

SEQ ID NO: 653133 - DNA, 22 bp, Artificial Sequence
  chemically synthesized
cccctagcttttctgttatgga

SEQ ID NO: 653134 - DNA, 22 bp, Artificial Sequence
  chemically synthesized
ccagcaactatccataacagaa

SEQ ID NO: 653135 - DNA, 22 bp, Artificial Sequence
  chemically synthesized
cttcccctagcttttctgttat

SEQ ID NO: 653136 - DNA, 22 bp, Artificial Sequence
  chemically synthesized
attccttcccctagcttttctg

SEQ ID NO: 653137 - DNA, 22 bp, Artificial Sequence
  chemically synthesized
tccataacagaaaagctagggg

SEQ ID NO: 653138 - DNA, 22 bp, Artificial Sequence
  chemically synthesized
ggggaaggaatcagttgtcatt

SEQ ID NO: 653139 - DNA, 22 bp, Artificial Sequence
  chemically synthesized
taacagagcaatagtaatgaca

SEQ ID NO: 653140 - DNA, 22 bp, Artificial Sequence
  chemically synthesized
cagtgtgctgtaacagagcaat

SEQ ID NO: 653141 - DNA, 22 bp, Artificial Sequence
  chemically synthesized
tcattactattgctctgttaca

SEQ ID NO: 653142 - DNA, 22 bp, Artificial Sequence
  chemically synthesized
ctattgctctgttacagcacac

SEQ ID NO: 653143 - DNA, 22 bp, Artificial Sequence
  chemically synthesized
ttgctctgttacagcacactgg

SEQ ID NO: 653144 - DNA, 22 bp, Artificial Sequence
  chemically synthesized
tatgaagccaccctccagtgtg

SEQ ID NO: 653145 - DNA, 22 bp, Artificial Sequence
  chemically synthesized
ctctgttacagcacactggagg

SEQ ID NO: 653146 - DNA, 22 bp, Artificial Sequence
  chemically synthesized
gtatgaagccaccctccagtgt

SEQ ID NO: 653147 - DNA, 22 bp, Artificial Sequence
  chemically synthesized
tgttacagcacactggagggtg

SEQ ID NO: 653148 - DNA, 22 bp, Artificial Sequence
  chemically synthesized
ttacagcacactggagggtggc

SEQ ID NO: 653149 - DNA, 22 bp, Artificial Sequence
  chemically synthesized
cagcacactggagggtggcttc

SEQ ID NO: 653150 - DNA, 22 bp, Artificial Sequence
  chemically synthesized
tataaaggtgatatttgtatga

SEQ ID NO: 653151 - DNA, 22 bp, Artificial Sequence
  chemically synthesized
gtataaaggtgatatttgtatg

SEQ ID NO: 653152 - DNA, 22 bp, Artificial Sequence
  chemically synthesized
gagggtggcttcatacaaatat

SEQ ID NO: 653153 - DNA, 22 bp, Artificial Sequence
  chemically synthesized
tatttgtataaaggtgatattt

SEQ ID NO: 653154 - DNA, 22 bp, Artificial Sequence
  chemically synthesized
ttatatttgtataaaggtgata

SEQ ID NO: 653155 - DNA, 22 bp, Artificial Sequence
  chemically synthesized
gttatatttgtataaaggtgat

SEQ ID NO: 653156 - DNA, 22 bp, Artificial Sequence
  chemically synthesized
catacaaatatcacctttatac

SEQ ID NO: 653157 - DNA, 22 bp, Artificial Sequence
  chemically synthesized
atacaaatatcacctttataca

SEQ ID NO: 653158 - DNA, 22 bp, Artificial Sequence
  chemically synthesized
tgtaccttgttatatttgtata

SEQ ID NO: 653159 - DNA, 22 bp, Artificial Sequence
  chemically synthesized
tctgtgtaccttgttatatttg

SEQ ID NO: 653160 - DNA, 22 bp, Artificial Sequence
  chemically synthesized
gtctgtgtaccttgttatattt

SEQ ID NO: 653161 - DNA, 22 bp, Artificial Sequence
  chemically synthesized
tgtctgtgtaccttgttatatt

SEQ ID NO: 653162 - DNA, 22 bp, Artificial Sequence
  chemically synthesized
tttgtctgtgtaccttgttata

SEQ ID NO: 653163 - DNA, 22 bp, Artificial Sequence
  chemically synthesized
tatacaaatataacaaggtaca

SEQ ID NO: 653164 - DNA, 22 bp, Artificial Sequence
  chemically synthesized
atacaaatataacaaggtacac

SEQ ID NO: 653165 - DNA, 22 bp, Artificial Sequence
  chemically synthesized
tacaaatataacaaggtacaca

SEQ ID NO: 653166 - DNA, 22 bp, Artificial Sequence
  chemically synthesized
agaattctttgtctgtgtacct

SEQ ID NO: 653167 - DNA, 22 bp, Artificial Sequence
  chemically synthesized
cagatattgagaattctttgtc

SEQ ID NO: 653168 - DNA, 22 bp, Artificial Sequence
  chemically synthesized
gaaattccagatattgagaatt

SEQ ID NO: 653169 - DNA, 22 bp, Artificial Sequence
  chemically synthesized
ctagaaattccagatattgaga

SEQ ID NO: 653170 - DNA, 22 bp, Artificial Sequence
  chemically synthesized
gctagaaattccagatattgag

SEQ ID NO: 653171 - DNA, 22 bp, Artificial Sequence
  chemically synthesized
tcaatatctggaatttctagca

SEQ ID NO: 653172 - DNA, 22 bp, Artificial Sequence
  chemically synthesized
aatatctggaatttctagcaaa

SEQ ID NO: 653173 - DNA, 22 bp, Artificial Sequence
  chemically synthesized
ataggtaaatcggtttgctaga

SEQ ID NO: 653174 - DNA, 22 bp, Artificial Sequence
  chemically synthesized
tattgataggtaaatcggtttg

SEQ ID NO: 653175 - DNA, 22 bp, Artificial Sequence
  chemically synthesized
gaatttctagcaaaccgattta

SEQ ID NO: 653176 - DNA, 22 bp, Artificial Sequence
  chemically synthesized
ttatattgataggtaaatcggt

SEQ ID NO: 653177 - DNA, 22 bp, Artificial Sequence
  chemically synthesized
attatattgataggtaaatcgg

SEQ ID NO: 653178 - DNA, 22 bp, Artificial Sequence
  chemically synthesized
ctagcaaaccgatttacctatc

SEQ ID NO: 653179 - DNA, 22 bp, Artificial Sequence
  chemically synthesized
tagcaaaccgatttacctatca

SEQ ID NO: 653180 - DNA, 22 bp, Artificial Sequence
  chemically synthesized
aacttattatattgataggtaa

SEQ ID NO: 653181 - DNA, 22 bp, Artificial Sequence
  chemically synthesized
aaacttattatattgataggta

SEQ ID NO: 653182 - DNA, 22 bp, Artificial Sequence
  chemically synthesized
gcaaaccgatttacctatcaat

SEQ ID NO: 653183 - DNA, 22 bp, Artificial Sequence
  chemically synthesized
taaacttattatattgataggt

SEQ ID NO: 653184 - DNA, 22 bp, Artificial Sequence
  chemically synthesized
ttaaacttattatattgatagg

SEQ ID NO: 653185 - DNA, 22 bp, Artificial Sequence
  chemically synthesized
acctatcaatataataagttta

SEQ ID NO: 653186 - DNA, 22 bp, Artificial Sequence
  chemically synthesized
cctatcaatataataagtttaa

SEQ ID NO: 653187 - DNA, 22 bp, Artificial Sequence
  chemically synthesized
ccatgtaatgcccttttaaact

SEQ ID NO: 653188 - DNA, 22 bp, Artificial Sequence
  chemically synthesized
tcaatataataagtttaaaagg

SEQ ID NO: 653189 - DNA, 22 bp, Artificial Sequence
  chemically synthesized
gccatgtaatgcccttttaaac

SEQ ID NO: 653190 - DNA, 22 bp, Artificial Sequence
  chemically synthesized
caaacttgccatgtaatgccct

SEQ ID NO: 653191 - DNA, 22 bp, Artificial Sequence
  chemically synthesized
cctccaaacttgccatgtaatg

SEQ ID NO: 653192 - DNA, 22 bp, Artificial Sequence
  chemically synthesized
ctacctccaaacttgccatgta

SEQ ID NO: 653193 - DNA, 22 bp, Artificial Sequence
  chemically synthesized
aaaagggcattacatggcaagt

SEQ ID NO: 653194 - DNA, 22 bp, Artificial Sequence
  chemically synthesized
tcctacctccaaacttgccatg

SEQ ID NO: 653195 - DNA, 22 bp, Artificial Sequence
  chemically synthesized
aaagggcattacatggcaagtt

SEQ ID NO: 653196 - DNA, 22 bp, Artificial Sequence
  chemically synthesized
catggcaagtttggaggtagga

SEQ ID NO: 653197 - DNA, 22 bp, Artificial Sequence
  chemically synthesized
ggaaccccagcaactctcctac

SEQ ID NO: 653198 - DNA, 22 bp, Artificial Sequence
  chemically synthesized
cggaaccccagcaactctccta

SEQ ID NO: 653199 - DNA, 22 bp, Artificial Sequence
  chemically synthesized
ttcggaaccccagcaactctcc

SEQ ID NO: 653200 - DNA, 22 bp, Artificial Sequence
  chemically synthesized
ggaggtaggagagttgctgggg

SEQ ID NO: 653201 - DNA, 22 bp, Artificial Sequence
  chemically synthesized
gaggtaggagagttgctggggt

SEQ ID NO: 653202 - DNA, 22 bp, Artificial Sequence
  chemically synthesized
ctggggttccgaagaacttttg

SEQ ID NO: 653203 - DNA, 22 bp, Artificial Sequence
  chemically synthesized
gggttccgaagaacttttggat

SEQ ID NO: 653204 - DNA, 22 bp, Artificial Sequence
  chemically synthesized
cgaagaacttttggatttcttt

SEQ ID NO: 653205 - DNA, 22 bp, Artificial Sequence
  chemically synthesized
tagaaagcacaacatcaaagaa

SEQ ID NO: 653206 - DNA, 22 bp, Artificial Sequence
  chemically synthesized
atagaaagcacaacatcaaaga

SEQ ID NO: 653207 - DNA, 22 bp, Artificial Sequence
  chemically synthesized
ttggatttctttgatgttgtgc

SEQ ID NO: 653208 - DNA, 22 bp, Artificial Sequence
  chemically synthesized
tggatttctttgatgttgtgct

SEQ ID NO: 653209 - DNA, 22 bp, Artificial Sequence
  chemically synthesized
ggatttctttgatgttgtgctt

SEQ ID NO: 653210 - DNA, 22 bp, Artificial Sequence
  chemically synthesized
gatttctttgatgttgtgcttt

SEQ ID NO: 653211 - DNA, 22 bp, Artificial Sequence
  chemically synthesized
ctttgatgttgtgctttctata

SEQ ID NO: 653212 - DNA, 22 bp, Artificial Sequence
  chemically synthesized
tttgatgttgtgctttctataa

SEQ ID NO: 653213 - DNA, 22 bp, Artificial Sequence
  chemically synthesized
agtgtccaaggatttatagaaa

SEQ ID NO: 653214 - DNA, 22 bp, Artificial Sequence
  chemically synthesized
tgatgttgtgctttctataaat

SEQ ID NO: 653215 - DNA, 22 bp, Artificial Sequence
  chemically synthesized
cagtgtccaaggatttatagaa

SEQ ID NO: 653216 - DNA, 22 bp, Artificial Sequence
  chemically synthesized
gatgttgtgctttctataaatc

SEQ ID NO: 653217 - DNA, 22 bp, Artificial Sequence
  chemically synthesized
atgttgtgctttctataaatcc

SEQ ID NO: 653218 - DNA, 22 bp, Artificial Sequence
  chemically synthesized
gcccttcagtgtccaaggattt

SEQ ID NO: 653219 - DNA, 22 bp, Artificial Sequence
  chemically synthesized
tgctttctataaatccttggac

SEQ ID NO: 653220 - DNA, 22 bp, Artificial Sequence
  chemically synthesized
tctataaatccttggacactga

SEQ ID NO: 653221 - DNA, 22 bp, Artificial Sequence
  chemically synthesized
ctataaatccttggacactgaa

SEQ ID NO: 653222 - DNA, 22 bp, Artificial Sequence
  chemically synthesized
tataaatccttggacactgaag

SEQ ID NO: 653223 - DNA, 22 bp, Artificial Sequence
  chemically synthesized
taaatccttggacactgaaggg

SEQ ID NO: 653224 - DNA, 22 bp, Artificial Sequence
  chemically synthesized
gcaggcggttggcccttcagtg

SEQ ID NO: 653225 - DNA, 22 bp, Artificial Sequence
  chemically synthesized
ctggcaggcggttggcccttca

SEQ ID NO: 653226 - DNA, 22 bp, Artificial Sequence
  chemically synthesized
ggacactgaagggccaaccgcc

SEQ ID NO: 653227 - DNA, 22 bp, Artificial Sequence
  chemically synthesized
gacactgaagggccaaccgcct

SEQ ID NO: 653228 - DNA, 22 bp, Artificial Sequence
  chemically synthesized
aggtggacctcctggcaggcgg

SEQ ID NO: 653229 - DNA, 22 bp, Artificial Sequence
  chemically synthesized
aagggccaaccgcctgccagga

SEQ ID NO: 653230 - DNA, 22 bp, Artificial Sequence
  chemically synthesized
agagaaaaatgagtattcaggt

SEQ ID NO: 653231 - DNA, 22 bp, Artificial Sequence
  chemically synthesized
ccaggaggtccacctgaatact

SEQ ID NO: 653232 - DNA, 22 bp, Artificial Sequence
  chemically synthesized
gagagaaaaatgagtattcagg

SEQ ID NO: 653233 - DNA, 22 bp, Artificial Sequence
  chemically synthesized
ccttgagagaaaaatgagtatt

SEQ ID NO: 653234 - DNA, 22 bp, Artificial Sequence
  chemically synthesized
ttaccttgagagaaaaatgagt

SEQ ID NO: 653235 - DNA, 22 bp, Artificial Sequence
  chemically synthesized
attaccttgagagaaaaatgag

SEQ ID NO: 653236 - DNA, 22 bp, Artificial Sequence
  chemically synthesized
tattaccttgagagaaaaatga

SEQ ID NO: 653237 - DNA, 22 bp, Artificial Sequence
  chemically synthesized
attttattaccttgagagaaaa

SEQ ID NO: 653238 - DNA, 22 bp, Artificial Sequence
  chemically synthesized
aatactcatttttctctcaagg

SEQ ID NO: 653239 - DNA, 22 bp, Artificial Sequence
  chemically synthesized
atttttctctcaaggtaataaa

SEQ ID NO: 653240 - DNA, 22 bp, Artificial Sequence
  chemically synthesized
tagccatgaattgattttatta

SEQ ID NO: 653241 - DNA, 22 bp, Artificial Sequence
  chemically synthesized
ttctctcaaggtaataaaatca

SEQ ID NO: 653242 - DNA, 22 bp, Artificial Sequence
  chemically synthesized
tctctcaaggtaataaaatcaa

SEQ ID NO: 653243 - DNA, 22 bp, Artificial Sequence
  chemically synthesized
tgtagccatgaattgattttat

SEQ ID NO: 653244 - DNA, 22 bp, Artificial Sequence
  chemically synthesized
ctctcaaggtaataaaatcaat

SEQ ID NO: 653245 - DNA, 22 bp, Artificial Sequence
  chemically synthesized
ctgtagccatgaattgatttta

SEQ ID NO: 653246 - DNA, 22 bp, Artificial Sequence
  chemically synthesized
tctcaaggtaataaaatcaatt

SEQ ID NO: 653247 - DNA, 22 bp, Artificial Sequence
  chemically synthesized
ttctgtagccatgaattgattt

SEQ ID NO: 653248 - DNA, 22 bp, Artificial Sequence
  chemically synthesized
tcaaggtaataaaatcaattca

SEQ ID NO: 653249 - DNA, 22 bp, Artificial Sequence
  chemically synthesized
cttctgtagccatgaattgatt

SEQ ID NO: 653250 - DNA, 22 bp, Artificial Sequence
  chemically synthesized
aaggtaataaaatcaattcatg

SEQ ID NO: 653251 - DNA, 22 bp, Artificial Sequence
  chemically synthesized
catttcttctgtagccatgaat

SEQ ID NO: 653252 - DNA, 22 bp, Artificial Sequence
  chemically synthesized
attgcatttcttctgtagccat

SEQ ID NO: 653253 - DNA, 22 bp, Artificial Sequence
  chemically synthesized
aattgcatttcttctgtagcca

SEQ ID NO: 653254 - DNA, 22 bp, Artificial Sequence
  chemically synthesized
agaaatacttaattgcatttct

SEQ ID NO: 653255 - DNA, 22 bp, Artificial Sequence
  chemically synthesized
atggctacagaagaaatgcaat

SEQ ID NO: 653256 - DNA, 22 bp, Artificial Sequence
  chemically synthesized
ctgagaaatacttaattgcatt

SEQ ID NO: 653257 - DNA, 22 bp, Artificial Sequence
  chemically synthesized
gctgagaaatacttaattgcat

SEQ ID NO: 653258 - DNA, 22 bp, Artificial Sequence
  chemically synthesized
cagaagaaatgcaattaagtat

SEQ ID NO: 653259 - DNA, 22 bp, Artificial Sequence
  chemically synthesized
ggatgcagggcttgctgagaaa

SEQ ID NO: 653260 - DNA, 22 bp, Artificial Sequence
  chemically synthesized
agtatttctcagcaagccctgc

SEQ ID NO: 653261 - DNA, 22 bp, Artificial Sequence
  chemically synthesized
atggtagctgggatgcagggct

SEQ ID NO: 653262 - DNA, 22 bp, Artificial Sequence
  chemically synthesized
ctcagcaagccctgcatcccag

SEQ ID NO: 653263 - DNA, 22 bp, Artificial Sequence
  chemically synthesized
tcagcaagccctgcatcccagc

SEQ ID NO: 653264 - DNA, 22 bp, Artificial Sequence
  chemically synthesized
agcaagccctgcatcccagcta

SEQ ID NO: 653265 - DNA, 22 bp, Artificial Sequence
  chemically synthesized
catcccagctaccatgaacacg

SEQ ID NO: 653266 - DNA, 22 bp, Artificial Sequence
  chemically synthesized
aaaaatacaatgtacgtgttca

SEQ ID NO: 653267 - DNA, 22 bp, Artificial Sequence
  chemically synthesized
ctaaaaaatacaatgtacgtgt

SEQ ID NO: 653268 - DNA, 22 bp, Artificial Sequence
  chemically synthesized
tcctaaaaaatacaatgtacgt

SEQ ID NO: 653269 - DNA, 22 bp, Artificial Sequence
  chemically synthesized
ctcctaaaaaatacaatgtacg

SEQ ID NO: 653270 - DNA, 22 bp, Artificial Sequence
  chemically synthesized
ccatgaacacgtacattgtatt

SEQ ID NO: 653271 - DNA, 22 bp, Artificial Sequence
  chemically synthesized
ccttctcctaaaaaatacaatg

SEQ ID NO: 653272 - DNA, 22 bp, Artificial Sequence
  chemically synthesized
aaatgccaattgccttctccta

SEQ ID NO: 653273 - DNA, 22 bp, Artificial Sequence
  chemically synthesized
tattttttaggagaaggcaatt

SEQ ID NO: 653274 - DNA, 22 bp, Artificial Sequence
  chemically synthesized
acaattgaaatgccaattgcct

SEQ ID NO: 653275 - DNA, 22 bp, Artificial Sequence
  chemically synthesized
tttaggagaaggcaattggcat

SEQ ID NO: 653276 - DNA, 22 bp, Artificial Sequence
  chemically synthesized
ttaggagaaggcaattggcatt

SEQ ID NO: 653277 - DNA, 22 bp, Artificial Sequence
  chemically synthesized
taggagaaggcaattggcattt

SEQ ID NO: 653278 - DNA, 22 bp, Artificial Sequence
  chemically synthesized
aggagaaggcaattggcatttc

SEQ ID NO: 653279 - DNA, 22 bp, Artificial Sequence
  chemically synthesized
ggagaaggcaattggcatttca

SEQ ID NO: 653280 - DNA, 22 bp, Artificial Sequence
  chemically synthesized
acaaacctcacaattgaaatgc

SEQ ID NO: 653281 - DNA, 22 bp, Artificial Sequence
  chemically synthesized
cacaaacctcacaattgaaatg

SEQ ID NO: 653282 - DNA, 22 bp, Artificial Sequence
  chemically synthesized
tcacaaacctcacaattgaaat

SEQ ID NO: 653283 - DNA, 22 bp, Artificial Sequence
  chemically synthesized
acatggttttcacaaacctcac

SEQ ID NO: 653284 - DNA, 22 bp, Artificial Sequence
  chemically synthesized
gcatttcaattgtgaggtttgt

SEQ ID NO: 653285 - DNA, 22 bp, Artificial Sequence
  chemically synthesized
caattgtgaggtttgtgaaaac

SEQ ID NO: 653286 - DNA, 22 bp, Artificial Sequence
  chemically synthesized
agtgttcacatggttttcacaa

SEQ ID NO: 653287 - DNA, 22 bp, Artificial Sequence
  chemically synthesized
aattgtgaggtttgtgaaaacc

SEQ ID NO: 653288 - DNA, 22 bp, Artificial Sequence
  chemically synthesized
ttaagtgttcacatggttttca

SEQ ID NO: 653289 - DNA, 22 bp, Artificial Sequence
  chemically synthesized
attaagtgttcacatggttttc

SEQ ID NO: 653290 - DNA, 22 bp, Artificial Sequence
  chemically synthesized
tgaggtttgtgaaaaccatgtg

SEQ ID NO: 653291 - DNA, 22 bp, Artificial Sequence
  chemically synthesized
tagtttattaagtgttcacatg

SEQ ID NO: 653292 - DNA, 22 bp, Artificial Sequence
  chemically synthesized
ttgtagtttattaagtgttcac

SEQ ID NO: 653293 - DNA, 22 bp, Artificial Sequence
  chemically synthesized
gtgaaaaccatgtgaacactta

SEQ ID NO: 653294 - DNA, 22 bp, Artificial Sequence
  chemically synthesized
tgaaaaccatgtgaacacttaa

SEQ ID NO: 653295 - DNA, 22 bp, Artificial Sequence
  chemically synthesized
attattgtagtttattaagtgt

SEQ ID NO: 653296 - DNA, 22 bp, Artificial Sequence
  chemically synthesized
tactaattattgtagtttatta

SEQ ID NO: 653297 - DNA, 22 bp, Artificial Sequence
  chemically synthesized
agggatgactgtactaattatt

SEQ ID NO: 653298 - DNA, 22 bp, Artificial Sequence
  chemically synthesized
aataaactacaataattagtac

SEQ ID NO: 653299 - DNA, 22 bp, Artificial Sequence
  chemically synthesized
ataaactacaataattagtaca

SEQ ID NO: 653300 - DNA, 22 bp, Artificial Sequence
  chemically synthesized
gcatatactgagggatgactgt

SEQ ID NO: 653301 - DNA, 22 bp, Artificial Sequence
  chemically synthesized
caataattagtacagtcatccc

SEQ ID NO: 653302 - DNA, 22 bp, Artificial Sequence
  chemically synthesized
gtacagtcatccctcagtatat

SEQ ID NO: 653303 - DNA, 22 bp, Artificial Sequence
  chemically synthesized
cggcgggccaggaagcaacccc

SEQ ID NO: 653304 - DNA, 22 bp, Artificial Sequence
  chemically synthesized
agtatatgctaggggttgcttc

SEQ ID NO: 653305 - DNA, 22 bp, Artificial Sequence
  chemically synthesized
ggggttgcttcctggcccgccg

SEQ ID NO: 653306 - DNA, 22 bp, Artificial Sequence
  chemically synthesized
cttcctggcccgccgcagcccc

SEQ ID NO: 653307 - DNA, 22 bp, Artificial Sequence
  chemically synthesized
cctggcccgccgcagccccact

SEQ ID NO: 653308 - DNA, 22 bp, Artificial Sequence
  chemically synthesized
ctggcccgccgcagccccactc

SEQ ID NO: 653309 - DNA, 22 bp, Artificial Sequence
  chemically synthesized
gcccgccgcagccccactccca

SEQ ID NO: 653310 - DNA, 22 bp, Artificial Sequence
  chemically synthesized
aacagcaaaatccccgtgggag

SEQ ID NO: 653311 - DNA, 22 bp, Artificial Sequence
  chemically synthesized
tatctcaacagcaaaatccccg

SEQ ID NO: 653312 - DNA, 22 bp, Artificial Sequence
  chemically synthesized
ctgtatctcaacagcaaaatcc

SEQ ID NO: 653313 - DNA, 22 bp, Artificial Sequence
  chemically synthesized
gctgtatctcaacagcaaaatc

SEQ ID NO: 653314 - DNA, 22 bp, Artificial Sequence
  chemically synthesized
tgctgtatctcaacagcaaaat

SEQ ID NO: 653315 - DNA, 22 bp, Artificial Sequence
  chemically synthesized
ccacggggattttgctgttgag

SEQ ID NO: 653316 - DNA, 22 bp, Artificial Sequence
  chemically synthesized
cgtatgcgtggattttgctgta

SEQ ID NO: 653317 - DNA, 22 bp, Artificial Sequence
  chemically synthesized
tgctgttgagatacagcaaaat

SEQ ID NO: 653318 - DNA, 22 bp, Artificial Sequence
  chemically synthesized
gcgtatgcgtggattttgctgt

SEQ ID NO: 653319 - DNA, 22 bp, Artificial Sequence
  chemically synthesized
gctgttgagatacagcaaaatc

SEQ ID NO: 653320 - DNA, 22 bp, Artificial Sequence
  chemically synthesized
ctgttgagatacagcaaaatcc

SEQ ID NO: 653321 - DNA, 22 bp, Artificial Sequence
  chemically synthesized
ttgagatacagcaaaatccacg

SEQ ID NO: 653322 - DNA, 22 bp, Artificial Sequence
  chemically synthesized
agatacagcaaaatccacgcat

SEQ ID NO: 653323 - DNA, 22 bp, Artificial Sequence
  chemically synthesized
tgggacttgcgtatgcgtggat

SEQ ID NO: 653324 - DNA, 22 bp, Artificial Sequence
  chemically synthesized
ctgtgggacttgcgtatgcgtg

SEQ ID NO: 653325 - DNA, 22 bp, Artificial Sequence
  chemically synthesized
ggcctactgtgggacttgcgta

SEQ ID NO: 653326 - DNA, 22 bp, Artificial Sequence
  chemically synthesized
agctgggcctactgtgggactt

SEQ ID NO: 653327 - DNA, 22 bp, Artificial Sequence
  chemically synthesized
cggatatgcgttcagctgggcc

SEQ ID NO: 653328 - DNA, 22 bp, Artificial Sequence
  chemically synthesized
aagagatgtgaaacctgcggat

SEQ ID NO: 653329 - DNA, 22 bp, Artificial Sequence
  chemically synthesized
aacgcatatccgcaggtttcac

SEQ ID NO: 653330 - DNA, 22 bp, Artificial Sequence
  chemically synthesized
cacatctcttgagtactgcatt

SEQ ID NO: 653331 - DNA, 22 bp, Artificial Sequence
  chemically synthesized
acatctcttgagtactgcattt

SEQ ID NO: 653332 - DNA, 22 bp, Artificial Sequence
  chemically synthesized
aaccaaatgcgtatcgaaaatg

SEQ ID NO: 653333 - DNA, 22 bp, Artificial Sequence
  chemically synthesized
caaccaaatgcgtatcgaaaat

SEQ ID NO: 653334 - DNA, 22 bp, Artificial Sequence
  chemically synthesized
ttgagtactgcattttcgatac

SEQ ID NO: 653335 - DNA, 22 bp, Artificial Sequence
  chemically synthesized
tcaaccaaatgcgtatcgaaaa

SEQ ID NO: 653336 - DNA, 22 bp, Artificial Sequence
  chemically synthesized
gagtactgcattttcgatacgc

SEQ ID NO: 653337 - DNA, 22 bp, Artificial Sequence
  chemically synthesized
agtactgcattttcgatacgca

SEQ ID NO: 653338 - DNA, 22 bp, Artificial Sequence
  chemically synthesized
cattttcgatacgcatttggtt

SEQ ID NO: 653339 - DNA, 22 bp, Artificial Sequence
  chemically synthesized
taagtggatcgttttcaaccaa

SEQ ID NO: 653340 - DNA, 22 bp, Artificial Sequence
  chemically synthesized
tcgatacgcatttggttgaaaa

SEQ ID NO: 653341 - DNA, 22 bp, Artificial Sequence
  chemically synthesized
ataagtggatcgttttcaacca

SEQ ID NO: 653342 - DNA, 22 bp, Artificial Sequence
  chemically synthesized
cgatacgcatttggttgaaaac

SEQ ID NO: 653343 - DNA, 22 bp, Artificial Sequence
  chemically synthesized
gatacgcatttggttgaaaacg

SEQ ID NO: 653344 - DNA, 22 bp, Artificial Sequence
  chemically synthesized
ggttgaaaacgatccacttata

SEQ ID NO: 653345 - DNA, 22 bp, Artificial Sequence
  chemically synthesized
tgtgggtccacttataagtgga

SEQ ID NO: 653346 - DNA, 22 bp, Artificial Sequence
  chemically synthesized
gttgaaaacgatccacttataa

SEQ ID NO: 653347 - DNA, 22 bp, Artificial Sequence
  chemically synthesized
aaaacgatccacttataagtgg

SEQ ID NO: 653348 - DNA, 22 bp, Artificial Sequence
  chemically synthesized
aactgtgtgggtccacttataa

SEQ ID NO: 653349 - DNA, 22 bp, Artificial Sequence
  chemically synthesized
gaactgtgtgggtccacttata

SEQ ID NO: 653350 - DNA, 22 bp, Artificial Sequence
  chemically synthesized
ataagtggacccacacagttca

SEQ ID NO: 653351 - DNA, 22 bp, Artificial Sequence
  chemically synthesized
taagtggacccacacagttcaa

SEQ ID NO: 653352 - DNA, 22 bp, Artificial Sequence
  chemically synthesized
aaaaacatagatttgaactgtg

SEQ ID NO: 653353 - DNA, 22 bp, Artificial Sequence
  chemically synthesized
gaaaaacatagatttgaactgt

SEQ ID NO: 653354 - DNA, 22 bp, Artificial Sequence
  chemically synthesized
acccttgaaaaacatagatttg

SEQ ID NO: 653355 - DNA, 22 bp, Artificial Sequence
  chemically synthesized
tatagagttgacccttgaaaaa

SEQ ID NO: 653356 - DNA, 22 bp, Artificial Sequence
  chemically synthesized
tatatagagttgacccttgaaa

SEQ ID NO: 653357 - DNA, 22 bp, Artificial Sequence
  chemically synthesized
aaatctatgtttttcaagggtc

SEQ ID NO: 653358 - DNA, 22 bp, Artificial Sequence
  chemically synthesized
tctatatagagttgacccttga

SEQ ID NO: 653359 - DNA, 22 bp, Artificial Sequence
  chemically synthesized
ctctatatagagttgacccttg

SEQ ID NO: 653360 - DNA, 22 bp, Artificial Sequence
  chemically synthesized
cttctctatatagagttgaccc

SEQ ID NO: 653361 - DNA, 22 bp, Artificial Sequence
  chemically synthesized
acttctctatatagagttgacc

SEQ ID NO: 653362 - DNA, 22 bp, Artificial Sequence
  chemically synthesized
tgtttttcaagggtcaactcta

SEQ ID NO: 653363 - DNA, 22 bp, Artificial Sequence
  chemically synthesized
ttcaagggtcaactctatatag

SEQ ID NO: 653364 - DNA, 22 bp, Artificial Sequence
  chemically synthesized
tcaagggtcaactctatataga

SEQ ID NO: 653365 - DNA, 22 bp, Artificial Sequence
  chemically synthesized
caagggtcaactctatatagag

SEQ ID NO: 653366 - DNA, 22 bp, Artificial Sequence
  chemically synthesized
aagggtcaactctatatagaga

SEQ ID NO: 653367 - DNA, 22 bp, Artificial Sequence
  chemically synthesized
cccaatgtttacttctctatat

SEQ ID NO: 653368 - DNA, 22 bp, Artificial Sequence
  chemically synthesized
gcccaatgtttacttctctata

SEQ ID NO: 653369 - DNA, 22 bp, Artificial Sequence
  chemically synthesized
ttgcccaatgtttacttctcta

SEQ ID NO: 653370 - DNA, 22 bp, Artificial Sequence
  chemically synthesized
tatatagagaagtaaacattgg

SEQ ID NO: 653371 - DNA, 22 bp, Artificial Sequence
  chemically synthesized
tatagagaagtaaacattgggc

SEQ ID NO: 653372 - DNA, 22 bp, Artificial Sequence
  chemically synthesized
ggcacagtctcttgcccaatgt

SEQ ID NO: 653373 - DNA, 22 bp, Artificial Sequence
  chemically synthesized
ctgggcacagtctcttgcccaa

SEQ ID NO: 653374 - DNA, 22 bp, Artificial Sequence
  chemically synthesized
agaattactgggcacagtctct

SEQ ID NO: 653375 - DNA, 22 bp, Artificial Sequence
  chemically synthesized
tctgagaattactgggcacagt

SEQ ID NO: 653376 - DNA, 22 bp, Artificial Sequence
  chemically synthesized
ttatctgagaattactgggcac

SEQ ID NO: 653377 - DNA, 22 bp, Artificial Sequence
  chemically synthesized
ggcaagagactgtgcccagtaa

SEQ ID NO: 653378 - DNA, 22 bp, Artificial Sequence
  chemically synthesized
gttatctgagaattactgggca

SEQ ID NO: 653379 - DNA, 22 bp, Artificial Sequence
  chemically synthesized
ttgttatctgagaattactggg

SEQ ID NO: 653380 - DNA, 22 bp, Artificial Sequence
  chemically synthesized
cttgttatctgagaattactgg

SEQ ID NO: 653381 - DNA, 22 bp, Artificial Sequence
  chemically synthesized
tgcccagtaattctcagataac

SEQ ID NO: 653382 - DNA, 22 bp, Artificial Sequence
  chemically synthesized
caggatggtggtttcttgttat

SEQ ID NO: 653383 - DNA, 22 bp, Artificial Sequence
  chemically synthesized
ccaggatggtggtttcttgtta

SEQ ID NO: 653384 - DNA, 22 bp, Artificial Sequence
  chemically synthesized
tttccaggatggtggtttcttg

SEQ ID NO: 653385 - DNA, 22 bp, Artificial Sequence
  chemically synthesized
tcagataacaagaaaccaccat

SEQ ID NO: 653386 - DNA, 22 bp, Artificial Sequence
  chemically synthesized
tattgtttccaggatggtggtt

SEQ ID NO: 653387 - DNA, 22 bp, Artificial Sequence
  chemically synthesized
agataacaagaaaccaccatcc

SEQ ID NO: 653388 - DNA, 22 bp, Artificial Sequence
  chemically synthesized
tgtattgtttccaggatggtgg

SEQ ID NO: 653389 - DNA, 22 bp, Artificial Sequence
  chemically synthesized
aggaggtatcgttctgtattgt

SEQ ID NO: 653390 - DNA, 22 bp, Artificial Sequence
  chemically synthesized
gaaacaatacagaacgatacct

SEQ ID NO: 653391 - DNA, 22 bp, Artificial Sequence
  chemically synthesized
ggaaagaaattaaggaggtatc

SEQ ID NO: 653392 - DNA, 22 bp, Artificial Sequence
  chemically synthesized
aggaaagaaattaaggaggtat

SEQ ID NO: 653393 - DNA, 22 bp, Artificial Sequence
  chemically synthesized
caatttaggaaagaaattaagg

SEQ ID NO: 653394 - DNA, 22 bp, Artificial Sequence
  chemically synthesized
atctgcaatttaggaaagaaat

SEQ ID NO: 653395 - DNA, 22 bp, Artificial Sequence
  chemically synthesized
attaatctgcaatttaggaaag

SEQ ID NO: 653396 - DNA, 22 bp, Artificial Sequence
  chemically synthesized
aattaatctgcaatttaggaaa

SEQ ID NO: 653397 - DNA, 22 bp, Artificial Sequence
  chemically synthesized
taattaatctgcaatttaggaa

SEQ ID NO: 653398 - DNA, 22 bp, Artificial Sequence
  chemically synthesized
cttaatttctttcctaaattgc

SEQ ID NO: 653399 - DNA, 22 bp, Artificial Sequence
  chemically synthesized
tctttaattaatctgcaattta

SEQ ID NO: 653400 - DNA, 22 bp, Artificial Sequence
  chemically synthesized
aatttctttcctaaattgcaga

SEQ ID NO: 653401 - DNA, 22 bp, Artificial Sequence
  chemically synthesized
atttctttcctaaattgcagat

SEQ ID NO: 653402 - DNA, 22 bp, Artificial Sequence
  chemically synthesized
ctgtctttaattaatctgcaat

SEQ ID NO: 653403 - DNA, 22 bp, Artificial Sequence
  chemically synthesized
ctttcctaaattgcagattaat

SEQ ID NO: 653404 - DNA, 22 bp, Artificial Sequence
  chemically synthesized
tttcctaaattgcagattaatt

SEQ ID NO: 653405 - DNA, 22 bp, Artificial Sequence
  chemically synthesized
tcctaaattgcagattaattaa

SEQ ID NO: 653406 - DNA, 22 bp, Artificial Sequence
  chemically synthesized
cctaaattgcagattaattaaa

SEQ ID NO: 653407 - DNA, 22 bp, Artificial Sequence
  chemically synthesized
ctaaattgcagattaattaaag

SEQ ID NO: 653408 - DNA, 22 bp, Artificial Sequence
  chemically synthesized
aattgcagattaattaaagaca

SEQ ID NO: 653409 - DNA, 22 bp, Artificial Sequence
  chemically synthesized
cagaagtatagttcctgtcttt

SEQ ID NO: 653410 - DNA, 22 bp, Artificial Sequence
  chemically synthesized
cagattaattaaagacaggaac

SEQ ID NO: 653411 - DNA, 22 bp, Artificial Sequence
  chemically synthesized
attaaagacaggaactatactt

SEQ ID NO: 653412 - DNA, 22 bp, Artificial Sequence
  chemically synthesized
acagagactccagaagtatagt

SEQ ID NO: 653413 - DNA, 22 bp, Artificial Sequence
  chemically synthesized
aacagagactccagaagtatag

SEQ ID NO: 653414 - DNA, 22 bp, Artificial Sequence
  chemically synthesized
taacagagactccagaagtata

SEQ ID NO: 653415 - DNA, 22 bp, Artificial Sequence
  chemically synthesized
aagacaggaactatacttctgg

SEQ ID NO: 653416 - DNA, 22 bp, Artificial Sequence
  chemically synthesized
agcagattttaacagagactcc

SEQ ID NO: 653417 - DNA, 22 bp, Artificial Sequence
  chemically synthesized
tacttctggagtctctgttaaa

SEQ ID NO: 653418 - DNA, 22 bp, Artificial Sequence
  chemically synthesized
aattcagcagattttaacagag

SEQ ID NO: 653419 - DNA, 22 bp, Artificial Sequence
  chemically synthesized
ttcaattcagcagattttaaca

SEQ ID NO: 653420 - DNA, 22 bp, Artificial Sequence
  chemically synthesized
ctggagtctctgttaaaatctg

SEQ ID NO: 653421 - DNA, 22 bp, Artificial Sequence
  chemically synthesized
tggagtctctgttaaaatctgc

SEQ ID NO: 653422 - DNA, 22 bp, Artificial Sequence
  chemically synthesized
gagtctctgttaaaatctgctg

SEQ ID NO: 653423 - DNA, 22 bp, Artificial Sequence
  chemically synthesized
ccacccactgttcaattcagca

SEQ ID NO: 653424 - DNA, 22 bp, Artificial Sequence
  chemically synthesized
tgttaaaatctgctgaattgaa

SEQ ID NO: 653425 - DNA, 22 bp, Artificial Sequence
  chemically synthesized
ttaaaatctgctgaattgaaca

SEQ ID NO: 653426 - DNA, 22 bp, Artificial Sequence
  chemically synthesized
aattcccacccactgttcaatt

SEQ ID NO: 653427 - DNA, 22 bp, Artificial Sequence
  chemically synthesized
aaatctgctgaattgaacagtg

SEQ ID NO: 653428 - DNA, 22 bp, Artificial Sequence
  chemically synthesized
cagttgaattcccacccactgt

SEQ ID NO: 653429 - DNA, 22 bp, Artificial Sequence
  chemically synthesized
ctgaattgaacagtgggtggga

SEQ ID NO: 653430 - DNA, 22 bp, Artificial Sequence
  chemically synthesized
aattgaacagtgggtgggaatt

SEQ ID NO: 653431 - DNA, 22 bp, Artificial Sequence
  chemically synthesized
aacagtgggtgggaattcaact

SEQ ID NO: 653432 - DNA, 22 bp, Artificial Sequence
  chemically synthesized
cgatcatattgcagttgaattc

SEQ ID NO: 653433 - DNA, 22 bp, Artificial Sequence
  chemically synthesized
gcgatcatattgcagttgaatt

SEQ ID NO: 653434 - DNA, 22 bp, Artificial Sequence
  chemically synthesized
ttgcgatcatattgcagttgaa

SEQ ID NO: 653435 - DNA, 22 bp, Artificial Sequence
  chemically synthesized
cttgcgatcatattgcagttga

SEQ ID NO: 653436 - DNA, 22 bp, Artificial Sequence
  chemically synthesized
tttcttgcgatcatattgcagt

SEQ ID NO: 653437 - DNA, 22 bp, Artificial Sequence
  chemically synthesized
atttcttgcgatcatattgcag

SEQ ID NO: 653438 - DNA, 22 bp, Artificial Sequence
  chemically synthesized
tatttcttgcgatcatattgca

SEQ ID NO: 653439 - DNA, 22 bp, Artificial Sequence
  chemically synthesized
ttatttcttgcgatcatattgc

SEQ ID NO: 653440 - DNA, 22 bp, Artificial Sequence
  chemically synthesized
cttttatttcttgcgatcatat

SEQ ID NO: 653441 - DNA, 22 bp, Artificial Sequence
  chemically synthesized
ccttttatttcttgcgatcata

SEQ ID NO: 653442 - DNA, 22 bp, Artificial Sequence
  chemically synthesized
aactgcaatatgatcgcaagaa

SEQ ID NO: 653443 - DNA, 22 bp, Artificial Sequence
  chemically synthesized
taatcttccttttatttcttgc

SEQ ID NO: 653444 - DNA, 22 bp, Artificial Sequence
  chemically synthesized
ataatcttccttttatttcttg

SEQ ID NO: 653445 - DNA, 22 bp, Artificial Sequence
  chemically synthesized
caatatgatcgcaagaaataaa

SEQ ID NO: 653446 - DNA, 22 bp, Artificial Sequence
  chemically synthesized
tataatcttccttttatttctt

SEQ ID NO: 653447 - DNA, 22 bp, Artificial Sequence
  chemically synthesized
atacagattttataatcttcct

SEQ ID NO: 653448 - DNA, 22 bp, Artificial Sequence
  chemically synthesized
catacagattttataatcttcc

SEQ ID NO: 653449 - DNA, 22 bp, Artificial Sequence
  chemically synthesized
acttcatacagattttataatc

SEQ ID NO: 653450 - DNA, 22 bp, Artificial Sequence
  chemically synthesized
tgacttcatacagattttataa

SEQ ID NO: 653451 - DNA, 22 bp, Artificial Sequence
  chemically synthesized
aaattctgacttcatacagatt

SEQ ID NO: 653452 - DNA, 22 bp, Artificial Sequence
  chemically synthesized
aaaattctgacttcatacagat

SEQ ID NO: 653453 - DNA, 22 bp, Artificial Sequence
  chemically synthesized
taaaattctgacttcatacaga

SEQ ID NO: 653454 - DNA, 22 bp, Artificial Sequence
  chemically synthesized
ttaaaattctgacttcatacag

SEQ ID NO: 653455 - DNA, 22 bp, Artificial Sequence
  chemically synthesized
tttaaaattctgacttcataca

SEQ ID NO: 653456 - DNA, 22 bp, Artificial Sequence
  chemically synthesized
taaaatctgtatgaagtcagaa

SEQ ID NO: 653457 - DNA, 22 bp, Artificial Sequence
  chemically synthesized
ggcagctttttaaaattctgac

SEQ ID NO: 653458 - DNA, 22 bp, Artificial Sequence
  chemically synthesized
tatgaagtcagaattttaaaaa

SEQ ID NO: 653459 - DNA, 22 bp, Artificial Sequence
  chemically synthesized
aggatgactaggcagcttttta

SEQ ID NO: 653460 - DNA, 22 bp, Artificial Sequence
  chemically synthesized
caggatgactaggcagcttttt

SEQ ID NO: 653461 - DNA, 22 bp, Artificial Sequence
  chemically synthesized
ttcaggatgactaggcagcttt

SEQ ID NO: 653462 - DNA, 22 bp, Artificial Sequence
  chemically synthesized
ctcttcaggatgactaggcagc

SEQ ID NO: 653463 - DNA, 22 bp, Artificial Sequence
  chemically synthesized
gctcttcaggatgactaggcag

SEQ ID NO: 653464 - DNA, 22 bp, Artificial Sequence
  chemically synthesized
tgctcttcaggatgactaggca

SEQ ID NO: 653465 - DNA, 22 bp, Artificial Sequence
  chemically synthesized
ttgctcttcaggatgactaggc

SEQ ID NO: 653466 - DNA, 22 bp, Artificial Sequence
  chemically synthesized
taaaaagctgcctagtcatcct

SEQ ID NO: 653467 - DNA, 22 bp, Artificial Sequence
  chemically synthesized
aaaaagctgcctagtcatcctg

SEQ ID NO: 653468 - DNA, 22 bp, Artificial Sequence
  chemically synthesized
aaaagctgcctagtcatcctga

SEQ ID NO: 653469 - DNA, 22 bp, Artificial Sequence
  chemically synthesized
cctagtcatcctgaagagcaaa

SEQ ID NO: 653470 - DNA, 22 bp, Artificial Sequence
  chemically synthesized
caagtgtatgtttttgctcttc

SEQ ID NO: 653471 - DNA, 22 bp, Artificial Sequence
  chemically synthesized
acaagtgtatgtttttgctctt

SEQ ID NO: 653472 - DNA, 22 bp, Artificial Sequence
  chemically synthesized
tacaagtgtatgtttttgctct

SEQ ID NO: 653473 - DNA, 22 bp, Artificial Sequence
  chemically synthesized
gtcatcctgaagagcaaaaaca

SEQ ID NO: 653474 - DNA, 22 bp, Artificial Sequence
  chemically synthesized
taaaatctttacaagtgtatgt

SEQ ID NO: 653475 - DNA, 22 bp, Artificial Sequence
  chemically synthesized
ataaaatctttacaagtgtatg

SEQ ID NO: 653476 - DNA, 22 bp, Artificial Sequence
  chemically synthesized
aagagcaaaaacatacacttgt

SEQ ID NO: 653477 - DNA, 22 bp, Artificial Sequence
  chemically synthesized
tataaaatctttacaagtgtat

SEQ ID NO: 653478 - DNA, 22 bp, Artificial Sequence
  chemically synthesized
tttataaaatctttacaagtgt

SEQ ID NO: 653479 - DNA, 22 bp, Artificial Sequence
  chemically synthesized
ctctttataaaatctttacaag

SEQ ID NO: 653480 - DNA, 22 bp, Artificial Sequence
  chemically synthesized
tgctctttataaaatctttaca

SEQ ID NO: 653481 - DNA, 22 bp, Artificial Sequence
  chemically synthesized
ctgctctttataaaatctttac

SEQ ID NO: 653482 - DNA, 22 bp, Artificial Sequence
  chemically synthesized
tcttctgctctttataaaatct

SEQ ID NO: 653483 - DNA, 22 bp, Artificial Sequence
  chemically synthesized
gtcttctgctctttataaaatc

SEQ ID NO: 653484 - DNA, 22 bp, Artificial Sequence
  chemically synthesized
tgtcttctgctctttataaaat

SEQ ID NO: 653485 - DNA, 22 bp, Artificial Sequence
  chemically synthesized
ttttgtcttctgctctttataa

SEQ ID NO: 653486 - DNA, 22 bp, Artificial Sequence
  chemically synthesized
attttgtcttctgctctttata

SEQ ID NO: 653487 - DNA, 22 bp, Artificial Sequence
  chemically synthesized
gtaaagattttataaagagcag

SEQ ID NO: 653488 - DNA, 22 bp, Artificial Sequence
  chemically synthesized
taaagattttataaagagcaga

SEQ ID NO: 653489 - DNA, 22 bp, Artificial Sequence
  chemically synthesized
tataaagagcagaagacaaaat

SEQ ID NO: 653490 - DNA, 22 bp, Artificial Sequence
  chemically synthesized
agaaagtaacttattttgtctt

SEQ ID NO: 653491 - DNA, 22 bp, Artificial Sequence
  chemically synthesized
ataaagagcagaagacaaaata

SEQ ID NO: 653492 - DNA, 22 bp, Artificial Sequence
  chemically synthesized
gagaaagtaacttattttgtct

SEQ ID NO: 653493 - DNA, 22 bp, Artificial Sequence
  chemically synthesized
taaagagcagaagacaaaataa

SEQ ID NO: 653494 - DNA, 22 bp, Artificial Sequence
  chemically synthesized
gacagtttgagaaagtaactta

SEQ ID NO: 653495 - DNA, 22 bp, Artificial Sequence
  chemically synthesized
ggacagtttgagaaagtaactt

SEQ ID NO: 653496 - DNA, 22 bp, Artificial Sequence
  chemically synthesized
tggacagtttgagaaagtaact

SEQ ID NO: 653497 - DNA, 22 bp, Artificial Sequence
  chemically synthesized
ctttctcaaactgtccaaaatt

SEQ ID NO: 653498 - DNA, 22 bp, Artificial Sequence
  chemically synthesized
taatcgataaaggaaattttgg

SEQ ID NO: 653499 - DNA, 22 bp, Artificial Sequence
  chemically synthesized
tctcaaactgtccaaaatttcc

SEQ ID NO: 653500 - DNA, 22 bp, Artificial Sequence
  chemically synthesized
ctcaaactgtccaaaatttcct

SEQ ID NO: 653501 - DNA, 22 bp, Artificial Sequence
  chemically synthesized
tcaaactgtccaaaatttcctt

SEQ ID NO: 653502 - DNA, 22 bp, Artificial Sequence
  chemically synthesized
ctgtaatcgataaaggaaattt

SEQ ID NO: 653503 - DNA, 22 bp, Artificial Sequence
  chemically synthesized
actgtaatcgataaaggaaatt

SEQ ID NO: 653504 - DNA, 22 bp, Artificial Sequence
  chemically synthesized
aaactgtccaaaatttccttta

SEQ ID NO: 653505 - DNA, 22 bp, Artificial Sequence
  chemically synthesized
tccaaaatttcctttatcgatt

SEQ ID NO: 653506 - DNA, 22 bp, Artificial Sequence
  chemically synthesized
cctttatcgattacagtaaatg

SEQ ID NO: 653507 - DNA, 22 bp, Artificial Sequence
  chemically synthesized
ctttatcgattacagtaaatgt

SEQ ID NO: 653508 - DNA, 22 bp, Artificial Sequence
  chemically synthesized
tatcgattacagtaaatgtcct

SEQ ID NO: 653509 - DNA, 22 bp, Artificial Sequence
  chemically synthesized
atcgattacagtaaatgtcctt

SEQ ID NO: 653510 - DNA, 22 bp, Artificial Sequence
  chemically synthesized
tcgattacagtaaatgtccttg

SEQ ID NO: 653511 - DNA, 22 bp, Artificial Sequence
  chemically synthesized
cagtaaatgtccttgtgttggt

SEQ ID NO: 653512 - DNA, 22 bp, Artificial Sequence
  chemically synthesized
tgtgtgataccatcacatagaa

SEQ ID NO: 653513 - DNA, 22 bp, Artificial Sequence
  chemically synthesized
atgtgtgataccatcacataga

SEQ ID NO: 653514 - DNA, 22 bp, Artificial Sequence
  chemically synthesized
tatgtgtgataccatcacatag

SEQ ID NO: 653515 - DNA, 22 bp, Artificial Sequence
  chemically synthesized
ttatgtgtgataccatcacata

SEQ ID NO: 653516 - DNA, 22 bp, Artificial Sequence
  chemically synthesized
gtgttggtttctatgtgatggt

SEQ ID NO: 653517 - DNA, 22 bp, Artificial Sequence
  chemically synthesized
tgttggtttctatgtgatggta

SEQ ID NO: 653518 - DNA, 22 bp, Artificial Sequence
  chemically synthesized
gccttttatgtgtgataccatc

SEQ ID NO: 653519 - DNA, 22 bp, Artificial Sequence
  chemically synthesized
gtttctatgtgatggtatcaca

SEQ ID NO: 653520 - DNA, 22 bp, Artificial Sequence
  chemically synthesized
ttagccttttatgtgtgatacc

SEQ ID NO: 653521 - DNA, 22 bp, Artificial Sequence
  chemically synthesized
ctatgtgatggtatcacacata

SEQ ID NO: 653522 - DNA, 22 bp, Artificial Sequence
  chemically synthesized
tatgtgatggtatcacacataa

SEQ ID NO: 653523 - DNA, 22 bp, Artificial Sequence
  chemically synthesized
tgtgatggtatcacacataaaa

SEQ ID NO: 653524 - DNA, 22 bp, Artificial Sequence
  chemically synthesized
agtccagatgaagtctgttagc

SEQ ID NO: 653525 - DNA, 22 bp, Artificial Sequence
  chemically synthesized
taagtccagatgaagtctgtta

SEQ ID NO: 653526 - DNA, 22 bp, Artificial Sequence
  chemically synthesized
ctaagtccagatgaagtctgtt

SEQ ID NO: 653527 - DNA, 22 bp, Artificial Sequence
  chemically synthesized
tacataccttctaagtccagat

SEQ ID NO: 653528 - DNA, 22 bp, Artificial Sequence
  chemically synthesized
tgtacataccttctaagtccag

SEQ ID NO: 653529 - DNA, 22 bp, Artificial Sequence
  chemically synthesized
acagacttcatctggacttaga

SEQ ID NO: 653530 - DNA, 22 bp, Artificial Sequence
  chemically synthesized
catctggacttagaaggtatgt

SEQ ID NO: 653531 - DNA, 22 bp, Artificial Sequence
  chemically synthesized
atctggacttagaaggtatgta

SEQ ID NO: 653532 - DNA, 22 bp, Artificial Sequence
  chemically synthesized
agccagatcattctgtacatac

SEQ ID NO: 653533 - DNA, 22 bp, Artificial Sequence
  chemically synthesized
aagccagatcattctgtacata

SEQ ID NO: 653534 - DNA, 22 bp, Artificial Sequence
  chemically synthesized
gacttagaaggtatgtacagaa

SEQ ID NO: 653535 - DNA, 22 bp, Artificial Sequence
  chemically synthesized
taagccagatcattctgtacat

SEQ ID NO: 653536 - DNA, 22 bp, Artificial Sequence
  chemically synthesized
agaaggtatgtacagaatgatc

SEQ ID NO: 653537 - DNA, 22 bp, Artificial Sequence
  chemically synthesized
tattttaagccagatcattctg

SEQ ID NO: 653538 - DNA, 22 bp, Artificial Sequence
  chemically synthesized
gaaggtatgtacagaatgatct

SEQ ID NO: 653539 - DNA, 22 bp, Artificial Sequence
  chemically synthesized
tgtatacctatattttaagcca

SEQ ID NO: 653540 - DNA, 22 bp, Artificial Sequence
  chemically synthesized
gtgtatacctatattttaagcc

SEQ ID NO: 653541 - DNA, 22 bp, Artificial Sequence
  chemically synthesized
tgtgtatacctatattttaagc

SEQ ID NO: 653542 - DNA, 22 bp, Artificial Sequence
  chemically synthesized
gcttaaaatataggtatacaca

SEQ ID NO: 653543 - DNA, 22 bp, Artificial Sequence
  chemically synthesized
aaaatataggtatacacaaaat

SEQ ID NO: 653544 - DNA, 22 bp, Artificial Sequence
  chemically synthesized
aaatataggtatacacaaaatt

SEQ ID NO: 653545 - DNA, 22 bp, Artificial Sequence
  chemically synthesized
aagggccccaagtgtgaatttt

SEQ ID NO: 653546 - DNA, 22 bp, Artificial Sequence
  chemically synthesized
caagggccccaagtgtgaattt

SEQ ID NO: 653547 - DNA, 22 bp, Artificial Sequence
  chemically synthesized
tcaagggccccaagtgtgaatt

SEQ ID NO: 653548 - DNA, 22 bp, Artificial Sequence
  chemically synthesized
ctttcaagggccccaagtgtga

SEQ ID NO: 653549 - DNA, 22 bp, Artificial Sequence
  chemically synthesized
tgcagttcctttcaagggcccc

SEQ ID NO: 653550 - DNA, 22 bp, Artificial Sequence
  chemically synthesized
cctgtgcagttcctttcaaggg

SEQ ID NO: 653551 - DNA, 22 bp, Artificial Sequence
  chemically synthesized
acacttggggcccttgaaagga

SEQ ID NO: 653552 - DNA, 22 bp, Artificial Sequence
  chemically synthesized
tctgcctgtgcagttcctttca

SEQ ID NO: 653553 - DNA, 22 bp, Artificial Sequence
  chemically synthesized
ggggcccttgaaaggaactgca

SEQ ID NO: 653554 - DNA, 22 bp, Artificial Sequence
  chemically synthesized
gggcccttgaaaggaactgcac

SEQ ID NO: 653555 - DNA, 22 bp, Artificial Sequence
  chemically synthesized
gagaaaagctatctgcctgtgc

SEQ ID NO: 653556 - DNA, 22 bp, Artificial Sequence
  chemically synthesized
gaaaggaactgcacaggcagat

SEQ ID NO: 653557 - DNA, 22 bp, Artificial Sequence
  chemically synthesized
aaaggaactgcacaggcagata

SEQ ID NO: 653558 - DNA, 22 bp, Artificial Sequence
  chemically synthesized
cacaggcagatagcttttctct

SEQ ID NO: 653559 - DNA, 22 bp, Artificial Sequence
  chemically synthesized
agaaccaccgacctagagaaaa

SEQ ID NO: 653560 - DNA, 22 bp, Artificial Sequence
  chemically synthesized
cggttgagaaccaccgacctag

SEQ ID NO: 653561 - DNA, 22 bp, Artificial Sequence
  chemically synthesized
ccggttgagaaccaccgaccta

SEQ ID NO: 653562 - DNA, 22 bp, Artificial Sequence
  chemically synthesized
ttctctaggtcggtggttctca

SEQ ID NO: 653563 - DNA, 22 bp, Artificial Sequence
  chemically synthesized
tctctaggtcggtggttctcaa

SEQ ID NO: 653564 - DNA, 22 bp, Artificial Sequence
  chemically synthesized
ctctaggtcggtggttctcaac

SEQ ID NO: 653565 - DNA, 22 bp, Artificial Sequence
  chemically synthesized
tctaggtcggtggttctcaacc

SEQ ID NO: 653566 - DNA, 22 bp, Artificial Sequence
  chemically synthesized
taggtcggtggttctcaaccgg

SEQ ID NO: 653567 - DNA, 22 bp, Artificial Sequence
  chemically synthesized
ggtcggtggttctcaaccggaa

SEQ ID NO: 653568 - DNA, 22 bp, Artificial Sequence
  chemically synthesized
gggtacggcatcatttccggtt

SEQ ID NO: 653569 - DNA, 22 bp, Artificial Sequence
  chemically synthesized
tggggtacggcatcatttccgg

SEQ ID NO: 653570 - DNA, 22 bp, Artificial Sequence
  chemically synthesized
ctctggggtacggcatcatttc

SEQ ID NO: 653571 - DNA, 22 bp, Artificial Sequence
  chemically synthesized
cctctggggtacggcatcattt

SEQ ID NO: 653572 - DNA, 22 bp, Artificial Sequence
  chemically synthesized
tcaaccggaaatgatgccgtac

SEQ ID NO: 653573 - DNA, 22 bp, Artificial Sequence
  chemically synthesized
tatttcctctggggtacggcat

SEQ ID NO: 653574 - DNA, 22 bp, Artificial Sequence
  chemically synthesized
aaccggaaatgatgccgtaccc

SEQ ID NO: 653575 - DNA, 22 bp, Artificial Sequence
  chemically synthesized
ttatatttcctctggggtacgg

SEQ ID NO: 653576 - DNA, 22 bp, Artificial Sequence
  chemically synthesized
caaacattgttatatttcctct

SEQ ID NO: 653577 - DNA, 22 bp, Artificial Sequence
  chemically synthesized
gtcgacactccaaacattgtta

SEQ ID NO: 653578 - DNA, 22 bp, Artificial Sequence
  chemically synthesized
ggtcgacactccaaacattgtt

SEQ ID NO: 653579 - DNA, 22 bp, Artificial Sequence
  chemically synthesized
tggtcgacactccaaacattgt

SEQ ID NO: 653580 - DNA, 22 bp, Artificial Sequence
  chemically synthesized
ttggtcgacactccaaacattg

SEQ ID NO: 653581 - DNA, 22 bp, Artificial Sequence
  chemically synthesized
tttggtcgacactccaaacatt

SEQ ID NO: 653582 - DNA, 22 bp, Artificial Sequence
  chemically synthesized
atgttttttggtcgacactcca

SEQ ID NO: 653583 - DNA, 22 bp, Artificial Sequence
  chemically synthesized
tgatgttttttggtcgacactc

SEQ ID NO: 653584 - DNA, 22 bp, Artificial Sequence
  chemically synthesized
tctgatgttttttggtcgacac

SEQ ID NO: 653585 - DNA, 22 bp, Artificial Sequence
  chemically synthesized
ctctgatgttttttggtcgaca

SEQ ID NO: 653586 - DNA, 22 bp, Artificial Sequence
  chemically synthesized
tctctgatgttttttggtcgac

SEQ ID NO: 653587 - DNA, 22 bp, Artificial Sequence
  chemically synthesized
ttctctgatgttttttggtcga

SEQ ID NO: 653588 - DNA, 22 bp, Artificial Sequence
  chemically synthesized
ggagtgtcgaccaaaaaacatc

SEQ ID NO: 653589 - DNA, 22 bp, Artificial Sequence
  chemically synthesized
gagtgtcgaccaaaaaacatca

SEQ ID NO: 653590 - DNA, 22 bp, Artificial Sequence
  chemically synthesized
gcgatgtttttctctgatgttt

SEQ ID NO: 653591 - DNA, 22 bp, Artificial Sequence
  chemically synthesized
ggcgatgtttttctctgatgtt

SEQ ID NO: 653592 - DNA, 22 bp, Artificial Sequence
  chemically synthesized
acatatttggcgatgtttttct

SEQ ID NO: 653593 - DNA, 22 bp, Artificial Sequence
  chemically synthesized
aacatatttggcgatgtttttc

SEQ ID NO: 653594 - DNA, 22 bp, Artificial Sequence
  chemically synthesized
caaaataaatttaacatatttg

SEQ ID NO: 653595 - DNA, 22 bp, Artificial Sequence
  chemically synthesized
attccaaaataaatttaacata

SEQ ID NO: 653596 - DNA, 22 bp, Artificial Sequence
  chemically synthesized
taattccaaaataaatttaaca

SEQ ID NO: 653597 - DNA, 22 bp, Artificial Sequence
  chemically synthesized
ctaattccaaaataaatttaac

SEQ ID NO: 653598 - DNA, 22 bp, Artificial Sequence
  chemically synthesized
atttctaattccaaaataaatt

SEQ ID NO: 653599 - DNA, 22 bp, Artificial Sequence
  chemically synthesized
taatcctcatttctaattccaa

SEQ ID NO: 653600 - DNA, 22 bp, Artificial Sequence
  chemically synthesized
aatttattttggaattagaaat

SEQ ID NO: 653601 - DNA, 22 bp, Artificial Sequence
  chemically synthesized
ggttgtaatcctcatttctaat

SEQ ID NO: 653602 - DNA, 22 bp, Artificial Sequence
  chemically synthesized
gggttgtaatcctcatttctaa

SEQ ID NO: 653603 - DNA, 22 bp, Artificial Sequence
  chemically synthesized
attttggaattagaaatgagga

SEQ ID NO: 653604 - DNA, 22 bp, Artificial Sequence
  chemically synthesized
ttttggaattagaaatgaggat

SEQ ID NO: 653605 - DNA, 22 bp, Artificial Sequence
  chemically synthesized
tggaattagaaatgaggattac

SEQ ID NO: 653606 - DNA, 22 bp, Artificial Sequence
  chemically synthesized
ggaattagaaatgaggattaca

SEQ ID NO: 653607 - DNA, 22 bp, Artificial Sequence
  chemically synthesized
gaattagaaatgaggattacaa

SEQ ID NO: 653608 - DNA, 22 bp, Artificial Sequence
  chemically synthesized
agatgcatcttgggttgtaatc

SEQ ID NO: 653609 - DNA, 22 bp, Artificial Sequence
  chemically synthesized
cagatgcatcttgggttgtaat

SEQ ID NO: 653610 - DNA, 22 bp, Artificial Sequence
  chemically synthesized
ttcagatgcatcttgggttgta

SEQ ID NO: 653611 - DNA, 22 bp, Artificial Sequence
  chemically synthesized
gaaatgaggattacaacccaag

SEQ ID NO: 653612 - DNA, 22 bp, Artificial Sequence
  chemically synthesized
ctcttcagatgcatcttgggtt

SEQ ID NO: 653613 - DNA, 22 bp, Artificial Sequence
  chemically synthesized
cagtctcctcttcagatgcatc

SEQ ID NO: 653614 - DNA, 22 bp, Artificial Sequence
  chemically synthesized
tacagtctcctcttcagatgca

SEQ ID NO: 653615 - DNA, 22 bp, Artificial Sequence
  chemically synthesized
caacccaagatgcatctgaaga

SEQ ID NO: 653616 - DNA, 22 bp, Artificial Sequence
  chemically synthesized
cctctacagtctcctcttcaga

SEQ ID NO: 653617 - DNA, 22 bp, Artificial Sequence
  chemically synthesized
ccctctacagtctcctcttcag

SEQ ID NO: 653618 - DNA, 22 bp, Artificial Sequence
  chemically synthesized
ccaataaaagtttccctctaca

SEQ ID NO: 653619 - DNA, 22 bp, Artificial Sequence
  chemically synthesized
accaataaaagtttccctctac

SEQ ID NO: 653620 - DNA, 22 bp, Artificial Sequence
  chemically synthesized
aagaggagactgtagagggaaa

SEQ ID NO: 653621 - DNA, 22 bp, Artificial Sequence
  chemically synthesized
taccaataaaagtttccctcta

SEQ ID NO: 653622 - DNA, 22 bp, Artificial Sequence
  chemically synthesized
ttaccaataaaagtttccctct

SEQ ID NO: 653623 - DNA, 22 bp, Artificial Sequence
  chemically synthesized
tttttaccaataaaagtttccc

SEQ ID NO: 653624 - DNA, 22 bp, Artificial Sequence
  chemically synthesized
tgtttttaccaataaaagtttc

SEQ ID NO: 653625 - DNA, 22 bp, Artificial Sequence
  chemically synthesized
ctgtttttaccaataaaagttt

SEQ ID NO: 653626 - DNA, 22 bp, Artificial Sequence
  chemically synthesized
tagagggaaacttttattggta

SEQ ID NO: 653627 - DNA, 22 bp, Artificial Sequence
  chemically synthesized
tgtaaacttctgtttttaccaa

SEQ ID NO: 653628 - DNA, 22 bp, Artificial Sequence
  chemically synthesized
atgtaaacttctgtttttacca

SEQ ID NO: 653629 - DNA, 22 bp, Artificial Sequence
  chemically synthesized
ttattggtaaaaacagaagttt

SEQ ID NO: 653630 - DNA, 22 bp, Artificial Sequence
  chemically synthesized
tattggtaaaaacagaagttta

SEQ ID NO: 653631 - DNA, 22 bp, Artificial Sequence
  chemically synthesized
attggtaaaaacagaagtttac

SEQ ID NO: 653632 - DNA, 22 bp, Artificial Sequence
  chemically synthesized
caagcagcttatgtaaacttct

SEQ ID NO: 653633 - DNA, 22 bp, Artificial Sequence
  chemically synthesized
ttggtaaaaacagaagtttaca

SEQ ID NO: 653634 - DNA, 22 bp, Artificial Sequence
  chemically synthesized
ccaagcagcttatgtaaacttc

SEQ ID NO: 653635 - DNA, 22 bp, Artificial Sequence
  chemically synthesized
gtaaaaacagaagtttacataa

SEQ ID NO: 653636 - DNA, 22 bp, Artificial Sequence
  chemically synthesized
tgtttccaagcagcttatgtaa

SEQ ID NO: 653637 - DNA, 22 bp, Artificial Sequence
  chemically synthesized
aaacgaactatgtttccaagca

SEQ ID NO: 653638 - DNA, 22 bp, Artificial Sequence
  chemically synthesized
acataagctgcttggaaacata

SEQ ID NO: 653639 - DNA, 22 bp, Artificial Sequence
  chemically synthesized
cataagctgcttggaaacatag

SEQ ID NO: 653640 - DNA, 22 bp, Artificial Sequence
  chemically synthesized
agcatctgaaacgaactatgtt

SEQ ID NO: 653641 - DNA, 22 bp, Artificial Sequence
  chemically synthesized
cttggaaacatagttcgtttca

SEQ ID NO: 653642 - DNA, 22 bp, Artificial Sequence
  chemically synthesized
gcgttgagcatctgaaacgaac

SEQ ID NO: 653643 - DNA, 22 bp, Artificial Sequence
  chemically synthesized
tggcgttgagcatctgaaacga

SEQ ID NO: 653644 - DNA, 22 bp, Artificial Sequence
  chemically synthesized
ggaaacatagttcgtttcagat

SEQ ID NO: 653645 - DNA, 22 bp, Artificial Sequence
  chemically synthesized
gaaacatagttcgtttcagatg

SEQ ID NO: 653646 - DNA, 22 bp, Artificial Sequence
  chemically synthesized
acaccagttctggcgttgagca

SEQ ID NO: 653647 - DNA, 22 bp, Artificial Sequence
  chemically synthesized
gtttcagatgctcaacgccaga

SEQ ID NO: 653648 - DNA, 22 bp, Artificial Sequence
  chemically synthesized
cagatgctcaacgccagaactg

SEQ ID NO: 653649 - DNA, 22 bp, Artificial Sequence
  chemically synthesized
ataaactgacaccagttctggc

SEQ ID NO: 653650 - DNA, 22 bp, Artificial Sequence
  chemically synthesized
agatgctcaacgccagaactgg

SEQ ID NO: 653651 - DNA, 22 bp, Artificial Sequence
  chemically synthesized
aacgccagaactggtgtcagtt

SEQ ID NO: 653652 - DNA, 22 bp, Artificial Sequence
  chemically synthesized
gtgtcagtttattagtggggat

SEQ ID NO: 653653 - DNA, 22 bp, Artificial Sequence
  chemically synthesized
cccagtaatggcatccccacta

SEQ ID NO: 653654 - DNA, 22 bp, Artificial Sequence
  chemically synthesized
attagtggggatgccattactg

SEQ ID NO: 653655 - DNA, 22 bp, Artificial Sequence
  chemically synthesized
ttagtggggatgccattactgg

SEQ ID NO: 653656 - DNA, 22 bp, Artificial Sequence
  chemically synthesized
aaaagaacatctgcccagtaat

SEQ ID NO: 653657 - DNA, 22 bp, Artificial Sequence
  chemically synthesized
gtggggatgccattactgggca

SEQ ID NO: 653658 - DNA, 22 bp, Artificial Sequence
  chemically synthesized
tcaaaagaacatctgcccagta

SEQ ID NO: 653659 - DNA, 22 bp, Artificial Sequence
  chemically synthesized
ctgggcagatgttcttttgaga

SEQ ID NO: 653660 - DNA, 22 bp, Artificial Sequence
  chemically synthesized
ggcagatgttcttttgagagca

SEQ ID NO: 653661 - DNA, 22 bp, Artificial Sequence
  chemically synthesized
cagcagtgcacgtaatatgctc

SEQ ID NO: 653662 - DNA, 22 bp, Artificial Sequence
  chemically synthesized
ttttgagagcatattacgtgca

SEQ ID NO: 653663 - DNA, 22 bp, Artificial Sequence
  chemically synthesized
ggactgcagcagtgcacgtaat

SEQ ID NO: 653664 - DNA, 22 bp, Artificial Sequence
  chemically synthesized
ttgagagcatattacgtgcact

SEQ ID NO: 653665 - DNA, 22 bp, Artificial Sequence
  chemically synthesized
tgagagcatattacgtgcactg

SEQ ID NO: 653666 - DNA, 22 bp, Artificial Sequence
  chemically synthesized
ttaggactgcagcagtgcacgt

SEQ ID NO: 653667 - DNA, 22 bp, Artificial Sequence
  chemically synthesized
gagagcatattacgtgcactgc

SEQ ID NO: 653668 - DNA, 22 bp, Artificial Sequence
  chemically synthesized
agagcatattacgtgcactgct

SEQ ID NO: 653669 - DNA, 22 bp, Artificial Sequence
  chemically synthesized
tgttaggactgcagcagtgcac

SEQ ID NO: 653670 - DNA, 22 bp, Artificial Sequence
  chemically synthesized
ctctgttaggactgcagcagtg

SEQ ID NO: 653671 - DNA, 22 bp, Artificial Sequence
  chemically synthesized
cgtgcactgctgcagtcctaac

SEQ ID NO: 653672 - DNA, 22 bp, Artificial Sequence
  chemically synthesized
ctgcagtcctaacagaggaatt

SEQ ID NO: 653673 - DNA, 22 bp, Artificial Sequence
  chemically synthesized
cagtcctaacagaggaatttct

SEQ ID NO: 653674 - DNA, 22 bp, Artificial Sequence
  chemically synthesized
aaatcgccccacaagaaattcc

SEQ ID NO: 653675 - DNA, 22 bp, Artificial Sequence
  chemically synthesized
taaaatcgccccacaagaaatt

SEQ ID NO: 653676 - DNA, 22 bp, Artificial Sequence
  chemically synthesized
ctaaaatcgccccacaagaaat

SEQ ID NO: 653677 - DNA, 22 bp, Artificial Sequence
  chemically synthesized
tctaaaatcgccccacaagaaa

SEQ ID NO: 653678 - DNA, 22 bp, Artificial Sequence
  chemically synthesized
acagaggaatttcttgtggggc

SEQ ID NO: 653679 - DNA, 22 bp, Artificial Sequence
  chemically synthesized
aaggactttctaaaatcgcccc

SEQ ID NO: 653680 - DNA, 22 bp, Artificial Sequence
  chemically synthesized
tctcaaggactttctaaaatcg

SEQ ID NO: 653681 - DNA, 22 bp, Artificial Sequence
  chemically synthesized
cttgtggggcgattttagaaag

SEQ ID NO: 653682 - DNA, 22 bp, Artificial Sequence
  chemically synthesized
ttgtggggcgattttagaaagt

SEQ ID NO: 653683 - DNA, 22 bp, Artificial Sequence
  chemically synthesized
gtggggcgattttagaaagtcc

SEQ ID NO: 653684 - DNA, 22 bp, Artificial Sequence
  chemically synthesized
tggggcgattttagaaagtcct

SEQ ID NO: 653685 - DNA, 22 bp, Artificial Sequence
  chemically synthesized
agataaagactgtctcaaggac

SEQ ID NO: 653686 - DNA, 22 bp, Artificial Sequence
  chemically synthesized
tagaaagtccttgagacagtct

SEQ ID NO: 653687 - DNA, 22 bp, Artificial Sequence
  chemically synthesized
agaaagtccttgagacagtctt

SEQ ID NO: 653688 - DNA, 22 bp, Artificial Sequence
  chemically synthesized
gaaagtccttgagacagtcttt

SEQ ID NO: 653689 - DNA, 22 bp, Artificial Sequence
  chemically synthesized
catgcctgagataaagactgtc

SEQ ID NO: 653690 - DNA, 22 bp, Artificial Sequence
  chemically synthesized
atggttacatgcctgagataaa

SEQ ID NO: 653691 - DNA, 22 bp, Artificial Sequence
  chemically synthesized
gagacagtctttatctcaggca

SEQ ID NO: 653692 - DNA, 22 bp, Artificial Sequence
  chemically synthesized
agacagtctttatctcaggcat

SEQ ID NO: 653693 - DNA, 22 bp, Artificial Sequence
  chemically synthesized
tatctcaggcatgtaaccatga

SEQ ID NO: 653694 - DNA, 22 bp, Artificial Sequence
  chemically synthesized
atctcaggcatgtaaccatgaa

SEQ ID NO: 653695 - DNA, 22 bp, Artificial Sequence
  chemically synthesized
tctcaggcatgtaaccatgaac

SEQ ID NO: 653696 - DNA, 22 bp, Artificial Sequence
  chemically synthesized
aggcatgtaaccatgaaccctc

SEQ ID NO: 653697 - DNA, 22 bp, Artificial Sequence
  chemically synthesized
gagccagggcagcatgaaagga

SEQ ID NO: 653698 - DNA, 22 bp, Artificial Sequence
  chemically synthesized
actagagccagggcagcatgaa

SEQ ID NO: 653699 - DNA, 22 bp, Artificial Sequence
  chemically synthesized
ctcctttcatgctgccctggct

SEQ ID NO: 653700 - DNA, 22 bp, Artificial Sequence
  chemically synthesized
ctttcatgctgccctggctcta

SEQ ID NO: 653701 - DNA, 22 bp, Artificial Sequence
  chemically synthesized
tcatgctgccctggctctagtt

SEQ ID NO: 653702 - DNA, 22 bp, Artificial Sequence
  chemically synthesized
catgctgccctggctctagtta

SEQ ID NO: 653703 - DNA, 22 bp, Artificial Sequence
  chemically synthesized
tcagtcccaaactaactagagc

SEQ ID NO: 653704 - DNA, 22 bp, Artificial Sequence
  chemically synthesized
atgctgccctggctctagttag

SEQ ID NO: 653705 - DNA, 22 bp, Artificial Sequence
  chemically synthesized
gtcagtcccaaactaactagag

SEQ ID NO: 653706 - DNA, 22 bp, Artificial Sequence
  chemically synthesized
tgtcagtcccaaactaactaga

SEQ ID NO: 653707 - DNA, 22 bp, Artificial Sequence
  chemically synthesized
ttgtcagtcccaaactaactag

SEQ ID NO: 653708 - DNA, 22 bp, Artificial Sequence
  chemically synthesized
tttgtcagtcccaaactaacta

SEQ ID NO: 653709 - DNA, 22 bp, Artificial Sequence
  chemically synthesized
ccctggctctagttagtttggg

SEQ ID NO: 653710 - DNA, 22 bp, Artificial Sequence
  chemically synthesized
gctctagttagtttgggactga

SEQ ID NO: 653711 - DNA, 22 bp, Artificial Sequence
  chemically synthesized
tagttagtttgggactgacaaa

SEQ ID NO: 653712 - DNA, 22 bp, Artificial Sequence
  chemically synthesized
gttagtttgggactgacaaaaa

SEQ ID NO: 653713 - DNA, 22 bp, Artificial Sequence
  chemically synthesized
gtttgggactgacaaaaagtga

SEQ ID NO: 653714 - DNA, 22 bp, Artificial Sequence
  chemically synthesized
gggactgacaaaaagtgatttc

SEQ ID NO: 653715 - DNA, 22 bp, Artificial Sequence
  chemically synthesized
ggactgacaaaaagtgatttca

SEQ ID NO: 653716 - DNA, 22 bp, Artificial Sequence
  chemically synthesized
acaaaaagtgatttcatcctgg

SEQ ID NO: 653717 - DNA, 22 bp, Artificial Sequence
  chemically synthesized
ccgtaaaagataccaggatgaa

SEQ ID NO: 653718 - DNA, 22 bp, Artificial Sequence
  chemically synthesized
catcctggtatcttttacggga

SEQ ID NO: 653719 - DNA, 22 bp, Artificial Sequence
  chemically synthesized
atcctggtatcttttacgggag

SEQ ID NO: 653720 - DNA, 22 bp, Artificial Sequence
  chemically synthesized
tgacaaccaaaaatgtctcccg

SEQ ID NO: 653721 - DNA, 22 bp, Artificial Sequence
  chemically synthesized
gtatcttttacgggagacattt

SEQ ID NO: 653722 - DNA, 22 bp, Artificial Sequence
  chemically synthesized
ttacgggagacatttttggttg

SEQ ID NO: 653723 - DNA, 22 bp, Artificial Sequence
  chemically synthesized
tacgggagacatttttggttgt

SEQ ID NO: 653724 - DNA, 22 bp, Artificial Sequence
  chemically synthesized
acgggagacatttttggttgtc

SEQ ID NO: 653725 - DNA, 22 bp, Artificial Sequence
  chemically synthesized
cgggagacatttttggttgtca

SEQ ID NO: 653726 - DNA, 22 bp, Artificial Sequence
  chemically synthesized
ttggttgtcacaactgggcggg

SEQ ID NO: 653727 - DNA, 22 bp, Artificial Sequence
  chemically synthesized
tggttgtcacaactgggcgggg

SEQ ID NO: 653728 - DNA, 22 bp, Artificial Sequence
  chemically synthesized
ggttgtcacaactgggcggggg

SEQ ID NO: 653729 - DNA, 22 bp, Artificial Sequence
  chemically synthesized
gttgtcacaactgggcgggggg

SEQ ID NO: 653730 - DNA, 22 bp, Artificial Sequence
  chemically synthesized
ccccccccccccccccccccgc

SEQ ID NO: 653731 - DNA, 22 bp, Artificial Sequence
  chemically synthesized
tcacaactgggcgggggggggg

SEQ ID NO: 653732 - DNA, 22 bp, Artificial Sequence
  chemically synthesized
cccctccccccccccccccccc

SEQ ID NO: 653733 - DNA, 22 bp, Artificial Sequence
  chemically synthesized
ggcggggggggggggggggggg

SEQ ID NO: 653734 - DNA, 22 bp, Artificial Sequence
  chemically synthesized
cccgccctccccctcccccccc

SEQ ID NO: 653735 - DNA, 22 bp, Artificial Sequence
  chemically synthesized
gtagcaccccctccccgccctc

SEQ ID NO: 653736 - DNA, 22 bp, Artificial Sequence
  chemically synthesized
aatgctagtagcaccccctccc

SEQ ID NO: 653737 - DNA, 22 bp, Artificial Sequence
  chemically synthesized
ctaaatgctagtagcaccccct

SEQ ID NO: 653738 - DNA, 22 bp, Artificial Sequence
  chemically synthesized
tctactaaatgctagtagcacc

SEQ ID NO: 653739 - DNA, 22 bp, Artificial Sequence
  chemically synthesized
tatctactaaatgctagtagca

SEQ ID NO: 653740 - DNA, 22 bp, Artificial Sequence
  chemically synthesized
gcctctatctactaaatgctag

SEQ ID NO: 653741 - DNA, 22 bp, Artificial Sequence
  chemically synthesized
cagaatcctggcctctatctac

SEQ ID NO: 653742 - DNA, 22 bp, Artificial Sequence
  chemically synthesized
gcagaatcctggcctctatcta

SEQ ID NO: 653743 - DNA, 22 bp, Artificial Sequence
  chemically synthesized
ctagcatttagtagatagaggc

SEQ ID NO: 653744 - DNA, 22 bp, Artificial Sequence
  chemically synthesized
tgcagaatcctggcctctatct

SEQ ID NO: 653745 - DNA, 22 bp, Artificial Sequence
  chemically synthesized
gcatttagtagatagaggccag

SEQ ID NO: 653746 - DNA, 22 bp, Artificial Sequence
  chemically synthesized
gatgttttgcagaatcctggcc

SEQ ID NO: 653747 - DNA, 22 bp, Artificial Sequence
  chemically synthesized
agtagatagaggccaggattct

SEQ ID NO: 653748 - DNA, 22 bp, Artificial Sequence
  chemically synthesized
gtagatagaggccaggattctg

SEQ ID NO: 653749 - DNA, 22 bp, Artificial Sequence
  chemically synthesized
ctggatgttttgcagaatcctg

SEQ ID NO: 653750 - DNA, 22 bp, Artificial Sequence
  chemically synthesized
tgtgctgctggatgttttgcag

SEQ ID NO: 653751 - DNA, 22 bp, Artificial Sequence
  chemically synthesized
ccctgtgtgctgctggatgttt

SEQ ID NO: 653752 - DNA, 22 bp, Artificial Sequence
  chemically synthesized
tgcaaaacatccagcagcacac

SEQ ID NO: 653753 - DNA, 22 bp, Artificial Sequence
  chemically synthesized
caaaacatccagcagcacacag

SEQ ID NO: 653754 - DNA, 22 bp, Artificial Sequence
  chemically synthesized
tgggaagctgccctgtgtgctg

SEQ ID NO: 653755 - DNA, 22 bp, Artificial Sequence
  chemically synthesized
ttgtgggaagctgccctgtgtg

SEQ ID NO: 653756 - DNA, 22 bp, Artificial Sequence
  chemically synthesized
gttgtgggaagctgccctgtgt

SEQ ID NO: 653757 - DNA, 22 bp, Artificial Sequence
  chemically synthesized
tgttgtgggaagctgccctgtg

SEQ ID NO: 653758 - DNA, 22 bp, Artificial Sequence
  chemically synthesized
tttgttgtgggaagctgccctg

SEQ ID NO: 653759 - DNA, 22 bp, Artificial Sequence
  chemically synthesized
gttctttgttgtgggaagctgc

SEQ ID NO: 653760 - DNA, 22 bp, Artificial Sequence
  chemically synthesized
tagttctttgttgtgggaagct

SEQ ID NO: 653761 - DNA, 22 bp, Artificial Sequence
  chemically synthesized
gcccgaatcattctagttcttt

SEQ ID NO: 653762 - DNA, 22 bp, Artificial Sequence
  chemically synthesized
ggcccgaatcattctagttctt

SEQ ID NO: 653763 - DNA, 22 bp, Artificial Sequence
  chemically synthesized
tggcccgaatcattctagttct

SEQ ID NO: 653764 - DNA, 22 bp, Artificial Sequence
  chemically synthesized
cccacaacaaagaactagaatg

SEQ ID NO: 653765 - DNA, 22 bp, Artificial Sequence
  chemically synthesized
ccacaacaaagaactagaatga

SEQ ID NO: 653766 - DNA, 22 bp, Artificial Sequence
  chemically synthesized
atgctttggcccgaatcattct

SEQ ID NO: 653767 - DNA, 22 bp, Artificial Sequence
  chemically synthesized
ctgatgctttggcccgaatcat

SEQ ID NO: 653768 - DNA, 22 bp, Artificial Sequence
  chemically synthesized
gtgctactgatgctttggcccg

SEQ ID NO: 653769 - DNA, 22 bp, Artificial Sequence
  chemically synthesized
ggtgctactgatgctttggccc

SEQ ID NO: 653770 - DNA, 22 bp, Artificial Sequence
  chemically synthesized
gaatgattcgggccaaagcatc

SEQ ID NO: 653771 - DNA, 22 bp, Artificial Sequence
  chemically synthesized
aaccttggtgctactgatgctt

SEQ ID NO: 653772 - DNA, 22 bp, Artificial Sequence
  chemically synthesized
tcaaccttggtgctactgatgc

SEQ ID NO: 653773 - DNA, 22 bp, Artificial Sequence
  chemically synthesized
ctcaaccttggtgctactgatg

SEQ ID NO: 653774 - DNA, 22 bp, Artificial Sequence
  chemically synthesized
gggccaaagcatcagtagcacc

SEQ ID NO: 653775 - DNA, 22 bp, Artificial Sequence
  chemically synthesized
gggcagggtttctcaaccttgg

SEQ ID NO: 653776 - DNA, 22 bp, Artificial Sequence
  chemically synthesized
acattggggcagggtttctcaa

SEQ ID NO: 653777 - DNA, 22 bp, Artificial Sequence
  chemically synthesized
tgtaagatgttaacattggggc

SEQ ID NO: 653778 - DNA, 22 bp, Artificial Sequence
  chemically synthesized
agaaaccctgccccaatgttaa

SEQ ID NO: 653779 - DNA, 22 bp, Artificial Sequence
  chemically synthesized
ccccaatgttaacatcttacat

SEQ ID NO: 653780 - DNA, 22 bp, Artificial Sequence
  chemically synthesized
acaagtgaaccatatggttatg

SEQ ID NO: 653781 - DNA, 22 bp, Artificial Sequence
  chemically synthesized
gacaagtgaaccatatggttat

SEQ ID NO: 653782 - DNA, 22 bp, Artificial Sequence
  chemically synthesized
tgacaagtgaaccatatggtta

SEQ ID NO: 653783 - DNA, 22 bp, Artificial Sequence
  chemically synthesized
acatcttacataaccatatggt

SEQ ID NO: 653784 - DNA, 22 bp, Artificial Sequence
  chemically synthesized
gttttgacaagtgaaccatatg

SEQ ID NO: 653785 - DNA, 22 bp, Artificial Sequence
  chemically synthesized
agttttgacaagtgaaccatat

SEQ ID NO: 653786 - DNA, 22 bp, Artificial Sequence
  chemically synthesized
ttagttttgacaagtgaaccat

SEQ ID NO: 653787 - DNA, 22 bp, Artificial Sequence
  chemically synthesized
cttagttttgacaagtgaacca

SEQ ID NO: 653788 - DNA, 22 bp, Artificial Sequence
  chemically synthesized
acataaccatatggttcacttg

SEQ ID NO: 653789 - DNA, 22 bp, Artificial Sequence
  chemically synthesized
cataaccatatggttcacttgt

SEQ ID NO: 653790 - DNA, 22 bp, Artificial Sequence
  chemically synthesized
acttgtcaaaactaagaaatcc

SEQ ID NO: 653791 - DNA, 22 bp, Artificial Sequence
  chemically synthesized
gtcaaaactaagaaatccacat

SEQ ID NO: 653792 - DNA, 22 bp, Artificial Sequence
  chemically synthesized
tcaaaactaagaaatccacatt

SEQ ID NO: 653793 - DNA, 22 bp, Artificial Sequence
  chemically synthesized
gtgaatagtgatgaatcaatgt

SEQ ID NO: 653794 - DNA, 22 bp, Artificial Sequence
  chemically synthesized
agtgaatagtgatgaatcaatg

SEQ ID NO: 653795 - DNA, 22 bp, Artificial Sequence
  chemically synthesized
agaaatccacattgattcatca

SEQ ID NO: 653796 - DNA, 22 bp, Artificial Sequence
  chemically synthesized
tttagtgaatagtgatgaatca

SEQ ID NO: 653797 - DNA, 22 bp, Artificial Sequence
  chemically synthesized
ttgtttagtgaatagtgatgaa

SEQ ID NO: 653798 - DNA, 22 bp, Artificial Sequence
  chemically synthesized
attcatcactattcactaaaca

SEQ ID NO: 653799 - DNA, 22 bp, Artificial Sequence
  chemically synthesized
agggaagtctgttgtttagtga

SEQ ID NO: 653800 - DNA, 22 bp, Artificial Sequence
  chemically synthesized
tcagggaagtctgttgtttagt

SEQ ID NO: 653801 - DNA, 22 bp, Artificial Sequence
  chemically synthesized
atcactattcactaaacaacag

SEQ ID NO: 653802 - DNA, 22 bp, Artificial Sequence
  chemically synthesized
caggactctcagggaagtctgt

SEQ ID NO: 653803 - DNA, 22 bp, Artificial Sequence
  chemically synthesized
ttcactaaacaacagacttccc

SEQ ID NO: 653804 - DNA, 22 bp, Artificial Sequence
  chemically synthesized
gcaggactctcagggaagtctg

SEQ ID NO: 653805 - DNA, 22 bp, Artificial Sequence
  chemically synthesized
actaaacaacagacttccctga

SEQ ID NO: 653806 - DNA, 22 bp, Artificial Sequence
  chemically synthesized
aacaacagacttccctgagagt

SEQ ID NO: 653807 - DNA, 22 bp, Artificial Sequence
  chemically synthesized
aatgcccttgcaggactctcag

SEQ ID NO: 653808 - DNA, 22 bp, Artificial Sequence
  chemically synthesized
ttaaatgcccttgcaggactct

SEQ ID NO: 653809 - DNA, 22 bp, Artificial Sequence
  chemically synthesized
attaaatgcccttgcaggactc

SEQ ID NO: 653810 - DNA, 22 bp, Artificial Sequence
  chemically synthesized
ccctgagagtcctgcaagggca

SEQ ID NO: 653811 - DNA, 22 bp, Artificial Sequence
  chemically synthesized
cctgagagtcctgcaagggcat

SEQ ID NO: 653812 - DNA, 22 bp, Artificial Sequence
  chemically synthesized
ccggcttattaaatgcccttgc

SEQ ID NO: 653813 - DNA, 22 bp, Artificial Sequence
  chemically synthesized
agagtcctgcaagggcatttaa

SEQ ID NO: 653814 - DNA, 22 bp, Artificial Sequence
  chemically synthesized
caagggcatttaataagccggc

SEQ ID NO: 653815 - DNA, 22 bp, Artificial Sequence
  chemically synthesized
tagaggatagttgccggcttat

SEQ ID NO: 653816 - DNA, 22 bp, Artificial Sequence
  chemically synthesized
tgttgtagaggatagttgccgg

SEQ ID NO: 653817 - DNA, 22 bp, Artificial Sequence
  chemically synthesized
tgtgttgtagaggatagttgcc

SEQ ID NO: 653818 - DNA, 22 bp, Artificial Sequence
  chemically synthesized
ctgtgttgtagaggatagttgc

SEQ ID NO: 653819 - DNA, 22 bp, Artificial Sequence
  chemically synthesized
aataagccggcaactatcctct

SEQ ID NO: 653820 - DNA, 22 bp, Artificial Sequence
  chemically synthesized
ataagccggcaactatcctcta

SEQ ID NO: 653821 - DNA, 22 bp, Artificial Sequence
  chemically synthesized
ccagtttctgtgttgtagagga

SEQ ID NO: 653822 - DNA, 22 bp, Artificial Sequence
  chemically synthesized
tggtagcctcccagtttctgtg

SEQ ID NO: 653823 - DNA, 22 bp, Artificial Sequence
  chemically synthesized
tcctctacaacacagaaactgg

SEQ ID NO: 653824 - DNA, 22 bp, Artificial Sequence
  chemically synthesized
tacaacacagaaactgggaggc

SEQ ID NO: 653825 - DNA, 22 bp, Artificial Sequence
  chemically synthesized
caacacagaaactgggaggcta

SEQ ID NO: 653826 - DNA, 22 bp, Artificial Sequence
  chemically synthesized
aataggcctatggtagcctccc

SEQ ID NO: 653827 - DNA, 22 bp, Artificial Sequence
  chemically synthesized
ggcagttgaataggcctatggt

SEQ ID NO: 653828 - DNA, 22 bp, Artificial Sequence
  chemically synthesized
cggcagttgaataggcctatgg

SEQ ID NO: 653829 - DNA, 22 bp, Artificial Sequence
  chemically synthesized
ggaggctaccataggcctattc

SEQ ID NO: 653830 - DNA, 22 bp, Artificial Sequence
  chemically synthesized
ccataggcctattcaactgccg

SEQ ID NO: 653831 - DNA, 22 bp, Artificial Sequence
  chemically synthesized
tgaacgagtgtggcatttcggc

SEQ ID NO: 653832 - DNA, 22 bp, Artificial Sequence
  chemically synthesized
atgaacgagtgtggcatttcgg

SEQ ID NO: 653833 - DNA, 22 bp, Artificial Sequence
  chemically synthesized
ttcaactgccgaaatgccacac

SEQ ID NO: 653834 - DNA, 22 bp, Artificial Sequence
  chemically synthesized
agtttatgaacgagtgtggcat

SEQ ID NO: 653835 - DNA, 22 bp, Artificial Sequence
  chemically synthesized
aactgccgaaatgccacactcg

SEQ ID NO: 653836 - DNA, 22 bp, Artificial Sequence
  chemically synthesized
ccctcagtttatgaacgagtgt

SEQ ID NO: 653837 - DNA, 22 bp, Artificial Sequence
  chemically synthesized
ccgaaatgccacactcgttcat

SEQ ID NO: 653838 - DNA, 22 bp, Artificial Sequence
  chemically synthesized
taccctcagtttatgaacgagt

SEQ ID NO: 653839 - DNA, 22 bp, Artificial Sequence
  chemically synthesized
tctaccctcagtttatgaacga

SEQ ID NO: 653840 - DNA, 22 bp, Artificial Sequence
  chemically synthesized
tctctaccctcagtttatgaac

SEQ ID NO: 653841 - DNA, 22 bp, Artificial Sequence
  chemically synthesized
ctctctctaccctcagtttatg

SEQ ID NO: 653842 - DNA, 22 bp, Artificial Sequence
  chemically synthesized
gctctctctaccctcagtttat

SEQ ID NO: 653843 - DNA, 22 bp, Artificial Sequence
  chemically synthesized
tgctctctctaccctcagttta

SEQ ID NO: 653844 - DNA, 22 bp, Artificial Sequence
  chemically synthesized
ttgctctctctaccctcagttt

SEQ ID NO: 653845 - DNA, 22 bp, Artificial Sequence
  chemically synthesized
ccttttgctctctctaccctca

SEQ ID NO: 653846 - DNA, 22 bp, Artificial Sequence
  chemically synthesized
cccttttgctctctctaccctc

SEQ ID NO: 653847 - DNA, 22 bp, Artificial Sequence
  chemically synthesized
gttcataaactgagggtagaga

SEQ ID NO: 653848 - DNA, 22 bp, Artificial Sequence
  chemically synthesized
atttcccttttgctctctctac

SEQ ID NO: 653849 - DNA, 22 bp, Artificial Sequence
  chemically synthesized
ataaactgagggtagagagagc

SEQ ID NO: 653850 - DNA, 22 bp, Artificial Sequence
  chemically synthesized
aatttcccttttgctctctcta

SEQ ID NO: 653851 - DNA, 22 bp, Artificial Sequence
  chemically synthesized
taatttcccttttgctctctct

SEQ ID NO: 653852 - DNA, 22 bp, Artificial Sequence
  chemically synthesized
ttaatttcccttttgctctctc

SEQ ID NO: 653853 - DNA, 22 bp, Artificial Sequence
  chemically synthesized
agggtagagagagcaaaaggga

SEQ ID NO: 653854 - DNA, 22 bp, Artificial Sequence
  chemically synthesized
gggcttttaatttcccttttgc

SEQ ID NO: 653855 - DNA, 22 bp, Artificial Sequence
  chemically synthesized
ggggcttttaatttcccttttg

SEQ ID NO: 653856 - DNA, 22 bp, Artificial Sequence
  chemically synthesized
gtttggggcttttaatttccct

SEQ ID NO: 653857 - DNA, 22 bp, Artificial Sequence
  chemically synthesized
tagtttggggcttttaatttcc

SEQ ID NO: 653858 - DNA, 22 bp, Artificial Sequence
  chemically synthesized
ctagtttggggcttttaatttc

SEQ ID NO: 653859 - DNA, 22 bp, Artificial Sequence
  chemically synthesized
tgacttctagtttggggctttt

SEQ ID NO: 653860 - DNA, 22 bp, Artificial Sequence
  chemically synthesized
gtgacttctagtttggggcttt

SEQ ID NO: 653861 - DNA, 22 bp, Artificial Sequence
  chemically synthesized
cttgtgacttctagtttggggc

SEQ ID NO: 653862 - DNA, 22 bp, Artificial Sequence
  chemically synthesized
ccttgtgacttctagtttgggg

SEQ ID NO: 653863 - DNA, 22 bp, Artificial Sequence
  chemically synthesized
aaagccccaaactagaagtcac

SEQ ID NO: 653864 - DNA, 22 bp, Artificial Sequence
  chemically synthesized
gcgtgtttccttgtgacttcta

SEQ ID NO: 653865 - DNA, 22 bp, Artificial Sequence
  chemically synthesized
agcgtgtttccttgtgacttct

SEQ ID NO: 653866 - DNA, 22 bp, Artificial Sequence
  chemically synthesized
tagcgtgtttccttgtgacttc

SEQ ID NO: 653867 - DNA, 22 bp, Artificial Sequence
  chemically synthesized
caattttagcgtgtttccttgt

SEQ ID NO: 653868 - DNA, 22 bp, Artificial Sequence
  chemically synthesized
gaagtcacaaggaaacacgcta

SEQ ID NO: 653869 - DNA, 22 bp, Artificial Sequence
  chemically synthesized
agtctacaattttagcgtgttt

SEQ ID NO: 653870 - DNA, 22 bp, Artificial Sequence
  chemically synthesized
aaatctgagtctacaattttag

SEQ ID NO: 653871 - DNA, 22 bp, Artificial Sequence
  chemically synthesized
caaatctgagtctacaatttta

SEQ ID NO: 653872 - DNA, 22 bp, Artificial Sequence
  chemically synthesized
atttcaaatctgagtctacaat

SEQ ID NO: 653873 - DNA, 22 bp, Artificial Sequence
  chemically synthesized
gatttcaaatctgagtctacaa

SEQ ID NO: 653874 - DNA, 22 bp, Artificial Sequence
  chemically synthesized
aaattgtagactcagatttgaa

SEQ ID NO: 653875 - DNA, 22 bp, Artificial Sequence
  chemically synthesized
agaagcaacttgatttcaaatc

SEQ ID NO: 653876 - DNA, 22 bp, Artificial Sequence
  chemically synthesized
gagaagcaacttgatttcaaat

SEQ ID NO: 653877 - DNA, 22 bp, Artificial Sequence
  chemically synthesized
tagactcagatttgaaatcaag

SEQ ID NO: 653878 - DNA, 22 bp, Artificial Sequence
  chemically synthesized
tcagtttgagaagcaacttgat

SEQ ID NO: 653879 - DNA, 22 bp, Artificial Sequence
  chemically synthesized
agatttgaaatcaagttgcttc

SEQ ID NO: 653880 - DNA, 22 bp, Artificial Sequence
  chemically synthesized
gaaatcaagttgcttctcaaac

SEQ ID NO: 653881 - DNA, 22 bp, Artificial Sequence
  chemically synthesized
aaatcaagttgcttctcaaact

SEQ ID NO: 653882 - DNA, 22 bp, Artificial Sequence
  chemically synthesized
catagagttgtcagtttgagaa

SEQ ID NO: 653883 - DNA, 22 bp, Artificial Sequence
  chemically synthesized
gaatacactgcatagagttgtc

SEQ ID NO: 653884 - DNA, 22 bp, Artificial Sequence
  chemically synthesized
cttctcaaactgacaactctat

SEQ ID NO: 653885 - DNA, 22 bp, Artificial Sequence
  chemically synthesized
ctcaaactgacaactctatgca

SEQ ID NO: 653886 - DNA, 22 bp, Artificial Sequence
  chemically synthesized
tcaaactgacaactctatgcag

SEQ ID NO: 653887 - DNA, 22 bp, Artificial Sequence
  chemically synthesized
tcctggaatacactgcatagag

SEQ ID NO: 653888 - DNA, 22 bp, Artificial Sequence
  chemically synthesized
atcctggaatacactgcataga

SEQ ID NO: 653889 - DNA, 22 bp, Artificial Sequence
  chemically synthesized
aaactgacaactctatgcagtg

SEQ ID NO: 653890 - DNA, 22 bp, Artificial Sequence
  chemically synthesized
tttatcctggaatacactgcat

SEQ ID NO: 653891 - DNA, 22 bp, Artificial Sequence
  chemically synthesized
acaactctatgcagtgtattcc

SEQ ID NO: 653892 - DNA, 22 bp, Artificial Sequence
  chemically synthesized
caactgtttatcctggaataca

SEQ ID NO: 653893 - DNA, 22 bp, Artificial Sequence
  chemically synthesized
tgcaactgtttatcctggaata

SEQ ID NO: 653894 - DNA, 22 bp, Artificial Sequence
  chemically synthesized
ctgcaactgtttatcctggaat

SEQ ID NO: 653895 - DNA, 22 bp, Artificial Sequence
  chemically synthesized
tatgcagtgtattccaggataa

SEQ ID NO: 653896 - DNA, 22 bp, Artificial Sequence
  chemically synthesized
tgcagtgtattccaggataaac

SEQ ID NO: 653897 - DNA, 22 bp, Artificial Sequence
  chemically synthesized
aataaataaatttctgcaactg

SEQ ID NO: 653898 - DNA, 22 bp, Artificial Sequence
  chemically synthesized
caggataaacagttgcagaaat

SEQ ID NO: 653899 - DNA, 22 bp, Artificial Sequence
  chemically synthesized
ccatgattaaataaataaattt

SEQ ID NO: 653900 - DNA, 22 bp, Artificial Sequence
  chemically synthesized
tctgccatgattaaataaataa

SEQ ID NO: 653901 - DNA, 22 bp, Artificial Sequence
  chemically synthesized
cagaaatttatttatttaatca

SEQ ID NO: 653902 - DNA, 22 bp, Artificial Sequence
  chemically synthesized
ggataattatctgccatgatta

SEQ ID NO: 653903 - DNA, 22 bp, Artificial Sequence
  chemically synthesized
gggataattatctgccatgatt

SEQ ID NO: 653904 - DNA, 22 bp, Artificial Sequence
  chemically synthesized
cttgggataattatctgccatg

SEQ ID NO: 653905 - DNA, 22 bp, Artificial Sequence
  chemically synthesized
atttatttaatcatggcagata

SEQ ID NO: 653906 - DNA, 22 bp, Artificial Sequence
  chemically synthesized
gcttgggataattatctgccat

SEQ ID NO: 653907 - DNA, 22 bp, Artificial Sequence
  chemically synthesized
tttatttaatcatggcagataa

SEQ ID NO: 653908 - DNA, 22 bp, Artificial Sequence
  chemically synthesized
atttaatcatggcagataatta

SEQ ID NO: 653909 - DNA, 22 bp, Artificial Sequence
  chemically synthesized
ccttgcttgggataattatctg

SEQ ID NO: 653910 - DNA, 22 bp, Artificial Sequence
  chemically synthesized
tttaatcatggcagataattat

SEQ ID NO: 653911 - DNA, 22 bp, Artificial Sequence
  chemically synthesized
accttgcttgggataattatct

SEQ ID NO: 653912 - DNA, 22 bp, Artificial Sequence
  chemically synthesized
taccttgcttgggataattatc

SEQ ID NO: 653913 - DNA, 22 bp, Artificial Sequence
  chemically synthesized
aatcatggcagataattatccc

SEQ ID NO: 653914 - DNA, 22 bp, Artificial Sequence
  chemically synthesized
atcatggcagataattatccca

SEQ ID NO: 653915 - DNA, 22 bp, Artificial Sequence
  chemically synthesized
ctttaccttgcttgggataatt

SEQ ID NO: 653916 - DNA, 22 bp, Artificial Sequence
  chemically synthesized
gcagacctgctttaccttgctt

SEQ ID NO: 653917 - DNA, 22 bp, Artificial Sequence
  chemically synthesized
tactagcagacctgctttacct

SEQ ID NO: 653918 - DNA, 22 bp, Artificial Sequence
  chemically synthesized
tcccaagcaaggtaaagcaggt

SEQ ID NO: 653919 - DNA, 22 bp, Artificial Sequence
  chemically synthesized
ctagtacaatgtgtatgtgtgt

SEQ ID NO: 653920 - DNA, 22 bp, Artificial Sequence
  chemically synthesized
gtacaatgtgtatgtgtgtgtg

SEQ ID NO: 653921 - DNA, 22 bp, Artificial Sequence
  chemically synthesized
agtaaaatcaaaacacacacac

SEQ ID NO: 653922 - DNA, 22 bp, Artificial Sequence
  chemically synthesized
tactaagtaaaatcaaaacaca

SEQ ID NO: 653923 - DNA, 22 bp, Artificial Sequence
  chemically synthesized
tgacctgtactaagtaaaatca

SEQ ID NO: 653924 - DNA, 22 bp, Artificial Sequence
  chemically synthesized
aatggttatgacctgtactaag

SEQ ID NO: 653925 - DNA, 22 bp, Artificial Sequence
  chemically synthesized
taaatggttatgacctgtacta

SEQ ID NO: 653926 - DNA, 22 bp, Artificial Sequence
  chemically synthesized
tgattttacttagtacaggtca

SEQ ID NO: 653927 - DNA, 22 bp, Artificial Sequence
  chemically synthesized
tctaaatggttatgacctgtac

SEQ ID NO: 653928 - DNA, 22 bp, Artificial Sequence
  chemically synthesized
gattttacttagtacaggtcat

SEQ ID NO: 653929 - DNA, 22 bp, Artificial Sequence
  chemically synthesized
ctctaaatggttatgacctgta

SEQ ID NO: 653930 - DNA, 22 bp, Artificial Sequence
  chemically synthesized
attttacttagtacaggtcata

SEQ ID NO: 653931 - DNA, 22 bp, Artificial Sequence
  chemically synthesized
tctctaaatggttatgacctgt

SEQ ID NO: 653932 - DNA, 22 bp, Artificial Sequence
  chemically synthesized
ttctctaaatggttatgacctg

SEQ ID NO: 653933 - DNA, 22 bp, Artificial Sequence
  chemically synthesized
tttctctaaatggttatgacct

SEQ ID NO: 653934 - DNA, 22 bp, Artificial Sequence
  chemically synthesized
tacttagtacaggtcataacca

SEQ ID NO: 653935 - DNA, 22 bp, Artificial Sequence
  chemically synthesized
acttagtacaggtcataaccat

SEQ ID NO: 653936 - DNA, 22 bp, Artificial Sequence
  chemically synthesized
ttttttctctaaatggttatga

SEQ ID NO: 653937 - DNA, 22 bp, Artificial Sequence
  chemically synthesized
cttagtacaggtcataaccatt

SEQ ID NO: 653938 - DNA, 22 bp, Artificial Sequence
  chemically synthesized
attttttctctaaatggttatg

SEQ ID NO: 653939 - DNA, 22 bp, Artificial Sequence
  chemically synthesized
ttattttttctctaaatggtta

SEQ ID NO: 653940 - DNA, 22 bp, Artificial Sequence
  chemically synthesized
agtacaggtcataaccatttag

SEQ ID NO: 653941 - DNA, 22 bp, Artificial Sequence
  chemically synthesized
gtacaggtcataaccatttaga

SEQ ID NO: 653942 - DNA, 22 bp, Artificial Sequence
  chemically synthesized
gttcttattttttctctaaatg

SEQ ID NO: 653943 - DNA, 22 bp, Artificial Sequence
  chemically synthesized
agttcttattttttctctaaat

SEQ ID NO: 653944 - DNA, 22 bp, Artificial Sequence
  chemically synthesized
catatttagttcttattttttc

SEQ ID NO: 653945 - DNA, 22 bp, Artificial Sequence
  chemically synthesized
gcatatttagttcttatttttt

SEQ ID NO: 653946 - DNA, 22 bp, Artificial Sequence
  chemically synthesized
atatttgcatatttagttctta

SEQ ID NO: 653947 - DNA, 22 bp, Artificial Sequence
  chemically synthesized
aatatttgcatatttagttctt

SEQ ID NO: 653948 - DNA, 22 bp, Artificial Sequence
  chemically synthesized
agagaaaaaataagaactaaat

SEQ ID NO: 653949 - DNA, 22 bp, Artificial Sequence
  chemically synthesized
gagaaaaaataagaactaaata

SEQ ID NO: 653950 - DNA, 22 bp, Artificial Sequence
  chemically synthesized
tggatatgtatgtatttaatat

SEQ ID NO: 653951 - DNA, 22 bp, Artificial Sequence
  chemically synthesized
atggatatgtatgtatttaata

SEQ ID NO: 653952 - DNA, 22 bp, Artificial Sequence
  chemically synthesized
aatatgcaaatattaaatacat

SEQ ID NO: 653953 - DNA, 22 bp, Artificial Sequence
  chemically synthesized
tttatggatatgtatgtattta

SEQ ID NO: 653954 - DNA, 22 bp, Artificial Sequence
  chemically synthesized
tatttatggatatgtatgtatt

SEQ ID NO: 653955 - DNA, 22 bp, Artificial Sequence
  chemically synthesized
ggaattctatttatggatatgt

SEQ ID NO: 653956 - DNA, 22 bp, Artificial Sequence
  chemically synthesized
aggaattctatttatggatatg

SEQ ID NO: 653957 - DNA, 22 bp, Artificial Sequence
  chemically synthesized
aatacatacatatccataaata

SEQ ID NO: 653958 - DNA, 22 bp, Artificial Sequence
  chemically synthesized
tcaataaaaatgtttaggaatt

SEQ ID NO: 653959 - DNA, 22 bp, Artificial Sequence
  chemically synthesized
tgtcaataaaaatgtttaggaa

SEQ ID NO: 653960 - DNA, 22 bp, Artificial Sequence
  chemically synthesized
ctgtcaataaaaatgtttagga

SEQ ID NO: 653961 - DNA, 22 bp, Artificial Sequence
  chemically synthesized
tctgtcaataaaaatgtttagg

SEQ ID NO: 653962 - DNA, 22 bp, Artificial Sequence
  chemically synthesized
ttctgtcaataaaaatgtttag

SEQ ID NO: 653963 - DNA, 22 bp, Artificial Sequence
  chemically synthesized
tttctgtcaataaaaatgttta

SEQ ID NO: 653964 - DNA, 22 bp, Artificial Sequence
  chemically synthesized
cctttttctgtcaataaaaatg

SEQ ID NO: 653965 - DNA, 22 bp, Artificial Sequence
  chemically synthesized
acctttttctgtcaataaaaat

SEQ ID NO: 653966 - DNA, 22 bp, Artificial Sequence
  chemically synthesized
ctaaacatttttattgacagaa

SEQ ID NO: 653967 - DNA, 22 bp, Artificial Sequence
  chemically synthesized
aacatttttattgacagaaaaa

SEQ ID NO: 653968 - DNA, 22 bp, Artificial Sequence
  chemically synthesized
cataaatttacctttttctgtc

SEQ ID NO: 653969 - DNA, 22 bp, Artificial Sequence
  chemically synthesized
ccataaatttacctttttctgt

SEQ ID NO: 653970 - DNA, 22 bp, Artificial Sequence
  chemically synthesized
tccataaatttacctttttctg

SEQ ID NO: 653971 - DNA, 22 bp, Artificial Sequence
  chemically synthesized
ttattgacagaaaaaggtaaat

SEQ ID NO: 653972 - DNA, 22 bp, Artificial Sequence
  chemically synthesized
tattgacagaaaaaggtaaatt

SEQ ID NO: 653973 - DNA, 22 bp, Artificial Sequence
  chemically synthesized
attgacagaaaaaggtaaattt

SEQ ID NO: 653974 - DNA, 22 bp, Artificial Sequence
  chemically synthesized
ttgacagaaaaaggtaaattta

SEQ ID NO: 653975 - DNA, 22 bp, Artificial Sequence
  chemically synthesized
acagaaaaaggtaaatttatgg

SEQ ID NO: 653976 - DNA, 22 bp, Artificial Sequence
  chemically synthesized
cccacaatgttttccataaatt

SEQ ID NO: 653977 - DNA, 22 bp, Artificial Sequence
  chemically synthesized
gcccacaatgttttccataaat

SEQ ID NO: 653978 - DNA, 22 bp, Artificial Sequence
  chemically synthesized
tggtttgcccacaatgttttcc

SEQ ID NO: 653979 - DNA, 22 bp, Artificial Sequence
  chemically synthesized
aaaatctgtggtttgcccacaa

SEQ ID NO: 653980 - DNA, 22 bp, Artificial Sequence
  chemically synthesized
aaaaatctgtggtttgcccaca

SEQ ID NO: 653981 - DNA, 22 bp, Artificial Sequence
  chemically synthesized
atggaaaacattgtgggcaaac

SEQ ID NO: 653982 - DNA, 22 bp, Artificial Sequence
  chemically synthesized
taaaaatctgtggtttgcccac

SEQ ID NO: 653983 - DNA, 22 bp, Artificial Sequence
  chemically synthesized
tggaaaacattgtgggcaaacc

SEQ ID NO: 653984 - DNA, 22 bp, Artificial Sequence
  chemically synthesized
ttaaaaatctgtggtttgccca

SEQ ID NO: 653985 - DNA, 22 bp, Artificial Sequence
  chemically synthesized
tttaaaaatctgtggtttgccc

SEQ ID NO: 653986 - DNA, 22 bp, Artificial Sequence
  chemically synthesized
ccctttttaaaaatctgtggtt

SEQ ID NO: 653987 - DNA, 22 bp, Artificial Sequence
  chemically synthesized
tgggcaaaccacagatttttaa

SEQ ID NO: 653988 - DNA, 22 bp, Artificial Sequence
  chemically synthesized
ttaaaaagggtaatctctcctt

SEQ ID NO: 653989 - DNA, 22 bp, Artificial Sequence
  chemically synthesized
taaaaagggtaatctctccttt

SEQ ID NO: 653990 - DNA, 22 bp, Artificial Sequence
  chemically synthesized
aaaaagggtaatctctcctttg

SEQ ID NO: 653991 - DNA, 22 bp, Artificial Sequence
  chemically synthesized
aaaagggtaatctctcctttgt

SEQ ID NO: 653992 - DNA, 22 bp, Artificial Sequence
  chemically synthesized
tcctttgtggctgatatggttt

SEQ ID NO: 653993 - DNA, 22 bp, Artificial Sequence
  chemically synthesized
ctttgtggctgatatggtttgg

SEQ ID NO: 653994 - DNA, 22 bp, Artificial Sequence
  chemically synthesized
ggtggggacacagccaaaccat

SEQ ID NO: 653995 - DNA, 22 bp, Artificial Sequence
  chemically synthesized
gggtggggacacagccaaacca

SEQ ID NO: 653996 - DNA, 22 bp, Artificial Sequence
  chemically synthesized
tgtggctgatatggtttggctg

SEQ ID NO: 653997 - DNA, 22 bp, Artificial Sequence
  chemically synthesized
gtggctgatatggtttggctgt

SEQ ID NO: 653998 - DNA, 22 bp, Artificial Sequence
  chemically synthesized
tggctgatatggtttggctgtg

SEQ ID NO: 653999 - DNA, 22 bp, Artificial Sequence
  chemically synthesized
atatggtttggctgtgtcccca

SEQ ID NO: 654000 - DNA, 22 bp, Artificial Sequence
  chemically synthesized
aagatgagatttgggtggggac

SEQ ID NO: 654001 - DNA, 22 bp, Artificial Sequence
  chemically synthesized
ggctgtgtccccacccaaatct

SEQ ID NO: 654002 - DNA, 22 bp, Artificial Sequence
  chemically synthesized
taattcaagatgagatttgggt

SEQ ID NO: 654003 - DNA, 22 bp, Artificial Sequence
  chemically synthesized
gctgtgtccccacccaaatctc

SEQ ID NO: 654004 - DNA, 22 bp, Artificial Sequence
  chemically synthesized
tgtccccacccaaatctcatct

SEQ ID NO: 654005 - DNA, 22 bp, Artificial Sequence
  chemically synthesized
tgggagttataattcaagatga

SEQ ID NO: 654006 - DNA, 22 bp, Artificial Sequence
  chemically synthesized
atcttgaattataactcccaca

SEQ ID NO: 654007 - DNA, 22 bp, Artificial Sequence
  chemically synthesized
gaattataactcccacaattcc

SEQ ID NO: 654008 - DNA, 22 bp, Artificial Sequence
  chemically synthesized
ccacgacatgtgggaattgtgg

SEQ ID NO: 654009 - DNA, 22 bp, Artificial Sequence
  chemically synthesized
aattataactcccacaattccc

SEQ ID NO: 654010 - DNA, 22 bp, Artificial Sequence
  chemically synthesized
ctcccacgacatgtgggaattg

SEQ ID NO: 654011 - DNA, 22 bp, Artificial Sequence
  chemically synthesized
taactcccacaattcccacatg

SEQ ID NO: 654012 - DNA, 22 bp, Artificial Sequence
  chemically synthesized
ccacaattcccacatgtcgtgg

SEQ ID NO: 654013 - DNA, 22 bp, Artificial Sequence
  chemically synthesized
ccaccaggctcctcccacgaca

SEQ ID NO: 654014 - DNA, 22 bp, Artificial Sequence
  chemically synthesized
ccacatgtcgtgggaggagcct

SEQ ID NO: 654015 - DNA, 22 bp, Artificial Sequence
  chemically synthesized
gtgggaggtgattgacttatgg

SEQ ID NO: 654016 - DNA, 22 bp, Artificial Sequence
  chemically synthesized
acttatgggggttggtctttcc

SEQ ID NO: 654017 - DNA, 22 bp, Artificial Sequence
  chemically synthesized
atgggggttggtctttcctgcg

SEQ ID NO: 654018 - DNA, 22 bp, Artificial Sequence
  chemically synthesized
tcacgagaacggcgcaggaaag

SEQ ID NO: 654019 - DNA, 22 bp, Artificial Sequence
  chemically synthesized
tgggggttggtctttcctgcgc

SEQ ID NO: 654020 - DNA, 22 bp, Artificial Sequence
  chemically synthesized
actatcacgagaacggcgcagg

SEQ ID NO: 654021 - DNA, 22 bp, Artificial Sequence
  chemically synthesized
attcactatcacgagaacggcg

SEQ ID NO: 654022 - DNA, 22 bp, Artificial Sequence
  chemically synthesized
gtctttcctgcgccgttctcgt

SEQ ID NO: 654023 - DNA, 22 bp, Artificial Sequence
  chemically synthesized
tcctgcgccgttctcgtgatag

SEQ ID NO: 654024 - DNA, 22 bp, Artificial Sequence
  chemically synthesized
cctgcgccgttctcgtgatagt

SEQ ID NO: 654025 - DNA, 22 bp, Artificial Sequence
  chemically synthesized
ctgcgccgttctcgtgatagtg

SEQ ID NO: 654026 - DNA, 22 bp, Artificial Sequence
  chemically synthesized
cgccgttctcgtgatagtgaat

SEQ ID NO: 654027 - DNA, 22 bp, Artificial Sequence
  chemically synthesized
tcgtgatagtgaatgagtctca

SEQ ID NO: 654028 - DNA, 22 bp, Artificial Sequence
  chemically synthesized
gtgatagtgaatgagtctcaca

SEQ ID NO: 654029 - DNA, 22 bp, Artificial Sequence
  chemically synthesized
aaaccatcagatagtgtgagac

SEQ ID NO: 654030 - DNA, 22 bp, Artificial Sequence
  chemically synthesized
aaaaccatcagatagtgtgaga

SEQ ID NO: 654031 - DNA, 22 bp, Artificial Sequence
  chemically synthesized
taaaaccatcagatagtgtgag

SEQ ID NO: 654032 - DNA, 22 bp, Artificial Sequence
  chemically synthesized
ttaaaaccatcagatagtgtga

SEQ ID NO: 654033 - DNA, 22 bp, Artificial Sequence
  chemically synthesized
ccgtttttaaaaccatcagata

SEQ ID NO: 654034 - DNA, 22 bp, Artificial Sequence
  chemically synthesized
acactatctgatggttttaaaa

SEQ ID NO: 654035 - DNA, 22 bp, Artificial Sequence
  chemically synthesized
tgcagagaaactcccgttttta

SEQ ID NO: 654036 - DNA, 22 bp, Artificial Sequence
  chemically synthesized
tctgatggttttaaaaacggga

SEQ ID NO: 654037 - DNA, 22 bp, Artificial Sequence
  chemically synthesized
gtgcagagaaactcccgttttt

SEQ ID NO: 654038 - DNA, 22 bp, Artificial Sequence
  chemically synthesized
atggttttaaaaacgggagttt

SEQ ID NO: 654039 - DNA, 22 bp, Artificial Sequence
  chemically synthesized
taaaaacgggagtttctctgca

SEQ ID NO: 654040 - DNA, 22 bp, Artificial Sequence
  chemically synthesized
aaaaacgggagtttctctgcac

SEQ ID NO: 654041 - DNA, 22 bp, Artificial Sequence
  chemically synthesized
aaaacgggagtttctctgcaca

SEQ ID NO: 654042 - DNA, 22 bp, Artificial Sequence
  chemically synthesized
ctctgcacaagctctttttttg

SEQ ID NO: 654043 - DNA, 22 bp, Artificial Sequence
  chemically synthesized
gatggcagcaggcaaaaaaaga

SEQ ID NO: 654044 - DNA, 22 bp, Artificial Sequence
  chemically synthesized
tctgcacaagctctttttttgc

SEQ ID NO: 654045 - DNA, 22 bp, Artificial Sequence
  chemically synthesized
tgcacaagctctttttttgcct

SEQ ID NO: 654046 - DNA, 22 bp, Artificial Sequence
  chemically synthesized
cctggatggcagcaggcaaaaa

SEQ ID NO: 654047 - DNA, 22 bp, Artificial Sequence
  chemically synthesized
cacaagctctttttttgcctgc

SEQ ID NO: 654048 - DNA, 22 bp, Artificial Sequence
  chemically synthesized
acctggatggcagcaggcaaaa

SEQ ID NO: 654049 - DNA, 22 bp, Artificial Sequence
  chemically synthesized
tttttttgcctgctgccatcca

SEQ ID NO: 654050 - DNA, 22 bp, Artificial Sequence
  chemically synthesized
tttttgcctgctgccatccagg

SEQ ID NO: 654051 - DNA, 22 bp, Artificial Sequence
  chemically synthesized
ttttgcctgctgccatccaggt

SEQ ID NO: 654052 - DNA, 22 bp, Artificial Sequence
  chemically synthesized
tttgcctgctgccatccaggta

SEQ ID NO: 654053 - DNA, 22 bp, Artificial Sequence
  chemically synthesized
ttgcctgctgccatccaggtaa

SEQ ID NO: 654054 - DNA, 22 bp, Artificial Sequence
  chemically synthesized
tgcctgctgccatccaggtaag

SEQ ID NO: 654055 - DNA, 22 bp, Artificial Sequence
  chemically synthesized
gcctgctgccatccaggtaagt

SEQ ID NO: 654056 - DNA, 22 bp, Artificial Sequence
  chemically synthesized
cctgctgccatccaggtaagtt

SEQ ID NO: 654057 - DNA, 22 bp, Artificial Sequence
  chemically synthesized
ctgccatccaggtaagttgtga

SEQ ID NO: 654058 - DNA, 22 bp, Artificial Sequence
  chemically synthesized
ccatccaggtaagttgtgactt

SEQ ID NO: 654059 - DNA, 22 bp, Artificial Sequence
  chemically synthesized
tgacttgctcctccttgccttc

SEQ ID NO: 654060 - DNA, 22 bp, Artificial Sequence
  chemically synthesized
acaatcatggcagaaggcaagg

SEQ ID NO: 654061 - DNA, 22 bp, Artificial Sequence
  chemically synthesized
gctcctccttgccttctgccat

SEQ ID NO: 654062 - DNA, 22 bp, Artificial Sequence
  chemically synthesized
ctcctccttgccttctgccatg

SEQ ID NO: 654063 - DNA, 22 bp, Artificial Sequence
  chemically synthesized
ctccttgccttctgccatgatt

SEQ ID NO: 654064 - DNA, 22 bp, Artificial Sequence
  chemically synthesized
gggaggcctcacaatcatggca

SEQ ID NO: 654065 - DNA, 22 bp, Artificial Sequence
  chemically synthesized
cttgccttctgccatgattgtg

SEQ ID NO: 654066 - DNA, 22 bp, Artificial Sequence
  chemically synthesized
gccttctgccatgattgtgagg

SEQ ID NO: 654067 - DNA, 22 bp, Artificial Sequence
  chemically synthesized
ccttctgccatgattgtgaggc

SEQ ID NO: 654068 - DNA, 22 bp, Artificial Sequence
  chemically synthesized
cacgtggctggggaggcctcac

SEQ ID NO: 654069 - DNA, 22 bp, Artificial Sequence
  chemically synthesized
ctgccatgattgtgaggcctcc

SEQ ID NO: 654070 - DNA, 22 bp, Artificial Sequence
  chemically synthesized
tgccatgattgtgaggcctccc

SEQ ID NO: 654071 - DNA, 22 bp, Artificial Sequence
  chemically synthesized
ccatgattgtgaggcctcccca

SEQ ID NO: 654072 - DNA, 22 bp, Artificial Sequence
  chemically synthesized
acagttccacgtggctggggag

SEQ ID NO: 654073 - DNA, 22 bp, Artificial Sequence
  chemically synthesized
aacagttccacgtggctgggga

SEQ ID NO: 654074 - DNA, 22 bp, Artificial Sequence
  chemically synthesized
tgaggcctccccagccacgtgg

SEQ ID NO: 654075 - DNA, 22 bp, Artificial Sequence
  chemically synthesized
gacttaacagttccacgtggct

SEQ ID NO: 654076 - DNA, 22 bp, Artificial Sequence
  chemically synthesized
cccagccacgtggaactgttaa

SEQ ID NO: 654077 - DNA, 22 bp, Artificial Sequence
  chemically synthesized
caaaagagagagggtcattgga

SEQ ID NO: 654078 - DNA, 22 bp, Artificial Sequence
  chemically synthesized
acaaaagagagagggtcattgg

SEQ ID NO: 654079 - DNA, 22 bp, Artificial Sequence
  chemically synthesized
ttaagtccaatgaccctctctc

SEQ ID NO: 654080 - DNA, 22 bp, Artificial Sequence
  chemically synthesized
agtccaatgaccctctctcttt

SEQ ID NO: 654081 - DNA, 22 bp, Artificial Sequence
  chemically synthesized
agatggggcaatttacaaaaga

SEQ ID NO: 654082 - DNA, 22 bp, Artificial Sequence
  chemically synthesized
tctcttttgtaaattgccccat

SEQ ID NO: 654083 - DNA, 22 bp, Artificial Sequence
  chemically synthesized
tcttttgtaaattgccccatct

SEQ ID NO: 654084 - DNA, 22 bp, Artificial Sequence
  chemically synthesized
ttttgtaaattgccccatctca

SEQ ID NO: 654085 - DNA, 22 bp, Artificial Sequence
  chemically synthesized
ataaagacatacctgagatggg

SEQ ID NO: 654086 - DNA, 22 bp, Artificial Sequence
  chemically synthesized
ttgtaaattgccccatctcagg

SEQ ID NO: 654087 - DNA, 22 bp, Artificial Sequence
  chemically synthesized
tgtaaattgccccatctcaggt

SEQ ID NO: 654088 - DNA, 22 bp, Artificial Sequence
  chemically synthesized
gtaaattgccccatctcaggta

SEQ ID NO: 654089 - DNA, 22 bp, Artificial Sequence
  chemically synthesized
ctgataaagacatacctgagat

SEQ ID NO: 654090 - DNA, 22 bp, Artificial Sequence
  chemically synthesized
taaattgccccatctcaggtat

SEQ ID NO: 654091 - DNA, 22 bp, Artificial Sequence
  chemically synthesized
acgctgctgataaagacatacc

SEQ ID NO: 654092 - DNA, 22 bp, Artificial Sequence
  chemically synthesized
cacgctgctgataaagacatac

SEQ ID NO: 654093 - DNA, 22 bp, Artificial Sequence
  chemically synthesized
ccccatctcaggtatgtcttta

SEQ ID NO: 654094 - DNA, 22 bp, Artificial Sequence
  chemically synthesized
tcacgctgctgataaagacata

SEQ ID NO: 654095 - DNA, 22 bp, Artificial Sequence
  chemically synthesized
gtccgttttcacgctgctgata

SEQ ID NO: 654096 - DNA, 22 bp, Artificial Sequence
  chemically synthesized
aggtatgtctttatcagcagcg

SEQ ID NO: 654097 - DNA, 22 bp, Artificial Sequence
  chemically synthesized
tattagtccgttttcacgctgc

SEQ ID NO: 654098 - DNA, 22 bp, Artificial Sequence
  chemically synthesized
tatcagcagcgtgaaaacggac

SEQ ID NO: 654099 - DNA, 22 bp, Artificial Sequence
  chemically synthesized
atcagcagcgtgaaaacggact

SEQ ID NO: 654100 - DNA, 22 bp, Artificial Sequence
  chemically synthesized
tcagcagcgtgaaaacggacta

SEQ ID NO: 654101 - DNA, 22 bp, Artificial Sequence
  chemically synthesized
atgaaaatagcaaatgaaaatg

SEQ ID NO: 654102 - DNA, 22 bp, Artificial Sequence
  chemically synthesized
atacagtggccattttcatttg

SEQ ID NO: 654103 - DNA, 22 bp, Artificial Sequence
  chemically synthesized
ctaatgaaaatagcaaatgaaa

SEQ ID NO: 654104 - DNA, 22 bp, Artificial Sequence
  chemically synthesized
tcatttgctattttcattagta

SEQ ID NO: 654105 - DNA, 22 bp, Artificial Sequence
  chemically synthesized
catttgctattttcattagtaa

SEQ ID NO: 654106 - DNA, 22 bp, Artificial Sequence
  chemically synthesized
atttgctattttcattagtaac

SEQ ID NO: 654107 - DNA, 22 bp, Artificial Sequence
  chemically synthesized
tgaagggaacatgttactaatg

SEQ ID NO: 654108 - DNA, 22 bp, Artificial Sequence
  chemically synthesized
atgaagggaacatgttactaat

SEQ ID NO: 654109 - DNA, 22 bp, Artificial Sequence
  chemically synthesized
gctattttcattagtaacatgt

SEQ ID NO: 654110 - DNA, 22 bp, Artificial Sequence
  chemically synthesized
ctattttcattagtaacatgtt

SEQ ID NO: 654111 - DNA, 22 bp, Artificial Sequence
  chemically synthesized
gatttatgaagggaacatgtta

SEQ ID NO: 654112 - DNA, 22 bp, Artificial Sequence
  chemically synthesized
ggatttatgaagggaacatgtt

SEQ ID NO: 654113 - DNA, 22 bp, Artificial Sequence
  chemically synthesized
ttttcattagtaacatgttccc

SEQ ID NO: 654114 - DNA, 22 bp, Artificial Sequence
  chemically synthesized
tggatttatgaagggaacatgt

SEQ ID NO: 654115 - DNA, 22 bp, Artificial Sequence
  chemically synthesized
ttggatttatgaagggaacatg

SEQ ID NO: 654116 - DNA, 22 bp, Artificial Sequence
  chemically synthesized
tttggatttatgaagggaacat

SEQ ID NO: 654117 - DNA, 22 bp, Artificial Sequence
  chemically synthesized
tcattagtaacatgttcccttc

SEQ ID NO: 654118 - DNA, 22 bp, Artificial Sequence
  chemically synthesized
cattagtaacatgttcccttca

SEQ ID NO: 654119 - DNA, 22 bp, Artificial Sequence
  chemically synthesized
attagtaacatgttcccttcat

SEQ ID NO: 654120 - DNA, 22 bp, Artificial Sequence
  chemically synthesized
gtaacatgttcccttcataaat

SEQ ID NO: 654121 - DNA, 22 bp, Artificial Sequence
  chemically synthesized
aaatgattttttggatttatga

SEQ ID NO: 654122 - DNA, 22 bp, Artificial Sequence
  chemically synthesized
ccttcataaatccaaaaaatca

SEQ ID NO: 654123 - DNA, 22 bp, Artificial Sequence
  chemically synthesized
cataaatccaaaaaatcatttc

SEQ ID NO: 654124 - DNA, 22 bp, Artificial Sequence
  chemically synthesized
ataaatccaaaaaatcatttca

SEQ ID NO: 654125 - DNA, 22 bp, Artificial Sequence
  chemically synthesized
acaatggcaatgacattgaaat

SEQ ID NO: 654126 - DNA, 22 bp, Artificial Sequence
  chemically synthesized
ttaacaatggcaatgacattga

SEQ ID NO: 654127 - DNA, 22 bp, Artificial Sequence
  chemically synthesized
caatgtcattgccattgttaat

SEQ ID NO: 654128 - DNA, 22 bp, Artificial Sequence
  chemically synthesized
atgccaatacctattaacaatg

SEQ ID NO: 654129 - DNA, 22 bp, Artificial Sequence
  chemically synthesized
aatgtcattgccattgttaata

SEQ ID NO: 654130 - DNA, 22 bp, Artificial Sequence
  chemically synthesized
ttaatgccaatacctattaaca

SEQ ID NO: 654131 - DNA, 22 bp, Artificial Sequence
  chemically synthesized
tcagctattaatgccaatacct

SEQ ID NO: 654132 - DNA, 22 bp, Artificial Sequence
  chemically synthesized
ccattgttaataggtattggca

SEQ ID NO: 654133 - DNA, 22 bp, Artificial Sequence
  chemically synthesized
agttgtcagctattaatgccaa

SEQ ID NO: 654134 - DNA, 22 bp, Artificial Sequence
  chemically synthesized
ttaataggtattggcattaata

SEQ ID NO: 654135 - DNA, 22 bp, Artificial Sequence
  chemically synthesized
ataggtattggcattaatagct

SEQ ID NO: 654136 - DNA, 22 bp, Artificial Sequence
  chemically synthesized
gaaaagttgagttgtcagctat

SEQ ID NO: 654137 - DNA, 22 bp, Artificial Sequence
  chemically synthesized
gcattaatagctgacaactcaa

SEQ ID NO: 654138 - DNA, 22 bp, Artificial Sequence
  chemically synthesized
atagctgacaactcaacttttc

SEQ ID NO: 654139 - DNA, 22 bp, Artificial Sequence
  chemically synthesized
taacgagggctagaaaagttga

SEQ ID NO: 654140 - DNA, 22 bp, Artificial Sequence
  chemically synthesized
ataacgagggctagaaaagttg

SEQ ID NO: 654141 - DNA, 22 bp, Artificial Sequence
  chemically synthesized
tataacgagggctagaaaagtt

SEQ ID NO: 654142 - DNA, 22 bp, Artificial Sequence
  chemically synthesized
ttataacgagggctagaaaagt

SEQ ID NO: 654143 - DNA, 22 bp, Artificial Sequence
  chemically synthesized
tttataacgagggctagaaaag

SEQ ID NO: 654144 - DNA, 22 bp, Artificial Sequence
  chemically synthesized
acaactcaacttttctagccct

SEQ ID NO: 654145 - DNA, 22 bp, Artificial Sequence
  chemically synthesized
aggctttttataacgagggcta

SEQ ID NO: 654146 - DNA, 22 bp, Artificial Sequence
  chemically synthesized
aacttttctagccctcgttata

SEQ ID NO: 654147 - DNA, 22 bp, Artificial Sequence
  chemically synthesized
ttctagccctcgttataaaaag

SEQ ID NO: 654148 - DNA, 22 bp, Artificial Sequence
  chemically synthesized
caaatgctaaggctttttataa

SEQ ID NO: 654149 - DNA, 22 bp, Artificial Sequence
  chemically synthesized
tctagccctcgttataaaaagc

SEQ ID NO: 654150 - DNA, 22 bp, Artificial Sequence
  chemically synthesized
ccaaatgctaaggctttttata

SEQ ID NO: 654151 - DNA, 22 bp, Artificial Sequence
  chemically synthesized
ctagccctcgttataaaaagcc

SEQ ID NO: 654152 - DNA, 22 bp, Artificial Sequence
  chemically synthesized
tccaaatgctaaggctttttat

SEQ ID NO: 654153 - DNA, 22 bp, Artificial Sequence
  chemically synthesized
tagccctcgttataaaaagcct

SEQ ID NO: 654154 - DNA, 22 bp, Artificial Sequence
  chemically synthesized
gccctcgttataaaaagcctta

SEQ ID NO: 654155 - DNA, 22 bp, Artificial Sequence
  chemically synthesized
gttataaaaagccttagcattt

SEQ ID NO: 654156 - DNA, 22 bp, Artificial Sequence
  chemically synthesized
agcaaatctttccaaatgctaa

SEQ ID NO: 654157 - DNA, 22 bp, Artificial Sequence
  chemically synthesized
taaaaagccttagcatttggaa

SEQ ID NO: 654158 - DNA, 22 bp, Artificial Sequence
  chemically synthesized
aattcagcaaatctttccaaat

SEQ ID NO: 654159 - DNA, 22 bp, Artificial Sequence
  chemically synthesized
aaattcagcaaatctttccaaa

SEQ ID NO: 654160 - DNA, 22 bp, Artificial Sequence
  chemically synthesized
taaatttaaattcagcaaatct

SEQ ID NO: 654161 - DNA, 22 bp, Artificial Sequence
  chemically synthesized
agcatttggaaagatttgctga

SEQ ID NO: 654162 - DNA, 22 bp, Artificial Sequence
  chemically synthesized
ataaatttaaattcagcaaatc

SEQ ID NO: 654163 - DNA, 22 bp, Artificial Sequence
  chemically synthesized
gcatttggaaagatttgctgaa

SEQ ID NO: 654164 - DNA, 22 bp, Artificial Sequence
  chemically synthesized
tataaatttaaattcagcaaat

SEQ ID NO: 654165 - DNA, 22 bp, Artificial Sequence
  chemically synthesized
ttataaatttaaattcagcaaa

SEQ ID NO: 654166 - DNA, 22 bp, Artificial Sequence
  chemically synthesized
ggaaagatttgctgaatttaaa

SEQ ID NO: 654167 - DNA, 22 bp, Artificial Sequence
  chemically synthesized
gaaagatttgctgaatttaaat

SEQ ID NO: 654168 - DNA, 22 bp, Artificial Sequence
  chemically synthesized
aaaaaacagtttttataaattt

SEQ ID NO: 654169 - DNA, 22 bp, Artificial Sequence
  chemically synthesized
gctgaatttaaatttataaaaa

SEQ ID NO: 654170 - DNA, 22 bp, Artificial Sequence
  chemically synthesized
ctgaatttaaatttataaaaac

SEQ ID NO: 654171 - DNA, 22 bp, Artificial Sequence
  chemically synthesized
taattcaaaaaacagtttttat

SEQ ID NO: 654172 - DNA, 22 bp, Artificial Sequence
  chemically synthesized
aatttaaatttataaaaactgt

SEQ ID NO: 654173 - DNA, 22 bp, Artificial Sequence
  chemically synthesized
aaatttataaaaactgtttttt

SEQ ID NO: 654174 - DNA, 22 bp, Artificial Sequence
  chemically synthesized
aatttataaaaactgttttttg

SEQ ID NO: 654175 - DNA, 22 bp, Artificial Sequence
  chemically synthesized
tgtacagactgtaattcaaaaa

SEQ ID NO: 654176 - DNA, 22 bp, Artificial Sequence
  chemically synthesized
ataaaaactgttttttgaatta

SEQ ID NO: 654177 - DNA, 22 bp, Artificial Sequence
  chemically synthesized
gtgtacagactgtaattcaaaa

SEQ ID NO: 654178 - DNA, 22 bp, Artificial Sequence
  chemically synthesized
taaaaactgttttttgaattac

SEQ ID NO: 654179 - DNA, 22 bp, Artificial Sequence
  chemically synthesized
tgtgtacagactgtaattcaaa

SEQ ID NO: 654180 - DNA, 22 bp, Artificial Sequence
  chemically synthesized
aatctttgtgtacagactgtaa

SEQ ID NO: 654181 - DNA, 22 bp, Artificial Sequence
  chemically synthesized
aaatctttgtgtacagactgta

SEQ ID NO: 654182 - DNA, 22 bp, Artificial Sequence
  chemically synthesized
taaatctttgtgtacagactgt

SEQ ID NO: 654183 - DNA, 22 bp, Artificial Sequence
  chemically synthesized
ttttttgaattacagtctgtac

SEQ ID NO: 654184 - DNA, 22 bp, Artificial Sequence
  chemically synthesized
tttgaattacagtctgtacaca

SEQ ID NO: 654185 - DNA, 22 bp, Artificial Sequence
  chemically synthesized
ttgaattacagtctgtacacaa

SEQ ID NO: 654186 - DNA, 22 bp, Artificial Sequence
  chemically synthesized
tgaattacagtctgtacacaaa

SEQ ID NO: 654187 - DNA, 22 bp, Artificial Sequence
  chemically synthesized
tagttttaaatctttgtgtaca

SEQ ID NO: 654188 - DNA, 22 bp, Artificial Sequence
  chemically synthesized
gaattacagtctgtacacaaag

SEQ ID NO: 654189 - DNA, 22 bp, Artificial Sequence
  chemically synthesized
gtagttttaaatctttgtgtac

SEQ ID NO: 654190 - DNA, 22 bp, Artificial Sequence
  chemically synthesized
aattacagtctgtacacaaaga

SEQ ID NO: 654191 - DNA, 22 bp, Artificial Sequence
  chemically synthesized
cttgtagttttaaatctttgtg

SEQ ID NO: 654192 - DNA, 22 bp, Artificial Sequence
  chemically synthesized
tccttgtagttttaaatctttg

SEQ ID NO: 654193 - DNA, 22 bp, Artificial Sequence
  chemically synthesized
cagtctgtacacaaagatttaa

SEQ ID NO: 654194 - DNA, 22 bp, Artificial Sequence
  chemically synthesized
accgttctccttgtagttttaa

SEQ ID NO: 654195 - DNA, 22 bp, Artificial Sequence
  chemically synthesized
tacacaaagatttaaaactaca

SEQ ID NO: 654196 - DNA, 22 bp, Artificial Sequence
  chemically synthesized
actaaccgttctccttgtagtt

SEQ ID NO: 654197 - DNA, 22 bp, Artificial Sequence
  chemically synthesized
accctgactaaccgttctcctt

SEQ ID NO: 654198 - DNA, 22 bp, Artificial Sequence
  chemically synthesized
aaaactacaaggagaacggtta

SEQ ID NO: 654199 - DNA, 22 bp, Artificial Sequence
  chemically synthesized
tctgaccctgactaaccgttct

SEQ ID NO: 654200 - DNA, 22 bp, Artificial Sequence
  chemically synthesized
aaactacaaggagaacggttag

SEQ ID NO: 654201 - DNA, 22 bp, Artificial Sequence
  chemically synthesized
tactgtctgaccctgactaacc

SEQ ID NO: 654202 - DNA, 22 bp, Artificial Sequence
  chemically synthesized
caaggagaacggttagtcaggg

SEQ ID NO: 654203 - DNA, 22 bp, Artificial Sequence
  chemically synthesized
tcctatactgtctgaccctgac

SEQ ID NO: 654204 - DNA, 22 bp, Artificial Sequence
  chemically synthesized
cctgtcctatactgtctgaccc

SEQ ID NO: 654205 - DNA, 22 bp, Artificial Sequence
  chemically synthesized
gtcagggtcagacagtatagga

SEQ ID NO: 654206 - DNA, 22 bp, Artificial Sequence
  chemically synthesized
taataacagatcagggaacagt

SEQ ID NO: 654207 - DNA, 22 bp, Artificial Sequence
  chemically synthesized
aagaaattgtaataacagatca

SEQ ID NO: 654208 - DNA, 22 bp, Artificial Sequence
  chemically synthesized
actgttccctgatctgttatta

SEQ ID NO: 654209 - DNA, 22 bp, Artificial Sequence
  chemically synthesized
ttaaagaaattgtaataacaga

SEQ ID NO: 654210 - DNA, 22 bp, Artificial Sequence
  chemically synthesized
ttccctgatctgttattacaat

SEQ ID NO: 654211 - DNA, 22 bp, Artificial Sequence
  chemically synthesized
cctgatctgttattacaatttc

SEQ ID NO: 654212 - DNA, 22 bp, Artificial Sequence
  chemically synthesized
gaggttgttaaagaaattgtaa

SEQ ID NO: 654213 - DNA, 22 bp, Artificial Sequence
  chemically synthesized
agaggttgttaaagaaattgta

SEQ ID NO: 654214 - DNA, 22 bp, Artificial Sequence
  chemically synthesized
atctgttattacaatttcttta

SEQ ID NO: 654215 - DNA, 22 bp, Artificial Sequence
  chemically synthesized
ttattacaatttctttaacaac

SEQ ID NO: 654216 - DNA, 22 bp, Artificial Sequence
  chemically synthesized
gtagatttagaggttgttaaag

SEQ ID NO: 654217 - DNA, 22 bp, Artificial Sequence
  chemically synthesized
ggtagatttagaggttgttaaa

SEQ ID NO: 654218 - DNA, 22 bp, Artificial Sequence
  chemically synthesized
ttacaatttctttaacaacctc

SEQ ID NO: 654219 - DNA, 22 bp, Artificial Sequence
  chemically synthesized
caatttctttaacaacctctaa

SEQ ID NO: 654220 - DNA, 22 bp, Artificial Sequence
  chemically synthesized
atgcccttggtagatttagagg

SEQ ID NO: 654221 - DNA, 22 bp, Artificial Sequence
  chemically synthesized
ctttaacaacctctaaatctac

SEQ ID NO: 654222 - DNA, 22 bp, Artificial Sequence
  chemically synthesized
tttaacaacctctaaatctacc

SEQ ID NO: 654223 - DNA, 22 bp, Artificial Sequence
  chemically synthesized
cactgatgcccttggtagattt

SEQ ID NO: 654224 - DNA, 22 bp, Artificial Sequence
  chemically synthesized
taacaacctctaaatctaccaa

SEQ ID NO: 654225 - DNA, 22 bp, Artificial Sequence
  chemically synthesized
aacaacctctaaatctaccaag

SEQ ID NO: 654226 - DNA, 22 bp, Artificial Sequence
  chemically synthesized
acaacctctaaatctaccaagg

SEQ ID NO: 654227 - DNA, 22 bp, Artificial Sequence
  chemically synthesized
taaatctaccaagggcatcagt

SEQ ID NO: 654228 - DNA, 22 bp, Artificial Sequence
  chemically synthesized
tgtaaaatattccactgatgcc

SEQ ID NO: 654229 - DNA, 22 bp, Artificial Sequence
  chemically synthesized
aatctaccaagggcatcagtgg

SEQ ID NO: 654230 - DNA, 22 bp, Artificial Sequence
  chemically synthesized
atgtaaaatattccactgatgc

SEQ ID NO: 654231 - DNA, 22 bp, Artificial Sequence
  chemically synthesized
ttatgtaaaatattccactgat

SEQ ID NO: 654232 - DNA, 22 bp, Artificial Sequence
  chemically synthesized
tcttatgtaaaatattccactg

SEQ ID NO: 654233 - DNA, 22 bp, Artificial Sequence
  chemically synthesized
ccaagggcatcagtggaatatt

SEQ ID NO: 654234 - DNA, 22 bp, Artificial Sequence
  chemically synthesized
tctcttatgtaaaatattccac

SEQ ID NO: 654235 - DNA, 22 bp, Artificial Sequence
  chemically synthesized
ctctcttatgtaaaatattcca

SEQ ID NO: 654236 - DNA, 22 bp, Artificial Sequence
  chemically synthesized
gtgcagacttctctcttatgta

SEQ ID NO: 654237 - DNA, 22 bp, Artificial Sequence
  chemically synthesized
ctggtgcagacttctctcttat

SEQ ID NO: 654238 - DNA, 22 bp, Artificial Sequence
  chemically synthesized
tgctggtgcagacttctctctt

SEQ ID NO: 654239 - DNA, 22 bp, Artificial Sequence
  chemically synthesized
tctgctggtgcagacttctctc

SEQ ID NO: 654240 - DNA, 22 bp, Artificial Sequence
  chemically synthesized
tacataagagagaagtctgcac

SEQ ID NO: 654241 - DNA, 22 bp, Artificial Sequence
  chemically synthesized
tgttctctgctggtgcagactt

SEQ ID NO: 654242 - DNA, 22 bp, Artificial Sequence
  chemically synthesized
acataagagagaagtctgcacc

SEQ ID NO: 654243 - DNA, 22 bp, Artificial Sequence
  chemically synthesized
atgttctctgctggtgcagact

SEQ ID NO: 654244 - DNA, 22 bp, Artificial Sequence
  chemically synthesized
cataagagagaagtctgcacca

SEQ ID NO: 654245 - DNA, 22 bp, Artificial Sequence
  chemically synthesized
tatgttctctgctggtgcagac

SEQ ID NO: 654246 - DNA, 22 bp, Artificial Sequence
  chemically synthesized
ttatgttctctgctggtgcaga

SEQ ID NO: 654247 - DNA, 22 bp, Artificial Sequence
  chemically synthesized
cttttatgttctctgctggtgc

SEQ ID NO: 654248 - DNA, 22 bp, Artificial Sequence
  chemically synthesized
ctccttttatgttctctgctgg

SEQ ID NO: 654249 - DNA, 22 bp, Artificial Sequence
  chemically synthesized
ttcctccttttatgttctctgc

SEQ ID NO: 654250 - DNA, 22 bp, Artificial Sequence
  chemically synthesized
gttcctccttttatgttctctg

SEQ ID NO: 654251 - DNA, 22 bp, Artificial Sequence
  chemically synthesized
ttgttcctccttttatgttctc

SEQ ID NO: 654252 - DNA, 22 bp, Artificial Sequence
  chemically synthesized
ttcttgttcctccttttatgtt

SEQ ID NO: 654253 - DNA, 22 bp, Artificial Sequence
  chemically synthesized
caccagcagagaacataaaagg

SEQ ID NO: 654254 - DNA, 22 bp, Artificial Sequence
  chemically synthesized
gttcttgttcctccttttatgt

SEQ ID NO: 654255 - DNA, 22 bp, Artificial Sequence
  chemically synthesized
cagcttgttcttgttcctcctt

SEQ ID NO: 654256 - DNA, 22 bp, Artificial Sequence
  chemically synthesized
acagcttgttcttgttcctcct

SEQ ID NO: 654257 - DNA, 22 bp, Artificial Sequence
  chemically synthesized
tacagcttgttcttgttcctcc

SEQ ID NO: 654258 - DNA, 22 bp, Artificial Sequence
  chemically synthesized
tttacagcttgttcttgttcct

SEQ ID NO: 654259 - DNA, 22 bp, Artificial Sequence
  chemically synthesized
atattctttacagcttgttctt

SEQ ID NO: 654260 - DNA, 22 bp, Artificial Sequence
  chemically synthesized
gaagaagagtcattaatattct

SEQ ID NO: 654261 - DNA, 22 bp, Artificial Sequence
  chemically synthesized
ggaagaagagtcattaatattc

SEQ ID NO: 654262 - DNA, 22 bp, Artificial Sequence
  chemically synthesized
tttggaagaagagtcattaata

SEQ ID NO: 654263 - DNA, 22 bp, Artificial Sequence
  chemically synthesized
taaagaatattaatgactcttc

SEQ ID NO: 654264 - DNA, 22 bp, Artificial Sequence
  chemically synthesized
ggattgtttggaagaagagtca

SEQ ID NO: 654265 - DNA, 22 bp, Artificial Sequence
  chemically synthesized
ataaaaattgggattgtttgga

SEQ ID NO: 654266 - DNA, 22 bp, Artificial Sequence
  chemically synthesized
atgactcttcttccaaacaatc

SEQ ID NO: 654267 - DNA, 22 bp, Artificial Sequence
  chemically synthesized
cataaaaattgggattgtttgg

SEQ ID NO: 654268 - DNA, 22 bp, Artificial Sequence
  chemically synthesized
tcataaaaattgggattgtttg

SEQ ID NO: 654269 - DNA, 22 bp, Artificial Sequence
  chemically synthesized
attttcataaaaattgggattg

SEQ ID NO: 654270 - DNA, 22 bp, Artificial Sequence
  chemically synthesized
gattttcataaaaattgggatt

SEQ ID NO: 654271 - DNA, 22 bp, Artificial Sequence
  chemically synthesized
ttcttccaaacaatcccaattt

SEQ ID NO: 654272 - DNA, 22 bp, Artificial Sequence
  chemically synthesized
cttccaaacaatcccaattttt

SEQ ID NO: 654273 - DNA, 22 bp, Artificial Sequence
  chemically synthesized
ttccaaacaatcccaattttta

SEQ ID NO: 654274 - DNA, 22 bp, Artificial Sequence
  chemically synthesized
atttgattttcataaaaattgg

SEQ ID NO: 654275 - DNA, 22 bp, Artificial Sequence
  chemically synthesized
ccaaacaatcccaatttttatg

SEQ ID NO: 654276 - DNA, 22 bp, Artificial Sequence
  chemically synthesized
caaacaatcccaatttttatga

SEQ ID NO: 654277 - DNA, 22 bp, Artificial Sequence
  chemically synthesized
tcactcatttgattttcataaa

SEQ ID NO: 654278 - DNA, 22 bp, Artificial Sequence
  chemically synthesized
atcactcatttgattttcataa

SEQ ID NO: 654279 - DNA, 22 bp, Artificial Sequence
  chemically synthesized
tatcactcatttgattttcata

SEQ ID NO: 654280 - DNA, 22 bp, Artificial Sequence
  chemically synthesized
ttatcactcatttgattttcat

SEQ ID NO: 654281 - DNA, 22 bp, Artificial Sequence
  chemically synthesized
tttatcactcatttgattttca

SEQ ID NO: 654282 - DNA, 22 bp, Artificial Sequence
  chemically synthesized
ttatgaaaatcaaatgagtgat

SEQ ID NO: 654283 - DNA, 22 bp, Artificial Sequence
  chemically synthesized
tagagtctttttatcactcatt

SEQ ID NO: 654284 - DNA, 22 bp, Artificial Sequence
  chemically synthesized
tatgaaaatcaaatgagtgata

SEQ ID NO: 654285 - DNA, 22 bp, Artificial Sequence
  chemically synthesized
atagagtctttttatcactcat

SEQ ID NO: 654286 - DNA, 22 bp, Artificial Sequence
  chemically synthesized
atgaaaatcaaatgagtgataa

SEQ ID NO: 654287 - DNA, 22 bp, Artificial Sequence
  chemically synthesized
tatagagtctttttatcactca

SEQ ID NO: 654288 - DNA, 22 bp, Artificial Sequence
  chemically synthesized
tgaaaatcaaatgagtgataaa

SEQ ID NO: 654289 - DNA, 22 bp, Artificial Sequence
  chemically synthesized
tatagttttatagagtcttttt

SEQ ID NO: 654290 - DNA, 22 bp, Artificial Sequence
  chemically synthesized
gtatagttttatagagtctttt

SEQ ID NO: 654291 - DNA, 22 bp, Artificial Sequence
  chemically synthesized
tgtatagttttatagagtcttt

SEQ ID NO: 654292 - DNA, 22 bp, Artificial Sequence
  chemically synthesized
catgcaggttttgtatagtttt

SEQ ID NO: 654293 - DNA, 22 bp, Artificial Sequence
  chemically synthesized
ttacatgcaggttttgtatagt

SEQ ID NO: 654294 - DNA, 22 bp, Artificial Sequence
  chemically synthesized
gttacatgcaggttttgtatag

SEQ ID NO: 654295 - DNA, 22 bp, Artificial Sequence
  chemically synthesized
tttgttacatgcaggttttgta

SEQ ID NO: 654296 - DNA, 22 bp, Artificial Sequence
  chemically synthesized
atttgttacatgcaggttttgt

SEQ ID NO: 654297 - DNA, 22 bp, Artificial Sequence
  chemically synthesized
tataaaactatacaaaacctgc

SEQ ID NO: 654298 - DNA, 22 bp, Artificial Sequence
  chemically synthesized
tatttgttacatgcaggttttg

SEQ ID NO: 654299 - DNA, 22 bp, Artificial Sequence
  chemically synthesized
taaaactatacaaaacctgcat

SEQ ID NO: 654300 - DNA, 22 bp, Artificial Sequence
  chemically synthesized
ttttatttgttacatgcaggtt

SEQ ID NO: 654301 - DNA, 22 bp, Artificial Sequence
  chemically synthesized
tgttttatttgttacatgcagg

SEQ ID NO: 654302 - DNA, 22 bp, Artificial Sequence
  chemically synthesized
ctgttttatttgttacatgcag

SEQ ID NO: 654303 - DNA, 22 bp, Artificial Sequence
  chemically synthesized
cttctgttttatttgttacatg

SEQ ID NO: 654304 - DNA, 22 bp, Artificial Sequence
  chemically synthesized
tacaaaacctgcatgtaacaaa

SEQ ID NO: 654305 - DNA, 22 bp, Artificial Sequence
  chemically synthesized
ccttctgttttatttgttacat

SEQ ID NO: 654306 - DNA, 22 bp, Artificial Sequence
  chemically synthesized
catgtaacaaataaaacagaag

SEQ ID NO: 654307 - DNA, 22 bp, Artificial Sequence
  chemically synthesized
agaggatcaaaatgtcaccttc

SEQ ID NO: 654308 - DNA, 22 bp, Artificial Sequence
  chemically synthesized
tgtctaagaggatcaaaatgtc

SEQ ID NO: 654309 - DNA, 22 bp, Artificial Sequence
  chemically synthesized
gtgtctaagaggatcaaaatgt

SEQ ID NO: 654310 - DNA, 22 bp, Artificial Sequence
  chemically synthesized
tgatcctcttagacacaagata

SEQ ID NO: 654311 - DNA, 22 bp, Artificial Sequence
  chemically synthesized
gatcctcttagacacaagatac

SEQ ID NO: 654312 - DNA, 22 bp, Artificial Sequence
  chemically synthesized
atcctcttagacacaagatact

SEQ ID NO: 654313 - DNA, 22 bp, Artificial Sequence
  chemically synthesized
aaaggtaaaacccaagtatctt

SEQ ID NO: 654314 - DNA, 22 bp, Artificial Sequence
  chemically synthesized
ttagacacaagatacttgggtt

SEQ ID NO: 654315 - DNA, 22 bp, Artificial Sequence
  chemically synthesized
agacacaagatacttgggtttt

SEQ ID NO: 654316 - DNA, 22 bp, Artificial Sequence
  chemically synthesized
gacacaagatacttgggtttta

SEQ ID NO: 654317 - DNA, 22 bp, Artificial Sequence
  chemically synthesized
agtaactcaaaggtaaaaccca

SEQ ID NO: 654318 - DNA, 22 bp, Artificial Sequence
  chemically synthesized
ctcagtaactcaaaggtaaaac

SEQ ID NO: 654319 - DNA, 22 bp, Artificial Sequence
  chemically synthesized
cctcagtaactcaaaggtaaaa

SEQ ID NO: 654320 - DNA, 22 bp, Artificial Sequence
  chemically synthesized
tagtttcctcagtaactcaaag

SEQ ID NO: 654321 - DNA, 22 bp, Artificial Sequence
  chemically synthesized
gggttttacctttgagttactg

SEQ ID NO: 654322 - DNA, 22 bp, Artificial Sequence
  chemically synthesized
ggttttacctttgagttactga

SEQ ID NO: 654323 - DNA, 22 bp, Artificial Sequence
  chemically synthesized
tacctttgagttactgaggaaa

SEQ ID NO: 654324 - DNA, 22 bp, Artificial Sequence
  chemically synthesized
acctttgagttactgaggaaac

SEQ ID NO: 654325 - DNA, 22 bp, Artificial Sequence
  chemically synthesized
cctttgagttactgaggaaact

SEQ ID NO: 654326 - DNA, 22 bp, Artificial Sequence
  chemically synthesized
cgtccgtacactatagtttcct

SEQ ID NO: 654327 - DNA, 22 bp, Artificial Sequence
  chemically synthesized
gcgtccgtacactatagtttcc

SEQ ID NO: 654328 - DNA, 22 bp, Artificial Sequence
  chemically synthesized
tgagttactgaggaaactatag

SEQ ID NO: 654329 - DNA, 22 bp, Artificial Sequence
  chemically synthesized
gagttactgaggaaactatagt

SEQ ID NO: 654330 - DNA, 22 bp, Artificial Sequence
  chemically synthesized
agttactgaggaaactatagtg

SEQ ID NO: 654331 - DNA, 22 bp, Artificial Sequence
  chemically synthesized
ctgaggaaactatagtgtacgg

SEQ ID NO: 654332 - DNA, 22 bp, Artificial Sequence
  chemically synthesized
aggaaactatagtgtacggacg

SEQ ID NO: 654333 - DNA, 22 bp, Artificial Sequence
  chemically synthesized
atgtaaatgatcccttgcgtcc

SEQ ID NO: 654334 - DNA, 22 bp, Artificial Sequence
  chemically synthesized
tagtgtacggacgcaagggatc

SEQ ID NO: 654335 - DNA, 22 bp, Artificial Sequence
  chemically synthesized
tgtacaacctcatgtaaatgat

SEQ ID NO: 654336 - DNA, 22 bp, Artificial Sequence
  chemically synthesized
acatgaggttgtacacaatggt

SEQ ID NO: 654337 - DNA, 22 bp, Artificial Sequence
  chemically synthesized
catgaggttgtacacaatggtt

SEQ ID NO: 654338 - DNA, 22 bp, Artificial Sequence
  chemically synthesized
agagcaagatgtgaaaaaccat

SEQ ID NO: 654339 - DNA, 22 bp, Artificial Sequence
  chemically synthesized
tacacaatggtttttcacatct

SEQ ID NO: 654340 - DNA, 22 bp, Artificial Sequence
  chemically synthesized
aatggaaacacacactaagagc

SEQ ID NO: 654341 - DNA, 22 bp, Artificial Sequence
  chemically synthesized
ttcacatcttgctcttagtgtg

SEQ ID NO: 654342 - DNA, 22 bp, Artificial Sequence
  chemically synthesized
tgaatggaaacacacactaaga

SEQ ID NO: 654343 - DNA, 22 bp, Artificial Sequence
  chemically synthesized
tcacatcttgctcttagtgtgt

SEQ ID NO: 654344 - DNA, 22 bp, Artificial Sequence
  chemically synthesized
cacatcttgctcttagtgtgtg

SEQ ID NO: 654345 - DNA, 22 bp, Artificial Sequence
  chemically synthesized
tctgaatggaaacacacactaa

SEQ ID NO: 654346 - DNA, 22 bp, Artificial Sequence
  chemically synthesized
acatcttgctcttagtgtgtgt

SEQ ID NO: 654347 - DNA, 22 bp, Artificial Sequence
  chemically synthesized
gctcttagtgtgtgtttccatt

SEQ ID NO: 654348 - DNA, 22 bp, Artificial Sequence
  chemically synthesized
ctcttagtgtgtgtttccattc

SEQ ID NO: 654349 - DNA, 22 bp, Artificial Sequence
  chemically synthesized
ttagtgtgtgtttccattcaga

SEQ ID NO: 654350 - DNA, 22 bp, Artificial Sequence
  chemically synthesized
agtgtgtgtttccattcagaga

SEQ ID NO: 654351 - DNA, 22 bp, Artificial Sequence
  chemically synthesized
gtgtgtgtttccattcagagaa

SEQ ID NO: 654352 - DNA, 22 bp, Artificial Sequence
  chemically synthesized
acatgagaccaagtgttctctg

SEQ ID NO: 654353 - DNA, 22 bp, Artificial Sequence
  chemically synthesized
cacatgagaccaagtgttctct

SEQ ID NO: 654354 - DNA, 22 bp, Artificial Sequence
  chemically synthesized
ccattcagagaacacttggtct

SEQ ID NO: 654355 - DNA, 22 bp, Artificial Sequence
  chemically synthesized
cattcagagaacacttggtctc

SEQ ID NO: 654356 - DNA, 22 bp, Artificial Sequence
  chemically synthesized
agagaacacttggtctcatgtg

SEQ ID NO: 654357 - DNA, 22 bp, Artificial Sequence
  chemically synthesized
tacatagagtgtggcatttcac

SEQ ID NO: 654358 - DNA, 22 bp, Artificial Sequence
  chemically synthesized
gtacatagagtgtggcatttca

SEQ ID NO: 654359 - DNA, 22 bp, Artificial Sequence
  chemically synthesized
ggtctcatgtgaaatgccacac

SEQ ID NO: 654360 - DNA, 22 bp, Artificial Sequence
  chemically synthesized
gtctcatgtgaaatgccacact

SEQ ID NO: 654361 - DNA, 22 bp, Artificial Sequence
  chemically synthesized
atgtgaaatgccacactctatg

SEQ ID NO: 654362 - DNA, 22 bp, Artificial Sequence
  chemically synthesized
taagatatagaaaacagtcttg

SEQ ID NO: 654363 - DNA, 22 bp, Artificial Sequence
  chemically synthesized
tatgtacaagactgttttctat

SEQ ID NO: 654364 - DNA, 22 bp, Artificial Sequence
  chemically synthesized
tgtacaagactgttttctatat

SEQ ID NO: 654365 - DNA, 22 bp, Artificial Sequence
  chemically synthesized
tatcagagctataagatataga

SEQ ID NO: 654366 - DNA, 22 bp, Artificial Sequence
  chemically synthesized
gtatcagagctataagatatag

SEQ ID NO: 654367 - DNA, 22 bp, Artificial Sequence
  chemically synthesized
ttgtatcagagctataagatat

SEQ ID NO: 654368 - DNA, 22 bp, Artificial Sequence
  chemically synthesized
ttttctatatcttatagctctg

SEQ ID NO: 654369 - DNA, 22 bp, Artificial Sequence
  chemically synthesized
tctatatcttatagctctgata

SEQ ID NO: 654370 - DNA, 22 bp, Artificial Sequence
  chemically synthesized
ctatatcttatagctctgatac

SEQ ID NO: 654371 - DNA, 22 bp, Artificial Sequence
  chemically synthesized
tatatcttatagctctgataca

SEQ ID NO: 654372 - DNA, 22 bp, Artificial Sequence
  chemically synthesized
tatcttatagctctgatacaag

SEQ ID NO: 654373 - DNA, 22 bp, Artificial Sequence
  chemically synthesized
cgggtaacaactcttgtatcag

SEQ ID NO: 654374 - DNA, 22 bp, Artificial Sequence
  chemically synthesized
ccgggtaacaactcttgtatca

SEQ ID NO: 654375 - DNA, 22 bp, Artificial Sequence
  chemically synthesized
atagctctgatacaagagttgt

SEQ ID NO: 654376 - DNA, 22 bp, Artificial Sequence
  chemically synthesized
atcttccgggtaacaactcttg

SEQ ID NO: 654377 - DNA, 22 bp, Artificial Sequence
  chemically synthesized
tagctctgatacaagagttgtt

SEQ ID NO: 654378 - DNA, 22 bp, Artificial Sequence
  chemically synthesized
cctgatcttccgggtaacaact

SEQ ID NO: 654379 - DNA, 22 bp, Artificial Sequence
  chemically synthesized
acctgatcttccgggtaacaac

SEQ ID NO: 654380 - DNA, 22 bp, Artificial Sequence
  chemically synthesized
tgatacaagagttgttacccgg

SEQ ID NO: 654381 - DNA, 22 bp, Artificial Sequence
  chemically synthesized
atacaagagttgttacccggaa

SEQ ID NO: 654382 - DNA, 22 bp, Artificial Sequence
  chemically synthesized
ttacccggaagatcaggtaaga

SEQ ID NO: 654383 - DNA, 22 bp, Artificial Sequence
  chemically synthesized
cccggaagatcaggtaagactt

SEQ ID NO: 654384 - DNA, 22 bp, Artificial Sequence
  chemically synthesized
gccatgatcagcaaagtcttac

SEQ ID NO: 654385 - DNA, 22 bp, Artificial Sequence
  chemically synthesized
ggccatgatcagcaaagtctta

SEQ ID NO: 654386 - DNA, 22 bp, Artificial Sequence
  chemically synthesized
aaagcttggccatgatcagcaa

SEQ ID NO: 654387 - DNA, 22 bp, Artificial Sequence
  chemically synthesized
caaagcttggccatgatcagca

SEQ ID NO: 654388 - DNA, 22 bp, Artificial Sequence
  chemically synthesized
tttcaaagcttggccatgatca

SEQ ID NO: 654389 - DNA, 22 bp, Artificial Sequence
  chemically synthesized
atttcaaagcttggccatgatc

SEQ ID NO: 654390 - DNA, 22 bp, Artificial Sequence
  chemically synthesized
tacttatttcaaagcttggcca

SEQ ID NO: 654391 - DNA, 22 bp, Artificial Sequence
  chemically synthesized
tgctgatcatggccaagctttg

SEQ ID NO: 654392 - DNA, 22 bp, Artificial Sequence
  chemically synthesized
ttgtacttatttcaaagcttgg

SEQ ID NO: 654393 - DNA, 22 bp, Artificial Sequence
  chemically synthesized
gctgatcatggccaagctttga

SEQ ID NO: 654394 - DNA, 22 bp, Artificial Sequence
  chemically synthesized
ctgatcatggccaagctttgaa

SEQ ID NO: 654395 - DNA, 22 bp, Artificial Sequence
  chemically synthesized
atcatggccaagctttgaaata

SEQ ID NO: 654396 - DNA, 22 bp, Artificial Sequence
  chemically synthesized
tgaaataagtacaataatccat

SEQ ID NO: 654397 - DNA, 22 bp, Artificial Sequence
  chemically synthesized
gaaataagtacaataatccatt

SEQ ID NO: 654398 - DNA, 22 bp, Artificial Sequence
  chemically synthesized
aaataagtacaataatccattt

SEQ ID NO: 654399 - DNA, 22 bp, Artificial Sequence
  chemically synthesized
taaaggccgaaagggaaatgga

SEQ ID NO: 654400 - DNA, 22 bp, Artificial Sequence
  chemically synthesized
aatgttataaaggccgaaaggg

SEQ ID NO: 654401 - DNA, 22 bp, Artificial Sequence
  chemically synthesized
tgctaaatgttataaaggccga

SEQ ID NO: 654402 - DNA, 22 bp, Artificial Sequence
  chemically synthesized
tatgctaaatgttataaaggcc

SEQ ID NO: 654403 - DNA, 22 bp, Artificial Sequence
  chemically synthesized
attctatgctaaatgttataaa

SEQ ID NO: 654404 - DNA, 22 bp, Artificial Sequence
  chemically synthesized
ccctttcggcctttataacatt

SEQ ID NO: 654405 - DNA, 22 bp, Artificial Sequence
  chemically synthesized
gattctatgctaaatgttataa

SEQ ID NO: 654406 - DNA, 22 bp, Artificial Sequence
  chemically synthesized
cctttcggcctttataacattt

SEQ ID NO: 654407 - DNA, 22 bp, Artificial Sequence
  chemically synthesized
tgattctatgctaaatgttata

SEQ ID NO: 654408 - DNA, 22 bp, Artificial Sequence
  chemically synthesized
tcggcctttataacatttagca

SEQ ID NO: 654409 - DNA, 22 bp, Artificial Sequence
  chemically synthesized
cggcctttataacatttagcat

SEQ ID NO: 654410 - DNA, 22 bp, Artificial Sequence
  chemically synthesized
ggcctttataacatttagcata

SEQ ID NO: 654411 - DNA, 22 bp, Artificial Sequence
  chemically synthesized
agtgtctttgattctatgctaa

SEQ ID NO: 654412 - DNA, 22 bp, Artificial Sequence
  chemically synthesized
tataacatttagcatagaatca

SEQ ID NO: 654413 - DNA, 22 bp, Artificial Sequence
  chemically synthesized
ataacatttagcatagaatcaa

SEQ ID NO: 654414 - DNA, 22 bp, Artificial Sequence
  chemically synthesized
taacatttagcatagaatcaaa

SEQ ID NO: 654415 - DNA, 22 bp, Artificial Sequence
  chemically synthesized
tccctaagtgtctttgattcta

SEQ ID NO: 654416 - DNA, 22 bp, Artificial Sequence
  chemically synthesized
atccctaagtgtctttgattct

SEQ ID NO: 654417 - DNA, 22 bp, Artificial Sequence
  chemically synthesized
cttatccctaagtgtctttgat

SEQ ID NO: 654418 - DNA, 22 bp, Artificial Sequence
  chemically synthesized
agcatagaatcaaagacactta

SEQ ID NO: 654419 - DNA, 22 bp, Artificial Sequence
  chemically synthesized
gcatagaatcaaagacacttag

SEQ ID NO: 654420 - DNA, 22 bp, Artificial Sequence
  chemically synthesized
aaaagttacttatccctaagtg

SEQ ID NO: 654421 - DNA, 22 bp, Artificial Sequence
  chemically synthesized
tctcaaaagttacttatcccta

SEQ ID NO: 654422 - DNA, 22 bp, Artificial Sequence
  chemically synthesized
aaacaggttatctcaaaagtta

SEQ ID NO: 654423 - DNA, 22 bp, Artificial Sequence
  chemically synthesized
agggataagtaacttttgagat

SEQ ID NO: 654424 - DNA, 22 bp, Artificial Sequence
  chemically synthesized
gggataagtaacttttgagata

SEQ ID NO: 654425 - DNA, 22 bp, Artificial Sequence
  chemically synthesized
taacataaagttaaaacaggtt

SEQ ID NO: 654426 - DNA, 22 bp, Artificial Sequence
  chemically synthesized
tctgtaacataaagttaaaaca

SEQ ID NO: 654427 - DNA, 22 bp, Artificial Sequence
  chemically synthesized
ttgagataacctgttttaactt

SEQ ID NO: 654428 - DNA, 22 bp, Artificial Sequence
  chemically synthesized
atctgtaacataaagttaaaac

SEQ ID NO: 654429 - DNA, 22 bp, Artificial Sequence
  chemically synthesized
tgagataacctgttttaacttt

SEQ ID NO: 654430 - DNA, 22 bp, Artificial Sequence
  chemically synthesized
gagataacctgttttaacttta

SEQ ID NO: 654431 - DNA, 22 bp, Artificial Sequence
  chemically synthesized
ttatctgtaacataaagttaaa

SEQ ID NO: 654432 - DNA, 22 bp, Artificial Sequence
  chemically synthesized
agataacctgttttaactttat

SEQ ID NO: 654433 - DNA, 22 bp, Artificial Sequence
  chemically synthesized
cttatctgtaacataaagttaa

SEQ ID NO: 654434 - DNA, 22 bp, Artificial Sequence
  chemically synthesized
tcttatctgtaacataaagtta

SEQ ID NO: 654435 - DNA, 22 bp, Artificial Sequence
  chemically synthesized
ttcttatctgtaacataaagtt

SEQ ID NO: 654436 - DNA, 22 bp, Artificial Sequence
  chemically synthesized
ggccttttcttatctgtaacat

SEQ ID NO: 654437 - DNA, 22 bp, Artificial Sequence
  chemically synthesized
gggccttttcttatctgtaaca

SEQ ID NO: 654438 - DNA, 22 bp, Artificial Sequence
  chemically synthesized
ttttaactttatgttacagata

SEQ ID NO: 654439 - DNA, 22 bp, Artificial Sequence
  chemically synthesized
tgggccttttcttatctgtaac

SEQ ID NO: 654440 - DNA, 22 bp, Artificial Sequence
  chemically synthesized
tttgggccttttcttatctgta

SEQ ID NO: 654441 - DNA, 22 bp, Artificial Sequence
  chemically synthesized
taactttatgttacagataaga

SEQ ID NO: 654442 - DNA, 22 bp, Artificial Sequence
  chemically synthesized
aactttatgttacagataagaa

SEQ ID NO: 654443 - DNA, 22 bp, Artificial Sequence
  chemically synthesized
actttatgttacagataagaaa

SEQ ID NO: 654444 - DNA, 22 bp, Artificial Sequence
  chemically synthesized
acctctttgggccttttcttat

SEQ ID NO: 654445 - DNA, 22 bp, Artificial Sequence
  chemically synthesized
aacctctttgggccttttctta

SEQ ID NO: 654446 - DNA, 22 bp, Artificial Sequence
  chemically synthesized
tatgttacagataagaaaaggc

SEQ ID NO: 654447 - DNA, 22 bp, Artificial Sequence
  chemically synthesized
atgttacagataagaaaaggcc

SEQ ID NO: 654448 - DNA, 22 bp, Artificial Sequence
  chemically synthesized
tgttacagataagaaaaggccc

SEQ ID NO: 654449 - DNA, 22 bp, Artificial Sequence
  chemically synthesized
cttaacctctttgggccttttc

SEQ ID NO: 654450 - DNA, 22 bp, Artificial Sequence
  chemically synthesized
ccttaacctctttgggcctttt

SEQ ID NO: 654451 - DNA, 22 bp, Artificial Sequence
  chemically synthesized
tttccttaacctctttgggcct

SEQ ID NO: 654452 - DNA, 22 bp, Artificial Sequence
  chemically synthesized
cagataagaaaaggcccaaaga

SEQ ID NO: 654453 - DNA, 22 bp, Artificial Sequence
  chemically synthesized
agctgtttccttaacctctttg

SEQ ID NO: 654454 - DNA, 22 bp, Artificial Sequence
  chemically synthesized
aagctgtttccttaacctcttt

SEQ ID NO: 654455 - DNA, 22 bp, Artificial Sequence
  chemically synthesized
aaatcgtagataatcttaagct

SEQ ID NO: 654456 - DNA, 22 bp, Artificial Sequence
  chemically synthesized
aggaaacagcttaagattatct

SEQ ID NO: 654457 - DNA, 22 bp, Artificial Sequence
  chemically synthesized
agtattaaaatcgtagataatc

SEQ ID NO: 654458 - DNA, 22 bp, Artificial Sequence
  chemically synthesized
cagtattaaaatcgtagataat

SEQ ID NO: 654459 - DNA, 22 bp, Artificial Sequence
  chemically synthesized
aagattatctacgattttaata

SEQ ID NO: 654460 - DNA, 22 bp, Artificial Sequence
  chemically synthesized
agattatctacgattttaatac

SEQ ID NO: 654461 - DNA, 22 bp, Artificial Sequence
  chemically synthesized
agcatatatttcagtattaaaa

SEQ ID NO: 654462 - DNA, 22 bp, Artificial Sequence
  chemically synthesized
aagcatatatttcagtattaaa

SEQ ID NO: 654463 - DNA, 22 bp, Artificial Sequence
  chemically synthesized
taagcatatatttcagtattaa

SEQ ID NO: 654464 - DNA, 22 bp, Artificial Sequence
  chemically synthesized
tctacgattttaatactgaaat

SEQ ID NO: 654465 - DNA, 22 bp, Artificial Sequence
  chemically synthesized
ttttaagcatatatttcagtat

SEQ ID NO: 654466 - DNA, 22 bp, Artificial Sequence
  chemically synthesized
cgattttaatactgaaatatat

SEQ ID NO: 654467 - DNA, 22 bp, Artificial Sequence
  chemically synthesized
agactattttaagcatatattt

SEQ ID NO: 654468 - DNA, 22 bp, Artificial Sequence
  chemically synthesized
aagactattttaagcatatatt

SEQ ID NO: 654469 - DNA, 22 bp, Artificial Sequence
  chemically synthesized
taagactattttaagcatatat

SEQ ID NO: 654470 - DNA, 22 bp, Artificial Sequence
  chemically synthesized
ttaagactattttaagcatata

SEQ ID NO: 654471 - DNA, 22 bp, Artificial Sequence
  chemically synthesized
taatactgaaatatatgcttaa

SEQ ID NO: 654472 - DNA, 22 bp, Artificial Sequence
  chemically synthesized
tttaagactattttaagcatat

SEQ ID NO: 654473 - DNA, 22 bp, Artificial Sequence
  chemically synthesized
aatactgaaatatatgcttaaa

SEQ ID NO: 654474 - DNA, 22 bp, Artificial Sequence
  chemically synthesized
atactgaaatatatgcttaaaa

SEQ ID NO: 654475 - DNA, 22 bp, Artificial Sequence
  chemically synthesized
tctttttaagactattttaagc

SEQ ID NO: 654476 - DNA, 22 bp, Artificial Sequence
  chemically synthesized
aaatatatgcttaaaatagtct

SEQ ID NO: 654477 - DNA, 22 bp, Artificial Sequence
  chemically synthesized
tcctgtctttttaagactattt

SEQ ID NO: 654478 - DNA, 22 bp, Artificial Sequence
  chemically synthesized
gtcctgtctttttaagactatt

SEQ ID NO: 654479 - DNA, 22 bp, Artificial Sequence
  chemically synthesized
tgtcctgtctttttaagactat

SEQ ID NO: 654480 - DNA, 22 bp, Artificial Sequence
  chemically synthesized
ttgtcctgtctttttaagacta

SEQ ID NO: 654481 - DNA, 22 bp, Artificial Sequence
  chemically synthesized
aaaatagtcttaaaaagacagg

SEQ ID NO: 654482 - DNA, 22 bp, Artificial Sequence
  chemically synthesized
aaatagtcttaaaaagacagga

SEQ ID NO: 654483 - DNA, 22 bp, Artificial Sequence
  chemically synthesized
ccataggaaatcacttttgtcc

SEQ ID NO: 654484 - DNA, 22 bp, Artificial Sequence
  chemically synthesized
cccataggaaatcacttttgtc

SEQ ID NO: 654485 - DNA, 22 bp, Artificial Sequence
  chemically synthesized
tcccataggaaatcacttttgt

SEQ ID NO: 654486 - DNA, 22 bp, Artificial Sequence
  chemically synthesized
aaaaagacaggacaaaagtgat

SEQ ID NO: 654487 - DNA, 22 bp, Artificial Sequence
  chemically synthesized
ttcccataggaaatcacttttg

SEQ ID NO: 654488 - DNA, 22 bp, Artificial Sequence
  chemically synthesized
aaaagacaggacaaaagtgatt

SEQ ID NO: 654489 - DNA, 22 bp, Artificial Sequence
  chemically synthesized
tttcccataggaaatcactttt

SEQ ID NO: 654490 - DNA, 22 bp, Artificial Sequence
  chemically synthesized
ctttttcccataggaaatcact

SEQ ID NO: 654491 - DNA, 22 bp, Artificial Sequence
  chemically synthesized
gctttttcccataggaaatcac

SEQ ID NO: 654492 - DNA, 22 bp, Artificial Sequence
  chemically synthesized
gggatcgccttgctttttccca

SEQ ID NO: 654493 - DNA, 22 bp, Artificial Sequence
  chemically synthesized
ggggatcgccttgctttttccc

SEQ ID NO: 654494 - DNA, 22 bp, Artificial Sequence
  chemically synthesized
tggggatcgccttgctttttcc

SEQ ID NO: 654495 - DNA, 22 bp, Artificial Sequence
  chemically synthesized
cctatgggaaaaagcaaggcga

SEQ ID NO: 654496 - DNA, 22 bp, Artificial Sequence
  chemically synthesized
ctatgggaaaaagcaaggcgat

SEQ ID NO: 654497 - DNA, 22 bp, Artificial Sequence
  chemically synthesized
aaaagattttggggatcgcctt

SEQ ID NO: 654498 - DNA, 22 bp, Artificial Sequence
  chemically synthesized
tgggaaaaagcaaggcgatccc

SEQ ID NO: 654499 - DNA, 22 bp, Artificial Sequence
  chemically synthesized
aagattcaaaagattttgggga

SEQ ID NO: 654500 - DNA, 22 bp, Artificial Sequence
  chemically synthesized
aaacaaattaaagattcaaaag

SEQ ID NO: 654501 - DNA, 22 bp, Artificial Sequence
  chemically synthesized
caaacaaattaaagattcaaaa

SEQ ID NO: 654502 - DNA, 22 bp, Artificial Sequence
  chemically synthesized
tcaaacaaattaaagattcaaa

SEQ ID NO: 654503 - DNA, 22 bp, Artificial Sequence
  chemically synthesized
gtactttcaaacaaattaaaga

SEQ ID NO: 654504 - DNA, 22 bp, Artificial Sequence
  chemically synthesized
tagtactttcaaacaaattaaa

SEQ ID NO: 654505 - DNA, 22 bp, Artificial Sequence
  chemically synthesized
ttgaatctttaatttgtttgaa

SEQ ID NO: 654506 - DNA, 22 bp, Artificial Sequence
  chemically synthesized
tgaatctttaatttgtttgaaa

SEQ ID NO: 654507 - DNA, 22 bp, Artificial Sequence
  chemically synthesized
gaatctttaatttgtttgaaag

SEQ ID NO: 654508 - DNA, 22 bp, Artificial Sequence
  chemically synthesized
aatctttaatttgtttgaaagt

SEQ ID NO: 654509 - DNA, 22 bp, Artificial Sequence
  chemically synthesized
tcagactctagtactttcaaac

SEQ ID NO: 654510 - DNA, 22 bp, Artificial Sequence
  chemically synthesized
gctatcagactctagtactttc

SEQ ID NO: 654511 - DNA, 22 bp, Artificial Sequence
  chemically synthesized
agctatcagactctagtacttt

SEQ ID NO: 654512 - DNA, 22 bp, Artificial Sequence
  chemically synthesized
taatttgtttgaaagtactaga

SEQ ID NO: 654513 - DNA, 22 bp, Artificial Sequence
  chemically synthesized
aatttgtttgaaagtactagag

SEQ ID NO: 654514 - DNA, 22 bp, Artificial Sequence
  chemically synthesized
atttgtttgaaagtactagagt

SEQ ID NO: 654515 - DNA, 22 bp, Artificial Sequence
  chemically synthesized
cttagctatcagactctagtac

SEQ ID NO: 654516 - DNA, 22 bp, Artificial Sequence
  chemically synthesized
acttagctatcagactctagta

SEQ ID NO: 654517 - DNA, 22 bp, Artificial Sequence
  chemically synthesized
gtttgaaagtactagagtctga

SEQ ID NO: 654518 - DNA, 22 bp, Artificial Sequence
  chemically synthesized
cttacttagctatcagactcta

SEQ ID NO: 654519 - DNA, 22 bp, Artificial Sequence
  chemically synthesized
tttgaaagtactagagtctgat

SEQ ID NO: 654520 - DNA, 22 bp, Artificial Sequence
  chemically synthesized
gcttacttagctatcagactct

SEQ ID NO: 654521 - DNA, 22 bp, Artificial Sequence
  chemically synthesized
gaaagtactagagtctgatagc

SEQ ID NO: 654522 - DNA, 22 bp, Artificial Sequence
  chemically synthesized
aaagtactagagtctgatagct

SEQ ID NO: 654523 - DNA, 22 bp, Artificial Sequence
  chemically synthesized
agtgggccttgcttacttagct

SEQ ID NO: 654524 - DNA, 22 bp, Artificial Sequence
  chemically synthesized
gagtctgatagctaagtaagca

SEQ ID NO: 654525 - DNA, 22 bp, Artificial Sequence
  chemically synthesized
tcctaagtgggccttgcttact

SEQ ID NO: 654526 - DNA, 22 bp, Artificial Sequence
  chemically synthesized
atagctaagtaagcaaggccca

SEQ ID NO: 654527 - DNA, 22 bp, Artificial Sequence
  chemically synthesized
gaaattgtcctaagtgggcctt

SEQ ID NO: 654528 - DNA, 22 bp, Artificial Sequence
  chemically synthesized
agtaagcaaggcccacttagga

SEQ ID NO: 654529 - DNA, 22 bp, Artificial Sequence
  chemically synthesized
acctggaaattgtcctaagtgg

SEQ ID NO: 654530 - DNA, 22 bp, Artificial Sequence
  chemically synthesized
tattcacctggaaattgtccta

SEQ ID NO: 654531 - DNA, 22 bp, Artificial Sequence
  chemically synthesized
atattcacctggaaattgtcct

SEQ ID NO: 654532 - DNA, 22 bp, Artificial Sequence
  chemically synthesized
aagatttatattcacctggaaa

SEQ ID NO: 654533 - DNA, 22 bp, Artificial Sequence
  chemically synthesized
aggacaatttccaggtgaatat

SEQ ID NO: 654534 - DNA, 22 bp, Artificial Sequence
  chemically synthesized
agttgaagatttatattcacct

SEQ ID NO: 654535 - DNA, 22 bp, Artificial Sequence
  chemically synthesized
ggacaatttccaggtgaatata

SEQ ID NO: 654536 - DNA, 22 bp, Artificial Sequence
  chemically synthesized
ccaggtgaatataaatcttcaa

SEQ ID NO: 654537 - DNA, 22 bp, Artificial Sequence
  chemically synthesized
caggtgaatataaatcttcaac

SEQ ID NO: 654538 - DNA, 22 bp, Artificial Sequence
  chemically synthesized
tcggcatataattcagttgaag

SEQ ID NO: 654539 - DNA, 22 bp, Artificial Sequence
  chemically synthesized
gcagccatgttatcggcatata

SEQ ID NO: 654540 - DNA, 22 bp, Artificial Sequence
  chemically synthesized
tcgcagccatgttatcggcata

SEQ ID NO: 654541 - DNA, 22 bp, Artificial Sequence
  chemically synthesized
caactgaattatatgccgataa

SEQ ID NO: 654542 - DNA, 22 bp, Artificial Sequence
  chemically synthesized
aactgaattatatgccgataac

SEQ ID NO: 654543 - DNA, 22 bp, Artificial Sequence
  chemically synthesized
gctctcgcagccatgttatcgg

SEQ ID NO: 654544 - DNA, 22 bp, Artificial Sequence
  chemically synthesized
aattatatgccgataacatggc

SEQ ID NO: 654545 - DNA, 22 bp, Artificial Sequence
  chemically synthesized
cattggctctcgcagccatgtt

SEQ ID NO: 654546 - DNA, 22 bp, Artificial Sequence
  chemically synthesized
ccattggctctcgcagccatgt

SEQ ID NO: 654547 - DNA, 22 bp, Artificial Sequence
  chemically synthesized
tatgccgataacatggctgcga

SEQ ID NO: 654548 - DNA, 22 bp, Artificial Sequence
  chemically synthesized
caccttccattggctctcgcag

SEQ ID NO: 654549 - DNA, 22 bp, Artificial Sequence
  chemically synthesized
gcaccttccattggctctcgca

SEQ ID NO: 654550 - DNA, 22 bp, Artificial Sequence
  chemically synthesized
acttgcaccttccattggctct

SEQ ID NO: 654551 - DNA, 22 bp, Artificial Sequence
  chemically synthesized
cgagagccaatggaaggtgcaa

SEQ ID NO: 654552 - DNA, 22 bp, Artificial Sequence
  chemically synthesized
tggggtattcacttgcaccttc

SEQ ID NO: 654553 - DNA, 22 bp, Artificial Sequence
  chemically synthesized
tcagtgttgtggggtattcact

SEQ ID NO: 654554 - DNA, 22 bp, Artificial Sequence
  chemically synthesized
atcagtgttgtggggtattcac

SEQ ID NO: 654555 - DNA, 22 bp, Artificial Sequence
  chemically synthesized
atcagatgagatataagtatgc

SEQ ID NO: 654556 - DNA, 22 bp, Artificial Sequence
  chemically synthesized
ataaatgcatacttatatctca

SEQ ID NO: 654557 - DNA, 22 bp, Artificial Sequence
  chemically synthesized
atatctcatctgatcaactcct

SEQ ID NO: 654558 - DNA, 22 bp, Artificial Sequence
  chemically synthesized
tatctcatctgatcaactcctt

SEQ ID NO: 654559 - DNA, 22 bp, Artificial Sequence
  chemically synthesized
aaaagaagggggaaaggagttg

SEQ ID NO: 654560 - DNA, 22 bp, Artificial Sequence
  chemically synthesized
atctgatcaactcctttccccc

SEQ ID NO: 654561 - DNA, 22 bp, Artificial Sequence
  chemically synthesized
atcaactcctttcccccttctt

SEQ ID NO: 654562 - DNA, 22 bp, Artificial Sequence
  chemically synthesized
ctttcccccttcttttcagcat

SEQ ID NO: 654563 - DNA, 22 bp, Artificial Sequence
  chemically synthesized
tcccccttcttttcagcattac

SEQ ID NO: 654564 - DNA, 22 bp, Artificial Sequence
  chemically synthesized
cccccttcttttcagcattaca

SEQ ID NO: 654565 - DNA, 22 bp, Artificial Sequence
  chemically synthesized
ccccttcttttcagcattacat

SEQ ID NO: 654566 - DNA, 22 bp, Artificial Sequence
  chemically synthesized
atggtacgagggacatgtaatg

SEQ ID NO: 654567 - DNA, 22 bp, Artificial Sequence
  chemically synthesized
cttttcagcattacatgtccct

SEQ ID NO: 654568 - DNA, 22 bp, Artificial Sequence
  chemically synthesized
ttttcagcattacatgtccctc

SEQ ID NO: 654569 - DNA, 22 bp, Artificial Sequence
  chemically synthesized
ttcagcattacatgtccctcgt

SEQ ID NO: 654570 - DNA, 22 bp, Artificial Sequence
  chemically synthesized
tcagcattacatgtccctcgta

SEQ ID NO: 654571 - DNA, 22 bp, Artificial Sequence
  chemically synthesized
cagcattacatgtccctcgtac

SEQ ID NO: 654572 - DNA, 22 bp, Artificial Sequence
  chemically synthesized
agcattacatgtccctcgtacc

SEQ ID NO: 654573 - DNA, 22 bp, Artificial Sequence
  chemically synthesized
catgtccctcgtaccattagat

SEQ ID NO: 654574 - DNA, 22 bp, Artificial Sequence
  chemically synthesized
atacatgccgtagcatctaatg

SEQ ID NO: 654575 - DNA, 22 bp, Artificial Sequence
  chemically synthesized
gtaccattagatgctacggcat

SEQ ID NO: 654576 - DNA, 22 bp, Artificial Sequence
  chemically synthesized
tcagtccaggtagctcatacat

SEQ ID NO: 654577 - DNA, 22 bp, Artificial Sequence
  chemically synthesized
gatgctacggcatgtatgagct

SEQ ID NO: 654578 - DNA, 22 bp, Artificial Sequence
  chemically synthesized
cggcatgtatgagctacctgga

SEQ ID NO: 654579 - DNA, 22 bp, Artificial Sequence
  chemically synthesized
aatatatatggacccgcacctg

SEQ ID NO: 654580 - DNA, 22 bp, Artificial Sequence
  chemically synthesized
caatatatatggacccgcacct

SEQ ID NO: 654581 - DNA, 22 bp, Artificial Sequence
  chemically synthesized
cctggactgacaggtgcgggtc

SEQ ID NO: 654582 - DNA, 22 bp, Artificial Sequence
  chemically synthesized
gactgacaggtgcgggtccata

SEQ ID NO: 654583 - DNA, 22 bp, Artificial Sequence
  chemically synthesized
ccacttcaatatatatggaccc

SEQ ID NO: 654584 - DNA, 22 bp, Artificial Sequence
  chemically synthesized
gccacttcaatatatatggacc

SEQ ID NO: 654585 - DNA, 22 bp, Artificial Sequence
  chemically synthesized
tgccacttcaatatatatggac

SEQ ID NO: 654586 - DNA, 22 bp, Artificial Sequence
  chemically synthesized
ttgccacttcaatatatatgga

SEQ ID NO: 654587 - DNA, 22 bp, Artificial Sequence
  chemically synthesized
acaggtgcgggtccatatatat

SEQ ID NO: 654588 - DNA, 22 bp, Artificial Sequence
  chemically synthesized
tttgccacttcaatatatatgg

SEQ ID NO: 654589 - DNA, 22 bp, Artificial Sequence
  chemically synthesized
ctttttgccacttcaatatata

SEQ ID NO: 654590 - DNA, 22 bp, Artificial Sequence
  chemically synthesized
cctttttgccacttcaatatat

SEQ ID NO: 654591 - DNA, 22 bp, Artificial Sequence
  chemically synthesized
tcctttttgccacttcaatata

SEQ ID NO: 654592 - DNA, 22 bp, Artificial Sequence
  chemically synthesized
ttcctttttgccacttcaatat

SEQ ID NO: 654593 - DNA, 22 bp, Artificial Sequence
  chemically synthesized
tttcctttttgccacttcaata

SEQ ID NO: 654594 - DNA, 22 bp, Artificial Sequence
  chemically synthesized
ttttcctttttgccacttcaat

SEQ ID NO: 654595 - DNA, 22 bp, Artificial Sequence
  chemically synthesized
tttttcctttttgccacttcaa

SEQ ID NO: 654596 - DNA, 22 bp, Artificial Sequence
  chemically synthesized
ttttttcctttttgccacttca

SEQ ID NO: 654597 - DNA, 22 bp, Artificial Sequence
  chemically synthesized
ttttttttcctttttgccactt

SEQ ID NO: 654598 - DNA, 22 bp, Artificial Sequence
  chemically synthesized
cttttttttcctttttgccact

SEQ ID NO: 654599 - DNA, 22 bp, Artificial Sequence
  chemically synthesized
tttcttttttttcctttttgcc

SEQ ID NO: 654600 - DNA, 22 bp, Artificial Sequence
  chemically synthesized
gtttcttttttttcctttttgc

SEQ ID NO: 654601 - DNA, 22 bp, Artificial Sequence
  chemically synthesized
tgtttcttttttttcctttttg

SEQ ID NO: 654602 - DNA, 22 bp, Artificial Sequence
  chemically synthesized
aagtggcaaaaaggaaaaaaaa

SEQ ID NO: 654603 - DNA, 22 bp, Artificial Sequence
  chemically synthesized
atagagttttgtttcttttttt

SEQ ID NO: 654604 - DNA, 22 bp, Artificial Sequence
  chemically synthesized
agaagctcatagagttttgttt

SEQ ID NO: 654605 - DNA, 22 bp, Artificial Sequence
  chemically synthesized
aattgagaagctcatagagttt

SEQ ID NO: 654606 - DNA, 22 bp, Artificial Sequence
  chemically synthesized
tgctgaattgagaagctcatag

SEQ ID NO: 654607 - DNA, 22 bp, Artificial Sequence
  chemically synthesized
tatgagcttctcaattcagcac

SEQ ID NO: 654608 - DNA, 22 bp, Artificial Sequence
  chemically synthesized
tgagcttctcaattcagcacag

SEQ ID NO: 654609 - DNA, 22 bp, Artificial Sequence
  chemically synthesized
aaacacgtaacatgaaaactgt

SEQ ID NO: 654610 - DNA, 22 bp, Artificial Sequence
  chemically synthesized
ctcaattcagcacagttttcat

SEQ ID NO: 654611 - DNA, 22 bp, Artificial Sequence
  chemically synthesized
tcaattcagcacagttttcatg

SEQ ID NO: 654612 - DNA, 22 bp, Artificial Sequence
  chemically synthesized
aattcagcacagttttcatgtt

SEQ ID NO: 654613 - DNA, 22 bp, Artificial Sequence
  chemically synthesized
agcacagttttcatgttacgtg

SEQ ID NO: 654614 - DNA, 22 bp, Artificial Sequence
  chemically synthesized
acataattaaaacacgtaacat

SEQ ID NO: 654615 - DNA, 22 bp, Artificial Sequence
  chemically synthesized
tcatgttacgtgttttaattat

SEQ ID NO: 654616 - DNA, 22 bp, Artificial Sequence
  chemically synthesized
catgttacgtgttttaattatg

SEQ ID NO: 654617 - DNA, 22 bp, Artificial Sequence
  chemically synthesized
atgttacgtgttttaattatgt

SEQ ID NO: 654618 - DNA, 22 bp, Artificial Sequence
  chemically synthesized
tgggaacaacacattgacataa

SEQ ID NO: 654619 - DNA, 22 bp, Artificial Sequence
  chemically synthesized
atgggaacaacacattgacata

SEQ ID NO: 654620 - DNA, 22 bp, Artificial Sequence
  chemically synthesized
cgtgttttaattatgtcaatgt

SEQ ID NO: 654621 - DNA, 22 bp, Artificial Sequence
  chemically synthesized
tatgggaacaacacattgacat

SEQ ID NO: 654622 - DNA, 22 bp, Artificial Sequence
  chemically synthesized
ttatgggaacaacacattgaca

SEQ ID NO: 654623 - DNA, 22 bp, Artificial Sequence
  chemically synthesized
taattatgtcaatgtgttgttc

SEQ ID NO: 654624 - DNA, 22 bp, Artificial Sequence
  chemically synthesized
aattatgtcaatgtgttgttcc

SEQ ID NO: 654625 - DNA, 22 bp, Artificial Sequence
  chemically synthesized
attatgtcaatgtgttgttccc

SEQ ID NO: 654626 - DNA, 22 bp, Artificial Sequence
  chemically synthesized
accaatccttttatgggaacaa

SEQ ID NO: 654627 - DNA, 22 bp, Artificial Sequence
  chemically synthesized
tgtcaatgtgttgttcccataa

SEQ ID NO: 654628 - DNA, 22 bp, Artificial Sequence
  chemically synthesized
catattaaccaatccttttatg

SEQ ID NO: 654629 - DNA, 22 bp, Artificial Sequence
  chemically synthesized
ccatattaaccaatccttttat

SEQ ID NO: 654630 - DNA, 22 bp, Artificial Sequence
  chemically synthesized
ttcccataaaaggattggttaa

SEQ ID NO: 654631 - DNA, 22 bp, Artificial Sequence
  chemically synthesized
ccataaaaggattggttaatat

SEQ ID NO: 654632 - DNA, 22 bp, Artificial Sequence
  chemically synthesized
ataaatacatttccatattaac

SEQ ID NO: 654633 - DNA, 22 bp, Artificial Sequence
  chemically synthesized
gttaatatggaaatgtatttat

SEQ ID NO: 654634 - DNA, 22 bp, Artificial Sequence
  chemically synthesized
atatggaaatgtatttattaga

SEQ ID NO: 654635 - DNA, 22 bp, Artificial Sequence
  chemically synthesized
cagagagccacataaacagatg

SEQ ID NO: 654636 - DNA, 22 bp, Artificial Sequence
  chemically synthesized
tccagagagccacataaacaga

SEQ ID NO: 654637 - DNA, 22 bp, Artificial Sequence
  chemically synthesized
ctccagagagccacataaacag

SEQ ID NO: 654638 - DNA, 22 bp, Artificial Sequence
  chemically synthesized
tctccagagagccacataaaca

SEQ ID NO: 654639 - DNA, 22 bp, Artificial Sequence
  chemically synthesized
attagacatctgtttatgtggc

SEQ ID NO: 654640 - DNA, 22 bp, Artificial Sequence
  chemically synthesized
ttagacatctgtttatgtggct

SEQ ID NO: 654641 - DNA, 22 bp, Artificial Sequence
  chemically synthesized
gacatctgtttatgtggctctc

SEQ ID NO: 654642 - DNA, 22 bp, Artificial Sequence
  chemically synthesized
aaagtcctttctccagagagcc

SEQ ID NO: 654643 - DNA, 22 bp, Artificial Sequence
  chemically synthesized
tttatgtggctctctggagaaa

SEQ ID NO: 654644 - DNA, 22 bp, Artificial Sequence
  chemically synthesized
atgtggctctctggagaaagga

SEQ ID NO: 654645 - DNA, 22 bp, Artificial Sequence
  chemically synthesized
tgtggctctctggagaaaggac

SEQ ID NO: 654646 - DNA, 22 bp, Artificial Sequence
  chemically synthesized
tctggagaaaggactttcaatt

SEQ ID NO: 654647 - DNA, 22 bp, Artificial Sequence
  chemically synthesized
tggagaaaggactttcaattcc

SEQ ID NO: 654648 - DNA, 22 bp, Artificial Sequence
  chemically synthesized
gagaaaggactttcaattccat

SEQ ID NO: 654649 - DNA, 22 bp, Artificial Sequence
  chemically synthesized
aaatggcagtgtatggaattga

SEQ ID NO: 654650 - DNA, 22 bp, Artificial Sequence
  chemically synthesized
aaaatggcagtgtatggaattg

SEQ ID NO: 654651 - DNA, 22 bp, Artificial Sequence
  chemically synthesized
tttaaaatggcagtgtatggaa

SEQ ID NO: 654652 - DNA, 22 bp, Artificial Sequence
  chemically synthesized
gaattgtttaaaatggcagtgt

SEQ ID NO: 654653 - DNA, 22 bp, Artificial Sequence
  chemically synthesized
ggaattgtttaaaatggcagtg

SEQ ID NO: 654654 - DNA, 22 bp, Artificial Sequence
  chemically synthesized
tcaattccatacactgccattt

SEQ ID NO: 654655 - DNA, 22 bp, Artificial Sequence
  chemically synthesized
caattccatacactgccatttt

SEQ ID NO: 654656 - DNA, 22 bp, Artificial Sequence
  chemically synthesized
aattccatacactgccatttta

SEQ ID NO: 654657 - DNA, 22 bp, Artificial Sequence
  chemically synthesized
tcttggaattgtttaaaatggc

SEQ ID NO: 654658 - DNA, 22 bp, Artificial Sequence
  chemically synthesized
gtcttggaattgtttaaaatgg

SEQ ID NO: 654659 - DNA, 22 bp, Artificial Sequence
  chemically synthesized
tgtcttggaattgtttaaaatg

SEQ ID NO: 654660 - DNA, 22 bp, Artificial Sequence
  chemically synthesized
ttgtcttggaattgtttaaaat

SEQ ID NO: 654661 - DNA, 22 bp, Artificial Sequence
  chemically synthesized
catacactgccattttaaacaa

SEQ ID NO: 654662 - DNA, 22 bp, Artificial Sequence
  chemically synthesized
tttttgtcttggaattgtttaa

SEQ ID NO: 654663 - DNA, 22 bp, Artificial Sequence
  chemically synthesized
ccattttaaacaattccaagac

SEQ ID NO: 654664 - DNA, 22 bp, Artificial Sequence
  chemically synthesized
gatactatttttgtcttggaat

SEQ ID NO: 654665 - DNA, 22 bp, Artificial Sequence
  chemically synthesized
taaacaattccaagacaaaaat

SEQ ID NO: 654666 - DNA, 22 bp, Artificial Sequence
  chemically synthesized
ccattggatactatttttgtct

SEQ ID NO: 654667 - DNA, 22 bp, Artificial Sequence
  chemically synthesized
aaacaattccaagacaaaaata

SEQ ID NO: 654668 - DNA, 22 bp, Artificial Sequence
  chemically synthesized
aacaattccaagacaaaaatag

SEQ ID NO: 654669 - DNA, 22 bp, Artificial Sequence
  chemically synthesized
aactgccattggatactatttt

SEQ ID NO: 654670 - DNA, 22 bp, Artificial Sequence
  chemically synthesized
ctgaactgccattggatactat

SEQ ID NO: 654671 - DNA, 22 bp, Artificial Sequence
  chemically synthesized
actgaactgccattggatacta

SEQ ID NO: 654672 - DNA, 22 bp, Artificial Sequence
  chemically synthesized
caagacaaaaatagtatccaat

SEQ ID NO: 654673 - DNA, 22 bp, Artificial Sequence
  chemically synthesized
tactgaactgccattggatact

SEQ ID NO: 654674 - DNA, 22 bp, Artificial Sequence
  chemically synthesized
tttactgaactgccattggata

SEQ ID NO: 654675 - DNA, 22 bp, Artificial Sequence
  chemically synthesized
tctttactgaactgccattgga

SEQ ID NO: 654676 - DNA, 22 bp, Artificial Sequence
  chemically synthesized
agtgtacaaagaatgatatctc

SEQ ID NO: 654677 - DNA, 22 bp, Artificial Sequence
  chemically synthesized
tgagtgtacaaagaatgatatc

SEQ ID NO: 654678 - DNA, 22 bp, Artificial Sequence
  chemically synthesized
agtaaagagagatatcattctt

SEQ ID NO: 654679 - DNA, 22 bp, Artificial Sequence
  chemically synthesized
tggacatccaaggtggttctga

SEQ ID NO: 654680 - DNA, 22 bp, Artificial Sequence
  chemically synthesized
tttgtacactcagaaccacctt

SEQ ID NO: 654681 - DNA, 22 bp, Artificial Sequence
  chemically synthesized
tgtacactcagaaccaccttgg

SEQ ID NO: 654682 - DNA, 22 bp, Artificial Sequence
  chemically synthesized
gtacactcagaaccaccttgga

SEQ ID NO: 654683 - DNA, 22 bp, Artificial Sequence
  chemically synthesized
tacactcagaaccaccttggat

SEQ ID NO: 654684 - DNA, 22 bp, Artificial Sequence
  chemically synthesized
atgaatatcactgtggacatcc

SEQ ID NO: 654685 - DNA, 22 bp, Artificial Sequence
  chemically synthesized
agaaccaccttggatgtccaca

SEQ ID NO: 654686 - DNA, 22 bp, Artificial Sequence
  chemically synthesized
ttcatgaatatcactgtggaca

SEQ ID NO: 654687 - DNA, 22 bp, Artificial Sequence
  chemically synthesized
ggatgtccacagtgatattcat

SEQ ID NO: 654688 - DNA, 22 bp, Artificial Sequence
  chemically synthesized
ccccgtctattcatgaatatca

SEQ ID NO: 654689 - DNA, 22 bp, Artificial Sequence
  chemically synthesized
gatgtccacagtgatattcatg

SEQ ID NO: 654690 - DNA, 22 bp, Artificial Sequence
  chemically synthesized
tcccccgtctattcatgaatat

SEQ ID NO: 654691 - DNA, 22 bp, Artificial Sequence
  chemically synthesized
cctctcccccgtctattcatga

SEQ ID NO: 654692 - DNA, 22 bp, Artificial Sequence
  chemically synthesized
tacctctcccccgtctattcat

SEQ ID NO: 654693 - DNA, 22 bp, Artificial Sequence
  chemically synthesized
ctacctctcccccgtctattca

SEQ ID NO: 654694 - DNA, 22 bp, Artificial Sequence
  chemically synthesized
atgaatagacgggggagaggta

SEQ ID NO: 654695 - DNA, 22 bp, Artificial Sequence
  chemically synthesized
tgtaaagaagagcttctacctc

SEQ ID NO: 654696 - DNA, 22 bp, Artificial Sequence
  chemically synthesized
atgtaaagaagagcttctacct

SEQ ID NO: 654697 - DNA, 22 bp, Artificial Sequence
  chemically synthesized
ttatgtaaagaagagcttctac

SEQ ID NO: 654698 - DNA, 22 bp, Artificial Sequence
  chemically synthesized
cttatgtaaagaagagcttcta

SEQ ID NO: 654699 - DNA, 22 bp, Artificial Sequence
  chemically synthesized
tcttatgtaaagaagagcttct

SEQ ID NO: 654700 - DNA, 22 bp, Artificial Sequence
  chemically synthesized
gaccattttcttatgtaaagaa

SEQ ID NO: 654701 - DNA, 22 bp, Artificial Sequence
  chemically synthesized
catgtattagaccattttctta

SEQ ID NO: 654702 - DNA, 22 bp, Artificial Sequence
  chemically synthesized
tgcatgtattagaccattttct

SEQ ID NO: 654703 - DNA, 22 bp, Artificial Sequence
  chemically synthesized
ttctttacataagaaaatggtc

SEQ ID NO: 654704 - DNA, 22 bp, Artificial Sequence
  chemically synthesized
ctgcatgtattagaccattttc

SEQ ID NO: 654705 - DNA, 22 bp, Artificial Sequence
  chemically synthesized
tctgcatgtattagaccatttt

SEQ ID NO: 654706 - DNA, 22 bp, Artificial Sequence
  chemically synthesized
ctttacataagaaaatggtcta

SEQ ID NO: 654707 - DNA, 22 bp, Artificial Sequence
  chemically synthesized
tttacataagaaaatggtctaa

SEQ ID NO: 654708 - DNA, 22 bp, Artificial Sequence
  chemically synthesized
tacataagaaaatggtctaata

SEQ ID NO: 654709 - DNA, 22 bp, Artificial Sequence
  chemically synthesized
acataagaaaatggtctaatac

SEQ ID NO: 654710 - DNA, 22 bp, Artificial Sequence
  chemically synthesized
cataagaaaatggtctaataca

SEQ ID NO: 654711 - DNA, 22 bp, Artificial Sequence
  chemically synthesized
ccatactttctgcatgtattag

SEQ ID NO: 654712 - DNA, 22 bp, Artificial Sequence
  chemically synthesized
taccatactttctgcatgtatt

SEQ ID NO: 654713 - DNA, 22 bp, Artificial Sequence
  chemically synthesized
attctaccatactttctgcatg

SEQ ID NO: 654714 - DNA, 22 bp, Artificial Sequence
  chemically synthesized
taattctaccatactttctgca

SEQ ID NO: 654715 - DNA, 22 bp, Artificial Sequence
  chemically synthesized
ctaattctaccatactttctgc

SEQ ID NO: 654716 - DNA, 22 bp, Artificial Sequence
  chemically synthesized
tctaattctaccatactttctg

SEQ ID NO: 654717 - DNA, 22 bp, Artificial Sequence
  chemically synthesized
atacatgcagaaagtatggtag

SEQ ID NO: 654718 - DNA, 22 bp, Artificial Sequence
  chemically synthesized
cataatggtggctttctaattc

SEQ ID NO: 654719 - DNA, 22 bp, Artificial Sequence
  chemically synthesized
gtggttgcataatggtggcttt

SEQ ID NO: 654720 - DNA, 22 bp, Artificial Sequence
  chemically synthesized
taatattggtggttgcataatg

SEQ ID NO: 654721 - DNA, 22 bp, Artificial Sequence
  chemically synthesized
gaaagccaccattatgcaacca

SEQ ID NO: 654722 - DNA, 22 bp, Artificial Sequence
  chemically synthesized
agttataatattggtggttgca

SEQ ID NO: 654723 - DNA, 22 bp, Artificial Sequence
  chemically synthesized
attcagttataatattggtggt

SEQ ID NO: 654724 - DNA, 22 bp, Artificial Sequence
  chemically synthesized
tctaattcagttataatattgg

SEQ ID NO: 654725 - DNA, 22 bp, Artificial Sequence
  chemically synthesized
gtctaattcagttataatattg

SEQ ID NO: 654726 - DNA, 22 bp, Artificial Sequence
  chemically synthesized
tgcaaccaccaatattataact

SEQ ID NO: 654727 - DNA, 22 bp, Artificial Sequence
  chemically synthesized
tggatgatccttgtctaattca

SEQ ID NO: 654728 - DNA, 22 bp, Artificial Sequence
  chemically synthesized
atggatgatccttgtctaattc

SEQ ID NO: 654729 - DNA, 22 bp, Artificial Sequence
  chemically synthesized
gcatttatggatgatccttgtc

SEQ ID NO: 654730 - DNA, 22 bp, Artificial Sequence
  chemically synthesized
taactgaattagacaaggatca

SEQ ID NO: 654731 - DNA, 22 bp, Artificial Sequence
  chemically synthesized
agcatttatggatgatccttgt

SEQ ID NO: 654732 - DNA, 22 bp, Artificial Sequence
  chemically synthesized
tagcatttatggatgatccttg

SEQ ID NO: 654733 - DNA, 22 bp, Artificial Sequence
  chemically synthesized
aattagacaaggatcatccata

SEQ ID NO: 654734 - DNA, 22 bp, Artificial Sequence
  chemically synthesized
tggttttagcatttatggatga

SEQ ID NO: 654735 - DNA, 22 bp, Artificial Sequence
  chemically synthesized
gacaaggatcatccataaatgc

SEQ ID NO: 654736 - DNA, 22 bp, Artificial Sequence
  chemically synthesized
ccctatggttttagcatttatg

SEQ ID NO: 654737 - DNA, 22 bp, Artificial Sequence
  chemically synthesized
accctatggttttagcatttat

SEQ ID NO: 654738 - DNA, 22 bp, Artificial Sequence
  chemically synthesized
taccctatggttttagcattta

SEQ ID NO: 654739 - DNA, 22 bp, Artificial Sequence
  chemically synthesized
ttaccctatggttttagcattt

SEQ ID NO: 654740 - DNA, 22 bp, Artificial Sequence
  chemically synthesized
accttttaccctatggttttag

SEQ ID NO: 654741 - DNA, 22 bp, Artificial Sequence
  chemically synthesized
aaccttttaccctatggtttta

SEQ ID NO: 654742 - DNA, 22 bp, Artificial Sequence
  chemically synthesized
cttaaccttttaccctatggtt

SEQ ID NO: 654743 - DNA, 22 bp, Artificial Sequence
  chemically synthesized
aaaccatagggtaaaaggttaa

SEQ ID NO: 654744 - DNA, 22 bp, Artificial Sequence
  chemically synthesized
taatatccattccttaaccttt

SEQ ID NO: 654745 - DNA, 22 bp, Artificial Sequence
  chemically synthesized
acatattataatatccattcct

SEQ ID NO: 654746 - DNA, 22 bp, Artificial Sequence
  chemically synthesized
gacatattataatatccattcc

SEQ ID NO: 654747 - DNA, 22 bp, Artificial Sequence
  chemically synthesized
tgacatattataatatccattc

SEQ ID NO: 654748 - DNA, 22 bp, Artificial Sequence
  chemically synthesized
atattttgacatattataatat

SEQ ID NO: 654749 - DNA, 22 bp, Artificial Sequence
  chemically synthesized
gatattttgacatattataata

SEQ ID NO: 654750 - DNA, 22 bp, Artificial Sequence
  chemically synthesized
tgatattttgacatattataat

SEQ ID NO: 654751 - DNA, 22 bp, Artificial Sequence
  chemically synthesized
ttgatattttgacatattataa

SEQ ID NO: 654752 - DNA, 22 bp, Artificial Sequence
  chemically synthesized
aggaatggatattataatatgt

SEQ ID NO: 654753 - DNA, 22 bp, Artificial Sequence
  chemically synthesized
tttgatattttgacatattata

SEQ ID NO: 654754 - DNA, 22 bp, Artificial Sequence
  chemically synthesized
taatatgtcaaaatatcaaaaa

SEQ ID NO: 654755 - DNA, 22 bp, Artificial Sequence
  chemically synthesized
taatgagaaagtaattttttga

SEQ ID NO: 654756 - DNA, 22 bp, Artificial Sequence
  chemically synthesized
gtaatgagaaagtaattttttg

SEQ ID NO: 654757 - DNA, 22 bp, Artificial Sequence
  chemically synthesized
tgtaatgagaaagtaatttttt

SEQ ID NO: 654758 - DNA, 22 bp, Artificial Sequence
  chemically synthesized
cctttgtaatgagaaagtaatt

SEQ ID NO: 654759 - DNA, 22 bp, Artificial Sequence
  chemically synthesized
ccctttgtaatgagaaagtaat

SEQ ID NO: 654760 - DNA, 22 bp, Artificial Sequence
  chemically synthesized
tccctttgtaatgagaaagtaa

SEQ ID NO: 654761 - DNA, 22 bp, Artificial Sequence
  chemically synthesized
ttccctttgtaatgagaaagta

SEQ ID NO: 654762 - DNA, 22 bp, Artificial Sequence
  chemically synthesized
taaaatatccttttccctttgt

SEQ ID NO: 654763 - DNA, 22 bp, Artificial Sequence
  chemically synthesized
gtaaaatatccttttccctttg

SEQ ID NO: 654764 - DNA, 22 bp, Artificial Sequence
  chemically synthesized
ctttctcattacaaagggaaaa

SEQ ID NO: 654765 - DNA, 22 bp, Artificial Sequence
  chemically synthesized
cttgtaaaatatccttttccct

SEQ ID NO: 654766 - DNA, 22 bp, Artificial Sequence
  chemically synthesized
tctcattacaaagggaaaagga

SEQ ID NO: 654767 - DNA, 22 bp, Artificial Sequence
  chemically synthesized
ccttgtaaaatatccttttccc

SEQ ID NO: 654768 - DNA, 22 bp, Artificial Sequence
  chemically synthesized
ctcattacaaagggaaaaggat

SEQ ID NO: 654769 - DNA, 22 bp, Artificial Sequence
  chemically synthesized
tccttgtaaaatatccttttcc

SEQ ID NO: 654770 - DNA, 22 bp, Artificial Sequence
  chemically synthesized
tcattacaaagggaaaaggata

SEQ ID NO: 654771 - DNA, 22 bp, Artificial Sequence
  chemically synthesized
attacaaagggaaaaggatatt

SEQ ID NO: 654772 - DNA, 22 bp, Artificial Sequence
  chemically synthesized
caaagggaaaaggatattttac

SEQ ID NO: 654773 - DNA, 22 bp, Artificial Sequence
  chemically synthesized
caagatactttccttgtaaaat

SEQ ID NO: 654774 - DNA, 22 bp, Artificial Sequence
  chemically synthesized
aggtggtgtctacaagatactt

SEQ ID NO: 654775 - DNA, 22 bp, Artificial Sequence
  chemically synthesized
tacaaggaaagtatcttgtaga

SEQ ID NO: 654776 - DNA, 22 bp, Artificial Sequence
  chemically synthesized
acaaggaaagtatcttgtagac

SEQ ID NO: 654777 - DNA, 22 bp, Artificial Sequence
  chemically synthesized
caaggaaagtatcttgtagaca

SEQ ID NO: 654778 - DNA, 22 bp, Artificial Sequence
  chemically synthesized
agaatgttaaggtggtgtctac

SEQ ID NO: 654779 - DNA, 22 bp, Artificial Sequence
  chemically synthesized
gtatcactaagaatgttaaggt

SEQ ID NO: 654780 - DNA, 22 bp, Artificial Sequence
  chemically synthesized
gtagacaccaccttaacattct

SEQ ID NO: 654781 - DNA, 22 bp, Artificial Sequence
  chemically synthesized
ttggtatcactaagaatgttaa

SEQ ID NO: 654782 - DNA, 22 bp, Artificial Sequence
  chemically synthesized
tagacaccaccttaacattctt

SEQ ID NO: 654783 - DNA, 22 bp, Artificial Sequence
  chemically synthesized
ctattggtatcactaagaatgt

SEQ ID NO: 654784 - DNA, 22 bp, Artificial Sequence
  chemically synthesized
ttcctattggtatcactaagaa

SEQ ID NO: 654785 - DNA, 22 bp, Artificial Sequence
  chemically synthesized
gttcctattggtatcactaaga

SEQ ID NO: 654786 - DNA, 22 bp, Artificial Sequence
  chemically synthesized
tgttcctattggtatcactaag

SEQ ID NO: 654787 - DNA, 22 bp, Artificial Sequence
  chemically synthesized
aacattcttagtgataccaata

SEQ ID NO: 654788 - DNA, 22 bp, Artificial Sequence
  chemically synthesized
acattcttagtgataccaatag

SEQ ID NO: 654789 - DNA, 22 bp, Artificial Sequence
  chemically synthesized
ttagtgataccaataggaacaa

SEQ ID NO: 654790 - DNA, 22 bp, Artificial Sequence
  chemically synthesized
agtgataccaataggaacaaaa

SEQ ID NO: 654791 - DNA, 22 bp, Artificial Sequence
  chemically synthesized
gtgataccaataggaacaaaat

SEQ ID NO: 654792 - DNA, 22 bp, Artificial Sequence
  chemically synthesized
gaggaacaaaataacattttgt

SEQ ID NO: 654793 - DNA, 22 bp, Artificial Sequence
  chemically synthesized
tatcacaatctggaggaacaaa

SEQ ID NO: 654794 - DNA, 22 bp, Artificial Sequence
  chemically synthesized
ccactgtatcacaatctggagg

SEQ ID NO: 654795 - DNA, 22 bp, Artificial Sequence
  chemically synthesized
ttttgttcctccagattgtgat

SEQ ID NO: 654796 - DNA, 22 bp, Artificial Sequence
  chemically synthesized
tacctaccactgtatcacaatc

SEQ ID NO: 654797 - DNA, 22 bp, Artificial Sequence
  chemically synthesized
tgttcctccagattgtgataca

SEQ ID NO: 654798 - DNA, 22 bp, Artificial Sequence
  chemically synthesized
tgtacctaccactgtatcacaa

SEQ ID NO: 654799 - DNA, 22 bp, Artificial Sequence
  chemically synthesized
gttcctccagattgtgatacag

SEQ ID NO: 654800 - DNA, 22 bp, Artificial Sequence
  chemically synthesized
ttcctccagattgtgatacagt

SEQ ID NO: 654801 - DNA, 22 bp, Artificial Sequence
  chemically synthesized
ctccagattgtgatacagtggt

SEQ ID NO: 654802 - DNA, 22 bp, Artificial Sequence
  chemically synthesized
cagattgtgatacagtggtagg

SEQ ID NO: 654803 - DNA, 22 bp, Artificial Sequence
  chemically synthesized
tgatacagtggtaggtacagag

SEQ ID NO: 654804 - DNA, 22 bp, Artificial Sequence
  chemically synthesized
gccaaaagacgataagatgatg

SEQ ID NO: 654805 - DNA, 22 bp, Artificial Sequence
  chemically synthesized
ggccaaaagacgataagatgat

SEQ ID NO: 654806 - DNA, 22 bp, Artificial Sequence
  chemically synthesized
tggccaaaagacgataagatga

SEQ ID NO: 654807 - DNA, 22 bp, Artificial Sequence
  chemically synthesized
ttggccaaaagacgataagatg

SEQ ID NO: 654808 - DNA, 22 bp, Artificial Sequence
  chemically synthesized
tttggccaaaagacgataagat

SEQ ID NO: 654809 - DNA, 22 bp, Artificial Sequence
  chemically synthesized
acattttttggccaaaagacga

SEQ ID NO: 654810 - DNA, 22 bp, Artificial Sequence
  chemically synthesized
atgttaacattttttggccaaa

SEQ ID NO: 654811 - DNA, 22 bp, Artificial Sequence
  chemically synthesized
atcgtcttttggccaaaaaatg

SEQ ID NO: 654812 - DNA, 22 bp, Artificial Sequence
  chemically synthesized
gattaatgttaacattttttgg

SEQ ID NO: 654813 - DNA, 22 bp, Artificial Sequence
  chemically synthesized
tcgtcttttggccaaaaaatgt

SEQ ID NO: 654814 - DNA, 22 bp, Artificial Sequence
  chemically synthesized
tgattagattaatgttaacatt

SEQ ID NO: 654815 - DNA, 22 bp, Artificial Sequence
  chemically synthesized
gtgattagattaatgttaacat

SEQ ID NO: 654816 - DNA, 22 bp, Artificial Sequence
  chemically synthesized
ttggccaaaaaatgttaacatt

SEQ ID NO: 654817 - DNA, 22 bp, Artificial Sequence
  chemically synthesized
tggccaaaaaatgttaacatta

SEQ ID NO: 654818 - DNA, 22 bp, Artificial Sequence
  chemically synthesized
ggccaaaaaatgttaacattaa

SEQ ID NO: 654819 - DNA, 22 bp, Artificial Sequence
  chemically synthesized
cttgtgattagattaatgttaa

SEQ ID NO: 654820 - DNA, 22 bp, Artificial Sequence
  chemically synthesized
gccaaaaaatgttaacattaat

SEQ ID NO: 654821 - DNA, 22 bp, Artificial Sequence
  chemically synthesized
ccttgtgattagattaatgtta

SEQ ID NO: 654822 - DNA, 22 bp, Artificial Sequence
  chemically synthesized
atggtttccttgtgattagatt

SEQ ID NO: 654823 - DNA, 22 bp, Artificial Sequence
  chemically synthesized
tgatggtttccttgtgattaga

SEQ ID NO: 654824 - DNA, 22 bp, Artificial Sequence
  chemically synthesized
ctgatggtttccttgtgattag

SEQ ID NO: 654825 - DNA, 22 bp, Artificial Sequence
  chemically synthesized
tctgatggtttccttgtgatta

SEQ ID NO: 654826 - DNA, 22 bp, Artificial Sequence
  chemically synthesized
ttctgatggtttccttgtgatt

SEQ ID NO: 654827 - DNA, 22 bp, Artificial Sequence
  chemically synthesized
acattaatctaatcacaaggaa

SEQ ID NO: 654828 - DNA, 22 bp, Artificial Sequence
  chemically synthesized
ggcttttctgatggtttccttg

SEQ ID NO: 654829 - DNA, 22 bp, Artificial Sequence
  chemically synthesized
tgggcttttctgatggtttcct

SEQ ID NO: 654830 - DNA, 22 bp, Artificial Sequence
  chemically synthesized
atctaatcacaaggaaaccatc

SEQ ID NO: 654831 - DNA, 22 bp, Artificial Sequence
  chemically synthesized
atcacaaggaaaccatcagaaa

SEQ ID NO: 654832 - DNA, 22 bp, Artificial Sequence
  chemically synthesized
aagaatgtcccatactctgggc

SEQ ID NO: 654833 - DNA, 22 bp, Artificial Sequence
  chemically synthesized
gaagaatgtcccatactctggg

SEQ ID NO: 654834 - DNA, 22 bp, Artificial Sequence
  chemically synthesized
ttgaagaatgtcccatactctg

SEQ ID NO: 654835 - DNA, 22 bp, Artificial Sequence
  chemically synthesized
tcttgaagaatgtcccatactc

SEQ ID NO: 654836 - DNA, 22 bp, Artificial Sequence
  chemically synthesized
agaccagttctcttgaagaatg

SEQ ID NO: 654837 - DNA, 22 bp, Artificial Sequence
  chemically synthesized
aagagttcagaccagttctctt

SEQ ID NO: 654838 - DNA, 22 bp, Artificial Sequence
  chemically synthesized
gaagagttcagaccagttctct

SEQ ID NO: 654839 - DNA, 22 bp, Artificial Sequence
  chemically synthesized
tgaagagttcagaccagttctc

SEQ ID NO: 654840 - DNA, 22 bp, Artificial Sequence
  chemically synthesized
ttgaagagttcagaccagttct

SEQ ID NO: 654841 - DNA, 22 bp, Artificial Sequence
  chemically synthesized
ttcaagagaactggtctgaact

SEQ ID NO: 654842 - DNA, 22 bp, Artificial Sequence
  chemically synthesized
acatttttgaagagttcagacc

SEQ ID NO: 654843 - DNA, 22 bp, Artificial Sequence
  chemically synthesized
caagagaactggtctgaactct

SEQ ID NO: 654844 - DNA, 22 bp, Artificial Sequence
  chemically synthesized
aagagaactggtctgaactctt

SEQ ID NO: 654845 - DNA, 22 bp, Artificial Sequence
  chemically synthesized
acgttgacatttttgaagagtt

SEQ ID NO: 654846 - DNA, 22 bp, Artificial Sequence
  chemically synthesized
gtctgaactcttcaaaaatgtc

SEQ ID NO: 654847 - DNA, 22 bp, Artificial Sequence
  chemically synthesized
aactcttcaaaaatgtcaacgt

SEQ ID NO: 654848 - DNA, 22 bp, Artificial Sequence
  chemically synthesized
ttcaaaaatgtcaacgtcagcc

SEQ ID NO: 654849 - DNA, 22 bp, Artificial Sequence
  chemically synthesized
caaaaatgtcaacgtcagcccg

SEQ ID NO: 654850 - DNA, 22 bp, Artificial Sequence
  chemically synthesized
aaaaatgtcaacgtcagcccgg

SEQ ID NO: 654851 - DNA, 22 bp, Artificial Sequence
  chemically synthesized
caggtatcagccaccacgccgg

SEQ ID NO: 654852 - DNA, 22 bp, Artificial Sequence
  chemically synthesized
gaattacaggtatcagccacca

SEQ ID NO: 654853 - DNA, 22 bp, Artificial Sequence
  chemically synthesized
ccaaagtactggaattacaggt

SEQ ID NO: 654854 - DNA, 22 bp, Artificial Sequence
  chemically synthesized
ggcctcccaaagtactggaatt

SEQ ID NO: 654855 - DNA, 22 bp, Artificial Sequence
  chemically synthesized
atacctgtaattccagtacttt

SEQ ID NO: 654856 - DNA, 22 bp, Artificial Sequence
  chemically synthesized
cctcggcctcccaaagtactgg

SEQ ID NO: 654857 - DNA, 22 bp, Artificial Sequence
  chemically synthesized
taattccagtactttgggaggc

SEQ ID NO: 654858 - DNA, 22 bp, Artificial Sequence
  chemically synthesized
cagtactttgggaggccgaggc

SEQ ID NO: 654859 - DNA, 22 bp, Artificial Sequence
  chemically synthesized
aggtgatccacctgcctcggcc

SEQ ID NO: 654860 - DNA, 22 bp, Artificial Sequence
  chemically synthesized
acctcaggtgatccacctgcct

SEQ ID NO: 654861 - DNA, 22 bp, Artificial Sequence
  chemically synthesized
tgggaggccgaggcaggtggat

SEQ ID NO: 654862 - DNA, 22 bp, Artificial Sequence
  chemically synthesized
gggaggccgaggcaggtggatc

SEQ ID NO: 654863 - DNA, 22 bp, Artificial Sequence
  chemically synthesized
ctgacctcaggtgatccacctg

SEQ ID NO: 654864 - DNA, 22 bp, Artificial Sequence
  chemically synthesized
ggaggccgaggcaggtggatca

SEQ ID NO: 654865 - DNA, 22 bp, Artificial Sequence
  chemically synthesized
aactcctgacctcaggtgatcc

SEQ ID NO: 654866 - DNA, 22 bp, Artificial Sequence
  chemically synthesized
gaactcctgacctcaggtgatc

SEQ ID NO: 654867 - DNA, 22 bp, Artificial Sequence
  chemically synthesized
gtcttgaactcctgacctcagg

SEQ ID NO: 654868 - DNA, 22 bp, Artificial Sequence
  chemically synthesized
gccaggctggtcttgaactcct

SEQ ID NO: 654869 - DNA, 22 bp, Artificial Sequence
  chemically synthesized
aggtcaggagttcaagaccagc

SEQ ID NO: 654870 - DNA, 22 bp, Artificial Sequence
  chemically synthesized
accacgttggccaggctggtct

SEQ ID NO: 654871 - DNA, 22 bp, Artificial Sequence
  chemically synthesized
caccacgttggccaggctggtc

SEQ ID NO: 654872 - DNA, 22 bp, Artificial Sequence
  chemically synthesized
aagaccagcctggccaacgtgg

SEQ ID NO: 654873 - DNA, 22 bp, Artificial Sequence
  chemically synthesized
gtagagacagggtttcaccacg

SEQ ID NO: 654874 - DNA, 22 bp, Artificial Sequence
  chemically synthesized
agtagagacagggtttcaccac

SEQ ID NO: 654875 - DNA, 22 bp, Artificial Sequence
  chemically synthesized
tagtagagacagggtttcacca

SEQ ID NO: 654876 - DNA, 22 bp, Artificial Sequence
  chemically synthesized
ttagtagagacagggtttcacc

SEQ ID NO: 654877 - DNA, 22 bp, Artificial Sequence
  chemically synthesized
gccaacgtggtgaaaccctgtc

SEQ ID NO: 654878 - DNA, 22 bp, Artificial Sequence
  chemically synthesized
tatttttagtagagacagggtt

SEQ ID NO: 654879 - DNA, 22 bp, Artificial Sequence
  chemically synthesized
gtatttttagtagagacagggt

SEQ ID NO: 654880 - DNA, 22 bp, Artificial Sequence
  chemically synthesized
tgtatttttagtagagacaggg

SEQ ID NO: 654881 - DNA, 22 bp, Artificial Sequence
  chemically synthesized
ttgtatttttagtagagacagg

SEQ ID NO: 654882 - DNA, 22 bp, Artificial Sequence
  chemically synthesized
atttttgtatttttagtagaga

SEQ ID NO: 654883 - DNA, 22 bp, Artificial Sequence
  chemically synthesized
tctctactaaaaatacaaaaat

SEQ ID NO: 654884 - DNA, 22 bp, Artificial Sequence
  chemically synthesized
tactaaaaatacaaaaatcagc

SEQ ID NO: 654885 - DNA, 22 bp, Artificial Sequence
  chemically synthesized
ctaaaaatacaaaaatcagccg

SEQ ID NO: 654886 - DNA, 22 bp, Artificial Sequence
  chemically synthesized
aaaatacaaaaatcagccgggt

SEQ ID NO: 654887 - DNA, 22 bp, Artificial Sequence
  chemically synthesized
caggcatgcaccaccacacccg

SEQ ID NO: 654888 - DNA, 22 bp, Artificial Sequence
  chemically synthesized
ggattacaggcatgcaccacca

SEQ ID NO: 654889 - DNA, 22 bp, Artificial Sequence
  chemically synthesized
aggagtagctgggattacaggc

SEQ ID NO: 654890 - DNA, 22 bp, Artificial Sequence
  chemically synthesized
agcctcaggagtagctgggatt

SEQ ID NO: 654891 - DNA, 22 bp, Artificial Sequence
  chemically synthesized
cacctcagcctcaggagtagct

SEQ ID NO: 654892 - DNA, 22 bp, Artificial Sequence
  chemically synthesized
tccacctcagcctcaggagtag

SEQ ID NO: 654893 - DNA, 22 bp, Artificial Sequence
  chemically synthesized
taatcccagctactcctgaggc

SEQ ID NO: 654894 - DNA, 22 bp, Artificial Sequence
  chemically synthesized
atgtgactctccacctcagcct

SEQ ID NO: 654895 - DNA, 22 bp, Artificial Sequence
  chemically synthesized
ctcctgaggctgaggtggagag

SEQ ID NO: 654896 - DNA, 22 bp, Artificial Sequence
  chemically synthesized
ccgagttcatgtgactctccac

SEQ ID NO: 654897 - DNA, 22 bp, Artificial Sequence
  chemically synthesized
ctgaggctgaggtggagagtca

SEQ ID NO: 654898 - DNA, 22 bp, Artificial Sequence
  chemically synthesized
cccgagttcatgtgactctcca

SEQ ID NO: 654899 - DNA, 22 bp, Artificial Sequence
  chemically synthesized
aggctgaggtggagagtcacat

SEQ ID NO: 654900 - DNA, 22 bp, Artificial Sequence
  chemically synthesized
cttcccgagttcatgtgactct

SEQ ID NO: 654901 - DNA, 22 bp, Artificial Sequence
  chemically synthesized
tgcttcccgagttcatgtgact

SEQ ID NO: 654902 - DNA, 22 bp, Artificial Sequence
  chemically synthesized
aggtggagagtcacatgaactc

SEQ ID NO: 654903 - DNA, 22 bp, Artificial Sequence
  chemically synthesized
caacctctgcttcccgagttca

SEQ ID NO: 654904 - DNA, 22 bp, Artificial Sequence
  chemically synthesized
actgcaacctctgcttcccgag

SEQ ID NO: 654905 - DNA, 22 bp, Artificial Sequence
  chemically synthesized
ggctcactgcaacctctgcttc

SEQ ID NO: 654906 - DNA, 22 bp, Artificial Sequence
  chemically synthesized
gggaagcagaggttgcagtgag

SEQ ID NO: 654907 - DNA, 22 bp, Artificial Sequence
  chemically synthesized
gagtgcagtggcgcaatctcgg

SEQ ID NO: 654908 - DNA, 22 bp, Artificial Sequence
  chemically synthesized
cagtgagccgagattgcgccac

SEQ ID NO: 654909 - DNA, 22 bp, Artificial Sequence
  chemically synthesized
tcacccaggctggagtgcagtg

SEQ ID NO: 654910 - DNA, 22 bp, Artificial Sequence
  chemically synthesized
tgtcacccaggctggagtgcag

SEQ ID NO: 654911 - DNA, 22 bp, Artificial Sequence
  chemically synthesized
gctctgtcacccaggctggagt

SEQ ID NO: 654912 - DNA, 22 bp, Artificial Sequence
  chemically synthesized
cgccactgcactccagcctggg

SEQ ID NO: 654913 - DNA, 22 bp, Artificial Sequence
  chemically synthesized
cactccagcctgggtgacagag

SEQ ID NO: 654914 - DNA, 22 bp, Artificial Sequence
  chemically synthesized
cagcctgggtgacagagcgaga

SEQ ID NO: 654915 - DNA, 22 bp, Artificial Sequence
  chemically synthesized
gtagggggacagagtctcgctc

SEQ ID NO: 654916 - DNA, 22 bp, Artificial Sequence
  chemically synthesized
ggtagggggacagagtctcgct

SEQ ID NO: 654917 - DNA, 22 bp, Artificial Sequence
  chemically synthesized
tggtagggggacagagtctcgc

SEQ ID NO: 654918 - DNA, 22 bp, Artificial Sequence
  chemically synthesized
ttggtagggggacagagtctcg

SEQ ID NO: 654919 - DNA, 22 bp, Artificial Sequence
  chemically synthesized
tttggtagggggacagagtctc

SEQ ID NO: 654920 - DNA, 22 bp, Artificial Sequence
  chemically synthesized
ggtgacagagcgagactctgtc

SEQ ID NO: 654921 - DNA, 22 bp, Artificial Sequence
  chemically synthesized
ttttggtagggggacagagtct

SEQ ID NO: 654922 - DNA, 22 bp, Artificial Sequence
  chemically synthesized
acttttttggtagggggacaga

SEQ ID NO: 654923 - DNA, 22 bp, Artificial Sequence
  chemically synthesized
atgacattgacttttttggtag

SEQ ID NO: 654924 - DNA, 22 bp, Artificial Sequence
  chemically synthesized
catgacattgacttttttggta

SEQ ID NO: 654925 - DNA, 22 bp, Artificial Sequence
  chemically synthesized
tcatgacattgacttttttggt

SEQ ID NO: 654926 - DNA, 22 bp, Artificial Sequence
  chemically synthesized
tgtccccctaccaaaaaagtca

SEQ ID NO: 654927 - DNA, 22 bp, Artificial Sequence
  chemically synthesized
ctttcatgacattgactttttt

SEQ ID NO: 654928 - DNA, 22 bp, Artificial Sequence
  chemically synthesized
cctttcatgacattgacttttt

SEQ ID NO: 654929 - DNA, 22 bp, Artificial Sequence
  chemically synthesized
tccccctaccaaaaaagtcaat

SEQ ID NO: 654930 - DNA, 22 bp, Artificial Sequence
  chemically synthesized
tcctttcatgacattgactttt

SEQ ID NO: 654931 - DNA, 22 bp, Artificial Sequence
  chemically synthesized
ttttcctttcatgacattgact

SEQ ID NO: 654932 - DNA, 22 bp, Artificial Sequence
  chemically synthesized
gttttcctttcatgacattgac

SEQ ID NO: 654933 - DNA, 22 bp, Artificial Sequence
  chemically synthesized
tgttttcctttcatgacattga

SEQ ID NO: 654934 - DNA, 22 bp, Artificial Sequence
  chemically synthesized
ccaaaaaagtcaatgtcatgaa

SEQ ID NO: 654935 - DNA, 22 bp, Artificial Sequence
  chemically synthesized
ccagcattttgttttcctttca

SEQ ID NO: 654936 - DNA, 22 bp, Artificial Sequence
  chemically synthesized
aacagtctcccagcattttgtt

SEQ ID NO: 654937 - DNA, 22 bp, Artificial Sequence
  chemically synthesized
gaacagtctcccagcattttgt

SEQ ID NO: 654938 - DNA, 22 bp, Artificial Sequence
  chemically synthesized
tgaacagtctcccagcattttg

SEQ ID NO: 654939 - DNA, 22 bp, Artificial Sequence
  chemically synthesized
gttttgaacagtctcccagcat

SEQ ID NO: 654940 - DNA, 22 bp, Artificial Sequence
  chemically synthesized
agttttgaacagtctcccagca

SEQ ID NO: 654941 - DNA, 22 bp, Artificial Sequence
  chemically synthesized
atttagttttgaacagtctccc

SEQ ID NO: 654942 - DNA, 22 bp, Artificial Sequence
  chemically synthesized
catttagttttgaacagtctcc

SEQ ID NO: 654943 - DNA, 22 bp, Artificial Sequence
  chemically synthesized
taccttcatttagttttgaaca

SEQ ID NO: 654944 - DNA, 22 bp, Artificial Sequence
  chemically synthesized
tgtaccttcatttagttttgaa

SEQ ID NO: 654945 - DNA, 22 bp, Artificial Sequence
  chemically synthesized
ggagactgttcaaaactaaatg

SEQ ID NO: 654946 - DNA, 22 bp, Artificial Sequence
  chemically synthesized
tcatgtctctgtaccttcattt

SEQ ID NO: 654947 - DNA, 22 bp, Artificial Sequence
  chemically synthesized
ttcaaaactaaatgaaggtaca

SEQ ID NO: 654948 - DNA, 22 bp, Artificial Sequence
  chemically synthesized
tctgtcatgtctctgtaccttc

SEQ ID NO: 654949 - DNA, 22 bp, Artificial Sequence
  chemically synthesized
gtctgtcatgtctctgtacctt

SEQ ID NO: 654950 - DNA, 22 bp, Artificial Sequence
  chemically synthesized
aaaactaaatgaaggtacagag

SEQ ID NO: 654951 - DNA, 22 bp, Artificial Sequence
  chemically synthesized
tgtctgtcatgtctctgtacct

SEQ ID NO: 654952 - DNA, 22 bp, Artificial Sequence
  chemically synthesized
ttgtctgtcatgtctctgtacc

SEQ ID NO: 654953 - DNA, 22 bp, Artificial Sequence
  chemically synthesized
aatgaaggtacagagacatgac

SEQ ID NO: 654954 - DNA, 22 bp, Artificial Sequence
  chemically synthesized
gtcaaggtttttgtctgtcatg

SEQ ID NO: 654955 - DNA, 22 bp, Artificial Sequence
  chemically synthesized
cagcatctagtcaaggtttttg

SEQ ID NO: 654956 - DNA, 22 bp, Artificial Sequence
  chemically synthesized
ccagcatctagtcaaggttttt

SEQ ID NO: 654957 - DNA, 22 bp, Artificial Sequence
  chemically synthesized
ttccagcatctagtcaaggttt

SEQ ID NO: 654958 - DNA, 22 bp, Artificial Sequence
  chemically synthesized
cttccagcatctagtcaaggtt

SEQ ID NO: 654959 - DNA, 22 bp, Artificial Sequence
  chemically synthesized
tcttccagcatctagtcaaggt

SEQ ID NO: 654960 - DNA, 22 bp, Artificial Sequence
  chemically synthesized
ttttcttccagcatctagtcaa

SEQ ID NO: 654961 - DNA, 22 bp, Artificial Sequence
  chemically synthesized
tagccactgttttcttccagca

SEQ ID NO: 654962 - DNA, 22 bp, Artificial Sequence
  chemically synthesized
atagccactgttttcttccagc

SEQ ID NO: 654963 - DNA, 22 bp, Artificial Sequence
  chemically synthesized
cttatagccactgttttcttcc

SEQ ID NO: 654964 - DNA, 22 bp, Artificial Sequence
  chemically synthesized
gactagatgctggaagaaaaca

SEQ ID NO: 654965 - DNA, 22 bp, Artificial Sequence
  chemically synthesized
actagatgctggaagaaaacag

SEQ ID NO: 654966 - DNA, 22 bp, Artificial Sequence
  chemically synthesized
ttccttatagccactgttttct

SEQ ID NO: 654967 - DNA, 22 bp, Artificial Sequence
  chemically synthesized
gatgctggaagaaaacagtggc

SEQ ID NO: 654968 - DNA, 22 bp, Artificial Sequence
  chemically synthesized
gaagaaaacagtggctataagg

SEQ ID NO: 654969 - DNA, 22 bp, Artificial Sequence
  chemically synthesized
cccagtgccccagaattgttcc

SEQ ID NO: 654970 - DNA, 22 bp, Artificial Sequence
  chemically synthesized
ccccagtgccccagaattgttc

SEQ ID NO: 654971 - DNA, 22 bp, Artificial Sequence
  chemically synthesized
tccccagtgccccagaattgtt

SEQ ID NO: 654972 - DNA, 22 bp, Artificial Sequence
  chemically synthesized
aactttccccagtgccccagaa

SEQ ID NO: 654973 - DNA, 22 bp, Artificial Sequence
  chemically synthesized
taaggaacaattctggggcact

SEQ ID NO: 654974 - DNA, 22 bp, Artificial Sequence
  chemically synthesized
tggggcactggggaaagttcag

SEQ ID NO: 654975 - DNA, 22 bp, Artificial Sequence
  chemically synthesized
gggcactggggaaagttcagtg

SEQ ID NO: 654976 - DNA, 22 bp, Artificial Sequence
  chemically synthesized
atatgcagtccacactgaactt

SEQ ID NO: 654977 - DNA, 22 bp, Artificial Sequence
  chemically synthesized
tgatatgcagtccacactgaac

SEQ ID NO: 654978 - DNA, 22 bp, Artificial Sequence
  chemically synthesized
gggaaagttcagtgtggactgc

SEQ ID NO: 654979 - DNA, 22 bp, Artificial Sequence
  chemically synthesized
agtgtggactgcatatcagagg

SEQ ID NO: 654980 - DNA, 22 bp, Artificial Sequence
  chemically synthesized
acagcaatccagcaataccctc

SEQ ID NO: 654981 - DNA, 22 bp, Artificial Sequence
  chemically synthesized
aacagcaatccagcaataccct

SEQ ID NO: 654982 - DNA, 22 bp, Artificial Sequence
  chemically synthesized
catatcagagggtattgctgga

SEQ ID NO: 654983 - DNA, 22 bp, Artificial Sequence
  chemically synthesized
cacacaaatttaacagcaatcc

SEQ ID NO: 654984 - DNA, 22 bp, Artificial Sequence
  chemically synthesized
tcgttacacacaaatttaacag

SEQ ID NO: 654985 - DNA, 22 bp, Artificial Sequence
  chemically synthesized
ctggattgctgttaaatttgtg

SEQ ID NO: 654986 - DNA, 22 bp, Artificial Sequence
  chemically synthesized
gattgctgttaaatttgtgtgt

SEQ ID NO: 654987 - DNA, 22 bp, Artificial Sequence
  chemically synthesized
caatgctatcgttacacacaaa

SEQ ID NO: 654988 - DNA, 22 bp, Artificial Sequence
  chemically synthesized
ctgttaaatttgtgtgtaacga

SEQ ID NO: 654989 - DNA, 22 bp, Artificial Sequence
  chemically synthesized
ttaaatttgtgtgtaacgatag

SEQ ID NO: 654990 - DNA, 22 bp, Artificial Sequence
  chemically synthesized
acataactgcaatgctatcgtt

SEQ ID NO: 654991 - DNA, 22 bp, Artificial Sequence
  chemically synthesized
aatttgtgtgtaacgatagcat

SEQ ID NO: 654992 - DNA, 22 bp, Artificial Sequence
  chemically synthesized
taacataactgcaatgctatcg

SEQ ID NO: 654993 - DNA, 22 bp, Artificial Sequence
  chemically synthesized
tctaacataactgcaatgctat

SEQ ID NO: 654994 - DNA, 22 bp, Artificial Sequence
  chemically synthesized
gtgtgtaacgatagcattgcag

SEQ ID NO: 654995 - DNA, 22 bp, Artificial Sequence
  chemically synthesized
tgtgtaacgatagcattgcagt

SEQ ID NO: 654996 - DNA, 22 bp, Artificial Sequence
  chemically synthesized
aaggatgacattctctaacata

SEQ ID NO: 654997 - DNA, 22 bp, Artificial Sequence
  chemically synthesized
aaaggatgacattctctaacat

SEQ ID NO: 654998 - DNA, 22 bp, Artificial Sequence
  chemically synthesized
ttaaaggatgacattctctaac

SEQ ID NO: 654999 - DNA, 22 bp, Artificial Sequence
  chemically synthesized
cttaaaggatgacattctctaa

SEQ ID NO: 655000 - DNA, 22 bp, Artificial Sequence
  chemically synthesized
tcttaaaggatgacattctcta

SEQ ID NO: 655001 - DNA, 22 bp, Artificial Sequence
  chemically synthesized
cagttatgttagagaatgtcat

SEQ ID NO: 655002 - DNA, 22 bp, Artificial Sequence
  chemically synthesized
tgttagagaatgtcatccttta

SEQ ID NO: 655003 - DNA, 22 bp, Artificial Sequence
  chemically synthesized
gagaatgtcatcctttaagaaa

SEQ ID NO: 655004 - DNA, 22 bp, Artificial Sequence
  chemically synthesized
accatacaccattttcttaaag

SEQ ID NO: 655005 - DNA, 22 bp, Artificial Sequence
  chemically synthesized
caccatacaccattttcttaaa

SEQ ID NO: 655006 - DNA, 22 bp, Artificial Sequence
  chemically synthesized
aacacttcaccatacaccattt

SEQ ID NO: 655007 - DNA, 22 bp, Artificial Sequence
  chemically synthesized
taagaaaatggtgtatggtgaa

SEQ ID NO: 655008 - DNA, 22 bp, Artificial Sequence
  chemically synthesized
aagaaaatggtgtatggtgaag

SEQ ID NO: 655009 - DNA, 22 bp, Artificial Sequence
  chemically synthesized
agaaaatggtgtatggtgaagt

SEQ ID NO: 655010 - DNA, 22 bp, Artificial Sequence
  chemically synthesized
aaagtaaaggagcatcacaaca

SEQ ID NO: 655011 - DNA, 22 bp, Artificial Sequence
  chemically synthesized
aaaagtaaaggagcatcacaac

SEQ ID NO: 655012 - DNA, 22 bp, Artificial Sequence
  chemically synthesized
aggggtttatgttgtgatgctc

SEQ ID NO: 655013 - DNA, 22 bp, Artificial Sequence
  chemically synthesized
ggggtttatgttgtgatgctcc

SEQ ID NO: 655014 - DNA, 22 bp, Artificial Sequence
  chemically synthesized
tgccatttaaaagtaaaggagc

SEQ ID NO: 655015 - DNA, 22 bp, Artificial Sequence
  chemically synthesized
atgttgtgatgctcctttactt

SEQ ID NO: 655016 - DNA, 22 bp, Artificial Sequence
  chemically synthesized
tgttgtgatgctcctttacttt

SEQ ID NO: 655017 - DNA, 22 bp, Artificial Sequence
  chemically synthesized
ccctatgccatttaaaagtaaa

SEQ ID NO: 655018 - DNA, 22 bp, Artificial Sequence
  chemically synthesized
cccctatgccatttaaaagtaa

SEQ ID NO: 655019 - DNA, 22 bp, Artificial Sequence
  chemically synthesized
tcccctatgccatttaaaagta

SEQ ID NO: 655020 - DNA, 22 bp, Artificial Sequence
  chemically synthesized
tgatgctcctttacttttaaat

SEQ ID NO: 655021 - DNA, 22 bp, Artificial Sequence
  chemically synthesized
ctttacttttaaatggcatagg

SEQ ID NO: 655022 - DNA, 22 bp, Artificial Sequence
  chemically synthesized
tacttttaaatggcatagggga

SEQ ID NO: 655023 - DNA, 22 bp, Artificial Sequence
  chemically synthesized
acttttaaatggcataggggaa

SEQ ID NO: 655024 - DNA, 22 bp, Artificial Sequence
  chemically synthesized
cttttaaatggcataggggaaa

SEQ ID NO: 655025 - DNA, 22 bp, Artificial Sequence
  chemically synthesized
ttaaatggcataggggaaaatg

SEQ ID NO: 655026 - DNA, 22 bp, Artificial Sequence
  chemically synthesized
taaatggcataggggaaaatgt

SEQ ID NO: 655027 - DNA, 22 bp, Artificial Sequence
  chemically synthesized
aaatggcataggggaaaatgtg

SEQ ID NO: 655028 - DNA, 22 bp, Artificial Sequence
  chemically synthesized
aatggcataggggaaaatgtgt

SEQ ID NO: 655029 - DNA, 22 bp, Artificial Sequence
  chemically synthesized
tgtacatacacacacaaacaca

SEQ ID NO: 655030 - DNA, 22 bp, Artificial Sequence
  chemically synthesized
tctgtgtacatacacacacaaa

SEQ ID NO: 655031 - DNA, 22 bp, Artificial Sequence
  chemically synthesized
tgtatgtgtctgtctgtgtaca

SEQ ID NO: 655032 - DNA, 22 bp, Artificial Sequence
  chemically synthesized
atgtatgtgtctgtctgtgtac

SEQ ID NO: 655033 - DNA, 22 bp, Artificial Sequence
  chemically synthesized
gtgtgtgtatgtacacagacag

SEQ ID NO: 655034 - DNA, 22 bp, Artificial Sequence
  chemically synthesized
tgtgtgtatgtacacagacaga

SEQ ID NO: 655035 - DNA, 22 bp, Artificial Sequence
  chemically synthesized
tttatgtatgtgtctgtctgtg

SEQ ID NO: 655036 - DNA, 22 bp, Artificial Sequence
  chemically synthesized
tgtttatgtatgtgtctgtctg

SEQ ID NO: 655037 - DNA, 22 bp, Artificial Sequence
  chemically synthesized
agctctgtttatgtatgtgtct

SEQ ID NO: 655038 - DNA, 22 bp, Artificial Sequence
  chemically synthesized
tcagctctgtttatgtatgtgt

SEQ ID NO: 655039 - DNA, 22 bp, Artificial Sequence
  chemically synthesized
caccctctcagctctgtttatg

SEQ ID NO: 655040 - DNA, 22 bp, Artificial Sequence
  chemically synthesized
ctccaccctctcagctctgttt

SEQ ID NO: 655041 - DNA, 22 bp, Artificial Sequence
  chemically synthesized
cctcctccaccctctcagctct

SEQ ID NO: 655042 - DNA, 22 bp, Artificial Sequence
  chemically synthesized
acctcctccaccctctcagctc

SEQ ID NO: 655043 - DNA, 22 bp, Artificial Sequence
  chemically synthesized
cttacctcctccaccctctcag

SEQ ID NO: 655044 - DNA, 22 bp, Artificial Sequence
  chemically synthesized
tacttacctcctccaccctctc

SEQ ID NO: 655045 - DNA, 22 bp, Artificial Sequence
  chemically synthesized
gctctacttacctcctccaccc

SEQ ID NO: 655046 - DNA, 22 bp, Artificial Sequence
  chemically synthesized
cgctctacttacctcctccacc

SEQ ID NO: 655047 - DNA, 22 bp, Artificial Sequence
  chemically synthesized
tcgctctacttacctcctccac

SEQ ID NO: 655048 - DNA, 22 bp, Artificial Sequence
  chemically synthesized
ttcgctctacttacctcctcca

SEQ ID NO: 655049 - DNA, 22 bp, Artificial Sequence
  chemically synthesized
cttttcgctctacttacctcct

SEQ ID NO: 655050 - DNA, 22 bp, Artificial Sequence
  chemically synthesized
agagggtggaggaggtaagtag

SEQ ID NO: 655051 - DNA, 22 bp, Artificial Sequence
  chemically synthesized
aatccatggttgcttttcgctc

SEQ ID NO: 655052 - DNA, 22 bp, Artificial Sequence
  chemically synthesized
ttcaatccatggttgcttttcg

SEQ ID NO: 655053 - DNA, 22 bp, Artificial Sequence
  chemically synthesized
tgtcatacatctgttcaatcca

SEQ ID NO: 655054 - DNA, 22 bp, Artificial Sequence
  chemically synthesized
atctgtgtcatacatctgttca

SEQ ID NO: 655055 - DNA, 22 bp, Artificial Sequence
  chemically synthesized
aagaacactcatctgtgtcata

SEQ ID NO: 655056 - DNA, 22 bp, Artificial Sequence
  chemically synthesized
aacagatgtatgacacagatga

SEQ ID NO: 655057 - DNA, 22 bp, Artificial Sequence
  chemically synthesized
aaaggatagtctaaagaacact

SEQ ID NO: 655058 - DNA, 22 bp, Artificial Sequence
  chemically synthesized
aagcacaaagagtagttgaaag

SEQ ID NO: 655059 - DNA, 22 bp, Artificial Sequence
  chemically synthesized
tttagactatcctttcaactac

SEQ ID NO: 655060 - DNA, 22 bp, Artificial Sequence
  chemically synthesized
caagcacaaagagtagttgaaa

SEQ ID NO: 655061 - DNA, 22 bp, Artificial Sequence
  chemically synthesized
tagactatcctttcaactactc

SEQ ID NO: 655062 - DNA, 22 bp, Artificial Sequence
  chemically synthesized
agactatcctttcaactactct

SEQ ID NO: 655063 - DNA, 22 bp, Artificial Sequence
  chemically synthesized
gactatcctttcaactactctt

SEQ ID NO: 655064 - DNA, 22 bp, Artificial Sequence
  chemically synthesized
tcctttcaactactctttgtgc

SEQ ID NO: 655065 - DNA, 22 bp, Artificial Sequence
  chemically synthesized
gaaacatttcaagcacaaagag

SEQ ID NO: 655066 - DNA, 22 bp, Artificial Sequence
  chemically synthesized
ggaaacatttcaagcacaaaga

SEQ ID NO: 655067 - DNA, 22 bp, Artificial Sequence
  chemically synthesized
tggaaacatttcaagcacaaag

SEQ ID NO: 655068 - DNA, 22 bp, Artificial Sequence
  chemically synthesized
tcaactactctttgtgcttgaa

SEQ ID NO: 655069 - DNA, 22 bp, Artificial Sequence
  chemically synthesized
ttttggaaacatttcaagcaca

SEQ ID NO: 655070 - DNA, 22 bp, Artificial Sequence
  chemically synthesized
caactactctttgtgcttgaaa

SEQ ID NO: 655071 - DNA, 22 bp, Artificial Sequence
  chemically synthesized
attttggaaacatttcaagcac

SEQ ID NO: 655072 - DNA, 22 bp, Artificial Sequence
  chemically synthesized
aactactctttgtgcttgaaat

SEQ ID NO: 655073 - DNA, 22 bp, Artificial Sequence
  chemically synthesized
tattttggaaacatttcaagca

SEQ ID NO: 655074 - DNA, 22 bp, Artificial Sequence
  chemically synthesized
ctctttgtgcttgaaatgtttc

SEQ ID NO: 655075 - DNA, 22 bp, Artificial Sequence
  chemically synthesized
tttgtgcttgaaatgtttccaa

SEQ ID NO: 655076 - DNA, 22 bp, Artificial Sequence
  chemically synthesized
tgtgcttgaaatgtttccaaaa

SEQ ID NO: 655077 - DNA, 22 bp, Artificial Sequence
  chemically synthesized
gtgcttgaaatgtttccaaaat

SEQ ID NO: 655078 - DNA, 22 bp, Artificial Sequence
  chemically synthesized
tgcttgaaatgtttccaaaata

SEQ ID NO: 655079 - DNA, 22 bp, Artificial Sequence
  chemically synthesized
caaccaacgttttattttggaa

SEQ ID NO: 655080 - DNA, 22 bp, Artificial Sequence
  chemically synthesized
ccaaccaacgttttattttgga

SEQ ID NO: 655081 - DNA, 22 bp, Artificial Sequence
  chemically synthesized
gaaatgtttccaaaataaaacg

SEQ ID NO: 655082 - DNA, 22 bp, Artificial Sequence
  chemically synthesized
aaatgtttccaaaataaaacgt

SEQ ID NO: 655083 - DNA, 22 bp, Artificial Sequence
  chemically synthesized
ccaaaataaaacgttggttgga

SEQ ID NO: 655084 - DNA, 22 bp, Artificial Sequence
  chemically synthesized
caaaataaaacgttggttggaa

SEQ ID NO: 655085 - DNA, 22 bp, Artificial Sequence
  chemically synthesized
ggagaaataacggtttccaacc

SEQ ID NO: 655086 - DNA, 22 bp, Artificial Sequence
  chemically synthesized
gggagaaataacggtttccaac

SEQ ID NO: 655087 - DNA, 22 bp, Artificial Sequence
  chemically synthesized
gttggaaaccgttatttctccc

SEQ ID NO: 655088 - DNA, 22 bp, Artificial Sequence
  chemically synthesized
gaaaccgttatttctcccaagt

SEQ ID NO: 655089 - DNA, 22 bp, Artificial Sequence
  chemically synthesized
ccatgaaggggtgacttgggag

SEQ ID NO: 655090 - DNA, 22 bp, Artificial Sequence
  chemically synthesized
ttcccatgaaggggtgacttgg

SEQ ID NO: 655091 - DNA, 22 bp, Artificial Sequence
  chemically synthesized
tttctcccaagtcaccccttca

SEQ ID NO: 655092 - DNA, 22 bp, Artificial Sequence
  chemically synthesized
ctcccaagtcaccccttcatgg

SEQ ID NO: 655093 - DNA, 22 bp, Artificial Sequence
  chemically synthesized
tcccaagtcaccccttcatggg

SEQ ID NO: 655094 - DNA, 22 bp, Artificial Sequence
  chemically synthesized
cccacaacctattcccatgaag

SEQ ID NO: 655095 - DNA, 22 bp, Artificial Sequence
  chemically synthesized
ccaagtcaccccttcatgggaa

SEQ ID NO: 655096 - DNA, 22 bp, Artificial Sequence
  chemically synthesized
gcccacaacctattcccatgaa

SEQ ID NO: 655097 - DNA, 22 bp, Artificial Sequence
  chemically synthesized
ccttgcccacaacctattccca

SEQ ID NO: 655098 - DNA, 22 bp, Artificial Sequence
  chemically synthesized
ctgccttgcccacaacctattc

SEQ ID NO: 655099 - DNA, 22 bp, Artificial Sequence
  chemically synthesized
catgggaataggttgtgggcaa

SEQ ID NO: 655100 - DNA, 22 bp, Artificial Sequence
  chemically synthesized
atgggaataggttgtgggcaag

SEQ ID NO: 655101 - DNA, 22 bp, Artificial Sequence
  chemically synthesized
cccaccctcctgccttgcccac

SEQ ID NO: 655102 - DNA, 22 bp, Artificial Sequence
  chemically synthesized
gcccaccctcctgccttgccca

SEQ ID NO: 655103 - DNA, 22 bp, Artificial Sequence
  chemically synthesized
ttgcccaccctcctgccttgcc

SEQ ID NO: 655104 - DNA, 22 bp, Artificial Sequence
  chemically synthesized
aaatcactcttgcccaccctcc

SEQ ID NO: 655105 - DNA, 22 bp, Artificial Sequence
  chemically synthesized
tgggcaaggcaggagggtgggc

SEQ ID NO: 655106 - DNA, 22 bp, Artificial Sequence
  chemically synthesized
ctaaaatcactcttgcccaccc

SEQ ID NO: 655107 - DNA, 22 bp, Artificial Sequence
  chemically synthesized
acagttactaaaatcactcttg

SEQ ID NO: 655108 - DNA, 22 bp, Artificial Sequence
  chemically synthesized
cacagttactaaaatcactctt

SEQ ID NO: 655109 - DNA, 22 bp, Artificial Sequence
  chemically synthesized
tcacagttactaaaatcactct

SEQ ID NO: 655110 - DNA, 22 bp, Artificial Sequence
  chemically synthesized
tccctttcacagttactaaaat

SEQ ID NO: 655111 - DNA, 22 bp, Artificial Sequence
  chemically synthesized
tcctgtccctttcacagttact

SEQ ID NO: 655112 - DNA, 22 bp, Artificial Sequence
  chemically synthesized
ataccattgtcctgtccctttc

SEQ ID NO: 655113 - DNA, 22 bp, Artificial Sequence
  chemically synthesized
tagtaactgtgaaagggacagg

SEQ ID NO: 655114 - DNA, 22 bp, Artificial Sequence
  chemically synthesized
agtaactgtgaaagggacagga

SEQ ID NO: 655115 - DNA, 22 bp, Artificial Sequence
  chemically synthesized
gtaactgtgaaagggacaggac

SEQ ID NO: 655116 - DNA, 22 bp, Artificial Sequence
  chemically synthesized
acattaataccattgtcctgtc

SEQ ID NO: 655117 - DNA, 22 bp, Artificial Sequence
  chemically synthesized
ttgacattaataccattgtcct

SEQ ID NO: 655118 - DNA, 22 bp, Artificial Sequence
  chemically synthesized
tgaaagggacaggacaatggta

SEQ ID NO: 655119 - DNA, 22 bp, Artificial Sequence
  chemically synthesized
ctattgacattaataccattgt

SEQ ID NO: 655120 - DNA, 22 bp, Artificial Sequence
  chemically synthesized
attactattgacattaatacca

SEQ ID NO: 655121 - DNA, 22 bp, Artificial Sequence
  chemically synthesized
acactcattactattgacatta

SEQ ID NO: 655122 - DNA, 22 bp, Artificial Sequence
  chemically synthesized
cacactcattactattgacatt

SEQ ID NO: 655123 - DNA, 22 bp, Artificial Sequence
  chemically synthesized
tcacactcattactattgacat

SEQ ID NO: 655124 - DNA, 22 bp, Artificial Sequence
  chemically synthesized
ttcacactcattactattgaca

SEQ ID NO: 655125 - DNA, 22 bp, Artificial Sequence
  chemically synthesized
gggaacttttcacactcattac

SEQ ID NO: 655126 - DNA, 22 bp, Artificial Sequence
  chemically synthesized
atgtcaatagtaatgagtgtga

SEQ ID NO: 655127 - DNA, 22 bp, Artificial Sequence
  chemically synthesized
gagaaaacgaatcctggggaac

SEQ ID NO: 655128 - DNA, 22 bp, Artificial Sequence
  chemically synthesized
agagaaaacgaatcctggggaa

SEQ ID NO: 655129 - DNA, 22 bp, Artificial Sequence
  chemically synthesized
tagagaaaacgaatcctgggga

SEQ ID NO: 655130 - DNA, 22 bp, Artificial Sequence
  chemically synthesized
ttagagaaaacgaatcctgggg

SEQ ID NO: 655131 - DNA, 22 bp, Artificial Sequence
  chemically synthesized
tatttttagagaaaacgaatcc

SEQ ID NO: 655132 - DNA, 22 bp, Artificial Sequence
  chemically synthesized
gtatttttagagaaaacgaatc

SEQ ID NO: 655133 - DNA, 22 bp, Artificial Sequence
  chemically synthesized
ggtttgtatttttagagaaaac

SEQ ID NO: 655134 - DNA, 22 bp, Artificial Sequence
  chemically synthesized
cccaggattcgttttctctaaa

SEQ ID NO: 655135 - DNA, 22 bp, Artificial Sequence
  chemically synthesized
cgttaggtttgtatttttagag

SEQ ID NO: 655136 - DNA, 22 bp, Artificial Sequence
  chemically synthesized
gcgttaggtttgtatttttaga

SEQ ID NO: 655137 - DNA, 22 bp, Artificial Sequence
  chemically synthesized
tgcgttaggtttgtatttttag

SEQ ID NO: 655138 - DNA, 22 bp, Artificial Sequence
  chemically synthesized
gttttctctaaaaatacaaacc

SEQ ID NO: 655139 - DNA, 22 bp, Artificial Sequence
  chemically synthesized
tctctaaaaatacaaacctaac

SEQ ID NO: 655140 - DNA, 22 bp, Artificial Sequence
  chemically synthesized
ctctaaaaatacaaacctaacg

SEQ ID NO: 655141 - DNA, 22 bp, Artificial Sequence
  chemically synthesized
tctaaaaatacaaacctaacgc

SEQ ID NO: 655142 - DNA, 22 bp, Artificial Sequence
  chemically synthesized
taaaaatacaaacctaacgcaa

SEQ ID NO: 655143 - DNA, 22 bp, Artificial Sequence
  chemically synthesized
aaaatacaaacctaacgcaaaa

SEQ ID NO: 655144 - DNA, 22 bp, Artificial Sequence
  chemically synthesized
acgcaaaattgatttccttcct

SEQ ID NO: 655145 - DNA, 22 bp, Artificial Sequence
  chemically synthesized
agaaccgtgacaaggacaggaa

SEQ ID NO: 655146 - DNA, 22 bp, Artificial Sequence
  chemically synthesized
aagaaccgtgacaaggacagga

SEQ ID NO: 655147 - DNA, 22 bp, Artificial Sequence
  chemically synthesized
taagaaccgtgacaaggacagg

SEQ ID NO: 655148 - DNA, 22 bp, Artificial Sequence
  chemically synthesized
atttccttcctgtccttgtcac

SEQ ID NO: 655149 - DNA, 22 bp, Artificial Sequence
  chemically synthesized
ccttcctgtccttgtcacggtt

SEQ ID NO: 655150 - DNA, 22 bp, Artificial Sequence
  chemically synthesized
cttcctgtccttgtcacggttc

SEQ ID NO: 655151 - DNA, 22 bp, Artificial Sequence
  chemically synthesized
cctgtccttgtcacggttctta

SEQ ID NO: 655152 - DNA, 22 bp, Artificial Sequence
  chemically synthesized
ctgtccttgtcacggttcttaa

SEQ ID NO: 655153 - DNA, 22 bp, Artificial Sequence
  chemically synthesized
tccttgtcacggttcttaaagc

SEQ ID NO: 655154 - DNA, 22 bp, Artificial Sequence
  chemically synthesized
gtcacggttcttaaagcatctc

SEQ ID NO: 655155 - DNA, 22 bp, Artificial Sequence
  chemically synthesized
tcacggttcttaaagcatctcc

SEQ ID NO: 655156 - DNA, 22 bp, Artificial Sequence
  chemically synthesized
ggcagagtcgatgaggagatgc

SEQ ID NO: 655157 - DNA, 22 bp, Artificial Sequence
  chemically synthesized
ttaaagcatctcctcatcgact

SEQ ID NO: 655158 - DNA, 22 bp, Artificial Sequence
  chemically synthesized
aaagcatctcctcatcgactct

SEQ ID NO: 655159 - DNA, 22 bp, Artificial Sequence
  chemically synthesized
aagcatctcctcatcgactctg

SEQ ID NO: 655160 - DNA, 22 bp, Artificial Sequence
  chemically synthesized
ggaaaagcacatctaggcagag

SEQ ID NO: 655161 - DNA, 22 bp, Artificial Sequence
  chemically synthesized
ctcatcgactctgcctagatgt

SEQ ID NO: 655162 - DNA, 22 bp, Artificial Sequence
  chemically synthesized
atcgactctgcctagatgtgct

SEQ ID NO: 655163 - DNA, 22 bp, Artificial Sequence
  chemically synthesized
gggatctaggaaaagcacatct

SEQ ID NO: 655164 - DNA, 22 bp, Artificial Sequence
  chemically synthesized
agggatctaggaaaagcacatc

SEQ ID NO: 655165 - DNA, 22 bp, Artificial Sequence
  chemically synthesized
tgcctagatgtgcttttcctag

SEQ ID NO: 655166 - DNA, 22 bp, Artificial Sequence
  chemically synthesized
acatttagggatctaggaaaag

SEQ ID NO: 655167 - DNA, 22 bp, Artificial Sequence
  chemically synthesized
cctagatgtgcttttcctagat

SEQ ID NO: 655168 - DNA, 22 bp, Artificial Sequence
  chemically synthesized
gatgtgcttttcctagatccct

SEQ ID NO: 655169 - DNA, 22 bp, Artificial Sequence
  chemically synthesized
gagattcacatttagggatcta

SEQ ID NO: 655170 - DNA, 22 bp, Artificial Sequence
  chemically synthesized
atgcctggagattcacatttag

SEQ ID NO: 655171 - DNA, 22 bp, Artificial Sequence
  chemically synthesized
ttcctagatccctaaatgtgaa

SEQ ID NO: 655172 - DNA, 22 bp, Artificial Sequence
  chemically synthesized
catgcctggagattcacattta

SEQ ID NO: 655173 - DNA, 22 bp, Artificial Sequence
  chemically synthesized
tcctagatccctaaatgtgaat

SEQ ID NO: 655174 - DNA, 22 bp, Artificial Sequence
  chemically synthesized
tcatgcctggagattcacattt

SEQ ID NO: 655175 - DNA, 22 bp, Artificial Sequence
  chemically synthesized
cctagatccctaaatgtgaatc

SEQ ID NO: 655176 - DNA, 22 bp, Artificial Sequence
  chemically synthesized
ctagatccctaaatgtgaatct

SEQ ID NO: 655177 - DNA, 22 bp, Artificial Sequence
  chemically synthesized
attttcatgcctggagattcac

SEQ ID NO: 655178 - DNA, 22 bp, Artificial Sequence
  chemically synthesized
gatccctaaatgtgaatctcca

SEQ ID NO: 655179 - DNA, 22 bp, Artificial Sequence
  chemically synthesized
aactcattttcatgcctggaga

SEQ ID NO: 655180 - DNA, 22 bp, Artificial Sequence
  chemically synthesized
aaactcattttcatgcctggag

SEQ ID NO: 655181 - DNA, 22 bp, Artificial Sequence
  chemically synthesized
ttaaactcattttcatgcctgg

SEQ ID NO: 655182 - DNA, 22 bp, Artificial Sequence
  chemically synthesized
aatgtgaatctccaggcatgaa

SEQ ID NO: 655183 - DNA, 22 bp, Artificial Sequence
  chemically synthesized
caggcatgaaaatgagtttaag

SEQ ID NO: 655184 - DNA, 22 bp, Artificial Sequence
  chemically synthesized
cgcatgtggggactcttaaact

SEQ ID NO: 655185 - DNA, 22 bp, Artificial Sequence
  chemically synthesized
tgcgcatgtggggactcttaaa

SEQ ID NO: 655186 - DNA, 22 bp, Artificial Sequence
  chemically synthesized
ctgcgcatgtggggactcttaa

SEQ ID NO: 655187 - DNA, 22 bp, Artificial Sequence
  chemically synthesized
cttctgcgcatgtggggactct

SEQ ID NO: 655188 - DNA, 22 bp, Artificial Sequence
  chemically synthesized
tgcttctgcgcatgtggggact

SEQ ID NO: 655189 - DNA, 22 bp, Artificial Sequence
  chemically synthesized
aagagtccccacatgcgcagaa

SEQ ID NO: 655190 - DNA, 22 bp, Artificial Sequence
  chemically synthesized
agagtccccacatgcgcagaag

SEQ ID NO: 655191 - DNA, 22 bp, Artificial Sequence
  chemically synthesized
aacaaaaagttctgcttctgcg

SEQ ID NO: 655192 - DNA, 22 bp, Artificial Sequence
  chemically synthesized
aaacaaaaagttctgcttctgc

SEQ ID NO: 655193 - DNA, 22 bp, Artificial Sequence
  chemically synthesized
aatccttaaacaaaaagttctg

SEQ ID NO: 655194 - DNA, 22 bp, Artificial Sequence
  chemically synthesized
tcaatccttaaacaaaaagttc

SEQ ID NO: 655195 - DNA, 22 bp, Artificial Sequence
  chemically synthesized
acctctcaatccttaaacaaaa

SEQ ID NO: 655196 - DNA, 22 bp, Artificial Sequence
  chemically synthesized
gacctctcaatccttaaacaaa

SEQ ID NO: 655197 - DNA, 22 bp, Artificial Sequence
  chemically synthesized
ttgacctctcaatccttaaaca

SEQ ID NO: 655198 - DNA, 22 bp, Artificial Sequence
  chemically synthesized
tttgtttaaggattgagaggtc

SEQ ID NO: 655199 - DNA, 22 bp, Artificial Sequence
  chemically synthesized
ttgtttaaggattgagaggtca

SEQ ID NO: 655200 - DNA, 22 bp, Artificial Sequence
  chemically synthesized
tgtttaaggattgagaggtcaa

SEQ ID NO: 655201 - DNA, 22 bp, Artificial Sequence
  chemically synthesized
gtttaaggattgagaggtcaag

SEQ ID NO: 655202 - DNA, 22 bp, Artificial Sequence
  chemically synthesized
acaaagacaactcttgacctct

SEQ ID NO: 655203 - DNA, 22 bp, Artificial Sequence
  chemically synthesized
tttaaggattgagaggtcaaga

SEQ ID NO: 655204 - DNA, 22 bp, Artificial Sequence
  chemically synthesized
aaggattgagaggtcaagagtt

SEQ ID NO: 655205 - DNA, 22 bp, Artificial Sequence
  chemically synthesized
tctcacaaagacaactcttgac

SEQ ID NO: 655206 - DNA, 22 bp, Artificial Sequence
  chemically synthesized
aggattgagaggtcaagagttg

SEQ ID NO: 655207 - DNA, 22 bp, Artificial Sequence
  chemically synthesized
gtctcacaaagacaactcttga

SEQ ID NO: 655208 - DNA, 22 bp, Artificial Sequence
  chemically synthesized
ttgtctcacaaagacaactctt

SEQ ID NO: 655209 - DNA, 22 bp, Artificial Sequence
  chemically synthesized
cttgtctcacaaagacaactct

SEQ ID NO: 655210 - DNA, 22 bp, Artificial Sequence
  chemically synthesized
ttcttgtctcacaaagacaact

SEQ ID NO: 655211 - DNA, 22 bp, Artificial Sequence
  chemically synthesized
cttcttgtctcacaaagacaac

SEQ ID NO: 655212 - DNA, 22 bp, Artificial Sequence
  chemically synthesized
agaggtcaagagttgtctttgt

SEQ ID NO: 655213 - DNA, 22 bp, Artificial Sequence
  chemically synthesized
cttcttcttgtctcacaaagac

SEQ ID NO: 655214 - DNA, 22 bp, Artificial Sequence
  chemically synthesized
acttcttcttgtctcacaaaga

SEQ ID NO: 655215 - DNA, 22 bp, Artificial Sequence
  chemically synthesized
tacttcttcttgtctcacaaag

SEQ ID NO: 655216 - DNA, 22 bp, Artificial Sequence
  chemically synthesized
ttacttcttcttgtctcacaaa

SEQ ID NO: 655217 - DNA, 22 bp, Artificial Sequence
  chemically synthesized
tctttgtgagacaagaagaagt

SEQ ID NO: 655218 - DNA, 22 bp, Artificial Sequence
  chemically synthesized
tgggaagccttttacttcttct

SEQ ID NO: 655219 - DNA, 22 bp, Artificial Sequence
  chemically synthesized
tgtgagacaagaagaagtaaaa

SEQ ID NO: 655220 - DNA, 22 bp, Artificial Sequence
  chemically synthesized
gtgagacaagaagaagtaaaag

SEQ ID NO: 655221 - DNA, 22 bp, Artificial Sequence
  chemically synthesized
tgagacaagaagaagtaaaagg

SEQ ID NO: 655222 - DNA, 22 bp, Artificial Sequence
  chemically synthesized
cccaagatggtagttatgggaa

SEQ ID NO: 655223 - DNA, 22 bp, Artificial Sequence
  chemically synthesized
tacccaagatggtagttatggg

SEQ ID NO: 655224 - DNA, 22 bp, Artificial Sequence
  chemically synthesized
ctacccaagatggtagttatgg

SEQ ID NO: 655225 - DNA, 22 bp, Artificial Sequence
  chemically synthesized
atttctacccaagatggtagtt

SEQ ID NO: 655226 - DNA, 22 bp, Artificial Sequence
  chemically synthesized
gatttctacccaagatggtagt

SEQ ID NO: 655227 - DNA, 22 bp, Artificial Sequence
  chemically synthesized
cccataactaccatcttgggta

SEQ ID NO: 655228 - DNA, 22 bp, Artificial Sequence
  chemically synthesized
ccataactaccatcttgggtag

SEQ ID NO: 655229 - DNA, 22 bp, Artificial Sequence
  chemically synthesized
aataaaatacttgatttctacc

SEQ ID NO: 655230 - DNA, 22 bp, Artificial Sequence
  chemically synthesized
aaataaaatacttgatttctac

SEQ ID NO: 655231 - DNA, 22 bp, Artificial Sequence
  chemically synthesized
taaataaaatacttgatttcta

SEQ ID NO: 655232 - DNA, 22 bp, Artificial Sequence
  chemically synthesized
ccatcttgggtagaaatcaagt

SEQ ID NO: 655233 - DNA, 22 bp, Artificial Sequence
  chemically synthesized
agaactttaaataaaatacttg

SEQ ID NO: 655234 - DNA, 22 bp, Artificial Sequence
  chemically synthesized
cagaactttaaataaaatactt

SEQ ID NO: 655235 - DNA, 22 bp, Artificial Sequence
  chemically synthesized
gggtagaaatcaagtattttat

SEQ ID NO: 655236 - DNA, 22 bp, Artificial Sequence
  chemically synthesized
ggtagaaatcaagtattttatt

SEQ ID NO: 655237 - DNA, 22 bp, Artificial Sequence
  chemically synthesized
tcttcagaactttaaataaaat

SEQ ID NO: 655238 - DNA, 22 bp, Artificial Sequence
  chemically synthesized
attatcttcagaactttaaata

SEQ ID NO: 655239 - DNA, 22 bp, Artificial Sequence
  chemically synthesized
ctcattatcttcagaactttaa

SEQ ID NO: 655240 - DNA, 22 bp, Artificial Sequence
  chemically synthesized
cctgctcattatcttcagaact

SEQ ID NO: 655241 - DNA, 22 bp, Artificial Sequence
  chemically synthesized
ctacctgctcattatcttcaga

SEQ ID NO: 655242 - DNA, 22 bp, Artificial Sequence
  chemically synthesized
tatttaaagttctgaagataat

SEQ ID NO: 655243 - DNA, 22 bp, Artificial Sequence
  chemically synthesized
atttaaagttctgaagataatg

SEQ ID NO: 655244 - DNA, 22 bp, Artificial Sequence
  chemically synthesized
tttaaagttctgaagataatga

SEQ ID NO: 655245 - DNA, 22 bp, Artificial Sequence
  chemically synthesized
gcctcctacctgctcattatct

SEQ ID NO: 655246 - DNA, 22 bp, Artificial Sequence
  chemically synthesized
aaagttctgaagataatgagca

SEQ ID NO: 655247 - DNA, 22 bp, Artificial Sequence
  chemically synthesized
aagttctgaagataatgagcag

SEQ ID NO: 655248 - DNA, 22 bp, Artificial Sequence
  chemically synthesized
ctggcctcctacctgctcatta

SEQ ID NO: 655249 - DNA, 22 bp, Artificial Sequence
  chemically synthesized
tgaagataatgagcaggtagga

SEQ ID NO: 655250 - DNA, 22 bp, Artificial Sequence
  chemically synthesized
aagataatgagcaggtaggagg

SEQ ID NO: 655251 - DNA, 22 bp, Artificial Sequence
  chemically synthesized
gagcagtgactgctggcctcct

SEQ ID NO: 655252 - DNA, 22 bp, Artificial Sequence
  chemically synthesized
agagcagtgactgctggcctcc

SEQ ID NO: 655253 - DNA, 22 bp, Artificial Sequence
  chemically synthesized
atatttagagcagtgactgctg

SEQ ID NO: 655254 - DNA, 22 bp, Artificial Sequence
  chemically synthesized
attaatatttagagcagtgact

SEQ ID NO: 655255 - DNA, 22 bp, Artificial Sequence
  chemically synthesized
agagtcctgattaatatttaga

SEQ ID NO: 655256 - DNA, 22 bp, Artificial Sequence
  chemically synthesized
ctctaaatattaatcaggactc

SEQ ID NO: 655257 - DNA, 22 bp, Artificial Sequence
  chemically synthesized
atgggtgattcagagtcctgat

SEQ ID NO: 655258 - DNA, 22 bp, Artificial Sequence
  chemically synthesized
aatgggtgattcagagtcctga

SEQ ID NO: 655259 - DNA, 22 bp, Artificial Sequence
  chemically synthesized
taatgggtgattcagagtcctg

SEQ ID NO: 655260 - DNA, 22 bp, Artificial Sequence
  chemically synthesized
taaatattaatcaggactctga

SEQ ID NO: 655261 - DNA, 22 bp, Artificial Sequence
  chemically synthesized
aatattaatcaggactctgaat

SEQ ID NO: 655262 - DNA, 22 bp, Artificial Sequence
  chemically synthesized
tctttaatgggtgattcagagt

SEQ ID NO: 655263 - DNA, 22 bp, Artificial Sequence
  chemically synthesized
atctttaatgggtgattcagag

SEQ ID NO: 655264 - DNA, 22 bp, Artificial Sequence
  chemically synthesized
tatctttaatgggtgattcaga

SEQ ID NO: 655265 - DNA, 22 bp, Artificial Sequence
  chemically synthesized
atcaggactctgaatcacccat

SEQ ID NO: 655266 - DNA, 22 bp, Artificial Sequence
  chemically synthesized
attttatctttaatgggtgatt

SEQ ID NO: 655267 - DNA, 22 bp, Artificial Sequence
  chemically synthesized
ggctgattttatctttaatggg

SEQ ID NO: 655268 - DNA, 22 bp, Artificial Sequence
  chemically synthesized
gggctgattttatctttaatgg

SEQ ID NO: 655269 - DNA, 22 bp, Artificial Sequence
  chemically synthesized
tttgggctgattttatctttaa

SEQ ID NO: 655270 - DNA, 22 bp, Artificial Sequence
  chemically synthesized
tgaatcacccattaaagataaa

SEQ ID NO: 655271 - DNA, 22 bp, Artificial Sequence
  chemically synthesized
aatcacccattaaagataaaat

SEQ ID NO: 655272 - DNA, 22 bp, Artificial Sequence
  chemically synthesized
ttgtttgggctgattttatctt

SEQ ID NO: 655273 - DNA, 22 bp, Artificial Sequence
  chemically synthesized
aagataaaatcagcccaaacaa

SEQ ID NO: 655274 - DNA, 22 bp, Artificial Sequence
  chemically synthesized
aacatggaaatgaagagtggat

SEQ ID NO: 655275 - DNA, 22 bp, Artificial Sequence
  chemically synthesized
gaacatggaaatgaagagtgga

SEQ ID NO: 655276 - DNA, 22 bp, Artificial Sequence
  chemically synthesized
tccttgaacatggaaatgaaga

SEQ ID NO: 655277 - DNA, 22 bp, Artificial Sequence
  chemically synthesized
tccactcttcatttccatgttc

SEQ ID NO: 655278 - DNA, 22 bp, Artificial Sequence
  chemically synthesized
ttcatttccatgttcaaggaca

SEQ ID NO: 655279 - DNA, 22 bp, Artificial Sequence
  chemically synthesized
aggtcaggacagttgtccttga

SEQ ID NO: 655280 - DNA, 22 bp, Artificial Sequence
  chemically synthesized
catttccatgttcaaggacaac

SEQ ID NO: 655281 - DNA, 22 bp, Artificial Sequence
  chemically synthesized
atttccatgttcaaggacaact

SEQ ID NO: 655282 - DNA, 22 bp, Artificial Sequence
  chemically synthesized
ccatgttcaaggacaactgtcc

SEQ ID NO: 655283 - DNA, 22 bp, Artificial Sequence
  chemically synthesized
catgttcaaggacaactgtcct

SEQ ID NO: 655284 - DNA, 22 bp, Artificial Sequence
  chemically synthesized
aaggacaactgtcctgacctca

SEQ ID NO: 655285 - DNA, 22 bp, Artificial Sequence
  chemically synthesized
gtcaggtggagtgcagagcctg

SEQ ID NO: 655286 - DNA, 22 bp, Artificial Sequence
  chemically synthesized
tcctgacctcaggctctgcact

SEQ ID NO: 655287 - DNA, 22 bp, Artificial Sequence
  chemically synthesized
ttagtcaggtggagtgcagagc

SEQ ID NO: 655288 - DNA, 22 bp, Artificial Sequence
  chemically synthesized
attagtcaggtggagtgcagag

SEQ ID NO: 655289 - DNA, 22 bp, Artificial Sequence
  chemically synthesized
acctcaggctctgcactccacc

SEQ ID NO: 655290 - DNA, 22 bp, Artificial Sequence
  chemically synthesized
gtttattagtcaggtggagtgc

SEQ ID NO: 655291 - DNA, 22 bp, Artificial Sequence
  chemically synthesized
attggtttattagtcaggtgga

SEQ ID NO: 655292 - DNA, 22 bp, Artificial Sequence
  chemically synthesized
aggctctgcactccacctgact

SEQ ID NO: 655293 - DNA, 22 bp, Artificial Sequence
  chemically synthesized
tgcactccacctgactaataaa

SEQ ID NO: 655294 - DNA, 22 bp, Artificial Sequence
  chemically synthesized
cactccacctgactaataaacc

SEQ ID NO: 655295 - DNA, 22 bp, Artificial Sequence
  chemically synthesized
cacctgactaataaaccaatta

SEQ ID NO: 655296 - DNA, 22 bp, Artificial Sequence
  chemically synthesized
gggccatggcgttaattggttt

SEQ ID NO: 655297 - DNA, 22 bp, Artificial Sequence
  chemically synthesized
cctagggccatggcgttaattg

SEQ ID NO: 655298 - DNA, 22 bp, Artificial Sequence
  chemically synthesized
actaataaaccaattaacgcca

SEQ ID NO: 655299 - DNA, 22 bp, Artificial Sequence
  chemically synthesized
ataaaccaattaacgccatggc

SEQ ID NO: 655300 - DNA, 22 bp, Artificial Sequence
  chemically synthesized
tgcatatgttccctagggccat

SEQ ID NO: 655301 - DNA, 22 bp, Artificial Sequence
  chemically synthesized
aaattgtgcatatgttccctag

SEQ ID NO: 655302 - DNA, 22 bp, Artificial Sequence
  chemically synthesized
acgccatggccctagggaacat

SEQ ID NO: 655303 - DNA, 22 bp, Artificial Sequence
  chemically synthesized
aaaattgtgcatatgttcccta

SEQ ID NO: 655304 - DNA, 22 bp, Artificial Sequence
  chemically synthesized
catagatttaaaattgtgcata

SEQ ID NO: 655305 - DNA, 22 bp, Artificial Sequence
  chemically synthesized
gcatagatttaaaattgtgcat

SEQ ID NO: 655306 - DNA, 22 bp, Artificial Sequence
  chemically synthesized
gggaacatatgcacaattttaa

SEQ ID NO: 655307 - DNA, 22 bp, Artificial Sequence
  chemically synthesized
gggatttgcatagatttaaaat

SEQ ID NO: 655308 - DNA, 22 bp, Artificial Sequence
  chemically synthesized
agggatttgcatagatttaaaa

SEQ ID NO: 655309 - DNA, 22 bp, Artificial Sequence
  chemically synthesized
agtatacttagggatttgcata

SEQ ID NO: 655310 - DNA, 22 bp, Artificial Sequence
  chemically synthesized
ttgagtatacttagggatttgc

SEQ ID NO: 655311 - DNA, 22 bp, Artificial Sequence
  chemically synthesized
taaatctatgcaaatccctaag

SEQ ID NO: 655312 - DNA, 22 bp, Artificial Sequence
  chemically synthesized
aaatctatgcaaatccctaagt

SEQ ID NO: 655313 - DNA, 22 bp, Artificial Sequence
  chemically synthesized
aatctatgcaaatccctaagta

SEQ ID NO: 655314 - DNA, 22 bp, Artificial Sequence
  chemically synthesized
atactgttgagtatacttaggg

SEQ ID NO: 655315 - DNA, 22 bp, Artificial Sequence
  chemically synthesized
tgcaaatccctaagtatactca

SEQ ID NO: 655316 - DNA, 22 bp, Artificial Sequence
  chemically synthesized
ggtagcataaattaatactgtt

SEQ ID NO: 655317 - DNA, 22 bp, Artificial Sequence
  chemically synthesized
agtatactcaacagtattaatt

SEQ ID NO: 655318 - DNA, 22 bp, Artificial Sequence
  chemically synthesized
gaactcggtagcataaattaat

SEQ ID NO: 655319 - DNA, 22 bp, Artificial Sequence
  chemically synthesized
aattagaactcggtagcataaa

SEQ ID NO: 655320 - DNA, 22 bp, Artificial Sequence
  chemically synthesized
aacagtattaatttatgctacc

SEQ ID NO: 655321 - DNA, 22 bp, Artificial Sequence
  chemically synthesized
ttaaattagaactcggtagcat

SEQ ID NO: 655322 - DNA, 22 bp, Artificial Sequence
  chemically synthesized
ctgttaaattagaactcggtag

SEQ ID NO: 655323 - DNA, 22 bp, Artificial Sequence
  chemically synthesized
cctgttaaattagaactcggta

SEQ ID NO: 655324 - DNA, 22 bp, Artificial Sequence
  chemically synthesized
tcctgttaaattagaactcggt

SEQ ID NO: 655325 - DNA, 22 bp, Artificial Sequence
  chemically synthesized
atttatgctaccgagttctaat

SEQ ID NO: 655326 - DNA, 22 bp, Artificial Sequence
  chemically synthesized
actttcctgttaaattagaact

SEQ ID NO: 655327 - DNA, 22 bp, Artificial Sequence
  chemically synthesized
aactttcctgttaaattagaac

SEQ ID NO: 655328 - DNA, 22 bp, Artificial Sequence
  chemically synthesized
atgctaccgagttctaatttaa

SEQ ID NO: 655329 - DNA, 22 bp, Artificial Sequence
  chemically synthesized
tgctaccgagttctaatttaac

SEQ ID NO: 655330 - DNA, 22 bp, Artificial Sequence
  chemically synthesized
atttaactttcctgttaaatta

SEQ ID NO: 655331 - DNA, 22 bp, Artificial Sequence
  chemically synthesized
taatttaactttcctgttaaat

SEQ ID NO: 655332 - DNA, 22 bp, Artificial Sequence
  chemically synthesized
ctaatttaactttcctgttaaa

SEQ ID NO: 655333 - DNA, 22 bp, Artificial Sequence
  chemically synthesized
ccgagttctaatttaacaggaa

SEQ ID NO: 655334 - DNA, 22 bp, Artificial Sequence
  chemically synthesized
tctaatttaactttcctgttaa

SEQ ID NO: 655335 - DNA, 22 bp, Artificial Sequence
  chemically synthesized
ttctaatttaactttcctgtta

SEQ ID NO: 655336 - DNA, 22 bp, Artificial Sequence
  chemically synthesized
taatttaacaggaaagttaaat

SEQ ID NO: 655337 - DNA, 22 bp, Artificial Sequence
  chemically synthesized
atttaacaggaaagttaaatta

SEQ ID NO: 655338 - DNA, 22 bp, Artificial Sequence
  chemically synthesized
aacaggaaagttaaattagaaa

SEQ ID NO: 655339 - DNA, 22 bp, Artificial Sequence
  chemically synthesized
acaggaaagttaaattagaaaa

SEQ ID NO: 655340 - DNA, 22 bp, Artificial Sequence
  chemically synthesized
ccatgtatatgtgaaacttttc

SEQ ID NO: 655341 - DNA, 22 bp, Artificial Sequence
  chemically synthesized
accatgtatatgtgaaactttt

SEQ ID NO: 655342 - DNA, 22 bp, Artificial Sequence
  chemically synthesized
taccatgtatatgtgaaacttt

SEQ ID NO: 655343 - DNA, 22 bp, Artificial Sequence
  chemically synthesized
aattagaaaagtttcacatata

SEQ ID NO: 655344 - DNA, 22 bp, Artificial Sequence
  chemically synthesized
gaaaagtttcacatatacatgg

SEQ ID NO: 655345 - DNA, 22 bp, Artificial Sequence
  chemically synthesized
cacatatacatggtaaagcaca

SEQ ID NO: 655346 - DNA, 22 bp, Artificial Sequence
  chemically synthesized
tagacagatatatgtgctttac

SEQ ID NO: 655347 - DNA, 22 bp, Artificial Sequence
  chemically synthesized
acatatacatggtaaagcacat

SEQ ID NO: 655348 - DNA, 22 bp, Artificial Sequence
  chemically synthesized
catggtacctatagacagatat

SEQ ID NO: 655349 - DNA, 22 bp, Artificial Sequence
  chemically synthesized
ggaaagtatattccatggtacc

SEQ ID NO: 655350 - DNA, 22 bp, Artificial Sequence
  chemically synthesized
gggaaagtatattccatggtac

SEQ ID NO: 655351 - DNA, 22 bp, Artificial Sequence
  chemically synthesized
tctataggtaccatggaatata

SEQ ID NO: 655352 - DNA, 22 bp, Artificial Sequence
  chemically synthesized
taggtaccatggaatatacttt

SEQ ID NO: 655353 - DNA, 22 bp, Artificial Sequence
  chemically synthesized
atccacacttgggaaagtatat

SEQ ID NO: 655354 - DNA, 22 bp, Artificial Sequence
  chemically synthesized
cataatgcgccctgatccacac

SEQ ID NO: 655355 - DNA, 22 bp, Artificial Sequence
  chemically synthesized
acataatgcgccctgatccaca

SEQ ID NO: 655356 - DNA, 22 bp, Artificial Sequence
  chemically synthesized
tacataatgcgccctgatccac

SEQ ID NO: 655357 - DNA, 22 bp, Artificial Sequence
  chemically synthesized
ttacataatgcgccctgatcca

SEQ ID NO: 655358 - DNA, 22 bp, Artificial Sequence
  chemically synthesized
ttttacataatgcgccctgatc

SEQ ID NO: 655359 - DNA, 22 bp, Artificial Sequence
  chemically synthesized
tcccaagtgtggatcagggcgc

SEQ ID NO: 655360 - DNA, 22 bp, Artificial Sequence
  chemically synthesized
cccaagtgtggatcagggcgca

SEQ ID NO: 655361 - DNA, 22 bp, Artificial Sequence
  chemically synthesized
ccaagtgtggatcagggcgcat

SEQ ID NO: 655362 - DNA, 22 bp, Artificial Sequence
  chemically synthesized
ttcttttacataatgcgccctg

SEQ ID NO: 655363 - DNA, 22 bp, Artificial Sequence
  chemically synthesized
gttcttttacataatgcgccct

SEQ ID NO: 655364 - DNA, 22 bp, Artificial Sequence
  chemically synthesized
tatcttgttcttttacataatg

SEQ ID NO: 655365 - DNA, 22 bp, Artificial Sequence
  chemically synthesized
atatcttgttcttttacataat

SEQ ID NO: 655366 - DNA, 22 bp, Artificial Sequence
  chemically synthesized
tatatcttgttcttttacataa

SEQ ID NO: 655367 - DNA, 22 bp, Artificial Sequence
  chemically synthesized
actttatatcttgttcttttac

SEQ ID NO: 655368 - DNA, 22 bp, Artificial Sequence
  chemically synthesized
tgtaaaagaacaagatataaag

SEQ ID NO: 655369 - DNA, 22 bp, Artificial Sequence
  chemically synthesized
taggaggcagtagtggaagagc

SEQ ID NO: 655370 - DNA, 22 bp, Artificial Sequence
  chemically synthesized
aaggattgtaggaggcagtagt

SEQ ID NO: 655371 - DNA, 22 bp, Artificial Sequence
  chemically synthesized
aaaggattgtaggaggcagtag

SEQ ID NO: 655372 - DNA, 22 bp, Artificial Sequence
  chemically synthesized
taaaggattgtaggaggcagta

SEQ ID NO: 655373 - DNA, 22 bp, Artificial Sequence
  chemically synthesized
gctcttccactactgcctccta

SEQ ID NO: 655374 - DNA, 22 bp, Artificial Sequence
  chemically synthesized
gattttaaaggattgtaggagg

SEQ ID NO: 655375 - DNA, 22 bp, Artificial Sequence
  chemically synthesized
ttccactactgcctcctacaat

SEQ ID NO: 655376 - DNA, 22 bp, Artificial Sequence
  chemically synthesized
ccactactgcctcctacaatcc

SEQ ID NO: 655377 - DNA, 22 bp, Artificial Sequence
  chemically synthesized
cactactgcctcctacaatcct

SEQ ID NO: 655378 - DNA, 22 bp, Artificial Sequence
  chemically synthesized
aactggattttaaaggattgta

SEQ ID NO: 655379 - DNA, 22 bp, Artificial Sequence
  chemically synthesized
ctgaactggattttaaaggatt

SEQ ID NO: 655380 - DNA, 22 bp, Artificial Sequence
  chemically synthesized
ctgcctcctacaatcctttaaa

SEQ ID NO: 655381 - DNA, 22 bp, Artificial Sequence
  chemically synthesized
cctgaactggattttaaaggat

SEQ ID NO: 655382 - DNA, 22 bp, Artificial Sequence
  chemically synthesized
tcctgaactggattttaaagga

SEQ ID NO: 655383 - DNA, 22 bp, Artificial Sequence
  chemically synthesized
ttcctgaactggattttaaagg

SEQ ID NO: 655384 - DNA, 22 bp, Artificial Sequence
  chemically synthesized
cctcctacaatcctttaaaatc

SEQ ID NO: 655385 - DNA, 22 bp, Artificial Sequence
  chemically synthesized
ccttttcctgaactggatttta

SEQ ID NO: 655386 - DNA, 22 bp, Artificial Sequence
  chemically synthesized
ctacaatcctttaaaatccagt

SEQ ID NO: 655387 - DNA, 22 bp, Artificial Sequence
  chemically synthesized
gccttttcctgaactggatttt

SEQ ID NO: 655388 - DNA, 22 bp, Artificial Sequence
  chemically synthesized
tgccttttcctgaactggattt

SEQ ID NO: 655389 - DNA, 22 bp, Artificial Sequence
  chemically synthesized
caatcctttaaaatccagttca

SEQ ID NO: 655390 - DNA, 22 bp, Artificial Sequence
  chemically synthesized
taattttgccttttcctgaact

SEQ ID NO: 655391 - DNA, 22 bp, Artificial Sequence
  chemically synthesized
ctgtaattttgccttttcctga

SEQ ID NO: 655392 - DNA, 22 bp, Artificial Sequence
  chemically synthesized
taaaatccagttcaggaaaagg

SEQ ID NO: 655393 - DNA, 22 bp, Artificial Sequence
  chemically synthesized
aaaatccagttcaggaaaaggc

SEQ ID NO: 655394 - DNA, 22 bp, Artificial Sequence
  chemically synthesized
aaatccagttcaggaaaaggca

SEQ ID NO: 655395 - DNA, 22 bp, Artificial Sequence
  chemically synthesized
ttcctgtaattttgccttttcc

SEQ ID NO: 655396 - DNA, 22 bp, Artificial Sequence
  chemically synthesized
tgttcctgtaattttgcctttt

SEQ ID NO: 655397 - DNA, 22 bp, Artificial Sequence
  chemically synthesized
ctgttcctgtaattttgccttt

SEQ ID NO: 655398 - DNA, 22 bp, Artificial Sequence
  chemically synthesized
tctgttcctgtaattttgcctt

SEQ ID NO: 655399 - DNA, 22 bp, Artificial Sequence
  chemically synthesized
ttttctgttcctgtaattttgc

SEQ ID NO: 655400 - DNA, 22 bp, Artificial Sequence
  chemically synthesized
tgttttctgttcctgtaatttt

SEQ ID NO: 655401 - DNA, 22 bp, Artificial Sequence
  chemically synthesized
aggaaaaggcaaaattacagga

SEQ ID NO: 655402 - DNA, 22 bp, Artificial Sequence
  chemically synthesized
gaaaccacagctctgttttctg

SEQ ID NO: 655403 - DNA, 22 bp, Artificial Sequence
  chemically synthesized
tggaaaccacagctctgttttc

SEQ ID NO: 655404 - DNA, 22 bp, Artificial Sequence
  chemically synthesized
caggaacagaaaacagagctgt

SEQ ID NO: 655405 - DNA, 22 bp, Artificial Sequence
  chemically synthesized
agtcccaatctctggaaaccac

SEQ ID NO: 655406 - DNA, 22 bp, Artificial Sequence
  chemically synthesized
actaagtcccaatctctggaaa

SEQ ID NO: 655407 - DNA, 22 bp, Artificial Sequence
  chemically synthesized
tggtttccagagattgggactt

SEQ ID NO: 655408 - DNA, 22 bp, Artificial Sequence
  chemically synthesized
tatcatctcactaagtcccaat

SEQ ID NO: 655409 - DNA, 22 bp, Artificial Sequence
  chemically synthesized
ccagagattgggacttagtgag

SEQ ID NO: 655410 - DNA, 22 bp, Artificial Sequence
  chemically synthesized
cagagattgggacttagtgaga

SEQ ID NO: 655411 - DNA, 22 bp, Artificial Sequence
  chemically synthesized
catcatgctgtatcatctcact

SEQ ID NO: 655412 - DNA, 22 bp, Artificial Sequence
  chemically synthesized
ggacttagtgagatgatacagc

SEQ ID NO: 655413 - DNA, 22 bp, Artificial Sequence
  chemically synthesized
aaattccatcatgctgtatcat

SEQ ID NO: 655414 - DNA, 22 bp, Artificial Sequence
  chemically synthesized
agtgagatgatacagcatgatg

SEQ ID NO: 655415 - DNA, 22 bp, Artificial Sequence
  chemically synthesized
gtgagatgatacagcatgatgg

SEQ ID NO: 655416 - DNA, 22 bp, Artificial Sequence
  chemically synthesized
tcacccctaaaattccatcatg

SEQ ID NO: 655417 - DNA, 22 bp, Artificial Sequence
  chemically synthesized
tatcacccctaaaattccatca

SEQ ID NO: 655418 - DNA, 22 bp, Artificial Sequence
  chemically synthesized
ctatcacccctaaaattccatc

SEQ ID NO: 655419 - DNA, 22 bp, Artificial Sequence
  chemically synthesized
catttctatcacccctaaaatt

SEQ ID NO: 655420 - DNA, 22 bp, Artificial Sequence
  chemically synthesized
ccatttctatcacccctaaaat

SEQ ID NO: 655421 - DNA, 22 bp, Artificial Sequence
  chemically synthesized
cttccatttctatcacccctaa

SEQ ID NO: 655422 - DNA, 22 bp, Artificial Sequence
  chemically synthesized
ccttccatttctatcaccccta

SEQ ID NO: 655423 - DNA, 22 bp, Artificial Sequence
  chemically synthesized
ttccttccatttctatcacccc

SEQ ID NO: 655424 - DNA, 22 bp, Artificial Sequence
  chemically synthesized
cttccttccatttctatcaccc

SEQ ID NO: 655425 - DNA, 22 bp, Artificial Sequence
  chemically synthesized
tcttccttccatttctatcacc

SEQ ID NO: 655426 - DNA, 22 bp, Artificial Sequence
  chemically synthesized
ctttcttccttccatttctatc

SEQ ID NO: 655427 - DNA, 22 bp, Artificial Sequence
  chemically synthesized
cctttcttccttccatttctat

SEQ ID NO: 655428 - DNA, 22 bp, Artificial Sequence
  chemically synthesized
cttcctttcttccttccatttc

SEQ ID NO: 655429 - DNA, 22 bp, Artificial Sequence
  chemically synthesized
taggggtgatagaaatggaagg

SEQ ID NO: 655430 - DNA, 22 bp, Artificial Sequence
  chemically synthesized
ccttcctttcttccttccattt

SEQ ID NO: 655431 - DNA, 22 bp, Artificial Sequence
  chemically synthesized
aggggtgatagaaatggaagga

SEQ ID NO: 655432 - DNA, 22 bp, Artificial Sequence
  chemically synthesized
ggggtgatagaaatggaaggaa

SEQ ID NO: 655433 - DNA, 22 bp, Artificial Sequence
  chemically synthesized
cttccttcctttcttccttcca

SEQ ID NO: 655434 - DNA, 22 bp, Artificial Sequence
  chemically synthesized
cctccttccttcctttcttcct

SEQ ID NO: 655435 - DNA, 22 bp, Artificial Sequence
  chemically synthesized
ccctccttccttcctttcttcc

SEQ ID NO: 655436 - DNA, 22 bp, Artificial Sequence
  chemically synthesized
cttccctccttccttcctttct

SEQ ID NO: 655437 - DNA, 22 bp, Artificial Sequence
  chemically synthesized
tccttccctccttccttccttt

SEQ ID NO: 655438 - DNA, 22 bp, Artificial Sequence
  chemically synthesized
ctccttccctccttccttcctt

SEQ ID NO: 655439 - DNA, 22 bp, Artificial Sequence
  chemically synthesized
tccccttctccttccctccttc

SEQ ID NO: 655440 - DNA, 22 bp, Artificial Sequence
  chemically synthesized
tgtccccttctccttccctcct

SEQ ID NO: 655441 - DNA, 22 bp, Artificial Sequence
  chemically synthesized
tctgtccccttctccttccctc

SEQ ID NO: 655442 - DNA, 22 bp, Artificial Sequence
  chemically synthesized
tctctgtccccttctccttccc

SEQ ID NO: 655443 - DNA, 22 bp, Artificial Sequence
  chemically synthesized
cctctctctgtccccttctcct

SEQ ID NO: 655444 - DNA, 22 bp, Artificial Sequence
  chemically synthesized
cctccctctctctgtccccttc

SEQ ID NO: 655445 - DNA, 22 bp, Artificial Sequence
  chemically synthesized
cctccctccctctctctgtccc

SEQ ID NO: 655446 - DNA, 22 bp, Artificial Sequence
  chemically synthesized
tccctccctccctctctctgtc

SEQ ID NO: 655447 - DNA, 22 bp, Artificial Sequence
  chemically synthesized
tctccctccctccctctctctg

SEQ ID NO: 655448 - DNA, 22 bp, Artificial Sequence
  chemically synthesized
tctctccctccctccctctctc

SEQ ID NO: 655449 - DNA, 22 bp, Artificial Sequence
  chemically synthesized
tctctctccctccctccctctc

SEQ ID NO: 655450 - DNA, 22 bp, Artificial Sequence
  chemically synthesized
tctctctctccctccctccctc

SEQ ID NO: 655451 - DNA, 22 bp, Artificial Sequence
  chemically synthesized
gttctctctctctccctccctc

SEQ ID NO: 655452 - DNA, 22 bp, Artificial Sequence
  chemically synthesized
cgttctctctctctccctccct

SEQ ID NO: 655453 - DNA, 22 bp, Artificial Sequence
  chemically synthesized
tcgttctctctctctccctccc

SEQ ID NO: 655454 - DNA, 22 bp, Artificial Sequence
  chemically synthesized
tttcgttctctctctctccctc

SEQ ID NO: 655455 - DNA, 22 bp, Artificial Sequence
  chemically synthesized
ctttcgttctctctctctccct

SEQ ID NO: 655456 - DNA, 22 bp, Artificial Sequence
  chemically synthesized
tctttcgttctctctctctccc

SEQ ID NO: 655457 - DNA, 22 bp, Artificial Sequence
  chemically synthesized
ttctttcgttctctctctctcc

SEQ ID NO: 655458 - DNA, 22 bp, Artificial Sequence
  chemically synthesized
ttttctttcgttctctctctct

SEQ ID NO: 655459 - DNA, 22 bp, Artificial Sequence
  chemically synthesized
tcttttctttcgttctctctct

SEQ ID NO: 655460 - DNA, 22 bp, Artificial Sequence
  chemically synthesized
ctcttttctttcgttctctctc

SEQ ID NO: 655461 - DNA, 22 bp, Artificial Sequence
  chemically synthesized
tctcttttctttcgttctctct

SEQ ID NO: 655462 - DNA, 22 bp, Artificial Sequence
  chemically synthesized
ttctcttttctttcgttctctc

SEQ ID NO: 655463 - DNA, 22 bp, Artificial Sequence
  chemically synthesized
ttttctcttttctttcgttctc

SEQ ID NO: 655464 - DNA, 22 bp, Artificial Sequence
  chemically synthesized
cttttctcttttctttcgttct

SEQ ID NO: 655465 - DNA, 22 bp, Artificial Sequence
  chemically synthesized
tcttttctcttttctttcgttc

SEQ ID NO: 655466 - DNA, 22 bp, Artificial Sequence
  chemically synthesized
tttcttttctcttttctttcgt

SEQ ID NO: 655467 - DNA, 22 bp, Artificial Sequence
  chemically synthesized
ctttcttttctcttttctttcg

SEQ ID NO: 655468 - DNA, 22 bp, Artificial Sequence
  chemically synthesized
tctttcttttctcttttctttc

SEQ ID NO: 655469 - DNA, 22 bp, Artificial Sequence
  chemically synthesized
tttctttcttttctcttttctt

SEQ ID NO: 655470 - DNA, 22 bp, Artificial Sequence
  chemically synthesized
ctttctttcttttctcttttct

SEQ ID NO: 655471 - DNA, 22 bp, Artificial Sequence
  chemically synthesized
tctttctttcttttctcttttc

SEQ ID NO: 655472 - DNA, 22 bp, Artificial Sequence
  chemically synthesized
ctttctttctttcttttctctt

SEQ ID NO: 655473 - DNA, 22 bp, Artificial Sequence
  chemically synthesized
cctttctttctttcttttctct

SEQ ID NO: 655474 - DNA, 22 bp, Artificial Sequence
  chemically synthesized
tcctttctttctttcttttctc

SEQ ID NO: 655475 - DNA, 22 bp, Artificial Sequence
  chemically synthesized
ctttcctttctttctttctttt

SEQ ID NO: 655476 - DNA, 22 bp, Artificial Sequence
  chemically synthesized
tcctttcctttctttctttctt

SEQ ID NO: 655477 - DNA, 22 bp, Artificial Sequence
  chemically synthesized
ctctcctttcctttctttcttt

SEQ ID NO: 655478 - DNA, 22 bp, Artificial Sequence
  chemically synthesized
tcctctcctttcctttctttct

SEQ ID NO: 655479 - DNA, 22 bp, Artificial Sequence
  chemically synthesized
ctctcctctcctttcctttctt

SEQ ID NO: 655480 - DNA, 22 bp, Artificial Sequence
  chemically synthesized
cctctcctctcctttcctttct

SEQ ID NO: 655481 - DNA, 22 bp, Artificial Sequence
  chemically synthesized
tcctctcctctcctttcctttc

SEQ ID NO: 655482 - DNA, 22 bp, Artificial Sequence
  chemically synthesized
ctttcctctcctctcctttcct

SEQ ID NO: 655483 - DNA, 22 bp, Artificial Sequence
  chemically synthesized
cctttcctctcctctcctttcc

SEQ ID NO: 655484 - DNA, 22 bp, Artificial Sequence
  chemically synthesized
ttcctttcctctcctctccttt

SEQ ID NO: 655485 - DNA, 22 bp, Artificial Sequence
  chemically synthesized
tcttcctttcctctcctctcct

SEQ ID NO: 655486 - DNA, 22 bp, Artificial Sequence
  chemically synthesized
ccgcctctcttcctttcctctc

SEQ ID NO: 655487 - DNA, 22 bp, Artificial Sequence
  chemically synthesized
cctcccgcctctcttcctttcc

SEQ ID NO: 655488 - DNA, 22 bp, Artificial Sequence
  chemically synthesized
ccctccctcccgcctctcttcc

SEQ ID NO: 655489 - DNA, 22 bp, Artificial Sequence
  chemically synthesized
ctgccctccctcccgcctctct

SEQ ID NO: 655490 - DNA, 22 bp, Artificial Sequence
  chemically synthesized
cctgccctccctcccgcctctc

SEQ ID NO: 655491 - DNA, 22 bp, Artificial Sequence
  chemically synthesized
cttcctgccctccctcccgcct

SEQ ID NO: 655492 - DNA, 22 bp, Artificial Sequence
  chemically synthesized
ccttcctgccctccctcccgcc

SEQ ID NO: 655493 - DNA, 22 bp, Artificial Sequence
  chemically synthesized
cttccttcctgccctccctccc

SEQ ID NO: 655494 - DNA, 22 bp, Artificial Sequence
  chemically synthesized
ccttccttcctgccctccctcc

SEQ ID NO: 655495 - DNA, 22 bp, Artificial Sequence
  chemically synthesized
cttccttccttcctgccctccc

SEQ ID NO: 655496 - DNA, 22 bp, Artificial Sequence
  chemically synthesized
ccttccttccttcctgccctcc

SEQ ID NO: 655497 - DNA, 22 bp, Artificial Sequence
  chemically synthesized
tccttccttccttcctgccctc

SEQ ID NO: 655498 - DNA, 22 bp, Artificial Sequence
  chemically synthesized
ttccttccttccttcctgccct

SEQ ID NO: 655499 - DNA, 22 bp, Artificial Sequence
  chemically synthesized
tcttttccttccttccttcctg

SEQ ID NO: 655500 - DNA, 22 bp, Artificial Sequence
  chemically synthesized
accctgtcttttccttccttcc

SEQ ID NO: 655501 - DNA, 22 bp, Artificial Sequence
  chemically synthesized
tcaccctgtcttttccttcctt

SEQ ID NO: 655502 - DNA, 22 bp, Artificial Sequence
  chemically synthesized
ctctcaccctgtcttttccttc

SEQ ID NO: 655503 - DNA, 22 bp, Artificial Sequence
  chemically synthesized
cctctcaccctgtcttttcctt

SEQ ID NO: 655504 - DNA, 22 bp, Artificial Sequence
  chemically synthesized
cttcctctcaccctgtcttttc

SEQ ID NO: 655505 - DNA, 22 bp, Artificial Sequence
  chemically synthesized
ccttcctctcaccctgtctttt

SEQ ID NO: 655506 - DNA, 22 bp, Artificial Sequence
  chemically synthesized
cttccttcctctcaccctgtct

SEQ ID NO: 655507 - DNA, 22 bp, Artificial Sequence
  chemically synthesized
ccttccttcctctcaccctgtc

SEQ ID NO: 655508 - DNA, 22 bp, Artificial Sequence
  chemically synthesized
ttccttccttcctctcaccctg

SEQ ID NO: 655509 - DNA, 22 bp, Artificial Sequence
  chemically synthesized
cttccttccttcctctcaccct

SEQ ID NO: 655510 - DNA, 22 bp, Artificial Sequence
  chemically synthesized
tcttccttccttcctctcaccc

SEQ ID NO: 655511 - DNA, 22 bp, Artificial Sequence
  chemically synthesized
tttcttccttccttcctctcac

SEQ ID NO: 655512 - DNA, 22 bp, Artificial Sequence
  chemically synthesized
ctttcttccttccttcctctca

SEQ ID NO: 655513 - DNA, 22 bp, Artificial Sequence
  chemically synthesized
tctttcttccttccttcctctc

SEQ ID NO: 655514 - DNA, 22 bp, Artificial Sequence
  chemically synthesized
tgaccaaatctttctttcttcc

SEQ ID NO: 655515 - DNA, 22 bp, Artificial Sequence
  chemically synthesized
ttatgaccaaatctttctttct

SEQ ID NO: 655516 - DNA, 22 bp, Artificial Sequence
  chemically synthesized
attgttatgaccaaatctttct

SEQ ID NO: 655517 - DNA, 22 bp, Artificial Sequence
  chemically synthesized
cattgttatgaccaaatctttc

SEQ ID NO: 655518 - DNA, 22 bp, Artificial Sequence
  chemically synthesized
aagtagcacttcattgttatga

SEQ ID NO: 655519 - DNA, 22 bp, Artificial Sequence
  chemically synthesized
taaagtagcacttcattgttat

SEQ ID NO: 655520 - DNA, 22 bp, Artificial Sequence
  chemically synthesized
ctaaagtagcacttcattgtta

SEQ ID NO: 655521 - DNA, 22 bp, Artificial Sequence
  chemically synthesized
atccttctaaagtagcacttca

SEQ ID NO: 655522 - DNA, 22 bp, Artificial Sequence
  chemically synthesized
ggtcataacaatgaagtgctac

SEQ ID NO: 655523 - DNA, 22 bp, Artificial Sequence
  chemically synthesized
catccttctaaagtagcacttc

SEQ ID NO: 655524 - DNA, 22 bp, Artificial Sequence
  chemically synthesized
gtcataacaatgaagtgctact

SEQ ID NO: 655525 - DNA, 22 bp, Artificial Sequence
  chemically synthesized
catcttcatccttctaaagtag

SEQ ID NO: 655526 - DNA, 22 bp, Artificial Sequence
  chemically synthesized
ccatcttcatccttctaaagta

SEQ ID NO: 655527 - DNA, 22 bp, Artificial Sequence
  chemically synthesized
tccatcttcatccttctaaagt

SEQ ID NO: 655528 - DNA, 22 bp, Artificial Sequence
  chemically synthesized
ttttccatcttcatccttctaa

SEQ ID NO: 655529 - DNA, 22 bp, Artificial Sequence
  chemically synthesized
gttttccatcttcatccttcta

SEQ ID NO: 655530 - DNA, 22 bp, Artificial Sequence
  chemically synthesized
tgttttccatcttcatccttct

SEQ ID NO: 655531 - DNA, 22 bp, Artificial Sequence
  chemically synthesized
ctttagaaggatgaagatggaa

SEQ ID NO: 655532 - DNA, 22 bp, Artificial Sequence
  chemically synthesized
tagaaggatgaagatggaaaac

SEQ ID NO: 655533 - DNA, 22 bp, Artificial Sequence
  chemically synthesized
agaaggatgaagatggaaaaca

SEQ ID NO: 655534 - DNA, 22 bp, Artificial Sequence
  chemically synthesized
gaaggatgaagatggaaaacaa

SEQ ID NO: 655535 - DNA, 22 bp, Artificial Sequence
  chemically synthesized
aggaaaagcacatgtcattttg

SEQ ID NO: 655536 - DNA, 22 bp, Artificial Sequence
  chemically synthesized
ctaaggaaaagcacatgtcatt

SEQ ID NO: 655537 - DNA, 22 bp, Artificial Sequence
  chemically synthesized
ctgctaaggaaaagcacatgtc

SEQ ID NO: 655538 - DNA, 22 bp, Artificial Sequence
  chemically synthesized
actgctaaggaaaagcacatgt

SEQ ID NO: 655539 - DNA, 22 bp, Artificial Sequence
  chemically synthesized
tacacttactgctaaggaaaag

SEQ ID NO: 655540 - DNA, 22 bp, Artificial Sequence
  chemically synthesized
atacacttactgctaaggaaaa

SEQ ID NO: 655541 - DNA, 22 bp, Artificial Sequence
  chemically synthesized
tttatacacttactgctaagga

SEQ ID NO: 655542 - DNA, 22 bp, Artificial Sequence
  chemically synthesized
gtttatacacttactgctaagg

SEQ ID NO: 655543 - DNA, 22 bp, Artificial Sequence
  chemically synthesized
tgtttatacacttactgctaag

SEQ ID NO: 655544 - DNA, 22 bp, Artificial Sequence
  chemically synthesized
ttttgtttatacacttactgct

SEQ ID NO: 655545 - DNA, 22 bp, Artificial Sequence
  chemically synthesized
ttccttagcagtaagtgtataa

SEQ ID NO: 655546 - DNA, 22 bp, Artificial Sequence
  chemically synthesized
tccttagcagtaagtgtataaa

SEQ ID NO: 655547 - DNA, 22 bp, Artificial Sequence
  chemically synthesized
aaacctgttttgtttatacact

SEQ ID NO: 655548 - DNA, 22 bp, Artificial Sequence
  chemically synthesized
ccttagcagtaagtgtataaac

SEQ ID NO: 655549 - DNA, 22 bp, Artificial Sequence
  chemically synthesized
cttagcagtaagtgtataaaca

SEQ ID NO: 655550 - DNA, 22 bp, Artificial Sequence
  chemically synthesized
agcagtaagtgtataaacaaaa

SEQ ID NO: 655551 - DNA, 22 bp, Artificial Sequence
  chemically synthesized
gcagtaagtgtataaacaaaac

SEQ ID NO: 655552 - DNA, 22 bp, Artificial Sequence
  chemically synthesized
tagttgaaacctgttttgttta

SEQ ID NO: 655553 - DNA, 22 bp, Artificial Sequence
  chemically synthesized
tgttgtagttgaaacctgtttt

SEQ ID NO: 655554 - DNA, 22 bp, Artificial Sequence
  chemically synthesized
gtgttgtagttgaaacctgttt

SEQ ID NO: 655555 - DNA, 22 bp, Artificial Sequence
  chemically synthesized
aagataggtttgtgttgtagtt

SEQ ID NO: 655556 - DNA, 22 bp, Artificial Sequence
  chemically synthesized
gaagataggtttgtgttgtagt

SEQ ID NO: 655557 - DNA, 22 bp, Artificial Sequence
  chemically synthesized
tgaagataggtttgtgttgtag

SEQ ID NO: 655558 - DNA, 22 bp, Artificial Sequence
  chemically synthesized
caactacaacacaaacctatct

SEQ ID NO: 655559 - DNA, 22 bp, Artificial Sequence
  chemically synthesized
aactacaacacaaacctatctt

SEQ ID NO: 655560 - DNA, 22 bp, Artificial Sequence
  chemically synthesized
accagaattttgaagataggtt

SEQ ID NO: 655561 - DNA, 22 bp, Artificial Sequence
  chemically synthesized
caccagaattttgaagataggt

SEQ ID NO: 655562 - DNA, 22 bp, Artificial Sequence
  chemically synthesized
ttcaccagaattttgaagatag

SEQ ID NO: 655563 - DNA, 22 bp, Artificial Sequence
  chemically synthesized
cttcaccagaattttgaagata

SEQ ID NO: 655564 - DNA, 22 bp, Artificial Sequence
  chemically synthesized
caacacaaacctatcttcaaaa

SEQ ID NO: 655565 - DNA, 22 bp, Artificial Sequence
  chemically synthesized
tcttcaccagaattttgaagat

SEQ ID NO: 655566 - DNA, 22 bp, Artificial Sequence
  chemically synthesized
tcttcaaaattctggtgaagaa

SEQ ID NO: 655567 - DNA, 22 bp, Artificial Sequence
  chemically synthesized
gagtaatggatgttttcttcac

SEQ ID NO: 655568 - DNA, 22 bp, Artificial Sequence
  chemically synthesized
caaaattctggtgaagaaaaca

SEQ ID NO: 655569 - DNA, 22 bp, Artificial Sequence
  chemically synthesized
aaaattctggtgaagaaaacat

SEQ ID NO: 655570 - DNA, 22 bp, Artificial Sequence
  chemically synthesized
ttggagtaatggatgttttctt

SEQ ID NO: 655571 - DNA, 22 bp, Artificial Sequence
  chemically synthesized
tattggagtaatggatgttttc

SEQ ID NO: 655572 - DNA, 22 bp, Artificial Sequence
  chemically synthesized
tctattggagtaatggatgttt

SEQ ID NO: 655573 - DNA, 22 bp, Artificial Sequence
  chemically synthesized
ctctattggagtaatggatgtt

SEQ ID NO: 655574 - DNA, 22 bp, Artificial Sequence
  chemically synthesized
tggtgaagaaaacatccattac

SEQ ID NO: 655575 - DNA, 22 bp, Artificial Sequence
  chemically synthesized
gtgaagaaaacatccattactc

SEQ ID NO: 655576 - DNA, 22 bp, Artificial Sequence
  chemically synthesized
acttctctattggagtaatgga

SEQ ID NO: 655577 - DNA, 22 bp, Artificial Sequence
  chemically synthesized
attaacttctctattggagtaa

SEQ ID NO: 655578 - DNA, 22 bp, Artificial Sequence
  chemically synthesized
gattaacttctctattggagta

SEQ ID NO: 655579 - DNA, 22 bp, Artificial Sequence
  chemically synthesized
tttgattaacttctctattgga

SEQ ID NO: 655580 - DNA, 22 bp, Artificial Sequence
  chemically synthesized
gtttgattaacttctctattgg

SEQ ID NO: 655581 - DNA, 22 bp, Artificial Sequence
  chemically synthesized
agtggtttgtttgattaacttc

SEQ ID NO: 655582 - DNA, 22 bp, Artificial Sequence
  chemically synthesized
aagtggtttgtttgattaactt

SEQ ID NO: 655583 - DNA, 22 bp, Artificial Sequence
  chemically synthesized
ctccaatagagaagttaatcaa

SEQ ID NO: 655584 - DNA, 22 bp, Artificial Sequence
  chemically synthesized
tttaagtggtttgtttgattaa

SEQ ID NO: 655585 - DNA, 22 bp, Artificial Sequence
  chemically synthesized
caatagagaagttaatcaaaca

SEQ ID NO: 655586 - DNA, 22 bp, Artificial Sequence
  chemically synthesized
tgatgatctgtttaagtggttt

SEQ ID NO: 655587 - DNA, 22 bp, Artificial Sequence
  chemically synthesized
atgatgatctgtttaagtggtt

SEQ ID NO: 655588 - DNA, 22 bp, Artificial Sequence
  chemically synthesized
tatgatgatctgtttaagtggt

SEQ ID NO: 655589 - DNA, 22 bp, Artificial Sequence
  chemically synthesized
atcaaacaaaccacttaaacag

SEQ ID NO: 655590 - DNA, 22 bp, Artificial Sequence
  chemically synthesized
agctttatgatgatctgtttaa

SEQ ID NO: 655591 - DNA, 22 bp, Artificial Sequence
  chemically synthesized
ccgtgggttaagctttatgatg

SEQ ID NO: 655592 - DNA, 22 bp, Artificial Sequence
  chemically synthesized
aaacagatcatcataaagctta

SEQ ID NO: 655593 - DNA, 22 bp, Artificial Sequence
  chemically synthesized
aacagatcatcataaagcttaa

SEQ ID NO: 655594 - DNA, 22 bp, Artificial Sequence
  chemically synthesized
agctaccgtgggttaagcttta

SEQ ID NO: 655595 - DNA, 22 bp, Artificial Sequence
  chemically synthesized
aagctaccgtgggttaagcttt

SEQ ID NO: 655596 - DNA, 22 bp, Artificial Sequence
  chemically synthesized
taagctaccgtgggttaagctt

SEQ ID NO: 655597 - DNA, 22 bp, Artificial Sequence
  chemically synthesized
aaaattttaagctaccgtgggt

SEQ ID NO: 655598 - DNA, 22 bp, Artificial Sequence
  chemically synthesized
aaaaattttaagctaccgtggg

SEQ ID NO: 655599 - DNA, 22 bp, Artificial Sequence
  chemically synthesized
taaaaattttaagctaccgtgg

SEQ ID NO: 655600 - DNA, 22 bp, Artificial Sequence
  chemically synthesized
ttaaaaattttaagctaccgtg

SEQ ID NO: 655601 - DNA, 22 bp, Artificial Sequence
  chemically synthesized
tttttaaaaattttaagctacc

SEQ ID NO: 655602 - DNA, 22 bp, Artificial Sequence
  chemically synthesized
ttatttttaaaaattttaagct

SEQ ID NO: 655603 - DNA, 22 bp, Artificial Sequence
  chemically synthesized
aacccacggtagcttaaaattt

SEQ ID NO: 655604 - DNA, 22 bp, Artificial Sequence
  chemically synthesized
acccacggtagcttaaaatttt

SEQ ID NO: 655605 - DNA, 22 bp, Artificial Sequence
  chemically synthesized
cagttgttatttttaaaaattt

SEQ ID NO: 655606 - DNA, 22 bp, Artificial Sequence
  chemically synthesized
ccagttgttatttttaaaaatt

SEQ ID NO: 655607 - DNA, 22 bp, Artificial Sequence
  chemically synthesized
gtttccagttgttatttttaaa

SEQ ID NO: 655608 - DNA, 22 bp, Artificial Sequence
  chemically synthesized
aaaatttttaaaaataacaact

SEQ ID NO: 655609 - DNA, 22 bp, Artificial Sequence
  chemically synthesized
atattggtttccagttgttatt

SEQ ID NO: 655610 - DNA, 22 bp, Artificial Sequence
  chemically synthesized
aaatttttaaaaataacaactg

SEQ ID NO: 655611 - DNA, 22 bp, Artificial Sequence
  chemically synthesized
aatattggtttccagttgttat

SEQ ID NO: 655612 - DNA, 22 bp, Artificial Sequence
  chemically synthesized
agtttaatattggtttccagtt

SEQ ID NO: 655613 - DNA, 22 bp, Artificial Sequence
  chemically synthesized
ttaaaaataacaactggaaacc

SEQ ID NO: 655614 - DNA, 22 bp, Artificial Sequence
  chemically synthesized
aagtttaatattggtttccagt

SEQ ID NO: 655615 - DNA, 22 bp, Artificial Sequence
  chemically synthesized
taaaaataacaactggaaacca

SEQ ID NO: 655616 - DNA, 22 bp, Artificial Sequence
  chemically synthesized
aaaaataacaactggaaaccaa

SEQ ID NO: 655617 - DNA, 22 bp, Artificial Sequence
  chemically synthesized
aaaataacaactggaaaccaat

SEQ ID NO: 655618 - DNA, 22 bp, Artificial Sequence
  chemically synthesized
tcttaagtttaatattggtttc

SEQ ID NO: 655619 - DNA, 22 bp, Artificial Sequence
  chemically synthesized
tcagtattgtcttaagtttaat

SEQ ID NO: 655620 - DNA, 22 bp, Artificial Sequence
  chemically synthesized
gaaaccaatattaaacttaaga

SEQ ID NO: 655621 - DNA, 22 bp, Artificial Sequence
  chemically synthesized
tcagagtattatcagtattgtc

SEQ ID NO: 655622 - DNA, 22 bp, Artificial Sequence
  chemically synthesized
atcagagtattatcagtattgt

SEQ ID NO: 655623 - DNA, 22 bp, Artificial Sequence
  chemically synthesized
aacttaagacaatactgataat

SEQ ID NO: 655624 - DNA, 22 bp, Artificial Sequence
  chemically synthesized
aagacaatactgataatactct

SEQ ID NO: 655625 - DNA, 22 bp, Artificial Sequence
  chemically synthesized
agacaatactgataatactctg

SEQ ID NO: 655626 - DNA, 22 bp, Artificial Sequence
  chemically synthesized
agaaaagacccttatcagagta

SEQ ID NO: 655627 - DNA, 22 bp, Artificial Sequence
  chemically synthesized
cagaaaagacccttatcagagt

SEQ ID NO: 655628 - DNA, 22 bp, Artificial Sequence
  chemically synthesized
tcagaaaagacccttatcagag

SEQ ID NO: 655629 - DNA, 22 bp, Artificial Sequence
  chemically synthesized
ataatactctgataagggtctt

SEQ ID NO: 655630 - DNA, 22 bp, Artificial Sequence
  chemically synthesized
caattttcagaaaagaccctta

SEQ ID NO: 655631 - DNA, 22 bp, Artificial Sequence
  chemically synthesized
ctgcaattttcagaaaagaccc

SEQ ID NO: 655632 - DNA, 22 bp, Artificial Sequence
  chemically synthesized
tgataagggtcttttctgaaaa

SEQ ID NO: 655633 - DNA, 22 bp, Artificial Sequence
  chemically synthesized
aaattcctgcaattttcagaaa

SEQ ID NO: 655634 - DNA, 22 bp, Artificial Sequence
  chemically synthesized
ataagggtcttttctgaaaatt

SEQ ID NO: 655635 - DNA, 22 bp, Artificial Sequence
  chemically synthesized
gttaaaattcctgcaattttca

SEQ ID NO: 655636 - DNA, 22 bp, Artificial Sequence
  chemically synthesized
ttctgaaaattgcaggaatttt

SEQ ID NO: 655637 - DNA, 22 bp, Artificial Sequence
  chemically synthesized
tctgaaaattgcaggaatttta

SEQ ID NO: 655638 - DNA, 22 bp, Artificial Sequence
  chemically synthesized
ctgaaaattgcaggaattttaa

SEQ ID NO: 655639 - DNA, 22 bp, Artificial Sequence
  chemically synthesized
atgaacagttagttaaaattcc

SEQ ID NO: 655640 - DNA, 22 bp, Artificial Sequence
  chemically synthesized
tgaaaattgcaggaattttaac

SEQ ID NO: 655641 - DNA, 22 bp, Artificial Sequence
  chemically synthesized
aaaattgcaggaattttaacta

SEQ ID NO: 655642 - DNA, 22 bp, Artificial Sequence
  chemically synthesized
ctcatgaacagttagttaaaat

SEQ ID NO: 655643 - DNA, 22 bp, Artificial Sequence
  chemically synthesized
ggcctgctcatgaacagttagt

SEQ ID NO: 655644 - DNA, 22 bp, Artificial Sequence
  chemically synthesized
caggaattttaactaactgttc

SEQ ID NO: 655645 - DNA, 22 bp, Artificial Sequence
  chemically synthesized
ctgggcctgctcatgaacagtt

SEQ ID NO: 655646 - DNA, 22 bp, Artificial Sequence
  chemically synthesized
actgggcctgctcatgaacagt

SEQ ID NO: 655647 - DNA, 22 bp, Artificial Sequence
  chemically synthesized
ttactgggcctgctcatgaaca

SEQ ID NO: 655648 - DNA, 22 bp, Artificial Sequence
  chemically synthesized
taactaactgttcatgagcagg

SEQ ID NO: 655649 - DNA, 22 bp, Artificial Sequence
  chemically synthesized
aactaactgttcatgagcaggc

SEQ ID NO: 655650 - DNA, 22 bp, Artificial Sequence
  chemically synthesized
actaactgttcatgagcaggcc

SEQ ID NO: 655651 - DNA, 22 bp, Artificial Sequence
  chemically synthesized
actgttcatgagcaggcccagt

SEQ ID NO: 655652 - DNA, 22 bp, Artificial Sequence
  chemically synthesized
ttcatgagcaggcccagtaaga

SEQ ID NO: 655653 - DNA, 22 bp, Artificial Sequence
  chemically synthesized
atgagcaggcccagtaagaggt

SEQ ID NO: 655654 - DNA, 22 bp, Artificial Sequence
  chemically synthesized
agagatatcaccgacctcttac

SEQ ID NO: 655655 - DNA, 22 bp, Artificial Sequence
  chemically synthesized
ccatgaaaagctgagagatatc

SEQ ID NO: 655656 - DNA, 22 bp, Artificial Sequence
  chemically synthesized
gctgccatgaaaagctgagaga

SEQ ID NO: 655657 - DNA, 22 bp, Artificial Sequence
  chemically synthesized
catagagatagctggctgccat

SEQ ID NO: 655658 - DNA, 22 bp, Artificial Sequence
  chemically synthesized
ccatagagatagctggctgcca

SEQ ID NO: 655659 - DNA, 22 bp, Artificial Sequence
  chemically synthesized
tcagcttttcatggcagccagc

SEQ ID NO: 655660 - DNA, 22 bp, Artificial Sequence
  chemically synthesized
agcttttcatggcagccagcta

SEQ ID NO: 655661 - DNA, 22 bp, Artificial Sequence
  chemically synthesized
ttcatggcagccagctatctct

SEQ ID NO: 655662 - DNA, 22 bp, Artificial Sequence
  chemically synthesized
tcatggcagccagctatctcta

SEQ ID NO: 655663 - DNA, 22 bp, Artificial Sequence
  chemically synthesized
catggcagccagctatctctat

SEQ ID NO: 655664 - DNA, 22 bp, Artificial Sequence
  chemically synthesized
atggcagccagctatctctatg

SEQ ID NO: 655665 - DNA, 22 bp, Artificial Sequence
  chemically synthesized
atagtccaatcagccttccata

SEQ ID NO: 655666 - DNA, 22 bp, Artificial Sequence
  chemically synthesized
tctctatggaaggctgattgga

SEQ ID NO: 655667 - DNA, 22 bp, Artificial Sequence
  chemically synthesized
tatggaaggctgattggactat

SEQ ID NO: 655668 - DNA, 22 bp, Artificial Sequence
  chemically synthesized
aaggtagaccctaatagtccaa

SEQ ID NO: 655669 - DNA, 22 bp, Artificial Sequence
  chemically synthesized
tggaaggctgattggactatta

SEQ ID NO: 655670 - DNA, 22 bp, Artificial Sequence
  chemically synthesized
ccagaattgaaggtagacccta

SEQ ID NO: 655671 - DNA, 22 bp, Artificial Sequence
  chemically synthesized
cccagaattgaaggtagaccct

SEQ ID NO: 655672 - DNA, 22 bp, Artificial Sequence
  chemically synthesized
attggactattagggtctacct

SEQ ID NO: 655673 - DNA, 22 bp, Artificial Sequence
  chemically synthesized
tcccagaattgaaggtagaccc

SEQ ID NO: 655674 - DNA, 22 bp, Artificial Sequence
  chemically synthesized
gactattagggtctaccttcaa

SEQ ID NO: 655675 - DNA, 22 bp, Artificial Sequence
  chemically synthesized
ttagggtctaccttcaattctg

SEQ ID NO: 655676 - DNA, 22 bp, Artificial Sequence
  chemically synthesized
gggtctaccttcaattctggga

SEQ ID NO: 655677 - DNA, 22 bp, Artificial Sequence
  chemically synthesized
taaagaggtggcctttcccaga

SEQ ID NO: 655678 - DNA, 22 bp, Artificial Sequence
  chemically synthesized
ataaagaggtggcctttcccag

SEQ ID NO: 655679 - DNA, 22 bp, Artificial Sequence
  chemically synthesized
ccttcaattctgggaaaggcca

SEQ ID NO: 655680 - DNA, 22 bp, Artificial Sequence
  chemically synthesized
gtatttataaagaggtggcctt

SEQ ID NO: 655681 - DNA, 22 bp, Artificial Sequence
  chemically synthesized
caattctgggaaaggccacctc

SEQ ID NO: 655682 - DNA, 22 bp, Artificial Sequence
  chemically synthesized
ggtatttataaagaggtggcct

SEQ ID NO: 655683 - DNA, 22 bp, Artificial Sequence
  chemically synthesized
aattctgggaaaggccacctct

SEQ ID NO: 655684 - DNA, 22 bp, Artificial Sequence
  chemically synthesized
tgggaaaggccacctctttata

SEQ ID NO: 655685 - DNA, 22 bp, Artificial Sequence
  chemically synthesized
caatttggtatttataaagagg

SEQ ID NO: 655686 - DNA, 22 bp, Artificial Sequence
  chemically synthesized
ggaaaggccacctctttataaa

SEQ ID NO: 655687 - DNA, 22 bp, Artificial Sequence
  chemically synthesized
ctacaatttggtatttataaag

SEQ ID NO: 655688 - DNA, 22 bp, Artificial Sequence
  chemically synthesized
gtaagagttactacaatttggt

SEQ ID NO: 655689 - DNA, 22 bp, Artificial Sequence
  chemically synthesized
tttataaataccaaattgtagt

SEQ ID NO: 655690 - DNA, 22 bp, Artificial Sequence
  chemically synthesized
tataaataccaaattgtagtaa

SEQ ID NO: 655691 - DNA, 22 bp, Artificial Sequence
  chemically synthesized
ataaataccaaattgtagtaac

SEQ ID NO: 655692 - DNA, 22 bp, Artificial Sequence
  chemically synthesized
taaataccaaattgtagtaact

SEQ ID NO: 655693 - DNA, 22 bp, Artificial Sequence
  chemically synthesized
agtaattagtaagagttactac

SEQ ID NO: 655694 - DNA, 22 bp, Artificial Sequence
  chemically synthesized
gtaactaagtaattagtaagag

SEQ ID NO: 655695 - DNA, 22 bp, Artificial Sequence
  chemically synthesized
actagtaactaagtaattagta

SEQ ID NO: 655696 - DNA, 22 bp, Artificial Sequence
  chemically synthesized
tagtaactcttactaattactt

SEQ ID NO: 655697 - DNA, 22 bp, Artificial Sequence
  chemically synthesized
ttactaattacttagttactag

SEQ ID NO: 655698 - DNA, 22 bp, Artificial Sequence
  chemically synthesized
actaattacttagttactagtg

SEQ ID NO: 655699 - DNA, 22 bp, Artificial Sequence
  chemically synthesized
ctaattacttagttactagtga

SEQ ID NO: 655700 - DNA, 22 bp, Artificial Sequence
  chemically synthesized
gacggatgaatactcactagta

SEQ ID NO: 655701 - DNA, 22 bp, Artificial Sequence
  chemically synthesized
ggacggatgaatactcactagt

SEQ ID NO: 655702 - DNA, 22 bp, Artificial Sequence
  chemically synthesized
attacttagttactagtgagta

SEQ ID NO: 655703 - DNA, 22 bp, Artificial Sequence
  chemically synthesized
tggacggatgaatactcactag

SEQ ID NO: 655704 - DNA, 22 bp, Artificial Sequence
  chemically synthesized
ttggacggatgaatactcacta

SEQ ID NO: 655705 - DNA, 22 bp, Artificial Sequence
  chemically synthesized
cttagttactagtgagtattca

SEQ ID NO: 655706 - DNA, 22 bp, Artificial Sequence
  chemically synthesized
agttactagtgagtattcatcc

SEQ ID NO: 655707 - DNA, 22 bp, Artificial Sequence
  chemically synthesized
gttactagtgagtattcatccg

SEQ ID NO: 655708 - DNA, 22 bp, Artificial Sequence
  chemically synthesized
caccccttttggacggatgaat

SEQ ID NO: 655709 - DNA, 22 bp, Artificial Sequence
  chemically synthesized
acaccccttttggacggatgaa

SEQ ID NO: 655710 - DNA, 22 bp, Artificial Sequence
  chemically synthesized
tacaccccttttggacggatga

SEQ ID NO: 655711 - DNA, 22 bp, Artificial Sequence
  chemically synthesized
ctagtgagtattcatccgtcca

SEQ ID NO: 655712 - DNA, 22 bp, Artificial Sequence
  chemically synthesized
ttacaccccttttggacggatg

SEQ ID NO: 655713 - DNA, 22 bp, Artificial Sequence
  chemically synthesized
gtgagtattcatccgtccaaaa

SEQ ID NO: 655714 - DNA, 22 bp, Artificial Sequence
  chemically synthesized
cttttacaccccttttggacgg

SEQ ID NO: 655715 - DNA, 22 bp, Artificial Sequence
  chemically synthesized
atccgtccaaaaggggtgtaaa

SEQ ID NO: 655716 - DNA, 22 bp, Artificial Sequence
  chemically synthesized
catagacattccttttacaccc

SEQ ID NO: 655717 - DNA, 22 bp, Artificial Sequence
  chemically synthesized
gttccatagacattccttttac

SEQ ID NO: 655718 - DNA, 22 bp, Artificial Sequence
  chemically synthesized
ggttccatagacattcctttta

SEQ ID NO: 655719 - DNA, 22 bp, Artificial Sequence
  chemically synthesized
tggttccatagacattcctttt

SEQ ID NO: 655720 - DNA, 22 bp, Artificial Sequence
  chemically synthesized
tgggccctttggttccatagac

SEQ ID NO: 655721 - DNA, 22 bp, Artificial Sequence
  chemically synthesized
atcagactgtgggccctttggt

SEQ ID NO: 655722 - DNA, 22 bp, Artificial Sequence
  chemically synthesized
tgtattaatcagactgtgggcc

SEQ ID NO: 655723 - DNA, 22 bp, Artificial Sequence
  chemically synthesized
tggaaccaaagggcccacagtc

SEQ ID NO: 655724 - DNA, 22 bp, Artificial Sequence
  chemically synthesized
gtgtattaatcagactgtgggc

SEQ ID NO: 655725 - DNA, 22 bp, Artificial Sequence
  chemically synthesized
tgtgtattaatcagactgtggg

SEQ ID NO: 655726 - DNA, 22 bp, Artificial Sequence
  chemically synthesized
ttgtgtattaatcagactgtgg

SEQ ID NO: 655727 - DNA, 22 bp, Artificial Sequence
  chemically synthesized
tttgtgtattaatcagactgtg

SEQ ID NO: 655728 - DNA, 22 bp, Artificial Sequence
  chemically synthesized
gctttttgtgtattaatcagac

SEQ ID NO: 655729 - DNA, 22 bp, Artificial Sequence
  chemically synthesized
ggctttttgtgtattaatcaga

SEQ ID NO: 655730 - DNA, 22 bp, Artificial Sequence
  chemically synthesized
tggctttttgtgtattaatcag

SEQ ID NO: 655731 - DNA, 22 bp, Artificial Sequence
  chemically synthesized
ctttggctttttgtgtattaat

SEQ ID NO: 655732 - DNA, 22 bp, Artificial Sequence
  chemically synthesized
cctttggctttttgtgtattaa

SEQ ID NO: 655733 - DNA, 22 bp, Artificial Sequence
  chemically synthesized
ggtttcctttggctttttgtgt

SEQ ID NO: 655734 - DNA, 22 bp, Artificial Sequence
  chemically synthesized
aggtttcctttggctttttgtg

SEQ ID NO: 655735 - DNA, 22 bp, Artificial Sequence
  chemically synthesized
acttaggtttcctttggctttt

SEQ ID NO: 655736 - DNA, 22 bp, Artificial Sequence
  chemically synthesized
attaatacacaaaaagccaaag

SEQ ID NO: 655737 - DNA, 22 bp, Artificial Sequence
  chemically synthesized
cacttaggtttcctttggcttt

SEQ ID NO: 655738 - DNA, 22 bp, Artificial Sequence
  chemically synthesized
cttcacttaggtttcctttggc

SEQ ID NO: 655739 - DNA, 22 bp, Artificial Sequence
  chemically synthesized
atacacaaaaagccaaaggaaa

SEQ ID NO: 655740 - DNA, 22 bp, Artificial Sequence
  chemically synthesized
aaaaccctccttcacttaggtt

SEQ ID NO: 655741 - DNA, 22 bp, Artificial Sequence
  chemically synthesized
ctaaaaaccctccttcacttag

SEQ ID NO: 655742 - DNA, 22 bp, Artificial Sequence
  chemically synthesized
aaagtaactcctaaaaaccctc

SEQ ID NO: 655743 - DNA, 22 bp, Artificial Sequence
  chemically synthesized
agtgaaggagggtttttaggag

SEQ ID NO: 655744 - DNA, 22 bp, Artificial Sequence
  chemically synthesized
catcctgaaagtaactcctaaa

SEQ ID NO: 655745 - DNA, 22 bp, Artificial Sequence
  chemically synthesized
ccatcctgaaagtaactcctaa

SEQ ID NO: 655746 - DNA, 22 bp, Artificial Sequence
  chemically synthesized
tccatcctgaaagtaactccta

SEQ ID NO: 655747 - DNA, 22 bp, Artificial Sequence
  chemically synthesized
atagattttccatcctgaaagt

SEQ ID NO: 655748 - DNA, 22 bp, Artificial Sequence
  chemically synthesized
ttaggagttactttcaggatgg

SEQ ID NO: 655749 - DNA, 22 bp, Artificial Sequence
  chemically synthesized
ttaatagattttccatcctgaa

SEQ ID NO: 655750 - DNA, 22 bp, Artificial Sequence
  chemically synthesized
taggagttactttcaggatgga

SEQ ID NO: 655751 - DNA, 22 bp, Artificial Sequence
  chemically synthesized
attaatagattttccatcctga

SEQ ID NO: 655752 - DNA, 22 bp, Artificial Sequence
  chemically synthesized
aggagttactttcaggatggaa

SEQ ID NO: 655753 - DNA, 22 bp, Artificial Sequence
  chemically synthesized
tattaatagattttccatcctg

SEQ ID NO: 655754 - DNA, 22 bp, Artificial Sequence
  chemically synthesized
ggagttactttcaggatggaaa

SEQ ID NO: 655755 - DNA, 22 bp, Artificial Sequence
  chemically synthesized
cattttattaatagattttcca

SEQ ID NO: 655756 - DNA, 22 bp, Artificial Sequence
  chemically synthesized
ctttcaggatggaaaatctatt

SEQ ID NO: 655757 - DNA, 22 bp, Artificial Sequence
  chemically synthesized
tcaggatggaaaatctattaat

SEQ ID NO: 655758 - DNA, 22 bp, Artificial Sequence
  chemically synthesized
caggatggaaaatctattaata

SEQ ID NO: 655759 - DNA, 22 bp, Artificial Sequence
  chemically synthesized
aggatggaaaatctattaataa

SEQ ID NO: 655760 - DNA, 22 bp, Artificial Sequence
  chemically synthesized
gccgattccattttattaatag

SEQ ID NO: 655761 - DNA, 22 bp, Artificial Sequence
  chemically synthesized
ttaataaaatggaatcggccag

SEQ ID NO: 655762 - DNA, 22 bp, Artificial Sequence
  chemically synthesized
ataaaatggaatcggccaggtg

SEQ ID NO: 655763 - DNA, 22 bp, Artificial Sequence
  chemically synthesized
caggcatgagccatcacacctg

SEQ ID NO: 655764 - DNA, 22 bp, Artificial Sequence
  chemically synthesized
ggattacaggcatgagccatca

SEQ ID NO: 655765 - DNA, 22 bp, Artificial Sequence
  chemically synthesized
ccaaagtgctgggattacaggc

SEQ ID NO: 655766 - DNA, 22 bp, Artificial Sequence
  chemically synthesized
agcctcccaaagtgctgggatt

SEQ ID NO: 655767 - DNA, 22 bp, Artificial Sequence
  chemically synthesized
atgcctgtaatcccagcacttt

SEQ ID NO: 655768 - DNA, 22 bp, Artificial Sequence
  chemically synthesized
taatcccagcactttgggaggc

SEQ ID NO: 655769 - DNA, 22 bp, Artificial Sequence
  chemically synthesized
tgatccgcccacctcagcctcc

SEQ ID NO: 655770 - DNA, 22 bp, Artificial Sequence
  chemically synthesized
gtgatccgcccacctcagcctc

SEQ ID NO: 655771 - DNA, 22 bp, Artificial Sequence
  chemically synthesized
accttgtgatccgcccacctca

SEQ ID NO: 655772 - DNA, 22 bp, Artificial Sequence
  chemically synthesized
gaccttgtgatccgcccacctc

SEQ ID NO: 655773 - DNA, 22 bp, Artificial Sequence
  chemically synthesized
ttgaccttgtgatccgcccacc

SEQ ID NO: 655774 - DNA, 22 bp, Artificial Sequence
  chemically synthesized
tgggaggctgaggtgggcggat

SEQ ID NO: 655775 - DNA, 22 bp, Artificial Sequence
  chemically synthesized
gggaggctgaggtgggcggatc

SEQ ID NO: 655776 - DNA, 22 bp, Artificial Sequence
  chemically synthesized
ggaggctgaggtgggcggatca

SEQ ID NO: 655777 - DNA, 22 bp, Artificial Sequence
  chemically synthesized
aatctcttgaccttgtgatccg

SEQ ID NO: 655778 - DNA, 22 bp, Artificial Sequence
  chemically synthesized
aggtgggcggatcacaaggtca

SEQ ID NO: 655779 - DNA, 22 bp, Artificial Sequence
  chemically synthesized
gccaggatggtctcaatctctt

SEQ ID NO: 655780 - DNA, 22 bp, Artificial Sequence
  chemically synthesized
accatgttggccaggatggtct

SEQ ID NO: 655781 - DNA, 22 bp, Artificial Sequence
  chemically synthesized
caccatgttggccaggatggtc

SEQ ID NO: 655782 - DNA, 22 bp, Artificial Sequence
  chemically synthesized
agaccatcctggccaacatggt

SEQ ID NO: 655783 - DNA, 22 bp, Artificial Sequence
  chemically synthesized
atagagaaggtttcaccatgtt

SEQ ID NO: 655784 - DNA, 22 bp, Artificial Sequence
  chemically synthesized
aatagagaaggtttcaccatgt

SEQ ID NO: 655785 - DNA, 22 bp, Artificial Sequence
  chemically synthesized
taatagagaaggtttcaccatg

SEQ ID NO: 655786 - DNA, 22 bp, Artificial Sequence
  chemically synthesized
ttaatagagaaggtttcaccat

SEQ ID NO: 655787 - DNA, 22 bp, Artificial Sequence
  chemically synthesized
tatttttaatagagaaggtttc

SEQ ID NO: 655788 - DNA, 22 bp, Artificial Sequence
  chemically synthesized
gccaacatggtgaaaccttctc

SEQ ID NO: 655789 - DNA, 22 bp, Artificial Sequence
  chemically synthesized
gtatttttaatagagaaggttt

SEQ ID NO: 655790 - DNA, 22 bp, Artificial Sequence
  chemically synthesized
tgtatttttaatagagaaggtt

SEQ ID NO: 655791 - DNA, 22 bp, Artificial Sequence
  chemically synthesized
ttgtatttttaatagagaaggt

SEQ ID NO: 655792 - DNA, 22 bp, Artificial Sequence
  chemically synthesized
atttttgtatttttaatagaga

SEQ ID NO: 655793 - DNA, 22 bp, Artificial Sequence
  chemically synthesized
ctctattaaaaatacaaaaatt

SEQ ID NO: 655794 - DNA, 22 bp, Artificial Sequence
  chemically synthesized
tctattaaaaatacaaaaatta

SEQ ID NO: 655795 - DNA, 22 bp, Artificial Sequence
  chemically synthesized
tattaaaaatacaaaaattagc

SEQ ID NO: 655796 - DNA, 22 bp, Artificial Sequence
  chemically synthesized
ttaaaaatacaaaaattagctg

SEQ ID NO: 655797 - DNA, 22 bp, Artificial Sequence
  chemically synthesized
aaaatacaaaaattagctgggc

SEQ ID NO: 655798 - DNA, 22 bp, Artificial Sequence
  chemically synthesized
caggcacgtgccaccacgccca

SEQ ID NO: 655799 - DNA, 22 bp, Artificial Sequence
  chemically synthesized
ggactacaggcacgtgccacca

SEQ ID NO: 655800 - DNA, 22 bp, Artificial Sequence
  chemically synthesized
gctgggcgtggtggcacgtgcc

SEQ ID NO: 655801 - DNA, 22 bp, Artificial Sequence
  chemically synthesized
ggcgtggtggcacgtgcctgta

SEQ ID NO: 655802 - DNA, 22 bp, Artificial Sequence
  chemically synthesized
ccaagtagctgggactacaggc

SEQ ID NO: 655803 - DNA, 22 bp, Artificial Sequence
  chemically synthesized
agcctcccaagtagctgggact

SEQ ID NO: 655804 - DNA, 22 bp, Artificial Sequence
  chemically synthesized
cctcagcctcccaagtagctgg

SEQ ID NO: 655805 - DNA, 22 bp, Artificial Sequence
  chemically synthesized
ctgcctcagcctcccaagtagc

SEQ ID NO: 655806 - DNA, 22 bp, Artificial Sequence
  chemically synthesized
tcctgcctcagcctcccaagta

SEQ ID NO: 655807 - DNA, 22 bp, Artificial Sequence
  chemically synthesized
tagtcccagctacttgggaggc

SEQ ID NO: 655808 - DNA, 22 bp, Artificial Sequence
  chemically synthesized
aagtgattctcctgcctcagcc

SEQ ID NO: 655809 - DNA, 22 bp, Artificial Sequence
  chemically synthesized
cttgggaggctgaggcaggaga

SEQ ID NO: 655810 - DNA, 22 bp, Artificial Sequence
  chemically synthesized
gggaggctgaggcaggagaatc

SEQ ID NO: 655811 - DNA, 22 bp, Artificial Sequence
  chemically synthesized
ccaggttcaagtgattctcctg

SEQ ID NO: 655812 - DNA, 22 bp, Artificial Sequence
  chemically synthesized
ggaggctgaggcaggagaatca

SEQ ID NO: 655813 - DNA, 22 bp, Artificial Sequence
  chemically synthesized
cacctcccaggttcaagtgatt

SEQ ID NO: 655814 - DNA, 22 bp, Artificial Sequence
  chemically synthesized
aggcaggagaatcacttgaacc

SEQ ID NO: 655815 - DNA, 22 bp, Artificial Sequence
  chemically synthesized
caacctccacctcccaggttca

SEQ ID NO: 655816 - DNA, 22 bp, Artificial Sequence
  chemically synthesized
ggcacactgcaacctccacctc

SEQ ID NO: 655817 - DNA, 22 bp, Artificial Sequence
  chemically synthesized
gaacctgggaggtggaggttgc

SEQ ID NO: 655818 - DNA, 22 bp, Artificial Sequence
  chemically synthesized
aacctgggaggtggaggttgca

SEQ ID NO: 655819 - DNA, 22 bp, Artificial Sequence
  chemically synthesized
ggaggtggaggttgcagtgtgc

SEQ ID NO: 655820 - DNA, 22 bp, Artificial Sequence
  chemically synthesized
gagtccagtggtgccatctcgg

SEQ ID NO: 655821 - DNA, 22 bp, Artificial Sequence
  chemically synthesized
cagtgtgccgagatggcaccac

SEQ ID NO: 655822 - DNA, 22 bp, Artificial Sequence
  chemically synthesized
ccaggctggagtccagtggtgc

SEQ ID NO: 655823 - DNA, 22 bp, Artificial Sequence
  chemically synthesized
ttgccaggctggagtccagtgg

SEQ ID NO: 655824 - DNA, 22 bp, Artificial Sequence
  chemically synthesized
tgttgccaggctggagtccagt

SEQ ID NO: 655825 - DNA, 22 bp, Artificial Sequence
  chemically synthesized
gctctgttgccaggctggagtc

SEQ ID NO: 655826 - DNA, 22 bp, Artificial Sequence
  chemically synthesized
gactccagcctggcaacagagc

SEQ ID NO: 655827 - DNA, 22 bp, Artificial Sequence
  chemically synthesized
agacagagtctcgctctgttgc

SEQ ID NO: 655828 - DNA, 22 bp, Artificial Sequence
  chemically synthesized
gagacagagtctcgctctgttg

SEQ ID NO: 655829 - DNA, 22 bp, Artificial Sequence
  chemically synthesized
tgagacagagtctcgctctgtt

SEQ ID NO: 655830 - DNA, 22 bp, Artificial Sequence
  chemically synthesized
ttgagacagagtctcgctctgt

SEQ ID NO: 655831 - DNA, 22 bp, Artificial Sequence
  chemically synthesized
tttgagacagagtctcgctctg

SEQ ID NO: 655832 - DNA, 22 bp, Artificial Sequence
  chemically synthesized
cagcctggcaacagagcgagac

SEQ ID NO: 655833 - DNA, 22 bp, Artificial Sequence
  chemically synthesized
ttttgagacagagtctcgctct

SEQ ID NO: 655834 - DNA, 22 bp, Artificial Sequence
  chemically synthesized
tttttgagacagagtctcgctc

SEQ ID NO: 655835 - DNA, 22 bp, Artificial Sequence
  chemically synthesized
ttttttgagacagagtctcgct

SEQ ID NO: 655836 - DNA, 22 bp, Artificial Sequence
  chemically synthesized
tttttttgagacagagtctcgc

SEQ ID NO: 655837 - DNA, 22 bp, Artificial Sequence
  chemically synthesized
ttttttttgagacagagtctcg

SEQ ID NO: 655838 - DNA, 22 bp, Artificial Sequence
  chemically synthesized
tttttttttgagacagagtctc

SEQ ID NO: 655839 - DNA, 22 bp, Artificial Sequence
  chemically synthesized
ttttttttttgagacagagtct

SEQ ID NO: 655840 - DNA, 22 bp, Artificial Sequence
  chemically synthesized
gcaacagagcgagactctgtct

SEQ ID NO: 655841 - DNA, 22 bp, Artificial Sequence
  chemically synthesized
tttttttttttgagacagagtc

SEQ ID NO: 655842 - DNA, 22 bp, Artificial Sequence
  chemically synthesized
ttttttttttttgagacagagt

SEQ ID NO: 655843 - DNA, 22 bp, Artificial Sequence
  chemically synthesized
tttttttttttttgagacagag

SEQ ID NO: 655844 - DNA, 22 bp, Artificial Sequence
  chemically synthesized
ttttttttttttttgagacaga

SEQ ID NO: 655845 - DNA, 22 bp, Artificial Sequence
  chemically synthesized
tttttttttttttttgagacag

SEQ ID NO: 655846 - DNA, 22 bp, Artificial Sequence
  chemically synthesized
ttttttttttttttttgagaca

SEQ ID NO: 655847 - DNA, 22 bp, Artificial Sequence
  chemically synthesized
tttttttttttttttttgagac

SEQ ID NO: 655848 - DNA, 22 bp, Artificial Sequence
  chemically synthesized
ttttttttttttttttttgaga

SEQ ID NO: 655849 - DNA, 22 bp, Artificial Sequence
  chemically synthesized
tttttttttttttttttttgag

SEQ ID NO: 655850 - DNA, 22 bp, Artificial Sequence
  chemically synthesized
ttttttttttttttttttttga

SEQ ID NO: 655851 - DNA, 22 bp, Artificial Sequence
  chemically synthesized
tttttttttttttttttttttg

SEQ ID NO: 655852 - DNA, 22 bp, Artificial Sequence
  chemically synthesized
tttttttttttttttttttttt

SEQ ID NO: 655853 - DNA, 22 bp, Artificial Sequence
  chemically synthesized
tttttttttttttttttttttt

SEQ ID NO: 655854 - DNA, 22 bp, Artificial Sequence
  chemically synthesized
tttttttttttttttttttttt

SEQ ID NO: 655855 - DNA, 22 bp, Artificial Sequence
  chemically synthesized
tttttttttttttttttttttt

SEQ ID NO: 655856 - DNA, 22 bp, Artificial Sequence
  chemically synthesized
tttttttttttttttttttttt

SEQ ID NO: 655857 - DNA, 22 bp, Artificial Sequence
  chemically synthesized
tttttttttttttttttttttt

SEQ ID NO: 655858 - DNA, 22 bp, Artificial Sequence
  chemically synthesized
tgtctcaaaaaaaaaaaaaaaa

SEQ ID NO: 655859 - DNA, 22 bp, Artificial Sequence
  chemically synthesized
tttttttttttttttttttttt

SEQ ID NO: 655860 - DNA, 22 bp, Artificial Sequence
  chemically synthesized
tttttttttttttttttttttt

SEQ ID NO: 655861 - DNA, 22 bp, Artificial Sequence
  chemically synthesized
tctcaaaaaaaaaaaaaaaaaa

SEQ ID NO: 655862 - DNA, 22 bp, Artificial Sequence
  chemically synthesized
tttttttttttttttttttttt

SEQ ID NO: 655863 - DNA, 22 bp, Artificial Sequence
  chemically synthesized
tttttttttttttttttttttt

SEQ ID NO: 655864 - DNA, 22 bp, Artificial Sequence
  chemically synthesized
tttttttttttttttttttttt

SEQ ID NO: 655865 - DNA, 22 bp, Artificial Sequence
  chemically synthesized
tttttttttttttttttttttt

SEQ ID NO: 655866 - DNA, 22 bp, Artificial Sequence
  chemically synthesized
aaaaaaaaaaaaaaaaaaaaaa

SEQ ID NO: 655867 - DNA, 22 bp, Artificial Sequence
  chemically synthesized
tttttttttttttttttttttt

SEQ ID NO: 655868 - DNA, 22 bp, Artificial Sequence
  chemically synthesized
tttttttttttttttttttttt

SEQ ID NO: 655869 - DNA, 22 bp, Artificial Sequence
  chemically synthesized
tttttttttttttttttttttt

SEQ ID NO: 655870 - DNA, 22 bp, Artificial Sequence
  chemically synthesized
tttttttttttttttttttttt

SEQ ID NO: 655871 - DNA, 22 bp, Artificial Sequence
  chemically synthesized
tttttttttttttttttttttt

SEQ ID NO: 655872 - DNA, 22 bp, Artificial Sequence
  chemically synthesized
tttttttttttttttttttttt

SEQ ID NO: 655873 - DNA, 22 bp, Artificial Sequence
  chemically synthesized
tttttttttttttttttttttt

SEQ ID NO: 655874 - DNA, 22 bp, Artificial Sequence
  chemically synthesized
tttttttttttttttttttttt

SEQ ID NO: 655875 - DNA, 22 bp, Artificial Sequence
  chemically synthesized
tttttttttttttttttttttt

SEQ ID NO: 655876 - DNA, 22 bp, Artificial Sequence
  chemically synthesized
tttttttttttttttttttttt

SEQ ID NO: 655877 - DNA, 22 bp, Artificial Sequence
  chemically synthesized
tttttttttttttttttttttt

SEQ ID NO: 655878 - DNA, 22 bp, Artificial Sequence
  chemically synthesized
tttttttttttttttttttttt

SEQ ID NO: 655879 - DNA, 22 bp, Artificial Sequence
  chemically synthesized
tttttttttttttttttttttt

SEQ ID NO: 655880 - DNA, 22 bp, Artificial Sequence
  chemically synthesized
cttttttttttttttttttttt

SEQ ID NO: 655881 - DNA, 22 bp, Artificial Sequence
  chemically synthesized
attacttttttttttttttttt

SEQ ID NO: 655882 - DNA, 22 bp, Artificial Sequence
  chemically synthesized
cccgggtcaactgattactttt

SEQ ID NO: 655883 - DNA, 22 bp, Artificial Sequence
  chemically synthesized
gacagcattccccgggtcaact

SEQ ID NO: 655884 - DNA, 22 bp, Artificial Sequence
  chemically synthesized
gttagacagcattccccgggtc

SEQ ID NO: 655885 - DNA, 22 bp, Artificial Sequence
  chemically synthesized
gctggttagacagcattccccg

SEQ ID NO: 655886 - DNA, 22 bp, Artificial Sequence
  chemically synthesized
ggctggttagacagcattcccc

SEQ ID NO: 655887 - DNA, 22 bp, Artificial Sequence
  chemically synthesized
tggctggttagacagcattccc

SEQ ID NO: 655888 - DNA, 22 bp, Artificial Sequence
  chemically synthesized
ttggctggttagacagcattcc

SEQ ID NO: 655889 - DNA, 22 bp, Artificial Sequence
  chemically synthesized
acccggggaatgctgtctaacc

SEQ ID NO: 655890 - DNA, 22 bp, Artificial Sequence
  chemically synthesized
tctaaccagccaaaagtctcct

SEQ ID NO: 655891 - DNA, 22 bp, Artificial Sequence
  chemically synthesized
aaatgccatatcaggagacttt

SEQ ID NO: 655892 - DNA, 22 bp, Artificial Sequence
  chemically synthesized
accagccaaaagtctcctgata

SEQ ID NO: 655893 - DNA, 22 bp, Artificial Sequence
  chemically synthesized
caaatgttaaaatgccatatca

SEQ ID NO: 655894 - DNA, 22 bp, Artificial Sequence
  chemically synthesized
tgcaaatgttaaaatgccatat

SEQ ID NO: 655895 - DNA, 22 bp, Artificial Sequence
  chemically synthesized
tctgcaaatgttaaaatgccat

SEQ ID NO: 655896 - DNA, 22 bp, Artificial Sequence
  chemically synthesized
ctctgcaaatgttaaaatgcca

SEQ ID NO: 655897 - DNA, 22 bp, Artificial Sequence
  chemically synthesized
tttctctgcaaatgttaaaatg

SEQ ID NO: 655898 - DNA, 22 bp, Artificial Sequence
  chemically synthesized
tgtttctctgcaaatgttaaaa

SEQ ID NO: 655899 - DNA, 22 bp, Artificial Sequence
  chemically synthesized
ctgatatggcattttaacattt

SEQ ID NO: 655900 - DNA, 22 bp, Artificial Sequence
  chemically synthesized
atatggcattttaacatttgca

SEQ ID NO: 655901 - DNA, 22 bp, Artificial Sequence
  chemically synthesized
gagattctgtttctctgcaaat

SEQ ID NO: 655902 - DNA, 22 bp, Artificial Sequence
  chemically synthesized
tggagattctgtttctctgcaa

SEQ ID NO: 655903 - DNA, 22 bp, Artificial Sequence
  chemically synthesized
taacatttgcagagaaacagaa

SEQ ID NO: 655904 - DNA, 22 bp, Artificial Sequence
  chemically synthesized
aacatttgcagagaaacagaat

SEQ ID NO: 655905 - DNA, 22 bp, Artificial Sequence
  chemically synthesized
gagattctggagattctgtttc

SEQ ID NO: 655906 - DNA, 22 bp, Artificial Sequence
  chemically synthesized
acatttgcagagaaacagaatc

SEQ ID NO: 655907 - DNA, 22 bp, Artificial Sequence
  chemically synthesized
agagattctggagattctgttt

SEQ ID NO: 655908 - DNA, 22 bp, Artificial Sequence
  chemically synthesized
tagagattctggagattctgtt

SEQ ID NO: 655909 - DNA, 22 bp, Artificial Sequence
  chemically synthesized
gcagagaaacagaatctccaga

SEQ ID NO: 655910 - DNA, 22 bp, Artificial Sequence
  chemically synthesized
cattttagagattctggagatt

SEQ ID NO: 655911 - DNA, 22 bp, Artificial Sequence
  chemically synthesized
cagagaaacagaatctccagaa

SEQ ID NO: 655912 - DNA, 22 bp, Artificial Sequence
  chemically synthesized
tggattgcattttagagattct

SEQ ID NO: 655913 - DNA, 22 bp, Artificial Sequence
  chemically synthesized
cagaatctctaaaatgcaatcc

SEQ ID NO: 655914 - DNA, 22 bp, Artificial Sequence
  chemically synthesized
taacaaaacatcatctgtggat

SEQ ID NO: 655915 - DNA, 22 bp, Artificial Sequence
  chemically synthesized
taaaatgcaatccacagatgat

SEQ ID NO: 655916 - DNA, 22 bp, Artificial Sequence
  chemically synthesized
tctataacaaaacatcatctgt

SEQ ID NO: 655917 - DNA, 22 bp, Artificial Sequence
  chemically synthesized
aaatgcaatccacagatgatgt

SEQ ID NO: 655918 - DNA, 22 bp, Artificial Sequence
  chemically synthesized
atctataacaaaacatcatctg

SEQ ID NO: 655919 - DNA, 22 bp, Artificial Sequence
  chemically synthesized
tatctataacaaaacatcatct

SEQ ID NO: 655920 - DNA, 22 bp, Artificial Sequence
  chemically synthesized
ttatctataacaaaacatcatc

SEQ ID NO: 655921 - DNA, 22 bp, Artificial Sequence
  chemically synthesized
cttttatctataacaaaacatc

SEQ ID NO: 655922 - DNA, 22 bp, Artificial Sequence
  chemically synthesized
acagttgcttttatctataaca

SEQ ID NO: 655923 - DNA, 22 bp, Artificial Sequence
  chemically synthesized
ccaatgttaacagttgctttta

SEQ ID NO: 655924 - DNA, 22 bp, Artificial Sequence
  chemically synthesized
tgttatagataaaagcaactgt

SEQ ID NO: 655925 - DNA, 22 bp, Artificial Sequence
  chemically synthesized
gttatagataaaagcaactgtt

SEQ ID NO: 655926 - DNA, 22 bp, Artificial Sequence
  chemically synthesized
ttatagataaaagcaactgtta

SEQ ID NO: 655927 - DNA, 22 bp, Artificial Sequence
  chemically synthesized
tagataaaagcaactgttaaca

SEQ ID NO: 655928 - DNA, 22 bp, Artificial Sequence
  chemically synthesized
tggcatgaaaatatcctgccaa

SEQ ID NO: 655929 - DNA, 22 bp, Artificial Sequence
  chemically synthesized
ttaacattggcaggatattttc

SEQ ID NO: 655930 - DNA, 22 bp, Artificial Sequence
  chemically synthesized
acattggcaggatattttcatg

SEQ ID NO: 655931 - DNA, 22 bp, Artificial Sequence
  chemically synthesized
aagtgtgttgtggcatgaaaat

SEQ ID NO: 655932 - DNA, 22 bp, Artificial Sequence
  chemically synthesized
tctaaagtgtgttgtggcatga

SEQ ID NO: 655933 - DNA, 22 bp, Artificial Sequence
  chemically synthesized
gcaggatattttcatgccacaa

SEQ ID NO: 655934 - DNA, 22 bp, Artificial Sequence
  chemically synthesized
tgattatctaaagtgtgttgtg

SEQ ID NO: 655935 - DNA, 22 bp, Artificial Sequence
  chemically synthesized
gctatgattatctaaagtgtgt

SEQ ID NO: 655936 - DNA, 22 bp, Artificial Sequence
  chemically synthesized
tcatgccacaacacactttaga

SEQ ID NO: 655937 - DNA, 22 bp, Artificial Sequence
  chemically synthesized
catgccacaacacactttagat

SEQ ID NO: 655938 - DNA, 22 bp, Artificial Sequence
  chemically synthesized
atgccacaacacactttagata

SEQ ID NO: 655939 - DNA, 22 bp, Artificial Sequence
  chemically synthesized
tagataatcatagctaacattc

SEQ ID NO: 655940 - DNA, 22 bp, Artificial Sequence
  chemically synthesized
agataatcatagctaacattca

SEQ ID NO: 655941 - DNA, 22 bp, Artificial Sequence
  chemically synthesized
gataatcatagctaacattcac

SEQ ID NO: 655942 - DNA, 22 bp, Artificial Sequence
  chemically synthesized
tagtggatacatagaaggtgcc

SEQ ID NO: 655943 - DNA, 22 bp, Artificial Sequence
  chemically synthesized
acattcactgggcaccttctat

SEQ ID NO: 655944 - DNA, 22 bp, Artificial Sequence
  chemically synthesized
agagctgtagtggatacataga

SEQ ID NO: 655945 - DNA, 22 bp, Artificial Sequence
  chemically synthesized
actgggcaccttctatgtatcc

SEQ ID NO: 655946 - DNA, 22 bp, Artificial Sequence
  chemically synthesized
aagagctgtagtggatacatag

SEQ ID NO: 655947 - DNA, 22 bp, Artificial Sequence
  chemically synthesized
ggcaccttctatgtatccacta

SEQ ID NO: 655948 - DNA, 22 bp, Artificial Sequence
  chemically synthesized
ctatgtatccactacagctctt

SEQ ID NO: 655949 - DNA, 22 bp, Artificial Sequence
  chemically synthesized
tatgtatccactacagctctta

SEQ ID NO: 655950 - DNA, 22 bp, Artificial Sequence
  chemically synthesized
tgtatccactacagctcttaag

SEQ ID NO: 655951 - DNA, 22 bp, Artificial Sequence
  chemically synthesized
cagctcttaagtgctttgcttc

SEQ ID NO: 655952 - DNA, 22 bp, Artificial Sequence
  chemically synthesized
aatgaaccaatagaagcaaagc

SEQ ID NO: 655953 - DNA, 22 bp, Artificial Sequence
  chemically synthesized
ttaagtgctttgcttctattgg

SEQ ID NO: 655954 - DNA, 22 bp, Artificial Sequence
  chemically synthesized
aagtgctttgcttctattggtt

SEQ ID NO: 655955 - DNA, 22 bp, Artificial Sequence
  chemically synthesized
agtgctttgcttctattggttc

SEQ ID NO: 655956 - DNA, 22 bp, Artificial Sequence
  chemically synthesized
tgaggattaaatgaaccaatag

SEQ ID NO: 655957 - DNA, 22 bp, Artificial Sequence
  chemically synthesized
tgcttctattggttcatttaat

SEQ ID NO: 655958 - DNA, 22 bp, Artificial Sequence
  chemically synthesized
gcttctattggttcatttaatc

SEQ ID NO: 655959 - DNA, 22 bp, Artificial Sequence
  chemically synthesized
cttctattggttcatttaatcc

SEQ ID NO: 655960 - DNA, 22 bp, Artificial Sequence
  chemically synthesized
gaggtgattgtgaggattaaat

SEQ ID NO: 655961 - DNA, 22 bp, Artificial Sequence
  chemically synthesized
ctattggttcatttaatcctca

SEQ ID NO: 655962 - DNA, 22 bp, Artificial Sequence
  chemically synthesized
tattggttcatttaatcctcac

SEQ ID NO: 655963 - DNA, 22 bp, Artificial Sequence
  chemically synthesized
ctggaggtgattgtgaggatta

SEQ ID NO: 655964 - DNA, 22 bp, Artificial Sequence
  chemically synthesized
ttggttcatttaatcctcacaa

SEQ ID NO: 655965 - DNA, 22 bp, Artificial Sequence
  chemically synthesized
gttcatttaatcctcacaatca

SEQ ID NO: 655966 - DNA, 22 bp, Artificial Sequence
  chemically synthesized
aactcctggaggtgattgtgag

SEQ ID NO: 655967 - DNA, 22 bp, Artificial Sequence
  chemically synthesized
atttaatcctcacaatcacctc

SEQ ID NO: 655968 - DNA, 22 bp, Artificial Sequence
  chemically synthesized
gcccctgaactcctggaggtga

SEQ ID NO: 655969 - DNA, 22 bp, Artificial Sequence
  chemically synthesized
aatcctcacaatcacctccagg

SEQ ID NO: 655970 - DNA, 22 bp, Artificial Sequence
  chemically synthesized
atcctcacaatcacctccagga

SEQ ID NO: 655971 - DNA, 22 bp, Artificial Sequence
  chemically synthesized
ctggcccctgaactcctggagg

SEQ ID NO: 655972 - DNA, 22 bp, Artificial Sequence
  chemically synthesized
cctggcccctgaactcctggag

SEQ ID NO: 655973 - DNA, 22 bp, Artificial Sequence
  chemically synthesized
acaatcacctccaggagttcag

SEQ ID NO: 655974 - DNA, 22 bp, Artificial Sequence
  chemically synthesized
accttcctggcccctgaactcc

SEQ ID NO: 655975 - DNA, 22 bp, Artificial Sequence
  chemically synthesized
aaccttcctggcccctgaactc

SEQ ID NO: 655976 - DNA, 22 bp, Artificial Sequence
  chemically synthesized
ttaaccttcctggcccctgaac

SEQ ID NO: 655977 - DNA, 22 bp, Artificial Sequence
  chemically synthesized
cttaaccttcctggcccctgaa

SEQ ID NO: 655978 - DNA, 22 bp, Artificial Sequence
  chemically synthesized
caggagttcaggggccaggaag

SEQ ID NO: 655979 - DNA, 22 bp, Artificial Sequence
  chemically synthesized
tggacacatttcttaaccttcc

SEQ ID NO: 655980 - DNA, 22 bp, Artificial Sequence
  chemically synthesized
aggggccaggaaggttaagaaa

SEQ ID NO: 655981 - DNA, 22 bp, Artificial Sequence
  chemically synthesized
tgtgactgtggacacatttctt

SEQ ID NO: 655982 - DNA, 22 bp, Artificial Sequence
  chemically synthesized
gctgtgtgactgtggacacatt

SEQ ID NO: 655983 - DNA, 22 bp, Artificial Sequence
  chemically synthesized
ctggctgtgtgactgtggacac

SEQ ID NO: 655984 - DNA, 22 bp, Artificial Sequence
  chemically synthesized
gctggctgtgtgactgtggaca

SEQ ID NO: 655985 - DNA, 22 bp, Artificial Sequence
  chemically synthesized
tttgctggctgtgtgactgtgg

SEQ ID NO: 655986 - DNA, 22 bp, Artificial Sequence
  chemically synthesized
agaaatgtgtccacagtcacac

SEQ ID NO: 655987 - DNA, 22 bp, Artificial Sequence
  chemically synthesized
ctatttgctggctgtgtgactg

SEQ ID NO: 655988 - DNA, 22 bp, Artificial Sequence
  chemically synthesized
tgctatttgctggctgtgtgac

SEQ ID NO: 655989 - DNA, 22 bp, Artificial Sequence
  chemically synthesized
agctctgctatttgctggctgt

SEQ ID NO: 655990 - DNA, 22 bp, Artificial Sequence
  chemically synthesized
agtccaaatctgagctctgcta

SEQ ID NO: 655991 - DNA, 22 bp, Artificial Sequence
  chemically synthesized
tgcctgagtccaaatctgagct

SEQ ID NO: 655992 - DNA, 22 bp, Artificial Sequence
  chemically synthesized
aaaccgaactgtgcctgagtcc

SEQ ID NO: 655993 - DNA, 22 bp, Artificial Sequence
  chemically synthesized
gaaaccgaactgtgcctgagtc

SEQ ID NO: 655994 - DNA, 22 bp, Artificial Sequence
  chemically synthesized
tgaaaccgaactgtgcctgagt

SEQ ID NO: 655995 - DNA, 22 bp, Artificial Sequence
  chemically synthesized
agatttggactcaggcacagtt

SEQ ID NO: 655996 - DNA, 22 bp, Artificial Sequence
  chemically synthesized
ggactcaggcacagttcggttt

SEQ ID NO: 655997 - DNA, 22 bp, Artificial Sequence
  chemically synthesized
gactcaggcacagttcggtttc

SEQ ID NO: 655998 - DNA, 22 bp, Artificial Sequence
  chemically synthesized
agtgcataggctttgaaaccga

SEQ ID NO: 655999 - DNA, 22 bp, Artificial Sequence
  chemically synthesized
aggcacagttcggtttcaaagc

SEQ ID NO: 656000 - DNA, 22 bp, Artificial Sequence
  chemically synthesized
gcagagtggttaagtgcatagg

SEQ ID NO: 656001 - DNA, 22 bp, Artificial Sequence
  chemically synthesized
ggtttcaaagcctatgcactta

SEQ ID NO: 656002 - DNA, 22 bp, Artificial Sequence
  chemically synthesized
caaagcctatgcacttaaccac

SEQ ID NO: 656003 - DNA, 22 bp, Artificial Sequence
  chemically synthesized
aaagcctatgcacttaaccact

SEQ ID NO: 656004 - DNA, 22 bp, Artificial Sequence
  chemically synthesized
gagaagtgactggcagagtggt

SEQ ID NO: 656005 - DNA, 22 bp, Artificial Sequence
  chemically synthesized
tgcacttaaccactctgccagt

SEQ ID NO: 656006 - DNA, 22 bp, Artificial Sequence
  chemically synthesized
aaccactctgccagtcacttct

SEQ ID NO: 656007 - DNA, 22 bp, Artificial Sequence
  chemically synthesized
cagaatatctggagaagtgact

SEQ ID NO: 656008 - DNA, 22 bp, Artificial Sequence
  chemically synthesized
accactctgccagtcacttctc

SEQ ID NO: 656009 - DNA, 22 bp, Artificial Sequence
  chemically synthesized
tgccagtcacttctccagatat

SEQ ID NO: 656010 - DNA, 22 bp, Artificial Sequence
  chemically synthesized
ccagtcacttctccagatattc

SEQ ID NO: 656011 - DNA, 22 bp, Artificial Sequence
  chemically synthesized
ctccagatattctggaatgctt

SEQ ID NO: 656012 - DNA, 22 bp, Artificial Sequence
  chemically synthesized
tccagatattctggaatgcttt

SEQ ID NO: 656013 - DNA, 22 bp, Artificial Sequence
  chemically synthesized
cagatattctggaatgctttct

SEQ ID NO: 656014 - DNA, 22 bp, Artificial Sequence
  chemically synthesized
tggaatgctttctcatttatgt

SEQ ID NO: 656015 - DNA, 22 bp, Artificial Sequence
  chemically synthesized
gaatgctttctcatttatgtgt

SEQ ID NO: 656016 - DNA, 22 bp, Artificial Sequence
  chemically synthesized
aggtgggaggatcagtaacaca

SEQ ID NO: 656017 - DNA, 22 bp, Artificial Sequence
  chemically synthesized
tctcatttatgtgttactgatc

SEQ ID NO: 656018 - DNA, 22 bp, Artificial Sequence
  chemically synthesized
ctcatttatgtgttactgatcc

SEQ ID NO: 656019 - DNA, 22 bp, Artificial Sequence
  chemically synthesized
tcatttatgtgttactgatcct

SEQ ID NO: 656020 - DNA, 22 bp, Artificial Sequence
  chemically synthesized
atttatgtgttactgatcctcc

SEQ ID NO: 656021 - DNA, 22 bp, Artificial Sequence
  chemically synthesized
aggagactgaggtgggaggatc

SEQ ID NO: 656022 - DNA, 22 bp, Artificial Sequence
  chemically synthesized
atgtgttactgatcctcccacc

SEQ ID NO: 656023 - DNA, 22 bp, Artificial Sequence
  chemically synthesized
tgtgttactgatcctcccacct

SEQ ID NO: 656024 - DNA, 22 bp, Artificial Sequence
  chemically synthesized
ctcaggagactgaggtgggagg

SEQ ID NO: 656025 - DNA, 22 bp, Artificial Sequence
  chemically synthesized
ctgatcctcccacctcagtctc

SEQ ID NO: 656026 - DNA, 22 bp, Artificial Sequence
  chemically synthesized
atcctcccacctcagtctcctg

SEQ ID NO: 656027 - DNA, 22 bp, Artificial Sequence
  chemically synthesized
tagtcccagctactcaggagac

SEQ ID NO: 656028 - DNA, 22 bp, Artificial Sequence
  chemically synthesized
ccacctcagtctcctgagtagc

SEQ ID NO: 656029 - DNA, 22 bp, Artificial Sequence
  chemically synthesized
agtctcctgagtagctgggact

SEQ ID NO: 656030 - DNA, 22 bp, Artificial Sequence
  chemically synthesized
ctgagtagctgggactacaggg

SEQ ID NO: 656031 - DNA, 22 bp, Artificial Sequence
  chemically synthesized
agtagctgggactacaggggca

SEQ ID NO: 656032 - DNA, 22 bp, Artificial Sequence
  chemically synthesized
ccatgcatggtggcatgcccct

SEQ ID NO: 656033 - DNA, 22 bp, Artificial Sequence
  chemically synthesized
ttgccatgcatggtggcatgcc

SEQ ID NO: 656034 - DNA, 22 bp, Artificial Sequence
  chemically synthesized
ggactacaggggcatgccacca

SEQ ID NO: 656035 - DNA, 22 bp, Artificial Sequence
  chemically synthesized
ttgttgccatgcatggtggcat

SEQ ID NO: 656036 - DNA, 22 bp, Artificial Sequence
  chemically synthesized
caggggcatgccaccatgcatg

SEQ ID NO: 656037 - DNA, 22 bp, Artificial Sequence
  chemically synthesized
aaatatacaatgtattattgtt

SEQ ID NO: 656038 - DNA, 22 bp, Artificial Sequence
  chemically synthesized
gaaatatacaatgtattattgt

SEQ ID NO: 656039 - DNA, 22 bp, Artificial Sequence
  chemically synthesized
tgaaatatacaatgtattattg

SEQ ID NO: 656040 - DNA, 22 bp, Artificial Sequence
  chemically synthesized
ttttgaaatatacaatgtatta

SEQ ID NO: 656041 - DNA, 22 bp, Artificial Sequence
  chemically synthesized
gttattttgaaatatacaatgt

SEQ ID NO: 656042 - DNA, 22 bp, Artificial Sequence
  chemically synthesized
agttattttgaaatatacaatg

SEQ ID NO: 656043 - DNA, 22 bp, Artificial Sequence
  chemically synthesized
tagttattttgaaatatacaat

SEQ ID NO: 656044 - DNA, 22 bp, Artificial Sequence
  chemically synthesized
ttagttattttgaaatatacaa

SEQ ID NO: 656045 - DNA, 22 bp, Artificial Sequence
  chemically synthesized
ttttagttattttgaaatatac

SEQ ID NO: 656046 - DNA, 22 bp, Artificial Sequence
  chemically synthesized
ctcttttagttattttgaaata

SEQ ID NO: 656047 - DNA, 22 bp, Artificial Sequence
  chemically synthesized
tactcttttagttattttgaaa

SEQ ID NO: 656048 - DNA, 22 bp, Artificial Sequence
  chemically synthesized
ccaattctactcttttagttat

SEQ ID NO: 656049 - DNA, 22 bp, Artificial Sequence
  chemically synthesized
tatatttcaaaataactaaaag

SEQ ID NO: 656050 - DNA, 22 bp, Artificial Sequence
  chemically synthesized
caaaataactaaaagagtagaa

SEQ ID NO: 656051 - DNA, 22 bp, Artificial Sequence
  chemically synthesized
aaaataactaaaagagtagaat

SEQ ID NO: 656052 - DNA, 22 bp, Artificial Sequence
  chemically synthesized
gaaacattcccaattctactct

SEQ ID NO: 656053 - DNA, 22 bp, Artificial Sequence
  chemically synthesized
tgttagaaacattcccaattct

SEQ ID NO: 656054 - DNA, 22 bp, Artificial Sequence
  chemically synthesized
tgtgttagaaacattcccaatt

SEQ ID NO: 656055 - DNA, 22 bp, Artificial Sequence
  chemically synthesized
tctgtgttagaaacattcccaa

SEQ ID NO: 656056 - DNA, 22 bp, Artificial Sequence
  chemically synthesized
aaagagtagaattgggaatgtt

SEQ ID NO: 656057 - DNA, 22 bp, Artificial Sequence
  chemically synthesized
ctctgtgttagaaacattccca

SEQ ID NO: 656058 - DNA, 22 bp, Artificial Sequence
  chemically synthesized
agaacaagtatttctctgtgtt

SEQ ID NO: 656059 - DNA, 22 bp, Artificial Sequence
  chemically synthesized
ggaatgtttctaacacagagaa

SEQ ID NO: 656060 - DNA, 22 bp, Artificial Sequence
  chemically synthesized
ttgagaacaagtatttctctgt

SEQ ID NO: 656061 - DNA, 22 bp, Artificial Sequence
  chemically synthesized
aactgttgagaacaagtatttc

SEQ ID NO: 656062 - DNA, 22 bp, Artificial Sequence
  chemically synthesized
ctaacacagagaaatacttgtt

SEQ ID NO: 656063 - DNA, 22 bp, Artificial Sequence
  chemically synthesized
taacacagagaaatacttgttc

SEQ ID NO: 656064 - DNA, 22 bp, Artificial Sequence
  chemically synthesized
acacagagaaatacttgttctc

SEQ ID NO: 656065 - DNA, 22 bp, Artificial Sequence
  chemically synthesized
cagtctcaactgttgagaacaa

SEQ ID NO: 656066 - DNA, 22 bp, Artificial Sequence
  chemically synthesized
gttctcaacagttgagactgta

SEQ ID NO: 656067 - DNA, 22 bp, Artificial Sequence
  chemically synthesized
ttctcaacagttgagactgtaa

SEQ ID NO: 656068 - DNA, 22 bp, Artificial Sequence
  chemically synthesized
tcaacagttgagactgtaattt

SEQ ID NO: 656069 - DNA, 22 bp, Artificial Sequence
  chemically synthesized
aacagttgagactgtaatttat

SEQ ID NO: 656070 - DNA, 22 bp, Artificial Sequence
  chemically synthesized
agactgtaatttattctcattt

SEQ ID NO: 656071 - DNA, 22 bp, Artificial Sequence
  chemically synthesized
taatttattctcattttcatat

SEQ ID NO: 656072 - DNA, 22 bp, Artificial Sequence
  chemically synthesized
taataatgtagaatgatatgaa

SEQ ID NO: 656073 - DNA, 22 bp, Artificial Sequence
  chemically synthesized
attctcattttcatatcattct

SEQ ID NO: 656074 - DNA, 22 bp, Artificial Sequence
  chemically synthesized
ttgtaataatgtagaatgatat

SEQ ID NO: 656075 - DNA, 22 bp, Artificial Sequence
  chemically synthesized
ttctcattttcatatcattcta

SEQ ID NO: 656076 - DNA, 22 bp, Artificial Sequence
  chemically synthesized
tcattttcatatcattctacat

SEQ ID NO: 656077 - DNA, 22 bp, Artificial Sequence
  chemically synthesized
attttcatatcattctacatta

SEQ ID NO: 656078 - DNA, 22 bp, Artificial Sequence
  chemically synthesized
tcatatcattctacattattac

SEQ ID NO: 656079 - DNA, 22 bp, Artificial Sequence
  chemically synthesized
tgcacagttgttgtaataatgt

SEQ ID NO: 656080 - DNA, 22 bp, Artificial Sequence
  chemically synthesized
catatcattctacattattaca

SEQ ID NO: 656081 - DNA, 22 bp, Artificial Sequence
  chemically synthesized
atatcattctacattattacaa

SEQ ID NO: 656082 - DNA, 22 bp, Artificial Sequence
  chemically synthesized
tacattattacaacaactgtgc

SEQ ID NO: 656083 - DNA, 22 bp, Artificial Sequence
  chemically synthesized
cattattacaacaactgtgcat

SEQ ID NO: 656084 - DNA, 22 bp, Artificial Sequence
  chemically synthesized
ttacaacaactgtgcatagatg

SEQ ID NO: 656085 - DNA, 22 bp, Artificial Sequence
  chemically synthesized
caacaactgtgcatagatggta

SEQ ID NO: 656086 - DNA, 22 bp, Artificial Sequence
  chemically synthesized
tatgacaaaaatgaataccatc

SEQ ID NO: 656087 - DNA, 22 bp, Artificial Sequence
  chemically synthesized
gtatgacaaaaatgaataccat

SEQ ID NO: 656088 - DNA, 22 bp, Artificial Sequence
  chemically synthesized
tttgtatgacaaaaatgaatac

SEQ ID NO: 656089 - DNA, 22 bp, Artificial Sequence
  chemically synthesized
tgcatagatggtattcattttt

SEQ ID NO: 656090 - DNA, 22 bp, Artificial Sequence
  chemically synthesized
tatttgtatgacaaaaatgaat

SEQ ID NO: 656091 - DNA, 22 bp, Artificial Sequence
  chemically synthesized
tctatttgtatgacaaaaatga

SEQ ID NO: 656092 - DNA, 22 bp, Artificial Sequence
  chemically synthesized
ctctatttgtatgacaaaaatg

SEQ ID NO: 656093 - DNA, 22 bp, Artificial Sequence
  chemically synthesized
aatttctctatttgtatgacaa

SEQ ID NO: 656094 - DNA, 22 bp, Artificial Sequence
  chemically synthesized
tgaatttctctatttgtatgac

SEQ ID NO: 656095 - DNA, 22 bp, Artificial Sequence
  chemically synthesized
ctgaatttctctatttgtatga

SEQ ID NO: 656096 - DNA, 22 bp, Artificial Sequence
  chemically synthesized
tcttctgaatttctctatttgt

SEQ ID NO: 656097 - DNA, 22 bp, Artificial Sequence
  chemically synthesized
atttttgtcatacaaatagaga

SEQ ID NO: 656098 - DNA, 22 bp, Artificial Sequence
  chemically synthesized
ttgtcatacaaatagagaaatt

SEQ ID NO: 656099 - DNA, 22 bp, Artificial Sequence
  chemically synthesized
tgtcatacaaatagagaaattc

SEQ ID NO: 656100 - DNA, 22 bp, Artificial Sequence
  chemically synthesized
catctatcttctgaatttctct

SEQ ID NO: 656101 - DNA, 22 bp, Artificial Sequence
  chemically synthesized
gtcatacaaatagagaaattca

SEQ ID NO: 656102 - DNA, 22 bp, Artificial Sequence
  chemically synthesized
ccatctatcttctgaatttctc

SEQ ID NO: 656103 - DNA, 22 bp, Artificial Sequence
  chemically synthesized
tcatacaaatagagaaattcag

SEQ ID NO: 656104 - DNA, 22 bp, Artificial Sequence
  chemically synthesized
tccatctatcttctgaatttct

SEQ ID NO: 656105 - DNA, 22 bp, Artificial Sequence
  chemically synthesized
ttccatctatcttctgaatttc

SEQ ID NO: 656106 - DNA, 22 bp, Artificial Sequence
  chemically synthesized
cttttccatctatcttctgaat

SEQ ID NO: 656107 - DNA, 22 bp, Artificial Sequence
  chemically synthesized
caaatgagtaagttgcttttcc

SEQ ID NO: 656108 - DNA, 22 bp, Artificial Sequence
  chemically synthesized
agaagatagatggaaaagcaac

SEQ ID NO: 656109 - DNA, 22 bp, Artificial Sequence
  chemically synthesized
gtattccaaatgagtaagttgc

SEQ ID NO: 656110 - DNA, 22 bp, Artificial Sequence
  chemically synthesized
agtattccaaatgagtaagttg

SEQ ID NO: 656111 - DNA, 22 bp, Artificial Sequence
  chemically synthesized
tacttagtattccaaatgagta

SEQ ID NO: 656112 - DNA, 22 bp, Artificial Sequence
  chemically synthesized
ttgtacttagtattccaaatga

SEQ ID NO: 656113 - DNA, 22 bp, Artificial Sequence
  chemically synthesized
ctgttgtacttagtattccaaa

SEQ ID NO: 656114 - DNA, 22 bp, Artificial Sequence
  chemically synthesized
cctcctgttgtacttagtattc

SEQ ID NO: 656115 - DNA, 22 bp, Artificial Sequence
  chemically synthesized
tgcctcctgttgtacttagtat

SEQ ID NO: 656116 - DNA, 22 bp, Artificial Sequence
  chemically synthesized
actcatttggaatactaagtac

SEQ ID NO: 656117 - DNA, 22 bp, Artificial Sequence
  chemically synthesized
ctgcctcctgttgtacttagta

SEQ ID NO: 656118 - DNA, 22 bp, Artificial Sequence
  chemically synthesized
ctcatttggaatactaagtaca

SEQ ID NO: 656119 - DNA, 22 bp, Artificial Sequence
  chemically synthesized
tctgcctcctgttgtacttagt

SEQ ID NO: 656120 - DNA, 22 bp, Artificial Sequence
  chemically synthesized
atttggaatactaagtacaaca

SEQ ID NO: 656121 - DNA, 22 bp, Artificial Sequence
  chemically synthesized
ttttctgcctcctgttgtactt

SEQ ID NO: 656122 - DNA, 22 bp, Artificial Sequence
  chemically synthesized
ggaatactaagtacaacaggag

SEQ ID NO: 656123 - DNA, 22 bp, Artificial Sequence
  chemically synthesized
gaatactaagtacaacaggagg

SEQ ID NO: 656124 - DNA, 22 bp, Artificial Sequence
  chemically synthesized
catctgttttctgcctcctgtt

SEQ ID NO: 656125 - DNA, 22 bp, Artificial Sequence
  chemically synthesized
acatctgttttctgcctcctgt

SEQ ID NO: 656126 - DNA, 22 bp, Artificial Sequence
  chemically synthesized
tacatctgttttctgcctcctg

SEQ ID NO: 656127 - DNA, 22 bp, Artificial Sequence
  chemically synthesized
ttttacatctgttttctgcctc

SEQ ID NO: 656128 - DNA, 22 bp, Artificial Sequence
  chemically synthesized
attttacatctgttttctgcct

SEQ ID NO: 656129 - DNA, 22 bp, Artificial Sequence
  chemically synthesized
agtacaacaggaggcagaaaac

SEQ ID NO: 656130 - DNA, 22 bp, Artificial Sequence
  chemically synthesized
tttattttacatctgttttctg

SEQ ID NO: 656131 - DNA, 22 bp, Artificial Sequence
  chemically synthesized
gagtgtcaaaatctgtttattt

SEQ ID NO: 656132 - DNA, 22 bp, Artificial Sequence
  chemically synthesized
tgagagctggagtgtcaaaatc

SEQ ID NO: 656133 - DNA, 22 bp, Artificial Sequence
  chemically synthesized
acctatgagagctggagtgtca

SEQ ID NO: 656134 - DNA, 22 bp, Artificial Sequence
  chemically synthesized
cacctatgagagctggagtgtc

SEQ ID NO: 656135 - DNA, 22 bp, Artificial Sequence
  chemically synthesized
aatatgcttcacctatgagagc

SEQ ID NO: 656136 - DNA, 22 bp, Artificial Sequence
  chemically synthesized
tgacactccagctctcataggt

SEQ ID NO: 656137 - DNA, 22 bp, Artificial Sequence
  chemically synthesized
gacactccagctctcataggtg

SEQ ID NO: 656138 - DNA, 22 bp, Artificial Sequence
  chemically synthesized
acactccagctctcataggtga

SEQ ID NO: 656139 - DNA, 22 bp, Artificial Sequence
  chemically synthesized
tattcaatatgcttcacctatg

SEQ ID NO: 656140 - DNA, 22 bp, Artificial Sequence
  chemically synthesized
atattcaatatgcttcacctat

SEQ ID NO: 656141 - DNA, 22 bp, Artificial Sequence
  chemically synthesized
tatattcaatatgcttcaccta

SEQ ID NO: 656142 - DNA, 22 bp, Artificial Sequence
  chemically synthesized
cagctctcataggtgaagcata

SEQ ID NO: 656143 - DNA, 22 bp, Artificial Sequence
  chemically synthesized
tcataggtgaagcatattgaat

SEQ ID NO: 656144 - DNA, 22 bp, Artificial Sequence
  chemically synthesized
ataggtgaagcatattgaatat

SEQ ID NO: 656145 - DNA, 22 bp, Artificial Sequence
  chemically synthesized
gataacgtcaagtataccaact

SEQ ID NO: 656146 - DNA, 22 bp, Artificial Sequence
  chemically synthesized
agataacgtcaagtataccaac

SEQ ID NO: 656147 - DNA, 22 bp, Artificial Sequence
  chemically synthesized
tttagataacgtcaagtatacc

SEQ ID NO: 656148 - DNA, 22 bp, Artificial Sequence
  chemically synthesized
aatataaagttggtatacttga

SEQ ID NO: 656149 - DNA, 22 bp, Artificial Sequence
  chemically synthesized
ttgtttagataacgtcaagtat

SEQ ID NO: 656150 - DNA, 22 bp, Artificial Sequence
  chemically synthesized
attgtttagataacgtcaagta

SEQ ID NO: 656151 - DNA, 22 bp, Artificial Sequence
  chemically synthesized
tattgtttagataacgtcaagt

SEQ ID NO: 656152 - DNA, 22 bp, Artificial Sequence
  chemically synthesized
aggactttattgtttagataac

SEQ ID NO: 656153 - DNA, 22 bp, Artificial Sequence
  chemically synthesized
gtatacttgacgttatctaaac

SEQ ID NO: 656154 - DNA, 22 bp, Artificial Sequence
  chemically synthesized
aaggactttattgtttagataa

SEQ ID NO: 656155 - DNA, 22 bp, Artificial Sequence
  chemically synthesized
taaggactttattgtttagata

SEQ ID NO: 656156 - DNA, 22 bp, Artificial Sequence
  chemically synthesized
gacgttatctaaacaataaagt

SEQ ID NO: 656157 - DNA, 22 bp, Artificial Sequence
  chemically synthesized
acgttatctaaacaataaagtc

SEQ ID NO: 656158 - DNA, 22 bp, Artificial Sequence
  chemically synthesized
agtaaacattttaaggacttta

SEQ ID NO: 656159 - DNA, 22 bp, Artificial Sequence
  chemically synthesized
cagtaaacattttaaggacttt

SEQ ID NO: 656160 - DNA, 22 bp, Artificial Sequence
  chemically synthesized
tctaaacaataaagtccttaaa

SEQ ID NO: 656161 - DNA, 22 bp, Artificial Sequence
  chemically synthesized
ttcagtaaacattttaaggact

SEQ ID NO: 656162 - DNA, 22 bp, Artificial Sequence
  chemically synthesized
cttcagtaaacattttaaggac

SEQ ID NO: 656163 - DNA, 22 bp, Artificial Sequence
  chemically synthesized
aacaataaagtccttaaaatgt

SEQ ID NO: 656164 - DNA, 22 bp, Artificial Sequence
  chemically synthesized
tagtatcttcttcagtaaacat

SEQ ID NO: 656165 - DNA, 22 bp, Artificial Sequence
  chemically synthesized
gtagtatcttcttcagtaaaca

SEQ ID NO: 656166 - DNA, 22 bp, Artificial Sequence
  chemically synthesized
tgtagtatcttcttcagtaaac

SEQ ID NO: 656167 - DNA, 22 bp, Artificial Sequence
  chemically synthesized
gattttgtagtatcttcttcag

SEQ ID NO: 656168 - DNA, 22 bp, Artificial Sequence
  chemically synthesized
cgattttgtagtatcttcttca

SEQ ID NO: 656169 - DNA, 22 bp, Artificial Sequence
  chemically synthesized
aaaatgtttactgaagaagata

SEQ ID NO: 656170 - DNA, 22 bp, Artificial Sequence
  chemically synthesized
aaatgtttactgaagaagatac

SEQ ID NO: 656171 - DNA, 22 bp, Artificial Sequence
  chemically synthesized
tggtttcgattttgtagtatct

SEQ ID NO: 656172 - DNA, 22 bp, Artificial Sequence
  chemically synthesized
gtggtttcgattttgtagtatc

SEQ ID NO: 656173 - DNA, 22 bp, Artificial Sequence
  chemically synthesized
tgtggtttcgattttgtagtat

SEQ ID NO: 656174 - DNA, 22 bp, Artificial Sequence
  chemically synthesized
ttgtggtttcgattttgtagta

SEQ ID NO: 656175 - DNA, 22 bp, Artificial Sequence
  chemically synthesized
actgaagaagatactacaaaat

SEQ ID NO: 656176 - DNA, 22 bp, Artificial Sequence
  chemically synthesized
tttgtggtttcgattttgtagt

SEQ ID NO: 656177 - DNA, 22 bp, Artificial Sequence
  chemically synthesized
ctgaagaagatactacaaaatc

SEQ ID NO: 656178 - DNA, 22 bp, Artificial Sequence
  chemically synthesized
aagaagatactacaaaatcgaa

SEQ ID NO: 656179 - DNA, 22 bp, Artificial Sequence
  chemically synthesized
caaaatcgaaaccacaaaaaga

SEQ ID NO: 656180 - DNA, 22 bp, Artificial Sequence
  chemically synthesized
cagtcaacatgggagtgcagat

SEQ ID NO: 656181 - DNA, 22 bp, Artificial Sequence
  chemically synthesized
tgaacaatgctgcagtcaacat

SEQ ID NO: 656182 - DNA, 22 bp, Artificial Sequence
  chemically synthesized
ttgtgaacaatgctgcagtcaa

SEQ ID NO: 656183 - DNA, 22 bp, Artificial Sequence
  chemically synthesized
cactcccatgttgactgcagca

SEQ ID NO: 656184 - DNA, 22 bp, Artificial Sequence
  chemically synthesized
gctattgtgaacaatgctgcag

SEQ ID NO: 656185 - DNA, 22 bp, Artificial Sequence
  chemically synthesized
ggctattgtgaacaatgctgca

SEQ ID NO: 656186 - DNA, 22 bp, Artificial Sequence
  chemically synthesized
ccatgttgactgcagcattgtt

SEQ ID NO: 656187 - DNA, 22 bp, Artificial Sequence
  chemically synthesized
tatcttggctattgtgaacaat

SEQ ID NO: 656188 - DNA, 22 bp, Artificial Sequence
  chemically synthesized
tatatcttggctattgtgaaca

SEQ ID NO: 656189 - DNA, 22 bp, Artificial Sequence
  chemically synthesized
actgcagcattgttcacaatag

SEQ ID NO: 656190 - DNA, 22 bp, Artificial Sequence
  chemically synthesized
attctatatcttggctattgtg

SEQ ID NO: 656191 - DNA, 22 bp, Artificial Sequence
  chemically synthesized
cagcattgttcacaatagccaa

SEQ ID NO: 656192 - DNA, 22 bp, Artificial Sequence
  chemically synthesized
ggttgattctatatcttggcta

SEQ ID NO: 656193 - DNA, 22 bp, Artificial Sequence
  chemically synthesized
aggttgattctatatcttggct

SEQ ID NO: 656194 - DNA, 22 bp, Artificial Sequence
  chemically synthesized
ttcacaatagccaagatataga

SEQ ID NO: 656195 - DNA, 22 bp, Artificial Sequence
  chemically synthesized
acaatagccaagatatagaatc

SEQ ID NO: 656196 - DNA, 22 bp, Artificial Sequence
  chemically synthesized
atgggcgcttaggttgattcta

SEQ ID NO: 656197 - DNA, 22 bp, Artificial Sequence
  chemically synthesized
atccactgatgggcgcttaggt

SEQ ID NO: 656198 - DNA, 22 bp, Artificial Sequence
  chemically synthesized
tgcattcatccactgatgggcg

SEQ ID NO: 656199 - DNA, 22 bp, Artificial Sequence
  chemically synthesized
atgcattcatccactgatgggc

SEQ ID NO: 656200 - DNA, 22 bp, Artificial Sequence
  chemically synthesized
tatgcattcatccactgatggg

SEQ ID NO: 656201 - DNA, 22 bp, Artificial Sequence
  chemically synthesized
tttatgcattcatccactgatg

SEQ ID NO: 656202 - DNA, 22 bp, Artificial Sequence
  chemically synthesized
ctttatgcattcatccactgat

SEQ ID NO: 656203 - DNA, 22 bp, Artificial Sequence
  chemically synthesized
tctttatgcattcatccactga

SEQ ID NO: 656204 - DNA, 22 bp, Artificial Sequence
  chemically synthesized
agcgcccatcagtggatgaatg

SEQ ID NO: 656205 - DNA, 22 bp, Artificial Sequence
  chemically synthesized
tagtacattttctttatgcatt

SEQ ID NO: 656206 - DNA, 22 bp, Artificial Sequence
  chemically synthesized
atagtacattttctttatgcat

SEQ ID NO: 656207 - DNA, 22 bp, Artificial Sequence
  chemically synthesized
tgtgtttatagtacattttctt

SEQ ID NO: 656208 - DNA, 22 bp, Artificial Sequence
  chemically synthesized
cattatgtgtttatagtacatt

SEQ ID NO: 656209 - DNA, 22 bp, Artificial Sequence
  chemically synthesized
aataatattccattatgtgttt

SEQ ID NO: 656210 - DNA, 22 bp, Artificial Sequence
  chemically synthesized
tggctgaataatattccattat

SEQ ID NO: 656211 - DNA, 22 bp, Artificial Sequence
  chemically synthesized
atggctgaataatattccatta

SEQ ID NO: 656212 - DNA, 22 bp, Artificial Sequence
  chemically synthesized
tatggctgaataatattccatt

SEQ ID NO: 656213 - DNA, 22 bp, Artificial Sequence
  chemically synthesized
ttatggctgaataatattccat

SEQ ID NO: 656214 - DNA, 22 bp, Artificial Sequence
  chemically synthesized
tttatggctgaataatattcca

SEQ ID NO: 656215 - DNA, 22 bp, Artificial Sequence
  chemically synthesized
taaacacataatggaatattat

SEQ ID NO: 656216 - DNA, 22 bp, Artificial Sequence
  chemically synthesized
attttttatggctgaataatat

SEQ ID NO: 656217 - DNA, 22 bp, Artificial Sequence
  chemically synthesized
cattttttatggctgaataata

SEQ ID NO: 656218 - DNA, 22 bp, Artificial Sequence
  chemically synthesized
caaataatgggatttcattttt

SEQ ID NO: 656219 - DNA, 22 bp, Artificial Sequence
  chemically synthesized
ttcagccataaaaaatgaaatc

SEQ ID NO: 656220 - DNA, 22 bp, Artificial Sequence
  chemically synthesized
ctgcaaataatgggatttcatt

SEQ ID NO: 656221 - DNA, 22 bp, Artificial Sequence
  chemically synthesized
agccataaaaaatgaaatccca

SEQ ID NO: 656222 - DNA, 22 bp, Artificial Sequence
  chemically synthesized
cgtacatgttgctgcaaataat

SEQ ID NO: 656223 - DNA, 22 bp, Artificial Sequence
  chemically synthesized
cggttccgtacatgttgctgca

SEQ ID NO: 656224 - DNA, 22 bp, Artificial Sequence
  chemically synthesized
ccggttccgtacatgttgctgc

SEQ ID NO: 656225 - DNA, 22 bp, Artificial Sequence
  chemically synthesized
tttgcagcaacatgtacggaac

SEQ ID NO: 656226 - DNA, 22 bp, Artificial Sequence
  chemically synthesized
gcagcaacatgtacggaaccgg

SEQ ID NO: 656227 - DNA, 22 bp, Artificial Sequence
  chemically synthesized
cagcaacatgtacggaaccgga

SEQ ID NO: 656228 - DNA, 22 bp, Artificial Sequence
  chemically synthesized
aacataacgtcttccggttccg

SEQ ID NO: 656229 - DNA, 22 bp, Artificial Sequence
  chemically synthesized
atctcaacataacgtcttccgg

SEQ ID NO: 656230 - DNA, 22 bp, Artificial Sequence
  chemically synthesized
tgtgtggctgatctcaacataa

SEQ ID NO: 656231 - DNA, 22 bp, Artificial Sequence
  chemically synthesized
tgtgtgtggctgatctcaacat

SEQ ID NO: 656232 - DNA, 22 bp, Artificial Sequence
  chemically synthesized
ctgtgtgtggctgatctcaaca

SEQ ID NO: 656233 - DNA, 22 bp, Artificial Sequence
  chemically synthesized
tctgtgtgtggctgatctcaac

SEQ ID NO: 656234 - DNA, 22 bp, Artificial Sequence
  chemically synthesized
tctttctgtgtgtggctgatct

SEQ ID NO: 656235 - DNA, 22 bp, Artificial Sequence
  chemically synthesized
gtctttctgtgtgtggctgatc

SEQ ID NO: 656236 - DNA, 22 bp, Artificial Sequence
  chemically synthesized
tgttgagatcagccacacacag

SEQ ID NO: 656237 - DNA, 22 bp, Artificial Sequence
  chemically synthesized
agatcagccacacacagaaaga

SEQ ID NO: 656238 - DNA, 22 bp, Artificial Sequence
  chemically synthesized
ccacacatgagtgagaacatgg

SEQ ID NO: 656239 - DNA, 22 bp, Artificial Sequence
  chemically synthesized
gctcccacacatgagtgagaac

SEQ ID NO: 656240 - DNA, 22 bp, Artificial Sequence
  chemically synthesized
agctcccacacatgagtgagaa

SEQ ID NO: 656241 - DNA, 22 bp, Artificial Sequence
  chemically synthesized
tagctcccacacatgagtgaga

SEQ ID NO: 656242 - DNA, 22 bp, Artificial Sequence
  chemically synthesized
ttagctcccacacatgagtgag

SEQ ID NO: 656243 - DNA, 22 bp, Artificial Sequence
  chemically synthesized
tttagctcccacacatgagtga

SEQ ID NO: 656244 - DNA, 22 bp, Artificial Sequence
  chemically synthesized
ttttagctcccacacatgagtg

SEQ ID NO: 656245 - DNA, 22 bp, Artificial Sequence
  chemically synthesized
tttttagctcccacacatgagt

SEQ ID NO: 656246 - DNA, 22 bp, Artificial Sequence
  chemically synthesized
ttttttagctcccacacatgag

SEQ ID NO: 656247 - DNA, 22 bp, Artificial Sequence
  chemically synthesized
tttttttagctcccacacatga

SEQ ID NO: 656248 - DNA, 22 bp, Artificial Sequence
  chemically synthesized
ttttttttagctcccacacatg

SEQ ID NO: 656249 - DNA, 22 bp, Artificial Sequence
  chemically synthesized
tttttttttagctcccacacat

SEQ ID NO: 656250 - DNA, 22 bp, Artificial Sequence
  chemically synthesized
ttttttttttagctcccacaca

SEQ ID NO: 656251 - DNA, 22 bp, Artificial Sequence
  chemically synthesized
tttttttttttagctcccacac

SEQ ID NO: 656252 - DNA, 22 bp, Artificial Sequence
  chemically synthesized
ttttttttttttagctcccaca

SEQ ID NO: 656253 - DNA, 22 bp, Artificial Sequence
  chemically synthesized
tttttttttttttagctcccac

SEQ ID NO: 656254 - DNA, 22 bp, Artificial Sequence
  chemically synthesized
ttttttttttttttagctccca

SEQ ID NO: 656255 - DNA, 22 bp, Artificial Sequence
  chemically synthesized
tcactcatgtgtgggagctaaa

SEQ ID NO: 656256 - DNA, 22 bp, Artificial Sequence
  chemically synthesized
tttttttttttttttagctccc

SEQ ID NO: 656257 - DNA, 22 bp, Artificial Sequence
  chemically synthesized
ttttttttttttttttagctcc

SEQ ID NO: 656258 - DNA, 22 bp, Artificial Sequence
  chemically synthesized
actcatgtgtgggagctaaaaa

SEQ ID NO: 656259 - DNA, 22 bp, Artificial Sequence
  chemically synthesized
tttttttttttttttttagctc

SEQ ID NO: 656260 - DNA, 22 bp, Artificial Sequence
  chemically synthesized
ttttttttttttttttttagct

SEQ ID NO: 656261 - DNA, 22 bp, Artificial Sequence
  chemically synthesized
tttttttttttttttttttagc

SEQ ID NO: 656262 - DNA, 22 bp, Artificial Sequence
  chemically synthesized
ttttttttttttttttttttag

SEQ ID NO: 656263 - DNA, 22 bp, Artificial Sequence
  chemically synthesized
atgtgtgggagctaaaaaaaaa

SEQ ID NO: 656264 - DNA, 22 bp, Artificial Sequence
  chemically synthesized
aatttttttttttttttttttt

SEQ ID NO: 656265 - DNA, 22 bp, Artificial Sequence
  chemically synthesized
catgagttcaattttttttttt

SEQ ID NO: 656266 - DNA, 22 bp, Artificial Sequence
  chemically synthesized
aaaaaaaaaaaaaaaaaaaaaa

SEQ ID NO: 656267 - DNA, 22 bp, Artificial Sequence
  chemically synthesized
tctccatgagttcaattttttt

SEQ ID NO: 656268 - DNA, 22 bp, Artificial Sequence
  chemically synthesized
tatctccatgagttcaattttt

SEQ ID NO: 656269 - DNA, 22 bp, Artificial Sequence
  chemically synthesized
ctctatctccatgagttcaatt

SEQ ID NO: 656270 - DNA, 22 bp, Artificial Sequence
  chemically synthesized
actctatctccatgagttcaat

SEQ ID NO: 656271 - DNA, 22 bp, Artificial Sequence
  chemically synthesized
tactctatctccatgagttcaa

SEQ ID NO: 656272 - DNA, 22 bp, Artificial Sequence
  chemically synthesized
gtagtcatgattttactctatc

SEQ ID NO: 656273 - DNA, 22 bp, Artificial Sequence
  chemically synthesized
aactcatggagatagagtaaaa

SEQ ID NO: 656274 - DNA, 22 bp, Artificial Sequence
  chemically synthesized
tggtagtcatgattttactcta

SEQ ID NO: 656275 - DNA, 22 bp, Artificial Sequence
  chemically synthesized
atggagatagagtaaaatcatg

SEQ ID NO: 656276 - DNA, 22 bp, Artificial Sequence
  chemically synthesized
ccagactctggtagtcatgatt

SEQ ID NO: 656277 - DNA, 22 bp, Artificial Sequence
  chemically synthesized
cccagactctggtagtcatgat

SEQ ID NO: 656278 - DNA, 22 bp, Artificial Sequence
  chemically synthesized
catttcccagactctggtagtc

SEQ ID NO: 656279 - DNA, 22 bp, Artificial Sequence
  chemically synthesized
actacatttcccagactctggt

SEQ ID NO: 656280 - DNA, 22 bp, Artificial Sequence
  chemically synthesized
cactacatttcccagactctgg

SEQ ID NO: 656281 - DNA, 22 bp, Artificial Sequence
  chemically synthesized
ccagagtctgggaaatgtagtg

SEQ ID NO: 656282 - DNA, 22 bp, Artificial Sequence
  chemically synthesized
tcccccgatcttcactacattt

SEQ ID NO: 656283 - DNA, 22 bp, Artificial Sequence
  chemically synthesized
atcccccgatcttcactacatt

SEQ ID NO: 656284 - DNA, 22 bp, Artificial Sequence
  chemically synthesized
tatcccccgatcttcactacat

SEQ ID NO: 656285 - DNA, 22 bp, Artificial Sequence
  chemically synthesized
ttatcccccgatcttcactaca

SEQ ID NO: 656286 - DNA, 22 bp, Artificial Sequence
  chemically synthesized
tttatcccccgatcttcactac

SEQ ID NO: 656287 - DNA, 22 bp, Artificial Sequence
  chemically synthesized
ttttatcccccgatcttcacta

SEQ ID NO: 656288 - DNA, 22 bp, Artificial Sequence
  chemically synthesized
ggaaatgtagtgaagatcgggg

SEQ ID NO: 656289 - DNA, 22 bp, Artificial Sequence
  chemically synthesized
accatcccttttttatcccccg

SEQ ID NO: 656290 - DNA, 22 bp, Artificial Sequence
  chemically synthesized
tacccattaaccatcccttttt

SEQ ID NO: 656291 - DNA, 22 bp, Artificial Sequence
  chemically synthesized
gtacccattaaccatccctttt

SEQ ID NO: 656292 - DNA, 22 bp, Artificial Sequence
  chemically synthesized
tgtacccattaaccatcccttt

SEQ ID NO: 656293 - DNA, 22 bp, Artificial Sequence
  chemically synthesized
ttgtacccattaaccatccctt

SEQ ID NO: 656294 - DNA, 22 bp, Artificial Sequence
  chemically synthesized
tatttttgtacccattaaccat

SEQ ID NO: 656295 - DNA, 22 bp, Artificial Sequence
  chemically synthesized
ctgtatttttgtacccattaac

SEQ ID NO: 656296 - DNA, 22 bp, Artificial Sequence
  chemically synthesized
actgtatttttgtacccattaa

SEQ ID NO: 656297 - DNA, 22 bp, Artificial Sequence
  chemically synthesized
ttactgtatttttgtacccatt

SEQ ID NO: 656298 - DNA, 22 bp, Artificial Sequence
  chemically synthesized
cttactgtatttttgtacccat

SEQ ID NO: 656299 - DNA, 22 bp, Artificial Sequence
  chemically synthesized
ttcttactgtatttttgtaccc

SEQ ID NO: 656300 - DNA, 22 bp, Artificial Sequence
  chemically synthesized
cttcttactgtatttttgtacc

SEQ ID NO: 656301 - DNA, 22 bp, Artificial Sequence
  chemically synthesized
atgggtacaaaaatacagtaag

SEQ ID NO: 656302 - DNA, 22 bp, Artificial Sequence
  chemically synthesized
gatcatatttcttcttactgta

SEQ ID NO: 656303 - DNA, 22 bp, Artificial Sequence
  chemically synthesized
ccaaacactagatcatatttct

SEQ ID NO: 656304 - DNA, 22 bp, Artificial Sequence
  chemically synthesized
tgctaccaaacactagatcata

SEQ ID NO: 656305 - DNA, 22 bp, Artificial Sequence
  chemically synthesized
ttgtgctaccaaacactagatc

SEQ ID NO: 656306 - DNA, 22 bp, Artificial Sequence
  chemically synthesized
attgtgctaccaaacactagat

SEQ ID NO: 656307 - DNA, 22 bp, Artificial Sequence
  chemically synthesized
tagtggccttattgtgctacca

SEQ ID NO: 656308 - DNA, 22 bp, Artificial Sequence
  chemically synthesized
ctatagtggccttattgtgcta

SEQ ID NO: 656309 - DNA, 22 bp, Artificial Sequence
  chemically synthesized
gtgtttggtagcacaataaggc

SEQ ID NO: 656310 - DNA, 22 bp, Artificial Sequence
  chemically synthesized
attactatagtggccttattgt

SEQ ID NO: 656311 - DNA, 22 bp, Artificial Sequence
  chemically synthesized
ggtagcacaataaggccactat

SEQ ID NO: 656312 - DNA, 22 bp, Artificial Sequence
  chemically synthesized
gtagcacaataaggccactata

SEQ ID NO: 656313 - DNA, 22 bp, Artificial Sequence
  chemically synthesized
aaaatatattgattactatagt

SEQ ID NO: 656314 - DNA, 22 bp, Artificial Sequence
  chemically synthesized
aaaaatatattgattactatag

SEQ ID NO: 656315 - DNA, 22 bp, Artificial Sequence
  chemically synthesized
taaaaagatttaaaaatatatt

SEQ ID NO: 656316 - DNA, 22 bp, Artificial Sequence
  chemically synthesized
tagtaatcaatatatttttaaa

SEQ ID NO: 656317 - DNA, 22 bp, Artificial Sequence
  chemically synthesized
tctgtaaaaagatttaaaaata

SEQ ID NO: 656318 - DNA, 22 bp, Artificial Sequence
  chemically synthesized
ttaaatctttttacagataggg

SEQ ID NO: 656319 - DNA, 22 bp, Artificial Sequence
  chemically synthesized
taaatctttttacagatagggt

SEQ ID NO: 656320 - DNA, 22 bp, Artificial Sequence
  chemically synthesized
aaatctttttacagatagggtc

SEQ ID NO: 656321 - DNA, 22 bp, Artificial Sequence
  chemically synthesized
aatctttttacagatagggtct

SEQ ID NO: 656322 - DNA, 22 bp, Artificial Sequence
  chemically synthesized
tttacagatagggtctcactat

SEQ ID NO: 656323 - DNA, 22 bp, Artificial Sequence
  chemically synthesized
ttacagatagggtctcactatg

SEQ ID NO: 656324 - DNA, 22 bp, Artificial Sequence
  chemically synthesized
caacatggacagcatagtgaga

SEQ ID NO: 656325 - DNA, 22 bp, Artificial Sequence
  chemically synthesized
tacagatagggtctcactatgc

SEQ ID NO: 656326 - DNA, 22 bp, Artificial Sequence
  chemically synthesized
acagatagggtctcactatgct

SEQ ID NO: 656327 - DNA, 22 bp, Artificial Sequence
  chemically synthesized
cagatagggtctcactatgctg

SEQ ID NO: 656328 - DNA, 22 bp, Artificial Sequence
  chemically synthesized
cactccaacatggacagcatag

SEQ ID NO: 656329 - DNA, 22 bp, Artificial Sequence
  chemically synthesized
actatgctgtccatgttggagt

SEQ ID NO: 656330 - DNA, 22 bp, Artificial Sequence
  chemically synthesized
tgaatagtcactacactccaac

SEQ ID NO: 656331 - DNA, 22 bp, Artificial Sequence
  chemically synthesized
tgctgtccatgttggagtgtag

SEQ ID NO: 656332 - DNA, 22 bp, Artificial Sequence
  chemically synthesized
cacctgtgaatagtcactacac

SEQ ID NO: 656333 - DNA, 22 bp, Artificial Sequence
  chemically synthesized
tccatgttggagtgtagtgact

SEQ ID NO: 656334 - DNA, 22 bp, Artificial Sequence
  chemically synthesized
gagtgtagtgactattcacagg

SEQ ID NO: 656335 - DNA, 22 bp, Artificial Sequence
  chemically synthesized
taatgcacaacaattgcacctg

SEQ ID NO: 656336 - DNA, 22 bp, Artificial Sequence
  chemically synthesized
aaggctgtaatgcacaacaatt

SEQ ID NO: 656337 - DNA, 22 bp, Artificial Sequence
  chemically synthesized
ttcacaggtgcaattgttgtgc

SEQ ID NO: 656338 - DNA, 22 bp, Artificial Sequence
  chemically synthesized
acaggtgcaattgttgtgcatt

SEQ ID NO: 656339 - DNA, 22 bp, Artificial Sequence
  chemically synthesized
cgcccaggaattcaaggctgta

SEQ ID NO: 656340 - DNA, 22 bp, Artificial Sequence
  chemically synthesized
gcgcccaggaattcaaggctgt

SEQ ID NO: 656341 - DNA, 22 bp, Artificial Sequence
  chemically synthesized
ttgtgcattacagccttgaatt

SEQ ID NO: 656342 - DNA, 22 bp, Artificial Sequence
  chemically synthesized
tgcattacagccttgaattcct

SEQ ID NO: 656343 - DNA, 22 bp, Artificial Sequence
  chemically synthesized
cagccttgaattcctgggcgca

SEQ ID NO: 656344 - DNA, 22 bp, Artificial Sequence
  chemically synthesized
aggtgggaggatcacttgcgcc

SEQ ID NO: 656345 - DNA, 22 bp, Artificial Sequence
  chemically synthesized
gaattcctgggcgcaagtgatc

SEQ ID NO: 656346 - DNA, 22 bp, Artificial Sequence
  chemically synthesized
aattcctgggcgcaagtgatcc

SEQ ID NO: 656347 - DNA, 22 bp, Artificial Sequence
  chemically synthesized
ctgggcgcaagtgatcctccca

SEQ ID NO: 656348 - DNA, 22 bp, Artificial Sequence
  chemically synthesized
aggaggctgaggtgggaggatc

SEQ ID NO: 656349 - DNA, 22 bp, Artificial Sequence
  chemically synthesized
caggaggctgaggtgggaggat

SEQ ID NO: 656350 - DNA, 22 bp, Artificial Sequence
  chemically synthesized
ggcgcaagtgatcctcccacct

SEQ ID NO: 656351 - DNA, 22 bp, Artificial Sequence
  chemically synthesized
taggaccagcgtttcaggaggc

SEQ ID NO: 656352 - DNA, 22 bp, Artificial Sequence
  chemically synthesized
ccacctcagcctcctgaaacgc

SEQ ID NO: 656353 - DNA, 22 bp, Artificial Sequence
  chemically synthesized
agcctcctgaaacgctggtcct

SEQ ID NO: 656354 - DNA, 22 bp, Artificial Sequence
  chemically synthesized
ctgaaacgctggtcctacaggt

SEQ ID NO: 656355 - DNA, 22 bp, Artificial Sequence
  chemically synthesized
aaacgctggtcctacaggtgcg

SEQ ID NO: 656356 - DNA, 22 bp, Artificial Sequence
  chemically synthesized
ccatgcatggtagcacgcacct

SEQ ID NO: 656357 - DNA, 22 bp, Artificial Sequence
  chemically synthesized
ttgccatgcatggtagcacgca

SEQ ID NO: 656358 - DNA, 22 bp, Artificial Sequence
  chemically synthesized
gtcctacaggtgcgtgctacca

SEQ ID NO: 656359 - DNA, 22 bp, Artificial Sequence
  chemically synthesized
ttgttgccatgcatggtagcac

SEQ ID NO: 656360 - DNA, 22 bp, Artificial Sequence
  chemically synthesized
caggtgcgtgctaccatgcatg

SEQ ID NO: 656361 - DNA, 22 bp, Artificial Sequence
  chemically synthesized
aaatatacaataaattattgtt

SEQ ID NO: 656362 - DNA, 22 bp, Artificial Sequence
  chemically synthesized
ccatgcatggcaacaataattt

SEQ ID NO: 656363 - DNA, 22 bp, Artificial Sequence
  chemically synthesized
gaaatatacaataaattattgt

SEQ ID NO: 656364 - DNA, 22 bp, Artificial Sequence
  chemically synthesized
tgaaatatacaataaattattg

SEQ ID NO: 656365 - DNA, 22 bp, Artificial Sequence
  chemically synthesized
ttttgaaatatacaataaatta

SEQ ID NO: 656366 - DNA, 22 bp, Artificial Sequence
  chemically synthesized
gttattttgaaatatacaataa

SEQ ID NO: 656367 - DNA, 22 bp, Artificial Sequence
  chemically synthesized
agttattttgaaatatacaata

SEQ ID NO: 656368 - DNA, 22 bp, Artificial Sequence
  chemically synthesized
tagttattttgaaatatacaat

SEQ ID NO: 656369 - DNA, 22 bp, Artificial Sequence
  chemically synthesized
ttagttattttgaaatatacaa

SEQ ID NO: 656370 - DNA, 22 bp, Artificial Sequence
  chemically synthesized
ttttagttattttgaaatatac

SEQ ID NO: 656371 - DNA, 22 bp, Artificial Sequence
  chemically synthesized
actcttttagttattttgaaat

SEQ ID NO: 656372 - DNA, 22 bp, Artificial Sequence
  chemically synthesized
cactcttttagttattttgaaa

SEQ ID NO: 656373 - DNA, 22 bp, Artificial Sequence
  chemically synthesized
attgtatatttcaaaataacta

SEQ ID NO: 656374 - DNA, 22 bp, Artificial Sequence
  chemically synthesized
ttgtatatttcaaaataactaa

SEQ ID NO: 656375 - DNA, 22 bp, Artificial Sequence
  chemically synthesized
ccatttcactcttttagttatt

SEQ ID NO: 656376 - DNA, 22 bp, Artificial Sequence
  chemically synthesized
tatatttcaaaataactaaaag

SEQ ID NO: 656377 - DNA, 22 bp, Artificial Sequence
  chemically synthesized
caaaataactaaaagagtgaaa

SEQ ID NO: 656378 - DNA, 22 bp, Artificial Sequence
  chemically synthesized
aaaataactaaaagagtgaaat

SEQ ID NO: 656379 - DNA, 22 bp, Artificial Sequence
  chemically synthesized
gtaggaacattcccatttcact

SEQ ID NO: 656380 - DNA, 22 bp, Artificial Sequence
  chemically synthesized
tggtaggaacattcccatttca

SEQ ID NO: 656381 - DNA, 22 bp, Artificial Sequence
  chemically synthesized
tctggtaggaacattcccattt

SEQ ID NO: 656382 - DNA, 22 bp, Artificial Sequence
  chemically synthesized
ctctggtaggaacattcccatt

SEQ ID NO: 656383 - DNA, 22 bp, Artificial Sequence
  chemically synthesized
aaagagtgaaatgggaatgttc

SEQ ID NO: 656384 - DNA, 22 bp, Artificial Sequence
  chemically synthesized
atcatttctctggtaggaacat

SEQ ID NO: 656385 - DNA, 22 bp, Artificial Sequence
  chemically synthesized
aaacattcatcatttctctggt

SEQ ID NO: 656386 - DNA, 22 bp, Artificial Sequence
  chemically synthesized
ctaccagagaaatgatgaatgt

SEQ ID NO: 656387 - DNA, 22 bp, Artificial Sequence
  chemically synthesized
ccagagaaatgatgaatgtttg

SEQ ID NO: 656388 - DNA, 22 bp, Artificial Sequence
  chemically synthesized
gggtgtccatcatctcaaacat

SEQ ID NO: 656389 - DNA, 22 bp, Artificial Sequence
  chemically synthesized
gagatgatggacaccccaatta

SEQ ID NO: 656390 - DNA, 22 bp, Artificial Sequence
  chemically synthesized
agatgatggacaccccaattac

SEQ ID NO: 656391 - DNA, 22 bp, Artificial Sequence
  chemically synthesized
ctctgattgtgttaccctacac

SEQ ID NO: 656392 - DNA, 22 bp, Artificial Sequence
  chemically synthesized
tgattgtgttaccctacacatt

SEQ ID NO: 656393 - DNA, 22 bp, Artificial Sequence
  chemically synthesized
atacaagcatacaatgtgtagg

SEQ ID NO: 656394 - DNA, 22 bp, Artificial Sequence
  chemically synthesized
gatacaagcatacaatgtgtag

SEQ ID NO: 656395 - DNA, 22 bp, Artificial Sequence
  chemically synthesized
attgtgttaccctacacattgt

SEQ ID NO: 656396 - DNA, 22 bp, Artificial Sequence
  chemically synthesized
tgatacaagcatacaatgtgta

SEQ ID NO: 656397 - DNA, 22 bp, Artificial Sequence
  chemically synthesized
tgttaccctacacattgtatgc

SEQ ID NO: 656398 - DNA, 22 bp, Artificial Sequence
  chemically synthesized
ccctacacattgtatgcttgta

SEQ ID NO: 656399 - DNA, 22 bp, Artificial Sequence
  chemically synthesized
catgtgatattttgatacaagc

SEQ ID NO: 656400 - DNA, 22 bp, Artificial Sequence
  chemically synthesized
cacattgtatgcttgtatcaaa

SEQ ID NO: 656401 - DNA, 22 bp, Artificial Sequence
  chemically synthesized
tgggttacatgtgatattttga

SEQ ID NO: 656402 - DNA, 22 bp, Artificial Sequence
  chemically synthesized
atgggttacatgtgatattttg

SEQ ID NO: 656403 - DNA, 22 bp, Artificial Sequence
  chemically synthesized
tatgcttgtatcaaaatatcac

SEQ ID NO: 656404 - DNA, 22 bp, Artificial Sequence
  chemically synthesized
atttatgggttacatgtgatat

SEQ ID NO: 656405 - DNA, 22 bp, Artificial Sequence
  chemically synthesized
gtatcaaaatatcacatgtaac

SEQ ID NO: 656406 - DNA, 22 bp, Artificial Sequence
  chemically synthesized
tatcaaaatatcacatgtaacc

SEQ ID NO: 656407 - DNA, 22 bp, Artificial Sequence
  chemically synthesized
tggacacataatagtactcatt

SEQ ID NO: 656408 - DNA, 22 bp, Artificial Sequence
  chemically synthesized
ttatggacacataatagtactc

SEQ ID NO: 656409 - DNA, 22 bp, Artificial Sequence
  chemically synthesized
attattatggacacataatagt

SEQ ID NO: 656410 - DNA, 22 bp, Artificial Sequence
  chemically synthesized
aattattatggacacataatag

SEQ ID NO: 656411 - DNA, 22 bp, Artificial Sequence
  chemically synthesized
taattattatggacacataata

SEQ ID NO: 656412 - DNA, 22 bp, Artificial Sequence
  chemically synthesized
ttaattattatggacacataat

SEQ ID NO: 656413 - DNA, 22 bp, Artificial Sequence
  chemically synthesized
aaatatttttaattattatgga

SEQ ID NO: 656414 - DNA, 22 bp, Artificial Sequence
  chemically synthesized
aaaatatttttaattattatgg

SEQ ID NO: 656415 - DNA, 22 bp, Artificial Sequence
  chemically synthesized
taaaatatttttaattattatg

SEQ ID NO: 656416 - DNA, 22 bp, Artificial Sequence
  chemically synthesized
ttatgtgtccataataattaaa

SEQ ID NO: 656417 - DNA, 22 bp, Artificial Sequence
  chemically synthesized
tgtgtccataataattaaaaat

SEQ ID NO: 656418 - DNA, 22 bp, Artificial Sequence
  chemically synthesized
acaggtaaaaaagtatgtttta

SEQ ID NO: 656419 - DNA, 22 bp, Artificial Sequence
  chemically synthesized
aacaggtaaaaaagtatgtttt

SEQ ID NO: 656420 - DNA, 22 bp, Artificial Sequence
  chemically synthesized
aaaatattttaaaacatacttt

SEQ ID NO: 656421 - DNA, 22 bp, Artificial Sequence
  chemically synthesized
ccagtcatttaacaggtaaaaa

SEQ ID NO: 656422 - DNA, 22 bp, Artificial Sequence
  chemically synthesized
taaaacatacttttttacctgt

SEQ ID NO: 656423 - DNA, 22 bp, Artificial Sequence
  chemically synthesized
aaaacatacttttttacctgtt

SEQ ID NO: 656424 - DNA, 22 bp, Artificial Sequence
  chemically synthesized
aaacatacttttttacctgtta

SEQ ID NO: 656425 - DNA, 22 bp, Artificial Sequence
  chemically synthesized
cactgccagtcatttaacaggt

SEQ ID NO: 656426 - DNA, 22 bp, Artificial Sequence
  chemically synthesized
ttttacctgttaaatgactggc

SEQ ID NO: 656427 - DNA, 22 bp, Artificial Sequence
  chemically synthesized
tttacctgttaaatgactggca

SEQ ID NO: 656428 - DNA, 22 bp, Artificial Sequence
  chemically synthesized
acaaacctgcactgccagtcat

SEQ ID NO: 656429 - DNA, 22 bp, Artificial Sequence
  chemically synthesized
ttacctgttaaatgactggcag

SEQ ID NO: 656430 - DNA, 22 bp, Artificial Sequence
  chemically synthesized
cacaaacctgcactgccagtca

SEQ ID NO: 656431 - DNA, 22 bp, Artificial Sequence
  chemically synthesized
tacctgttaaatgactggcagt

SEQ ID NO: 656432 - DNA, 22 bp, Artificial Sequence
  chemically synthesized
acctgttaaatgactggcagtg

SEQ ID NO: 656433 - DNA, 22 bp, Artificial Sequence
  chemically synthesized
cctgttaaatgactggcagtgc

SEQ ID NO: 656434 - DNA, 22 bp, Artificial Sequence
  chemically synthesized
tttcacaaacctgcactgccag

SEQ ID NO: 656435 - DNA, 22 bp, Artificial Sequence
  chemically synthesized
ttaaatgactggcagtgcaggt

SEQ ID NO: 656436 - DNA, 22 bp, Artificial Sequence
  chemically synthesized
aatgactggcagtgcaggtttg

SEQ ID NO: 656437 - DNA, 22 bp, Artificial Sequence
  chemically synthesized
gcagtgcaggtttgtgaaataa

SEQ ID NO: 656438 - DNA, 22 bp, Artificial Sequence
  chemically synthesized
taacatcatagcacgaagaatt

SEQ ID NO: 656439 - DNA, 22 bp, Artificial Sequence
  chemically synthesized
gtgaaataattcttcgtgctat

SEQ ID NO: 656440 - DNA, 22 bp, Artificial Sequence
  chemically synthesized
tgaaataattcttcgtgctatg

SEQ ID NO: 656441 - DNA, 22 bp, Artificial Sequence
  chemically synthesized
tagccattgtaacatcatagca

SEQ ID NO: 656442 - DNA, 22 bp, Artificial Sequence
  chemically synthesized
ttcgtgctatgatgttacaatg

SEQ ID NO: 656443 - DNA, 22 bp, Artificial Sequence
  chemically synthesized
tgacactgtagccattgtaaca

SEQ ID NO: 656444 - DNA, 22 bp, Artificial Sequence
  chemically synthesized
gtgacactgtagccattgtaac

SEQ ID NO: 656445 - DNA, 22 bp, Artificial Sequence
  chemically synthesized
cgtgctatgatgttacaatggc

SEQ ID NO: 656446 - DNA, 22 bp, Artificial Sequence
  chemically synthesized
tgtgacactgtagccattgtaa

SEQ ID NO: 656447 - DNA, 22 bp, Artificial Sequence
  chemically synthesized
gtgctatgatgttacaatggct

SEQ ID NO: 656448 - DNA, 22 bp, Artificial Sequence
  chemically synthesized
ctttgtgacactgtagccattg

SEQ ID NO: 656449 - DNA, 22 bp, Artificial Sequence
  chemically synthesized
tgatgttacaatggctacagtg

SEQ ID NO: 656450 - DNA, 22 bp, Artificial Sequence
  chemically synthesized
gcattactttgtgacactgtag

SEQ ID NO: 656451 - DNA, 22 bp, Artificial Sequence
  chemically synthesized
caatggctacagtgtcacaaag

SEQ ID NO: 656452 - DNA, 22 bp, Artificial Sequence
  chemically synthesized
aaaaattcgcattactttgtga

SEQ ID NO: 656453 - DNA, 22 bp, Artificial Sequence
  chemically synthesized
cagtgtcacaaagtaatgcgaa

SEQ ID NO: 656454 - DNA, 22 bp, Artificial Sequence
  chemically synthesized
taatggaactgaaaaattcgca

SEQ ID NO: 656455 - DNA, 22 bp, Artificial Sequence
  chemically synthesized
ttcagttccattataatctctt

SEQ ID NO: 656456 - DNA, 22 bp, Artificial Sequence
  chemically synthesized
tcagttccattataatctcttc

SEQ ID NO: 656457 - DNA, 22 bp, Artificial Sequence
  chemically synthesized
cagttccattataatctcttct

SEQ ID NO: 656458 - DNA, 22 bp, Artificial Sequence
  chemically synthesized
agttccattataatctcttctt

SEQ ID NO: 656459 - DNA, 22 bp, Artificial Sequence
  chemically synthesized
cattataatctcttcttacgtt

SEQ ID NO: 656460 - DNA, 22 bp, Artificial Sequence
  chemically synthesized
taatctcttcttacgttgatct

SEQ ID NO: 656461 - DNA, 22 bp, Artificial Sequence
  chemically synthesized
tggtggtcccataagatcaacg

SEQ ID NO: 656462 - DNA, 22 bp, Artificial Sequence
  chemically synthesized
ttcttacgttgatcttatggga

SEQ ID NO: 656463 - DNA, 22 bp, Artificial Sequence
  chemically synthesized
cttacgttgatcttatgggacc

SEQ ID NO: 656464 - DNA, 22 bp, Artificial Sequence
  chemically synthesized
ttacgttgatcttatgggacca

SEQ ID NO: 656465 - DNA, 22 bp, Artificial Sequence
  chemically synthesized
acgttgatcttatgggaccacc

SEQ ID NO: 656466 - DNA, 22 bp, Artificial Sequence
  chemically synthesized
cgttgatcttatgggaccacca

SEQ ID NO: 656467 - DNA, 22 bp, Artificial Sequence
  chemically synthesized
atcttatgggaccaccatagta

SEQ ID NO: 656468 - DNA, 22 bp, Artificial Sequence
  chemically synthesized
atgggaccaccatagtatatat

SEQ ID NO: 656469 - DNA, 22 bp, Artificial Sequence
  chemically synthesized
tgggaccaccatagtatatatg

SEQ ID NO: 656470 - DNA, 22 bp, Artificial Sequence
  chemically synthesized
gtcaatgacaggccatatatac

SEQ ID NO: 656471 - DNA, 22 bp, Artificial Sequence
  chemically synthesized
ggtcaatgacaggccatatata

SEQ ID NO: 656472 - DNA, 22 bp, Artificial Sequence
  chemically synthesized
tggtcaatgacaggccatatat

SEQ ID NO: 656473 - DNA, 22 bp, Artificial Sequence
  chemically synthesized
aagaatgacgttttggtcaatg

SEQ ID NO: 656474 - DNA, 22 bp, Artificial Sequence
  chemically synthesized
tcattgaccaaaacgtcattct

SEQ ID NO: 656475 - DNA, 22 bp, Artificial Sequence
  chemically synthesized
tacagtcatgtgctgaagaatg

SEQ ID NO: 656476 - DNA, 22 bp, Artificial Sequence
  chemically synthesized
accaaaacgtcattcttcagca

SEQ ID NO: 656477 - DNA, 22 bp, Artificial Sequence
  chemically synthesized
ggtgggaaaactatacagtcat

SEQ ID NO: 656478 - DNA, 22 bp, Artificial Sequence
  chemically synthesized
aggtgggaaaactatacagtca

SEQ ID NO: 656479 - DNA, 22 bp, Artificial Sequence
  chemically synthesized
taggtgggaaaactatacagtc

SEQ ID NO: 656480 - DNA, 22 bp, Artificial Sequence
  chemically synthesized
ttaggtgggaaaactatacagt

SEQ ID NO: 656481 - DNA, 22 bp, Artificial Sequence
  chemically synthesized
ttcagcacatgactgtatagtt

SEQ ID NO: 656482 - DNA, 22 bp, Artificial Sequence
  chemically synthesized
cagcacatgactgtatagtttt

SEQ ID NO: 656483 - DNA, 22 bp, Artificial Sequence
  chemically synthesized
agcacatgactgtatagttttc

SEQ ID NO: 656484 - DNA, 22 bp, Artificial Sequence
  chemically synthesized
tatagttttcccacctaaaagt

SEQ ID NO: 656485 - DNA, 22 bp, Artificial Sequence
  chemically synthesized
agataaaaccaagtatcacttt

SEQ ID NO: 656486 - DNA, 22 bp, Artificial Sequence
  chemically synthesized
cagataaaaccaagtatcactt

SEQ ID NO: 656487 - DNA, 22 bp, Artificial Sequence
  chemically synthesized
tcccacctaaaagtgatacttg

SEQ ID NO: 656488 - DNA, 22 bp, Artificial Sequence
  chemically synthesized
cccacctaaaagtgatacttgg

SEQ ID NO: 656489 - DNA, 22 bp, Artificial Sequence
  chemically synthesized
ccacctaaaagtgatacttggt

SEQ ID NO: 656490 - DNA, 22 bp, Artificial Sequence
  chemically synthesized
tcttcagataaaaccaagtatc

SEQ ID NO: 656491 - DNA, 22 bp, Artificial Sequence
  chemically synthesized
gtctatcttcagataaaaccaa

SEQ ID NO: 656492 - DNA, 22 bp, Artificial Sequence
  chemically synthesized
agtctatcttcagataaaacca

SEQ ID NO: 656493 - DNA, 22 bp, Artificial Sequence
  chemically synthesized
aaagtgatacttggttttatct

SEQ ID NO: 656494 - DNA, 22 bp, Artificial Sequence
  chemically synthesized
tttagtctatcttcagataaaa

SEQ ID NO: 656495 - DNA, 22 bp, Artificial Sequence
  chemically synthesized
ggttttatctgaagatagacta

SEQ ID NO: 656496 - DNA, 22 bp, Artificial Sequence
  chemically synthesized
gttttatctgaagatagactaa

SEQ ID NO: 656497 - DNA, 22 bp, Artificial Sequence
  chemically synthesized
tatctgaagatagactaaacag

SEQ ID NO: 656498 - DNA, 22 bp, Artificial Sequence
  chemically synthesized
atcccaacatagctgtttagtc

SEQ ID NO: 656499 - DNA, 22 bp, Artificial Sequence
  chemically synthesized
atctgaagatagactaaacagc

SEQ ID NO: 656500 - DNA, 22 bp, Artificial Sequence
  chemically synthesized
tctgaagatagactaaacagct

SEQ ID NO: 656501 - DNA, 22 bp, Artificial Sequence
  chemically synthesized
taatcccaacatagctgtttag

SEQ ID NO: 656502 - DNA, 22 bp, Artificial Sequence
  chemically synthesized
aagatagactaaacagctatgt

SEQ ID NO: 656503 - DNA, 22 bp, Artificial Sequence
  chemically synthesized
aaaatactctaatcccaacata

SEQ ID NO: 656504 - DNA, 22 bp, Artificial Sequence
  chemically synthesized
ttgaaaatactctaatcccaac

SEQ ID NO: 656505 - DNA, 22 bp, Artificial Sequence
  chemically synthesized
attgaaaatactctaatcccaa

SEQ ID NO: 656506 - DNA, 22 bp, Artificial Sequence
  chemically synthesized
tattgaaaatactctaatccca

SEQ ID NO: 656507 - DNA, 22 bp, Artificial Sequence
  chemically synthesized
aacagctatgttgggattagag

SEQ ID NO: 656508 - DNA, 22 bp, Artificial Sequence
  chemically synthesized
tgttgggattagagtattttca

SEQ ID NO: 656509 - DNA, 22 bp, Artificial Sequence
  chemically synthesized
ggattagagtattttcaataaa

SEQ ID NO: 656510 - DNA, 22 bp, Artificial Sequence
  chemically synthesized
gagtattttcaataaagatggg

SEQ ID NO: 656511 - DNA, 22 bp, Artificial Sequence
  chemically synthesized
tcaataaagatgggtgtgtgtg

SEQ ID NO: 656512 - DNA, 22 bp, Artificial Sequence
  chemically synthesized
caataaagatgggtgtgtgtgc

SEQ ID NO: 656513 - DNA, 22 bp, Artificial Sequence
  chemically synthesized
aataaagatgggtgtgtgtgca

SEQ ID NO: 656514 - DNA, 22 bp, Artificial Sequence
  chemically synthesized
ccccaaaacacatacatgcaca

SEQ ID NO: 656515 - DNA, 22 bp, Artificial Sequence
  chemically synthesized
tgggggaggggtgtttatttat

SEQ ID NO: 656516 - DNA, 22 bp, Artificial Sequence
  chemically synthesized
gggggaggggtgtttatttatc

SEQ ID NO: 656517 - DNA, 22 bp, Artificial Sequence
  chemically synthesized
ggggaggggtgtttatttatct

SEQ ID NO: 656518 - DNA, 22 bp, Artificial Sequence
  chemically synthesized
taatagaatgagatagataaat

SEQ ID NO: 656519 - DNA, 22 bp, Artificial Sequence
  chemically synthesized
gattgtaatagaatgagataga

SEQ ID NO: 656520 - DNA, 22 bp, Artificial Sequence
  chemically synthesized
agattgtaatagaatgagatag

SEQ ID NO: 656521 - DNA, 22 bp, Artificial Sequence
  chemically synthesized
tagattgtaatagaatgagata

SEQ ID NO: 656522 - DNA, 22 bp, Artificial Sequence
  chemically synthesized
atttatctatctcattctatta

SEQ ID NO: 656523 - DNA, 22 bp, Artificial Sequence
  chemically synthesized
tttatctatctcattctattac

SEQ ID NO: 656524 - DNA, 22 bp, Artificial Sequence
  chemically synthesized
atctatctcattctattacaat

SEQ ID NO: 656525 - DNA, 22 bp, Artificial Sequence
  chemically synthesized
tatgaattttagattgtaatag

SEQ ID NO: 656526 - DNA, 22 bp, Artificial Sequence
  chemically synthesized
tctatctcattctattacaatc

SEQ ID NO: 656527 - DNA, 22 bp, Artificial Sequence
  chemically synthesized
tctcattctattacaatctaaa

SEQ ID NO: 656528 - DNA, 22 bp, Artificial Sequence
  chemically synthesized
attctattacaatctaaaattc

SEQ ID NO: 656529 - DNA, 22 bp, Artificial Sequence
  chemically synthesized
tattacaatctaaaattcatat

SEQ ID NO: 656530 - DNA, 22 bp, Artificial Sequence
  chemically synthesized
ttacaatctaaaattcatatag

SEQ ID NO: 656531 - DNA, 22 bp, Artificial Sequence
  chemically synthesized
caatctaaaattcatatagggg

SEQ ID NO: 656532 - DNA, 22 bp, Artificial Sequence
  chemically synthesized
atgtgtcaatgtgatcccctat

SEQ ID NO: 656533 - DNA, 22 bp, Artificial Sequence
  chemically synthesized
aaattcatataggggatcacat

SEQ ID NO: 656534 - DNA, 22 bp, Artificial Sequence
  chemically synthesized
atataggggatcacattgacac

SEQ ID NO: 656535 - DNA, 22 bp, Artificial Sequence
  chemically synthesized
aaatgacagagtgttaatgtgt

SEQ ID NO: 656536 - DNA, 22 bp, Artificial Sequence
  chemically synthesized
gattgaaatgacagagtgttaa

SEQ ID NO: 656537 - DNA, 22 bp, Artificial Sequence
  chemically synthesized
acacattaacactctgtcattt

SEQ ID NO: 656538 - DNA, 22 bp, Artificial Sequence
  chemically synthesized
ggagactagattgaaatgacag

SEQ ID NO: 656539 - DNA, 22 bp, Artificial Sequence
  chemically synthesized
acactctgtcatttcaatctag

SEQ ID NO: 656540 - DNA, 22 bp, Artificial Sequence
  chemically synthesized
aaccagttcggagactagattg

SEQ ID NO: 656541 - DNA, 22 bp, Artificial Sequence
  chemically synthesized
caaccagttcggagactagatt

SEQ ID NO: 656542 - DNA, 22 bp, Artificial Sequence
  chemically synthesized
tgtcatttcaatctagtctccg

SEQ ID NO: 656543 - DNA, 22 bp, Artificial Sequence
  chemically synthesized
tcatttcaatctagtctccgaa

SEQ ID NO: 656544 - DNA, 22 bp, Artificial Sequence
  chemically synthesized
tggcttcaaccagttcggagac

SEQ ID NO: 656545 - DNA, 22 bp, Artificial Sequence
  chemically synthesized
caatctagtctccgaactggtt

SEQ ID NO: 656546 - DNA, 22 bp, Artificial Sequence
  chemically synthesized
aatctagtctccgaactggttg

SEQ ID NO: 656547 - DNA, 22 bp, Artificial Sequence
  chemically synthesized
catcatgttatggcttcaacca

SEQ ID NO: 656548 - DNA, 22 bp, Artificial Sequence
  chemically synthesized
acatcatgttatggcttcaacc

SEQ ID NO: 656549 - DNA, 22 bp, Artificial Sequence
  chemically synthesized
gtctccgaactggttgaagcca

SEQ ID NO: 656550 - DNA, 22 bp, Artificial Sequence
  chemically synthesized
cgaactggttgaagccataaca

SEQ ID NO: 656551 - DNA, 22 bp, Artificial Sequence
  chemically synthesized
gttgaagccataacatgatgta

SEQ ID NO: 656552 - DNA, 22 bp, Artificial Sequence
  chemically synthesized
catcgtgcaatttacatcatgt

SEQ ID NO: 656553 - DNA, 22 bp, Artificial Sequence
  chemically synthesized
aagccataacatgatgtaaatt

SEQ ID NO: 656554 - DNA, 22 bp, Artificial Sequence
  chemically synthesized
gtctacatcgtgcaatttacat

SEQ ID NO: 656555 - DNA, 22 bp, Artificial Sequence
  chemically synthesized
cacgatgtagactagattcatt

SEQ ID NO: 656556 - DNA, 22 bp, Artificial Sequence
  chemically synthesized
gattcattgtgccactgtgggc

SEQ ID NO: 656557 - DNA, 22 bp, Artificial Sequence
  chemically synthesized
agatgagaaaacaggcccacag

SEQ ID NO: 656558 - DNA, 22 bp, Artificial Sequence
  chemically synthesized
cagatgagaaaacaggcccaca

SEQ ID NO: 656559 - DNA, 22 bp, Artificial Sequence
  chemically synthesized
tcagatgagaaaacaggcccac

SEQ ID NO: 656560 - DNA, 22 bp, Artificial Sequence
  chemically synthesized
attgtgccactgtgggcctgtt

SEQ ID NO: 656561 - DNA, 22 bp, Artificial Sequence
  chemically synthesized
ttcagatgagaaaacaggccca

SEQ ID NO: 656562 - DNA, 22 bp, Artificial Sequence
  chemically synthesized
tttcagatgagaaaacaggccc

SEQ ID NO: 656563 - DNA, 22 bp, Artificial Sequence
  chemically synthesized
tgccactgtgggcctgttttct

SEQ ID NO: 656564 - DNA, 22 bp, Artificial Sequence
  chemically synthesized
ctttttcagatgagaaaacagg

SEQ ID NO: 656565 - DNA, 22 bp, Artificial Sequence
  chemically synthesized
tcctttttcagatgagaaaaca

SEQ ID NO: 656566 - DNA, 22 bp, Artificial Sequence
  chemically synthesized
tgggcctgttttctcatctgaa

SEQ ID NO: 656567 - DNA, 22 bp, Artificial Sequence
  chemically synthesized
cacctctcctttttcagatgag

SEQ ID NO: 656568 - DNA, 22 bp, Artificial Sequence
  chemically synthesized
tgcacctctcctttttcagatg

SEQ ID NO: 656569 - DNA, 22 bp, Artificial Sequence
  chemically synthesized
ctgcacctctcctttttcagat

SEQ ID NO: 656570 - DNA, 22 bp, Artificial Sequence
  chemically synthesized
tctgcacctctcctttttcaga

SEQ ID NO: 656571 - DNA, 22 bp, Artificial Sequence
  chemically synthesized
ttttctcatctgaaaaaggaga

SEQ ID NO: 656572 - DNA, 22 bp, Artificial Sequence
  chemically synthesized
tctcatctgaaaaaggagaggt

SEQ ID NO: 656573 - DNA, 22 bp, Artificial Sequence
  chemically synthesized
aggattttctgcacctctcctt

SEQ ID NO: 656574 - DNA, 22 bp, Artificial Sequence
  chemically synthesized
ctcatctgaaaaaggagaggtg

SEQ ID NO: 656575 - DNA, 22 bp, Artificial Sequence
  chemically synthesized
gaggattttctgcacctctcct

SEQ ID NO: 656576 - DNA, 22 bp, Artificial Sequence
  chemically synthesized
tcatctgaaaaaggagaggtgc

SEQ ID NO: 656577 - DNA, 22 bp, Artificial Sequence
  chemically synthesized
atctgaaaaaggagaggtgcag

SEQ ID NO: 656578 - DNA, 22 bp, Artificial Sequence
  chemically synthesized
aaaaaggagaggtgcagaaaat

SEQ ID NO: 656579 - DNA, 22 bp, Artificial Sequence
  chemically synthesized
aaggaaccttgaggattttctg

SEQ ID NO: 656580 - DNA, 22 bp, Artificial Sequence
  chemically synthesized
cctgaaggaaccttgaggattt

SEQ ID NO: 656581 - DNA, 22 bp, Artificial Sequence
  chemically synthesized
aaggttccttcaggcagtctat

SEQ ID NO: 656582 - DNA, 22 bp, Artificial Sequence
  chemically synthesized
gcagtgagtcacatagactgcc

SEQ ID NO: 656583 - DNA, 22 bp, Artificial Sequence
  chemically synthesized
ccctggcagtgagtcacataga

SEQ ID NO: 656584 - DNA, 22 bp, Artificial Sequence
  chemically synthesized
cttcaggcagtctatgtgactc

SEQ ID NO: 656585 - DNA, 22 bp, Artificial Sequence
  chemically synthesized
caggcagtctatgtgactcact

SEQ ID NO: 656586 - DNA, 22 bp, Artificial Sequence
  chemically synthesized
aggcagtctatgtgactcactg

SEQ ID NO: 656587 - DNA, 22 bp, Artificial Sequence
  chemically synthesized
gtaaggccaagcctgccctggc

SEQ ID NO: 656588 - DNA, 22 bp, Artificial Sequence
  chemically synthesized
tgtgactcactgccagggcagg

SEQ ID NO: 656589 - DNA, 22 bp, Artificial Sequence
  chemically synthesized
agtaaggccaagcctgccctgg

SEQ ID NO: 656590 - DNA, 22 bp, Artificial Sequence
  chemically synthesized
cgaccttagtaaggccaagcct

SEQ ID NO: 656591 - DNA, 22 bp, Artificial Sequence
  chemically synthesized
actgccagggcaggcttggcct

SEQ ID NO: 656592 - DNA, 22 bp, Artificial Sequence
  chemically synthesized
acgaccttagtaaggccaagcc

SEQ ID NO: 656593 - DNA, 22 bp, Artificial Sequence
  chemically synthesized
tacgaccttagtaaggccaagc

SEQ ID NO: 656594 - DNA, 22 bp, Artificial Sequence
  chemically synthesized
ttacgaccttagtaaggccaag

SEQ ID NO: 656595 - DNA, 22 bp, Artificial Sequence
  chemically synthesized
ccagggcaggcttggccttact

SEQ ID NO: 656596 - DNA, 22 bp, Artificial Sequence
  chemically synthesized
atttttacgaccttagtaaggc

SEQ ID NO: 656597 - DNA, 22 bp, Artificial Sequence
  chemically synthesized
gattgatttttacgaccttagt

SEQ ID NO: 656598 - DNA, 22 bp, Artificial Sequence
  chemically synthesized
ggccttactaaggtcgtaaaaa

SEQ ID NO: 656599 - DNA, 22 bp, Artificial Sequence
  chemically synthesized
gccttactaaggtcgtaaaaat

SEQ ID NO: 656600 - DNA, 22 bp, Artificial Sequence
  chemically synthesized
agagattagattgatttttacg

SEQ ID NO: 656601 - DNA, 22 bp, Artificial Sequence
  chemically synthesized
ttgagagattagattgattttt

SEQ ID NO: 656602 - DNA, 22 bp, Artificial Sequence
  chemically synthesized
actaaggtcgtaaaaatcaatc

SEQ ID NO: 656603 - DNA, 22 bp, Artificial Sequence
  chemically synthesized
ctaaggtcgtaaaaatcaatct

SEQ ID NO: 656604 - DNA, 22 bp, Artificial Sequence
  chemically synthesized
aggtcgtaaaaatcaatctaat

SEQ ID NO: 656605 - DNA, 22 bp, Artificial Sequence
  chemically synthesized
catggaaacagccctgttgaga

SEQ ID NO: 656606 - DNA, 22 bp, Artificial Sequence
  chemically synthesized
atattccatggaaacagccctg

SEQ ID NO: 656607 - DNA, 22 bp, Artificial Sequence
  chemically synthesized
tcatattccatggaaacagccc

SEQ ID NO: 656608 - DNA, 22 bp, Artificial Sequence
  chemically synthesized
atctctcaacagggctgtttcc

SEQ ID NO: 656609 - DNA, 22 bp, Artificial Sequence
  chemically synthesized
ctcatattccatggaaacagcc

SEQ ID NO: 656610 - DNA, 22 bp, Artificial Sequence
  chemically synthesized
tctcatattccatggaaacagc

SEQ ID NO: 656611 - DNA, 22 bp, Artificial Sequence
  chemically synthesized
ctttctcatattccatggaaac

SEQ ID NO: 656612 - DNA, 22 bp, Artificial Sequence
  chemically synthesized
tcaacagggctgtttccatgga

SEQ ID NO: 656613 - DNA, 22 bp, Artificial Sequence
  chemically synthesized
aacagggctgtttccatggaat

SEQ ID NO: 656614 - DNA, 22 bp, Artificial Sequence
  chemically synthesized
ttcctttctcatattccatgga

SEQ ID NO: 656615 - DNA, 22 bp, Artificial Sequence
  chemically synthesized
gttcctttctcatattccatgg

SEQ ID NO: 656616 - DNA, 22 bp, Artificial Sequence
  chemically synthesized
ccagcttgttcctttctcatat

SEQ ID NO: 656617 - DNA, 22 bp, Artificial Sequence
  chemically synthesized
tttccatggaatatgagaaagg

SEQ ID NO: 656618 - DNA, 22 bp, Artificial Sequence
  chemically synthesized
ccatggaatatgagaaaggaac

SEQ ID NO: 656619 - DNA, 22 bp, Artificial Sequence
  chemically synthesized
catggaatatgagaaaggaaca

SEQ ID NO: 656620 - DNA, 22 bp, Artificial Sequence
  chemically synthesized
atatattgccagcttgttcctt

SEQ ID NO: 656621 - DNA, 22 bp, Artificial Sequence
  chemically synthesized
taattaatatattgccagcttg

SEQ ID NO: 656622 - DNA, 22 bp, Artificial Sequence
  chemically synthesized
agagatacagctgtaattaata

SEQ ID NO: 656623 - DNA, 22 bp, Artificial Sequence
  chemically synthesized
aagagatacagctgtaattaat

SEQ ID NO: 656624 - DNA, 22 bp, Artificial Sequence
  chemically synthesized
gcaatatattaattacagctgt

SEQ ID NO: 656625 - DNA, 22 bp, Artificial Sequence
  chemically synthesized
caacgagtttaagagatacagc

SEQ ID NO: 656626 - DNA, 22 bp, Artificial Sequence
  chemically synthesized
gcaacgagtttaagagatacag

SEQ ID NO: 656627 - DNA, 22 bp, Artificial Sequence
  chemically synthesized
tgcaacgagtttaagagataca

SEQ ID NO: 656628 - DNA, 22 bp, Artificial Sequence
  chemically synthesized
attacagctgtatctcttaaac

SEQ ID NO: 656629 - DNA, 22 bp, Artificial Sequence
  chemically synthesized
cagctgtatctcttaaactcgt

SEQ ID NO: 656630 - DNA, 22 bp, Artificial Sequence
  chemically synthesized
tatctcttaaactcgttgcaaa

SEQ ID NO: 656631 - DNA, 22 bp, Artificial Sequence
  chemically synthesized
ttaaactcgttgcaaaacttta

SEQ ID NO: 656632 - DNA, 22 bp, Artificial Sequence
  chemically synthesized
gtagtgatagaagtaaagtttt

SEQ ID NO: 656633 - DNA, 22 bp, Artificial Sequence
  chemically synthesized
aaactcgttgcaaaactttact

SEQ ID NO: 656634 - DNA, 22 bp, Artificial Sequence
  chemically synthesized
ggtagtgatagaagtaaagttt

SEQ ID NO: 656635 - DNA, 22 bp, Artificial Sequence
  chemically synthesized
aactcgttgcaaaactttactt

SEQ ID NO: 656636 - DNA, 22 bp, Artificial Sequence
  chemically synthesized
tggtagtgatagaagtaaagtt

SEQ ID NO: 656637 - DNA, 22 bp, Artificial Sequence
  chemically synthesized
attttggtagtgatagaagtaa

SEQ ID NO: 656638 - DNA, 22 bp, Artificial Sequence
  chemically synthesized
gttgcaaaactttacttctatc

SEQ ID NO: 656639 - DNA, 22 bp, Artificial Sequence
  chemically synthesized
actcattttggtagtgatagaa

SEQ ID NO: 656640 - DNA, 22 bp, Artificial Sequence
  chemically synthesized
caaaactttacttctatcacta

SEQ ID NO: 656641 - DNA, 22 bp, Artificial Sequence
  chemically synthesized
ggaaattgactcattttggtag

SEQ ID NO: 656642 - DNA, 22 bp, Artificial Sequence
  chemically synthesized
tacttctatcactaccaaaatg

SEQ ID NO: 656643 - DNA, 22 bp, Artificial Sequence
  chemically synthesized
acttctatcactaccaaaatga

SEQ ID NO: 656644 - DNA, 22 bp, Artificial Sequence
  chemically synthesized
cttctatcactaccaaaatgag

SEQ ID NO: 656645 - DNA, 22 bp, Artificial Sequence
  chemically synthesized
ctgggaaattgactcattttgg

SEQ ID NO: 656646 - DNA, 22 bp, Artificial Sequence
  chemically synthesized
actgggaaattgactcattttg

SEQ ID NO: 656647 - DNA, 22 bp, Artificial Sequence
  chemically synthesized
ctatcactaccaaaatgagtca

SEQ ID NO: 656648 - DNA, 22 bp, Artificial Sequence
  chemically synthesized
tatcactaccaaaatgagtcaa

SEQ ID NO: 656649 - DNA, 22 bp, Artificial Sequence
  chemically synthesized
tcactaccaaaatgagtcaatt

SEQ ID NO: 656650 - DNA, 22 bp, Artificial Sequence
  chemically synthesized
ccaaaatgagtcaatttcccag

SEQ ID NO: 656651 - DNA, 22 bp, Artificial Sequence
  chemically synthesized
cagtcaacacatttactgggaa

SEQ ID NO: 656652 - DNA, 22 bp, Artificial Sequence
  chemically synthesized
atagcatattgcagtcaacaca

SEQ ID NO: 656653 - DNA, 22 bp, Artificial Sequence
  chemically synthesized
cccagtaaatgtgttgactgca

SEQ ID NO: 656654 - DNA, 22 bp, Artificial Sequence
  chemically synthesized
ccagtaaatgtgttgactgcaa

SEQ ID NO: 656655 - DNA, 22 bp, Artificial Sequence
  chemically synthesized
cacattaatagcatattgcagt

SEQ ID NO: 656656 - DNA, 22 bp, Artificial Sequence
  chemically synthesized
ccacattaatagcatattgcag

SEQ ID NO: 656657 - DNA, 22 bp, Artificial Sequence
  chemically synthesized
actgcaatatgctattaatgtg

SEQ ID NO: 656658 - DNA, 22 bp, Artificial Sequence
  chemically synthesized
caatatgctattaatgtggaaa

SEQ ID NO: 656659 - DNA, 22 bp, Artificial Sequence
  chemically synthesized
aatgaggcaacaggatatgttt

SEQ ID NO: 656660 - DNA, 22 bp, Artificial Sequence
  chemically synthesized
ttaatgtggaaacatatcctgt

SEQ ID NO: 656661 - DNA, 22 bp, Artificial Sequence
  chemically synthesized
atgtggaaacatatcctgttgc

SEQ ID NO: 656662 - DNA, 22 bp, Artificial Sequence
  chemically synthesized
gtagatactaaatgaggcaaca

SEQ ID NO: 656663 - DNA, 22 bp, Artificial Sequence
  chemically synthesized
cgtagatactaaatgaggcaac

SEQ ID NO: 656664 - DNA, 22 bp, Artificial Sequence
  chemically synthesized
ttgcctcatttagtatctacga

SEQ ID NO: 656665 - DNA, 22 bp, Artificial Sequence
  chemically synthesized
acagtggtatcttcgtagatac

SEQ ID NO: 656666 - DNA, 22 bp, Artificial Sequence
  chemically synthesized
gacagtggtatcttcgtagata

SEQ ID NO: 656667 - DNA, 22 bp, Artificial Sequence
  chemically synthesized
tgacagtggtatcttcgtagat

SEQ ID NO: 656668 - DNA, 22 bp, Artificial Sequence
  chemically synthesized
cctcatttagtatctacgaaga

SEQ ID NO: 656669 - DNA, 22 bp, Artificial Sequence
  chemically synthesized
atttagtatctacgaagatacc

SEQ ID NO: 656670 - DNA, 22 bp, Artificial Sequence
  chemically synthesized
tggctttgacagtggtatcttc

SEQ ID NO: 656671 - DNA, 22 bp, Artificial Sequence
  chemically synthesized
atggctttgacagtggtatctt

SEQ ID NO: 656672 - DNA, 22 bp, Artificial Sequence
  chemically synthesized
agtatctacgaagataccactg

SEQ ID NO: 656673 - DNA, 22 bp, Artificial Sequence
  chemically synthesized
gtatctacgaagataccactgt

SEQ ID NO: 656674 - DNA, 22 bp, Artificial Sequence
  chemically synthesized
taaatttatggctttgacagtg

SEQ ID NO: 656675 - DNA, 22 bp, Artificial Sequence
  chemically synthesized
cgaagataccactgtcaaagcc

SEQ ID NO: 656676 - DNA, 22 bp, Artificial Sequence
  chemically synthesized
tcaaagccataaatttacagtg

SEQ ID NO: 656677 - DNA, 22 bp, Artificial Sequence
  chemically synthesized
acagtgactattcctttttcat

SEQ ID NO: 656678 - DNA, 22 bp, Artificial Sequence
  chemically synthesized
cagtgactattcctttttcata

SEQ ID NO: 656679 - DNA, 22 bp, Artificial Sequence
  chemically synthesized
ttcctttttcatatccatggat

SEQ ID NO: 656680 - DNA, 22 bp, Artificial Sequence
  chemically synthesized
ctttttcatatccatggatgtg

SEQ ID NO: 656681 - DNA, 22 bp, Artificial Sequence
  chemically synthesized
tttcatatccatggatgtgact

SEQ ID NO: 656682 - DNA, 22 bp, Artificial Sequence
  chemically synthesized
ttcatatccatggatgtgactt

SEQ ID NO: 656683 - DNA, 22 bp, Artificial Sequence
  chemically synthesized
agccaggaaatgaagtcacatc

SEQ ID NO: 656684 - DNA, 22 bp, Artificial Sequence
  chemically synthesized
tcatatccatggatgtgacttc

SEQ ID NO: 656685 - DNA, 22 bp, Artificial Sequence
  chemically synthesized
catatccatggatgtgacttca

SEQ ID NO: 656686 - DNA, 22 bp, Artificial Sequence
  chemically synthesized
atatccatggatgtgacttcat

SEQ ID NO: 656687 - DNA, 22 bp, Artificial Sequence
  chemically synthesized
tccattaagccaggaaatgaag

SEQ ID NO: 656688 - DNA, 22 bp, Artificial Sequence
  chemically synthesized
caaggaattatccattaagcca

SEQ ID NO: 656689 - DNA, 22 bp, Artificial Sequence
  chemically synthesized
ccaaggaattatccattaagcc

SEQ ID NO: 656690 - DNA, 22 bp, Artificial Sequence
  chemically synthesized
catttcctggcttaatggataa

SEQ ID NO: 656691 - DNA, 22 bp, Artificial Sequence
  chemically synthesized
atttcctggcttaatggataat

SEQ ID NO: 656692 - DNA, 22 bp, Artificial Sequence
  chemically synthesized
taggtcttccaaggaattatcc

SEQ ID NO: 656693 - DNA, 22 bp, Artificial Sequence
  chemically synthesized
cctggcttaatggataattcct

SEQ ID NO: 656694 - DNA, 22 bp, Artificial Sequence
  chemically synthesized
ctggcttaatggataattcctt

SEQ ID NO: 656695 - DNA, 22 bp, Artificial Sequence
  chemically synthesized
gcttaatggataattccttgga

SEQ ID NO: 656696 - DNA, 22 bp, Artificial Sequence
  chemically synthesized
aatggataattccttggaagac

SEQ ID NO: 656697 - DNA, 22 bp, Artificial Sequence
  chemically synthesized
atggataattccttggaagacc

SEQ ID NO: 656698 - DNA, 22 bp, Artificial Sequence
  chemically synthesized
aaaatcactataggtcttccaa

SEQ ID NO: 656699 - DNA, 22 bp, Artificial Sequence
  chemically synthesized
aaaaatcactataggtcttcca

SEQ ID NO: 656700 - DNA, 22 bp, Artificial Sequence
  chemically synthesized
tttaaaaatcactataggtctt

SEQ ID NO: 656701 - DNA, 22 bp, Artificial Sequence
  chemically synthesized
atttaaaaatcactataggtct

SEQ ID NO: 656702 - DNA, 22 bp, Artificial Sequence
  chemically synthesized
cttatttaaaaatcactatagg

SEQ ID NO: 656703 - DNA, 22 bp, Artificial Sequence
  chemically synthesized
gcttatttaaaaatcactatag

SEQ ID NO: 656704 - DNA, 22 bp, Artificial Sequence
  chemically synthesized
tgcttatttaaaaatcactata

SEQ ID NO: 656705 - DNA, 22 bp, Artificial Sequence
  chemically synthesized
cttggaagacctatagtgattt

SEQ ID NO: 656706 - DNA, 22 bp, Artificial Sequence
  chemically synthesized
ggaagacctatagtgattttta

SEQ ID NO: 656707 - DNA, 22 bp, Artificial Sequence
  chemically synthesized
gaagacctatagtgatttttaa

SEQ ID NO: 656708 - DNA, 22 bp, Artificial Sequence
  chemically synthesized
aatgtaaaattttgcttattta

SEQ ID NO: 656709 - DNA, 22 bp, Artificial Sequence
  chemically synthesized
tagtgatttttaaataagcaaa

SEQ ID NO: 656710 - DNA, 22 bp, Artificial Sequence
  chemically synthesized
tcaggtctaaatgtaaaatttt

SEQ ID NO: 656711 - DNA, 22 bp, Artificial Sequence
  chemically synthesized
ttaaataagcaaaattttacat

SEQ ID NO: 656712 - DNA, 22 bp, Artificial Sequence
  chemically synthesized
taaataagcaaaattttacatt

SEQ ID NO: 656713 - DNA, 22 bp, Artificial Sequence
  chemically synthesized
aaataagcaaaattttacattt

SEQ ID NO: 656714 - DNA, 22 bp, Artificial Sequence
  chemically synthesized
aataagcaaaattttacattta

SEQ ID NO: 656715 - DNA, 22 bp, Artificial Sequence
  chemically synthesized
gaaaaggaaatcacctatcagg

SEQ ID NO: 656716 - DNA, 22 bp, Artificial Sequence
  chemically synthesized
agaaaaggaaatcacctatcag

SEQ ID NO: 656717 - DNA, 22 bp, Artificial Sequence
  chemically synthesized
tacatttagacctgataggtga

SEQ ID NO: 656718 - DNA, 22 bp, Artificial Sequence
  chemically synthesized
acatttagacctgataggtgat

SEQ ID NO: 656719 - DNA, 22 bp, Artificial Sequence
  chemically synthesized
catttagacctgataggtgatt

SEQ ID NO: 656720 - DNA, 22 bp, Artificial Sequence
  chemically synthesized
accacttagaaaaggaaatcac

SEQ ID NO: 656721 - DNA, 22 bp, Artificial Sequence
  chemically synthesized
agacctgataggtgatttcctt

SEQ ID NO: 656722 - DNA, 22 bp, Artificial Sequence
  chemically synthesized
gacctgataggtgatttccttt

SEQ ID NO: 656723 - DNA, 22 bp, Artificial Sequence
  chemically synthesized
cccactaaccacttagaaaagg

SEQ ID NO: 656724 - DNA, 22 bp, Artificial Sequence
  chemically synthesized
ataggtgatttccttttctaag

SEQ ID NO: 656725 - DNA, 22 bp, Artificial Sequence
  chemically synthesized
atatccctccccactaaccact

SEQ ID NO: 656726 - DNA, 22 bp, Artificial Sequence
  chemically synthesized
tcatatccctccccactaacca

SEQ ID NO: 656727 - DNA, 22 bp, Artificial Sequence
  chemically synthesized
ccttttctaagtggttagtggg

SEQ ID NO: 656728 - DNA, 22 bp, Artificial Sequence
  chemically synthesized
ctcatatccctccccactaacc

SEQ ID NO: 656729 - DNA, 22 bp, Artificial Sequence
  chemically synthesized
cttttctaagtggttagtgggg

SEQ ID NO: 656730 - DNA, 22 bp, Artificial Sequence
  chemically synthesized
tctcatatccctccccactaac

SEQ ID NO: 656731 - DNA, 22 bp, Artificial Sequence
  chemically synthesized
ttctaagtggttagtggggagg

SEQ ID NO: 656732 - DNA, 22 bp, Artificial Sequence
  chemically synthesized
tctaagtggttagtggggaggg

SEQ ID NO: 656733 - DNA, 22 bp, Artificial Sequence
  chemically synthesized
ctaagtggttagtggggaggga

SEQ ID NO: 656734 - DNA, 22 bp, Artificial Sequence
  chemically synthesized
taagtggttagtggggagggat

SEQ ID NO: 656735 - DNA, 22 bp, Artificial Sequence
  chemically synthesized
aaggttttctcatatccctccc

SEQ ID NO: 656736 - DNA, 22 bp, Artificial Sequence
  chemically synthesized
agtggttagtggggagggatat

SEQ ID NO: 656737 - DNA, 22 bp, Artificial Sequence
  chemically synthesized
ttaaaggttttctcatatccct

SEQ ID NO: 656738 - DNA, 22 bp, Artificial Sequence
  chemically synthesized
tctattaaaggttttctcatat

SEQ ID NO: 656739 - DNA, 22 bp, Artificial Sequence
  chemically synthesized
gtggggagggatatgagaaaac

SEQ ID NO: 656740 - DNA, 22 bp, Artificial Sequence
  chemically synthesized
gattatctattaaaggttttct

SEQ ID NO: 656741 - DNA, 22 bp, Artificial Sequence
  chemically synthesized
tggattatctattaaaggtttt

SEQ ID NO: 656742 - DNA, 22 bp, Artificial Sequence
  chemically synthesized
tctggattatctattaaaggtt

SEQ ID NO: 656743 - DNA, 22 bp, Artificial Sequence
  chemically synthesized
tgtgccacactctctggattat

SEQ ID NO: 656744 - DNA, 22 bp, Artificial Sequence
  chemically synthesized
gtgtgccacactctctggatta

SEQ ID NO: 656745 - DNA, 22 bp, Artificial Sequence
  chemically synthesized
taatagataatccagagagtgt

SEQ ID NO: 656746 - DNA, 22 bp, Artificial Sequence
  chemically synthesized
aatagataatccagagagtgtg

SEQ ID NO: 656747 - DNA, 22 bp, Artificial Sequence
  chemically synthesized
atagataatccagagagtgtgg

SEQ ID NO: 656748 - DNA, 22 bp, Artificial Sequence
  chemically synthesized
agacaagggcccagtagtggca

SEQ ID NO: 656749 - DNA, 22 bp, Artificial Sequence
  chemically synthesized
attcagacaagggcccagtagt

SEQ ID NO: 656750 - DNA, 22 bp, Artificial Sequence
  chemically synthesized
tcttcttgccactactgggccc

SEQ ID NO: 656751 - DNA, 22 bp, Artificial Sequence
  chemically synthesized
tgattcagacaagggcccagta

SEQ ID NO: 656752 - DNA, 22 bp, Artificial Sequence
  chemically synthesized
ctgattcagacaagggcccagt

SEQ ID NO: 656753 - DNA, 22 bp, Artificial Sequence
  chemically synthesized
ttcttgccactactgggccctt

SEQ ID NO: 656754 - DNA, 22 bp, Artificial Sequence
  chemically synthesized
cttgccactactgggcccttgt

SEQ ID NO: 656755 - DNA, 22 bp, Artificial Sequence
  chemically synthesized
ttgccactactgggcccttgtc

SEQ ID NO: 656756 - DNA, 22 bp, Artificial Sequence
  chemically synthesized
gccactactgggcccttgtctg

SEQ ID NO: 656757 - DNA, 22 bp, Artificial Sequence
  chemically synthesized
aatcttctgattcagacaaggg

SEQ ID NO: 656758 - DNA, 22 bp, Artificial Sequence
  chemically synthesized
ccactactgggcccttgtctga

SEQ ID NO: 656759 - DNA, 22 bp, Artificial Sequence
  chemically synthesized
ctgggcccttgtctgaatcaga

SEQ ID NO: 656760 - DNA, 22 bp, Artificial Sequence
  chemically synthesized
ggcccttgtctgaatcagaaga

SEQ ID NO: 656761 - DNA, 22 bp, Artificial Sequence
  chemically synthesized
gaaaggtactgaatcttctgat

SEQ ID NO: 656762 - DNA, 22 bp, Artificial Sequence
  chemically synthesized
gtctgaatcagaagattcagta

SEQ ID NO: 656763 - DNA, 22 bp, Artificial Sequence
  chemically synthesized
tctgaatcagaagattcagtac

SEQ ID NO: 656764 - DNA, 22 bp, Artificial Sequence
  chemically synthesized
gtacagttagaaaggtactgaa

SEQ ID NO: 656765 - DNA, 22 bp, Artificial Sequence
  chemically synthesized
aatcagaagattcagtaccttt

SEQ ID NO: 656766 - DNA, 22 bp, Artificial Sequence
  chemically synthesized
aggttggtacagttagaaaggt

SEQ ID NO: 656767 - DNA, 22 bp, Artificial Sequence
  chemically synthesized
caggttggtacagttagaaagg

SEQ ID NO: 656768 - DNA, 22 bp, Artificial Sequence
  chemically synthesized
tttcaggttggtacagttagaa

SEQ ID NO: 656769 - DNA, 22 bp, Artificial Sequence
  chemically synthesized
gtttcaggttggtacagttaga

SEQ ID NO: 656770 - DNA, 22 bp, Artificial Sequence
  chemically synthesized
tgtttcaggttggtacagttag

SEQ ID NO: 656771 - DNA, 22 bp, Artificial Sequence
  chemically synthesized
agtacctttctaactgtaccaa

SEQ ID NO: 656772 - DNA, 22 bp, Artificial Sequence
  chemically synthesized
ctttgtttcaggttggtacagt

SEQ ID NO: 656773 - DNA, 22 bp, Artificial Sequence
  chemically synthesized
actttgtttcaggttggtacag

SEQ ID NO: 656774 - DNA, 22 bp, Artificial Sequence
  chemically synthesized
tctaactgtaccaacctgaaac

SEQ ID NO: 656775 - DNA, 22 bp, Artificial Sequence
  chemically synthesized
ctaactgtaccaacctgaaaca

SEQ ID NO: 656776 - DNA, 22 bp, Artificial Sequence
  chemically synthesized
gaaaccttactttgtttcaggt

SEQ ID NO: 656777 - DNA, 22 bp, Artificial Sequence
  chemically synthesized
taactgtaccaacctgaaacaa

SEQ ID NO: 656778 - DNA, 22 bp, Artificial Sequence
  chemically synthesized
actgtaccaacctgaaacaaag

SEQ ID NO: 656779 - DNA, 22 bp, Artificial Sequence
  chemically synthesized
taccaacctgaaacaaagtaag

SEQ ID NO: 656780 - DNA, 22 bp, Artificial Sequence
  chemically synthesized
tcaccacctggaaaccttactt

SEQ ID NO: 656781 - DNA, 22 bp, Artificial Sequence
  chemically synthesized
gtcaccacctggaaaccttact

SEQ ID NO: 656782 - DNA, 22 bp, Artificial Sequence
  chemically synthesized
ttgtcaccacctggaaacctta

SEQ ID NO: 656783 - DNA, 22 bp, Artificial Sequence
  chemically synthesized
cttgtcaccacctggaaacctt

SEQ ID NO: 656784 - DNA, 22 bp, Artificial Sequence
  chemically synthesized
aaacaaagtaaggtttccaggt

SEQ ID NO: 656785 - DNA, 22 bp, Artificial Sequence
  chemically synthesized
atttcttgtcaccacctggaaa

SEQ ID NO: 656786 - DNA, 22 bp, Artificial Sequence
  chemically synthesized
gatttcttgtcaccacctggaa

SEQ ID NO: 656787 - DNA, 22 bp, Artificial Sequence
  chemically synthesized
tgatttcttgtcaccacctgga

SEQ ID NO: 656788 - DNA, 22 bp, Artificial Sequence
  chemically synthesized
ctttgatttcttgtcaccacct

SEQ ID NO: 656789 - DNA, 22 bp, Artificial Sequence
  chemically synthesized
cctttgatttcttgtcaccacc

SEQ ID NO: 656790 - DNA, 22 bp, Artificial Sequence
  chemically synthesized
atttcctttgatttcttgtcac

SEQ ID NO: 656791 - DNA, 22 bp, Artificial Sequence
  chemically synthesized
gatttcctttgatttcttgtca

SEQ ID NO: 656792 - DNA, 22 bp, Artificial Sequence
  chemically synthesized
ccaggtggtgacaagaaatcaa

SEQ ID NO: 656793 - DNA, 22 bp, Artificial Sequence
  chemically synthesized
caggtggtgacaagaaatcaaa

SEQ ID NO: 656794 - DNA, 22 bp, Artificial Sequence
  chemically synthesized
cagatttgatttcctttgattt

SEQ ID NO: 656795 - DNA, 22 bp, Artificial Sequence
  chemically synthesized
cattgcagatttgatttccttt

SEQ ID NO: 656796 - DNA, 22 bp, Artificial Sequence
  chemically synthesized
gcattgcagatttgatttcctt

SEQ ID NO: 656797 - DNA, 22 bp, Artificial Sequence
  chemically synthesized
cttgcattgcagatttgatttc

SEQ ID NO: 656798 - DNA, 22 bp, Artificial Sequence
  chemically synthesized
caagtgcattccttgcattgca

SEQ ID NO: 656799 - DNA, 22 bp, Artificial Sequence
  chemically synthesized
tcctacaagtgcattccttgca

SEQ ID NO: 656800 - DNA, 22 bp, Artificial Sequence
  chemically synthesized
atcctacaagtgcattccttgc

SEQ ID NO: 656801 - DNA, 22 bp, Artificial Sequence
  chemically synthesized
tttatcctacaagtgcattcct

SEQ ID NO: 656802 - DNA, 22 bp, Artificial Sequence
  chemically synthesized
gtttatcctacaagtgcattcc

SEQ ID NO: 656803 - DNA, 22 bp, Artificial Sequence
  chemically synthesized
caatgcaaggaatgcacttgta

SEQ ID NO: 656804 - DNA, 22 bp, Artificial Sequence
  chemically synthesized
gtaggataaacaagtactttat

SEQ ID NO: 656805 - DNA, 22 bp, Artificial Sequence
  chemically synthesized
aggtaaacggtaataaagtact

SEQ ID NO: 656806 - DNA, 22 bp, Artificial Sequence
  chemically synthesized
taggataaacaagtactttatt

SEQ ID NO: 656807 - DNA, 22 bp, Artificial Sequence
  chemically synthesized
ccagcctgaggtaaacggtaat

SEQ ID NO: 656808 - DNA, 22 bp, Artificial Sequence
  chemically synthesized
taccagcctgaggtaaacggta

SEQ ID NO: 656809 - DNA, 22 bp, Artificial Sequence
  chemically synthesized
ctaccagcctgaggtaaacggt

SEQ ID NO: 656810 - DNA, 22 bp, Artificial Sequence
  chemically synthesized
tttctaccagcctgaggtaaac

SEQ ID NO: 656811 - DNA, 22 bp, Artificial Sequence
  chemically synthesized
ctatttctaccagcctgaggta

SEQ ID NO: 656812 - DNA, 22 bp, Artificial Sequence
  chemically synthesized
tattaccgtttacctcaggctg

SEQ ID NO: 656813 - DNA, 22 bp, Artificial Sequence
  chemically synthesized
attaccgtttacctcaggctgg

SEQ ID NO: 656814 - DNA, 22 bp, Artificial Sequence
  chemically synthesized
ttaccgtttacctcaggctggt

SEQ ID NO: 656815 - DNA, 22 bp, Artificial Sequence
  chemically synthesized
ccgtttacctcaggctggtaga

SEQ ID NO: 656816 - DNA, 22 bp, Artificial Sequence
  chemically synthesized
aaaggctgctatttctaccagc

SEQ ID NO: 656817 - DNA, 22 bp, Artificial Sequence
  chemically synthesized
acctcaggctggtagaaatagc

SEQ ID NO: 656818 - DNA, 22 bp, Artificial Sequence
  chemically synthesized
tgctcaaaggctgctatttcta

SEQ ID NO: 656819 - DNA, 22 bp, Artificial Sequence
  chemically synthesized
cctcaggctggtagaaatagca

SEQ ID NO: 656820 - DNA, 22 bp, Artificial Sequence
  chemically synthesized
gtgctcaaaggctgctatttct

SEQ ID NO: 656821 - DNA, 22 bp, Artificial Sequence
  chemically synthesized
aggctggtagaaatagcagcct

SEQ ID NO: 656822 - DNA, 22 bp, Artificial Sequence
  chemically synthesized
agcaagcttgtgctcaaaggct

SEQ ID NO: 656823 - DNA, 22 bp, Artificial Sequence
  chemically synthesized
gtagaaatagcagcctttgagc

SEQ ID NO: 656824 - DNA, 22 bp, Artificial Sequence
  chemically synthesized
cagcaagcttgtgctcaaaggc

SEQ ID NO: 656825 - DNA, 22 bp, Artificial Sequence
  chemically synthesized
cttcagcaagcttgtgctcaaa

SEQ ID NO: 656826 - DNA, 22 bp, Artificial Sequence
  chemically synthesized
gttccttcagcaagcttgtgct

SEQ ID NO: 656827 - DNA, 22 bp, Artificial Sequence
  chemically synthesized
ggctggttccttcagcaagctt

SEQ ID NO: 656828 - DNA, 22 bp, Artificial Sequence
  chemically synthesized
tgagcacaagcttgctgaagga

SEQ ID NO: 656829 - DNA, 22 bp, Artificial Sequence
  chemically synthesized
gagcacaagcttgctgaaggaa

SEQ ID NO: 656830 - DNA, 22 bp, Artificial Sequence
  chemically synthesized
agcacaagcttgctgaaggaac

SEQ ID NO: 656831 - DNA, 22 bp, Artificial Sequence
  chemically synthesized
agaatgaggctgggctggttcc

SEQ ID NO: 656832 - DNA, 22 bp, Artificial Sequence
  chemically synthesized
cagaatgaggctgggctggttc

SEQ ID NO: 656833 - DNA, 22 bp, Artificial Sequence
  chemically synthesized
gctgaaggaaccagcccagcct

SEQ ID NO: 656834 - DNA, 22 bp, Artificial Sequence
  chemically synthesized
ctgaaggaaccagcccagcctc

SEQ ID NO: 656835 - DNA, 22 bp, Artificial Sequence
  chemically synthesized
aaggaaccagcccagcctcatt

SEQ ID NO: 656836 - DNA, 22 bp, Artificial Sequence
  chemically synthesized
aagtataggaccttcagaatga

SEQ ID NO: 656837 - DNA, 22 bp, Artificial Sequence
  chemically synthesized
gaagtataggaccttcagaatg

SEQ ID NO: 656838 - DNA, 22 bp, Artificial Sequence
  chemically synthesized
tttgaagtataggaccttcaga

SEQ ID NO: 656839 - DNA, 22 bp, Artificial Sequence
  chemically synthesized
gtttgaagtataggaccttcag

SEQ ID NO: 656840 - DNA, 22 bp, Artificial Sequence
  chemically synthesized
tgtttgaagtataggaccttca

SEQ ID NO: 656841 - DNA, 22 bp, Artificial Sequence
  chemically synthesized
ccctttgtttgaagtataggac

SEQ ID NO: 656842 - DNA, 22 bp, Artificial Sequence
  chemically synthesized
tgccctttgtttgaagtatagg

SEQ ID NO: 656843 - DNA, 22 bp, Artificial Sequence
  chemically synthesized
attctgaaggtcctatacttca

SEQ ID NO: 656844 - DNA, 22 bp, Artificial Sequence
  chemically synthesized
tgaaggtcctatacttcaaaca

SEQ ID NO: 656845 - DNA, 22 bp, Artificial Sequence
  chemically synthesized
aaggtcctatacttcaaacaaa

SEQ ID NO: 656846 - DNA, 22 bp, Artificial Sequence
  chemically synthesized
tacttcaaacaaagggcagagg

SEQ ID NO: 656847 - DNA, 22 bp, Artificial Sequence
  chemically synthesized
caaacaaagggcagaggacatt

SEQ ID NO: 656848 - DNA, 22 bp, Artificial Sequence
  chemically synthesized
aaacaaagggcagaggacattt

SEQ ID NO: 656849 - DNA, 22 bp, Artificial Sequence
  chemically synthesized
tagggaaagataacaggagtga

SEQ ID NO: 656850 - DNA, 22 bp, Artificial Sequence
  chemically synthesized
ctgtagggaaagataacaggag

SEQ ID NO: 656851 - DNA, 22 bp, Artificial Sequence
  chemically synthesized
gctgtagggaaagataacagga

SEQ ID NO: 656852 - DNA, 22 bp, Artificial Sequence
  chemically synthesized
tcactcctgttatctttcccta

SEQ ID NO: 656853 - DNA, 22 bp, Artificial Sequence
  chemically synthesized
cactcctgttatctttccctac

SEQ ID NO: 656854 - DNA, 22 bp, Artificial Sequence
  chemically synthesized
actcctgttatctttccctaca

SEQ ID NO: 656855 - DNA, 22 bp, Artificial Sequence
  chemically synthesized
ctgttatctttccctacagcaa

SEQ ID NO: 656856 - DNA, 22 bp, Artificial Sequence
  chemically synthesized
ttatctttccctacagcaaaca

SEQ ID NO: 656857 - DNA, 22 bp, Artificial Sequence
  chemically synthesized
tctttccctacagcaaacattg

SEQ ID NO: 656858 - DNA, 22 bp, Artificial Sequence
  chemically synthesized
tccctacagcaaacattgtatt

SEQ ID NO: 656859 - DNA, 22 bp, Artificial Sequence
  chemically synthesized
ccctacagcaaacattgtattt

SEQ ID NO: 656860 - DNA, 22 bp, Artificial Sequence
  chemically synthesized
cctacagcaaacattgtatttt

SEQ ID NO: 656861 - DNA, 22 bp, Artificial Sequence
  chemically synthesized
tgccacgtgcataaaaatacaa

SEQ ID NO: 656862 - DNA, 22 bp, Artificial Sequence
  chemically synthesized
cagcaaacattgtatttttatg

SEQ ID NO: 656863 - DNA, 22 bp, Artificial Sequence
  chemically synthesized
attgtgccacgtgcataaaaat

SEQ ID NO: 656864 - DNA, 22 bp, Artificial Sequence
  chemically synthesized
cattgtgccacgtgcataaaaa

SEQ ID NO: 656865 - DNA, 22 bp, Artificial Sequence
  chemically synthesized
tcattgtgccacgtgcataaaa

SEQ ID NO: 656866 - DNA, 22 bp, Artificial Sequence
  chemically synthesized
cctttcattgtgccacgtgcat

SEQ ID NO: 656867 - DNA, 22 bp, Artificial Sequence
  chemically synthesized
gcctttcattgtgccacgtgca

SEQ ID NO: 656868 - DNA, 22 bp, Artificial Sequence
  chemically synthesized
tatttttatgcacgtggcacaa

SEQ ID NO: 656869 - DNA, 22 bp, Artificial Sequence
  chemically synthesized
ttatgcacgtggcacaatgaaa

SEQ ID NO: 656870 - DNA, 22 bp, Artificial Sequence
  chemically synthesized
tatgcacgtggcacaatgaaag

SEQ ID NO: 656871 - DNA, 22 bp, Artificial Sequence
  chemically synthesized
atgcacgtggcacaatgaaagg

SEQ ID NO: 656872 - DNA, 22 bp, Artificial Sequence
  chemically synthesized
gcggtcaccttgcctttcattg

SEQ ID NO: 656873 - DNA, 22 bp, Artificial Sequence
  chemically synthesized
tgcacgtggcacaatgaaaggc

SEQ ID NO: 656874 - DNA, 22 bp, Artificial Sequence
  chemically synthesized
ggccaggtgcactggcggtcac

SEQ ID NO: 656875 - DNA, 22 bp, Artificial Sequence
  chemically synthesized
ctcggccaggtgcactggcggt

SEQ ID NO: 656876 - DNA, 22 bp, Artificial Sequence
  chemically synthesized
cctcggccaggtgcactggcgg

SEQ ID NO: 656877 - DNA, 22 bp, Artificial Sequence
  chemically synthesized
tcctcggccaggtgcactggcg

SEQ ID NO: 656878 - DNA, 22 bp, Artificial Sequence
  chemically synthesized
ttcctcggccaggtgcactggc

SEQ ID NO: 656879 - DNA, 22 bp, Artificial Sequence
  chemically synthesized
gcatgcttttcctcggccaggt

SEQ ID NO: 656880 - DNA, 22 bp, Artificial Sequence
  chemically synthesized
gccctggcatgcttttcctcgg

SEQ ID NO: 656881 - DNA, 22 bp, Artificial Sequence
  chemically synthesized
gccgaggaaaagcatgccaggg

SEQ ID NO: 656882 - DNA, 22 bp, Artificial Sequence
  chemically synthesized
ggaatccacgtcctggccctgg

SEQ ID NO: 656883 - DNA, 22 bp, Artificial Sequence
  chemically synthesized
aggaatccacgtcctggccctg

SEQ ID NO: 656884 - DNA, 22 bp, Artificial Sequence
  chemically synthesized
ggaatacttaggaatccacgtc

SEQ ID NO: 656885 - DNA, 22 bp, Artificial Sequence
  chemically synthesized
aggaatacttaggaatccacgt

SEQ ID NO: 656886 - DNA, 22 bp, Artificial Sequence
  chemically synthesized
taaatacttaggaatacttagg

SEQ ID NO: 656887 - DNA, 22 bp, Artificial Sequence
  chemically synthesized
ctaagtattcctaagtatttac

SEQ ID NO: 656888 - DNA, 22 bp, Artificial Sequence
  chemically synthesized
aatggatccattgtaaatactt

SEQ ID NO: 656889 - DNA, 22 bp, Artificial Sequence
  chemically synthesized
agtattcctaagtatttacaat

SEQ ID NO: 656890 - DNA, 22 bp, Artificial Sequence
  chemically synthesized
ctaagtatttacaatggatcca

SEQ ID NO: 656891 - DNA, 22 bp, Artificial Sequence
  chemically synthesized
caatcaggttgaatggatccat

SEQ ID NO: 656892 - DNA, 22 bp, Artificial Sequence
  chemically synthesized
gcaatcaggttgaatggatcca

SEQ ID NO: 656893 - DNA, 22 bp, Artificial Sequence
  chemically synthesized
agtatttacaatggatccattc

SEQ ID NO: 656894 - DNA, 22 bp, Artificial Sequence
  chemically synthesized
gcaatttgcaatcaggttgaat

SEQ ID NO: 656895 - DNA, 22 bp, Artificial Sequence
  chemically synthesized
acaatggatccattcaacctga

SEQ ID NO: 656896 - DNA, 22 bp, Artificial Sequence
  chemically synthesized
agcaatttgcaatcaggttgaa

SEQ ID NO: 656897 - DNA, 22 bp, Artificial Sequence
  chemically synthesized
caatggatccattcaacctgat

SEQ ID NO: 656898 - DNA, 22 bp, Artificial Sequence
  chemically synthesized
tagcaatttgcaatcaggttga

SEQ ID NO: 656899 - DNA, 22 bp, Artificial Sequence
  chemically synthesized
agcgttttagcaatttgcaatc

SEQ ID NO: 656900 - DNA, 22 bp, Artificial Sequence
  chemically synthesized
tcagcgttttagcaatttgcaa

SEQ ID NO: 656901 - DNA, 22 bp, Artificial Sequence
  chemically synthesized
aacctgattgcaaattgctaaa

SEQ ID NO: 656902 - DNA, 22 bp, Artificial Sequence
  chemically synthesized
gggagcctctcagcgttttagc

SEQ ID NO: 656903 - DNA, 22 bp, Artificial Sequence
  chemically synthesized
ggggagcctctcagcgttttag

SEQ ID NO: 656904 - DNA, 22 bp, Artificial Sequence
  chemically synthesized
attgcaaattgctaaaacgctg

SEQ ID NO: 656905 - DNA, 22 bp, Artificial Sequence
  chemically synthesized
caaattgctaaaacgctgagag

SEQ ID NO: 656906 - DNA, 22 bp, Artificial Sequence
  chemically synthesized
gatttggggagcctctcagcgt

SEQ ID NO: 656907 - DNA, 22 bp, Artificial Sequence
  chemically synthesized
agatttggggagcctctcagcg

SEQ ID NO: 656908 - DNA, 22 bp, Artificial Sequence
  chemically synthesized
cttagatttggggagcctctca

SEQ ID NO: 656909 - DNA, 22 bp, Artificial Sequence
  chemically synthesized
ctaaaacgctgagaggctcccc

SEQ ID NO: 656910 - DNA, 22 bp, Artificial Sequence
  chemically synthesized
attacttagatttggggagcct

SEQ ID NO: 656911 - DNA, 22 bp, Artificial Sequence
  chemically synthesized
cattacttagatttggggagcc

SEQ ID NO: 656912 - DNA, 22 bp, Artificial Sequence
  chemically synthesized
aaacgctgagaggctccccaaa

SEQ ID NO: 656913 - DNA, 22 bp, Artificial Sequence
  chemically synthesized
tcattacttagatttggggagc

SEQ ID NO: 656914 - DNA, 22 bp, Artificial Sequence
  chemically synthesized
agaggctccccaaatctaagta

SEQ ID NO: 656915 - DNA, 22 bp, Artificial Sequence
  chemically synthesized
cccaaatctaagtaatgaaagc

SEQ ID NO: 656916 - DNA, 22 bp, Artificial Sequence
  chemically synthesized
catatgtatggcgaggctttca

SEQ ID NO: 656917 - DNA, 22 bp, Artificial Sequence
  chemically synthesized
agtaatgaaagcctcgccatac

SEQ ID NO: 656918 - DNA, 22 bp, Artificial Sequence
  chemically synthesized
gtaaattccatatgtatggcga

SEQ ID NO: 656919 - DNA, 22 bp, Artificial Sequence
  chemically synthesized
atcagatgctagtaaattccat

SEQ ID NO: 656920 - DNA, 22 bp, Artificial Sequence
  chemically synthesized
taatcagatgctagtaaattcc

SEQ ID NO: 656921 - DNA, 22 bp, Artificial Sequence
  chemically synthesized
gccatacatatggaatttacta

SEQ ID NO: 656922 - DNA, 22 bp, Artificial Sequence
  chemically synthesized
ctaatcagatgctagtaaattc

SEQ ID NO: 656923 - DNA, 22 bp, Artificial Sequence
  chemically synthesized
gcaaatgtagtatttctaatca

SEQ ID NO: 656924 - DNA, 22 bp, Artificial Sequence
  chemically synthesized
actagcatctgattagaaatac

SEQ ID NO: 656925 - DNA, 22 bp, Artificial Sequence
  chemically synthesized
ctagcatctgattagaaatact

SEQ ID NO: 656926 - DNA, 22 bp, Artificial Sequence
  chemically synthesized
gcatctgattagaaatactaca

SEQ ID NO: 656927 - DNA, 22 bp, Artificial Sequence
  chemically synthesized
aagtgctggcaaatgtagtatt

SEQ ID NO: 656928 - DNA, 22 bp, Artificial Sequence
  chemically synthesized
gaagtgctggcaaatgtagtat

SEQ ID NO: 656929 - DNA, 22 bp, Artificial Sequence
  chemically synthesized
gtttgaagtgctggcaaatgta

SEQ ID NO: 656930 - DNA, 22 bp, Artificial Sequence
  chemically synthesized
attagaaatactacatttgcca

SEQ ID NO: 656931 - DNA, 22 bp, Artificial Sequence
  chemically synthesized
gaaatactacatttgccagcac

SEQ ID NO: 656932 - DNA, 22 bp, Artificial Sequence
  chemically synthesized
catttgccagcacttcaaacta

SEQ ID NO: 656933 - DNA, 22 bp, Artificial Sequence
  chemically synthesized
agggggaagaggaattagtttg

SEQ ID NO: 656934 - DNA, 22 bp, Artificial Sequence
  chemically synthesized
gagggggaagaggaattagttt

SEQ ID NO: 656935 - DNA, 22 bp, Artificial Sequence
  chemically synthesized
gccagcacttcaaactaattcc

SEQ ID NO: 656936 - DNA, 22 bp, Artificial Sequence
  chemically synthesized
ccagcacttcaaactaattcct

SEQ ID NO: 656937 - DNA, 22 bp, Artificial Sequence
  chemically synthesized
caaactaattcctcttccccct

SEQ ID NO: 656938 - DNA, 22 bp, Artificial Sequence
  chemically synthesized
aaactaattcctcttccccctc

SEQ ID NO: 656939 - DNA, 22 bp, Artificial Sequence
  chemically synthesized
attcctcttccccctcaagggt

SEQ ID NO: 656940 - DNA, 22 bp, Artificial Sequence
  chemically synthesized
ctcttccccctcaagggtcccc

SEQ ID NO: 656941 - DNA, 22 bp, Artificial Sequence
  chemically synthesized
ttccccctcaagggtcccctgt

SEQ ID NO: 656942 - DNA, 22 bp, Artificial Sequence
  chemically synthesized
ccccctcaagggtcccctgtct

SEQ ID NO: 656943 - DNA, 22 bp, Artificial Sequence
  chemically synthesized
cccctcaagggtcccctgtctt

SEQ ID NO: 656944 - DNA, 22 bp, Artificial Sequence
  chemically synthesized
aagggtcccctgtcttgttata

SEQ ID NO: 656945 - DNA, 22 bp, Artificial Sequence
  chemically synthesized
gatagaataagaaaaggtataa

SEQ ID NO: 656946 - DNA, 22 bp, Artificial Sequence
  chemically synthesized
tcttgttataccttttcttatt

SEQ ID NO: 656947 - DNA, 22 bp, Artificial Sequence
  chemically synthesized
agtcctggatagaataagaaaa

SEQ ID NO: 656948 - DNA, 22 bp, Artificial Sequence
  chemically synthesized
ctgagtcctggatagaataaga

SEQ ID NO: 656949 - DNA, 22 bp, Artificial Sequence
  chemically synthesized
gttataccttttcttattctat

SEQ ID NO: 656950 - DNA, 22 bp, Artificial Sequence
  chemically synthesized
cctgagtcctggatagaataag

SEQ ID NO: 656951 - DNA, 22 bp, Artificial Sequence
  chemically synthesized
ttataccttttcttattctatc

SEQ ID NO: 656952 - DNA, 22 bp, Artificial Sequence
  chemically synthesized
tcctgagtcctggatagaataa

SEQ ID NO: 656953 - DNA, 22 bp, Artificial Sequence
  chemically synthesized
ttcctgagtcctggatagaata

SEQ ID NO: 656954 - DNA, 22 bp, Artificial Sequence
  chemically synthesized
taccttttcttattctatccag

SEQ ID NO: 656955 - DNA, 22 bp, Artificial Sequence
  chemically synthesized
cttttcctgagtcctggataga

SEQ ID NO: 656956 - DNA, 22 bp, Artificial Sequence
  chemically synthesized
ttcttattctatccaggactca

SEQ ID NO: 656957 - DNA, 22 bp, Artificial Sequence
  chemically synthesized
tcttattctatccaggactcag

SEQ ID NO: 656958 - DNA, 22 bp, Artificial Sequence
  chemically synthesized
cttattctatccaggactcagg

SEQ ID NO: 656959 - DNA, 22 bp, Artificial Sequence
  chemically synthesized
ttattctatccaggactcagga

SEQ ID NO: 656960 - DNA, 22 bp, Artificial Sequence
  chemically synthesized
attctatccaggactcaggaaa

SEQ ID NO: 656961 - DNA, 22 bp, Artificial Sequence
  chemically synthesized
ttctatccaggactcaggaaaa

SEQ ID NO: 656962 - DNA, 22 bp, Artificial Sequence
  chemically synthesized
tatccaggactcaggaaaagta

SEQ ID NO: 656963 - DNA, 22 bp, Artificial Sequence
  chemically synthesized
tccaggactcaggaaaagtagc

SEQ ID NO: 656964 - DNA, 22 bp, Artificial Sequence
  chemically synthesized
ccaaggccaaacaacagctact

SEQ ID NO: 656965 - DNA, 22 bp, Artificial Sequence
  chemically synthesized
cccaaggccaaacaacagctac

SEQ ID NO: 656966 - DNA, 22 bp, Artificial Sequence
  chemically synthesized
aggaaaagtagctgttgtttgg

SEQ ID NO: 656967 - DNA, 22 bp, Artificial Sequence
  chemically synthesized
cagcttcccaaggccaaacaac

SEQ ID NO: 656968 - DNA, 22 bp, Artificial Sequence
  chemically synthesized
tccagcttcccaaggccaaaca

SEQ ID NO: 656969 - DNA, 22 bp, Artificial Sequence
  chemically synthesized
ctctccagcttcccaaggccaa

SEQ ID NO: 656970 - DNA, 22 bp, Artificial Sequence
  chemically synthesized
tgctctccagcttcccaaggcc

SEQ ID NO: 656971 - DNA, 22 bp, Artificial Sequence
  chemically synthesized
ctgctctccagcttcccaaggc

SEQ ID NO: 656972 - DNA, 22 bp, Artificial Sequence
  chemically synthesized
ttgtttggccttgggaagctgg

SEQ ID NO: 656973 - DNA, 22 bp, Artificial Sequence
  chemically synthesized
atacttctgctctccagcttcc

SEQ ID NO: 656974 - DNA, 22 bp, Artificial Sequence
  chemically synthesized
tttggccttgggaagctggaga

SEQ ID NO: 656975 - DNA, 22 bp, Artificial Sequence
  chemically synthesized
tgatacttctgctctccagctt

SEQ ID NO: 656976 - DNA, 22 bp, Artificial Sequence
  chemically synthesized
ctgatacttctgctctccagct

SEQ ID NO: 656977 - DNA, 22 bp, Artificial Sequence
  chemically synthesized
ggccttgggaagctggagagca

SEQ ID NO: 656978 - DNA, 22 bp, Artificial Sequence
  chemically synthesized
gccttgggaagctggagagcag

SEQ ID NO: 656979 - DNA, 22 bp, Artificial Sequence
  chemically synthesized
gggaagctggagagcagaagta

SEQ ID NO: 656980 - DNA, 22 bp, Artificial Sequence
  chemically synthesized
ggaagctggagagcagaagtat

SEQ ID NO: 656981 - DNA, 22 bp, Artificial Sequence
  chemically synthesized
ccaaatatgtagtttctgatac

SEQ ID NO: 656982 - DNA, 22 bp, Artificial Sequence
  chemically synthesized
gagagcagaagtatcagaaact

SEQ ID NO: 656983 - DNA, 22 bp, Artificial Sequence
  chemically synthesized
attcccaaatatgtagtttctg

SEQ ID NO: 656984 - DNA, 22 bp, Artificial Sequence
  chemically synthesized
cctcattcccaaatatgtagtt

SEQ ID NO: 656985 - DNA, 22 bp, Artificial Sequence
  chemically synthesized
ctacctcattcccaaatatgta

SEQ ID NO: 656986 - DNA, 22 bp, Artificial Sequence
  chemically synthesized
actacctcattcccaaatatgt

SEQ ID NO: 656987 - DNA, 22 bp, Artificial Sequence
  chemically synthesized
catatttgggaatgaggtagta

SEQ ID NO: 656988 - DNA, 22 bp, Artificial Sequence
  chemically synthesized
gggaatgaggtagtaaatgtgg

SEQ ID NO: 656989 - DNA, 22 bp, Artificial Sequence
  chemically synthesized
ggaatgaggtagtaaatgtggc

SEQ ID NO: 656990 - DNA, 22 bp, Artificial Sequence
  chemically synthesized
gtccagtatgcccaccgccaca

SEQ ID NO: 656991 - DNA, 22 bp, Artificial Sequence
  chemically synthesized
ctagtccagtatgcccaccgcc

SEQ ID NO: 656992 - DNA, 22 bp, Artificial Sequence
  chemically synthesized
attcctagtccagtatgcccac

SEQ ID NO: 656993 - DNA, 22 bp, Artificial Sequence
  chemically synthesized
gattcctagtccagtatgccca

SEQ ID NO: 656994 - DNA, 22 bp, Artificial Sequence
  chemically synthesized
gtggaagggtttgattcctagt

SEQ ID NO: 656995 - DNA, 22 bp, Artificial Sequence
  chemically synthesized
agctggtggaagggtttgattc

SEQ ID NO: 656996 - DNA, 22 bp, Artificial Sequence
  chemically synthesized
gactaggaatcaaacccttcca

SEQ ID NO: 656997 - DNA, 22 bp, Artificial Sequence
  chemically synthesized
aagtccctcagctggtggaagg

SEQ ID NO: 656998 - DNA, 22 bp, Artificial Sequence
  chemically synthesized
aaagtccctcagctggtggaag

SEQ ID NO: 656999 - DNA, 22 bp, Artificial Sequence
  chemically synthesized
ggaatcaaacccttccaccagc

SEQ ID NO: 657000 - DNA, 22 bp, Artificial Sequence
  chemically synthesized
cgcccttaaagtccctcagctg

SEQ ID NO: 657001 - DNA, 22 bp, Artificial Sequence
  chemically synthesized
gcgcccttaaagtccctcagct

SEQ ID NO: 657002 - DNA, 22 bp, Artificial Sequence
  chemically synthesized
tttgcgcccttaaagtccctca

SEQ ID NO: 657003 - DNA, 22 bp, Artificial Sequence
  chemically synthesized
atttgcgcccttaaagtccctc

SEQ ID NO: 657004 - DNA, 22 bp, Artificial Sequence
  chemically synthesized
ccaccagctgagggactttaag

SEQ ID NO: 657005 - DNA, 22 bp, Artificial Sequence
  chemically synthesized
caccagctgagggactttaagg

SEQ ID NO: 657006 - DNA, 22 bp, Artificial Sequence
  chemically synthesized
agggactttaagggcgcaaata

SEQ ID NO: 657007 - DNA, 22 bp, Artificial Sequence
  chemically synthesized
agtggatgaataatttatttgc

SEQ ID NO: 657008 - DNA, 22 bp, Artificial Sequence
  chemically synthesized
aagtggatgaataatttatttg

SEQ ID NO: 657009 - DNA, 22 bp, Artificial Sequence
  chemically synthesized
tttaagtggatgaataatttat

SEQ ID NO: 657010 - DNA, 22 bp, Artificial Sequence
  chemically synthesized
taagggcgcaaataaattattc

SEQ ID NO: 657011 - DNA, 22 bp, Artificial Sequence
  chemically synthesized
aagggcgcaaataaattattca

SEQ ID NO: 657012 - DNA, 22 bp, Artificial Sequence
  chemically synthesized
agggcgcaaataaattattcat

SEQ ID NO: 657013 - DNA, 22 bp, Artificial Sequence
  chemically synthesized
ttgtttaagtggatgaataatt

SEQ ID NO: 657014 - DNA, 22 bp, Artificial Sequence
  chemically synthesized
ttattgtttaagtggatgaata

SEQ ID NO: 657015 - DNA, 22 bp, Artificial Sequence
  chemically synthesized
attattgtttaagtggatgaat

SEQ ID NO: 657016 - DNA, 22 bp, Artificial Sequence
  chemically synthesized
tattattgtttaagtggatgaa

SEQ ID NO: 657017 - DNA, 22 bp, Artificial Sequence
  chemically synthesized
ttattattgtttaagtggatga

SEQ ID NO: 657018 - DNA, 22 bp, Artificial Sequence
  chemically synthesized
cttttattattgtttaagtgga

SEQ ID NO: 657019 - DNA, 22 bp, Artificial Sequence
  chemically synthesized
gcttttattattgtttaagtgg

SEQ ID NO: 657020 - DNA, 22 bp, Artificial Sequence
  chemically synthesized
tgcttttattattgtttaagtg

SEQ ID NO: 657021 - DNA, 22 bp, Artificial Sequence
  chemically synthesized
ttcatccacttaaacaataata

SEQ ID NO: 657022 - DNA, 22 bp, Artificial Sequence
  chemically synthesized
gagattttgcttttattattgt

SEQ ID NO: 657023 - DNA, 22 bp, Artificial Sequence
  chemically synthesized
ggagattttgcttttattattg

SEQ ID NO: 657024 - DNA, 22 bp, Artificial Sequence
  chemically synthesized
atccacttaaacaataataaaa

SEQ ID NO: 657025 - DNA, 22 bp, Artificial Sequence
  chemically synthesized
tggagattttgcttttattatt

SEQ ID NO: 657026 - DNA, 22 bp, Artificial Sequence
  chemically synthesized
aaacaataataaaagcaaaatc

SEQ ID NO: 657027 - DNA, 22 bp, Artificial Sequence
  chemically synthesized
aacaataataaaagcaaaatct

SEQ ID NO: 657028 - DNA, 22 bp, Artificial Sequence
  chemically synthesized
aggggaacagaatagtcaggct

SEQ ID NO: 657029 - DNA, 22 bp, Artificial Sequence
  chemically synthesized
gaggggaacagaatagtcaggc

SEQ ID NO: 657030 - DNA, 22 bp, Artificial Sequence
  chemically synthesized
tgaggggaacagaatagtcagg

SEQ ID NO: 657031 - DNA, 22 bp, Artificial Sequence
  chemically synthesized
caaagcctgactattctgttcc

SEQ ID NO: 657032 - DNA, 22 bp, Artificial Sequence
  chemically synthesized
accaagtctttgaggggaacag

SEQ ID NO: 657033 - DNA, 22 bp, Artificial Sequence
  chemically synthesized
actattctgttcccctcaaaga

SEQ ID NO: 657034 - DNA, 22 bp, Artificial Sequence
  chemically synthesized
atcctcaccaagtctttgaggg

SEQ ID NO: 657035 - DNA, 22 bp, Artificial Sequence
  chemically synthesized
aatcctcaccaagtctttgagg

SEQ ID NO: 657036 - DNA, 22 bp, Artificial Sequence
  chemically synthesized
ttctgttcccctcaaagacttg

SEQ ID NO: 657037 - DNA, 22 bp, Artificial Sequence
  chemically synthesized
atttaatcctcaccaagtcttt

SEQ ID NO: 657038 - DNA, 22 bp, Artificial Sequence
  chemically synthesized
tgttcccctcaaagacttggtg

SEQ ID NO: 657039 - DNA, 22 bp, Artificial Sequence
  chemically synthesized
tcatttaatcctcaccaagtct

SEQ ID NO: 657040 - DNA, 22 bp, Artificial Sequence
  chemically synthesized
ttcccctcaaagacttggtgag

SEQ ID NO: 657041 - DNA, 22 bp, Artificial Sequence
  chemically synthesized
tctcatttaatcctcaccaagt

SEQ ID NO: 657042 - DNA, 22 bp, Artificial Sequence
  chemically synthesized
ccctcaaagacttggtgaggat

SEQ ID NO: 657043 - DNA, 22 bp, Artificial Sequence
  chemically synthesized
aaagacttggtgaggattaaat

SEQ ID NO: 657044 - DNA, 22 bp, Artificial Sequence
  chemically synthesized
acatgaattctctcatttaatc

SEQ ID NO: 657045 - DNA, 22 bp, Artificial Sequence
  chemically synthesized
ttcacatgaattctctcattta

SEQ ID NO: 657046 - DNA, 22 bp, Artificial Sequence
  chemically synthesized
gttcacatgaattctctcattt

SEQ ID NO: 657047 - DNA, 22 bp, Artificial Sequence
  chemically synthesized
tgttcacatgaattctctcatt

SEQ ID NO: 657048 - DNA, 22 bp, Artificial Sequence
  chemically synthesized
ggtgaggattaaatgagagaat

SEQ ID NO: 657049 - DNA, 22 bp, Artificial Sequence
  chemically synthesized
gtgaggattaaatgagagaatt

SEQ ID NO: 657050 - DNA, 22 bp, Artificial Sequence
  chemically synthesized
acaaaactttgttcacatgaat

SEQ ID NO: 657051 - DNA, 22 bp, Artificial Sequence
  chemically synthesized
aatgagagaattcatgtgaaca

SEQ ID NO: 657052 - DNA, 22 bp, Artificial Sequence
  chemically synthesized
ctaacaaaactttgttcacatg

SEQ ID NO: 657053 - DNA, 22 bp, Artificial Sequence
  chemically synthesized
ctactaacaaaactttgttcac

SEQ ID NO: 657054 - DNA, 22 bp, Artificial Sequence
  chemically synthesized
ccattgctactaacaaaacttt

SEQ ID NO: 657055 - DNA, 22 bp, Artificial Sequence
  chemically synthesized
ttaccattgctactaacaaaac

SEQ ID NO: 657056 - DNA, 22 bp, Artificial Sequence
  chemically synthesized
atgtgaacaaagttttgttagt

SEQ ID NO: 657057 - DNA, 22 bp, Artificial Sequence
  chemically synthesized
taaataatattgttaccattgc

SEQ ID NO: 657058 - DNA, 22 bp, Artificial Sequence
  chemically synthesized
ataaataatattgttaccattg

SEQ ID NO: 657059 - DNA, 22 bp, Artificial Sequence
  chemically synthesized
tgttagtagcaatggtaacaat

SEQ ID NO: 657060 - DNA, 22 bp, Artificial Sequence
  chemically synthesized
gttagtagcaatggtaacaata

SEQ ID NO: 657061 - DNA, 22 bp, Artificial Sequence
  chemically synthesized
ttagtagcaatggtaacaatat

SEQ ID NO: 657062 - DNA, 22 bp, Artificial Sequence
  chemically synthesized
tgcttataaataatattgttac

SEQ ID NO: 657063 - DNA, 22 bp, Artificial Sequence
  chemically synthesized
gtagcaatggtaacaatattat

SEQ ID NO: 657064 - DNA, 22 bp, Artificial Sequence
  chemically synthesized
ttatgcttataaataatattgt

SEQ ID NO: 657065 - DNA, 22 bp, Artificial Sequence
  chemically synthesized
tacctattatgcttataaataa

SEQ ID NO: 657066 - DNA, 22 bp, Artificial Sequence
  chemically synthesized
gtacctattatgcttataaata

SEQ ID NO: 657067 - DNA, 22 bp, Artificial Sequence
  chemically synthesized
ccatttgtacctattatgctta

SEQ ID NO: 657068 - DNA, 22 bp, Artificial Sequence
  chemically synthesized
accatttgtacctattatgctt

SEQ ID NO: 657069 - DNA, 22 bp, Artificial Sequence
  chemically synthesized
cttaccatttgtacctattatg

SEQ ID NO: 657070 - DNA, 22 bp, Artificial Sequence
  chemically synthesized
tccttaccatttgtacctatta

SEQ ID NO: 657071 - DNA, 22 bp, Artificial Sequence
  chemically synthesized
ctccttaccatttgtacctatt

SEQ ID NO: 657072 - DNA, 22 bp, Artificial Sequence
  chemically synthesized
tttataagcataataggtacaa

SEQ ID NO: 657073 - DNA, 22 bp, Artificial Sequence
  chemically synthesized
ataagcataataggtacaaatg

SEQ ID NO: 657074 - DNA, 22 bp, Artificial Sequence
  chemically synthesized
taagcataataggtacaaatgg

SEQ ID NO: 657075 - DNA, 22 bp, Artificial Sequence
  chemically synthesized
tcatgaaacagcttctccttac

SEQ ID NO: 657076 - DNA, 22 bp, Artificial Sequence
  chemically synthesized
actatcatgaaacagcttctcc

SEQ ID NO: 657077 - DNA, 22 bp, Artificial Sequence
  chemically synthesized
cactatcatgaaacagcttctc

SEQ ID NO: 657078 - DNA, 22 bp, Artificial Sequence
  chemically synthesized
tcactatcatgaaacagcttct

SEQ ID NO: 657079 - DNA, 22 bp, Artificial Sequence
  chemically synthesized
ctttcactatcatgaaacagct

SEQ ID NO: 657080 - DNA, 22 bp, Artificial Sequence
  chemically synthesized
gctttcactatcatgaaacagc

SEQ ID NO: 657081 - DNA, 22 bp, Artificial Sequence
  chemically synthesized
tttcatgatagtgaaagcaaac

SEQ ID NO: 657082 - DNA, 22 bp, Artificial Sequence
  chemically synthesized
ataaccacccatagtttgcttt

SEQ ID NO: 657083 - DNA, 22 bp, Artificial Sequence
  chemically synthesized
cataaccacccatagtttgctt

SEQ ID NO: 657084 - DNA, 22 bp, Artificial Sequence
  chemically synthesized
catgatagtgaaagcaaactat

SEQ ID NO: 657085 - DNA, 22 bp, Artificial Sequence
  chemically synthesized
atgatagtgaaagcaaactatg

SEQ ID NO: 657086 - DNA, 22 bp, Artificial Sequence
  chemically synthesized
gtttcataaccacccatagttt

SEQ ID NO: 657087 - DNA, 22 bp, Artificial Sequence
  chemically synthesized
tggtttcataaccacccatagt

SEQ ID NO: 657088 - DNA, 22 bp, Artificial Sequence
  chemically synthesized
ctctggtttcataaccacccat

SEQ ID NO: 657089 - DNA, 22 bp, Artificial Sequence
  chemically synthesized
ctactctggtttcataaccacc

SEQ ID NO: 657090 - DNA, 22 bp, Artificial Sequence
  chemically synthesized
cctactctggtttcataaccac

SEQ ID NO: 657091 - DNA, 22 bp, Artificial Sequence
  chemically synthesized
tcctactctggtttcataacca

SEQ ID NO: 657092 - DNA, 22 bp, Artificial Sequence
  chemically synthesized
agacctttcctactctggtttc

SEQ ID NO: 657093 - DNA, 22 bp, Artificial Sequence
  chemically synthesized
tgggtggttatgaaaccagagt

SEQ ID NO: 657094 - DNA, 22 bp, Artificial Sequence
  chemically synthesized
tcagacctttcctactctggtt

SEQ ID NO: 657095 - DNA, 22 bp, Artificial Sequence
  chemically synthesized
actctcagacctttcctactct

SEQ ID NO: 657096 - DNA, 22 bp, Artificial Sequence
  chemically synthesized
aactctcagacctttcctactc

SEQ ID NO: 657097 - DNA, 22 bp, Artificial Sequence
  chemically synthesized
tttaactctcagacctttccta

SEQ ID NO: 657098 - DNA, 22 bp, Artificial Sequence
  chemically synthesized
tgaaaccagagtaggaaaggtc

SEQ ID NO: 657099 - DNA, 22 bp, Artificial Sequence
  chemically synthesized
tatttaactctcagacctttcc

SEQ ID NO: 657100 - DNA, 22 bp, Artificial Sequence
  chemically synthesized
ctctatttaactctcagacctt

SEQ ID NO: 657101 - DNA, 22 bp, Artificial Sequence
  chemically synthesized
attcctctatttaactctcaga

SEQ ID NO: 657102 - DNA, 22 bp, Artificial Sequence
  chemically synthesized
gtgaacaaatcctaattcctct

SEQ ID NO: 657103 - DNA, 22 bp, Artificial Sequence
  chemically synthesized
agagttaaatagaggaattagg

SEQ ID NO: 657104 - DNA, 22 bp, Artificial Sequence
  chemically synthesized
tctagtgaacaaatcctaattc

SEQ ID NO: 657105 - DNA, 22 bp, Artificial Sequence
  chemically synthesized
ttgtctagtgaacaaatcctaa

SEQ ID NO: 657106 - DNA, 22 bp, Artificial Sequence
  chemically synthesized
aatagaggaattaggatttgtt

SEQ ID NO: 657107 - DNA, 22 bp, Artificial Sequence
  chemically synthesized
tgttgtctagtgaacaaatcct

SEQ ID NO: 657108 - DNA, 22 bp, Artificial Sequence
  chemically synthesized
ctgttgtctagtgaacaaatcc

SEQ ID NO: 657109 - DNA, 22 bp, Artificial Sequence
  chemically synthesized
tctgttgtctagtgaacaaatc

SEQ ID NO: 657110 - DNA, 22 bp, Artificial Sequence
  chemically synthesized
ggatttgttcactagacaacag

SEQ ID NO: 657111 - DNA, 22 bp, Artificial Sequence
  chemically synthesized
aaaatgtcagtatctttctgtt

SEQ ID NO: 657112 - DNA, 22 bp, Artificial Sequence
  chemically synthesized
gttcactagacaacagaaagat

SEQ ID NO: 657113 - DNA, 22 bp, Artificial Sequence
  chemically synthesized
gaaaatgtcagtatctttctgt

SEQ ID NO: 657114 - DNA, 22 bp, Artificial Sequence
  chemically synthesized
ttcactagacaacagaaagata

SEQ ID NO: 657115 - DNA, 22 bp, Artificial Sequence
  chemically synthesized
actagacaacagaaagatactg

SEQ ID NO: 657116 - DNA, 22 bp, Artificial Sequence
  chemically synthesized
gacaacagaaagatactgacat

SEQ ID NO: 657117 - DNA, 22 bp, Artificial Sequence
  chemically synthesized
ccatatgatgccgtccttgaaa

SEQ ID NO: 657118 - DNA, 22 bp, Artificial Sequence
  chemically synthesized
cccatatgatgccgtccttgaa

SEQ ID NO: 657119 - DNA, 22 bp, Artificial Sequence
  chemically synthesized
acattttcaaggacggcatcat

SEQ ID NO: 657120 - DNA, 22 bp, Artificial Sequence
  chemically synthesized
tcaaggacggcatcatatggga

SEQ ID NO: 657121 - DNA, 22 bp, Artificial Sequence
  chemically synthesized
gagaaaagcatttcccatatga

SEQ ID NO: 657122 - DNA, 22 bp, Artificial Sequence
  chemically synthesized
caaggacggcatcatatgggaa

SEQ ID NO: 657123 - DNA, 22 bp, Artificial Sequence
  chemically synthesized
agagaaaagcatttcccatatg

SEQ ID NO: 657124 - DNA, 22 bp, Artificial Sequence
  chemically synthesized
aaggacggcatcatatgggaaa

SEQ ID NO: 657125 - DNA, 22 bp, Artificial Sequence
  chemically synthesized
tagagaaaagcatttcccatat

SEQ ID NO: 657126 - DNA, 22 bp, Artificial Sequence
  chemically synthesized
gttttagagaaaagcatttccc

SEQ ID NO: 657127 - DNA, 22 bp, Artificial Sequence
  chemically synthesized
atactagttttagagaaaagca

SEQ ID NO: 657128 - DNA, 22 bp, Artificial Sequence
  chemically synthesized
ccctcatactagttttagagaa

SEQ ID NO: 657129 - DNA, 22 bp, Artificial Sequence
  chemically synthesized
ttgccctcatactagttttaga

SEQ ID NO: 657130 - DNA, 22 bp, Artificial Sequence
  chemically synthesized
attgccctcatactagttttag

SEQ ID NO: 657131 - DNA, 22 bp, Artificial Sequence
  chemically synthesized
gtcttattgccctcatactagt

SEQ ID NO: 657132 - DNA, 22 bp, Artificial Sequence
  chemically synthesized
ttctctaaaactagtatgaggg

SEQ ID NO: 657133 - DNA, 22 bp, Artificial Sequence
  chemically synthesized
tctctaaaactagtatgagggc

SEQ ID NO: 657134 - DNA, 22 bp, Artificial Sequence
  chemically synthesized
attggtcttattgccctcatac

SEQ ID NO: 657135 - DNA, 22 bp, Artificial Sequence
  chemically synthesized
ctctaaaactagtatgagggca

SEQ ID NO: 657136 - DNA, 22 bp, Artificial Sequence
  chemically synthesized
cattggtcttattgccctcata

SEQ ID NO: 657137 - DNA, 22 bp, Artificial Sequence
  chemically synthesized
tctaaaactagtatgagggcaa

SEQ ID NO: 657138 - DNA, 22 bp, Artificial Sequence
  chemically synthesized
tcattggtcttattgccctcat

SEQ ID NO: 657139 - DNA, 22 bp, Artificial Sequence
  chemically synthesized
ttcattggtcttattgccctca

SEQ ID NO: 657140 - DNA, 22 bp, Artificial Sequence
  chemically synthesized
taaaactagtatgagggcaata

SEQ ID NO: 657141 - DNA, 22 bp, Artificial Sequence
  chemically synthesized
aaactagtatgagggcaataag

SEQ ID NO: 657142 - DNA, 22 bp, Artificial Sequence
  chemically synthesized
cagtccttttcattggtcttat

SEQ ID NO: 657143 - DNA, 22 bp, Artificial Sequence
  chemically synthesized
gtatgagggcaataagaccaat

SEQ ID NO: 657144 - DNA, 22 bp, Artificial Sequence
  chemically synthesized
acactccagtccttttcattgg

SEQ ID NO: 657145 - DNA, 22 bp, Artificial Sequence
  chemically synthesized
cacactccagtccttttcattg

SEQ ID NO: 657146 - DNA, 22 bp, Artificial Sequence
  chemically synthesized
cacttcacactccagtcctttt

SEQ ID NO: 657147 - DNA, 22 bp, Artificial Sequence
  chemically synthesized
gcaagcctccacttcacactcc

SEQ ID NO: 657148 - DNA, 22 bp, Artificial Sequence
  chemically synthesized
ctagcaagcctccacttcacac

SEQ ID NO: 657149 - DNA, 22 bp, Artificial Sequence
  chemically synthesized
cctagcaagcctccacttcaca

SEQ ID NO: 657150 - DNA, 22 bp, Artificial Sequence
  chemically synthesized
gcttcctagcaagcctccactt

SEQ ID NO: 657151 - DNA, 22 bp, Artificial Sequence
  chemically synthesized
gagtgtgaagtggaggcttgct

SEQ ID NO: 657152 - DNA, 22 bp, Artificial Sequence
  chemically synthesized
cactggcttcctagcaagcctc

SEQ ID NO: 657153 - DNA, 22 bp, Artificial Sequence
  chemically synthesized
atcattgcactggcttcctagc

SEQ ID NO: 657154 - DNA, 22 bp, Artificial Sequence
  chemically synthesized
tcatcattgcactggcttccta

SEQ ID NO: 657155 - DNA, 22 bp, Artificial Sequence
  chemically synthesized
ctcatcattgcactggcttcct

SEQ ID NO: 657156 - DNA, 22 bp, Artificial Sequence
  chemically synthesized
caggccttctcatcattgcact

SEQ ID NO: 657157 - DNA, 22 bp, Artificial Sequence
  chemically synthesized
gctaggaagccagtgcaatgat

SEQ ID NO: 657158 - DNA, 22 bp, Artificial Sequence
  chemically synthesized
ccaggccttctcatcattgcac

SEQ ID NO: 657159 - DNA, 22 bp, Artificial Sequence
  chemically synthesized
ctaggaagccagtgcaatgatg

SEQ ID NO: 657160 - DNA, 22 bp, Artificial Sequence
  chemically synthesized
tttccaggccttctcatcattg

SEQ ID NO: 657161 - DNA, 22 bp, Artificial Sequence
  chemically synthesized
ggaagccagtgcaatgatgaga

SEQ ID NO: 657162 - DNA, 22 bp, Artificial Sequence
  chemically synthesized
cattgtttccaggccttctcat

SEQ ID NO: 657163 - DNA, 22 bp, Artificial Sequence
  chemically synthesized
acattgtttccaggccttctca

SEQ ID NO: 657164 - DNA, 22 bp, Artificial Sequence
  chemically synthesized
ttacattgtttccaggccttct

SEQ ID NO: 657165 - DNA, 22 bp, Artificial Sequence
  chemically synthesized
ccattcttacattgtttccagg

SEQ ID NO: 657166 - DNA, 22 bp, Artificial Sequence
  chemically synthesized
cattgccattcttacattgttt

SEQ ID NO: 657167 - DNA, 22 bp, Artificial Sequence
  chemically synthesized
ccattgccattcttacattgtt

SEQ ID NO: 657168 - DNA, 22 bp, Artificial Sequence
  chemically synthesized
tccattgccattcttacattgt

SEQ ID NO: 657169 - DNA, 22 bp, Artificial Sequence
  chemically synthesized
ctttccattgccattcttacat

SEQ ID NO: 657170 - DNA, 22 bp, Artificial Sequence
  chemically synthesized
attgctttccattgccattctt

SEQ ID NO: 657171 - DNA, 22 bp, Artificial Sequence
  chemically synthesized
gattgctttccattgccattct

SEQ ID NO: 657172 - DNA, 22 bp, Artificial Sequence
  chemically synthesized
gaaacaatgtaagaatggcaat

SEQ ID NO: 657173 - DNA, 22 bp, Artificial Sequence
  chemically synthesized
tttgattgctttccattgccat

SEQ ID NO: 657174 - DNA, 22 bp, Artificial Sequence
  chemically synthesized
gtttgattgctttccattgcca

SEQ ID NO: 657175 - DNA, 22 bp, Artificial Sequence
  chemically synthesized
tgtttgattgctttccattgcc

SEQ ID NO: 657176 - DNA, 22 bp, Artificial Sequence
  chemically synthesized
gggaaagaaacatgttttgttt

SEQ ID NO: 657177 - DNA, 22 bp, Artificial Sequence
  chemically synthesized
agggaaagaaacatgttttgtt

SEQ ID NO: 657178 - DNA, 22 bp, Artificial Sequence
  chemically synthesized
tagggaaagaaacatgttttgt

SEQ ID NO: 657179 - DNA, 22 bp, Artificial Sequence
  chemically synthesized
ttagggaaagaaacatgttttg

SEQ ID NO: 657180 - DNA, 22 bp, Artificial Sequence
  chemically synthesized
tttagggaaagaaacatgtttt

SEQ ID NO: 657181 - DNA, 22 bp, Artificial Sequence
  chemically synthesized
ttttagggaaagaaacatgttt

SEQ ID NO: 657182 - DNA, 22 bp, Artificial Sequence
  chemically synthesized
tttttagggaaagaaacatgtt

SEQ ID NO: 657183 - DNA, 22 bp, Artificial Sequence
  chemically synthesized
tttttttagggaaagaaacatg

SEQ ID NO: 657184 - DNA, 22 bp, Artificial Sequence
  chemically synthesized
cctctttttttagggaaagaaa

SEQ ID NO: 657185 - DNA, 22 bp, Artificial Sequence
  chemically synthesized
gtaaagtgctgcctcttttttt

SEQ ID NO: 657186 - DNA, 22 bp, Artificial Sequence
  chemically synthesized
ctttccctaaaaaaagaggcag

SEQ ID NO: 657187 - DNA, 22 bp, Artificial Sequence
  chemically synthesized
tttccctaaaaaaagaggcagc

SEQ ID NO: 657188 - DNA, 22 bp, Artificial Sequence
  chemically synthesized
tccctaaaaaaagaggcagcac

SEQ ID NO: 657189 - DNA, 22 bp, Artificial Sequence
  chemically synthesized
ccctaaaaaaagaggcagcact

SEQ ID NO: 657190 - DNA, 22 bp, Artificial Sequence
  chemically synthesized
cctaaaaaaagaggcagcactt

SEQ ID NO: 657191 - DNA, 22 bp, Artificial Sequence
  chemically synthesized
gaaaaaaaattagtaaagtgct

SEQ ID NO: 657192 - DNA, 22 bp, Artificial Sequence
  chemically synthesized
aaaaaagaggcagcactttact

SEQ ID NO: 657193 - DNA, 22 bp, Artificial Sequence
  chemically synthesized
taattagaaaaaaaattagtaa

SEQ ID NO: 657194 - DNA, 22 bp, Artificial Sequence
  chemically synthesized
ataattagaaaaaaaattagta

SEQ ID NO: 657195 - DNA, 22 bp, Artificial Sequence
  chemically synthesized
aacatttataattagaaaaaaa

SEQ ID NO: 657196 - DNA, 22 bp, Artificial Sequence
  chemically synthesized
gaacatttataattagaaaaaa

SEQ ID NO: 657197 - DNA, 22 bp, Artificial Sequence
  chemically synthesized
tgaacatttataattagaaaaa

SEQ ID NO: 657198 - DNA, 22 bp, Artificial Sequence
  chemically synthesized
tttgaacatttataattagaaa

SEQ ID NO: 657199 - DNA, 22 bp, Artificial Sequence
  chemically synthesized
tactaattttttttctaattat

SEQ ID NO: 657200 - DNA, 22 bp, Artificial Sequence
  chemically synthesized
ctttgaacatttataattagaa

SEQ ID NO: 657201 - DNA, 22 bp, Artificial Sequence
  chemically synthesized
actaattttttttctaattata

SEQ ID NO: 657202 - DNA, 22 bp, Artificial Sequence
  chemically synthesized
ctaattttttttctaattataa

SEQ ID NO: 657203 - DNA, 22 bp, Artificial Sequence
  chemically synthesized
ttctttgaacatttataattag

SEQ ID NO: 657204 - DNA, 22 bp, Artificial Sequence
  chemically synthesized
cttctttgaacatttataatta

SEQ ID NO: 657205 - DNA, 22 bp, Artificial Sequence
  chemically synthesized
tcttctttgaacatttataatt

SEQ ID NO: 657206 - DNA, 22 bp, Artificial Sequence
  chemically synthesized
attttttttctaattataaatg

SEQ ID NO: 657207 - DNA, 22 bp, Artificial Sequence
  chemically synthesized
tttttctaattataaatgttca

SEQ ID NO: 657208 - DNA, 22 bp, Artificial Sequence
  chemically synthesized
agttttcttctttgaacattta

SEQ ID NO: 657209 - DNA, 22 bp, Artificial Sequence
  chemically synthesized
ttttctaattataaatgttcaa

SEQ ID NO: 657210 - DNA, 22 bp, Artificial Sequence
  chemically synthesized
tttctaattataaatgttcaaa

SEQ ID NO: 657211 - DNA, 22 bp, Artificial Sequence
  chemically synthesized
tgagttttcttctttgaacatt

SEQ ID NO: 657212 - DNA, 22 bp, Artificial Sequence
  chemically synthesized
ttctaattataaatgttcaaag

SEQ ID NO: 657213 - DNA, 22 bp, Artificial Sequence
  chemically synthesized
ctgagttttcttctttgaacat

SEQ ID NO: 657214 - DNA, 22 bp, Artificial Sequence
  chemically synthesized
tctaattataaatgttcaaaga

SEQ ID NO: 657215 - DNA, 22 bp, Artificial Sequence
  chemically synthesized
tctgagttttcttctttgaaca

SEQ ID NO: 657216 - DNA, 22 bp, Artificial Sequence
  chemically synthesized
ctaattataaatgttcaaagaa

SEQ ID NO: 657217 - DNA, 22 bp, Artificial Sequence
  chemically synthesized
taattataaatgttcaaagaag

SEQ ID NO: 657218 - DNA, 22 bp, Artificial Sequence
  chemically synthesized
ttttctgagttttcttctttga

SEQ ID NO: 657219 - DNA, 22 bp, Artificial Sequence
  chemically synthesized
attataaatgttcaaagaagaa

SEQ ID NO: 657220 - DNA, 22 bp, Artificial Sequence
  chemically synthesized
attttctgagttttcttctttg

SEQ ID NO: 657221 - DNA, 22 bp, Artificial Sequence
  chemically synthesized
tattttctgagttttcttcttt

SEQ ID NO: 657222 - DNA, 22 bp, Artificial Sequence
  chemically synthesized
ttattttctgagttttcttctt

SEQ ID NO: 657223 - DNA, 22 bp, Artificial Sequence
  chemically synthesized
taaatgttcaaagaagaaaact

SEQ ID NO: 657224 - DNA, 22 bp, Artificial Sequence
  chemically synthesized
tttttattttctgagttttctt

SEQ ID NO: 657225 - DNA, 22 bp, Artificial Sequence
  chemically synthesized
tactatttttattttctgagtt

SEQ ID NO: 657226 - DNA, 22 bp, Artificial Sequence
  chemically synthesized
tgtactatttttattttctgag

SEQ ID NO: 657227 - DNA, 22 bp, Artificial Sequence
  chemically synthesized
aaagaagaaaactcagaaaata

SEQ ID NO: 657228 - DNA, 22 bp, Artificial Sequence
  chemically synthesized
tctgtactatttttattttctg

SEQ ID NO: 657229 - DNA, 22 bp, Artificial Sequence
  chemically synthesized
ctctgtactatttttattttct

SEQ ID NO: 657230 - DNA, 22 bp, Artificial Sequence
  chemically synthesized
tctctgtactatttttattttc

SEQ ID NO: 657231 - DNA, 22 bp, Artificial Sequence
  chemically synthesized
attttctctgtactatttttat

SEQ ID NO: 657232 - DNA, 22 bp, Artificial Sequence
  chemically synthesized
gattttctctgtactattttta

SEQ ID NO: 657233 - DNA, 22 bp, Artificial Sequence
  chemically synthesized
tgattttctctgtactattttt

SEQ ID NO: 657234 - DNA, 22 bp, Artificial Sequence
  chemically synthesized
ttgattttctctgtactatttt

SEQ ID NO: 657235 - DNA, 22 bp, Artificial Sequence
  chemically synthesized
agaaaataaaaatagtacagag

SEQ ID NO: 657236 - DNA, 22 bp, Artificial Sequence
  chemically synthesized
gggggaaatcagtcaagatatg

SEQ ID NO: 657237 - DNA, 22 bp, Artificial Sequence
  chemically synthesized
ttaccaccattcatatcttgac

SEQ ID NO: 657238 - DNA, 22 bp, Artificial Sequence
  chemically synthesized
ccaccattcatatcttgactga

SEQ ID NO: 657239 - DNA, 22 bp, Artificial Sequence
  chemically synthesized
tgagactggggggaaatcagtc

SEQ ID NO: 657240 - DNA, 22 bp, Artificial Sequence
  chemically synthesized
tatgagactggggggaaatcag

SEQ ID NO: 657241 - DNA, 22 bp, Artificial Sequence
  chemically synthesized
ctatgagactggggggaaatca

SEQ ID NO: 657242 - DNA, 22 bp, Artificial Sequence
  chemically synthesized
tctatgagactggggggaaatc

SEQ ID NO: 657243 - DNA, 22 bp, Artificial Sequence
  chemically synthesized
atatcttgactgatttcccccc

SEQ ID NO: 657244 - DNA, 22 bp, Artificial Sequence
  chemically synthesized
gactgatttccccccagtctca

SEQ ID NO: 657245 - DNA, 22 bp, Artificial Sequence
  chemically synthesized
aaatgttttctatgagactggg

SEQ ID NO: 657246 - DNA, 22 bp, Artificial Sequence
  chemically synthesized
actgatttccccccagtctcat

SEQ ID NO: 657247 - DNA, 22 bp, Artificial Sequence
  chemically synthesized
gaaatgttttctatgagactgg

SEQ ID NO: 657248 - DNA, 22 bp, Artificial Sequence
  chemically synthesized
atttccccccagtctcatagaa

SEQ ID NO: 657249 - DNA, 22 bp, Artificial Sequence
  chemically synthesized
ccccccagtctcatagaaaaca

SEQ ID NO: 657250 - DNA, 22 bp, Artificial Sequence
  chemically synthesized
cccccagtctcatagaaaacat

SEQ ID NO: 657251 - DNA, 22 bp, Artificial Sequence
  chemically synthesized
atagaaaacatttcaaggctgg

SEQ ID NO: 657252 - DNA, 22 bp, Artificial Sequence
  chemically synthesized
caaggctggatgccgtggctca

SEQ ID NO: 657253 - DNA, 22 bp, Artificial Sequence
  chemically synthesized
ggagtacaggcgtgagccacgg

SEQ ID NO: 657254 - DNA, 22 bp, Artificial Sequence
  chemically synthesized
aaggctggatgccgtggctcac

SEQ ID NO: 657255 - DNA, 22 bp, Artificial Sequence
  chemically synthesized
gatgccgtggctcacgcctgta

SEQ ID NO: 657256 - DNA, 22 bp, Artificial Sequence
  chemically synthesized
ccaaaatgttgggagtacaggc

SEQ ID NO: 657257 - DNA, 22 bp, Artificial Sequence
  chemically synthesized
agcctcccaaaatgttgggagt

SEQ ID NO: 657258 - DNA, 22 bp, Artificial Sequence
  chemically synthesized
acgcctgtactcccaacatttt

SEQ ID NO: 657259 - DNA, 22 bp, Artificial Sequence
  chemically synthesized
tactcccaacattttgggaggc

SEQ ID NO: 657260 - DNA, 22 bp, Artificial Sequence
  chemically synthesized
tccacccacctcagcctcccaa

SEQ ID NO: 657261 - DNA, 22 bp, Artificial Sequence
  chemically synthesized
ccaacattttgggaggctgagg

SEQ ID NO: 657262 - DNA, 22 bp, Artificial Sequence
  chemically synthesized
aagctgtccacccacctcagcc

SEQ ID NO: 657263 - DNA, 22 bp, Artificial Sequence
  chemically synthesized
ggctcaagctgtccacccacct

SEQ ID NO: 657264 - DNA, 22 bp, Artificial Sequence
  chemically synthesized
gggctcaagctgtccacccacc

SEQ ID NO: 657265 - DNA, 22 bp, Artificial Sequence
  chemically synthesized
tgggaggctgaggtgggtggac

SEQ ID NO: 657266 - DNA, 22 bp, Artificial Sequence
  chemically synthesized
gggaggctgaggtgggtggaca

SEQ ID NO: 657267 - DNA, 22 bp, Artificial Sequence
  chemically synthesized
ttgggctcaagctgtccaccca

SEQ ID NO: 657268 - DNA, 22 bp, Artificial Sequence
  chemically synthesized
ggaggctgaggtgggtggacag

SEQ ID NO: 657269 - DNA, 22 bp, Artificial Sequence
  chemically synthesized
gagctcttgggctcaagctgtc

SEQ ID NO: 657270 - DNA, 22 bp, Artificial Sequence
  chemically synthesized
aggtgggtggacagcttgagcc

SEQ ID NO: 657271 - DNA, 22 bp, Artificial Sequence
  chemically synthesized
gtctcgagctcttgggctcaag

SEQ ID NO: 657272 - DNA, 22 bp, Artificial Sequence
  chemically synthesized
ggctggtctcgagctcttgggc

SEQ ID NO: 657273 - DNA, 22 bp, Artificial Sequence
  chemically synthesized
cctaggctggtctcgagctctt

SEQ ID NO: 657274 - DNA, 22 bp, Artificial Sequence
  chemically synthesized
gagcccaagagctcgagaccag

SEQ ID NO: 657275 - DNA, 22 bp, Artificial Sequence
  chemically synthesized
agcccaagagctcgagaccagc

SEQ ID NO: 657276 - DNA, 22 bp, Artificial Sequence
  chemically synthesized
gccatgttgcctaggctggtct

SEQ ID NO: 657277 - DNA, 22 bp, Artificial Sequence
  chemically synthesized
tcgccatgttgcctaggctggt

SEQ ID NO: 657278 - DNA, 22 bp, Artificial Sequence
  chemically synthesized
gagaccagcctaggcaacatgg

SEQ ID NO: 657279 - DNA, 22 bp, Artificial Sequence
  chemically synthesized
ggcaacatggcgagagaccctg

SEQ ID NO: 657280 - DNA, 22 bp, Artificial Sequence
  chemically synthesized
tacacacacacacacacacaca

SEQ ID NO: 657281 - DNA, 22 bp, Artificial Sequence
  chemically synthesized
gtgtatgtgtgtgtgtgtgcgt

SEQ ID NO: 657282 - DNA, 22 bp, Artificial Sequence
  chemically synthesized
ggtgtatgtgtgtgtgtgtgcg

SEQ ID NO: 657283 - DNA, 22 bp, Artificial Sequence
  chemically synthesized
tggtgtatgtgtgtgtgtgtgc

SEQ ID NO: 657284 - DNA, 22 bp, Artificial Sequence
  chemically synthesized
ttggtgtatgtgtgtgtgtgtg

SEQ ID NO: 657285 - DNA, 22 bp, Artificial Sequence
  chemically synthesized
tttggtgtatgtgtgtgtgtgt

SEQ ID NO: 657286 - DNA, 22 bp, Artificial Sequence
  chemically synthesized
ttttggtgtatgtgtgtgtgtg

SEQ ID NO: 657287 - DNA, 22 bp, Artificial Sequence
  chemically synthesized
gcatttttttggtgtatgtgtg

SEQ ID NO: 657288 - DNA, 22 bp, Artificial Sequence
  chemically synthesized
caggcatggaccgccacgcctg

SEQ ID NO: 657289 - DNA, 22 bp, Artificial Sequence
  chemically synthesized
ggactacaggcatggaccgcca

SEQ ID NO: 657290 - DNA, 22 bp, Artificial Sequence
  chemically synthesized
agtagctgggactacaggcatg

SEQ ID NO: 657291 - DNA, 22 bp, Artificial Sequence
  chemically synthesized
ctgagtagctgggactacaggc

SEQ ID NO: 657292 - DNA, 22 bp, Artificial Sequence
  chemically synthesized
agcctcctgagtagctgggact

SEQ ID NO: 657293 - DNA, 22 bp, Artificial Sequence
  chemically synthesized
ccacctcagcctcctgagtagc

SEQ ID NO: 657294 - DNA, 22 bp, Artificial Sequence
  chemically synthesized
tagtcccagctactcaggaggc

SEQ ID NO: 657295 - DNA, 22 bp, Artificial Sequence
  chemically synthesized
aagtgatcctcccacctcagcc

SEQ ID NO: 657296 - DNA, 22 bp, Artificial Sequence
  chemically synthesized
ctcaggaggctgaggtgggagg

SEQ ID NO: 657297 - DNA, 22 bp, Artificial Sequence
  chemically synthesized
ggctcaagtgatcctcccacct

SEQ ID NO: 657298 - DNA, 22 bp, Artificial Sequence
  chemically synthesized
tgggctcaagtgatcctcccac

SEQ ID NO: 657299 - DNA, 22 bp, Artificial Sequence
  chemically synthesized
aggaggctgaggtgggaggatc

SEQ ID NO: 657300 - DNA, 22 bp, Artificial Sequence
  chemically synthesized
gacctctgggctcaagtgatcc

SEQ ID NO: 657301 - DNA, 22 bp, Artificial Sequence
  chemically synthesized
aggtgggaggatcacttgagcc

SEQ ID NO: 657302 - DNA, 22 bp, Artificial Sequence
  chemically synthesized
cagcctcgacctctgggctcaa

SEQ ID NO: 657303 - DNA, 22 bp, Artificial Sequence
  chemically synthesized
attgcagcctcgacctctgggc

SEQ ID NO: 657304 - DNA, 22 bp, Artificial Sequence
  chemically synthesized
gagcccagaggtcgaggctgca

SEQ ID NO: 657305 - DNA, 22 bp, Artificial Sequence
  chemically synthesized
agcccagaggtcgaggctgcaa

SEQ ID NO: 657306 - DNA, 22 bp, Artificial Sequence
  chemically synthesized
gagtgcagtggcacgatcacag

SEQ ID NO: 657307 - DNA, 22 bp, Artificial Sequence
  chemically synthesized
caatgagctgtgatcgtgccac

SEQ ID NO: 657308 - DNA, 22 bp, Artificial Sequence
  chemically synthesized
gtcacccaggctggagtgcagt

SEQ ID NO: 657309 - DNA, 22 bp, Artificial Sequence
  chemically synthesized
cgtcacccaggctggagtgcag

SEQ ID NO: 657310 - DNA, 22 bp, Artificial Sequence
  chemically synthesized
tgatcgtgccactgcactccag

SEQ ID NO: 657311 - DNA, 22 bp, Artificial Sequence
  chemically synthesized
acttcgtcacccaggctggagt

SEQ ID NO: 657312 - DNA, 22 bp, Artificial Sequence
  chemically synthesized
cactccagcctgggtgacgaag

SEQ ID NO: 657313 - DNA, 22 bp, Artificial Sequence
  chemically synthesized
agaaggggtctaacttcgtcac

SEQ ID NO: 657314 - DNA, 22 bp, Artificial Sequence
  chemically synthesized
cagaaggggtctaacttcgtca

SEQ ID NO: 657315 - DNA, 22 bp, Artificial Sequence
  chemically synthesized
tcagaaggggtctaacttcgtc

SEQ ID NO: 657316 - DNA, 22 bp, Artificial Sequence
  chemically synthesized
cagcctgggtgacgaagttaga

SEQ ID NO: 657317 - DNA, 22 bp, Artificial Sequence
  chemically synthesized
ttttcagaaggggtctaacttc

SEQ ID NO: 657318 - DNA, 22 bp, Artificial Sequence
  chemically synthesized
gttttcagaaggggtctaactt

SEQ ID NO: 657319 - DNA, 22 bp, Artificial Sequence
  chemically synthesized
tgttttcagaaggggtctaact

SEQ ID NO: 657320 - DNA, 22 bp, Artificial Sequence
  chemically synthesized
ttttgttttcagaaggggtcta

SEQ ID NO: 657321 - DNA, 22 bp, Artificial Sequence
  chemically synthesized
ggtgacgaagttagaccccttc

SEQ ID NO: 657322 - DNA, 22 bp, Artificial Sequence
  chemically synthesized
gttttgttttcagaaggggtct

SEQ ID NO: 657323 - DNA, 22 bp, Artificial Sequence
  chemically synthesized
tgttttgttttcagaaggggtc

SEQ ID NO: 657324 - DNA, 22 bp, Artificial Sequence
  chemically synthesized
gaccccttctgaaaacaaaaca

SEQ ID NO: 657325 - DNA, 22 bp, Artificial Sequence
  chemically synthesized
aaatgtgaaatgtgttttgttt

SEQ ID NO: 657326 - DNA, 22 bp, Artificial Sequence
  chemically synthesized
gaaatgtgaaatgtgttttgtt

SEQ ID NO: 657327 - DNA, 22 bp, Artificial Sequence
  chemically synthesized
tgaaatgtgaaatgtgttttgt

SEQ ID NO: 657328 - DNA, 22 bp, Artificial Sequence
  chemically synthesized
ctgaaaacaaaacaaaacacat

SEQ ID NO: 657329 - DNA, 22 bp, Artificial Sequence
  chemically synthesized
tgaaaacaaaacaaaacacatt

SEQ ID NO: 657330 - DNA, 22 bp, Artificial Sequence
  chemically synthesized
tttgaaatgtgaaatgtgtttt

SEQ ID NO: 657331 - DNA, 22 bp, Artificial Sequence
  chemically synthesized
aaaacaaaacaaaacacatttc

SEQ ID NO: 657332 - DNA, 22 bp, Artificial Sequence
  chemically synthesized
caagctctttgaaatgtgaaat

SEQ ID NO: 657333 - DNA, 22 bp, Artificial Sequence
  chemically synthesized
gccagccagtctccaagctctt

SEQ ID NO: 657334 - DNA, 22 bp, Artificial Sequence
  chemically synthesized
cacatttcaaagagcttggaga

SEQ ID NO: 657335 - DNA, 22 bp, Artificial Sequence
  chemically synthesized
acatttcaaagagcttggagac

SEQ ID NO: 657336 - DNA, 22 bp, Artificial Sequence
  chemically synthesized
gttggccagccagtctccaagc

SEQ ID NO: 657337 - DNA, 22 bp, Artificial Sequence
  chemically synthesized
ctggttggccagccagtctcca

SEQ ID NO: 657338 - DNA, 22 bp, Artificial Sequence
  chemically synthesized
caaagagcttggagactggctg

SEQ ID NO: 657339 - DNA, 22 bp, Artificial Sequence
  chemically synthesized
aaagagcttggagactggctgg

SEQ ID NO: 657340 - DNA, 22 bp, Artificial Sequence
  chemically synthesized
aatgcctcctggttggccagcc

SEQ ID NO: 657341 - DNA, 22 bp, Artificial Sequence
  chemically synthesized
ttgaatgcctcctggttggcca

SEQ ID NO: 657342 - DNA, 22 bp, Artificial Sequence
  chemically synthesized
gttgaatgcctcctggttggcc

SEQ ID NO: 657343 - DNA, 22 bp, Artificial Sequence
  chemically synthesized
ggagactggctggccaaccagg

SEQ ID NO: 657344 - DNA, 22 bp, Artificial Sequence
  chemically synthesized
gagactggctggccaaccagga

SEQ ID NO: 657345 - DNA, 22 bp, Artificial Sequence
  chemically synthesized
catatttgttgaatgcctcctg

SEQ ID NO: 657346 - DNA, 22 bp, Artificial Sequence
  chemically synthesized
gcatatttgttgaatgcctcct

SEQ ID NO: 657347 - DNA, 22 bp, Artificial Sequence
  chemically synthesized
gctggccaaccaggaggcattc

SEQ ID NO: 657348 - DNA, 22 bp, Artificial Sequence
  chemically synthesized
gccaaccaggaggcattcaaca

SEQ ID NO: 657349 - DNA, 22 bp, Artificial Sequence
  chemically synthesized
agtccatccttgcatatttgtt

SEQ ID NO: 657350 - DNA, 22 bp, Artificial Sequence
  chemically synthesized
aattcagtccatccttgcatat

SEQ ID NO: 657351 - DNA, 22 bp, Artificial Sequence
  chemically synthesized
gaattcagtccatccttgcata

SEQ ID NO: 657352 - DNA, 22 bp, Artificial Sequence
  chemically synthesized
tgaattcagtccatccttgcat

SEQ ID NO: 657353 - DNA, 22 bp, Artificial Sequence
  chemically synthesized
aacaaatatgcaaggatggact

SEQ ID NO: 657354 - DNA, 22 bp, Artificial Sequence
  chemically synthesized
aaagctttgaattcagtccatc

SEQ ID NO: 657355 - DNA, 22 bp, Artificial Sequence
  chemically synthesized
agtctcaaagctttgaattcag

SEQ ID NO: 657356 - DNA, 22 bp, Artificial Sequence
  chemically synthesized
tcagtctcaaagctttgaattc

SEQ ID NO: 657357 - DNA, 22 bp, Artificial Sequence
  chemically synthesized
tattctcagtctcaaagctttg

SEQ ID NO: 657358 - DNA, 22 bp, Artificial Sequence
  chemically synthesized
tgtattctcagtctcaaagctt

SEQ ID NO: 657359 - DNA, 22 bp, Artificial Sequence
  chemically synthesized
aattcaaagctttgagactgag

SEQ ID NO: 657360 - DNA, 22 bp, Artificial Sequence
  chemically synthesized
aaagctttgagactgagaatac

SEQ ID NO: 657361 - DNA, 22 bp, Artificial Sequence
  chemically synthesized
taataacaactctgtattctca

SEQ ID NO: 657362 - DNA, 22 bp, Artificial Sequence
  chemically synthesized
tgtaataacaactctgtattct

SEQ ID NO: 657363 - DNA, 22 bp, Artificial Sequence
  chemically synthesized
tgagactgagaatacagagttg

SEQ ID NO: 657364 - DNA, 22 bp, Artificial Sequence
  chemically synthesized
tctctgtaataacaactctgta

SEQ ID NO: 657365 - DNA, 22 bp, Artificial Sequence
  chemically synthesized
gagactgagaatacagagttgt

SEQ ID NO: 657366 - DNA, 22 bp, Artificial Sequence
  chemically synthesized
agactgagaatacagagttgtt

SEQ ID NO: 657367 - DNA, 22 bp, Artificial Sequence
  chemically synthesized
tgtctctgtaataacaactctg

SEQ ID NO: 657368 - DNA, 22 bp, Artificial Sequence
  chemically synthesized
ctgtctctgtaataacaactct

SEQ ID NO: 657369 - DNA, 22 bp, Artificial Sequence
  chemically synthesized
agaatacagagttgttattaca

SEQ ID NO: 657370 - DNA, 22 bp, Artificial Sequence
  chemically synthesized
catttctgtctctgtaataaca

SEQ ID NO: 657371 - DNA, 22 bp, Artificial Sequence
  chemically synthesized
gttacatttctgtctctgtaat

SEQ ID NO: 657372 - DNA, 22 bp, Artificial Sequence
  chemically synthesized
ggttacatttctgtctctgtaa

SEQ ID NO: 657373 - DNA, 22 bp, Artificial Sequence
  chemically synthesized
gtttggttacatttctgtctct

SEQ ID NO: 657374 - DNA, 22 bp, Artificial Sequence
  chemically synthesized
tggtttggttacatttctgtct

SEQ ID NO: 657375 - DNA, 22 bp, Artificial Sequence
  chemically synthesized
ttattacagagacagaaatgta

SEQ ID NO: 657376 - DNA, 22 bp, Artificial Sequence
  chemically synthesized
ttacagagacagaaatgtaacc

SEQ ID NO: 657377 - DNA, 22 bp, Artificial Sequence
  chemically synthesized
cagagacagaaatgtaaccaaa

SEQ ID NO: 657378 - DNA, 22 bp, Artificial Sequence
  chemically synthesized
agcccatgtctctggtttggtt

SEQ ID NO: 657379 - DNA, 22 bp, Artificial Sequence
  chemically synthesized
ccctaagcccatgtctctggtt

SEQ ID NO: 657380 - DNA, 22 bp, Artificial Sequence
  chemically synthesized
ctcccctaagcccatgtctctg

SEQ ID NO: 657381 - DNA, 22 bp, Artificial Sequence
  chemically synthesized
ctactcccctaagcccatgtct

SEQ ID NO: 657382 - DNA, 22 bp, Artificial Sequence
  chemically synthesized
gataacctcctactcccctaag

SEQ ID NO: 657383 - DNA, 22 bp, Artificial Sequence
  chemically synthesized
ctggataacctcctactcccct

SEQ ID NO: 657384 - DNA, 22 bp, Artificial Sequence
  chemically synthesized
gctggataacctcctactcccc

SEQ ID NO: 657385 - DNA, 22 bp, Artificial Sequence
  chemically synthesized
tgctggataacctcctactccc

SEQ ID NO: 657386 - DNA, 22 bp, Artificial Sequence
  chemically synthesized
ttgctggataacctcctactcc

SEQ ID NO: 657387 - DNA, 22 bp, Artificial Sequence
  chemically synthesized
catccttttgctggataacctc

SEQ ID NO: 657388 - DNA, 22 bp, Artificial Sequence
  chemically synthesized
aggggagtaggaggttatccag

SEQ ID NO: 657389 - DNA, 22 bp, Artificial Sequence
  chemically synthesized
ggggagtaggaggttatccagc

SEQ ID NO: 657390 - DNA, 22 bp, Artificial Sequence
  chemically synthesized
ctacatccttttgctggataac

SEQ ID NO: 657391 - DNA, 22 bp, Artificial Sequence
  chemically synthesized
cctgctacatccttttgctgga

SEQ ID NO: 657392 - DNA, 22 bp, Artificial Sequence
  chemically synthesized
tgcctgctacatccttttgctg

SEQ ID NO: 657393 - DNA, 22 bp, Artificial Sequence
  chemically synthesized
ctgcctgctacatccttttgct

SEQ ID NO: 657394 - DNA, 22 bp, Artificial Sequence
  chemically synthesized
catttctgcctgctacatcctt

SEQ ID NO: 657395 - DNA, 22 bp, Artificial Sequence
  chemically synthesized
ttccatttctgcctgctacatc

SEQ ID NO: 657396 - DNA, 22 bp, Artificial Sequence
  chemically synthesized
tccagcaaaaggatgtagcagg

SEQ ID NO: 657397 - DNA, 22 bp, Artificial Sequence
  chemically synthesized
tcaggagaccaacctattccat

SEQ ID NO: 657398 - DNA, 22 bp, Artificial Sequence
  chemically synthesized
atcaggagaccaacctattcca

SEQ ID NO: 657399 - DNA, 22 bp, Artificial Sequence
  chemically synthesized
ccccccttatcaggagaccaac

SEQ ID NO: 657400 - DNA, 22 bp, Artificial Sequence
  chemically synthesized
ggctgccccccttatcaggaga

SEQ ID NO: 657401 - DNA, 22 bp, Artificial Sequence
  chemically synthesized
cctgggctgccccccttatcag

SEQ ID NO: 657402 - DNA, 22 bp, Artificial Sequence
  chemically synthesized
ccctgggctgccccccttatca

SEQ ID NO: 657403 - DNA, 22 bp, Artificial Sequence
  chemically synthesized
tccctgggctgccccccttatc

SEQ ID NO: 657404 - DNA, 22 bp, Artificial Sequence
  chemically synthesized
ctttccctgggctgcccccctt

SEQ ID NO: 657405 - DNA, 22 bp, Artificial Sequence
  chemically synthesized
gtctcctgataaggggggcagc

SEQ ID NO: 657406 - DNA, 22 bp, Artificial Sequence
  chemically synthesized
tgctttccctgggctgcccccc

SEQ ID NO: 657407 - DNA, 22 bp, Artificial Sequence
  chemically synthesized
ctgataaggggggcagcccagg

SEQ ID NO: 657408 - DNA, 22 bp, Artificial Sequence
  chemically synthesized
ataaggggggcagcccagggaa

SEQ ID NO: 657409 - DNA, 22 bp, Artificial Sequence
  chemically synthesized
tcaggataagcggtggccatac

SEQ ID NO: 657410 - DNA, 22 bp, Artificial Sequence
  chemically synthesized
gttgtcaggataagcggtggcc

SEQ ID NO: 657411 - DNA, 22 bp, Artificial Sequence
  chemically synthesized
ggttgtcaggataagcggtggc

SEQ ID NO: 657412 - DNA, 22 bp, Artificial Sequence
  chemically synthesized
ctgtatggccaccgcttatcct

SEQ ID NO: 657413 - DNA, 22 bp, Artificial Sequence
  chemically synthesized
gatttggttgtcaggataagcg

SEQ ID NO: 657414 - DNA, 22 bp, Artificial Sequence
  chemically synthesized
tgtatggccaccgcttatcctg

SEQ ID NO: 657415 - DNA, 22 bp, Artificial Sequence
  chemically synthesized
ggatttggttgtcaggataagc

SEQ ID NO: 657416 - DNA, 22 bp, Artificial Sequence
  chemically synthesized
tatggccaccgcttatcctgac

SEQ ID NO: 657417 - DNA, 22 bp, Artificial Sequence
  chemically synthesized
ttggatttggttgtcaggataa

SEQ ID NO: 657418 - DNA, 22 bp, Artificial Sequence
  chemically synthesized
gccctcttggatttggttgtca

SEQ ID NO: 657419 - DNA, 22 bp, Artificial Sequence
  chemically synthesized
tggccctcttggatttggttgt

SEQ ID NO: 657420 - DNA, 22 bp, Artificial Sequence
  chemically synthesized
atcctgacaaccaaatccaaga

SEQ ID NO: 657421 - DNA, 22 bp, Artificial Sequence
  chemically synthesized
tcctgacaaccaaatccaagag

SEQ ID NO: 657422 - DNA, 22 bp, Artificial Sequence
  chemically synthesized
cagcctctggccctcttggatt

SEQ ID NO: 657423 - DNA, 22 bp, Artificial Sequence
  chemically synthesized
actgcagcctctggccctcttg

SEQ ID NO: 657424 - DNA, 22 bp, Artificial Sequence
  chemically synthesized
acaaccaaatccaagagggcca

SEQ ID NO: 657425 - DNA, 22 bp, Artificial Sequence
  chemically synthesized
atcaggaagccaccaccatcct

SEQ ID NO: 657426 - DNA, 22 bp, Artificial Sequence
  chemically synthesized
actcatcaggaagccaccacca

SEQ ID NO: 657427 - DNA, 22 bp, Artificial Sequence
  chemically synthesized
cagtgaggatggtggtggcttc

SEQ ID NO: 657428 - DNA, 22 bp, Artificial Sequence
  chemically synthesized
gcccgagtactgactcatcagg

SEQ ID NO: 657429 - DNA, 22 bp, Artificial Sequence
  chemically synthesized
tcgcccgagtactgactcatca

SEQ ID NO: 657430 - DNA, 22 bp, Artificial Sequence
  chemically synthesized
ctcgcccgagtactgactcatc

SEQ ID NO: 657431 - DNA, 22 bp, Artificial Sequence
  chemically synthesized
tctcgcccgagtactgactcat

SEQ ID NO: 657432 - DNA, 22 bp, Artificial Sequence
  chemically synthesized
ttttctcgcccgagtactgact

SEQ ID NO: 657433 - DNA, 22 bp, Artificial Sequence
  chemically synthesized
gttttctcgcccgagtactgac

SEQ ID NO: 657434 - DNA, 22 bp, Artificial Sequence
  chemically synthesized
tgttttctcgcccgagtactga

SEQ ID NO: 657435 - DNA, 22 bp, Artificial Sequence
  chemically synthesized
tttgttttctcgcccgagtact

SEQ ID NO: 657436 - DNA, 22 bp, Artificial Sequence
  chemically synthesized
cctgatgagtcagtactcgggc

SEQ ID NO: 657437 - DNA, 22 bp, Artificial Sequence
  chemically synthesized
ctgatgagtcagtactcgggcg

SEQ ID NO: 657438 - DNA, 22 bp, Artificial Sequence
  chemically synthesized
atgagtcagtactcgggcgaga

SEQ ID NO: 657439 - DNA, 22 bp, Artificial Sequence
  chemically synthesized
gattctttgttttctcgcccga

SEQ ID NO: 657440 - DNA, 22 bp, Artificial Sequence
  chemically synthesized
agggccagctggattctttgtt

SEQ ID NO: 657441 - DNA, 22 bp, Artificial Sequence
  chemically synthesized
gggcgagaaaacaaagaatcca

SEQ ID NO: 657442 - DNA, 22 bp, Artificial Sequence
  chemically synthesized
tattcagggccagctggattct

SEQ ID NO: 657443 - DNA, 22 bp, Artificial Sequence
  chemically synthesized
ggctgtattcagggccagctgg

SEQ ID NO: 657444 - DNA, 22 bp, Artificial Sequence
  chemically synthesized
caaagtaaactaggctgtattc

SEQ ID NO: 657445 - DNA, 22 bp, Artificial Sequence
  chemically synthesized
ctgcaaagtaaactaggctgta

SEQ ID NO: 657446 - DNA, 22 bp, Artificial Sequence
  chemically synthesized
gccctgaatacagcctagttta

SEQ ID NO: 657447 - DNA, 22 bp, Artificial Sequence
  chemically synthesized
aatacagcctagtttactttgc

SEQ ID NO: 657448 - DNA, 22 bp, Artificial Sequence
  chemically synthesized
agtgatggtccctgctgcaaag

SEQ ID NO: 657449 - DNA, 22 bp, Artificial Sequence
  chemically synthesized
gtttactttgcagcagggacca

SEQ ID NO: 657450 - DNA, 22 bp, Artificial Sequence
  chemically synthesized
actttgcagcagggaccatcac

SEQ ID NO: 657451 - DNA, 22 bp, Artificial Sequence
  chemically synthesized
ctttgcagcagggaccatcact

SEQ ID NO: 657452 - DNA, 22 bp, Artificial Sequence
  chemically synthesized
aaggtaaggctcagtgatggtc

SEQ ID NO: 657453 - DNA, 22 bp, Artificial Sequence
  chemically synthesized
tgcagcagggaccatcactgag

SEQ ID NO: 657454 - DNA, 22 bp, Artificial Sequence
  chemically synthesized
gcagcagggaccatcactgagc

SEQ ID NO: 657455 - DNA, 22 bp, Artificial Sequence
  chemically synthesized
cagcagggaccatcactgagcc

SEQ ID NO: 657456 - DNA, 22 bp, Artificial Sequence
  chemically synthesized
ggttaaaggtaaggctcagtga

SEQ ID NO: 657457 - DNA, 22 bp, Artificial Sequence
  chemically synthesized
gggttaaaggtaaggctcagtg

SEQ ID NO: 657458 - DNA, 22 bp, Artificial Sequence
  chemically synthesized
tgacttgggttaaaggtaaggc

SEQ ID NO: 657459 - DNA, 22 bp, Artificial Sequence
  chemically synthesized
agccttacctttaacccaagtc

SEQ ID NO: 657460 - DNA, 22 bp, Artificial Sequence
  chemically synthesized
acctttaacccaagtcacaatg

SEQ ID NO: 657461 - DNA, 22 bp, Artificial Sequence
  chemically synthesized
cctttaacccaagtcacaatgc

SEQ ID NO: 657462 - DNA, 22 bp, Artificial Sequence
  chemically synthesized
taacccaagtcacaatgcacac

SEQ ID NO: 657463 - DNA, 22 bp, Artificial Sequence
  chemically synthesized
aacccaagtcacaatgcacaca

SEQ ID NO: 657464 - DNA, 22 bp, Artificial Sequence
  chemically synthesized
acccaagtcacaatgcacacac

SEQ ID NO: 657465 - DNA, 22 bp, Artificial Sequence
  chemically synthesized
atatatagggatatataaacat

SEQ ID NO: 657466 - DNA, 22 bp, Artificial Sequence
  chemically synthesized
atatatccctatatatgaacac

SEQ ID NO: 657467 - DNA, 22 bp, Artificial Sequence
  chemically synthesized
tatatccctatatatgaacacg

SEQ ID NO: 657468 - DNA, 22 bp, Artificial Sequence
  chemically synthesized
gtgaaacacacacacgtgttca

SEQ ID NO: 657469 - DNA, 22 bp, Artificial Sequence
  chemically synthesized
tagtgaaacacacacacgtgtt

SEQ ID NO: 657470 - DNA, 22 bp, Artificial Sequence
  chemically synthesized
agttctagtgaaacacacacac

SEQ ID NO: 657471 - DNA, 22 bp, Artificial Sequence
  chemically synthesized
tatatgaacacgtgtgtgtgtt

SEQ ID NO: 657472 - DNA, 22 bp, Artificial Sequence
  chemically synthesized
gagttctagtgaaacacacaca

SEQ ID NO: 657473 - DNA, 22 bp, Artificial Sequence
  chemically synthesized
tgagttctagtgaaacacacac

SEQ ID NO: 657474 - DNA, 22 bp, Artificial Sequence
  chemically synthesized
tttgagttctagtgaaacacac

SEQ ID NO: 657475 - DNA, 22 bp, Artificial Sequence
  chemically synthesized
ctctttgagttctagtgaaaca

SEQ ID NO: 657476 - DNA, 22 bp, Artificial Sequence
  chemically synthesized
agttactctttgagttctagtg

SEQ ID NO: 657477 - DNA, 22 bp, Artificial Sequence
  chemically synthesized
gtcaagtctcagttactctttg

SEQ ID NO: 657478 - DNA, 22 bp, Artificial Sequence
  chemically synthesized
agtcaagtctcagttactcttt

SEQ ID NO: 657479 - DNA, 22 bp, Artificial Sequence
  chemically synthesized
cactagaactcaaagagtaact

SEQ ID NO: 657480 - DNA, 22 bp, Artificial Sequence
  chemically synthesized
tagtcaagtctcagttactctt

SEQ ID NO: 657481 - DNA, 22 bp, Artificial Sequence
  chemically synthesized
actagaactcaaagagtaactg

SEQ ID NO: 657482 - DNA, 22 bp, Artificial Sequence
  chemically synthesized
gaactcaaagagtaactgagac

SEQ ID NO: 657483 - DNA, 22 bp, Artificial Sequence
  chemically synthesized
ccctttagtcaagtctcagtta

SEQ ID NO: 657484 - DNA, 22 bp, Artificial Sequence
  chemically synthesized
cccctttagtcaagtctcagtt

SEQ ID NO: 657485 - DNA, 22 bp, Artificial Sequence
  chemically synthesized
tcccctttagtcaagtctcagt

SEQ ID NO: 657486 - DNA, 22 bp, Artificial Sequence
  chemically synthesized
ttcccctttagtcaagtctcag

SEQ ID NO: 657487 - DNA, 22 bp, Artificial Sequence
  chemically synthesized
aaagagtaactgagacttgact

SEQ ID NO: 657488 - DNA, 22 bp, Artificial Sequence
  chemically synthesized
atcatttttcccctttagtcaa

SEQ ID NO: 657489 - DNA, 22 bp, Artificial Sequence
  chemically synthesized
agacttgactaaaggggaaaaa

SEQ ID NO: 657490 - DNA, 22 bp, Artificial Sequence
  chemically synthesized
caggtcctaatcatttttcccc

SEQ ID NO: 657491 - DNA, 22 bp, Artificial Sequence
  chemically synthesized
gactaaaggggaaaaatgatta

SEQ ID NO: 657492 - DNA, 22 bp, Artificial Sequence
  chemically synthesized
actaaaggggaaaaatgattag

SEQ ID NO: 657493 - DNA, 22 bp, Artificial Sequence
  chemically synthesized
ggattacaggtcctaatcattt

SEQ ID NO: 657494 - DNA, 22 bp, Artificial Sequence
  chemically synthesized
aaggggaaaaatgattaggacc

SEQ ID NO: 657495 - DNA, 22 bp, Artificial Sequence
  chemically synthesized
ccaaagtgctgggattacaggt

SEQ ID NO: 657496 - DNA, 22 bp, Artificial Sequence
  chemically synthesized
ggcctcccaaagtgctgggatt

SEQ ID NO: 657497 - DNA, 22 bp, Artificial Sequence
  chemically synthesized
ggacctgtaatcccagcacttt

SEQ ID NO: 657498 - DNA, 22 bp, Artificial Sequence
  chemically synthesized
cctcggcctcccaaagtgctgg

SEQ ID NO: 657499 - DNA, 22 bp, Artificial Sequence
  chemically synthesized
taatcccagcactttgggaggc

SEQ ID NO: 657500 - DNA, 22 bp, Artificial Sequence
  chemically synthesized
aagcaatccacctgcctcggcc

SEQ ID NO: 657501 - DNA, 22 bp, Artificial Sequence
  chemically synthesized
atctcaagcaatccacctgcct

SEQ ID NO: 657502 - DNA, 22 bp, Artificial Sequence
  chemically synthesized
tgggaggccgaggcaggtggat

SEQ ID NO: 657503 - DNA, 22 bp, Artificial Sequence
  chemically synthesized
gggaggccgaggcaggtggatt

SEQ ID NO: 657504 - DNA, 22 bp, Artificial Sequence
  chemically synthesized
ctgatctcaagcaatccacctg

SEQ ID NO: 657505 - DNA, 22 bp, Artificial Sequence
  chemically synthesized
ggaggccgaggcaggtggattg

SEQ ID NO: 657506 - DNA, 22 bp, Artificial Sequence
  chemically synthesized
aaactcctgatctcaagcaatc

SEQ ID NO: 657507 - DNA, 22 bp, Artificial Sequence
  chemically synthesized
agctcaaactcctgatctcaag

SEQ ID NO: 657508 - DNA, 22 bp, Artificial Sequence
  chemically synthesized
gccaggctgagctcaaactcct

SEQ ID NO: 657509 - DNA, 22 bp, Artificial Sequence
  chemically synthesized
cttgagatcaggagtttgagct

SEQ ID NO: 657510 - DNA, 22 bp, Artificial Sequence
  chemically synthesized
gagatcaggagtttgagctcag

SEQ ID NO: 657511 - DNA, 22 bp, Artificial Sequence
  chemically synthesized
agatcaggagtttgagctcagc

SEQ ID NO: 657512 - DNA, 22 bp, Artificial Sequence
  chemically synthesized
accatgttggccaggctgagct

SEQ ID NO: 657513 - DNA, 22 bp, Artificial Sequence
  chemically synthesized
caccatgttggccaggctgagc

SEQ ID NO: 657514 - DNA, 22 bp, Artificial Sequence
  chemically synthesized
gagctcagcctggccaacatgg

SEQ ID NO: 657515 - DNA, 22 bp, Artificial Sequence
  chemically synthesized
agctcagcctggccaacatggt

SEQ ID NO: 657516 - DNA, 22 bp, Artificial Sequence
  chemically synthesized
tggagacagggtttcaccatgt

SEQ ID NO: 657517 - DNA, 22 bp, Artificial Sequence
  chemically synthesized
gtggagacagggtttcaccatg

SEQ ID NO: 657518 - DNA, 22 bp, Artificial Sequence
  chemically synthesized
agcctggccaacatggtgaaac

SEQ ID NO: 657519 - DNA, 22 bp, Artificial Sequence
  chemically synthesized
tgtggagacagggtttcaccat

SEQ ID NO: 657520 - DNA, 22 bp, Artificial Sequence
  chemically synthesized
ttgtggagacagggtttcacca

SEQ ID NO: 657521 - DNA, 22 bp, Artificial Sequence
  chemically synthesized
tttgtggagacagggtttcacc

SEQ ID NO: 657522 - DNA, 22 bp, Artificial Sequence
  chemically synthesized
gccaacatggtgaaaccctgtc

SEQ ID NO: 657523 - DNA, 22 bp, Artificial Sequence
  chemically synthesized
attttttgtggagacagggttt

SEQ ID NO: 657524 - DNA, 22 bp, Artificial Sequence
  chemically synthesized
gctaattttttgtggagacagg

SEQ ID NO: 657525 - DNA, 22 bp, Artificial Sequence
  chemically synthesized
ccaccatgcctggctaattttt

SEQ ID NO: 657526 - DNA, 22 bp, Artificial Sequence
  chemically synthesized
tctccacaaaaaattagccagg

SEQ ID NO: 657527 - DNA, 22 bp, Artificial Sequence
  chemically synthesized
cacaaaaaattagccaggcatg

SEQ ID NO: 657528 - DNA, 22 bp, Artificial Sequence
  chemically synthesized
cagggtgcctgccaccatgcct

SEQ ID NO: 657529 - DNA, 22 bp, Artificial Sequence
  chemically synthesized
ggattacagggtgcctgccacc

SEQ ID NO: 657530 - DNA, 22 bp, Artificial Sequence
  chemically synthesized
gccaggcatggtggcaggcacc

SEQ ID NO: 657531 - DNA, 22 bp, Artificial Sequence
  chemically synthesized
ccgagtagctgggattacaggg

SEQ ID NO: 657532 - DNA, 22 bp, Artificial Sequence
  chemically synthesized
agcctcccgagtagctgggatt

SEQ ID NO: 657533 - DNA, 22 bp, Artificial Sequence
  chemically synthesized
tcatgcctcagcctcccgagta

SEQ ID NO: 657534 - DNA, 22 bp, Artificial Sequence
  chemically synthesized
taatcccagctactcgggaggc

SEQ ID NO: 657535 - DNA, 22 bp, Artificial Sequence
  chemically synthesized
aagcaattgtcatgcctcagcc

SEQ ID NO: 657536 - DNA, 22 bp, Artificial Sequence
  chemically synthesized
gttcaagcaattgtcatgcctc

SEQ ID NO: 657537 - DNA, 22 bp, Artificial Sequence
  chemically synthesized
ctcgggaggctgaggcatgaca

SEQ ID NO: 657538 - DNA, 22 bp, Artificial Sequence
  chemically synthesized
gggaggctgaggcatgacaatt

SEQ ID NO: 657539 - DNA, 22 bp, Artificial Sequence
  chemically synthesized
cctggttcaagcaattgtcatg

SEQ ID NO: 657540 - DNA, 22 bp, Artificial Sequence
  chemically synthesized
cgcctccctggttcaagcaatt

SEQ ID NO: 657541 - DNA, 22 bp, Artificial Sequence
  chemically synthesized
aggcatgacaattgcttgaacc

SEQ ID NO: 657542 - DNA, 22 bp, Artificial Sequence
  chemically synthesized
caacctccgcctccctggttca

SEQ ID NO: 657543 - DNA, 22 bp, Artificial Sequence
  chemically synthesized
actgcaacctccgcctccctgg

SEQ ID NO: 657544 - DNA, 22 bp, Artificial Sequence
  chemically synthesized
ggctcactgcaacctccgcctc

SEQ ID NO: 657545 - DNA, 22 bp, Artificial Sequence
  chemically synthesized
cttgaaccagggaggcggaggt

SEQ ID NO: 657546 - DNA, 22 bp, Artificial Sequence
  chemically synthesized
gaaccagggaggcggaggttgc

SEQ ID NO: 657547 - DNA, 22 bp, Artificial Sequence
  chemically synthesized
aaccagggaggcggaggttgca

SEQ ID NO: 657548 - DNA, 22 bp, Artificial Sequence
  chemically synthesized
gagtgcaatggcgcgatctcgg

SEQ ID NO: 657549 - DNA, 22 bp, Artificial Sequence
  chemically synthesized
cagtgagccgagatcgcgccat

SEQ ID NO: 657550 - DNA, 22 bp, Artificial Sequence
  chemically synthesized
tcgcccaggctggagtgcaatg

SEQ ID NO: 657551 - DNA, 22 bp, Artificial Sequence
  chemically synthesized
tgtcgcccaggctggagtgcaa

SEQ ID NO: 657552 - DNA, 22 bp, Artificial Sequence
  chemically synthesized
cctctgtcgcccaggctggagt

SEQ ID NO: 657553 - DNA, 22 bp, Artificial Sequence
  chemically synthesized
cactccagcctgggcgacagag

SEQ ID NO: 657554 - DNA, 22 bp, Artificial Sequence
  chemically synthesized
agatggagtctccctctgtcgc

SEQ ID NO: 657555 - DNA, 22 bp, Artificial Sequence
  chemically synthesized
gagatggagtctccctctgtcg

SEQ ID NO: 657556 - DNA, 22 bp, Artificial Sequence
  chemically synthesized
tgagatggagtctccctctgtc

SEQ ID NO: 657557 - DNA, 22 bp, Artificial Sequence
  chemically synthesized
cagcctgggcgacagagggaga

SEQ ID NO: 657558 - DNA, 22 bp, Artificial Sequence
  chemically synthesized
ttttgagatggagtctccctct

SEQ ID NO: 657559 - DNA, 22 bp, Artificial Sequence
  chemically synthesized
gttttgagatggagtctccctc

SEQ ID NO: 657560 - DNA, 22 bp, Artificial Sequence
  chemically synthesized
tgttttgagatggagtctccct

SEQ ID NO: 657561 - DNA, 22 bp, Artificial Sequence
  chemically synthesized
ttttgttttgagatggagtctc

SEQ ID NO: 657562 - DNA, 22 bp, Artificial Sequence
  chemically synthesized
ggcgacagagggagactccatc

SEQ ID NO: 657563 - DNA, 22 bp, Artificial Sequence
  chemically synthesized
gttttgttttgagatggagtct

SEQ ID NO: 657564 - DNA, 22 bp, Artificial Sequence
  chemically synthesized
tgttttgttttgagatggagtc

SEQ ID NO: 657565 - DNA, 22 bp, Artificial Sequence
  chemically synthesized
ttttgttttgttttgagatgga

SEQ ID NO: 657566 - DNA, 22 bp, Artificial Sequence
  chemically synthesized
gttttgttttgttttgagatgg

SEQ ID NO: 657567 - DNA, 22 bp, Artificial Sequence
  chemically synthesized
tgttttgttttgttttgagatg

SEQ ID NO: 657568 - DNA, 22 bp, Artificial Sequence
  chemically synthesized
ttgttttgttttgttttgagat

SEQ ID NO: 657569 - DNA, 22 bp, Artificial Sequence
  chemically synthesized
tttgttttgttttgttttgaga

SEQ ID NO: 657570 - DNA, 22 bp, Artificial Sequence
  chemically synthesized
ttttgttttgttttgttttgag

SEQ ID NO: 657571 - DNA, 22 bp, Artificial Sequence
  chemically synthesized
tttttgttttgttttgttttga

SEQ ID NO: 657572 - DNA, 22 bp, Artificial Sequence
  chemically synthesized
tgtgttttttttgttttgtttt

SEQ ID NO: 657573 - DNA, 22 bp, Artificial Sequence
  chemically synthesized
catctcaaaacaaaacaaaaca

SEQ ID NO: 657574 - DNA, 22 bp, Artificial Sequence
  chemically synthesized
gttgtgtgttttttttgttttg

SEQ ID NO: 657575 - DNA, 22 bp, Artificial Sequence
  chemically synthesized
ggttgtgtgttttttttgtttt

SEQ ID NO: 657576 - DNA, 22 bp, Artificial Sequence
  chemically synthesized
tggttgtgtgttttttttgttt

SEQ ID NO: 657577 - DNA, 22 bp, Artificial Sequence
  chemically synthesized
aaaacaaaacaaaacaaaaaaa

SEQ ID NO: 657578 - DNA, 22 bp, Artificial Sequence
  chemically synthesized
ttggttgtgtgttttttttgtt

SEQ ID NO: 657579 - DNA, 22 bp, Artificial Sequence
  chemically synthesized
atcttttggttgtgtgtttttt

SEQ ID NO: 657580 - DNA, 22 bp, Artificial Sequence
  chemically synthesized
ctaatcttttggttgtgtgttt

SEQ ID NO: 657581 - DNA, 22 bp, Artificial Sequence
  chemically synthesized
cctaatcttttggttgtgtgtt

SEQ ID NO: 657582 - DNA, 22 bp, Artificial Sequence
  chemically synthesized
tttcctaatcttttggttgtgt

SEQ ID NO: 657583 - DNA, 22 bp, Artificial Sequence
  chemically synthesized
ccataaacgcgagttatttcct

SEQ ID NO: 657584 - DNA, 22 bp, Artificial Sequence
  chemically synthesized
gccataaacgcgagttatttcc

SEQ ID NO: 657585 - DNA, 22 bp, Artificial Sequence
  chemically synthesized
taaaacaacttgccataaacgc

SEQ ID NO: 657586 - DNA, 22 bp, Artificial Sequence
  chemically synthesized
ggaaataactcgcgtttatggc

SEQ ID NO: 657587 - DNA, 22 bp, Artificial Sequence
  chemically synthesized
aaatccaattataaaacaactt

SEQ ID NO: 657588 - DNA, 22 bp, Artificial Sequence
  chemically synthesized
gcgtttatggcaagttgtttta

SEQ ID NO: 657589 - DNA, 22 bp, Artificial Sequence
  chemically synthesized
aaaatccaattataaaacaact

SEQ ID NO: 657590 - DNA, 22 bp, Artificial Sequence
  chemically synthesized
taaaatccaattataaaacaac

SEQ ID NO: 657591 - DNA, 22 bp, Artificial Sequence
  chemically synthesized
ttaaaatccaattataaaacaa

SEQ ID NO: 657592 - DNA, 22 bp, Artificial Sequence
  chemically synthesized
tttaaaatccaattataaaaca

SEQ ID NO: 657593 - DNA, 22 bp, Artificial Sequence
  chemically synthesized
atggcaagttgttttataattg

SEQ ID NO: 657594 - DNA, 22 bp, Artificial Sequence
  chemically synthesized
tggcaagttgttttataattgg

SEQ ID NO: 657595 - DNA, 22 bp, Artificial Sequence
  chemically synthesized
attttttaaaatccaattataa

SEQ ID NO: 657596 - DNA, 22 bp, Artificial Sequence
  chemically synthesized
gattttttaaaatccaattata

SEQ ID NO: 657597 - DNA, 22 bp, Artificial Sequence
  chemically synthesized
tgattttttaaaatccaattat

SEQ ID NO: 657598 - DNA, 22 bp, Artificial Sequence
  chemically synthesized
attttgattttttaaaatccaa

SEQ ID NO: 657599 - DNA, 22 bp, Artificial Sequence
  chemically synthesized
ttttataattggattttaaaaa

SEQ ID NO: 657600 - DNA, 22 bp, Artificial Sequence
  chemically synthesized
ggttcattttgattttttaaaa

SEQ ID NO: 657601 - DNA, 22 bp, Artificial Sequence
  chemically synthesized
tataattggattttaaaaaatc

SEQ ID NO: 657602 - DNA, 22 bp, Artificial Sequence
  chemically synthesized
ataattggattttaaaaaatca

SEQ ID NO: 657603 - DNA, 22 bp, Artificial Sequence
  chemically synthesized
taattggattttaaaaaatcaa

SEQ ID NO: 657604 - DNA, 22 bp, Artificial Sequence
  chemically synthesized
gattttaaaaaatcaaaatgaa

SEQ ID NO: 657605 - DNA, 22 bp, Artificial Sequence
  chemically synthesized
taaaaaatcaaaatgaacctag

SEQ ID NO: 657606 - DNA, 22 bp, Artificial Sequence
  chemically synthesized
aaaaaatcaaaatgaacctaga

SEQ ID NO: 657607 - DNA, 22 bp, Artificial Sequence
  chemically synthesized
aaaaatcaaaatgaacctagat

SEQ ID NO: 657608 - DNA, 22 bp, Artificial Sequence
  chemically synthesized
atggccacaggcaatctaggtt

SEQ ID NO: 657609 - DNA, 22 bp, Artificial Sequence
  chemically synthesized
catacaatgaatattaatggcc

SEQ ID NO: 657610 - DNA, 22 bp, Artificial Sequence
  chemically synthesized
ccatacaatgaatattaatggc

SEQ ID NO: 657611 - DNA, 22 bp, Artificial Sequence
  chemically synthesized
gattgcctgtggccattaatat

SEQ ID NO: 657612 - DNA, 22 bp, Artificial Sequence
  chemically synthesized
cctgtggccattaatattcatt

SEQ ID NO: 657613 - DNA, 22 bp, Artificial Sequence
  chemically synthesized
tggccattaatattcattgtat

SEQ ID NO: 657614 - DNA, 22 bp, Artificial Sequence
  chemically synthesized
atattcattgtatggaagttac

SEQ ID NO: 657615 - DNA, 22 bp, Artificial Sequence
  chemically synthesized
attgtatggaagttacttgtgt

SEQ ID NO: 657616 - DNA, 22 bp, Artificial Sequence
  chemically synthesized
tatggaagttacttgtgtctac

SEQ ID NO: 657617 - DNA, 22 bp, Artificial Sequence
  chemically synthesized
cttgtgtctacattttgatgat

SEQ ID NO: 657618 - DNA, 22 bp, Artificial Sequence
  chemically synthesized
gtgtctacattttgatgattga

SEQ ID NO: 657619 - DNA, 22 bp, Artificial Sequence
  chemically synthesized
tgtctacattttgatgattgat

SEQ ID NO: 657620 - DNA, 22 bp, Artificial Sequence
  chemically synthesized
cattttgatgattgattggatt

SEQ ID NO: 657621 - DNA, 22 bp, Artificial Sequence
  chemically synthesized
tgatgattgattggattgatca

SEQ ID NO: 657622 - DNA, 22 bp, Artificial Sequence
  chemically synthesized
gatgattgattggattgatcat

SEQ ID NO: 657623 - DNA, 22 bp, Artificial Sequence
  chemically synthesized
atgattgattggattgatcatc

SEQ ID NO: 657624 - DNA, 22 bp, Artificial Sequence
  chemically synthesized
caaaatgcagatagatgatcaa

SEQ ID NO: 657625 - DNA, 22 bp, Artificial Sequence
  chemically synthesized
ccaaaatgcagatagatgatca

SEQ ID NO: 657626 - DNA, 22 bp, Artificial Sequence
  chemically synthesized
attggattgatcatctatctgc

SEQ ID NO: 657627 - DNA, 22 bp, Artificial Sequence
  chemically synthesized
gattgatcatctatctgcattt

SEQ ID NO: 657628 - DNA, 22 bp, Artificial Sequence
  chemically synthesized
atacccaaaccttccaaaatgc

SEQ ID NO: 657629 - DNA, 22 bp, Artificial Sequence
  chemically synthesized
atcatctatctgcattttggaa

SEQ ID NO: 657630 - DNA, 22 bp, Artificial Sequence
  chemically synthesized
ctcatacccaaaccttccaaaa

SEQ ID NO: 657631 - DNA, 22 bp, Artificial Sequence
  chemically synthesized
ctcctcatacccaaaccttcca

SEQ ID NO: 657632 - DNA, 22 bp, Artificial Sequence
  chemically synthesized
cctcctcatacccaaaccttcc

SEQ ID NO: 657633 - DNA, 22 bp, Artificial Sequence
  chemically synthesized
tcctcctcatacccaaaccttc

SEQ ID NO: 657634 - DNA, 22 bp, Artificial Sequence
  chemically synthesized
tctgcattttggaaggtttggg

SEQ ID NO: 657635 - DNA, 22 bp, Artificial Sequence
  chemically synthesized
ttcctcctcatacccaaacctt

SEQ ID NO: 657636 - DNA, 22 bp, Artificial Sequence
  chemically synthesized
cattttggaaggtttgggtatg

SEQ ID NO: 657637 - DNA, 22 bp, Artificial Sequence
  chemically synthesized
tggaaggtttgggtatgaggag

SEQ ID NO: 657638 - DNA, 22 bp, Artificial Sequence
  chemically synthesized
ggaaggtttgggtatgaggagg

SEQ ID NO: 657639 - DNA, 22 bp, Artificial Sequence
  chemically synthesized
gaaggtttgggtatgaggagga

SEQ ID NO: 657640 - DNA, 22 bp, Artificial Sequence
  chemically synthesized
gggtatgaggaggaaaagatat

SEQ ID NO: 657641 - DNA, 22 bp, Artificial Sequence
  chemically synthesized
ggtatgaggaggaaaagatatt

SEQ ID NO: 657642 - DNA, 22 bp, Artificial Sequence
  chemically synthesized
taaatgtaaaatgcatgtggag

SEQ ID NO: 657643 - DNA, 22 bp, Artificial Sequence
  chemically synthesized
gttgtaaatgtaaaatgcatgt

SEQ ID NO: 657644 - DNA, 22 bp, Artificial Sequence
  chemically synthesized
atttctccacatgcattttaca

SEQ ID NO: 657645 - DNA, 22 bp, Artificial Sequence
  chemically synthesized
tttctccacatgcattttacat

SEQ ID NO: 657646 - DNA, 22 bp, Artificial Sequence
  chemically synthesized
ctccacatgcattttacattta

SEQ ID NO: 657647 - DNA, 22 bp, Artificial Sequence
  chemically synthesized
tccacatgcattttacatttac

SEQ ID NO: 657648 - DNA, 22 bp, Artificial Sequence
  chemically synthesized
tggcaaattagttgtaaatgta

SEQ ID NO: 657649 - DNA, 22 bp, Artificial Sequence
  chemically synthesized
cacatgcattttacatttacaa

SEQ ID NO: 657650 - DNA, 22 bp, Artificial Sequence
  chemically synthesized
ccaaaattatggcaaattagtt

SEQ ID NO: 657651 - DNA, 22 bp, Artificial Sequence
  chemically synthesized
gccaaaattatggcaaattagt

SEQ ID NO: 657652 - DNA, 22 bp, Artificial Sequence
  chemically synthesized
tgccaaaattatggcaaattag

SEQ ID NO: 657653 - DNA, 22 bp, Artificial Sequence
  chemically synthesized
tacatttacaactaatttgcca

SEQ ID NO: 657654 - DNA, 22 bp, Artificial Sequence
  chemically synthesized
acatttacaactaatttgccat

SEQ ID NO: 657655 - DNA, 22 bp, Artificial Sequence
  chemically synthesized
catttacaactaatttgccata

SEQ ID NO: 657656 - DNA, 22 bp, Artificial Sequence
  chemically synthesized
ttttgccaaaattatggcaaat

SEQ ID NO: 657657 - DNA, 22 bp, Artificial Sequence
  chemically synthesized
acaactaatttgccataatttt

SEQ ID NO: 657658 - DNA, 22 bp, Artificial Sequence
  chemically synthesized
aattattttgccaaaattatgg

SEQ ID NO: 657659 - DNA, 22 bp, Artificial Sequence
  chemically synthesized
caactaatttgccataattttg

SEQ ID NO: 657660 - DNA, 22 bp, Artificial Sequence
  chemically synthesized
gaattattttgccaaaattatg

SEQ ID NO: 657661 - DNA, 22 bp, Artificial Sequence
  chemically synthesized
tttgaattattttgccaaaatt

SEQ ID NO: 657662 - DNA, 22 bp, Artificial Sequence
  chemically synthesized
atttgccataattttggcaaaa

SEQ ID NO: 657663 - DNA, 22 bp, Artificial Sequence
  chemically synthesized
gccataattttggcaaaataat

SEQ ID NO: 657664 - DNA, 22 bp, Artificial Sequence
  chemically synthesized
ccataattttggcaaaataatt

SEQ ID NO: 657665 - DNA, 22 bp, Artificial Sequence
  chemically synthesized
tggcaaaataattcaaacagta

SEQ ID NO: 657666 - DNA, 22 bp, Artificial Sequence
  chemically synthesized
ggcaaaataattcaaacagtat

SEQ ID NO: 657667 - DNA, 22 bp, Artificial Sequence
  chemically synthesized
gcaaaataattcaaacagtata

SEQ ID NO: 657668 - DNA, 22 bp, Artificial Sequence
  chemically synthesized
tgtaaagtgggatatactgttt

SEQ ID NO: 657669 - DNA, 22 bp, Artificial Sequence
  chemically synthesized
atgtaaagtgggatatactgtt

SEQ ID NO: 657670 - DNA, 22 bp, Artificial Sequence
  chemically synthesized
atttatgtaaagtgggatatac

SEQ ID NO: 657671 - DNA, 22 bp, Artificial Sequence
  chemically synthesized
aaacagtatatcccactttaca

SEQ ID NO: 657672 - DNA, 22 bp, Artificial Sequence
  chemically synthesized
ccggatgcacacataataagtt

SEQ ID NO: 657673 - DNA, 22 bp, Artificial Sequence
  chemically synthesized
accggatgcacacataataagt

SEQ ID NO: 657674 - DNA, 22 bp, Artificial Sequence
  chemically synthesized
tacataaatgaacttattatgt

SEQ ID NO: 657675 - DNA, 22 bp, Artificial Sequence
  chemically synthesized
acataaatgaacttattatgtg

SEQ ID NO: 657676 - DNA, 22 bp, Artificial Sequence
  chemically synthesized
cataaatgaacttattatgtgt

SEQ ID NO: 657677 - DNA, 22 bp, Artificial Sequence
  chemically synthesized
gatagatttaccggatgcacac

SEQ ID NO: 657678 - DNA, 22 bp, Artificial Sequence
  chemically synthesized
gttggatagatttaccggatgc

SEQ ID NO: 657679 - DNA, 22 bp, Artificial Sequence
  chemically synthesized
attatgtgtgcatccggtaaat

SEQ ID NO: 657680 - DNA, 22 bp, Artificial Sequence
  chemically synthesized
ttatgtgtgcatccggtaaatc

SEQ ID NO: 657681 - DNA, 22 bp, Artificial Sequence
  chemically synthesized
tgtgtgcatccggtaaatctat

SEQ ID NO: 657682 - DNA, 22 bp, Artificial Sequence
  chemically synthesized
atagttagttggatagatttac

SEQ ID NO: 657683 - DNA, 22 bp, Artificial Sequence
  chemically synthesized
aatagttagttggatagattta

SEQ ID NO: 657684 - DNA, 22 bp, Artificial Sequence
  chemically synthesized
tttaatagttagttggatagat

SEQ ID NO: 657685 - DNA, 22 bp, Artificial Sequence
  chemically synthesized
atttaatagttagttggataga

SEQ ID NO: 657686 - DNA, 22 bp, Artificial Sequence
  chemically synthesized
agtatttatttaatagttagtt

SEQ ID NO: 657687 - DNA, 22 bp, Artificial Sequence
  chemically synthesized
gagtatttatttaatagttagt

SEQ ID NO: 657688 - DNA, 22 bp, Artificial Sequence
  chemically synthesized
tccaactaactattaaataaat

SEQ ID NO: 657689 - DNA, 22 bp, Artificial Sequence
  chemically synthesized
aagcagtttgagtatttattta

SEQ ID NO: 657690 - DNA, 22 bp, Artificial Sequence
  chemically synthesized
aaagcagtttgagtatttattt

SEQ ID NO: 657691 - DNA, 22 bp, Artificial Sequence
  chemically synthesized
actattaaataaatactcaaac

SEQ ID NO: 657692 - DNA, 22 bp, Artificial Sequence
  chemically synthesized
ggtgtttaaagcagtttgagta

SEQ ID NO: 657693 - DNA, 22 bp, Artificial Sequence
  chemically synthesized
aggtgtttaaagcagtttgagt

SEQ ID NO: 657694 - DNA, 22 bp, Artificial Sequence
  chemically synthesized
ttaaataaatactcaaactgct

SEQ ID NO: 657695 - DNA, 22 bp, Artificial Sequence
  chemically synthesized
aataaatactcaaactgcttta

SEQ ID NO: 657696 - DNA, 22 bp, Artificial Sequence
  chemically synthesized
tgaatatttaggtgtttaaagc

SEQ ID NO: 657697 - DNA, 22 bp, Artificial Sequence
  chemically synthesized
aaactgctttaaacacctaaat

SEQ ID NO: 657698 - DNA, 22 bp, Artificial Sequence
  chemically synthesized
ggcagatcactgtgaatattta

SEQ ID NO: 657699 - DNA, 22 bp, Artificial Sequence
  chemically synthesized
ctttaaacacctaaatattcac

SEQ ID NO: 657700 - DNA, 22 bp, Artificial Sequence
  chemically synthesized
ctgggcagatcactgtgaatat

SEQ ID NO: 657701 - DNA, 22 bp, Artificial Sequence
  chemically synthesized
taaacacctaaatattcacagt

SEQ ID NO: 657702 - DNA, 22 bp, Artificial Sequence
  chemically synthesized
cctgggcagatcactgtgaata

SEQ ID NO: 657703 - DNA, 22 bp, Artificial Sequence
  chemically synthesized
aaacacctaaatattcacagtg

SEQ ID NO: 657704 - DNA, 22 bp, Artificial Sequence
  chemically synthesized
aacacctaaatattcacagtga

SEQ ID NO: 657705 - DNA, 22 bp, Artificial Sequence
  chemically synthesized
aatattcacagtgatctgccca

SEQ ID NO: 657706 - DNA, 22 bp, Artificial Sequence
  chemically synthesized
tagaaggtttcctgggcagatc

SEQ ID NO: 657707 - DNA, 22 bp, Artificial Sequence
  chemically synthesized
acagtgatctgcccaggaaacc

SEQ ID NO: 657708 - DNA, 22 bp, Artificial Sequence
  chemically synthesized
ggatgaaactatagaaggtttc

SEQ ID NO: 657709 - DNA, 22 bp, Artificial Sequence
  chemically synthesized
cccaggaaaccttctatagttt

SEQ ID NO: 657710 - DNA, 22 bp, Artificial Sequence
  chemically synthesized
accacagactaggatgaaacta

SEQ ID NO: 657711 - DNA, 22 bp, Artificial Sequence
  chemically synthesized
gaccacagactaggatgaaact

SEQ ID NO: 657712 - DNA, 22 bp, Artificial Sequence
  chemically synthesized
tgaccacagactaggatgaaac

SEQ ID NO: 657713 - DNA, 22 bp, Artificial Sequence
  chemically synthesized
ctatagtttcatcctagtctgt

SEQ ID NO: 657714 - DNA, 22 bp, Artificial Sequence
  chemically synthesized
aagtctttgaccacagactagg

SEQ ID NO: 657715 - DNA, 22 bp, Artificial Sequence
  chemically synthesized
tatagtttcatcctagtctgtg

SEQ ID NO: 657716 - DNA, 22 bp, Artificial Sequence
  chemically synthesized
tagtttcatcctagtctgtggt

SEQ ID NO: 657717 - DNA, 22 bp, Artificial Sequence
  chemically synthesized
tatctgaagtctttgaccacag

SEQ ID NO: 657718 - DNA, 22 bp, Artificial Sequence
  chemically synthesized
catcctagtctgtggtcaaaga

SEQ ID NO: 657719 - DNA, 22 bp, Artificial Sequence
  chemically synthesized
atcctagtctgtggtcaaagac

SEQ ID NO: 657720 - DNA, 22 bp, Artificial Sequence
  chemically synthesized
ggttatatctgaagtctttgac

SEQ ID NO: 657721 - DNA, 22 bp, Artificial Sequence
  chemically synthesized
actgggttatatctgaagtctt

SEQ ID NO: 657722 - DNA, 22 bp, Artificial Sequence
  chemically synthesized
gtctgtggtcaaagacttcaga

SEQ ID NO: 657723 - DNA, 22 bp, Artificial Sequence
  chemically synthesized
tggtcaaagacttcagatataa

SEQ ID NO: 657724 - DNA, 22 bp, Artificial Sequence
  chemically synthesized
tagaactaactgggttatatct

SEQ ID NO: 657725 - DNA, 22 bp, Artificial Sequence
  chemically synthesized
gctgtagaactaactgggttat

SEQ ID NO: 657726 - DNA, 22 bp, Artificial Sequence
  chemically synthesized
cagatataacccagttagttct

SEQ ID NO: 657727 - DNA, 22 bp, Artificial Sequence
  chemically synthesized
agatataacccagttagttcta

SEQ ID NO: 657728 - DNA, 22 bp, Artificial Sequence
  chemically synthesized
caaaatggaactagctgtagaa

SEQ ID NO: 657729 - DNA, 22 bp, Artificial Sequence
  chemically synthesized
acaaaatggaactagctgtaga

SEQ ID NO: 657730 - DNA, 22 bp, Artificial Sequence
  chemically synthesized
agatttacaaaatggaactagc

SEQ ID NO: 657731 - DNA, 22 bp, Artificial Sequence
  chemically synthesized
gttctacagctagttccatttt

SEQ ID NO: 657732 - DNA, 22 bp, Artificial Sequence
  chemically synthesized
tacagctagttccattttgtaa

SEQ ID NO: 657733 - DNA, 22 bp, Artificial Sequence
  chemically synthesized
cagctagttccattttgtaaat

SEQ ID NO: 657734 - DNA, 22 bp, Artificial Sequence
  chemically synthesized
acaatggctgagatttacaaaa

SEQ ID NO: 657735 - DNA, 22 bp, Artificial Sequence
  chemically synthesized
ttaacaatggctgagatttaca

SEQ ID NO: 657736 - DNA, 22 bp, Artificial Sequence
  chemically synthesized
tattaacaatggctgagattta

SEQ ID NO: 657737 - DNA, 22 bp, Artificial Sequence
  chemically synthesized
gttccattttgtaaatctcagc

SEQ ID NO: 657738 - DNA, 22 bp, Artificial Sequence
  chemically synthesized
attctattaacaatggctgaga

SEQ ID NO: 657739 - DNA, 22 bp, Artificial Sequence
  chemically synthesized
cattttgtaaatctcagccatt

SEQ ID NO: 657740 - DNA, 22 bp, Artificial Sequence
  chemically synthesized
taattctattaacaatggctga

SEQ ID NO: 657741 - DNA, 22 bp, Artificial Sequence
  chemically synthesized
tgtaaatctcagccattgttaa

SEQ ID NO: 657742 - DNA, 22 bp, Artificial Sequence
  chemically synthesized
gtaaatctcagccattgttaat

SEQ ID NO: 657743 - DNA, 22 bp, Artificial Sequence
  chemically synthesized
taaatctcagccattgttaata

SEQ ID NO: 657744 - DNA, 22 bp, Artificial Sequence
  chemically synthesized
aatccattctaattctattaac

SEQ ID NO: 657745 - DNA, 22 bp, Artificial Sequence
  chemically synthesized
tcaatccattctaattctatta

SEQ ID NO: 657746 - DNA, 22 bp, Artificial Sequence
  chemically synthesized
ctcaatccattctaattctatt

SEQ ID NO: 657747 - DNA, 22 bp, Artificial Sequence
  chemically synthesized
agccattgttaatagaattaga

SEQ ID NO: 657748 - DNA, 22 bp, Artificial Sequence
  chemically synthesized
ttaatagaattagaatggattg

SEQ ID NO: 657749 - DNA, 22 bp, Artificial Sequence
  chemically synthesized
tgtagggtttctcaatccattc

SEQ ID NO: 657750 - DNA, 22 bp, Artificial Sequence
  chemically synthesized
atgtagggtttctcaatccatt

SEQ ID NO: 657751 - DNA, 22 bp, Artificial Sequence
  chemically synthesized
atagaattagaatggattgaga

SEQ ID NO: 657752 - DNA, 22 bp, Artificial Sequence
  chemically synthesized
ttatgtagggtttctcaatcca

SEQ ID NO: 657753 - DNA, 22 bp, Artificial Sequence
  chemically synthesized
cttatgtagggtttctcaatcc

SEQ ID NO: 657754 - DNA, 22 bp, Artificial Sequence
  chemically synthesized
tcttatgtagggtttctcaatc

SEQ ID NO: 657755 - DNA, 22 bp, Artificial Sequence
  chemically synthesized
ttcttatgtagggtttctcaat

SEQ ID NO: 657756 - DNA, 22 bp, Artificial Sequence
  chemically synthesized
tttttcttatgtagggtttctc

SEQ ID NO: 657757 - DNA, 22 bp, Artificial Sequence
  chemically synthesized
gaatggattgagaaaccctaca

SEQ ID NO: 657758 - DNA, 22 bp, Artificial Sequence
  chemically synthesized
agagctgtttttcttatgtagg

SEQ ID NO: 657759 - DNA, 22 bp, Artificial Sequence
  chemically synthesized
agaaaccctacataagaaaaac

SEQ ID NO: 657760 - DNA, 22 bp, Artificial Sequence
  chemically synthesized
aagtgctaagagctgtttttct

SEQ ID NO: 657761 - DNA, 22 bp, Artificial Sequence
  chemically synthesized
caagtgctaagagctgtttttc

SEQ ID NO: 657762 - DNA, 22 bp, Artificial Sequence
  chemically synthesized
tcaagtgctaagagctgttttt

SEQ ID NO: 657763 - DNA, 22 bp, Artificial Sequence
  chemically synthesized
ttcaagtgctaagagctgtttt

SEQ ID NO: 657764 - DNA, 22 bp, Artificial Sequence
  chemically synthesized
tttcaagtgctaagagctgttt

SEQ ID NO: 657765 - DNA, 22 bp, Artificial Sequence
  chemically synthesized
cataagaaaaacagctcttagc

SEQ ID NO: 657766 - DNA, 22 bp, Artificial Sequence
  chemically synthesized
gttttttcaagtgctaagagct

SEQ ID NO: 657767 - DNA, 22 bp, Artificial Sequence
  chemically synthesized
ggttttttcaagtgctaagagc

SEQ ID NO: 657768 - DNA, 22 bp, Artificial Sequence
  chemically synthesized
tggttttttcaagtgctaagag

SEQ ID NO: 657769 - DNA, 22 bp, Artificial Sequence
  chemically synthesized
ttggttttttcaagtgctaaga

SEQ ID NO: 657770 - DNA, 22 bp, Artificial Sequence
  chemically synthesized
tttttggttttttcaagtgcta

SEQ ID NO: 657771 - DNA, 22 bp, Artificial Sequence
  chemically synthesized
gtttttggttttttcaagtgct

SEQ ID NO: 657772 - DNA, 22 bp, Artificial Sequence
  chemically synthesized
tgtttttggttttttcaagtgc

SEQ ID NO: 657773 - DNA, 22 bp, Artificial Sequence
  chemically synthesized
ttgtttttggttttttcaagtg

SEQ ID NO: 657774 - DNA, 22 bp, Artificial Sequence
  chemically synthesized
tgtttttgtttttggttttttc

SEQ ID NO: 657775 - DNA, 22 bp, Artificial Sequence
  chemically synthesized
atgtttttgtttttggtttttt

SEQ ID NO: 657776 - DNA, 22 bp, Artificial Sequence
  chemically synthesized
ttagcacttgaaaaaaccaaaa

SEQ ID NO: 657777 - DNA, 22 bp, Artificial Sequence
  chemically synthesized
ttatgtttttgtttttggtttt

SEQ ID NO: 657778 - DNA, 22 bp, Artificial Sequence
  chemically synthesized
agcacttgaaaaaaccaaaaac

SEQ ID NO: 657779 - DNA, 22 bp, Artificial Sequence
  chemically synthesized
gcacttgaaaaaaccaaaaaca

SEQ ID NO: 657780 - DNA, 22 bp, Artificial Sequence
  chemically synthesized
gaaaaaaccaaaaacaaaaaca

SEQ ID NO: 657781 - DNA, 22 bp, Artificial Sequence
  chemically synthesized
acagtgttcttatgtttttgtt

SEQ ID NO: 657782 - DNA, 22 bp, Artificial Sequence
  chemically synthesized
aaaaaaccaaaaacaaaaacat

SEQ ID NO: 657783 - DNA, 22 bp, Artificial Sequence
  chemically synthesized
ttcacagtgttcttatgttttt

SEQ ID NO: 657784 - DNA, 22 bp, Artificial Sequence
  chemically synthesized
ggtatcacattattcacagtgt

SEQ ID NO: 657785 - DNA, 22 bp, Artificial Sequence
  chemically synthesized
cggtatcacattattcacagtg

SEQ ID NO: 657786 - DNA, 22 bp, Artificial Sequence
  chemically synthesized
tcggtatcacattattcacagt

SEQ ID NO: 657787 - DNA, 22 bp, Artificial Sequence
  chemically synthesized
tgaataatgtgataccgaaagc

SEQ ID NO: 657788 - DNA, 22 bp, Artificial Sequence
  chemically synthesized
aaggagtaagatgctttcggta

SEQ ID NO: 657789 - DNA, 22 bp, Artificial Sequence
  chemically synthesized
tcagtattgaaggagtaagatg

SEQ ID NO: 657790 - DNA, 22 bp, Artificial Sequence
  chemically synthesized
taacgctatcagtattgaagga

SEQ ID NO: 657791 - DNA, 22 bp, Artificial Sequence
  chemically synthesized
attgtaacgctatcagtattga

SEQ ID NO: 657792 - DNA, 22 bp, Artificial Sequence
  chemically synthesized
taattgtaacgctatcagtatt

SEQ ID NO: 657793 - DNA, 22 bp, Artificial Sequence
  chemically synthesized
ttctaattgtaacgctatcagt

SEQ ID NO: 657794 - DNA, 22 bp, Artificial Sequence
  chemically synthesized
actccttcaatactgatagcgt

SEQ ID NO: 657795 - DNA, 22 bp, Artificial Sequence
  chemically synthesized
ctccttcaatactgatagcgtt

SEQ ID NO: 657796 - DNA, 22 bp, Artificial Sequence
  chemically synthesized
cttcaatactgatagcgttaca

SEQ ID NO: 657797 - DNA, 22 bp, Artificial Sequence
  chemically synthesized
caatactgatagcgttacaatt

SEQ ID NO: 657798 - DNA, 22 bp, Artificial Sequence
  chemically synthesized
aaaagttgttctaattgtaacg

SEQ ID NO: 657799 - DNA, 22 bp, Artificial Sequence
  chemically synthesized
aatactgatagcgttacaatta

SEQ ID NO: 657800 - DNA, 22 bp, Artificial Sequence
  chemically synthesized
caaaagttgttctaattgtaac

SEQ ID NO: 657801 - DNA, 22 bp, Artificial Sequence
  chemically synthesized
ttcaaaagttgttctaattgta

SEQ ID NO: 657802 - DNA, 22 bp, Artificial Sequence
  chemically synthesized
cttcaaaagttgttctaattgt

SEQ ID NO: 657803 - DNA, 22 bp, Artificial Sequence
  chemically synthesized
tcttcaaaagttgttctaattg

SEQ ID NO: 657804 - DNA, 22 bp, Artificial Sequence
  chemically synthesized
atagcgttacaattagaacaac

SEQ ID NO: 657805 - DNA, 22 bp, Artificial Sequence
  chemically synthesized
tggcctttcttcaaaagttgtt

SEQ ID NO: 657806 - DNA, 22 bp, Artificial Sequence
  chemically synthesized
gtggcctttcttcaaaagttgt

SEQ ID NO: 657807 - DNA, 22 bp, Artificial Sequence
  chemically synthesized
tgtggcctttcttcaaaagttg

SEQ ID NO: 657808 - DNA, 22 bp, Artificial Sequence
  chemically synthesized
ttgtggcctttcttcaaaagtt

SEQ ID NO: 657809 - DNA, 22 bp, Artificial Sequence
  chemically synthesized
tttgtggcctttcttcaaaagt

SEQ ID NO: 657810 - DNA, 22 bp, Artificial Sequence
  chemically synthesized
caattagaacaacttttgaaga

SEQ ID NO: 657811 - DNA, 22 bp, Artificial Sequence
  chemically synthesized
gaacaacttttgaagaaaggcc

SEQ ID NO: 657812 - DNA, 22 bp, Artificial Sequence
  chemically synthesized
ttgaagaaaggccacaaaaaat

SEQ ID NO: 657813 - DNA, 22 bp, Artificial Sequence
  chemically synthesized
tgaagaaaggccacaaaaaatg

SEQ ID NO: 657814 - DNA, 22 bp, Artificial Sequence
  chemically synthesized
gaagaaaggccacaaaaaatgt

SEQ ID NO: 657815 - DNA, 22 bp, Artificial Sequence
  chemically synthesized
aagaaaggccacaaaaaatgtt

SEQ ID NO: 657816 - DNA, 22 bp, Artificial Sequence
  chemically synthesized
ccagacaaaataatataaacat

SEQ ID NO: 657817 - DNA, 22 bp, Artificial Sequence
  chemically synthesized
aggcgtgtgattgccagacaaa

SEQ ID NO: 657818 - DNA, 22 bp, Artificial Sequence
  chemically synthesized
tcaggcgtgtgattgccagaca

SEQ ID NO: 657819 - DNA, 22 bp, Artificial Sequence
  chemically synthesized
atattattttgtctggcaatca

SEQ ID NO: 657820 - DNA, 22 bp, Artificial Sequence
  chemically synthesized
tattattttgtctggcaatcac

SEQ ID NO: 657821 - DNA, 22 bp, Artificial Sequence
  chemically synthesized
ttttgtctggcaatcacacgcc

SEQ ID NO: 657822 - DNA, 22 bp, Artificial Sequence
  chemically synthesized
tgtctggcaatcacacgcctga

SEQ ID NO: 657823 - DNA, 22 bp, Artificial Sequence
  chemically synthesized
taggatcaattctcaggcgtgt

SEQ ID NO: 657824 - DNA, 22 bp, Artificial Sequence
  chemically synthesized
gtctggcaatcacacgcctgag

SEQ ID NO: 657825 - DNA, 22 bp, Artificial Sequence
  chemically synthesized
ataggatcaattctcaggcgtg

SEQ ID NO: 657826 - DNA, 22 bp, Artificial Sequence
  chemically synthesized
tctggcaatcacacgcctgaga

SEQ ID NO: 657827 - DNA, 22 bp, Artificial Sequence
  chemically synthesized
tataggatcaattctcaggcgt

SEQ ID NO: 657828 - DNA, 22 bp, Artificial Sequence
  chemically synthesized
tttataggatcaattctcaggc

SEQ ID NO: 657829 - DNA, 22 bp, Artificial Sequence
  chemically synthesized
ctttataggatcaattctcagg

SEQ ID NO: 657830 - DNA, 22 bp, Artificial Sequence
  chemically synthesized
gcaatcacacgcctgagaattg

SEQ ID NO: 657831 - DNA, 22 bp, Artificial Sequence
  chemically synthesized
tctttataggatcaattctcag

SEQ ID NO: 657832 - DNA, 22 bp, Artificial Sequence
  chemically synthesized
aagctttctttataggatcaat

SEQ ID NO: 657833 - DNA, 22 bp, Artificial Sequence
  chemically synthesized
gaagctttctttataggatcaa

SEQ ID NO: 657834 - DNA, 22 bp, Artificial Sequence
  chemically synthesized
tgaagctttctttataggatca

SEQ ID NO: 657835 - DNA, 22 bp, Artificial Sequence
  chemically synthesized
tctttgaagctttctttatagg

SEQ ID NO: 657836 - DNA, 22 bp, Artificial Sequence
  chemically synthesized
gtctttgaagctttctttatag

SEQ ID NO: 657837 - DNA, 22 bp, Artificial Sequence
  chemically synthesized
tgtctttgaagctttctttata

SEQ ID NO: 657838 - DNA, 22 bp, Artificial Sequence
  chemically synthesized
agaattgatcctataaagaaag

SEQ ID NO: 657839 - DNA, 22 bp, Artificial Sequence
  chemically synthesized
ttgtctttgaagctttctttat

SEQ ID NO: 657840 - DNA, 22 bp, Artificial Sequence
  chemically synthesized
gcttttgtctttgaagctttct

SEQ ID NO: 657841 - DNA, 22 bp, Artificial Sequence
  chemically synthesized
agcttttgtctttgaagctttc

SEQ ID NO: 657842 - DNA, 22 bp, Artificial Sequence
  chemically synthesized
atcctataaagaaagcttcaaa

SEQ ID NO: 657843 - DNA, 22 bp, Artificial Sequence
  chemically synthesized
tcgtttagcttttgtctttgaa

SEQ ID NO: 657844 - DNA, 22 bp, Artificial Sequence
  chemically synthesized
atcgtttagcttttgtctttga

SEQ ID NO: 657845 - DNA, 22 bp, Artificial Sequence
  chemically synthesized
taaagaaagcttcaaagacaaa

SEQ ID NO: 657846 - DNA, 22 bp, Artificial Sequence
  chemically synthesized
caaagacaaaagctaaacgata

SEQ ID NO: 657847 - DNA, 22 bp, Artificial Sequence
  chemically synthesized
aaagacaaaagctaaacgataa

SEQ ID NO: 657848 - DNA, 22 bp, Artificial Sequence
  chemically synthesized
caatgaacatccttatcgttta

SEQ ID NO: 657849 - DNA, 22 bp, Artificial Sequence
  chemically synthesized
aacgataaggatgttcattgta

SEQ ID NO: 657850 - DNA, 22 bp, Artificial Sequence
  chemically synthesized
ggtagatagtgctacaatgaac

SEQ ID NO: 657851 - DNA, 22 bp, Artificial Sequence
  chemically synthesized
ttaggtagatagtgctacaatg

SEQ ID NO: 657852 - DNA, 22 bp, Artificial Sequence
  chemically synthesized
attaggtagatagtgctacaat

SEQ ID NO: 657853 - DNA, 22 bp, Artificial Sequence
  chemically synthesized
tattaggtagatagtgctacaa

SEQ ID NO: 657854 - DNA, 22 bp, Artificial Sequence
  chemically synthesized
ttattaggtagatagtgctaca

SEQ ID NO: 657855 - DNA, 22 bp, Artificial Sequence
  chemically synthesized
atttttattaggtagatagtgc

SEQ ID NO: 657856 - DNA, 22 bp, Artificial Sequence
  chemically synthesized
taatttttattaggtagatagt

SEQ ID NO: 657857 - DNA, 22 bp, Artificial Sequence
  chemically synthesized
attgtagcactatctacctaat

SEQ ID NO: 657858 - DNA, 22 bp, Artificial Sequence
  chemically synthesized
gcctctaatttttattaggtag

SEQ ID NO: 657859 - DNA, 22 bp, Artificial Sequence
  chemically synthesized
tagcactatctacctaataaaa

SEQ ID NO: 657860 - DNA, 22 bp, Artificial Sequence
  chemically synthesized
tctacctaataaaaattagagg

SEQ ID NO: 657861 - DNA, 22 bp, Artificial Sequence
  chemically synthesized
cctaataaaaattagaggccag

SEQ ID NO: 657862 - DNA, 22 bp, Artificial Sequence
  chemically synthesized
ataaaaattagaggccaggcac

SEQ ID NO: 657863 - DNA, 22 bp, Artificial Sequence
  chemically synthesized
caggcgtaagccaccgtgcctg

SEQ ID NO: 657864 - DNA, 22 bp, Artificial Sequence
  chemically synthesized
ggattacaggcgtaagccaccg

SEQ ID NO: 657865 - DNA, 22 bp, Artificial Sequence
  chemically synthesized
gaggccaggcacggtggcttac

SEQ ID NO: 657866 - DNA, 22 bp, Artificial Sequence
  chemically synthesized
ccaaagtgctcggattacaggc

SEQ ID NO: 657867 - DNA, 22 bp, Artificial Sequence
  chemically synthesized
gaactcccaaagtgctcggatt

SEQ ID NO: 657868 - DNA, 22 bp, Artificial Sequence
  chemically synthesized
acgcctgtaatccgagcacttt

SEQ ID NO: 657869 - DNA, 22 bp, Artificial Sequence
  chemically synthesized
cctcgaactcccaaagtgctcg

SEQ ID NO: 657870 - DNA, 22 bp, Artificial Sequence
  chemically synthesized
cgcctgtaatccgagcactttg

SEQ ID NO: 657871 - DNA, 22 bp, Artificial Sequence
  chemically synthesized
taatccgagcactttgggagtt

SEQ ID NO: 657872 - DNA, 22 bp, Artificial Sequence
  chemically synthesized
aggtgatccacctgcctcgaac

SEQ ID NO: 657873 - DNA, 22 bp, Artificial Sequence
  chemically synthesized
acctcaggtgatccacctgcct

SEQ ID NO: 657874 - DNA, 22 bp, Artificial Sequence
  chemically synthesized
tgggagttcgaggcaggtggat

SEQ ID NO: 657875 - DNA, 22 bp, Artificial Sequence
  chemically synthesized
gggagttcgaggcaggtggatc

SEQ ID NO: 657876 - DNA, 22 bp, Artificial Sequence
  chemically synthesized
ctgacctcaggtgatccacctg

SEQ ID NO: 657877 - DNA, 22 bp, Artificial Sequence
  chemically synthesized
ggagttcgaggcaggtggatca

SEQ ID NO: 657878 - DNA, 22 bp, Artificial Sequence
  chemically synthesized
aaactcctgacctcaggtgatc

SEQ ID NO: 657879 - DNA, 22 bp, Artificial Sequence
  chemically synthesized
gaggcaggtggatcacctgagg

SEQ ID NO: 657880 - DNA, 22 bp, Artificial Sequence
  chemically synthesized
gtctcaaactcctgacctcagg

SEQ ID NO: 657881 - DNA, 22 bp, Artificial Sequence
  chemically synthesized
gccaggctggtctcaaactcct

SEQ ID NO: 657882 - DNA, 22 bp, Artificial Sequence
  chemically synthesized
aggtcaggagtttgagaccagc

SEQ ID NO: 657883 - DNA, 22 bp, Artificial Sequence
  chemically synthesized
accaggttggccaggctggtct

SEQ ID NO: 657884 - DNA, 22 bp, Artificial Sequence
  chemically synthesized
caccaggttggccaggctggtc

SEQ ID NO: 657885 - DNA, 22 bp, Artificial Sequence
  chemically synthesized
gagaccagcctggccaacctgg

SEQ ID NO: 657886 - DNA, 22 bp, Artificial Sequence
  chemically synthesized
agaccagcctggccaacctggt

SEQ ID NO: 657887 - DNA, 22 bp, Artificial Sequence
  chemically synthesized
gtagagacagggtttcaccagg

SEQ ID NO: 657888 - DNA, 22 bp, Artificial Sequence
  chemically synthesized
agtagagacagggtttcaccag

SEQ ID NO: 657889 - DNA, 22 bp, Artificial Sequence
  chemically synthesized
tagtagagacagggtttcacca

SEQ ID NO: 657890 - DNA, 22 bp, Artificial Sequence
  chemically synthesized
ttagtagagacagggtttcacc

SEQ ID NO: 657891 - DNA, 22 bp, Artificial Sequence
  chemically synthesized
gccaacctggtgaaaccctgtc

SEQ ID NO: 657892 - DNA, 22 bp, Artificial Sequence
  chemically synthesized
tatttttagtagagacagggtt

SEQ ID NO: 657893 - DNA, 22 bp, Artificial Sequence
  chemically synthesized
gtatttttagtagagacagggt

SEQ ID NO: 657894 - DNA, 22 bp, Artificial Sequence
  chemically synthesized
tgtatttttagtagagacaggg

SEQ ID NO: 657895 - DNA, 22 bp, Artificial Sequence
  chemically synthesized
ttgtatttttagtagagacagg

SEQ ID NO: 657896 - DNA, 22 bp, Artificial Sequence
  chemically synthesized
atttttgtatttttagtagaga

SEQ ID NO: 657897 - DNA, 22 bp, Artificial Sequence
  chemically synthesized
gtgaaaccctgtctctactaaa

SEQ ID NO: 657898 - DNA, 22 bp, Artificial Sequence
  chemically synthesized
tctctactaaaaatacaaaaat

SEQ ID NO: 657899 - DNA, 22 bp, Artificial Sequence
  chemically synthesized
tactaaaaatacaaaaattagc

SEQ ID NO: 657900 - DNA, 22 bp, Artificial Sequence
  chemically synthesized
ctaaaaatacaaaaattagctt

SEQ ID NO: 657901 - DNA, 22 bp, Artificial Sequence
  chemically synthesized
aaaatacaaaaattagcttggg

SEQ ID NO: 657902 - DNA, 22 bp, Artificial Sequence
  chemically synthesized
caggcgcccaccgccaccccaa

SEQ ID NO: 657903 - DNA, 22 bp, Artificial Sequence
  chemically synthesized
ggattacaggcgcccaccgcca

SEQ ID NO: 657904 - DNA, 22 bp, Artificial Sequence
  chemically synthesized
gcttggggtggcggtgggcgcc

SEQ ID NO: 657905 - DNA, 22 bp, Artificial Sequence
  chemically synthesized
ggggtggcggtgggcgcctgta

SEQ ID NO: 657906 - DNA, 22 bp, Artificial Sequence
  chemically synthesized
gggtggcggtgggcgcctgtaa

SEQ ID NO: 657907 - DNA, 22 bp, Artificial Sequence
  chemically synthesized
ccgagtagctgggattacaggc

SEQ ID NO: 657908 - DNA, 22 bp, Artificial Sequence
  chemically synthesized
agcctcccgagtagctgggatt

SEQ ID NO: 657909 - DNA, 22 bp, Artificial Sequence
  chemically synthesized
cctcagcctcccgagtagctgg

SEQ ID NO: 657910 - DNA, 22 bp, Artificial Sequence
  chemically synthesized
ctacctcagcctcccgagtagc

SEQ ID NO: 657911 - DNA, 22 bp, Artificial Sequence
  chemically synthesized
tgctacctcagcctcccgagta

SEQ ID NO: 657912 - DNA, 22 bp, Artificial Sequence
  chemically synthesized
taatcccagctactcgggaggc

SEQ ID NO: 657913 - DNA, 22 bp, Artificial Sequence
  chemically synthesized
aagtgattctgctacctcagcc

SEQ ID NO: 657914 - DNA, 22 bp, Artificial Sequence
  chemically synthesized
ctcgggaggctgaggtagcaga

SEQ ID NO: 657915 - DNA, 22 bp, Artificial Sequence
  chemically synthesized
gggaggctgaggtagcagaatc

SEQ ID NO: 657916 - DNA, 22 bp, Artificial Sequence
  chemically synthesized
ccgggttcaagtgattctgcta

SEQ ID NO: 657917 - DNA, 22 bp, Artificial Sequence
  chemically synthesized
cacctcccgggttcaagtgatt

SEQ ID NO: 657918 - DNA, 22 bp, Artificial Sequence
  chemically synthesized
aggtagcagaatcacttgaacc

SEQ ID NO: 657919 - DNA, 22 bp, Artificial Sequence
  chemically synthesized
caacctccacctcccgggttca

SEQ ID NO: 657920 - DNA, 22 bp, Artificial Sequence
  chemically synthesized
actgcaacctccacctcccggg

SEQ ID NO: 657921 - DNA, 22 bp, Artificial Sequence
  chemically synthesized
ctcactgcaacctccacctccc

SEQ ID NO: 657922 - DNA, 22 bp, Artificial Sequence
  chemically synthesized
tgctcactgcaacctccacctc

SEQ ID NO: 657923 - DNA, 22 bp, Artificial Sequence
  chemically synthesized
gaacccgggaggtggaggttgc

SEQ ID NO: 657924 - DNA, 22 bp, Artificial Sequence
  chemically synthesized
aacccgggaggtggaggttgca

SEQ ID NO: 657925 - DNA, 22 bp, Artificial Sequence
  chemically synthesized
gagtgcagtggtgagatctctg

SEQ ID NO: 657926 - DNA, 22 bp, Artificial Sequence
  chemically synthesized
cagtgagcagagatctcaccac

SEQ ID NO: 657927 - DNA, 22 bp, Artificial Sequence
  chemically synthesized
tcacccaggctggagtgcagtg

SEQ ID NO: 657928 - DNA, 22 bp, Artificial Sequence
  chemically synthesized
tgtcacccaggctggagtgcag

SEQ ID NO: 657929 - DNA, 22 bp, Artificial Sequence
  chemically synthesized
gctctgtcacccaggctggagt

SEQ ID NO: 657930 - DNA, 22 bp, Artificial Sequence
  chemically synthesized
accactgcactccagcctgggt

SEQ ID NO: 657931 - DNA, 22 bp, Artificial Sequence
  chemically synthesized
cagtctcgctctgtcacccagg

SEQ ID NO: 657932 - DNA, 22 bp, Artificial Sequence
  chemically synthesized
cactccagcctgggtgacagag

SEQ ID NO: 657933 - DNA, 22 bp, Artificial Sequence
  chemically synthesized
agttgcagtctcgctctgtcac

SEQ ID NO: 657934 - DNA, 22 bp, Artificial Sequence
  chemically synthesized
gagttgcagtctcgctctgtca

SEQ ID NO: 657935 - DNA, 22 bp, Artificial Sequence
  chemically synthesized
tgagttgcagtctcgctctgtc

SEQ ID NO: 657936 - DNA, 22 bp, Artificial Sequence
  chemically synthesized
ttgagttgcagtctcgctctgt

SEQ ID NO: 657937 - DNA, 22 bp, Artificial Sequence
  chemically synthesized
cagcctgggtgacagagcgaga

SEQ ID NO: 657938 - DNA, 22 bp, Artificial Sequence
  chemically synthesized
tttgagttgcagtctcgctctg

SEQ ID NO: 657939 - DNA, 22 bp, Artificial Sequence
  chemically synthesized
ttttgagttgcagtctcgctct

SEQ ID NO: 657940 - DNA, 22 bp, Artificial Sequence
  chemically synthesized
ttttttgagttgcagtctcgct

SEQ ID NO: 657941 - DNA, 22 bp, Artificial Sequence
  chemically synthesized
cttttttgagttgcagtctcgc

SEQ ID NO: 657942 - DNA, 22 bp, Artificial Sequence
  chemically synthesized
tcttttttgagttgcagtctcg

SEQ ID NO: 657943 - DNA, 22 bp, Artificial Sequence
  chemically synthesized
ttcttttttgagttgcagtctc

SEQ ID NO: 657944 - DNA, 22 bp, Artificial Sequence
  chemically synthesized
ggtgacagagcgagactgcaac

SEQ ID NO: 657945 - DNA, 22 bp, Artificial Sequence
  chemically synthesized
tttcttttttgagttgcagtct

SEQ ID NO: 657946 - DNA, 22 bp, Artificial Sequence
  chemically synthesized
ttttcttttttgagttgcagtc

SEQ ID NO: 657947 - DNA, 22 bp, Artificial Sequence
  chemically synthesized
tttttcttttttgagttgcagt

SEQ ID NO: 657948 - DNA, 22 bp, Artificial Sequence
  chemically synthesized
ttttttcttttttgagttgcag

SEQ ID NO: 657949 - DNA, 22 bp, Artificial Sequence
  chemically synthesized
tttttttcttttttgagttgca

SEQ ID NO: 657950 - DNA, 22 bp, Artificial Sequence
  chemically synthesized
ttttttttcttttttgagttgc

SEQ ID NO: 657951 - DNA, 22 bp, Artificial Sequence
  chemically synthesized
tttttttttcttttttgagttg

SEQ ID NO: 657952 - DNA, 22 bp, Artificial Sequence
  chemically synthesized
ttttttttttcttttttgagtt

SEQ ID NO: 657953 - DNA, 22 bp, Artificial Sequence
  chemically synthesized
tttttttttttcttttttgagt

SEQ ID NO: 657954 - DNA, 22 bp, Artificial Sequence
  chemically synthesized
ttttttttttttcttttttgag

SEQ ID NO: 657955 - DNA, 22 bp, Artificial Sequence
  chemically synthesized
tttttttttttttcttttttga

SEQ ID NO: 657956 - DNA, 22 bp, Artificial Sequence
  chemically synthesized
ttttttttttttttcttttttg

SEQ ID NO: 657957 - DNA, 22 bp, Artificial Sequence
  chemically synthesized
cttttttttttttttttctttt

SEQ ID NO: 657958 - DNA, 22 bp, Artificial Sequence
  chemically synthesized
ccttttttttttttttttcttt

SEQ ID NO: 657959 - DNA, 22 bp, Artificial Sequence
  chemically synthesized
tccttttttttttttttttctt

SEQ ID NO: 657960 - DNA, 22 bp, Artificial Sequence
  chemically synthesized
caactcaaaaaagaaaaaaaaa

SEQ ID NO: 657961 - DNA, 22 bp, Artificial Sequence
  chemically synthesized
tttccttttttttttttttttc

SEQ ID NO: 657962 - DNA, 22 bp, Artificial Sequence
  chemically synthesized
tctttccttttttttttttttt

SEQ ID NO: 657963 - DNA, 22 bp, Artificial Sequence
  chemically synthesized
ctctttcctttttttttttttt

SEQ ID NO: 657964 - DNA, 22 bp, Artificial Sequence
  chemically synthesized
tctctttccttttttttttttt

SEQ ID NO: 657965 - DNA, 22 bp, Artificial Sequence
  chemically synthesized
ttctctttcctttttttttttt

SEQ ID NO: 657966 - DNA, 22 bp, Artificial Sequence
  chemically synthesized
aaaaaagaaaaaaaaaaaaaaa

SEQ ID NO: 657967 - DNA, 22 bp, Artificial Sequence
  chemically synthesized
tttctctttccttttttttttt

SEQ ID NO: 657968 - DNA, 22 bp, Artificial Sequence
  chemically synthesized
ttttctctttcctttttttttt

SEQ ID NO: 657969 - DNA, 22 bp, Artificial Sequence
  chemically synthesized
tttttctctttccttttttttt

SEQ ID NO: 657970 - DNA, 22 bp, Artificial Sequence
  chemically synthesized
ttttttctctttcctttttttt

SEQ ID NO: 657971 - DNA, 22 bp, Artificial Sequence
  chemically synthesized
atttttttttctctttcctttt

SEQ ID NO: 657972 - DNA, 22 bp, Artificial Sequence
  chemically synthesized
taatttttttttctctttcctt

SEQ ID NO: 657973 - DNA, 22 bp, Artificial Sequence
  chemically synthesized
ttctaatttttttttctctttc

SEQ ID NO: 657974 - DNA, 22 bp, Artificial Sequence
  chemically synthesized
gttctaatttttttttctcttt

SEQ ID NO: 657975 - DNA, 22 bp, Artificial Sequence
  chemically synthesized
atcttgttctaatttttttttc

SEQ ID NO: 657976 - DNA, 22 bp, Artificial Sequence
  chemically synthesized
gtagacattcatcttgttctaa

SEQ ID NO: 657977 - DNA, 22 bp, Artificial Sequence
  chemically synthesized
cactggtagacattcatcttgt

SEQ ID NO: 657978 - DNA, 22 bp, Artificial Sequence
  chemically synthesized
agcactccactggtagacattc

SEQ ID NO: 657979 - DNA, 22 bp, Artificial Sequence
  chemically synthesized
gaacaagatgaatgtctaccag

SEQ ID NO: 657980 - DNA, 22 bp, Artificial Sequence
  chemically synthesized
ccaaatgcctgagcactccact

SEQ ID NO: 657981 - DNA, 22 bp, Artificial Sequence
  chemically synthesized
cccaaatgcctgagcactccac

SEQ ID NO: 657982 - DNA, 22 bp, Artificial Sequence
  chemically synthesized
ttcccaaatgcctgagcactcc

SEQ ID NO: 657983 - DNA, 22 bp, Artificial Sequence
  chemically synthesized
cttcccaaatgcctgagcactc

SEQ ID NO: 657984 - DNA, 22 bp, Artificial Sequence
  chemically synthesized
ttcttcccaaatgcctgagcac

SEQ ID NO: 657985 - DNA, 22 bp, Artificial Sequence
  chemically synthesized
ccagtggagtgctcaggcattt

SEQ ID NO: 657986 - DNA, 22 bp, Artificial Sequence
  chemically synthesized
aggcatttgggaagaagagggt

SEQ ID NO: 657987 - DNA, 22 bp, Artificial Sequence
  chemically synthesized
gggaagaagagggtgtttctgg

SEQ ID NO: 657988 - DNA, 22 bp, Artificial Sequence
  chemically synthesized
ggaagaagagggtgtttctggg

SEQ ID NO: 657989 - DNA, 22 bp, Artificial Sequence
  chemically synthesized
tcgtagtcagtgccccagaaac

SEQ ID NO: 657990 - DNA, 22 bp, Artificial Sequence
  chemically synthesized
tgtcgtagtcagtgccccagaa

SEQ ID NO: 657991 - DNA, 22 bp, Artificial Sequence
  chemically synthesized
tctgtcgtagtcagtgccccag

SEQ ID NO: 657992 - DNA, 22 bp, Artificial Sequence
  chemically synthesized
ctctgtcgtagtcagtgcccca

SEQ ID NO: 657993 - DNA, 22 bp, Artificial Sequence
  chemically synthesized
tctctgtcgtagtcagtgcccc

SEQ ID NO: 657994 - DNA, 22 bp, Artificial Sequence
  chemically synthesized
ttctctgtcgtagtcagtgccc

SEQ ID NO: 657995 - DNA, 22 bp, Artificial Sequence
  chemically synthesized
tttctctgtcgtagtcagtgcc

SEQ ID NO: 657996 - DNA, 22 bp, Artificial Sequence
  chemically synthesized
ctttttctctgtcgtagtcagt

SEQ ID NO: 657997 - DNA, 22 bp, Artificial Sequence
  chemically synthesized
ctggggcactgactacgacaga

SEQ ID NO: 657998 - DNA, 22 bp, Artificial Sequence
  chemically synthesized
tggggcactgactacgacagag

SEQ ID NO: 657999 - DNA, 22 bp, Artificial Sequence
  chemically synthesized
gggcactgactacgacagagaa

SEQ ID NO: 658000 - DNA, 22 bp, Artificial Sequence
  chemically synthesized
tcccattgctttttctctgtcg

SEQ ID NO: 658001 - DNA, 22 bp, Artificial Sequence
  chemically synthesized
tcctgtcccattgctttttctc

SEQ ID NO: 658002 - DNA, 22 bp, Artificial Sequence
  chemically synthesized
actacgacagagaaaaagcaat

SEQ ID NO: 658003 - DNA, 22 bp, Artificial Sequence
  chemically synthesized
ctatcctgtcccattgcttttt

SEQ ID NO: 658004 - DNA, 22 bp, Artificial Sequence
  chemically synthesized
cctatcctgtcccattgctttt

SEQ ID NO: 658005 - DNA, 22 bp, Artificial Sequence
  chemically synthesized
tcctatcctgtcccattgcttt

SEQ ID NO: 658006 - DNA, 22 bp, Artificial Sequence
  chemically synthesized
cgacagagaaaaagcaatggga

SEQ ID NO: 658007 - DNA, 22 bp, Artificial Sequence
  chemically synthesized
tttcctatcctgtcccattgct

SEQ ID NO: 658008 - DNA, 22 bp, Artificial Sequence
  chemically synthesized
tctttcctatcctgtcccattg

SEQ ID NO: 658009 - DNA, 22 bp, Artificial Sequence
  chemically synthesized
tccgttctctttcctatcctgt

SEQ ID NO: 658010 - DNA, 22 bp, Artificial Sequence
  chemically synthesized
gtccgttctctttcctatcctg

SEQ ID NO: 658011 - DNA, 22 bp, Artificial Sequence
  chemically synthesized
ttgtccgttctctttcctatcc

SEQ ID NO: 658012 - DNA, 22 bp, Artificial Sequence
  chemically synthesized
aacacactcttgtccgttctct

SEQ ID NO: 658013 - DNA, 22 bp, Artificial Sequence
  chemically synthesized
actgaacacactcttgtccgtt

SEQ ID NO: 658014 - DNA, 22 bp, Artificial Sequence
  chemically synthesized
atgtccatcactgactgaacac

SEQ ID NO: 658015 - DNA, 22 bp, Artificial Sequence
  chemically synthesized
ctaatgtccatcactgactgaa

SEQ ID NO: 658016 - DNA, 22 bp, Artificial Sequence
  chemically synthesized
tgctaatgtccatcactgactg

SEQ ID NO: 658017 - DNA, 22 bp, Artificial Sequence
  chemically synthesized
tctgctaatgtccatcactgac

SEQ ID NO: 658018 - DNA, 22 bp, Artificial Sequence
  chemically synthesized
agtcagtgatggacattagcag

SEQ ID NO: 658019 - DNA, 22 bp, Artificial Sequence
  chemically synthesized
gaggtgtatactctctgctaat

SEQ ID NO: 658020 - DNA, 22 bp, Artificial Sequence
  chemically synthesized
caaagtctagaggtgtatactc

SEQ ID NO: 658021 - DNA, 22 bp, Artificial Sequence
  chemically synthesized
ttccaaagtctagaggtgtata

SEQ ID NO: 658022 - DNA, 22 bp, Artificial Sequence
  chemically synthesized
ttattccaaagtctagaggtgt

SEQ ID NO: 658023 - DNA, 22 bp, Artificial Sequence
  chemically synthesized
gcagagagtatacacctctaga

SEQ ID NO: 658024 - DNA, 22 bp, Artificial Sequence
  chemically synthesized
ccctattattccaaagtctaga

SEQ ID NO: 658025 - DNA, 22 bp, Artificial Sequence
  chemically synthesized
acattcccctattattccaaag

SEQ ID NO: 658026 - DNA, 22 bp, Artificial Sequence
  chemically synthesized
gacattcccctattattccaaa

SEQ ID NO: 658027 - DNA, 22 bp, Artificial Sequence
  chemically synthesized
tgacattcccctattattccaa

SEQ ID NO: 658028 - DNA, 22 bp, Artificial Sequence
  chemically synthesized
tagactttggaataatagggga

SEQ ID NO: 658029 - DNA, 22 bp, Artificial Sequence
  chemically synthesized
tagctttgacattcccctatta

SEQ ID NO: 658030 - DNA, 22 bp, Artificial Sequence
  chemically synthesized
gtagctttgacattcccctatt

SEQ ID NO: 658031 - DNA, 22 bp, Artificial Sequence
  chemically synthesized
gactttggaataataggggaat

SEQ ID NO: 658032 - DNA, 22 bp, Artificial Sequence
  chemically synthesized
tgtagctttgacattcccctat

SEQ ID NO: 658033 - DNA, 22 bp, Artificial Sequence
  chemically synthesized
tggaataataggggaatgtcaa

SEQ ID NO: 658034 - DNA, 22 bp, Artificial Sequence
  chemically synthesized
tcctttgtagctttgacattcc

SEQ ID NO: 658035 - DNA, 22 bp, Artificial Sequence
  chemically synthesized
ggaataataggggaatgtcaaa

SEQ ID NO: 658036 - DNA, 22 bp, Artificial Sequence
  chemically synthesized
gaataataggggaatgtcaaag

SEQ ID NO: 658037 - DNA, 22 bp, Artificial Sequence
  chemically synthesized
aaactgtcctttgtagctttga

SEQ ID NO: 658038 - DNA, 22 bp, Artificial Sequence
  chemically synthesized
aaaactgtcctttgtagctttg

SEQ ID NO: 658039 - DNA, 22 bp, Artificial Sequence
  chemically synthesized
taaaactgtcctttgtagcttt

SEQ ID NO: 658040 - DNA, 22 bp, Artificial Sequence
  chemically synthesized
ttaaaactgtcctttgtagctt

SEQ ID NO: 658041 - DNA, 22 bp, Artificial Sequence
  chemically synthesized
tttaaaactgtcctttgtagct

SEQ ID NO: 658042 - DNA, 22 bp, Artificial Sequence
  chemically synthesized
ttttaaaactgtcctttgtagc

SEQ ID NO: 658043 - DNA, 22 bp, Artificial Sequence
  chemically synthesized
tttttaaaactgtcctttgtag

SEQ ID NO: 658044 - DNA, 22 bp, Artificial Sequence
  chemically synthesized
ttttttaaaactgtcctttgta

SEQ ID NO: 658045 - DNA, 22 bp, Artificial Sequence
  chemically synthesized
tccttttttttaaaactgtcct

SEQ ID NO: 658046 - DNA, 22 bp, Artificial Sequence
  chemically synthesized
caaaggacagttttaaaaaaaa

SEQ ID NO: 658047 - DNA, 22 bp, Artificial Sequence
  chemically synthesized
gcacagctgtccttttttttaa

SEQ ID NO: 658048 - DNA, 22 bp, Artificial Sequence
  chemically synthesized
ttagcacagctgtccttttttt

SEQ ID NO: 658049 - DNA, 22 bp, Artificial Sequence
  chemically synthesized
gtaaattgttagcacagctgtc

SEQ ID NO: 658050 - DNA, 22 bp, Artificial Sequence
  chemically synthesized
taaaaaaaaggacagctgtgct

SEQ ID NO: 658051 - DNA, 22 bp, Artificial Sequence
  chemically synthesized
aaaaaaaaggacagctgtgcta

SEQ ID NO: 658052 - DNA, 22 bp, Artificial Sequence
  chemically synthesized
ttggtaaattgttagcacagct

SEQ ID NO: 658053 - DNA, 22 bp, Artificial Sequence
  chemically synthesized
aaaaaaaggacagctgtgctaa

SEQ ID NO: 658054 - DNA, 22 bp, Artificial Sequence
  chemically synthesized
aatggctgttggtaaattgtta

SEQ ID NO: 658055 - DNA, 22 bp, Artificial Sequence
  chemically synthesized
caatggctgttggtaaattgtt

SEQ ID NO: 658056 - DNA, 22 bp, Artificial Sequence
  chemically synthesized
tcaatggctgttggtaaattgt

SEQ ID NO: 658057 - DNA, 22 bp, Artificial Sequence
  chemically synthesized
ctttcaatggctgttggtaaat

SEQ ID NO: 658058 - DNA, 22 bp, Artificial Sequence
  chemically synthesized
tgctaacaatttaccaacagcc

SEQ ID NO: 658059 - DNA, 22 bp, Artificial Sequence
  chemically synthesized
tagcctcctttcaatggctgtt

SEQ ID NO: 658060 - DNA, 22 bp, Artificial Sequence
  chemically synthesized
acaatttaccaacagccattga

SEQ ID NO: 658061 - DNA, 22 bp, Artificial Sequence
  chemically synthesized
tcattatagcctcctttcaatg

SEQ ID NO: 658062 - DNA, 22 bp, Artificial Sequence
  chemically synthesized
tatcattatagcctcctttcaa

SEQ ID NO: 658063 - DNA, 22 bp, Artificial Sequence
  chemically synthesized
accaacagccattgaaaggagg

SEQ ID NO: 658064 - DNA, 22 bp, Artificial Sequence
  chemically synthesized
ccaacagccattgaaaggaggc

SEQ ID NO: 658065 - DNA, 22 bp, Artificial Sequence
  chemically synthesized
attctatcattatagcctcctt

SEQ ID NO: 658066 - DNA, 22 bp, Artificial Sequence
  chemically synthesized
taattctatcattatagcctcc

SEQ ID NO: 658067 - DNA, 22 bp, Artificial Sequence
  chemically synthesized
tctaattctatcattatagcct

SEQ ID NO: 658068 - DNA, 22 bp, Artificial Sequence
  chemically synthesized
ctctaattctatcattatagcc

SEQ ID NO: 658069 - DNA, 22 bp, Artificial Sequence
  chemically synthesized
tctctaattctatcattatagc

SEQ ID NO: 658070 - DNA, 22 bp, Artificial Sequence
  chemically synthesized
aaaggaggctataatgatagaa

SEQ ID NO: 658071 - DNA, 22 bp, Artificial Sequence
  chemically synthesized
agtcctttctctaattctatca

SEQ ID NO: 658072 - DNA, 22 bp, Artificial Sequence
  chemically synthesized
tgagtcctttctctaattctat

SEQ ID NO: 658073 - DNA, 22 bp, Artificial Sequence
  chemically synthesized
gtctctgagtcctttctctaat

SEQ ID NO: 658074 - DNA, 22 bp, Artificial Sequence
  chemically synthesized
agtctctgagtcctttctctaa

SEQ ID NO: 658075 - DNA, 22 bp, Artificial Sequence
  chemically synthesized
taatgatagaattagagaaagg

SEQ ID NO: 658076 - DNA, 22 bp, Artificial Sequence
  chemically synthesized
ttagtctctgagtcctttctct

SEQ ID NO: 658077 - DNA, 22 bp, Artificial Sequence
  chemically synthesized
taggcgagtctcttagtctctg

SEQ ID NO: 658078 - DNA, 22 bp, Artificial Sequence
  chemically synthesized
gagaaaggactcagagactaag

SEQ ID NO: 658079 - DNA, 22 bp, Artificial Sequence
  chemically synthesized
gtaggcgagtctcttagtctct

SEQ ID NO: 658080 - DNA, 22 bp, Artificial Sequence
  chemically synthesized
tgtaggcgagtctcttagtctc

SEQ ID NO: 658081 - DNA, 22 bp, Artificial Sequence
  chemically synthesized
agagactaagagactcgcctac

SEQ ID NO: 658082 - DNA, 22 bp, Artificial Sequence
  chemically synthesized
agagactcgcctacaaaggcca

SEQ ID NO: 658083 - DNA, 22 bp, Artificial Sequence
  chemically synthesized
tgtatataagaaaatggccttt

SEQ ID NO: 658084 - DNA, 22 bp, Artificial Sequence
  chemically synthesized
gcctacaaaggccattttctta

SEQ ID NO: 658085 - DNA, 22 bp, Artificial Sequence
  chemically synthesized
caaaggccattttcttatatac

SEQ ID NO: 658086 - DNA, 22 bp, Artificial Sequence
  chemically synthesized
gccacagaaatcctatgtatat

SEQ ID NO: 658087 - DNA, 22 bp, Artificial Sequence
  chemically synthesized
tagccacagaaatcctatgtat

SEQ ID NO: 658088 - DNA, 22 bp, Artificial Sequence
  chemically synthesized
tcttatatacataggatttctg

SEQ ID NO: 658089 - DNA, 22 bp, Artificial Sequence
  chemically synthesized
cttatatacataggatttctgt

SEQ ID NO: 658090 - DNA, 22 bp, Artificial Sequence
  chemically synthesized
ttatatacataggatttctgtg

SEQ ID NO: 658091 - DNA, 22 bp, Artificial Sequence
  chemically synthesized
atatacataggatttctgtggc

SEQ ID NO: 658092 - DNA, 22 bp, Artificial Sequence
  chemically synthesized
tatacataggatttctgtggct

SEQ ID NO: 658093 - DNA, 22 bp, Artificial Sequence
  chemically synthesized
agcaagggaggaaataagtctc

SEQ ID NO: 658094 - DNA, 22 bp, Artificial Sequence
  chemically synthesized
ctgtggctagagacttatttcc

SEQ ID NO: 658095 - DNA, 22 bp, Artificial Sequence
  chemically synthesized
tgtggctagagacttatttcct

SEQ ID NO: 658096 - DNA, 22 bp, Artificial Sequence
  chemically synthesized
tggctagagacttatttcctcc

SEQ ID NO: 658097 - DNA, 22 bp, Artificial Sequence
  chemically synthesized
gagacttatttcctcccttgct

SEQ ID NO: 658098 - DNA, 22 bp, Artificial Sequence
  chemically synthesized
gaggggaagaagttcagcaagg

SEQ ID NO: 658099 - DNA, 22 bp, Artificial Sequence
  chemically synthesized
atttcctcccttgctgaacttc

SEQ ID NO: 658100 - DNA, 22 bp, Artificial Sequence
  chemically synthesized
tttcctcccttgctgaacttct

SEQ ID NO: 658101 - DNA, 22 bp, Artificial Sequence
  chemically synthesized
cctcccttgctgaacttcttcc

SEQ ID NO: 658102 - DNA, 22 bp, Artificial Sequence
  chemically synthesized
aggtgctagaggggaagaagtt

SEQ ID NO: 658103 - DNA, 22 bp, Artificial Sequence
  chemically synthesized
ctcccttgctgaacttcttccc

SEQ ID NO: 658104 - DNA, 22 bp, Artificial Sequence
  chemically synthesized
ttgaggtgctagaggggaagaa

SEQ ID NO: 658105 - DNA, 22 bp, Artificial Sequence
  chemically synthesized
ccttgctgaacttcttcccctc

SEQ ID NO: 658106 - DNA, 22 bp, Artificial Sequence
  chemically synthesized
gctgaacttcttcccctctagc

SEQ ID NO: 658107 - DNA, 22 bp, Artificial Sequence
  chemically synthesized
ctgaacttcttcccctctagca

SEQ ID NO: 658108 - DNA, 22 bp, Artificial Sequence
  chemically synthesized
aacttcttcccctctagcacct

SEQ ID NO: 658109 - DNA, 22 bp, Artificial Sequence
  chemically synthesized
cttcccctctagcacctcaata

SEQ ID NO: 658110 - DNA, 22 bp, Artificial Sequence
  chemically synthesized
ttcccctctagcacctcaataa

SEQ ID NO: 658111 - DNA, 22 bp, Artificial Sequence
  chemically synthesized
cccctctagcacctcaataact

SEQ ID NO: 658112 - DNA, 22 bp, Artificial Sequence
  chemically synthesized
ccctctagcacctcaataactg

SEQ ID NO: 658113 - DNA, 22 bp, Artificial Sequence
  chemically synthesized
cagcagggaccccacagttatt

SEQ ID NO: 658114 - DNA, 22 bp, Artificial Sequence
  chemically synthesized
tagcacctcaataactgtgggg

SEQ ID NO: 658115 - DNA, 22 bp, Artificial Sequence
  chemically synthesized
gcacctcaataactgtggggtc

SEQ ID NO: 658116 - DNA, 22 bp, Artificial Sequence
  chemically synthesized
catctgcagcagggaccccaca

SEQ ID NO: 658117 - DNA, 22 bp, Artificial Sequence
  chemically synthesized
aataactgtggggtccctgctg

SEQ ID NO: 658118 - DNA, 22 bp, Artificial Sequence
  chemically synthesized
tggggtccctgctgcagatgga

SEQ ID NO: 658119 - DNA, 22 bp, Artificial Sequence
  chemically synthesized
aggaaggaaaagaaatctccat

SEQ ID NO: 658120 - DNA, 22 bp, Artificial Sequence
  chemically synthesized
ctgcagatggagatttcttttc

SEQ ID NO: 658121 - DNA, 22 bp, Artificial Sequence
  chemically synthesized
cagatggagatttcttttcctt

SEQ ID NO: 658122 - DNA, 22 bp, Artificial Sequence
  chemically synthesized
ggaaagaagacagtgctgagga

SEQ ID NO: 658123 - DNA, 22 bp, Artificial Sequence
  chemically synthesized
gggaaagaagacagtgctgagg

SEQ ID NO: 658124 - DNA, 22 bp, Artificial Sequence
  chemically synthesized
tgggaaagaagacagtgctgag

SEQ ID NO: 658125 - DNA, 22 bp, Artificial Sequence
  chemically synthesized
cttttccttcctcagcactgtc

SEQ ID NO: 658126 - DNA, 22 bp, Artificial Sequence
  chemically synthesized
ttttccttcctcagcactgtct

SEQ ID NO: 658127 - DNA, 22 bp, Artificial Sequence
  chemically synthesized
ttccttcctcagcactgtcttc

SEQ ID NO: 658128 - DNA, 22 bp, Artificial Sequence
  chemically synthesized
ggttttgggaaagaagacagtg

SEQ ID NO: 658129 - DNA, 22 bp, Artificial Sequence
  chemically synthesized
tccttcctcagcactgtcttct

SEQ ID NO: 658130 - DNA, 22 bp, Artificial Sequence
  chemically synthesized
ccttcctcagcactgtcttctt

SEQ ID NO: 658131 - DNA, 22 bp, Artificial Sequence
  chemically synthesized
taggttttgggaaagaagacag

SEQ ID NO: 658132 - DNA, 22 bp, Artificial Sequence
  chemically synthesized
cttcctcagcactgtcttcttt

SEQ ID NO: 658133 - DNA, 22 bp, Artificial Sequence
  chemically synthesized
cctcagcactgtcttctttccc

SEQ ID NO: 658134 - DNA, 22 bp, Artificial Sequence
  chemically synthesized
ctcagcactgtcttctttccca

SEQ ID NO: 658135 - DNA, 22 bp, Artificial Sequence
  chemically synthesized
gaactctaggttttgggaaaga

SEQ ID NO: 658136 - DNA, 22 bp, Artificial Sequence
  chemically synthesized
agcactgtcttctttcccaaaa

SEQ ID NO: 658137 - DNA, 22 bp, Artificial Sequence
  chemically synthesized
tggaactctaggttttgggaaa

SEQ ID NO: 658138 - DNA, 22 bp, Artificial Sequence
  chemically synthesized
ctggaactctaggttttgggaa

SEQ ID NO: 658139 - DNA, 22 bp, Artificial Sequence
  chemically synthesized
tcttctttcccaaaacctagag

SEQ ID NO: 658140 - DNA, 22 bp, Artificial Sequence
  chemically synthesized
ctttcccaaaacctagagttcc

SEQ ID NO: 658141 - DNA, 22 bp, Artificial Sequence
  chemically synthesized
tttcccaaaacctagagttcca

SEQ ID NO: 658142 - DNA, 22 bp, Artificial Sequence
  chemically synthesized
tcccaaaacctagagttccaga

SEQ ID NO: 658143 - DNA, 22 bp, Artificial Sequence
  chemically synthesized
cccaaaacctagagttccagaa

SEQ ID NO: 658144 - DNA, 22 bp, Artificial Sequence
  chemically synthesized
taagtaagcagcttctggaact

SEQ ID NO: 658145 - DNA, 22 bp, Artificial Sequence
  chemically synthesized
ccaaaacctagagttccagaag

SEQ ID NO: 658146 - DNA, 22 bp, Artificial Sequence
  chemically synthesized
tgtaagtaagcagcttctggaa

SEQ ID NO: 658147 - DNA, 22 bp, Artificial Sequence
  chemically synthesized
gaacctctgtaagtaagcagct

SEQ ID NO: 658148 - DNA, 22 bp, Artificial Sequence
  chemically synthesized
ggaacctctgtaagtaagcagc

SEQ ID NO: 658149 - DNA, 22 bp, Artificial Sequence
  chemically synthesized
gagttccagaagctgcttactt

SEQ ID NO: 658150 - DNA, 22 bp, Artificial Sequence
  chemically synthesized
cagaagctgcttacttacagag

SEQ ID NO: 658151 - DNA, 22 bp, Artificial Sequence
  chemically synthesized
ggatatttggaacctctgtaag

SEQ ID NO: 658152 - DNA, 22 bp, Artificial Sequence
  chemically synthesized
gggatatttggaacctctgtaa

SEQ ID NO: 658153 - DNA, 22 bp, Artificial Sequence
  chemically synthesized
cttacttacagaggttccaaat

SEQ ID NO: 658154 - DNA, 22 bp, Artificial Sequence
  chemically synthesized
acttacagaggttccaaatatc

SEQ ID NO: 658155 - DNA, 22 bp, Artificial Sequence
  chemically synthesized
cttacagaggttccaaatatcc

SEQ ID NO: 658156 - DNA, 22 bp, Artificial Sequence
  chemically synthesized
acagaggttccaaatatcccaa

SEQ ID NO: 658157 - DNA, 22 bp, Artificial Sequence
  chemically synthesized
cagaggttccaaatatcccaaa

SEQ ID NO: 658158 - DNA, 22 bp, Artificial Sequence
  chemically synthesized
agtaggcagtaggtatgggatt

SEQ ID NO: 658159 - DNA, 22 bp, Artificial Sequence
  chemically synthesized
caaatatcccaaatcccatacc

SEQ ID NO: 658160 - DNA, 22 bp, Artificial Sequence
  chemically synthesized
cagtaggcagtaggtatgggat

SEQ ID NO: 658161 - DNA, 22 bp, Artificial Sequence
  chemically synthesized
ttcagtaggcagtaggtatggg

SEQ ID NO: 658162 - DNA, 22 bp, Artificial Sequence
  chemically synthesized
gctcttcagtaggcagtaggta

SEQ ID NO: 658163 - DNA, 22 bp, Artificial Sequence
  chemically synthesized
atattagctcttcagtaggcag

SEQ ID NO: 658164 - DNA, 22 bp, Artificial Sequence
  chemically synthesized
tcatattagctcttcagtaggc

SEQ ID NO: 658165 - DNA, 22 bp, Artificial Sequence
  chemically synthesized
ctcatattagctcttcagtagg

SEQ ID NO: 658166 - DNA, 22 bp, Artificial Sequence
  chemically synthesized
tctcatattagctcttcagtag

SEQ ID NO: 658167 - DNA, 22 bp, Artificial Sequence
  chemically synthesized
gttttctcatattagctcttca

SEQ ID NO: 658168 - DNA, 22 bp, Artificial Sequence
  chemically synthesized
cgttttctcatattagctcttc

SEQ ID NO: 658169 - DNA, 22 bp, Artificial Sequence
  chemically synthesized
ctgcctactgaagagctaatat

SEQ ID NO: 658170 - DNA, 22 bp, Artificial Sequence
  chemically synthesized
cctactgaagagctaatatgag

SEQ ID NO: 658171 - DNA, 22 bp, Artificial Sequence
  chemically synthesized
ctgaagagctaatatgagaaaa

SEQ ID NO: 658172 - DNA, 22 bp, Artificial Sequence
  chemically synthesized
aagagctaatatgagaaaacga

SEQ ID NO: 658173 - DNA, 22 bp, Artificial Sequence
  chemically synthesized
aaaaacccacagagcttcgttt

SEQ ID NO: 658174 - DNA, 22 bp, Artificial Sequence
  chemically synthesized
atatgagaaaacgaagctctgt

SEQ ID NO: 658175 - DNA, 22 bp, Artificial Sequence
  chemically synthesized
attaaaaaacccacagagcttc

SEQ ID NO: 658176 - DNA, 22 bp, Artificial Sequence
  chemically synthesized
gaaattaattaaaaaacccaca

SEQ ID NO: 658177 - DNA, 22 bp, Artificial Sequence
  chemically synthesized
agaaattaattaaaaaacccac

SEQ ID NO: 658178 - DNA, 22 bp, Artificial Sequence
  chemically synthesized
tagaaattaattaaaaaaccca

SEQ ID NO: 658179 - DNA, 22 bp, Artificial Sequence
  chemically synthesized
atattttagaaattaattaaaa

SEQ ID NO: 658180 - DNA, 22 bp, Artificial Sequence
  chemically synthesized
catattttagaaattaattaaa

SEQ ID NO: 658181 - DNA, 22 bp, Artificial Sequence
  chemically synthesized
tcatattttagaaattaattaa

SEQ ID NO: 658182 - DNA, 22 bp, Artificial Sequence
  chemically synthesized
tgtgggttttttaattaatttc

SEQ ID NO: 658183 - DNA, 22 bp, Artificial Sequence
  chemically synthesized
tttcatattttagaaattaatt

SEQ ID NO: 658184 - DNA, 22 bp, Artificial Sequence
  chemically synthesized
tgggttttttaattaatttcta

SEQ ID NO: 658185 - DNA, 22 bp, Artificial Sequence
  chemically synthesized
ttctttcatattttagaaatta

SEQ ID NO: 658186 - DNA, 22 bp, Artificial Sequence
  chemically synthesized
attctttcatattttagaaatt

SEQ ID NO: 658187 - DNA, 22 bp, Artificial Sequence
  chemically synthesized
tttaattaatttctaaaatatg

SEQ ID NO: 658188 - DNA, 22 bp, Artificial Sequence
  chemically synthesized
ttaattaatttctaaaatatga

SEQ ID NO: 658189 - DNA, 22 bp, Artificial Sequence
  chemically synthesized
taattaatttctaaaatatgaa

SEQ ID NO: 658190 - DNA, 22 bp, Artificial Sequence
  chemically synthesized
aattaatttctaaaatatgaaa

SEQ ID NO: 658191 - DNA, 22 bp, Artificial Sequence
  chemically synthesized
attaatttctaaaatatgaaag

SEQ ID NO: 658192 - DNA, 22 bp, Artificial Sequence
  chemically synthesized
ggtaacatatttattctttcat

SEQ ID NO: 658193 - DNA, 22 bp, Artificial Sequence
  chemically synthesized
atttctaaaatatgaaagaata

SEQ ID NO: 658194 - DNA, 22 bp, Artificial Sequence
  chemically synthesized
taggtaacatatttattctttc

SEQ ID NO: 658195 - DNA, 22 bp, Artificial Sequence
  chemically synthesized
ctaggtaacatatttattcttt

SEQ ID NO: 658196 - DNA, 22 bp, Artificial Sequence
  chemically synthesized
ctaaaatatgaaagaataaata

SEQ ID NO: 658197 - DNA, 22 bp, Artificial Sequence
  chemically synthesized
taaaatatgaaagaataaatat

SEQ ID NO: 658198 - DNA, 22 bp, Artificial Sequence
  chemically synthesized
aaatatgaaagaataaatatgt

SEQ ID NO: 658199 - DNA, 22 bp, Artificial Sequence
  chemically synthesized
accttctaggtaacatatttat

SEQ ID NO: 658200 - DNA, 22 bp, Artificial Sequence
  chemically synthesized
ttcaccttctaggtaacatatt

SEQ ID NO: 658201 - DNA, 22 bp, Artificial Sequence
  chemically synthesized
taagttattcaccttctaggta

SEQ ID NO: 658202 - DNA, 22 bp, Artificial Sequence
  chemically synthesized
gtaagttattcaccttctaggt

SEQ ID NO: 658203 - DNA, 22 bp, Artificial Sequence
  chemically synthesized
caatttgtaagttattcacctt

SEQ ID NO: 658204 - DNA, 22 bp, Artificial Sequence
  chemically synthesized
ccaatttgtaagttattcacct

SEQ ID NO: 658205 - DNA, 22 bp, Artificial Sequence
  chemically synthesized
cttccaatttgtaagttattca

SEQ ID NO: 658206 - DNA, 22 bp, Artificial Sequence
  chemically synthesized
cctagaaggtgaataacttaca

SEQ ID NO: 658207 - DNA, 22 bp, Artificial Sequence
  chemically synthesized
gaaggtgaataacttacaaatt

SEQ ID NO: 658208 - DNA, 22 bp, Artificial Sequence
  chemically synthesized
agccaagtgtccggagctgctt

SEQ ID NO: 658209 - DNA, 22 bp, Artificial Sequence
  chemically synthesized
acaaattggaagcagctccgga

SEQ ID NO: 658210 - DNA, 22 bp, Artificial Sequence
  chemically synthesized
caaattggaagcagctccggac

SEQ ID NO: 658211 - DNA, 22 bp, Artificial Sequence
  chemically synthesized
gaagcagctccggacacttggc

SEQ ID NO: 658212 - DNA, 22 bp, Artificial Sequence
  chemically synthesized
ggggcagtaacattgagccaag

SEQ ID NO: 658213 - DNA, 22 bp, Artificial Sequence
  chemically synthesized
gggggcagtaacattgagccaa

SEQ ID NO: 658214 - DNA, 22 bp, Artificial Sequence
  chemically synthesized
tgggggcagtaacattgagcca

SEQ ID NO: 658215 - DNA, 22 bp, Artificial Sequence
  chemically synthesized
cggacacttggctcaatgttac

SEQ ID NO: 658216 - DNA, 22 bp, Artificial Sequence
  chemically synthesized
catcctttgggggcagtaacat

SEQ ID NO: 658217 - DNA, 22 bp, Artificial Sequence
  chemically synthesized
ggctcaatgttactgcccccaa

SEQ ID NO: 658218 - DNA, 22 bp, Artificial Sequence
  chemically synthesized
gctcaatgttactgcccccaaa

SEQ ID NO: 658219 - DNA, 22 bp, Artificial Sequence
  chemically synthesized
ggtgaagttgcatcctttgggg

SEQ ID NO: 658220 - DNA, 22 bp, Artificial Sequence
  chemically synthesized
aatgttactgcccccaaaggat

SEQ ID NO: 658221 - DNA, 22 bp, Artificial Sequence
  chemically synthesized
ctgcccccaaaggatgcaactt

SEQ ID NO: 658222 - DNA, 22 bp, Artificial Sequence
  chemically synthesized
cccccaaaggatgcaacttcac

SEQ ID NO: 658223 - DNA, 22 bp, Artificial Sequence
  chemically synthesized
caagacagttgggtgaagttgc

SEQ ID NO: 658224 - DNA, 22 bp, Artificial Sequence
  chemically synthesized
tccaaattccaagacagttggg

SEQ ID NO: 658225 - DNA, 22 bp, Artificial Sequence
  chemically synthesized
tatccaaattccaagacagttg

SEQ ID NO: 658226 - DNA, 22 bp, Artificial Sequence
  chemically synthesized
cacccaactgtcttggaatttg

SEQ ID NO: 658227 - DNA, 22 bp, Artificial Sequence
  chemically synthesized
catgattctatccaaattccaa

SEQ ID NO: 658228 - DNA, 22 bp, Artificial Sequence
  chemically synthesized
acccaactgtcttggaatttgg

SEQ ID NO: 658229 - DNA, 22 bp, Artificial Sequence
  chemically synthesized
tgcatgattctatccaaattcc

SEQ ID NO: 658230 - DNA, 22 bp, Artificial Sequence
  chemically synthesized
ctgcatgattctatccaaattc

SEQ ID NO: 658231 - DNA, 22 bp, Artificial Sequence
  chemically synthesized
cttctgcatgattctatccaaa

SEQ ID NO: 658232 - DNA, 22 bp, Artificial Sequence
  chemically synthesized
tcttggaatttggatagaatca

SEQ ID NO: 658233 - DNA, 22 bp, Artificial Sequence
  chemically synthesized
ggcctccttctgcatgattcta

SEQ ID NO: 658234 - DNA, 22 bp, Artificial Sequence
  chemically synthesized
ggaatttggatagaatcatgca

SEQ ID NO: 658235 - DNA, 22 bp, Artificial Sequence
  chemically synthesized
gaatttggatagaatcatgcag

SEQ ID NO: 658236 - DNA, 22 bp, Artificial Sequence
  chemically synthesized
ggatagaatcatgcagaaggag

SEQ ID NO: 658237 - DNA, 22 bp, Artificial Sequence
  chemically synthesized
gatagaatcatgcagaaggagg

SEQ ID NO: 658238 - DNA, 22 bp, Artificial Sequence
  chemically synthesized
tgaccagcgcaggctgggcctc

SEQ ID NO: 658239 - DNA, 22 bp, Artificial Sequence
  chemically synthesized
gtgaccagcgcaggctgggcct

SEQ ID NO: 658240 - DNA, 22 bp, Artificial Sequence
  chemically synthesized
tgtgaccagcgcaggctgggcc

SEQ ID NO: 658241 - DNA, 22 bp, Artificial Sequence
  chemically synthesized
aacaggattttgtgaccagcgc

SEQ ID NO: 658242 - DNA, 22 bp, Artificial Sequence
  chemically synthesized
cgctggtcacaaaatcctgttg

SEQ ID NO: 658243 - DNA, 22 bp, Artificial Sequence
  chemically synthesized
aagcaagtggcaagttcaacag

SEQ ID NO: 658244 - DNA, 22 bp, Artificial Sequence
  chemically synthesized
gtcacaaaatcctgttgaactt

SEQ ID NO: 658245 - DNA, 22 bp, Artificial Sequence
  chemically synthesized
caagcaagtggcaagttcaaca

SEQ ID NO: 658246 - DNA, 22 bp, Artificial Sequence
  chemically synthesized
tcaagcaagtggcaagttcaac

SEQ ID NO: 658247 - DNA, 22 bp, Artificial Sequence
  chemically synthesized
ttcaagcaagtggcaagttcaa

SEQ ID NO: 658248 - DNA, 22 bp, Artificial Sequence
  chemically synthesized
tagaccttttcaagcaagtggc

SEQ ID NO: 658249 - DNA, 22 bp, Artificial Sequence
  chemically synthesized
gtagaccttttcaagcaagtgg

SEQ ID NO: 658250 - DNA, 22 bp, Artificial Sequence
  chemically synthesized
tgtagaccttttcaagcaagtg

SEQ ID NO: 658251 - DNA, 22 bp, Artificial Sequence
  chemically synthesized
ttgaacttgccacttgcttgaa

SEQ ID NO: 658252 - DNA, 22 bp, Artificial Sequence
  chemically synthesized
ctttgtagaccttttcaagcaa

SEQ ID NO: 658253 - DNA, 22 bp, Artificial Sequence
  chemically synthesized
cctttgtagaccttttcaagca

SEQ ID NO: 658254 - DNA, 22 bp, Artificial Sequence
  chemically synthesized
aacttgccacttgcttgaaaag

SEQ ID NO: 658255 - DNA, 22 bp, Artificial Sequence
  chemically synthesized
ttcctttgtagaccttttcaag

SEQ ID NO: 658256 - DNA, 22 bp, Artificial Sequence
  chemically synthesized
cttcctttgtagaccttttcaa

SEQ ID NO: 658257 - DNA, 22 bp, Artificial Sequence
  chemically synthesized
ttcttcctttgtagaccttttc

SEQ ID NO: 658258 - DNA, 22 bp, Artificial Sequence
  chemically synthesized
gccacttgcttgaaaaggtcta

SEQ ID NO: 658259 - DNA, 22 bp, Artificial Sequence
  chemically synthesized
cttcttcctttgtagacctttt

SEQ ID NO: 658260 - DNA, 22 bp, Artificial Sequence
  chemically synthesized
ccacttgcttgaaaaggtctac

SEQ ID NO: 658261 - DNA, 22 bp, Artificial Sequence
  chemically synthesized
tcttcttcctttgtagaccttt

SEQ ID NO: 658262 - DNA, 22 bp, Artificial Sequence
  chemically synthesized
gcttgaaaaggtctacaaagga

SEQ ID NO: 658263 - DNA, 22 bp, Artificial Sequence
  chemically synthesized
caattttcttcttcctttgtag

SEQ ID NO: 658264 - DNA, 22 bp, Artificial Sequence
  chemically synthesized
cttgaaaaggtctacaaaggaa

SEQ ID NO: 658265 - DNA, 22 bp, Artificial Sequence
  chemically synthesized
ttgcaattttcttcttcctttg

SEQ ID NO: 658266 - DNA, 22 bp, Artificial Sequence
  chemically synthesized
gaaaaggtctacaaaggaagaa

SEQ ID NO: 658267 - DNA, 22 bp, Artificial Sequence
  chemically synthesized
aaaaggtctacaaaggaagaag

SEQ ID NO: 658268 - DNA, 22 bp, Artificial Sequence
  chemically synthesized
actgttgcaattttcttcttcc

SEQ ID NO: 658269 - DNA, 22 bp, Artificial Sequence
  chemically synthesized
gactgttgcaattttcttcttc

SEQ ID NO: 658270 - DNA, 22 bp, Artificial Sequence
  chemically synthesized
tgactgttgcaattttcttctt

SEQ ID NO: 658271 - DNA, 22 bp, Artificial Sequence
  chemically synthesized
tgttttgactgttgcaattttc

SEQ ID NO: 658272 - DNA, 22 bp, Artificial Sequence
  chemically synthesized
caaaggaagaagaaaattgcaa

SEQ ID NO: 658273 - DNA, 22 bp, Artificial Sequence
  chemically synthesized
gcatccatgggtgctgtgtttt

SEQ ID NO: 658274 - DNA, 22 bp, Artificial Sequence
  chemically synthesized
ctggcatccatgggtgctgtgt

SEQ ID NO: 658275 - DNA, 22 bp, Artificial Sequence
  chemically synthesized
caacagtcaaaacacagcaccc

SEQ ID NO: 658276 - DNA, 22 bp, Artificial Sequence
  chemically synthesized
tgctggcatccatgggtgctgt

SEQ ID NO: 658277 - DNA, 22 bp, Artificial Sequence
  chemically synthesized
gatgtcaggttctgctggcatc

SEQ ID NO: 658278 - DNA, 22 bp, Artificial Sequence
  chemically synthesized
agttggatgtcaggttctgctg

SEQ ID NO: 658279 - DNA, 22 bp, Artificial Sequence
  chemically synthesized
gaattgagttggatgtcaggtt

SEQ ID NO: 658280 - DNA, 22 bp, Artificial Sequence
  chemically synthesized
ctggaattgagttggatgtcag

SEQ ID NO: 658281 - DNA, 22 bp, Artificial Sequence
  chemically synthesized
ctactggaattgagttggatgt

SEQ ID NO: 658282 - DNA, 22 bp, Artificial Sequence
  chemically synthesized
agaattgctactggaattgagt

SEQ ID NO: 658283 - DNA, 22 bp, Artificial Sequence
  chemically synthesized
gagaattgctactggaattgag

SEQ ID NO: 658284 - DNA, 22 bp, Artificial Sequence
  chemically synthesized
ttgagaattgctactggaattg

SEQ ID NO: 658285 - DNA, 22 bp, Artificial Sequence
  chemically synthesized
acatccaactcaattccagtag

SEQ ID NO: 658286 - DNA, 22 bp, Artificial Sequence
  chemically synthesized
ctcttgagaattgctactggaa

SEQ ID NO: 658287 - DNA, 22 bp, Artificial Sequence
  chemically synthesized
gctactcttgagaattgctact

SEQ ID NO: 658288 - DNA, 22 bp, Artificial Sequence
  chemically synthesized
aattccagtagcaattctcaag

SEQ ID NO: 658289 - DNA, 22 bp, Artificial Sequence
  chemically synthesized
cagtagcaattctcaagagtag

SEQ ID NO: 658290 - DNA, 22 bp, Artificial Sequence
  chemically synthesized
tggaaatactggctactcttga

SEQ ID NO: 658291 - DNA, 22 bp, Artificial Sequence
  chemically synthesized
tgtggaaatactggctactctt

SEQ ID NO: 658292 - DNA, 22 bp, Artificial Sequence
  chemically synthesized
tcaagagtagccagtatttcca

SEQ ID NO: 658293 - DNA, 22 bp, Artificial Sequence
  chemically synthesized
aagagtagccagtatttccaca

SEQ ID NO: 658294 - DNA, 22 bp, Artificial Sequence
  chemically synthesized
gaagtaaccccactctgtggaa

SEQ ID NO: 658295 - DNA, 22 bp, Artificial Sequence
  chemically synthesized
gcacaaattagaagtaacccca

SEQ ID NO: 658296 - DNA, 22 bp, Artificial Sequence
  chemically synthesized
ccacagagtggggttacttcta

SEQ ID NO: 658297 - DNA, 22 bp, Artificial Sequence
  chemically synthesized
cacagagtggggttacttctaa

SEQ ID NO: 658298 - DNA, 22 bp, Artificial Sequence
  chemically synthesized
cttctaatttgtgctaatctgg

SEQ ID NO: 658299 - DNA, 22 bp, Artificial Sequence
  chemically synthesized
ctaatttgtgctaatctggata

SEQ ID NO: 658300 - DNA, 22 bp, Artificial Sequence
  chemically synthesized
taatttgtgctaatctggatat

SEQ ID NO: 658301 - DNA, 22 bp, Artificial Sequence
  chemically synthesized
ataaaaataataaatatccaga

SEQ ID NO: 658302 - DNA, 22 bp, Artificial Sequence
  chemically synthesized
atttgtgctaatctggatattt

SEQ ID NO: 658303 - DNA, 22 bp, Artificial Sequence
  chemically synthesized
attcataaaaataataaatatc

SEQ ID NO: 658304 - DNA, 22 bp, Artificial Sequence
  chemically synthesized
gtgctaatctggatatttatta

SEQ ID NO: 658305 - DNA, 22 bp, Artificial Sequence
  chemically synthesized
gattcataaaaataataaatat

SEQ ID NO: 658306 - DNA, 22 bp, Artificial Sequence
  chemically synthesized
tgctaatctggatatttattat

SEQ ID NO: 658307 - DNA, 22 bp, Artificial Sequence
  chemically synthesized
acttgattcataaaaataataa

SEQ ID NO: 658308 - DNA, 22 bp, Artificial Sequence
  chemically synthesized
atctggatatttattattttta

SEQ ID NO: 658309 - DNA, 22 bp, Artificial Sequence
  chemically synthesized
gatatttattatttttatgaat

SEQ ID NO: 658310 - DNA, 22 bp, Artificial Sequence
  chemically synthesized
attatttttatgaatcaagtta

SEQ ID NO: 658311 - DNA, 22 bp, Artificial Sequence
  chemically synthesized
ttatttttatgaatcaagttaa

SEQ ID NO: 658312 - DNA, 22 bp, Artificial Sequence
  chemically synthesized
tttttatgaatcaagttaatga

SEQ ID NO: 658313 - DNA, 22 bp, Artificial Sequence
  chemically synthesized
ttatgaatcaagttaatgatca

SEQ ID NO: 658314 - DNA, 22 bp, Artificial Sequence
  chemically synthesized
atatatatacagtgatcattaa

SEQ ID NO: 658315 - DNA, 22 bp, Artificial Sequence
  chemically synthesized
tatgaatcaagttaatgatcac

SEQ ID NO: 658316 - DNA, 22 bp, Artificial Sequence
  chemically synthesized
catatatatacagtgatcatta

SEQ ID NO: 658317 - DNA, 22 bp, Artificial Sequence
  chemically synthesized
atgaatcaagttaatgatcact

SEQ ID NO: 658318 - DNA, 22 bp, Artificial Sequence
  chemically synthesized
tgaatcaagttaatgatcactg

SEQ ID NO: 658319 - DNA, 22 bp, Artificial Sequence
  chemically synthesized
tcacacttcatatatatacagt

SEQ ID NO: 658320 - DNA, 22 bp, Artificial Sequence
  chemically synthesized
atgatcactgtatatatatgaa

SEQ ID NO: 658321 - DNA, 22 bp, Artificial Sequence
  chemically synthesized
tgtaaaagttatcacacttcat

SEQ ID NO: 658322 - DNA, 22 bp, Artificial Sequence
  chemically synthesized
atgtaaaagttatcacacttca

SEQ ID NO: 658323 - DNA, 22 bp, Artificial Sequence
  chemically synthesized
tatatatatgaagtgtgataac

SEQ ID NO: 658324 - DNA, 22 bp, Artificial Sequence
  chemically synthesized
cagtgacacagtttatgtaaaa

SEQ ID NO: 658325 - DNA, 22 bp, Artificial Sequence
  chemically synthesized
gcagtgacacagtttatgtaaa

SEQ ID NO: 658326 - DNA, 22 bp, Artificial Sequence
  chemically synthesized
ttgcagtgacacagtttatgta

SEQ ID NO: 658327 - DNA, 22 bp, Artificial Sequence
  chemically synthesized
cttgcagtgacacagtttatgt

SEQ ID NO: 658328 - DNA, 22 bp, Artificial Sequence
  chemically synthesized
cgcttcttgcagtgacacagtt

SEQ ID NO: 658329 - DNA, 22 bp, Artificial Sequence
  chemically synthesized
gcgcttcttgcagtgacacagt

SEQ ID NO: 658330 - DNA, 22 bp, Artificial Sequence
  chemically synthesized
ttacataaactgtgtcactgca

SEQ ID NO: 658331 - DNA, 22 bp, Artificial Sequence
  chemically synthesized
tacataaactgtgtcactgcaa

SEQ ID NO: 658332 - DNA, 22 bp, Artificial Sequence
  chemically synthesized
acataaactgtgtcactgcaag

SEQ ID NO: 658333 - DNA, 22 bp, Artificial Sequence
  chemically synthesized
cataaactgtgtcactgcaaga

SEQ ID NO: 658334 - DNA, 22 bp, Artificial Sequence
  chemically synthesized
tgtcactgcaagaagcgcaagc

SEQ ID NO: 658335 - DNA, 22 bp, Artificial Sequence
  chemically synthesized
caagaagcgcaagcttacacgt

SEQ ID NO: 658336 - DNA, 22 bp, Artificial Sequence
  chemically synthesized
agtgtcgagggtacgtgtaagc

SEQ ID NO: 658337 - DNA, 22 bp, Artificial Sequence
  chemically synthesized
aagtgtcgagggtacgtgtaag

SEQ ID NO: 658338 - DNA, 22 bp, Artificial Sequence
  chemically synthesized
gaagaaatttaagtgtcgaggg

SEQ ID NO: 658339 - DNA, 22 bp, Artificial Sequence
  chemically synthesized
agaagaaatttaagtgtcgagg

SEQ ID NO: 658340 - DNA, 22 bp, Artificial Sequence
  chemically synthesized
acacgtaccctcgacacttaaa

SEQ ID NO: 658341 - DNA, 22 bp, Artificial Sequence
  chemically synthesized
gcttagaagaaatttaagtgtc

SEQ ID NO: 658342 - DNA, 22 bp, Artificial Sequence
  chemically synthesized
cacgtaccctcgacacttaaat

SEQ ID NO: 658343 - DNA, 22 bp, Artificial Sequence
  chemically synthesized
tggcttagaagaaatttaagtg

SEQ ID NO: 658344 - DNA, 22 bp, Artificial Sequence
  chemically synthesized
tgttctggcttagaagaaattt

SEQ ID NO: 658345 - DNA, 22 bp, Artificial Sequence
  chemically synthesized
gacacttaaatttcttctaagc

SEQ ID NO: 658346 - DNA, 22 bp, Artificial Sequence
  chemically synthesized
ccaaggattatgttctggctta

SEQ ID NO: 658347 - DNA, 22 bp, Artificial Sequence
  chemically synthesized
aaatttcttctaagccagaaca

SEQ ID NO: 658348 - DNA, 22 bp, Artificial Sequence
  chemically synthesized
aatttcttctaagccagaacat

SEQ ID NO: 658349 - DNA, 22 bp, Artificial Sequence
  chemically synthesized
cttctaagccagaacataatcc

SEQ ID NO: 658350 - DNA, 22 bp, Artificial Sequence
  chemically synthesized
ttctaagccagaacataatcct

SEQ ID NO: 658351 - DNA, 22 bp, Artificial Sequence
  chemically synthesized
ctaagccagaacataatccttg

SEQ ID NO: 658352 - DNA, 22 bp, Artificial Sequence
  chemically synthesized
taagccagaacataatccttgg

SEQ ID NO: 658353 - DNA, 22 bp, Artificial Sequence
  chemically synthesized
tatacaataattcccaaggatt

SEQ ID NO: 658354 - DNA, 22 bp, Artificial Sequence
  chemically synthesized
agccagaacataatccttggga

SEQ ID NO: 658355 - DNA, 22 bp, Artificial Sequence
  chemically synthesized
catcctatatacaataattccc

SEQ ID NO: 658356 - DNA, 22 bp, Artificial Sequence
  chemically synthesized
atgtagttacatcctatataca

SEQ ID NO: 658357 - DNA, 22 bp, Artificial Sequence
  chemically synthesized
gatgtagttacatcctatatac

SEQ ID NO: 658358 - DNA, 22 bp, Artificial Sequence
  chemically synthesized
tgatgtagttacatcctatata

SEQ ID NO: 658359 - DNA, 22 bp, Artificial Sequence
  chemically synthesized
gggaattattgtatataggatg

SEQ ID NO: 658360 - DNA, 22 bp, Artificial Sequence
  chemically synthesized
ttgatgtagttacatcctatat

SEQ ID NO: 658361 - DNA, 22 bp, Artificial Sequence
  chemically synthesized
ggaattattgtatataggatgt

SEQ ID NO: 658362 - DNA, 22 bp, Artificial Sequence
  chemically synthesized
tttgatgtagttacatcctata

SEQ ID NO: 658363 - DNA, 22 bp, Artificial Sequence
  chemically synthesized
ttttttgatgtagttacatcct

SEQ ID NO: 658364 - DNA, 22 bp, Artificial Sequence
  chemically synthesized
attttttgatgtagttacatcc

SEQ ID NO: 658365 - DNA, 22 bp, Artificial Sequence
  chemically synthesized
ttgtatataggatgtaactaca

SEQ ID NO: 658366 - DNA, 22 bp, Artificial Sequence
  chemically synthesized
tatataggatgtaactacatca

SEQ ID NO: 658367 - DNA, 22 bp, Artificial Sequence
  chemically synthesized
aaacacttattttttgatgtag

SEQ ID NO: 658368 - DNA, 22 bp, Artificial Sequence
  chemically synthesized
atgctaaaacacttattttttg

SEQ ID NO: 658369 - DNA, 22 bp, Artificial Sequence
  chemically synthesized
aatgctaaaacacttatttttt

SEQ ID NO: 658370 - DNA, 22 bp, Artificial Sequence
  chemically synthesized
ttaatgctaaaacacttatttt

SEQ ID NO: 658371 - DNA, 22 bp, Artificial Sequence
  chemically synthesized
catcaaaaaataagtgttttag

SEQ ID NO: 658372 - DNA, 22 bp, Artificial Sequence
  chemically synthesized
tatgtctcttaatgctaaaaca

SEQ ID NO: 658373 - DNA, 22 bp, Artificial Sequence
  chemically synthesized
ggccagttatatgtctcttaat

SEQ ID NO: 658374 - DNA, 22 bp, Artificial Sequence
  chemically synthesized
gggccagttatatgtctcttaa

SEQ ID NO: 658375 - DNA, 22 bp, Artificial Sequence
  chemically synthesized
tgggccagttatatgtctctta

SEQ ID NO: 658376 - DNA, 22 bp, Artificial Sequence
  chemically synthesized
tagcattaagagacatataact

SEQ ID NO: 658377 - DNA, 22 bp, Artificial Sequence
  chemically synthesized
agcattaagagacatataactg

SEQ ID NO: 658378 - DNA, 22 bp, Artificial Sequence
  chemically synthesized
gcattaagagacatataactgg

SEQ ID NO: 658379 - DNA, 22 bp, Artificial Sequence
  chemically synthesized
agagacatataactggcccaaa

SEQ ID NO: 658380 - DNA, 22 bp, Artificial Sequence
  chemically synthesized
gtgtccaaggagggtggtgctt

SEQ ID NO: 658381 - DNA, 22 bp, Artificial Sequence
  chemically synthesized
tggtgtccaaggagggtggtgc

SEQ ID NO: 658382 - DNA, 22 bp, Artificial Sequence
  chemically synthesized
gcccaaagcaccaccctccttg

SEQ ID NO: 658383 - DNA, 22 bp, Artificial Sequence
  chemically synthesized
aatctctggtgtccaaggaggg

SEQ ID NO: 658384 - DNA, 22 bp, Artificial Sequence
  chemically synthesized
gaatctctggtgtccaaggagg

SEQ ID NO: 658385 - DNA, 22 bp, Artificial Sequence
  chemically synthesized
tgaatctctggtgtccaaggag

SEQ ID NO: 658386 - DNA, 22 bp, Artificial Sequence
  chemically synthesized
ttgaatctctggtgtccaagga

SEQ ID NO: 658387 - DNA, 22 bp, Artificial Sequence
  chemically synthesized
tggtacatttttgaatctctgg

SEQ ID NO: 658388 - DNA, 22 bp, Artificial Sequence
  chemically synthesized
cttggacaccagagattcaaaa

SEQ ID NO: 658389 - DNA, 22 bp, Artificial Sequence
  chemically synthesized
ggacaccagagattcaaaaatg

SEQ ID NO: 658390 - DNA, 22 bp, Artificial Sequence
  chemically synthesized
gacaccagagattcaaaaatgt

SEQ ID NO: 658391 - DNA, 22 bp, Artificial Sequence
  chemically synthesized
cataaagaagtcccaactgtgg

SEQ ID NO: 658392 - DNA, 22 bp, Artificial Sequence
  chemically synthesized
aaaaatgtaccacagttgggac

SEQ ID NO: 658393 - DNA, 22 bp, Artificial Sequence
  chemically synthesized
tgactccataaagaagtcccaa

SEQ ID NO: 658394 - DNA, 22 bp, Artificial Sequence
  chemically synthesized
atgactccataaagaagtccca

SEQ ID NO: 658395 - DNA, 22 bp, Artificial Sequence
  chemically synthesized
agtgatcttatgactccataaa

SEQ ID NO: 658396 - DNA, 22 bp, Artificial Sequence
  chemically synthesized
ggacttctttatggagtcataa

SEQ ID NO: 658397 - DNA, 22 bp, Artificial Sequence
  chemically synthesized
gaagctcagtgatcttatgact

SEQ ID NO: 658398 - DNA, 22 bp, Artificial Sequence
  chemically synthesized
ctttatggagtcataagatcac

SEQ ID NO: 658399 - DNA, 22 bp, Artificial Sequence
  chemically synthesized
tttatggagtcataagatcact

SEQ ID NO: 658400 - DNA, 22 bp, Artificial Sequence
  chemically synthesized
tatggagtcataagatcactga

SEQ ID NO: 658401 - DNA, 22 bp, Artificial Sequence
  chemically synthesized
atggagtcataagatcactgag

SEQ ID NO: 658402 - DNA, 22 bp, Artificial Sequence
  chemically synthesized
tggagtcataagatcactgagc

SEQ ID NO: 658403 - DNA, 22 bp, Artificial Sequence
  chemically synthesized
tgggaacacatacatgatggac

SEQ ID NO: 658404 - DNA, 22 bp, Artificial Sequence
  chemically synthesized
agcttctagtccatcatgtatg

SEQ ID NO: 658405 - DNA, 22 bp, Artificial Sequence
  chemically synthesized
ctagtccatcatgtatgtgttc

SEQ ID NO: 658406 - DNA, 22 bp, Artificial Sequence
  chemically synthesized
tagtccatcatgtatgtgttcc

SEQ ID NO: 658407 - DNA, 22 bp, Artificial Sequence
  chemically synthesized
gtccatcatgtatgtgttccca

SEQ ID NO: 658408 - DNA, 22 bp, Artificial Sequence
  chemically synthesized
tgcacagtatcctgtgggaaca

SEQ ID NO: 658409 - DNA, 22 bp, Artificial Sequence
  chemically synthesized
ccacaggatactgtgcatagtt

SEQ ID NO: 658410 - DNA, 22 bp, Artificial Sequence
  chemically synthesized
aaaaaacaacaacaacaacaac

SEQ ID NO: 658411 - DNA, 22 bp, Artificial Sequence
  chemically synthesized
tgcatagtttgttgttgttgtt

SEQ ID NO: 658412 - DNA, 22 bp, Artificial Sequence
  chemically synthesized
cgtctcaaaaaacaacaacaac

SEQ ID NO: 658413 - DNA, 22 bp, Artificial Sequence
  chemically synthesized
gttgttgttgttgttgtttttt

SEQ ID NO: 658414 - DNA, 22 bp, Artificial Sequence
  chemically synthesized
ttgttgttgttgttgttttttg

SEQ ID NO: 658415 - DNA, 22 bp, Artificial Sequence
  chemically synthesized
ttgttgttgttgttttttgaga

SEQ ID NO: 658416 - DNA, 22 bp, Artificial Sequence
  chemically synthesized
ttgttgttgttttttgagacgg

SEQ ID NO: 658417 - DNA, 22 bp, Artificial Sequence
  chemically synthesized
ttgttgttttttgagacggagt

SEQ ID NO: 658418 - DNA, 22 bp, Artificial Sequence
  chemically synthesized
ggcgacagagcaagactccgtc

SEQ ID NO: 658419 - DNA, 22 bp, Artificial Sequence
  chemically synthesized
ttgttttttgagacggagtctt

SEQ ID NO: 658420 - DNA, 22 bp, Artificial Sequence
  chemically synthesized
ttttttgagacggagtcttgct

SEQ ID NO: 658421 - DNA, 22 bp, Artificial Sequence
  chemically synthesized
tttgagacggagtcttgctctg

SEQ ID NO: 658422 - DNA, 22 bp, Artificial Sequence
  chemically synthesized
cagcctgggcgacagagcaaga

SEQ ID NO: 658423 - DNA, 22 bp, Artificial Sequence
  chemically synthesized
ttgagacggagtcttgctctgt

SEQ ID NO: 658424 - DNA, 22 bp, Artificial Sequence
  chemically synthesized
tgagacggagtcttgctctgtc

SEQ ID NO: 658425 - DNA, 22 bp, Artificial Sequence
  chemically synthesized
gagacggagtcttgctctgtcg

SEQ ID NO: 658426 - DNA, 22 bp, Artificial Sequence
  chemically synthesized
agacggagtcttgctctgtcgc

SEQ ID NO: 658427 - DNA, 22 bp, Artificial Sequence
  chemically synthesized
cactgcagcctgggcgacagag

SEQ ID NO: 658428 - DNA, 22 bp, Artificial Sequence
  chemically synthesized
gctctgtcgcccaggctgcagt

SEQ ID NO: 658429 - DNA, 22 bp, Artificial Sequence
  chemically synthesized
ctctgtcgcccaggctgcagtg

SEQ ID NO: 658430 - DNA, 22 bp, Artificial Sequence
  chemically synthesized
tgtcgcccaggctgcagtgcag

SEQ ID NO: 658431 - DNA, 22 bp, Artificial Sequence
  chemically synthesized
tcgcccaggctgcagtgcagtg

SEQ ID NO: 658432 - DNA, 22 bp, Artificial Sequence
  chemically synthesized
cggtgagcagagatcgcaccac

SEQ ID NO: 658433 - DNA, 22 bp, Artificial Sequence
  chemically synthesized
cagtgcagtggtgcgatctctg

SEQ ID NO: 658434 - DNA, 22 bp, Artificial Sequence
  chemically synthesized
aacccgggaggcagaggttgcg

SEQ ID NO: 658435 - DNA, 22 bp, Artificial Sequence
  chemically synthesized
gaacccgggaggcagaggttgc

SEQ ID NO: 658436 - DNA, 22 bp, Artificial Sequence
  chemically synthesized
tgctcaccgcaacctctgcctc

SEQ ID NO: 658437 - DNA, 22 bp, Artificial Sequence
  chemically synthesized
ctcaccgcaacctctgcctccc

SEQ ID NO: 658438 - DNA, 22 bp, Artificial Sequence
  chemically synthesized
accgcaacctctgcctcccggg

SEQ ID NO: 658439 - DNA, 22 bp, Artificial Sequence
  chemically synthesized
aggcaggagaatggcttgaacc

SEQ ID NO: 658440 - DNA, 22 bp, Artificial Sequence
  chemically synthesized
tgcctcccgggttcaagccatt

SEQ ID NO: 658441 - DNA, 22 bp, Artificial Sequence
  chemically synthesized
cctcccgggttcaagccattct

SEQ ID NO: 658442 - DNA, 22 bp, Artificial Sequence
  chemically synthesized
ccgggttcaagccattctcctg

SEQ ID NO: 658443 - DNA, 22 bp, Artificial Sequence
  chemically synthesized
aggcggctgaggcaggagaatg

SEQ ID NO: 658444 - DNA, 22 bp, Artificial Sequence
  chemically synthesized
ctcaggcggctgaggcaggaga

SEQ ID NO: 658445 - DNA, 22 bp, Artificial Sequence
  chemically synthesized
aagccattctcctgcctcagcc

SEQ ID NO: 658446 - DNA, 22 bp, Artificial Sequence
  chemically synthesized
taatcgcagctactcaggcggc

SEQ ID NO: 658447 - DNA, 22 bp, Artificial Sequence
  chemically synthesized
tcctgcctcagccgcctgagta

SEQ ID NO: 658448 - DNA, 22 bp, Artificial Sequence
  chemically synthesized
ctgcctcagccgcctgagtagc

SEQ ID NO: 658449 - DNA, 22 bp, Artificial Sequence
  chemically synthesized
cctcagccgcctgagtagctgc

SEQ ID NO: 658450 - DNA, 22 bp, Artificial Sequence
  chemically synthesized
agccgcctgagtagctgcgatt

SEQ ID NO: 658451 - DNA, 22 bp, Artificial Sequence
  chemically synthesized
agtagctgcgattacaggcaca

SEQ ID NO: 658452 - DNA, 22 bp, Artificial Sequence
  chemically synthesized
ggtgtgatggcatgtgcctgta

SEQ ID NO: 658453 - DNA, 22 bp, Artificial Sequence
  chemically synthesized
gctgggtgtgatggcatgtgcc

SEQ ID NO: 658454 - DNA, 22 bp, Artificial Sequence
  chemically synthesized
cgattacaggcacatgccatca

SEQ ID NO: 658455 - DNA, 22 bp, Artificial Sequence
  chemically synthesized
caggcacatgccatcacaccca

SEQ ID NO: 658456 - DNA, 22 bp, Artificial Sequence
  chemically synthesized
cagtaaaaatacaaaaattagc

SEQ ID NO: 658457 - DNA, 22 bp, Artificial Sequence
  chemically synthesized
atttttgtatttttactggaga

SEQ ID NO: 658458 - DNA, 22 bp, Artificial Sequence
  chemically synthesized
ttgtatttttactggagacgtg

SEQ ID NO: 658459 - DNA, 22 bp, Artificial Sequence
  chemically synthesized
tgtatttttactggagacgtgt

SEQ ID NO: 658460 - DNA, 22 bp, Artificial Sequence
  chemically synthesized
gtatttttactggagacgtgtt

SEQ ID NO: 658461 - DNA, 22 bp, Artificial Sequence
  chemically synthesized
tatttttactggagacgtgttt

SEQ ID NO: 658462 - DNA, 22 bp, Artificial Sequence
  chemically synthesized
gccatcatggtgaaacacgtct

SEQ ID NO: 658463 - DNA, 22 bp, Artificial Sequence
  chemically synthesized
ttactggagacgtgtttcacca

SEQ ID NO: 658464 - DNA, 22 bp, Artificial Sequence
  chemically synthesized
tactggagacgtgtttcaccat

SEQ ID NO: 658465 - DNA, 22 bp, Artificial Sequence
  chemically synthesized
actggagacgtgtttcaccatg

SEQ ID NO: 658466 - DNA, 22 bp, Artificial Sequence
  chemically synthesized
ctggagacgtgtttcaccatga

SEQ ID NO: 658467 - DNA, 22 bp, Artificial Sequence
  chemically synthesized
gagacgtgtttcaccatgatgg

SEQ ID NO: 658468 - DNA, 22 bp, Artificial Sequence
  chemically synthesized
aagaccagcctggccatcatgg

SEQ ID NO: 658469 - DNA, 22 bp, Artificial Sequence
  chemically synthesized
caccatgatggccaggctggtc

SEQ ID NO: 658470 - DNA, 22 bp, Artificial Sequence
  chemically synthesized
accatgatggccaggctggtct

SEQ ID NO: 658471 - DNA, 22 bp, Artificial Sequence
  chemically synthesized
aggtcaggagttcaagaccagc

SEQ ID NO: 658472 - DNA, 22 bp, Artificial Sequence
  chemically synthesized
gaggtcaggagttcaagaccag

SEQ ID NO: 658473 - DNA, 22 bp, Artificial Sequence
  chemically synthesized
gtcttgaactcctgacctcaag

SEQ ID NO: 658474 - DNA, 22 bp, Artificial Sequence
  chemically synthesized
gaactcctgacctcaagtgatc

SEQ ID NO: 658475 - DNA, 22 bp, Artificial Sequence
  chemically synthesized
aactcctgacctcaagtgatcc

SEQ ID NO: 658476 - DNA, 22 bp, Artificial Sequence
  chemically synthesized
ctgacctcaagtgatcctccta

SEQ ID NO: 658477 - DNA, 22 bp, Artificial Sequence
  chemically synthesized
gggaggccgaggtaggaggatc

SEQ ID NO: 658478 - DNA, 22 bp, Artificial Sequence
  chemically synthesized
agggaggccgaggtaggaggat

SEQ ID NO: 658479 - DNA, 22 bp, Artificial Sequence
  chemically synthesized
acctcaagtgatcctcctacct

SEQ ID NO: 658480 - DNA, 22 bp, Artificial Sequence
  chemically synthesized
aagtgatcctcctacctcggcc

SEQ ID NO: 658481 - DNA, 22 bp, Artificial Sequence
  chemically synthesized
taatcccagcacttagggaggc

SEQ ID NO: 658482 - DNA, 22 bp, Artificial Sequence
  chemically synthesized
ctacctcggcctccctaagtgc

SEQ ID NO: 658483 - DNA, 22 bp, Artificial Sequence
  chemically synthesized
cctcggcctccctaagtgctgg

SEQ ID NO: 658484 - DNA, 22 bp, Artificial Sequence
  chemically synthesized
acacctgtaatcccagcactta

SEQ ID NO: 658485 - DNA, 22 bp, Artificial Sequence
  chemically synthesized
ggcctccctaagtgctgggatt

SEQ ID NO: 658486 - DNA, 22 bp, Artificial Sequence
  chemically synthesized
cctaagtgctgggattacaggt

SEQ ID NO: 658487 - DNA, 22 bp, Artificial Sequence
  chemically synthesized
agtgctgggattacaggtgtga

SEQ ID NO: 658488 - DNA, 22 bp, Artificial Sequence
  chemically synthesized
ggattacaggtgtgagctactg

SEQ ID NO: 658489 - DNA, 22 bp, Artificial Sequence
  chemically synthesized
caggtgtgagctactgcgcctg

SEQ ID NO: 658490 - DNA, 22 bp, Artificial Sequence
  chemically synthesized
gaaatacgcagccaggcgcagt

SEQ ID NO: 658491 - DNA, 22 bp, Artificial Sequence
  chemically synthesized
attagaaatacgcagccaggcg

SEQ ID NO: 658492 - DNA, 22 bp, Artificial Sequence
  chemically synthesized
ttaattagaaatacgcagccag

SEQ ID NO: 658493 - DNA, 22 bp, Artificial Sequence
  chemically synthesized
ctgcgcctggctgcgtatttct

SEQ ID NO: 658494 - DNA, 22 bp, Artificial Sequence
  chemically synthesized
cgcctggctgcgtatttctaat

SEQ ID NO: 658495 - DNA, 22 bp, Artificial Sequence
  chemically synthesized
gctgcgtatttctaattaatag

SEQ ID NO: 658496 - DNA, 22 bp, Artificial Sequence
  chemically synthesized
cgtatttctaattaatagctca

SEQ ID NO: 658497 - DNA, 22 bp, Artificial Sequence
  chemically synthesized
ctaattaatagctcacatcatg

SEQ ID NO: 658498 - DNA, 22 bp, Artificial Sequence
  chemically synthesized
taattaatagctcacatcatgt

SEQ ID NO: 658499 - DNA, 22 bp, Artificial Sequence
  chemically synthesized
attaatagctcacatcatgtta

SEQ ID NO: 658500 - DNA, 22 bp, Artificial Sequence
  chemically synthesized
aatcaatgccagcataacatga

SEQ ID NO: 658501 - DNA, 22 bp, Artificial Sequence
  chemically synthesized
atagctcacatcatgttatgct

SEQ ID NO: 658502 - DNA, 22 bp, Artificial Sequence
  chemically synthesized
acatcatgttatgctggcattg

SEQ ID NO: 658503 - DNA, 22 bp, Artificial Sequence
  chemically synthesized
tgctggcattgattcaatatgt

SEQ ID NO: 658504 - DNA, 22 bp, Artificial Sequence
  chemically synthesized
ccaaaaacgatagacacatatt

SEQ ID NO: 658505 - DNA, 22 bp, Artificial Sequence
  chemically synthesized
gcattgattcaatatgtgtcta

SEQ ID NO: 658506 - DNA, 22 bp, Artificial Sequence
  chemically synthesized
ctgccaaaaacgatagacacat

SEQ ID NO: 658507 - DNA, 22 bp, Artificial Sequence
  chemically synthesized
attcaatatgtgtctatcgttt

SEQ ID NO: 658508 - DNA, 22 bp, Artificial Sequence
  chemically synthesized
aatatgtgtctatcgtttttgg

SEQ ID NO: 658509 - DNA, 22 bp, Artificial Sequence
  chemically synthesized
aaggggatataagtctcctgcc

SEQ ID NO: 658510 - DNA, 22 bp, Artificial Sequence
  chemically synthesized
tcgtttttggcaggagacttat

SEQ ID NO: 658511 - DNA, 22 bp, Artificial Sequence
  chemically synthesized
cctcaaggggatataagtctcc

SEQ ID NO: 658512 - DNA, 22 bp, Artificial Sequence
  chemically synthesized
ccctcaaggggatataagtctc

SEQ ID NO: 658513 - DNA, 22 bp, Artificial Sequence
  chemically synthesized
cttccctcaaggggatataagt

SEQ ID NO: 658514 - DNA, 22 bp, Artificial Sequence
  chemically synthesized
ttggcaggagacttatatcccc

SEQ ID NO: 658515 - DNA, 22 bp, Artificial Sequence
  chemically synthesized
tggcaggagacttatatcccct

SEQ ID NO: 658516 - DNA, 22 bp, Artificial Sequence
  chemically synthesized
ggcaggagacttatatcccctt

SEQ ID NO: 658517 - DNA, 22 bp, Artificial Sequence
  chemically synthesized
gcaggagacttatatccccttg

SEQ ID NO: 658518 - DNA, 22 bp, Artificial Sequence
  chemically synthesized
accaagatatggttccttccct

SEQ ID NO: 658519 - DNA, 22 bp, Artificial Sequence
  chemically synthesized
atatccccttgagggaaggaac

SEQ ID NO: 658520 - DNA, 22 bp, Artificial Sequence
  chemically synthesized
tatccccttgagggaaggaacc

SEQ ID NO: 658521 - DNA, 22 bp, Artificial Sequence
  chemically synthesized
gagggaaggaaccatatcttgg

SEQ ID NO: 658522 - DNA, 22 bp, Artificial Sequence
  chemically synthesized
gcacacaactgaccaagatatg

SEQ ID NO: 658523 - DNA, 22 bp, Artificial Sequence
  chemically synthesized
agggaaggaaccatatcttggt

SEQ ID NO: 658524 - DNA, 22 bp, Artificial Sequence
  chemically synthesized
tggcacacaactgaccaagata

SEQ ID NO: 658525 - DNA, 22 bp, Artificial Sequence
  chemically synthesized
ctggcacacaactgaccaagat

SEQ ID NO: 658526 - DNA, 22 bp, Artificial Sequence
  chemically synthesized
tagatacttctggcacacaact

SEQ ID NO: 658527 - DNA, 22 bp, Artificial Sequence
  chemically synthesized
ctgtagatacttctggcacaca

SEQ ID NO: 658528 - DNA, 22 bp, Artificial Sequence
  chemically synthesized
tactgtagatacttctggcaca

SEQ ID NO: 658529 - DNA, 22 bp, Artificial Sequence
  chemically synthesized
ggtcagttgtgtgccagaagta

SEQ ID NO: 658530 - DNA, 22 bp, Artificial Sequence
  chemically synthesized
gtcagttgtgtgccagaagtat

SEQ ID NO: 658531 - DNA, 22 bp, Artificial Sequence
  chemically synthesized
ccattctactgtagatacttct

SEQ ID NO: 658532 - DNA, 22 bp, Artificial Sequence
  chemically synthesized
tgtgccagaagtatctacagta

SEQ ID NO: 658533 - DNA, 22 bp, Artificial Sequence
  chemically synthesized
tccaccgggtactgccattcta

SEQ ID NO: 658534 - DNA, 22 bp, Artificial Sequence
  chemically synthesized
ctatccaccgggtactgccatt

SEQ ID NO: 658535 - DNA, 22 bp, Artificial Sequence
  chemically synthesized
cagtagaatggcagtacccggt

SEQ ID NO: 658536 - DNA, 22 bp, Artificial Sequence
  chemically synthesized
ggcacctactatccaccgggta

SEQ ID NO: 658537 - DNA, 22 bp, Artificial Sequence
  chemically synthesized
catatattgggcacctactatc

SEQ ID NO: 658538 - DNA, 22 bp, Artificial Sequence
  chemically synthesized
ttacatatattgggcacctact

SEQ ID NO: 658539 - DNA, 22 bp, Artificial Sequence
  chemically synthesized
tgttacatatattgggcaccta

SEQ ID NO: 658540 - DNA, 22 bp, Artificial Sequence
  chemically synthesized
attctgttacatatattgggca

SEQ ID NO: 658541 - DNA, 22 bp, Artificial Sequence
  chemically synthesized
attcattctgttacatatattg

SEQ ID NO: 658542 - DNA, 22 bp, Artificial Sequence
  chemically synthesized
agtatgttcattcattctgtta

SEQ ID NO: 658543 - DNA, 22 bp, Artificial Sequence
  chemically synthesized
caagcattcagtatgttcattc

SEQ ID NO: 658544 - DNA, 22 bp, Artificial Sequence
  chemically synthesized
agaacaaaacataacattgcaa

SEQ ID NO: 658545 - DNA, 22 bp, Artificial Sequence
  chemically synthesized
tatctgagaacaaaacataaca

SEQ ID NO: 658546 - DNA, 22 bp, Artificial Sequence
  chemically synthesized
aatgcttgcaatgttatgtttt

SEQ ID NO: 658547 - DNA, 22 bp, Artificial Sequence
  chemically synthesized
atatctgagaacaaaacataac

SEQ ID NO: 658548 - DNA, 22 bp, Artificial Sequence
  chemically synthesized
tatatctgagaacaaaacataa

SEQ ID NO: 658549 - DNA, 22 bp, Artificial Sequence
  chemically synthesized
gcaatgttatgttttgttctca

SEQ ID NO: 658550 - DNA, 22 bp, Artificial Sequence
  chemically synthesized
aaattttatatctgagaacaaa

SEQ ID NO: 658551 - DNA, 22 bp, Artificial Sequence
  chemically synthesized
caatgttatgttttgttctcag

SEQ ID NO: 658552 - DNA, 22 bp, Artificial Sequence
  chemically synthesized
tgttttgttctcagatataaaa

SEQ ID NO: 658553 - DNA, 22 bp, Artificial Sequence
  chemically synthesized
tgttctcagatataaaatttta

SEQ ID NO: 658554 - DNA, 22 bp, Artificial Sequence
  chemically synthesized
gttctcagatataaaattttaa

SEQ ID NO: 658555 - DNA, 22 bp, Artificial Sequence
  chemically synthesized
ttctcagatataaaattttaat

SEQ ID NO: 658556 - DNA, 22 bp, Artificial Sequence
  chemically synthesized
tcagatataaaattttaatcat

SEQ ID NO: 658557 - DNA, 22 bp, Artificial Sequence
  chemically synthesized
agatataaaattttaatcatac

SEQ ID NO: 658558 - DNA, 22 bp, Artificial Sequence
  chemically synthesized
ggtgaatataaggtatgattaa

SEQ ID NO: 658559 - DNA, 22 bp, Artificial Sequence
  chemically synthesized
taggtgaatataaggtatgatt

SEQ ID NO: 658560 - DNA, 22 bp, Artificial Sequence
  chemically synthesized
ctaggtgaatataaggtatgat

SEQ ID NO: 658561 - DNA, 22 bp, Artificial Sequence
  chemically synthesized
taatcataccttatattcacct

SEQ ID NO: 658562 - DNA, 22 bp, Artificial Sequence
  chemically synthesized
aatcataccttatattcaccta

SEQ ID NO: 658563 - DNA, 22 bp, Artificial Sequence
  chemically synthesized
aggggcaacttctaggtgaata

SEQ ID NO: 658564 - DNA, 22 bp, Artificial Sequence
  chemically synthesized
atcataccttatattcacctag

SEQ ID NO: 658565 - DNA, 22 bp, Artificial Sequence
  chemically synthesized
gaggggcaacttctaggtgaat

SEQ ID NO: 658566 - DNA, 22 bp, Artificial Sequence
  chemically synthesized
tgaggggcaacttctaggtgaa

SEQ ID NO: 658567 - DNA, 22 bp, Artificial Sequence
  chemically synthesized
ttgaggggcaacttctaggtga

SEQ ID NO: 658568 - DNA, 22 bp, Artificial Sequence
  chemically synthesized
tttgaggggcaacttctaggtg

SEQ ID NO: 658569 - DNA, 22 bp, Artificial Sequence
  chemically synthesized
ttttgaggggcaacttctaggt

SEQ ID NO: 658570 - DNA, 22 bp, Artificial Sequence
  chemically synthesized
tttttgaggggcaacttctagg

SEQ ID NO: 658571 - DNA, 22 bp, Artificial Sequence
  chemically synthesized
ctttttttgaggggcaacttct

SEQ ID NO: 658572 - DNA, 22 bp, Artificial Sequence
  chemically synthesized
actttttttgaggggcaacttc

SEQ ID NO: 658573 - DNA, 22 bp, Artificial Sequence
  chemically synthesized
atattcacctagaagttgcccc

SEQ ID NO: 658574 - DNA, 22 bp, Artificial Sequence
  chemically synthesized
tattcacctagaagttgcccct

SEQ ID NO: 658575 - DNA, 22 bp, Artificial Sequence
  chemically synthesized
gatttactttttttgaggggca

SEQ ID NO: 658576 - DNA, 22 bp, Artificial Sequence
  chemically synthesized
ggatttactttttttgaggggc

SEQ ID NO: 658577 - DNA, 22 bp, Artificial Sequence
  chemically synthesized
acctagaagttgcccctcaaaa

SEQ ID NO: 658578 - DNA, 22 bp, Artificial Sequence
  chemically synthesized
ttggatttactttttttgaggg

SEQ ID NO: 658579 - DNA, 22 bp, Artificial Sequence
  chemically synthesized
cttggatttactttttttgagg

SEQ ID NO: 658580 - DNA, 22 bp, Artificial Sequence
  chemically synthesized
tcttggatttactttttttgag

SEQ ID NO: 658581 - DNA, 22 bp, Artificial Sequence
  chemically synthesized
gaagttgcccctcaaaaaaagt

SEQ ID NO: 658582 - DNA, 22 bp, Artificial Sequence
  chemically synthesized
cccctcaaaaaaagtaaatcca

SEQ ID NO: 658583 - DNA, 22 bp, Artificial Sequence
  chemically synthesized
aaaaaaagtaaatccaagaaag

SEQ ID NO: 658584 - DNA, 22 bp, Artificial Sequence
  chemically synthesized
tgggtacagaaagctttcttgg

SEQ ID NO: 658585 - DNA, 22 bp, Artificial Sequence
  chemically synthesized
atgggtacagaaagctttcttg

SEQ ID NO: 658586 - DNA, 22 bp, Artificial Sequence
  chemically synthesized
aagtgtgcttatgggtacagaa

SEQ ID NO: 658587 - DNA, 22 bp, Artificial Sequence
  chemically synthesized
aaagtgtgcttatgggtacaga

SEQ ID NO: 658588 - DNA, 22 bp, Artificial Sequence
  chemically synthesized
gagtttaaagtgtgcttatggg

SEQ ID NO: 658589 - DNA, 22 bp, Artificial Sequence
  chemically synthesized
ctagagtttaaagtgtgcttat

SEQ ID NO: 658590 - DNA, 22 bp, Artificial Sequence
  chemically synthesized
cctagagtttaaagtgtgctta

SEQ ID NO: 658591 - DNA, 22 bp, Artificial Sequence
  chemically synthesized
tctgtacccataagcacacttt

SEQ ID NO: 658592 - DNA, 22 bp, Artificial Sequence
  chemically synthesized
ctgtacccataagcacacttta

SEQ ID NO: 658593 - DNA, 22 bp, Artificial Sequence
  chemically synthesized
tgtacccataagcacactttaa

SEQ ID NO: 658594 - DNA, 22 bp, Artificial Sequence
  chemically synthesized
atttcctagagtttaaagtgtg

SEQ ID NO: 658595 - DNA, 22 bp, Artificial Sequence
  chemically synthesized
aatttcctagagtttaaagtgt

SEQ ID NO: 658596 - DNA, 22 bp, Artificial Sequence
  chemically synthesized
tacccataagcacactttaaac

SEQ ID NO: 658597 - DNA, 22 bp, Artificial Sequence
  chemically synthesized
aaacatttaatttcctagagtt

SEQ ID NO: 658598 - DNA, 22 bp, Artificial Sequence
  chemically synthesized
ttaaaacatttaatttcctaga

SEQ ID NO: 658599 - DNA, 22 bp, Artificial Sequence
  chemically synthesized
taaactctaggaaattaaatgt

SEQ ID NO: 658600 - DNA, 22 bp, Artificial Sequence
  chemically synthesized
aaactctaggaaattaaatgtt

SEQ ID NO: 658601 - DNA, 22 bp, Artificial Sequence
  chemically synthesized
aactctaggaaattaaatgttt

SEQ ID NO: 658602 - DNA, 22 bp, Artificial Sequence
  chemically synthesized
ggtatcctgttaaaacatttaa

SEQ ID NO: 658603 - DNA, 22 bp, Artificial Sequence
  chemically synthesized
aggtatcctgttaaaacattta

SEQ ID NO: 658604 - DNA, 22 bp, Artificial Sequence
  chemically synthesized
taggaaattaaatgttttaaca

SEQ ID NO: 658605 - DNA, 22 bp, Artificial Sequence
  chemically synthesized
ggaaattaaatgttttaacagg

SEQ ID NO: 658606 - DNA, 22 bp, Artificial Sequence
  chemically synthesized
gtgccatcttaggtatcctgtt

SEQ ID NO: 658607 - DNA, 22 bp, Artificial Sequence
  chemically synthesized
agtgccatcttaggtatcctgt

SEQ ID NO: 658608 - DNA, 22 bp, Artificial Sequence
  chemically synthesized
tagtgccatcttaggtatcctg

SEQ ID NO: 658609 - DNA, 22 bp, Artificial Sequence
  chemically synthesized
ttagtgccatcttaggtatcct

SEQ ID NO: 658610 - DNA, 22 bp, Artificial Sequence
  chemically synthesized
aatgttttaacaggatacctaa

SEQ ID NO: 658611 - DNA, 22 bp, Artificial Sequence
  chemically synthesized
aatttttagtgccatcttaggt

SEQ ID NO: 658612 - DNA, 22 bp, Artificial Sequence
  chemically synthesized
taacaggatacctaagatggca

SEQ ID NO: 658613 - DNA, 22 bp, Artificial Sequence
  chemically synthesized
aacaggatacctaagatggcac

SEQ ID NO: 658614 - DNA, 22 bp, Artificial Sequence
  chemically synthesized
acaggatacctaagatggcact

SEQ ID NO: 658615 - DNA, 22 bp, Artificial Sequence
  chemically synthesized
tgcgtacaatctcaatttttag

SEQ ID NO: 658616 - DNA, 22 bp, Artificial Sequence
  chemically synthesized
agatggcactaaaaattgagat

SEQ ID NO: 658617 - DNA, 22 bp, Artificial Sequence
  chemically synthesized
aaaattgagattgtacgcacag

SEQ ID NO: 658618 - DNA, 22 bp, Artificial Sequence
  chemically synthesized
agattgtacgcacagcttttta

SEQ ID NO: 658619 - DNA, 22 bp, Artificial Sequence
  chemically synthesized
tacgcacagctttttatctgct

SEQ ID NO: 658620 - DNA, 22 bp, Artificial Sequence
  chemically synthesized
ggtatgtatatcggagagcaga

SEQ ID NO: 658621 - DNA, 22 bp, Artificial Sequence
  chemically synthesized
tttatctgctctccgatataca

SEQ ID NO: 658622 - DNA, 22 bp, Artificial Sequence
  chemically synthesized
ttatctgctctccgatatacat

SEQ ID NO: 658623 - DNA, 22 bp, Artificial Sequence
  chemically synthesized
tatctgctctccgatatacata

SEQ ID NO: 658624 - DNA, 22 bp, Artificial Sequence
  chemically synthesized
atctgctctccgatatacatac

SEQ ID NO: 658625 - DNA, 22 bp, Artificial Sequence
  chemically synthesized
tctgctctccgatatacatacc

SEQ ID NO: 658626 - DNA, 22 bp, Artificial Sequence
  chemically synthesized
aaaataaacacctaggtatgta

SEQ ID NO: 658627 - DNA, 22 bp, Artificial Sequence
  chemically synthesized
gaaaataaacacctaggtatgt

SEQ ID NO: 658628 - DNA, 22 bp, Artificial Sequence
  chemically synthesized
ctctccgatatacatacctagg

SEQ ID NO: 658629 - DNA, 22 bp, Artificial Sequence
  chemically synthesized
tgaaaataaacacctaggtatg

SEQ ID NO: 658630 - DNA, 22 bp, Artificial Sequence
  chemically synthesized
tccgatatacatacctaggtgt

SEQ ID NO: 658631 - DNA, 22 bp, Artificial Sequence
  chemically synthesized
cgatatacatacctaggtgttt

SEQ ID NO: 658632 - DNA, 22 bp, Artificial Sequence
  chemically synthesized
ataactttgaaaataaacacct

SEQ ID NO: 658633 - DNA, 22 bp, Artificial Sequence
  chemically synthesized
aaagtaactcataactttgaaa

SEQ ID NO: 658634 - DNA, 22 bp, Artificial Sequence
  chemically synthesized
gaaagtaactcataactttgaa

SEQ ID NO: 658635 - DNA, 22 bp, Artificial Sequence
  chemically synthesized
ggtgtttattttcaaagttatg

SEQ ID NO: 658636 - DNA, 22 bp, Artificial Sequence
  chemically synthesized
attttcaaagttatgagttact

SEQ ID NO: 658637 - DNA, 22 bp, Artificial Sequence
  chemically synthesized
ttttcaaagttatgagttactt

SEQ ID NO: 658638 - DNA, 22 bp, Artificial Sequence
  chemically synthesized
tcaaagttatgagttactttca

SEQ ID NO: 658639 - DNA, 22 bp, Artificial Sequence
  chemically synthesized
caaagttatgagttactttcaa

SEQ ID NO: 658640 - DNA, 22 bp, Artificial Sequence
  chemically synthesized
aaagttatgagttactttcaaa

SEQ ID NO: 658641 - DNA, 22 bp, Artificial Sequence
  chemically synthesized
aatgcaaaatgagatgtttgaa

SEQ ID NO: 658642 - DNA, 22 bp, Artificial Sequence
  chemically synthesized
tgagttactttcaaacatctca

SEQ ID NO: 658643 - DNA, 22 bp, Artificial Sequence
  chemically synthesized
ctttcaaacatctcattttgca

SEQ ID NO: 658644 - DNA, 22 bp, Artificial Sequence
  chemically synthesized
tcaaacatctcattttgcattt

SEQ ID NO: 658645 - DNA, 22 bp, Artificial Sequence
  chemically synthesized
caaacatctcattttgcattta

SEQ ID NO: 658646 - DNA, 22 bp, Artificial Sequence
  chemically synthesized
aaacatctcattttgcatttaa

SEQ ID NO: 658647 - DNA, 22 bp, Artificial Sequence
  chemically synthesized
gtgaaacaaaaatattaaatgc

SEQ ID NO: 658648 - DNA, 22 bp, Artificial Sequence
  chemically synthesized
ggttggtgaaacaaaaatatta

SEQ ID NO: 658649 - DNA, 22 bp, Artificial Sequence
  chemically synthesized
aggttggtgaaacaaaaatatt

SEQ ID NO: 658650 - DNA, 22 bp, Artificial Sequence
  chemically synthesized
attttgcatttaatatttttgt

SEQ ID NO: 658651 - DNA, 22 bp, Artificial Sequence
  chemically synthesized
taggttggtgaaacaaaaatat

SEQ ID NO: 658652 - DNA, 22 bp, Artificial Sequence
  chemically synthesized
ttaggttggtgaaacaaaaata

SEQ ID NO: 658653 - DNA, 22 bp, Artificial Sequence
  chemically synthesized
tgcatttaatatttttgtttca

SEQ ID NO: 658654 - DNA, 22 bp, Artificial Sequence
  chemically synthesized
gcatttaatatttttgtttcac

SEQ ID NO: 658655 - DNA, 22 bp, Artificial Sequence
  chemically synthesized
catttaatatttttgtttcacc

SEQ ID NO: 658656 - DNA, 22 bp, Artificial Sequence
  chemically synthesized
aatatttttgtttcaccaacct

SEQ ID NO: 658657 - DNA, 22 bp, Artificial Sequence
  chemically synthesized
atatttttgtttcaccaaccta

SEQ ID NO: 658658 - DNA, 22 bp, Artificial Sequence
  chemically synthesized
agagggaacatgtttttaggtt

SEQ ID NO: 658659 - DNA, 22 bp, Artificial Sequence
  chemically synthesized
ttgtttcaccaacctaaaaaca

SEQ ID NO: 658660 - DNA, 22 bp, Artificial Sequence
  chemically synthesized
tgtttcaccaacctaaaaacat

SEQ ID NO: 658661 - DNA, 22 bp, Artificial Sequence
  chemically synthesized
ctaagagggaacatgtttttag

SEQ ID NO: 658662 - DNA, 22 bp, Artificial Sequence
  chemically synthesized
gtttcaccaacctaaaaacatg

SEQ ID NO: 658663 - DNA, 22 bp, Artificial Sequence
  chemically synthesized
tttcaccaacctaaaaacatgt

SEQ ID NO: 658664 - DNA, 22 bp, Artificial Sequence
  chemically synthesized
caccaacctaaaaacatgttcc

SEQ ID NO: 658665 - DNA, 22 bp, Artificial Sequence
  chemically synthesized
accaacctaaaaacatgttccc

SEQ ID NO: 658666 - DNA, 22 bp, Artificial Sequence
  chemically synthesized
gaataactactaagagggaaca

SEQ ID NO: 658667 - DNA, 22 bp, Artificial Sequence
  chemically synthesized
cgaataactactaagagggaac

SEQ ID NO: 658668 - DNA, 22 bp, Artificial Sequence
  chemically synthesized
aaaacatgttccctcttagtag

SEQ ID NO: 658669 - DNA, 22 bp, Artificial Sequence
  chemically synthesized
gtgtttcgaataactactaaga

SEQ ID NO: 658670 - DNA, 22 bp, Artificial Sequence
  chemically synthesized
agttggtgtttcgaataactac

SEQ ID NO: 658671 - DNA, 22 bp, Artificial Sequence
  chemically synthesized
gagttggtgtttcgaataacta

SEQ ID NO: 658672 - DNA, 22 bp, Artificial Sequence
  chemically synthesized
tgagttggtgtttcgaataact

SEQ ID NO: 658673 - DNA, 22 bp, Artificial Sequence
  chemically synthesized
cctcttagtagttattcgaaac

SEQ ID NO: 658674 - DNA, 22 bp, Artificial Sequence
  chemically synthesized
ttagtagttattcgaaacacca

SEQ ID NO: 658675 - DNA, 22 bp, Artificial Sequence
  chemically synthesized
agtagttattcgaaacaccaac

SEQ ID NO: 658676 - DNA, 22 bp, Artificial Sequence
  chemically synthesized
aggaagctttgagttggtgttt

SEQ ID NO: 658677 - DNA, 22 bp, Artificial Sequence
  chemically synthesized
gtagttattcgaaacaccaact

SEQ ID NO: 658678 - DNA, 22 bp, Artificial Sequence
  chemically synthesized
ttcgaaacaccaactcaaagct

SEQ ID NO: 658679 - DNA, 22 bp, Artificial Sequence
  chemically synthesized
aataattgaggaagctttgagt

SEQ ID NO: 658680 - DNA, 22 bp, Artificial Sequence
  chemically synthesized
gaaacaccaactcaaagcttcc

SEQ ID NO: 658681 - DNA, 22 bp, Artificial Sequence
  chemically synthesized
aattgaataattgaggaagctt

SEQ ID NO: 658682 - DNA, 22 bp, Artificial Sequence
  chemically synthesized
aaagcttcctcaattattcaat

SEQ ID NO: 658683 - DNA, 22 bp, Artificial Sequence
  chemically synthesized
taaatataatattaaattgaat

SEQ ID NO: 658684 - DNA, 22 bp, Artificial Sequence
  chemically synthesized
cctcaattattcaatttaatat

SEQ ID NO: 658685 - DNA, 22 bp, Artificial Sequence
  chemically synthesized
ctcaattattcaatttaatatt

SEQ ID NO: 658686 - DNA, 22 bp, Artificial Sequence
  chemically synthesized
aattattcaatttaatattata

SEQ ID NO: 658687 - DNA, 22 bp, Artificial Sequence
  chemically synthesized
ttcaatttaatattatatttac

SEQ ID NO: 658688 - DNA, 22 bp, Artificial Sequence
  chemically synthesized
aatttaatattatatttacaat

SEQ ID NO: 658689 - DNA, 22 bp, Artificial Sequence
  chemically synthesized
aatattatatttacaatgtgct

SEQ ID NO: 658690 - DNA, 22 bp, Artificial Sequence
  chemically synthesized
atattatatttacaatgtgctg

SEQ ID NO: 658691 - DNA, 22 bp, Artificial Sequence
  chemically synthesized
tatttacaatgtgctgtcacta

SEQ ID NO: 658692 - DNA, 22 bp, Artificial Sequence
  chemically synthesized
ccgtatatatggtatagtgaca

SEQ ID NO: 658693 - DNA, 22 bp, Artificial Sequence
  chemically synthesized
acaatgtgctgtcactatacca

SEQ ID NO: 658694 - DNA, 22 bp, Artificial Sequence
  chemically synthesized
caatgtgctgtcactataccat

SEQ ID NO: 658695 - DNA, 22 bp, Artificial Sequence
  chemically synthesized
atctaccgtatatatggtatag

SEQ ID NO: 658696 - DNA, 22 bp, Artificial Sequence
  chemically synthesized
taatctaccgtatatatggtat

SEQ ID NO: 658697 - DNA, 22 bp, Artificial Sequence
  chemically synthesized
ggttctaatctaccgtatatat

SEQ ID NO: 658698 - DNA, 22 bp, Artificial Sequence
  chemically synthesized
tcactataccatatatacggta

SEQ ID NO: 658699 - DNA, 22 bp, Artificial Sequence
  chemically synthesized
taccatatatacggtagattag

SEQ ID NO: 658700 - DNA, 22 bp, Artificial Sequence
  chemically synthesized
gtataggttaggttctaatcta

SEQ ID NO: 658701 - DNA, 22 bp, Artificial Sequence
  chemically synthesized
agtataggttaggttctaatct

SEQ ID NO: 658702 - DNA, 22 bp, Artificial Sequence
  chemically synthesized
cttagtataggttaggttctaa

SEQ ID NO: 658703 - DNA, 22 bp, Artificial Sequence
  chemically synthesized
tagttacttagtataggttagg

SEQ ID NO: 658704 - DNA, 22 bp, Artificial Sequence
  chemically synthesized
aatattgtagttacttagtata

SEQ ID NO: 658705 - DNA, 22 bp, Artificial Sequence
  chemically synthesized
aaatattgtagttacttagtat

SEQ ID NO: 658706 - DNA, 22 bp, Artificial Sequence
  chemically synthesized
gaacctaacctatactaagtaa

SEQ ID NO: 658707 - DNA, 22 bp, Artificial Sequence
  chemically synthesized
taaatattgtagttacttagta

SEQ ID NO: 658708 - DNA, 22 bp, Artificial Sequence
  chemically synthesized
ctttaaatattgtagttactta

SEQ ID NO: 658709 - DNA, 22 bp, Artificial Sequence
  chemically synthesized
tcctttaaatattgtagttact

SEQ ID NO: 658710 - DNA, 22 bp, Artificial Sequence
  chemically synthesized
ctcctttaaatattgtagttac

SEQ ID NO: 658711 - DNA, 22 bp, Artificial Sequence
  chemically synthesized
acctatactaagtaactacaat

SEQ ID NO: 658712 - DNA, 22 bp, Artificial Sequence
  chemically synthesized
tctcctttaaatattgtagtta

SEQ ID NO: 658713 - DNA, 22 bp, Artificial Sequence
  chemically synthesized
ttctcctttaaatattgtagtt

SEQ ID NO: 658714 - DNA, 22 bp, Artificial Sequence
  chemically synthesized
tactaagtaactacaatattta

SEQ ID NO: 658715 - DNA, 22 bp, Artificial Sequence
  chemically synthesized
tgtgcttttctcctttaaatat

SEQ ID NO: 658716 - DNA, 22 bp, Artificial Sequence
  chemically synthesized
agtaactacaatatttaaagga

SEQ ID NO: 658717 - DNA, 22 bp, Artificial Sequence
  chemically synthesized
caatatttaaaggagaaaagca

SEQ ID NO: 658718 - DNA, 22 bp, Artificial Sequence
  chemically synthesized
aaaggagaaaagcacacaggta

SEQ ID NO: 658719 - DNA, 22 bp, Artificial Sequence
  chemically synthesized
aaggagaaaagcacacaggtat

SEQ ID NO: 658720 - DNA, 22 bp, Artificial Sequence
  chemically synthesized
ggatgagatgggatacctgtgt

SEQ ID NO: 658721 - DNA, 22 bp, Artificial Sequence
  chemically synthesized
cggatgagatgggatacctgtg

SEQ ID NO: 658722 - DNA, 22 bp, Artificial Sequence
  chemically synthesized
aaatgtatttcggatgagatgg

SEQ ID NO: 658723 - DNA, 22 bp, Artificial Sequence
  chemically synthesized
aaaatgtatttcggatgagatg

SEQ ID NO: 658724 - DNA, 22 bp, Artificial Sequence
  chemically synthesized
taaaatgtatttcggatgagat

SEQ ID NO: 658725 - DNA, 22 bp, Artificial Sequence
  chemically synthesized
accattttaaaatgtatttcgg

SEQ ID NO: 658726 - DNA, 22 bp, Artificial Sequence
  chemically synthesized
ttaaccattttaaaatgtattt

SEQ ID NO: 658727 - DNA, 22 bp, Artificial Sequence
  chemically synthesized
gttaaccattttaaaatgtatt

SEQ ID NO: 658728 - DNA, 22 bp, Artificial Sequence
  chemically synthesized
tgttaaccattttaaaatgtat

SEQ ID NO: 658729 - DNA, 22 bp, Artificial Sequence
  chemically synthesized
ttgttaaccattttaaaatgta

SEQ ID NO: 658730 - DNA, 22 bp, Artificial Sequence
  chemically synthesized
atccgaaatacattttaaaatg

SEQ ID NO: 658731 - DNA, 22 bp, Artificial Sequence
  chemically synthesized
aacagcttttgttaaccatttt

SEQ ID NO: 658732 - DNA, 22 bp, Artificial Sequence
  chemically synthesized
taaaatggttaacaaaagctgt

SEQ ID NO: 658733 - DNA, 22 bp, Artificial Sequence
  chemically synthesized
aaaatggttaacaaaagctgtt

SEQ ID NO: 658734 - DNA, 22 bp, Artificial Sequence
  chemically synthesized
aaatggttaacaaaagctgttc

SEQ ID NO: 658735 - DNA, 22 bp, Artificial Sequence
  chemically synthesized
agaacgagagaaaaataactga

SEQ ID NO: 658736 - DNA, 22 bp, Artificial Sequence
  chemically synthesized
acaaaagctgttcagttatttt

SEQ ID NO: 658737 - DNA, 22 bp, Artificial Sequence
  chemically synthesized
atcctcagaacgagagaaaaat

SEQ ID NO: 658738 - DNA, 22 bp, Artificial Sequence
  chemically synthesized
tcatcctcagaacgagagaaaa

SEQ ID NO: 658739 - DNA, 22 bp, Artificial Sequence
  chemically synthesized
ctcatcctcagaacgagagaaa

SEQ ID NO: 658740 - DNA, 22 bp, Artificial Sequence
  chemically synthesized
tctcatcctcagaacgagagaa

SEQ ID NO: 658741 - DNA, 22 bp, Artificial Sequence
  chemically synthesized
ttcagttatttttctctcgttc

SEQ ID NO: 658742 - DNA, 22 bp, Artificial Sequence
  chemically synthesized
agttatttttctctcgttctga

SEQ ID NO: 658743 - DNA, 22 bp, Artificial Sequence
  chemically synthesized
agttttctcatcctcagaacga

SEQ ID NO: 658744 - DNA, 22 bp, Artificial Sequence
  chemically synthesized
gagttttctcatcctcagaacg

SEQ ID NO: 658745 - DNA, 22 bp, Artificial Sequence
  chemically synthesized
tttttctctcgttctgaggatg

SEQ ID NO: 658746 - DNA, 22 bp, Artificial Sequence
  chemically synthesized
cacttgagttttctcatcctca

SEQ ID NO: 658747 - DNA, 22 bp, Artificial Sequence
  chemically synthesized
ttctctcgttctgaggatgaga

SEQ ID NO: 658748 - DNA, 22 bp, Artificial Sequence
  chemically synthesized
ccacttgagttttctcatcctc

SEQ ID NO: 658749 - DNA, 22 bp, Artificial Sequence
  chemically synthesized
tctctcgttctgaggatgagaa

SEQ ID NO: 658750 - DNA, 22 bp, Artificial Sequence
  chemically synthesized
ctctcgttctgaggatgagaaa

SEQ ID NO: 658751 - DNA, 22 bp, Artificial Sequence
  chemically synthesized
tctcgttctgaggatgagaaaa

SEQ ID NO: 658752 - DNA, 22 bp, Artificial Sequence
  chemically synthesized
tcgttctgaggatgagaaaact

SEQ ID NO: 658753 - DNA, 22 bp, Artificial Sequence
  chemically synthesized
gttctgaggatgagaaaactca

SEQ ID NO: 658754 - DNA, 22 bp, Artificial Sequence
  chemically synthesized
tgtagtttccacttgagttttc

SEQ ID NO: 658755 - DNA, 22 bp, Artificial Sequence
  chemically synthesized
atgtagtttccacttgagtttt

SEQ ID NO: 658756 - DNA, 22 bp, Artificial Sequence
  chemically synthesized
tatgtagtttccacttgagttt

SEQ ID NO: 658757 - DNA, 22 bp, Artificial Sequence
  chemically synthesized
tgaggatgagaaaactcaagtg

SEQ ID NO: 658758 - DNA, 22 bp, Artificial Sequence
  chemically synthesized
ttatgtagtttccacttgagtt

SEQ ID NO: 658759 - DNA, 22 bp, Artificial Sequence
  chemically synthesized
aggatgagaaaactcaagtgga

SEQ ID NO: 658760 - DNA, 22 bp, Artificial Sequence
  chemically synthesized
acttttatgtagtttccacttg

SEQ ID NO: 658761 - DNA, 22 bp, Artificial Sequence
  chemically synthesized
gccctcacttttatgtagtttc

SEQ ID NO: 658762 - DNA, 22 bp, Artificial Sequence
  chemically synthesized
ggccctcacttttatgtagttt

SEQ ID NO: 658763 - DNA, 22 bp, Artificial Sequence
  chemically synthesized
tggccctcacttttatgtagtt

SEQ ID NO: 658764 - DNA, 22 bp, Artificial Sequence
  chemically synthesized
aagtggaaactacataaaagtg

SEQ ID NO: 658765 - DNA, 22 bp, Artificial Sequence
  chemically synthesized
cataaaagtgagggccaaaatg

SEQ ID NO: 658766 - DNA, 22 bp, Artificial Sequence
  chemically synthesized
aggagtaagccacaaaatacac

SEQ ID NO: 658767 - DNA, 22 bp, Artificial Sequence
  chemically synthesized
caggagtaagccacaaaataca

SEQ ID NO: 658768 - DNA, 22 bp, Artificial Sequence
  chemically synthesized
cttcaggagtaagccacaaaat

SEQ ID NO: 658769 - DNA, 22 bp, Artificial Sequence
  chemically synthesized
tccttcaggagtaagccacaaa

SEQ ID NO: 658770 - DNA, 22 bp, Artificial Sequence
  chemically synthesized
ctccttcaggagtaagccacaa

SEQ ID NO: 658771 - DNA, 22 bp, Artificial Sequence
  chemically synthesized
gtgtattttgtggcttactcct

SEQ ID NO: 658772 - DNA, 22 bp, Artificial Sequence
  chemically synthesized
tgtattttgtggcttactcctg

SEQ ID NO: 658773 - DNA, 22 bp, Artificial Sequence
  chemically synthesized
atcatttctccttcaggagtaa

SEQ ID NO: 658774 - DNA, 22 bp, Artificial Sequence
  chemically synthesized
ctgatcatttctccttcaggag

SEQ ID NO: 658775 - DNA, 22 bp, Artificial Sequence
  chemically synthesized
tgtggcttactcctgaaggaga

SEQ ID NO: 658776 - DNA, 22 bp, Artificial Sequence
  chemically synthesized
ctactgatcatttctccttcag

SEQ ID NO: 658777 - DNA, 22 bp, Artificial Sequence
  chemically synthesized
gtggcttactcctgaaggagaa

SEQ ID NO: 658778 - DNA, 22 bp, Artificial Sequence
  chemically synthesized
tggcttactcctgaaggagaaa

SEQ ID NO: 658779 - DNA, 22 bp, Artificial Sequence
  chemically synthesized
tctcctactgatcatttctcct

SEQ ID NO: 658780 - DNA, 22 bp, Artificial Sequence
  chemically synthesized
tgtctcctactgatcatttctc

SEQ ID NO: 658781 - DNA, 22 bp, Artificial Sequence
  chemically synthesized
actcctgaaggagaaatgatca

SEQ ID NO: 658782 - DNA, 22 bp, Artificial Sequence
  chemically synthesized
ctcctgaaggagaaatgatcag

SEQ ID NO: 658783 - DNA, 22 bp, Artificial Sequence
  chemically synthesized
ctgaaggagaaatgatcagtag

SEQ ID NO: 658784 - DNA, 22 bp, Artificial Sequence
  chemically synthesized
aaggagaaatgatcagtaggag

SEQ ID NO: 658785 - DNA, 22 bp, Artificial Sequence
  chemically synthesized
aggacaggcaggagataaaagc

SEQ ID NO: 658786 - DNA, 22 bp, Artificial Sequence
  chemically synthesized
caggacaggcaggagataaaag

SEQ ID NO: 658787 - DNA, 22 bp, Artificial Sequence
  chemically synthesized
agcttcaggacaggcaggagat

SEQ ID NO: 658788 - DNA, 22 bp, Artificial Sequence
  chemically synthesized
ttatctcctgcctgtcctgaag

SEQ ID NO: 658789 - DNA, 22 bp, Artificial Sequence
  chemically synthesized
tatctcctgcctgtcctgaagc

SEQ ID NO: 658790 - DNA, 22 bp, Artificial Sequence
  chemically synthesized
atctcctgcctgtcctgaagct

SEQ ID NO: 658791 - DNA, 22 bp, Artificial Sequence
  chemically synthesized
tctcctgcctgtcctgaagctt

SEQ ID NO: 658792 - DNA, 22 bp, Artificial Sequence
  chemically synthesized
ctgcctgtcctgaagcttagca

SEQ ID NO: 658793 - DNA, 22 bp, Artificial Sequence
  chemically synthesized
cctgtcctgaagcttagcacat

SEQ ID NO: 658794 - DNA, 22 bp, Artificial Sequence
  chemically synthesized
tcctgaagcttagcacatctcc

SEQ ID NO: 658795 - DNA, 22 bp, Artificial Sequence
  chemically synthesized
gccacacatgtgaggagatgtg

SEQ ID NO: 658796 - DNA, 22 bp, Artificial Sequence
  chemically synthesized
aagcttagcacatctcctcaca

SEQ ID NO: 658797 - DNA, 22 bp, Artificial Sequence
  chemically synthesized
aggcctagccacacatgtgagg

SEQ ID NO: 658798 - DNA, 22 bp, Artificial Sequence
  chemically synthesized
agcacatctcctcacatgtgtg

SEQ ID NO: 658799 - DNA, 22 bp, Artificial Sequence
  chemically synthesized
gcacatctcctcacatgtgtgg

SEQ ID NO: 658800 - DNA, 22 bp, Artificial Sequence
  chemically synthesized
ccctgaggcctagccacacatg

SEQ ID NO: 658801 - DNA, 22 bp, Artificial Sequence
  chemically synthesized
cccctgaggcctagccacacat

SEQ ID NO: 658802 - DNA, 22 bp, Artificial Sequence
  chemically synthesized
ttcccctgaggcctagccacac

SEQ ID NO: 658803 - DNA, 22 bp, Artificial Sequence
  chemically synthesized
tcttcccctgaggcctagccac

SEQ ID NO: 658804 - DNA, 22 bp, Artificial Sequence
  chemically synthesized
tctcttcccctgaggcctagcc

SEQ ID NO: 658805 - DNA, 22 bp, Artificial Sequence
  chemically synthesized
ctcacatgtgtggctaggcctc

SEQ ID NO: 658806 - DNA, 22 bp, Artificial Sequence
  chemically synthesized
ctctcttcccctgaggcctagc

SEQ ID NO: 658807 - DNA, 22 bp, Artificial Sequence
  chemically synthesized
tctctcttcccctgaggcctag

SEQ ID NO: 658808 - DNA, 22 bp, Artificial Sequence
  chemically synthesized
ttctctcttcccctgaggccta

SEQ ID NO: 658809 - DNA, 22 bp, Artificial Sequence
  chemically synthesized
acatgtgtggctaggcctcagg

SEQ ID NO: 658810 - DNA, 22 bp, Artificial Sequence
  chemically synthesized
tcttttctctcttcccctgagg

SEQ ID NO: 658811 - DNA, 22 bp, Artificial Sequence
  chemically synthesized
gtcttttctctcttcccctgag

SEQ ID NO: 658812 - DNA, 22 bp, Artificial Sequence
  chemically synthesized
gcttgtcttttctctcttcccc

SEQ ID NO: 658813 - DNA, 22 bp, Artificial Sequence
  chemically synthesized
ggcctcaggggaagagagaaaa

SEQ ID NO: 658814 - DNA, 22 bp, Artificial Sequence
  chemically synthesized
agcctagcttgtcttttctctc

SEQ ID NO: 658815 - DNA, 22 bp, Artificial Sequence
  chemically synthesized
aggggaagagagaaaagacaag

SEQ ID NO: 658816 - DNA, 22 bp, Artificial Sequence
  chemically synthesized
aacaaattcagcctagcttgtc

SEQ ID NO: 658817 - DNA, 22 bp, Artificial Sequence
  chemically synthesized
agtaggaatattaaacaaattc

SEQ ID NO: 658818 - DNA, 22 bp, Artificial Sequence
  chemically synthesized
cagtaggaatattaaacaaatt

SEQ ID NO: 658819 - DNA, 22 bp, Artificial Sequence
  chemically synthesized
tcagtaggaatattaaacaaat

SEQ ID NO: 658820 - DNA, 22 bp, Artificial Sequence
  chemically synthesized
ttcagtaggaatattaaacaaa

SEQ ID NO: 658821 - DNA, 22 bp, Artificial Sequence
  chemically synthesized
ggctgaatttgtttaatattcc

SEQ ID NO: 658822 - DNA, 22 bp, Artificial Sequence
  chemically synthesized
aatttgtttaatattcctactg

SEQ ID NO: 658823 - DNA, 22 bp, Artificial Sequence
  chemically synthesized
taagcaatcttttcagtaggaa

SEQ ID NO: 658824 - DNA, 22 bp, Artificial Sequence
  chemically synthesized
ataagcaatcttttcagtagga

SEQ ID NO: 658825 - DNA, 22 bp, Artificial Sequence
  chemically synthesized
gtttaatattcctactgaaaag

SEQ ID NO: 658826 - DNA, 22 bp, Artificial Sequence
  chemically synthesized
tttaatattcctactgaaaaga

SEQ ID NO: 658827 - DNA, 22 bp, Artificial Sequence
  chemically synthesized
aatattcctactgaaaagattg

SEQ ID NO: 658828 - DNA, 22 bp, Artificial Sequence
  chemically synthesized
atattcctactgaaaagattgc

SEQ ID NO: 658829 - DNA, 22 bp, Artificial Sequence
  chemically synthesized
aaatgcttataagcaatctttt

SEQ ID NO: 658830 - DNA, 22 bp, Artificial Sequence
  chemically synthesized
gaaatgcttataagcaatcttt

SEQ ID NO: 658831 - DNA, 22 bp, Artificial Sequence
  chemically synthesized
ctactgaaaagattgcttataa

SEQ ID NO: 658832 - DNA, 22 bp, Artificial Sequence
  chemically synthesized
cccttgaaatgcttataagcaa

SEQ ID NO: 658833 - DNA, 22 bp, Artificial Sequence
  chemically synthesized
ccccttgaaatgcttataagca

SEQ ID NO: 658834 - DNA, 22 bp, Artificial Sequence
  chemically synthesized
tccccttgaaatgcttataagc

SEQ ID NO: 658835 - DNA, 22 bp, Artificial Sequence
  chemically synthesized
ctgaaaagattgcttataagca

SEQ ID NO: 658836 - DNA, 22 bp, Artificial Sequence
  chemically synthesized
aaaagattgcttataagcattt

SEQ ID NO: 658837 - DNA, 22 bp, Artificial Sequence
  chemically synthesized
gttttccccttgaaatgcttat

SEQ ID NO: 658838 - DNA, 22 bp, Artificial Sequence
  chemically synthesized
cagttggttttccccttgaaat

SEQ ID NO: 658839 - DNA, 22 bp, Artificial Sequence
  chemically synthesized
cttataagcatttcaaggggaa

SEQ ID NO: 658840 - DNA, 22 bp, Artificial Sequence
  chemically synthesized
ataagcatttcaaggggaaaac

SEQ ID NO: 658841 - DNA, 22 bp, Artificial Sequence
  chemically synthesized
taagcatttcaaggggaaaacc

SEQ ID NO: 658842 - DNA, 22 bp, Artificial Sequence
  chemically synthesized
tgaaaggctgcagttggttttc

SEQ ID NO: 658843 - DNA, 22 bp, Artificial Sequence
  chemically synthesized
caaggggaaaaccaactgcagc

SEQ ID NO: 658844 - DNA, 22 bp, Artificial Sequence
  chemically synthesized
atattgtgaaaggctgcagttg

SEQ ID NO: 658845 - DNA, 22 bp, Artificial Sequence
  chemically synthesized
aaggggaaaaccaactgcagcc

SEQ ID NO: 658846 - DNA, 22 bp, Artificial Sequence
  chemically synthesized
cagcctttcacaatatgaatgg

SEQ ID NO: 658847 - DNA, 22 bp, Artificial Sequence
  chemically synthesized
agatgaccaagtgaccatccat

SEQ ID NO: 658848 - DNA, 22 bp, Artificial Sequence
  chemically synthesized
tcacaatatgaatggatggtca

SEQ ID NO: 658849 - DNA, 22 bp, Artificial Sequence
  chemically synthesized
cacaatatgaatggatggtcac

SEQ ID NO: 658850 - DNA, 22 bp, Artificial Sequence
  chemically synthesized
acaatatgaatggatggtcact

SEQ ID NO: 658851 - DNA, 22 bp, Artificial Sequence
  chemically synthesized
gaggagtgatggttcagatgac

SEQ ID NO: 658852 - DNA, 22 bp, Artificial Sequence
  chemically synthesized
ggtcatctgaaccatcactcct

SEQ ID NO: 658853 - DNA, 22 bp, Artificial Sequence
  chemically synthesized
gtcatctgaaccatcactcctc

SEQ ID NO: 658854 - DNA, 22 bp, Artificial Sequence
  chemically synthesized
aaagccaatgctagaggagtga

SEQ ID NO: 658855 - DNA, 22 bp, Artificial Sequence
  chemically synthesized
aaccatcactcctctagcattg

SEQ ID NO: 658856 - DNA, 22 bp, Artificial Sequence
  chemically synthesized
taaaaccaaattaaaagccaat

SEQ ID NO: 658857 - DNA, 22 bp, Artificial Sequence
  chemically synthesized
ctctagcattggcttttaattt

SEQ ID NO: 658858 - DNA, 22 bp, Artificial Sequence
  chemically synthesized
aaaactgtaaaaccaaattaaa

SEQ ID NO: 658859 - DNA, 22 bp, Artificial Sequence
  chemically synthesized
tagcattggcttttaatttggt

SEQ ID NO: 658860 - DNA, 22 bp, Artificial Sequence
  chemically synthesized
aaaaactgtaaaaccaaattaa

SEQ ID NO: 658861 - DNA, 22 bp, Artificial Sequence
  chemically synthesized
gcattggcttttaatttggttt

SEQ ID NO: 658862 - DNA, 22 bp, Artificial Sequence
  chemically synthesized
cttaaaaactgtaaaaccaaat

SEQ ID NO: 658863 - DNA, 22 bp, Artificial Sequence
  chemically synthesized
tgcttaaaaactgtaaaaccaa

SEQ ID NO: 658864 - DNA, 22 bp, Artificial Sequence
  chemically synthesized
ctgcttaaaaactgtaaaacca

SEQ ID NO: 658865 - DNA, 22 bp, Artificial Sequence
  chemically synthesized
gcttttaatttggttttacagt

SEQ ID NO: 658866 - DNA, 22 bp, Artificial Sequence
  chemically synthesized
ttctgcttaaaaactgtaaaac

SEQ ID NO: 658867 - DNA, 22 bp, Artificial Sequence
  chemically synthesized
ttaatttggttttacagttttt

SEQ ID NO: 658868 - DNA, 22 bp, Artificial Sequence
  chemically synthesized
taatttggttttacagttttta

SEQ ID NO: 658869 - DNA, 22 bp, Artificial Sequence
  chemically synthesized
ggttcttctgcttaaaaactgt

SEQ ID NO: 658870 - DNA, 22 bp, Artificial Sequence
  chemically synthesized
aatttggttttacagtttttaa

SEQ ID NO: 658871 - DNA, 22 bp, Artificial Sequence
  chemically synthesized
atttggttttacagtttttaag

SEQ ID NO: 658872 - DNA, 22 bp, Artificial Sequence
  chemically synthesized
ggttttacagtttttaagcaga

SEQ ID NO: 658873 - DNA, 22 bp, Artificial Sequence
  chemically synthesized
gttttacagtttttaagcagaa

SEQ ID NO: 658874 - DNA, 22 bp, Artificial Sequence
  chemically synthesized
cgcattgggttcttctgcttaa

SEQ ID NO: 658875 - DNA, 22 bp, Artificial Sequence
  chemically synthesized
tacagtttttaagcagaagaac

SEQ ID NO: 658876 - DNA, 22 bp, Artificial Sequence
  chemically synthesized
attacgcattgggttcttctgc

SEQ ID NO: 658877 - DNA, 22 bp, Artificial Sequence
  chemically synthesized
acagtttttaagcagaagaacc

SEQ ID NO: 658878 - DNA, 22 bp, Artificial Sequence
  chemically synthesized
gattacgcattgggttcttctg

SEQ ID NO: 658879 - DNA, 22 bp, Artificial Sequence
  chemically synthesized
cagtttttaagcagaagaaccc

SEQ ID NO: 658880 - DNA, 22 bp, Artificial Sequence
  chemically synthesized
tgattacgcattgggttcttct

SEQ ID NO: 658881 - DNA, 22 bp, Artificial Sequence
  chemically synthesized
ttgattacgcattgggttcttc

SEQ ID NO: 658882 - DNA, 22 bp, Artificial Sequence
  chemically synthesized
cttttgattacgcattgggttc

SEQ ID NO: 658883 - DNA, 22 bp, Artificial Sequence
  chemically synthesized
ccttttgattacgcattgggtt

SEQ ID NO: 658884 - DNA, 22 bp, Artificial Sequence
  chemically synthesized
ttaagcagaagaacccaatgcg

SEQ ID NO: 658885 - DNA, 22 bp, Artificial Sequence
  chemically synthesized
taagcagaagaacccaatgcgt

SEQ ID NO: 658886 - DNA, 22 bp, Artificial Sequence
  chemically synthesized
aagcagaagaacccaatgcgta

SEQ ID NO: 658887 - DNA, 22 bp, Artificial Sequence
  chemically synthesized
agcagaagaacccaatgcgtaa

SEQ ID NO: 658888 - DNA, 22 bp, Artificial Sequence
  chemically synthesized
cagaatttccttttgattacgc

SEQ ID NO: 658889 - DNA, 22 bp, Artificial Sequence
  chemically synthesized
aaggatagatacgtaccaccct

SEQ ID NO: 658890 - DNA, 22 bp, Artificial Sequence
  chemically synthesized
aaaggatagatacgtaccaccc

SEQ ID NO: 658891 - DNA, 22 bp, Artificial Sequence
  chemically synthesized
ttaaaggatagatacgtaccac

SEQ ID NO: 658892 - DNA, 22 bp, Artificial Sequence
  chemically synthesized
cttaaaggatagatacgtacca

SEQ ID NO: 658893 - DNA, 22 bp, Artificial Sequence
  chemically synthesized
tttcttaaaggatagatacgta

SEQ ID NO: 658894 - DNA, 22 bp, Artificial Sequence
  chemically synthesized
tgtagggtggtacgtatctatc

SEQ ID NO: 658895 - DNA, 22 bp, Artificial Sequence
  chemically synthesized
ctgtttcttaaaggatagatac

SEQ ID NO: 658896 - DNA, 22 bp, Artificial Sequence
  chemically synthesized
tagggtggtacgtatctatcct

SEQ ID NO: 658897 - DNA, 22 bp, Artificial Sequence
  chemically synthesized
gctgtttcttaaaggatagata

SEQ ID NO: 658898 - DNA, 22 bp, Artificial Sequence
  chemically synthesized
agagacagatagcttgctgttt

SEQ ID NO: 658899 - DNA, 22 bp, Artificial Sequence
  chemically synthesized
gagagacagatagcttgctgtt

SEQ ID NO: 658900 - DNA, 22 bp, Artificial Sequence
  chemically synthesized
tcctttaagaaacagcaagcta

SEQ ID NO: 658901 - DNA, 22 bp, Artificial Sequence
  chemically synthesized
tttgagagacagatagcttgct

SEQ ID NO: 658902 - DNA, 22 bp, Artificial Sequence
  chemically synthesized
ttatttgagagacagatagctt

SEQ ID NO: 658903 - DNA, 22 bp, Artificial Sequence
  chemically synthesized
taagaaacagcaagctatctgt

SEQ ID NO: 658904 - DNA, 22 bp, Artificial Sequence
  chemically synthesized
attatttgagagacagatagct

SEQ ID NO: 658905 - DNA, 22 bp, Artificial Sequence
  chemically synthesized
aagaaacagcaagctatctgtc

SEQ ID NO: 658906 - DNA, 22 bp, Artificial Sequence
  chemically synthesized
tattatttgagagacagatagc

SEQ ID NO: 658907 - DNA, 22 bp, Artificial Sequence
  chemically synthesized
agaaacagcaagctatctgtct

SEQ ID NO: 658908 - DNA, 22 bp, Artificial Sequence
  chemically synthesized
acattttattatttgagagaca

SEQ ID NO: 658909 - DNA, 22 bp, Artificial Sequence
  chemically synthesized
tctgtctctcaaataataaaat

SEQ ID NO: 658910 - DNA, 22 bp, Artificial Sequence
  chemically synthesized
cgtgacgtgactaacattttat

SEQ ID NO: 658911 - DNA, 22 bp, Artificial Sequence
  chemically synthesized
tctctcaaataataaaatgtta

SEQ ID NO: 658912 - DNA, 22 bp, Artificial Sequence
  chemically synthesized
tcaaataataaaatgttagtca

SEQ ID NO: 658913 - DNA, 22 bp, Artificial Sequence
  chemically synthesized
aaataataaaatgttagtcacg

SEQ ID NO: 658914 - DNA, 22 bp, Artificial Sequence
  chemically synthesized
acacatccaattccgtgacgtg

SEQ ID NO: 658915 - DNA, 22 bp, Artificial Sequence
  chemically synthesized
tactgacacatccaattccgtg

SEQ ID NO: 658916 - DNA, 22 bp, Artificial Sequence
  chemically synthesized
gtcacgtcacggaattggatgt

SEQ ID NO: 658917 - DNA, 22 bp, Artificial Sequence
  chemically synthesized
caagttgtactgacacatccaa

SEQ ID NO: 658918 - DNA, 22 bp, Artificial Sequence
  chemically synthesized
ctgcaagttgtactgacacatc

SEQ ID NO: 658919 - DNA, 22 bp, Artificial Sequence
  chemically synthesized
actgcaagttgtactgacacat

SEQ ID NO: 658920 - DNA, 22 bp, Artificial Sequence
  chemically synthesized
taatcatcttactgcaagttgt

SEQ ID NO: 658921 - DNA, 22 bp, Artificial Sequence
  chemically synthesized
gatgtgtcagtacaacttgcag

SEQ ID NO: 658922 - DNA, 22 bp, Artificial Sequence
  chemically synthesized
ataatcatcttactgcaagttg

SEQ ID NO: 658923 - DNA, 22 bp, Artificial Sequence
  chemically synthesized
tataatcatcttactgcaagtt

SEQ ID NO: 658924 - DNA, 22 bp, Artificial Sequence
  chemically synthesized
ttttataatcatcttactgcaa

SEQ ID NO: 658925 - DNA, 22 bp, Artificial Sequence
  chemically synthesized
attttataatcatcttactgca

SEQ ID NO: 658926 - DNA, 22 bp, Artificial Sequence
  chemically synthesized
tttattttataatcatcttact

SEQ ID NO: 658927 - DNA, 22 bp, Artificial Sequence
  chemically synthesized
gcagtaagatgattataaaata

SEQ ID NO: 658928 - DNA, 22 bp, Artificial Sequence
  chemically synthesized
cagtaagatgattataaaataa

SEQ ID NO: 658929 - DNA, 22 bp, Artificial Sequence
  chemically synthesized
aagaaacattgtttattttata

SEQ ID NO: 658930 - DNA, 22 bp, Artificial Sequence
  chemically synthesized
atgttcaagaaacattgtttat

SEQ ID NO: 658931 - DNA, 22 bp, Artificial Sequence
  chemically synthesized
taaaataaacaatgtttcttga

SEQ ID NO: 658932 - DNA, 22 bp, Artificial Sequence
  chemically synthesized
aagaataccatgtgacattcat

SEQ ID NO: 658933 - DNA, 22 bp, Artificial Sequence
  chemically synthesized
aaagaataccatgtgacattca

SEQ ID NO: 658934 - DNA, 22 bp, Artificial Sequence
  chemically synthesized
tttaaagaataccatgtgacat

SEQ ID NO: 658935 - DNA, 22 bp, Artificial Sequence
  chemically synthesized
cttgaacatgaatgtcacatgg

SEQ ID NO: 658936 - DNA, 22 bp, Artificial Sequence
  chemically synthesized
atttaaagaataccatgtgaca

SEQ ID NO: 658937 - DNA, 22 bp, Artificial Sequence
  chemically synthesized
ttgaacatgaatgtcacatggt

SEQ ID NO: 658938 - DNA, 22 bp, Artificial Sequence
  chemically synthesized
ttatttaaagaataccatgtga

SEQ ID NO: 658939 - DNA, 22 bp, Artificial Sequence
  chemically synthesized
gaacatgaatgtcacatggtat

SEQ ID NO: 658940 - DNA, 22 bp, Artificial Sequence
  chemically synthesized
aacatgaatgtcacatggtatt

SEQ ID NO: 658941 - DNA, 22 bp, Artificial Sequence
  chemically synthesized
ggttcttatttaaagaatacca

SEQ ID NO: 658942 - DNA, 22 bp, Artificial Sequence
  chemically synthesized
gggttcttatttaaagaatacc

SEQ ID NO: 658943 - DNA, 22 bp, Artificial Sequence
  chemically synthesized
tgggttcttatttaaagaatac

SEQ ID NO: 658944 - DNA, 22 bp, Artificial Sequence
  chemically synthesized
gtctttgggttcttatttaaag

SEQ ID NO: 658945 - DNA, 22 bp, Artificial Sequence
  chemically synthesized
tctagtctttgggttcttattt

SEQ ID NO: 658946 - DNA, 22 bp, Artificial Sequence
  chemically synthesized
gtctagtctttgggttcttatt

SEQ ID NO: 658947 - DNA, 22 bp, Artificial Sequence
  chemically synthesized
cacttgtctagtctttgggttc

SEQ ID NO: 658948 - DNA, 22 bp, Artificial Sequence
  chemically synthesized
tgcacttgtctagtctttgggt

SEQ ID NO: 658949 - DNA, 22 bp, Artificial Sequence
  chemically synthesized
tttaaataagaacccaaagact

SEQ ID NO: 658950 - DNA, 22 bp, Artificial Sequence
  chemically synthesized
taaataagaacccaaagactag

SEQ ID NO: 658951 - DNA, 22 bp, Artificial Sequence
  chemically synthesized
aaataagaacccaaagactaga

SEQ ID NO: 658952 - DNA, 22 bp, Artificial Sequence
  chemically synthesized
aataagaacccaaagactagac

SEQ ID NO: 658953 - DNA, 22 bp, Artificial Sequence
  chemically synthesized
atctctgcacttgtctagtctt

SEQ ID NO: 658954 - DNA, 22 bp, Artificial Sequence
  chemically synthesized
aatctctgcacttgtctagtct

SEQ ID NO: 658955 - DNA, 22 bp, Artificial Sequence
  chemically synthesized
gacaagtgcagagattaaatct

SEQ ID NO: 658956 - DNA, 22 bp, Artificial Sequence
  chemically synthesized
taagtcggaaaaataagtgtga

SEQ ID NO: 658957 - DNA, 22 bp, Artificial Sequence
  chemically synthesized
tgtaagtcggaaaaataagtgt

SEQ ID NO: 658958 - DNA, 22 bp, Artificial Sequence
  chemically synthesized
ctgtaagtcggaaaaataagtg

SEQ ID NO: 658959 - DNA, 22 bp, Artificial Sequence
  chemically synthesized
tctgtaagtcggaaaaataagt

SEQ ID NO: 658960 - DNA, 22 bp, Artificial Sequence
  chemically synthesized
tttctgtaagtcggaaaaataa

SEQ ID NO: 658961 - DNA, 22 bp, Artificial Sequence
  chemically synthesized
aatcttcacacttatttttccg

SEQ ID NO: 658962 - DNA, 22 bp, Artificial Sequence
  chemically synthesized
acctctttctgtaagtcggaaa

SEQ ID NO: 658963 - DNA, 22 bp, Artificial Sequence
  chemically synthesized
cacacttatttttccgacttac

SEQ ID NO: 658964 - DNA, 22 bp, Artificial Sequence
  chemically synthesized
taacctctttctgtaagtcgga

SEQ ID NO: 658965 - DNA, 22 bp, Artificial Sequence
  chemically synthesized
acacttatttttccgacttaca

SEQ ID NO: 658966 - DNA, 22 bp, Artificial Sequence
  chemically synthesized
ctaacctctttctgtaagtcgg

SEQ ID NO: 658967 - DNA, 22 bp, Artificial Sequence
  chemically synthesized
tctaacctctttctgtaagtcg

SEQ ID NO: 658968 - DNA, 22 bp, Artificial Sequence
  chemically synthesized
attttctaacctctttctgtaa

SEQ ID NO: 658969 - DNA, 22 bp, Artificial Sequence
  chemically synthesized
atttttccgacttacagaaaga

SEQ ID NO: 658970 - DNA, 22 bp, Artificial Sequence
  chemically synthesized
tttttccgacttacagaaagag

SEQ ID NO: 658971 - DNA, 22 bp, Artificial Sequence
  chemically synthesized
ttccgacttacagaaagaggtt

SEQ ID NO: 658972 - DNA, 22 bp, Artificial Sequence
  chemically synthesized
tccgacttacagaaagaggtta

SEQ ID NO: 658973 - DNA, 22 bp, Artificial Sequence
  chemically synthesized
ccgacttacagaaagaggttag

SEQ ID NO: 658974 - DNA, 22 bp, Artificial Sequence
  chemically synthesized
cgacttacagaaagaggttaga

SEQ ID NO: 658975 - DNA, 22 bp, Artificial Sequence
  chemically synthesized
acagaaagaggttagaaaatca

SEQ ID NO: 658976 - DNA, 22 bp, Artificial Sequence
  chemically synthesized
ggggataaagtctgattttcta

SEQ ID NO: 658977 - DNA, 22 bp, Artificial Sequence
  chemically synthesized
cagaaagaggttagaaaatcag

SEQ ID NO: 658978 - DNA, 22 bp, Artificial Sequence
  chemically synthesized
ctaggggataaagtctgatttt

SEQ ID NO: 658979 - DNA, 22 bp, Artificial Sequence
  chemically synthesized
gaaaatcagactttatccccta

SEQ ID NO: 658980 - DNA, 22 bp, Artificial Sequence
  chemically synthesized
aataaaacacatgttcctaggg

SEQ ID NO: 658981 - DNA, 22 bp, Artificial Sequence
  chemically synthesized
tgtctgaataaaacacatgttc

SEQ ID NO: 658982 - DNA, 22 bp, Artificial Sequence
  chemically synthesized
tatcccctaggaacatgtgttt

SEQ ID NO: 658983 - DNA, 22 bp, Artificial Sequence
  chemically synthesized
atcccctaggaacatgtgtttt

SEQ ID NO: 658984 - DNA, 22 bp, Artificial Sequence
  chemically synthesized
tcccctaggaacatgtgtttta

SEQ ID NO: 658985 - DNA, 22 bp, Artificial Sequence
  chemically synthesized
actgtgtctgaataaaacacat

SEQ ID NO: 658986 - DNA, 22 bp, Artificial Sequence
  chemically synthesized
cattgactgtgtctgaataaaa

SEQ ID NO: 658987 - DNA, 22 bp, Artificial Sequence
  chemically synthesized
ggaacatgtgttttattcagac

SEQ ID NO: 658988 - DNA, 22 bp, Artificial Sequence
  chemically synthesized
cattacattgactgtgtctgaa

SEQ ID NO: 658989 - DNA, 22 bp, Artificial Sequence
  chemically synthesized
acattacattgactgtgtctga

SEQ ID NO: 658990 - DNA, 22 bp, Artificial Sequence
  chemically synthesized
tacattacattgactgtgtctg

SEQ ID NO: 658991 - DNA, 22 bp, Artificial Sequence
  chemically synthesized
ttttacattacattgactgtgt

SEQ ID NO: 658992 - DNA, 22 bp, Artificial Sequence
  chemically synthesized
tattcagacacagtcaatgtaa

SEQ ID NO: 658993 - DNA, 22 bp, Artificial Sequence
  chemically synthesized
attcagacacagtcaatgtaat

SEQ ID NO: 658994 - DNA, 22 bp, Artificial Sequence
  chemically synthesized
ttcagacacagtcaatgtaatg

SEQ ID NO: 658995 - DNA, 22 bp, Artificial Sequence
  chemically synthesized
agacacagtcaatgtaatgtaa

SEQ ID NO: 658996 - DNA, 22 bp, Artificial Sequence
  chemically synthesized
cagtccaggtattattttacat

SEQ ID NO: 658997 - DNA, 22 bp, Artificial Sequence
  chemically synthesized
ccagtccaggtattattttaca

SEQ ID NO: 658998 - DNA, 22 bp, Artificial Sequence
  chemically synthesized
tccagtccaggtattattttac

SEQ ID NO: 658999 - DNA, 22 bp, Artificial Sequence
  chemically synthesized
ttccagtccaggtattatttta

SEQ ID NO: 659000 - DNA, 22 bp, Artificial Sequence
  chemically synthesized
gcttttccagtccaggtattat

SEQ ID NO: 659001 - DNA, 22 bp, Artificial Sequence
  chemically synthesized
agtagagaatgaggattagctt

SEQ ID NO: 659002 - DNA, 22 bp, Artificial Sequence
  chemically synthesized
aagtagagaatgaggattagct

SEQ ID NO: 659003 - DNA, 22 bp, Artificial Sequence
  chemically synthesized
gactggaaaagctaatcctcat

SEQ ID NO: 659004 - DNA, 22 bp, Artificial Sequence
  chemically synthesized
gaaaagctaatcctcattctct

SEQ ID NO: 659005 - DNA, 22 bp, Artificial Sequence
  chemically synthesized
caggcatttaagtagagaatga

SEQ ID NO: 659006 - DNA, 22 bp, Artificial Sequence
  chemically synthesized
aattgcaggcatttaagtagag

SEQ ID NO: 659007 - DNA, 22 bp, Artificial Sequence
  chemically synthesized
atcctcattctctacttaaatg

SEQ ID NO: 659008 - DNA, 22 bp, Artificial Sequence
  chemically synthesized
attctctacttaaatgcctgca

SEQ ID NO: 659009 - DNA, 22 bp, Artificial Sequence
  chemically synthesized
tcaaacattaaattgcaggcat

SEQ ID NO: 659010 - DNA, 22 bp, Artificial Sequence
  chemically synthesized
gtcaaacattaaattgcaggca

SEQ ID NO: 659011 - DNA, 22 bp, Artificial Sequence
  chemically synthesized
tctacttaaatgcctgcaattt

SEQ ID NO: 659012 - DNA, 22 bp, Artificial Sequence
  chemically synthesized
cttgtcaaacattaaattgcag

SEQ ID NO: 659013 - DNA, 22 bp, Artificial Sequence
  chemically synthesized
tacttaaatgcctgcaatttaa

SEQ ID NO: 659014 - DNA, 22 bp, Artificial Sequence
  chemically synthesized
cttaaatgcctgcaatttaatg

SEQ ID NO: 659015 - DNA, 22 bp, Artificial Sequence
  chemically synthesized
aaatgcctgcaatttaatgttt

SEQ ID NO: 659016 - DNA, 22 bp, Artificial Sequence
  chemically synthesized
aatgcctgcaatttaatgtttg

SEQ ID NO: 659017 - DNA, 22 bp, Artificial Sequence
  chemically synthesized
tgccattccttgtcaaacatta

SEQ ID NO: 659018 - DNA, 22 bp, Artificial Sequence
  chemically synthesized
gtgccattccttgtcaaacatt

SEQ ID NO: 659019 - DNA, 22 bp, Artificial Sequence
  chemically synthesized
gtttgtgccattccttgtcaaa

SEQ ID NO: 659020 - DNA, 22 bp, Artificial Sequence
  chemically synthesized
ggtttgtgccattccttgtcaa

SEQ ID NO: 659021 - DNA, 22 bp, Artificial Sequence
  chemically synthesized
caatttaatgtttgacaaggaa

SEQ ID NO: 659022 - DNA, 22 bp, Artificial Sequence
  chemically synthesized
aatgtttgacaaggaatggcac

SEQ ID NO: 659023 - DNA, 22 bp, Artificial Sequence
  chemically synthesized
atgtttgacaaggaatggcaca

SEQ ID NO: 659024 - DNA, 22 bp, Artificial Sequence
  chemically synthesized
gacaaggaatggcacaaaccaa

SEQ ID NO: 659025 - DNA, 22 bp, Artificial Sequence
  chemically synthesized
acaaggaatggcacaaaccaaa

SEQ ID NO: 659026 - DNA, 22 bp, Artificial Sequence
  chemically synthesized
gagtgtcataaaatttggtttg

SEQ ID NO: 659027 - DNA, 22 bp, Artificial Sequence
  chemically synthesized
agagtgtcataaaatttggttt

SEQ ID NO: 659028 - DNA, 22 bp, Artificial Sequence
  chemically synthesized
tagagtgtcataaaatttggtt

SEQ ID NO: 659029 - DNA, 22 bp, Artificial Sequence
  chemically synthesized
ttagagtgtcataaaatttggt

SEQ ID NO: 659030 - DNA, 22 bp, Artificial Sequence
  chemically synthesized
cttttagagtgtcataaaattt

SEQ ID NO: 659031 - DNA, 22 bp, Artificial Sequence
  chemically synthesized
tatgacactctaaaagcagttc

SEQ ID NO: 659032 - DNA, 22 bp, Artificial Sequence
  chemically synthesized
atgtaagatgtagaactgcttt

SEQ ID NO: 659033 - DNA, 22 bp, Artificial Sequence
  chemically synthesized
atgacactctaaaagcagttct

SEQ ID NO: 659034 - DNA, 22 bp, Artificial Sequence
  chemically synthesized
tgacactctaaaagcagttcta

SEQ ID NO: 659035 - DNA, 22 bp, Artificial Sequence
  chemically synthesized
ctcatgtaagatgtagaactgc

SEQ ID NO: 659036 - DNA, 22 bp, Artificial Sequence
  chemically synthesized
taaaagcagttctacatcttac

SEQ ID NO: 659037 - DNA, 22 bp, Artificial Sequence
  chemically synthesized
aaagcagttctacatcttacat

SEQ ID NO: 659038 - DNA, 22 bp, Artificial Sequence
  chemically synthesized
acagcagattcctcatgtaaga

SEQ ID NO: 659039 - DNA, 22 bp, Artificial Sequence
  chemically synthesized
gacagcagattcctcatgtaag

SEQ ID NO: 659040 - DNA, 22 bp, Artificial Sequence
  chemically synthesized
tttgacagcagattcctcatgt

SEQ ID NO: 659041 - DNA, 22 bp, Artificial Sequence
  chemically synthesized
atttgacagcagattcctcatg

SEQ ID NO: 659042 - DNA, 22 bp, Artificial Sequence
  chemically synthesized
ttatttgacagcagattcctca

SEQ ID NO: 659043 - DNA, 22 bp, Artificial Sequence
  chemically synthesized
tacatcttacatgaggaatctg

SEQ ID NO: 659044 - DNA, 22 bp, Artificial Sequence
  chemically synthesized
catcttacatgaggaatctgct

SEQ ID NO: 659045 - DNA, 22 bp, Artificial Sequence
  chemically synthesized
ttcttatttgacagcagattcc

SEQ ID NO: 659046 - DNA, 22 bp, Artificial Sequence
  chemically synthesized
acatgaggaatctgctgtcaaa

SEQ ID NO: 659047 - DNA, 22 bp, Artificial Sequence
  chemically synthesized
catgaggaatctgctgtcaaat

SEQ ID NO: 659048 - DNA, 22 bp, Artificial Sequence
  chemically synthesized
gatgggaaatgacagactgttc

SEQ ID NO: 659049 - DNA, 22 bp, Artificial Sequence
  chemically synthesized
ctgtcaaataagaacagtctgt

SEQ ID NO: 659050 - DNA, 22 bp, Artificial Sequence
  chemically synthesized
tagatgggaaatgacagactgt

SEQ ID NO: 659051 - DNA, 22 bp, Artificial Sequence
  chemically synthesized
tcaaataagaacagtctgtcat

SEQ ID NO: 659052 - DNA, 22 bp, Artificial Sequence
  chemically synthesized
gttctagatgggaaatgacaga

SEQ ID NO: 659053 - DNA, 22 bp, Artificial Sequence
  chemically synthesized
ccctagttctagatgggaaatg

SEQ ID NO: 659054 - DNA, 22 bp, Artificial Sequence
  chemically synthesized
attaccctagttctagatggga

SEQ ID NO: 659055 - DNA, 22 bp, Artificial Sequence
  chemically synthesized
gctaattaccctagttctagat

SEQ ID NO: 659056 - DNA, 22 bp, Artificial Sequence
  chemically synthesized
tcatttcccatctagaactagg

SEQ ID NO: 659057 - DNA, 22 bp, Artificial Sequence
  chemically synthesized
atgttggctaattaccctagtt

SEQ ID NO: 659058 - DNA, 22 bp, Artificial Sequence
  chemically synthesized
cccatctagaactagggtaatt

SEQ ID NO: 659059 - DNA, 22 bp, Artificial Sequence
  chemically synthesized
ttaatgttggctaattacccta

SEQ ID NO: 659060 - DNA, 22 bp, Artificial Sequence
  chemically synthesized
ccatctagaactagggtaatta

SEQ ID NO: 659061 - DNA, 22 bp, Artificial Sequence
  chemically synthesized
attaatgttggctaattaccct

SEQ ID NO: 659062 - DNA, 22 bp, Artificial Sequence
  chemically synthesized
tattaatgttggctaattaccc

SEQ ID NO: 659063 - DNA, 22 bp, Artificial Sequence
  chemically synthesized
ttattaatgttggctaattacc

SEQ ID NO: 659064 - DNA, 22 bp, Artificial Sequence
  chemically synthesized
ttttattaatgttggctaatta

SEQ ID NO: 659065 - DNA, 22 bp, Artificial Sequence
  chemically synthesized
gaactagggtaattagccaaca

SEQ ID NO: 659066 - DNA, 22 bp, Artificial Sequence
  chemically synthesized
tattcttttattaatgttggct

SEQ ID NO: 659067 - DNA, 22 bp, Artificial Sequence
  chemically synthesized
gggtaattagccaacattaata

SEQ ID NO: 659068 - DNA, 22 bp, Artificial Sequence
  chemically synthesized
atgctgtattcttttattaatg

SEQ ID NO: 659069 - DNA, 22 bp, Artificial Sequence
  chemically synthesized
gccaacattaataaaagaatac

SEQ ID NO: 659070 - DNA, 22 bp, Artificial Sequence
  chemically synthesized
ataaaagaatacagcattaata

SEQ ID NO: 659071 - DNA, 22 bp, Artificial Sequence
  chemically synthesized
gaagacaagtacagatgtaagt

SEQ ID NO: 659072 - DNA, 22 bp, Artificial Sequence
  chemically synthesized
ggaagacaagtacagatgtaag

SEQ ID NO: 659073 - DNA, 22 bp, Artificial Sequence
  chemically synthesized
atatacacgacttacatctgta

SEQ ID NO: 659074 - DNA, 22 bp, Artificial Sequence
  chemically synthesized
tgtaaagcacatttggaagaca

SEQ ID NO: 659075 - DNA, 22 bp, Artificial Sequence
  chemically synthesized
acatctgtacttgtcttccaaa

SEQ ID NO: 659076 - DNA, 22 bp, Artificial Sequence
  chemically synthesized
catctgtacttgtcttccaaat

SEQ ID NO: 659077 - DNA, 22 bp, Artificial Sequence
  chemically synthesized
cctgtgtaaagcacatttggaa

SEQ ID NO: 659078 - DNA, 22 bp, Artificial Sequence
  chemically synthesized
ccctgtgtaaagcacatttgga

SEQ ID NO: 659079 - DNA, 22 bp, Artificial Sequence
  chemically synthesized
tacttgtcttccaaatgtgctt

SEQ ID NO: 659080 - DNA, 22 bp, Artificial Sequence
  chemically synthesized
gtcttccaaatgtgctttacac

SEQ ID NO: 659081 - DNA, 22 bp, Artificial Sequence
  chemically synthesized
tcttccaaatgtgctttacaca

SEQ ID NO: 659082 - DNA, 22 bp, Artificial Sequence
  chemically synthesized
gcatcatttccctgtgtaaagc

SEQ ID NO: 659083 - DNA, 22 bp, Artificial Sequence
  chemically synthesized
ccaaatgtgctttacacaggga

SEQ ID NO: 659084 - DNA, 22 bp, Artificial Sequence
  chemically synthesized
caaatgtgctttacacagggaa

SEQ ID NO: 659085 - DNA, 22 bp, Artificial Sequence
  chemically synthesized
aaactggcatcatttccctgtg

SEQ ID NO: 659086 - DNA, 22 bp, Artificial Sequence
  chemically synthesized
aaaactggcatcatttccctgt

SEQ ID NO: 659087 - DNA, 22 bp, Artificial Sequence
  chemically synthesized
taaaactggcatcatttccctg

SEQ ID NO: 659088 - DNA, 22 bp, Artificial Sequence
  chemically synthesized
ttaaaactggcatcatttccct

SEQ ID NO: 659089 - DNA, 22 bp, Artificial Sequence
  chemically synthesized
tcttttaaaactggcatcattt

SEQ ID NO: 659090 - DNA, 22 bp, Artificial Sequence
  chemically synthesized
tacacagggaaatgatgccagt

SEQ ID NO: 659091 - DNA, 22 bp, Artificial Sequence
  chemically synthesized
acacagggaaatgatgccagtt

SEQ ID NO: 659092 - DNA, 22 bp, Artificial Sequence
  chemically synthesized
cacagggaaatgatgccagttt

SEQ ID NO: 659093 - DNA, 22 bp, Artificial Sequence
  chemically synthesized
taaaagacaggacacggatcct

SEQ ID NO: 659094 - DNA, 22 bp, Artificial Sequence
  chemically synthesized
aaaagacaggacacggatcctc

SEQ ID NO: 659095 - DNA, 22 bp, Artificial Sequence
  chemically synthesized
aaagacaggacacggatcctcc

SEQ ID NO: 659096 - DNA, 22 bp, Artificial Sequence
  chemically synthesized
ataataggggacgaacagggag

SEQ ID NO: 659097 - DNA, 22 bp, Artificial Sequence
  chemically synthesized
cataataggggacgaacaggga

SEQ ID NO: 659098 - DNA, 22 bp, Artificial Sequence
  chemically synthesized
ttcataataggggacgaacagg

SEQ ID NO: 659099 - DNA, 22 bp, Artificial Sequence
  chemically synthesized
attcttcataataggggacgaa

SEQ ID NO: 659100 - DNA, 22 bp, Artificial Sequence
  chemically synthesized
gattcttcataataggggacga

SEQ ID NO: 659101 - DNA, 22 bp, Artificial Sequence
  chemically synthesized
tgattcttcataataggggacg

SEQ ID NO: 659102 - DNA, 22 bp, Artificial Sequence
  chemically synthesized
ctttgattcttcataatagggg

SEQ ID NO: 659103 - DNA, 22 bp, Artificial Sequence
  chemically synthesized
tgctttgattcttcataatagg

SEQ ID NO: 659104 - DNA, 22 bp, Artificial Sequence
  chemically synthesized
cctgttcgtcccctattatgaa

SEQ ID NO: 659105 - DNA, 22 bp, Artificial Sequence
  chemically synthesized
ctgctttgattcttcataatag

SEQ ID NO: 659106 - DNA, 22 bp, Artificial Sequence
  chemically synthesized
tctgctttgattcttcataata

SEQ ID NO: 659107 - DNA, 22 bp, Artificial Sequence
  chemically synthesized
ttcgtcccctattatgaagaat

SEQ ID NO: 659108 - DNA, 22 bp, Artificial Sequence
  chemically synthesized
ttttctgctttgattcttcata

SEQ ID NO: 659109 - DNA, 22 bp, Artificial Sequence
  chemically synthesized
gtcccctattatgaagaatcaa

SEQ ID NO: 659110 - DNA, 22 bp, Artificial Sequence
  chemically synthesized
ttatgaagaatcaaagcagaaa

SEQ ID NO: 659111 - DNA, 22 bp, Artificial Sequence
  chemically synthesized
tgaagaatcaaagcagaaaaca

SEQ ID NO: 659112 - DNA, 22 bp, Artificial Sequence
  chemically synthesized
ggaaagggtcagtaattgtttt

SEQ ID NO: 659113 - DNA, 22 bp, Artificial Sequence
  chemically synthesized
taggaaagggtcagtaattgtt

SEQ ID NO: 659114 - DNA, 22 bp, Artificial Sequence
  chemically synthesized
ccctctaggaaagggtcagtaa

SEQ ID NO: 659115 - DNA, 22 bp, Artificial Sequence
  chemically synthesized
accctctaggaaagggtcagta

SEQ ID NO: 659116 - DNA, 22 bp, Artificial Sequence
  chemically synthesized
gaagtgtttaccctctaggaaa

SEQ ID NO: 659117 - DNA, 22 bp, Artificial Sequence
  chemically synthesized
actagaagtgtttaccctctag

SEQ ID NO: 659118 - DNA, 22 bp, Artificial Sequence
  chemically synthesized
ctgaccctttcctagagggtaa

SEQ ID NO: 659119 - DNA, 22 bp, Artificial Sequence
  chemically synthesized
aactagaagtgtttaccctcta

SEQ ID NO: 659120 - DNA, 22 bp, Artificial Sequence
  chemically synthesized
ttaactagaagtgtttaccctc

SEQ ID NO: 659121 - DNA, 22 bp, Artificial Sequence
  chemically synthesized
accctttcctagagggtaaaca

SEQ ID NO: 659122 - DNA, 22 bp, Artificial Sequence
  chemically synthesized
ttcttaactagaagtgtttacc

SEQ ID NO: 659123 - DNA, 22 bp, Artificial Sequence
  chemically synthesized
attcttaactagaagtgtttac

SEQ ID NO: 659124 - DNA, 22 bp, Artificial Sequence
  chemically synthesized
tattcttaactagaagtgttta

SEQ ID NO: 659125 - DNA, 22 bp, Artificial Sequence
  chemically synthesized
tcctagagggtaaacacttcta

SEQ ID NO: 659126 - DNA, 22 bp, Artificial Sequence
  chemically synthesized
cctagagggtaaacacttctag

SEQ ID NO: 659127 - DNA, 22 bp, Artificial Sequence
  chemically synthesized
ctagagggtaaacacttctagt

SEQ ID NO: 659128 - DNA, 22 bp, Artificial Sequence
  chemically synthesized
gagggtaaacacttctagttaa

SEQ ID NO: 659129 - DNA, 22 bp, Artificial Sequence
  chemically synthesized
aaggctttattcttaactagaa

SEQ ID NO: 659130 - DNA, 22 bp, Artificial Sequence
  chemically synthesized
caaggctttattcttaactaga

SEQ ID NO: 659131 - DNA, 22 bp, Artificial Sequence
  chemically synthesized
tcaaggctttattcttaactag

SEQ ID NO: 659132 - DNA, 22 bp, Artificial Sequence
  chemically synthesized
ttcaaggctttattcttaacta

SEQ ID NO: 659133 - DNA, 22 bp, Artificial Sequence
  chemically synthesized
cttttcaaggctttattcttaa

SEQ ID NO: 659134 - DNA, 22 bp, Artificial Sequence
  chemically synthesized
ccttttcaaggctttattctta

SEQ ID NO: 659135 - DNA, 22 bp, Artificial Sequence
  chemically synthesized
tccttttcaaggctttattctt

SEQ ID NO: 659136 - DNA, 22 bp, Artificial Sequence
  chemically synthesized
ttccttttcaaggctttattct

SEQ ID NO: 659137 - DNA, 22 bp, Artificial Sequence
  chemically synthesized
tttttccttttcaaggctttat

SEQ ID NO: 659138 - DNA, 22 bp, Artificial Sequence
  chemically synthesized
atttttccttttcaaggcttta

SEQ ID NO: 659139 - DNA, 22 bp, Artificial Sequence
  chemically synthesized
ctagttaagaataaagccttga

SEQ ID NO: 659140 - DNA, 22 bp, Artificial Sequence
  chemically synthesized
tatttttccttttcaaggcttt

SEQ ID NO: 659141 - DNA, 22 bp, Artificial Sequence
  chemically synthesized
tagttaagaataaagccttgaa

SEQ ID NO: 659142 - DNA, 22 bp, Artificial Sequence
  chemically synthesized
gttaagaataaagccttgaaaa

SEQ ID NO: 659143 - DNA, 22 bp, Artificial Sequence
  chemically synthesized
ctttatttttccttttcaaggc

SEQ ID NO: 659144 - DNA, 22 bp, Artificial Sequence
  chemically synthesized
ctcctttatttttccttttcaa

SEQ ID NO: 659145 - DNA, 22 bp, Artificial Sequence
  chemically synthesized
agaataaagccttgaaaaggaa

SEQ ID NO: 659146 - DNA, 22 bp, Artificial Sequence
  chemically synthesized
actcctttatttttccttttca

SEQ ID NO: 659147 - DNA, 22 bp, Artificial Sequence
  chemically synthesized
tactcctttatttttccttttc

SEQ ID NO: 659148 - DNA, 22 bp, Artificial Sequence
  chemically synthesized
agcactttactcctttattttt

SEQ ID NO: 659149 - DNA, 22 bp, Artificial Sequence
  chemically synthesized
gaaaaggaaaaataaaggagta

SEQ ID NO: 659150 - DNA, 22 bp, Artificial Sequence
  chemically synthesized
aaaaggaaaaataaaggagtaa

SEQ ID NO: 659151 - DNA, 22 bp, Artificial Sequence
  chemically synthesized
acacatcattgagcactttact

SEQ ID NO: 659152 - DNA, 22 bp, Artificial Sequence
  chemically synthesized
aatgatgtgtgaactctattga

SEQ ID NO: 659153 - DNA, 22 bp, Artificial Sequence
  chemically synthesized
ataaaacagtggtcaatagagt

SEQ ID NO: 659154 - DNA, 22 bp, Artificial Sequence
  chemically synthesized
aataaaacagtggtcaatagag

SEQ ID NO: 659155 - DNA, 22 bp, Artificial Sequence
  chemically synthesized
aaaacaatcttaataaaacagt

SEQ ID NO: 659156 - DNA, 22 bp, Artificial Sequence
  chemically synthesized
tattgaccactgttttattaag

SEQ ID NO: 659157 - DNA, 22 bp, Artificial Sequence
  chemically synthesized
ttgaccactgttttattaagat

SEQ ID NO: 659158 - DNA, 22 bp, Artificial Sequence
  chemically synthesized
accactgttttattaagattgt

SEQ ID NO: 659159 - DNA, 22 bp, Artificial Sequence
  chemically synthesized
gaaaagttcaaaacaatcttaa

SEQ ID NO: 659160 - DNA, 22 bp, Artificial Sequence
  chemically synthesized
ggaaaagttcaaaacaatctta

SEQ ID NO: 659161 - DNA, 22 bp, Artificial Sequence
  chemically synthesized
ttttattaagattgttttgaac

SEQ ID NO: 659162 - DNA, 22 bp, Artificial Sequence
  chemically synthesized
tattaagattgttttgaacttt

SEQ ID NO: 659163 - DNA, 22 bp, Artificial Sequence
  chemically synthesized
attaagattgttttgaactttt

SEQ ID NO: 659164 - DNA, 22 bp, Artificial Sequence
  chemically synthesized
ttaagattgttttgaacttttc

SEQ ID NO: 659165 - DNA, 22 bp, Artificial Sequence
  chemically synthesized
agattgttttgaacttttccaa

SEQ ID NO: 659166 - DNA, 22 bp, Artificial Sequence
  chemically synthesized
ttttgaacttttccaaattcat

SEQ ID NO: 659167 - DNA, 22 bp, Artificial Sequence
  chemically synthesized
tgaacttttccaaattcattat

SEQ ID NO: 659168 - DNA, 22 bp, Artificial Sequence
  chemically synthesized
gaacttttccaaattcattatc

SEQ ID NO: 659169 - DNA, 22 bp, Artificial Sequence
  chemically synthesized
aacttttccaaattcattatct

SEQ ID NO: 659170 - DNA, 22 bp, Artificial Sequence
  chemically synthesized
ttccaaattcattatctctttg

SEQ ID NO: 659171 - DNA, 22 bp, Artificial Sequence
  chemically synthesized
taggtcatcagtcaaagagata

SEQ ID NO: 659172 - DNA, 22 bp, Artificial Sequence
  chemically synthesized
tccaaattcattatctctttga

SEQ ID NO: 659173 - DNA, 22 bp, Artificial Sequence
  chemically synthesized
ccaaattcattatctctttgac

SEQ ID NO: 659174 - DNA, 22 bp, Artificial Sequence
  chemically synthesized
caaattcattatctctttgact

SEQ ID NO: 659175 - DNA, 22 bp, Artificial Sequence
  chemically synthesized
cattgtaggtcatcagtcaaag

SEQ ID NO: 659176 - DNA, 22 bp, Artificial Sequence
  chemically synthesized
attatctctttgactgatgacc

SEQ ID NO: 659177 - DNA, 22 bp, Artificial Sequence
  chemically synthesized
cattgcattgtaggtcatcagt

SEQ ID NO: 659178 - DNA, 22 bp, Artificial Sequence
  chemically synthesized
ccattgcattgtaggtcatcag

SEQ ID NO: 659179 - DNA, 22 bp, Artificial Sequence
  chemically synthesized
tctctttgactgatgacctaca

SEQ ID NO: 659180 - DNA, 22 bp, Artificial Sequence
  chemically synthesized
aatttccattgcattgtaggtc

SEQ ID NO: 659181 - DNA, 22 bp, Artificial Sequence
  chemically synthesized
tttgactgatgacctacaatgc

SEQ ID NO: 659182 - DNA, 22 bp, Artificial Sequence
  chemically synthesized
tgactgatgacctacaatgcaa

SEQ ID NO: 659183 - DNA, 22 bp, Artificial Sequence
  chemically synthesized
gttgaatttccattgcattgta

SEQ ID NO: 659184 - DNA, 22 bp, Artificial Sequence
  chemically synthesized
gactgatgacctacaatgcaat

SEQ ID NO: 659185 - DNA, 22 bp, Artificial Sequence
  chemically synthesized
actgatgacctacaatgcaatg

SEQ ID NO: 659186 - DNA, 22 bp, Artificial Sequence
  chemically synthesized
atgacctacaatgcaatggaaa

SEQ ID NO: 659187 - DNA, 22 bp, Artificial Sequence
  chemically synthesized
agtggtcaagttggttgaattt

SEQ ID NO: 659188 - DNA, 22 bp, Artificial Sequence
  chemically synthesized
caatgcaatggaaattcaacca

SEQ ID NO: 659189 - DNA, 22 bp, Artificial Sequence
  chemically synthesized
gtaaacattcagtggtcaagtt

SEQ ID NO: 659190 - DNA, 22 bp, Artificial Sequence
  chemically synthesized
ggtaaacattcagtggtcaagt

SEQ ID NO: 659191 - DNA, 22 bp, Artificial Sequence
  chemically synthesized
aaacttggtaaacattcagtgg

SEQ ID NO: 659192 - DNA, 22 bp, Artificial Sequence
  chemically synthesized
aaccaacttgaccactgaatgt

SEQ ID NO: 659193 - DNA, 22 bp, Artificial Sequence
  chemically synthesized
ggaattgaaacttggtaaacat

SEQ ID NO: 659194 - DNA, 22 bp, Artificial Sequence
  chemically synthesized
aggaattgaaacttggtaaaca

SEQ ID NO: 659195 - DNA, 22 bp, Artificial Sequence
  chemically synthesized
taggaattgaaacttggtaaac

SEQ ID NO: 659196 - DNA, 22 bp, Artificial Sequence
  chemically synthesized
gaccactgaatgtttaccaagt

SEQ ID NO: 659197 - DNA, 22 bp, Artificial Sequence
  chemically synthesized
ttaggaattgaaacttggtaaa

SEQ ID NO: 659198 - DNA, 22 bp, Artificial Sequence
  chemically synthesized
accactgaatgtttaccaagtt

SEQ ID NO: 659199 - DNA, 22 bp, Artificial Sequence
  chemically synthesized
aatgtttaccaagtttcaattc

SEQ ID NO: 659200 - DNA, 22 bp, Artificial Sequence
  chemically synthesized
aaataagggtttttaggaattg

SEQ ID NO: 659201 - DNA, 22 bp, Artificial Sequence
  chemically synthesized
accaagtttcaattcctaaaaa

SEQ ID NO: 659202 - DNA, 22 bp, Artificial Sequence
  chemically synthesized
ccaagtttcaattcctaaaaac

SEQ ID NO: 659203 - DNA, 22 bp, Artificial Sequence
  chemically synthesized
cagttcaaataagggtttttag

SEQ ID NO: 659204 - DNA, 22 bp, Artificial Sequence
  chemically synthesized
gcagttcaaataagggttttta

SEQ ID NO: 659205 - DNA, 22 bp, Artificial Sequence
  chemically synthesized
tgcagttcaaataagggttttt

SEQ ID NO: 659206 - DNA, 22 bp, Artificial Sequence
  chemically synthesized
ttgcagttcaaataagggtttt

SEQ ID NO: 659207 - DNA, 22 bp, Artificial Sequence
  chemically synthesized
caattcctaaaaacccttattt

SEQ ID NO: 659208 - DNA, 22 bp, Artificial Sequence
  chemically synthesized
aattcctaaaaacccttatttg

SEQ ID NO: 659209 - DNA, 22 bp, Artificial Sequence
  chemically synthesized
ctaaaaacccttatttgaactg

SEQ ID NO: 659210 - DNA, 22 bp, Artificial Sequence
  chemically synthesized
tgtagaacttttgcagttcaaa

SEQ ID NO: 659211 - DNA, 22 bp, Artificial Sequence
  chemically synthesized
atgtagaacttttgcagttcaa

SEQ ID NO: 659212 - DNA, 22 bp, Artificial Sequence
  chemically synthesized
aaaacccttatttgaactgcaa

SEQ ID NO: 659213 - DNA, 22 bp, Artificial Sequence
  chemically synthesized
atttatgtagaacttttgcagt

SEQ ID NO: 659214 - DNA, 22 bp, Artificial Sequence
  chemically synthesized
aatttatgtagaacttttgcag

SEQ ID NO: 659215 - DNA, 22 bp, Artificial Sequence
  chemically synthesized
ttaatttatgtagaacttttgc

SEQ ID NO: 659216 - DNA, 22 bp, Artificial Sequence
  chemically synthesized
cttaatttatgtagaacttttg

SEQ ID NO: 659217 - DNA, 22 bp, Artificial Sequence
  chemically synthesized
tcttaatttatgtagaactttt

SEQ ID NO: 659218 - DNA, 22 bp, Artificial Sequence
  chemically synthesized
atttgaactgcaaaagttctac

SEQ ID NO: 659219 - DNA, 22 bp, Artificial Sequence
  chemically synthesized
ttcttaatttatgtagaacttt

SEQ ID NO: 659220 - DNA, 22 bp, Artificial Sequence
  chemically synthesized
tttgaactgcaaaagttctaca

SEQ ID NO: 659221 - DNA, 22 bp, Artificial Sequence
  chemically synthesized
tttcttaatttatgtagaactt

SEQ ID NO: 659222 - DNA, 22 bp, Artificial Sequence
  chemically synthesized
ttttcttaatttatgtagaact

SEQ ID NO: 659223 - DNA, 22 bp, Artificial Sequence
  chemically synthesized
tttttcttaatttatgtagaac

SEQ ID NO: 659224 - DNA, 22 bp, Artificial Sequence
  chemically synthesized
gaactgcaaaagttctacataa

SEQ ID NO: 659225 - DNA, 22 bp, Artificial Sequence
  chemically synthesized
ttttttcttaatttatgtagaa

SEQ ID NO: 659226 - DNA, 22 bp, Artificial Sequence
  chemically synthesized
aactgcaaaagttctacataaa

SEQ ID NO: 659227 - DNA, 22 bp, Artificial Sequence
  chemically synthesized
caaaagttctacataaattaag

SEQ ID NO: 659228 - DNA, 22 bp, Artificial Sequence
  chemically synthesized
tacataaattaagaaaaaaaaa

SEQ ID NO: 659229 - DNA, 22 bp, Artificial Sequence
  chemically synthesized
cataaattaagaaaaaaaaatt

SEQ ID NO: 659230 - DNA, 22 bp, Artificial Sequence
  chemically synthesized
cataggtgaatagaattttttt

SEQ ID NO: 659231 - DNA, 22 bp, Artificial Sequence
  chemically synthesized
ccataggtgaatagaatttttt

SEQ ID NO: 659232 - DNA, 22 bp, Artificial Sequence
  chemically synthesized
tccataggtgaatagaattttt

SEQ ID NO: 659233 - DNA, 22 bp, Artificial Sequence
  chemically synthesized
agaaaaaaaaattctattcacc

SEQ ID NO: 659234 - DNA, 22 bp, Artificial Sequence
  chemically synthesized
aaccaaggtggctttccatagg

SEQ ID NO: 659235 - DNA, 22 bp, Artificial Sequence
  chemically synthesized
aaaccaaggtggctttccatag

SEQ ID NO: 659236 - DNA, 22 bp, Artificial Sequence
  chemically synthesized
tattcacctatggaaagccacc

SEQ ID NO: 659237 - DNA, 22 bp, Artificial Sequence
  chemically synthesized
ttcacctatggaaagccacctt

SEQ ID NO: 659238 - DNA, 22 bp, Artificial Sequence
  chemically synthesized
ccaacttaaaccaaggtggctt

SEQ ID NO: 659239 - DNA, 22 bp, Artificial Sequence
  chemically synthesized
accaacttaaaccaaggtggct

SEQ ID NO: 659240 - DNA, 22 bp, Artificial Sequence
  chemically synthesized
acctatggaaagccaccttggt

SEQ ID NO: 659241 - DNA, 22 bp, Artificial Sequence
  chemically synthesized
cttaccaacttaaaccaaggtg

SEQ ID NO: 659242 - DNA, 22 bp, Artificial Sequence
  chemically synthesized
tgcttaccaacttaaaccaagg

SEQ ID NO: 659243 - DNA, 22 bp, Artificial Sequence
  chemically synthesized
ctgcttaccaacttaaaccaag

SEQ ID NO: 659244 - DNA, 22 bp, Artificial Sequence
  chemically synthesized
tggaaagccaccttggtttaag

SEQ ID NO: 659245 - DNA, 22 bp, Artificial Sequence
  chemically synthesized
ttctgcttaccaacttaaacca

SEQ ID NO: 659246 - DNA, 22 bp, Artificial Sequence
  chemically synthesized
gtaattcttctgcttaccaact

SEQ ID NO: 659247 - DNA, 22 bp, Artificial Sequence
  chemically synthesized
ggtttaagttggtaagcagaag

SEQ ID NO: 659248 - DNA, 22 bp, Artificial Sequence
  chemically synthesized
gtttaagttggtaagcagaaga

SEQ ID NO: 659249 - DNA, 22 bp, Artificial Sequence
  chemically synthesized
gtgaagattagtaattcttctg

SEQ ID NO: 659250 - DNA, 22 bp, Artificial Sequence
  chemically synthesized
aagttggtaagcagaagaatta

SEQ ID NO: 659251 - DNA, 22 bp, Artificial Sequence
  chemically synthesized
agttggtaagcagaagaattac

SEQ ID NO: 659252 - DNA, 22 bp, Artificial Sequence
  chemically synthesized
gtaagcagaagaattactaatc

SEQ ID NO: 659253 - DNA, 22 bp, Artificial Sequence
  chemically synthesized
gtaaccaaagtagattggtgaa

SEQ ID NO: 659254 - DNA, 22 bp, Artificial Sequence
  chemically synthesized
agtaaccaaagtagattggtga

SEQ ID NO: 659255 - DNA, 22 bp, Artificial Sequence
  chemically synthesized
tagtaaccaaagtagattggtg

SEQ ID NO: 659256 - DNA, 22 bp, Artificial Sequence
  chemically synthesized
ctttagtaaccaaagtagattg

SEQ ID NO: 659257 - DNA, 22 bp, Artificial Sequence
  chemically synthesized
ctaatcttcaccaatctacttt

SEQ ID NO: 659258 - DNA, 22 bp, Artificial Sequence
  chemically synthesized
gctttagtaaccaaagtagatt

SEQ ID NO: 659259 - DNA, 22 bp, Artificial Sequence
  chemically synthesized
atcttcaccaatctactttggt

SEQ ID NO: 659260 - DNA, 22 bp, Artificial Sequence
  chemically synthesized
caccaatctactttggttacta

SEQ ID NO: 659261 - DNA, 22 bp, Artificial Sequence
  chemically synthesized
accaatctactttggttactaa

SEQ ID NO: 659262 - DNA, 22 bp, Artificial Sequence
  chemically synthesized
ctttggttactaaagcaaatta

SEQ ID NO: 659263 - DNA, 22 bp, Artificial Sequence
  chemically synthesized
tggttactaaagcaaattacct

SEQ ID NO: 659264 - DNA, 22 bp, Artificial Sequence
  chemically synthesized
catgaccaaagtaggtaatttg

SEQ ID NO: 659265 - DNA, 22 bp, Artificial Sequence
  chemically synthesized
ggttactaaagcaaattaccta

SEQ ID NO: 659266 - DNA, 22 bp, Artificial Sequence
  chemically synthesized
ccatgaccaaagtaggtaattt

SEQ ID NO: 659267 - DNA, 22 bp, Artificial Sequence
  chemically synthesized
gttactaaagcaaattacctac

SEQ ID NO: 659268 - DNA, 22 bp, Artificial Sequence
  chemically synthesized
gcttccatgaccaaagtaggta

SEQ ID NO: 659269 - DNA, 22 bp, Artificial Sequence
  chemically synthesized
ctaaagcaaattacctactttg

SEQ ID NO: 659270 - DNA, 22 bp, Artificial Sequence
  chemically synthesized
ggcttccatgaccaaagtaggt

SEQ ID NO: 659271 - DNA, 22 bp, Artificial Sequence
  chemically synthesized
tggcttccatgaccaaagtagg

SEQ ID NO: 659272 - DNA, 22 bp, Artificial Sequence
  chemically synthesized
ttggcttccatgaccaaagtag

SEQ ID NO: 659273 - DNA, 22 bp, Artificial Sequence
  chemically synthesized
aagcaaattacctactttggtc

SEQ ID NO: 659274 - DNA, 22 bp, Artificial Sequence
  chemically synthesized
tttggcttccatgaccaaagta

SEQ ID NO: 659275 - DNA, 22 bp, Artificial Sequence
  chemically synthesized
ttttggcttccatgaccaaagt

SEQ ID NO: 659276 - DNA, 22 bp, Artificial Sequence
  chemically synthesized
gtaatttttttggcttccatga

SEQ ID NO: 659277 - DNA, 22 bp, Artificial Sequence
  chemically synthesized
cctactttggtcatggaagcca

SEQ ID NO: 659278 - DNA, 22 bp, Artificial Sequence
  chemically synthesized
ctggtaatttttttggcttcca

SEQ ID NO: 659279 - DNA, 22 bp, Artificial Sequence
  chemically synthesized
ctttggtcatggaagccaaaaa

SEQ ID NO: 659280 - DNA, 22 bp, Artificial Sequence
  chemically synthesized
gttgctggtaatttttttggct

SEQ ID NO: 659281 - DNA, 22 bp, Artificial Sequence
  chemically synthesized
tggtcatggaagccaaaaaaat

SEQ ID NO: 659282 - DNA, 22 bp, Artificial Sequence
  chemically synthesized
ggtcatggaagccaaaaaaatt

SEQ ID NO: 659283 - DNA, 22 bp, Artificial Sequence
  chemically synthesized
gtcatggaagccaaaaaaatta

SEQ ID NO: 659284 - DNA, 22 bp, Artificial Sequence
  chemically synthesized
agcagttagttgctggtaattt

SEQ ID NO: 659285 - DNA, 22 bp, Artificial Sequence
  chemically synthesized
agagggctgagcagttagttgc

SEQ ID NO: 659286 - DNA, 22 bp, Artificial Sequence
  chemically synthesized
aagagggctgagcagttagttg

SEQ ID NO: 659287 - DNA, 22 bp, Artificial Sequence
  chemically synthesized
agcatttaagagggctgagcag

SEQ ID NO: 659288 - DNA, 22 bp, Artificial Sequence
  chemically synthesized
ccagcaactaactgctcagccc

SEQ ID NO: 659289 - DNA, 22 bp, Artificial Sequence
  chemically synthesized
actgctcagccctcttaaatgc

SEQ ID NO: 659290 - DNA, 22 bp, Artificial Sequence
  chemically synthesized
atgaagatctgagcatttaaga

SEQ ID NO: 659291 - DNA, 22 bp, Artificial Sequence
  chemically synthesized
ctcagccctcttaaatgctcag

SEQ ID NO: 659292 - DNA, 22 bp, Artificial Sequence
  chemically synthesized
agccctcttaaatgctcagatc

SEQ ID NO: 659293 - DNA, 22 bp, Artificial Sequence
  chemically synthesized
ttaaatgctcagatcttcatca

SEQ ID NO: 659294 - DNA, 22 bp, Artificial Sequence
  chemically synthesized
aaatgctcagatcttcatcaga

SEQ ID NO: 659295 - DNA, 22 bp, Artificial Sequence
  chemically synthesized
aataaggggcaatctgatgaag

SEQ ID NO: 659296 - DNA, 22 bp, Artificial Sequence
  chemically synthesized
aatgctcagatcttcatcagat

SEQ ID NO: 659297 - DNA, 22 bp, Artificial Sequence
  chemically synthesized
caataaggggcaatctgatgaa

SEQ ID NO: 659298 - DNA, 22 bp, Artificial Sequence
  chemically synthesized
tcaataaggggcaatctgatga

SEQ ID NO: 659299 - DNA, 22 bp, Artificial Sequence
  chemically synthesized
tttcaataaggggcaatctgat

SEQ ID NO: 659300 - DNA, 22 bp, Artificial Sequence
  chemically synthesized
ctttcaataaggggcaatctga

SEQ ID NO: 659301 - DNA, 22 bp, Artificial Sequence
  chemically synthesized
tctttcaataaggggcaatctg

SEQ ID NO: 659302 - DNA, 22 bp, Artificial Sequence
  chemically synthesized
agatcttcatcagattgcccct

SEQ ID NO: 659303 - DNA, 22 bp, Artificial Sequence
  chemically synthesized
attttctttcaataaggggcaa

SEQ ID NO: 659304 - DNA, 22 bp, Artificial Sequence
  chemically synthesized
catcagattgccccttattgaa

SEQ ID NO: 659305 - DNA, 22 bp, Artificial Sequence
  chemically synthesized
atcagattgccccttattgaaa

SEQ ID NO: 659306 - DNA, 22 bp, Artificial Sequence
  chemically synthesized
aagtaattaattttctttcaat

SEQ ID NO: 659307 - DNA, 22 bp, Artificial Sequence
  chemically synthesized
ccccttattgaaagaaaattaa

SEQ ID NO: 659308 - DNA, 22 bp, Artificial Sequence
  chemically synthesized
tgtggcctgaagtaattaattt

SEQ ID NO: 659309 - DNA, 22 bp, Artificial Sequence
  chemically synthesized
attgaaagaaaattaattactt

SEQ ID NO: 659310 - DNA, 22 bp, Artificial Sequence
  chemically synthesized
ttgaaagaaaattaattacttc

SEQ ID NO: 659311 - DNA, 22 bp, Artificial Sequence
  chemically synthesized
aaagaaaattaattacttcagg

SEQ ID NO: 659312 - DNA, 22 bp, Artificial Sequence
  chemically synthesized
tgtgttatgtggcctgaagtaa

SEQ ID NO: 659313 - DNA, 22 bp, Artificial Sequence
  chemically synthesized
tattatgtgttatgtggcctga

SEQ ID NO: 659314 - DNA, 22 bp, Artificial Sequence
  chemically synthesized
tatattatgtgttatgtggcct

SEQ ID NO: 659315 - DNA, 22 bp, Artificial Sequence
  chemically synthesized
attacttcaggccacataacac

SEQ ID NO: 659316 - DNA, 22 bp, Artificial Sequence
  chemically synthesized
tattctatattatgtgttatgt

SEQ ID NO: 659317 - DNA, 22 bp, Artificial Sequence
  chemically synthesized
atattctatattatgtgttatg

SEQ ID NO: 659318 - DNA, 22 bp, Artificial Sequence
  chemically synthesized
cttcaggccacataacacataa

SEQ ID NO: 659319 - DNA, 22 bp, Artificial Sequence
  chemically synthesized
caggccacataacacataatat

SEQ ID NO: 659320 - DNA, 22 bp, Artificial Sequence
  chemically synthesized
aggccacataacacataatata

SEQ ID NO: 659321 - DNA, 22 bp, Artificial Sequence
  chemically synthesized
cggagataaacatttatattct

SEQ ID NO: 659322 - DNA, 22 bp, Artificial Sequence
  chemically synthesized
acggagataaacatttatattc

SEQ ID NO: 659323 - DNA, 22 bp, Artificial Sequence
  chemically synthesized
ttacggagataaacatttatat

SEQ ID NO: 659324 - DNA, 22 bp, Artificial Sequence
  chemically synthesized
cttacggagataaacatttata

SEQ ID NO: 659325 - DNA, 22 bp, Artificial Sequence
  chemically synthesized
tcttacggagataaacatttat

SEQ ID NO: 659326 - DNA, 22 bp, Artificial Sequence
  chemically synthesized
ttcttacggagataaacattta

SEQ ID NO: 659327 - DNA, 22 bp, Artificial Sequence
  chemically synthesized
atagagtatgatatttttctta

SEQ ID NO: 659328 - DNA, 22 bp, Artificial Sequence
  chemically synthesized
aatagagtatgatatttttctt

SEQ ID NO: 659329 - DNA, 22 bp, Artificial Sequence
  chemically synthesized
tttaatagagtatgatattttt

SEQ ID NO: 659330 - DNA, 22 bp, Artificial Sequence
  chemically synthesized
atctccgtaagaaaaatatcat

SEQ ID NO: 659331 - DNA, 22 bp, Artificial Sequence
  chemically synthesized
tctccgtaagaaaaatatcata

SEQ ID NO: 659332 - DNA, 22 bp, Artificial Sequence
  chemically synthesized
cgtaagaaaaatatcatactct

SEQ ID NO: 659333 - DNA, 22 bp, Artificial Sequence
  chemically synthesized
aatgttgtttaatagagtatga

SEQ ID NO: 659334 - DNA, 22 bp, Artificial Sequence
  chemically synthesized
gaatgttgtttaatagagtatg

SEQ ID NO: 659335 - DNA, 22 bp, Artificial Sequence
  chemically synthesized
gatcatatatttgaatgttgtt

SEQ ID NO: 659336 - DNA, 22 bp, Artificial Sequence
  chemically synthesized
agatcatatatttgaatgttgt

SEQ ID NO: 659337 - DNA, 22 bp, Artificial Sequence
  chemically synthesized
tagatcatatatttgaatgttg

SEQ ID NO: 659338 - DNA, 22 bp, Artificial Sequence
  chemically synthesized
ttagatcatatatttgaatgtt

SEQ ID NO: 659339 - DNA, 22 bp, Artificial Sequence
  chemically synthesized
tttagatcatatatttgaatgt

SEQ ID NO: 659340 - DNA, 22 bp, Artificial Sequence
  chemically synthesized
tattaaacaacattcaaatata

SEQ ID NO: 659341 - DNA, 22 bp, Artificial Sequence
  chemically synthesized
ttttttagatcatatatttgaa

SEQ ID NO: 659342 - DNA, 22 bp, Artificial Sequence
  chemically synthesized
attttttagatcatatatttga

SEQ ID NO: 659343 - DNA, 22 bp, Artificial Sequence
  chemically synthesized
ttaaacaacattcaaatatatg

SEQ ID NO: 659344 - DNA, 22 bp, Artificial Sequence
  chemically synthesized
aacaacattcaaatatatgatc

SEQ ID NO: 659345 - DNA, 22 bp, Artificial Sequence
  chemically synthesized
taaatttattttttagatcata

SEQ ID NO: 659346 - DNA, 22 bp, Artificial Sequence
  chemically synthesized
ataaatttattttttagatcat

SEQ ID NO: 659347 - DNA, 22 bp, Artificial Sequence
  chemically synthesized
tttataaatttattttttagat

SEQ ID NO: 659348 - DNA, 22 bp, Artificial Sequence
  chemically synthesized
aaatatatgatctaaaaaataa

SEQ ID NO: 659349 - DNA, 22 bp, Artificial Sequence
  chemically synthesized
atatagcaacaggttatttata

SEQ ID NO: 659350 - DNA, 22 bp, Artificial Sequence
  chemically synthesized
aaaaataaatttataaataacc

SEQ ID NO: 659351 - DNA, 22 bp, Artificial Sequence
  chemically synthesized
aaacactgatatagcaacaggt

SEQ ID NO: 659352 - DNA, 22 bp, Artificial Sequence
  chemically synthesized
ataaataacctgttgctatatc

SEQ ID NO: 659353 - DNA, 22 bp, Artificial Sequence
  chemically synthesized
tattaaaacactgatatagcaa

SEQ ID NO: 659354 - DNA, 22 bp, Artificial Sequence
  chemically synthesized
taaataacctgttgctatatca

SEQ ID NO: 659355 - DNA, 22 bp, Artificial Sequence
  chemically synthesized
ttgctatatcagtgttttaata

SEQ ID NO: 659356 - DNA, 22 bp, Artificial Sequence
  chemically synthesized
ctatatcagtgttttaatatag

SEQ ID NO: 659357 - DNA, 22 bp, Artificial Sequence
  chemically synthesized
tatcagtgttttaatatagatt

SEQ ID NO: 659358 - DNA, 22 bp, Artificial Sequence
  chemically synthesized
tgcaaataaaagcaatctatat

SEQ ID NO: 659359 - DNA, 22 bp, Artificial Sequence
  chemically synthesized
taatatagattgcttttatttg

SEQ ID NO: 659360 - DNA, 22 bp, Artificial Sequence
  chemically synthesized
aatatagattgcttttatttgc

SEQ ID NO: 659361 - DNA, 22 bp, Artificial Sequence
  chemically synthesized
atatagattgcttttatttgca

SEQ ID NO: 659362 - DNA, 22 bp, Artificial Sequence
  chemically synthesized
cttttatttgcatagcattttc

SEQ ID NO: 659363 - DNA, 22 bp, Artificial Sequence
  chemically synthesized
tatgcaaatatagaaaatgcta

SEQ ID NO: 659364 - DNA, 22 bp, Artificial Sequence
  chemically synthesized
tatatgcaaatatagaaaatgc

SEQ ID NO: 659365 - DNA, 22 bp, Artificial Sequence
  chemically synthesized
ttatttgcatagcattttctat

SEQ ID NO: 659366 - DNA, 22 bp, Artificial Sequence
  chemically synthesized
ctatatgcaaatatagaaaatg

SEQ ID NO: 659367 - DNA, 22 bp, Artificial Sequence
  chemically synthesized
tatttgcatagcattttctata

SEQ ID NO: 659368 - DNA, 22 bp, Artificial Sequence
  chemically synthesized
tctatatgcaaatatagaaaat

SEQ ID NO: 659369 - DNA, 22 bp, Artificial Sequence
  chemically synthesized
atttgcatagcattttctatat

SEQ ID NO: 659370 - DNA, 22 bp, Artificial Sequence
  chemically synthesized
tttgcatagcattttctatatt

SEQ ID NO: 659371 - DNA, 22 bp, Artificial Sequence
  chemically synthesized
gcatagcattttctatatttgc

SEQ ID NO: 659372 - DNA, 22 bp, Artificial Sequence
  chemically synthesized
agttttctatatgcaaatatag

SEQ ID NO: 659373 - DNA, 22 bp, Artificial Sequence
  chemically synthesized
catagcattttctatatttgca

SEQ ID NO: 659374 - DNA, 22 bp, Artificial Sequence
  chemically synthesized
cagttttctatatgcaaatata

SEQ ID NO: 659375 - DNA, 22 bp, Artificial Sequence
  chemically synthesized
tttcagttttctatatgcaaat

SEQ ID NO: 659376 - DNA, 22 bp, Artificial Sequence
  chemically synthesized
atttcagttttctatatgcaaa

SEQ ID NO: 659377 - DNA, 22 bp, Artificial Sequence
  chemically synthesized
tatttcagttttctatatgcaa

SEQ ID NO: 659378 - DNA, 22 bp, Artificial Sequence
  chemically synthesized
tctatatttgcatatagaaaac

SEQ ID NO: 659379 - DNA, 22 bp, Artificial Sequence
  chemically synthesized
ctatatttgcatatagaaaact

SEQ ID NO: 659380 - DNA, 22 bp, Artificial Sequence
  chemically synthesized
tatatttgcatatagaaaactg

SEQ ID NO: 659381 - DNA, 22 bp, Artificial Sequence
  chemically synthesized
tatttgcatatagaaaactgaa

SEQ ID NO: 659382 - DNA, 22 bp, Artificial Sequence
  chemically synthesized
tgtgaaatgctttatttcagtt

SEQ ID NO: 659383 - DNA, 22 bp, Artificial Sequence
  chemically synthesized
gcatatagaaaactgaaataaa

SEQ ID NO: 659384 - DNA, 22 bp, Artificial Sequence
  chemically synthesized
catatagaaaactgaaataaag

SEQ ID NO: 659385 - DNA, 22 bp, Artificial Sequence
  chemically synthesized
ttatgtgaaatgctttatttca

SEQ ID NO: 659386 - DNA, 22 bp, Artificial Sequence
  chemically synthesized
gttatgtgaaatgctttatttc

SEQ ID NO: 659387 - DNA, 22 bp, Artificial Sequence
  chemically synthesized
ataaatttgttatgtgaaatgc

SEQ ID NO: 659388 - DNA, 22 bp, Artificial Sequence
  chemically synthesized
ttaataaatttgttatgtgaaa

SEQ ID NO: 659389 - DNA, 22 bp, Artificial Sequence
  chemically synthesized
attaataaatttgttatgtgaa

SEQ ID NO: 659390 - DNA, 22 bp, Artificial Sequence
  chemically synthesized
aaataaagcatttcacataaca

SEQ ID NO: 659391 - DNA, 22 bp, Artificial Sequence
  chemically synthesized
gcttattaataaatttgttatg

SEQ ID NO: 659392 - DNA, 22 bp, Artificial Sequence
  chemically synthesized
cacataacaaatttattaataa

SEQ ID NO: 659393 - DNA, 22 bp, Artificial Sequence
  chemically synthesized
acataacaaatttattaataag

SEQ ID NO: 659394 - DNA, 22 bp, Artificial Sequence
  chemically synthesized
ccccatggataaaattagctta

SEQ ID NO: 659395 - DNA, 22 bp, Artificial Sequence
  chemically synthesized
cccccatggataaaattagctt

SEQ ID NO: 659396 - DNA, 22 bp, Artificial Sequence
  chemically synthesized
tcccccatggataaaattagct

SEQ ID NO: 659397 - DNA, 22 bp, Artificial Sequence
  chemically synthesized
ttcccccatggataaaattagc

SEQ ID NO: 659398 - DNA, 22 bp, Artificial Sequence
  chemically synthesized
tttcccccatggataaaattag

SEQ ID NO: 659399 - DNA, 22 bp, Artificial Sequence
  chemically synthesized
ttttcccccatggataaaatta

SEQ ID NO: 659400 - DNA, 22 bp, Artificial Sequence
  chemically synthesized
tttttcccccatggataaaatt

SEQ ID NO: 659401 - DNA, 22 bp, Artificial Sequence
  chemically synthesized
attaataagctaattttatcca

SEQ ID NO: 659402 - DNA, 22 bp, Artificial Sequence
  chemically synthesized
ttaataagctaattttatccat

SEQ ID NO: 659403 - DNA, 22 bp, Artificial Sequence
  chemically synthesized
ctttttttcccccatggataaa

SEQ ID NO: 659404 - DNA, 22 bp, Artificial Sequence
  chemically synthesized
cctttttttcccccatggataa

SEQ ID NO: 659405 - DNA, 22 bp, Artificial Sequence
  chemically synthesized
ataagctaattttatccatggg

SEQ ID NO: 659406 - DNA, 22 bp, Artificial Sequence
  chemically synthesized
tcctttttttcccccatggata

SEQ ID NO: 659407 - DNA, 22 bp, Artificial Sequence
  chemically synthesized
ttcctttttttcccccatggat

SEQ ID NO: 659408 - DNA, 22 bp, Artificial Sequence
  chemically synthesized
tttttcctttttttcccccatg

SEQ ID NO: 659409 - DNA, 22 bp, Artificial Sequence
  chemically synthesized
atttttcctttttttcccccat

SEQ ID NO: 659410 - DNA, 22 bp, Artificial Sequence
  chemically synthesized
ttatttttcctttttttccccc

SEQ ID NO: 659411 - DNA, 22 bp, Artificial Sequence
  chemically synthesized
attttatccatgggggaaaaaa

SEQ ID NO: 659412 - DNA, 22 bp, Artificial Sequence
  chemically synthesized
attcttatttttcctttttttc

SEQ ID NO: 659413 - DNA, 22 bp, Artificial Sequence
  chemically synthesized
tatccatgggggaaaaaaagga

SEQ ID NO: 659414 - DNA, 22 bp, Artificial Sequence
  chemically synthesized
cattcttatttttccttttttt

SEQ ID NO: 659415 - DNA, 22 bp, Artificial Sequence
  chemically synthesized
atccatgggggaaaaaaaggaa

SEQ ID NO: 659416 - DNA, 22 bp, Artificial Sequence
  chemically synthesized
tcattcttatttttcctttttt

SEQ ID NO: 659417 - DNA, 22 bp, Artificial Sequence
  chemically synthesized
tccatgggggaaaaaaaggaaa

SEQ ID NO: 659418 - DNA, 22 bp, Artificial Sequence
  chemically synthesized
ttcattcttatttttccttttt

SEQ ID NO: 659419 - DNA, 22 bp, Artificial Sequence
  chemically synthesized
caaaatggaaaacttttcattc

SEQ ID NO: 659420 - DNA, 22 bp, Artificial Sequence
  chemically synthesized
tacaaaatggaaaacttttcat

SEQ ID NO: 659421 - DNA, 22 bp, Artificial Sequence
  chemically synthesized
ctacaaaatggaaaacttttca

SEQ ID NO: 659422 - DNA, 22 bp, Artificial Sequence
  chemically synthesized
tctacaaaatggaaaacttttc

SEQ ID NO: 659423 - DNA, 22 bp, Artificial Sequence
  chemically synthesized
aaagacattttctacaaaatgg

SEQ ID NO: 659424 - DNA, 22 bp, Artificial Sequence
  chemically synthesized
gaaagacattttctacaaaatg

SEQ ID NO: 659425 - DNA, 22 bp, Artificial Sequence
  chemically synthesized
catgtcttgaaagacattttct

SEQ ID NO: 659426 - DNA, 22 bp, Artificial Sequence
  chemically synthesized
tccattttgtagaaaatgtctt

SEQ ID NO: 659427 - DNA, 22 bp, Artificial Sequence
  chemically synthesized
ccattttgtagaaaatgtcttt

SEQ ID NO: 659428 - DNA, 22 bp, Artificial Sequence
  chemically synthesized
cattttgtagaaaatgtctttc

SEQ ID NO: 659429 - DNA, 22 bp, Artificial Sequence
  chemically synthesized
attccatgtcttgaaagacatt

SEQ ID NO: 659430 - DNA, 22 bp, Artificial Sequence
  chemically synthesized
tgtagaaaatgtctttcaagac

SEQ ID NO: 659431 - DNA, 22 bp, Artificial Sequence
  chemically synthesized
gtagaaaatgtctttcaagaca

SEQ ID NO: 659432 - DNA, 22 bp, Artificial Sequence
  chemically synthesized
atattgattccatgtcttgaaa

SEQ ID NO: 659433 - DNA, 22 bp, Artificial Sequence
  chemically synthesized
tagaaaatgtctttcaagacat

SEQ ID NO: 659434 - DNA, 22 bp, Artificial Sequence
  chemically synthesized
atgggcattcatattgattcca

SEQ ID NO: 659435 - DNA, 22 bp, Artificial Sequence
  chemically synthesized
tcaagacatggaatcaatatga

SEQ ID NO: 659436 - DNA, 22 bp, Artificial Sequence
  chemically synthesized
attgatgggcattcatattgat

SEQ ID NO: 659437 - DNA, 22 bp, Artificial Sequence
  chemically synthesized
caagacatggaatcaatatgaa

SEQ ID NO: 659438 - DNA, 22 bp, Artificial Sequence
  chemically synthesized
aagacatggaatcaatatgaat

SEQ ID NO: 659439 - DNA, 22 bp, Artificial Sequence
  chemically synthesized
tcattgatgggcattcatattg

SEQ ID NO: 659440 - DNA, 22 bp, Artificial Sequence
  chemically synthesized
ctcattgatgggcattcatatt

SEQ ID NO: 659441 - DNA, 22 bp, Artificial Sequence
  chemically synthesized
catagtgtatatgtaccatatt

SEQ ID NO: 659442 - DNA, 22 bp, Artificial Sequence
  chemically synthesized
catggtattccatagtgtatat

SEQ ID NO: 659443 - DNA, 22 bp, Artificial Sequence
  chemically synthesized
tagctgcatggtattccatagt

SEQ ID NO: 659444 - DNA, 22 bp, Artificial Sequence
  chemically synthesized
atagctgcatggtattccatag

SEQ ID NO: 659445 - DNA, 22 bp, Artificial Sequence
  chemically synthesized
tatagctgcatggtattccata

SEQ ID NO: 659446 - DNA, 22 bp, Artificial Sequence
  chemically synthesized
ttatagctgcatggtattccat

SEQ ID NO: 659447 - DNA, 22 bp, Artificial Sequence
  chemically synthesized
tttatagctgcatggtattcca

SEQ ID NO: 659448 - DNA, 22 bp, Artificial Sequence
  chemically synthesized
ttttatagctgcatggtattcc

SEQ ID NO: 659449 - DNA, 22 bp, Artificial Sequence
  chemically synthesized
ttttttatagctgcatggtatt

SEQ ID NO: 659450 - DNA, 22 bp, Artificial Sequence
  chemically synthesized
attcttttttatagctgcatgg

SEQ ID NO: 659451 - DNA, 22 bp, Artificial Sequence
  chemically synthesized
tggaataccatgcagctataaa

SEQ ID NO: 659452 - DNA, 22 bp, Artificial Sequence
  chemically synthesized
aaaagacatgatctcattcttt

SEQ ID NO: 659453 - DNA, 22 bp, Artificial Sequence
  chemically synthesized
taaaaaagaatgagatcatgtc

SEQ ID NO: 659454 - DNA, 22 bp, Artificial Sequence
  chemically synthesized
atccgtgttcaaaagacatgat

SEQ ID NO: 659455 - DNA, 22 bp, Artificial Sequence
  chemically synthesized
cagctaatccgtgttcaaaaga

SEQ ID NO: 659456 - DNA, 22 bp, Artificial Sequence
  chemically synthesized
aggataatagtctccagctaat

SEQ ID NO: 659457 - DNA, 22 bp, Artificial Sequence
  chemically synthesized
ttgaacacggattagctggaga

SEQ ID NO: 659458 - DNA, 22 bp, Artificial Sequence
  chemically synthesized
tgaacacggattagctggagac

SEQ ID NO: 659459 - DNA, 22 bp, Artificial Sequence
  chemically synthesized
ctaaggataatagtctccagct

SEQ ID NO: 659460 - DNA, 22 bp, Artificial Sequence
  chemically synthesized
gaacacggattagctggagact

SEQ ID NO: 659461 - DNA, 22 bp, Artificial Sequence
  chemically synthesized
gctaaggataatagtctccagc

SEQ ID NO: 659462 - DNA, 22 bp, Artificial Sequence
  chemically synthesized
aacacggattagctggagacta

SEQ ID NO: 659463 - DNA, 22 bp, Artificial Sequence
  chemically synthesized
gtttgctaaggataatagtctc

SEQ ID NO: 659464 - DNA, 22 bp, Artificial Sequence
  chemically synthesized
cattagtttgctaaggataata

SEQ ID NO: 659465 - DNA, 22 bp, Artificial Sequence
  chemically synthesized
tgcattagtttgctaaggataa

SEQ ID NO: 659466 - DNA, 22 bp, Artificial Sequence
  chemically synthesized
gctggagactattatccttagc

SEQ ID NO: 659467 - DNA, 22 bp, Artificial Sequence
  chemically synthesized
ctgcattagtttgctaaggata

SEQ ID NO: 659468 - DNA, 22 bp, Artificial Sequence
  chemically synthesized
tttctgcattagtttgctaagg

SEQ ID NO: 659469 - DNA, 22 bp, Artificial Sequence
  chemically synthesized
gagactattatccttagcaaac

SEQ ID NO: 659470 - DNA, 22 bp, Artificial Sequence
  chemically synthesized
tgtttctgcattagtttgctaa

SEQ ID NO: 659471 - DNA, 22 bp, Artificial Sequence
  chemically synthesized
ctgtttctgcattagtttgcta

SEQ ID NO: 659472 - DNA, 22 bp, Artificial Sequence
  chemically synthesized
tctgtttctgcattagtttgct

SEQ ID NO: 659473 - DNA, 22 bp, Artificial Sequence
  chemically synthesized
ttctgtttctgcattagtttgc

SEQ ID NO: 659474 - DNA, 22 bp, Artificial Sequence
  chemically synthesized
ttatccttagcaaactaatgca

SEQ ID NO: 659475 - DNA, 22 bp, Artificial Sequence
  chemically synthesized
cttttctgtttctgcattagtt

SEQ ID NO: 659476 - DNA, 22 bp, Artificial Sequence
  chemically synthesized
acttttctgtttctgcattagt

SEQ ID NO: 659477 - DNA, 22 bp, Artificial Sequence
  chemically synthesized
tccttagcaaactaatgcagaa

SEQ ID NO: 659478 - DNA, 22 bp, Artificial Sequence
  chemically synthesized
agcaaactaatgcagaaacaga

SEQ ID NO: 659479 - DNA, 22 bp, Artificial Sequence
  chemically synthesized
gcaaactaatgcagaaacagaa

SEQ ID NO: 659480 - DNA, 22 bp, Artificial Sequence
  chemically synthesized
atgcagaaacagaaaagtaaat

SEQ ID NO: 659481 - DNA, 22 bp, Artificial Sequence
  chemically synthesized
gaagtgagaacatgcagtattt

SEQ ID NO: 659482 - DNA, 22 bp, Artificial Sequence
  chemically synthesized
agaagtgagaacatgcagtatt

SEQ ID NO: 659483 - DNA, 22 bp, Artificial Sequence
  chemically synthesized
cacttagaagtgagaacatgca

SEQ ID NO: 659484 - DNA, 22 bp, Artificial Sequence
  chemically synthesized
ccacttagaagtgagaacatgc

SEQ ID NO: 659485 - DNA, 22 bp, Artificial Sequence
  chemically synthesized
gcttccacttagaagtgagaac

SEQ ID NO: 659486 - DNA, 22 bp, Artificial Sequence
  chemically synthesized
agcttccacttagaagtgagaa

SEQ ID NO: 659487 - DNA, 22 bp, Artificial Sequence
  chemically synthesized
atcatttagcttccacttagaa

SEQ ID NO: 659488 - DNA, 22 bp, Artificial Sequence
  chemically synthesized
catgttctcacttctaagtgga

SEQ ID NO: 659489 - DNA, 22 bp, Artificial Sequence
  chemically synthesized
tcatcatttagcttccacttag

SEQ ID NO: 659490 - DNA, 22 bp, Artificial Sequence
  chemically synthesized
tcacttctaagtggaagctaaa

SEQ ID NO: 659491 - DNA, 22 bp, Artificial Sequence
  chemically synthesized
acttctaagtggaagctaaatg

SEQ ID NO: 659492 - DNA, 22 bp, Artificial Sequence
  chemically synthesized
gtgagctctcatcatttagctt

SEQ ID NO: 659493 - DNA, 22 bp, Artificial Sequence
  chemically synthesized
ctaagtggaagctaaatgatga

SEQ ID NO: 659494 - DNA, 22 bp, Artificial Sequence
  chemically synthesized
taagtggaagctaaatgatgag

SEQ ID NO: 659495 - DNA, 22 bp, Artificial Sequence
  chemically synthesized
tgttcgtgagctctcatcattt

SEQ ID NO: 659496 - DNA, 22 bp, Artificial Sequence
  chemically synthesized
gtgttcgtgagctctcatcatt

SEQ ID NO: 659497 - DNA, 22 bp, Artificial Sequence
  chemically synthesized
agtggaagctaaatgatgagag

SEQ ID NO: 659498 - DNA, 22 bp, Artificial Sequence
  chemically synthesized
ccttgtgttcgtgagctctcat

SEQ ID NO: 659499 - DNA, 22 bp, Artificial Sequence
  chemically synthesized
ttcccttgtgttcgtgagctct

SEQ ID NO: 659500 - DNA, 22 bp, Artificial Sequence
  chemically synthesized
ttgttcccttgtgttcgtgagc

SEQ ID NO: 659501 - DNA, 22 bp, Artificial Sequence
  chemically synthesized
aatgatgagagctcacgaacac

SEQ ID NO: 659502 - DNA, 22 bp, Artificial Sequence
  chemically synthesized
acgaacacaagggaacaacaga

SEQ ID NO: 659503 - DNA, 22 bp, Artificial Sequence
  chemically synthesized
aagaccccagtatctgttgttc

SEQ ID NO: 659504 - DNA, 22 bp, Artificial Sequence
  chemically synthesized
caccctcaagaccccagtatct

SEQ ID NO: 659505 - DNA, 22 bp, Artificial Sequence
  chemically synthesized
caccctccaccctcaagacccc

SEQ ID NO: 659506 - DNA, 22 bp, Artificial Sequence
  chemically synthesized
ccaccctccaccctcaagaccc

SEQ ID NO: 659507 - DNA, 22 bp, Artificial Sequence
  chemically synthesized
cttccaccctccaccctcaaga

SEQ ID NO: 659508 - DNA, 22 bp, Artificial Sequence
  chemically synthesized
cctccttccaccctccaccctc

SEQ ID NO: 659509 - DNA, 22 bp, Artificial Sequence
  chemically synthesized
tccctccttccaccctccaccc

SEQ ID NO: 659510 - DNA, 22 bp, Artificial Sequence
  chemically synthesized
gggtcttgagggtggagggtgg

SEQ ID NO: 659511 - DNA, 22 bp, Artificial Sequence
  chemically synthesized
ctctccctccttccaccctcca

SEQ ID NO: 659512 - DNA, 22 bp, Artificial Sequence
  chemically synthesized
ctcctctccctccttccaccct

SEQ ID NO: 659513 - DNA, 22 bp, Artificial Sequence
  chemically synthesized
tgctcctctccctccttccacc

SEQ ID NO: 659514 - DNA, 22 bp, Artificial Sequence
  chemically synthesized
ctgctcctctccctccttccac

SEQ ID NO: 659515 - DNA, 22 bp, Artificial Sequence
  chemically synthesized
gagggtggagggtggaaggagg

SEQ ID NO: 659516 - DNA, 22 bp, Artificial Sequence
  chemically synthesized
tctgctcctctccctccttcca

SEQ ID NO: 659517 - DNA, 22 bp, Artificial Sequence
  chemically synthesized
agggtggagggtggaaggaggg

SEQ ID NO: 659518 - DNA, 22 bp, Artificial Sequence
  chemically synthesized
ttctgctcctctccctccttcc

SEQ ID NO: 659519 - DNA, 22 bp, Artificial Sequence
  chemically synthesized
tcttttctgctcctctccctcc

SEQ ID NO: 659520 - DNA, 22 bp, Artificial Sequence
  chemically synthesized
agcgcagtacccaacagttgtc

SEQ ID NO: 659521 - DNA, 22 bp, Artificial Sequence
  chemically synthesized
cagcataaatgggttaagcgca

SEQ ID NO: 659522 - DNA, 22 bp, Artificial Sequence
  chemically synthesized
ttgggtactgcgcttaacccat

SEQ ID NO: 659523 - DNA, 22 bp, Artificial Sequence
  chemically synthesized
ggtactgcgcttaacccattta

SEQ ID NO: 659524 - DNA, 22 bp, Artificial Sequence
  chemically synthesized
cgcttaacccatttatgctgga

SEQ ID NO: 659525 - DNA, 22 bp, Artificial Sequence
  chemically synthesized
aacccatttatgctggaggctg

SEQ ID NO: 659526 - DNA, 22 bp, Artificial Sequence
  chemically synthesized
acccatttatgctggaggctgc

SEQ ID NO: 659527 - DNA, 22 bp, Artificial Sequence
  chemically synthesized
acaaaaagtaatatgcagcctc

SEQ ID NO: 659528 - DNA, 22 bp, Artificial Sequence
  chemically synthesized
cacaaaaagtaatatgcagcct

SEQ ID NO: 659529 - DNA, 22 bp, Artificial Sequence
  chemically synthesized
tcacaaaaagtaatatgcagcc

SEQ ID NO: 659530 - DNA, 22 bp, Artificial Sequence
  chemically synthesized
atgctggaggctgcatattact

SEQ ID NO: 659531 - DNA, 22 bp, Artificial Sequence
  chemically synthesized
attttcacaaaaagtaatatgc

SEQ ID NO: 659532 - DNA, 22 bp, Artificial Sequence
  chemically synthesized
tgctggaggctgcatattactt

SEQ ID NO: 659533 - DNA, 22 bp, Artificial Sequence
  chemically synthesized
gaggctgcatattactttttgt

SEQ ID NO: 659534 - DNA, 22 bp, Artificial Sequence
  chemically synthesized
catattactttttgtgaaaatc

SEQ ID NO: 659535 - DNA, 22 bp, Artificial Sequence
  chemically synthesized
ctttttgtgaaaatcagacctt

SEQ ID NO: 659536 - DNA, 22 bp, Artificial Sequence
  chemically synthesized
aaggtcatcgccaaggtctgat

SEQ ID NO: 659537 - DNA, 22 bp, Artificial Sequence
  chemically synthesized
tttgtgaaaatcagaccttggc

SEQ ID NO: 659538 - DNA, 22 bp, Artificial Sequence
  chemically synthesized
ctcaaggtcatcgccaaggtct

SEQ ID NO: 659539 - DNA, 22 bp, Artificial Sequence
  chemically synthesized
ttgtgaaaatcagaccttggcg

SEQ ID NO: 659540 - DNA, 22 bp, Artificial Sequence
  chemically synthesized
tgtgaaaatcagaccttggcga

SEQ ID NO: 659541 - DNA, 22 bp, Artificial Sequence
  chemically synthesized
gtgaaaatcagaccttggcgat

SEQ ID NO: 659542 - DNA, 22 bp, Artificial Sequence
  chemically synthesized
ctgctcaaggtcatcgccaagg

SEQ ID NO: 659543 - DNA, 22 bp, Artificial Sequence
  chemically synthesized
tgaaaatcagaccttggcgatg

SEQ ID NO: 659544 - DNA, 22 bp, Artificial Sequence
  chemically synthesized
tcctactgctcaaggtcatcgc

SEQ ID NO: 659545 - DNA, 22 bp, Artificial Sequence
  chemically synthesized
ctatcctactgctcaaggtcat

SEQ ID NO: 659546 - DNA, 22 bp, Artificial Sequence
  chemically synthesized
ttcctatcctactgctcaaggt

SEQ ID NO: 659547 - DNA, 22 bp, Artificial Sequence
  chemically synthesized
ggcgatgaccttgagcagtagg

SEQ ID NO: 659548 - DNA, 22 bp, Artificial Sequence
  chemically synthesized
gcgatgaccttgagcagtagga

SEQ ID NO: 659549 - DNA, 22 bp, Artificial Sequence
  chemically synthesized
tgggaattattcctatcctact

SEQ ID NO: 659550 - DNA, 22 bp, Artificial Sequence
  chemically synthesized
gtgggaattattcctatcctac

SEQ ID NO: 659551 - DNA, 22 bp, Artificial Sequence
  chemically synthesized
agcttgtgggaattattcctat

SEQ ID NO: 659552 - DNA, 22 bp, Artificial Sequence
  chemically synthesized
gagcagtaggataggaataatt

SEQ ID NO: 659553 - DNA, 22 bp, Artificial Sequence
  chemically synthesized
agcagtaggataggaataattc

SEQ ID NO: 659554 - DNA, 22 bp, Artificial Sequence
  chemically synthesized
gaacactaagcttgtgggaatt

SEQ ID NO: 659555 - DNA, 22 bp, Artificial Sequence
  chemically synthesized
ttggaacactaagcttgtggga

SEQ ID NO: 659556 - DNA, 22 bp, Artificial Sequence
  chemically synthesized
cattattggaacactaagcttg

SEQ ID NO: 659557 - DNA, 22 bp, Artificial Sequence
  chemically synthesized
gtgttccattattggaacacta

SEQ ID NO: 659558 - DNA, 22 bp, Artificial Sequence
  chemically synthesized
ccacaagcttagtgttccaata

SEQ ID NO: 659559 - DNA, 22 bp, Artificial Sequence
  chemically synthesized
tgcctagtgttccattattgga

SEQ ID NO: 659560 - DNA, 22 bp, Artificial Sequence
  chemically synthesized
atgcctagtgttccattattgg

SEQ ID NO: 659561 - DNA, 22 bp, Artificial Sequence
  chemically synthesized
agtgttccaataatggaacact

SEQ ID NO: 659562 - DNA, 22 bp, Artificial Sequence
  chemically synthesized
gtgttccaataatggaacacta

SEQ ID NO: 659563 - DNA, 22 bp, Artificial Sequence
  chemically synthesized
acccatttatgcctagtgttcc

SEQ ID NO: 659564 - DNA, 22 bp, Artificial Sequence
  chemically synthesized
caataatggaacactaggcata

SEQ ID NO: 659565 - DNA, 22 bp, Artificial Sequence
  chemically synthesized
aggtattaacccatttatgcct

SEQ ID NO: 659566 - DNA, 22 bp, Artificial Sequence
  chemically synthesized
atcactcaggtattaacccatt

SEQ ID NO: 659567 - DNA, 22 bp, Artificial Sequence
  chemically synthesized
catcactcaggtattaacccat

SEQ ID NO: 659568 - DNA, 22 bp, Artificial Sequence
  chemically synthesized
tttcatcactcaggtattaacc

SEQ ID NO: 659569 - DNA, 22 bp, Artificial Sequence
  chemically synthesized
ggcataaatgggttaatacctg

SEQ ID NO: 659570 - DNA, 22 bp, Artificial Sequence
  chemically synthesized
tacagattatttcatcactcag

SEQ ID NO: 659571 - DNA, 22 bp, Artificial Sequence
  chemically synthesized
ttgtacagattatttcatcact

SEQ ID NO: 659572 - DNA, 22 bp, Artificial Sequence
  chemically synthesized
gttgtacagattatttcatcac

SEQ ID NO: 659573 - DNA, 22 bp, Artificial Sequence
  chemically synthesized
atacctgagtgatgaaataatc

SEQ ID NO: 659574 - DNA, 22 bp, Artificial Sequence
  chemically synthesized
agtgatgaaataatctgtacaa

SEQ ID NO: 659575 - DNA, 22 bp, Artificial Sequence
  chemically synthesized
acgtcacgggggtttgttgtac

SEQ ID NO: 659576 - DNA, 22 bp, Artificial Sequence
  chemically synthesized
tacaacaaacccccgtgacgtg

SEQ ID NO: 659577 - DNA, 22 bp, Artificial Sequence
  chemically synthesized
cataggtaaactcacgtcacgg

SEQ ID NO: 659578 - DNA, 22 bp, Artificial Sequence
  chemically synthesized
ttacataggtaaactcacgtca

SEQ ID NO: 659579 - DNA, 22 bp, Artificial Sequence
  chemically synthesized
tgtgaaggtctgttacataggt

SEQ ID NO: 659580 - DNA, 22 bp, Artificial Sequence
  chemically synthesized
ggggtattatgtgaaggtctgt

SEQ ID NO: 659581 - DNA, 22 bp, Artificial Sequence
  chemically synthesized
cggggtattatgtgaaggtctg

SEQ ID NO: 659582 - DNA, 22 bp, Artificial Sequence
  chemically synthesized
acctatgtaacagaccttcaca

SEQ ID NO: 659583 - DNA, 22 bp, Artificial Sequence
  chemically synthesized
cctatgtaacagaccttcacat

SEQ ID NO: 659584 - DNA, 22 bp, Artificial Sequence
  chemically synthesized
ggtttcggggtattatgtgaag

SEQ ID NO: 659585 - DNA, 22 bp, Artificial Sequence
  chemically synthesized
aggtttcggggtattatgtgaa

SEQ ID NO: 659586 - DNA, 22 bp, Artificial Sequence
  chemically synthesized
tgtaacagaccttcacataata

SEQ ID NO: 659587 - DNA, 22 bp, Artificial Sequence
  chemically synthesized
taggtttcggggtattatgtga

SEQ ID NO: 659588 - DNA, 22 bp, Artificial Sequence
  chemically synthesized
attttaggtttcggggtattat

SEQ ID NO: 659589 - DNA, 22 bp, Artificial Sequence
  chemically synthesized
aattttaggtttcggggtatta

SEQ ID NO: 659590 - DNA, 22 bp, Artificial Sequence
  chemically synthesized
taattttaggtttcggggtatt

SEQ ID NO: 659591 - DNA, 22 bp, Artificial Sequence
  chemically synthesized
actttaattttaggtttcgggg

SEQ ID NO: 659592 - DNA, 22 bp, Artificial Sequence
  chemically synthesized
aactttaattttaggtttcggg

SEQ ID NO: 659593 - DNA, 22 bp, Artificial Sequence
  chemically synthesized
taactttaattttaggtttcgg

SEQ ID NO: 659594 - DNA, 22 bp, Artificial Sequence
  chemically synthesized
cacataataccccgaaacctaa

SEQ ID NO: 659595 - DNA, 22 bp, Artificial Sequence
  chemically synthesized
ttaactttaattttaggtttcg

SEQ ID NO: 659596 - DNA, 22 bp, Artificial Sequence
  chemically synthesized
acataataccccgaaacctaaa

SEQ ID NO: 659597 - DNA, 22 bp, Artificial Sequence
  chemically synthesized
tttaactttaattttaggtttc

SEQ ID NO: 659598 - DNA, 22 bp, Artificial Sequence
  chemically synthesized
aaagacactttttaactttaat

SEQ ID NO: 659599 - DNA, 22 bp, Artificial Sequence
  chemically synthesized
ttgaaagacactttttaacttt

SEQ ID NO: 659600 - DNA, 22 bp, Artificial Sequence
  chemically synthesized
aaattaaagttaaaaagtgtct

SEQ ID NO: 659601 - DNA, 22 bp, Artificial Sequence
  chemically synthesized
aagttaaaaagtgtctttcaat

SEQ ID NO: 659602 - DNA, 22 bp, Artificial Sequence
  chemically synthesized
aaaagtgtctttcaatagtttt

SEQ ID NO: 659603 - DNA, 22 bp, Artificial Sequence
  chemically synthesized
cgtaataaaataagaagccaaa

SEQ ID NO: 659604 - DNA, 22 bp, Artificial Sequence
  chemically synthesized
ccgtaataaaataagaagccaa

SEQ ID NO: 659605 - DNA, 22 bp, Artificial Sequence
  chemically synthesized
tcaatagttttttggcttctta

SEQ ID NO: 659606 - DNA, 22 bp, Artificial Sequence
  chemically synthesized
tccgtaataaaataagaagcca

SEQ ID NO: 659607 - DNA, 22 bp, Artificial Sequence
  chemically synthesized
caatagttttttggcttcttat

SEQ ID NO: 659608 - DNA, 22 bp, Artificial Sequence
  chemically synthesized
aatagttttttggcttcttatt

SEQ ID NO: 659609 - DNA, 22 bp, Artificial Sequence
  chemically synthesized
tttggcttcttattttattacg

SEQ ID NO: 659610 - DNA, 22 bp, Artificial Sequence
  chemically synthesized
ttggcttcttattttattacgg

SEQ ID NO: 659611 - DNA, 22 bp, Artificial Sequence
  chemically synthesized
tggcttcttattttattacgga

SEQ ID NO: 659612 - DNA, 22 bp, Artificial Sequence
  chemically synthesized
ggcttcttattttattacggaa

SEQ ID NO: 659613 - DNA, 22 bp, Artificial Sequence
  chemically synthesized
gcttcttattttattacggaaa

SEQ ID NO: 659614 - DNA, 22 bp, Artificial Sequence
  chemically synthesized
agggccagtagctttccgtaat

SEQ ID NO: 659615 - DNA, 22 bp, Artificial Sequence
  chemically synthesized
cttattttattacggaaagcta

SEQ ID NO: 659616 - DNA, 22 bp, Artificial Sequence
  chemically synthesized
ttattttattacggaaagctac

SEQ ID NO: 659617 - DNA, 22 bp, Artificial Sequence
  chemically synthesized
attttattacggaaagctactg

SEQ ID NO: 659618 - DNA, 22 bp, Artificial Sequence
  chemically synthesized
ttttattacggaaagctactgg

SEQ ID NO: 659619 - DNA, 22 bp, Artificial Sequence
  chemically synthesized
ccaatatctaagggccagtagc

SEQ ID NO: 659620 - DNA, 22 bp, Artificial Sequence
  chemically synthesized
tattacggaaagctactggccc

SEQ ID NO: 659621 - DNA, 22 bp, Artificial Sequence
  chemically synthesized
accaatatctaagggccagtag

SEQ ID NO: 659622 - DNA, 22 bp, Artificial Sequence
  chemically synthesized
attacggaaagctactggccct

SEQ ID NO: 659623 - DNA, 22 bp, Artificial Sequence
  chemically synthesized
taccaatatctaagggccagta

SEQ ID NO: 659624 - DNA, 22 bp, Artificial Sequence
  chemically synthesized
ttacggaaagctactggccctt

SEQ ID NO: 659625 - DNA, 22 bp, Artificial Sequence
  chemically synthesized
ttaccaatatctaagggccagt

SEQ ID NO: 659626 - DNA, 22 bp, Artificial Sequence
  chemically synthesized
tttaccaatatctaagggccag

SEQ ID NO: 659627 - DNA, 22 bp, Artificial Sequence
  chemically synthesized
cggaaagctactggcccttaga

SEQ ID NO: 659628 - DNA, 22 bp, Artificial Sequence
  chemically synthesized
tttttaccaatatctaagggcc

SEQ ID NO: 659629 - DNA, 22 bp, Artificial Sequence
  chemically synthesized
ctttttaccaatatctaagggc

SEQ ID NO: 659630 - DNA, 22 bp, Artificial Sequence
  chemically synthesized
tctttttaccaatatctaaggg

SEQ ID NO: 659631 - DNA, 22 bp, Artificial Sequence
  chemically synthesized
ttctttttaccaatatctaagg

SEQ ID NO: 659632 - DNA, 22 bp, Artificial Sequence
  chemically synthesized
tttctttttaccaatatctaag

SEQ ID NO: 659633 - DNA, 22 bp, Artificial Sequence
  chemically synthesized
ctttttctttttaccaatatct

SEQ ID NO: 659634 - DNA, 22 bp, Artificial Sequence
  chemically synthesized
tcctttttctttttaccaatat

SEQ ID NO: 659635 - DNA, 22 bp, Artificial Sequence
  chemically synthesized
ctggcccttagatattggtaaa

SEQ ID NO: 659636 - DNA, 22 bp, Artificial Sequence
  chemically synthesized
ctcctttttctttttaccaata

SEQ ID NO: 659637 - DNA, 22 bp, Artificial Sequence
  chemically synthesized
tctcctttttctttttaccaat

SEQ ID NO: 659638 - DNA, 22 bp, Artificial Sequence
  chemically synthesized
gcccttagatattggtaaaaag

SEQ ID NO: 659639 - DNA, 22 bp, Artificial Sequence
  chemically synthesized
agatattggtaaaaagaaaaag

SEQ ID NO: 659640 - DNA, 22 bp, Artificial Sequence
  chemically synthesized
aaatattttctcctttttcttt

SEQ ID NO: 659641 - DNA, 22 bp, Artificial Sequence
  chemically synthesized
gatattggtaaaaagaaaaagg

SEQ ID NO: 659642 - DNA, 22 bp, Artificial Sequence
  chemically synthesized
tgaaatattttctcctttttct

SEQ ID NO: 659643 - DNA, 22 bp, Artificial Sequence
  chemically synthesized
ttctgaaatattttctcctttt

SEQ ID NO: 659644 - DNA, 22 bp, Artificial Sequence
  chemically synthesized
gtaaaaagaaaaaggagaaaat

SEQ ID NO: 659645 - DNA, 22 bp, Artificial Sequence
  chemically synthesized
ataggcgaattattctgaaata

SEQ ID NO: 659646 - DNA, 22 bp, Artificial Sequence
  chemically synthesized
aagtgctaataggcgaattatt

SEQ ID NO: 659647 - DNA, 22 bp, Artificial Sequence
  chemically synthesized
gaagtgctaataggcgaattat

SEQ ID NO: 659648 - DNA, 22 bp, Artificial Sequence
  chemically synthesized
tgaagtgctaataggcgaatta

SEQ ID NO: 659649 - DNA, 22 bp, Artificial Sequence
  chemically synthesized
tgattttgaagtgctaataggc

SEQ ID NO: 659650 - DNA, 22 bp, Artificial Sequence
  chemically synthesized
cagaataattcgcctattagca

SEQ ID NO: 659651 - DNA, 22 bp, Artificial Sequence
  chemically synthesized
gtgattttgaagtgctaatagg

SEQ ID NO: 659652 - DNA, 22 bp, Artificial Sequence
  chemically synthesized
agaataattcgcctattagcac

SEQ ID NO: 659653 - DNA, 22 bp, Artificial Sequence
  chemically synthesized
tgtgattttgaagtgctaatag

SEQ ID NO: 659654 - DNA, 22 bp, Artificial Sequence
  chemically synthesized
tcctttgtgattttgaagtgct

SEQ ID NO: 659655 - DNA, 22 bp, Artificial Sequence
  chemically synthesized
gcctattagcacttcaaaatca

SEQ ID NO: 659656 - DNA, 22 bp, Artificial Sequence
  chemically synthesized
ggacctatcctttgtgattttg

SEQ ID NO: 659657 - DNA, 22 bp, Artificial Sequence
  chemically synthesized
ttagcacttcaaaatcacaaag

SEQ ID NO: 659658 - DNA, 22 bp, Artificial Sequence
  chemically synthesized
gcacttcaaaatcacaaaggat

SEQ ID NO: 659659 - DNA, 22 bp, Artificial Sequence
  chemically synthesized
caaaatcacaaaggataggtcc

SEQ ID NO: 659660 - DNA, 22 bp, Artificial Sequence
  chemically synthesized
aaaatcacaaaggataggtccc

SEQ ID NO: 659661 - DNA, 22 bp, Artificial Sequence
  chemically synthesized
accgaaaataaccgccattggg

SEQ ID NO: 659662 - DNA, 22 bp, Artificial Sequence
  chemically synthesized
ttcaccgaaaataaccgccatt

SEQ ID NO: 659663 - DNA, 22 bp, Artificial Sequence
  chemically synthesized
agcatattgttcaccgaaaata

SEQ ID NO: 659664 - DNA, 22 bp, Artificial Sequence
  chemically synthesized
gaagttgagcatattgttcacc

SEQ ID NO: 659665 - DNA, 22 bp, Artificial Sequence
  chemically synthesized
ttttcggtgaacaatatgctca

SEQ ID NO: 659666 - DNA, 22 bp, Artificial Sequence
  chemically synthesized
gtagctggaagttgagcatatt

SEQ ID NO: 659667 - DNA, 22 bp, Artificial Sequence
  chemically synthesized
agtagctggaagttgagcatat

SEQ ID NO: 659668 - DNA, 22 bp, Artificial Sequence
  chemically synthesized
tagtagctggaagttgagcata

SEQ ID NO: 659669 - DNA, 22 bp, Artificial Sequence
  chemically synthesized
tcggtgaacaatatgctcaact

SEQ ID NO: 659670 - DNA, 22 bp, Artificial Sequence
  chemically synthesized
cggtgaacaatatgctcaactt

SEQ ID NO: 659671 - DNA, 22 bp, Artificial Sequence
  chemically synthesized
ggtgaacaatatgctcaacttc

SEQ ID NO: 659672 - DNA, 22 bp, Artificial Sequence
  chemically synthesized
ataaattttagtagctggaagt

SEQ ID NO: 659673 - DNA, 22 bp, Artificial Sequence
  chemically synthesized
aataaattttagtagctggaag

SEQ ID NO: 659674 - DNA, 22 bp, Artificial Sequence
  chemically synthesized
agggatttaataaattttagta

SEQ ID NO: 659675 - DNA, 22 bp, Artificial Sequence
  chemically synthesized
aacttccagctactaaaattta

SEQ ID NO: 659676 - DNA, 22 bp, Artificial Sequence
  chemically synthesized
actgagggatttaataaatttt

SEQ ID NO: 659677 - DNA, 22 bp, Artificial Sequence
  chemically synthesized
gactgagggatttaataaattt

SEQ ID NO: 659678 - DNA, 22 bp, Artificial Sequence
  chemically synthesized
tgactgagggatttaataaatt

SEQ ID NO: 659679 - DNA, 22 bp, Artificial Sequence
  chemically synthesized
ccagctactaaaatttattaaa

SEQ ID NO: 659680 - DNA, 22 bp, Artificial Sequence
  chemically synthesized
ttgactgagggatttaataaat

SEQ ID NO: 659681 - DNA, 22 bp, Artificial Sequence
  chemically synthesized
cagctactaaaatttattaaat

SEQ ID NO: 659682 - DNA, 22 bp, Artificial Sequence
  chemically synthesized
tttgactgagggatttaataaa

SEQ ID NO: 659683 - DNA, 22 bp, Artificial Sequence
  chemically synthesized
tttttgactgagggatttaata

SEQ ID NO: 659684 - DNA, 22 bp, Artificial Sequence
  chemically synthesized
ctttttgactgagggatttaat

SEQ ID NO: 659685 - DNA, 22 bp, Artificial Sequence
  chemically synthesized
ctaaaatttattaaatccctca

SEQ ID NO: 659686 - DNA, 22 bp, Artificial Sequence
  chemically synthesized
aaatttattaaatccctcagtc

SEQ ID NO: 659687 - DNA, 22 bp, Artificial Sequence
  chemically synthesized
attaaatccctcagtcaaaaag

SEQ ID NO: 659688 - DNA, 22 bp, Artificial Sequence
  chemically synthesized
ttaaatccctcagtcaaaaaga

SEQ ID NO: 659689 - DNA, 22 bp, Artificial Sequence
  chemically synthesized
gtgcccaggatttctttttgac

SEQ ID NO: 659690 - DNA, 22 bp, Artificial Sequence
  chemically synthesized
aatccctcagtcaaaaagaaat

SEQ ID NO: 659691 - DNA, 22 bp, Artificial Sequence
  chemically synthesized
gtccattagtgcccaggatttc

SEQ ID NO: 659692 - DNA, 22 bp, Artificial Sequence
  chemically synthesized
agtccattagtgcccaggattt

SEQ ID NO: 659693 - DNA, 22 bp, Artificial Sequence
  chemically synthesized
agtcaaaaagaaatcctgggca

SEQ ID NO: 659694 - DNA, 22 bp, Artificial Sequence
  chemically synthesized
tttagtccattagtgcccagga

SEQ ID NO: 659695 - DNA, 22 bp, Artificial Sequence
  chemically synthesized
gtttagtccattagtgcccagg

SEQ ID NO: 659696 - DNA, 22 bp, Artificial Sequence
  chemically synthesized
cagtgataggaatttgtttagt

SEQ ID NO: 659697 - DNA, 22 bp, Artificial Sequence
  chemically synthesized
ggcactaatggactaaacaaat

SEQ ID NO: 659698 - DNA, 22 bp, Artificial Sequence
  chemically synthesized
ccagtgataggaatttgtttag

SEQ ID NO: 659699 - DNA, 22 bp, Artificial Sequence
  chemically synthesized
tccagtgataggaatttgttta

SEQ ID NO: 659700 - DNA, 22 bp, Artificial Sequence
  chemically synthesized
atggactaaacaaattcctatc

SEQ ID NO: 659701 - DNA, 22 bp, Artificial Sequence
  chemically synthesized
aacaaattcctatcactggaaa

SEQ ID NO: 659702 - DNA, 22 bp, Artificial Sequence
  chemically synthesized
ctatcactggaaaattttctta

SEQ ID NO: 659703 - DNA, 22 bp, Artificial Sequence
  chemically synthesized
agagggagaaagataagaaaat

SEQ ID NO: 659704 - DNA, 22 bp, Artificial Sequence
  chemically synthesized
aagagggagaaagataagaaaa

SEQ ID NO: 659705 - DNA, 22 bp, Artificial Sequence
  chemically synthesized
tcactggaaaattttcttatct

SEQ ID NO: 659706 - DNA, 22 bp, Artificial Sequence
  chemically synthesized
ttaagagggagaaagataagaa

SEQ ID NO: 659707 - DNA, 22 bp, Artificial Sequence
  chemically synthesized
cttaagagggagaaagataaga

SEQ ID NO: 659708 - DNA, 22 bp, Artificial Sequence
  chemically synthesized
tcttaagagggagaaagataag

SEQ ID NO: 659709 - DNA, 22 bp, Artificial Sequence
  chemically synthesized
ttcttaagagggagaaagataa

SEQ ID NO: 659710 - DNA, 22 bp, Artificial Sequence
  chemically synthesized
gaaaattttcttatctttctcc

SEQ ID NO: 659711 - DNA, 22 bp, Artificial Sequence
  chemically synthesized
ccttttcttaagagggagaaag

SEQ ID NO: 659712 - DNA, 22 bp, Artificial Sequence
  chemically synthesized
atctaccttttcttaagaggga

SEQ ID NO: 659713 - DNA, 22 bp, Artificial Sequence
  chemically synthesized
tcttatctttctccctcttaag

SEQ ID NO: 659714 - DNA, 22 bp, Artificial Sequence
  chemically synthesized
gatctaccttttcttaagaggg

SEQ ID NO: 659715 - DNA, 22 bp, Artificial Sequence
  chemically synthesized
cttatctttctccctcttaaga

SEQ ID NO: 659716 - DNA, 22 bp, Artificial Sequence
  chemically synthesized
tgatctaccttttcttaagagg

SEQ ID NO: 659717 - DNA, 22 bp, Artificial Sequence
  chemically synthesized
ttatctttctccctcttaagaa

SEQ ID NO: 659718 - DNA, 22 bp, Artificial Sequence
  chemically synthesized
atctttctccctcttaagaaaa

SEQ ID NO: 659719 - DNA, 22 bp, Artificial Sequence
  chemically synthesized
tctttctccctcttaagaaaag

SEQ ID NO: 659720 - DNA, 22 bp, Artificial Sequence
  chemically synthesized
aattttgatctaccttttctta

SEQ ID NO: 659721 - DNA, 22 bp, Artificial Sequence
  chemically synthesized
tctccctcttaagaaaaggtag

SEQ ID NO: 659722 - DNA, 22 bp, Artificial Sequence
  chemically synthesized
ttaaattttgatctaccttttc

SEQ ID NO: 659723 - DNA, 22 bp, Artificial Sequence
  chemically synthesized
ctccctcttaagaaaaggtaga

SEQ ID NO: 659724 - DNA, 22 bp, Artificial Sequence
  chemically synthesized
gttaaattttgatctacctttt

SEQ ID NO: 659725 - DNA, 22 bp, Artificial Sequence
  chemically synthesized
tccctcttaagaaaaggtagat

SEQ ID NO: 659726 - DNA, 22 bp, Artificial Sequence
  chemically synthesized
cctcttaagaaaaggtagatca

SEQ ID NO: 659727 - DNA, 22 bp, Artificial Sequence
  chemically synthesized
ttaagaaaaggtagatcaaaat

SEQ ID NO: 659728 - DNA, 22 bp, Artificial Sequence
  chemically synthesized
aagaaaaggtagatcaaaattt

SEQ ID NO: 659729 - DNA, 22 bp, Artificial Sequence
  chemically synthesized
agaaaaggtagatcaaaattta

SEQ ID NO: 659730 - DNA, 22 bp, Artificial Sequence
  chemically synthesized
tataaagtggatttgttaaatt

SEQ ID NO: 659731 - DNA, 22 bp, Artificial Sequence
  chemically synthesized
ctgtataaagtggatttgttaa

SEQ ID NO: 659732 - DNA, 22 bp, Artificial Sequence
  chemically synthesized
agttgctgtataaagtggattt

SEQ ID NO: 659733 - DNA, 22 bp, Artificial Sequence
  chemically synthesized
aagacctgagttgctgtataaa

SEQ ID NO: 659734 - DNA, 22 bp, Artificial Sequence
  chemically synthesized
aacaaatccactttatacagca

SEQ ID NO: 659735 - DNA, 22 bp, Artificial Sequence
  chemically synthesized
gaagacctgagttgctgtataa

SEQ ID NO: 659736 - DNA, 22 bp, Artificial Sequence
  chemically synthesized
acaaatccactttatacagcaa

SEQ ID NO: 659737 - DNA, 22 bp, Artificial Sequence
  chemically synthesized
cttgaagacctgagttgctgta

SEQ ID NO: 659738 - DNA, 22 bp, Artificial Sequence
  chemically synthesized
actccttgaagacctgagttgc

SEQ ID NO: 659739 - DNA, 22 bp, Artificial Sequence
  chemically synthesized
aactccttgaagacctgagttg

SEQ ID NO: 659740 - DNA, 22 bp, Artificial Sequence
  chemically synthesized
taactccttgaagacctgagtt

SEQ ID NO: 659741 - DNA, 22 bp, Artificial Sequence
  chemically synthesized
tatacagcaactcaggtcttca

SEQ ID NO: 659742 - DNA, 22 bp, Artificial Sequence
  chemically synthesized
atacagcaactcaggtcttcaa

SEQ ID NO: 659743 - DNA, 22 bp, Artificial Sequence
  chemically synthesized
tacagcaactcaggtcttcaag

SEQ ID NO: 659744 - DNA, 22 bp, Artificial Sequence
  chemically synthesized
gtgacaattttaactccttgaa

SEQ ID NO: 659745 - DNA, 22 bp, Artificial Sequence
  chemically synthesized
ggtgacaattttaactccttga

SEQ ID NO: 659746 - DNA, 22 bp, Artificial Sequence
  chemically synthesized
aggtcttcaaggagttaaaatt

SEQ ID NO: 659747 - DNA, 22 bp, Artificial Sequence
  chemically synthesized
aaaagtatttggtgacaatttt

SEQ ID NO: 659748 - DNA, 22 bp, Artificial Sequence
  chemically synthesized
caaggagttaaaattgtcacca

SEQ ID NO: 659749 - DNA, 22 bp, Artificial Sequence
  chemically synthesized
aaggagttaaaattgtcaccaa

SEQ ID NO: 659750 - DNA, 22 bp, Artificial Sequence
  chemically synthesized
actgaaaagtatttggtgacaa

SEQ ID NO: 659751 - DNA, 22 bp, Artificial Sequence
  chemically synthesized
cctgactgaaaagtatttggtg

SEQ ID NO: 659752 - DNA, 22 bp, Artificial Sequence
  chemically synthesized
tacctgactgaaaagtatttgg

SEQ ID NO: 659753 - DNA, 22 bp, Artificial Sequence
  chemically synthesized
ctacctgactgaaaagtatttg

SEQ ID NO: 659754 - DNA, 22 bp, Artificial Sequence
  chemically synthesized
aaattgtcaccaaatacttttc

SEQ ID NO: 659755 - DNA, 22 bp, Artificial Sequence
  chemically synthesized
cttctacctgactgaaaagtat

SEQ ID NO: 659756 - DNA, 22 bp, Artificial Sequence
  chemically synthesized
ccttctacctgactgaaaagta

SEQ ID NO: 659757 - DNA, 22 bp, Artificial Sequence
  chemically synthesized
tcaccaaatacttttcagtcag

SEQ ID NO: 659758 - DNA, 22 bp, Artificial Sequence
  chemically synthesized
aatgtataacttccttctacct

SEQ ID NO: 659759 - DNA, 22 bp, Artificial Sequence
  chemically synthesized
tgaatgtataacttccttctac

SEQ ID NO: 659760 - DNA, 22 bp, Artificial Sequence
  chemically synthesized
ttcagtcaggtagaaggaagtt

SEQ ID NO: 659761 - DNA, 22 bp, Artificial Sequence
  chemically synthesized
tcagtcaggtagaaggaagtta

SEQ ID NO: 659762 - DNA, 22 bp, Artificial Sequence
  chemically synthesized
cagtcaggtagaaggaagttat

SEQ ID NO: 659763 - DNA, 22 bp, Artificial Sequence
  chemically synthesized
agtcaggtagaaggaagttata

SEQ ID NO: 659764 - DNA, 22 bp, Artificial Sequence
  chemically synthesized
cagatgacatgtgaatgcattc

SEQ ID NO: 659765 - DNA, 22 bp, Artificial Sequence
  chemically synthesized
gcagatgacatgtgaatgcatt

SEQ ID NO: 659766 - DNA, 22 bp, Artificial Sequence
  chemically synthesized
tgcagatgacatgtgaatgcat

SEQ ID NO: 659767 - DNA, 22 bp, Artificial Sequence
  chemically synthesized
tacattcagaatgcattcacat

SEQ ID NO: 659768 - DNA, 22 bp, Artificial Sequence
  chemically synthesized
tttgcagatgacatgtgaatgc

SEQ ID NO: 659769 - DNA, 22 bp, Artificial Sequence
  chemically synthesized
ctttgcagatgacatgtgaatg

SEQ ID NO: 659770 - DNA, 22 bp, Artificial Sequence
  chemically synthesized
tctttgcagatgacatgtgaat

SEQ ID NO: 659771 - DNA, 22 bp, Artificial Sequence
  chemically synthesized
ttttctttgcagatgacatgtg

SEQ ID NO: 659772 - DNA, 22 bp, Artificial Sequence
  chemically synthesized
agaatgcattcacatgtcatct

SEQ ID NO: 659773 - DNA, 22 bp, Artificial Sequence
  chemically synthesized
gcactgttttctttgcagatga

SEQ ID NO: 659774 - DNA, 22 bp, Artificial Sequence
  chemically synthesized
ggcactgttttctttgcagatg

SEQ ID NO: 659775 - DNA, 22 bp, Artificial Sequence
  chemically synthesized
tggcactgttttctttgcagat

SEQ ID NO: 659776 - DNA, 22 bp, Artificial Sequence
  chemically synthesized
acatgtcatctgcaaagaaaac

SEQ ID NO: 659777 - DNA, 22 bp, Artificial Sequence
  chemically synthesized
aaatatattttggcactgtttt

SEQ ID NO: 659778 - DNA, 22 bp, Artificial Sequence
  chemically synthesized
ccctcaaatatattttggcact

SEQ ID NO: 659779 - DNA, 22 bp, Artificial Sequence
  chemically synthesized
cccctcaaatatattttggcac

SEQ ID NO: 659780 - DNA, 22 bp, Artificial Sequence
  chemically synthesized
caaagaaaacagtgccaaaata

SEQ ID NO: 659781 - DNA, 22 bp, Artificial Sequence
  chemically synthesized
aggtttcccctcaaatatattt

SEQ ID NO: 659782 - DNA, 22 bp, Artificial Sequence
  chemically synthesized
tattcaggtttcccctcaaata

SEQ ID NO: 659783 - DNA, 22 bp, Artificial Sequence
  chemically synthesized
gtattcaggtttcccctcaaat

SEQ ID NO: 659784 - DNA, 22 bp, Artificial Sequence
  chemically synthesized
ataagagtttgtattcaggttt

SEQ ID NO: 659785 - DNA, 22 bp, Artificial Sequence
  chemically synthesized
gataagagtttgtattcaggtt

SEQ ID NO: 659786 - DNA, 22 bp, Artificial Sequence
  chemically synthesized
tgataagagtttgtattcaggt

SEQ ID NO: 659787 - DNA, 22 bp, Artificial Sequence
  chemically synthesized
gaggggaaacctgaatacaaac

SEQ ID NO: 659788 - DNA, 22 bp, Artificial Sequence
  chemically synthesized
gttttgataagagtttgtattc

SEQ ID NO: 659789 - DNA, 22 bp, Artificial Sequence
  chemically synthesized
aggggaaacctgaatacaaact

SEQ ID NO: 659790 - DNA, 22 bp, Artificial Sequence
  chemically synthesized
acattagttttgataagagttt

SEQ ID NO: 659791 - DNA, 22 bp, Artificial Sequence
  chemically synthesized
cgttcacattagttttgataag

SEQ ID NO: 659792 - DNA, 22 bp, Artificial Sequence
  chemically synthesized
aatacaaactcttatcaaaact

SEQ ID NO: 659793 - DNA, 22 bp, Artificial Sequence
  chemically synthesized
tgaactacgttcacattagttt

SEQ ID NO: 659794 - DNA, 22 bp, Artificial Sequence
  chemically synthesized
aattgtgaactacgttcacatt

SEQ ID NO: 659795 - DNA, 22 bp, Artificial Sequence
  chemically synthesized
ttatcaaaactaatgtgaacgt

SEQ ID NO: 659796 - DNA, 22 bp, Artificial Sequence
  chemically synthesized
caattgtgaactacgttcacat

SEQ ID NO: 659797 - DNA, 22 bp, Artificial Sequence
  chemically synthesized
atcaaaactaatgtgaacgtag

SEQ ID NO: 659798 - DNA, 22 bp, Artificial Sequence
  chemically synthesized
tcaaaactaatgtgaacgtagt

SEQ ID NO: 659799 - DNA, 22 bp, Artificial Sequence
  chemically synthesized
atgtgaacgtagttcacaattg

SEQ ID NO: 659800 - DNA, 22 bp, Artificial Sequence
  chemically synthesized
aacatgtcggatttcaattgtg

SEQ ID NO: 659801 - DNA, 22 bp, Artificial Sequence
  chemically synthesized
gaacatgtcggatttcaattgt

SEQ ID NO: 659802 - DNA, 22 bp, Artificial Sequence
  chemically synthesized
ccaagtccttgaacatgtcgga

SEQ ID NO: 659803 - DNA, 22 bp, Artificial Sequence
  chemically synthesized
acaattgaaatccgacatgttc

SEQ ID NO: 659804 - DNA, 22 bp, Artificial Sequence
  chemically synthesized
aaatccgacatgttcaaggact

SEQ ID NO: 659805 - DNA, 22 bp, Artificial Sequence
  chemically synthesized
atcatagtcatctaccaagtcc

SEQ ID NO: 659806 - DNA, 22 bp, Artificial Sequence
  chemically synthesized
cattcatcatagtcatctacca

SEQ ID NO: 659807 - DNA, 22 bp, Artificial Sequence
  chemically synthesized
ttacattcatcatagtcatcta

SEQ ID NO: 659808 - DNA, 22 bp, Artificial Sequence
  chemically synthesized
aaggacttggtagatgactatg

SEQ ID NO: 659809 - DNA, 22 bp, Artificial Sequence
  chemically synthesized
actattacattcatcatagtca

SEQ ID NO: 659810 - DNA, 22 bp, Artificial Sequence
  chemically synthesized
ggtagatgactatgatgaatgt

SEQ ID NO: 659811 - DNA, 22 bp, Artificial Sequence
  chemically synthesized
gtagatgactatgatgaatgta

SEQ ID NO: 659812 - DNA, 22 bp, Artificial Sequence
  chemically synthesized
aggaccacctgactattacatt

SEQ ID NO: 659813 - DNA, 22 bp, Artificial Sequence
  chemically synthesized
caggaccacctgactattacat

SEQ ID NO: 659814 - DNA, 22 bp, Artificial Sequence
  chemically synthesized
tgatgaatgtaatagtcaggtg

SEQ ID NO: 659815 - DNA, 22 bp, Artificial Sequence
  chemically synthesized
aaatttcaggaccacctgacta

SEQ ID NO: 659816 - DNA, 22 bp, Artificial Sequence
  chemically synthesized
aaaatttcaggaccacctgact

SEQ ID NO: 659817 - DNA, 22 bp, Artificial Sequence
  chemically synthesized
taaaatttcaggaccacctgac

SEQ ID NO: 659818 - DNA, 22 bp, Artificial Sequence
  chemically synthesized
ttaaaatttcaggaccacctga

SEQ ID NO: 659819 - DNA, 22 bp, Artificial Sequence
  chemically synthesized
tttaaaatttcaggaccacctg

SEQ ID NO: 659820 - DNA, 22 bp, Artificial Sequence
  chemically synthesized
ctttttaaaatttcaggaccac

SEQ ID NO: 659821 - DNA, 22 bp, Artificial Sequence
  chemically synthesized
ataaggtattgctttttaaaat

SEQ ID NO: 659822 - DNA, 22 bp, Artificial Sequence
  chemically synthesized
gataaggtattgctttttaaaa

SEQ ID NO: 659823 - DNA, 22 bp, Artificial Sequence
  chemically synthesized
tgataaggtattgctttttaaa

SEQ ID NO: 659824 - DNA, 22 bp, Artificial Sequence
  chemically synthesized
ttttgataaggtattgcttttt

SEQ ID NO: 659825 - DNA, 22 bp, Artificial Sequence
  chemically synthesized
attttgataaggtattgctttt

SEQ ID NO: 659826 - DNA, 22 bp, Artificial Sequence
  chemically synthesized
ttattttgataaggtattgctt

SEQ ID NO: 659827 - DNA, 22 bp, Artificial Sequence
  chemically synthesized
cttattttgataaggtattgct

SEQ ID NO: 659828 - DNA, 22 bp, Artificial Sequence
  chemically synthesized
aaattttaaaaagcaatacctt

SEQ ID NO: 659829 - DNA, 22 bp, Artificial Sequence
  chemically synthesized
tcttattttgataaggtattgc

SEQ ID NO: 659830 - DNA, 22 bp, Artificial Sequence
  chemically synthesized
tttcttattttgataaggtatt

SEQ ID NO: 659831 - DNA, 22 bp, Artificial Sequence
  chemically synthesized
ctttcttattttgataaggtat

SEQ ID NO: 659832 - DNA, 22 bp, Artificial Sequence
  chemically synthesized
tctttcttattttgataaggta

SEQ ID NO: 659833 - DNA, 22 bp, Artificial Sequence
  chemically synthesized
ttctttcttattttgataaggt

SEQ ID NO: 659834 - DNA, 22 bp, Artificial Sequence
  chemically synthesized
taaaaagcaataccttatcaaa

SEQ ID NO: 659835 - DNA, 22 bp, Artificial Sequence
  chemically synthesized
tttctttcttattttgataagg

SEQ ID NO: 659836 - DNA, 22 bp, Artificial Sequence
  chemically synthesized
aaaaagcaataccttatcaaaa

SEQ ID NO: 659837 - DNA, 22 bp, Artificial Sequence
  chemically synthesized
ttttctttcttattttgataag

SEQ ID NO: 659838 - DNA, 22 bp, Artificial Sequence
  chemically synthesized
aaaagcaataccttatcaaaat

SEQ ID NO: 659839 - DNA, 22 bp, Artificial Sequence
  chemically synthesized
tttttctttcttattttgataa

SEQ ID NO: 659840 - DNA, 22 bp, Artificial Sequence
  chemically synthesized
tacctttttttctttcttattt

SEQ ID NO: 659841 - DNA, 22 bp, Artificial Sequence
  chemically synthesized
atacctttttttctttcttatt

SEQ ID NO: 659842 - DNA, 22 bp, Artificial Sequence
  chemically synthesized
aaatttatacctttttttcttt

SEQ ID NO: 659843 - DNA, 22 bp, Artificial Sequence
  chemically synthesized
atcaaaataagaaagaaaaaaa

SEQ ID NO: 659844 - DNA, 22 bp, Artificial Sequence
  chemically synthesized
tcaaaataagaaagaaaaaaag

SEQ ID NO: 659845 - DNA, 22 bp, Artificial Sequence
  chemically synthesized
aactaaaatttatacctttttt

SEQ ID NO: 659846 - DNA, 22 bp, Artificial Sequence
  chemically synthesized
gaactaaaatttataccttttt

SEQ ID NO: 659847 - DNA, 22 bp, Artificial Sequence
  chemically synthesized
tgaactaaaatttatacctttt

SEQ ID NO: 659848 - DNA, 22 bp, Artificial Sequence
  chemically synthesized
ttgaactaaaatttataccttt

SEQ ID NO: 659849 - DNA, 22 bp, Artificial Sequence
  chemically synthesized
ccttttgaactaaaatttatac

SEQ ID NO: 659850 - DNA, 22 bp, Artificial Sequence
  chemically synthesized
ctaccttttgaactaaaattta

SEQ ID NO: 659851 - DNA, 22 bp, Artificial Sequence
  chemically synthesized
tactaccttttgaactaaaatt

SEQ ID NO: 659852 - DNA, 22 bp, Artificial Sequence
  chemically synthesized
ctactaccttttgaactaaaat

SEQ ID NO: 659853 - DNA, 22 bp, Artificial Sequence
  chemically synthesized
tagacttctactaccttttgaa

SEQ ID NO: 659854 - DNA, 22 bp, Artificial Sequence
  chemically synthesized
ttgtagacttctactacctttt

SEQ ID NO: 659855 - DNA, 22 bp, Artificial Sequence
  chemically synthesized
gttgtagacttctactaccttt

SEQ ID NO: 659856 - DNA, 22 bp, Artificial Sequence
  chemically synthesized
tgttgtagacttctactacctt

SEQ ID NO: 659857 - DNA, 22 bp, Artificial Sequence
  chemically synthesized
tagttcaaaaggtagtagaagt

SEQ ID NO: 659858 - DNA, 22 bp, Artificial Sequence
  chemically synthesized
cctttgttgtagacttctacta

SEQ ID NO: 659859 - DNA, 22 bp, Artificial Sequence
  chemically synthesized
agttcaaaaggtagtagaagtc

SEQ ID NO: 659860 - DNA, 22 bp, Artificial Sequence
  chemically synthesized
acctttgttgtagacttctact

SEQ ID NO: 659861 - DNA, 22 bp, Artificial Sequence
  chemically synthesized
gttcaaaaggtagtagaagtct

SEQ ID NO: 659862 - DNA, 22 bp, Artificial Sequence
  chemically synthesized
tacctttgttgtagacttctac

SEQ ID NO: 659863 - DNA, 22 bp, Artificial Sequence
  chemically synthesized
ttacctttgttgtagacttcta

SEQ ID NO: 659864 - DNA, 22 bp, Artificial Sequence
  chemically synthesized
aaaaggtagtagaagtctacaa

SEQ ID NO: 659865 - DNA, 22 bp, Artificial Sequence
  chemically synthesized
ccttttacctttgttgtagact

SEQ ID NO: 659866 - DNA, 22 bp, Artificial Sequence
  chemically synthesized
gccttttacctttgttgtagac

SEQ ID NO: 659867 - DNA, 22 bp, Artificial Sequence
  chemically synthesized
tgccttttacctttgttgtaga

SEQ ID NO: 659868 - DNA, 22 bp, Artificial Sequence
  chemically synthesized
ttttgccttttacctttgttgt

SEQ ID NO: 659869 - DNA, 22 bp, Artificial Sequence
  chemically synthesized
caaaacaactgttttgcctttt

SEQ ID NO: 659870 - DNA, 22 bp, Artificial Sequence
  chemically synthesized
caacaaaggtaaaaggcaaaac

SEQ ID NO: 659871 - DNA, 22 bp, Artificial Sequence
  chemically synthesized
aaaagagttgcaaaacaactgt

SEQ ID NO: 659872 - DNA, 22 bp, Artificial Sequence
  chemically synthesized
tgaaaagagttgcaaaacaact

SEQ ID NO: 659873 - DNA, 22 bp, Artificial Sequence
  chemically synthesized
ctgaaaagagttgcaaaacaac

SEQ ID NO: 659874 - DNA, 22 bp, Artificial Sequence
  chemically synthesized
tctgaaaagagttgcaaaacaa

SEQ ID NO: 659875 - DNA, 22 bp, Artificial Sequence
  chemically synthesized
ggaaggttttctgaaaagagtt

SEQ ID NO: 659876 - DNA, 22 bp, Artificial Sequence
  chemically synthesized
ttttgcaactcttttcagaaaa

SEQ ID NO: 659877 - DNA, 22 bp, Artificial Sequence
  chemically synthesized
gaaatctgggaaggttttctga

SEQ ID NO: 659878 - DNA, 22 bp, Artificial Sequence
  chemically synthesized
tgcaactcttttcagaaaacct

SEQ ID NO: 659879 - DNA, 22 bp, Artificial Sequence
  chemically synthesized
ggaaatctgggaaggttttctg

SEQ ID NO: 659880 - DNA, 22 bp, Artificial Sequence
  chemically synthesized
gcaactcttttcagaaaacctt

SEQ ID NO: 659881 - DNA, 22 bp, Artificial Sequence
  chemically synthesized
caactcttttcagaaaaccttc

SEQ ID NO: 659882 - DNA, 22 bp, Artificial Sequence
  chemically synthesized
ccatttggaaatctgggaaggt

SEQ ID NO: 659883 - DNA, 22 bp, Artificial Sequence
  chemically synthesized
ttttcagaaaaccttcccagat

SEQ ID NO: 659884 - DNA, 22 bp, Artificial Sequence
  chemically synthesized
ttcagaaaaccttcccagattt

SEQ ID NO: 659885 - DNA, 22 bp, Artificial Sequence
  chemically synthesized
tcagaaaaccttcccagatttc

SEQ ID NO: 659886 - DNA, 22 bp, Artificial Sequence
  chemically synthesized
cagaaaaccttcccagatttcc

SEQ ID NO: 659887 - DNA, 22 bp, Artificial Sequence
  chemically synthesized
agaaaaccttcccagatttcca

SEQ ID NO: 659888 - DNA, 22 bp, Artificial Sequence
  chemically synthesized
cccagatttccaaatgggagta

SEQ ID NO: 659889 - DNA, 22 bp, Artificial Sequence
  chemically synthesized
ccagatttccaaatgggagtat

SEQ ID NO: 659890 - DNA, 22 bp, Artificial Sequence
  chemically synthesized
accaatcaagaacatactccca

SEQ ID NO: 659891 - DNA, 22 bp, Artificial Sequence
  chemically synthesized
caccaatcaagaacatactccc

SEQ ID NO: 659892 - DNA, 22 bp, Artificial Sequence
  chemically synthesized
atttcaccaatcaagaacatac

SEQ ID NO: 659893 - DNA, 22 bp, Artificial Sequence
  chemically synthesized
ccaaatgggagtatgttcttga

SEQ ID NO: 659894 - DNA, 22 bp, Artificial Sequence
  chemically synthesized
caaatgggagtatgttcttgat

SEQ ID NO: 659895 - DNA, 22 bp, Artificial Sequence
  chemically synthesized
catgcctcatttcaccaatcaa

SEQ ID NO: 659896 - DNA, 22 bp, Artificial Sequence
  chemically synthesized
ttacatgcctcatttcaccaat

SEQ ID NO: 659897 - DNA, 22 bp, Artificial Sequence
  chemically synthesized
aaaattattacatgcctcattt

SEQ ID NO: 659898 - DNA, 22 bp, Artificial Sequence
  chemically synthesized
ttgattggtgaaatgaggcatg

SEQ ID NO: 659899 - DNA, 22 bp, Artificial Sequence
  chemically synthesized
gattggtgaaatgaggcatgta

SEQ ID NO: 659900 - DNA, 22 bp, Artificial Sequence
  chemically synthesized
attggtgaaatgaggcatgtaa

SEQ ID NO: 659901 - DNA, 22 bp, Artificial Sequence
  chemically synthesized
gatctcaaaattattacatgcc

SEQ ID NO: 659902 - DNA, 22 bp, Artificial Sequence
  chemically synthesized
agatctcaaaattattacatgc

SEQ ID NO: 659903 - DNA, 22 bp, Artificial Sequence
  chemically synthesized
gtgaaatgaggcatgtaataat

SEQ ID NO: 659904 - DNA, 22 bp, Artificial Sequence
  chemically synthesized
ttagatctcaaaattattacat

SEQ ID NO: 659905 - DNA, 22 bp, Artificial Sequence
  chemically synthesized
cttagatctcaaaattattaca

SEQ ID NO: 659906 - DNA, 22 bp, Artificial Sequence
  chemically synthesized
ttcttagatctcaaaattatta

SEQ ID NO: 659907 - DNA, 22 bp, Artificial Sequence
  chemically synthesized
aattcttcttagatctcaaaat

SEQ ID NO: 659908 - DNA, 22 bp, Artificial Sequence
  chemically synthesized
cctaaattcttcttagatctca

SEQ ID NO: 659909 - DNA, 22 bp, Artificial Sequence
  chemically synthesized
gcctaaattcttcttagatctc

SEQ ID NO: 659910 - DNA, 22 bp, Artificial Sequence
  chemically synthesized
tgcctaaattcttcttagatct

SEQ ID NO: 659911 - DNA, 22 bp, Artificial Sequence
  chemically synthesized
attttgcctaaattcttcttag

SEQ ID NO: 659912 - DNA, 22 bp, Artificial Sequence
  chemically synthesized
aattttgcctaaattcttctta

SEQ ID NO: 659913 - DNA, 22 bp, Artificial Sequence
  chemically synthesized
tgagatctaagaagaatttagg

SEQ ID NO: 659914 - DNA, 22 bp, Artificial Sequence
  chemically synthesized
gtcttaattttgcctaaattct

SEQ ID NO: 659915 - DNA, 22 bp, Artificial Sequence
  chemically synthesized
gagatctaagaagaatttaggc

SEQ ID NO: 659916 - DNA, 22 bp, Artificial Sequence
  chemically synthesized
agatctaagaagaatttaggca

SEQ ID NO: 659917 - DNA, 22 bp, Artificial Sequence
  chemically synthesized
agaagaatttaggcaaaattaa

SEQ ID NO: 659918 - DNA, 22 bp, Artificial Sequence
  chemically synthesized
aggcaaaattaagaccaattcc

SEQ ID NO: 659919 - DNA, 22 bp, Artificial Sequence
  chemically synthesized
ggcaaaattaagaccaattcct

SEQ ID NO: 659920 - DNA, 22 bp, Artificial Sequence
  chemically synthesized
aagaagggagcagaaggaattg

SEQ ID NO: 659921 - DNA, 22 bp, Artificial Sequence
  chemically synthesized
agaccaattccttctgctccct

SEQ ID NO: 659922 - DNA, 22 bp, Artificial Sequence
  chemically synthesized
atgaagacaattgaagaaggga

SEQ ID NO: 659923 - DNA, 22 bp, Artificial Sequence
  chemically synthesized
aatgaagacaattgaagaaggg

SEQ ID NO: 659924 - DNA, 22 bp, Artificial Sequence
  chemically synthesized
cttctgctcccttcttcaattg

SEQ ID NO: 659925 - DNA, 22 bp, Artificial Sequence
  chemically synthesized
agcttaatgaagacaattgaag

SEQ ID NO: 659926 - DNA, 22 bp, Artificial Sequence
  chemically synthesized
gagcttaatgaagacaattgaa

SEQ ID NO: 659927 - DNA, 22 bp, Artificial Sequence
  chemically synthesized
ctgctcccttcttcaattgtct

SEQ ID NO: 659928 - DNA, 22 bp, Artificial Sequence
  chemically synthesized
tgctcccttcttcaattgtctt

SEQ ID NO: 659929 - DNA, 22 bp, Artificial Sequence
  chemically synthesized
ttgagcttaatgaagacaattg

SEQ ID NO: 659930 - DNA, 22 bp, Artificial Sequence
  chemically synthesized
cttgagcttaatgaagacaatt

SEQ ID NO: 659931 - DNA, 22 bp, Artificial Sequence
  chemically synthesized
ctcccttcttcaattgtcttca

SEQ ID NO: 659932 - DNA, 22 bp, Artificial Sequence
  chemically synthesized
tcttgagcttaatgaagacaat

SEQ ID NO: 659933 - DNA, 22 bp, Artificial Sequence
  chemically synthesized
ttcttgagcttaatgaagacaa

SEQ ID NO: 659934 - DNA, 22 bp, Artificial Sequence
  chemically synthesized
tttcttgagcttaatgaagaca

SEQ ID NO: 659935 - DNA, 22 bp, Artificial Sequence
  chemically synthesized
ccttcttcaattgtcttcatta

SEQ ID NO: 659936 - DNA, 22 bp, Artificial Sequence
  chemically synthesized
ttttcttgagcttaatgaagac

SEQ ID NO: 659937 - DNA, 22 bp, Artificial Sequence
  chemically synthesized
tttttcttgagcttaatgaaga

SEQ ID NO: 659938 - DNA, 22 bp, Artificial Sequence
  chemically synthesized
ttttttcttgagcttaatgaag

SEQ ID NO: 659939 - DNA, 22 bp, Artificial Sequence
  chemically synthesized
tttttttcttgagcttaatgaa

SEQ ID NO: 659940 - DNA, 22 bp, Artificial Sequence
  chemically synthesized
cttcaattgtcttcattaagct

SEQ ID NO: 659941 - DNA, 22 bp, Artificial Sequence
  chemically synthesized
ttttttttcttgagcttaatga

SEQ ID NO: 659942 - DNA, 22 bp, Artificial Sequence
  chemically synthesized
ttcaattgtcttcattaagctc

SEQ ID NO: 659943 - DNA, 22 bp, Artificial Sequence
  chemically synthesized
caattgtcttcattaagctcaa

SEQ ID NO: 659944 - DNA, 22 bp, Artificial Sequence
  chemically synthesized
aattgtcttcattaagctcaag

SEQ ID NO: 659945 - DNA, 22 bp, Artificial Sequence
  chemically synthesized
atttttttttttcttgagctta

SEQ ID NO: 659946 - DNA, 22 bp, Artificial Sequence
  chemically synthesized
tgatttttttttttcttgagct

SEQ ID NO: 659947 - DNA, 22 bp, Artificial Sequence
  chemically synthesized
tcttcattaagctcaagaaaaa

SEQ ID NO: 659948 - DNA, 22 bp, Artificial Sequence
  chemically synthesized
cattaagctcaagaaaaaaaaa

SEQ ID NO: 659949 - DNA, 22 bp, Artificial Sequence
  chemically synthesized
attaagctcaagaaaaaaaaaa

SEQ ID NO: 659950 - DNA, 22 bp, Artificial Sequence
  chemically synthesized
agctcaagaaaaaaaaaaatca

SEQ ID NO: 659951 - DNA, 22 bp, Artificial Sequence
  chemically synthesized
aagaaaaaaaaaaatcagaact

SEQ ID NO: 659952 - DNA, 22 bp, Artificial Sequence
  chemically synthesized
cacacaagggagatatccccag

SEQ ID NO: 659953 - DNA, 22 bp, Artificial Sequence
  chemically synthesized
gattgcacacaagggagatatc

SEQ ID NO: 659954 - DNA, 22 bp, Artificial Sequence
  chemically synthesized
ggattgcacacaagggagatat

SEQ ID NO: 659955 - DNA, 22 bp, Artificial Sequence
  chemically synthesized
tggattgcacacaagggagata

SEQ ID NO: 659956 - DNA, 22 bp, Artificial Sequence
  chemically synthesized
ttttggattgcacacaagggag

SEQ ID NO: 659957 - DNA, 22 bp, Artificial Sequence
  chemically synthesized
gttttggattgcacacaaggga

SEQ ID NO: 659958 - DNA, 22 bp, Artificial Sequence
  chemically synthesized
tttgttttggattgcacacaag

SEQ ID NO: 659959 - DNA, 22 bp, Artificial Sequence
  chemically synthesized
gggatatctcccttgtgtgcaa

SEQ ID NO: 659960 - DNA, 22 bp, Artificial Sequence
  chemically synthesized
ccttgtgtgcaatccaaaacaa

SEQ ID NO: 659961 - DNA, 22 bp, Artificial Sequence
  chemically synthesized
gagaacaattgtttgttttgga

SEQ ID NO: 659962 - DNA, 22 bp, Artificial Sequence
  chemically synthesized
agagaacaattgtttgttttgg

SEQ ID NO: 659963 - DNA, 22 bp, Artificial Sequence
  chemically synthesized
ttagagaacaattgtttgtttt

SEQ ID NO: 659964 - DNA, 22 bp, Artificial Sequence
  chemically synthesized
gtgtgcaatccaaaacaaacaa

SEQ ID NO: 659965 - DNA, 22 bp, Artificial Sequence
  chemically synthesized
tgtgcaatccaaaacaaacaat

SEQ ID NO: 659966 - DNA, 22 bp, Artificial Sequence
  chemically synthesized
tcttagagaacaattgtttgtt

SEQ ID NO: 659967 - DNA, 22 bp, Artificial Sequence
  chemically synthesized
tctcttagagaacaattgtttg

SEQ ID NO: 659968 - DNA, 22 bp, Artificial Sequence
  chemically synthesized
atcactctctcttagagaacaa

SEQ ID NO: 659969 - DNA, 22 bp, Artificial Sequence
  chemically synthesized
cattcatcactctctcttagag

SEQ ID NO: 659970 - DNA, 22 bp, Artificial Sequence
  chemically synthesized
gcgcctccattcatcactctct

SEQ ID NO: 659971 - DNA, 22 bp, Artificial Sequence
  chemically synthesized
ggcgcctccattcatcactctc

SEQ ID NO: 659972 - DNA, 22 bp, Artificial Sequence
  chemically synthesized
ttctctaagagagagtgatgaa

SEQ ID NO: 659973 - DNA, 22 bp, Artificial Sequence
  chemically synthesized
tctaagagagagtgatgaatgg

SEQ ID NO: 659974 - DNA, 22 bp, Artificial Sequence
  chemically synthesized
agtttggcgcctccattcatca

SEQ ID NO: 659975 - DNA, 22 bp, Artificial Sequence
  chemically synthesized
cagtttggcgcctccattcatc

SEQ ID NO: 659976 - DNA, 22 bp, Artificial Sequence
  chemically synthesized
taagagagagtgatgaatggag

SEQ ID NO: 659977 - DNA, 22 bp, Artificial Sequence
  chemically synthesized
agagagagtgatgaatggaggc

SEQ ID NO: 659978 - DNA, 22 bp, Artificial Sequence
  chemically synthesized
tgaagtttcagtttggcgcctc

SEQ ID NO: 659979 - DNA, 22 bp, Artificial Sequence
  chemically synthesized
atgaagtttcagtttggcgcct

SEQ ID NO: 659980 - DNA, 22 bp, Artificial Sequence
  chemically synthesized
tatgaagtttcagtttggcgcc

SEQ ID NO: 659981 - DNA, 22 bp, Artificial Sequence
  chemically synthesized
ataagattttatgaagtttcag

SEQ ID NO: 659982 - DNA, 22 bp, Artificial Sequence
  chemically synthesized
aataagattttatgaagtttca

SEQ ID NO: 659983 - DNA, 22 bp, Artificial Sequence
  chemically synthesized
taataagattttatgaagtttc

SEQ ID NO: 659984 - DNA, 22 bp, Artificial Sequence
  chemically synthesized
ttaataagattttatgaagttt

SEQ ID NO: 659985 - DNA, 22 bp, Artificial Sequence
  chemically synthesized
tttaataagattttatgaagtt

SEQ ID NO: 659986 - DNA, 22 bp, Artificial Sequence
  chemically synthesized
ttttttaataagattttatgaa

SEQ ID NO: 659987 - DNA, 22 bp, Artificial Sequence
  chemically synthesized
gttttttaataagattttatga

SEQ ID NO: 659988 - DNA, 22 bp, Artificial Sequence
  chemically synthesized
tgttttttaataagattttatg

SEQ ID NO: 659989 - DNA, 22 bp, Artificial Sequence
  chemically synthesized
ttgttttttaataagattttat

SEQ ID NO: 659990 - DNA, 22 bp, Artificial Sequence
  chemically synthesized
ttttgttttttaataagatttt

SEQ ID NO: 659991 - DNA, 22 bp, Artificial Sequence
  chemically synthesized
cttttgttttttaataagattt

SEQ ID NO: 659992 - DNA, 22 bp, Artificial Sequence
  chemically synthesized
tcttttgttttttaataagatt

SEQ ID NO: 659993 - DNA, 22 bp, Artificial Sequence
  chemically synthesized
aaacttcataaaatcttattaa

SEQ ID NO: 659994 - DNA, 22 bp, Artificial Sequence
  chemically synthesized
gttttcttttgttttttaataa

SEQ ID NO: 659995 - DNA, 22 bp, Artificial Sequence
  chemically synthesized
cgttttcttttgttttttaata

SEQ ID NO: 659996 - DNA, 22 bp, Artificial Sequence
  chemically synthesized
tcgttttcttttgttttttaat

SEQ ID NO: 659997 - DNA, 22 bp, Artificial Sequence
  chemically synthesized
cataaaatcttattaaaaaaca

SEQ ID NO: 659998 - DNA, 22 bp, Artificial Sequence
  chemically synthesized
ttcgttttcttttgttttttaa

SEQ ID NO: 659999 - DNA, 22 bp, Artificial Sequence
  chemically synthesized
ataaaatcttattaaaaaacaa

SEQ ID NO: 660000 - DNA, 22 bp, Artificial Sequence
  chemically synthesized
agaacatttttcgttttctttt

SEQ ID NO: 660001 - DNA, 22 bp, Artificial Sequence
  chemically synthesized
attaaaaaacaaaagaaaacga

SEQ ID NO: 660002 - DNA, 22 bp, Artificial Sequence
  chemically synthesized
ttaaaaaacaaaagaaaacgaa

SEQ ID NO: 660003 - DNA, 22 bp, Artificial Sequence
  chemically synthesized
aaaaacaaaagaaaacgaaaaa

SEQ ID NO: 660004 - DNA, 22 bp, Artificial Sequence
  chemically synthesized
aaactgagaacatttttcgttt

SEQ ID NO: 660005 - DNA, 22 bp, Artificial Sequence
  chemically synthesized
tcaaactgagaacatttttcgt

SEQ ID NO: 660006 - DNA, 22 bp, Artificial Sequence
  chemically synthesized
ctcaaactgagaacatttttcg

SEQ ID NO: 660007 - DNA, 22 bp, Artificial Sequence
  chemically synthesized
gcttctcaaactgagaacattt

SEQ ID NO: 660008 - DNA, 22 bp, Artificial Sequence
  chemically synthesized
agcttctcaaactgagaacatt

SEQ ID NO: 660009 - DNA, 22 bp, Artificial Sequence
  chemically synthesized
atacagcaaacttagcttctca

SEQ ID NO: 660010 - DNA, 22 bp, Artificial Sequence
  chemically synthesized
aatacagcaaacttagcttctc

SEQ ID NO: 660011 - DNA, 22 bp, Artificial Sequence
  chemically synthesized
tcagtttgagaagctaagtttg

SEQ ID NO: 660012 - DNA, 22 bp, Artificial Sequence
  chemically synthesized
agtttgagaagctaagtttgct

SEQ ID NO: 660013 - DNA, 22 bp, Artificial Sequence
  chemically synthesized
gagaagctaagtttgctgtatt

SEQ ID NO: 660014 - DNA, 22 bp, Artificial Sequence
  chemically synthesized
agaagctaagtttgctgtatta

SEQ ID NO: 660015 - DNA, 22 bp, Artificial Sequence
  chemically synthesized
agtttgctgtattaagggcttg

SEQ ID NO: 660016 - DNA, 22 bp, Artificial Sequence
  chemically synthesized
gctgtattaagggcttgttttc

SEQ ID NO: 660017 - DNA, 22 bp, Artificial Sequence
  chemically synthesized
ctgtattaagggcttgttttca

SEQ ID NO: 660018 - DNA, 22 bp, Artificial Sequence
  chemically synthesized
tattaagggcttgttttcattt

SEQ ID NO: 660019 - DNA, 22 bp, Artificial Sequence
  chemically synthesized
ataggccaaacaaaatgaaaac

SEQ ID NO: 660020 - DNA, 22 bp, Artificial Sequence
  chemically synthesized
agggcttgttttcattttgttt

SEQ ID NO: 660021 - DNA, 22 bp, Artificial Sequence
  chemically synthesized
tgaattgataggccaaacaaaa

SEQ ID NO: 660022 - DNA, 22 bp, Artificial Sequence
  chemically synthesized
gttttcattttgtttggcctat

SEQ ID NO: 660023 - DNA, 22 bp, Artificial Sequence
  chemically synthesized
ttttcattttgtttggcctatc

SEQ ID NO: 660024 - DNA, 22 bp, Artificial Sequence
  chemically synthesized
tcattttgtttggcctatcaat

SEQ ID NO: 660025 - DNA, 22 bp, Artificial Sequence
  chemically synthesized
cattttgtttggcctatcaatt

SEQ ID NO: 660026 - DNA, 22 bp, Artificial Sequence
  chemically synthesized
cagaagattatgaattgatagg

SEQ ID NO: 660027 - DNA, 22 bp, Artificial Sequence
  chemically synthesized
attttgtttggcctatcaattc

SEQ ID NO: 660028 - DNA, 22 bp, Artificial Sequence
  chemically synthesized
gcagaagattatgaattgatag

SEQ ID NO: 660029 - DNA, 22 bp, Artificial Sequence
  chemically synthesized
tgcagaagattatgaattgata

SEQ ID NO: 660030 - DNA, 22 bp, Artificial Sequence
  chemically synthesized
ttgcagaagattatgaattgat

SEQ ID NO: 660031 - DNA, 22 bp, Artificial Sequence
  chemically synthesized
tgtttggcctatcaattcataa

SEQ ID NO: 660032 - DNA, 22 bp, Artificial Sequence
  chemically synthesized
gtttggcctatcaattcataat

SEQ ID NO: 660033 - DNA, 22 bp, Artificial Sequence
  chemically synthesized
tttggcctatcaattcataatc

SEQ ID NO: 660034 - DNA, 22 bp, Artificial Sequence
  chemically synthesized
ggcctatcaattcataatcttc

SEQ ID NO: 660035 - DNA, 22 bp, Artificial Sequence
  chemically synthesized
gcctatcaattcataatcttct

SEQ ID NO: 660036 - DNA, 22 bp, Artificial Sequence
  chemically synthesized
ggacacttttgcagaagattat

SEQ ID NO: 660037 - DNA, 22 bp, Artificial Sequence
  chemically synthesized
aggacacttttgcagaagatta

SEQ ID NO: 660038 - DNA, 22 bp, Artificial Sequence
  chemically synthesized
tcaattcataatcttctgcaaa

SEQ ID NO: 660039 - DNA, 22 bp, Artificial Sequence
  chemically synthesized
atacttaggacacttttgcaga

SEQ ID NO: 660040 - DNA, 22 bp, Artificial Sequence
  chemically synthesized
gctgatacttaggacacttttg

SEQ ID NO: 660041 - DNA, 22 bp, Artificial Sequence
  chemically synthesized
ataatcttctgcaaaagtgtcc

SEQ ID NO: 660042 - DNA, 22 bp, Artificial Sequence
  chemically synthesized
agctgatacttaggacactttt

SEQ ID NO: 660043 - DNA, 22 bp, Artificial Sequence
  chemically synthesized
ctgcaaaagtgtcctaagtatc

SEQ ID NO: 660044 - DNA, 22 bp, Artificial Sequence
  chemically synthesized
tgcaaaagtgtcctaagtatca

SEQ ID NO: 660045 - DNA, 22 bp, Artificial Sequence
  chemically synthesized
caaaagtgtcctaagtatcagc

SEQ ID NO: 660046 - DNA, 22 bp, Artificial Sequence
  chemically synthesized
cagatcagaatggtcttagctg

SEQ ID NO: 660047 - DNA, 22 bp, Artificial Sequence
  chemically synthesized
tctccagatcagaatggtctta

SEQ ID NO: 660048 - DNA, 22 bp, Artificial Sequence
  chemically synthesized
agtatcagctaagaccattctg

SEQ ID NO: 660049 - DNA, 22 bp, Artificial Sequence
  chemically synthesized
gcacacctgtctccagatcaga

SEQ ID NO: 660050 - DNA, 22 bp, Artificial Sequence
  chemically synthesized
agaccattctgatctggagaca

SEQ ID NO: 660051 - DNA, 22 bp, Artificial Sequence
  chemically synthesized
gagatactggcacacctgtctc

SEQ ID NO: 660052 - DNA, 22 bp, Artificial Sequence
  chemically synthesized
ctggagatactggcacacctgt

SEQ ID NO: 660053 - DNA, 22 bp, Artificial Sequence
  chemically synthesized
tgatctggagacaggtgtgcca

SEQ ID NO: 660054 - DNA, 22 bp, Artificial Sequence
  chemically synthesized
atctggagacaggtgtgccagt

SEQ ID NO: 660055 - DNA, 22 bp, Artificial Sequence
  chemically synthesized
tgctcctggagatactggcaca

SEQ ID NO: 660056 - DNA, 22 bp, Artificial Sequence
  chemically synthesized
gagacaggtgtgccagtatctc

SEQ ID NO: 660057 - DNA, 22 bp, Artificial Sequence
  chemically synthesized
gcggccatggctgtgctcctgg

SEQ ID NO: 660058 - DNA, 22 bp, Artificial Sequence
  chemically synthesized
actggcggccatggctgtgctc

SEQ ID NO: 660059 - DNA, 22 bp, Artificial Sequence
  chemically synthesized
tcactggcggccatggctgtgc

SEQ ID NO: 660060 - DNA, 22 bp, Artificial Sequence
  chemically synthesized
ctctcactggcggccatggctg

SEQ ID NO: 660061 - DNA, 22 bp, Artificial Sequence
  chemically synthesized
cctctcactggcggccatggct

SEQ ID NO: 660062 - DNA, 22 bp, Artificial Sequence
  chemically synthesized
caggagcacagccatggccgcc

SEQ ID NO: 660063 - DNA, 22 bp, Artificial Sequence
  chemically synthesized
aggggtggcttcctctcactgg

SEQ ID NO: 660064 - DNA, 22 bp, Artificial Sequence
  chemically synthesized
caggggtggcttcctctcactg

SEQ ID NO: 660065 - DNA, 22 bp, Artificial Sequence
  chemically synthesized
catgcacttcaggggtggcttc

SEQ ID NO: 660066 - DNA, 22 bp, Artificial Sequence
  chemically synthesized
ccatgcacttcaggggtggctt

SEQ ID NO: 660067 - DNA, 22 bp, Artificial Sequence
  chemically synthesized
ttccatgcacttcaggggtggc

SEQ ID NO: 660068 - DNA, 22 bp, Artificial Sequence
  chemically synthesized
gaattcttccatgcacttcagg

SEQ ID NO: 660069 - DNA, 22 bp, Artificial Sequence
  chemically synthesized
ggaattcttccatgcacttcag

SEQ ID NO: 660070 - DNA, 22 bp, Artificial Sequence
  chemically synthesized
tggaattcttccatgcacttca

SEQ ID NO: 660071 - DNA, 22 bp, Artificial Sequence
  chemically synthesized
gcccatggattttggaattctt

SEQ ID NO: 660072 - DNA, 22 bp, Artificial Sequence
  chemically synthesized
aagtgcatggaagaattccaaa

SEQ ID NO: 660073 - DNA, 22 bp, Artificial Sequence
  chemically synthesized
tcgcccatggattttggaattc

SEQ ID NO: 660074 - DNA, 22 bp, Artificial Sequence
  chemically synthesized
ctcgcccatggattttggaatt

SEQ ID NO: 660075 - DNA, 22 bp, Artificial Sequence
  chemically synthesized
tctcgcccatggattttggaat

SEQ ID NO: 660076 - DNA, 22 bp, Artificial Sequence
  chemically synthesized
cctttctcgcccatggattttg

SEQ ID NO: 660077 - DNA, 22 bp, Artificial Sequence
  chemically synthesized
ccctttctcgcccatggatttt

SEQ ID NO: 660078 - DNA, 22 bp, Artificial Sequence
  chemically synthesized
tccctttctcgcccatggattt

SEQ ID NO: 660079 - DNA, 22 bp, Artificial Sequence
  chemically synthesized
tttccctttctcgcccatggat

SEQ ID NO: 660080 - DNA, 22 bp, Artificial Sequence
  chemically synthesized
gttctttccctttctcgcccat

SEQ ID NO: 660081 - DNA, 22 bp, Artificial Sequence
  chemically synthesized
ggttctttccctttctcgccca

SEQ ID NO: 660082 - DNA, 22 bp, Artificial Sequence
  chemically synthesized
tggttctttccctttctcgccc

SEQ ID NO: 660083 - DNA, 22 bp, Artificial Sequence
  chemically synthesized
caaaatccatgggcgagaaagg

SEQ ID NO: 660084 - DNA, 22 bp, Artificial Sequence
  chemically synthesized
caaatagtggaatgagtcgaca

SEQ ID NO: 660085 - DNA, 22 bp, Artificial Sequence
  chemically synthesized
gcaaatagtggaatgagtcgac

SEQ ID NO: 660086 - DNA, 22 bp, Artificial Sequence
  chemically synthesized
tgcaaatagtggaatgagtcga

SEQ ID NO: 660087 - DNA, 22 bp, Artificial Sequence
  chemically synthesized
attttgcaaatagtggaatgag

SEQ ID NO: 660088 - DNA, 22 bp, Artificial Sequence
  chemically synthesized
tatgtcgactcattccactatt

SEQ ID NO: 660089 - DNA, 22 bp, Artificial Sequence
  chemically synthesized
agacactcattttgcaaatagt

SEQ ID NO: 660090 - DNA, 22 bp, Artificial Sequence
  chemically synthesized
attccactatttgcaaaatgag

SEQ ID NO: 660091 - DNA, 22 bp, Artificial Sequence
  chemically synthesized
cactatttgcaaaatgagtgtc

SEQ ID NO: 660092 - DNA, 22 bp, Artificial Sequence
  chemically synthesized
tttgcaaaatgagtgtctcagg

SEQ ID NO: 660093 - DNA, 22 bp, Artificial Sequence
  chemically synthesized
gcaaaatgagtgtctcagggtt

SEQ ID NO: 660094 - DNA, 22 bp, Artificial Sequence
  chemically synthesized
gaaaacaaacaaaaccctgaga

SEQ ID NO: 660095 - DNA, 22 bp, Artificial Sequence
  chemically synthesized
caaaatgagtgtctcagggttt

SEQ ID NO: 660096 - DNA, 22 bp, Artificial Sequence
  chemically synthesized
agattagaaaacaaacaaaacc

SEQ ID NO: 660097 - DNA, 22 bp, Artificial Sequence
  chemically synthesized
tcagattagaaaacaaacaaaa

SEQ ID NO: 660098 - DNA, 22 bp, Artificial Sequence
  chemically synthesized
ctctcagattagaaaacaaaca

SEQ ID NO: 660099 - DNA, 22 bp, Artificial Sequence
  chemically synthesized
agggttttgtttgttttctaat

SEQ ID NO: 660100 - DNA, 22 bp, Artificial Sequence
  chemically synthesized
tgtttgttttctaatctgagag

SEQ ID NO: 660101 - DNA, 22 bp, Artificial Sequence
  chemically synthesized
gtttgttttctaatctgagagc

SEQ ID NO: 660102 - DNA, 22 bp, Artificial Sequence
  chemically synthesized
tttgttttctaatctgagagca

SEQ ID NO: 660103 - DNA, 22 bp, Artificial Sequence
  chemically synthesized
gttttctaatctgagagcaatc

SEQ ID NO: 660104 - DNA, 22 bp, Artificial Sequence
  chemically synthesized
ttttctaatctgagagcaatct

SEQ ID NO: 660105 - DNA, 22 bp, Artificial Sequence
  chemically synthesized
agagccagaatgtagattgctc

SEQ ID NO: 660106 - DNA, 22 bp, Artificial Sequence
  chemically synthesized
tctaatctgagagcaatctaca

SEQ ID NO: 660107 - DNA, 22 bp, Artificial Sequence
  chemically synthesized
ctaatctgagagcaatctacat

SEQ ID NO: 660108 - DNA, 22 bp, Artificial Sequence
  chemically synthesized
taatctgagagcaatctacatt

SEQ ID NO: 660109 - DNA, 22 bp, Artificial Sequence
  chemically synthesized
atctgagagcaatctacattct

SEQ ID NO: 660110 - DNA, 22 bp, Artificial Sequence
  chemically synthesized
ggagttaagagccagaatgtag

SEQ ID NO: 660111 - DNA, 22 bp, Artificial Sequence
  chemically synthesized
agagcaatctacattctggctc

SEQ ID NO: 660112 - DNA, 22 bp, Artificial Sequence
  chemically synthesized
ataagctaggagttaagagcca

SEQ ID NO: 660113 - DNA, 22 bp, Artificial Sequence
  chemically synthesized
gataagctaggagttaagagcc

SEQ ID NO: 660114 - DNA, 22 bp, Artificial Sequence
  chemically synthesized
tgataagctaggagttaagagc

SEQ ID NO: 660115 - DNA, 22 bp, Artificial Sequence
  chemically synthesized
cattctggctcttaactcctag

SEQ ID NO: 660116 - DNA, 22 bp, Artificial Sequence
  chemically synthesized
tggctcttaactcctagcttat

SEQ ID NO: 660117 - DNA, 22 bp, Artificial Sequence
  chemically synthesized
aaaaatattttgataagctagg

SEQ ID NO: 660118 - DNA, 22 bp, Artificial Sequence
  chemically synthesized
gaaaaatattttgataagctag

SEQ ID NO: 660119 - DNA, 22 bp, Artificial Sequence
  chemically synthesized
gctcttaactcctagcttatca

SEQ ID NO: 660120 - DNA, 22 bp, Artificial Sequence
  chemically synthesized
ttaactcctagcttatcaaaat

SEQ ID NO: 660121 - DNA, 22 bp, Artificial Sequence
  chemically synthesized
tgacttgaaaaatattttgata

SEQ ID NO: 660122 - DNA, 22 bp, Artificial Sequence
  chemically synthesized
aactcctagcttatcaaaatat

SEQ ID NO: 660123 - DNA, 22 bp, Artificial Sequence
  chemically synthesized
atgacttgaaaaatattttgat

SEQ ID NO: 660124 - DNA, 22 bp, Artificial Sequence
  chemically synthesized
actcctagcttatcaaaatatt

SEQ ID NO: 660125 - DNA, 22 bp, Artificial Sequence
  chemically synthesized
ctagcttatcaaaatatttttc

SEQ ID NO: 660126 - DNA, 22 bp, Artificial Sequence
  chemically synthesized
catttatgacttgaaaaatatt

SEQ ID NO: 660127 - DNA, 22 bp, Artificial Sequence
  chemically synthesized
gcatttatgacttgaaaaatat

SEQ ID NO: 660128 - DNA, 22 bp, Artificial Sequence
  chemically synthesized
tgcatttatgacttgaaaaata

SEQ ID NO: 660129 - DNA, 22 bp, Artificial Sequence
  chemically synthesized
gcttatcaaaatatttttcaag

SEQ ID NO: 660130 - DNA, 22 bp, Artificial Sequence
  chemically synthesized
ttgcatttatgacttgaaaaat

SEQ ID NO: 660131 - DNA, 22 bp, Artificial Sequence
  chemically synthesized
atcaaaatatttttcaagtcat

SEQ ID NO: 660132 - DNA, 22 bp, Artificial Sequence
  chemically synthesized
tcaaaatatttttcaagtcata

SEQ ID NO: 660133 - DNA, 22 bp, Artificial Sequence
  chemically synthesized
tgataaatcatttttgcattta

SEQ ID NO: 660134 - DNA, 22 bp, Artificial Sequence
  chemically synthesized
ttcaagtcataaatgcaaaaat

SEQ ID NO: 660135 - DNA, 22 bp, Artificial Sequence
  chemically synthesized
ctgtgataaatcatttttgcat

SEQ ID NO: 660136 - DNA, 22 bp, Artificial Sequence
  chemically synthesized
tcaagtcataaatgcaaaaatg

SEQ ID NO: 660137 - DNA, 22 bp, Artificial Sequence
  chemically synthesized
cctgtgataaatcatttttgca

SEQ ID NO: 660138 - DNA, 22 bp, Artificial Sequence
  chemically synthesized
caagtcataaatgcaaaaatga

SEQ ID NO: 660139 - DNA, 22 bp, Artificial Sequence
  chemically synthesized
aagtcataaatgcaaaaatgat

SEQ ID NO: 660140 - DNA, 22 bp, Artificial Sequence
  chemically synthesized
ttcctgtgataaatcatttttg

SEQ ID NO: 660141 - DNA, 22 bp, Artificial Sequence
  chemically synthesized
atgctcttcctgtgataaatca

SEQ ID NO: 660142 - DNA, 22 bp, Artificial Sequence
  chemically synthesized
tggacctaatgctcttcctgtg

SEQ ID NO: 660143 - DNA, 22 bp, Artificial Sequence
  chemically synthesized
gaagctgtggacctaatgctct

SEQ ID NO: 660144 - DNA, 22 bp, Artificial Sequence
  chemically synthesized
atcacaggaagagcattaggtc

SEQ ID NO: 660145 - DNA, 22 bp, Artificial Sequence
  chemically synthesized
tcacaggaagagcattaggtcc

SEQ ID NO: 660146 - DNA, 22 bp, Artificial Sequence
  chemically synthesized
caacagggccctggaagctgtg

SEQ ID NO: 660147 - DNA, 22 bp, Artificial Sequence
  chemically synthesized
gcattacaacagggccctggaa

SEQ ID NO: 660148 - DNA, 22 bp, Artificial Sequence
  chemically synthesized
ggtccacagcttccagggccct

SEQ ID NO: 660149 - DNA, 22 bp, Artificial Sequence
  chemically synthesized
ccagggccctgttgtaatgcta

SEQ ID NO: 660150 - DNA, 22 bp, Artificial Sequence
  chemically synthesized
cagggccctgttgtaatgctaa

SEQ ID NO: 660151 - DNA, 22 bp, Artificial Sequence
  chemically synthesized
ttgtaatgctaattacacttca

SEQ ID NO: 660152 - DNA, 22 bp, Artificial Sequence
  chemically synthesized
gcgtacagaatggtgaagtgta

SEQ ID NO: 660153 - DNA, 22 bp, Artificial Sequence
  chemically synthesized
agcgtacagaatggtgaagtgt

SEQ ID NO: 660154 - DNA, 22 bp, Artificial Sequence
  chemically synthesized
taatgctaattacacttcacca

SEQ ID NO: 660155 - DNA, 22 bp, Artificial Sequence
  chemically synthesized
attacacttcaccattctgtac

SEQ ID NO: 660156 - DNA, 22 bp, Artificial Sequence
  chemically synthesized
cacttcaccattctgtacgcta

SEQ ID NO: 660157 - DNA, 22 bp, Artificial Sequence
  chemically synthesized
tcacaggaggcttagcgtacag

SEQ ID NO: 660158 - DNA, 22 bp, Artificial Sequence
  chemically synthesized
tgtcacaggaggcttagcgtac

SEQ ID NO: 660159 - DNA, 22 bp, Artificial Sequence
  chemically synthesized
caccattctgtacgctaagcct

SEQ ID NO: 660160 - DNA, 22 bp, Artificial Sequence
  chemically synthesized
accattctgtacgctaagcctc

SEQ ID NO: 660161 - DNA, 22 bp, Artificial Sequence
  chemically synthesized
ccgggctctgtcacaggaggct

SEQ ID NO: 660162 - DNA, 22 bp, Artificial Sequence
  chemically synthesized
cccgggctctgtcacaggaggc

SEQ ID NO: 660163 - DNA, 22 bp, Artificial Sequence
  chemically synthesized
tgtacgctaagcctcctgtgac

SEQ ID NO: 660164 - DNA, 22 bp, Artificial Sequence
  chemically synthesized
tttcccgggctctgtcacagga

SEQ ID NO: 660165 - DNA, 22 bp, Artificial Sequence
  chemically synthesized
tacgctaagcctcctgtgacag

SEQ ID NO: 660166 - DNA, 22 bp, Artificial Sequence
  chemically synthesized
atttcccgggctctgtcacagg

SEQ ID NO: 660167 - DNA, 22 bp, Artificial Sequence
  chemically synthesized
tatttcccgggctctgtcacag

SEQ ID NO: 660168 - DNA, 22 bp, Artificial Sequence
  chemically synthesized
ttatttcccgggctctgtcaca

SEQ ID NO: 660169 - DNA, 22 bp, Artificial Sequence
  chemically synthesized
agcctcctgtgacagagcccgg

SEQ ID NO: 660170 - DNA, 22 bp, Artificial Sequence
  chemically synthesized
ctgtgacagagcccgggaaata

SEQ ID NO: 660171 - DNA, 22 bp, Artificial Sequence
  chemically synthesized
tgacagagcccgggaaataaaa

SEQ ID NO: 660172 - DNA, 22 bp, Artificial Sequence
  chemically synthesized
tgatacgtacgtatggcatgtt

SEQ ID NO: 660173 - DNA, 22 bp, Artificial Sequence
  chemically synthesized
atgatacgtacgtatggcatgt

SEQ ID NO: 660174 - DNA, 22 bp, Artificial Sequence
  chemically synthesized
aatgtttatgatacgtacgtat

SEQ ID NO: 660175 - DNA, 22 bp, Artificial Sequence
  chemically synthesized
ctgaatgtttatgatacgtacg

SEQ ID NO: 660176 - DNA, 22 bp, Artificial Sequence
  chemically synthesized
gctgctgaatgtttatgatacg

SEQ ID NO: 660177 - DNA, 22 bp, Artificial Sequence
  chemically synthesized
aactggctgctgaatgtttatg

SEQ ID NO: 660178 - DNA, 22 bp, Artificial Sequence
  chemically synthesized
cgtggatatgtgtctgaactgg

SEQ ID NO: 660179 - DNA, 22 bp, Artificial Sequence
  chemically synthesized
tgcgtggatatgtgtctgaact

SEQ ID NO: 660180 - DNA, 22 bp, Artificial Sequence
  chemically synthesized
tctgcgtggatatgtgtctgaa

SEQ ID NO: 660181 - DNA, 22 bp, Artificial Sequence
  chemically synthesized
agcagccagttcagacacatat

SEQ ID NO: 660182 - DNA, 22 bp, Artificial Sequence
  chemically synthesized
gtcaacgtccctctctgcgtgg

SEQ ID NO: 660183 - DNA, 22 bp, Artificial Sequence
  chemically synthesized
ggtcaacgtccctctctgcgtg

SEQ ID NO: 660184 - DNA, 22 bp, Artificial Sequence
  chemically synthesized
agacacatatccacgcagagag

SEQ ID NO: 660185 - DNA, 22 bp, Artificial Sequence
  chemically synthesized
gagcaagagcacaacaatttgg

SEQ ID NO: 660186 - DNA, 22 bp, Artificial Sequence
  chemically synthesized
tgaccgcctggagcaagagcac

SEQ ID NO: 660187 - DNA, 22 bp, Artificial Sequence
  chemically synthesized
accaaattgttgtgctcttgct

SEQ ID NO: 660188 - DNA, 22 bp, Artificial Sequence
  chemically synthesized
atgaccgcctggagcaagagca

SEQ ID NO: 660189 - DNA, 22 bp, Artificial Sequence
  chemically synthesized
tttatgaccgcctggagcaaga

SEQ ID NO: 660190 - DNA, 22 bp, Artificial Sequence
  chemically synthesized
ttgtgctcttgctccaggcggt

SEQ ID NO: 660191 - DNA, 22 bp, Artificial Sequence
  chemically synthesized
accactatttatgaccgcctgg

SEQ ID NO: 660192 - DNA, 22 bp, Artificial Sequence
  chemically synthesized
gaccactatttatgaccgcctg

SEQ ID NO: 660193 - DNA, 22 bp, Artificial Sequence
  chemically synthesized
tgctcttgctccaggcggtcat

SEQ ID NO: 660194 - DNA, 22 bp, Artificial Sequence
  chemically synthesized
tttgaccactatttatgaccgc

SEQ ID NO: 660195 - DNA, 22 bp, Artificial Sequence
  chemically synthesized
ttgctccaggcggtcataaata

SEQ ID NO: 660196 - DNA, 22 bp, Artificial Sequence
  chemically synthesized
attgtttgaccactatttatga

SEQ ID NO: 660197 - DNA, 22 bp, Artificial Sequence
  chemically synthesized
gctccaggcggtcataaatagt

SEQ ID NO: 660198 - DNA, 22 bp, Artificial Sequence
  chemically synthesized
ctccaggcggtcataaatagtg

SEQ ID NO: 660199 - DNA, 22 bp, Artificial Sequence
  chemically synthesized
ttaattgtttgaccactattta

SEQ ID NO: 660200 - DNA, 22 bp, Artificial Sequence
  chemically synthesized
caggcggtcataaatagtggtc

SEQ ID NO: 660201 - DNA, 22 bp, Artificial Sequence
  chemically synthesized
cagattattaattgtttgacca

SEQ ID NO: 660202 - DNA, 22 bp, Artificial Sequence
  chemically synthesized
ataatctgcaggatatccatgg

SEQ ID NO: 660203 - DNA, 22 bp, Artificial Sequence
  chemically synthesized
aagcaaaatgaccagcccatgg

SEQ ID NO: 660204 - DNA, 22 bp, Artificial Sequence
  chemically synthesized
caggatatccatgggctggtca

SEQ ID NO: 660205 - DNA, 22 bp, Artificial Sequence
  chemically synthesized
gaccagcacaacctcaagcaaa

SEQ ID NO: 660206 - DNA, 22 bp, Artificial Sequence
  chemically synthesized
ggaccagcacaacctcaagcaa

SEQ ID NO: 660207 - DNA, 22 bp, Artificial Sequence
  chemically synthesized
gtcattttgcttgaggttgtgc

SEQ ID NO: 660208 - DNA, 22 bp, Artificial Sequence
  chemically synthesized
tgcttgaggttgtgctggtcca

SEQ ID NO: 660209 - DNA, 22 bp, Artificial Sequence
  chemically synthesized
catgtgatgccttggaccagca

SEQ ID NO: 660210 - DNA, 22 bp, Artificial Sequence
  chemically synthesized
gcttgaggttgtgctggtccaa

SEQ ID NO: 660211 - DNA, 22 bp, Artificial Sequence
  chemically synthesized
cttgaggttgtgctggtccaag

SEQ ID NO: 660212 - DNA, 22 bp, Artificial Sequence
  chemically synthesized
gaggttgtgctggtccaaggca

SEQ ID NO: 660213 - DNA, 22 bp, Artificial Sequence
  chemically synthesized
aggttgtgctggtccaaggcat

SEQ ID NO: 660214 - DNA, 22 bp, Artificial Sequence
  chemically synthesized
tcagctgcatgtgatgccttgg

SEQ ID NO: 660215 - DNA, 22 bp, Artificial Sequence
  chemically synthesized
tgctggtccaaggcatcacatg

SEQ ID NO: 660216 - DNA, 22 bp, Artificial Sequence
  chemically synthesized
agcctgtcagctgcatgtgatg

SEQ ID NO: 660217 - DNA, 22 bp, Artificial Sequence
  chemically synthesized
gagcctgtcagctgcatgtgat

SEQ ID NO: 660218 - DNA, 22 bp, Artificial Sequence
  chemically synthesized
ttgagcctgtcagctgcatgtg

SEQ ID NO: 660219 - DNA, 22 bp, Artificial Sequence
  chemically synthesized
gtccaaggcatcacatgcagct

SEQ ID NO: 660220 - DNA, 22 bp, Artificial Sequence
  chemically synthesized
cagtggatctcttgagcctgtc

SEQ ID NO: 660221 - DNA, 22 bp, Artificial Sequence
  chemically synthesized
gcagtggatctcttgagcctgt

SEQ ID NO: 660222 - DNA, 22 bp, Artificial Sequence
  chemically synthesized
tgcagtggatctcttgagcctg

SEQ ID NO: 660223 - DNA, 22 bp, Artificial Sequence
  chemically synthesized
ttgcagtggatctcttgagcct

SEQ ID NO: 660224 - DNA, 22 bp, Artificial Sequence
  chemically synthesized
tttgcagtggatctcttgagcc

SEQ ID NO: 660225 - DNA, 22 bp, Artificial Sequence
  chemically synthesized
ttttttgcagtggatctcttga

SEQ ID NO: 660226 - DNA, 22 bp, Artificial Sequence
  chemically synthesized
gttttttgcagtggatctcttg

SEQ ID NO: 660227 - DNA, 22 bp, Artificial Sequence
  chemically synthesized
tttgttttttgcagtggatctc

SEQ ID NO: 660228 - DNA, 22 bp, Artificial Sequence
  chemically synthesized
atttgttttttgcagtggatct

SEQ ID NO: 660229 - DNA, 22 bp, Artificial Sequence
  chemically synthesized
acaggctcaagagatccactgc

SEQ ID NO: 660230 - DNA, 22 bp, Artificial Sequence
  chemically synthesized
tatttgttttttgcagtggatc

SEQ ID NO: 660231 - DNA, 22 bp, Artificial Sequence
  chemically synthesized
tgattttatttgttttttgcag

SEQ ID NO: 660232 - DNA, 22 bp, Artificial Sequence
  chemically synthesized
gtgattttatttgttttttgca

SEQ ID NO: 660233 - DNA, 22 bp, Artificial Sequence
  chemically synthesized
aagagatccactgcaaaaaaca

SEQ ID NO: 660234 - DNA, 22 bp, Artificial Sequence
  chemically synthesized
agtcatttgtgattttatttgt

SEQ ID NO: 660235 - DNA, 22 bp, Artificial Sequence
  chemically synthesized
gagtcatttgtgattttatttg

SEQ ID NO: 660236 - DNA, 22 bp, Artificial Sequence
  chemically synthesized
tgagtcatttgtgattttattt

SEQ ID NO: 660237 - DNA, 22 bp, Artificial Sequence
  chemically synthesized
tttgagtcatttgtgattttat

SEQ ID NO: 660238 - DNA, 22 bp, Artificial Sequence
  chemically synthesized
caaaaaacaaataaaatcacaa

SEQ ID NO: 660239 - DNA, 22 bp, Artificial Sequence
  chemically synthesized
ctctttgagtcatttgtgattt

SEQ ID NO: 660240 - DNA, 22 bp, Artificial Sequence
  chemically synthesized
actctttgagtcatttgtgatt

SEQ ID NO: 660241 - DNA, 22 bp, Artificial Sequence
  chemically synthesized
tactctttgagtcatttgtgat

SEQ ID NO: 660242 - DNA, 22 bp, Artificial Sequence
  chemically synthesized
aaaggaaggttttactctttga

SEQ ID NO: 660243 - DNA, 22 bp, Artificial Sequence
  chemically synthesized
aaagagtaaaaccttcctttca

SEQ ID NO: 660244 - DNA, 22 bp, Artificial Sequence
  chemically synthesized
agaggaaaaaggacactgaaag

SEQ ID NO: 660245 - DNA, 22 bp, Artificial Sequence
  chemically synthesized
tcagaggaaaaaggacactgaa

SEQ ID NO: 660246 - DNA, 22 bp, Artificial Sequence
  chemically synthesized
ggattctcagaggaaaaaggac

SEQ ID NO: 660247 - DNA, 22 bp, Artificial Sequence
  chemically synthesized
cctttcagtgtcctttttcctc

SEQ ID NO: 660248 - DNA, 22 bp, Artificial Sequence
  chemically synthesized
ctttcagtgtcctttttcctct

SEQ ID NO: 660249 - DNA, 22 bp, Artificial Sequence
  chemically synthesized
gctaggattctcagaggaaaaa

SEQ ID NO: 660250 - DNA, 22 bp, Artificial Sequence
  chemically synthesized
tcagtgtcctttttcctctgag

SEQ ID NO: 660251 - DNA, 22 bp, Artificial Sequence
  chemically synthesized
cagtgtcctttttcctctgaga

SEQ ID NO: 660252 - DNA, 22 bp, Artificial Sequence
  chemically synthesized
agtgtcctttttcctctgagaa

SEQ ID NO: 660253 - DNA, 22 bp, Artificial Sequence
  chemically synthesized
tttcctctgagaatcctagcta

SEQ ID NO: 660254 - DNA, 22 bp, Artificial Sequence
  chemically synthesized
ttcctctgagaatcctagctag

SEQ ID NO: 660255 - DNA, 22 bp, Artificial Sequence
  chemically synthesized
tcctctgagaatcctagctagg

SEQ ID NO: 660256 - DNA, 22 bp, Artificial Sequence
  chemically synthesized
cctctgagaatcctagctagga

SEQ ID NO: 660257 - DNA, 22 bp, Artificial Sequence
  chemically synthesized
ctctgagaatcctagctaggac

SEQ ID NO: 660258 - DNA, 22 bp, Artificial Sequence
  chemically synthesized
aagggtatgagagagtcctagc

SEQ ID NO: 660259 - DNA, 22 bp, Artificial Sequence
  chemically synthesized
tgagaatcctagctaggactct

SEQ ID NO: 660260 - DNA, 22 bp, Artificial Sequence
  chemically synthesized
agaatcctagctaggactctct

SEQ ID NO: 660261 - DNA, 22 bp, Artificial Sequence
  chemically synthesized
ttaaagggtatgagagagtcct

SEQ ID NO: 660262 - DNA, 22 bp, Artificial Sequence
  chemically synthesized
attaaagggtatgagagagtcc

SEQ ID NO: 660263 - DNA, 22 bp, Artificial Sequence
  chemically synthesized
gtgtttattaaagggtatgaga

SEQ ID NO: 660264 - DNA, 22 bp, Artificial Sequence
  chemically synthesized
ggtgtttattaaagggtatgag

SEQ ID NO: 660265 - DNA, 22 bp, Artificial Sequence
  chemically synthesized
gctaggactctctcataccctt

SEQ ID NO: 660266 - DNA, 22 bp, Artificial Sequence
  chemically synthesized
ggactctctcataccctttaat

SEQ ID NO: 660267 - DNA, 22 bp, Artificial Sequence
  chemically synthesized
acgtttggtgtttattaaaggg

SEQ ID NO: 660268 - DNA, 22 bp, Artificial Sequence
  chemically synthesized
tctcataccctttaataaacac

SEQ ID NO: 660269 - DNA, 22 bp, Artificial Sequence
  chemically synthesized
tcataccctttaataaacacca

SEQ ID NO: 660270 - DNA, 22 bp, Artificial Sequence
  chemically synthesized
ataccctttaataaacaccaaa

SEQ ID NO: 660271 - DNA, 22 bp, Artificial Sequence
  chemically synthesized
aaagagagtgtggttcacgttt

SEQ ID NO: 660272 - DNA, 22 bp, Artificial Sequence
  chemically synthesized
taataaacaccaaacgtgaacc

SEQ ID NO: 660273 - DNA, 22 bp, Artificial Sequence
  chemically synthesized
caaagagagtgtggttcacgtt

SEQ ID NO: 660274 - DNA, 22 bp, Artificial Sequence
  chemically synthesized
aataaacaccaaacgtgaacca

SEQ ID NO: 660275 - DNA, 22 bp, Artificial Sequence
  chemically synthesized
tcaaagagagtgtggttcacgt

SEQ ID NO: 660276 - DNA, 22 bp, Artificial Sequence
  chemically synthesized
ataaacaccaaacgtgaaccac

SEQ ID NO: 660277 - DNA, 22 bp, Artificial Sequence
  chemically synthesized
tctttgaaaggtgttttatttt

SEQ ID NO: 660278 - DNA, 22 bp, Artificial Sequence
  chemically synthesized
gagtcgaggcataaaaataaaa

SEQ ID NO: 660279 - DNA, 22 bp, Artificial Sequence
  chemically synthesized
tttgaaaggtgttttattttta

SEQ ID NO: 660280 - DNA, 22 bp, Artificial Sequence
  chemically synthesized
agagtcgaggcataaaaataaa

SEQ ID NO: 660281 - DNA, 22 bp, Artificial Sequence
  chemically synthesized
tgaaaggtgttttatttttatg

SEQ ID NO: 660282 - DNA, 22 bp, Artificial Sequence
  chemically synthesized
gaaaggtgttttatttttatgc

SEQ ID NO: 660283 - DNA, 22 bp, Artificial Sequence
  chemically synthesized
aaaggtgttttatttttatgcc

SEQ ID NO: 660284 - DNA, 22 bp, Artificial Sequence
  chemically synthesized
atcaacttagagtcgaggcata

SEQ ID NO: 660285 - DNA, 22 bp, Artificial Sequence
  chemically synthesized
tatttttatgcctcgactctaa

SEQ ID NO: 660286 - DNA, 22 bp, Artificial Sequence
  chemically synthesized
atttttatgcctcgactctaag

SEQ ID NO: 660287 - DNA, 22 bp, Artificial Sequence
  chemically synthesized
tttttatgcctcgactctaagt

SEQ ID NO: 660288 - DNA, 22 bp, Artificial Sequence
  chemically synthesized
atcaaactcatcaacttagagt

SEQ ID NO: 660289 - DNA, 22 bp, Artificial Sequence
  chemically synthesized
ttatgcctcgactctaagttga

SEQ ID NO: 660290 - DNA, 22 bp, Artificial Sequence
  chemically synthesized
tatgcctcgactctaagttgat

SEQ ID NO: 660291 - DNA, 22 bp, Artificial Sequence
  chemically synthesized
atgcctcgactctaagttgatg

SEQ ID NO: 660292 - DNA, 22 bp, Artificial Sequence
  chemically synthesized
tgcctcgactctaagttgatga

SEQ ID NO: 660293 - DNA, 22 bp, Artificial Sequence
  chemically synthesized
aatactgatcaaactcatcaac

SEQ ID NO: 660294 - DNA, 22 bp, Artificial Sequence
  chemically synthesized
gactctaagttgatgagtttga

SEQ ID NO: 660295 - DNA, 22 bp, Artificial Sequence
  chemically synthesized
agatcctgaatactgatcaaac

SEQ ID NO: 660296 - DNA, 22 bp, Artificial Sequence
  chemically synthesized
taagttgatgagtttgatcagt

SEQ ID NO: 660297 - DNA, 22 bp, Artificial Sequence
  chemically synthesized
cagatcctgaatactgatcaaa

SEQ ID NO: 660298 - DNA, 22 bp, Artificial Sequence
  chemically synthesized
agttgatgagtttgatcagtat

SEQ ID NO: 660299 - DNA, 22 bp, Artificial Sequence
  chemically synthesized
atgagtttgatcagtattcagg

SEQ ID NO: 660300 - DNA, 22 bp, Artificial Sequence
  chemically synthesized
agaacaacttcagatcctgaat

SEQ ID NO: 660301 - DNA, 22 bp, Artificial Sequence
  chemically synthesized
aagaacaacttcagatcctgaa

SEQ ID NO: 660302 - DNA, 22 bp, Artificial Sequence
  chemically synthesized
gatcagtattcaggatctgaag

SEQ ID NO: 660303 - DNA, 22 bp, Artificial Sequence
  chemically synthesized
atcagtattcaggatctgaagt

SEQ ID NO: 660304 - DNA, 22 bp, Artificial Sequence
  chemically synthesized
aggatctgaagttgttcttaaa

SEQ ID NO: 660305 - DNA, 22 bp, Artificial Sequence
  chemically synthesized
acccaatgccagtgagatttaa

SEQ ID NO: 660306 - DNA, 22 bp, Artificial Sequence
  chemically synthesized
cacccaatgccagtgagattta

SEQ ID NO: 660307 - DNA, 22 bp, Artificial Sequence
  chemically synthesized
aagttgttcttaaatctcactg

SEQ ID NO: 660308 - DNA, 22 bp, Artificial Sequence
  chemically synthesized
ttcttaaatctcactggcattg

SEQ ID NO: 660309 - DNA, 22 bp, Artificial Sequence
  chemically synthesized
cccatatcttcacccaatgcca

SEQ ID NO: 660310 - DNA, 22 bp, Artificial Sequence
  chemically synthesized
ttaaatctcactggcattgggt

SEQ ID NO: 660311 - DNA, 22 bp, Artificial Sequence
  chemically synthesized
gcccatatcttcacccaatgcc

SEQ ID NO: 660312 - DNA, 22 bp, Artificial Sequence
  chemically synthesized
tgcccatatcttcacccaatgc

SEQ ID NO: 660313 - DNA, 22 bp, Artificial Sequence
  chemically synthesized
aaatctcactggcattgggtga

SEQ ID NO: 660314 - DNA, 22 bp, Artificial Sequence
  chemically synthesized
aatctcactggcattgggtgaa

SEQ ID NO: 660315 - DNA, 22 bp, Artificial Sequence
  chemically synthesized
tatctttgcccatatcttcacc

SEQ ID NO: 660316 - DNA, 22 bp, Artificial Sequence
  chemically synthesized
actggcattgggtgaagatatg

SEQ ID NO: 660317 - DNA, 22 bp, Artificial Sequence
  chemically synthesized
gcattgggtgaagatatgggca

SEQ ID NO: 660318 - DNA, 22 bp, Artificial Sequence
  chemically synthesized
ggtgaagatatgggcaaagata

SEQ ID NO: 660319 - DNA, 22 bp, Artificial Sequence
  chemically synthesized
cccagtaatccaaggatgggaa

SEQ ID NO: 660320 - DNA, 22 bp, Artificial Sequence
  chemically synthesized
agatattccccagtaatccaag

SEQ ID NO: 660321 - DNA, 22 bp, Artificial Sequence
  chemically synthesized
tcagatattccccagtaatcca

SEQ ID NO: 660322 - DNA, 22 bp, Artificial Sequence
  chemically synthesized
actctcagatattccccagtaa

SEQ ID NO: 660323 - DNA, 22 bp, Artificial Sequence
  chemically synthesized
ccatccttggattactggggaa

SEQ ID NO: 660324 - DNA, 22 bp, Artificial Sequence
  chemically synthesized
aactctcagatattccccagta

SEQ ID NO: 660325 - DNA, 22 bp, Artificial Sequence
  chemically synthesized
ggattactggggaatatctgag

SEQ ID NO: 660326 - DNA, 22 bp, Artificial Sequence
  chemically synthesized
gattactggggaatatctgaga

SEQ ID NO: 660327 - DNA, 22 bp, Artificial Sequence
  chemically synthesized
ggtccccttaactctcagatat

SEQ ID NO: 660328 - DNA, 22 bp, Artificial Sequence
  chemically synthesized
ctggggaatatctgagagttaa

SEQ ID NO: 660329 - DNA, 22 bp, Artificial Sequence
  chemically synthesized
gggaatatctgagagttaaggg

SEQ ID NO: 660330 - DNA, 22 bp, Artificial Sequence
  chemically synthesized
tgtagaacaggctaggtcccct

SEQ ID NO: 660331 - DNA, 22 bp, Artificial Sequence
  chemically synthesized
atgtagaacaggctaggtcccc

SEQ ID NO: 660332 - DNA, 22 bp, Artificial Sequence
  chemically synthesized
tttatgtagaacaggctaggtc

SEQ ID NO: 660333 - DNA, 22 bp, Artificial Sequence
  chemically synthesized
agagttaaggggacctagcctg

SEQ ID NO: 660334 - DNA, 22 bp, Artificial Sequence
  chemically synthesized
tgtttatgtagaacaggctagg

SEQ ID NO: 660335 - DNA, 22 bp, Artificial Sequence
  chemically synthesized
actctgtttatgtagaacaggc

SEQ ID NO: 660336 - DNA, 22 bp, Artificial Sequence
  chemically synthesized
aggggacctagcctgttctaca

SEQ ID NO: 660337 - DNA, 22 bp, Artificial Sequence
  chemically synthesized
gcctgttctacataaacagagt

SEQ ID NO: 660338 - DNA, 22 bp, Artificial Sequence
  chemically synthesized
aggtgacaattgactctgttta

SEQ ID NO: 660339 - DNA, 22 bp, Artificial Sequence
  chemically synthesized
ttcaggtgacaattgactctgt

SEQ ID NO: 660340 - DNA, 22 bp, Artificial Sequence
  chemically synthesized
attcaggtgacaattgactctg

SEQ ID NO: 660341 - DNA, 22 bp, Artificial Sequence
  chemically synthesized
ttctacataaacagagtcaatt

SEQ ID NO: 660342 - DNA, 22 bp, Artificial Sequence
  chemically synthesized
ttattcaggtgacaattgactc

SEQ ID NO: 660343 - DNA, 22 bp, Artificial Sequence
  chemically synthesized
cttattcaggtgacaattgact

SEQ ID NO: 660344 - DNA, 22 bp, Artificial Sequence
  chemically synthesized
tacataaacagagtcaattgtc

SEQ ID NO: 660345 - DNA, 22 bp, Artificial Sequence
  chemically synthesized
tcttattcaggtgacaattgac

SEQ ID NO: 660346 - DNA, 22 bp, Artificial Sequence
  chemically synthesized
ttcttattcaggtgacaattga

SEQ ID NO: 660347 - DNA, 22 bp, Artificial Sequence
  chemically synthesized
cataaacagagtcaattgtcac

SEQ ID NO: 660348 - DNA, 22 bp, Artificial Sequence
  chemically synthesized
tttcttattcaggtgacaattg

SEQ ID NO: 660349 - DNA, 22 bp, Artificial Sequence
  chemically synthesized
ttttcttattcaggtgacaatt

SEQ ID NO: 660350 - DNA, 22 bp, Artificial Sequence
  chemically synthesized
tttttcttattcaggtgacaat

SEQ ID NO: 660351 - DNA, 22 bp, Artificial Sequence
  chemically synthesized
ttttttcttattcaggtgacaa

SEQ ID NO: 660352 - DNA, 22 bp, Artificial Sequence
  chemically synthesized
tttttttcttattcaggtgaca

SEQ ID NO: 660353 - DNA, 22 bp, Artificial Sequence
  chemically synthesized
aaacattttttttttcttattc

SEQ ID NO: 660354 - DNA, 22 bp, Artificial Sequence
  chemically synthesized
ctaaaacattttttttttctta

SEQ ID NO: 660355 - DNA, 22 bp, Artificial Sequence
  chemically synthesized
tgctaaaacattttttttttct

SEQ ID NO: 660356 - DNA, 22 bp, Artificial Sequence
  chemically synthesized
tcacctgaataagaaaaaaaaa

SEQ ID NO: 660357 - DNA, 22 bp, Artificial Sequence
  chemically synthesized
ctgctaaaacattttttttttc

SEQ ID NO: 660358 - DNA, 22 bp, Artificial Sequence
  chemically synthesized
aataagaaaaaaaaaatgtttt

SEQ ID NO: 660359 - DNA, 22 bp, Artificial Sequence
  chemically synthesized
aaaatttctgctaaaacatttt

SEQ ID NO: 660360 - DNA, 22 bp, Artificial Sequence
  chemically synthesized
aaaaatttctgctaaaacattt

SEQ ID NO: 660361 - DNA, 22 bp, Artificial Sequence
  chemically synthesized
taaaaatttctgctaaaacatt

SEQ ID NO: 660362 - DNA, 22 bp, Artificial Sequence
  chemically synthesized
tttaaaaatttctgctaaaaca

SEQ ID NO: 660363 - DNA, 22 bp, Artificial Sequence
  chemically synthesized
tagcagaaatttttaaagagat

SEQ ID NO: 660364 - DNA, 22 bp, Artificial Sequence
  chemically synthesized
agcagaaatttttaaagagatc

SEQ ID NO: 660365 - DNA, 22 bp, Artificial Sequence
  chemically synthesized
gcagaaatttttaaagagatcc

SEQ ID NO: 660366 - DNA, 22 bp, Artificial Sequence
  chemically synthesized
atacaagaaagtatcatcggat

SEQ ID NO: 660367 - DNA, 22 bp, Artificial Sequence
  chemically synthesized
ttaaagagatccgatgatactt

SEQ ID NO: 660368 - DNA, 22 bp, Artificial Sequence
  chemically synthesized
taaagagatccgatgatacttt

SEQ ID NO: 660369 - DNA, 22 bp, Artificial Sequence
  chemically synthesized
aaagagatccgatgatactttc

SEQ ID NO: 660370 - DNA, 22 bp, Artificial Sequence
  chemically synthesized
atgctaatacaagaaagtatca

SEQ ID NO: 660371 - DNA, 22 bp, Artificial Sequence
  chemically synthesized
aagagatccgatgatactttct

SEQ ID NO: 660372 - DNA, 22 bp, Artificial Sequence
  chemically synthesized
taatgctaatacaagaaagtat

SEQ ID NO: 660373 - DNA, 22 bp, Artificial Sequence
  chemically synthesized
tctaatgctaatacaagaaagt

SEQ ID NO: 660374 - DNA, 22 bp, Artificial Sequence
  chemically synthesized
ctctaatgctaatacaagaaag

SEQ ID NO: 660375 - DNA, 22 bp, Artificial Sequence
  chemically synthesized
acagatcttctctaatgctaat

SEQ ID NO: 660376 - DNA, 22 bp, Artificial Sequence
  chemically synthesized
atctaacagatcttctctaatg

SEQ ID NO: 660377 - DNA, 22 bp, Artificial Sequence
  chemically synthesized
tcttgtattagcattagagaag

SEQ ID NO: 660378 - DNA, 22 bp, Artificial Sequence
  chemically synthesized
cttgtattagcattagagaaga

SEQ ID NO: 660379 - DNA, 22 bp, Artificial Sequence
  chemically synthesized
ttgtattagcattagagaagat

SEQ ID NO: 660380 - DNA, 22 bp, Artificial Sequence
  chemically synthesized
gtattagcattagagaagatct

SEQ ID NO: 660381 - DNA, 22 bp, Artificial Sequence
  chemically synthesized
tattagcattagagaagatctg

SEQ ID NO: 660382 - DNA, 22 bp, Artificial Sequence
  chemically synthesized
gcattagagaagatctgttaga

SEQ ID NO: 660383 - DNA, 22 bp, Artificial Sequence
  chemically synthesized
gccatacagattaatctaacag

SEQ ID NO: 660384 - DNA, 22 bp, Artificial Sequence
  chemically synthesized
agccatacagattaatctaaca

SEQ ID NO: 660385 - DNA, 22 bp, Artificial Sequence
  chemically synthesized
gagaagatctgttagattaatc

SEQ ID NO: 660386 - DNA, 22 bp, Artificial Sequence
  chemically synthesized
cacaaccttagccatacagatt

SEQ ID NO: 660387 - DNA, 22 bp, Artificial Sequence
  chemically synthesized
acacaaccttagccatacagat

SEQ ID NO: 660388 - DNA, 22 bp, Artificial Sequence
  chemically synthesized
ttagattaatctgtatggctaa

SEQ ID NO: 660389 - DNA, 22 bp, Artificial Sequence
  chemically synthesized
gattaatctgtatggctaaggt

SEQ ID NO: 660390 - DNA, 22 bp, Artificial Sequence
  chemically synthesized
atctgtatggctaaggttgtgt

SEQ ID NO: 660391 - DNA, 22 bp, Artificial Sequence
  chemically synthesized
gaaatagagtttacacaacctt

SEQ ID NO: 660392 - DNA, 22 bp, Artificial Sequence
  chemically synthesized
tatggctaaggttgtgtaaact

SEQ ID NO: 660393 - DNA, 22 bp, Artificial Sequence
  chemically synthesized
aggttgtgtaaactctatttct

SEQ ID NO: 660394 - DNA, 22 bp, Artificial Sequence
  chemically synthesized
taaatgcatagctagaaataga

SEQ ID NO: 660395 - DNA, 22 bp, Artificial Sequence
  chemically synthesized
tgtaaactctatttctagctat

SEQ ID NO: 660396 - DNA, 22 bp, Artificial Sequence
  chemically synthesized
atgattataaatgcatagctag

SEQ ID NO: 660397 - DNA, 22 bp, Artificial Sequence
  chemically synthesized
aatgattataaatgcatagcta

SEQ ID NO: 660398 - DNA, 22 bp, Artificial Sequence
  chemically synthesized
tatttctagctatgcatttata

SEQ ID NO: 660399 - DNA, 22 bp, Artificial Sequence
  chemically synthesized
tttctagctatgcatttataat

SEQ ID NO: 660400 - DNA, 22 bp, Artificial Sequence
  chemically synthesized
ctagctatgcatttataatcat

SEQ ID NO: 660401 - DNA, 22 bp, Artificial Sequence
  chemically synthesized
tagctatgcatttataatcatt

SEQ ID NO: 660402 - DNA, 22 bp, Artificial Sequence
  chemically synthesized
gctatgcatttataatcattaa

SEQ ID NO: 660403 - DNA, 22 bp, Artificial Sequence
  chemically synthesized
aaggagaaaagcgcttaatgat

SEQ ID NO: 660404 - DNA, 22 bp, Artificial Sequence
  chemically synthesized
caaggagaaaagcgcttaatga

SEQ ID NO: 660405 - DNA, 22 bp, Artificial Sequence
  chemically synthesized
tgcatttataatcattaagcgc

SEQ ID NO: 660406 - DNA, 22 bp, Artificial Sequence
  chemically synthesized
atatttcaaggagaaaagcgct

SEQ ID NO: 660407 - DNA, 22 bp, Artificial Sequence
  chemically synthesized
ataatcattaagcgcttttctc

SEQ ID NO: 660408 - DNA, 22 bp, Artificial Sequence
  chemically synthesized
taatcattaagcgcttttctcc

SEQ ID NO: 660409 - DNA, 22 bp, Artificial Sequence
  chemically synthesized
aggtgactgatatttcaaggag

SEQ ID NO: 660410 - DNA, 22 bp, Artificial Sequence
  chemically synthesized
agcgcttttctccttgaaatat

SEQ ID NO: 660411 - DNA, 22 bp, Artificial Sequence
  chemically synthesized
ttctccttgaaatatcagtcac

SEQ ID NO: 660412 - DNA, 22 bp, Artificial Sequence
  chemically synthesized
tctccttgaaatatcagtcacc

SEQ ID NO: 660413 - DNA, 22 bp, Artificial Sequence
  chemically synthesized
ctccttgaaatatcagtcacct

SEQ ID NO: 660414 - DNA, 22 bp, Artificial Sequence
  chemically synthesized
tccttgaaatatcagtcacctc

SEQ ID NO: 660415 - DNA, 22 bp, Artificial Sequence
  chemically synthesized
cttgaaatatcagtcacctcag

SEQ ID NO: 660416 - DNA, 22 bp, Artificial Sequence
  chemically synthesized
gaaatatcagtcacctcagcat

SEQ ID NO: 660417 - DNA, 22 bp, Artificial Sequence
  chemically synthesized
aaatatcagtcacctcagcatc

SEQ ID NO: 660418 - DNA, 22 bp, Artificial Sequence
  chemically synthesized
gggtagcagagagatgctgagg

SEQ ID NO: 660419 - DNA, 22 bp, Artificial Sequence
  chemically synthesized
atattagggtagcagagagatg

SEQ ID NO: 660420 - DNA, 22 bp, Artificial Sequence
  chemically synthesized
acctaatattagggtagcagag

SEQ ID NO: 660421 - DNA, 22 bp, Artificial Sequence
  chemically synthesized
cacctaatattagggtagcaga

SEQ ID NO: 660422 - DNA, 22 bp, Artificial Sequence
  chemically synthesized
tcacctaatattagggtagcag

SEQ ID NO: 660423 - DNA, 22 bp, Artificial Sequence
  chemically synthesized
ttcacctaatattagggtagca

SEQ ID NO: 660424 - DNA, 22 bp, Artificial Sequence
  chemically synthesized
tttcacctaatattagggtagc

SEQ ID NO: 660425 - DNA, 22 bp, Artificial Sequence
  chemically synthesized
agcatctctctgctaccctaat

SEQ ID NO: 660426 - DNA, 22 bp, Artificial Sequence
  chemically synthesized
ttttcacctaatattagggtag

SEQ ID NO: 660427 - DNA, 22 bp, Artificial Sequence
  chemically synthesized
tctgctaccctaatattaggtg

SEQ ID NO: 660428 - DNA, 22 bp, Artificial Sequence
  chemically synthesized
tgctaccctaatattaggtgaa

SEQ ID NO: 660429 - DNA, 22 bp, Artificial Sequence
  chemically synthesized
ctaccctaatattaggtgaaaa

SEQ ID NO: 660430 - DNA, 22 bp, Artificial Sequence
  chemically synthesized
gtggagagtatttttttcacct

SEQ ID NO: 660431 - DNA, 22 bp, Artificial Sequence
  chemically synthesized
agtggagagtatttttttcacc

SEQ ID NO: 660432 - DNA, 22 bp, Artificial Sequence
  chemically synthesized
ccctaatattaggtgaaaaaaa

SEQ ID NO: 660433 - DNA, 22 bp, Artificial Sequence
  chemically synthesized
tagtggagagtatttttttcac

SEQ ID NO: 660434 - DNA, 22 bp, Artificial Sequence
  chemically synthesized
atattaggtgaaaaaaatactc

SEQ ID NO: 660435 - DNA, 22 bp, Artificial Sequence
  chemically synthesized
tagaaaattttagtggagagta

SEQ ID NO: 660436 - DNA, 22 bp, Artificial Sequence
  chemically synthesized
ggtgaaaaaaatactctccact

SEQ ID NO: 660437 - DNA, 22 bp, Artificial Sequence
  chemically synthesized
cctatagaaaattttagtggag

SEQ ID NO: 660438 - DNA, 22 bp, Artificial Sequence
  chemically synthesized
gcctatagaaaattttagtgga

SEQ ID NO: 660439 - DNA, 22 bp, Artificial Sequence
  chemically synthesized
gtttgcctatagaaaattttag

SEQ ID NO: 660440 - DNA, 22 bp, Artificial Sequence
  chemically synthesized
agtttgcctatagaaaatttta

SEQ ID NO: 660441 - DNA, 22 bp, Artificial Sequence
  chemically synthesized
tagtttgcctatagaaaatttt

SEQ ID NO: 660442 - DNA, 22 bp, Artificial Sequence
  chemically synthesized
ctttagtttgcctatagaaaat

SEQ ID NO: 660443 - DNA, 22 bp, Artificial Sequence
  chemically synthesized
tccactaaaattttctataggc

SEQ ID NO: 660444 - DNA, 22 bp, Artificial Sequence
  chemically synthesized
cactaaaattttctataggcaa

SEQ ID NO: 660445 - DNA, 22 bp, Artificial Sequence
  chemically synthesized
tgcaattactttagtttgccta

SEQ ID NO: 660446 - DNA, 22 bp, Artificial Sequence
  chemically synthesized
aaattttctataggcaaactaa

SEQ ID NO: 660447 - DNA, 22 bp, Artificial Sequence
  chemically synthesized
tctataggcaaactaaagtaat

SEQ ID NO: 660448 - DNA, 22 bp, Artificial Sequence
  chemically synthesized
ctataggcaaactaaagtaatt

SEQ ID NO: 660449 - DNA, 22 bp, Artificial Sequence
  chemically synthesized
gatagattatgcaattacttta

SEQ ID NO: 660450 - DNA, 22 bp, Artificial Sequence
  chemically synthesized
tataggcaaactaaagtaattg

SEQ ID NO: 660451 - DNA, 22 bp, Artificial Sequence
  chemically synthesized
taggcaaactaaagtaattgca

SEQ ID NO: 660452 - DNA, 22 bp, Artificial Sequence
  chemically synthesized
aaaactggatagattatgcaat

SEQ ID NO: 660453 - DNA, 22 bp, Artificial Sequence
  chemically synthesized
aagtaattgcataatctatcca

SEQ ID NO: 660454 - DNA, 22 bp, Artificial Sequence
  chemically synthesized
aggtctgaaaactggatagatt

SEQ ID NO: 660455 - DNA, 22 bp, Artificial Sequence
  chemically synthesized
cataatctatccagttttcaga

SEQ ID NO: 660456 - DNA, 22 bp, Artificial Sequence
  chemically synthesized
tccagttttcagacctgaggct

SEQ ID NO: 660457 - DNA, 22 bp, Artificial Sequence
  chemically synthesized
tcagacctgaggctcgcttatt

SEQ ID NO: 660458 - DNA, 22 bp, Artificial Sequence
  chemically synthesized
cagacctgaggctcgcttattt

SEQ ID NO: 660459 - DNA, 22 bp, Artificial Sequence
  chemically synthesized
agacctgaggctcgcttatttc

SEQ ID NO: 660460 - DNA, 22 bp, Artificial Sequence
  chemically synthesized
aaggtgaaaggagaaataagcg

SEQ ID NO: 660461 - DNA, 22 bp, Artificial Sequence
  chemically synthesized
gaaggtgaaaggagaaataagc

SEQ ID NO: 660462 - DNA, 22 bp, Artificial Sequence
  chemically synthesized
aggctcgcttatttctcctttc

SEQ ID NO: 660463 - DNA, 22 bp, Artificial Sequence
  chemically synthesized
gcttatttctcctttcaccttc

SEQ ID NO: 660464 - DNA, 22 bp, Artificial Sequence
  chemically synthesized
tgaaatacaatttgaaggtgaa

SEQ ID NO: 660465 - DNA, 22 bp, Artificial Sequence
  chemically synthesized
atttctcctttcaccttcaaat

SEQ ID NO: 660466 - DNA, 22 bp, Artificial Sequence
  chemically synthesized
tttctcctttcaccttcaaatt

SEQ ID NO: 660467 - DNA, 22 bp, Artificial Sequence
  chemically synthesized
ctcctttcaccttcaaattgta

SEQ ID NO: 660468 - DNA, 22 bp, Artificial Sequence
  chemically synthesized
tcctttcaccttcaaattgtat

SEQ ID NO: 660469 - DNA, 22 bp, Artificial Sequence
  chemically synthesized
ctttcaccttcaaattgtattt

SEQ ID NO: 660470 - DNA, 22 bp, Artificial Sequence
  chemically synthesized
gaaagaatattatgaaatacaa

SEQ ID NO: 660471 - DNA, 22 bp, Artificial Sequence
  chemically synthesized
tcaccttcaaattgtatttcat

SEQ ID NO: 660472 - DNA, 22 bp, Artificial Sequence
  chemically synthesized
agaaagaatattatgaaataca

SEQ ID NO: 660473 - DNA, 22 bp, Artificial Sequence
  chemically synthesized
caccttcaaattgtatttcata

SEQ ID NO: 660474 - DNA, 22 bp, Artificial Sequence
  chemically synthesized
accttcaaattgtatttcataa

SEQ ID NO: 660475 - DNA, 22 bp, Artificial Sequence
  chemically synthesized
caaattgtatttcataatattc

SEQ ID NO: 660476 - DNA, 22 bp, Artificial Sequence
  chemically synthesized
aaattgtatttcataatattct

SEQ ID NO: 660477 - DNA, 22 bp, Artificial Sequence
  chemically synthesized
gaggacttagaaagaatattat

SEQ ID NO: 660478 - DNA, 22 bp, Artificial Sequence
  chemically synthesized
ttagaggacttagaaagaatat

SEQ ID NO: 660479 - DNA, 22 bp, Artificial Sequence
  chemically synthesized
tatttcataatattctttctaa

SEQ ID NO: 660480 - DNA, 22 bp, Artificial Sequence
  chemically synthesized
cataatattctttctaagtcct

SEQ ID NO: 660481 - DNA, 22 bp, Artificial Sequence
  chemically synthesized
taaagttgttagaggacttaga

SEQ ID NO: 660482 - DNA, 22 bp, Artificial Sequence
  chemically synthesized
ataatattctttctaagtcctc

SEQ ID NO: 660483 - DNA, 22 bp, Artificial Sequence
  chemically synthesized
ataaagttgttagaggacttag

SEQ ID NO: 660484 - DNA, 22 bp, Artificial Sequence
  chemically synthesized
agccttataaagttgttagagg

SEQ ID NO: 660485 - DNA, 22 bp, Artificial Sequence
  chemically synthesized
tttctaagtcctctaacaactt

SEQ ID NO: 660486 - DNA, 22 bp, Artificial Sequence
  chemically synthesized
cctcagccttataaagttgtta

SEQ ID NO: 660487 - DNA, 22 bp, Artificial Sequence
  chemically synthesized
tctaagtcctctaacaacttta

SEQ ID NO: 660488 - DNA, 22 bp, Artificial Sequence
  chemically synthesized
ctaagtcctctaacaactttat

SEQ ID NO: 660489 - DNA, 22 bp, Artificial Sequence
  chemically synthesized
taagtcctctaacaactttata

SEQ ID NO: 660490 - DNA, 22 bp, Artificial Sequence
  chemically synthesized
ctccctcagccttataaagttg

SEQ ID NO: 660491 - DNA, 22 bp, Artificial Sequence
  chemically synthesized
cctccctcagccttataaagtt

SEQ ID NO: 660492 - DNA, 22 bp, Artificial Sequence
  chemically synthesized
agtcctctaacaactttataag

SEQ ID NO: 660493 - DNA, 22 bp, Artificial Sequence
  chemically synthesized
tcctccctcagccttataaagt

SEQ ID NO: 660494 - DNA, 22 bp, Artificial Sequence
  chemically synthesized
taacaactttataaggctgagg

SEQ ID NO: 660495 - DNA, 22 bp, Artificial Sequence
  chemically synthesized
acaactttataaggctgaggga

SEQ ID NO: 660496 - DNA, 22 bp, Artificial Sequence
  chemically synthesized
agatcaagggaattttcctccc

SEQ ID NO: 660497 - DNA, 22 bp, Artificial Sequence
  chemically synthesized
tataaggctgagggaggaaaat

SEQ ID NO: 660498 - DNA, 22 bp, Artificial Sequence
  chemically synthesized
ataaggctgagggaggaaaatt

SEQ ID NO: 660499 - DNA, 22 bp, Artificial Sequence
  chemically synthesized
taaggctgagggaggaaaattc

SEQ ID NO: 660500 - DNA, 22 bp, Artificial Sequence
  chemically synthesized
ctcagatcaagggaattttcct

SEQ ID NO: 660501 - DNA, 22 bp, Artificial Sequence
  chemically synthesized
agggaggaaaattcccttgatc

SEQ ID NO: 660502 - DNA, 22 bp, Artificial Sequence
  chemically synthesized
aacacctcctcagatcaaggga

SEQ ID NO: 660503 - DNA, 22 bp, Artificial Sequence
  chemically synthesized
ccttgatctgaggaggtgttta

SEQ ID NO: 660504 - DNA, 22 bp, Artificial Sequence
  chemically synthesized
tccccagcataagattaaacac

SEQ ID NO: 660505 - DNA, 22 bp, Artificial Sequence
  chemically synthesized
gatctgaggaggtgtttaatct

SEQ ID NO: 660506 - DNA, 22 bp, Artificial Sequence
  chemically synthesized
gtccccagcataagattaaaca

SEQ ID NO: 660507 - DNA, 22 bp, Artificial Sequence
  chemically synthesized
atctgaggaggtgtttaatctt

SEQ ID NO: 660508 - DNA, 22 bp, Artificial Sequence
  chemically synthesized
tgtccccagcataagattaaac

SEQ ID NO: 660509 - DNA, 22 bp, Artificial Sequence
  chemically synthesized
ttgtccccagcataagattaaa

SEQ ID NO: 660510 - DNA, 22 bp, Artificial Sequence
  chemically synthesized
aggaggtgtttaatcttatgct

SEQ ID NO: 660511 - DNA, 22 bp, Artificial Sequence
  chemically synthesized
aatttttgtccccagcataaga

SEQ ID NO: 660512 - DNA, 22 bp, Artificial Sequence
  chemically synthesized
ttaaatttttgtccccagcata

SEQ ID NO: 660513 - DNA, 22 bp, Artificial Sequence
  chemically synthesized
gttaaatttttgtccccagcat

SEQ ID NO: 660514 - DNA, 22 bp, Artificial Sequence
  chemically synthesized
tgttaaatttttgtccccagca

SEQ ID NO: 660515 - DNA, 22 bp, Artificial Sequence
  chemically synthesized
ttgttaaatttttgtccccagc

SEQ ID NO: 660516 - DNA, 22 bp, Artificial Sequence
  chemically synthesized
aatcttatgctggggacaaaaa

SEQ ID NO: 660517 - DNA, 22 bp, Artificial Sequence
  chemically synthesized
acttttgttaaatttttgtccc

SEQ ID NO: 660518 - DNA, 22 bp, Artificial Sequence
  chemically synthesized
atcttatgctggggacaaaaat

SEQ ID NO: 660519 - DNA, 22 bp, Artificial Sequence
  chemically synthesized
cacttttgttaaatttttgtcc

SEQ ID NO: 660520 - DNA, 22 bp, Artificial Sequence
  chemically synthesized
atgctggggacaaaaatttaac

SEQ ID NO: 660521 - DNA, 22 bp, Artificial Sequence
  chemically synthesized
tgctggggacaaaaatttaaca

SEQ ID NO: 660522 - DNA, 22 bp, Artificial Sequence
  chemically synthesized
aagtttcacttttgttaaattt

SEQ ID NO: 660523 - DNA, 22 bp, Artificial Sequence
  chemically synthesized
gggacaaaaatttaacaaaagt

SEQ ID NO: 660524 - DNA, 22 bp, Artificial Sequence
  chemically synthesized
gacaaggttgaagtttcacttt

SEQ ID NO: 660525 - DNA, 22 bp, Artificial Sequence
  chemically synthesized
atgttggacaaggttgaagttt

SEQ ID NO: 660526 - DNA, 22 bp, Artificial Sequence
  chemically synthesized
aacaaaagtgaaacttcaacct

SEQ ID NO: 660527 - DNA, 22 bp, Artificial Sequence
  chemically synthesized
acaaaagtgaaacttcaacctt

SEQ ID NO: 660528 - DNA, 22 bp, Artificial Sequence
  chemically synthesized
ctgatgttggacaaggttgaag

SEQ ID NO: 660529 - DNA, 22 bp, Artificial Sequence
  chemically synthesized
gctgatgttggacaaggttgaa

SEQ ID NO: 660530 - DNA, 22 bp, Artificial Sequence
  chemically synthesized
tgatttgctgatgttggacaag

SEQ ID NO: 660531 - DNA, 22 bp, Artificial Sequence
  chemically synthesized
gtgatttgctgatgttggacaa

SEQ ID NO: 660532 - DNA, 22 bp, Artificial Sequence
  chemically synthesized
caaccttgtccaacatcagcaa

SEQ ID NO: 660533 - DNA, 22 bp, Artificial Sequence
  chemically synthesized
aaccttgtccaacatcagcaaa

SEQ ID NO: 660534 - DNA, 22 bp, Artificial Sequence
  chemically synthesized
ggaataaagcttgtgatttgct

SEQ ID NO: 660535 - DNA, 22 bp, Artificial Sequence
  chemically synthesized
gggaataaagcttgtgatttgc

SEQ ID NO: 660536 - DNA, 22 bp, Artificial Sequence
  chemically synthesized
gtccaacatcagcaaatcacaa

SEQ ID NO: 660537 - DNA, 22 bp, Artificial Sequence
  chemically synthesized
tccaacatcagcaaatcacaag

SEQ ID NO: 660538 - DNA, 22 bp, Artificial Sequence
  chemically synthesized
atgacacttgggaataaagctt

SEQ ID NO: 660539 - DNA, 22 bp, Artificial Sequence
  chemically synthesized
catgacacttgggaataaagct

SEQ ID NO: 660540 - DNA, 22 bp, Artificial Sequence
  chemically synthesized
tcatgacacttgggaataaagc

SEQ ID NO: 660541 - DNA, 22 bp, Artificial Sequence
  chemically synthesized
ttcatgacacttgggaataaag

SEQ ID NO: 660542 - DNA, 22 bp, Artificial Sequence
  chemically synthesized
gagaaatgcatcttttcatgac

SEQ ID NO: 660543 - DNA, 22 bp, Artificial Sequence
  chemically synthesized
tattcccaagtgtcatgaaaag

SEQ ID NO: 660544 - DNA, 22 bp, Artificial Sequence
  chemically synthesized
agagaaatgcatcttttcatga

SEQ ID NO: 660545 - DNA, 22 bp, Artificial Sequence
  chemically synthesized
attcccaagtgtcatgaaaaga

SEQ ID NO: 660546 - DNA, 22 bp, Artificial Sequence
  chemically synthesized
tagagaaatgcatcttttcatg

SEQ ID NO: 660547 - DNA, 22 bp, Artificial Sequence
  chemically synthesized
ttcccaagtgtcatgaaaagat

SEQ ID NO: 660548 - DNA, 22 bp, Artificial Sequence
  chemically synthesized
ccaagtgtcatgaaaagatgca

SEQ ID NO: 660549 - DNA, 22 bp, Artificial Sequence
  chemically synthesized
gctttagagaaatgcatctttt

SEQ ID NO: 660550 - DNA, 22 bp, Artificial Sequence
  chemically synthesized
ataaattggctttagagaaatg

SEQ ID NO: 660551 - DNA, 22 bp, Artificial Sequence
  chemically synthesized
gctaataaattggctttagaga

SEQ ID NO: 660552 - DNA, 22 bp, Artificial Sequence
  chemically synthesized
ggctaataaattggctttagag

SEQ ID NO: 660553 - DNA, 22 bp, Artificial Sequence
  chemically synthesized
gtttggctaataaattggcttt

SEQ ID NO: 660554 - DNA, 22 bp, Artificial Sequence
  chemically synthesized
tagtttggctaataaattggct

SEQ ID NO: 660555 - DNA, 22 bp, Artificial Sequence
  chemically synthesized
ctagtttggctaataaattggc

SEQ ID NO: 660556 - DNA, 22 bp, Artificial Sequence
  chemically synthesized
ctctaaagccaatttattagcc

SEQ ID NO: 660557 - DNA, 22 bp, Artificial Sequence
  chemically synthesized
tgtttctagtttggctaataaa

SEQ ID NO: 660558 - DNA, 22 bp, Artificial Sequence
  chemically synthesized
tctaaagccaatttattagcca

SEQ ID NO: 660559 - DNA, 22 bp, Artificial Sequence
  chemically synthesized
taaagccaatttattagccaaa

SEQ ID NO: 660560 - DNA, 22 bp, Artificial Sequence
  chemically synthesized
ttgtgtttctagtttggctaat

SEQ ID NO: 660561 - DNA, 22 bp, Artificial Sequence
  chemically synthesized
aagccaatttattagccaaact

SEQ ID NO: 660562 - DNA, 22 bp, Artificial Sequence
  chemically synthesized
attagccaaactagaaacacaa

SEQ ID NO: 660563 - DNA, 22 bp, Artificial Sequence
  chemically synthesized
ttagccaaactagaaacacaac

SEQ ID NO: 660564 - DNA, 22 bp, Artificial Sequence
  chemically synthesized
gccaaactagaaacacaacaac

SEQ ID NO: 660565 - DNA, 22 bp, Artificial Sequence
  chemically synthesized
gaaacacaacaacattgctttt

SEQ ID NO: 660566 - DNA, 22 bp, Artificial Sequence
  chemically synthesized
ggtgtataaggtagtataaaag

SEQ ID NO: 660567 - DNA, 22 bp, Artificial Sequence
  chemically synthesized
aggtgtataaggtagtataaaa

SEQ ID NO: 660568 - DNA, 22 bp, Artificial Sequence
  chemically synthesized
cttttatactaccttatacacc

SEQ ID NO: 660569 - DNA, 22 bp, Artificial Sequence
  chemically synthesized
caaccagagcttaggtgtataa

SEQ ID NO: 660570 - DNA, 22 bp, Artificial Sequence
  chemically synthesized
ttatactaccttatacacctaa

SEQ ID NO: 660571 - DNA, 22 bp, Artificial Sequence
  chemically synthesized
tatactaccttatacacctaag

SEQ ID NO: 660572 - DNA, 22 bp, Artificial Sequence
  chemically synthesized
atactaccttatacacctaagc

SEQ ID NO: 660573 - DNA, 22 bp, Artificial Sequence
  chemically synthesized
tactaccttatacacctaagct

SEQ ID NO: 660574 - DNA, 22 bp, Artificial Sequence
  chemically synthesized
agaattccaaccagagcttagg

SEQ ID NO: 660575 - DNA, 22 bp, Artificial Sequence
  chemically synthesized
ccttatacacctaagctctggt

SEQ ID NO: 660576 - DNA, 22 bp, Artificial Sequence
  chemically synthesized
atacacctaagctctggttgga

SEQ ID NO: 660577 - DNA, 22 bp, Artificial Sequence
  chemically synthesized
tacacctaagctctggttggaa

SEQ ID NO: 660578 - DNA, 22 bp, Artificial Sequence
  chemically synthesized
aaaggactgagaattccaacca

SEQ ID NO: 660579 - DNA, 22 bp, Artificial Sequence
  chemically synthesized
cctcaaaggactgagaattcca

SEQ ID NO: 660580 - DNA, 22 bp, Artificial Sequence
  chemically synthesized
gcctcaaaggactgagaattcc

SEQ ID NO: 660581 - DNA, 22 bp, Artificial Sequence
  chemically synthesized
agctctggttggaattctcagt

SEQ ID NO: 660582 - DNA, 22 bp, Artificial Sequence
  chemically synthesized
cttgcctcaaaggactgagaat

SEQ ID NO: 660583 - DNA, 22 bp, Artificial Sequence
  chemically synthesized
tggttggaattctcagtccttt

SEQ ID NO: 660584 - DNA, 22 bp, Artificial Sequence
  chemically synthesized
attccttgcctcaaaggactga

SEQ ID NO: 660585 - DNA, 22 bp, Artificial Sequence
  chemically synthesized
gttggaattctcagtcctttga

SEQ ID NO: 660586 - DNA, 22 bp, Artificial Sequence
  chemically synthesized
gaattctcagtcctttgaggca

SEQ ID NO: 660587 - DNA, 22 bp, Artificial Sequence
  chemically synthesized
gcattgattccttgcctcaaag

SEQ ID NO: 660588 - DNA, 22 bp, Artificial Sequence
  chemically synthesized
attagcattgattccttgcctc

SEQ ID NO: 660589 - DNA, 22 bp, Artificial Sequence
  chemically synthesized
aattagcattgattccttgcct

SEQ ID NO: 660590 - DNA, 22 bp, Artificial Sequence
  chemically synthesized
tcagtcctttgaggcaaggaat

SEQ ID NO: 660591 - DNA, 22 bp, Artificial Sequence
  chemically synthesized
agtcctttgaggcaaggaatca

SEQ ID NO: 660592 - DNA, 22 bp, Artificial Sequence
  chemically synthesized
cttaattagcattgattccttg

SEQ ID NO: 660593 - DNA, 22 bp, Artificial Sequence
  chemically synthesized
acttaattagcattgattcctt

SEQ ID NO: 660594 - DNA, 22 bp, Artificial Sequence
  chemically synthesized
tgaggcaaggaatcaatgctaa

SEQ ID NO: 660595 - DNA, 22 bp, Artificial Sequence
  chemically synthesized
gaggcaaggaatcaatgctaat

SEQ ID NO: 660596 - DNA, 22 bp, Artificial Sequence
  chemically synthesized
aggcaaggaatcaatgctaatt

SEQ ID NO: 660597 - DNA, 22 bp, Artificial Sequence
  chemically synthesized
gatgcatgagagatttacttaa

SEQ ID NO: 660598 - DNA, 22 bp, Artificial Sequence
  chemically synthesized
cccctagatgcatgagagattt

SEQ ID NO: 660599 - DNA, 22 bp, Artificial Sequence
  chemically synthesized
ccccctagatgcatgagagatt

SEQ ID NO: 660600 - DNA, 22 bp, Artificial Sequence
  chemically synthesized
attaagtaaatctctcatgcat

SEQ ID NO: 660601 - DNA, 22 bp, Artificial Sequence
  chemically synthesized
ccccttccccctagatgcatga

SEQ ID NO: 660602 - DNA, 22 bp, Artificial Sequence
  chemically synthesized
agtaaatctctcatgcatctag

SEQ ID NO: 660603 - DNA, 22 bp, Artificial Sequence
  chemically synthesized
aattgccccttccccctagatg

SEQ ID NO: 660604 - DNA, 22 bp, Artificial Sequence
  chemically synthesized
taattgaattgccccttccccc

SEQ ID NO: 660605 - DNA, 22 bp, Artificial Sequence
  chemically synthesized
tcatgcatctagggggaagggg

SEQ ID NO: 660606 - DNA, 22 bp, Artificial Sequence
  chemically synthesized
ataattgaattgccccttcccc

SEQ ID NO: 660607 - DNA, 22 bp, Artificial Sequence
  chemically synthesized
atgcatctagggggaaggggca

SEQ ID NO: 660608 - DNA, 22 bp, Artificial Sequence
  chemically synthesized
catttataattgaattgcccct

SEQ ID NO: 660609 - DNA, 22 bp, Artificial Sequence
  chemically synthesized
gggggaaggggcaattcaatta

SEQ ID NO: 660610 - DNA, 22 bp, Artificial Sequence
  chemically synthesized
tgtgaactacatttataattga

SEQ ID NO: 660611 - DNA, 22 bp, Artificial Sequence
  chemically synthesized
atgtgaactacatttataattg

SEQ ID NO: 660612 - DNA, 22 bp, Artificial Sequence
  chemically synthesized
tttatgtgaactacatttataa

SEQ ID NO: 660613 - DNA, 22 bp, Artificial Sequence
  chemically synthesized
tatttatgtgaactacatttat

SEQ ID NO: 660614 - DNA, 22 bp, Artificial Sequence
  chemically synthesized
cctctatttatgtgaactacat

SEQ ID NO: 660615 - DNA, 22 bp, Artificial Sequence
  chemically synthesized
acctctatttatgtgaactaca

SEQ ID NO: 660616 - DNA, 22 bp, Artificial Sequence
  chemically synthesized
aattataaatgtagttcacata

SEQ ID NO: 660617 - DNA, 22 bp, Artificial Sequence
  chemically synthesized
taaatgtagttcacataaatag

SEQ ID NO: 660618 - DNA, 22 bp, Artificial Sequence
  chemically synthesized
agcgggatttacctctatttat

SEQ ID NO: 660619 - DNA, 22 bp, Artificial Sequence
  chemically synthesized
ctgagcgggatttacctctatt

SEQ ID NO: 660620 - DNA, 22 bp, Artificial Sequence
  chemically synthesized
actgagcgggatttacctctat

SEQ ID NO: 660621 - DNA, 22 bp, Artificial Sequence
  chemically synthesized
acataaatagaggtaaatcccg

SEQ ID NO: 660622 - DNA, 22 bp, Artificial Sequence
  chemically synthesized
ggaaaggtgtttactgagcggg

SEQ ID NO: 660623 - DNA, 22 bp, Artificial Sequence
  chemically synthesized
ctgggaaaggtgtttactgagc

SEQ ID NO: 660624 - DNA, 22 bp, Artificial Sequence
  chemically synthesized
ttactgggaaaggtgtttactg

SEQ ID NO: 660625 - DNA, 22 bp, Artificial Sequence
  chemically synthesized
attactgggaaaggtgtttact

SEQ ID NO: 660626 - DNA, 22 bp, Artificial Sequence
  chemically synthesized
tattactgggaaaggtgtttac

SEQ ID NO: 660627 - DNA, 22 bp, Artificial Sequence
  chemically synthesized
tttattactgggaaaggtgttt

SEQ ID NO: 660628 - DNA, 22 bp, Artificial Sequence
  chemically synthesized
ctttattactgggaaaggtgtt

SEQ ID NO: 660629 - DNA, 22 bp, Artificial Sequence
  chemically synthesized
catttctttattactgggaaag

SEQ ID NO: 660630 - DNA, 22 bp, Artificial Sequence
  chemically synthesized
gcatttctttattactgggaaa

SEQ ID NO: 660631 - DNA, 22 bp, Artificial Sequence
  chemically synthesized
agtaaacacctttcccagtaat

SEQ ID NO: 660632 - DNA, 22 bp, Artificial Sequence
  chemically synthesized
agtttgcatttctttattactg

SEQ ID NO: 660633 - DNA, 22 bp, Artificial Sequence
  chemically synthesized
aagtttgcatttctttattact

SEQ ID NO: 660634 - DNA, 22 bp, Artificial Sequence
  chemically synthesized
aagccttaagtttgcatttctt

SEQ ID NO: 660635 - DNA, 22 bp, Artificial Sequence
  chemically synthesized
tcccagtaataaagaaatgcaa

SEQ ID NO: 660636 - DNA, 22 bp, Artificial Sequence
  chemically synthesized
cccagtaataaagaaatgcaaa

SEQ ID NO: 660637 - DNA, 22 bp, Artificial Sequence
  chemically synthesized
ccagtaataaagaaatgcaaac

SEQ ID NO: 660638 - DNA, 22 bp, Artificial Sequence
  chemically synthesized
taaaatatactaaagccttaag

SEQ ID NO: 660639 - DNA, 22 bp, Artificial Sequence
  chemically synthesized
gtaaaatatactaaagccttaa

SEQ ID NO: 660640 - DNA, 22 bp, Artificial Sequence
  chemically synthesized
aaggctttagtatattttacaa

SEQ ID NO: 660641 - DNA, 22 bp, Artificial Sequence
  chemically synthesized
gccatgaataacttgtaaaata

SEQ ID NO: 660642 - DNA, 22 bp, Artificial Sequence
  chemically synthesized
aggctttagtatattttacaag

SEQ ID NO: 660643 - DNA, 22 bp, Artificial Sequence
  chemically synthesized
gaactggccatgaataacttgt

SEQ ID NO: 660644 - DNA, 22 bp, Artificial Sequence
  chemically synthesized
tagtatattttacaagttattc

SEQ ID NO: 660645 - DNA, 22 bp, Artificial Sequence
  chemically synthesized
agtatattttacaagttattca

SEQ ID NO: 660646 - DNA, 22 bp, Artificial Sequence
  chemically synthesized
gtatattttacaagttattcat

SEQ ID NO: 660647 - DNA, 22 bp, Artificial Sequence
  chemically synthesized
attagaactggccatgaataac

SEQ ID NO: 660648 - DNA, 22 bp, Artificial Sequence
  chemically synthesized
aattagaactggccatgaataa

SEQ ID NO: 660649 - DNA, 22 bp, Artificial Sequence
  chemically synthesized
tacaagttattcatggccagtt

SEQ ID NO: 660650 - DNA, 22 bp, Artificial Sequence
  chemically synthesized
atatttaattagaactggccat

SEQ ID NO: 660651 - DNA, 22 bp, Artificial Sequence
  chemically synthesized
acaagttattcatggccagttc

SEQ ID NO: 660652 - DNA, 22 bp, Artificial Sequence
  chemically synthesized
aatatttaattagaactggcca

SEQ ID NO: 660653 - DNA, 22 bp, Artificial Sequence
  chemically synthesized
caagttattcatggccagttct

SEQ ID NO: 660654 - DNA, 22 bp, Artificial Sequence
  chemically synthesized
ttaatatttaattagaactggc

SEQ ID NO: 660655 - DNA, 22 bp, Artificial Sequence
  chemically synthesized
cttaatatttaattagaactgg

SEQ ID NO: 660656 - DNA, 22 bp, Artificial Sequence
  chemically synthesized
tcttaatatttaattagaactg

SEQ ID NO: 660657 - DNA, 22 bp, Artificial Sequence
  chemically synthesized
ttcttaatatttaattagaact

SEQ ID NO: 660658 - DNA, 22 bp, Artificial Sequence
  chemically synthesized
tttcttaatatttaattagaac

SEQ ID NO: 660659 - DNA, 22 bp, Artificial Sequence
  chemically synthesized
ttttcttaatatttaattagaa

SEQ ID NO: 660660 - DNA, 22 bp, Artificial Sequence
  chemically synthesized
ttcatggccagttctaattaaa

SEQ ID NO: 660661 - DNA, 22 bp, Artificial Sequence
  chemically synthesized
tttttttcttaatatttaatta

SEQ ID NO: 660662 - DNA, 22 bp, Artificial Sequence
  chemically synthesized
atggccagttctaattaaatat

SEQ ID NO: 660663 - DNA, 22 bp, Artificial Sequence
  chemically synthesized
gtttttttcttaatatttaatt

SEQ ID NO: 660664 - DNA, 22 bp, Artificial Sequence
  chemically synthesized
tgtttttttcttaatatttaat

SEQ ID NO: 660665 - DNA, 22 bp, Artificial Sequence
  chemically synthesized
ttgtttttttcttaatatttaa

SEQ ID NO: 660666 - DNA, 22 bp, Artificial Sequence
  chemically synthesized
tttttgtttttttcttaatatt

SEQ ID NO: 660667 - DNA, 22 bp, Artificial Sequence
  chemically synthesized
taattaaatattaagaaaaaaa

SEQ ID NO: 660668 - DNA, 22 bp, Artificial Sequence
  chemically synthesized
accactatttttgtttttttct

SEQ ID NO: 660669 - DNA, 22 bp, Artificial Sequence
  chemically synthesized
attaaatattaagaaaaaaaca

SEQ ID NO: 660670 - DNA, 22 bp, Artificial Sequence
  chemically synthesized
aatattaagaaaaaaacaaaaa

SEQ ID NO: 660671 - DNA, 22 bp, Artificial Sequence
  chemically synthesized
cataggtattaaccactatttt

SEQ ID NO: 660672 - DNA, 22 bp, Artificial Sequence
  chemically synthesized
agaaaaaaacaaaaatagtggt

SEQ ID NO: 660673 - DNA, 22 bp, Artificial Sequence
  chemically synthesized
cacaaacctacataggtattaa

SEQ ID NO: 660674 - DNA, 22 bp, Artificial Sequence
  chemically synthesized
gcacaaacctacataggtatta

SEQ ID NO: 660675 - DNA, 22 bp, Artificial Sequence
  chemically synthesized
tgcacaaacctacataggtatt

SEQ ID NO: 660676 - DNA, 22 bp, Artificial Sequence
  chemically synthesized
ttgcacaaacctacataggtat

SEQ ID NO: 660677 - DNA, 22 bp, Artificial Sequence
  chemically synthesized
atacctatgtaggtttgtgcaa

SEQ ID NO: 660678 - DNA, 22 bp, Artificial Sequence
  chemically synthesized
tgtaggtttgtgcaaaaatact

SEQ ID NO: 660679 - DNA, 22 bp, Artificial Sequence
  chemically synthesized
gtgcaaaaatacttttccacct

SEQ ID NO: 660680 - DNA, 22 bp, Artificial Sequence
  chemically synthesized
tgcaaaaatacttttccaccta

SEQ ID NO: 660681 - DNA, 22 bp, Artificial Sequence
  chemically synthesized
aaagagaaaaatgtgtgcgcaa

SEQ ID NO: 660682 - DNA, 22 bp, Artificial Sequence
  chemically synthesized
ttccacctatattgcgcacaca

SEQ ID NO: 660683 - DNA, 22 bp, Artificial Sequence
  chemically synthesized
aaaagagaaaaatgtgtgcgca

SEQ ID NO: 660684 - DNA, 22 bp, Artificial Sequence
  chemically synthesized
tccacctatattgcgcacacat

SEQ ID NO: 660685 - DNA, 22 bp, Artificial Sequence
  chemically synthesized
taaaagagaaaaatgtgtgcgc

SEQ ID NO: 660686 - DNA, 22 bp, Artificial Sequence
  chemically synthesized
ccacctatattgcgcacacatt

SEQ ID NO: 660687 - DNA, 22 bp, Artificial Sequence
  chemically synthesized
ttaaaagagaaaaatgtgtgcg

SEQ ID NO: 660688 - DNA, 22 bp, Artificial Sequence
  chemically synthesized
cacctatattgcgcacacattt

SEQ ID NO: 660689 - DNA, 22 bp, Artificial Sequence
  chemically synthesized
tttaaaagagaaaaatgtgtgc

SEQ ID NO: 660690 - DNA, 22 bp, Artificial Sequence
  chemically synthesized
ttttaaaagagaaaaatgtgtg

SEQ ID NO: 660691 - DNA, 22 bp, Artificial Sequence
  chemically synthesized
tttttaaaagagaaaaatgtgt

SEQ ID NO: 660692 - DNA, 22 bp, Artificial Sequence
  chemically synthesized
ctttttttaaaagagaaaaatg

SEQ ID NO: 660693 - DNA, 22 bp, Artificial Sequence
  chemically synthesized
tattgcgcacacatttttctct

SEQ ID NO: 660694 - DNA, 22 bp, Artificial Sequence
  chemically synthesized
cctttttttaaaagagaaaaat

SEQ ID NO: 660695 - DNA, 22 bp, Artificial Sequence
  chemically synthesized
tcctttttttaaaagagaaaaa

SEQ ID NO: 660696 - DNA, 22 bp, Artificial Sequence
  chemically synthesized
ttttcctttttttaaaagagaa

SEQ ID NO: 660697 - DNA, 22 bp, Artificial Sequence
  chemically synthesized
cgcacacatttttctcttttaa

SEQ ID NO: 660698 - DNA, 22 bp, Artificial Sequence
  chemically synthesized
tgttttcctttttttaaaagag

SEQ ID NO: 660699 - DNA, 22 bp, Artificial Sequence
  chemically synthesized
ctgttttcctttttttaaaaga

SEQ ID NO: 660700 - DNA, 22 bp, Artificial Sequence
  chemically synthesized
tctgttttcctttttttaaaag

SEQ ID NO: 660701 - DNA, 22 bp, Artificial Sequence
  chemically synthesized
ttctcttttaaaaaaaggaaaa

SEQ ID NO: 660702 - DNA, 22 bp, Artificial Sequence
  chemically synthesized
caggattttctgttttcctttt

SEQ ID NO: 660703 - DNA, 22 bp, Artificial Sequence
  chemically synthesized
tctcttttaaaaaaaggaaaac

SEQ ID NO: 660704 - DNA, 22 bp, Artificial Sequence
  chemically synthesized
ctcttttaaaaaaaggaaaaca

SEQ ID NO: 660705 - DNA, 22 bp, Artificial Sequence
  chemically synthesized
tcttttaaaaaaaggaaaacag

SEQ ID NO: 660706 - DNA, 22 bp, Artificial Sequence
  chemically synthesized
ttttaaaaaaaggaaaacagaa

SEQ ID NO: 660707 - DNA, 22 bp, Artificial Sequence
  chemically synthesized
ttaaaaaaaggaaaacagaaaa

SEQ ID NO: 660708 - DNA, 22 bp, Artificial Sequence
  chemically synthesized
taaaaaaaggaaaacagaaaat

SEQ ID NO: 660709 - DNA, 22 bp, Artificial Sequence
  chemically synthesized
aaaaaaaggaaaacagaaaatc

SEQ ID NO: 660710 - DNA, 22 bp, Artificial Sequence
  chemically synthesized
gggaaactccaggattttctgt

SEQ ID NO: 660711 - DNA, 22 bp, Artificial Sequence
  chemically synthesized
aaaaaaggaaaacagaaaatcc

SEQ ID NO: 660712 - DNA, 22 bp, Artificial Sequence
  chemically synthesized
tggggaaactccaggattttct

SEQ ID NO: 660713 - DNA, 22 bp, Artificial Sequence
  chemically synthesized
ctggggaaactccaggattttc

SEQ ID NO: 660714 - DNA, 22 bp, Artificial Sequence
  chemically synthesized
atgcttctggggaaactccagg

SEQ ID NO: 660715 - DNA, 22 bp, Artificial Sequence
  chemically synthesized
catgcttctggggaaactccag

SEQ ID NO: 660716 - DNA, 22 bp, Artificial Sequence
  chemically synthesized
tttcatgcttctggggaaactc

SEQ ID NO: 660717 - DNA, 22 bp, Artificial Sequence
  chemically synthesized
gagtttccccagaagcatgaaa

SEQ ID NO: 660718 - DNA, 22 bp, Artificial Sequence
  chemically synthesized
caccaccatgtctgtttcatgc

SEQ ID NO: 660719 - DNA, 22 bp, Artificial Sequence
  chemically synthesized
ccaccaccatgtctgtttcatg

SEQ ID NO: 660720 - DNA, 22 bp, Artificial Sequence
  chemically synthesized
ccccagaagcatgaaacagaca

SEQ ID NO: 660721 - DNA, 22 bp, Artificial Sequence
  chemically synthesized
cttccaccaccatgtctgtttc

SEQ ID NO: 660722 - DNA, 22 bp, Artificial Sequence
  chemically synthesized
cccagaagcatgaaacagacat

SEQ ID NO: 660723 - DNA, 22 bp, Artificial Sequence
  chemically synthesized
ctgcttccaccaccatgtctgt

SEQ ID NO: 660724 - DNA, 22 bp, Artificial Sequence
  chemically synthesized
caagggaggagtgcagactcct

SEQ ID NO: 660725 - DNA, 22 bp, Artificial Sequence
  chemically synthesized
ccaagggaggagtgcagactcc

SEQ ID NO: 660726 - DNA, 22 bp, Artificial Sequence
  chemically synthesized
ccttccaagggaggagtgcaga

SEQ ID NO: 660727 - DNA, 22 bp, Artificial Sequence
  chemically synthesized
cccttccaagggaggagtgcag

SEQ ID NO: 660728 - DNA, 22 bp, Artificial Sequence
  chemically synthesized
cactcctcccttggaagggaag

SEQ ID NO: 660729 - DNA, 22 bp, Artificial Sequence
  chemically synthesized
ctcccttggaagggaaggcccc

SEQ ID NO: 660730 - DNA, 22 bp, Artificial Sequence
  chemically synthesized
agagcaaaaacagaggggcctt

SEQ ID NO: 660731 - DNA, 22 bp, Artificial Sequence
  chemically synthesized
ccttggaagggaaggcccctct

SEQ ID NO: 660732 - DNA, 22 bp, Artificial Sequence
  chemically synthesized
cagagcaaaaacagaggggcct

SEQ ID NO: 660733 - DNA, 22 bp, Artificial Sequence
  chemically synthesized
ggaagggaaggcccctctgttt

SEQ ID NO: 660734 - DNA, 22 bp, Artificial Sequence
  chemically synthesized
gaagggaaggcccctctgtttt

SEQ ID NO: 660735 - DNA, 22 bp, Artificial Sequence
  chemically synthesized
gagtatttcagagcaaaaacag

SEQ ID NO: 660736 - DNA, 22 bp, Artificial Sequence
  chemically synthesized
agagtatttcagagcaaaaaca

SEQ ID NO: 660737 - DNA, 22 bp, Artificial Sequence
  chemically synthesized
tagagtatttcagagcaaaaac

SEQ ID NO: 660738 - DNA, 22 bp, Artificial Sequence
  chemically synthesized
tctttagagtatttcagagcaa

SEQ ID NO: 660739 - DNA, 22 bp, Artificial Sequence
  chemically synthesized
tatctttagagtatttcagagc

SEQ ID NO: 660740 - DNA, 22 bp, Artificial Sequence
  chemically synthesized
tctatctttagagtatttcaga

SEQ ID NO: 660741 - DNA, 22 bp, Artificial Sequence
  chemically synthesized
ctctatctttagagtatttcag

SEQ ID NO: 660742 - DNA, 22 bp, Artificial Sequence
  chemically synthesized
tgtttttgctctgaaatactct

SEQ ID NO: 660743 - DNA, 22 bp, Artificial Sequence
  chemically synthesized
tttttgctctgaaatactctaa

SEQ ID NO: 660744 - DNA, 22 bp, Artificial Sequence
  chemically synthesized
ttgctctgaaatactctaaaga

SEQ ID NO: 660745 - DNA, 22 bp, Artificial Sequence
  chemically synthesized
tgctctgaaatactctaaagat

SEQ ID NO: 660746 - DNA, 22 bp, Artificial Sequence
  chemically synthesized
gctctgaaatactctaaagata

SEQ ID NO: 660747 - DNA, 22 bp, Artificial Sequence
  chemically synthesized
ctctgaaatactctaaagatag

SEQ ID NO: 660748 - DNA, 22 bp, Artificial Sequence
  chemically synthesized
tgaaatactctaaagatagaga

SEQ ID NO: 660749 - DNA, 22 bp, Artificial Sequence
  chemically synthesized
aaatactctaaagatagagaaa

SEQ ID NO: 660750 - DNA, 22 bp, Artificial Sequence
  chemically synthesized
catgaaaagggtcatttctcta

SEQ ID NO: 660751 - DNA, 22 bp, Artificial Sequence
  chemically synthesized
ccatgaaaagggtcatttctct

SEQ ID NO: 660752 - DNA, 22 bp, Artificial Sequence
  chemically synthesized
taaagatagagaaatgaccctt

SEQ ID NO: 660753 - DNA, 22 bp, Artificial Sequence
  chemically synthesized
agcttccatgaaaagggtcatt

SEQ ID NO: 660754 - DNA, 22 bp, Artificial Sequence
  chemically synthesized
aagatagagaaatgaccctttt

SEQ ID NO: 660755 - DNA, 22 bp, Artificial Sequence
  chemically synthesized
aagaaagtctcagcttccatga

SEQ ID NO: 660756 - DNA, 22 bp, Artificial Sequence
  chemically synthesized
aaagaaagtctcagcttccatg

SEQ ID NO: 660757 - DNA, 22 bp, Artificial Sequence
  chemically synthesized
taaagaaagtctcagcttccat

SEQ ID NO: 660758 - DNA, 22 bp, Artificial Sequence
  chemically synthesized
ccactttaaagaaagtctcagc

SEQ ID NO: 660759 - DNA, 22 bp, Artificial Sequence
  chemically synthesized
ttcatggaagctgagactttct

SEQ ID NO: 660760 - DNA, 22 bp, Artificial Sequence
  chemically synthesized
ctcccactttaaagaaagtctc

SEQ ID NO: 660761 - DNA, 22 bp, Artificial Sequence
  chemically synthesized
tcatggaagctgagactttctt

SEQ ID NO: 660762 - DNA, 22 bp, Artificial Sequence
  chemically synthesized
cctcccactttaaagaaagtct

SEQ ID NO: 660763 - DNA, 22 bp, Artificial Sequence
  chemically synthesized
catggaagctgagactttcttt

SEQ ID NO: 660764 - DNA, 22 bp, Artificial Sequence
  chemically synthesized
atggaagctgagactttcttta

SEQ ID NO: 660765 - DNA, 22 bp, Artificial Sequence
  chemically synthesized
cttcctcccactttaaagaaag

SEQ ID NO: 660766 - DNA, 22 bp, Artificial Sequence
  chemically synthesized
ccttcctcccactttaaagaaa

SEQ ID NO: 660767 - DNA, 22 bp, Artificial Sequence
  chemically synthesized
tcttccttcctcccactttaaa

SEQ ID NO: 660768 - DNA, 22 bp, Artificial Sequence
  chemically synthesized
agactttctttaaagtgggagg

SEQ ID NO: 660769 - DNA, 22 bp, Artificial Sequence
  chemically synthesized
ccaagttatcttccttcctccc

SEQ ID NO: 660770 - DNA, 22 bp, Artificial Sequence
  chemically synthesized
tctttaaagtgggaggaaggaa

SEQ ID NO: 660771 - DNA, 22 bp, Artificial Sequence
  chemically synthesized
ctttaaagtgggaggaaggaag

SEQ ID NO: 660772 - DNA, 22 bp, Artificial Sequence
  chemically synthesized
tttaaagtgggaggaaggaaga

SEQ ID NO: 660773 - DNA, 22 bp, Artificial Sequence
  chemically synthesized
taaagtgggaggaaggaagata

SEQ ID NO: 660774 - DNA, 22 bp, Artificial Sequence
  chemically synthesized
aaagtgggaggaaggaagataa

SEQ ID NO: 660775 - DNA, 22 bp, Artificial Sequence
  chemically synthesized
aagtgggaggaaggaagataac

SEQ ID NO: 660776 - DNA, 22 bp, Artificial Sequence
  chemically synthesized
agataagtctcccaagttatct

SEQ ID NO: 660777 - DNA, 22 bp, Artificial Sequence
  chemically synthesized
cagataagtctcccaagttatc

SEQ ID NO: 660778 - DNA, 22 bp, Artificial Sequence
  chemically synthesized
ttcagataagtctcccaagtta

SEQ ID NO: 660779 - DNA, 22 bp, Artificial Sequence
  chemically synthesized
attcttcagataagtctcccaa

SEQ ID NO: 660780 - DNA, 22 bp, Artificial Sequence
  chemically synthesized
gattcttcagataagtctccca

SEQ ID NO: 660781 - DNA, 22 bp, Artificial Sequence
  chemically synthesized
acttgattcttcagataagtct

SEQ ID NO: 660782 - DNA, 22 bp, Artificial Sequence
  chemically synthesized
tcacttgattcttcagataagt

SEQ ID NO: 660783 - DNA, 22 bp, Artificial Sequence
  chemically synthesized
ctcacttgattcttcagataag

SEQ ID NO: 660784 - DNA, 22 bp, Artificial Sequence
  chemically synthesized
tctcacttgattcttcagataa

SEQ ID NO: 660785 - DNA, 22 bp, Artificial Sequence
  chemically synthesized
ttctcacttgattcttcagata

SEQ ID NO: 660786 - DNA, 22 bp, Artificial Sequence
  chemically synthesized
tttttctcacttgattcttcag

SEQ ID NO: 660787 - DNA, 22 bp, Artificial Sequence
  chemically synthesized
gggagacttatctgaagaatca

SEQ ID NO: 660788 - DNA, 22 bp, Artificial Sequence
  chemically synthesized
ggagacttatctgaagaatcaa

SEQ ID NO: 660789 - DNA, 22 bp, Artificial Sequence
  chemically synthesized
ttatttttctcacttgattctt

SEQ ID NO: 660790 - DNA, 22 bp, Artificial Sequence
  chemically synthesized
attatttttctcacttgattct

SEQ ID NO: 660791 - DNA, 22 bp, Artificial Sequence
  chemically synthesized
tattatttttctcacttgattc

SEQ ID NO: 660792 - DNA, 22 bp, Artificial Sequence
  chemically synthesized
tttattatttttctcacttgat

SEQ ID NO: 660793 - DNA, 22 bp, Artificial Sequence
  chemically synthesized
atctgaagaatcaagtgagaaa

SEQ ID NO: 660794 - DNA, 22 bp, Artificial Sequence
  chemically synthesized
tctgaagaatcaagtgagaaaa

SEQ ID NO: 660795 - DNA, 22 bp, Artificial Sequence
  chemically synthesized
aaattctttattatttttctca

SEQ ID NO: 660796 - DNA, 22 bp, Artificial Sequence
  chemically synthesized
aaaattctttattatttttctc

SEQ ID NO: 660797 - DNA, 22 bp, Artificial Sequence
  chemically synthesized
aagaatcaagtgagaaaaataa

SEQ ID NO: 660798 - DNA, 22 bp, Artificial Sequence
  chemically synthesized
taaaattctttattatttttct

SEQ ID NO: 660799 - DNA, 22 bp, Artificial Sequence
  chemically synthesized
ttaaaattctttattatttttc

SEQ ID NO: 660800 - DNA, 22 bp, Artificial Sequence
  chemically synthesized
tttaaaattctttattattttt

SEQ ID NO: 660801 - DNA, 22 bp, Artificial Sequence
  chemically synthesized
ctttttaaaattctttattatt

SEQ ID NO: 660802 - DNA, 22 bp, Artificial Sequence
  chemically synthesized
cattgctttttaaaattcttta

SEQ ID NO: 660803 - DNA, 22 bp, Artificial Sequence
  chemically synthesized
gcattgctttttaaaattcttt

SEQ ID NO: 660804 - DNA, 22 bp, Artificial Sequence
  chemically synthesized
cttgcattgctttttaaaattc

SEQ ID NO: 660805 - DNA, 22 bp, Artificial Sequence
  chemically synthesized
cctccttgcattgctttttaaa

SEQ ID NO: 660806 - DNA, 22 bp, Artificial Sequence
  chemically synthesized
ctgcctccttgcattgcttttt

SEQ ID NO: 660807 - DNA, 22 bp, Artificial Sequence
  chemically synthesized
ccgtcctcctgcctccttgcat

SEQ ID NO: 660808 - DNA, 22 bp, Artificial Sequence
  chemically synthesized
taaaaagcaatgcaaggaggca

SEQ ID NO: 660809 - DNA, 22 bp, Artificial Sequence
  chemically synthesized
aaaaagcaatgcaaggaggcag

SEQ ID NO: 660810 - DNA, 22 bp, Artificial Sequence
  chemically synthesized
aaaagcaatgcaaggaggcagg

SEQ ID NO: 660811 - DNA, 22 bp, Artificial Sequence
  chemically synthesized
acgtcctcccgtcctcctgcct

SEQ ID NO: 660812 - DNA, 22 bp, Artificial Sequence
  chemically synthesized
ctcacgtcctcccgtcctcctg

SEQ ID NO: 660813 - DNA, 22 bp, Artificial Sequence
  chemically synthesized
cctcctcacgtcctcccgtcct

SEQ ID NO: 660814 - DNA, 22 bp, Artificial Sequence
  chemically synthesized
agccattccctcctcacgtcct

SEQ ID NO: 660815 - DNA, 22 bp, Artificial Sequence
  chemically synthesized
cagccattccctcctcacgtcc

SEQ ID NO: 660816 - DNA, 22 bp, Artificial Sequence
  chemically synthesized
tcagccattccctcctcacgtc

SEQ ID NO: 660817 - DNA, 22 bp, Artificial Sequence
  chemically synthesized
tttcagccattccctcctcacg

SEQ ID NO: 660818 - DNA, 22 bp, Artificial Sequence
  chemically synthesized
ctttcagccattccctcctcac

SEQ ID NO: 660819 - DNA, 22 bp, Artificial Sequence
  chemically synthesized
ccacgcagtcttctttcagcca

SEQ ID NO: 660820 - DNA, 22 bp, Artificial Sequence
  chemically synthesized
cagcctcccacgcagtcttctt

SEQ ID NO: 660821 - DNA, 22 bp, Artificial Sequence
  chemically synthesized
gctccagcctcccacgcagtct

SEQ ID NO: 660822 - DNA, 22 bp, Artificial Sequence
  chemically synthesized
gacctcgctccagcctcccacg

SEQ ID NO: 660823 - DNA, 22 bp, Artificial Sequence
  chemically synthesized
aaagaagactgcgtgggaggct

SEQ ID NO: 660824 - DNA, 22 bp, Artificial Sequence
  chemically synthesized
tggacctcgctccagcctccca

SEQ ID NO: 660825 - DNA, 22 bp, Artificial Sequence
  chemically synthesized
tctctggacctcgctccagcct

SEQ ID NO: 660826 - DNA, 22 bp, Artificial Sequence
  chemically synthesized
gtctctggacctcgctccagcc

SEQ ID NO: 660827 - DNA, 22 bp, Artificial Sequence
  chemically synthesized
tgtctctggacctcgctccagc

SEQ ID NO: 660828 - DNA, 22 bp, Artificial Sequence
  chemically synthesized
ttgtctctggacctcgctccag

SEQ ID NO: 660829 - DNA, 22 bp, Artificial Sequence
  chemically synthesized
cgtgggaggctggagcgaggtc

SEQ ID NO: 660830 - DNA, 22 bp, Artificial Sequence
  chemically synthesized
agtcttttgtctctggacctcg

SEQ ID NO: 660831 - DNA, 22 bp, Artificial Sequence
  chemically synthesized
gagtcttttgtctctggacctc

SEQ ID NO: 660832 - DNA, 22 bp, Artificial Sequence
  chemically synthesized
gagcgaggtccagagacaaaag

SEQ ID NO: 660833 - DNA, 22 bp, Artificial Sequence
  chemically synthesized
aaacttttcttctctctctctt

SEQ ID NO: 660834 - DNA, 22 bp, Artificial Sequence
  chemically synthesized
ttcttctctctctcttctgtgt

SEQ ID NO: 660835 - DNA, 22 bp, Artificial Sequence
  chemically synthesized
aggaaaacaagcacacagaaga

SEQ ID NO: 660836 - DNA, 22 bp, Artificial Sequence
  chemically synthesized
tcttctctctctcttctgtgtg

SEQ ID NO: 660837 - DNA, 22 bp, Artificial Sequence
  chemically synthesized
cttctctctctcttctgtgtgc

SEQ ID NO: 660838 - DNA, 22 bp, Artificial Sequence
  chemically synthesized
tgaggaaaacaagcacacagaa

SEQ ID NO: 660839 - DNA, 22 bp, Artificial Sequence
  chemically synthesized
ttctctctctcttctgtgtgct

SEQ ID NO: 660840 - DNA, 22 bp, Artificial Sequence
  chemically synthesized
ctctctctcttctgtgtgcttg

SEQ ID NO: 660841 - DNA, 22 bp, Artificial Sequence
  chemically synthesized
tctctctcttctgtgtgcttgt

SEQ ID NO: 660842 - DNA, 22 bp, Artificial Sequence
  chemically synthesized
tctctcttctgtgtgcttgttt

SEQ ID NO: 660843 - DNA, 22 bp, Artificial Sequence
  chemically synthesized
tctcttctgtgtgcttgttttc

SEQ ID NO: 660844 - DNA, 22 bp, Artificial Sequence
  chemically synthesized
tcttctgtgtgcttgttttcct

SEQ ID NO: 660845 - DNA, 22 bp, Artificial Sequence
  chemically synthesized
ttctgtgtgcttgttttcctca

SEQ ID NO: 660846 - DNA, 22 bp, Artificial Sequence
  chemically synthesized
agtatgtgccctctgaggaaaa

SEQ ID NO: 660847 - DNA, 22 bp, Artificial Sequence
  chemically synthesized
ctgtgtgcttgttttcctcaga

SEQ ID NO: 660848 - DNA, 22 bp, Artificial Sequence
  chemically synthesized
gagtatgtgccctctgaggaaa

SEQ ID NO: 660849 - DNA, 22 bp, Artificial Sequence
  chemically synthesized
tgtgtgcttgttttcctcagag

SEQ ID NO: 660850 - DNA, 22 bp, Artificial Sequence
  chemically synthesized
tgtgcttgttttcctcagaggg

SEQ ID NO: 660851 - DNA, 22 bp, Artificial Sequence
  chemically synthesized
cgtgcacttgagtatgtgccct

SEQ ID NO: 660852 - DNA, 22 bp, Artificial Sequence
  chemically synthesized
gttttcctcagagggcacatac

SEQ ID NO: 660853 - DNA, 22 bp, Artificial Sequence
  chemically synthesized
ttttcctcagagggcacatact

SEQ ID NO: 660854 - DNA, 22 bp, Artificial Sequence
  chemically synthesized
ctacgtgcacttgagtatgtgc

SEQ ID NO: 660855 - DNA, 22 bp, Artificial Sequence
  chemically synthesized
tcctcagagggcacatactcaa

SEQ ID NO: 660856 - DNA, 22 bp, Artificial Sequence
  chemically synthesized
cctcagagggcacatactcaag

SEQ ID NO: 660857 - DNA, 22 bp, Artificial Sequence
  chemically synthesized
ctactacgtgcacttgagtatg

SEQ ID NO: 660858 - DNA, 22 bp, Artificial Sequence
  chemically synthesized
ctcagagggcacatactcaagt

SEQ ID NO: 660859 - DNA, 22 bp, Artificial Sequence
  chemically synthesized
agagggcacatactcaagtgca

SEQ ID NO: 660860 - DNA, 22 bp, Artificial Sequence
  chemically synthesized
agtgttcctactacgtgcactt

SEQ ID NO: 660861 - DNA, 22 bp, Artificial Sequence
  chemically synthesized
taagtgttcctactacgtgcac

SEQ ID NO: 660862 - DNA, 22 bp, Artificial Sequence
  chemically synthesized
ctaagtgttcctactacgtgca

SEQ ID NO: 660863 - DNA, 22 bp, Artificial Sequence
  chemically synthesized
aagtgcacgtagtaggaacact

SEQ ID NO: 660864 - DNA, 22 bp, Artificial Sequence
  chemically synthesized
gcataccgtgtttctaagtgtt

SEQ ID NO: 660865 - DNA, 22 bp, Artificial Sequence
  chemically synthesized
cagtaatggagctggcataccg

SEQ ID NO: 660866 - DNA, 22 bp, Artificial Sequence
  chemically synthesized
ccagtaatggagctggcatacc

SEQ ID NO: 660867 - DNA, 22 bp, Artificial Sequence
  chemically synthesized
ttccagtaatggagctggcata

SEQ ID NO: 660868 - DNA, 22 bp, Artificial Sequence
  chemically synthesized
agaaacacggtatgccagctcc

SEQ ID NO: 660869 - DNA, 22 bp, Artificial Sequence
  chemically synthesized
tcttccagtaatggagctggca

SEQ ID NO: 660870 - DNA, 22 bp, Artificial Sequence
  chemically synthesized
gaaacacggtatgccagctcca

SEQ ID NO: 660871 - DNA, 22 bp, Artificial Sequence
  chemically synthesized
ctctcttccagtaatggagctg

SEQ ID NO: 660872 - DNA, 22 bp, Artificial Sequence
  chemically synthesized
gaagaaatccattcctctcttc

SEQ ID NO: 660873 - DNA, 22 bp, Artificial Sequence
  chemically synthesized
ggaagaaatccattcctctctt

SEQ ID NO: 660874 - DNA, 22 bp, Artificial Sequence
  chemically synthesized
cattactggaagagaggaatgg

SEQ ID NO: 660875 - DNA, 22 bp, Artificial Sequence
  chemically synthesized
gtgtttggaagaaatccattcc

SEQ ID NO: 660876 - DNA, 22 bp, Artificial Sequence
  chemically synthesized
ctggaagagaggaatggatttc

SEQ ID NO: 660877 - DNA, 22 bp, Artificial Sequence
  chemically synthesized
gaagagaggaatggatttcttc

SEQ ID NO: 660878 - DNA, 22 bp, Artificial Sequence
  chemically synthesized
ggaatattggtgtttggaagaa

SEQ ID NO: 660879 - DNA, 22 bp, Artificial Sequence
  chemically synthesized
cttccaaacaccaatattccca

SEQ ID NO: 660880 - DNA, 22 bp, Artificial Sequence
  chemically synthesized
ttccaaacaccaatattcccaa

SEQ ID NO: 660881 - DNA, 22 bp, Artificial Sequence
  chemically synthesized
ccaaacaccaatattcccaaca

SEQ ID NO: 660882 - DNA, 22 bp, Artificial Sequence
  chemically synthesized
caaacaccaatattcccaacat

SEQ ID NO: 660883 - DNA, 22 bp, Artificial Sequence
  chemically synthesized
agtatataaggaaacatgttgg

SEQ ID NO: 660884 - DNA, 22 bp, Artificial Sequence
  chemically synthesized
cagtatataaggaaacatgttg

SEQ ID NO: 660885 - DNA, 22 bp, Artificial Sequence
  chemically synthesized
cttcagtatataaggaaacatg

SEQ ID NO: 660886 - DNA, 22 bp, Artificial Sequence
  chemically synthesized
ccttcagtatataaggaaacat

SEQ ID NO: 660887 - DNA, 22 bp, Artificial Sequence
  chemically synthesized
ccaacatgtttccttatatact

SEQ ID NO: 660888 - DNA, 22 bp, Artificial Sequence
  chemically synthesized
aaaccacccatagcttccttca

SEQ ID NO: 660889 - DNA, 22 bp, Artificial Sequence
  chemically synthesized
caaaccacccatagcttccttc

SEQ ID NO: 660890 - DNA, 22 bp, Artificial Sequence
  chemically synthesized
ccttatatactgaaggaagcta

SEQ ID NO: 660891 - DNA, 22 bp, Artificial Sequence
  chemically synthesized
cttatatactgaaggaagctat

SEQ ID NO: 660892 - DNA, 22 bp, Artificial Sequence
  chemically synthesized
atatactgaaggaagctatggg

SEQ ID NO: 660893 - DNA, 22 bp, Artificial Sequence
  chemically synthesized
tatactgaaggaagctatgggt

SEQ ID NO: 660894 - DNA, 22 bp, Artificial Sequence
  chemically synthesized
aaaaacttcaaaccacccatag

SEQ ID NO: 660895 - DNA, 22 bp, Artificial Sequence
  chemically synthesized
aaggaagctatgggtggtttga

SEQ ID NO: 660896 - DNA, 22 bp, Artificial Sequence
  chemically synthesized
tgggtggtttgaagtttttcaa

SEQ ID NO: 660897 - DNA, 22 bp, Artificial Sequence
  chemically synthesized
gaagtttttcaattattttctt

SEQ ID NO: 660898 - DNA, 22 bp, Artificial Sequence
  chemically synthesized
aagtttttcaattattttcttt

SEQ ID NO: 660899 - DNA, 22 bp, Artificial Sequence
  chemically synthesized
aagcagagtaacaaaaaagaaa

SEQ ID NO: 660900 - DNA, 22 bp, Artificial Sequence
  chemically synthesized
ttcaattattttcttttttgtt

SEQ ID NO: 660901 - DNA, 22 bp, Artificial Sequence
  chemically synthesized
tcaattattttcttttttgtta

SEQ ID NO: 660902 - DNA, 22 bp, Artificial Sequence
  chemically synthesized
caattattttcttttttgttac

SEQ ID NO: 660903 - DNA, 22 bp, Artificial Sequence
  chemically synthesized
aattattttcttttttgttact

SEQ ID NO: 660904 - DNA, 22 bp, Artificial Sequence
  chemically synthesized
tgatgactaaagcagagtaaca

SEQ ID NO: 660905 - DNA, 22 bp, Artificial Sequence
  chemically synthesized
atgatgactaaagcagagtaac

SEQ ID NO: 660906 - DNA, 22 bp, Artificial Sequence
  chemically synthesized
ttttcttttttgttactctgct

SEQ ID NO: 660907 - DNA, 22 bp, Artificial Sequence
  chemically synthesized
tcttttttgttactctgcttta

SEQ ID NO: 660908 - DNA, 22 bp, Artificial Sequence
  chemically synthesized
cttttttgttactctgctttag

SEQ ID NO: 660909 - DNA, 22 bp, Artificial Sequence
  chemically synthesized
ttttttgttactctgctttagt

SEQ ID NO: 660910 - DNA, 22 bp, Artificial Sequence
  chemically synthesized
ttttgttactctgctttagtca

SEQ ID NO: 660911 - DNA, 22 bp, Artificial Sequence
  chemically synthesized
tttgttactctgctttagtcat

SEQ ID NO: 660912 - DNA, 22 bp, Artificial Sequence
  chemically synthesized
ttgttactctgctttagtcatc

SEQ ID NO: 660913 - DNA, 22 bp, Artificial Sequence
  chemically synthesized
tgttactctgctttagtcatca

SEQ ID NO: 660914 - DNA, 22 bp, Artificial Sequence
  chemically synthesized
gttactctgctttagtcatcat

SEQ ID NO: 660915 - DNA, 22 bp, Artificial Sequence
  chemically synthesized
ttactctgctttagtcatcata

SEQ ID NO: 660916 - DNA, 22 bp, Artificial Sequence
  chemically synthesized
ctctgctttagtcatcataaat

SEQ ID NO: 660917 - DNA, 22 bp, Artificial Sequence
  chemically synthesized
tgctttagtcatcataaatatt

SEQ ID NO: 660918 - DNA, 22 bp, Artificial Sequence
  chemically synthesized
gatcagaggcaaaatatttatg

SEQ ID NO: 660919 - DNA, 22 bp, Artificial Sequence
  chemically synthesized
ctttagtcatcataaatatttt

SEQ ID NO: 660920 - DNA, 22 bp, Artificial Sequence
  chemically synthesized
tagtcatcataaatattttgcc

SEQ ID NO: 660921 - DNA, 22 bp, Artificial Sequence
  chemically synthesized
agtcatcataaatattttgcct

SEQ ID NO: 660922 - DNA, 22 bp, Artificial Sequence
  chemically synthesized
gtcatcataaatattttgcctc

SEQ ID NO: 660923 - DNA, 22 bp, Artificial Sequence
  chemically synthesized
aatgcctggatcagaggcaaaa

SEQ ID NO: 660924 - DNA, 22 bp, Artificial Sequence
  chemically synthesized
aaatgcctggatcagaggcaaa

SEQ ID NO: 660925 - DNA, 22 bp, Artificial Sequence
  chemically synthesized
ttaaatgcctggatcagaggca

SEQ ID NO: 660926 - DNA, 22 bp, Artificial Sequence
  chemically synthesized
cttaaatgcctggatcagaggc

SEQ ID NO: 660927 - DNA, 22 bp, Artificial Sequence
  chemically synthesized
cttcttaaatgcctggatcaga

SEQ ID NO: 660928 - DNA, 22 bp, Artificial Sequence
  chemically synthesized
gttacttcttaaatgcctggat

SEQ ID NO: 660929 - DNA, 22 bp, Artificial Sequence
  chemically synthesized
tgcctctgatccaggcatttaa

SEQ ID NO: 660930 - DNA, 22 bp, Artificial Sequence
  chemically synthesized
actagttacttcttaaatgcct

SEQ ID NO: 660931 - DNA, 22 bp, Artificial Sequence
  chemically synthesized
gcctctgatccaggcatttaag

SEQ ID NO: 660932 - DNA, 22 bp, Artificial Sequence
  chemically synthesized
cactagttacttcttaaatgcc

SEQ ID NO: 660933 - DNA, 22 bp, Artificial Sequence
  chemically synthesized
cctctgatccaggcatttaaga

SEQ ID NO: 660934 - DNA, 22 bp, Artificial Sequence
  chemically synthesized
tcactagttacttcttaaatgc

SEQ ID NO: 660935 - DNA, 22 bp, Artificial Sequence
  chemically synthesized
tgatccaggcatttaagaagta

SEQ ID NO: 660936 - DNA, 22 bp, Artificial Sequence
  chemically synthesized
atccaggcatttaagaagtaac

SEQ ID NO: 660937 - DNA, 22 bp, Artificial Sequence
  chemically synthesized
gaaaaattttcactagttactt

SEQ ID NO: 660938 - DNA, 22 bp, Artificial Sequence
  chemically synthesized
aagaagtaactagtgaaaattt

SEQ ID NO: 660939 - DNA, 22 bp, Artificial Sequence
  chemically synthesized
agaagtaactagtgaaaatttt

SEQ ID NO: 660940 - DNA, 22 bp, Artificial Sequence
  chemically synthesized
atacaaaagtgattcgaaaaat

SEQ ID NO: 660941 - DNA, 22 bp, Artificial Sequence
  chemically synthesized
aatacaaaagtgattcgaaaaa

SEQ ID NO: 660942 - DNA, 22 bp, Artificial Sequence
  chemically synthesized
ttaatacaaaagtgattcgaaa

SEQ ID NO: 660943 - DNA, 22 bp, Artificial Sequence
  chemically synthesized
gtgaaaatttttcgaatcactt

SEQ ID NO: 660944 - DNA, 22 bp, Artificial Sequence
  chemically synthesized
aataagactcttaatacaaaag

SEQ ID NO: 660945 - DNA, 22 bp, Artificial Sequence
  chemically synthesized
ttcgaatcacttttgtattaag

SEQ ID NO: 660946 - DNA, 22 bp, Artificial Sequence
  chemically synthesized
tcgaatcacttttgtattaaga

SEQ ID NO: 660947 - DNA, 22 bp, Artificial Sequence
  chemically synthesized
cgaatcacttttgtattaagag

SEQ ID NO: 660948 - DNA, 22 bp, Artificial Sequence
  chemically synthesized
gaatcacttttgtattaagagt

SEQ ID NO: 660949 - DNA, 22 bp, Artificial Sequence
  chemically synthesized
catcacacggctaaataagact

SEQ ID NO: 660950 - DNA, 22 bp, Artificial Sequence
  chemically synthesized
ccatcacacggctaaataagac

SEQ ID NO: 660951 - DNA, 22 bp, Artificial Sequence
  chemically synthesized
ttgtattaagagtcttatttag

SEQ ID NO: 660952 - DNA, 22 bp, Artificial Sequence
  chemically synthesized
tgtattaagagtcttatttagc

SEQ ID NO: 660953 - DNA, 22 bp, Artificial Sequence
  chemically synthesized
gtattaagagtcttatttagcc

SEQ ID NO: 660954 - DNA, 22 bp, Artificial Sequence
  chemically synthesized
tattaagagtcttatttagccg

SEQ ID NO: 660955 - DNA, 22 bp, Artificial Sequence
  chemically synthesized
atttccatcacacggctaaata

SEQ ID NO: 660956 - DNA, 22 bp, Artificial Sequence
  chemically synthesized
ttcatttccatcacacggctaa

SEQ ID NO: 660957 - DNA, 22 bp, Artificial Sequence
  chemically synthesized
agagtcttatttagccgtgtga

SEQ ID NO: 660958 - DNA, 22 bp, Artificial Sequence
  chemically synthesized
tgttcatttccatcacacggct

SEQ ID NO: 660959 - DNA, 22 bp, Artificial Sequence
  chemically synthesized
tctgttcatttccatcacacgg

SEQ ID NO: 660960 - DNA, 22 bp, Artificial Sequence
  chemically synthesized
ctctgttcatttccatcacacg

SEQ ID NO: 660961 - DNA, 22 bp, Artificial Sequence
  chemically synthesized
tctctgttcatttccatcacac

SEQ ID NO: 660962 - DNA, 22 bp, Artificial Sequence
  chemically synthesized
ttctctgttcatttccatcaca

SEQ ID NO: 660963 - DNA, 22 bp, Artificial Sequence
  chemically synthesized
atttagccgtgtgatggaaatg

SEQ ID NO: 660964 - DNA, 22 bp, Artificial Sequence
  chemically synthesized
tttagccgtgtgatggaaatga

SEQ ID NO: 660965 - DNA, 22 bp, Artificial Sequence
  chemically synthesized
agccgtgtgatggaaatgaaca

SEQ ID NO: 660966 - DNA, 22 bp, Artificial Sequence
  chemically synthesized
gccgtgtgatggaaatgaacag

SEQ ID NO: 660967 - DNA, 22 bp, Artificial Sequence
  chemically synthesized
catgcatttcattttatggggc

SEQ ID NO: 660968 - DNA, 22 bp, Artificial Sequence
  chemically synthesized
tacagagataagagcaggcccc

SEQ ID NO: 660969 - DNA, 22 bp, Artificial Sequence
  chemically synthesized
cattttatggggcctgctctta

SEQ ID NO: 660970 - DNA, 22 bp, Artificial Sequence
  chemically synthesized
attttatggggcctgctcttat

SEQ ID NO: 660971 - DNA, 22 bp, Artificial Sequence
  chemically synthesized
acctgtacagagataagagcag

SEQ ID NO: 660972 - DNA, 22 bp, Artificial Sequence
  chemically synthesized
tatggggcctgctcttatctct

SEQ ID NO: 660973 - DNA, 22 bp, Artificial Sequence
  chemically synthesized
atggggcctgctcttatctctg

SEQ ID NO: 660974 - DNA, 22 bp, Artificial Sequence
  chemically synthesized
tggggcctgctcttatctctgt

SEQ ID NO: 660975 - DNA, 22 bp, Artificial Sequence
  chemically synthesized
cccattcacctgtacagagata

SEQ ID NO: 660976 - DNA, 22 bp, Artificial Sequence
  chemically synthesized
tgtgttacccattcacctgtac

SEQ ID NO: 660977 - DNA, 22 bp, Artificial Sequence
  chemically synthesized
ctcttatctctgtacaggtgaa

SEQ ID NO: 660978 - DNA, 22 bp, Artificial Sequence
  chemically synthesized
tatgtgttacccattcacctgt

SEQ ID NO: 660979 - DNA, 22 bp, Artificial Sequence
  chemically synthesized
ttatctctgtacaggtgaatgg

SEQ ID NO: 660980 - DNA, 22 bp, Artificial Sequence
  chemically synthesized
ttctatgtgttacccattcacc

SEQ ID NO: 660981 - DNA, 22 bp, Artificial Sequence
  chemically synthesized
atctctgtacaggtgaatgggt

SEQ ID NO: 660982 - DNA, 22 bp, Artificial Sequence
  chemically synthesized
tctctgtacaggtgaatgggta

SEQ ID NO: 660983 - DNA, 22 bp, Artificial Sequence
  chemically synthesized
ctgttctatgtgttacccattc

SEQ ID NO: 660984 - DNA, 22 bp, Artificial Sequence
  chemically synthesized
gctgttctatgtgttacccatt

SEQ ID NO: 660985 - DNA, 22 bp, Artificial Sequence
  chemically synthesized
tgtacaggtgaatgggtaacac

SEQ ID NO: 660986 - DNA, 22 bp, Artificial Sequence
  chemically synthesized
tacaggtgaatgggtaacacat

SEQ ID NO: 660987 - DNA, 22 bp, Artificial Sequence
  chemically synthesized
aacatttgctgttctatgtgtt

SEQ ID NO: 660988 - DNA, 22 bp, Artificial Sequence
  chemically synthesized
ctcaacatttgctgttctatgt

SEQ ID NO: 660989 - DNA, 22 bp, Artificial Sequence
  chemically synthesized
tactcaacatttgctgttctat

SEQ ID NO: 660990 - DNA, 22 bp, Artificial Sequence
  chemically synthesized
ctactcaacatttgctgttcta

SEQ ID NO: 660991 - DNA, 22 bp, Artificial Sequence
  chemically synthesized
tttctactcaacatttgctgtt

SEQ ID NO: 660992 - DNA, 22 bp, Artificial Sequence
  chemically synthesized
gagctatttctactcaacattt

SEQ ID NO: 660993 - DNA, 22 bp, Artificial Sequence
  chemically synthesized
tggagctatttctactcaacat

SEQ ID NO: 660994 - DNA, 22 bp, Artificial Sequence
  chemically synthesized
ccctctggagctatttctactc

SEQ ID NO: 660995 - DNA, 22 bp, Artificial Sequence
  chemically synthesized
ctcccctctggagctatttcta

SEQ ID NO: 660996 - DNA, 22 bp, Artificial Sequence
  chemically synthesized
gctcccctctggagctatttct

SEQ ID NO: 660997 - DNA, 22 bp, Artificial Sequence
  chemically synthesized
tgctcccctctggagctatttc

SEQ ID NO: 660998 - DNA, 22 bp, Artificial Sequence
  chemically synthesized
ctttgctcccctctggagctat

SEQ ID NO: 660999 - DNA, 22 bp, Artificial Sequence
  chemically synthesized
agtagaaatagctccagagggg

SEQ ID NO: 661000 - DNA, 22 bp, Artificial Sequence
  chemically synthesized
agagcaattgctttgctcccct

SEQ ID NO: 661001 - DNA, 22 bp, Artificial Sequence
  chemically synthesized
cagagcaattgctttgctcccc

SEQ ID NO: 661002 - DNA, 22 bp, Artificial Sequence
  chemically synthesized
taatttcagagcaattgctttg

SEQ ID NO: 661003 - DNA, 22 bp, Artificial Sequence
  chemically synthesized
cagaggggagcaaagcaattgc

SEQ ID NO: 661004 - DNA, 22 bp, Artificial Sequence
  chemically synthesized
ctgtaatttcagagcaattgct

SEQ ID NO: 661005 - DNA, 22 bp, Artificial Sequence
  chemically synthesized
ctcctgtaatttcagagcaatt

SEQ ID NO: 661006 - DNA, 22 bp, Artificial Sequence
  chemically synthesized
tgctcctgtaatttcagagcaa

SEQ ID NO: 661007 - DNA, 22 bp, Artificial Sequence
  chemically synthesized
ctgctcctgtaatttcagagca

SEQ ID NO: 661008 - DNA, 22 bp, Artificial Sequence
  chemically synthesized
tgtcatcttctgctcctgtaat

SEQ ID NO: 661009 - DNA, 22 bp, Artificial Sequence
  chemically synthesized
actgtgtcatcttctgctcctg

SEQ ID NO: 661010 - DNA, 22 bp, Artificial Sequence
  chemically synthesized
ctctgaaattacaggagcagaa

SEQ ID NO: 661011 - DNA, 22 bp, Artificial Sequence
  chemically synthesized
ctaactgtgtcatcttctgctc

SEQ ID NO: 661012 - DNA, 22 bp, Artificial Sequence
  chemically synthesized
tgaaattacaggagcagaagat

SEQ ID NO: 661013 - DNA, 22 bp, Artificial Sequence
  chemically synthesized
tcctaactgtgtcatcttctgc

SEQ ID NO: 661014 - DNA, 22 bp, Artificial Sequence
  chemically synthesized
aaattacaggagcagaagatga

SEQ ID NO: 661015 - DNA, 22 bp, Artificial Sequence
  chemically synthesized
tctcctaactgtgtcatcttct

SEQ ID NO: 661016 - DNA, 22 bp, Artificial Sequence
  chemically synthesized
ctctcctaactgtgtcatcttc

SEQ ID NO: 661017 - DNA, 22 bp, Artificial Sequence
  chemically synthesized
caggagcagaagatgacacagt

SEQ ID NO: 661018 - DNA, 22 bp, Artificial Sequence
  chemically synthesized
cacagtatttctctcctaactg

SEQ ID NO: 661019 - DNA, 22 bp, Artificial Sequence
  chemically synthesized
gcagagcacactgcacagtatt

SEQ ID NO: 661020 - DNA, 22 bp, Artificial Sequence
  chemically synthesized
agcagagcacactgcacagtat

SEQ ID NO: 661021 - DNA, 22 bp, Artificial Sequence
  chemically synthesized
tagcagagcacactgcacagta

SEQ ID NO: 661022 - DNA, 22 bp, Artificial Sequence
  chemically synthesized
ggagagaaatactgtgcagtgt

SEQ ID NO: 661023 - DNA, 22 bp, Artificial Sequence
  chemically synthesized
accacatccagttttagcagag

SEQ ID NO: 661024 - DNA, 22 bp, Artificial Sequence
  chemically synthesized
aaccacatccagttttagcaga

SEQ ID NO: 661025 - DNA, 22 bp, Artificial Sequence
  chemically synthesized
tgcagtgtgctctgctaaaact

SEQ ID NO: 661026 - DNA, 22 bp, Artificial Sequence
  chemically synthesized
tgtttaaccacatccagtttta

SEQ ID NO: 661027 - DNA, 22 bp, Artificial Sequence
  chemically synthesized
gtgtttaaccacatccagtttt

SEQ ID NO: 661028 - DNA, 22 bp, Artificial Sequence
  chemically synthesized
ttgtgtttaaccacatccagtt

SEQ ID NO: 661029 - DNA, 22 bp, Artificial Sequence
  chemically synthesized
ttcttgtgtttaaccacatcca

SEQ ID NO: 661030 - DNA, 22 bp, Artificial Sequence
  chemically synthesized
tgctaaaactggatgtggttaa

SEQ ID NO: 661031 - DNA, 22 bp, Artificial Sequence
  chemically synthesized
ctaaaactggatgtggttaaac

SEQ ID NO: 661032 - DNA, 22 bp, Artificial Sequence
  chemically synthesized
aaactggatgtggttaaacaca

SEQ ID NO: 661033 - DNA, 22 bp, Artificial Sequence
  chemically synthesized
tgatggattgttcttgtgttta

SEQ ID NO: 661034 - DNA, 22 bp, Artificial Sequence
  chemically synthesized
tgtgatggattgttcttgtgtt

SEQ ID NO: 661035 - DNA, 22 bp, Artificial Sequence
  chemically synthesized
ctgtgatggattgttcttgtgt

SEQ ID NO: 661036 - DNA, 22 bp, Artificial Sequence
  chemically synthesized
gatgtggttaaacacaagaaca

SEQ ID NO: 661037 - DNA, 22 bp, Artificial Sequence
  chemically synthesized
agtcttctgtgatggattgttc

SEQ ID NO: 661038 - DNA, 22 bp, Artificial Sequence
  chemically synthesized
cagtcttctgtgatggattgtt

SEQ ID NO: 661039 - DNA, 22 bp, Artificial Sequence
  chemically synthesized
ttcagtcttctgtgatggattg

SEQ ID NO: 661040 - DNA, 22 bp, Artificial Sequence
  chemically synthesized
aacacaagaacaatccatcaca

SEQ ID NO: 661041 - DNA, 22 bp, Artificial Sequence
  chemically synthesized
gggaaatgtgctcttcagtctt

SEQ ID NO: 661042 - DNA, 22 bp, Artificial Sequence
  chemically synthesized
agggaaatgtgctcttcagtct

SEQ ID NO: 661043 - DNA, 22 bp, Artificial Sequence
  chemically synthesized
tttagggaaatgtgctcttcag

SEQ ID NO: 661044 - DNA, 22 bp, Artificial Sequence
  chemically synthesized
gtttagggaaatgtgctcttca

SEQ ID NO: 661045 - DNA, 22 bp, Artificial Sequence
  chemically synthesized
acatgtttgtttagggaaatgt

SEQ ID NO: 661046 - DNA, 22 bp, Artificial Sequence
  chemically synthesized
gacatgtttgtttagggaaatg

SEQ ID NO: 661047 - DNA, 22 bp, Artificial Sequence
  chemically synthesized
tttgacatgtttgtttagggaa

SEQ ID NO: 661048 - DNA, 22 bp, Artificial Sequence
  chemically synthesized
aagagcacatttccctaaacaa

SEQ ID NO: 661049 - DNA, 22 bp, Artificial Sequence
  chemically synthesized
tgtttgacatgtttgtttaggg

SEQ ID NO: 661050 - DNA, 22 bp, Artificial Sequence
  chemically synthesized
aattctgtttgacatgtttgtt

SEQ ID NO: 661051 - DNA, 22 bp, Artificial Sequence
  chemically synthesized
ccctaaacaaacatgtcaaaca

SEQ ID NO: 661052 - DNA, 22 bp, Artificial Sequence
  chemically synthesized
cctaaacaaacatgtcaaacag

SEQ ID NO: 661053 - DNA, 22 bp, Artificial Sequence
  chemically synthesized
catgaaagttgaattctgtttg

SEQ ID NO: 661054 - DNA, 22 bp, Artificial Sequence
  chemically synthesized
aacaaacatgtcaaacagaatt

SEQ ID NO: 661055 - DNA, 22 bp, Artificial Sequence
  chemically synthesized
aaaatagctccatgaaagttga

SEQ ID NO: 661056 - DNA, 22 bp, Artificial Sequence
  chemically synthesized
caaaatagctccatgaaagttg

SEQ ID NO: 661057 - DNA, 22 bp, Artificial Sequence
  chemically synthesized
tcaaaatagctccatgaaagtt

SEQ ID NO: 661058 - DNA, 22 bp, Artificial Sequence
  chemically synthesized
ttcaaaatagctccatgaaagt

SEQ ID NO: 661059 - DNA, 22 bp, Artificial Sequence
  chemically synthesized
tttcaaaatagctccatgaaag

SEQ ID NO: 661060 - DNA, 22 bp, Artificial Sequence
  chemically synthesized
aactttcatggagctattttga

SEQ ID NO: 661061 - DNA, 22 bp, Artificial Sequence
  chemically synthesized
aatggaaattttttcaaaatag

SEQ ID NO: 661062 - DNA, 22 bp, Artificial Sequence
  chemically synthesized
tcatggagctattttgaaaaaa

SEQ ID NO: 661063 - DNA, 22 bp, Artificial Sequence
  chemically synthesized
catggagctattttgaaaaaat

SEQ ID NO: 661064 - DNA, 22 bp, Artificial Sequence
  chemically synthesized
atggagctattttgaaaaaatt

SEQ ID NO: 661065 - DNA, 22 bp, Artificial Sequence
  chemically synthesized
tgtatacctaaatggaaatttt

SEQ ID NO: 661066 - DNA, 22 bp, Artificial Sequence
  chemically synthesized
ttttgaaaaaatttccatttag

SEQ ID NO: 661067 - DNA, 22 bp, Artificial Sequence
  chemically synthesized
tgaaaaaatttccatttaggta

SEQ ID NO: 661068 - DNA, 22 bp, Artificial Sequence
  chemically synthesized
gaaaaaatttccatttaggtat

SEQ ID NO: 661069 - DNA, 22 bp, Artificial Sequence
  chemically synthesized
aaaaaatttccatttaggtata

SEQ ID NO: 661070 - DNA, 22 bp, Artificial Sequence
  chemically synthesized
ccatttaggtatacacaatcca

SEQ ID NO: 661071 - DNA, 22 bp, Artificial Sequence
  chemically synthesized
gggtccatagcatggattgtgt

SEQ ID NO: 661072 - DNA, 22 bp, Artificial Sequence
  chemically synthesized
catttaggtatacacaatccat

SEQ ID NO: 661073 - DNA, 22 bp, Artificial Sequence
  chemically synthesized
cgggtccatagcatggattgtg

SEQ ID NO: 661074 - DNA, 22 bp, Artificial Sequence
  chemically synthesized
tcgggtccatagcatggattgt

SEQ ID NO: 661075 - DNA, 22 bp, Artificial Sequence
  chemically synthesized
ttcgggtccatagcatggattg

SEQ ID NO: 661076 - DNA, 22 bp, Artificial Sequence
  chemically synthesized
aggtatacacaatccatgctat

SEQ ID NO: 661077 - DNA, 22 bp, Artificial Sequence
  chemically synthesized
cttttcgggtccatagcatgga

SEQ ID NO: 661078 - DNA, 22 bp, Artificial Sequence
  chemically synthesized
ggtatacacaatccatgctatg

SEQ ID NO: 661079 - DNA, 22 bp, Artificial Sequence
  chemically synthesized
acctccttttcgggtccatagc

SEQ ID NO: 661080 - DNA, 22 bp, Artificial Sequence
  chemically synthesized
tcacctccttttcgggtccata

SEQ ID NO: 661081 - DNA, 22 bp, Artificial Sequence
  chemically synthesized
atattctcacctccttttcggg

SEQ ID NO: 661082 - DNA, 22 bp, Artificial Sequence
  chemically synthesized
ttgatattctcacctccttttc

SEQ ID NO: 661083 - DNA, 22 bp, Artificial Sequence
  chemically synthesized
tggacccgaaaaggaggtgaga

SEQ ID NO: 661084 - DNA, 22 bp, Artificial Sequence
  chemically synthesized
tccctattgatattctcacctc

SEQ ID NO: 661085 - DNA, 22 bp, Artificial Sequence
  chemically synthesized
aattgtccctattgatattctc

SEQ ID NO: 661086 - DNA, 22 bp, Artificial Sequence
  chemically synthesized
aaaagcatatgcatggcaatta

SEQ ID NO: 661087 - DNA, 22 bp, Artificial Sequence
  chemically synthesized
gaaaagcatatgcatggcaatt

SEQ ID NO: 661088 - DNA, 22 bp, Artificial Sequence
  chemically synthesized
tgaaaagcatatgcatggcaat

SEQ ID NO: 661089 - DNA, 22 bp, Artificial Sequence
  chemically synthesized
attttgaaaagcatatgcatgg

SEQ ID NO: 661090 - DNA, 22 bp, Artificial Sequence
  chemically synthesized
aattgccatgcatatgcttttc

SEQ ID NO: 661091 - DNA, 22 bp, Artificial Sequence
  chemically synthesized
attgccatgcatatgcttttca

SEQ ID NO: 661092 - DNA, 22 bp, Artificial Sequence
  chemically synthesized
agatgctcattttgaaaagcat

SEQ ID NO: 661093 - DNA, 22 bp, Artificial Sequence
  chemically synthesized
taagatgctcattttgaaaagc

SEQ ID NO: 661094 - DNA, 22 bp, Artificial Sequence
  chemically synthesized
ccatgcatatgcttttcaaaat

SEQ ID NO: 661095 - DNA, 22 bp, Artificial Sequence
  chemically synthesized
tctaagatgctcattttgaaaa

SEQ ID NO: 661096 - DNA, 22 bp, Artificial Sequence
  chemically synthesized
ggtgtgttctctaagatgctca

SEQ ID NO: 661097 - DNA, 22 bp, Artificial Sequence
  chemically synthesized
ttcaaaatgagcatcttagaga

SEQ ID NO: 661098 - DNA, 22 bp, Artificial Sequence
  chemically synthesized
tcaaaatgagcatcttagagaa

SEQ ID NO: 661099 - DNA, 22 bp, Artificial Sequence
  chemically synthesized
caaaatgagcatcttagagaac

SEQ ID NO: 661100 - DNA, 22 bp, Artificial Sequence
  chemically synthesized
aaaatgagcatcttagagaaca

SEQ ID NO: 661101 - DNA, 22 bp, Artificial Sequence
  chemically synthesized
atcaaaaagtctaggtgtgttc

SEQ ID NO: 661102 - DNA, 22 bp, Artificial Sequence
  chemically synthesized
catcaaaaagtctaggtgtgtt

SEQ ID NO: 661103 - DNA, 22 bp, Artificial Sequence
  chemically synthesized
atgtttcatcaaaaagtctagg

SEQ ID NO: 661104 - DNA, 22 bp, Artificial Sequence
  chemically synthesized
aatgtttcatcaaaaagtctag

SEQ ID NO: 661105 - DNA, 22 bp, Artificial Sequence
  chemically synthesized
agagaacacacctagacttttt

SEQ ID NO: 661106 - DNA, 22 bp, Artificial Sequence
  chemically synthesized
gagaacacacctagactttttg

SEQ ID NO: 661107 - DNA, 22 bp, Artificial Sequence
  chemically synthesized
catttaatgtttcatcaaaaag

SEQ ID NO: 661108 - DNA, 22 bp, Artificial Sequence
  chemically synthesized
atcattacatttaatgtttcat

SEQ ID NO: 661109 - DNA, 22 bp, Artificial Sequence
  chemically synthesized
gactttttgatgaaacattaaa

SEQ ID NO: 661110 - DNA, 22 bp, Artificial Sequence
  chemically synthesized
tttgatgaaacattaaatgtaa

SEQ ID NO: 661111 - DNA, 22 bp, Artificial Sequence
  chemically synthesized
ttgatgaaacattaaatgtaat

SEQ ID NO: 661112 - DNA, 22 bp, Artificial Sequence
  chemically synthesized
tgatgaaacattaaatgtaatg

SEQ ID NO: 661113 - DNA, 22 bp, Artificial Sequence
  chemically synthesized
gaaagagctaatcattacattt

SEQ ID NO: 661114 - DNA, 22 bp, Artificial Sequence
  chemically synthesized
gatgaaacattaaatgtaatga

SEQ ID NO: 661115 - DNA, 22 bp, Artificial Sequence
  chemically synthesized
atgaaacattaaatgtaatgat

SEQ ID NO: 661116 - DNA, 22 bp, Artificial Sequence
  chemically synthesized
agggtcctagaaagagctaatc

SEQ ID NO: 661117 - DNA, 22 bp, Artificial Sequence
  chemically synthesized
ttgagggtcctagaaagagcta

SEQ ID NO: 661118 - DNA, 22 bp, Artificial Sequence
  chemically synthesized
aatgtaatgattagctctttct

SEQ ID NO: 661119 - DNA, 22 bp, Artificial Sequence
  chemically synthesized
attgagggtcctagaaagagct

SEQ ID NO: 661120 - DNA, 22 bp, Artificial Sequence
  chemically synthesized
cttattgagggtcctagaaaga

SEQ ID NO: 661121 - DNA, 22 bp, Artificial Sequence
  chemically synthesized
gttgcttattgagggtcctaga

SEQ ID NO: 661122 - DNA, 22 bp, Artificial Sequence
  chemically synthesized
ctggttgcttattgagggtcct

SEQ ID NO: 661123 - DNA, 22 bp, Artificial Sequence
  chemically synthesized
gctctttctaggaccctcaata

SEQ ID NO: 661124 - DNA, 22 bp, Artificial Sequence
  chemically synthesized
tatctgctggttgcttattgag

SEQ ID NO: 661125 - DNA, 22 bp, Artificial Sequence
  chemically synthesized
tttctaggaccctcaataagca

SEQ ID NO: 661126 - DNA, 22 bp, Artificial Sequence
  chemically synthesized
tctaggaccctcaataagcaac

SEQ ID NO: 661127 - DNA, 22 bp, Artificial Sequence
  chemically synthesized
ctaggaccctcaataagcaacc

SEQ ID NO: 661128 - DNA, 22 bp, Artificial Sequence
  chemically synthesized
taggaccctcaataagcaacca

SEQ ID NO: 661129 - DNA, 22 bp, Artificial Sequence
  chemically synthesized
ggaccctcaataagcaaccagc

SEQ ID NO: 661130 - DNA, 22 bp, Artificial Sequence
  chemically synthesized
acacaactgtatctgctggttg

SEQ ID NO: 661131 - DNA, 22 bp, Artificial Sequence
  chemically synthesized
cacacaactgtatctgctggtt

SEQ ID NO: 661132 - DNA, 22 bp, Artificial Sequence
  chemically synthesized
aataagcaaccagcagatacag

SEQ ID NO: 661133 - DNA, 22 bp, Artificial Sequence
  chemically synthesized
aggaaacaatggtttcacacaa

SEQ ID NO: 661134 - DNA, 22 bp, Artificial Sequence
  chemically synthesized
aaggaaacaatggtttcacaca

SEQ ID NO: 661135 - DNA, 22 bp, Artificial Sequence
  chemically synthesized
gcttaaggaaacaatggtttca

SEQ ID NO: 661136 - DNA, 22 bp, Artificial Sequence
  chemically synthesized
ctagcttaaggaaacaatggtt

SEQ ID NO: 661137 - DNA, 22 bp, Artificial Sequence
  chemically synthesized
tgtgaaaccattgtttccttaa

SEQ ID NO: 661138 - DNA, 22 bp, Artificial Sequence
  chemically synthesized
atggaaattcctagcttaagga

SEQ ID NO: 661139 - DNA, 22 bp, Artificial Sequence
  chemically synthesized
aatggaaattcctagcttaagg

SEQ ID NO: 661140 - DNA, 22 bp, Artificial Sequence
  chemically synthesized
tttccttaagctaggaatttcc

SEQ ID NO: 661141 - DNA, 22 bp, Artificial Sequence
  chemically synthesized
ccttaagctaggaatttccatt

SEQ ID NO: 661142 - DNA, 22 bp, Artificial Sequence
  chemically synthesized
cttaagctaggaatttccatta

SEQ ID NO: 661143 - DNA, 22 bp, Artificial Sequence
  chemically synthesized
aagctaggaatttccattaaat

SEQ ID NO: 661144 - DNA, 22 bp, Artificial Sequence
  chemically synthesized
agctaggaatttccattaaata

SEQ ID NO: 661145 - DNA, 22 bp, Artificial Sequence
  chemically synthesized
ggaatttccattaaatatatta

SEQ ID NO: 661146 - DNA, 22 bp, Artificial Sequence
  chemically synthesized
ccattaaatatattatatatat

SEQ ID NO: 661147 - DNA, 22 bp, Artificial Sequence
  chemically synthesized
cattaaatatattatatatata

SEQ ID NO: 661148 - DNA, 22 bp, Artificial Sequence
  chemically synthesized
aatatattatatatatatatat

SEQ ID NO: 661149 - DNA, 22 bp, Artificial Sequence
  chemically synthesized
tatatatatatatatatatgtg

SEQ ID NO: 661150 - DNA, 22 bp, Artificial Sequence
  chemically synthesized
gtgaatacacacaaacacacac

SEQ ID NO: 661151 - DNA, 22 bp, Artificial Sequence
  chemically synthesized
ctagtgaatacacacaaacaca

SEQ ID NO: 661152 - DNA, 22 bp, Artificial Sequence
  chemically synthesized
aagatatatctactagtgaata

SEQ ID NO: 661153 - DNA, 22 bp, Artificial Sequence
  chemically synthesized
aaagatatatctactagtgaat

SEQ ID NO: 661154 - DNA, 22 bp, Artificial Sequence
  chemically synthesized
taaagatatatctactagtgaa

SEQ ID NO: 661155 - DNA, 22 bp, Artificial Sequence
  chemically synthesized
gtgtgtattcactagtagatat

SEQ ID NO: 661156 - DNA, 22 bp, Artificial Sequence
  chemically synthesized
tgtgtattcactagtagatata

SEQ ID NO: 661157 - DNA, 22 bp, Artificial Sequence
  chemically synthesized
tgtagctttaaagatatatcta

SEQ ID NO: 661158 - DNA, 22 bp, Artificial Sequence
  chemically synthesized
atgtagctttaaagatatatct

SEQ ID NO: 661159 - DNA, 22 bp, Artificial Sequence
  chemically synthesized
tatgtagctttaaagatatatc

SEQ ID NO: 661160 - DNA, 22 bp, Artificial Sequence
  chemically synthesized
ttatgtagctttaaagatatat

SEQ ID NO: 661161 - DNA, 22 bp, Artificial Sequence
  chemically synthesized
actagtagatatatctttaaag

SEQ ID NO: 661162 - DNA, 22 bp, Artificial Sequence
  chemically synthesized
ggtttttatgtagctttaaaga

SEQ ID NO: 661163 - DNA, 22 bp, Artificial Sequence
  chemically synthesized
gggtttttatgtagctttaaag

SEQ ID NO: 661164 - DNA, 22 bp, Artificial Sequence
  chemically synthesized
gtagatatatctttaaagctac

SEQ ID NO: 661165 - DNA, 22 bp, Artificial Sequence
  chemically synthesized
gaatacttgggtttttatgtag

SEQ ID NO: 661166 - DNA, 22 bp, Artificial Sequence
  chemically synthesized
taaagctacataaaaacccaag

SEQ ID NO: 661167 - DNA, 22 bp, Artificial Sequence
  chemically synthesized
aaagctacataaaaacccaagt

SEQ ID NO: 661168 - DNA, 22 bp, Artificial Sequence
  chemically synthesized
aagctacataaaaacccaagta

SEQ ID NO: 661169 - DNA, 22 bp, Artificial Sequence
  chemically synthesized
cataaaaacccaagtattctaa

SEQ ID NO: 661170 - DNA, 22 bp, Artificial Sequence
  chemically synthesized
gaaagtgaagatgtattagaat

SEQ ID NO: 661171 - DNA, 22 bp, Artificial Sequence
  chemically synthesized
agaaagtgaagatgtattagaa

SEQ ID NO: 661172 - DNA, 22 bp, Artificial Sequence
  chemically synthesized
taaacataatttagaaagtgaa

SEQ ID NO: 661173 - DNA, 22 bp, Artificial Sequence
  chemically synthesized
taatacatcttcactttctaaa

SEQ ID NO: 661174 - DNA, 22 bp, Artificial Sequence
  chemically synthesized
ctgtaaacataatttagaaagt

SEQ ID NO: 661175 - DNA, 22 bp, Artificial Sequence
  chemically synthesized
atacatcttcactttctaaatt

SEQ ID NO: 661176 - DNA, 22 bp, Artificial Sequence
  chemically synthesized
tactgtaaacataatttagaaa

SEQ ID NO: 661177 - DNA, 22 bp, Artificial Sequence
  chemically synthesized
cactttctaaattatgtttaca

SEQ ID NO: 661178 - DNA, 22 bp, Artificial Sequence
  chemically synthesized
actttctaaattatgtttacag

SEQ ID NO: 661179 - DNA, 22 bp, Artificial Sequence
  chemically synthesized
tagcatcctctactgtaaacat

SEQ ID NO: 661180 - DNA, 22 bp, Artificial Sequence
  chemically synthesized
tctaaattatgtttacagtaga

SEQ ID NO: 661181 - DNA, 22 bp, Artificial Sequence
  chemically synthesized
ctaaattatgtttacagtagag

SEQ ID NO: 661182 - DNA, 22 bp, Artificial Sequence
  chemically synthesized
taaattatgtttacagtagagg

SEQ ID NO: 661183 - DNA, 22 bp, Artificial Sequence
  chemically synthesized
aattatgtttacagtagaggat

SEQ ID NO: 661184 - DNA, 22 bp, Artificial Sequence
  chemically synthesized
aaagcctatagcatcctctact

SEQ ID NO: 661185 - DNA, 22 bp, Artificial Sequence
  chemically synthesized
caaagcctatagcatcctctac

SEQ ID NO: 661186 - DNA, 22 bp, Artificial Sequence
  chemically synthesized
tgtttacagtagaggatgctat

SEQ ID NO: 661187 - DNA, 22 bp, Artificial Sequence
  chemically synthesized
aatggcttcaaagcctatagca

SEQ ID NO: 661188 - DNA, 22 bp, Artificial Sequence
  chemically synthesized
acagtagaggatgctataggct

SEQ ID NO: 661189 - DNA, 22 bp, Artificial Sequence
  chemically synthesized
caatggcttcaaagcctatagc

SEQ ID NO: 661190 - DNA, 22 bp, Artificial Sequence
  chemically synthesized
cagtagaggatgctataggctt

SEQ ID NO: 661191 - DNA, 22 bp, Artificial Sequence
  chemically synthesized
ttcaatggcttcaaagcctata

SEQ ID NO: 661192 - DNA, 22 bp, Artificial Sequence
  chemically synthesized
ttcttcaatggcttcaaagcct

SEQ ID NO: 661193 - DNA, 22 bp, Artificial Sequence
  chemically synthesized
taggctttgaagccattgaaga

SEQ ID NO: 661194 - DNA, 22 bp, Artificial Sequence
  chemically synthesized
tgaagccattgaagaacaggga

SEQ ID NO: 661195 - DNA, 22 bp, Artificial Sequence
  chemically synthesized
gaagccattgaagaacagggac

SEQ ID NO: 661196 - DNA, 22 bp, Artificial Sequence
  chemically synthesized
aagccattgaagaacagggacc

SEQ ID NO: 661197 - DNA, 22 bp, Artificial Sequence
  chemically synthesized
aagaacagggaccatgtggtgg

SEQ ID NO: 661198 - DNA, 22 bp, Artificial Sequence
  chemically synthesized
atgcatagggtaccaccacatg

SEQ ID NO: 661199 - DNA, 22 bp, Artificial Sequence
  chemically synthesized
acccccacagccctcatgcata

SEQ ID NO: 661200 - DNA, 22 bp, Artificial Sequence
  chemically synthesized
tcacccccacagccctcatgca

SEQ ID NO: 661201 - DNA, 22 bp, Artificial Sequence
  chemically synthesized
tctcacccccacagccctcatg

SEQ ID NO: 661202 - DNA, 22 bp, Artificial Sequence
  chemically synthesized
tgcatgagggctgtgggggtga

SEQ ID NO: 661203 - DNA, 22 bp, Artificial Sequence
  chemically synthesized
tccccaccctctctcaccccca

SEQ ID NO: 661204 - DNA, 22 bp, Artificial Sequence
  chemically synthesized
tcctgtccccaccctctctcac

SEQ ID NO: 661205 - DNA, 22 bp, Artificial Sequence
  chemically synthesized
atcctgtccccaccctctctca

SEQ ID NO: 661206 - DNA, 22 bp, Artificial Sequence
  chemically synthesized
tatcctgtccccaccctctctc

SEQ ID NO: 661207 - DNA, 22 bp, Artificial Sequence
  chemically synthesized
ttatcctgtccccaccctctct

SEQ ID NO: 661208 - DNA, 22 bp, Artificial Sequence
  chemically synthesized
ttttatcctgtccccaccctct

SEQ ID NO: 661209 - DNA, 22 bp, Artificial Sequence
  chemically synthesized
cttttatcctgtccccaccctc

SEQ ID NO: 661210 - DNA, 22 bp, Artificial Sequence
  chemically synthesized
tgggggtgagagagggtgggga

SEQ ID NO: 661211 - DNA, 22 bp, Artificial Sequence
  chemically synthesized
gagagtcagccatttcttttat

SEQ ID NO: 661212 - DNA, 22 bp, Artificial Sequence
  chemically synthesized
cacagcaaagaggatcctggag

SEQ ID NO: 661213 - DNA, 22 bp, Artificial Sequence
  chemically synthesized
ctgcacagcaaagaggatcctg

SEQ ID NO: 661214 - DNA, 22 bp, Artificial Sequence
  chemically synthesized
cctgcacagcaaagaggatcct

SEQ ID NO: 661215 - DNA, 22 bp, Artificial Sequence
  chemically synthesized
tcctgcacagcaaagaggatcc

SEQ ID NO: 661216 - DNA, 22 bp, Artificial Sequence
  chemically synthesized
ttcctgcacagcaaagaggatc

SEQ ID NO: 661217 - DNA, 22 bp, Artificial Sequence
  chemically synthesized
actctccaggatcctctttgct

SEQ ID NO: 661218 - DNA, 22 bp, Artificial Sequence
  chemically synthesized
cttttcctgcacagcaaagagg

SEQ ID NO: 661219 - DNA, 22 bp, Artificial Sequence
  chemically synthesized
tccaggatcctctttgctgtgc

SEQ ID NO: 661220 - DNA, 22 bp, Artificial Sequence
  chemically synthesized
tctgcttttcctgcacagcaaa

SEQ ID NO: 661221 - DNA, 22 bp, Artificial Sequence
  chemically synthesized
caggatcctctttgctgtgcag

SEQ ID NO: 661222 - DNA, 22 bp, Artificial Sequence
  chemically synthesized
tttgctgtgcaggaaaagcaga

SEQ ID NO: 661223 - DNA, 22 bp, Artificial Sequence
  chemically synthesized
tgctgtgcaggaaaagcagaca

SEQ ID NO: 661224 - DNA, 22 bp, Artificial Sequence
  chemically synthesized
gctgtgcaggaaaagcagacag

SEQ ID NO: 661225 - DNA, 22 bp, Artificial Sequence
  chemically synthesized
ctgtgcaggaaaagcagacagt

SEQ ID NO: 661226 - DNA, 22 bp, Artificial Sequence
  chemically synthesized
tgcaggaaaagcagacagtggc

SEQ ID NO: 661227 - DNA, 22 bp, Artificial Sequence
  chemically synthesized
gccgccccccaaccgccactgt

SEQ ID NO: 661228 - DNA, 22 bp, Artificial Sequence
  chemically synthesized
ctcgccgccccccaaccgccac

SEQ ID NO: 661229 - DNA, 22 bp, Artificial Sequence
  chemically synthesized
cctgctcgccgccccccaaccg

SEQ ID NO: 661230 - DNA, 22 bp, Artificial Sequence
  chemically synthesized
aagtcctgcctgctcgccgccc

SEQ ID NO: 661231 - DNA, 22 bp, Artificial Sequence
  chemically synthesized
tgttgaagtcctgcctgctcgc

SEQ ID NO: 661232 - DNA, 22 bp, Artificial Sequence
  chemically synthesized
gggggcggcgagcaggcaggac

SEQ ID NO: 661233 - DNA, 22 bp, Artificial Sequence
  chemically synthesized
gtgggatccctgtgttgaagtc

SEQ ID NO: 661234 - DNA, 22 bp, Artificial Sequence
  chemically synthesized
aggaaccattagtgggatccct

SEQ ID NO: 661235 - DNA, 22 bp, Artificial Sequence
  chemically synthesized
caacacagggatcccactaatg

SEQ ID NO: 661236 - DNA, 22 bp, Artificial Sequence
  chemically synthesized
aacacagggatcccactaatgg

SEQ ID NO: 661237 - DNA, 22 bp, Artificial Sequence
  chemically synthesized
ggcacaaccagagcctcaggaa

SEQ ID NO: 661238 - DNA, 22 bp, Artificial Sequence
  chemically synthesized
atggttcctgaggctctggttg

SEQ ID NO: 661239 - DNA, 22 bp, Artificial Sequence
  chemically synthesized
agaagatgattaggcacaacca

SEQ ID NO: 661240 - DNA, 22 bp, Artificial Sequence
  chemically synthesized
ctgaggctctggttgtgcctaa

SEQ ID NO: 661241 - DNA, 22 bp, Artificial Sequence
  chemically synthesized
aggctctggttgtgcctaatca

SEQ ID NO: 661242 - DNA, 22 bp, Artificial Sequence
  chemically synthesized
gaaggttgagaagatgattagg

SEQ ID NO: 661243 - DNA, 22 bp, Artificial Sequence
  chemically synthesized
tggttgtgcctaatcatcttct

SEQ ID NO: 661244 - DNA, 22 bp, Artificial Sequence
  chemically synthesized
gttgtgcctaatcatcttctca

SEQ ID NO: 661245 - DNA, 22 bp, Artificial Sequence
  chemically synthesized
aagctagaaggttgagaagatg

SEQ ID NO: 661246 - DNA, 22 bp, Artificial Sequence
  chemically synthesized
gaagctagaaggttgagaagat

SEQ ID NO: 661247 - DNA, 22 bp, Artificial Sequence
  chemically synthesized
tgaagctagaaggttgagaaga

SEQ ID NO: 661248 - DNA, 22 bp, Artificial Sequence
  chemically synthesized
ttgaagctagaaggttgagaag

SEQ ID NO: 661249 - DNA, 22 bp, Artificial Sequence
  chemically synthesized
tgcctaatcatcttctcaacct

SEQ ID NO: 661250 - DNA, 22 bp, Artificial Sequence
  chemically synthesized
atcatcttctcaaccttctagc

SEQ ID NO: 661251 - DNA, 22 bp, Artificial Sequence
  chemically synthesized
ctcaaccttctagcttcaaaag

SEQ ID NO: 661252 - DNA, 22 bp, Artificial Sequence
  chemically synthesized
tcaaccttctagcttcaaaagc

SEQ ID NO: 661253 - DNA, 22 bp, Artificial Sequence
  chemically synthesized
aaccttctagcttcaaaagctc

SEQ ID NO: 661254 - DNA, 22 bp, Artificial Sequence
  chemically synthesized
ctagcttcaaaagctcattctt

SEQ ID NO: 661255 - DNA, 22 bp, Artificial Sequence
  chemically synthesized
tagcttcaaaagctcattcttt

SEQ ID NO: 661256 - DNA, 22 bp, Artificial Sequence
  chemically synthesized
gcttcaaaagctcattcttttc

SEQ ID NO: 661257 - DNA, 22 bp, Artificial Sequence
  chemically synthesized
caaaagctcattcttttccttt

SEQ ID NO: 661258 - DNA, 22 bp, Artificial Sequence
  chemically synthesized
tggcatacatagaaaggaaaag

SEQ ID NO: 661259 - DNA, 22 bp, Artificial Sequence
  chemically synthesized
aaaagctcattcttttcctttc

SEQ ID NO: 661260 - DNA, 22 bp, Artificial Sequence
  chemically synthesized
ctgtggcatacatagaaaggaa

SEQ ID NO: 661261 - DNA, 22 bp, Artificial Sequence
  chemically synthesized
gctactgtggcatacatagaaa

SEQ ID NO: 661262 - DNA, 22 bp, Artificial Sequence
  chemically synthesized
attcttttcctttctatgtatg

SEQ ID NO: 661263 - DNA, 22 bp, Artificial Sequence
  chemically synthesized
ttttcctttctatgtatgccac

SEQ ID NO: 661264 - DNA, 22 bp, Artificial Sequence
  chemically synthesized
ttcctttctatgtatgccacag

SEQ ID NO: 661265 - DNA, 22 bp, Artificial Sequence
  chemically synthesized
tcctttctatgtatgccacagt

SEQ ID NO: 661266 - DNA, 22 bp, Artificial Sequence
  chemically synthesized
cctttctatgtatgccacagta

SEQ ID NO: 661267 - DNA, 22 bp, Artificial Sequence
  chemically synthesized
ctttctatgtatgccacagtag

SEQ ID NO: 661268 - DNA, 22 bp, Artificial Sequence
  chemically synthesized
tctatgtatgccacagtagcta

SEQ ID NO: 661269 - DNA, 22 bp, Artificial Sequence
  chemically synthesized
ctatgtatgccacagtagctaa

SEQ ID NO: 661270 - DNA, 22 bp, Artificial Sequence
  chemically synthesized
tatgtatgccacagtagctaac

SEQ ID NO: 661271 - DNA, 22 bp, Artificial Sequence
  chemically synthesized
tgtatgccacagtagctaactc

SEQ ID NO: 661272 - DNA, 22 bp, Artificial Sequence
  chemically synthesized
cataggaaggaatagcaagagt

SEQ ID NO: 661273 - DNA, 22 bp, Artificial Sequence
  chemically synthesized
acataggaaggaatagcaagag

SEQ ID NO: 661274 - DNA, 22 bp, Artificial Sequence
  chemically synthesized
tcttacataggaaggaatagca

SEQ ID NO: 661275 - DNA, 22 bp, Artificial Sequence
  chemically synthesized
actcttgctattccttcctatg

SEQ ID NO: 661276 - DNA, 22 bp, Artificial Sequence
  chemically synthesized
ttgctattccttcctatgtaag

SEQ ID NO: 661277 - DNA, 22 bp, Artificial Sequence
  chemically synthesized
gctattccttcctatgtaagac

SEQ ID NO: 661278 - DNA, 22 bp, Artificial Sequence
  chemically synthesized
ctattccttcctatgtaagaca

SEQ ID NO: 661279 - DNA, 22 bp, Artificial Sequence
  chemically synthesized
ttccttcctatgtaagacagat

SEQ ID NO: 661280 - DNA, 22 bp, Artificial Sequence
  chemically synthesized
cttcctatgtaagacagatttt

SEQ ID NO: 661281 - DNA, 22 bp, Artificial Sequence
  chemically synthesized
taaaagacaaaaaaaatctgtc

SEQ ID NO: 661282 - DNA, 22 bp, Artificial Sequence
  chemically synthesized
tgtaaaagacaaaaaaaatctg

SEQ ID NO: 661283 - DNA, 22 bp, Artificial Sequence
  chemically synthesized
cctatgtaagacagattttttt

SEQ ID NO: 661284 - DNA, 22 bp, Artificial Sequence
  chemically synthesized
ctatgtaagacagatttttttt

SEQ ID NO: 661285 - DNA, 22 bp, Artificial Sequence
  chemically synthesized
tgtaagacagattttttttgtc

SEQ ID NO: 661286 - DNA, 22 bp, Artificial Sequence
  chemically synthesized
tcactctgtaaaagacaaaaaa

SEQ ID NO: 661287 - DNA, 22 bp, Artificial Sequence
  chemically synthesized
agagtctatcactctgtaaaag

SEQ ID NO: 661288 - DNA, 22 bp, Artificial Sequence
  chemically synthesized
taagagtctatcactctgtaaa

SEQ ID NO: 661289 - DNA, 22 bp, Artificial Sequence
  chemically synthesized
tttttgtcttttacagagtgat

SEQ ID NO: 661290 - DNA, 22 bp, Artificial Sequence
  chemically synthesized
ttttgtcttttacagagtgata

SEQ ID NO: 661291 - DNA, 22 bp, Artificial Sequence
  chemically synthesized
gctctaagagtctatcactctg

SEQ ID NO: 661292 - DNA, 22 bp, Artificial Sequence
  chemically synthesized
tttgtcttttacagagtgatag

SEQ ID NO: 661293 - DNA, 22 bp, Artificial Sequence
  chemically synthesized
ttgtcttttacagagtgataga

SEQ ID NO: 661294 - DNA, 22 bp, Artificial Sequence
  chemically synthesized
tggctctaagagtctatcactc

SEQ ID NO: 661295 - DNA, 22 bp, Artificial Sequence
  chemically synthesized
tgtcttttacagagtgatagac

SEQ ID NO: 661296 - DNA, 22 bp, Artificial Sequence
  chemically synthesized
ctggctctaagagtctatcact

SEQ ID NO: 661297 - DNA, 22 bp, Artificial Sequence
  chemically synthesized
gtcttttacagagtgatagact

SEQ ID NO: 661298 - DNA, 22 bp, Artificial Sequence
  chemically synthesized
tcttttacagagtgatagactc

SEQ ID NO: 661299 - DNA, 22 bp, Artificial Sequence
  chemically synthesized
ttacagagtgatagactcttag

SEQ ID NO: 661300 - DNA, 22 bp, Artificial Sequence
  chemically synthesized
tacagagtgatagactcttaga

SEQ ID NO: 661301 - DNA, 22 bp, Artificial Sequence
  chemically synthesized
acagagtgatagactcttagag

SEQ ID NO: 661302 - DNA, 22 bp, Artificial Sequence
  chemically synthesized
cagagtgatagactcttagagc

SEQ ID NO: 661303 - DNA, 22 bp, Artificial Sequence
  chemically synthesized
aagcaaccttctggctctaaga

SEQ ID NO: 661304 - DNA, 22 bp, Artificial Sequence
  chemically synthesized
aaagcaaccttctggctctaag

SEQ ID NO: 661305 - DNA, 22 bp, Artificial Sequence
  chemically synthesized
taaagcaaccttctggctctaa

SEQ ID NO: 661306 - DNA, 22 bp, Artificial Sequence
  chemically synthesized
caaaatgattttaaagcaacct

SEQ ID NO: 661307 - DNA, 22 bp, Artificial Sequence
  chemically synthesized
ttagagccagaaggttgcttta

SEQ ID NO: 661308 - DNA, 22 bp, Artificial Sequence
  chemically synthesized
agagccagaaggttgctttaaa

SEQ ID NO: 661309 - DNA, 22 bp, Artificial Sequence
  chemically synthesized
gagccagaaggttgctttaaaa

SEQ ID NO: 661310 - DNA, 22 bp, Artificial Sequence
  chemically synthesized
aactgcaaaatgattttaaagc

SEQ ID NO: 661311 - DNA, 22 bp, Artificial Sequence
  chemically synthesized
tctcaactgcaaaatgatttta

SEQ ID NO: 661312 - DNA, 22 bp, Artificial Sequence
  chemically synthesized
agttgtctcaactgcaaaatga

SEQ ID NO: 661313 - DNA, 22 bp, Artificial Sequence
  chemically synthesized
ctttaaaatcattttgcagttg

SEQ ID NO: 661314 - DNA, 22 bp, Artificial Sequence
  chemically synthesized
gtctcagttgtctcaactgcaa

SEQ ID NO: 661315 - DNA, 22 bp, Artificial Sequence
  chemically synthesized
taaaatcattttgcagttgaga

SEQ ID NO: 661316 - DNA, 22 bp, Artificial Sequence
  chemically synthesized
tggtctcagttgtctcaactgc

SEQ ID NO: 661317 - DNA, 22 bp, Artificial Sequence
  chemically synthesized
aaaatcattttgcagttgagac

SEQ ID NO: 661318 - DNA, 22 bp, Artificial Sequence
  chemically synthesized
aaatcattttgcagttgagaca

SEQ ID NO: 661319 - DNA, 22 bp, Artificial Sequence
  chemically synthesized
catatctctggtctcagttgtc

SEQ ID NO: 661320 - DNA, 22 bp, Artificial Sequence
  chemically synthesized
tgcagttgagacaactgagacc

SEQ ID NO: 661321 - DNA, 22 bp, Artificial Sequence
  chemically synthesized
gcagttgagacaactgagacca

SEQ ID NO: 661322 - DNA, 22 bp, Artificial Sequence
  chemically synthesized
cagttgagacaactgagaccag

SEQ ID NO: 661323 - DNA, 22 bp, Artificial Sequence
  chemically synthesized
agacaactgagaccagagatat

SEQ ID NO: 661324 - DNA, 22 bp, Artificial Sequence
  chemically synthesized
agaccagagatatggagactca

SEQ ID NO: 661325 - DNA, 22 bp, Artificial Sequence
  chemically synthesized
ccataacacccagagtgagtct

SEQ ID NO: 661326 - DNA, 22 bp, Artificial Sequence
  chemically synthesized
gatatcctgccataacacccag

SEQ ID NO: 661327 - DNA, 22 bp, Artificial Sequence
  chemically synthesized
actctgggtgttatggcaggat

SEQ ID NO: 661328 - DNA, 22 bp, Artificial Sequence
  chemically synthesized
tgggtgttatggcaggatatct

SEQ ID NO: 661329 - DNA, 22 bp, Artificial Sequence
  chemically synthesized
ggtgttatggcaggatatctag

SEQ ID NO: 661330 - DNA, 22 bp, Artificial Sequence
  chemically synthesized
catgagaaatcagaaaacctag

SEQ ID NO: 661331 - DNA, 22 bp, Artificial Sequence
  chemically synthesized
tggcaggatatctaggttttct

SEQ ID NO: 661332 - DNA, 22 bp, Artificial Sequence
  chemically synthesized
caatatgtacctccatgagaaa

SEQ ID NO: 661333 - DNA, 22 bp, Artificial Sequence
  chemically synthesized
acaatatgtacctccatgagaa

SEQ ID NO: 661334 - DNA, 22 bp, Artificial Sequence
  chemically synthesized
ggttttctgatttctcatggag

SEQ ID NO: 661335 - DNA, 22 bp, Artificial Sequence
  chemically synthesized
tctgatttctcatggaggtaca

SEQ ID NO: 661336 - DNA, 22 bp, Artificial Sequence
  chemically synthesized
ccccttacaatatgtacctcca

SEQ ID NO: 661337 - DNA, 22 bp, Artificial Sequence
  chemically synthesized
ctgatttctcatggaggtacat

SEQ ID NO: 661338 - DNA, 22 bp, Artificial Sequence
  chemically synthesized
cccccttacaatatgtacctcc

SEQ ID NO: 661339 - DNA, 22 bp, Artificial Sequence
  chemically synthesized
tgatttctcatggaggtacata

SEQ ID NO: 661340 - DNA, 22 bp, Artificial Sequence
  chemically synthesized
tcccccttacaatatgtacctc

SEQ ID NO: 661341 - DNA, 22 bp, Artificial Sequence
  chemically synthesized
ttcccccttacaatatgtacct

SEQ ID NO: 661342 - DNA, 22 bp, Artificial Sequence
  chemically synthesized
atttctcatggaggtacatatt

SEQ ID NO: 661343 - DNA, 22 bp, Artificial Sequence
  chemically synthesized
ctcatggaggtacatattgtaa

SEQ ID NO: 661344 - DNA, 22 bp, Artificial Sequence
  chemically synthesized
tcatggaggtacatattgtaag

SEQ ID NO: 661345 - DNA, 22 bp, Artificial Sequence
  chemically synthesized
atggaggtacatattgtaaggg

SEQ ID NO: 661346 - DNA, 22 bp, Artificial Sequence
  chemically synthesized
ccacccacttttcccccttaca

SEQ ID NO: 661347 - DNA, 22 bp, Artificial Sequence
  chemically synthesized
tgccacccacttttccccctta

SEQ ID NO: 661348 - DNA, 22 bp, Artificial Sequence
  chemically synthesized
ctgccacccacttttccccctt

SEQ ID NO: 661349 - DNA, 22 bp, Artificial Sequence
  chemically synthesized
taagggggaaaagtgggtggca

SEQ ID NO: 661350 - DNA, 22 bp, Artificial Sequence
  chemically synthesized
taaagtcagtaaggacaccttc

SEQ ID NO: 661351 - DNA, 22 bp, Artificial Sequence
  chemically synthesized
tgtaaagtcagtaaggacacct

SEQ ID NO: 661352 - DNA, 22 bp, Artificial Sequence
  chemically synthesized
ttctgtaaagtcagtaaggaca

SEQ ID NO: 661353 - DNA, 22 bp, Artificial Sequence
  chemically synthesized
ctgttctgtaaagtcagtaagg

SEQ ID NO: 661354 - DNA, 22 bp, Artificial Sequence
  chemically synthesized
cctgttctgtaaagtcagtaag

SEQ ID NO: 661355 - DNA, 22 bp, Artificial Sequence
  chemically synthesized
tcctgttctgtaaagtcagtaa

SEQ ID NO: 661356 - DNA, 22 bp, Artificial Sequence
  chemically synthesized
actgactttacagaacaggaaa

SEQ ID NO: 661357 - DNA, 22 bp, Artificial Sequence
  chemically synthesized
ctgactttacagaacaggaaaa

SEQ ID NO: 661358 - DNA, 22 bp, Artificial Sequence
  chemically synthesized
actttacagaacaggaaaacca

SEQ ID NO: 661359 - DNA, 22 bp, Artificial Sequence
  chemically synthesized
gcatggaatgcagaatggtttt

SEQ ID NO: 661360 - DNA, 22 bp, Artificial Sequence
  chemically synthesized
tacagaacaggaaaaccattct

SEQ ID NO: 661361 - DNA, 22 bp, Artificial Sequence
  chemically synthesized
acagaacaggaaaaccattctg

SEQ ID NO: 661362 - DNA, 22 bp, Artificial Sequence
  chemically synthesized
cagaacaggaaaaccattctgc

SEQ ID NO: 661363 - DNA, 22 bp, Artificial Sequence
  chemically synthesized
tcattagcatggaatgcagaat

SEQ ID NO: 661364 - DNA, 22 bp, Artificial Sequence
  chemically synthesized
ttgtcattagcatggaatgcag

SEQ ID NO: 661365 - DNA, 22 bp, Artificial Sequence
  chemically synthesized
ctgttgtcattagcatggaatg

SEQ ID NO: 661366 - DNA, 22 bp, Artificial Sequence
  chemically synthesized
tcctactgttgtcattagcatg

SEQ ID NO: 661367 - DNA, 22 bp, Artificial Sequence
  chemically synthesized
atcctactgttgtcattagcat

SEQ ID NO: 661368 - DNA, 22 bp, Artificial Sequence
  chemically synthesized
tatcctactgttgtcattagca

SEQ ID NO: 661369 - DNA, 22 bp, Artificial Sequence
  chemically synthesized
tgcattccatgctaatgacaac

SEQ ID NO: 661370 - DNA, 22 bp, Artificial Sequence
  chemically synthesized
ttttatcctactgttgtcatta

SEQ ID NO: 661371 - DNA, 22 bp, Artificial Sequence
  chemically synthesized
cattccatgctaatgacaacag

SEQ ID NO: 661372 - DNA, 22 bp, Artificial Sequence
  chemically synthesized
tgttttatcctactgttgtcat

SEQ ID NO: 661373 - DNA, 22 bp, Artificial Sequence
  chemically synthesized
ctgttttatcctactgttgtca

SEQ ID NO: 661374 - DNA, 22 bp, Artificial Sequence
  chemically synthesized
catgctaatgacaacagtagga

SEQ ID NO: 661375 - DNA, 22 bp, Artificial Sequence
  chemically synthesized
gtgcttctgttttatcctactg

SEQ ID NO: 661376 - DNA, 22 bp, Artificial Sequence
  chemically synthesized
ggtgcttctgttttatcctact

SEQ ID NO: 661377 - DNA, 22 bp, Artificial Sequence
  chemically synthesized
tggtgcttctgttttatcctac

SEQ ID NO: 661378 - DNA, 22 bp, Artificial Sequence
  chemically synthesized
ttggtgcttctgttttatccta

SEQ ID NO: 661379 - DNA, 22 bp, Artificial Sequence
  chemically synthesized
tttggtgcttctgttttatcct

SEQ ID NO: 661380 - DNA, 22 bp, Artificial Sequence
  chemically synthesized
atgacaacagtaggataaaaca

SEQ ID NO: 661381 - DNA, 22 bp, Artificial Sequence
  chemically synthesized
accaactttttggtgcttctgt

SEQ ID NO: 661382 - DNA, 22 bp, Artificial Sequence
  chemically synthesized
cactaaccaactttttggtgct

SEQ ID NO: 661383 - DNA, 22 bp, Artificial Sequence
  chemically synthesized
tccactaaccaactttttggtg

SEQ ID NO: 661384 - DNA, 22 bp, Artificial Sequence
  chemically synthesized
ctccactaaccaactttttggt

SEQ ID NO: 661385 - DNA, 22 bp, Artificial Sequence
  chemically synthesized
tctccactaaccaactttttgg

SEQ ID NO: 661386 - DNA, 22 bp, Artificial Sequence
  chemically synthesized
ttctccactaaccaactttttg

SEQ ID NO: 661387 - DNA, 22 bp, Artificial Sequence
  chemically synthesized
tttctccactaaccaacttttt

SEQ ID NO: 661388 - DNA, 22 bp, Artificial Sequence
  chemically synthesized
ttttctccactaaccaactttt

SEQ ID NO: 661389 - DNA, 22 bp, Artificial Sequence
  chemically synthesized
tttttctccactaaccaacttt

SEQ ID NO: 661390 - DNA, 22 bp, Artificial Sequence
  chemically synthesized
ttttttctccactaaccaactt

SEQ ID NO: 661391 - DNA, 22 bp, Artificial Sequence
  chemically synthesized
tttttttctccactaaccaact

SEQ ID NO: 661392 - DNA, 22 bp, Artificial Sequence
  chemically synthesized
gttagtggagaaaaaaaaagtc

SEQ ID NO: 661393 - DNA, 22 bp, Artificial Sequence
  chemically synthesized
tatgggcaccatgagacttttt

SEQ ID NO: 661394 - DNA, 22 bp, Artificial Sequence
  chemically synthesized
gtggagaaaaaaaaagtctcat

SEQ ID NO: 661395 - DNA, 22 bp, Artificial Sequence
  chemically synthesized
gggttatatgggcaccatgaga

SEQ ID NO: 661396 - DNA, 22 bp, Artificial Sequence
  chemically synthesized
ggggttatatgggcaccatgag

SEQ ID NO: 661397 - DNA, 22 bp, Artificial Sequence
  chemically synthesized
taggatgaacttggggttatat

SEQ ID NO: 661398 - DNA, 22 bp, Artificial Sequence
  chemically synthesized
atggtgcccatataaccccaag

SEQ ID NO: 661399 - DNA, 22 bp, Artificial Sequence
  chemically synthesized
acctataggatgaacttggggt

SEQ ID NO: 661400 - DNA, 22 bp, Artificial Sequence
  chemically synthesized
atcctataggtcaatctgtata

SEQ ID NO: 661401 - DNA, 22 bp, Artificial Sequence
  chemically synthesized
tacatcaacatagaatatacag

SEQ ID NO: 661402 - DNA, 22 bp, Artificial Sequence
  chemically synthesized
atacatcaacatagaatataca

SEQ ID NO: 661403 - DNA, 22 bp, Artificial Sequence
  chemically synthesized
taggtcaatctgtatattctat

SEQ ID NO: 661404 - DNA, 22 bp, Artificial Sequence
  chemically synthesized
tttatacatcaacatagaatat

SEQ ID NO: 661405 - DNA, 22 bp, Artificial Sequence
  chemically synthesized
tatattctatgttgatgtataa

SEQ ID NO: 661406 - DNA, 22 bp, Artificial Sequence
  chemically synthesized
gatcacagaattatttatacat

SEQ ID NO: 661407 - DNA, 22 bp, Artificial Sequence
  chemically synthesized
attagatcacagaattatttat

SEQ ID NO: 661408 - DNA, 22 bp, Artificial Sequence
  chemically synthesized
tatgttgatgtataaataattc

SEQ ID NO: 661409 - DNA, 22 bp, Artificial Sequence
  chemically synthesized
tgttgatgtataaataattctg

SEQ ID NO: 661410 - DNA, 22 bp, Artificial Sequence
  chemically synthesized
tgctaattagatcacagaatta

SEQ ID NO: 661411 - DNA, 22 bp, Artificial Sequence
  chemically synthesized
tgtgctaattagatcacagaat

SEQ ID NO: 661412 - DNA, 22 bp, Artificial Sequence
  chemically synthesized
atgtataaataattctgtgatc

SEQ ID NO: 661413 - DNA, 22 bp, Artificial Sequence
  chemically synthesized
ctgtgctaattagatcacagaa

SEQ ID NO: 661414 - DNA, 22 bp, Artificial Sequence
  chemically synthesized
tttctgtgctaattagatcaca

SEQ ID NO: 661415 - DNA, 22 bp, Artificial Sequence
  chemically synthesized
tgtttctgtgctaattagatca

SEQ ID NO: 661416 - DNA, 22 bp, Artificial Sequence
  chemically synthesized
ctgtttctgtgctaattagatc

SEQ ID NO: 661417 - DNA, 22 bp, Artificial Sequence
  chemically synthesized
tctgtttctgtgctaattagat

SEQ ID NO: 661418 - DNA, 22 bp, Artificial Sequence
  chemically synthesized
tttctgtttctgtgctaattag

SEQ ID NO: 661419 - DNA, 22 bp, Artificial Sequence
  chemically synthesized
acctctttctgtttctgtgcta

SEQ ID NO: 661420 - DNA, 22 bp, Artificial Sequence
  chemically synthesized
tgtgatctaattagcacagaaa

SEQ ID NO: 661421 - DNA, 22 bp, Artificial Sequence
  chemically synthesized
tgatctaattagcacagaaaca

SEQ ID NO: 661422 - DNA, 22 bp, Artificial Sequence
  chemically synthesized
ctcacctctttctgtttctgtg

SEQ ID NO: 661423 - DNA, 22 bp, Artificial Sequence
  chemically synthesized
attagcacagaaacagaaagag

SEQ ID NO: 661424 - DNA, 22 bp, Artificial Sequence
  chemically synthesized
caccattactcacctctttctg

SEQ ID NO: 661425 - DNA, 22 bp, Artificial Sequence
  chemically synthesized
ccaccattactcacctctttct

SEQ ID NO: 661426 - DNA, 22 bp, Artificial Sequence
  chemically synthesized
gcacagaaacagaaagaggtga

SEQ ID NO: 661427 - DNA, 22 bp, Artificial Sequence
  chemically synthesized
ttccaccattactcacctcttt

SEQ ID NO: 661428 - DNA, 22 bp, Artificial Sequence
  chemically synthesized
ggcaagaaaaatcagcaaacat

SEQ ID NO: 661429 - DNA, 22 bp, Artificial Sequence
  chemically synthesized
ctgtatgtttgctgatttttct

SEQ ID NO: 661430 - DNA, 22 bp, Artificial Sequence
  chemically synthesized
tatgtttgctgatttttcttgc

SEQ ID NO: 661431 - DNA, 22 bp, Artificial Sequence
  chemically synthesized
tagagtggcatgcctgggcaag

SEQ ID NO: 661432 - DNA, 22 bp, Artificial Sequence
  chemically synthesized
gctgatttttcttgcccaggca

SEQ ID NO: 661433 - DNA, 22 bp, Artificial Sequence
  chemically synthesized
ctgatttttcttgcccaggcat

SEQ ID NO: 661434 - DNA, 22 bp, Artificial Sequence
  chemically synthesized
cctgtagagtggcatgcctggg

SEQ ID NO: 661435 - DNA, 22 bp, Artificial Sequence
  chemically synthesized
atttttcttgcccaggcatgcc

SEQ ID NO: 661436 - DNA, 22 bp, Artificial Sequence
  chemically synthesized
ttcttgcccaggcatgccactc

SEQ ID NO: 661437 - DNA, 22 bp, Artificial Sequence
  chemically synthesized
tcttgcccaggcatgccactct

SEQ ID NO: 661438 - DNA, 22 bp, Artificial Sequence
  chemically synthesized
cttgcccaggcatgccactcta

SEQ ID NO: 661439 - DNA, 22 bp, Artificial Sequence
  chemically synthesized
ttgcccaggcatgccactctac

SEQ ID NO: 661440 - DNA, 22 bp, Artificial Sequence
  chemically synthesized
gcccaggcatgccactctacag

SEQ ID NO: 661441 - DNA, 22 bp, Artificial Sequence
  chemically synthesized
cccaggcatgccactctacagg

SEQ ID NO: 661442 - DNA, 22 bp, Artificial Sequence
  chemically synthesized
agccataagtgtaagttgcctg

SEQ ID NO: 661443 - DNA, 22 bp, Artificial Sequence
  chemically synthesized
tacaggcaacttacacttatgg

SEQ ID NO: 661444 - DNA, 22 bp, Artificial Sequence
  chemically synthesized
ggaggtccctcagccataagtg

SEQ ID NO: 661445 - DNA, 22 bp, Artificial Sequence
  chemically synthesized
caggcaacttacacttatggct

SEQ ID NO: 661446 - DNA, 22 bp, Artificial Sequence
  chemically synthesized
gggaggtccctcagccataagt

SEQ ID NO: 661447 - DNA, 22 bp, Artificial Sequence
  chemically synthesized
cttgggaggtccctcagccata

SEQ ID NO: 661448 - DNA, 22 bp, Artificial Sequence
  chemically synthesized
gcttgggaggtccctcagccat

SEQ ID NO: 661449 - DNA, 22 bp, Artificial Sequence
  chemically synthesized
acacttatggctgagggacctc

SEQ ID NO: 661450 - DNA, 22 bp, Artificial Sequence
  chemically synthesized
cacttatggctgagggacctcc

SEQ ID NO: 661451 - DNA, 22 bp, Artificial Sequence
  chemically synthesized
atggctgagggacctcccaagc

SEQ ID NO: 661452 - DNA, 22 bp, Artificial Sequence
  chemically synthesized
tggctgagggacctcccaagca

SEQ ID NO: 661453 - DNA, 22 bp, Artificial Sequence
  chemically synthesized
aagtgcaaagatttgcttggga

SEQ ID NO: 661454 - DNA, 22 bp, Artificial Sequence
  chemically synthesized
gaagtgcaaagatttgcttggg

SEQ ID NO: 661455 - DNA, 22 bp, Artificial Sequence
  chemically synthesized
ttgaagtgcaaagatttgcttg

SEQ ID NO: 661456 - DNA, 22 bp, Artificial Sequence
  chemically synthesized
cttgaagtgcaaagatttgctt

SEQ ID NO: 661457 - DNA, 22 bp, Artificial Sequence
  chemically synthesized
agggacctcccaagcaaatctt

SEQ ID NO: 661458 - DNA, 22 bp, Artificial Sequence
  chemically synthesized
tcttgaagtgcaaagatttgct

SEQ ID NO: 661459 - DNA, 22 bp, Artificial Sequence
  chemically synthesized
actttcttgaagtgcaaagatt

SEQ ID NO: 661460 - DNA, 22 bp, Artificial Sequence
  chemically synthesized
ccaagcaaatctttgcacttca

SEQ ID NO: 661461 - DNA, 22 bp, Artificial Sequence
  chemically synthesized
catcaaagtgcattgactttct

SEQ ID NO: 661462 - DNA, 22 bp, Artificial Sequence
  chemically synthesized
tgcacttcaagaaagtcaatgc

SEQ ID NO: 661463 - DNA, 22 bp, Artificial Sequence
  chemically synthesized
gcacttcaagaaagtcaatgca

SEQ ID NO: 661464 - DNA, 22 bp, Artificial Sequence
  chemically synthesized
cacttcaagaaagtcaatgcac

SEQ ID NO: 661465 - DNA, 22 bp, Artificial Sequence
  chemically synthesized
caagaaagtcaatgcactttga

SEQ ID NO: 661466 - DNA, 22 bp, Artificial Sequence
  chemically synthesized
aagaaagtcaatgcactttgat

SEQ ID NO: 661467 - DNA, 22 bp, Artificial Sequence
  chemically synthesized
cacagacaactacatcaaagtg

SEQ ID NO: 661468 - DNA, 22 bp, Artificial Sequence
  chemically synthesized
ctgcacagacaactacatcaaa

SEQ ID NO: 661469 - DNA, 22 bp, Artificial Sequence
  chemically synthesized
actgcacagacaactacatcaa

SEQ ID NO: 661470 - DNA, 22 bp, Artificial Sequence
  chemically synthesized
acccttactgcacagacaacta

SEQ ID NO: 661471 - DNA, 22 bp, Artificial Sequence
  chemically synthesized
gaattaacccttactgcacaga

SEQ ID NO: 661472 - DNA, 22 bp, Artificial Sequence
  chemically synthesized
tgatgtagttgtctgtgcagta

SEQ ID NO: 661473 - DNA, 22 bp, Artificial Sequence
  chemically synthesized
gatgtagttgtctgtgcagtaa

SEQ ID NO: 661474 - DNA, 22 bp, Artificial Sequence
  chemically synthesized
tggaattaacccttactgcaca

SEQ ID NO: 661475 - DNA, 22 bp, Artificial Sequence
  chemically synthesized
atgtagttgtctgtgcagtaag

SEQ ID NO: 661476 - DNA, 22 bp, Artificial Sequence
  chemically synthesized
tctggaattaacccttactgca

SEQ ID NO: 661477 - DNA, 22 bp, Artificial Sequence
  chemically synthesized
cagcctctctggaattaaccct

SEQ ID NO: 661478 - DNA, 22 bp, Artificial Sequence
  chemically synthesized
tctgtgcagtaagggttaattc

SEQ ID NO: 661479 - DNA, 22 bp, Artificial Sequence
  chemically synthesized
tgcagtaagggttaattccaga

SEQ ID NO: 661480 - DNA, 22 bp, Artificial Sequence
  chemically synthesized
gtgccaactccagcctctctgg

SEQ ID NO: 661481 - DNA, 22 bp, Artificial Sequence
  chemically synthesized
attccagagaggctggagttgg

SEQ ID NO: 661482 - DNA, 22 bp, Artificial Sequence
  chemically synthesized
gcaagtcatctcgtgccaactc

SEQ ID NO: 661483 - DNA, 22 bp, Artificial Sequence
  chemically synthesized
cagagaggctggagttggcacg

SEQ ID NO: 661484 - DNA, 22 bp, Artificial Sequence
  chemically synthesized
agcaagtcatctcgtgccaact

SEQ ID NO: 661485 - DNA, 22 bp, Artificial Sequence
  chemically synthesized
tagcaagtcatctcgtgccaac

SEQ ID NO: 661486 - DNA, 22 bp, Artificial Sequence
  chemically synthesized
gagttggcacgagatgacttgc

SEQ ID NO: 661487 - DNA, 22 bp, Artificial Sequence
  chemically synthesized
tgtagatattttagcaagtcat

SEQ ID NO: 661488 - DNA, 22 bp, Artificial Sequence
  chemically synthesized
gcacgagatgacttgctaaaat

SEQ ID NO: 661489 - DNA, 22 bp, Artificial Sequence
  chemically synthesized
cactgtgtagatattttagcaa

SEQ ID NO: 661490 - DNA, 22 bp, Artificial Sequence
  chemically synthesized
tgcactgtgtagatattttagc

SEQ ID NO: 661491 - DNA, 22 bp, Artificial Sequence
  chemically synthesized
accagggctctgcactgtgtag

SEQ ID NO: 661492 - DNA, 22 bp, Artificial Sequence
  chemically synthesized
gaccagggctctgcactgtgta

SEQ ID NO: 661493 - DNA, 22 bp, Artificial Sequence
  chemically synthesized
gctaaaatatctacacagtgca

SEQ ID NO: 661494 - DNA, 22 bp, Artificial Sequence
  chemically synthesized
tgaccagggctctgcactgtgt

SEQ ID NO: 661495 - DNA, 22 bp, Artificial Sequence
  chemically synthesized
ctaaaatatctacacagtgcag

SEQ ID NO: 661496 - DNA, 22 bp, Artificial Sequence
  chemically synthesized
aaatatctacacagtgcagagc

SEQ ID NO: 661497 - DNA, 22 bp, Artificial Sequence
  chemically synthesized
cacagtgcagagccctggtcaa

SEQ ID NO: 661498 - DNA, 22 bp, Artificial Sequence
  chemically synthesized
aaaagcaagtgctttgaccagg

SEQ ID NO: 661499 - DNA, 22 bp, Artificial Sequence
  chemically synthesized
gaaaagcaagtgctttgaccag

SEQ ID NO: 661500 - DNA, 22 bp, Artificial Sequence
  chemically synthesized
tgaaaagcaagtgctttgacca

SEQ ID NO: 661501 - DNA, 22 bp, Artificial Sequence
  chemically synthesized
gtcaaagcacttgcttttcaaa

SEQ ID NO: 661502 - DNA, 22 bp, Artificial Sequence
  chemically synthesized
aacacagtaagtcactttgaaa

SEQ ID NO: 661503 - DNA, 22 bp, Artificial Sequence
  chemically synthesized
caacacagtaagtcactttgaa

SEQ ID NO: 661504 - DNA, 22 bp, Artificial Sequence
  chemically synthesized
cacttcaacacagtaagtcact

SEQ ID NO: 661505 - DNA, 22 bp, Artificial Sequence
  chemically synthesized
gcttttcaaagtgacttactgt

SEQ ID NO: 661506 - DNA, 22 bp, Artificial Sequence
  chemically synthesized
cttttcaaagtgacttactgtg

SEQ ID NO: 661507 - DNA, 22 bp, Artificial Sequence
  chemically synthesized
ttcaaagtgacttactgtgttg

SEQ ID NO: 661508 - DNA, 22 bp, Artificial Sequence
  chemically synthesized
tcaaagtgacttactgtgttga

SEQ ID NO: 661509 - DNA, 22 bp, Artificial Sequence
  chemically synthesized
caaagtgacttactgtgttgaa

SEQ ID NO: 661510 - DNA, 22 bp, Artificial Sequence
  chemically synthesized
aaagtgacttactgtgttgaag

SEQ ID NO: 661511 - DNA, 22 bp, Artificial Sequence
  chemically synthesized
caacccatggctacacttcaac

SEQ ID NO: 661512 - DNA, 22 bp, Artificial Sequence
  chemically synthesized
actgtgttgaagtgtagccatg

SEQ ID NO: 661513 - DNA, 22 bp, Artificial Sequence
  chemically synthesized
ctgtgttgaagtgtagccatgg

SEQ ID NO: 661514 - DNA, 22 bp, Artificial Sequence
  chemically synthesized
tgttgaagtgtagccatgggtt

SEQ ID NO: 661515 - DNA, 22 bp, Artificial Sequence
  chemically synthesized
aagtgtagccatgggttgcagg

SEQ ID NO: 661516 - DNA, 22 bp, Artificial Sequence
  chemically synthesized
gcaataaacaatggtgataacc

SEQ ID NO: 661517 - DNA, 22 bp, Artificial Sequence
  chemically synthesized
ttagcaataaacaatggtgata

SEQ ID NO: 661518 - DNA, 22 bp, Artificial Sequence
  chemically synthesized
ctgttagcaataaacaatggtg

SEQ ID NO: 661519 - DNA, 22 bp, Artificial Sequence
  chemically synthesized
caggttatcaccattgtttatt

SEQ ID NO: 661520 - DNA, 22 bp, Artificial Sequence
  chemically synthesized
tcaccattgtttattgctaaca

SEQ ID NO: 661521 - DNA, 22 bp, Artificial Sequence
  chemically synthesized
tttattgctaacagtaacattg

SEQ ID NO: 661522 - DNA, 22 bp, Artificial Sequence
  chemically synthesized
attgctaacagtaacattgacc

SEQ ID NO: 661523 - DNA, 22 bp, Artificial Sequence
  chemically synthesized
ttgctaacagtaacattgacca

SEQ ID NO: 661524 - DNA, 22 bp, Artificial Sequence
  chemically synthesized
tgcccgggtaaaaatggtcaat

SEQ ID NO: 661525 - DNA, 22 bp, Artificial Sequence
  chemically synthesized
ctaacagtaacattgaccattt

SEQ ID NO: 661526 - DNA, 22 bp, Artificial Sequence
  chemically synthesized
acagtaacattgaccattttta

SEQ ID NO: 661527 - DNA, 22 bp, Artificial Sequence
  chemically synthesized
actgtgcccgggtaaaaatggt

SEQ ID NO: 661528 - DNA, 22 bp, Artificial Sequence
  chemically synthesized
gtctgactgtgcccgggtaaaa

SEQ ID NO: 661529 - DNA, 22 bp, Artificial Sequence
  chemically synthesized
cgttggtctgactgtgcccggg

SEQ ID NO: 661530 - DNA, 22 bp, Artificial Sequence
  chemically synthesized
ccgttggtctgactgtgcccgg

SEQ ID NO: 661531 - DNA, 22 bp, Artificial Sequence
  chemically synthesized
accatttttacccgggcacagt

SEQ ID NO: 661532 - DNA, 22 bp, Artificial Sequence
  chemically synthesized
ttacccgggcacagtcagacca

SEQ ID NO: 661533 - DNA, 22 bp, Artificial Sequence
  chemically synthesized
agtggcttccgttggtctgact

SEQ ID NO: 661534 - DNA, 22 bp, Artificial Sequence
  chemically synthesized
tacccgggcacagtcagaccaa

SEQ ID NO: 661535 - DNA, 22 bp, Artificial Sequence
  chemically synthesized
acccgggcacagtcagaccaac

SEQ ID NO: 661536 - DNA, 22 bp, Artificial Sequence
  chemically synthesized
cccgggcacagtcagaccaacg

SEQ ID NO: 661537 - DNA, 22 bp, Artificial Sequence
  chemically synthesized
aaactcagtggcttccgttggt

SEQ ID NO: 661538 - DNA, 22 bp, Artificial Sequence
  chemically synthesized
tgtaaccagcctcaaactcagt

SEQ ID NO: 661539 - DNA, 22 bp, Artificial Sequence
  chemically synthesized
ctatgtaaccagcctcaaactc

SEQ ID NO: 661540 - DNA, 22 bp, Artificial Sequence
  chemically synthesized
ttcctatgtaaccagcctcaaa

SEQ ID NO: 661541 - DNA, 22 bp, Artificial Sequence
  chemically synthesized
ggcatactgttcctatgtaacc

SEQ ID NO: 661542 - DNA, 22 bp, Artificial Sequence
  chemically synthesized
agtttgaggctggttacatagg

SEQ ID NO: 661543 - DNA, 22 bp, Artificial Sequence
  chemically synthesized
gaggctggttacataggaacag

SEQ ID NO: 661544 - DNA, 22 bp, Artificial Sequence
  chemically synthesized
aggctggttacataggaacagt

SEQ ID NO: 661545 - DNA, 22 bp, Artificial Sequence
  chemically synthesized
gttacataggaacagtatgcct

SEQ ID NO: 661546 - DNA, 22 bp, Artificial Sequence
  chemically synthesized
cataggaacagtatgcctaggt

SEQ ID NO: 661547 - DNA, 22 bp, Artificial Sequence
  chemically synthesized
tatcccgtgggtaacctaggca

SEQ ID NO: 661548 - DNA, 22 bp, Artificial Sequence
  chemically synthesized
atatcccgtgggtaacctaggc

SEQ ID NO: 661549 - DNA, 22 bp, Artificial Sequence
  chemically synthesized
ttatatcccgtgggtaacctag

SEQ ID NO: 661550 - DNA, 22 bp, Artificial Sequence
  chemically synthesized
cttatatcccgtgggtaaccta

SEQ ID NO: 661551 - DNA, 22 bp, Artificial Sequence
  chemically synthesized
agccagggtttcttatatcccg

SEQ ID NO: 661552 - DNA, 22 bp, Artificial Sequence
  chemically synthesized
cagccagggtttcttatatccc

SEQ ID NO: 661553 - DNA, 22 bp, Artificial Sequence
  chemically synthesized
ggttacccacgggatataagaa

SEQ ID NO: 661554 - DNA, 22 bp, Artificial Sequence
  chemically synthesized
gagtttcagccagggtttctta

SEQ ID NO: 661555 - DNA, 22 bp, Artificial Sequence
  chemically synthesized
cccacgggatataagaaaccct

SEQ ID NO: 661556 - DNA, 22 bp, Artificial Sequence
  chemically synthesized
gaaaccagggagcacaaattgg

SEQ ID NO: 661557 - DNA, 22 bp, Artificial Sequence
  chemically synthesized
ggaaaccagggagcacaaattg

SEQ ID NO: 661558 - DNA, 22 bp, Artificial Sequence
  chemically synthesized
gctgaaactccaatttgtgctc

SEQ ID NO: 661559 - DNA, 22 bp, Artificial Sequence
  chemically synthesized
aaactccaatttgtgctccctg

SEQ ID NO: 661560 - DNA, 22 bp, Artificial Sequence
  chemically synthesized
caatttgtgctccctggtttcc

SEQ ID NO: 661561 - DNA, 22 bp, Artificial Sequence
  chemically synthesized
gtgctccctggtttccaaggtg

SEQ ID NO: 661562 - DNA, 22 bp, Artificial Sequence
  chemically synthesized
tgctccctggtttccaaggtgt

SEQ ID NO: 661563 - DNA, 22 bp, Artificial Sequence
  chemically synthesized
atgtgagcacagaacaccttgg

SEQ ID NO: 661564 - DNA, 22 bp, Artificial Sequence
  chemically synthesized
ctgatgtgagcacagaacacct

SEQ ID NO: 661565 - DNA, 22 bp, Artificial Sequence
  chemically synthesized
cctggtttccaaggtgttctgt

SEQ ID NO: 661566 - DNA, 22 bp, Artificial Sequence
  chemically synthesized
gtttccaaggtgttctgtgctc

SEQ ID NO: 661567 - DNA, 22 bp, Artificial Sequence
  chemically synthesized
ccaaggtgttctgtgctcacat

SEQ ID NO: 661568 - DNA, 22 bp, Artificial Sequence
  chemically synthesized
caaggtgttctgtgctcacatc

SEQ ID NO: 661569 - DNA, 22 bp, Artificial Sequence
  chemically synthesized
gaacaagagctactgatgtgag

SEQ ID NO: 661570 - DNA, 22 bp, Artificial Sequence
  chemically synthesized
ggaacaagagctactgatgtga

SEQ ID NO: 661571 - DNA, 22 bp, Artificial Sequence
  chemically synthesized
ttggaacaagagctactgatgt

SEQ ID NO: 661572 - DNA, 22 bp, Artificial Sequence
  chemically synthesized
tcttggaacaagagctactgat

SEQ ID NO: 661573 - DNA, 22 bp, Artificial Sequence
  chemically synthesized
tctcttggaacaagagctactg

SEQ ID NO: 661574 - DNA, 22 bp, Artificial Sequence
  chemically synthesized
tgtgctcacatcagtagctctt

SEQ ID NO: 661575 - DNA, 22 bp, Artificial Sequence
  chemically synthesized
ctctcttggaacaagagctact

SEQ ID NO: 661576 - DNA, 22 bp, Artificial Sequence
  chemically synthesized
tctctcttggaacaagagctac

SEQ ID NO: 661577 - DNA, 22 bp, Artificial Sequence
  chemically synthesized
tgctcacatcagtagctcttgt

SEQ ID NO: 661578 - DNA, 22 bp, Artificial Sequence
  chemically synthesized
acatcagtagctcttgttccaa

SEQ ID NO: 661579 - DNA, 22 bp, Artificial Sequence
  chemically synthesized
ttgttccaagagagaaaatgca

SEQ ID NO: 661580 - DNA, 22 bp, Artificial Sequence
  chemically synthesized
gttccaagagagaaaatgcatc

SEQ ID NO: 661581 - DNA, 22 bp, Artificial Sequence
  chemically synthesized
ttccaagagagaaaatgcatcg

SEQ ID NO: 661582 - DNA, 22 bp, Artificial Sequence
  chemically synthesized
caagagccacaccacgatgcat

SEQ ID NO: 661583 - DNA, 22 bp, Artificial Sequence
  chemically synthesized
caagagagaaaatgcatcgtgg

SEQ ID NO: 661584 - DNA, 22 bp, Artificial Sequence
  chemically synthesized
tctgcaagagccacaccacgat

SEQ ID NO: 661585 - DNA, 22 bp, Artificial Sequence
  chemically synthesized
tgtctgcaagagccacaccacg

SEQ ID NO: 661586 - DNA, 22 bp, Artificial Sequence
  chemically synthesized
ccctctgtctgcaagagccaca

SEQ ID NO: 661587 - DNA, 22 bp, Artificial Sequence
  chemically synthesized
taattgccctctgtctgcaaga

SEQ ID NO: 661588 - DNA, 22 bp, Artificial Sequence
  chemically synthesized
ttgcagacagagggcaattata

SEQ ID NO: 661589 - DNA, 22 bp, Artificial Sequence
  chemically synthesized
gcagacagagggcaattatagc

SEQ ID NO: 661590 - DNA, 22 bp, Artificial Sequence
  chemically synthesized
cagacagagggcaattatagct

SEQ ID NO: 661591 - DNA, 22 bp, Artificial Sequence
  chemically synthesized
tagcttgcacctgtcctctctg

SEQ ID NO: 661592 - DNA, 22 bp, Artificial Sequence
  chemically synthesized
acagcatagggtccagagagga

SEQ ID NO: 661593 - DNA, 22 bp, Artificial Sequence
  chemically synthesized
cctcacagcatagggtccagag

SEQ ID NO: 661594 - DNA, 22 bp, Artificial Sequence
  chemically synthesized
gcacctgtcctctctggaccct

SEQ ID NO: 661595 - DNA, 22 bp, Artificial Sequence
  chemically synthesized
cacctgtcctctctggacccta

SEQ ID NO: 661596 - DNA, 22 bp, Artificial Sequence
  chemically synthesized
tcctctctggaccctatgctgt

SEQ ID NO: 661597 - DNA, 22 bp, Artificial Sequence
  chemically synthesized
tctggaccctatgctgtgaggc

SEQ ID NO: 661598 - DNA, 22 bp, Artificial Sequence
  chemically synthesized
tggaccctatgctgtgaggcag

SEQ ID NO: 661599 - DNA, 22 bp, Artificial Sequence
  chemically synthesized
gaccctatgctgtgaggcaggc

SEQ ID NO: 661600 - DNA, 22 bp, Artificial Sequence
  chemically synthesized
tgctgtgaggcaggctgtggct

SEQ ID NO: 661601 - DNA, 22 bp, Artificial Sequence
  chemically synthesized
tgaggcaggctgtggctgtgac

SEQ ID NO: 661602 - DNA, 22 bp, Artificial Sequence
  chemically synthesized
aaacaagaataagtgtcacagc

SEQ ID NO: 661603 - DNA, 22 bp, Artificial Sequence
  chemically synthesized
tggctgtgacacttattcttgt

SEQ ID NO: 661604 - DNA, 22 bp, Artificial Sequence
  chemically synthesized
tgacacttattcttgttttaat

SEQ ID NO: 661605 - DNA, 22 bp, Artificial Sequence
  chemically synthesized
attcttgttttaatgttgtggg

SEQ ID NO: 661606 - DNA, 22 bp, Artificial Sequence
  chemically synthesized
ttcttgttttaatgttgtgggt

SEQ ID NO: 661607 - DNA, 22 bp, Artificial Sequence
  chemically synthesized
ttgttttaatgttgtgggtata

SEQ ID NO: 661608 - DNA, 22 bp, Artificial Sequence
  chemically synthesized
gttttaatgttgtgggtatatt

SEQ ID NO: 661609 - DNA, 22 bp, Artificial Sequence
  chemically synthesized
ttttaatgttgtgggtatattg

SEQ ID NO: 661610 - DNA, 22 bp, Artificial Sequence
  chemically synthesized
cagaaaaaggatgcaatatacc

SEQ ID NO: 661611 - DNA, 22 bp, Artificial Sequence
  chemically synthesized
gcagaaaaaggatgcaatatac

SEQ ID NO: 661612 - DNA, 22 bp, Artificial Sequence
  chemically synthesized
taatgttgtgggtatattgcat

SEQ ID NO: 661613 - DNA, 22 bp, Artificial Sequence
  chemically synthesized
aatgttgtgggtatattgcatc

SEQ ID NO: 661614 - DNA, 22 bp, Artificial Sequence
  chemically synthesized
atgttgtgggtatattgcatcc

SEQ ID NO: 661615 - DNA, 22 bp, Artificial Sequence
  chemically synthesized
cttgcagaaaaaggatgcaata

SEQ ID NO: 661616 - DNA, 22 bp, Artificial Sequence
  chemically synthesized
tgggtatattgcatcctttttc

SEQ ID NO: 661617 - DNA, 22 bp, Artificial Sequence
  chemically synthesized
gagttccttgcagaaaaaggat

SEQ ID NO: 661618 - DNA, 22 bp, Artificial Sequence
  chemically synthesized
cgaatctagagttccttgcaga

SEQ ID NO: 661619 - DNA, 22 bp, Artificial Sequence
  chemically synthesized
acgaatctagagttccttgcag

SEQ ID NO: 661620 - DNA, 22 bp, Artificial Sequence
  chemically synthesized
catcctttttctgcaaggaact

SEQ ID NO: 661621 - DNA, 22 bp, Artificial Sequence
  chemically synthesized
tttctgcaaggaactctagatt

SEQ ID NO: 661622 - DNA, 22 bp, Artificial Sequence
  chemically synthesized
ttctgcaaggaactctagattc

SEQ ID NO: 661623 - DNA, 22 bp, Artificial Sequence
  chemically synthesized
tctgcaaggaactctagattcg

SEQ ID NO: 661624 - DNA, 22 bp, Artificial Sequence
  chemically synthesized
ctgcaaggaactctagattcgt

SEQ ID NO: 661625 - DNA, 22 bp, Artificial Sequence
  chemically synthesized
tgcaaggaactctagattcgta

SEQ ID NO: 661626 - DNA, 22 bp, Artificial Sequence
  chemically synthesized
caaggaactctagattcgtaag

SEQ ID NO: 661627 - DNA, 22 bp, Artificial Sequence
  chemically synthesized
acaggaaccaaatgacagtgct

SEQ ID NO: 661628 - DNA, 22 bp, Artificial Sequence
  chemically synthesized
tagattcgtaagcactgtcatt

SEQ ID NO: 661629 - DNA, 22 bp, Artificial Sequence
  chemically synthesized
gattcgtaagcactgtcatttg

SEQ ID NO: 661630 - DNA, 22 bp, Artificial Sequence
  chemically synthesized
gtaagcactgtcatttggttcc

SEQ ID NO: 661631 - DNA, 22 bp, Artificial Sequence
  chemically synthesized
aagaggactcacaggaaccaaa

SEQ ID NO: 661632 - DNA, 22 bp, Artificial Sequence
  chemically synthesized
ctaaagaggactcacaggaacc

SEQ ID NO: 661633 - DNA, 22 bp, Artificial Sequence
  chemically synthesized
aattgctaaagaggactcacag

SEQ ID NO: 661634 - DNA, 22 bp, Artificial Sequence
  chemically synthesized
tcatttggttcctgtgagtcct

SEQ ID NO: 661635 - DNA, 22 bp, Artificial Sequence
  chemically synthesized
ggttcctgtgagtcctctttag

SEQ ID NO: 661636 - DNA, 22 bp, Artificial Sequence
  chemically synthesized
gttcctgtgagtcctctttagc

SEQ ID NO: 661637 - DNA, 22 bp, Artificial Sequence
  chemically synthesized
aacagggttcaattgctaaaga

SEQ ID NO: 661638 - DNA, 22 bp, Artificial Sequence
  chemically synthesized
ctgtgagtcctctttagcaatt

SEQ ID NO: 661639 - DNA, 22 bp, Artificial Sequence
  chemically synthesized
tgagtcctctttagcaattgaa

SEQ ID NO: 661640 - DNA, 22 bp, Artificial Sequence
  chemically synthesized
acagtggaagttaaacagggtt

SEQ ID NO: 661641 - DNA, 22 bp, Artificial Sequence
  chemically synthesized
tttagcaattgaaccctgttta

SEQ ID NO: 661642 - DNA, 22 bp, Artificial Sequence
  chemically synthesized
tagcaattgaaccctgtttaac

SEQ ID NO: 661643 - DNA, 22 bp, Artificial Sequence
  chemically synthesized
agcaattgaaccctgtttaact

SEQ ID NO: 661644 - DNA, 22 bp, Artificial Sequence
  chemically synthesized
gcaattgaaccctgtttaactt

SEQ ID NO: 661645 - DNA, 22 bp, Artificial Sequence
  chemically synthesized
ccctgacagtggaagttaaaca

SEQ ID NO: 661646 - DNA, 22 bp, Artificial Sequence
  chemically synthesized
actgccctgacagtggaagtta

SEQ ID NO: 661647 - DNA, 22 bp, Artificial Sequence
  chemically synthesized
aaccctgtttaacttccactgt

SEQ ID NO: 661648 - DNA, 22 bp, Artificial Sequence
  chemically synthesized
acactcactgccctgacagtgg

SEQ ID NO: 661649 - DNA, 22 bp, Artificial Sequence
  chemically synthesized
tgacactcactgccctgacagt

SEQ ID NO: 661650 - DNA, 22 bp, Artificial Sequence
  chemically synthesized
ctgacactcactgccctgacag

SEQ ID NO: 661651 - DNA, 22 bp, Artificial Sequence
  chemically synthesized
tttaacttccactgtcagggca

SEQ ID NO: 661652 - DNA, 22 bp, Artificial Sequence
  chemically synthesized
cttctgacactcactgccctga

SEQ ID NO: 661653 - DNA, 22 bp, Artificial Sequence
  chemically synthesized
aacttccactgtcagggcagtg

SEQ ID NO: 661654 - DNA, 22 bp, Artificial Sequence
  chemically synthesized
gcttctgacactcactgccctg

SEQ ID NO: 661655 - DNA, 22 bp, Artificial Sequence
  chemically synthesized
acttccactgtcagggcagtga

SEQ ID NO: 661656 - DNA, 22 bp, Artificial Sequence
  chemically synthesized
ccactgtcagggcagtgagtgt

SEQ ID NO: 661657 - DNA, 22 bp, Artificial Sequence
  chemically synthesized
cactgtcagggcagtgagtgtc

SEQ ID NO: 661658 - DNA, 22 bp, Artificial Sequence
  chemically synthesized
aacaatcttgcttctgacactc

SEQ ID NO: 661659 - DNA, 22 bp, Artificial Sequence
  chemically synthesized
tcagggcagtgagtgtcagaag

SEQ ID NO: 661660 - DNA, 22 bp, Artificial Sequence
  chemically synthesized
taaacaatcttgcttctgacac

SEQ ID NO: 661661 - DNA, 22 bp, Artificial Sequence
  chemically synthesized
gaggtgttctaaacaatcttgc

SEQ ID NO: 661662 - DNA, 22 bp, Artificial Sequence
  chemically synthesized
agaatgagttggaggtgttcta

SEQ ID NO: 661663 - DNA, 22 bp, Artificial Sequence
  chemically synthesized
gctaagaatgagttggaggtgt

SEQ ID NO: 661664 - DNA, 22 bp, Artificial Sequence
  chemically synthesized
agctaagaatgagttggaggtg

SEQ ID NO: 661665 - DNA, 22 bp, Artificial Sequence
  chemically synthesized
tagctaagaatgagttggaggt

SEQ ID NO: 661666 - DNA, 22 bp, Artificial Sequence
  chemically synthesized
ttagctaagaatgagttggagg

SEQ ID NO: 661667 - DNA, 22 bp, Artificial Sequence
  chemically synthesized
tttagaacacctccaactcatt

SEQ ID NO: 661668 - DNA, 22 bp, Artificial Sequence
  chemically synthesized
agaacacctccaactcattctt

SEQ ID NO: 661669 - DNA, 22 bp, Artificial Sequence
  chemically synthesized
gaacacctccaactcattctta

SEQ ID NO: 661670 - DNA, 22 bp, Artificial Sequence
  chemically synthesized
agtcatacttttagctaagaat

SEQ ID NO: 661671 - DNA, 22 bp, Artificial Sequence
  chemically synthesized
caactcattcttagctaaaagt

SEQ ID NO: 661672 - DNA, 22 bp, Artificial Sequence
  chemically synthesized
aataatgcctcagtcatacttt

SEQ ID NO: 661673 - DNA, 22 bp, Artificial Sequence
  chemically synthesized
attcttagctaaaagtatgact

SEQ ID NO: 661674 - DNA, 22 bp, Artificial Sequence
  chemically synthesized
taaataatgcctcagtcatact

SEQ ID NO: 661675 - DNA, 22 bp, Artificial Sequence
  chemically synthesized
ctaaataatgcctcagtcatac

SEQ ID NO: 661676 - DNA, 22 bp, Artificial Sequence
  chemically synthesized
tctaaataatgcctcagtcata

SEQ ID NO: 661677 - DNA, 22 bp, Artificial Sequence
  chemically synthesized
ttagctaaaagtatgactgagg

SEQ ID NO: 661678 - DNA, 22 bp, Artificial Sequence
  chemically synthesized
tttctaaataatgcctcagtca

SEQ ID NO: 661679 - DNA, 22 bp, Artificial Sequence
  chemically synthesized
agctaaaagtatgactgaggca

SEQ ID NO: 661680 - DNA, 22 bp, Artificial Sequence
  chemically synthesized
ctttctaaataatgcctcagtc

SEQ ID NO: 661681 - DNA, 22 bp, Artificial Sequence
  chemically synthesized
gctaaaagtatgactgaggcat

SEQ ID NO: 661682 - DNA, 22 bp, Artificial Sequence
  chemically synthesized
tctttctaaataatgcctcagt

SEQ ID NO: 661683 - DNA, 22 bp, Artificial Sequence
  chemically synthesized
ttctttctaaataatgcctcag

SEQ ID NO: 661684 - DNA, 22 bp, Artificial Sequence
  chemically synthesized
tttctttctaaataatgcctca

SEQ ID NO: 661685 - DNA, 22 bp, Artificial Sequence
  chemically synthesized
ttttctttctaaataatgcctc

SEQ ID NO: 661686 - DNA, 22 bp, Artificial Sequence
  chemically synthesized
aaagtatgactgaggcattatt

SEQ ID NO: 661687 - DNA, 22 bp, Artificial Sequence
  chemically synthesized
tttttctttctaaataatgcct

SEQ ID NO: 661688 - DNA, 22 bp, Artificial Sequence
  chemically synthesized
tttttttctttctaaataatgc

SEQ ID NO: 661689 - DNA, 22 bp, Artificial Sequence
  chemically synthesized
ctttttttctttctaaataatg

SEQ ID NO: 661690 - DNA, 22 bp, Artificial Sequence
  chemically synthesized
aggcattatttagaaagaaaaa

SEQ ID NO: 661691 - DNA, 22 bp, Artificial Sequence
  chemically synthesized
tcagaatcttctttttttcttt

SEQ ID NO: 661692 - DNA, 22 bp, Artificial Sequence
  chemically synthesized
atcagaatcttctttttttctt

SEQ ID NO: 661693 - DNA, 22 bp, Artificial Sequence
  chemically synthesized
tatcagaatcttctttttttct

SEQ ID NO: 661694 - DNA, 22 bp, Artificial Sequence
  chemically synthesized
ttatcagaatcttctttttttc

SEQ ID NO: 661695 - DNA, 22 bp, Artificial Sequence
  chemically synthesized
tttagaaagaaaaaaagaagat

SEQ ID NO: 661696 - DNA, 22 bp, Artificial Sequence
  chemically synthesized
agaaagaaaaaaagaagattct

SEQ ID NO: 661697 - DNA, 22 bp, Artificial Sequence
  chemically synthesized
atcccttttatcagaatcttct

SEQ ID NO: 661698 - DNA, 22 bp, Artificial Sequence
  chemically synthesized
gaaagaaaaaaagaagattctg

SEQ ID NO: 661699 - DNA, 22 bp, Artificial Sequence
  chemically synthesized
catcccttttatcagaatcttc

SEQ ID NO: 661700 - DNA, 22 bp, Artificial Sequence
  chemically synthesized
tcatcccttttatcagaatctt

SEQ ID NO: 661701 - DNA, 22 bp, Artificial Sequence
  chemically synthesized
ttcatcccttttatcagaatct

SEQ ID NO: 661702 - DNA, 22 bp, Artificial Sequence
  chemically synthesized
tttcatcccttttatcagaatc

SEQ ID NO: 661703 - DNA, 22 bp, Artificial Sequence
  chemically synthesized
tttttcatcccttttatcagaa

SEQ ID NO: 661704 - DNA, 22 bp, Artificial Sequence
  chemically synthesized
aaaggttctttttcatcccttt

SEQ ID NO: 661705 - DNA, 22 bp, Artificial Sequence
  chemically synthesized
caaaggttctttttcatccctt

SEQ ID NO: 661706 - DNA, 22 bp, Artificial Sequence
  chemically synthesized
tgataaaagggatgaaaaagaa

SEQ ID NO: 661707 - DNA, 22 bp, Artificial Sequence
  chemically synthesized
ataaaagggatgaaaaagaacc

SEQ ID NO: 661708 - DNA, 22 bp, Artificial Sequence
  chemically synthesized
agcaacttcaaaggttcttttt

SEQ ID NO: 661709 - DNA, 22 bp, Artificial Sequence
  chemically synthesized
ttgagcaacttcaaaggttctt

SEQ ID NO: 661710 - DNA, 22 bp, Artificial Sequence
  chemically synthesized
gttgagcaacttcaaaggttct

SEQ ID NO: 661711 - DNA, 22 bp, Artificial Sequence
  chemically synthesized
aaccaagcgtagcttgttgagc

SEQ ID NO: 661712 - DNA, 22 bp, Artificial Sequence
  chemically synthesized
caaccaagcgtagcttgttgag

SEQ ID NO: 661713 - DNA, 22 bp, Artificial Sequence
  chemically synthesized
tcaaccaagcgtagcttgttga

SEQ ID NO: 661714 - DNA, 22 bp, Artificial Sequence
  chemically synthesized
ttcaaccaagcgtagcttgttg

SEQ ID NO: 661715 - DNA, 22 bp, Artificial Sequence
  chemically synthesized
tgaagttgctcaacaagctacg

SEQ ID NO: 661716 - DNA, 22 bp, Artificial Sequence
  chemically synthesized
gaagttgctcaacaagctacgc

SEQ ID NO: 661717 - DNA, 22 bp, Artificial Sequence
  chemically synthesized
cttttcaaccaagcgtagcttg

SEQ ID NO: 661718 - DNA, 22 bp, Artificial Sequence
  chemically synthesized
aagttgctcaacaagctacgct

SEQ ID NO: 661719 - DNA, 22 bp, Artificial Sequence
  chemically synthesized
tgttacttttcaaccaagcgta

SEQ ID NO: 661720 - DNA, 22 bp, Artificial Sequence
  chemically synthesized
ctcaacaagctacgcttggttg

SEQ ID NO: 661721 - DNA, 22 bp, Artificial Sequence
  chemically synthesized
aacaagctacgcttggttgaaa

SEQ ID NO: 661722 - DNA, 22 bp, Artificial Sequence
  chemically synthesized
aaagcctgtgttacttttcaac

SEQ ID NO: 661723 - DNA, 22 bp, Artificial Sequence
  chemically synthesized
caaagcctgtgttacttttcaa

SEQ ID NO: 661724 - DNA, 22 bp, Artificial Sequence
  chemically synthesized
cgcttggttgaaaagtaacaca

SEQ ID NO: 661725 - DNA, 22 bp, Artificial Sequence
  chemically synthesized
ggttgaaaagtaacacaggctt

SEQ ID NO: 661726 - DNA, 22 bp, Artificial Sequence
  chemically synthesized
gttgaaaagtaacacaggcttt

SEQ ID NO: 661727 - DNA, 22 bp, Artificial Sequence
  chemically synthesized
aaaagtaacacaggctttgaaa

SEQ ID NO: 661728 - DNA, 22 bp, Artificial Sequence
  chemically synthesized
caccatcagtaaccaatttcaa

SEQ ID NO: 661729 - DNA, 22 bp, Artificial Sequence
  chemically synthesized
gaaagttacaccatcagtaacc

SEQ ID NO: 661730 - DNA, 22 bp, Artificial Sequence
  chemically synthesized
tgaaattggttactgatggtgt

SEQ ID NO: 661731 - DNA, 22 bp, Artificial Sequence
  chemically synthesized
cactagaaagttacaccatcag

SEQ ID NO: 661732 - DNA, 22 bp, Artificial Sequence
  chemically synthesized
gaaattggttactgatggtgta

SEQ ID NO: 661733 - DNA, 22 bp, Artificial Sequence
  chemically synthesized
aaattggttactgatggtgtaa

SEQ ID NO: 661734 - DNA, 22 bp, Artificial Sequence
  chemically synthesized
cagattccactagaaagttaca

SEQ ID NO: 661735 - DNA, 22 bp, Artificial Sequence
  chemically synthesized
gttactgatggtgtaactttct

SEQ ID NO: 661736 - DNA, 22 bp, Artificial Sequence
  chemically synthesized
ccagattccactagaaagttac

SEQ ID NO: 661737 - DNA, 22 bp, Artificial Sequence
  chemically synthesized
ctgatggtgtaactttctagtg

SEQ ID NO: 661738 - DNA, 22 bp, Artificial Sequence
  chemically synthesized
acttccagattccactagaaag

SEQ ID NO: 661739 - DNA, 22 bp, Artificial Sequence
  chemically synthesized
tcacttccagattccactagaa

SEQ ID NO: 661740 - DNA, 22 bp, Artificial Sequence
  chemically synthesized
atggtgtaactttctagtggaa

SEQ ID NO: 661741 - DNA, 22 bp, Artificial Sequence
  chemically synthesized
tctcacttccagattccactag

SEQ ID NO: 661742 - DNA, 22 bp, Artificial Sequence
  chemically synthesized
aagttctctcacttccagattc

SEQ ID NO: 661743 - DNA, 22 bp, Artificial Sequence
  chemically synthesized
tctagtggaatctggaagtgag

SEQ ID NO: 661744 - DNA, 22 bp, Artificial Sequence
  chemically synthesized
ggttcaagttctctcacttcca

SEQ ID NO: 661745 - DNA, 22 bp, Artificial Sequence
  chemically synthesized
ctagtggaatctggaagtgaga

SEQ ID NO: 661746 - DNA, 22 bp, Artificial Sequence
  chemically synthesized
aggttcaagttctctcacttcc

SEQ ID NO: 661747 - DNA, 22 bp, Artificial Sequence
  chemically synthesized
tagtggaatctggaagtgagag

SEQ ID NO: 661748 - DNA, 22 bp, Artificial Sequence
  chemically synthesized
gtggaatctggaagtgagagaa

SEQ ID NO: 661749 - DNA, 22 bp, Artificial Sequence
  chemically synthesized
cttaggttcaagttctctcact

SEQ ID NO: 661750 - DNA, 22 bp, Artificial Sequence
  chemically synthesized
gctccttaggttcaagttctct

SEQ ID NO: 661751 - DNA, 22 bp, Artificial Sequence
  chemically synthesized
ttagctccttaggttcaagttc

SEQ ID NO: 661752 - DNA, 22 bp, Artificial Sequence
  chemically synthesized
gttagctccttaggttcaagtt

SEQ ID NO: 661753 - DNA, 22 bp, Artificial Sequence
  chemically synthesized
tgttagctccttaggttcaagt

SEQ ID NO: 661754 - DNA, 22 bp, Artificial Sequence
  chemically synthesized
gaagtgagagaacttgaaccta

SEQ ID NO: 661755 - DNA, 22 bp, Artificial Sequence
  chemically synthesized
atccattttgttagctccttag

SEQ ID NO: 661756 - DNA, 22 bp, Artificial Sequence
  chemically synthesized
ctaatccattttgttagctcct

SEQ ID NO: 661757 - DNA, 22 bp, Artificial Sequence
  chemically synthesized
cctcctaatccattttgttagc

SEQ ID NO: 661758 - DNA, 22 bp, Artificial Sequence
  chemically synthesized
gaacctaaggagctaacaaaat

SEQ ID NO: 661759 - DNA, 22 bp, Artificial Sequence
  chemically synthesized
aacctaaggagctaacaaaatg

SEQ ID NO: 661760 - DNA, 22 bp, Artificial Sequence
  chemically synthesized
caattgcctcctaatccatttt

SEQ ID NO: 661761 - DNA, 22 bp, Artificial Sequence
  chemically synthesized
gcaattgcctcctaatccattt

SEQ ID NO: 661762 - DNA, 22 bp, Artificial Sequence
  chemically synthesized
aggagctaacaaaatggattag

SEQ ID NO: 661763 - DNA, 22 bp, Artificial Sequence
  chemically synthesized
acaaaatggattaggaggcaat

SEQ ID NO: 661764 - DNA, 22 bp, Artificial Sequence
  chemically synthesized
ccatcagtttgcaattgcctcc

SEQ ID NO: 661765 - DNA, 22 bp, Artificial Sequence
  chemically synthesized
gccatcagtttgcaattgcctc

SEQ ID NO: 661766 - DNA, 22 bp, Artificial Sequence
  chemically synthesized
gcagccttgccatcagtttgca

SEQ ID NO: 661767 - DNA, 22 bp, Artificial Sequence
  chemically synthesized
agcagccttgccatcagtttgc

SEQ ID NO: 661768 - DNA, 22 bp, Artificial Sequence
  chemically synthesized
tagcagccttgccatcagtttg

SEQ ID NO: 661769 - DNA, 22 bp, Artificial Sequence
  chemically synthesized
ggaggcaattgcaaactgatgg

SEQ ID NO: 661770 - DNA, 22 bp, Artificial Sequence
  chemically synthesized
ttagcagccttgccatcagttt

SEQ ID NO: 661771 - DNA, 22 bp, Artificial Sequence
  chemically synthesized
tttagcagccttgccatcagtt

SEQ ID NO: 661772 - DNA, 22 bp, Artificial Sequence
  chemically synthesized
ttttagcagccttgccatcagt

SEQ ID NO: 661773 - DNA, 22 bp, Artificial Sequence
  chemically synthesized
tttttagcagccttgccatcag

SEQ ID NO: 661774 - DNA, 22 bp, Artificial Sequence
  chemically synthesized
ttttttagcagccttgccatca

SEQ ID NO: 661775 - DNA, 22 bp, Artificial Sequence
  chemically synthesized
gatttttttttagcagccttgc

SEQ ID NO: 661776 - DNA, 22 bp, Artificial Sequence
  chemically synthesized
ggatttttttttagcagccttg

SEQ ID NO: 661777 - DNA, 22 bp, Artificial Sequence
  chemically synthesized
caaactgatggcaaggctgcta

SEQ ID NO: 661778 - DNA, 22 bp, Artificial Sequence
  chemically synthesized
tggatttttttttagcagcctt

SEQ ID NO: 661779 - DNA, 22 bp, Artificial Sequence
  chemically synthesized
ttggatttttttttagcagcct

SEQ ID NO: 661780 - DNA, 22 bp, Artificial Sequence
  chemically synthesized
gcttttggatttttttttagca

SEQ ID NO: 661781 - DNA, 22 bp, Artificial Sequence
  chemically synthesized
atggcaaggctgctaaaaaaaa

SEQ ID NO: 661782 - DNA, 22 bp, Artificial Sequence
  chemically synthesized
acattagcttttggattttttt

SEQ ID NO: 661783 - DNA, 22 bp, Artificial Sequence
  chemically synthesized
aacattagcttttggatttttt

SEQ ID NO: 661784 - DNA, 22 bp, Artificial Sequence
  chemically synthesized
aacttaacattagcttttggat

SEQ ID NO: 661785 - DNA, 22 bp, Artificial Sequence
  chemically synthesized
ctaaaaaaaaatccaaaagcta

SEQ ID NO: 661786 - DNA, 22 bp, Artificial Sequence
  chemically synthesized
tgaacttaacattagcttttgg

SEQ ID NO: 661787 - DNA, 22 bp, Artificial Sequence
  chemically synthesized
aaaaaaaatccaaaagctaatg

SEQ ID NO: 661788 - DNA, 22 bp, Artificial Sequence
  chemically synthesized
atgttaagttcagaatttcttt

SEQ ID NO: 661789 - DNA, 22 bp, Artificial Sequence
  chemically synthesized
agttcagaatttctttccactg

SEQ ID NO: 661790 - DNA, 22 bp, Artificial Sequence
  chemically synthesized
agaatttctttccactgggctt

SEQ ID NO: 661791 - DNA, 22 bp, Artificial Sequence
  chemically synthesized
caggccagagagggtgaagccc

SEQ ID NO: 661792 - DNA, 22 bp, Artificial Sequence
  chemically synthesized
ctttccactgggcttcaccctc

SEQ ID NO: 661793 - DNA, 22 bp, Artificial Sequence
  chemically synthesized
tttccactgggcttcaccctct

SEQ ID NO: 661794 - DNA, 22 bp, Artificial Sequence
  chemically synthesized
tccactgggcttcaccctctct

SEQ ID NO: 661795 - DNA, 22 bp, Artificial Sequence
  chemically synthesized
cacctgcaggccagagagggtg

SEQ ID NO: 661796 - DNA, 22 bp, Artificial Sequence
  chemically synthesized
ccactgggcttcaccctctctg

SEQ ID NO: 661797 - DNA, 22 bp, Artificial Sequence
  chemically synthesized
cactgggcttcaccctctctgg

SEQ ID NO: 661798 - DNA, 22 bp, Artificial Sequence
  chemically synthesized
ggactccacctgcaggccagag

SEQ ID NO: 661799 - DNA, 22 bp, Artificial Sequence
  chemically synthesized
ggcttcaccctctctggcctgc

SEQ ID NO: 661800 - DNA, 22 bp, Artificial Sequence
  chemically synthesized
gttgggactccacctgcaggcc

SEQ ID NO: 661801 - DNA, 22 bp, Artificial Sequence
  chemically synthesized
ggttgggactccacctgcaggc

SEQ ID NO: 661802 - DNA, 22 bp, Artificial Sequence
  chemically synthesized
caccctctctggcctgcaggtg

SEQ ID NO: 661803 - DNA, 22 bp, Artificial Sequence
  chemically synthesized
tggttgggactccacctgcagg

SEQ ID NO: 661804 - DNA, 22 bp, Artificial Sequence
  chemically synthesized
accctctctggcctgcaggtgg

SEQ ID NO: 661805 - DNA, 22 bp, Artificial Sequence
  chemically synthesized
ttggttgggactccacctgcag

SEQ ID NO: 661806 - DNA, 22 bp, Artificial Sequence
  chemically synthesized
tttggttgggactccacctgca

SEQ ID NO: 661807 - DNA, 22 bp, Artificial Sequence
  chemically synthesized
tctggcctgcaggtggagtccc

SEQ ID NO: 661808 - DNA, 22 bp, Artificial Sequence
  chemically synthesized
agctttttggttgggactccac

SEQ ID NO: 661809 - DNA, 22 bp, Artificial Sequence
  chemically synthesized
cagctttttggttgggactcca

SEQ ID NO: 661810 - DNA, 22 bp, Artificial Sequence
  chemically synthesized
tggcctgcaggtggagtcccaa

SEQ ID NO: 661811 - DNA, 22 bp, Artificial Sequence
  chemically synthesized
gcctgcaggtggagtcccaacc

SEQ ID NO: 661812 - DNA, 22 bp, Artificial Sequence
  chemically synthesized
cttcagctttttggttgggact

SEQ ID NO: 661813 - DNA, 22 bp, Artificial Sequence
  chemically synthesized
caggtggagtcccaaccaaaaa

SEQ ID NO: 661814 - DNA, 22 bp, Artificial Sequence
  chemically synthesized
aaaaatgatagttgcttcagct

SEQ ID NO: 661815 - DNA, 22 bp, Artificial Sequence
  chemically synthesized
tcaaaaatgatagttgcttcag

SEQ ID NO: 661816 - DNA, 22 bp, Artificial Sequence
  chemically synthesized
ctcaaaaatgatagttgcttca

SEQ ID NO: 661817 - DNA, 22 bp, Artificial Sequence
  chemically synthesized
aagcaactatcatttttgagaa

SEQ ID NO: 661818 - DNA, 22 bp, Artificial Sequence
  chemically synthesized
acaggtgtagcccatttctcaa

SEQ ID NO: 661819 - DNA, 22 bp, Artificial Sequence
  chemically synthesized
gtctcacaggtgtagcccattt

SEQ ID NO: 661820 - DNA, 22 bp, Artificial Sequence
  chemically synthesized
tcatttttgagaaatgggctac

SEQ ID NO: 661821 - DNA, 22 bp, Artificial Sequence
  chemically synthesized
taactggtctcacaggtgtagc

SEQ ID NO: 661822 - DNA, 22 bp, Artificial Sequence
  chemically synthesized
ttgagaaatgggctacacctgt

SEQ ID NO: 661823 - DNA, 22 bp, Artificial Sequence
  chemically synthesized
tgagaaatgggctacacctgtg

SEQ ID NO: 661824 - DNA, 22 bp, Artificial Sequence
  chemically synthesized
gagaaatgggctacacctgtga

SEQ ID NO: 661825 - DNA, 22 bp, Artificial Sequence
  chemically synthesized
agaaatgggctacacctgtgag

SEQ ID NO: 661826 - DNA, 22 bp, Artificial Sequence
  chemically synthesized
attgtaactggtctcacaggtg

SEQ ID NO: 661827 - DNA, 22 bp, Artificial Sequence
  chemically synthesized
aattgtaactggtctcacaggt

SEQ ID NO: 661828 - DNA, 22 bp, Artificial Sequence
  chemically synthesized
taattgtaactggtctcacagg

SEQ ID NO: 661829 - DNA, 22 bp, Artificial Sequence
  chemically synthesized
ttaattgtaactggtctcacag

SEQ ID NO: 661830 - DNA, 22 bp, Artificial Sequence
  chemically synthesized
tttaattgtaactggtctcaca

SEQ ID NO: 661831 - DNA, 22 bp, Artificial Sequence
  chemically synthesized
tctttttaattgtaactggtct

SEQ ID NO: 661832 - DNA, 22 bp, Artificial Sequence
  chemically synthesized
cacctgtgagaccagttacaat

SEQ ID NO: 661833 - DNA, 22 bp, Artificial Sequence
  chemically synthesized
aattatctttttaattgtaact

SEQ ID NO: 661834 - DNA, 22 bp, Artificial Sequence
  chemically synthesized
gaattatctttttaattgtaac

SEQ ID NO: 661835 - DNA, 22 bp, Artificial Sequence
  chemically synthesized
tgagaccagttacaattaaaaa

SEQ ID NO: 661836 - DNA, 22 bp, Artificial Sequence
  chemically synthesized
taagtgccccacttgaattatc

SEQ ID NO: 661837 - DNA, 22 bp, Artificial Sequence
  chemically synthesized
caattaaaaagataattcaagt

SEQ ID NO: 661838 - DNA, 22 bp, Artificial Sequence
  chemically synthesized
aaaagataattcaagtggggca

SEQ ID NO: 661839 - DNA, 22 bp, Artificial Sequence
  chemically synthesized
aagtggggcacttacaggtatt

SEQ ID NO: 661840 - DNA, 22 bp, Artificial Sequence
  chemically synthesized
tagtgacatagggaatacctgt

SEQ ID NO: 661841 - DNA, 22 bp, Artificial Sequence
  chemically synthesized
acaggtattccctatgtcacta

SEQ ID NO: 661842 - DNA, 22 bp, Artificial Sequence
  chemically synthesized
caggtattccctatgtcactac

SEQ ID NO: 661843 - DNA, 22 bp, Artificial Sequence
  chemically synthesized
gcatcaaaaaagaaacctgtag

SEQ ID NO: 661844 - DNA, 22 bp, Artificial Sequence
  chemically synthesized
cctatgtcactacaggtttctt

SEQ ID NO: 661845 - DNA, 22 bp, Artificial Sequence
  chemically synthesized
ggtctggcatcaaaaaagaaac

SEQ ID NO: 661846 - DNA, 22 bp, Artificial Sequence
  chemically synthesized
tgtcactacaggtttctttttt

SEQ ID NO: 661847 - DNA, 22 bp, Artificial Sequence
  chemically synthesized
ctaggtctggcatcaaaaaaga

SEQ ID NO: 661848 - DNA, 22 bp, Artificial Sequence
  chemically synthesized
caggtttcttttttgatgccag

SEQ ID NO: 661849 - DNA, 22 bp, Artificial Sequence
  chemically synthesized
agggactactaggtctggcatc

SEQ ID NO: 661850 - DNA, 22 bp, Artificial Sequence
  chemically synthesized
cttttttgatgccagacctagt

SEQ ID NO: 661851 - DNA, 22 bp, Artificial Sequence
  chemically synthesized
ttttttgatgccagacctagta

SEQ ID NO: 661852 - DNA, 22 bp, Artificial Sequence
  chemically synthesized
ttttgatgccagacctagtagt

SEQ ID NO: 661853 - DNA, 22 bp, Artificial Sequence
  chemically synthesized
tttgatgccagacctagtagtc

SEQ ID NO: 661854 - DNA, 22 bp, Artificial Sequence
  chemically synthesized
ttgatgccagacctagtagtcc

SEQ ID NO: 661855 - DNA, 22 bp, Artificial Sequence
  chemically synthesized
tgatgccagacctagtagtccc

SEQ ID NO: 661856 - DNA, 22 bp, Artificial Sequence
  chemically synthesized
gatgccagacctagtagtccct

SEQ ID NO: 661857 - DNA, 22 bp, Artificial Sequence
  chemically synthesized
tagccccagttcagggactact

SEQ ID NO: 661858 - DNA, 22 bp, Artificial Sequence
  chemically synthesized
atgccagacctagtagtccctg

SEQ ID NO: 661859 - DNA, 22 bp, Artificial Sequence
  chemically synthesized
attgtagccccagttcagggac

SEQ ID NO: 661860 - DNA, 22 bp, Artificial Sequence
  chemically synthesized
aattgtagccccagttcaggga

SEQ ID NO: 661861 - DNA, 22 bp, Artificial Sequence
  chemically synthesized
ttaattgtagccccagttcagg

SEQ ID NO: 661862 - DNA, 22 bp, Artificial Sequence
  chemically synthesized
gtagtccctgaactggggctac

SEQ ID NO: 661863 - DNA, 22 bp, Artificial Sequence
  chemically synthesized
aaactcttaattgtagccccag

SEQ ID NO: 661864 - DNA, 22 bp, Artificial Sequence
  chemically synthesized
gaaactcttaattgtagcccca

SEQ ID NO: 661865 - DNA, 22 bp, Artificial Sequence
  chemically synthesized
tgaaactcttaattgtagcccc

SEQ ID NO: 661866 - DNA, 22 bp, Artificial Sequence
  chemically synthesized
aactggggctacaattaagagt

SEQ ID NO: 661867 - DNA, 22 bp, Artificial Sequence
  chemically synthesized
ccagcctttgaaactcttaatt

SEQ ID NO: 661868 - DNA, 22 bp, Artificial Sequence
  chemically synthesized
gggctacaattaagagtttcaa

SEQ ID NO: 661869 - DNA, 22 bp, Artificial Sequence
  chemically synthesized
gaatattaccagcctttgaaac

SEQ ID NO: 661870 - DNA, 22 bp, Artificial Sequence
  chemically synthesized
ggaatattaccagcctttgaaa

SEQ ID NO: 661871 - DNA, 22 bp, Artificial Sequence
  chemically synthesized
tggaatattaccagcctttgaa

SEQ ID NO: 661872 - DNA, 22 bp, Artificial Sequence
  chemically synthesized
caattaagagtttcaaaggctg

SEQ ID NO: 661873 - DNA, 22 bp, Artificial Sequence
  chemically synthesized
ttttggaatattaccagccttt

SEQ ID NO: 661874 - DNA, 22 bp, Artificial Sequence
  chemically synthesized
attttggaatattaccagcctt

SEQ ID NO: 661875 - DNA, 22 bp, Artificial Sequence
  chemically synthesized
agagtttcaaaggctggtaata

SEQ ID NO: 661876 - DNA, 22 bp, Artificial Sequence
  chemically synthesized
caaaggctggtaatattccaaa

SEQ ID NO: 661877 - DNA, 22 bp, Artificial Sequence
  chemically synthesized
aaaggctggtaatattccaaaa

SEQ ID NO: 661878 - DNA, 22 bp, Artificial Sequence
  chemically synthesized
atagccatagtatcttattttg

SEQ ID NO: 661879 - DNA, 22 bp, Artificial Sequence
  chemically synthesized
gtaatattccaaaataagatac

SEQ ID NO: 661880 - DNA, 22 bp, Artificial Sequence
  chemically synthesized
agtaccaactaatagccatagt

SEQ ID NO: 661881 - DNA, 22 bp, Artificial Sequence
  chemically synthesized
caaaataagatactatggctat

SEQ ID NO: 661882 - DNA, 22 bp, Artificial Sequence
  chemically synthesized
aagtaccaactaatagccatag

SEQ ID NO: 661883 - DNA, 22 bp, Artificial Sequence
  chemically synthesized
tgcttaagtaccaactaatagc

SEQ ID NO: 661884 - DNA, 22 bp, Artificial Sequence
  chemically synthesized
gtgcttaagtaccaactaatag

SEQ ID NO: 661885 - DNA, 22 bp, Artificial Sequence
  chemically synthesized
tggctattagttggtacttaag

SEQ ID NO: 661886 - DNA, 22 bp, Artificial Sequence
  chemically synthesized
tggaatgcttgtgcttaagtac

SEQ ID NO: 661887 - DNA, 22 bp, Artificial Sequence
  chemically synthesized
gtggaatgcttgtgcttaagta

SEQ ID NO: 661888 - DNA, 22 bp, Artificial Sequence
  chemically synthesized
ttagttggtacttaagcacaag

SEQ ID NO: 661889 - DNA, 22 bp, Artificial Sequence
  chemically synthesized
atccttgtggaatgcttgtgct

SEQ ID NO: 661890 - DNA, 22 bp, Artificial Sequence
  chemically synthesized
gttggtacttaagcacaagcat

SEQ ID NO: 661891 - DNA, 22 bp, Artificial Sequence
  chemically synthesized
gtacttaagcacaagcattcca

SEQ ID NO: 661892 - DNA, 22 bp, Artificial Sequence
  chemically synthesized
cattgatccttgtggaatgctt

SEQ ID NO: 661893 - DNA, 22 bp, Artificial Sequence
  chemically synthesized
aagcacaagcattccacaagga

SEQ ID NO: 661894 - DNA, 22 bp, Artificial Sequence
  chemically synthesized
agcacaagcattccacaaggat

SEQ ID NO: 661895 - DNA, 22 bp, Artificial Sequence
  chemically synthesized
cacaaggatcaatggaatggat

SEQ ID NO: 661896 - DNA, 22 bp, Artificial Sequence
  chemically synthesized
ggcaaggcacaaggaaggagta

SEQ ID NO: 661897 - DNA, 22 bp, Artificial Sequence
  chemically synthesized
aattaggcaaggcacaaggaag

SEQ ID NO: 661898 - DNA, 22 bp, Artificial Sequence
  chemically synthesized
caattaggcaaggcacaaggaa

SEQ ID NO: 661899 - DNA, 22 bp, Artificial Sequence
  chemically synthesized
ctccttccttgtgccttgccta

SEQ ID NO: 661900 - DNA, 22 bp, Artificial Sequence
  chemically synthesized
cttccttgtgccttgcctaatt

SEQ ID NO: 661901 - DNA, 22 bp, Artificial Sequence
  chemically synthesized
tgtgatagcttcaattaggcaa

SEQ ID NO: 661902 - DNA, 22 bp, Artificial Sequence
  chemically synthesized
ccttgtgccttgcctaattgaa

SEQ ID NO: 661903 - DNA, 22 bp, Artificial Sequence
  chemically synthesized
cttgtgccttgcctaattgaag

SEQ ID NO: 661904 - DNA, 22 bp, Artificial Sequence
  chemically synthesized
gtgccttgcctaattgaagcta

SEQ ID NO: 661905 - DNA, 22 bp, Artificial Sequence
  chemically synthesized
tgccttgcctaattgaagctat

SEQ ID NO: 661906 - DNA, 22 bp, Artificial Sequence
  chemically synthesized
tgatggggttgtgtgatagctt

SEQ ID NO: 661907 - DNA, 22 bp, Artificial Sequence
  chemically synthesized
gcctaattgaagctatcacaca

SEQ ID NO: 661908 - DNA, 22 bp, Artificial Sequence
  chemically synthesized
cctaattgaagctatcacacaa

SEQ ID NO: 661909 - DNA, 22 bp, Artificial Sequence
  chemically synthesized
aacctatgatggggttgtgtga

SEQ ID NO: 661910 - DNA, 22 bp, Artificial Sequence
  chemically synthesized
caacctatgatggggttgtgtg

SEQ ID NO: 661911 - DNA, 22 bp, Artificial Sequence
  chemically synthesized
attgaagctatcacacaacccc

SEQ ID NO: 661912 - DNA, 22 bp, Artificial Sequence
  chemically synthesized
tcaacctatgatggggttgtgt

SEQ ID NO: 661913 - DNA, 22 bp, Artificial Sequence
  chemically synthesized
aagctatcacacaaccccatca

SEQ ID NO: 661914 - DNA, 22 bp, Artificial Sequence
  chemically synthesized
agatattttcaacctatgatgg

SEQ ID NO: 661915 - DNA, 22 bp, Artificial Sequence
  chemically synthesized
aagatattttcaacctatgatg

SEQ ID NO: 661916 - DNA, 22 bp, Artificial Sequence
  chemically synthesized
tcacacaaccccatcataggtt

SEQ ID NO: 661917 - DNA, 22 bp, Artificial Sequence
  chemically synthesized
tgacttaagatattttcaacct

SEQ ID NO: 661918 - DNA, 22 bp, Artificial Sequence
  chemically synthesized
gtgacttaagatattttcaacc

SEQ ID NO: 661919 - DNA, 22 bp, Artificial Sequence
  chemically synthesized
aatgcatttgtgacttaagata

SEQ ID NO: 661920 - DNA, 22 bp, Artificial Sequence
  chemically synthesized
aaaatatcttaagtcacaaatg

SEQ ID NO: 661921 - DNA, 22 bp, Artificial Sequence
  chemically synthesized
ggtgtattaaatgcatttgtga

SEQ ID NO: 661922 - DNA, 22 bp, Artificial Sequence
  chemically synthesized
gttaggtgtattaaatgcattt

SEQ ID NO: 661923 - DNA, 22 bp, Artificial Sequence
  chemically synthesized
aagtcacaaatgcatttaatac

SEQ ID NO: 661924 - DNA, 22 bp, Artificial Sequence
  chemically synthesized
agttagttaggtgtattaaatg

SEQ ID NO: 661925 - DNA, 22 bp, Artificial Sequence
  chemically synthesized
agtcacaaatgcatttaataca

SEQ ID NO: 661926 - DNA, 22 bp, Artificial Sequence
  chemically synthesized
cagttagttaggtgtattaaat

SEQ ID NO: 661927 - DNA, 22 bp, Artificial Sequence
  chemically synthesized
tgagtttcagttagttaggtgt

SEQ ID NO: 661928 - DNA, 22 bp, Artificial Sequence
  chemically synthesized
agctgtgagtttcagttagtta

SEQ ID NO: 661929 - DNA, 22 bp, Artificial Sequence
  chemically synthesized
aatacacctaactaactgaaac

SEQ ID NO: 661930 - DNA, 22 bp, Artificial Sequence
  chemically synthesized
atacacctaactaactgaaact

SEQ ID NO: 661931 - DNA, 22 bp, Artificial Sequence
  chemically synthesized
ggctaagctgtgagtttcagtt

SEQ ID NO: 661932 - DNA, 22 bp, Artificial Sequence
  chemically synthesized
actaactgaaactcacagctta

SEQ ID NO: 661933 - DNA, 22 bp, Artificial Sequence
  chemically synthesized
aaggtaggctaggctaagctgt

SEQ ID NO: 661934 - DNA, 22 bp, Artificial Sequence
  chemically synthesized
actgaaactcacagcttagcct

SEQ ID NO: 661935 - DNA, 22 bp, Artificial Sequence
  chemically synthesized
aaactcacagcttagcctagcc

SEQ ID NO: 661936 - DNA, 22 bp, Artificial Sequence
  chemically synthesized
ggagcacattgaaggtaggcta

SEQ ID NO: 661937 - DNA, 22 bp, Artificial Sequence
  chemically synthesized
acagcttagcctagcctacctt

SEQ ID NO: 661938 - DNA, 22 bp, Artificial Sequence
  chemically synthesized
agcctagcctaccttcaatgtg

SEQ ID NO: 661939 - DNA, 22 bp, Artificial Sequence
  chemically synthesized
gcctagcctaccttcaatgtgc

SEQ ID NO: 661940 - DNA, 22 bp, Artificial Sequence
  chemically synthesized
gcctaccttcaatgtgctccca

SEQ ID NO: 661941 - DNA, 22 bp, Artificial Sequence
  chemically synthesized
ccttcaatgtgctcccaacact

SEQ ID NO: 661942 - DNA, 22 bp, Artificial Sequence
  chemically synthesized
taggccgatgtaagtgttggga

SEQ ID NO: 661943 - DNA, 22 bp, Artificial Sequence
  chemically synthesized
caatgtgctcccaacacttaca

SEQ ID NO: 661944 - DNA, 22 bp, Artificial Sequence
  chemically synthesized
aatgtgctcccaacacttacat

SEQ ID NO: 661945 - DNA, 22 bp, Artificial Sequence
  chemically synthesized
cccaactgtaggccgatgtaag

SEQ ID NO: 661946 - DNA, 22 bp, Artificial Sequence
  chemically synthesized
gcccaactgtaggccgatgtaa

SEQ ID NO: 661947 - DNA, 22 bp, Artificial Sequence
  chemically synthesized
tgcccaactgtaggccgatgta

SEQ ID NO: 661948 - DNA, 22 bp, Artificial Sequence
  chemically synthesized
ccaacacttacatcggcctaca

SEQ ID NO: 661949 - DNA, 22 bp, Artificial Sequence
  chemically synthesized
gacagttttgcccaactgtagg

SEQ ID NO: 661950 - DNA, 22 bp, Artificial Sequence
  chemically synthesized
ctagacagttttgcccaactgt

SEQ ID NO: 661951 - DNA, 22 bp, Artificial Sequence
  chemically synthesized
acatcggcctacagttgggcaa

SEQ ID NO: 661952 - DNA, 22 bp, Artificial Sequence
  chemically synthesized
catcggcctacagttgggcaaa

SEQ ID NO: 661953 - DNA, 22 bp, Artificial Sequence
  chemically synthesized
tgtaaggtgttgctagacagtt

SEQ ID NO: 661954 - DNA, 22 bp, Artificial Sequence
  chemically synthesized
cagttgggcaaaactgtctagc

SEQ ID NO: 661955 - DNA, 22 bp, Artificial Sequence
  chemically synthesized
ctgtgtaaggtgttgctagaca

SEQ ID NO: 661956 - DNA, 22 bp, Artificial Sequence
  chemically synthesized
actgtgtaaggtgttgctagac

SEQ ID NO: 661957 - DNA, 22 bp, Artificial Sequence
  chemically synthesized
tactgtgtaaggtgttgctaga

SEQ ID NO: 661958 - DNA, 22 bp, Artificial Sequence
  chemically synthesized
ggcaaaactgtctagcaacacc

SEQ ID NO: 661959 - DNA, 22 bp, Artificial Sequence
  chemically synthesized
acactttactgtgtaaggtgtt

SEQ ID NO: 661960 - DNA, 22 bp, Artificial Sequence
  chemically synthesized
tctagcaacaccttacacagta

SEQ ID NO: 661961 - DNA, 22 bp, Artificial Sequence
  chemically synthesized
aacaactgacactttactgtgt

SEQ ID NO: 661962 - DNA, 22 bp, Artificial Sequence
  chemically synthesized
gcaacaccttacacagtaaagt

SEQ ID NO: 661963 - DNA, 22 bp, Artificial Sequence
  chemically synthesized
acacagtaaagtgtcagttgtt

SEQ ID NO: 661964 - DNA, 22 bp, Artificial Sequence
  chemically synthesized
cacagtaaagtgtcagttgttt

SEQ ID NO: 661965 - DNA, 22 bp, Artificial Sequence
  chemically synthesized
ccagtcagccacaagatcatga

SEQ ID NO: 661966 - DNA, 22 bp, Artificial Sequence
  chemically synthesized
tttagcctcatgatcttgtggc

SEQ ID NO: 661967 - DNA, 22 bp, Artificial Sequence
  chemically synthesized
agctcccagtcagccacaagat

SEQ ID NO: 661968 - DNA, 22 bp, Artificial Sequence
  chemically synthesized
agcctcatgatcttgtggctga

SEQ ID NO: 661969 - DNA, 22 bp, Artificial Sequence
  chemically synthesized
gcctcatgatcttgtggctgac

SEQ ID NO: 661970 - DNA, 22 bp, Artificial Sequence
  chemically synthesized
aacctcagctcccagtcagcca

SEQ ID NO: 661971 - DNA, 22 bp, Artificial Sequence
  chemically synthesized
atgatcttgtggctgactggga

SEQ ID NO: 661972 - DNA, 22 bp, Artificial Sequence
  chemically synthesized
gtggctgactgggagctgaggt

SEQ ID NO: 661973 - DNA, 22 bp, Artificial Sequence
  chemically synthesized
tggctgactgggagctgaggtt

SEQ ID NO: 661974 - DNA, 22 bp, Artificial Sequence
  chemically synthesized
ggcagcagcactgaacctcagc

SEQ ID NO: 661975 - DNA, 22 bp, Artificial Sequence
  chemically synthesized
ctgggcagcagcactgaacctc

SEQ ID NO: 661976 - DNA, 22 bp, Artificial Sequence
  chemically synthesized
gctgggcagcagcactgaacct

SEQ ID NO: 661977 - DNA, 22 bp, Artificial Sequence
  chemically synthesized
actgggagctgaggttcagtgc

SEQ ID NO: 661978 - DNA, 22 bp, Artificial Sequence
  chemically synthesized
ggagctgaggttcagtgctgct

SEQ ID NO: 661979 - DNA, 22 bp, Artificial Sequence
  chemically synthesized
cccttgctgggcagcagcactg

SEQ ID NO: 661980 - DNA, 22 bp, Artificial Sequence
  chemically synthesized
tccccttgctgggcagcagcac

SEQ ID NO: 661981 - DNA, 22 bp, Artificial Sequence
  chemically synthesized
tctccccttgctgggcagcagc

SEQ ID NO: 661982 - DNA, 22 bp, Artificial Sequence
  chemically synthesized
aggttcagtgctgctgcccagc

SEQ ID NO: 661983 - DNA, 22 bp, Artificial Sequence
  chemically synthesized
agtgctgctgcccagcaagggg

SEQ ID NO: 661984 - DNA, 22 bp, Artificial Sequence
  chemically synthesized
ctgcccagcaaggggagagagt

SEQ ID NO: 661985 - DNA, 22 bp, Artificial Sequence
  chemically synthesized
cccagcaaggggagagagtatc

SEQ ID NO: 661986 - DNA, 22 bp, Artificial Sequence
  chemically synthesized
gtaatatgcggtatgatactct

SEQ ID NO: 661987 - DNA, 22 bp, Artificial Sequence
  chemically synthesized
caaggctagtaatatgcggtat

SEQ ID NO: 661988 - DNA, 22 bp, Artificial Sequence
  chemically synthesized
ccaaggctagtaatatgcggta

SEQ ID NO: 661989 - DNA, 22 bp, Artificial Sequence
  chemically synthesized
tccaaggctagtaatatgcggt

SEQ ID NO: 661990 - DNA, 22 bp, Artificial Sequence
  chemically synthesized
ttccaaggctagtaatatgcgg

SEQ ID NO: 661991 - DNA, 22 bp, Artificial Sequence
  chemically synthesized
atcttttccaaggctagtaata

SEQ ID NO: 661992 - DNA, 22 bp, Artificial Sequence
  chemically synthesized
gatcttttccaaggctagtaat

SEQ ID NO: 661993 - DNA, 22 bp, Artificial Sequence
  chemically synthesized
tgatcttttccaaggctagtaa

SEQ ID NO: 661994 - DNA, 22 bp, Artificial Sequence
  chemically synthesized
aattttgatcttttccaaggct

SEQ ID NO: 661995 - DNA, 22 bp, Artificial Sequence
  chemically synthesized
gaattttgatcttttccaaggc

SEQ ID NO: 661996 - DNA, 22 bp, Artificial Sequence
  chemically synthesized
gatttgaattttgatcttttcc

SEQ ID NO: 661997 - DNA, 22 bp, Artificial Sequence
  chemically synthesized
tagatttgaattttgatctttt

SEQ ID NO: 661998 - DNA, 22 bp, Artificial Sequence
  chemically synthesized
ctagatttgaattttgatcttt

SEQ ID NO: 661999 - DNA, 22 bp, Artificial Sequence
  chemically synthesized
ctagccttggaaaagatcaaaa

SEQ ID NO: 662000 - DNA, 22 bp, Artificial Sequence
  chemically synthesized
cttctagatttgaattttgatc

SEQ ID NO: 662001 - DNA, 22 bp, Artificial Sequence
  chemically synthesized
gccttggaaaagatcaaaattc

SEQ ID NO: 662002 - DNA, 22 bp, Artificial Sequence
  chemically synthesized
tacttctagatttgaattttga

SEQ ID NO: 662003 - DNA, 22 bp, Artificial Sequence
  chemically synthesized
ggaaaagatcaaaattcaaatc

SEQ ID NO: 662004 - DNA, 22 bp, Artificial Sequence
  chemically synthesized
gaaaagatcaaaattcaaatct

SEQ ID NO: 662005 - DNA, 22 bp, Artificial Sequence
  chemically synthesized
aatagaaactctacttctagat

SEQ ID NO: 662006 - DNA, 22 bp, Artificial Sequence
  chemically synthesized
aaatctagaagtagagtttcta

SEQ ID NO: 662007 - DNA, 22 bp, Artificial Sequence
  chemically synthesized
gaagtagagtttctattgaatg

SEQ ID NO: 662008 - DNA, 22 bp, Artificial Sequence
  chemically synthesized
acagtgatgcaaagtgatatgc

SEQ ID NO: 662009 - DNA, 22 bp, Artificial Sequence
  chemically synthesized
cacagtgatgcaaagtgatatg

SEQ ID NO: 662010 - DNA, 22 bp, Artificial Sequence
  chemically synthesized
ctattgaatgcatatcactttg

SEQ ID NO: 662011 - DNA, 22 bp, Artificial Sequence
  chemically synthesized
tattgaatgcatatcactttgc

SEQ ID NO: 662012 - DNA, 22 bp, Artificial Sequence
  chemically synthesized
atttcacagtgatgcaaagtga

SEQ ID NO: 662013 - DNA, 22 bp, Artificial Sequence
  chemically synthesized
ttgaatgcatatcactttgcat

SEQ ID NO: 662014 - DNA, 22 bp, Artificial Sequence
  chemically synthesized
gatttcacagtgatgcaaagtg

SEQ ID NO: 662015 - DNA, 22 bp, Artificial Sequence
  chemically synthesized
tgatttcacagtgatgcaaagt

SEQ ID NO: 662016 - DNA, 22 bp, Artificial Sequence
  chemically synthesized
ttgatttcacagtgatgcaaag

SEQ ID NO: 662017 - DNA, 22 bp, Artificial Sequence
  chemically synthesized
aatgcatatcactttgcatcac

SEQ ID NO: 662018 - DNA, 22 bp, Artificial Sequence
  chemically synthesized
tttgatttcacagtgatgcaaa

SEQ ID NO: 662019 - DNA, 22 bp, Artificial Sequence
  chemically synthesized
acaattttttgatttcacagtg

SEQ ID NO: 662020 - DNA, 22 bp, Artificial Sequence
  chemically synthesized
aacaattttttgatttcacagt

SEQ ID NO: 662021 - DNA, 22 bp, Artificial Sequence
  chemically synthesized
aacttaacaattttttgatttc

SEQ ID NO: 662022 - DNA, 22 bp, Artificial Sequence
  chemically synthesized
tgcatcactgtgaaatcaaaaa

SEQ ID NO: 662023 - DNA, 22 bp, Artificial Sequence
  chemically synthesized
caacttaacaattttttgattt

SEQ ID NO: 662024 - DNA, 22 bp, Artificial Sequence
  chemically synthesized
gcatcactgtgaaatcaaaaaa

SEQ ID NO: 662025 - DNA, 22 bp, Artificial Sequence
  chemically synthesized
catcactgtgaaatcaaaaaat

SEQ ID NO: 662026 - DNA, 22 bp, Artificial Sequence
  chemically synthesized
tgaagtttcaacttaacaattt

SEQ ID NO: 662027 - DNA, 22 bp, Artificial Sequence
  chemically synthesized
gtgaagtttcaacttaacaatt

SEQ ID NO: 662028 - DNA, 22 bp, Artificial Sequence
  chemically synthesized
tgaaatcaaaaaattgttaagt

SEQ ID NO: 662029 - DNA, 22 bp, Artificial Sequence
  chemically synthesized
ttaagttgaaacttcacaagtt

SEQ ID NO: 662030 - DNA, 22 bp, Artificial Sequence
  chemically synthesized
agttgaaacttcacaagttggg

SEQ ID NO: 662031 - DNA, 22 bp, Artificial Sequence
  chemically synthesized
aaacttcacaagttggggactg

SEQ ID NO: 662032 - DNA, 22 bp, Artificial Sequence
  chemically synthesized
cacaagttggggactgtctgca

SEQ ID NO: 662033 - DNA, 22 bp, Artificial Sequence
  chemically synthesized
acaagttggggactgtctgcat

SEQ ID NO: 662034 - DNA, 22 bp, Artificial Sequence
  chemically synthesized
cacacacacaccacacaatgca

SEQ ID NO: 662035 - DNA, 22 bp, Artificial Sequence
  chemically synthesized
gggactgtctgcattgtgtggt

SEQ ID NO: 662036 - DNA, 22 bp, Artificial Sequence
  chemically synthesized
cccagctacacacacacaccac

SEQ ID NO: 662037 - DNA, 22 bp, Artificial Sequence
  chemically synthesized
ccccagctacacacacacacca

SEQ ID NO: 662038 - DNA, 22 bp, Artificial Sequence
  chemically synthesized
tctgcattgtgtggtgtgtgtg

SEQ ID NO: 662039 - DNA, 22 bp, Artificial Sequence
  chemically synthesized
ttccccagctacacacacacac

SEQ ID NO: 662040 - DNA, 22 bp, Artificial Sequence
  chemically synthesized
cattgtgtggtgtgtgtgtgta

SEQ ID NO: 662041 - DNA, 22 bp, Artificial Sequence
  chemically synthesized
tgtggtgtgtgtgtgtagctgg

SEQ ID NO: 662042 - DNA, 22 bp, Artificial Sequence
  chemically synthesized
agccaaacctcttccccagcta

SEQ ID NO: 662043 - DNA, 22 bp, Artificial Sequence
  chemically synthesized
aagccaaacctcttccccagct

SEQ ID NO: 662044 - DNA, 22 bp, Artificial Sequence
  chemically synthesized
taagccaaacctcttccccagc

SEQ ID NO: 662045 - DNA, 22 bp, Artificial Sequence
  chemically synthesized
attttaagccaaacctcttccc

SEQ ID NO: 662046 - DNA, 22 bp, Artificial Sequence
  chemically synthesized
tcattaattttaagccaaacct

SEQ ID NO: 662047 - DNA, 22 bp, Artificial Sequence
  chemically synthesized
atcattaattttaagccaaacc

SEQ ID NO: 662048 - DNA, 22 bp, Artificial Sequence
  chemically synthesized
tatcattaattttaagccaaac

SEQ ID NO: 662049 - DNA, 22 bp, Artificial Sequence
  chemically synthesized
ttatcattaattttaagccaaa

SEQ ID NO: 662050 - DNA, 22 bp, Artificial Sequence
  chemically synthesized
gggaagaggtttggcttaaaat

SEQ ID NO: 662051 - DNA, 22 bp, Artificial Sequence
  chemically synthesized
cttttatcattaattttaagcc

SEQ ID NO: 662052 - DNA, 22 bp, Artificial Sequence
  chemically synthesized
ccttttatcattaattttaagc

SEQ ID NO: 662053 - DNA, 22 bp, Artificial Sequence
  chemically synthesized
tccttttatcattaattttaag

SEQ ID NO: 662054 - DNA, 22 bp, Artificial Sequence
  chemically synthesized
ttccttttatcattaattttaa

SEQ ID NO: 662055 - DNA, 22 bp, Artificial Sequence
  chemically synthesized
tttccttttatcattaatttta

SEQ ID NO: 662056 - DNA, 22 bp, Artificial Sequence
  chemically synthesized
acctttttccttttatcattaa

SEQ ID NO: 662057 - DNA, 22 bp, Artificial Sequence
  chemically synthesized
ggcttaaaattaatgataaaag

SEQ ID NO: 662058 - DNA, 22 bp, Artificial Sequence
  chemically synthesized
gcttaaaattaatgataaaagg

SEQ ID NO: 662059 - DNA, 22 bp, Artificial Sequence
  chemically synthesized
aaaattaatgataaaaggaaaa

SEQ ID NO: 662060 - DNA, 22 bp, Artificial Sequence
  chemically synthesized
aaattaatgataaaaggaaaaa

SEQ ID NO: 662061 - DNA, 22 bp, Artificial Sequence
  chemically synthesized
caacaatctcacctttttcctt

SEQ ID NO: 662062 - DNA, 22 bp, Artificial Sequence
  chemically synthesized
gcaacaatctcacctttttcct

SEQ ID NO: 662063 - DNA, 22 bp, Artificial Sequence
  chemically synthesized
atgataaaaggaaaaaggtgag

SEQ ID NO: 662064 - DNA, 22 bp, Artificial Sequence
  chemically synthesized
cccttgcaacaatctcaccttt

SEQ ID NO: 662065 - DNA, 22 bp, Artificial Sequence
  chemically synthesized
ccccttgcaacaatctcacctt

SEQ ID NO: 662066 - DNA, 22 bp, Artificial Sequence
  chemically synthesized
cttccccttgcaacaatctcac

SEQ ID NO: 662067 - DNA, 22 bp, Artificial Sequence
  chemically synthesized
ccttccccttgcaacaatctca

SEQ ID NO: 662068 - DNA, 22 bp, Artificial Sequence
  chemically synthesized
gtggtttccttccccttgcaac

SEQ ID NO: 662069 - DNA, 22 bp, Artificial Sequence
  chemically synthesized
ggtggtttccttccccttgcaa

SEQ ID NO: 662070 - DNA, 22 bp, Artificial Sequence
  chemically synthesized
tggtggtttccttccccttgca

SEQ ID NO: 662071 - DNA, 22 bp, Artificial Sequence
  chemically synthesized
ttgcaaggggaaggaaaccacc

SEQ ID NO: 662072 - DNA, 22 bp, Artificial Sequence
  chemically synthesized
caaggggaaggaaaccaccaaa

SEQ ID NO: 662073 - DNA, 22 bp, Artificial Sequence
  chemically synthesized
ttttatttcttttttctttttt

SEQ ID NO: 662074 - DNA, 22 bp, Artificial Sequence
  chemically synthesized
tttatttcttttttcttttttt

SEQ ID NO: 662075 - DNA, 22 bp, Artificial Sequence
  chemically synthesized
ttatttcttttttctttttttt

SEQ ID NO: 662076 - DNA, 22 bp, Artificial Sequence
  chemically synthesized
tatttcttttttcttttttttt

SEQ ID NO: 662077 - DNA, 22 bp, Artificial Sequence
  chemically synthesized
atttcttttttctttttttttt

SEQ ID NO: 662078 - DNA, 22 bp, Artificial Sequence
  chemically synthesized
aaaaaaaaaaaaaaaaaaaaaa

SEQ ID NO: 662079 - DNA, 22 bp, Artificial Sequence
  chemically synthesized
tttcttttttcttttttttttt

SEQ ID NO: 662080 - DNA, 22 bp, Artificial Sequence
  chemically synthesized
cttttttctttttttttttttt

SEQ ID NO: 662081 - DNA, 22 bp, Artificial Sequence
  chemically synthesized
ttttttcttttttttttttttt

SEQ ID NO: 662082 - DNA, 22 bp, Artificial Sequence
  chemically synthesized
ggtctcaaaaaaaaaaaaaaaa

SEQ ID NO: 662083 - DNA, 22 bp, Artificial Sequence
  chemically synthesized
ttttcttttttttttttttttt

SEQ ID NO: 662084 - DNA, 22 bp, Artificial Sequence
  chemically synthesized
tttctttttttttttttttttt

SEQ ID NO: 662085 - DNA, 22 bp, Artificial Sequence
  chemically synthesized
ttcttttttttttttttttttt

SEQ ID NO: 662086 - DNA, 22 bp, Artificial Sequence
  chemically synthesized
tctttttttttttttttttttt

SEQ ID NO: 662087 - DNA, 22 bp, Artificial Sequence
  chemically synthesized
cttttttttttttttttttttt

SEQ ID NO: 662088 - DNA, 22 bp, Artificial Sequence
  chemically synthesized
tttttttttttttttttttttt

SEQ ID NO: 662089 - DNA, 22 bp, Artificial Sequence
  chemically synthesized
ttttttttttttttttttttga

SEQ ID NO: 662090 - DNA, 22 bp, Artificial Sequence
  chemically synthesized
tttttttttttttttttttgag

SEQ ID NO: 662091 - DNA, 22 bp, Artificial Sequence
  chemically synthesized
ttttttttttttttttttgaga

SEQ ID NO: 662092 - DNA, 22 bp, Artificial Sequence
  chemically synthesized
tttttttttttttttttgagac

SEQ ID NO: 662093 - DNA, 22 bp, Artificial Sequence
  chemically synthesized
ttttttttttttttttgagacc

SEQ ID NO: 662094 - DNA, 22 bp, Artificial Sequence
  chemically synthesized
tttttttttttttttgagaccg

SEQ ID NO: 662095 - DNA, 22 bp, Artificial Sequence
  chemically synthesized
ttttttttttttttgagaccga

SEQ ID NO: 662096 - DNA, 22 bp, Artificial Sequence
  chemically synthesized
tttttttttttttgagaccgag

SEQ ID NO: 662097 - DNA, 22 bp, Artificial Sequence
  chemically synthesized
ttttttttttttgagaccgagt

SEQ ID NO: 662098 - DNA, 22 bp, Artificial Sequence
  chemically synthesized
tttttttttttgagaccgagtc

SEQ ID NO: 662099 - DNA, 22 bp, Artificial Sequence
  chemically synthesized
ttttttttttgagaccgagtct

SEQ ID NO: 662100 - DNA, 22 bp, Artificial Sequence
  chemically synthesized
ggtgacagagcaagactcggtc

SEQ ID NO: 662101 - DNA, 22 bp, Artificial Sequence
  chemically synthesized
tttttttttgagaccgagtctt

SEQ ID NO: 662102 - DNA, 22 bp, Artificial Sequence
  chemically synthesized
ttttttttgagaccgagtcttg

SEQ ID NO: 662103 - DNA, 22 bp, Artificial Sequence
  chemically synthesized
tttttttgagaccgagtcttgc

SEQ ID NO: 662104 - DNA, 22 bp, Artificial Sequence
  chemically synthesized
ttttttgagaccgagtcttgct

SEQ ID NO: 662105 - DNA, 22 bp, Artificial Sequence
  chemically synthesized
tttttgagaccgagtcttgctc

SEQ ID NO: 662106 - DNA, 22 bp, Artificial Sequence
  chemically synthesized
ttttgagaccgagtcttgctct

SEQ ID NO: 662107 - DNA, 22 bp, Artificial Sequence
  chemically synthesized
tttgagaccgagtcttgctctg

SEQ ID NO: 662108 - DNA, 22 bp, Artificial Sequence
  chemically synthesized
cagcctgggtgacagagcaaga

SEQ ID NO: 662109 - DNA, 22 bp, Artificial Sequence
  chemically synthesized
ttgagaccgagtcttgctctgt

SEQ ID NO: 662110 - DNA, 22 bp, Artificial Sequence
  chemically synthesized
tgagaccgagtcttgctctgtc

SEQ ID NO: 662111 - DNA, 22 bp, Artificial Sequence
  chemically synthesized
gagaccgagtcttgctctgtca

SEQ ID NO: 662112 - DNA, 22 bp, Artificial Sequence
  chemically synthesized
agaccgagtcttgctctgtcac

SEQ ID NO: 662113 - DNA, 22 bp, Artificial Sequence
  chemically synthesized
tcctccagcctgggtgacagag

SEQ ID NO: 662114 - DNA, 22 bp, Artificial Sequence
  chemically synthesized
gctctgtcacccaggctggagg

SEQ ID NO: 662115 - DNA, 22 bp, Artificial Sequence
  chemically synthesized
ctctgtcacccaggctggagga

SEQ ID NO: 662116 - DNA, 22 bp, Artificial Sequence
  chemically synthesized
tgtcacccaggctggaggacag

SEQ ID NO: 662117 - DNA, 22 bp, Artificial Sequence
  chemically synthesized
tcacccaggctggaggacagtg

SEQ ID NO: 662118 - DNA, 22 bp, Artificial Sequence
  chemically synthesized
cagcgagccgagatcgcgccac

SEQ ID NO: 662119 - DNA, 22 bp, Artificial Sequence
  chemically synthesized
gcagcgagccgagatcgcgcca

SEQ ID NO: 662120 - DNA, 22 bp, Artificial Sequence
  chemically synthesized
gaggacagtggcgcgatctcgg

SEQ ID NO: 662121 - DNA, 22 bp, Artificial Sequence
  chemically synthesized
ggaggcggagcttgcagcgagc

SEQ ID NO: 662122 - DNA, 22 bp, Artificial Sequence
  chemically synthesized
ggctcgctgcaagctccgcctc

SEQ ID NO: 662123 - DNA, 22 bp, Artificial Sequence
  chemically synthesized
gctgcaagctccgcctcccagg

SEQ ID NO: 662124 - DNA, 22 bp, Artificial Sequence
  chemically synthesized
caagctccgcctcccaggttca

SEQ ID NO: 662125 - DNA, 22 bp, Artificial Sequence
  chemically synthesized
aggcaggagaatggcgtgaacc

SEQ ID NO: 662126 - DNA, 22 bp, Artificial Sequence
  chemically synthesized
cgcctcccaggttcacgccatt

SEQ ID NO: 662127 - DNA, 22 bp, Artificial Sequence
  chemically synthesized
ccaggttcacgccattctcctg

SEQ ID NO: 662128 - DNA, 22 bp, Artificial Sequence
  chemically synthesized
gggagtctgaggcaggagaatg

SEQ ID NO: 662129 - DNA, 22 bp, Artificial Sequence
  chemically synthesized
ctcgggagtctgaggcaggaga

SEQ ID NO: 662130 - DNA, 22 bp, Artificial Sequence
  chemically synthesized
acgccattctcctgcctcagac

SEQ ID NO: 662131 - DNA, 22 bp, Artificial Sequence
  chemically synthesized
tagtcccagctactcgggagtc

SEQ ID NO: 662132 - DNA, 22 bp, Artificial Sequence
  chemically synthesized
tcctgcctcagactcccgagta

SEQ ID NO: 662133 - DNA, 22 bp, Artificial Sequence
  chemically synthesized
ctgcctcagactcccgagtagc

SEQ ID NO: 662134 - DNA, 22 bp, Artificial Sequence
  chemically synthesized
cctcagactcccgagtagctgg

SEQ ID NO: 662135 - DNA, 22 bp, Artificial Sequence
  chemically synthesized
agactcccgagtagctgggact

SEQ ID NO: 662136 - DNA, 22 bp, Artificial Sequence
  chemically synthesized
ccgagtagctgggactacagtc

SEQ ID NO: 662137 - DNA, 22 bp, Artificial Sequence
  chemically synthesized
gccaggcgtgatggcgagcgac

SEQ ID NO: 662138 - DNA, 22 bp, Artificial Sequence
  chemically synthesized
ggactacagtcgctcgccatca

SEQ ID NO: 662139 - DNA, 22 bp, Artificial Sequence
  chemically synthesized
cagtcgctcgccatcacgcctg

SEQ ID NO: 662140 - DNA, 22 bp, Artificial Sequence
  chemically synthesized
aaaatacaaaaaattagccagg

SEQ ID NO: 662141 - DNA, 22 bp, Artificial Sequence
  chemically synthesized
gccatcacgcctggctaatttt

SEQ ID NO: 662142 - DNA, 22 bp, Artificial Sequence
  chemically synthesized
ctaaaaatacaaaaaattagcc

SEQ ID NO: 662143 - DNA, 22 bp, Artificial Sequence
  chemically synthesized
tactaaaaatacaaaaaattag

SEQ ID NO: 662144 - DNA, 22 bp, Artificial Sequence
  chemically synthesized
gctaattttttgtatttttagt

SEQ ID NO: 662145 - DNA, 22 bp, Artificial Sequence
  chemically synthesized
attttttgtatttttagtagag

SEQ ID NO: 662146 - DNA, 22 bp, Artificial Sequence
  chemically synthesized
tttgtatttttagtagagatgg

SEQ ID NO: 662147 - DNA, 22 bp, Artificial Sequence
  chemically synthesized
ttgtatttttagtagagatggg

SEQ ID NO: 662148 - DNA, 22 bp, Artificial Sequence
  chemically synthesized
acacggtgaaaccccatctcta

SEQ ID NO: 662149 - DNA, 22 bp, Artificial Sequence
  chemically synthesized
tgtatttttagtagagatgggg

SEQ ID NO: 662150 - DNA, 22 bp, Artificial Sequence
  chemically synthesized
gtatttttagtagagatggggt

SEQ ID NO: 662151 - DNA, 22 bp, Artificial Sequence
  chemically synthesized
tatttttagtagagatggggtt

SEQ ID NO: 662152 - DNA, 22 bp, Artificial Sequence
  chemically synthesized
gctaacacggtgaaaccccatc

SEQ ID NO: 662153 - DNA, 22 bp, Artificial Sequence
  chemically synthesized
ttagtagagatggggtttcacc

SEQ ID NO: 662154 - DNA, 22 bp, Artificial Sequence
  chemically synthesized
tagtagagatggggtttcaccg

SEQ ID NO: 662155 - DNA, 22 bp, Artificial Sequence
  chemically synthesized
agtagagatggggtttcaccgt

SEQ ID NO: 662156 - DNA, 22 bp, Artificial Sequence
  chemically synthesized
gtagagatggggtttcaccgtg

SEQ ID NO: 662157 - DNA, 22 bp, Artificial Sequence
  chemically synthesized
gaggccatcctggctaacacgg

SEQ ID NO: 662158 - DNA, 22 bp, Artificial Sequence
  chemically synthesized
caccgtgttagccaggatggcc

SEQ ID NO: 662159 - DNA, 22 bp, Artificial Sequence
  chemically synthesized
accgtgttagccaggatggcct

SEQ ID NO: 662160 - DNA, 22 bp, Artificial Sequence
  chemically synthesized
gccaggatggcctcgaactcct

SEQ ID NO: 662161 - DNA, 22 bp, Artificial Sequence
  chemically synthesized
gaactcctgacctcgtgatctg

SEQ ID NO: 662162 - DNA, 22 bp, Artificial Sequence
  chemically synthesized
gggaggccgaggcaggcagatc

SEQ ID NO: 662163 - DNA, 22 bp, Artificial Sequence
  chemically synthesized
cgggaggccgaggcaggcagat

SEQ ID NO: 662164 - DNA, 22 bp, Artificial Sequence
  chemically synthesized
ctgacctcgtgatctgcctgcc

SEQ ID NO: 662165 - DNA, 22 bp, Artificial Sequence
  chemically synthesized
acctcgtgatctgcctgcctcg

SEQ ID NO: 662166 - DNA, 22 bp, Artificial Sequence
  chemically synthesized
gtgatctgcctgcctcggcctc

SEQ ID NO: 662167 - DNA, 22 bp, Artificial Sequence
  chemically synthesized
taatcccagcacttcgggaggc

SEQ ID NO: 662168 - DNA, 22 bp, Artificial Sequence
  chemically synthesized
cctgcctcggcctcccgaagtg

SEQ ID NO: 662169 - DNA, 22 bp, Artificial Sequence
  chemically synthesized
cctcggcctcccgaagtgctgg

SEQ ID NO: 662170 - DNA, 22 bp, Artificial Sequence
  chemically synthesized
acgcctgtaatcccagcacttc

SEQ ID NO: 662171 - DNA, 22 bp, Artificial Sequence
  chemically synthesized
ggcctcccgaagtgctgggatt

SEQ ID NO: 662172 - DNA, 22 bp, Artificial Sequence
  chemically synthesized
ggtggctcacgcctgtaatccc

SEQ ID NO: 662173 - DNA, 22 bp, Artificial Sequence
  chemically synthesized
ccgaagtgctgggattacaggc

SEQ ID NO: 662174 - DNA, 22 bp, Artificial Sequence
  chemically synthesized
ggctcggtggctcacgcctgta

SEQ ID NO: 662175 - DNA, 22 bp, Artificial Sequence
  chemically synthesized
ggattacaggcgtgagccaccg

SEQ ID NO: 662176 - DNA, 22 bp, Artificial Sequence
  chemically synthesized
caggcgtgagccaccgagccca

SEQ ID NO: 662177 - DNA, 22 bp, Artificial Sequence
  chemically synthesized
aaaaaaaaaaaaagtatcggct

SEQ ID NO: 662178 - DNA, 22 bp, Artificial Sequence
  chemically synthesized
aaaaaaaaaaaaaagtatcggc

SEQ ID NO: 662179 - DNA, 22 bp, Artificial Sequence
  chemically synthesized
taaaaaaaaaaaaaagtatcgg

SEQ ID NO: 662180 - DNA, 22 bp, Artificial Sequence
  chemically synthesized
cctttaaaaaaaaaaaaaagta

SEQ ID NO: 662181 - DNA, 22 bp, Artificial Sequence
  chemically synthesized
ccctttaaaaaaaaaaaaaagt

SEQ ID NO: 662182 - DNA, 22 bp, Artificial Sequence
  chemically synthesized
tccctttaaaaaaaaaaaaaag

SEQ ID NO: 662183 - DNA, 22 bp, Artificial Sequence
  chemically synthesized
ggttttccctttaaaaaaaaaa

SEQ ID NO: 662184 - DNA, 22 bp, Artificial Sequence
  chemically synthesized
tattaggttttccctttaaaaa

SEQ ID NO: 662185 - DNA, 22 bp, Artificial Sequence
  chemically synthesized
ttttttttttttaaagggaaaa

SEQ ID NO: 662186 - DNA, 22 bp, Artificial Sequence
  chemically synthesized
tttttttttttaaagggaaaac

SEQ ID NO: 662187 - DNA, 22 bp, Artificial Sequence
  chemically synthesized
ttttttttttaaagggaaaacc

SEQ ID NO: 662188 - DNA, 22 bp, Artificial Sequence
  chemically synthesized
tttttttttaaagggaaaacct

SEQ ID NO: 662189 - DNA, 22 bp, Artificial Sequence
  chemically synthesized
ttttttttaaagggaaaaccta

SEQ ID NO: 662190 - DNA, 22 bp, Artificial Sequence
  chemically synthesized
tttttttaaagggaaaacctaa

SEQ ID NO: 662191 - DNA, 22 bp, Artificial Sequence
  chemically synthesized
ttttttaaagggaaaacctaat

SEQ ID NO: 662192 - DNA, 22 bp, Artificial Sequence
  chemically synthesized
tttttaaagggaaaacctaata

SEQ ID NO: 662193 - DNA, 22 bp, Artificial Sequence
  chemically synthesized
ttttaaagggaaaacctaatat

SEQ ID NO: 662194 - DNA, 22 bp, Artificial Sequence
  chemically synthesized
tttaaagggaaaacctaatata

SEQ ID NO: 662195 - DNA, 22 bp, Artificial Sequence
  chemically synthesized
ttaaagggaaaacctaatataa

SEQ ID NO: 662196 - DNA, 22 bp, Artificial Sequence
  chemically synthesized
taaagggaaaacctaatataat

SEQ ID NO: 662197 - DNA, 22 bp, Artificial Sequence
  chemically synthesized
aaagggaaaacctaatataatg

SEQ ID NO: 662198 - DNA, 22 bp, Artificial Sequence
  chemically synthesized
cgtaggcagcaacattatatta

SEQ ID NO: 662199 - DNA, 22 bp, Artificial Sequence
  chemically synthesized
aagggaaaacctaatataatgt

SEQ ID NO: 662200 - DNA, 22 bp, Artificial Sequence
  chemically synthesized
tccgtaggcagcaacattatat

SEQ ID NO: 662201 - DNA, 22 bp, Artificial Sequence
  chemically synthesized
aacctctccgtaggcagcaaca

SEQ ID NO: 662202 - DNA, 22 bp, Artificial Sequence
  chemically synthesized
aaacctctccgtaggcagcaac

SEQ ID NO: 662203 - DNA, 22 bp, Artificial Sequence
  chemically synthesized
taaacctctccgtaggcagcaa

SEQ ID NO: 662204 - DNA, 22 bp, Artificial Sequence
  chemically synthesized
ttttaaacctctccgtaggcag

SEQ ID NO: 662205 - DNA, 22 bp, Artificial Sequence
  chemically synthesized
atataatgttgctgcctacgga

SEQ ID NO: 662206 - DNA, 22 bp, Artificial Sequence
  chemically synthesized
attttaaacctctccgtaggca

SEQ ID NO: 662207 - DNA, 22 bp, Artificial Sequence
  chemically synthesized
ttattttaaacctctccgtagg

SEQ ID NO: 662208 - DNA, 22 bp, Artificial Sequence
  chemically synthesized
tcttattttaaacctctccgta

SEQ ID NO: 662209 - DNA, 22 bp, Artificial Sequence
  chemically synthesized
ttctcttattttaaacctctcc

SEQ ID NO: 662210 - DNA, 22 bp, Artificial Sequence
  chemically synthesized
ctgcctacggagaggtttaaaa

SEQ ID NO: 662211 - DNA, 22 bp, Artificial Sequence
  chemically synthesized
cctacggagaggtttaaaataa

SEQ ID NO: 662212 - DNA, 22 bp, Artificial Sequence
  chemically synthesized
cggagaggtttaaaataagaga

SEQ ID NO: 662213 - DNA, 22 bp, Artificial Sequence
  chemically synthesized
agccaagggagcatattattct

SEQ ID NO: 662214 - DNA, 22 bp, Artificial Sequence
  chemically synthesized
aaaataagagaataatatgctc

SEQ ID NO: 662215 - DNA, 22 bp, Artificial Sequence
  chemically synthesized
aaataagagaataatatgctcc

SEQ ID NO: 662216 - DNA, 22 bp, Artificial Sequence
  chemically synthesized
agtctaagccaagggagcatat

SEQ ID NO: 662217 - DNA, 22 bp, Artificial Sequence
  chemically synthesized
ccttggcttagactcagatgcc

SEQ ID NO: 662218 - DNA, 22 bp, Artificial Sequence
  chemically synthesized
ggcttagactcagatgcctctt

SEQ ID NO: 662219 - DNA, 22 bp, Artificial Sequence
  chemically synthesized
gcttagactcagatgcctcttg

SEQ ID NO: 662220 - DNA, 22 bp, Artificial Sequence
  chemically synthesized
agactcagatgcctcttggggt

SEQ ID NO: 662221 - DNA, 22 bp, Artificial Sequence
  chemically synthesized
gcagagtcccccaccccaagag

SEQ ID NO: 662222 - DNA, 22 bp, Artificial Sequence
  chemically synthesized
gactcagatgcctcttggggtg

SEQ ID NO: 662223 - DNA, 22 bp, Artificial Sequence
  chemically synthesized
agcagagtcccccaccccaaga

SEQ ID NO: 662224 - DNA, 22 bp, Artificial Sequence
  chemically synthesized
tagcagagtcccccaccccaag

SEQ ID NO: 662225 - DNA, 22 bp, Artificial Sequence
  chemically synthesized
agatgcctcttggggtggggga

SEQ ID NO: 662226 - DNA, 22 bp, Artificial Sequence
  chemically synthesized
ttggggtgggggactctgctaa

SEQ ID NO: 662227 - DNA, 22 bp, Artificial Sequence
  chemically synthesized
ggggtgggggactctgctaaaa

SEQ ID NO: 662228 - DNA, 22 bp, Artificial Sequence
  chemically synthesized
gggtgggggactctgctaaaac

SEQ ID NO: 662229 - DNA, 22 bp, Artificial Sequence
  chemically synthesized
aaggaggaggaggttttagcag

SEQ ID NO: 662230 - DNA, 22 bp, Artificial Sequence
  chemically synthesized
caaggaggaggaggttttagca

SEQ ID NO: 662231 - DNA, 22 bp, Artificial Sequence
  chemically synthesized
tcaaggaggaggaggttttagc

SEQ ID NO: 662232 - DNA, 22 bp, Artificial Sequence
  chemically synthesized
tttcaaggaggaggaggtttta

SEQ ID NO: 662233 - DNA, 22 bp, Artificial Sequence
  chemically synthesized
gctctttcaaggaggaggaggt

SEQ ID NO: 662234 - DNA, 22 bp, Artificial Sequence
  chemically synthesized
ggctctttcaaggaggaggagg

SEQ ID NO: 662235 - DNA, 22 bp, Artificial Sequence
  chemically synthesized
tgctaaaacctcctcctccttg

SEQ ID NO: 662236 - DNA, 22 bp, Artificial Sequence
  chemically synthesized
ctaaaacctcctcctccttgaa

SEQ ID NO: 662237 - DNA, 22 bp, Artificial Sequence
  chemically synthesized
acatcttggctctttcaaggag

SEQ ID NO: 662238 - DNA, 22 bp, Artificial Sequence
  chemically synthesized
aaacctcctcctccttgaaaga

SEQ ID NO: 662239 - DNA, 22 bp, Artificial Sequence
  chemically synthesized
ccactcacatcttggctctttc

SEQ ID NO: 662240 - DNA, 22 bp, Artificial Sequence
  chemically synthesized
tcccactcacatcttggctctt

SEQ ID NO: 662241 - DNA, 22 bp, Artificial Sequence
  chemically synthesized
ctcctccttgaaagagccaaga

SEQ ID NO: 662242 - DNA, 22 bp, Artificial Sequence
  chemically synthesized
ctccttgaaagagccaagatgt

SEQ ID NO: 662243 - DNA, 22 bp, Artificial Sequence
  chemically synthesized
actctcccactcacatcttggc

SEQ ID NO: 662244 - DNA, 22 bp, Artificial Sequence
  chemically synthesized
cttgaaagagccaagatgtgag

SEQ ID NO: 662245 - DNA, 22 bp, Artificial Sequence
  chemically synthesized
gctgactctcccactcacatct

SEQ ID NO: 662246 - DNA, 22 bp, Artificial Sequence
  chemically synthesized
gaaagagccaagatgtgagtgg

SEQ ID NO: 662247 - DNA, 22 bp, Artificial Sequence
  chemically synthesized
aaagagccaagatgtgagtggg

SEQ ID NO: 662248 - DNA, 22 bp, Artificial Sequence
  chemically synthesized
gataggttggctgactctccca

SEQ ID NO: 662249 - DNA, 22 bp, Artificial Sequence
  chemically synthesized
gtcatccagtgtgttggatagg

SEQ ID NO: 662250 - DNA, 22 bp, Artificial Sequence
  chemically synthesized
gaacgcccatctcgtcatccag

SEQ ID NO: 662251 - DNA, 22 bp, Artificial Sequence
  chemically synthesized
tccaacacactggatgacgaga

SEQ ID NO: 662252 - DNA, 22 bp, Artificial Sequence
  chemically synthesized
tagtcgcagttagaacgcccat

SEQ ID NO: 662253 - DNA, 22 bp, Artificial Sequence
  chemically synthesized
gatgacgagatgggcgttctaa

SEQ ID NO: 662254 - DNA, 22 bp, Artificial Sequence
  chemically synthesized
catggtgttgtagtcgcagtta

SEQ ID NO: 662255 - DNA, 22 bp, Artificial Sequence
  chemically synthesized
ctccatggtgttgtagtcgcag

SEQ ID NO: 662256 - DNA, 22 bp, Artificial Sequence
  chemically synthesized
atattgctccatggtgttgtag

SEQ ID NO: 662257 - DNA, 22 bp, Artificial Sequence
  chemically synthesized
taactgcgactacaacaccatg

SEQ ID NO: 662258 - DNA, 22 bp, Artificial Sequence
  chemically synthesized
actgcgactacaacaccatgga

SEQ ID NO: 662259 - DNA, 22 bp, Artificial Sequence
  chemically synthesized
cgactacaacaccatggagcaa

SEQ ID NO: 662260 - DNA, 22 bp, Artificial Sequence
  chemically synthesized
caacaccatggagcaatattaa

SEQ ID NO: 662261 - DNA, 22 bp, Artificial Sequence
  chemically synthesized
accaaaagccacattaatattg

SEQ ID NO: 662262 - DNA, 22 bp, Artificial Sequence
  chemically synthesized
acgaatactaaccaaaagccac

SEQ ID NO: 662263 - DNA, 22 bp, Artificial Sequence
  chemically synthesized
atgtggcttttggttagtattc

SEQ ID NO: 662264 - DNA, 22 bp, Artificial Sequence
  chemically synthesized
ttggttagtattcgttaatgtc

SEQ ID NO: 662265 - DNA, 22 bp, Artificial Sequence
  chemically synthesized
tggttagtattcgttaatgtct

SEQ ID NO: 662266 - DNA, 22 bp, Artificial Sequence
  chemically synthesized
ggttagtattcgttaatgtctt

SEQ ID NO: 662267 - DNA, 22 bp, Artificial Sequence
  chemically synthesized
gttagtattcgttaatgtcttt

SEQ ID NO: 662268 - DNA, 22 bp, Artificial Sequence
  chemically synthesized
tgaaagaagaaccaaaagacat

SEQ ID NO: 662269 - DNA, 22 bp, Artificial Sequence
  chemically synthesized
gtattcgttaatgtcttttggt

SEQ ID NO: 662270 - DNA, 22 bp, Artificial Sequence
  chemically synthesized
gttaatgtcttttggttcttct

SEQ ID NO: 662271 - DNA, 22 bp, Artificial Sequence
  chemically synthesized
atgtcttttggttcttctttca

SEQ ID NO: 662272 - DNA, 22 bp, Artificial Sequence
  chemically synthesized
ataacagatatgtcctgtgaaa

SEQ ID NO: 662273 - DNA, 22 bp, Artificial Sequence
  chemically synthesized
ttggttcttctttcacaggaca

SEQ ID NO: 662274 - DNA, 22 bp, Artificial Sequence
  chemically synthesized
tggttcttctttcacaggacat

SEQ ID NO: 662275 - DNA, 22 bp, Artificial Sequence
  chemically synthesized
ggttcttctttcacaggacata

SEQ ID NO: 662276 - DNA, 22 bp, Artificial Sequence
  chemically synthesized
attaataacagatatgtcctgt

SEQ ID NO: 662277 - DNA, 22 bp, Artificial Sequence
  chemically synthesized
gttcttctttcacaggacatat

SEQ ID NO: 662278 - DNA, 22 bp, Artificial Sequence
  chemically synthesized
ttctttcacaggacatatctgt

SEQ ID NO: 662279 - DNA, 22 bp, Artificial Sequence
  chemically synthesized
ctttcacaggacatatctgtta

SEQ ID NO: 662280 - DNA, 22 bp, Artificial Sequence
  chemically synthesized
tttcacaggacatatctgttat

SEQ ID NO: 662281 - DNA, 22 bp, Artificial Sequence
  chemically synthesized
acacagctgattaataacagat

SEQ ID NO: 662282 - DNA, 22 bp, Artificial Sequence
  chemically synthesized
tcacaggacatatctgttatta

SEQ ID NO: 662283 - DNA, 22 bp, Artificial Sequence
  chemically synthesized
cacaggacatatctgttattaa

SEQ ID NO: 662284 - DNA, 22 bp, Artificial Sequence
  chemically synthesized
acaggacatatctgttattaat

SEQ ID NO: 662285 - DNA, 22 bp, Artificial Sequence
  chemically synthesized
ctgacacagctgattaataaca

SEQ ID NO: 662286 - DNA, 22 bp, Artificial Sequence
  chemically synthesized
cctgacacagctgattaataac

SEQ ID NO: 662287 - DNA, 22 bp, Artificial Sequence
  chemically synthesized
tttcctgacacagctgattaat

SEQ ID NO: 662288 - DNA, 22 bp, Artificial Sequence
  chemically synthesized
aggttatttcctgacacagctg

SEQ ID NO: 662289 - DNA, 22 bp, Artificial Sequence
  chemically synthesized
ttattaatcagctgtgtcagga

SEQ ID NO: 662290 - DNA, 22 bp, Artificial Sequence
  chemically synthesized
cctcaggttatttcctgacaca

SEQ ID NO: 662291 - DNA, 22 bp, Artificial Sequence
  chemically synthesized
ttaatcagctgtgtcaggaaat

SEQ ID NO: 662292 - DNA, 22 bp, Artificial Sequence
  chemically synthesized
atcagctgtgtcaggaaataac

SEQ ID NO: 662293 - DNA, 22 bp, Artificial Sequence
  chemically synthesized
ggtaaatattccctcaggttat

SEQ ID NO: 662294 - DNA, 22 bp, Artificial Sequence
  chemically synthesized
tgtcaggaaataacctgaggga

SEQ ID NO: 662295 - DNA, 22 bp, Artificial Sequence
  chemically synthesized
actgggtaaatattccctcagg

SEQ ID NO: 662296 - DNA, 22 bp, Artificial Sequence
  chemically synthesized
gactgggtaaatattccctcag

SEQ ID NO: 662297 - DNA, 22 bp, Artificial Sequence
  chemically synthesized
agatttgactgggtaaatattc

SEQ ID NO: 662298 - DNA, 22 bp, Artificial Sequence
  chemically synthesized
cagatttgactgggtaaatatt

SEQ ID NO: 662299 - DNA, 22 bp, Artificial Sequence
  chemically synthesized
ttcagatttgactgggtaaata

SEQ ID NO: 662300 - DNA, 22 bp, Artificial Sequence
  chemically synthesized
ttcttcagatttgactgggtaa

SEQ ID NO: 662301 - DNA, 22 bp, Artificial Sequence
  chemically synthesized
agggaatatttacccagtcaaa

SEQ ID NO: 662302 - DNA, 22 bp, Artificial Sequence
  chemically synthesized
taaatcattgttcttcagattt

SEQ ID NO: 662303 - DNA, 22 bp, Artificial Sequence
  chemically synthesized
ttataaatcattgttcttcaga

SEQ ID NO: 662304 - DNA, 22 bp, Artificial Sequence
  chemically synthesized
acccagtcaaatctgaagaaca

SEQ ID NO: 662305 - DNA, 22 bp, Artificial Sequence
  chemically synthesized
cccagtcaaatctgaagaacaa

SEQ ID NO: 662306 - DNA, 22 bp, Artificial Sequence
  chemically synthesized
agattgttataaatcattgttc

SEQ ID NO: 662307 - DNA, 22 bp, Artificial Sequence
  chemically synthesized
ttgagattgttataaatcattg

SEQ ID NO: 662308 - DNA, 22 bp, Artificial Sequence
  chemically synthesized
attgagattgttataaatcatt

SEQ ID NO: 662309 - DNA, 22 bp, Artificial Sequence
  chemically synthesized
aagaacaatgatttataacaat

SEQ ID NO: 662310 - DNA, 22 bp, Artificial Sequence
  chemically synthesized
atggccacacagtgtttattga

SEQ ID NO: 662311 - DNA, 22 bp, Artificial Sequence
  chemically synthesized
ataacaatctcaataaacactg

SEQ ID NO: 662312 - DNA, 22 bp, Artificial Sequence
  chemically synthesized
taacaatctcaataaacactgt

SEQ ID NO: 662313 - DNA, 22 bp, Artificial Sequence
  chemically synthesized
atcatcacaattgatggccaca

SEQ ID NO: 662314 - DNA, 22 bp, Artificial Sequence
  chemically synthesized
aataaacactgtgtggccatca

SEQ ID NO: 662315 - DNA, 22 bp, Artificial Sequence
  chemically synthesized
catcatcacaattgatggccac

SEQ ID NO: 662316 - DNA, 22 bp, Artificial Sequence
  chemically synthesized
aaccttcatcatcacaattgat

SEQ ID NO: 662317 - DNA, 22 bp, Artificial Sequence
  chemically synthesized
ttaaaccttcatcatcacaatt

SEQ ID NO: 662318 - DNA, 22 bp, Artificial Sequence
  chemically synthesized
gttaaaccttcatcatcacaat

SEQ ID NO: 662319 - DNA, 22 bp, Artificial Sequence
  chemically synthesized
tgtggccatcaattgtgatgat

SEQ ID NO: 662320 - DNA, 22 bp, Artificial Sequence
  chemically synthesized
tgttaaaccttcatcatcacaa

SEQ ID NO: 662321 - DNA, 22 bp, Artificial Sequence
  chemically synthesized
tgatgatgaaggtttaacaaag

SEQ ID NO: 662322 - DNA, 22 bp, Artificial Sequence
  chemically synthesized
tcacatgcccaatacctttgtt

SEQ ID NO: 662323 - DNA, 22 bp, Artificial Sequence
  chemically synthesized
tatcacatgcccaatacctttg

SEQ ID NO: 662324 - DNA, 22 bp, Artificial Sequence
  chemically synthesized
ctatcacatgcccaataccttt

SEQ ID NO: 662325 - DNA, 22 bp, Artificial Sequence
  chemically synthesized
aacaaaggtattgggcatgtga

SEQ ID NO: 662326 - DNA, 22 bp, Artificial Sequence
  chemically synthesized
acaaaggtattgggcatgtgat

SEQ ID NO: 662327 - DNA, 22 bp, Artificial Sequence
  chemically synthesized
ggcatgtgatagaaggcttacg

SEQ ID NO: 662328 - DNA, 22 bp, Artificial Sequence
  chemically synthesized
tgacagatgaaacatacagcac

SEQ ID NO: 662329 - DNA, 22 bp, Artificial Sequence
  chemically synthesized
acgtgctgtatgtttcatctgt

SEQ ID NO: 662330 - DNA, 22 bp, Artificial Sequence
  chemically synthesized
cgtgctgtatgtttcatctgtc

SEQ ID NO: 662331 - DNA, 22 bp, Artificial Sequence
  chemically synthesized
aacacataatgttatgacagat

SEQ ID NO: 662332 - DNA, 22 bp, Artificial Sequence
  chemically synthesized
aaacacataatgttatgacaga

SEQ ID NO: 662333 - DNA, 22 bp, Artificial Sequence
  chemically synthesized
taaacacataatgttatgacag

SEQ ID NO: 662334 - DNA, 22 bp, Artificial Sequence
  chemically synthesized
ttaaacacataatgttatgaca

SEQ ID NO: 662335 - DNA, 22 bp, Artificial Sequence
  chemically synthesized
tatgtttcatctgtcataacat

SEQ ID NO: 662336 - DNA, 22 bp, Artificial Sequence
  chemically synthesized
tttaaacacataatgttatgac

SEQ ID NO: 662337 - DNA, 22 bp, Artificial Sequence
  chemically synthesized
ttttaaacacataatgttatga

SEQ ID NO: 662338 - DNA, 22 bp, Artificial Sequence
  chemically synthesized
tttttttaaacacataatgtta

SEQ ID NO: 662339 - DNA, 22 bp, Artificial Sequence
  chemically synthesized
catctgtcataacattatgtgt

SEQ ID NO: 662340 - DNA, 22 bp, Artificial Sequence
  chemically synthesized
atctgtcataacattatgtgtt

SEQ ID NO: 662341 - DNA, 22 bp, Artificial Sequence
  chemically synthesized
tcataacattatgtgtttaaaa

SEQ ID NO: 662342 - DNA, 22 bp, Artificial Sequence
  chemically synthesized
tgtgtttaaaaaaatagctatt

SEQ ID NO: 662343 - DNA, 22 bp, Artificial Sequence
  chemically synthesized
aaaaaaatagctatttgcccca

SEQ ID NO: 662344 - DNA, 22 bp, Artificial Sequence
  chemically synthesized
cacacggagtaatggggcaaat

SEQ ID NO: 662345 - DNA, 22 bp, Artificial Sequence
  chemically synthesized
aaaaaatagctatttgccccat

SEQ ID NO: 662346 - DNA, 22 bp, Artificial Sequence
  chemically synthesized
ccacacggagtaatggggcaaa

SEQ ID NO: 662347 - DNA, 22 bp, Artificial Sequence
  chemically synthesized
tccacacggagtaatggggcaa

SEQ ID NO: 662348 - DNA, 22 bp, Artificial Sequence
  chemically synthesized
atggctttccacacggagtaat

SEQ ID NO: 662349 - DNA, 22 bp, Artificial Sequence
  chemically synthesized
tttgccccattactccgtgtgg

SEQ ID NO: 662350 - DNA, 22 bp, Artificial Sequence
  chemically synthesized
gccccattactccgtgtggaaa

SEQ ID NO: 662351 - DNA, 22 bp, Artificial Sequence
  chemically synthesized
ccccattactccgtgtggaaag

SEQ ID NO: 662352 - DNA, 22 bp, Artificial Sequence
  chemically synthesized
cacccactaatggctttccaca

SEQ ID NO: 662353 - DNA, 22 bp, Artificial Sequence
  chemically synthesized
tccctccacccactaatggctt

SEQ ID NO: 662354 - DNA, 22 bp, Artificial Sequence
  chemically synthesized
ctccgtgtggaaagccattagt

SEQ ID NO: 662355 - DNA, 22 bp, Artificial Sequence
  chemically synthesized
cgtgtggaaagccattagtggg

SEQ ID NO: 662356 - DNA, 22 bp, Artificial Sequence
  chemically synthesized
tcccaattgtccctccacccac

SEQ ID NO: 662357 - DNA, 22 bp, Artificial Sequence
  chemically synthesized
aagctgtcccaattgtccctcc

SEQ ID NO: 662358 - DNA, 22 bp, Artificial Sequence
  chemically synthesized
attcaagctgtcccaattgtcc

SEQ ID NO: 662359 - DNA, 22 bp, Artificial Sequence
  chemically synthesized
gtgggtggagggacaattggga

SEQ ID NO: 662360 - DNA, 22 bp, Artificial Sequence
  chemically synthesized
tcactgattcaagctgtcccaa

SEQ ID NO: 662361 - DNA, 22 bp, Artificial Sequence
  chemically synthesized
aatatctgtcactgattcaagc

SEQ ID NO: 662362 - DNA, 22 bp, Artificial Sequence
  chemically synthesized
aaatatctgtcactgattcaag

SEQ ID NO: 662363 - DNA, 22 bp, Artificial Sequence
  chemically synthesized
aacttaaatatctgtcactgat

SEQ ID NO: 662364 - DNA, 22 bp, Artificial Sequence
  chemically synthesized
ggacagcttgaatcagtgacag

SEQ ID NO: 662365 - DNA, 22 bp, Artificial Sequence
  chemically synthesized
gaatcagtgacagatatttaag

SEQ ID NO: 662366 - DNA, 22 bp, Artificial Sequence
  chemically synthesized
aatcagtgacagatatttaagt

SEQ ID NO: 662367 - DNA, 22 bp, Artificial Sequence
  chemically synthesized
aggaaagtaggcccaccaaatt

SEQ ID NO: 662368 - DNA, 22 bp, Artificial Sequence
  chemically synthesized
aagttgaatttggtgggcctac

SEQ ID NO: 662369 - DNA, 22 bp, Artificial Sequence
  chemically synthesized
agtctcaggaaagtaggcccac

SEQ ID NO: 662370 - DNA, 22 bp, Artificial Sequence
  chemically synthesized
agttgaatttggtgggcctact

SEQ ID NO: 662371 - DNA, 22 bp, Artificial Sequence
  chemically synthesized
cagtctcaggaaagtaggccca

SEQ ID NO: 662372 - DNA, 22 bp, Artificial Sequence
  chemically synthesized
tcagtctcaggaaagtaggccc

SEQ ID NO: 662373 - DNA, 22 bp, Artificial Sequence
  chemically synthesized
ttcagtctcaggaaagtaggcc

SEQ ID NO: 662374 - DNA, 22 bp, Artificial Sequence
  chemically synthesized
aatttggtgggcctactttcct

SEQ ID NO: 662375 - DNA, 22 bp, Artificial Sequence
  chemically synthesized
gcttttcagtctcaggaaagta

SEQ ID NO: 662376 - DNA, 22 bp, Artificial Sequence
  chemically synthesized
tagcttttcagtctcaggaaag

SEQ ID NO: 662377 - DNA, 22 bp, Artificial Sequence
  chemically synthesized
ctagcttttcagtctcaggaaa

SEQ ID NO: 662378 - DNA, 22 bp, Artificial Sequence
  chemically synthesized
ggtgggcctactttcctgagac

SEQ ID NO: 662379 - DNA, 22 bp, Artificial Sequence
  chemically synthesized
gtgggcctactttcctgagact

SEQ ID NO: 662380 - DNA, 22 bp, Artificial Sequence
  chemically synthesized
ctttcctgagactgaaaagcta

SEQ ID NO: 662381 - DNA, 22 bp, Artificial Sequence
  chemically synthesized
tcctgagactgaaaagctagaa

SEQ ID NO: 662382 - DNA, 22 bp, Artificial Sequence
  chemically synthesized
cctgagactgaaaagctagaaa

SEQ ID NO: 662383 - DNA, 22 bp, Artificial Sequence
  chemically synthesized
ctgagactgaaaagctagaaat

SEQ ID NO: 662384 - DNA, 22 bp, Artificial Sequence
  chemically synthesized
agactgaaaagctagaaattgg

SEQ ID NO: 662385 - DNA, 22 bp, Artificial Sequence
  chemically synthesized
tagccatccatatccaatttct

SEQ ID NO: 662386 - DNA, 22 bp, Artificial Sequence
  chemically synthesized
tgtagccatccatatccaattt

SEQ ID NO: 662387 - DNA, 22 bp, Artificial Sequence
  chemically synthesized
ctgtagccatccatatccaatt

SEQ ID NO: 662388 - DNA, 22 bp, Artificial Sequence
  chemically synthesized
aaaagctagaaattggatatgg

SEQ ID NO: 662389 - DNA, 22 bp, Artificial Sequence
  chemically synthesized
gaaattggatatggatggctac

SEQ ID NO: 662390 - DNA, 22 bp, Artificial Sequence
  chemically synthesized
gatatggatggctacagaaatt

SEQ ID NO: 662391 - DNA, 22 bp, Artificial Sequence
  chemically synthesized
ggtatgtcacagaaatttctgt

SEQ ID NO: 662392 - DNA, 22 bp, Artificial Sequence
  chemically synthesized
gggtatgtcacagaaatttctg

SEQ ID NO: 662393 - DNA, 22 bp, Artificial Sequence
  chemically synthesized
gtttgggtatgtcacagaaatt

SEQ ID NO: 662394 - DNA, 22 bp, Artificial Sequence
  chemically synthesized
ggtttgggtatgtcacagaaat

SEQ ID NO: 662395 - DNA, 22 bp, Artificial Sequence
  chemically synthesized
tggtttgggtatgtcacagaaa

SEQ ID NO: 662396 - DNA, 22 bp, Artificial Sequence
  chemically synthesized
cagaaatttctgtgacataccc

SEQ ID NO: 662397 - DNA, 22 bp, Artificial Sequence
  chemically synthesized
aaaggactttggtttgggtatg

SEQ ID NO: 662398 - DNA, 22 bp, Artificial Sequence
  chemically synthesized
ctaaaaggactttggtttgggt

SEQ ID NO: 662399 - DNA, 22 bp, Artificial Sequence
  chemically synthesized
ctgtgacatacccaaaccaaag

SEQ ID NO: 662400 - DNA, 22 bp, Artificial Sequence
  chemically synthesized
tgtgacatacccaaaccaaagt

SEQ ID NO: 662401 - DNA, 22 bp, Artificial Sequence
  chemically synthesized
tgacatacccaaaccaaagtcc

SEQ ID NO: 662402 - DNA, 22 bp, Artificial Sequence
  chemically synthesized
aaatcatatgaatagtagtcac

SEQ ID NO: 662403 - DNA, 22 bp, Artificial Sequence
  chemically synthesized
ggctaaaatcatatgaatagta

SEQ ID NO: 662404 - DNA, 22 bp, Artificial Sequence
  chemically synthesized
ttaggagtgactactattcata

SEQ ID NO: 662405 - DNA, 22 bp, Artificial Sequence
  chemically synthesized
taggagtgactactattcatat

SEQ ID NO: 662406 - DNA, 22 bp, Artificial Sequence
  chemically synthesized
aggagtgactactattcatatg

SEQ ID NO: 662407 - DNA, 22 bp, Artificial Sequence
  chemically synthesized
ggagtgactactattcatatga

SEQ ID NO: 662408 - DNA, 22 bp, Artificial Sequence
  chemically synthesized
ctattcatatgattttagccta

SEQ ID NO: 662409 - DNA, 22 bp, Artificial Sequence
  chemically synthesized
ttcatatgattttagcctagtc

SEQ ID NO: 662410 - DNA, 22 bp, Artificial Sequence
  chemically synthesized
atatgattttagcctagtcaca

SEQ ID NO: 662411 - DNA, 22 bp, Artificial Sequence
  chemically synthesized
tagcctagtcacatttttgtgt

SEQ ID NO: 662412 - DNA, 22 bp, Artificial Sequence
  chemically synthesized
agcctagtcacatttttgtgtc

SEQ ID NO: 662413 - DNA, 22 bp, Artificial Sequence
  chemically synthesized
gcctagtcacatttttgtgtct

SEQ ID NO: 662414 - DNA, 22 bp, Artificial Sequence
  chemically synthesized
atgggaaatacacatgagacac

SEQ ID NO: 662415 - DNA, 22 bp, Artificial Sequence
  chemically synthesized
gtcacatttttgtgtctcatgt

SEQ ID NO: 662416 - DNA, 22 bp, Artificial Sequence
  chemically synthesized
aatgggaaatacacatgagaca

SEQ ID NO: 662417 - DNA, 22 bp, Artificial Sequence
  chemically synthesized
taatgggaaatacacatgagac

SEQ ID NO: 662418 - DNA, 22 bp, Artificial Sequence
  chemically synthesized
ttgtgtctcatgtgtatttccc

SEQ ID NO: 662419 - DNA, 22 bp, Artificial Sequence
  chemically synthesized
tgtgtctcatgtgtatttccca

SEQ ID NO: 662420 - DNA, 22 bp, Artificial Sequence
  chemically synthesized
gtgtctcatgtgtatttcccat

SEQ ID NO: 662421 - DNA, 22 bp, Artificial Sequence
  chemically synthesized
tgtctcatgtgtatttcccatt

SEQ ID NO: 662422 - DNA, 22 bp, Artificial Sequence
  chemically synthesized
agaaatagcagctttaatggga

SEQ ID NO: 662423 - DNA, 22 bp, Artificial Sequence
  chemically synthesized
atgtgtatttcccattaaagct

SEQ ID NO: 662424 - DNA, 22 bp, Artificial Sequence
  chemically synthesized
ccattgagaaatagcagcttta

SEQ ID NO: 662425 - DNA, 22 bp, Artificial Sequence
  chemically synthesized
cccattaaagctgctatttctc

SEQ ID NO: 662426 - DNA, 22 bp, Artificial Sequence
  chemically synthesized
ccattaaagctgctatttctca

SEQ ID NO: 662427 - DNA, 22 bp, Artificial Sequence
  chemically synthesized
aagctgctatttctcaatggca

SEQ ID NO: 662428 - DNA, 22 bp, Artificial Sequence
  chemically synthesized
gcccaccagacatgttgccatt

SEQ ID NO: 662429 - DNA, 22 bp, Artificial Sequence
  chemically synthesized
ggcccaccagacatgttgccat

SEQ ID NO: 662430 - DNA, 22 bp, Artificial Sequence
  chemically synthesized
ctatttctcaatggcaacatgt

SEQ ID NO: 662431 - DNA, 22 bp, Artificial Sequence
  chemically synthesized
tttctcaatggcaacatgtctg

SEQ ID NO: 662432 - DNA, 22 bp, Artificial Sequence
  chemically synthesized
ctcaatggcaacatgtctggtg

SEQ ID NO: 662433 - DNA, 22 bp, Artificial Sequence
  chemically synthesized
tcaatggcaacatgtctggtgg

SEQ ID NO: 662434 - DNA, 22 bp, Artificial Sequence
  chemically synthesized
atgccccttggcccaccagaca

SEQ ID NO: 662435 - DNA, 22 bp, Artificial Sequence
  chemically synthesized
aatggcaacatgtctggtgggc

SEQ ID NO: 662436 - DNA, 22 bp, Artificial Sequence
  chemically synthesized
aagtggattcatgccccttggc

SEQ ID NO: 662437 - DNA, 22 bp, Artificial Sequence
  chemically synthesized
caagtggattcatgccccttgg

SEQ ID NO: 662438 - DNA, 22 bp, Artificial Sequence
  chemically synthesized
tttcaagtggattcatgcccct

SEQ ID NO: 662439 - DNA, 22 bp, Artificial Sequence
  chemically synthesized
atttcaagtggattcatgcccc

SEQ ID NO: 662440 - DNA, 22 bp, Artificial Sequence
  chemically synthesized
tatttcaagtggattcatgccc

SEQ ID NO: 662441 - DNA, 22 bp, Artificial Sequence
  chemically synthesized
ttatttcaagtggattcatgcc

SEQ ID NO: 662442 - DNA, 22 bp, Artificial Sequence
  chemically synthesized
gtgggccaaggggcatgaatcc

SEQ ID NO: 662443 - DNA, 22 bp, Artificial Sequence
  chemically synthesized
ttttatttcaagtggattcatg

SEQ ID NO: 662444 - DNA, 22 bp, Artificial Sequence
  chemically synthesized
cttttatttcaagtggattcat

SEQ ID NO: 662445 - DNA, 22 bp, Artificial Sequence
  chemically synthesized
atagaagtttcttttatttcaa

SEQ ID NO: 662446 - DNA, 22 bp, Artificial Sequence
  chemically synthesized
ctaatagaagtttcttttattt

SEQ ID NO: 662447 - DNA, 22 bp, Artificial Sequence
  chemically synthesized
tcctaatagaagtttcttttat

SEQ ID NO: 662448 - DNA, 22 bp, Artificial Sequence
  chemically synthesized
attctcctaatagaagtttctt

SEQ ID NO: 662449 - DNA, 22 bp, Artificial Sequence
  chemically synthesized
ctaattctcctaatagaagttt

SEQ ID NO: 662450 - DNA, 22 bp, Artificial Sequence
  chemically synthesized
gaaataaaagaaacttctatta

SEQ ID NO: 662451 - DNA, 22 bp, Artificial Sequence
  chemically synthesized
aaataaaagaaacttctattag

SEQ ID NO: 662452 - DNA, 22 bp, Artificial Sequence
  chemically synthesized
gcccagttcctaattctcctaa

SEQ ID NO: 662453 - DNA, 22 bp, Artificial Sequence
  chemically synthesized
tagcccagttcctaattctcct

SEQ ID NO: 662454 - DNA, 22 bp, Artificial Sequence
  chemically synthesized
ctattaggagaattaggaactg

SEQ ID NO: 662455 - DNA, 22 bp, Artificial Sequence
  chemically synthesized
tattaggagaattaggaactgg

SEQ ID NO: 662456 - DNA, 22 bp, Artificial Sequence
  chemically synthesized
ttaggagaattaggaactgggc

SEQ ID NO: 662457 - DNA, 22 bp, Artificial Sequence
  chemically synthesized
gccaggtatctctagcccagtt

SEQ ID NO: 662458 - DNA, 22 bp, Artificial Sequence
  chemically synthesized
ggagaattaggaactgggctag

SEQ ID NO: 662459 - DNA, 22 bp, Artificial Sequence
  chemically synthesized
cctggccaggtatctctagccc

SEQ ID NO: 662460 - DNA, 22 bp, Artificial Sequence
  chemically synthesized
tacctggccaggtatctctagc

SEQ ID NO: 662461 - DNA, 22 bp, Artificial Sequence
  chemically synthesized
ggaactgggctagagatacctg

SEQ ID NO: 662462 - DNA, 22 bp, Artificial Sequence
  chemically synthesized
ggctagagatacctggccaggt

SEQ ID NO: 662463 - DNA, 22 bp, Artificial Sequence
  chemically synthesized
aaagcaaattctacctggccag

SEQ ID NO: 662464 - DNA, 22 bp, Artificial Sequence
  chemically synthesized
attcaaagcaaattctacctgg

SEQ ID NO: 662465 - DNA, 22 bp, Artificial Sequence
  chemically synthesized
gagatacctggccaggtagaat

SEQ ID NO: 662466 - DNA, 22 bp, Artificial Sequence
  chemically synthesized
tcattcaaagcaaattctacct

SEQ ID NO: 662467 - DNA, 22 bp, Artificial Sequence
  chemically synthesized
ctcattcaaagcaaattctacc

SEQ ID NO: 662468 - DNA, 22 bp, Artificial Sequence
  chemically synthesized
tcatttctcattcaaagcaaat

SEQ ID NO: 662469 - DNA, 22 bp, Artificial Sequence
  chemically synthesized
atcatttctcattcaaagcaaa

SEQ ID NO: 662470 - DNA, 22 bp, Artificial Sequence
  chemically synthesized
gccaggtagaatttgctttgaa

SEQ ID NO: 662471 - DNA, 22 bp, Artificial Sequence
  chemically synthesized
gtcagtttatcatttctcattc

SEQ ID NO: 662472 - DNA, 22 bp, Artificial Sequence
  chemically synthesized
tcgtcagtttatcatttctcat

SEQ ID NO: 662473 - DNA, 22 bp, Artificial Sequence
  chemically synthesized
ctcgtcagtttatcatttctca

SEQ ID NO: 662474 - DNA, 22 bp, Artificial Sequence
  chemically synthesized
tctcgtcagtttatcatttctc

SEQ ID NO: 662475 - DNA, 22 bp, Artificial Sequence
  chemically synthesized
gctttgaatgagaaatgataaa

SEQ ID NO: 662476 - DNA, 22 bp, Artificial Sequence
  chemically synthesized
ctttgaatgagaaatgataaac

SEQ ID NO: 662477 - DNA, 22 bp, Artificial Sequence
  chemically synthesized
tgaatgagaaatgataaactga

SEQ ID NO: 662478 - DNA, 22 bp, Artificial Sequence
  chemically synthesized
gaatgagaaatgataaactgac

SEQ ID NO: 662479 - DNA, 22 bp, Artificial Sequence
  chemically synthesized
aatgagaaatgataaactgacg

SEQ ID NO: 662480 - DNA, 22 bp, Artificial Sequence
  chemically synthesized
ggaagtctttctcgtcagttta

SEQ ID NO: 662481 - DNA, 22 bp, Artificial Sequence
  chemically synthesized
cactaggaagtctttctcgtca

SEQ ID NO: 662482 - DNA, 22 bp, Artificial Sequence
  chemically synthesized
gcactaggaagtctttctcgtc

SEQ ID NO: 662483 - DNA, 22 bp, Artificial Sequence
  chemically synthesized
ttgcactaggaagtctttctcg

SEQ ID NO: 662484 - DNA, 22 bp, Artificial Sequence
  chemically synthesized
cttgcactaggaagtctttctc

SEQ ID NO: 662485 - DNA, 22 bp, Artificial Sequence
  chemically synthesized
acgagaaagacttcctagtgca

SEQ ID NO: 662486 - DNA, 22 bp, Artificial Sequence
  chemically synthesized
aagtgcgcttcttgcactagga

SEQ ID NO: 662487 - DNA, 22 bp, Artificial Sequence
  chemically synthesized
gaagtgcgcttcttgcactagg

SEQ ID NO: 662488 - DNA, 22 bp, Artificial Sequence
  chemically synthesized
gatgcccttgaagtgcgcttct

SEQ ID NO: 662489 - DNA, 22 bp, Artificial Sequence
  chemically synthesized
cctagtgcaagaagcgcacttc

SEQ ID NO: 662490 - DNA, 22 bp, Artificial Sequence
  chemically synthesized
ctagtgcaagaagcgcacttca

SEQ ID NO: 662491 - DNA, 22 bp, Artificial Sequence
  chemically synthesized
gaattggatgcccttgaagtgc

SEQ ID NO: 662492 - DNA, 22 bp, Artificial Sequence
  chemically synthesized
gtgcaagaagcgcacttcaagg

SEQ ID NO: 662493 - DNA, 22 bp, Artificial Sequence
  chemically synthesized
ctggaattggatgcccttgaag

SEQ ID NO: 662494 - DNA, 22 bp, Artificial Sequence
  chemically synthesized
ctcctggaattggatgcccttg

SEQ ID NO: 662495 - DNA, 22 bp, Artificial Sequence
  chemically synthesized
cctcctggaattggatgccctt

SEQ ID NO: 662496 - DNA, 22 bp, Artificial Sequence
  chemically synthesized
tccttcctcctggaattggatg

SEQ ID NO: 662497 - DNA, 22 bp, Artificial Sequence
  chemically synthesized
caagggcatccaattccaggag

SEQ ID NO: 662498 - DNA, 22 bp, Artificial Sequence
  chemically synthesized
aagggcatccaattccaggagg

SEQ ID NO: 662499 - DNA, 22 bp, Artificial Sequence
  chemically synthesized
ccatccctatccttcctcctgg

SEQ ID NO: 662500 - DNA, 22 bp, Artificial Sequence
  chemically synthesized
gccatccctatccttcctcctg

SEQ ID NO: 662501 - DNA, 22 bp, Artificial Sequence
  chemically synthesized
gcagcttgccatccctatcctt

SEQ ID NO: 662502 - DNA, 22 bp, Artificial Sequence
  chemically synthesized
ggcagcttgccatccctatcct

SEQ ID NO: 662503 - DNA, 22 bp, Artificial Sequence
  chemically synthesized
caggaggaaggatagggatggc

SEQ ID NO: 662504 - DNA, 22 bp, Artificial Sequence
  chemically synthesized
tcaaccttggcagcttgccatc

SEQ ID NO: 662505 - DNA, 22 bp, Artificial Sequence
  chemically synthesized
cagctatcaaccttggcagctt

SEQ ID NO: 662506 - DNA, 22 bp, Artificial Sequence
  chemically synthesized
tccagctatcaaccttggcagc

SEQ ID NO: 662507 - DNA, 22 bp, Artificial Sequence
  chemically synthesized
cattctccagctatcaaccttg

SEQ ID NO: 662508 - DNA, 22 bp, Artificial Sequence
  chemically synthesized
gttccattctccagctatcaac

SEQ ID NO: 662509 - DNA, 22 bp, Artificial Sequence
  chemically synthesized
ttggttccattctccagctatc

SEQ ID NO: 662510 - DNA, 22 bp, Artificial Sequence
  chemically synthesized
ccaaggttgatagctggagaat

SEQ ID NO: 662511 - DNA, 22 bp, Artificial Sequence
  chemically synthesized
gtaattattggttccattctcc

SEQ ID NO: 662512 - DNA, 22 bp, Artificial Sequence
  chemically synthesized
tagtaattattggttccattct

SEQ ID NO: 662513 - DNA, 22 bp, Artificial Sequence
  chemically synthesized
ctagtaattattggttccattc

SEQ ID NO: 662514 - DNA, 22 bp, Artificial Sequence
  chemically synthesized
tctagtaattattggttccatt

SEQ ID NO: 662515 - DNA, 22 bp, Artificial Sequence
  chemically synthesized
atagctggagaatggaaccaat

SEQ ID NO: 662516 - DNA, 22 bp, Artificial Sequence
  chemically synthesized
cgttttctagtaattattggtt

SEQ ID NO: 662517 - DNA, 22 bp, Artificial Sequence
  chemically synthesized
gagaatggaaccaataattact

SEQ ID NO: 662518 - DNA, 22 bp, Artificial Sequence
  chemically synthesized
gtaggttccgttttctagtaat

SEQ ID NO: 662519 - DNA, 22 bp, Artificial Sequence
  chemically synthesized
aagaacacctcgtaggttccgt

SEQ ID NO: 662520 - DNA, 22 bp, Artificial Sequence
  chemically synthesized
ctagaaaacggaacctacgagg

SEQ ID NO: 662521 - DNA, 22 bp, Artificial Sequence
  chemically synthesized
gaaaacggaacctacgaggtgt

SEQ ID NO: 662522 - DNA, 22 bp, Artificial Sequence
  chemically synthesized
aagagattaaagaacacctcgt

SEQ ID NO: 662523 - DNA, 22 bp, Artificial Sequence
  chemically synthesized
agtcagatgctaaagagattaa

SEQ ID NO: 662524 - DNA, 22 bp, Artificial Sequence
  chemically synthesized
cgaggtgttctttaatctcttt

SEQ ID NO: 662525 - DNA, 22 bp, Artificial Sequence
  chemically synthesized
tcagtcagatgctaaagagatt

SEQ ID NO: 662526 - DNA, 22 bp, Artificial Sequence
  chemically synthesized
tctcagtcagatgctaaagaga

SEQ ID NO: 662527 - DNA, 22 bp, Artificial Sequence
  chemically synthesized
ctctcagtcagatgctaaagag

SEQ ID NO: 662528 - DNA, 22 bp, Artificial Sequence
  chemically synthesized
tctctcagtcagatgctaaaga

SEQ ID NO: 662529 - DNA, 22 bp, Artificial Sequence
  chemically synthesized
tttaatctctttagcatctgac

SEQ ID NO: 662530 - DNA, 22 bp, Artificial Sequence
  chemically synthesized
taatctctttagcatctgactg

SEQ ID NO: 662531 - DNA, 22 bp, Artificial Sequence
  chemically synthesized
aatctctttagcatctgactga

SEQ ID NO: 662532 - DNA, 22 bp, Artificial Sequence
  chemically synthesized
atctctttagcatctgactgag

SEQ ID NO: 662533 - DNA, 22 bp, Artificial Sequence
  chemically synthesized
tttagcatctgactgagagaaa

SEQ ID NO: 662534 - DNA, 22 bp, Artificial Sequence
  chemically synthesized
gggaaagaatggttttctctca

SEQ ID NO: 662535 - DNA, 22 bp, Artificial Sequence
  chemically synthesized
tagcatctgactgagagaaaac

SEQ ID NO: 662536 - DNA, 22 bp, Artificial Sequence
  chemically synthesized
agcatctgactgagagaaaacc

SEQ ID NO: 662537 - DNA, 22 bp, Artificial Sequence
  chemically synthesized
gcatctgactgagagaaaacca

SEQ ID NO: 662538 - DNA, 22 bp, Artificial Sequence
  chemically synthesized
cccactagggaaagaatggttt

SEQ ID NO: 662539 - DNA, 22 bp, Artificial Sequence
  chemically synthesized
actgagagaaaaccattctttc

SEQ ID NO: 662540 - DNA, 22 bp, Artificial Sequence
  chemically synthesized
ttacccactagggaaagaatgg

SEQ ID NO: 662541 - DNA, 22 bp, Artificial Sequence
  chemically synthesized
agagaaaaccattctttcccta

SEQ ID NO: 662542 - DNA, 22 bp, Artificial Sequence
  chemically synthesized
gctgttacccactagggaaaga

SEQ ID NO: 662543 - DNA, 22 bp, Artificial Sequence
  chemically synthesized
agctgttacccactagggaaag

SEQ ID NO: 662544 - DNA, 22 bp, Artificial Sequence
  chemically synthesized
tttagctgttacccactaggga

SEQ ID NO: 662545 - DNA, 22 bp, Artificial Sequence
  chemically synthesized
gtttagctgttacccactaggg

SEQ ID NO: 662546 - DNA, 22 bp, Artificial Sequence
  chemically synthesized
taatcttgtttagctgttaccc

SEQ ID NO: 662547 - DNA, 22 bp, Artificial Sequence
  chemically synthesized
tttccctagtgggtaacagcta

SEQ ID NO: 662548 - DNA, 22 bp, Artificial Sequence
  chemically synthesized
tccctagtgggtaacagctaaa

SEQ ID NO: 662549 - DNA, 22 bp, Artificial Sequence
  chemically synthesized
ccctagtgggtaacagctaaac

SEQ ID NO: 662550 - DNA, 22 bp, Artificial Sequence
  chemically synthesized
cctagtgggtaacagctaaaca

SEQ ID NO: 662551 - DNA, 22 bp, Artificial Sequence
  chemically synthesized
gtgggtaacagctaaacaagat

SEQ ID NO: 662552 - DNA, 22 bp, Artificial Sequence
  chemically synthesized
ccaggggaaatactgtaatctt

SEQ ID NO: 662553 - DNA, 22 bp, Artificial Sequence
  chemically synthesized
tctcccaggggaaatactgtaa

SEQ ID NO: 662554 - DNA, 22 bp, Artificial Sequence
  chemically synthesized
aacaagattacagtatttcccc

SEQ ID NO: 662555 - DNA, 22 bp, Artificial Sequence
  chemically synthesized
cagtatttcccctgggagatag

SEQ ID NO: 662556 - DNA, 22 bp, Artificial Sequence
  chemically synthesized
ataacatgacccatctatctcc

SEQ ID NO: 662557 - DNA, 22 bp, Artificial Sequence
  chemically synthesized
cccctgggagatagatgggtca

SEQ ID NO: 662558 - DNA, 22 bp, Artificial Sequence
  chemically synthesized
ccctgggagatagatgggtcat

SEQ ID NO: 662559 - DNA, 22 bp, Artificial Sequence
  chemically synthesized
ggagatagatgggtcatgttat

SEQ ID NO: 662560 - DNA, 22 bp, Artificial Sequence
  chemically synthesized
gtgcccaagagaggtctcataa

SEQ ID NO: 662561 - DNA, 22 bp, Artificial Sequence
  chemically synthesized
acagatattagtgcccaagaga

SEQ ID NO: 662562 - DNA, 22 bp, Artificial Sequence
  chemically synthesized
gacagatattagtgcccaagag

SEQ ID NO: 662563 - DNA, 22 bp, Artificial Sequence
  chemically synthesized
tgagacctctcttgggcactaa

SEQ ID NO: 662564 - DNA, 22 bp, Artificial Sequence
  chemically synthesized
tatggtttgacagatattagtg

SEQ ID NO: 662565 - DNA, 22 bp, Artificial Sequence
  chemically synthesized
atatggtttgacagatattagt

SEQ ID NO: 662566 - DNA, 22 bp, Artificial Sequence
  chemically synthesized
tcttgggcactaatatctgtca

SEQ ID NO: 662567 - DNA, 22 bp, Artificial Sequence
  chemically synthesized
agtttatatggtttgacagata

SEQ ID NO: 662568 - DNA, 22 bp, Artificial Sequence
  chemically synthesized
ttgggcactaatatctgtcaaa

SEQ ID NO: 662569 - DNA, 22 bp, Artificial Sequence
  chemically synthesized
tcagtttatatggtttgacaga

SEQ ID NO: 662570 - DNA, 22 bp, Artificial Sequence
  chemically synthesized
gggcactaatatctgtcaaacc

SEQ ID NO: 662571 - DNA, 22 bp, Artificial Sequence
  chemically synthesized
ctcagtttatatggtttgacag

SEQ ID NO: 662572 - DNA, 22 bp, Artificial Sequence
  chemically synthesized
ggcactaatatctgtcaaacca

SEQ ID NO: 662573 - DNA, 22 bp, Artificial Sequence
  chemically synthesized
tctcagtttatatggtttgaca

SEQ ID NO: 662574 - DNA, 22 bp, Artificial Sequence
  chemically synthesized
attttctcagtttatatggttt

SEQ ID NO: 662575 - DNA, 22 bp, Artificial Sequence
  chemically synthesized
atatctgtcaaaccatataaac

SEQ ID NO: 662576 - DNA, 22 bp, Artificial Sequence
  chemically synthesized
tcaaaccatataaactgagaaa

SEQ ID NO: 662577 - DNA, 22 bp, Artificial Sequence
  chemically synthesized
aggacatggccaaactaatttt

SEQ ID NO: 662578 - DNA, 22 bp, Artificial Sequence
  chemically synthesized
gaggacatggccaaactaattt

SEQ ID NO: 662579 - DNA, 22 bp, Artificial Sequence
  chemically synthesized
agaaaattagtttggccatgtc

SEQ ID NO: 662580 - DNA, 22 bp, Artificial Sequence
  chemically synthesized
agacgtcttgaggacatggcca

SEQ ID NO: 662581 - DNA, 22 bp, Artificial Sequence
  chemically synthesized
aagacgtcttgaggacatggcc

SEQ ID NO: 662582 - DNA, 22 bp, Artificial Sequence
  chemically synthesized
agtttaagacgtcttgaggaca

SEQ ID NO: 662583 - DNA, 22 bp, Artificial Sequence
  chemically synthesized
tgagtttaagacgtcttgagga

SEQ ID NO: 662584 - DNA, 22 bp, Artificial Sequence
  chemically synthesized
gtttggccatgtcctcaagacg

SEQ ID NO: 662585 - DNA, 22 bp, Artificial Sequence
  chemically synthesized
gttctgagtttaagacgtcttg

SEQ ID NO: 662586 - DNA, 22 bp, Artificial Sequence
  chemically synthesized
ggccatgtcctcaagacgtctt

SEQ ID NO: 662587 - DNA, 22 bp, Artificial Sequence
  chemically synthesized
gccatgtcctcaagacgtctta

SEQ ID NO: 662588 - DNA, 22 bp, Artificial Sequence
  chemically synthesized
ttagttctgagtttaagacgtc

SEQ ID NO: 662589 - DNA, 22 bp, Artificial Sequence
  chemically synthesized
tgttagttctgagtttaagacg

SEQ ID NO: 662590 - DNA, 22 bp, Artificial Sequence
  chemically synthesized
aagacgtcttaaactcagaact

SEQ ID NO: 662591 - DNA, 22 bp, Artificial Sequence
  chemically synthesized
gaggccatgtctctgttagttc

SEQ ID NO: 662592 - DNA, 22 bp, Artificial Sequence
  chemically synthesized
aaactcagaactaacagagaca

SEQ ID NO: 662593 - DNA, 22 bp, Artificial Sequence
  chemically synthesized
aactcagaactaacagagacat

SEQ ID NO: 662594 - DNA, 22 bp, Artificial Sequence
  chemically synthesized
acataggttagaggccatgtct

SEQ ID NO: 662595 - DNA, 22 bp, Artificial Sequence
  chemically synthesized
agaactaacagagacatggcct

SEQ ID NO: 662596 - DNA, 22 bp, Artificial Sequence
  chemically synthesized
cacataggttagaggccatgtc

SEQ ID NO: 662597 - DNA, 22 bp, Artificial Sequence
  chemically synthesized
tcacataggttagaggccatgt

SEQ ID NO: 662598 - DNA, 22 bp, Artificial Sequence
  chemically synthesized
ttcacataggttagaggccatg

SEQ ID NO: 662599 - DNA, 22 bp, Artificial Sequence
  chemically synthesized
tttttcacataggttagaggcc

SEQ ID NO: 662600 - DNA, 22 bp, Artificial Sequence
  chemically synthesized
acagagacatggcctctaacct

SEQ ID NO: 662601 - DNA, 22 bp, Artificial Sequence
  chemically synthesized
tataccatgtattatttttcac

SEQ ID NO: 662602 - DNA, 22 bp, Artificial Sequence
  chemically synthesized
tatataccatgtattatttttc

SEQ ID NO: 662603 - DNA, 22 bp, Artificial Sequence
  chemically synthesized
ctatataccatgtattattttt

SEQ ID NO: 662604 - DNA, 22 bp, Artificial Sequence
  chemically synthesized
taacctatgtgaaaaataatac

SEQ ID NO: 662605 - DNA, 22 bp, Artificial Sequence
  chemically synthesized
tctatataccatgtattatttt

SEQ ID NO: 662606 - DNA, 22 bp, Artificial Sequence
  chemically synthesized
ttctatataccatgtattattt

SEQ ID NO: 662607 - DNA, 22 bp, Artificial Sequence
  chemically synthesized
acctatgtgaaaaataatacat

SEQ ID NO: 662608 - DNA, 22 bp, Artificial Sequence
  chemically synthesized
tttctatataccatgtattatt

SEQ ID NO: 662609 - DNA, 22 bp, Artificial Sequence
  chemically synthesized
ctttttctatataccatgtatt

SEQ ID NO: 662610 - DNA, 22 bp, Artificial Sequence
  chemically synthesized
tgtgaaaaataatacatggtat

SEQ ID NO: 662611 - DNA, 22 bp, Artificial Sequence
  chemically synthesized
caaaaatctactttttctatat

SEQ ID NO: 662612 - DNA, 22 bp, Artificial Sequence
  chemically synthesized
tcctacaaaaatctactttttc

SEQ ID NO: 662613 - DNA, 22 bp, Artificial Sequence
  chemically synthesized
ccactgtcctacaaaaatctac

SEQ ID NO: 662614 - DNA, 22 bp, Artificial Sequence
  chemically synthesized
gccactgtcctacaaaaatcta

SEQ ID NO: 662615 - DNA, 22 bp, Artificial Sequence
  chemically synthesized
tgccactgtcctacaaaaatct

SEQ ID NO: 662616 - DNA, 22 bp, Artificial Sequence
  chemically synthesized
ttttgccactgtcctacaaaaa

SEQ ID NO: 662617 - DNA, 22 bp, Artificial Sequence
  chemically synthesized
ttgtaggacagtggcaaaataa

SEQ ID NO: 662618 - DNA, 22 bp, Artificial Sequence
  chemically synthesized
tgtaggacagtggcaaaataat

SEQ ID NO: 662619 - DNA, 22 bp, Artificial Sequence
  chemically synthesized
gtaggacagtggcaaaataatt

SEQ ID NO: 662620 - DNA, 22 bp, Artificial Sequence
  chemically synthesized
taggacagtggcaaaataatta

SEQ ID NO: 662621 - DNA, 22 bp, Artificial Sequence
  chemically synthesized
gagaggccagtgtaattatttt

SEQ ID NO: 662622 - DNA, 22 bp, Artificial Sequence
  chemically synthesized
cacagcaagggggtctcgagag

SEQ ID NO: 662623 - DNA, 22 bp, Artificial Sequence
  chemically synthesized
cctccacagcaagggggtctcg

SEQ ID NO: 662624 - DNA, 22 bp, Artificial Sequence
  chemically synthesized
cactggcctctcgagaccccct

SEQ ID NO: 662625 - DNA, 22 bp, Artificial Sequence
  chemically synthesized
gcctctcgagacccccttgctg

SEQ ID NO: 662626 - DNA, 22 bp, Artificial Sequence
  chemically synthesized
tcgagacccccttgctgtggag

SEQ ID NO: 662627 - DNA, 22 bp, Artificial Sequence
  chemically synthesized
gagacccccttgctgtggaggc

SEQ ID NO: 662628 - DNA, 22 bp, Artificial Sequence
  chemically synthesized
gctgtggaggcagcctgtggct

SEQ ID NO: 662629 - DNA, 22 bp, Artificial Sequence
  chemically synthesized
ctgtggaggcagcctgtggctg

SEQ ID NO: 662630 - DNA, 22 bp, Artificial Sequence
  chemically synthesized
tggaggcagcctgtggctgtgg

SEQ ID NO: 662631 - DNA, 22 bp, Artificial Sequence
  chemically synthesized
tcaggatatggatccacagcca

SEQ ID NO: 662632 - DNA, 22 bp, Artificial Sequence
  chemically synthesized
ctgtcaggatatggatccacag

SEQ ID NO: 662633 - DNA, 22 bp, Artificial Sequence
  chemically synthesized
tggctgtggatccatatcctga

SEQ ID NO: 662634 - DNA, 22 bp, Artificial Sequence
  chemically synthesized
caagagcattactgtcaggata

SEQ ID NO: 662635 - DNA, 22 bp, Artificial Sequence
  chemically synthesized
tggatccatatcctgacagtaa

SEQ ID NO: 662636 - DNA, 22 bp, Artificial Sequence
  chemically synthesized
cattacaagagcattactgtca

SEQ ID NO: 662637 - DNA, 22 bp, Artificial Sequence
  chemically synthesized
ccagaaaaggctacattacaag

SEQ ID NO: 662638 - DNA, 22 bp, Artificial Sequence
  chemically synthesized
acagtaatgctcttgtaatgta

SEQ ID NO: 662639 - DNA, 22 bp, Artificial Sequence
  chemically synthesized
ttgccagaaaaggctacattac

SEQ ID NO: 662640 - DNA, 22 bp, Artificial Sequence
  chemically synthesized
tattgccagaaaaggctacatt

SEQ ID NO: 662641 - DNA, 22 bp, Artificial Sequence
  chemically synthesized
ttgtaatgtagccttttctggc

SEQ ID NO: 662642 - DNA, 22 bp, Artificial Sequence
  chemically synthesized
gtaatgtagccttttctggcaa

SEQ ID NO: 662643 - DNA, 22 bp, Artificial Sequence
  chemically synthesized
taatgtagccttttctggcaat

SEQ ID NO: 662644 - DNA, 22 bp, Artificial Sequence
  chemically synthesized
caaatccgcgctctattgccag

SEQ ID NO: 662645 - DNA, 22 bp, Artificial Sequence
  chemically synthesized
acaaatccgcgctctattgcca

SEQ ID NO: 662646 - DNA, 22 bp, Artificial Sequence
  chemically synthesized
ttctggcaatagagcgcggatt

SEQ ID NO: 662647 - DNA, 22 bp, Artificial Sequence
  chemically synthesized
tctggcaatagagcgcggattt

SEQ ID NO: 662648 - DNA, 22 bp, Artificial Sequence
  chemically synthesized
ctggcaatagagcgcggatttg

SEQ ID NO: 662649 - DNA, 22 bp, Artificial Sequence
  chemically synthesized
tggcaatagagcgcggatttgt

SEQ ID NO: 662650 - DNA, 22 bp, Artificial Sequence
  chemically synthesized
gcaatagagcgcggatttgtaa

SEQ ID NO: 662651 - DNA, 22 bp, Artificial Sequence
  chemically synthesized
aggacccacaataacatggctt

SEQ ID NO: 662652 - DNA, 22 bp, Artificial Sequence
  chemically synthesized
tcaggacccacaataacatggc

SEQ ID NO: 662653 - DNA, 22 bp, Artificial Sequence
  chemically synthesized
gtaagccatgttattgtgggtc

SEQ ID NO: 662654 - DNA, 22 bp, Artificial Sequence
  chemically synthesized
taagccatgttattgtgggtcc

SEQ ID NO: 662655 - DNA, 22 bp, Artificial Sequence
  chemically synthesized
aagaagactctcaggacccaca

SEQ ID NO: 662656 - DNA, 22 bp, Artificial Sequence
  chemically synthesized
ctaaagaagactctcaggaccc

SEQ ID NO: 662657 - DNA, 22 bp, Artificial Sequence
  chemically synthesized
agttgctaaagaagactctcag

SEQ ID NO: 662658 - DNA, 22 bp, Artificial Sequence
  chemically synthesized
cagttgctaaagaagactctca

SEQ ID NO: 662659 - DNA, 22 bp, Artificial Sequence
  chemically synthesized
ttgtgggtcctgagagtcttct

SEQ ID NO: 662660 - DNA, 22 bp, Artificial Sequence
  chemically synthesized
tgggtcctgagagtcttcttta

SEQ ID NO: 662661 - DNA, 22 bp, Artificial Sequence
  chemically synthesized
gataggcttcagttgctaaaga

SEQ ID NO: 662662 - DNA, 22 bp, Artificial Sequence
  chemically synthesized
agagtcttctttagcaactgaa

SEQ ID NO: 662663 - DNA, 22 bp, Artificial Sequence
  chemically synthesized
agggtgacattagataggcttc

SEQ ID NO: 662664 - DNA, 22 bp, Artificial Sequence
  chemically synthesized
ctttagcaactgaagcctatct

SEQ ID NO: 662665 - DNA, 22 bp, Artificial Sequence
  chemically synthesized
tttagcaactgaagcctatcta

SEQ ID NO: 662666 - DNA, 22 bp, Artificial Sequence
  chemically synthesized
tagcaactgaagcctatctaat

SEQ ID NO: 662667 - DNA, 22 bp, Artificial Sequence
  chemically synthesized
agcaactgaagcctatctaatg

SEQ ID NO: 662668 - DNA, 22 bp, Artificial Sequence
  chemically synthesized
gcaactgaagcctatctaatgt

SEQ ID NO: 662669 - DNA, 22 bp, Artificial Sequence
  chemically synthesized
atggtgcgctaagggtgacatt

SEQ ID NO: 662670 - DNA, 22 bp, Artificial Sequence
  chemically synthesized
gatggtgcgctaagggtgacat

SEQ ID NO: 662671 - DNA, 22 bp, Artificial Sequence
  chemically synthesized
aagcctatctaatgtcaccctt

SEQ ID NO: 662672 - DNA, 22 bp, Artificial Sequence
  chemically synthesized
tgatggtgcgctaagggtgaca

SEQ ID NO: 662673 - DNA, 22 bp, Artificial Sequence
  chemically synthesized
ttgatggtgcgctaagggtgac

SEQ ID NO: 662674 - DNA, 22 bp, Artificial Sequence
  chemically synthesized
accttttgatggtgcgctaagg

SEQ ID NO: 662675 - DNA, 22 bp, Artificial Sequence
  chemically synthesized
tctaatgtcacccttagcgcac

SEQ ID NO: 662676 - DNA, 22 bp, Artificial Sequence
  chemically synthesized
atgtcacccttagcgcaccatc

SEQ ID NO: 662677 - DNA, 22 bp, Artificial Sequence
  chemically synthesized
taaatgcacctcaccttttgat

SEQ ID NO: 662678 - DNA, 22 bp, Artificial Sequence
  chemically synthesized
tgtaaatgcacctcaccttttg

SEQ ID NO: 662679 - DNA, 22 bp, Artificial Sequence
  chemically synthesized
agcgcaccatcaaaaggtgagg

SEQ ID NO: 662680 - DNA, 22 bp, Artificial Sequence
  chemically synthesized
tctgtaaatgcacctcaccttt

SEQ ID NO: 662681 - DNA, 22 bp, Artificial Sequence
  chemically synthesized
gcgcaccatcaaaaggtgaggt

SEQ ID NO: 662682 - DNA, 22 bp, Artificial Sequence
  chemically synthesized
ctctgtaaatgcacctcacctt

SEQ ID NO: 662683 - DNA, 22 bp, Artificial Sequence
  chemically synthesized
acagagaaggcggtgcattttt

SEQ ID NO: 662684 - DNA, 22 bp, Artificial Sequence
  chemically synthesized
cagagaaggcggtgcatttttc

SEQ ID NO: 662685 - DNA, 22 bp, Artificial Sequence
  chemically synthesized
accatgacaaaccaggtgaaaa

SEQ ID NO: 662686 - DNA, 22 bp, Artificial Sequence
  chemically synthesized
gccctcaccatgacaaaccagg

SEQ ID NO: 662687 - DNA, 22 bp, Artificial Sequence
  chemically synthesized
gactcgccctcaccatgacaaa

SEQ ID NO: 662688 - DNA, 22 bp, Artificial Sequence
  chemically synthesized
tggactcgccctcaccatgaca

SEQ ID NO: 662689 - DNA, 22 bp, Artificial Sequence
  chemically synthesized
ttcacctggtttgtcatggtga

SEQ ID NO: 662690 - DNA, 22 bp, Artificial Sequence
  chemically synthesized
ctggactcgccctcaccatgac

SEQ ID NO: 662691 - DNA, 22 bp, Artificial Sequence
  chemically synthesized
tcacctggtttgtcatggtgag

SEQ ID NO: 662692 - DNA, 22 bp, Artificial Sequence
  chemically synthesized
cacctggtttgtcatggtgagg

SEQ ID NO: 662693 - DNA, 22 bp, Artificial Sequence
  chemically synthesized
acctggtttgtcatggtgaggg

SEQ ID NO: 662694 - DNA, 22 bp, Artificial Sequence
  chemically synthesized
gtttgtcatggtgagggcgagt

SEQ ID NO: 662695 - DNA, 22 bp, Artificial Sequence
  chemically synthesized
gtcatggtgagggcgagtccag

SEQ ID NO: 662696 - DNA, 22 bp, Artificial Sequence
  chemically synthesized
tcatggtgagggcgagtccaga

SEQ ID NO: 662697 - DNA, 22 bp, Artificial Sequence
  chemically synthesized
tgtgaatagtcacagtttctgg

SEQ ID NO: 662698 - DNA, 22 bp, Artificial Sequence
  chemically synthesized
gagttgtgtgaatagtcacagt

SEQ ID NO: 662699 - DNA, 22 bp, Artificial Sequence
  chemically synthesized
gtacaggctggagttgtgtgaa

SEQ ID NO: 662700 - DNA, 22 bp, Artificial Sequence
  chemically synthesized
ggtacaggctggagttgtgtga

SEQ ID NO: 662701 - DNA, 22 bp, Artificial Sequence
  chemically synthesized
tgactattcacacaactccagc

SEQ ID NO: 662702 - DNA, 22 bp, Artificial Sequence
  chemically synthesized
tagagatttggtacaggctgga

SEQ ID NO: 662703 - DNA, 22 bp, Artificial Sequence
  chemically synthesized
ttcacacaactccagcctgtac

SEQ ID NO: 662704 - DNA, 22 bp, Artificial Sequence
  chemically synthesized
acacaactccagcctgtaccaa

SEQ ID NO: 662705 - DNA, 22 bp, Artificial Sequence
  chemically synthesized
aagcacacattatagagatttg

SEQ ID NO: 662706 - DNA, 22 bp, Artificial Sequence
  chemically synthesized
cagcctgtaccaaatctctata

SEQ ID NO: 662707 - DNA, 22 bp, Artificial Sequence
  chemically synthesized
agcaactaaagcacacattata

SEQ ID NO: 662708 - DNA, 22 bp, Artificial Sequence
  chemically synthesized
taccaaatctctataatgtgtg

SEQ ID NO: 662709 - DNA, 22 bp, Artificial Sequence
  chemically synthesized
ttcagcaactaaagcacacatt

SEQ ID NO: 662710 - DNA, 22 bp, Artificial Sequence
  chemically synthesized
tattcagcaactaaagcacaca

SEQ ID NO: 662711 - DNA, 22 bp, Artificial Sequence
  chemically synthesized
cctctattcagcaactaaagca

SEQ ID NO: 662712 - DNA, 22 bp, Artificial Sequence
  chemically synthesized
gcctctattcagcaactaaagc

SEQ ID NO: 662713 - DNA, 22 bp, Artificial Sequence
  chemically synthesized
tgcctctattcagcaactaaag

SEQ ID NO: 662714 - DNA, 22 bp, Artificial Sequence
  chemically synthesized
tataatgtgtgctttagttgct

SEQ ID NO: 662715 - DNA, 22 bp, Artificial Sequence
  chemically synthesized
taatgtgtgctttagttgctga

SEQ ID NO: 662716 - DNA, 22 bp, Artificial Sequence
  chemically synthesized
tagttgctgaatagaggcaaaa

SEQ ID NO: 662717 - DNA, 22 bp, Artificial Sequence
  chemically synthesized
agttgctgaatagaggcaaaat

SEQ ID NO: 662718 - DNA, 22 bp, Artificial Sequence
  chemically synthesized
gttgctgaatagaggcaaaatg

SEQ ID NO: 662719 - DNA, 22 bp, Artificial Sequence
  chemically synthesized
ctgaatagaggcaaaatgttct

SEQ ID NO: 662720 - DNA, 22 bp, Artificial Sequence
  chemically synthesized
aatagaggcaaaatgttctcta

SEQ ID NO: 662721 - DNA, 22 bp, Artificial Sequence
  chemically synthesized
caaacagtaagaaatagagaac

SEQ ID NO: 662722 - DNA, 22 bp, Artificial Sequence
  chemically synthesized
tgcaaacagtaagaaatagaga

SEQ ID NO: 662723 - DNA, 22 bp, Artificial Sequence
  chemically synthesized
tctatttcttactgtttgcaga

SEQ ID NO: 662724 - DNA, 22 bp, Artificial Sequence
  chemically synthesized
tatttcttactgtttgcagaat

SEQ ID NO: 662725 - DNA, 22 bp, Artificial Sequence
  chemically synthesized
tttcttactgtttgcagaatat

SEQ ID NO: 662726 - DNA, 22 bp, Artificial Sequence
  chemically synthesized
ataagtgtgacaaatattctgc

SEQ ID NO: 662727 - DNA, 22 bp, Artificial Sequence
  chemically synthesized
cttactgtttgcagaatatttg

SEQ ID NO: 662728 - DNA, 22 bp, Artificial Sequence
  chemically synthesized
ttactgtttgcagaatatttgt

SEQ ID NO: 662729 - DNA, 22 bp, Artificial Sequence
  chemically synthesized
actgtttgcagaatatttgtca

SEQ ID NO: 662730 - DNA, 22 bp, Artificial Sequence
  chemically synthesized
ctgtttgcagaatatttgtcac

SEQ ID NO: 662731 - DNA, 22 bp, Artificial Sequence
  chemically synthesized
cagttgataagtgtgacaaata

SEQ ID NO: 662732 - DNA, 22 bp, Artificial Sequence
  chemically synthesized
tttgcagaatatttgtcacact

SEQ ID NO: 662733 - DNA, 22 bp, Artificial Sequence
  chemically synthesized
gcagaatatttgtcacacttat

SEQ ID NO: 662734 - DNA, 22 bp, Artificial Sequence
  chemically synthesized
cagaatatttgtcacacttatc

SEQ ID NO: 662735 - DNA, 22 bp, Artificial Sequence
  chemically synthesized
aatatactgcagttgataagtg

SEQ ID NO: 662736 - DNA, 22 bp, Artificial Sequence
  chemically synthesized
gtcacacttatcaactgcagta

SEQ ID NO: 662737 - DNA, 22 bp, Artificial Sequence
  chemically synthesized
tcacacttatcaactgcagtat

SEQ ID NO: 662738 - DNA, 22 bp, Artificial Sequence
  chemically synthesized
atcaactgcagtatatttagcc

SEQ ID NO: 662739 - DNA, 22 bp, Artificial Sequence
  chemically synthesized
tcaactgcagtatatttagccc

SEQ ID NO: 662740 - DNA, 22 bp, Artificial Sequence
  chemically synthesized
gagagagcccaaaccatagggc

SEQ ID NO: 662741 - DNA, 22 bp, Artificial Sequence
  chemically synthesized
cagtatatttagccctatggtt

SEQ ID NO: 662742 - DNA, 22 bp, Artificial Sequence
  chemically synthesized
agccctatggtttgggctctct

SEQ ID NO: 662743 - DNA, 22 bp, Artificial Sequence
  chemically synthesized
gccctatggtttgggctctctc

SEQ ID NO: 662744 - DNA, 22 bp, Artificial Sequence
  chemically synthesized
tggtttgggctctctccaaccc

SEQ ID NO: 662745 - DNA, 22 bp, Artificial Sequence
  chemically synthesized
ataatgtgtggtgggttggaga

SEQ ID NO: 662746 - DNA, 22 bp, Artificial Sequence
  chemically synthesized
ttaataatgtgtggtgggttgg

SEQ ID NO: 662747 - DNA, 22 bp, Artificial Sequence
  chemically synthesized
attaataatgtgtggtgggttg

SEQ ID NO: 662748 - DNA, 22 bp, Artificial Sequence
  chemically synthesized
gggctctctccaacccaccaca

SEQ ID NO: 662749 - DNA, 22 bp, Artificial Sequence
  chemically synthesized
ggctctctccaacccaccacac

SEQ ID NO: 662750 - DNA, 22 bp, Artificial Sequence
  chemically synthesized
gtttattaataatgtgtggtgg

SEQ ID NO: 662751 - DNA, 22 bp, Artificial Sequence
  chemically synthesized
agtttattaataatgtgtggtg

SEQ ID NO: 662752 - DNA, 22 bp, Artificial Sequence
  chemically synthesized
tctccaacccaccacacattat

SEQ ID NO: 662753 - DNA, 22 bp, Artificial Sequence
  chemically synthesized
tccaacccaccacacattatta

SEQ ID NO: 662754 - DNA, 22 bp, Artificial Sequence
  chemically synthesized
caacccaccacacattattaat

SEQ ID NO: 662755 - DNA, 22 bp, Artificial Sequence
  chemically synthesized
acaaagcaagtgtatttagttt

SEQ ID NO: 662756 - DNA, 22 bp, Artificial Sequence
  chemically synthesized
aacaaagcaagtgtatttagtt

SEQ ID NO: 662757 - DNA, 22 bp, Artificial Sequence
  chemically synthesized
ttaataaactaaatacacttgc

SEQ ID NO: 662758 - DNA, 22 bp, Artificial Sequence
  chemically synthesized
ataaactaaatacacttgcttt

SEQ ID NO: 662759 - DNA, 22 bp, Artificial Sequence
  chemically synthesized
aatacacttgctttgttaagtg

SEQ ID NO: 662760 - DNA, 22 bp, Artificial Sequence
  chemically synthesized
taagagcagaaataaaaacgca

SEQ ID NO: 662761 - DNA, 22 bp, Artificial Sequence
  chemically synthesized
gctttgttaagtgcgtttttat

SEQ ID NO: 662762 - DNA, 22 bp, Artificial Sequence
  chemically synthesized
gtaagagcagaaataaaaacgc

SEQ ID NO: 662763 - DNA, 22 bp, Artificial Sequence
  chemically synthesized
ctttgttaagtgcgtttttatt

SEQ ID NO: 662764 - DNA, 22 bp, Artificial Sequence
  chemically synthesized
tgttaagtgcgtttttatttct

SEQ ID NO: 662765 - DNA, 22 bp, Artificial Sequence
  chemically synthesized
gttaagtgcgtttttatttctg

SEQ ID NO: 662766 - DNA, 22 bp, Artificial Sequence
  chemically synthesized
ttaagtgcgtttttatttctgc

SEQ ID NO: 662767 - DNA, 22 bp, Artificial Sequence
  chemically synthesized
agtgcgtttttatttctgctct

SEQ ID NO: 662768 - DNA, 22 bp, Artificial Sequence
  chemically synthesized
aaaagccaacttgtaagagcag

SEQ ID NO: 662769 - DNA, 22 bp, Artificial Sequence
  chemically synthesized
ttatttctgctcttacaagttg

SEQ ID NO: 662770 - DNA, 22 bp, Artificial Sequence
  chemically synthesized
aaattaaaaagccaacttgtaa

SEQ ID NO: 662771 - DNA, 22 bp, Artificial Sequence
  chemically synthesized
tatttctgctcttacaagttgg

SEQ ID NO: 662772 - DNA, 22 bp, Artificial Sequence
  chemically synthesized
atttctgctcttacaagttggc

SEQ ID NO: 662773 - DNA, 22 bp, Artificial Sequence
  chemically synthesized
taaaattaaaaagccaacttgt

SEQ ID NO: 662774 - DNA, 22 bp, Artificial Sequence
  chemically synthesized
tttctgctcttacaagttggct

SEQ ID NO: 662775 - DNA, 22 bp, Artificial Sequence
  chemically synthesized
ctaaaattaaaaagccaacttg

SEQ ID NO: 662776 - DNA, 22 bp, Artificial Sequence
  chemically synthesized
ctgctcttacaagttggctttt

SEQ ID NO: 662777 - DNA, 22 bp, Artificial Sequence
  chemically synthesized
tgctcttacaagttggcttttt

SEQ ID NO: 662778 - DNA, 22 bp, Artificial Sequence
  chemically synthesized
ctcttacaagttggctttttaa

SEQ ID NO: 662779 - DNA, 22 bp, Artificial Sequence
  chemically synthesized
ttacaagttggctttttaattt

SEQ ID NO: 662780 - DNA, 22 bp, Artificial Sequence
  chemically synthesized
acaagttggctttttaatttta

SEQ ID NO: 662781 - DNA, 22 bp, Artificial Sequence
  chemically synthesized
caagttggctttttaattttag

SEQ ID NO: 662782 - DNA, 22 bp, Artificial Sequence
  chemically synthesized
caggtgtgaggcttctaaaatt

SEQ ID NO: 662783 - DNA, 22 bp, Artificial Sequence
  chemically synthesized
tacaggtgtgaggcttctaaaa

SEQ ID NO: 662784 - DNA, 22 bp, Artificial Sequence
  chemically synthesized
gctttttaattttagaagcctc

SEQ ID NO: 662785 - DNA, 22 bp, Artificial Sequence
  chemically synthesized
tttaattttagaagcctcacac

SEQ ID NO: 662786 - DNA, 22 bp, Artificial Sequence
  chemically synthesized
ttaattttagaagcctcacacc

SEQ ID NO: 662787 - DNA, 22 bp, Artificial Sequence
  chemically synthesized
taattttagaagcctcacacct

SEQ ID NO: 662788 - DNA, 22 bp, Artificial Sequence
  chemically synthesized
atgacattctacaggtgtgagg

SEQ ID NO: 662789 - DNA, 22 bp, Artificial Sequence
  chemically synthesized
aattttagaagcctcacacctg

SEQ ID NO: 662790 - DNA, 22 bp, Artificial Sequence
  chemically synthesized
attttagaagcctcacacctgt

SEQ ID NO: 662791 - DNA, 22 bp, Artificial Sequence
  chemically synthesized
tgatgacattctacaggtgtga

SEQ ID NO: 662792 - DNA, 22 bp, Artificial Sequence
  chemically synthesized
tagaagcctcacacctgtagaa

SEQ ID NO: 662793 - DNA, 22 bp, Artificial Sequence
  chemically synthesized
agaagcctcacacctgtagaat

SEQ ID NO: 662794 - DNA, 22 bp, Artificial Sequence
  chemically synthesized
gaagcctcacacctgtagaatg

SEQ ID NO: 662795 - DNA, 22 bp, Artificial Sequence
  chemically synthesized
tagttctgatgacattctacag

SEQ ID NO: 662796 - DNA, 22 bp, Artificial Sequence
  chemically synthesized
gtagttctgatgacattctaca

SEQ ID NO: 662797 - DNA, 22 bp, Artificial Sequence
  chemically synthesized
tgtagttctgatgacattctac

SEQ ID NO: 662798 - DNA, 22 bp, Artificial Sequence
  chemically synthesized
cctttgtagttctgatgacatt

SEQ ID NO: 662799 - DNA, 22 bp, Artificial Sequence
  chemically synthesized
acacctgtagaatgtcatcaga

SEQ ID NO: 662800 - DNA, 22 bp, Artificial Sequence
  chemically synthesized
tccctttgtagttctgatgaca

SEQ ID NO: 662801 - DNA, 22 bp, Artificial Sequence
  chemically synthesized
ctccctttgtagttctgatgac

SEQ ID NO: 662802 - DNA, 22 bp, Artificial Sequence
  chemically synthesized
tctccctttgtagttctgatga

SEQ ID NO: 662803 - DNA, 22 bp, Artificial Sequence
  chemically synthesized
tttctccctttgtagttctgat

SEQ ID NO: 662804 - DNA, 22 bp, Artificial Sequence
  chemically synthesized
ctttctccctttgtagttctga

SEQ ID NO: 662805 - DNA, 22 bp, Artificial Sequence
  chemically synthesized
tctttctccctttgtagttctg

SEQ ID NO: 662806 - DNA, 22 bp, Artificial Sequence
  chemically synthesized
tagaatgtcatcagaactacaa

SEQ ID NO: 662807 - DNA, 22 bp, Artificial Sequence
  chemically synthesized
agcattttctttctccctttgt

SEQ ID NO: 662808 - DNA, 22 bp, Artificial Sequence
  chemically synthesized
aagcattttctttctccctttg

SEQ ID NO: 662809 - DNA, 22 bp, Artificial Sequence
  chemically synthesized
caaagggagaaagaaaatgctt

SEQ ID NO: 662810 - DNA, 22 bp, Artificial Sequence
  chemically synthesized
tgaagaaggtaatttaagcatt

SEQ ID NO: 662811 - DNA, 22 bp, Artificial Sequence
  chemically synthesized
aaagttatgaagaaggtaattt

SEQ ID NO: 662812 - DNA, 22 bp, Artificial Sequence
  chemically synthesized
cattgaaagttatgaagaaggt

SEQ ID NO: 662813 - DNA, 22 bp, Artificial Sequence
  chemically synthesized
atactccattgaaagttatgaa

SEQ ID NO: 662814 - DNA, 22 bp, Artificial Sequence
  chemically synthesized
aaattaccttcttcataacttt

SEQ ID NO: 662815 - DNA, 22 bp, Artificial Sequence
  chemically synthesized
aattaccttcttcataactttc

SEQ ID NO: 662816 - DNA, 22 bp, Artificial Sequence
  chemically synthesized
ccttcttcataactttcaatgg

SEQ ID NO: 662817 - DNA, 22 bp, Artificial Sequence
  chemically synthesized
atatagctgatactccattgaa

SEQ ID NO: 662818 - DNA, 22 bp, Artificial Sequence
  chemically synthesized
catatagctgatactccattga

SEQ ID NO: 662819 - DNA, 22 bp, Artificial Sequence
  chemically synthesized
cttcataactttcaatggagta

SEQ ID NO: 662820 - DNA, 22 bp, Artificial Sequence
  chemically synthesized
ttcataactttcaatggagtat

SEQ ID NO: 662821 - DNA, 22 bp, Artificial Sequence
  chemically synthesized
tttcatatagctgatactccat

SEQ ID NO: 662822 - DNA, 22 bp, Artificial Sequence
  chemically synthesized
cataactttcaatggagtatca

SEQ ID NO: 662823 - DNA, 22 bp, Artificial Sequence
  chemically synthesized
ataactttcaatggagtatcag

SEQ ID NO: 662824 - DNA, 22 bp, Artificial Sequence
  chemically synthesized
taaactgtttcatatagctgat

SEQ ID NO: 662825 - DNA, 22 bp, Artificial Sequence
  chemically synthesized
ataaactgtttcatatagctga

SEQ ID NO: 662826 - DNA, 22 bp, Artificial Sequence
  chemically synthesized
tcaatggagtatcagctatatg

SEQ ID NO: 662827 - DNA, 22 bp, Artificial Sequence
  chemically synthesized
caatggagtatcagctatatga

SEQ ID NO: 662828 - DNA, 22 bp, Artificial Sequence
  chemically synthesized
aatggagtatcagctatatgaa

SEQ ID NO: 662829 - DNA, 22 bp, Artificial Sequence
  chemically synthesized
gtaagaaggatttataaactgt

SEQ ID NO: 662830 - DNA, 22 bp, Artificial Sequence
  chemically synthesized
ggtaagaaggatttataaactg

SEQ ID NO: 662831 - DNA, 22 bp, Artificial Sequence
  chemically synthesized
tatgaaacagtttataaatcct

SEQ ID NO: 662832 - DNA, 22 bp, Artificial Sequence
  chemically synthesized
ataaatccttcttaccaagatt

SEQ ID NO: 662833 - DNA, 22 bp, Artificial Sequence
  chemically synthesized
taaatccttcttaccaagattt

SEQ ID NO: 662834 - DNA, 22 bp, Artificial Sequence
  chemically synthesized
cttaccaagattttatctttgt

SEQ ID NO: 662835 - DNA, 22 bp, Artificial Sequence
  chemically synthesized
ttaccaagattttatctttgtt

SEQ ID NO: 662836 - DNA, 22 bp, Artificial Sequence
  chemically synthesized
gtagaaaagcaggaacaaagat

SEQ ID NO: 662837 - DNA, 22 bp, Artificial Sequence
  chemically synthesized
accaagattttatctttgttcc

SEQ ID NO: 662838 - DNA, 22 bp, Artificial Sequence
  chemically synthesized
ggtagaaaagcaggaacaaaga

SEQ ID NO: 662839 - DNA, 22 bp, Artificial Sequence
  chemically synthesized
ccaagattttatctttgttcct

SEQ ID NO: 662840 - DNA, 22 bp, Artificial Sequence
  chemically synthesized
tatctttgttcctgcttttcta

SEQ ID NO: 662841 - DNA, 22 bp, Artificial Sequence
  chemically synthesized
atctttgttcctgcttttctac

SEQ ID NO: 662842 - DNA, 22 bp, Artificial Sequence
  chemically synthesized
tctttgttcctgcttttctacc

SEQ ID NO: 662843 - DNA, 22 bp, Artificial Sequence
  chemically synthesized
tgttcctgcttttctaccaagt

SEQ ID NO: 662844 - DNA, 22 bp, Artificial Sequence
  chemically synthesized
gttcctgcttttctaccaagtt

SEQ ID NO: 662845 - DNA, 22 bp, Artificial Sequence
  chemically synthesized
ttcctgcttttctaccaagttt

SEQ ID NO: 662846 - DNA, 22 bp, Artificial Sequence
  chemically synthesized
gaaatgaaaatgaaacttggta

SEQ ID NO: 662847 - DNA, 22 bp, Artificial Sequence
  chemically synthesized
ctgcttttctaccaagtttcat

SEQ ID NO: 662848 - DNA, 22 bp, Artificial Sequence
  chemically synthesized
cttttctaccaagtttcatttt

SEQ ID NO: 662849 - DNA, 22 bp, Artificial Sequence
  chemically synthesized
ttctaccaagtttcattttcat

SEQ ID NO: 662850 - DNA, 22 bp, Artificial Sequence
  chemically synthesized
aacacattggaaatgaaaatga

SEQ ID NO: 662851 - DNA, 22 bp, Artificial Sequence
  chemically synthesized
tctaccaagtttcattttcatt

SEQ ID NO: 662852 - DNA, 22 bp, Artificial Sequence
  chemically synthesized
ctaccaagtttcattttcattt

SEQ ID NO: 662853 - DNA, 22 bp, Artificial Sequence
  chemically synthesized
tcaacacattggaaatgaaaat

SEQ ID NO: 662854 - DNA, 22 bp, Artificial Sequence
  chemically synthesized
taccaagtttcattttcatttc

SEQ ID NO: 662855 - DNA, 22 bp, Artificial Sequence
  chemically synthesized
ccaagtttcattttcatttcca

SEQ ID NO: 662856 - DNA, 22 bp, Artificial Sequence
  chemically synthesized
cctctcaacacattggaaatga

SEQ ID NO: 662857 - DNA, 22 bp, Artificial Sequence
  chemically synthesized
ctgcctctcaacacattggaaa

SEQ ID NO: 662858 - DNA, 22 bp, Artificial Sequence
  chemically synthesized
actgcctctcaacacattggaa

SEQ ID NO: 662859 - DNA, 22 bp, Artificial Sequence
  chemically synthesized
cattttcatttccaatgtgttg

SEQ ID NO: 662860 - DNA, 22 bp, Artificial Sequence
  chemically synthesized
cttactgcctctcaacacattg

SEQ ID NO: 662861 - DNA, 22 bp, Artificial Sequence
  chemically synthesized
attttcatttccaatgtgttga

SEQ ID NO: 662862 - DNA, 22 bp, Artificial Sequence
  chemically synthesized
tcatttccaatgtgttgagagg

SEQ ID NO: 662863 - DNA, 22 bp, Artificial Sequence
  chemically synthesized
catttccaatgtgttgagaggc

SEQ ID NO: 662864 - DNA, 22 bp, Artificial Sequence
  chemically synthesized
atttccaatgtgttgagaggca

SEQ ID NO: 662865 - DNA, 22 bp, Artificial Sequence
  chemically synthesized
catgactccttactgcctctca

SEQ ID NO: 662866 - DNA, 22 bp, Artificial Sequence
  chemically synthesized
ccaatgtgttgagaggcagtaa

SEQ ID NO: 662867 - DNA, 22 bp, Artificial Sequence
  chemically synthesized
caatgtgttgagaggcagtaag

SEQ ID NO: 662868 - DNA, 22 bp, Artificial Sequence
  chemically synthesized
agtgttgcatgactccttactg

SEQ ID NO: 662869 - DNA, 22 bp, Artificial Sequence
  chemically synthesized
agaggcagtaaggagtcatgca

SEQ ID NO: 662870 - DNA, 22 bp, Artificial Sequence
  chemically synthesized
taatcagttaagtgttgcatga

SEQ ID NO: 662871 - DNA, 22 bp, Artificial Sequence
  chemically synthesized
gtaatcagttaagtgttgcatg

SEQ ID NO: 662872 - DNA, 22 bp, Artificial Sequence
  chemically synthesized
taatgtccccagtttgtaatca

SEQ ID NO: 662873 - DNA, 22 bp, Artificial Sequence
  chemically synthesized
gcctataatgtccccagtttgt

SEQ ID NO: 662874 - DNA, 22 bp, Artificial Sequence
  chemically synthesized
aactgattacaaactggggaca

SEQ ID NO: 662875 - DNA, 22 bp, Artificial Sequence
  chemically synthesized
actgattacaaactggggacat

SEQ ID NO: 662876 - DNA, 22 bp, Artificial Sequence
  chemically synthesized
attacaaactggggacattata

SEQ ID NO: 662877 - DNA, 22 bp, Artificial Sequence
  chemically synthesized
caaactggggacattataggcc

SEQ ID NO: 662878 - DNA, 22 bp, Artificial Sequence
  chemically synthesized
gggacattataggccaacggtg

SEQ ID NO: 662879 - DNA, 22 bp, Artificial Sequence
  chemically synthesized
agtggagagcatcaccgttggc

SEQ ID NO: 662880 - DNA, 22 bp, Artificial Sequence
  chemically synthesized
aagtggagagcatcaccgttgg

SEQ ID NO: 662881 - DNA, 22 bp, Artificial Sequence
  chemically synthesized
tttaagtggagagcatcaccgt

SEQ ID NO: 662882 - DNA, 22 bp, Artificial Sequence
  chemically synthesized
actatttaagtggagagcatca

SEQ ID NO: 662883 - DNA, 22 bp, Artificial Sequence
  chemically synthesized
taggccaacggtgatgctctcc

SEQ ID NO: 662884 - DNA, 22 bp, Artificial Sequence
  chemically synthesized
tagagaattcactatttaagtg

SEQ ID NO: 662885 - DNA, 22 bp, Artificial Sequence
  chemically synthesized
tatccactatagagaattcact

SEQ ID NO: 662886 - DNA, 22 bp, Artificial Sequence
  chemically synthesized
tccacttaaatagtgaattctc

SEQ ID NO: 662887 - DNA, 22 bp, Artificial Sequence
  chemically synthesized
cacttaaatagtgaattctcta

SEQ ID NO: 662888 - DNA, 22 bp, Artificial Sequence
  chemically synthesized
aaatagtgaattctctatagtg

SEQ ID NO: 662889 - DNA, 22 bp, Artificial Sequence
  chemically synthesized
aatagtgaattctctatagtgg

SEQ ID NO: 662890 - DNA, 22 bp, Artificial Sequence
  chemically synthesized
tctatagtggatacaattgggt

SEQ ID NO: 662891 - DNA, 22 bp, Artificial Sequence
  chemically synthesized
tatagtggatacaattgggtta

SEQ ID NO: 662892 - DNA, 22 bp, Artificial Sequence
  chemically synthesized
cagaaagccaaataacccaatt

SEQ ID NO: 662893 - DNA, 22 bp, Artificial Sequence
  chemically synthesized
tagtggatacaattgggttatt

SEQ ID NO: 662894 - DNA, 22 bp, Artificial Sequence
  chemically synthesized
cgtattgcagaaagccaaataa

SEQ ID NO: 662895 - DNA, 22 bp, Artificial Sequence
  chemically synthesized
ccgtattgcagaaagccaaata

SEQ ID NO: 662896 - DNA, 22 bp, Artificial Sequence
  chemically synthesized
ggttatttggctttctgcaata

SEQ ID NO: 662897 - DNA, 22 bp, Artificial Sequence
  chemically synthesized
tcaatgtttccgtattgcagaa

SEQ ID NO: 662898 - DNA, 22 bp, Artificial Sequence
  chemically synthesized
cctatcaatgtttccgtattgc

SEQ ID NO: 662899 - DNA, 22 bp, Artificial Sequence
  chemically synthesized
tttggctttctgcaatacggaa

SEQ ID NO: 662900 - DNA, 22 bp, Artificial Sequence
  chemically synthesized
ccctatcaatgtttccgtattg

SEQ ID NO: 662901 - DNA, 22 bp, Artificial Sequence
  chemically synthesized
ggctttctgcaatacggaaaca

SEQ ID NO: 662902 - DNA, 22 bp, Artificial Sequence
  chemically synthesized
gctttctgcaatacggaaacat

SEQ ID NO: 662903 - DNA, 22 bp, Artificial Sequence
  chemically synthesized
acttccctatcaatgtttccgt

SEQ ID NO: 662904 - DNA, 22 bp, Artificial Sequence
  chemically synthesized
cacttccctatcaatgtttccg

SEQ ID NO: 662905 - DNA, 22 bp, Artificial Sequence
  chemically synthesized
tcacttccctatcaatgtttcc

SEQ ID NO: 662906 - DNA, 22 bp, Artificial Sequence
  chemically synthesized
ttcacttccctatcaatgtttc

SEQ ID NO: 662907 - DNA, 22 bp, Artificial Sequence
  chemically synthesized
tctgcaatacggaaacattgat

SEQ ID NO: 662908 - DNA, 22 bp, Artificial Sequence
  chemically synthesized
tttcacttccctatcaatgttt

SEQ ID NO: 662909 - DNA, 22 bp, Artificial Sequence
  chemically synthesized
ctgcaatacggaaacattgata

SEQ ID NO: 662910 - DNA, 22 bp, Artificial Sequence
  chemically synthesized
ttttcacttccctatcaatgtt

SEQ ID NO: 662911 - DNA, 22 bp, Artificial Sequence
  chemically synthesized
tgcaatacggaaacattgatag

SEQ ID NO: 662912 - DNA, 22 bp, Artificial Sequence
  chemically synthesized
tttttcacttccctatcaatgt

SEQ ID NO: 662913 - DNA, 22 bp, Artificial Sequence
  chemically synthesized
ttttttcacttccctatcaatg

SEQ ID NO: 662914 - DNA, 22 bp, Artificial Sequence
  chemically synthesized
caatacggaaacattgataggg

SEQ ID NO: 662915 - DNA, 22 bp, Artificial Sequence
  chemically synthesized
tttttttttcacttccctatca

SEQ ID NO: 662916 - DNA, 22 bp, Artificial Sequence
  chemically synthesized
atttttttttcacttccctatc

SEQ ID NO: 662917 - DNA, 22 bp, Artificial Sequence
  chemically synthesized
atcttatttttttttcacttcc

SEQ ID NO: 662918 - DNA, 22 bp, Artificial Sequence
  chemically synthesized
gatcttatttttttttcacttc

SEQ ID NO: 662919 - DNA, 22 bp, Artificial Sequence
  chemically synthesized
atagggaagtgaaaaaaaaata

SEQ ID NO: 662920 - DNA, 22 bp, Artificial Sequence
  chemically synthesized
agcacttgatcttatttttttt

SEQ ID NO: 662921 - DNA, 22 bp, Artificial Sequence
  chemically synthesized
ttaagcacttgatcttattttt

SEQ ID NO: 662922 - DNA, 22 bp, Artificial Sequence
  chemically synthesized
tattaagcacttgatcttattt

SEQ ID NO: 662923 - DNA, 22 bp, Artificial Sequence
  chemically synthesized
cacctctattaagcacttgatc

SEQ ID NO: 662924 - DNA, 22 bp, Artificial Sequence
  chemically synthesized
ccacctctattaagcacttgat

SEQ ID NO: 662925 - DNA, 22 bp, Artificial Sequence
  chemically synthesized
gaaatatgcacttccacctcta

SEQ ID NO: 662926 - DNA, 22 bp, Artificial Sequence
  chemically synthesized
ggaaatatgcacttccacctct

SEQ ID NO: 662927 - DNA, 22 bp, Artificial Sequence
  chemically synthesized
aatagaggtggaagtgcatatt

SEQ ID NO: 662928 - DNA, 22 bp, Artificial Sequence
  chemically synthesized
atagaggtggaagtgcatattt

SEQ ID NO: 662929 - DNA, 22 bp, Artificial Sequence
  chemically synthesized
cagatgccttggaaatatgcac

SEQ ID NO: 662930 - DNA, 22 bp, Artificial Sequence
  chemically synthesized
aattacagatgccttggaaata

SEQ ID NO: 662931 - DNA, 22 bp, Artificial Sequence
  chemically synthesized
gaattacagatgccttggaaat

SEQ ID NO: 662932 - DNA, 22 bp, Artificial Sequence
  chemically synthesized
ccaaggcatctgtaattcaaac

SEQ ID NO: 662933 - DNA, 22 bp, Artificial Sequence
  chemically synthesized
caaggcatctgtaattcaaact

SEQ ID NO: 662934 - DNA, 22 bp, Artificial Sequence
  chemically synthesized
gtgccagtgaagagtttgaatt

SEQ ID NO: 662935 - DNA, 22 bp, Artificial Sequence
  chemically synthesized
ctggtgccagtgaagagtttga

SEQ ID NO: 662936 - DNA, 22 bp, Artificial Sequence
  chemically synthesized
cctggtgccagtgaagagtttg

SEQ ID NO: 662937 - DNA, 22 bp, Artificial Sequence
  chemically synthesized
taattcaaactcttcactggca

SEQ ID NO: 662938 - DNA, 22 bp, Artificial Sequence
  chemically synthesized
agtgatttcctggtgccagtga

SEQ ID NO: 662939 - DNA, 22 bp, Artificial Sequence
  chemically synthesized
tctcagtgatttcctggtgcca

SEQ ID NO: 662940 - DNA, 22 bp, Artificial Sequence
  chemically synthesized
aaactcttcactggcaccagga

SEQ ID NO: 662941 - DNA, 22 bp, Artificial Sequence
  chemically synthesized
ttcactggcaccaggaaatcac

SEQ ID NO: 662942 - DNA, 22 bp, Artificial Sequence
  chemically synthesized
cactggcaccaggaaatcactg

SEQ ID NO: 662943 - DNA, 22 bp, Artificial Sequence
  chemically synthesized
atgatgttatctcagtgatttc

SEQ ID NO: 662944 - DNA, 22 bp, Artificial Sequence
  chemically synthesized
actggcaccaggaaatcactga

SEQ ID NO: 662945 - DNA, 22 bp, Artificial Sequence
  chemically synthesized
gcaccaggaaatcactgagata

SEQ ID NO: 662946 - DNA, 22 bp, Artificial Sequence
  chemically synthesized
aggaaaattaatgatgttatct

SEQ ID NO: 662947 - DNA, 22 bp, Artificial Sequence
  chemically synthesized
aaggaaaattaatgatgttatc

SEQ ID NO: 662948 - DNA, 22 bp, Artificial Sequence
  chemically synthesized
taaggaaaattaatgatgttat

SEQ ID NO: 662949 - DNA, 22 bp, Artificial Sequence
  chemically synthesized
actttaaggaaaattaatgatg

SEQ ID NO: 662950 - DNA, 22 bp, Artificial Sequence
  chemically synthesized
taactttaaggaaaattaatga

SEQ ID NO: 662951 - DNA, 22 bp, Artificial Sequence
  chemically synthesized
agataacatcattaattttcct

SEQ ID NO: 662952 - DNA, 22 bp, Artificial Sequence
  chemically synthesized
ccaactctaactttaaggaaaa

SEQ ID NO: 662953 - DNA, 22 bp, Artificial Sequence
  chemically synthesized
taccaactctaactttaaggaa

SEQ ID NO: 662954 - DNA, 22 bp, Artificial Sequence
  chemically synthesized
ctaccaactctaactttaagga

SEQ ID NO: 662955 - DNA, 22 bp, Artificial Sequence
  chemically synthesized
attttccttaaagttagagttg

SEQ ID NO: 662956 - DNA, 22 bp, Artificial Sequence
  chemically synthesized
tccttaaagttagagttggtag

SEQ ID NO: 662957 - DNA, 22 bp, Artificial Sequence
  chemically synthesized
ccttaaagttagagttggtaga

SEQ ID NO: 662958 - DNA, 22 bp, Artificial Sequence
  chemically synthesized
ccaaaggccacttctaccaact

SEQ ID NO: 662959 - DNA, 22 bp, Artificial Sequence
  chemically synthesized
cttaaagttagagttggtagaa

SEQ ID NO: 662960 - DNA, 22 bp, Artificial Sequence
  chemically synthesized
aaagttagagttggtagaagtg

SEQ ID NO: 662961 - DNA, 22 bp, Artificial Sequence
  chemically synthesized
cctaccaaaggccacttctacc

SEQ ID NO: 662962 - DNA, 22 bp, Artificial Sequence
  chemically synthesized
aagttagagttggtagaagtgg

SEQ ID NO: 662963 - DNA, 22 bp, Artificial Sequence
  chemically synthesized
ccctaccaaaggccacttctac

SEQ ID NO: 662964 - DNA, 22 bp, Artificial Sequence
  chemically synthesized
tccctaccaaaggccacttcta

SEQ ID NO: 662965 - DNA, 22 bp, Artificial Sequence
  chemically synthesized
gctttccctaccaaaggccact

SEQ ID NO: 662966 - DNA, 22 bp, Artificial Sequence
  chemically synthesized
gagttggtagaagtggcctttg

SEQ ID NO: 662967 - DNA, 22 bp, Artificial Sequence
  chemically synthesized
gctagctttccctaccaaaggc

SEQ ID NO: 662968 - DNA, 22 bp, Artificial Sequence
  chemically synthesized
gtagaagtggcctttggtaggg

SEQ ID NO: 662969 - DNA, 22 bp, Artificial Sequence
  chemically synthesized
ccctggctagctttccctacca

SEQ ID NO: 662970 - DNA, 22 bp, Artificial Sequence
  chemically synthesized
gccctggctagctttccctacc

SEQ ID NO: 662971 - DNA, 22 bp, Artificial Sequence
  chemically synthesized
tggtagggaaagctagccaggg

SEQ ID NO: 662972 - DNA, 22 bp, Artificial Sequence
  chemically synthesized
ggtagggaaagctagccagggc

SEQ ID NO: 662973 - DNA, 22 bp, Artificial Sequence
  chemically synthesized
gtagggaaagctagccagggca

SEQ ID NO: 662974 - DNA, 22 bp, Artificial Sequence
  chemically synthesized
cggtacaggcaaataaaacttg

SEQ ID NO: 662975 - DNA, 22 bp, Artificial Sequence
  chemically synthesized
tctgcggtacaggcaaataaaa

SEQ ID NO: 662976 - DNA, 22 bp, Artificial Sequence
  chemically synthesized
gccagggcaagttttatttgcc

SEQ ID NO: 662977 - DNA, 22 bp, Artificial Sequence
  chemically synthesized
ttgtctgcggtacaggcaaata

SEQ ID NO: 662978 - DNA, 22 bp, Artificial Sequence
  chemically synthesized
tatttgcctgtaccgcagacaa

SEQ ID NO: 662979 - DNA, 22 bp, Artificial Sequence
  chemically synthesized
atttgcctgtaccgcagacaat

SEQ ID NO: 662980 - DNA, 22 bp, Artificial Sequence
  chemically synthesized
tttgcctgtaccgcagacaata

SEQ ID NO: 662981 - DNA, 22 bp, Artificial Sequence
  chemically synthesized
gcctgtaccgcagacaatagct

SEQ ID NO: 662982 - DNA, 22 bp, Artificial Sequence
  chemically synthesized
cctgtaccgcagacaatagctc

SEQ ID NO: 662983 - DNA, 22 bp, Artificial Sequence
  chemically synthesized
caaagccatgataaagagctat

SEQ ID NO: 662984 - DNA, 22 bp, Artificial Sequence
  chemically synthesized
taccgcagacaatagctcttta

SEQ ID NO: 662985 - DNA, 22 bp, Artificial Sequence
  chemically synthesized
agcctgcaaagccatgataaag

SEQ ID NO: 662986 - DNA, 22 bp, Artificial Sequence
  chemically synthesized
taagcctgcaaagccatgataa

SEQ ID NO: 662987 - DNA, 22 bp, Artificial Sequence
  chemically synthesized
ctaagcctgcaaagccatgata

SEQ ID NO: 662988 - DNA, 22 bp, Artificial Sequence
  chemically synthesized
tcatttctaagcctgcaaagcc

SEQ ID NO: 662989 - DNA, 22 bp, Artificial Sequence
  chemically synthesized
gtcatttctaagcctgcaaagc

SEQ ID NO: 662990 - DNA, 22 bp, Artificial Sequence
  chemically synthesized
tgtcatttctaagcctgcaaag

SEQ ID NO: 662991 - DNA, 22 bp, Artificial Sequence
  chemically synthesized
ttgtcatttctaagcctgcaaa

SEQ ID NO: 662992 - DNA, 22 bp, Artificial Sequence
  chemically synthesized
tttatcatggctttgcaggctt

SEQ ID NO: 662993 - DNA, 22 bp, Artificial Sequence
  chemically synthesized
tatcatggctttgcaggcttag

SEQ ID NO: 662994 - DNA, 22 bp, Artificial Sequence
  chemically synthesized
atcatggctttgcaggcttaga

SEQ ID NO: 662995 - DNA, 22 bp, Artificial Sequence
  chemically synthesized
tcatggctttgcaggcttagaa

SEQ ID NO: 662996 - DNA, 22 bp, Artificial Sequence
  chemically synthesized
caggcttttgtcatttctaagc

SEQ ID NO: 662997 - DNA, 22 bp, Artificial Sequence
  chemically synthesized
ccaggcttttgtcatttctaag

SEQ ID NO: 662998 - DNA, 22 bp, Artificial Sequence
  chemically synthesized
gcttccaggcttttgtcatttc

SEQ ID NO: 662999 - DNA, 22 bp, Artificial Sequence
  chemically synthesized
agcttccaggcttttgtcattt

SEQ ID NO: 663000 - DNA, 22 bp, Artificial Sequence
  chemically synthesized
tgcaggcttagaaatgacaaaa

SEQ ID NO: 663001 - DNA, 22 bp, Artificial Sequence
  chemically synthesized
gcaggcttagaaatgacaaaag

SEQ ID NO: 663002 - DNA, 22 bp, Artificial Sequence
  chemically synthesized
caggcttagaaatgacaaaagc

SEQ ID NO: 663003 - DNA, 22 bp, Artificial Sequence
  chemically synthesized
gatttagcttccaggcttttgt

SEQ ID NO: 663004 - DNA, 22 bp, Artificial Sequence
  chemically synthesized
agatttagcttccaggcttttg

SEQ ID NO: 663005 - DNA, 22 bp, Artificial Sequence
  chemically synthesized
cttagatttagcttccaggctt

SEQ ID NO: 663006 - DNA, 22 bp, Artificial Sequence
  chemically synthesized
agaaatgacaaaagcctggaag

SEQ ID NO: 663007 - DNA, 22 bp, Artificial Sequence
  chemically synthesized
gcttagatttagcttccaggct

SEQ ID NO: 663008 - DNA, 22 bp, Artificial Sequence
  chemically synthesized
gaaatgacaaaagcctggaagc

SEQ ID NO: 663009 - DNA, 22 bp, Artificial Sequence
  chemically synthesized
tatttgcttagatttagcttcc

SEQ ID NO: 663010 - DNA, 22 bp, Artificial Sequence
  chemically synthesized
atatttgcttagatttagcttc

SEQ ID NO: 663011 - DNA, 22 bp, Artificial Sequence
  chemically synthesized
tatatttgcttagatttagctt

SEQ ID NO: 663012 - DNA, 22 bp, Artificial Sequence
  chemically synthesized
attttatatttgcttagattta

SEQ ID NO: 663013 - DNA, 22 bp, Artificial Sequence
  chemically synthesized
ctaattttatatttgcttagat

SEQ ID NO: 663014 - DNA, 22 bp, Artificial Sequence
  chemically synthesized
tcctaattttatatttgcttag

SEQ ID NO: 663015 - DNA, 22 bp, Artificial Sequence
  chemically synthesized
ctcctaattttatatttgctta

SEQ ID NO: 663016 - DNA, 22 bp, Artificial Sequence
  chemically synthesized
gaagctaaatctaagcaaatat

SEQ ID NO: 663017 - DNA, 22 bp, Artificial Sequence
  chemically synthesized
tctcctaattttatatttgctt

SEQ ID NO: 663018 - DNA, 22 bp, Artificial Sequence
  chemically synthesized
aatctaagcaaatataaaatta

SEQ ID NO: 663019 - DNA, 22 bp, Artificial Sequence
  chemically synthesized
agaattttctcctaattttata

SEQ ID NO: 663020 - DNA, 22 bp, Artificial Sequence
  chemically synthesized
aagaattttctcctaattttat

SEQ ID NO: 663021 - DNA, 22 bp, Artificial Sequence
  chemically synthesized
agcaaatataaaattaggagaa

SEQ ID NO: 663022 - DNA, 22 bp, Artificial Sequence
  chemically synthesized
aatatatgatttaagaattttc

SEQ ID NO: 663023 - DNA, 22 bp, Artificial Sequence
  chemically synthesized
caatatatgatttaagaatttt

SEQ ID NO: 663024 - DNA, 22 bp, Artificial Sequence
  chemically synthesized
tcaatatatgatttaagaattt

SEQ ID NO: 663025 - DNA, 22 bp, Artificial Sequence
  chemically synthesized
ctttcaatatatgatttaagaa

SEQ ID NO: 663026 - DNA, 22 bp, Artificial Sequence
  chemically synthesized
actttcaatatatgatttaaga

SEQ ID NO: 663027 - DNA, 22 bp, Artificial Sequence
  chemically synthesized
ggagaaaattcttaaatcatat

SEQ ID NO: 663028 - DNA, 22 bp, Artificial Sequence
  chemically synthesized
cttactttcaatatatgattta

SEQ ID NO: 663029 - DNA, 22 bp, Artificial Sequence
  chemically synthesized
ttaaatcatatattgaaagtaa

SEQ ID NO: 663030 - DNA, 22 bp, Artificial Sequence
  chemically synthesized
aaatcatatattgaaagtaagt

SEQ ID NO: 663031 - DNA, 22 bp, Artificial Sequence
  chemically synthesized
aatcatatattgaaagtaagta

SEQ ID NO: 663032 - DNA, 22 bp, Artificial Sequence
  chemically synthesized
aacatatgtgtggtcacattac

SEQ ID NO: 663033 - DNA, 22 bp, Artificial Sequence
  chemically synthesized
ttgaacatatgtgtggtcacat

SEQ ID NO: 663034 - DNA, 22 bp, Artificial Sequence
  chemically synthesized
attgaacatatgtgtggtcaca

SEQ ID NO: 663035 - DNA, 22 bp, Artificial Sequence
  chemically synthesized
aaagtaagtaatgtgaccacac

SEQ ID NO: 663036 - DNA, 22 bp, Artificial Sequence
  chemically synthesized
tattgaacatatgtgtggtcac

SEQ ID NO: 663037 - DNA, 22 bp, Artificial Sequence
  chemically synthesized
ttattgaacatatgtgtggtca

SEQ ID NO: 663038 - DNA, 22 bp, Artificial Sequence
  chemically synthesized
accccatccttttattgaacat

SEQ ID NO: 663039 - DNA, 22 bp, Artificial Sequence
  chemically synthesized
tagaatgaagagttcaccccat

SEQ ID NO: 663040 - DNA, 22 bp, Artificial Sequence
  chemically synthesized
aataaaaggatggggtgaactc

SEQ ID NO: 663041 - DNA, 22 bp, Artificial Sequence
  chemically synthesized
ttcattctatagttttactata

SEQ ID NO: 663042 - DNA, 22 bp, Artificial Sequence
  chemically synthesized
ggagggtgccatatatagtaaa

SEQ ID NO: 663043 - DNA, 22 bp, Artificial Sequence
  chemically synthesized
cattctatagttttactatata

SEQ ID NO: 663044 - DNA, 22 bp, Artificial Sequence
  chemically synthesized
attctatagttttactatatat

SEQ ID NO: 663045 - DNA, 22 bp, Artificial Sequence
  chemically synthesized
tatagttttactatatatggca

SEQ ID NO: 663046 - DNA, 22 bp, Artificial Sequence
  chemically synthesized
atgctaggagggtgccatatat

SEQ ID NO: 663047 - DNA, 22 bp, Artificial Sequence
  chemically synthesized
tagttttactatatatggcacc

SEQ ID NO: 663048 - DNA, 22 bp, Artificial Sequence
  chemically synthesized
attaatgctaggagggtgccat

SEQ ID NO: 663049 - DNA, 22 bp, Artificial Sequence
  chemically synthesized
tcattaatgctaggagggtgcc

SEQ ID NO: 663050 - DNA, 22 bp, Artificial Sequence
  chemically synthesized
tactatatatggcaccctccta

SEQ ID NO: 663051 - DNA, 22 bp, Artificial Sequence
  chemically synthesized
actatatatggcaccctcctag

SEQ ID NO: 663052 - DNA, 22 bp, Artificial Sequence
  chemically synthesized
ctatatatggcaccctcctagc

SEQ ID NO: 663053 - DNA, 22 bp, Artificial Sequence
  chemically synthesized
aattctcattaatgctaggagg

SEQ ID NO: 663054 - DNA, 22 bp, Artificial Sequence
  chemically synthesized
tatatggcaccctcctagcatt

SEQ ID NO: 663055 - DNA, 22 bp, Artificial Sequence
  chemically synthesized
agtattgaattctcattaatgc

SEQ ID NO: 663056 - DNA, 22 bp, Artificial Sequence
  chemically synthesized
aattaagtattgaattctcatt

SEQ ID NO: 663057 - DNA, 22 bp, Artificial Sequence
  chemically synthesized
ctagcattaatgagaattcaat

SEQ ID NO: 663058 - DNA, 22 bp, Artificial Sequence
  chemically synthesized
gcattaatgagaattcaatact

SEQ ID NO: 663059 - DNA, 22 bp, Artificial Sequence
  chemically synthesized
atgagaattcaatacttaattt

SEQ ID NO: 663060 - DNA, 22 bp, Artificial Sequence
  chemically synthesized
aggtgtatgtatctaaattaag

SEQ ID NO: 663061 - DNA, 22 bp, Artificial Sequence
  chemically synthesized
aatacttaatttagatacatac

SEQ ID NO: 663062 - DNA, 22 bp, Artificial Sequence
  chemically synthesized
aatttagatacatacaccttaa

SEQ ID NO: 663063 - DNA, 22 bp, Artificial Sequence
  chemically synthesized
atttagatacatacaccttaat

SEQ ID NO: 663064 - DNA, 22 bp, Artificial Sequence
  chemically synthesized
aagtatgccaaaattaaggtgt

SEQ ID NO: 663065 - DNA, 22 bp, Artificial Sequence
  chemically synthesized
agatacatacaccttaattttg

SEQ ID NO: 663066 - DNA, 22 bp, Artificial Sequence
  chemically synthesized
gatacatacaccttaattttgg

SEQ ID NO: 663067 - DNA, 22 bp, Artificial Sequence
  chemically synthesized
atatgtgaaaaagattcaagta

SEQ ID NO: 663068 - DNA, 22 bp, Artificial Sequence
  chemically synthesized
aattttggcatacttgaatctt

SEQ ID NO: 663069 - DNA, 22 bp, Artificial Sequence
  chemically synthesized
taatatgtgaaaaagattcaag

SEQ ID NO: 663070 - DNA, 22 bp, Artificial Sequence
  chemically synthesized
attttggcatacttgaatcttt

SEQ ID NO: 663071 - DNA, 22 bp, Artificial Sequence
  chemically synthesized
ctaatatgtgaaaaagattcaa

SEQ ID NO: 663072 - DNA, 22 bp, Artificial Sequence
  chemically synthesized
tctaatatgtgaaaaagattca

SEQ ID NO: 663073 - DNA, 22 bp, Artificial Sequence
  chemically synthesized
ttctaatatgtgaaaaagattc

SEQ ID NO: 663074 - DNA, 22 bp, Artificial Sequence
  chemically synthesized
tggcatacttgaatctttttca

SEQ ID NO: 663075 - DNA, 22 bp, Artificial Sequence
  chemically synthesized
ggcatacttgaatctttttcac

SEQ ID NO: 663076 - DNA, 22 bp, Artificial Sequence
  chemically synthesized
gcatacttgaatctttttcaca

SEQ ID NO: 663077 - DNA, 22 bp, Artificial Sequence
  chemically synthesized
agcatggcttttctaatatgtg

SEQ ID NO: 663078 - DNA, 22 bp, Artificial Sequence
  chemically synthesized
gaatctttttcacatattagaa

SEQ ID NO: 663079 - DNA, 22 bp, Artificial Sequence
  chemically synthesized
tgagcatggcttttctaatatg

SEQ ID NO: 663080 - DNA, 22 bp, Artificial Sequence
  chemically synthesized
aatctttttcacatattagaaa

SEQ ID NO: 663081 - DNA, 22 bp, Artificial Sequence
  chemically synthesized
ctgagcatggcttttctaatat

SEQ ID NO: 663082 - DNA, 22 bp, Artificial Sequence
  chemically synthesized
tctgagcatggcttttctaata

SEQ ID NO: 663083 - DNA, 22 bp, Artificial Sequence
  chemically synthesized
ctttctgagcatggcttttcta

SEQ ID NO: 663084 - DNA, 22 bp, Artificial Sequence
  chemically synthesized
cctttctgagcatggcttttct

SEQ ID NO: 663085 - DNA, 22 bp, Artificial Sequence
  chemically synthesized
tttcacatattagaaaagccat

SEQ ID NO: 663086 - DNA, 22 bp, Artificial Sequence
  chemically synthesized
ttcacatattagaaaagccatg

SEQ ID NO: 663087 - DNA, 22 bp, Artificial Sequence
  chemically synthesized
tcacatattagaaaagccatgc

SEQ ID NO: 663088 - DNA, 22 bp, Artificial Sequence
  chemically synthesized
cacatattagaaaagccatgct

SEQ ID NO: 663089 - DNA, 22 bp, Artificial Sequence
  chemically synthesized
acatattagaaaagccatgctc

SEQ ID NO: 663090 - DNA, 22 bp, Artificial Sequence
  chemically synthesized
catttcctttctgagcatggct

SEQ ID NO: 663091 - DNA, 22 bp, Artificial Sequence
  chemically synthesized
tgcatttcctttctgagcatgg

SEQ ID NO: 663092 - DNA, 22 bp, Artificial Sequence
  chemically synthesized
tctgcatttcctttctgagcat

SEQ ID NO: 663093 - DNA, 22 bp, Artificial Sequence
  chemically synthesized
gaaaagccatgctcagaaagga

SEQ ID NO: 663094 - DNA, 22 bp, Artificial Sequence
  chemically synthesized
aaattctctgcatttcctttct

SEQ ID NO: 663095 - DNA, 22 bp, Artificial Sequence
  chemically synthesized
gaaattctctgcatttcctttc

SEQ ID NO: 663096 - DNA, 22 bp, Artificial Sequence
  chemically synthesized
aatcaatttgaaattctctgca

SEQ ID NO: 663097 - DNA, 22 bp, Artificial Sequence
  chemically synthesized
aaatcaatttgaaattctctgc

SEQ ID NO: 663098 - DNA, 22 bp, Artificial Sequence
  chemically synthesized
agaaaggaaatgcagagaattt

SEQ ID NO: 663099 - DNA, 22 bp, Artificial Sequence
  chemically synthesized
taaatcaatttgaaattctctg

SEQ ID NO: 663100 - DNA, 22 bp, Artificial Sequence
  chemically synthesized
ttaaatcaatttgaaattctct

SEQ ID NO: 663101 - DNA, 22 bp, Artificial Sequence
  chemically synthesized
acttttaaatcaatttgaaatt

SEQ ID NO: 663102 - DNA, 22 bp, Artificial Sequence
  chemically synthesized
cacttttaaatcaatttgaaat

SEQ ID NO: 663103 - DNA, 22 bp, Artificial Sequence
  chemically synthesized
tcacttttaaatcaatttgaaa

SEQ ID NO: 663104 - DNA, 22 bp, Artificial Sequence
  chemically synthesized
aattttcacttttaaatcaatt

SEQ ID NO: 663105 - DNA, 22 bp, Artificial Sequence
  chemically synthesized
aaattttcacttttaaatcaat

SEQ ID NO: 663106 - DNA, 22 bp, Artificial Sequence
  chemically synthesized
taaattttcacttttaaatcaa

SEQ ID NO: 663107 - DNA, 22 bp, Artificial Sequence
  chemically synthesized
tttaaattttcacttttaaatc

SEQ ID NO: 663108 - DNA, 22 bp, Artificial Sequence
  chemically synthesized
ctttaaattttcacttttaaat

SEQ ID NO: 663109 - DNA, 22 bp, Artificial Sequence
  chemically synthesized
caaattgatttaaaagtgaaaa

SEQ ID NO: 663110 - DNA, 22 bp, Artificial Sequence
  chemically synthesized
aaattgatttaaaagtgaaaat

SEQ ID NO: 663111 - DNA, 22 bp, Artificial Sequence
  chemically synthesized
atttaaaagtgaaaatttaaag

SEQ ID NO: 663112 - DNA, 22 bp, Artificial Sequence
  chemically synthesized
aaaagtgaaaatttaaagaaat

SEQ ID NO: 663113 - DNA, 22 bp, Artificial Sequence
  chemically synthesized
aaagtgaaaatttaaagaaatt

SEQ ID NO: 663114 - DNA, 22 bp, Artificial Sequence
  chemically synthesized
cgaatgtagaataatttcttta

SEQ ID NO: 663115 - DNA, 22 bp, Artificial Sequence
  chemically synthesized
aaagaaattattctacattcgg

SEQ ID NO: 663116 - DNA, 22 bp, Artificial Sequence
  chemically synthesized
aagaaattattctacattcgga

SEQ ID NO: 663117 - DNA, 22 bp, Artificial Sequence
  chemically synthesized
taataaaggtaagctccgaatg

SEQ ID NO: 663118 - DNA, 22 bp, Artificial Sequence
  chemically synthesized
gtaataaaggtaagctccgaat

SEQ ID NO: 663119 - DNA, 22 bp, Artificial Sequence
  chemically synthesized
ttctacattcggagcttacctt

SEQ ID NO: 663120 - DNA, 22 bp, Artificial Sequence
  chemically synthesized
tacattcggagcttacctttat

SEQ ID NO: 663121 - DNA, 22 bp, Artificial Sequence
  chemically synthesized
cattcggagcttacctttatta

SEQ ID NO: 663122 - DNA, 22 bp, Artificial Sequence
  chemically synthesized
aggtgataaccttgtaataaag

SEQ ID NO: 663123 - DNA, 22 bp, Artificial Sequence
  chemically synthesized
gaggtgataaccttgtaataaa

SEQ ID NO: 663124 - DNA, 22 bp, Artificial Sequence
  chemically synthesized
ggagcttacctttattacaagg

SEQ ID NO: 663125 - DNA, 22 bp, Artificial Sequence
  chemically synthesized
tccatttgaggtgataaccttg

SEQ ID NO: 663126 - DNA, 22 bp, Artificial Sequence
  chemically synthesized
gtccatttgaggtgataacctt

SEQ ID NO: 663127 - DNA, 22 bp, Artificial Sequence
  chemically synthesized
acctttattacaaggttatcac

SEQ ID NO: 663128 - DNA, 22 bp, Artificial Sequence
  chemically synthesized
tgtccatttgaggtgataacct

SEQ ID NO: 663129 - DNA, 22 bp, Artificial Sequence
  chemically synthesized
cctttattacaaggttatcacc

SEQ ID NO: 663130 - DNA, 22 bp, Artificial Sequence
  chemically synthesized
tattacaaggttatcacctcaa

SEQ ID NO: 663131 - DNA, 22 bp, Artificial Sequence
  chemically synthesized
attacaaggttatcacctcaaa

SEQ ID NO: 663132 - DNA, 22 bp, Artificial Sequence
  chemically synthesized
ttacaaggttatcacctcaaat

SEQ ID NO: 663133 - DNA, 22 bp, Artificial Sequence
  chemically synthesized
caaggttatcacctcaaatgga

SEQ ID NO: 663134 - DNA, 22 bp, Artificial Sequence
  chemically synthesized
ataatatacaaaattttgtcca

SEQ ID NO: 663135 - DNA, 22 bp, Artificial Sequence
  chemically synthesized
cataatatacaaaattttgtcc

SEQ ID NO: 663136 - DNA, 22 bp, Artificial Sequence
  chemically synthesized
tcacctcaaatggacaaaattt

SEQ ID NO: 663137 - DNA, 22 bp, Artificial Sequence
  chemically synthesized
aaatggacaaaattttgtatat

SEQ ID NO: 663138 - DNA, 22 bp, Artificial Sequence
  chemically synthesized
ggaaaatgggggaatttcataa

SEQ ID NO: 663139 - DNA, 22 bp, Artificial Sequence
  chemically synthesized
gggaaaatgggggaatttcata

SEQ ID NO: 663140 - DNA, 22 bp, Artificial Sequence
  chemically synthesized
tgggaaaatgggggaatttcat

SEQ ID NO: 663141 - DNA, 22 bp, Artificial Sequence
  chemically synthesized
tgtatattatgaaattccccca

SEQ ID NO: 663142 - DNA, 22 bp, Artificial Sequence
  chemically synthesized
gtatattatgaaattcccccat

SEQ ID NO: 663143 - DNA, 22 bp, Artificial Sequence
  chemically synthesized
tatattatgaaattcccccatt

SEQ ID NO: 663144 - DNA, 22 bp, Artificial Sequence
  chemically synthesized
caataaactttgggaaaatggg

SEQ ID NO: 663145 - DNA, 22 bp, Artificial Sequence
  chemically synthesized
ccaataaactttgggaaaatgg

SEQ ID NO: 663146 - DNA, 22 bp, Artificial Sequence
  chemically synthesized
tgaaattcccccattttcccaa

SEQ ID NO: 663147 - DNA, 22 bp, Artificial Sequence
  chemically synthesized
taatttccaataaactttggga

SEQ ID NO: 663148 - DNA, 22 bp, Artificial Sequence
  chemically synthesized
ataatttccaataaactttggg

SEQ ID NO: 663149 - DNA, 22 bp, Artificial Sequence
  chemically synthesized
ccccattttcccaaagtttatt

SEQ ID NO: 663150 - DNA, 22 bp, Artificial Sequence
  chemically synthesized
aacttataatttccaataaact

SEQ ID NO: 663151 - DNA, 22 bp, Artificial Sequence
  chemically synthesized
caacttataatttccaataaac

SEQ ID NO: 663152 - DNA, 22 bp, Artificial Sequence
  chemically synthesized
tcccaaagtttattggaaatta

SEQ ID NO: 663153 - DNA, 22 bp, Artificial Sequence
  chemically synthesized
cccaaagtttattggaaattat

SEQ ID NO: 663154 - DNA, 22 bp, Artificial Sequence
  chemically synthesized
tcatttcaacttataatttcca

SEQ ID NO: 663155 - DNA, 22 bp, Artificial Sequence
  chemically synthesized
ccaaagtttattggaaattata

SEQ ID NO: 663156 - DNA, 22 bp, Artificial Sequence
  chemically synthesized
tctgtcatttcaacttataatt

SEQ ID NO: 663157 - DNA, 22 bp, Artificial Sequence
  chemically synthesized
ttgtctgtcatttcaacttata

SEQ ID NO: 663158 - DNA, 22 bp, Artificial Sequence
  chemically synthesized
attgtctgtcatttcaacttat

SEQ ID NO: 663159 - DNA, 22 bp, Artificial Sequence
  chemically synthesized
tattgtctgtcatttcaactta

SEQ ID NO: 663160 - DNA, 22 bp, Artificial Sequence
  chemically synthesized
attggaaattataagttgaaat

SEQ ID NO: 663161 - DNA, 22 bp, Artificial Sequence
  chemically synthesized
ttggaaattataagttgaaatg

SEQ ID NO: 663162 - DNA, 22 bp, Artificial Sequence
  chemically synthesized
gaaattataagttgaaatgaca

SEQ ID NO: 663163 - DNA, 22 bp, Artificial Sequence
  chemically synthesized
taagttgaaatgacagacaata

SEQ ID NO: 663164 - DNA, 22 bp, Artificial Sequence
  chemically synthesized
acatatgtgttttattgtctgt

SEQ ID NO: 663165 - DNA, 22 bp, Artificial Sequence
  chemically synthesized
cattcacatatgtgttttattg

SEQ ID NO: 663166 - DNA, 22 bp, Artificial Sequence
  chemically synthesized
aaatgacagacaataaaacaca

SEQ ID NO: 663167 - DNA, 22 bp, Artificial Sequence
  chemically synthesized
aaaaaaaattccattcacatat

SEQ ID NO: 663168 - DNA, 22 bp, Artificial Sequence
  chemically synthesized
ctcaaaaaaaattccattcaca

SEQ ID NO: 663169 - DNA, 22 bp, Artificial Sequence
  chemically synthesized
ctgctcaaaaaaaattccattc

SEQ ID NO: 663170 - DNA, 22 bp, Artificial Sequence
  chemically synthesized
cctgctcaaaaaaaattccatt

SEQ ID NO: 663171 - DNA, 22 bp, Artificial Sequence
  chemically synthesized
tcctgctcaaaaaaaattccat

SEQ ID NO: 663172 - DNA, 22 bp, Artificial Sequence
  chemically synthesized
gattttcctgctcaaaaaaaat

SEQ ID NO: 663173 - DNA, 22 bp, Artificial Sequence
  chemically synthesized
ttcgattttcctgctcaaaaaa

SEQ ID NO: 663174 - DNA, 22 bp, Artificial Sequence
  chemically synthesized
ggcattattcgattttcctgct

SEQ ID NO: 663175 - DNA, 22 bp, Artificial Sequence
  chemically synthesized
aggcattattcgattttcctgc

SEQ ID NO: 663176 - DNA, 22 bp, Artificial Sequence
  chemically synthesized
tttttgagcaggaaaatcgaat

SEQ ID NO: 663177 - DNA, 22 bp, Artificial Sequence
  chemically synthesized
gatttaggcattattcgatttt

SEQ ID NO: 663178 - DNA, 22 bp, Artificial Sequence
  chemically synthesized
ttttgagcaggaaaatcgaata

SEQ ID NO: 663179 - DNA, 22 bp, Artificial Sequence
  chemically synthesized
tttgagcaggaaaatcgaataa

SEQ ID NO: 663180 - DNA, 22 bp, Artificial Sequence
  chemically synthesized
ttgagcaggaaaatcgaataat

SEQ ID NO: 663181 - DNA, 22 bp, Artificial Sequence
  chemically synthesized
tgagcaggaaaatcgaataatg

SEQ ID NO: 663182 - DNA, 22 bp, Artificial Sequence
  chemically synthesized
gagcaggaaaatcgaataatgc

SEQ ID NO: 663183 - DNA, 22 bp, Artificial Sequence
  chemically synthesized
agcaggaaaatcgaataatgcc

SEQ ID NO: 663184 - DNA, 22 bp, Artificial Sequence
  chemically synthesized
accctggatttaggcattattc

SEQ ID NO: 663185 - DNA, 22 bp, Artificial Sequence
  chemically synthesized
caccctggatttaggcattatt

SEQ ID NO: 663186 - DNA, 22 bp, Artificial Sequence
  chemically synthesized
tcaccctggatttaggcattat

SEQ ID NO: 663187 - DNA, 22 bp, Artificial Sequence
  chemically synthesized
taatgtccattttcaccctgga

SEQ ID NO: 663188 - DNA, 22 bp, Artificial Sequence
  chemically synthesized
tataatgtccattttcaccctg

SEQ ID NO: 663189 - DNA, 22 bp, Artificial Sequence
  chemically synthesized
ctataatgtccattttcaccct

SEQ ID NO: 663190 - DNA, 22 bp, Artificial Sequence
  chemically synthesized
tctataatgtccattttcaccc

SEQ ID NO: 663191 - DNA, 22 bp, Artificial Sequence
  chemically synthesized
ctttctataatgtccattttca

SEQ ID NO: 663192 - DNA, 22 bp, Artificial Sequence
  chemically synthesized
aatccagggtgaaaatggacat

SEQ ID NO: 663193 - DNA, 22 bp, Artificial Sequence
  chemically synthesized
ttcctttctataatgtccattt

SEQ ID NO: 663194 - DNA, 22 bp, Artificial Sequence
  chemically synthesized
taatgactgttcctttctataa

SEQ ID NO: 663195 - DNA, 22 bp, Artificial Sequence
  chemically synthesized
ataatgactgttcctttctata

SEQ ID NO: 663196 - DNA, 22 bp, Artificial Sequence
  chemically synthesized
tagaaaggaacagtcattataa

SEQ ID NO: 663197 - DNA, 22 bp, Artificial Sequence
  chemically synthesized
taaggtttttccatctggtcta

SEQ ID NO: 663198 - DNA, 22 bp, Artificial Sequence
  chemically synthesized
ttccatctggtctatttctggg

SEQ ID NO: 663199 - DNA, 22 bp, Artificial Sequence
  chemically synthesized
tccatctggtctatttctgggt

SEQ ID NO: 663200 - DNA, 22 bp, Artificial Sequence
  chemically synthesized
ccatctggtctatttctgggtt

SEQ ID NO: 663201 - DNA, 22 bp, Artificial Sequence
  chemically synthesized
catctggtctatttctgggttt

SEQ ID NO: 663202 - DNA, 22 bp, Artificial Sequence
  chemically synthesized
gtctatttctgggtttcttttt

SEQ ID NO: 663203 - DNA, 22 bp, Artificial Sequence
  chemically synthesized
tggaaaaaaaaaaaaaagaaac

SEQ ID NO: 663204 - DNA, 22 bp, Artificial Sequence
  chemically synthesized
tttctgggtttctttttttttt

SEQ ID NO: 663205 - DNA, 22 bp, Artificial Sequence
  chemically synthesized
tactatggaaaaaaaaaaaaaa

SEQ ID NO: 663206 - DNA, 22 bp, Artificial Sequence
  chemically synthesized
atactatggaaaaaaaaaaaaa

SEQ ID NO: 663207 - DNA, 22 bp, Artificial Sequence
  chemically synthesized
ctgggtttcttttttttttttt

SEQ ID NO: 663208 - DNA, 22 bp, Artificial Sequence
  chemically synthesized
tgggtttctttttttttttttt

SEQ ID NO: 663209 - DNA, 22 bp, Artificial Sequence
  chemically synthesized
ggtttcttttttttttttttcc

SEQ ID NO: 663210 - DNA, 22 bp, Artificial Sequence
  chemically synthesized
cagtttatactatggaaaaaaa

SEQ ID NO: 663211 - DNA, 22 bp, Artificial Sequence
  chemically synthesized
ttccagtttatactatggaaaa

SEQ ID NO: 663212 - DNA, 22 bp, Artificial Sequence
  chemically synthesized
cttttttttttttttccatagt

SEQ ID NO: 663213 - DNA, 22 bp, Artificial Sequence
  chemically synthesized
gttccagtttatactatggaaa

SEQ ID NO: 663214 - DNA, 22 bp, Artificial Sequence
  chemically synthesized
ttttttttttttttccatagta

SEQ ID NO: 663215 - DNA, 22 bp, Artificial Sequence
  chemically synthesized
ttttttttttttccatagtata

SEQ ID NO: 663216 - DNA, 22 bp, Artificial Sequence
  chemically synthesized
tttttttttttccatagtataa

SEQ ID NO: 663217 - DNA, 22 bp, Artificial Sequence
  chemically synthesized
ttttttttttccatagtataaa

SEQ ID NO: 663218 - DNA, 22 bp, Artificial Sequence
  chemically synthesized
tttttttttccatagtataaac

SEQ ID NO: 663219 - DNA, 22 bp, Artificial Sequence
  chemically synthesized
ttttttttccatagtataaact

SEQ ID NO: 663220 - DNA, 22 bp, Artificial Sequence
  chemically synthesized
accatttgttccagtttatact

SEQ ID NO: 663221 - DNA, 22 bp, Artificial Sequence
  chemically synthesized
tttttttccatagtataaactg

SEQ ID NO: 663222 - DNA, 22 bp, Artificial Sequence
  chemically synthesized
ttttttccatagtataaactgg

SEQ ID NO: 663223 - DNA, 22 bp, Artificial Sequence
  chemically synthesized
tttttccatagtataaactgga

SEQ ID NO: 663224 - DNA, 22 bp, Artificial Sequence
  chemically synthesized
ttttccatagtataaactggaa

SEQ ID NO: 663225 - DNA, 22 bp, Artificial Sequence
  chemically synthesized
tttccatagtataaactggaac

SEQ ID NO: 663226 - DNA, 22 bp, Artificial Sequence
  chemically synthesized
ttccatagtataaactggaaca

SEQ ID NO: 663227 - DNA, 22 bp, Artificial Sequence
  chemically synthesized
tccatagtataaactggaacaa

SEQ ID NO: 663228 - DNA, 22 bp, Artificial Sequence
  chemically synthesized
ccatagtataaactggaacaaa

SEQ ID NO: 663229 - DNA, 22 bp, Artificial Sequence
  chemically synthesized
agaagctaaccatttgttccag

SEQ ID NO: 663230 - DNA, 22 bp, Artificial Sequence
  chemically synthesized
catagtataaactggaacaaat

SEQ ID NO: 663231 - DNA, 22 bp, Artificial Sequence
  chemically synthesized
aaagttcagaagctaaccattt

SEQ ID NO: 663232 - DNA, 22 bp, Artificial Sequence
  chemically synthesized
gaacaaatggttagcttctgaa

SEQ ID NO: 663233 - DNA, 22 bp, Artificial Sequence
  chemically synthesized
tgagatcctaaaagttcagaag

SEQ ID NO: 663234 - DNA, 22 bp, Artificial Sequence
  chemically synthesized
ctgtgagatcctaaaagttcag

SEQ ID NO: 663235 - DNA, 22 bp, Artificial Sequence
  chemically synthesized
gcttctgaacttttaggatctc

SEQ ID NO: 663236 - DNA, 22 bp, Artificial Sequence
  chemically synthesized
gagaatattcctgtgagatcct

SEQ ID NO: 663237 - DNA, 22 bp, Artificial Sequence
  chemically synthesized
ctgaacttttaggatctcacag

SEQ ID NO: 663238 - DNA, 22 bp, Artificial Sequence
  chemically synthesized
tgaacttttaggatctcacagg

SEQ ID NO: 663239 - DNA, 22 bp, Artificial Sequence
  chemically synthesized
aacttttaggatctcacaggaa

SEQ ID NO: 663240 - DNA, 22 bp, Artificial Sequence
  chemically synthesized
ttaggatctcacaggaatattc

SEQ ID NO: 663241 - DNA, 22 bp, Artificial Sequence
  chemically synthesized
taggatctcacaggaatattct

SEQ ID NO: 663242 - DNA, 22 bp, Artificial Sequence
  chemically synthesized
aggatctcacaggaatattctc

SEQ ID NO: 663243 - DNA, 22 bp, Artificial Sequence
  chemically synthesized
ggatctcacaggaatattctct

SEQ ID NO: 663244 - DNA, 22 bp, Artificial Sequence
  chemically synthesized
tcatgaagtgctagagaatatt

SEQ ID NO: 663245 - DNA, 22 bp, Artificial Sequence
  chemically synthesized
gttatcatgaagtgctagagaa

SEQ ID NO: 663246 - DNA, 22 bp, Artificial Sequence
  chemically synthesized
acaggaatattctctagcactt

SEQ ID NO: 663247 - DNA, 22 bp, Artificial Sequence
  chemically synthesized
ggcactggttatcatgaagtgc

SEQ ID NO: 663248 - DNA, 22 bp, Artificial Sequence
  chemically synthesized
tctagcacttcatgataaccag

SEQ ID NO: 663249 - DNA, 22 bp, Artificial Sequence
  chemically synthesized
tagcacttcatgataaccagtg

SEQ ID NO: 663250 - DNA, 22 bp, Artificial Sequence
  chemically synthesized
gcacttcatgataaccagtgcc

SEQ ID NO: 663251 - DNA, 22 bp, Artificial Sequence
  chemically synthesized
ataaaggagtaattaggcactg

SEQ ID NO: 663252 - DNA, 22 bp, Artificial Sequence
  chemically synthesized
aataaaggagtaattaggcact

SEQ ID NO: 663253 - DNA, 22 bp, Artificial Sequence
  chemically synthesized
taataaaggagtaattaggcac

SEQ ID NO: 663254 - DNA, 22 bp, Artificial Sequence
  chemically synthesized
catgataaccagtgcctaatta

SEQ ID NO: 663255 - DNA, 22 bp, Artificial Sequence
  chemically synthesized
atgataaccagtgcctaattac

SEQ ID NO: 663256 - DNA, 22 bp, Artificial Sequence
  chemically synthesized
ctttaataaaggagtaattagg

SEQ ID NO: 663257 - DNA, 22 bp, Artificial Sequence
  chemically synthesized
cctttaataaaggagtaattag

SEQ ID NO: 663258 - DNA, 22 bp, Artificial Sequence
  chemically synthesized
tcctttaataaaggagtaatta

SEQ ID NO: 663259 - DNA, 22 bp, Artificial Sequence
  chemically synthesized
ctttcctttaataaaggagtaa

SEQ ID NO: 663260 - DNA, 22 bp, Artificial Sequence
  chemically synthesized
ctgctttcctttaataaaggag

SEQ ID NO: 663261 - DNA, 22 bp, Artificial Sequence
  chemically synthesized
attactcctttattaaaggaaa

SEQ ID NO: 663262 - DNA, 22 bp, Artificial Sequence
  chemically synthesized
ctcctttattaaaggaaagcag

SEQ ID NO: 663263 - DNA, 22 bp, Artificial Sequence
  chemically synthesized
ctttattaaaggaaagcagtag

SEQ ID NO: 663264 - DNA, 22 bp, Artificial Sequence
  chemically synthesized
ccccatcccagagctactgctt

SEQ ID NO: 663265 - DNA, 22 bp, Artificial Sequence
  chemically synthesized
tattaaaggaaagcagtagctc

SEQ ID NO: 663266 - DNA, 22 bp, Artificial Sequence
  chemically synthesized
attaaaggaaagcagtagctct

SEQ ID NO: 663267 - DNA, 22 bp, Artificial Sequence
  chemically synthesized
ttaaaggaaagcagtagctctg

SEQ ID NO: 663268 - DNA, 22 bp, Artificial Sequence
  chemically synthesized
cccctgccccatcccagagcta

SEQ ID NO: 663269 - DNA, 22 bp, Artificial Sequence
  chemically synthesized
aaggaaagcagtagctctggga

SEQ ID NO: 663270 - DNA, 22 bp, Artificial Sequence
  chemically synthesized
cccctgcccctgccccatccca

SEQ ID NO: 663271 - DNA, 22 bp, Artificial Sequence
  chemically synthesized
cccctgcccctgcccctgcccc

SEQ ID NO: 663272 - DNA, 22 bp, Artificial Sequence
  chemically synthesized
acctgcccctgcccctgcccct

SEQ ID NO: 663273 - DNA, 22 bp, Artificial Sequence
  chemically synthesized
tgggatggggcaggggcagggg

SEQ ID NO: 663274 - DNA, 22 bp, Artificial Sequence
  chemically synthesized
cacctgcccctgcccctgcccc

SEQ ID NO: 663275 - DNA, 22 bp, Artificial Sequence
  chemically synthesized
ggatggggcaggggcaggggca

SEQ ID NO: 663276 - DNA, 22 bp, Artificial Sequence
  chemically synthesized
ttcacctgcccctgcccctgcc

SEQ ID NO: 663277 - DNA, 22 bp, Artificial Sequence
  chemically synthesized
cttcacctgcccctgcccctgc

SEQ ID NO: 663278 - DNA, 22 bp, Artificial Sequence
  chemically synthesized
tcttcacctgcccctgcccctg

SEQ ID NO: 663279 - DNA, 22 bp, Artificial Sequence
  chemically synthesized
ttcttcacctgcccctgcccct

SEQ ID NO: 663280 - DNA, 22 bp, Artificial Sequence
  chemically synthesized
tttcttcacctgcccctgcccc

SEQ ID NO: 663281 - DNA, 22 bp, Artificial Sequence
  chemically synthesized
tttttcttcacctgcccctgcc

SEQ ID NO: 663282 - DNA, 22 bp, Artificial Sequence
  chemically synthesized
cctctttttcttcacctgcccc

SEQ ID NO: 663283 - DNA, 22 bp, Artificial Sequence
  chemically synthesized
gcctctttttcttcacctgccc

SEQ ID NO: 663284 - DNA, 22 bp, Artificial Sequence
  chemically synthesized
ttgcctctttttcttcacctgc

SEQ ID NO: 663285 - DNA, 22 bp, Artificial Sequence
  chemically synthesized
cttgcctctttttcttcacctg

SEQ ID NO: 663286 - DNA, 22 bp, Artificial Sequence
  chemically synthesized
tcttgcctctttttcttcacct

SEQ ID NO: 663287 - DNA, 22 bp, Artificial Sequence
  chemically synthesized
aatagagaaagttttcttgcct

SEQ ID NO: 663288 - DNA, 22 bp, Artificial Sequence
  chemically synthesized
ggatgggatcgagtcagggggc

SEQ ID NO: 663289 - DNA, 22 bp, Artificial Sequence
  chemically synthesized
gggatgggatcgagtcaggggg

SEQ ID NO: 663290 - DNA, 22 bp, Artificial Sequence
  chemically synthesized
tctctattcagccccctgactc

SEQ ID NO: 663291 - DNA, 22 bp, Artificial Sequence
  chemically synthesized
ctctattcagccccctgactcg

SEQ ID NO: 663292 - DNA, 22 bp, Artificial Sequence
  chemically synthesized
tctattcagccccctgactcga

SEQ ID NO: 663293 - DNA, 22 bp, Artificial Sequence
  chemically synthesized
tattcagccccctgactcgatc

SEQ ID NO: 663294 - DNA, 22 bp, Artificial Sequence
  chemically synthesized
ttcagccccctgactcgatccc

SEQ ID NO: 663295 - DNA, 22 bp, Artificial Sequence
  chemically synthesized
agccccctgactcgatcccatc

SEQ ID NO: 663296 - DNA, 22 bp, Artificial Sequence
  chemically synthesized
ggaaaaagtagtttgggatggg

SEQ ID NO: 663297 - DNA, 22 bp, Artificial Sequence
  chemically synthesized
actcgatcccatcccaaactac

SEQ ID NO: 663298 - DNA, 22 bp, Artificial Sequence
  chemically synthesized
gatcccatcccaaactactttt

SEQ ID NO: 663299 - DNA, 22 bp, Artificial Sequence
  chemically synthesized
atacgtcatagctgggaaaaag

SEQ ID NO: 663300 - DNA, 22 bp, Artificial Sequence
  chemically synthesized
ttaatacgtcatagctgggaaa

SEQ ID NO: 663301 - DNA, 22 bp, Artificial Sequence
  chemically synthesized
ggacctgttaatacgtcatagc

SEQ ID NO: 663302 - DNA, 22 bp, Artificial Sequence
  chemically synthesized
aggacctgttaatacgtcatag

SEQ ID NO: 663303 - DNA, 22 bp, Artificial Sequence
  chemically synthesized
ctttttcccagctatgacgtat

SEQ ID NO: 663304 - DNA, 22 bp, Artificial Sequence
  chemically synthesized
cttaggacctgttaatacgtca

SEQ ID NO: 663305 - DNA, 22 bp, Artificial Sequence
  chemically synthesized
tttcccagctatgacgtattaa

SEQ ID NO: 663306 - DNA, 22 bp, Artificial Sequence
  chemically synthesized
ccttaggacctgttaatacgtc

SEQ ID NO: 663307 - DNA, 22 bp, Artificial Sequence
  chemically synthesized
ttcccagctatgacgtattaac

SEQ ID NO: 663308 - DNA, 22 bp, Artificial Sequence
  chemically synthesized
tcccagctatgacgtattaaca

SEQ ID NO: 663309 - DNA, 22 bp, Artificial Sequence
  chemically synthesized
cccagctatgacgtattaacag

SEQ ID NO: 663310 - DNA, 22 bp, Artificial Sequence
  chemically synthesized
ccagctatgacgtattaacagg

SEQ ID NO: 663311 - DNA, 22 bp, Artificial Sequence
  chemically synthesized
tgacgtattaacaggtcctaag

SEQ ID NO: 663312 - DNA, 22 bp, Artificial Sequence
  chemically synthesized
caggtcgagggtttccttagga

SEQ ID NO: 663313 - DNA, 22 bp, Artificial Sequence
  chemically synthesized
ccaggtcgagggtttccttagg

SEQ ID NO: 663314 - DNA, 22 bp, Artificial Sequence
  chemically synthesized
tccaggtcgagggtttccttag

SEQ ID NO: 663315 - DNA, 22 bp, Artificial Sequence
  chemically synthesized
acaggtcctaaggaaaccctcg

SEQ ID NO: 663316 - DNA, 22 bp, Artificial Sequence
  chemically synthesized
aagggctttccaggtcgagggt

SEQ ID NO: 663317 - DNA, 22 bp, Artificial Sequence
  chemically synthesized
aaagggctttccaggtcgaggg

SEQ ID NO: 663318 - DNA, 22 bp, Artificial Sequence
  chemically synthesized
aggaaaccctcgacctggaaag

SEQ ID NO: 663319 - DNA, 22 bp, Artificial Sequence
  chemically synthesized
gtgtttaaagggctttccaggt

SEQ ID NO: 663320 - DNA, 22 bp, Artificial Sequence
  chemically synthesized
actggtgtttaaagggctttcc

SEQ ID NO: 663321 - DNA, 22 bp, Artificial Sequence
  chemically synthesized
aactggtgtttaaagggctttc

SEQ ID NO: 663322 - DNA, 22 bp, Artificial Sequence
  chemically synthesized
gacctggaaagccctttaaaca

SEQ ID NO: 663323 - DNA, 22 bp, Artificial Sequence
  chemically synthesized
ccaagtttaactggtgtttaaa

SEQ ID NO: 663324 - DNA, 22 bp, Artificial Sequence
  chemically synthesized
gaaagccctttaaacaccagtt

SEQ ID NO: 663325 - DNA, 22 bp, Artificial Sequence
  chemically synthesized
tatagttgccaagtttaactgg

SEQ ID NO: 663326 - DNA, 22 bp, Artificial Sequence
  chemically synthesized
agctatatagttgccaagttta

SEQ ID NO: 663327 - DNA, 22 bp, Artificial Sequence
  chemically synthesized
taaacaccagttaaacttggca

SEQ ID NO: 663328 - DNA, 22 bp, Artificial Sequence
  chemically synthesized
cagctatatagttgccaagttt

SEQ ID NO: 663329 - DNA, 22 bp, Artificial Sequence
  chemically synthesized
aaacaccagttaaacttggcaa

SEQ ID NO: 663330 - DNA, 22 bp, Artificial Sequence
  chemically synthesized
tcagctatatagttgccaagtt

SEQ ID NO: 663331 - DNA, 22 bp, Artificial Sequence
  chemically synthesized
aacaccagttaaacttggcaac

SEQ ID NO: 663332 - DNA, 22 bp, Artificial Sequence
  chemically synthesized
ttcagctatatagttgccaagt

SEQ ID NO: 663333 - DNA, 22 bp, Artificial Sequence
  chemically synthesized
tcatttttcagctatatagttg

SEQ ID NO: 663334 - DNA, 22 bp, Artificial Sequence
  chemically synthesized
aacttggcaactatatagctga

SEQ ID NO: 663335 - DNA, 22 bp, Artificial Sequence
  chemically synthesized
ggcaactatatagctgaaaaat

SEQ ID NO: 663336 - DNA, 22 bp, Artificial Sequence
  chemically synthesized
gcaactatatagctgaaaaatg

SEQ ID NO: 663337 - DNA, 22 bp, Artificial Sequence
  chemically synthesized
tagcccgaagttatcatttttc

SEQ ID NO: 663338 - DNA, 22 bp, Artificial Sequence
  chemically synthesized
atagcccgaagttatcattttt

SEQ ID NO: 663339 - DNA, 22 bp, Artificial Sequence
  chemically synthesized
cttatagcccgaagttatcatt

SEQ ID NO: 663340 - DNA, 22 bp, Artificial Sequence
  chemically synthesized
tatagctgaaaaatgataactt

SEQ ID NO: 663341 - DNA, 22 bp, Artificial Sequence
  chemically synthesized
ccttatagcccgaagttatcat

SEQ ID NO: 663342 - DNA, 22 bp, Artificial Sequence
  chemically synthesized
catttccttatagcccgaagtt

SEQ ID NO: 663343 - DNA, 22 bp, Artificial Sequence
  chemically synthesized
ccatttccttatagcccgaagt

SEQ ID NO: 663344 - DNA, 22 bp, Artificial Sequence
  chemically synthesized
aaaaatgataacttcgggctat

SEQ ID NO: 663345 - DNA, 22 bp, Artificial Sequence
  chemically synthesized
cgggctataaggaaatggaagc

SEQ ID NO: 663346 - DNA, 22 bp, Artificial Sequence
  chemically synthesized
gggctataaggaaatggaagcc

SEQ ID NO: 663347 - DNA, 22 bp, Artificial Sequence
  chemically synthesized
taaggaaatggaagccttggtt

SEQ ID NO: 663348 - DNA, 22 bp, Artificial Sequence
  chemically synthesized
atgagatgaatgcatgaatgaa

SEQ ID NO: 663349 - DNA, 22 bp, Artificial Sequence
  chemically synthesized
catgagatgaatgcatgaatga

SEQ ID NO: 663350 - DNA, 22 bp, Artificial Sequence
  chemically synthesized
tcatgagatgaatgcatgaatg

SEQ ID NO: 663351 - DNA, 22 bp, Artificial Sequence
  chemically synthesized
ggtttactttcattcatgcatt

SEQ ID NO: 663352 - DNA, 22 bp, Artificial Sequence
  chemically synthesized
gtttactttcattcatgcattc

SEQ ID NO: 663353 - DNA, 22 bp, Artificial Sequence
  chemically synthesized
actttcattcatgcattcatct

SEQ ID NO: 663354 - DNA, 22 bp, Artificial Sequence
  chemically synthesized
ctttcattcatgcattcatctc

SEQ ID NO: 663355 - DNA, 22 bp, Artificial Sequence
  chemically synthesized
aatatgttttcatgagatgaat

SEQ ID NO: 663356 - DNA, 22 bp, Artificial Sequence
  chemically synthesized
tcattcatgcattcatctcatg

SEQ ID NO: 663357 - DNA, 22 bp, Artificial Sequence
  chemically synthesized
cattcatgcattcatctcatga

SEQ ID NO: 663358 - DNA, 22 bp, Artificial Sequence
  chemically synthesized
attcatgcattcatctcatgaa

SEQ ID NO: 663359 - DNA, 22 bp, Artificial Sequence
  chemically synthesized
atgcattcatctcatgaaaaca

SEQ ID NO: 663360 - DNA, 22 bp, Artificial Sequence
  chemically synthesized
atctcatgaaaacatattgaac

SEQ ID NO: 663361 - DNA, 22 bp, Artificial Sequence
  chemically synthesized
gcacacagcatggttcaatatg

SEQ ID NO: 663362 - DNA, 22 bp, Artificial Sequence
  chemically synthesized
atgaaaacatattgaaccatgc

SEQ ID NO: 663363 - DNA, 22 bp, Artificial Sequence
  chemically synthesized
gtacaaaacctggcacacagca

SEQ ID NO: 663364 - DNA, 22 bp, Artificial Sequence
  chemically synthesized
agtacaaaacctggcacacagc

SEQ ID NO: 663365 - DNA, 22 bp, Artificial Sequence
  chemically synthesized
aaccatgctgtgtgccaggttt

SEQ ID NO: 663366 - DNA, 22 bp, Artificial Sequence
  chemically synthesized
gtatccccaatgcttagtacaa

SEQ ID NO: 663367 - DNA, 22 bp, Artificial Sequence
  chemically synthesized
tgtgccaggttttgtactaagc

SEQ ID NO: 663368 - DNA, 22 bp, Artificial Sequence
  chemically synthesized
ggtatccccaatgcttagtaca

SEQ ID NO: 663369 - DNA, 22 bp, Artificial Sequence
  chemically synthesized
atcttggtatccccaatgctta

SEQ ID NO: 663370 - DNA, 22 bp, Artificial Sequence
  chemically synthesized
catcttggtatccccaatgctt

SEQ ID NO: 663371 - DNA, 22 bp, Artificial Sequence
  chemically synthesized
ccttcatcttggtatccccaat

SEQ ID NO: 663372 - DNA, 22 bp, Artificial Sequence
  chemically synthesized
cccttcatcttggtatccccaa

SEQ ID NO: 663373 - DNA, 22 bp, Artificial Sequence
  chemically synthesized
tgtactaagcattggggatacc

SEQ ID NO: 663374 - DNA, 22 bp, Artificial Sequence
  chemically synthesized
tcccttcatcttggtatcccca

SEQ ID NO: 663375 - DNA, 22 bp, Artificial Sequence
  chemically synthesized
gtactaagcattggggatacca

SEQ ID NO: 663376 - DNA, 22 bp, Artificial Sequence
  chemically synthesized
ttcccttcatcttggtatcccc

SEQ ID NO: 663377 - DNA, 22 bp, Artificial Sequence
  chemically synthesized
tactaagcattggggataccaa

SEQ ID NO: 663378 - DNA, 22 bp, Artificial Sequence
  chemically synthesized
agcattggggataccaagatga

SEQ ID NO: 663379 - DNA, 22 bp, Artificial Sequence
  chemically synthesized
ggccttttcccttcatcttggt

SEQ ID NO: 663380 - DNA, 22 bp, Artificial Sequence
  chemically synthesized
gggataccaagatgaagggaaa

SEQ ID NO: 663381 - DNA, 22 bp, Artificial Sequence
  chemically synthesized
gaaagagagactaggccttttc

SEQ ID NO: 663382 - DNA, 22 bp, Artificial Sequence
  chemically synthesized
ggaaagagagactaggcctttt

SEQ ID NO: 663383 - DNA, 22 bp, Artificial Sequence
  chemically synthesized
tttggaaagagagactaggcct

SEQ ID NO: 663384 - DNA, 22 bp, Artificial Sequence
  chemically synthesized
gaagtggaattatttggaaaga

SEQ ID NO: 663385 - DNA, 22 bp, Artificial Sequence
  chemically synthesized
agaagtggaattatttggaaag

SEQ ID NO: 663386 - DNA, 22 bp, Artificial Sequence
  chemically synthesized
gtctctctttccaaataattcc

SEQ ID NO: 663387 - DNA, 22 bp, Artificial Sequence
  chemically synthesized
tctttccaaataattccacttc

SEQ ID NO: 663388 - DNA, 22 bp, Artificial Sequence
  chemically synthesized
tttccaaataattccacttcta

SEQ ID NO: 663389 - DNA, 22 bp, Artificial Sequence
  chemically synthesized
tccaaataattccacttctaag

SEQ ID NO: 663390 - DNA, 22 bp, Artificial Sequence
  chemically synthesized
ccaaataattccacttctaagg

SEQ ID NO: 663391 - DNA, 22 bp, Artificial Sequence
  chemically synthesized
caaataattccacttctaaggc

SEQ ID NO: 663392 - DNA, 22 bp, Artificial Sequence
  chemically synthesized
cacagagatagagaagaaatgc

SEQ ID NO: 663393 - DNA, 22 bp, Artificial Sequence
  chemically synthesized
acacagagatagagaagaaatg

SEQ ID NO: 663394 - DNA, 22 bp, Artificial Sequence
  chemically synthesized
cacttctaaggcatttcttctc

SEQ ID NO: 663395 - DNA, 22 bp, Artificial Sequence
  chemically synthesized
ttacacagagatagagaagaaa

SEQ ID NO: 663396 - DNA, 22 bp, Artificial Sequence
  chemically synthesized
ctaaggcatttcttctctatct

SEQ ID NO: 663397 - DNA, 22 bp, Artificial Sequence
  chemically synthesized
taaggcatttcttctctatctc

SEQ ID NO: 663398 - DNA, 22 bp, Artificial Sequence
  chemically synthesized
aggcatttcttctctatctctg

SEQ ID NO: 663399 - DNA, 22 bp, Artificial Sequence
  chemically synthesized
gcatatggttcttacacagaga

SEQ ID NO: 663400 - DNA, 22 bp, Artificial Sequence
  chemically synthesized
ggcatatggttcttacacagag

SEQ ID NO: 663401 - DNA, 22 bp, Artificial Sequence
  chemically synthesized
cttctctatctctgtgtaagaa

SEQ ID NO: 663402 - DNA, 22 bp, Artificial Sequence
  chemically synthesized
ttctctatctctgtgtaagaac

SEQ ID NO: 663403 - DNA, 22 bp, Artificial Sequence
  chemically synthesized
ctctatctctgtgtaagaacca

SEQ ID NO: 663404 - DNA, 22 bp, Artificial Sequence
  chemically synthesized
tctatctctgtgtaagaaccat

SEQ ID NO: 663405 - DNA, 22 bp, Artificial Sequence
  chemically synthesized
tatctctgtgtaagaaccatat

SEQ ID NO: 663406 - DNA, 22 bp, Artificial Sequence
  chemically synthesized
tctctgtgtaagaaccatatgc

SEQ ID NO: 663407 - DNA, 22 bp, Artificial Sequence
  chemically synthesized
tgtgtaagaaccatatgccaag

SEQ ID NO: 663408 - DNA, 22 bp, Artificial Sequence
  chemically synthesized
tgtaagaaccatatgccaagtg

SEQ ID NO: 663409 - DNA, 22 bp, Artificial Sequence
  chemically synthesized
gcaataagatagtcaaggagtc

SEQ ID NO: 663410 - DNA, 22 bp, Artificial Sequence
  chemically synthesized
cagaggctagcaataagatagt

SEQ ID NO: 663411 - DNA, 22 bp, Artificial Sequence
  chemically synthesized
cttgactatcttattgctagcc

SEQ ID NO: 663412 - DNA, 22 bp, Artificial Sequence
  chemically synthesized
gactatcttattgctagcctct

SEQ ID NO: 663413 - DNA, 22 bp, Artificial Sequence
  chemically synthesized
actatcttattgctagcctctg

SEQ ID NO: 663414 - DNA, 22 bp, Artificial Sequence
  chemically synthesized
aaccagaggatctgcagaggct

SEQ ID NO: 663415 - DNA, 22 bp, Artificial Sequence
  chemically synthesized
tcttattgctagcctctgcaga

SEQ ID NO: 663416 - DNA, 22 bp, Artificial Sequence
  chemically synthesized
attgctagcctctgcagatcct

SEQ ID NO: 663417 - DNA, 22 bp, Artificial Sequence
  chemically synthesized
ttgctagcctctgcagatcctc

SEQ ID NO: 663418 - DNA, 22 bp, Artificial Sequence
  chemically synthesized
ctagcctctgcagatcctctgg

SEQ ID NO: 663419 - DNA, 22 bp, Artificial Sequence
  chemically synthesized
gcctctgcagatcctctggttg

SEQ ID NO: 663420 - DNA, 22 bp, Artificial Sequence
  chemically synthesized
agaaataaaggggttcaaccag

SEQ ID NO: 663421 - DNA, 22 bp, Artificial Sequence
  chemically synthesized
cagaaataaaggggttcaacca

SEQ ID NO: 663422 - DNA, 22 bp, Artificial Sequence
  chemically synthesized
tgcagatcctctggttgaaccc

SEQ ID NO: 663423 - DNA, 22 bp, Artificial Sequence
  chemically synthesized
cagatcctctggttgaacccct

SEQ ID NO: 663424 - DNA, 22 bp, Artificial Sequence
  chemically synthesized
ccaggtcttcagaaataaaggg

SEQ ID NO: 663425 - DNA, 22 bp, Artificial Sequence
  chemically synthesized
tggttgaacccctttatttctg

SEQ ID NO: 663426 - DNA, 22 bp, Artificial Sequence
  chemically synthesized
gctgccaggtcttcagaaataa

SEQ ID NO: 663427 - DNA, 22 bp, Artificial Sequence
  chemically synthesized
gttgaacccctttatttctgaa

SEQ ID NO: 663428 - DNA, 22 bp, Artificial Sequence
  chemically synthesized
aacccctttatttctgaagacc

SEQ ID NO: 663429 - DNA, 22 bp, Artificial Sequence
  chemically synthesized
tatttctgaagacctggcagcc

SEQ ID NO: 663430 - DNA, 22 bp, Artificial Sequence
  chemically synthesized
atttctgaagacctggcagcca

SEQ ID NO: 663431 - DNA, 22 bp, Artificial Sequence
  chemically synthesized
tttctgaagacctggcagccag

SEQ ID NO: 663432 - DNA, 22 bp, Artificial Sequence
  chemically synthesized
ctgaagacctggcagccagggt

SEQ ID NO: 663433 - DNA, 22 bp, Artificial Sequence
  chemically synthesized
tgaagacctggcagccagggtt

SEQ ID NO: 663434 - DNA, 22 bp, Artificial Sequence
  chemically synthesized
aagacctggcagccagggttca

SEQ ID NO: 663435 - DNA, 22 bp, Artificial Sequence
  chemically synthesized
ggcaaaagagaaggaccgtgaa

SEQ ID NO: 663436 - DNA, 22 bp, Artificial Sequence
  chemically synthesized
gcagccagggttcacggtcctt

SEQ ID NO: 663437 - DNA, 22 bp, Artificial Sequence
  chemically synthesized
gagcgagaactgggcaaaagag

SEQ ID NO: 663438 - DNA, 22 bp, Artificial Sequence
  chemically synthesized
acggtccttctcttttgcccag

SEQ ID NO: 663439 - DNA, 22 bp, Artificial Sequence
  chemically synthesized
ctcttttgcccagttctcgctc

SEQ ID NO: 663440 - DNA, 22 bp, Artificial Sequence
  chemically synthesized
tcttttgcccagttctcgctcc

SEQ ID NO: 663441 - DNA, 22 bp, Artificial Sequence
  chemically synthesized
ttttgcccagttctcgctccaa

SEQ ID NO: 663442 - DNA, 22 bp, Artificial Sequence
  chemically synthesized
aaatcatgcagaattggagcga

SEQ ID NO: 663443 - DNA, 22 bp, Artificial Sequence
  chemically synthesized
ttgcccagttctcgctccaatt

SEQ ID NO: 663444 - DNA, 22 bp, Artificial Sequence
  chemically synthesized
tgcccagttctcgctccaattc

SEQ ID NO: 663445 - DNA, 22 bp, Artificial Sequence
  chemically synthesized
gcccagttctcgctccaattct

SEQ ID NO: 663446 - DNA, 22 bp, Artificial Sequence
  chemically synthesized
cccagttctcgctccaattctg

SEQ ID NO: 663447 - DNA, 22 bp, Artificial Sequence
  chemically synthesized
tcgctccaattctgcatgattt

SEQ ID NO: 663448 - DNA, 22 bp, Artificial Sequence
  chemically synthesized
gctccaattctgcatgatttca

SEQ ID NO: 663449 - DNA, 22 bp, Artificial Sequence
  chemically synthesized
caattctgcatgatttcaacat

SEQ ID NO: 663450 - DNA, 22 bp, Artificial Sequence
  chemically synthesized
tgcatgatttcaacattggcat

SEQ ID NO: 663451 - DNA, 22 bp, Artificial Sequence
  chemically synthesized
catgatttcaacattggcatgg

SEQ ID NO: 663452 - DNA, 22 bp, Artificial Sequence
  chemically synthesized
gaatgatgcatgagtcccccat

SEQ ID NO: 663453 - DNA, 22 bp, Artificial Sequence
  chemically synthesized
caacattggcatgggggactca

SEQ ID NO: 663454 - DNA, 22 bp, Artificial Sequence
  chemically synthesized
aacattggcatgggggactcat

SEQ ID NO: 663455 - DNA, 22 bp, Artificial Sequence
  chemically synthesized
agaggctagaatgatgcatgag

SEQ ID NO: 663456 - DNA, 22 bp, Artificial Sequence
  chemically synthesized
gcatgggggactcatgcatcat

SEQ ID NO: 663457 - DNA, 22 bp, Artificial Sequence
  chemically synthesized
aggaactgagaggctagaatga

SEQ ID NO: 663458 - DNA, 22 bp, Artificial Sequence
  chemically synthesized
atgcatcattctagcctctcag

SEQ ID NO: 663459 - DNA, 22 bp, Artificial Sequence
  chemically synthesized
tagcctctcagttccttaactt

SEQ ID NO: 663460 - DNA, 22 bp, Artificial Sequence
  chemically synthesized
gcctctcagttccttaacttgc

SEQ ID NO: 663461 - DNA, 22 bp, Artificial Sequence
  chemically synthesized
catggaggtgaaatagcaagtt

SEQ ID NO: 663462 - DNA, 22 bp, Artificial Sequence
  chemically synthesized
ccatggaggtgaaatagcaagt

SEQ ID NO: 663463 - DNA, 22 bp, Artificial Sequence
  chemically synthesized
tcagttccttaacttgctattt

SEQ ID NO: 663464 - DNA, 22 bp, Artificial Sequence
  chemically synthesized
agttccttaacttgctatttca

SEQ ID NO: 663465 - DNA, 22 bp, Artificial Sequence
  chemically synthesized
cttaacttgctatttcacctcc

SEQ ID NO: 663466 - DNA, 22 bp, Artificial Sequence
  chemically synthesized
aacttgctatttcacctccatg

SEQ ID NO: 663467 - DNA, 22 bp, Artificial Sequence
  chemically synthesized
acttgctatttcacctccatgg

SEQ ID NO: 663468 - DNA, 22 bp, Artificial Sequence
  chemically synthesized
gctatttcacctccatggaaat

SEQ ID NO: 663469 - DNA, 22 bp, Artificial Sequence
  chemically synthesized
ctatttcacctccatggaaatt

SEQ ID NO: 663470 - DNA, 22 bp, Artificial Sequence
  chemically synthesized
tttcacctccatggaaattcac

SEQ ID NO: 663471 - DNA, 22 bp, Artificial Sequence
  chemically synthesized
cacctccatggaaattcacatc

SEQ ID NO: 663472 - DNA, 22 bp, Artificial Sequence
  chemically synthesized
acctccatggaaattcacatcc

SEQ ID NO: 663473 - DNA, 22 bp, Artificial Sequence
  chemically synthesized
catggaaattcacatccactct

SEQ ID NO: 663474 - DNA, 22 bp, Artificial Sequence
  chemically synthesized
agtaggtggcagaggtagagtg

SEQ ID NO: 663475 - DNA, 22 bp, Artificial Sequence
  chemically synthesized
gagtaggtggcagaggtagagt

SEQ ID NO: 663476 - DNA, 22 bp, Artificial Sequence
  chemically synthesized
acatccactctacctctgccac

SEQ ID NO: 663477 - DNA, 22 bp, Artificial Sequence
  chemically synthesized
ggatatagccatttgagtaggt

SEQ ID NO: 663478 - DNA, 22 bp, Artificial Sequence
  chemically synthesized
tacctctgccacctactcaaat

SEQ ID NO: 663479 - DNA, 22 bp, Artificial Sequence
  chemically synthesized
cctctgccacctactcaaatgg

SEQ ID NO: 663480 - DNA, 22 bp, Artificial Sequence
  chemically synthesized
gatctaggatatagccatttga

SEQ ID NO: 663481 - DNA, 22 bp, Artificial Sequence
  chemically synthesized
tgccacctactcaaatggctat

SEQ ID NO: 663482 - DNA, 22 bp, Artificial Sequence
  chemically synthesized
ccacctactcaaatggctatat

SEQ ID NO: 663483 - DNA, 22 bp, Artificial Sequence
  chemically synthesized
aggtgattagatctaggatata

SEQ ID NO: 663484 - DNA, 22 bp, Artificial Sequence
  chemically synthesized
caggtgattagatctaggatat

SEQ ID NO: 663485 - DNA, 22 bp, Artificial Sequence
  chemically synthesized
ctcaaatggctatatcctagat

SEQ ID NO: 663486 - DNA, 22 bp, Artificial Sequence
  chemically synthesized
aaatggctatatcctagatcta

SEQ ID NO: 663487 - DNA, 22 bp, Artificial Sequence
  chemically synthesized
tatcctagatctaatcacctga

SEQ ID NO: 663488 - DNA, 22 bp, Artificial Sequence
  chemically synthesized
aaggtggaacagtttcaggtga

SEQ ID NO: 663489 - DNA, 22 bp, Artificial Sequence
  chemically synthesized
gaaggtggaacagtttcaggtg

SEQ ID NO: 663490 - DNA, 22 bp, Artificial Sequence
  chemically synthesized
tgaaggtggaacagtttcaggt

SEQ ID NO: 663491 - DNA, 22 bp, Artificial Sequence
  chemically synthesized
gatctaatcacctgaaactgtt

SEQ ID NO: 663492 - DNA, 22 bp, Artificial Sequence
  chemically synthesized
ttttgaaggtggaacagtttca

SEQ ID NO: 663493 - DNA, 22 bp, Artificial Sequence
  chemically synthesized
atcacctgaaactgttccacct

SEQ ID NO: 663494 - DNA, 22 bp, Artificial Sequence
  chemically synthesized
aaactgttccaccttcaaaata

SEQ ID NO: 663495 - DNA, 22 bp, Artificial Sequence
  chemically synthesized
ttccaccttcaaaataatgttc

SEQ ID NO: 663496 - DNA, 22 bp, Artificial Sequence
  chemically synthesized
caccttcaaaataatgttcatc

SEQ ID NO: 663497 - DNA, 22 bp, Artificial Sequence
  chemically synthesized
caaaataatgttcatctatgat

SEQ ID NO: 663498 - DNA, 22 bp, Artificial Sequence
  chemically synthesized
tggtcagagagaatcatagatg

SEQ ID NO: 663499 - DNA, 22 bp, Artificial Sequence
  chemically synthesized
aaaataatgttcatctatgatt

SEQ ID NO: 663500 - DNA, 22 bp, Artificial Sequence
  chemically synthesized
atctatgattctctctgaccac

SEQ ID NO: 663501 - DNA, 22 bp, Artificial Sequence
  chemically synthesized
aaggtcaagaagttgtggtcag

SEQ ID NO: 663502 - DNA, 22 bp, Artificial Sequence
  chemically synthesized
tgattctctctgaccacaactt

SEQ ID NO: 663503 - DNA, 22 bp, Artificial Sequence
  chemically synthesized
tctctgaccacaacttcttgac

SEQ ID NO: 663504 - DNA, 22 bp, Artificial Sequence
  chemically synthesized
tctgaccacaacttcttgacct

SEQ ID NO: 663505 - DNA, 22 bp, Artificial Sequence
  chemically synthesized
tgaccacaacttcttgaccttc

SEQ ID NO: 663506 - DNA, 22 bp, Artificial Sequence
  chemically synthesized
accacaacttcttgaccttcag

SEQ ID NO: 663507 - DNA, 22 bp, Artificial Sequence
  chemically synthesized
cttgaccttcagttcctttact

SEQ ID NO: 663508 - DNA, 22 bp, Artificial Sequence
  chemically synthesized
ttgaccttcagttcctttacta

SEQ ID NO: 663509 - DNA, 22 bp, Artificial Sequence
  chemically synthesized
gaccttcagttcctttactact

SEQ ID NO: 663510 - DNA, 22 bp, Artificial Sequence
  chemically synthesized
accttcagttcctttactactt

SEQ ID NO: 663511 - DNA, 22 bp, Artificial Sequence
  chemically synthesized
agggaggtaggggaagaagtag

SEQ ID NO: 663512 - DNA, 22 bp, Artificial Sequence
  chemically synthesized
cagttcctttactacttcttcc

SEQ ID NO: 663513 - DNA, 22 bp, Artificial Sequence
  chemically synthesized
cagggaggtaggggaagaagta

SEQ ID NO: 663514 - DNA, 22 bp, Artificial Sequence
  chemically synthesized
agttcctttactacttcttccc

SEQ ID NO: 663515 - DNA, 22 bp, Artificial Sequence
  chemically synthesized
ttcagggaggtaggggaagaag

SEQ ID NO: 663516 - DNA, 22 bp, Artificial Sequence
  chemically synthesized
ctttactacttcttcccctacc

SEQ ID NO: 663517 - DNA, 22 bp, Artificial Sequence
  chemically synthesized
actcttcagggaggtaggggaa

SEQ ID NO: 663518 - DNA, 22 bp, Artificial Sequence
  chemically synthesized
tactacttcttcccctacctcc

SEQ ID NO: 663519 - DNA, 22 bp, Artificial Sequence
  chemically synthesized
actacttcttcccctacctccc

SEQ ID NO: 663520 - DNA, 22 bp, Artificial Sequence
  chemically synthesized
ctacttcttcccctacctccct

SEQ ID NO: 663521 - DNA, 22 bp, Artificial Sequence
  chemically synthesized
cttcttcccctacctccctgaa

SEQ ID NO: 663522 - DNA, 22 bp, Artificial Sequence
  chemically synthesized
cttcccctacctccctgaagag

SEQ ID NO: 663523 - DNA, 22 bp, Artificial Sequence
  chemically synthesized
ttcccctacctccctgaagagt

SEQ ID NO: 663524 - DNA, 22 bp, Artificial Sequence
  chemically synthesized
cccctacctccctgaagagtta

SEQ ID NO: 663525 - DNA, 22 bp, Artificial Sequence
  chemically synthesized
ccctacctccctgaagagttag

SEQ ID NO: 663526 - DNA, 22 bp, Artificial Sequence
  chemically synthesized
cctccctgaagagttagcattt

SEQ ID NO: 663527 - DNA, 22 bp, Artificial Sequence
  chemically synthesized
cctgaagagttagcattttcat

SEQ ID NO: 663528 - DNA, 22 bp, Artificial Sequence
  chemically synthesized
ggaggtagagggatgaaaatgc

SEQ ID NO: 663529 - DNA, 22 bp, Artificial Sequence
  chemically synthesized
aagagttagcattttcatccct

SEQ ID NO: 663530 - DNA, 22 bp, Artificial Sequence
  chemically synthesized
gtaattaggaggtagagggatg

SEQ ID NO: 663531 - DNA, 22 bp, Artificial Sequence
  chemically synthesized
gcattttcatccctctacctcc

SEQ ID NO: 663532 - DNA, 22 bp, Artificial Sequence
  chemically synthesized
tcatccctctacctcctaatta

SEQ ID NO: 663533 - DNA, 22 bp, Artificial Sequence
  chemically synthesized
catccctctacctcctaattac

SEQ ID NO: 663534 - DNA, 22 bp, Artificial Sequence
  chemically synthesized
atccctctacctcctaattacc

SEQ ID NO: 663535 - DNA, 22 bp, Artificial Sequence
  chemically synthesized
tgaacgcatatggaaactggta

SEQ ID NO: 663536 - DNA, 22 bp, Artificial Sequence
  chemically synthesized
tacctcctaattaccagtttcc

SEQ ID NO: 663537 - DNA, 22 bp, Artificial Sequence
  chemically synthesized
cctcctaattaccagtttccat

SEQ ID NO: 663538 - DNA, 22 bp, Artificial Sequence
  chemically synthesized
ctaattaccagtttccatatgc

SEQ ID NO: 663539 - DNA, 22 bp, Artificial Sequence
  chemically synthesized
attaccagtttccatatgcgtt

SEQ ID NO: 663540 - DNA, 22 bp, Artificial Sequence
  chemically synthesized
ccagtttccatatgcgttcaca

SEQ ID NO: 663541 - DNA, 22 bp, Artificial Sequence
  chemically synthesized
ggtaggagaagctgtgaacgca

SEQ ID NO: 663542 - DNA, 22 bp, Artificial Sequence
  chemically synthesized
ttgggtaggagaagctgtgaac

SEQ ID NO: 663543 - DNA, 22 bp, Artificial Sequence
  chemically synthesized
ccatatgcgttcacagcttctc

SEQ ID NO: 663544 - DNA, 22 bp, Artificial Sequence
  chemically synthesized
catatgcgttcacagcttctcc

SEQ ID NO: 663545 - DNA, 22 bp, Artificial Sequence
  chemically synthesized
acaagtccctgttgggtaggag

SEQ ID NO: 663546 - DNA, 22 bp, Artificial Sequence
  chemically synthesized
acagcttctcctacccaacagg

SEQ ID NO: 663547 - DNA, 22 bp, Artificial Sequence
  chemically synthesized
aaatgatactgacaagtccctg

SEQ ID NO: 663548 - DNA, 22 bp, Artificial Sequence
  chemically synthesized
ctcctacccaacagggacttgt

SEQ ID NO: 663549 - DNA, 22 bp, Artificial Sequence
  chemically synthesized
tcctacccaacagggacttgtc

SEQ ID NO: 663550 - DNA, 22 bp, Artificial Sequence
  chemically synthesized
ctacccaacagggacttgtcag

SEQ ID NO: 663551 - DNA, 22 bp, Artificial Sequence
  chemically synthesized
attaaaatgatactgacaagtc

SEQ ID NO: 663552 - DNA, 22 bp, Artificial Sequence
  chemically synthesized
cccaacagggacttgtcagtat

SEQ ID NO: 663553 - DNA, 22 bp, Artificial Sequence
  chemically synthesized
ggcaaaagattgattaaaatga

SEQ ID NO: 663554 - DNA, 22 bp, Artificial Sequence
  chemically synthesized
gggcaaaagattgattaaaatg

SEQ ID NO: 663555 - DNA, 22 bp, Artificial Sequence
  chemically synthesized
gtcagtatcattttaatcaatc

SEQ ID NO: 663556 - DNA, 22 bp, Artificial Sequence
  chemically synthesized
tcagtatcattttaatcaatct

SEQ ID NO: 663557 - DNA, 22 bp, Artificial Sequence
  chemically synthesized
taatcaatcttttgcccaaatc

SEQ ID NO: 663558 - DNA, 22 bp, Artificial Sequence
  chemically synthesized
aatcaatcttttgcccaaatcc

SEQ ID NO: 663559 - DNA, 22 bp, Artificial Sequence
  chemically synthesized
atcaatcttttgcccaaatcct

SEQ ID NO: 663560 - DNA, 22 bp, Artificial Sequence
  chemically synthesized
ggcaagagaagtgaggatttgg

SEQ ID NO: 663561 - DNA, 22 bp, Artificial Sequence
  chemically synthesized
ttgcccaaatcctcacttctct

SEQ ID NO: 663562 - DNA, 22 bp, Artificial Sequence
  chemically synthesized
tgcccaaatcctcacttctctt

SEQ ID NO: 663563 - DNA, 22 bp, Artificial Sequence
  chemically synthesized
gcccaaatcctcacttctcttg

SEQ ID NO: 663564 - DNA, 22 bp, Artificial Sequence
  chemically synthesized
cccaaatcctcacttctcttgc

SEQ ID NO: 663565 - DNA, 22 bp, Artificial Sequence
  chemically synthesized
gggtagggagggaacagctggg

SEQ ID NO: 663566 - DNA, 22 bp, Artificial Sequence
  chemically synthesized
acttctcttgcccagctgttcc

SEQ ID NO: 663567 - DNA, 22 bp, Artificial Sequence
  chemically synthesized
tcctggggtagggagggaacag

SEQ ID NO: 663568 - DNA, 22 bp, Artificial Sequence
  chemically synthesized
ctcttgcccagctgttccctcc

SEQ ID NO: 663569 - DNA, 22 bp, Artificial Sequence
  chemically synthesized
tcttgcccagctgttccctccc

SEQ ID NO: 663570 - DNA, 22 bp, Artificial Sequence
  chemically synthesized
tgtcctggggtagggagggaac

SEQ ID NO: 663571 - DNA, 22 bp, Artificial Sequence
  chemically synthesized
ctgtcctggggtagggagggaa

SEQ ID NO: 663572 - DNA, 22 bp, Artificial Sequence
  chemically synthesized
ttgcccagctgttccctcccta

SEQ ID NO: 663573 - DNA, 22 bp, Artificial Sequence
  chemically synthesized
gcccagctgttccctccctacc

SEQ ID NO: 663574 - DNA, 22 bp, Artificial Sequence
  chemically synthesized
cccagctgttccctccctaccc

SEQ ID NO: 663575 - DNA, 22 bp, Artificial Sequence
  chemically synthesized
ttccctccctaccccaggacag

SEQ ID NO: 663576 - DNA, 22 bp, Artificial Sequence
  chemically synthesized
ggagccagatgcttctgtcctg

SEQ ID NO: 663577 - DNA, 22 bp, Artificial Sequence
  chemically synthesized
cctccctaccccaggacagaag

SEQ ID NO: 663578 - DNA, 22 bp, Artificial Sequence
  chemically synthesized
gggagccagatgcttctgtcct

SEQ ID NO: 663579 - DNA, 22 bp, Artificial Sequence
  chemically synthesized
cctaccccaggacagaagcatc

SEQ ID NO: 663580 - DNA, 22 bp, Artificial Sequence
  chemically synthesized
gcacttgggagccagatgcttc

SEQ ID NO: 663581 - DNA, 22 bp, Artificial Sequence
  chemically synthesized
agcacttgggagccagatgctt

SEQ ID NO: 663582 - DNA, 22 bp, Artificial Sequence
  chemically synthesized
ccccaggacagaagcatctggc

SEQ ID NO: 663583 - DNA, 22 bp, Artificial Sequence
  chemically synthesized
cccaggcacgcttagcacttgg

SEQ ID NO: 663584 - DNA, 22 bp, Artificial Sequence
  chemically synthesized
ccccaggcacgcttagcacttg

SEQ ID NO: 663585 - DNA, 22 bp, Artificial Sequence
  chemically synthesized
gctcccaagtgctaagcgtgcc

SEQ ID NO: 663586 - DNA, 22 bp, Artificial Sequence
  chemically synthesized
ccaagtgctaagcgtgcctggg

SEQ ID NO: 663587 - DNA, 22 bp, Artificial Sequence
  chemically synthesized
caggggtgtggtatttccccag

SEQ ID NO: 663588 - DNA, 22 bp, Artificial Sequence
  chemically synthesized
agcgtgcctggggaaataccac

SEQ ID NO: 663589 - DNA, 22 bp, Artificial Sequence
  chemically synthesized
caatctgcaggggtgtggtatt

SEQ ID NO: 663590 - DNA, 22 bp, Artificial Sequence
  chemically synthesized
gggaaataccacacccctgcag

SEQ ID NO: 663591 - DNA, 22 bp, Artificial Sequence
  chemically synthesized
acggtagctccaatctgcaggg

SEQ ID NO: 663592 - DNA, 22 bp, Artificial Sequence
  chemically synthesized
cacggtagctccaatctgcagg

SEQ ID NO: 663593 - DNA, 22 bp, Artificial Sequence
  chemically synthesized
agtgtttcacggtagctccaat

SEQ ID NO: 663594 - DNA, 22 bp, Artificial Sequence
  chemically synthesized
cagattggagctaccgtgaaac

SEQ ID NO: 663595 - DNA, 22 bp, Artificial Sequence
  chemically synthesized
gagctaccgtgaaacactcagc

SEQ ID NO: 663596 - DNA, 22 bp, Artificial Sequence
  chemically synthesized
tgtgaacccagaggcggctgag

SEQ ID NO: 663597 - DNA, 22 bp, Artificial Sequence
  chemically synthesized
ccgtgaaacactcagccgcctc

SEQ ID NO: 663598 - DNA, 22 bp, Artificial Sequence
  chemically synthesized
aaaaccagctgtgtgaacccag

SEQ ID NO: 663599 - DNA, 22 bp, Artificial Sequence
  chemically synthesized
agccgcctctgggttcacacag

SEQ ID NO: 663600 - DNA, 22 bp, Artificial Sequence
  chemically synthesized
tgggttcacacagctggttttc

SEQ ID NO: 663601 - DNA, 22 bp, Artificial Sequence
  chemically synthesized
ggttcacacagctggttttcaa

SEQ ID NO: 663602 - DNA, 22 bp, Artificial Sequence
  chemically synthesized
acacagctggttttcaactccg

SEQ ID NO: 663603 - DNA, 22 bp, Artificial Sequence
  chemically synthesized
tggagaataagagagagggcgg

SEQ ID NO: 663604 - DNA, 22 bp, Artificial Sequence
  chemically synthesized
gtggagaataagagagagggcg

SEQ ID NO: 663605 - DNA, 22 bp, Artificial Sequence
  chemically synthesized
gttttcaactccgccctctctc

SEQ ID NO: 663606 - DNA, 22 bp, Artificial Sequence
  chemically synthesized
tgtggagaataagagagagggc

SEQ ID NO: 663607 - DNA, 22 bp, Artificial Sequence
  chemically synthesized
tcaactccgccctctctcttat

SEQ ID NO: 663608 - DNA, 22 bp, Artificial Sequence
  chemically synthesized
tctttgtggagaataagagaga

SEQ ID NO: 663609 - DNA, 22 bp, Artificial Sequence
  chemically synthesized
caactccgccctctctcttatt

SEQ ID NO: 663610 - DNA, 22 bp, Artificial Sequence
  chemically synthesized
atctttgtggagaataagagag

SEQ ID NO: 663611 - DNA, 22 bp, Artificial Sequence
  chemically synthesized
aactccgccctctctcttattc

SEQ ID NO: 663612 - DNA, 22 bp, Artificial Sequence
  chemically synthesized
ggcttatctttgtggagaataa

SEQ ID NO: 663613 - DNA, 22 bp, Artificial Sequence
  chemically synthesized
cgccctctctcttattctccac

SEQ ID NO: 663614 - DNA, 22 bp, Artificial Sequence
  chemically synthesized
tctcttattctccacaaagata

SEQ ID NO: 663615 - DNA, 22 bp, Artificial Sequence
  chemically synthesized
tcttattctccacaaagataag

SEQ ID NO: 663616 - DNA, 22 bp, Artificial Sequence
  chemically synthesized
ttattctccacaaagataagcc

SEQ ID NO: 663617 - DNA, 22 bp, Artificial Sequence
  chemically synthesized
attctccacaaagataagccca

SEQ ID NO: 663618 - DNA, 22 bp, Artificial Sequence
  chemically synthesized
ttctccacaaagataagcccaa

SEQ ID NO: 663619 - DNA, 22 bp, Artificial Sequence
  chemically synthesized
tccacaaagataagcccaactt

SEQ ID NO: 663620 - DNA, 22 bp, Artificial Sequence
  chemically synthesized
cacaaagataagcccaacttca

SEQ ID NO: 663621 - DNA, 22 bp, Artificial Sequence
  chemically synthesized
acagcaggagatgatgaagttg

SEQ ID NO: 663622 - DNA, 22 bp, Artificial Sequence
  chemically synthesized
caacgcagttaacagcaggaga

SEQ ID NO: 663623 - DNA, 22 bp, Artificial Sequence
  chemically synthesized
catcatctcctgctgttaactg

SEQ ID NO: 663624 - DNA, 22 bp, Artificial Sequence
  chemically synthesized
atcatctcctgctgttaactgc

SEQ ID NO: 663625 - DNA, 22 bp, Artificial Sequence
  chemically synthesized
ctgctgttaactgcgttgcagg

SEQ ID NO: 663626 - DNA, 22 bp, Artificial Sequence
  chemically synthesized
ctgttaactgcgttgcagggac

SEQ ID NO: 663627 - DNA, 22 bp, Artificial Sequence
  chemically synthesized
tatggagtggagagtccctgca

SEQ ID NO: 663628 - DNA, 22 bp, Artificial Sequence
  chemically synthesized
gtatggagtggagagtccctgc

SEQ ID NO: 663629 - DNA, 22 bp, Artificial Sequence
  chemically synthesized
ttaactgcgttgcagggactct

SEQ ID NO: 663630 - DNA, 22 bp, Artificial Sequence
  chemically synthesized
tgtatggagtggagagtccctg

SEQ ID NO: 663631 - DNA, 22 bp, Artificial Sequence
  chemically synthesized
ttgtatggagtggagagtccct

SEQ ID NO: 663632 - DNA, 22 bp, Artificial Sequence
  chemically synthesized
tttgtatggagtggagagtccc

SEQ ID NO: 663633 - DNA, 22 bp, Artificial Sequence
  chemically synthesized
actgcgttgcagggactctcca

SEQ ID NO: 663634 - DNA, 22 bp, Artificial Sequence
  chemically synthesized
cgttgcagggactctccactcc

SEQ ID NO: 663635 - DNA, 22 bp, Artificial Sequence
  chemically synthesized
cattttttgtatggagtggaga

SEQ ID NO: 663636 - DNA, 22 bp, Artificial Sequence
  chemically synthesized
ccattttttgtatggagtggag

SEQ ID NO: 663637 - DNA, 22 bp, Artificial Sequence
  chemically synthesized
cagggactctccactccataca

SEQ ID NO: 663638 - DNA, 22 bp, Artificial Sequence
  chemically synthesized
taaaggcttccattttttgtat

SEQ ID NO: 663639 - DNA, 22 bp, Artificial Sequence
  chemically synthesized
ctataaaggcttccattttttg

SEQ ID NO: 663640 - DNA, 22 bp, Artificial Sequence
  chemically synthesized
tccactccatacaaaaaatgga

SEQ ID NO: 663641 - DNA, 22 bp, Artificial Sequence
  chemically synthesized
actataaaggcttccatttttt

SEQ ID NO: 663642 - DNA, 22 bp, Artificial Sequence
  chemically synthesized
cactccatacaaaaaatggaag

SEQ ID NO: 663643 - DNA, 22 bp, Artificial Sequence
  chemically synthesized
catacaaaaaatggaagccttt

SEQ ID NO: 663644 - DNA, 22 bp, Artificial Sequence
  chemically synthesized
tatagtaagacatccttcacct

SEQ ID NO: 663645 - DNA, 22 bp, Artificial Sequence
  chemically synthesized
atagtaagacatccttcacctt

SEQ ID NO: 663646 - DNA, 22 bp, Artificial Sequence
  chemically synthesized
tagtaagacatccttcaccttg

SEQ ID NO: 663647 - DNA, 22 bp, Artificial Sequence
  chemically synthesized
agaaaccaggtagcagcaaggt

SEQ ID NO: 663648 - DNA, 22 bp, Artificial Sequence
  chemically synthesized
caccttgctgctacctggtttc

SEQ ID NO: 663649 - DNA, 22 bp, Artificial Sequence
  chemically synthesized
accttgctgctacctggtttct

SEQ ID NO: 663650 - DNA, 22 bp, Artificial Sequence
  chemically synthesized
gctgctacctggtttcttagtt

SEQ ID NO: 663651 - DNA, 22 bp, Artificial Sequence
  chemically synthesized
ctgctacctggtttcttagtta

SEQ ID NO: 663652 - DNA, 22 bp, Artificial Sequence
  chemically synthesized
ggcaggtccaggtaactaagaa

SEQ ID NO: 663653 - DNA, 22 bp, Artificial Sequence
  chemically synthesized
ctacctggtttcttagttacct

SEQ ID NO: 663654 - DNA, 22 bp, Artificial Sequence
  chemically synthesized
cctggtttcttagttacctgga

SEQ ID NO: 663655 - DNA, 22 bp, Artificial Sequence
  chemically synthesized
gtttcttagttacctggacctg

SEQ ID NO: 663656 - DNA, 22 bp, Artificial Sequence
  chemically synthesized
cttagttacctggacctgccca

SEQ ID NO: 663657 - DNA, 22 bp, Artificial Sequence
  chemically synthesized
ttagttacctggacctgcccag

SEQ ID NO: 663658 - DNA, 22 bp, Artificial Sequence
  chemically synthesized
agttacctggacctgcccagat

SEQ ID NO: 663659 - DNA, 22 bp, Artificial Sequence
  chemically synthesized
gttacctggacctgcccagatc

SEQ ID NO: 663660 - DNA, 22 bp, Artificial Sequence
  chemically synthesized
cctggacctgcccagatccttc

SEQ ID NO: 663661 - DNA, 22 bp, Artificial Sequence
  chemically synthesized
gacctgcccagatccttccctc

SEQ ID NO: 663662 - DNA, 22 bp, Artificial Sequence
  chemically synthesized
taatgggtggggtagagggaag

SEQ ID NO: 663663 - DNA, 22 bp, Artificial Sequence
  chemically synthesized
cccagatccttccctctacccc

SEQ ID NO: 663664 - DNA, 22 bp, Artificial Sequence
  chemically synthesized
cactgtaatgggtggggtagag

SEQ ID NO: 663665 - DNA, 22 bp, Artificial Sequence
  chemically synthesized
ccactgtaatgggtggggtaga

SEQ ID NO: 663666 - DNA, 22 bp, Artificial Sequence
  chemically synthesized
ttccactgtaatgggtggggta

SEQ ID NO: 663667 - DNA, 22 bp, Artificial Sequence
  chemically synthesized
tcttccactgtaatgggtgggg

SEQ ID NO: 663668 - DNA, 22 bp, Artificial Sequence
  chemically synthesized
ccctctaccccacccattacag

SEQ ID NO: 663669 - DNA, 22 bp, Artificial Sequence
  chemically synthesized
cctctaccccacccattacagt

SEQ ID NO: 663670 - DNA, 22 bp, Artificial Sequence
  chemically synthesized
taccccacccattacagtggaa

SEQ ID NO: 663671 - DNA, 22 bp, Artificial Sequence
  chemically synthesized
ccccacccattacagtggaaga

SEQ ID NO: 663672 - DNA, 22 bp, Artificial Sequence
  chemically synthesized
cagtggaagagaggtatctctt

SEQ ID NO: 663673 - DNA, 22 bp, Artificial Sequence
  chemically synthesized
ttccctcccttgggctctggat

SEQ ID NO: 663674 - DNA, 22 bp, Artificial Sequence
  chemically synthesized
ccctcccttgggctctggatta

SEQ ID NO: 663675 - DNA, 22 bp, Artificial Sequence
  chemically synthesized
cctcccttgggctctggattac

SEQ ID NO: 663676 - DNA, 22 bp, Artificial Sequence
  chemically synthesized
agagaatacgggcaggtaatcc

SEQ ID NO: 663677 - DNA, 22 bp, Artificial Sequence
  chemically synthesized
ccttgggctctggattacctgc

SEQ ID NO: 663678 - DNA, 22 bp, Artificial Sequence
  chemically synthesized
tcagagaatacgggcaggtaat

SEQ ID NO: 663679 - DNA, 22 bp, Artificial Sequence
  chemically synthesized
gggctctggattacctgcccgt

SEQ ID NO: 663680 - DNA, 22 bp, Artificial Sequence
  chemically synthesized
ggctctggattacctgcccgta

SEQ ID NO: 663681 - DNA, 22 bp, Artificial Sequence
  chemically synthesized
tggattacctgcccgtattctc

SEQ ID NO: 663682 - DNA, 22 bp, Artificial Sequence
  chemically synthesized
gattacctgcccgtattctctg

SEQ ID NO: 663683 - DNA, 22 bp, Artificial Sequence
  chemically synthesized
cctgcccgtattctctgagaac

SEQ ID NO: 663684 - DNA, 22 bp, Artificial Sequence
  chemically synthesized
cccgtattctctgagaacaccc

SEQ ID NO: 663685 - DNA, 22 bp, Artificial Sequence
  chemically synthesized
tctgagaacacccattatttat

SEQ ID NO: 663686 - DNA, 22 bp, Artificial Sequence
  chemically synthesized
tgagaacacccattatttatca

SEQ ID NO: 663687 - DNA, 22 bp, Artificial Sequence
  chemically synthesized
gcccaagaggagatgataaata

SEQ ID NO: 663688 - DNA, 22 bp, Artificial Sequence
  chemically synthesized
agaacacccattatttatcatc

SEQ ID NO: 663689 - DNA, 22 bp, Artificial Sequence
  chemically synthesized
ttggcccaagaggagatgataa

SEQ ID NO: 663690 - DNA, 22 bp, Artificial Sequence
  chemically synthesized
caattattggcccaagaggaga

SEQ ID NO: 663691 - DNA, 22 bp, Artificial Sequence
  chemically synthesized
tttatcatctcctcttgggcca

SEQ ID NO: 663692 - DNA, 22 bp, Artificial Sequence
  chemically synthesized
atcatctcctcttgggccaata

SEQ ID NO: 663693 - DNA, 22 bp, Artificial Sequence
  chemically synthesized
tcatctcctcttgggccaataa

SEQ ID NO: 663694 - DNA, 22 bp, Artificial Sequence
  chemically synthesized
ctcttgggccaataattgtaat

SEQ ID NO: 663695 - DNA, 22 bp, Artificial Sequence
  chemically synthesized
ttgggccaataattgtaatctc

SEQ ID NO: 663696 - DNA, 22 bp, Artificial Sequence
  chemically synthesized
gggccaataattgtaatctcac

SEQ ID NO: 663697 - DNA, 22 bp, Artificial Sequence
  chemically synthesized
ggccaataattgtaatctcacc

SEQ ID NO: 663698 - DNA, 22 bp, Artificial Sequence
  chemically synthesized
tatgagtatgagaagacagggt

SEQ ID NO: 663699 - DNA, 22 bp, Artificial Sequence
  chemically synthesized
atatgagtatgagaagacaggg

SEQ ID NO: 663700 - DNA, 22 bp, Artificial Sequence
  chemically synthesized
taatctcaccctgtcttctcat

SEQ ID NO: 663701 - DNA, 22 bp, Artificial Sequence
  chemically synthesized
accctgtcttctcatactcata

SEQ ID NO: 663702 - DNA, 22 bp, Artificial Sequence
  chemically synthesized
gtgggaatgtatttatatgagt

SEQ ID NO: 663703 - DNA, 22 bp, Artificial Sequence
  chemically synthesized
tcttctcatactcatataaata

SEQ ID NO: 663704 - DNA, 22 bp, Artificial Sequence
  chemically synthesized
ctcatactcatataaatacatt

SEQ ID NO: 663705 - DNA, 22 bp, Artificial Sequence
  chemically synthesized
tcatactcatataaatacattc

SEQ ID NO: 663706 - DNA, 22 bp, Artificial Sequence
  chemically synthesized
atactcatataaatacattccc

SEQ ID NO: 663707 - DNA, 22 bp, Artificial Sequence
  chemically synthesized
atataaatacattcccacgaat

SEQ ID NO: 663708 - DNA, 22 bp, Artificial Sequence
  chemically synthesized
ccacgaatactatatgtttggc

SEQ ID NO: 663709 - DNA, 22 bp, Artificial Sequence
  chemically synthesized
aatcaaatgcaggccaaacata

SEQ ID NO: 663710 - DNA, 22 bp, Artificial Sequence
  chemically synthesized
caatcaaatgcaggccaaacat

SEQ ID NO: 663711 - DNA, 22 bp, Artificial Sequence
  chemically synthesized
tcaatcaaatgcaggccaaaca

SEQ ID NO: 663712 - DNA, 22 bp, Artificial Sequence
  chemically synthesized
ttcaatcaaatgcaggccaaac

SEQ ID NO: 663713 - DNA, 22 bp, Artificial Sequence
  chemically synthesized
tttcaatcaaatgcaggccaaa

SEQ ID NO: 663714 - DNA, 22 bp, Artificial Sequence
  chemically synthesized
ttttcaatcaaatgcaggccaa

SEQ ID NO: 663715 - DNA, 22 bp, Artificial Sequence
  chemically synthesized
tatgtttggcctgcatttgatt

SEQ ID NO: 663716 - DNA, 22 bp, Artificial Sequence
  chemically synthesized
cgtggatttttttcaatcaaat

SEQ ID NO: 663717 - DNA, 22 bp, Artificial Sequence
  chemically synthesized
acgtggatttttttcaatcaaa

SEQ ID NO: 663718 - DNA, 22 bp, Artificial Sequence
  chemically synthesized
ggcctgcatttgattgaaaaaa

SEQ ID NO: 663719 - DNA, 22 bp, Artificial Sequence
  chemically synthesized
gcctgcatttgattgaaaaaaa

SEQ ID NO: 663720 - DNA, 22 bp, Artificial Sequence
  chemically synthesized
ggtcaacttacgtggatttttt

SEQ ID NO: 663721 - DNA, 22 bp, Artificial Sequence
  chemically synthesized
catttgattgaaaaaaatccac

SEQ ID NO: 663722 - DNA, 22 bp, Artificial Sequence
  chemically synthesized
gggtcaacttacgtggattttt

SEQ ID NO: 663723 - DNA, 22 bp, Artificial Sequence
  chemically synthesized
cttgggtcaacttacgtggatt

SEQ ID NO: 663724 - DNA, 22 bp, Artificial Sequence
  chemically synthesized
gattgaaaaaaatccacgtaag

SEQ ID NO: 663725 - DNA, 22 bp, Artificial Sequence
  chemically synthesized
attgaaaaaaatccacgtaagt

SEQ ID NO: 663726 - DNA, 22 bp, Artificial Sequence
  chemically synthesized
aactgcttgggtcaacttacgt

SEQ ID NO: 663727 - DNA, 22 bp, Artificial Sequence
  chemically synthesized
gaactgcttgggtcaacttacg

SEQ ID NO: 663728 - DNA, 22 bp, Artificial Sequence
  chemically synthesized
aaaaaaatccacgtaagttgac

SEQ ID NO: 663729 - DNA, 22 bp, Artificial Sequence
  chemically synthesized
aacaacatgggtttgaactgct

SEQ ID NO: 663730 - DNA, 22 bp, Artificial Sequence
  chemically synthesized
gaacaacatgggtttgaactgc

SEQ ID NO: 663731 - DNA, 22 bp, Artificial Sequence
  chemically synthesized
acccaagcagttcaaacccatg

SEQ ID NO: 663732 - DNA, 22 bp, Artificial Sequence
  chemically synthesized
atccttgaacaacatgggtttg

SEQ ID NO: 663733 - DNA, 22 bp, Artificial Sequence
  chemically synthesized
aaacccatgttgttcaaggatc

SEQ ID NO: 663734 - DNA, 22 bp, Artificial Sequence
  chemically synthesized
ttcaaggatcaatgtatacaca

SEQ ID NO: 663735 - DNA, 22 bp, Artificial Sequence
  chemically synthesized
aaggatcaatgtatacacacac

SEQ ID NO: 663736 - DNA, 22 bp, Artificial Sequence
  chemically synthesized
tgtggcacaatatgtgtatata

SEQ ID NO: 663737 - DNA, 22 bp, Artificial Sequence
  chemically synthesized
aaatgtcattatgtggcacaat

SEQ ID NO: 663738 - DNA, 22 bp, Artificial Sequence
  chemically synthesized
atatacacatattgtgccacat

SEQ ID NO: 663739 - DNA, 22 bp, Artificial Sequence
  chemically synthesized
tatacacatattgtgccacata

SEQ ID NO: 663740 - DNA, 22 bp, Artificial Sequence
  chemically synthesized
actgaaatgtcattatgtggca

SEQ ID NO: 663741 - DNA, 22 bp, Artificial Sequence
  chemically synthesized
ttgactgaaatgtcattatgtg

SEQ ID NO: 663742 - DNA, 22 bp, Artificial Sequence
  chemically synthesized
tgccacataatgacatttcagt

SEQ ID NO: 663743 - DNA, 22 bp, Artificial Sequence
  chemically synthesized
tcatataggcagtccattgttg

SEQ ID NO: 663744 - DNA, 22 bp, Artificial Sequence
  chemically synthesized
gctgtcatataggcagtccatt

SEQ ID NO: 663745 - DNA, 22 bp, Artificial Sequence
  chemically synthesized
cagtcaacaatggactgcctat

SEQ ID NO: 663746 - DNA, 22 bp, Artificial Sequence
  chemically synthesized
agtcaacaatggactgcctata

SEQ ID NO: 663747 - DNA, 22 bp, Artificial Sequence
  chemically synthesized
atgggctcgctgtcatataggc

SEQ ID NO: 663748 - DNA, 22 bp, Artificial Sequence
  chemically synthesized
cctatatgacagcgagcccatg

SEQ ID NO: 663749 - DNA, 22 bp, Artificial Sequence
  chemically synthesized
tatgacagcgagcccatgagat

SEQ ID NO: 663750 - DNA, 22 bp, Artificial Sequence
  chemically synthesized
cactattatatatttttactgt

SEQ ID NO: 663751 - DNA, 22 bp, Artificial Sequence
  chemically synthesized
aacatagaaagatacagtaaaa

SEQ ID NO: 663752 - DNA, 22 bp, Artificial Sequence
  chemically synthesized
aaacatagaaagatacagtaaa

SEQ ID NO: 663753 - DNA, 22 bp, Artificial Sequence
  chemically synthesized
ttatatatttttactgtatctt

SEQ ID NO: 663754 - DNA, 22 bp, Artificial Sequence
  chemically synthesized
tatatttttactgtatctttct

SEQ ID NO: 663755 - DNA, 22 bp, Artificial Sequence
  chemically synthesized
ttactgtatctttctatgttta

SEQ ID NO: 663756 - DNA, 22 bp, Artificial Sequence
  chemically synthesized
tactgtatctttctatgtttaa

SEQ ID NO: 663757 - DNA, 22 bp, Artificial Sequence
  chemically synthesized
actgtatctttctatgtttaaa

SEQ ID NO: 663758 - DNA, 22 bp, Artificial Sequence
  chemically synthesized
ctgtatctttctatgtttaaat

SEQ ID NO: 663759 - DNA, 22 bp, Artificial Sequence
  chemically synthesized
tgtatcgaaacgtatttaaaca

SEQ ID NO: 663760 - DNA, 22 bp, Artificial Sequence
  chemically synthesized
tatctttctatgtttaaatacg

SEQ ID NO: 663761 - DNA, 22 bp, Artificial Sequence
  chemically synthesized
tctatgtttaaatacgtttcga

SEQ ID NO: 663762 - DNA, 22 bp, Artificial Sequence
  chemically synthesized
ctatgtttaaatacgtttcgat

SEQ ID NO: 663763 - DNA, 22 bp, Artificial Sequence
  chemically synthesized
tatgtttaaatacgtttcgata

SEQ ID NO: 663764 - DNA, 22 bp, Artificial Sequence
  chemically synthesized
tgtttaaatacgtttcgataca

SEQ ID NO: 663765 - DNA, 22 bp, Artificial Sequence
  chemically synthesized
aaatacgtttcgatacacaata

SEQ ID NO: 663766 - DNA, 22 bp, Artificial Sequence
  chemically synthesized
aatacgtttcgatacacaatac

SEQ ID NO: 663767 - DNA, 22 bp, Artificial Sequence
  chemically synthesized
gaacacaatagtaagtattgtg

SEQ ID NO: 663768 - DNA, 22 bp, Artificial Sequence
  chemically synthesized
cgatacacaatacttactattg

SEQ ID NO: 663769 - DNA, 22 bp, Artificial Sequence
  chemically synthesized
gatacacaatacttactattgt

SEQ ID NO: 663770 - DNA, 22 bp, Artificial Sequence
  chemically synthesized
taggcagttggaacacaatagt

SEQ ID NO: 663771 - DNA, 22 bp, Artificial Sequence
  chemically synthesized
aatactgtaggcagttggaaca

SEQ ID NO: 663772 - DNA, 22 bp, Artificial Sequence
  chemically synthesized
tgaatactgtaggcagttggaa

SEQ ID NO: 663773 - DNA, 22 bp, Artificial Sequence
  chemically synthesized
actattgtgttccaactgccta

SEQ ID NO: 663774 - DNA, 22 bp, Artificial Sequence
  chemically synthesized
ttctgaatactgtaggcagttg

SEQ ID NO: 663775 - DNA, 22 bp, Artificial Sequence
  chemically synthesized
ctattgtgttccaactgcctac

SEQ ID NO: 663776 - DNA, 22 bp, Artificial Sequence
  chemically synthesized
ttgtgttccaactgcctacagt

SEQ ID NO: 663777 - DNA, 22 bp, Artificial Sequence
  chemically synthesized
tgttccaactgcctacagtatt

SEQ ID NO: 663778 - DNA, 22 bp, Artificial Sequence
  chemically synthesized
caactgcctacagtattcagaa

SEQ ID NO: 663779 - DNA, 22 bp, Artificial Sequence
  chemically synthesized
tacagcacgtgactgttctgaa

SEQ ID NO: 663780 - DNA, 22 bp, Artificial Sequence
  chemically synthesized
cctacagtattcagaacagtca

SEQ ID NO: 663781 - DNA, 22 bp, Artificial Sequence
  chemically synthesized
cagtattcagaacagtcacgtg

SEQ ID NO: 663782 - DNA, 22 bp, Artificial Sequence
  chemically synthesized
tacacctgtacagcacgtgact

SEQ ID NO: 663783 - DNA, 22 bp, Artificial Sequence
  chemically synthesized
ggctatacacctgtacagcacg

SEQ ID NO: 663784 - DNA, 22 bp, Artificial Sequence
  chemically synthesized
agaacagtcacgtgctgtacag

SEQ ID NO: 663785 - DNA, 22 bp, Artificial Sequence
  chemically synthesized
ctaggctatacacctgtacagc

SEQ ID NO: 663786 - DNA, 22 bp, Artificial Sequence
  chemically synthesized
ctcctaggctatacacctgtac

SEQ ID NO: 663787 - DNA, 22 bp, Artificial Sequence
  chemically synthesized
ttgctcctaggctatacacctg

SEQ ID NO: 663788 - DNA, 22 bp, Artificial Sequence
  chemically synthesized
tacaggtgtatagcctaggagc

SEQ ID NO: 663789 - DNA, 22 bp, Artificial Sequence
  chemically synthesized
tatgggatagcctattgctcct

SEQ ID NO: 663790 - DNA, 22 bp, Artificial Sequence
  chemically synthesized
ggctgtatgggatagcctattg

SEQ ID NO: 663791 - DNA, 22 bp, Artificial Sequence
  chemically synthesized
ggagcaataggctatcccatac

SEQ ID NO: 663792 - DNA, 22 bp, Artificial Sequence
  chemically synthesized
gtacacacctaggctgtatggg

SEQ ID NO: 663793 - DNA, 22 bp, Artificial Sequence
  chemically synthesized
tcccatacagcctaggtgtgta

SEQ ID NO: 663794 - DNA, 22 bp, Artificial Sequence
  chemically synthesized
gatggtatagcctagtacacac

SEQ ID NO: 663795 - DNA, 22 bp, Artificial Sequence
  chemically synthesized
agatggtatagcctagtacaca

SEQ ID NO: 663796 - DNA, 22 bp, Artificial Sequence
  chemically synthesized
cacaaacttagatggtatagcc

SEQ ID NO: 663797 - DNA, 22 bp, Artificial Sequence
  chemically synthesized
ggtgtgtactaggctataccat

SEQ ID NO: 663798 - DNA, 22 bp, Artificial Sequence
  chemically synthesized
ggctataccatctaagtttgtg

SEQ ID NO: 663799 - DNA, 22 bp, Artificial Sequence
  chemically synthesized
taccatctaagtttgtgtagta

SEQ ID NO: 663800 - DNA, 22 bp, Artificial Sequence
  chemically synthesized
tgtcaatataggagagtactac

SEQ ID NO: 663801 - DNA, 22 bp, Artificial Sequence
  chemically synthesized
ttatgtcaatataggagagtac

SEQ ID NO: 663802 - DNA, 22 bp, Artificial Sequence
  chemically synthesized
agtttgtgtagtactctcctat

SEQ ID NO: 663803 - DNA, 22 bp, Artificial Sequence
  chemically synthesized
ttgttatgtcaatataggagag

SEQ ID NO: 663804 - DNA, 22 bp, Artificial Sequence
  chemically synthesized
gttgttatgtcaatataggaga

SEQ ID NO: 663805 - DNA, 22 bp, Artificial Sequence
  chemically synthesized
tgttgttatgtcaatataggag

SEQ ID NO: 663806 - DNA, 22 bp, Artificial Sequence
  chemically synthesized
gtgtagtactctcctatattga

SEQ ID NO: 663807 - DNA, 22 bp, Artificial Sequence
  chemically synthesized
tgtagtactctcctatattgac

SEQ ID NO: 663808 - DNA, 22 bp, Artificial Sequence
  chemically synthesized
ggcaactttgttgttatgtcaa

SEQ ID NO: 663809 - DNA, 22 bp, Artificial Sequence
  chemically synthesized
ttaggcaactttgttgttatgt

SEQ ID NO: 663810 - DNA, 22 bp, Artificial Sequence
  chemically synthesized
tcctatattgacataacaacaa

SEQ ID NO: 663811 - DNA, 22 bp, Artificial Sequence
  chemically synthesized
ctatattgacataacaacaaag

SEQ ID NO: 663812 - DNA, 22 bp, Artificial Sequence
  chemically synthesized
tattgacataacaacaaagttg

SEQ ID NO: 663813 - DNA, 22 bp, Artificial Sequence
  chemically synthesized
acataacaacaaagttgcctaa

SEQ ID NO: 663814 - DNA, 22 bp, Artificial Sequence
  chemically synthesized
agaaatgtgttgttaggcaact

SEQ ID NO: 663815 - DNA, 22 bp, Artificial Sequence
  chemically synthesized
taagaaatgtgttgttaggcaa

SEQ ID NO: 663816 - DNA, 22 bp, Artificial Sequence
  chemically synthesized
cctaacaacacatttcttagaa

SEQ ID NO: 663817 - DNA, 22 bp, Artificial Sequence
  chemically synthesized
acaatggggatatgttctaaga

SEQ ID NO: 663818 - DNA, 22 bp, Artificial Sequence
  chemically synthesized
aacaatggggatatgttctaag

SEQ ID NO: 663819 - DNA, 22 bp, Artificial Sequence
  chemically synthesized
acaacacatttcttagaacata

SEQ ID NO: 663820 - DNA, 22 bp, Artificial Sequence
  chemically synthesized
cttaacaatggggatatgttct

SEQ ID NO: 663821 - DNA, 22 bp, Artificial Sequence
  chemically synthesized
cttagaacatatccccattgtt

SEQ ID NO: 663822 - DNA, 22 bp, Artificial Sequence
  chemically synthesized
ttagaacatatccccattgtta

SEQ ID NO: 663823 - DNA, 22 bp, Artificial Sequence
  chemically synthesized
agaacatatccccattgttaag

SEQ ID NO: 663824 - DNA, 22 bp, Artificial Sequence
  chemically synthesized
gaacatatccccattgttaagc

SEQ ID NO: 663825 - DNA, 22 bp, Artificial Sequence
  chemically synthesized
atggaaatgtatgtacagtcac

SEQ ID NO: 663826 - DNA, 22 bp, Artificial Sequence
  chemically synthesized
ttaagcaacacgtgactgtaca

SEQ ID NO: 663827 - DNA, 22 bp, Artificial Sequence
  chemically synthesized
agcaacacgtgactgtacatac

SEQ ID NO: 663828 - DNA, 22 bp, Artificial Sequence
  chemically synthesized
aggagttaatggaaatgtatgt

SEQ ID NO: 663829 - DNA, 22 bp, Artificial Sequence
  chemically synthesized
gagggggctgaggagttaatgg

SEQ ID NO: 663830 - DNA, 22 bp, Artificial Sequence
  chemically synthesized
tacatacatttccattaactcc

SEQ ID NO: 663831 - DNA, 22 bp, Artificial Sequence
  chemically synthesized
gttggagggggctgaggagtta

SEQ ID NO: 663832 - DNA, 22 bp, Artificial Sequence
  chemically synthesized
ccattaactcctcagccccctc

SEQ ID NO: 663833 - DNA, 22 bp, Artificial Sequence
  chemically synthesized
cattaactcctcagccccctcc

SEQ ID NO: 663834 - DNA, 22 bp, Artificial Sequence
  chemically synthesized
actcctcagccccctccaacta

SEQ ID NO: 663835 - DNA, 22 bp, Artificial Sequence
  chemically synthesized
ctcagccccctccaactagcta

SEQ ID NO: 663836 - DNA, 22 bp, Artificial Sequence
  chemically synthesized
agccccctccaactagctacca

SEQ ID NO: 663837 - DNA, 22 bp, Artificial Sequence
  chemically synthesized
tgaaggggagaagagtggggtg

SEQ ID NO: 663838 - DNA, 22 bp, Artificial Sequence
  chemically synthesized
caactagctaccaccccactct

SEQ ID NO: 663839 - DNA, 22 bp, Artificial Sequence
  chemically synthesized
atgaaggggagaagagtggggt

SEQ ID NO: 663840 - DNA, 22 bp, Artificial Sequence
  chemically synthesized
cttatgaaggggagaagagtgg

SEQ ID NO: 663841 - DNA, 22 bp, Artificial Sequence
  chemically synthesized
acttatgaaggggagaagagtg

SEQ ID NO: 663842 - DNA, 22 bp, Artificial Sequence
  chemically synthesized
gctaccaccccactcttctccc

SEQ ID NO: 663843 - DNA, 22 bp, Artificial Sequence
  chemically synthesized
ccaccccactcttctccccttc

SEQ ID NO: 663844 - DNA, 22 bp, Artificial Sequence
  chemically synthesized
gagaaatttacttatgaagggg

SEQ ID NO: 663845 - DNA, 22 bp, Artificial Sequence
  chemically synthesized
ggagaaatttacttatgaaggg

SEQ ID NO: 663846 - DNA, 22 bp, Artificial Sequence
  chemically synthesized
ttggagaaatttacttatgaag

SEQ ID NO: 663847 - DNA, 22 bp, Artificial Sequence
  chemically synthesized
ttctccccttcataagtaaatt

SEQ ID NO: 663848 - DNA, 22 bp, Artificial Sequence
  chemically synthesized
ctccccttcataagtaaatttc

SEQ ID NO: 663849 - DNA, 22 bp, Artificial Sequence
  chemically synthesized
tccccttcataagtaaatttct

SEQ ID NO: 663850 - DNA, 22 bp, Artificial Sequence
  chemically synthesized
cccttcataagtaaatttctcc

SEQ ID NO: 663851 - DNA, 22 bp, Artificial Sequence
  chemically synthesized
cataagtaaatttctccaagaa

SEQ ID NO: 663852 - DNA, 22 bp, Artificial Sequence
  chemically synthesized
ataagtaaatttctccaagaat

SEQ ID NO: 663853 - DNA, 22 bp, Artificial Sequence
  chemically synthesized
gagaaggtatgaatgattcttg

SEQ ID NO: 663854 - DNA, 22 bp, Artificial Sequence
  chemically synthesized
ctccaagaatcattcatacctt

SEQ ID NO: 663855 - DNA, 22 bp, Artificial Sequence
  chemically synthesized
tccaagaatcattcataccttc

SEQ ID NO: 663856 - DNA, 22 bp, Artificial Sequence
  chemically synthesized
caagaatcattcataccttctc

SEQ ID NO: 663857 - DNA, 22 bp, Artificial Sequence
  chemically synthesized
ataccttctctaattctccact

SEQ ID NO: 663858 - DNA, 22 bp, Artificial Sequence
  chemically synthesized
aaaagtgaaccaaaagtggaga

SEQ ID NO: 663859 - DNA, 22 bp, Artificial Sequence
  chemically synthesized
ctctaattctccacttttggtt

SEQ ID NO: 663860 - DNA, 22 bp, Artificial Sequence
  chemically synthesized
tctaattctccacttttggttc

SEQ ID NO: 663861 - DNA, 22 bp, Artificial Sequence
  chemically synthesized
taattctccacttttggttcac

SEQ ID NO: 663862 - DNA, 22 bp, Artificial Sequence
  chemically synthesized
attctccacttttggttcactt

SEQ ID NO: 663863 - DNA, 22 bp, Artificial Sequence
  chemically synthesized
tccacttttggttcacttttga

SEQ ID NO: 663864 - DNA, 22 bp, Artificial Sequence
  chemically synthesized
cacttttggttcacttttgaac

SEQ ID NO: 663865 - DNA, 22 bp, Artificial Sequence
  chemically synthesized
ttggttcacttttgaactcacc

SEQ ID NO: 663866 - DNA, 22 bp, Artificial Sequence
  chemically synthesized
tggttcacttttgaactcacca

SEQ ID NO: 663867 - DNA, 22 bp, Artificial Sequence
  chemically synthesized
ggttcacttttgaactcaccac

SEQ ID NO: 663868 - DNA, 22 bp, Artificial Sequence
  chemically synthesized
gttcacttttgaactcaccaca

SEQ ID NO: 663869 - DNA, 22 bp, Artificial Sequence
  chemically synthesized
acttttgaactcaccacaccac

SEQ ID NO: 663870 - DNA, 22 bp, Artificial Sequence
  chemically synthesized
gaggcacagtggaagtggtgtg

SEQ ID NO: 663871 - DNA, 22 bp, Artificial Sequence
  chemically synthesized
agaggcacagtggaagtggtgt

SEQ ID NO: 663872 - DNA, 22 bp, Artificial Sequence
  chemically synthesized
ttgaactcaccacaccacttcc

SEQ ID NO: 663873 - DNA, 22 bp, Artificial Sequence
  chemically synthesized
tagaggcacagtggaagtggtg

SEQ ID NO: 663874 - DNA, 22 bp, Artificial Sequence
  chemically synthesized
tgaactcaccacaccacttcca

SEQ ID NO: 663875 - DNA, 22 bp, Artificial Sequence
  chemically synthesized
gaactcaccacaccacttccac

SEQ ID NO: 663876 - DNA, 22 bp, Artificial Sequence
  chemically synthesized
aactcaccacaccacttccact

SEQ ID NO: 663877 - DNA, 22 bp, Artificial Sequence
  chemically synthesized
accacaccacttccactgtgcc

SEQ ID NO: 663878 - DNA, 22 bp, Artificial Sequence
  chemically synthesized
gtgagattttagaggcacagtg

SEQ ID NO: 663879 - DNA, 22 bp, Artificial Sequence
  chemically synthesized
ggtgagattttagaggcacagt

SEQ ID NO: 663880 - DNA, 22 bp, Artificial Sequence
  chemically synthesized
tggtgagattttagaggcacag

SEQ ID NO: 663881 - DNA, 22 bp, Artificial Sequence
  chemically synthesized
gtaactttggtgagattttaga

SEQ ID NO: 663882 - DNA, 22 bp, Artificial Sequence
  chemically synthesized
ccactgtgcctctaaaatctca

SEQ ID NO: 663883 - DNA, 22 bp, Artificial Sequence
  chemically synthesized
cactgtgcctctaaaatctcac

SEQ ID NO: 663884 - DNA, 22 bp, Artificial Sequence
  chemically synthesized
tgcctctaaaatctcaccaaag

SEQ ID NO: 663885 - DNA, 22 bp, Artificial Sequence
  chemically synthesized
taaaatctcaccaaagttacta

SEQ ID NO: 663886 - DNA, 22 bp, Artificial Sequence
  chemically synthesized
aaatctcaccaaagttactagg

SEQ ID NO: 663887 - DNA, 22 bp, Artificial Sequence
  chemically synthesized
gcaacaggaaggtccctagtaa

SEQ ID NO: 663888 - DNA, 22 bp, Artificial Sequence
  chemically synthesized
agcaacaggaaggtccctagta

SEQ ID NO: 663889 - DNA, 22 bp, Artificial Sequence
  chemically synthesized
accaaagttactagggaccttc

SEQ ID NO: 663890 - DNA, 22 bp, Artificial Sequence
  chemically synthesized
gacttagcaacaggaaggtccc

SEQ ID NO: 663891 - DNA, 22 bp, Artificial Sequence
  chemically synthesized
ctagggaccttcctgttgctaa

SEQ ID NO: 663892 - DNA, 22 bp, Artificial Sequence
  chemically synthesized
gggaccttcctgttgctaagtc

SEQ ID NO: 663893 - DNA, 22 bp, Artificial Sequence
  chemically synthesized
cggaaaatgcccattggactta

SEQ ID NO: 663894 - DNA, 22 bp, Artificial Sequence
  chemically synthesized
cctgttgctaagtccaatgggc

SEQ ID NO: 663895 - DNA, 22 bp, Artificial Sequence
  chemically synthesized
ctgttgctaagtccaatgggca

SEQ ID NO: 663896 - DNA, 22 bp, Artificial Sequence
  chemically synthesized
ttgctaagtccaatgggcattt

SEQ ID NO: 663897 - DNA, 22 bp, Artificial Sequence
  chemically synthesized
ctaagtccaatgggcattttcc

SEQ ID NO: 663898 - DNA, 22 bp, Artificial Sequence
  chemically synthesized
agtccaatgggcattttccgca

SEQ ID NO: 663899 - DNA, 22 bp, Artificial Sequence
  chemically synthesized
ggatgtcagcataaagttgcgg

SEQ ID NO: 663900 - DNA, 22 bp, Artificial Sequence
  chemically synthesized
ctgggatgtcagcataaagttg

SEQ ID NO: 663901 - DNA, 22 bp, Artificial Sequence
  chemically synthesized
tccgcaactttatgctgacatc

SEQ ID NO: 663902 - DNA, 22 bp, Artificial Sequence
  chemically synthesized
ccgcaactttatgctgacatcc

SEQ ID NO: 663903 - DNA, 22 bp, Artificial Sequence
  chemically synthesized
cgcaactttatgctgacatccc

SEQ ID NO: 663904 - DNA, 22 bp, Artificial Sequence
  chemically synthesized
ccagggtcagatgttgctggga

SEQ ID NO: 663905 - DNA, 22 bp, Artificial Sequence
  chemically synthesized
tatgctgacatcccagcaacat

SEQ ID NO: 663906 - DNA, 22 bp, Artificial Sequence
  chemically synthesized
atgctgacatcccagcaacatc

SEQ ID NO: 663907 - DNA, 22 bp, Artificial Sequence
  chemically synthesized
tgctgacatcccagcaacatct

SEQ ID NO: 663908 - DNA, 22 bp, Artificial Sequence
  chemically synthesized
acatcccagcaacatctgaccc

SEQ ID NO: 663909 - DNA, 22 bp, Artificial Sequence
  chemically synthesized
catgggaagaaagaaagaaccc

SEQ ID NO: 663910 - DNA, 22 bp, Artificial Sequence
  chemically synthesized
accctggtaacgggttctttct

SEQ ID NO: 663911 - DNA, 22 bp, Artificial Sequence
  chemically synthesized
gtaacgggttctttctttcttc

SEQ ID NO: 663912 - DNA, 22 bp, Artificial Sequence
  chemically synthesized
tgatgccacatgctccatggga

SEQ ID NO: 663913 - DNA, 22 bp, Artificial Sequence
  chemically synthesized
tttctttcttcccatggagcat

SEQ ID NO: 663914 - DNA, 22 bp, Artificial Sequence
  chemically synthesized
tctttcttcccatggagcatgt

SEQ ID NO: 663915 - DNA, 22 bp, Artificial Sequence
  chemically synthesized
ctttcttcccatggagcatgtg

SEQ ID NO: 663916 - DNA, 22 bp, Artificial Sequence
  chemically synthesized
tttcttcccatggagcatgtgg

SEQ ID NO: 663917 - DNA, 22 bp, Artificial Sequence
  chemically synthesized
tcttcccatggagcatgtggca

SEQ ID NO: 663918 - DNA, 22 bp, Artificial Sequence
  chemically synthesized
cttcccatggagcatgtggcat

SEQ ID NO: 663919 - DNA, 22 bp, Artificial Sequence
  chemically synthesized
caagaggttatgatgccacatg

SEQ ID NO: 663920 - DNA, 22 bp, Artificial Sequence
  chemically synthesized
ttcccatggagcatgtggcatc

SEQ ID NO: 663921 - DNA, 22 bp, Artificial Sequence
  chemically synthesized
cccatggagcatgtggcatcat

SEQ ID NO: 663922 - DNA, 22 bp, Artificial Sequence
  chemically synthesized
ccatggagcatgtggcatcata

SEQ ID NO: 663923 - DNA, 22 bp, Artificial Sequence
  chemically synthesized
ttggaattttccttctttcctc

SEQ ID NO: 663924 - DNA, 22 bp, Artificial Sequence
  chemically synthesized
ggaattttccttctttcctcct

SEQ ID NO: 663925 - DNA, 22 bp, Artificial Sequence
  chemically synthesized
gaattttccttctttcctcctg

SEQ ID NO: 663926 - DNA, 22 bp, Artificial Sequence
  chemically synthesized
caaaggaatggccaggaggaaa

SEQ ID NO: 663927 - DNA, 22 bp, Artificial Sequence
  chemically synthesized
tccttctttcctcctggccatt

SEQ ID NO: 663928 - DNA, 22 bp, Artificial Sequence
  chemically synthesized
ccttctttcctcctggccattc

SEQ ID NO: 663929 - DNA, 22 bp, Artificial Sequence
  chemically synthesized
cttctttcctcctggccattcc

SEQ ID NO: 663930 - DNA, 22 bp, Artificial Sequence
  chemically synthesized
ctttcctcctggccattccttt

SEQ ID NO: 663931 - DNA, 22 bp, Artificial Sequence
  chemically synthesized
tttcctcctggccattcctttg

SEQ ID NO: 663932 - DNA, 22 bp, Artificial Sequence
  chemically synthesized
cagaagggactgcaaaggaatg

SEQ ID NO: 663933 - DNA, 22 bp, Artificial Sequence
  chemically synthesized
tcctcctggccattcctttgca

SEQ ID NO: 663934 - DNA, 22 bp, Artificial Sequence
  chemically synthesized
cctcctggccattcctttgcag

SEQ ID NO: 663935 - DNA, 22 bp, Artificial Sequence
  chemically synthesized
ctcctggccattcctttgcagt

SEQ ID NO: 663936 - DNA, 22 bp, Artificial Sequence
  chemically synthesized
ctggccattcctttgcagtccc

SEQ ID NO: 663937 - DNA, 22 bp, Artificial Sequence
  chemically synthesized
gccattcctttgcagtcccttc

SEQ ID NO: 663938 - DNA, 22 bp, Artificial Sequence
  chemically synthesized
ctttgcagtcccttctgtaggt

SEQ ID NO: 663939 - DNA, 22 bp, Artificial Sequence
  chemically synthesized
tgcagtcccttctgtaggttgc

SEQ ID NO: 663940 - DNA, 22 bp, Artificial Sequence
  chemically synthesized
gcagtcccttctgtaggttgct

SEQ ID NO: 663941 - DNA, 22 bp, Artificial Sequence
  chemically synthesized
ggacacaggataagcaacctac

SEQ ID NO: 663942 - DNA, 22 bp, Artificial Sequence
  chemically synthesized
cagtcccttctgtaggttgctt

SEQ ID NO: 663943 - DNA, 22 bp, Artificial Sequence
  chemically synthesized
aggacacaggataagcaaccta

SEQ ID NO: 663944 - DNA, 22 bp, Artificial Sequence
  chemically synthesized
tttaggacacaggataagcaac

SEQ ID NO: 663945 - DNA, 22 bp, Artificial Sequence
  chemically synthesized
ctgtaggttgcttatcctgtgt

SEQ ID NO: 663946 - DNA, 22 bp, Artificial Sequence
  chemically synthesized
tgtaggttgcttatcctgtgtc

SEQ ID NO: 663947 - DNA, 22 bp, Artificial Sequence
  chemically synthesized
taggttgcttatcctgtgtcct

SEQ ID NO: 663948 - DNA, 22 bp, Artificial Sequence
  chemically synthesized
cttatcctgtgtcctaaataac

SEQ ID NO: 663949 - DNA, 22 bp, Artificial Sequence
  chemically synthesized
atcctgtgtcctaaataacttc

SEQ ID NO: 663950 - DNA, 22 bp, Artificial Sequence
  chemically synthesized
tcctgtgtcctaaataacttcc

SEQ ID NO: 663951 - DNA, 22 bp, Artificial Sequence
  chemically synthesized
tgtcctaaataacttcccttct

SEQ ID NO: 663952 - DNA, 22 bp, Artificial Sequence
  chemically synthesized
caggaaagtgtagcgtgagaag

SEQ ID NO: 663953 - DNA, 22 bp, Artificial Sequence
  chemically synthesized
aataacttcccttctcacgcta

SEQ ID NO: 663954 - DNA, 22 bp, Artificial Sequence
  chemically synthesized
gatagctccaggaaagtgtagc

SEQ ID NO: 663955 - DNA, 22 bp, Artificial Sequence
  chemically synthesized
cccttctcacgctacactttcc

SEQ ID NO: 663956 - DNA, 22 bp, Artificial Sequence
  chemically synthesized
ccttctcacgctacactttcct

SEQ ID NO: 663957 - DNA, 22 bp, Artificial Sequence
  chemically synthesized
ctcacgctacactttcctggag

SEQ ID NO: 663958 - DNA, 22 bp, Artificial Sequence
  chemically synthesized
tcacgctacactttcctggagc

SEQ ID NO: 663959 - DNA, 22 bp, Artificial Sequence
  chemically synthesized
acgctacactttcctggagcta

SEQ ID NO: 663960 - DNA, 22 bp, Artificial Sequence
  chemically synthesized
cactttcctggagctatccaat

SEQ ID NO: 663961 - DNA, 22 bp, Artificial Sequence
  chemically synthesized
taacgggggagaggattggata

SEQ ID NO: 663962 - DNA, 22 bp, Artificial Sequence
  chemically synthesized
gtaacgggggagaggattggat

SEQ ID NO: 663963 - DNA, 22 bp, Artificial Sequence
  chemically synthesized
tcctggagctatccaatcctct

SEQ ID NO: 663964 - DNA, 22 bp, Artificial Sequence
  chemically synthesized
cctggagctatccaatcctctc

SEQ ID NO: 663965 - DNA, 22 bp, Artificial Sequence
  chemically synthesized
cttgtaacgggggagaggattg

SEQ ID NO: 663966 - DNA, 22 bp, Artificial Sequence
  chemically synthesized
ctggagctatccaatcctctcc

SEQ ID NO: 663967 - DNA, 22 bp, Artificial Sequence
  chemically synthesized
gagctatccaatcctctccccc

SEQ ID NO: 663968 - DNA, 22 bp, Artificial Sequence
  chemically synthesized
taggtgctgcttgtaacggggg

SEQ ID NO: 663969 - DNA, 22 bp, Artificial Sequence
  chemically synthesized
tccaatcctctcccccgttaca

SEQ ID NO: 663970 - DNA, 22 bp, Artificial Sequence
  chemically synthesized
tcccccgttacaagcagcacct

SEQ ID NO: 663971 - DNA, 22 bp, Artificial Sequence
  chemically synthesized
ccccgttacaagcagcacctac

SEQ ID NO: 663972 - DNA, 22 bp, Artificial Sequence
  chemically synthesized
gggatcatgagcctgtaggtgc

SEQ ID NO: 663973 - DNA, 22 bp, Artificial Sequence
  chemically synthesized
agggatcatgagcctgtaggtg

SEQ ID NO: 663974 - DNA, 22 bp, Artificial Sequence
  chemically synthesized
caagcagcacctacaggctcat

SEQ ID NO: 663975 - DNA, 22 bp, Artificial Sequence
  chemically synthesized
caggctcatgatccctaaacgt

SEQ ID NO: 663976 - DNA, 22 bp, Artificial Sequence
  chemically synthesized
aggagaaatatacaaacaacgt

SEQ ID NO: 663977 - DNA, 22 bp, Artificial Sequence
  chemically synthesized
atgatccctaaacgttgtttgt

SEQ ID NO: 663978 - DNA, 22 bp, Artificial Sequence
  chemically synthesized
tggtgctcaggagaaatataca

SEQ ID NO: 663979 - DNA, 22 bp, Artificial Sequence
  chemically synthesized
aacgttgtttgtatatttctcc

SEQ ID NO: 663980 - DNA, 22 bp, Artificial Sequence
  chemically synthesized
tttgtatatttctcctgagcac

SEQ ID NO: 663981 - DNA, 22 bp, Artificial Sequence
  chemically synthesized
gacacggagctgtggtgctcag

SEQ ID NO: 663982 - DNA, 22 bp, Artificial Sequence
  chemically synthesized
gtatatttctcctgagcaccac

SEQ ID NO: 663983 - DNA, 22 bp, Artificial Sequence
  chemically synthesized
tatatttctcctgagcaccaca

SEQ ID NO: 663984 - DNA, 22 bp, Artificial Sequence
  chemically synthesized
ctcctgagcaccacagctccgt

SEQ ID NO: 663985 - DNA, 22 bp, Artificial Sequence
  chemically synthesized
gtaaggttagacacggagctgt

SEQ ID NO: 663986 - DNA, 22 bp, Artificial Sequence
  chemically synthesized
tcctgagcaccacagctccgtg

SEQ ID NO: 663987 - DNA, 22 bp, Artificial Sequence
  chemically synthesized
ctgagcaccacagctccgtgtc

SEQ ID NO: 663988 - DNA, 22 bp, Artificial Sequence
  chemically synthesized
tctggtaaggttagacacggag

SEQ ID NO: 663989 - DNA, 22 bp, Artificial Sequence
  chemically synthesized
gtctggtaaggttagacacgga

SEQ ID NO: 663990 - DNA, 22 bp, Artificial Sequence
  chemically synthesized
agcaccacagctccgtgtctaa

SEQ ID NO: 663991 - DNA, 22 bp, Artificial Sequence
  chemically synthesized
cgtgtctaaccttaccagacaa

SEQ ID NO: 663992 - DNA, 22 bp, Artificial Sequence
  chemically synthesized
accttaccagacaagtcccaca

SEQ ID NO: 663993 - DNA, 22 bp, Artificial Sequence
  chemically synthesized
gaatatcaggtgaatgtgggac

SEQ ID NO: 663994 - DNA, 22 bp, Artificial Sequence
  chemically synthesized
ggaatatcaggtgaatgtggga

SEQ ID NO: 663995 - DNA, 22 bp, Artificial Sequence
  chemically synthesized
accagacaagtcccacattcac

SEQ ID NO: 663996 - DNA, 22 bp, Artificial Sequence
  chemically synthesized
ccagacaagtcccacattcacc

SEQ ID NO: 663997 - DNA, 22 bp, Artificial Sequence
  chemically synthesized
gcttggaatatcaggtgaatgt

SEQ ID NO: 663998 - DNA, 22 bp, Artificial Sequence
  chemically synthesized
ggcttggaatatcaggtgaatg

SEQ ID NO: 663999 - DNA, 22 bp, Artificial Sequence
  chemically synthesized
ggtgcttggcttggaatatcag

SEQ ID NO: 664000 - DNA, 22 bp, Artificial Sequence
  chemically synthesized
aggtgcttggcttggaatatca

SEQ ID NO: 664001 - DNA, 22 bp, Artificial Sequence
  chemically synthesized
acctgatattccaagccaagca

SEQ ID NO: 664002 - DNA, 22 bp, Artificial Sequence
  chemically synthesized
atattccaagccaagcacctaa

SEQ ID NO: 664003 - DNA, 22 bp, Artificial Sequence
  chemically synthesized
caagccaagcacctaagtgtct

SEQ ID NO: 664004 - DNA, 22 bp, Artificial Sequence
  chemically synthesized
agtgtcttccttgactcccttt

SEQ ID NO: 664005 - DNA, 22 bp, Artificial Sequence
  chemically synthesized
atgtggtgggtgaaagggagtc

SEQ ID NO: 664006 - DNA, 22 bp, Artificial Sequence
  chemically synthesized
gatgtggtgggtgaaagggagt

SEQ ID NO: 664007 - DNA, 22 bp, Artificial Sequence
  chemically synthesized
ccttgactccctttcacccacc

SEQ ID NO: 664008 - DNA, 22 bp, Artificial Sequence
  chemically synthesized
cttgactccctttcacccacca

SEQ ID NO: 664009 - DNA, 22 bp, Artificial Sequence
  chemically synthesized
gacaagcttgatgtggtgggtg

SEQ ID NO: 664010 - DNA, 22 bp, Artificial Sequence
  chemically synthesized
gactccctttcacccaccacat

SEQ ID NO: 664011 - DNA, 22 bp, Artificial Sequence
  chemically synthesized
actccctttcacccaccacatc

SEQ ID NO: 664012 - DNA, 22 bp, Artificial Sequence
  chemically synthesized
cctttcacccaccacatcaagc

SEQ ID NO: 664013 - DNA, 22 bp, Artificial Sequence
  chemically synthesized
tcacccaccacatcaagcttgt

SEQ ID NO: 664014 - DNA, 22 bp, Artificial Sequence
  chemically synthesized
cacccaccacatcaagcttgtc

SEQ ID NO: 664015 - DNA, 22 bp, Artificial Sequence
  chemically synthesized
ggccacaggttggacaagcttg

SEQ ID NO: 664016 - DNA, 22 bp, Artificial Sequence
  chemically synthesized
acccaccacatcaagcttgtcc

SEQ ID NO: 664017 - DNA, 22 bp, Artificial Sequence
  chemically synthesized
aaagccatcctgggccacaggt

SEQ ID NO: 664018 - DNA, 22 bp, Artificial Sequence
  chemically synthesized
attcaaagccatcctgggccac

SEQ ID NO: 664019 - DNA, 22 bp, Artificial Sequence
  chemically synthesized
gtccaacctgtggcccaggatg

SEQ ID NO: 664020 - DNA, 22 bp, Artificial Sequence
  chemically synthesized
tccaacctgtggcccaggatgg

SEQ ID NO: 664021 - DNA, 22 bp, Artificial Sequence
  chemically synthesized
ggcctcattcaaagccatcctg

SEQ ID NO: 664022 - DNA, 22 bp, Artificial Sequence
  chemically synthesized
gggcctcattcaaagccatcct

SEQ ID NO: 664023 - DNA, 22 bp, Artificial Sequence
  chemically synthesized
atttgggcctcattcaaagcca

SEQ ID NO: 664024 - DNA, 22 bp, Artificial Sequence
  chemically synthesized
tggcccaggatggctttgaatg

SEQ ID NO: 664025 - DNA, 22 bp, Artificial Sequence
  chemically synthesized
cgaattcatttgggcctcattc

SEQ ID NO: 664026 - DNA, 22 bp, Artificial Sequence
  chemically synthesized
acgaattcatttgggcctcatt

SEQ ID NO: 664027 - DNA, 22 bp, Artificial Sequence
  chemically synthesized
ggaaagtttacgaattcatttg

SEQ ID NO: 664028 - DNA, 22 bp, Artificial Sequence
  chemically synthesized
tgaatgaggcccaaatgaattc

SEQ ID NO: 664029 - DNA, 22 bp, Artificial Sequence
  chemically synthesized
aggaaagtttacgaattcattt

SEQ ID NO: 664030 - DNA, 22 bp, Artificial Sequence
  chemically synthesized
gaatgaggcccaaatgaattcg

SEQ ID NO: 664031 - DNA, 22 bp, Artificial Sequence
  chemically synthesized
taggaaagtttacgaattcatt

SEQ ID NO: 664032 - DNA, 22 bp, Artificial Sequence
  chemically synthesized
aatgaggcccaaatgaattcgt

SEQ ID NO: 664033 - DNA, 22 bp, Artificial Sequence
  chemically synthesized
gtaaactttcctaaaacatttt

SEQ ID NO: 664034 - DNA, 22 bp, Artificial Sequence
  chemically synthesized
tcctaaaacatttttttttttt

SEQ ID NO: 664035 - DNA, 22 bp, Artificial Sequence
  chemically synthesized
cctaaaacattttttttttttt

SEQ ID NO: 664036 - DNA, 22 bp, Artificial Sequence
  chemically synthesized
ctaaaacatttttttttttttt

SEQ ID NO: 664037 - DNA, 22 bp, Artificial Sequence
  chemically synthesized
aaacatttttttttttttttgc

SEQ ID NO: 664038 - DNA, 22 bp, Artificial Sequence
  chemically synthesized
ttttttttttttgcgatttttt

SEQ ID NO: 664039 - DNA, 22 bp, Artificial Sequence
  chemically synthesized
tttttttttttgcgattttttt

SEQ ID NO: 664040 - DNA, 22 bp, Artificial Sequence
  chemically synthesized
ttttttttttgcgatttttttt

SEQ ID NO: 664041 - DNA, 22 bp, Artificial Sequence
  chemically synthesized
tttttttttgcgattttttttt

SEQ ID NO: 664042 - DNA, 22 bp, Artificial Sequence
  chemically synthesized
ttttttttgcgatttttttttt

SEQ ID NO: 664043 - DNA, 22 bp, Artificial Sequence
  chemically synthesized
tttttttgcgattttttttttt

SEQ ID NO: 664044 - DNA, 22 bp, Artificial Sequence
  chemically synthesized
ttttttgcgatttttttttttt

SEQ ID NO: 664045 - DNA, 22 bp, Artificial Sequence
  chemically synthesized
aaaaaaaaaaaaaaaaaaaaaa

SEQ ID NO: 664046 - DNA, 22 bp, Artificial Sequence
  chemically synthesized
tttttgcgattttttttttttt

SEQ ID NO: 664047 - DNA, 22 bp, Artificial Sequence
  chemically synthesized
ttttgcgatttttttttttttt

SEQ ID NO: 664048 - DNA, 22 bp, Artificial Sequence
  chemically synthesized
tttgcgattttttttttttttt

SEQ ID NO: 664049 - DNA, 22 bp, Artificial Sequence
  chemically synthesized
ttgcgatttttttttttttttt

SEQ ID NO: 664050 - DNA, 22 bp, Artificial Sequence
  chemically synthesized
tgcgattttttttttttttttt

SEQ ID NO: 664051 - DNA, 22 bp, Artificial Sequence
  chemically synthesized
gcgatttttttttttttttttt

SEQ ID NO: 664052 - DNA, 22 bp, Artificial Sequence
  chemically synthesized
cgattttttttttttttttttt

SEQ ID NO: 664053 - DNA, 22 bp, Artificial Sequence
  chemically synthesized
atgagctaaaaaaaaaaaaaaa

SEQ ID NO: 664054 - DNA, 22 bp, Artificial Sequence
  chemically synthesized
tttttttttttttttttttttt

SEQ ID NO: 664055 - DNA, 22 bp, Artificial Sequence
  chemically synthesized
ttttttttttttttttttttta

SEQ ID NO: 664056 - DNA, 22 bp, Artificial Sequence
  chemically synthesized
ttttttttttttttttttttag

SEQ ID NO: 664057 - DNA, 22 bp, Artificial Sequence
  chemically synthesized
tttttttttttttttttttagc

SEQ ID NO: 664058 - DNA, 22 bp, Artificial Sequence
  chemically synthesized
ttttttttttttttttttagct

SEQ ID NO: 664059 - DNA, 22 bp, Artificial Sequence
  chemically synthesized
tttttttttttttttttagctc

SEQ ID NO: 664060 - DNA, 22 bp, Artificial Sequence
  chemically synthesized
acggtagctgatgagctaaaaa

SEQ ID NO: 664061 - DNA, 22 bp, Artificial Sequence
  chemically synthesized
ttttttttttttttttagctca

SEQ ID NO: 664062 - DNA, 22 bp, Artificial Sequence
  chemically synthesized
tttttttttttttttagctcat

SEQ ID NO: 664063 - DNA, 22 bp, Artificial Sequence
  chemically synthesized
ttttttttttttttagctcatc

SEQ ID NO: 664064 - DNA, 22 bp, Artificial Sequence
  chemically synthesized
tttttttttttttagctcatca

SEQ ID NO: 664065 - DNA, 22 bp, Artificial Sequence
  chemically synthesized
ttttttttttttagctcatcag

SEQ ID NO: 664066 - DNA, 22 bp, Artificial Sequence
  chemically synthesized
tttttttttttagctcatcagc

SEQ ID NO: 664067 - DNA, 22 bp, Artificial Sequence
  chemically synthesized
acgctaacggtagctgatgagc

SEQ ID NO: 664068 - DNA, 22 bp, Artificial Sequence
  chemically synthesized
ttttttttttagctcatcagct

SEQ ID NO: 664069 - DNA, 22 bp, Artificial Sequence
  chemically synthesized
tttttttttagctcatcagcta

SEQ ID NO: 664070 - DNA, 22 bp, Artificial Sequence
  chemically synthesized
ttttttttagctcatcagctac

SEQ ID NO: 664071 - DNA, 22 bp, Artificial Sequence
  chemically synthesized
tttttttagctcatcagctacc

SEQ ID NO: 664072 - DNA, 22 bp, Artificial Sequence
  chemically synthesized
ttttttagctcatcagctaccg

SEQ ID NO: 664073 - DNA, 22 bp, Artificial Sequence
  chemically synthesized
tttttagctcatcagctaccgt

SEQ ID NO: 664074 - DNA, 22 bp, Artificial Sequence
  chemically synthesized
ttttagctcatcagctaccgtt

SEQ ID NO: 664075 - DNA, 22 bp, Artificial Sequence
  chemically synthesized
tttagctcatcagctaccgtta

SEQ ID NO: 664076 - DNA, 22 bp, Artificial Sequence
  chemically synthesized
ttagctcatcagctaccgttag

SEQ ID NO: 664077 - DNA, 22 bp, Artificial Sequence
  chemically synthesized
tagctcatcagctaccgttagc

SEQ ID NO: 664078 - DNA, 22 bp, Artificial Sequence
  chemically synthesized
agctcatcagctaccgttagcg

SEQ ID NO: 664079 - DNA, 22 bp, Artificial Sequence
  chemically synthesized
gctcatcagctaccgttagcgt

SEQ ID NO: 664080 - DNA, 22 bp, Artificial Sequence
  chemically synthesized
atcagctaccgttagcgttagt

SEQ ID NO: 664081 - DNA, 22 bp, Artificial Sequence
  chemically synthesized
gaccccacataaaatacactaa

SEQ ID NO: 664082 - DNA, 22 bp, Artificial Sequence
  chemically synthesized
ggaccccacataaaatacacta

SEQ ID NO: 664083 - DNA, 22 bp, Artificial Sequence
  chemically synthesized
ccgttagcgttagtgtatttta

SEQ ID NO: 664084 - DNA, 22 bp, Artificial Sequence
  chemically synthesized
tcttggaccccacataaaatac

SEQ ID NO: 664085 - DNA, 22 bp, Artificial Sequence
  chemically synthesized
gcgttagtgtattttatgtggg

SEQ ID NO: 664086 - DNA, 22 bp, Artificial Sequence
  chemically synthesized
gtgtattttatgtggggtccaa

SEQ ID NO: 664087 - DNA, 22 bp, Artificial Sequence
  chemically synthesized
tatgtggggtccaagacaattc

SEQ ID NO: 664088 - DNA, 22 bp, Artificial Sequence
  chemically synthesized
atgtggggtccaagacaattct

SEQ ID NO: 664089 - DNA, 22 bp, Artificial Sequence
  chemically synthesized
tgtggggtccaagacaattctt

SEQ ID NO: 664090 - DNA, 22 bp, Artificial Sequence
  chemically synthesized
cgggccacagtggaagaagaat

SEQ ID NO: 664091 - DNA, 22 bp, Artificial Sequence
  chemically synthesized
tccgggccacagtggaagaaga

SEQ ID NO: 664092 - DNA, 22 bp, Artificial Sequence
  chemically synthesized
ctccgggccacagtggaagaag

SEQ ID NO: 664093 - DNA, 22 bp, Artificial Sequence
  chemically synthesized
gcttctccgggccacagtggaa

SEQ ID NO: 664094 - DNA, 22 bp, Artificial Sequence
  chemically synthesized
ggcttctccgggccacagtgga

SEQ ID NO: 664095 - DNA, 22 bp, Artificial Sequence
  chemically synthesized
tggcttctccgggccacagtgg

SEQ ID NO: 664096 - DNA, 22 bp, Artificial Sequence
  chemically synthesized
ttggcttctccgggccacagtg

SEQ ID NO: 664097 - DNA, 22 bp, Artificial Sequence
  chemically synthesized
ttcttccactgtggcccggaga

SEQ ID NO: 664098 - DNA, 22 bp, Artificial Sequence
  chemically synthesized
cttccactgtggcccggagaag

SEQ ID NO: 664099 - DNA, 22 bp, Artificial Sequence
  chemically synthesized
ttccactgtggcccggagaagc

SEQ ID NO: 664100 - DNA, 22 bp, Artificial Sequence
  chemically synthesized
ccactgtggcccggagaagcca

SEQ ID NO: 664101 - DNA, 22 bp, Artificial Sequence
  chemically synthesized
cactgtggcccggagaagccaa

SEQ ID NO: 664102 - DNA, 22 bp, Artificial Sequence
  chemically synthesized
tggcccggagaagccaaaagat

SEQ ID NO: 664103 - DNA, 22 bp, Artificial Sequence
  chemically synthesized
atgtggtgcagggatgtccaat

SEQ ID NO: 664104 - DNA, 22 bp, Artificial Sequence
  chemically synthesized
gatgtggtgcagggatgtccaa

SEQ ID NO: 664105 - DNA, 22 bp, Artificial Sequence
  chemically synthesized
atttgatgtggtgcagggatgt

SEQ ID NO: 664106 - DNA, 22 bp, Artificial Sequence
  chemically synthesized
agtgattcatttgatgtggtgc

SEQ ID NO: 664107 - DNA, 22 bp, Artificial Sequence
  chemically synthesized
gacatccctgcaccacatcaaa

SEQ ID NO: 664108 - DNA, 22 bp, Artificial Sequence
  chemically synthesized
acaggcctcagtgattcatttg

SEQ ID NO: 664109 - DNA, 22 bp, Artificial Sequence
  chemically synthesized
gacaggcctcagtgattcattt

SEQ ID NO: 664110 - DNA, 22 bp, Artificial Sequence
  chemically synthesized
caccacatcaaatgaatcactg

SEQ ID NO: 664111 - DNA, 22 bp, Artificial Sequence
  chemically synthesized
ggaagtggatttgacaggcctc

SEQ ID NO: 664112 - DNA, 22 bp, Artificial Sequence
  chemically synthesized
aggaagtggatttgacaggcct

SEQ ID NO: 664113 - DNA, 22 bp, Artificial Sequence
  chemically synthesized
gaaatatttaggaagtggattt

SEQ ID NO: 664114 - DNA, 22 bp, Artificial Sequence
  chemically synthesized
agaaatatttaggaagtggatt

SEQ ID NO: 664115 - DNA, 22 bp, Artificial Sequence
  chemically synthesized
aggcctgtcaaatccacttcct

SEQ ID NO: 664116 - DNA, 22 bp, Artificial Sequence
  chemically synthesized
tcaaatccacttcctaaatatt

SEQ ID NO: 664117 - DNA, 22 bp, Artificial Sequence
  chemically synthesized
cctaaatatttctaaattctct

SEQ ID NO: 664118 - DNA, 22 bp, Artificial Sequence
  chemically synthesized
ctaaatatttctaaattctctc

SEQ ID NO: 664119 - DNA, 22 bp, Artificial Sequence
  chemically synthesized
aatatttctaaattctctccac

SEQ ID NO: 664120 - DNA, 22 bp, Artificial Sequence
  chemically synthesized
ctaaattctctccacttatctc

SEQ ID NO: 664121 - DNA, 22 bp, Artificial Sequence
  chemically synthesized
taaattctctccacttatctcc

SEQ ID NO: 664122 - DNA, 22 bp, Artificial Sequence
  chemically synthesized
gcagagtagtaagggagataag

SEQ ID NO: 664123 - DNA, 22 bp, Artificial Sequence
  chemically synthesized
aattctctccacttatctccct

SEQ ID NO: 664124 - DNA, 22 bp, Artificial Sequence
  chemically synthesized
aattagcagagtagtaagggag

SEQ ID NO: 664125 - DNA, 22 bp, Artificial Sequence
  chemically synthesized
tctccacttatctcccttacta

SEQ ID NO: 664126 - DNA, 22 bp, Artificial Sequence
  chemically synthesized
gaattagcagagtagtaaggga

SEQ ID NO: 664127 - DNA, 22 bp, Artificial Sequence
  chemically synthesized
tccacttatctcccttactact

SEQ ID NO: 664128 - DNA, 22 bp, Artificial Sequence
  chemically synthesized
cacttatctcccttactactct

SEQ ID NO: 664129 - DNA, 22 bp, Artificial Sequence
  chemically synthesized
atctcccttactactctgctaa

SEQ ID NO: 664130 - DNA, 22 bp, Artificial Sequence
  chemically synthesized
tctcccttactactctgctaat

SEQ ID NO: 664131 - DNA, 22 bp, Artificial Sequence
  chemically synthesized
ccttactactctgctaattcaa

SEQ ID NO: 664132 - DNA, 22 bp, Artificial Sequence
  chemically synthesized
actactctgctaattcaagcca

SEQ ID NO: 664133 - DNA, 22 bp, Artificial Sequence
  chemically synthesized
ctactctgctaattcaagccac

SEQ ID NO: 664134 - DNA, 22 bp, Artificial Sequence
  chemically synthesized
aaccagcaatgtggtggcttga

SEQ ID NO: 664135 - DNA, 22 bp, Artificial Sequence
  chemically synthesized
ctctgctaattcaagccaccac

SEQ ID NO: 664136 - DNA, 22 bp, Artificial Sequence
  chemically synthesized
tgctaattcaagccaccacatt

SEQ ID NO: 664137 - DNA, 22 bp, Artificial Sequence
  chemically synthesized
ctaattcaagccaccacattgc

SEQ ID NO: 664138 - DNA, 22 bp, Artificial Sequence
  chemically synthesized
attcaagccaccacattgctgg

SEQ ID NO: 664139 - DNA, 22 bp, Artificial Sequence
  chemically synthesized
cagtaatctaaaccagcaatgt

SEQ ID NO: 664140 - DNA, 22 bp, Artificial Sequence
  chemically synthesized
ttgcagtaatctaaaccagcaa

SEQ ID NO: 664141 - DNA, 22 bp, Artificial Sequence
  chemically synthesized
aagccaccacattgctggttta

SEQ ID NO: 664142 - DNA, 22 bp, Artificial Sequence
  chemically synthesized
ctggtttagattactgcaacag

SEQ ID NO: 664143 - DNA, 22 bp, Artificial Sequence
  chemically synthesized
gtttagattactgcaacaggtt

SEQ ID NO: 664144 - DNA, 22 bp, Artificial Sequence
  chemically synthesized
agattactgcaacaggtttttc

SEQ ID NO: 664145 - DNA, 22 bp, Artificial Sequence
  chemically synthesized
gattactgcaacaggtttttct

SEQ ID NO: 664146 - DNA, 22 bp, Artificial Sequence
  chemically synthesized
ctgcaacaggtttttctcctgt

SEQ ID NO: 664147 - DNA, 22 bp, Artificial Sequence
  chemically synthesized
caacaggtttttctcctgtcac

SEQ ID NO: 664148 - DNA, 22 bp, Artificial Sequence
  chemically synthesized
gtgcgatgtgggagtgacagga

SEQ ID NO: 664149 - DNA, 22 bp, Artificial Sequence
  chemically synthesized
ttctcctgtcactcccacatcg

SEQ ID NO: 664150 - DNA, 22 bp, Artificial Sequence
  chemically synthesized
tctcctgtcactcccacatcgc

SEQ ID NO: 664151 - DNA, 22 bp, Artificial Sequence
  chemically synthesized
ctcctgtcactcccacatcgca

SEQ ID NO: 664152 - DNA, 22 bp, Artificial Sequence
  chemically synthesized
tcctgtcactcccacatcgcac

SEQ ID NO: 664153 - DNA, 22 bp, Artificial Sequence
  chemically synthesized
ctgtcactcccacatcgcacca

SEQ ID NO: 664154 - DNA, 22 bp, Artificial Sequence
  chemically synthesized
tcactcccacatcgcaccaatc

SEQ ID NO: 664155 - DNA, 22 bp, Artificial Sequence
  chemically synthesized
tggaacagagtatggattggtg

SEQ ID NO: 664156 - DNA, 22 bp, Artificial Sequence
  chemically synthesized
ctgtggaacagagtatggattg

SEQ ID NO: 664157 - DNA, 22 bp, Artificial Sequence
  chemically synthesized
ccacatcgcaccaatccatact

SEQ ID NO: 664158 - DNA, 22 bp, Artificial Sequence
  chemically synthesized
gctgtggaacagagtatggatt

SEQ ID NO: 664159 - DNA, 22 bp, Artificial Sequence
  chemically synthesized
ttgctgtggaacagagtatgga

SEQ ID NO: 664160 - DNA, 22 bp, Artificial Sequence
  chemically synthesized
gaaagatgattcttgctgtgga

SEQ ID NO: 664161 - DNA, 22 bp, Artificial Sequence
  chemically synthesized
agaaagatgattcttgctgtgg

SEQ ID NO: 664162 - DNA, 22 bp, Artificial Sequence
  chemically synthesized
tcgcttagaaagatgattcttg

SEQ ID NO: 664163 - DNA, 22 bp, Artificial Sequence
  chemically synthesized
tgttccacagcaagaatcatct

SEQ ID NO: 664164 - DNA, 22 bp, Artificial Sequence
  chemically synthesized
ttccacagcaagaatcatcttt

SEQ ID NO: 664165 - DNA, 22 bp, Artificial Sequence
  chemically synthesized
cacagcaagaatcatctttcta

SEQ ID NO: 664166 - DNA, 22 bp, Artificial Sequence
  chemically synthesized
ggggtgacataatcagattgtc

SEQ ID NO: 664167 - DNA, 22 bp, Artificial Sequence
  chemically synthesized
tctaagcgacaatctgattatg

SEQ ID NO: 664168 - DNA, 22 bp, Artificial Sequence
  chemically synthesized
gcctgggggtgacataatcaga

SEQ ID NO: 664169 - DNA, 22 bp, Artificial Sequence
  chemically synthesized
ctaagcgacaatctgattatgt

SEQ ID NO: 664170 - DNA, 22 bp, Artificial Sequence
  chemically synthesized
ggcctgggggtgacataatcag

SEQ ID NO: 664171 - DNA, 22 bp, Artificial Sequence
  chemically synthesized
taagcgacaatctgattatgtc

SEQ ID NO: 664172 - DNA, 22 bp, Artificial Sequence
  chemically synthesized
agcgacaatctgattatgtcac

SEQ ID NO: 664173 - DNA, 22 bp, Artificial Sequence
  chemically synthesized
attatgtcacccccaggccaaa

SEQ ID NO: 664174 - DNA, 22 bp, Artificial Sequence
  chemically synthesized
gaggtcaggggatttggcctgg

SEQ ID NO: 664175 - DNA, 22 bp, Artificial Sequence
  chemically synthesized
agaggtcaggggatttggcctg

SEQ ID NO: 664176 - DNA, 22 bp, Artificial Sequence
  chemically synthesized
tgtcacccccaggccaaatccc

SEQ ID NO: 664177 - DNA, 22 bp, Artificial Sequence
  chemically synthesized
aggaatttagaggtcaggggat

SEQ ID NO: 664178 - DNA, 22 bp, Artificial Sequence
  chemically synthesized
aaacccaagttaaggaatttag

SEQ ID NO: 664179 - DNA, 22 bp, Artificial Sequence
  chemically synthesized
aaaacccaagttaaggaattta

SEQ ID NO: 664180 - DNA, 22 bp, Artificial Sequence
  chemically synthesized
taaaacccaagttaaggaattt

SEQ ID NO: 664181 - DNA, 22 bp, Artificial Sequence
  chemically synthesized
ttaaaacccaagttaaggaatt

SEQ ID NO: 664182 - DNA, 22 bp, Artificial Sequence
  chemically synthesized
acctctaaattccttaacttgg

SEQ ID NO: 664183 - DNA, 22 bp, Artificial Sequence
  chemically synthesized
taaattccttaacttgggtttt

SEQ ID NO: 664184 - DNA, 22 bp, Artificial Sequence
  chemically synthesized
tgcaaggtttttaaaacccaag

SEQ ID NO: 664185 - DNA, 22 bp, Artificial Sequence
  chemically synthesized
aattccttaacttgggttttaa

SEQ ID NO: 664186 - DNA, 22 bp, Artificial Sequence
  chemically synthesized
cttaacttgggttttaaaaacc

SEQ ID NO: 664187 - DNA, 22 bp, Artificial Sequence
  chemically synthesized
aacttgggttttaaaaaccttg

SEQ ID NO: 664188 - DNA, 22 bp, Artificial Sequence
  chemically synthesized
acttgggttttaaaaaccttgc

SEQ ID NO: 664189 - DNA, 22 bp, Artificial Sequence
  chemically synthesized
gggttttaaaaaccttgcacaa

SEQ ID NO: 664190 - DNA, 22 bp, Artificial Sequence
  chemically synthesized
ggttttaaaaaccttgcacaat

SEQ ID NO: 664191 - DNA, 22 bp, Artificial Sequence
  chemically synthesized
taaaaaccttgcacaatctgct

SEQ ID NO: 664192 - DNA, 22 bp, Artificial Sequence
  chemically synthesized
aaaaaccttgcacaatctgctt

SEQ ID NO: 664193 - DNA, 22 bp, Artificial Sequence
  chemically synthesized
aaaaccttgcacaatctgcttc

SEQ ID NO: 664194 - DNA, 22 bp, Artificial Sequence
  chemically synthesized
gagagagaagcaggaagcagat

SEQ ID NO: 664195 - DNA, 22 bp, Artificial Sequence
  chemically synthesized
gcacaatctgcttcctgcttct

SEQ ID NO: 664196 - DNA, 22 bp, Artificial Sequence
  chemically synthesized
cacaatctgcttcctgcttctc

SEQ ID NO: 664197 - DNA, 22 bp, Artificial Sequence
  chemically synthesized
tgaaataataggctggagagag

SEQ ID NO: 664198 - DNA, 22 bp, Artificial Sequence
  chemically synthesized
cttcctgcttctctctccagcc

SEQ ID NO: 664199 - DNA, 22 bp, Artificial Sequence
  chemically synthesized
ttgtgaaataataggctggaga

SEQ ID NO: 664200 - DNA, 22 bp, Artificial Sequence
  chemically synthesized
cctgcttctctctccagcctat

SEQ ID NO: 664201 - DNA, 22 bp, Artificial Sequence
  chemically synthesized
ctgcttctctctccagcctatt

SEQ ID NO: 664202 - DNA, 22 bp, Artificial Sequence
  chemically synthesized
cttctctctccagcctattatt

SEQ ID NO: 664203 - DNA, 22 bp, Artificial Sequence
  chemically synthesized
ctctctccagcctattatttca

SEQ ID NO: 664204 - DNA, 22 bp, Artificial Sequence
  chemically synthesized
tctctccagcctattatttcac

SEQ ID NO: 664205 - DNA, 22 bp, Artificial Sequence
  chemically synthesized
tctccagcctattatttcacaa

SEQ ID NO: 664206 - DNA, 22 bp, Artificial Sequence
  chemically synthesized
tccagcctattatttcacaata

SEQ ID NO: 664207 - DNA, 22 bp, Artificial Sequence
  chemically synthesized
caggggaaagatctattgtgaa

SEQ ID NO: 664208 - DNA, 22 bp, Artificial Sequence
  chemically synthesized
cagcctattatttcacaataga

SEQ ID NO: 664209 - DNA, 22 bp, Artificial Sequence
  chemically synthesized
ttatttcacaatagatctttcc

SEQ ID NO: 664210 - DNA, 22 bp, Artificial Sequence
  chemically synthesized
tttcacaatagatctttcccct

SEQ ID NO: 664211 - DNA, 22 bp, Artificial Sequence
  chemically synthesized
aagcacagaattccaggggaaa

SEQ ID NO: 664212 - DNA, 22 bp, Artificial Sequence
  chemically synthesized
cacaatagatctttcccctgga

SEQ ID NO: 664213 - DNA, 22 bp, Artificial Sequence
  chemically synthesized
acaatagatctttcccctggaa

SEQ ID NO: 664214 - DNA, 22 bp, Artificial Sequence
  chemically synthesized
tcccctggaattctgtgcttta

SEQ ID NO: 664215 - DNA, 22 bp, Artificial Sequence
  chemically synthesized
cccctggaattctgtgctttag

SEQ ID NO: 664216 - DNA, 22 bp, Artificial Sequence
  chemically synthesized
ccctggaattctgtgctttagc

SEQ ID NO: 664217 - DNA, 22 bp, Artificial Sequence
  chemically synthesized
aaaatatgtcagtatggctaaa

SEQ ID NO: 664218 - DNA, 22 bp, Artificial Sequence
  chemically synthesized
gaattctgtgctttagccatac

SEQ ID NO: 664219 - DNA, 22 bp, Artificial Sequence
  chemically synthesized
tgtgctttagccatactgacat

SEQ ID NO: 664220 - DNA, 22 bp, Artificial Sequence
  chemically synthesized
aggaactgaaaatatgtcagta

SEQ ID NO: 664221 - DNA, 22 bp, Artificial Sequence
  chemically synthesized
tgctttagccatactgacatat

SEQ ID NO: 664222 - DNA, 22 bp, Artificial Sequence
  chemically synthesized
tagccatactgacatattttca

SEQ ID NO: 664223 - DNA, 22 bp, Artificial Sequence
  chemically synthesized
agccatactgacatattttcag

SEQ ID NO: 664224 - DNA, 22 bp, Artificial Sequence
  chemically synthesized
gccatactgacatattttcagt

SEQ ID NO: 664225 - DNA, 22 bp, Artificial Sequence
  chemically synthesized
acatattttcagttcctgaatg

SEQ ID NO: 664226 - DNA, 22 bp, Artificial Sequence
  chemically synthesized
tcagttcctgaatgtgtcatgc

SEQ ID NO: 664227 - DNA, 22 bp, Artificial Sequence
  chemically synthesized
cagttcctgaatgtgtcatgct

SEQ ID NO: 664228 - DNA, 22 bp, Artificial Sequence
  chemically synthesized
agttcctgaatgtgtcatgctt

SEQ ID NO: 664229 - DNA, 22 bp, Artificial Sequence
  chemically synthesized
aagggcccagagaaagcatgac

SEQ ID NO: 664230 - DNA, 22 bp, Artificial Sequence
  chemically synthesized
ctgaatgtgtcatgctttctct

SEQ ID NO: 664231 - DNA, 22 bp, Artificial Sequence
  chemically synthesized
aatgtgtcatgctttctctggg

SEQ ID NO: 664232 - DNA, 22 bp, Artificial Sequence
  chemically synthesized
tctctgggcccttcagcacatg

SEQ ID NO: 664233 - DNA, 22 bp, Artificial Sequence
  chemically synthesized
ctctgggcccttcagcacatgc

SEQ ID NO: 664234 - DNA, 22 bp, Artificial Sequence
  chemically synthesized
tctgggcccttcagcacatgct

SEQ ID NO: 664235 - DNA, 22 bp, Artificial Sequence
  chemically synthesized
gtcagaaagaagagcatgtgct

SEQ ID NO: 664236 - DNA, 22 bp, Artificial Sequence
  chemically synthesized
tgggcccttcagcacatgctct

SEQ ID NO: 664237 - DNA, 22 bp, Artificial Sequence
  chemically synthesized
tagtcagaaagaagagcatgtg

SEQ ID NO: 664238 - DNA, 22 bp, Artificial Sequence
  chemically synthesized
ggcccttcagcacatgctcttc

SEQ ID NO: 664239 - DNA, 22 bp, Artificial Sequence
  chemically synthesized
cagcacatgctcttctttctga

SEQ ID NO: 664240 - DNA, 22 bp, Artificial Sequence
  chemically synthesized
agcacatgctcttctttctgac

SEQ ID NO: 664241 - DNA, 22 bp, Artificial Sequence
  chemically synthesized
ggaagagcgttctagtcagaaa

SEQ ID NO: 664242 - DNA, 22 bp, Artificial Sequence
  chemically synthesized
taggaagagcgttctagtcaga

SEQ ID NO: 664243 - DNA, 22 bp, Artificial Sequence
  chemically synthesized
tctaggaagagcgttctagtca

SEQ ID NO: 664244 - DNA, 22 bp, Artificial Sequence
  chemically synthesized
tctctaggaagagcgttctagt

SEQ ID NO: 664245 - DNA, 22 bp, Artificial Sequence
  chemically synthesized
tctctctaggaagagcgttcta

SEQ ID NO: 664246 - DNA, 22 bp, Artificial Sequence
  chemically synthesized
ttctttctgactagaacgctct

SEQ ID NO: 664247 - DNA, 22 bp, Artificial Sequence
  chemically synthesized
ctttctgactagaacgctcttc

SEQ ID NO: 664248 - DNA, 22 bp, Artificial Sequence
  chemically synthesized
tttctgactagaacgctcttcc

SEQ ID NO: 664249 - DNA, 22 bp, Artificial Sequence
  chemically synthesized
tctgactagaacgctcttccta

SEQ ID NO: 664250 - DNA, 22 bp, Artificial Sequence
  chemically synthesized
ctgactagaacgctcttcctag

SEQ ID NO: 664251 - DNA, 22 bp, Artificial Sequence
  chemically synthesized
tgactagaacgctcttcctaga

SEQ ID NO: 664252 - DNA, 22 bp, Artificial Sequence
  chemically synthesized
actagaacgctcttcctagaga

SEQ ID NO: 664253 - DNA, 22 bp, Artificial Sequence
  chemically synthesized
gaacgctcttcctagagagaga

SEQ ID NO: 664254 - DNA, 22 bp, Artificial Sequence
  chemically synthesized
gaagagtaagcagctctctctc

SEQ ID NO: 664255 - DNA, 22 bp, Artificial Sequence
  chemically synthesized
tagaagagtaagcagctctctc

SEQ ID NO: 664256 - DNA, 22 bp, Artificial Sequence
  chemically synthesized
ttcctagagagagagctgctta

SEQ ID NO: 664257 - DNA, 22 bp, Artificial Sequence
  chemically synthesized
cctagagagagagctgcttact

SEQ ID NO: 664258 - DNA, 22 bp, Artificial Sequence
  chemically synthesized
ctagagagagagctgcttactc

SEQ ID NO: 664259 - DNA, 22 bp, Artificial Sequence
  chemically synthesized
ggtaactctagaagagtaagca

SEQ ID NO: 664260 - DNA, 22 bp, Artificial Sequence
  chemically synthesized
gagagagagctgcttactcttc

SEQ ID NO: 664261 - DNA, 22 bp, Artificial Sequence
  chemically synthesized
agctaggtaactctagaagagt

SEQ ID NO: 664262 - DNA, 22 bp, Artificial Sequence
  chemically synthesized
cttactcttctagagttaccta

SEQ ID NO: 664263 - DNA, 22 bp, Artificial Sequence
  chemically synthesized
actcttctagagttacctagct

SEQ ID NO: 664264 - DNA, 22 bp, Artificial Sequence
  chemically synthesized
ctcttctagagttacctagctt

SEQ ID NO: 664265 - DNA, 22 bp, Artificial Sequence
  chemically synthesized
aagaggtgatgtctaagctagg

SEQ ID NO: 664266 - DNA, 22 bp, Artificial Sequence
  chemically synthesized
ttctagagttacctagcttaga

SEQ ID NO: 664267 - DNA, 22 bp, Artificial Sequence
  chemically synthesized
gaagaggtgatgtctaagctag

SEQ ID NO: 664268 - DNA, 22 bp, Artificial Sequence
  chemically synthesized
ctagagttacctagcttagaca

SEQ ID NO: 664269 - DNA, 22 bp, Artificial Sequence
  chemically synthesized
tagagttacctagcttagacat

SEQ ID NO: 664270 - DNA, 22 bp, Artificial Sequence
  chemically synthesized
tttgaagaggtgatgtctaagc

SEQ ID NO: 664271 - DNA, 22 bp, Artificial Sequence
  chemically synthesized
gtttgaagaggtgatgtctaag

SEQ ID NO: 664272 - DNA, 22 bp, Artificial Sequence
  chemically synthesized
gagttacctagcttagacatca

SEQ ID NO: 664273 - DNA, 22 bp, Artificial Sequence
  chemically synthesized
cctagcttagacatcacctctt

SEQ ID NO: 664274 - DNA, 22 bp, Artificial Sequence
  chemically synthesized
gcttagacatcacctcttcaaa

SEQ ID NO: 664275 - DNA, 22 bp, Artificial Sequence
  chemically synthesized
aaagaatgtttgtttgaagagg

SEQ ID NO: 664276 - DNA, 22 bp, Artificial Sequence
  chemically synthesized
agacatcacctcttcaaacaaa

SEQ ID NO: 664277 - DNA, 22 bp, Artificial Sequence
  chemically synthesized
gacatcacctcttcaaacaaac

SEQ ID NO: 664278 - DNA, 22 bp, Artificial Sequence
  chemically synthesized
tgtggaatgagattcaaagaat

SEQ ID NO: 664279 - DNA, 22 bp, Artificial Sequence
  chemically synthesized
ttcaaacaaacattctttgaat

SEQ ID NO: 664280 - DNA, 22 bp, Artificial Sequence
  chemically synthesized
caaacaaacattctttgaatct

SEQ ID NO: 664281 - DNA, 22 bp, Artificial Sequence
  chemically synthesized
aaacaaacattctttgaatctc

SEQ ID NO: 664282 - DNA, 22 bp, Artificial Sequence
  chemically synthesized
actgtgtggaatgagattcaaa

SEQ ID NO: 664283 - DNA, 22 bp, Artificial Sequence
  chemically synthesized
tttgaatctcattccacacagt

SEQ ID NO: 664284 - DNA, 22 bp, Artificial Sequence
  chemically synthesized
tgtgaacagctaactgtgtgga

SEQ ID NO: 664285 - DNA, 22 bp, Artificial Sequence
  chemically synthesized
tgaatctcattccacacagtta

SEQ ID NO: 664286 - DNA, 22 bp, Artificial Sequence
  chemically synthesized
gaatctcattccacacagttag

SEQ ID NO: 664287 - DNA, 22 bp, Artificial Sequence
  chemically synthesized
aatctcattccacacagttagc

SEQ ID NO: 664288 - DNA, 22 bp, Artificial Sequence
  chemically synthesized
attccacacagttagctgttca

SEQ ID NO: 664289 - DNA, 22 bp, Artificial Sequence
  chemically synthesized
cacacagttagctgttcacata

SEQ ID NO: 664290 - DNA, 22 bp, Artificial Sequence
  chemically synthesized
gctgttcacatagtaccccatt

SEQ ID NO: 664291 - DNA, 22 bp, Artificial Sequence
  chemically synthesized
tgcaacagtgggacaatggggt

SEQ ID NO: 664292 - DNA, 22 bp, Artificial Sequence
  chemically synthesized
ttcacatagtaccccattgtcc

SEQ ID NO: 664293 - DNA, 22 bp, Artificial Sequence
  chemically synthesized
gttgtgcaacagtgggacaatg

SEQ ID NO: 664294 - DNA, 22 bp, Artificial Sequence
  chemically synthesized
acatagtaccccattgtcccac

SEQ ID NO: 664295 - DNA, 22 bp, Artificial Sequence
  chemically synthesized
agttgtgcaacagtgggacaat

SEQ ID NO: 664296 - DNA, 22 bp, Artificial Sequence
  chemically synthesized
aatgtcatatatttagttgtgc

SEQ ID NO: 664297 - DNA, 22 bp, Artificial Sequence
  chemically synthesized
caatgtcatatatttagttgtg

SEQ ID NO: 664298 - DNA, 22 bp, Artificial Sequence
  chemically synthesized
tcccactgttgcacaactaaat

SEQ ID NO: 664299 - DNA, 22 bp, Artificial Sequence
  chemically synthesized
ttgcacaactaaatatatgaca

SEQ ID NO: 664300 - DNA, 22 bp, Artificial Sequence
  chemically synthesized
caagaccatttcaatgtcatat

SEQ ID NO: 664301 - DNA, 22 bp, Artificial Sequence
  chemically synthesized
cacaactaaatatatgacattg

SEQ ID NO: 664302 - DNA, 22 bp, Artificial Sequence
  chemically synthesized
ccaagaccatttcaatgtcata

SEQ ID NO: 664303 - DNA, 22 bp, Artificial Sequence
  chemically synthesized
tttccaagaccatttcaatgtc

SEQ ID NO: 664304 - DNA, 22 bp, Artificial Sequence
  chemically synthesized
tatttccaagaccatttcaatg

SEQ ID NO: 664305 - DNA, 22 bp, Artificial Sequence
  chemically synthesized
aatatatgacattgaaatggtc

SEQ ID NO: 664306 - DNA, 22 bp, Artificial Sequence
  chemically synthesized
tctctatttccaagaccatttc

SEQ ID NO: 664307 - DNA, 22 bp, Artificial Sequence
  chemically synthesized
gtctctatttccaagaccattt

SEQ ID NO: 664308 - DNA, 22 bp, Artificial Sequence
  chemically synthesized
aaatggtcttggaaatagagac

SEQ ID NO: 664309 - DNA, 22 bp, Artificial Sequence
  chemically synthesized
aaaaaataaagtgatcttgtct

SEQ ID NO: 664310 - DNA, 22 bp, Artificial Sequence
  chemically synthesized
ggaaatagagacaagatcactt

SEQ ID NO: 664311 - DNA, 22 bp, Artificial Sequence
  chemically synthesized
gttaaaaaaataaagtgatctt

SEQ ID NO: 664312 - DNA, 22 bp, Artificial Sequence
  chemically synthesized
gaaatagagacaagatcacttt

SEQ ID NO: 664313 - DNA, 22 bp, Artificial Sequence
  chemically synthesized
cagttggttaaaaaaataaagt

SEQ ID NO: 664314 - DNA, 22 bp, Artificial Sequence
  chemically synthesized
agaatgtctacagttggttaaa

SEQ ID NO: 664315 - DNA, 22 bp, Artificial Sequence
  chemically synthesized
tatttttttaaccaactgtaga

SEQ ID NO: 664316 - DNA, 22 bp, Artificial Sequence
  chemically synthesized
atttttttaaccaactgtagac

SEQ ID NO: 664317 - DNA, 22 bp, Artificial Sequence
  chemically synthesized
tttttttaaccaactgtagaca

SEQ ID NO: 664318 - DNA, 22 bp, Artificial Sequence
  chemically synthesized
ttttaaccaactgtagacattc

SEQ ID NO: 664319 - DNA, 22 bp, Artificial Sequence
  chemically synthesized
tttaaccaactgtagacattct

SEQ ID NO: 664320 - DNA, 22 bp, Artificial Sequence
  chemically synthesized
ttaaccaactgtagacattctt

SEQ ID NO: 664321 - DNA, 22 bp, Artificial Sequence
  chemically synthesized
taaccaactgtagacattctta

SEQ ID NO: 664322 - DNA, 22 bp, Artificial Sequence
  chemically synthesized
aaccaactgtagacattcttaa

SEQ ID NO: 664323 - DNA, 22 bp, Artificial Sequence
  chemically synthesized
accaactgtagacattcttaat

SEQ ID NO: 664324 - DNA, 22 bp, Artificial Sequence
  chemically synthesized
tagacattcttaatacattata

SEQ ID NO: 664325 - DNA, 22 bp, Artificial Sequence
  chemically synthesized
tagacataagcaaatatatgta

SEQ ID NO: 664326 - DNA, 22 bp, Artificial Sequence
  chemically synthesized
ttaatacattatacatatattt

SEQ ID NO: 664327 - DNA, 22 bp, Artificial Sequence
  chemically synthesized
gtagacataagcaaatatatgt

SEQ ID NO: 664328 - DNA, 22 bp, Artificial Sequence
  chemically synthesized
aatacattatacatatatttgc

SEQ ID NO: 664329 - DNA, 22 bp, Artificial Sequence
  chemically synthesized
atacattatacatatatttgct

SEQ ID NO: 664330 - DNA, 22 bp, Artificial Sequence
  chemically synthesized
atgaaatttgtagacataagca

SEQ ID NO: 664331 - DNA, 22 bp, Artificial Sequence
  chemically synthesized
tacatatatttgcttatgtcta

SEQ ID NO: 664332 - DNA, 22 bp, Artificial Sequence
  chemically synthesized
gcttatgtctacaaatttcatg

SEQ ID NO: 664333 - DNA, 22 bp, Artificial Sequence
  chemically synthesized
cttatgtctacaaatttcatga

SEQ ID NO: 664334 - DNA, 22 bp, Artificial Sequence
  chemically synthesized
atgtctacaaatttcatgaaca

SEQ ID NO: 664335 - DNA, 22 bp, Artificial Sequence
  chemically synthesized
tgtctacaaatttcatgaacat

SEQ ID NO: 664336 - DNA, 22 bp, Artificial Sequence
  chemically synthesized
acaagggataaccaggatgttc

SEQ ID NO: 664337 - DNA, 22 bp, Artificial Sequence
  chemically synthesized
caaatttcatgaacatcctggt

SEQ ID NO: 664338 - DNA, 22 bp, Artificial Sequence
  chemically synthesized
cagtctaacaagggataaccag

SEQ ID NO: 664339 - DNA, 22 bp, Artificial Sequence
  chemically synthesized
acagtctaacaagggataacca

SEQ ID NO: 664340 - DNA, 22 bp, Artificial Sequence
  chemically synthesized
catgaacatcctggttatccct

SEQ ID NO: 664341 - DNA, 22 bp, Artificial Sequence
  chemically synthesized
atgaacatcctggttatccctt

SEQ ID NO: 664342 - DNA, 22 bp, Artificial Sequence
  chemically synthesized
atggaacttacagtctaacaag

SEQ ID NO: 664343 - DNA, 22 bp, Artificial Sequence
  chemically synthesized
tgatggaacttacagtctaaca

SEQ ID NO: 664344 - DNA, 22 bp, Artificial Sequence
  chemically synthesized
gttatcccttgttagactgtaa

SEQ ID NO: 664345 - DNA, 22 bp, Artificial Sequence
  chemically synthesized
ctctgatggaacttacagtcta

SEQ ID NO: 664346 - DNA, 22 bp, Artificial Sequence
  chemically synthesized
tgctctgatggaacttacagtc

SEQ ID NO: 664347 - DNA, 22 bp, Artificial Sequence
  chemically synthesized
ctgctctgatggaacttacagt

SEQ ID NO: 664348 - DNA, 22 bp, Artificial Sequence
  chemically synthesized
tcccttgttagactgtaagttc

SEQ ID NO: 664349 - DNA, 22 bp, Artificial Sequence
  chemically synthesized
gttagactgtaagttccatcag

SEQ ID NO: 664350 - DNA, 22 bp, Artificial Sequence
  chemically synthesized
ttagactgtaagttccatcaga

SEQ ID NO: 664351 - DNA, 22 bp, Artificial Sequence
  chemically synthesized
gactgtaagttccatcagagca

SEQ ID NO: 664352 - DNA, 22 bp, Artificial Sequence
  chemically synthesized
taagttccatcagagcagaaac

SEQ ID NO: 664353 - DNA, 22 bp, Artificial Sequence
  chemically synthesized
catcagagcagaaactgtgcct

SEQ ID NO: 664354 - DNA, 22 bp, Artificial Sequence
  chemically synthesized
tgcctgttgggccgggcgcatt

SEQ ID NO: 664355 - DNA, 22 bp, Artificial Sequence
  chemically synthesized
caggcgtgagccaatgcgcccg

SEQ ID NO: 664356 - DNA, 22 bp, Artificial Sequence
  chemically synthesized
ttgggccgggcgcattggctca

SEQ ID NO: 664357 - DNA, 22 bp, Artificial Sequence
  chemically synthesized
ggattacaggcgtgagccaatg

SEQ ID NO: 664358 - DNA, 22 bp, Artificial Sequence
  chemically synthesized
ggccgggcgcattggctcacgc

SEQ ID NO: 664359 - DNA, 22 bp, Artificial Sequence
  chemically synthesized
ccaaagtgctgggattacaggc

SEQ ID NO: 664360 - DNA, 22 bp, Artificial Sequence
  chemically synthesized
gctcacgcctgtaatcccagca

SEQ ID NO: 664361 - DNA, 22 bp, Artificial Sequence
  chemically synthesized
agcctcccaaagtgctgggatt

SEQ ID NO: 664362 - DNA, 22 bp, Artificial Sequence
  chemically synthesized
acgcctgtaatcccagcacttt

SEQ ID NO: 664363 - DNA, 22 bp, Artificial Sequence
  chemically synthesized
acccgcctcagcctcccaaagt

SEQ ID NO: 664364 - DNA, 22 bp, Artificial Sequence
  chemically synthesized
taatcccagcactttgggaggc

SEQ ID NO: 664365 - DNA, 22 bp, Artificial Sequence
  chemically synthesized
aggtgattcacccgcctcagcc

SEQ ID NO: 664366 - DNA, 22 bp, Artificial Sequence
  chemically synthesized
acctcaggtgattcacccgcct

SEQ ID NO: 664367 - DNA, 22 bp, Artificial Sequence
  chemically synthesized
tgggaggctgaggcgggtgaat

SEQ ID NO: 664368 - DNA, 22 bp, Artificial Sequence
  chemically synthesized
gggaggctgaggcgggtgaatc

SEQ ID NO: 664369 - DNA, 22 bp, Artificial Sequence
  chemically synthesized
ctgacctcaggtgattcacccg

SEQ ID NO: 664370 - DNA, 22 bp, Artificial Sequence
  chemically synthesized
ggaggctgaggcgggtgaatca

SEQ ID NO: 664371 - DNA, 22 bp, Artificial Sequence
  chemically synthesized
gaactcctgacctcaggtgatt

SEQ ID NO: 664372 - DNA, 22 bp, Artificial Sequence
  chemically synthesized
aggcgggtgaatcacctgaggt

SEQ ID NO: 664373 - DNA, 22 bp, Artificial Sequence
  chemically synthesized
gtctcgaactcctgacctcagg

SEQ ID NO: 664374 - DNA, 22 bp, Artificial Sequence
  chemically synthesized
gtcaggctggtctcgaactcct

SEQ ID NO: 664375 - DNA, 22 bp, Artificial Sequence
  chemically synthesized
aggtcaggagttcgagaccagc

SEQ ID NO: 664376 - DNA, 22 bp, Artificial Sequence
  chemically synthesized
accatgttggtcaggctggtct

SEQ ID NO: 664377 - DNA, 22 bp, Artificial Sequence
  chemically synthesized
caccatgttggtcaggctggtc

SEQ ID NO: 664378 - DNA, 22 bp, Artificial Sequence
  chemically synthesized
gagaccagcctgaccaacatgg

SEQ ID NO: 664379 - DNA, 22 bp, Artificial Sequence
  chemically synthesized
atagagacggggtttcaccatg

SEQ ID NO: 664380 - DNA, 22 bp, Artificial Sequence
  chemically synthesized
aatagagacggggtttcaccat

SEQ ID NO: 664381 - DNA, 22 bp, Artificial Sequence
  chemically synthesized
taatagagacggggtttcacca

SEQ ID NO: 664382 - DNA, 22 bp, Artificial Sequence
  chemically synthesized
ttaatagagacggggtttcacc

SEQ ID NO: 664383 - DNA, 22 bp, Artificial Sequence
  chemically synthesized
tttaatagagacggggtttcac

SEQ ID NO: 664384 - DNA, 22 bp, Artificial Sequence
  chemically synthesized
accaacatggtgaaaccccgtc

SEQ ID NO: 664385 - DNA, 22 bp, Artificial Sequence
  chemically synthesized
tattttttaatagagacggggt

SEQ ID NO: 664386 - DNA, 22 bp, Artificial Sequence
  chemically synthesized
gtattttttaatagagacgggg

SEQ ID NO: 664387 - DNA, 22 bp, Artificial Sequence
  chemically synthesized
tgtattttttaatagagacggg

SEQ ID NO: 664388 - DNA, 22 bp, Artificial Sequence
  chemically synthesized
ttgtattttttaatagagacgg

SEQ ID NO: 664389 - DNA, 22 bp, Artificial Sequence
  chemically synthesized
atttttgtattttttaatagag

SEQ ID NO: 664390 - DNA, 22 bp, Artificial Sequence
  chemically synthesized
tattaaaaaatacaaaaattag

SEQ ID NO: 664391 - DNA, 22 bp, Artificial Sequence
  chemically synthesized
ttaaaaaatacaaaaattaggc

SEQ ID NO: 664392 - DNA, 22 bp, Artificial Sequence
  chemically synthesized
aaaaatacaaaaattaggccgg

SEQ ID NO: 664393 - DNA, 22 bp, Artificial Sequence
  chemically synthesized
caggcatgagccaccacgcccg

SEQ ID NO: 664394 - DNA, 22 bp, Artificial Sequence
  chemically synthesized
ggattacaggcatgagccacca

SEQ ID NO: 664395 - DNA, 22 bp, Artificial Sequence
  chemically synthesized
ggccgggcgtggtggctcatgc

SEQ ID NO: 664396 - DNA, 22 bp, Artificial Sequence
  chemically synthesized
ccaaagtgctgggattacaggc

SEQ ID NO: 664397 - DNA, 22 bp, Artificial Sequence
  chemically synthesized
ggcctcccaaagtgctgggatt

SEQ ID NO: 664398 - DNA, 22 bp, Artificial Sequence
  chemically synthesized
ctcggcctcccaaagtgctggg

SEQ ID NO: 664399 - DNA, 22 bp, Artificial Sequence
  chemically synthesized
atgcctgtaatcccagcacttt

SEQ ID NO: 664400 - DNA, 22 bp, Artificial Sequence
  chemically synthesized
taatcccagcactttgggaggc

SEQ ID NO: 664401 - DNA, 22 bp, Artificial Sequence
  chemically synthesized
tgatccgccctcctcggcctcc

SEQ ID NO: 664402 - DNA, 22 bp, Artificial Sequence
  chemically synthesized
gtgatccgccctcctcggcctc

SEQ ID NO: 664403 - DNA, 22 bp, Artificial Sequence
  chemically synthesized
accttgtgatccgccctcctcg

SEQ ID NO: 664404 - DNA, 22 bp, Artificial Sequence
  chemically synthesized
ctgaccttgtgatccgccctcc

SEQ ID NO: 664405 - DNA, 22 bp, Artificial Sequence
  chemically synthesized
tgggaggccgaggagggcggat

SEQ ID NO: 664406 - DNA, 22 bp, Artificial Sequence
  chemically synthesized
gggaggccgaggagggcggatc

SEQ ID NO: 664407 - DNA, 22 bp, Artificial Sequence
  chemically synthesized
ggaggccgaggagggcggatca

SEQ ID NO: 664408 - DNA, 22 bp, Artificial Sequence
  chemically synthesized
gatctcctgaccttgtgatccg

SEQ ID NO: 664409 - DNA, 22 bp, Artificial Sequence
  chemically synthesized
gccaggatggtctcgatctcct

SEQ ID NO: 664410 - DNA, 22 bp, Artificial Sequence
  chemically synthesized
accgtgttagccaggatggtct

SEQ ID NO: 664411 - DNA, 22 bp, Artificial Sequence
  chemically synthesized
caccgtgttagccaggatggtc

SEQ ID NO: 664412 - DNA, 22 bp, Artificial Sequence
  chemically synthesized
gtagaggcggggtttcaccgtg

SEQ ID NO: 664413 - DNA, 22 bp, Artificial Sequence
  chemically synthesized
agtagaggcggggtttcaccgt

SEQ ID NO: 664414 - DNA, 22 bp, Artificial Sequence
  chemically synthesized
tagtagaggcggggtttcaccg

SEQ ID NO: 664415 - DNA, 22 bp, Artificial Sequence
  chemically synthesized
gctaacacggtgaaaccccgcc

SEQ ID NO: 664416 - DNA, 22 bp, Artificial Sequence
  chemically synthesized
taattttagtagaggcggggtt

SEQ ID NO: 664417 - DNA, 22 bp, Artificial Sequence
  chemically synthesized
gtaattttagtagaggcggggt

SEQ ID NO: 664418 - DNA, 22 bp, Artificial Sequence
  chemically synthesized
tgtaattttagtagaggcgggg

SEQ ID NO: 664419 - DNA, 22 bp, Artificial Sequence
  chemically synthesized
acacggtgaaaccccgcctcta

SEQ ID NO: 664420 - DNA, 22 bp, Artificial Sequence
  chemically synthesized
ttgtaattttagtagaggcggg

SEQ ID NO: 664421 - DNA, 22 bp, Artificial Sequence
  chemically synthesized
tttttgtaattttagtagaggc

SEQ ID NO: 664422 - DNA, 22 bp, Artificial Sequence
  chemically synthesized
gtttttgtaattttagtagagg

SEQ ID NO: 664423 - DNA, 22 bp, Artificial Sequence
  chemically synthesized
tgtttttgtaattttagtagag

SEQ ID NO: 664424 - DNA, 22 bp, Artificial Sequence
  chemically synthesized
attttgtttttgtaattttagt

SEQ ID NO: 664425 - DNA, 22 bp, Artificial Sequence
  chemically synthesized
gctaattttgtttttgtaattt

SEQ ID NO: 664426 - DNA, 22 bp, Artificial Sequence
  chemically synthesized
tactaaaattacaaaaacaaaa

SEQ ID NO: 664427 - DNA, 22 bp, Artificial Sequence
  chemically synthesized
ctaaaattacaaaaacaaaatt

SEQ ID NO: 664428 - DNA, 22 bp, Artificial Sequence
  chemically synthesized
aaattacaaaaacaaaattagc

SEQ ID NO: 664429 - DNA, 22 bp, Artificial Sequence
  chemically synthesized
caaaaacaaaattagccaggcg

SEQ ID NO: 664430 - DNA, 22 bp, Artificial Sequence
  chemically synthesized
caggcacccaccaccacgcctg

SEQ ID NO: 664431 - DNA, 22 bp, Artificial Sequence
  chemically synthesized
ggactacaggcacccaccacca

SEQ ID NO: 664432 - DNA, 22 bp, Artificial Sequence
  chemically synthesized
gccaggcgtggtggtgggtgcc

SEQ ID NO: 664433 - DNA, 22 bp, Artificial Sequence
  chemically synthesized
cggagtagctgggactacaggc

SEQ ID NO: 664434 - DNA, 22 bp, Artificial Sequence
  chemically synthesized
agcctccggagtagctgggact

SEQ ID NO: 664435 - DNA, 22 bp, Artificial Sequence
  chemically synthesized
gctcagcctccggagtagctgg

SEQ ID NO: 664436 - DNA, 22 bp, Artificial Sequence
  chemically synthesized
ctggctcagcctccggagtagc

SEQ ID NO: 664437 - DNA, 22 bp, Artificial Sequence
  chemically synthesized
tcctggctcagcctccggagta

SEQ ID NO: 664438 - DNA, 22 bp, Artificial Sequence
  chemically synthesized
tagtcccagctactccggaggc

SEQ ID NO: 664439 - DNA, 22 bp, Artificial Sequence
  chemically synthesized
acgccattctcctggctcagcc

SEQ ID NO: 664440 - DNA, 22 bp, Artificial Sequence
  chemically synthesized
ctccggaggctgagccaggaga

SEQ ID NO: 664441 - DNA, 22 bp, Artificial Sequence
  chemically synthesized
cggaggctgagccaggagaatg

SEQ ID NO: 664442 - DNA, 22 bp, Artificial Sequence
  chemically synthesized
ccgggttcacgccattctcctg

SEQ ID NO: 664443 - DNA, 22 bp, Artificial Sequence
  chemically synthesized
cacctcccgggttcacgccatt

SEQ ID NO: 664444 - DNA, 22 bp, Artificial Sequence
  chemically synthesized
agccaggagaatggcgtgaacc

SEQ ID NO: 664445 - DNA, 22 bp, Artificial Sequence
  chemically synthesized
cagactccacctcccgggttca

SEQ ID NO: 664446 - DNA, 22 bp, Artificial Sequence
  chemically synthesized
actgcagactccacctcccggg

SEQ ID NO: 664447 - DNA, 22 bp, Artificial Sequence
  chemically synthesized
ggctcactgcagactccacctc

SEQ ID NO: 664448 - DNA, 22 bp, Artificial Sequence
  chemically synthesized
taggctcactgcagactccacc

SEQ ID NO: 664449 - DNA, 22 bp, Artificial Sequence
  chemically synthesized
gagtgcagtggcgcgttctagg

SEQ ID NO: 664450 - DNA, 22 bp, Artificial Sequence
  chemically synthesized
gctggagtgcagtggcgcgttc

SEQ ID NO: 664451 - DNA, 22 bp, Artificial Sequence
  chemically synthesized
cagtgagcctagaacgcgccac

SEQ ID NO: 664452 - DNA, 22 bp, Artificial Sequence
  chemically synthesized
tcaccctggctggagtgcagtg

SEQ ID NO: 664453 - DNA, 22 bp, Artificial Sequence
  chemically synthesized
tgtcaccctggctggagtgcag

SEQ ID NO: 664454 - DNA, 22 bp, Artificial Sequence
  chemically synthesized
gaacgcgccactgcactccagc

SEQ ID NO: 664455 - DNA, 22 bp, Artificial Sequence
  chemically synthesized
gctctgtcaccctggctggagt

SEQ ID NO: 664456 - DNA, 22 bp, Artificial Sequence
  chemically synthesized
cactccagccagggtgacagag

SEQ ID NO: 664457 - DNA, 22 bp, Artificial Sequence
  chemically synthesized
agacagagtctcgctctgtcac

SEQ ID NO: 664458 - DNA, 22 bp, Artificial Sequence
  chemically synthesized
gagacagagtctcgctctgtca

SEQ ID NO: 664459 - DNA, 22 bp, Artificial Sequence
  chemically synthesized
tgagacagagtctcgctctgtc

SEQ ID NO: 664460 - DNA, 22 bp, Artificial Sequence
  chemically synthesized
ttgagacagagtctcgctctgt

SEQ ID NO: 664461 - DNA, 22 bp, Artificial Sequence
  chemically synthesized
cagccagggtgacagagcgaga

SEQ ID NO: 664462 - DNA, 22 bp, Artificial Sequence
  chemically synthesized
tttgagacagagtctcgctctg

SEQ ID NO: 664463 - DNA, 22 bp, Artificial Sequence
  chemically synthesized
ttttgagacagagtctcgctct

SEQ ID NO: 664464 - DNA, 22 bp, Artificial Sequence
  chemically synthesized
tttttgagacagagtctcgctc

SEQ ID NO: 664465 - DNA, 22 bp, Artificial Sequence
  chemically synthesized
ttttttgagacagagtctcgct

SEQ ID NO: 664466 - DNA, 22 bp, Artificial Sequence
  chemically synthesized
tttttttttgagacagagtctc

SEQ ID NO: 664467 - DNA, 22 bp, Artificial Sequence
  chemically synthesized
gtttttttttgagacagagtct

SEQ ID NO: 664468 - DNA, 22 bp, Artificial Sequence
  chemically synthesized
tgtttttttttgagacagagtc

SEQ ID NO: 664469 - DNA, 22 bp, Artificial Sequence
  chemically synthesized
ttttgtttttttttgagacaga

SEQ ID NO: 664470 - DNA, 22 bp, Artificial Sequence
  chemically synthesized
gttttgtttttttttgagacag

SEQ ID NO: 664471 - DNA, 22 bp, Artificial Sequence
  chemically synthesized
tttgttttgtttttttttgaga

SEQ ID NO: 664472 - DNA, 22 bp, Artificial Sequence
  chemically synthesized
gtttgttttgtttttttttgag

SEQ ID NO: 664473 - DNA, 22 bp, Artificial Sequence
  chemically synthesized
tttgtttgttttgttttttttt

SEQ ID NO: 664474 - DNA, 22 bp, Artificial Sequence
  chemically synthesized
gtttgtttgttttgtttttttt

SEQ ID NO: 664475 - DNA, 22 bp, Artificial Sequence
  chemically synthesized
tttgtttgtttgttttgttttt

SEQ ID NO: 664476 - DNA, 22 bp, Artificial Sequence
  chemically synthesized
gtttgtttgtttgttttgtttt

SEQ ID NO: 664477 - DNA, 22 bp, Artificial Sequence
  chemically synthesized
tgtctcaaaaaaaaacaaaaca

SEQ ID NO: 664478 - DNA, 22 bp, Artificial Sequence
  chemically synthesized
tctcaaaaaaaaacaaaacaaa

SEQ ID NO: 664479 - DNA, 22 bp, Artificial Sequence
  chemically synthesized
tttgtttgtttgtttgttttgt

SEQ ID NO: 664480 - DNA, 22 bp, Artificial Sequence
  chemically synthesized
gtttgtttgtttgtttgttttg

SEQ ID NO: 664481 - DNA, 22 bp, Artificial Sequence
  chemically synthesized
tgtttgtttgtttgtttgtttt

SEQ ID NO: 664482 - DNA, 22 bp, Artificial Sequence
  chemically synthesized
ttgtttgtttgtttgtttgttt

SEQ ID NO: 664483 - DNA, 22 bp, Artificial Sequence
  chemically synthesized
aaaaaaaaacaaaacaaacaaa

SEQ ID NO: 664484 - DNA, 22 bp, Artificial Sequence
  chemically synthesized
tttgtttgtttgtttgtttgtt

SEQ ID NO: 664485 - DNA, 22 bp, Artificial Sequence
  chemically synthesized
ttttttgtttgtttgtttgttt

SEQ ID NO: 664486 - DNA, 22 bp, Artificial Sequence
  chemically synthesized
gttttttgtttgtttgtttgtt

SEQ ID NO: 664487 - DNA, 22 bp, Artificial Sequence
  chemically synthesized
tgttttttgtttgtttgtttgt

SEQ ID NO: 664488 - DNA, 22 bp, Artificial Sequence
  chemically synthesized
ttgttttttgtttgtttgtttg

SEQ ID NO: 664489 - DNA, 22 bp, Artificial Sequence
  chemically synthesized
atttttgttttttgtttgtttg

SEQ ID NO: 664490 - DNA, 22 bp, Artificial Sequence
  chemically synthesized
caggcatgccccaccatgcccg

SEQ ID NO: 664491 - DNA, 22 bp, Artificial Sequence
  chemically synthesized
ggattacaggcatgccccacca

SEQ ID NO: 664492 - DNA, 22 bp, Artificial Sequence
  chemically synthesized
gccgggcatggtggggcatgcc

SEQ ID NO: 664493 - DNA, 22 bp, Artificial Sequence
  chemically synthesized
ccaggtagctgggattacaggc

SEQ ID NO: 664494 - DNA, 22 bp, Artificial Sequence
  chemically synthesized
cgtcagcctcccaggtagctgg

SEQ ID NO: 664495 - DNA, 22 bp, Artificial Sequence
  chemically synthesized
ctgcgtcagcctcccaggtagc

SEQ ID NO: 664496 - DNA, 22 bp, Artificial Sequence
  chemically synthesized
tcctgcgtcagcctcccaggta

SEQ ID NO: 664497 - DNA, 22 bp, Artificial Sequence
  chemically synthesized
taatcccagctacctgggaggc

SEQ ID NO: 664498 - DNA, 22 bp, Artificial Sequence
  chemically synthesized
aagtgattctcctgcgtcagcc

SEQ ID NO: 664499 - DNA, 22 bp, Artificial Sequence
  chemically synthesized
cctgggaggctgacgcaggaga

SEQ ID NO: 664500 - DNA, 22 bp, Artificial Sequence
  chemically synthesized
ccaggttcaagtgattctcctg

SEQ ID NO: 664501 - DNA, 22 bp, Artificial Sequence
  chemically synthesized
ggaggctgacgcaggagaatca

SEQ ID NO: 664502 - DNA, 22 bp, Artificial Sequence
  chemically synthesized
cacctcccaggttcaagtgatt

SEQ ID NO: 664503 - DNA, 22 bp, Artificial Sequence
  chemically synthesized
acgcaggagaatcacttgaacc

SEQ ID NO: 664504 - DNA, 22 bp, Artificial Sequence
  chemically synthesized
caacctccacctcccaggttca

SEQ ID NO: 664505 - DNA, 22 bp, Artificial Sequence
  chemically synthesized
actgcaacctccacctcccagg

SEQ ID NO: 664506 - DNA, 22 bp, Artificial Sequence
  chemically synthesized
gaacctgggaggtggaggttgc

SEQ ID NO: 664507 - DNA, 22 bp, Artificial Sequence
  chemically synthesized
aacctgggaggtggaggttgca

SEQ ID NO: 664508 - DNA, 22 bp, Artificial Sequence
  chemically synthesized
ggaggtggaggttgcagtgagc

SEQ ID NO: 664509 - DNA, 22 bp, Artificial Sequence
  chemically synthesized
cagtgagcccatattgcgccac

SEQ ID NO: 664510 - DNA, 22 bp, Artificial Sequence
  chemically synthesized
gagtgcagtggagtggcgcaat

SEQ ID NO: 664511 - DNA, 22 bp, Artificial Sequence
  chemically synthesized
cccaggctggagtgcagtggag

SEQ ID NO: 664512 - DNA, 22 bp, Artificial Sequence
  chemically synthesized
ttgcccaggctggagtgcagtg

SEQ ID NO: 664513 - DNA, 22 bp, Artificial Sequence
  chemically synthesized
tgttgcccaggctggagtgcag

SEQ ID NO: 664514 - DNA, 22 bp, Artificial Sequence
  chemically synthesized
cgccactccactgcactccagc

SEQ ID NO: 664515 - DNA, 22 bp, Artificial Sequence
  chemically synthesized
ctctgttgcccaggctggagtg

SEQ ID NO: 664516 - DNA, 22 bp, Artificial Sequence
  chemically synthesized
gctctgttgcccaggctggagt

SEQ ID NO: 664517 - DNA, 22 bp, Artificial Sequence
  chemically synthesized
cactgcactccagcctgggcaa

SEQ ID NO: 664518 - DNA, 22 bp, Artificial Sequence
  chemically synthesized
cactccagcctgggcaacagag

SEQ ID NO: 664519 - DNA, 22 bp, Artificial Sequence
  chemically synthesized
agatggagtcttgctctgttgc

SEQ ID NO: 664520 - DNA, 22 bp, Artificial Sequence
  chemically synthesized
gagatggagtcttgctctgttg

SEQ ID NO: 664521 - DNA, 22 bp, Artificial Sequence
  chemically synthesized
tgagatggagtcttgctctgtt

SEQ ID NO: 664522 - DNA, 22 bp, Artificial Sequence
  chemically synthesized
ttgagatggagtcttgctctgt

SEQ ID NO: 664523 - DNA, 22 bp, Artificial Sequence
  chemically synthesized
cagcctgggcaacagagcaaga

SEQ ID NO: 664524 - DNA, 22 bp, Artificial Sequence
  chemically synthesized
tttgagatggagtcttgctctg

SEQ ID NO: 664525 - DNA, 22 bp, Artificial Sequence
  chemically synthesized
ttttgagatggagtcttgctct

SEQ ID NO: 664526 - DNA, 22 bp, Artificial Sequence
  chemically synthesized
tttttgagatggagtcttgctc

SEQ ID NO: 664527 - DNA, 22 bp, Artificial Sequence
  chemically synthesized
ttttttgagatggagtcttgct

SEQ ID NO: 664528 - DNA, 22 bp, Artificial Sequence
  chemically synthesized
tttttttgagatggagtcttgc

SEQ ID NO: 664529 - DNA, 22 bp, Artificial Sequence
  chemically synthesized
ttttttttgagatggagtcttg

SEQ ID NO: 664530 - DNA, 22 bp, Artificial Sequence
  chemically synthesized
tttttttttgagatggagtctt

SEQ ID NO: 664531 - DNA, 22 bp, Artificial Sequence
  chemically synthesized
ggcaacagagcaagactccatc

SEQ ID NO: 664532 - DNA, 22 bp, Artificial Sequence
  chemically synthesized
ttttttttttgagatggagtct

SEQ ID NO: 664533 - DNA, 22 bp, Artificial Sequence
  chemically synthesized
tttttttttttgagatggagtc

SEQ ID NO: 664534 - DNA, 22 bp, Artificial Sequence
  chemically synthesized
ttttttttttttgagatggagt

SEQ ID NO: 664535 - DNA, 22 bp, Artificial Sequence
  chemically synthesized
tttttttttttttgagatggag

SEQ ID NO: 664536 - DNA, 22 bp, Artificial Sequence
  chemically synthesized
ttttttttttttttgagatgga

SEQ ID NO: 664537 - DNA, 22 bp, Artificial Sequence
  chemically synthesized
tttttttttttttttgagatgg

SEQ ID NO: 664538 - DNA, 22 bp, Artificial Sequence
  chemically synthesized
ttttttttttttttttgagatg

SEQ ID NO: 664539 - DNA, 22 bp, Artificial Sequence
  chemically synthesized
tttttttttttttttttgagat

SEQ ID NO: 664540 - DNA, 22 bp, Artificial Sequence
  chemically synthesized
ttttttttttttttttttgaga

SEQ ID NO: 664541 - DNA, 22 bp, Artificial Sequence
  chemically synthesized
tttttttttttttttttttgag

SEQ ID NO: 664542 - DNA, 22 bp, Artificial Sequence
  chemically synthesized
ttttttttttttttttttttga

SEQ ID NO: 664543 - DNA, 22 bp, Artificial Sequence
  chemically synthesized
tttttttttttttttttttttg

SEQ ID NO: 664544 - DNA, 22 bp, Artificial Sequence
  chemically synthesized
tttttttttttttttttttttt

SEQ ID NO: 664545 - DNA, 22 bp, Artificial Sequence
  chemically synthesized
tttttttttttttttttttttt

SEQ ID NO: 664546 - DNA, 22 bp, Artificial Sequence
  chemically synthesized
tgtttttttttttttttttttt

SEQ ID NO: 664547 - DNA, 22 bp, Artificial Sequence
  chemically synthesized
catctcaaaaaaaaaaaaaaaa

SEQ ID NO: 664548 - DNA, 22 bp, Artificial Sequence
  chemically synthesized
ctgttttttttttttttttttt

SEQ ID NO: 664549 - DNA, 22 bp, Artificial Sequence
  chemically synthesized
tctgtttttttttttttttttt

SEQ ID NO: 664550 - DNA, 22 bp, Artificial Sequence
  chemically synthesized
ttctgttttttttttttttttt

SEQ ID NO: 664551 - DNA, 22 bp, Artificial Sequence
  chemically synthesized
tttctgtttttttttttttttt

SEQ ID NO: 664552 - DNA, 22 bp, Artificial Sequence
  chemically synthesized
ttttctgttttttttttttttt

SEQ ID NO: 664553 - DNA, 22 bp, Artificial Sequence
  chemically synthesized
tttttctgtttttttttttttt

SEQ ID NO: 664554 - DNA, 22 bp, Artificial Sequence
  chemically synthesized
aaaaaaaaaaaaaaaaaaaaaa

SEQ ID NO: 664555 - DNA, 22 bp, Artificial Sequence
  chemically synthesized
tttttttctgtttttttttttt

SEQ ID NO: 664556 - DNA, 22 bp, Artificial Sequence
  chemically synthesized
ctttttttctgttttttttttt

SEQ ID NO: 664557 - DNA, 22 bp, Artificial Sequence
  chemically synthesized
tctttttttctgtttttttttt

SEQ ID NO: 664558 - DNA, 22 bp, Artificial Sequence
  chemically synthesized
ttctttttttctgttttttttt

SEQ ID NO: 664559 - DNA, 22 bp, Artificial Sequence
  chemically synthesized
tttctttttttctgtttttttt

SEQ ID NO: 664560 - DNA, 22 bp, Artificial Sequence
  chemically synthesized
tttttctttttttctgtttttt

SEQ ID NO: 664561 - DNA, 22 bp, Artificial Sequence
  chemically synthesized
ctttttctttttttctgttttt

SEQ ID NO: 664562 - DNA, 22 bp, Artificial Sequence
  chemically synthesized
atgatatgcccatgaaacaggc

SEQ ID NO: 664563 - DNA, 22 bp, Artificial Sequence
  chemically synthesized
tgtgcattgatgatatgcccat

SEQ ID NO: 664564 - DNA, 22 bp, Artificial Sequence
  chemically synthesized
tgcctgtttcatgggcatatca

SEQ ID NO: 664565 - DNA, 22 bp, Artificial Sequence
  chemically synthesized
tttcatgggcatatcatcaatg

SEQ ID NO: 664566 - DNA, 22 bp, Artificial Sequence
  chemically synthesized
agggtctgtgtgcattgatgat

SEQ ID NO: 664567 - DNA, 22 bp, Artificial Sequence
  chemically synthesized
catgggcatatcatcaatgcac

SEQ ID NO: 664568 - DNA, 22 bp, Artificial Sequence
  chemically synthesized
atgggcatatcatcaatgcaca

SEQ ID NO: 664569 - DNA, 22 bp, Artificial Sequence
  chemically synthesized
tctgagggtctgtgtgcattga

SEQ ID NO: 664570 - DNA, 22 bp, Artificial Sequence
  chemically synthesized
ttgtctgagggtctgtgtgcat

SEQ ID NO: 664571 - DNA, 22 bp, Artificial Sequence
  chemically synthesized
ctattgtctgagggtctgtgtg

SEQ ID NO: 664572 - DNA, 22 bp, Artificial Sequence
  chemically synthesized
tactattgtctgagggtctgtg

SEQ ID NO: 664573 - DNA, 22 bp, Artificial Sequence
  chemically synthesized
tgtataactctactattgtctg

SEQ ID NO: 664574 - DNA, 22 bp, Artificial Sequence
  chemically synthesized
atgtataactctactattgtct

SEQ ID NO: 664575 - DNA, 22 bp, Artificial Sequence
  chemically synthesized
agacaatagtagagttatacat

SEQ ID NO: 664576 - DNA, 22 bp, Artificial Sequence
  chemically synthesized
tcatgtcatcaaatagtttatg

SEQ ID NO: 664577 - DNA, 22 bp, Artificial Sequence
  chemically synthesized
tatcatgtcatcaaatagttta

SEQ ID NO: 664578 - DNA, 22 bp, Artificial Sequence
  chemically synthesized
tacataaactatttgatgacat

SEQ ID NO: 664579 - DNA, 22 bp, Artificial Sequence
  chemically synthesized
cacagctctatcatgtcatcaa

SEQ ID NO: 664580 - DNA, 22 bp, Artificial Sequence
  chemically synthesized
aagtgttacacagctctatcat

SEQ ID NO: 664581 - DNA, 22 bp, Artificial Sequence
  chemically synthesized
tttgatgacatgatagagctgt

SEQ ID NO: 664582 - DNA, 22 bp, Artificial Sequence
  chemically synthesized
gatgacatgatagagctgtgta

SEQ ID NO: 664583 - DNA, 22 bp, Artificial Sequence
  chemically synthesized
atgacatgatagagctgtgtaa

SEQ ID NO: 664584 - DNA, 22 bp, Artificial Sequence
  chemically synthesized
tggaaaaatcctgaagtgttac

SEQ ID NO: 664585 - DNA, 22 bp, Artificial Sequence
  chemically synthesized
tgtaacacttcaggatttttcc

SEQ ID NO: 664586 - DNA, 22 bp, Artificial Sequence
  chemically synthesized
tcatacatctgtggaaaaatcc

SEQ ID NO: 664587 - DNA, 22 bp, Artificial Sequence
  chemically synthesized
atcatacatctgtggaaaaatc

SEQ ID NO: 664588 - DNA, 22 bp, Artificial Sequence
  chemically synthesized
tatcatacatctgtggaaaaat

SEQ ID NO: 664589 - DNA, 22 bp, Artificial Sequence
  chemically synthesized
ttatcatacatctgtggaaaaa

SEQ ID NO: 664590 - DNA, 22 bp, Artificial Sequence
  chemically synthesized
tttatcatacatctgtggaaaa

SEQ ID NO: 664591 - DNA, 22 bp, Artificial Sequence
  chemically synthesized
ttttatcatacatctgtggaaa

SEQ ID NO: 664592 - DNA, 22 bp, Artificial Sequence
  chemically synthesized
cttttttatcatacatctgtgg

SEQ ID NO: 664593 - DNA, 22 bp, Artificial Sequence
  chemically synthesized
caggatttttccacagatgtat

SEQ ID NO: 664594 - DNA, 22 bp, Artificial Sequence
  chemically synthesized
aggatttttccacagatgtatg

SEQ ID NO: 664595 - DNA, 22 bp, Artificial Sequence
  chemically synthesized
ctccttttttatcatacatctg

SEQ ID NO: 664596 - DNA, 22 bp, Artificial Sequence
  chemically synthesized
cctccttttttatcatacatct

SEQ ID NO: 664597 - DNA, 22 bp, Artificial Sequence
  chemically synthesized
tcctccttttttatcatacatc

SEQ ID NO: 664598 - DNA, 22 bp, Artificial Sequence
  chemically synthesized
ctttcctccttttttatcatac

SEQ ID NO: 664599 - DNA, 22 bp, Artificial Sequence
  chemically synthesized
ttccacagatgtatgataaaaa

SEQ ID NO: 664600 - DNA, 22 bp, Artificial Sequence
  chemically synthesized
tccacagatgtatgataaaaaa

SEQ ID NO: 664601 - DNA, 22 bp, Artificial Sequence
  chemically synthesized
ccacagatgtatgataaaaaag

SEQ ID NO: 664602 - DNA, 22 bp, Artificial Sequence
  chemically synthesized
cacagatgtatgataaaaaagg

SEQ ID NO: 664603 - DNA, 22 bp, Artificial Sequence
  chemically synthesized
tgtcatttttcctctaccactt

SEQ ID NO: 664604 - DNA, 22 bp, Artificial Sequence
  chemically synthesized
tcatttttcctctaccacttca

SEQ ID NO: 664605 - DNA, 22 bp, Artificial Sequence
  chemically synthesized
acgtgcagatgaatgaagtggt

SEQ ID NO: 664606 - DNA, 22 bp, Artificial Sequence
  chemically synthesized
ttcctctaccacttcattcatc

SEQ ID NO: 664607 - DNA, 22 bp, Artificial Sequence
  chemically synthesized
tcctctaccacttcattcatct

SEQ ID NO: 664608 - DNA, 22 bp, Artificial Sequence
  chemically synthesized
cctctaccacttcattcatctg

SEQ ID NO: 664609 - DNA, 22 bp, Artificial Sequence
  chemically synthesized
aatgctaacgtgcagatgaatg

SEQ ID NO: 664610 - DNA, 22 bp, Artificial Sequence
  chemically synthesized
ctctaccacttcattcatctgc

SEQ ID NO: 664611 - DNA, 22 bp, Artificial Sequence
  chemically synthesized
gaatgctaacgtgcagatgaat

SEQ ID NO: 664612 - DNA, 22 bp, Artificial Sequence
  chemically synthesized
taccacttcattcatctgcacg

SEQ ID NO: 664613 - DNA, 22 bp, Artificial Sequence
  chemically synthesized
gcttgaatgctaacgtgcagat

SEQ ID NO: 664614 - DNA, 22 bp, Artificial Sequence
  chemically synthesized
ccacttcattcatctgcacgtt

SEQ ID NO: 664615 - DNA, 22 bp, Artificial Sequence
  chemically synthesized
ttagcttgaatgctaacgtgca

SEQ ID NO: 664616 - DNA, 22 bp, Artificial Sequence
  chemically synthesized
attagcttgaatgctaacgtgc

SEQ ID NO: 664617 - DNA, 22 bp, Artificial Sequence
  chemically synthesized
cattcatctgcacgttagcatt

SEQ ID NO: 664618 - DNA, 22 bp, Artificial Sequence
  chemically synthesized
attcatctgcacgttagcattc

SEQ ID NO: 664619 - DNA, 22 bp, Artificial Sequence
  chemically synthesized
atctgcacgttagcattcaagc

SEQ ID NO: 664620 - DNA, 22 bp, Artificial Sequence
  chemically synthesized
cacgttagcattcaagctaata

SEQ ID NO: 664621 - DNA, 22 bp, Artificial Sequence
  chemically synthesized
atagacatgtgtggtttattag

SEQ ID NO: 664622 - DNA, 22 bp, Artificial Sequence
  chemically synthesized
catagacatgtgtggtttatta

SEQ ID NO: 664623 - DNA, 22 bp, Artificial Sequence
  chemically synthesized
gcattcaagctaataaaccaca

SEQ ID NO: 664624 - DNA, 22 bp, Artificial Sequence
  chemically synthesized
aagctaataaaccacacatgtc

SEQ ID NO: 664625 - DNA, 22 bp, Artificial Sequence
  chemically synthesized
aaccaaacttcatagacatgtg

SEQ ID NO: 664626 - DNA, 22 bp, Artificial Sequence
  chemically synthesized
ataaaccacacatgtctatgaa

SEQ ID NO: 664627 - DNA, 22 bp, Artificial Sequence
  chemically synthesized
atctaaaccaaacttcatagac

SEQ ID NO: 664628 - DNA, 22 bp, Artificial Sequence
  chemically synthesized
tctgatctaaaccaaacttcat

SEQ ID NO: 664629 - DNA, 22 bp, Artificial Sequence
  chemically synthesized
tgactatctgatctaaaccaaa

SEQ ID NO: 664630 - DNA, 22 bp, Artificial Sequence
  chemically synthesized
tgaagtttggtttagatcagat

SEQ ID NO: 664631 - DNA, 22 bp, Artificial Sequence
  chemically synthesized
gaagactatgactatctgatct

SEQ ID NO: 664632 - DNA, 22 bp, Artificial Sequence
  chemically synthesized
gtattagaagactatgactatc

SEQ ID NO: 664633 - DNA, 22 bp, Artificial Sequence
  chemically synthesized
ggtttagatcagatagtcatag

SEQ ID NO: 664634 - DNA, 22 bp, Artificial Sequence
  chemically synthesized
agtattagaagactatgactat

SEQ ID NO: 664635 - DNA, 22 bp, Artificial Sequence
  chemically synthesized
gtttagatcagatagtcatagt

SEQ ID NO: 664636 - DNA, 22 bp, Artificial Sequence
  chemically synthesized
agatcagatagtcatagtcttc

SEQ ID NO: 664637 - DNA, 22 bp, Artificial Sequence
  chemically synthesized
gatcagatagtcatagtcttct

SEQ ID NO: 664638 - DNA, 22 bp, Artificial Sequence
  chemically synthesized
caaaatgtacttagtattagaa

SEQ ID NO: 664639 - DNA, 22 bp, Artificial Sequence
  chemically synthesized
acaaaatgtacttagtattaga

SEQ ID NO: 664640 - DNA, 22 bp, Artificial Sequence
  chemically synthesized
tacaaaatgtacttagtattag

SEQ ID NO: 664641 - DNA, 22 bp, Artificial Sequence
  chemically synthesized
ttacaaaatgtacttagtatta

SEQ ID NO: 664642 - DNA, 22 bp, Artificial Sequence
  chemically synthesized
tttacaaaatgtacttagtatt

SEQ ID NO: 664643 - DNA, 22 bp, Artificial Sequence
  chemically synthesized
tttttacaaaatgtacttagta

SEQ ID NO: 664644 - DNA, 22 bp, Artificial Sequence
  chemically synthesized
ctttttacaaaatgtacttagt

SEQ ID NO: 664645 - DNA, 22 bp, Artificial Sequence
  chemically synthesized
tctttttacaaaatgtacttag

SEQ ID NO: 664646 - DNA, 22 bp, Artificial Sequence
  chemically synthesized
ttctttttacaaaatgtactta

SEQ ID NO: 664647 - DNA, 22 bp, Artificial Sequence
  chemically synthesized
tttctttttacaaaatgtactt

SEQ ID NO: 664648 - DNA, 22 bp, Artificial Sequence
  chemically synthesized
ttttctttttacaaaatgtact

SEQ ID NO: 664649 - DNA, 22 bp, Artificial Sequence
  chemically synthesized
tttttctttttacaaaatgtac

SEQ ID NO: 664650 - DNA, 22 bp, Artificial Sequence
  chemically synthesized
ttttttctttttacaaaatgta

SEQ ID NO: 664651 - DNA, 22 bp, Artificial Sequence
  chemically synthesized
ctaatactaagtacattttgta

SEQ ID NO: 664652 - DNA, 22 bp, Artificial Sequence
  chemically synthesized
taatactaagtacattttgtaa

SEQ ID NO: 664653 - DNA, 22 bp, Artificial Sequence
  chemically synthesized
tttttttttctttttacaaaat

SEQ ID NO: 664654 - DNA, 22 bp, Artificial Sequence
  chemically synthesized
atactaagtacattttgtaaaa

SEQ ID NO: 664655 - DNA, 22 bp, Artificial Sequence
  chemically synthesized
gtttttttttctttttacaaaa

SEQ ID NO: 664656 - DNA, 22 bp, Artificial Sequence
  chemically synthesized
tgtttttttttctttttacaaa

SEQ ID NO: 664657 - DNA, 22 bp, Artificial Sequence
  chemically synthesized
cctttgtttttttttcttttta

SEQ ID NO: 664658 - DNA, 22 bp, Artificial Sequence
  chemically synthesized
agtacattttgtaaaaagaaaa

SEQ ID NO: 664659 - DNA, 22 bp, Artificial Sequence
  chemically synthesized
tacctttgtttttttttctttt

SEQ ID NO: 664660 - DNA, 22 bp, Artificial Sequence
  chemically synthesized
ttctacctttgtttttttttct

SEQ ID NO: 664661 - DNA, 22 bp, Artificial Sequence
  chemically synthesized
gttctacctttgtttttttttc

SEQ ID NO: 664662 - DNA, 22 bp, Artificial Sequence
  chemically synthesized
tgtaaaaagaaaaaaaaacaaa

SEQ ID NO: 664663 - DNA, 22 bp, Artificial Sequence
  chemically synthesized
gtaaaaagaaaaaaaaacaaag

SEQ ID NO: 664664 - DNA, 22 bp, Artificial Sequence
  chemically synthesized
taaaaagaaaaaaaaacaaagg

SEQ ID NO: 664665 - DNA, 22 bp, Artificial Sequence
  chemically synthesized
cacaatccttgttctacctttg

SEQ ID NO: 664666 - DNA, 22 bp, Artificial Sequence
  chemically synthesized
gcacaatccttgttctaccttt

SEQ ID NO: 664667 - DNA, 22 bp, Artificial Sequence
  chemically synthesized
tgaaacttgcacaatccttgtt

SEQ ID NO: 664668 - DNA, 22 bp, Artificial Sequence
  chemically synthesized
gtgaaacttgcacaatccttgt

SEQ ID NO: 664669 - DNA, 22 bp, Artificial Sequence
  chemically synthesized
tgtgaaacttgcacaatccttg

SEQ ID NO: 664670 - DNA, 22 bp, Artificial Sequence
  chemically synthesized
cctttgtgaaacttgcacaatc

SEQ ID NO: 664671 - DNA, 22 bp, Artificial Sequence
  chemically synthesized
tgcaagtttcacaaaggtaatt

SEQ ID NO: 664672 - DNA, 22 bp, Artificial Sequence
  chemically synthesized
gcatcggcatccataattacct

SEQ ID NO: 664673 - DNA, 22 bp, Artificial Sequence
  chemically synthesized
gcattggcatcggcatccataa

SEQ ID NO: 664674 - DNA, 22 bp, Artificial Sequence
  chemically synthesized
cacaaaggtaattatggatgcc

SEQ ID NO: 664675 - DNA, 22 bp, Artificial Sequence
  chemically synthesized
acaaaggtaattatggatgccg

SEQ ID NO: 664676 - DNA, 22 bp, Artificial Sequence
  chemically synthesized
ctggcattggcatcggcatcca

SEQ ID NO: 664677 - DNA, 22 bp, Artificial Sequence
  chemically synthesized
caactactggcattggcatcgg

SEQ ID NO: 664678 - DNA, 22 bp, Artificial Sequence
  chemically synthesized
ccaactactggcattggcatcg

SEQ ID NO: 664679 - DNA, 22 bp, Artificial Sequence
  chemically synthesized
tccaactactggcattggcatc

SEQ ID NO: 664680 - DNA, 22 bp, Artificial Sequence
  chemically synthesized
ttttccaactactggcattggc

SEQ ID NO: 664681 - DNA, 22 bp, Artificial Sequence
  chemically synthesized
tggatgccgatgccaatgccag

SEQ ID NO: 664682 - DNA, 22 bp, Artificial Sequence
  chemically synthesized
attttccaactactggcattgg

SEQ ID NO: 664683 - DNA, 22 bp, Artificial Sequence
  chemically synthesized
tattttccaactactggcattg

SEQ ID NO: 664684 - DNA, 22 bp, Artificial Sequence
  chemically synthesized
ttattttccaactactggcatt

SEQ ID NO: 664685 - DNA, 22 bp, Artificial Sequence
  chemically synthesized
agaatttttattttccaactac

SEQ ID NO: 664686 - DNA, 22 bp, Artificial Sequence
  chemically synthesized
agatattgagaatttttatttt

SEQ ID NO: 664687 - DNA, 22 bp, Artificial Sequence
  chemically synthesized
aattaagatattgagaattttt

SEQ ID NO: 664688 - DNA, 22 bp, Artificial Sequence
  chemically synthesized
gaaaataaaaattctcaatatc

SEQ ID NO: 664689 - DNA, 22 bp, Artificial Sequence
  chemically synthesized
atgttgaattaagatattgaga

SEQ ID NO: 664690 - DNA, 22 bp, Artificial Sequence
  chemically synthesized
ctgatgttgaattaagatattg

SEQ ID NO: 664691 - DNA, 22 bp, Artificial Sequence
  chemically synthesized
agctactgatgttgaattaaga

SEQ ID NO: 664692 - DNA, 22 bp, Artificial Sequence
  chemically synthesized
ctcagctactgatgttgaatta

SEQ ID NO: 664693 - DNA, 22 bp, Artificial Sequence
  chemically synthesized
tcaatatcttaattcaacatca

SEQ ID NO: 664694 - DNA, 22 bp, Artificial Sequence
  chemically synthesized
aatatcttaattcaacatcagt

SEQ ID NO: 664695 - DNA, 22 bp, Artificial Sequence
  chemically synthesized
tcaccattcctcagctactgat

SEQ ID NO: 664696 - DNA, 22 bp, Artificial Sequence
  chemically synthesized
ctgtcaccattcctcagctact

SEQ ID NO: 664697 - DNA, 22 bp, Artificial Sequence
  chemically synthesized
aattcaacatcagtagctgagg

SEQ ID NO: 664698 - DNA, 22 bp, Artificial Sequence
  chemically synthesized
attcaacatcagtagctgagga

SEQ ID NO: 664699 - DNA, 22 bp, Artificial Sequence
  chemically synthesized
aacatcagtagctgaggaatgg

SEQ ID NO: 664700 - DNA, 22 bp, Artificial Sequence
  chemically synthesized
gaatcattcctgtcaccattcc

SEQ ID NO: 664701 - DNA, 22 bp, Artificial Sequence
  chemically synthesized
agaatcattcctgtcaccattc

SEQ ID NO: 664702 - DNA, 22 bp, Artificial Sequence
  chemically synthesized
tagaatcattcctgtcaccatt

SEQ ID NO: 664703 - DNA, 22 bp, Artificial Sequence
  chemically synthesized
ttagaatcattcctgtcaccat

SEQ ID NO: 664704 - DNA, 22 bp, Artificial Sequence
  chemically synthesized
tttttagaatcattcctgtcac

SEQ ID NO: 664705 - DNA, 22 bp, Artificial Sequence
  chemically synthesized
atttttagaatcattcctgtca

SEQ ID NO: 664706 - DNA, 22 bp, Artificial Sequence
  chemically synthesized
tatttttagaatcattcctgtc

SEQ ID NO: 664707 - DNA, 22 bp, Artificial Sequence
  chemically synthesized
aggaatggtgacaggaatgatt

SEQ ID NO: 664708 - DNA, 22 bp, Artificial Sequence
  chemically synthesized
ttttatttttagaatcattcct

SEQ ID NO: 664709 - DNA, 22 bp, Artificial Sequence
  chemically synthesized
gttttatttttagaatcattcc

SEQ ID NO: 664710 - DNA, 22 bp, Artificial Sequence
  chemically synthesized
tgttttatttttagaatcattc

SEQ ID NO: 664711 - DNA, 22 bp, Artificial Sequence
  chemically synthesized
gaatgttttgttttatttttag

SEQ ID NO: 664712 - DNA, 22 bp, Artificial Sequence
  chemically synthesized
cctagaatgttttgttttattt

SEQ ID NO: 664713 - DNA, 22 bp, Artificial Sequence
  chemically synthesized
gcctagaatgttttgttttatt

SEQ ID NO: 664714 - DNA, 22 bp, Artificial Sequence
  chemically synthesized
gagtttgcctagaatgttttgt

SEQ ID NO: 664715 - DNA, 22 bp, Artificial Sequence
  chemically synthesized
taaaaataaaacaaaacattct

SEQ ID NO: 664716 - DNA, 22 bp, Artificial Sequence
  chemically synthesized
aaaataaaacaaaacattctag

SEQ ID NO: 664717 - DNA, 22 bp, Artificial Sequence
  chemically synthesized
gcctagagtttgcctagaatgt

SEQ ID NO: 664718 - DNA, 22 bp, Artificial Sequence
  chemically synthesized
ggcctagagtttgcctagaatg

SEQ ID NO: 664719 - DNA, 22 bp, Artificial Sequence
  chemically synthesized
atgtatccttggcctagagttt

SEQ ID NO: 664720 - DNA, 22 bp, Artificial Sequence
  chemically synthesized
aatgtatccttggcctagagtt

SEQ ID NO: 664721 - DNA, 22 bp, Artificial Sequence
  chemically synthesized
taatgtatccttggcctagagt

SEQ ID NO: 664722 - DNA, 22 bp, Artificial Sequence
  chemically synthesized
tttaatgtatccttggcctaga

SEQ ID NO: 664723 - DNA, 22 bp, Artificial Sequence
  chemically synthesized
taggcaaactctaggccaagga

SEQ ID NO: 664724 - DNA, 22 bp, Artificial Sequence
  chemically synthesized
attctttaatgtatccttggcc

SEQ ID NO: 664725 - DNA, 22 bp, Artificial Sequence
  chemically synthesized
ggcaaactctaggccaaggata

SEQ ID NO: 664726 - DNA, 22 bp, Artificial Sequence
  chemically synthesized
taggccaaggatacattaaaga

SEQ ID NO: 664727 - DNA, 22 bp, Artificial Sequence
  chemically synthesized
ggccaaggatacattaaagaat

SEQ ID NO: 664728 - DNA, 22 bp, Artificial Sequence
  chemically synthesized
caatgtataattcattctttaa

SEQ ID NO: 664729 - DNA, 22 bp, Artificial Sequence
  chemically synthesized
ttgcaatgtataattcattctt

SEQ ID NO: 664730 - DNA, 22 bp, Artificial Sequence
  chemically synthesized
ctgttgcaatgtataattcatt

SEQ ID NO: 664731 - DNA, 22 bp, Artificial Sequence
  chemically synthesized
aagaatgaattatacattgcaa

SEQ ID NO: 664732 - DNA, 22 bp, Artificial Sequence
  chemically synthesized
tcacaattcctgttgcaatgta

SEQ ID NO: 664733 - DNA, 22 bp, Artificial Sequence
  chemically synthesized
tacattgcaacaggaattgtga

SEQ ID NO: 664734 - DNA, 22 bp, Artificial Sequence
  chemically synthesized
caacaggaattgtgacagctgt

SEQ ID NO: 664735 - DNA, 22 bp, Artificial Sequence
  chemically synthesized
gagaggggagaaacagctgtca

SEQ ID NO: 664736 - DNA, 22 bp, Artificial Sequence
  chemically synthesized
agagaggggagaaacagctgtc

SEQ ID NO: 664737 - DNA, 22 bp, Artificial Sequence
  chemically synthesized
cttagagaggggagaaacagct

SEQ ID NO: 664738 - DNA, 22 bp, Artificial Sequence
  chemically synthesized
acttagagaggggagaaacagc

SEQ ID NO: 664739 - DNA, 22 bp, Artificial Sequence
  chemically synthesized
tacttagagaggggagaaacag

SEQ ID NO: 664740 - DNA, 22 bp, Artificial Sequence
  chemically synthesized
ttacttagagaggggagaaaca

SEQ ID NO: 664741 - DNA, 22 bp, Artificial Sequence
  chemically synthesized
tgacagctgtttctcccctctc

SEQ ID NO: 664742 - DNA, 22 bp, Artificial Sequence
  chemically synthesized
ggtacatttttacttagagagg

SEQ ID NO: 664743 - DNA, 22 bp, Artificial Sequence
  chemically synthesized
tttctcccctctctaagtaaaa

SEQ ID NO: 664744 - DNA, 22 bp, Artificial Sequence
  chemically synthesized
ctcccctctctaagtaaaaatg

SEQ ID NO: 664745 - DNA, 22 bp, Artificial Sequence
  chemically synthesized
tcccctctctaagtaaaaatgt

SEQ ID NO: 664746 - DNA, 22 bp, Artificial Sequence
  chemically synthesized
ccctctctaagtaaaaatgtac

SEQ ID NO: 664747 - DNA, 22 bp, Artificial Sequence
  chemically synthesized
tctaagtaaaaatgtacccaac

SEQ ID NO: 664748 - DNA, 22 bp, Artificial Sequence
  chemically synthesized
gaataaaaagtaggttgggtac

SEQ ID NO: 664749 - DNA, 22 bp, Artificial Sequence
  chemically synthesized
taagtaaaaatgtacccaacct

SEQ ID NO: 664750 - DNA, 22 bp, Artificial Sequence
  chemically synthesized
agaataaaaagtaggttgggta

SEQ ID NO: 664751 - DNA, 22 bp, Artificial Sequence
  chemically synthesized
agtaaaaatgtacccaacctac

SEQ ID NO: 664752 - DNA, 22 bp, Artificial Sequence
  chemically synthesized
cttagaataaaaagtaggttgg

SEQ ID NO: 664753 - DNA, 22 bp, Artificial Sequence
  chemically synthesized
gcttagaataaaaagtaggttg

SEQ ID NO: 664754 - DNA, 22 bp, Artificial Sequence
  chemically synthesized
tgcttagaataaaaagtaggtt

SEQ ID NO: 664755 - DNA, 22 bp, Artificial Sequence
  chemically synthesized
tgtctttgcttagaataaaaag

SEQ ID NO: 664756 - DNA, 22 bp, Artificial Sequence
  chemically synthesized
atactatgtctttgcttagaat

SEQ ID NO: 664757 - DNA, 22 bp, Artificial Sequence
  chemically synthesized
gatactatgtctttgcttagaa

SEQ ID NO: 664758 - DNA, 22 bp, Artificial Sequence
  chemically synthesized
ctttttattctaagcaaagaca

SEQ ID NO: 664759 - DNA, 22 bp, Artificial Sequence
  chemically synthesized
tttattctaagcaaagacatag

SEQ ID NO: 664760 - DNA, 22 bp, Artificial Sequence
  chemically synthesized
aagatcttgatactatgtcttt

SEQ ID NO: 664761 - DNA, 22 bp, Artificial Sequence
  chemically synthesized
ttattctaagcaaagacatagt

SEQ ID NO: 664762 - DNA, 22 bp, Artificial Sequence
  chemically synthesized
gaagatcttgatactatgtctt

SEQ ID NO: 664763 - DNA, 22 bp, Artificial Sequence
  chemically synthesized
tattctaagcaaagacatagta

SEQ ID NO: 664764 - DNA, 22 bp, Artificial Sequence
  chemically synthesized
attctaagcaaagacatagtat

SEQ ID NO: 664765 - DNA, 22 bp, Artificial Sequence
  chemically synthesized
ttctaagcaaagacatagtatc

SEQ ID NO: 664766 - DNA, 22 bp, Artificial Sequence
  chemically synthesized
taagcaaagacatagtatcaag

SEQ ID NO: 664767 - DNA, 22 bp, Artificial Sequence
  chemically synthesized
agcaaagacatagtatcaagat

SEQ ID NO: 664768 - DNA, 22 bp, Artificial Sequence
  chemically synthesized
gccagtatttgaagatcttgat

SEQ ID NO: 664769 - DNA, 22 bp, Artificial Sequence
  chemically synthesized
taagtattggccagtatttgaa

SEQ ID NO: 664770 - DNA, 22 bp, Artificial Sequence
  chemically synthesized
ctgtaagtattggccagtattt

SEQ ID NO: 664771 - DNA, 22 bp, Artificial Sequence
  chemically synthesized
gctgtaagtattggccagtatt

SEQ ID NO: 664772 - DNA, 22 bp, Artificial Sequence
  chemically synthesized
tgctgtaagtattggccagtat

SEQ ID NO: 664773 - DNA, 22 bp, Artificial Sequence
  chemically synthesized
caaatactggccaatacttaca

SEQ ID NO: 664774 - DNA, 22 bp, Artificial Sequence
  chemically synthesized
aaatactggccaatacttacag

SEQ ID NO: 664775 - DNA, 22 bp, Artificial Sequence
  chemically synthesized
cagaaggccctttgctgtaagt

SEQ ID NO: 664776 - DNA, 22 bp, Artificial Sequence
  chemically synthesized
gccaatacttacagcaaagggc

SEQ ID NO: 664777 - DNA, 22 bp, Artificial Sequence
  chemically synthesized
cgaagactgcagaaggcccttt

SEQ ID NO: 664778 - DNA, 22 bp, Artificial Sequence
  chemically synthesized
acagcaaagggccttctgcagt

SEQ ID NO: 664779 - DNA, 22 bp, Artificial Sequence
  chemically synthesized
cagcaaagggccttctgcagtc

SEQ ID NO: 664780 - DNA, 22 bp, Artificial Sequence
  chemically synthesized
ccatgaaactccgaagactgca

SEQ ID NO: 664781 - DNA, 22 bp, Artificial Sequence
  chemically synthesized
taggactgccatgaaactccga

SEQ ID NO: 664782 - DNA, 22 bp, Artificial Sequence
  chemically synthesized
ataggactgccatgaaactccg

SEQ ID NO: 664783 - DNA, 22 bp, Artificial Sequence
  chemically synthesized
ctgcagtcttcggagtttcatg

SEQ ID NO: 664784 - DNA, 22 bp, Artificial Sequence
  chemically synthesized
tgcagtcttcggagtttcatgg

SEQ ID NO: 664785 - DNA, 22 bp, Artificial Sequence
  chemically synthesized
cagtcttcggagtttcatggca

SEQ ID NO: 664786 - DNA, 22 bp, Artificial Sequence
  chemically synthesized
agcttataggactgccatgaaa

SEQ ID NO: 664787 - DNA, 22 bp, Artificial Sequence
  chemically synthesized
tcagcttataggactgccatga

SEQ ID NO: 664788 - DNA, 22 bp, Artificial Sequence
  chemically synthesized
cggagtttcatggcagtcctat

SEQ ID NO: 664789 - DNA, 22 bp, Artificial Sequence
  chemically synthesized
ggagtttcatggcagtcctata

SEQ ID NO: 664790 - DNA, 22 bp, Artificial Sequence
  chemically synthesized
catggcagtcctataagctgag

SEQ ID NO: 664791 - DNA, 22 bp, Artificial Sequence
  chemically synthesized
atggcagtcctataagctgaga

SEQ ID NO: 664792 - DNA, 22 bp, Artificial Sequence
  chemically synthesized
aataatgtcagattctcagctt

SEQ ID NO: 664793 - DNA, 22 bp, Artificial Sequence
  chemically synthesized
acctgaataatgtcagattctc

SEQ ID NO: 664794 - DNA, 22 bp, Artificial Sequence
  chemically synthesized
agctgacctgaataatgtcaga

SEQ ID NO: 664795 - DNA, 22 bp, Artificial Sequence
  chemically synthesized
taagctgagaatctgacattat

SEQ ID NO: 664796 - DNA, 22 bp, Artificial Sequence
  chemically synthesized
cagctgacctgaataatgtcag

SEQ ID NO: 664797 - DNA, 22 bp, Artificial Sequence
  chemically synthesized
tcagctgacctgaataatgtca

SEQ ID NO: 664798 - DNA, 22 bp, Artificial Sequence
  chemically synthesized
ttcagctgacctgaataatgtc

SEQ ID NO: 664799 - DNA, 22 bp, Artificial Sequence
  chemically synthesized
ttttcagctgacctgaataatg

SEQ ID NO: 664800 - DNA, 22 bp, Artificial Sequence
  chemically synthesized
agaatctgacattattcaggtc

SEQ ID NO: 664801 - DNA, 22 bp, Artificial Sequence
  chemically synthesized
cctcttttcagctgacctgaat

SEQ ID NO: 664802 - DNA, 22 bp, Artificial Sequence
  chemically synthesized
ccctcttttcagctgacctgaa

SEQ ID NO: 664803 - DNA, 22 bp, Artificial Sequence
  chemically synthesized
tccctcttttcagctgacctga

SEQ ID NO: 664804 - DNA, 22 bp, Artificial Sequence
  chemically synthesized
ttttccctcttttcagctgacc

SEQ ID NO: 664805 - DNA, 22 bp, Artificial Sequence
  chemically synthesized
gttttccctcttttcagctgac

SEQ ID NO: 664806 - DNA, 22 bp, Artificial Sequence
  chemically synthesized
acattattcaggtcagctgaaa

SEQ ID NO: 664807 - DNA, 22 bp, Artificial Sequence
  chemically synthesized
tgttttccctcttttcagctga

SEQ ID NO: 664808 - DNA, 22 bp, Artificial Sequence
  chemically synthesized
tttgttttccctcttttcagct

SEQ ID NO: 664809 - DNA, 22 bp, Artificial Sequence
  chemically synthesized
ttcaggtcagctgaaaagaggg

SEQ ID NO: 664810 - DNA, 22 bp, Artificial Sequence
  chemically synthesized
aggtcagctgaaaagagggaaa

SEQ ID NO: 664811 - DNA, 22 bp, Artificial Sequence
  chemically synthesized
aaaagagggaaaacaaagagca

SEQ ID NO: 664812 - DNA, 22 bp, Artificial Sequence
  chemically synthesized
atggaataacaaatgctctttg

SEQ ID NO: 664813 - DNA, 22 bp, Artificial Sequence
  chemically synthesized
tgatggaataacaaatgctctt

SEQ ID NO: 664814 - DNA, 22 bp, Artificial Sequence
  chemically synthesized
ctgatggaataacaaatgctct

SEQ ID NO: 664815 - DNA, 22 bp, Artificial Sequence
  chemically synthesized
tttctgatggaataacaaatgc

SEQ ID NO: 664816 - DNA, 22 bp, Artificial Sequence
  chemically synthesized
ttatttctgatggaataacaaa

SEQ ID NO: 664817 - DNA, 22 bp, Artificial Sequence
  chemically synthesized
tctgttatttctgatggaataa

SEQ ID NO: 664818 - DNA, 22 bp, Artificial Sequence
  chemically synthesized
gttattccatcagaaataacag

SEQ ID NO: 664819 - DNA, 22 bp, Artificial Sequence
  chemically synthesized
ttattccatcagaaataacaga

SEQ ID NO: 664820 - DNA, 22 bp, Artificial Sequence
  chemically synthesized
ttccatcagaaataacagacaa

SEQ ID NO: 664821 - DNA, 22 bp, Artificial Sequence
  chemically synthesized
catcagaaataacagacaaccc

SEQ ID NO: 664822 - DNA, 22 bp, Artificial Sequence
  chemically synthesized
ggcgtcgggggtgggttgtctg

SEQ ID NO: 664823 - DNA, 22 bp, Artificial Sequence
  chemically synthesized
gcaaatcactgggcgtcggggg

SEQ ID NO: 664824 - DNA, 22 bp, Artificial Sequence
  chemically synthesized
ttggcaaatcactgggcgtcgg

SEQ ID NO: 664825 - DNA, 22 bp, Artificial Sequence
  chemically synthesized
tagttattggcaaatcactggg

SEQ ID NO: 664826 - DNA, 22 bp, Artificial Sequence
  chemically synthesized
tggtggttgtagttattggcaa

SEQ ID NO: 664827 - DNA, 22 bp, Artificial Sequence
  chemically synthesized
gtggtggttgtagttattggca

SEQ ID NO: 664828 - DNA, 22 bp, Artificial Sequence
  chemically synthesized
tgtggtggttgtagttattggc

SEQ ID NO: 664829 - DNA, 22 bp, Artificial Sequence
  chemically synthesized
ttgtggtggttgtagttattgg

SEQ ID NO: 664830 - DNA, 22 bp, Artificial Sequence
  chemically synthesized
tttttgtggtggttgtagttat

SEQ ID NO: 664831 - DNA, 22 bp, Artificial Sequence
  chemically synthesized
ggctatttttgtggtggttgta

SEQ ID NO: 664832 - DNA, 22 bp, Artificial Sequence
  chemically synthesized
taggctatttttgtggtggttg

SEQ ID NO: 664833 - DNA, 22 bp, Artificial Sequence
  chemically synthesized
gccaataactacaaccaccaca

SEQ ID NO: 664834 - DNA, 22 bp, Artificial Sequence
  chemically synthesized
ctaggctatttttgtggtggtt

SEQ ID NO: 664835 - DNA, 22 bp, Artificial Sequence
  chemically synthesized
ccaataactacaaccaccacaa

SEQ ID NO: 664836 - DNA, 22 bp, Artificial Sequence
  chemically synthesized
tctaggctatttttgtggtggt

SEQ ID NO: 664837 - DNA, 22 bp, Artificial Sequence
  chemically synthesized
tatgttttctaggctatttttg

SEQ ID NO: 664838 - DNA, 22 bp, Artificial Sequence
  chemically synthesized
caaccaccacaaaaatagccta

SEQ ID NO: 664839 - DNA, 22 bp, Artificial Sequence
  chemically synthesized
gcgtatacacactatatgtttt

SEQ ID NO: 664840 - DNA, 22 bp, Artificial Sequence
  chemically synthesized
ggcgtatacacactatatgttt

SEQ ID NO: 664841 - DNA, 22 bp, Artificial Sequence
  chemically synthesized
cgaaagcttggcgtatacacac

SEQ ID NO: 664842 - DNA, 22 bp, Artificial Sequence
  chemically synthesized
gaaaacatatagtgtgtatacg

SEQ ID NO: 664843 - DNA, 22 bp, Artificial Sequence
  chemically synthesized
acctccgaaagcttggcgtata

SEQ ID NO: 664844 - DNA, 22 bp, Artificial Sequence
  chemically synthesized
cacctccgaaagcttggcgtat

SEQ ID NO: 664845 - DNA, 22 bp, Artificial Sequence
  chemically synthesized
tcacctccgaaagcttggcgta

SEQ ID NO: 664846 - DNA, 22 bp, Artificial Sequence
  chemically synthesized
acagaattttcacctccgaaag

SEQ ID NO: 664847 - DNA, 22 bp, Artificial Sequence
  chemically synthesized
cccacgttaacagaattttcac

SEQ ID NO: 664848 - DNA, 22 bp, Artificial Sequence
  chemically synthesized
ccccacgttaacagaattttca

SEQ ID NO: 664849 - DNA, 22 bp, Artificial Sequence
  chemically synthesized
tccccacgttaacagaattttc

SEQ ID NO: 664850 - DNA, 22 bp, Artificial Sequence
  chemically synthesized
ttccccacgttaacagaatttt

SEQ ID NO: 664851 - DNA, 22 bp, Artificial Sequence
  chemically synthesized
ttttccccacgttaacagaatt

SEQ ID NO: 664852 - DNA, 22 bp, Artificial Sequence
  chemically synthesized
tcggaggtgaaaattctgttaa

SEQ ID NO: 664853 - DNA, 22 bp, Artificial Sequence
  chemically synthesized
cttttccccacgttaacagaat

SEQ ID NO: 664854 - DNA, 22 bp, Artificial Sequence
  chemically synthesized
cggaggtgaaaattctgttaac

SEQ ID NO: 664855 - DNA, 22 bp, Artificial Sequence
  chemically synthesized
tcttttccccacgttaacagaa

SEQ ID NO: 664856 - DNA, 22 bp, Artificial Sequence
  chemically synthesized
ggaggtgaaaattctgttaacg

SEQ ID NO: 664857 - DNA, 22 bp, Artificial Sequence
  chemically synthesized
ttcttttccccacgttaacaga

SEQ ID NO: 664858 - DNA, 22 bp, Artificial Sequence
  chemically synthesized
tttcttttccccacgttaacag

SEQ ID NO: 664859 - DNA, 22 bp, Artificial Sequence
  chemically synthesized
ttttttcttttccccacgttaa

SEQ ID NO: 664860 - DNA, 22 bp, Artificial Sequence
  chemically synthesized
tgttaacgtggggaaaagaaaa

SEQ ID NO: 664861 - DNA, 22 bp, Artificial Sequence
  chemically synthesized
ttaacgtggggaaaagaaaaaa

SEQ ID NO: 664862 - DNA, 22 bp, Artificial Sequence
  chemically synthesized
acgtggggaaaagaaaaaataa

SEQ ID NO: 664863 - DNA, 22 bp, Artificial Sequence
  chemically synthesized
tcaaagggcaaaaggaattatt

SEQ ID NO: 664864 - DNA, 22 bp, Artificial Sequence
  chemically synthesized
gttgtcaaagggcaaaaggaat

SEQ ID NO: 664865 - DNA, 22 bp, Artificial Sequence
  chemically synthesized
ctggttgtcaaagggcaaaagg

SEQ ID NO: 664866 - DNA, 22 bp, Artificial Sequence
  chemically synthesized
cctggttgtcaaagggcaaaag

SEQ ID NO: 664867 - DNA, 22 bp, Artificial Sequence
  chemically synthesized
gccttcctggttgtcaaagggc

SEQ ID NO: 664868 - DNA, 22 bp, Artificial Sequence
  chemically synthesized
agccttcctggttgtcaaaggg

SEQ ID NO: 664869 - DNA, 22 bp, Artificial Sequence
  chemically synthesized
cttttgccctttgacaaccagg

SEQ ID NO: 664870 - DNA, 22 bp, Artificial Sequence
  chemically synthesized
ttgccctttgacaaccaggaag

SEQ ID NO: 664871 - DNA, 22 bp, Artificial Sequence
  chemically synthesized
acagaacttagccttcctggtt

SEQ ID NO: 664872 - DNA, 22 bp, Artificial Sequence
  chemically synthesized
tgccctttgacaaccaggaagg

SEQ ID NO: 664873 - DNA, 22 bp, Artificial Sequence
  chemically synthesized
cacagaacttagccttcctggt

SEQ ID NO: 664874 - DNA, 22 bp, Artificial Sequence
  chemically synthesized
gccctttgacaaccaggaaggc

SEQ ID NO: 664875 - DNA, 22 bp, Artificial Sequence
  chemically synthesized
ccctttgacaaccaggaaggct

SEQ ID NO: 664876 - DNA, 22 bp, Artificial Sequence
  chemically synthesized
gtcttcacagaacttagccttc

SEQ ID NO: 664877 - DNA, 22 bp, Artificial Sequence
  chemically synthesized
agtcttcacagaacttagcctt

SEQ ID NO: 664878 - DNA, 22 bp, Artificial Sequence
  chemically synthesized
tgacaaccaggaaggctaagtt

SEQ ID NO: 664879 - DNA, 22 bp, Artificial Sequence
  chemically synthesized
tagtcttcacagaacttagcct

SEQ ID NO: 664880 - DNA, 22 bp, Artificial Sequence
  chemically synthesized
gacaaccaggaaggctaagttc

SEQ ID NO: 664881 - DNA, 22 bp, Artificial Sequence
  chemically synthesized
acaaccaggaaggctaagttct

SEQ ID NO: 664882 - DNA, 22 bp, Artificial Sequence
  chemically synthesized
taccactttagtcttcacagaa

SEQ ID NO: 664883 - DNA, 22 bp, Artificial Sequence
  chemically synthesized
aggctataccactttagtcttc

SEQ ID NO: 664884 - DNA, 22 bp, Artificial Sequence
  chemically synthesized
caggctataccactttagtctt

SEQ ID NO: 664885 - DNA, 22 bp, Artificial Sequence
  chemically synthesized
agttctgtgaagactaaagtgg

SEQ ID NO: 664886 - DNA, 22 bp, Artificial Sequence
  chemically synthesized
tgtgaagactaaagtggtatag

SEQ ID NO: 664887 - DNA, 22 bp, Artificial Sequence
  chemically synthesized
tgaagactaaagtggtatagcc

SEQ ID NO: 664888 - DNA, 22 bp, Artificial Sequence
  chemically synthesized
catgaatgcccttcaggctata

SEQ ID NO: 664889 - DNA, 22 bp, Artificial Sequence
  chemically synthesized
aagtggtatagcctgaagggca

SEQ ID NO: 664890 - DNA, 22 bp, Artificial Sequence
  chemically synthesized
ggaacaggactacatgaatgcc

SEQ ID NO: 664891 - DNA, 22 bp, Artificial Sequence
  chemically synthesized
gggaacaggactacatgaatgc

SEQ ID NO: 664892 - DNA, 22 bp, Artificial Sequence
  chemically synthesized
ttgggaacaggactacatgaat

SEQ ID NO: 664893 - DNA, 22 bp, Artificial Sequence
  chemically synthesized
ctcttgggaacaggactacatg

SEQ ID NO: 664894 - DNA, 22 bp, Artificial Sequence
  chemically synthesized
cctcttgggaacaggactacat

SEQ ID NO: 664895 - DNA, 22 bp, Artificial Sequence
  chemically synthesized
tcctcttgggaacaggactaca

SEQ ID NO: 664896 - DNA, 22 bp, Artificial Sequence
  chemically synthesized
aagggcattcatgtagtcctgt

SEQ ID NO: 664897 - DNA, 22 bp, Artificial Sequence
  chemically synthesized
tttcctcttgggaacaggacta

SEQ ID NO: 664898 - DNA, 22 bp, Artificial Sequence
  chemically synthesized
tccatctctttcctcttgggaa

SEQ ID NO: 664899 - DNA, 22 bp, Artificial Sequence
  chemically synthesized
atgtagtcctgttcccaagagg

SEQ ID NO: 664900 - DNA, 22 bp, Artificial Sequence
  chemically synthesized
ttcccaagaggaaagagatgga

SEQ ID NO: 664901 - DNA, 22 bp, Artificial Sequence
  chemically synthesized
ccaagaggaaagagatggacag

SEQ ID NO: 664902 - DNA, 22 bp, Artificial Sequence
  chemically synthesized
gaaaaaaataatgcctgtccat

SEQ ID NO: 664903 - DNA, 22 bp, Artificial Sequence
  chemically synthesized
tagaaaaaaataatgcctgtcc

SEQ ID NO: 664904 - DNA, 22 bp, Artificial Sequence
  chemically synthesized
ctagaaaaaaataatgcctgtc

SEQ ID NO: 664905 - DNA, 22 bp, Artificial Sequence
  chemically synthesized
tctagaaaaaaataatgcctgt

SEQ ID NO: 664906 - DNA, 22 bp, Artificial Sequence
  chemically synthesized
ctttctagaaaaaaataatgcc

SEQ ID NO: 664907 - DNA, 22 bp, Artificial Sequence
  chemically synthesized
cagtagatccagattactttct

SEQ ID NO: 664908 - DNA, 22 bp, Artificial Sequence
  chemically synthesized
tttttttctagaaagtaatctg

SEQ ID NO: 664909 - DNA, 22 bp, Artificial Sequence
  chemically synthesized
actacagtagatccagattact

SEQ ID NO: 664910 - DNA, 22 bp, Artificial Sequence
  chemically synthesized
ttttctagaaagtaatctggat

SEQ ID NO: 664911 - DNA, 22 bp, Artificial Sequence
  chemically synthesized
tttctagaaagtaatctggatc

SEQ ID NO: 664912 - DNA, 22 bp, Artificial Sequence
  chemically synthesized
ttctagaaagtaatctggatct

SEQ ID NO: 664913 - DNA, 22 bp, Artificial Sequence
  chemically synthesized
tctagaaagtaatctggatcta

SEQ ID NO: 664914 - DNA, 22 bp, Artificial Sequence
  chemically synthesized
ctagaaagtaatctggatctac

SEQ ID NO: 664915 - DNA, 22 bp, Artificial Sequence
  chemically synthesized
tagaaagtaatctggatctact

SEQ ID NO: 664916 - DNA, 22 bp, Artificial Sequence
  chemically synthesized
gaaagtaatctggatctactgt

SEQ ID NO: 664917 - DNA, 22 bp, Artificial Sequence
  chemically synthesized
tgcagaaaagattcactacagt

SEQ ID NO: 664918 - DNA, 22 bp, Artificial Sequence
  chemically synthesized
gtgcagaaaagattcactacag

SEQ ID NO: 664919 - DNA, 22 bp, Artificial Sequence
  chemically synthesized
atcttgtgcagaaaagattcac

SEQ ID NO: 664920 - DNA, 22 bp, Artificial Sequence
  chemically synthesized
gatctactgtagtgaatctttt

SEQ ID NO: 664921 - DNA, 22 bp, Artificial Sequence
  chemically synthesized
aatcttgtgcagaaaagattca

SEQ ID NO: 664922 - DNA, 22 bp, Artificial Sequence
  chemically synthesized
taatcttgtgcagaaaagattc

SEQ ID NO: 664923 - DNA, 22 bp, Artificial Sequence
  chemically synthesized
tttaatcttgtgcagaaaagat

SEQ ID NO: 664924 - DNA, 22 bp, Artificial Sequence
  chemically synthesized
tctttaatcttgtgcagaaaag

SEQ ID NO: 664925 - DNA, 22 bp, Artificial Sequence
  chemically synthesized
ctgtagtgaatcttttctgcac

SEQ ID NO: 664926 - DNA, 22 bp, Artificial Sequence
  chemically synthesized
ttctctttaatcttgtgcagaa

SEQ ID NO: 664927 - DNA, 22 bp, Artificial Sequence
  chemically synthesized
tagtgaatcttttctgcacaag

SEQ ID NO: 664928 - DNA, 22 bp, Artificial Sequence
  chemically synthesized
gttctctttaatcttgtgcaga

SEQ ID NO: 664929 - DNA, 22 bp, Artificial Sequence
  chemically synthesized
ttgttctctttaatcttgtgca

SEQ ID NO: 664930 - DNA, 22 bp, Artificial Sequence
  chemically synthesized
cttgttctctttaatcttgtgc

SEQ ID NO: 664931 - DNA, 22 bp, Artificial Sequence
  chemically synthesized
ttctgcacaagattaaagagaa

SEQ ID NO: 664932 - DNA, 22 bp, Artificial Sequence
  chemically synthesized
tctgcacaagattaaagagaac

SEQ ID NO: 664933 - DNA, 22 bp, Artificial Sequence
  chemically synthesized
ctgcacaagattaaagagaaca

SEQ ID NO: 664934 - DNA, 22 bp, Artificial Sequence
  chemically synthesized
tgcacaagattaaagagaacaa

SEQ ID NO: 664935 - DNA, 22 bp, Artificial Sequence
  chemically synthesized
aataatgtatttcttgttctct

SEQ ID NO: 664936 - DNA, 22 bp, Artificial Sequence
  chemically synthesized
cacaagattaaagagaacaaga

SEQ ID NO: 664937 - DNA, 22 bp, Artificial Sequence
  chemically synthesized
aaataatgtatttcttgttctc

SEQ ID NO: 664938 - DNA, 22 bp, Artificial Sequence
  chemically synthesized
tttaaataatgtatttcttgtt

SEQ ID NO: 664939 - DNA, 22 bp, Artificial Sequence
  chemically synthesized
tagctatttaaataatgtattt

SEQ ID NO: 664940 - DNA, 22 bp, Artificial Sequence
  chemically synthesized
aagagaacaagaaatacattat

SEQ ID NO: 664941 - DNA, 22 bp, Artificial Sequence
  chemically synthesized
atagctatttaaataatgtatt

SEQ ID NO: 664942 - DNA, 22 bp, Artificial Sequence
  chemically synthesized
aggtcttatagctatttaaata

SEQ ID NO: 664943 - DNA, 22 bp, Artificial Sequence
  chemically synthesized
aaggtcttatagctatttaaat

SEQ ID NO: 664944 - DNA, 22 bp, Artificial Sequence
  chemically synthesized
tttaaggtcttatagctattta

SEQ ID NO: 664945 - DNA, 22 bp, Artificial Sequence
  chemically synthesized
attgtttaaggtcttatagcta

SEQ ID NO: 664946 - DNA, 22 bp, Artificial Sequence
  chemically synthesized
gattgtttaaggtcttatagct

SEQ ID NO: 664947 - DNA, 22 bp, Artificial Sequence
  chemically synthesized
tttaaatagctataagacctta

SEQ ID NO: 664948 - DNA, 22 bp, Artificial Sequence
  chemically synthesized
ccacttgattgtttaaggtctt

SEQ ID NO: 664949 - DNA, 22 bp, Artificial Sequence
  chemically synthesized
aaatagctataagaccttaaac

SEQ ID NO: 664950 - DNA, 22 bp, Artificial Sequence
  chemically synthesized
aatagctataagaccttaaaca

SEQ ID NO: 664951 - DNA, 22 bp, Artificial Sequence
  chemically synthesized
tattgccacttgattgtttaag

SEQ ID NO: 664952 - DNA, 22 bp, Artificial Sequence
  chemically synthesized
taagaccttaaacaatcaagtg

SEQ ID NO: 664953 - DNA, 22 bp, Artificial Sequence
  chemically synthesized
aaacaatcaagtggcaatataa

SEQ ID NO: 664954 - DNA, 22 bp, Artificial Sequence
  chemically synthesized
aacaatcaagtggcaatataac

SEQ ID NO: 664955 - DNA, 22 bp, Artificial Sequence
  chemically synthesized
cagtcagaaaaaatgttatatt

SEQ ID NO: 664956 - DNA, 22 bp, Artificial Sequence
  chemically synthesized
tacagtcagaaaaaatgttata

SEQ ID NO: 664957 - DNA, 22 bp, Artificial Sequence
  chemically synthesized
ctacagtcagaaaaaatgttat

SEQ ID NO: 664958 - DNA, 22 bp, Artificial Sequence
  chemically synthesized
tttctgactgtagaagttatac

SEQ ID NO: 664959 - DNA, 22 bp, Artificial Sequence
  chemically synthesized
ttctgactgtagaagttataca

SEQ ID NO: 664960 - DNA, 22 bp, Artificial Sequence
  chemically synthesized
tctgactgtagaagttatacat

SEQ ID NO: 664961 - DNA, 22 bp, Artificial Sequence
  chemically synthesized
cccaaagtgagcatgtataact

SEQ ID NO: 664962 - DNA, 22 bp, Artificial Sequence
  chemically synthesized
ctgactgtagaagttatacatg

SEQ ID NO: 664963 - DNA, 22 bp, Artificial Sequence
  chemically synthesized
tgactgtagaagttatacatgc

SEQ ID NO: 664964 - DNA, 22 bp, Artificial Sequence
  chemically synthesized
actgtagaagttatacatgctc

SEQ ID NO: 664965 - DNA, 22 bp, Artificial Sequence
  chemically synthesized
agttacccaaagtgagcatgta

SEQ ID NO: 664966 - DNA, 22 bp, Artificial Sequence
  chemically synthesized
tagaagttatacatgctcactt

SEQ ID NO: 664967 - DNA, 22 bp, Artificial Sequence
  chemically synthesized
aatgtctaagttacccaaagtg

SEQ ID NO: 664968 - DNA, 22 bp, Artificial Sequence
  chemically synthesized
tacatgctcactttgggtaact

SEQ ID NO: 664969 - DNA, 22 bp, Artificial Sequence
  chemically synthesized
actttgggtaacttagacattt

SEQ ID NO: 664970 - DNA, 22 bp, Artificial Sequence
  chemically synthesized
tatatgtatatgttaaatgtct

SEQ ID NO: 664971 - DNA, 22 bp, Artificial Sequence
  chemically synthesized
tgggtaacttagacatttaaca

SEQ ID NO: 664972 - DNA, 22 bp, Artificial Sequence
  chemically synthesized
gggtaacttagacatttaacat

SEQ ID NO: 664973 - DNA, 22 bp, Artificial Sequence
  chemically synthesized
ggtaacttagacatttaacata

SEQ ID NO: 664974 - DNA, 22 bp, Artificial Sequence
  chemically synthesized
attatatatgtatatgttaaat

SEQ ID NO: 664975 - DNA, 22 bp, Artificial Sequence
  chemically synthesized
gattatatatgtatatgttaaa

SEQ ID NO: 664976 - DNA, 22 bp, Artificial Sequence
  chemically synthesized
tttgattatatatgtatatgtt

SEQ ID NO: 664977 - DNA, 22 bp, Artificial Sequence
  chemically synthesized
atttgattatatatgtatatgt

SEQ ID NO: 664978 - DNA, 22 bp, Artificial Sequence
  chemically synthesized
agacatttaacatatacatata

SEQ ID NO: 664979 - DNA, 22 bp, Artificial Sequence
  chemically synthesized
gacatttaacatatacatatat

SEQ ID NO: 664980 - DNA, 22 bp, Artificial Sequence
  chemically synthesized
tggatgatttatttgattatat

SEQ ID NO: 664981 - DNA, 22 bp, Artificial Sequence
  chemically synthesized
aacatatacatatataatcaaa

SEQ ID NO: 664982 - DNA, 22 bp, Artificial Sequence
  chemically synthesized
gtggatgatttatttgattata

SEQ ID NO: 664983 - DNA, 22 bp, Artificial Sequence
  chemically synthesized
acatatacatatataatcaaat

SEQ ID NO: 664984 - DNA, 22 bp, Artificial Sequence
  chemically synthesized
tgggcttgtggatgatttattt

SEQ ID NO: 664985 - DNA, 22 bp, Artificial Sequence
  chemically synthesized
atgggcttgtggatgatttatt

SEQ ID NO: 664986 - DNA, 22 bp, Artificial Sequence
  chemically synthesized
agtttatgggcttgtggatgat

SEQ ID NO: 664987 - DNA, 22 bp, Artificial Sequence
  chemically synthesized
gagtttatgggcttgtggatga

SEQ ID NO: 664988 - DNA, 22 bp, Artificial Sequence
  chemically synthesized
tgagtttatgggcttgtggatg

SEQ ID NO: 664989 - DNA, 22 bp, Artificial Sequence
  chemically synthesized
ttgagtttatgggcttgtggat

SEQ ID NO: 664990 - DNA, 22 bp, Artificial Sequence
  chemically synthesized
tttttgagtttatgggcttgtg

SEQ ID NO: 664991 - DNA, 22 bp, Artificial Sequence
  chemically synthesized
tgcctatttttgagtttatggg

SEQ ID NO: 664992 - DNA, 22 bp, Artificial Sequence
  chemically synthesized
aatccagccagttgtgcctatt

SEQ ID NO: 664993 - DNA, 22 bp, Artificial Sequence
  chemically synthesized
aaaaataggcacaactggctgg

SEQ ID NO: 664994 - DNA, 22 bp, Artificial Sequence
  chemically synthesized
caggcatgagccactgaatcca

SEQ ID NO: 664995 - DNA, 22 bp, Artificial Sequence
  chemically synthesized
ggattacaggcatgagccactg

SEQ ID NO: 664996 - DNA, 22 bp, Artificial Sequence
  chemically synthesized
gctggattcagtggctcatgcc

SEQ ID NO: 664997 - DNA, 22 bp, Artificial Sequence
  chemically synthesized
gattcagtggctcatgcctgta

SEQ ID NO: 664998 - DNA, 22 bp, Artificial Sequence
  chemically synthesized
aaagcgttgggattacaggcat

SEQ ID NO: 664999 - DNA, 22 bp, Artificial Sequence
  chemically synthesized
tcaaagcgttgggattacaggc

SEQ ID NO: 665000 - DNA, 22 bp, Artificial Sequence
  chemically synthesized
agtggctcatgcctgtaatccc

SEQ ID NO: 665001 - DNA, 22 bp, Artificial Sequence
  chemically synthesized
gcctctcaaagcgttgggatta

SEQ ID NO: 665002 - DNA, 22 bp, Artificial Sequence
  chemically synthesized
ggcctctcaaagcgttgggatt

SEQ ID NO: 665003 - DNA, 22 bp, Artificial Sequence
  chemically synthesized
atgcctgtaatcccaacgcttt

SEQ ID NO: 665004 - DNA, 22 bp, Artificial Sequence
  chemically synthesized
ccaccttggcctctcaaagcgt

SEQ ID NO: 665005 - DNA, 22 bp, Artificial Sequence
  chemically synthesized
taatcccaacgctttgagaggc

SEQ ID NO: 665006 - DNA, 22 bp, Artificial Sequence
  chemically synthesized
aagcagtcctcccaccttggcc

SEQ ID NO: 665007 - DNA, 22 bp, Artificial Sequence
  chemically synthesized
gcctcaagcagtcctcccacct

SEQ ID NO: 665008 - DNA, 22 bp, Artificial Sequence
  chemically synthesized
tgagaggccaaggtgggaggac

SEQ ID NO: 665009 - DNA, 22 bp, Artificial Sequence
  chemically synthesized
gagaggccaaggtgggaggact

SEQ ID NO: 665010 - DNA, 22 bp, Artificial Sequence
  chemically synthesized
ctggcctcaagcagtcctccca

SEQ ID NO: 665011 - DNA, 22 bp, Artificial Sequence
  chemically synthesized
agaggccaaggtgggaggactg

SEQ ID NO: 665012 - DNA, 22 bp, Artificial Sequence
  chemically synthesized
agctcctggcctcaagcagtcc

SEQ ID NO: 665013 - DNA, 22 bp, Artificial Sequence
  chemically synthesized
aagctcctggcctcaagcagtc

SEQ ID NO: 665014 - DNA, 22 bp, Artificial Sequence
  chemically synthesized
gtcttaagctcctggcctcaag

SEQ ID NO: 665015 - DNA, 22 bp, Artificial Sequence
  chemically synthesized
cccaagctggtcttaagctcct

SEQ ID NO: 665016 - DNA, 22 bp, Artificial Sequence
  chemically synthesized
cttgaggccaggagcttaagac

SEQ ID NO: 665017 - DNA, 22 bp, Artificial Sequence
  chemically synthesized
tgttgcccaagctggtcttaag

SEQ ID NO: 665018 - DNA, 22 bp, Artificial Sequence
  chemically synthesized
gaggccaggagcttaagaccag

SEQ ID NO: 665019 - DNA, 22 bp, Artificial Sequence
  chemically synthesized
aggccaggagcttaagaccagc

SEQ ID NO: 665020 - DNA, 22 bp, Artificial Sequence
  chemically synthesized
actatgttgcccaagctggtct

SEQ ID NO: 665021 - DNA, 22 bp, Artificial Sequence
  chemically synthesized
aagaccagcttgggcaacatag

SEQ ID NO: 665022 - DNA, 22 bp, Artificial Sequence
  chemically synthesized
agaccagcttgggcaacatagt

SEQ ID NO: 665023 - DNA, 22 bp, Artificial Sequence
  chemically synthesized
tagagatgggatctcactatgt

SEQ ID NO: 665024 - DNA, 22 bp, Artificial Sequence
  chemically synthesized
gtagagatgggatctcactatg

SEQ ID NO: 665025 - DNA, 22 bp, Artificial Sequence
  chemically synthesized
tgtagagatgggatctcactat

SEQ ID NO: 665026 - DNA, 22 bp, Artificial Sequence
  chemically synthesized
ttgtagagatgggatctcacta

SEQ ID NO: 665027 - DNA, 22 bp, Artificial Sequence
  chemically synthesized
tttgtagagatgggatctcact

SEQ ID NO: 665028 - DNA, 22 bp, Artificial Sequence
  chemically synthesized
ttttgtagagatgggatctcac

SEQ ID NO: 665029 - DNA, 22 bp, Artificial Sequence
  chemically synthesized
tttttgtagagatgggatctca

SEQ ID NO: 665030 - DNA, 22 bp, Artificial Sequence
  chemically synthesized
gggcaacatagtgagatcccat

SEQ ID NO: 665031 - DNA, 22 bp, Artificial Sequence
  chemically synthesized
ggcaacatagtgagatcccatc

SEQ ID NO: 665032 - DNA, 22 bp, Artificial Sequence
  chemically synthesized
tataaactttttttgtagagat

SEQ ID NO: 665033 - DNA, 22 bp, Artificial Sequence
  chemically synthesized
atataaactttttttgtagaga

SEQ ID NO: 665034 - DNA, 22 bp, Artificial Sequence
  chemically synthesized
aaaggtttatataaactttttt

SEQ ID NO: 665035 - DNA, 22 bp, Artificial Sequence
  chemically synthesized
aaaaggtttatataaacttttt

SEQ ID NO: 665036 - DNA, 22 bp, Artificial Sequence
  chemically synthesized
tttaaaaggtttatataaactt

SEQ ID NO: 665037 - DNA, 22 bp, Artificial Sequence
  chemically synthesized
atttaaaaggtttatataaact

SEQ ID NO: 665038 - DNA, 22 bp, Artificial Sequence
  chemically synthesized
tacaaaaaaagtttatataaac

SEQ ID NO: 665039 - DNA, 22 bp, Artificial Sequence
  chemically synthesized
caaaaaaagtttatataaacct

SEQ ID NO: 665040 - DNA, 22 bp, Artificial Sequence
  chemically synthesized
acagtgcttatttaaaaggttt

SEQ ID NO: 665041 - DNA, 22 bp, Artificial Sequence
  chemically synthesized
atataaaccttttaaataagca

SEQ ID NO: 665042 - DNA, 22 bp, Artificial Sequence
  chemically synthesized
tataaaccttttaaataagcac

SEQ ID NO: 665043 - DNA, 22 bp, Artificial Sequence
  chemically synthesized
aaaatgttaacagtgcttattt

SEQ ID NO: 665044 - DNA, 22 bp, Artificial Sequence
  chemically synthesized
ttaaataagcactgttaacatt

SEQ ID NO: 665045 - DNA, 22 bp, Artificial Sequence
  chemically synthesized
taaataagcactgttaacattt

SEQ ID NO: 665046 - DNA, 22 bp, Artificial Sequence
  chemically synthesized
aaataagcactgttaacatttt

SEQ ID NO: 665047 - DNA, 22 bp, Artificial Sequence
  chemically synthesized
aataagcactgttaacattttg

SEQ ID NO: 665048 - DNA, 22 bp, Artificial Sequence
  chemically synthesized
gataaaaaatactcaaaatgtt

SEQ ID NO: 665049 - DNA, 22 bp, Artificial Sequence
  chemically synthesized
ttaacattttgagtatttttta

SEQ ID NO: 665050 - DNA, 22 bp, Artificial Sequence
  chemically synthesized
acattttgagtattttttatcc

SEQ ID NO: 665051 - DNA, 22 bp, Artificial Sequence
  chemically synthesized
tgagtattttttatccaacata

SEQ ID NO: 665052 - DNA, 22 bp, Artificial Sequence
  chemically synthesized
gagtattttttatccaacatat

SEQ ID NO: 665053 - DNA, 22 bp, Artificial Sequence
  chemically synthesized
agtattttttatccaacatatg

SEQ ID NO: 665054 - DNA, 22 bp, Artificial Sequence
  chemically synthesized
tttatccaacatatgtgtctat

SEQ ID NO: 665055 - DNA, 22 bp, Artificial Sequence
  chemically synthesized
ttatccaacatatgtgtctatg

SEQ ID NO: 665056 - DNA, 22 bp, Artificial Sequence
  chemically synthesized
tatccaacatatgtgtctatgt

SEQ ID NO: 665057 - DNA, 22 bp, Artificial Sequence
  chemically synthesized
atccaacatatgtgtctatgtg

SEQ ID NO: 665058 - DNA, 22 bp, Artificial Sequence
  chemically synthesized
tccaacatatgtgtctatgtgt

SEQ ID NO: 665059 - DNA, 22 bp, Artificial Sequence
  chemically synthesized
aatacatatcacacacatagac

SEQ ID NO: 665060 - DNA, 22 bp, Artificial Sequence
  chemically synthesized
aaatacatatcacacacataga

SEQ ID NO: 665061 - DNA, 22 bp, Artificial Sequence
  chemically synthesized
taaatacatatcacacacatag

SEQ ID NO: 665062 - DNA, 22 bp, Artificial Sequence
  chemically synthesized
ttaaatacatatcacacacata

SEQ ID NO: 665063 - DNA, 22 bp, Artificial Sequence
  chemically synthesized
tatttttaaatacatatcacac

SEQ ID NO: 665064 - DNA, 22 bp, Artificial Sequence
  chemically synthesized
attatatttttaaatacatatc

SEQ ID NO: 665065 - DNA, 22 bp, Artificial Sequence
  chemically synthesized
ctaattatatttttaaatacat

SEQ ID NO: 665066 - DNA, 22 bp, Artificial Sequence
  chemically synthesized
tgtgtgtgatatgtatttaaaa

SEQ ID NO: 665067 - DNA, 22 bp, Artificial Sequence
  chemically synthesized
ttcctaattatatttttaaata

SEQ ID NO: 665068 - DNA, 22 bp, Artificial Sequence
  chemically synthesized
attcctaattatatttttaaat

SEQ ID NO: 665069 - DNA, 22 bp, Artificial Sequence
  chemically synthesized
tattcctaattatatttttaaa

SEQ ID NO: 665070 - DNA, 22 bp, Artificial Sequence
  chemically synthesized
ttttattcctaattatattttt

SEQ ID NO: 665071 - DNA, 22 bp, Artificial Sequence
  chemically synthesized
attttattcctaattatatttt

SEQ ID NO: 665072 - DNA, 22 bp, Artificial Sequence
  chemically synthesized
aaaaatataattaggaataaaa

SEQ ID NO: 665073 - DNA, 22 bp, Artificial Sequence
  chemically synthesized
aaaatataattaggaataaaat

SEQ ID NO: 665074 - DNA, 22 bp, Artificial Sequence
  chemically synthesized
gaatatagagccaaatgtttat

SEQ ID NO: 665075 - DNA, 22 bp, Artificial Sequence
  chemically synthesized
agaatatagagccaaatgttta

SEQ ID NO: 665076 - DNA, 22 bp, Artificial Sequence
  chemically synthesized
ggaataaaataaacatttggct

SEQ ID NO: 665077 - DNA, 22 bp, Artificial Sequence
  chemically synthesized
taccttagaatatagagccaaa

SEQ ID NO: 665078 - DNA, 22 bp, Artificial Sequence
  chemically synthesized
gaatgattgtaccttagaatat

SEQ ID NO: 665079 - DNA, 22 bp, Artificial Sequence
  chemically synthesized
ggctctatattctaaggtacaa

SEQ ID NO: 665080 - DNA, 22 bp, Artificial Sequence
  chemically synthesized
gctctatattctaaggtacaat

SEQ ID NO: 665081 - DNA, 22 bp, Artificial Sequence
  chemically synthesized
aacattagaatgattgtacctt

SEQ ID NO: 665082 - DNA, 22 bp, Artificial Sequence
  chemically synthesized
tatattctaaggtacaatcatt

SEQ ID NO: 665083 - DNA, 22 bp, Artificial Sequence
  chemically synthesized
tgctgaacattagaatgattgt

SEQ ID NO: 665084 - DNA, 22 bp, Artificial Sequence
  chemically synthesized
tattctaaggtacaatcattct

SEQ ID NO: 665085 - DNA, 22 bp, Artificial Sequence
  chemically synthesized
tgtgctgaacattagaatgatt

SEQ ID NO: 665086 - DNA, 22 bp, Artificial Sequence
  chemically synthesized
ttctgtgctgaacattagaatg

SEQ ID NO: 665087 - DNA, 22 bp, Artificial Sequence
  chemically synthesized
taaggtacaatcattctaatgt

SEQ ID NO: 665088 - DNA, 22 bp, Artificial Sequence
  chemically synthesized
aggtacaatcattctaatgttc

SEQ ID NO: 665089 - DNA, 22 bp, Artificial Sequence
  chemically synthesized
ttattctgtgctgaacattaga

SEQ ID NO: 665090 - DNA, 22 bp, Artificial Sequence
  chemically synthesized
ttgttattctgtgctgaacatt

SEQ ID NO: 665091 - DNA, 22 bp, Artificial Sequence
  chemically synthesized
taatgttcagcacagaataaca

SEQ ID NO: 665092 - DNA, 22 bp, Artificial Sequence
  chemically synthesized
atgttcagcacagaataacaac

SEQ ID NO: 665093 - DNA, 22 bp, Artificial Sequence
  chemically synthesized
agcacagaataacaacaatata

SEQ ID NO: 665094 - DNA, 22 bp, Artificial Sequence
  chemically synthesized
cagaaaccacagtaacatatat

SEQ ID NO: 665095 - DNA, 22 bp, Artificial Sequence
  chemically synthesized
atagaccggtgactgcagaaac

SEQ ID NO: 665096 - DNA, 22 bp, Artificial Sequence
  chemically synthesized
gatagaccggtgactgcagaaa

SEQ ID NO: 665097 - DNA, 22 bp, Artificial Sequence
  chemically synthesized
ctgtggtttctgcagtcaccgg

SEQ ID NO: 665098 - DNA, 22 bp, Artificial Sequence
  chemically synthesized
tggtttctgcagtcaccggtct

SEQ ID NO: 665099 - DNA, 22 bp, Artificial Sequence
  chemically synthesized
ctgcagtcaccggtctatcaag

SEQ ID NO: 665100 - DNA, 22 bp, Artificial Sequence
  chemically synthesized
tgcagtcaccggtctatcaagc

SEQ ID NO: 665101 - DNA, 22 bp, Artificial Sequence
  chemically synthesized
cagtcaccggtctatcaagccc

SEQ ID NO: 665102 - DNA, 22 bp, Artificial Sequence
  chemically synthesized
ggtggcgtgagtcagggcttga

SEQ ID NO: 665103 - DNA, 22 bp, Artificial Sequence
  chemically synthesized
ctaggtggcgtgagtcagggct

SEQ ID NO: 665104 - DNA, 22 bp, Artificial Sequence
  chemically synthesized
ctgctaggtggcgtgagtcagg

SEQ ID NO: 665105 - DNA, 22 bp, Artificial Sequence
  chemically synthesized
cctgctaggtggcgtgagtcag

SEQ ID NO: 665106 - DNA, 22 bp, Artificial Sequence
  chemically synthesized
tcaagccctgactcacgccacc

SEQ ID NO: 665107 - DNA, 22 bp, Artificial Sequence
  chemically synthesized
aatatagcttcctgctaggtgg

SEQ ID NO: 665108 - DNA, 22 bp, Artificial Sequence
  chemically synthesized
actcacgccacctagcaggaag

SEQ ID NO: 665109 - DNA, 22 bp, Artificial Sequence
  chemically synthesized
acgccacctagcaggaagctat

SEQ ID NO: 665110 - DNA, 22 bp, Artificial Sequence
  chemically synthesized
agtaagaacatcatctaaatat

SEQ ID NO: 665111 - DNA, 22 bp, Artificial Sequence
  chemically synthesized
gagtaagaacatcatctaaata

SEQ ID NO: 665112 - DNA, 22 bp, Artificial Sequence
  chemically synthesized
gcaggaagctatatttagatga

SEQ ID NO: 665113 - DNA, 22 bp, Artificial Sequence
  chemically synthesized
tgcagacttgagtaagaacatc

SEQ ID NO: 665114 - DNA, 22 bp, Artificial Sequence
  chemically synthesized
gtgcagacttgagtaagaacat

SEQ ID NO: 665115 - DNA, 22 bp, Artificial Sequence
  chemically synthesized
tatttagatgatgttcttactc

SEQ ID NO: 665116 - DNA, 22 bp, Artificial Sequence
  chemically synthesized
agatgatgttcttactcaagtc

SEQ ID NO: 665117 - DNA, 22 bp, Artificial Sequence
  chemically synthesized
gatgatgttcttactcaagtct

SEQ ID NO: 665118 - DNA, 22 bp, Artificial Sequence
  chemically synthesized
tcaaggcttgtgcagacttgag

SEQ ID NO: 665119 - DNA, 22 bp, Artificial Sequence
  chemically synthesized
ttactcaagtctgcacaagcct

SEQ ID NO: 665120 - DNA, 22 bp, Artificial Sequence
  chemically synthesized
actcaagtctgcacaagccttg

SEQ ID NO: 665121 - DNA, 22 bp, Artificial Sequence
  chemically synthesized
ctcaagtctgcacaagccttga

SEQ ID NO: 665122 - DNA, 22 bp, Artificial Sequence
  chemically synthesized
aagtctgcacaagccttgatag

SEQ ID NO: 665123 - DNA, 22 bp, Artificial Sequence
  chemically synthesized
cacaagccttgatagatactgg

SEQ ID NO: 665124 - DNA, 22 bp, Artificial Sequence
  chemically synthesized
aaataaatgtagcccagtatct

SEQ ID NO: 665125 - DNA, 22 bp, Artificial Sequence
  chemically synthesized
ctgaaataaatgtagcccagta

SEQ ID NO: 665126 - DNA, 22 bp, Artificial Sequence
  chemically synthesized
agttcctgaaataaatgtagcc

SEQ ID NO: 665127 - DNA, 22 bp, Artificial Sequence
  chemically synthesized
gatagatactgggctacattta

SEQ ID NO: 665128 - DNA, 22 bp, Artificial Sequence
  chemically synthesized
atagatactgggctacatttat

SEQ ID NO: 665129 - DNA, 22 bp, Artificial Sequence
  chemically synthesized
gagctgagttcctgaaataaat

SEQ ID NO: 665130 - DNA, 22 bp, Artificial Sequence
  chemically synthesized
ggagctgagttcctgaaataaa

SEQ ID NO: 665131 - DNA, 22 bp, Artificial Sequence
  chemically synthesized
tggagctgagttcctgaaataa

SEQ ID NO: 665132 - DNA, 22 bp, Artificial Sequence
  chemically synthesized
ttggagctgagttcctgaaata

SEQ ID NO: 665133 - DNA, 22 bp, Artificial Sequence
  chemically synthesized
tttggagctgagttcctgaaat

SEQ ID NO: 665134 - DNA, 22 bp, Artificial Sequence
  chemically synthesized
ggctacatttatttcaggaact

SEQ ID NO: 665135 - DNA, 22 bp, Artificial Sequence
  chemically synthesized
catttatttcaggaactcagct

SEQ ID NO: 665136 - DNA, 22 bp, Artificial Sequence
  chemically synthesized
aaggagctttttggagctgagt

SEQ ID NO: 665137 - DNA, 22 bp, Artificial Sequence
  chemically synthesized
caaggagctttttggagctgag

SEQ ID NO: 665138 - DNA, 22 bp, Artificial Sequence
  chemically synthesized
atttcaggaactcagctccaaa

SEQ ID NO: 665139 - DNA, 22 bp, Artificial Sequence
  chemically synthesized
tttcaggaactcagctccaaaa

SEQ ID NO: 665140 - DNA, 22 bp, Artificial Sequence
  chemically synthesized
tcttcaaggagctttttggagc

SEQ ID NO: 665141 - DNA, 22 bp, Artificial Sequence
  chemically synthesized
gtcttcaaggagctttttggag

SEQ ID NO: 665142 - DNA, 22 bp, Artificial Sequence
  chemically synthesized
caggaactcagctccaaaaagc

SEQ ID NO: 665143 - DNA, 22 bp, Artificial Sequence
  chemically synthesized
aggaactcagctccaaaaagct

SEQ ID NO: 665144 - DNA, 22 bp, Artificial Sequence
  chemically synthesized
ttgtcttcaaggagctttttgg

SEQ ID NO: 665145 - DNA, 22 bp, Artificial Sequence
  chemically synthesized
agctccaaaaagctccttgaag

SEQ ID NO: 665146 - DNA, 22 bp, Artificial Sequence
  chemically synthesized
caaaaagctccttgaagacaag

SEQ ID NO: 665147 - DNA, 22 bp, Artificial Sequence
  chemically synthesized
cttgaagacaagaactctgtca

SEQ ID NO: 665148 - DNA, 22 bp, Artificial Sequence
  chemically synthesized
gaagacaagaactctgtcacct

SEQ ID NO: 665149 - DNA, 22 bp, Artificial Sequence
  chemically synthesized
aagacaagaactctgtcaccta

SEQ ID NO: 665150 - DNA, 22 bp, Artificial Sequence
  chemically synthesized
ggaaaaatgacagaagtaggtg

SEQ ID NO: 665151 - DNA, 22 bp, Artificial Sequence
  chemically synthesized
ctaggaaaaatgacagaagtag

SEQ ID NO: 665152 - DNA, 22 bp, Artificial Sequence
  chemically synthesized
agttgctaggaaaaatgacaga

SEQ ID NO: 665153 - DNA, 22 bp, Artificial Sequence
  chemically synthesized
tgtcacctacttctgtcatttt

SEQ ID NO: 665154 - DNA, 22 bp, Artificial Sequence
  chemically synthesized
tcacctacttctgtcatttttc

SEQ ID NO: 665155 - DNA, 22 bp, Artificial Sequence
  chemically synthesized
catattaagttgctaggaaaaa

SEQ ID NO: 665156 - DNA, 22 bp, Artificial Sequence
  chemically synthesized
cttctgtcatttttcctagcaa

SEQ ID NO: 665157 - DNA, 22 bp, Artificial Sequence
  chemically synthesized
ctgtcatttttcctagcaactt

SEQ ID NO: 665158 - DNA, 22 bp, Artificial Sequence
  chemically synthesized
tgtcatttttcctagcaactta

SEQ ID NO: 665159 - DNA, 22 bp, Artificial Sequence
  chemically synthesized
tcatttttcctagcaacttaat

SEQ ID NO: 665160 - DNA, 22 bp, Artificial Sequence
  chemically synthesized
agagggcagttgcatattaagt

SEQ ID NO: 665161 - DNA, 22 bp, Artificial Sequence
  chemically synthesized
cagagggcagttgcatattaag

SEQ ID NO: 665162 - DNA, 22 bp, Artificial Sequence
  chemically synthesized
tcagagggcagttgcatattaa

SEQ ID NO: 665163 - DNA, 22 bp, Artificial Sequence
  chemically synthesized
ttcctagcaacttaatatgcaa

SEQ ID NO: 665164 - DNA, 22 bp, Artificial Sequence
  chemically synthesized
ttcagagggcagttgcatatta

SEQ ID NO: 665165 - DNA, 22 bp, Artificial Sequence
  chemically synthesized
tcctagcaacttaatatgcaac

SEQ ID NO: 665166 - DNA, 22 bp, Artificial Sequence
  chemically synthesized
tttcagagggcagttgcatatt

SEQ ID NO: 665167 - DNA, 22 bp, Artificial Sequence
  chemically synthesized
cctagcaacttaatatgcaact

SEQ ID NO: 665168 - DNA, 22 bp, Artificial Sequence
  chemically synthesized
ctagcaacttaatatgcaactg

SEQ ID NO: 665169 - DNA, 22 bp, Artificial Sequence
  chemically synthesized
gcaacttaatatgcaactgccc

SEQ ID NO: 665170 - DNA, 22 bp, Artificial Sequence
  chemically synthesized
aaacagctttttcagagggcag

SEQ ID NO: 665171 - DNA, 22 bp, Artificial Sequence
  chemically synthesized
aatatgcaactgccctctgaaa

SEQ ID NO: 665172 - DNA, 22 bp, Artificial Sequence
  chemically synthesized
atatgcaactgccctctgaaaa

SEQ ID NO: 665173 - DNA, 22 bp, Artificial Sequence
  chemically synthesized
tattaaaacagctttttcagag

SEQ ID NO: 665174 - DNA, 22 bp, Artificial Sequence
  chemically synthesized
ccctctgaaaaagctgttttaa

SEQ ID NO: 665175 - DNA, 22 bp, Artificial Sequence
  chemically synthesized
tgaaaaagctgttttaatacag

SEQ ID NO: 665176 - DNA, 22 bp, Artificial Sequence
  chemically synthesized
aaaaagctgttttaatacagat

SEQ ID NO: 665177 - DNA, 22 bp, Artificial Sequence
  chemically synthesized
gtcagtcggtccatgatctgta

SEQ ID NO: 665178 - DNA, 22 bp, Artificial Sequence
  chemically synthesized
agttggtcagtcggtccatgat

SEQ ID NO: 665179 - DNA, 22 bp, Artificial Sequence
  chemically synthesized
ttttaatacagatcatggaccg

SEQ ID NO: 665180 - DNA, 22 bp, Artificial Sequence
  chemically synthesized
taatacagatcatggaccgact

SEQ ID NO: 665181 - DNA, 22 bp, Artificial Sequence
  chemically synthesized
attcagttggtcagtcggtcca

SEQ ID NO: 665182 - DNA, 22 bp, Artificial Sequence
  chemically synthesized
aatacagatcatggaccgactg

SEQ ID NO: 665183 - DNA, 22 bp, Artificial Sequence
  chemically synthesized
atacagatcatggaccgactga

SEQ ID NO: 665184 - DNA, 22 bp, Artificial Sequence
  chemically synthesized
ttgattcagttggtcagtcggt

SEQ ID NO: 665185 - DNA, 22 bp, Artificial Sequence
  chemically synthesized
attgattcagttggtcagtcgg

SEQ ID NO: 665186 - DNA, 22 bp, Artificial Sequence
  chemically synthesized
tttattgattcagttggtcagt

SEQ ID NO: 665187 - DNA, 22 bp, Artificial Sequence
  chemically synthesized
gtttattgattcagttggtcag

SEQ ID NO: 665188 - DNA, 22 bp, Artificial Sequence
  chemically synthesized
tgtttattgattcagttggtca

SEQ ID NO: 665189 - DNA, 22 bp, Artificial Sequence
  chemically synthesized
ttgtttattgattcagttggtc

SEQ ID NO: 665190 - DNA, 22 bp, Artificial Sequence
  chemically synthesized
ttttgtttattgattcagttgg

SEQ ID NO: 665191 - DNA, 22 bp, Artificial Sequence
  chemically synthesized
attcttttgtttattgattcag

SEQ ID NO: 665192 - DNA, 22 bp, Artificial Sequence
  chemically synthesized
cattcttttgtttattgattca

SEQ ID NO: 665193 - DNA, 22 bp, Artificial Sequence
  chemically synthesized
tcattcttttgtttattgattc

SEQ ID NO: 665194 - DNA, 22 bp, Artificial Sequence
  chemically synthesized
tttcattcttttgtttattgat

SEQ ID NO: 665195 - DNA, 22 bp, Artificial Sequence
  chemically synthesized
ctttcattcttttgtttattga

SEQ ID NO: 665196 - DNA, 22 bp, Artificial Sequence
  chemically synthesized
tctttcattcttttgtttattg

SEQ ID NO: 665197 - DNA, 22 bp, Artificial Sequence
  chemically synthesized
accaactgaatcaataaacaaa

SEQ ID NO: 665198 - DNA, 22 bp, Artificial Sequence
  chemically synthesized
tttctttcattcttttgtttat

SEQ ID NO: 665199 - DNA, 22 bp, Artificial Sequence
  chemically synthesized
ctttctttcattcttttgttta

SEQ ID NO: 665200 - DNA, 22 bp, Artificial Sequence
  chemically synthesized
tctttctttcattcttttgttt

SEQ ID NO: 665201 - DNA, 22 bp, Artificial Sequence
  chemically synthesized
ttctttctttcattcttttgtt

SEQ ID NO: 665202 - DNA, 22 bp, Artificial Sequence
  chemically synthesized
tttctttctttcattcttttgt

SEQ ID NO: 665203 - DNA, 22 bp, Artificial Sequence
  chemically synthesized
aatcaataaacaaaagaatgaa

SEQ ID NO: 665204 - DNA, 22 bp, Artificial Sequence
  chemically synthesized
tggcagtcatgtatgtcagtgt

SEQ ID NO: 665205 - DNA, 22 bp, Artificial Sequence
  chemically synthesized
attatggcagtcatgtatgtca

SEQ ID NO: 665206 - DNA, 22 bp, Artificial Sequence
  chemically synthesized
gattatggcagtcatgtatgtc

SEQ ID NO: 665207 - DNA, 22 bp, Artificial Sequence
  chemically synthesized
acatacatgactgccataatca

SEQ ID NO: 665208 - DNA, 22 bp, Artificial Sequence
  chemically synthesized
gtaggtgtcatttgattatggc

SEQ ID NO: 665209 - DNA, 22 bp, Artificial Sequence
  chemically synthesized
cgtaggtgtcatttgattatgg

SEQ ID NO: 665210 - DNA, 22 bp, Artificial Sequence
  chemically synthesized
gtttcgtaggtgtcatttgatt

SEQ ID NO: 665211 - DNA, 22 bp, Artificial Sequence
  chemically synthesized
ccataatcaaatgacacctacg

SEQ ID NO: 665212 - DNA, 22 bp, Artificial Sequence
  chemically synthesized
atcagaattggtttcgtaggtg

SEQ ID NO: 665213 - DNA, 22 bp, Artificial Sequence
  chemically synthesized
acacctcatcagaattggtttc

SEQ ID NO: 665214 - DNA, 22 bp, Artificial Sequence
  chemically synthesized
ctaacacctcatcagaattggt

SEQ ID NO: 665215 - DNA, 22 bp, Artificial Sequence
  chemically synthesized
cctaacacctcatcagaattgg

SEQ ID NO: 665216 - DNA, 22 bp, Artificial Sequence
  chemically synthesized
tcctaacacctcatcagaattg

SEQ ID NO: 665217 - DNA, 22 bp, Artificial Sequence
  chemically synthesized
ccctttcctaacacctcatcag

SEQ ID NO: 665218 - DNA, 22 bp, Artificial Sequence
  chemically synthesized
cgaaaccaattctgatgaggtg

SEQ ID NO: 665219 - DNA, 22 bp, Artificial Sequence
  chemically synthesized
ttgccctttcctaacacctcat

SEQ ID NO: 665220 - DNA, 22 bp, Artificial Sequence
  chemically synthesized
aattattgccctttcctaacac

SEQ ID NO: 665221 - DNA, 22 bp, Artificial Sequence
  chemically synthesized
tgatgaggtgttaggaaagggc

SEQ ID NO: 665222 - DNA, 22 bp, Artificial Sequence
  chemically synthesized
atgaggtgttaggaaagggcaa

SEQ ID NO: 665223 - DNA, 22 bp, Artificial Sequence
  chemically synthesized
gatatggattgaattattgccc

SEQ ID NO: 665224 - DNA, 22 bp, Artificial Sequence
  chemically synthesized
ggatatggattgaattattgcc

SEQ ID NO: 665225 - DNA, 22 bp, Artificial Sequence
  chemically synthesized
ggaaagggcaataattcaatcc

SEQ ID NO: 665226 - DNA, 22 bp, Artificial Sequence
  chemically synthesized
acccaagtgacttggatatgga

SEQ ID NO: 665227 - DNA, 22 bp, Artificial Sequence
  chemically synthesized
aaaatgttgacccaagtgactt

SEQ ID NO: 665228 - DNA, 22 bp, Artificial Sequence
  chemically synthesized
aatccatatccaagtcacttgg

SEQ ID NO: 665229 - DNA, 22 bp, Artificial Sequence
  chemically synthesized
cgatggccataaagctgaaaat

SEQ ID NO: 665230 - DNA, 22 bp, Artificial Sequence
  chemically synthesized
tgcgatggccataaagctgaaa

SEQ ID NO: 665231 - DNA, 22 bp, Artificial Sequence
  chemically synthesized
gggtcaacattttcagctttat

SEQ ID NO: 665232 - DNA, 22 bp, Artificial Sequence
  chemically synthesized
ggtcaacattttcagctttatg

SEQ ID NO: 665233 - DNA, 22 bp, Artificial Sequence
  chemically synthesized
gtctctgcgatggccataaagc

SEQ ID NO: 665234 - DNA, 22 bp, Artificial Sequence
  chemically synthesized
ggtctctgcgatggccataaag

SEQ ID NO: 665235 - DNA, 22 bp, Artificial Sequence
  chemically synthesized
tgtttggtctctgcgatggcca

SEQ ID NO: 665236 - DNA, 22 bp, Artificial Sequence
  chemically synthesized
atgtttggtctctgcgatggcc

SEQ ID NO: 665237 - DNA, 22 bp, Artificial Sequence
  chemically synthesized
tatgtttggtctctgcgatggc

SEQ ID NO: 665238 - DNA, 22 bp, Artificial Sequence
  chemically synthesized
tcagctttatggccatcgcaga

SEQ ID NO: 665239 - DNA, 22 bp, Artificial Sequence
  chemically synthesized
ttatgtttggtctctgcgatgg

SEQ ID NO: 665240 - DNA, 22 bp, Artificial Sequence
  chemically synthesized
cagctttatggccatcgcagag

SEQ ID NO: 665241 - DNA, 22 bp, Artificial Sequence
  chemically synthesized
agctttatggccatcgcagaga

SEQ ID NO: 665242 - DNA, 22 bp, Artificial Sequence
  chemically synthesized
aggcttttatgtttggtctctg

SEQ ID NO: 665243 - DNA, 22 bp, Artificial Sequence
  chemically synthesized
tatggccatcgcagagaccaaa

SEQ ID NO: 665244 - DNA, 22 bp, Artificial Sequence
  chemically synthesized
atggccatcgcagagaccaaac

SEQ ID NO: 665245 - DNA, 22 bp, Artificial Sequence
  chemically synthesized
tggccatcgcagagaccaaaca

SEQ ID NO: 665246 - DNA, 22 bp, Artificial Sequence
  chemically synthesized
aaattcaggcttttatgtttgg

SEQ ID NO: 665247 - DNA, 22 bp, Artificial Sequence
  chemically synthesized
gttgaaattcaggcttttatgt

SEQ ID NO: 665248 - DNA, 22 bp, Artificial Sequence
  chemically synthesized
ccctagttgaaattcaggcttt

SEQ ID NO: 665249 - DNA, 22 bp, Artificial Sequence
  chemically synthesized
cccctagttgaaattcaggctt

SEQ ID NO: 665250 - DNA, 22 bp, Artificial Sequence
  chemically synthesized
tcccctagttgaaattcaggct

SEQ ID NO: 665251 - DNA, 22 bp, Artificial Sequence
  chemically synthesized
tttcccctagttgaaattcagg

SEQ ID NO: 665252 - DNA, 22 bp, Artificial Sequence
  chemically synthesized
ctttcccctagttgaaattcag

SEQ ID NO: 665253 - DNA, 22 bp, Artificial Sequence
  chemically synthesized
tctttcccctagttgaaattca

SEQ ID NO: 665254 - DNA, 22 bp, Artificial Sequence
  chemically synthesized
ttttctttcccctagttgaaat

SEQ ID NO: 665255 - DNA, 22 bp, Artificial Sequence
  chemically synthesized
cagacattgttttctttcccct

SEQ ID NO: 665256 - DNA, 22 bp, Artificial Sequence
  chemically synthesized
aatttcaactaggggaaagaaa

SEQ ID NO: 665257 - DNA, 22 bp, Artificial Sequence
  chemically synthesized
aattacagacattgttttcttt

SEQ ID NO: 665258 - DNA, 22 bp, Artificial Sequence
  chemically synthesized
aaattacagacattgttttctt

SEQ ID NO: 665259 - DNA, 22 bp, Artificial Sequence
  chemically synthesized
caactaggggaaagaaaacaat

SEQ ID NO: 665260 - DNA, 22 bp, Artificial Sequence
  chemically synthesized
aactaggggaaagaaaacaatg

SEQ ID NO: 665261 - DNA, 22 bp, Artificial Sequence
  chemically synthesized
ggggaaagaaaacaatgtctgt

SEQ ID NO: 665262 - DNA, 22 bp, Artificial Sequence
  chemically synthesized
aatagtttaaattacagacatt

SEQ ID NO: 665263 - DNA, 22 bp, Artificial Sequence
  chemically synthesized
tatgctgaatagtttaaattac

SEQ ID NO: 665264 - DNA, 22 bp, Artificial Sequence
  chemically synthesized
aacaaaattgtatgctgaatag

SEQ ID NO: 665265 - DNA, 22 bp, Artificial Sequence
  chemically synthesized
aaacaaaattgtatgctgaata

SEQ ID NO: 665266 - DNA, 22 bp, Artificial Sequence
  chemically synthesized
taaacaaaattgtatgctgaat

SEQ ID NO: 665267 - DNA, 22 bp, Artificial Sequence
  chemically synthesized
taatttaaactattcagcatac

SEQ ID NO: 665268 - DNA, 22 bp, Artificial Sequence
  chemically synthesized
ttaaacaaaattgtatgctgaa

SEQ ID NO: 665269 - DNA, 22 bp, Artificial Sequence
  chemically synthesized
aaactattcagcatacaatttt

SEQ ID NO: 665270 - DNA, 22 bp, Artificial Sequence
  chemically synthesized
aactattcagcatacaattttg

SEQ ID NO: 665271 - DNA, 22 bp, Artificial Sequence
  chemically synthesized
cggtcttttaaacaaaattgta

SEQ ID NO: 665272 - DNA, 22 bp, Artificial Sequence
  chemically synthesized
ttcagcatacaattttgtttaa

SEQ ID NO: 665273 - DNA, 22 bp, Artificial Sequence
  chemically synthesized
gtattccggtcttttaaacaaa

SEQ ID NO: 665274 - DNA, 22 bp, Artificial Sequence
  chemically synthesized
ggtattccggtcttttaaacaa

SEQ ID NO: 665275 - DNA, 22 bp, Artificial Sequence
  chemically synthesized
agcatacaattttgtttaaaag

SEQ ID NO: 665276 - DNA, 22 bp, Artificial Sequence
  chemically synthesized
accaacatttggtattccggtc

SEQ ID NO: 665277 - DNA, 22 bp, Artificial Sequence
  chemically synthesized
tgtttaaaagaccggaatacca

SEQ ID NO: 665278 - DNA, 22 bp, Artificial Sequence
  chemically synthesized
gtttaaaagaccggaataccaa

SEQ ID NO: 665279 - DNA, 22 bp, Artificial Sequence
  chemically synthesized
tttaaaagaccggaataccaaa

SEQ ID NO: 665280 - DNA, 22 bp, Artificial Sequence
  chemically synthesized
aaaagaccggaataccaaatgt

SEQ ID NO: 665281 - DNA, 22 bp, Artificial Sequence
  chemically synthesized
aaagaccggaataccaaatgtt

SEQ ID NO: 665282 - DNA, 22 bp, Artificial Sequence
  chemically synthesized
catatcctcaccaacatttggt

SEQ ID NO: 665283 - DNA, 22 bp, Artificial Sequence
  chemically synthesized
cagtcgctccatatcctcacca

SEQ ID NO: 665284 - DNA, 22 bp, Artificial Sequence
  chemically synthesized
agaattccagtcgctccatatc

SEQ ID NO: 665285 - DNA, 22 bp, Artificial Sequence
  chemically synthesized
gtgaggatatggagcgactgga

SEQ ID NO: 665286 - DNA, 22 bp, Artificial Sequence
  chemically synthesized
ccaacaagcagtgtctgagaat

SEQ ID NO: 665287 - DNA, 22 bp, Artificial Sequence
  chemically synthesized
gaattctcagacactgcttgtt

SEQ ID NO: 665288 - DNA, 22 bp, Artificial Sequence
  chemically synthesized
tcgtacattcccaacaagcagt

SEQ ID NO: 665289 - DNA, 22 bp, Artificial Sequence
  chemically synthesized
tcagacactgcttgttgggaat

SEQ ID NO: 665290 - DNA, 22 bp, Artificial Sequence
  chemically synthesized
agacactgcttgttgggaatgt

SEQ ID NO: 665291 - DNA, 22 bp, Artificial Sequence
  chemically synthesized
ccaaagttgtcgtacattccca

SEQ ID NO: 665292 - DNA, 22 bp, Artificial Sequence
  chemically synthesized
cccaaagttgtcgtacattccc

SEQ ID NO: 665293 - DNA, 22 bp, Artificial Sequence
  chemically synthesized
gtttcccaaagttgtcgtacat

SEQ ID NO: 665294 - DNA, 22 bp, Artificial Sequence
  chemically synthesized
cttgttgggaatgtacgacaac

SEQ ID NO: 665295 - DNA, 22 bp, Artificial Sequence
  chemically synthesized
actggtttcccaaagttgtcgt

SEQ ID NO: 665296 - DNA, 22 bp, Artificial Sequence
  chemically synthesized
gttgggaatgtacgacaacttt

SEQ ID NO: 665297 - DNA, 22 bp, Artificial Sequence
  chemically synthesized
ttgggaatgtacgacaactttg

SEQ ID NO: 665298 - DNA, 22 bp, Artificial Sequence
  chemically synthesized
cctaactggtttcccaaagttg

SEQ ID NO: 665299 - DNA, 22 bp, Artificial Sequence
  chemically synthesized
ggaatgtacgacaactttggga

SEQ ID NO: 665300 - DNA, 22 bp, Artificial Sequence
  chemically synthesized
ataagaaactgcctaactggtt

SEQ ID NO: 665301 - DNA, 22 bp, Artificial Sequence
  chemically synthesized
cataagaaactgcctaactggt

SEQ ID NO: 665302 - DNA, 22 bp, Artificial Sequence
  chemically synthesized
atttcataagaaactgcctaac

SEQ ID NO: 665303 - DNA, 22 bp, Artificial Sequence
  chemically synthesized
aatttcataagaaactgcctaa

SEQ ID NO: 665304 - DNA, 22 bp, Artificial Sequence
  chemically synthesized
tgggaaaccagttaggcagttt

SEQ ID NO: 665305 - DNA, 22 bp, Artificial Sequence
  chemically synthesized
gggaaaccagttaggcagtttc

SEQ ID NO: 665306 - DNA, 22 bp, Artificial Sequence
  chemically synthesized
ggaaaccagttaggcagtttct

SEQ ID NO: 665307 - DNA, 22 bp, Artificial Sequence
  chemically synthesized
ggcagtttcttatgaaattaaa

SEQ ID NO: 665308 - DNA, 22 bp, Artificial Sequence
  chemically synthesized
cttatgaaattaaacacacatg

SEQ ID NO: 665309 - DNA, 22 bp, Artificial Sequence
  chemically synthesized
agtcataatatacatgtgtgtt

SEQ ID NO: 665310 - DNA, 22 bp, Artificial Sequence
  chemically synthesized
ttatgaaattaaacacacatgt

SEQ ID NO: 665311 - DNA, 22 bp, Artificial Sequence
  chemically synthesized
gagtcataatatacatgtgtgt

SEQ ID NO: 665312 - DNA, 22 bp, Artificial Sequence
  chemically synthesized
atgaaattaaacacacatgtat

SEQ ID NO: 665313 - DNA, 22 bp, Artificial Sequence
  chemically synthesized
tgaaattaaacacacatgtata

SEQ ID NO: 665314 - DNA, 22 bp, Artificial Sequence
  chemically synthesized
aacacacatgtatattatgact

SEQ ID NO: 665315 - DNA, 22 bp, Artificial Sequence
  chemically synthesized
tgcaaatatccaggaaaagaat

SEQ ID NO: 665316 - DNA, 22 bp, Artificial Sequence
  chemically synthesized
tgactcaaatattcttttcctg

SEQ ID NO: 665317 - DNA, 22 bp, Artificial Sequence
  chemically synthesized
tgtgcaaatatccaggaaaaga

SEQ ID NO: 665318 - DNA, 22 bp, Artificial Sequence
  chemically synthesized
ttctgtgcaaatatccaggaaa

SEQ ID NO: 665319 - DNA, 22 bp, Artificial Sequence
  chemically synthesized
attctgtgcaaatatccaggaa

SEQ ID NO: 665320 - DNA, 22 bp, Artificial Sequence
  chemically synthesized
tattctgtgcaaatatccagga

SEQ ID NO: 665321 - DNA, 22 bp, Artificial Sequence
  chemically synthesized
aaatattcttttcctggatatt

SEQ ID NO: 665322 - DNA, 22 bp, Artificial Sequence
  chemically synthesized
ttattctgtgcaaatatccagg

SEQ ID NO: 665323 - DNA, 22 bp, Artificial Sequence
  chemically synthesized
tttattctgtgcaaatatccag

SEQ ID NO: 665324 - DNA, 22 bp, Artificial Sequence
  chemically synthesized
ttttattctgtgcaaatatcca

SEQ ID NO: 665325 - DNA, 22 bp, Artificial Sequence
  chemically synthesized
tttttattctgtgcaaatatcc

SEQ ID NO: 665326 - DNA, 22 bp, Artificial Sequence
  chemically synthesized
ttttttattctgtgcaaatatc

SEQ ID NO: 665327 - DNA, 22 bp, Artificial Sequence
  chemically synthesized
ttttcctggatatttgcacaga

SEQ ID NO: 665328 - DNA, 22 bp, Artificial Sequence
  chemically synthesized
ttcctggatatttgcacagaat

SEQ ID NO: 665329 - DNA, 22 bp, Artificial Sequence
  chemically synthesized
tcctggatatttgcacagaata

SEQ ID NO: 665330 - DNA, 22 bp, Artificial Sequence
  chemically synthesized
cctggatatttgcacagaataa

SEQ ID NO: 665331 - DNA, 22 bp, Artificial Sequence
  chemically synthesized
ctggatatttgcacagaataaa

SEQ ID NO: 665332 - DNA, 22 bp, Artificial Sequence
  chemically synthesized
gatatttgcacagaataaaaaa

SEQ ID NO: 665333 - DNA, 22 bp, Artificial Sequence
  chemically synthesized
tggacatacatttttttttatt

SEQ ID NO: 665334 - DNA, 22 bp, Artificial Sequence
  chemically synthesized
gtggacatacatttttttttat

SEQ ID NO: 665335 - DNA, 22 bp, Artificial Sequence
  chemically synthesized
tgtggacatacattttttttta

SEQ ID NO: 665336 - DNA, 22 bp, Artificial Sequence
  chemically synthesized
ttgtggacatacattttttttt

SEQ ID NO: 665337 - DNA, 22 bp, Artificial Sequence
  chemically synthesized
tttgtggacatacatttttttt

SEQ ID NO: 665338 - DNA, 22 bp, Artificial Sequence
  chemically synthesized
gcacagaataaaaaaaaatgta

SEQ ID NO: 665339 - DNA, 22 bp, Artificial Sequence
  chemically synthesized
cacagaataaaaaaaaatgtat

SEQ ID NO: 665340 - DNA, 22 bp, Artificial Sequence
  chemically synthesized
atgtacacatctttttgtggac

SEQ ID NO: 665341 - DNA, 22 bp, Artificial Sequence
  chemically synthesized
tggatattcatgtacacatctt

SEQ ID NO: 665342 - DNA, 22 bp, Artificial Sequence
  chemically synthesized
ctatggatattcatgtacacat

SEQ ID NO: 665343 - DNA, 22 bp, Artificial Sequence
  chemically synthesized
tgaataaagctgctatggatat

SEQ ID NO: 665344 - DNA, 22 bp, Artificial Sequence
  chemically synthesized
ttatgaataaagctgctatgga

SEQ ID NO: 665345 - DNA, 22 bp, Artificial Sequence
  chemically synthesized
actattatgaataaagctgcta

SEQ ID NO: 665346 - DNA, 22 bp, Artificial Sequence
  chemically synthesized
gactattatgaataaagctgct

SEQ ID NO: 665347 - DNA, 22 bp, Artificial Sequence
  chemically synthesized
tgactattatgaataaagctgc

SEQ ID NO: 665348 - DNA, 22 bp, Artificial Sequence
  chemically synthesized
ttgactattatgaataaagctg

SEQ ID NO: 665349 - DNA, 22 bp, Artificial Sequence
  chemically synthesized
cggtttttgactattatgaata

SEQ ID NO: 665350 - DNA, 22 bp, Artificial Sequence
  chemically synthesized
ccggtttttgactattatgaat

SEQ ID NO: 665351 - DNA, 22 bp, Artificial Sequence
  chemically synthesized
gtttccggtttttgactattat

SEQ ID NO: 665352 - DNA, 22 bp, Artificial Sequence
  chemically synthesized
gttggtttccggtttttgacta

SEQ ID NO: 665353 - DNA, 22 bp, Artificial Sequence
  chemically synthesized
tattcataatagtcaaaaaccg

SEQ ID NO: 665354 - DNA, 22 bp, Artificial Sequence
  chemically synthesized
ctggttggtttccggtttttga

SEQ ID NO: 665355 - DNA, 22 bp, Artificial Sequence
  chemically synthesized
attcataatagtcaaaaaccgg

SEQ ID NO: 665356 - DNA, 22 bp, Artificial Sequence
  chemically synthesized
actggttggtttccggtttttg

SEQ ID NO: 665357 - DNA, 22 bp, Artificial Sequence
  chemically synthesized
ttcataatagtcaaaaaccgga

SEQ ID NO: 665358 - DNA, 22 bp, Artificial Sequence
  chemically synthesized
ataatagtcaaaaaccggaaac

SEQ ID NO: 665359 - DNA, 22 bp, Artificial Sequence
  chemically synthesized
ccttactggttggtttccggtt

SEQ ID NO: 665360 - DNA, 22 bp, Artificial Sequence
  chemically synthesized
tccattaccttactggttggtt

SEQ ID NO: 665361 - DNA, 22 bp, Artificial Sequence
  chemically synthesized
atccattaccttactggttggt

SEQ ID NO: 665362 - DNA, 22 bp, Artificial Sequence
  chemically synthesized
tttatccattaccttactggtt

SEQ ID NO: 665363 - DNA, 22 bp, Artificial Sequence
  chemically synthesized
gtttatccattaccttactggt

SEQ ID NO: 665364 - DNA, 22 bp, Artificial Sequence
  chemically synthesized
ccacaacttgtttatccattac

SEQ ID NO: 665365 - DNA, 22 bp, Artificial Sequence
  chemically synthesized
accacaacttgtttatccatta

SEQ ID NO: 665366 - DNA, 22 bp, Artificial Sequence
  chemically synthesized
taccacaacttgtttatccatt

SEQ ID NO: 665367 - DNA, 22 bp, Artificial Sequence
  chemically synthesized
aatgactttaccacaacttgtt

SEQ ID NO: 665368 - DNA, 22 bp, Artificial Sequence
  chemically synthesized
cacagtagtatcccactgaatg

SEQ ID NO: 665369 - DNA, 22 bp, Artificial Sequence
  chemically synthesized
gcacagtagtatcccactgaat

SEQ ID NO: 665370 - DNA, 22 bp, Artificial Sequence
  chemically synthesized
tgcacagtagtatcccactgaa

SEQ ID NO: 665371 - DNA, 22 bp, Artificial Sequence
  chemically synthesized
tggtaaagtcattcagtgggat

SEQ ID NO: 665372 - DNA, 22 bp, Artificial Sequence
  chemically synthesized
cactttgcacagtagtatccca

SEQ ID NO: 665373 - DNA, 22 bp, Artificial Sequence
  chemically synthesized
ttgcactttgcacagtagtatc

SEQ ID NO: 665374 - DNA, 22 bp, Artificial Sequence
  chemically synthesized
attgcactttgcacagtagtat

SEQ ID NO: 665375 - DNA, 22 bp, Artificial Sequence
  chemically synthesized
tattgcactttgcacagtagta

SEQ ID NO: 665376 - DNA, 22 bp, Artificial Sequence
  chemically synthesized
ttattgcactttgcacagtagt

SEQ ID NO: 665377 - DNA, 22 bp, Artificial Sequence
  chemically synthesized
tttattgcactttgcacagtag

SEQ ID NO: 665378 - DNA, 22 bp, Artificial Sequence
  chemically synthesized
agtgggatactactgtgcaaag

SEQ ID NO: 665379 - DNA, 22 bp, Artificial Sequence
  chemically synthesized
ctttttattgcactttgcacag

SEQ ID NO: 665380 - DNA, 22 bp, Artificial Sequence
  chemically synthesized
gttcctttttattgcactttgc

SEQ ID NO: 665381 - DNA, 22 bp, Artificial Sequence
  chemically synthesized
ctgtgcaaagtgcaataaaaag

SEQ ID NO: 665382 - DNA, 22 bp, Artificial Sequence
  chemically synthesized
tcagtagttagttcctttttat

SEQ ID NO: 665383 - DNA, 22 bp, Artificial Sequence
  chemically synthesized
tgcaaagtgcaataaaaaggaa

SEQ ID NO: 665384 - DNA, 22 bp, Artificial Sequence
  chemically synthesized
cattatcagtagttagttcctt

SEQ ID NO: 665385 - DNA, 22 bp, Artificial Sequence
  chemically synthesized
ttgcattatcagtagttagttc

SEQ ID NO: 665386 - DNA, 22 bp, Artificial Sequence
  chemically synthesized
acattgttgcattatcagtagt

SEQ ID NO: 665387 - DNA, 22 bp, Artificial Sequence
  chemically synthesized
agatcagttcacattgttgcat

SEQ ID NO: 665388 - DNA, 22 bp, Artificial Sequence
  chemically synthesized
cagatcagttcacattgttgca

SEQ ID NO: 665389 - DNA, 22 bp, Artificial Sequence
  chemically synthesized
actactgataatgcaacaatgt

SEQ ID NO: 665390 - DNA, 22 bp, Artificial Sequence
  chemically synthesized
tcagatcagttcacattgttgc

SEQ ID NO: 665391 - DNA, 22 bp, Artificial Sequence
  chemically synthesized
ttcagatcagttcacattgttg

SEQ ID NO: 665392 - DNA, 22 bp, Artificial Sequence
  chemically synthesized
ctgataatgcaacaatgtgaac

SEQ ID NO: 665393 - DNA, 22 bp, Artificial Sequence
  chemically synthesized
ataatgcaacaatgtgaactga

SEQ ID NO: 665394 - DNA, 22 bp, Artificial Sequence
  chemically synthesized
gtgtttttcagatcagttcaca

SEQ ID NO: 665395 - DNA, 22 bp, Artificial Sequence
  chemically synthesized
agtgtttttcagatcagttcac

SEQ ID NO: 665396 - DNA, 22 bp, Artificial Sequence
  chemically synthesized
cccagcttagtgtttttcagat

SEQ ID NO: 665397 - DNA, 22 bp, Artificial Sequence
  chemically synthesized
acccagcttagtgtttttcaga

SEQ ID NO: 665398 - DNA, 22 bp, Artificial Sequence
  chemically synthesized
tacccagcttagtgtttttcag

SEQ ID NO: 665399 - DNA, 22 bp, Artificial Sequence
  chemically synthesized
ttacccagcttagtgtttttca

SEQ ID NO: 665400 - DNA, 22 bp, Artificial Sequence
  chemically synthesized
ttttacccagcttagtgttttt

SEQ ID NO: 665401 - DNA, 22 bp, Artificial Sequence
  chemically synthesized
cttttacccagcttagtgtttt

SEQ ID NO: 665402 - DNA, 22 bp, Artificial Sequence
  chemically synthesized
gcttcttttacccagcttagtg

SEQ ID NO: 665403 - DNA, 22 bp, Artificial Sequence
  chemically synthesized
atctgaaaaacactaagctggg

SEQ ID NO: 665404 - DNA, 22 bp, Artificial Sequence
  chemically synthesized
tgcctggcttcttttacccagc

SEQ ID NO: 665405 - DNA, 22 bp, Artificial Sequence
  chemically synthesized
aaaaacactaagctgggtaaaa

SEQ ID NO: 665406 - DNA, 22 bp, Artificial Sequence
  chemically synthesized
gtgcctggcttcttttacccag

SEQ ID NO: 665407 - DNA, 22 bp, Artificial Sequence
  chemically synthesized
tgtgcctggcttcttttaccca

SEQ ID NO: 665408 - DNA, 22 bp, Artificial Sequence
  chemically synthesized
ttttgtgcctggcttcttttac

SEQ ID NO: 665409 - DNA, 22 bp, Artificial Sequence
  chemically synthesized
agctgggtaaaagaagccaggc

SEQ ID NO: 665410 - DNA, 22 bp, Artificial Sequence
  chemically synthesized
ggtaaaagaagccaggcacaaa

SEQ ID NO: 665411 - DNA, 22 bp, Artificial Sequence
  chemically synthesized
atataagtgaaatcaaacagta

SEQ ID NO: 665412 - DNA, 22 bp, Artificial Sequence
  chemically synthesized
gaagttgatataagtgaaatca

SEQ ID NO: 665413 - DNA, 22 bp, Artificial Sequence
  chemically synthesized
tagaagttgatataagtgaaat

SEQ ID NO: 665414 - DNA, 22 bp, Artificial Sequence
  chemically synthesized
ttctagaagttgatataagtga

SEQ ID NO: 665415 - DNA, 22 bp, Artificial Sequence
  chemically synthesized
cctgttctagaagttgatataa

SEQ ID NO: 665416 - DNA, 22 bp, Artificial Sequence
  chemically synthesized
tttgatttcacttatatcaact

SEQ ID NO: 665417 - DNA, 22 bp, Artificial Sequence
  chemically synthesized
gcctgttctagaagttgatata

SEQ ID NO: 665418 - DNA, 22 bp, Artificial Sequence
  chemically synthesized
tgcctgttctagaagttgatat

SEQ ID NO: 665419 - DNA, 22 bp, Artificial Sequence
  chemically synthesized
gatttcacttatatcaacttct

SEQ ID NO: 665420 - DNA, 22 bp, Artificial Sequence
  chemically synthesized
atttcacttatatcaacttcta

SEQ ID NO: 665421 - DNA, 22 bp, Artificial Sequence
  chemically synthesized
agttttgcctgttctagaagtt

SEQ ID NO: 665422 - DNA, 22 bp, Artificial Sequence
  chemically synthesized
cacttatatcaacttctagaac

SEQ ID NO: 665423 - DNA, 22 bp, Artificial Sequence
  chemically synthesized
acttatatcaacttctagaaca

SEQ ID NO: 665424 - DNA, 22 bp, Artificial Sequence
  chemically synthesized
atatcaacttctagaacaggca

SEQ ID NO: 665425 - DNA, 22 bp, Artificial Sequence
  chemically synthesized
tatcaacttctagaacaggcaa

SEQ ID NO: 665426 - DNA, 22 bp, Artificial Sequence
  chemically synthesized
gcatagtagctaagttttgcct

SEQ ID NO: 665427 - DNA, 22 bp, Artificial Sequence
  chemically synthesized
ctagaacaggcaaaacttagct

SEQ ID NO: 665428 - DNA, 22 bp, Artificial Sequence
  chemically synthesized
tagaacaggcaaaacttagcta

SEQ ID NO: 665429 - DNA, 22 bp, Artificial Sequence
  chemically synthesized
ccatctggcatagtagctaagt

SEQ ID NO: 665430 - DNA, 22 bp, Artificial Sequence
  chemically synthesized
gaacaggcaaaacttagctact

SEQ ID NO: 665431 - DNA, 22 bp, Artificial Sequence
  chemically synthesized
agctactatgccagatggtagc

SEQ ID NO: 665432 - DNA, 22 bp, Artificial Sequence
  chemically synthesized
gctactatgccagatggtagcc

SEQ ID NO: 665433 - DNA, 22 bp, Artificial Sequence
  chemically synthesized
ccaccacaccccaggctaccat

SEQ ID NO: 665434 - DNA, 22 bp, Artificial Sequence
  chemically synthesized
ctatgccagatggtagcctggg

SEQ ID NO: 665435 - DNA, 22 bp, Artificial Sequence
  chemically synthesized
ctcccaccacaccccaggctac

SEQ ID NO: 665436 - DNA, 22 bp, Artificial Sequence
  chemically synthesized
tgccagatggtagcctggggtg

SEQ ID NO: 665437 - DNA, 22 bp, Artificial Sequence
  chemically synthesized
cctactcccaccacaccccagg

SEQ ID NO: 665438 - DNA, 22 bp, Artificial Sequence
  chemically synthesized
aggtcagttacctactcccacc

SEQ ID NO: 665439 - DNA, 22 bp, Artificial Sequence
  chemically synthesized
gaggtcagttacctactcccac

SEQ ID NO: 665440 - DNA, 22 bp, Artificial Sequence
  chemically synthesized
tgaggtcagttacctactccca

SEQ ID NO: 665441 - DNA, 22 bp, Artificial Sequence
  chemically synthesized
ctttgaggtcagttacctactc

SEQ ID NO: 665442 - DNA, 22 bp, Artificial Sequence
  chemically synthesized
gggtgtggtgggagtaggtaac

SEQ ID NO: 665443 - DNA, 22 bp, Artificial Sequence
  chemically synthesized
tgttcctttgaggtcagttacc

SEQ ID NO: 665444 - DNA, 22 bp, Artificial Sequence
  chemically synthesized
gtgttcctttgaggtcagttac

SEQ ID NO: 665445 - DNA, 22 bp, Artificial Sequence
  chemically synthesized
gaaaacacccttgtgttccttt

SEQ ID NO: 665446 - DNA, 22 bp, Artificial Sequence
  chemically synthesized
acctcaaaggaacacaagggtg

SEQ ID NO: 665447 - DNA, 22 bp, Artificial Sequence
  chemically synthesized
gatcacctagaaaacacccttg

SEQ ID NO: 665448 - DNA, 22 bp, Artificial Sequence
  chemically synthesized
cgatcacctagaaaacaccctt

SEQ ID NO: 665449 - DNA, 22 bp, Artificial Sequence
  chemically synthesized
aaaggaacacaagggtgttttc

SEQ ID NO: 665450 - DNA, 22 bp, Artificial Sequence
  chemically synthesized
tctaggtgatcgaaatgttata

SEQ ID NO: 665451 - DNA, 22 bp, Artificial Sequence
  chemically synthesized
ctaggtgatcgaaatgttatat

SEQ ID NO: 665452 - DNA, 22 bp, Artificial Sequence
  chemically synthesized
taggtgatcgaaatgttatatc

SEQ ID NO: 665453 - DNA, 22 bp, Artificial Sequence
  chemically synthesized
ggtgatcgaaatgttatatctt

SEQ ID NO: 665454 - DNA, 22 bp, Artificial Sequence
  chemically synthesized
gtgtaaccaccatgccaatcaa

SEQ ID NO: 665455 - DNA, 22 bp, Artificial Sequence
  chemically synthesized
tatcttgattggcatggtggtt

SEQ ID NO: 665456 - DNA, 22 bp, Artificial Sequence
  chemically synthesized
gattggcatggtggttacacga

SEQ ID NO: 665457 - DNA, 22 bp, Artificial Sequence
  chemically synthesized
attggcatggtggttacacgag

SEQ ID NO: 665458 - DNA, 22 bp, Artificial Sequence
  chemically synthesized
gcaaatgtatacactcgtgtaa

SEQ ID NO: 665459 - DNA, 22 bp, Artificial Sequence
  chemically synthesized
ggcaaatgtatacactcgtgta

SEQ ID NO: 665460 - DNA, 22 bp, Artificial Sequence
  chemically synthesized
tggcaaatgtatacactcgtgt

SEQ ID NO: 665461 - DNA, 22 bp, Artificial Sequence
  chemically synthesized
gcatggtggttacacgagtgta

SEQ ID NO: 665462 - DNA, 22 bp, Artificial Sequence
  chemically synthesized
gattttggcaaatgtatacact

SEQ ID NO: 665463 - DNA, 22 bp, Artificial Sequence
  chemically synthesized
aggttagattttggcaaatgta

SEQ ID NO: 665464 - DNA, 22 bp, Artificial Sequence
  chemically synthesized
cacgagtgtatacatttgccaa

SEQ ID NO: 665465 - DNA, 22 bp, Artificial Sequence
  chemically synthesized
agtgttcaggttagattttggc

SEQ ID NO: 665466 - DNA, 22 bp, Artificial Sequence
  chemically synthesized
aagtgttcaggttagattttgg

SEQ ID NO: 665467 - DNA, 22 bp, Artificial Sequence
  chemically synthesized
taagtgttcaggttagattttg

SEQ ID NO: 665468 - DNA, 22 bp, Artificial Sequence
  chemically synthesized
cattttaagtgttcaggttaga

SEQ ID NO: 665469 - DNA, 22 bp, Artificial Sequence
  chemically synthesized
ccattttaagtgttcaggttag

SEQ ID NO: 665470 - DNA, 22 bp, Artificial Sequence
  chemically synthesized
gccaaaatctaacctgaacact

SEQ ID NO: 665471 - DNA, 22 bp, Artificial Sequence
  chemically synthesized
ccaaaatctaacctgaacactt

SEQ ID NO: 665472 - DNA, 22 bp, Artificial Sequence
  chemically synthesized
taacatgtttccattttaagtg

SEQ ID NO: 665473 - DNA, 22 bp, Artificial Sequence
  chemically synthesized
acctgaacacttaaaatggaaa

SEQ ID NO: 665474 - DNA, 22 bp, Artificial Sequence
  chemically synthesized
aacactataacatgtttccatt

SEQ ID NO: 665475 - DNA, 22 bp, Artificial Sequence
  chemically synthesized
aaacactataacatgtttccat

SEQ ID NO: 665476 - DNA, 22 bp, Artificial Sequence
  chemically synthesized
aacacttaaaatggaaacatgt

SEQ ID NO: 665477 - DNA, 22 bp, Artificial Sequence
  chemically synthesized
aaaatggaaacatgttatagtg

SEQ ID NO: 665478 - DNA, 22 bp, Artificial Sequence
  chemically synthesized
aaatggaaacatgttatagtgt

SEQ ID NO: 665479 - DNA, 22 bp, Artificial Sequence
  chemically synthesized
tcagggcataatttaaacacta

SEQ ID NO: 665480 - DNA, 22 bp, Artificial Sequence
  chemically synthesized
atcagggcataatttaaacact

SEQ ID NO: 665481 - DNA, 22 bp, Artificial Sequence
  chemically synthesized
ccttatcagggcataatttaaa

SEQ ID NO: 665482 - DNA, 22 bp, Artificial Sequence
  chemically synthesized
accttatcagggcataatttaa

SEQ ID NO: 665483 - DNA, 22 bp, Artificial Sequence
  chemically synthesized
tagtgtttaaattatgccctga

SEQ ID NO: 665484 - DNA, 22 bp, Artificial Sequence
  chemically synthesized
aaatttaccttatcagggcata

SEQ ID NO: 665485 - DNA, 22 bp, Artificial Sequence
  chemically synthesized
aaaatttaccttatcagggcat

SEQ ID NO: 665486 - DNA, 22 bp, Artificial Sequence
  chemically synthesized
ttaaaatttaccttatcagggc

SEQ ID NO: 665487 - DNA, 22 bp, Artificial Sequence
  chemically synthesized
aaattatgccctgataaggtaa

SEQ ID NO: 665488 - DNA, 22 bp, Artificial Sequence
  chemically synthesized
aattatgccctgataaggtaaa

SEQ ID NO: 665489 - DNA, 22 bp, Artificial Sequence
  chemically synthesized
aagactcttaaaatttacctta

SEQ ID NO: 665490 - DNA, 22 bp, Artificial Sequence
  chemically synthesized
aaagactcttaaaatttacctt

SEQ ID NO: 665491 - DNA, 22 bp, Artificial Sequence
  chemically synthesized
taaagactcttaaaatttacct

SEQ ID NO: 665492 - DNA, 22 bp, Artificial Sequence
  chemically synthesized
ttaaagactcttaaaatttacc

SEQ ID NO: 665493 - DNA, 22 bp, Artificial Sequence
  chemically synthesized
tgccctgataaggtaaatttta

SEQ ID NO: 665494 - DNA, 22 bp, Artificial Sequence
  chemically synthesized
ataaggtaaattttaagagtct

SEQ ID NO: 665495 - DNA, 22 bp, Artificial Sequence
  chemically synthesized
atgtgagggtttttaaagactc

SEQ ID NO: 665496 - DNA, 22 bp, Artificial Sequence
  chemically synthesized
ttcatgtgagggtttttaaaga

SEQ ID NO: 665497 - DNA, 22 bp, Artificial Sequence
  chemically synthesized
taagagtctttaaaaaccctca

SEQ ID NO: 665498 - DNA, 22 bp, Artificial Sequence
  chemically synthesized
aagagtctttaaaaaccctcac

SEQ ID NO: 665499 - DNA, 22 bp, Artificial Sequence
  chemically synthesized
agagtctttaaaaaccctcaca

SEQ ID NO: 665500 - DNA, 22 bp, Artificial Sequence
  chemically synthesized
taaaaaccctcacatgaacagt

SEQ ID NO: 665501 - DNA, 22 bp, Artificial Sequence
  chemically synthesized
aaaaaccctcacatgaacagta

SEQ ID NO: 665502 - DNA, 22 bp, Artificial Sequence
  chemically synthesized
aaaaccctcacatgaacagtac

SEQ ID NO: 665503 - DNA, 22 bp, Artificial Sequence
  chemically synthesized
acacacacatacatcagagtgt

SEQ ID NO: 665504 - DNA, 22 bp, Artificial Sequence
  chemically synthesized
acatgaacagtacactctgatg

SEQ ID NO: 665505 - DNA, 22 bp, Artificial Sequence
  chemically synthesized
agctaacacacacatacatcag

SEQ ID NO: 665506 - DNA, 22 bp, Artificial Sequence
  chemically synthesized
aagctaacacacacatacatca

SEQ ID NO: 665507 - DNA, 22 bp, Artificial Sequence
  chemically synthesized
cagtgtagcttaagctaacaca

SEQ ID NO: 665508 - DNA, 22 bp, Artificial Sequence
  chemically synthesized
tgatgtatgtgtgtgttagctt

SEQ ID NO: 665509 - DNA, 22 bp, Artificial Sequence
  chemically synthesized
tacagtgtagcttaagctaaca

SEQ ID NO: 665510 - DNA, 22 bp, Artificial Sequence
  chemically synthesized
atgtatgtgtgtgttagcttaa

SEQ ID NO: 665511 - DNA, 22 bp, Artificial Sequence
  chemically synthesized
accacctctacagtgtagctta

SEQ ID NO: 665512 - DNA, 22 bp, Artificial Sequence
  chemically synthesized
gcttaagctacactgtagaggt

SEQ ID NO: 665513 - DNA, 22 bp, Artificial Sequence
  chemically synthesized
agacaactgaccacctctacag

SEQ ID NO: 665514 - DNA, 22 bp, Artificial Sequence
  chemically synthesized
aagctacactgtagaggtggtc

SEQ ID NO: 665515 - DNA, 22 bp, Artificial Sequence
  chemically synthesized
attaagacaactgaccacctct

SEQ ID NO: 665516 - DNA, 22 bp, Artificial Sequence
  chemically synthesized
agctacactgtagaggtggtca

SEQ ID NO: 665517 - DNA, 22 bp, Artificial Sequence
  chemically synthesized
ctgattaagacaactgaccacc

SEQ ID NO: 665518 - DNA, 22 bp, Artificial Sequence
  chemically synthesized
cactgtagaggtggtcagttgt

SEQ ID NO: 665519 - DNA, 22 bp, Artificial Sequence
  chemically synthesized
actcctgattaagacaactgac

SEQ ID NO: 665520 - DNA, 22 bp, Artificial Sequence
  chemically synthesized
tagaggtggtcagttgtcttaa

SEQ ID NO: 665521 - DNA, 22 bp, Artificial Sequence
  chemically synthesized
gagttcactcctgattaagaca

SEQ ID NO: 665522 - DNA, 22 bp, Artificial Sequence
  chemically synthesized
ggagttcactcctgattaagac

SEQ ID NO: 665523 - DNA, 22 bp, Artificial Sequence
  chemically synthesized
tcttaatcaggagtgaactcca

SEQ ID NO: 665524 - DNA, 22 bp, Artificial Sequence
  chemically synthesized
gccaaccacccttggagttcac

SEQ ID NO: 665525 - DNA, 22 bp, Artificial Sequence
  chemically synthesized
ctagccaaccacccttggagtt

SEQ ID NO: 665526 - DNA, 22 bp, Artificial Sequence
  chemically synthesized
aatcaggagtgaactccaaggg

SEQ ID NO: 665527 - DNA, 22 bp, Artificial Sequence
  chemically synthesized
atcaggagtgaactccaagggt

SEQ ID NO: 665528 - DNA, 22 bp, Artificial Sequence
  chemically synthesized
attgctagccaaccacccttgg

SEQ ID NO: 665529 - DNA, 22 bp, Artificial Sequence
  chemically synthesized
attaattgctagccaaccaccc

SEQ ID NO: 665530 - DNA, 22 bp, Artificial Sequence
  chemically synthesized
gattaattgctagccaaccacc

SEQ ID NO: 665531 - DNA, 22 bp, Artificial Sequence
  chemically synthesized
tgattaattgctagccaaccac

SEQ ID NO: 665532 - DNA, 22 bp, Artificial Sequence
  chemically synthesized
ttgattaattgctagccaacca

SEQ ID NO: 665533 - DNA, 22 bp, Artificial Sequence
  chemically synthesized
tttgattaattgctagccaacc

SEQ ID NO: 665534 - DNA, 22 bp, Artificial Sequence
  chemically synthesized
caagggtggttggctagcaatt

SEQ ID NO: 665535 - DNA, 22 bp, Artificial Sequence
  chemically synthesized
tggcatgaggctttttgattaa

SEQ ID NO: 665536 - DNA, 22 bp, Artificial Sequence
  chemically synthesized
gctagcaattaatcaaaaagcc

SEQ ID NO: 665537 - DNA, 22 bp, Artificial Sequence
  chemically synthesized
gcaattaatcaaaaagcctcat

SEQ ID NO: 665538 - DNA, 22 bp, Artificial Sequence
  chemically synthesized
cagtggccgcctgtggcatgag

SEQ ID NO: 665539 - DNA, 22 bp, Artificial Sequence
  chemically synthesized
acagtggccgcctgtggcatga

SEQ ID NO: 665540 - DNA, 22 bp, Artificial Sequence
  chemically synthesized
atcaaaaagcctcatgccacag

SEQ ID NO: 665541 - DNA, 22 bp, Artificial Sequence
  chemically synthesized
aatcacttacagtggccgcctg

SEQ ID NO: 665542 - DNA, 22 bp, Artificial Sequence
  chemically synthesized
atgccacaggcggccactgtaa

SEQ ID NO: 665543 - DNA, 22 bp, Artificial Sequence
  chemically synthesized
aatataactgaatcacttacag

SEQ ID NO: 665544 - DNA, 22 bp, Artificial Sequence
  chemically synthesized
taagtgattcagttatatttag

SEQ ID NO: 665545 - DNA, 22 bp, Artificial Sequence
  chemically synthesized
gtgtaataagagctaaatataa

SEQ ID NO: 665546 - DNA, 22 bp, Artificial Sequence
  chemically synthesized
agttatatttagctcttattac

SEQ ID NO: 665547 - DNA, 22 bp, Artificial Sequence
  chemically synthesized
atgaaacccctggtgtaataag

SEQ ID NO: 665548 - DNA, 22 bp, Artificial Sequence
  chemically synthesized
tatttagctcttattacaccag

SEQ ID NO: 665549 - DNA, 22 bp, Artificial Sequence
  chemically synthesized
agctcttattacaccaggggtt

SEQ ID NO: 665550 - DNA, 22 bp, Artificial Sequence
  chemically synthesized
gctcttattacaccaggggttt

SEQ ID NO: 665551 - DNA, 22 bp, Artificial Sequence
  chemically synthesized
ggaaaattaatgaaacccctgg

SEQ ID NO: 665552 - DNA, 22 bp, Artificial Sequence
  chemically synthesized
ttattacaccaggggtttcatt

SEQ ID NO: 665553 - DNA, 22 bp, Artificial Sequence
  chemically synthesized
attaggaaaattaatgaaaccc

SEQ ID NO: 665554 - DNA, 22 bp, Artificial Sequence
  chemically synthesized
attacaccaggggtttcattaa

SEQ ID NO: 665555 - DNA, 22 bp, Artificial Sequence
  chemically synthesized
ttacaccaggggtttcattaat

SEQ ID NO: 665556 - DNA, 22 bp, Artificial Sequence
  chemically synthesized
ttaattaggaaaattaatgaaa

SEQ ID NO: 665557 - DNA, 22 bp, Artificial Sequence
  chemically synthesized
caccaggggtttcattaatttt

SEQ ID NO: 665558 - DNA, 22 bp, Artificial Sequence
  chemically synthesized
actattaattaggaaaattaat

SEQ ID NO: 665559 - DNA, 22 bp, Artificial Sequence
  chemically synthesized
cattaattttcctaattaatag

SEQ ID NO: 665560 - DNA, 22 bp, Artificial Sequence
  chemically synthesized
attaattttcctaattaatagt

SEQ ID NO: 665561 - DNA, 22 bp, Artificial Sequence
  chemically synthesized
cacaggcccgtctaactattaa

SEQ ID NO: 665562 - DNA, 22 bp, Artificial Sequence
  chemically synthesized
attttcctaattaatagttaga

SEQ ID NO: 665563 - DNA, 22 bp, Artificial Sequence
  chemically synthesized
tcctaattaatagttagacggg

SEQ ID NO: 665564 - DNA, 22 bp, Artificial Sequence
  chemically synthesized
cctaattaatagttagacgggc

SEQ ID NO: 665565 - DNA, 22 bp, Artificial Sequence
  chemically synthesized
ctaattaatagttagacgggcc

SEQ ID NO: 665566 - DNA, 22 bp, Artificial Sequence
  chemically synthesized
atatcactacacaggcccgtct

SEQ ID NO: 665567 - DNA, 22 bp, Artificial Sequence
  chemically synthesized
attaatagttagacgggcctgt

SEQ ID NO: 665568 - DNA, 22 bp, Artificial Sequence
  chemically synthesized
atagttagacgggcctgtgtag

SEQ ID NO: 665569 - DNA, 22 bp, Artificial Sequence
  chemically synthesized
caaaccactaatatcactacac

SEQ ID NO: 665570 - DNA, 22 bp, Artificial Sequence
  chemically synthesized
gcaaaccactaatatcactaca

SEQ ID NO: 665571 - DNA, 22 bp, Artificial Sequence
  chemically synthesized
tgcaaaccactaatatcactac

SEQ ID NO: 665572 - DNA, 22 bp, Artificial Sequence
  chemically synthesized
gacgggcctgtgtagtgatatt

SEQ ID NO: 665573 - DNA, 22 bp, Artificial Sequence
  chemically synthesized
atattttgcaaaccactaatat

SEQ ID NO: 665574 - DNA, 22 bp, Artificial Sequence
  chemically synthesized
catattttgcaaaccactaata

SEQ ID NO: 665575 - DNA, 22 bp, Artificial Sequence
  chemically synthesized
tgtagtgatattagtggtttgc

SEQ ID NO: 665576 - DNA, 22 bp, Artificial Sequence
  chemically synthesized
aacaatcttcatattttgcaaa

SEQ ID NO: 665577 - DNA, 22 bp, Artificial Sequence
  chemically synthesized
caacaatcttcatattttgcaa

SEQ ID NO: 665578 - DNA, 22 bp, Artificial Sequence
  chemically synthesized
tcaacaatcttcatattttgca

SEQ ID NO: 665579 - DNA, 22 bp, Artificial Sequence
  chemically synthesized
ttcaacaatcttcatattttgc

SEQ ID NO: 665580 - DNA, 22 bp, Artificial Sequence
  chemically synthesized
gtggtttgcaaaatatgaagat

SEQ ID NO: 665581 - DNA, 22 bp, Artificial Sequence
  chemically synthesized
aatgtttttcaacaatcttcat

SEQ ID NO: 665582 - DNA, 22 bp, Artificial Sequence
  chemically synthesized
taaatgtttttcaacaatcttc

SEQ ID NO: 665583 - DNA, 22 bp, Artificial Sequence
  chemically synthesized
ctaaatgtttttcaacaatctt

SEQ ID NO: 665584 - DNA, 22 bp, Artificial Sequence
  chemically synthesized
gcaaaatatgaagattgttgaa

SEQ ID NO: 665585 - DNA, 22 bp, Artificial Sequence
  chemically synthesized
caaaatatgaagattgttgaaa

SEQ ID NO: 665586 - DNA, 22 bp, Artificial Sequence
  chemically synthesized
aaggcagggagtgtttctaaat

SEQ ID NO: 665587 - DNA, 22 bp, Artificial Sequence
  chemically synthesized
aaaggcagggagtgtttctaaa

SEQ ID NO: 665588 - DNA, 22 bp, Artificial Sequence
  chemically synthesized
ttgaaaaacatttagaaacact

SEQ ID NO: 665589 - DNA, 22 bp, Artificial Sequence
  chemically synthesized
aaaaacatttagaaacactccc

SEQ ID NO: 665590 - DNA, 22 bp, Artificial Sequence
  chemically synthesized
aatttaaaggcagggagtgttt

SEQ ID NO: 665591 - DNA, 22 bp, Artificial Sequence
  chemically synthesized
aactcaatttaaaggcagggag

SEQ ID NO: 665592 - DNA, 22 bp, Artificial Sequence
  chemically synthesized
aaactcaatttaaaggcaggga

SEQ ID NO: 665593 - DNA, 22 bp, Artificial Sequence
  chemically synthesized
ttaaactcaatttaaaggcagg

SEQ ID NO: 665594 - DNA, 22 bp, Artificial Sequence
  chemically synthesized
cttaaactcaatttaaaggcag

SEQ ID NO: 665595 - DNA, 22 bp, Artificial Sequence
  chemically synthesized
agaaacactccctgcctttaaa

SEQ ID NO: 665596 - DNA, 22 bp, Artificial Sequence
  chemically synthesized
gaaacactccctgcctttaaat

SEQ ID NO: 665597 - DNA, 22 bp, Artificial Sequence
  chemically synthesized
ttcttaaactcaatttaaaggc

SEQ ID NO: 665598 - DNA, 22 bp, Artificial Sequence
  chemically synthesized
gattcttcttaaactcaattta

SEQ ID NO: 665599 - DNA, 22 bp, Artificial Sequence
  chemically synthesized
ctggattcttcttaaactcaat

SEQ ID NO: 665600 - DNA, 22 bp, Artificial Sequence
  chemically synthesized
cctgcctttaaattgagtttaa

SEQ ID NO: 665601 - DNA, 22 bp, Artificial Sequence
  chemically synthesized
cctttaaattgagtttaagaag

SEQ ID NO: 665602 - DNA, 22 bp, Artificial Sequence
  chemically synthesized
taaattgagtttaagaagaatc

SEQ ID NO: 665603 - DNA, 22 bp, Artificial Sequence
  chemically synthesized
aaattgagtttaagaagaatcc

SEQ ID NO: 665604 - DNA, 22 bp, Artificial Sequence
  chemically synthesized
aattgagtttaagaagaatcca

SEQ ID NO: 665605 - DNA, 22 bp, Artificial Sequence
  chemically synthesized
aagatggagaacctactggatt

SEQ ID NO: 665606 - DNA, 22 bp, Artificial Sequence
  chemically synthesized
agtttaagaagaatccagtagg

SEQ ID NO: 665607 - DNA, 22 bp, Artificial Sequence
  chemically synthesized
taaagatggagaacctactgga

SEQ ID NO: 665608 - DNA, 22 bp, Artificial Sequence
  chemically synthesized
ctaaagatggagaacctactgg

SEQ ID NO: 665609 - DNA, 22 bp, Artificial Sequence
  chemically synthesized
aagaagaatccagtaggttctc

SEQ ID NO: 665610 - DNA, 22 bp, Artificial Sequence
  chemically synthesized
agaagaatccagtaggttctcc

SEQ ID NO: 665611 - DNA, 22 bp, Artificial Sequence
  chemically synthesized
gggcaccatttctaaagatgga

SEQ ID NO: 665612 - DNA, 22 bp, Artificial Sequence
  chemically synthesized
agcctagggcaccatttctaaa

SEQ ID NO: 665613 - DNA, 22 bp, Artificial Sequence
  chemically synthesized
tccatctttagaaatggtgccc

SEQ ID NO: 665614 - DNA, 22 bp, Artificial Sequence
  chemically synthesized
gaattcagcctagggcaccatt

SEQ ID NO: 665615 - DNA, 22 bp, Artificial Sequence
  chemically synthesized
ggaattcagcctagggcaccat

SEQ ID NO: 665616 - DNA, 22 bp, Artificial Sequence
  chemically synthesized
catctttagaaatggtgcccta

SEQ ID NO: 665617 - DNA, 22 bp, Artificial Sequence
  chemically synthesized
tggaattcagcctagggcacca

SEQ ID NO: 665618 - DNA, 22 bp, Artificial Sequence
  chemically synthesized
tagaaatggtgccctaggctga

SEQ ID NO: 665619 - DNA, 22 bp, Artificial Sequence
  chemically synthesized
agaaatggtgccctaggctgaa

SEQ ID NO: 665620 - DNA, 22 bp, Artificial Sequence
  chemically synthesized
gacattttggaattcagcctag

SEQ ID NO: 665621 - DNA, 22 bp, Artificial Sequence
  chemically synthesized
gaaatggtgccctaggctgaat

SEQ ID NO: 665622 - DNA, 22 bp, Artificial Sequence
  chemically synthesized
ggctgaattccaaaatgtccag

SEQ ID NO: 665623 - DNA, 22 bp, Artificial Sequence
  chemically synthesized
aattccaaaatgtccagctgtg

SEQ ID NO: 665624 - DNA, 22 bp, Artificial Sequence
  chemically synthesized
agaatccggtgaaccacagctg

SEQ ID NO: 665625 - DNA, 22 bp, Artificial Sequence
  chemically synthesized
caaaatgtccagctgtggttca

SEQ ID NO: 665626 - DNA, 22 bp, Artificial Sequence
  chemically synthesized
gcaactaagaatccggtgaacc

SEQ ID NO: 665627 - DNA, 22 bp, Artificial Sequence
  chemically synthesized
tggcaactaagaatccggtgaa

SEQ ID NO: 665628 - DNA, 22 bp, Artificial Sequence
  chemically synthesized
aattctggcaactaagaatccg

SEQ ID NO: 665629 - DNA, 22 bp, Artificial Sequence
  chemically synthesized
tggttcaccggattcttagttg

SEQ ID NO: 665630 - DNA, 22 bp, Artificial Sequence
  chemically synthesized
actgaattctggcaactaagaa

SEQ ID NO: 665631 - DNA, 22 bp, Artificial Sequence
  chemically synthesized
accggattcttagttgccagaa

SEQ ID NO: 665632 - DNA, 22 bp, Artificial Sequence
  chemically synthesized
aaccatctaactgaattctggc

SEQ ID NO: 665633 - DNA, 22 bp, Artificial Sequence
  chemically synthesized
cctcaaccatctaactgaattc

SEQ ID NO: 665634 - DNA, 22 bp, Artificial Sequence
  chemically synthesized
ttagttgccagaattcagttag

SEQ ID NO: 665635 - DNA, 22 bp, Artificial Sequence
  chemically synthesized
agttgccagaattcagttagat

SEQ ID NO: 665636 - DNA, 22 bp, Artificial Sequence
  chemically synthesized
gttgccagaattcagttagatg

SEQ ID NO: 665637 - DNA, 22 bp, Artificial Sequence
  chemically synthesized
ccagaattcagttagatggttg

SEQ ID NO: 665638 - DNA, 22 bp, Artificial Sequence
  chemically synthesized
gcagcaggattccctcaaccat

SEQ ID NO: 665639 - DNA, 22 bp, Artificial Sequence
  chemically synthesized
tagcagcaggattccctcaacc

SEQ ID NO: 665640 - DNA, 22 bp, Artificial Sequence
  chemically synthesized
ttctagcagcaggattccctca

SEQ ID NO: 665641 - DNA, 22 bp, Artificial Sequence
  chemically synthesized
agttagatggttgagggaatcc

SEQ ID NO: 665642 - DNA, 22 bp, Artificial Sequence
  chemically synthesized
gatggttgagggaatcctgctg

SEQ ID NO: 665643 - DNA, 22 bp, Artificial Sequence
  chemically synthesized
aaaaccattgttctagcagcag

SEQ ID NO: 665644 - DNA, 22 bp, Artificial Sequence
  chemically synthesized
agggaatcctgctgctagaaca

SEQ ID NO: 665645 - DNA, 22 bp, Artificial Sequence
  chemically synthesized
aagtctgaaaaccattgttcta

SEQ ID NO: 665646 - DNA, 22 bp, Artificial Sequence
  chemically synthesized
ctcaagtctgaaaaccattgtt

SEQ ID NO: 665647 - DNA, 22 bp, Artificial Sequence
  chemically synthesized
gctcaagtctgaaaaccattgt

SEQ ID NO: 665648 - DNA, 22 bp, Artificial Sequence
  chemically synthesized
ctgctagaacaatggttttcag

SEQ ID NO: 665649 - DNA, 22 bp, Artificial Sequence
  chemically synthesized
atgtttgctcaagtctgaaaac

SEQ ID NO: 665650 - DNA, 22 bp, Artificial Sequence
  chemically synthesized
ctagaacaatggttttcagact

SEQ ID NO: 665651 - DNA, 22 bp, Artificial Sequence
  chemically synthesized
tgatgtttgctcaagtctgaaa

SEQ ID NO: 665652 - DNA, 22 bp, Artificial Sequence
  chemically synthesized
gaacaatggttttcagacttga

SEQ ID NO: 665653 - DNA, 22 bp, Artificial Sequence
  chemically synthesized
caggtgattctgatgtttgctc

SEQ ID NO: 665654 - DNA, 22 bp, Artificial Sequence
  chemically synthesized
tcagacttgagcaaacatcaga

SEQ ID NO: 665655 - DNA, 22 bp, Artificial Sequence
  chemically synthesized
cagacttgagcaaacatcagaa

SEQ ID NO: 665656 - DNA, 22 bp, Artificial Sequence
  chemically synthesized
agacttgagcaaacatcagaat

SEQ ID NO: 665657 - DNA, 22 bp, Artificial Sequence
  chemically synthesized
tccactccaggtgattctgatg

SEQ ID NO: 665658 - DNA, 22 bp, Artificial Sequence
  chemically synthesized
gagcaaacatcagaatcacctg

SEQ ID NO: 665659 - DNA, 22 bp, Artificial Sequence
  chemically synthesized
aactatccactccaggtgattc

SEQ ID NO: 665660 - DNA, 22 bp, Artificial Sequence
  chemically synthesized
agcaaacatcagaatcacctgg

SEQ ID NO: 665661 - DNA, 22 bp, Artificial Sequence
  chemically synthesized
aaactatccactccaggtgatt

SEQ ID NO: 665662 - DNA, 22 bp, Artificial Sequence
  chemically synthesized
taaactatccactccaggtgat

SEQ ID NO: 665663 - DNA, 22 bp, Artificial Sequence
  chemically synthesized
catctttaaactatccactcca

SEQ ID NO: 665664 - DNA, 22 bp, Artificial Sequence
  chemically synthesized
ggaaatctgcatctttaaacta

SEQ ID NO: 665665 - DNA, 22 bp, Artificial Sequence
  chemically synthesized
gagtggatagtttaaagatgca

SEQ ID NO: 665666 - DNA, 22 bp, Artificial Sequence
  chemically synthesized
gaggtggggcctaggaaatctg

SEQ ID NO: 665667 - DNA, 22 bp, Artificial Sequence
  chemically synthesized
aaagatgcagatttcctaggcc

SEQ ID NO: 665668 - DNA, 22 bp, Artificial Sequence
  chemically synthesized
aagatgcagatttcctaggccc

SEQ ID NO: 665669 - DNA, 22 bp, Artificial Sequence
  chemically synthesized
gaaaatctggaggtggggccta

SEQ ID NO: 665670 - DNA, 22 bp, Artificial Sequence
  chemically synthesized
aattagaaaatctggaggtggg

SEQ ID NO: 665671 - DNA, 22 bp, Artificial Sequence
  chemically synthesized
ctgaattagaaaatctggaggt

SEQ ID NO: 665672 - DNA, 22 bp, Artificial Sequence
  chemically synthesized
cctaggccccacctccagattt

SEQ ID NO: 665673 - DNA, 22 bp, Artificial Sequence
  chemically synthesized
ctaggccccacctccagatttt

SEQ ID NO: 665674 - DNA, 22 bp, Artificial Sequence
  chemically synthesized
ggccccacctccagattttcta

SEQ ID NO: 665675 - DNA, 22 bp, Artificial Sequence
  chemically synthesized
ccatacctactgaattagaaaa

SEQ ID NO: 665676 - DNA, 22 bp, Artificial Sequence
  chemically synthesized
cccatacctactgaattagaaa

SEQ ID NO: 665677 - DNA, 22 bp, Artificial Sequence
  chemically synthesized
cagattttctaattcagtaggt

SEQ ID NO: 665678 - DNA, 22 bp, Artificial Sequence
  chemically synthesized
ccaggcccttcccatacctact

SEQ ID NO: 665679 - DNA, 22 bp, Artificial Sequence
  chemically synthesized
tctaattcagtaggtatgggaa

SEQ ID NO: 665680 - DNA, 22 bp, Artificial Sequence
  chemically synthesized
ctaattcagtaggtatgggaag

SEQ ID NO: 665681 - DNA, 22 bp, Artificial Sequence
  chemically synthesized
taattcagtaggtatgggaagg

SEQ ID NO: 665682 - DNA, 22 bp, Artificial Sequence
  chemically synthesized
agattcccaggcccttcccata

SEQ ID NO: 665683 - DNA, 22 bp, Artificial Sequence
  chemically synthesized
attcagtaggtatgggaagggc

SEQ ID NO: 665684 - DNA, 22 bp, Artificial Sequence
  chemically synthesized
agtaggtatgggaagggcctgg

SEQ ID NO: 665685 - DNA, 22 bp, Artificial Sequence
  chemically synthesized
gaaattcagattcccaggccct

SEQ ID NO: 665686 - DNA, 22 bp, Artificial Sequence
  chemically synthesized
ctagaaattcagattcccaggc

SEQ ID NO: 665687 - DNA, 22 bp, Artificial Sequence
  chemically synthesized
gctagaaattcagattcccagg

SEQ ID NO: 665688 - DNA, 22 bp, Artificial Sequence
  chemically synthesized
gaaacttgctagaaattcagat

SEQ ID NO: 665689 - DNA, 22 bp, Artificial Sequence
  chemically synthesized
ggaatctgaatttctagcaagt

SEQ ID NO: 665690 - DNA, 22 bp, Artificial Sequence
  chemically synthesized
aatttctagcaagtttccaggt

SEQ ID NO: 665691 - DNA, 22 bp, Artificial Sequence
  chemically synthesized
ctagcaagtttccaggtgatgc

SEQ ID NO: 665692 - DNA, 22 bp, Artificial Sequence
  chemically synthesized
tagcaagtttccaggtgatgct

SEQ ID NO: 665693 - DNA, 22 bp, Artificial Sequence
  chemically synthesized
gaccagcagcatcagcatcacc

SEQ ID NO: 665694 - DNA, 22 bp, Artificial Sequence
  chemically synthesized
gcaagtttccaggtgatgctga

SEQ ID NO: 665695 - DNA, 22 bp, Artificial Sequence
  chemically synthesized
ccaggtgatgctgatgctgctg

SEQ ID NO: 665696 - DNA, 22 bp, Artificial Sequence
  chemically synthesized
caggtgatgctgatgctgctgg

SEQ ID NO: 665697 - DNA, 22 bp, Artificial Sequence
  chemically synthesized
aaagtgtggtccctggaccagc

SEQ ID NO: 665698 - DNA, 22 bp, Artificial Sequence
  chemically synthesized
tcaaagtgtggtccctggacca

SEQ ID NO: 665699 - DNA, 22 bp, Artificial Sequence
  chemically synthesized
atgctgctggtccagggaccac

SEQ ID NO: 665700 - DNA, 22 bp, Artificial Sequence
  chemically synthesized
gagtggttctcaaagtgtggtc

SEQ ID NO: 665701 - DNA, 22 bp, Artificial Sequence
  chemically synthesized
ctggtccagggaccacactttg

SEQ ID NO: 665702 - DNA, 22 bp, Artificial Sequence
  chemically synthesized
ttagagtggttctcaaagtgtg

SEQ ID NO: 665703 - DNA, 22 bp, Artificial Sequence
  chemically synthesized
gtccagggaccacactttgaga

SEQ ID NO: 665704 - DNA, 22 bp, Artificial Sequence
  chemically synthesized
tattagagtggttctcaaagtg

SEQ ID NO: 665705 - DNA, 22 bp, Artificial Sequence
  chemically synthesized
tgagaaccactctaatagagga

SEQ ID NO: 665706 - DNA, 22 bp, Artificial Sequence
  chemically synthesized
cacaggccacagtcctctatta

SEQ ID NO: 665707 - DNA, 22 bp, Artificial Sequence
  chemically synthesized
gagaaccactctaatagaggac

SEQ ID NO: 665708 - DNA, 22 bp, Artificial Sequence
  chemically synthesized
agaaccactctaatagaggact

SEQ ID NO: 665709 - DNA, 22 bp, Artificial Sequence
  chemically synthesized
acagtctacacaggccacagtc

SEQ ID NO: 665710 - DNA, 22 bp, Artificial Sequence
  chemically synthesized
taatagaggactgtggcctgtg

SEQ ID NO: 665711 - DNA, 22 bp, Artificial Sequence
  chemically synthesized
atagaggactgtggcctgtgta

SEQ ID NO: 665712 - DNA, 22 bp, Artificial Sequence
  chemically synthesized
gtgtgagaggctcacagtctac

SEQ ID NO: 665713 - DNA, 22 bp, Artificial Sequence
  chemically synthesized
ggtgtgagaggctcacagtcta

SEQ ID NO: 665714 - DNA, 22 bp, Artificial Sequence
  chemically synthesized
tggcctgtgtagactgtgagcc

SEQ ID NO: 665715 - DNA, 22 bp, Artificial Sequence
  chemically synthesized
gggtgcttggtgtgagaggctc

SEQ ID NO: 665716 - DNA, 22 bp, Artificial Sequence
  chemically synthesized
ggggtgcttggtgtgagaggct

SEQ ID NO: 665717 - DNA, 22 bp, Artificial Sequence
  chemically synthesized
tgtagactgtgagcctctcaca

SEQ ID NO: 665718 - DNA, 22 bp, Artificial Sequence
  chemically synthesized
tggggtgcttggtgtgagaggc

SEQ ID NO: 665719 - DNA, 22 bp, Artificial Sequence
  chemically synthesized
ttggggtgcttggtgtgagagg

SEQ ID NO: 665720 - DNA, 22 bp, Artificial Sequence
  chemically synthesized
tcttttggggtgcttggtgtga

SEQ ID NO: 665721 - DNA, 22 bp, Artificial Sequence
  chemically synthesized
tgtcttttggggtgcttggtgt

SEQ ID NO: 665722 - DNA, 22 bp, Artificial Sequence
  chemically synthesized
tgagcctctcacaccaagcacc

SEQ ID NO: 665723 - DNA, 22 bp, Artificial Sequence
  chemically synthesized
tcacaccaagcaccccaaaaga

SEQ ID NO: 665724 - DNA, 22 bp, Artificial Sequence
  chemically synthesized
acaccaagcaccccaaaagaca

SEQ ID NO: 665725 - DNA, 22 bp, Artificial Sequence
  chemically synthesized
tgccagagacacagtgaagtca

SEQ ID NO: 665726 - DNA, 22 bp, Artificial Sequence
  chemically synthesized
cagcctgtgccagagacacagt

SEQ ID NO: 665727 - DNA, 22 bp, Artificial Sequence
  chemically synthesized
acagcctgtgccagagacacag

SEQ ID NO: 665728 - DNA, 22 bp, Artificial Sequence
  chemically synthesized
tgacttcactgtgtctctggca

SEQ ID NO: 665729 - DNA, 22 bp, Artificial Sequence
  chemically synthesized
cactgtgtctctggcacaggct

SEQ ID NO: 665730 - DNA, 22 bp, Artificial Sequence
  chemically synthesized
actgtgtctctggcacaggctg

SEQ ID NO: 665731 - DNA, 22 bp, Artificial Sequence
  chemically synthesized
tgtctctggcacaggctgtaag

SEQ ID NO: 665732 - DNA, 22 bp, Artificial Sequence
  chemically synthesized
tggcacaggctgtaagattgtt

SEQ ID NO: 665733 - DNA, 22 bp, Artificial Sequence
  chemically synthesized
gcacaggctgtaagattgtttt

SEQ ID NO: 665734 - DNA, 22 bp, Artificial Sequence
  chemically synthesized
gccaatgggtacaaaacaatct

SEQ ID NO: 665735 - DNA, 22 bp, Artificial Sequence
  chemically synthesized
ttagccaatgggtacaaaacaa

SEQ ID NO: 665736 - DNA, 22 bp, Artificial Sequence
  chemically synthesized
attagccaatgggtacaaaaca

SEQ ID NO: 665737 - DNA, 22 bp, Artificial Sequence
  chemically synthesized
taagattgttttgtacccattg

SEQ ID NO: 665738 - DNA, 22 bp, Artificial Sequence
  chemically synthesized
ggagcatttattagccaatggg

SEQ ID NO: 665739 - DNA, 22 bp, Artificial Sequence
  chemically synthesized
aggagcatttattagccaatgg

SEQ ID NO: 665740 - DNA, 22 bp, Artificial Sequence
  chemically synthesized
ttttgtacccattggctaataa

SEQ ID NO: 665741 - DNA, 22 bp, Artificial Sequence
  chemically synthesized
tcacttaggagcatttattagc

SEQ ID NO: 665742 - DNA, 22 bp, Artificial Sequence
  chemically synthesized
tgtacccattggctaataaatg

SEQ ID NO: 665743 - DNA, 22 bp, Artificial Sequence
  chemically synthesized
gtacccattggctaataaatgc

SEQ ID NO: 665744 - DNA, 22 bp, Artificial Sequence
  chemically synthesized
tgtcacttaggagcatttatta

SEQ ID NO: 665745 - DNA, 22 bp, Artificial Sequence
  chemically synthesized
tacccattggctaataaatgct

SEQ ID NO: 665746 - DNA, 22 bp, Artificial Sequence
  chemically synthesized
gctaataaatgctcctaagtga

SEQ ID NO: 665747 - DNA, 22 bp, Artificial Sequence
  chemically synthesized
agtacaagttctgtcacttagg

SEQ ID NO: 665748 - DNA, 22 bp, Artificial Sequence
  chemically synthesized
ataaatgctcctaagtgacaga

SEQ ID NO: 665749 - DNA, 22 bp, Artificial Sequence
  chemically synthesized
ctaagtgacagaacttgtactg

SEQ ID NO: 665750 - DNA, 22 bp, Artificial Sequence
  chemically synthesized
agtgacagaacttgtactgaga

SEQ ID NO: 665751 - DNA, 22 bp, Artificial Sequence
  chemically synthesized
taaagaaagcaagtctcagtac

SEQ ID NO: 665752 - DNA, 22 bp, Artificial Sequence
  chemically synthesized
ccaggttataaagaaagcaagt

SEQ ID NO: 665753 - DNA, 22 bp, Artificial Sequence
  chemically synthesized
gtactgagacttgctttcttta

SEQ ID NO: 665754 - DNA, 22 bp, Artificial Sequence
  chemically synthesized
tactgagacttgctttctttat

SEQ ID NO: 665755 - DNA, 22 bp, Artificial Sequence
  chemically synthesized
ggctgccaggttataaagaaag

SEQ ID NO: 665756 - DNA, 22 bp, Artificial Sequence
  chemically synthesized
tcggctgccaggttataaagaa

SEQ ID NO: 665757 - DNA, 22 bp, Artificial Sequence
  chemically synthesized
agacttgctttctttataacct

SEQ ID NO: 665758 - DNA, 22 bp, Artificial Sequence
  chemically synthesized
cctctcggctgccaggttataa

SEQ ID NO: 665759 - DNA, 22 bp, Artificial Sequence
  chemically synthesized
actacctctcggctgccaggtt

SEQ ID NO: 665760 - DNA, 22 bp, Artificial Sequence
  chemically synthesized
gctttctttataacctggcagc

SEQ ID NO: 665761 - DNA, 22 bp, Artificial Sequence
  chemically synthesized
aactacctctcggctgccaggt

SEQ ID NO: 665762 - DNA, 22 bp, Artificial Sequence
  chemically synthesized
ctttctttataacctggcagcc

SEQ ID NO: 665763 - DNA, 22 bp, Artificial Sequence
  chemically synthesized
ttaactacctctcggctgccag

SEQ ID NO: 665764 - DNA, 22 bp, Artificial Sequence
  chemically synthesized
tctttataacctggcagccgag

SEQ ID NO: 665765 - DNA, 22 bp, Artificial Sequence
  chemically synthesized
ctttataacctggcagccgaga

SEQ ID NO: 665766 - DNA, 22 bp, Artificial Sequence
  chemically synthesized
tttataacctggcagccgagag

SEQ ID NO: 665767 - DNA, 22 bp, Artificial Sequence
  chemically synthesized
ccctcttaactacctctcggct

SEQ ID NO: 665768 - DNA, 22 bp, Artificial Sequence
  chemically synthesized
tataacctggcagccgagaggt

SEQ ID NO: 665769 - DNA, 22 bp, Artificial Sequence
  chemically synthesized
ataacctggcagccgagaggta

SEQ ID NO: 665770 - DNA, 22 bp, Artificial Sequence
  chemically synthesized
taacctggcagccgagaggtag

SEQ ID NO: 665771 - DNA, 22 bp, Artificial Sequence
  chemically synthesized
aggactgccctcttaactacct

SEQ ID NO: 665772 - DNA, 22 bp, Artificial Sequence
  chemically synthesized
gcagccgagaggtagttaagag

SEQ ID NO: 665773 - DNA, 22 bp, Artificial Sequence
  chemically synthesized
gatgtagttgaggactgccctc

SEQ ID NO: 665774 - DNA, 22 bp, Artificial Sequence
  chemically synthesized
atggttagatgtagttgaggac

SEQ ID NO: 665775 - DNA, 22 bp, Artificial Sequence
  chemically synthesized
agagggcagtcctcaactacat

SEQ ID NO: 665776 - DNA, 22 bp, Artificial Sequence
  chemically synthesized
gtagtcattcatggttagatgt

SEQ ID NO: 665777 - DNA, 22 bp, Artificial Sequence
  chemically synthesized
gtgttggtagtcattcatggtt

SEQ ID NO: 665778 - DNA, 22 bp, Artificial Sequence
  chemically synthesized
aactacatctaaccatgaatga

SEQ ID NO: 665779 - DNA, 22 bp, Artificial Sequence
  chemically synthesized
taattggtgttggtagtcattc

SEQ ID NO: 665780 - DNA, 22 bp, Artificial Sequence
  chemically synthesized
catctaaccatgaatgactacc

SEQ ID NO: 665781 - DNA, 22 bp, Artificial Sequence
  chemically synthesized
tgtaattggtgttggtagtcat

SEQ ID NO: 665782 - DNA, 22 bp, Artificial Sequence
  chemically synthesized
tctgtaattggtgttggtagtc

SEQ ID NO: 665783 - DNA, 22 bp, Artificial Sequence
  chemically synthesized
accatgaatgactaccaacacc

SEQ ID NO: 665784 - DNA, 22 bp, Artificial Sequence
  chemically synthesized
acacaggttctctgtaattggt

SEQ ID NO: 665785 - DNA, 22 bp, Artificial Sequence
  chemically synthesized
ccaacaccaattacagagaacc

SEQ ID NO: 665786 - DNA, 22 bp, Artificial Sequence
  chemically synthesized
acaaggactcacacaggttctc

SEQ ID NO: 665787 - DNA, 22 bp, Artificial Sequence
  chemically synthesized
actaacaaggactcacacaggt

SEQ ID NO: 665788 - DNA, 22 bp, Artificial Sequence
  chemically synthesized
gactaacaaggactcacacagg

SEQ ID NO: 665789 - DNA, 22 bp, Artificial Sequence
  chemically synthesized
tgactaacaaggactcacacag

SEQ ID NO: 665790 - DNA, 22 bp, Artificial Sequence
  chemically synthesized
cagagaacctgtgtgagtcctt

SEQ ID NO: 665791 - DNA, 22 bp, Artificial Sequence
  chemically synthesized
aaatcacactttgactaacaag

SEQ ID NO: 665792 - DNA, 22 bp, Artificial Sequence
  chemically synthesized
ctcaaatcacactttgactaac

SEQ ID NO: 665793 - DNA, 22 bp, Artificial Sequence
  chemically synthesized
tgtgagtccttgttagtcaaag

SEQ ID NO: 665794 - DNA, 22 bp, Artificial Sequence
  chemically synthesized
cctcaaatcacactttgactaa

SEQ ID NO: 665795 - DNA, 22 bp, Artificial Sequence
  chemically synthesized
ttcctcaaatcacactttgact

SEQ ID NO: 665796 - DNA, 22 bp, Artificial Sequence
  chemically synthesized
ttcttcctcaaatcacactttg

SEQ ID NO: 665797 - DNA, 22 bp, Artificial Sequence
  chemically synthesized
gttagtcaaagtgtgatttgag

SEQ ID NO: 665798 - DNA, 22 bp, Artificial Sequence
  chemically synthesized
atgctattcttcctcaaatcac

SEQ ID NO: 665799 - DNA, 22 bp, Artificial Sequence
  chemically synthesized
ttagtcaaagtgtgatttgagg

SEQ ID NO: 665800 - DNA, 22 bp, Artificial Sequence
  chemically synthesized
gtcaaagtgtgatttgaggaag

SEQ ID NO: 665801 - DNA, 22 bp, Artificial Sequence
  chemically synthesized
caagcagatactgatgctattc

SEQ ID NO: 665802 - DNA, 22 bp, Artificial Sequence
  chemically synthesized
gaggaagaatagcatcagtatc

SEQ ID NO: 665803 - DNA, 22 bp, Artificial Sequence
  chemically synthesized
aggaagaatagcatcagtatct

SEQ ID NO: 665804 - DNA, 22 bp, Artificial Sequence
  chemically synthesized
ataagctccaagcagatactga

SEQ ID NO: 665805 - DNA, 22 bp, Artificial Sequence
  chemically synthesized
tcataagctccaagcagatact

SEQ ID NO: 665806 - DNA, 22 bp, Artificial Sequence
  chemically synthesized
ctcataagctccaagcagatac

SEQ ID NO: 665807 - DNA, 22 bp, Artificial Sequence
  chemically synthesized
catttctcataagctccaagca

SEQ ID NO: 665808 - DNA, 22 bp, Artificial Sequence
  chemically synthesized
tgcatttctcataagctccaag

SEQ ID NO: 665809 - DNA, 22 bp, Artificial Sequence
  chemically synthesized
agattctgcatttctcataagc

SEQ ID NO: 665810 - DNA, 22 bp, Artificial Sequence
  chemically synthesized
cttggagcttatgagaaatgca

SEQ ID NO: 665811 - DNA, 22 bp, Artificial Sequence
  chemically synthesized
ggagcttatgagaaatgcagaa

SEQ ID NO: 665812 - DNA, 22 bp, Artificial Sequence
  chemically synthesized
gagcttatgagaaatgcagaat

SEQ ID NO: 665813 - DNA, 22 bp, Artificial Sequence
  chemically synthesized
ggtggggcctgagattctgcat

SEQ ID NO: 665814 - DNA, 22 bp, Artificial Sequence
  chemically synthesized
atgagaaatgcagaatctcagg

SEQ ID NO: 665815 - DNA, 22 bp, Artificial Sequence
  chemically synthesized
tgagaaatgcagaatctcaggc

SEQ ID NO: 665816 - DNA, 22 bp, Artificial Sequence
  chemically synthesized
acagatctgggtggggcctgag

SEQ ID NO: 665817 - DNA, 22 bp, Artificial Sequence
  chemically synthesized
ggattcacagatctgggtgggg

SEQ ID NO: 665818 - DNA, 22 bp, Artificial Sequence
  chemically synthesized
attcggattcacagatctgggt

SEQ ID NO: 665819 - DNA, 22 bp, Artificial Sequence
  chemically synthesized
aggccccacccagatctgtgaa

SEQ ID NO: 665820 - DNA, 22 bp, Artificial Sequence
  chemically synthesized
gtaaaatattgattcggattca

SEQ ID NO: 665821 - DNA, 22 bp, Artificial Sequence
  chemically synthesized
agtaaaatattgattcggattc

SEQ ID NO: 665822 - DNA, 22 bp, Artificial Sequence
  chemically synthesized
ttagtaaaatattgattcggat

SEQ ID NO: 665823 - DNA, 22 bp, Artificial Sequence
  chemically synthesized
tgaatccgaatcaatattttac

SEQ ID NO: 665824 - DNA, 22 bp, Artificial Sequence
  chemically synthesized
catatgaatcaccagaggctct

SEQ ID NO: 665825 - DNA, 22 bp, Artificial Sequence
  chemically synthesized
ccatatgaatcaccagaggctc

SEQ ID NO: 665826 - DNA, 22 bp, Artificial Sequence
  chemically synthesized
tactaagagcctctggtgattc

SEQ ID NO: 665827 - DNA, 22 bp, Artificial Sequence
  chemically synthesized
actaagagcctctggtgattca

SEQ ID NO: 665828 - DNA, 22 bp, Artificial Sequence
  chemically synthesized
ctaagagcctctggtgattcat

SEQ ID NO: 665829 - DNA, 22 bp, Artificial Sequence
  chemically synthesized
aagaacttccatatgaatcacc

SEQ ID NO: 665830 - DNA, 22 bp, Artificial Sequence
  chemically synthesized
aaagaacttccatatgaatcac

SEQ ID NO: 665831 - DNA, 22 bp, Artificial Sequence
  chemically synthesized
agagcctctggtgattcatatg

SEQ ID NO: 665832 - DNA, 22 bp, Artificial Sequence
  chemically synthesized
atttaaagaacttccatatgaa

SEQ ID NO: 665833 - DNA, 22 bp, Artificial Sequence
  chemically synthesized
tggtgattcatatggaagttct

SEQ ID NO: 665834 - DNA, 22 bp, Artificial Sequence
  chemically synthesized
gtgattcatatggaagttcttt

SEQ ID NO: 665835 - DNA, 22 bp, Artificial Sequence
  chemically synthesized
aaatattcatttaaagaacttc

SEQ ID NO: 665836 - DNA, 22 bp, Artificial Sequence
  chemically synthesized
ttaaaatattcatttaaagaac

SEQ ID NO: 665837 - DNA, 22 bp, Artificial Sequence
  chemically synthesized
attaaaatattcatttaaagaa

SEQ ID NO: 665838 - DNA, 22 bp, Artificial Sequence
  chemically synthesized
tattaaaatattcatttaaaga

SEQ ID NO: 665839 - DNA, 22 bp, Artificial Sequence
  chemically synthesized
atatggaagttctttaaatgaa

SEQ ID NO: 665840 - DNA, 22 bp, Artificial Sequence
  chemically synthesized
tttaaatgaatattttaataaa

SEQ ID NO: 665841 - DNA, 22 bp, Artificial Sequence
  chemically synthesized
taaatgaatattttaataaagt

SEQ ID NO: 665842 - DNA, 22 bp, Artificial Sequence
  chemically synthesized
aaatgaatattttaataaagtt

SEQ ID NO: 665843 - DNA, 22 bp, Artificial Sequence
  chemically synthesized
aatgaatattttaataaagttt

SEQ ID NO: 665844 - DNA, 22 bp, Artificial Sequence
  chemically synthesized
acaacacggaacaagaaacttt

SEQ ID NO: 665845 - DNA, 22 bp, Artificial Sequence
  chemically synthesized
aacaacacggaacaagaaactt

SEQ ID NO: 665846 - DNA, 22 bp, Artificial Sequence
  chemically synthesized
aagtttaacaacacggaacaag

SEQ ID NO: 665847 - DNA, 22 bp, Artificial Sequence
  chemically synthesized
taataaagtttcttgttccgtg

SEQ ID NO: 665848 - DNA, 22 bp, Artificial Sequence
  chemically synthesized
gaagtttaacaacacggaacaa

SEQ ID NO: 665849 - DNA, 22 bp, Artificial Sequence
  chemically synthesized
aataaagtttcttgttccgtgt

SEQ ID NO: 665850 - DNA, 22 bp, Artificial Sequence
  chemically synthesized
ataaagtttcttgttccgtgtt

SEQ ID NO: 665851 - DNA, 22 bp, Artificial Sequence
  chemically synthesized
tacttgaagtttaacaacacgg

SEQ ID NO: 665852 - DNA, 22 bp, Artificial Sequence
  chemically synthesized
atacttgaagtttaacaacacg

SEQ ID NO: 665853 - DNA, 22 bp, Artificial Sequence
  chemically synthesized
cttgttccgtgttgttaaactt

SEQ ID NO: 665854 - DNA, 22 bp, Artificial Sequence
  chemically synthesized
ttgttccgtgttgttaaacttc

SEQ ID NO: 665855 - DNA, 22 bp, Artificial Sequence
  chemically synthesized
gttccgtgttgttaaacttcaa

SEQ ID NO: 665856 - DNA, 22 bp, Artificial Sequence
  chemically synthesized
ttccgtgttgttaaacttcaag

SEQ ID NO: 665857 - DNA, 22 bp, Artificial Sequence
  chemically synthesized
cgtgttgttaaacttcaagtat

SEQ ID NO: 665858 - DNA, 22 bp, Artificial Sequence
  chemically synthesized
gtatacagaatttatacttgaa

SEQ ID NO: 665859 - DNA, 22 bp, Artificial Sequence
  chemically synthesized
ttaaacttcaagtataaattct

SEQ ID NO: 665860 - DNA, 22 bp, Artificial Sequence
  chemically synthesized
aacttcaagtataaattctgta

SEQ ID NO: 665861 - DNA, 22 bp, Artificial Sequence
  chemically synthesized
caagtataaattctgtatacca

SEQ ID NO: 665862 - DNA, 22 bp, Artificial Sequence
  chemically synthesized
aagtataaattctgtataccaa

SEQ ID NO: 665863 - DNA, 22 bp, Artificial Sequence
  chemically synthesized
tgtataccaacaccatcctgtg

SEQ ID NO: 665864 - DNA, 22 bp, Artificial Sequence
  chemically synthesized
tataccaacaccatcctgtgtt

SEQ ID NO: 665865 - DNA, 22 bp, Artificial Sequence
  chemically synthesized
tgttgtcttttgtttttctatc

SEQ ID NO: 665866 - DNA, 22 bp, Artificial Sequence
  chemically synthesized
tcttttgtttttctatctttct

SEQ ID NO: 665867 - DNA, 22 bp, Artificial Sequence
  chemically synthesized
ttgtttttctatctttctatct

SEQ ID NO: 665868 - DNA, 22 bp, Artificial Sequence
  chemically synthesized
tgtttttctatctttctatctt

SEQ ID NO: 665869 - DNA, 22 bp, Artificial Sequence
  chemically synthesized
gtttttctatctttctatcttc

SEQ ID NO: 665870 - DNA, 22 bp, Artificial Sequence
  chemically synthesized
tttttctatctttctatcttcc

SEQ ID NO: 665871 - DNA, 22 bp, Artificial Sequence
  chemically synthesized
ttctatctttctatcttccatt

SEQ ID NO: 665872 - DNA, 22 bp, Artificial Sequence
  chemically synthesized
tctatctttctatcttccattt

SEQ ID NO: 665873 - DNA, 22 bp, Artificial Sequence
  chemically synthesized
ctatctttctatcttccatttt

SEQ ID NO: 665874 - DNA, 22 bp, Artificial Sequence
  chemically synthesized
ataaaagcccacaaaatggaag

SEQ ID NO: 665875 - DNA, 22 bp, Artificial Sequence
  chemically synthesized
tatctttctatcttccattttg

SEQ ID NO: 665876 - DNA, 22 bp, Artificial Sequence
  chemically synthesized
tctttctatcttccattttgtg

SEQ ID NO: 665877 - DNA, 22 bp, Artificial Sequence
  chemically synthesized
ttaataaaagcccacaaaatgg

SEQ ID NO: 665878 - DNA, 22 bp, Artificial Sequence
  chemically synthesized
tctatcttccattttgtgggct

SEQ ID NO: 665879 - DNA, 22 bp, Artificial Sequence
  chemically synthesized
ctatcttccattttgtgggctt

SEQ ID NO: 665880 - DNA, 22 bp, Artificial Sequence
  chemically synthesized
tatcttccattttgtgggcttt

SEQ ID NO: 665881 - DNA, 22 bp, Artificial Sequence
  chemically synthesized
tcttccattttgtgggctttta

SEQ ID NO: 665882 - DNA, 22 bp, Artificial Sequence
  chemically synthesized
aataatctattaataaaagccc

SEQ ID NO: 665883 - DNA, 22 bp, Artificial Sequence
  chemically synthesized
ccattttgtgggcttttattaa

SEQ ID NO: 665884 - DNA, 22 bp, Artificial Sequence
  chemically synthesized
ttaaataatctattaataaaag

SEQ ID NO: 665885 - DNA, 22 bp, Artificial Sequence
  chemically synthesized
cattttgtgggcttttattaat

SEQ ID NO: 665886 - DNA, 22 bp, Artificial Sequence
  chemically synthesized
tgtgggcttttattaatagatt

SEQ ID NO: 665887 - DNA, 22 bp, Artificial Sequence
  chemically synthesized
gtgggcttttattaatagatta

SEQ ID NO: 665888 - DNA, 22 bp, Artificial Sequence
  chemically synthesized
tgggcttttattaatagattat

SEQ ID NO: 665889 - DNA, 22 bp, Artificial Sequence
  chemically synthesized
tagtagttattaaataatctat

SEQ ID NO: 665890 - DNA, 22 bp, Artificial Sequence
  chemically synthesized
actatagtagttattaaataat

SEQ ID NO: 665891 - DNA, 22 bp, Artificial Sequence
  chemically synthesized
ttattaatagattatttaataa

SEQ ID NO: 665892 - DNA, 22 bp, Artificial Sequence
  chemically synthesized
tattaatagattatttaataac

SEQ ID NO: 665893 - DNA, 22 bp, Artificial Sequence
  chemically synthesized
attaatagattatttaataact

SEQ ID NO: 665894 - DNA, 22 bp, Artificial Sequence
  chemically synthesized
ttaatagattatttaataacta

SEQ ID NO: 665895 - DNA, 22 bp, Artificial Sequence
  chemically synthesized
atagattatttaataactacta

SEQ ID NO: 665896 - DNA, 22 bp, Artificial Sequence
  chemically synthesized
gtgtagttgactatagtagtta

SEQ ID NO: 665897 - DNA, 22 bp, Artificial Sequence
  chemically synthesized
ggtgtagttgactatagtagtt

SEQ ID NO: 665898 - DNA, 22 bp, Artificial Sequence
  chemically synthesized
tggtgtagttgactatagtagt

SEQ ID NO: 665899 - DNA, 22 bp, Artificial Sequence
  chemically synthesized
tttaataactactatagtcaac

SEQ ID NO: 665900 - DNA, 22 bp, Artificial Sequence
  chemically synthesized
aataactactatagtcaactac

SEQ ID NO: 665901 - DNA, 22 bp, Artificial Sequence
  chemically synthesized
ataactactatagtcaactaca

SEQ ID NO: 665902 - DNA, 22 bp, Artificial Sequence
  chemically synthesized
ctatagtcaactacaccaaaac

SEQ ID NO: 665903 - DNA, 22 bp, Artificial Sequence
  chemically synthesized
tagtcaactacaccaaaacctc

SEQ ID NO: 665904 - DNA, 22 bp, Artificial Sequence
  chemically synthesized
acaaatatatcccagaggggag

SEQ ID NO: 665905 - DNA, 22 bp, Artificial Sequence
  chemically synthesized
caccaaaacctcccctctggga

SEQ ID NO: 665906 - DNA, 22 bp, Artificial Sequence
  chemically synthesized
ccctctgggatatatttgtgag

SEQ ID NO: 665907 - DNA, 22 bp, Artificial Sequence
  chemically synthesized
tcataaacaagagactcacaaa

SEQ ID NO: 665908 - DNA, 22 bp, Artificial Sequence
  chemically synthesized
atcataaacaagagactcacaa

SEQ ID NO: 665909 - DNA, 22 bp, Artificial Sequence
  chemically synthesized
tgggatatatttgtgagtctct

SEQ ID NO: 665910 - DNA, 22 bp, Artificial Sequence
  chemically synthesized
ggatatatttgtgagtctcttg

SEQ ID NO: 665911 - DNA, 22 bp, Artificial Sequence
  chemically synthesized
gtatttatcataaacaagagac

SEQ ID NO: 665912 - DNA, 22 bp, Artificial Sequence
  chemically synthesized
ttggtatttatcataaacaaga

SEQ ID NO: 665913 - DNA, 22 bp, Artificial Sequence
  chemically synthesized
attggtatttatcataaacaag

SEQ ID NO: 665914 - DNA, 22 bp, Artificial Sequence
  chemically synthesized
tattggtatttatcataaacaa

SEQ ID NO: 665915 - DNA, 22 bp, Artificial Sequence
  chemically synthesized
ttattggtatttatcataaaca

SEQ ID NO: 665916 - DNA, 22 bp, Artificial Sequence
  chemically synthesized
tttattggtatttatcataaac

SEQ ID NO: 665917 - DNA, 22 bp, Artificial Sequence
  chemically synthesized
gtgagtctcttgtttatgataa

SEQ ID NO: 665918 - DNA, 22 bp, Artificial Sequence
  chemically synthesized
tgagtctcttgtttatgataaa

SEQ ID NO: 665919 - DNA, 22 bp, Artificial Sequence
  chemically synthesized
aatactttttattggtatttat

SEQ ID NO: 665920 - DNA, 22 bp, Artificial Sequence
  chemically synthesized
ttgtttatgataaataccaata

SEQ ID NO: 665921 - DNA, 22 bp, Artificial Sequence
  chemically synthesized
ttgaatactttttattggtatt

SEQ ID NO: 665922 - DNA, 22 bp, Artificial Sequence
  chemically synthesized
attgaatactttttattggtat

SEQ ID NO: 665923 - DNA, 22 bp, Artificial Sequence
  chemically synthesized
gtttatgataaataccaataaa

SEQ ID NO: 665924 - DNA, 22 bp, Artificial Sequence
  chemically synthesized
tttatgataaataccaataaaa

SEQ ID NO: 665925 - DNA, 22 bp, Artificial Sequence
  chemically synthesized
atttattgaatactttttattg

SEQ ID NO: 665926 - DNA, 22 bp, Artificial Sequence
  chemically synthesized
atgataaataccaataaaaagt

SEQ ID NO: 665927 - DNA, 22 bp, Artificial Sequence
  chemically synthesized
aatttattgaatactttttatt

SEQ ID NO: 665928 - DNA, 22 bp, Artificial Sequence
  chemically synthesized
tgataaataccaataaaaagta

SEQ ID NO: 665929 - DNA, 22 bp, Artificial Sequence
  chemically synthesized
taatttattgaatactttttat

SEQ ID NO: 665930 - DNA, 22 bp, Artificial Sequence
  chemically synthesized
ttaatttattgaatacttttta

SEQ ID NO: 665931 - DNA, 22 bp, Artificial Sequence
  chemically synthesized
cgagatgcttttaatttattga

SEQ ID NO: 665932 - DNA, 22 bp, Artificial Sequence
  chemically synthesized
aagatactccgagatgctttta

SEQ ID NO: 665933 - DNA, 22 bp, Artificial Sequence
  chemically synthesized
caagatactccgagatgctttt

SEQ ID NO: 665934 - DNA, 22 bp, Artificial Sequence
  chemically synthesized
aataaattaaaagcatctcgga

SEQ ID NO: 665935 - DNA, 22 bp, Artificial Sequence
  chemically synthesized
aaagcatctcggagtatcttga

SEQ ID NO: 665936 - DNA, 22 bp, Artificial Sequence
  chemically synthesized
tatatatagcatttcaagatac

SEQ ID NO: 665937 - DNA, 22 bp, Artificial Sequence
  chemically synthesized
ggagtatcttgaaatgctatat

SEQ ID NO: 665938 - DNA, 22 bp, Artificial Sequence
  chemically synthesized
aagaagcaatctgtatatatag

SEQ ID NO: 665939 - DNA, 22 bp, Artificial Sequence
  chemically synthesized
caagaagcaatctgtatatata

SEQ ID NO: 665940 - DNA, 22 bp, Artificial Sequence
  chemically synthesized
tcttcaagaagcaatctgtata

SEQ ID NO: 665941 - DNA, 22 bp, Artificial Sequence
  chemically synthesized
gaaatgctatatatacagattg

SEQ ID NO: 665942 - DNA, 22 bp, Artificial Sequence
  chemically synthesized
aaatgctatatatacagattgc

SEQ ID NO: 665943 - DNA, 22 bp, Artificial Sequence
  chemically synthesized
attatcttcaagaagcaatctg

SEQ ID NO: 665944 - DNA, 22 bp, Artificial Sequence
  chemically synthesized
tatatacagattgcttcttgaa

SEQ ID NO: 665945 - DNA, 22 bp, Artificial Sequence
  chemically synthesized
cttcttgaagataattaacatt

SEQ ID NO: 665946 - DNA, 22 bp, Artificial Sequence
  chemically synthesized
cttgaagataattaacatttgc

SEQ ID NO: 665947 - DNA, 22 bp, Artificial Sequence
  chemically synthesized
ttgaagataattaacatttgcc

SEQ ID NO: 665948 - DNA, 22 bp, Artificial Sequence
  chemically synthesized
gaagataattaacatttgcctg

SEQ ID NO: 665949 - DNA, 22 bp, Artificial Sequence
  chemically synthesized
aaggacagcgtccaggcaaatg

SEQ ID NO: 665950 - DNA, 22 bp, Artificial Sequence
  chemically synthesized
aagataattaacatttgcctgg

SEQ ID NO: 665951 - DNA, 22 bp, Artificial Sequence
  chemically synthesized
actaaaggacagcgtccaggca

SEQ ID NO: 665952 - DNA, 22 bp, Artificial Sequence
  chemically synthesized
ctcactaaaggacagcgtccag

SEQ ID NO: 665953 - DNA, 22 bp, Artificial Sequence
  chemically synthesized
tgctcactaaaggacagcgtcc

SEQ ID NO: 665954 - DNA, 22 bp, Artificial Sequence
  chemically synthesized
acatttgcctggacgctgtcct

SEQ ID NO: 665955 - DNA, 22 bp, Artificial Sequence
  chemically synthesized
gcctggacgctgtcctttagtg

SEQ ID NO: 665956 - DNA, 22 bp, Artificial Sequence
  chemically synthesized
cctggacgctgtcctttagtga

SEQ ID NO: 665957 - DNA, 22 bp, Artificial Sequence
  chemically synthesized
gatcaagttctgctcactaaag

SEQ ID NO: 665958 - DNA, 22 bp, Artificial Sequence
  chemically synthesized
gacgctgtcctttagtgagcag

SEQ ID NO: 665959 - DNA, 22 bp, Artificial Sequence
  chemically synthesized
aactagatcaagttctgctcac

SEQ ID NO: 665960 - DNA, 22 bp, Artificial Sequence
  chemically synthesized
tcctttagtgagcagaacttga

SEQ ID NO: 665961 - DNA, 22 bp, Artificial Sequence
  chemically synthesized
aagggactcaactagatcaagt

SEQ ID NO: 665962 - DNA, 22 bp, Artificial Sequence
  chemically synthesized
tagtgagcagaacttgatctag

SEQ ID NO: 665963 - DNA, 22 bp, Artificial Sequence
  chemically synthesized
agtgagcagaacttgatctagt

SEQ ID NO: 665964 - DNA, 22 bp, Artificial Sequence
  chemically synthesized
gtgagcagaacttgatctagtt

SEQ ID NO: 665965 - DNA, 22 bp, Artificial Sequence
  chemically synthesized
gatctagttgagtccctttaat

SEQ ID NO: 665966 - DNA, 22 bp, Artificial Sequence
  chemically synthesized
atctagttgagtccctttaatt

SEQ ID NO: 665967 - DNA, 22 bp, Artificial Sequence
  chemically synthesized
gttgagtccctttaattgtcct

SEQ ID NO: 665968 - DNA, 22 bp, Artificial Sequence
  chemically synthesized
ggggagagagagagaaggacaa

SEQ ID NO: 665969 - DNA, 22 bp, Artificial Sequence
  chemically synthesized
agtccctttaattgtccttctc

SEQ ID NO: 665970 - DNA, 22 bp, Artificial Sequence
  chemically synthesized
aggggagagagagagaaggaca

SEQ ID NO: 665971 - DNA, 22 bp, Artificial Sequence
  chemically synthesized
taggggagagagagagaaggac

SEQ ID NO: 665972 - DNA, 22 bp, Artificial Sequence
  chemically synthesized
ttaggggagagagagagaagga

SEQ ID NO: 665973 - DNA, 22 bp, Artificial Sequence
  chemically synthesized
taattgtccttctctctctctc

SEQ ID NO: 665974 - DNA, 22 bp, Artificial Sequence
  chemically synthesized
aattgtccttctctctctctcc

SEQ ID NO: 665975 - DNA, 22 bp, Artificial Sequence
  chemically synthesized
attgtccttctctctctctccc

SEQ ID NO: 665976 - DNA, 22 bp, Artificial Sequence
  chemically synthesized
tccttctctctctctcccctaa

SEQ ID NO: 665977 - DNA, 22 bp, Artificial Sequence
  chemically synthesized
ctctctctctcccctaaaagat

SEQ ID NO: 665978 - DNA, 22 bp, Artificial Sequence
  chemically synthesized
tctctctctcccctaaaagatg

SEQ ID NO: 665979 - DNA, 22 bp, Artificial Sequence
  chemically synthesized
tctctctcccctaaaagatgtg

SEQ ID NO: 665980 - DNA, 22 bp, Artificial Sequence
  chemically synthesized
tctctcccctaaaagatgtggt

SEQ ID NO: 665981 - DNA, 22 bp, Artificial Sequence
  chemically synthesized
tctcccctaaaagatgtggttc

SEQ ID NO: 665982 - DNA, 22 bp, Artificial Sequence
  chemically synthesized
tcccctaaaagatgtggttctt

SEQ ID NO: 665983 - DNA, 22 bp, Artificial Sequence
  chemically synthesized
ccctaaaagatgtggttcttcc

SEQ ID NO: 665984 - DNA, 22 bp, Artificial Sequence
  chemically synthesized
ggcaaaagagacaaaggaagaa

SEQ ID NO: 665985 - DNA, 22 bp, Artificial Sequence
  chemically synthesized
aaagatgtggttcttcctttgt

SEQ ID NO: 665986 - DNA, 22 bp, Artificial Sequence
  chemically synthesized
ttcctttgtctcttttgcccag

SEQ ID NO: 665987 - DNA, 22 bp, Artificial Sequence
  chemically synthesized
cctttgtctcttttgcccagtc

SEQ ID NO: 665988 - DNA, 22 bp, Artificial Sequence
  chemically synthesized
ctttgtctcttttgcccagtca

SEQ ID NO: 665989 - DNA, 22 bp, Artificial Sequence
  chemically synthesized
tgtctcttttgcccagtcatca

SEQ ID NO: 665990 - DNA, 22 bp, Artificial Sequence
  chemically synthesized
gtctcttttgcccagtcatcac

SEQ ID NO: 665991 - DNA, 22 bp, Artificial Sequence
  chemically synthesized
aaaaagtaagcagtgatgactg

SEQ ID NO: 665992 - DNA, 22 bp, Artificial Sequence
  chemically synthesized
tctcttttgcccagtcatcact

SEQ ID NO: 665993 - DNA, 22 bp, Artificial Sequence
  chemically synthesized
aaaaaagtaagcagtgatgact

SEQ ID NO: 665994 - DNA, 22 bp, Artificial Sequence
  chemically synthesized
ttttgcccagtcatcactgctt

SEQ ID NO: 665995 - DNA, 22 bp, Artificial Sequence
  chemically synthesized
ttgcccagtcatcactgcttac

SEQ ID NO: 665996 - DNA, 22 bp, Artificial Sequence
  chemically synthesized
tgcccagtcatcactgcttact

SEQ ID NO: 665997 - DNA, 22 bp, Artificial Sequence
  chemically synthesized
gcccagtcatcactgcttactt

SEQ ID NO: 665998 - DNA, 22 bp, Artificial Sequence
  chemically synthesized
cccagtcatcactgcttacttt

SEQ ID NO: 665999 - DNA, 22 bp, Artificial Sequence
  chemically synthesized
agaccacttaaaaaagtaagca

SEQ ID NO: 666000 - DNA, 22 bp, Artificial Sequence
  chemically synthesized
gctgagaccacttaaaaaagta

SEQ ID NO: 666001 - DNA, 22 bp, Artificial Sequence
  chemically synthesized
cttacttttttaagtggtctca

SEQ ID NO: 666002 - DNA, 22 bp, Artificial Sequence
  chemically synthesized
acttttttaagtggtctcagcc

SEQ ID NO: 666003 - DNA, 22 bp, Artificial Sequence
  chemically synthesized
ataccatgagttggctgagacc

SEQ ID NO: 666004 - DNA, 22 bp, Artificial Sequence
  chemically synthesized
cttttttaagtggtctcagcca

SEQ ID NO: 666005 - DNA, 22 bp, Artificial Sequence
  chemically synthesized
ttttaagtggtctcagccaact

SEQ ID NO: 666006 - DNA, 22 bp, Artificial Sequence
  chemically synthesized
tttaagtggtctcagccaactc

SEQ ID NO: 666007 - DNA, 22 bp, Artificial Sequence
  chemically synthesized
ttaagtggtctcagccaactca

SEQ ID NO: 666008 - DNA, 22 bp, Artificial Sequence
  chemically synthesized
taagtggtctcagccaactcat

SEQ ID NO: 666009 - DNA, 22 bp, Artificial Sequence
  chemically synthesized
aagtggtctcagccaactcatg

SEQ ID NO: 666010 - DNA, 22 bp, Artificial Sequence
  chemically synthesized
agtggtctcagccaactcatgg

SEQ ID NO: 666011 - DNA, 22 bp, Artificial Sequence
  chemically synthesized
atgccgcaagacaattcatacc

SEQ ID NO: 666012 - DNA, 22 bp, Artificial Sequence
  chemically synthesized
agccaactcatggtatgaattg

SEQ ID NO: 666013 - DNA, 22 bp, Artificial Sequence
  chemically synthesized
atggattgatgccgcaagacaa

SEQ ID NO: 666014 - DNA, 22 bp, Artificial Sequence
  chemically synthesized
atggtatgaattgtcttgcggc

SEQ ID NO: 666015 - DNA, 22 bp, Artificial Sequence
  chemically synthesized
tcatggattgatgccgcaagac

SEQ ID NO: 666016 - DNA, 22 bp, Artificial Sequence
  chemically synthesized
ctcatggattgatgccgcaaga

SEQ ID NO: 666017 - DNA, 22 bp, Artificial Sequence
  chemically synthesized
gtttctcatggattgatgccgc

SEQ ID NO: 666018 - DNA, 22 bp, Artificial Sequence
  chemically synthesized
tcttgcggcatcaatccatgag

SEQ ID NO: 666019 - DNA, 22 bp, Artificial Sequence
  chemically synthesized
gcggcatcaatccatgagaaac

SEQ ID NO: 666020 - DNA, 22 bp, Artificial Sequence
  chemically synthesized
cggcatcaatccatgagaaacc

SEQ ID NO: 666021 - DNA, 22 bp, Artificial Sequence
  chemically synthesized
gaggggaggacaggaattggtt

SEQ ID NO: 666022 - DNA, 22 bp, Artificial Sequence
  chemically synthesized
caccaatctggaggggaggaca

SEQ ID NO: 666023 - DNA, 22 bp, Artificial Sequence
  chemically synthesized
ctgtcctcccctccagattggt

SEQ ID NO: 666024 - DNA, 22 bp, Artificial Sequence
  chemically synthesized
gtgaaggatgttgcaccaatct

SEQ ID NO: 666025 - DNA, 22 bp, Artificial Sequence
  chemically synthesized
tcctcccctccagattggtgca

SEQ ID NO: 666026 - DNA, 22 bp, Artificial Sequence
  chemically synthesized
ccctccagattggtgcaacatc

SEQ ID NO: 666027 - DNA, 22 bp, Artificial Sequence
  chemically synthesized
atggtactggtgaaggatgttg

SEQ ID NO: 666028 - DNA, 22 bp, Artificial Sequence
  chemically synthesized
gatggtactggtgaaggatgtt

SEQ ID NO: 666029 - DNA, 22 bp, Artificial Sequence
  chemically synthesized
cagattggtgcaacatccttca

SEQ ID NO: 666030 - DNA, 22 bp, Artificial Sequence
  chemically synthesized
gtgcaacatccttcaccagtac

SEQ ID NO: 666031 - DNA, 22 bp, Artificial Sequence
  chemically synthesized
gcaagtacaggaaaaatttgat

SEQ ID NO: 666032 - DNA, 22 bp, Artificial Sequence
  chemically synthesized
caccagtaccatcaaatttttc

SEQ ID NO: 666033 - DNA, 22 bp, Artificial Sequence
  chemically synthesized
accagtaccatcaaatttttcc

SEQ ID NO: 666034 - DNA, 22 bp, Artificial Sequence
  chemically synthesized
cacactagcaagtacaggaaaa

SEQ ID NO: 666035 - DNA, 22 bp, Artificial Sequence
  chemically synthesized
ttcctgtacttgctagtgtgga

SEQ ID NO: 666036 - DNA, 22 bp, Artificial Sequence
  chemically synthesized
tcctgtacttgctagtgtggag

SEQ ID NO: 666037 - DNA, 22 bp, Artificial Sequence
  chemically synthesized
cctgtacttgctagtgtggagt

SEQ ID NO: 666038 - DNA, 22 bp, Artificial Sequence
  chemically synthesized
ctgtacttgctagtgtggagtt

SEQ ID NO: 666039 - DNA, 22 bp, Artificial Sequence
  chemically synthesized
tacttgctagtgtggagttccc

SEQ ID NO: 666040 - DNA, 22 bp, Artificial Sequence
  chemically synthesized
gctagtgtggagttcccttaca

SEQ ID NO: 666041 - DNA, 22 bp, Artificial Sequence
  chemically synthesized
ctagtgtggagttcccttacac

SEQ ID NO: 666042 - DNA, 22 bp, Artificial Sequence
  chemically synthesized
aatgatgagtgtgtgtgtaagg

SEQ ID NO: 666043 - DNA, 22 bp, Artificial Sequence
  chemically synthesized
gtgtggagttcccttacacaca

SEQ ID NO: 666044 - DNA, 22 bp, Artificial Sequence
  chemically synthesized
ccttacacacacactcatcatt

SEQ ID NO: 666045 - DNA, 22 bp, Artificial Sequence
  chemically synthesized
acacacacactcatcattgagt

SEQ ID NO: 666046 - DNA, 22 bp, Artificial Sequence
  chemically synthesized
cacacacactcatcattgagtc

SEQ ID NO: 666047 - DNA, 22 bp, Artificial Sequence
  chemically synthesized
taaagagtcaaagggactcaat

SEQ ID NO: 666048 - DNA, 22 bp, Artificial Sequence
  chemically synthesized
ataaagagtcaaagggactcaa

SEQ ID NO: 666049 - DNA, 22 bp, Artificial Sequence
  chemically synthesized
tataaagagtcaaagggactca

SEQ ID NO: 666050 - DNA, 22 bp, Artificial Sequence
  chemically synthesized
ttataaagagtcaaagggactc

SEQ ID NO: 666051 - DNA, 22 bp, Artificial Sequence
  chemically synthesized
tttataaagagtcaaagggact

SEQ ID NO: 666052 - DNA, 22 bp, Artificial Sequence
  chemically synthesized
tttttataaagagtcaaaggga

SEQ ID NO: 666053 - DNA, 22 bp, Artificial Sequence
  chemically synthesized
ctttttataaagagtcaaaggg

SEQ ID NO: 666054 - DNA, 22 bp, Artificial Sequence
  chemically synthesized
atcattgagtccctttgactct

SEQ ID NO: 666055 - DNA, 22 bp, Artificial Sequence
  chemically synthesized
catttctttttataaagagtca

SEQ ID NO: 666056 - DNA, 22 bp, Artificial Sequence
  chemically synthesized
tacatttctttttataaagagt

SEQ ID NO: 666057 - DNA, 22 bp, Artificial Sequence
  chemically synthesized
agtccctttgactctttataaa

SEQ ID NO: 666058 - DNA, 22 bp, Artificial Sequence
  chemically synthesized
cacgtctctacatttcttttta

SEQ ID NO: 666059 - DNA, 22 bp, Artificial Sequence
  chemically synthesized
ccacgtctctacatttcttttt

SEQ ID NO: 666060 - DNA, 22 bp, Artificial Sequence
  chemically synthesized
tgactctttataaaaagaaatg

SEQ ID NO: 666061 - DNA, 22 bp, Artificial Sequence
  chemically synthesized
gactctttataaaaagaaatgt

SEQ ID NO: 666062 - DNA, 22 bp, Artificial Sequence
  chemically synthesized
actctttataaaaagaaatgta

SEQ ID NO: 666063 - DNA, 22 bp, Artificial Sequence
  chemically synthesized
tttataaaaagaaatgtagaga

SEQ ID NO: 666064 - DNA, 22 bp, Artificial Sequence
  chemically synthesized
tataaaaagaaatgtagagacg

SEQ ID NO: 666065 - DNA, 22 bp, Artificial Sequence
  chemically synthesized
ataaaaagaaatgtagagacgt

SEQ ID NO: 666066 - DNA, 22 bp, Artificial Sequence
  chemically synthesized
taaaaagaaatgtagagacgtg

SEQ ID NO: 666067 - DNA, 22 bp, Artificial Sequence
  chemically synthesized
accaaaagtgcatttccacgtc

SEQ ID NO: 666068 - DNA, 22 bp, Artificial Sequence
  chemically synthesized
gaccaaaagtgcatttccacgt

SEQ ID NO: 666069 - DNA, 22 bp, Artificial Sequence
  chemically synthesized
tatttgaccaaaagtgcatttc

SEQ ID NO: 666070 - DNA, 22 bp, Artificial Sequence
  chemically synthesized
atgggaaagggatctgtatttg

SEQ ID NO: 666071 - DNA, 22 bp, Artificial Sequence
  chemically synthesized
gtgttaatgggaaagggatctg

SEQ ID NO: 666072 - DNA, 22 bp, Artificial Sequence
  chemically synthesized
ttggtcaaatacagatcccttt

SEQ ID NO: 666073 - DNA, 22 bp, Artificial Sequence
  chemically synthesized
tggtcaaatacagatccctttc

SEQ ID NO: 666074 - DNA, 22 bp, Artificial Sequence
  chemically synthesized
ggtcaaatacagatccctttcc

SEQ ID NO: 666075 - DNA, 22 bp, Artificial Sequence
  chemically synthesized
gtcaaatacagatccctttccc

SEQ ID NO: 666076 - DNA, 22 bp, Artificial Sequence
  chemically synthesized
caggctggtgttaatgggaaag

SEQ ID NO: 666077 - DNA, 22 bp, Artificial Sequence
  chemically synthesized
ctacaggctggtgttaatggga

SEQ ID NO: 666078 - DNA, 22 bp, Artificial Sequence
  chemically synthesized
gaaactgctacaggctggtgtt

SEQ ID NO: 666079 - DNA, 22 bp, Artificial Sequence
  chemically synthesized
tcccattaacaccagcctgtag

SEQ ID NO: 666080 - DNA, 22 bp, Artificial Sequence
  chemically synthesized
cccattaacaccagcctgtagc

SEQ ID NO: 666081 - DNA, 22 bp, Artificial Sequence
  chemically synthesized
ccattaacaccagcctgtagca

SEQ ID NO: 666082 - DNA, 22 bp, Artificial Sequence
  chemically synthesized
tcccctggaaactgctacaggc

SEQ ID NO: 666083 - DNA, 22 bp, Artificial Sequence
  chemically synthesized
atcccctggaaactgctacagg

SEQ ID NO: 666084 - DNA, 22 bp, Artificial Sequence
  chemically synthesized
acaccagcctgtagcagtttcc

SEQ ID NO: 666085 - DNA, 22 bp, Artificial Sequence
  chemically synthesized
gatgcttatcccctggaaactg

SEQ ID NO: 666086 - DNA, 22 bp, Artificial Sequence
  chemically synthesized
ggattggatgcttatcccctgg

SEQ ID NO: 666087 - DNA, 22 bp, Artificial Sequence
  chemically synthesized
gggattggatgcttatcccctg

SEQ ID NO: 666088 - DNA, 22 bp, Artificial Sequence
  chemically synthesized
tagcagtttccaggggataagc

SEQ ID NO: 666089 - DNA, 22 bp, Artificial Sequence
  chemically synthesized
ccaggggataagcatccaatcc

SEQ ID NO: 666090 - DNA, 22 bp, Artificial Sequence
  chemically synthesized
caggggataagcatccaatccc

SEQ ID NO: 666091 - DNA, 22 bp, Artificial Sequence
  chemically synthesized
cataagtaaaggaatgagagaa

SEQ ID NO: 666092 - DNA, 22 bp, Artificial Sequence
  chemically synthesized
gcataagtaaaggaatgagaga

SEQ ID NO: 666093 - DNA, 22 bp, Artificial Sequence
  chemically synthesized
tgcataagtaaaggaatgagag

SEQ ID NO: 666094 - DNA, 22 bp, Artificial Sequence
  chemically synthesized
ttgcataagtaaaggaatgaga

SEQ ID NO: 666095 - DNA, 22 bp, Artificial Sequence
  chemically synthesized
aatacttttgcataagtaaagg

SEQ ID NO: 666096 - DNA, 22 bp, Artificial Sequence
  chemically synthesized
tctctcattcctttacttatgc

SEQ ID NO: 666097 - DNA, 22 bp, Artificial Sequence
  chemically synthesized
ctctcattcctttacttatgca

SEQ ID NO: 666098 - DNA, 22 bp, Artificial Sequence
  chemically synthesized
tctcattcctttacttatgcaa

SEQ ID NO: 666099 - DNA, 22 bp, Artificial Sequence
  chemically synthesized
acactcaatacttttgcataag

SEQ ID NO: 666100 - DNA, 22 bp, Artificial Sequence
  chemically synthesized
tcattcctttacttatgcaaaa

SEQ ID NO: 666101 - DNA, 22 bp, Artificial Sequence
  chemically synthesized
attcctttacttatgcaaaagt

SEQ ID NO: 666102 - DNA, 22 bp, Artificial Sequence
  chemically synthesized
ctttacttatgcaaaagtattg

SEQ ID NO: 666103 - DNA, 22 bp, Artificial Sequence
  chemically synthesized
tacttatgcaaaagtattgagt

SEQ ID NO: 666104 - DNA, 22 bp, Artificial Sequence
  chemically synthesized
acttatgcaaaagtattgagtg

SEQ ID NO: 666105 - DNA, 22 bp, Artificial Sequence
  chemically synthesized
gcacaaaactaacactcaatac

SEQ ID NO: 666106 - DNA, 22 bp, Artificial Sequence
  chemically synthesized
cttatgcaaaagtattgagtgt

SEQ ID NO: 666107 - DNA, 22 bp, Artificial Sequence
  chemically synthesized
atgcaaaagtattgagtgttag

SEQ ID NO: 666108 - DNA, 22 bp, Artificial Sequence
  chemically synthesized
gctggcacaaaactaacactca

SEQ ID NO: 666109 - DNA, 22 bp, Artificial Sequence
  chemically synthesized
tgcaaaagtattgagtgttagt

SEQ ID NO: 666110 - DNA, 22 bp, Artificial Sequence
  chemically synthesized
ggctggcacaaaactaacactc

SEQ ID NO: 666111 - DNA, 22 bp, Artificial Sequence
  chemically synthesized
caagatgtttggctggcacaaa

SEQ ID NO: 666112 - DNA, 22 bp, Artificial Sequence
  chemically synthesized
tacaagatgtttggctggcaca

SEQ ID NO: 666113 - DNA, 22 bp, Artificial Sequence
  chemically synthesized
agtgttagttttgtgccagcca

SEQ ID NO: 666114 - DNA, 22 bp, Artificial Sequence
  chemically synthesized
ctacaagatgtttggctggcac

SEQ ID NO: 666115 - DNA, 22 bp, Artificial Sequence
  chemically synthesized
gttttgtgccagccaaacatct

SEQ ID NO: 666116 - DNA, 22 bp, Artificial Sequence
  chemically synthesized
tgtgccagccaaacatcttgta

SEQ ID NO: 666117 - DNA, 22 bp, Artificial Sequence
  chemically synthesized
gtgccagccaaacatcttgtag

SEQ ID NO: 666118 - DNA, 22 bp, Artificial Sequence
  chemically synthesized
tgccaatatcttctacaagatg

SEQ ID NO: 666119 - DNA, 22 bp, Artificial Sequence
  chemically synthesized
tgccagccaaacatcttgtaga

SEQ ID NO: 666120 - DNA, 22 bp, Artificial Sequence
  chemically synthesized
atgccaatatcttctacaagat

SEQ ID NO: 666121 - DNA, 22 bp, Artificial Sequence
  chemically synthesized
tatgccaatatcttctacaaga

SEQ ID NO: 666122 - DNA, 22 bp, Artificial Sequence
  chemically synthesized
gtagaagatattggcataaagt

SEQ ID NO: 666123 - DNA, 22 bp, Artificial Sequence
  chemically synthesized
tagaagatattggcataaagtt

SEQ ID NO: 666124 - DNA, 22 bp, Artificial Sequence
  chemically synthesized
gaaagggaaaaaaagaagagaa

SEQ ID NO: 666125 - DNA, 22 bp, Artificial Sequence
  chemically synthesized
gcataaagtttctcttcttttt

SEQ ID NO: 666126 - DNA, 22 bp, Artificial Sequence
  chemically synthesized
ctcttctttttttccctttcta

SEQ ID NO: 666127 - DNA, 22 bp, Artificial Sequence
  chemically synthesized
tcttctttttttccctttctaa

SEQ ID NO: 666128 - DNA, 22 bp, Artificial Sequence
  chemically synthesized
ttctttttttccctttctaatc

SEQ ID NO: 666129 - DNA, 22 bp, Artificial Sequence
  chemically synthesized
ctttttttccctttctaatcct

SEQ ID NO: 666130 - DNA, 22 bp, Artificial Sequence
  chemically synthesized
tttttttccctttctaatcctc

SEQ ID NO: 666131 - DNA, 22 bp, Artificial Sequence
  chemically synthesized
tttttccctttctaatcctcct

SEQ ID NO: 666132 - DNA, 22 bp, Artificial Sequence
  chemically synthesized
ttttccctttctaatcctcctt

SEQ ID NO: 666133 - DNA, 22 bp, Artificial Sequence
  chemically synthesized
tttccctttctaatcctccttc

SEQ ID NO: 666134 - DNA, 22 bp, Artificial Sequence
  chemically synthesized
cgaggcagtggagaaggaggat

SEQ ID NO: 666135 - DNA, 22 bp, Artificial Sequence
  chemically synthesized
ttccctttctaatcctccttct

SEQ ID NO: 666136 - DNA, 22 bp, Artificial Sequence
  chemically synthesized
tccctttctaatcctccttctc

SEQ ID NO: 666137 - DNA, 22 bp, Artificial Sequence
  chemically synthesized
ccctttctaatcctccttctcc

SEQ ID NO: 666138 - DNA, 22 bp, Artificial Sequence
  chemically synthesized
cctttctaatcctccttctcca

SEQ ID NO: 666139 - DNA, 22 bp, Artificial Sequence
  chemically synthesized
tctaatcctccttctccactgc

SEQ ID NO: 666140 - DNA, 22 bp, Artificial Sequence
  chemically synthesized
ctaatcctccttctccactgcc

SEQ ID NO: 666141 - DNA, 22 bp, Artificial Sequence
  chemically synthesized
taatcctccttctccactgcct

SEQ ID NO: 666142 - DNA, 22 bp, Artificial Sequence
  chemically synthesized
atcctccttctccactgcctcg

SEQ ID NO: 666143 - DNA, 22 bp, Artificial Sequence
  chemically synthesized
ggcacatgagttacgaggcagt

SEQ ID NO: 666144 - DNA, 22 bp, Artificial Sequence
  chemically synthesized
cttctccactgcctcgtaactc

SEQ ID NO: 666145 - DNA, 22 bp, Artificial Sequence
  chemically synthesized
ctccactgcctcgtaactcatg

SEQ ID NO: 666146 - DNA, 22 bp, Artificial Sequence
  chemically synthesized
tccactgcctcgtaactcatgt

SEQ ID NO: 666147 - DNA, 22 bp, Artificial Sequence
  chemically synthesized
cactgcctcgtaactcatgtgc

SEQ ID NO: 666148 - DNA, 22 bp, Artificial Sequence
  chemically synthesized
cctcgtaactcatgtgcctagt

SEQ ID NO: 666149 - DNA, 22 bp, Artificial Sequence
  chemically synthesized
gtaactcatgtgcctagtttcc

SEQ ID NO: 666150 - DNA, 22 bp, Artificial Sequence
  chemically synthesized
aaagaagaaagatgataggaaa

SEQ ID NO: 666151 - DNA, 22 bp, Artificial Sequence
  chemically synthesized
gaaagaagaaagatgataggaa

SEQ ID NO: 666152 - DNA, 22 bp, Artificial Sequence
  chemically synthesized
atgtgcctagtttcctatcatc

SEQ ID NO: 666153 - DNA, 22 bp, Artificial Sequence
  chemically synthesized
tgaaagaagaaagatgatagga

SEQ ID NO: 666154 - DNA, 22 bp, Artificial Sequence
  chemically synthesized
tttgaaagaagaaagatgatag

SEQ ID NO: 666155 - DNA, 22 bp, Artificial Sequence
  chemically synthesized
gtttcctatcatctttcttctt

SEQ ID NO: 666156 - DNA, 22 bp, Artificial Sequence
  chemically synthesized
cctatcatctttcttctttcaa

SEQ ID NO: 666157 - DNA, 22 bp, Artificial Sequence
  chemically synthesized
ctatcatctttcttctttcaaa

SEQ ID NO: 666158 - DNA, 22 bp, Artificial Sequence
  chemically synthesized
tcatctttcttctttcaaagaa

SEQ ID NO: 666159 - DNA, 22 bp, Artificial Sequence
  chemically synthesized
tcttctttcaaagaacgacgat

SEQ ID NO: 666160 - DNA, 22 bp, Artificial Sequence
  chemically synthesized
cttctttcaaagaacgacgatt

SEQ ID NO: 666161 - DNA, 22 bp, Artificial Sequence
  chemically synthesized
ttctttcaaagaacgacgattc

SEQ ID NO: 666162 - DNA, 22 bp, Artificial Sequence
  chemically synthesized
ctttcaaagaacgacgattcct

SEQ ID NO: 666163 - DNA, 22 bp, Artificial Sequence
  chemically synthesized
gggtcataagagaggaatcgtc

SEQ ID NO: 666164 - DNA, 22 bp, Artificial Sequence
  chemically synthesized
tttcaaagaacgacgattcctc

SEQ ID NO: 666165 - DNA, 22 bp, Artificial Sequence
  chemically synthesized
tcaaagaacgacgattcctctc

SEQ ID NO: 666166 - DNA, 22 bp, Artificial Sequence
  chemically synthesized
caaagaacgacgattcctctct

SEQ ID NO: 666167 - DNA, 22 bp, Artificial Sequence
  chemically synthesized
aaagaacgacgattcctctctt

SEQ ID NO: 666168 - DNA, 22 bp, Artificial Sequence
  chemically synthesized
ctctcttatgaccccaattcta

SEQ ID NO: 666169 - DNA, 22 bp, Artificial Sequence
  chemically synthesized
tcttatgaccccaattctaccc

SEQ ID NO: 666170 - DNA, 22 bp, Artificial Sequence
  chemically synthesized
ttatgaccccaattctaccctc

SEQ ID NO: 666171 - DNA, 22 bp, Artificial Sequence
  chemically synthesized
atgaccccaattctaccctctt

SEQ ID NO: 666172 - DNA, 22 bp, Artificial Sequence
  chemically synthesized
tgaccccaattctaccctcttt

SEQ ID NO: 666173 - DNA, 22 bp, Artificial Sequence
  chemically synthesized
aatagaaccaggaaaataggaa

SEQ ID NO: 666174 - DNA, 22 bp, Artificial Sequence
  chemically synthesized
taccctcttttcctattttcct

SEQ ID NO: 666175 - DNA, 22 bp, Artificial Sequence
  chemically synthesized
ccctcttttcctattttcctgg

SEQ ID NO: 666176 - DNA, 22 bp, Artificial Sequence
  chemically synthesized
aatgctgaatagaaccaggaaa

SEQ ID NO: 666177 - DNA, 22 bp, Artificial Sequence
  chemically synthesized
taaatgctgaatagaaccagga

SEQ ID NO: 666178 - DNA, 22 bp, Artificial Sequence
  chemically synthesized
ttttcctattttcctggttcta

SEQ ID NO: 666179 - DNA, 22 bp, Artificial Sequence
  chemically synthesized
ttcctattttcctggttctatt

SEQ ID NO: 666180 - DNA, 22 bp, Artificial Sequence
  chemically synthesized
ttctaaatgctgaatagaacca

SEQ ID NO: 666181 - DNA, 22 bp, Artificial Sequence
  chemically synthesized
tcctattttcctggttctattc

SEQ ID NO: 666182 - DNA, 22 bp, Artificial Sequence
  chemically synthesized
gttctaaatgctgaatagaacc

SEQ ID NO: 666183 - DNA, 22 bp, Artificial Sequence
  chemically synthesized
cctattttcctggttctattca

SEQ ID NO: 666184 - DNA, 22 bp, Artificial Sequence
  chemically synthesized
ctattttcctggttctattcag

SEQ ID NO: 666185 - DNA, 22 bp, Artificial Sequence
  chemically synthesized
ttttcctggttctattcagcat

SEQ ID NO: 666186 - DNA, 22 bp, Artificial Sequence
  chemically synthesized
tcctggttctattcagcattta

SEQ ID NO: 666187 - DNA, 22 bp, Artificial Sequence
  chemically synthesized
gaccatttgttctaaatgctga

SEQ ID NO: 666188 - DNA, 22 bp, Artificial Sequence
  chemically synthesized
cctggttctattcagcatttag

SEQ ID NO: 666189 - DNA, 22 bp, Artificial Sequence
  chemically synthesized
agaccatttgttctaaatgctg

SEQ ID NO: 666190 - DNA, 22 bp, Artificial Sequence
  chemically synthesized
ctggttctattcagcatttaga

SEQ ID NO: 666191 - DNA, 22 bp, Artificial Sequence
  chemically synthesized
gttctattcagcatttagaaca

SEQ ID NO: 666192 - DNA, 22 bp, Artificial Sequence
  chemically synthesized
atttagaccatttgttctaaat

SEQ ID NO: 666193 - DNA, 22 bp, Artificial Sequence
  chemically synthesized
tattcagcatttagaacaaatg

SEQ ID NO: 666194 - DNA, 22 bp, Artificial Sequence
  chemically synthesized
ttcagcatttagaacaaatggt

SEQ ID NO: 666195 - DNA, 22 bp, Artificial Sequence
  chemically synthesized
tgacctcatttagaccatttgt

SEQ ID NO: 666196 - DNA, 22 bp, Artificial Sequence
  chemically synthesized
gtgacctcatttagaccatttg

SEQ ID NO: 666197 - DNA, 22 bp, Artificial Sequence
  chemically synthesized
agcatttagaacaaatggtcta

SEQ ID NO: 666198 - DNA, 22 bp, Artificial Sequence
  chemically synthesized
agaacaaatggtctaaatgagg

SEQ ID NO: 666199 - DNA, 22 bp, Artificial Sequence
  chemically synthesized
gaacaaatggtctaaatgaggt

SEQ ID NO: 666200 - DNA, 22 bp, Artificial Sequence
  chemically synthesized
gatggagcttgtgacctcattt

SEQ ID NO: 666201 - DNA, 22 bp, Artificial Sequence
  chemically synthesized
ggatggagcttgtgacctcatt

SEQ ID NO: 666202 - DNA, 22 bp, Artificial Sequence
  chemically synthesized
agatttggatggagcttgtgac

SEQ ID NO: 666203 - DNA, 22 bp, Artificial Sequence
  chemically synthesized
aatgaggtcacaagctccatcc

SEQ ID NO: 666204 - DNA, 22 bp, Artificial Sequence
  chemically synthesized
atatgaacgctaagatttggat

SEQ ID NO: 666205 - DNA, 22 bp, Artificial Sequence
  chemically synthesized
gatatgaacgctaagatttgga

SEQ ID NO: 666206 - DNA, 22 bp, Artificial Sequence
  chemically synthesized
ttgatatgaacgctaagatttg

SEQ ID NO: 666207 - DNA, 22 bp, Artificial Sequence
  chemically synthesized
ccaattcttgatatgaacgcta

SEQ ID NO: 666208 - DNA, 22 bp, Artificial Sequence
  chemically synthesized
catccaaatcttagcgttcata

SEQ ID NO: 666209 - DNA, 22 bp, Artificial Sequence
  chemically synthesized
gccaattcttgatatgaacgct

SEQ ID NO: 666210 - DNA, 22 bp, Artificial Sequence
  chemically synthesized
gaatttgccaattcttgatatg

SEQ ID NO: 666211 - DNA, 22 bp, Artificial Sequence
  chemically synthesized
ctggaatttgccaattcttgat

SEQ ID NO: 666212 - DNA, 22 bp, Artificial Sequence
  chemically synthesized
agcgttcatatcaagaattggc

SEQ ID NO: 666213 - DNA, 22 bp, Artificial Sequence
  chemically synthesized
gcgttcatatcaagaattggca

SEQ ID NO: 666214 - DNA, 22 bp, Artificial Sequence
  chemically synthesized
gctactggaatttgccaattct

SEQ ID NO: 666215 - DNA, 22 bp, Artificial Sequence
  chemically synthesized
tagctactggaatttgccaatt

SEQ ID NO: 666216 - DNA, 22 bp, Artificial Sequence
  chemically synthesized
atatcaagaattggcaaattcc

SEQ ID NO: 666217 - DNA, 22 bp, Artificial Sequence
  chemically synthesized
gatctctagctactggaatttg

SEQ ID NO: 666218 - DNA, 22 bp, Artificial Sequence
  chemically synthesized
ggatctctagctactggaattt

SEQ ID NO: 666219 - DNA, 22 bp, Artificial Sequence
  chemically synthesized
ccacttggatctctagctactg

SEQ ID NO: 666220 - DNA, 22 bp, Artificial Sequence
  chemically synthesized
tcccacttggatctctagctac

SEQ ID NO: 666221 - DNA, 22 bp, Artificial Sequence
  chemically synthesized
gcaaattccagtagctagagat

SEQ ID NO: 666222 - DNA, 22 bp, Artificial Sequence
  chemically synthesized
cctctcccacttggatctctag

SEQ ID NO: 666223 - DNA, 22 bp, Artificial Sequence
  chemically synthesized
gcctctcccacttggatctcta

SEQ ID NO: 666224 - DNA, 22 bp, Artificial Sequence
  chemically synthesized
ttgcctctcccacttggatctc

SEQ ID NO: 666225 - DNA, 22 bp, Artificial Sequence
  chemically synthesized
cagtagctagagatccaagtgg

SEQ ID NO: 666226 - DNA, 22 bp, Artificial Sequence
  chemically synthesized
gagatccaagtgggagaggcaa

SEQ ID NO: 666227 - DNA, 22 bp, Artificial Sequence
  chemically synthesized
aaagaatcagatcattcttgcc

SEQ ID NO: 666228 - DNA, 22 bp, Artificial Sequence
  chemically synthesized
atgccctgaaagaatcagatca

SEQ ID NO: 666229 - DNA, 22 bp, Artificial Sequence
  chemically synthesized
atattcatgccctgaaagaatc

SEQ ID NO: 666230 - DNA, 22 bp, Artificial Sequence
  chemically synthesized
cacactaatattcatgccctga

SEQ ID NO: 666231 - DNA, 22 bp, Artificial Sequence
  chemically synthesized
ttccacactaatattcatgccc

SEQ ID NO: 666232 - DNA, 22 bp, Artificial Sequence
  chemically synthesized
attctttcagggcatgaatatt

SEQ ID NO: 666233 - DNA, 22 bp, Artificial Sequence
  chemically synthesized
atactgttccacactaatattc

SEQ ID NO: 666234 - DNA, 22 bp, Artificial Sequence
  chemically synthesized
tttcagggcatgaatattagtg

SEQ ID NO: 666235 - DNA, 22 bp, Artificial Sequence
  chemically synthesized
tgatactgttccacactaatat

SEQ ID NO: 666236 - DNA, 22 bp, Artificial Sequence
  chemically synthesized
tcagggcatgaatattagtgtg

SEQ ID NO: 666237 - DNA, 22 bp, Artificial Sequence
  chemically synthesized
cagggcatgaatattagtgtgg

SEQ ID NO: 666238 - DNA, 22 bp, Artificial Sequence
  chemically synthesized
agggcatgaatattagtgtgga

SEQ ID NO: 666239 - DNA, 22 bp, Artificial Sequence
  chemically synthesized
aactctgatactgttccacact

SEQ ID NO: 666240 - DNA, 22 bp, Artificial Sequence
  chemically synthesized
gaactctgatactgttccacac

SEQ ID NO: 666241 - DNA, 22 bp, Artificial Sequence
  chemically synthesized
gtgtggaacagtatcagagttc

SEQ ID NO: 666242 - DNA, 22 bp, Artificial Sequence
  chemically synthesized
gaagggaagaaagtttgaactc

SEQ ID NO: 666243 - DNA, 22 bp, Artificial Sequence
  chemically synthesized
agaagggaagaaagtttgaact

SEQ ID NO: 666244 - DNA, 22 bp, Artificial Sequence
  chemically synthesized
gaagtatttagaagggaagaaa

SEQ ID NO: 666245 - DNA, 22 bp, Artificial Sequence
  chemically synthesized
aaactttcttcccttctaaata

SEQ ID NO: 666246 - DNA, 22 bp, Artificial Sequence
  chemically synthesized
tcttcccttctaaatacttcta

SEQ ID NO: 666247 - DNA, 22 bp, Artificial Sequence
  chemically synthesized
cttcccttctaaatacttctaa

SEQ ID NO: 666248 - DNA, 22 bp, Artificial Sequence
  chemically synthesized
ttcccttctaaatacttctaac

SEQ ID NO: 666249 - DNA, 22 bp, Artificial Sequence
  chemically synthesized
cccttctaaatacttctaacta

SEQ ID NO: 666250 - DNA, 22 bp, Artificial Sequence
  chemically synthesized
ccttctaaatacttctaactat

SEQ ID NO: 666251 - DNA, 22 bp, Artificial Sequence
  chemically synthesized
gaggcagaatgtgtcatagtta

SEQ ID NO: 666252 - DNA, 22 bp, Artificial Sequence
  chemically synthesized
ctaaatacttctaactatgaca

SEQ ID NO: 666253 - DNA, 22 bp, Artificial Sequence
  chemically synthesized
taaatacttctaactatgacac

SEQ ID NO: 666254 - DNA, 22 bp, Artificial Sequence
  chemically synthesized
aatacttctaactatgacacat

SEQ ID NO: 666255 - DNA, 22 bp, Artificial Sequence
  chemically synthesized
actagaggcagaatgtgtcata

SEQ ID NO: 666256 - DNA, 22 bp, Artificial Sequence
  chemically synthesized
ctaactatgacacattctgcct

SEQ ID NO: 666257 - DNA, 22 bp, Artificial Sequence
  chemically synthesized
taactatgacacattctgcctc

SEQ ID NO: 666258 - DNA, 22 bp, Artificial Sequence
  chemically synthesized
actatgacacattctgcctcta

SEQ ID NO: 666259 - DNA, 22 bp, Artificial Sequence
  chemically synthesized
tgacacattctgcctctagtta

SEQ ID NO: 666260 - DNA, 22 bp, Artificial Sequence
  chemically synthesized
aaaagatgtcagggaggattaa

SEQ ID NO: 666261 - DNA, 22 bp, Artificial Sequence
  chemically synthesized
tgcctctagttaatcctccctg

SEQ ID NO: 666262 - DNA, 22 bp, Artificial Sequence
  chemically synthesized
cctctagttaatcctccctgac

SEQ ID NO: 666263 - DNA, 22 bp, Artificial Sequence
  chemically synthesized
tagttaatcctccctgacatct

SEQ ID NO: 666264 - DNA, 22 bp, Artificial Sequence
  chemically synthesized
gttaatcctccctgacatcttt

SEQ ID NO: 666265 - DNA, 22 bp, Artificial Sequence
  chemically synthesized
ggggtaggctgaaaagatgtca

SEQ ID NO: 666266 - DNA, 22 bp, Artificial Sequence
  chemically synthesized
atcctccctgacatcttttcag

SEQ ID NO: 666267 - DNA, 22 bp, Artificial Sequence
  chemically synthesized
cctgacatcttttcagcctacc

SEQ ID NO: 666268 - DNA, 22 bp, Artificial Sequence
  chemically synthesized
cagtgggttgggggtaggctga

SEQ ID NO: 666269 - DNA, 22 bp, Artificial Sequence
  chemically synthesized
acatcttttcagcctaccccca

SEQ ID NO: 666270 - DNA, 22 bp, Artificial Sequence
  chemically synthesized
actgcagtgggttgggggtagg

SEQ ID NO: 666271 - DNA, 22 bp, Artificial Sequence
  chemically synthesized
ttcactgcagtgggttgggggt

SEQ ID NO: 666272 - DNA, 22 bp, Artificial Sequence
  chemically synthesized
attcactgcagtgggttggggg

SEQ ID NO: 666273 - DNA, 22 bp, Artificial Sequence
  chemically synthesized
ttcagcctacccccaacccact

SEQ ID NO: 666274 - DNA, 22 bp, Artificial Sequence
  chemically synthesized
tcagcctacccccaacccactg

SEQ ID NO: 666275 - DNA, 22 bp, Artificial Sequence
  chemically synthesized
cagcctacccccaacccactgc

SEQ ID NO: 666276 - DNA, 22 bp, Artificial Sequence
  chemically synthesized
agcctacccccaacccactgca

SEQ ID NO: 666277 - DNA, 22 bp, Artificial Sequence
  chemically synthesized
cccccaacccactgcagtgaat

SEQ ID NO: 666278 - DNA, 22 bp, Artificial Sequence
  chemically synthesized
gtagcagaaggcttattcactg

SEQ ID NO: 666279 - DNA, 22 bp, Artificial Sequence
  chemically synthesized
cagtgaataagccttctgctac

SEQ ID NO: 666280 - DNA, 22 bp, Artificial Sequence
  chemically synthesized
gtgcgtggaaaactggtagcag

SEQ ID NO: 666281 - DNA, 22 bp, Artificial Sequence
  chemically synthesized
ggtgcgtggaaaactggtagca

SEQ ID NO: 666282 - DNA, 22 bp, Artificial Sequence
  chemically synthesized
tggtgcgtggaaaactggtagc

SEQ ID NO: 666283 - DNA, 22 bp, Artificial Sequence
  chemically synthesized
gactttggtgcgtggaaaactg

SEQ ID NO: 666284 - DNA, 22 bp, Artificial Sequence
  chemically synthesized
ctgctaccagttttccacgcac

SEQ ID NO: 666285 - DNA, 22 bp, Artificial Sequence
  chemically synthesized
tgctaccagttttccacgcacc

SEQ ID NO: 666286 - DNA, 22 bp, Artificial Sequence
  chemically synthesized
ctaccagttttccacgcaccaa

SEQ ID NO: 666287 - DNA, 22 bp, Artificial Sequence
  chemically synthesized
ccagttttccacgcaccaaagt

SEQ ID NO: 666288 - DNA, 22 bp, Artificial Sequence
  chemically synthesized
agaatggattggactttggtgc

SEQ ID NO: 666289 - DNA, 22 bp, Artificial Sequence
  chemically synthesized
gagaatggattggactttggtg

SEQ ID NO: 666290 - DNA, 22 bp, Artificial Sequence
  chemically synthesized
tttgagaatggattggactttg

SEQ ID NO: 666291 - DNA, 22 bp, Artificial Sequence
  chemically synthesized
tccacgcaccaaagtccaatcc

SEQ ID NO: 666292 - DNA, 22 bp, Artificial Sequence
  chemically synthesized
ccacgcaccaaagtccaatcca

SEQ ID NO: 666293 - DNA, 22 bp, Artificial Sequence
  chemically synthesized
cacgcaccaaagtccaatccat

SEQ ID NO: 666294 - DNA, 22 bp, Artificial Sequence
  chemically synthesized
aatcactgtttgagaatggatt

SEQ ID NO: 666295 - DNA, 22 bp, Artificial Sequence
  chemically synthesized
gtatgcctgaatcactgtttga

SEQ ID NO: 666296 - DNA, 22 bp, Artificial Sequence
  chemically synthesized
tggtatgcctgaatcactgttt

SEQ ID NO: 666297 - DNA, 22 bp, Artificial Sequence
  chemically synthesized
ctggtatgcctgaatcactgtt

SEQ ID NO: 666298 - DNA, 22 bp, Artificial Sequence
  chemically synthesized
ttctggtatgcctgaatcactg

SEQ ID NO: 666299 - DNA, 22 bp, Artificial Sequence
  chemically synthesized
cttctggtatgcctgaatcact

SEQ ID NO: 666300 - DNA, 22 bp, Artificial Sequence
  chemically synthesized
tcttctggtatgcctgaatcac

SEQ ID NO: 666301 - DNA, 22 bp, Artificial Sequence
  chemically synthesized
ctttcttctggtatgcctgaat

SEQ ID NO: 666302 - DNA, 22 bp, Artificial Sequence
  chemically synthesized
tcaaacagtgattcaggcatac

SEQ ID NO: 666303 - DNA, 22 bp, Artificial Sequence
  chemically synthesized
ctactttcttctggtatgcctg

SEQ ID NO: 666304 - DNA, 22 bp, Artificial Sequence
  chemically synthesized
aaacagtgattcaggcatacca

SEQ ID NO: 666305 - DNA, 22 bp, Artificial Sequence
  chemically synthesized
cctgctactttcttctggtatg

SEQ ID NO: 666306 - DNA, 22 bp, Artificial Sequence
  chemically synthesized
aggcataccagaagaaagtagc

SEQ ID NO: 666307 - DNA, 22 bp, Artificial Sequence
  chemically synthesized
gaggcattccctgctactttct

SEQ ID NO: 666308 - DNA, 22 bp, Artificial Sequence
  chemically synthesized
agccaaaagaacaaagctggag

SEQ ID NO: 666309 - DNA, 22 bp, Artificial Sequence
  chemically synthesized
ccaagtcagtcctaagccaaaa

SEQ ID NO: 666310 - DNA, 22 bp, Artificial Sequence
  chemically synthesized
cagctttgttcttttggcttag

SEQ ID NO: 666311 - DNA, 22 bp, Artificial Sequence
  chemically synthesized
tgttcttttggcttaggactga

SEQ ID NO: 666312 - DNA, 22 bp, Artificial Sequence
  chemically synthesized
gttcttttggcttaggactgac

SEQ ID NO: 666313 - DNA, 22 bp, Artificial Sequence
  chemically synthesized
ttcttttggcttaggactgact

SEQ ID NO: 666314 - DNA, 22 bp, Artificial Sequence
  chemically synthesized
ttttggcttaggactgacttgg

SEQ ID NO: 666315 - DNA, 22 bp, Artificial Sequence
  chemically synthesized
ttggcttaggactgacttggca

SEQ ID NO: 666316 - DNA, 22 bp, Artificial Sequence
  chemically synthesized
tggcttaggactgacttggcaa

SEQ ID NO: 666317 - DNA, 22 bp, Artificial Sequence
  chemically synthesized
ggcttaggactgacttggcaat

SEQ ID NO: 666318 - DNA, 22 bp, Artificial Sequence
  chemically synthesized
gcttaggactgacttggcaatg

SEQ ID NO: 666319 - DNA, 22 bp, Artificial Sequence
  chemically synthesized
aggactgacttggcaatgcggg

SEQ ID NO: 666320 - DNA, 22 bp, Artificial Sequence
  chemically synthesized
ggactgacttggcaatgcgggc

SEQ ID NO: 666321 - DNA, 22 bp, Artificial Sequence
  chemically synthesized
acttggcaatgcgggctctttt

SEQ ID NO: 666322 - DNA, 22 bp, Artificial Sequence
  chemically synthesized
atatggaaccaaaaaagagccc

SEQ ID NO: 666323 - DNA, 22 bp, Artificial Sequence
  chemically synthesized
ggcaatgcgggctcttttttgg

SEQ ID NO: 666324 - DNA, 22 bp, Artificial Sequence
  chemically synthesized
gcaatgcgggctcttttttggt

SEQ ID NO: 666325 - DNA, 22 bp, Artificial Sequence
  chemically synthesized
aagttcatatggaaccaaaaaa

SEQ ID NO: 666326 - DNA, 22 bp, Artificial Sequence
  chemically synthesized
aaagttcatatggaaccaaaaa

SEQ ID NO: 666327 - DNA, 22 bp, Artificial Sequence
  chemically synthesized
taaagttcatatggaaccaaaa

SEQ ID NO: 666328 - DNA, 22 bp, Artificial Sequence
  chemically synthesized
ctttaaagttcatatggaacca

SEQ ID NO: 666329 - DNA, 22 bp, Artificial Sequence
  chemically synthesized
ttttttggttccatatgaactt

SEQ ID NO: 666330 - DNA, 22 bp, Artificial Sequence
  chemically synthesized
ttttggttccatatgaacttta

SEQ ID NO: 666331 - DNA, 22 bp, Artificial Sequence
  chemically synthesized
tttggttccatatgaactttaa

SEQ ID NO: 666332 - DNA, 22 bp, Artificial Sequence
  chemically synthesized
gaaaaaactactttaaagttca

SEQ ID NO: 666333 - DNA, 22 bp, Artificial Sequence
  chemically synthesized
ttggttccatatgaactttaaa

SEQ ID NO: 666334 - DNA, 22 bp, Artificial Sequence
  chemically synthesized
tggttccatatgaactttaaag

SEQ ID NO: 666335 - DNA, 22 bp, Artificial Sequence
  chemically synthesized
ggttccatatgaactttaaagt

SEQ ID NO: 666336 - DNA, 22 bp, Artificial Sequence
  chemically synthesized
gttccatatgaactttaaagta

SEQ ID NO: 666337 - DNA, 22 bp, Artificial Sequence
  chemically synthesized
catatgaactttaaagtagttt

SEQ ID NO: 666338 - DNA, 22 bp, Artificial Sequence
  chemically synthesized
acagaattggaaaaaactactt

SEQ ID NO: 666339 - DNA, 22 bp, Artificial Sequence
  chemically synthesized
cacagaattggaaaaaactact

SEQ ID NO: 666340 - DNA, 22 bp, Artificial Sequence
  chemically synthesized
ttcacagaattggaaaaaacta

SEQ ID NO: 666341 - DNA, 22 bp, Artificial Sequence
  chemically synthesized
cttcacagaattggaaaaaact

SEQ ID NO: 666342 - DNA, 22 bp, Artificial Sequence
  chemically synthesized
tcttcacagaattggaaaaaac

SEQ ID NO: 666343 - DNA, 22 bp, Artificial Sequence
  chemically synthesized
taaagtagttttttccaattct

SEQ ID NO: 666344 - DNA, 22 bp, Artificial Sequence
  chemically synthesized
aaagtagttttttccaattctg

SEQ ID NO: 666345 - DNA, 22 bp, Artificial Sequence
  chemically synthesized
aagtagttttttccaattctgt

SEQ ID NO: 666346 - DNA, 22 bp, Artificial Sequence
  chemically synthesized
ccaatgactttcttcacagaat

SEQ ID NO: 666347 - DNA, 22 bp, Artificial Sequence
  chemically synthesized
tttccaattctgtgaagaaagt

SEQ ID NO: 666348 - DNA, 22 bp, Artificial Sequence
  chemically synthesized
ttccaattctgtgaagaaagtc

SEQ ID NO: 666349 - DNA, 22 bp, Artificial Sequence
  chemically synthesized
tccaattctgtgaagaaagtca

SEQ ID NO: 666350 - DNA, 22 bp, Artificial Sequence
  chemically synthesized
ccaattctgtgaagaaagtcat

SEQ ID NO: 666351 - DNA, 22 bp, Artificial Sequence
  chemically synthesized
caattctgtgaagaaagtcatt

SEQ ID NO: 666352 - DNA, 22 bp, Artificial Sequence
  chemically synthesized
tgtgaagaaagtcattggtagc

SEQ ID NO: 666353 - DNA, 22 bp, Artificial Sequence
  chemically synthesized
tgaagaaagtcattggtagctt

SEQ ID NO: 666354 - DNA, 22 bp, Artificial Sequence
  chemically synthesized
aatgccatccccatcaagctac

SEQ ID NO: 666355 - DNA, 22 bp, Artificial Sequence
  chemically synthesized
cagattcaatgccatccccatc

SEQ ID NO: 666356 - DNA, 22 bp, Artificial Sequence
  chemically synthesized
acagattcaatgccatccccat

SEQ ID NO: 666357 - DNA, 22 bp, Artificial Sequence
  chemically synthesized
gtagcttgatggggatggcatt

SEQ ID NO: 666358 - DNA, 22 bp, Artificial Sequence
  chemically synthesized
gatggggatggcattgaatctg

SEQ ID NO: 666359 - DNA, 22 bp, Artificial Sequence
  chemically synthesized
atggggatggcattgaatctgt

SEQ ID NO: 666360 - DNA, 22 bp, Artificial Sequence
  chemically synthesized
cccaaggtaatttacagattca

SEQ ID NO: 666361 - DNA, 22 bp, Artificial Sequence
  chemically synthesized
aatctgtaaattaccttgggca

SEQ ID NO: 666362 - DNA, 22 bp, Artificial Sequence
  chemically synthesized
taaattaccttgggcagtatga

SEQ ID NO: 666363 - DNA, 22 bp, Artificial Sequence
  chemically synthesized
ccttgggcagtatgaccatttt

SEQ ID NO: 666364 - DNA, 22 bp, Artificial Sequence
  chemically synthesized
gggcagtatgaccattttcacg

SEQ ID NO: 666365 - DNA, 22 bp, Artificial Sequence
  chemically synthesized
ggcagtatgaccattttcacga

SEQ ID NO: 666366 - DNA, 22 bp, Artificial Sequence
  chemically synthesized
atgggtaggaagaatcaatatc

SEQ ID NO: 666367 - DNA, 22 bp, Artificial Sequence
  chemically synthesized
catgctcatgggtaggaagaat

SEQ ID NO: 666368 - DNA, 22 bp, Artificial Sequence
  chemically synthesized
tcacgatattgattcttcctac

SEQ ID NO: 666369 - DNA, 22 bp, Artificial Sequence
  chemically synthesized
cacgatattgattcttcctacc

SEQ ID NO: 666370 - DNA, 22 bp, Artificial Sequence
  chemically synthesized
acgatattgattcttcctaccc

SEQ ID NO: 666371 - DNA, 22 bp, Artificial Sequence
  chemically synthesized
attcttcctacccatgagcatg

SEQ ID NO: 666372 - DNA, 22 bp, Artificial Sequence
  chemically synthesized
ttcctacccatgagcatggaat

SEQ ID NO: 666373 - DNA, 22 bp, Artificial Sequence
  chemically synthesized
cctacccatgagcatggaatgt

SEQ ID NO: 666374 - DNA, 22 bp, Artificial Sequence
  chemically synthesized
ctacccatgagcatggaatgtt

SEQ ID NO: 666375 - DNA, 22 bp, Artificial Sequence
  chemically synthesized
cccatgagcatggaatgttctt

SEQ ID NO: 666376 - DNA, 22 bp, Artificial Sequence
  chemically synthesized
aaggaaataaaagaggatacaa

SEQ ID NO: 666377 - DNA, 22 bp, Artificial Sequence
  chemically synthesized
ttccatttgtttgtatcctctt

SEQ ID NO: 666378 - DNA, 22 bp, Artificial Sequence
  chemically synthesized
ctcaaggaaataaaagaggata

SEQ ID NO: 666379 - DNA, 22 bp, Artificial Sequence
  chemically synthesized
ccatttgtttgtatcctctttt

SEQ ID NO: 666380 - DNA, 22 bp, Artificial Sequence
  chemically synthesized
catttgtttgtatcctctttta

SEQ ID NO: 666381 - DNA, 22 bp, Artificial Sequence
  chemically synthesized
gtttgtatcctcttttatttcc

SEQ ID NO: 666382 - DNA, 22 bp, Artificial Sequence
  chemically synthesized
tttgtatcctcttttatttcct

SEQ ID NO: 666383 - DNA, 22 bp, Artificial Sequence
  chemically synthesized
caaaccactgctcaaggaaata

SEQ ID NO: 666384 - DNA, 22 bp, Artificial Sequence
  chemically synthesized
gtatcctcttttatttccttga

SEQ ID NO: 666385 - DNA, 22 bp, Artificial Sequence
  chemically synthesized
tatcctcttttatttccttgag

SEQ ID NO: 666386 - DNA, 22 bp, Artificial Sequence
  chemically synthesized
ttttatttccttgagcagtggt

SEQ ID NO: 666387 - DNA, 22 bp, Artificial Sequence
  chemically synthesized
ttatttccttgagcagtggttt

SEQ ID NO: 666388 - DNA, 22 bp, Artificial Sequence
  chemically synthesized
aaggagaactacaaaccactgc

SEQ ID NO: 666389 - DNA, 22 bp, Artificial Sequence
  chemically synthesized
tatttccttgagcagtggtttg

SEQ ID NO: 666390 - DNA, 22 bp, Artificial Sequence
  chemically synthesized
caaggagaactacaaaccactg

SEQ ID NO: 666391 - DNA, 22 bp, Artificial Sequence
  chemically synthesized
atttccttgagcagtggtttgt

SEQ ID NO: 666392 - DNA, 22 bp, Artificial Sequence
  chemically synthesized
tttccttgagcagtggtttgta

SEQ ID NO: 666393 - DNA, 22 bp, Artificial Sequence
  chemically synthesized
ttcaaggagaactacaaaccac

SEQ ID NO: 666394 - DNA, 22 bp, Artificial Sequence
  chemically synthesized
ccttgagcagtggtttgtagtt

SEQ ID NO: 666395 - DNA, 22 bp, Artificial Sequence
  chemically synthesized
cttgagcagtggtttgtagttc

SEQ ID NO: 666396 - DNA, 22 bp, Artificial Sequence
  chemically synthesized
gagcagtggtttgtagttctcc

SEQ ID NO: 666397 - DNA, 22 bp, Artificial Sequence
  chemically synthesized
agcagtggtttgtagttctcct

SEQ ID NO: 666398 - DNA, 22 bp, Artificial Sequence
  chemically synthesized
gtagttctccttgaagaggtcc

SEQ ID NO: 666399 - DNA, 22 bp, Artificial Sequence
  chemically synthesized
tagttctccttgaagaggtcct

SEQ ID NO: 666400 - DNA, 22 bp, Artificial Sequence
  chemically synthesized
tccttgaagaggtccttcacat

SEQ ID NO: 666401 - DNA, 22 bp, Artificial Sequence
  chemically synthesized
cttgaagaggtccttcacattg

SEQ ID NO: 666402 - DNA, 22 bp, Artificial Sequence
  chemically synthesized
tgaataatgccacaatgtgaag

SEQ ID NO: 666403 - DNA, 22 bp, Artificial Sequence
  chemically synthesized
gaagaggtccttcacattgtgg

SEQ ID NO: 666404 - DNA, 22 bp, Artificial Sequence
  chemically synthesized
ttgtgaataatgccacaatgtg

SEQ ID NO: 666405 - DNA, 22 bp, Artificial Sequence
  chemically synthesized
aagaggtccttcacattgtggc

SEQ ID NO: 666406 - DNA, 22 bp, Artificial Sequence
  chemically synthesized
ctattgtgaataatgccacaat

SEQ ID NO: 666407 - DNA, 22 bp, Artificial Sequence
  chemically synthesized
gctattgtgaataatgccacaa

SEQ ID NO: 666408 - DNA, 22 bp, Artificial Sequence
  chemically synthesized
tgctattgtgaataatgccaca

SEQ ID NO: 666409 - DNA, 22 bp, Artificial Sequence
  chemically synthesized
cacattgtggcattattcacaa

SEQ ID NO: 666410 - DNA, 22 bp, Artificial Sequence
  chemically synthesized
acattgtggcattattcacaat

SEQ ID NO: 666411 - DNA, 22 bp, Artificial Sequence
  chemically synthesized
caagtctttgctattgtgaata

SEQ ID NO: 666412 - DNA, 22 bp, Artificial Sequence
  chemically synthesized
gttccaagtctttgctattgtg

SEQ ID NO: 666413 - DNA, 22 bp, Artificial Sequence
  chemically synthesized
tggcattattcacaatagcaaa

SEQ ID NO: 666414 - DNA, 22 bp, Artificial Sequence
  chemically synthesized
ggttggttccaagtctttgcta

SEQ ID NO: 666415 - DNA, 22 bp, Artificial Sequence
  chemically synthesized
gggttggttccaagtctttgct

SEQ ID NO: 666416 - DNA, 22 bp, Artificial Sequence
  chemically synthesized
ttcacaatagcaaagacttgga

SEQ ID NO: 666417 - DNA, 22 bp, Artificial Sequence
  chemically synthesized
acaatagcaaagacttggaacc

SEQ ID NO: 666418 - DNA, 22 bp, Artificial Sequence
  chemically synthesized
gacatttgggttggttccaagt

SEQ ID NO: 666419 - DNA, 22 bp, Artificial Sequence
  chemically synthesized
ttggacatttgggttggttcca

SEQ ID NO: 666420 - DNA, 22 bp, Artificial Sequence
  chemically synthesized
tcattgttggacatttgggttg

SEQ ID NO: 666421 - DNA, 22 bp, Artificial Sequence
  chemically synthesized
ggaaccaacccaaatgtccaac

SEQ ID NO: 666422 - DNA, 22 bp, Artificial Sequence
  chemically synthesized
gaaccaacccaaatgtccaaca

SEQ ID NO: 666423 - DNA, 22 bp, Artificial Sequence
  chemically synthesized
atccagtctatcattgttggac

SEQ ID NO: 666424 - DNA, 22 bp, Artificial Sequence
  chemically synthesized
aatccagtctatcattgttgga

SEQ ID NO: 666425 - DNA, 22 bp, Artificial Sequence
  chemically synthesized
ttaatccagtctatcattgttg

SEQ ID NO: 666426 - DNA, 22 bp, Artificial Sequence
  chemically synthesized
cttaatccagtctatcattgtt

SEQ ID NO: 666427 - DNA, 22 bp, Artificial Sequence
  chemically synthesized
tcttaatccagtctatcattgt

SEQ ID NO: 666428 - DNA, 22 bp, Artificial Sequence
  chemically synthesized
catggtgtatatgtgccacatt

SEQ ID NO: 666429 - DNA, 22 bp, Artificial Sequence
  chemically synthesized
gattaagaaaatgtggcacata

SEQ ID NO: 666430 - DNA, 22 bp, Artificial Sequence
  chemically synthesized
agaaaatgtggcacatatacac

SEQ ID NO: 666431 - DNA, 22 bp, Artificial Sequence
  chemically synthesized
catagtattccatggtgtatat

SEQ ID NO: 666432 - DNA, 22 bp, Artificial Sequence
  chemically synthesized
tggctgcatagtattccatggt

SEQ ID NO: 666433 - DNA, 22 bp, Artificial Sequence
  chemically synthesized
atggctgcatagtattccatgg

SEQ ID NO: 666434 - DNA, 22 bp, Artificial Sequence
  chemically synthesized
tatggctgcatagtattccatg

SEQ ID NO: 666435 - DNA, 22 bp, Artificial Sequence
  chemically synthesized
ttatggctgcatagtattccat

SEQ ID NO: 666436 - DNA, 22 bp, Artificial Sequence
  chemically synthesized
tttatggctgcatagtattcca

SEQ ID NO: 666437 - DNA, 22 bp, Artificial Sequence
  chemically synthesized
ttttatggctgcatagtattcc

SEQ ID NO: 666438 - DNA, 22 bp, Artificial Sequence
  chemically synthesized
atccttttttatggctgcatag

SEQ ID NO: 666439 - DNA, 22 bp, Artificial Sequence
  chemically synthesized
tgcagccataaaaaaggatgag

SEQ ID NO: 666440 - DNA, 22 bp, Artificial Sequence
  chemically synthesized
caaaggacatgaactcatcctt

SEQ ID NO: 666441 - DNA, 22 bp, Artificial Sequence
  chemically synthesized
atccatgtccctacaaaggaca

SEQ ID NO: 666442 - DNA, 22 bp, Artificial Sequence
  chemically synthesized
catccatgtccctacaaaggac

SEQ ID NO: 666443 - DNA, 22 bp, Artificial Sequence
  chemically synthesized
caatttcatccatgtccctaca

SEQ ID NO: 666444 - DNA, 22 bp, Artificial Sequence
  chemically synthesized
ccaatttcatccatgtccctac

SEQ ID NO: 666445 - DNA, 22 bp, Artificial Sequence
  chemically synthesized
atgtcctttgtagggacatgga

SEQ ID NO: 666446 - DNA, 22 bp, Artificial Sequence
  chemically synthesized
tgtagggacatggatgaaattg

SEQ ID NO: 666447 - DNA, 22 bp, Artificial Sequence
  chemically synthesized
gtagggacatggatgaaattgg

SEQ ID NO: 666448 - DNA, 22 bp, Artificial Sequence
  chemically synthesized
tagggacatggatgaaattgga

SEQ ID NO: 666449 - DNA, 22 bp, Artificial Sequence
  chemically synthesized
agaatgatgatttccaatttca

SEQ ID NO: 666450 - DNA, 22 bp, Artificial Sequence
  chemically synthesized
ctgagaatgatgatttccaatt

SEQ ID NO: 666451 - DNA, 22 bp, Artificial Sequence
  chemically synthesized
actgagaatgatgatttccaat

SEQ ID NO: 666452 - DNA, 22 bp, Artificial Sequence
  chemically synthesized
cgatagtttactgagaatgatg

SEQ ID NO: 666453 - DNA, 22 bp, Artificial Sequence
  chemically synthesized
gcgatagtttactgagaatgat

SEQ ID NO: 666454 - DNA, 22 bp, Artificial Sequence
  chemically synthesized
ttgcgatagtttactgagaatg

SEQ ID NO: 666455 - DNA, 22 bp, Artificial Sequence
  chemically synthesized
ttcttgcgatagtttactgaga

SEQ ID NO: 666456 - DNA, 22 bp, Artificial Sequence
  chemically synthesized
gaaatcatcattctcagtaaac

SEQ ID NO: 666457 - DNA, 22 bp, Artificial Sequence
  chemically synthesized
gttcttgcgatagtttactgag

SEQ ID NO: 666458 - DNA, 22 bp, Artificial Sequence
  chemically synthesized
tgttcttgcgatagtttactga

SEQ ID NO: 666459 - DNA, 22 bp, Artificial Sequence
  chemically synthesized
ttgttcttgcgatagtttactg

SEQ ID NO: 666460 - DNA, 22 bp, Artificial Sequence
  chemically synthesized
tttgttcttgcgatagtttact

SEQ ID NO: 666461 - DNA, 22 bp, Artificial Sequence
  chemically synthesized
gttttttgttcttgcgatagtt

SEQ ID NO: 666462 - DNA, 22 bp, Artificial Sequence
  chemically synthesized
ggttttttgttcttgcgatagt

SEQ ID NO: 666463 - DNA, 22 bp, Artificial Sequence
  chemically synthesized
tcagtaaactatcgcaagaaca

SEQ ID NO: 666464 - DNA, 22 bp, Artificial Sequence
  chemically synthesized
agtaaactatcgcaagaacaaa

SEQ ID NO: 666465 - DNA, 22 bp, Artificial Sequence
  chemically synthesized
tcgcaagaacaaaaaaccaaac

SEQ ID NO: 666466 - DNA, 22 bp, Artificial Sequence
  chemically synthesized
tgagtgagaatatgcggtgttt

SEQ ID NO: 666467 - DNA, 22 bp, Artificial Sequence
  chemically synthesized
ccacctatgagtgagaatatgc

SEQ ID NO: 666468 - DNA, 22 bp, Artificial Sequence
  chemically synthesized
aattcccacctatgagtgagaa

SEQ ID NO: 666469 - DNA, 22 bp, Artificial Sequence
  chemically synthesized
ttcaattcccacctatgagtga

SEQ ID NO: 666470 - DNA, 22 bp, Artificial Sequence
  chemically synthesized
attgttcaattcccacctatga

SEQ ID NO: 666471 - DNA, 22 bp, Artificial Sequence
  chemically synthesized
tcactcataggtgggaattgaa

SEQ ID NO: 666472 - DNA, 22 bp, Artificial Sequence
  chemically synthesized
actcataggtgggaattgaaca

SEQ ID NO: 666473 - DNA, 22 bp, Artificial Sequence
  chemically synthesized
ataggtgggaattgaacaatga

SEQ ID NO: 666474 - DNA, 22 bp, Artificial Sequence
  chemically synthesized
tgtccatgtgatctcattgttc

SEQ ID NO: 666475 - DNA, 22 bp, Artificial Sequence
  chemically synthesized
ctgtgtccatgtgatctcattg

SEQ ID NO: 666476 - DNA, 22 bp, Artificial Sequence
  chemically synthesized
cctgtgtccatgtgatctcatt

SEQ ID NO: 666477 - DNA, 22 bp, Artificial Sequence
  chemically synthesized
cccttcctgtgtccatgtgatc

SEQ ID NO: 666478 - DNA, 22 bp, Artificial Sequence
  chemically synthesized
aacaatgagatcacatggacac

SEQ ID NO: 666479 - DNA, 22 bp, Artificial Sequence
  chemically synthesized
cccccaccccaccacagtcccc

SEQ ID NO: 666480 - DNA, 22 bp, Artificial Sequence
  chemically synthesized
tggggactgtggtggggtgggg

SEQ ID NO: 666481 - DNA, 22 bp, Artificial Sequence
  chemically synthesized
tcccccccactccccccacccc

SEQ ID NO: 666482 - DNA, 22 bp, Artificial Sequence
  chemically synthesized
gggactgtggtggggtgggggg

SEQ ID NO: 666483 - DNA, 22 bp, Artificial Sequence
  chemically synthesized
tggtggggtggggggagtgggg

SEQ ID NO: 666484 - DNA, 22 bp, Artificial Sequence
  chemically synthesized
ggtatatcacccagtgctatcc

SEQ ID NO: 666485 - DNA, 22 bp, Artificial Sequence
  chemically synthesized
gcattaggtatatcacccagtg

SEQ ID NO: 666486 - DNA, 22 bp, Artificial Sequence
  chemically synthesized
gtcatctagcattaggtatatc

SEQ ID NO: 666487 - DNA, 22 bp, Artificial Sequence
  chemically synthesized
actcgtcatctagcattaggta

SEQ ID NO: 666488 - DNA, 22 bp, Artificial Sequence
  chemically synthesized
ggtgatatacctaatgctagat

SEQ ID NO: 666489 - DNA, 22 bp, Artificial Sequence
  chemically synthesized
cacccactaactcgtcatctag

SEQ ID NO: 666490 - DNA, 22 bp, Artificial Sequence
  chemically synthesized
gtgcgctgcacccactaactcg

SEQ ID NO: 666491 - DNA, 22 bp, Artificial Sequence
  chemically synthesized
atgctagatgacgagttagtgg

SEQ ID NO: 666492 - DNA, 22 bp, Artificial Sequence
  chemically synthesized
gatgacgagttagtgggtgcag

SEQ ID NO: 666493 - DNA, 22 bp, Artificial Sequence
  chemically synthesized
gtgggtgcagcgcaccagcatg

SEQ ID NO: 666494 - DNA, 22 bp, Artificial Sequence
  chemically synthesized
catatgtatacatgtgccatgc

SEQ ID NO: 666495 - DNA, 22 bp, Artificial Sequence
  chemically synthesized
gttacatatgtatacatgtgcc

SEQ ID NO: 666496 - DNA, 22 bp, Artificial Sequence
  chemically synthesized
tgcaggttagttacatatgtat

SEQ ID NO: 666497 - DNA, 22 bp, Artificial Sequence
  chemically synthesized
gggtacatgtgcacattgtgca

SEQ ID NO: 666498 - DNA, 22 bp, Artificial Sequence
  chemically synthesized
agggtacatgtgcacattgtgc

SEQ ID NO: 666499 - DNA, 22 bp, Artificial Sequence
  chemically synthesized
tagggtacatgtgcacattgtg

SEQ ID NO: 666500 - DNA, 22 bp, Artificial Sequence
  chemically synthesized
agttttagggtacatgtgcaca

SEQ ID NO: 666501 - DNA, 22 bp, Artificial Sequence
  chemically synthesized
aagttttagggtacatgtgcac

SEQ ID NO: 666502 - DNA, 22 bp, Artificial Sequence
  chemically synthesized
acctgcacaatgtgcacatgta

SEQ ID NO: 666503 - DNA, 22 bp, Artificial Sequence
  chemically synthesized
taagttttagggtacatgtgca

SEQ ID NO: 666504 - DNA, 22 bp, Artificial Sequence
  chemically synthesized
cacaatgtgcacatgtacccta

SEQ ID NO: 666505 - DNA, 22 bp, Artificial Sequence
  chemically synthesized
tactttaagttttagggtacat

SEQ ID NO: 666506 - DNA, 22 bp, Artificial Sequence
  chemically synthesized
ttatactttaagttttagggta

SEQ ID NO: 666507 - DNA, 22 bp, Artificial Sequence
  chemically synthesized
attatactttaagttttagggt

SEQ ID NO: 666508 - DNA, 22 bp, Artificial Sequence
  chemically synthesized
tattatactttaagttttaggg

SEQ ID NO: 666509 - DNA, 22 bp, Artificial Sequence
  chemically synthesized
ttattatactttaagttttagg

SEQ ID NO: 666510 - DNA, 22 bp, Artificial Sequence
  chemically synthesized
tttattatactttaagttttag

SEQ ID NO: 666511 - DNA, 22 bp, Artificial Sequence
  chemically synthesized
ttttattatactttaagtttta

SEQ ID NO: 666512 - DNA, 22 bp, Artificial Sequence
  chemically synthesized
tttttattatactttaagtttt

SEQ ID NO: 666513 - DNA, 22 bp, Artificial Sequence
  chemically synthesized
ttttttattatactttaagttt

SEQ ID NO: 666514 - DNA, 22 bp, Artificial Sequence
  chemically synthesized
tttttttattatactttaagtt

SEQ ID NO: 666515 - DNA, 22 bp, Artificial Sequence
  chemically synthesized
ttttttttttattatactttaa

SEQ ID NO: 666516 - DNA, 22 bp, Artificial Sequence
  chemically synthesized
attttttttttattatacttta

SEQ ID NO: 666517 - DNA, 22 bp, Artificial Sequence
  chemically synthesized
tattttttttttattatacttt

SEQ ID NO: 666518 - DNA, 22 bp, Artificial Sequence
  chemically synthesized
ttattttttttttattatactt

SEQ ID NO: 666519 - DNA, 22 bp, Artificial Sequence
  chemically synthesized
tttattttttttttattatact

SEQ ID NO: 666520 - DNA, 22 bp, Artificial Sequence
  chemically synthesized
ttttattttttttttattatac

SEQ ID NO: 666521 - DNA, 22 bp, Artificial Sequence
  chemically synthesized
aaacttaaagtataataaaaaa

SEQ ID NO: 666522 - DNA, 22 bp, Artificial Sequence
  chemically synthesized
tttttttattttttttttatta

SEQ ID NO: 666523 - DNA, 22 bp, Artificial Sequence
  chemically synthesized
atttttttattttttttttatt

SEQ ID NO: 666524 - DNA, 22 bp, Artificial Sequence
  chemically synthesized
tatttttttattttttttttat

SEQ ID NO: 666525 - DNA, 22 bp, Artificial Sequence
  chemically synthesized
ttatttttttatttttttttta

SEQ ID NO: 666526 - DNA, 22 bp, Artificial Sequence
  chemically synthesized
tttatttttttatttttttttt

SEQ ID NO: 666527 - DNA, 22 bp, Artificial Sequence
  chemically synthesized
ttttatttttttattttttttt

SEQ ID NO: 666528 - DNA, 22 bp, Artificial Sequence
  chemically synthesized
aaagtataataaaaaaaaaata

SEQ ID NO: 666529 - DNA, 22 bp, Artificial Sequence
  chemically synthesized
tttttatttttttatttttttt

SEQ ID NO: 666530 - DNA, 22 bp, Artificial Sequence
  chemically synthesized
aagtataataaaaaaaaaataa

SEQ ID NO: 666531 - DNA, 22 bp, Artificial Sequence
  chemically synthesized
ttttttatttttttattttttt

SEQ ID NO: 666532 - DNA, 22 bp, Artificial Sequence
  chemically synthesized
tttttttatttttttatttttt

SEQ ID NO: 666533 - DNA, 22 bp, Artificial Sequence
  chemically synthesized
ttttttttatttttttattttt

SEQ ID NO: 666534 - DNA, 22 bp, Artificial Sequence
  chemically synthesized
tttttttttatttttttatttt

SEQ ID NO: 666535 - DNA, 22 bp, Artificial Sequence
  chemically synthesized
ttttttttttatttttttattt

SEQ ID NO: 666536 - DNA, 22 bp, Artificial Sequence
  chemically synthesized
tttttttttttatttttttatt

SEQ ID NO: 666537 - DNA, 22 bp, Artificial Sequence
  chemically synthesized
ttttttttttttatttttttat

SEQ ID NO: 666538 - DNA, 22 bp, Artificial Sequence
  chemically synthesized
tttttttttttttattttttta

SEQ ID NO: 666539 - DNA, 22 bp, Artificial Sequence
  chemically synthesized
ttttttttttttttattttttt

SEQ ID NO: 666540 - DNA, 22 bp, Artificial Sequence
  chemically synthesized
ttttttttttttttttattttt

SEQ ID NO: 666541 - DNA, 22 bp, Artificial Sequence
  chemically synthesized
cttttttttttttttttatttt

SEQ ID NO: 666542 - DNA, 22 bp, Artificial Sequence
  chemically synthesized
tcttttttttttttttttattt

SEQ ID NO: 666543 - DNA, 22 bp, Artificial Sequence
  chemically synthesized
ctttctttttttttttttttta

SEQ ID NO: 666544 - DNA, 22 bp, Artificial Sequence
  chemically synthesized
ctactttctttttttttttttt

SEQ ID NO: 666545 - DNA, 22 bp, Artificial Sequence
  chemically synthesized
ccctgctactttcttttttttt

SEQ ID NO: 666546 - DNA, 22 bp, Artificial Sequence
  chemically synthesized
gccctgctactttctttttttt

SEQ ID NO: 666547 - DNA, 22 bp, Artificial Sequence
  chemically synthesized
aacgtttgccctgctactttct

SEQ ID NO: 666548 - DNA, 22 bp, Artificial Sequence
  chemically synthesized
tgatggaagctaaacgtttgcc

SEQ ID NO: 666549 - DNA, 22 bp, Artificial Sequence
  chemically synthesized
cgtagcattgtgatggaagcta

SEQ ID NO: 666550 - DNA, 22 bp, Artificial Sequence
  chemically synthesized
ccgtagcattgtgatggaagct

SEQ ID NO: 666551 - DNA, 22 bp, Artificial Sequence
  chemically synthesized
tatggcttccgtagcattgtga

SEQ ID NO: 666552 - DNA, 22 bp, Artificial Sequence
  chemically synthesized
gtatggcttccgtagcattgtg

SEQ ID NO: 666553 - DNA, 22 bp, Artificial Sequence
  chemically synthesized
agcttccatcacaatgctacgg

SEQ ID NO: 666554 - DNA, 22 bp, Artificial Sequence
  chemically synthesized
gcttccatcacaatgctacgga

SEQ ID NO: 666555 - DNA, 22 bp, Artificial Sequence
  chemically synthesized
ccatcacaatgctacggaagcc

SEQ ID NO: 666556 - DNA, 22 bp, Artificial Sequence
  chemically synthesized
catcacaatgctacggaagcca

SEQ ID NO: 666557 - DNA, 22 bp, Artificial Sequence
  chemically synthesized
ccagatatacatttgtatggct

SEQ ID NO: 666558 - DNA, 22 bp, Artificial Sequence
  chemically synthesized
acagttaccagatatacatttg

SEQ ID NO: 666559 - DNA, 22 bp, Artificial Sequence
  chemically synthesized
cggaagccatacaaatgtatat

SEQ ID NO: 666560 - DNA, 22 bp, Artificial Sequence
  chemically synthesized
actgacagttaccagatataca

SEQ ID NO: 666561 - DNA, 22 bp, Artificial Sequence
  chemically synthesized
cagttcactgacagttaccaga

SEQ ID NO: 666562 - DNA, 22 bp, Artificial Sequence
  chemically synthesized
cgttgcagttcactgacagtta

SEQ ID NO: 666563 - DNA, 22 bp, Artificial Sequence
  chemically synthesized
gtaactgtcagtgaactgcaac

SEQ ID NO: 666564 - DNA, 22 bp, Artificial Sequence
  chemically synthesized
tagggcaccagaactccgttgc

SEQ ID NO: 666565 - DNA, 22 bp, Artificial Sequence
  chemically synthesized
gtagggcaccagaactccgttg

SEQ ID NO: 666566 - DNA, 22 bp, Artificial Sequence
  chemically synthesized
tcagtgaactgcaacggagttc

SEQ ID NO: 666567 - DNA, 22 bp, Artificial Sequence
  chemically synthesized
caacggagttctggtgccctac

SEQ ID NO: 666568 - DNA, 22 bp, Artificial Sequence
  chemically synthesized
agtagtagacttgtagggcacc

SEQ ID NO: 666569 - DNA, 22 bp, Artificial Sequence
  chemically synthesized
gagtagtagacttgtagggcac

SEQ ID NO: 666570 - DNA, 22 bp, Artificial Sequence
  chemically synthesized
ttgagtagtagacttgtagggc

SEQ ID NO: 666571 - DNA, 22 bp, Artificial Sequence
  chemically synthesized
tcttgagtagtagacttgtagg

SEQ ID NO: 666572 - DNA, 22 bp, Artificial Sequence
  chemically synthesized
actctcttgagtagtagacttg

SEQ ID NO: 666573 - DNA, 22 bp, Artificial Sequence
  chemically synthesized
tggtgccctacaagtctactac

SEQ ID NO: 666574 - DNA, 22 bp, Artificial Sequence
  chemically synthesized
gtgccctacaagtctactactc

SEQ ID NO: 666575 - DNA, 22 bp, Artificial Sequence
  chemically synthesized
caagtctactactcaagagagt

SEQ ID NO: 666576 - DNA, 22 bp, Artificial Sequence
  chemically synthesized
aaacaacacaggcagttaactc

SEQ ID NO: 666577 - DNA, 22 bp, Artificial Sequence
  chemically synthesized
ctactcaagagagttaactgcc

SEQ ID NO: 666578 - DNA, 22 bp, Artificial Sequence
  chemically synthesized
ctcaagagagttaactgcctgt

SEQ ID NO: 666579 - DNA, 22 bp, Artificial Sequence
  chemically synthesized
aagagagttaactgcctgtgtt

SEQ ID NO: 666580 - DNA, 22 bp, Artificial Sequence
  chemically synthesized
gcaacacatgcggactcaaaca

SEQ ID NO: 666581 - DNA, 22 bp, Artificial Sequence
  chemically synthesized
actgcctgtgttgtttgagtcc

SEQ ID NO: 666582 - DNA, 22 bp, Artificial Sequence
  chemically synthesized
ctagcaacacatgcggactcaa

SEQ ID NO: 666583 - DNA, 22 bp, Artificial Sequence
  chemically synthesized
cctgtgttgtttgagtccgcat

SEQ ID NO: 666584 - DNA, 22 bp, Artificial Sequence
  chemically synthesized
tgttgtttgagtccgcatgtgt

SEQ ID NO: 666585 - DNA, 22 bp, Artificial Sequence
  chemically synthesized
cagactcctagcaacacatgcg

SEQ ID NO: 666586 - DNA, 22 bp, Artificial Sequence
  chemically synthesized
tttgagtccgcatgtgttgcta

SEQ ID NO: 666587 - DNA, 22 bp, Artificial Sequence
  chemically synthesized
gagtccgcatgtgttgctagga

SEQ ID NO: 666588 - DNA, 22 bp, Artificial Sequence
  chemically synthesized
agtccgcatgtgttgctaggag

SEQ ID NO: 666589 - DNA, 22 bp, Artificial Sequence
  chemically synthesized
taagccggagggagtggtgctg

SEQ ID NO: 666590 - DNA, 22 bp, Artificial Sequence
  chemically synthesized
ctaggagtctgcagcaccactc

SEQ ID NO: 666591 - DNA, 22 bp, Artificial Sequence
  chemically synthesized
ggagtctgcagcaccactccct

SEQ ID NO: 666592 - DNA, 22 bp, Artificial Sequence
  chemically synthesized
cagctgtaagccggagggagtg

SEQ ID NO: 666593 - DNA, 22 bp, Artificial Sequence
  chemically synthesized
ccagctgtaagccggagggagt

SEQ ID NO: 666594 - DNA, 22 bp, Artificial Sequence
  chemically synthesized
ttccagctgtaagccggaggga

SEQ ID NO: 666595 - DNA, 22 bp, Artificial Sequence
  chemically synthesized
cagcaccactccctccggctta

SEQ ID NO: 666596 - DNA, 22 bp, Artificial Sequence
  chemically synthesized
tctcttccagctgtaagccgga

SEQ ID NO: 666597 - DNA, 22 bp, Artificial Sequence
  chemically synthesized
atctcttccagctgtaagccgg

SEQ ID NO: 666598 - DNA, 22 bp, Artificial Sequence
  chemically synthesized
cctccggcttacagctggaaga

SEQ ID NO: 666599 - DNA, 22 bp, Artificial Sequence
  chemically synthesized
aggcagagacttatctcttcca

SEQ ID NO: 666600 - DNA, 22 bp, Artificial Sequence
  chemically synthesized
cggcttacagctggaagagata

SEQ ID NO: 666601 - DNA, 22 bp, Artificial Sequence
  chemically synthesized
ctaaggcagagacttatctctt

SEQ ID NO: 666602 - DNA, 22 bp, Artificial Sequence
  chemically synthesized
cctaaggcagagacttatctct

SEQ ID NO: 666603 - DNA, 22 bp, Artificial Sequence
  chemically synthesized
tcctaaggcagagacttatctc

SEQ ID NO: 666604 - DNA, 22 bp, Artificial Sequence
  chemically synthesized
acagctggaagagataagtctc

SEQ ID NO: 666605 - DNA, 22 bp, Artificial Sequence
  chemically synthesized
cagctggaagagataagtctct

SEQ ID NO: 666606 - DNA, 22 bp, Artificial Sequence
  chemically synthesized
cacactttcctaaggcagagac

SEQ ID NO: 666607 - DNA, 22 bp, Artificial Sequence
  chemically synthesized
gaagagataagtctctgcctta

SEQ ID NO: 666608 - DNA, 22 bp, Artificial Sequence
  chemically synthesized
tgtgcatcctacacactttcct

SEQ ID NO: 666609 - DNA, 22 bp, Artificial Sequence
  chemically synthesized
tgtgtgcatcctacacactttc

SEQ ID NO: 666610 - DNA, 22 bp, Artificial Sequence
  chemically synthesized
ctgtgtgcatcctacacacttt

SEQ ID NO: 666611 - DNA, 22 bp, Artificial Sequence
  chemically synthesized
tgccttaggaaagtgtgtagga

SEQ ID NO: 666612 - DNA, 22 bp, Artificial Sequence
  chemically synthesized
ccttaggaaagtgtgtaggatg

SEQ ID NO: 666613 - DNA, 22 bp, Artificial Sequence
  chemically synthesized
aggtttctgtgtgcatcctaca

SEQ ID NO: 666614 - DNA, 22 bp, Artificial Sequence
  chemically synthesized
gaggtttctgtgtgcatcctac

SEQ ID NO: 666615 - DNA, 22 bp, Artificial Sequence
  chemically synthesized
aggaaagtgtgtaggatgcaca

SEQ ID NO: 666616 - DNA, 22 bp, Artificial Sequence
  chemically synthesized
ggaaagtgtgtaggatgcacac

SEQ ID NO: 666617 - DNA, 22 bp, Artificial Sequence
  chemically synthesized
catcttgaggtttctgtgtgca

SEQ ID NO: 666618 - DNA, 22 bp, Artificial Sequence
  chemically synthesized
tattgcatcttgaggtttctgt

SEQ ID NO: 666619 - DNA, 22 bp, Artificial Sequence
  chemically synthesized
acagctgtattgcatcttgagg

SEQ ID NO: 666620 - DNA, 22 bp, Artificial Sequence
  chemically synthesized
ttcacagctgtattgcatcttg

SEQ ID NO: 666621 - DNA, 22 bp, Artificial Sequence
  chemically synthesized
aagatgcaatacagctgtgaac

SEQ ID NO: 666622 - DNA, 22 bp, Artificial Sequence
  chemically synthesized
gcccaggacagtgtcacattgt

SEQ ID NO: 666623 - DNA, 22 bp, Artificial Sequence
  chemically synthesized
agcccaggacagtgtcacattg

SEQ ID NO: 666624 - DNA, 22 bp, Artificial Sequence
  chemically synthesized
tagcccaggacagtgtcacatt

SEQ ID NO: 666625 - DNA, 22 bp, Artificial Sequence
  chemically synthesized
tgaacaatgtgacactgtcctg

SEQ ID NO: 666626 - DNA, 22 bp, Artificial Sequence
  chemically synthesized
cacagtcatcccaagctttagc

SEQ ID NO: 666627 - DNA, 22 bp, Artificial Sequence
  chemically synthesized
actacacagtcatcccaagctt

SEQ ID NO: 666628 - DNA, 22 bp, Artificial Sequence
  chemically synthesized
cactacacagtcatcccaagct

SEQ ID NO: 666629 - DNA, 22 bp, Artificial Sequence
  chemically synthesized
tcctgggctaaagcttgggatg

SEQ ID NO: 666630 - DNA, 22 bp, Artificial Sequence
  chemically synthesized
tcactacacagtcatcccaagc

SEQ ID NO: 666631 - DNA, 22 bp, Artificial Sequence
  chemically synthesized
ggctaaagcttgggatgactgt

SEQ ID NO: 666632 - DNA, 22 bp, Artificial Sequence
  chemically synthesized
aagcttgggatgactgtgtagt

SEQ ID NO: 666633 - DNA, 22 bp, Artificial Sequence
  chemically synthesized
catacatactttcactacacag

SEQ ID NO: 666634 - DNA, 22 bp, Artificial Sequence
  chemically synthesized
gggatgactgtgtagtgaaagt

SEQ ID NO: 666635 - DNA, 22 bp, Artificial Sequence
  chemically synthesized
aactgcatacatactttcacta

SEQ ID NO: 666636 - DNA, 22 bp, Artificial Sequence
  chemically synthesized
ggatgactgtgtagtgaaagta

SEQ ID NO: 666637 - DNA, 22 bp, Artificial Sequence
  chemically synthesized
ttaaactgcatacatactttca

SEQ ID NO: 666638 - DNA, 22 bp, Artificial Sequence
  chemically synthesized
attaaactgcatacatactttc

SEQ ID NO: 666639 - DNA, 22 bp, Artificial Sequence
  chemically synthesized
tattaaactgcatacatacttt

SEQ ID NO: 666640 - DNA, 22 bp, Artificial Sequence
  chemically synthesized
gctttattaaactgcatacata

SEQ ID NO: 666641 - DNA, 22 bp, Artificial Sequence
  chemically synthesized
tgtagtgaaagtatgtatgcag

SEQ ID NO: 666642 - DNA, 22 bp, Artificial Sequence
  chemically synthesized
agctttattaaactgcatacat

SEQ ID NO: 666643 - DNA, 22 bp, Artificial Sequence
  chemically synthesized
tagctttattaaactgcataca

SEQ ID NO: 666644 - DNA, 22 bp, Artificial Sequence
  chemically synthesized
aataaagctaaagccccccatt

SEQ ID NO: 666645 - DNA, 22 bp, Artificial Sequence
  chemically synthesized
atggggcacgggaatggggggc

SEQ ID NO: 666646 - DNA, 22 bp, Artificial Sequence
  chemically synthesized
ataaagctaaagccccccattc

SEQ ID NO: 666647 - DNA, 22 bp, Artificial Sequence
  chemically synthesized
tcatggggcacgggaatggggg

SEQ ID NO: 666648 - DNA, 22 bp, Artificial Sequence
  chemically synthesized
aagccccccattcccgtgcccc

SEQ ID NO: 666649 - DNA, 22 bp, Artificial Sequence
  chemically synthesized
ccgtgccccatgagagactgtc

SEQ ID NO: 666650 - DNA, 22 bp, Artificial Sequence
  chemically synthesized
ccagggaaagtggaggacagtc

SEQ ID NO: 666651 - DNA, 22 bp, Artificial Sequence
  chemically synthesized
gaaagtcagctcccagggaaag

SEQ ID NO: 666652 - DNA, 22 bp, Artificial Sequence
  chemically synthesized
tcctccactttccctgggagct

SEQ ID NO: 666653 - DNA, 22 bp, Artificial Sequence
  chemically synthesized
cactttccctgggagctgactt

SEQ ID NO: 666654 - DNA, 22 bp, Artificial Sequence
  chemically synthesized
gatcagagtcctggaaagtcag

SEQ ID NO: 666655 - DNA, 22 bp, Artificial Sequence
  chemically synthesized
ggatcagagtcctggaaagtca

SEQ ID NO: 666656 - DNA, 22 bp, Artificial Sequence
  chemically synthesized
tccctgggagctgactttccag

SEQ ID NO: 666657 - DNA, 22 bp, Artificial Sequence
  chemically synthesized
ccctgggagctgactttccagg

SEQ ID NO: 666658 - DNA, 22 bp, Artificial Sequence
  chemically synthesized
cctgggagctgactttccagga

SEQ ID NO: 666659 - DNA, 22 bp, Artificial Sequence
  chemically synthesized
caacttggatcagagtcctgga

SEQ ID NO: 666660 - DNA, 22 bp, Artificial Sequence
  chemically synthesized
ggagctgactttccaggactct

SEQ ID NO: 666661 - DNA, 22 bp, Artificial Sequence
  chemically synthesized
attacaacttggatcagagtcc

SEQ ID NO: 666662 - DNA, 22 bp, Artificial Sequence
  chemically synthesized
actttccaggactctgatccaa

SEQ ID NO: 666663 - DNA, 22 bp, Artificial Sequence
  chemically synthesized
tccaggactctgatccaagttg

SEQ ID NO: 666664 - DNA, 22 bp, Artificial Sequence
  chemically synthesized
gtgagctcattacaacttggat

SEQ ID NO: 666665 - DNA, 22 bp, Artificial Sequence
  chemically synthesized
ccaggactctgatccaagttgt

SEQ ID NO: 666666 - DNA, 22 bp, Artificial Sequence
  chemically synthesized
caggactctgatccaagttgta

SEQ ID NO: 666667 - DNA, 22 bp, Artificial Sequence
  chemically synthesized
tgagagctagtgagctcattac

SEQ ID NO: 666668 - DNA, 22 bp, Artificial Sequence
  chemically synthesized
tgatccaagttgtaatgagctc

SEQ ID NO: 666669 - DNA, 22 bp, Artificial Sequence
  chemically synthesized
atccaagttgtaatgagctcac

SEQ ID NO: 666670 - DNA, 22 bp, Artificial Sequence
  chemically synthesized
cggctgtgagagctagtgagct

SEQ ID NO: 666671 - DNA, 22 bp, Artificial Sequence
  chemically synthesized
agttccggctgtgagagctagt

SEQ ID NO: 666672 - DNA, 22 bp, Artificial Sequence
  chemically synthesized
gagttccggctgtgagagctag

SEQ ID NO: 666673 - DNA, 22 bp, Artificial Sequence
  chemically synthesized
taatgagctcactagctctcac

SEQ ID NO: 666674 - DNA, 22 bp, Artificial Sequence
  chemically synthesized
ttgagttccggctgtgagagct

SEQ ID NO: 666675 - DNA, 22 bp, Artificial Sequence
  chemically synthesized
ctcttgagttccggctgtgaga

SEQ ID NO: 666676 - DNA, 22 bp, Artificial Sequence
  chemically synthesized
actcctcttgagttccggctgt

SEQ ID NO: 666677 - DNA, 22 bp, Artificial Sequence
  chemically synthesized
actagctctcacagccggaact

SEQ ID NO: 666678 - DNA, 22 bp, Artificial Sequence
  chemically synthesized
gctctcacagccggaactcaag

SEQ ID NO: 666679 - DNA, 22 bp, Artificial Sequence
  chemically synthesized
gatagtctcactcctcttgagt

SEQ ID NO: 666680 - DNA, 22 bp, Artificial Sequence
  chemically synthesized
tcacagccggaactcaagagga

SEQ ID NO: 666681 - DNA, 22 bp, Artificial Sequence
  chemically synthesized
ggatagtctcactcctcttgag

SEQ ID NO: 666682 - DNA, 22 bp, Artificial Sequence
  chemically synthesized
acagccggaactcaagaggagt

SEQ ID NO: 666683 - DNA, 22 bp, Artificial Sequence
  chemically synthesized
ttggatagtctcactcctcttg

SEQ ID NO: 666684 - DNA, 22 bp, Artificial Sequence
  chemically synthesized
cttggatagtctcactcctctt

SEQ ID NO: 666685 - DNA, 22 bp, Artificial Sequence
  chemically synthesized
gtttcttggatagtctcactcc

SEQ ID NO: 666686 - DNA, 22 bp, Artificial Sequence
  chemically synthesized
aagaggagtgagactatccaag

SEQ ID NO: 666687 - DNA, 22 bp, Artificial Sequence
  chemically synthesized
ccatggaaacatggcgtaactg

SEQ ID NO: 666688 - DNA, 22 bp, Artificial Sequence
  chemically synthesized
tccaagaaaccagttacgccat

SEQ ID NO: 666689 - DNA, 22 bp, Artificial Sequence
  chemically synthesized
ccagctgccatggaaacatggc

SEQ ID NO: 666690 - DNA, 22 bp, Artificial Sequence
  chemically synthesized
tcccagctgccatggaaacatg

SEQ ID NO: 666691 - DNA, 22 bp, Artificial Sequence
  chemically synthesized
ctcccagctgccatggaaacat

SEQ ID NO: 666692 - DNA, 22 bp, Artificial Sequence
  chemically synthesized
tctcccagctgccatggaaaca

SEQ ID NO: 666693 - DNA, 22 bp, Artificial Sequence
  chemically synthesized
cgccatgtttccatggcagctg

SEQ ID NO: 666694 - DNA, 22 bp, Artificial Sequence
  chemically synthesized
aagtgcgctttctcccagctgc

SEQ ID NO: 666695 - DNA, 22 bp, Artificial Sequence
  chemically synthesized
tgaagtgcgctttctcccagct

SEQ ID NO: 666696 - DNA, 22 bp, Artificial Sequence
  chemically synthesized
ctgaagtgcgctttctcccagc

SEQ ID NO: 666697 - DNA, 22 bp, Artificial Sequence
  chemically synthesized
ccatggcagctgggagaaagcg

SEQ ID NO: 666698 - DNA, 22 bp, Artificial Sequence
  chemically synthesized
catggcagctgggagaaagcgc

SEQ ID NO: 666699 - DNA, 22 bp, Artificial Sequence
  chemically synthesized
cccttctgaagtgcgctttctc

SEQ ID NO: 666700 - DNA, 22 bp, Artificial Sequence
  chemically synthesized
acccttctgaagtgcgctttct

SEQ ID NO: 666701 - DNA, 22 bp, Artificial Sequence
  chemically synthesized
tacccttctgaagtgcgctttc

SEQ ID NO: 666702 - DNA, 22 bp, Artificial Sequence
  chemically synthesized
ttacccttctgaagtgcgcttt

SEQ ID NO: 666703 - DNA, 22 bp, Artificial Sequence
  chemically synthesized
agcatttttacccttctgaagt

SEQ ID NO: 666704 - DNA, 22 bp, Artificial Sequence
  chemically synthesized
ggagaaagcgcacttcagaagg

SEQ ID NO: 666705 - DNA, 22 bp, Artificial Sequence
  chemically synthesized
cagaagggtaaaaatgctgaac

SEQ ID NO: 666706 - DNA, 22 bp, Artificial Sequence
  chemically synthesized
agaagggtaaaaatgctgaact

SEQ ID NO: 666707 - DNA, 22 bp, Artificial Sequence
  chemically synthesized
tgaagagaaatgtgcagttcag

SEQ ID NO: 666708 - DNA, 22 bp, Artificial Sequence
  chemically synthesized
aactgcacatttctcttcataa

SEQ ID NO: 666709 - DNA, 22 bp, Artificial Sequence
  chemically synthesized
gataaaataatacaagttatga

SEQ ID NO: 666710 - DNA, 22 bp, Artificial Sequence
  chemically synthesized
cacatttctcttcataacttgt

SEQ ID NO: 666711 - DNA, 22 bp, Artificial Sequence
  chemically synthesized
ctcttcataacttgtattattt

SEQ ID NO: 666712 - DNA, 22 bp, Artificial Sequence
  chemically synthesized
tcttcataacttgtattatttt

SEQ ID NO: 666713 - DNA, 22 bp, Artificial Sequence
  chemically synthesized
ttcataacttgtattattttat

SEQ ID NO: 666714 - DNA, 22 bp, Artificial Sequence
  chemically synthesized
gaaccagccctggataaaataa

SEQ ID NO: 666715 - DNA, 22 bp, Artificial Sequence
  chemically synthesized
cataacttgtattattttatcc

SEQ ID NO: 666716 - DNA, 22 bp, Artificial Sequence
  chemically synthesized
ataacttgtattattttatcca

SEQ ID NO: 666717 - DNA, 22 bp, Artificial Sequence
  chemically synthesized
taggctagaaccagccctggat

SEQ ID NO: 666718 - DNA, 22 bp, Artificial Sequence
  chemically synthesized
ataggctagaaccagccctgga

SEQ ID NO: 666719 - DNA, 22 bp, Artificial Sequence
  chemically synthesized
gtattattttatccagggctgg

SEQ ID NO: 666720 - DNA, 22 bp, Artificial Sequence
  chemically synthesized
tattattttatccagggctggt

SEQ ID NO: 666721 - DNA, 22 bp, Artificial Sequence
  chemically synthesized
tttataggctagaaccagccct

SEQ ID NO: 666722 - DNA, 22 bp, Artificial Sequence
  chemically synthesized
tatttataggctagaaccagcc

SEQ ID NO: 666723 - DNA, 22 bp, Artificial Sequence
  chemically synthesized
ttttatccagggctggttctag

SEQ ID NO: 666724 - DNA, 22 bp, Artificial Sequence
  chemically synthesized
tctatttataggctagaaccag

SEQ ID NO: 666725 - DNA, 22 bp, Artificial Sequence
  chemically synthesized
ctctatttataggctagaacca

SEQ ID NO: 666726 - DNA, 22 bp, Artificial Sequence
  chemically synthesized
tatccagggctggttctagcct

SEQ ID NO: 666727 - DNA, 22 bp, Artificial Sequence
  chemically synthesized
atccagggctggttctagccta

SEQ ID NO: 666728 - DNA, 22 bp, Artificial Sequence
  chemically synthesized
tccagggctggttctagcctat

SEQ ID NO: 666729 - DNA, 22 bp, Artificial Sequence
  chemically synthesized
gatttctctatttataggctag

SEQ ID NO: 666730 - DNA, 22 bp, Artificial Sequence
  chemically synthesized
tagatttctctatttataggct

SEQ ID NO: 666731 - DNA, 22 bp, Artificial Sequence
  chemically synthesized
ctagatttctctatttataggc

SEQ ID NO: 666732 - DNA, 22 bp, Artificial Sequence
  chemically synthesized
cgtttctagatttctctattta

SEQ ID NO: 666733 - DNA, 22 bp, Artificial Sequence
  chemically synthesized
gttctagcctataaatagagaa

SEQ ID NO: 666734 - DNA, 22 bp, Artificial Sequence
  chemically synthesized
acgtttctagatttctctattt

SEQ ID NO: 666735 - DNA, 22 bp, Artificial Sequence
  chemically synthesized
cttacgtttctagatttctcta

SEQ ID NO: 666736 - DNA, 22 bp, Artificial Sequence
  chemically synthesized
tagcctataaatagagaaatct

SEQ ID NO: 666737 - DNA, 22 bp, Artificial Sequence
  chemically synthesized
gcctataaatagagaaatctag

SEQ ID NO: 666738 - DNA, 22 bp, Artificial Sequence
  chemically synthesized
ttccttacgtttctagatttct

SEQ ID NO: 666739 - DNA, 22 bp, Artificial Sequence
  chemically synthesized
gttccttacgtttctagatttc

SEQ ID NO: 666740 - DNA, 22 bp, Artificial Sequence
  chemically synthesized
taaatagagaaatctagaaacg

SEQ ID NO: 666741 - DNA, 22 bp, Artificial Sequence
  chemically synthesized
cccttgttccttacgtttctag

SEQ ID NO: 666742 - DNA, 22 bp, Artificial Sequence
  chemically synthesized
gcccttgttccttacgtttcta

SEQ ID NO: 666743 - DNA, 22 bp, Artificial Sequence
  chemically synthesized
atgtttgcccttgttccttacg

SEQ ID NO: 666744 - DNA, 22 bp, Artificial Sequence
  chemically synthesized
gatgtttgcccttgttccttac

SEQ ID NO: 666745 - DNA, 22 bp, Artificial Sequence
  chemically synthesized
gaaacgtaaggaacaagggcaa

SEQ ID NO: 666746 - DNA, 22 bp, Artificial Sequence
  chemically synthesized
agaaggtaggtggtttgatgtt

SEQ ID NO: 666747 - DNA, 22 bp, Artificial Sequence
  chemically synthesized
gagaaggtaggtggtttgatgt

SEQ ID NO: 666748 - DNA, 22 bp, Artificial Sequence
  chemically synthesized
aacttgagaaggtaggtggttt

SEQ ID NO: 666749 - DNA, 22 bp, Artificial Sequence
  chemically synthesized
gaaattcaacttgagaaggtag

SEQ ID NO: 666750 - DNA, 22 bp, Artificial Sequence
  chemically synthesized
agtagttggaaattcaacttga

SEQ ID NO: 666751 - DNA, 22 bp, Artificial Sequence
  chemically synthesized
cagtagttggaaattcaacttg

SEQ ID NO: 666752 - DNA, 22 bp, Artificial Sequence
  chemically synthesized
ccttctcaagttgaatttccaa

SEQ ID NO: 666753 - DNA, 22 bp, Artificial Sequence
  chemically synthesized
tcacttcagtagttggaaattc

SEQ ID NO: 666754 - DNA, 22 bp, Artificial Sequence
  chemically synthesized
ctcaagttgaatttccaactac

SEQ ID NO: 666755 - DNA, 22 bp, Artificial Sequence
  chemically synthesized
tcaagttgaatttccaactact

SEQ ID NO: 666756 - DNA, 22 bp, Artificial Sequence
  chemically synthesized
aagttgaatttccaactactga

SEQ ID NO: 666757 - DNA, 22 bp, Artificial Sequence
  chemically synthesized
aatttccaactactgaagtgat

SEQ ID NO: 666758 - DNA, 22 bp, Artificial Sequence
  chemically synthesized
ccaactactgaagtgataggcc

SEQ ID NO: 666759 - DNA, 22 bp, Artificial Sequence
  chemically synthesized
caactactgaagtgataggcca

SEQ ID NO: 666760 - DNA, 22 bp, Artificial Sequence
  chemically synthesized
aaaataaaagatgaatggccta

SEQ ID NO: 666761 - DNA, 22 bp, Artificial Sequence
  chemically synthesized
caaaataaaagatgaatggcct

SEQ ID NO: 666762 - DNA, 22 bp, Artificial Sequence
  chemically synthesized
ctgaagtgataggccattcatc

SEQ ID NO: 666763 - DNA, 22 bp, Artificial Sequence
  chemically synthesized
aagtgataggccattcatcttt

SEQ ID NO: 666764 - DNA, 22 bp, Artificial Sequence
  chemically synthesized
atgtttcaaaataaaagatgaa

SEQ ID NO: 666765 - DNA, 22 bp, Artificial Sequence
  chemically synthesized
catgtttcaaaataaaagatga

SEQ ID NO: 666766 - DNA, 22 bp, Artificial Sequence
  chemically synthesized
tttcatgtttcaaaataaaaga

SEQ ID NO: 666767 - DNA, 22 bp, Artificial Sequence
  chemically synthesized
gtttcatgtttcaaaataaaag

SEQ ID NO: 666768 - DNA, 22 bp, Artificial Sequence
  chemically synthesized
cttgtttcatgtttcaaaataa

SEQ ID NO: 666769 - DNA, 22 bp, Artificial Sequence
  chemically synthesized
ttacttgtttcatgtttcaaaa

SEQ ID NO: 666770 - DNA, 22 bp, Artificial Sequence
  chemically synthesized
atcttttattttgaaacatgaa

SEQ ID NO: 666771 - DNA, 22 bp, Artificial Sequence
  chemically synthesized
ttattttgaaacatgaaacaag

SEQ ID NO: 666772 - DNA, 22 bp, Artificial Sequence
  chemically synthesized
tattttgaaacatgaaacaagt

SEQ ID NO: 666773 - DNA, 22 bp, Artificial Sequence
  chemically synthesized
attttgaaacatgaaacaagta

SEQ ID NO: 666774 - DNA, 22 bp, Artificial Sequence
  chemically synthesized
ttttgaaacatgaaacaagtaa

SEQ ID NO: 666775 - DNA, 22 bp, Artificial Sequence
  chemically synthesized
tgaaacatgaaacaagtaatag

SEQ ID NO: 666776 - DNA, 22 bp, Artificial Sequence
  chemically synthesized
gaaacatgaaacaagtaatagg

SEQ ID NO: 666777 - DNA, 22 bp, Artificial Sequence
  chemically synthesized
aaacatgaaacaagtaataggc

SEQ ID NO: 666778 - DNA, 22 bp, Artificial Sequence
  chemically synthesized
aacaaaggggcaagagaagcct

SEQ ID NO: 666779 - DNA, 22 bp, Artificial Sequence
  chemically synthesized
ctcttgcccctttgtttagtct

SEQ ID NO: 666780 - DNA, 22 bp, Artificial Sequence
  chemically synthesized
tcttgcccctttgtttagtcta

SEQ ID NO: 666781 - DNA, 22 bp, Artificial Sequence
  chemically synthesized
ttgcccctttgtttagtctatg

SEQ ID NO: 666782 - DNA, 22 bp, Artificial Sequence
  chemically synthesized
gcccctttgtttagtctatgca

SEQ ID NO: 666783 - DNA, 22 bp, Artificial Sequence
  chemically synthesized
cccctttgtttagtctatgcat

SEQ ID NO: 666784 - DNA, 22 bp, Artificial Sequence
  chemically synthesized
ccaaagtcaagaaaaatgcata

SEQ ID NO: 666785 - DNA, 22 bp, Artificial Sequence
  chemically synthesized
accaaagtcaagaaaaatgcat

SEQ ID NO: 666786 - DNA, 22 bp, Artificial Sequence
  chemically synthesized
tgtttagtctatgcatttttct

SEQ ID NO: 666787 - DNA, 22 bp, Artificial Sequence
  chemically synthesized
gtttagtctatgcatttttctt

SEQ ID NO: 666788 - DNA, 22 bp, Artificial Sequence
  chemically synthesized
tttagtctatgcatttttcttg

SEQ ID NO: 666789 - DNA, 22 bp, Artificial Sequence
  chemically synthesized
agtctatgcatttttcttgact

SEQ ID NO: 666790 - DNA, 22 bp, Artificial Sequence
  chemically synthesized
gtctatgcatttttcttgactt

SEQ ID NO: 666791 - DNA, 22 bp, Artificial Sequence
  chemically synthesized
tgcatttttcttgactttggta

SEQ ID NO: 666792 - DNA, 22 bp, Artificial Sequence
  chemically synthesized
ttcttgactttggtaagtattt

SEQ ID NO: 666793 - DNA, 22 bp, Artificial Sequence
  chemically synthesized
tcttgactttggtaagtatttc

SEQ ID NO: 666794 - DNA, 22 bp, Artificial Sequence
  chemically synthesized
cttgactttggtaagtatttct

SEQ ID NO: 666795 - DNA, 22 bp, Artificial Sequence
  chemically synthesized
ttgactttggtaagtatttctg

SEQ ID NO: 666796 - DNA, 22 bp, Artificial Sequence
  chemically synthesized
gactttggtaagtatttctgtt

SEQ ID NO: 666797 - DNA, 22 bp, Artificial Sequence
  chemically synthesized
actttggtaagtatttctgttt

SEQ ID NO: 666798 - DNA, 22 bp, Artificial Sequence
  chemically synthesized
tggtaagtatttctgttttatg

SEQ ID NO: 666799 - DNA, 22 bp, Artificial Sequence
  chemically synthesized
ggtaagtatttctgttttatga

SEQ ID NO: 666800 - DNA, 22 bp, Artificial Sequence
  chemically synthesized
gtaagtatttctgttttatgac

SEQ ID NO: 666801 - DNA, 22 bp, Artificial Sequence
  chemically synthesized
cacagagtaaaagtgaaagtca

SEQ ID NO: 666802 - DNA, 22 bp, Artificial Sequence
  chemically synthesized
ttacacagagtaaaagtgaaag

SEQ ID NO: 666803 - DNA, 22 bp, Artificial Sequence
  chemically synthesized
ctgttttatgactttcactttt

SEQ ID NO: 666804 - DNA, 22 bp, Artificial Sequence
  chemically synthesized
tgttttatgactttcactttta

SEQ ID NO: 666805 - DNA, 22 bp, Artificial Sequence
  chemically synthesized
ctattacacagagtaaaagtga

SEQ ID NO: 666806 - DNA, 22 bp, Artificial Sequence
  chemically synthesized
ttttatgactttcacttttact

SEQ ID NO: 666807 - DNA, 22 bp, Artificial Sequence
  chemically synthesized
ctactattacacagagtaaaag

SEQ ID NO: 666808 - DNA, 22 bp, Artificial Sequence
  chemically synthesized
tatgactttcacttttactctg

SEQ ID NO: 666809 - DNA, 22 bp, Artificial Sequence
  chemically synthesized
atgactttcacttttactctgt

SEQ ID NO: 666810 - DNA, 22 bp, Artificial Sequence
  chemically synthesized
tgactttcacttttactctgtg

SEQ ID NO: 666811 - DNA, 22 bp, Artificial Sequence
  chemically synthesized
acacctgctactattacacaga

SEQ ID NO: 666812 - DNA, 22 bp, Artificial Sequence
  chemically synthesized
gacacctgctactattacacag

SEQ ID NO: 666813 - DNA, 22 bp, Artificial Sequence
  chemically synthesized
tcacttttactctgtgtaatag

SEQ ID NO: 666814 - DNA, 22 bp, Artificial Sequence
  chemically synthesized
tgacacctgctactattacaca

SEQ ID NO: 666815 - DNA, 22 bp, Artificial Sequence
  chemically synthesized
cacttttactctgtgtaatagt

SEQ ID NO: 666816 - DNA, 22 bp, Artificial Sequence
  chemically synthesized
acttttactctgtgtaatagta

SEQ ID NO: 666817 - DNA, 22 bp, Artificial Sequence
  chemically synthesized
ttactctgtgtaatagtagcag

SEQ ID NO: 666818 - DNA, 22 bp, Artificial Sequence
  chemically synthesized
tactctgtgtaatagtagcagg

SEQ ID NO: 666819 - DNA, 22 bp, Artificial Sequence
  chemically synthesized
actctgtgtaatagtagcaggt

SEQ ID NO: 666820 - DNA, 22 bp, Artificial Sequence
  chemically synthesized
gtgaattttgacacctgctact

SEQ ID NO: 666821 - DNA, 22 bp, Artificial Sequence
  chemically synthesized
ctctgtgtaatagtagcaggtg

SEQ ID NO: 666822 - DNA, 22 bp, Artificial Sequence
  chemically synthesized
tggtgaattttgacacctgcta

SEQ ID NO: 666823 - DNA, 22 bp, Artificial Sequence
  chemically synthesized
ctggtgaattttgacacctgct

SEQ ID NO: 666824 - DNA, 22 bp, Artificial Sequence
  chemically synthesized
tgtgtaatagtagcaggtgtca

SEQ ID NO: 666825 - DNA, 22 bp, Artificial Sequence
  chemically synthesized
tctggtgaattttgacacctgc

SEQ ID NO: 666826 - DNA, 22 bp, Artificial Sequence
  chemically synthesized
ttctggtgaattttgacacctg

SEQ ID NO: 666827 - DNA, 22 bp, Artificial Sequence
  chemically synthesized
tgtaatagtagcaggtgtcaaa

SEQ ID NO: 666828 - DNA, 22 bp, Artificial Sequence
  chemically synthesized
ttttctggtgaattttgacacc

SEQ ID NO: 666829 - DNA, 22 bp, Artificial Sequence
  chemically synthesized
ctcttttctggtgaattttgac

SEQ ID NO: 666830 - DNA, 22 bp, Artificial Sequence
  chemically synthesized
ttcctcttttctggtgaatttt

SEQ ID NO: 666831 - DNA, 22 bp, Artificial Sequence
  chemically synthesized
accagttgttcctcttttctgg

SEQ ID NO: 666832 - DNA, 22 bp, Artificial Sequence
  chemically synthesized
gaccagttgttcctcttttctg

SEQ ID NO: 666833 - DNA, 22 bp, Artificial Sequence
  chemically synthesized
accagaaaagaggaacaactgg

SEQ ID NO: 666834 - DNA, 22 bp, Artificial Sequence
  chemically synthesized
gtcaagtttgcgtcacatatct

SEQ ID NO: 666835 - DNA, 22 bp, Artificial Sequence
  chemically synthesized
aaaagcatgtaacatgtagata

SEQ ID NO: 666836 - DNA, 22 bp, Artificial Sequence
  chemically synthesized
caaaagcatgtaacatgtagat

SEQ ID NO: 666837 - DNA, 22 bp, Artificial Sequence
  chemically synthesized
tcaaaagcatgtaacatgtaga

SEQ ID NO: 666838 - DNA, 22 bp, Artificial Sequence
  chemically synthesized
ttcaaaagcatgtaacatgtag

SEQ ID NO: 666839 - DNA, 22 bp, Artificial Sequence
  chemically synthesized
gcgtcacatatctacatgttac

SEQ ID NO: 666840 - DNA, 22 bp, Artificial Sequence
  chemically synthesized
cgtcacatatctacatgttaca

SEQ ID NO: 666841 - DNA, 22 bp, Artificial Sequence
  chemically synthesized
tttttcaaaagcatgtaacatg

SEQ ID NO: 666842 - DNA, 22 bp, Artificial Sequence
  chemically synthesized
actatttttcaaaagcatgtaa

SEQ ID NO: 666843 - DNA, 22 bp, Artificial Sequence
  chemically synthesized
tcactatttttcaaaagcatgt

SEQ ID NO: 666844 - DNA, 22 bp, Artificial Sequence
  chemically synthesized
ctcactatttttcaaaagcatg

SEQ ID NO: 666845 - DNA, 22 bp, Artificial Sequence
  chemically synthesized
catgttacatgcttttgaaaaa

SEQ ID NO: 666846 - DNA, 22 bp, Artificial Sequence
  chemically synthesized
aggtgtttctcactatttttca

SEQ ID NO: 666847 - DNA, 22 bp, Artificial Sequence
  chemically synthesized
catgcttttgaaaaatagtgag

SEQ ID NO: 666848 - DNA, 22 bp, Artificial Sequence
  chemically synthesized
aaatgctgaggtgtttctcact

SEQ ID NO: 666849 - DNA, 22 bp, Artificial Sequence
  chemically synthesized
aaaatgctgaggtgtttctcac

SEQ ID NO: 666850 - DNA, 22 bp, Artificial Sequence
  chemically synthesized
taaaatgctgaggtgtttctca

SEQ ID NO: 666851 - DNA, 22 bp, Artificial Sequence
  chemically synthesized
ttgaaaaatagtgagaaacacc

SEQ ID NO: 666852 - DNA, 22 bp, Artificial Sequence
  chemically synthesized
tgaaaaatagtgagaaacacct

SEQ ID NO: 666853 - DNA, 22 bp, Artificial Sequence
  chemically synthesized
gaaaaatagtgagaaacacctc

SEQ ID NO: 666854 - DNA, 22 bp, Artificial Sequence
  chemically synthesized
aaaaatagtgagaaacacctca

SEQ ID NO: 666855 - DNA, 22 bp, Artificial Sequence
  chemically synthesized
catggctttaaaatgctgaggt

SEQ ID NO: 666856 - DNA, 22 bp, Artificial Sequence
  chemically synthesized
ccatggctttaaaatgctgagg

SEQ ID NO: 666857 - DNA, 22 bp, Artificial Sequence
  chemically synthesized
gaatgcttccatggctttaaaa

SEQ ID NO: 666858 - DNA, 22 bp, Artificial Sequence
  chemically synthesized
ggaatgcttccatggctttaaa

SEQ ID NO: 666859 - DNA, 22 bp, Artificial Sequence
  chemically synthesized
tggaatgcttccatggctttaa

SEQ ID NO: 666860 - DNA, 22 bp, Artificial Sequence
  chemically synthesized
agcattttaaagccatggaagc

SEQ ID NO: 666861 - DNA, 22 bp, Artificial Sequence
  chemically synthesized
taatatctttggaatgcttcca

SEQ ID NO: 666862 - DNA, 22 bp, Artificial Sequence
  chemically synthesized
tgtaatatctttggaatgcttc

SEQ ID NO: 666863 - DNA, 22 bp, Artificial Sequence
  chemically synthesized
ctgtaatatctttggaatgctt

SEQ ID NO: 666864 - DNA, 22 bp, Artificial Sequence
  chemically synthesized
taaagccatggaagcattccaa

SEQ ID NO: 666865 - DNA, 22 bp, Artificial Sequence
  chemically synthesized
tctgtaatatctttggaatgct

SEQ ID NO: 666866 - DNA, 22 bp, Artificial Sequence
  chemically synthesized
aaagccatggaagcattccaaa

SEQ ID NO: 666867 - DNA, 22 bp, Artificial Sequence
  chemically synthesized
ttctgtaatatctttggaatgc

SEQ ID NO: 666868 - DNA, 22 bp, Artificial Sequence
  chemically synthesized
aagccatggaagcattccaaag

SEQ ID NO: 666869 - DNA, 22 bp, Artificial Sequence
  chemically synthesized
tttctgtaatatctttggaatg

SEQ ID NO: 666870 - DNA, 22 bp, Artificial Sequence
  chemically synthesized
ttttctgtaatatctttggaat

SEQ ID NO: 666871 - DNA, 22 bp, Artificial Sequence
  chemically synthesized
tttttctgtaatatctttggaa

SEQ ID NO: 666872 - DNA, 22 bp, Artificial Sequence
  chemically synthesized
atgttttttttctgtaatatct

SEQ ID NO: 666873 - DNA, 22 bp, Artificial Sequence
  chemically synthesized
aatgttttttttctgtaatatc

SEQ ID NO: 666874 - DNA, 22 bp, Artificial Sequence
  chemically synthesized
caaagatattacagaaaaaaaa

SEQ ID NO: 666875 - DNA, 22 bp, Artificial Sequence
  chemically synthesized
aaatgaagggacttaatgtttt

SEQ ID NO: 666876 - DNA, 22 bp, Artificial Sequence
  chemically synthesized
cagaaaaaaaacattaagtccc

SEQ ID NO: 666877 - DNA, 22 bp, Artificial Sequence
  chemically synthesized
taaaattgaaatgaagggactt

SEQ ID NO: 666878 - DNA, 22 bp, Artificial Sequence
  chemically synthesized
agtcccttcatttcaattttat

SEQ ID NO: 666879 - DNA, 22 bp, Artificial Sequence
  chemically synthesized
aaaagacagaaaccagctataa

SEQ ID NO: 666880 - DNA, 22 bp, Artificial Sequence
  chemically synthesized
catttcaattttatagctggtt

SEQ ID NO: 666881 - DNA, 22 bp, Artificial Sequence
  chemically synthesized
atttcaattttatagctggttt

SEQ ID NO: 666882 - DNA, 22 bp, Artificial Sequence
  chemically synthesized
ttaaaaagacagaaaccagcta

SEQ ID NO: 666883 - DNA, 22 bp, Artificial Sequence
  chemically synthesized
caattttatagctggtttctgt

SEQ ID NO: 666884 - DNA, 22 bp, Artificial Sequence
  chemically synthesized
aattttatagctggtttctgtc

SEQ ID NO: 666885 - DNA, 22 bp, Artificial Sequence
  chemically synthesized
cagtattattaaaaagacagaa

SEQ ID NO: 666886 - DNA, 22 bp, Artificial Sequence
  chemically synthesized
gcagtattattaaaaagacaga

SEQ ID NO: 666887 - DNA, 22 bp, Artificial Sequence
  chemically synthesized
tatagctggtttctgtcttttt

SEQ ID NO: 666888 - DNA, 22 bp, Artificial Sequence
  chemically synthesized
tgcagtattattaaaaagacag

SEQ ID NO: 666889 - DNA, 22 bp, Artificial Sequence
  chemically synthesized
atagctggtttctgtcttttta

SEQ ID NO: 666890 - DNA, 22 bp, Artificial Sequence
  chemically synthesized
ttgcagtattattaaaaagaca

SEQ ID NO: 666891 - DNA, 22 bp, Artificial Sequence
  chemically synthesized
tagctggtttctgtctttttaa

SEQ ID NO: 666892 - DNA, 22 bp, Artificial Sequence
  chemically synthesized
gtttctgtctttttaataatac

SEQ ID NO: 666893 - DNA, 22 bp, Artificial Sequence
  chemically synthesized
ctgtctttttaataatactgca

SEQ ID NO: 666894 - DNA, 22 bp, Artificial Sequence
  chemically synthesized
tgtctttttaataatactgcaa

SEQ ID NO: 666895 - DNA, 22 bp, Artificial Sequence
  chemically synthesized
tctttttaataatactgcaaaa

SEQ ID NO: 666896 - DNA, 22 bp, Artificial Sequence
  chemically synthesized
tttaataatactgcaaaaatcc

SEQ ID NO: 666897 - DNA, 22 bp, Artificial Sequence
  chemically synthesized
ttaataatactgcaaaaatcct

SEQ ID NO: 666898 - DNA, 22 bp, Artificial Sequence
  chemically synthesized
taataatactgcaaaaatccta

SEQ ID NO: 666899 - DNA, 22 bp, Artificial Sequence
  chemically synthesized
agtcagagatagtaggattttt

SEQ ID NO: 666900 - DNA, 22 bp, Artificial Sequence
  chemically synthesized
aataatactgcaaaaatcctac

SEQ ID NO: 666901 - DNA, 22 bp, Artificial Sequence
  chemically synthesized
ataatactgcaaaaatcctact

SEQ ID NO: 666902 - DNA, 22 bp, Artificial Sequence
  chemically synthesized
agttcagtcagagatagtagga

SEQ ID NO: 666903 - DNA, 22 bp, Artificial Sequence
  chemically synthesized
caaaaatcctactatctctgac

SEQ ID NO: 666904 - DNA, 22 bp, Artificial Sequence
  chemically synthesized
gacctcagttcagtcagagata

SEQ ID NO: 666905 - DNA, 22 bp, Artificial Sequence
  chemically synthesized
tagacctcagttcagtcagaga

SEQ ID NO: 666906 - DNA, 22 bp, Artificial Sequence
  chemically synthesized
aattctagacctcagttcagtc

SEQ ID NO: 666907 - DNA, 22 bp, Artificial Sequence
  chemically synthesized
aaattctagacctcagttcagt

SEQ ID NO: 666908 - DNA, 22 bp, Artificial Sequence
  chemically synthesized
taaattctagacctcagttcag

SEQ ID NO: 666909 - DNA, 22 bp, Artificial Sequence
  chemically synthesized
ctatctctgactgaactgaggt

SEQ ID NO: 666910 - DNA, 22 bp, Artificial Sequence
  chemically synthesized
ttttaaattctagacctcagtt

SEQ ID NO: 666911 - DNA, 22 bp, Artificial Sequence
  chemically synthesized
gttttaaattctagacctcagt

SEQ ID NO: 666912 - DNA, 22 bp, Artificial Sequence
  chemically synthesized
tctctgactgaactgaggtcta

SEQ ID NO: 666913 - DNA, 22 bp, Artificial Sequence
  chemically synthesized
cttgttttaaattctagacctc

SEQ ID NO: 666914 - DNA, 22 bp, Artificial Sequence
  chemically synthesized
tgactgaactgaggtctagaat

SEQ ID NO: 666915 - DNA, 22 bp, Artificial Sequence
  chemically synthesized
actgaactgaggtctagaattt

SEQ ID NO: 666916 - DNA, 22 bp, Artificial Sequence
  chemically synthesized
aactgaggtctagaatttaaaa

SEQ ID NO: 666917 - DNA, 22 bp, Artificial Sequence
  chemically synthesized
aaacactccttgttttaaattc

SEQ ID NO: 666918 - DNA, 22 bp, Artificial Sequence
  chemically synthesized
aggtctagaatttaaaacaagg

SEQ ID NO: 666919 - DNA, 22 bp, Artificial Sequence
  chemically synthesized
gaatttaaaacaaggagtgttt

SEQ ID NO: 666920 - DNA, 22 bp, Artificial Sequence
  chemically synthesized
gaaagatagactaaaacactcc

SEQ ID NO: 666921 - DNA, 22 bp, Artificial Sequence
  chemically synthesized
aaaacaaggagtgttttagtct

SEQ ID NO: 666922 - DNA, 22 bp, Artificial Sequence
  chemically synthesized
aaacaaggagtgttttagtcta

SEQ ID NO: 666923 - DNA, 22 bp, Artificial Sequence
  chemically synthesized
cataagccattggaaagataga

SEQ ID NO: 666924 - DNA, 22 bp, Artificial Sequence
  chemically synthesized
tagtctatctttccaatggctt

SEQ ID NO: 666925 - DNA, 22 bp, Artificial Sequence
  chemically synthesized
agtctatctttccaatggctta

SEQ ID NO: 666926 - DNA, 22 bp, Artificial Sequence
  chemically synthesized
gtctatctttccaatggcttat

SEQ ID NO: 666927 - DNA, 22 bp, Artificial Sequence
  chemically synthesized
caaaaagtctccataagccatt

SEQ ID NO: 666928 - DNA, 22 bp, Artificial Sequence
  chemically synthesized
ccaaaaagtctccataagccat

SEQ ID NO: 666929 - DNA, 22 bp, Artificial Sequence
  chemically synthesized
tccaaaaagtctccataagcca

SEQ ID NO: 666930 - DNA, 22 bp, Artificial Sequence
  chemically synthesized
tctttccaatggcttatggaga

SEQ ID NO: 666931 - DNA, 22 bp, Artificial Sequence
  chemically synthesized
ggcctttccaaaaagtctccat

SEQ ID NO: 666932 - DNA, 22 bp, Artificial Sequence
  chemically synthesized
tccaatggcttatggagacttt

SEQ ID NO: 666933 - DNA, 22 bp, Artificial Sequence
  chemically synthesized
aggcctttccaaaaagtctcca

SEQ ID NO: 666934 - DNA, 22 bp, Artificial Sequence
  chemically synthesized
ccaatggcttatggagactttt

SEQ ID NO: 666935 - DNA, 22 bp, Artificial Sequence
  chemically synthesized
caatggcttatggagacttttt

SEQ ID NO: 666936 - DNA, 22 bp, Artificial Sequence
  chemically synthesized
aaaccttaggcctttccaaaaa

SEQ ID NO: 666937 - DNA, 22 bp, Artificial Sequence
  chemically synthesized
atggagactttttggaaaggcc

SEQ ID NO: 666938 - DNA, 22 bp, Artificial Sequence
  chemically synthesized
tggagactttttggaaaggcct

SEQ ID NO: 666939 - DNA, 22 bp, Artificial Sequence
  chemically synthesized
tttggaaaggcctaaggtttca

SEQ ID NO: 666940 - DNA, 22 bp, Artificial Sequence
  chemically synthesized
ttggaaaggcctaaggtttcaa

SEQ ID NO: 666941 - DNA, 22 bp, Artificial Sequence
  chemically synthesized
tggaaaggcctaaggtttcaat

SEQ ID NO: 666942 - DNA, 22 bp, Artificial Sequence
  chemically synthesized
atagataggcatattgaaacct

SEQ ID NO: 666943 - DNA, 22 bp, Artificial Sequence
  chemically synthesized
ggaaaggcctaaggtttcaata

SEQ ID NO: 666944 - DNA, 22 bp, Artificial Sequence
  chemically synthesized
gaaaggcctaaggtttcaatat

SEQ ID NO: 666945 - DNA, 22 bp, Artificial Sequence
  chemically synthesized
gctaatagataggcatattgaa

SEQ ID NO: 666946 - DNA, 22 bp, Artificial Sequence
  chemically synthesized
tagctaatagataggcatattg

SEQ ID NO: 666947 - DNA, 22 bp, Artificial Sequence
  chemically synthesized
ctagctaatagataggcatatt

SEQ ID NO: 666948 - DNA, 22 bp, Artificial Sequence
  chemically synthesized
tctagctaatagataggcatat

SEQ ID NO: 666949 - DNA, 22 bp, Artificial Sequence
  chemically synthesized
tttctagctaatagataggcat

SEQ ID NO: 666950 - DNA, 22 bp, Artificial Sequence
  chemically synthesized
aggtttcaatatgcctatctat

SEQ ID NO: 666951 - DNA, 22 bp, Artificial Sequence
  chemically synthesized
ttctttctagctaatagatagg

SEQ ID NO: 666952 - DNA, 22 bp, Artificial Sequence
  chemically synthesized
ttgttctttctagctaatagat

SEQ ID NO: 666953 - DNA, 22 bp, Artificial Sequence
  chemically synthesized
caatatgcctatctattagcta

SEQ ID NO: 666954 - DNA, 22 bp, Artificial Sequence
  chemically synthesized
aatatgcctatctattagctag

SEQ ID NO: 666955 - DNA, 22 bp, Artificial Sequence
  chemically synthesized
atgaggtcattattgttctttc

SEQ ID NO: 666956 - DNA, 22 bp, Artificial Sequence
  chemically synthesized
tctattagctagaaagaacaat

SEQ ID NO: 666957 - DNA, 22 bp, Artificial Sequence
  chemically synthesized
ttagctagaaagaacaataatg

SEQ ID NO: 666958 - DNA, 22 bp, Artificial Sequence
  chemically synthesized
gctagaaagaacaataatgacc

SEQ ID NO: 666959 - DNA, 22 bp, Artificial Sequence
  chemically synthesized
ataaagttaatgaggtcattat

SEQ ID NO: 666960 - DNA, 22 bp, Artificial Sequence
  chemically synthesized
gaaagaacaataatgacctcat

SEQ ID NO: 666961 - DNA, 22 bp, Artificial Sequence
  chemically synthesized
cactcataaagttaatgaggtc

SEQ ID NO: 666962 - DNA, 22 bp, Artificial Sequence
  chemically synthesized
ccactcataaagttaatgaggt

SEQ ID NO: 666963 - DNA, 22 bp, Artificial Sequence
  chemically synthesized
tccactcataaagttaatgagg

SEQ ID NO: 666964 - DNA, 22 bp, Artificial Sequence
  chemically synthesized
tttccactcataaagttaatga

SEQ ID NO: 666965 - DNA, 22 bp, Artificial Sequence
  chemically synthesized
gccgtacagctctttccactca

SEQ ID NO: 666966 - DNA, 22 bp, Artificial Sequence
  chemically synthesized
agccgtacagctctttccactc

SEQ ID NO: 666967 - DNA, 22 bp, Artificial Sequence
  chemically synthesized
attaactttatgagtggaaaga

SEQ ID NO: 666968 - DNA, 22 bp, Artificial Sequence
  chemically synthesized
actttatgagtggaaagagctg

SEQ ID NO: 666969 - DNA, 22 bp, Artificial Sequence
  chemically synthesized
tatgagtggaaagagctgtacg

SEQ ID NO: 666970 - DNA, 22 bp, Artificial Sequence
  chemically synthesized
atgagtggaaagagctgtacgg

SEQ ID NO: 666971 - DNA, 22 bp, Artificial Sequence
  chemically synthesized
tgagtggaaagagctgtacggc

SEQ ID NO: 666972 - DNA, 22 bp, Artificial Sequence
  chemically synthesized
gaataatcatttagccgtacag

SEQ ID NO: 666973 - DNA, 22 bp, Artificial Sequence
  chemically synthesized
ttggaataatcatttagccgta

SEQ ID NO: 666974 - DNA, 22 bp, Artificial Sequence
  chemically synthesized
tctgttggaataatcatttagc

SEQ ID NO: 666975 - DNA, 22 bp, Artificial Sequence
  chemically synthesized
atctgttggaataatcatttag

SEQ ID NO: 666976 - DNA, 22 bp, Artificial Sequence
  chemically synthesized
tacggctaaatgattattccaa

SEQ ID NO: 666977 - DNA, 22 bp, Artificial Sequence
  chemically synthesized
taccaatttatctgttggaata

SEQ ID NO: 666978 - DNA, 22 bp, Artificial Sequence
  chemically synthesized
aatgattattccaacagataaa

SEQ ID NO: 666979 - DNA, 22 bp, Artificial Sequence
  chemically synthesized
ttccaacagataaattggtata

SEQ ID NO: 666980 - DNA, 22 bp, Artificial Sequence
  chemically synthesized
caacagataaattggtatagtg

SEQ ID NO: 666981 - DNA, 22 bp, Artificial Sequence
  chemically synthesized
gtatgaagaaacaaagaccact

SEQ ID NO: 666982 - DNA, 22 bp, Artificial Sequence
  chemically synthesized
gtatagtggtctttgtttcttc

SEQ ID NO: 666983 - DNA, 22 bp, Artificial Sequence
  chemically synthesized
ggaaatagagttggtatgaaga

SEQ ID NO: 666984 - DNA, 22 bp, Artificial Sequence
  chemically synthesized
tgggaaatagagttggtatgaa

SEQ ID NO: 666985 - DNA, 22 bp, Artificial Sequence
  chemically synthesized
ctgggaaatagagttggtatga

SEQ ID NO: 666986 - DNA, 22 bp, Artificial Sequence
  chemically synthesized
ttctgggaaatagagttggtat

SEQ ID NO: 666987 - DNA, 22 bp, Artificial Sequence
  chemically synthesized
cttctgggaaatagagttggta

SEQ ID NO: 666988 - DNA, 22 bp, Artificial Sequence
  chemically synthesized
tgtttcttcataccaactctat

SEQ ID NO: 666989 - DNA, 22 bp, Artificial Sequence
  chemically synthesized
gtttcttcataccaactctatt

SEQ ID NO: 666990 - DNA, 22 bp, Artificial Sequence
  chemically synthesized
tttcttcataccaactctattt

SEQ ID NO: 666991 - DNA, 22 bp, Artificial Sequence
  chemically synthesized
aatttcttctgggaaatagagt

SEQ ID NO: 666992 - DNA, 22 bp, Artificial Sequence
  chemically synthesized
cttcataccaactctatttccc

SEQ ID NO: 666993 - DNA, 22 bp, Artificial Sequence
  chemically synthesized
ttcataccaactctatttccca

SEQ ID NO: 666994 - DNA, 22 bp, Artificial Sequence
  chemically synthesized
cataccaactctatttcccaga

SEQ ID NO: 666995 - DNA, 22 bp, Artificial Sequence
  chemically synthesized
gattaaatttcttctgggaaat

SEQ ID NO: 666996 - DNA, 22 bp, Artificial Sequence
  chemically synthesized
ataccaactctatttcccagaa

SEQ ID NO: 666997 - DNA, 22 bp, Artificial Sequence
  chemically synthesized
ggattaaatttcttctgggaaa

SEQ ID NO: 666998 - DNA, 22 bp, Artificial Sequence
  chemically synthesized
ggagatttggattaaatttctt

SEQ ID NO: 666999 - DNA, 22 bp, Artificial Sequence
  chemically synthesized
tatttcccagaagaaatttaat

SEQ ID NO: 667000 - DNA, 22 bp, Artificial Sequence
  chemically synthesized
tttcccagaagaaatttaatcc

SEQ ID NO: 667001 - DNA, 22 bp, Artificial Sequence
  chemically synthesized
cccagaagaaatttaatccaaa

SEQ ID NO: 667002 - DNA, 22 bp, Artificial Sequence
  chemically synthesized
ccacctgggagatttggattaa

SEQ ID NO: 667003 - DNA, 22 bp, Artificial Sequence
  chemically synthesized
ccagaagaaatttaatccaaat

SEQ ID NO: 667004 - DNA, 22 bp, Artificial Sequence
  chemically synthesized
accacctgggagatttggatta

SEQ ID NO: 667005 - DNA, 22 bp, Artificial Sequence
  chemically synthesized
acttaccacctgggagatttgg

SEQ ID NO: 667006 - DNA, 22 bp, Artificial Sequence
  chemically synthesized
cacttaccacctgggagatttg

SEQ ID NO: 667007 - DNA, 22 bp, Artificial Sequence
  chemically synthesized
tcacttaccacctgggagattt

SEQ ID NO: 667008 - DNA, 22 bp, Artificial Sequence
  chemically synthesized
ttcacttaccacctgggagatt

SEQ ID NO: 667009 - DNA, 22 bp, Artificial Sequence
  chemically synthesized
tttttcacttaccacctgggag

SEQ ID NO: 667010 - DNA, 22 bp, Artificial Sequence
  chemically synthesized
atttttcacttaccacctggga

SEQ ID NO: 667011 - DNA, 22 bp, Artificial Sequence
  chemically synthesized
tatttttcacttaccacctggg

SEQ ID NO: 667012 - DNA, 22 bp, Artificial Sequence
  chemically synthesized
aatccaaatctcccaggtggta

SEQ ID NO: 667013 - DNA, 22 bp, Artificial Sequence
  chemically synthesized
atccaaatctcccaggtggtaa

SEQ ID NO: 667014 - DNA, 22 bp, Artificial Sequence
  chemically synthesized
aattttatttttcacttaccac

SEQ ID NO: 667015 - DNA, 22 bp, Artificial Sequence
  chemically synthesized
taaattttatttttcacttacc

SEQ ID NO: 667016 - DNA, 22 bp, Artificial Sequence
  chemically synthesized
ccaggtggtaagtgaaaaataa

SEQ ID NO: 667017 - DNA, 22 bp, Artificial Sequence
  chemically synthesized
ccccaaaagcatatgtgctcta

SEQ ID NO: 667018 - DNA, 22 bp, Artificial Sequence
  chemically synthesized
gaacaatactcccccaaaagca

SEQ ID NO: 667019 - DNA, 22 bp, Artificial Sequence
  chemically synthesized
agaacaatactcccccaaaagc

SEQ ID NO: 667020 - DNA, 22 bp, Artificial Sequence
  chemically synthesized
agagcacatatgcttttggggg

SEQ ID NO: 667021 - DNA, 22 bp, Artificial Sequence
  chemically synthesized
gagcacatatgcttttggggga

SEQ ID NO: 667022 - DNA, 22 bp, Artificial Sequence
  chemically synthesized
aatttagaacaatactccccca

SEQ ID NO: 667023 - DNA, 22 bp, Artificial Sequence
  chemically synthesized
ttgggggagtattgttctaaat

SEQ ID NO: 667024 - DNA, 22 bp, Artificial Sequence
  chemically synthesized
tgggggagtattgttctaaatt

SEQ ID NO: 667025 - DNA, 22 bp, Artificial Sequence
  chemically synthesized
gggggagtattgttctaaattc

SEQ ID NO: 667026 - DNA, 22 bp, Artificial Sequence
  chemically synthesized
ggggagtattgttctaaattca

SEQ ID NO: 667027 - DNA, 22 bp, Artificial Sequence
  chemically synthesized
tatgccaaacactgaatttaga

SEQ ID NO: 667028 - DNA, 22 bp, Artificial Sequence
  chemically synthesized
ttctaaattcagtgtttggcat

SEQ ID NO: 667029 - DNA, 22 bp, Artificial Sequence
  chemically synthesized
aatgcgtattgtatgccaaaca

SEQ ID NO: 667030 - DNA, 22 bp, Artificial Sequence
  chemically synthesized
taaattcagtgtttggcataca

SEQ ID NO: 667031 - DNA, 22 bp, Artificial Sequence
  chemically synthesized
aattcagtgtttggcatacaat

SEQ ID NO: 667032 - DNA, 22 bp, Artificial Sequence
  chemically synthesized
agtgtttggcatacaatacgca

SEQ ID NO: 667033 - DNA, 22 bp, Artificial Sequence
  chemically synthesized
ggcatacaatacgcattgaact

SEQ ID NO: 667034 - DNA, 22 bp, Artificial Sequence
  chemically synthesized
gcatacaatacgcattgaacta

SEQ ID NO: 667035 - DNA, 22 bp, Artificial Sequence
  chemically synthesized
gtaaaataggcaggcagtagta

SEQ ID NO: 667036 - DNA, 22 bp, Artificial Sequence
  chemically synthesized
gaaaattagtaaaataggcagg

SEQ ID NO: 667037 - DNA, 22 bp, Artificial Sequence
  chemically synthesized
aactactactgcctgcctattt

SEQ ID NO: 667038 - DNA, 22 bp, Artificial Sequence
  chemically synthesized
ggaaaattagtaaaataggcag

SEQ ID NO: 667039 - DNA, 22 bp, Artificial Sequence
  chemically synthesized
ctactgcctgcctattttacta

SEQ ID NO: 667040 - DNA, 22 bp, Artificial Sequence
  chemically synthesized
ctgcctgcctattttactaatt

SEQ ID NO: 667041 - DNA, 22 bp, Artificial Sequence
  chemically synthesized
ggaaaatttggaaaattagtaa

SEQ ID NO: 667042 - DNA, 22 bp, Artificial Sequence
  chemically synthesized
gggaaaatttggaaaattagta

SEQ ID NO: 667043 - DNA, 22 bp, Artificial Sequence
  chemically synthesized
cctgcctattttactaattttc

SEQ ID NO: 667044 - DNA, 22 bp, Artificial Sequence
  chemically synthesized
ttgggaaaatttggaaaattag

SEQ ID NO: 667045 - DNA, 22 bp, Artificial Sequence
  chemically synthesized
cttgggaaaatttggaaaatta

SEQ ID NO: 667046 - DNA, 22 bp, Artificial Sequence
  chemically synthesized
cctattttactaattttccaaa

SEQ ID NO: 667047 - DNA, 22 bp, Artificial Sequence
  chemically synthesized
gcttcttgggaaaatttggaaa

SEQ ID NO: 667048 - DNA, 22 bp, Artificial Sequence
  chemically synthesized
ggcttcttgggaaaatttggaa

SEQ ID NO: 667049 - DNA, 22 bp, Artificial Sequence
  chemically synthesized
ttttactaattttccaaatttt

SEQ ID NO: 667050 - DNA, 22 bp, Artificial Sequence
  chemically synthesized
tggcttcttgggaaaatttgga

SEQ ID NO: 667051 - DNA, 22 bp, Artificial Sequence
  chemically synthesized
tactaattttccaaattttccc

SEQ ID NO: 667052 - DNA, 22 bp, Artificial Sequence
  chemically synthesized
ttttggcttcttgggaaaattt

SEQ ID NO: 667053 - DNA, 22 bp, Artificial Sequence
  chemically synthesized
actaattttccaaattttccca

SEQ ID NO: 667054 - DNA, 22 bp, Artificial Sequence
  chemically synthesized
gttttggcttcttgggaaaatt

SEQ ID NO: 667055 - DNA, 22 bp, Artificial Sequence
  chemically synthesized
ctaattttccaaattttcccaa

SEQ ID NO: 667056 - DNA, 22 bp, Artificial Sequence
  chemically synthesized
attttccaaattttcccaagaa

SEQ ID NO: 667057 - DNA, 22 bp, Artificial Sequence
  chemically synthesized
ccttgttttggcttcttgggaa

SEQ ID NO: 667058 - DNA, 22 bp, Artificial Sequence
  chemically synthesized
tccaaattttcccaagaagcca

SEQ ID NO: 667059 - DNA, 22 bp, Artificial Sequence
  chemically synthesized
ccaaattttcccaagaagccaa

SEQ ID NO: 667060 - DNA, 22 bp, Artificial Sequence
  chemically synthesized
caaattttcccaagaagccaaa

SEQ ID NO: 667061 - DNA, 22 bp, Artificial Sequence
  chemically synthesized
tcccaagaagccaaaacaaggc

SEQ ID NO: 667062 - DNA, 22 bp, Artificial Sequence
  chemically synthesized
cccaagaagccaaaacaaggca

SEQ ID NO: 667063 - DNA, 22 bp, Artificial Sequence
  chemically synthesized
ccaagaagccaaaacaaggcag

SEQ ID NO: 667064 - DNA, 22 bp, Artificial Sequence
  chemically synthesized
taataggagtatgtggggagac

SEQ ID NO: 667065 - DNA, 22 bp, Artificial Sequence
  chemically synthesized
tataataggagtatgtggggag

SEQ ID NO: 667066 - DNA, 22 bp, Artificial Sequence
  chemically synthesized
ctataataggagtatgtgggga

SEQ ID NO: 667067 - DNA, 22 bp, Artificial Sequence
  chemically synthesized
tctataataggagtatgtgggg

SEQ ID NO: 667068 - DNA, 22 bp, Artificial Sequence
  chemically synthesized
cccacatactcctattatagaa

SEQ ID NO: 667069 - DNA, 22 bp, Artificial Sequence
  chemically synthesized
aaatatgccacctttctataat

SEQ ID NO: 667070 - DNA, 22 bp, Artificial Sequence
  chemically synthesized
aaaatatgccacctttctataa

SEQ ID NO: 667071 - DNA, 22 bp, Artificial Sequence
  chemically synthesized
taaaatatgccacctttctata

SEQ ID NO: 667072 - DNA, 22 bp, Artificial Sequence
  chemically synthesized
tattttaaaatatgccaccttt

SEQ ID NO: 667073 - DNA, 22 bp, Artificial Sequence
  chemically synthesized
ctattatagaaaggtggcatat

SEQ ID NO: 667074 - DNA, 22 bp, Artificial Sequence
  chemically synthesized
ttatattttaaaatatgccacc

SEQ ID NO: 667075 - DNA, 22 bp, Artificial Sequence
  chemically synthesized
ttatagaaaggtggcatatttt

SEQ ID NO: 667076 - DNA, 22 bp, Artificial Sequence
  chemically synthesized
tagaaaggtggcatattttaaa

SEQ ID NO: 667077 - DNA, 22 bp, Artificial Sequence
  chemically synthesized
gagacatattattatattttaa

SEQ ID NO: 667078 - DNA, 22 bp, Artificial Sequence
  chemically synthesized
gaaaattggagacatattatta

SEQ ID NO: 667079 - DNA, 22 bp, Artificial Sequence
  chemically synthesized
taaaatataataatatgtctcc

SEQ ID NO: 667080 - DNA, 22 bp, Artificial Sequence
  chemically synthesized
aaaatataataatatgtctcca

SEQ ID NO: 667081 - DNA, 22 bp, Artificial Sequence
  chemically synthesized
aaatataataatatgtctccaa

SEQ ID NO: 667082 - DNA, 22 bp, Artificial Sequence
  chemically synthesized
gaggagtgagactggaaaattg

SEQ ID NO: 667083 - DNA, 22 bp, Artificial Sequence
  chemically synthesized
ggaggagtgagactggaaaatt

SEQ ID NO: 667084 - DNA, 22 bp, Artificial Sequence
  chemically synthesized
tggaggagtgagactggaaaat

SEQ ID NO: 667085 - DNA, 22 bp, Artificial Sequence
  chemically synthesized
gaatcctttggaggagtgagac

SEQ ID NO: 667086 - DNA, 22 bp, Artificial Sequence
  chemically synthesized
caattttccagtctcactcctc

SEQ ID NO: 667087 - DNA, 22 bp, Artificial Sequence
  chemically synthesized
tccagtctcactcctccaaagg

SEQ ID NO: 667088 - DNA, 22 bp, Artificial Sequence
  chemically synthesized
ccagtctcactcctccaaagga

SEQ ID NO: 667089 - DNA, 22 bp, Artificial Sequence
  chemically synthesized
cagtctcactcctccaaaggat

SEQ ID NO: 667090 - DNA, 22 bp, Artificial Sequence
  chemically synthesized
aaaagtccattagaatcctttg

SEQ ID NO: 667091 - DNA, 22 bp, Artificial Sequence
  chemically synthesized
actcctccaaaggattctaatg

SEQ ID NO: 667092 - DNA, 22 bp, Artificial Sequence
  chemically synthesized
tcatctgaaaagtccattagaa

SEQ ID NO: 667093 - DNA, 22 bp, Artificial Sequence
  chemically synthesized
gtcatctgaaaagtccattaga

SEQ ID NO: 667094 - DNA, 22 bp, Artificial Sequence
  chemically synthesized
ctccaaaggattctaatggact

SEQ ID NO: 667095 - DNA, 22 bp, Artificial Sequence
  chemically synthesized
caaaggattctaatggactttt

SEQ ID NO: 667096 - DNA, 22 bp, Artificial Sequence
  chemically synthesized
taatggacttttcagatgacaa

SEQ ID NO: 667097 - DNA, 22 bp, Artificial Sequence
  chemically synthesized
gcaagaataatacttgtcatct

SEQ ID NO: 667098 - DNA, 22 bp, Artificial Sequence
  chemically synthesized
atggacttttcagatgacaagt

SEQ ID NO: 667099 - DNA, 22 bp, Artificial Sequence
  chemically synthesized
agctggcaagaataatacttgt

SEQ ID NO: 667100 - DNA, 22 bp, Artificial Sequence
  chemically synthesized
gagctggcaagaataatacttg

SEQ ID NO: 667101 - DNA, 22 bp, Artificial Sequence
  chemically synthesized
ttcagatgacaagtattattct

SEQ ID NO: 667102 - DNA, 22 bp, Artificial Sequence
  chemically synthesized
tcagatgacaagtattattctt

SEQ ID NO: 667103 - DNA, 22 bp, Artificial Sequence
  chemically synthesized
cagatgacaagtattattcttg

SEQ ID NO: 667104 - DNA, 22 bp, Artificial Sequence
  chemically synthesized
agatgacaagtattattcttgc

SEQ ID NO: 667105 - DNA, 22 bp, Artificial Sequence
  chemically synthesized
gtgagtttgagctggcaagaat

SEQ ID NO: 667106 - DNA, 22 bp, Artificial Sequence
  chemically synthesized
tagtgagtttgagctggcaaga

SEQ ID NO: 667107 - DNA, 22 bp, Artificial Sequence
  chemically synthesized
ttctagtgagtttgagctggca

SEQ ID NO: 667108 - DNA, 22 bp, Artificial Sequence
  chemically synthesized
tctgttctagtgagtttgagct

SEQ ID NO: 667109 - DNA, 22 bp, Artificial Sequence
  chemically synthesized
gtctgttctagtgagtttgagc

SEQ ID NO: 667110 - DNA, 22 bp, Artificial Sequence
  chemically synthesized
ttgtctgttctagtgagtttga

SEQ ID NO: 667111 - DNA, 22 bp, Artificial Sequence
  chemically synthesized
ttcttgccagctcaaactcact

SEQ ID NO: 667112 - DNA, 22 bp, Artificial Sequence
  chemically synthesized
ttgccagctcaaactcactaga

SEQ ID NO: 667113 - DNA, 22 bp, Artificial Sequence
  chemically synthesized
gccagctcaaactcactagaac

SEQ ID NO: 667114 - DNA, 22 bp, Artificial Sequence
  chemically synthesized
ccagctcaaactcactagaaca

SEQ ID NO: 667115 - DNA, 22 bp, Artificial Sequence
  chemically synthesized
agatccaaggttcttgtctgtt

SEQ ID NO: 667116 - DNA, 22 bp, Artificial Sequence
  chemically synthesized
aaactcactagaacagacaaga

SEQ ID NO: 667117 - DNA, 22 bp, Artificial Sequence
  chemically synthesized
attaagatccaaggttcttgtc

SEQ ID NO: 667118 - DNA, 22 bp, Artificial Sequence
  chemically synthesized
actagaacagacaagaaccttg

SEQ ID NO: 667119 - DNA, 22 bp, Artificial Sequence
  chemically synthesized
gaacagacaagaaccttggatc

SEQ ID NO: 667120 - DNA, 22 bp, Artificial Sequence
  chemically synthesized
aagtctcattaagatccaaggt

SEQ ID NO: 667121 - DNA, 22 bp, Artificial Sequence
  chemically synthesized
tctgaagtctcattaagatcca

SEQ ID NO: 667122 - DNA, 22 bp, Artificial Sequence
  chemically synthesized
gtctgaagtctcattaagatcc

SEQ ID NO: 667123 - DNA, 22 bp, Artificial Sequence
  chemically synthesized
aatttgtctgaagtctcattaa

SEQ ID NO: 667124 - DNA, 22 bp, Artificial Sequence
  chemically synthesized
ctcaatttgtctgaagtctcat

SEQ ID NO: 667125 - DNA, 22 bp, Artificial Sequence
  chemically synthesized
ggatcttaatgagacttcagac

SEQ ID NO: 667126 - DNA, 22 bp, Artificial Sequence
  chemically synthesized
gatcttaatgagacttcagaca

SEQ ID NO: 667127 - DNA, 22 bp, Artificial Sequence
  chemically synthesized
aattactcaatttgtctgaagt

SEQ ID NO: 667128 - DNA, 22 bp, Artificial Sequence
  chemically synthesized
aaattactcaatttgtctgaag

SEQ ID NO: 667129 - DNA, 22 bp, Artificial Sequence
  chemically synthesized
aatgagacttcagacaaattga

SEQ ID NO: 667130 - DNA, 22 bp, Artificial Sequence
  chemically synthesized
gatttaaattactcaatttgtc

SEQ ID NO: 667131 - DNA, 22 bp, Artificial Sequence
  chemically synthesized
atgagacttcagacaaattgag

SEQ ID NO: 667132 - DNA, 22 bp, Artificial Sequence
  chemically synthesized
cagacaaattgagtaatttaaa

SEQ ID NO: 667133 - DNA, 22 bp, Artificial Sequence
  chemically synthesized
agacaaattgagtaatttaaat

SEQ ID NO: 667134 - DNA, 22 bp, Artificial Sequence
  chemically synthesized
aagacagactggatttaaatta

SEQ ID NO: 667135 - DNA, 22 bp, Artificial Sequence
  chemically synthesized
caagacagactggatttaaatt

SEQ ID NO: 667136 - DNA, 22 bp, Artificial Sequence
  chemically synthesized
tcaagacagactggatttaaat

SEQ ID NO: 667137 - DNA, 22 bp, Artificial Sequence
  chemically synthesized
ctttcaagacagactggattta

SEQ ID NO: 667138 - DNA, 22 bp, Artificial Sequence
  chemically synthesized
gctttcaagacagactggattt

SEQ ID NO: 667139 - DNA, 22 bp, Artificial Sequence
  chemically synthesized
agtaatttaaatccagtctgtc

SEQ ID NO: 667140 - DNA, 22 bp, Artificial Sequence
  chemically synthesized
atttgctttcaagacagactgg

SEQ ID NO: 667141 - DNA, 22 bp, Artificial Sequence
  chemically synthesized
aatttgctttcaagacagactg

SEQ ID NO: 667142 - DNA, 22 bp, Artificial Sequence
  chemically synthesized
gcttaatttgctttcaagacag

SEQ ID NO: 667143 - DNA, 22 bp, Artificial Sequence
  chemically synthesized
ggcttaatttgctttcaagaca

SEQ ID NO: 667144 - DNA, 22 bp, Artificial Sequence
  chemically synthesized
tggcttaatttgctttcaagac

SEQ ID NO: 667145 - DNA, 22 bp, Artificial Sequence
  chemically synthesized
aaatccagtctgtcttgaaagc

SEQ ID NO: 667146 - DNA, 22 bp, Artificial Sequence
  chemically synthesized
aatccagtctgtcttgaaagca

SEQ ID NO: 667147 - DNA, 22 bp, Artificial Sequence
  chemically synthesized
gatattttggcttaatttgctt

SEQ ID NO: 667148 - DNA, 22 bp, Artificial Sequence
  chemically synthesized
tcttgaaagcaaattaagccaa

SEQ ID NO: 667149 - DNA, 22 bp, Artificial Sequence
  chemically synthesized
aagcctggatattttggcttaa

SEQ ID NO: 667150 - DNA, 22 bp, Artificial Sequence
  chemically synthesized
tgaagcctggatattttggctt

SEQ ID NO: 667151 - DNA, 22 bp, Artificial Sequence
  chemically synthesized
gaaagcaaattaagccaaaata

SEQ ID NO: 667152 - DNA, 22 bp, Artificial Sequence
  chemically synthesized
ctgaagcctggatattttggct

SEQ ID NO: 667153 - DNA, 22 bp, Artificial Sequence
  chemically synthesized
aaagcaaattaagccaaaatat

SEQ ID NO: 667154 - DNA, 22 bp, Artificial Sequence
  chemically synthesized
gacttctgaagcctggatattt

SEQ ID NO: 667155 - DNA, 22 bp, Artificial Sequence
  chemically synthesized
tagacttctgaagcctggatat

SEQ ID NO: 667156 - DNA, 22 bp, Artificial Sequence
  chemically synthesized
agccaaaatatccaggcttcag

SEQ ID NO: 667157 - DNA, 22 bp, Artificial Sequence
  chemically synthesized
ccaataattctagacttctgaa

SEQ ID NO: 667158 - DNA, 22 bp, Artificial Sequence
  chemically synthesized
aagatctcccaataattctaga

SEQ ID NO: 667159 - DNA, 22 bp, Artificial Sequence
  chemically synthesized
gaagatctcccaataattctag

SEQ ID NO: 667160 - DNA, 22 bp, Artificial Sequence
  chemically synthesized
ttgaagatctcccaataattct

SEQ ID NO: 667161 - DNA, 22 bp, Artificial Sequence
  chemically synthesized
cagaagtctagaattattggga

SEQ ID NO: 667162 - DNA, 22 bp, Artificial Sequence
  chemically synthesized
ttcttgaagatctcccaataat

SEQ ID NO: 667163 - DNA, 22 bp, Artificial Sequence
  chemically synthesized
agaagtctagaattattgggag

SEQ ID NO: 667164 - DNA, 22 bp, Artificial Sequence
  chemically synthesized
gtctgttcttgaagatctccca

SEQ ID NO: 667165 - DNA, 22 bp, Artificial Sequence
  chemically synthesized
ctggtctgttcttgaagatctc

SEQ ID NO: 667166 - DNA, 22 bp, Artificial Sequence
  chemically synthesized
gaattattgggagatcttcaag

SEQ ID NO: 667167 - DNA, 22 bp, Artificial Sequence
  chemically synthesized
ttgggagatcttcaagaacaga

SEQ ID NO: 667168 - DNA, 22 bp, Artificial Sequence
  chemically synthesized
cagaattcctggtctgttcttg

SEQ ID NO: 667169 - DNA, 22 bp, Artificial Sequence
  chemically synthesized
ggagatcttcaagaacagacca

SEQ ID NO: 667170 - DNA, 22 bp, Artificial Sequence
  chemically synthesized
aagatatgttccagaattcctg

SEQ ID NO: 667171 - DNA, 22 bp, Artificial Sequence
  chemically synthesized
caagaacagaccaggaattctg

SEQ ID NO: 667172 - DNA, 22 bp, Artificial Sequence
  chemically synthesized
aaagatatgttccagaattcct

SEQ ID NO: 667173 - DNA, 22 bp, Artificial Sequence
  chemically synthesized
aagaacagaccaggaattctgg

SEQ ID NO: 667174 - DNA, 22 bp, Artificial Sequence
  chemically synthesized
taaagatatgttccagaattcc

SEQ ID NO: 667175 - DNA, 22 bp, Artificial Sequence
  chemically synthesized
tttaaagatatgttccagaatt

SEQ ID NO: 667176 - DNA, 22 bp, Artificial Sequence
  chemically synthesized
attctttaaagatatgttccag

SEQ ID NO: 667177 - DNA, 22 bp, Artificial Sequence
  chemically synthesized
agctaattctttaaagatatgt

SEQ ID NO: 667178 - DNA, 22 bp, Artificial Sequence
  chemically synthesized
tcagctaattctttaaagatat

SEQ ID NO: 667179 - DNA, 22 bp, Artificial Sequence
  chemically synthesized
tctcagctaattctttaaagat

SEQ ID NO: 667180 - DNA, 22 bp, Artificial Sequence
  chemically synthesized
ctctcagctaattctttaaaga

SEQ ID NO: 667181 - DNA, 22 bp, Artificial Sequence
  chemically synthesized
ttctctcagctaattctttaaa

SEQ ID NO: 667182 - DNA, 22 bp, Artificial Sequence
  chemically synthesized
tggaacatatctttaaagaatt

SEQ ID NO: 667183 - DNA, 22 bp, Artificial Sequence
  chemically synthesized
gaacatatctttaaagaattag

SEQ ID NO: 667184 - DNA, 22 bp, Artificial Sequence
  chemically synthesized
ctcttctctcagctaattcttt

SEQ ID NO: 667185 - DNA, 22 bp, Artificial Sequence
  chemically synthesized
gtgttcctcttctctcagctaa

SEQ ID NO: 667186 - DNA, 22 bp, Artificial Sequence
  chemically synthesized
taaagaattagctgagagaaga

SEQ ID NO: 667187 - DNA, 22 bp, Artificial Sequence
  chemically synthesized
aaagaattagctgagagaagag

SEQ ID NO: 667188 - DNA, 22 bp, Artificial Sequence
  chemically synthesized
aagaattagctgagagaagagg

SEQ ID NO: 667189 - DNA, 22 bp, Artificial Sequence
  chemically synthesized
gctgagagaagaggaacactaa

SEQ ID NO: 667190 - DNA, 22 bp, Artificial Sequence
  chemically synthesized
agagaagaggaacactaacaca

SEQ ID NO: 667191 - DNA, 22 bp, Artificial Sequence
  chemically synthesized
tagaccaagtatgatgtgttag

SEQ ID NO: 667192 - DNA, 22 bp, Artificial Sequence
  chemically synthesized
aaaaattatagaccaagtatga

SEQ ID NO: 667193 - DNA, 22 bp, Artificial Sequence
  chemically synthesized
acacatcatacttggtctataa

SEQ ID NO: 667194 - DNA, 22 bp, Artificial Sequence
  chemically synthesized
aaatatatctaaaaaattatag

SEQ ID NO: 667195 - DNA, 22 bp, Artificial Sequence
  chemically synthesized
ggtctataattttttagatata

SEQ ID NO: 667196 - DNA, 22 bp, Artificial Sequence
  chemically synthesized
agaggcctcaaatatatctaaa

SEQ ID NO: 667197 - DNA, 22 bp, Artificial Sequence
  chemically synthesized
gtctataattttttagatatat

SEQ ID NO: 667198 - DNA, 22 bp, Artificial Sequence
  chemically synthesized
aagaggcctcaaatatatctaa

SEQ ID NO: 667199 - DNA, 22 bp, Artificial Sequence
  chemically synthesized
taagaggcctcaaatatatcta

SEQ ID NO: 667200 - DNA, 22 bp, Artificial Sequence
  chemically synthesized
taattttttagatatatttgag

SEQ ID NO: 667201 - DNA, 22 bp, Artificial Sequence
  chemically synthesized
agattttaagaggcctcaaata

SEQ ID NO: 667202 - DNA, 22 bp, Artificial Sequence
  chemically synthesized
tttagatatatttgaggcctct

SEQ ID NO: 667203 - DNA, 22 bp, Artificial Sequence
  chemically synthesized
ttagatatatttgaggcctctt

SEQ ID NO: 667204 - DNA, 22 bp, Artificial Sequence
  chemically synthesized
tagatatatttgaggcctctta

SEQ ID NO: 667205 - DNA, 22 bp, Artificial Sequence
  chemically synthesized
agatatatttgaggcctcttaa

SEQ ID NO: 667206 - DNA, 22 bp, Artificial Sequence
  chemically synthesized
cgagttgagattttaagaggcc

SEQ ID NO: 667207 - DNA, 22 bp, Artificial Sequence
  chemically synthesized
gatatatttgaggcctcttaaa

SEQ ID NO: 667208 - DNA, 22 bp, Artificial Sequence
  chemically synthesized
acgagttgagattttaagaggc

SEQ ID NO: 667209 - DNA, 22 bp, Artificial Sequence
  chemically synthesized
tacgagttgagattttaagagg

SEQ ID NO: 667210 - DNA, 22 bp, Artificial Sequence
  chemically synthesized
ttacgagttgagattttaagag

SEQ ID NO: 667211 - DNA, 22 bp, Artificial Sequence
  chemically synthesized
gaggcctcttaaaatctcaact

SEQ ID NO: 667212 - DNA, 22 bp, Artificial Sequence
  chemically synthesized
aggcctcttaaaatctcaactc

SEQ ID NO: 667213 - DNA, 22 bp, Artificial Sequence
  chemically synthesized
atgatgaggtttttacgagttg

SEQ ID NO: 667214 - DNA, 22 bp, Artificial Sequence
  chemically synthesized
ttaaaatctcaactcgtaaaaa

SEQ ID NO: 667215 - DNA, 22 bp, Artificial Sequence
  chemically synthesized
aaaatctcaactcgtaaaaacc

SEQ ID NO: 667216 - DNA, 22 bp, Artificial Sequence
  chemically synthesized
tgttgatgatgaggtttttacg

SEQ ID NO: 667217 - DNA, 22 bp, Artificial Sequence
  chemically synthesized
aaatctcaactcgtaaaaacct

SEQ ID NO: 667218 - DNA, 22 bp, Artificial Sequence
  chemically synthesized
tatgttgatgatgaggttttta

SEQ ID NO: 667219 - DNA, 22 bp, Artificial Sequence
  chemically synthesized
aactcgtaaaaacctcatcatc

SEQ ID NO: 667220 - DNA, 22 bp, Artificial Sequence
  chemically synthesized
agtaaagctctatgttgatgat

SEQ ID NO: 667221 - DNA, 22 bp, Artificial Sequence
  chemically synthesized
gtaaaaacctcatcatcaacat

SEQ ID NO: 667222 - DNA, 22 bp, Artificial Sequence
  chemically synthesized
aagtaaagctctatgttgatga

SEQ ID NO: 667223 - DNA, 22 bp, Artificial Sequence
  chemically synthesized
ccccatttaagtaaagctctat

SEQ ID NO: 667224 - DNA, 22 bp, Artificial Sequence
  chemically synthesized
cccccatttaagtaaagctcta

SEQ ID NO: 667225 - DNA, 22 bp, Artificial Sequence
  chemically synthesized
tcccccatttaagtaaagctct

SEQ ID NO: 667226 - DNA, 22 bp, Artificial Sequence
  chemically synthesized
atcatcaacatagagctttact

SEQ ID NO: 667227 - DNA, 22 bp, Artificial Sequence
  chemically synthesized
ttcccccatttaagtaaagctc

SEQ ID NO: 667228 - DNA, 22 bp, Artificial Sequence
  chemically synthesized
tttttcccccatttaagtaaag

SEQ ID NO: 667229 - DNA, 22 bp, Artificial Sequence
  chemically synthesized
atttttcccccatttaagtaaa

SEQ ID NO: 667230 - DNA, 22 bp, Artificial Sequence
  chemically synthesized
tgtgtaggtttatttttccccc

SEQ ID NO: 667231 - DNA, 22 bp, Artificial Sequence
  chemically synthesized
tacttaaatgggggaaaaataa

SEQ ID NO: 667232 - DNA, 22 bp, Artificial Sequence
  chemically synthesized
acttaaatgggggaaaaataaa

SEQ ID NO: 667233 - DNA, 22 bp, Artificial Sequence
  chemically synthesized
tctgtgtgtaggtttatttttc

SEQ ID NO: 667234 - DNA, 22 bp, Artificial Sequence
  chemically synthesized
cttaaatgggggaaaaataaac

SEQ ID NO: 667235 - DNA, 22 bp, Artificial Sequence
  chemically synthesized
atctgtgtgtaggtttattttt

SEQ ID NO: 667236 - DNA, 22 bp, Artificial Sequence
  chemically synthesized
aaatgggggaaaaataaaccta

SEQ ID NO: 667237 - DNA, 22 bp, Artificial Sequence
  chemically synthesized
tttatctgtgtgtaggtttatt

SEQ ID NO: 667238 - DNA, 22 bp, Artificial Sequence
  chemically synthesized
aatgggggaaaaataaacctac

SEQ ID NO: 667239 - DNA, 22 bp, Artificial Sequence
  chemically synthesized
ctgtttatctgtgtgtaggttt

SEQ ID NO: 667240 - DNA, 22 bp, Artificial Sequence
  chemically synthesized
agtatgaatgcataattcctgt

SEQ ID NO: 667241 - DNA, 22 bp, Artificial Sequence
  chemically synthesized
cacacagataaacaggaattat

SEQ ID NO: 667242 - DNA, 22 bp, Artificial Sequence
  chemically synthesized
tctaagtatgaatgcataattc

SEQ ID NO: 667243 - DNA, 22 bp, Artificial Sequence
  chemically synthesized
atctaagtatgaatgcataatt

SEQ ID NO: 667244 - DNA, 22 bp, Artificial Sequence
  chemically synthesized
tacttatctaagtatgaatgca

SEQ ID NO: 667245 - DNA, 22 bp, Artificial Sequence
  chemically synthesized
tgtacttatctaagtatgaatg

SEQ ID NO: 667246 - DNA, 22 bp, Artificial Sequence
  chemically synthesized
ctgtacttatctaagtatgaat

SEQ ID NO: 667247 - DNA, 22 bp, Artificial Sequence
  chemically synthesized
tctgtacttatctaagtatgaa

SEQ ID NO: 667248 - DNA, 22 bp, Artificial Sequence
  chemically synthesized
tactttctgtacttatctaagt

SEQ ID NO: 667249 - DNA, 22 bp, Artificial Sequence
  chemically synthesized
tgcattcatacttagataagta

SEQ ID NO: 667250 - DNA, 22 bp, Artificial Sequence
  chemically synthesized
acagactgtactttctgtactt

SEQ ID NO: 667251 - DNA, 22 bp, Artificial Sequence
  chemically synthesized
atacttagataagtacagaaag

SEQ ID NO: 667252 - DNA, 22 bp, Artificial Sequence
  chemically synthesized
taaattcacagactgtactttc

SEQ ID NO: 667253 - DNA, 22 bp, Artificial Sequence
  chemically synthesized
agataagtacagaaagtacagt

SEQ ID NO: 667254 - DNA, 22 bp, Artificial Sequence
  chemically synthesized
gataagtacagaaagtacagtc

SEQ ID NO: 667255 - DNA, 22 bp, Artificial Sequence
  chemically synthesized
atagtaattataaattcacaga

SEQ ID NO: 667256 - DNA, 22 bp, Artificial Sequence
  chemically synthesized
gatagtaattataaattcacag

SEQ ID NO: 667257 - DNA, 22 bp, Artificial Sequence
  chemically synthesized
gaaacataacttgatagtaatt

SEQ ID NO: 667258 - DNA, 22 bp, Artificial Sequence
  chemically synthesized
tgaatttataattactatcaag

SEQ ID NO: 667259 - DNA, 22 bp, Artificial Sequence
  chemically synthesized
acatctggaaacataacttgat

SEQ ID NO: 667260 - DNA, 22 bp, Artificial Sequence
  chemically synthesized
cacatctggaaacataacttga

SEQ ID NO: 667261 - DNA, 22 bp, Artificial Sequence
  chemically synthesized
ataattactatcaagttatgtt

SEQ ID NO: 667262 - DNA, 22 bp, Artificial Sequence
  chemically synthesized
taattactatcaagttatgttt

SEQ ID NO: 667263 - DNA, 22 bp, Artificial Sequence
  chemically synthesized
ctatcaagttatgtttccagat

SEQ ID NO: 667264 - DNA, 22 bp, Artificial Sequence
  chemically synthesized
tcaagttatgtttccagatgtg

SEQ ID NO: 667265 - DNA, 22 bp, Artificial Sequence
  chemically synthesized
tgtttccagatgtgaaatggta

SEQ ID NO: 667266 - DNA, 22 bp, Artificial Sequence
  chemically synthesized
gtgataaataagtaataccatt

SEQ ID NO: 667267 - DNA, 22 bp, Artificial Sequence
  chemically synthesized
ccagatgtgaaatggtattact

SEQ ID NO: 667268 - DNA, 22 bp, Artificial Sequence
  chemically synthesized
cagatgtgaaatggtattactt

SEQ ID NO: 667269 - DNA, 22 bp, Artificial Sequence
  chemically synthesized
caaagtcattggtgataaataa

SEQ ID NO: 667270 - DNA, 22 bp, Artificial Sequence
  chemically synthesized
acaaagtcattggtgataaata

SEQ ID NO: 667271 - DNA, 22 bp, Artificial Sequence
  chemically synthesized
tacaaagtcattggtgataaat

SEQ ID NO: 667272 - DNA, 22 bp, Artificial Sequence
  chemically synthesized
cttatttatcaccaatgacttt

SEQ ID NO: 667273 - DNA, 22 bp, Artificial Sequence
  chemically synthesized
gaagagttttacaaagtcattg

SEQ ID NO: 667274 - DNA, 22 bp, Artificial Sequence
  chemically synthesized
agaagagttttacaaagtcatt

SEQ ID NO: 667275 - DNA, 22 bp, Artificial Sequence
  chemically synthesized
atttatcaccaatgactttgta

SEQ ID NO: 667276 - DNA, 22 bp, Artificial Sequence
  chemically synthesized
ttagaagagttttacaaagtca

SEQ ID NO: 667277 - DNA, 22 bp, Artificial Sequence
  chemically synthesized
tttatcaccaatgactttgtaa

SEQ ID NO: 667278 - DNA, 22 bp, Artificial Sequence
  chemically synthesized
cttagaagagttttacaaagtc

SEQ ID NO: 667279 - DNA, 22 bp, Artificial Sequence
  chemically synthesized
atcaccaatgactttgtaaaac

SEQ ID NO: 667280 - DNA, 22 bp, Artificial Sequence
  chemically synthesized
tcaccaatgactttgtaaaact

SEQ ID NO: 667281 - DNA, 22 bp, Artificial Sequence
  chemically synthesized
atttcttagaagagttttacaa

SEQ ID NO: 667282 - DNA, 22 bp, Artificial Sequence
  chemically synthesized
catttcttagaagagttttaca

SEQ ID NO: 667283 - DNA, 22 bp, Artificial Sequence
  chemically synthesized
cttcatttcttagaagagtttt

SEQ ID NO: 667284 - DNA, 22 bp, Artificial Sequence
  chemically synthesized
tccttcatttcttagaagagtt

SEQ ID NO: 667285 - DNA, 22 bp, Artificial Sequence
  chemically synthesized
gccctctccttcatttcttaga

SEQ ID NO: 667286 - DNA, 22 bp, Artificial Sequence
  chemically synthesized
tgtaaaactcttctaagaaatg

SEQ ID NO: 667287 - DNA, 22 bp, Artificial Sequence
  chemically synthesized
gtaaaactcttctaagaaatga

SEQ ID NO: 667288 - DNA, 22 bp, Artificial Sequence
  chemically synthesized
taaaactcttctaagaaatgaa

SEQ ID NO: 667289 - DNA, 22 bp, Artificial Sequence
  chemically synthesized
ttctaagaaatgaaggagaggg

SEQ ID NO: 667290 - DNA, 22 bp, Artificial Sequence
  chemically synthesized
ctaagaaatgaaggagagggcc

SEQ ID NO: 667291 - DNA, 22 bp, Artificial Sequence
  chemically synthesized
taagaaatgaaggagagggcca

SEQ ID NO: 667292 - DNA, 22 bp, Artificial Sequence
  chemically synthesized
agaaatgaaggagagggccagg

SEQ ID NO: 667293 - DNA, 22 bp, Artificial Sequence
  chemically synthesized
caggtgtgagccaccacacctg

SEQ ID NO: 667294 - DNA, 22 bp, Artificial Sequence
  chemically synthesized
ggattacaggtgtgagccacca

SEQ ID NO: 667295 - DNA, 22 bp, Artificial Sequence
  chemically synthesized
cataagtgctgggattacaggt

SEQ ID NO: 667296 - DNA, 22 bp, Artificial Sequence
  chemically synthesized
gacctccataagtgctgggatt

SEQ ID NO: 667297 - DNA, 22 bp, Artificial Sequence
  chemically synthesized
acacctgtaatcccagcactta

SEQ ID NO: 667298 - DNA, 22 bp, Artificial Sequence
  chemically synthesized
taatcccagcacttatggaggt

SEQ ID NO: 667299 - DNA, 22 bp, Artificial Sequence
  chemically synthesized
gtgatccgcccgcctcgacctc

SEQ ID NO: 667300 - DNA, 22 bp, Artificial Sequence
  chemically synthesized
acctcgtgatccgcccgcctcg

SEQ ID NO: 667301 - DNA, 22 bp, Artificial Sequence
  chemically synthesized
ctgacctcgtgatccgcccgcc

SEQ ID NO: 667302 - DNA, 22 bp, Artificial Sequence
  chemically synthesized
atggaggtcgaggcgggcggat

SEQ ID NO: 667303 - DNA, 22 bp, Artificial Sequence
  chemically synthesized
tggaggtcgaggcgggcggatc

SEQ ID NO: 667304 - DNA, 22 bp, Artificial Sequence
  chemically synthesized
gaactcctgacctcgtgatccg

SEQ ID NO: 667305 - DNA, 22 bp, Artificial Sequence
  chemically synthesized
tcgaactcctgacctcgtgatc

SEQ ID NO: 667306 - DNA, 22 bp, Artificial Sequence
  chemically synthesized
ctctcgaactcctgacctcgtg

SEQ ID NO: 667307 - DNA, 22 bp, Artificial Sequence
  chemically synthesized
gccaggctgctctcgaactcct

SEQ ID NO: 667308 - DNA, 22 bp, Artificial Sequence
  chemically synthesized
accatgttggccaggctgctct

SEQ ID NO: 667309 - DNA, 22 bp, Artificial Sequence
  chemically synthesized
caccatgttggccaggctgctc

SEQ ID NO: 667310 - DNA, 22 bp, Artificial Sequence
  chemically synthesized
gagagcagcctggccaacatgg

SEQ ID NO: 667311 - DNA, 22 bp, Artificial Sequence
  chemically synthesized
atagagacggggtttcaccatg

SEQ ID NO: 667312 - DNA, 22 bp, Artificial Sequence
  chemically synthesized
aatagagacggggtttcaccat

SEQ ID NO: 667313 - DNA, 22 bp, Artificial Sequence
  chemically synthesized
taatagagacggggtttcacca

SEQ ID NO: 667314 - DNA, 22 bp, Artificial Sequence
  chemically synthesized
ttaatagagacggggtttcacc

SEQ ID NO: 667315 - DNA, 22 bp, Artificial Sequence
  chemically synthesized
gccaacatggtgaaaccccgtc

SEQ ID NO: 667316 - DNA, 22 bp, Artificial Sequence
  chemically synthesized
tgtttttaatagagacggggtt

SEQ ID NO: 667317 - DNA, 22 bp, Artificial Sequence
  chemically synthesized
gtgtttttaatagagacggggt

SEQ ID NO: 667318 - DNA, 22 bp, Artificial Sequence
  chemically synthesized
tgtgtttttaatagagacgggg

SEQ ID NO: 667319 - DNA, 22 bp, Artificial Sequence
  chemically synthesized
ttgtgtttttaatagagacggg

SEQ ID NO: 667320 - DNA, 22 bp, Artificial Sequence
  chemically synthesized
tttgtgtttttaatagagacgg

SEQ ID NO: 667321 - DNA, 22 bp, Artificial Sequence
  chemically synthesized
ttttgtgtttttaatagagacg

SEQ ID NO: 667322 - DNA, 22 bp, Artificial Sequence
  chemically synthesized
atttttttgtgtttttaataga

SEQ ID NO: 667323 - DNA, 22 bp, Artificial Sequence
  chemically synthesized
gctaatttttttgtgtttttaa

SEQ ID NO: 667324 - DNA, 22 bp, Artificial Sequence
  chemically synthesized
tattaaaaacacaaaaaaatta

SEQ ID NO: 667325 - DNA, 22 bp, Artificial Sequence
  chemically synthesized
ttaaaaacacaaaaaaattagc

SEQ ID NO: 667326 - DNA, 22 bp, Artificial Sequence
  chemically synthesized
aaaacacaaaaaaattagccag

SEQ ID NO: 667327 - DNA, 22 bp, Artificial Sequence
  chemically synthesized
caggtgtgcaccaccatgcctg

SEQ ID NO: 667328 - DNA, 22 bp, Artificial Sequence
  chemically synthesized
ggattacaggtgtgcaccacca

SEQ ID NO: 667329 - DNA, 22 bp, Artificial Sequence
  chemically synthesized
gccaggcatggtggtgcacacc

SEQ ID NO: 667330 - DNA, 22 bp, Artificial Sequence
  chemically synthesized
agtagctaggattacaggtgtg

SEQ ID NO: 667331 - DNA, 22 bp, Artificial Sequence
  chemically synthesized
ctgagtagctaggattacaggt

SEQ ID NO: 667332 - DNA, 22 bp, Artificial Sequence
  chemically synthesized
agcctcctgagtagctaggatt

SEQ ID NO: 667333 - DNA, 22 bp, Artificial Sequence
  chemically synthesized
cagcctcctgagtagctaggat

SEQ ID NO: 667334 - DNA, 22 bp, Artificial Sequence
  chemically synthesized
cttcagcctcctgagtagctag

SEQ ID NO: 667335 - DNA, 22 bp, Artificial Sequence
  chemically synthesized
tcctgcttcagcctcctgagta

SEQ ID NO: 667336 - DNA, 22 bp, Artificial Sequence
  chemically synthesized
taatcctagctactcaggaggc

SEQ ID NO: 667337 - DNA, 22 bp, Artificial Sequence
  chemically synthesized
aagcaattatcctgcttcagcc

SEQ ID NO: 667338 - DNA, 22 bp, Artificial Sequence
  chemically synthesized
gctactcaggaggctgaagcag

SEQ ID NO: 667339 - DNA, 22 bp, Artificial Sequence
  chemically synthesized
ctcaggaggctgaagcaggata

SEQ ID NO: 667340 - DNA, 22 bp, Artificial Sequence
  chemically synthesized
ggttcaagcaattatcctgctt

SEQ ID NO: 667341 - DNA, 22 bp, Artificial Sequence
  chemically synthesized
aggaggctgaagcaggataatt

SEQ ID NO: 667342 - DNA, 22 bp, Artificial Sequence
  chemically synthesized
ctgggttcaagcaattatcctg

SEQ ID NO: 667343 - DNA, 22 bp, Artificial Sequence
  chemically synthesized
cacctcctgggttcaagcaatt

SEQ ID NO: 667344 - DNA, 22 bp, Artificial Sequence
  chemically synthesized
aagcaggataattgcttgaacc

SEQ ID NO: 667345 - DNA, 22 bp, Artificial Sequence
  chemically synthesized
caacctccacctcctgggttca

SEQ ID NO: 667346 - DNA, 22 bp, Artificial Sequence
  chemically synthesized
actacaacctccacctcctggg

SEQ ID NO: 667347 - DNA, 22 bp, Artificial Sequence
  chemically synthesized
agctcactacaacctccacctc

SEQ ID NO: 667348 - DNA, 22 bp, Artificial Sequence
  chemically synthesized
cttgaacccaggaggtggaggt

SEQ ID NO: 667349 - DNA, 22 bp, Artificial Sequence
  chemically synthesized
gaacccaggaggtggaggttgt

SEQ ID NO: 667350 - DNA, 22 bp, Artificial Sequence
  chemically synthesized
aacccaggaggtggaggttgta

SEQ ID NO: 667351 - DNA, 22 bp, Artificial Sequence
  chemically synthesized
aagtgcagtggtgcgatctcag

SEQ ID NO: 667352 - DNA, 22 bp, Artificial Sequence
  chemically synthesized
tagtgagctgagatcgcaccac

SEQ ID NO: 667353 - DNA, 22 bp, Artificial Sequence
  chemically synthesized
tcgcccaggctgaagtgcagtg

SEQ ID NO: 667354 - DNA, 22 bp, Artificial Sequence
  chemically synthesized
tgtcgcccaggctgaagtgcag

SEQ ID NO: 667355 - DNA, 22 bp, Artificial Sequence
  chemically synthesized
agatcgcaccactgcacttcag

SEQ ID NO: 667356 - DNA, 22 bp, Artificial Sequence
  chemically synthesized
attctgtcgcccaggctgaagt

SEQ ID NO: 667357 - DNA, 22 bp, Artificial Sequence
  chemically synthesized
cacttcagcctgggcgacagaa

SEQ ID NO: 667358 - DNA, 22 bp, Artificial Sequence
  chemically synthesized
agatggagtctcattctgtcgc

SEQ ID NO: 667359 - DNA, 22 bp, Artificial Sequence
  chemically synthesized
gagatggagtctcattctgtcg

SEQ ID NO: 667360 - DNA, 22 bp, Artificial Sequence
  chemically synthesized
ttgagatggagtctcattctgt

SEQ ID NO: 667361 - DNA, 22 bp, Artificial Sequence
  chemically synthesized
cagcctgggcgacagaatgaga

SEQ ID NO: 667362 - DNA, 22 bp, Artificial Sequence
  chemically synthesized
cttgagatggagtctcattctg

SEQ ID NO: 667363 - DNA, 22 bp, Artificial Sequence
  chemically synthesized
agcctgggcgacagaatgagac

SEQ ID NO: 667364 - DNA, 22 bp, Artificial Sequence
  chemically synthesized
tcttgagatggagtctcattct

SEQ ID NO: 667365 - DNA, 22 bp, Artificial Sequence
  chemically synthesized
ttcttgagatggagtctcattc

SEQ ID NO: 667366 - DNA, 22 bp, Artificial Sequence
  chemically synthesized
tttcttgagatggagtctcatt

SEQ ID NO: 667367 - DNA, 22 bp, Artificial Sequence
  chemically synthesized
ttttcttgagatggagtctcat

SEQ ID NO: 667368 - DNA, 22 bp, Artificial Sequence
  chemically synthesized
tttttcttgagatggagtctca

SEQ ID NO: 667369 - DNA, 22 bp, Artificial Sequence
  chemically synthesized
ttttttcttgagatggagtctc

SEQ ID NO: 667370 - DNA, 22 bp, Artificial Sequence
  chemically synthesized
ggcgacagaatgagactccatc

SEQ ID NO: 667371 - DNA, 22 bp, Artificial Sequence
  chemically synthesized
tttttttcttgagatggagtct

SEQ ID NO: 667372 - DNA, 22 bp, Artificial Sequence
  chemically synthesized
ttttttttcttgagatggagtc

SEQ ID NO: 667373 - DNA, 22 bp, Artificial Sequence
  chemically synthesized
tttttttttcttgagatggagt

SEQ ID NO: 667374 - DNA, 22 bp, Artificial Sequence
  chemically synthesized
ttttttttttcttgagatggag

SEQ ID NO: 667375 - DNA, 22 bp, Artificial Sequence
  chemically synthesized
ccttttttttttttcttgagat

SEQ ID NO: 667376 - DNA, 22 bp, Artificial Sequence
  chemically synthesized
tcccttttttttttttcttgag

SEQ ID NO: 667377 - DNA, 22 bp, Artificial Sequence
  chemically synthesized
tctcccttttttttttttcttg

SEQ ID NO: 667378 - DNA, 22 bp, Artificial Sequence
  chemically synthesized
ctctcccttttttttttttctt

SEQ ID NO: 667379 - DNA, 22 bp, Artificial Sequence
  chemically synthesized
cttctctccctttttttttttt

SEQ ID NO: 667380 - DNA, 22 bp, Artificial Sequence
  chemically synthesized
catctcaagaaaaaaaaaaaag

SEQ ID NO: 667381 - DNA, 22 bp, Artificial Sequence
  chemically synthesized
ttgcttctctcccttttttttt

SEQ ID NO: 667382 - DNA, 22 bp, Artificial Sequence
  chemically synthesized
attgcttctctccctttttttt

SEQ ID NO: 667383 - DNA, 22 bp, Artificial Sequence
  chemically synthesized
tattgcttctctcccttttttt

SEQ ID NO: 667384 - DNA, 22 bp, Artificial Sequence
  chemically synthesized
aagaaaaaaaaaaaagggagag

SEQ ID NO: 667385 - DNA, 22 bp, Artificial Sequence
  chemically synthesized
ggtactttattgcttctctccc

SEQ ID NO: 667386 - DNA, 22 bp, Artificial Sequence
  chemically synthesized
tgccatactaggtactttattg

SEQ ID NO: 667387 - DNA, 22 bp, Artificial Sequence
  chemically synthesized
gtgccatactaggtactttatt

SEQ ID NO: 667388 - DNA, 22 bp, Artificial Sequence
  chemically synthesized
cacatttgtgccatactaggta

SEQ ID NO: 667389 - DNA, 22 bp, Artificial Sequence
  chemically synthesized
ccacatttgtgccatactaggt

SEQ ID NO: 667390 - DNA, 22 bp, Artificial Sequence
  chemically synthesized
agtcttccacatttgtgccata

SEQ ID NO: 667391 - DNA, 22 bp, Artificial Sequence
  chemically synthesized
tgagtcttccacatttgtgcca

SEQ ID NO: 667392 - DNA, 22 bp, Artificial Sequence
  chemically synthesized
aattctgagtcttccacatttg

SEQ ID NO: 667393 - DNA, 22 bp, Artificial Sequence
  chemically synthesized
ctcaattctgagtcttccacat

SEQ ID NO: 667394 - DNA, 22 bp, Artificial Sequence
  chemically synthesized
gtatggcacaaatgtggaagac

SEQ ID NO: 667395 - DNA, 22 bp, Artificial Sequence
  chemically synthesized
cctcaattctgagtcttccaca

SEQ ID NO: 667396 - DNA, 22 bp, Artificial Sequence
  chemically synthesized
tcctcaattctgagtcttccac

SEQ ID NO: 667397 - DNA, 22 bp, Artificial Sequence
  chemically synthesized
ttcctcaattctgagtcttcca

SEQ ID NO: 667398 - DNA, 22 bp, Artificial Sequence
  chemically synthesized
ttttcctcaattctgagtcttc

SEQ ID NO: 667399 - DNA, 22 bp, Artificial Sequence
  chemically synthesized
tcttttcctcaattctgagtct

SEQ ID NO: 667400 - DNA, 22 bp, Artificial Sequence
  chemically synthesized
ctcttttcctcaattctgagtc

SEQ ID NO: 667401 - DNA, 22 bp, Artificial Sequence
  chemically synthesized
tctcttttcctcaattctgagt

SEQ ID NO: 667402 - DNA, 22 bp, Artificial Sequence
  chemically synthesized
ttctcttttcctcaattctgag

SEQ ID NO: 667403 - DNA, 22 bp, Artificial Sequence
  chemically synthesized
tttctcttttcctcaattctga

SEQ ID NO: 667404 - DNA, 22 bp, Artificial Sequence
  chemically synthesized
ataacctttttctcttttcctc

SEQ ID NO: 667405 - DNA, 22 bp, Artificial Sequence
  chemically synthesized
gttcataacctttttctctttt

SEQ ID NO: 667406 - DNA, 22 bp, Artificial Sequence
  chemically synthesized
ggttcataacctttttctcttt

SEQ ID NO: 667407 - DNA, 22 bp, Artificial Sequence
  chemically synthesized
agaattgaggaaaagagaaaaa

SEQ ID NO: 667408 - DNA, 22 bp, Artificial Sequence
  chemically synthesized
tggttcataacctttttctctt

SEQ ID NO: 667409 - DNA, 22 bp, Artificial Sequence
  chemically synthesized
ttggttcataacctttttctct

SEQ ID NO: 667410 - DNA, 22 bp, Artificial Sequence
  chemically synthesized
tttggttcataacctttttctc

SEQ ID NO: 667411 - DNA, 22 bp, Artificial Sequence
  chemically synthesized
aggaaaagagaaaaaggttatg

SEQ ID NO: 667412 - DNA, 22 bp, Artificial Sequence
  chemically synthesized
agtattttttggttcataacct

SEQ ID NO: 667413 - DNA, 22 bp, Artificial Sequence
  chemically synthesized
tcagtattttttggttcataac

SEQ ID NO: 667414 - DNA, 22 bp, Artificial Sequence
  chemically synthesized
ctcagtattttttggttcataa

SEQ ID NO: 667415 - DNA, 22 bp, Artificial Sequence
  chemically synthesized
aacttctcagtattttttggtt

SEQ ID NO: 667416 - DNA, 22 bp, Artificial Sequence
  chemically synthesized
acagttgaacttctcagtattt

SEQ ID NO: 667417 - DNA, 22 bp, Artificial Sequence
  chemically synthesized
cacagttgaacttctcagtatt

SEQ ID NO: 667418 - DNA, 22 bp, Artificial Sequence
  chemically synthesized
tgaaccaaaaaatactgagaag

SEQ ID NO: 667419 - DNA, 22 bp, Artificial Sequence
  chemically synthesized
tttcacagttgaacttctcagt

SEQ ID NO: 667420 - DNA, 22 bp, Artificial Sequence
  chemically synthesized
atttcacagttgaacttctcag

SEQ ID NO: 667421 - DNA, 22 bp, Artificial Sequence
  chemically synthesized
tatttcacagttgaacttctca

SEQ ID NO: 667422 - DNA, 22 bp, Artificial Sequence
  chemically synthesized
ttatttcacagttgaacttctc

SEQ ID NO: 667423 - DNA, 22 bp, Artificial Sequence
  chemically synthesized
tcttttatttcacagttgaact

SEQ ID NO: 667424 - DNA, 22 bp, Artificial Sequence
  chemically synthesized
tgctatcttttatttcacagtt

SEQ ID NO: 667425 - DNA, 22 bp, Artificial Sequence
  chemically synthesized
gtgctatcttttatttcacagt

SEQ ID NO: 667426 - DNA, 22 bp, Artificial Sequence
  chemically synthesized
tgtgctatcttttatttcacag

SEQ ID NO: 667427 - DNA, 22 bp, Artificial Sequence
  chemically synthesized
agaagttcaactgtgaaataaa

SEQ ID NO: 667428 - DNA, 22 bp, Artificial Sequence
  chemically synthesized
aactgtgaaataaaagatagca

SEQ ID NO: 667429 - DNA, 22 bp, Artificial Sequence
  chemically synthesized
tgaaataaaagatagcacaaaa

SEQ ID NO: 667430 - DNA, 22 bp, Artificial Sequence
  chemically synthesized
aacaatccacagccaggatttt

SEQ ID NO: 667431 - DNA, 22 bp, Artificial Sequence
  chemically synthesized
aaacaatccacagccaggattt

SEQ ID NO: 667432 - DNA, 22 bp, Artificial Sequence
  chemically synthesized
gctgtggattgtttaaggcatt

SEQ ID NO: 667433 - DNA, 22 bp, Artificial Sequence
  chemically synthesized
tggattgtttaaggcatttctg

SEQ ID NO: 667434 - DNA, 22 bp, Artificial Sequence
  chemically synthesized
tttaaggcatttctggctccct

SEQ ID NO: 667435 - DNA, 22 bp, Artificial Sequence
  chemically synthesized
aaggcatttctggctccctcct

SEQ ID NO: 667436 - DNA, 22 bp, Artificial Sequence
  chemically synthesized
aggcatttctggctccctcctc

SEQ ID NO: 667437 - DNA, 22 bp, Artificial Sequence
  chemically synthesized
aggaaggccaagcaagaggagg

SEQ ID NO: 667438 - DNA, 22 bp, Artificial Sequence
  chemically synthesized
ctgaggaaggccaagcaagagg

SEQ ID NO: 667439 - DNA, 22 bp, Artificial Sequence
  chemically synthesized
ctggctccctcctcttgcttgg

SEQ ID NO: 667440 - DNA, 22 bp, Artificial Sequence
  chemically synthesized
tgctgaggaaggccaagcaaga

SEQ ID NO: 667441 - DNA, 22 bp, Artificial Sequence
  chemically synthesized
tggctccctcctcttgcttggc

SEQ ID NO: 667442 - DNA, 22 bp, Artificial Sequence
  chemically synthesized
gctccctcctcttgcttggcct

SEQ ID NO: 667443 - DNA, 22 bp, Artificial Sequence
  chemically synthesized
cctcctcttgcttggccttcct

SEQ ID NO: 667444 - DNA, 22 bp, Artificial Sequence
  chemically synthesized
ctcttgcttggccttcctcagc

SEQ ID NO: 667445 - DNA, 22 bp, Artificial Sequence
  chemically synthesized
ttgcttggccttcctcagcaga

SEQ ID NO: 667446 - DNA, 22 bp, Artificial Sequence
  chemically synthesized
gcttggccttcctcagcagaat

SEQ ID NO: 667447 - DNA, 22 bp, Artificial Sequence
  chemically synthesized
agaagtagtgagattctgctga

SEQ ID NO: 667448 - DNA, 22 bp, Artificial Sequence
  chemically synthesized
cttggccttcctcagcagaatc

SEQ ID NO: 667449 - DNA, 22 bp, Artificial Sequence
  chemically synthesized
ctaagaagtagtgagattctgc

SEQ ID NO: 667450 - DNA, 22 bp, Artificial Sequence
  chemically synthesized
ggccttcctcagcagaatctca

SEQ ID NO: 667451 - DNA, 22 bp, Artificial Sequence
  chemically synthesized
gccttcctcagcagaatctcac

SEQ ID NO: 667452 - DNA, 22 bp, Artificial Sequence
  chemically synthesized
cctcagcagaatctcactactt

SEQ ID NO: 667453 - DNA, 22 bp, Artificial Sequence
  chemically synthesized
ctcagcagaatctcactacttc

SEQ ID NO: 667454 - DNA, 22 bp, Artificial Sequence
  chemically synthesized
cagtgttgctaagaagtagtga

SEQ ID NO: 667455 - DNA, 22 bp, Artificial Sequence
  chemically synthesized
agcagaatctcactacttctta

SEQ ID NO: 667456 - DNA, 22 bp, Artificial Sequence
  chemically synthesized
ttacagtgttgctaagaagtag

SEQ ID NO: 667457 - DNA, 22 bp, Artificial Sequence
  chemically synthesized
ccattattacagtgttgctaag

SEQ ID NO: 667458 - DNA, 22 bp, Artificial Sequence
  chemically synthesized
tgccattattacagtgttgcta

SEQ ID NO: 667459 - DNA, 22 bp, Artificial Sequence
  chemically synthesized
actacttcttagcaacactgta

SEQ ID NO: 667460 - DNA, 22 bp, Artificial Sequence
  chemically synthesized
aactctgccattattacagtgt

SEQ ID NO: 667461 - DNA, 22 bp, Artificial Sequence
  chemically synthesized
caactctgccattattacagtg

SEQ ID NO: 667462 - DNA, 22 bp, Artificial Sequence
  chemically synthesized
cttcttagcaacactgtaataa

SEQ ID NO: 667463 - DNA, 22 bp, Artificial Sequence
  chemically synthesized
cttagcaacactgtaataatgg

SEQ ID NO: 667464 - DNA, 22 bp, Artificial Sequence
  chemically synthesized
ttagcaacactgtaataatggc

SEQ ID NO: 667465 - DNA, 22 bp, Artificial Sequence
  chemically synthesized
aatttcaactctgccattatta

SEQ ID NO: 667466 - DNA, 22 bp, Artificial Sequence
  chemically synthesized
gaatttcaactctgccattatt

SEQ ID NO: 667467 - DNA, 22 bp, Artificial Sequence
  chemically synthesized
agcaacactgtaataatggcag

SEQ ID NO: 667468 - DNA, 22 bp, Artificial Sequence
  chemically synthesized
gcaacactgtaataatggcaga

SEQ ID NO: 667469 - DNA, 22 bp, Artificial Sequence
  chemically synthesized
atttgaatttcaactctgccat

SEQ ID NO: 667470 - DNA, 22 bp, Artificial Sequence
  chemically synthesized
taataatggcagagttgaaatt

SEQ ID NO: 667471 - DNA, 22 bp, Artificial Sequence
  chemically synthesized
acaatgagcaaaactaatttga

SEQ ID NO: 667472 - DNA, 22 bp, Artificial Sequence
  chemically synthesized
aaattcaaattagttttgctca

SEQ ID NO: 667473 - DNA, 22 bp, Artificial Sequence
  chemically synthesized
ccagggcagctaacaatgagca

SEQ ID NO: 667474 - DNA, 22 bp, Artificial Sequence
  chemically synthesized
accagggcagctaacaatgagc

SEQ ID NO: 667475 - DNA, 22 bp, Artificial Sequence
  chemically synthesized
aaattagttttgctcattgtta

SEQ ID NO: 667476 - DNA, 22 bp, Artificial Sequence
  chemically synthesized
taccagggcagctaacaatgag

SEQ ID NO: 667477 - DNA, 22 bp, Artificial Sequence
  chemically synthesized
ttaccagggcagctaacaatga

SEQ ID NO: 667478 - DNA, 22 bp, Artificial Sequence
  chemically synthesized
gttttgctcattgttagctgcc

SEQ ID NO: 667479 - DNA, 22 bp, Artificial Sequence
  chemically synthesized
tgctcattgttagctgccctgg

SEQ ID NO: 667480 - DNA, 22 bp, Artificial Sequence
  chemically synthesized
gctcattgttagctgccctggt

SEQ ID NO: 667481 - DNA, 22 bp, Artificial Sequence
  chemically synthesized
aacaaaccttttaccagggcag

SEQ ID NO: 667482 - DNA, 22 bp, Artificial Sequence
  chemically synthesized
ctcattgttagctgccctggta

SEQ ID NO: 667483 - DNA, 22 bp, Artificial Sequence
  chemically synthesized
tcaacaaaccttttaccagggc

SEQ ID NO: 667484 - DNA, 22 bp, Artificial Sequence
  chemically synthesized
ctcaacaaaccttttaccaggg

SEQ ID NO: 667485 - DNA, 22 bp, Artificial Sequence
  chemically synthesized
attgttagctgccctggtaaaa

SEQ ID NO: 667486 - DNA, 22 bp, Artificial Sequence
  chemically synthesized
tctcaacaaaccttttaccagg

SEQ ID NO: 667487 - DNA, 22 bp, Artificial Sequence
  chemically synthesized
ctttctcaacaaaccttttacc

SEQ ID NO: 667488 - DNA, 22 bp, Artificial Sequence
  chemically synthesized
ttagctgccctggtaaaaggtt

SEQ ID NO: 667489 - DNA, 22 bp, Artificial Sequence
  chemically synthesized
gctgccctggtaaaaggtttgt

SEQ ID NO: 667490 - DNA, 22 bp, Artificial Sequence
  chemically synthesized
ccctggtaaaaggtttgttgag

SEQ ID NO: 667491 - DNA, 22 bp, Artificial Sequence
  chemically synthesized
cagaaactgctttctcaacaaa

SEQ ID NO: 667492 - DNA, 22 bp, Artificial Sequence
  chemically synthesized
ttacagaaactgctttctcaac

SEQ ID NO: 667493 - DNA, 22 bp, Artificial Sequence
  chemically synthesized
gtaaaaggtttgttgagaaagc

SEQ ID NO: 667494 - DNA, 22 bp, Artificial Sequence
  chemically synthesized
gttacagaaactgctttctcaa

SEQ ID NO: 667495 - DNA, 22 bp, Artificial Sequence
  chemically synthesized
gttgagaaagcagtttctgtaa

SEQ ID NO: 667496 - DNA, 22 bp, Artificial Sequence
  chemically synthesized
ttgagaaagcagtttctgtaac

SEQ ID NO: 667497 - DNA, 22 bp, Artificial Sequence
  chemically synthesized
tatcggccatttgttacagaaa

SEQ ID NO: 667498 - DNA, 22 bp, Artificial Sequence
  chemically synthesized
atatcggccatttgttacagaa

SEQ ID NO: 667499 - DNA, 22 bp, Artificial Sequence
  chemically synthesized
tatatcggccatttgttacaga

SEQ ID NO: 667500 - DNA, 22 bp, Artificial Sequence
  chemically synthesized
agaaagcagtttctgtaacaaa

SEQ ID NO: 667501 - DNA, 22 bp, Artificial Sequence
  chemically synthesized
ctgtaacaaatggccgatataa

SEQ ID NO: 667502 - DNA, 22 bp, Artificial Sequence
  chemically synthesized
ccccagaaaactttatatcggc

SEQ ID NO: 667503 - DNA, 22 bp, Artificial Sequence
  chemically synthesized
tgtaacaaatggccgatataaa

SEQ ID NO: 667504 - DNA, 22 bp, Artificial Sequence
  chemically synthesized
tcccccagaaaactttatatcg

SEQ ID NO: 667505 - DNA, 22 bp, Artificial Sequence
  chemically synthesized
taacaaatggccgatataaagt

SEQ ID NO: 667506 - DNA, 22 bp, Artificial Sequence
  chemically synthesized
agatacacagttctcccccaga

SEQ ID NO: 667507 - DNA, 22 bp, Artificial Sequence
  chemically synthesized
aagatacacagttctcccccag

SEQ ID NO: 667508 - DNA, 22 bp, Artificial Sequence
  chemically synthesized
tctgggggagaactgtgtatct

SEQ ID NO: 667509 - DNA, 22 bp, Artificial Sequence
  chemically synthesized
ctgggggagaactgtgtatctt

SEQ ID NO: 667510 - DNA, 22 bp, Artificial Sequence
  chemically synthesized
tgggggagaactgtgtatctta

SEQ ID NO: 667511 - DNA, 22 bp, Artificial Sequence
  chemically synthesized
ggggagaactgtgtatcttaag

SEQ ID NO: 667512 - DNA, 22 bp, Artificial Sequence
  chemically synthesized
aggccccagaaatggtacttaa

SEQ ID NO: 667513 - DNA, 22 bp, Artificial Sequence
  chemically synthesized
tgtatcttaagtaccatttctg

SEQ ID NO: 667514 - DNA, 22 bp, Artificial Sequence
  chemically synthesized
gggcagaattcaggccccagaa

SEQ ID NO: 667515 - DNA, 22 bp, Artificial Sequence
  chemically synthesized
aagtaccatttctggggcctga

SEQ ID NO: 667516 - DNA, 22 bp, Artificial Sequence
  chemically synthesized
agtaccatttctggggcctgaa

SEQ ID NO: 667517 - DNA, 22 bp, Artificial Sequence
  chemically synthesized
tctggggcagaattcaggcccc

SEQ ID NO: 667518 - DNA, 22 bp, Artificial Sequence
  chemically synthesized
cattatctggggcagaattcag

SEQ ID NO: 667519 - DNA, 22 bp, Artificial Sequence
  chemically synthesized
ctggggcctgaattctgcccca

SEQ ID NO: 667520 - DNA, 22 bp, Artificial Sequence
  chemically synthesized
tggggcctgaattctgccccag

SEQ ID NO: 667521 - DNA, 22 bp, Artificial Sequence
  chemically synthesized
gggcctgaattctgccccagat

SEQ ID NO: 667522 - DNA, 22 bp, Artificial Sequence
  chemically synthesized
aattctgccccagataatggag

SEQ ID NO: 667523 - DNA, 22 bp, Artificial Sequence
  chemically synthesized
tatgagtcagccctccattatc

SEQ ID NO: 667524 - DNA, 22 bp, Artificial Sequence
  chemically synthesized
tgccccagataatggagggctg

SEQ ID NO: 667525 - DNA, 22 bp, Artificial Sequence
  chemically synthesized
ccccagataatggagggctgac

SEQ ID NO: 667526 - DNA, 22 bp, Artificial Sequence
  chemically synthesized
aaggagcatggcacagtggtgc

SEQ ID NO: 667527 - DNA, 22 bp, Artificial Sequence
  chemically synthesized
aaaggagcatggcacagtggtg

SEQ ID NO: 667528 - DNA, 22 bp, Artificial Sequence
  chemically synthesized
actcatataggcaccactgtgc

SEQ ID NO: 667529 - DNA, 22 bp, Artificial Sequence
  chemically synthesized
atttaaaggagcatggcacagt

SEQ ID NO: 667530 - DNA, 22 bp, Artificial Sequence
  chemically synthesized
atataggcaccactgtgccatg

SEQ ID NO: 667531 - DNA, 22 bp, Artificial Sequence
  chemically synthesized
gatttaaaggagcatggcacag

SEQ ID NO: 667532 - DNA, 22 bp, Artificial Sequence
  chemically synthesized
aagcttgatttaaaggagcatg

SEQ ID NO: 667533 - DNA, 22 bp, Artificial Sequence
  chemically synthesized
gaagcttgatttaaaggagcat

SEQ ID NO: 667534 - DNA, 22 bp, Artificial Sequence
  chemically synthesized
ttgaagcttgatttaaaggagc

SEQ ID NO: 667535 - DNA, 22 bp, Artificial Sequence
  chemically synthesized
cgctcttgaagcttgatttaaa

SEQ ID NO: 667536 - DNA, 22 bp, Artificial Sequence
  chemically synthesized
tgccatgctcctttaaatcaag

SEQ ID NO: 667537 - DNA, 22 bp, Artificial Sequence
  chemically synthesized
ccgctcttgaagcttgatttaa

SEQ ID NO: 667538 - DNA, 22 bp, Artificial Sequence
  chemically synthesized
atccttccgctcttgaagcttg

SEQ ID NO: 667539 - DNA, 22 bp, Artificial Sequence
  chemically synthesized
ctttaaatcaagcttcaagagc

SEQ ID NO: 667540 - DNA, 22 bp, Artificial Sequence
  chemically synthesized
taaatcaagcttcaagagcgga

SEQ ID NO: 667541 - DNA, 22 bp, Artificial Sequence
  chemically synthesized
aaatcaagcttcaagagcggaa

SEQ ID NO: 667542 - DNA, 22 bp, Artificial Sequence
  chemically synthesized
gagccctgatccttccgctctt

SEQ ID NO: 667543 - DNA, 22 bp, Artificial Sequence
  chemically synthesized
aatcaagcttcaagagcggaag

SEQ ID NO: 667544 - DNA, 22 bp, Artificial Sequence
  chemically synthesized
ggagttagagccctgatccttc

SEQ ID NO: 667545 - DNA, 22 bp, Artificial Sequence
  chemically synthesized
gggagttagagccctgatcctt

SEQ ID NO: 667546 - DNA, 22 bp, Artificial Sequence
  chemically synthesized
tgggagttagagccctgatcct

SEQ ID NO: 667547 - DNA, 22 bp, Artificial Sequence
  chemically synthesized
caagagcggaaggatcagggct

SEQ ID NO: 667548 - DNA, 22 bp, Artificial Sequence
  chemically synthesized
aagagcggaaggatcagggctc

SEQ ID NO: 667549 - DNA, 22 bp, Artificial Sequence
  chemically synthesized
tatataatgaaggttttgggag

SEQ ID NO: 667550 - DNA, 22 bp, Artificial Sequence
  chemically synthesized
atatataatgaaggttttggga

SEQ ID NO: 667551 - DNA, 22 bp, Artificial Sequence
  chemically synthesized
tatatataatgaaggttttggg

SEQ ID NO: 667552 - DNA, 22 bp, Artificial Sequence
  chemically synthesized
taactcccaaaaccttcattat

SEQ ID NO: 667553 - DNA, 22 bp, Artificial Sequence
  chemically synthesized
tatgttttatatataatgaagg

SEQ ID NO: 667554 - DNA, 22 bp, Artificial Sequence
  chemically synthesized
actcccaaaaccttcattatat

SEQ ID NO: 667555 - DNA, 22 bp, Artificial Sequence
  chemically synthesized
ccaaaaccttcattatatataa

SEQ ID NO: 667556 - DNA, 22 bp, Artificial Sequence
  chemically synthesized
tggattgtatgttttatatata

SEQ ID NO: 667557 - DNA, 22 bp, Artificial Sequence
  chemically synthesized
ttatggattgtatgttttatat

SEQ ID NO: 667558 - DNA, 22 bp, Artificial Sequence
  chemically synthesized
cattatatataaaacatacaat

SEQ ID NO: 667559 - DNA, 22 bp, Artificial Sequence
  chemically synthesized
attatatataaaacatacaatc

SEQ ID NO: 667560 - DNA, 22 bp, Artificial Sequence
  chemically synthesized
tatataaaacatacaatccata

SEQ ID NO: 667561 - DNA, 22 bp, Artificial Sequence
  chemically synthesized
tggatccataattattatggat

SEQ ID NO: 667562 - DNA, 22 bp, Artificial Sequence
  chemically synthesized
atggatccataattattatgga

SEQ ID NO: 667563 - DNA, 22 bp, Artificial Sequence
  chemically synthesized
tccttatggatccataattatt

SEQ ID NO: 667564 - DNA, 22 bp, Artificial Sequence
  chemically synthesized
atccttatggatccataattat

SEQ ID NO: 667565 - DNA, 22 bp, Artificial Sequence
  chemically synthesized
gaagacatttatccttatggat

SEQ ID NO: 667566 - DNA, 22 bp, Artificial Sequence
  chemically synthesized
agaagacatttatccttatgga

SEQ ID NO: 667567 - DNA, 22 bp, Artificial Sequence
  chemically synthesized
tagaagacatttatccttatgg

SEQ ID NO: 667568 - DNA, 22 bp, Artificial Sequence
  chemically synthesized
ttagaagacatttatccttatg

SEQ ID NO: 667569 - DNA, 22 bp, Artificial Sequence
  chemically synthesized
tttagaagacatttatccttat

SEQ ID NO: 667570 - DNA, 22 bp, Artificial Sequence
  chemically synthesized
tggatccataaggataaatgtc

SEQ ID NO: 667571 - DNA, 22 bp, Artificial Sequence
  chemically synthesized
tagctttttagaagacatttat

SEQ ID NO: 667572 - DNA, 22 bp, Artificial Sequence
  chemically synthesized
gtagctttttagaagacattta

SEQ ID NO: 667573 - DNA, 22 bp, Artificial Sequence
  chemically synthesized
tgtagctttttagaagacattt

SEQ ID NO: 667574 - DNA, 22 bp, Artificial Sequence
  chemically synthesized
ctttgtagctttttagaagaca

SEQ ID NO: 667575 - DNA, 22 bp, Artificial Sequence
  chemically synthesized
ctaaaaagctacaaagcagtgt

SEQ ID NO: 667576 - DNA, 22 bp, Artificial Sequence
  chemically synthesized
aaagatcaggcaacactgcttt

SEQ ID NO: 667577 - DNA, 22 bp, Artificial Sequence
  chemically synthesized
taaaaagctacaaagcagtgtt

SEQ ID NO: 667578 - DNA, 22 bp, Artificial Sequence
  chemically synthesized
aaaagatcaggcaacactgctt

SEQ ID NO: 667579 - DNA, 22 bp, Artificial Sequence
  chemically synthesized
taaaagatcaggcaacactgct

SEQ ID NO: 667580 - DNA, 22 bp, Artificial Sequence
  chemically synthesized
aaaagctacaaagcagtgttgc

SEQ ID NO: 667581 - DNA, 22 bp, Artificial Sequence
  chemically synthesized
ttaaaagatcaggcaacactgc

SEQ ID NO: 667582 - DNA, 22 bp, Artificial Sequence
  chemically synthesized
atgatttttaaaagatcaggca

SEQ ID NO: 667583 - DNA, 22 bp, Artificial Sequence
  chemically synthesized
caaagcagtgttgcctgatctt

SEQ ID NO: 667584 - DNA, 22 bp, Artificial Sequence
  chemically synthesized
aaataatactaatgatttttaa

SEQ ID NO: 667585 - DNA, 22 bp, Artificial Sequence
  chemically synthesized
cctgatcttttaaaaatcatta

SEQ ID NO: 667586 - DNA, 22 bp, Artificial Sequence
  chemically synthesized
atcttttaaaaatcattagtat

SEQ ID NO: 667587 - DNA, 22 bp, Artificial Sequence
  chemically synthesized
tatattaaaataatactaatga

SEQ ID NO: 667588 - DNA, 22 bp, Artificial Sequence
  chemically synthesized
ttaaaaatcattagtattattt

SEQ ID NO: 667589 - DNA, 22 bp, Artificial Sequence
  chemically synthesized
taaaaatcattagtattatttt

SEQ ID NO: 667590 - DNA, 22 bp, Artificial Sequence
  chemically synthesized
aaaaatcattagtattatttta

SEQ ID NO: 667591 - DNA, 22 bp, Artificial Sequence
  chemically synthesized
aaaatcattagtattattttaa

SEQ ID NO: 667592 - DNA, 22 bp, Artificial Sequence
  chemically synthesized
aaataatatatgttatatatta

SEQ ID NO: 667593 - DNA, 22 bp, Artificial Sequence
  chemically synthesized
aaaataatatatgttatatatt

SEQ ID NO: 667594 - DNA, 22 bp, Artificial Sequence
  chemically synthesized
gtattattttaatatataacat

SEQ ID NO: 667595 - DNA, 22 bp, Artificial Sequence
  chemically synthesized
ttttaatatataacatatatta

SEQ ID NO: 667596 - DNA, 22 bp, Artificial Sequence
  chemically synthesized
aatgtatttaaaataatatatg

SEQ ID NO: 667597 - DNA, 22 bp, Artificial Sequence
  chemically synthesized
aaatgtatttaaaataatatat

SEQ ID NO: 667598 - DNA, 22 bp, Artificial Sequence
  chemically synthesized
taatatataacatatattattt

SEQ ID NO: 667599 - DNA, 22 bp, Artificial Sequence
  chemically synthesized
taaatgtatttaaaataatata

SEQ ID NO: 667600 - DNA, 22 bp, Artificial Sequence
  chemically synthesized
aatatataacatatattatttt

SEQ ID NO: 667601 - DNA, 22 bp, Artificial Sequence
  chemically synthesized
atatataacatatattatttta

SEQ ID NO: 667602 - DNA, 22 bp, Artificial Sequence
  chemically synthesized
ttttaaatgtatttaaaataat

SEQ ID NO: 667603 - DNA, 22 bp, Artificial Sequence
  chemically synthesized
tactattttaaatgtatttaaa

SEQ ID NO: 667604 - DNA, 22 bp, Artificial Sequence
  chemically synthesized
gtactattttaaatgtatttaa

SEQ ID NO: 667605 - DNA, 22 bp, Artificial Sequence
  chemically synthesized
ttttaaatacatttaaaatagt

SEQ ID NO: 667606 - DNA, 22 bp, Artificial Sequence
  chemically synthesized
aatatgtcatttgtactatttt

SEQ ID NO: 667607 - DNA, 22 bp, Artificial Sequence
  chemically synthesized
taaatacatttaaaatagtaca

SEQ ID NO: 667608 - DNA, 22 bp, Artificial Sequence
  chemically synthesized
aaatatgtcatttgtactattt

SEQ ID NO: 667609 - DNA, 22 bp, Artificial Sequence
  chemically synthesized
aaatacatttaaaatagtacaa

SEQ ID NO: 667610 - DNA, 22 bp, Artificial Sequence
  chemically synthesized
aatacatttaaaatagtacaaa

SEQ ID NO: 667611 - DNA, 22 bp, Artificial Sequence
  chemically synthesized
aaaatagtacaaatgacatatt

SEQ ID NO: 667612 - DNA, 22 bp, Artificial Sequence
  chemically synthesized
aaatagtacaaatgacatattt

SEQ ID NO: 667613 - DNA, 22 bp, Artificial Sequence
  chemically synthesized
taaatatataaaatatgtattt

SEQ ID NO: 667614 - DNA, 22 bp, Artificial Sequence
  chemically synthesized
aaatacatattttatatattta

SEQ ID NO: 667615 - DNA, 22 bp, Artificial Sequence
  chemically synthesized
aatacatattttatatatttat

SEQ ID NO: 667616 - DNA, 22 bp, Artificial Sequence
  chemically synthesized
aatacacatatgttataaatat

SEQ ID NO: 667617 - DNA, 22 bp, Artificial Sequence
  chemically synthesized
aaatacacatatgttataaata

SEQ ID NO: 667618 - DNA, 22 bp, Artificial Sequence
  chemically synthesized
tatatatttataacatatgtgt

SEQ ID NO: 667619 - DNA, 22 bp, Artificial Sequence
  chemically synthesized
atatatttataacatatgtgta

SEQ ID NO: 667620 - DNA, 22 bp, Artificial Sequence
  chemically synthesized
tatatttataacatatgtgtat

SEQ ID NO: 667621 - DNA, 22 bp, Artificial Sequence
  chemically synthesized
aaatacatatttaaatacacat

SEQ ID NO: 667622 - DNA, 22 bp, Artificial Sequence
  chemically synthesized
caaatacatatttaaatacaca

SEQ ID NO: 667623 - DNA, 22 bp, Artificial Sequence
  chemically synthesized
cttcaaatacatatttaaatac

SEQ ID NO: 667624 - DNA, 22 bp, Artificial Sequence
  chemically synthesized
ataacatatgtgtatttaaata

SEQ ID NO: 667625 - DNA, 22 bp, Artificial Sequence
  chemically synthesized
taacatatgtgtatttaaatat

SEQ ID NO: 667626 - DNA, 22 bp, Artificial Sequence
  chemically synthesized
atcagtagtattacttcaaata

SEQ ID NO: 667627 - DNA, 22 bp, Artificial Sequence
  chemically synthesized
aatcagtagtattacttcaaat

SEQ ID NO: 667628 - DNA, 22 bp, Artificial Sequence
  chemically synthesized
taatcagtagtattacttcaaa

SEQ ID NO: 667629 - DNA, 22 bp, Artificial Sequence
  chemically synthesized
ttaatcagtagtattacttcaa

SEQ ID NO: 667630 - DNA, 22 bp, Artificial Sequence
  chemically synthesized
tttaatcagtagtattacttca

SEQ ID NO: 667631 - DNA, 22 bp, Artificial Sequence
  chemically synthesized
aaatatgtatttgaagtaatac

SEQ ID NO: 667632 - DNA, 22 bp, Artificial Sequence
  chemically synthesized
ttttaatcagtagtattacttc

SEQ ID NO: 667633 - DNA, 22 bp, Artificial Sequence
  chemically synthesized
aatatgtatttgaagtaatact

SEQ ID NO: 667634 - DNA, 22 bp, Artificial Sequence
  chemically synthesized
aagagtcttttttaatcagtag

SEQ ID NO: 667635 - DNA, 22 bp, Artificial Sequence
  chemically synthesized
gaagtaatactactgattaaaa

SEQ ID NO: 667636 - DNA, 22 bp, Artificial Sequence
  chemically synthesized
aagtaatactactgattaaaaa

SEQ ID NO: 667637 - DNA, 22 bp, Artificial Sequence
  chemically synthesized
cctaaagagtcttttttaatca

SEQ ID NO: 667638 - DNA, 22 bp, Artificial Sequence
  chemically synthesized
tgcctaaagagtcttttttaat

SEQ ID NO: 667639 - DNA, 22 bp, Artificial Sequence
  chemically synthesized
ctgattaaaaaagactctttag

SEQ ID NO: 667640 - DNA, 22 bp, Artificial Sequence
  chemically synthesized
taaaacagttctgcctaaagag

SEQ ID NO: 667641 - DNA, 22 bp, Artificial Sequence
  chemically synthesized
attaaaaaagactctttaggca

SEQ ID NO: 667642 - DNA, 22 bp, Artificial Sequence
  chemically synthesized
aaaaagactctttaggcagaac

SEQ ID NO: 667643 - DNA, 22 bp, Artificial Sequence
  chemically synthesized
agcagttataaaacagttctgc

SEQ ID NO: 667644 - DNA, 22 bp, Artificial Sequence
  chemically synthesized
aagcagttataaaacagttctg

SEQ ID NO: 667645 - DNA, 22 bp, Artificial Sequence
  chemically synthesized
taagcagttataaaacagttct

SEQ ID NO: 667646 - DNA, 22 bp, Artificial Sequence
  chemically synthesized
ttaagcagttataaaacagttc

SEQ ID NO: 667647 - DNA, 22 bp, Artificial Sequence
  chemically synthesized
tttaggcagaactgttttataa

SEQ ID NO: 667648 - DNA, 22 bp, Artificial Sequence
  chemically synthesized
taggcagaactgttttataact

SEQ ID NO: 667649 - DNA, 22 bp, Artificial Sequence
  chemically synthesized
aggcagaactgttttataactg

SEQ ID NO: 667650 - DNA, 22 bp, Artificial Sequence
  chemically synthesized
ggcagaactgttttataactgc

SEQ ID NO: 667651 - DNA, 22 bp, Artificial Sequence
  chemically synthesized
ttttataactgcttaaaagaca

SEQ ID NO: 667652 - DNA, 22 bp, Artificial Sequence
  chemically synthesized
tggatagatgaatgtcttttaa

SEQ ID NO: 667653 - DNA, 22 bp, Artificial Sequence
  chemically synthesized
tataactgcttaaaagacattc

SEQ ID NO: 667654 - DNA, 22 bp, Artificial Sequence
  chemically synthesized
ataactgcttaaaagacattca

SEQ ID NO: 667655 - DNA, 22 bp, Artificial Sequence
  chemically synthesized
taactgcttaaaagacattcat

SEQ ID NO: 667656 - DNA, 22 bp, Artificial Sequence
  chemically synthesized
cttaaaagacattcatctatcc

SEQ ID NO: 667657 - DNA, 22 bp, Artificial Sequence
  chemically synthesized
aaaagacattcatctatccata

SEQ ID NO: 667658 - DNA, 22 bp, Artificial Sequence
  chemically synthesized
aaagacattcatctatccataa

SEQ ID NO: 667659 - DNA, 22 bp, Artificial Sequence
  chemically synthesized
aaaggatagatgaaaggattat

SEQ ID NO: 667660 - DNA, 22 bp, Artificial Sequence
  chemically synthesized
atctatccataatcctttcatc

SEQ ID NO: 667661 - DNA, 22 bp, Artificial Sequence
  chemically synthesized
tccataatcctttcatctatcc

SEQ ID NO: 667662 - DNA, 22 bp, Artificial Sequence
  chemically synthesized
tcatctatcctttcaatattta

SEQ ID NO: 667663 - DNA, 22 bp, Artificial Sequence
  chemically synthesized
catctatcctttcaatatttat

SEQ ID NO: 667664 - DNA, 22 bp, Artificial Sequence
  chemically synthesized
atctatcctttcaatatttatt

SEQ ID NO: 667665 - DNA, 22 bp, Artificial Sequence
  chemically synthesized
tagtacatgcacaataaatatt

SEQ ID NO: 667666 - DNA, 22 bp, Artificial Sequence
  chemically synthesized
atagtacatgcacaataaatat

SEQ ID NO: 667667 - DNA, 22 bp, Artificial Sequence
  chemically synthesized
tcctttcaatatttattgtgca

SEQ ID NO: 667668 - DNA, 22 bp, Artificial Sequence
  chemically synthesized
gcttatagtacatgcacaataa

SEQ ID NO: 667669 - DNA, 22 bp, Artificial Sequence
  chemically synthesized
ggcttatagtacatgcacaata

SEQ ID NO: 667670 - DNA, 22 bp, Artificial Sequence
  chemically synthesized
ttggcttatagtacatgcacaa

SEQ ID NO: 667671 - DNA, 22 bp, Artificial Sequence
  chemically synthesized
tcaatatttattgtgcatgtac

SEQ ID NO: 667672 - DNA, 22 bp, Artificial Sequence
  chemically synthesized
caatatttattgtgcatgtact

SEQ ID NO: 667673 - DNA, 22 bp, Artificial Sequence
  chemically synthesized
aatatttattgtgcatgtacta

SEQ ID NO: 667674 - DNA, 22 bp, Artificial Sequence
  chemically synthesized
gcatggttcttggcttatagta

SEQ ID NO: 667675 - DNA, 22 bp, Artificial Sequence
  chemically synthesized
ggcatggttcttggcttatagt

SEQ ID NO: 667676 - DNA, 22 bp, Artificial Sequence
  chemically synthesized
attgtgcatgtactataagcca

SEQ ID NO: 667677 - DNA, 22 bp, Artificial Sequence
  chemically synthesized
ttgtgcatgtactataagccaa

SEQ ID NO: 667678 - DNA, 22 bp, Artificial Sequence
  chemically synthesized
tgcatgtactataagccaagaa

SEQ ID NO: 667679 - DNA, 22 bp, Artificial Sequence
  chemically synthesized
catgtacttggcatggttcttg

SEQ ID NO: 667680 - DNA, 22 bp, Artificial Sequence
  chemically synthesized
taagccaagaaccatgccaagt

SEQ ID NO: 667681 - DNA, 22 bp, Artificial Sequence
  chemically synthesized
ccagtgtattccatgtacttgg

SEQ ID NO: 667682 - DNA, 22 bp, Artificial Sequence
  chemically synthesized
gttaccagtgtattccatgtac

SEQ ID NO: 667683 - DNA, 22 bp, Artificial Sequence
  chemically synthesized
ggttaccagtgtattccatgta

SEQ ID NO: 667684 - DNA, 22 bp, Artificial Sequence
  chemically synthesized
tggttaccagtgtattccatgt

SEQ ID NO: 667685 - DNA, 22 bp, Artificial Sequence
  chemically synthesized
ttttggttaccagtgtattcca

SEQ ID NO: 667686 - DNA, 22 bp, Artificial Sequence
  chemically synthesized
attttggttaccagtgtattcc

SEQ ID NO: 667687 - DNA, 22 bp, Artificial Sequence
  chemically synthesized
gtaaccaaaataaatctctgcc

SEQ ID NO: 667688 - DNA, 22 bp, Artificial Sequence
  chemically synthesized
caaagtcaataaaggcagagat

SEQ ID NO: 667689 - DNA, 22 bp, Artificial Sequence
  chemically synthesized
cactgcaaagtcaataaaggca

SEQ ID NO: 667690 - DNA, 22 bp, Artificial Sequence
  chemically synthesized
gctacactgcaaagtcaataaa

SEQ ID NO: 667691 - DNA, 22 bp, Artificial Sequence
  chemically synthesized
cgctacactgcaaagtcaataa

SEQ ID NO: 667692 - DNA, 22 bp, Artificial Sequence
  chemically synthesized
cttcgctacactgcaaagtcaa

SEQ ID NO: 667693 - DNA, 22 bp, Artificial Sequence
  chemically synthesized
tgcctttattgactttgcagtg

SEQ ID NO: 667694 - DNA, 22 bp, Artificial Sequence
  chemically synthesized
cctttattgactttgcagtgta

SEQ ID NO: 667695 - DNA, 22 bp, Artificial Sequence
  chemically synthesized
tccatctccttcgctacactgc

SEQ ID NO: 667696 - DNA, 22 bp, Artificial Sequence
  chemically synthesized
tattgactttgcagtgtagcga

SEQ ID NO: 667697 - DNA, 22 bp, Artificial Sequence
  chemically synthesized
attgactttgcagtgtagcgaa

SEQ ID NO: 667698 - DNA, 22 bp, Artificial Sequence
  chemically synthesized
ttatccatctccttcgctacac

SEQ ID NO: 667699 - DNA, 22 bp, Artificial Sequence
  chemically synthesized
ttgactttgcagtgtagcgaag

SEQ ID NO: 667700 - DNA, 22 bp, Artificial Sequence
  chemically synthesized
actttgcagtgtagcgaaggag

SEQ ID NO: 667701 - DNA, 22 bp, Artificial Sequence
  chemically synthesized
attattatccatctccttcgct

SEQ ID NO: 667702 - DNA, 22 bp, Artificial Sequence
  chemically synthesized
gattattatccatctccttcgc

SEQ ID NO: 667703 - DNA, 22 bp, Artificial Sequence
  chemically synthesized
tgcagtgtagcgaaggagatgg

SEQ ID NO: 667704 - DNA, 22 bp, Artificial Sequence
  chemically synthesized
gcagtgtagcgaaggagatgga

SEQ ID NO: 667705 - DNA, 22 bp, Artificial Sequence
  chemically synthesized
cagtgtagcgaaggagatggat

SEQ ID NO: 667706 - DNA, 22 bp, Artificial Sequence
  chemically synthesized
catatgaatatttgattattat

SEQ ID NO: 667707 - DNA, 22 bp, Artificial Sequence
  chemically synthesized
gcctacatatgaatatttgatt

SEQ ID NO: 667708 - DNA, 22 bp, Artificial Sequence
  chemically synthesized
caggcgcgagccaccgcacctg

SEQ ID NO: 667709 - DNA, 22 bp, Artificial Sequence
  chemically synthesized
atatgtaggccaggtgcggtgg

SEQ ID NO: 667710 - DNA, 22 bp, Artificial Sequence
  chemically synthesized
ggattacaggcgcgagccaccg

SEQ ID NO: 667711 - DNA, 22 bp, Artificial Sequence
  chemically synthesized
ccaaaggctgggattacaggcg

SEQ ID NO: 667712 - DNA, 22 bp, Artificial Sequence
  chemically synthesized
gcctcccaaaggctgggattac

SEQ ID NO: 667713 - DNA, 22 bp, Artificial Sequence
  chemically synthesized
ggcctcccaaaggctgggatta

SEQ ID NO: 667714 - DNA, 22 bp, Artificial Sequence
  chemically synthesized
ccttggcctcccaaaggctggg

SEQ ID NO: 667715 - DNA, 22 bp, Artificial Sequence
  chemically synthesized
gcgcctgtaatcccagcctttg

SEQ ID NO: 667716 - DNA, 22 bp, Artificial Sequence
  chemically synthesized
cctgccttggcctcccaaaggc

SEQ ID NO: 667717 - DNA, 22 bp, Artificial Sequence
  chemically synthesized
taatcccagcctttgggaggcc

SEQ ID NO: 667718 - DNA, 22 bp, Artificial Sequence
  chemically synthesized
aggtgatctgcctgccttggcc

SEQ ID NO: 667719 - DNA, 22 bp, Artificial Sequence
  chemically synthesized
acctcaggtgatctgcctgcct

SEQ ID NO: 667720 - DNA, 22 bp, Artificial Sequence
  chemically synthesized
tgggaggccaaggcaggcagat

SEQ ID NO: 667721 - DNA, 22 bp, Artificial Sequence
  chemically synthesized
tgacctcaggtgatctgcctgc

SEQ ID NO: 667722 - DNA, 22 bp, Artificial Sequence
  chemically synthesized
gggaggccaaggcaggcagatc

SEQ ID NO: 667723 - DNA, 22 bp, Artificial Sequence
  chemically synthesized
ctgacctcaggtgatctgcctg

SEQ ID NO: 667724 - DNA, 22 bp, Artificial Sequence
  chemically synthesized
ggaggccaaggcaggcagatca

SEQ ID NO: 667725 - DNA, 22 bp, Artificial Sequence
  chemically synthesized
gaacttctgacctcaggtgatc

SEQ ID NO: 667726 - DNA, 22 bp, Artificial Sequence
  chemically synthesized
gcccaggtggtctcgaacttct

SEQ ID NO: 667727 - DNA, 22 bp, Artificial Sequence
  chemically synthesized
aggtcagaagttcgagaccacc

SEQ ID NO: 667728 - DNA, 22 bp, Artificial Sequence
  chemically synthesized
gccatgttggcccaggtggtct

SEQ ID NO: 667729 - DNA, 22 bp, Artificial Sequence
  chemically synthesized
cgccatgttggcccaggtggtc

SEQ ID NO: 667730 - DNA, 22 bp, Artificial Sequence
  chemically synthesized
gagaccacctgggccaacatgg

SEQ ID NO: 667731 - DNA, 22 bp, Artificial Sequence
  chemically synthesized
gtagagacggggtttcgccatg

SEQ ID NO: 667732 - DNA, 22 bp, Artificial Sequence
  chemically synthesized
agtagagacggggtttcgccat

SEQ ID NO: 667733 - DNA, 22 bp, Artificial Sequence
  chemically synthesized
tagtagagacggggtttcgcca

SEQ ID NO: 667734 - DNA, 22 bp, Artificial Sequence
  chemically synthesized
ttagtagagacggggtttcgcc

SEQ ID NO: 667735 - DNA, 22 bp, Artificial Sequence
  chemically synthesized
ggccaacatggcgaaaccccgt

SEQ ID NO: 667736 - DNA, 22 bp, Artificial Sequence
  chemically synthesized
tatttttagtagagacggggtt

SEQ ID NO: 667737 - DNA, 22 bp, Artificial Sequence
  chemically synthesized
gtatttttagtagagacggggt

SEQ ID NO: 667738 - DNA, 22 bp, Artificial Sequence
  chemically synthesized
tgtatttttagtagagacgggg

SEQ ID NO: 667739 - DNA, 22 bp, Artificial Sequence
  chemically synthesized
ttgtatttttagtagagacggg

SEQ ID NO: 667740 - DNA, 22 bp, Artificial Sequence
  chemically synthesized
tttgtatttttagtagagacgg

SEQ ID NO: 667741 - DNA, 22 bp, Artificial Sequence
  chemically synthesized
attttttgtatttttagtagag

SEQ ID NO: 667742 - DNA, 22 bp, Artificial Sequence
  chemically synthesized
tactaaaaatacaaaaaattag

SEQ ID NO: 667743 - DNA, 22 bp, Artificial Sequence
  chemically synthesized
ccgccgcatccagctaattttt

SEQ ID NO: 667744 - DNA, 22 bp, Artificial Sequence
  chemically synthesized
ctaaaaatacaaaaaattagct

SEQ ID NO: 667745 - DNA, 22 bp, Artificial Sequence
  chemically synthesized
aaaatacaaaaaattagctgga

SEQ ID NO: 667746 - DNA, 22 bp, Artificial Sequence
  chemically synthesized
caggtgcctgccgccgcatcca

SEQ ID NO: 667747 - DNA, 22 bp, Artificial Sequence
  chemically synthesized
ggattacaggtgcctgccgccg

SEQ ID NO: 667748 - DNA, 22 bp, Artificial Sequence
  chemically synthesized
gctggatgcggcggcaggcacc

SEQ ID NO: 667749 - DNA, 22 bp, Artificial Sequence
  chemically synthesized
gatgcggcggcaggcacctgta

SEQ ID NO: 667750 - DNA, 22 bp, Artificial Sequence
  chemically synthesized
ccaggtagtagctgggattaca

SEQ ID NO: 667751 - DNA, 22 bp, Artificial Sequence
  chemically synthesized
agcctcccaggtagtagctggg

SEQ ID NO: 667752 - DNA, 22 bp, Artificial Sequence
  chemically synthesized
cctcagcctcccaggtagtagc

SEQ ID NO: 667753 - DNA, 22 bp, Artificial Sequence
  chemically synthesized
ctgcctcagcctcccaggtagt

SEQ ID NO: 667754 - DNA, 22 bp, Artificial Sequence
  chemically synthesized
taatcccagctactacctggga

SEQ ID NO: 667755 - DNA, 22 bp, Artificial Sequence
  chemically synthesized
tcctgcctcagcctcccaggta

SEQ ID NO: 667756 - DNA, 22 bp, Artificial Sequence
  chemically synthesized
aagcgattctcctgcctcagcc

SEQ ID NO: 667757 - DNA, 22 bp, Artificial Sequence
  chemically synthesized
ctacctgggaggctgaggcagg

SEQ ID NO: 667758 - DNA, 22 bp, Artificial Sequence
  chemically synthesized
cctgggaggctgaggcaggaga

SEQ ID NO: 667759 - DNA, 22 bp, Artificial Sequence
  chemically synthesized
ccaggttcaagcgattctcctg

SEQ ID NO: 667760 - DNA, 22 bp, Artificial Sequence
  chemically synthesized
ggaggctgaggcaggagaatcg

SEQ ID NO: 667761 - DNA, 22 bp, Artificial Sequence
  chemically synthesized
cacctcccaggttcaagcgatt

SEQ ID NO: 667762 - DNA, 22 bp, Artificial Sequence
  chemically synthesized
aggcaggagaatcgcttgaacc

SEQ ID NO: 667763 - DNA, 22 bp, Artificial Sequence
  chemically synthesized
cagcctccacctcccaggttca

SEQ ID NO: 667764 - DNA, 22 bp, Artificial Sequence
  chemically synthesized
actgcagcctccacctcccagg

SEQ ID NO: 667765 - DNA, 22 bp, Artificial Sequence
  chemically synthesized
ggctcactgcagcctccacctc

SEQ ID NO: 667766 - DNA, 22 bp, Artificial Sequence
  chemically synthesized
gaacctgggaggtggaggctgc

SEQ ID NO: 667767 - DNA, 22 bp, Artificial Sequence
  chemically synthesized
aacctgggaggtggaggctgca

SEQ ID NO: 667768 - DNA, 22 bp, Artificial Sequence
  chemically synthesized
ggaggtggaggctgcagtgagc

SEQ ID NO: 667769 - DNA, 22 bp, Artificial Sequence
  chemically synthesized
gagtgcaacggcacaatctcgg

SEQ ID NO: 667770 - DNA, 22 bp, Artificial Sequence
  chemically synthesized
cagtgagccgagattgtgccgt

SEQ ID NO: 667771 - DNA, 22 bp, Artificial Sequence
  chemically synthesized
cccaggctggagtgcaacggca

SEQ ID NO: 667772 - DNA, 22 bp, Artificial Sequence
  chemically synthesized
ttgcccaggctggagtgcaacg

SEQ ID NO: 667773 - DNA, 22 bp, Artificial Sequence
  chemically synthesized
gttgcccaggctggagtgcaac

SEQ ID NO: 667774 - DNA, 22 bp, Artificial Sequence
  chemically synthesized
ttgttgcccaggctggagtgca

SEQ ID NO: 667775 - DNA, 22 bp, Artificial Sequence
  chemically synthesized
ctcttgttgcccaggctggagt

SEQ ID NO: 667776 - DNA, 22 bp, Artificial Sequence
  chemically synthesized
gctcttgttgcccaggctggag

SEQ ID NO: 667777 - DNA, 22 bp, Artificial Sequence
  chemically synthesized
tgctcttgttgcccaggctgga

SEQ ID NO: 667778 - DNA, 22 bp, Artificial Sequence
  chemically synthesized
tgccgttgcactccagcctggg

SEQ ID NO: 667779 - DNA, 22 bp, Artificial Sequence
  chemically synthesized
cactccagcctgggcaacaaga

SEQ ID NO: 667780 - DNA, 22 bp, Artificial Sequence
  chemically synthesized
agacggagttttgctcttgttg

SEQ ID NO: 667781 - DNA, 22 bp, Artificial Sequence
  chemically synthesized
gagacggagttttgctcttgtt

SEQ ID NO: 667782 - DNA, 22 bp, Artificial Sequence
  chemically synthesized
cagcctgggcaacaagagcaaa

SEQ ID NO: 667783 - DNA, 22 bp, Artificial Sequence
  chemically synthesized
tttgagacggagttttgctctt

SEQ ID NO: 667784 - DNA, 22 bp, Artificial Sequence
  chemically synthesized
gtttgagacggagttttgctct

SEQ ID NO: 667785 - DNA, 22 bp, Artificial Sequence
  chemically synthesized
gtttgtttgagacggagttttg

SEQ ID NO: 667786 - DNA, 22 bp, Artificial Sequence
  chemically synthesized
ggcaacaagagcaaaactccgt

SEQ ID NO: 667787 - DNA, 22 bp, Artificial Sequence
  chemically synthesized
ttagtttgtttgagacggagtt

SEQ ID NO: 667788 - DNA, 22 bp, Artificial Sequence
  chemically synthesized
gttagtttgtttgagacggagt

SEQ ID NO: 667789 - DNA, 22 bp, Artificial Sequence
  chemically synthesized
tttgttagtttgtttgagacgg

SEQ ID NO: 667790 - DNA, 22 bp, Artificial Sequence
  chemically synthesized
gtttgttagtttgtttgagacg

SEQ ID NO: 667791 - DNA, 22 bp, Artificial Sequence
  chemically synthesized
cgtctcaaacaaactaacaaac

SEQ ID NO: 667792 - DNA, 22 bp, Artificial Sequence
  chemically synthesized
aaacaaactaacaaacaaatat

SEQ ID NO: 667793 - DNA, 22 bp, Artificial Sequence
  chemically synthesized
ccacagtacatatgaatatttg

SEQ ID NO: 667794 - DNA, 22 bp, Artificial Sequence
  chemically synthesized
accacagtacatatgaatattt

SEQ ID NO: 667795 - DNA, 22 bp, Artificial Sequence
  chemically synthesized
taccacagtacatatgaatatt

SEQ ID NO: 667796 - DNA, 22 bp, Artificial Sequence
  chemically synthesized
acaaacaaatattcatatgtac

SEQ ID NO: 667797 - DNA, 22 bp, Artificial Sequence
  chemically synthesized
accattttaccacagtacatat

SEQ ID NO: 667798 - DNA, 22 bp, Artificial Sequence
  chemically synthesized
caccattttaccacagtacata

SEQ ID NO: 667799 - DNA, 22 bp, Artificial Sequence
  chemically synthesized
cttcaccattttaccacagtac

SEQ ID NO: 667800 - DNA, 22 bp, Artificial Sequence
  chemically synthesized
ccttcaccattttaccacagta

SEQ ID NO: 667801 - DNA, 22 bp, Artificial Sequence
  chemically synthesized
atatgtactgtggtaaaatggt

SEQ ID NO: 667802 - DNA, 22 bp, Artificial Sequence
  chemically synthesized
tgtgtttccttcaccattttac

SEQ ID NO: 667803 - DNA, 22 bp, Artificial Sequence
  chemically synthesized
ctgtgtgtttccttcaccattt

SEQ ID NO: 667804 - DNA, 22 bp, Artificial Sequence
  chemically synthesized
cctgtgtgtttccttcaccatt

SEQ ID NO: 667805 - DNA, 22 bp, Artificial Sequence
  chemically synthesized
tggtaaaatggtgaaggaaaca

SEQ ID NO: 667806 - DNA, 22 bp, Artificial Sequence
  chemically synthesized
atcacttcctgtgtgtttcctt

SEQ ID NO: 667807 - DNA, 22 bp, Artificial Sequence
  chemically synthesized
tgtatacagtctcatcacttcc

SEQ ID NO: 667808 - DNA, 22 bp, Artificial Sequence
  chemically synthesized
cctatgtatacagtctcatcac

SEQ ID NO: 667809 - DNA, 22 bp, Artificial Sequence
  chemically synthesized
ccctatgtatacagtctcatca

SEQ ID NO: 667810 - DNA, 22 bp, Artificial Sequence
  chemically synthesized
tgtttccctatgtatacagtct

SEQ ID NO: 667811 - DNA, 22 bp, Artificial Sequence
  chemically synthesized
ggacctatgtttccctatgtat

SEQ ID NO: 667812 - DNA, 22 bp, Artificial Sequence
  chemically synthesized
tcggacctatgtttccctatgt

SEQ ID NO: 667813 - DNA, 22 bp, Artificial Sequence
  chemically synthesized
tatacatagggaaacataggtc

SEQ ID NO: 667814 - DNA, 22 bp, Artificial Sequence
  chemically synthesized
caagaagcctctcggacctatg

SEQ ID NO: 667815 - DNA, 22 bp, Artificial Sequence
  chemically synthesized
tccaagaagcctctcggaccta

SEQ ID NO: 667816 - DNA, 22 bp, Artificial Sequence
  chemically synthesized
ctccaagaagcctctcggacct

SEQ ID NO: 667817 - DNA, 22 bp, Artificial Sequence
  chemically synthesized
aatgtcaccttctccaagaagc

SEQ ID NO: 667818 - DNA, 22 bp, Artificial Sequence
  chemically synthesized
caatgtcaccttctccaagaag

SEQ ID NO: 667819 - DNA, 22 bp, Artificial Sequence
  chemically synthesized
cttcaatgtcaccttctccaag

SEQ ID NO: 667820 - DNA, 22 bp, Artificial Sequence
  chemically synthesized
gcttcaatgtcaccttctccaa

SEQ ID NO: 667821 - DNA, 22 bp, Artificial Sequence
  chemically synthesized
tgcttcaatgtcaccttctcca

SEQ ID NO: 667822 - DNA, 22 bp, Artificial Sequence
  chemically synthesized
aagtctttgcttcaatgtcacc

SEQ ID NO: 667823 - DNA, 22 bp, Artificial Sequence
  chemically synthesized
caagtctttgcttcaatgtcac

SEQ ID NO: 667824 - DNA, 22 bp, Artificial Sequence
  chemically synthesized
cttggagaaggtgacattgaag

SEQ ID NO: 667825 - DNA, 22 bp, Artificial Sequence
  chemically synthesized
ttggagaaggtgacattgaagc

SEQ ID NO: 667826 - DNA, 22 bp, Artificial Sequence
  chemically synthesized
ggagaaggtgacattgaagcaa

SEQ ID NO: 667827 - DNA, 22 bp, Artificial Sequence
  chemically synthesized
gagaaggtgacattgaagcaaa

SEQ ID NO: 667828 - DNA, 22 bp, Artificial Sequence
  chemically synthesized
ccatcatccttcaagtctttgc

SEQ ID NO: 667829 - DNA, 22 bp, Artificial Sequence
  chemically synthesized
gcacgctcccatcatccttcaa

SEQ ID NO: 667830 - DNA, 22 bp, Artificial Sequence
  chemically synthesized
aagcaaagacttgaaggatgat

SEQ ID NO: 667831 - DNA, 22 bp, Artificial Sequence
  chemically synthesized
cctggcacgctcccatcatcct

SEQ ID NO: 667832 - DNA, 22 bp, Artificial Sequence
  chemically synthesized
acctggcacgctcccatcatcc

SEQ ID NO: 667833 - DNA, 22 bp, Artificial Sequence
  chemically synthesized
ttacctggcacgctcccatcat

SEQ ID NO: 667834 - DNA, 22 bp, Artificial Sequence
  chemically synthesized
tgttcttacctggcacgctccc

SEQ ID NO: 667835 - DNA, 22 bp, Artificial Sequence
  chemically synthesized
gaaggatgatgggagcgtgcca

SEQ ID NO: 667836 - DNA, 22 bp, Artificial Sequence
  chemically synthesized
aaggatgatgggagcgtgccag

SEQ ID NO: 667837 - DNA, 22 bp, Artificial Sequence
  chemically synthesized
ctgtgttcttacctggcacgct

SEQ ID NO: 667838 - DNA, 22 bp, Artificial Sequence
  chemically synthesized
cgctgctgtgttcttacctggc

SEQ ID NO: 667839 - DNA, 22 bp, Artificial Sequence
  chemically synthesized
ttacgctgctgtgttcttacct

SEQ ID NO: 667840 - DNA, 22 bp, Artificial Sequence
  chemically synthesized
acctattacgctgctgtgttct

SEQ ID NO: 667841 - DNA, 22 bp, Artificial Sequence
  chemically synthesized
acatgtgctgacctattacgct

SEQ ID NO: 667842 - DNA, 22 bp, Artificial Sequence
  chemically synthesized
aacatgtgctgacctattacgc

SEQ ID NO: 667843 - DNA, 22 bp, Artificial Sequence
  chemically synthesized
taacatgtgctgacctattacg

SEQ ID NO: 667844 - DNA, 22 bp, Artificial Sequence
  chemically synthesized
ttaacatgtgctgacctattac

SEQ ID NO: 667845 - DNA, 22 bp, Artificial Sequence
  chemically synthesized
tttaacatgtgctgacctatta

SEQ ID NO: 667846 - DNA, 22 bp, Artificial Sequence
  chemically synthesized
ttttaacatgtgctgacctatt

SEQ ID NO: 667847 - DNA, 22 bp, Artificial Sequence
  chemically synthesized
tttttaacatgtgctgacctat

SEQ ID NO: 667848 - DNA, 22 bp, Artificial Sequence
  chemically synthesized
ttttttaacatgtgctgaccta

SEQ ID NO: 667849 - DNA, 22 bp, Artificial Sequence
  chemically synthesized
tttttttaacatgtgctgacct

SEQ ID NO: 667850 - DNA, 22 bp, Artificial Sequence
  chemically synthesized
ttttttttaacatgtgctgacc

SEQ ID NO: 667851 - DNA, 22 bp, Artificial Sequence
  chemically synthesized
tttttttttaacatgtgctgac

SEQ ID NO: 667852 - DNA, 22 bp, Artificial Sequence
  chemically synthesized
ttttttttttaacatgtgctga

SEQ ID NO: 667853 - DNA, 22 bp, Artificial Sequence
  chemically synthesized
tttttttttttaacatgtgctg

SEQ ID NO: 667854 - DNA, 22 bp, Artificial Sequence
  chemically synthesized
ttttttttttttaacatgtgct

SEQ ID NO: 667855 - DNA, 22 bp, Artificial Sequence
  chemically synthesized
tttttttttttttaacatgtgc

SEQ ID NO: 667856 - DNA, 22 bp, Artificial Sequence
  chemically synthesized
ttttttttttttttaacatgtg

SEQ ID NO: 667857 - DNA, 22 bp, Artificial Sequence
  chemically synthesized
tttttttttttttttaacatgt

SEQ ID NO: 667858 - DNA, 22 bp, Artificial Sequence
  chemically synthesized
ttttttttttttttttaacatg

SEQ ID NO: 667859 - DNA, 22 bp, Artificial Sequence
  chemically synthesized
tttttttttttttttttaacat

SEQ ID NO: 667860 - DNA, 22 bp, Artificial Sequence
  chemically synthesized
ttttttttttttttttttaaca

SEQ ID NO: 667861 - DNA, 22 bp, Artificial Sequence
  chemically synthesized
tttttttttttttttttttaac

SEQ ID NO: 667862 - DNA, 22 bp, Artificial Sequence
  chemically synthesized
ttttttttttttttttttttaa

SEQ ID NO: 667863 - DNA, 22 bp, Artificial Sequence
  chemically synthesized
ttttttttttttttttttttta

SEQ ID NO: 667864 - DNA, 22 bp, Artificial Sequence
  chemically synthesized
tttttttttttttttttttttt

SEQ ID NO: 667865 - DNA, 22 bp, Artificial Sequence
  chemically synthesized
tttttttttttttttttttttt

SEQ ID NO: 667866 - DNA, 22 bp, Artificial Sequence
  chemically synthesized
tttttttttttttttttttttt

SEQ ID NO: 667867 - DNA, 22 bp, Artificial Sequence
  chemically synthesized
agagcttttttttttttttttt

SEQ ID NO: 667868 - DNA, 22 bp, Artificial Sequence
  chemically synthesized
cagagctttttttttttttttt

SEQ ID NO: 667869 - DNA, 22 bp, Artificial Sequence
  chemically synthesized
aaaaaaaaaaaaaaaaaaaaaa

SEQ ID NO: 667870 - DNA, 22 bp, Artificial Sequence
  chemically synthesized
cttcagagcttttttttttttt

SEQ ID NO: 667871 - DNA, 22 bp, Artificial Sequence
  chemically synthesized
tgcttcagagcttttttttttt

SEQ ID NO: 667872 - DNA, 22 bp, Artificial Sequence
  chemically synthesized
tctgcttcagagcttttttttt

SEQ ID NO: 667873 - DNA, 22 bp, Artificial Sequence
  chemically synthesized
ctctgcttcagagctttttttt

SEQ ID NO: 667874 - DNA, 22 bp, Artificial Sequence
  chemically synthesized
ttctctgcttcagagctttttt

SEQ ID NO: 667875 - DNA, 22 bp, Artificial Sequence
  chemically synthesized
cttctctgcttcagagcttttt

SEQ ID NO: 667876 - DNA, 22 bp, Artificial Sequence
  chemically synthesized
aagccccaccttcttctctgct

SEQ ID NO: 667877 - DNA, 22 bp, Artificial Sequence
  chemically synthesized
aaagccccaccttcttctctgc

SEQ ID NO: 667878 - DNA, 22 bp, Artificial Sequence
  chemically synthesized
ttaaagccccaccttcttctct

SEQ ID NO: 667879 - DNA, 22 bp, Artificial Sequence
  chemically synthesized
tgaagcagagaagaaggtgggg

SEQ ID NO: 667880 - DNA, 22 bp, Artificial Sequence
  chemically synthesized
aggattcttaaagccccacctt

SEQ ID NO: 667881 - DNA, 22 bp, Artificial Sequence
  chemically synthesized
aagcagagaagaaggtggggct

SEQ ID NO: 667882 - DNA, 22 bp, Artificial Sequence
  chemically synthesized
taaggattcttaaagccccacc

SEQ ID NO: 667883 - DNA, 22 bp, Artificial Sequence
  chemically synthesized
ctaaggattcttaaagccccac

SEQ ID NO: 667884 - DNA, 22 bp, Artificial Sequence
  chemically synthesized
gccttctaaggattcttaaagc

SEQ ID NO: 667885 - DNA, 22 bp, Artificial Sequence
  chemically synthesized
agcaatattggccttctaagga

SEQ ID NO: 667886 - DNA, 22 bp, Artificial Sequence
  chemically synthesized
cagcaatattggccttctaagg

SEQ ID NO: 667887 - DNA, 22 bp, Artificial Sequence
  chemically synthesized
taagaatccttagaaggccaat

SEQ ID NO: 667888 - DNA, 22 bp, Artificial Sequence
  chemically synthesized
aagaatccttagaaggccaata

SEQ ID NO: 667889 - DNA, 22 bp, Artificial Sequence
  chemically synthesized
agatttcagcaatattggcctt

SEQ ID NO: 667890 - DNA, 22 bp, Artificial Sequence
  chemically synthesized
agaatccttagaaggccaatat

SEQ ID NO: 667891 - DNA, 22 bp, Artificial Sequence
  chemically synthesized
tgagatttcagcaatattggcc

SEQ ID NO: 667892 - DNA, 22 bp, Artificial Sequence
  chemically synthesized
tctgagatttcagcaatattgg

SEQ ID NO: 667893 - DNA, 22 bp, Artificial Sequence
  chemically synthesized
ctctctgagatttcagcaatat

SEQ ID NO: 667894 - DNA, 22 bp, Artificial Sequence
  chemically synthesized
cctctctgagatttcagcaata

SEQ ID NO: 667895 - DNA, 22 bp, Artificial Sequence
  chemically synthesized
agaaggccaatattgctgaaat

SEQ ID NO: 667896 - DNA, 22 bp, Artificial Sequence
  chemically synthesized
gaaggccaatattgctgaaatc

SEQ ID NO: 667897 - DNA, 22 bp, Artificial Sequence
  chemically synthesized
cttcctctctgagatttcagca

SEQ ID NO: 667898 - DNA, 22 bp, Artificial Sequence
  chemically synthesized
ctccttcctctctgagatttca

SEQ ID NO: 667899 - DNA, 22 bp, Artificial Sequence
  chemically synthesized
cctccttcctctctgagatttc

SEQ ID NO: 667900 - DNA, 22 bp, Artificial Sequence
  chemically synthesized
ttcctccttcctctctgagatt

SEQ ID NO: 667901 - DNA, 22 bp, Artificial Sequence
  chemically synthesized
ctgaaatctcagagaggaagga

SEQ ID NO: 667902 - DNA, 22 bp, Artificial Sequence
  chemically synthesized
tgcccactcttcctccttcctc

SEQ ID NO: 667903 - DNA, 22 bp, Artificial Sequence
  chemically synthesized
aaatctcagagaggaaggagga

SEQ ID NO: 667904 - DNA, 22 bp, Artificial Sequence
  chemically synthesized
tctgtgcccactcttcctcctt

SEQ ID NO: 667905 - DNA, 22 bp, Artificial Sequence
  chemically synthesized
atctgtgcccactcttcctcct

SEQ ID NO: 667906 - DNA, 22 bp, Artificial Sequence
  chemically synthesized
agagaggaaggaggaagagtgg

SEQ ID NO: 667907 - DNA, 22 bp, Artificial Sequence
  chemically synthesized
tcaggccttatctgtgcccact

SEQ ID NO: 667908 - DNA, 22 bp, Artificial Sequence
  chemically synthesized
cctgtcaggccttatctgtgcc

SEQ ID NO: 667909 - DNA, 22 bp, Artificial Sequence
  chemically synthesized
cctacctgtcaggccttatctg

SEQ ID NO: 667910 - DNA, 22 bp, Artificial Sequence
  chemically synthesized
cccctgcctacctgtcaggcct

SEQ ID NO: 667911 - DNA, 22 bp, Artificial Sequence
  chemically synthesized
cagtgggcctccccctgcctac

SEQ ID NO: 667912 - DNA, 22 bp, Artificial Sequence
  chemically synthesized
tgcagtgggcctccccctgcct

SEQ ID NO: 667913 - DNA, 22 bp, Artificial Sequence
  chemically synthesized
acaggtaggcagggggaggccc

SEQ ID NO: 667914 - DNA, 22 bp, Artificial Sequence
  chemically synthesized
acacgatgtgcagggctctgca

SEQ ID NO: 667915 - DNA, 22 bp, Artificial Sequence
  chemically synthesized
cacacgatgtgcagggctctgc

SEQ ID NO: 667916 - DNA, 22 bp, Artificial Sequence
  chemically synthesized
cagagccctgcacatcgtgtga

SEQ ID NO: 667917 - DNA, 22 bp, Artificial Sequence
  chemically synthesized
cacatcgtgtgaaggattttgg

SEQ ID NO: 667918 - DNA, 22 bp, Artificial Sequence
  chemically synthesized
gaagtcccaacacccaaaatcc

SEQ ID NO: 667919 - DNA, 22 bp, Artificial Sequence
  chemically synthesized
actagaagtcccaacacccaaa

SEQ ID NO: 667920 - DNA, 22 bp, Artificial Sequence
  chemically synthesized
aactagaagtcccaacacccaa

SEQ ID NO: 667921 - DNA, 22 bp, Artificial Sequence
  chemically synthesized
tgtttaactagaagtcccaaca

SEQ ID NO: 667922 - DNA, 22 bp, Artificial Sequence
  chemically synthesized
ctgtgtttaactagaagtccca

SEQ ID NO: 667923 - DNA, 22 bp, Artificial Sequence
  chemically synthesized
tgggtgttgggacttctagtta

SEQ ID NO: 667924 - DNA, 22 bp, Artificial Sequence
  chemically synthesized
gggtgttgggacttctagttaa

SEQ ID NO: 667925 - DNA, 22 bp, Artificial Sequence
  chemically synthesized
catctgctgtgtttaactagaa

SEQ ID NO: 667926 - DNA, 22 bp, Artificial Sequence
  chemically synthesized
ggtgttgggacttctagttaaa

SEQ ID NO: 667927 - DNA, 22 bp, Artificial Sequence
  chemically synthesized
ctccatctgctgtgtttaacta

SEQ ID NO: 667928 - DNA, 22 bp, Artificial Sequence
  chemically synthesized
ggacttctagttaaacacagca

SEQ ID NO: 667929 - DNA, 22 bp, Artificial Sequence
  chemically synthesized
ctagttaaacacagcagatgga

SEQ ID NO: 667930 - DNA, 22 bp, Artificial Sequence
  chemically synthesized
tagttaaacacagcagatggag

SEQ ID NO: 667931 - DNA, 22 bp, Artificial Sequence
  chemically synthesized
gttaaacacagcagatggagca

SEQ ID NO: 667932 - DNA, 22 bp, Artificial Sequence
  chemically synthesized
aacacagcagatggagcagact

SEQ ID NO: 667933 - DNA, 22 bp, Artificial Sequence
  chemically synthesized
agggataaagagagacaaatga

SEQ ID NO: 667934 - DNA, 22 bp, Artificial Sequence
  chemically synthesized
cagggataaagagagacaaatg

SEQ ID NO: 667935 - DNA, 22 bp, Artificial Sequence
  chemically synthesized
gtagagtttcagggataaagag

SEQ ID NO: 667936 - DNA, 22 bp, Artificial Sequence
  chemically synthesized
atttgtctctctttatccctga

SEQ ID NO: 667937 - DNA, 22 bp, Artificial Sequence
  chemically synthesized
gtctctctttatccctgaaact

SEQ ID NO: 667938 - DNA, 22 bp, Artificial Sequence
  chemically synthesized
tcaacctggtagagtttcaggg

SEQ ID NO: 667939 - DNA, 22 bp, Artificial Sequence
  chemically synthesized
tctctctttatccctgaaactc

SEQ ID NO: 667940 - DNA, 22 bp, Artificial Sequence
  chemically synthesized
tatcaacctggtagagtttcag

SEQ ID NO: 667941 - DNA, 22 bp, Artificial Sequence
  chemically synthesized
ctatcaacctggtagagtttca

SEQ ID NO: 667942 - DNA, 22 bp, Artificial Sequence
  chemically synthesized
tctttatccctgaaactctacc

SEQ ID NO: 667943 - DNA, 22 bp, Artificial Sequence
  chemically synthesized
ttctatcaacctggtagagttt

SEQ ID NO: 667944 - DNA, 22 bp, Artificial Sequence
  chemically synthesized
tttatccctgaaactctaccag

SEQ ID NO: 667945 - DNA, 22 bp, Artificial Sequence
  chemically synthesized
ctcttctatcaacctggtagag

SEQ ID NO: 667946 - DNA, 22 bp, Artificial Sequence
  chemically synthesized
tatccctgaaactctaccaggt

SEQ ID NO: 667947 - DNA, 22 bp, Artificial Sequence
  chemically synthesized
atccctgaaactctaccaggtt

SEQ ID NO: 667948 - DNA, 22 bp, Artificial Sequence
  chemically synthesized
tccctgaaactctaccaggttg

SEQ ID NO: 667949 - DNA, 22 bp, Artificial Sequence
  chemically synthesized
ttcctcttctatcaacctggta

SEQ ID NO: 667950 - DNA, 22 bp, Artificial Sequence
  chemically synthesized
attcctcttctatcaacctggt

SEQ ID NO: 667951 - DNA, 22 bp, Artificial Sequence
  chemically synthesized
tattcctcttctatcaacctgg

SEQ ID NO: 667952 - DNA, 22 bp, Artificial Sequence
  chemically synthesized
ttattcctcttctatcaacctg

SEQ ID NO: 667953 - DNA, 22 bp, Artificial Sequence
  chemically synthesized
tttattcctcttctatcaacct

SEQ ID NO: 667954 - DNA, 22 bp, Artificial Sequence
  chemically synthesized
aaactctaccaggttgatagaa

SEQ ID NO: 667955 - DNA, 22 bp, Artificial Sequence
  chemically synthesized
taccaggttgatagaagaggaa

SEQ ID NO: 667956 - DNA, 22 bp, Artificial Sequence
  chemically synthesized
ccaggttgatagaagaggaata

SEQ ID NO: 667957 - DNA, 22 bp, Artificial Sequence
  chemically synthesized
ggtaaatgccattttttattcc

SEQ ID NO: 667958 - DNA, 22 bp, Artificial Sequence
  chemically synthesized
gggtaaatgccattttttattc

SEQ ID NO: 667959 - DNA, 22 bp, Artificial Sequence
  chemically synthesized
tgggtaaatgccattttttatt

SEQ ID NO: 667960 - DNA, 22 bp, Artificial Sequence
  chemically synthesized
ttgggtaaatgccattttttat

SEQ ID NO: 667961 - DNA, 22 bp, Artificial Sequence
  chemically synthesized
atagaagaggaataaaaaatgg

SEQ ID NO: 667962 - DNA, 22 bp, Artificial Sequence
  chemically synthesized
ttttgggtaaatgccatttttt

SEQ ID NO: 667963 - DNA, 22 bp, Artificial Sequence
  chemically synthesized
cttttgggtaaatgccattttt

SEQ ID NO: 667964 - DNA, 22 bp, Artificial Sequence
  chemically synthesized
tcttttgggtaaatgccatttt

SEQ ID NO: 667965 - DNA, 22 bp, Artificial Sequence
  chemically synthesized
attttcttttgggtaaatgcca

SEQ ID NO: 667966 - DNA, 22 bp, Artificial Sequence
  chemically synthesized
ttaattttcttttgggtaaatg

SEQ ID NO: 667967 - DNA, 22 bp, Artificial Sequence
  chemically synthesized
gttaattttcttttgggtaaat

SEQ ID NO: 667968 - DNA, 22 bp, Artificial Sequence
  chemically synthesized
tgttaattttcttttgggtaaa

SEQ ID NO: 667969 - DNA, 22 bp, Artificial Sequence
  chemically synthesized
ttttgttaattttcttttgggt

SEQ ID NO: 667970 - DNA, 22 bp, Artificial Sequence
  chemically synthesized
ctgttttgttaattttcttttg

SEQ ID NO: 667971 - DNA, 22 bp, Artificial Sequence
  chemically synthesized
tcctgttttgttaattttcttt

SEQ ID NO: 667972 - DNA, 22 bp, Artificial Sequence
  chemically synthesized
ctctcctgttttgttaattttc

SEQ ID NO: 667973 - DNA, 22 bp, Artificial Sequence
  chemically synthesized
acccaaaagaaaattaacaaaa

SEQ ID NO: 667974 - DNA, 22 bp, Artificial Sequence
  chemically synthesized
cccaaaagaaaattaacaaaac

SEQ ID NO: 667975 - DNA, 22 bp, Artificial Sequence
  chemically synthesized
atctcctctcctgttttgttaa

SEQ ID NO: 667976 - DNA, 22 bp, Artificial Sequence
  chemically synthesized
tcatctcctctcctgttttgtt

SEQ ID NO: 667977 - DNA, 22 bp, Artificial Sequence
  chemically synthesized
ttctcatctcctctcctgtttt

SEQ ID NO: 667978 - DNA, 22 bp, Artificial Sequence
  chemically synthesized
atctgttctcatctcctctcct

SEQ ID NO: 667979 - DNA, 22 bp, Artificial Sequence
  chemically synthesized
tgatctgttctcatctcctctc

SEQ ID NO: 667980 - DNA, 22 bp, Artificial Sequence
  chemically synthesized
acaaaacaggagaggagatgag

SEQ ID NO: 667981 - DNA, 22 bp, Artificial Sequence
  chemically synthesized
gagctctgatctgttctcatct

SEQ ID NO: 667982 - DNA, 22 bp, Artificial Sequence
  chemically synthesized
agccaccaaaatactggagctc

SEQ ID NO: 667983 - DNA, 22 bp, Artificial Sequence
  chemically synthesized
taagccaccaaaatactggagc

SEQ ID NO: 667984 - DNA, 22 bp, Artificial Sequence
  chemically synthesized
ctaagccaccaaaatactggag

SEQ ID NO: 667985 - DNA, 22 bp, Artificial Sequence
  chemically synthesized
tctaagccaccaaaatactgga

SEQ ID NO: 667986 - DNA, 22 bp, Artificial Sequence
  chemically synthesized
cagtattttggtggcttagaaa

SEQ ID NO: 667987 - DNA, 22 bp, Artificial Sequence
  chemically synthesized
ccagcaggtcattttctaagcc

SEQ ID NO: 667988 - DNA, 22 bp, Artificial Sequence
  chemically synthesized
gttaccagcaggtcattttcta

SEQ ID NO: 667989 - DNA, 22 bp, Artificial Sequence
  chemically synthesized
tggtggcttagaaaatgacctg

SEQ ID NO: 667990 - DNA, 22 bp, Artificial Sequence
  chemically synthesized
ggtggcttagaaaatgacctgc

SEQ ID NO: 667991 - DNA, 22 bp, Artificial Sequence
  chemically synthesized
agttggttaccagcaggtcatt

SEQ ID NO: 667992 - DNA, 22 bp, Artificial Sequence
  chemically synthesized
gtggcttagaaaatgacctgct

SEQ ID NO: 667993 - DNA, 22 bp, Artificial Sequence
  chemically synthesized
ctaagttggttaccagcaggtc

SEQ ID NO: 667994 - DNA, 22 bp, Artificial Sequence
  chemically synthesized
agaaaatgacctgctggtaacc

SEQ ID NO: 667995 - DNA, 22 bp, Artificial Sequence
  chemically synthesized
gtctcctaagttggttaccagc

SEQ ID NO: 667996 - DNA, 22 bp, Artificial Sequence
  chemically synthesized
gaaaatgacctgctggtaacca

SEQ ID NO: 667997 - DNA, 22 bp, Artificial Sequence
  chemically synthesized
tggtctcctaagttggttacca

SEQ ID NO: 667998 - DNA, 22 bp, Artificial Sequence
  chemically synthesized
tctggtctcctaagttggttac

SEQ ID NO: 667999 - DNA, 22 bp, Artificial Sequence
  chemically synthesized
ctctggtctcctaagttggtta

SEQ ID NO: 668000 - DNA, 22 bp, Artificial Sequence
  chemically synthesized
ggatttctctggtctcctaagt

SEQ ID NO: 668001 - DNA, 22 bp, Artificial Sequence
  chemically synthesized
gggatttctctggtctcctaag

SEQ ID NO: 668002 - DNA, 22 bp, Artificial Sequence
  chemically synthesized
ctggtaaccaacttaggagacc

SEQ ID NO: 668003 - DNA, 22 bp, Artificial Sequence
  chemically synthesized
gtaaccaacttaggagaccaga

SEQ ID NO: 668004 - DNA, 22 bp, Artificial Sequence
  chemically synthesized
agcttgggatttctctggtctc

SEQ ID NO: 668005 - DNA, 22 bp, Artificial Sequence
  chemically synthesized
attgagcttgggatttctctgg

SEQ ID NO: 668006 - DNA, 22 bp, Artificial Sequence
  chemically synthesized
aggagaccagagaaatcccaag

SEQ ID NO: 668007 - DNA, 22 bp, Artificial Sequence
  chemically synthesized
ggagaccagagaaatcccaagc

SEQ ID NO: 668008 - DNA, 22 bp, Artificial Sequence
  chemically synthesized
cccaacatcattaattgagctt

SEQ ID NO: 668009 - DNA, 22 bp, Artificial Sequence
  chemically synthesized
tctccccaacatcattaattga

SEQ ID NO: 668010 - DNA, 22 bp, Artificial Sequence
  chemically synthesized
gtctccccaacatcattaattg

SEQ ID NO: 668011 - DNA, 22 bp, Artificial Sequence
  chemically synthesized
cttgtctccccaacatcattaa

SEQ ID NO: 668012 - DNA, 22 bp, Artificial Sequence
  chemically synthesized
aattaatgatgttggggagaca

SEQ ID NO: 668013 - DNA, 22 bp, Artificial Sequence
  chemically synthesized
ccccaatctccttgtctcccca

SEQ ID NO: 668014 - DNA, 22 bp, Artificial Sequence
  chemically synthesized
cctgccccaatctccttgtctc

SEQ ID NO: 668015 - DNA, 22 bp, Artificial Sequence
  chemically synthesized
atgatgttggggagacaaggag

SEQ ID NO: 668016 - DNA, 22 bp, Artificial Sequence
  chemically synthesized
ccactccctgccccaatctcct

SEQ ID NO: 668017 - DNA, 22 bp, Artificial Sequence
  chemically synthesized
ctcccactccctgccccaatct

SEQ ID NO: 668018 - DNA, 22 bp, Artificial Sequence
  chemically synthesized
gggagacaaggagattggggca

SEQ ID NO: 668019 - DNA, 22 bp, Artificial Sequence
  chemically synthesized
gttcctcccactccctgcccca

SEQ ID NO: 668020 - DNA, 22 bp, Artificial Sequence
  chemically synthesized
ttagttcctcccactccctgcc

SEQ ID NO: 668021 - DNA, 22 bp, Artificial Sequence
  chemically synthesized
gttagttcctcccactccctgc

SEQ ID NO: 668022 - DNA, 22 bp, Artificial Sequence
  chemically synthesized
gggcagggagtgggaggaacta

SEQ ID NO: 668023 - DNA, 22 bp, Artificial Sequence
  chemically synthesized
gcatgcgtcttgttagttcctc

SEQ ID NO: 668024 - DNA, 22 bp, Artificial Sequence
  chemically synthesized
cataaactggcatgcgtcttgt

SEQ ID NO: 668025 - DNA, 22 bp, Artificial Sequence
  chemically synthesized
gctacataaactggcatgcgtc

SEQ ID NO: 668026 - DNA, 22 bp, Artificial Sequence
  chemically synthesized
ggctacataaactggcatgcgt

SEQ ID NO: 668027 - DNA, 22 bp, Artificial Sequence
  chemically synthesized
ttggctacataaactggcatgc

SEQ ID NO: 668028 - DNA, 22 bp, Artificial Sequence
  chemically synthesized
cttggctacataaactggcatg

SEQ ID NO: 668029 - DNA, 22 bp, Artificial Sequence
  chemically synthesized
acaagacgcatgccagtttatg

SEQ ID NO: 668030 - DNA, 22 bp, Artificial Sequence
  chemically synthesized
agacttcttggctacataaact

SEQ ID NO: 668031 - DNA, 22 bp, Artificial Sequence
  chemically synthesized
tgagacttcttggctacataaa

SEQ ID NO: 668032 - DNA, 22 bp, Artificial Sequence
  chemically synthesized
ctgagacttcttggctacataa

SEQ ID NO: 668033 - DNA, 22 bp, Artificial Sequence
  chemically synthesized
atttctgagacttcttggctac

SEQ ID NO: 668034 - DNA, 22 bp, Artificial Sequence
  chemically synthesized
catttctgagacttcttggcta

SEQ ID NO: 668035 - DNA, 22 bp, Artificial Sequence
  chemically synthesized
tcatttctgagacttcttggct

SEQ ID NO: 668036 - DNA, 22 bp, Artificial Sequence
  chemically synthesized
gagcctttcatttctgagactt

SEQ ID NO: 668037 - DNA, 22 bp, Artificial Sequence
  chemically synthesized
atgtagccaagaagtctcagaa

SEQ ID NO: 668038 - DNA, 22 bp, Artificial Sequence
  chemically synthesized
tgtagccaagaagtctcagaaa

SEQ ID NO: 668039 - DNA, 22 bp, Artificial Sequence
  chemically synthesized
agaggaacctggagcctttcat

SEQ ID NO: 668040 - DNA, 22 bp, Artificial Sequence
  chemically synthesized
cagaggaacctggagcctttca

SEQ ID NO: 668041 - DNA, 22 bp, Artificial Sequence
  chemically synthesized
agtcttcagaggaacctggagc

SEQ ID NO: 668042 - DNA, 22 bp, Artificial Sequence
  chemically synthesized
agaaatgaaaggctccaggttc

SEQ ID NO: 668043 - DNA, 22 bp, Artificial Sequence
  chemically synthesized
cagtcttcagaggaacctggag

SEQ ID NO: 668044 - DNA, 22 bp, Artificial Sequence
  chemically synthesized
agccacatttcagtcttcagag

SEQ ID NO: 668045 - DNA, 22 bp, Artificial Sequence
  chemically synthesized
cagccacatttcagtcttcaga

SEQ ID NO: 668046 - DNA, 22 bp, Artificial Sequence
  chemically synthesized
tcagccacatttcagtcttcag

SEQ ID NO: 668047 - DNA, 22 bp, Artificial Sequence
  chemically synthesized
caggttcctctgaagactgaaa

SEQ ID NO: 668048 - DNA, 22 bp, Artificial Sequence
  chemically synthesized
tattttcagccacatttcagtc

SEQ ID NO: 668049 - DNA, 22 bp, Artificial Sequence
  chemically synthesized
gtattttcagccacatttcagt

SEQ ID NO: 668050 - DNA, 22 bp, Artificial Sequence
  chemically synthesized
ctctgaagactgaaatgtggct

SEQ ID NO: 668051 - DNA, 22 bp, Artificial Sequence
  chemically synthesized
tgaagactgaaatgtggctgaa

SEQ ID NO: 668052 - DNA, 22 bp, Artificial Sequence
  chemically synthesized
aagactgaaatgtggctgaaaa

SEQ ID NO: 668053 - DNA, 22 bp, Artificial Sequence
  chemically synthesized
aaccagtccttgtattttcagc

SEQ ID NO: 668054 - DNA, 22 bp, Artificial Sequence
  chemically synthesized
caaccagtccttgtattttcag

SEQ ID NO: 668055 - DNA, 22 bp, Artificial Sequence
  chemically synthesized
tcaaccagtccttgtattttca

SEQ ID NO: 668056 - DNA, 22 bp, Artificial Sequence
  chemically synthesized
aaatgtggctgaaaatacaagg

SEQ ID NO: 668057 - DNA, 22 bp, Artificial Sequence
  chemically synthesized
aagactttcaaccagtccttgt

SEQ ID NO: 668058 - DNA, 22 bp, Artificial Sequence
  chemically synthesized
taaagactttcaaccagtcctt

SEQ ID NO: 668059 - DNA, 22 bp, Artificial Sequence
  chemically synthesized
aaaatacaaggactggttgaaa

SEQ ID NO: 668060 - DNA, 22 bp, Artificial Sequence
  chemically synthesized
gggctctaaagactttcaacca

SEQ ID NO: 668061 - DNA, 22 bp, Artificial Sequence
  chemically synthesized
agggctctaaagactttcaacc

SEQ ID NO: 668062 - DNA, 22 bp, Artificial Sequence
  chemically synthesized
gttgaaagtctttagagcccta

SEQ ID NO: 668063 - DNA, 22 bp, Artificial Sequence
  chemically synthesized
aaagtctttagagccctaaaca

SEQ ID NO: 668064 - DNA, 22 bp, Artificial Sequence
  chemically synthesized
caagtgggggaggtgtttaggg

SEQ ID NO: 668065 - DNA, 22 bp, Artificial Sequence
  chemically synthesized
ggctccaagtgggggaggtgtt

SEQ ID NO: 668066 - DNA, 22 bp, Artificial Sequence
  chemically synthesized
tagagccctaaacacctccccc

SEQ ID NO: 668067 - DNA, 22 bp, Artificial Sequence
  chemically synthesized
agagccctaaacacctccccca

SEQ ID NO: 668068 - DNA, 22 bp, Artificial Sequence
  chemically synthesized
gagccctaaacacctcccccac

SEQ ID NO: 668069 - DNA, 22 bp, Artificial Sequence
  chemically synthesized
agatgctaggctccaagtgggg

SEQ ID NO: 668070 - DNA, 22 bp, Artificial Sequence
  chemically synthesized
aacacctcccccacttggagcc

SEQ ID NO: 668071 - DNA, 22 bp, Artificial Sequence
  chemically synthesized
ccccacttggagcctagcatct

SEQ ID NO: 668072 - DNA, 22 bp, Artificial Sequence
  chemically synthesized
ggagcctagcatctcagccacc

SEQ ID NO: 668073 - DNA, 22 bp, Artificial Sequence
  chemically synthesized
gagcctagcatctcagccacct

SEQ ID NO: 668074 - DNA, 22 bp, Artificial Sequence
  chemically synthesized
tcaggatgaagcagcaggtggc

SEQ ID NO: 668075 - DNA, 22 bp, Artificial Sequence
  chemically synthesized
tgtcaggatgaagcagcaggtg

SEQ ID NO: 668076 - DNA, 22 bp, Artificial Sequence
  chemically synthesized
ctgtcaggatgaagcagcaggt

SEQ ID NO: 668077 - DNA, 22 bp, Artificial Sequence
  chemically synthesized
gcatctcagccacctgctgctt

SEQ ID NO: 668078 - DNA, 22 bp, Artificial Sequence
  chemically synthesized
cagccttctgtcaggatgaagc

SEQ ID NO: 668079 - DNA, 22 bp, Artificial Sequence
  chemically synthesized
agccacctgctgcttcatcctg

SEQ ID NO: 668080 - DNA, 22 bp, Artificial Sequence
  chemically synthesized
agcctccagccttctgtcagga

SEQ ID NO: 668081 - DNA, 22 bp, Artificial Sequence
  chemically synthesized
ctgcttcatcctgacagaaggc

SEQ ID NO: 668082 - DNA, 22 bp, Artificial Sequence
  chemically synthesized
cttcatcctgacagaaggctgg

SEQ ID NO: 668083 - DNA, 22 bp, Artificial Sequence
  chemically synthesized
gagattaagcctccagccttct

SEQ ID NO: 668084 - DNA, 22 bp, Artificial Sequence
  chemically synthesized
cgagattaagcctccagccttc

SEQ ID NO: 668085 - DNA, 22 bp, Artificial Sequence
  chemically synthesized
catcctgacagaaggctggagg

SEQ ID NO: 668086 - DNA, 22 bp, Artificial Sequence
  chemically synthesized
atcctgacagaaggctggaggc

SEQ ID NO: 668087 - DNA, 22 bp, Artificial Sequence
  chemically synthesized
acagaaggctggaggcttaatc

SEQ ID NO: 668088 - DNA, 22 bp, Artificial Sequence
  chemically synthesized
gtgtgtggtgcagcttcgagat

SEQ ID NO: 668089 - DNA, 22 bp, Artificial Sequence
  chemically synthesized
gaggcttaatctcgaagctgca

SEQ ID NO: 668090 - DNA, 22 bp, Artificial Sequence
  chemically synthesized
atgcgccctggtgtgtggtgca

SEQ ID NO: 668091 - DNA, 22 bp, Artificial Sequence
  chemically synthesized
aatctcgaagctgcaccacaca

SEQ ID NO: 668092 - DNA, 22 bp, Artificial Sequence
  chemically synthesized
atctcgaagctgcaccacacac

SEQ ID NO: 668093 - DNA, 22 bp, Artificial Sequence
  chemically synthesized
ctcatgcgccctggtgtgtggt

SEQ ID NO: 668094 - DNA, 22 bp, Artificial Sequence
  chemically synthesized
ctcctcatgcgccctggtgtgt

SEQ ID NO: 668095 - DNA, 22 bp, Artificial Sequence
  chemically synthesized
gaagctgcaccacacaccaggg

SEQ ID NO: 668096 - DNA, 22 bp, Artificial Sequence
  chemically synthesized
actgctcctcatgcgccctggt

SEQ ID NO: 668097 - DNA, 22 bp, Artificial Sequence
  chemically synthesized
cactgctcctcatgcgccctgg

SEQ ID NO: 668098 - DNA, 22 bp, Artificial Sequence
  chemically synthesized
caccacacaccagggcgcatga

SEQ ID NO: 668099 - DNA, 22 bp, Artificial Sequence
  chemically synthesized
caaatttcactgctcctcatgc

SEQ ID NO: 668100 - DNA, 22 bp, Artificial Sequence
  chemically synthesized
ccaaatttcactgctcctcatg

SEQ ID NO: 668101 - DNA, 22 bp, Artificial Sequence
  chemically synthesized
ccacttccaaatttcactgctc

SEQ ID NO: 668102 - DNA, 22 bp, Artificial Sequence
  chemically synthesized
tcccacttccaaatttcactgc

SEQ ID NO: 668103 - DNA, 22 bp, Artificial Sequence
  chemically synthesized
ctcccacttccaaatttcactg

SEQ ID NO: 668104 - DNA, 22 bp, Artificial Sequence
  chemically synthesized
cagtgccttctcccacttccaa

SEQ ID NO: 668105 - DNA, 22 bp, Artificial Sequence
  chemically synthesized
ccagtgccttctcccacttcca

SEQ ID NO: 668106 - DNA, 22 bp, Artificial Sequence
  chemically synthesized
tttccagtgccttctcccactt

SEQ ID NO: 668107 - DNA, 22 bp, Artificial Sequence
  chemically synthesized
tgtttccagtgccttctcccac

SEQ ID NO: 668108 - DNA, 22 bp, Artificial Sequence
  chemically synthesized
ggaagtgggagaaggcactgga

SEQ ID NO: 668109 - DNA, 22 bp, Artificial Sequence
  chemically synthesized
gaagtgggagaaggcactggaa

SEQ ID NO: 668110 - DNA, 22 bp, Artificial Sequence
  chemically synthesized
gtatgtaatccctctgtttcca

SEQ ID NO: 668111 - DNA, 22 bp, Artificial Sequence
  chemically synthesized
gaaacagagggattacatacca

SEQ ID NO: 668112 - DNA, 22 bp, Artificial Sequence
  chemically synthesized
aggatgcagagctggtatgtaa

SEQ ID NO: 668113 - DNA, 22 bp, Artificial Sequence
  chemically synthesized
caggatgcagagctggtatgta

SEQ ID NO: 668114 - DNA, 22 bp, Artificial Sequence
  chemically synthesized
tcaggatgcagagctggtatgt

SEQ ID NO: 668115 - DNA, 22 bp, Artificial Sequence
  chemically synthesized
tttcaggatgcagagctggtat

SEQ ID NO: 668116 - DNA, 22 bp, Artificial Sequence
  chemically synthesized
ctttcaggatgcagagctggta

SEQ ID NO: 668117 - DNA, 22 bp, Artificial Sequence
  chemically synthesized
tctttcaggatgcagagctggt

SEQ ID NO: 668118 - DNA, 22 bp, Artificial Sequence
  chemically synthesized
ctttctttcaggatgcagagct

SEQ ID NO: 668119 - DNA, 22 bp, Artificial Sequence
  chemically synthesized
actttctttcaggatgcagagc

SEQ ID NO: 668120 - DNA, 22 bp, Artificial Sequence
  chemically synthesized
cataccagctctgcatcctgaa

SEQ ID NO: 668121 - DNA, 22 bp, Artificial Sequence
  chemically synthesized
aagatttactttctttcaggat

SEQ ID NO: 668122 - DNA, 22 bp, Artificial Sequence
  chemically synthesized
gaagatttactttctttcagga

SEQ ID NO: 668123 - DNA, 22 bp, Artificial Sequence
  chemically synthesized
tgcatcctgaaagaaagtaaat

SEQ ID NO: 668124 - DNA, 22 bp, Artificial Sequence
  chemically synthesized
catcctgaaagaaagtaaatct

SEQ ID NO: 668125 - DNA, 22 bp, Artificial Sequence
  chemically synthesized
aaagaaagtaaatcttcaaatt

SEQ ID NO: 668126 - DNA, 22 bp, Artificial Sequence
  chemically synthesized
aggagtaggaaatgaaggaaat

SEQ ID NO: 668127 - DNA, 22 bp, Artificial Sequence
  chemically synthesized
caaattcatttccttcatttcc

SEQ ID NO: 668128 - DNA, 22 bp, Artificial Sequence
  chemically synthesized
aaattcatttccttcatttcct

SEQ ID NO: 668129 - DNA, 22 bp, Artificial Sequence
  chemically synthesized
atttccttcatttcctactcct

SEQ ID NO: 668130 - DNA, 22 bp, Artificial Sequence
  chemically synthesized
aatatggaattgaggagtagga

SEQ ID NO: 668131 - DNA, 22 bp, Artificial Sequence
  chemically synthesized
ccttcatttcctactcctcaat

SEQ ID NO: 668132 - DNA, 22 bp, Artificial Sequence
  chemically synthesized
cttcatttcctactcctcaatt

SEQ ID NO: 668133 - DNA, 22 bp, Artificial Sequence
  chemically synthesized
catttcctactcctcaattcca

SEQ ID NO: 668134 - DNA, 22 bp, Artificial Sequence
  chemically synthesized
atttcctactcctcaattccat

SEQ ID NO: 668135 - DNA, 22 bp, Artificial Sequence
  chemically synthesized
cctactcctcaattccatattt

SEQ ID NO: 668136 - DNA, 22 bp, Artificial Sequence
  chemically synthesized
ctactcctcaattccatattta

SEQ ID NO: 668137 - DNA, 22 bp, Artificial Sequence
  chemically synthesized
ctcctcaattccatatttagtc

SEQ ID NO: 668138 - DNA, 22 bp, Artificial Sequence
  chemically synthesized
acagaaaacagcagactaaata

SEQ ID NO: 668139 - DNA, 22 bp, Artificial Sequence
  chemically synthesized
ctcaattccatatttagtctgc

SEQ ID NO: 668140 - DNA, 22 bp, Artificial Sequence
  chemically synthesized
aattccatatttagtctgctgt

SEQ ID NO: 668141 - DNA, 22 bp, Artificial Sequence
  chemically synthesized
catatttagtctgctgttttct

SEQ ID NO: 668142 - DNA, 22 bp, Artificial Sequence
  chemically synthesized
aaatgagttaacagaaaacagc

SEQ ID NO: 668143 - DNA, 22 bp, Artificial Sequence
  chemically synthesized
aaaatgagttaacagaaaacag

SEQ ID NO: 668144 - DNA, 22 bp, Artificial Sequence
  chemically synthesized
taaaatgagttaacagaaaaca

SEQ ID NO: 668145 - DNA, 22 bp, Artificial Sequence
  chemically synthesized
ttaaaatgagttaacagaaaac

SEQ ID NO: 668146 - DNA, 22 bp, Artificial Sequence
  chemically synthesized
tttaaaatgagttaacagaaaa

SEQ ID NO: 668147 - DNA, 22 bp, Artificial Sequence
  chemically synthesized
agtctgctgttttctgttaact

SEQ ID NO: 668148 - DNA, 22 bp, Artificial Sequence
  chemically synthesized
gtctgctgttttctgttaactc

SEQ ID NO: 668149 - DNA, 22 bp, Artificial Sequence
  chemically synthesized
ctgttttctgttaactcatttt

SEQ ID NO: 668150 - DNA, 22 bp, Artificial Sequence
  chemically synthesized
ttttctgttaactcattttaaa

SEQ ID NO: 668151 - DNA, 22 bp, Artificial Sequence
  chemically synthesized
ggtagaagagctttttaaaatg

SEQ ID NO: 668152 - DNA, 22 bp, Artificial Sequence
  chemically synthesized
aggtagaagagctttttaaaat

SEQ ID NO: 668153 - DNA, 22 bp, Artificial Sequence
  chemically synthesized
tctgttaactcattttaaaaag

SEQ ID NO: 668154 - DNA, 22 bp, Artificial Sequence
  chemically synthesized
ctgttaactcattttaaaaagc

SEQ ID NO: 668155 - DNA, 22 bp, Artificial Sequence
  chemically synthesized
tgttaactcattttaaaaagct

SEQ ID NO: 668156 - DNA, 22 bp, Artificial Sequence
  chemically synthesized
ttaactcattttaaaaagctct

SEQ ID NO: 668157 - DNA, 22 bp, Artificial Sequence
  chemically synthesized
actcattttaaaaagctcttct

SEQ ID NO: 668158 - DNA, 22 bp, Artificial Sequence
  chemically synthesized
attttaaaaagctcttctacct

SEQ ID NO: 668159 - DNA, 22 bp, Artificial Sequence
  chemically synthesized
taaaaagctcttctacctaagc

SEQ ID NO: 668160 - DNA, 22 bp, Artificial Sequence
  chemically synthesized
aaaaagctcttctacctaagca

SEQ ID NO: 668161 - DNA, 22 bp, Artificial Sequence
  chemically synthesized
aaaagctcttctacctaagcac

SEQ ID NO: 668162 - DNA, 22 bp, Artificial Sequence
  chemically synthesized
ttctacctaagcactttctttt

SEQ ID NO: 668163 - DNA, 22 bp, Artificial Sequence
  chemically synthesized
ctacctaagcactttctttttt

SEQ ID NO: 668164 - DNA, 22 bp, Artificial Sequence
  chemically synthesized
tacctaagcactttcttttttg

SEQ ID NO: 668165 - DNA, 22 bp, Artificial Sequence
  chemically synthesized
gagataaaggtggcaaaaaaga

SEQ ID NO: 668166 - DNA, 22 bp, Artificial Sequence
  chemically synthesized
cctaagcactttcttttttgcc

SEQ ID NO: 668167 - DNA, 22 bp, Artificial Sequence
  chemically synthesized
tggagataaaggtggcaaaaaa

SEQ ID NO: 668168 - DNA, 22 bp, Artificial Sequence
  chemically synthesized
ctggagataaaggtggcaaaaa

SEQ ID NO: 668169 - DNA, 22 bp, Artificial Sequence
  chemically synthesized
agcactttcttttttgccacct

SEQ ID NO: 668170 - DNA, 22 bp, Artificial Sequence
  chemically synthesized
cttctggagataaaggtggcaa

SEQ ID NO: 668171 - DNA, 22 bp, Artificial Sequence
  chemically synthesized
tcttttttgccacctttatctc

SEQ ID NO: 668172 - DNA, 22 bp, Artificial Sequence
  chemically synthesized
aagttccttctggagataaagg

SEQ ID NO: 668173 - DNA, 22 bp, Artificial Sequence
  chemically synthesized
cttttttgccacctttatctcc

SEQ ID NO: 668174 - DNA, 22 bp, Artificial Sequence
  chemically synthesized
ttttttgccacctttatctcca

SEQ ID NO: 668175 - DNA, 22 bp, Artificial Sequence
  chemically synthesized
ttttgccacctttatctccaga

SEQ ID NO: 668176 - DNA, 22 bp, Artificial Sequence
  chemically synthesized
tttgccacctttatctccagaa

SEQ ID NO: 668177 - DNA, 22 bp, Artificial Sequence
  chemically synthesized
ttgccacctttatctccagaag

SEQ ID NO: 668178 - DNA, 22 bp, Artificial Sequence
  chemically synthesized
aagttgaagttccttctggaga

SEQ ID NO: 668179 - DNA, 22 bp, Artificial Sequence
  chemically synthesized
tgccacctttatctccagaagg

SEQ ID NO: 668180 - DNA, 22 bp, Artificial Sequence
  chemically synthesized
gccacctttatctccagaagga

SEQ ID NO: 668181 - DNA, 22 bp, Artificial Sequence
  chemically synthesized
ccacctttatctccagaaggaa

SEQ ID NO: 668182 - DNA, 22 bp, Artificial Sequence
  chemically synthesized
ctgaagttgaagttccttctgg

SEQ ID NO: 668183 - DNA, 22 bp, Artificial Sequence
  chemically synthesized
gctgaagttgaagttccttctg

SEQ ID NO: 668184 - DNA, 22 bp, Artificial Sequence
  chemically synthesized
tatctccagaaggaacttcaac

SEQ ID NO: 668185 - DNA, 22 bp, Artificial Sequence
  chemically synthesized
atctccagaaggaacttcaact

SEQ ID NO: 668186 - DNA, 22 bp, Artificial Sequence
  chemically synthesized
tctccagaaggaacttcaactt

SEQ ID NO: 668187 - DNA, 22 bp, Artificial Sequence
  chemically synthesized
cataccttgctgaagttgaagt

SEQ ID NO: 668188 - DNA, 22 bp, Artificial Sequence
  chemically synthesized
cagaaggaacttcaacttcagc

SEQ ID NO: 668189 - DNA, 22 bp, Artificial Sequence
  chemically synthesized
atggctgcataccttgctgaag

SEQ ID NO: 668190 - DNA, 22 bp, Artificial Sequence
  chemically synthesized
aatggctgcataccttgctgaa

SEQ ID NO: 668191 - DNA, 22 bp, Artificial Sequence
  chemically synthesized
caacttcagcaaggtatgcagc

SEQ ID NO: 668192 - DNA, 22 bp, Artificial Sequence
  chemically synthesized
aacttcagcaaggtatgcagcc

SEQ ID NO: 668193 - DNA, 22 bp, Artificial Sequence
  chemically synthesized
aggaacaatttaatggctgcat

SEQ ID NO: 668194 - DNA, 22 bp, Artificial Sequence
  chemically synthesized
cagcaaggtatgcagccattaa

SEQ ID NO: 668195 - DNA, 22 bp, Artificial Sequence
  chemically synthesized
agcaaggtatgcagccattaaa

SEQ ID NO: 668196 - DNA, 22 bp, Artificial Sequence
  chemically synthesized
aattgttcctcaattatcatcc

SEQ ID NO: 668197 - DNA, 22 bp, Artificial Sequence
  chemically synthesized
ttcctcaattatcatccctata

SEQ ID NO: 668198 - DNA, 22 bp, Artificial Sequence
  chemically synthesized
ctcaattatcatccctatatat

SEQ ID NO: 668199 - DNA, 22 bp, Artificial Sequence
  chemically synthesized
aattatcatccctatatatcat

SEQ ID NO: 668200 - DNA, 22 bp, Artificial Sequence
  chemically synthesized
cagcatgaagaatatgatatat

SEQ ID NO: 668201 - DNA, 22 bp, Artificial Sequence
  chemically synthesized
tcatccctatatatcatattct

SEQ ID NO: 668202 - DNA, 22 bp, Artificial Sequence
  chemically synthesized
taactgcagcatgaagaatatg

SEQ ID NO: 668203 - DNA, 22 bp, Artificial Sequence
  chemically synthesized
tatatcatattcttcatgctgc

SEQ ID NO: 668204 - DNA, 22 bp, Artificial Sequence
  chemically synthesized
gagtagttgtaactgcagcatg

SEQ ID NO: 668205 - DNA, 22 bp, Artificial Sequence
  chemically synthesized
ggagtagttgtaactgcagcat

SEQ ID NO: 668206 - DNA, 22 bp, Artificial Sequence
  chemically synthesized
atttggagtagttgtaactgca

SEQ ID NO: 668207 - DNA, 22 bp, Artificial Sequence
  chemically synthesized
gatttggagtagttgtaactgc

SEQ ID NO: 668208 - DNA, 22 bp, Artificial Sequence
  chemically synthesized
ttcatgctgcagttacaactac

SEQ ID NO: 668209 - DNA, 22 bp, Artificial Sequence
  chemically synthesized
atttgatttggagtagttgtaa

SEQ ID NO: 668210 - DNA, 22 bp, Artificial Sequence
  chemically synthesized
catgctgcagttacaactactc

SEQ ID NO: 668211 - DNA, 22 bp, Artificial Sequence
  chemically synthesized
atgctgcagttacaactactcc

SEQ ID NO: 668212 - DNA, 22 bp, Artificial Sequence
  chemically synthesized
cagttacaactactccaaatca

SEQ ID NO: 668213 - DNA, 22 bp, Artificial Sequence
  chemically synthesized
caactactccaaatcaaatcaa

SEQ ID NO: 668214 - DNA, 22 bp, Artificial Sequence
  chemically synthesized
caaggaaagtgcattgatttga

SEQ ID NO: 668215 - DNA, 22 bp, Artificial Sequence
  chemically synthesized
ctccaaatcaaatcaatgcact

SEQ ID NO: 668216 - DNA, 22 bp, Artificial Sequence
  chemically synthesized
caaatcaaatcaatgcactttc

SEQ ID NO: 668217 - DNA, 22 bp, Artificial Sequence
  chemically synthesized
tcaagagggagactgcaaggaa

SEQ ID NO: 668218 - DNA, 22 bp, Artificial Sequence
  chemically synthesized
taagtcgcctgtcaagagggag

SEQ ID NO: 668219 - DNA, 22 bp, Artificial Sequence
  chemically synthesized
tccttgcagtctccctcttgac

SEQ ID NO: 668220 - DNA, 22 bp, Artificial Sequence
  chemically synthesized
ccttgcagtctccctcttgaca

SEQ ID NO: 668221 - DNA, 22 bp, Artificial Sequence
  chemically synthesized
cttgcagtctccctcttgacag

SEQ ID NO: 668222 - DNA, 22 bp, Artificial Sequence
  chemically synthesized
gcagtctccctcttgacaggcg

SEQ ID NO: 668223 - DNA, 22 bp, Artificial Sequence
  chemically synthesized
cagtctccctcttgacaggcga

SEQ ID NO: 668224 - DNA, 22 bp, Artificial Sequence
  chemically synthesized
tgtgactgtaagtcgcctgtca

SEQ ID NO: 668225 - DNA, 22 bp, Artificial Sequence
  chemically synthesized
cctcttgacaggcgacttacag

SEQ ID NO: 668226 - DNA, 22 bp, Artificial Sequence
  chemically synthesized
ttgacaggcgacttacagtcac

SEQ ID NO: 668227 - DNA, 22 bp, Artificial Sequence
  chemically synthesized
gacaggcgacttacagtcacac

SEQ ID NO: 668228 - DNA, 22 bp, Artificial Sequence
  chemically synthesized
acaggcgacttacagtcacaca

SEQ ID NO: 668229 - DNA, 22 bp, Artificial Sequence
  chemically synthesized
cagcagccagagtggcctgtgt

SEQ ID NO: 668230 - DNA, 22 bp, Artificial Sequence
  chemically synthesized
ttccagcagccagagtggcctg

SEQ ID NO: 668231 - DNA, 22 bp, Artificial Sequence
  chemically synthesized
attccagcagccagagtggcct

SEQ ID NO: 668232 - DNA, 22 bp, Artificial Sequence
  chemically synthesized
acagtcacacaggccactctgg

SEQ ID NO: 668233 - DNA, 22 bp, Artificial Sequence
  chemically synthesized
cagtcacacaggccactctggc

SEQ ID NO: 668234 - DNA, 22 bp, Artificial Sequence
  chemically synthesized
tttattccagcagccagagtgg

SEQ ID NO: 668235 - DNA, 22 bp, Artificial Sequence
  chemically synthesized
tggctgctggaataaacaatac

SEQ ID NO: 668236 - DNA, 22 bp, Artificial Sequence
  chemically synthesized
gctgctggaataaacaatacta

SEQ ID NO: 668237 - DNA, 22 bp, Artificial Sequence
  chemically synthesized
ctggaataaacaatactattct

SEQ ID NO: 668238 - DNA, 22 bp, Artificial Sequence
  chemically synthesized
agccaaaggaggagaatagtat

SEQ ID NO: 668239 - DNA, 22 bp, Artificial Sequence
  chemically synthesized
tgagccaaaggaggagaatagt

SEQ ID NO: 668240 - DNA, 22 bp, Artificial Sequence
  chemically synthesized
gaataaacaatactattctcct

SEQ ID NO: 668241 - DNA, 22 bp, Artificial Sequence
  chemically synthesized
aaggttctgagccaaaggagga

SEQ ID NO: 668242 - DNA, 22 bp, Artificial Sequence
  chemically synthesized
ttctcctcctttggctcagaac

SEQ ID NO: 668243 - DNA, 22 bp, Artificial Sequence
  chemically synthesized
tcctcctttggctcagaacctt

SEQ ID NO: 668244 - DNA, 22 bp, Artificial Sequence
  chemically synthesized
ctcctttggctcagaaccttca

SEQ ID NO: 668245 - DNA, 22 bp, Artificial Sequence
  chemically synthesized
ctttggctcagaaccttcagtc

SEQ ID NO: 668246 - DNA, 22 bp, Artificial Sequence
  chemically synthesized
tggctcagaaccttcagtcact

SEQ ID NO: 668247 - DNA, 22 bp, Artificial Sequence
  chemically synthesized
ggctcagaaccttcagtcactg

SEQ ID NO: 668248 - DNA, 22 bp, Artificial Sequence
  chemically synthesized
gctcagaaccttcagtcactgc

SEQ ID NO: 668249 - DNA, 22 bp, Artificial Sequence
  chemically synthesized
agaaccttcagtcactgctctc

SEQ ID NO: 668250 - DNA, 22 bp, Artificial Sequence
  chemically synthesized
agaaaaacaggagagagcagtg

SEQ ID NO: 668251 - DNA, 22 bp, Artificial Sequence
  chemically synthesized
tgactgagaaaaacaggagaga

SEQ ID NO: 668252 - DNA, 22 bp, Artificial Sequence
  chemically synthesized
cagtcactgctctctcctgttt

SEQ ID NO: 668253 - DNA, 22 bp, Artificial Sequence
  chemically synthesized
agtcactgctctctcctgtttt

SEQ ID NO: 668254 - DNA, 22 bp, Artificial Sequence
  chemically synthesized
cccatgttgtgactgagaaaaa

SEQ ID NO: 668255 - DNA, 22 bp, Artificial Sequence
  chemically synthesized
ctctctcctgtttttctcagtc

SEQ ID NO: 668256 - DNA, 22 bp, Artificial Sequence
  chemically synthesized
tctcctgtttttctcagtcaca

SEQ ID NO: 668257 - DNA, 22 bp, Artificial Sequence
  chemically synthesized
agttacccatgttgtgactgag

SEQ ID NO: 668258 - DNA, 22 bp, Artificial Sequence
  chemically synthesized
tcctgtttttctcagtcacaac

SEQ ID NO: 668259 - DNA, 22 bp, Artificial Sequence
  chemically synthesized
ctgtttttctcagtcacaacat

SEQ ID NO: 668260 - DNA, 22 bp, Artificial Sequence
  chemically synthesized
tttttctcagtcacaacatggg

SEQ ID NO: 668261 - DNA, 22 bp, Artificial Sequence
  chemically synthesized
ttctcagtcacaacatgggtaa

SEQ ID NO: 668262 - DNA, 22 bp, Artificial Sequence
  chemically synthesized
taagtagctgagttacccatgt

SEQ ID NO: 668263 - DNA, 22 bp, Artificial Sequence
  chemically synthesized
tctcagtcacaacatgggtaac

SEQ ID NO: 668264 - DNA, 22 bp, Artificial Sequence
  chemically synthesized
ctcagtcacaacatgggtaact

SEQ ID NO: 668265 - DNA, 22 bp, Artificial Sequence
  chemically synthesized
tgtaagtagctgagttacccat

SEQ ID NO: 668266 - DNA, 22 bp, Artificial Sequence
  chemically synthesized
tcagtcacaacatgggtaactc

SEQ ID NO: 668267 - DNA, 22 bp, Artificial Sequence
  chemically synthesized
agtcacaacatgggtaactcag

SEQ ID NO: 668268 - DNA, 22 bp, Artificial Sequence
  chemically synthesized
agagttctgtaagtagctgagt

SEQ ID NO: 668269 - DNA, 22 bp, Artificial Sequence
  chemically synthesized
tgagagttctgtaagtagctga

SEQ ID NO: 668270 - DNA, 22 bp, Artificial Sequence
  chemically synthesized
tgtcattctgagagttctgtaa

SEQ ID NO: 668271 - DNA, 22 bp, Artificial Sequence
  chemically synthesized
gtgtcattctgagagttctgta

SEQ ID NO: 668272 - DNA, 22 bp, Artificial Sequence
  chemically synthesized
agctacttacagaactctcaga

SEQ ID NO: 668273 - DNA, 22 bp, Artificial Sequence
  chemically synthesized
taagtttgtgtcattctgagag

SEQ ID NO: 668274 - DNA, 22 bp, Artificial Sequence
  chemically synthesized
ataagtttgtgtcattctgaga

SEQ ID NO: 668275 - DNA, 22 bp, Artificial Sequence
  chemically synthesized
cttacagaactctcagaatgac

SEQ ID NO: 668276 - DNA, 22 bp, Artificial Sequence
  chemically synthesized
acagaactctcagaatgacaca

SEQ ID NO: 668277 - DNA, 22 bp, Artificial Sequence
  chemically synthesized
cagaactctcagaatgacacaa

SEQ ID NO: 668278 - DNA, 22 bp, Artificial Sequence
  chemically synthesized
gggtaaatttataagtttgtgt

SEQ ID NO: 668279 - DNA, 22 bp, Artificial Sequence
  chemically synthesized
tcagaatgacacaaacttataa

SEQ ID NO: 668280 - DNA, 22 bp, Artificial Sequence
  chemically synthesized
agaatgacacaaacttataaat

SEQ ID NO: 668281 - DNA, 22 bp, Artificial Sequence
  chemically synthesized
aaggagattggggtaaatttat

SEQ ID NO: 668282 - DNA, 22 bp, Artificial Sequence
  chemically synthesized
ataaatttaccccaatctcctt

SEQ ID NO: 668283 - DNA, 22 bp, Artificial Sequence
  chemically synthesized
agaatagagttgaaggagattg

SEQ ID NO: 668284 - DNA, 22 bp, Artificial Sequence
  chemically synthesized
taaatttaccccaatctccttc

SEQ ID NO: 668285 - DNA, 22 bp, Artificial Sequence
  chemically synthesized
accccaatctccttcaactcta

SEQ ID NO: 668286 - DNA, 22 bp, Artificial Sequence
  chemically synthesized
ccccaatctccttcaactctat

SEQ ID NO: 668287 - DNA, 22 bp, Artificial Sequence
  chemically synthesized
atgaggttgagaatagagttga

SEQ ID NO: 668288 - DNA, 22 bp, Artificial Sequence
  chemically synthesized
attaatgaggttgagaatagag

SEQ ID NO: 668289 - DNA, 22 bp, Artificial Sequence
  chemically synthesized
gttaattaatgaggttgagaat

SEQ ID NO: 668290 - DNA, 22 bp, Artificial Sequence
  chemically synthesized
cttcaactctattctcaacctc

SEQ ID NO: 668291 - DNA, 22 bp, Artificial Sequence
  chemically synthesized
caactctattctcaacctcatt

SEQ ID NO: 668292 - DNA, 22 bp, Artificial Sequence
  chemically synthesized
aactctattctcaacctcatta

SEQ ID NO: 668293 - DNA, 22 bp, Artificial Sequence
  chemically synthesized
agattcgttaattaatgaggtt

SEQ ID NO: 668294 - DNA, 22 bp, Artificial Sequence
  chemically synthesized
ttaagattcgttaattaatgag

SEQ ID NO: 668295 - DNA, 22 bp, Artificial Sequence
  chemically synthesized
tattctcaacctcattaattaa

SEQ ID NO: 668296 - DNA, 22 bp, Artificial Sequence
  chemically synthesized
ttctcaacctcattaattaacg

SEQ ID NO: 668297 - DNA, 22 bp, Artificial Sequence
  chemically synthesized
tcaacctcattaattaacgaat

SEQ ID NO: 668298 - DNA, 22 bp, Artificial Sequence
  chemically synthesized
aacctcattaattaacgaatct

SEQ ID NO: 668299 - DNA, 22 bp, Artificial Sequence
  chemically synthesized
tgaagagagactgttaagattc

SEQ ID NO: 668300 - DNA, 22 bp, Artificial Sequence
  chemically synthesized
atgaagagagactgttaagatt

SEQ ID NO: 668301 - DNA, 22 bp, Artificial Sequence
  chemically synthesized
attaattaacgaatcttaacag

SEQ ID NO: 668302 - DNA, 22 bp, Artificial Sequence
  chemically synthesized
acttatgaagagagactgttaa

SEQ ID NO: 668303 - DNA, 22 bp, Artificial Sequence
  chemically synthesized
attaacgaatcttaacagtctc

SEQ ID NO: 668304 - DNA, 22 bp, Artificial Sequence
  chemically synthesized
acgaatcttaacagtctctctt

SEQ ID NO: 668305 - DNA, 22 bp, Artificial Sequence
  chemically synthesized
ggatgtgtgttcacttatgaag

SEQ ID NO: 668306 - DNA, 22 bp, Artificial Sequence
  chemically synthesized
aacagtctctcttcataagtga

SEQ ID NO: 668307 - DNA, 22 bp, Artificial Sequence
  chemically synthesized
acagtctctcttcataagtgaa

SEQ ID NO: 668308 - DNA, 22 bp, Artificial Sequence
  chemically synthesized
gcgaatctgggatgtgtgttca

SEQ ID NO: 668309 - DNA, 22 bp, Artificial Sequence
  chemically synthesized
tcttcataagtgaacacacatc

SEQ ID NO: 668310 - DNA, 22 bp, Artificial Sequence
  chemically synthesized
ttcataagtgaacacacatccc

SEQ ID NO: 668311 - DNA, 22 bp, Artificial Sequence
  chemically synthesized
ccctggcgaatctgggatgtgt

SEQ ID NO: 668312 - DNA, 22 bp, Artificial Sequence
  chemically synthesized
cataagtgaacacacatcccag

SEQ ID NO: 668313 - DNA, 22 bp, Artificial Sequence
  chemically synthesized
ataagtgaacacacatcccaga

SEQ ID NO: 668314 - DNA, 22 bp, Artificial Sequence
  chemically synthesized
tgccctggcgaatctgggatgt

SEQ ID NO: 668315 - DNA, 22 bp, Artificial Sequence
  chemically synthesized
gctctgccctggcgaatctggg

SEQ ID NO: 668316 - DNA, 22 bp, Artificial Sequence
  chemically synthesized
aactggctctgccctggcgaat

SEQ ID NO: 668317 - DNA, 22 bp, Artificial Sequence
  chemically synthesized
attaaactggctctgccctggc

SEQ ID NO: 668318 - DNA, 22 bp, Artificial Sequence
  chemically synthesized
aattaaactggctctgccctgg

SEQ ID NO: 668319 - DNA, 22 bp, Artificial Sequence
  chemically synthesized
gccagggcagagccagtttaat

SEQ ID NO: 668320 - DNA, 22 bp, Artificial Sequence
  chemically synthesized
taacaaagaggaaaatttaatt

SEQ ID NO: 668321 - DNA, 22 bp, Artificial Sequence
  chemically synthesized
ataacaaagaggaaaatttaat

SEQ ID NO: 668322 - DNA, 22 bp, Artificial Sequence
  chemically synthesized
tataacaaagaggaaaatttaa

SEQ ID NO: 668323 - DNA, 22 bp, Artificial Sequence
  chemically synthesized
ttataacaaagaggaaaattta

SEQ ID NO: 668324 - DNA, 22 bp, Artificial Sequence
  chemically synthesized
ccttttataacaaagaggaaaa

SEQ ID NO: 668325 - DNA, 22 bp, Artificial Sequence
  chemically synthesized
accttttataacaaagaggaaa

SEQ ID NO: 668326 - DNA, 22 bp, Artificial Sequence
  chemically synthesized
aattaaattttcctctttgtta

SEQ ID NO: 668327 - DNA, 22 bp, Artificial Sequence
  chemically synthesized
attaaattttcctctttgttat

SEQ ID NO: 668328 - DNA, 22 bp, Artificial Sequence
  chemically synthesized
gagtcttaccttttataacaaa

SEQ ID NO: 668329 - DNA, 22 bp, Artificial Sequence
  chemically synthesized
agagtcttaccttttataacaa

SEQ ID NO: 668330 - DNA, 22 bp, Artificial Sequence
  chemically synthesized
aattttcctctttgttataaaa

SEQ ID NO: 668331 - DNA, 22 bp, Artificial Sequence
  chemically synthesized
tagagtcttaccttttataaca

SEQ ID NO: 668332 - DNA, 22 bp, Artificial Sequence
  chemically synthesized
ttagagtcttaccttttataac

SEQ ID NO: 668333 - DNA, 22 bp, Artificial Sequence
  chemically synthesized
tcctctttgttataaaaggtaa

SEQ ID NO: 668334 - DNA, 22 bp, Artificial Sequence
  chemically synthesized
cctctttgttataaaaggtaag

SEQ ID NO: 668335 - DNA, 22 bp, Artificial Sequence
  chemically synthesized
ctctttgttataaaaggtaaga

SEQ ID NO: 668336 - DNA, 22 bp, Artificial Sequence
  chemically synthesized
atcatttttagagtcttacctt

SEQ ID NO: 668337 - DNA, 22 bp, Artificial Sequence
  chemically synthesized
tttgttataaaaggtaagactc

SEQ ID NO: 668338 - DNA, 22 bp, Artificial Sequence
  chemically synthesized
tgttataaaaggtaagactcta

SEQ ID NO: 668339 - DNA, 22 bp, Artificial Sequence
  chemically synthesized
gttataaaaggtaagactctaa

SEQ ID NO: 668340 - DNA, 22 bp, Artificial Sequence
  chemically synthesized
ttataaaaggtaagactctaaa

SEQ ID NO: 668341 - DNA, 22 bp, Artificial Sequence
  chemically synthesized
taaaaggtaagactctaaaaat

SEQ ID NO: 668342 - DNA, 22 bp, Artificial Sequence
  chemically synthesized
agtcacatctgatcatttttag

SEQ ID NO: 668343 - DNA, 22 bp, Artificial Sequence
  chemically synthesized
taaaaatgatcagatgtgactt

SEQ ID NO: 668344 - DNA, 22 bp, Artificial Sequence
  chemically synthesized
aaaatgatcagatgtgacttaa

SEQ ID NO: 668345 - DNA, 22 bp, Artificial Sequence
  chemically synthesized
caaaggtataagaattaagtca

SEQ ID NO: 668346 - DNA, 22 bp, Artificial Sequence
  chemically synthesized
gcaaaggtataagaattaagtc

SEQ ID NO: 668347 - DNA, 22 bp, Artificial Sequence
  chemically synthesized
tgcaaaggtataagaattaagt

SEQ ID NO: 668348 - DNA, 22 bp, Artificial Sequence
  chemically synthesized
gctttgcaaaggtataagaatt

SEQ ID NO: 668349 - DNA, 22 bp, Artificial Sequence
  chemically synthesized
ggctttgcaaaggtataagaat

SEQ ID NO: 668350 - DNA, 22 bp, Artificial Sequence
  chemically synthesized
tgaatttggctttgcaaaggta

SEQ ID NO: 668351 - DNA, 22 bp, Artificial Sequence
  chemically synthesized
aattcttatacctttgcaaagc

SEQ ID NO: 668352 - DNA, 22 bp, Artificial Sequence
  chemically synthesized
attcttatacctttgcaaagcc

SEQ ID NO: 668353 - DNA, 22 bp, Artificial Sequence
  chemically synthesized
ttatacctttgcaaagccaaat

SEQ ID NO: 668354 - DNA, 22 bp, Artificial Sequence
  chemically synthesized
atacctttgcaaagccaaattc

SEQ ID NO: 668355 - DNA, 22 bp, Artificial Sequence
  chemically synthesized
tacctttgcaaagccaaattca

SEQ ID NO: 668356 - DNA, 22 bp, Artificial Sequence
  chemically synthesized
aaaaaaaaaatctgtgaatttg

SEQ ID NO: 668357 - DNA, 22 bp, Artificial Sequence
  chemically synthesized
tgcaaagccaaattcacagatt

SEQ ID NO: 668358 - DNA, 22 bp, Artificial Sequence
  chemically synthesized
gcaaagccaaattcacagattt

SEQ ID NO: 668359 - DNA, 22 bp, Artificial Sequence
  chemically synthesized
caaagccaaattcacagatttt

SEQ ID NO: 668360 - DNA, 22 bp, Artificial Sequence
  chemically synthesized
aggcacaacattaaaaaaaaaa

SEQ ID NO: 668361 - DNA, 22 bp, Artificial Sequence
  chemically synthesized
acagatttttttttttaatgtt

SEQ ID NO: 668362 - DNA, 22 bp, Artificial Sequence
  chemically synthesized
ttttttttaatgttgtgcctta

SEQ ID NO: 668363 - DNA, 22 bp, Artificial Sequence
  chemically synthesized
tttttttaatgttgtgccttag

SEQ ID NO: 668364 - DNA, 22 bp, Artificial Sequence
  chemically synthesized
ttttttaatgttgtgccttagc

SEQ ID NO: 668365 - DNA, 22 bp, Artificial Sequence
  chemically synthesized
caatccaaaaaagctaaggcac

SEQ ID NO: 668366 - DNA, 22 bp, Artificial Sequence
  chemically synthesized
tttttaatgttgtgccttagct

SEQ ID NO: 668367 - DNA, 22 bp, Artificial Sequence
  chemically synthesized
gcaatccaaaaaagctaaggca

SEQ ID NO: 668368 - DNA, 22 bp, Artificial Sequence
  chemically synthesized
ttttaatgttgtgccttagctt

SEQ ID NO: 668369 - DNA, 22 bp, Artificial Sequence
  chemically synthesized
tgcaatccaaaaaagctaaggc

SEQ ID NO: 668370 - DNA, 22 bp, Artificial Sequence
  chemically synthesized
tttaatgttgtgccttagcttt

SEQ ID NO: 668371 - DNA, 22 bp, Artificial Sequence
  chemically synthesized
ttgcaatccaaaaaagctaagg

SEQ ID NO: 668372 - DNA, 22 bp, Artificial Sequence
  chemically synthesized
ttaatgttgtgccttagctttt

SEQ ID NO: 668373 - DNA, 22 bp, Artificial Sequence
  chemically synthesized
taatgttgtgccttagcttttt

SEQ ID NO: 668374 - DNA, 22 bp, Artificial Sequence
  chemically synthesized
aatgttgtgccttagctttttt

SEQ ID NO: 668375 - DNA, 22 bp, Artificial Sequence
  chemically synthesized
atgttgtgccttagcttttttg

SEQ ID NO: 668376 - DNA, 22 bp, Artificial Sequence
  chemically synthesized
tgccttagcttttttggattgc

SEQ ID NO: 668377 - DNA, 22 bp, Artificial Sequence
  chemically synthesized
tgaagagtatgtttttgcaatc

SEQ ID NO: 668378 - DNA, 22 bp, Artificial Sequence
  chemically synthesized
agcttttttggattgcaaaaac

SEQ ID NO: 668379 - DNA, 22 bp, Artificial Sequence
  chemically synthesized
gcttttttggattgcaaaaaca

SEQ ID NO: 668380 - DNA, 22 bp, Artificial Sequence
  chemically synthesized
ttttggattgcaaaaacatact

SEQ ID NO: 668381 - DNA, 22 bp, Artificial Sequence
  chemically synthesized
tttggattgcaaaaacatactc

SEQ ID NO: 668382 - DNA, 22 bp, Artificial Sequence
  chemically synthesized
ttggattgcaaaaacatactct

SEQ ID NO: 668383 - DNA, 22 bp, Artificial Sequence
  chemically synthesized
tggattgcaaaaacatactctt

SEQ ID NO: 668384 - DNA, 22 bp, Artificial Sequence
  chemically synthesized
ggattgcaaaaacatactcttc

SEQ ID NO: 668385 - DNA, 22 bp, Artificial Sequence
  chemically synthesized
gattgcaaaaacatactcttca

SEQ ID NO: 668386 - DNA, 22 bp, Artificial Sequence
  chemically synthesized
caaaaacatactcttcataata

SEQ ID NO: 668387 - DNA, 22 bp, Artificial Sequence
  chemically synthesized
aaaataggtaatgtcaaccata

SEQ ID NO: 668388 - DNA, 22 bp, Artificial Sequence
  chemically synthesized
ttcataatatggttgacattac

SEQ ID NO: 668389 - DNA, 22 bp, Artificial Sequence
  chemically synthesized
cataatatggttgacattacct

SEQ ID NO: 668390 - DNA, 22 bp, Artificial Sequence
  chemically synthesized
ataatatggttgacattaccta

SEQ ID NO: 668391 - DNA, 22 bp, Artificial Sequence
  chemically synthesized
acattacctattttgaatttat

SEQ ID NO: 668392 - DNA, 22 bp, Artificial Sequence
  chemically synthesized
taagagagagtgataaattcaa

SEQ ID NO: 668393 - DNA, 22 bp, Artificial Sequence
  chemically synthesized
aactgtaagagagagtgataaa

SEQ ID NO: 668394 - DNA, 22 bp, Artificial Sequence
  chemically synthesized
cctattttgaatttatcactct

SEQ ID NO: 668395 - DNA, 22 bp, Artificial Sequence
  chemically synthesized
caactgtaagagagagtgataa

SEQ ID NO: 668396 - DNA, 22 bp, Artificial Sequence
  chemically synthesized
tcaactgtaagagagagtgata

SEQ ID NO: 668397 - DNA, 22 bp, Artificial Sequence
  chemically synthesized
ttcaactgtaagagagagtgat

SEQ ID NO: 668398 - DNA, 22 bp, Artificial Sequence
  chemically synthesized
ttttgaatttatcactctctct

SEQ ID NO: 668399 - DNA, 22 bp, Artificial Sequence
  chemically synthesized
tgaatttatcactctctcttac

SEQ ID NO: 668400 - DNA, 22 bp, Artificial Sequence
  chemically synthesized
gaatttatcactctctcttaca

SEQ ID NO: 668401 - DNA, 22 bp, Artificial Sequence
  chemically synthesized
aatttatcactctctcttacag

SEQ ID NO: 668402 - DNA, 22 bp, Artificial Sequence
  chemically synthesized
cacaaatttttcaactgtaaga

SEQ ID NO: 668403 - DNA, 22 bp, Artificial Sequence
  chemically synthesized
ccacaaatttttcaactgtaag

SEQ ID NO: 668404 - DNA, 22 bp, Artificial Sequence
  chemically synthesized
tccacaaatttttcaactgtaa

SEQ ID NO: 668405 - DNA, 22 bp, Artificial Sequence
  chemically synthesized
atcactctctcttacagttgaa

SEQ ID NO: 668406 - DNA, 22 bp, Artificial Sequence
  chemically synthesized
tcactctctcttacagttgaaa

SEQ ID NO: 668407 - DNA, 22 bp, Artificial Sequence
  chemically synthesized
tctcttacagttgaaaaatttg

SEQ ID NO: 668408 - DNA, 22 bp, Artificial Sequence
  chemically synthesized
tcttacagttgaaaaatttgtg

SEQ ID NO: 668409 - DNA, 22 bp, Artificial Sequence
  chemically synthesized
aaatacgctttccacaaatttt

SEQ ID NO: 668410 - DNA, 22 bp, Artificial Sequence
  chemically synthesized
ttacagttgaaaaatttgtgga

SEQ ID NO: 668411 - DNA, 22 bp, Artificial Sequence
  chemically synthesized
acagttgaaaaatttgtggaaa

SEQ ID NO: 668412 - DNA, 22 bp, Artificial Sequence
  chemically synthesized
cagttgaaaaatttgtggaaag

SEQ ID NO: 668413 - DNA, 22 bp, Artificial Sequence
  chemically synthesized
atcattaaaatacgctttccac

SEQ ID NO: 668414 - DNA, 22 bp, Artificial Sequence
  chemically synthesized
catcattaaaatacgctttcca

SEQ ID NO: 668415 - DNA, 22 bp, Artificial Sequence
  chemically synthesized
tcatcattaaaatacgctttcc

SEQ ID NO: 668416 - DNA, 22 bp, Artificial Sequence
  chemically synthesized
aaaaatttgtggaaagcgtatt

SEQ ID NO: 668417 - DNA, 22 bp, Artificial Sequence
  chemically synthesized
ttttcatcattaaaatacgctt

SEQ ID NO: 668418 - DNA, 22 bp, Artificial Sequence
  chemically synthesized
attttcatcattaaaatacgct

SEQ ID NO: 668419 - DNA, 22 bp, Artificial Sequence
  chemically synthesized
tttattttcatcattaaaatac

SEQ ID NO: 668420 - DNA, 22 bp, Artificial Sequence
  chemically synthesized
gtggaaagcgtattttaatgat

SEQ ID NO: 668421 - DNA, 22 bp, Artificial Sequence
  chemically synthesized
ttatttattttcatcattaaaa

SEQ ID NO: 668422 - DNA, 22 bp, Artificial Sequence
  chemically synthesized
tggaaagcgtattttaatgatg

SEQ ID NO: 668423 - DNA, 22 bp, Artificial Sequence
  chemically synthesized
ctgttatttattttcatcatta

SEQ ID NO: 668424 - DNA, 22 bp, Artificial Sequence
  chemically synthesized
actgttatttattttcatcatt

SEQ ID NO: 668425 - DNA, 22 bp, Artificial Sequence
  chemically synthesized
taatgatgaaaataaataacag

SEQ ID NO: 668426 - DNA, 22 bp, Artificial Sequence
  chemically synthesized
aatgatgaaaataaataacagt

SEQ ID NO: 668427 - DNA, 22 bp, Artificial Sequence
  chemically synthesized
atgatgaaaataaataacagta

SEQ ID NO: 668428 - DNA, 22 bp, Artificial Sequence
  chemically synthesized
aagcagatgaggaaatttactg

SEQ ID NO: 668429 - DNA, 22 bp, Artificial Sequence
  chemically synthesized
cctcatctgctttaacctcatc

SEQ ID NO: 668430 - DNA, 22 bp, Artificial Sequence
  chemically synthesized
ctcatctgctttaacctcatct

SEQ ID NO: 668431 - DNA, 22 bp, Artificial Sequence
  chemically synthesized
atctgctttaacctcatctttt

SEQ ID NO: 668432 - DNA, 22 bp, Artificial Sequence
  chemically synthesized
aaacaggaaggggcaaaagatg

SEQ ID NO: 668433 - DNA, 22 bp, Artificial Sequence
  chemically synthesized
aaaacaggaaggggcaaaagat

SEQ ID NO: 668434 - DNA, 22 bp, Artificial Sequence
  chemically synthesized
taaaacaggaaggggcaaaaga

SEQ ID NO: 668435 - DNA, 22 bp, Artificial Sequence
  chemically synthesized
ctttaacctcatcttttgcccc

SEQ ID NO: 668436 - DNA, 22 bp, Artificial Sequence
  chemically synthesized
ttaaaacaggaaggggcaaaag

SEQ ID NO: 668437 - DNA, 22 bp, Artificial Sequence
  chemically synthesized
tttaaaacaggaaggggcaaaa

SEQ ID NO: 668438 - DNA, 22 bp, Artificial Sequence
  chemically synthesized
taacctcatcttttgccccttc

SEQ ID NO: 668439 - DNA, 22 bp, Artificial Sequence
  chemically synthesized
aacctcatcttttgccccttcc

SEQ ID NO: 668440 - DNA, 22 bp, Artificial Sequence
  chemically synthesized
acctcatcttttgccccttcct

SEQ ID NO: 668441 - DNA, 22 bp, Artificial Sequence
  chemically synthesized
agactttttaaaacaggaaggg

SEQ ID NO: 668442 - DNA, 22 bp, Artificial Sequence
  chemically synthesized
atcttttgccccttcctgtttt

SEQ ID NO: 668443 - DNA, 22 bp, Artificial Sequence
  chemically synthesized
agttaagactttttaaaacagg

SEQ ID NO: 668444 - DNA, 22 bp, Artificial Sequence
  chemically synthesized
ttgccccttcctgttttaaaaa

SEQ ID NO: 668445 - DNA, 22 bp, Artificial Sequence
  chemically synthesized
tgccccttcctgttttaaaaag

SEQ ID NO: 668446 - DNA, 22 bp, Artificial Sequence
  chemically synthesized
gccccttcctgttttaaaaagt

SEQ ID NO: 668447 - DNA, 22 bp, Artificial Sequence
  chemically synthesized
ccccttcctgttttaaaaagtc

SEQ ID NO: 668448 - DNA, 22 bp, Artificial Sequence
  chemically synthesized
ggaaaattaagttaagactttt

SEQ ID NO: 668449 - DNA, 22 bp, Artificial Sequence
  chemically synthesized
aggaaaattaagttaagacttt

SEQ ID NO: 668450 - DNA, 22 bp, Artificial Sequence
  chemically synthesized
taggaaaattaagttaagactt

SEQ ID NO: 668451 - DNA, 22 bp, Artificial Sequence
  chemically synthesized
cctgttttaaaaagtcttaact

SEQ ID NO: 668452 - DNA, 22 bp, Artificial Sequence
  chemically synthesized
ctgttttaaaaagtcttaactt

SEQ ID NO: 668453 - DNA, 22 bp, Artificial Sequence
  chemically synthesized
ttttaaaaagtcttaacttaat

SEQ ID NO: 668454 - DNA, 22 bp, Artificial Sequence
  chemically synthesized
taaaaagtcttaacttaatttt

SEQ ID NO: 668455 - DNA, 22 bp, Artificial Sequence
  chemically synthesized
aaaaagtcttaacttaattttc

SEQ ID NO: 668456 - DNA, 22 bp, Artificial Sequence
  chemically synthesized
aaaagtcttaacttaattttcc

SEQ ID NO: 668457 - DNA, 22 bp, Artificial Sequence
  chemically synthesized
aacttaattttcctaaaggcta

SEQ ID NO: 668458 - DNA, 22 bp, Artificial Sequence
  chemically synthesized
acttaattttcctaaaggctac

SEQ ID NO: 668459 - DNA, 22 bp, Artificial Sequence
  chemically synthesized
aattttcctaaaggctaccttt

SEQ ID NO: 668460 - DNA, 22 bp, Artificial Sequence
  chemically synthesized
attttcctaaaggctacctttt

SEQ ID NO: 668461 - DNA, 22 bp, Artificial Sequence
  chemically synthesized
tcctaaaggctaccttttctac

SEQ ID NO: 668462 - DNA, 22 bp, Artificial Sequence
  chemically synthesized
cctaaaggctaccttttctacc

SEQ ID NO: 668463 - DNA, 22 bp, Artificial Sequence
  chemically synthesized
ctaaaggctaccttttctacct

SEQ ID NO: 668464 - DNA, 22 bp, Artificial Sequence
  chemically synthesized
aaggctaccttttctaccttgg

SEQ ID NO: 668465 - DNA, 22 bp, Artificial Sequence
  chemically synthesized
ccttttctaccttggccttacc

SEQ ID NO: 668466 - DNA, 22 bp, Artificial Sequence
  chemically synthesized
ttctaccttggccttaccgccg

SEQ ID NO: 668467 - DNA, 22 bp, Artificial Sequence
  chemically synthesized
tctaccttggccttaccgccgt

SEQ ID NO: 668468 - DNA, 22 bp, Artificial Sequence
  chemically synthesized
ctaccttggccttaccgccgtc

SEQ ID NO: 668469 - DNA, 22 bp, Artificial Sequence
  chemically synthesized
taccttggccttaccgccgtct

SEQ ID NO: 668470 - DNA, 22 bp, Artificial Sequence
  chemically synthesized
ccttggccttaccgccgtctcg

SEQ ID NO: 668471 - DNA, 22 bp, Artificial Sequence
  chemically synthesized
ggccttaccgccgtctcggctt

SEQ ID NO: 668472 - DNA, 22 bp, Artificial Sequence
  chemically synthesized
gccttaccgccgtctcggctta

SEQ ID NO: 668473 - DNA, 22 bp, Artificial Sequence
  chemically synthesized
accgccgtctcggcttacttat

SEQ ID NO: 668474 - DNA, 22 bp, Artificial Sequence
  chemically synthesized
ccgccgtctcggcttacttatt

SEQ ID NO: 668475 - DNA, 22 bp, Artificial Sequence
  chemically synthesized
ggagataagggcagagaaataa

SEQ ID NO: 668476 - DNA, 22 bp, Artificial Sequence
  chemically synthesized
gggagataagggcagagaaata

SEQ ID NO: 668477 - DNA, 22 bp, Artificial Sequence
  chemically synthesized
ggcttacttatttctctgccct

SEQ ID NO: 668478 - DNA, 22 bp, Artificial Sequence
  chemically synthesized
aaatcttgggagataagggcag

SEQ ID NO: 668479 - DNA, 22 bp, Artificial Sequence
  chemically synthesized
acttatttctctgcccttatct

SEQ ID NO: 668480 - DNA, 22 bp, Artificial Sequence
  chemically synthesized
cttatttctctgcccttatctc

SEQ ID NO: 668481 - DNA, 22 bp, Artificial Sequence
  chemically synthesized
atttctctgcccttatctccca

SEQ ID NO: 668482 - DNA, 22 bp, Artificial Sequence
  chemically synthesized
tttctctgcccttatctcccaa

SEQ ID NO: 668483 - DNA, 22 bp, Artificial Sequence
  chemically synthesized
ctctgcccttatctcccaagat

SEQ ID NO: 668484 - DNA, 22 bp, Artificial Sequence
  chemically synthesized
tctgcccttatctcccaagatt

SEQ ID NO: 668485 - DNA, 22 bp, Artificial Sequence
  chemically synthesized
tgcccttatctcccaagatttc

SEQ ID NO: 668486 - DNA, 22 bp, Artificial Sequence
  chemically synthesized
cccttatctcccaagatttcaa

SEQ ID NO: 668487 - DNA, 22 bp, Artificial Sequence
  chemically synthesized
ggagaaagatcatatgttgaaa

SEQ ID NO: 668488 - DNA, 22 bp, Artificial Sequence
  chemically synthesized
atctcccaagatttcaacatat

SEQ ID NO: 668489 - DNA, 22 bp, Artificial Sequence
  chemically synthesized
gggagaaagatcatatgttgaa

SEQ ID NO: 668490 - DNA, 22 bp, Artificial Sequence
  chemically synthesized
tctcccaagatttcaacatatg

SEQ ID NO: 668491 - DNA, 22 bp, Artificial Sequence
  chemically synthesized
tgggagaaagatcatatgttga

SEQ ID NO: 668492 - DNA, 22 bp, Artificial Sequence
  chemically synthesized
ccaagatttcaacatatgatct

SEQ ID NO: 668493 - DNA, 22 bp, Artificial Sequence
  chemically synthesized
aaatggagttttgggagaaaga

SEQ ID NO: 668494 - DNA, 22 bp, Artificial Sequence
  chemically synthesized
caacatatgatctttctcccaa

SEQ ID NO: 668495 - DNA, 22 bp, Artificial Sequence
  chemically synthesized
aacatatgatctttctcccaaa

SEQ ID NO: 668496 - DNA, 22 bp, Artificial Sequence
  chemically synthesized
ccagagaagtaattgaaatgga

SEQ ID NO: 668497 - DNA, 22 bp, Artificial Sequence
  chemically synthesized
tctcccaaaactccatttcaat

SEQ ID NO: 668498 - DNA, 22 bp, Artificial Sequence
  chemically synthesized
ctcccaaaactccatttcaatt

SEQ ID NO: 668499 - DNA, 22 bp, Artificial Sequence
  chemically synthesized
tcccaaaactccatttcaatta

SEQ ID NO: 668500 - DNA, 22 bp, Artificial Sequence
  chemically synthesized
ccaaaactccatttcaattact

SEQ ID NO: 668501 - DNA, 22 bp, Artificial Sequence
  chemically synthesized
tggttaccagagaagtaattga

SEQ ID NO: 668502 - DNA, 22 bp, Artificial Sequence
  chemically synthesized
gtctgtggttaccagagaagta

SEQ ID NO: 668503 - DNA, 22 bp, Artificial Sequence
  chemically synthesized
tggtctgtggttaccagagaag

SEQ ID NO: 668504 - DNA, 22 bp, Artificial Sequence
  chemically synthesized
catttcaattacttctctggta

SEQ ID NO: 668505 - DNA, 22 bp, Artificial Sequence
  chemically synthesized
caattacttctctggtaaccac

SEQ ID NO: 668506 - DNA, 22 bp, Artificial Sequence
  chemically synthesized
aattacttctctggtaaccaca

SEQ ID NO: 668507 - DNA, 22 bp, Artificial Sequence
  chemically synthesized
gtgacctctggtctgtggttac

SEQ ID NO: 668508 - DNA, 22 bp, Artificial Sequence
  chemically synthesized
cttctctggtaaccacagacca

SEQ ID NO: 668509 - DNA, 22 bp, Artificial Sequence
  chemically synthesized
ctctggtaaccacagaccagag

SEQ ID NO: 668510 - DNA, 22 bp, Artificial Sequence
  chemically synthesized
tctggtaaccacagaccagagg

SEQ ID NO: 668511 - DNA, 22 bp, Artificial Sequence
  chemically synthesized
aaccagttggtgacctctggtc

SEQ ID NO: 668512 - DNA, 22 bp, Artificial Sequence
  chemically synthesized
tggtaaccacagaccagaggtc

SEQ ID NO: 668513 - DNA, 22 bp, Artificial Sequence
  chemically synthesized
gtaaccacagaccagaggtcac

SEQ ID NO: 668514 - DNA, 22 bp, Artificial Sequence
  chemically synthesized
aattcaaccagttggtgacctc

SEQ ID NO: 668515 - DNA, 22 bp, Artificial Sequence
  chemically synthesized
cagactaaattcaaccagttgg

SEQ ID NO: 668516 - DNA, 22 bp, Artificial Sequence
  chemically synthesized
gttgaatttagtctgcagactc

SEQ ID NO: 668517 - DNA, 22 bp, Artificial Sequence
  chemically synthesized
aatttagtctgcagactctttt

SEQ ID NO: 668518 - DNA, 22 bp, Artificial Sequence
  chemically synthesized
agtctgcagactctttttttgt

SEQ ID NO: 668519 - DNA, 22 bp, Artificial Sequence
  chemically synthesized
gtctgcagactctttttttgtg

SEQ ID NO: 668520 - DNA, 22 bp, Artificial Sequence
  chemically synthesized
cagactctttttttgtgtgtgt

SEQ ID NO: 668521 - DNA, 22 bp, Artificial Sequence
  chemically synthesized
tttttttgtgtgtgtgtgtgtt

SEQ ID NO: 668522 - DNA, 22 bp, Artificial Sequence
  chemically synthesized
accaacgaatcaaacacacaca

SEQ ID NO: 668523 - DNA, 22 bp, Artificial Sequence
  chemically synthesized
tttttgtgtgtgtgtgtgtttg

SEQ ID NO: 668524 - DNA, 22 bp, Artificial Sequence
  chemically synthesized
ttttgtgtgtgtgtgtgtttga

SEQ ID NO: 668525 - DNA, 22 bp, Artificial Sequence
  chemically synthesized
tttgtgtgtgtgtgtgtttgat

SEQ ID NO: 668526 - DNA, 22 bp, Artificial Sequence
  chemically synthesized
ttgtgtgtgtgtgtgtttgatt

SEQ ID NO: 668527 - DNA, 22 bp, Artificial Sequence
  chemically synthesized
tgtgtgtgtgtgtgtttgattc

SEQ ID NO: 668528 - DNA, 22 bp, Artificial Sequence
  chemically synthesized
gtgtgtgtgtgtgtttgattcg

SEQ ID NO: 668529 - DNA, 22 bp, Artificial Sequence
  chemically synthesized
tgtgtgtgtgtgtttgattcgt

SEQ ID NO: 668530 - DNA, 22 bp, Artificial Sequence
  chemically synthesized
tgtgagcccaaactgaccaacg

SEQ ID NO: 668531 - DNA, 22 bp, Artificial Sequence
  chemically synthesized
gattcgttggtcagtttgggct

SEQ ID NO: 668532 - DNA, 22 bp, Artificial Sequence
  chemically synthesized
attcgttggtcagtttgggctc

SEQ ID NO: 668533 - DNA, 22 bp, Artificial Sequence
  chemically synthesized
aaaaaccattatgtgagcccaa

SEQ ID NO: 668534 - DNA, 22 bp, Artificial Sequence
  chemically synthesized
caaaaaccattatgtgagccca

SEQ ID NO: 668535 - DNA, 22 bp, Artificial Sequence
  chemically synthesized
gttggtcagtttgggctcacat

SEQ ID NO: 668536 - DNA, 22 bp, Artificial Sequence
  chemically synthesized
gtcagtttgggctcacataatg

SEQ ID NO: 668537 - DNA, 22 bp, Artificial Sequence
  chemically synthesized
aacaatttcaaaaaccattatg

SEQ ID NO: 668538 - DNA, 22 bp, Artificial Sequence
  chemically synthesized
gggctcacataatggtttttga

SEQ ID NO: 668539 - DNA, 22 bp, Artificial Sequence
  chemically synthesized
ggctcacataatggtttttgaa

SEQ ID NO: 668540 - DNA, 22 bp, Artificial Sequence
  chemically synthesized
acataatggtttttgaaattgt

SEQ ID NO: 668541 - DNA, 22 bp, Artificial Sequence
  chemically synthesized
atggcgtatcattcaacaattt

SEQ ID NO: 668542 - DNA, 22 bp, Artificial Sequence
  chemically synthesized
actaatggcgtatcattcaaca

SEQ ID NO: 668543 - DNA, 22 bp, Artificial Sequence
  chemically synthesized
aactaatggcgtatcattcaac

SEQ ID NO: 668544 - DNA, 22 bp, Artificial Sequence
  chemically synthesized
taactaatggcgtatcattcaa

SEQ ID NO: 668545 - DNA, 22 bp, Artificial Sequence
  chemically synthesized
ttaactaatggcgtatcattca

SEQ ID NO: 668546 - DNA, 22 bp, Artificial Sequence
  chemically synthesized
ttgaaattgttgaatgatacgc

SEQ ID NO: 668547 - DNA, 22 bp, Artificial Sequence
  chemically synthesized
tgaaattgttgaatgatacgcc

SEQ ID NO: 668548 - DNA, 22 bp, Artificial Sequence
  chemically synthesized
gaaattgttgaatgatacgcca

SEQ ID NO: 668549 - DNA, 22 bp, Artificial Sequence
  chemically synthesized
aaattgttgaatgatacgccat

SEQ ID NO: 668550 - DNA, 22 bp, Artificial Sequence
  chemically synthesized
ttgaatgatacgccattagtta

SEQ ID NO: 668551 - DNA, 22 bp, Artificial Sequence
  chemically synthesized
aatgatacgccattagttaaaa

SEQ ID NO: 668552 - DNA, 22 bp, Artificial Sequence
  chemically synthesized
gttaaaaatctggtgatttccc

SEQ ID NO: 668553 - DNA, 22 bp, Artificial Sequence
  chemically synthesized
aaaatctggtgatttcccgttg

SEQ ID NO: 668554 - DNA, 22 bp, Artificial Sequence
  chemically synthesized
cagagaagcaagacaacgggaa

SEQ ID NO: 668555 - DNA, 22 bp, Artificial Sequence
  chemically synthesized
ccagagaagcaagacaacggga

SEQ ID NO: 668556 - DNA, 22 bp, Artificial Sequence
  chemically synthesized
ttccagagaagcaagacaacgg

SEQ ID NO: 668557 - DNA, 22 bp, Artificial Sequence
  chemically synthesized
gtgatttcccgttgtcttgctt

SEQ ID NO: 668558 - DNA, 22 bp, Artificial Sequence
  chemically synthesized
aggttcttccagagaagcaaga

SEQ ID NO: 668559 - DNA, 22 bp, Artificial Sequence
  chemically synthesized
caggttcttccagagaagcaag

SEQ ID NO: 668560 - DNA, 22 bp, Artificial Sequence
  chemically synthesized
cccgttgtcttgcttctctgga

SEQ ID NO: 668561 - DNA, 22 bp, Artificial Sequence
  chemically synthesized
ccgttgtcttgcttctctggaa

SEQ ID NO: 668562 - DNA, 22 bp, Artificial Sequence
  chemically synthesized
tcaggtcttcaggttcttccag

SEQ ID NO: 668563 - DNA, 22 bp, Artificial Sequence
  chemically synthesized
tcttgcttctctggaagaacct

SEQ ID NO: 668564 - DNA, 22 bp, Artificial Sequence
  chemically synthesized
ttgtcaggtcttcaggttcttc

SEQ ID NO: 668565 - DNA, 22 bp, Artificial Sequence
  chemically synthesized
tattgtcaggtcttcaggttct

SEQ ID NO: 668566 - DNA, 22 bp, Artificial Sequence
  chemically synthesized
gcttctctggaagaacctgaag

SEQ ID NO: 668567 - DNA, 22 bp, Artificial Sequence
  chemically synthesized
cttctctggaagaacctgaaga

SEQ ID NO: 668568 - DNA, 22 bp, Artificial Sequence
  chemically synthesized
ctctggaagaacctgaagacct

SEQ ID NO: 668569 - DNA, 22 bp, Artificial Sequence
  chemically synthesized
tctggaagaacctgaagacctg

SEQ ID NO: 668570 - DNA, 22 bp, Artificial Sequence
  chemically synthesized
tggaagaacctgaagacctgac

SEQ ID NO: 668571 - DNA, 22 bp, Artificial Sequence
  chemically synthesized
gaagaacctgaagacctgacaa

SEQ ID NO: 668572 - DNA, 22 bp, Artificial Sequence
  chemically synthesized
tgagaatgtgagtctctattgt

SEQ ID NO: 668573 - DNA, 22 bp, Artificial Sequence
  chemically synthesized
tatgagaatgtgagtctctatt

SEQ ID NO: 668574 - DNA, 22 bp, Artificial Sequence
  chemically synthesized
aagacctgacaatagagactca

SEQ ID NO: 668575 - DNA, 22 bp, Artificial Sequence
  chemically synthesized
ttctatgagaatgtgagtctct

SEQ ID NO: 668576 - DNA, 22 bp, Artificial Sequence
  chemically synthesized
actgttctatgagaatgtgagt

SEQ ID NO: 668577 - DNA, 22 bp, Artificial Sequence
  chemically synthesized
acaatagagactcacattctca

SEQ ID NO: 668578 - DNA, 22 bp, Artificial Sequence
  chemically synthesized
cagctgactgttctatgagaat

SEQ ID NO: 668579 - DNA, 22 bp, Artificial Sequence
  chemically synthesized
cgttgcagctgactgttctatg

SEQ ID NO: 668580 - DNA, 22 bp, Artificial Sequence
  chemically synthesized
acattctcatagaacagtcagc

SEQ ID NO: 668581 - DNA, 22 bp, Artificial Sequence
  chemically synthesized
tcatagaacagtcagctgcaac

SEQ ID NO: 668582 - DNA, 22 bp, Artificial Sequence
  chemically synthesized
atagaacagtcagctgcaacgg

SEQ ID NO: 668583 - DNA, 22 bp, Artificial Sequence
  chemically synthesized
gggtaacagagcctccgttgca

SEQ ID NO: 668584 - DNA, 22 bp, Artificial Sequence
  chemically synthesized
ttagggtaacagagcctccgtt

SEQ ID NO: 668585 - DNA, 22 bp, Artificial Sequence
  chemically synthesized
tgttagggtaacagagcctccg

SEQ ID NO: 668586 - DNA, 22 bp, Artificial Sequence
  chemically synthesized
ctgttagggtaacagagcctcc

SEQ ID NO: 668587 - DNA, 22 bp, Artificial Sequence
  chemically synthesized
caacggaggctctgttacccta

SEQ ID NO: 668588 - DNA, 22 bp, Artificial Sequence
  chemically synthesized
aaaagcttctgttagggtaaca

SEQ ID NO: 668589 - DNA, 22 bp, Artificial Sequence
  chemically synthesized
gggcaacctgaaaagcttctgt

SEQ ID NO: 668590 - DNA, 22 bp, Artificial Sequence
  chemically synthesized
tgttaccctaacagaagctttt

SEQ ID NO: 668591 - DNA, 22 bp, Artificial Sequence
  chemically synthesized
ttaccctaacagaagcttttca

SEQ ID NO: 668592 - DNA, 22 bp, Artificial Sequence
  chemically synthesized
ccctaacagaagcttttcaggt

SEQ ID NO: 668593 - DNA, 22 bp, Artificial Sequence
  chemically synthesized
ggtgggaactggggcaacctga

SEQ ID NO: 668594 - DNA, 22 bp, Artificial Sequence
  chemically synthesized
acagaagcttttcaggttgccc

SEQ ID NO: 668595 - DNA, 22 bp, Artificial Sequence
  chemically synthesized
aaggtgactgggtgggaactgg

SEQ ID NO: 668596 - DNA, 22 bp, Artificial Sequence
  chemically synthesized
ttcaggttgccccagttcccac

SEQ ID NO: 668597 - DNA, 22 bp, Artificial Sequence
  chemically synthesized
tcaggttgccccagttcccacc

SEQ ID NO: 668598 - DNA, 22 bp, Artificial Sequence
  chemically synthesized
caggttgccccagttcccaccc

SEQ ID NO: 668599 - DNA, 22 bp, Artificial Sequence
  chemically synthesized
aggttgccccagttcccaccca

SEQ ID NO: 668600 - DNA, 22 bp, Artificial Sequence
  chemically synthesized
aatgactgaaggtgactgggtg

SEQ ID NO: 668601 - DNA, 22 bp, Artificial Sequence
  chemically synthesized
gaatgactgaaggtgactgggt

SEQ ID NO: 668602 - DNA, 22 bp, Artificial Sequence
  chemically synthesized
ccccagttcccacccagtcacc

SEQ ID NO: 668603 - DNA, 22 bp, Artificial Sequence
  chemically synthesized
gtaatttgaatgactgaaggtg

SEQ ID NO: 668604 - DNA, 22 bp, Artificial Sequence
  chemically synthesized
ccacccagtcaccttcagtcat

SEQ ID NO: 668605 - DNA, 22 bp, Artificial Sequence
  chemically synthesized
gggccaagctggtaatttgaat

SEQ ID NO: 668606 - DNA, 22 bp, Artificial Sequence
  chemically synthesized
ctggggccaagctggtaatttg

SEQ ID NO: 668607 - DNA, 22 bp, Artificial Sequence
  chemically synthesized
cagtcattcaaattaccagctt

SEQ ID NO: 668608 - DNA, 22 bp, Artificial Sequence
  chemically synthesized
agtcattcaaattaccagcttg

SEQ ID NO: 668609 - DNA, 22 bp, Artificial Sequence
  chemically synthesized
aaattaccagcttggccccagg

SEQ ID NO: 668610 - DNA, 22 bp, Artificial Sequence
  chemically synthesized
aaaagaaatgcctcctggggcc

SEQ ID NO: 668611 - DNA, 22 bp, Artificial Sequence
  chemically synthesized
ccagcttggccccaggaggcat

SEQ ID NO: 668612 - DNA, 22 bp, Artificial Sequence
  chemically synthesized
ggccccaggaggcatttctttt

SEQ ID NO: 668613 - DNA, 22 bp, Artificial Sequence
  chemically synthesized
gccccaggaggcatttcttttc

SEQ ID NO: 668614 - DNA, 22 bp, Artificial Sequence
  chemically synthesized
aggcaaagatctgaaaagaaat

SEQ ID NO: 668615 - DNA, 22 bp, Artificial Sequence
  chemically synthesized
cttttcagatctttgcctcagc

SEQ ID NO: 668616 - DNA, 22 bp, Artificial Sequence
  chemically synthesized
ttttcagatctttgcctcagcc

SEQ ID NO: 668617 - DNA, 22 bp, Artificial Sequence
  chemically synthesized
ttcagatctttgcctcagcctg

SEQ ID NO: 668618 - DNA, 22 bp, Artificial Sequence
  chemically synthesized
tcagatctttgcctcagcctga

SEQ ID NO: 668619 - DNA, 22 bp, Artificial Sequence
  chemically synthesized
cagatctttgcctcagcctgac

SEQ ID NO: 668620 - DNA, 22 bp, Artificial Sequence
  chemically synthesized
agatctttgcctcagcctgacc

SEQ ID NO: 668621 - DNA, 22 bp, Artificial Sequence
  chemically synthesized
ggagaacaagggagtggtcagg

SEQ ID NO: 668622 - DNA, 22 bp, Artificial Sequence
  chemically synthesized
gggagaacaagggagtggtcag

SEQ ID NO: 668623 - DNA, 22 bp, Artificial Sequence
  chemically synthesized
tgggagaacaagggagtggtca

SEQ ID NO: 668624 - DNA, 22 bp, Artificial Sequence
  chemically synthesized
ttgggagaacaagggagtggtc

SEQ ID NO: 668625 - DNA, 22 bp, Artificial Sequence
  chemically synthesized
tgcctcagcctgaccactccct

SEQ ID NO: 668626 - DNA, 22 bp, Artificial Sequence
  chemically synthesized
gcctcagcctgaccactccctt

SEQ ID NO: 668627 - DNA, 22 bp, Artificial Sequence
  chemically synthesized
cctcagcctgaccactcccttg

SEQ ID NO: 668628 - DNA, 22 bp, Artificial Sequence
  chemically synthesized
agcctgaccactcccttgttct

SEQ ID NO: 668629 - DNA, 22 bp, Artificial Sequence
  chemically synthesized
accactcccttgttctcccaaa

SEQ ID NO: 668630 - DNA, 22 bp, Artificial Sequence
  chemically synthesized
ccttgttctcccaaaagctttt

SEQ ID NO: 668631 - DNA, 22 bp, Artificial Sequence
  chemically synthesized
aagggtaaatgtaaaagctttt

SEQ ID NO: 668632 - DNA, 22 bp, Artificial Sequence
  chemically synthesized
gttctcccaaaagcttttacat

SEQ ID NO: 668633 - DNA, 22 bp, Artificial Sequence
  chemically synthesized
ttctcccaaaagcttttacatt

SEQ ID NO: 668634 - DNA, 22 bp, Artificial Sequence
  chemically synthesized
tcccaaaagcttttacatttac

SEQ ID NO: 668635 - DNA, 22 bp, Artificial Sequence
  chemically synthesized
ccaaaagcttttacatttaccc

SEQ ID NO: 668636 - DNA, 22 bp, Artificial Sequence
  chemically synthesized
aaaaagagtgtaactgaagggt

SEQ ID NO: 668637 - DNA, 22 bp, Artificial Sequence
  chemically synthesized
ttacatttacccttcagttaca

SEQ ID NO: 668638 - DNA, 22 bp, Artificial Sequence
  chemically synthesized
tacatttacccttcagttacac

SEQ ID NO: 668639 - DNA, 22 bp, Artificial Sequence
  chemically synthesized
acatttacccttcagttacact

SEQ ID NO: 668640 - DNA, 22 bp, Artificial Sequence
  chemically synthesized
catttacccttcagttacactc

SEQ ID NO: 668641 - DNA, 22 bp, Artificial Sequence
  chemically synthesized
acagggacctgaaaaagagtgt

SEQ ID NO: 668642 - DNA, 22 bp, Artificial Sequence
  chemically synthesized
acccttcagttacactcttttt

SEQ ID NO: 668643 - DNA, 22 bp, Artificial Sequence
  chemically synthesized
gacagggacctgaaaaagagtg

SEQ ID NO: 668644 - DNA, 22 bp, Artificial Sequence
  chemically synthesized
cccttcagttacactctttttc

SEQ ID NO: 668645 - DNA, 22 bp, Artificial Sequence
  chemically synthesized
cagttacactctttttcaggtc

SEQ ID NO: 668646 - DNA, 22 bp, Artificial Sequence
  chemically synthesized
agttacactctttttcaggtcc

SEQ ID NO: 668647 - DNA, 22 bp, Artificial Sequence
  chemically synthesized
cactctttttcaggtccctgtc

SEQ ID NO: 668648 - DNA, 22 bp, Artificial Sequence
  chemically synthesized
cacagtcagagccttgacaggg

SEQ ID NO: 668649 - DNA, 22 bp, Artificial Sequence
  chemically synthesized
tttttcaggtccctgtcaaggc

SEQ ID NO: 668650 - DNA, 22 bp, Artificial Sequence
  chemically synthesized
tttcaggtccctgtcaaggctc

SEQ ID NO: 668651 - DNA, 22 bp, Artificial Sequence
  chemically synthesized
ttcaggtccctgtcaaggctct

SEQ ID NO: 668652 - DNA, 22 bp, Artificial Sequence
  chemically synthesized
tcaggtccctgtcaaggctctg

SEQ ID NO: 668653 - DNA, 22 bp, Artificial Sequence
  chemically synthesized
caggtccctgtcaaggctctga

SEQ ID NO: 668654 - DNA, 22 bp, Artificial Sequence
  chemically synthesized
aggtccctgtcaaggctctgac

SEQ ID NO: 668655 - DNA, 22 bp, Artificial Sequence
  chemically synthesized
gagggactccacagtcagagcc

SEQ ID NO: 668656 - DNA, 22 bp, Artificial Sequence
  chemically synthesized
ttggagggactccacagtcaga

SEQ ID NO: 668657 - DNA, 22 bp, Artificial Sequence
  chemically synthesized
attggagggactccacagtcag

SEQ ID NO: 668658 - DNA, 22 bp, Artificial Sequence
  chemically synthesized
cttattggagggactccacagt

SEQ ID NO: 668659 - DNA, 22 bp, Artificial Sequence
  chemically synthesized
tcaaggctctgactgtggagtc

SEQ ID NO: 668660 - DNA, 22 bp, Artificial Sequence
  chemically synthesized
tgactgtggagtccctccaata

SEQ ID NO: 668661 - DNA, 22 bp, Artificial Sequence
  chemically synthesized
actgtggagtccctccaataag

SEQ ID NO: 668662 - DNA, 22 bp, Artificial Sequence
  chemically synthesized
tggagtccctccaataagtagc

SEQ ID NO: 668663 - DNA, 22 bp, Artificial Sequence
  chemically synthesized
agtgacagccaggtaatagcta

SEQ ID NO: 668664 - DNA, 22 bp, Artificial Sequence
  chemically synthesized
gagtgacagccaggtaatagct

SEQ ID NO: 668665 - DNA, 22 bp, Artificial Sequence
  chemically synthesized
caataagtagctattacctggc

SEQ ID NO: 668666 - DNA, 22 bp, Artificial Sequence
  chemically synthesized
catagagtaatttgagtgacag

SEQ ID NO: 668667 - DNA, 22 bp, Artificial Sequence
  chemically synthesized
ccatagagtaatttgagtgaca

SEQ ID NO: 668668 - DNA, 22 bp, Artificial Sequence
  chemically synthesized
ttacctggctgtcactcaaatt

SEQ ID NO: 668669 - DNA, 22 bp, Artificial Sequence
  chemically synthesized
tttccatagagtaatttgagtg

SEQ ID NO: 668670 - DNA, 22 bp, Artificial Sequence
  chemically synthesized
cctggctgtcactcaaattact

SEQ ID NO: 668671 - DNA, 22 bp, Artificial Sequence
  chemically synthesized
gctgtcactcaaattactctat

SEQ ID NO: 668672 - DNA, 22 bp, Artificial Sequence
  chemically synthesized
tcactcaaattactctatggaa

SEQ ID NO: 668673 - DNA, 22 bp, Artificial Sequence
  chemically synthesized
aaattactctatggaaacagtt

SEQ ID NO: 668674 - DNA, 22 bp, Artificial Sequence
  chemically synthesized
ggaaaacccagtaacaactgtt

SEQ ID NO: 668675 - DNA, 22 bp, Artificial Sequence
  chemically synthesized
gggaaaacccagtaacaactgt

SEQ ID NO: 668676 - DNA, 22 bp, Artificial Sequence
  chemically synthesized
tgggaaaacccagtaacaactg

SEQ ID NO: 668677 - DNA, 22 bp, Artificial Sequence
  chemically synthesized
ctctatggaaacagttgttact

SEQ ID NO: 668678 - DNA, 22 bp, Artificial Sequence
  chemically synthesized
tatggaaacagttgttactggg

SEQ ID NO: 668679 - DNA, 22 bp, Artificial Sequence
  chemically synthesized
tggaaacagttgttactgggtt

SEQ ID NO: 668680 - DNA, 22 bp, Artificial Sequence
  chemically synthesized
gaaagttttgggaaaacccagt

SEQ ID NO: 668681 - DNA, 22 bp, Artificial Sequence
  chemically synthesized
atcgctggaaagttttgggaaa

SEQ ID NO: 668682 - DNA, 22 bp, Artificial Sequence
  chemically synthesized
ttactgggttttcccaaaactt

SEQ ID NO: 668683 - DNA, 22 bp, Artificial Sequence
  chemically synthesized
ctgggttttcccaaaactttcc

SEQ ID NO: 668684 - DNA, 22 bp, Artificial Sequence
  chemically synthesized
ggttttcccaaaactttccagc

SEQ ID NO: 668685 - DNA, 22 bp, Artificial Sequence
  chemically synthesized
tcccaaaactttccagcgatta

SEQ ID NO: 668686 - DNA, 22 bp, Artificial Sequence
  chemically synthesized
cccaaaactttccagcgattaa

SEQ ID NO: 668687 - DNA, 22 bp, Artificial Sequence
  chemically synthesized
ccaaaactttccagcgattaat

SEQ ID NO: 668688 - DNA, 22 bp, Artificial Sequence
  chemically synthesized
tccagcgattaattctttggac

SEQ ID NO: 668689 - DNA, 22 bp, Artificial Sequence
  chemically synthesized
gtaaaaggtggagtccaaagaa

SEQ ID NO: 668690 - DNA, 22 bp, Artificial Sequence
  chemically synthesized
ccagcgattaattctttggact

SEQ ID NO: 668691 - DNA, 22 bp, Artificial Sequence
  chemically synthesized
cagcgattaattctttggactc

SEQ ID NO: 668692 - DNA, 22 bp, Artificial Sequence
  chemically synthesized
aatgcattagtaaaaggtggag

SEQ ID NO: 668693 - DNA, 22 bp, Artificial Sequence
  chemically synthesized
gaatgcattagtaaaaggtgga

SEQ ID NO: 668694 - DNA, 22 bp, Artificial Sequence
  chemically synthesized
attctttggactccacctttta

SEQ ID NO: 668695 - DNA, 22 bp, Artificial Sequence
  chemically synthesized
gtttgaatgcattagtaaaagg

SEQ ID NO: 668696 - DNA, 22 bp, Artificial Sequence
  chemically synthesized
tttggactccaccttttactaa

SEQ ID NO: 668697 - DNA, 22 bp, Artificial Sequence
  chemically synthesized
agtttgaatgcattagtaaaag

SEQ ID NO: 668698 - DNA, 22 bp, Artificial Sequence
  chemically synthesized
tggactccaccttttactaatg

SEQ ID NO: 668699 - DNA, 22 bp, Artificial Sequence
  chemically synthesized
ggactccaccttttactaatgc

SEQ ID NO: 668700 - DNA, 22 bp, Artificial Sequence
  chemically synthesized
gactccaccttttactaatgca

SEQ ID NO: 668701 - DNA, 22 bp, Artificial Sequence
  chemically synthesized
caccttttactaatgcattcaa

SEQ ID NO: 668702 - DNA, 22 bp, Artificial Sequence
  chemically synthesized
ttactaatgcattcaaactaaa

SEQ ID NO: 668703 - DNA, 22 bp, Artificial Sequence
  chemically synthesized
gcagcacaatcatttagtttga

SEQ ID NO: 668704 - DNA, 22 bp, Artificial Sequence
  chemically synthesized
tactaatgcattcaaactaaat

SEQ ID NO: 668705 - DNA, 22 bp, Artificial Sequence
  chemically synthesized
ggcagcacaatcatttagtttg

SEQ ID NO: 668706 - DNA, 22 bp, Artificial Sequence
  chemically synthesized
actaatgcattcaaactaaatg

SEQ ID NO: 668707 - DNA, 22 bp, Artificial Sequence
  chemically synthesized
tggcagcacaatcatttagttt

SEQ ID NO: 668708 - DNA, 22 bp, Artificial Sequence
  chemically synthesized
ctaatgcattcaaactaaatga

SEQ ID NO: 668709 - DNA, 22 bp, Artificial Sequence
  chemically synthesized
ttggcagcacaatcatttagtt

SEQ ID NO: 668710 - DNA, 22 bp, Artificial Sequence
  chemically synthesized
atgcattcaaactaaatgattg

SEQ ID NO: 668711 - DNA, 22 bp, Artificial Sequence
  chemically synthesized
aaactaaatgattgtgctgcca

SEQ ID NO: 668712 - DNA, 22 bp, Artificial Sequence
  chemically synthesized
aggcaatatttttggcagcaca

SEQ ID NO: 668713 - DNA, 22 bp, Artificial Sequence
  chemically synthesized
aatgattgtgctgccaaaaata

SEQ ID NO: 668714 - DNA, 22 bp, Artificial Sequence
  chemically synthesized
tgctgccaaaaatattgcctta

SEQ ID NO: 668715 - DNA, 22 bp, Artificial Sequence
  chemically synthesized
caacagtaagtgtattaaggca

SEQ ID NO: 668716 - DNA, 22 bp, Artificial Sequence
  chemically synthesized
ccaaaaatattgccttaataca

SEQ ID NO: 668717 - DNA, 22 bp, Artificial Sequence
  chemically synthesized
tactgcaacagtaagtgtatta

SEQ ID NO: 668718 - DNA, 22 bp, Artificial Sequence
  chemically synthesized
gtactgcaacagtaagtgtatt

SEQ ID NO: 668719 - DNA, 22 bp, Artificial Sequence
  chemically synthesized
ttgtactgcaacagtaagtgta

SEQ ID NO: 668720 - DNA, 22 bp, Artificial Sequence
  chemically synthesized
ttcttgtactgcaacagtaagt

SEQ ID NO: 668721 - DNA, 22 bp, Artificial Sequence
  chemically synthesized
ccttaatacacttactgttgca

SEQ ID NO: 668722 - DNA, 22 bp, Artificial Sequence
  chemically synthesized
cctgttcttgtactgcaacagt

SEQ ID NO: 668723 - DNA, 22 bp, Artificial Sequence
  chemically synthesized
aatacacttactgttgcagtac

SEQ ID NO: 668724 - DNA, 22 bp, Artificial Sequence
  chemically synthesized
ctacctgttcttgtactgcaac

SEQ ID NO: 668725 - DNA, 22 bp, Artificial Sequence
  chemically synthesized
atacacttactgttgcagtaca

SEQ ID NO: 668726 - DNA, 22 bp, Artificial Sequence
  chemically synthesized
cctacctgttcttgtactgcaa

SEQ ID NO: 668727 - DNA, 22 bp, Artificial Sequence
  chemically synthesized
tcttcctacctgttcttgtact

SEQ ID NO: 668728 - DNA, 22 bp, Artificial Sequence
  chemically synthesized
actgttgcagtacaagaacagg

SEQ ID NO: 668729 - DNA, 22 bp, Artificial Sequence
  chemically synthesized
ctgttgcagtacaagaacaggt

SEQ ID NO: 668730 - DNA, 22 bp, Artificial Sequence
  chemically synthesized
gcctgtcttcctacctgttctt

SEQ ID NO: 668731 - DNA, 22 bp, Artificial Sequence
  chemically synthesized
ggcctgtcttcctacctgttct

SEQ ID NO: 668732 - DNA, 22 bp, Artificial Sequence
  chemically synthesized
tggcctgtcttcctacctgttc

SEQ ID NO: 668733 - DNA, 22 bp, Artificial Sequence
  chemically synthesized
ttgcagtacaagaacaggtagg

SEQ ID NO: 668734 - DNA, 22 bp, Artificial Sequence
  chemically synthesized
cagtacaagaacaggtaggaag

SEQ ID NO: 668735 - DNA, 22 bp, Artificial Sequence
  chemically synthesized
atggattttggcctgtcttcct

SEQ ID NO: 668736 - DNA, 22 bp, Artificial Sequence
  chemically synthesized
atgaaatatagtcaggagactc

SEQ ID NO: 668737 - DNA, 22 bp, Artificial Sequence
  chemically synthesized
aatgaaatatagtcaggagact

SEQ ID NO: 668738 - DNA, 22 bp, Artificial Sequence
  chemically synthesized
tcacttaatgaaatatagtcag

SEQ ID NO: 668739 - DNA, 22 bp, Artificial Sequence
  chemically synthesized
ctgactatatttcattaagtga

SEQ ID NO: 668740 - DNA, 22 bp, Artificial Sequence
  chemically synthesized
actatatttcattaagtgacaa

SEQ ID NO: 668741 - DNA, 22 bp, Artificial Sequence
  chemically synthesized
aatgcagaagtaattgtcactt

SEQ ID NO: 668742 - DNA, 22 bp, Artificial Sequence
  chemically synthesized
aaatgcagaagtaattgtcact

SEQ ID NO: 668743 - DNA, 22 bp, Artificial Sequence
  chemically synthesized
taaatgcagaagtaattgtcac

SEQ ID NO: 668744 - DNA, 22 bp, Artificial Sequence
  chemically synthesized
tatttcattaagtgacaattac

SEQ ID NO: 668745 - DNA, 22 bp, Artificial Sequence
  chemically synthesized
cattaagtgacaattacttctg

SEQ ID NO: 668746 - DNA, 22 bp, Artificial Sequence
  chemically synthesized
attaagtgacaattacttctgc

SEQ ID NO: 668747 - DNA, 22 bp, Artificial Sequence
  chemically synthesized
atgattttaaatgcagaagtaa

SEQ ID NO: 668748 - DNA, 22 bp, Artificial Sequence
  chemically synthesized
agtgacaattacttctgcattt

SEQ ID NO: 668749 - DNA, 22 bp, Artificial Sequence
  chemically synthesized
cttctgcatttaaaatcatcag

SEQ ID NO: 668750 - DNA, 22 bp, Artificial Sequence
  chemically synthesized
agtaagcgtcaactgatgattt

SEQ ID NO: 668751 - DNA, 22 bp, Artificial Sequence
  chemically synthesized
aagtaagcgtcaactgatgatt

SEQ ID NO: 668752 - DNA, 22 bp, Artificial Sequence
  chemically synthesized
ctgcatttaaaatcatcagttg

SEQ ID NO: 668753 - DNA, 22 bp, Artificial Sequence
  chemically synthesized
tgcatttaaaatcatcagttga

SEQ ID NO: 668754 - DNA, 22 bp, Artificial Sequence
  chemically synthesized
catttaaaatcatcagttgacg

SEQ ID NO: 668755 - DNA, 22 bp, Artificial Sequence
  chemically synthesized
aaaatcatcagttgacgcttac

SEQ ID NO: 668756 - DNA, 22 bp, Artificial Sequence
  chemically synthesized
aaatcatcagttgacgcttact

SEQ ID NO: 668757 - DNA, 22 bp, Artificial Sequence
  chemically synthesized
ggcatataataggtgcttaagt

SEQ ID NO: 668758 - DNA, 22 bp, Artificial Sequence
  chemically synthesized
acgcttacttaagcacctatta

SEQ ID NO: 668759 - DNA, 22 bp, Artificial Sequence
  chemically synthesized
gtacacagttaggcatataata

SEQ ID NO: 668760 - DNA, 22 bp, Artificial Sequence
  chemically synthesized
acttaagcacctattatatgcc

SEQ ID NO: 668761 - DNA, 22 bp, Artificial Sequence
  chemically synthesized
agtacacagttaggcatataat

SEQ ID NO: 668762 - DNA, 22 bp, Artificial Sequence
  chemically synthesized
cttaagcacctattatatgcct

SEQ ID NO: 668763 - DNA, 22 bp, Artificial Sequence
  chemically synthesized
aagcacctattatatgcctaac

SEQ ID NO: 668764 - DNA, 22 bp, Artificial Sequence
  chemically synthesized
agcacctattatatgcctaact

SEQ ID NO: 668765 - DNA, 22 bp, Artificial Sequence
  chemically synthesized
ggcttagtacacagttaggcat

SEQ ID NO: 668766 - DNA, 22 bp, Artificial Sequence
  chemically synthesized
acccctgggcttagtacacagt

SEQ ID NO: 668767 - DNA, 22 bp, Artificial Sequence
  chemically synthesized
ttatatgcctaactgtgtacta

SEQ ID NO: 668768 - DNA, 22 bp, Artificial Sequence
  chemically synthesized
aacccctgggcttagtacacag

SEQ ID NO: 668769 - DNA, 22 bp, Artificial Sequence
  chemically synthesized
taacccctgggcttagtacaca

SEQ ID NO: 668770 - DNA, 22 bp, Artificial Sequence
  chemically synthesized
tatgcctaactgtgtactaagc

SEQ ID NO: 668771 - DNA, 22 bp, Artificial Sequence
  chemically synthesized
aatctttaacccctgggcttag

SEQ ID NO: 668772 - DNA, 22 bp, Artificial Sequence
  chemically synthesized
actgtgtactaagcccaggggt

SEQ ID NO: 668773 - DNA, 22 bp, Artificial Sequence
  chemically synthesized
tgtactaagcccaggggttaaa

SEQ ID NO: 668774 - DNA, 22 bp, Artificial Sequence
  chemically synthesized
gaaacctgaatctttaacccct

SEQ ID NO: 668775 - DNA, 22 bp, Artificial Sequence
  chemically synthesized
agaaacctgaatctttaacccc

SEQ ID NO: 668776 - DNA, 22 bp, Artificial Sequence
  chemically synthesized
agcccaggggttaaagattcag

SEQ ID NO: 668777 - DNA, 22 bp, Artificial Sequence
  chemically synthesized
cccaatatcttagaaacctgaa

SEQ ID NO: 668778 - DNA, 22 bp, Artificial Sequence
  chemically synthesized
ccccaatatcttagaaacctga

SEQ ID NO: 668779 - DNA, 22 bp, Artificial Sequence
  chemically synthesized
tccccaatatcttagaaacctg

SEQ ID NO: 668780 - DNA, 22 bp, Artificial Sequence
  chemically synthesized
ttttccccaatatcttagaaac

SEQ ID NO: 668781 - DNA, 22 bp, Artificial Sequence
  chemically synthesized
gttttccccaatatcttagaaa

SEQ ID NO: 668782 - DNA, 22 bp, Artificial Sequence
  chemically synthesized
tgttttccccaatatcttagaa

SEQ ID NO: 668783 - DNA, 22 bp, Artificial Sequence
  chemically synthesized
aagattcaggtttctaagatat

SEQ ID NO: 668784 - DNA, 22 bp, Artificial Sequence
  chemically synthesized
ttgttttccccaatatcttaga

SEQ ID NO: 668785 - DNA, 22 bp, Artificial Sequence
  chemically synthesized
tttgttttccccaatatcttag

SEQ ID NO: 668786 - DNA, 22 bp, Artificial Sequence
  chemically synthesized
aggtttctaagatattggggaa

SEQ ID NO: 668787 - DNA, 22 bp, Artificial Sequence
  chemically synthesized
ctaagatattggggaaaacaaa

SEQ ID NO: 668788 - DNA, 22 bp, Artificial Sequence
  chemically synthesized
taagatattggggaaaacaaaa

SEQ ID NO: 668789 - DNA, 22 bp, Artificial Sequence
  chemically synthesized
agatattggggaaaacaaaaag

SEQ ID NO: 668790 - DNA, 22 bp, Artificial Sequence
  chemically synthesized
cagggtgaataatctttttgtt

SEQ ID NO: 668791 - DNA, 22 bp, Artificial Sequence
  chemically synthesized
acagggtgaataatctttttgt

SEQ ID NO: 668792 - DNA, 22 bp, Artificial Sequence
  chemically synthesized
tacagggtgaataatctttttg

SEQ ID NO: 668793 - DNA, 22 bp, Artificial Sequence
  chemically synthesized
ttacagggtgaataatcttttt

SEQ ID NO: 668794 - DNA, 22 bp, Artificial Sequence
  chemically synthesized
tttacagggtgaataatctttt

SEQ ID NO: 668795 - DNA, 22 bp, Artificial Sequence
  chemically synthesized
gggaaaacaaaaagattattca

SEQ ID NO: 668796 - DNA, 22 bp, Artificial Sequence
  chemically synthesized
attttttacagggtgaataatc

SEQ ID NO: 668797 - DNA, 22 bp, Artificial Sequence
  chemically synthesized
ggatacgtgtactgatttttta

SEQ ID NO: 668798 - DNA, 22 bp, Artificial Sequence
  chemically synthesized
ttcaccctgtaaaaaatcagta

SEQ ID NO: 668799 - DNA, 22 bp, Artificial Sequence
  chemically synthesized
accctgtaaaaaatcagtacac

SEQ ID NO: 668800 - DNA, 22 bp, Artificial Sequence
  chemically synthesized
taaaaaatcagtacacgtatcc

SEQ ID NO: 668801 - DNA, 22 bp, Artificial Sequence
  chemically synthesized
acacatcacaaatacctgggat

SEQ ID NO: 668802 - DNA, 22 bp, Artificial Sequence
  chemically synthesized
gacacatcacaaatacctggga

SEQ ID NO: 668803 - DNA, 22 bp, Artificial Sequence
  chemically synthesized
cttgacacatcacaaatacctg

SEQ ID NO: 668804 - DNA, 22 bp, Artificial Sequence
  chemically synthesized
tatgtgtgtgttgcttgacaca

SEQ ID NO: 668805 - DNA, 22 bp, Artificial Sequence
  chemically synthesized
gtatgtgtgtgttgcttgacac

SEQ ID NO: 668806 - DNA, 22 bp, Artificial Sequence
  chemically synthesized
tgtatgtgtgtgttgcttgaca

SEQ ID NO: 668807 - DNA, 22 bp, Artificial Sequence
  chemically synthesized
gtgatgtgtcaagcaacacaca

SEQ ID NO: 668808 - DNA, 22 bp, Artificial Sequence
  chemically synthesized
tgatgtgtcaagcaacacacac

SEQ ID NO: 668809 - DNA, 22 bp, Artificial Sequence
  chemically synthesized
acataaccagagttttgtatgt

SEQ ID NO: 668810 - DNA, 22 bp, Artificial Sequence
  chemically synthesized
acactcacataaccagagtttt

SEQ ID NO: 668811 - DNA, 22 bp, Artificial Sequence
  chemically synthesized
gacactcacataaccagagttt

SEQ ID NO: 668812 - DNA, 22 bp, Artificial Sequence
  chemically synthesized
tgacactcacataaccagagtt

SEQ ID NO: 668813 - DNA, 22 bp, Artificial Sequence
  chemically synthesized
tttgacactcacataaccagag

SEQ ID NO: 668814 - DNA, 22 bp, Artificial Sequence
  chemically synthesized
ctttgacactcacataaccaga

SEQ ID NO: 668815 - DNA, 22 bp, Artificial Sequence
  chemically synthesized
tctttgacactcacataaccag

SEQ ID NO: 668816 - DNA, 22 bp, Artificial Sequence
  chemically synthesized
ttctttgacactcacataacca

SEQ ID NO: 668817 - DNA, 22 bp, Artificial Sequence
  chemically synthesized
gtttttctttgacactcacata

SEQ ID NO: 668818 - DNA, 22 bp, Artificial Sequence
  chemically synthesized
tggtttttctttgacactcaca

SEQ ID NO: 668819 - DNA, 22 bp, Artificial Sequence
  chemically synthesized
tggttatgtgagtgtcaaagaa

SEQ ID NO: 668820 - DNA, 22 bp, Artificial Sequence
  chemically synthesized
gttatgtgagtgtcaaagaaaa

SEQ ID NO: 668821 - DNA, 22 bp, Artificial Sequence
  chemically synthesized
ccgtccatctctggtttttctt

SEQ ID NO: 668822 - DNA, 22 bp, Artificial Sequence
  chemically synthesized
tgtgagtgtcaaagaaaaacca

SEQ ID NO: 668823 - DNA, 22 bp, Artificial Sequence
  chemically synthesized
accgtccatctctggtttttct

SEQ ID NO: 668824 - DNA, 22 bp, Artificial Sequence
  chemically synthesized
taccgtccatctctggtttttc

SEQ ID NO: 668825 - DNA, 22 bp, Artificial Sequence
  chemically synthesized
ccactttaccgtccatctctgg

SEQ ID NO: 668826 - DNA, 22 bp, Artificial Sequence
  chemically synthesized
accactttaccgtccatctctg

SEQ ID NO: 668827 - DNA, 22 bp, Artificial Sequence
  chemically synthesized
taccactttaccgtccatctct

SEQ ID NO: 668828 - DNA, 22 bp, Artificial Sequence
  chemically synthesized
ttaccactttaccgtccatctc

SEQ ID NO: 668829 - DNA, 22 bp, Artificial Sequence
  chemically synthesized
tttttaccactttaccgtccat

SEQ ID NO: 668830 - DNA, 22 bp, Artificial Sequence
  chemically synthesized
aataaaatctgtttttaccact

SEQ ID NO: 668831 - DNA, 22 bp, Artificial Sequence
  chemically synthesized
ctgaataaaatctgtttttacc

SEQ ID NO: 668832 - DNA, 22 bp, Artificial Sequence
  chemically synthesized
caatattcctgaataaaatctg

SEQ ID NO: 668833 - DNA, 22 bp, Artificial Sequence
  chemically synthesized
ttgcaatattcctgaataaaat

SEQ ID NO: 668834 - DNA, 22 bp, Artificial Sequence
  chemically synthesized
ccactattgcaatattcctgaa

SEQ ID NO: 668835 - DNA, 22 bp, Artificial Sequence
  chemically synthesized
cccactattgcaatattcctga

SEQ ID NO: 668836 - DNA, 22 bp, Artificial Sequence
  chemically synthesized
tcccactattgcaatattcctg

SEQ ID NO: 668837 - DNA, 22 bp, Artificial Sequence
  chemically synthesized
tttcccactattgcaatattcc

SEQ ID NO: 668838 - DNA, 22 bp, Artificial Sequence
  chemically synthesized
tattcaggaatattgcaatagt

SEQ ID NO: 668839 - DNA, 22 bp, Artificial Sequence
  chemically synthesized
attcaggaatattgcaatagtg

SEQ ID NO: 668840 - DNA, 22 bp, Artificial Sequence
  chemically synthesized
aggtctctttcccactattgca

SEQ ID NO: 668841 - DNA, 22 bp, Artificial Sequence
  chemically synthesized
ttcaggaatattgcaatagtgg

SEQ ID NO: 668842 - DNA, 22 bp, Artificial Sequence
  chemically synthesized
aggaatattgcaatagtgggaa

SEQ ID NO: 668843 - DNA, 22 bp, Artificial Sequence
  chemically synthesized
tactgaggtctctttcccacta

SEQ ID NO: 668844 - DNA, 22 bp, Artificial Sequence
  chemically synthesized
tatactgaggtctctttcccac

SEQ ID NO: 668845 - DNA, 22 bp, Artificial Sequence
  chemically synthesized
caatagtgggaaagagacctca

SEQ ID NO: 668846 - DNA, 22 bp, Artificial Sequence
  chemically synthesized
agcccagttctatactgaggtc

SEQ ID NO: 668847 - DNA, 22 bp, Artificial Sequence
  chemically synthesized
agagttgagcccagttctatac

SEQ ID NO: 668848 - DNA, 22 bp, Artificial Sequence
  chemically synthesized
tattcagagttgagcccagttc

SEQ ID NO: 668849 - DNA, 22 bp, Artificial Sequence
  chemically synthesized
agtatagaactgggctcaactc

SEQ ID NO: 668850 - DNA, 22 bp, Artificial Sequence
  chemically synthesized
tccatgctgtattcagagttga

SEQ ID NO: 668851 - DNA, 22 bp, Artificial Sequence
  chemically synthesized
gtccatgctgtattcagagttg

SEQ ID NO: 668852 - DNA, 22 bp, Artificial Sequence
  chemically synthesized
ccacttgtccatgctgtattca

SEQ ID NO: 668853 - DNA, 22 bp, Artificial Sequence
  chemically synthesized
ggctcaactctgaatacagcat

SEQ ID NO: 668854 - DNA, 22 bp, Artificial Sequence
  chemically synthesized
aactctgaatacagcatggaca

SEQ ID NO: 668855 - DNA, 22 bp, Artificial Sequence
  chemically synthesized
tcaattcccacttgtccatgct

SEQ ID NO: 668856 - DNA, 22 bp, Artificial Sequence
  chemically synthesized
gctatcaattcccacttgtcca

SEQ ID NO: 668857 - DNA, 22 bp, Artificial Sequence
  chemically synthesized
tgaatacagcatggacaagtgg

SEQ ID NO: 668858 - DNA, 22 bp, Artificial Sequence
  chemically synthesized
ggctatcaattcccacttgtcc

SEQ ID NO: 668859 - DNA, 22 bp, Artificial Sequence
  chemically synthesized
aatacagcatggacaagtggga

SEQ ID NO: 668860 - DNA, 22 bp, Artificial Sequence
  chemically synthesized
cttggctatcaattcccacttg

SEQ ID NO: 668861 - DNA, 22 bp, Artificial Sequence
  chemically synthesized
ctccttggctatcaattcccac

SEQ ID NO: 668862 - DNA, 22 bp, Artificial Sequence
  chemically synthesized
catccaccaaaccccaccctgc

SEQ ID NO: 668863 - DNA, 22 bp, Artificial Sequence
  chemically synthesized
atagccaaggagcagggtgggg

SEQ ID NO: 668864 - DNA, 22 bp, Artificial Sequence
  chemically synthesized
ccatccaccaaaccccaccctg

SEQ ID NO: 668865 - DNA, 22 bp, Artificial Sequence
  chemically synthesized
tccatccaccaaaccccaccct

SEQ ID NO: 668866 - DNA, 22 bp, Artificial Sequence
  chemically synthesized
gtagttttccatccaccaaacc

SEQ ID NO: 668867 - DNA, 22 bp, Artificial Sequence
  chemically synthesized
agtagttttccatccaccaaac

SEQ ID NO: 668868 - DNA, 22 bp, Artificial Sequence
  chemically synthesized
ttagtagttttccatccaccaa

SEQ ID NO: 668869 - DNA, 22 bp, Artificial Sequence
  chemically synthesized
tcttagtagttttccatccacc

SEQ ID NO: 668870 - DNA, 22 bp, Artificial Sequence
  chemically synthesized
ctcttagtagttttccatccac

SEQ ID NO: 668871 - DNA, 22 bp, Artificial Sequence
  chemically synthesized
tctcttagtagttttccatcca

SEQ ID NO: 668872 - DNA, 22 bp, Artificial Sequence
  chemically synthesized
ggtggatggaaaactactaaga

SEQ ID NO: 668873 - DNA, 22 bp, Artificial Sequence
  chemically synthesized
gtggatggaaaactactaagag

SEQ ID NO: 668874 - DNA, 22 bp, Artificial Sequence
  chemically synthesized
cccccatgctttctcttagtag

SEQ ID NO: 668875 - DNA, 22 bp, Artificial Sequence
  chemically synthesized
acccccatgctttctcttagta

SEQ ID NO: 668876 - DNA, 22 bp, Artificial Sequence
  chemically synthesized
gaatcccccttacccccatgct

SEQ ID NO: 668877 - DNA, 22 bp, Artificial Sequence
  chemically synthesized
ctaagagaaagcatgggggtaa

SEQ ID NO: 668878 - DNA, 22 bp, Artificial Sequence
  chemically synthesized
gctagaatcccccttaccccca

SEQ ID NO: 668879 - DNA, 22 bp, Artificial Sequence
  chemically synthesized
agctagaatcccccttaccccc

SEQ ID NO: 668880 - DNA, 22 bp, Artificial Sequence
  chemically synthesized
agagaaagcatgggggtaaggg

SEQ ID NO: 668881 - DNA, 22 bp, Artificial Sequence
  chemically synthesized
tagctagaatcccccttacccc

SEQ ID NO: 668882 - DNA, 22 bp, Artificial Sequence
  chemically synthesized
ttagctagaatcccccttaccc

SEQ ID NO: 668883 - DNA, 22 bp, Artificial Sequence
  chemically synthesized
tttagctagaatcccccttacc

SEQ ID NO: 668884 - DNA, 22 bp, Artificial Sequence
  chemically synthesized
ttttagctagaatcccccttac

SEQ ID NO: 668885 - DNA, 22 bp, Artificial Sequence
  chemically synthesized
tttttagctagaatccccctta

SEQ ID NO: 668886 - DNA, 22 bp, Artificial Sequence
  chemically synthesized
agttttttttagctagaatccc

SEQ ID NO: 668887 - DNA, 22 bp, Artificial Sequence
  chemically synthesized
ttaagttttttttagctagaat

SEQ ID NO: 668888 - DNA, 22 bp, Artificial Sequence
  chemically synthesized
ctgttaagttttttttagctag

SEQ ID NO: 668889 - DNA, 22 bp, Artificial Sequence
  chemically synthesized
agcaaggttcctgttaagtttt

SEQ ID NO: 668890 - DNA, 22 bp, Artificial Sequence
  chemically synthesized
cagcaaggttcctgttaagttt

SEQ ID NO: 668891 - DNA, 22 bp, Artificial Sequence
  chemically synthesized
tagctaaaaaaaacttaacagg

SEQ ID NO: 668892 - DNA, 22 bp, Artificial Sequence
  chemically synthesized
gctaaaaaaaacttaacaggaa

SEQ ID NO: 668893 - DNA, 22 bp, Artificial Sequence
  chemically synthesized
tgtcttcagcaaggttcctgtt

SEQ ID NO: 668894 - DNA, 22 bp, Artificial Sequence
  chemically synthesized
aaaaaaacttaacaggaacctt

SEQ ID NO: 668895 - DNA, 22 bp, Artificial Sequence
  chemically synthesized
gcctgtgtcttcagcaaggttc

SEQ ID NO: 668896 - DNA, 22 bp, Artificial Sequence
  chemically synthesized
aacaggaaccttgctgaagaca

SEQ ID NO: 668897 - DNA, 22 bp, Artificial Sequence
  chemically synthesized
acaggaaccttgctgaagacac

SEQ ID NO: 668898 - DNA, 22 bp, Artificial Sequence
  chemically synthesized
atcaccctggcctgtgtcttca

SEQ ID NO: 668899 - DNA, 22 bp, Artificial Sequence
  chemically synthesized
gctgaagacacaggccagggtg

SEQ ID NO: 668900 - DNA, 22 bp, Artificial Sequence
  chemically synthesized
ctgaagacacaggccagggtga

SEQ ID NO: 668901 - DNA, 22 bp, Artificial Sequence
  chemically synthesized
aagacacaggccagggtgatca

SEQ ID NO: 668902 - DNA, 22 bp, Artificial Sequence
  chemically synthesized
caccatcccccatgtgacgtct

SEQ ID NO: 668903 - DNA, 22 bp, Artificial Sequence
  chemically synthesized
atcctccaccatcccccatgtg

SEQ ID NO: 668904 - DNA, 22 bp, Artificial Sequence
  chemically synthesized
ctcatcctccaccatcccccat

SEQ ID NO: 668905 - DNA, 22 bp, Artificial Sequence
  chemically synthesized
atcaggttcctcatcctccacc

SEQ ID NO: 668906 - DNA, 22 bp, Artificial Sequence
  chemically synthesized
tgtatctgatcaggttcctcat

SEQ ID NO: 668907 - DNA, 22 bp, Artificial Sequence
  chemically synthesized
atgtatctgatcaggttcctca

SEQ ID NO: 668908 - DNA, 22 bp, Artificial Sequence
  chemically synthesized
ttatgtatctgatcaggttcct

SEQ ID NO: 668909 - DNA, 22 bp, Artificial Sequence
  chemically synthesized
ctcttatgtatctgatcaggtt

SEQ ID NO: 668910 - DNA, 22 bp, Artificial Sequence
  chemically synthesized
cctcttatgtatctgatcaggt

SEQ ID NO: 668911 - DNA, 22 bp, Artificial Sequence
  chemically synthesized
gcaagaaccaccttcctcttat

SEQ ID NO: 668912 - DNA, 22 bp, Artificial Sequence
  chemically synthesized
agcaagaaccaccttcctctta

SEQ ID NO: 668913 - DNA, 22 bp, Artificial Sequence
  chemically synthesized
atcagatacataagaggaaggt

SEQ ID NO: 668914 - DNA, 22 bp, Artificial Sequence
  chemically synthesized
aatcagtttagcaagaaccacc

SEQ ID NO: 668915 - DNA, 22 bp, Artificial Sequence
  chemically synthesized
ctaaatcagtttagcaagaacc

SEQ ID NO: 668916 - DNA, 22 bp, Artificial Sequence
  chemically synthesized
tagcgagaatcctgctaaatca

SEQ ID NO: 668917 - DNA, 22 bp, Artificial Sequence
  chemically synthesized
ttgctaaactgatttagcagga

SEQ ID NO: 668918 - DNA, 22 bp, Artificial Sequence
  chemically synthesized
gctaaactgatttagcaggatt

SEQ ID NO: 668919 - DNA, 22 bp, Artificial Sequence
  chemically synthesized
ctaaactgatttagcaggattc

SEQ ID NO: 668920 - DNA, 22 bp, Artificial Sequence
  chemically synthesized
aactgatttagcaggattctcg

SEQ ID NO: 668921 - DNA, 22 bp, Artificial Sequence
  chemically synthesized
atttagcaggattctcgctaca

SEQ ID NO: 668922 - DNA, 22 bp, Artificial Sequence
  chemically synthesized
taaaaatccagctgtagcgaga

SEQ ID NO: 668923 - DNA, 22 bp, Artificial Sequence
  chemically synthesized
gtaaaaatccagctgtagcgag

SEQ ID NO: 668924 - DNA, 22 bp, Artificial Sequence
  chemically synthesized
tgtaaaaatccagctgtagcga

SEQ ID NO: 668925 - DNA, 22 bp, Artificial Sequence
  chemically synthesized
agcaggattctcgctacagctg

SEQ ID NO: 668926 - DNA, 22 bp, Artificial Sequence
  chemically synthesized
tttgtaaaaatccagctgtagc

SEQ ID NO: 668927 - DNA, 22 bp, Artificial Sequence
  chemically synthesized
gcaggattctcgctacagctgg

SEQ ID NO: 668928 - DNA, 22 bp, Artificial Sequence
  chemically synthesized
ctttgtaaaaatccagctgtag

SEQ ID NO: 668929 - DNA, 22 bp, Artificial Sequence
  chemically synthesized
tgcacttctttgtaaaaatcca

SEQ ID NO: 668930 - DNA, 22 bp, Artificial Sequence
  chemically synthesized
tcgctacagctggatttttaca

SEQ ID NO: 668931 - DNA, 22 bp, Artificial Sequence
  chemically synthesized
gctacagctggatttttacaaa

SEQ ID NO: 668932 - DNA, 22 bp, Artificial Sequence
  chemically synthesized
cagctggatttttacaaagaag

SEQ ID NO: 668933 - DNA, 22 bp, Artificial Sequence
  chemically synthesized
ggcccacctgtgcacttctttg

SEQ ID NO: 668934 - DNA, 22 bp, Artificial Sequence
  chemically synthesized
ctaggcccacctgtgcacttct

SEQ ID NO: 668935 - DNA, 22 bp, Artificial Sequence
  chemically synthesized
gatttttacaaagaagtgcaca

SEQ ID NO: 668936 - DNA, 22 bp, Artificial Sequence
  chemically synthesized
tcctaggcccacctgtgcactt

SEQ ID NO: 668937 - DNA, 22 bp, Artificial Sequence
  chemically synthesized
ctcctaggcccacctgtgcact

SEQ ID NO: 668938 - DNA, 22 bp, Artificial Sequence
  chemically synthesized
ttacaaagaagtgcacaggtgg

SEQ ID NO: 668939 - DNA, 22 bp, Artificial Sequence
  chemically synthesized
tacaaagaagtgcacaggtggg

SEQ ID NO: 668940 - DNA, 22 bp, Artificial Sequence
  chemically synthesized
acaaagaagtgcacaggtgggc

SEQ ID NO: 668941 - DNA, 22 bp, Artificial Sequence
  chemically synthesized
caaagaagtgcacaggtgggcc

SEQ ID NO: 668942 - DNA, 22 bp, Artificial Sequence
  chemically synthesized
aaccttctcctaggcccacctg

SEQ ID NO: 668943 - DNA, 22 bp, Artificial Sequence
  chemically synthesized
ctgaaccttctcctaggcccac

SEQ ID NO: 668944 - DNA, 22 bp, Artificial Sequence
  chemically synthesized
agccagactcctgaaccttctc

SEQ ID NO: 668945 - DNA, 22 bp, Artificial Sequence
  chemically synthesized
cagccagactcctgaaccttct

SEQ ID NO: 668946 - DNA, 22 bp, Artificial Sequence
  chemically synthesized
atcaaacttcagccagactcct

SEQ ID NO: 668947 - DNA, 22 bp, Artificial Sequence
  chemically synthesized
ggagaaggttcaggagtctggc

SEQ ID NO: 668948 - DNA, 22 bp, Artificial Sequence
  chemically synthesized
gatcaaacttcagccagactcc

SEQ ID NO: 668949 - DNA, 22 bp, Artificial Sequence
  chemically synthesized
cttgatcaaacttcagccagac

SEQ ID NO: 668950 - DNA, 22 bp, Artificial Sequence
  chemically synthesized
tctacttgatcaaacttcagcc

SEQ ID NO: 668951 - DNA, 22 bp, Artificial Sequence
  chemically synthesized
aggagtctggctgaagtttgat

SEQ ID NO: 668952 - DNA, 22 bp, Artificial Sequence
  chemically synthesized
gctgaagtttgatcaagtagac

SEQ ID NO: 668953 - DNA, 22 bp, Artificial Sequence
  chemically synthesized
atgataaagattgtctacttga

SEQ ID NO: 668954 - DNA, 22 bp, Artificial Sequence
  chemically synthesized
aagtttgatcaagtagacaatc

SEQ ID NO: 668955 - DNA, 22 bp, Artificial Sequence
  chemically synthesized
gatcaagtagacaatctttatc

SEQ ID NO: 668956 - DNA, 22 bp, Artificial Sequence
  chemically synthesized
atcaagtagacaatctttatca

SEQ ID NO: 668957 - DNA, 22 bp, Artificial Sequence
  chemically synthesized
tatgtacataagcatcctcatg

SEQ ID NO: 668958 - DNA, 22 bp, Artificial Sequence
  chemically synthesized
tgtatgtacataagcatcctca

SEQ ID NO: 668959 - DNA, 22 bp, Artificial Sequence
  chemically synthesized
ctgtatgtacataagcatcctc

SEQ ID NO: 668960 - DNA, 22 bp, Artificial Sequence
  chemically synthesized
tatcatgaggatgcttatgtac

SEQ ID NO: 668961 - DNA, 22 bp, Artificial Sequence
  chemically synthesized
atcatgaggatgcttatgtaca

SEQ ID NO: 668962 - DNA, 22 bp, Artificial Sequence
  chemically synthesized
tatgtttctgtatgtacataag

SEQ ID NO: 668963 - DNA, 22 bp, Artificial Sequence
  chemically synthesized
tcatgaggatgcttatgtacat

SEQ ID NO: 668964 - DNA, 22 bp, Artificial Sequence
  chemically synthesized
attatatgtttctgtatgtaca

SEQ ID NO: 668965 - DNA, 22 bp, Artificial Sequence
  chemically synthesized
cattatatgtttctgtatgtac

SEQ ID NO: 668966 - DNA, 22 bp, Artificial Sequence
  chemically synthesized
tcattatatgtttctgtatgta

SEQ ID NO: 668967 - DNA, 22 bp, Artificial Sequence
  chemically synthesized
ttttcattatatgtttctgtat

SEQ ID NO: 668968 - DNA, 22 bp, Artificial Sequence
  chemically synthesized
atgtacatacagaaacatataa

SEQ ID NO: 668969 - DNA, 22 bp, Artificial Sequence
  chemically synthesized
tgtacatacagaaacatataat

SEQ ID NO: 668970 - DNA, 22 bp, Artificial Sequence
  chemically synthesized
cacgatggtctattttcattat

SEQ ID NO: 668971 - DNA, 22 bp, Artificial Sequence
  chemically synthesized
acatataaactgcacgatggtc

SEQ ID NO: 668972 - DNA, 22 bp, Artificial Sequence
  chemically synthesized
cggttgacatataaactgcacg

SEQ ID NO: 668973 - DNA, 22 bp, Artificial Sequence
  chemically synthesized
gcggttgacatataaactgcac

SEQ ID NO: 668974 - DNA, 22 bp, Artificial Sequence
  chemically synthesized
tgcggttgacatataaactgca

SEQ ID NO: 668975 - DNA, 22 bp, Artificial Sequence
  chemically synthesized
cctttgcggttgacatataaac

SEQ ID NO: 668976 - DNA, 22 bp, Artificial Sequence
  chemically synthesized
gaaactacctttgcggttgaca

SEQ ID NO: 668977 - DNA, 22 bp, Artificial Sequence
  chemically synthesized
ggaaactacctttgcggttgac

SEQ ID NO: 668978 - DNA, 22 bp, Artificial Sequence
  chemically synthesized
atatgtcaaccgcaaaggtagt

SEQ ID NO: 668979 - DNA, 22 bp, Artificial Sequence
  chemically synthesized
tatgtcaaccgcaaaggtagtt

SEQ ID NO: 668980 - DNA, 22 bp, Artificial Sequence
  chemically synthesized
tgtcatcttggaaactaccttt

SEQ ID NO: 668981 - DNA, 22 bp, Artificial Sequence
  chemically synthesized
atgtcatcttggaaactacctt

SEQ ID NO: 668982 - DNA, 22 bp, Artificial Sequence
  chemically synthesized
cttatgtcatcttggaaactac

SEQ ID NO: 668983 - DNA, 22 bp, Artificial Sequence
  chemically synthesized
gaatactgcttatgtcatcttg

SEQ ID NO: 668984 - DNA, 22 bp, Artificial Sequence
  chemically synthesized
attggaatactgcttatgtcat

SEQ ID NO: 668985 - DNA, 22 bp, Artificial Sequence
  chemically synthesized
ccaagatgacataagcagtatt

SEQ ID NO: 668986 - DNA, 22 bp, Artificial Sequence
  chemically synthesized
caagatgacataagcagtattc

SEQ ID NO: 668987 - DNA, 22 bp, Artificial Sequence
  chemically synthesized
aaaatgttcattggaatactgc

SEQ ID NO: 668988 - DNA, 22 bp, Artificial Sequence
  chemically synthesized
aaaaatgttcattggaatactg

SEQ ID NO: 668989 - DNA, 22 bp, Artificial Sequence
  chemically synthesized
accttaaaaatgttcattggaa

SEQ ID NO: 668990 - DNA, 22 bp, Artificial Sequence
  chemically synthesized
caatgccattaaccttaaaaat

SEQ ID NO: 668991 - DNA, 22 bp, Artificial Sequence
  chemically synthesized
ccaatgccattaaccttaaaaa

SEQ ID NO: 668992 - DNA, 22 bp, Artificial Sequence
  chemically synthesized
caatgaacatttttaaggttaa

SEQ ID NO: 668993 - DNA, 22 bp, Artificial Sequence
  chemically synthesized
tgtaggaaatttccaatgccat

SEQ ID NO: 668994 - DNA, 22 bp, Artificial Sequence
  chemically synthesized
atgtaggaaatttccaatgcca

SEQ ID NO: 668995 - DNA, 22 bp, Artificial Sequence
  chemically synthesized
ttaaggttaatggcattggaaa

SEQ ID NO: 668996 - DNA, 22 bp, Artificial Sequence
  chemically synthesized
taaggttaatggcattggaaat

SEQ ID NO: 668997 - DNA, 22 bp, Artificial Sequence
  chemically synthesized
aaggttaatggcattggaaatt

SEQ ID NO: 668998 - DNA, 22 bp, Artificial Sequence
  chemically synthesized
aggttaatggcattggaaattt

SEQ ID NO: 668999 - DNA, 22 bp, Artificial Sequence
  chemically synthesized
atggcattggaaatttcctaca

SEQ ID NO: 669000 - DNA, 22 bp, Artificial Sequence
  chemically synthesized
atgagtaacatggcttatgtag

SEQ ID NO: 669001 - DNA, 22 bp, Artificial Sequence
  chemically synthesized
catgagtaacatggcttatgta

SEQ ID NO: 669002 - DNA, 22 bp, Artificial Sequence
  chemically synthesized
gaaatttcctacataagccatg

SEQ ID NO: 669003 - DNA, 22 bp, Artificial Sequence
  chemically synthesized
tttcatgagtaacatggcttat

SEQ ID NO: 669004 - DNA, 22 bp, Artificial Sequence
  chemically synthesized
ctgtttcatgagtaacatggct

SEQ ID NO: 669005 - DNA, 22 bp, Artificial Sequence
  chemically synthesized
cctacataagccatgttactca

SEQ ID NO: 669006 - DNA, 22 bp, Artificial Sequence
  chemically synthesized
ctacataagccatgttactcat

SEQ ID NO: 669007 - DNA, 22 bp, Artificial Sequence
  chemically synthesized
gaaattactgtttcatgagtaa

SEQ ID NO: 669008 - DNA, 22 bp, Artificial Sequence
  chemically synthesized
cataagccatgttactcatgaa

SEQ ID NO: 669009 - DNA, 22 bp, Artificial Sequence
  chemically synthesized
agaaattactgtttcatgagta

SEQ ID NO: 669010 - DNA, 22 bp, Artificial Sequence
  chemically synthesized
tgggcttagaaattactgtttc

SEQ ID NO: 669011 - DNA, 22 bp, Artificial Sequence
  chemically synthesized
gtgggcttagaaattactgttt

SEQ ID NO: 669012 - DNA, 22 bp, Artificial Sequence
  chemically synthesized
tgtgggcttagaaattactgtt

SEQ ID NO: 669013 - DNA, 22 bp, Artificial Sequence
  chemically synthesized
ctcatgaaacagtaatttctaa

SEQ ID NO: 669014 - DNA, 22 bp, Artificial Sequence
  chemically synthesized
agcctttgtgggcttagaaatt

SEQ ID NO: 669015 - DNA, 22 bp, Artificial Sequence
  chemically synthesized
aagcctttgtgggcttagaaat

SEQ ID NO: 669016 - DNA, 22 bp, Artificial Sequence
  chemically synthesized
atgaaacagtaatttctaagcc

SEQ ID NO: 669017 - DNA, 22 bp, Artificial Sequence
  chemically synthesized
aatttaagcctttgtgggctta

SEQ ID NO: 669018 - DNA, 22 bp, Artificial Sequence
  chemically synthesized
aactaaatttaagcctttgtgg

SEQ ID NO: 669019 - DNA, 22 bp, Artificial Sequence
  chemically synthesized
aaactaaatttaagcctttgtg

SEQ ID NO: 669020 - DNA, 22 bp, Artificial Sequence
  chemically synthesized
ctaagcccacaaaggcttaaat

SEQ ID NO: 669021 - DNA, 22 bp, Artificial Sequence
  chemically synthesized
taagcccacaaaggcttaaatt

SEQ ID NO: 669022 - DNA, 22 bp, Artificial Sequence
  chemically synthesized
gatatttaaactaaatttaagc

SEQ ID NO: 669023 - DNA, 22 bp, Artificial Sequence
  chemically synthesized
agcccacaaaggcttaaattta

SEQ ID NO: 669024 - DNA, 22 bp, Artificial Sequence
  chemically synthesized
tatactggatatttaaactaaa

SEQ ID NO: 669025 - DNA, 22 bp, Artificial Sequence
  chemically synthesized
ttgtatactggatatttaaact

SEQ ID NO: 669026 - DNA, 22 bp, Artificial Sequence
  chemically synthesized
attgtatactggatatttaaac

SEQ ID NO: 669027 - DNA, 22 bp, Artificial Sequence
  chemically synthesized
tattgtatactggatatttaaa

SEQ ID NO: 669028 - DNA, 22 bp, Artificial Sequence
  chemically synthesized
ttattgtatactggatatttaa

SEQ ID NO: 669029 - DNA, 22 bp, Artificial Sequence
  chemically synthesized
aaatttagtttaaatatccagt

SEQ ID NO: 669030 - DNA, 22 bp, Artificial Sequence
  chemically synthesized
tttttattgtatactggatatt

SEQ ID NO: 669031 - DNA, 22 bp, Artificial Sequence
  chemically synthesized
aatttagtttaaatatccagta

SEQ ID NO: 669032 - DNA, 22 bp, Artificial Sequence
  chemically synthesized
atttttattgtatactggatat

SEQ ID NO: 669033 - DNA, 22 bp, Artificial Sequence
  chemically synthesized
tatttttattgtatactggata

SEQ ID NO: 669034 - DNA, 22 bp, Artificial Sequence
  chemically synthesized
agtttaaatatccagtatacaa

SEQ ID NO: 669035 - DNA, 22 bp, Artificial Sequence
  chemically synthesized
gtttaaatatccagtatacaat

SEQ ID NO: 669036 - DNA, 22 bp, Artificial Sequence
  chemically synthesized
tagattttatttttattgtata

SEQ ID NO: 669037 - DNA, 22 bp, Artificial Sequence
  chemically synthesized
aaatatccagtatacaataaaa

SEQ ID NO: 669038 - DNA, 22 bp, Artificial Sequence
  chemically synthesized
aatatccagtatacaataaaaa

SEQ ID NO: 669039 - DNA, 22 bp, Artificial Sequence
  chemically synthesized
ctatagattttatttttattgt

SEQ ID NO: 669040 - DNA, 22 bp, Artificial Sequence
  chemically synthesized
tcagtattactatagattttat

SEQ ID NO: 669041 - DNA, 22 bp, Artificial Sequence
  chemically synthesized
tatcagtattactatagatttt

SEQ ID NO: 669042 - DNA, 22 bp, Artificial Sequence
  chemically synthesized
ctatcagtattactatagattt

SEQ ID NO: 669043 - DNA, 22 bp, Artificial Sequence
  chemically synthesized
catcagtcatttctatcagtat

SEQ ID NO: 669044 - DNA, 22 bp, Artificial Sequence
  chemically synthesized
gttacatcagtcatttctatca

SEQ ID NO: 669045 - DNA, 22 bp, Artificial Sequence
  chemically synthesized
tagtaatactgatagaaatgac

SEQ ID NO: 669046 - DNA, 22 bp, Artificial Sequence
  chemically synthesized
attagttacatcagtcatttct

SEQ ID NO: 669047 - DNA, 22 bp, Artificial Sequence
  chemically synthesized
taattagttacatcagtcattt

SEQ ID NO: 669048 - DNA, 22 bp, Artificial Sequence
  chemically synthesized
ctaattagttacatcagtcatt

SEQ ID NO: 669049 - DNA, 22 bp, Artificial Sequence
  chemically synthesized
tttctaattagttacatcagtc

SEQ ID NO: 669050 - DNA, 22 bp, Artificial Sequence
  chemically synthesized
atagaaatgactgatgtaacta

SEQ ID NO: 669051 - DNA, 22 bp, Artificial Sequence
  chemically synthesized
atgtaactaattagaaatagct

SEQ ID NO: 669052 - DNA, 22 bp, Artificial Sequence
  chemically synthesized
attagaaatagctttatttttc

SEQ ID NO: 669053 - DNA, 22 bp, Artificial Sequence
  chemically synthesized
aagtataagaatgaaaaataaa

SEQ ID NO: 669054 - DNA, 22 bp, Artificial Sequence
  chemically synthesized
gaaatagctttatttttcattc

SEQ ID NO: 669055 - DNA, 22 bp, Artificial Sequence
  chemically synthesized
cctcaagtataagaatgaaaaa

SEQ ID NO: 669056 - DNA, 22 bp, Artificial Sequence
  chemically synthesized
ccctcaagtataagaatgaaaa

SEQ ID NO: 669057 - DNA, 22 bp, Artificial Sequence
  chemically synthesized
tccctcaagtataagaatgaaa

SEQ ID NO: 669058 - DNA, 22 bp, Artificial Sequence
  chemically synthesized
ttccctcaagtataagaatgaa

SEQ ID NO: 669059 - DNA, 22 bp, Artificial Sequence
  chemically synthesized
tttccctcaagtataagaatga

SEQ ID NO: 669060 - DNA, 22 bp, Artificial Sequence
  chemically synthesized
ttttccctcaagtataagaatg

SEQ ID NO: 669061 - DNA, 22 bp, Artificial Sequence
  chemically synthesized
tatttttcattcttatacttga

SEQ ID NO: 669062 - DNA, 22 bp, Artificial Sequence
  chemically synthesized
atcttttttccctcaagtataa

SEQ ID NO: 669063 - DNA, 22 bp, Artificial Sequence
  chemically synthesized
atttttcattcttatacttgag

SEQ ID NO: 669064 - DNA, 22 bp, Artificial Sequence
  chemically synthesized
tttttcattcttatacttgagg

SEQ ID NO: 669065 - DNA, 22 bp, Artificial Sequence
  chemically synthesized
tcatcttttttccctcaagtat

SEQ ID NO: 669066 - DNA, 22 bp, Artificial Sequence
  chemically synthesized
ctcatcttttttccctcaagta

SEQ ID NO: 669067 - DNA, 22 bp, Artificial Sequence
  chemically synthesized
tctcatcttttttccctcaagt

SEQ ID NO: 669068 - DNA, 22 bp, Artificial Sequence
  chemically synthesized
ttcattcttatacttgagggaa

SEQ ID NO: 669069 - DNA, 22 bp, Artificial Sequence
  chemically synthesized
ttctcatcttttttccctcaag

SEQ ID NO: 669070 - DNA, 22 bp, Artificial Sequence
  chemically synthesized
tcattcttatacttgagggaaa

SEQ ID NO: 669071 - DNA, 22 bp, Artificial Sequence
  chemically synthesized
cattcttatacttgagggaaaa

SEQ ID NO: 669072 - DNA, 22 bp, Artificial Sequence
  chemically synthesized
attcttatacttgagggaaaaa

SEQ ID NO: 669073 - DNA, 22 bp, Artificial Sequence
  chemically synthesized
catttttctcatcttttttccc

SEQ ID NO: 669074 - DNA, 22 bp, Artificial Sequence
  chemically synthesized
ttatacttgagggaaaaaagat

SEQ ID NO: 669075 - DNA, 22 bp, Artificial Sequence
  chemically synthesized
atacttgagggaaaaaagatga

SEQ ID NO: 669076 - DNA, 22 bp, Artificial Sequence
  chemically synthesized
tacttgagggaaaaaagatgag

SEQ ID NO: 669077 - DNA, 22 bp, Artificial Sequence
  chemically synthesized
agaagtctgcatttttctcatc

SEQ ID NO: 669078 - DNA, 22 bp, Artificial Sequence
  chemically synthesized
gagggaaaaaagatgagaaaaa

SEQ ID NO: 669079 - DNA, 22 bp, Artificial Sequence
  chemically synthesized
cagaagtctgcatttttctcat

SEQ ID NO: 669080 - DNA, 22 bp, Artificial Sequence
  chemically synthesized
agggaaaaaagatgagaaaaat

SEQ ID NO: 669081 - DNA, 22 bp, Artificial Sequence
  chemically synthesized
ttcagaagtctgcatttttctc

SEQ ID NO: 669082 - DNA, 22 bp, Artificial Sequence
  chemically synthesized
ctgaagaggtcatgttgtgttc

SEQ ID NO: 669083 - DNA, 22 bp, Artificial Sequence
  chemically synthesized
tgaagaggtcatgttgtgttca

SEQ ID NO: 669084 - DNA, 22 bp, Artificial Sequence
  chemically synthesized
aagaggtcatgttgtgttcact

SEQ ID NO: 669085 - DNA, 22 bp, Artificial Sequence
  chemically synthesized
gatgccaaggataagtgaacac

SEQ ID NO: 669086 - DNA, 22 bp, Artificial Sequence
  chemically synthesized
ccctagatgccaaggataagtg

SEQ ID NO: 669087 - DNA, 22 bp, Artificial Sequence
  chemically synthesized
ttgccctagatgccaaggataa

SEQ ID NO: 669088 - DNA, 22 bp, Artificial Sequence
  chemically synthesized
attgccctagatgccaaggata

SEQ ID NO: 669089 - DNA, 22 bp, Artificial Sequence
  chemically synthesized
tgttcacttatccttggcatct

SEQ ID NO: 669090 - DNA, 22 bp, Artificial Sequence
  chemically synthesized
acttatccttggcatctagggc

SEQ ID NO: 669091 - DNA, 22 bp, Artificial Sequence
  chemically synthesized
atccttggcatctagggcaata

SEQ ID NO: 669092 - DNA, 22 bp, Artificial Sequence
  chemically synthesized
agcaccatcatttattgcccta

SEQ ID NO: 669093 - DNA, 22 bp, Artificial Sequence
  chemically synthesized
tccttggcatctagggcaataa

SEQ ID NO: 669094 - DNA, 22 bp, Artificial Sequence
  chemically synthesized
ttgagcaccatcatttattgcc

SEQ ID NO: 669095 - DNA, 22 bp, Artificial Sequence
  chemically synthesized
attgagcaccatcatttattgc

SEQ ID NO: 669096 - DNA, 22 bp, Artificial Sequence
  chemically synthesized
ggcatctagggcaataaatgat

SEQ ID NO: 669097 - DNA, 22 bp, Artificial Sequence
  chemically synthesized
gcatctagggcaataaatgatg

SEQ ID NO: 669098 - DNA, 22 bp, Artificial Sequence
  chemically synthesized
gggcaataaatgatggtgctca

SEQ ID NO: 669099 - DNA, 22 bp, Artificial Sequence
  chemically synthesized
caaatacatttattgagcacca

SEQ ID NO: 669100 - DNA, 22 bp, Artificial Sequence
  chemically synthesized
ttccaaatacatttattgagca

SEQ ID NO: 669101 - DNA, 22 bp, Artificial Sequence
  chemically synthesized
attccaaatacatttattgagc

SEQ ID NO: 669102 - DNA, 22 bp, Artificial Sequence
  chemically synthesized
tattccaaatacatttattgag

SEQ ID NO: 669103 - DNA, 22 bp, Artificial Sequence
  chemically synthesized
attttattccaaatacatttat

SEQ ID NO: 669104 - DNA, 22 bp, Artificial Sequence
  chemically synthesized
agaatctaattttattccaaat

SEQ ID NO: 669105 - DNA, 22 bp, Artificial Sequence
  chemically synthesized
cagaatctaattttattccaaa

SEQ ID NO: 669106 - DNA, 22 bp, Artificial Sequence
  chemically synthesized
tcagaatctaattttattccaa

SEQ ID NO: 669107 - DNA, 22 bp, Artificial Sequence
  chemically synthesized
aataaatgtatttggaataaaa

SEQ ID NO: 669108 - DNA, 22 bp, Artificial Sequence
  chemically synthesized
ctttcagaatctaattttattc

SEQ ID NO: 669109 - DNA, 22 bp, Artificial Sequence
  chemically synthesized
ggaataaaattagattctgaaa

SEQ ID NO: 669110 - DNA, 22 bp, Artificial Sequence
  chemically synthesized
gaataaaattagattctgaaag

SEQ ID NO: 669111 - DNA, 22 bp, Artificial Sequence
  chemically synthesized
gtaaaagcaaggaagttccttt

SEQ ID NO: 669112 - DNA, 22 bp, Artificial Sequence
  chemically synthesized
gattctgaaaggaacttccttg

SEQ ID NO: 669113 - DNA, 22 bp, Artificial Sequence
  chemically synthesized
aacctggtaaaagcaaggaagt

SEQ ID NO: 669114 - DNA, 22 bp, Artificial Sequence
  chemically synthesized
aaacctggtaaaagcaaggaag

SEQ ID NO: 669115 - DNA, 22 bp, Artificial Sequence
  chemically synthesized
tgaaaggaacttccttgctttt

SEQ ID NO: 669116 - DNA, 22 bp, Artificial Sequence
  chemically synthesized
aaaggaacttccttgcttttac

SEQ ID NO: 669117 - DNA, 22 bp, Artificial Sequence
  chemically synthesized
ccttgcttttaccaggtttaag

SEQ ID NO: 669118 - DNA, 22 bp, Artificial Sequence
  chemically synthesized
cttgcttttaccaggtttaagc

SEQ ID NO: 669119 - DNA, 22 bp, Artificial Sequence
  chemically synthesized
gcttttaccaggtttaagctgt

SEQ ID NO: 669120 - DNA, 22 bp, Artificial Sequence
  chemically synthesized
cttttaccaggtttaagctgtc

SEQ ID NO: 669121 - DNA, 22 bp, Artificial Sequence
  chemically synthesized
ttaccaggtttaagctgtcgat

SEQ ID NO: 669122 - DNA, 22 bp, Artificial Sequence
  chemically synthesized
taccaggtttaagctgtcgatg

SEQ ID NO: 669123 - DNA, 22 bp, Artificial Sequence
  chemically synthesized
accaggtttaagctgtcgatga

SEQ ID NO: 669124 - DNA, 22 bp, Artificial Sequence
  chemically synthesized
ccaggtttaagctgtcgatgac

SEQ ID NO: 669125 - DNA, 22 bp, Artificial Sequence
  chemically synthesized
gatgtaaaatcaatgtcatcga

SEQ ID NO: 669126 - DNA, 22 bp, Artificial Sequence
  chemically synthesized
aagctgtcgatgacattgattt

SEQ ID NO: 669127 - DNA, 22 bp, Artificial Sequence
  chemically synthesized
agctgtcgatgacattgatttt

SEQ ID NO: 669128 - DNA, 22 bp, Artificial Sequence
  chemically synthesized
aagaaaaattagatgtaaaatc

SEQ ID NO: 669129 - DNA, 22 bp, Artificial Sequence
  chemically synthesized
tcgatgacattgattttacatc

SEQ ID NO: 669130 - DNA, 22 bp, Artificial Sequence
  chemically synthesized
gaagaaaaattagatgtaaaat

SEQ ID NO: 669131 - DNA, 22 bp, Artificial Sequence
  chemically synthesized
tttgaagaaaaattagatgtaa

SEQ ID NO: 669132 - DNA, 22 bp, Artificial Sequence
  chemically synthesized
tattatttgaagaaaaattaga

SEQ ID NO: 669133 - DNA, 22 bp, Artificial Sequence
  chemically synthesized
attttacatctaatttttcttc

SEQ ID NO: 669134 - DNA, 22 bp, Artificial Sequence
  chemically synthesized
tacatctaatttttcttcaaat

SEQ ID NO: 669135 - DNA, 22 bp, Artificial Sequence
  chemically synthesized
acatctaatttttcttcaaata

SEQ ID NO: 669136 - DNA, 22 bp, Artificial Sequence
  chemically synthesized
catctaatttttcttcaaataa

SEQ ID NO: 669137 - DNA, 22 bp, Artificial Sequence
  chemically synthesized
atttttcttcaaataatataat

SEQ ID NO: 669138 - DNA, 22 bp, Artificial Sequence
  chemically synthesized
ttcttcaaataatataattttc

SEQ ID NO: 669139 - DNA, 22 bp, Artificial Sequence
  chemically synthesized
tcttcaaataatataattttcc

SEQ ID NO: 669140 - DNA, 22 bp, Artificial Sequence
  chemically synthesized
agccatagaagtggaaaattat

SEQ ID NO: 669141 - DNA, 22 bp, Artificial Sequence
  chemically synthesized
cttcaaataatataattttcca

SEQ ID NO: 669142 - DNA, 22 bp, Artificial Sequence
  chemically synthesized
ttcaaataatataattttccac

SEQ ID NO: 669143 - DNA, 22 bp, Artificial Sequence
  chemically synthesized
caaataatataattttccactt

SEQ ID NO: 669144 - DNA, 22 bp, Artificial Sequence
  chemically synthesized
aaataatataattttccacttc

SEQ ID NO: 669145 - DNA, 22 bp, Artificial Sequence
  chemically synthesized
cagtgattcagccatagaagtg

SEQ ID NO: 669146 - DNA, 22 bp, Artificial Sequence
  chemically synthesized
tccacttctatggctgaatcac

SEQ ID NO: 669147 - DNA, 22 bp, Artificial Sequence
  chemically synthesized
ccacttctatggctgaatcact

SEQ ID NO: 669148 - DNA, 22 bp, Artificial Sequence
  chemically synthesized
cacttctatggctgaatcactg

SEQ ID NO: 669149 - DNA, 22 bp, Artificial Sequence
  chemically synthesized
ctatggctgaatcactggaatt

SEQ ID NO: 669150 - DNA, 22 bp, Artificial Sequence
  chemically synthesized
tatggctgaatcactggaatta

SEQ ID NO: 669151 - DNA, 22 bp, Artificial Sequence
  chemically synthesized
tggctgaatcactggaattatt

SEQ ID NO: 669152 - DNA, 22 bp, Artificial Sequence
  chemically synthesized
aatcactggaattattattttt

SEQ ID NO: 669153 - DNA, 22 bp, Artificial Sequence
  chemically synthesized
taaggagtaagcaaaaataata

SEQ ID NO: 669154 - DNA, 22 bp, Artificial Sequence
  chemically synthesized
aggttgtaaggagtaagcaaaa

SEQ ID NO: 669155 - DNA, 22 bp, Artificial Sequence
  chemically synthesized
gaattattatttttgcttactc

SEQ ID NO: 669156 - DNA, 22 bp, Artificial Sequence
  chemically synthesized
cagctcaggttgtaaggagtaa

SEQ ID NO: 669157 - DNA, 22 bp, Artificial Sequence
  chemically synthesized
ttatttttgcttactccttaca

SEQ ID NO: 669158 - DNA, 22 bp, Artificial Sequence
  chemically synthesized
tttttgcttactccttacaacc

SEQ ID NO: 669159 - DNA, 22 bp, Artificial Sequence
  chemically synthesized
ttgcttactccttacaacctga

SEQ ID NO: 669160 - DNA, 22 bp, Artificial Sequence
  chemically synthesized
tgcttactccttacaacctgag

SEQ ID NO: 669161 - DNA, 22 bp, Artificial Sequence
  chemically synthesized
gcttactccttacaacctgagc

SEQ ID NO: 669162 - DNA, 22 bp, Artificial Sequence
  chemically synthesized
cttactccttacaacctgagct

SEQ ID NO: 669163 - DNA, 22 bp, Artificial Sequence
  chemically synthesized
aaaaaagaagctccagctcagg

SEQ ID NO: 669164 - DNA, 22 bp, Artificial Sequence
  chemically synthesized
actccttacaacctgagctgga

SEQ ID NO: 669165 - DNA, 22 bp, Artificial Sequence
  chemically synthesized
caaaaaagaagctccagctcag

SEQ ID NO: 669166 - DNA, 22 bp, Artificial Sequence
  chemically synthesized
ctccttacaacctgagctggag

SEQ ID NO: 669167 - DNA, 22 bp, Artificial Sequence
  chemically synthesized
cttacaacctgagctggagctt

SEQ ID NO: 669168 - DNA, 22 bp, Artificial Sequence
  chemically synthesized
acaacctgagctggagcttctt

SEQ ID NO: 669169 - DNA, 22 bp, Artificial Sequence
  chemically synthesized
caacctgagctggagcttcttt

SEQ ID NO: 669170 - DNA, 22 bp, Artificial Sequence
  chemically synthesized
tgaggtgtgtttcaaaaaagaa

SEQ ID NO: 669171 - DNA, 22 bp, Artificial Sequence
  chemically synthesized
gtgaggtgtgtttcaaaaaaga

SEQ ID NO: 669172 - DNA, 22 bp, Artificial Sequence
  chemically synthesized
tgtgaggtgtgtttcaaaaaag

SEQ ID NO: 669173 - DNA, 22 bp, Artificial Sequence
  chemically synthesized
agctggagcttcttttttgaaa

SEQ ID NO: 669174 - DNA, 22 bp, Artificial Sequence
  chemically synthesized
gagcttcttttttgaaacacac

SEQ ID NO: 669175 - DNA, 22 bp, Artificial Sequence
  chemically synthesized
atatctttgtgaggtgtgtttc

SEQ ID NO: 669176 - DNA, 22 bp, Artificial Sequence
  chemically synthesized
gatatctttgtgaggtgtgttt

SEQ ID NO: 669177 - DNA, 22 bp, Artificial Sequence
  chemically synthesized
cttttttgaaacacacctcaca

SEQ ID NO: 669178 - DNA, 22 bp, Artificial Sequence
  chemically synthesized
ttttttgaaacacacctcacaa

SEQ ID NO: 669179 - DNA, 22 bp, Artificial Sequence
  chemically synthesized
ttttgaaacacacctcacaaag

SEQ ID NO: 669180 - DNA, 22 bp, Artificial Sequence
  chemically synthesized
tttgaaacacacctcacaaaga

SEQ ID NO: 669181 - DNA, 22 bp, Artificial Sequence
  chemically synthesized
ttgaaacacacctcacaaagat

SEQ ID NO: 669182 - DNA, 22 bp, Artificial Sequence
  chemically synthesized
tgaaacacacctcacaaagata

SEQ ID NO: 669183 - DNA, 22 bp, Artificial Sequence
  chemically synthesized
ggaaagtcttgatatctttgtg

SEQ ID NO: 669184 - DNA, 22 bp, Artificial Sequence
  chemically synthesized
gaaacacacctcacaaagatat

SEQ ID NO: 669185 - DNA, 22 bp, Artificial Sequence
  chemically synthesized
aggaaagtcttgatatctttgt

SEQ ID NO: 669186 - DNA, 22 bp, Artificial Sequence
  chemically synthesized
aaacacacctcacaaagatatc

SEQ ID NO: 669187 - DNA, 22 bp, Artificial Sequence
  chemically synthesized
cttaggaaagtcttgatatctt

SEQ ID NO: 669188 - DNA, 22 bp, Artificial Sequence
  chemically synthesized
ttccttaggaaagtcttgatat

SEQ ID NO: 669189 - DNA, 22 bp, Artificial Sequence
  chemically synthesized
attccttaggaaagtcttgata

SEQ ID NO: 669190 - DNA, 22 bp, Artificial Sequence
  chemically synthesized
tattccttaggaaagtcttgat

SEQ ID NO: 669191 - DNA, 22 bp, Artificial Sequence
  chemically synthesized
ctttattccttaggaaagtctt

SEQ ID NO: 669192 - DNA, 22 bp, Artificial Sequence
  chemically synthesized
acaaagatatcaagactttcct

SEQ ID NO: 669193 - DNA, 22 bp, Artificial Sequence
  chemically synthesized
tcccaattcctttattccttag

SEQ ID NO: 669194 - DNA, 22 bp, Artificial Sequence
  chemically synthesized
gtcccaattcctttattcctta

SEQ ID NO: 669195 - DNA, 22 bp, Artificial Sequence
  chemically synthesized
tgtcccaattcctttattcctt

SEQ ID NO: 669196 - DNA, 22 bp, Artificial Sequence
  chemically synthesized
tttgtcccaattcctttattcc

SEQ ID NO: 669197 - DNA, 22 bp, Artificial Sequence
  chemically synthesized
tctttgtcccaattcctttatt

SEQ ID NO: 669198 - DNA, 22 bp, Artificial Sequence
  chemically synthesized
tctctttgtcccaattccttta

SEQ ID NO: 669199 - DNA, 22 bp, Artificial Sequence
  chemically synthesized
ctctctttgtcccaattccttt

SEQ ID NO: 669200 - DNA, 22 bp, Artificial Sequence
  chemically synthesized
tcctaaggaataaaggaattgg

SEQ ID NO: 669201 - DNA, 22 bp, Artificial Sequence
  chemically synthesized
tctctctttgtcccaattcctt

SEQ ID NO: 669202 - DNA, 22 bp, Artificial Sequence
  chemically synthesized
cctaaggaataaaggaattggg

SEQ ID NO: 669203 - DNA, 22 bp, Artificial Sequence
  chemically synthesized
ctaaggaataaaggaattggga

SEQ ID NO: 669204 - DNA, 22 bp, Artificial Sequence
  chemically synthesized
tttctctctttgtcccaattcc

SEQ ID NO: 669205 - DNA, 22 bp, Artificial Sequence
  chemically synthesized
ctttctctctttgtcccaattc

SEQ ID NO: 669206 - DNA, 22 bp, Artificial Sequence
  chemically synthesized
tctttctctctttgtcccaatt

SEQ ID NO: 669207 - DNA, 22 bp, Artificial Sequence
  chemically synthesized
aggaataaaggaattgggacaa

SEQ ID NO: 669208 - DNA, 22 bp, Artificial Sequence
  chemically synthesized
ttttctttctctctttgtccca

SEQ ID NO: 669209 - DNA, 22 bp, Artificial Sequence
  chemically synthesized
attttctttctctctttgtccc

SEQ ID NO: 669210 - DNA, 22 bp, Artificial Sequence
  chemically synthesized
gaccatttattttctttctctc

SEQ ID NO: 669211 - DNA, 22 bp, Artificial Sequence
  chemically synthesized
agaccatttattttctttctct

SEQ ID NO: 669212 - DNA, 22 bp, Artificial Sequence
  chemically synthesized
tagaccatttattttctttctc

SEQ ID NO: 669213 - DNA, 22 bp, Artificial Sequence
  chemically synthesized
ttagaccatttattttctttct

SEQ ID NO: 669214 - DNA, 22 bp, Artificial Sequence
  chemically synthesized
tttagaccatttattttctttc

SEQ ID NO: 669215 - DNA, 22 bp, Artificial Sequence
  chemically synthesized
ggacaaagagagaaagaaaata

SEQ ID NO: 669216 - DNA, 22 bp, Artificial Sequence
  chemically synthesized
tttttagaccatttattttctt

SEQ ID NO: 669217 - DNA, 22 bp, Artificial Sequence
  chemically synthesized
caaataagcattctttttagac

SEQ ID NO: 669218 - DNA, 22 bp, Artificial Sequence
  chemically synthesized
gcaaataagcattctttttaga

SEQ ID NO: 669219 - DNA, 22 bp, Artificial Sequence
  chemically synthesized
accttgcaaataagcattcttt

SEQ ID NO: 669220 - DNA, 22 bp, Artificial Sequence
  chemically synthesized
aaaagaatgcttatttgcaagg

SEQ ID NO: 669221 - DNA, 22 bp, Artificial Sequence
  chemically synthesized
aatacagcggattcaccttgca

SEQ ID NO: 669222 - DNA, 22 bp, Artificial Sequence
  chemically synthesized
atttgcaaggtgaatccgctgt

SEQ ID NO: 669223 - DNA, 22 bp, Artificial Sequence
  chemically synthesized
ccacaattaaatacagcggatt

SEQ ID NO: 669224 - DNA, 22 bp, Artificial Sequence
  chemically synthesized
tttgcaaggtgaatccgctgta

SEQ ID NO: 669225 - DNA, 22 bp, Artificial Sequence
  chemically synthesized
gcaaggtgaatccgctgtattt

SEQ ID NO: 669226 - DNA, 22 bp, Artificial Sequence
  chemically synthesized
tctgccacaattaaatacagcg

SEQ ID NO: 669227 - DNA, 22 bp, Artificial Sequence
  chemically synthesized
caaggtgaatccgctgtattta

SEQ ID NO: 669228 - DNA, 22 bp, Artificial Sequence
  chemically synthesized
tatttaattgtggcagataact

SEQ ID NO: 669229 - DNA, 22 bp, Artificial Sequence
  chemically synthesized
agtgagccaacatacagttatc

SEQ ID NO: 669230 - DNA, 22 bp, Artificial Sequence
  chemically synthesized
aattgtggcagataactgtatg

SEQ ID NO: 669231 - DNA, 22 bp, Artificial Sequence
  chemically synthesized
attgtggcagataactgtatgt

SEQ ID NO: 669232 - DNA, 22 bp, Artificial Sequence
  chemically synthesized
tggcagataactgtatgttggc

SEQ ID NO: 669233 - DNA, 22 bp, Artificial Sequence
  chemically synthesized
ggaaggggtgttgagtgagcca

SEQ ID NO: 669234 - DNA, 22 bp, Artificial Sequence
  chemically synthesized
gggaaggggtgttgagtgagcc

SEQ ID NO: 669235 - DNA, 22 bp, Artificial Sequence
  chemically synthesized
tatgttggctcactcaacaccc

SEQ ID NO: 669236 - DNA, 22 bp, Artificial Sequence
  chemically synthesized
gctcactcaacaccccttccca

SEQ ID NO: 669237 - DNA, 22 bp, Artificial Sequence
  chemically synthesized
actcaacaccccttcccaaatt

SEQ ID NO: 669238 - DNA, 22 bp, Artificial Sequence
  chemically synthesized
aacaccccttcccaaattcttt

SEQ ID NO: 669239 - DNA, 22 bp, Artificial Sequence
  chemically synthesized
tagcagagaaagaccaaggaga

SEQ ID NO: 669240 - DNA, 22 bp, Artificial Sequence
  chemically synthesized
cccaaattctttctccttggtc

SEQ ID NO: 669241 - DNA, 22 bp, Artificial Sequence
  chemically synthesized
gtagcagagaaagaccaaggag

SEQ ID NO: 669242 - DNA, 22 bp, Artificial Sequence
  chemically synthesized
ccaaattctttctccttggtct

SEQ ID NO: 669243 - DNA, 22 bp, Artificial Sequence
  chemically synthesized
tgtagcagagaaagaccaagga

SEQ ID NO: 669244 - DNA, 22 bp, Artificial Sequence
  chemically synthesized
cagcctttgtagcagagaaaga

SEQ ID NO: 669245 - DNA, 22 bp, Artificial Sequence
  chemically synthesized
tttctccttggtctttctctgc

SEQ ID NO: 669246 - DNA, 22 bp, Artificial Sequence
  chemically synthesized
tctccttggtctttctctgcta

SEQ ID NO: 669247 - DNA, 22 bp, Artificial Sequence
  chemically synthesized
ctccttggtctttctctgctac

SEQ ID NO: 669248 - DNA, 22 bp, Artificial Sequence
  chemically synthesized
tccttggtctttctctgctaca

SEQ ID NO: 669249 - DNA, 22 bp, Artificial Sequence
  chemically synthesized
cttggtctttctctgctacaaa

SEQ ID NO: 669250 - DNA, 22 bp, Artificial Sequence
  chemically synthesized
agatcctccagcctttgtagca

SEQ ID NO: 669251 - DNA, 22 bp, Artificial Sequence
  chemically synthesized
ggtctttctctgctacaaaggc

SEQ ID NO: 669252 - DNA, 22 bp, Artificial Sequence
  chemically synthesized
gtctttctctgctacaaaggct

SEQ ID NO: 669253 - DNA, 22 bp, Artificial Sequence
  chemically synthesized
tctctgctacaaaggctggagg

SEQ ID NO: 669254 - DNA, 22 bp, Artificial Sequence
  chemically synthesized
ctctgctacaaaggctggagga

SEQ ID NO: 669255 - DNA, 22 bp, Artificial Sequence
  chemically synthesized
tctgctacaaaggctggaggat

SEQ ID NO: 669256 - DNA, 22 bp, Artificial Sequence
  chemically synthesized
tgctacaaaggctggaggatct

SEQ ID NO: 669257 - DNA, 22 bp, Artificial Sequence
  chemically synthesized
gatcagggaattgagatcctcc

SEQ ID NO: 669258 - DNA, 22 bp, Artificial Sequence
  chemically synthesized
ctacaaaggctggaggatctca

SEQ ID NO: 669259 - DNA, 22 bp, Artificial Sequence
  chemically synthesized
caaaggctggaggatctcaatt

SEQ ID NO: 669260 - DNA, 22 bp, Artificial Sequence
  chemically synthesized
gctggatcagggaattgagatc

SEQ ID NO: 669261 - DNA, 22 bp, Artificial Sequence
  chemically synthesized
ccctggctggatcagggaattg

SEQ ID NO: 669262 - DNA, 22 bp, Artificial Sequence
  chemically synthesized
cccctggctggatcagggaatt

SEQ ID NO: 669263 - DNA, 22 bp, Artificial Sequence
  chemically synthesized
gaggatctcaattccctgatcc

SEQ ID NO: 669264 - DNA, 22 bp, Artificial Sequence
  chemically synthesized
aattccctgatccagccagggg

SEQ ID NO: 669265 - DNA, 22 bp, Artificial Sequence
  chemically synthesized
tgtccacacagcttcccctggc

SEQ ID NO: 669266 - DNA, 22 bp, Artificial Sequence
  chemically synthesized
cctgatccagccaggggaagct

SEQ ID NO: 669267 - DNA, 22 bp, Artificial Sequence
  chemically synthesized
atccagccaggggaagctgtgt

SEQ ID NO: 669268 - DNA, 22 bp, Artificial Sequence
  chemically synthesized
gccaaaactgtgtccacacagc

SEQ ID NO: 669269 - DNA, 22 bp, Artificial Sequence
  chemically synthesized
aagcattggccaaaactgtgtc

SEQ ID NO: 669270 - DNA, 22 bp, Artificial Sequence
  chemically synthesized
tcaagcattggccaaaactgtg

SEQ ID NO: 669271 - DNA, 22 bp, Artificial Sequence
  chemically synthesized
ctcaagcattggccaaaactgt

SEQ ID NO: 669272 - DNA, 22 bp, Artificial Sequence
  chemically synthesized
tgtggacacagttttggccaat

SEQ ID NO: 669273 - DNA, 22 bp, Artificial Sequence
  chemically synthesized
cagatatcttctcaagcattgg

SEQ ID NO: 669274 - DNA, 22 bp, Artificial Sequence
  chemically synthesized
gcagatatcttctcaagcattg

SEQ ID NO: 669275 - DNA, 22 bp, Artificial Sequence
  chemically synthesized
ttgcagatatcttctcaagcat

SEQ ID NO: 669276 - DNA, 22 bp, Artificial Sequence
  chemically synthesized
cttgcagatatcttctcaagca

SEQ ID NO: 669277 - DNA, 22 bp, Artificial Sequence
  chemically synthesized
tcttgcagatatcttctcaagc

SEQ ID NO: 669278 - DNA, 22 bp, Artificial Sequence
  chemically synthesized
tggccaatgcttgagaagatat

SEQ ID NO: 669279 - DNA, 22 bp, Artificial Sequence
  chemically synthesized
ggccaatgcttgagaagatatc

SEQ ID NO: 669280 - DNA, 22 bp, Artificial Sequence
  chemically synthesized
gccaatgcttgagaagatatct

SEQ ID NO: 669281 - DNA, 22 bp, Artificial Sequence
  chemically synthesized
ggaagggaaatcctttcttgca

SEQ ID NO: 669282 - DNA, 22 bp, Artificial Sequence
  chemically synthesized
gagaagatatctgcaagaaagg

SEQ ID NO: 669283 - DNA, 22 bp, Artificial Sequence
  chemically synthesized
gggaagggaaatcctttcttgc

SEQ ID NO: 669284 - DNA, 22 bp, Artificial Sequence
  chemically synthesized
agaagatatctgcaagaaagga

SEQ ID NO: 669285 - DNA, 22 bp, Artificial Sequence
  chemically synthesized
catttgggaagggaaatccttt

SEQ ID NO: 669286 - DNA, 22 bp, Artificial Sequence
  chemically synthesized
ccatttgggaagggaaatcctt

SEQ ID NO: 669287 - DNA, 22 bp, Artificial Sequence
  chemically synthesized
tccatttgggaagggaaatcct

SEQ ID NO: 669288 - DNA, 22 bp, Artificial Sequence
  chemically synthesized
tctttccatttgggaagggaaa

SEQ ID NO: 669289 - DNA, 22 bp, Artificial Sequence
  chemically synthesized
gtctttccatttgggaagggaa

SEQ ID NO: 669290 - DNA, 22 bp, Artificial Sequence
  chemically synthesized
caagaaaggatttcccttccca

SEQ ID NO: 669291 - DNA, 22 bp, Artificial Sequence
  chemically synthesized
tgtctttccatttgggaaggga

SEQ ID NO: 669292 - DNA, 22 bp, Artificial Sequence
  chemically synthesized
tttgtctttccatttgggaagg

SEQ ID NO: 669293 - DNA, 22 bp, Artificial Sequence
  chemically synthesized
agagtctctttgtctttccatt

SEQ ID NO: 669294 - DNA, 22 bp, Artificial Sequence
  chemically synthesized
cccttcccaaatggaaagacaa

SEQ ID NO: 669295 - DNA, 22 bp, Artificial Sequence
  chemically synthesized
ccttcccaaatggaaagacaaa

SEQ ID NO: 669296 - DNA, 22 bp, Artificial Sequence
  chemically synthesized
agcctcagagtctctttgtctt

SEQ ID NO: 669297 - DNA, 22 bp, Artificial Sequence
  chemically synthesized
cccaaatggaaagacaaagaga

SEQ ID NO: 669298 - DNA, 22 bp, Artificial Sequence
  chemically synthesized
ccaaatggaaagacaaagagac

SEQ ID NO: 669299 - DNA, 22 bp, Artificial Sequence
  chemically synthesized
tgaggctgaacgtcctttctct

SEQ ID NO: 669300 - DNA, 22 bp, Artificial Sequence
  chemically synthesized
aggcaggaagaaagagaaagga

SEQ ID NO: 669301 - DNA, 22 bp, Artificial Sequence
  chemically synthesized
aggctgaacgtcctttctcttt

SEQ ID NO: 669302 - DNA, 22 bp, Artificial Sequence
  chemically synthesized
tcaggcaggaagaaagagaaag

SEQ ID NO: 669303 - DNA, 22 bp, Artificial Sequence
  chemically synthesized
ctcaggcaggaagaaagagaaa

SEQ ID NO: 669304 - DNA, 22 bp, Artificial Sequence
  chemically synthesized
cttctcaggcaggaagaaagag

SEQ ID NO: 669305 - DNA, 22 bp, Artificial Sequence
  chemically synthesized
aacgtcctttctctttcttcct

SEQ ID NO: 669306 - DNA, 22 bp, Artificial Sequence
  chemically synthesized
ctgcttctcaggcaggaagaaa

SEQ ID NO: 669307 - DNA, 22 bp, Artificial Sequence
  chemically synthesized
tctctttcttcctgcctgagaa

SEQ ID NO: 669308 - DNA, 22 bp, Artificial Sequence
  chemically synthesized
ctctttcttcctgcctgagaag

SEQ ID NO: 669309 - DNA, 22 bp, Artificial Sequence
  chemically synthesized
tctttcttcctgcctgagaagc

SEQ ID NO: 669310 - DNA, 22 bp, Artificial Sequence
  chemically synthesized
caagacgactgctgcttctcag

SEQ ID NO: 669311 - DNA, 22 bp, Artificial Sequence
  chemically synthesized
tttcttcctgcctgagaagcag

SEQ ID NO: 669312 - DNA, 22 bp, Artificial Sequence
  chemically synthesized
tcttcctgcctgagaagcagca

SEQ ID NO: 669313 - DNA, 22 bp, Artificial Sequence
  chemically synthesized
cttcctgcctgagaagcagcag

SEQ ID NO: 669314 - DNA, 22 bp, Artificial Sequence
  chemically synthesized
ttcctgcctgagaagcagcagt

SEQ ID NO: 669315 - DNA, 22 bp, Artificial Sequence
  chemically synthesized
cctgcctgagaagcagcagtcg

SEQ ID NO: 669316 - DNA, 22 bp, Artificial Sequence
  chemically synthesized
atggttccaagacgactgctgc

SEQ ID NO: 669317 - DNA, 22 bp, Artificial Sequence
  chemically synthesized
ctgcctgagaagcagcagtcgt

SEQ ID NO: 669318 - DNA, 22 bp, Artificial Sequence
  chemically synthesized
cctgagaagcagcagtcgtctt

SEQ ID NO: 669319 - DNA, 22 bp, Artificial Sequence
  chemically synthesized
gtcctgatggttccaagacgac

SEQ ID NO: 669320 - DNA, 22 bp, Artificial Sequence
  chemically synthesized
ggtcctgatggttccaagacga

SEQ ID NO: 669321 - DNA, 22 bp, Artificial Sequence
  chemically synthesized
agaagcagcagtcgtcttggaa

SEQ ID NO: 669322 - DNA, 22 bp, Artificial Sequence
  chemically synthesized
tggtcctgatggttccaagacg

SEQ ID NO: 669323 - DNA, 22 bp, Artificial Sequence
  chemically synthesized
acgagtgactttggtcctgatg

SEQ ID NO: 669324 - DNA, 22 bp, Artificial Sequence
  chemically synthesized
aacgagtgactttggtcctgat

SEQ ID NO: 669325 - DNA, 22 bp, Artificial Sequence
  chemically synthesized
taacgagtgactttggtcctga

SEQ ID NO: 669326 - DNA, 22 bp, Artificial Sequence
  chemically synthesized
ttaacgagtgactttggtcctg

SEQ ID NO: 669327 - DNA, 22 bp, Artificial Sequence
  chemically synthesized
ggaaccatcaggaccaaagtca

SEQ ID NO: 669328 - DNA, 22 bp, Artificial Sequence
  chemically synthesized
gaaccatcaggaccaaagtcac

SEQ ID NO: 669329 - DNA, 22 bp, Artificial Sequence
  chemically synthesized
taccatttttaacgagtgactt

SEQ ID NO: 669330 - DNA, 22 bp, Artificial Sequence
  chemically synthesized
ctgtaccatttttaacgagtga

SEQ ID NO: 669331 - DNA, 22 bp, Artificial Sequence
  chemically synthesized
tgctgtaccatttttaacgagt

SEQ ID NO: 669332 - DNA, 22 bp, Artificial Sequence
  chemically synthesized
ttctgctgtaccatttttaacg

SEQ ID NO: 669333 - DNA, 22 bp, Artificial Sequence
  chemically synthesized
attctgctgtaccatttttaac

SEQ ID NO: 669334 - DNA, 22 bp, Artificial Sequence
  chemically synthesized
ggccatggtttattctgctgta

SEQ ID NO: 669335 - DNA, 22 bp, Artificial Sequence
  chemically synthesized
gttaaaaatggtacagcagaat

SEQ ID NO: 669336 - DNA, 22 bp, Artificial Sequence
  chemically synthesized
aaaatggtacagcagaataaac

SEQ ID NO: 669337 - DNA, 22 bp, Artificial Sequence
  chemically synthesized
cgtgatgtcatcagagacctgg

SEQ ID NO: 669338 - DNA, 22 bp, Artificial Sequence
  chemically synthesized
tggaagagttccgtgatgtcat

SEQ ID NO: 669339 - DNA, 22 bp, Artificial Sequence
  chemically synthesized
agagctatggaagagttccgtg

SEQ ID NO: 669340 - DNA, 22 bp, Artificial Sequence
  chemically synthesized
tgatgacatcacggaactcttc

SEQ ID NO: 669341 - DNA, 22 bp, Artificial Sequence
  chemically synthesized
atgacatcacggaactcttcca

SEQ ID NO: 669342 - DNA, 22 bp, Artificial Sequence
  chemically synthesized
gaggcaggtagttgagagctat

SEQ ID NO: 669343 - DNA, 22 bp, Artificial Sequence
  chemically synthesized
ttccatagctctcaactacctg

SEQ ID NO: 669344 - DNA, 22 bp, Artificial Sequence
  chemically synthesized
ccatagctctcaactacctgcc

SEQ ID NO: 669345 - DNA, 22 bp, Artificial Sequence
  chemically synthesized
catagctctcaactacctgcct

SEQ ID NO: 669346 - DNA, 22 bp, Artificial Sequence
  chemically synthesized
tagaacaagaagtctggaggca

SEQ ID NO: 669347 - DNA, 22 bp, Artificial Sequence
  chemically synthesized
gtagaacaagaagtctggaggc

SEQ ID NO: 669348 - DNA, 22 bp, Artificial Sequence
  chemically synthesized
tgtagaacaagaagtctggagg

SEQ ID NO: 669349 - DNA, 22 bp, Artificial Sequence
  chemically synthesized
tcaactacctgcctccagactt

SEQ ID NO: 669350 - DNA, 22 bp, Artificial Sequence
  chemically synthesized
ttgtagaacaagaagtctggag

SEQ ID NO: 669351 - DNA, 22 bp, Artificial Sequence
  chemically synthesized
tttgtagaacaagaagtctgga

SEQ ID NO: 669352 - DNA, 22 bp, Artificial Sequence
  chemically synthesized
aactacctgcctccagacttct

SEQ ID NO: 669353 - DNA, 22 bp, Artificial Sequence
  chemically synthesized
cctgcctccagacttcttgttc

SEQ ID NO: 669354 - DNA, 22 bp, Artificial Sequence
  chemically synthesized
atattttttgtagaacaagaag

SEQ ID NO: 669355 - DNA, 22 bp, Artificial Sequence
  chemically synthesized
cctccagacttcttgttctaca

SEQ ID NO: 669356 - DNA, 22 bp, Artificial Sequence
  chemically synthesized
cagacttcttgttctacaaaaa

SEQ ID NO: 669357 - DNA, 22 bp, Artificial Sequence
  chemically synthesized
cttgttctacaaaaaatatcaa

SEQ ID NO: 669358 - DNA, 22 bp, Artificial Sequence
  chemically synthesized
aacacagaggagttgatatttt

SEQ ID NO: 669359 - DNA, 22 bp, Artificial Sequence
  chemically synthesized
ttgttctacaaaaaatatcaac

SEQ ID NO: 669360 - DNA, 22 bp, Artificial Sequence
  chemically synthesized
aaacacagaggagttgatattt

SEQ ID NO: 669361 - DNA, 22 bp, Artificial Sequence
  chemically synthesized
gttctacaaaaaatatcaactc

SEQ ID NO: 669362 - DNA, 22 bp, Artificial Sequence
  chemically synthesized
ttctacaaaaaatatcaactcc

SEQ ID NO: 669363 - DNA, 22 bp, Artificial Sequence
  chemically synthesized
tacaaaaaatatcaactcctct

SEQ ID NO: 669364 - DNA, 22 bp, Artificial Sequence
  chemically synthesized
tatcttaaacacagaggagttg

SEQ ID NO: 669365 - DNA, 22 bp, Artificial Sequence
  chemically synthesized
caaaaaatatcaactcctctgt

SEQ ID NO: 669366 - DNA, 22 bp, Artificial Sequence
  chemically synthesized
accaattgtatcttaaacacag

SEQ ID NO: 669367 - DNA, 22 bp, Artificial Sequence
  chemically synthesized
ctctgtgtttaagatacaattg

SEQ ID NO: 669368 - DNA, 22 bp, Artificial Sequence
  chemically synthesized
ataaaatatctgaccaattgta

SEQ ID NO: 669369 - DNA, 22 bp, Artificial Sequence
  chemically synthesized
tgtgtttaagatacaattggtc

SEQ ID NO: 669370 - DNA, 22 bp, Artificial Sequence
  chemically synthesized
tgtttaagatacaattggtcag

SEQ ID NO: 669371 - DNA, 22 bp, Artificial Sequence
  chemically synthesized
cagttaataaaatatctgacca

SEQ ID NO: 669372 - DNA, 22 bp, Artificial Sequence
  chemically synthesized
aagatacaattggtcagatatt

SEQ ID NO: 669373 - DNA, 22 bp, Artificial Sequence
  chemically synthesized
agatacaattggtcagatattt

SEQ ID NO: 669374 - DNA, 22 bp, Artificial Sequence
  chemically synthesized
gttgcagttaataaaatatctg

SEQ ID NO: 669375 - DNA, 22 bp, Artificial Sequence
  chemically synthesized
ggttgcagttaataaaatatct

SEQ ID NO: 669376 - DNA, 22 bp, Artificial Sequence
  chemically synthesized
tggttgcagttaataaaatatc

SEQ ID NO: 669377 - DNA, 22 bp, Artificial Sequence
  chemically synthesized
ttggttgcagttaataaaatat

SEQ ID NO: 669378 - DNA, 22 bp, Artificial Sequence
  chemically synthesized
gtcagatattttattaactgca

SEQ ID NO: 669379 - DNA, 22 bp, Artificial Sequence
  chemically synthesized
gagatgacttttggttgcagtt

SEQ ID NO: 669380 - DNA, 22 bp, Artificial Sequence
  chemically synthesized
tattaactgcaaccaaaagtca

SEQ ID NO: 669381 - DNA, 22 bp, Artificial Sequence
  chemically synthesized
attaactgcaaccaaaagtcat

SEQ ID NO: 669382 - DNA, 22 bp, Artificial Sequence
  chemically synthesized
ttaactgcaaccaaaagtcatc

SEQ ID NO: 669383 - DNA, 22 bp, Artificial Sequence
  chemically synthesized
acatgtcagttagagatgactt

SEQ ID NO: 669384 - DNA, 22 bp, Artificial Sequence
  chemically synthesized
actgcaaccaaaagtcatctct

SEQ ID NO: 669385 - DNA, 22 bp, Artificial Sequence
  chemically synthesized
caaccaaaagtcatctctaact

SEQ ID NO: 669386 - DNA, 22 bp, Artificial Sequence
  chemically synthesized
aattaacatgtcagttagagat

SEQ ID NO: 669387 - DNA, 22 bp, Artificial Sequence
  chemically synthesized
cagttcaattaacatgtcagtt

SEQ ID NO: 669388 - DNA, 22 bp, Artificial Sequence
  chemically synthesized
acagttcaattaacatgtcagt

SEQ ID NO: 669389 - DNA, 22 bp, Artificial Sequence
  chemically synthesized
cttacagttcaattaacatgtc

SEQ ID NO: 669390 - DNA, 22 bp, Artificial Sequence
  chemically synthesized
ttgcttacagttcaattaacat

SEQ ID NO: 669391 - DNA, 22 bp, Artificial Sequence
  chemically synthesized
gttgcttacagttcaattaaca

SEQ ID NO: 669392 - DNA, 22 bp, Artificial Sequence
  chemically synthesized
tgttgcttacagttcaattaac

SEQ ID NO: 669393 - DNA, 22 bp, Artificial Sequence
  chemically synthesized
taactgacatgttaattgaact

SEQ ID NO: 669394 - DNA, 22 bp, Artificial Sequence
  chemically synthesized
actgacatgttaattgaactgt

SEQ ID NO: 669395 - DNA, 22 bp, Artificial Sequence
  chemically synthesized
cattttgttgcttacagttcaa

SEQ ID NO: 669396 - DNA, 22 bp, Artificial Sequence
  chemically synthesized
tgcattttgttgcttacagttc

SEQ ID NO: 669397 - DNA, 22 bp, Artificial Sequence
  chemically synthesized
acatgttaattgaactgtaagc

SEQ ID NO: 669398 - DNA, 22 bp, Artificial Sequence
  chemically synthesized
ctgcattttgttgcttacagtt

SEQ ID NO: 669399 - DNA, 22 bp, Artificial Sequence
  chemically synthesized
gtcttctgcattttgttgctta

SEQ ID NO: 669400 - DNA, 22 bp, Artificial Sequence
  chemically synthesized
agtcttctgcattttgttgctt

SEQ ID NO: 669401 - DNA, 22 bp, Artificial Sequence
  chemically synthesized
attgaactgtaagcaacaaaat

SEQ ID NO: 669402 - DNA, 22 bp, Artificial Sequence
  chemically synthesized
tttagtcttctgcattttgttg

SEQ ID NO: 669403 - DNA, 22 bp, Artificial Sequence
  chemically synthesized
aactgtaagcaacaaaatgcag

SEQ ID NO: 669404 - DNA, 22 bp, Artificial Sequence
  chemically synthesized
cctatttagtcttctgcatttt

SEQ ID NO: 669405 - DNA, 22 bp, Artificial Sequence
  chemically synthesized
taagcaacaaaatgcagaagac

SEQ ID NO: 669406 - DNA, 22 bp, Artificial Sequence
  chemically synthesized
cgggggtggacgatgctcccta

SEQ ID NO: 669407 - DNA, 22 bp, Artificial Sequence
  chemically synthesized
aatagggagcatcgtccacccc

SEQ ID NO: 669408 - DNA, 22 bp, Artificial Sequence
  chemically synthesized
caccgcaaggaggattgcgggg

SEQ ID NO: 669409 - DNA, 22 bp, Artificial Sequence
  chemically synthesized
tccaccgcaaggaggattgcgg

SEQ ID NO: 669410 - DNA, 22 bp, Artificial Sequence
  chemically synthesized
ctccaccgcaaggaggattgcg

SEQ ID NO: 669411 - DNA, 22 bp, Artificial Sequence
  chemically synthesized
acgtcatttctccaccgcaagg

SEQ ID NO: 669412 - DNA, 22 bp, Artificial Sequence
  chemically synthesized
gtgctcacgtcatttctccacc

SEQ ID NO: 669413 - DNA, 22 bp, Artificial Sequence
  chemically synthesized
agtgctcacgtcatttctccac

SEQ ID NO: 669414 - DNA, 22 bp, Artificial Sequence
  chemically synthesized
tagtgctcacgtcatttctcca

SEQ ID NO: 669415 - DNA, 22 bp, Artificial Sequence
  chemically synthesized
tttagtgctcacgtcatttctc

SEQ ID NO: 669416 - DNA, 22 bp, Artificial Sequence
  chemically synthesized
cttgcggtggagaaatgacgtg

SEQ ID NO: 669417 - DNA, 22 bp, Artificial Sequence
  chemically synthesized
gcggtggagaaatgacgtgagc

SEQ ID NO: 669418 - DNA, 22 bp, Artificial Sequence
  chemically synthesized
cggtggagaaatgacgtgagca

SEQ ID NO: 669419 - DNA, 22 bp, Artificial Sequence
  chemically synthesized
ccacccaagatctctttagtgc

SEQ ID NO: 669420 - DNA, 22 bp, Artificial Sequence
  chemically synthesized
tgccacccaagatctctttagt

SEQ ID NO: 669421 - DNA, 22 bp, Artificial Sequence
  chemically synthesized
aagagatcttgggtggcagaga

SEQ ID NO: 669422 - DNA, 22 bp, Artificial Sequence
  chemically synthesized
gtagcaaggatggagatctctg

SEQ ID NO: 669423 - DNA, 22 bp, Artificial Sequence
  chemically synthesized
gggtggcagagatctccatcct

SEQ ID NO: 669424 - DNA, 22 bp, Artificial Sequence
  chemically synthesized
ggtggcagagatctccatcctt

SEQ ID NO: 669425 - DNA, 22 bp, Artificial Sequence
  chemically synthesized
catcagtggcaccacctggtag

SEQ ID NO: 669426 - DNA, 22 bp, Artificial Sequence
  chemically synthesized
tgcatcagtggcaccacctggt

SEQ ID NO: 669427 - DNA, 22 bp, Artificial Sequence
  chemically synthesized
catccttgctaccaggtggtgc

SEQ ID NO: 669428 - DNA, 22 bp, Artificial Sequence
  chemically synthesized
ttctgcatcagtggcaccacct

SEQ ID NO: 669429 - DNA, 22 bp, Artificial Sequence
  chemically synthesized
gctaccaggtggtgccactgat

SEQ ID NO: 669430 - DNA, 22 bp, Artificial Sequence
  chemically synthesized
ctaccaggtggtgccactgatg

SEQ ID NO: 669431 - DNA, 22 bp, Artificial Sequence
  chemically synthesized
tcaagctgttctgcatcagtgg

SEQ ID NO: 669432 - DNA, 22 bp, Artificial Sequence
  chemically synthesized
ccaggtggtgccactgatgcag

SEQ ID NO: 669433 - DNA, 22 bp, Artificial Sequence
  chemically synthesized
gctgtcaagctgttctgcatca

SEQ ID NO: 669434 - DNA, 22 bp, Artificial Sequence
  chemically synthesized
aattagctgtcaagctgttctg

SEQ ID NO: 669435 - DNA, 22 bp, Artificial Sequence
  chemically synthesized
aacgttaaattagctgtcaagc

SEQ ID NO: 669436 - DNA, 22 bp, Artificial Sequence
  chemically synthesized
aaacgttaaattagctgtcaag

SEQ ID NO: 669437 - DNA, 22 bp, Artificial Sequence
  chemically synthesized
atgcagaacagcttgacagcta

SEQ ID NO: 669438 - DNA, 22 bp, Artificial Sequence
  chemically synthesized
taaacgttaaattagctgtcaa

SEQ ID NO: 669439 - DNA, 22 bp, Artificial Sequence
  chemically synthesized
ttttaaacgttaaattagctgt

SEQ ID NO: 669440 - DNA, 22 bp, Artificial Sequence
  chemically synthesized
taaaattgttttaaacgttaaa

SEQ ID NO: 669441 - DNA, 22 bp, Artificial Sequence
  chemically synthesized
gacagctaatttaacgtttaaa

SEQ ID NO: 669442 - DNA, 22 bp, Artificial Sequence
  chemically synthesized
ttataaaattgttttaaacgtt

SEQ ID NO: 669443 - DNA, 22 bp, Artificial Sequence
  chemically synthesized
acagctaatttaacgtttaaaa

SEQ ID NO: 669444 - DNA, 22 bp, Artificial Sequence
  chemically synthesized
tgttataaaattgttttaaacg

SEQ ID NO: 669445 - DNA, 22 bp, Artificial Sequence
  chemically synthesized
atttaacgtttaaaacaatttt

SEQ ID NO: 669446 - DNA, 22 bp, Artificial Sequence
  chemically synthesized
aacgtttaaaacaattttataa

SEQ ID NO: 669447 - DNA, 22 bp, Artificial Sequence
  chemically synthesized
acgtttaaaacaattttataac

SEQ ID NO: 669448 - DNA, 22 bp, Artificial Sequence
  chemically synthesized
cccatataagccctctgttata

SEQ ID NO: 669449 - DNA, 22 bp, Artificial Sequence
  chemically synthesized
acccatataagccctctgttat

SEQ ID NO: 669450 - DNA, 22 bp, Artificial Sequence
  chemically synthesized
aaaacaattttataacagaggg

SEQ ID NO: 669451 - DNA, 22 bp, Artificial Sequence
  chemically synthesized
aaacaattttataacagagggc

SEQ ID NO: 669452 - DNA, 22 bp, Artificial Sequence
  chemically synthesized
tataacagagggcttatatggg

SEQ ID NO: 669453 - DNA, 22 bp, Artificial Sequence
  chemically synthesized
ataacagagggcttatatgggt

SEQ ID NO: 669454 - DNA, 22 bp, Artificial Sequence
  chemically synthesized
gaagagtgccttacccatataa

SEQ ID NO: 669455 - DNA, 22 bp, Artificial Sequence
  chemically synthesized
taacagagggcttatatgggta

SEQ ID NO: 669456 - DNA, 22 bp, Artificial Sequence
  chemically synthesized
tctagaagagtgccttacccat

SEQ ID NO: 669457 - DNA, 22 bp, Artificial Sequence
  chemically synthesized
gtctagaagagtgccttaccca

SEQ ID NO: 669458 - DNA, 22 bp, Artificial Sequence
  chemically synthesized
tgtctagaagagtgccttaccc

SEQ ID NO: 669459 - DNA, 22 bp, Artificial Sequence
  chemically synthesized
cagactttgtctagaagagtgc

SEQ ID NO: 669460 - DNA, 22 bp, Artificial Sequence
  chemically synthesized
atatgggtaaggcactcttcta

SEQ ID NO: 669461 - DNA, 22 bp, Artificial Sequence
  chemically synthesized
gcagactttgtctagaagagtg

SEQ ID NO: 669462 - DNA, 22 bp, Artificial Sequence
  chemically synthesized
tatgggtaaggcactcttctag

SEQ ID NO: 669463 - DNA, 22 bp, Artificial Sequence
  chemically synthesized
tgcagactttgtctagaagagt

SEQ ID NO: 669464 - DNA, 22 bp, Artificial Sequence
  chemically synthesized
aacactttgcagactttgtcta

SEQ ID NO: 669465 - DNA, 22 bp, Artificial Sequence
  chemically synthesized
ttctagacaaagtctgcaaagt

SEQ ID NO: 669466 - DNA, 22 bp, Artificial Sequence
  chemically synthesized
ctagacaaagtctgcaaagtgt

SEQ ID NO: 669467 - DNA, 22 bp, Artificial Sequence
  chemically synthesized
tagacaaagtctgcaaagtgtt

SEQ ID NO: 669468 - DNA, 22 bp, Artificial Sequence
  chemically synthesized
gacaaagtctgcaaagtgttta

SEQ ID NO: 669469 - DNA, 22 bp, Artificial Sequence
  chemically synthesized
caaacaaatggctaaacacttt

SEQ ID NO: 669470 - DNA, 22 bp, Artificial Sequence
  chemically synthesized
caaagtgtttagccatttgttt

SEQ ID NO: 669471 - DNA, 22 bp, Artificial Sequence
  chemically synthesized
tgaacgtcccattccaaacaaa

SEQ ID NO: 669472 - DNA, 22 bp, Artificial Sequence
  chemically synthesized
gtgaacgtcccattccaaacaa

SEQ ID NO: 669473 - DNA, 22 bp, Artificial Sequence
  chemically synthesized
agccatttgtttggaatgggac

SEQ ID NO: 669474 - DNA, 22 bp, Artificial Sequence
  chemically synthesized
gccatttgtttggaatgggacg

SEQ ID NO: 669475 - DNA, 22 bp, Artificial Sequence
  chemically synthesized
gtttggaatgggacgttcacaa

SEQ ID NO: 669476 - DNA, 22 bp, Artificial Sequence
  chemically synthesized
tttggaatgggacgttcacaag

SEQ ID NO: 669477 - DNA, 22 bp, Artificial Sequence
  chemically synthesized
ggcagaatcagacttgtgaacg

SEQ ID NO: 669478 - DNA, 22 bp, Artificial Sequence
  chemically synthesized
ggaatgggacgttcacaagtct

SEQ ID NO: 669479 - DNA, 22 bp, Artificial Sequence
  chemically synthesized
gaatgggacgttcacaagtctg

SEQ ID NO: 669480 - DNA, 22 bp, Artificial Sequence
  chemically synthesized
catctgggcagaatcagacttg

SEQ ID NO: 669481 - DNA, 22 bp, Artificial Sequence
  chemically synthesized
acatctgggcagaatcagactt

SEQ ID NO: 669482 - DNA, 22 bp, Artificial Sequence
  chemically synthesized
tcttacatctgggcagaatcag

SEQ ID NO: 669483 - DNA, 22 bp, Artificial Sequence
  chemically synthesized
atcttacatctgggcagaatca

SEQ ID NO: 669484 - DNA, 22 bp, Artificial Sequence
  chemically synthesized
acaagtctgattctgcccagat

SEQ ID NO: 669485 - DNA, 22 bp, Artificial Sequence
  chemically synthesized
caatccttatcttacatctggg

SEQ ID NO: 669486 - DNA, 22 bp, Artificial Sequence
  chemically synthesized
aattccaatccttatcttacat

SEQ ID NO: 669487 - DNA, 22 bp, Artificial Sequence
  chemically synthesized
attctgcccagatgtaagataa

SEQ ID NO: 669488 - DNA, 22 bp, Artificial Sequence
  chemically synthesized
aaattccaatccttatcttaca

SEQ ID NO: 669489 - DNA, 22 bp, Artificial Sequence
  chemically synthesized
taaattccaatccttatcttac

SEQ ID NO: 669490 - DNA, 22 bp, Artificial Sequence
  chemically synthesized
ttaaattccaatccttatctta

SEQ ID NO: 669491 - DNA, 22 bp, Artificial Sequence
  chemically synthesized
tgcccagatgtaagataaggat

SEQ ID NO: 669492 - DNA, 22 bp, Artificial Sequence
  chemically synthesized
cccagatgtaagataaggattg

SEQ ID NO: 669493 - DNA, 22 bp, Artificial Sequence
  chemically synthesized
tatgtttttaaattccaatcct

SEQ ID NO: 669494 - DNA, 22 bp, Artificial Sequence
  chemically synthesized
gtatgtttttaaattccaatcc

SEQ ID NO: 669495 - DNA, 22 bp, Artificial Sequence
  chemically synthesized
cagagaagtaacttgtatgttt

SEQ ID NO: 669496 - DNA, 22 bp, Artificial Sequence
  chemically synthesized
ccagagaagtaacttgtatgtt

SEQ ID NO: 669497 - DNA, 22 bp, Artificial Sequence
  chemically synthesized
gaatttaaaaacatacaagtta

SEQ ID NO: 669498 - DNA, 22 bp, Artificial Sequence
  chemically synthesized
aaaaacatacaagttacttctc

SEQ ID NO: 669499 - DNA, 22 bp, Artificial Sequence
  chemically synthesized
aaaacatacaagttacttctct

SEQ ID NO: 669500 - DNA, 22 bp, Artificial Sequence
  chemically synthesized
acacgtgaatttccagagaagt

SEQ ID NO: 669501 - DNA, 22 bp, Artificial Sequence
  chemically synthesized
taggttgacacgtgaatttcca

SEQ ID NO: 669502 - DNA, 22 bp, Artificial Sequence
  chemically synthesized
ataggttgacacgtgaatttcc

SEQ ID NO: 669503 - DNA, 22 bp, Artificial Sequence
  chemically synthesized
atttataggttgacacgtgaat

SEQ ID NO: 669504 - DNA, 22 bp, Artificial Sequence
  chemically synthesized
cttctctggaaattcacgtgtc

SEQ ID NO: 669505 - DNA, 22 bp, Artificial Sequence
  chemically synthesized
ctctggaaattcacgtgtcaac

SEQ ID NO: 669506 - DNA, 22 bp, Artificial Sequence
  chemically synthesized
tctggaaattcacgtgtcaacc

SEQ ID NO: 669507 - DNA, 22 bp, Artificial Sequence
  chemically synthesized
tggaaattcacgtgtcaaccta

SEQ ID NO: 669508 - DNA, 22 bp, Artificial Sequence
  chemically synthesized
gaaattcacgtgtcaacctata

SEQ ID NO: 669509 - DNA, 22 bp, Artificial Sequence
  chemically synthesized
tatgtgttcatttataggttga

SEQ ID NO: 669510 - DNA, 22 bp, Artificial Sequence
  chemically synthesized
attatatgtgttcatttatagg

SEQ ID NO: 669511 - DNA, 22 bp, Artificial Sequence
  chemically synthesized
acgtgtcaacctataaatgaac

SEQ ID NO: 669512 - DNA, 22 bp, Artificial Sequence
  chemically synthesized
gttgattatatgtgttcattta

SEQ ID NO: 669513 - DNA, 22 bp, Artificial Sequence
  chemically synthesized
atgaaaaactagttgattatat

SEQ ID NO: 669514 - DNA, 22 bp, Artificial Sequence
  chemically synthesized
taaatgaacacatataatcaac

SEQ ID NO: 669515 - DNA, 22 bp, Artificial Sequence
  chemically synthesized
aagagttaatgaaaaactagtt

SEQ ID NO: 669516 - DNA, 22 bp, Artificial Sequence
  chemically synthesized
taaagagttaatgaaaaactag

SEQ ID NO: 669517 - DNA, 22 bp, Artificial Sequence
  chemically synthesized
actctaaagagttaatgaaaaa

SEQ ID NO: 669518 - DNA, 22 bp, Artificial Sequence
  chemically synthesized
attaactctaaagagttaatga

SEQ ID NO: 669519 - DNA, 22 bp, Artificial Sequence
  chemically synthesized
cattaactctaaagagttaatg

SEQ ID NO: 669520 - DNA, 22 bp, Artificial Sequence
  chemically synthesized
gtttttcattaactctttagag

SEQ ID NO: 669521 - DNA, 22 bp, Artificial Sequence
  chemically synthesized
tgaacatttcattaactctaaa

SEQ ID NO: 669522 - DNA, 22 bp, Artificial Sequence
  chemically synthesized
ttcattaactctttagagttaa

SEQ ID NO: 669523 - DNA, 22 bp, Artificial Sequence
  chemically synthesized
tcattaactctttagagttaat

SEQ ID NO: 669524 - DNA, 22 bp, Artificial Sequence
  chemically synthesized
cattaactctttagagttaatg

SEQ ID NO: 669525 - DNA, 22 bp, Artificial Sequence
  chemically synthesized
attaactctttagagttaatga

SEQ ID NO: 669526 - DNA, 22 bp, Artificial Sequence
  chemically synthesized
actctttagagttaatgaaatg

SEQ ID NO: 669527 - DNA, 22 bp, Artificial Sequence
  chemically synthesized
tttagagttaatgaaatgttca

SEQ ID NO: 669528 - DNA, 22 bp, Artificial Sequence
  chemically synthesized
gagatgaagttatgaacatttc

SEQ ID NO: 669529 - DNA, 22 bp, Artificial Sequence
  chemically synthesized
tagagttaatgaaatgttcata

SEQ ID NO: 669530 - DNA, 22 bp, Artificial Sequence
  chemically synthesized
agagttaatgaaatgttcataa

SEQ ID NO: 669531 - DNA, 22 bp, Artificial Sequence
  chemically synthesized
gagttaatgaaatgttcataac

SEQ ID NO: 669532 - DNA, 22 bp, Artificial Sequence
  chemically synthesized
cactagagatgaagttatgaac

SEQ ID NO: 669533 - DNA, 22 bp, Artificial Sequence
  chemically synthesized
gcactagagatgaagttatgaa

SEQ ID NO: 669534 - DNA, 22 bp, Artificial Sequence
  chemically synthesized
tgcactagagatgaagttatga

SEQ ID NO: 669535 - DNA, 22 bp, Artificial Sequence
  chemically synthesized
atgaaatgttcataacttcatc

SEQ ID NO: 669536 - DNA, 22 bp, Artificial Sequence
  chemically synthesized
ataacttcatctctagtgcaaa

SEQ ID NO: 669537 - DNA, 22 bp, Artificial Sequence
  chemically synthesized
taaataaagaggaaattttgca

SEQ ID NO: 669538 - DNA, 22 bp, Artificial Sequence
  chemically synthesized
catctctagtgcaaaatttcct

SEQ ID NO: 669539 - DNA, 22 bp, Artificial Sequence
  chemically synthesized
atctctagtgcaaaatttcctc

SEQ ID NO: 669540 - DNA, 22 bp, Artificial Sequence
  chemically synthesized
agagctataaataaagaggaaa

SEQ ID NO: 669541 - DNA, 22 bp, Artificial Sequence
  chemically synthesized
aagagctataaataaagaggaa

SEQ ID NO: 669542 - DNA, 22 bp, Artificial Sequence
  chemically synthesized
tagtgcaaaatttcctctttat

SEQ ID NO: 669543 - DNA, 22 bp, Artificial Sequence
  chemically synthesized
gtgcaaaatttcctctttattt

SEQ ID NO: 669544 - DNA, 22 bp, Artificial Sequence
  chemically synthesized
tcttaagagctataaataaaga

SEQ ID NO: 669545 - DNA, 22 bp, Artificial Sequence
  chemically synthesized
atcttaagagctataaataaag

SEQ ID NO: 669546 - DNA, 22 bp, Artificial Sequence
  chemically synthesized
cctctttatttatagctcttaa

SEQ ID NO: 669547 - DNA, 22 bp, Artificial Sequence
  chemically synthesized
ctctttatttatagctcttaag

SEQ ID NO: 669548 - DNA, 22 bp, Artificial Sequence
  chemically synthesized
aataacatttatcttaagagct

SEQ ID NO: 669549 - DNA, 22 bp, Artificial Sequence
  chemically synthesized
aaataacatttatcttaagagc

SEQ ID NO: 669550 - DNA, 22 bp, Artificial Sequence
  chemically synthesized
taaataacatttatcttaagag

SEQ ID NO: 669551 - DNA, 22 bp, Artificial Sequence
  chemically synthesized
tttatttatagctcttaagata

SEQ ID NO: 669552 - DNA, 22 bp, Artificial Sequence
  chemically synthesized
ttaaataacatttatcttaaga

SEQ ID NO: 669553 - DNA, 22 bp, Artificial Sequence
  chemically synthesized
tttaaataacatttatcttaag

SEQ ID NO: 669554 - DNA, 22 bp, Artificial Sequence
  chemically synthesized
tatttatagctcttaagataaa

SEQ ID NO: 669555 - DNA, 22 bp, Artificial Sequence
  chemically synthesized
ttttaaataacatttatcttaa

SEQ ID NO: 669556 - DNA, 22 bp, Artificial Sequence
  chemically synthesized
atttatagctcttaagataaat

SEQ ID NO: 669557 - DNA, 22 bp, Artificial Sequence
  chemically synthesized
tttatagctcttaagataaatg

SEQ ID NO: 669558 - DNA, 22 bp, Artificial Sequence
  chemically synthesized
tttttttaaataacatttatct

SEQ ID NO: 669559 - DNA, 22 bp, Artificial Sequence
  chemically synthesized
atagctcttaagataaatgtta

SEQ ID NO: 669560 - DNA, 22 bp, Artificial Sequence
  chemically synthesized
tagctcttaagataaatgttat

SEQ ID NO: 669561 - DNA, 22 bp, Artificial Sequence
  chemically synthesized
ttaagataaatgttatttaaaa

SEQ ID NO: 669562 - DNA, 22 bp, Artificial Sequence
  chemically synthesized
ccaaaactatttttttaaataa

SEQ ID NO: 669563 - DNA, 22 bp, Artificial Sequence
  chemically synthesized
aagataaatgttatttaaaaaa

SEQ ID NO: 669564 - DNA, 22 bp, Artificial Sequence
  chemically synthesized
agataaatgttatttaaaaaaa

SEQ ID NO: 669565 - DNA, 22 bp, Artificial Sequence
  chemically synthesized
aagttaccaaaactattttttt

SEQ ID NO: 669566 - DNA, 22 bp, Artificial Sequence
  chemically synthesized
gttgaagttaccaaaactattt

SEQ ID NO: 669567 - DNA, 22 bp, Artificial Sequence
  chemically synthesized
tttaaaaaaatagttttggtaa

SEQ ID NO: 669568 - DNA, 22 bp, Artificial Sequence
  chemically synthesized
aaaaaaatagttttggtaactt

SEQ ID NO: 669569 - DNA, 22 bp, Artificial Sequence
  chemically synthesized
aaaaaatagttttggtaacttc

SEQ ID NO: 669570 - DNA, 22 bp, Artificial Sequence
  chemically synthesized
tcaaaacatatgattagttgaa

SEQ ID NO: 669571 - DNA, 22 bp, Artificial Sequence
  chemically synthesized
actgtcaaaacatatgattagt

SEQ ID NO: 669572 - DNA, 22 bp, Artificial Sequence
  chemically synthesized
tggtaacttcaactaatcatat

SEQ ID NO: 669573 - DNA, 22 bp, Artificial Sequence
  chemically synthesized
gactgtcaaaacatatgattag

SEQ ID NO: 669574 - DNA, 22 bp, Artificial Sequence
  chemically synthesized
ggtaacttcaactaatcatatg

SEQ ID NO: 669575 - DNA, 22 bp, Artificial Sequence
  chemically synthesized
gtaacttcaactaatcatatgt

SEQ ID NO: 669576 - DNA, 22 bp, Artificial Sequence
  chemically synthesized
atttgactgtcaaaacatatga

SEQ ID NO: 669577 - DNA, 22 bp, Artificial Sequence
  chemically synthesized
aatttgactgtcaaaacatatg

SEQ ID NO: 669578 - DNA, 22 bp, Artificial Sequence
  chemically synthesized
caactaatcatatgttttgaca

SEQ ID NO: 669579 - DNA, 22 bp, Artificial Sequence
  chemically synthesized
aactaatcatatgttttgacag

SEQ ID NO: 669580 - DNA, 22 bp, Artificial Sequence
  chemically synthesized
atcatatgttttgacagtcaaa

SEQ ID NO: 669581 - DNA, 22 bp, Artificial Sequence
  chemically synthesized
tgacagtcaaattaagattctt

SEQ ID NO: 669582 - DNA, 22 bp, Artificial Sequence
  chemically synthesized
gacagtcaaattaagattcttc

SEQ ID NO: 669583 - DNA, 22 bp, Artificial Sequence
  chemically synthesized
acagtcaaattaagattcttct

SEQ ID NO: 669584 - DNA, 22 bp, Artificial Sequence
  chemically synthesized
gataaagggtagagaagaatct

SEQ ID NO: 669585 - DNA, 22 bp, Artificial Sequence
  chemically synthesized
ttagataaagggtagagaagaa

SEQ ID NO: 669586 - DNA, 22 bp, Artificial Sequence
  chemically synthesized
ctgttagataaagggtagagaa

SEQ ID NO: 669587 - DNA, 22 bp, Artificial Sequence
  chemically synthesized
actgttagataaagggtagaga

SEQ ID NO: 669588 - DNA, 22 bp, Artificial Sequence
  chemically synthesized
agattcttctctaccctttatc

SEQ ID NO: 669589 - DNA, 22 bp, Artificial Sequence
  chemically synthesized
aaatgtttactgttagataaag

SEQ ID NO: 669590 - DNA, 22 bp, Artificial Sequence
  chemically synthesized
ttctctaccctttatctaacag

SEQ ID NO: 669591 - DNA, 22 bp, Artificial Sequence
  chemically synthesized
ctctaccctttatctaacagta

SEQ ID NO: 669592 - DNA, 22 bp, Artificial Sequence
  chemically synthesized
tctaccctttatctaacagtaa

SEQ ID NO: 669593 - DNA, 22 bp, Artificial Sequence
  chemically synthesized
taccctttatctaacagtaaac

SEQ ID NO: 669594 - DNA, 22 bp, Artificial Sequence
  chemically synthesized
agaacctaaaatgtttactgtt

SEQ ID NO: 669595 - DNA, 22 bp, Artificial Sequence
  chemically synthesized
ccctttatctaacagtaaacat

SEQ ID NO: 669596 - DNA, 22 bp, Artificial Sequence
  chemically synthesized
actcagaacctaaaatgtttac

SEQ ID NO: 669597 - DNA, 22 bp, Artificial Sequence
  chemically synthesized
cactcagaacctaaaatgttta

SEQ ID NO: 669598 - DNA, 22 bp, Artificial Sequence
  chemically synthesized
tcactcagaacctaaaatgttt

SEQ ID NO: 669599 - DNA, 22 bp, Artificial Sequence
  chemically synthesized
tatctaacagtaaacattttag

SEQ ID NO: 669600 - DNA, 22 bp, Artificial Sequence
  chemically synthesized
atctaacagtaaacattttagg

SEQ ID NO: 669601 - DNA, 22 bp, Artificial Sequence
  chemically synthesized
tctaacagtaaacattttaggt

SEQ ID NO: 669602 - DNA, 22 bp, Artificial Sequence
  chemically synthesized
acagtaaacattttaggttctg

SEQ ID NO: 669603 - DNA, 22 bp, Artificial Sequence
  chemically synthesized
taggttctgagtgaaaatgatt

SEQ ID NO: 669604 - DNA, 22 bp, Artificial Sequence
  chemically synthesized
aggttctgagtgaaaatgattt

SEQ ID NO: 669605 - DNA, 22 bp, Artificial Sequence
  chemically synthesized
ggttctgagtgaaaatgatttg

SEQ ID NO: 669606 - DNA, 22 bp, Artificial Sequence
  chemically synthesized
tgagtgaaaatgatttgcatcc

SEQ ID NO: 669607 - DNA, 22 bp, Artificial Sequence
  chemically synthesized
agtgaaaatgatttgcatcctc

SEQ ID NO: 669608 - DNA, 22 bp, Artificial Sequence
  chemically synthesized
gcatcctccatctgcctctttc

SEQ ID NO: 669609 - DNA, 22 bp, Artificial Sequence
  chemically synthesized
catcctccatctgcctctttcc

SEQ ID NO: 669610 - DNA, 22 bp, Artificial Sequence
  chemically synthesized
ggcaccagagaaatggaaagag

SEQ ID NO: 669611 - DNA, 22 bp, Artificial Sequence
  chemically synthesized
catctgcctctttccatttctc

SEQ ID NO: 669612 - DNA, 22 bp, Artificial Sequence
  chemically synthesized
atgttgggcaccagagaaatgg

SEQ ID NO: 669613 - DNA, 22 bp, Artificial Sequence
  chemically synthesized
cctctttccatttctctggtgc

SEQ ID NO: 669614 - DNA, 22 bp, Artificial Sequence
  chemically synthesized
tttccatttctctggtgcccaa

SEQ ID NO: 669615 - DNA, 22 bp, Artificial Sequence
  chemically synthesized
tccatttctctggtgcccaaca

SEQ ID NO: 669616 - DNA, 22 bp, Artificial Sequence
  chemically synthesized
ggggtgtgttgatgttgggcac

SEQ ID NO: 669617 - DNA, 22 bp, Artificial Sequence
  chemically synthesized
ccatttctctggtgcccaacat

SEQ ID NO: 669618 - DNA, 22 bp, Artificial Sequence
  chemically synthesized
catttctctggtgcccaacatc

SEQ ID NO: 669619 - DNA, 22 bp, Artificial Sequence
  chemically synthesized
ctctggtgcccaacatcaacac

SEQ ID NO: 669620 - DNA, 22 bp, Artificial Sequence
  chemically synthesized
tctggtgcccaacatcaacaca

SEQ ID NO: 669621 - DNA, 22 bp, Artificial Sequence
  chemically synthesized
tggtgcccaacatcaacacacc

SEQ ID NO: 669622 - DNA, 22 bp, Artificial Sequence
  chemically synthesized
gtgcccaacatcaacacacccc

SEQ ID NO: 669623 - DNA, 22 bp, Artificial Sequence
  chemically synthesized
gagggcatggatattgggggtg

SEQ ID NO: 669624 - DNA, 22 bp, Artificial Sequence
  chemically synthesized
ttagagggcatggatattgggg

SEQ ID NO: 669625 - DNA, 22 bp, Artificial Sequence
  chemically synthesized
atgatgattattagagggcatg

SEQ ID NO: 669626 - DNA, 22 bp, Artificial Sequence
  chemically synthesized
ttcatgatgattattagagggc

SEQ ID NO: 669627 - DNA, 22 bp, Artificial Sequence
  chemically synthesized
attcatgatgattattagaggg

SEQ ID NO: 669628 - DNA, 22 bp, Artificial Sequence
  chemically synthesized
tattcatgatgattattagagg

SEQ ID NO: 669629 - DNA, 22 bp, Artificial Sequence
  chemically synthesized
gcatccattttattcatgatga

SEQ ID NO: 669630 - DNA, 22 bp, Artificial Sequence
  chemically synthesized
ggcatccattttattcatgatg

SEQ ID NO: 669631 - DNA, 22 bp, Artificial Sequence
  chemically synthesized
tggcatccattttattcatgat

SEQ ID NO: 669632 - DNA, 22 bp, Artificial Sequence
  chemically synthesized
taataatcatcatgaataaaat

SEQ ID NO: 669633 - DNA, 22 bp, Artificial Sequence
  chemically synthesized
attttggcatccattttattca

SEQ ID NO: 669634 - DNA, 22 bp, Artificial Sequence
  chemically synthesized
ataatcatcatgaataaaatgg

SEQ ID NO: 669635 - DNA, 22 bp, Artificial Sequence
  chemically synthesized
tggttcattttggcatccattt

SEQ ID NO: 669636 - DNA, 22 bp, Artificial Sequence
  chemically synthesized
ctgtggttcattttggcatcca

SEQ ID NO: 669637 - DNA, 22 bp, Artificial Sequence
  chemically synthesized
tactgtggttcattttggcatc

SEQ ID NO: 669638 - DNA, 22 bp, Artificial Sequence
  chemically synthesized
ctactgtggttcattttggcat

SEQ ID NO: 669639 - DNA, 22 bp, Artificial Sequence
  chemically synthesized
atttctactgtggttcattttg

SEQ ID NO: 669640 - DNA, 22 bp, Artificial Sequence
  chemically synthesized
aggttaatttctactgtggttc

SEQ ID NO: 669641 - DNA, 22 bp, Artificial Sequence
  chemically synthesized
ccatggtaactaaggttaattt

SEQ ID NO: 669642 - DNA, 22 bp, Artificial Sequence
  chemically synthesized
cccatggtaactaaggttaatt

SEQ ID NO: 669643 - DNA, 22 bp, Artificial Sequence
  chemically synthesized
tcccatggtaactaaggttaat

SEQ ID NO: 669644 - DNA, 22 bp, Artificial Sequence
  chemically synthesized
ttcccatggtaactaaggttaa

SEQ ID NO: 669645 - DNA, 22 bp, Artificial Sequence
  chemically synthesized
cttttcccatggtaactaaggt

SEQ ID NO: 669646 - DNA, 22 bp, Artificial Sequence
  chemically synthesized
gcttttcccatggtaactaagg

SEQ ID NO: 669647 - DNA, 22 bp, Artificial Sequence
  chemically synthesized
accttagttaccatgggaaaag

SEQ ID NO: 669648 - DNA, 22 bp, Artificial Sequence
  chemically synthesized
caagaaggtcagtttgcttttc

SEQ ID NO: 669649 - DNA, 22 bp, Artificial Sequence
  chemically synthesized
agttaccatgggaaaagcaaac

SEQ ID NO: 669650 - DNA, 22 bp, Artificial Sequence
  chemically synthesized
gcaagaaggtcagtttgctttt

SEQ ID NO: 669651 - DNA, 22 bp, Artificial Sequence
  chemically synthesized
gttaccatgggaaaagcaaact

SEQ ID NO: 669652 - DNA, 22 bp, Artificial Sequence
  chemically synthesized
tgcaagaaggtcagtttgcttt

SEQ ID NO: 669653 - DNA, 22 bp, Artificial Sequence
  chemically synthesized
ttgcaagaaggtcagtttgctt

SEQ ID NO: 669654 - DNA, 22 bp, Artificial Sequence
  chemically synthesized
tttgcaagaaggtcagtttgct

SEQ ID NO: 669655 - DNA, 22 bp, Artificial Sequence
  chemically synthesized
ccatgggaaaagcaaactgacc

SEQ ID NO: 669656 - DNA, 22 bp, Artificial Sequence
  chemically synthesized
caaaaatgttttttgcaagaag

SEQ ID NO: 669657 - DNA, 22 bp, Artificial Sequence
  chemically synthesized
accttcttgcaaaaaacatttt

SEQ ID NO: 669658 - DNA, 22 bp, Artificial Sequence
  chemically synthesized
agacagaaatgttgcaaaaatg

SEQ ID NO: 669659 - DNA, 22 bp, Artificial Sequence
  chemically synthesized
cttgcaaaaaacatttttgcaa

SEQ ID NO: 669660 - DNA, 22 bp, Artificial Sequence
  chemically synthesized
ttgcaaaaaacatttttgcaac

SEQ ID NO: 669661 - DNA, 22 bp, Artificial Sequence
  chemically synthesized
gcaaaaaacatttttgcaacat

SEQ ID NO: 669662 - DNA, 22 bp, Artificial Sequence
  chemically synthesized
caaaaaacatttttgcaacatt

SEQ ID NO: 669663 - DNA, 22 bp, Artificial Sequence
  chemically synthesized
ttgcaacatttctgtcttaggc

SEQ ID NO: 669664 - DNA, 22 bp, Artificial Sequence
  chemically synthesized
tgcaacatttctgtcttaggct

SEQ ID NO: 669665 - DNA, 22 bp, Artificial Sequence
  chemically synthesized
gcaacatttctgtcttaggctg

SEQ ID NO: 669666 - DNA, 22 bp, Artificial Sequence
  chemically synthesized
caacatttctgtcttaggctgg

SEQ ID NO: 669667 - DNA, 22 bp, Artificial Sequence
  chemically synthesized
ctgtcttaggctggtatgcatg

SEQ ID NO: 669668 - DNA, 22 bp, Artificial Sequence
  chemically synthesized
atgaggtgaaagcatgcatacc

SEQ ID NO: 669669 - DNA, 22 bp, Artificial Sequence
  chemically synthesized
tgtcttaggctggtatgcatgc

SEQ ID NO: 669670 - DNA, 22 bp, Artificial Sequence
  chemically synthesized
tcttaggctggtatgcatgctt

SEQ ID NO: 669671 - DNA, 22 bp, Artificial Sequence
  chemically synthesized
ctaatgaggtgaaagcatgcat

SEQ ID NO: 669672 - DNA, 22 bp, Artificial Sequence
  chemically synthesized
cctaatgaggtgaaagcatgca

SEQ ID NO: 669673 - DNA, 22 bp, Artificial Sequence
  chemically synthesized
tcctaatgaggtgaaagcatgc

SEQ ID NO: 669674 - DNA, 22 bp, Artificial Sequence
  chemically synthesized
aggctggtatgcatgctttcac

SEQ ID NO: 669675 - DNA, 22 bp, Artificial Sequence
  chemically synthesized
ggctggtatgcatgctttcacc

SEQ ID NO: 669676 - DNA, 22 bp, Artificial Sequence
  chemically synthesized
gtatgcatgctttcacctcatt

SEQ ID NO: 669677 - DNA, 22 bp, Artificial Sequence
  chemically synthesized
tcacctcattaggaaagataca

SEQ ID NO: 669678 - DNA, 22 bp, Artificial Sequence
  chemically synthesized
cacctcattaggaaagatacat

SEQ ID NO: 669679 - DNA, 22 bp, Artificial Sequence
  chemically synthesized
acctcattaggaaagatacatt

SEQ ID NO: 669680 - DNA, 22 bp, Artificial Sequence
  chemically synthesized
attaggaaagatacattgtttg

SEQ ID NO: 669681 - DNA, 22 bp, Artificial Sequence
  chemically synthesized
ggaaagatacattgtttgggtt

SEQ ID NO: 669682 - DNA, 22 bp, Artificial Sequence
  chemically synthesized
aaacagcaacatcaacaaaacc

SEQ ID NO: 669683 - DNA, 22 bp, Artificial Sequence
  chemically synthesized
tcaaacagcaacatcaacaaaa

SEQ ID NO: 669684 - DNA, 22 bp, Artificial Sequence
  chemically synthesized
tttgggttttgttgatgttgct

SEQ ID NO: 669685 - DNA, 22 bp, Artificial Sequence
  chemically synthesized
cacctctcaaacagcaacatca

SEQ ID NO: 669686 - DNA, 22 bp, Artificial Sequence
  chemically synthesized
gcacctctcaaacagcaacatc

SEQ ID NO: 669687 - DNA, 22 bp, Artificial Sequence
  chemically synthesized
gggttttgttgatgttgctgtt

SEQ ID NO: 669688 - DNA, 22 bp, Artificial Sequence
  chemically synthesized
ttgcacctctcaaacagcaaca

SEQ ID NO: 669689 - DNA, 22 bp, Artificial Sequence
  chemically synthesized
ggttttgttgatgttgctgttt

SEQ ID NO: 669690 - DNA, 22 bp, Artificial Sequence
  chemically synthesized
cttgcacctctcaaacagcaac

SEQ ID NO: 669691 - DNA, 22 bp, Artificial Sequence
  chemically synthesized
ttcttgcacctctcaaacagca

SEQ ID NO: 669692 - DNA, 22 bp, Artificial Sequence
  chemically synthesized
tcttcttgcacctctcaaacag

SEQ ID NO: 669693 - DNA, 22 bp, Artificial Sequence
  chemically synthesized
tgttgatgttgctgtttgagag

SEQ ID NO: 669694 - DNA, 22 bp, Artificial Sequence
  chemically synthesized
gttgatgttgctgtttgagagg

SEQ ID NO: 669695 - DNA, 22 bp, Artificial Sequence
  chemically synthesized
ttgatgttgctgtttgagaggt

SEQ ID NO: 669696 - DNA, 22 bp, Artificial Sequence
  chemically synthesized
atgttgctgtttgagaggtgca

SEQ ID NO: 669697 - DNA, 22 bp, Artificial Sequence
  chemically synthesized
aacagattctcttcttgcacct

SEQ ID NO: 669698 - DNA, 22 bp, Artificial Sequence
  chemically synthesized
ctgtttgagaggtgcaagaaga

SEQ ID NO: 669699 - DNA, 22 bp, Artificial Sequence
  chemically synthesized
tttgagaggtgcaagaagagaa

SEQ ID NO: 669700 - DNA, 22 bp, Artificial Sequence
  chemically synthesized
gagaggtgcaagaagagaatct

SEQ ID NO: 669701 - DNA, 22 bp, Artificial Sequence
  chemically synthesized
agaggtgcaagaagagaatctg

SEQ ID NO: 669702 - DNA, 22 bp, Artificial Sequence
  chemically synthesized
atgcataaagactcaacagatt

SEQ ID NO: 669703 - DNA, 22 bp, Artificial Sequence
  chemically synthesized
ttcatgcataaagactcaacag

SEQ ID NO: 669704 - DNA, 22 bp, Artificial Sequence
  chemically synthesized
attattcatgcataaagactca

SEQ ID NO: 669705 - DNA, 22 bp, Artificial Sequence
  chemically synthesized
gactcattattcatgcataaag

SEQ ID NO: 669706 - DNA, 22 bp, Artificial Sequence
  chemically synthesized
ggactcattattcatgcataaa

SEQ ID NO: 669707 - DNA, 22 bp, Artificial Sequence
  chemically synthesized
tcttggactcattattcatgca

SEQ ID NO: 669708 - DNA, 22 bp, Artificial Sequence
  chemically synthesized
ttgagtctttatgcatgaataa

SEQ ID NO: 669709 - DNA, 22 bp, Artificial Sequence
  chemically synthesized
tatcttggactcattattcatg

SEQ ID NO: 669710 - DNA, 22 bp, Artificial Sequence
  chemically synthesized
agtctttatgcatgaataatga

SEQ ID NO: 669711 - DNA, 22 bp, Artificial Sequence
  chemically synthesized
tgttctatcttggactcattat

SEQ ID NO: 669712 - DNA, 22 bp, Artificial Sequence
  chemically synthesized
tatgcatgaataatgagtccaa

SEQ ID NO: 669713 - DNA, 22 bp, Artificial Sequence
  chemically synthesized
atgcatgaataatgagtccaag

SEQ ID NO: 669714 - DNA, 22 bp, Artificial Sequence
  chemically synthesized
tgcatgaataatgagtccaaga

SEQ ID NO: 669715 - DNA, 22 bp, Artificial Sequence
  chemically synthesized
aattgtgttctatcttggactc

SEQ ID NO: 669716 - DNA, 22 bp, Artificial Sequence
  chemically synthesized
gaattgtgttctatcttggact

SEQ ID NO: 669717 - DNA, 22 bp, Artificial Sequence
  chemically synthesized
aatatcttgaattgtgttctat

SEQ ID NO: 669718 - DNA, 22 bp, Artificial Sequence
  chemically synthesized
aaatatcttgaattgtgttcta

SEQ ID NO: 669719 - DNA, 22 bp, Artificial Sequence
  chemically synthesized
gatgcttaaatatcttgaattg

SEQ ID NO: 669720 - DNA, 22 bp, Artificial Sequence
  chemically synthesized
tgatcctagatgcttaaatatc

SEQ ID NO: 669721 - DNA, 22 bp, Artificial Sequence
  chemically synthesized
ctatgatcctagatgcttaaat

SEQ ID NO: 669722 - DNA, 22 bp, Artificial Sequence
  chemically synthesized
actatgatcctagatgcttaaa

SEQ ID NO: 669723 - DNA, 22 bp, Artificial Sequence
  chemically synthesized
aagatatttaagcatctaggat

SEQ ID NO: 669724 - DNA, 22 bp, Artificial Sequence
  chemically synthesized
aagcatctaggatcatagtaaa

SEQ ID NO: 669725 - DNA, 22 bp, Artificial Sequence
  chemically synthesized
agcatctaggatcatagtaaac

SEQ ID NO: 669726 - DNA, 22 bp, Artificial Sequence
  chemically synthesized
ggatcatagtaaactatgcgta

SEQ ID NO: 669727 - DNA, 22 bp, Artificial Sequence
  chemically synthesized
gagtatacaaaaagcagagata

SEQ ID NO: 669728 - DNA, 22 bp, Artificial Sequence
  chemically synthesized
tgctagagtatacaaaaagcag

SEQ ID NO: 669729 - DNA, 22 bp, Artificial Sequence
  chemically synthesized
tgcgtatctctgctttttgtat

SEQ ID NO: 669730 - DNA, 22 bp, Artificial Sequence
  chemically synthesized
ttatgctagagtatacaaaaag

SEQ ID NO: 669731 - DNA, 22 bp, Artificial Sequence
  chemically synthesized
tgttatgctagagtatacaaaa

SEQ ID NO: 669732 - DNA, 22 bp, Artificial Sequence
  chemically synthesized
ctgttatgctagagtatacaaa

SEQ ID NO: 669733 - DNA, 22 bp, Artificial Sequence
  chemically synthesized
ttctgttatgctagagtataca

SEQ ID NO: 669734 - DNA, 22 bp, Artificial Sequence
  chemically synthesized
tgctttttgtatactctagcat

SEQ ID NO: 669735 - DNA, 22 bp, Artificial Sequence
  chemically synthesized
ccctcttctgttatgctagagt

SEQ ID NO: 669736 - DNA, 22 bp, Artificial Sequence
  chemically synthesized
ctttttgtatactctagcataa

SEQ ID NO: 669737 - DNA, 22 bp, Artificial Sequence
  chemically synthesized
ttcccctcttctgttatgctag

SEQ ID NO: 669738 - DNA, 22 bp, Artificial Sequence
  chemically synthesized
tttgtatactctagcataacag

SEQ ID NO: 669739 - DNA, 22 bp, Artificial Sequence
  chemically synthesized
ttgtatactctagcataacaga

SEQ ID NO: 669740 - DNA, 22 bp, Artificial Sequence
  chemically synthesized
tgtatactctagcataacagaa

SEQ ID NO: 669741 - DNA, 22 bp, Artificial Sequence
  chemically synthesized
gtatactctagcataacagaag

SEQ ID NO: 669742 - DNA, 22 bp, Artificial Sequence
  chemically synthesized
tatactctagcataacagaaga

SEQ ID NO: 669743 - DNA, 22 bp, Artificial Sequence
  chemically synthesized
tagcataacagaagaggggaac

SEQ ID NO: 669744 - DNA, 22 bp, Artificial Sequence
  chemically synthesized
agtcataccacctgttcccctc

SEQ ID NO: 669745 - DNA, 22 bp, Artificial Sequence
  chemically synthesized
gcataacagaagaggggaacag

SEQ ID NO: 669746 - DNA, 22 bp, Artificial Sequence
  chemically synthesized
gagtcataccacctgttcccct

SEQ ID NO: 669747 - DNA, 22 bp, Artificial Sequence
  chemically synthesized
catgcatgggcaatttgagtca

SEQ ID NO: 669748 - DNA, 22 bp, Artificial Sequence
  chemically synthesized
tgcatgcatgggcaatttgagt

SEQ ID NO: 669749 - DNA, 22 bp, Artificial Sequence
  chemically synthesized
ctgcatgcatgggcaatttgag

SEQ ID NO: 669750 - DNA, 22 bp, Artificial Sequence
  chemically synthesized
tcacatgcttctgcatgcatgg

SEQ ID NO: 669751 - DNA, 22 bp, Artificial Sequence
  chemically synthesized
tatcacatgcttctgcatgcat

SEQ ID NO: 669752 - DNA, 22 bp, Artificial Sequence
  chemically synthesized
tctatcacatgcttctgcatgc

SEQ ID NO: 669753 - DNA, 22 bp, Artificial Sequence
  chemically synthesized
aaattgcccatgcatgcagaag

SEQ ID NO: 669754 - DNA, 22 bp, Artificial Sequence
  chemically synthesized
cccatgcatgcagaagcatgtg

SEQ ID NO: 669755 - DNA, 22 bp, Artificial Sequence
  chemically synthesized
acacataacagtgaaaagaaaa

SEQ ID NO: 669756 - DNA, 22 bp, Artificial Sequence
  chemically synthesized
cagaaaagttaacacataacag

SEQ ID NO: 669757 - DNA, 22 bp, Artificial Sequence
  chemically synthesized
tcttttcactgttatgtgttaa

SEQ ID NO: 669758 - DNA, 22 bp, Artificial Sequence
  chemically synthesized
cttttcactgttatgtgttaac

SEQ ID NO: 669759 - DNA, 22 bp, Artificial Sequence
  chemically synthesized
gtctccagaaaagttaacacat

SEQ ID NO: 669760 - DNA, 22 bp, Artificial Sequence
  chemically synthesized
ttttcactgttatgtgttaact

SEQ ID NO: 669761 - DNA, 22 bp, Artificial Sequence
  chemically synthesized
ttcactgttatgtgttaacttt

SEQ ID NO: 669762 - DNA, 22 bp, Artificial Sequence
  chemically synthesized
tcactgttatgtgttaactttt

SEQ ID NO: 669763 - DNA, 22 bp, Artificial Sequence
  chemically synthesized
cactgttatgtgttaacttttc

SEQ ID NO: 669764 - DNA, 22 bp, Artificial Sequence
  chemically synthesized
actgttatgtgttaacttttct

SEQ ID NO: 669765 - DNA, 22 bp, Artificial Sequence
  chemically synthesized
gcatctagtctccagaaaagtt

SEQ ID NO: 669766 - DNA, 22 bp, Artificial Sequence
  chemically synthesized
ttatgtgttaacttttctggag

SEQ ID NO: 669767 - DNA, 22 bp, Artificial Sequence
  chemically synthesized
tgtgttaacttttctggagact

SEQ ID NO: 669768 - DNA, 22 bp, Artificial Sequence
  chemically synthesized
atcattagcatctagtctccag

SEQ ID NO: 669769 - DNA, 22 bp, Artificial Sequence
  chemically synthesized
acttttctggagactagatgct

SEQ ID NO: 669770 - DNA, 22 bp, Artificial Sequence
  chemically synthesized
ttctggagactagatgctaatg

SEQ ID NO: 669771 - DNA, 22 bp, Artificial Sequence
  chemically synthesized
tctggagactagatgctaatga

SEQ ID NO: 669772 - DNA, 22 bp, Artificial Sequence
  chemically synthesized
agcaggatctcatcattagcat

SEQ ID NO: 669773 - DNA, 22 bp, Artificial Sequence
  chemically synthesized
ctggagactagatgctaatgat

SEQ ID NO: 669774 - DNA, 22 bp, Artificial Sequence
  chemically synthesized
cagcaggatctcatcattagca

SEQ ID NO: 669775 - DNA, 22 bp, Artificial Sequence
  chemically synthesized
tggagactagatgctaatgatg

SEQ ID NO: 669776 - DNA, 22 bp, Artificial Sequence
  chemically synthesized
gagactagatgctaatgatgag

SEQ ID NO: 669777 - DNA, 22 bp, Artificial Sequence
  chemically synthesized
gtgtcttcagcaggatctcatc

SEQ ID NO: 669778 - DNA, 22 bp, Artificial Sequence
  chemically synthesized
gatgctaatgatgagatcctgc

SEQ ID NO: 669779 - DNA, 22 bp, Artificial Sequence
  chemically synthesized
catattagtgtcttcagcagga

SEQ ID NO: 669780 - DNA, 22 bp, Artificial Sequence
  chemically synthesized
acatattagtgtcttcagcagg

SEQ ID NO: 669781 - DNA, 22 bp, Artificial Sequence
  chemically synthesized
atgatgagatcctgctgaagac

SEQ ID NO: 669782 - DNA, 22 bp, Artificial Sequence
  chemically synthesized
aggaatgatttacatattagtg

SEQ ID NO: 669783 - DNA, 22 bp, Artificial Sequence
  chemically synthesized
aaggaatgatttacatattagt

SEQ ID NO: 669784 - DNA, 22 bp, Artificial Sequence
  chemically synthesized
tttaaggaatgatttacatatt

SEQ ID NO: 669785 - DNA, 22 bp, Artificial Sequence
  chemically synthesized
ctgaagacactaatatgtaaat

SEQ ID NO: 669786 - DNA, 22 bp, Artificial Sequence
  chemically synthesized
gtttaaggaatgatttacatat

SEQ ID NO: 669787 - DNA, 22 bp, Artificial Sequence
  chemically synthesized
tgtttaaggaatgatttacata

SEQ ID NO: 669788 - DNA, 22 bp, Artificial Sequence
  chemically synthesized
aagacactaatatgtaaatcat

SEQ ID NO: 669789 - DNA, 22 bp, Artificial Sequence
  chemically synthesized
agtaattttgtttaaggaatga

SEQ ID NO: 669790 - DNA, 22 bp, Artificial Sequence
  chemically synthesized
atatgtaaatcattccttaaac

SEQ ID NO: 669791 - DNA, 22 bp, Artificial Sequence
  chemically synthesized
ctaagtaattttgtttaaggaa

SEQ ID NO: 669792 - DNA, 22 bp, Artificial Sequence
  chemically synthesized
cagctgctaagtaattttgttt

SEQ ID NO: 669793 - DNA, 22 bp, Artificial Sequence
  chemically synthesized
cttaaacaaaattacttagcag

SEQ ID NO: 669794 - DNA, 22 bp, Artificial Sequence
  chemically synthesized
tcataactgcagctgctaagta

SEQ ID NO: 669795 - DNA, 22 bp, Artificial Sequence
  chemically synthesized
atcataactgcagctgctaagt

SEQ ID NO: 669796 - DNA, 22 bp, Artificial Sequence
  chemically synthesized
tatcataactgcagctgctaag

SEQ ID NO: 669797 - DNA, 22 bp, Artificial Sequence
  chemically synthesized
aaacaaaattacttagcagctg

SEQ ID NO: 669798 - DNA, 22 bp, Artificial Sequence
  chemically synthesized
aacaaaattacttagcagctgc

SEQ ID NO: 669799 - DNA, 22 bp, Artificial Sequence
  chemically synthesized
ttttatcataactgcagctgct

SEQ ID NO: 669800 - DNA, 22 bp, Artificial Sequence
  chemically synthesized
attttatcataactgcagctgc

SEQ ID NO: 669801 - DNA, 22 bp, Artificial Sequence
  chemically synthesized
atttattttatcataactgcag

SEQ ID NO: 669802 - DNA, 22 bp, Artificial Sequence
  chemically synthesized
cttagcagctgcagttatgata

SEQ ID NO: 669803 - DNA, 22 bp, Artificial Sequence
  chemically synthesized
ccattgatttattttatcataa

SEQ ID NO: 669804 - DNA, 22 bp, Artificial Sequence
  chemically synthesized
agcagctgcagttatgataaaa

SEQ ID NO: 669805 - DNA, 22 bp, Artificial Sequence
  chemically synthesized
gcagctgcagttatgataaaat

SEQ ID NO: 669806 - DNA, 22 bp, Artificial Sequence
  chemically synthesized
ctaccattgatttattttatca

SEQ ID NO: 669807 - DNA, 22 bp, Artificial Sequence
  chemically synthesized
cagttatgataaaataaatcaa

SEQ ID NO: 669808 - DNA, 22 bp, Artificial Sequence
  chemically synthesized
atgaaaatctcctaccattgat

SEQ ID NO: 669809 - DNA, 22 bp, Artificial Sequence
  chemically synthesized
tgataaaataaatcaatggtag

SEQ ID NO: 669810 - DNA, 22 bp, Artificial Sequence
  chemically synthesized
tctaatgaaaatctcctaccat

SEQ ID NO: 669811 - DNA, 22 bp, Artificial Sequence
  chemically synthesized
tgtcagagggccaggcagtcca

SEQ ID NO: 669812 - DNA, 22 bp, Artificial Sequence
  chemically synthesized
tcattagataatggactgcctg

SEQ ID NO: 669813 - DNA, 22 bp, Artificial Sequence
  chemically synthesized
cattagataatggactgcctgg

SEQ ID NO: 669814 - DNA, 22 bp, Artificial Sequence
  chemically synthesized
attagataatggactgcctggc

SEQ ID NO: 669815 - DNA, 22 bp, Artificial Sequence
  chemically synthesized
agtctatgtcagagggccaggc

SEQ ID NO: 669816 - DNA, 22 bp, Artificial Sequence
  chemically synthesized
gataatggactgcctggccctc

SEQ ID NO: 669817 - DNA, 22 bp, Artificial Sequence
  chemically synthesized
aaagcacctcagtctatgtcag

SEQ ID NO: 669818 - DNA, 22 bp, Artificial Sequence
  chemically synthesized
cctggccctctgacatagactg

SEQ ID NO: 669819 - DNA, 22 bp, Artificial Sequence
  chemically synthesized
ttaaaagcacctcagtctatgt

SEQ ID NO: 669820 - DNA, 22 bp, Artificial Sequence
  chemically synthesized
attaaaagcacctcagtctatg

SEQ ID NO: 669821 - DNA, 22 bp, Artificial Sequence
  chemically synthesized
tattaaaagcacctcagtctat

SEQ ID NO: 669822 - DNA, 22 bp, Artificial Sequence
  chemically synthesized
gccctctgacatagactgaggt

SEQ ID NO: 669823 - DNA, 22 bp, Artificial Sequence
  chemically synthesized
tgacatagactgaggtgctttt

SEQ ID NO: 669824 - DNA, 22 bp, Artificial Sequence
  chemically synthesized
acatagactgaggtgcttttaa

SEQ ID NO: 669825 - DNA, 22 bp, Artificial Sequence
  chemically synthesized
aggcatcctttattaaaagcac

SEQ ID NO: 669826 - DNA, 22 bp, Artificial Sequence
  chemically synthesized
caggcatcctttattaaaagca

SEQ ID NO: 669827 - DNA, 22 bp, Artificial Sequence
  chemically synthesized
aggtgcttttaataaaggatgc

SEQ ID NO: 669828 - DNA, 22 bp, Artificial Sequence
  chemically synthesized
ttaataaaggatgcctgaagcg

SEQ ID NO: 669829 - DNA, 22 bp, Artificial Sequence
  chemically synthesized
taataaaggatgcctgaagcgt

SEQ ID NO: 669830 - DNA, 22 bp, Artificial Sequence
  chemically synthesized
aataaaggatgcctgaagcgtt

SEQ ID NO: 669831 - DNA, 22 bp, Artificial Sequence
  chemically synthesized
ataaaggatgcctgaagcgttc

SEQ ID NO: 669832 - DNA, 22 bp, Artificial Sequence
  chemically synthesized
tccagatacacagagggtaaac

SEQ ID NO: 669833 - DNA, 22 bp, Artificial Sequence
  chemically synthesized
aagcgttcctgtttaccctctg

SEQ ID NO: 669834 - DNA, 22 bp, Artificial Sequence
  chemically synthesized
ctgtttaccctctgtgtatctg

SEQ ID NO: 669835 - DNA, 22 bp, Artificial Sequence
  chemically synthesized
aaatgtattgtccagatacaca

SEQ ID NO: 669836 - DNA, 22 bp, Artificial Sequence
  chemically synthesized
tttaccctctgtgtatctggac

SEQ ID NO: 669837 - DNA, 22 bp, Artificial Sequence
  chemically synthesized
accctctgtgtatctggacaat

SEQ ID NO: 669838 - DNA, 22 bp, Artificial Sequence
  chemically synthesized
ccctctgtgtatctggacaata

SEQ ID NO: 669839 - DNA, 22 bp, Artificial Sequence
  chemically synthesized
cagattcaaatgtattgtccag

SEQ ID NO: 669840 - DNA, 22 bp, Artificial Sequence
  chemically synthesized
gttccagattcaaatgtattgt

SEQ ID NO: 669841 - DNA, 22 bp, Artificial Sequence
  chemically synthesized
tgtgtatctggacaatacattt

SEQ ID NO: 669842 - DNA, 22 bp, Artificial Sequence
  chemically synthesized
tgtatctggacaatacatttga

SEQ ID NO: 669843 - DNA, 22 bp, Artificial Sequence
  chemically synthesized
gacaatacatttgaatctggaa

SEQ ID NO: 669844 - DNA, 22 bp, Artificial Sequence
  chemically synthesized
ccggagtaccggtaatattggt

SEQ ID NO: 669845 - DNA, 22 bp, Artificial Sequence
  chemically synthesized
cccggagtaccggtaatattgg

SEQ ID NO: 669846 - DNA, 22 bp, Artificial Sequence
  chemically synthesized
tcccggagtaccggtaatattg

SEQ ID NO: 669847 - DNA, 22 bp, Artificial Sequence
  chemically synthesized
gaatctggaaccaatattaccg

SEQ ID NO: 669848 - DNA, 22 bp, Artificial Sequence
  chemically synthesized
aatctggaaccaatattaccgg

SEQ ID NO: 669849 - DNA, 22 bp, Artificial Sequence
  chemically synthesized
gaaccaatattaccggtactcc

SEQ ID NO: 669850 - DNA, 22 bp, Artificial Sequence
  chemically synthesized
ccggtactccgggaaaatactc

SEQ ID NO: 669851 - DNA, 22 bp, Artificial Sequence
  chemically synthesized
cgggaaaatactctttttattt

SEQ ID NO: 669852 - DNA, 22 bp, Artificial Sequence
  chemically synthesized
aaaaaaataaaaataaaataaa

SEQ ID NO: 669853 - DNA, 22 bp, Artificial Sequence
  chemically synthesized
cgtctaaaaaaaataaaaataa

SEQ ID NO: 669854 - DNA, 22 bp, Artificial Sequence
  chemically synthesized
tttttattttatttttattttt

SEQ ID NO: 669855 - DNA, 22 bp, Artificial Sequence
  chemically synthesized
tttattttatttttattttttt

SEQ ID NO: 669856 - DNA, 22 bp, Artificial Sequence
  chemically synthesized
ttattttatttttatttttttt

SEQ ID NO: 669857 - DNA, 22 bp, Artificial Sequence
  chemically synthesized
tattttatttttatttttttta

SEQ ID NO: 669858 - DNA, 22 bp, Artificial Sequence
  chemically synthesized
attttatttttattttttttag

SEQ ID NO: 669859 - DNA, 22 bp, Artificial Sequence
  chemically synthesized
ttttatttttattttttttaga

SEQ ID NO: 669860 - DNA, 22 bp, Artificial Sequence
  chemically synthesized
tatttttattttttttagacgg

SEQ ID NO: 669861 - DNA, 22 bp, Artificial Sequence
  chemically synthesized
atttttattttttttagacgga

SEQ ID NO: 669862 - DNA, 22 bp, Artificial Sequence
  chemically synthesized
tttttattttttttagacggag

SEQ ID NO: 669863 - DNA, 22 bp, Artificial Sequence
  chemically synthesized
ttattttttttagacggagtct

SEQ ID NO: 669864 - DNA, 22 bp, Artificial Sequence
  chemically synthesized
ggcgagagaatgagactccgtc

SEQ ID NO: 669865 - DNA, 22 bp, Artificial Sequence
  chemically synthesized
tattttttttagacggagtctc

SEQ ID NO: 669866 - DNA, 22 bp, Artificial Sequence
  chemically synthesized
attttttttagacggagtctca

SEQ ID NO: 669867 - DNA, 22 bp, Artificial Sequence
  chemically synthesized
ttttttttagacggagtctcat

SEQ ID NO: 669868 - DNA, 22 bp, Artificial Sequence
  chemically synthesized
tttttagacggagtctcattct

SEQ ID NO: 669869 - DNA, 22 bp, Artificial Sequence
  chemically synthesized
ttttagacggagtctcattctc

SEQ ID NO: 669870 - DNA, 22 bp, Artificial Sequence
  chemically synthesized
cagcctgggcgagagaatgaga

SEQ ID NO: 669871 - DNA, 22 bp, Artificial Sequence
  chemically synthesized
tttagacggagtctcattctct

SEQ ID NO: 669872 - DNA, 22 bp, Artificial Sequence
  chemically synthesized
ttagacggagtctcattctctc

SEQ ID NO: 669873 - DNA, 22 bp, Artificial Sequence
  chemically synthesized
tagacggagtctcattctctcg

SEQ ID NO: 669874 - DNA, 22 bp, Artificial Sequence
  chemically synthesized
agacggagtctcattctctcgc

SEQ ID NO: 669875 - DNA, 22 bp, Artificial Sequence
  chemically synthesized
gacggagtctcattctctcgcc

SEQ ID NO: 669876 - DNA, 22 bp, Artificial Sequence
  chemically synthesized
cattccagcctgggcgagagaa

SEQ ID NO: 669877 - DNA, 22 bp, Artificial Sequence
  chemically synthesized
attctctcgcccaggctggaat

SEQ ID NO: 669878 - DNA, 22 bp, Artificial Sequence
  chemically synthesized
tctcgcccaggctggaatgcag

SEQ ID NO: 669879 - DNA, 22 bp, Artificial Sequence
  chemically synthesized
tcgcccaggctggaatgcagtg

SEQ ID NO: 669880 - DNA, 22 bp, Artificial Sequence
  chemically synthesized
gcccaggctggaatgcagtggc

SEQ ID NO: 669881 - DNA, 22 bp, Artificial Sequence
  chemically synthesized
cagtgagccgagatcatgccac

SEQ ID NO: 669882 - DNA, 22 bp, Artificial Sequence
  chemically synthesized
gaatgcagtggcatgatctcgg

SEQ ID NO: 669883 - DNA, 22 bp, Artificial Sequence
  chemically synthesized
aacccaggaggcagaggttgca

SEQ ID NO: 669884 - DNA, 22 bp, Artificial Sequence
  chemically synthesized
gaacccaggaggcagaggttgc

SEQ ID NO: 669885 - DNA, 22 bp, Artificial Sequence
  chemically synthesized
ggctcactgcaacctctgcctc

SEQ ID NO: 669886 - DNA, 22 bp, Artificial Sequence
  chemically synthesized
actgcaacctctgcctcctggg

SEQ ID NO: 669887 - DNA, 22 bp, Artificial Sequence
  chemically synthesized
caacctctgcctcctgggttca

SEQ ID NO: 669888 - DNA, 22 bp, Artificial Sequence
  chemically synthesized
aggcacaagcatcacttgaacc

SEQ ID NO: 669889 - DNA, 22 bp, Artificial Sequence
  chemically synthesized
tgcctcctgggttcaagtgatg

SEQ ID NO: 669890 - DNA, 22 bp, Artificial Sequence
  chemically synthesized
cctcctgggttcaagtgatgct

SEQ ID NO: 669891 - DNA, 22 bp, Artificial Sequence
  chemically synthesized
ggaggctgaggcacaagcatca

SEQ ID NO: 669892 - DNA, 22 bp, Artificial Sequence
  chemically synthesized
ctgggttcaagtgatgcttgtg

SEQ ID NO: 669893 - DNA, 22 bp, Artificial Sequence
  chemically synthesized
gggaggctgaggcacaagcatc

SEQ ID NO: 669894 - DNA, 22 bp, Artificial Sequence
  chemically synthesized
ggttcaagtgatgcttgtgcct

SEQ ID NO: 669895 - DNA, 22 bp, Artificial Sequence
  chemically synthesized
cttgggaggctgaggcacaagc

SEQ ID NO: 669896 - DNA, 22 bp, Artificial Sequence
  chemically synthesized
aagtgatgcttgtgcctcagcc

SEQ ID NO: 669897 - DNA, 22 bp, Artificial Sequence
  chemically synthesized
taataccagctacttgggaggc

SEQ ID NO: 669898 - DNA, 22 bp, Artificial Sequence
  chemically synthesized
gtgcctcagcctcccaagtagc

SEQ ID NO: 669899 - DNA, 22 bp, Artificial Sequence
  chemically synthesized
tgcctcagcctcccaagtagct

SEQ ID NO: 669900 - DNA, 22 bp, Artificial Sequence
  chemically synthesized
agcctcccaagtagctggtatt

SEQ ID NO: 669901 - DNA, 22 bp, Artificial Sequence
  chemically synthesized
ccaagtagctggtattacaggt

SEQ ID NO: 669902 - DNA, 22 bp, Artificial Sequence
  chemically synthesized
ggcgtggtggtgggcacctgta

SEQ ID NO: 669903 - DNA, 22 bp, Artificial Sequence
  chemically synthesized
gctgggcgtggtggtgggcacc

SEQ ID NO: 669904 - DNA, 22 bp, Artificial Sequence
  chemically synthesized
gtattacaggtgcccaccacca

SEQ ID NO: 669905 - DNA, 22 bp, Artificial Sequence
  chemically synthesized
caggtgcccaccaccacgccca

SEQ ID NO: 669906 - DNA, 22 bp, Artificial Sequence
  chemically synthesized
aaaatatgaaaattagctgggc

SEQ ID NO: 669907 - DNA, 22 bp, Artificial Sequence
  chemically synthesized
ctaaaaatatgaaaattagctg

SEQ ID NO: 669908 - DNA, 22 bp, Artificial Sequence
  chemically synthesized
tactaaaaatatgaaaattagc

SEQ ID NO: 669909 - DNA, 22 bp, Artificial Sequence
  chemically synthesized
atctctactaaaaatatgaaaa

SEQ ID NO: 669910 - DNA, 22 bp, Artificial Sequence
  chemically synthesized
attttcatatttttagtagaga

SEQ ID NO: 669911 - DNA, 22 bp, Artificial Sequence
  chemically synthesized
tcatatttttagtagagatgag

SEQ ID NO: 669912 - DNA, 22 bp, Artificial Sequence
  chemically synthesized
catatttttagtagagatgagg

SEQ ID NO: 669913 - DNA, 22 bp, Artificial Sequence
  chemically synthesized
atatttttagtagagatgaggt

SEQ ID NO: 669914 - DNA, 22 bp, Artificial Sequence
  chemically synthesized
gccagcatggtgaaacctcatc

SEQ ID NO: 669915 - DNA, 22 bp, Artificial Sequence
  chemically synthesized
ttagtagagatgaggtttcacc

SEQ ID NO: 669916 - DNA, 22 bp, Artificial Sequence
  chemically synthesized
tagtagagatgaggtttcacca

SEQ ID NO: 669917 - DNA, 22 bp, Artificial Sequence
  chemically synthesized
agtagagatgaggtttcaccat

SEQ ID NO: 669918 - DNA, 22 bp, Artificial Sequence
  chemically synthesized
gtagagatgaggtttcaccatg

SEQ ID NO: 669919 - DNA, 22 bp, Artificial Sequence
  chemically synthesized
gagaccagcctggccagcatgg

SEQ ID NO: 669920 - DNA, 22 bp, Artificial Sequence
  chemically synthesized
caccatgctggccaggctggtc

SEQ ID NO: 669921 - DNA, 22 bp, Artificial Sequence
  chemically synthesized
accatgctggccaggctggtct

SEQ ID NO: 669922 - DNA, 22 bp, Artificial Sequence
  chemically synthesized
aggtcgggagttcgagaccagc

SEQ ID NO: 669923 - DNA, 22 bp, Artificial Sequence
  chemically synthesized
gaggtcgggagttcgagaccag

SEQ ID NO: 669924 - DNA, 22 bp, Artificial Sequence
  chemically synthesized
gccaggctggtctcgaactccc

SEQ ID NO: 669925 - DNA, 22 bp, Artificial Sequence
  chemically synthesized
gtctcgaactcccgacctcaag

SEQ ID NO: 669926 - DNA, 22 bp, Artificial Sequence
  chemically synthesized
gaactcccgacctcaagtgatc

SEQ ID NO: 669927 - DNA, 22 bp, Artificial Sequence
  chemically synthesized
ggaggccaaggcaggcagatca

SEQ ID NO: 669928 - DNA, 22 bp, Artificial Sequence
  chemically synthesized
ccgacctcaagtgatctgcctg

SEQ ID NO: 669929 - DNA, 22 bp, Artificial Sequence
  chemically synthesized
gggaggccaaggcaggcagatc

SEQ ID NO: 669930 - DNA, 22 bp, Artificial Sequence
  chemically synthesized
tgggaggccaaggcaggcagat

SEQ ID NO: 669931 - DNA, 22 bp, Artificial Sequence
  chemically synthesized
aagtgatctgcctgccttggcc

SEQ ID NO: 669932 - DNA, 22 bp, Artificial Sequence
  chemically synthesized
agcactttgggaggccaaggca

SEQ ID NO: 669933 - DNA, 22 bp, Artificial Sequence
  chemically synthesized
taatctcagcactttgggaggc

SEQ ID NO: 669934 - DNA, 22 bp, Artificial Sequence
  chemically synthesized
cctgccttggcctcccaaagtg

SEQ ID NO: 669935 - DNA, 22 bp, Artificial Sequence
  chemically synthesized
ccttggcctcccaaagtgctga

SEQ ID NO: 669936 - DNA, 22 bp, Artificial Sequence
  chemically synthesized
acgcctgtaatctcagcacttt

SEQ ID NO: 669937 - DNA, 22 bp, Artificial Sequence
  chemically synthesized
ggcctcccaaagtgctgagatt

SEQ ID NO: 669938 - DNA, 22 bp, Artificial Sequence
  chemically synthesized
gcctcccaaagtgctgagatta

SEQ ID NO: 669939 - DNA, 22 bp, Artificial Sequence
  chemically synthesized
ccaaagtgctgagattacaggc

SEQ ID NO: 669940 - DNA, 22 bp, Artificial Sequence
  chemically synthesized
ggcacaatagttcacgcctgta

SEQ ID NO: 669941 - DNA, 22 bp, Artificial Sequence
  chemically synthesized
aaggctgggcacaatagttcac

SEQ ID NO: 669942 - DNA, 22 bp, Artificial Sequence
  chemically synthesized
agattacaggcgtgaactattg

SEQ ID NO: 669943 - DNA, 22 bp, Artificial Sequence
  chemically synthesized
caaggctgggcacaatagttca

SEQ ID NO: 669944 - DNA, 22 bp, Artificial Sequence
  chemically synthesized
tcaaggctgggcacaatagttc

SEQ ID NO: 669945 - DNA, 22 bp, Artificial Sequence
  chemically synthesized
ttcaaggctgggcacaatagtt

SEQ ID NO: 669946 - DNA, 22 bp, Artificial Sequence
  chemically synthesized
caggcgtgaactattgtgccca

SEQ ID NO: 669947 - DNA, 22 bp, Artificial Sequence
  chemically synthesized
ttgtgcccagccttgaaaagac

SEQ ID NO: 669948 - DNA, 22 bp, Artificial Sequence
  chemically synthesized
tgcccagccttgaaaagactct

SEQ ID NO: 669949 - DNA, 22 bp, Artificial Sequence
  chemically synthesized
aggtgataaagaagagtctttt

SEQ ID NO: 669950 - DNA, 22 bp, Artificial Sequence
  chemically synthesized
gaggtgataaagaagagtcttt

SEQ ID NO: 669951 - DNA, 22 bp, Artificial Sequence
  chemically synthesized
tgaggtgataaagaagagtctt

SEQ ID NO: 669952 - DNA, 22 bp, Artificial Sequence
  chemically synthesized
gaaaagactcttctttatcacc

SEQ ID NO: 669953 - DNA, 22 bp, Artificial Sequence
  chemically synthesized
aaaagactcttctttatcacct

SEQ ID NO: 669954 - DNA, 22 bp, Artificial Sequence
  chemically synthesized
ccaaatgcagcatagttttgag

SEQ ID NO: 669955 - DNA, 22 bp, Artificial Sequence
  chemically synthesized
ttctttatcacctcaaaactat

SEQ ID NO: 669956 - DNA, 22 bp, Artificial Sequence
  chemically synthesized
ctttatcacctcaaaactatgc

SEQ ID NO: 669957 - DNA, 22 bp, Artificial Sequence
  chemically synthesized
tttatcacctcaaaactatgct

SEQ ID NO: 669958 - DNA, 22 bp, Artificial Sequence
  chemically synthesized
tatcacctcaaaactatgctgc

SEQ ID NO: 669959 - DNA, 22 bp, Artificial Sequence
  chemically synthesized
atcacctcaaaactatgctgca

SEQ ID NO: 669960 - DNA, 22 bp, Artificial Sequence
  chemically synthesized
tcacctcaaaactatgctgcat

SEQ ID NO: 669961 - DNA, 22 bp, Artificial Sequence
  chemically synthesized
tatcaagcaactcccaaatgca

SEQ ID NO: 669962 - DNA, 22 bp, Artificial Sequence
  chemically synthesized
atatcaagcaactcccaaatgc

SEQ ID NO: 669963 - DNA, 22 bp, Artificial Sequence
  chemically synthesized
aaaactatgctgcatttgggag

SEQ ID NO: 669964 - DNA, 22 bp, Artificial Sequence
  chemically synthesized
tatatcaagcaactcccaaatg

SEQ ID NO: 669965 - DNA, 22 bp, Artificial Sequence
  chemically synthesized
tgctgcatttgggagttgcttg

SEQ ID NO: 669966 - DNA, 22 bp, Artificial Sequence
  chemically synthesized
gtaaagctttatatcaagcaac

SEQ ID NO: 669967 - DNA, 22 bp, Artificial Sequence
  chemically synthesized
catttgggagttgcttgatata

SEQ ID NO: 669968 - DNA, 22 bp, Artificial Sequence
  chemically synthesized
aaattggtaaagctttatatca

SEQ ID NO: 669969 - DNA, 22 bp, Artificial Sequence
  chemically synthesized
caaattggtaaagctttatatc

SEQ ID NO: 669970 - DNA, 22 bp, Artificial Sequence
  chemically synthesized
gggagttgcttgatataaagct

SEQ ID NO: 669971 - DNA, 22 bp, Artificial Sequence
  chemically synthesized
ggagttgcttgatataaagctt

SEQ ID NO: 669972 - DNA, 22 bp, Artificial Sequence
  chemically synthesized
aatcttcaaattggtaaagctt

SEQ ID NO: 669973 - DNA, 22 bp, Artificial Sequence
  chemically synthesized
cttgatataaagctttaccaat

SEQ ID NO: 669974 - DNA, 22 bp, Artificial Sequence
  chemically synthesized
gattgaatcttcaaattggtaa

SEQ ID NO: 669975 - DNA, 22 bp, Artificial Sequence
  chemically synthesized
gatataaagctttaccaatttg

SEQ ID NO: 669976 - DNA, 22 bp, Artificial Sequence
  chemically synthesized
ggattgaatcttcaaattggta

SEQ ID NO: 669977 - DNA, 22 bp, Artificial Sequence
  chemically synthesized
atataaagctttaccaatttga

SEQ ID NO: 669978 - DNA, 22 bp, Artificial Sequence
  chemically synthesized
ttggattgaatcttcaaattgg

SEQ ID NO: 669979 - DNA, 22 bp, Artificial Sequence
  chemically synthesized
cccgattcttggattgaatctt

SEQ ID NO: 669980 - DNA, 22 bp, Artificial Sequence
  chemically synthesized
taccaatttgaagattcaatcc

SEQ ID NO: 669981 - DNA, 22 bp, Artificial Sequence
  chemically synthesized
accaatttgaagattcaatcca

SEQ ID NO: 669982 - DNA, 22 bp, Artificial Sequence
  chemically synthesized
ccaatttgaagattcaatccaa

SEQ ID NO: 669983 - DNA, 22 bp, Artificial Sequence
  chemically synthesized
agagtctgcccgattcttggat

SEQ ID NO: 669984 - DNA, 22 bp, Artificial Sequence
  chemically synthesized
gaagattcaatccaagaatcgg

SEQ ID NO: 669985 - DNA, 22 bp, Artificial Sequence
  chemically synthesized
aagattcaatccaagaatcggg

SEQ ID NO: 669986 - DNA, 22 bp, Artificial Sequence
  chemically synthesized
aatccaagaatcgggcagactc

SEQ ID NO: 669987 - DNA, 22 bp, Artificial Sequence
  chemically synthesized
agggccatccatgaggtgggca

SEQ ID NO: 669988 - DNA, 22 bp, Artificial Sequence
  chemically synthesized
cagggccatccatgaggtgggc

SEQ ID NO: 669989 - DNA, 22 bp, Artificial Sequence
  chemically synthesized
tgagttcctctgcccacctcat

SEQ ID NO: 669990 - DNA, 22 bp, Artificial Sequence
  chemically synthesized
agttcctctgcccacctcatgg

SEQ ID NO: 669991 - DNA, 22 bp, Artificial Sequence
  chemically synthesized
tgacttcagggccatccatgag

SEQ ID NO: 669992 - DNA, 22 bp, Artificial Sequence
  chemically synthesized
ctctgcccacctcatggatggc

SEQ ID NO: 669993 - DNA, 22 bp, Artificial Sequence
  chemically synthesized
ctgtgacttcagggccatccat

SEQ ID NO: 669994 - DNA, 22 bp, Artificial Sequence
  chemically synthesized
tgcccacctcatggatggccct

SEQ ID NO: 669995 - DNA, 22 bp, Artificial Sequence
  chemically synthesized
cccacctcatggatggccctga

SEQ ID NO: 669996 - DNA, 22 bp, Artificial Sequence
  chemically synthesized
actcctgtgacttcagggccat

SEQ ID NO: 669997 - DNA, 22 bp, Artificial Sequence
  chemically synthesized
atggatggccctgaagtcacag

SEQ ID NO: 669998 - DNA, 22 bp, Artificial Sequence
  chemically synthesized
aagtcacaggagtgagtttgcc

SEQ ID NO: 669999 - DNA, 22 bp, Artificial Sequence
  chemically synthesized
agaggagaaagaaggcaaactc

SEQ ID NO: 670000 - DNA, 22 bp, Artificial Sequence
  chemically synthesized
ccactgagaggagaaagaaggc

SEQ ID NO: 670001 - DNA, 22 bp, Artificial Sequence
  chemically synthesized
gccttctttctcctctcagtgg

SEQ ID NO: 670002 - DNA, 22 bp, Artificial Sequence
  chemically synthesized
ccttctttctcctctcagtggc

SEQ ID NO: 670003 - DNA, 22 bp, Artificial Sequence
  chemically synthesized
ctttctcctctcagtggcaatg

SEQ ID NO: 670004 - DNA, 22 bp, Artificial Sequence
  chemically synthesized
tttctcctctcagtggcaatga

SEQ ID NO: 670005 - DNA, 22 bp, Artificial Sequence
  chemically synthesized
tctcctctcagtggcaatgacc

SEQ ID NO: 670006 - DNA, 22 bp, Artificial Sequence
  chemically synthesized
ctcctctcagtggcaatgacca

SEQ ID NO: 670007 - DNA, 22 bp, Artificial Sequence
  chemically synthesized
tcctctcagtggcaatgaccac

SEQ ID NO: 670008 - DNA, 22 bp, Artificial Sequence
  chemically synthesized
ctctcagtggcaatgaccacgg

SEQ ID NO: 670009 - DNA, 22 bp, Artificial Sequence
  chemically synthesized
tcagtggcaatgaccacggatt

SEQ ID NO: 670010 - DNA, 22 bp, Artificial Sequence
  chemically synthesized
agtggcaatgaccacggattcc

SEQ ID NO: 670011 - DNA, 22 bp, Artificial Sequence
  chemically synthesized
tgaagtaggaggcaatccaaaa

SEQ ID NO: 670012 - DNA, 22 bp, Artificial Sequence
  chemically synthesized
ctatgaagtaggaggcaatcca

SEQ ID NO: 670013 - DNA, 22 bp, Artificial Sequence
  chemically synthesized
cttgtcttttggattgcctcct

SEQ ID NO: 670014 - DNA, 22 bp, Artificial Sequence
  chemically synthesized
tctgctatgaagtaggaggcaa

SEQ ID NO: 670015 - DNA, 22 bp, Artificial Sequence
  chemically synthesized
gtcttttggattgcctcctact

SEQ ID NO: 670016 - DNA, 22 bp, Artificial Sequence
  chemically synthesized
tcttttggattgcctcctactt

SEQ ID NO: 670017 - DNA, 22 bp, Artificial Sequence
  chemically synthesized
ttggattgcctcctacttcata

SEQ ID NO: 670018 - DNA, 22 bp, Artificial Sequence
  chemically synthesized
tggattgcctcctacttcatag

SEQ ID NO: 670019 - DNA, 22 bp, Artificial Sequence
  chemically synthesized
ggattgcctcctacttcatagc

SEQ ID NO: 670020 - DNA, 22 bp, Artificial Sequence
  chemically synthesized
gattgcctcctacttcatagca

SEQ ID NO: 670021 - DNA, 22 bp, Artificial Sequence
  chemically synthesized
cctcctacttcatagcagacag

SEQ ID NO: 670022 - DNA, 22 bp, Artificial Sequence
  chemically synthesized
ctacttcatagcagacagggct

SEQ ID NO: 670023 - DNA, 22 bp, Artificial Sequence
  chemically synthesized
cttcatagcagacagggctcat

SEQ ID NO: 670024 - DNA, 22 bp, Artificial Sequence
  chemically synthesized
catagcagacagggctcattcc

SEQ ID NO: 670025 - DNA, 22 bp, Artificial Sequence
  chemically synthesized
atagcagacagggctcattccc

SEQ ID NO: 670026 - DNA, 22 bp, Artificial Sequence
  chemically synthesized
attccccctttctctgcctctc

SEQ ID NO: 670027 - DNA, 22 bp, Artificial Sequence
  chemically synthesized
cccctttctctgcctctctgtt

SEQ ID NO: 670028 - DNA, 22 bp, Artificial Sequence
  chemically synthesized
aggtgagaagtgagagaaacag

SEQ ID NO: 670029 - DNA, 22 bp, Artificial Sequence
  chemically synthesized
tctctgcctctctgtttctctc

SEQ ID NO: 670030 - DNA, 22 bp, Artificial Sequence
  chemically synthesized
ctctgcctctctgtttctctca

SEQ ID NO: 670031 - DNA, 22 bp, Artificial Sequence
  chemically synthesized
tctgcctctctgtttctctcac

SEQ ID NO: 670032 - DNA, 22 bp, Artificial Sequence
  chemically synthesized
tgcctctctgtttctctcactt

SEQ ID NO: 670033 - DNA, 22 bp, Artificial Sequence
  chemically synthesized
cctctctgtttctctcacttct

SEQ ID NO: 670034 - DNA, 22 bp, Artificial Sequence
  chemically synthesized
tctgtttctctcacttctcacc

SEQ ID NO: 670035 - DNA, 22 bp, Artificial Sequence
  chemically synthesized
aaaagaaagctgaggtgagaag

SEQ ID NO: 670036 - DNA, 22 bp, Artificial Sequence
  chemically synthesized
tgtttctctcacttctcacctc

SEQ ID NO: 670037 - DNA, 22 bp, Artificial Sequence
  chemically synthesized
tttctctcacttctcacctcag

SEQ ID NO: 670038 - DNA, 22 bp, Artificial Sequence
  chemically synthesized
ctctcacttctcacctcagctt

SEQ ID NO: 670039 - DNA, 22 bp, Artificial Sequence
  chemically synthesized
tctcacttctcacctcagcttt

SEQ ID NO: 670040 - DNA, 22 bp, Artificial Sequence
  chemically synthesized
tcacttctcacctcagctttct

SEQ ID NO: 670041 - DNA, 22 bp, Artificial Sequence
  chemically synthesized
acttctcacctcagctttcttt

SEQ ID NO: 670042 - DNA, 22 bp, Artificial Sequence
  chemically synthesized
ctcacctcagctttcttttcaa

SEQ ID NO: 670043 - DNA, 22 bp, Artificial Sequence
  chemically synthesized
tcacctcagctttcttttcaac

SEQ ID NO: 670044 - DNA, 22 bp, Artificial Sequence
  chemically synthesized
acctcagctttcttttcaacac

SEQ ID NO: 670045 - DNA, 22 bp, Artificial Sequence
  chemically synthesized
ggtcagatccagtgtgttgaaa

SEQ ID NO: 670046 - DNA, 22 bp, Artificial Sequence
  chemically synthesized
agctttcttttcaacacactgg

SEQ ID NO: 670047 - DNA, 22 bp, Artificial Sequence
  chemically synthesized
tcttttcaacacactggatctg

SEQ ID NO: 670048 - DNA, 22 bp, Artificial Sequence
  chemically synthesized
cttttcaacacactggatctga

SEQ ID NO: 670049 - DNA, 22 bp, Artificial Sequence
  chemically synthesized
ttttcaacacactggatctgac

SEQ ID NO: 670050 - DNA, 22 bp, Artificial Sequence
  chemically synthesized
ttcaacacactggatctgaccc

SEQ ID NO: 670051 - DNA, 22 bp, Artificial Sequence
  chemically synthesized
tcaacacactggatctgaccca

SEQ ID NO: 670052 - DNA, 22 bp, Artificial Sequence
  chemically synthesized
caacacactggatctgacccag

SEQ ID NO: 670053 - DNA, 22 bp, Artificial Sequence
  chemically synthesized
aacacactggatctgacccagc

SEQ ID NO: 670054 - DNA, 22 bp, Artificial Sequence
  chemically synthesized
aggagaataaaagctgggtcag

SEQ ID NO: 670055 - DNA, 22 bp, Artificial Sequence
  chemically synthesized
tgaggagaataaaagctgggtc

SEQ ID NO: 670056 - DNA, 22 bp, Artificial Sequence
  chemically synthesized
gatctgacccagcttttattct

SEQ ID NO: 670057 - DNA, 22 bp, Artificial Sequence
  chemically synthesized
tccaggattctgaggagaataa

SEQ ID NO: 670058 - DNA, 22 bp, Artificial Sequence
  chemically synthesized
gtccaggattctgaggagaata

SEQ ID NO: 670059 - DNA, 22 bp, Artificial Sequence
  chemically synthesized
tgtccaggattctgaggagaat

SEQ ID NO: 670060 - DNA, 22 bp, Artificial Sequence
  chemically synthesized
acccagcttttattctcctcag

SEQ ID NO: 670061 - DNA, 22 bp, Artificial Sequence
  chemically synthesized
aagtagttttgtccaggattct

SEQ ID NO: 670062 - DNA, 22 bp, Artificial Sequence
  chemically synthesized
ttattctcctcagaatcctgga

SEQ ID NO: 670063 - DNA, 22 bp, Artificial Sequence
  chemically synthesized
tattctcctcagaatcctggac

SEQ ID NO: 670064 - DNA, 22 bp, Artificial Sequence
  chemically synthesized
attctcctcagaatcctggaca

SEQ ID NO: 670065 - DNA, 22 bp, Artificial Sequence
  chemically synthesized
ttctcctcagaatcctggacaa

SEQ ID NO: 670066 - DNA, 22 bp, Artificial Sequence
  chemically synthesized
tcctcaagtagttttgtccagg

SEQ ID NO: 670067 - DNA, 22 bp, Artificial Sequence
  chemically synthesized
atcctcaagtagttttgtccag

SEQ ID NO: 670068 - DNA, 22 bp, Artificial Sequence
  chemically synthesized
tcctcagaatcctggacaaaac

SEQ ID NO: 670069 - DNA, 22 bp, Artificial Sequence
  chemically synthesized
ctcagaatcctggacaaaacta

SEQ ID NO: 670070 - DNA, 22 bp, Artificial Sequence
  chemically synthesized
ggtttatcctcaagtagttttg

SEQ ID NO: 670071 - DNA, 22 bp, Artificial Sequence
  chemically synthesized
agaatcctggacaaaactactt

SEQ ID NO: 670072 - DNA, 22 bp, Artificial Sequence
  chemically synthesized
aggtttatcctcaagtagtttt

SEQ ID NO: 670073 - DNA, 22 bp, Artificial Sequence
  chemically synthesized
taggtttatcctcaagtagttt

SEQ ID NO: 670074 - DNA, 22 bp, Artificial Sequence
  chemically synthesized
ctttaggtttatcctcaagtag

SEQ ID NO: 670075 - DNA, 22 bp, Artificial Sequence
  chemically synthesized
gacaaaactacttgaggataaa

SEQ ID NO: 670076 - DNA, 22 bp, Artificial Sequence
  chemically synthesized
ggaaaaaagggctgctttaggt

SEQ ID NO: 670077 - DNA, 22 bp, Artificial Sequence
  chemically synthesized
cttgaggataaacctaaagcag

SEQ ID NO: 670078 - DNA, 22 bp, Artificial Sequence
  chemically synthesized
aggaaaaaagggctgctttagg

SEQ ID NO: 670079 - DNA, 22 bp, Artificial Sequence
  chemically synthesized
gaggataaacctaaagcagccc

SEQ ID NO: 670080 - DNA, 22 bp, Artificial Sequence
  chemically synthesized
aggataaacctaaagcagccct

SEQ ID NO: 670081 - DNA, 22 bp, Artificial Sequence
  chemically synthesized
catcttaggaaaaaagggctgc

SEQ ID NO: 670082 - DNA, 22 bp, Artificial Sequence
  chemically synthesized
aagcagcccttttttcctaaga

SEQ ID NO: 670083 - DNA, 22 bp, Artificial Sequence
  chemically synthesized
aagtaagagtcacctacatctt

SEQ ID NO: 670084 - DNA, 22 bp, Artificial Sequence
  chemically synthesized
ttttcctaagatgtaggtgact

SEQ ID NO: 670085 - DNA, 22 bp, Artificial Sequence
  chemically synthesized
tttcctaagatgtaggtgactc

SEQ ID NO: 670086 - DNA, 22 bp, Artificial Sequence
  chemically synthesized
ttcctaagatgtaggtgactct

SEQ ID NO: 670087 - DNA, 22 bp, Artificial Sequence
  chemically synthesized
tcctaagatgtaggtgactctt

SEQ ID NO: 670088 - DNA, 22 bp, Artificial Sequence
  chemically synthesized
cctaagatgtaggtgactctta

SEQ ID NO: 670089 - DNA, 22 bp, Artificial Sequence
  chemically synthesized
ctaagatgtaggtgactcttac

SEQ ID NO: 670090 - DNA, 22 bp, Artificial Sequence
  chemically synthesized
agatgtaggtgactcttacttc

SEQ ID NO: 670091 - DNA, 22 bp, Artificial Sequence
  chemically synthesized
catacaaaaagagctgaagtaa

SEQ ID NO: 670092 - DNA, 22 bp, Artificial Sequence
  chemically synthesized
gcatacaaaaagagctgaagta

SEQ ID NO: 670093 - DNA, 22 bp, Artificial Sequence
  chemically synthesized
ttacttcagctctttttgtatg

SEQ ID NO: 670094 - DNA, 22 bp, Artificial Sequence
  chemically synthesized
cagggaatacttgcatacaaaa

SEQ ID NO: 670095 - DNA, 22 bp, Artificial Sequence
  chemically synthesized
acttcagctctttttgtatgca

SEQ ID NO: 670096 - DNA, 22 bp, Artificial Sequence
  chemically synthesized
cttcagctctttttgtatgcaa

SEQ ID NO: 670097 - DNA, 22 bp, Artificial Sequence
  chemically synthesized
tacagggaatacttgcatacaa

SEQ ID NO: 670098 - DNA, 22 bp, Artificial Sequence
  chemically synthesized
cagctctttttgtatgcaagta

SEQ ID NO: 670099 - DNA, 22 bp, Artificial Sequence
  chemically synthesized
agctctttttgtatgcaagtat

SEQ ID NO: 670100 - DNA, 22 bp, Artificial Sequence
  chemically synthesized
gctctacagggaatacttgcat

SEQ ID NO: 670101 - DNA, 22 bp, Artificial Sequence
  chemically synthesized
ggctctacagggaatacttgca

SEQ ID NO: 670102 - DNA, 22 bp, Artificial Sequence
  chemically synthesized
tggctctacagggaatacttgc

SEQ ID NO: 670103 - DNA, 22 bp, Artificial Sequence
  chemically synthesized
tttggctctacagggaatactt

SEQ ID NO: 670104 - DNA, 22 bp, Artificial Sequence
  chemically synthesized
tttttgtatgcaagtattccct

SEQ ID NO: 670105 - DNA, 22 bp, Artificial Sequence
  chemically synthesized
tctttggctctacagggaatac

SEQ ID NO: 670106 - DNA, 22 bp, Artificial Sequence
  chemically synthesized
tttgtatgcaagtattccctgt

SEQ ID NO: 670107 - DNA, 22 bp, Artificial Sequence
  chemically synthesized
ctctttggctctacagggaata

SEQ ID NO: 670108 - DNA, 22 bp, Artificial Sequence
  chemically synthesized
ttgtatgcaagtattccctgta

SEQ ID NO: 670109 - DNA, 22 bp, Artificial Sequence
  chemically synthesized
tctctttggctctacagggaat

SEQ ID NO: 670110 - DNA, 22 bp, Artificial Sequence
  chemically synthesized
tgtatgcaagtattccctgtag

SEQ ID NO: 670111 - DNA, 22 bp, Artificial Sequence
  chemically synthesized
ttctctttggctctacagggaa

SEQ ID NO: 670112 - DNA, 22 bp, Artificial Sequence
  chemically synthesized
gtatgcaagtattccctgtaga

SEQ ID NO: 670113 - DNA, 22 bp, Artificial Sequence
  chemically synthesized
tatgcaagtattccctgtagag

SEQ ID NO: 670114 - DNA, 22 bp, Artificial Sequence
  chemically synthesized
cgtttttctctttggctctaca

SEQ ID NO: 670115 - DNA, 22 bp, Artificial Sequence
  chemically synthesized
ccgtttttctctttggctctac

SEQ ID NO: 670116 - DNA, 22 bp, Artificial Sequence
  chemically synthesized
tcacttccgtttttctctttgg

SEQ ID NO: 670117 - DNA, 22 bp, Artificial Sequence
  chemically synthesized
cctgtagagccaaagagaaaaa

SEQ ID NO: 670118 - DNA, 22 bp, Artificial Sequence
  chemically synthesized
tagagccaaagagaaaaacgga

SEQ ID NO: 670119 - DNA, 22 bp, Artificial Sequence
  chemically synthesized
ccatcggcctgtcacttccgtt

SEQ ID NO: 670120 - DNA, 22 bp, Artificial Sequence
  chemically synthesized
tgccatcggcctgtcacttccg

SEQ ID NO: 670121 - DNA, 22 bp, Artificial Sequence
  chemically synthesized
ctgccatcggcctgtcacttcc

SEQ ID NO: 670122 - DNA, 22 bp, Artificial Sequence
  chemically synthesized
cttctgccatcggcctgtcact

SEQ ID NO: 670123 - DNA, 22 bp, Artificial Sequence
  chemically synthesized
gtattccttctgccatcggcct

SEQ ID NO: 670124 - DNA, 22 bp, Artificial Sequence
  chemically synthesized
agcgaatgttagtattccttct

SEQ ID NO: 670125 - DNA, 22 bp, Artificial Sequence
  chemically synthesized
agtgctcagcgaatgttagtat

SEQ ID NO: 670126 - DNA, 22 bp, Artificial Sequence
  chemically synthesized
gagtgctcagcgaatgttagta

SEQ ID NO: 670127 - DNA, 22 bp, Artificial Sequence
  chemically synthesized
cccttgagtgctcagcgaatgt

SEQ ID NO: 670128 - DNA, 22 bp, Artificial Sequence
  chemically synthesized
gcccttgagtgctcagcgaatg

SEQ ID NO: 670129 - DNA, 22 bp, Artificial Sequence
  chemically synthesized
acattcgctgagcactcaaggg

SEQ ID NO: 670130 - DNA, 22 bp, Artificial Sequence
  chemically synthesized
gctgagcactcaagggcaaatg

SEQ ID NO: 670131 - DNA, 22 bp, Artificial Sequence
  chemically synthesized
agcactcaagggcaaatgtcgt

SEQ ID NO: 670132 - DNA, 22 bp, Artificial Sequence
  chemically synthesized
gatggtatcaggtacacacgac

SEQ ID NO: 670133 - DNA, 22 bp, Artificial Sequence
  chemically synthesized
aagggcaaatgtcgtgtgtacc

SEQ ID NO: 670134 - DNA, 22 bp, Artificial Sequence
  chemically synthesized
taaggactcgatggtatcaggt

SEQ ID NO: 670135 - DNA, 22 bp, Artificial Sequence
  chemically synthesized
gtaaggactcgatggtatcagg

SEQ ID NO: 670136 - DNA, 22 bp, Artificial Sequence
  chemically synthesized
agggccttgtaaggactcgatg

SEQ ID NO: 670137 - DNA, 22 bp, Artificial Sequence
  chemically synthesized
ataccatcgagtccttacaagg

SEQ ID NO: 670138 - DNA, 22 bp, Artificial Sequence
  chemically synthesized
ataatacagaactcagggcctt

SEQ ID NO: 670139 - DNA, 22 bp, Artificial Sequence
  chemically synthesized
acaaagctgataatacagaact

SEQ ID NO: 670140 - DNA, 22 bp, Artificial Sequence
  chemically synthesized
acaaggccctgagttctgtatt

SEQ ID NO: 670141 - DNA, 22 bp, Artificial Sequence
  chemically synthesized
aacaaagctgataatacagaac

SEQ ID NO: 670142 - DNA, 22 bp, Artificial Sequence
  chemically synthesized
caaggccctgagttctgtatta

SEQ ID NO: 670143 - DNA, 22 bp, Artificial Sequence
  chemically synthesized
taacaaagctgataatacagaa

SEQ ID NO: 670144 - DNA, 22 bp, Artificial Sequence
  chemically synthesized
tctttaacaaagctgataatac

SEQ ID NO: 670145 - DNA, 22 bp, Artificial Sequence
  chemically synthesized
atctttaacaaagctgataata

SEQ ID NO: 670146 - DNA, 22 bp, Artificial Sequence
  chemically synthesized
tatctttaacaaagctgataat

SEQ ID NO: 670147 - DNA, 22 bp, Artificial Sequence
  chemically synthesized
agttctgtattatcagctttgt

SEQ ID NO: 670148 - DNA, 22 bp, Artificial Sequence
  chemically synthesized
attttatctttaacaaagctga

SEQ ID NO: 670149 - DNA, 22 bp, Artificial Sequence
  chemically synthesized
tgtattatcagctttgttaaag

SEQ ID NO: 670150 - DNA, 22 bp, Artificial Sequence
  chemically synthesized
tattatcagctttgttaaagat

SEQ ID NO: 670151 - DNA, 22 bp, Artificial Sequence
  chemically synthesized
tgagcctcattttatctttaac

SEQ ID NO: 670152 - DNA, 22 bp, Artificial Sequence
  chemically synthesized
gtgagcctcattttatctttaa

SEQ ID NO: 670153 - DNA, 22 bp, Artificial Sequence
  chemically synthesized
tcagctttgttaaagataaaat

SEQ ID NO: 670154 - DNA, 22 bp, Artificial Sequence
  chemically synthesized
tgttaaagataaaatgaggctc

SEQ ID NO: 670155 - DNA, 22 bp, Artificial Sequence
  chemically synthesized
ccaaacatttgtgagcctcatt

SEQ ID NO: 670156 - DNA, 22 bp, Artificial Sequence
  chemically synthesized
gttaaagataaaatgaggctca

SEQ ID NO: 670157 - DNA, 22 bp, Artificial Sequence
  chemically synthesized
ttaaagataaaatgaggctcac

SEQ ID NO: 670158 - DNA, 22 bp, Artificial Sequence
  chemically synthesized
aagataaaatgaggctcacaaa

SEQ ID NO: 670159 - DNA, 22 bp, Artificial Sequence
  chemically synthesized
acaaatgtttggtaacttccct

SEQ ID NO: 670160 - DNA, 22 bp, Artificial Sequence
  chemically synthesized
ggatgcaaccgtagggaagtta

SEQ ID NO: 670161 - DNA, 22 bp, Artificial Sequence
  chemically synthesized
tgggatgcaaccgtagggaagt

SEQ ID NO: 670162 - DNA, 22 bp, Artificial Sequence
  chemically synthesized
ggtaacttccctacggttgcat

SEQ ID NO: 670163 - DNA, 22 bp, Artificial Sequence
  chemically synthesized
gtaacttccctacggttgcatc

SEQ ID NO: 670164 - DNA, 22 bp, Artificial Sequence
  chemically synthesized
aatgcaggctctgggatgcaac

SEQ ID NO: 670165 - DNA, 22 bp, Artificial Sequence
  chemically synthesized
gaatgcaggctctgggatgcaa

SEQ ID NO: 670166 - DNA, 22 bp, Artificial Sequence
  chemically synthesized
ccctacggttgcatcccagagc

SEQ ID NO: 670167 - DNA, 22 bp, Artificial Sequence
  chemically synthesized
cctacggttgcatcccagagcc

SEQ ID NO: 670168 - DNA, 22 bp, Artificial Sequence
  chemically synthesized
gtcttgaatgcaggctctggga

SEQ ID NO: 670169 - DNA, 22 bp, Artificial Sequence
  chemically synthesized
ggtcttgaatgcaggctctggg

SEQ ID NO: 670170 - DNA, 22 bp, Artificial Sequence
  chemically synthesized
cggttgcatcccagagcctgca

SEQ ID NO: 670171 - DNA, 22 bp, Artificial Sequence
  chemically synthesized
catcccagagcctgcattcaag

SEQ ID NO: 670172 - DNA, 22 bp, Artificial Sequence
  chemically synthesized
agtgtcagaaagatttggtctt

SEQ ID NO: 670173 - DNA, 22 bp, Artificial Sequence
  chemically synthesized
gagtgtcagaaagatttggtct

SEQ ID NO: 670174 - DNA, 22 bp, Artificial Sequence
  chemically synthesized
tgagtgtcagaaagatttggtc

SEQ ID NO: 670175 - DNA, 22 bp, Artificial Sequence
  chemically synthesized
cattcaagaccaaatctttctg

SEQ ID NO: 670176 - DNA, 22 bp, Artificial Sequence
  chemically synthesized
aagaccaaatctttctgacact

SEQ ID NO: 670177 - DNA, 22 bp, Artificial Sequence
  chemically synthesized
tctgacactcaaagcctctgat

SEQ ID NO: 670178 - DNA, 22 bp, Artificial Sequence
  chemically synthesized
ctgacactcaaagcctctgatg

SEQ ID NO: 670179 - DNA, 22 bp, Artificial Sequence
  chemically synthesized
tgacactcaaagcctctgatgg

SEQ ID NO: 670180 - DNA, 22 bp, Artificial Sequence
  chemically synthesized
acactcaaagcctctgatggcc

SEQ ID NO: 670181 - DNA, 22 bp, Artificial Sequence
  chemically synthesized
aaagcctctgatggccttcccc

SEQ ID NO: 670182 - DNA, 22 bp, Artificial Sequence
  chemically synthesized
tagcggagaagcggggaaggcc

SEQ ID NO: 670183 - DNA, 22 bp, Artificial Sequence
  chemically synthesized
tgtagcggagaagcggggaagg

SEQ ID NO: 670184 - DNA, 22 bp, Artificial Sequence
  chemically synthesized
ttctgtagcggagaagcgggga

SEQ ID NO: 670185 - DNA, 22 bp, Artificial Sequence
  chemically synthesized
gttctgtagcggagaagcgggg

SEQ ID NO: 670186 - DNA, 22 bp, Artificial Sequence
  chemically synthesized
tgatggccttccccgcttctcc

SEQ ID NO: 670187 - DNA, 22 bp, Artificial Sequence
  chemically synthesized
atggccttccccgcttctccgc

SEQ ID NO: 670188 - DNA, 22 bp, Artificial Sequence
  chemically synthesized
ccccgcttctccgctacagaac

SEQ ID NO: 670189 - DNA, 22 bp, Artificial Sequence
  chemically synthesized
cccgcttctccgctacagaaca

SEQ ID NO: 670190 - DNA, 22 bp, Artificial Sequence
  chemically synthesized
ggtaaggaaagacatttgttct

SEQ ID NO: 670191 - DNA, 22 bp, Artificial Sequence
  chemically synthesized
ctccgctacagaacaaatgtct

SEQ ID NO: 670192 - DNA, 22 bp, Artificial Sequence
  chemically synthesized
tccgctacagaacaaatgtctt

SEQ ID NO: 670193 - DNA, 22 bp, Artificial Sequence
  chemically synthesized
cactgggtaaggaaagacattt

SEQ ID NO: 670194 - DNA, 22 bp, Artificial Sequence
  chemically synthesized
cgctacagaacaaatgtctttc

SEQ ID NO: 670195 - DNA, 22 bp, Artificial Sequence
  chemically synthesized
cagaacaaatgtctttccttac

SEQ ID NO: 670196 - DNA, 22 bp, Artificial Sequence
  chemically synthesized
ggattacactgggtaaggaaag

SEQ ID NO: 670197 - DNA, 22 bp, Artificial Sequence
  chemically synthesized
attaggattacactgggtaagg

SEQ ID NO: 670198 - DNA, 22 bp, Artificial Sequence
  chemically synthesized
tgctaattaggattacactggg

SEQ ID NO: 670199 - DNA, 22 bp, Artificial Sequence
  chemically synthesized
gtgctaattaggattacactgg

SEQ ID NO: 670200 - DNA, 22 bp, Artificial Sequence
  chemically synthesized
tccttacccagtgtaatcctaa

SEQ ID NO: 670201 - DNA, 22 bp, Artificial Sequence
  chemically synthesized
ccttacccagtgtaatcctaat

SEQ ID NO: 670202 - DNA, 22 bp, Artificial Sequence
  chemically synthesized
acccttgtgctaattaggatta

SEQ ID NO: 670203 - DNA, 22 bp, Artificial Sequence
  chemically synthesized
cttacccagtgtaatcctaatt

SEQ ID NO: 670204 - DNA, 22 bp, Artificial Sequence
  chemically synthesized
acccagtgtaatcctaattagc

SEQ ID NO: 670205 - DNA, 22 bp, Artificial Sequence
  chemically synthesized
cccagtgtaatcctaattagca

SEQ ID NO: 670206 - DNA, 22 bp, Artificial Sequence
  chemically synthesized
cccattcacccttgtgctaatt

SEQ ID NO: 670207 - DNA, 22 bp, Artificial Sequence
  chemically synthesized
ctgcccattcacccttgtgcta

SEQ ID NO: 670208 - DNA, 22 bp, Artificial Sequence
  chemically synthesized
agggtactactgcccattcacc

SEQ ID NO: 670209 - DNA, 22 bp, Artificial Sequence
  chemically synthesized
attagcacaagggtgaatgggc

SEQ ID NO: 670210 - DNA, 22 bp, Artificial Sequence
  chemically synthesized
tgagggtactactgcccattca

SEQ ID NO: 670211 - DNA, 22 bp, Artificial Sequence
  chemically synthesized
ctgagggtactactgcccattc

SEQ ID NO: 670212 - DNA, 22 bp, Artificial Sequence
  chemically synthesized
gcacaagggtgaatgggcagta

SEQ ID NO: 670213 - DNA, 22 bp, Artificial Sequence
  chemically synthesized
ttctgagggtactactgcccat

SEQ ID NO: 670214 - DNA, 22 bp, Artificial Sequence
  chemically synthesized
cccggtatcatggttcttctga

SEQ ID NO: 670215 - DNA, 22 bp, Artificial Sequence
  chemically synthesized
gcccggtatcatggttcttctg

SEQ ID NO: 670216 - DNA, 22 bp, Artificial Sequence
  chemically synthesized
cttgcccggtatcatggttctt

SEQ ID NO: 670217 - DNA, 22 bp, Artificial Sequence
  chemically synthesized
ctccttgcccggtatcatggtt

SEQ ID NO: 670218 - DNA, 22 bp, Artificial Sequence
  chemically synthesized
tgctccttgcccggtatcatgg

SEQ ID NO: 670219 - DNA, 22 bp, Artificial Sequence
  chemically synthesized
agaagaaccatgataccgggca

SEQ ID NO: 670220 - DNA, 22 bp, Artificial Sequence
  chemically synthesized
accccataccctctgctccttg

SEQ ID NO: 670221 - DNA, 22 bp, Artificial Sequence
  chemically synthesized
cctcaccccataccctctgctc

SEQ ID NO: 670222 - DNA, 22 bp, Artificial Sequence
  chemically synthesized
tgcctcaccccataccctctgc

SEQ ID NO: 670223 - DNA, 22 bp, Artificial Sequence
  chemically synthesized
ctgcctcaccccataccctctg

SEQ ID NO: 670224 - DNA, 22 bp, Artificial Sequence
  chemically synthesized
tgcaagggtttctgcctcaccc

SEQ ID NO: 670225 - DNA, 22 bp, Artificial Sequence
  chemically synthesized
gtgcaagggtttctgcctcacc

SEQ ID NO: 670226 - DNA, 22 bp, Artificial Sequence
  chemically synthesized
tggtccttgtgcaagggtttct

SEQ ID NO: 670227 - DNA, 22 bp, Artificial Sequence
  chemically synthesized
cctgtggtccttgtgcaagggt

SEQ ID NO: 670228 - DNA, 22 bp, Artificial Sequence
  chemically synthesized
cctccctgtggtccttgtgcaa

SEQ ID NO: 670229 - DNA, 22 bp, Artificial Sequence
  chemically synthesized
ccctccctgtggtccttgtgca

SEQ ID NO: 670230 - DNA, 22 bp, Artificial Sequence
  chemically synthesized
gtcagtttccctccctgtggtc

SEQ ID NO: 670231 - DNA, 22 bp, Artificial Sequence
  chemically synthesized
actggtcagtttccctccctgt

SEQ ID NO: 670232 - DNA, 22 bp, Artificial Sequence
  chemically synthesized
gcacaaggaccacagggaggga

SEQ ID NO: 670233 - DNA, 22 bp, Artificial Sequence
  chemically synthesized
cacaaggaccacagggagggaa

SEQ ID NO: 670234 - DNA, 22 bp, Artificial Sequence
  chemically synthesized
atcccattgactggtcagtttc

SEQ ID NO: 670235 - DNA, 22 bp, Artificial Sequence
  chemically synthesized
cctcatcccattgactggtcag

SEQ ID NO: 670236 - DNA, 22 bp, Artificial Sequence
  chemically synthesized
gtcactccctcatcccattgac

SEQ ID NO: 670237 - DNA, 22 bp, Artificial Sequence
  chemically synthesized
ctggtcactccctcatcccatt

SEQ ID NO: 670238 - DNA, 22 bp, Artificial Sequence
  chemically synthesized
accagtcaatgggatgagggag

SEQ ID NO: 670239 - DNA, 22 bp, Artificial Sequence
  chemically synthesized
cattcctggtcactccctcatc

SEQ ID NO: 670240 - DNA, 22 bp, Artificial Sequence
  chemically synthesized
gttacattcctggtcactccct

SEQ ID NO: 670241 - DNA, 22 bp, Artificial Sequence
  chemically synthesized
gtctagttacattcctggtcac

SEQ ID NO: 670242 - DNA, 22 bp, Artificial Sequence
  chemically synthesized
ttggtctagttacattcctggt

SEQ ID NO: 670243 - DNA, 22 bp, Artificial Sequence
  chemically synthesized
atcattattggtctagttacat

SEQ ID NO: 670244 - DNA, 22 bp, Artificial Sequence
  chemically synthesized
catcattattggtctagttaca

SEQ ID NO: 670245 - DNA, 22 bp, Artificial Sequence
  chemically synthesized
ggaacttcatcattattggtct

SEQ ID NO: 670246 - DNA, 22 bp, Artificial Sequence
  chemically synthesized
gaccaataatgatgaagttccc

SEQ ID NO: 670247 - DNA, 22 bp, Artificial Sequence
  chemically synthesized
gataaggaggactgggaacttc

SEQ ID NO: 670248 - DNA, 22 bp, Artificial Sequence
  chemically synthesized
tagataaggaggactgggaact

SEQ ID NO: 670249 - DNA, 22 bp, Artificial Sequence
  chemically synthesized
tctagataaggaggactgggaa

SEQ ID NO: 670250 - DNA, 22 bp, Artificial Sequence
  chemically synthesized
ctctagataaggaggactggga

SEQ ID NO: 670251 - DNA, 22 bp, Artificial Sequence
  chemically synthesized
agcaaacttctctagataagga

SEQ ID NO: 670252 - DNA, 22 bp, Artificial Sequence
  chemically synthesized
ttcagcaaacttctctagataa

SEQ ID NO: 670253 - DNA, 22 bp, Artificial Sequence
  chemically synthesized
ccagtcctccttatctagagaa

SEQ ID NO: 670254 - DNA, 22 bp, Artificial Sequence
  chemically synthesized
attattcagcaaacttctctag

SEQ ID NO: 670255 - DNA, 22 bp, Artificial Sequence
  chemically synthesized
cttatctagagaagtttgctga

SEQ ID NO: 670256 - DNA, 22 bp, Artificial Sequence
  chemically synthesized
caggtgttgattattcagcaaa

SEQ ID NO: 670257 - DNA, 22 bp, Artificial Sequence
  chemically synthesized
atctagagaagtttgctgaata

SEQ ID NO: 670258 - DNA, 22 bp, Artificial Sequence
  chemically synthesized
tctagagaagtttgctgaataa

SEQ ID NO: 670259 - DNA, 22 bp, Artificial Sequence
  chemically synthesized
gagaagtttgctgaataatcaa

SEQ ID NO: 670260 - DNA, 22 bp, Artificial Sequence
  chemically synthesized
gtactgcaggtgttgattattc

SEQ ID NO: 670261 - DNA, 22 bp, Artificial Sequence
  chemically synthesized
gctgaataatcaacacctgcag

SEQ ID NO: 670262 - DNA, 22 bp, Artificial Sequence
  chemically synthesized
ctgaataatcaacacctgcagt

SEQ ID NO: 670263 - DNA, 22 bp, Artificial Sequence
  chemically synthesized
aataatcaacacctgcagtacg

SEQ ID NO: 670264 - DNA, 22 bp, Artificial Sequence
  chemically synthesized
taggaaaaatggtagaaactcg

SEQ ID NO: 670265 - DNA, 22 bp, Artificial Sequence
  chemically synthesized
gtaggaaaaatggtagaaactc

SEQ ID NO: 670266 - DNA, 22 bp, Artificial Sequence
  chemically synthesized
tgtaggaaaaatggtagaaact

SEQ ID NO: 670267 - DNA, 22 bp, Artificial Sequence
  chemically synthesized
ttgtaggaaaaatggtagaaac

SEQ ID NO: 670268 - DNA, 22 bp, Artificial Sequence
  chemically synthesized
cagtacgagtttctaccatttt

SEQ ID NO: 670269 - DNA, 22 bp, Artificial Sequence
  chemically synthesized
ctaccatttttcctacaaaagt

SEQ ID NO: 670270 - DNA, 22 bp, Artificial Sequence
  chemically synthesized
tgggagcaaaaaacttttgtag

SEQ ID NO: 670271 - DNA, 22 bp, Artificial Sequence
  chemically synthesized
taccatttttcctacaaaagtt

SEQ ID NO: 670272 - DNA, 22 bp, Artificial Sequence
  chemically synthesized
tatgggagcaaaaaacttttgt

SEQ ID NO: 670273 - DNA, 22 bp, Artificial Sequence
  chemically synthesized
ccatttttcctacaaaagtttt

SEQ ID NO: 670274 - DNA, 22 bp, Artificial Sequence
  chemically synthesized
ctatgggagcaaaaaacttttg

SEQ ID NO: 670275 - DNA, 22 bp, Artificial Sequence
  chemically synthesized
ttcctacaaaagttttttgctc

SEQ ID NO: 670276 - DNA, 22 bp, Artificial Sequence
  chemically synthesized
tcctacaaaagttttttgctcc

SEQ ID NO: 670277 - DNA, 22 bp, Artificial Sequence
  chemically synthesized
tatgtttctatgggagcaaaaa

SEQ ID NO: 670278 - DNA, 22 bp, Artificial Sequence
  chemically synthesized
cctacaaaagttttttgctccc

SEQ ID NO: 670279 - DNA, 22 bp, Artificial Sequence
  chemically synthesized
ctacaaaagttttttgctccca

SEQ ID NO: 670280 - DNA, 22 bp, Artificial Sequence
  chemically synthesized
caaaagttttttgctcccatag

SEQ ID NO: 670281 - DNA, 22 bp, Artificial Sequence
  chemically synthesized
tttgctcccatagaaacataca

SEQ ID NO: 670282 - DNA, 22 bp, Artificial Sequence
  chemically synthesized
ttgctcccatagaaacatacag

SEQ ID NO: 670283 - DNA, 22 bp, Artificial Sequence
  chemically synthesized
tgctcccatagaaacatacagc

SEQ ID NO: 670284 - DNA, 22 bp, Artificial Sequence
  chemically synthesized
gctcccatagaaacatacagct

SEQ ID NO: 670285 - DNA, 22 bp, Artificial Sequence
  chemically synthesized
ctcccatagaaacatacagctg

SEQ ID NO: 670286 - DNA, 22 bp, Artificial Sequence
  chemically synthesized
ccatagaaacatacagctgctt

SEQ ID NO: 670287 - DNA, 22 bp, Artificial Sequence
  chemically synthesized
caccatgtaaatagaaagcagc

SEQ ID NO: 670288 - DNA, 22 bp, Artificial Sequence
  chemically synthesized
atatactgcaccatgtaaatag

SEQ ID NO: 670289 - DNA, 22 bp, Artificial Sequence
  chemically synthesized
ctttctatttacatggtgcagt

SEQ ID NO: 670290 - DNA, 22 bp, Artificial Sequence
  chemically synthesized
agagtgcctgatatactgcacc

SEQ ID NO: 670291 - DNA, 22 bp, Artificial Sequence
  chemically synthesized
tctatttacatggtgcagtata

SEQ ID NO: 670292 - DNA, 22 bp, Artificial Sequence
  chemically synthesized
ctatttacatggtgcagtatat

SEQ ID NO: 670293 - DNA, 22 bp, Artificial Sequence
  chemically synthesized
tatttacatggtgcagtatatc

SEQ ID NO: 670294 - DNA, 22 bp, Artificial Sequence
  chemically synthesized
tttacatggtgcagtatatcag

SEQ ID NO: 670295 - DNA, 22 bp, Artificial Sequence
  chemically synthesized
accctcagagtgcctgatatac

SEQ ID NO: 670296 - DNA, 22 bp, Artificial Sequence
  chemically synthesized
acatggtgcagtatatcaggca

SEQ ID NO: 670297 - DNA, 22 bp, Artificial Sequence
  chemically synthesized
catggtgcagtatatcaggcac

SEQ ID NO: 670298 - DNA, 22 bp, Artificial Sequence
  chemically synthesized
gttaaccctcagagtgcctgat

SEQ ID NO: 670299 - DNA, 22 bp, Artificial Sequence
  chemically synthesized
agttaaccctcagagtgcctga

SEQ ID NO: 670300 - DNA, 22 bp, Artificial Sequence
  chemically synthesized
agtcacagaatcttagttaacc

SEQ ID NO: 670301 - DNA, 22 bp, Artificial Sequence
  chemically synthesized
tgagggttaactaagattctgt

SEQ ID NO: 670302 - DNA, 22 bp, Artificial Sequence
  chemically synthesized
ggtccctaagtcacagaatctt

SEQ ID NO: 670303 - DNA, 22 bp, Artificial Sequence
  chemically synthesized
agggttaactaagattctgtga

SEQ ID NO: 670304 - DNA, 22 bp, Artificial Sequence
  chemically synthesized
actaagattctgtgacttaggg

SEQ ID NO: 670305 - DNA, 22 bp, Artificial Sequence
  chemically synthesized
agattctgtgacttagggacct

SEQ ID NO: 670306 - DNA, 22 bp, Artificial Sequence
  chemically synthesized
taaatggtggttaggtccctaa

SEQ ID NO: 670307 - DNA, 22 bp, Artificial Sequence
  chemically synthesized
tgtgacttagggacctaaccac

SEQ ID NO: 670308 - DNA, 22 bp, Artificial Sequence
  chemically synthesized
tgacttagggacctaaccacca

SEQ ID NO: 670309 - DNA, 22 bp, Artificial Sequence
  chemically synthesized
agggacctaaccaccatttata

SEQ ID NO: 670310 - DNA, 22 bp, Artificial Sequence
  chemically synthesized
gggacctaaccaccatttataa

SEQ ID NO: 670311 - DNA, 22 bp, Artificial Sequence
  chemically synthesized
gaatgaaatgtgttataaatgg

SEQ ID NO: 670312 - DNA, 22 bp, Artificial Sequence
  chemically synthesized
ggaatgaaatgtgttataaatg

SEQ ID NO: 670313 - DNA, 22 bp, Artificial Sequence
  chemically synthesized
accaccatttataacacatttc

SEQ ID NO: 670314 - DNA, 22 bp, Artificial Sequence
  chemically synthesized
catacaatttggaatgaaatgt

SEQ ID NO: 670315 - DNA, 22 bp, Artificial Sequence
  chemically synthesized
ataacacatttcattccaaatt

SEQ ID NO: 670316 - DNA, 22 bp, Artificial Sequence
  chemically synthesized
taacacatttcattccaaattg

SEQ ID NO: 670317 - DNA, 22 bp, Artificial Sequence
  chemically synthesized
taagtcagttgcatacaatttg

SEQ ID NO: 670318 - DNA, 22 bp, Artificial Sequence
  chemically synthesized
gtaagtcagttgcatacaattt

SEQ ID NO: 670319 - DNA, 22 bp, Artificial Sequence
  chemically synthesized
tttgtaagtcagttgcatacaa

SEQ ID NO: 670320 - DNA, 22 bp, Artificial Sequence
  chemically synthesized
atttgtaagtcagttgcataca

SEQ ID NO: 670321 - DNA, 22 bp, Artificial Sequence
  chemically synthesized
cattccaaattgtatgcaactg

SEQ ID NO: 670322 - DNA, 22 bp, Artificial Sequence
  chemically synthesized
attccaaattgtatgcaactga

SEQ ID NO: 670323 - DNA, 22 bp, Artificial Sequence
  chemically synthesized
caaattgtatgcaactgactta

SEQ ID NO: 670324 - DNA, 22 bp, Artificial Sequence
  chemically synthesized
caagtttatttgtaagtcagtt

SEQ ID NO: 670325 - DNA, 22 bp, Artificial Sequence
  chemically synthesized
ttccaagtttatttgtaagtca

SEQ ID NO: 670326 - DNA, 22 bp, Artificial Sequence
  chemically synthesized
tgttccaagtttatttgtaagt

SEQ ID NO: 670327 - DNA, 22 bp, Artificial Sequence
  chemically synthesized
tatgcaactgacttacaaataa

SEQ ID NO: 670328 - DNA, 22 bp, Artificial Sequence
  chemically synthesized
gggctctgttccaagtttattt

SEQ ID NO: 670329 - DNA, 22 bp, Artificial Sequence
  chemically synthesized
ccctcgggctctgttccaagtt

SEQ ID NO: 670330 - DNA, 22 bp, Artificial Sequence
  chemically synthesized
acttacaaataaacttggaaca

SEQ ID NO: 670331 - DNA, 22 bp, Artificial Sequence
  chemically synthesized
accctcgggctctgttccaagt

SEQ ID NO: 670332 - DNA, 22 bp, Artificial Sequence
  chemically synthesized
acaaataaacttggaacagagc

SEQ ID NO: 670333 - DNA, 22 bp, Artificial Sequence
  chemically synthesized
caaataaacttggaacagagcc

SEQ ID NO: 670334 - DNA, 22 bp, Artificial Sequence
  chemically synthesized
caaacttaccctcgggctctgt

SEQ ID NO: 670335 - DNA, 22 bp, Artificial Sequence
  chemically synthesized
ccaaacttaccctcgggctctg

SEQ ID NO: 670336 - DNA, 22 bp, Artificial Sequence
  chemically synthesized
tccaaacttaccctcgggctct

SEQ ID NO: 670337 - DNA, 22 bp, Artificial Sequence
  chemically synthesized
ggcctttccaaacttaccctcg

SEQ ID NO: 670338 - DNA, 22 bp, Artificial Sequence
  chemically synthesized
ggaacagagcccgagggtaagt

SEQ ID NO: 670339 - DNA, 22 bp, Artificial Sequence
  chemically synthesized
aggcctttccaaacttaccctc

SEQ ID NO: 670340 - DNA, 22 bp, Artificial Sequence
  chemically synthesized
gaacagagcccgagggtaagtt

SEQ ID NO: 670341 - DNA, 22 bp, Artificial Sequence
  chemically synthesized
agacaagatttaggcctttcca

SEQ ID NO: 670342 - DNA, 22 bp, Artificial Sequence
  chemically synthesized
gagacaagatttaggcctttcc

SEQ ID NO: 670343 - DNA, 22 bp, Artificial Sequence
  chemically synthesized
ccaccttgagacaagatttagg

SEQ ID NO: 670344 - DNA, 22 bp, Artificial Sequence
  chemically synthesized
ggaaaggcctaaatcttgtctc

SEQ ID NO: 670345 - DNA, 22 bp, Artificial Sequence
  chemically synthesized
gaaaggcctaaatcttgtctca

SEQ ID NO: 670346 - DNA, 22 bp, Artificial Sequence
  chemically synthesized
aatcttgtctcaaggtgggaat

SEQ ID NO: 670347 - DNA, 22 bp, Artificial Sequence
  chemically synthesized
gtctcaaggtgggaatgtggtt

SEQ ID NO: 670348 - DNA, 22 bp, Artificial Sequence
  chemically synthesized
tctcaaggtgggaatgtggttc

SEQ ID NO: 670349 - DNA, 22 bp, Artificial Sequence
  chemically synthesized
agcagtcaggcaagaaccacat

SEQ ID NO: 670350 - DNA, 22 bp, Artificial Sequence
  chemically synthesized
tcagcagtcaggcaagaaccac

SEQ ID NO: 670351 - DNA, 22 bp, Artificial Sequence
  chemically synthesized
aaggtgggaatgtggttcttgc

SEQ ID NO: 670352 - DNA, 22 bp, Artificial Sequence
  chemically synthesized
ctcagcagtcaggcaagaacca

SEQ ID NO: 670353 - DNA, 22 bp, Artificial Sequence
  chemically synthesized
aatttctcagcagtcaggcaag

SEQ ID NO: 670354 - DNA, 22 bp, Artificial Sequence
  chemically synthesized
ttgcctgactgctgagaaattt

SEQ ID NO: 670355 - DNA, 22 bp, Artificial Sequence
  chemically synthesized
cccagtaaccattaaatttctc

SEQ ID NO: 670356 - DNA, 22 bp, Artificial Sequence
  chemically synthesized
gcctgactgctgagaaatttaa

SEQ ID NO: 670357 - DNA, 22 bp, Artificial Sequence
  chemically synthesized
cctgactgctgagaaatttaat

SEQ ID NO: 670358 - DNA, 22 bp, Artificial Sequence
  chemically synthesized
gttgcccagtaaccattaaatt

SEQ ID NO: 670359 - DNA, 22 bp, Artificial Sequence
  chemically synthesized
actgctgagaaatttaatggtt

SEQ ID NO: 670360 - DNA, 22 bp, Artificial Sequence
  chemically synthesized
ctggttgcccagtaaccattaa

SEQ ID NO: 670361 - DNA, 22 bp, Artificial Sequence
  chemically synthesized
ctgagaaatttaatggttactg

SEQ ID NO: 670362 - DNA, 22 bp, Artificial Sequence
  chemically synthesized
attcctggttgcccagtaacca

SEQ ID NO: 670363 - DNA, 22 bp, Artificial Sequence
  chemically synthesized
aattcctggttgcccagtaacc

SEQ ID NO: 670364 - DNA, 22 bp, Artificial Sequence
  chemically synthesized
agaaatttaatggttactgggc

SEQ ID NO: 670365 - DNA, 22 bp, Artificial Sequence
  chemically synthesized
tttaattcctggttgcccagta

SEQ ID NO: 670366 - DNA, 22 bp, Artificial Sequence
  chemically synthesized
aatggttactgggcaaccagga

SEQ ID NO: 670367 - DNA, 22 bp, Artificial Sequence
  chemically synthesized
atggttactgggcaaccaggaa

SEQ ID NO: 670368 - DNA, 22 bp, Artificial Sequence
  chemically synthesized
ccaaattatttaattcctggtt

SEQ ID NO: 670369 - DNA, 22 bp, Artificial Sequence
  chemically synthesized
cccaaattatttaattcctggt

SEQ ID NO: 670370 - DNA, 22 bp, Artificial Sequence
  chemically synthesized
ctgggcaaccaggaattaaata

SEQ ID NO: 670371 - DNA, 22 bp, Artificial Sequence
  chemically synthesized
aaatttcccaaattatttaatt

SEQ ID NO: 670372 - DNA, 22 bp, Artificial Sequence
  chemically synthesized
ggcaaccaggaattaaataatt

SEQ ID NO: 670373 - DNA, 22 bp, Artificial Sequence
  chemically synthesized
aataatttgggaaattttaact

SEQ ID NO: 670374 - DNA, 22 bp, Artificial Sequence
  chemically synthesized
ataagaaaaaggtagagttaaa

SEQ ID NO: 670375 - DNA, 22 bp, Artificial Sequence
  chemically synthesized
gggaaattttaactctaccttt

SEQ ID NO: 670376 - DNA, 22 bp, Artificial Sequence
  chemically synthesized
ggaaattttaactctacctttt

SEQ ID NO: 670377 - DNA, 22 bp, Artificial Sequence
  chemically synthesized
aagaatactcataagaaaaagg

SEQ ID NO: 670378 - DNA, 22 bp, Artificial Sequence
  chemically synthesized
taactctacctttttcttatga

SEQ ID NO: 670379 - DNA, 22 bp, Artificial Sequence
  chemically synthesized
aactctacctttttcttatgag

SEQ ID NO: 670380 - DNA, 22 bp, Artificial Sequence
  chemically synthesized
ccctaaagaatactcataagaa

SEQ ID NO: 670381 - DNA, 22 bp, Artificial Sequence
  chemically synthesized
actctacctttttcttatgagt

SEQ ID NO: 670382 - DNA, 22 bp, Artificial Sequence
  chemically synthesized
tacctttttcttatgagtattc

SEQ ID NO: 670383 - DNA, 22 bp, Artificial Sequence
  chemically synthesized
cctttttcttatgagtattctt

SEQ ID NO: 670384 - DNA, 22 bp, Artificial Sequence
  chemically synthesized
tttcttatgagtattctttagg

SEQ ID NO: 670385 - DNA, 22 bp, Artificial Sequence
  chemically synthesized
ttcttatgagtattctttaggg

SEQ ID NO: 670386 - DNA, 22 bp, Artificial Sequence
  chemically synthesized
tcttatgagtattctttagggg

SEQ ID NO: 670387 - DNA, 22 bp, Artificial Sequence
  chemically synthesized
cttatgagtattctttagggga

SEQ ID NO: 670388 - DNA, 22 bp, Artificial Sequence
  chemically synthesized
ttatgagtattctttaggggaa

SEQ ID NO: 670389 - DNA, 22 bp, Artificial Sequence
  chemically synthesized
atgagtattctttaggggaata

SEQ ID NO: 670390 - DNA, 22 bp, Artificial Sequence
  chemically synthesized
tgagtattctttaggggaatat

SEQ ID NO: 670391 - DNA, 22 bp, Artificial Sequence
  chemically synthesized
ataaaaagtatatatattcccc

SEQ ID NO: 670392 - DNA, 22 bp, Artificial Sequence
  chemically synthesized
aataaaaagtatatatattccc

SEQ ID NO: 670393 - DNA, 22 bp, Artificial Sequence
  chemically synthesized
ttaataaaaagtatatatattc

SEQ ID NO: 670394 - DNA, 22 bp, Artificial Sequence
  chemically synthesized
cttaataaaaagtatatatatt

SEQ ID NO: 670395 - DNA, 22 bp, Artificial Sequence
  chemically synthesized
tcttaataaaaagtatatatat

SEQ ID NO: 670396 - DNA, 22 bp, Artificial Sequence
  chemically synthesized
tttaggggaatatatatacttt

SEQ ID NO: 670397 - DNA, 22 bp, Artificial Sequence
  chemically synthesized
attttcttaataaaaagtatat

SEQ ID NO: 670398 - DNA, 22 bp, Artificial Sequence
  chemically synthesized
taggggaatatatatacttttt

SEQ ID NO: 670399 - DNA, 22 bp, Artificial Sequence
  chemically synthesized
cattttcttaataaaaagtata

SEQ ID NO: 670400 - DNA, 22 bp, Artificial Sequence
  chemically synthesized
aggggaatatatatacttttta

SEQ ID NO: 670401 - DNA, 22 bp, Artificial Sequence
  chemically synthesized
ggggaatatatatactttttat

SEQ ID NO: 670402 - DNA, 22 bp, Artificial Sequence
  chemically synthesized
aggcaccatgtatttcattttc

SEQ ID NO: 670403 - DNA, 22 bp, Artificial Sequence
  chemically synthesized
taaggcaccatgtatttcattt

SEQ ID NO: 670404 - DNA, 22 bp, Artificial Sequence
  chemically synthesized
ctaaggcaccatgtatttcatt

SEQ ID NO: 670405 - DNA, 22 bp, Artificial Sequence
  chemically synthesized
tttattaagaaaatgaaataca

SEQ ID NO: 670406 - DNA, 22 bp, Artificial Sequence
  chemically synthesized
ttattaagaaaatgaaatacat

SEQ ID NO: 670407 - DNA, 22 bp, Artificial Sequence
  chemically synthesized
tattaagaaaatgaaatacatg

SEQ ID NO: 670408 - DNA, 22 bp, Artificial Sequence
  chemically synthesized
tttctaaggcaccatgtatttc

SEQ ID NO: 670409 - DNA, 22 bp, Artificial Sequence
  chemically synthesized
attaagaaaatgaaatacatgg

SEQ ID NO: 670410 - DNA, 22 bp, Artificial Sequence
  chemically synthesized
ttaagaaaatgaaatacatggt

SEQ ID NO: 670411 - DNA, 22 bp, Artificial Sequence
  chemically synthesized
tatttctaaggcaccatgtatt

SEQ ID NO: 670412 - DNA, 22 bp, Artificial Sequence
  chemically synthesized
agaaaatgaaatacatggtgcc

SEQ ID NO: 670413 - DNA, 22 bp, Artificial Sequence
  chemically synthesized
gagattctatttctaaggcacc

SEQ ID NO: 670414 - DNA, 22 bp, Artificial Sequence
  chemically synthesized
aattagagattctatttctaag

SEQ ID NO: 670415 - DNA, 22 bp, Artificial Sequence
  chemically synthesized
aaattagagattctatttctaa

SEQ ID NO: 670416 - DNA, 22 bp, Artificial Sequence
  chemically synthesized
taaattagagattctatttcta

SEQ ID NO: 670417 - DNA, 22 bp, Artificial Sequence
  chemically synthesized
agaaatagaatctctaatttaa

SEQ ID NO: 670418 - DNA, 22 bp, Artificial Sequence
  chemically synthesized
gaaatagaatctctaatttaaa

SEQ ID NO: 670419 - DNA, 22 bp, Artificial Sequence
  chemically synthesized
gaaaatgaaaattttaaattag

SEQ ID NO: 670420 - DNA, 22 bp, Artificial Sequence
  chemically synthesized
ggaaaatgaaaattttaaatta

SEQ ID NO: 670421 - DNA, 22 bp, Artificial Sequence
  chemically synthesized
atttggaaaatgaaaattttaa

SEQ ID NO: 670422 - DNA, 22 bp, Artificial Sequence
  chemically synthesized
tcatttggaaaatgaaaatttt

SEQ ID NO: 670423 - DNA, 22 bp, Artificial Sequence
  chemically synthesized
tctcatttggaaaatgaaaatt

SEQ ID NO: 670424 - DNA, 22 bp, Artificial Sequence
  chemically synthesized
taatttaaaattttcattttcc

SEQ ID NO: 670425 - DNA, 22 bp, Artificial Sequence
  chemically synthesized
gttctctcatttggaaaatgaa

SEQ ID NO: 670426 - DNA, 22 bp, Artificial Sequence
  chemically synthesized
agttctctcatttggaaaatga

SEQ ID NO: 670427 - DNA, 22 bp, Artificial Sequence
  chemically synthesized
atttaaaattttcattttccaa

SEQ ID NO: 670428 - DNA, 22 bp, Artificial Sequence
  chemically synthesized
aaaattttcattttccaaatga

SEQ ID NO: 670429 - DNA, 22 bp, Artificial Sequence
  chemically synthesized
aaattttcattttccaaatgag

SEQ ID NO: 670430 - DNA, 22 bp, Artificial Sequence
  chemically synthesized
gtccttagttctctcatttgga

SEQ ID NO: 670431 - DNA, 22 bp, Artificial Sequence
  chemically synthesized
tagtccttagttctctcatttg

SEQ ID NO: 670432 - DNA, 22 bp, Artificial Sequence
  chemically synthesized
ctagtccttagttctctcattt

SEQ ID NO: 670433 - DNA, 22 bp, Artificial Sequence
  chemically synthesized
tctagtccttagttctctcatt

SEQ ID NO: 670434 - DNA, 22 bp, Artificial Sequence
  chemically synthesized
tcattttccaaatgagagaact

SEQ ID NO: 670435 - DNA, 22 bp, Artificial Sequence
  chemically synthesized
cattttccaaatgagagaacta

SEQ ID NO: 670436 - DNA, 22 bp, Artificial Sequence
  chemically synthesized
attttccaaatgagagaactaa

SEQ ID NO: 670437 - DNA, 22 bp, Artificial Sequence
  chemically synthesized
agagctttctagtccttagttc

SEQ ID NO: 670438 - DNA, 22 bp, Artificial Sequence
  chemically synthesized
tccaaatgagagaactaaggac

SEQ ID NO: 670439 - DNA, 22 bp, Artificial Sequence
  chemically synthesized
ccaaatgagagaactaaggact

SEQ ID NO: 670440 - DNA, 22 bp, Artificial Sequence
  chemically synthesized
caaatgagagaactaaggacta

SEQ ID NO: 670441 - DNA, 22 bp, Artificial Sequence
  chemically synthesized
ctaagagctttctagtccttag

SEQ ID NO: 670442 - DNA, 22 bp, Artificial Sequence
  chemically synthesized
agaacaagttactaagagcttt

SEQ ID NO: 670443 - DNA, 22 bp, Artificial Sequence
  chemically synthesized
aggactagaaagctcttagtaa

SEQ ID NO: 670444 - DNA, 22 bp, Artificial Sequence
  chemically synthesized
gggaattcagaacaagttacta

SEQ ID NO: 670445 - DNA, 22 bp, Artificial Sequence
  chemically synthesized
gaaagctcttagtaacttgttc

SEQ ID NO: 670446 - DNA, 22 bp, Artificial Sequence
  chemically synthesized
actagggaattcagaacaagtt

SEQ ID NO: 670447 - DNA, 22 bp, Artificial Sequence
  chemically synthesized
gctgactagggaattcagaaca

SEQ ID NO: 670448 - DNA, 22 bp, Artificial Sequence
  chemically synthesized
ttagtaacttgttctgaattcc

SEQ ID NO: 670449 - DNA, 22 bp, Artificial Sequence
  chemically synthesized
ctagctgactagggaattcaga

SEQ ID NO: 670450 - DNA, 22 bp, Artificial Sequence
  chemically synthesized
agtaacttgttctgaattccct

SEQ ID NO: 670451 - DNA, 22 bp, Artificial Sequence
  chemically synthesized
tcctagctgactagggaattca

SEQ ID NO: 670452 - DNA, 22 bp, Artificial Sequence
  chemically synthesized
gtaacttgttctgaattcccta

SEQ ID NO: 670453 - DNA, 22 bp, Artificial Sequence
  chemically synthesized
ctcctagctgactagggaattc

SEQ ID NO: 670454 - DNA, 22 bp, Artificial Sequence
  chemically synthesized
tctcctagctgactagggaatt

SEQ ID NO: 670455 - DNA, 22 bp, Artificial Sequence
  chemically synthesized
ttctcctagctgactagggaat

SEQ ID NO: 670456 - DNA, 22 bp, Artificial Sequence
  chemically synthesized
gttctgaattccctagtcagct

SEQ ID NO: 670457 - DNA, 22 bp, Artificial Sequence
  chemically synthesized
ttctgaattccctagtcagcta

SEQ ID NO: 670458 - DNA, 22 bp, Artificial Sequence
  chemically synthesized
atgtttttctcctagctgacta

SEQ ID NO: 670459 - DNA, 22 bp, Artificial Sequence
  chemically synthesized
tgaattccctagtcagctagga

SEQ ID NO: 670460 - DNA, 22 bp, Artificial Sequence
  chemically synthesized
gttgatgtttttctcctagctg

SEQ ID NO: 670461 - DNA, 22 bp, Artificial Sequence
  chemically synthesized
aattccctagtcagctaggaga

SEQ ID NO: 670462 - DNA, 22 bp, Artificial Sequence
  chemically synthesized
tagttgatgtttttctcctagc

SEQ ID NO: 670463 - DNA, 22 bp, Artificial Sequence
  chemically synthesized
cctagtcagctaggagaaaaac

SEQ ID NO: 670464 - DNA, 22 bp, Artificial Sequence
  chemically synthesized
gattctagttgatgtttttctc

SEQ ID NO: 670465 - DNA, 22 bp, Artificial Sequence
  chemically synthesized
ggattctagttgatgtttttct

SEQ ID NO: 670466 - DNA, 22 bp, Artificial Sequence
  chemically synthesized
gtcagctaggagaaaaacatca

SEQ ID NO: 670467 - DNA, 22 bp, Artificial Sequence
  chemically synthesized
ggagaaaaacatcaactagaat

SEQ ID NO: 670468 - DNA, 22 bp, Artificial Sequence
  chemically synthesized
gggagaaaaagacttggattct

SEQ ID NO: 670469 - DNA, 22 bp, Artificial Sequence
  chemically synthesized
ggggagaaaaagacttggattc

SEQ ID NO: 670470 - DNA, 22 bp, Artificial Sequence
  chemically synthesized
gaatccaagtctttttctcccc

SEQ ID NO: 670471 - DNA, 22 bp, Artificial Sequence
  chemically synthesized
agggaagggatacacacttggg

SEQ ID NO: 670472 - DNA, 22 bp, Artificial Sequence
  chemically synthesized
ctcagggaagggatacacactt

SEQ ID NO: 670473 - DNA, 22 bp, Artificial Sequence
  chemically synthesized
gctcagggaagggatacacact

SEQ ID NO: 670474 - DNA, 22 bp, Artificial Sequence
  chemically synthesized
tttctccccaagtgtgtatccc

SEQ ID NO: 670475 - DNA, 22 bp, Artificial Sequence
  chemically synthesized
ttctccccaagtgtgtatccct

SEQ ID NO: 670476 - DNA, 22 bp, Artificial Sequence
  chemically synthesized
tctccccaagtgtgtatccctt

SEQ ID NO: 670477 - DNA, 22 bp, Artificial Sequence
  chemically synthesized
ctccccaagtgtgtatcccttc

SEQ ID NO: 670478 - DNA, 22 bp, Artificial Sequence
  chemically synthesized
tccccaagtgtgtatcccttcc

SEQ ID NO: 670479 - DNA, 22 bp, Artificial Sequence
  chemically synthesized
tggcttgctcagggaagggata

SEQ ID NO: 670480 - DNA, 22 bp, Artificial Sequence
  chemically synthesized
cccaagtgtgtatcccttccct

SEQ ID NO: 670481 - DNA, 22 bp, Artificial Sequence
  chemically synthesized
tgtggcttgctcagggaaggga

SEQ ID NO: 670482 - DNA, 22 bp, Artificial Sequence
  chemically synthesized
ttctgtggcttgctcagggaag

SEQ ID NO: 670483 - DNA, 22 bp, Artificial Sequence
  chemically synthesized
gttctgtggcttgctcagggaa

SEQ ID NO: 670484 - DNA, 22 bp, Artificial Sequence
  chemically synthesized
tgttctgtggcttgctcaggga

SEQ ID NO: 670485 - DNA, 22 bp, Artificial Sequence
  chemically synthesized
ttgttctgtggcttgctcaggg

SEQ ID NO: 670486 - DNA, 22 bp, Artificial Sequence
  chemically synthesized
tatttttgttctgtggcttgct

SEQ ID NO: 670487 - DNA, 22 bp, Artificial Sequence
  chemically synthesized
atatttttgttctgtggcttgc

SEQ ID NO: 670488 - DNA, 22 bp, Artificial Sequence
  chemically synthesized
tatatttttgttctgtggcttg

SEQ ID NO: 670489 - DNA, 22 bp, Artificial Sequence
  chemically synthesized
ccctgagcaagccacagaacaa

SEQ ID NO: 670490 - DNA, 22 bp, Artificial Sequence
  chemically synthesized
cctgagcaagccacagaacaaa

SEQ ID NO: 670491 - DNA, 22 bp, Artificial Sequence
  chemically synthesized
agcaagccacagaacaaaaata

SEQ ID NO: 670492 - DNA, 22 bp, Artificial Sequence
  chemically synthesized
gaatgagcctttatatttttgt

SEQ ID NO: 670493 - DNA, 22 bp, Artificial Sequence
  chemically synthesized
agaatgagcctttatatttttg

SEQ ID NO: 670494 - DNA, 22 bp, Artificial Sequence
  chemically synthesized
aagtcccacttagaatgagcct

SEQ ID NO: 670495 - DNA, 22 bp, Artificial Sequence
  chemically synthesized
gaagtcccacttagaatgagcc

SEQ ID NO: 670496 - DNA, 22 bp, Artificial Sequence
  chemically synthesized
aatgagtagacttgaagtccca

SEQ ID NO: 670497 - DNA, 22 bp, Artificial Sequence
  chemically synthesized
attctaagtgggacttcaagtc

SEQ ID NO: 670498 - DNA, 22 bp, Artificial Sequence
  chemically synthesized
agctgaatgagtagacttgaag

SEQ ID NO: 670499 - DNA, 22 bp, Artificial Sequence
  chemically synthesized
aagctgaatgagtagacttgaa

SEQ ID NO: 670500 - DNA, 22 bp, Artificial Sequence
  chemically synthesized
taagtgggacttcaagtctact

SEQ ID NO: 670501 - DNA, 22 bp, Artificial Sequence
  chemically synthesized
agtgggacttcaagtctactca

SEQ ID NO: 670502 - DNA, 22 bp, Artificial Sequence
  chemically synthesized
ggagcccttaagctgaatgagt

SEQ ID NO: 670503 - DNA, 22 bp, Artificial Sequence
  chemically synthesized
caagtctactcattcagcttaa

SEQ ID NO: 670504 - DNA, 22 bp, Artificial Sequence
  chemically synthesized
aagtctactcattcagcttaag

SEQ ID NO: 670505 - DNA, 22 bp, Artificial Sequence
  chemically synthesized
ggagcaattgggagcccttaag

SEQ ID NO: 670506 - DNA, 22 bp, Artificial Sequence
  chemically synthesized
ctcattcagcttaagggctccc

SEQ ID NO: 670507 - DNA, 22 bp, Artificial Sequence
  chemically synthesized
attcagcttaagggctcccaat

SEQ ID NO: 670508 - DNA, 22 bp, Artificial Sequence
  chemically synthesized
gaattgggagcaattgggagcc

SEQ ID NO: 670509 - DNA, 22 bp, Artificial Sequence
  chemically synthesized
ttcgaattgggagcaattggga

SEQ ID NO: 670510 - DNA, 22 bp, Artificial Sequence
  chemically synthesized
agcttaagggctcccaattgct

SEQ ID NO: 670511 - DNA, 22 bp, Artificial Sequence
  chemically synthesized
tgttcgaattgggagcaattgg

SEQ ID NO: 670512 - DNA, 22 bp, Artificial Sequence
  chemically synthesized
aagggctcccaattgctcccaa

SEQ ID NO: 670513 - DNA, 22 bp, Artificial Sequence
  chemically synthesized
agggctcccaattgctcccaat

SEQ ID NO: 670514 - DNA, 22 bp, Artificial Sequence
  chemically synthesized
acgggccctctgttcgaattgg

SEQ ID NO: 670515 - DNA, 22 bp, Artificial Sequence
  chemically synthesized
ccaattgctcccaattcgaaca

SEQ ID NO: 670516 - DNA, 22 bp, Artificial Sequence
  chemically synthesized
ctcccaattcgaacagagggcc

SEQ ID NO: 670517 - DNA, 22 bp, Artificial Sequence
  chemically synthesized
aagaaattcacgggccctctgt

SEQ ID NO: 670518 - DNA, 22 bp, Artificial Sequence
  chemically synthesized
ccaattcgaacagagggcccgt

SEQ ID NO: 670519 - DNA, 22 bp, Artificial Sequence
  chemically synthesized
tcaaggttaaagaaattcacgg

SEQ ID NO: 670520 - DNA, 22 bp, Artificial Sequence
  chemically synthesized
gaacagagggcccgtgaatttc

SEQ ID NO: 670521 - DNA, 22 bp, Artificial Sequence
  chemically synthesized
gtcaaggttaaagaaattcacg

SEQ ID NO: 670522 - DNA, 22 bp, Artificial Sequence
  chemically synthesized
cagtcagatgtttgtcaaggtt

SEQ ID NO: 670523 - DNA, 22 bp, Artificial Sequence
  chemically synthesized
ccagtcagatgtttgtcaaggt

SEQ ID NO: 670524 - DNA, 22 bp, Artificial Sequence
  chemically synthesized
tccagtcagatgtttgtcaagg

SEQ ID NO: 670525 - DNA, 22 bp, Artificial Sequence
  chemically synthesized
ttttccagtcagatgtttgtca

SEQ ID NO: 670526 - DNA, 22 bp, Artificial Sequence
  chemically synthesized
gttttccagtcagatgtttgtc

SEQ ID NO: 670527 - DNA, 22 bp, Artificial Sequence
  chemically synthesized
ctttaaccttgacaaacatctg

SEQ ID NO: 670528 - DNA, 22 bp, Artificial Sequence
  chemically synthesized
tttaaccttgacaaacatctga

SEQ ID NO: 670529 - DNA, 22 bp, Artificial Sequence
  chemically synthesized
taaccttgacaaacatctgact

SEQ ID NO: 670530 - DNA, 22 bp, Artificial Sequence
  chemically synthesized
aaccttgacaaacatctgactg

SEQ ID NO: 670531 - DNA, 22 bp, Artificial Sequence
  chemically synthesized
accttgacaaacatctgactgg

SEQ ID NO: 670532 - DNA, 22 bp, Artificial Sequence
  chemically synthesized
ggaaaatttgttttccagtcag

SEQ ID NO: 670533 - DNA, 22 bp, Artificial Sequence
  chemically synthesized
gggaaaatttgttttccagtca

SEQ ID NO: 670534 - DNA, 22 bp, Artificial Sequence
  chemically synthesized
tgggaaaatttgttttccagtc

SEQ ID NO: 670535 - DNA, 22 bp, Artificial Sequence
  chemically synthesized
gacaaacatctgactggaaaac

SEQ ID NO: 670536 - DNA, 22 bp, Artificial Sequence
  chemically synthesized
ttgggaaaatttgttttccagt

SEQ ID NO: 670537 - DNA, 22 bp, Artificial Sequence
  chemically synthesized
acaaacatctgactggaaaaca

SEQ ID NO: 670538 - DNA, 22 bp, Artificial Sequence
  chemically synthesized
cttttgggaaaatttgttttcc

SEQ ID NO: 670539 - DNA, 22 bp, Artificial Sequence
  chemically synthesized
gcttttgggaaaatttgttttc

SEQ ID NO: 670540 - DNA, 22 bp, Artificial Sequence
  chemically synthesized
cttgcttttgggaaaatttgtt

SEQ ID NO: 670541 - DNA, 22 bp, Artificial Sequence
  chemically synthesized
actggaaaacaaattttcccaa

SEQ ID NO: 670542 - DNA, 22 bp, Artificial Sequence
  chemically synthesized
gaccctgcttgcttttgggaaa

SEQ ID NO: 670543 - DNA, 22 bp, Artificial Sequence
  chemically synthesized
gaaaacaaattttcccaaaagc

SEQ ID NO: 670544 - DNA, 22 bp, Artificial Sequence
  chemically synthesized
tcccaaaagcaagcagggtcta

SEQ ID NO: 670545 - DNA, 22 bp, Artificial Sequence
  chemically synthesized
acaggggaaaattagaccctgc

SEQ ID NO: 670546 - DNA, 22 bp, Artificial Sequence
  chemically synthesized
cccaaaagcaagcagggtctaa

SEQ ID NO: 670547 - DNA, 22 bp, Artificial Sequence
  chemically synthesized
aacaggggaaaattagaccctg

SEQ ID NO: 670548 - DNA, 22 bp, Artificial Sequence
  chemically synthesized
ccaaaagcaagcagggtctaat

SEQ ID NO: 670549 - DNA, 22 bp, Artificial Sequence
  chemically synthesized
ttaacaggggaaaattagaccc

SEQ ID NO: 670550 - DNA, 22 bp, Artificial Sequence
  chemically synthesized
gaaaccactcttaacaggggaa

SEQ ID NO: 670551 - DNA, 22 bp, Artificial Sequence
  chemically synthesized
attttcccctgttaagagtggt

SEQ ID NO: 670552 - DNA, 22 bp, Artificial Sequence
  chemically synthesized
tcccctgttaagagtggtttct

SEQ ID NO: 670553 - DNA, 22 bp, Artificial Sequence
  chemically synthesized
cccctgttaagagtggtttcta

SEQ ID NO: 670554 - DNA, 22 bp, Artificial Sequence
  chemically synthesized
ccctgttaagagtggtttctag

SEQ ID NO: 670555 - DNA, 22 bp, Artificial Sequence
  chemically synthesized
agaagatgccaaggtctagaaa

SEQ ID NO: 670556 - DNA, 22 bp, Artificial Sequence
  chemically synthesized
aagaagatgccaaggtctagaa

SEQ ID NO: 670557 - DNA, 22 bp, Artificial Sequence
  chemically synthesized
ttaagagtggtttctagacctt

SEQ ID NO: 670558 - DNA, 22 bp, Artificial Sequence
  chemically synthesized
agagtggtttctagaccttggc

SEQ ID NO: 670559 - DNA, 22 bp, Artificial Sequence
  chemically synthesized
aaaatttaagaagatgccaagg

SEQ ID NO: 670560 - DNA, 22 bp, Artificial Sequence
  chemically synthesized
aaaaatttaagaagatgccaag

SEQ ID NO: 670561 - DNA, 22 bp, Artificial Sequence
  chemically synthesized
ctagaccttggcatcttcttaa

SEQ ID NO: 670562 - DNA, 22 bp, Artificial Sequence
  chemically synthesized
aatcttaaaaatttaagaagat

SEQ ID NO: 670563 - DNA, 22 bp, Artificial Sequence
  chemically synthesized
tagaccttggcatcttcttaaa

SEQ ID NO: 670564 - DNA, 22 bp, Artificial Sequence
  chemically synthesized
gaccttggcatcttcttaaatt

SEQ ID NO: 670565 - DNA, 22 bp, Artificial Sequence
  chemically synthesized
ggcatcttcttaaatttttaag

SEQ ID NO: 670566 - DNA, 22 bp, Artificial Sequence
  chemically synthesized
gcatcttcttaaatttttaaga

SEQ ID NO: 670567 - DNA, 22 bp, Artificial Sequence
  chemically synthesized
ggaggagctgaatcttaaaaat

SEQ ID NO: 670568 - DNA, 22 bp, Artificial Sequence
  chemically synthesized
cttaaatttttaagattcagct

SEQ ID NO: 670569 - DNA, 22 bp, Artificial Sequence
  chemically synthesized
ttaaatttttaagattcagctc

SEQ ID NO: 670570 - DNA, 22 bp, Artificial Sequence
  chemically synthesized
aaatttttaagattcagctcct

SEQ ID NO: 670571 - DNA, 22 bp, Artificial Sequence
  chemically synthesized
aatttttaagattcagctcctc

SEQ ID NO: 670572 - DNA, 22 bp, Artificial Sequence
  chemically synthesized
ttaagattcagctcctcctaac

SEQ ID NO: 670573 - DNA, 22 bp, Artificial Sequence
  chemically synthesized
taagattcagctcctcctaacc

SEQ ID NO: 670574 - DNA, 22 bp, Artificial Sequence
  chemically synthesized
tatgtcagagcgggttaggagg

SEQ ID NO: 670575 - DNA, 22 bp, Artificial Sequence
  chemically synthesized
aagattcagctcctcctaaccc

SEQ ID NO: 670576 - DNA, 22 bp, Artificial Sequence
  chemically synthesized
atatgtcagagcgggttaggag

SEQ ID NO: 670577 - DNA, 22 bp, Artificial Sequence
  chemically synthesized
agattcagctcctcctaacccg

SEQ ID NO: 670578 - DNA, 22 bp, Artificial Sequence
  chemically synthesized
tatatgtcagagcgggttagga

SEQ ID NO: 670579 - DNA, 22 bp, Artificial Sequence
  chemically synthesized
agctcctcctaacccgctctga

SEQ ID NO: 670580 - DNA, 22 bp, Artificial Sequence
  chemically synthesized
tgactttatatgtcagagcggg

SEQ ID NO: 670581 - DNA, 22 bp, Artificial Sequence
  chemically synthesized
ctcctaacccgctctgacatat

SEQ ID NO: 670582 - DNA, 22 bp, Artificial Sequence
  chemically synthesized
ctaacccgctctgacatataaa

SEQ ID NO: 670583 - DNA, 22 bp, Artificial Sequence
  chemically synthesized
acaacactatgactttatatgt

SEQ ID NO: 670584 - DNA, 22 bp, Artificial Sequence
  chemically synthesized
cacaacactatgactttatatg

SEQ ID NO: 670585 - DNA, 22 bp, Artificial Sequence
  chemically synthesized
acccgctctgacatataaagtc

SEQ ID NO: 670586 - DNA, 22 bp, Artificial Sequence
  chemically synthesized
cttcacaacactatgactttat

SEQ ID NO: 670587 - DNA, 22 bp, Artificial Sequence
  chemically synthesized
tgacatataaagtcatagtgtt

SEQ ID NO: 670588 - DNA, 22 bp, Artificial Sequence
  chemically synthesized
acatataaagtcatagtgttgt

SEQ ID NO: 670589 - DNA, 22 bp, Artificial Sequence
  chemically synthesized
taacacagtctgcttcacaaca

SEQ ID NO: 670590 - DNA, 22 bp, Artificial Sequence
  chemically synthesized
tataacacagtctgcttcacaa

SEQ ID NO: 670591 - DNA, 22 bp, Artificial Sequence
  chemically synthesized
ctataacacagtctgcttcaca

SEQ ID NO: 670592 - DNA, 22 bp, Artificial Sequence
  chemically synthesized
cttctataacacagtctgcttc

SEQ ID NO: 670593 - DNA, 22 bp, Artificial Sequence
  chemically synthesized
ccttctataacacagtctgctt

SEQ ID NO: 670594 - DNA, 22 bp, Artificial Sequence
  chemically synthesized
acttccttctataacacagtct

SEQ ID NO: 670595 - DNA, 22 bp, Artificial Sequence
  chemically synthesized
ctgacttccttctataacacag

SEQ ID NO: 670596 - DNA, 22 bp, Artificial Sequence
  chemically synthesized
cctgacttccttctataacaca

SEQ ID NO: 670597 - DNA, 22 bp, Artificial Sequence
  chemically synthesized
tgaagcagactgtgttatagaa

SEQ ID NO: 670598 - DNA, 22 bp, Artificial Sequence
  chemically synthesized
cttcctgacttccttctataac

SEQ ID NO: 670599 - DNA, 22 bp, Artificial Sequence
  chemically synthesized
acttcctgacttccttctataa

SEQ ID NO: 670600 - DNA, 22 bp, Artificial Sequence
  chemically synthesized
acatccttacttcctgacttcc

SEQ ID NO: 670601 - DNA, 22 bp, Artificial Sequence
  chemically synthesized
tgttatagaaggaagtcaggaa

SEQ ID NO: 670602 - DNA, 22 bp, Artificial Sequence
  chemically synthesized
tagaaggaagtcaggaagtaag

SEQ ID NO: 670603 - DNA, 22 bp, Artificial Sequence
  chemically synthesized
aaagaaatgttcacatccttac

SEQ ID NO: 670604 - DNA, 22 bp, Artificial Sequence
  chemically synthesized
aaaagaaatgttcacatcctta

SEQ ID NO: 670605 - DNA, 22 bp, Artificial Sequence
  chemically synthesized
taaaagaaatgttcacatcctt

SEQ ID NO: 670606 - DNA, 22 bp, Artificial Sequence
  chemically synthesized
tttaaaagaaatgttcacatcc

SEQ ID NO: 670607 - DNA, 22 bp, Artificial Sequence
  chemically synthesized
ctctttaaaagaaatgttcaca

SEQ ID NO: 670608 - DNA, 22 bp, Artificial Sequence
  chemically synthesized
ctactctttaaaagaaatgttc

SEQ ID NO: 670609 - DNA, 22 bp, Artificial Sequence
  chemically synthesized
ctgctactctttaaaagaaatg

SEQ ID NO: 670610 - DNA, 22 bp, Artificial Sequence
  chemically synthesized
aggatggaggctgctgctactc

SEQ ID NO: 670611 - DNA, 22 bp, Artificial Sequence
  chemically synthesized
cttttaaagagtagcagcagcc

SEQ ID NO: 670612 - DNA, 22 bp, Artificial Sequence
  chemically synthesized
attcaggatggaggctgctgct

SEQ ID NO: 670613 - DNA, 22 bp, Artificial Sequence
  chemically synthesized
ttttaaagagtagcagcagcct

SEQ ID NO: 670614 - DNA, 22 bp, Artificial Sequence
  chemically synthesized
cattcaggatggaggctgctgc

SEQ ID NO: 670615 - DNA, 22 bp, Artificial Sequence
  chemically synthesized
ttaaagagtagcagcagcctcc

SEQ ID NO: 670616 - DNA, 22 bp, Artificial Sequence
  chemically synthesized
ttcattcaggatggaggctgct

SEQ ID NO: 670617 - DNA, 22 bp, Artificial Sequence
  chemically synthesized
taaagagtagcagcagcctcca

SEQ ID NO: 670618 - DNA, 22 bp, Artificial Sequence
  chemically synthesized
cttcattcaggatggaggctgc

SEQ ID NO: 670619 - DNA, 22 bp, Artificial Sequence
  chemically synthesized
aaagagtagcagcagcctccat

SEQ ID NO: 670620 - DNA, 22 bp, Artificial Sequence
  chemically synthesized
aagagtagcagcagcctccatc

SEQ ID NO: 670621 - DNA, 22 bp, Artificial Sequence
  chemically synthesized
gcttcttcattcaggatggagg

SEQ ID NO: 670622 - DNA, 22 bp, Artificial Sequence
  chemically synthesized
agacctggcttcttcattcagg

SEQ ID NO: 670623 - DNA, 22 bp, Artificial Sequence
  chemically synthesized
catcctgaatgaagaagccagg

SEQ ID NO: 670624 - DNA, 22 bp, Artificial Sequence
  chemically synthesized
agggagtgtctgagacctggct

SEQ ID NO: 670625 - DNA, 22 bp, Artificial Sequence
  chemically synthesized
aatgaagaagccaggtctcaga

SEQ ID NO: 670626 - DNA, 22 bp, Artificial Sequence
  chemically synthesized
aaggcggcacgtctaagggagt

SEQ ID NO: 670627 - DNA, 22 bp, Artificial Sequence
  chemically synthesized
aaaggcggcacgtctaagggag

SEQ ID NO: 670628 - DNA, 22 bp, Artificial Sequence
  chemically synthesized
ttaaaggcggcacgtctaaggg

SEQ ID NO: 670629 - DNA, 22 bp, Artificial Sequence
  chemically synthesized
cttaaaggcggcacgtctaagg

SEQ ID NO: 670630 - DNA, 22 bp, Artificial Sequence
  chemically synthesized
tcttaaaggcggcacgtctaag

SEQ ID NO: 670631 - DNA, 22 bp, Artificial Sequence
  chemically synthesized
agacactcccttagacgtgccg

SEQ ID NO: 670632 - DNA, 22 bp, Artificial Sequence
  chemically synthesized
ccttagacgtgccgcctttaag

SEQ ID NO: 670633 - DNA, 22 bp, Artificial Sequence
  chemically synthesized
agacgtgccgcctttaagaaag

SEQ ID NO: 670634 - DNA, 22 bp, Artificial Sequence
  chemically synthesized
gacgtgccgcctttaagaaagg

SEQ ID NO: 670635 - DNA, 22 bp, Artificial Sequence
  chemically synthesized
taagaaaggacatcctctctgt

SEQ ID NO: 670636 - DNA, 22 bp, Artificial Sequence
  chemically synthesized
atcatcagaagtacagagagga

SEQ ID NO: 670637 - DNA, 22 bp, Artificial Sequence
  chemically synthesized
aagaaaggacatcctctctgta

SEQ ID NO: 670638 - DNA, 22 bp, Artificial Sequence
  chemically synthesized
agaaaggacatcctctctgtac

SEQ ID NO: 670639 - DNA, 22 bp, Artificial Sequence
  chemically synthesized
agctgatcatcagaagtacaga

SEQ ID NO: 670640 - DNA, 22 bp, Artificial Sequence
  chemically synthesized
tctgtacttctgatgatcagct

SEQ ID NO: 670641 - DNA, 22 bp, Artificial Sequence
  chemically synthesized
aaatgggaaattaagctgatca

SEQ ID NO: 670642 - DNA, 22 bp, Artificial Sequence
  chemically synthesized
tgtacttctgatgatcagctta

SEQ ID NO: 670643 - DNA, 22 bp, Artificial Sequence
  chemically synthesized
tacttctgatgatcagcttaat

SEQ ID NO: 670644 - DNA, 22 bp, Artificial Sequence
  chemically synthesized
ttcaaatgggaaattaagctga

SEQ ID NO: 670645 - DNA, 22 bp, Artificial Sequence
  chemically synthesized
ctgatgatcagcttaatttccc

SEQ ID NO: 670646 - DNA, 22 bp, Artificial Sequence
  chemically synthesized
tgatgatcagcttaatttccca

SEQ ID NO: 670647 - DNA, 22 bp, Artificial Sequence
  chemically synthesized
atgatcagcttaatttcccatt

SEQ ID NO: 670648 - DNA, 22 bp, Artificial Sequence
  chemically synthesized
aatttcccatttgaataatgat

SEQ ID NO: 670649 - DNA, 22 bp, Artificial Sequence
  chemically synthesized
atttcccatttgaataatgatt

SEQ ID NO: 670650 - DNA, 22 bp, Artificial Sequence
  chemically synthesized
agaagcaaacaaaaaaatcatt

SEQ ID NO: 670651 - DNA, 22 bp, Artificial Sequence
  chemically synthesized
cccatttgaataatgatttttt

SEQ ID NO: 670652 - DNA, 22 bp, Artificial Sequence
  chemically synthesized
cagaagcaaacaaaaaaatcat

SEQ ID NO: 670653 - DNA, 22 bp, Artificial Sequence
  chemically synthesized
ccatttgaataatgattttttt

SEQ ID NO: 670654 - DNA, 22 bp, Artificial Sequence
  chemically synthesized
gaataatgatttttttgtttgc

SEQ ID NO: 670655 - DNA, 22 bp, Artificial Sequence
  chemically synthesized
atgacttcagaagcaaacaaaa

SEQ ID NO: 670656 - DNA, 22 bp, Artificial Sequence
  chemically synthesized
aataatgatttttttgtttgct

SEQ ID NO: 670657 - DNA, 22 bp, Artificial Sequence
  chemically synthesized
tcatgacttcagaagcaaacaa

SEQ ID NO: 670658 - DNA, 22 bp, Artificial Sequence
  chemically synthesized
ctcatgacttcagaagcaaaca

SEQ ID NO: 670659 - DNA, 22 bp, Artificial Sequence
  chemically synthesized
cttctcatgacttcagaagcaa

SEQ ID NO: 670660 - DNA, 22 bp, Artificial Sequence
  chemically synthesized
actgcttctcatgacttcagaa

SEQ ID NO: 670661 - DNA, 22 bp, Artificial Sequence
  chemically synthesized
ttttgtttgcttctgaagtcat

SEQ ID NO: 670662 - DNA, 22 bp, Artificial Sequence
  chemically synthesized
tttgtttgcttctgaagtcatg

SEQ ID NO: 670663 - DNA, 22 bp, Artificial Sequence
  chemically synthesized
ttgtttgcttctgaagtcatga

SEQ ID NO: 670664 - DNA, 22 bp, Artificial Sequence
  chemically synthesized
tgtttgcttctgaagtcatgag

SEQ ID NO: 670665 - DNA, 22 bp, Artificial Sequence
  chemically synthesized
gtttgcttctgaagtcatgaga

SEQ ID NO: 670666 - DNA, 22 bp, Artificial Sequence
  chemically synthesized
tttgcttctgaagtcatgagaa

SEQ ID NO: 670667 - DNA, 22 bp, Artificial Sequence
  chemically synthesized
gcttctgaagtcatgagaagca

SEQ ID NO: 670668 - DNA, 22 bp, Artificial Sequence
  chemically synthesized
ataaatgctaactgcttctcat

SEQ ID NO: 670669 - DNA, 22 bp, Artificial Sequence
  chemically synthesized
cttctgaagtcatgagaagcag

SEQ ID NO: 670670 - DNA, 22 bp, Artificial Sequence
  chemically synthesized
cataaatgctaactgcttctca

SEQ ID NO: 670671 - DNA, 22 bp, Artificial Sequence
  chemically synthesized
ctgaagtcatgagaagcagtta

SEQ ID NO: 670672 - DNA, 22 bp, Artificial Sequence
  chemically synthesized
tgaagtcatgagaagcagttag

SEQ ID NO: 670673 - DNA, 22 bp, Artificial Sequence
  chemically synthesized
aagtcatgagaagcagttagca

SEQ ID NO: 670674 - DNA, 22 bp, Artificial Sequence
  chemically synthesized
aaagcttcataaatgctaactg

SEQ ID NO: 670675 - DNA, 22 bp, Artificial Sequence
  chemically synthesized
gacaaccattcaaagcttcata

SEQ ID NO: 670676 - DNA, 22 bp, Artificial Sequence
  chemically synthesized
gcatttatgaagctttgaatgg

SEQ ID NO: 670677 - DNA, 22 bp, Artificial Sequence
  chemically synthesized
agtcaaattggacaaccattca

SEQ ID NO: 670678 - DNA, 22 bp, Artificial Sequence
  chemically synthesized
aagtcaaattggacaaccattc

SEQ ID NO: 670679 - DNA, 22 bp, Artificial Sequence
  chemically synthesized
taagtcaaattggacaaccatt

SEQ ID NO: 670680 - DNA, 22 bp, Artificial Sequence
  chemically synthesized
atgaagctttgaatggttgtcc

SEQ ID NO: 670681 - DNA, 22 bp, Artificial Sequence
  chemically synthesized
tgaagctttgaatggttgtcca

SEQ ID NO: 670682 - DNA, 22 bp, Artificial Sequence
  chemically synthesized
gtggcctttaagtcaaattgga

SEQ ID NO: 670683 - DNA, 22 bp, Artificial Sequence
  chemically synthesized
tgaatggttgtccaatttgact

SEQ ID NO: 670684 - DNA, 22 bp, Artificial Sequence
  chemically synthesized
gaatggttgtccaatttgactt

SEQ ID NO: 670685 - DNA, 22 bp, Artificial Sequence
  chemically synthesized
aatggttgtccaatttgactta

SEQ ID NO: 670686 - DNA, 22 bp, Artificial Sequence
  chemically synthesized
tccaatttgacttaaaggccac

SEQ ID NO: 670687 - DNA, 22 bp, Artificial Sequence
  chemically synthesized
acatcagcatctcgtggccttt

SEQ ID NO: 670688 - DNA, 22 bp, Artificial Sequence
  chemically synthesized
aacatcagcatctcgtggcctt

SEQ ID NO: 670689 - DNA, 22 bp, Artificial Sequence
  chemically synthesized
gacttaaaggccacgagatgct

SEQ ID NO: 670690 - DNA, 22 bp, Artificial Sequence
  chemically synthesized
acttaaaggccacgagatgctg

SEQ ID NO: 670691 - DNA, 22 bp, Artificial Sequence
  chemically synthesized
aaaggccacgagatgctgatgt

SEQ ID NO: 670692 - DNA, 22 bp, Artificial Sequence
  chemically synthesized
aaggccacgagatgctgatgtt

SEQ ID NO: 670693 - DNA, 22 bp, Artificial Sequence
  chemically synthesized
atgttaaacttcgtacatttat

SEQ ID NO: 670694 - DNA, 22 bp, Artificial Sequence
  chemically synthesized
aacttcgtacatttatttctgg

SEQ ID NO: 670695 - DNA, 22 bp, Artificial Sequence
  chemically synthesized
ataagacaggaacccagaaata

SEQ ID NO: 670696 - DNA, 22 bp, Artificial Sequence
  chemically synthesized
aataagacaggaacccagaaat

SEQ ID NO: 670697 - DNA, 22 bp, Artificial Sequence
  chemically synthesized
taataagacaggaacccagaaa

SEQ ID NO: 670698 - DNA, 22 bp, Artificial Sequence
  chemically synthesized
cgtacatttatttctgggttcc

SEQ ID NO: 670699 - DNA, 22 bp, Artificial Sequence
  chemically synthesized
gtacatttatttctgggttcct

SEQ ID NO: 670700 - DNA, 22 bp, Artificial Sequence
  chemically synthesized
atttctgggttcctgtcttatt

SEQ ID NO: 670701 - DNA, 22 bp, Artificial Sequence
  chemically synthesized
tgtcagtgttttaataagacag

SEQ ID NO: 670702 - DNA, 22 bp, Artificial Sequence
  chemically synthesized
tttctgggttcctgtcttatta

SEQ ID NO: 670703 - DNA, 22 bp, Artificial Sequence
  chemically synthesized
ctgggttcctgtcttattaaaa

SEQ ID NO: 670704 - DNA, 22 bp, Artificial Sequence
  chemically synthesized
tgggttcctgtcttattaaaac

SEQ ID NO: 670705 - DNA, 22 bp, Artificial Sequence
  chemically synthesized
ggttcctgtcttattaaaacac

SEQ ID NO: 670706 - DNA, 22 bp, Artificial Sequence
  chemically synthesized
tggagagttatgtcagtgtttt

SEQ ID NO: 670707 - DNA, 22 bp, Artificial Sequence
  chemically synthesized
ctgtcttattaaaacactgaca

SEQ ID NO: 670708 - DNA, 22 bp, Artificial Sequence
  chemically synthesized
tcttattaaaacactgacataa

SEQ ID NO: 670709 - DNA, 22 bp, Artificial Sequence
  chemically synthesized
cactatggagagttatgtcagt

SEQ ID NO: 670710 - DNA, 22 bp, Artificial Sequence
  chemically synthesized
gcactatggagagttatgtcag

SEQ ID NO: 670711 - DNA, 22 bp, Artificial Sequence
  chemically synthesized
attaaaacactgacataactct

SEQ ID NO: 670712 - DNA, 22 bp, Artificial Sequence
  chemically synthesized
ttaaaacactgacataactctc

SEQ ID NO: 670713 - DNA, 22 bp, Artificial Sequence
  chemically synthesized
aaacactgacataactctccat

SEQ ID NO: 670714 - DNA, 22 bp, Artificial Sequence
  chemically synthesized
acataactctccatagtgcaag

SEQ ID NO: 670715 - DNA, 22 bp, Artificial Sequence
  chemically synthesized
acagatggtgaatgaaaacttg

SEQ ID NO: 670716 - DNA, 22 bp, Artificial Sequence
  chemically synthesized
tccatagtgcaagttttcattc

SEQ ID NO: 670717 - DNA, 22 bp, Artificial Sequence
  chemically synthesized
catagtgcaagttttcattcac

SEQ ID NO: 670718 - DNA, 22 bp, Artificial Sequence
  chemically synthesized
tagcgcaatagactgacagatg

SEQ ID NO: 670719 - DNA, 22 bp, Artificial Sequence
  chemically synthesized
ctgtagcgcaatagactgacag

SEQ ID NO: 670720 - DNA, 22 bp, Artificial Sequence
  chemically synthesized
tcattcaccatctgtcagtcta

SEQ ID NO: 670721 - DNA, 22 bp, Artificial Sequence
  chemically synthesized
cctgtagcgcaatagactgaca

SEQ ID NO: 670722 - DNA, 22 bp, Artificial Sequence
  chemically synthesized
cattcaccatctgtcagtctat

SEQ ID NO: 670723 - DNA, 22 bp, Artificial Sequence
  chemically synthesized
tcctgtagcgcaatagactgac

SEQ ID NO: 670724 - DNA, 22 bp, Artificial Sequence
  chemically synthesized
attcaccatctgtcagtctatt

SEQ ID NO: 670725 - DNA, 22 bp, Artificial Sequence
  chemically synthesized
ttcctgtagcgcaatagactga

SEQ ID NO: 670726 - DNA, 22 bp, Artificial Sequence
  chemically synthesized
tttcctgtagcgcaatagactg

SEQ ID NO: 670727 - DNA, 22 bp, Artificial Sequence
  chemically synthesized
ttttcctgtagcgcaatagact

SEQ ID NO: 670728 - DNA, 22 bp, Artificial Sequence
  chemically synthesized
tttttcctgtagcgcaatagac

SEQ ID NO: 670729 - DNA, 22 bp, Artificial Sequence
  chemically synthesized
accatctgtcagtctattgcgc

SEQ ID NO: 670730 - DNA, 22 bp, Artificial Sequence
  chemically synthesized
ttttttcctgtagcgcaataga

SEQ ID NO: 670731 - DNA, 22 bp, Artificial Sequence
  chemically synthesized
tttttttcctgtagcgcaatag

SEQ ID NO: 670732 - DNA, 22 bp, Artificial Sequence
  chemically synthesized
gagttttttttttcctgtagcg

SEQ ID NO: 670733 - DNA, 22 bp, Artificial Sequence
  chemically synthesized
tcagtctattgcgctacaggaa

SEQ ID NO: 670734 - DNA, 22 bp, Artificial Sequence
  chemically synthesized
acctggagttttttttttcctg

SEQ ID NO: 670735 - DNA, 22 bp, Artificial Sequence
  chemically synthesized
ttgcgctacaggaaaaaaaaaa

SEQ ID NO: 670736 - DNA, 22 bp, Artificial Sequence
  chemically synthesized
cgctacaggaaaaaaaaaactc

SEQ ID NO: 670737 - DNA, 22 bp, Artificial Sequence
  chemically synthesized
cataattaacctggagtttttt

SEQ ID NO: 670738 - DNA, 22 bp, Artificial Sequence
  chemically synthesized
acataattaacctggagttttt

SEQ ID NO: 670739 - DNA, 22 bp, Artificial Sequence
  chemically synthesized
tacataattaacctggagtttt

SEQ ID NO: 670740 - DNA, 22 bp, Artificial Sequence
  chemically synthesized
ttacataattaacctggagttt

SEQ ID NO: 670741 - DNA, 22 bp, Artificial Sequence
  chemically synthesized
caggaaaaaaaaaactccaggt

SEQ ID NO: 670742 - DNA, 22 bp, Artificial Sequence
  chemically synthesized
ccttttacataattaacctgga

SEQ ID NO: 670743 - DNA, 22 bp, Artificial Sequence
  chemically synthesized
ttaccttttacataattaacct

SEQ ID NO: 670744 - DNA, 22 bp, Artificial Sequence
  chemically synthesized
atgctattaccttttacataat

SEQ ID NO: 670745 - DNA, 22 bp, Artificial Sequence
  chemically synthesized
gatgctattaccttttacataa

SEQ ID NO: 670746 - DNA, 22 bp, Artificial Sequence
  chemically synthesized
tgatgctattaccttttacata

SEQ ID NO: 670747 - DNA, 22 bp, Artificial Sequence
  chemically synthesized
tttgatgctattaccttttaca

SEQ ID NO: 670748 - DNA, 22 bp, Artificial Sequence
  chemically synthesized
caggttaattatgtaaaaggta

SEQ ID NO: 670749 - DNA, 22 bp, Artificial Sequence
  chemically synthesized
ttctttgatgctattacctttt

SEQ ID NO: 670750 - DNA, 22 bp, Artificial Sequence
  chemically synthesized
tgttctttgatgctattacctt

SEQ ID NO: 670751 - DNA, 22 bp, Artificial Sequence
  chemically synthesized
attatgtaaaaggtaatagcat

SEQ ID NO: 670752 - DNA, 22 bp, Artificial Sequence
  chemically synthesized
tgtaaaaggtaatagcatcaaa

SEQ ID NO: 670753 - DNA, 22 bp, Artificial Sequence
  chemically synthesized
agagtataataggcacaatgtt

SEQ ID NO: 670754 - DNA, 22 bp, Artificial Sequence
  chemically synthesized
cacattgagagtataataggca

SEQ ID NO: 670755 - DNA, 22 bp, Artificial Sequence
  chemically synthesized
gcacattgagagtataataggc

SEQ ID NO: 670756 - DNA, 22 bp, Artificial Sequence
  chemically synthesized
tgcacattgagagtataatagg

SEQ ID NO: 670757 - DNA, 22 bp, Artificial Sequence
  chemically synthesized
ttgcacattgagagtataatag

SEQ ID NO: 670758 - DNA, 22 bp, Artificial Sequence
  chemically synthesized
tgcctattatactctcaatgtg

SEQ ID NO: 670759 - DNA, 22 bp, Artificial Sequence
  chemically synthesized
ttatactctcaatgtgcaaaaa

SEQ ID NO: 670760 - DNA, 22 bp, Artificial Sequence
  chemically synthesized
tactctcaatgtgcaaaaatgg

SEQ ID NO: 670761 - DNA, 22 bp, Artificial Sequence
  chemically synthesized
tcaatgtgcaaaaatgggcata

SEQ ID NO: 670762 - DNA, 22 bp, Artificial Sequence
  chemically synthesized
aatgtgcaaaaatgggcatatt

SEQ ID NO: 670763 - DNA, 22 bp, Artificial Sequence
  chemically synthesized
catatacaaacatacacataaa

SEQ ID NO: 670764 - DNA, 22 bp, Artificial Sequence
  chemically synthesized
gcatatacaaacatacacataa

SEQ ID NO: 670765 - DNA, 22 bp, Artificial Sequence
  chemically synthesized
tgcatatacaaacatacacata

SEQ ID NO: 670766 - DNA, 22 bp, Artificial Sequence
  chemically synthesized
ttgcatatacaaacatacacat

SEQ ID NO: 670767 - DNA, 22 bp, Artificial Sequence
  chemically synthesized
taaatatttttgcatatacaaa

SEQ ID NO: 670768 - DNA, 22 bp, Artificial Sequence
  chemically synthesized
ttatgtgtatgtttgtatatgc

SEQ ID NO: 670769 - DNA, 22 bp, Artificial Sequence
  chemically synthesized
tatgtgtatgtttgtatatgca

SEQ ID NO: 670770 - DNA, 22 bp, Artificial Sequence
  chemically synthesized
tgtaaatatttttgcatataca

SEQ ID NO: 670771 - DNA, 22 bp, Artificial Sequence
  chemically synthesized
atgtgtatgtttgtatatgcaa

SEQ ID NO: 670772 - DNA, 22 bp, Artificial Sequence
  chemically synthesized
ctgtaaatatttttgcatatac

SEQ ID NO: 670773 - DNA, 22 bp, Artificial Sequence
  chemically synthesized
tgtgtatgtttgtatatgcaaa

SEQ ID NO: 670774 - DNA, 22 bp, Artificial Sequence
  chemically synthesized
cttctgtaaatatttttgcata

SEQ ID NO: 670775 - DNA, 22 bp, Artificial Sequence
  chemically synthesized
gcttctgtaaatatttttgcat

SEQ ID NO: 670776 - DNA, 22 bp, Artificial Sequence
  chemically synthesized
tgtttgcttctgtaaatatttt

SEQ ID NO: 670777 - DNA, 22 bp, Artificial Sequence
  chemically synthesized
atgtttgcttctgtaaatattt

SEQ ID NO: 670778 - DNA, 22 bp, Artificial Sequence
  chemically synthesized
tatgtttgcttctgtaaatatt

SEQ ID NO: 670779 - DNA, 22 bp, Artificial Sequence
  chemically synthesized
gtatatgcaaaaatatttacag

SEQ ID NO: 670780 - DNA, 22 bp, Artificial Sequence
  chemically synthesized
ttatgtttgcttctgtaaatat

SEQ ID NO: 670781 - DNA, 22 bp, Artificial Sequence
  chemically synthesized
tatatgcaaaaatatttacaga

SEQ ID NO: 670782 - DNA, 22 bp, Artificial Sequence
  chemically synthesized
acagtatagtttttatgtttgc

SEQ ID NO: 670783 - DNA, 22 bp, Artificial Sequence
  chemically synthesized
acagaagcaaacataaaaacta

SEQ ID NO: 670784 - DNA, 22 bp, Artificial Sequence
  chemically synthesized
cagaagcaaacataaaaactat

SEQ ID NO: 670785 - DNA, 22 bp, Artificial Sequence
  chemically synthesized
gagacaattaacagtatagttt

SEQ ID NO: 670786 - DNA, 22 bp, Artificial Sequence
  chemically synthesized
ctagagacaattaacagtatag

SEQ ID NO: 670787 - DNA, 22 bp, Artificial Sequence
  chemically synthesized
cctagagacaattaacagtata

SEQ ID NO: 670788 - DNA, 22 bp, Artificial Sequence
  chemically synthesized
cttcctagagacaattaacagt

SEQ ID NO: 670789 - DNA, 22 bp, Artificial Sequence
  chemically synthesized
acttcctagagacaattaacag

SEQ ID NO: 670790 - DNA, 22 bp, Artificial Sequence
  chemically synthesized
tacttcctagagacaattaaca

SEQ ID NO: 670791 - DNA, 22 bp, Artificial Sequence
  chemically synthesized
attttacttcctagagacaatt

SEQ ID NO: 670792 - DNA, 22 bp, Artificial Sequence
  chemically synthesized
tactgttaattgtctctaggaa

SEQ ID NO: 670793 - DNA, 22 bp, Artificial Sequence
  chemically synthesized
ttaattgtctctaggaagtaaa

SEQ ID NO: 670794 - DNA, 22 bp, Artificial Sequence
  chemically synthesized
attgtctctaggaagtaaaatt

SEQ ID NO: 670795 - DNA, 22 bp, Artificial Sequence
  chemically synthesized
gtatcaatcccctaattttact

SEQ ID NO: 670796 - DNA, 22 bp, Artificial Sequence
  chemically synthesized
ggtatcaatcccctaattttac

SEQ ID NO: 670797 - DNA, 22 bp, Artificial Sequence
  chemically synthesized
tctctaggaagtaaaattaggg

SEQ ID NO: 670798 - DNA, 22 bp, Artificial Sequence
  chemically synthesized
ttggtatcaatcccctaatttt

SEQ ID NO: 670799 - DNA, 22 bp, Artificial Sequence
  chemically synthesized
taggaagtaaaattaggggatt

SEQ ID NO: 670800 - DNA, 22 bp, Artificial Sequence
  chemically synthesized
ggaagtaaaattaggggattga

SEQ ID NO: 670801 - DNA, 22 bp, Artificial Sequence
  chemically synthesized
caaccactcttggtatcaatcc

SEQ ID NO: 670802 - DNA, 22 bp, Artificial Sequence
  chemically synthesized
ggggattgataccaagagtggt

SEQ ID NO: 670803 - DNA, 22 bp, Artificial Sequence
  chemically synthesized
aaaagtaagtctccaaccactc

SEQ ID NO: 670804 - DNA, 22 bp, Artificial Sequence
  chemically synthesized
ataccaagagtggttggagact

SEQ ID NO: 670805 - DNA, 22 bp, Artificial Sequence
  chemically synthesized
taagaggatagtattgaaaagt

SEQ ID NO: 670806 - DNA, 22 bp, Artificial Sequence
  chemically synthesized
gagacttacttttcaatactat

SEQ ID NO: 670807 - DNA, 22 bp, Artificial Sequence
  chemically synthesized
acttttcaatactatcctctta

SEQ ID NO: 670808 - DNA, 22 bp, Artificial Sequence
  chemically synthesized
cttttcaatactatcctcttac

SEQ ID NO: 670809 - DNA, 22 bp, Artificial Sequence
  chemically synthesized
agaaatcaaacattgtaagagg

SEQ ID NO: 670810 - DNA, 22 bp, Artificial Sequence
  chemically synthesized
ttcaatactatcctcttacaat

SEQ ID NO: 670811 - DNA, 22 bp, Artificial Sequence
  chemically synthesized
aagaaatcaaacattgtaagag

SEQ ID NO: 670812 - DNA, 22 bp, Artificial Sequence
  chemically synthesized
tcaatactatcctcttacaatg

SEQ ID NO: 670813 - DNA, 22 bp, Artificial Sequence
  chemically synthesized
taagaaatcaaacattgtaaga

SEQ ID NO: 670814 - DNA, 22 bp, Artificial Sequence
  chemically synthesized
caatactatcctcttacaatgt

SEQ ID NO: 670815 - DNA, 22 bp, Artificial Sequence
  chemically synthesized
aatactatcctcttacaatgtt

SEQ ID NO: 670816 - DNA, 22 bp, Artificial Sequence
  chemically synthesized
tcctcttacaatgtttgatttc

SEQ ID NO: 670817 - DNA, 22 bp, Artificial Sequence
  chemically synthesized
ttacaatgtttgatttcttaaa

SEQ ID NO: 670818 - DNA, 22 bp, Artificial Sequence
  chemically synthesized
acaatgtttgatttcttaaagt

SEQ ID NO: 670819 - DNA, 22 bp, Artificial Sequence
  chemically synthesized
caatgtttgatttcttaaagtc

SEQ ID NO: 670820 - DNA, 22 bp, Artificial Sequence
  chemically synthesized
aaaaaagtgcacatgactttaa

SEQ ID NO: 670821 - DNA, 22 bp, Artificial Sequence
  chemically synthesized
gatttcttaaagtcatgtgcac

SEQ ID NO: 670822 - DNA, 22 bp, Artificial Sequence
  chemically synthesized
atttcttaaagtcatgtgcact

SEQ ID NO: 670823 - DNA, 22 bp, Artificial Sequence
  chemically synthesized
aatcattaaaaaaagtgcacat

SEQ ID NO: 670824 - DNA, 22 bp, Artificial Sequence
  chemically synthesized
cttaaagtcatgtgcacttttt

SEQ ID NO: 670825 - DNA, 22 bp, Artificial Sequence
  chemically synthesized
ttaaagtcatgtgcactttttt

SEQ ID NO: 670826 - DNA, 22 bp, Artificial Sequence
  chemically synthesized
aaagtcatgtgcacttttttta

SEQ ID NO: 670827 - DNA, 22 bp, Artificial Sequence
  chemically synthesized
atactcaatcattaaaaaaagt

SEQ ID NO: 670828 - DNA, 22 bp, Artificial Sequence
  chemically synthesized
aagtcatgtgcactttttttaa

SEQ ID NO: 670829 - DNA, 22 bp, Artificial Sequence
  chemically synthesized
aatactcaatcattaaaaaaag

SEQ ID NO: 670830 - DNA, 22 bp, Artificial Sequence
  chemically synthesized
tttttaatgattgagtattaaa

SEQ ID NO: 670831 - DNA, 22 bp, Artificial Sequence
  chemically synthesized
ttttaatgattgagtattaaat

SEQ ID NO: 670832 - DNA, 22 bp, Artificial Sequence
  chemically synthesized
tttaatgattgagtattaaatc

SEQ ID NO: 670833 - DNA, 22 bp, Artificial Sequence
  chemically synthesized
ttaatgattgagtattaaatct

SEQ ID NO: 670834 - DNA, 22 bp, Artificial Sequence
  chemically synthesized
taatgattgagtattaaatcta

SEQ ID NO: 670835 - DNA, 22 bp, Artificial Sequence
  chemically synthesized
aatgattgagtattaaatctat

SEQ ID NO: 670836 - DNA, 22 bp, Artificial Sequence
  chemically synthesized
aaaagaagatagatagatttaa

SEQ ID NO: 670837 - DNA, 22 bp, Artificial Sequence
  chemically synthesized
atgattgagtattaaatctatc

SEQ ID NO: 670838 - DNA, 22 bp, Artificial Sequence
  chemically synthesized
gaaaagaagatagatagattta

SEQ ID NO: 670839 - DNA, 22 bp, Artificial Sequence
  chemically synthesized
agtattaaatctatctatcttc

SEQ ID NO: 670840 - DNA, 22 bp, Artificial Sequence
  chemically synthesized
aatctatctatcttcttttcaa

SEQ ID NO: 670841 - DNA, 22 bp, Artificial Sequence
  chemically synthesized
tctatcttcttttcaagatttc

SEQ ID NO: 670842 - DNA, 22 bp, Artificial Sequence
  chemically synthesized
tcttcttttcaagatttctcta

SEQ ID NO: 670843 - DNA, 22 bp, Artificial Sequence
  chemically synthesized
gaagaaatcccagatagagaaa

SEQ ID NO: 670844 - DNA, 22 bp, Artificial Sequence
  chemically synthesized
ggaagaaatcccagatagagaa

SEQ ID NO: 670845 - DNA, 22 bp, Artificial Sequence
  chemically synthesized
cttttcaagatttctctatctg

SEQ ID NO: 670846 - DNA, 22 bp, Artificial Sequence
  chemically synthesized
ttttcaagatttctctatctgg

SEQ ID NO: 670847 - DNA, 22 bp, Artificial Sequence
  chemically synthesized
ttcaagatttctctatctggga

SEQ ID NO: 670848 - DNA, 22 bp, Artificial Sequence
  chemically synthesized
tcaagatttctctatctgggat

SEQ ID NO: 670849 - DNA, 22 bp, Artificial Sequence
  chemically synthesized
caagatttctctatctgggatt

SEQ ID NO: 670850 - DNA, 22 bp, Artificial Sequence
  chemically synthesized
aagatttctctatctgggattt

SEQ ID NO: 670851 - DNA, 22 bp, Artificial Sequence
  chemically synthesized
agaatttggaagaaatcccaga

SEQ ID NO: 670852 - DNA, 22 bp, Artificial Sequence
  chemically synthesized
ctctatctgggatttcttccaa

SEQ ID NO: 670853 - DNA, 22 bp, Artificial Sequence
  chemically synthesized
tctatctgggatttcttccaaa

SEQ ID NO: 670854 - DNA, 22 bp, Artificial Sequence
  chemically synthesized
tatctgggatttcttccaaatt

SEQ ID NO: 670855 - DNA, 22 bp, Artificial Sequence
  chemically synthesized
tctgggatttcttccaaattct

SEQ ID NO: 670856 - DNA, 22 bp, Artificial Sequence
  chemically synthesized
ggatttcttccaaattcttagc

SEQ ID NO: 670857 - DNA, 22 bp, Artificial Sequence
  chemically synthesized
aaggacagcgggtgaagctaag

SEQ ID NO: 670858 - DNA, 22 bp, Artificial Sequence
  chemically synthesized
cttccaaattcttagcttcacc

SEQ ID NO: 670859 - DNA, 22 bp, Artificial Sequence
  chemically synthesized
ttccaaattcttagcttcaccc

SEQ ID NO: 670860 - DNA, 22 bp, Artificial Sequence
  chemically synthesized
ctgaaggacagcgggtgaagct

SEQ ID NO: 670861 - DNA, 22 bp, Artificial Sequence
  chemically synthesized
ccaaattcttagcttcacccgc

SEQ ID NO: 670862 - DNA, 22 bp, Artificial Sequence
  chemically synthesized
tcctgaaggacagcgggtgaag

SEQ ID NO: 670863 - DNA, 22 bp, Artificial Sequence
  chemically synthesized
caaattcttagcttcacccgct

SEQ ID NO: 670864 - DNA, 22 bp, Artificial Sequence
  chemically synthesized
ttagcttcacccgctgtccttc

SEQ ID NO: 670865 - DNA, 22 bp, Artificial Sequence
  chemically synthesized
agcttcacccgctgtccttcag

SEQ ID NO: 670866 - DNA, 22 bp, Artificial Sequence
  chemically synthesized
gcttcacccgctgtccttcagg

SEQ ID NO: 670867 - DNA, 22 bp, Artificial Sequence
  chemically synthesized
tacaatagtactctcctgaagg

SEQ ID NO: 670868 - DNA, 22 bp, Artificial Sequence
  chemically synthesized
cacccgctgtccttcaggagag

SEQ ID NO: 670869 - DNA, 22 bp, Artificial Sequence
  chemically synthesized
acccgctgtccttcaggagagt

SEQ ID NO: 670870 - DNA, 22 bp, Artificial Sequence
  chemically synthesized
cattgtacaatagtactctcct

SEQ ID NO: 670871 - DNA, 22 bp, Artificial Sequence
  chemically synthesized
ccattgtacaatagtactctcc

SEQ ID NO: 670872 - DNA, 22 bp, Artificial Sequence
  chemically synthesized
tccattgtacaatagtactctc

SEQ ID NO: 670873 - DNA, 22 bp, Artificial Sequence
  chemically synthesized
ttccattgtacaatagtactct

SEQ ID NO: 670874 - DNA, 22 bp, Artificial Sequence
  chemically synthesized
tccttcaggagagtactattgt

SEQ ID NO: 670875 - DNA, 22 bp, Artificial Sequence
  chemically synthesized
caggagagtactattgtacaat

SEQ ID NO: 670876 - DNA, 22 bp, Artificial Sequence
  chemically synthesized
aggagagtactattgtacaatg

SEQ ID NO: 670877 - DNA, 22 bp, Artificial Sequence
  chemically synthesized
cccagtagtttttccattgtac

SEQ ID NO: 670878 - DNA, 22 bp, Artificial Sequence
  chemically synthesized
tacccagtagtttttccattgt

SEQ ID NO: 670879 - DNA, 22 bp, Artificial Sequence
  chemically synthesized
tctacccagtagtttttccatt

SEQ ID NO: 670880 - DNA, 22 bp, Artificial Sequence
  chemically synthesized
ctctacccagtagtttttccat

SEQ ID NO: 670881 - DNA, 22 bp, Artificial Sequence
  chemically synthesized
ttctctacccagtagtttttcc

SEQ ID NO: 670882 - DNA, 22 bp, Artificial Sequence
  chemically synthesized
cttctctacccagtagtttttc

SEQ ID NO: 670883 - DNA, 22 bp, Artificial Sequence
  chemically synthesized
tcttctctacccagtagttttt

SEQ ID NO: 670884 - DNA, 22 bp, Artificial Sequence
  chemically synthesized
ttgtacaatggaaaaactactg

SEQ ID NO: 670885 - DNA, 22 bp, Artificial Sequence
  chemically synthesized
tacaatggaaaaactactgggt

SEQ ID NO: 670886 - DNA, 22 bp, Artificial Sequence
  chemically synthesized
agttttcttctctacccagtag

SEQ ID NO: 670887 - DNA, 22 bp, Artificial Sequence
  chemically synthesized
ctgggtagagaagaaaacttaa

SEQ ID NO: 670888 - DNA, 22 bp, Artificial Sequence
  chemically synthesized
ggtagagaagaaaacttaatgg

SEQ ID NO: 670889 - DNA, 22 bp, Artificial Sequence
  chemically synthesized
cagcaaagacataaatagagcc

SEQ ID NO: 670890 - DNA, 22 bp, Artificial Sequence
  chemically synthesized
acagcaaagacataaatagagc

SEQ ID NO: 670891 - DNA, 22 bp, Artificial Sequence
  chemically synthesized
tacagcaaagacataaatagag

SEQ ID NO: 670892 - DNA, 22 bp, Artificial Sequence
  chemically synthesized
ttttacagcaaagacataaata

SEQ ID NO: 670893 - DNA, 22 bp, Artificial Sequence
  chemically synthesized
aatgggctctatttatgtcttt

SEQ ID NO: 670894 - DNA, 22 bp, Artificial Sequence
  chemically synthesized
ttattttacagcaaagacataa

SEQ ID NO: 670895 - DNA, 22 bp, Artificial Sequence
  chemically synthesized
atgggctctatttatgtctttg

SEQ ID NO: 670896 - DNA, 22 bp, Artificial Sequence
  chemically synthesized
ctattattttacagcaaagaca

SEQ ID NO: 670897 - DNA, 22 bp, Artificial Sequence
  chemically synthesized
ttactattattttacagcaaag

SEQ ID NO: 670898 - DNA, 22 bp, Artificial Sequence
  chemically synthesized
tatttatgtctttgctgtaaaa

SEQ ID NO: 670899 - DNA, 22 bp, Artificial Sequence
  chemically synthesized
tttatgtctttgctgtaaaata

SEQ ID NO: 670900 - DNA, 22 bp, Artificial Sequence
  chemically synthesized
atgtctttgctgtaaaataata

SEQ ID NO: 670901 - DNA, 22 bp, Artificial Sequence
  chemically synthesized
tgtctttgctgtaaaataatag

SEQ ID NO: 670902 - DNA, 22 bp, Artificial Sequence
  chemically synthesized
tgctgtaaaataatagtaataa

SEQ ID NO: 670903 - DNA, 22 bp, Artificial Sequence
  chemically synthesized
gctgtaaaataatagtaataat

SEQ ID NO: 670904 - DNA, 22 bp, Artificial Sequence
  chemically synthesized
ctgtaaaataatagtaataatg

SEQ ID NO: 670905 - DNA, 22 bp, Artificial Sequence
  chemically synthesized
ataaatgataaccattattact

SEQ ID NO: 670906 - DNA, 22 bp, Artificial Sequence
  chemically synthesized
taaaataatagtaataatggtt

SEQ ID NO: 670907 - DNA, 22 bp, Artificial Sequence
  chemically synthesized
caaacatagggtaagcacctaa

SEQ ID NO: 670908 - DNA, 22 bp, Artificial Sequence
  chemically synthesized
ttgcaaacatagggtaagcacc

SEQ ID NO: 670909 - DNA, 22 bp, Artificial Sequence
  chemically synthesized
attgcaaacatagggtaagcac

SEQ ID NO: 670910 - DNA, 22 bp, Artificial Sequence
  chemically synthesized
tcatttattaggtgcttaccct

SEQ ID NO: 670911 - DNA, 22 bp, Artificial Sequence
  chemically synthesized
tttattgcaaacatagggtaag

SEQ ID NO: 670912 - DNA, 22 bp, Artificial Sequence
  chemically synthesized
attaggtgcttaccctatgttt

SEQ ID NO: 670913 - DNA, 22 bp, Artificial Sequence
  chemically synthesized
ttaggtgcttaccctatgtttg

SEQ ID NO: 670914 - DNA, 22 bp, Artificial Sequence
  chemically synthesized
tgttatttattgcaaacatagg

SEQ ID NO: 670915 - DNA, 22 bp, Artificial Sequence
  chemically synthesized
atgttatttattgcaaacatag

SEQ ID NO: 670916 - DNA, 22 bp, Artificial Sequence
  chemically synthesized
ggtgcttaccctatgtttgcaa

SEQ ID NO: 670917 - DNA, 22 bp, Artificial Sequence
  chemically synthesized
agaatttatgttatttattgca

SEQ ID NO: 670918 - DNA, 22 bp, Artificial Sequence
  chemically synthesized
accctatgtttgcaataaataa

SEQ ID NO: 670919 - DNA, 22 bp, Artificial Sequence
  chemically synthesized
ccctatgtttgcaataaataac

SEQ ID NO: 670920 - DNA, 22 bp, Artificial Sequence
  chemically synthesized
tgtttgcaataaataacataaa

SEQ ID NO: 670921 - DNA, 22 bp, Artificial Sequence
  chemically synthesized
gcaataaataacataaattctc

SEQ ID NO: 670922 - DNA, 22 bp, Artificial Sequence
  chemically synthesized
caataaataacataaattctca

SEQ ID NO: 670923 - DNA, 22 bp, Artificial Sequence
  chemically synthesized
ataaatgataacctgagaattt

SEQ ID NO: 670924 - DNA, 22 bp, Artificial Sequence
  chemically synthesized
tcaggttatcatttattaggtg

SEQ ID NO: 670925 - DNA, 22 bp, Artificial Sequence
  chemically synthesized
aggttatcatttattaggtgct

SEQ ID NO: 670926 - DNA, 22 bp, Artificial Sequence
  chemically synthesized
caaacatagggtaagcacctaa

SEQ ID NO: 670927 - DNA, 22 bp, Artificial Sequence
  chemically synthesized
ttgcaaacatagggtaagcacc

SEQ ID NO: 670928 - DNA, 22 bp, Artificial Sequence
  chemically synthesized
attgcaaacatagggtaagcac

SEQ ID NO: 670929 - DNA, 22 bp, Artificial Sequence
  chemically synthesized
tcatttattaggtgcttaccct

SEQ ID NO: 670930 - DNA, 22 bp, Artificial Sequence
  chemically synthesized
tttattgcaaacatagggtaag

SEQ ID NO: 670931 - DNA, 22 bp, Artificial Sequence
  chemically synthesized
attaggtgcttaccctatgttt

SEQ ID NO: 670932 - DNA, 22 bp, Artificial Sequence
  chemically synthesized
ttaggtgcttaccctatgtttg

SEQ ID NO: 670933 - DNA, 22 bp, Artificial Sequence
  chemically synthesized
tgttatttattgcaaacatagg

SEQ ID NO: 670934 - DNA, 22 bp, Artificial Sequence
  chemically synthesized
atgttatttattgcaaacatag

SEQ ID NO: 670935 - DNA, 22 bp, Artificial Sequence
  chemically synthesized
ggtgcttaccctatgtttgcaa

SEQ ID NO: 670936 - DNA, 22 bp, Artificial Sequence
  chemically synthesized
accctatgtttgcaataaataa

SEQ ID NO: 670937 - DNA, 22 bp, Artificial Sequence
  chemically synthesized
ccctatgtttgcaataaataac

SEQ ID NO: 670938 - DNA, 22 bp, Artificial Sequence
  chemically synthesized
tatgagaatttatgttatttat

SEQ ID NO: 670939 - DNA, 22 bp, Artificial Sequence
  chemically synthesized
tgtttgcaataaataacataaa

SEQ ID NO: 670940 - DNA, 22 bp, Artificial Sequence
  chemically synthesized
gcaataaataacataaattctc

SEQ ID NO: 670941 - DNA, 22 bp, Artificial Sequence
  chemically synthesized
caataaataacataaattctca

SEQ ID NO: 670942 - DNA, 22 bp, Artificial Sequence
  chemically synthesized
aaggtaattatatgagaattta

SEQ ID NO: 670943 - DNA, 22 bp, Artificial Sequence
  chemically synthesized
tcatataattaccttcaactgt

SEQ ID NO: 670944 - DNA, 22 bp, Artificial Sequence
  chemically synthesized
aaataatgatatcacagttgaa

SEQ ID NO: 670945 - DNA, 22 bp, Artificial Sequence
  chemically synthesized
atataattaccttcaactgtga

SEQ ID NO: 670946 - DNA, 22 bp, Artificial Sequence
  chemically synthesized
ccttcaactgtgatatcattat

SEQ ID NO: 670947 - DNA, 22 bp, Artificial Sequence
  chemically synthesized
taaaatgggattgaaataatga

SEQ ID NO: 670948 - DNA, 22 bp, Artificial Sequence
  chemically synthesized
caactgtgatatcattatttca

SEQ ID NO: 670949 - DNA, 22 bp, Artificial Sequence
  chemically synthesized
ataaaatgggattgaaataatg

SEQ ID NO: 670950 - DNA, 22 bp, Artificial Sequence
  chemically synthesized
aactgtgatatcattatttcaa

SEQ ID NO: 670951 - DNA, 22 bp, Artificial Sequence
  chemically synthesized
tttataaaatgggattgaaata

SEQ ID NO: 670952 - DNA, 22 bp, Artificial Sequence
  chemically synthesized
atttataaaatgggattgaaat

SEQ ID NO: 670953 - DNA, 22 bp, Artificial Sequence
  chemically synthesized
tgatatcattatttcaatccca

SEQ ID NO: 670954 - DNA, 22 bp, Artificial Sequence
  chemically synthesized
cttatttataaaatgggattga

SEQ ID NO: 670955 - DNA, 22 bp, Artificial Sequence
  chemically synthesized
ccttatttataaaatgggattg

SEQ ID NO: 670956 - DNA, 22 bp, Artificial Sequence
  chemically synthesized
gtttccttatttataaaatggg

SEQ ID NO: 670957 - DNA, 22 bp, Artificial Sequence
  chemically synthesized
ggtttccttatttataaaatgg

SEQ ID NO: 670958 - DNA, 22 bp, Artificial Sequence
  chemically synthesized
tggtttccttatttataaaatg

SEQ ID NO: 670959 - DNA, 22 bp, Artificial Sequence
  chemically synthesized
tttcaatcccattttataaata

SEQ ID NO: 670960 - DNA, 22 bp, Artificial Sequence
  chemically synthesized
caatcccattttataaataagg

SEQ ID NO: 670961 - DNA, 22 bp, Artificial Sequence
  chemically synthesized
ggcctttggtttccttatttat

SEQ ID NO: 670962 - DNA, 22 bp, Artificial Sequence
  chemically synthesized
aatcccattttataaataagga

SEQ ID NO: 670963 - DNA, 22 bp, Artificial Sequence
  chemically synthesized
aggcctttggtttccttattta

SEQ ID NO: 670964 - DNA, 22 bp, Artificial Sequence
  chemically synthesized
ttaggcctttggtttccttatt

SEQ ID NO: 670965 - DNA, 22 bp, Artificial Sequence
  chemically synthesized
cttaggcctttggtttccttat

SEQ ID NO: 670966 - DNA, 22 bp, Artificial Sequence
  chemically synthesized
cttcttaggcctttggtttcct

SEQ ID NO: 670967 - DNA, 22 bp, Artificial Sequence
  chemically synthesized
acttcttaggcctttggtttcc

SEQ ID NO: 670968 - DNA, 22 bp, Artificial Sequence
  chemically synthesized
tacttcttaggcctttggtttc

SEQ ID NO: 670969 - DNA, 22 bp, Artificial Sequence
  chemically synthesized
tataaataaggaaaccaaaggc

SEQ ID NO: 670970 - DNA, 22 bp, Artificial Sequence
  chemically synthesized
ataaataaggaaaccaaaggcc

SEQ ID NO: 670971 - DNA, 22 bp, Artificial Sequence
  chemically synthesized
taaataaggaaaccaaaggcct

SEQ ID NO: 670972 - DNA, 22 bp, Artificial Sequence
  chemically synthesized
aattttacttcttaggcctttg

SEQ ID NO: 670973 - DNA, 22 bp, Artificial Sequence
  chemically synthesized
gaattttacttcttaggccttt

SEQ ID NO: 670974 - DNA, 22 bp, Artificial Sequence
  chemically synthesized
gggtcaaatggatttgaatttt

SEQ ID NO: 670975 - DNA, 22 bp, Artificial Sequence
  chemically synthesized
agggtcaaatggatttgaattt

SEQ ID NO: 670976 - DNA, 22 bp, Artificial Sequence
  chemically synthesized
tagggtcaaatggatttgaatt

SEQ ID NO: 670977 - DNA, 22 bp, Artificial Sequence
  chemically synthesized
agaagtaaaattcaaatccatt

SEQ ID NO: 670978 - DNA, 22 bp, Artificial Sequence
  chemically synthesized
aaatccatttgaccctaaagcc

SEQ ID NO: 670979 - DNA, 22 bp, Artificial Sequence
  chemically synthesized
gaccctaaagcccttcctcttc

SEQ ID NO: 670980 - DNA, 22 bp, Artificial Sequence
  chemically synthesized
accctaaagcccttcctcttca

SEQ ID NO: 670981 - DNA, 22 bp, Artificial Sequence
  chemically synthesized
ggagaccatagtgatgaagagg

SEQ ID NO: 670982 - DNA, 22 bp, Artificial Sequence
  chemically synthesized
ttgggagaccatagtgatgaag

SEQ ID NO: 670983 - DNA, 22 bp, Artificial Sequence
  chemically synthesized
aagcccttcctcttcatcacta

SEQ ID NO: 670984 - DNA, 22 bp, Artificial Sequence
  chemically synthesized
attgggagaccatagtgatgaa

SEQ ID NO: 670985 - DNA, 22 bp, Artificial Sequence
  chemically synthesized
cctcttcatcactatggtctcc

SEQ ID NO: 670986 - DNA, 22 bp, Artificial Sequence
  chemically synthesized
ctcttcatcactatggtctccc

SEQ ID NO: 670987 - DNA, 22 bp, Artificial Sequence
  chemically synthesized
gaccaagcttattgggagacca

SEQ ID NO: 670988 - DNA, 22 bp, Artificial Sequence
  chemically synthesized
ttcatcactatggtctcccaat

SEQ ID NO: 670989 - DNA, 22 bp, Artificial Sequence
  chemically synthesized
ctagaccaagcttattgggaga

SEQ ID NO: 670990 - DNA, 22 bp, Artificial Sequence
  chemically synthesized
catcactatggtctcccaataa

SEQ ID NO: 670991 - DNA, 22 bp, Artificial Sequence
  chemically synthesized
atcactatggtctcccaataag

SEQ ID NO: 670992 - DNA, 22 bp, Artificial Sequence
  chemically synthesized
aggttactagaccaagcttatt

SEQ ID NO: 670993 - DNA, 22 bp, Artificial Sequence
  chemically synthesized
tggtctcccaataagcttggtc

SEQ ID NO: 670994 - DNA, 22 bp, Artificial Sequence
  chemically synthesized
ggaaagttaaggttactagacc

SEQ ID NO: 670995 - DNA, 22 bp, Artificial Sequence
  chemically synthesized
ccaataagcttggtctagtaac

SEQ ID NO: 670996 - DNA, 22 bp, Artificial Sequence
  chemically synthesized
aggaaagttaaggttactagac

SEQ ID NO: 670997 - DNA, 22 bp, Artificial Sequence
  chemically synthesized
ggtctagtaaccttaactttcc

SEQ ID NO: 670998 - DNA, 22 bp, Artificial Sequence
  chemically synthesized
gtctagtaaccttaactttcct

SEQ ID NO: 670999 - DNA, 22 bp, Artificial Sequence
  chemically synthesized
gtaaccttaactttcctaagct

SEQ ID NO: 671000 - DNA, 22 bp, Artificial Sequence
  chemically synthesized
aactttcctaagcttcattttt

SEQ ID NO: 671001 - DNA, 22 bp, Artificial Sequence
  chemically synthesized
actttcctaagcttcatttttt

SEQ ID NO: 671002 - DNA, 22 bp, Artificial Sequence
  chemically synthesized
aaaatgaacaaaaaaaaaatga

SEQ ID NO: 671003 - DNA, 22 bp, Artificial Sequence
  chemically synthesized
aaaaatgaacaaaaaaaaaatg

SEQ ID NO: 671004 - DNA, 22 bp, Artificial Sequence
  chemically synthesized
taaaaatgaacaaaaaaaaaat

SEQ ID NO: 671005 - DNA, 22 bp, Artificial Sequence
  chemically synthesized
tcctaagcttcatttttttttt

SEQ ID NO: 671006 - DNA, 22 bp, Artificial Sequence
  chemically synthesized
cctaagcttcattttttttttg

SEQ ID NO: 671007 - DNA, 22 bp, Artificial Sequence
  chemically synthesized
ctaagcttcattttttttttgt

SEQ ID NO: 671008 - DNA, 22 bp, Artificial Sequence
  chemically synthesized
cctttaaaaatgaacaaaaaaa

SEQ ID NO: 671009 - DNA, 22 bp, Artificial Sequence
  chemically synthesized
agcttcattttttttttgttca

SEQ ID NO: 671010 - DNA, 22 bp, Artificial Sequence
  chemically synthesized
ttccctttaaaaatgaacaaaa

SEQ ID NO: 671011 - DNA, 22 bp, Artificial Sequence
  chemically synthesized
ctgttccctttaaaaatgaaca

SEQ ID NO: 671012 - DNA, 22 bp, Artificial Sequence
  chemically synthesized
cattttttttttgttcattttt

SEQ ID NO: 671013 - DNA, 22 bp, Artificial Sequence
  chemically synthesized
attttttttttgttcattttta

SEQ ID NO: 671014 - DNA, 22 bp, Artificial Sequence
  chemically synthesized
ttactgttccctttaaaaatga

SEQ ID NO: 671015 - DNA, 22 bp, Artificial Sequence
  chemically synthesized
tttttttgttcatttttaaagg

SEQ ID NO: 671016 - DNA, 22 bp, Artificial Sequence
  chemically synthesized
ttttttgttcatttttaaaggg

SEQ ID NO: 671017 - DNA, 22 bp, Artificial Sequence
  chemically synthesized
tttttgttcatttttaaaggga

SEQ ID NO: 671018 - DNA, 22 bp, Artificial Sequence
  chemically synthesized
ttttgttcatttttaaagggaa

SEQ ID NO: 671019 - DNA, 22 bp, Artificial Sequence
  chemically synthesized
tttgttcatttttaaagggaac

SEQ ID NO: 671020 - DNA, 22 bp, Artificial Sequence
  chemically synthesized
ttgttcatttttaaagggaaca

SEQ ID NO: 671021 - DNA, 22 bp, Artificial Sequence
  chemically synthesized
tgttcatttttaaagggaacag

SEQ ID NO: 671022 - DNA, 22 bp, Artificial Sequence
  chemically synthesized
gttcatttttaaagggaacagt

SEQ ID NO: 671023 - DNA, 22 bp, Artificial Sequence
  chemically synthesized
ttcatttttaaagggaacagta

SEQ ID NO: 671024 - DNA, 22 bp, Artificial Sequence
  chemically synthesized
ggaataggtactattactgttc

SEQ ID NO: 671025 - DNA, 22 bp, Artificial Sequence
  chemically synthesized
atttttaaagggaacagtaata

SEQ ID NO: 671026 - DNA, 22 bp, Artificial Sequence
  chemically synthesized
ttaaagggaacagtaatagtac

SEQ ID NO: 671027 - DNA, 22 bp, Artificial Sequence
  chemically synthesized
taaagggaacagtaatagtacc

SEQ ID NO: 671028 - DNA, 22 bp, Artificial Sequence
  chemically synthesized
aaagggaacagtaatagtacct

SEQ ID NO: 671029 - DNA, 22 bp, Artificial Sequence
  chemically synthesized
aagggaacagtaatagtaccta

SEQ ID NO: 671030 - DNA, 22 bp, Artificial Sequence
  chemically synthesized
caacagccctaggaataggtac

SEQ ID NO: 671031 - DNA, 22 bp, Artificial Sequence
  chemically synthesized
gcaacagccctaggaataggta

SEQ ID NO: 671032 - DNA, 22 bp, Artificial Sequence
  chemically synthesized
tgcaacagccctaggaataggt

SEQ ID NO: 671033 - DNA, 22 bp, Artificial Sequence
  chemically synthesized
gttttgcaacagccctaggaat

SEQ ID NO: 671034 - DNA, 22 bp, Artificial Sequence
  chemically synthesized
agttttgcaacagccctaggaa

SEQ ID NO: 671035 - DNA, 22 bp, Artificial Sequence
  chemically synthesized
ttagttttgcaacagccctagg

SEQ ID NO: 671036 - DNA, 22 bp, Artificial Sequence
  chemically synthesized
tcttagttttgcaacagcccta

SEQ ID NO: 671037 - DNA, 22 bp, Artificial Sequence
  chemically synthesized
tctctcttagttttgcaacagc

SEQ ID NO: 671038 - DNA, 22 bp, Artificial Sequence
  chemically synthesized
ttcctagggctgttgcaaaact

SEQ ID NO: 671039 - DNA, 22 bp, Artificial Sequence
  chemically synthesized
ctagggctgttgcaaaactaag

SEQ ID NO: 671040 - DNA, 22 bp, Artificial Sequence
  chemically synthesized
gggctgttgcaaaactaagaga

SEQ ID NO: 671041 - DNA, 22 bp, Artificial Sequence
  chemically synthesized
agatacactatctctcttagtt

SEQ ID NO: 671042 - DNA, 22 bp, Artificial Sequence
  chemically synthesized
gagatacactatctctcttagt

SEQ ID NO: 671043 - DNA, 22 bp, Artificial Sequence
  chemically synthesized
tgagatacactatctctcttag

SEQ ID NO: 671044 - DNA, 22 bp, Artificial Sequence
  chemically synthesized
ttgagatacactatctctctta

SEQ ID NO: 671045 - DNA, 22 bp, Artificial Sequence
  chemically synthesized
ttgcaaaactaagagagatagt

SEQ ID NO: 671046 - DNA, 22 bp, Artificial Sequence
  chemically synthesized
caaaactaagagagatagtgta

SEQ ID NO: 671047 - DNA, 22 bp, Artificial Sequence
  chemically synthesized
gagcttttgagatacactatct

SEQ ID NO: 671048 - DNA, 22 bp, Artificial Sequence
  chemically synthesized
ggagcttttgagatacactatc

SEQ ID NO: 671049 - DNA, 22 bp, Artificial Sequence
  chemically synthesized
tggagcttttgagatacactat

SEQ ID NO: 671050 - DNA, 22 bp, Artificial Sequence
  chemically synthesized
tttggagcttttgagatacact

SEQ ID NO: 671051 - DNA, 22 bp, Artificial Sequence
  chemically synthesized
ctctttggagcttttgagatac

SEQ ID NO: 671052 - DNA, 22 bp, Artificial Sequence
  chemically synthesized
agagagatagtgtatctcaaaa

SEQ ID NO: 671053 - DNA, 22 bp, Artificial Sequence
  chemically synthesized
aaaagctccaaagaggagatgt

SEQ ID NO: 671054 - DNA, 22 bp, Artificial Sequence
  chemically synthesized
caaagaggagatgtatcttgga

SEQ ID NO: 671055 - DNA, 22 bp, Artificial Sequence
  chemically synthesized
agcaagtatatatccaagatac

SEQ ID NO: 671056 - DNA, 22 bp, Artificial Sequence
  chemically synthesized
ctgagcaagtatatatccaaga

SEQ ID NO: 671057 - DNA, 22 bp, Artificial Sequence
  chemically synthesized
actgagcaagtatatatccaag

SEQ ID NO: 671058 - DNA, 22 bp, Artificial Sequence
  chemically synthesized
tactgagcaagtatatatccaa

SEQ ID NO: 671059 - DNA, 22 bp, Artificial Sequence
  chemically synthesized
ttactgagcaagtatatatcca

SEQ ID NO: 671060 - DNA, 22 bp, Artificial Sequence
  chemically synthesized
acttttactgagcaagtatata

SEQ ID NO: 671061 - DNA, 22 bp, Artificial Sequence
  chemically synthesized
ctaacttttactgagcaagtat

SEQ ID NO: 671062 - DNA, 22 bp, Artificial Sequence
  chemically synthesized
ggatatatacttgctcagtaaa

SEQ ID NO: 671063 - DNA, 22 bp, Artificial Sequence
  chemically synthesized
gatatatacttgctcagtaaaa

SEQ ID NO: 671064 - DNA, 22 bp, Artificial Sequence
  chemically synthesized
gctcagtaaaagttaggaacct

SEQ ID NO: 671065 - DNA, 22 bp, Artificial Sequence
  chemically synthesized
ctcagtaaaagttaggaacctt

SEQ ID NO: 671066 - DNA, 22 bp, Artificial Sequence
  chemically synthesized
agtaaaagttaggaacctttct

SEQ ID NO: 671067 - DNA, 22 bp, Artificial Sequence
  chemically synthesized
taacaagaagtacaggggcaga

SEQ ID NO: 671068 - DNA, 22 bp, Artificial Sequence
  chemically synthesized
ataacaagaagtacaggggcag

SEQ ID NO: 671069 - DNA, 22 bp, Artificial Sequence
  chemically synthesized
ggaacctttctctgcccctgta

SEQ ID NO: 671070 - DNA, 22 bp, Artificial Sequence
  chemically synthesized
tataacaagaagtacaggggca

SEQ ID NO: 671071 - DNA, 22 bp, Artificial Sequence
  chemically synthesized
tactttataacaagaagtacag

SEQ ID NO: 671072 - DNA, 22 bp, Artificial Sequence
  chemically synthesized
tctctgcccctgtacttcttgt

SEQ ID NO: 671073 - DNA, 22 bp, Artificial Sequence
  chemically synthesized
ttatactttataacaagaagta

SEQ ID NO: 671074 - DNA, 22 bp, Artificial Sequence
  chemically synthesized
ctctgcccctgtacttcttgtt

SEQ ID NO: 671075 - DNA, 22 bp, Artificial Sequence
  chemically synthesized
attatactttataacaagaagt

SEQ ID NO: 671076 - DNA, 22 bp, Artificial Sequence
  chemically synthesized
tctgcccctgtacttcttgtta

SEQ ID NO: 671077 - DNA, 22 bp, Artificial Sequence
  chemically synthesized
tattatactttataacaagaag

SEQ ID NO: 671078 - DNA, 22 bp, Artificial Sequence
  chemically synthesized
ttattatactttataacaagaa

SEQ ID NO: 671079 - DNA, 22 bp, Artificial Sequence
  chemically synthesized
tgcccctgtacttcttgttata

SEQ ID NO: 671080 - DNA, 22 bp, Artificial Sequence
  chemically synthesized
cccctgtacttcttgttataaa

SEQ ID NO: 671081 - DNA, 22 bp, Artificial Sequence
  chemically synthesized
cacttttattatactttataac

SEQ ID NO: 671082 - DNA, 22 bp, Artificial Sequence
  chemically synthesized
gcacttttattatactttataa

SEQ ID NO: 671083 - DNA, 22 bp, Artificial Sequence
  chemically synthesized
tacttcttgttataaagtataa

SEQ ID NO: 671084 - DNA, 22 bp, Artificial Sequence
  chemically synthesized
cttgcacttttattatacttta

SEQ ID NO: 671085 - DNA, 22 bp, Artificial Sequence
  chemically synthesized
cttgttataaagtataataaaa

SEQ ID NO: 671086 - DNA, 22 bp, Artificial Sequence
  chemically synthesized
ttgttataaagtataataaaag

SEQ ID NO: 671087 - DNA, 22 bp, Artificial Sequence
  chemically synthesized
gttataaagtataataaaagtg

SEQ ID NO: 671088 - DNA, 22 bp, Artificial Sequence
  chemically synthesized
ttataaagtataataaaagtgc

SEQ ID NO: 671089 - DNA, 22 bp, Artificial Sequence
  chemically synthesized
taaagtataataaaagtgcaag

SEQ ID NO: 671090 - DNA, 22 bp, Artificial Sequence
  chemically synthesized
gtccacagcatgataaaaatat

SEQ ID NO: 671091 - DNA, 22 bp, Artificial Sequence
  chemically synthesized
ggtccacagcatgataaaaata

SEQ ID NO: 671092 - DNA, 22 bp, Artificial Sequence
  chemically synthesized
ttatcatgctgtggaccaaact

SEQ ID NO: 671093 - DNA, 22 bp, Artificial Sequence
  chemically synthesized
tatcatgctgtggaccaaactc

SEQ ID NO: 671094 - DNA, 22 bp, Artificial Sequence
  chemically synthesized
atcatgctgtggaccaaactct

SEQ ID NO: 671095 - DNA, 22 bp, Artificial Sequence
  chemically synthesized
tcatgctgtggaccaaactctt

SEQ ID NO: 671096 - DNA, 22 bp, Artificial Sequence
  chemically synthesized
aaaaggggaaccgaagaaagag

SEQ ID NO: 671097 - DNA, 22 bp, Artificial Sequence
  chemically synthesized
gaaaaggggaaccgaagaaaga

SEQ ID NO: 671098 - DNA, 22 bp, Artificial Sequence
  chemically synthesized
tggaccaaactctttcttcggt

SEQ ID NO: 671099 - DNA, 22 bp, Artificial Sequence
  chemically synthesized
aagccatttgaaaaggggaacc

SEQ ID NO: 671100 - DNA, 22 bp, Artificial Sequence
  chemically synthesized
taaagccatttgaaaaggggaa

SEQ ID NO: 671101 - DNA, 22 bp, Artificial Sequence
  chemically synthesized
tttcttcggttccccttttcaa

SEQ ID NO: 671102 - DNA, 22 bp, Artificial Sequence
  chemically synthesized
tcttcggttccccttttcaaat

SEQ ID NO: 671103 - DNA, 22 bp, Artificial Sequence
  chemically synthesized
cttcggttccccttttcaaatg

SEQ ID NO: 671104 - DNA, 22 bp, Artificial Sequence
  chemically synthesized
ttcggttccccttttcaaatgg

SEQ ID NO: 671105 - DNA, 22 bp, Artificial Sequence
  chemically synthesized
cggttccccttttcaaatggct

SEQ ID NO: 671106 - DNA, 22 bp, Artificial Sequence
  chemically synthesized
ggttccccttttcaaatggctt

SEQ ID NO: 671107 - DNA, 22 bp, Artificial Sequence
  chemically synthesized
aagaggaaatactctaaagcca

SEQ ID NO: 671108 - DNA, 22 bp, Artificial Sequence
  chemically synthesized
cccttttcaaatggctttagag

SEQ ID NO: 671109 - DNA, 22 bp, Artificial Sequence
  chemically synthesized
gaagaggaaatactctaaagcc

SEQ ID NO: 671110 - DNA, 22 bp, Artificial Sequence
  chemically synthesized
tgaagaggaaatactctaaagc

SEQ ID NO: 671111 - DNA, 22 bp, Artificial Sequence
  chemically synthesized
ttcaaatggctttagagtattt

SEQ ID NO: 671112 - DNA, 22 bp, Artificial Sequence
  chemically synthesized
tcaaatggctttagagtatttc

SEQ ID NO: 671113 - DNA, 22 bp, Artificial Sequence
  chemically synthesized
caaatggctttagagtatttcc

SEQ ID NO: 671114 - DNA, 22 bp, Artificial Sequence
  chemically synthesized
aaatggctttagagtatttcct

SEQ ID NO: 671115 - DNA, 22 bp, Artificial Sequence
  chemically synthesized
tagagtatttcctcttcaaaat

SEQ ID NO: 671116 - DNA, 22 bp, Artificial Sequence
  chemically synthesized
agagtatttcctcttcaaaatg

SEQ ID NO: 671117 - DNA, 22 bp, Artificial Sequence
  chemically synthesized
gagtatttcctcttcaaaatgc

SEQ ID NO: 671118 - DNA, 22 bp, Artificial Sequence
  chemically synthesized
agaggggacagtggcattttga

SEQ ID NO: 671119 - DNA, 22 bp, Artificial Sequence
  chemically synthesized
ctgagaggggacagtggcattt

SEQ ID NO: 671120 - DNA, 22 bp, Artificial Sequence
  chemically synthesized
cctgagaggggacagtggcatt

SEQ ID NO: 671121 - DNA, 22 bp, Artificial Sequence
  chemically synthesized
ttcctgagaggggacagtggca

SEQ ID NO: 671122 - DNA, 22 bp, Artificial Sequence
  chemically synthesized
cctcttcaaaatgccactgtcc

SEQ ID NO: 671123 - DNA, 22 bp, Artificial Sequence
  chemically synthesized
cttcctgagaggggacagtggc

SEQ ID NO: 671124 - DNA, 22 bp, Artificial Sequence
  chemically synthesized
ctcttcaaaatgccactgtccc

SEQ ID NO: 671125 - DNA, 22 bp, Artificial Sequence
  chemically synthesized
tcttcctgagaggggacagtgg

SEQ ID NO: 671126 - DNA, 22 bp, Artificial Sequence
  chemically synthesized
ttcaaaatgccactgtcccctc

SEQ ID NO: 671127 - DNA, 22 bp, Artificial Sequence
  chemically synthesized
caaaatgccactgtcccctctc

SEQ ID NO: 671128 - DNA, 22 bp, Artificial Sequence
  chemically synthesized
tactttcttcctgagaggggac

SEQ ID NO: 671129 - DNA, 22 bp, Artificial Sequence
  chemically synthesized
aaaatgccactgtcccctctca

SEQ ID NO: 671130 - DNA, 22 bp, Artificial Sequence
  chemically synthesized
agctatactttcttcctgagag

SEQ ID NO: 671131 - DNA, 22 bp, Artificial Sequence
  chemically synthesized
gcccctcagctatactttcttc

SEQ ID NO: 671132 - DNA, 22 bp, Artificial Sequence
  chemically synthesized
tcccctctcaggaagaaagtat

SEQ ID NO: 671133 - DNA, 22 bp, Artificial Sequence
  chemically synthesized
agcccctcagctatactttctt

SEQ ID NO: 671134 - DNA, 22 bp, Artificial Sequence
  chemically synthesized
tcaggaagaaagtatagctgag

SEQ ID NO: 671135 - DNA, 22 bp, Artificial Sequence
  chemically synthesized
aggaagaaagtatagctgaggg

SEQ ID NO: 671136 - DNA, 22 bp, Artificial Sequence
  chemically synthesized
aaccagcgatttagcccctcag

SEQ ID NO: 671137 - DNA, 22 bp, Artificial Sequence
  chemically synthesized
ctaaaccagcgatttagcccct

SEQ ID NO: 671138 - DNA, 22 bp, Artificial Sequence
  chemically synthesized
actcctaaaccagcgatttagc

SEQ ID NO: 671139 - DNA, 22 bp, Artificial Sequence
  chemically synthesized
aactcctaaaccagcgatttag

SEQ ID NO: 671140 - DNA, 22 bp, Artificial Sequence
  chemically synthesized
taactcctaaaccagcgattta

SEQ ID NO: 671141 - DNA, 22 bp, Artificial Sequence
  chemically synthesized
ttaactcctaaaccagcgattt

SEQ ID NO: 671142 - DNA, 22 bp, Artificial Sequence
  chemically synthesized
aggggctaaatcgctggtttag

SEQ ID NO: 671143 - DNA, 22 bp, Artificial Sequence
  chemically synthesized
cgtgtacttttaactcctaaac

SEQ ID NO: 671144 - DNA, 22 bp, Artificial Sequence
  chemically synthesized
acgtgtacttttaactcctaaa

SEQ ID NO: 671145 - DNA, 22 bp, Artificial Sequence
  chemically synthesized
aatcgctggtttaggagttaaa

SEQ ID NO: 671146 - DNA, 22 bp, Artificial Sequence
  chemically synthesized
gtttaggagttaaaagtacacg

SEQ ID NO: 671147 - DNA, 22 bp, Artificial Sequence
  chemically synthesized
caaagcagggatttacgtgtac

SEQ ID NO: 671148 - DNA, 22 bp, Artificial Sequence
  chemically synthesized
aggagttaaaagtacacgtaaa

SEQ ID NO: 671149 - DNA, 22 bp, Artificial Sequence
  chemically synthesized
ggagttaaaagtacacgtaaat

SEQ ID NO: 671150 - DNA, 22 bp, Artificial Sequence
  chemically synthesized
acattgcaaagcagggatttac

SEQ ID NO: 671151 - DNA, 22 bp, Artificial Sequence
  chemically synthesized
tcacattgcaaagcagggattt

SEQ ID NO: 671152 - DNA, 22 bp, Artificial Sequence
  chemically synthesized
aaagtacacgtaaatccctgct

SEQ ID NO: 671153 - DNA, 22 bp, Artificial Sequence
  chemically synthesized
ctcacattgcaaagcagggatt

SEQ ID NO: 671154 - DNA, 22 bp, Artificial Sequence
  chemically synthesized
tctcacattgcaaagcagggat

SEQ ID NO: 671155 - DNA, 22 bp, Artificial Sequence
  chemically synthesized
agagaaaataggtaattttctc

SEQ ID NO: 671156 - DNA, 22 bp, Artificial Sequence
  chemically synthesized
ctttgcaatgtgagaaaattac

SEQ ID NO: 671157 - DNA, 22 bp, Artificial Sequence
  chemically synthesized
tgcaatgtgagaaaattaccta

SEQ ID NO: 671158 - DNA, 22 bp, Artificial Sequence
  chemically synthesized
gcaatgtgagaaaattacctat

SEQ ID NO: 671159 - DNA, 22 bp, Artificial Sequence
  chemically synthesized
caatgtgagaaaattacctatt

SEQ ID NO: 671160 - DNA, 22 bp, Artificial Sequence
  chemically synthesized
tgcagatgaggctcagagaaaa

SEQ ID NO: 671161 - DNA, 22 bp, Artificial Sequence
  chemically synthesized
cattgtgcagatgaggctcaga

SEQ ID NO: 671162 - DNA, 22 bp, Artificial Sequence
  chemically synthesized
cctattttctctgagcctcatc

SEQ ID NO: 671163 - DNA, 22 bp, Artificial Sequence
  chemically synthesized
tatctccattgtgcagatgagg

SEQ ID NO: 671164 - DNA, 22 bp, Artificial Sequence
  chemically synthesized
ttttctctgagcctcatctgca

SEQ ID NO: 671165 - DNA, 22 bp, Artificial Sequence
  chemically synthesized
gtatctccattgtgcagatgag

SEQ ID NO: 671166 - DNA, 22 bp, Artificial Sequence
  chemically synthesized
tctctgagcctcatctgcacaa

SEQ ID NO: 671167 - DNA, 22 bp, Artificial Sequence
  chemically synthesized
ctctgagcctcatctgcacaat

SEQ ID NO: 671168 - DNA, 22 bp, Artificial Sequence
  chemically synthesized
tctgagcctcatctgcacaatg

SEQ ID NO: 671169 - DNA, 22 bp, Artificial Sequence
  chemically synthesized
tgagcctcatctgcacaatgga

SEQ ID NO: 671170 - DNA, 22 bp, Artificial Sequence
  chemically synthesized
agcctcatctgcacaatggaga

SEQ ID NO: 671171 - DNA, 22 bp, Artificial Sequence
  chemically synthesized
taaaagatatttgtatctccat

SEQ ID NO: 671172 - DNA, 22 bp, Artificial Sequence
  chemically synthesized
atctgcacaatggagatacaaa

SEQ ID NO: 671173 - DNA, 22 bp, Artificial Sequence
  chemically synthesized
cacaatggagatacaaatatct

SEQ ID NO: 671174 - DNA, 22 bp, Artificial Sequence
  chemically synthesized
aaaaaccctgtaaaagatattt

SEQ ID NO: 671175 - DNA, 22 bp, Artificial Sequence
  chemically synthesized
caaaaaccctgtaaaagatatt

SEQ ID NO: 671176 - DNA, 22 bp, Artificial Sequence
  chemically synthesized
tcaaaaaccctgtaaaagatat

SEQ ID NO: 671177 - DNA, 22 bp, Artificial Sequence
  chemically synthesized
atcctttcaaaaaccctgtaaa

SEQ ID NO: 671178 - DNA, 22 bp, Artificial Sequence
  chemically synthesized
attaatcctttcaaaaaccctg

SEQ ID NO: 671179 - DNA, 22 bp, Artificial Sequence
  chemically synthesized
tcattaatcctttcaaaaaccc

SEQ ID NO: 671180 - DNA, 22 bp, Artificial Sequence
  chemically synthesized
ctcattaatcctttcaaaaacc

SEQ ID NO: 671181 - DNA, 22 bp, Artificial Sequence
  chemically synthesized
ttacagggtttttgaaaggatt

SEQ ID NO: 671182 - DNA, 22 bp, Artificial Sequence
  chemically synthesized
tacagggtttttgaaaggatta

SEQ ID NO: 671183 - DNA, 22 bp, Artificial Sequence
  chemically synthesized
acagggtttttgaaaggattaa

SEQ ID NO: 671184 - DNA, 22 bp, Artificial Sequence
  chemically synthesized
cagggtttttgaaaggattaat

SEQ ID NO: 671185 - DNA, 22 bp, Artificial Sequence
  chemically synthesized
ttgaaaggattaatgagaaata

SEQ ID NO: 671186 - DNA, 22 bp, Artificial Sequence
  chemically synthesized
tgaaaggattaatgagaaatat

SEQ ID NO: 671187 - DNA, 22 bp, Artificial Sequence
  chemically synthesized
gaaaggattaatgagaaatata

SEQ ID NO: 671188 - DNA, 22 bp, Artificial Sequence
  chemically synthesized
aaaggattaatgagaaatatat

SEQ ID NO: 671189 - DNA, 22 bp, Artificial Sequence
  chemically synthesized
ccataccataagcatatatttc

SEQ ID NO: 671190 - DNA, 22 bp, Artificial Sequence
  chemically synthesized
atgagaaatatatgcttatggt

SEQ ID NO: 671191 - DNA, 22 bp, Artificial Sequence
  chemically synthesized
atataaatgtatgtgctgccat

SEQ ID NO: 671192 - DNA, 22 bp, Artificial Sequence
  chemically synthesized
atggtatggcagcacatacatt

SEQ ID NO: 671193 - DNA, 22 bp, Artificial Sequence
  chemically synthesized
gtggctcatataaatgtatgtg

SEQ ID NO: 671194 - DNA, 22 bp, Artificial Sequence
  chemically synthesized
tggtatggcagcacatacattt

SEQ ID NO: 671195 - DNA, 22 bp, Artificial Sequence
  chemically synthesized
ggtggctcatataaatgtatgt

SEQ ID NO: 671196 - DNA, 22 bp, Artificial Sequence
  chemically synthesized
tggtggctcatataaatgtatg

SEQ ID NO: 671197 - DNA, 22 bp, Artificial Sequence
  chemically synthesized
ttggtggctcatataaatgtat

SEQ ID NO: 671198 - DNA, 22 bp, Artificial Sequence
  chemically synthesized
tttttggtggctcatataaatg

SEQ ID NO: 671199 - DNA, 22 bp, Artificial Sequence
  chemically synthesized
atttttggtggctcatataaat

SEQ ID NO: 671200 - DNA, 22 bp, Artificial Sequence
  chemically synthesized
gaaaaatttatttttggtggct

SEQ ID NO: 671201 - DNA, 22 bp, Artificial Sequence
  chemically synthesized
agaaaaatttatttttggtggc

SEQ ID NO: 671202 - DNA, 22 bp, Artificial Sequence
  chemically synthesized
ttagaaaaatttatttttggtg

SEQ ID NO: 671203 - DNA, 22 bp, Artificial Sequence
  chemically synthesized
cttagaaaaatttatttttggt

SEQ ID NO: 671204 - DNA, 22 bp, Artificial Sequence
  chemically synthesized
ttcttagaaaaatttatttttg

SEQ ID NO: 671205 - DNA, 22 bp, Artificial Sequence
  chemically synthesized
atatgagccaccaaaaataaat

SEQ ID NO: 671206 - DNA, 22 bp, Artificial Sequence
  chemically synthesized
tatgagccaccaaaaataaatt

SEQ ID NO: 671207 - DNA, 22 bp, Artificial Sequence
  chemically synthesized
tcttcttagaaaaatttatttt

SEQ ID NO: 671208 - DNA, 22 bp, Artificial Sequence
  chemically synthesized
ctcttcttagaaaaatttattt

SEQ ID NO: 671209 - DNA, 22 bp, Artificial Sequence
  chemically synthesized
caatttctcttcttagaaaaat

SEQ ID NO: 671210 - DNA, 22 bp, Artificial Sequence
  chemically synthesized
acaatttctcttcttagaaaaa

SEQ ID NO: 671211 - DNA, 22 bp, Artificial Sequence
  chemically synthesized
tttacaatttctcttcttagaa

SEQ ID NO: 671212 - DNA, 22 bp, Artificial Sequence
  chemically synthesized
atttacaatttctcttcttaga

SEQ ID NO: 671213 - DNA, 22 bp, Artificial Sequence
  chemically synthesized
tgggtttatttacaatttctct

SEQ ID NO: 671214 - DNA, 22 bp, Artificial Sequence
  chemically synthesized
atgggtttatttacaatttctc

SEQ ID NO: 671215 - DNA, 22 bp, Artificial Sequence
  chemically synthesized
ttctaagaagagaaattgtaaa

SEQ ID NO: 671216 - DNA, 22 bp, Artificial Sequence
  chemically synthesized
tctaagaagagaaattgtaaat

SEQ ID NO: 671217 - DNA, 22 bp, Artificial Sequence
  chemically synthesized
ctaagaagagaaattgtaaata

SEQ ID NO: 671218 - DNA, 22 bp, Artificial Sequence
  chemically synthesized
taagaagagaaattgtaaataa

SEQ ID NO: 671219 - DNA, 22 bp, Artificial Sequence
  chemically synthesized
catacttatgggtttatttaca

SEQ ID NO: 671220 - DNA, 22 bp, Artificial Sequence
  chemically synthesized
agaagagaaattgtaaataaac

SEQ ID NO: 671221 - DNA, 22 bp, Artificial Sequence
  chemically synthesized
aattacatacttatgggtttat

SEQ ID NO: 671222 - DNA, 22 bp, Artificial Sequence
  chemically synthesized
attgaattacatacttatgggt

SEQ ID NO: 671223 - DNA, 22 bp, Artificial Sequence
  chemically synthesized
gattgaattacatacttatggg

SEQ ID NO: 671224 - DNA, 22 bp, Artificial Sequence
  chemically synthesized
taaataaacccataagtatgta

SEQ ID NO: 671225 - DNA, 22 bp, Artificial Sequence
  chemically synthesized
aatcaaattcatatctattccc

SEQ ID NO: 671226 - DNA, 22 bp, Artificial Sequence
  chemically synthesized
agcggagcaacagggaatagat

SEQ ID NO: 671227 - DNA, 22 bp, Artificial Sequence
  chemically synthesized
caaactgagcggagcaacaggg

SEQ ID NO: 671228 - DNA, 22 bp, Artificial Sequence
  chemically synthesized
atatctattccctgttgctccg

SEQ ID NO: 671229 - DNA, 22 bp, Artificial Sequence
  chemically synthesized
ttccctgttgctccgctcagtt

SEQ ID NO: 671230 - DNA, 22 bp, Artificial Sequence
  chemically synthesized
cctgttgctccgctcagtttgc

SEQ ID NO: 671231 - DNA, 22 bp, Artificial Sequence
  chemically synthesized
ttgctccgctcagtttgcaatt

SEQ ID NO: 671232 - DNA, 22 bp, Artificial Sequence
  chemically synthesized
aggaaaagaggaaattgcaaac

SEQ ID NO: 671233 - DNA, 22 bp, Artificial Sequence
  chemically synthesized
ctccgctcagtttgcaatttcc

SEQ ID NO: 671234 - DNA, 22 bp, Artificial Sequence
  chemically synthesized
cgctcagtttgcaatttcctct

SEQ ID NO: 671235 - DNA, 22 bp, Artificial Sequence
  chemically synthesized
agtttgcaatttcctcttttcc

SEQ ID NO: 671236 - DNA, 22 bp, Artificial Sequence
  chemically synthesized
gcaatttcctcttttcctcaat

SEQ ID NO: 671237 - DNA, 22 bp, Artificial Sequence
  chemically synthesized
caatttcctcttttcctcaatg

SEQ ID NO: 671238 - DNA, 22 bp, Artificial Sequence
  chemically synthesized
cctcttttcctcaatggtatca

SEQ ID NO: 671239 - DNA, 22 bp, Artificial Sequence
  chemically synthesized
ctcttttcctcaatggtatcac

SEQ ID NO: 671240 - DNA, 22 bp, Artificial Sequence
  chemically synthesized
ttttcctcaatggtatcaccat

SEQ ID NO: 671241 - DNA, 22 bp, Artificial Sequence
  chemically synthesized
ttcctcaatggtatcaccattc

SEQ ID NO: 671242 - DNA, 22 bp, Artificial Sequence
  chemically synthesized
tcctcaatggtatcaccattct

SEQ ID NO: 671243 - DNA, 22 bp, Artificial Sequence
  chemically synthesized
cctcaatggtatcaccattctc

SEQ ID NO: 671244 - DNA, 22 bp, Artificial Sequence
  chemically synthesized
ctcaatggtatcaccattctct

SEQ ID NO: 671245 - DNA, 22 bp, Artificial Sequence
  chemically synthesized
aatggtatcaccattctctgtg

SEQ ID NO: 671246 - DNA, 22 bp, Artificial Sequence
  chemically synthesized
aaggcgtggtgacacagagaat

SEQ ID NO: 671247 - DNA, 22 bp, Artificial Sequence
  chemically synthesized
gaaggcgtggtgacacagagaa

SEQ ID NO: 671248 - DNA, 22 bp, Artificial Sequence
  chemically synthesized
aaaatttgaaggcgtggtgaca

SEQ ID NO: 671249 - DNA, 22 bp, Artificial Sequence
  chemically synthesized
caaaatttgaaggcgtggtgac

SEQ ID NO: 671250 - DNA, 22 bp, Artificial Sequence
  chemically synthesized
tctgtgtcaccacgccttcaaa

SEQ ID NO: 671251 - DNA, 22 bp, Artificial Sequence
  chemically synthesized
tatgtcttcaaaatttgaaggc

SEQ ID NO: 671252 - DNA, 22 bp, Artificial Sequence
  chemically synthesized
tgtgtcaccacgccttcaaatt

SEQ ID NO: 671253 - DNA, 22 bp, Artificial Sequence
  chemically synthesized
tgtcaccacgccttcaaatttt

SEQ ID NO: 671254 - DNA, 22 bp, Artificial Sequence
  chemically synthesized
aagaaaaagggagttatatgtc

SEQ ID NO: 671255 - DNA, 22 bp, Artificial Sequence
  chemically synthesized
caaattttgaagacatataact

SEQ ID NO: 671256 - DNA, 22 bp, Artificial Sequence
  chemically synthesized
aaagaaaaagggagttatatgt

SEQ ID NO: 671257 - DNA, 22 bp, Artificial Sequence
  chemically synthesized
aaattttgaagacatataactc

SEQ ID NO: 671258 - DNA, 22 bp, Artificial Sequence
  chemically synthesized
taaagaaaaagggagttatatg

SEQ ID NO: 671259 - DNA, 22 bp, Artificial Sequence
  chemically synthesized
tgaagacatataactccctttt

SEQ ID NO: 671260 - DNA, 22 bp, Artificial Sequence
  chemically synthesized
gaagacatataactcccttttt

SEQ ID NO: 671261 - DNA, 22 bp, Artificial Sequence
  chemically synthesized
aagacatataactccctttttc

SEQ ID NO: 671262 - DNA, 22 bp, Artificial Sequence
  chemically synthesized
gacaggttttaaagaaaaaggg

SEQ ID NO: 671263 - DNA, 22 bp, Artificial Sequence
  chemically synthesized
cctttttctttaaaacctgtcc

SEQ ID NO: 671264 - DNA, 22 bp, Artificial Sequence
  chemically synthesized
tttctttaaaacctgtccaatc

SEQ ID NO: 671265 - DNA, 22 bp, Artificial Sequence
  chemically synthesized
ttctttaaaacctgtccaatct

SEQ ID NO: 671266 - DNA, 22 bp, Artificial Sequence
  chemically synthesized
tctttaaaacctgtccaatctg

SEQ ID NO: 671267 - DNA, 22 bp, Artificial Sequence
  chemically synthesized
ctttaaaacctgtccaatctgt

SEQ ID NO: 671268 - DNA, 22 bp, Artificial Sequence
  chemically synthesized
tttaaaacctgtccaatctgtg

SEQ ID NO: 671269 - DNA, 22 bp, Artificial Sequence
  chemically synthesized
ccagaaggtaatcacagattgg

SEQ ID NO: 671270 - DNA, 22 bp, Artificial Sequence
  chemically synthesized
taaaacctgtccaatctgtgat

SEQ ID NO: 671271 - DNA, 22 bp, Artificial Sequence
  chemically synthesized
aaaacctgtccaatctgtgatt

SEQ ID NO: 671272 - DNA, 22 bp, Artificial Sequence
  chemically synthesized
aaacctgtccaatctgtgatta

SEQ ID NO: 671273 - DNA, 22 bp, Artificial Sequence
  chemically synthesized
tccaatctgtgattaccttctg

SEQ ID NO: 671274 - DNA, 22 bp, Artificial Sequence
  chemically synthesized
acaaggtagaattgccagaagg

SEQ ID NO: 671275 - DNA, 22 bp, Artificial Sequence
  chemically synthesized
aacaaggtagaattgccagaag

SEQ ID NO: 671276 - DNA, 22 bp, Artificial Sequence
  chemically synthesized
ttaacaaggtagaattgccaga

SEQ ID NO: 671277 - DNA, 22 bp, Artificial Sequence
  chemically synthesized
cttaacaaggtagaattgccag

SEQ ID NO: 671278 - DNA, 22 bp, Artificial Sequence
  chemically synthesized
tcttaacaaggtagaattgcca

SEQ ID NO: 671279 - DNA, 22 bp, Artificial Sequence
  chemically synthesized
tgattaccttctggcaattcta

SEQ ID NO: 671280 - DNA, 22 bp, Artificial Sequence
  chemically synthesized
ttcttaacaaggtagaattgcc

SEQ ID NO: 671281 - DNA, 22 bp, Artificial Sequence
  chemically synthesized
ccttctggcaattctaccttgt

SEQ ID NO: 671282 - DNA, 22 bp, Artificial Sequence
  chemically synthesized
cagaggtttttcttaacaaggt

SEQ ID NO: 671283 - DNA, 22 bp, Artificial Sequence
  chemically synthesized
ctggcaattctaccttgttaag

SEQ ID NO: 671284 - DNA, 22 bp, Artificial Sequence
  chemically synthesized
tggcaattctaccttgttaaga

SEQ ID NO: 671285 - DNA, 22 bp, Artificial Sequence
  chemically synthesized
gcaattctaccttgttaagaaa

SEQ ID NO: 671286 - DNA, 22 bp, Artificial Sequence
  chemically synthesized
taccttgttaagaaaaacctct

SEQ ID NO: 671287 - DNA, 22 bp, Artificial Sequence
  chemically synthesized
ccttgttaagaaaaacctctgg

SEQ ID NO: 671288 - DNA, 22 bp, Artificial Sequence
  chemically synthesized
gttaagaaaaacctctggagtc

SEQ ID NO: 671289 - DNA, 22 bp, Artificial Sequence
  chemically synthesized
ttaagaaaaacctctggagtca

SEQ ID NO: 671290 - DNA, 22 bp, Artificial Sequence
  chemically synthesized
agaaaaacctctggagtcacgt

SEQ ID NO: 671291 - DNA, 22 bp, Artificial Sequence
  chemically synthesized
tggagtcacgttcccttttcct

SEQ ID NO: 671292 - DNA, 22 bp, Artificial Sequence
  chemically synthesized
gagtcacgttcccttttccttc

SEQ ID NO: 671293 - DNA, 22 bp, Artificial Sequence
  chemically synthesized
ggatagcaatgggggaaggaaa

SEQ ID NO: 671294 - DNA, 22 bp, Artificial Sequence
  chemically synthesized
aggatagcaatgggggaaggaa

SEQ ID NO: 671295 - DNA, 22 bp, Artificial Sequence
  chemically synthesized
ccttttccttcccccattgcta

SEQ ID NO: 671296 - DNA, 22 bp, Artificial Sequence
  chemically synthesized
ttccttcccccattgctatcct

SEQ ID NO: 671297 - DNA, 22 bp, Artificial Sequence
  chemically synthesized
tccttcccccattgctatccta

SEQ ID NO: 671298 - DNA, 22 bp, Artificial Sequence
  chemically synthesized
ccttcccccattgctatcctaa

SEQ ID NO: 671299 - DNA, 22 bp, Artificial Sequence
  chemically synthesized
cttcccccattgctatcctaag

SEQ ID NO: 671300 - DNA, 22 bp, Artificial Sequence
  chemically synthesized
acatgatgagggtcttaggata

SEQ ID NO: 671301 - DNA, 22 bp, Artificial Sequence
  chemically synthesized
cccccattgctatcctaagacc

SEQ ID NO: 671302 - DNA, 22 bp, Artificial Sequence
  chemically synthesized
ccccattgctatcctaagaccc

SEQ ID NO: 671303 - DNA, 22 bp, Artificial Sequence
  chemically synthesized
aggtaattgacatgatgagggt

SEQ ID NO: 671304 - DNA, 22 bp, Artificial Sequence
  chemically synthesized
gaggtaattgacatgatgaggg

SEQ ID NO: 671305 - DNA, 22 bp, Artificial Sequence
  chemically synthesized
ctatcctaagaccctcatcatg

SEQ ID NO: 671306 - DNA, 22 bp, Artificial Sequence
  chemically synthesized
tgaggtaattgacatgatgagg

SEQ ID NO: 671307 - DNA, 22 bp, Artificial Sequence
  chemically synthesized
tcctaagaccctcatcatgtca

SEQ ID NO: 671308 - DNA, 22 bp, Artificial Sequence
  chemically synthesized
ttttgaggtaattgacatgatg

SEQ ID NO: 671309 - DNA, 22 bp, Artificial Sequence
  chemically synthesized
gttttgaggtaattgacatgat

SEQ ID NO: 671310 - DNA, 22 bp, Artificial Sequence
  chemically synthesized
tgttttgaggtaattgacatga

SEQ ID NO: 671311 - DNA, 22 bp, Artificial Sequence
  chemically synthesized
agaccctcatcatgtcaattac

SEQ ID NO: 671312 - DNA, 22 bp, Artificial Sequence
  chemically synthesized
gttttgttttgaggtaattgac

SEQ ID NO: 671313 - DNA, 22 bp, Artificial Sequence
  chemically synthesized
cgttttgttttgaggtaattga

SEQ ID NO: 671314 - DNA, 22 bp, Artificial Sequence
  chemically synthesized
tttcgttttgttttgaggtaat

SEQ ID NO: 671315 - DNA, 22 bp, Artificial Sequence
  chemically synthesized
atcatgtcaattacctcaaaac

SEQ ID NO: 671316 - DNA, 22 bp, Artificial Sequence
  chemically synthesized
cctcaaaacaaaacgaaataat

SEQ ID NO: 671317 - DNA, 22 bp, Artificial Sequence
  chemically synthesized
gagaggggagagattatttcgt

SEQ ID NO: 671318 - DNA, 22 bp, Artificial Sequence
  chemically synthesized
aaaacaaaacgaaataatctct

SEQ ID NO: 671319 - DNA, 22 bp, Artificial Sequence
  chemically synthesized
aggacagttagagaggggagag

SEQ ID NO: 671320 - DNA, 22 bp, Artificial Sequence
  chemically synthesized
aaggacagttagagaggggaga

SEQ ID NO: 671321 - DNA, 22 bp, Artificial Sequence
  chemically synthesized
gtgggtgagtttaaggacagtt

SEQ ID NO: 671322 - DNA, 22 bp, Artificial Sequence
  chemically synthesized
ggtgggtgagtttaaggacagt

SEQ ID NO: 671323 - DNA, 22 bp, Artificial Sequence
  chemically synthesized
tcccctctctaactgtccttaa

SEQ ID NO: 671324 - DNA, 22 bp, Artificial Sequence
  chemically synthesized
ccctctctaactgtccttaaac

SEQ ID NO: 671325 - DNA, 22 bp, Artificial Sequence
  chemically synthesized
tctaactgtccttaaactcacc

SEQ ID NO: 671326 - DNA, 22 bp, Artificial Sequence
  chemically synthesized
taactgtccttaaactcaccca

SEQ ID NO: 671327 - DNA, 22 bp, Artificial Sequence
  chemically synthesized
actgtccttaaactcacccacc

SEQ ID NO: 671328 - DNA, 22 bp, Artificial Sequence
  chemically synthesized
gaataggaatttggtgggtgag

SEQ ID NO: 671329 - DNA, 22 bp, Artificial Sequence
  chemically synthesized
ggaataggaatttggtgggtga

SEQ ID NO: 671330 - DNA, 22 bp, Artificial Sequence
  chemically synthesized
tggaataggaatttggtgggtg

SEQ ID NO: 671331 - DNA, 22 bp, Artificial Sequence
  chemically synthesized
tccttaaactcacccaccaaat

SEQ ID NO: 671332 - DNA, 22 bp, Artificial Sequence
  chemically synthesized
tgttttggaataggaatttggt

SEQ ID NO: 671333 - DNA, 22 bp, Artificial Sequence
  chemically synthesized
aaactcacccaccaaattccta

SEQ ID NO: 671334 - DNA, 22 bp, Artificial Sequence
  chemically synthesized
tgtgttttggaataggaatttg

SEQ ID NO: 671335 - DNA, 22 bp, Artificial Sequence
  chemically synthesized
aactcacccaccaaattcctat

SEQ ID NO: 671336 - DNA, 22 bp, Artificial Sequence
  chemically synthesized
ctgtgttttggaataggaattt

SEQ ID NO: 671337 - DNA, 22 bp, Artificial Sequence
  chemically synthesized
acccaccaaattcctattccaa

SEQ ID NO: 671338 - DNA, 22 bp, Artificial Sequence
  chemically synthesized
ctattccaaaacacagaagacg

SEQ ID NO: 671339 - DNA, 22 bp, Artificial Sequence
  chemically synthesized
ttccaaaacacagaagacggac

SEQ ID NO: 671340 - DNA, 22 bp, Artificial Sequence
  chemically synthesized
caaaacacagaagacggacttc

SEQ ID NO: 671341 - DNA, 22 bp, Artificial Sequence
  chemically synthesized
agaaaagagaaataatgaagtc

SEQ ID NO: 671342 - DNA, 22 bp, Artificial Sequence
  chemically synthesized
cagaaaagagaaataatgaagt

SEQ ID NO: 671343 - DNA, 22 bp, Artificial Sequence
  chemically synthesized
aatcttcagaaaagagaaataa

SEQ ID NO: 671344 - DNA, 22 bp, Artificial Sequence
  chemically synthesized
ttaaatcttcagaaaagagaaa

SEQ ID NO: 671345 - DNA, 22 bp, Artificial Sequence
  chemically synthesized
cattatttctcttttctgaaga

SEQ ID NO: 671346 - DNA, 22 bp, Artificial Sequence
  chemically synthesized
attatttctcttttctgaagat

SEQ ID NO: 671347 - DNA, 22 bp, Artificial Sequence
  chemically synthesized
tttctcttttctgaagatttaa

SEQ ID NO: 671348 - DNA, 22 bp, Artificial Sequence
  chemically synthesized
ctcttttctgaagatttaacaa

SEQ ID NO: 671349 - DNA, 22 bp, Artificial Sequence
  chemically synthesized
tcttttctgaagatttaacaat

SEQ ID NO: 671350 - DNA, 22 bp, Artificial Sequence
  chemically synthesized
ttttctgaagatttaacaatgt

SEQ ID NO: 671351 - DNA, 22 bp, Artificial Sequence
  chemically synthesized
gcaatgggaaaaacattgttaa

SEQ ID NO: 671352 - DNA, 22 bp, Artificial Sequence
  chemically synthesized
ttctgaagatttaacaatgttt

SEQ ID NO: 671353 - DNA, 22 bp, Artificial Sequence
  chemically synthesized
tctgaagatttaacaatgtttt

SEQ ID NO: 671354 - DNA, 22 bp, Artificial Sequence
  chemically synthesized
ctgaagatttaacaatgttttt

SEQ ID NO: 671355 - DNA, 22 bp, Artificial Sequence
  chemically synthesized
attggcaatgggaaaaacattg

SEQ ID NO: 671356 - DNA, 22 bp, Artificial Sequence
  chemically synthesized
tgaagatttaacaatgtttttc

SEQ ID NO: 671357 - DNA, 22 bp, Artificial Sequence
  chemically synthesized
gattggcaatgggaaaaacatt

SEQ ID NO: 671358 - DNA, 22 bp, Artificial Sequence
  chemically synthesized
aagatttaacaatgtttttccc

SEQ ID NO: 671359 - DNA, 22 bp, Artificial Sequence
  chemically synthesized
catttgattggcaatgggaaaa

SEQ ID NO: 671360 - DNA, 22 bp, Artificial Sequence
  chemically synthesized
aacaatgtttttcccattgcca

SEQ ID NO: 671361 - DNA, 22 bp, Artificial Sequence
  chemically synthesized
acaatgtttttcccattgccaa

SEQ ID NO: 671362 - DNA, 22 bp, Artificial Sequence
  chemically synthesized
cattgcatttgattggcaatgg

SEQ ID NO: 671363 - DNA, 22 bp, Artificial Sequence
  chemically synthesized
acattgcatttgattggcaatg

SEQ ID NO: 671364 - DNA, 22 bp, Artificial Sequence
  chemically synthesized
ttcccattgccaatcaaatgca

SEQ ID NO: 671365 - DNA, 22 bp, Artificial Sequence
  chemically synthesized
tcccattgccaatcaaatgcaa

SEQ ID NO: 671366 - DNA, 22 bp, Artificial Sequence
  chemically synthesized
cccattgccaatcaaatgcaat

SEQ ID NO: 671367 - DNA, 22 bp, Artificial Sequence
  chemically synthesized
ccattgccaatcaaatgcaatg

SEQ ID NO: 671368 - DNA, 22 bp, Artificial Sequence
  chemically synthesized
tagagtgagaaatttacattgc

SEQ ID NO: 671369 - DNA, 22 bp, Artificial Sequence
  chemically synthesized
ccaatcaaatgcaatgtaaatt

SEQ ID NO: 671370 - DNA, 22 bp, Artificial Sequence
  chemically synthesized
aattatagagtgagaaatttac

SEQ ID NO: 671371 - DNA, 22 bp, Artificial Sequence
  chemically synthesized
aaattatagagtgagaaattta

SEQ ID NO: 671372 - DNA, 22 bp, Artificial Sequence
  chemically synthesized
agtgccttaaattatagagtga

SEQ ID NO: 671373 - DNA, 22 bp, Artificial Sequence
  chemically synthesized
gggtgaactaagtgccttaaat

SEQ ID NO: 671374 - DNA, 22 bp, Artificial Sequence
  chemically synthesized
ctcactctataatttaaggcac

SEQ ID NO: 671375 - DNA, 22 bp, Artificial Sequence
  chemically synthesized
tcactctataatttaaggcact

SEQ ID NO: 671376 - DNA, 22 bp, Artificial Sequence
  chemically synthesized
actctataatttaaggcactta

SEQ ID NO: 671377 - DNA, 22 bp, Artificial Sequence
  chemically synthesized
tataatttaaggcacttagttc

SEQ ID NO: 671378 - DNA, 22 bp, Artificial Sequence
  chemically synthesized
taatttaaggcacttagttcac

SEQ ID NO: 671379 - DNA, 22 bp, Artificial Sequence
  chemically synthesized
agtgcccctggggtgaactaag

SEQ ID NO: 671380 - DNA, 22 bp, Artificial Sequence
  chemically synthesized
attcagtgcccctggggtgaac

SEQ ID NO: 671381 - DNA, 22 bp, Artificial Sequence
  chemically synthesized
aaggcacttagttcaccccagg

SEQ ID NO: 671382 - DNA, 22 bp, Artificial Sequence
  chemically synthesized
aggcacttagttcaccccaggg

SEQ ID NO: 671383 - DNA, 22 bp, Artificial Sequence
  chemically synthesized
agttcaccccaggggcactgaa

SEQ ID NO: 671384 - DNA, 22 bp, Artificial Sequence
  chemically synthesized
gttcaccccaggggcactgaat

SEQ ID NO: 671385 - DNA, 22 bp, Artificial Sequence
  chemically synthesized
aaagggaaatctgattcagtgc

SEQ ID NO: 671386 - DNA, 22 bp, Artificial Sequence
  chemically synthesized
aaaagggaaatctgattcagtg

SEQ ID NO: 671387 - DNA, 22 bp, Artificial Sequence
  chemically synthesized
taaaagggaaatctgattcagt

SEQ ID NO: 671388 - DNA, 22 bp, Artificial Sequence
  chemically synthesized
accccaggggcactgaatcaga

SEQ ID NO: 671389 - DNA, 22 bp, Artificial Sequence
  chemically synthesized
ttaaaagggaaatctgattcag

SEQ ID NO: 671390 - DNA, 22 bp, Artificial Sequence
  chemically synthesized
cagatttttaaaagggaaatct

SEQ ID NO: 671391 - DNA, 22 bp, Artificial Sequence
  chemically synthesized
gccactccagatttttaaaagg

SEQ ID NO: 671392 - DNA, 22 bp, Artificial Sequence
  chemically synthesized
aatcagatttcccttttaaaaa

SEQ ID NO: 671393 - DNA, 22 bp, Artificial Sequence
  chemically synthesized
cccttttaaaaatctggagtgg

SEQ ID NO: 671394 - DNA, 22 bp, Artificial Sequence
  chemically synthesized
ccttttaaaaatctggagtggc

SEQ ID NO: 671395 - DNA, 22 bp, Artificial Sequence
  chemically synthesized
ttaaaaatctggagtggccagg

SEQ ID NO: 671396 - DNA, 22 bp, Artificial Sequence
  chemically synthesized
taaaaatctggagtggccaggc

SEQ ID NO: 671397 - DNA, 22 bp, Artificial Sequence
  chemically synthesized
aaaaatctggagtggccaggcg

SEQ ID NO: 671398 - DNA, 22 bp, Artificial Sequence
  chemically synthesized
aaaatctggagtggccaggcgc

SEQ ID NO: 671399 - DNA, 22 bp, Artificial Sequence
  chemically synthesized
caagaatgagccaccgcgcctg

SEQ ID NO: 671400 - DNA, 22 bp, Artificial Sequence
  chemically synthesized
gagtggccaggcgcggtggctc

SEQ ID NO: 671401 - DNA, 22 bp, Artificial Sequence
  chemically synthesized
ggattacaagaatgagccaccg

SEQ ID NO: 671402 - DNA, 22 bp, Artificial Sequence
  chemically synthesized
aagtgctgggattacaagaatg

SEQ ID NO: 671403 - DNA, 22 bp, Artificial Sequence
  chemically synthesized
ctaaagtgctgggattacaaga

SEQ ID NO: 671404 - DNA, 22 bp, Artificial Sequence
  chemically synthesized
cctaaagtgctgggattacaag

SEQ ID NO: 671405 - DNA, 22 bp, Artificial Sequence
  chemically synthesized
ggcttcctaaagtgctgggatt

SEQ ID NO: 671406 - DNA, 22 bp, Artificial Sequence
  chemically synthesized
attcttgtaatcccagcacttt

SEQ ID NO: 671407 - DNA, 22 bp, Artificial Sequence
  chemically synthesized
ttgtaatcccagcactttagga

SEQ ID NO: 671408 - DNA, 22 bp, Artificial Sequence
  chemically synthesized
cccatctcggcttcctaaagtg

SEQ ID NO: 671409 - DNA, 22 bp, Artificial Sequence
  chemically synthesized
gtaatcccagcactttaggaag

SEQ ID NO: 671410 - DNA, 22 bp, Artificial Sequence
  chemically synthesized
taatcccagcactttaggaagc

SEQ ID NO: 671411 - DNA, 22 bp, Artificial Sequence
  chemically synthesized
aagccatctgcccatctcggct

SEQ ID NO: 671412 - DNA, 22 bp, Artificial Sequence
  chemically synthesized
agctcaagccatctgcccatct

SEQ ID NO: 671413 - DNA, 22 bp, Artificial Sequence
  chemically synthesized
gagctcaagccatctgcccatc

SEQ ID NO: 671414 - DNA, 22 bp, Artificial Sequence
  chemically synthesized
taggaagccgagatgggcagat

SEQ ID NO: 671415 - DNA, 22 bp, Artificial Sequence
  chemically synthesized
aggaagccgagatgggcagatg

SEQ ID NO: 671416 - DNA, 22 bp, Artificial Sequence
  chemically synthesized
ttgagctcaagccatctgccca

SEQ ID NO: 671417 - DNA, 22 bp, Artificial Sequence
  chemically synthesized
ggaagccgagatgggcagatgg

SEQ ID NO: 671418 - DNA, 22 bp, Artificial Sequence
  chemically synthesized
aactcttgagctcaagccatct

SEQ ID NO: 671419 - DNA, 22 bp, Artificial Sequence
  chemically synthesized
tcaactcttgagctcaagccat

SEQ ID NO: 671420 - DNA, 22 bp, Artificial Sequence
  chemically synthesized
ttctcaactcttgagctcaagc

SEQ ID NO: 671421 - DNA, 22 bp, Artificial Sequence
  chemically synthesized
tccaggctgttctcaactcttg

SEQ ID NO: 671422 - DNA, 22 bp, Artificial Sequence
  chemically synthesized
gagctcaagagttgagaacagc

SEQ ID NO: 671423 - DNA, 22 bp, Artificial Sequence
  chemically synthesized
agctcaagagttgagaacagcc

SEQ ID NO: 671424 - DNA, 22 bp, Artificial Sequence
  chemically synthesized
ccatgttatccaggctgttctc

SEQ ID NO: 671425 - DNA, 22 bp, Artificial Sequence
  chemically synthesized
gccatgttatccaggctgttct

SEQ ID NO: 671426 - DNA, 22 bp, Artificial Sequence
  chemically synthesized
tgccatgttatccaggctgttc

SEQ ID NO: 671427 - DNA, 22 bp, Artificial Sequence
  chemically synthesized
aagagttgagaacagcctggat

SEQ ID NO: 671428 - DNA, 22 bp, Artificial Sequence
  chemically synthesized
agaacagcctggataacatggc

SEQ ID NO: 671429 - DNA, 22 bp, Artificial Sequence
  chemically synthesized
gtagagacagggttttgccatg

SEQ ID NO: 671430 - DNA, 22 bp, Artificial Sequence
  chemically synthesized
ggtagagacagggttttgccat

SEQ ID NO: 671431 - DNA, 22 bp, Artificial Sequence
  chemically synthesized
tggtagagacagggttttgcca

SEQ ID NO: 671432 - DNA, 22 bp, Artificial Sequence
  chemically synthesized
ttggtagagacagggttttgcc

SEQ ID NO: 671433 - DNA, 22 bp, Artificial Sequence
  chemically synthesized
gataacatggcaaaaccctgtc

SEQ ID NO: 671434 - DNA, 22 bp, Artificial Sequence
  chemically synthesized
tatttttggtagagacagggtt

SEQ ID NO: 671435 - DNA, 22 bp, Artificial Sequence
  chemically synthesized
gtatttttggtagagacagggt

SEQ ID NO: 671436 - DNA, 22 bp, Artificial Sequence
  chemically synthesized
tgtatttttggtagagacaggg

SEQ ID NO: 671437 - DNA, 22 bp, Artificial Sequence
  chemically synthesized
ttgtatttttggtagagacagg

SEQ ID NO: 671438 - DNA, 22 bp, Artificial Sequence
  chemically synthesized
atttttgtatttttggtagaga

SEQ ID NO: 671439 - DNA, 22 bp, Artificial Sequence
  chemically synthesized
gctaatttttgtatttttggta

SEQ ID NO: 671440 - DNA, 22 bp, Artificial Sequence
  chemically synthesized
tctctaccaaaaatacaaaaat

SEQ ID NO: 671441 - DNA, 22 bp, Artificial Sequence
  chemically synthesized
taccaaaaatacaaaaattagc

SEQ ID NO: 671442 - DNA, 22 bp, Artificial Sequence
  chemically synthesized
ccaaaaatacaaaaattagcca

SEQ ID NO: 671443 - DNA, 22 bp, Artificial Sequence
  chemically synthesized
caggcacacaccgccatacctg

SEQ ID NO: 671444 - DNA, 22 bp, Artificial Sequence
  chemically synthesized
ggactacaggcacacaccgcca

SEQ ID NO: 671445 - DNA, 22 bp, Artificial Sequence
  chemically synthesized
gccaggtatggcggtgtgtgcc

SEQ ID NO: 671446 - DNA, 22 bp, Artificial Sequence
  chemically synthesized
agccccccaggcagctgggact

SEQ ID NO: 671447 - DNA, 22 bp, Artificial Sequence
  chemically synthesized
cctcagccccccaggcagctgg

SEQ ID NO: 671448 - DNA, 22 bp, Artificial Sequence
  chemically synthesized
ctgcctcagccccccaggcagc

SEQ ID NO: 671449 - DNA, 22 bp, Artificial Sequence
  chemically synthesized
tcctgcctcagccccccaggca

SEQ ID NO: 671450 - DNA, 22 bp, Artificial Sequence
  chemically synthesized
tagtcccagctgcctggggggc

SEQ ID NO: 671451 - DNA, 22 bp, Artificial Sequence
  chemically synthesized
aagtgattctcctgcctcagcc

SEQ ID NO: 671452 - DNA, 22 bp, Artificial Sequence
  chemically synthesized
cctggggggctgaggcaggaga

SEQ ID NO: 671453 - DNA, 22 bp, Artificial Sequence
  chemically synthesized
ggctcaagtgattctcctgcct

SEQ ID NO: 671454 - DNA, 22 bp, Artificial Sequence
  chemically synthesized
ctgggctcaagtgattctcctg

SEQ ID NO: 671455 - DNA, 22 bp, Artificial Sequence
  chemically synthesized
gggggctgaggcaggagaatca

SEQ ID NO: 671456 - DNA, 22 bp, Artificial Sequence
  chemically synthesized
aggcaggagaatcacttgagcc

SEQ ID NO: 671457 - DNA, 22 bp, Artificial Sequence
  chemically synthesized
gtgccacaacctcctgggctca

SEQ ID NO: 671458 - DNA, 22 bp, Artificial Sequence
  chemically synthesized
actggtgccacaacctcctggg

SEQ ID NO: 671459 - DNA, 22 bp, Artificial Sequence
  chemically synthesized
gagcccaggaggttgtggcacc

SEQ ID NO: 671460 - DNA, 22 bp, Artificial Sequence
  chemically synthesized
agcccaggaggttgtggcacca

SEQ ID NO: 671461 - DNA, 22 bp, Artificial Sequence
  chemically synthesized
tggcaccagtgagccatgttcg

SEQ ID NO: 671462 - DNA, 22 bp, Artificial Sequence
  chemically synthesized
gggtgcagtggtgcgaacatgg

SEQ ID NO: 671463 - DNA, 22 bp, Artificial Sequence
  chemically synthesized
tcgcccaggctggggtgcagtg

SEQ ID NO: 671464 - DNA, 22 bp, Artificial Sequence
  chemically synthesized
gtcgcccaggctggggtgcagt

SEQ ID NO: 671465 - DNA, 22 bp, Artificial Sequence
  chemically synthesized
tgtcgcccaggctggggtgcag

SEQ ID NO: 671466 - DNA, 22 bp, Artificial Sequence
  chemically synthesized
actttgtcgcccaggctggggt

SEQ ID NO: 671467 - DNA, 22 bp, Artificial Sequence
  chemically synthesized
gcaccactgcaccccagcctgg

SEQ ID NO: 671468 - DNA, 22 bp, Artificial Sequence
  chemically synthesized
caccccagcctgggcgacaaag

SEQ ID NO: 671469 - DNA, 22 bp, Artificial Sequence
  chemically synthesized
agacagggtctcactttgtcgc

SEQ ID NO: 671470 - DNA, 22 bp, Artificial Sequence
  chemically synthesized
gagacagggtctcactttgtcg

SEQ ID NO: 671471 - DNA, 22 bp, Artificial Sequence
  chemically synthesized
tgagacagggtctcactttgtc

SEQ ID NO: 671472 - DNA, 22 bp, Artificial Sequence
  chemically synthesized
ttgagacagggtctcactttgt

SEQ ID NO: 671473 - DNA, 22 bp, Artificial Sequence
  chemically synthesized
tttgagacagggtctcactttg

SEQ ID NO: 671474 - DNA, 22 bp, Artificial Sequence
  chemically synthesized
ctttttgagacagggtctcact

SEQ ID NO: 671475 - DNA, 22 bp, Artificial Sequence
  chemically synthesized
gctttttgagacagggtctcac

SEQ ID NO: 671476 - DNA, 22 bp, Artificial Sequence
  chemically synthesized
tgctttttgagacagggtctca

SEQ ID NO: 671477 - DNA, 22 bp, Artificial Sequence
  chemically synthesized
ttgctttttgagacagggtctc

SEQ ID NO: 671478 - DNA, 22 bp, Artificial Sequence
  chemically synthesized
ggcgacaaagtgagaccctgtc

SEQ ID NO: 671479 - DNA, 22 bp, Artificial Sequence
  chemically synthesized
tttgctttttgagacagggtct

SEQ ID NO: 671480 - DNA, 22 bp, Artificial Sequence
  chemically synthesized
ttttgctttttgagacagggtc

SEQ ID NO: 671481 - DNA, 22 bp, Artificial Sequence
  chemically synthesized
tttttgctttttgagacagggt

SEQ ID NO: 671482 - DNA, 22 bp, Artificial Sequence
  chemically synthesized
ttttttgctttttgagacaggg

SEQ ID NO: 671483 - DNA, 22 bp, Artificial Sequence
  chemically synthesized
tttttttgctttttgagacagg

SEQ ID NO: 671484 - DNA, 22 bp, Artificial Sequence
  chemically synthesized
ttttttttgctttttgagacag

SEQ ID NO: 671485 - DNA, 22 bp, Artificial Sequence
  chemically synthesized
tttttttttgctttttgagaca

SEQ ID NO: 671486 - DNA, 22 bp, Artificial Sequence
  chemically synthesized
ttttttttttgctttttgagac

SEQ ID NO: 671487 - DNA, 22 bp, Artificial Sequence
  chemically synthesized
tttttttttttgctttttgaga

SEQ ID NO: 671488 - DNA, 22 bp, Artificial Sequence
  chemically synthesized
ttttttttttttgctttttgag

SEQ ID NO: 671489 - DNA, 22 bp, Artificial Sequence
  chemically synthesized
tttttttttttttgctttttga

SEQ ID NO: 671490 - DNA, 22 bp, Artificial Sequence
  chemically synthesized
ttttttttttttttgctttttg

SEQ ID NO: 671491 - DNA, 22 bp, Artificial Sequence
  chemically synthesized
tttttttttttttttgcttttt

SEQ ID NO: 671492 - DNA, 22 bp, Artificial Sequence
  chemically synthesized
ttttttttttttttttgctttt

SEQ ID NO: 671493 - DNA, 22 bp, Artificial Sequence
  chemically synthesized
tttttttttttttttttgcttt

SEQ ID NO: 671494 - DNA, 22 bp, Artificial Sequence
  chemically synthesized
ttttttttttttttttttgctt

SEQ ID NO: 671495 - DNA, 22 bp, Artificial Sequence
  chemically synthesized
tttttttttttttttttttgct

SEQ ID NO: 671496 - DNA, 22 bp, Artificial Sequence
  chemically synthesized
ttttttttttttttttttttgc

SEQ ID NO: 671497 - DNA, 22 bp, Artificial Sequence
  chemically synthesized
tttttttttttttttttttttg

SEQ ID NO: 671498 - DNA, 22 bp, Artificial Sequence
  chemically synthesized
tttttttttttttttttttttt

SEQ ID NO: 671499 - DNA, 22 bp, Artificial Sequence
  chemically synthesized
tctcaaaaagcaaaaaaaaaaa

SEQ ID NO: 671500 - DNA, 22 bp, Artificial Sequence
  chemically synthesized
tttttttttttttttttttttt

SEQ ID NO: 671501 - DNA, 22 bp, Artificial Sequence
  chemically synthesized
tttttttttttttttttttttt

SEQ ID NO: 671502 - DNA, 22 bp, Artificial Sequence
  chemically synthesized
tttttttttttttttttttttt

SEQ ID NO: 671503 - DNA, 22 bp, Artificial Sequence
  chemically synthesized
tttttttttttttttttttttt

SEQ ID NO: 671504 - DNA, 22 bp, Artificial Sequence
  chemically synthesized
aaaaagcaaaaaaaaaaaaaaa

SEQ ID NO: 671505 - DNA, 22 bp, Artificial Sequence
  chemically synthesized
cagatttttttttttttttttt

SEQ ID NO: 671506 - DNA, 22 bp, Artificial Sequence
  chemically synthesized
ctccagattttttttttttttt

SEQ ID NO: 671507 - DNA, 22 bp, Artificial Sequence
  chemically synthesized
agaatctactccagattttttt

SEQ ID NO: 671508 - DNA, 22 bp, Artificial Sequence
  chemically synthesized
tgagaatctactccagattttt

SEQ ID NO: 671509 - DNA, 22 bp, Artificial Sequence
  chemically synthesized
tctgagaatctactccagattt

SEQ ID NO: 671510 - DNA, 22 bp, Artificial Sequence
  chemically synthesized
ttctctgagaatctactccaga

SEQ ID NO: 671511 - DNA, 22 bp, Artificial Sequence
  chemically synthesized
gagtagattctcagagaacaat

SEQ ID NO: 671512 - DNA, 22 bp, Artificial Sequence
  chemically synthesized
cgagtcagtgaagacattgttc

SEQ ID NO: 671513 - DNA, 22 bp, Artificial Sequence
  chemically synthesized
gcgagtcagtgaagacattgtt

SEQ ID NO: 671514 - DNA, 22 bp, Artificial Sequence
  chemically synthesized
tttgcgagtcagtgaagacatt

SEQ ID NO: 671515 - DNA, 22 bp, Artificial Sequence
  chemically synthesized
gtttgcgagtcagtgaagacat

SEQ ID NO: 671516 - DNA, 22 bp, Artificial Sequence
  chemically synthesized
tcagagaacaatgtcttcactg

SEQ ID NO: 671517 - DNA, 22 bp, Artificial Sequence
  chemically synthesized
agagaacaatgtcttcactgac

SEQ ID NO: 671518 - DNA, 22 bp, Artificial Sequence
  chemically synthesized
gcttgtttgcgagtcagtgaag

SEQ ID NO: 671519 - DNA, 22 bp, Artificial Sequence
  chemically synthesized
cactgactcgcaaacaagccag

SEQ ID NO: 671520 - DNA, 22 bp, Artificial Sequence
  chemically synthesized
actgactcgcaaacaagccagt

SEQ ID NO: 671521 - DNA, 22 bp, Artificial Sequence
  chemically synthesized
actcgcaaacaagccagtcttt

SEQ ID NO: 671522 - DNA, 22 bp, Artificial Sequence
  chemically synthesized
gcaaacaagccagtctttcata

SEQ ID NO: 671523 - DNA, 22 bp, Artificial Sequence
  chemically synthesized
cagatagtgtagcagcataaac

SEQ ID NO: 671524 - DNA, 22 bp, Artificial Sequence
  chemically synthesized
tcatacctttgtttatgctgct

SEQ ID NO: 671525 - DNA, 22 bp, Artificial Sequence
  chemically synthesized
catacctttgtttatgctgcta

SEQ ID NO: 671526 - DNA, 22 bp, Artificial Sequence
  chemically synthesized
atacctttgtttatgctgctac

SEQ ID NO: 671527 - DNA, 22 bp, Artificial Sequence
  chemically synthesized
tgtttatgctgctacactatct

SEQ ID NO: 671528 - DNA, 22 bp, Artificial Sequence
  chemically synthesized
gtttatgctgctacactatctg

SEQ ID NO: 671529 - DNA, 22 bp, Artificial Sequence
  chemically synthesized
tttatgctgctacactatctgg

SEQ ID NO: 671530 - DNA, 22 bp, Artificial Sequence
  chemically synthesized
atgctgctacactatctggaat

SEQ ID NO: 671531 - DNA, 22 bp, Artificial Sequence
  chemically synthesized
tgctgctacactatctggaata

SEQ ID NO: 671532 - DNA, 22 bp, Artificial Sequence
  chemically synthesized
ctacactatctggaatatcttg

SEQ ID NO: 671533 - DNA, 22 bp, Artificial Sequence
  chemically synthesized
cactatctggaatatcttggcc

SEQ ID NO: 671534 - DNA, 22 bp, Artificial Sequence
  chemically synthesized
tctggaatatcttggccctaca

SEQ ID NO: 671535 - DNA, 22 bp, Artificial Sequence
  chemically synthesized
aggtaaagtaaaatgtagggcc

SEQ ID NO: 671536 - DNA, 22 bp, Artificial Sequence
  chemically synthesized
gaatatcttggccctacatttt

SEQ ID NO: 671537 - DNA, 22 bp, Artificial Sequence
  chemically synthesized
taatactcaggtaaagtaaaat

SEQ ID NO: 671538 - DNA, 22 bp, Artificial Sequence
  chemically synthesized
gtaatactcaggtaaagtaaaa

SEQ ID NO: 671539 - DNA, 22 bp, Artificial Sequence
  chemically synthesized
tgtaatactcaggtaaagtaaa

SEQ ID NO: 671540 - DNA, 22 bp, Artificial Sequence
  chemically synthesized
ggccctacattttactttacct

SEQ ID NO: 671541 - DNA, 22 bp, Artificial Sequence
  chemically synthesized
gccctacattttactttacctg

SEQ ID NO: 671542 - DNA, 22 bp, Artificial Sequence
  chemically synthesized
cattttactttacctgagtatt

SEQ ID NO: 671543 - DNA, 22 bp, Artificial Sequence
  chemically synthesized
ggaagaaattttgtaatactca

SEQ ID NO: 671544 - DNA, 22 bp, Artificial Sequence
  chemically synthesized
taggaagaaattttgtaatact

SEQ ID NO: 671545 - DNA, 22 bp, Artificial Sequence
  chemically synthesized
tactttacctgagtattacaaa

SEQ ID NO: 671546 - DNA, 22 bp, Artificial Sequence
  chemically synthesized
actttacctgagtattacaaaa

SEQ ID NO: 671547 - DNA, 22 bp, Artificial Sequence
  chemically synthesized
ctttacctgagtattacaaaat

SEQ ID NO: 671548 - DNA, 22 bp, Artificial Sequence
  chemically synthesized
ttctaggaagaaattttgtaat

SEQ ID NO: 671549 - DNA, 22 bp, Artificial Sequence
  chemically synthesized
tacctgagtattacaaaatttc

SEQ ID NO: 671550 - DNA, 22 bp, Artificial Sequence
  chemically synthesized
acctgagtattacaaaatttct

SEQ ID NO: 671551 - DNA, 22 bp, Artificial Sequence
  chemically synthesized
cctgagtattacaaaatttctt

SEQ ID NO: 671552 - DNA, 22 bp, Artificial Sequence
  chemically synthesized
agtattacaaaatttcttccta

SEQ ID NO: 671553 - DNA, 22 bp, Artificial Sequence
  chemically synthesized
caaaatttcttcctagaacaat

SEQ ID NO: 671554 - DNA, 22 bp, Artificial Sequence
  chemically synthesized
gagagtggaaaaaaacattgtt

SEQ ID NO: 671555 - DNA, 22 bp, Artificial Sequence
  chemically synthesized
ggagagtggaaaaaaacattgt

SEQ ID NO: 671556 - DNA, 22 bp, Artificial Sequence
  chemically synthesized
cttcctagaacaatgttttttt

SEQ ID NO: 671557 - DNA, 22 bp, Artificial Sequence
  chemically synthesized
tttggagagtggaaaaaaacat

SEQ ID NO: 671558 - DNA, 22 bp, Artificial Sequence
  chemically synthesized
ttcctagaacaatgtttttttc

SEQ ID NO: 671559 - DNA, 22 bp, Artificial Sequence
  chemically synthesized
cctagaacaatgtttttttcca

SEQ ID NO: 671560 - DNA, 22 bp, Artificial Sequence
  chemically synthesized
ctagaacaatgtttttttccac

SEQ ID NO: 671561 - DNA, 22 bp, Artificial Sequence
  chemically synthesized
gaacaatgtttttttccactct

SEQ ID NO: 671562 - DNA, 22 bp, Artificial Sequence
  chemically synthesized
gggagagttgtttggagagtgg

SEQ ID NO: 671563 - DNA, 22 bp, Artificial Sequence
  chemically synthesized
ttttccactctccaaacaactc

SEQ ID NO: 671564 - DNA, 22 bp, Artificial Sequence
  chemically synthesized
tttccactctccaaacaactct

SEQ ID NO: 671565 - DNA, 22 bp, Artificial Sequence
  chemically synthesized
gaataattagggagagttgttt

SEQ ID NO: 671566 - DNA, 22 bp, Artificial Sequence
  chemically synthesized
ttccactctccaaacaactctc

SEQ ID NO: 671567 - DNA, 22 bp, Artificial Sequence
  chemically synthesized
tccactctccaaacaactctcc

SEQ ID NO: 671568 - DNA, 22 bp, Artificial Sequence
  chemically synthesized
ccactctccaaacaactctccc

SEQ ID NO: 671569 - DNA, 22 bp, Artificial Sequence
  chemically synthesized
cactctccaaacaactctccct

SEQ ID NO: 671570 - DNA, 22 bp, Artificial Sequence
  chemically synthesized
attagaataattagggagagtt

SEQ ID NO: 671571 - DNA, 22 bp, Artificial Sequence
  chemically synthesized
tccaaacaactctccctaatta

SEQ ID NO: 671572 - DNA, 22 bp, Artificial Sequence
  chemically synthesized
caaacaactctccctaattatt

SEQ ID NO: 671573 - DNA, 22 bp, Artificial Sequence
  chemically synthesized
tccctaattattctaattaata

SEQ ID NO: 671574 - DNA, 22 bp, Artificial Sequence
  chemically synthesized
cctaattattctaattaatact

SEQ ID NO: 671575 - DNA, 22 bp, Artificial Sequence
  chemically synthesized
attattctaattaatactgctc

SEQ ID NO: 671576 - DNA, 22 bp, Artificial Sequence
  chemically synthesized
tataggtaggaagagcagtatt

SEQ ID NO: 671577 - DNA, 22 bp, Artificial Sequence
  chemically synthesized
atataggtaggaagagcagtat

SEQ ID NO: 671578 - DNA, 22 bp, Artificial Sequence
  chemically synthesized
ttctaattaatactgctcttcc

SEQ ID NO: 671579 - DNA, 22 bp, Artificial Sequence
  chemically synthesized
taattaatactgctcttcctac

SEQ ID NO: 671580 - DNA, 22 bp, Artificial Sequence
  chemically synthesized
attaatactgctcttcctacct

SEQ ID NO: 671581 - DNA, 22 bp, Artificial Sequence
  chemically synthesized
atactgctcttcctacctatat

SEQ ID NO: 671582 - DNA, 22 bp, Artificial Sequence
  chemically synthesized
ctcttcctacctatataaggta

SEQ ID NO: 671583 - DNA, 22 bp, Artificial Sequence
  chemically synthesized
ttcctacctatataaggtacca

SEQ ID NO: 671584 - DNA, 22 bp, Artificial Sequence
  chemically synthesized
aggtcaaacgtatggtacctta

SEQ ID NO: 671585 - DNA, 22 bp, Artificial Sequence
  chemically synthesized
cctacctatataaggtaccata

SEQ ID NO: 671586 - DNA, 22 bp, Artificial Sequence
  chemically synthesized
ctacctatataaggtaccatac

SEQ ID NO: 671587 - DNA, 22 bp, Artificial Sequence
  chemically synthesized
cctatataaggtaccatacgtt

SEQ ID NO: 671588 - DNA, 22 bp, Artificial Sequence
  chemically synthesized
tataaggtaccatacgtttgac

SEQ ID NO: 671589 - DNA, 22 bp, Artificial Sequence
  chemically synthesized
aataagattaaggtcaaacgta

SEQ ID NO: 671590 - DNA, 22 bp, Artificial Sequence
  chemically synthesized
aaataagattaaggtcaaacgt

SEQ ID NO: 671591 - DNA, 22 bp, Artificial Sequence
  chemically synthesized
gaccttaatcttatttaagttg

SEQ ID NO: 671592 - DNA, 22 bp, Artificial Sequence
  chemically synthesized
accttaatcttatttaagttgg

SEQ ID NO: 671593 - DNA, 22 bp, Artificial Sequence
  chemically synthesized
caagaccgtgtacaccaactta

SEQ ID NO: 671594 - DNA, 22 bp, Artificial Sequence
  chemically synthesized
aatcttatttaagttggtgtac

SEQ ID NO: 671595 - DNA, 22 bp, Artificial Sequence
  chemically synthesized
atcttatttaagttggtgtaca

SEQ ID NO: 671596 - DNA, 22 bp, Artificial Sequence
  chemically synthesized
atttaagttggtgtacacggtc

SEQ ID NO: 671597 - DNA, 22 bp, Artificial Sequence
  chemically synthesized
tttaagttggtgtacacggtct

SEQ ID NO: 671598 - DNA, 22 bp, Artificial Sequence
  chemically synthesized
ataaatgttacaagaccgtgta

SEQ ID NO: 671599 - DNA, 22 bp, Artificial Sequence
  chemically synthesized
aagttggtgtacacggtcttgt

SEQ ID NO: 671600 - DNA, 22 bp, Artificial Sequence
  chemically synthesized
agttggtgtacacggtcttgta

SEQ ID NO: 671601 - DNA, 22 bp, Artificial Sequence
  chemically synthesized
gtgtacacggtcttgtaacatt

SEQ ID NO: 671602 - DNA, 22 bp, Artificial Sequence
  chemically synthesized
ggaagtaataaaacagttaata

SEQ ID NO: 671603 - DNA, 22 bp, Artificial Sequence
  chemically synthesized
gtaacatttattaactgtttta

SEQ ID NO: 671604 - DNA, 22 bp, Artificial Sequence
  chemically synthesized
taacatttattaactgttttat

SEQ ID NO: 671605 - DNA, 22 bp, Artificial Sequence
  chemically synthesized
attaactgttttattacttccc

SEQ ID NO: 671606 - DNA, 22 bp, Artificial Sequence
  chemically synthesized
ttaactgttttattacttccca

SEQ ID NO: 671607 - DNA, 22 bp, Artificial Sequence
  chemically synthesized
ggggaaataaaattgggaagta

SEQ ID NO: 671608 - DNA, 22 bp, Artificial Sequence
  chemically synthesized
gggggaaataaaattgggaagt

SEQ ID NO: 671609 - DNA, 22 bp, Artificial Sequence
  chemically synthesized
actgttttattacttcccaatt

SEQ ID NO: 671610 - DNA, 22 bp, Artificial Sequence
  chemically synthesized
tgggggaaataaaattgggaag

SEQ ID NO: 671611 - DNA, 22 bp, Artificial Sequence
  chemically synthesized
ttttattacttcccaattttat

SEQ ID NO: 671612 - DNA, 22 bp, Artificial Sequence
  chemically synthesized
tgttttgggggaaataaaattg

SEQ ID NO: 671613 - DNA, 22 bp, Artificial Sequence
  chemically synthesized
tattacttcccaattttatttc

SEQ ID NO: 671614 - DNA, 22 bp, Artificial Sequence
  chemically synthesized
attacttcccaattttatttcc

SEQ ID NO: 671615 - DNA, 22 bp, Artificial Sequence
  chemically synthesized
ctgtgttttgggggaaataaaa

SEQ ID NO: 671616 - DNA, 22 bp, Artificial Sequence
  chemically synthesized
ttacttcccaattttatttccc

SEQ ID NO: 671617 - DNA, 22 bp, Artificial Sequence
  chemically synthesized
cttcccaattttatttccccca

SEQ ID NO: 671618 - DNA, 22 bp, Artificial Sequence
  chemically synthesized
cccaattttatttcccccaaaa

SEQ ID NO: 671619 - DNA, 22 bp, Artificial Sequence
  chemically synthesized
ccaattttatttcccccaaaac

SEQ ID NO: 671620 - DNA, 22 bp, Artificial Sequence
  chemically synthesized
acaaaagatgttactgtgtttt

SEQ ID NO: 671621 - DNA, 22 bp, Artificial Sequence
  chemically synthesized
cacaaaagatgttactgtgttt

SEQ ID NO: 671622 - DNA, 22 bp, Artificial Sequence
  chemically synthesized
tatttcccccaaaacacagtaa

SEQ ID NO: 671623 - DNA, 22 bp, Artificial Sequence
  chemically synthesized
atttcccccaaaacacagtaac

SEQ ID NO: 671624 - DNA, 22 bp, Artificial Sequence
  chemically synthesized
tttcccccaaaacacagtaaca

SEQ ID NO: 671625 - DNA, 22 bp, Artificial Sequence
  chemically synthesized
cccccaaaacacagtaacatct

SEQ ID NO: 671626 - DNA, 22 bp, Artificial Sequence
  chemically synthesized
ccccaaaacacagtaacatctt

SEQ ID NO: 671627 - DNA, 22 bp, Artificial Sequence
  chemically synthesized
tgtcagcttcacaaaagatgtt

SEQ ID NO: 671628 - DNA, 22 bp, Artificial Sequence
  chemically synthesized
aaaaaagcctatgtcagcttca

SEQ ID NO: 671629 - DNA, 22 bp, Artificial Sequence
  chemically synthesized
gaaaaaagcctatgtcagcttc

SEQ ID NO: 671630 - DNA, 22 bp, Artificial Sequence
  chemically synthesized
tgaaaaaagcctatgtcagctt

SEQ ID NO: 671631 - DNA, 22 bp, Artificial Sequence
  chemically synthesized
ttgtgaagctgacataggcttt

SEQ ID NO: 671632 - DNA, 22 bp, Artificial Sequence
  chemically synthesized
tgtgaagctgacataggctttt

SEQ ID NO: 671633 - DNA, 22 bp, Artificial Sequence
  chemically synthesized
gtgaagctgacataggcttttt

SEQ ID NO: 671634 - DNA, 22 bp, Artificial Sequence
  chemically synthesized
tgaagctgacataggctttttt

SEQ ID NO: 671635 - DNA, 22 bp, Artificial Sequence
  chemically synthesized
tataagaaatcctttgaaaaaa

SEQ ID NO: 671636 - DNA, 22 bp, Artificial Sequence
  chemically synthesized
ttgtataagaaatcctttgaaa

SEQ ID NO: 671637 - DNA, 22 bp, Artificial Sequence
  chemically synthesized
acataggcttttttcaaaggat

SEQ ID NO: 671638 - DNA, 22 bp, Artificial Sequence
  chemically synthesized
cctgttgtataagaaatccttt

SEQ ID NO: 671639 - DNA, 22 bp, Artificial Sequence
  chemically synthesized
tacctgttgtataagaaatcct

SEQ ID NO: 671640 - DNA, 22 bp, Artificial Sequence
  chemically synthesized
ctacctgttgtataagaaatcc

SEQ ID NO: 671641 - DNA, 22 bp, Artificial Sequence
  chemically synthesized
tctacctgttgtataagaaatc

SEQ ID NO: 671642 - DNA, 22 bp, Artificial Sequence
  chemically synthesized
ttttcaaaggatttcttataca

SEQ ID NO: 671643 - DNA, 22 bp, Artificial Sequence
  chemically synthesized
tttcaaaggatttcttatacaa

SEQ ID NO: 671644 - DNA, 22 bp, Artificial Sequence
  chemically synthesized
tctttctacctgttgtataaga

SEQ ID NO: 671645 - DNA, 22 bp, Artificial Sequence
  chemically synthesized
ttcaaaggatttcttatacaac

SEQ ID NO: 671646 - DNA, 22 bp, Artificial Sequence
  chemically synthesized
tcaaaggatttcttatacaaca

SEQ ID NO: 671647 - DNA, 22 bp, Artificial Sequence
  chemically synthesized
caaaggatttcttatacaacag

SEQ ID NO: 671648 - DNA, 22 bp, Artificial Sequence
  chemically synthesized
ctatctttctacctgttgtata

SEQ ID NO: 671649 - DNA, 22 bp, Artificial Sequence
  chemically synthesized
aaaggatttcttatacaacagg

SEQ ID NO: 671650 - DNA, 22 bp, Artificial Sequence
  chemically synthesized
cctgctatctttctacctgttg

SEQ ID NO: 671651 - DNA, 22 bp, Artificial Sequence
  chemically synthesized
ttgcctgctatctttctacctg

SEQ ID NO: 671652 - DNA, 22 bp, Artificial Sequence
  chemically synthesized
cttatacaacaggtagaaagat

SEQ ID NO: 671653 - DNA, 22 bp, Artificial Sequence
  chemically synthesized
ttgttgcctgctatctttctac

SEQ ID NO: 671654 - DNA, 22 bp, Artificial Sequence
  chemically synthesized
ttatacaacaggtagaaagata

SEQ ID NO: 671655 - DNA, 22 bp, Artificial Sequence
  chemically synthesized
attgttgcctgctatctttcta

SEQ ID NO: 671656 - DNA, 22 bp, Artificial Sequence
  chemically synthesized
atacaacaggtagaaagatagc

SEQ ID NO: 671657 - DNA, 22 bp, Artificial Sequence
  chemically synthesized
tacaacaggtagaaagatagca

SEQ ID NO: 671658 - DNA, 22 bp, Artificial Sequence
  chemically synthesized
tatatgacacacacacacacac

SEQ ID NO: 671659 - DNA, 22 bp, Artificial Sequence
  chemically synthesized
atatatgacacacacacacaca

SEQ ID NO: 671660 - DNA, 22 bp, Artificial Sequence
  chemically synthesized
aaatttatatatgacacacaca

SEQ ID NO: 671661 - DNA, 22 bp, Artificial Sequence
  chemically synthesized
tacattcaaatttatatatgac

SEQ ID NO: 671662 - DNA, 22 bp, Artificial Sequence
  chemically synthesized
atacattcaaatttatatatga

SEQ ID NO: 671663 - DNA, 22 bp, Artificial Sequence
  chemically synthesized
aaggcttatacattcaaattta

SEQ ID NO: 671664 - DNA, 22 bp, Artificial Sequence
  chemically synthesized
gaatgactgaaggcttatacat

SEQ ID NO: 671665 - DNA, 22 bp, Artificial Sequence
  chemically synthesized
ggttggaatgactgaaggctta

SEQ ID NO: 671666 - DNA, 22 bp, Artificial Sequence
  chemically synthesized
aggttggaatgactgaaggctt

SEQ ID NO: 671667 - DNA, 22 bp, Artificial Sequence
  chemically synthesized
gaatgtataagccttcagtcat

SEQ ID NO: 671668 - DNA, 22 bp, Artificial Sequence
  chemically synthesized
aatgtataagccttcagtcatt

SEQ ID NO: 671669 - DNA, 22 bp, Artificial Sequence
  chemically synthesized
gatgtcttaggttggaatgact

SEQ ID NO: 671670 - DNA, 22 bp, Artificial Sequence
  chemically synthesized
agatgtcttaggttggaatgac

SEQ ID NO: 671671 - DNA, 22 bp, Artificial Sequence
  chemically synthesized
tagatgtcttaggttggaatga

SEQ ID NO: 671672 - DNA, 22 bp, Artificial Sequence
  chemically synthesized
ctttagatgtcttaggttggaa

SEQ ID NO: 671673 - DNA, 22 bp, Artificial Sequence
  chemically synthesized
cagtcattccaacctaagacat

SEQ ID NO: 671674 - DNA, 22 bp, Artificial Sequence
  chemically synthesized
agtcattccaacctaagacatc

SEQ ID NO: 671675 - DNA, 22 bp, Artificial Sequence
  chemically synthesized
aaggttactttagatgtcttag

SEQ ID NO: 671676 - DNA, 22 bp, Artificial Sequence
  chemically synthesized
caaggttactttagatgtctta

SEQ ID NO: 671677 - DNA, 22 bp, Artificial Sequence
  chemically synthesized
tcaaggttactttagatgtctt

SEQ ID NO: 671678 - DNA, 22 bp, Artificial Sequence
  chemically synthesized
ttcaaggttactttagatgtct

SEQ ID NO: 671679 - DNA, 22 bp, Artificial Sequence
  chemically synthesized
cttttcaaggttactttagatg

SEQ ID NO: 671680 - DNA, 22 bp, Artificial Sequence
  chemically synthesized
gcttttcaaggttactttagat

SEQ ID NO: 671681 - DNA, 22 bp, Artificial Sequence
  chemically synthesized
caacctaagacatctaaagtaa

SEQ ID NO: 671682 - DNA, 22 bp, Artificial Sequence
  chemically synthesized
tgcttttcaaggttactttaga

SEQ ID NO: 671683 - DNA, 22 bp, Artificial Sequence
  chemically synthesized
agacatctaaagtaaccttgaa

SEQ ID NO: 671684 - DNA, 22 bp, Artificial Sequence
  chemically synthesized
aagtaaccttgaaaagcaaaat

SEQ ID NO: 671685 - DNA, 22 bp, Artificial Sequence
  chemically synthesized
atgccaacgtatacccattttg

SEQ ID NO: 671686 - DNA, 22 bp, Artificial Sequence
  chemically synthesized
ttaatgccaacgtatacccatt

SEQ ID NO: 671687 - DNA, 22 bp, Artificial Sequence
  chemically synthesized
attaatgccaacgtatacccat

SEQ ID NO: 671688 - DNA, 22 bp, Artificial Sequence
  chemically synthesized
gaaaagcaaaatgggtatacgt

SEQ ID NO: 671689 - DNA, 22 bp, Artificial Sequence
  chemically synthesized
aaaagcaaaatgggtatacgtt

SEQ ID NO: 671690 - DNA, 22 bp, Artificial Sequence
  chemically synthesized
gtggtatcgtttattaatgcca

SEQ ID NO: 671691 - DNA, 22 bp, Artificial Sequence
  chemically synthesized
ctagtggtatcgtttattaatg

SEQ ID NO: 671692 - DNA, 22 bp, Artificial Sequence
  chemically synthesized
ttgctagtggtatcgtttatta

SEQ ID NO: 671693 - DNA, 22 bp, Artificial Sequence
  chemically synthesized
attgctagtggtatcgtttatt

SEQ ID NO: 671694 - DNA, 22 bp, Artificial Sequence
  chemically synthesized
ttattgctagtggtatcgttta

SEQ ID NO: 671695 - DNA, 22 bp, Artificial Sequence
  chemically synthesized
tcttattgctagtggtatcgtt

SEQ ID NO: 671696 - DNA, 22 bp, Artificial Sequence
  chemically synthesized
ctcttattgctagtggtatcgt

SEQ ID NO: 671697 - DNA, 22 bp, Artificial Sequence
  chemically synthesized
gcattaataaacgataccacta

SEQ ID NO: 671698 - DNA, 22 bp, Artificial Sequence
  chemically synthesized
tcttctcttattgctagtggta

SEQ ID NO: 671699 - DNA, 22 bp, Artificial Sequence
  chemically synthesized
atcttctcttattgctagtggt

SEQ ID NO: 671700 - DNA, 22 bp, Artificial Sequence
  chemically synthesized
tatcttctcttattgctagtgg

SEQ ID NO: 671701 - DNA, 22 bp, Artificial Sequence
  chemically synthesized
ataaacgataccactagcaata

SEQ ID NO: 671702 - DNA, 22 bp, Artificial Sequence
  chemically synthesized
ttttatcttctcttattgctag

SEQ ID NO: 671703 - DNA, 22 bp, Artificial Sequence
  chemically synthesized
gcaataagagaagataaaataa

SEQ ID NO: 671704 - DNA, 22 bp, Artificial Sequence
  chemically synthesized
tagaacccaaatgacaaccata

SEQ ID NO: 671705 - DNA, 22 bp, Artificial Sequence
  chemically synthesized
tctgtagaacccaaatgacaac

SEQ ID NO: 671706 - DNA, 22 bp, Artificial Sequence
  chemically synthesized
tgtctgtagaacccaaatgaca

SEQ ID NO: 671707 - DNA, 22 bp, Artificial Sequence
  chemically synthesized
ctgtctgtagaacccaaatgac

SEQ ID NO: 671708 - DNA, 22 bp, Artificial Sequence
  chemically synthesized
tctgtctgtagaacccaaatga

SEQ ID NO: 671709 - DNA, 22 bp, Artificial Sequence
  chemically synthesized
agtcctttctgtctgtagaacc

SEQ ID NO: 671710 - DNA, 22 bp, Artificial Sequence
  chemically synthesized
taagtcctttctgtctgtagaa

SEQ ID NO: 671711 - DNA, 22 bp, Artificial Sequence
  chemically synthesized
tcatttgggttctacagacaga

SEQ ID NO: 671712 - DNA, 22 bp, Artificial Sequence
  chemically synthesized
ttctaagtcctttctgtctgta

SEQ ID NO: 671713 - DNA, 22 bp, Artificial Sequence
  chemically synthesized
cattattctaagtcctttctgt

SEQ ID NO: 671714 - DNA, 22 bp, Artificial Sequence
  chemically synthesized
gggttctacagacagaaaggac

SEQ ID NO: 671715 - DNA, 22 bp, Artificial Sequence
  chemically synthesized
acattattctaagtcctttctg

SEQ ID NO: 671716 - DNA, 22 bp, Artificial Sequence
  chemically synthesized
ggttctacagacagaaaggact

SEQ ID NO: 671717 - DNA, 22 bp, Artificial Sequence
  chemically synthesized
tacagacagaaaggacttagaa

SEQ ID NO: 671718 - DNA, 22 bp, Artificial Sequence
  chemically synthesized
cagacagaaaggacttagaata

SEQ ID NO: 671719 - DNA, 22 bp, Artificial Sequence
  chemically synthesized
tggccggtggtggaacacttac

SEQ ID NO: 671720 - DNA, 22 bp, Artificial Sequence
  chemically synthesized
gtggccggtggtggaacactta

SEQ ID NO: 671721 - DNA, 22 bp, Artificial Sequence
  chemically synthesized
agaataatgtaagtgttccacc

SEQ ID NO: 671722 - DNA, 22 bp, Artificial Sequence
  chemically synthesized
cttgtggccggtggtggaacac

SEQ ID NO: 671723 - DNA, 22 bp, Artificial Sequence
  chemically synthesized
gaataatgtaagtgttccacca

SEQ ID NO: 671724 - DNA, 22 bp, Artificial Sequence
  chemically synthesized
caccaccggccacaagtagacc

SEQ ID NO: 671725 - DNA, 22 bp, Artificial Sequence
  chemically synthesized
tgagagtgaaggagatggtacc

SEQ ID NO: 671726 - DNA, 22 bp, Artificial Sequence
  chemically synthesized
cctatgagagtgaaggagatgg

SEQ ID NO: 671727 - DNA, 22 bp, Artificial Sequence
  chemically synthesized
gcctatgagagtgaaggagatg

SEQ ID NO: 671728 - DNA, 22 bp, Artificial Sequence
  chemically synthesized
cttgcctatgagagtgaaggag

SEQ ID NO: 671729 - DNA, 22 bp, Artificial Sequence
  chemically synthesized
gtaccatctccttcactctcat

SEQ ID NO: 671730 - DNA, 22 bp, Artificial Sequence
  chemically synthesized
cttcactctcataggcaaggaa

SEQ ID NO: 671731 - DNA, 22 bp, Artificial Sequence
  chemically synthesized
atgatgtgatagaattccttgc

SEQ ID NO: 671732 - DNA, 22 bp, Artificial Sequence
  chemically synthesized
cactctcataggcaaggaattc

SEQ ID NO: 671733 - DNA, 22 bp, Artificial Sequence
  chemically synthesized
catgatgtgatagaattccttg

SEQ ID NO: 671734 - DNA, 22 bp, Artificial Sequence
  chemically synthesized
actctcataggcaaggaattct

SEQ ID NO: 671735 - DNA, 22 bp, Artificial Sequence
  chemically synthesized
tcataggcaaggaattctatca

SEQ ID NO: 671736 - DNA, 22 bp, Artificial Sequence
  chemically synthesized
ataggcaaggaattctatcaca

SEQ ID NO: 671737 - DNA, 22 bp, Artificial Sequence
  chemically synthesized
gtcatgcagcggacttcatgat

SEQ ID NO: 671738 - DNA, 22 bp, Artificial Sequence
  chemically synthesized
tggtcatgcagcggacttcatg

SEQ ID NO: 671739 - DNA, 22 bp, Artificial Sequence
  chemically synthesized
tatcacatcatgaagtccgctg

SEQ ID NO: 671740 - DNA, 22 bp, Artificial Sequence
  chemically synthesized
tcacatcatgaagtccgctgca

SEQ ID NO: 671741 - DNA, 22 bp, Artificial Sequence
  chemically synthesized
gcgtgactctggtcatgcagcg

SEQ ID NO: 671742 - DNA, 22 bp, Artificial Sequence
  chemically synthesized
cccaagctggcgtgactctggt

SEQ ID NO: 671743 - DNA, 22 bp, Artificial Sequence
  chemically synthesized
attgcccaagctggcgtgactc

SEQ ID NO: 671744 - DNA, 22 bp, Artificial Sequence
  chemically synthesized
ttcattgcccaagctggcgtga

SEQ ID NO: 671745 - DNA, 22 bp, Artificial Sequence
  chemically synthesized
catgaccagagtcacgccagct

SEQ ID NO: 671746 - DNA, 22 bp, Artificial Sequence
  chemically synthesized
gggcaatgaacagggatcatgc

SEQ ID NO: 671747 - DNA, 22 bp, Artificial Sequence
  chemically synthesized
ggcaatgaacagggatcatgcc

SEQ ID NO: 671748 - DNA, 22 bp, Artificial Sequence
  chemically synthesized
ggtaatagaatgcacaaaagta

SEQ ID NO: 671749 - DNA, 22 bp, Artificial Sequence
  chemically synthesized
tgggtaatagaatgcacaaaag

SEQ ID NO: 671750 - DNA, 22 bp, Artificial Sequence
  chemically synthesized
tctgggtaatagaatgcacaaa

SEQ ID NO: 671751 - DNA, 22 bp, Artificial Sequence
  chemically synthesized
ctctgggtaatagaatgcacaa

SEQ ID NO: 671752 - DNA, 22 bp, Artificial Sequence
  chemically synthesized
tctctgggtaatagaatgcaca

SEQ ID NO: 671753 - DNA, 22 bp, Artificial Sequence
  chemically synthesized
atacttttgtgcattctattac

SEQ ID NO: 671754 - DNA, 22 bp, Artificial Sequence
  chemically synthesized
tacttttgtgcattctattacc

SEQ ID NO: 671755 - DNA, 22 bp, Artificial Sequence
  chemically synthesized
aaaacctttctctgggtaatag

SEQ ID NO: 671756 - DNA, 22 bp, Artificial Sequence
  chemically synthesized
ttgtgcattctattacccagag

SEQ ID NO: 671757 - DNA, 22 bp, Artificial Sequence
  chemically synthesized
tgtgcattctattacccagaga

SEQ ID NO: 671758 - DNA, 22 bp, Artificial Sequence
  chemically synthesized
gtgcattctattacccagagaa

SEQ ID NO: 671759 - DNA, 22 bp, Artificial Sequence
  chemically synthesized
tgcattctattacccagagaaa

SEQ ID NO: 671760 - DNA, 22 bp, Artificial Sequence
  chemically synthesized
gaatgttcaaaacctttctctg

SEQ ID NO: 671761 - DNA, 22 bp, Artificial Sequence
  chemically synthesized
agaatgttcaaaacctttctct

SEQ ID NO: 671762 - DNA, 22 bp, Artificial Sequence
  chemically synthesized
tattacccagagaaaggttttg

SEQ ID NO: 671763 - DNA, 22 bp, Artificial Sequence
  chemically synthesized
ttacccagagaaaggttttgaa

SEQ ID NO: 671764 - DNA, 22 bp, Artificial Sequence
  chemically synthesized
cccagagaaaggttttgaacat

SEQ ID NO: 671765 - DNA, 22 bp, Artificial Sequence
  chemically synthesized
ccccataaatatggagtactta

SEQ ID NO: 671766 - DNA, 22 bp, Artificial Sequence
  chemically synthesized
cccccataaatatggagtactt

SEQ ID NO: 671767 - DNA, 22 bp, Artificial Sequence
  chemically synthesized
tcccccataaatatggagtact

SEQ ID NO: 671768 - DNA, 22 bp, Artificial Sequence
  chemically synthesized
tgaacattctaagtactccata

SEQ ID NO: 671769 - DNA, 22 bp, Artificial Sequence
  chemically synthesized
ttcccccataaatatggagtac

SEQ ID NO: 671770 - DNA, 22 bp, Artificial Sequence
  chemically synthesized
gaacattctaagtactccatat

SEQ ID NO: 671771 - DNA, 22 bp, Artificial Sequence
  chemically synthesized
tttcccccataaatatggagta

SEQ ID NO: 671772 - DNA, 22 bp, Artificial Sequence
  chemically synthesized
aacattctaagtactccatatt

SEQ ID NO: 671773 - DNA, 22 bp, Artificial Sequence
  chemically synthesized
ttttcccccataaatatggagt

SEQ ID NO: 671774 - DNA, 22 bp, Artificial Sequence
  chemically synthesized
atttttttcccccataaatatg

SEQ ID NO: 671775 - DNA, 22 bp, Artificial Sequence
  chemically synthesized
taagtactccatatttatgggg

SEQ ID NO: 671776 - DNA, 22 bp, Artificial Sequence
  chemically synthesized
agtactccatatttatggggga

SEQ ID NO: 671777 - DNA, 22 bp, Artificial Sequence
  chemically synthesized
tgaggcattgatttttttcccc

SEQ ID NO: 671778 - DNA, 22 bp, Artificial Sequence
  chemically synthesized
catatttatgggggaaaaaaat

SEQ ID NO: 671779 - DNA, 22 bp, Artificial Sequence
  chemically synthesized
tgtgaggcattgatttttttcc

SEQ ID NO: 671780 - DNA, 22 bp, Artificial Sequence
  chemically synthesized
ctgtgaggcattgatttttttc

SEQ ID NO: 671781 - DNA, 22 bp, Artificial Sequence
  chemically synthesized
tctgtgaggcattgattttttt

SEQ ID NO: 671782 - DNA, 22 bp, Artificial Sequence
  chemically synthesized
atgggggaaaaaaatcaatgcc

SEQ ID NO: 671783 - DNA, 22 bp, Artificial Sequence
  chemically synthesized
tgggggaaaaaaatcaatgcct

SEQ ID NO: 671784 - DNA, 22 bp, Artificial Sequence
  chemically synthesized
cagttttctgtgaggcattgat

SEQ ID NO: 671785 - DNA, 22 bp, Artificial Sequence
  chemically synthesized
acagttttctgtgaggcattga

SEQ ID NO: 671786 - DNA, 22 bp, Artificial Sequence
  chemically synthesized
catttacagttttctgtgaggc

SEQ ID NO: 671787 - DNA, 22 bp, Artificial Sequence
  chemically synthesized
acatttacagttttctgtgagg

SEQ ID NO: 671788 - DNA, 22 bp, Artificial Sequence
  chemically synthesized
acagaaaactgtaaatgtaaac

SEQ ID NO: 671789 - DNA, 22 bp, Artificial Sequence
  chemically synthesized
atgtataccatagatatggtca

SEQ ID NO: 671790 - DNA, 22 bp, Artificial Sequence
  chemically synthesized
taaatgtaaactgaccatatct

SEQ ID NO: 671791 - DNA, 22 bp, Artificial Sequence
  chemically synthesized
accatatctatggtatacatga

SEQ ID NO: 671792 - DNA, 22 bp, Artificial Sequence
  chemically synthesized
ggtgaggaagactcatgtatac

SEQ ID NO: 671793 - DNA, 22 bp, Artificial Sequence
  chemically synthesized
gggtgaggaagactcatgtata

SEQ ID NO: 671794 - DNA, 22 bp, Artificial Sequence
  chemically synthesized
ttgggtgaggaagactcatgta

SEQ ID NO: 671795 - DNA, 22 bp, Artificial Sequence
  chemically synthesized
cctcttgggtgaggaagactca

SEQ ID NO: 671796 - DNA, 22 bp, Artificial Sequence
  chemically synthesized
tggtatacatgagtcttcctca

SEQ ID NO: 671797 - DNA, 22 bp, Artificial Sequence
  chemically synthesized
ctgcctcttgggtgaggaagac

SEQ ID NO: 671798 - DNA, 22 bp, Artificial Sequence
  chemically synthesized
cctgcctcttgggtgaggaaga

SEQ ID NO: 671799 - DNA, 22 bp, Artificial Sequence
  chemically synthesized
cttcctgcctcttgggtgagga

SEQ ID NO: 671800 - DNA, 22 bp, Artificial Sequence
  chemically synthesized
cctcacccaagaggcaggaagc

SEQ ID NO: 671801 - DNA, 22 bp, Artificial Sequence
  chemically synthesized
ctcacccaagaggcaggaagca

SEQ ID NO: 671802 - DNA, 22 bp, Artificial Sequence
  chemically synthesized
acccaagaggcaggaagcaatc

SEQ ID NO: 671803 - DNA, 22 bp, Artificial Sequence
  chemically synthesized
acagaaaaggaagattgcttcc

SEQ ID NO: 671804 - DNA, 22 bp, Artificial Sequence
  chemically synthesized
ttaacagaaaaggaagattgct

SEQ ID NO: 671805 - DNA, 22 bp, Artificial Sequence
  chemically synthesized
agttattaacagaaaaggaaga

SEQ ID NO: 671806 - DNA, 22 bp, Artificial Sequence
  chemically synthesized
ttcagttattaacagaaaagga

SEQ ID NO: 671807 - DNA, 22 bp, Artificial Sequence
  chemically synthesized
ataaaaggctattcagttatta

SEQ ID NO: 671808 - DNA, 22 bp, Artificial Sequence
  chemically synthesized
ccttttctgttaataactgaat

SEQ ID NO: 671809 - DNA, 22 bp, Artificial Sequence
  chemically synthesized
cttttctgttaataactgaata

SEQ ID NO: 671810 - DNA, 22 bp, Artificial Sequence
  chemically synthesized
tcctaataaaaggctattcagt

SEQ ID NO: 671811 - DNA, 22 bp, Artificial Sequence
  chemically synthesized
ttctgttaataactgaatagcc

SEQ ID NO: 671812 - DNA, 22 bp, Artificial Sequence
  chemically synthesized
tctgttaataactgaatagcct

SEQ ID NO: 671813 - DNA, 22 bp, Artificial Sequence
  chemically synthesized
ctgttaataactgaatagcctt

SEQ ID NO: 671814 - DNA, 22 bp, Artificial Sequence
  chemically synthesized
tgttaataactgaatagccttt

SEQ ID NO: 671815 - DNA, 22 bp, Artificial Sequence
  chemically synthesized
ttaataactgaatagcctttta

SEQ ID NO: 671816 - DNA, 22 bp, Artificial Sequence
  chemically synthesized
ataactgaatagccttttatta

SEQ ID NO: 671817 - DNA, 22 bp, Artificial Sequence
  chemically synthesized
cagtggctgtcctaataaaagg

SEQ ID NO: 671818 - DNA, 22 bp, Artificial Sequence
  chemically synthesized
aattacagtggctgtcctaata

SEQ ID NO: 671819 - DNA, 22 bp, Artificial Sequence
  chemically synthesized
aatagccttttattaggacagc

SEQ ID NO: 671820 - DNA, 22 bp, Artificial Sequence
  chemically synthesized
ttattaggacagccactgtaat

SEQ ID NO: 671821 - DNA, 22 bp, Artificial Sequence
  chemically synthesized
tattaggacagccactgtaatt

SEQ ID NO: 671822 - DNA, 22 bp, Artificial Sequence
  chemically synthesized
attaggacagccactgtaattt

SEQ ID NO: 671823 - DNA, 22 bp, Artificial Sequence
  chemically synthesized
ttaggacagccactgtaattta

SEQ ID NO: 671824 - DNA, 22 bp, Artificial Sequence
  chemically synthesized
ggacagccactgtaatttaggg

SEQ ID NO: 671825 - DNA, 22 bp, Artificial Sequence
  chemically synthesized
aatatatgcagagccctaaatt

SEQ ID NO: 671826 - DNA, 22 bp, Artificial Sequence
  chemically synthesized
aaatatatgcagagccctaaat

SEQ ID NO: 671827 - DNA, 22 bp, Artificial Sequence
  chemically synthesized
taaatatatgcagagccctaaa

SEQ ID NO: 671828 - DNA, 22 bp, Artificial Sequence
  chemically synthesized
ttaaatatatgcagagccctaa

SEQ ID NO: 671829 - DNA, 22 bp, Artificial Sequence
  chemically synthesized
tttaaatatatgcagagcccta

SEQ ID NO: 671830 - DNA, 22 bp, Artificial Sequence
  chemically synthesized
acattttttaaatatatgcaga

SEQ ID NO: 671831 - DNA, 22 bp, Artificial Sequence
  chemically synthesized
taatttagggctctgcatatat

SEQ ID NO: 671832 - DNA, 22 bp, Artificial Sequence
  chemically synthesized
cacattttttaaatatatgcag

SEQ ID NO: 671833 - DNA, 22 bp, Artificial Sequence
  chemically synthesized
ttcacattttttaaatatatgc

SEQ ID NO: 671834 - DNA, 22 bp, Artificial Sequence
  chemically synthesized
cttcacattttttaaatatatg

SEQ ID NO: 671835 - DNA, 22 bp, Artificial Sequence
  chemically synthesized
agggctctgcatatatttaaaa

SEQ ID NO: 671836 - DNA, 22 bp, Artificial Sequence
  chemically synthesized
tttcttcacattttttaaatat

SEQ ID NO: 671837 - DNA, 22 bp, Artificial Sequence
  chemically synthesized
gggctctgcatatatttaaaaa

SEQ ID NO: 671838 - DNA, 22 bp, Artificial Sequence
  chemically synthesized
ctgtttcttcacattttttaaa

SEQ ID NO: 671839 - DNA, 22 bp, Artificial Sequence
  chemically synthesized
tgcatatatttaaaaaatgtga

SEQ ID NO: 671840 - DNA, 22 bp, Artificial Sequence
  chemically synthesized
catatatttaaaaaatgtgaag

SEQ ID NO: 671841 - DNA, 22 bp, Artificial Sequence
  chemically synthesized
taccaactcctgtttcttcaca

SEQ ID NO: 671842 - DNA, 22 bp, Artificial Sequence
  chemically synthesized
tataccaactcctgtttcttca

SEQ ID NO: 671843 - DNA, 22 bp, Artificial Sequence
  chemically synthesized
tctataccaactcctgtttctt

SEQ ID NO: 671844 - DNA, 22 bp, Artificial Sequence
  chemically synthesized
aaaaaatgtgaagaaacaggag

SEQ ID NO: 671845 - DNA, 22 bp, Artificial Sequence
  chemically synthesized
aaaaatgtgaagaaacaggagt

SEQ ID NO: 671846 - DNA, 22 bp, Artificial Sequence
  chemically synthesized
ttctctataccaactcctgttt

SEQ ID NO: 671847 - DNA, 22 bp, Artificial Sequence
  chemically synthesized
attctctataccaactcctgtt

SEQ ID NO: 671848 - DNA, 22 bp, Artificial Sequence
  chemically synthesized
tattctctataccaactcctgt

SEQ ID NO: 671849 - DNA, 22 bp, Artificial Sequence
  chemically synthesized
aattttattctctataccaact

SEQ ID NO: 671850 - DNA, 22 bp, Artificial Sequence
  chemically synthesized
aattaaattttattctctatac

SEQ ID NO: 671851 - DNA, 22 bp, Artificial Sequence
  chemically synthesized
cccattaaattaaattttattc

SEQ ID NO: 671852 - DNA, 22 bp, Artificial Sequence
  chemically synthesized
tctacccattaaattaaatttt

SEQ ID NO: 671853 - DNA, 22 bp, Artificial Sequence
  chemically synthesized
gtatagagaataaaatttaatt

SEQ ID NO: 671854 - DNA, 22 bp, Artificial Sequence
  chemically synthesized
ttatctacccattaaattaaat

SEQ ID NO: 671855 - DNA, 22 bp, Artificial Sequence
  chemically synthesized
gtggatctattatctacccatt

SEQ ID NO: 671856 - DNA, 22 bp, Artificial Sequence
  chemically synthesized
agtggatctattatctacccat

SEQ ID NO: 671857 - DNA, 22 bp, Artificial Sequence
  chemically synthesized
aatttaatgggtagataataga

SEQ ID NO: 671858 - DNA, 22 bp, Artificial Sequence
  chemically synthesized
atttaatgggtagataatagat

SEQ ID NO: 671859 - DNA, 22 bp, Artificial Sequence
  chemically synthesized
tccatccttagtggatctatta

SEQ ID NO: 671860 - DNA, 22 bp, Artificial Sequence
  chemically synthesized
atccatccttagtggatctatt

SEQ ID NO: 671861 - DNA, 22 bp, Artificial Sequence
  chemically synthesized
aatgggtagataatagatccac

SEQ ID NO: 671862 - DNA, 22 bp, Artificial Sequence
  chemically synthesized
tatccatccttagtggatctat

SEQ ID NO: 671863 - DNA, 22 bp, Artificial Sequence
  chemically synthesized
atgggtagataatagatccact

SEQ ID NO: 671864 - DNA, 22 bp, Artificial Sequence
  chemically synthesized
tccctttatccatccttagtgg

SEQ ID NO: 671865 - DNA, 22 bp, Artificial Sequence
  chemically synthesized
atccctttatccatccttagtg

SEQ ID NO: 671866 - DNA, 22 bp, Artificial Sequence
  chemically synthesized
aataagccttatccctttatcc

SEQ ID NO: 671867 - DNA, 22 bp, Artificial Sequence
  chemically synthesized
agctaaataagccttatccctt

SEQ ID NO: 671868 - DNA, 22 bp, Artificial Sequence
  chemically synthesized
cagctaaataagccttatccct

SEQ ID NO: 671869 - DNA, 22 bp, Artificial Sequence
  chemically synthesized
aggatggataaagggataaggc

SEQ ID NO: 671870 - DNA, 22 bp, Artificial Sequence
  chemically synthesized
tcagctaaataagccttatccc

SEQ ID NO: 671871 - DNA, 22 bp, Artificial Sequence
  chemically synthesized
ttcagctaaataagccttatcc

SEQ ID NO: 671872 - DNA, 22 bp, Artificial Sequence
  chemically synthesized
tttcagctaaataagccttatc

SEQ ID NO: 671873 - DNA, 22 bp, Artificial Sequence
  chemically synthesized
ttttcagctaaataagccttat

SEQ ID NO: 671874 - DNA, 22 bp, Artificial Sequence
  chemically synthesized
tttttcagctaaataagcctta

SEQ ID NO: 671875 - DNA, 22 bp, Artificial Sequence
  chemically synthesized
attttttttcagctaaataagc

SEQ ID NO: 671876 - DNA, 22 bp, Artificial Sequence
  chemically synthesized
aattttttttcagctaaataag

SEQ ID NO: 671877 - DNA, 22 bp, Artificial Sequence
  chemically synthesized
tacagtttaattttttttcagc

SEQ ID NO: 671878 - DNA, 22 bp, Artificial Sequence
  chemically synthesized
atttagctgaaaaaaaattaaa

SEQ ID NO: 671879 - DNA, 22 bp, Artificial Sequence
  chemically synthesized
tttagctgaaaaaaaattaaac

SEQ ID NO: 671880 - DNA, 22 bp, Artificial Sequence
  chemically synthesized
agctgaaaaaaaattaaactgt

SEQ ID NO: 671881 - DNA, 22 bp, Artificial Sequence
  chemically synthesized
cataaatactgtacagtttaat

SEQ ID NO: 671882 - DNA, 22 bp, Artificial Sequence
  chemically synthesized
gctgaaaaaaaattaaactgta

SEQ ID NO: 671883 - DNA, 22 bp, Artificial Sequence
  chemically synthesized
gttacataaatactgtacagtt

SEQ ID NO: 671884 - DNA, 22 bp, Artificial Sequence
  chemically synthesized
aaaaaaaattaaactgtacagt

SEQ ID NO: 671885 - DNA, 22 bp, Artificial Sequence
  chemically synthesized
ctggttacataaatactgtaca

SEQ ID NO: 671886 - DNA, 22 bp, Artificial Sequence
  chemically synthesized
aactgtacagtatttatgtaac

SEQ ID NO: 671887 - DNA, 22 bp, Artificial Sequence
  chemically synthesized
gtaacagcctcctggttacata

SEQ ID NO: 671888 - DNA, 22 bp, Artificial Sequence
  chemically synthesized
tacagtatttatgtaaccagga

SEQ ID NO: 671889 - DNA, 22 bp, Artificial Sequence
  chemically synthesized
gttggtaacagcctcctggtta

SEQ ID NO: 671890 - DNA, 22 bp, Artificial Sequence
  chemically synthesized
tagttggtaacagcctcctggt

SEQ ID NO: 671891 - DNA, 22 bp, Artificial Sequence
  chemically synthesized
atgtaaccaggaggctgttacc

SEQ ID NO: 671892 - DNA, 22 bp, Artificial Sequence
  chemically synthesized
tgtaaccaggaggctgttacca

SEQ ID NO: 671893 - DNA, 22 bp, Artificial Sequence
  chemically synthesized
aggggctctagttggtaacagc

SEQ ID NO: 671894 - DNA, 22 bp, Artificial Sequence
  chemically synthesized
tgttgaggggctctagttggta

SEQ ID NO: 671895 - DNA, 22 bp, Artificial Sequence
  chemically synthesized
tgtgttatgttgaggggctcta

SEQ ID NO: 671896 - DNA, 22 bp, Artificial Sequence
  chemically synthesized
gtgtgttatgttgaggggctct

SEQ ID NO: 671897 - DNA, 22 bp, Artificial Sequence
  chemically synthesized
tgtgtgttatgttgaggggctc

SEQ ID NO: 671898 - DNA, 22 bp, Artificial Sequence
  chemically synthesized
ttgtgtgttatgttgaggggct

SEQ ID NO: 671899 - DNA, 22 bp, Artificial Sequence
  chemically synthesized
ttaccaactagagcccctcaac

SEQ ID NO: 671900 - DNA, 22 bp, Artificial Sequence
  chemically synthesized
tttgtgtgttatgttgaggggc

SEQ ID NO: 671901 - DNA, 22 bp, Artificial Sequence
  chemically synthesized
ttttgtgtgttatgttgagggg

SEQ ID NO: 671902 - DNA, 22 bp, Artificial Sequence
  chemically synthesized
ccaactagagcccctcaacata

SEQ ID NO: 671903 - DNA, 22 bp, Artificial Sequence
  chemically synthesized
gagcccctcaacataacacaca

SEQ ID NO: 671904 - DNA, 22 bp, Artificial Sequence
  chemically synthesized
atataatacacacttttttgtg

SEQ ID NO: 671905 - DNA, 22 bp, Artificial Sequence
  chemically synthesized
tgatataatacacacttttttg

SEQ ID NO: 671906 - DNA, 22 bp, Artificial Sequence
  chemically synthesized
aacataacacacaaaaaagtgt

SEQ ID NO: 671907 - DNA, 22 bp, Artificial Sequence
  chemically synthesized
ctgatataatacacactttttt

SEQ ID NO: 671908 - DNA, 22 bp, Artificial Sequence
  chemically synthesized
tctgatataatacacacttttt

SEQ ID NO: 671909 - DNA, 22 bp, Artificial Sequence
  chemically synthesized
ttctgatataatacacactttt

SEQ ID NO: 671910 - DNA, 22 bp, Artificial Sequence
  chemically synthesized
caaacttttctgatataataca

SEQ ID NO: 671911 - DNA, 22 bp, Artificial Sequence
  chemically synthesized
ccaaacttttctgatataatac

SEQ ID NO: 671912 - DNA, 22 bp, Artificial Sequence
  chemically synthesized
ttccaaacttttctgatataat

SEQ ID NO: 671913 - DNA, 22 bp, Artificial Sequence
  chemically synthesized
accaaacacaactcttccaaac

SEQ ID NO: 671914 - DNA, 22 bp, Artificial Sequence
  chemically synthesized
tatcagaaaagtttggaagagt

SEQ ID NO: 671915 - DNA, 22 bp, Artificial Sequence
  chemically synthesized
ggaagagttgtgtttggttaac

SEQ ID NO: 671916 - DNA, 22 bp, Artificial Sequence
  chemically synthesized
gaagagttgtgtttggttaact

SEQ ID NO: 671917 - DNA, 22 bp, Artificial Sequence
  chemically synthesized
tgtttggttaacttcgttttgt

SEQ ID NO: 671918 - DNA, 22 bp, Artificial Sequence
  chemically synthesized
agtaatgtgaaaacaaaacgaa

SEQ ID NO: 671919 - DNA, 22 bp, Artificial Sequence
  chemically synthesized
gagtaatgtgaaaacaaaacga

SEQ ID NO: 671920 - DNA, 22 bp, Artificial Sequence
  chemically synthesized
tgagtaatgtgaaaacaaaacg

SEQ ID NO: 671921 - DNA, 22 bp, Artificial Sequence
  chemically synthesized
ttgagtaatgtgaaaacaaaac

SEQ ID NO: 671922 - DNA, 22 bp, Artificial Sequence
  chemically synthesized
tttgagtaatgtgaaaacaaaa

SEQ ID NO: 671923 - DNA, 22 bp, Artificial Sequence
  chemically synthesized
ggttaacttcgttttgttttca

SEQ ID NO: 671924 - DNA, 22 bp, Artificial Sequence
  chemically synthesized
ttttgagtaatgtgaaaacaaa

SEQ ID NO: 671925 - DNA, 22 bp, Artificial Sequence
  chemically synthesized
gttaacttcgttttgttttcac

SEQ ID NO: 671926 - DNA, 22 bp, Artificial Sequence
  chemically synthesized
ttttttgagtaatgtgaaaaca

SEQ ID NO: 671927 - DNA, 22 bp, Artificial Sequence
  chemically synthesized
cttttttgagtaatgtgaaaac

SEQ ID NO: 671928 - DNA, 22 bp, Artificial Sequence
  chemically synthesized
acttcgttttgttttcacatta

SEQ ID NO: 671929 - DNA, 22 bp, Artificial Sequence
  chemically synthesized
ttcttttttgagtaatgtgaaa

SEQ ID NO: 671930 - DNA, 22 bp, Artificial Sequence
  chemically synthesized
cttcttttttgagtaatgtgaa

SEQ ID NO: 671931 - DNA, 22 bp, Artificial Sequence
  chemically synthesized
tcttcttttttgagtaatgtga

SEQ ID NO: 671932 - DNA, 22 bp, Artificial Sequence
  chemically synthesized
ttcttcttttttgagtaatgtg

SEQ ID NO: 671933 - DNA, 22 bp, Artificial Sequence
  chemically synthesized
cgttttgttttcacattactca

SEQ ID NO: 671934 - DNA, 22 bp, Artificial Sequence
  chemically synthesized
gttttgttttcacattactcaa

SEQ ID NO: 671935 - DNA, 22 bp, Artificial Sequence
  chemically synthesized
tgttttcacattactcaaaaaa

SEQ ID NO: 671936 - DNA, 22 bp, Artificial Sequence
  chemically synthesized
gttttcacattactcaaaaaag

SEQ ID NO: 671937 - DNA, 22 bp, Artificial Sequence
  chemically synthesized
ggtgtttttcttcttttttgag

SEQ ID NO: 671938 - DNA, 22 bp, Artificial Sequence
  chemically synthesized
ttttcacattactcaaaaaaga

SEQ ID NO: 671939 - DNA, 22 bp, Artificial Sequence
  chemically synthesized
ctgggtgtttttcttctttttt

SEQ ID NO: 671940 - DNA, 22 bp, Artificial Sequence
  chemically synthesized
tcacattactcaaaaaagaaga

SEQ ID NO: 671941 - DNA, 22 bp, Artificial Sequence
  chemically synthesized
cacattactcaaaaaagaagaa

SEQ ID NO: 671942 - DNA, 22 bp, Artificial Sequence
  chemically synthesized
acattactcaaaaaagaagaaa

SEQ ID NO: 671943 - DNA, 22 bp, Artificial Sequence
  chemically synthesized
aatatctgctgggtgtttttct

SEQ ID NO: 671944 - DNA, 22 bp, Artificial Sequence
  chemically synthesized
ctcaaaaaagaagaaaaacacc

SEQ ID NO: 671945 - DNA, 22 bp, Artificial Sequence
  chemically synthesized
aaatatctgctgggtgtttttc

SEQ ID NO: 671946 - DNA, 22 bp, Artificial Sequence
  chemically synthesized
taaatatctgctgggtgttttt

SEQ ID NO: 671947 - DNA, 22 bp, Artificial Sequence
  chemically synthesized
ttaaatatctgctgggtgtttt

SEQ ID NO: 671948 - DNA, 22 bp, Artificial Sequence
  chemically synthesized
aaaaaagaagaaaaacacccag

SEQ ID NO: 671949 - DNA, 22 bp, Artificial Sequence
  chemically synthesized
ttttaaatatctgctgggtgtt

SEQ ID NO: 671950 - DNA, 22 bp, Artificial Sequence
  chemically synthesized
cttttaaatatctgctgggtgt

SEQ ID NO: 671951 - DNA, 22 bp, Artificial Sequence
  chemically synthesized
tcttttaaatatctgctgggtg

SEQ ID NO: 671952 - DNA, 22 bp, Artificial Sequence
  chemically synthesized
gtgaccacaaatgttttctttt

SEQ ID NO: 671953 - DNA, 22 bp, Artificial Sequence
  chemically synthesized
tagtgaccacaaatgttttctt

SEQ ID NO: 671954 - DNA, 22 bp, Artificial Sequence
  chemically synthesized
ctagtgaccacaaatgttttct

SEQ ID NO: 671955 - DNA, 22 bp, Artificial Sequence
  chemically synthesized
tttctagtgaccacaaatgttt

SEQ ID NO: 671956 - DNA, 22 bp, Artificial Sequence
  chemically synthesized
atttctagtgaccacaaatgtt

SEQ ID NO: 671957 - DNA, 22 bp, Artificial Sequence
  chemically synthesized
tatttctagtgaccacaaatgt

SEQ ID NO: 671958 - DNA, 22 bp, Artificial Sequence
  chemically synthesized
ttatttctagtgaccacaaatg

SEQ ID NO: 671959 - DNA, 22 bp, Artificial Sequence
  chemically synthesized
tttatttctagtgaccacaaat

SEQ ID NO: 671960 - DNA, 22 bp, Artificial Sequence
  chemically synthesized
aaaagaaaacatttgtggtcac

SEQ ID NO: 671961 - DNA, 22 bp, Artificial Sequence
  chemically synthesized
aaagaaaacatttgtggtcact

SEQ ID NO: 671962 - DNA, 22 bp, Artificial Sequence
  chemically synthesized
tgtattttttatttctagtgac

SEQ ID NO: 671963 - DNA, 22 bp, Artificial Sequence
  chemically synthesized
gtgtattttttatttctagtga

SEQ ID NO: 671964 - DNA, 22 bp, Artificial Sequence
  chemically synthesized
atatttgtgtattttttatttc

SEQ ID NO: 671965 - DNA, 22 bp, Artificial Sequence
  chemically synthesized
gtggtcactagaaataaaaaat

SEQ ID NO: 671966 - DNA, 22 bp, Artificial Sequence
  chemically synthesized
tggtcactagaaataaaaaata

SEQ ID NO: 671967 - DNA, 22 bp, Artificial Sequence
  chemically synthesized
ttaatatttgtgtattttttat

SEQ ID NO: 671968 - DNA, 22 bp, Artificial Sequence
  chemically synthesized
attgttaatatttgtgtatttt

SEQ ID NO: 671969 - DNA, 22 bp, Artificial Sequence
  chemically synthesized
gaaataaaaaatacacaaatat

SEQ ID NO: 671970 - DNA, 22 bp, Artificial Sequence
  chemically synthesized
aaccatctcattgttaatattt

SEQ ID NO: 671971 - DNA, 22 bp, Artificial Sequence
  chemically synthesized
taacaaggaaaattaaaccatc

SEQ ID NO: 671972 - DNA, 22 bp, Artificial Sequence
  chemically synthesized
ttgtaacaaggaaaattaaacc

SEQ ID NO: 671973 - DNA, 22 bp, Artificial Sequence
  chemically synthesized
acaatgagatggtttaattttc

SEQ ID NO: 671974 - DNA, 22 bp, Artificial Sequence
  chemically synthesized
ctattgtaacaaggaaaattaa

SEQ ID NO: 671975 - DNA, 22 bp, Artificial Sequence
  chemically synthesized
gctattgtaacaaggaaaatta

SEQ ID NO: 671976 - DNA, 22 bp, Artificial Sequence
  chemically synthesized
tgctattgtaacaaggaaaatt

SEQ ID NO: 671977 - DNA, 22 bp, Artificial Sequence
  chemically synthesized
ttgctattgtaacaaggaaaat

SEQ ID NO: 671978 - DNA, 22 bp, Artificial Sequence
  chemically synthesized
cttttgctattgtaacaaggaa

SEQ ID NO: 671979 - DNA, 22 bp, Artificial Sequence
  chemically synthesized
acttttgctattgtaacaagga

SEQ ID NO: 671980 - DNA, 22 bp, Artificial Sequence
  chemically synthesized
tacttttgctattgtaacaagg

SEQ ID NO: 671981 - DNA, 22 bp, Artificial Sequence
  chemically synthesized
ttacttttgctattgtaacaag

SEQ ID NO: 671982 - DNA, 22 bp, Artificial Sequence
  chemically synthesized
tttttacttttgctattgtaac

SEQ ID NO: 671983 - DNA, 22 bp, Artificial Sequence
  chemically synthesized
aattttccttgttacaatagca

SEQ ID NO: 671984 - DNA, 22 bp, Artificial Sequence
  chemically synthesized
attttccttgttacaatagcaa

SEQ ID NO: 671985 - DNA, 22 bp, Artificial Sequence
  chemically synthesized
tccttgttacaatagcaaaagt

SEQ ID NO: 671986 - DNA, 22 bp, Artificial Sequence
  chemically synthesized
ccttgttacaatagcaaaagta

SEQ ID NO: 671987 - DNA, 22 bp, Artificial Sequence
  chemically synthesized
cttgttacaatagcaaaagtaa

SEQ ID NO: 671988 - DNA, 22 bp, Artificial Sequence
  chemically synthesized
gttacaatagcaaaagtaaaaa

SEQ ID NO: 671989 - DNA, 22 bp, Artificial Sequence
  chemically synthesized
ttacaatagcaaaagtaaaaat

SEQ ID NO: 671990 - DNA, 22 bp, Artificial Sequence
  chemically synthesized
caatagcaaaagtaaaaataat

SEQ ID NO: 671991 - DNA, 22 bp, Artificial Sequence
  chemically synthesized
ccagcatggagtattattttta

SEQ ID NO: 671992 - DNA, 22 bp, Artificial Sequence
  chemically synthesized
cccagcatggagtattattttt

SEQ ID NO: 671993 - DNA, 22 bp, Artificial Sequence
  chemically synthesized
accatgtccttcccagcatgga

SEQ ID NO: 671994 - DNA, 22 bp, Artificial Sequence
  chemically synthesized
catgctgggaaggacatggtta

SEQ ID NO: 671995 - DNA, 22 bp, Artificial Sequence
  chemically synthesized
aaagtgccaatctaaccatgtc

SEQ ID NO: 671996 - DNA, 22 bp, Artificial Sequence
  chemically synthesized
caaagtgccaatctaaccatgt

SEQ ID NO: 671997 - DNA, 22 bp, Artificial Sequence
  chemically synthesized
ggaaggacatggttagattggc

SEQ ID NO: 671998 - DNA, 22 bp, Artificial Sequence
  chemically synthesized
ataatacttcaaagtgccaatc

SEQ ID NO: 671999 - DNA, 22 bp, Artificial Sequence
  chemically synthesized
cactcataatacttcaaagtgc

SEQ ID NO: 672000 - DNA, 22 bp, Artificial Sequence
  chemically synthesized
acactcataatacttcaaagtg

SEQ ID NO: 672001 - DNA, 22 bp, Artificial Sequence
  chemically synthesized
gattggcactttgaagtattat

SEQ ID NO: 672002 - DNA, 22 bp, Artificial Sequence
  chemically synthesized
tagccatttacactcataatac

SEQ ID NO: 672003 - DNA, 22 bp, Artificial Sequence
  chemically synthesized
gcactttgaagtattatgagtg

SEQ ID NO: 672004 - DNA, 22 bp, Artificial Sequence
  chemically synthesized
tgaagtattatgagtgtaaatg

SEQ ID NO: 672005 - DNA, 22 bp, Artificial Sequence
  chemically synthesized
gaagtattatgagtgtaaatgg

SEQ ID NO: 672006 - DNA, 22 bp, Artificial Sequence
  chemically synthesized
aaaaggctgtagccatttacac

SEQ ID NO: 672007 - DNA, 22 bp, Artificial Sequence
  chemically synthesized
aagtattatgagtgtaaatggc

SEQ ID NO: 672008 - DNA, 22 bp, Artificial Sequence
  chemically synthesized
tcaaaaggctgtagccatttac

SEQ ID NO: 672009 - DNA, 22 bp, Artificial Sequence
  chemically synthesized
ctcaaaaggctgtagccattta

SEQ ID NO: 672010 - DNA, 22 bp, Artificial Sequence
  chemically synthesized
tctcaaaaggctgtagccattt

SEQ ID NO: 672011 - DNA, 22 bp, Artificial Sequence
  chemically synthesized
tgagtgtaaatggctacagcct

SEQ ID NO: 672012 - DNA, 22 bp, Artificial Sequence
  chemically synthesized
aaactttctcaaaaggctgtag

SEQ ID NO: 672013 - DNA, 22 bp, Artificial Sequence
  chemically synthesized
cctgaaactttctcaaaaggct

SEQ ID NO: 672014 - DNA, 22 bp, Artificial Sequence
  chemically synthesized
gaatgcactgcctgaaactttc

SEQ ID NO: 672015 - DNA, 22 bp, Artificial Sequence
  chemically synthesized
cagccttttgagaaagtttcag

SEQ ID NO: 672016 - DNA, 22 bp, Artificial Sequence
  chemically synthesized
ggaatgcactgcctgaaacttt

SEQ ID NO: 672017 - DNA, 22 bp, Artificial Sequence
  chemically synthesized
ttggaatgcactgcctgaaact

SEQ ID NO: 672018 - DNA, 22 bp, Artificial Sequence
  chemically synthesized
cttggaatgcactgcctgaaac

SEQ ID NO: 672019 - DNA, 22 bp, Artificial Sequence
  chemically synthesized
ttgagaaagtttcaggcagtgc

SEQ ID NO: 672020 - DNA, 22 bp, Artificial Sequence
  chemically synthesized
tgagaaagtttcaggcagtgca

SEQ ID NO: 672021 - DNA, 22 bp, Artificial Sequence
  chemically synthesized
agcttcttggaatgcactgcct

SEQ ID NO: 672022 - DNA, 22 bp, Artificial Sequence
  chemically synthesized
gagaaagtttcaggcagtgcat

SEQ ID NO: 672023 - DNA, 22 bp, Artificial Sequence
  chemically synthesized
agaaagtttcaggcagtgcatt

SEQ ID NO: 672024 - DNA, 22 bp, Artificial Sequence
  chemically synthesized
taagcttcttggaatgcactgc

SEQ ID NO: 672025 - DNA, 22 bp, Artificial Sequence
  chemically synthesized
ctaagcttcttggaatgcactg

SEQ ID NO: 672026 - DNA, 22 bp, Artificial Sequence
  chemically synthesized
atgtttctaagcttcttggaat

SEQ ID NO: 672027 - DNA, 22 bp, Artificial Sequence
  chemically synthesized
caggcagtgcattccaagaagc

SEQ ID NO: 672028 - DNA, 22 bp, Artificial Sequence
  chemically synthesized
aggcagtgcattccaagaagct

SEQ ID NO: 672029 - DNA, 22 bp, Artificial Sequence
  chemically synthesized
agtcaaatggtgttaatgtttc

SEQ ID NO: 672030 - DNA, 22 bp, Artificial Sequence
  chemically synthesized
caagaagcttagaaacattaac

SEQ ID NO: 672031 - DNA, 22 bp, Artificial Sequence
  chemically synthesized
agaaacattaacaccatttgac

SEQ ID NO: 672032 - DNA, 22 bp, Artificial Sequence
  chemically synthesized
gaaacattaacaccatttgact

SEQ ID NO: 672033 - DNA, 22 bp, Artificial Sequence
  chemically synthesized
atgtaagtggaatcactgagtc

SEQ ID NO: 672034 - DNA, 22 bp, Artificial Sequence
  chemically synthesized
acaccatttgactcagtgattc

SEQ ID NO: 672035 - DNA, 22 bp, Artificial Sequence
  chemically synthesized
attcatgtaagtggaatcactg

SEQ ID NO: 672036 - DNA, 22 bp, Artificial Sequence
  chemically synthesized
gattcatgtaagtggaatcact

SEQ ID NO: 672037 - DNA, 22 bp, Artificial Sequence
  chemically synthesized
catttgattcatgtaagtggaa

SEQ ID NO: 672038 - DNA, 22 bp, Artificial Sequence
  chemically synthesized
gactcagtgattccacttacat

SEQ ID NO: 672039 - DNA, 22 bp, Artificial Sequence
  chemically synthesized
tacatttgattcatgtaagtgg

SEQ ID NO: 672040 - DNA, 22 bp, Artificial Sequence
  chemically synthesized
actcagtgattccacttacatg

SEQ ID NO: 672041 - DNA, 22 bp, Artificial Sequence
  chemically synthesized
ctacatttgattcatgtaagtg

SEQ ID NO: 672042 - DNA, 22 bp, Artificial Sequence
  chemically synthesized
tctacatttgattcatgtaagt

SEQ ID NO: 672043 - DNA, 22 bp, Artificial Sequence
  chemically synthesized
agtgattccacttacatgaatc

SEQ ID NO: 672044 - DNA, 22 bp, Artificial Sequence
  chemically synthesized
cacttacatgaatcaaatgtag

SEQ ID NO: 672045 - DNA, 22 bp, Artificial Sequence
  chemically synthesized
tgcataacacctttctacattt

SEQ ID NO: 672046 - DNA, 22 bp, Artificial Sequence
  chemically synthesized
atgcataacacctttctacatt

SEQ ID NO: 672047 - DNA, 22 bp, Artificial Sequence
  chemically synthesized
tatgcataacacctttctacat

SEQ ID NO: 672048 - DNA, 22 bp, Artificial Sequence
  chemically synthesized
acatgaatcaaatgtagaaagg

SEQ ID NO: 672049 - DNA, 22 bp, Artificial Sequence
  chemically synthesized
catgaatcaaatgtagaaaggt

SEQ ID NO: 672050 - DNA, 22 bp, Artificial Sequence
  chemically synthesized
aggaacacctttatgcataaca

SEQ ID NO: 672051 - DNA, 22 bp, Artificial Sequence
  chemically synthesized
gaggaacacctttatgcataac

SEQ ID NO: 672052 - DNA, 22 bp, Artificial Sequence
  chemically synthesized
tgaggaacacctttatgcataa

SEQ ID NO: 672053 - DNA, 22 bp, Artificial Sequence
  chemically synthesized
cacgtaagactttgaggaacac

SEQ ID NO: 672054 - DNA, 22 bp, Artificial Sequence
  chemically synthesized
tgcataaaggtgttcctcaaag

SEQ ID NO: 672055 - DNA, 22 bp, Artificial Sequence
  chemically synthesized
ttccacgtaagactttgaggaa

SEQ ID NO: 672056 - DNA, 22 bp, Artificial Sequence
  chemically synthesized
ctgttccacgtaagactttgag

SEQ ID NO: 672057 - DNA, 22 bp, Artificial Sequence
  chemically synthesized
tactgttccacgtaagactttg

SEQ ID NO: 672058 - DNA, 22 bp, Artificial Sequence
  chemically synthesized
ctactgttccacgtaagacttt

SEQ ID NO: 672059 - DNA, 22 bp, Artificial Sequence
  chemically synthesized
tctactgttccacgtaagactt

SEQ ID NO: 672060 - DNA, 22 bp, Artificial Sequence
  chemically synthesized
ttctactgttccacgtaagact

SEQ ID NO: 672061 - DNA, 22 bp, Artificial Sequence
  chemically synthesized
caatttttctactgttccacgt

SEQ ID NO: 672062 - DNA, 22 bp, Artificial Sequence
  chemically synthesized
ctcaaagtcttacgtggaacag

SEQ ID NO: 672063 - DNA, 22 bp, Artificial Sequence
  chemically synthesized
ccaatttttctactgttccacg

SEQ ID NO: 672064 - DNA, 22 bp, Artificial Sequence
  chemically synthesized
aaagtcttacgtggaacagtag

SEQ ID NO: 672065 - DNA, 22 bp, Artificial Sequence
  chemically synthesized
acgtggaacagtagaaaaattg

SEQ ID NO: 672066 - DNA, 22 bp, Artificial Sequence
  chemically synthesized
catagtcgtttccaatttttct

SEQ ID NO: 672067 - DNA, 22 bp, Artificial Sequence
  chemically synthesized
cgtggaacagtagaaaaattgg

SEQ ID NO: 672068 - DNA, 22 bp, Artificial Sequence
  chemically synthesized
ccatagtcgtttccaatttttc

SEQ ID NO: 672069 - DNA, 22 bp, Artificial Sequence
  chemically synthesized
tttccatagtcgtttccaattt

SEQ ID NO: 672070 - DNA, 22 bp, Artificial Sequence
  chemically synthesized
ataattatttccatagtcgttt

SEQ ID NO: 672071 - DNA, 22 bp, Artificial Sequence
  chemically synthesized
gaaacgactatggaaataatta

SEQ ID NO: 672072 - DNA, 22 bp, Artificial Sequence
  chemically synthesized
aagaatatagagctgataatta

SEQ ID NO: 672073 - DNA, 22 bp, Artificial Sequence
  chemically synthesized
tggaaataattatcagctctat

SEQ ID NO: 672074 - DNA, 22 bp, Artificial Sequence
  chemically synthesized
gccaagacgcaattaaagaata

SEQ ID NO: 672075 - DNA, 22 bp, Artificial Sequence
  chemically synthesized
tggccaagacgcaattaaagaa

SEQ ID NO: 672076 - DNA, 22 bp, Artificial Sequence
  chemically synthesized
tcagctctatattctttaattg

SEQ ID NO: 672077 - DNA, 22 bp, Artificial Sequence
  chemically synthesized
ctggccaagacgcaattaaaga

SEQ ID NO: 672078 - DNA, 22 bp, Artificial Sequence
  chemically synthesized
tctggccaagacgcaattaaag

SEQ ID NO: 672079 - DNA, 22 bp, Artificial Sequence
  chemically synthesized
cattttctggccaagacgcaat

SEQ ID NO: 672080 - DNA, 22 bp, Artificial Sequence
  chemically synthesized
tatattctttaattgcgtcttg

SEQ ID NO: 672081 - DNA, 22 bp, Artificial Sequence
  chemically synthesized
tattctttaattgcgtcttggc

SEQ ID NO: 672082 - DNA, 22 bp, Artificial Sequence
  chemically synthesized
agttacattttctggccaagac

SEQ ID NO: 672083 - DNA, 22 bp, Artificial Sequence
  chemically synthesized
cagttacattttctggccaaga

SEQ ID NO: 672084 - DNA, 22 bp, Artificial Sequence
  chemically synthesized
tttaattgcgtcttggccagaa

SEQ ID NO: 672085 - DNA, 22 bp, Artificial Sequence
  chemically synthesized
cttcagttacattttctggcca

SEQ ID NO: 672086 - DNA, 22 bp, Artificial Sequence
  chemically synthesized
taattgcgtcttggccagaaaa

SEQ ID NO: 672087 - DNA, 22 bp, Artificial Sequence
  chemically synthesized
acttcagttacattttctggcc

SEQ ID NO: 672088 - DNA, 22 bp, Artificial Sequence
  chemically synthesized
aattgcgtcttggccagaaaat

SEQ ID NO: 672089 - DNA, 22 bp, Artificial Sequence
  chemically synthesized
attgcgtcttggccagaaaatg

SEQ ID NO: 672090 - DNA, 22 bp, Artificial Sequence
  chemically synthesized
ttacttcagttacattttctgg

SEQ ID NO: 672091 - DNA, 22 bp, Artificial Sequence
  chemically synthesized
cgtcttggccagaaaatgtaac

SEQ ID NO: 672092 - DNA, 22 bp, Artificial Sequence
  chemically synthesized
tagcctcttacttcagttacat

SEQ ID NO: 672093 - DNA, 22 bp, Artificial Sequence
  chemically synthesized
gtagcctcttacttcagttaca

SEQ ID NO: 672094 - DNA, 22 bp, Artificial Sequence
  chemically synthesized
tgtagcctcttacttcagttac

SEQ ID NO: 672095 - DNA, 22 bp, Artificial Sequence
  chemically synthesized
ggccagaaaatgtaactgaagt

SEQ ID NO: 672096 - DNA, 22 bp, Artificial Sequence
  chemically synthesized
ttgtagcctcttacttcagtta

SEQ ID NO: 672097 - DNA, 22 bp, Artificial Sequence
  chemically synthesized
gccagaaaatgtaactgaagta

SEQ ID NO: 672098 - DNA, 22 bp, Artificial Sequence
  chemically synthesized
aggcttttgtagcctcttactt

SEQ ID NO: 672099 - DNA, 22 bp, Artificial Sequence
  chemically synthesized
tcagttaaggcttttgtagcct

SEQ ID NO: 672100 - DNA, 22 bp, Artificial Sequence
  chemically synthesized
actgtcagttaaggcttttgta

SEQ ID NO: 672101 - DNA, 22 bp, Artificial Sequence
  chemically synthesized
aagtaagaggctacaaaagcct

SEQ ID NO: 672102 - DNA, 22 bp, Artificial Sequence
  chemically synthesized
taactgtcagttaaggcttttg

SEQ ID NO: 672103 - DNA, 22 bp, Artificial Sequence
  chemically synthesized
ctaactgtcagttaaggctttt

SEQ ID NO: 672104 - DNA, 22 bp, Artificial Sequence
  chemically synthesized
cttctaactgtcagttaaggct

SEQ ID NO: 672105 - DNA, 22 bp, Artificial Sequence
  chemically synthesized
gcttctaactgtcagttaaggc

SEQ ID NO: 672106 - DNA, 22 bp, Artificial Sequence
  chemically synthesized
ttgcttctaactgtcagttaag

SEQ ID NO: 672107 - DNA, 22 bp, Artificial Sequence
  chemically synthesized
caaaagccttaactgacagtta

SEQ ID NO: 672108 - DNA, 22 bp, Artificial Sequence
  chemically synthesized
aaggttcttgcttctaactgtc

SEQ ID NO: 672109 - DNA, 22 bp, Artificial Sequence
  chemically synthesized
caaggttcttgcttctaactgt

SEQ ID NO: 672110 - DNA, 22 bp, Artificial Sequence
  chemically synthesized
tcaaggttcttgcttctaactg

SEQ ID NO: 672111 - DNA, 22 bp, Artificial Sequence
  chemically synthesized
ttcaaggttcttgcttctaact

SEQ ID NO: 672112 - DNA, 22 bp, Artificial Sequence
  chemically synthesized
ttttcaaggttcttgcttctaa

SEQ ID NO: 672113 - DNA, 22 bp, Artificial Sequence
  chemically synthesized
aactgacagttagaagcaagaa

SEQ ID NO: 672114 - DNA, 22 bp, Artificial Sequence
  chemically synthesized
actgacagttagaagcaagaac

SEQ ID NO: 672115 - DNA, 22 bp, Artificial Sequence
  chemically synthesized
acagttagaagcaagaaccttg

SEQ ID NO: 672116 - DNA, 22 bp, Artificial Sequence
  chemically synthesized
ccatgttcttttcaaggttctt

SEQ ID NO: 672117 - DNA, 22 bp, Artificial Sequence
  chemically synthesized
gaagcaagaaccttgaaaagaa

SEQ ID NO: 672118 - DNA, 22 bp, Artificial Sequence
  chemically synthesized
tgtgtacagttcccatgttctt

SEQ ID NO: 672119 - DNA, 22 bp, Artificial Sequence
  chemically synthesized
gtgtgtacagttcccatgttct

SEQ ID NO: 672120 - DNA, 22 bp, Artificial Sequence
  chemically synthesized
gaaaagaacatgggaactgtac

SEQ ID NO: 672121 - DNA, 22 bp, Artificial Sequence
  chemically synthesized
aaaagaacatgggaactgtaca

SEQ ID NO: 672122 - DNA, 22 bp, Artificial Sequence
  chemically synthesized
aaaacatttgtgtgtacagttc

SEQ ID NO: 672123 - DNA, 22 bp, Artificial Sequence
  chemically synthesized
tcaaaacatttgtgtgtacagt

SEQ ID NO: 672124 - DNA, 22 bp, Artificial Sequence
  chemically synthesized
ctcaaaacatttgtgtgtacag

SEQ ID NO: 672125 - DNA, 22 bp, Artificial Sequence
  chemically synthesized
tcttctcaaaacatttgtgtgt

SEQ ID NO: 672126 - DNA, 22 bp, Artificial Sequence
  chemically synthesized
atcttctcaaaacatttgtgtg

SEQ ID NO: 672127 - DNA, 22 bp, Artificial Sequence
  chemically synthesized
tatcttctcaaaacatttgtgt

SEQ ID NO: 672128 - DNA, 22 bp, Artificial Sequence
  chemically synthesized
ttttatcttctcaaaacatttg

SEQ ID NO: 672129 - DNA, 22 bp, Artificial Sequence
  chemically synthesized
tacacacaaatgttttgagaag

SEQ ID NO: 672130 - DNA, 22 bp, Artificial Sequence
  chemically synthesized
gcagactgttttatcttctcaa

SEQ ID NO: 672131 - DNA, 22 bp, Artificial Sequence
  chemically synthesized
tgagaagataaaacagtctgct

SEQ ID NO: 672132 - DNA, 22 bp, Artificial Sequence
  chemically synthesized
gagaagataaaacagtctgcta

SEQ ID NO: 672133 - DNA, 22 bp, Artificial Sequence
  chemically synthesized
agaagataaaacagtctgctag

SEQ ID NO: 672134 - DNA, 22 bp, Artificial Sequence
  chemically synthesized
caggtagaatggctagcagact

SEQ ID NO: 672135 - DNA, 22 bp, Artificial Sequence
  chemically synthesized
tccaggtagaatggctagcaga

SEQ ID NO: 672136 - DNA, 22 bp, Artificial Sequence
  chemically synthesized
tctctccaggtagaatggctag

SEQ ID NO: 672137 - DNA, 22 bp, Artificial Sequence
  chemically synthesized
atctctccaggtagaatggcta

SEQ ID NO: 672138 - DNA, 22 bp, Artificial Sequence
  chemically synthesized
acttatctctccaggtagaatg

SEQ ID NO: 672139 - DNA, 22 bp, Artificial Sequence
  chemically synthesized
aacttatctctccaggtagaat

SEQ ID NO: 672140 - DNA, 22 bp, Artificial Sequence
  chemically synthesized
taacttatctctccaggtagaa

SEQ ID NO: 672141 - DNA, 22 bp, Artificial Sequence
  chemically synthesized
cctttaacttatctctccaggt

SEQ ID NO: 672142 - DNA, 22 bp, Artificial Sequence
  chemically synthesized
ctagccattctacctggagaga

SEQ ID NO: 672143 - DNA, 22 bp, Artificial Sequence
  chemically synthesized
gccattctacctggagagataa

SEQ ID NO: 672144 - DNA, 22 bp, Artificial Sequence
  chemically synthesized
gttacctttaacttatctctcc

SEQ ID NO: 672145 - DNA, 22 bp, Artificial Sequence
  chemically synthesized
agttacctttaacttatctctc

SEQ ID NO: 672146 - DNA, 22 bp, Artificial Sequence
  chemically synthesized
tacctggagagataagttaaag

SEQ ID NO: 672147 - DNA, 22 bp, Artificial Sequence
  chemically synthesized
cctggagagataagttaaaggt

SEQ ID NO: 672148 - DNA, 22 bp, Artificial Sequence
  chemically synthesized
gagagataagttaaaggtaact

SEQ ID NO: 672149 - DNA, 22 bp, Artificial Sequence
  chemically synthesized
atatgtaaatatttagttacct

SEQ ID NO: 672150 - DNA, 22 bp, Artificial Sequence
  chemically synthesized
taataactgatatgtaaatatt

SEQ ID NO: 672151 - DNA, 22 bp, Artificial Sequence
  chemically synthesized
ataataactgatatgtaaatat

SEQ ID NO: 672152 - DNA, 22 bp, Artificial Sequence
  chemically synthesized
aaggtaactaaatatttacata

SEQ ID NO: 672153 - DNA, 22 bp, Artificial Sequence
  chemically synthesized
tataataactgatatgtaaata

SEQ ID NO: 672154 - DNA, 22 bp, Artificial Sequence
  chemically synthesized
ttataataactgatatgtaaat

SEQ ID NO: 672155 - DNA, 22 bp, Artificial Sequence
  chemically synthesized
atttttataataactgatatgt

SEQ ID NO: 672156 - DNA, 22 bp, Artificial Sequence
  chemically synthesized
aatttttataataactgatatg

SEQ ID NO: 672157 - DNA, 22 bp, Artificial Sequence
  chemically synthesized
taatttttataataactgatat

SEQ ID NO: 672158 - DNA, 22 bp, Artificial Sequence
  chemically synthesized
aatatttacatatcagttatta

SEQ ID NO: 672159 - DNA, 22 bp, Artificial Sequence
  chemically synthesized
taagttttaatttttataataa

SEQ ID NO: 672160 - DNA, 22 bp, Artificial Sequence
  chemically synthesized
tgtaagttttaatttttataat

SEQ ID NO: 672161 - DNA, 22 bp, Artificial Sequence
  chemically synthesized
acatatcagttattataaaaat

SEQ ID NO: 672162 - DNA, 22 bp, Artificial Sequence
  chemically synthesized
ctgtaagttttaatttttataa

SEQ ID NO: 672163 - DNA, 22 bp, Artificial Sequence
  chemically synthesized
catatcagttattataaaaatt

SEQ ID NO: 672164 - DNA, 22 bp, Artificial Sequence
  chemically synthesized
tgatgggtttctgtaagtttta

SEQ ID NO: 672165 - DNA, 22 bp, Artificial Sequence
  chemically synthesized
atgatgggtttctgtaagtttt

SEQ ID NO: 672166 - DNA, 22 bp, Artificial Sequence
  chemically synthesized
ttataaaaattaaaacttacag

SEQ ID NO: 672167 - DNA, 22 bp, Artificial Sequence
  chemically synthesized
tatgatgggtttctgtaagttt

SEQ ID NO: 672168 - DNA, 22 bp, Artificial Sequence
  chemically synthesized
taaaaattaaaacttacagaaa

SEQ ID NO: 672169 - DNA, 22 bp, Artificial Sequence
  chemically synthesized
aactttatgatgggtttctgta

SEQ ID NO: 672170 - DNA, 22 bp, Artificial Sequence
  chemically synthesized
aaacttacagaaacccatcata

SEQ ID NO: 672171 - DNA, 22 bp, Artificial Sequence
  chemically synthesized
tacagaaactcaactttatgat

SEQ ID NO: 672172 - DNA, 22 bp, Artificial Sequence
  chemically synthesized
atacagaaactcaactttatga

SEQ ID NO: 672173 - DNA, 22 bp, Artificial Sequence
  chemically synthesized
acagaaacccatcataaagttg

SEQ ID NO: 672174 - DNA, 22 bp, Artificial Sequence
  chemically synthesized
tatacagaaactcaactttatg

SEQ ID NO: 672175 - DNA, 22 bp, Artificial Sequence
  chemically synthesized
cagaaacccatcataaagttga

SEQ ID NO: 672176 - DNA, 22 bp, Artificial Sequence
  chemically synthesized
gcaagcaattttatacagaaac

SEQ ID NO: 672177 - DNA, 22 bp, Artificial Sequence
  chemically synthesized
agcaagcaattttatacagaaa

SEQ ID NO: 672178 - DNA, 22 bp, Artificial Sequence
  chemically synthesized
ttagcaagcaattttatacaga

SEQ ID NO: 672179 - DNA, 22 bp, Artificial Sequence
  chemically synthesized
cttagcaagcaattttatacag

SEQ ID NO: 672180 - DNA, 22 bp, Artificial Sequence
  chemically synthesized
cccttcttagcaagcaatttta

SEQ ID NO: 672181 - DNA, 22 bp, Artificial Sequence
  chemically synthesized
gcccttcttagcaagcaatttt

SEQ ID NO: 672182 - DNA, 22 bp, Artificial Sequence
  chemically synthesized
agtttctgtataaaattgcttg

SEQ ID NO: 672183 - DNA, 22 bp, Artificial Sequence
  chemically synthesized
tgcccttcttagcaagcaattt

SEQ ID NO: 672184 - DNA, 22 bp, Artificial Sequence
  chemically synthesized
ctgtataaaattgcttgctaag

SEQ ID NO: 672185 - DNA, 22 bp, Artificial Sequence
  chemically synthesized
tgtataaaattgcttgctaaga

SEQ ID NO: 672186 - DNA, 22 bp, Artificial Sequence
  chemically synthesized
tataaaattgcttgctaagaag

SEQ ID NO: 672187 - DNA, 22 bp, Artificial Sequence
  chemically synthesized
caggaacaactttgcccttctt

SEQ ID NO: 672188 - DNA, 22 bp, Artificial Sequence
  chemically synthesized
cttgctaagaagggcaaagttg

SEQ ID NO: 672189 - DNA, 22 bp, Artificial Sequence
  chemically synthesized
cgaattacaggaacaactttgc

SEQ ID NO: 672190 - DNA, 22 bp, Artificial Sequence
  chemically synthesized
ccgaattacaggaacaactttg

SEQ ID NO: 672191 - DNA, 22 bp, Artificial Sequence
  chemically synthesized
gctaagaagggcaaagttgttc

SEQ ID NO: 672192 - DNA, 22 bp, Artificial Sequence
  chemically synthesized
tccgaattacaggaacaacttt

SEQ ID NO: 672193 - DNA, 22 bp, Artificial Sequence
  chemically synthesized
ctaagaagggcaaagttgttcc

SEQ ID NO: 672194 - DNA, 22 bp, Artificial Sequence
  chemically synthesized
agaagggcaaagttgttcctgt

SEQ ID NO: 672195 - DNA, 22 bp, Artificial Sequence
  chemically synthesized
taaactttccgaattacaggaa

SEQ ID NO: 672196 - DNA, 22 bp, Artificial Sequence
  chemically synthesized
gtaaactttccgaattacagga

SEQ ID NO: 672197 - DNA, 22 bp, Artificial Sequence
  chemically synthesized
ttcctgtaattcggaaagttta

SEQ ID NO: 672198 - DNA, 22 bp, Artificial Sequence
  chemically synthesized
ctgtaattcggaaagtttacaa

SEQ ID NO: 672199 - DNA, 22 bp, Artificial Sequence
  chemically synthesized
taattcggaaagtttacaagga

SEQ ID NO: 672200 - DNA, 22 bp, Artificial Sequence
  chemically synthesized
ggaaagtttacaaggatacttg

SEQ ID NO: 672201 - DNA, 22 bp, Artificial Sequence
  chemically synthesized
acaaggatacttgccttgtcac

SEQ ID NO: 672202 - DNA, 22 bp, Artificial Sequence
  chemically synthesized
caaggatacttgccttgtcacc

SEQ ID NO: 672203 - DNA, 22 bp, Artificial Sequence
  chemically synthesized
ccaaatatgtatggtgtcaagg

SEQ ID NO: 672204 - DNA, 22 bp, Artificial Sequence
  chemically synthesized
accaaatatgtatggtgtcaag

SEQ ID NO: 672205 - DNA, 22 bp, Artificial Sequence
  chemically synthesized
taccaaatatgtatggtgtcaa

SEQ ID NO: 672206 - DNA, 22 bp, Artificial Sequence
  chemically synthesized
gccttgtcaccttgacaccata

SEQ ID NO: 672207 - DNA, 22 bp, Artificial Sequence
  chemically synthesized
ccttgtcaccttgacaccatac

SEQ ID NO: 672208 - DNA, 22 bp, Artificial Sequence
  chemically synthesized
tttaccaaatatgtatggtgtc

SEQ ID NO: 672209 - DNA, 22 bp, Artificial Sequence
  chemically synthesized
ctttaccaaatatgtatggtgt

SEQ ID NO: 672210 - DNA, 22 bp, Artificial Sequence
  chemically synthesized
tctttaccaaatatgtatggtg

SEQ ID NO: 672211 - DNA, 22 bp, Artificial Sequence
  chemically synthesized
gtcaccttgacaccatacatat

SEQ ID NO: 672212 - DNA, 22 bp, Artificial Sequence
  chemically synthesized
tcaccttgacaccatacatatt

SEQ ID NO: 672213 - DNA, 22 bp, Artificial Sequence
  chemically synthesized
gacaccatacatatttggtaaa

SEQ ID NO: 672214 - DNA, 22 bp, Artificial Sequence
  chemically synthesized
acaccatacatatttggtaaag

SEQ ID NO: 672215 - DNA, 22 bp, Artificial Sequence
  chemically synthesized
atggataaaattttctttacca

SEQ ID NO: 672216 - DNA, 22 bp, Artificial Sequence
  chemically synthesized
aatggataaaattttctttacc

SEQ ID NO: 672217 - DNA, 22 bp, Artificial Sequence
  chemically synthesized
ggtaaagaaaattttatccatt

SEQ ID NO: 672218 - DNA, 22 bp, Artificial Sequence
  chemically synthesized
gtaaagaaaattttatccatta

SEQ ID NO: 672219 - DNA, 22 bp, Artificial Sequence
  chemically synthesized
ccacaaatatcttaatggataa

SEQ ID NO: 672220 - DNA, 22 bp, Artificial Sequence
  chemically synthesized
taccacaaatatcttaatggat

SEQ ID NO: 672221 - DNA, 22 bp, Artificial Sequence
  chemically synthesized
ctaccacaaatatcttaatgga

SEQ ID NO: 672222 - DNA, 22 bp, Artificial Sequence
  chemically synthesized
tctaccacaaatatcttaatgg

SEQ ID NO: 672223 - DNA, 22 bp, Artificial Sequence
  chemically synthesized
tatccattaagatatttgtggt

SEQ ID NO: 672224 - DNA, 22 bp, Artificial Sequence
  chemically synthesized
atccattaagatatttgtggta

SEQ ID NO: 672225 - DNA, 22 bp, Artificial Sequence
  chemically synthesized
tccattaagatatttgtggtag

SEQ ID NO: 672226 - DNA, 22 bp, Artificial Sequence
  chemically synthesized
aatcaatagttttctaccacaa

SEQ ID NO: 672227 - DNA, 22 bp, Artificial Sequence
  chemically synthesized
aaatcaatagttttctaccaca

SEQ ID NO: 672228 - DNA, 22 bp, Artificial Sequence
  chemically synthesized
agatatttgtggtagaaaacta

SEQ ID NO: 672229 - DNA, 22 bp, Artificial Sequence
  chemically synthesized
tgaatttaaatcaatagttttc

SEQ ID NO: 672230 - DNA, 22 bp, Artificial Sequence
  chemically synthesized
gtggtagaaaactattgattta

SEQ ID NO: 672231 - DNA, 22 bp, Artificial Sequence
  chemically synthesized
tggtagaaaactattgatttaa

SEQ ID NO: 672232 - DNA, 22 bp, Artificial Sequence
  chemically synthesized
tgaaaaatatagctatgaattt

SEQ ID NO: 672233 - DNA, 22 bp, Artificial Sequence
  chemically synthesized
ttgatttaaattcatagctata

SEQ ID NO: 672234 - DNA, 22 bp, Artificial Sequence
  chemically synthesized
tcctatgaaaaatatagctatg

SEQ ID NO: 672235 - DNA, 22 bp, Artificial Sequence
  chemically synthesized
atcctatgaaaaatatagctat

SEQ ID NO: 672236 - DNA, 22 bp, Artificial Sequence
  chemically synthesized
atttaaattcatagctatattt

SEQ ID NO: 672237 - DNA, 22 bp, Artificial Sequence
  chemically synthesized
aaattcatagctatatttttca

SEQ ID NO: 672238 - DNA, 22 bp, Artificial Sequence
  chemically synthesized
aattcatagctatatttttcat

SEQ ID NO: 672239 - DNA, 22 bp, Artificial Sequence
  chemically synthesized
atagctatatttttcataggat

SEQ ID NO: 672240 - DNA, 22 bp, Artificial Sequence
  chemically synthesized
ataagtaacatttatcctatga

SEQ ID NO: 672241 - DNA, 22 bp, Artificial Sequence
  chemically synthesized
tatttttcataggataaatgtt

SEQ ID NO: 672242 - DNA, 22 bp, Artificial Sequence
  chemically synthesized
ttcataggataaatgttactta

SEQ ID NO: 672243 - DNA, 22 bp, Artificial Sequence
  chemically synthesized
tcagaaagttgataagtaacat

SEQ ID NO: 672244 - DNA, 22 bp, Artificial Sequence
  chemically synthesized
tcataggataaatgttacttat

SEQ ID NO: 672245 - DNA, 22 bp, Artificial Sequence
  chemically synthesized
cataggataaatgttacttatc

SEQ ID NO: 672246 - DNA, 22 bp, Artificial Sequence
  chemically synthesized
ataggataaatgttacttatca

SEQ ID NO: 672247 - DNA, 22 bp, Artificial Sequence
  chemically synthesized
cttatcaactttctgataactg

SEQ ID NO: 672248 - DNA, 22 bp, Artificial Sequence
  chemically synthesized
atcaactttctgataactgact

SEQ ID NO: 672249 - DNA, 22 bp, Artificial Sequence
  chemically synthesized
tcaactttctgataactgactg

SEQ ID NO: 672250 - DNA, 22 bp, Artificial Sequence
  chemically synthesized
tctgataactgactgtctgttt

SEQ ID NO: 672251 - DNA, 22 bp, Artificial Sequence
  chemically synthesized
ctgataactgactgtctgtttt

SEQ ID NO: 672252 - DNA, 22 bp, Artificial Sequence
  chemically synthesized
tgataactgactgtctgttttt

SEQ ID NO: 672253 - DNA, 22 bp, Artificial Sequence
  chemically synthesized
ataactgactgtctgtttttga

SEQ ID NO: 672254 - DNA, 22 bp, Artificial Sequence
  chemically synthesized
actgtctgtttttgaccacact

SEQ ID NO: 672255 - DNA, 22 bp, Artificial Sequence
  chemically synthesized
cagaataaagtcagtgtggtca

SEQ ID NO: 672256 - DNA, 22 bp, Artificial Sequence
  chemically synthesized
tctgtttttgaccacactgact

SEQ ID NO: 672257 - DNA, 22 bp, Artificial Sequence
  chemically synthesized
tttttgaccacactgactttat

SEQ ID NO: 672258 - DNA, 22 bp, Artificial Sequence
  chemically synthesized
ttgaccacactgactttattct

SEQ ID NO: 672259 - DNA, 22 bp, Artificial Sequence
  chemically synthesized
tgaccacactgactttattctg

SEQ ID NO: 672260 - DNA, 22 bp, Artificial Sequence
  chemically synthesized
gaccacactgactttattctgt

SEQ ID NO: 672261 - DNA, 22 bp, Artificial Sequence
  chemically synthesized
accacactgactttattctgta

SEQ ID NO: 672262 - DNA, 22 bp, Artificial Sequence
  chemically synthesized
tgtataagtgatgttacagaat

SEQ ID NO: 672263 - DNA, 22 bp, Artificial Sequence
  chemically synthesized
atgtataagtgatgttacagaa

SEQ ID NO: 672264 - DNA, 22 bp, Artificial Sequence
  chemically synthesized
cttatgtataagtgatgttaca

SEQ ID NO: 672265 - DNA, 22 bp, Artificial Sequence
  chemically synthesized
actttattctgtaacatcactt

SEQ ID NO: 672266 - DNA, 22 bp, Artificial Sequence
  chemically synthesized
tattctgtaacatcacttatac

SEQ ID NO: 672267 - DNA, 22 bp, Artificial Sequence
  chemically synthesized
attctgtaacatcacttataca

SEQ ID NO: 672268 - DNA, 22 bp, Artificial Sequence
  chemically synthesized
ttctgtaacatcacttatacat

SEQ ID NO: 672269 - DNA, 22 bp, Artificial Sequence
  chemically synthesized
tgtaacatcacttatacataag

SEQ ID NO: 672270 - DNA, 22 bp, Artificial Sequence
  chemically synthesized
tccaacaagctacttatgtata

SEQ ID NO: 672271 - DNA, 22 bp, Artificial Sequence
  chemically synthesized
taacatcacttatacataagta

SEQ ID NO: 672272 - DNA, 22 bp, Artificial Sequence
  chemically synthesized
tgtccaacaagctacttatgta

SEQ ID NO: 672273 - DNA, 22 bp, Artificial Sequence
  chemically synthesized
ctgtccaacaagctacttatgt

SEQ ID NO: 672274 - DNA, 22 bp, Artificial Sequence
  chemically synthesized
taataccttctgtccaacaagc

SEQ ID NO: 672275 - DNA, 22 bp, Artificial Sequence
  chemically synthesized
atacataagtagcttgttggac

SEQ ID NO: 672276 - DNA, 22 bp, Artificial Sequence
  chemically synthesized
tacataagtagcttgttggaca

SEQ ID NO: 672277 - DNA, 22 bp, Artificial Sequence
  chemically synthesized
gttggacagaaggtattataac

SEQ ID NO: 672278 - DNA, 22 bp, Artificial Sequence
  chemically synthesized
ttggacagaaggtattataaca

SEQ ID NO: 672279 - DNA, 22 bp, Artificial Sequence
  chemically synthesized
gacagaaggtattataacactt

SEQ ID NO: 672280 - DNA, 22 bp, Artificial Sequence
  chemically synthesized
agaagaaagccaagtaaagtgt

SEQ ID NO: 672281 - DNA, 22 bp, Artificial Sequence
  chemically synthesized
tgagaagaaagccaagtaaagt

SEQ ID NO: 672282 - DNA, 22 bp, Artificial Sequence
  chemically synthesized
ctgagaagaaagccaagtaaag

SEQ ID NO: 672283 - DNA, 22 bp, Artificial Sequence
  chemically synthesized
taacactttacttggctttctt

SEQ ID NO: 672284 - DNA, 22 bp, Artificial Sequence
  chemically synthesized
acaagcttctgagaagaaagcc

SEQ ID NO: 672285 - DNA, 22 bp, Artificial Sequence
  chemically synthesized
ctaacaagcttctgagaagaaa

SEQ ID NO: 672286 - DNA, 22 bp, Artificial Sequence
  chemically synthesized
ttactaacaagcttctgagaag

SEQ ID NO: 672287 - DNA, 22 bp, Artificial Sequence
  chemically synthesized
tacttggctttcttctcagaag

SEQ ID NO: 672288 - DNA, 22 bp, Artificial Sequence
  chemically synthesized
attactaacaagcttctgagaa

SEQ ID NO: 672289 - DNA, 22 bp, Artificial Sequence
  chemically synthesized
acttggctttcttctcagaagc

SEQ ID NO: 672290 - DNA, 22 bp, Artificial Sequence
  chemically synthesized
cttggctttcttctcagaagct

SEQ ID NO: 672291 - DNA, 22 bp, Artificial Sequence
  chemically synthesized
ggctttcttctcagaagcttgt

SEQ ID NO: 672292 - DNA, 22 bp, Artificial Sequence
  chemically synthesized
gctttcttctcagaagcttgtt

SEQ ID NO: 672293 - DNA, 22 bp, Artificial Sequence
  chemically synthesized
gaggcttattactaacaagctt

SEQ ID NO: 672294 - DNA, 22 bp, Artificial Sequence
  chemically synthesized
tcttctcagaagcttgttagta

SEQ ID NO: 672295 - DNA, 22 bp, Artificial Sequence
  chemically synthesized
cttctcagaagcttgttagtaa

SEQ ID NO: 672296 - DNA, 22 bp, Artificial Sequence
  chemically synthesized
ttctcagaagcttgttagtaat

SEQ ID NO: 672297 - DNA, 22 bp, Artificial Sequence
  chemically synthesized
ctcagaagcttgttagtaataa

SEQ ID NO: 672298 - DNA, 22 bp, Artificial Sequence
  chemically synthesized
tcagaagcttgttagtaataag

SEQ ID NO: 672299 - DNA, 22 bp, Artificial Sequence
  chemically synthesized
agaatctggaggcttattacta

SEQ ID NO: 672300 - DNA, 22 bp, Artificial Sequence
  chemically synthesized
aagaatctggaggcttattact

SEQ ID NO: 672301 - DNA, 22 bp, Artificial Sequence
  chemically synthesized
agaagcttgttagtaataagcc

SEQ ID NO: 672302 - DNA, 22 bp, Artificial Sequence
  chemically synthesized
taagaatctggaggcttattac

SEQ ID NO: 672303 - DNA, 22 bp, Artificial Sequence
  chemically synthesized
gttagtaataagcctccagatt

SEQ ID NO: 672304 - DNA, 22 bp, Artificial Sequence
  chemically synthesized
ttagtaataagcctccagattc

SEQ ID NO: 672305 - DNA, 22 bp, Artificial Sequence
  chemically synthesized
gtaataagcctccagattctta

SEQ ID NO: 672306 - DNA, 22 bp, Artificial Sequence
  chemically synthesized
tggaaggaaatctttaagaatc

SEQ ID NO: 672307 - DNA, 22 bp, Artificial Sequence
  chemically synthesized
atggaaggaaatctttaagaat

SEQ ID NO: 672308 - DNA, 22 bp, Artificial Sequence
  chemically synthesized
aatttatggaaggaaatcttta

SEQ ID NO: 672309 - DNA, 22 bp, Artificial Sequence
  chemically synthesized
cagattcttaaagatttccttc

SEQ ID NO: 672310 - DNA, 22 bp, Artificial Sequence
  chemically synthesized
gtgttgaatttatggaaggaaa

SEQ ID NO: 672311 - DNA, 22 bp, Artificial Sequence
  chemically synthesized
ttaaagatttccttccataaat

SEQ ID NO: 672312 - DNA, 22 bp, Artificial Sequence
  chemically synthesized
aaagatttccttccataaattc

SEQ ID NO: 672313 - DNA, 22 bp, Artificial Sequence
  chemically synthesized
aagatttccttccataaattca

SEQ ID NO: 672314 - DNA, 22 bp, Artificial Sequence
  chemically synthesized
ccttccataaattcaacacgaa

SEQ ID NO: 672315 - DNA, 22 bp, Artificial Sequence
  chemically synthesized
cttccataaattcaacacgaat

SEQ ID NO: 672316 - DNA, 22 bp, Artificial Sequence
  chemically synthesized
ccataaattcaacacgaatttg

SEQ ID NO: 672317 - DNA, 22 bp, Artificial Sequence
  chemically synthesized
cataaattcaacacgaatttga

SEQ ID NO: 672318 - DNA, 22 bp, Artificial Sequence
  chemically synthesized
tgacaaagaaaagtcaaattcg

SEQ ID NO: 672319 - DNA, 22 bp, Artificial Sequence
  chemically synthesized
aaaattgtgacaaagaaaagtc

SEQ ID NO: 672320 - DNA, 22 bp, Artificial Sequence
  chemically synthesized
aacacgaatttgacttttcttt

SEQ ID NO: 672321 - DNA, 22 bp, Artificial Sequence
  chemically synthesized
gaaaattgtgacaaagaaaagt

SEQ ID NO: 672322 - DNA, 22 bp, Artificial Sequence
  chemically synthesized
tgaaaattgtgacaaagaaaag

SEQ ID NO: 672323 - DNA, 22 bp, Artificial Sequence
  chemically synthesized
ttgaaaattgtgacaaagaaaa

SEQ ID NO: 672324 - DNA, 22 bp, Artificial Sequence
  chemically synthesized
ccaatttttgaaaattgtgaca

SEQ ID NO: 672325 - DNA, 22 bp, Artificial Sequence
  chemically synthesized
cccaatttttgaaaattgtgac

SEQ ID NO: 672326 - DNA, 22 bp, Artificial Sequence
  chemically synthesized
gacttttctttgtcacaatttt

SEQ ID NO: 672327 - DNA, 22 bp, Artificial Sequence
  chemically synthesized
acttttctttgtcacaattttc

SEQ ID NO: 672328 - DNA, 22 bp, Artificial Sequence
  chemically synthesized
ttctttgtcacaattttcaaaa

SEQ ID NO: 672329 - DNA, 22 bp, Artificial Sequence
  chemically synthesized
tctttgtcacaattttcaaaaa

SEQ ID NO: 672330 - DNA, 22 bp, Artificial Sequence
  chemically synthesized
ctttgtcacaattttcaaaaat

SEQ ID NO: 672331 - DNA, 22 bp, Artificial Sequence
  chemically synthesized
tttgtcacaattttcaaaaatt

SEQ ID NO: 672332 - DNA, 22 bp, Artificial Sequence
  chemically synthesized
tgtcacaattttcaaaaattgg

SEQ ID NO: 672333 - DNA, 22 bp, Artificial Sequence
  chemically synthesized
gtcacaattttcaaaaattggg

SEQ ID NO: 672334 - DNA, 22 bp, Artificial Sequence
  chemically synthesized
tcacaattttcaaaaattggga

SEQ ID NO: 672335 - DNA, 22 bp, Artificial Sequence
  chemically synthesized
taaaaaaatatttcccaatttt

SEQ ID NO: 672336 - DNA, 22 bp, Artificial Sequence
  chemically synthesized
gtaaaaaaatatttcccaattt

SEQ ID NO: 672337 - DNA, 22 bp, Artificial Sequence
  chemically synthesized
tgtaaaaaaatatttcccaatt

SEQ ID NO: 672338 - DNA, 22 bp, Artificial Sequence
  chemically synthesized
ttgtaaaaaaatatttcccaat

SEQ ID NO: 672339 - DNA, 22 bp, Artificial Sequence
  chemically synthesized
tcaaaaattgggaaatattttt

SEQ ID NO: 672340 - DNA, 22 bp, Artificial Sequence
  chemically synthesized
caaaaattgggaaatatttttt

SEQ ID NO: 672341 - DNA, 22 bp, Artificial Sequence
  chemically synthesized
aaaaattgggaaatattttttt

SEQ ID NO: 672342 - DNA, 22 bp, Artificial Sequence
  chemically synthesized
gggtaccacttttgtaaaaaaa

SEQ ID NO: 672343 - DNA, 22 bp, Artificial Sequence
  chemically synthesized
ttggggtaccacttttgtaaaa

SEQ ID NO: 672344 - DNA, 22 bp, Artificial Sequence
  chemically synthesized
attggggtaccacttttgtaaa

SEQ ID NO: 672345 - DNA, 22 bp, Artificial Sequence
  chemically synthesized
ggaaatatttttttacaaaagt

SEQ ID NO: 672346 - DNA, 22 bp, Artificial Sequence
  chemically synthesized
cagtttattggggtaccacttt

SEQ ID NO: 672347 - DNA, 22 bp, Artificial Sequence
  chemically synthesized
gttgcagtttattggggtacca

SEQ ID NO: 672348 - DNA, 22 bp, Artificial Sequence
  chemically synthesized
ttttacaaaagtggtaccccaa

SEQ ID NO: 672349 - DNA, 22 bp, Artificial Sequence
  chemically synthesized
tttacaaaagtggtaccccaat

SEQ ID NO: 672350 - DNA, 22 bp, Artificial Sequence
  chemically synthesized
ttacaaaagtggtaccccaata

SEQ ID NO: 672351 - DNA, 22 bp, Artificial Sequence
  chemically synthesized
tacaaaagtggtaccccaataa

SEQ ID NO: 672352 - DNA, 22 bp, Artificial Sequence
  chemically synthesized
gctagttgcagtttattggggt

SEQ ID NO: 672353 - DNA, 22 bp, Artificial Sequence
  chemically synthesized
acaaaagtggtaccccaataaa

SEQ ID NO: 672354 - DNA, 22 bp, Artificial Sequence
  chemically synthesized
cgctagttgcagtttattgggg

SEQ ID NO: 672355 - DNA, 22 bp, Artificial Sequence
  chemically synthesized
caaaagtggtaccccaataaac

SEQ ID NO: 672356 - DNA, 22 bp, Artificial Sequence
  chemically synthesized
tcgctagttgcagtttattggg

SEQ ID NO: 672357 - DNA, 22 bp, Artificial Sequence
  chemically synthesized
ttcgctagttgcagtttattgg

SEQ ID NO: 672358 - DNA, 22 bp, Artificial Sequence
  chemically synthesized
tttttcgctagttgcagtttat

SEQ ID NO: 672359 - DNA, 22 bp, Artificial Sequence
  chemically synthesized
agagatgttatttttcgctagt

SEQ ID NO: 672360 - DNA, 22 bp, Artificial Sequence
  chemically synthesized
ctcagagatgttatttttcgct

SEQ ID NO: 672361 - DNA, 22 bp, Artificial Sequence
  chemically synthesized
gttcctcagagatgttattttt

SEQ ID NO: 672362 - DNA, 22 bp, Artificial Sequence
  chemically synthesized
agttcctcagagatgttatttt

SEQ ID NO: 672363 - DNA, 22 bp, Artificial Sequence
  chemically synthesized
caactagcgaaaaataacatct

SEQ ID NO: 672364 - DNA, 22 bp, Artificial Sequence
  chemically synthesized
ttagttcctcagagatgttatt

SEQ ID NO: 672365 - DNA, 22 bp, Artificial Sequence
  chemically synthesized
ttcttagttcctcagagatgtt

SEQ ID NO: 672366 - DNA, 22 bp, Artificial Sequence
  chemically synthesized
attcttagttcctcagagatgt

SEQ ID NO: 672367 - DNA, 22 bp, Artificial Sequence
  chemically synthesized
gcgaaaaataacatctctgagg

SEQ ID NO: 672368 - DNA, 22 bp, Artificial Sequence
  chemically synthesized
ttattcttagttcctcagagat

SEQ ID NO: 672369 - DNA, 22 bp, Artificial Sequence
  chemically synthesized
tcttattcttagttcctcagag

SEQ ID NO: 672370 - DNA, 22 bp, Artificial Sequence
  chemically synthesized
ctcttattcttagttcctcaga

SEQ ID NO: 672371 - DNA, 22 bp, Artificial Sequence
  chemically synthesized
tgaggaactaagaataagagaa

SEQ ID NO: 672372 - DNA, 22 bp, Artificial Sequence
  chemically synthesized
taatcataagtcttctcttatt

SEQ ID NO: 672373 - DNA, 22 bp, Artificial Sequence
  chemically synthesized
aggaactaagaataagagaaga

SEQ ID NO: 672374 - DNA, 22 bp, Artificial Sequence
  chemically synthesized
ctgtaatcataagtcttctctt

SEQ ID NO: 672375 - DNA, 22 bp, Artificial Sequence
  chemically synthesized
agaataagagaagacttatgat

SEQ ID NO: 672376 - DNA, 22 bp, Artificial Sequence
  chemically synthesized
tatcctactgtaatcataagtc

SEQ ID NO: 672377 - DNA, 22 bp, Artificial Sequence
  chemically synthesized
aagtgttgtatcctactgtaat

SEQ ID NO: 672378 - DNA, 22 bp, Artificial Sequence
  chemically synthesized
aaagtgttgtatcctactgtaa

SEQ ID NO: 672379 - DNA, 22 bp, Artificial Sequence
  chemically synthesized
atgattacagtaggatacaaca

SEQ ID NO: 672380 - DNA, 22 bp, Artificial Sequence
  chemically synthesized
tgattacagtaggatacaacac

SEQ ID NO: 672381 - DNA, 22 bp, Artificial Sequence
  chemically synthesized
cagtaggatacaacactttaaa

SEQ ID NO: 672382 - DNA, 22 bp, Artificial Sequence
  chemically synthesized
agataatagaatgtttaaagtg

SEQ ID NO: 672383 - DNA, 22 bp, Artificial Sequence
  chemically synthesized
gagataatagaatgtttaaagt

SEQ ID NO: 672384 - DNA, 22 bp, Artificial Sequence
  chemically synthesized
tttgagataatagaatgtttaa

SEQ ID NO: 672385 - DNA, 22 bp, Artificial Sequence
  chemically synthesized
tatagttgtttgagataataga

SEQ ID NO: 672386 - DNA, 22 bp, Artificial Sequence
  chemically synthesized
atatagttgtttgagataatag

SEQ ID NO: 672387 - DNA, 22 bp, Artificial Sequence
  chemically synthesized
tatatagttgtttgagataata

SEQ ID NO: 672388 - DNA, 22 bp, Artificial Sequence
  chemically synthesized
ttatatagttgtttgagataat

SEQ ID NO: 672389 - DNA, 22 bp, Artificial Sequence
  chemically synthesized
taaacattctattatctcaaac

SEQ ID NO: 672390 - DNA, 22 bp, Artificial Sequence
  chemically synthesized
aaacattctattatctcaaaca

SEQ ID NO: 672391 - DNA, 22 bp, Artificial Sequence
  chemically synthesized
aacattctattatctcaaacaa

SEQ ID NO: 672392 - DNA, 22 bp, Artificial Sequence
  chemically synthesized
tgcatttttatatagttgtttg

SEQ ID NO: 672393 - DNA, 22 bp, Artificial Sequence
  chemically synthesized
ctatgcatttttatatagttgt

SEQ ID NO: 672394 - DNA, 22 bp, Artificial Sequence
  chemically synthesized
tattatctcaaacaactatata

SEQ ID NO: 672395 - DNA, 22 bp, Artificial Sequence
  chemically synthesized
cctatgcatttttatatagttg

SEQ ID NO: 672396 - DNA, 22 bp, Artificial Sequence
  chemically synthesized
tcctatgcatttttatatagtt

SEQ ID NO: 672397 - DNA, 22 bp, Artificial Sequence
  chemically synthesized
ttatctcaaacaactatataaa

SEQ ID NO: 672398 - DNA, 22 bp, Artificial Sequence
  chemically synthesized
tttcctatgcatttttatatag

SEQ ID NO: 672399 - DNA, 22 bp, Artificial Sequence
  chemically synthesized
ctttcctatgcatttttatata

SEQ ID NO: 672400 - DNA, 22 bp, Artificial Sequence
  chemically synthesized
tctcaaacaactatataaaaat

SEQ ID NO: 672401 - DNA, 22 bp, Artificial Sequence
  chemically synthesized
aaacaactatataaaaatgcat

SEQ ID NO: 672402 - DNA, 22 bp, Artificial Sequence
  chemically synthesized
cggtcttctttcctatgcattt

SEQ ID NO: 672403 - DNA, 22 bp, Artificial Sequence
  chemically synthesized
ccggtcttctttcctatgcatt

SEQ ID NO: 672404 - DNA, 22 bp, Artificial Sequence
  chemically synthesized
cttccggtcttctttcctatgc

SEQ ID NO: 672405 - DNA, 22 bp, Artificial Sequence
  chemically synthesized
tataaaaatgcataggaaagaa

SEQ ID NO: 672406 - DNA, 22 bp, Artificial Sequence
  chemically synthesized
aaagattgcttccggtcttctt

SEQ ID NO: 672407 - DNA, 22 bp, Artificial Sequence
  chemically synthesized
aaaagattgcttccggtcttct

SEQ ID NO: 672408 - DNA, 22 bp, Artificial Sequence
  chemically synthesized
taaaagattgcttccggtcttc

SEQ ID NO: 672409 - DNA, 22 bp, Artificial Sequence
  chemically synthesized
cattttaaaagattgcttccgg

SEQ ID NO: 672410 - DNA, 22 bp, Artificial Sequence
  chemically synthesized
acattttaaaagattgcttccg

SEQ ID NO: 672411 - DNA, 22 bp, Artificial Sequence
  chemically synthesized
tttacattttaaaagattgctt

SEQ ID NO: 672412 - DNA, 22 bp, Artificial Sequence
  chemically synthesized
agtacccagaaatagccactat

SEQ ID NO: 672413 - DNA, 22 bp, Artificial Sequence
  chemically synthesized
ttaaaatgtaaatagtggctat

SEQ ID NO: 672414 - DNA, 22 bp, Artificial Sequence
  chemically synthesized
taaaatgtaaatagtggctatt

SEQ ID NO: 672415 - DNA, 22 bp, Artificial Sequence
  chemically synthesized
aaaatgtaaatagtggctattt

SEQ ID NO: 672416 - DNA, 22 bp, Artificial Sequence
  chemically synthesized
aaatgtaaatagtggctatttc

SEQ ID NO: 672417 - DNA, 22 bp, Artificial Sequence
  chemically synthesized
acatctcagtacccagaaatag

SEQ ID NO: 672418 - DNA, 22 bp, Artificial Sequence
  chemically synthesized
tttctgggtactgagatgtgag

SEQ ID NO: 672419 - DNA, 22 bp, Artificial Sequence
  chemically synthesized
ctgggtactgagatgtgaggtg

SEQ ID NO: 672420 - DNA, 22 bp, Artificial Sequence
  chemically synthesized
tgggtactgagatgtgaggtga

SEQ ID NO: 672421 - DNA, 22 bp, Artificial Sequence
  chemically synthesized
ggtactgagatgtgaggtgatt

SEQ ID NO: 672422 - DNA, 22 bp, Artificial Sequence
  chemically synthesized
agatgtgaggtgattttcattt

SEQ ID NO: 672423 - DNA, 22 bp, Artificial Sequence
  chemically synthesized
gaaggtgaagtgcaaaaacaaa

SEQ ID NO: 672424 - DNA, 22 bp, Artificial Sequence
  chemically synthesized
agaaggtgaagtgcaaaaacaa

SEQ ID NO: 672425 - DNA, 22 bp, Artificial Sequence
  chemically synthesized
tagaaggtgaagtgcaaaaaca

SEQ ID NO: 672426 - DNA, 22 bp, Artificial Sequence
  chemically synthesized
tcattttgtttttgcacttcac

SEQ ID NO: 672427 - DNA, 22 bp, Artificial Sequence
  chemically synthesized
cattttgtttttgcacttcacc

SEQ ID NO: 672428 - DNA, 22 bp, Artificial Sequence
  chemically synthesized
gaaattttagaaggtgaagtgc

SEQ ID NO: 672429 - DNA, 22 bp, Artificial Sequence
  chemically synthesized
attttgtttttgcacttcacct

SEQ ID NO: 672430 - DNA, 22 bp, Artificial Sequence
  chemically synthesized
tagaaattttagaaggtgaagt

SEQ ID NO: 672431 - DNA, 22 bp, Artificial Sequence
  chemically synthesized
tgtttttgcacttcaccttcta

SEQ ID NO: 672432 - DNA, 22 bp, Artificial Sequence
  chemically synthesized
gtttttgcacttcaccttctaa

SEQ ID NO: 672433 - DNA, 22 bp, Artificial Sequence
  chemically synthesized
attctagaaattttagaaggtg

SEQ ID NO: 672434 - DNA, 22 bp, Artificial Sequence
  chemically synthesized
tttttgcacttcaccttctaaa

SEQ ID NO: 672435 - DNA, 22 bp, Artificial Sequence
  chemically synthesized
ttgcacttcaccttctaaaatt

SEQ ID NO: 672436 - DNA, 22 bp, Artificial Sequence
  chemically synthesized
tgcacttcaccttctaaaattt

SEQ ID NO: 672437 - DNA, 22 bp, Artificial Sequence
  chemically synthesized
gcacttcaccttctaaaatttc

SEQ ID NO: 672438 - DNA, 22 bp, Artificial Sequence
  chemically synthesized
cacttcaccttctaaaatttct

SEQ ID NO: 672439 - DNA, 22 bp, Artificial Sequence
  chemically synthesized
caccttctaaaatttctagaat

SEQ ID NO: 672440 - DNA, 22 bp, Artificial Sequence
  chemically synthesized
accttctaaaatttctagaatg

SEQ ID NO: 672441 - DNA, 22 bp, Artificial Sequence
  chemically synthesized
aaacatggatgttcattctaga

SEQ ID NO: 672442 - DNA, 22 bp, Artificial Sequence
  chemically synthesized
ctaaaatttctagaatgaacat

SEQ ID NO: 672443 - DNA, 22 bp, Artificial Sequence
  chemically synthesized
taaaatttctagaatgaacatc

SEQ ID NO: 672444 - DNA, 22 bp, Artificial Sequence
  chemically synthesized
aaatttctagaatgaacatcca

SEQ ID NO: 672445 - DNA, 22 bp, Artificial Sequence
  chemically synthesized
aacattaaaacatggatgttca

SEQ ID NO: 672446 - DNA, 22 bp, Artificial Sequence
  chemically synthesized
ttgaacattaaaacatggatgt

SEQ ID NO: 672447 - DNA, 22 bp, Artificial Sequence
  chemically synthesized
attgaacattaaaacatggatg

SEQ ID NO: 672448 - DNA, 22 bp, Artificial Sequence
  chemically synthesized
tattgaacattaaaacatggat

SEQ ID NO: 672449 - DNA, 22 bp, Artificial Sequence
  chemically synthesized
ctagaatgaacatccatgtttt

SEQ ID NO: 672450 - DNA, 22 bp, Artificial Sequence
  chemically synthesized
ttattgaacattaaaacatgga

SEQ ID NO: 672451 - DNA, 22 bp, Artificial Sequence
  chemically synthesized
tagaatgaacatccatgtttta

SEQ ID NO: 672452 - DNA, 22 bp, Artificial Sequence
  chemically synthesized
gaatgaacatccatgttttaat

SEQ ID NO: 672453 - DNA, 22 bp, Artificial Sequence
  chemically synthesized
cttttattgaacattaaaacat

SEQ ID NO: 672454 - DNA, 22 bp, Artificial Sequence
  chemically synthesized
acttttattgaacattaaaaca

SEQ ID NO: 672455 - DNA, 22 bp, Artificial Sequence
  chemically synthesized
tgatcttacttttattgaacat

SEQ ID NO: 672456 - DNA, 22 bp, Artificial Sequence
  chemically synthesized
atgatcttacttttattgaaca

SEQ ID NO: 672457 - DNA, 22 bp, Artificial Sequence
  chemically synthesized
tatgatcttacttttattgaac

SEQ ID NO: 672458 - DNA, 22 bp, Artificial Sequence
  chemically synthesized
ttatgatcttacttttattgaa

SEQ ID NO: 672459 - DNA, 22 bp, Artificial Sequence
  chemically synthesized
taatgttcaataaaagtaagat

SEQ ID NO: 672460 - DNA, 22 bp, Artificial Sequence
  chemically synthesized
aatgttcaataaaagtaagatc

SEQ ID NO: 672461 - DNA, 22 bp, Artificial Sequence
  chemically synthesized
atgttcaataaaagtaagatca

SEQ ID NO: 672462 - DNA, 22 bp, Artificial Sequence
  chemically synthesized
aataaaagtaagatcataaaaa

SEQ ID NO: 672463 - DNA, 22 bp, Artificial Sequence
  chemically synthesized
agggtatagaagtttttatgat

SEQ ID NO: 672464 - DNA, 22 bp, Artificial Sequence
  chemically synthesized
ctgagggtatagaagtttttat

SEQ ID NO: 672465 - DNA, 22 bp, Artificial Sequence
  chemically synthesized
actgagggtatagaagttttta

SEQ ID NO: 672466 - DNA, 22 bp, Artificial Sequence
  chemically synthesized
ctataccctcagtaaacgtttt

SEQ ID NO: 672467 - DNA, 22 bp, Artificial Sequence
  chemically synthesized
tataccctcagtaaacgttttt

SEQ ID NO: 672468 - DNA, 22 bp, Artificial Sequence
  chemically synthesized
taccctcagtaaacgtttttct

SEQ ID NO: 672469 - DNA, 22 bp, Artificial Sequence
  chemically synthesized
aaaatatcaaggagaaaaacgt

SEQ ID NO: 672470 - DNA, 22 bp, Artificial Sequence
  chemically synthesized
agtaaacgtttttctccttgat

SEQ ID NO: 672471 - DNA, 22 bp, Artificial Sequence
  chemically synthesized
gggcaacaggctaaaaatatca

SEQ ID NO: 672472 - DNA, 22 bp, Artificial Sequence
  chemically synthesized
agggcaacaggctaaaaatatc

SEQ ID NO: 672473 - DNA, 22 bp, Artificial Sequence
  chemically synthesized
tagggcaacaggctaaaaatat

SEQ ID NO: 672474 - DNA, 22 bp, Artificial Sequence
  chemically synthesized
ttctccttgatatttttagcct

SEQ ID NO: 672475 - DNA, 22 bp, Artificial Sequence
  chemically synthesized
tctccttgatatttttagcctg

SEQ ID NO: 672476 - DNA, 22 bp, Artificial Sequence
  chemically synthesized
ctccttgatatttttagcctgt

SEQ ID NO: 672477 - DNA, 22 bp, Artificial Sequence
  chemically synthesized
tccttgatatttttagcctgtt

SEQ ID NO: 672478 - DNA, 22 bp, Artificial Sequence
  chemically synthesized
aaactttagggcaacaggctaa

SEQ ID NO: 672479 - DNA, 22 bp, Artificial Sequence
  chemically synthesized
caaactttagggcaacaggcta

SEQ ID NO: 672480 - DNA, 22 bp, Artificial Sequence
  chemically synthesized
cttgatatttttagcctgttgc

SEQ ID NO: 672481 - DNA, 22 bp, Artificial Sequence
  chemically synthesized
tcaaactttagggcaacaggct

SEQ ID NO: 672482 - DNA, 22 bp, Artificial Sequence
  chemically synthesized
gatatttttagcctgttgccct

SEQ ID NO: 672483 - DNA, 22 bp, Artificial Sequence
  chemically synthesized
atatttttagcctgttgcccta

SEQ ID NO: 672484 - DNA, 22 bp, Artificial Sequence
  chemically synthesized
ttagcctgttgccctaaagttt

SEQ ID NO: 672485 - DNA, 22 bp, Artificial Sequence
  chemically synthesized
tagcctgttgccctaaagtttg

SEQ ID NO: 672486 - DNA, 22 bp, Artificial Sequence
  chemically synthesized
agcctgttgccctaaagtttga

SEQ ID NO: 672487 - DNA, 22 bp, Artificial Sequence
  chemically synthesized
gcctgttgccctaaagtttgaa

SEQ ID NO: 672488 - DNA, 22 bp, Artificial Sequence
  chemically synthesized
ttgccctaaagtttgaaaatac

SEQ ID NO: 672489 - DNA, 22 bp, Artificial Sequence
  chemically synthesized
agagcgtgccatgtattttcaa

SEQ ID NO: 672490 - DNA, 22 bp, Artificial Sequence
  chemically synthesized
aagagcgtgccatgtattttca

SEQ ID NO: 672491 - DNA, 22 bp, Artificial Sequence
  chemically synthesized
ccctaaagtttgaaaatacatg

SEQ ID NO: 672492 - DNA, 22 bp, Artificial Sequence
  chemically synthesized
aagtttgaaaatacatggcacg

SEQ ID NO: 672493 - DNA, 22 bp, Artificial Sequence
  chemically synthesized
agtaaacatttaagagcgtgcc

SEQ ID NO: 672494 - DNA, 22 bp, Artificial Sequence
  chemically synthesized
cagtaaacatttaagagcgtgc

SEQ ID NO: 672495 - DNA, 22 bp, Artificial Sequence
  chemically synthesized
gaaaatacatggcacgctctta

SEQ ID NO: 672496 - DNA, 22 bp, Artificial Sequence
  chemically synthesized
aaaatacatggcacgctcttaa

SEQ ID NO: 672497 - DNA, 22 bp, Artificial Sequence
  chemically synthesized
cttcagtaaacatttaagagcg

SEQ ID NO: 672498 - DNA, 22 bp, Artificial Sequence
  chemically synthesized
ctgcttcagtaaacatttaaga

SEQ ID NO: 672499 - DNA, 22 bp, Artificial Sequence
  chemically synthesized
cctgcttcagtaaacatttaag

SEQ ID NO: 672500 - DNA, 22 bp, Artificial Sequence
  chemically synthesized
gtttcctgcttcagtaaacatt

SEQ ID NO: 672501 - DNA, 22 bp, Artificial Sequence
  chemically synthesized
attggtttcctgcttcagtaaa

SEQ ID NO: 672502 - DNA, 22 bp, Artificial Sequence
  chemically synthesized
gttcattggtttcctgcttcag

SEQ ID NO: 672503 - DNA, 22 bp, Artificial Sequence
  chemically synthesized
ttaaatgtttactgaagcagga

SEQ ID NO: 672504 - DNA, 22 bp, Artificial Sequence
  chemically synthesized
aaatgtttactgaagcaggaaa

SEQ ID NO: 672505 - DNA, 22 bp, Artificial Sequence
  chemically synthesized
aatgtttactgaagcaggaaac

SEQ ID NO: 672506 - DNA, 22 bp, Artificial Sequence
  chemically synthesized
gttcgttcattggtttcctgct

SEQ ID NO: 672507 - DNA, 22 bp, Artificial Sequence
  chemically synthesized
actgaagcaggaaaccaatgaa

SEQ ID NO: 672508 - DNA, 22 bp, Artificial Sequence
  chemically synthesized
ctgaagcaggaaaccaatgaac

SEQ ID NO: 672509 - DNA, 22 bp, Artificial Sequence
  chemically synthesized
atggcctcgttcgttcattggt

SEQ ID NO: 672510 - DNA, 22 bp, Artificial Sequence
  chemically synthesized
aagcaggaaaccaatgaacgaa

SEQ ID NO: 672511 - DNA, 22 bp, Artificial Sequence
  chemically synthesized
atgtgctgatggcctcgttcgt

SEQ ID NO: 672512 - DNA, 22 bp, Artificial Sequence
  chemically synthesized
gatgtgctgatggcctcgttcg

SEQ ID NO: 672513 - DNA, 22 bp, Artificial Sequence
  chemically synthesized
aacacaatttgatgtgctgatg

SEQ ID NO: 672514 - DNA, 22 bp, Artificial Sequence
  chemically synthesized
tatgacaaagaaaggaaacact

SEQ ID NO: 672515 - DNA, 22 bp, Artificial Sequence
  chemically synthesized
atatgacaaagaaaggaaacac

SEQ ID NO: 672516 - DNA, 22 bp, Artificial Sequence
  chemically synthesized
tgttcagtgtttcctttctttg

SEQ ID NO: 672517 - DNA, 22 bp, Artificial Sequence
  chemically synthesized
agaatttatatgacaaagaaag

SEQ ID NO: 672518 - DNA, 22 bp, Artificial Sequence
  chemically synthesized
agtgtttcctttctttgtcata

SEQ ID NO: 672519 - DNA, 22 bp, Artificial Sequence
  chemically synthesized
tggattcagaatttatatgaca

SEQ ID NO: 672520 - DNA, 22 bp, Artificial Sequence
  chemically synthesized
cctttctttgtcatataaattc

SEQ ID NO: 672521 - DNA, 22 bp, Artificial Sequence
  chemically synthesized
ctttctttgtcatataaattct

SEQ ID NO: 672522 - DNA, 22 bp, Artificial Sequence
  chemically synthesized
tctttgtcatataaattctgaa

SEQ ID NO: 672523 - DNA, 22 bp, Artificial Sequence
  chemically synthesized
ctttgtcatataaattctgaat

SEQ ID NO: 672524 - DNA, 22 bp, Artificial Sequence
  chemically synthesized
tttgtcatataaattctgaatc

SEQ ID NO: 672525 - DNA, 22 bp, Artificial Sequence
  chemically synthesized
tgtcatataaattctgaatcca

SEQ ID NO: 672526 - DNA, 22 bp, Artificial Sequence
  chemically synthesized
gtcatataaattctgaatccat

SEQ ID NO: 672527 - DNA, 22 bp, Artificial Sequence
  chemically synthesized
tcatataaattctgaatccata

SEQ ID NO: 672528 - DNA, 22 bp, Artificial Sequence
  chemically synthesized
tgaatccatagtgacacttttt

SEQ ID NO: 672529 - DNA, 22 bp, Artificial Sequence
  chemically synthesized
aatccatagtgacactttttac

SEQ ID NO: 672530 - DNA, 22 bp, Artificial Sequence
  chemically synthesized
ataaggagaaataagacccgta

SEQ ID NO: 672531 - DNA, 22 bp, Artificial Sequence
  chemically synthesized
attgataaggagaaataagacc

SEQ ID NO: 672532 - DNA, 22 bp, Artificial Sequence
  chemically synthesized
tttacgggtcttatttctcctt

SEQ ID NO: 672533 - DNA, 22 bp, Artificial Sequence
  chemically synthesized
ttacgggtcttatttctcctta

SEQ ID NO: 672534 - DNA, 22 bp, Artificial Sequence
  chemically synthesized
tacgggtcttatttctccttat

SEQ ID NO: 672535 - DNA, 22 bp, Artificial Sequence
  chemically synthesized
acgggtcttatttctccttatc

SEQ ID NO: 672536 - DNA, 22 bp, Artificial Sequence
  chemically synthesized
cgggtcttatttctccttatca

SEQ ID NO: 672537 - DNA, 22 bp, Artificial Sequence
  chemically synthesized
aaaggaataattaattgataag

SEQ ID NO: 672538 - DNA, 22 bp, Artificial Sequence
  chemically synthesized
atttctccttatcaattaatta

SEQ ID NO: 672539 - DNA, 22 bp, Artificial Sequence
  chemically synthesized
ccctaaaaggaataattaattg

SEQ ID NO: 672540 - DNA, 22 bp, Artificial Sequence
  chemically synthesized
tttctccttatcaattaattat

SEQ ID NO: 672541 - DNA, 22 bp, Artificial Sequence
  chemically synthesized
gccctaaaaggaataattaatt

SEQ ID NO: 672542 - DNA, 22 bp, Artificial Sequence
  chemically synthesized
tgccctaaaaggaataattaat

SEQ ID NO: 672543 - DNA, 22 bp, Artificial Sequence
  chemically synthesized
ctccttatcaattaattattcc

SEQ ID NO: 672544 - DNA, 22 bp, Artificial Sequence
  chemically synthesized
tccttatcaattaattattcct

SEQ ID NO: 672545 - DNA, 22 bp, Artificial Sequence
  chemically synthesized
attttgccctaaaaggaataat

SEQ ID NO: 672546 - DNA, 22 bp, Artificial Sequence
  chemically synthesized
cttatcaattaattattccttt

SEQ ID NO: 672547 - DNA, 22 bp, Artificial Sequence
  chemically synthesized
atcaattaattattccttttag

SEQ ID NO: 672548 - DNA, 22 bp, Artificial Sequence
  chemically synthesized
tcaattaattattccttttagg

SEQ ID NO: 672549 - DNA, 22 bp, Artificial Sequence
  chemically synthesized
gaattaattttgccctaaaagg

SEQ ID NO: 672550 - DNA, 22 bp, Artificial Sequence
  chemically synthesized
tggaattaattttgccctaaaa

SEQ ID NO: 672551 - DNA, 22 bp, Artificial Sequence
  chemically synthesized
ttctggaattaattttgcccta

SEQ ID NO: 672552 - DNA, 22 bp, Artificial Sequence
  chemically synthesized
attattccttttagggcaaaat

SEQ ID NO: 672553 - DNA, 22 bp, Artificial Sequence
  chemically synthesized
ctattctggaattaattttgcc

SEQ ID NO: 672554 - DNA, 22 bp, Artificial Sequence
  chemically synthesized
ttccttttagggcaaaattaat

SEQ ID NO: 672555 - DNA, 22 bp, Artificial Sequence
  chemically synthesized
cttttagggcaaaattaattcc

SEQ ID NO: 672556 - DNA, 22 bp, Artificial Sequence
  chemically synthesized
ttagggcaaaattaattccaga

SEQ ID NO: 672557 - DNA, 22 bp, Artificial Sequence
  chemically synthesized
tagggcaaaattaattccagaa

SEQ ID NO: 672558 - DNA, 22 bp, Artificial Sequence
  chemically synthesized
agggcaaaattaattccagaat

SEQ ID NO: 672559 - DNA, 22 bp, Artificial Sequence
  chemically synthesized
gggcaaaattaattccagaata

SEQ ID NO: 672560 - DNA, 22 bp, Artificial Sequence
  chemically synthesized
gcaaaaccaagtgaactgctat

SEQ ID NO: 672561 - DNA, 22 bp, Artificial Sequence
  chemically synthesized
agcaaaaccaagtgaactgcta

SEQ ID NO: 672562 - DNA, 22 bp, Artificial Sequence
  chemically synthesized
attccagaatagcagttcactt

SEQ ID NO: 672563 - DNA, 22 bp, Artificial Sequence
  chemically synthesized
tcttagcaaaaccaagtgaact

SEQ ID NO: 672564 - DNA, 22 bp, Artificial Sequence
  chemically synthesized
cagaatagcagttcacttggtt

SEQ ID NO: 672565 - DNA, 22 bp, Artificial Sequence
  chemically synthesized
ttatcttagcaaaaccaagtga

SEQ ID NO: 672566 - DNA, 22 bp, Artificial Sequence
  chemically synthesized
gttatcttagcaaaaccaagtg

SEQ ID NO: 672567 - DNA, 22 bp, Artificial Sequence
  chemically synthesized
gcaatttgttatcttagcaaaa

SEQ ID NO: 672568 - DNA, 22 bp, Artificial Sequence
  chemically synthesized
ttggcaatttgttatcttagca

SEQ ID NO: 672569 - DNA, 22 bp, Artificial Sequence
  chemically synthesized
attggcaatttgttatcttagc

SEQ ID NO: 672570 - DNA, 22 bp, Artificial Sequence
  chemically synthesized
tattggcaatttgttatcttag

SEQ ID NO: 672571 - DNA, 22 bp, Artificial Sequence
  chemically synthesized
acttggttttgctaagataaca

SEQ ID NO: 672572 - DNA, 22 bp, Artificial Sequence
  chemically synthesized
ggttttgctaagataacaaatt

SEQ ID NO: 672573 - DNA, 22 bp, Artificial Sequence
  chemically synthesized
gttttgctaagataacaaattg

SEQ ID NO: 672574 - DNA, 22 bp, Artificial Sequence
  chemically synthesized
tagattttattggcaatttgtt

SEQ ID NO: 672575 - DNA, 22 bp, Artificial Sequence
  chemically synthesized
tgctaagataacaaattgccaa

SEQ ID NO: 672576 - DNA, 22 bp, Artificial Sequence
  chemically synthesized
gctaagataacaaattgccaat

SEQ ID NO: 672577 - DNA, 22 bp, Artificial Sequence
  chemically synthesized
ctaagataacaaattgccaata

SEQ ID NO: 672578 - DNA, 22 bp, Artificial Sequence
  chemically synthesized
agttgtagattttattggcaat

SEQ ID NO: 672579 - DNA, 22 bp, Artificial Sequence
  chemically synthesized
agataacaaattgccaataaaa

SEQ ID NO: 672580 - DNA, 22 bp, Artificial Sequence
  chemically synthesized
ccaataaaatctacaacttaac

SEQ ID NO: 672581 - DNA, 22 bp, Artificial Sequence
  chemically synthesized
aaatagggaatatcagttaagt

SEQ ID NO: 672582 - DNA, 22 bp, Artificial Sequence
  chemically synthesized
caacttaactgatattccctat

SEQ ID NO: 672583 - DNA, 22 bp, Artificial Sequence
  chemically synthesized
aaagtaattaaaatagggaata

SEQ ID NO: 672584 - DNA, 22 bp, Artificial Sequence
  chemically synthesized
aactgatattccctattttaat

SEQ ID NO: 672585 - DNA, 22 bp, Artificial Sequence
  chemically synthesized
actgatattccctattttaatt

SEQ ID NO: 672586 - DNA, 22 bp, Artificial Sequence
  chemically synthesized
atattccctattttaattactt

SEQ ID NO: 672587 - DNA, 22 bp, Artificial Sequence
  chemically synthesized
cctattttaattactttgaggc

SEQ ID NO: 672588 - DNA, 22 bp, Artificial Sequence
  chemically synthesized
ttttaattactttgaggcttta

SEQ ID NO: 672589 - DNA, 22 bp, Artificial Sequence
  chemically synthesized
cagaaagtagaagataaagcct

SEQ ID NO: 672590 - DNA, 22 bp, Artificial Sequence
  chemically synthesized
taattactttgaggctttatct

SEQ ID NO: 672591 - DNA, 22 bp, Artificial Sequence
  chemically synthesized
ccagaaagtagaagataaagcc

SEQ ID NO: 672592 - DNA, 22 bp, Artificial Sequence
  chemically synthesized
aattactttgaggctttatctt

SEQ ID NO: 672593 - DNA, 22 bp, Artificial Sequence
  chemically synthesized
tccagaaagtagaagataaagc

SEQ ID NO: 672594 - DNA, 22 bp, Artificial Sequence
  chemically synthesized
attactttgaggctttatcttc

SEQ ID NO: 672595 - DNA, 22 bp, Artificial Sequence
  chemically synthesized
tttccagaaagtagaagataaa

SEQ ID NO: 672596 - DNA, 22 bp, Artificial Sequence
  chemically synthesized
ctttgaggctttatcttctact

SEQ ID NO: 672597 - DNA, 22 bp, Artificial Sequence
  chemically synthesized
tgaggctttatcttctactttc

SEQ ID NO: 672598 - DNA, 22 bp, Artificial Sequence
  chemically synthesized
gaggctttatcttctactttct

SEQ ID NO: 672599 - DNA, 22 bp, Artificial Sequence
  chemically synthesized
aggctttatcttctactttctg

SEQ ID NO: 672600 - DNA, 22 bp, Artificial Sequence
  chemically synthesized
tatcttctactttctggaaaga

SEQ ID NO: 672601 - DNA, 22 bp, Artificial Sequence
  chemically synthesized
gagagatggagttctttccaga

SEQ ID NO: 672602 - DNA, 22 bp, Artificial Sequence
  chemically synthesized
atcttctactttctggaaagaa

SEQ ID NO: 672603 - DNA, 22 bp, Artificial Sequence
  chemically synthesized
tcttctactttctggaaagaac

SEQ ID NO: 672604 - DNA, 22 bp, Artificial Sequence
  chemically synthesized
tggagagatggagttctttcca

SEQ ID NO: 672605 - DNA, 22 bp, Artificial Sequence
  chemically synthesized
ctactttctggaaagaactcca

SEQ ID NO: 672606 - DNA, 22 bp, Artificial Sequence
  chemically synthesized
tactttctggaaagaactccat

SEQ ID NO: 672607 - DNA, 22 bp, Artificial Sequence
  chemically synthesized
ctttctggaaagaactccatct

SEQ ID NO: 672608 - DNA, 22 bp, Artificial Sequence
  chemically synthesized
tctggaaagaactccatctctc

SEQ ID NO: 672609 - DNA, 22 bp, Artificial Sequence
  chemically synthesized
ctggaaagaactccatctctcc

SEQ ID NO: 672610 - DNA, 22 bp, Artificial Sequence
  chemically synthesized
tggaaagaactccatctctcca

SEQ ID NO: 672611 - DNA, 22 bp, Artificial Sequence
  chemically synthesized
gaaagaactccatctctccaga

SEQ ID NO: 672612 - DNA, 22 bp, Artificial Sequence
  chemically synthesized
gcaagatggaactctggagaga

SEQ ID NO: 672613 - DNA, 22 bp, Artificial Sequence
  chemically synthesized
aactggcaagatggaactctgg

SEQ ID NO: 672614 - DNA, 22 bp, Artificial Sequence
  chemically synthesized
ttaaactggcaagatggaactc

SEQ ID NO: 672615 - DNA, 22 bp, Artificial Sequence
  chemically synthesized
catctctccagagttccatctt

SEQ ID NO: 672616 - DNA, 22 bp, Artificial Sequence
  chemically synthesized
tccagagttccatcttgccagt

SEQ ID NO: 672617 - DNA, 22 bp, Artificial Sequence
  chemically synthesized
cagagttccatcttgccagttt

SEQ ID NO: 672618 - DNA, 22 bp, Artificial Sequence
  chemically synthesized
aggcggattattaaactggcaa

SEQ ID NO: 672619 - DNA, 22 bp, Artificial Sequence
  chemically synthesized
taaggcggattattaaactggc

SEQ ID NO: 672620 - DNA, 22 bp, Artificial Sequence
  chemically synthesized
ctaaggcggattattaaactgg

SEQ ID NO: 672621 - DNA, 22 bp, Artificial Sequence
  chemically synthesized
tctaaggcggattattaaactg

SEQ ID NO: 672622 - DNA, 22 bp, Artificial Sequence
  chemically synthesized
catcttgccagtttaataatcc

SEQ ID NO: 672623 - DNA, 22 bp, Artificial Sequence
  chemically synthesized
gccagtttaataatccgcctta

SEQ ID NO: 672624 - DNA, 22 bp, Artificial Sequence
  chemically synthesized
ccagtttaataatccgccttag

SEQ ID NO: 672625 - DNA, 22 bp, Artificial Sequence
  chemically synthesized
aataatccgccttagaaaaccc

SEQ ID NO: 672626 - DNA, 22 bp, Artificial Sequence
  chemically synthesized
ataatccgccttagaaaaccct

SEQ ID NO: 672627 - DNA, 22 bp, Artificial Sequence
  chemically synthesized
aagaagatggaaagatacagat

SEQ ID NO: 672628 - DNA, 22 bp, Artificial Sequence
  chemically synthesized
agaaaaccctcatctgtatctt

SEQ ID NO: 672629 - DNA, 22 bp, Artificial Sequence
  chemically synthesized
gaaaaccctcatctgtatcttt

SEQ ID NO: 672630 - DNA, 22 bp, Artificial Sequence
  chemically synthesized
atctgtatctttccatcttctt

SEQ ID NO: 672631 - DNA, 22 bp, Artificial Sequence
  chemically synthesized
tatctttccatcttcttgagtg

SEQ ID NO: 672632 - DNA, 22 bp, Artificial Sequence
  chemically synthesized
gggaggaaaacaaataccactc

SEQ ID NO: 672633 - DNA, 22 bp, Artificial Sequence
  chemically synthesized
tccatcttcttgagtggtattt

SEQ ID NO: 672634 - DNA, 22 bp, Artificial Sequence
  chemically synthesized
ccatcttcttgagtggtatttg

SEQ ID NO: 672635 - DNA, 22 bp, Artificial Sequence
  chemically synthesized
catcttcttgagtggtatttgt

SEQ ID NO: 672636 - DNA, 22 bp, Artificial Sequence
  chemically synthesized
ctcgggaggaaaacaaatacca

SEQ ID NO: 672637 - DNA, 22 bp, Artificial Sequence
  chemically synthesized
gctcgggaggaaaacaaatacc

SEQ ID NO: 672638 - DNA, 22 bp, Artificial Sequence
  chemically synthesized
tgctcgggaggaaaacaaatac

SEQ ID NO: 672639 - DNA, 22 bp, Artificial Sequence
  chemically synthesized
cttgagtggtatttgttttcct

SEQ ID NO: 672640 - DNA, 22 bp, Artificial Sequence
  chemically synthesized
ttgagtggtatttgttttcctc

SEQ ID NO: 672641 - DNA, 22 bp, Artificial Sequence
  chemically synthesized
gagtggtatttgttttcctccc

SEQ ID NO: 672642 - DNA, 22 bp, Artificial Sequence
  chemically synthesized
agtggtatttgttttcctcccg

SEQ ID NO: 672643 - DNA, 22 bp, Artificial Sequence
  chemically synthesized
gttttcctcccgagcaaaatca

SEQ ID NO: 672644 - DNA, 22 bp, Artificial Sequence
  chemically synthesized
ttttcctcccgagcaaaatcac

SEQ ID NO: 672645 - DNA, 22 bp, Artificial Sequence
  chemically synthesized
tcctcccgagcaaaatcactct

SEQ ID NO: 672646 - DNA, 22 bp, Artificial Sequence
  chemically synthesized
cctcccgagcaaaatcactctc

SEQ ID NO: 672647 - DNA, 22 bp, Artificial Sequence
  chemically synthesized
ctcccgagcaaaatcactctcc

SEQ ID NO: 672648 - DNA, 22 bp, Artificial Sequence
  chemically synthesized
ccgagcaaaatcactctccctt

SEQ ID NO: 672649 - DNA, 22 bp, Artificial Sequence
  chemically synthesized
aatgaagcacagtagagcaagg

SEQ ID NO: 672650 - DNA, 22 bp, Artificial Sequence
  chemically synthesized
attgaatgaagcacagtagagc

SEQ ID NO: 672651 - DNA, 22 bp, Artificial Sequence
  chemically synthesized
ttcattgaatgaagcacagtag

SEQ ID NO: 672652 - DNA, 22 bp, Artificial Sequence
  chemically synthesized
tcccttgctctactgtgcttca

SEQ ID NO: 672653 - DNA, 22 bp, Artificial Sequence
  chemically synthesized
ccttgctctactgtgcttcatt

SEQ ID NO: 672654 - DNA, 22 bp, Artificial Sequence
  chemically synthesized
gctctactgtgcttcattcaat

SEQ ID NO: 672655 - DNA, 22 bp, Artificial Sequence
  chemically synthesized
ctctactgtgcttcattcaatg

SEQ ID NO: 672656 - DNA, 22 bp, Artificial Sequence
  chemically synthesized
aaaaaataattgttcattgaat

SEQ ID NO: 672657 - DNA, 22 bp, Artificial Sequence
  chemically synthesized
tactgtgcttcattcaatgaac

SEQ ID NO: 672658 - DNA, 22 bp, Artificial Sequence
  chemically synthesized
tgaaaaaataattgttcattga

SEQ ID NO: 672659 - DNA, 22 bp, Artificial Sequence
  chemically synthesized
ctgtgcttcattcaatgaacaa

SEQ ID NO: 672660 - DNA, 22 bp, Artificial Sequence
  chemically synthesized
tgcttcattcaatgaacaatta

SEQ ID NO: 672661 - DNA, 22 bp, Artificial Sequence
  chemically synthesized
cattcaatgaacaattattttt

SEQ ID NO: 672662 - DNA, 22 bp, Artificial Sequence
  chemically synthesized
attcaatgaacaattatttttt

SEQ ID NO: 672663 - DNA, 22 bp, Artificial Sequence
  chemically synthesized
aatgaacaattattttttcaga

SEQ ID NO: 672664 - DNA, 22 bp, Artificial Sequence
  chemically synthesized
gtgcatggtagcctctgaaaaa

SEQ ID NO: 672665 - DNA, 22 bp, Artificial Sequence
  chemically synthesized
ttttttcagaggctaccatgca

SEQ ID NO: 672666 - DNA, 22 bp, Artificial Sequence
  chemically synthesized
tcaccagtgcctggtgcatggt

SEQ ID NO: 672667 - DNA, 22 bp, Artificial Sequence
  chemically synthesized
tttcagaggctaccatgcacca

SEQ ID NO: 672668 - DNA, 22 bp, Artificial Sequence
  chemically synthesized
gtcaccagtgcctggtgcatgg

SEQ ID NO: 672669 - DNA, 22 bp, Artificial Sequence
  chemically synthesized
ttcagaggctaccatgcaccag

SEQ ID NO: 672670 - DNA, 22 bp, Artificial Sequence
  chemically synthesized
tgtcaccagtgcctggtgcatg

SEQ ID NO: 672671 - DNA, 22 bp, Artificial Sequence
  chemically synthesized
tcagaggctaccatgcaccagg

SEQ ID NO: 672672 - DNA, 22 bp, Artificial Sequence
  chemically synthesized
cagaggctaccatgcaccaggc

SEQ ID NO: 672673 - DNA, 22 bp, Artificial Sequence
  chemically synthesized
agaggctaccatgcaccaggca

SEQ ID NO: 672674 - DNA, 22 bp, Artificial Sequence
  chemically synthesized
atctttgtcaccagtgcctggt

SEQ ID NO: 672675 - DNA, 22 bp, Artificial Sequence
  chemically synthesized
ctcatctttgtcaccagtgcct

SEQ ID NO: 672676 - DNA, 22 bp, Artificial Sequence
  chemically synthesized
cctcatctttgtcaccagtgcc

SEQ ID NO: 672677 - DNA, 22 bp, Artificial Sequence
  chemically synthesized
ccatgcaccaggcactggtgac

SEQ ID NO: 672678 - DNA, 22 bp, Artificial Sequence
  chemically synthesized
tcttcctcatctttgtcaccag

SEQ ID NO: 672679 - DNA, 22 bp, Artificial Sequence
  chemically synthesized
aagcaggaactgtcttcctcat

SEQ ID NO: 672680 - DNA, 22 bp, Artificial Sequence
  chemically synthesized
aaagcaggaactgtcttcctca

SEQ ID NO: 672681 - DNA, 22 bp, Artificial Sequence
  chemically synthesized
taaagcaggaactgtcttcctc

SEQ ID NO: 672682 - DNA, 22 bp, Artificial Sequence
  chemically synthesized
gtgacaaagatgaggaagacag

SEQ ID NO: 672683 - DNA, 22 bp, Artificial Sequence
  chemically synthesized
tttaaagcaggaactgtcttcc

SEQ ID NO: 672684 - DNA, 22 bp, Artificial Sequence
  chemically synthesized
taatgagcctctttaaagcagg

SEQ ID NO: 672685 - DNA, 22 bp, Artificial Sequence
  chemically synthesized
ctgctttaaagaggctcattac

SEQ ID NO: 672686 - DNA, 22 bp, Artificial Sequence
  chemically synthesized
atgagatgagcctgtaatgagc

SEQ ID NO: 672687 - DNA, 22 bp, Artificial Sequence
  chemically synthesized
aatgagatgagcctgtaatgag

SEQ ID NO: 672688 - DNA, 22 bp, Artificial Sequence
  chemically synthesized
ctttaaagaggctcattacagg

SEQ ID NO: 672689 - DNA, 22 bp, Artificial Sequence
  chemically synthesized
taaagaggctcattacaggctc

SEQ ID NO: 672690 - DNA, 22 bp, Artificial Sequence
  chemically synthesized
aaagaggctcattacaggctca

SEQ ID NO: 672691 - DNA, 22 bp, Artificial Sequence
  chemically synthesized
aagaggctcattacaggctcat

SEQ ID NO: 672692 - DNA, 22 bp, Artificial Sequence
  chemically synthesized
attacaggctcatctcattaaa

SEQ ID NO: 672693 - DNA, 22 bp, Artificial Sequence
  chemically synthesized
caggctcatctcattaaattgc

SEQ ID NO: 672694 - DNA, 22 bp, Artificial Sequence
  chemically synthesized
atctcattaaattgcactttgc

SEQ ID NO: 672695 - DNA, 22 bp, Artificial Sequence
  chemically synthesized
acaaagtgcaatacagcaaagt

SEQ ID NO: 672696 - DNA, 22 bp, Artificial Sequence
  chemically synthesized
cacaaagtgcaatacagcaaag

SEQ ID NO: 672697 - DNA, 22 bp, Artificial Sequence
  chemically synthesized
attaaattgcactttgctgtat

SEQ ID NO: 672698 - DNA, 22 bp, Artificial Sequence
  chemically synthesized
tcacaaagtgcaatacagcaaa

SEQ ID NO: 672699 - DNA, 22 bp, Artificial Sequence
  chemically synthesized
aattgcactttgctgtattgca

SEQ ID NO: 672700 - DNA, 22 bp, Artificial Sequence
  chemically synthesized
cactttgctgtattgcactttg

SEQ ID NO: 672701 - DNA, 22 bp, Artificial Sequence
  chemically synthesized
tgctgtattgcactttgtgaaa

SEQ ID NO: 672702 - DNA, 22 bp, Artificial Sequence
  chemically synthesized
gctgtattgcactttgtgaaaa

SEQ ID NO: 672703 - DNA, 22 bp, Artificial Sequence
  chemically synthesized
taaacaatgcaattttcacaaa

SEQ ID NO: 672704 - DNA, 22 bp, Artificial Sequence
  chemically synthesized
ctgtattgcactttgtgaaaat

SEQ ID NO: 672705 - DNA, 22 bp, Artificial Sequence
  chemically synthesized
gtaaacaatgcaattttcacaa

SEQ ID NO: 672706 - DNA, 22 bp, Artificial Sequence
  chemically synthesized
tattgcactttgtgaaaattgc

SEQ ID NO: 672707 - DNA, 22 bp, Artificial Sequence
  chemically synthesized
agtttgtaaacaatgcaatttt

SEQ ID NO: 672708 - DNA, 22 bp, Artificial Sequence
  chemically synthesized
cagtttgtaaacaatgcaattt

SEQ ID NO: 672709 - DNA, 22 bp, Artificial Sequence
  chemically synthesized
cactttgtgaaaattgcattgt

SEQ ID NO: 672710 - DNA, 22 bp, Artificial Sequence
  chemically synthesized
tgtgaaaattgcattgtttaca

SEQ ID NO: 672711 - DNA, 22 bp, Artificial Sequence
  chemically synthesized
gtgaaaattgcattgtttacaa

SEQ ID NO: 672712 - DNA, 22 bp, Artificial Sequence
  chemically synthesized
tgaaaattgcattgtttacaaa

SEQ ID NO: 672713 - DNA, 22 bp, Artificial Sequence
  chemically synthesized
ccacaaaccttcagtttgtaaa

SEQ ID NO: 672714 - DNA, 22 bp, Artificial Sequence
  chemically synthesized
cattgtttacaaactgaaggtt

SEQ ID NO: 672715 - DNA, 22 bp, Artificial Sequence
  chemically synthesized
tttacaaactgaaggtttgtgg

SEQ ID NO: 672716 - DNA, 22 bp, Artificial Sequence
  chemically synthesized
aacacaggattgccacaaacct

SEQ ID NO: 672717 - DNA, 22 bp, Artificial Sequence
  chemically synthesized
acaaactgaaggtttgtggcaa

SEQ ID NO: 672718 - DNA, 22 bp, Artificial Sequence
  chemically synthesized
caaactgaaggtttgtggcaat

SEQ ID NO: 672719 - DNA, 22 bp, Artificial Sequence
  chemically synthesized
aaggtttgtggcaatcctgtgt

SEQ ID NO: 672720 - DNA, 22 bp, Artificial Sequence
  chemically synthesized
gtggcaatcctgtgttgagcat

SEQ ID NO: 672721 - DNA, 22 bp, Artificial Sequence
  chemically synthesized
tggcaatcctgtgttgagcatg

SEQ ID NO: 672722 - DNA, 22 bp, Artificial Sequence
  chemically synthesized
gaaaaatgtccatagacatgct

SEQ ID NO: 672723 - DNA, 22 bp, Artificial Sequence
  chemically synthesized
ctggaaaaatgtccatagacat

SEQ ID NO: 672724 - DNA, 22 bp, Artificial Sequence
  chemically synthesized
tgttgagcatgtctatggacat

SEQ ID NO: 672725 - DNA, 22 bp, Artificial Sequence
  chemically synthesized
agcatgtctatggacatttttc

SEQ ID NO: 672726 - DNA, 22 bp, Artificial Sequence
  chemically synthesized
tggacatttttccagcagcatg

SEQ ID NO: 672727 - DNA, 22 bp, Artificial Sequence
  chemically synthesized
ttccagcagcatgtgctcactt

SEQ ID NO: 672728 - DNA, 22 bp, Artificial Sequence
  chemically synthesized
tccagcagcatgtgctcacttt

SEQ ID NO: 672729 - DNA, 22 bp, Artificial Sequence
  chemically synthesized
ccagcagcatgtgctcactttg

SEQ ID NO: 672730 - DNA, 22 bp, Artificial Sequence
  chemically synthesized
cagcagcatgtgctcactttgg

SEQ ID NO: 672731 - DNA, 22 bp, Artificial Sequence
  chemically synthesized
aaaacgagacacagacccaaag

SEQ ID NO: 672732 - DNA, 22 bp, Artificial Sequence
  chemically synthesized
caaaacgagacacagacccaaa

SEQ ID NO: 672733 - DNA, 22 bp, Artificial Sequence
  chemically synthesized
tcaaaacgagacacagacccaa

SEQ ID NO: 672734 - DNA, 22 bp, Artificial Sequence
  chemically synthesized
actttgggtctgtgtctcgttt

SEQ ID NO: 672735 - DNA, 22 bp, Artificial Sequence
  chemically synthesized
agggaattttcaaaacgagaca

SEQ ID NO: 672736 - DNA, 22 bp, Artificial Sequence
  chemically synthesized
tgggtctgtgtctcgttttgaa

SEQ ID NO: 672737 - DNA, 22 bp, Artificial Sequence
  chemically synthesized
gggtctgtgtctcgttttgaaa

SEQ ID NO: 672738 - DNA, 22 bp, Artificial Sequence
  chemically synthesized
ggtctgtgtctcgttttgaaaa

SEQ ID NO: 672739 - DNA, 22 bp, Artificial Sequence
  chemically synthesized
aaatattgagggaattttcaaa

SEQ ID NO: 672740 - DNA, 22 bp, Artificial Sequence
  chemically synthesized
gaaatattgagggaattttcaa

SEQ ID NO: 672741 - DNA, 22 bp, Artificial Sequence
  chemically synthesized
tgtctcgttttgaaaattccct

SEQ ID NO: 672742 - DNA, 22 bp, Artificial Sequence
  chemically synthesized
gttttgaaaattccctcaatat

SEQ ID NO: 672743 - DNA, 22 bp, Artificial Sequence
  chemically synthesized
tgaaaattccctcaatatttca

SEQ ID NO: 672744 - DNA, 22 bp, Artificial Sequence
  chemically synthesized
gaaaattccctcaatatttcaa

SEQ ID NO: 672745 - DNA, 22 bp, Artificial Sequence
  chemically synthesized
aaaattccctcaatatttcaaa

SEQ ID NO: 672746 - DNA, 22 bp, Artificial Sequence
  chemically synthesized
cctcaatatttcaaatttgtca

SEQ ID NO: 672747 - DNA, 22 bp, Artificial Sequence
  chemically synthesized
aatatttcaaatttgtcattat

SEQ ID NO: 672748 - DNA, 22 bp, Artificial Sequence
  chemically synthesized
accataatagatataaaaataa

SEQ ID NO: 672749 - DNA, 22 bp, Artificial Sequence
  chemically synthesized
caaatttgtcattatttttata

SEQ ID NO: 672750 - DNA, 22 bp, Artificial Sequence
  chemically synthesized
aaatttgtcattatttttatat

SEQ ID NO: 672751 - DNA, 22 bp, Artificial Sequence
  chemically synthesized
gtcattatttttatatctatta

SEQ ID NO: 672752 - DNA, 22 bp, Artificial Sequence
  chemically synthesized
tcattatttttatatctattat

SEQ ID NO: 672753 - DNA, 22 bp, Artificial Sequence
  chemically synthesized
atcacgattcaccataatagat

SEQ ID NO: 672754 - DNA, 22 bp, Artificial Sequence
  chemically synthesized
ctgatcacgattcaccataata

SEQ ID NO: 672755 - DNA, 22 bp, Artificial Sequence
  chemically synthesized
tttttatatctattatggtgaa

SEQ ID NO: 672756 - DNA, 22 bp, Artificial Sequence
  chemically synthesized
ttatatctattatggtgaatcg

SEQ ID NO: 672757 - DNA, 22 bp, Artificial Sequence
  chemically synthesized
tatatctattatggtgaatcgt

SEQ ID NO: 672758 - DNA, 22 bp, Artificial Sequence
  chemically synthesized
atatctattatggtgaatcgtg

SEQ ID NO: 672759 - DNA, 22 bp, Artificial Sequence
  chemically synthesized
tatctattatggtgaatcgtga

SEQ ID NO: 672760 - DNA, 22 bp, Artificial Sequence
  chemically synthesized
ttatggtgaatcgtgatcagta

SEQ ID NO: 672761 - DNA, 22 bp, Artificial Sequence
  chemically synthesized
tggtgaatcgtgatcagtaatc

SEQ ID NO: 672762 - DNA, 22 bp, Artificial Sequence
  chemically synthesized
agtagtaacatcaacgattact

SEQ ID NO: 672763 - DNA, 22 bp, Artificial Sequence
  chemically synthesized
cagtagtaacatcaacgattac

SEQ ID NO: 672764 - DNA, 22 bp, Artificial Sequence
  chemically synthesized
caccccaaaacaatttcagtag

SEQ ID NO: 672765 - DNA, 22 bp, Artificial Sequence
  chemically synthesized
gttgcaccccaaaacaatttca

SEQ ID NO: 672766 - DNA, 22 bp, Artificial Sequence
  chemically synthesized
atgttactactgaaattgtttt

SEQ ID NO: 672767 - DNA, 22 bp, Artificial Sequence
  chemically synthesized
ctactgaaattgttttggggtg

SEQ ID NO: 672768 - DNA, 22 bp, Artificial Sequence
  chemically synthesized
ctgaaattgttttggggtgcaa

SEQ ID NO: 672769 - DNA, 22 bp, Artificial Sequence
  chemically synthesized
aaattgttttggggtgcaacta

SEQ ID NO: 672770 - DNA, 22 bp, Artificial Sequence
  chemically synthesized
tgtgggtgtggttagttgcacc

SEQ ID NO: 672771 - DNA, 22 bp, Artificial Sequence
  chemically synthesized
atgtgggtgtggttagttgcac

SEQ ID NO: 672772 - DNA, 22 bp, Artificial Sequence
  chemically synthesized
ttttggggtgcaactaaccaca

SEQ ID NO: 672773 - DNA, 22 bp, Artificial Sequence
  chemically synthesized
ccatcttatgtgggtgtggtta

SEQ ID NO: 672774 - DNA, 22 bp, Artificial Sequence
  chemically synthesized
tggggtgcaactaaccacaccc

SEQ ID NO: 672775 - DNA, 22 bp, Artificial Sequence
  chemically synthesized
gccatcttatgtgggtgtggtt

SEQ ID NO: 672776 - DNA, 22 bp, Artificial Sequence
  chemically synthesized
ggggtgcaactaaccacaccca

SEQ ID NO: 672777 - DNA, 22 bp, Artificial Sequence
  chemically synthesized
gggtgcaactaaccacacccac

SEQ ID NO: 672778 - DNA, 22 bp, Artificial Sequence
  chemically synthesized
agtttgccatcttatgtgggtg

SEQ ID NO: 672779 - DNA, 22 bp, Artificial Sequence
  chemically synthesized
accacacccacataagatggca

SEQ ID NO: 672780 - DNA, 22 bp, Artificial Sequence
  chemically synthesized
atcaattaagtttgccatctta

SEQ ID NO: 672781 - DNA, 22 bp, Artificial Sequence
  chemically synthesized
aattgatcaacgtcatacgtgt

SEQ ID NO: 672782 - DNA, 22 bp, Artificial Sequence
  chemically synthesized
attgatcaacgtcatacgtgtt

SEQ ID NO: 672783 - DNA, 22 bp, Artificial Sequence
  chemically synthesized
atcaacgtcatacgtgttctga

SEQ ID NO: 672784 - DNA, 22 bp, Artificial Sequence
  chemically synthesized
gtcggtggagcagtcagaacac

SEQ ID NO: 672785 - DNA, 22 bp, Artificial Sequence
  chemically synthesized
tgactgctccaccgaccagctg

SEQ ID NO: 672786 - DNA, 22 bp, Artificial Sequence
  chemically synthesized
actgctccaccgaccagctgtt

SEQ ID NO: 672787 - DNA, 22 bp, Artificial Sequence
  chemically synthesized
ctccaccgaccagctgttcccc

SEQ ID NO: 672788 - DNA, 22 bp, Artificial Sequence
  chemically synthesized
caccgaccagctgttcccccat

SEQ ID NO: 672789 - DNA, 22 bp, Artificial Sequence
  chemically synthesized
ttcccccatctctttccctctc

SEQ ID NO: 672790 - DNA, 22 bp, Artificial Sequence
  chemically synthesized
ccccatctctttccctctcctc

SEQ ID NO: 672791 - DNA, 22 bp, Artificial Sequence
  chemically synthesized
agaacaggaaggccagaggaga

SEQ ID NO: 672792 - DNA, 22 bp, Artificial Sequence
  chemically synthesized
tttccctctcctctggccttcc

SEQ ID NO: 672793 - DNA, 22 bp, Artificial Sequence
  chemically synthesized
tgtctcagaacaggaaggccag

SEQ ID NO: 672794 - DNA, 22 bp, Artificial Sequence
  chemically synthesized
tccctctcctctggccttcctg

SEQ ID NO: 672795 - DNA, 22 bp, Artificial Sequence
  chemically synthesized
ccctctcctctggccttcctgt

SEQ ID NO: 672796 - DNA, 22 bp, Artificial Sequence
  chemically synthesized
ttgtgtctcagaacaggaaggc

SEQ ID NO: 672797 - DNA, 22 bp, Artificial Sequence
  chemically synthesized
cctctcctctggccttcctgtt

SEQ ID NO: 672798 - DNA, 22 bp, Artificial Sequence
  chemically synthesized
tcctctggccttcctgttctga

SEQ ID NO: 672799 - DNA, 22 bp, Artificial Sequence
  chemically synthesized
atattgttgtgtctcagaacag

SEQ ID NO: 672800 - DNA, 22 bp, Artificial Sequence
  chemically synthesized
ctctggccttcctgttctgaga

SEQ ID NO: 672801 - DNA, 22 bp, Artificial Sequence
  chemically synthesized
aatattgttgtgtctcagaaca

SEQ ID NO: 672802 - DNA, 22 bp, Artificial Sequence
  chemically synthesized
taatattgttgtgtctcagaac

SEQ ID NO: 672803 - DNA, 22 bp, Artificial Sequence
  chemically synthesized
tggccttcctgttctgagacac

SEQ ID NO: 672804 - DNA, 22 bp, Artificial Sequence
  chemically synthesized
gccttcctgttctgagacacaa

SEQ ID NO: 672805 - DNA, 22 bp, Artificial Sequence
  chemically synthesized
attttaatattgttgtgtctca

SEQ ID NO: 672806 - DNA, 22 bp, Artificial Sequence
  chemically synthesized
cctgttctgagacacaacaata

SEQ ID NO: 672807 - DNA, 22 bp, Artificial Sequence
  chemically synthesized
ccctgattttaatattgttgtg

SEQ ID NO: 672808 - DNA, 22 bp, Artificial Sequence
  chemically synthesized
ctgttctgagacacaacaatat

SEQ ID NO: 672809 - DNA, 22 bp, Artificial Sequence
  chemically synthesized
ttctgagacacaacaatattaa

SEQ ID NO: 672810 - DNA, 22 bp, Artificial Sequence
  chemically synthesized
attaccctgattttaatattgt

SEQ ID NO: 672811 - DNA, 22 bp, Artificial Sequence
  chemically synthesized
tgagacacaacaatattaaaat

SEQ ID NO: 672812 - DNA, 22 bp, Artificial Sequence
  chemically synthesized
ttaattaccctgattttaatat

SEQ ID NO: 672813 - DNA, 22 bp, Artificial Sequence
  chemically synthesized
agacacaacaatattaaaatca

SEQ ID NO: 672814 - DNA, 22 bp, Artificial Sequence
  chemically synthesized
tagggttattaattaccctgat

SEQ ID NO: 672815 - DNA, 22 bp, Artificial Sequence
  chemically synthesized
aaatcagggtaattaataaccc

SEQ ID NO: 672816 - DNA, 22 bp, Artificial Sequence
  chemically synthesized
gaggccattgtagggttattaa

SEQ ID NO: 672817 - DNA, 22 bp, Artificial Sequence
  chemically synthesized
agaggccattgtagggttatta

SEQ ID NO: 672818 - DNA, 22 bp, Artificial Sequence
  chemically synthesized
aacacttagaggccattgtagg

SEQ ID NO: 672819 - DNA, 22 bp, Artificial Sequence
  chemically synthesized
gaacacttagaggccattgtag

SEQ ID NO: 672820 - DNA, 22 bp, Artificial Sequence
  chemically synthesized
ccttgaacacttagaggccatt

SEQ ID NO: 672821 - DNA, 22 bp, Artificial Sequence
  chemically synthesized
cccttgaacacttagaggccat

SEQ ID NO: 672822 - DNA, 22 bp, Artificial Sequence
  chemically synthesized
ataaccctacaatggcctctaa

SEQ ID NO: 672823 - DNA, 22 bp, Artificial Sequence
  chemically synthesized
ttcccttgaacacttagaggcc

SEQ ID NO: 672824 - DNA, 22 bp, Artificial Sequence
  chemically synthesized
cttcccttgaacacttagaggc

SEQ ID NO: 672825 - DNA, 22 bp, Artificial Sequence
  chemically synthesized
tcttcccttgaacacttagagg

SEQ ID NO: 672826 - DNA, 22 bp, Artificial Sequence
  chemically synthesized
tttcttcccttgaacacttaga

SEQ ID NO: 672827 - DNA, 22 bp, Artificial Sequence
  chemically synthesized
caatggcctctaagtgttcaag

SEQ ID NO: 672828 - DNA, 22 bp, Artificial Sequence
  chemically synthesized
taagtgttcaagggaagaaaga

SEQ ID NO: 672829 - DNA, 22 bp, Artificial Sequence
  chemically synthesized
agtgttcaagggaagaaagagc

SEQ ID NO: 672830 - DNA, 22 bp, Artificial Sequence
  chemically synthesized
aagggaagaaagagccatacct

SEQ ID NO: 672831 - DNA, 22 bp, Artificial Sequence
  chemically synthesized
atgtaaagtgacagaggtatgg

SEQ ID NO: 672832 - DNA, 22 bp, Artificial Sequence
  chemically synthesized
tgatgtaaagtgacagaggtat

SEQ ID NO: 672833 - DNA, 22 bp, Artificial Sequence
  chemically synthesized
ctgatgtaaagtgacagaggta

SEQ ID NO: 672834 - DNA, 22 bp, Artificial Sequence
  chemically synthesized
atagcttctgatgtaaagtgac

SEQ ID NO: 672835 - DNA, 22 bp, Artificial Sequence
  chemically synthesized
aatcattaatagcttctgatgt

SEQ ID NO: 672836 - DNA, 22 bp, Artificial Sequence
  chemically synthesized
tgtcactttacatcagaagcta

SEQ ID NO: 672837 - DNA, 22 bp, Artificial Sequence
  chemically synthesized
tcactttacatcagaagctatt

SEQ ID NO: 672838 - DNA, 22 bp, Artificial Sequence
  chemically synthesized
agctcaatcattaatagcttct

SEQ ID NO: 672839 - DNA, 22 bp, Artificial Sequence
  chemically synthesized
actaagctcaatcattaatagc

SEQ ID NO: 672840 - DNA, 22 bp, Artificial Sequence
  chemically synthesized
tacatcagaagctattaatgat

SEQ ID NO: 672841 - DNA, 22 bp, Artificial Sequence
  chemically synthesized
acatcagaagctattaatgatt

SEQ ID NO: 672842 - DNA, 22 bp, Artificial Sequence
  chemically synthesized
ctcactaagctcaatcattaat

SEQ ID NO: 672843 - DNA, 22 bp, Artificial Sequence
  chemically synthesized
catcagaagctattaatgattg

SEQ ID NO: 672844 - DNA, 22 bp, Artificial Sequence
  chemically synthesized
cctcactaagctcaatcattaa

SEQ ID NO: 672845 - DNA, 22 bp, Artificial Sequence
  chemically synthesized
tcctcactaagctcaatcatta

SEQ ID NO: 672846 - DNA, 22 bp, Artificial Sequence
  chemically synthesized
aacatgctttcctcactaagct

SEQ ID NO: 672847 - DNA, 22 bp, Artificial Sequence
  chemically synthesized
caacatgctttcctcactaagc

SEQ ID NO: 672848 - DNA, 22 bp, Artificial Sequence
  chemically synthesized
ttaatgattgagcttagtgagg

SEQ ID NO: 672849 - DNA, 22 bp, Artificial Sequence
  chemically synthesized
tcaacatgctttcctcactaag

SEQ ID NO: 672850 - DNA, 22 bp, Artificial Sequence
  chemically synthesized
atgattgagcttagtgaggaaa

SEQ ID NO: 672851 - DNA, 22 bp, Artificial Sequence
  chemically synthesized
atctttcaacatgctttcctca

SEQ ID NO: 672852 - DNA, 22 bp, Artificial Sequence
  chemically synthesized
tctcatctttcaacatgctttc

SEQ ID NO: 672853 - DNA, 22 bp, Artificial Sequence
  chemically synthesized
agcttagtgaggaaagcatgtt

SEQ ID NO: 672854 - DNA, 22 bp, Artificial Sequence
  chemically synthesized
agtgaggaaagcatgttgaaag

SEQ ID NO: 672855 - DNA, 22 bp, Artificial Sequence
  chemically synthesized
agtctgtctcatctttcaacat

SEQ ID NO: 672856 - DNA, 22 bp, Artificial Sequence
  chemically synthesized
gtgaggaaagcatgttgaaaga

SEQ ID NO: 672857 - DNA, 22 bp, Artificial Sequence
  chemically synthesized
cagtctgtctcatctttcaaca

SEQ ID NO: 672858 - DNA, 22 bp, Artificial Sequence
  chemically synthesized
tcagtctgtctcatctttcaac

SEQ ID NO: 672859 - DNA, 22 bp, Artificial Sequence
  chemically synthesized
gctttcagtctgtctcatcttt

SEQ ID NO: 672860 - DNA, 22 bp, Artificial Sequence
  chemically synthesized
aaagatgagacagactgaaagc

SEQ ID NO: 672861 - DNA, 22 bp, Artificial Sequence
  chemically synthesized
gcatgagaggcctagctttcag

SEQ ID NO: 672862 - DNA, 22 bp, Artificial Sequence
  chemically synthesized
ggcatgagaggcctagctttca

SEQ ID NO: 672863 - DNA, 22 bp, Artificial Sequence
  chemically synthesized
tttggcatgagaggcctagctt

SEQ ID NO: 672864 - DNA, 22 bp, Artificial Sequence
  chemically synthesized
actgtttggcatgagaggccta

SEQ ID NO: 672865 - DNA, 22 bp, Artificial Sequence
  chemically synthesized
gactgtttggcatgagaggcct

SEQ ID NO: 672866 - DNA, 22 bp, Artificial Sequence
  chemically synthesized
aaagctaggcctctcatgccaa

SEQ ID NO: 672867 - DNA, 22 bp, Artificial Sequence
  chemically synthesized
acaacttgactgtttggcatga

SEQ ID NO: 672868 - DNA, 22 bp, Artificial Sequence
  chemically synthesized
cattcacaacttgactgtttgg

SEQ ID NO: 672869 - DNA, 22 bp, Artificial Sequence
  chemically synthesized
ggcctctcatgccaaacagtca

SEQ ID NO: 672870 - DNA, 22 bp, Artificial Sequence
  chemically synthesized
gcattcacaacttgactgtttg

SEQ ID NO: 672871 - DNA, 22 bp, Artificial Sequence
  chemically synthesized
tgcattcacaacttgactgttt

SEQ ID NO: 672872 - DNA, 22 bp, Artificial Sequence
  chemically synthesized
ctttgcattcacaacttgactg

SEQ ID NO: 672873 - DNA, 22 bp, Artificial Sequence
  chemically synthesized
cctttgcattcacaacttgact

SEQ ID NO: 672874 - DNA, 22 bp, Artificial Sequence
  chemically synthesized
tcatgccaaacagtcaagttgt

SEQ ID NO: 672875 - DNA, 22 bp, Artificial Sequence
  chemically synthesized
tcctttgcattcacaacttgac

SEQ ID NO: 672876 - DNA, 22 bp, Artificial Sequence
  chemically synthesized
ttcctttgcattcacaacttga

SEQ ID NO: 672877 - DNA, 22 bp, Artificial Sequence
  chemically synthesized
atgccaaacagtcaagttgtga

SEQ ID NO: 672878 - DNA, 22 bp, Artificial Sequence
  chemically synthesized
acttttcctttgcattcacaac

SEQ ID NO: 672879 - DNA, 22 bp, Artificial Sequence
  chemically synthesized
attaacttttcctttgcattca

SEQ ID NO: 672880 - DNA, 22 bp, Artificial Sequence
  chemically synthesized
cattaacttttcctttgcattc

SEQ ID NO: 672881 - DNA, 22 bp, Artificial Sequence
  chemically synthesized
cttcattaacttttcctttgca

SEQ ID NO: 672882 - DNA, 22 bp, Artificial Sequence
  chemically synthesized
ccttcattaacttttcctttgc

SEQ ID NO: 672883 - DNA, 22 bp, Artificial Sequence
  chemically synthesized
atttccttcattaacttttcct

SEQ ID NO: 672884 - DNA, 22 bp, Artificial Sequence
  chemically synthesized
aatttccttcattaacttttcc

SEQ ID NO: 672885 - DNA, 22 bp, Artificial Sequence
  chemically synthesized
taatttccttcattaacttttc

SEQ ID NO: 672886 - DNA, 22 bp, Artificial Sequence
  chemically synthesized
tgaatgcaaaggaaaagttaat

SEQ ID NO: 672887 - DNA, 22 bp, Artificial Sequence
  chemically synthesized
ttaatttccttcattaactttt

SEQ ID NO: 672888 - DNA, 22 bp, Artificial Sequence
  chemically synthesized
gcagggtagtacttttaatttc

SEQ ID NO: 672889 - DNA, 22 bp, Artificial Sequence
  chemically synthesized
atgaaggaaattaaaagtacta

SEQ ID NO: 672890 - DNA, 22 bp, Artificial Sequence
  chemically synthesized
tgtgctcgcagggtagtacttt

SEQ ID NO: 672891 - DNA, 22 bp, Artificial Sequence
  chemically synthesized
gtgtgctcgcagggtagtactt

SEQ ID NO: 672892 - DNA, 22 bp, Artificial Sequence
  chemically synthesized
tcatttgtgtgctcgcagggta

SEQ ID NO: 672893 - DNA, 22 bp, Artificial Sequence
  chemically synthesized
atcatttgtgtgctcgcagggt

SEQ ID NO: 672894 - DNA, 22 bp, Artificial Sequence
  chemically synthesized
ttatcatttgtgtgctcgcagg

SEQ ID NO: 672895 - DNA, 22 bp, Artificial Sequence
  chemically synthesized
cttatcatttgtgtgctcgcag

SEQ ID NO: 672896 - DNA, 22 bp, Artificial Sequence
  chemically synthesized
aaagtactaccctgcgagcaca

SEQ ID NO: 672897 - DNA, 22 bp, Artificial Sequence
  chemically synthesized
tcttatcatttgtgtgctcgca

SEQ ID NO: 672898 - DNA, 22 bp, Artificial Sequence
  chemically synthesized
ctttcttatcatttgtgtgctc

SEQ ID NO: 672899 - DNA, 22 bp, Artificial Sequence
  chemically synthesized
actttcttatcatttgtgtgct

SEQ ID NO: 672900 - DNA, 22 bp, Artificial Sequence
  chemically synthesized
tactttcttatcatttgtgtgc

SEQ ID NO: 672901 - DNA, 22 bp, Artificial Sequence
  chemically synthesized
ttttactttcttatcatttgtg

SEQ ID NO: 672902 - DNA, 22 bp, Artificial Sequence
  chemically synthesized
ccctgcgagcacacaaatgata

SEQ ID NO: 672903 - DNA, 22 bp, Artificial Sequence
  chemically synthesized
cgagcacacaaatgataagaaa

SEQ ID NO: 672904 - DNA, 22 bp, Artificial Sequence
  chemically synthesized
catatcaggaataaggctgttt

SEQ ID NO: 672905 - DNA, 22 bp, Artificial Sequence
  chemically synthesized
tccatatcaggaataaggctgt

SEQ ID NO: 672906 - DNA, 22 bp, Artificial Sequence
  chemically synthesized
ctccatatcaggaataaggctg

SEQ ID NO: 672907 - DNA, 22 bp, Artificial Sequence
  chemically synthesized
tctccatatcaggaataaggct

SEQ ID NO: 672908 - DNA, 22 bp, Artificial Sequence
  chemically synthesized
aaactttctccatatcaggaat

SEQ ID NO: 672909 - DNA, 22 bp, Artificial Sequence
  chemically synthesized
agagcactcaaactttctccat

SEQ ID NO: 672910 - DNA, 22 bp, Artificial Sequence
  chemically synthesized
attcctgatatggagaaagttt

SEQ ID NO: 672911 - DNA, 22 bp, Artificial Sequence
  chemically synthesized
ttcagagcactcaaactttctc

SEQ ID NO: 672912 - DNA, 22 bp, Artificial Sequence
  chemically synthesized
ttcctgatatggagaaagtttg

SEQ ID NO: 672913 - DNA, 22 bp, Artificial Sequence
  chemically synthesized
tattcagagcactcaaactttc

SEQ ID NO: 672914 - DNA, 22 bp, Artificial Sequence
  chemically synthesized
ctattcagagcactcaaacttt

SEQ ID NO: 672915 - DNA, 22 bp, Artificial Sequence
  chemically synthesized
ctgatatggagaaagtttgagt

SEQ ID NO: 672916 - DNA, 22 bp, Artificial Sequence
  chemically synthesized
atatggagaaagtttgagtgct

SEQ ID NO: 672917 - DNA, 22 bp, Artificial Sequence
  chemically synthesized
atcttctattcagagcactcaa

SEQ ID NO: 672918 - DNA, 22 bp, Artificial Sequence
  chemically synthesized
gatcttctattcagagcactca

SEQ ID NO: 672919 - DNA, 22 bp, Artificial Sequence
  chemically synthesized
gtttgatcttctattcagagca

SEQ ID NO: 672920 - DNA, 22 bp, Artificial Sequence
  chemically synthesized
tggctagtttgatcttctattc

SEQ ID NO: 672921 - DNA, 22 bp, Artificial Sequence
  chemically synthesized
gagtgctctgaatagaagatca

SEQ ID NO: 672922 - DNA, 22 bp, Artificial Sequence
  chemically synthesized
agtgctctgaatagaagatcaa

SEQ ID NO: 672923 - DNA, 22 bp, Artificial Sequence
  chemically synthesized
tgaatagaagatcaaactagcc

SEQ ID NO: 672924 - DNA, 22 bp, Artificial Sequence
  chemically synthesized
aagaaatgttgtggctagtttg

SEQ ID NO: 672925 - DNA, 22 bp, Artificial Sequence
  chemically synthesized
aaagaaatgttgtggctagttt

SEQ ID NO: 672926 - DNA, 22 bp, Artificial Sequence
  chemically synthesized
aatagaagatcaaactagccac

SEQ ID NO: 672927 - DNA, 22 bp, Artificial Sequence
  chemically synthesized
gcttaaagaaatgttgtggcta

SEQ ID NO: 672928 - DNA, 22 bp, Artificial Sequence
  chemically synthesized
ggcttaaagaaatgttgtggct

SEQ ID NO: 672929 - DNA, 22 bp, Artificial Sequence
  chemically synthesized
tggcttaaagaaatgttgtggc

SEQ ID NO: 672930 - DNA, 22 bp, Artificial Sequence
  chemically synthesized
ggctttggcttaaagaaatgtt

SEQ ID NO: 672931 - DNA, 22 bp, Artificial Sequence
  chemically synthesized
gattaggctttggcttaaagaa

SEQ ID NO: 672932 - DNA, 22 bp, Artificial Sequence
  chemically synthesized
gccacaacatttctttaagcca

SEQ ID NO: 672933 - DNA, 22 bp, Artificial Sequence
  chemically synthesized
tggattaggctttggcttaaag

SEQ ID NO: 672934 - DNA, 22 bp, Artificial Sequence
  chemically synthesized
ctctggattaggctttggctta

SEQ ID NO: 672935 - DNA, 22 bp, Artificial Sequence
  chemically synthesized
gctctggattaggctttggctt

SEQ ID NO: 672936 - DNA, 22 bp, Artificial Sequence
  chemically synthesized
tgctctggattaggctttggct

SEQ ID NO: 672937 - DNA, 22 bp, Artificial Sequence
  chemically synthesized
aggttttgctctggattaggct

SEQ ID NO: 672938 - DNA, 22 bp, Artificial Sequence
  chemically synthesized
ctttaagccaaagcctaatcca

SEQ ID NO: 672939 - DNA, 22 bp, Artificial Sequence
  chemically synthesized
tttaagccaaagcctaatccag

SEQ ID NO: 672940 - DNA, 22 bp, Artificial Sequence
  chemically synthesized
taagccaaagcctaatccagag

SEQ ID NO: 672941 - DNA, 22 bp, Artificial Sequence
  chemically synthesized
aagccaaagcctaatccagagc

SEQ ID NO: 672942 - DNA, 22 bp, Artificial Sequence
  chemically synthesized
agccaaagcctaatccagagca

SEQ ID NO: 672943 - DNA, 22 bp, Artificial Sequence
  chemically synthesized
aagggagttaaggttttgctct

SEQ ID NO: 672944 - DNA, 22 bp, Artificial Sequence
  chemically synthesized
atccagagcaaaaccttaactc

SEQ ID NO: 672945 - DNA, 22 bp, Artificial Sequence
  chemically synthesized
atagaattgaagggagttaagg

SEQ ID NO: 672946 - DNA, 22 bp, Artificial Sequence
  chemically synthesized
catagaattgaagggagttaag

SEQ ID NO: 672947 - DNA, 22 bp, Artificial Sequence
  chemically synthesized
gccttcatagaattgaagggag

SEQ ID NO: 672948 - DNA, 22 bp, Artificial Sequence
  chemically synthesized
agccttcatagaattgaaggga

SEQ ID NO: 672949 - DNA, 22 bp, Artificial Sequence
  chemically synthesized
tagccttcatagaattgaaggg

SEQ ID NO: 672950 - DNA, 22 bp, Artificial Sequence
  chemically synthesized
ttagccttcatagaattgaagg

SEQ ID NO: 672951 - DNA, 22 bp, Artificial Sequence
  chemically synthesized
ttttagccttcatagaattgaa

SEQ ID NO: 672952 - DNA, 22 bp, Artificial Sequence
  chemically synthesized
aactcccttcaattctatgaag

SEQ ID NO: 672953 - DNA, 22 bp, Artificial Sequence
  chemically synthesized
atctcttttagccttcatagaa

SEQ ID NO: 672954 - DNA, 22 bp, Artificial Sequence
  chemically synthesized
actcccttcaattctatgaagg

SEQ ID NO: 672955 - DNA, 22 bp, Artificial Sequence
  chemically synthesized
ctcatctcttttagccttcata

SEQ ID NO: 672956 - DNA, 22 bp, Artificial Sequence
  chemically synthesized
cctcatctcttttagccttcat

SEQ ID NO: 672957 - DNA, 22 bp, Artificial Sequence
  chemically synthesized
ccttcaattctatgaaggctaa

SEQ ID NO: 672958 - DNA, 22 bp, Artificial Sequence
  chemically synthesized
caattctatgaaggctaaaaga

SEQ ID NO: 672959 - DNA, 22 bp, Artificial Sequence
  chemically synthesized
aattctatgaaggctaaaagag

SEQ ID NO: 672960 - DNA, 22 bp, Artificial Sequence
  chemically synthesized
cagcttcctcatctcttttagc

SEQ ID NO: 672961 - DNA, 22 bp, Artificial Sequence
  chemically synthesized
tgcagcttcctcatctctttta

SEQ ID NO: 672962 - DNA, 22 bp, Artificial Sequence
  chemically synthesized
ctgcagcttcctcatctctttt

SEQ ID NO: 672963 - DNA, 22 bp, Artificial Sequence
  chemically synthesized
tatgaaggctaaaagagatgag

SEQ ID NO: 672964 - DNA, 22 bp, Artificial Sequence
  chemically synthesized
ttctgcagcttcctcatctctt

SEQ ID NO: 672965 - DNA, 22 bp, Artificial Sequence
  chemically synthesized
cttctgcagcttcctcatctct

SEQ ID NO: 672966 - DNA, 22 bp, Artificial Sequence
  chemically synthesized
tgaaggctaaaagagatgagga

SEQ ID NO: 672967 - DNA, 22 bp, Artificial Sequence
  chemically synthesized
tcttctgcagcttcctcatctc

SEQ ID NO: 672968 - DNA, 22 bp, Artificial Sequence
  chemically synthesized
ttcttctgcagcttcctcatct

SEQ ID NO: 672969 - DNA, 22 bp, Artificial Sequence
  chemically synthesized
caacttttcttctgcagcttcc

SEQ ID NO: 672970 - DNA, 22 bp, Artificial Sequence
  chemically synthesized
ccaacttttcttctgcagcttc

SEQ ID NO: 672971 - DNA, 22 bp, Artificial Sequence
  chemically synthesized
aaagagatgaggaagctgcaga

SEQ ID NO: 672972 - DNA, 22 bp, Artificial Sequence
  chemically synthesized
gcttccaacttttcttctgcag

SEQ ID NO: 672973 - DNA, 22 bp, Artificial Sequence
  chemically synthesized
ctagcttccaacttttcttctg

SEQ ID NO: 672974 - DNA, 22 bp, Artificial Sequence
  chemically synthesized
tactagcttccaacttttcttc

SEQ ID NO: 672975 - DNA, 22 bp, Artificial Sequence
  chemically synthesized
cagaagaaaagttggaagctag

SEQ ID NO: 672976 - DNA, 22 bp, Artificial Sequence
  chemically synthesized
aagcaacctctactagcttcca

SEQ ID NO: 672977 - DNA, 22 bp, Artificial Sequence
  chemically synthesized
gaagcaacctctactagcttcc

SEQ ID NO: 672978 - DNA, 22 bp, Artificial Sequence
  chemically synthesized
ttgaagcaacctctactagctt

SEQ ID NO: 672979 - DNA, 22 bp, Artificial Sequence
  chemically synthesized
cttgaagcaacctctactagct

SEQ ID NO: 672980 - DNA, 22 bp, Artificial Sequence
  chemically synthesized
agcttcttgaagcaacctctac

SEQ ID NO: 672981 - DNA, 22 bp, Artificial Sequence
  chemically synthesized
aagcttcttgaagcaacctcta

SEQ ID NO: 672982 - DNA, 22 bp, Artificial Sequence
  chemically synthesized
cttaagcttcttgaagcaacct

SEQ ID NO: 672983 - DNA, 22 bp, Artificial Sequence
  chemically synthesized
gaagctagtagaggttgcttca

SEQ ID NO: 672984 - DNA, 22 bp, Artificial Sequence
  chemically synthesized
ccttaagcttcttgaagcaacc

SEQ ID NO: 672985 - DNA, 22 bp, Artificial Sequence
  chemically synthesized
tttccttaagcttcttgaagca

SEQ ID NO: 672986 - DNA, 22 bp, Artificial Sequence
  chemically synthesized
gtttccttaagcttcttgaagc

SEQ ID NO: 672987 - DNA, 22 bp, Artificial Sequence
  chemically synthesized
gtagaggttgcttcaagaagct

SEQ ID NO: 672988 - DNA, 22 bp, Artificial Sequence
  chemically synthesized
tggatatggcttgtttccttaa

SEQ ID NO: 672989 - DNA, 22 bp, Artificial Sequence
  chemically synthesized
cttcaagaagcttaaggaaaca

SEQ ID NO: 672990 - DNA, 22 bp, Artificial Sequence
  chemically synthesized
caagaagcttaaggaaacaagc

SEQ ID NO: 672991 - DNA, 22 bp, Artificial Sequence
  chemically synthesized
aagaagcttaaggaaacaagcc

SEQ ID NO: 672992 - DNA, 22 bp, Artificial Sequence
  chemically synthesized
atgttatggatatggcttgttt

SEQ ID NO: 672993 - DNA, 22 bp, Artificial Sequence
  chemically synthesized
aatgttatggatatggcttgtt

SEQ ID NO: 672994 - DNA, 22 bp, Artificial Sequence
  chemically synthesized
caccttaatgttatggatatgg

SEQ ID NO: 672995 - DNA, 22 bp, Artificial Sequence
  chemically synthesized
aaggaaacaagccatatccata

SEQ ID NO: 672996 - DNA, 22 bp, Artificial Sequence
  chemically synthesized
gcaccttaatgttatggatatg

SEQ ID NO: 672997 - DNA, 22 bp, Artificial Sequence
  chemically synthesized
aggaaacaagccatatccataa

SEQ ID NO: 672998 - DNA, 22 bp, Artificial Sequence
  chemically synthesized
atcttgcaccttaatgttatgg

SEQ ID NO: 672999 - DNA, 22 bp, Artificial Sequence
  chemically synthesized
catcttgcaccttaatgttatg

SEQ ID NO: 673000 - DNA, 22 bp, Artificial Sequence
  chemically synthesized
cttcatcttgcaccttaatgtt

SEQ ID NO: 673001 - DNA, 22 bp, Artificial Sequence
  chemically synthesized
ctgcttcatcttgcaccttaat

SEQ ID NO: 673002 - DNA, 22 bp, Artificial Sequence
  chemically synthesized
gctgcttcatcttgcaccttaa

SEQ ID NO: 673003 - DNA, 22 bp, Artificial Sequence
  chemically synthesized
catcaatgcttgctgcttcatc

SEQ ID NO: 673004 - DNA, 22 bp, Artificial Sequence
  chemically synthesized
tgcatcaatgcttgctgcttca

SEQ ID NO: 673005 - DNA, 22 bp, Artificial Sequence
  chemically synthesized
ctgcatcaatgcttgctgcttc

SEQ ID NO: 673006 - DNA, 22 bp, Artificial Sequence
  chemically synthesized
aggtgcaagatgaagcagcaag

SEQ ID NO: 673007 - DNA, 22 bp, Artificial Sequence
  chemically synthesized
cagcttctgcatcaatgcttgc

SEQ ID NO: 673008 - DNA, 22 bp, Artificial Sequence
  chemically synthesized
gctgcagcttctgcatcaatgc

SEQ ID NO: 673009 - DNA, 22 bp, Artificial Sequence
  chemically synthesized
ggctgcagcttctgcatcaatg

SEQ ID NO: 673010 - DNA, 22 bp, Artificial Sequence
  chemically synthesized
gaaaacttggctgcagcttctg

SEQ ID NO: 673011 - DNA, 22 bp, Artificial Sequence
  chemically synthesized
atctggaaaacttggctgcagc

SEQ ID NO: 673012 - DNA, 22 bp, Artificial Sequence
  chemically synthesized
catctggaaaacttggctgcag

SEQ ID NO: 673013 - DNA, 22 bp, Artificial Sequence
  chemically synthesized
atgcagaagctgcagccaagtt

SEQ ID NO: 673014 - DNA, 22 bp, Artificial Sequence
  chemically synthesized
gcttcatctggaaaacttggct

SEQ ID NO: 673015 - DNA, 22 bp, Artificial Sequence
  chemically synthesized
agcttcatctggaaaacttggc

SEQ ID NO: 673016 - DNA, 22 bp, Artificial Sequence
  chemically synthesized
cagccaagttttccagatgaag

SEQ ID NO: 673017 - DNA, 22 bp, Artificial Sequence
  chemically synthesized
atccatgaccttagcttcatct

SEQ ID NO: 673018 - DNA, 22 bp, Artificial Sequence
  chemically synthesized
catccatgaccttagcttcatc

SEQ ID NO: 673019 - DNA, 22 bp, Artificial Sequence
  chemically synthesized
tccagatgaagctaaggtcatg

SEQ ID NO: 673020 - DNA, 22 bp, Artificial Sequence
  chemically synthesized
ccagatgaagctaaggtcatgg

SEQ ID NO: 673021 - DNA, 22 bp, Artificial Sequence
  chemically synthesized
cagatgaagctaaggtcatgga

SEQ ID NO: 673022 - DNA, 22 bp, Artificial Sequence
  chemically synthesized
tagccaccttcatccatgacct

SEQ ID NO: 673023 - DNA, 22 bp, Artificial Sequence
  chemically synthesized
gttgtagccaccttcatccatg

SEQ ID NO: 673024 - DNA, 22 bp, Artificial Sequence
  chemically synthesized
ttcgttgtagccaccttcatcc

SEQ ID NO: 673025 - DNA, 22 bp, Artificial Sequence
  chemically synthesized
ttgttcgttgtagccaccttca

SEQ ID NO: 673026 - DNA, 22 bp, Artificial Sequence
  chemically synthesized
aggtcatggatgaaggtggcta

SEQ ID NO: 673027 - DNA, 22 bp, Artificial Sequence
  chemically synthesized
aaaatctgttgttcgttgtagc

SEQ ID NO: 673028 - DNA, 22 bp, Artificial Sequence
  chemically synthesized
tgttgaaaatctgttgttcgtt

SEQ ID NO: 673029 - DNA, 22 bp, Artificial Sequence
  chemically synthesized
atctatgttgaaaatctgttgt

SEQ ID NO: 673030 - DNA, 22 bp, Artificial Sequence
  chemically synthesized
catctatgttgaaaatctgttg

SEQ ID NO: 673031 - DNA, 22 bp, Artificial Sequence
  chemically synthesized
tttcatctatgttgaaaatctg

SEQ ID NO: 673032 - DNA, 22 bp, Artificial Sequence
  chemically synthesized
caacgaacaacagattttcaac

SEQ ID NO: 673033 - DNA, 22 bp, Artificial Sequence
  chemically synthesized
aatagaaggctgtttcatctat

SEQ ID NO: 673034 - DNA, 22 bp, Artificial Sequence
  chemically synthesized
aaatagaaggctgtttcatcta

SEQ ID NO: 673035 - DNA, 22 bp, Artificial Sequence
  chemically synthesized
taaatagaaggctgtttcatct

SEQ ID NO: 673036 - DNA, 22 bp, Artificial Sequence
  chemically synthesized
tcaacatagatgaaacagcctt

SEQ ID NO: 673037 - DNA, 22 bp, Artificial Sequence
  chemically synthesized
caacatagatgaaacagccttc

SEQ ID NO: 673038 - DNA, 22 bp, Artificial Sequence
  chemically synthesized
aacatagatgaaacagccttct

SEQ ID NO: 673039 - DNA, 22 bp, Artificial Sequence
  chemically synthesized
gatagtatcacctttaaataga

SEQ ID NO: 673040 - DNA, 22 bp, Artificial Sequence
  chemically synthesized
tgaaagtcctagatagtatcac

SEQ ID NO: 673041 - DNA, 22 bp, Artificial Sequence
  chemically synthesized
ctatttaaaggtgatactatct

SEQ ID NO: 673042 - DNA, 22 bp, Artificial Sequence
  chemically synthesized
tatttaaaggtgatactatcta

SEQ ID NO: 673043 - DNA, 22 bp, Artificial Sequence
  chemically synthesized
tttaaaggtgatactatctagg

SEQ ID NO: 673044 - DNA, 22 bp, Artificial Sequence
  chemically synthesized
gagctatgaaagtcctagatag

SEQ ID NO: 673045 - DNA, 22 bp, Artificial Sequence
  chemically synthesized
aaaggtgatactatctaggact

SEQ ID NO: 673046 - DNA, 22 bp, Artificial Sequence
  chemically synthesized
tagagctatgaaagtcctagat

SEQ ID NO: 673047 - DNA, 22 bp, Artificial Sequence
  chemically synthesized
aaggtgatactatctaggactt

SEQ ID NO: 673048 - DNA, 22 bp, Artificial Sequence
  chemically synthesized
ctctagagctatgaaagtccta

SEQ ID NO: 673049 - DNA, 22 bp, Artificial Sequence
  chemically synthesized
tcctctagagctatgaaagtcc

SEQ ID NO: 673050 - DNA, 22 bp, Artificial Sequence
  chemically synthesized
ctcctctagagctatgaaagtc

SEQ ID NO: 673051 - DNA, 22 bp, Artificial Sequence
  chemically synthesized
atttctcctctagagctatgaa

SEQ ID NO: 673052 - DNA, 22 bp, Artificial Sequence
  chemically synthesized
tctaggactttcatagctctag

SEQ ID NO: 673053 - DNA, 22 bp, Artificial Sequence
  chemically synthesized
ggactttcatagctctagagga

SEQ ID NO: 673054 - DNA, 22 bp, Artificial Sequence
  chemically synthesized
tcatagctctagaggagaaatc

SEQ ID NO: 673055 - DNA, 22 bp, Artificial Sequence
  chemically synthesized
aaggcagtcattgatttctcct

SEQ ID NO: 673056 - DNA, 22 bp, Artificial Sequence
  chemically synthesized
catagctctagaggagaaatca

SEQ ID NO: 673057 - DNA, 22 bp, Artificial Sequence
  chemically synthesized
gaaggcagtcattgatttctcc

SEQ ID NO: 673058 - DNA, 22 bp, Artificial Sequence
  chemically synthesized
atagctctagaggagaaatcaa

SEQ ID NO: 673059 - DNA, 22 bp, Artificial Sequence
  chemically synthesized
tgaaggcagtcattgatttctc

SEQ ID NO: 673060 - DNA, 22 bp, Artificial Sequence
  chemically synthesized
aagctttgaaggcagtcattga

SEQ ID NO: 673061 - DNA, 22 bp, Artificial Sequence
  chemically synthesized
tagaggagaaatcaatgactgc

SEQ ID NO: 673062 - DNA, 22 bp, Artificial Sequence
  chemically synthesized
gaggagaaatcaatgactgcct

SEQ ID NO: 673063 - DNA, 22 bp, Artificial Sequence
  chemically synthesized
tccattgaagctttgaaggcag

SEQ ID NO: 673064 - DNA, 22 bp, Artificial Sequence
  chemically synthesized
agagatacagcctgtccattga

SEQ ID NO: 673065 - DNA, 22 bp, Artificial Sequence
  chemically synthesized
ccttcaaagcttcaatggacag

SEQ ID NO: 673066 - DNA, 22 bp, Artificial Sequence
  chemically synthesized
ctaagagatacagcctgtccat

SEQ ID NO: 673067 - DNA, 22 bp, Artificial Sequence
  chemically synthesized
caaagcttcaatggacaggctg

SEQ ID NO: 673068 - DNA, 22 bp, Artificial Sequence
  chemically synthesized
aaagcttcaatggacaggctgt

SEQ ID NO: 673069 - DNA, 22 bp, Artificial Sequence
  chemically synthesized
ggccctactaagagatacagcc

SEQ ID NO: 673070 - DNA, 22 bp, Artificial Sequence
  chemically synthesized
caatggacaggctgtatctctt

SEQ ID NO: 673071 - DNA, 22 bp, Artificial Sequence
  chemically synthesized
aatggacaggctgtatctctta

SEQ ID NO: 673072 - DNA, 22 bp, Artificial Sequence
  chemically synthesized
cattaggccctactaagagata

SEQ ID NO: 673073 - DNA, 22 bp, Artificial Sequence
  chemically synthesized
gtcaccagctgcattaggccct

SEQ ID NO: 673074 - DNA, 22 bp, Artificial Sequence
  chemically synthesized
tatctcttagtagggcctaatg

SEQ ID NO: 673075 - DNA, 22 bp, Artificial Sequence
  chemically synthesized
agtcaccagctgcattaggccc

SEQ ID NO: 673076 - DNA, 22 bp, Artificial Sequence
  chemically synthesized
aacttagtcaccagctgcatta

SEQ ID NO: 673077 - DNA, 22 bp, Artificial Sequence
  chemically synthesized
ttagtagggcctaatgcagctg

SEQ ID NO: 673078 - DNA, 22 bp, Artificial Sequence
  chemically synthesized
caacttagtcaccagctgcatt

SEQ ID NO: 673079 - DNA, 22 bp, Artificial Sequence
  chemically synthesized
agtagggcctaatgcagctggt

SEQ ID NO: 673080 - DNA, 22 bp, Artificial Sequence
  chemically synthesized
gtagggcctaatgcagctggtg

SEQ ID NO: 673081 - DNA, 22 bp, Artificial Sequence
  chemically synthesized
gcttcaacttagtcaccagctg

SEQ ID NO: 673082 - DNA, 22 bp, Artificial Sequence
  chemically synthesized
atgcagctggtgactaagttga

SEQ ID NO: 673083 - DNA, 22 bp, Artificial Sequence
  chemically synthesized
gtgactaagttgaagccaatgc

SEQ ID NO: 673084 - DNA, 22 bp, Artificial Sequence
  chemically synthesized
agaatggtagatgagcattggc

SEQ ID NO: 673085 - DNA, 22 bp, Artificial Sequence
  chemically synthesized
cagaatggtagatgagcattgg

SEQ ID NO: 673086 - DNA, 22 bp, Artificial Sequence
  chemically synthesized
agttgaagccaatgctcatcta

SEQ ID NO: 673087 - DNA, 22 bp, Artificial Sequence
  chemically synthesized
tgatttcagaatggtagatgag

SEQ ID NO: 673088 - DNA, 22 bp, Artificial Sequence
  chemically synthesized
aagccaatgctcatctaccatt

SEQ ID NO: 673089 - DNA, 22 bp, Artificial Sequence
  chemically synthesized
agggccctgtgatttcagaatg

SEQ ID NO: 673090 - DNA, 22 bp, Artificial Sequence
  chemically synthesized
aagggccctgtgatttcagaat

SEQ ID NO: 673091 - DNA, 22 bp, Artificial Sequence
  chemically synthesized
ttaagggccctgtgatttcaga

SEQ ID NO: 673092 - DNA, 22 bp, Artificial Sequence
  chemically synthesized
atctaccattctgaaatcacag

SEQ ID NO: 673093 - DNA, 22 bp, Artificial Sequence
  chemically synthesized
ccattctgaaatcacagggccc

SEQ ID NO: 673094 - DNA, 22 bp, Artificial Sequence
  chemically synthesized
acataattcttaagggccctgt

SEQ ID NO: 673095 - DNA, 22 bp, Artificial Sequence
  chemically synthesized
cacataattcttaagggccctg

SEQ ID NO: 673096 - DNA, 22 bp, Artificial Sequence
  chemically synthesized
tgaaatcacagggcccttaaga

SEQ ID NO: 673097 - DNA, 22 bp, Artificial Sequence
  chemically synthesized
atttcacataattcttaagggc

SEQ ID NO: 673098 - DNA, 22 bp, Artificial Sequence
  chemically synthesized
aaatcacagggcccttaagaat

SEQ ID NO: 673099 - DNA, 22 bp, Artificial Sequence
  chemically synthesized
tgcccggcctgatttcacataa

SEQ ID NO: 673100 - DNA, 22 bp, Artificial Sequence
  chemically synthesized
aagaattatgtgaaatcaggcc

SEQ ID NO: 673101 - DNA, 22 bp, Artificial Sequence
  chemically synthesized
agaattatgtgaaatcaggccg

SEQ ID NO: 673102 - DNA, 22 bp, Artificial Sequence
  chemically synthesized
tgtgaaatcaggccgggcacag

SEQ ID NO: 673103 - DNA, 22 bp, Artificial Sequence
  chemically synthesized
caggcatgagccactgtgcccg

SEQ ID NO: 673104 - DNA, 22 bp, Artificial Sequence
  chemically synthesized
ggattacaggcatgagccactg

SEQ ID NO: 673105 - DNA, 22 bp, Artificial Sequence
  chemically synthesized
ccaaagtgctgggattacaggc

SEQ ID NO: 673106 - DNA, 22 bp, Artificial Sequence
  chemically synthesized
agcctcccaaagtgctgggatt

SEQ ID NO: 673107 - DNA, 22 bp, Artificial Sequence
  chemically synthesized
atgcctgtaatcccagcacttt

SEQ ID NO: 673108 - DNA, 22 bp, Artificial Sequence
  chemically synthesized
cccgcctcagcctcccaaagtg

SEQ ID NO: 673109 - DNA, 22 bp, Artificial Sequence
  chemically synthesized
taatcccagcactttgggaggc

SEQ ID NO: 673110 - DNA, 22 bp, Artificial Sequence
  chemically synthesized
gtgatctgcccgcctcagcctc

SEQ ID NO: 673111 - DNA, 22 bp, Artificial Sequence
  chemically synthesized
acctcgtgatctgcccgcctca

SEQ ID NO: 673112 - DNA, 22 bp, Artificial Sequence
  chemically synthesized
ctgacctcgtgatctgcccgcc

SEQ ID NO: 673113 - DNA, 22 bp, Artificial Sequence
  chemically synthesized
tgggaggctgaggcgggcagat

SEQ ID NO: 673114 - DNA, 22 bp, Artificial Sequence
  chemically synthesized
gggaggctgaggcgggcagatc

SEQ ID NO: 673115 - DNA, 22 bp, Artificial Sequence
  chemically synthesized
ggaggctgaggcgggcagatca

SEQ ID NO: 673116 - DNA, 22 bp, Artificial Sequence
  chemically synthesized
caactcctgacctcgtgatctg

SEQ ID NO: 673117 - DNA, 22 bp, Artificial Sequence
  chemically synthesized
aggcgggcagatcacgaggtca

SEQ ID NO: 673118 - DNA, 22 bp, Artificial Sequence
  chemically synthesized
gtctccaactcctgacctcgtg

SEQ ID NO: 673119 - DNA, 22 bp, Artificial Sequence
  chemically synthesized
gccaggctggtctccaactcct

SEQ ID NO: 673120 - DNA, 22 bp, Artificial Sequence
  chemically synthesized
accatgttggccaggctggtct

SEQ ID NO: 673121 - DNA, 22 bp, Artificial Sequence
  chemically synthesized
caccatgttggccaggctggtc

SEQ ID NO: 673122 - DNA, 22 bp, Artificial Sequence
  chemically synthesized
gagaccagcctggccaacatgg

SEQ ID NO: 673123 - DNA, 22 bp, Artificial Sequence
  chemically synthesized
gtggagacggggtttcaccatg

SEQ ID NO: 673124 - DNA, 22 bp, Artificial Sequence
  chemically synthesized
agtggagacggggtttcaccat

SEQ ID NO: 673125 - DNA, 22 bp, Artificial Sequence
  chemically synthesized
tagtggagacggggtttcacca

SEQ ID NO: 673126 - DNA, 22 bp, Artificial Sequence
  chemically synthesized
ttagtggagacggggtttcacc

SEQ ID NO: 673127 - DNA, 22 bp, Artificial Sequence
  chemically synthesized
gccaacatggtgaaaccccgtc

SEQ ID NO: 673128 - DNA, 22 bp, Artificial Sequence
  chemically synthesized
tatttttagtggagacggggtt

SEQ ID NO: 673129 - DNA, 22 bp, Artificial Sequence
  chemically synthesized
gtatttttagtggagacggggt

SEQ ID NO: 673130 - DNA, 22 bp, Artificial Sequence
  chemically synthesized
tgtatttttagtggagacgggg

SEQ ID NO: 673131 - DNA, 22 bp, Artificial Sequence
  chemically synthesized
ttgtatttttagtggagacggg

SEQ ID NO: 673132 - DNA, 22 bp, Artificial Sequence
  chemically synthesized
atttttgtatttttagtggaga

SEQ ID NO: 673133 - DNA, 22 bp, Artificial Sequence
  chemically synthesized
gttaatttttgtatttttagtg

SEQ ID NO: 673134 - DNA, 22 bp, Artificial Sequence
  chemically synthesized
cactaaaaatacaaaaattaac

SEQ ID NO: 673135 - DNA, 22 bp, Artificial Sequence
  chemically synthesized
ccaccacacctggttaattttt

SEQ ID NO: 673136 - DNA, 22 bp, Artificial Sequence
  chemically synthesized
aaaatacaaaaattaaccaggt

SEQ ID NO: 673137 - DNA, 22 bp, Artificial Sequence
  chemically synthesized
caggcgtctgccaccacacctg

SEQ ID NO: 673138 - DNA, 22 bp, Artificial Sequence
  chemically synthesized
ggattacaggcgtctgccacca

SEQ ID NO: 673139 - DNA, 22 bp, Artificial Sequence
  chemically synthesized
accaggtgtggtggcagacgcc

SEQ ID NO: 673140 - DNA, 22 bp, Artificial Sequence
  chemically synthesized
agtagctgggattacaggcgtc

SEQ ID NO: 673141 - DNA, 22 bp, Artificial Sequence
  chemically synthesized
ctgagtagctgggattacaggc

SEQ ID NO: 673142 - DNA, 22 bp, Artificial Sequence
  chemically synthesized
agcctcctgagtagctgggatt

SEQ ID NO: 673143 - DNA, 22 bp, Artificial Sequence
  chemically synthesized
cctcagcctcctgagtagctgg

SEQ ID NO: 673144 - DNA, 22 bp, Artificial Sequence
  chemically synthesized
ctgcctcagcctcctgagtagc

SEQ ID NO: 673145 - DNA, 22 bp, Artificial Sequence
  chemically synthesized
tcctgcctcagcctcctgagta

SEQ ID NO: 673146 - DNA, 22 bp, Artificial Sequence
  chemically synthesized
taatcccagctactcaggaggc

SEQ ID NO: 673147 - DNA, 22 bp, Artificial Sequence
  chemically synthesized
aagcaattctcctgcctcagcc

SEQ ID NO: 673148 - DNA, 22 bp, Artificial Sequence
  chemically synthesized
ctcaggaggctgaggcaggaga

SEQ ID NO: 673149 - DNA, 22 bp, Artificial Sequence
  chemically synthesized
aggaggctgaggcaggagaatt

SEQ ID NO: 673150 - DNA, 22 bp, Artificial Sequence
  chemically synthesized
ccgggttcaagcaattctcctg

SEQ ID NO: 673151 - DNA, 22 bp, Artificial Sequence
  chemically synthesized
cacctcccgggttcaagcaatt

SEQ ID NO: 673152 - DNA, 22 bp, Artificial Sequence
  chemically synthesized
aggcaggagaattgcttgaacc

SEQ ID NO: 673153 - DNA, 22 bp, Artificial Sequence
  chemically synthesized
caacctccacctcccgggttca

SEQ ID NO: 673154 - DNA, 22 bp, Artificial Sequence
  chemically synthesized
actgcaacctccacctcccggg

SEQ ID NO: 673155 - DNA, 22 bp, Artificial Sequence
  chemically synthesized
gctcactgcaacctccacctcc

SEQ ID NO: 673156 - DNA, 22 bp, Artificial Sequence
  chemically synthesized
ggctcactgcaacctccacctc

SEQ ID NO: 673157 - DNA, 22 bp, Artificial Sequence
  chemically synthesized
cttgaacccgggaggtggaggt

SEQ ID NO: 673158 - DNA, 22 bp, Artificial Sequence
  chemically synthesized
gaacccgggaggtggaggttgc

SEQ ID NO: 673159 - DNA, 22 bp, Artificial Sequence
  chemically synthesized
aacccgggaggtggaggttgca

SEQ ID NO: 673160 - DNA, 22 bp, Artificial Sequence
  chemically synthesized
gagtgcagtggtacgatcttgg

SEQ ID NO: 673161 - DNA, 22 bp, Artificial Sequence
  chemically synthesized
cagtgagccaagatcgtaccac

SEQ ID NO: 673162 - DNA, 22 bp, Artificial Sequence
  chemically synthesized
tcacccaggctggagtgcagtg

SEQ ID NO: 673163 - DNA, 22 bp, Artificial Sequence
  chemically synthesized
tgtcacccaggctggagtgcag

SEQ ID NO: 673164 - DNA, 22 bp, Artificial Sequence
  chemically synthesized
ctctgtcacccaggctggagtg

SEQ ID NO: 673165 - DNA, 22 bp, Artificial Sequence
  chemically synthesized
gctctgtcacccaggctggagt

SEQ ID NO: 673166 - DNA, 22 bp, Artificial Sequence
  chemically synthesized
cactccagcctgggtgacagag

SEQ ID NO: 673167 - DNA, 22 bp, Artificial Sequence
  chemically synthesized
caagacggagtcttgctctgtc

SEQ ID NO: 673168 - DNA, 22 bp, Artificial Sequence
  chemically synthesized
ccaagacggagtcttgctctgt

SEQ ID NO: 673169 - DNA, 22 bp, Artificial Sequence
  chemically synthesized
cagcctgggtgacagagcaaga

SEQ ID NO: 673170 - DNA, 22 bp, Artificial Sequence
  chemically synthesized
cttccaagacggagtcttgctc

SEQ ID NO: 673171 - DNA, 22 bp, Artificial Sequence
  chemically synthesized
ccttccaagacggagtcttgct

SEQ ID NO: 673172 - DNA, 22 bp, Artificial Sequence
  chemically synthesized
tccttccaagacggagtcttgc

SEQ ID NO: 673173 - DNA, 22 bp, Artificial Sequence
  chemically synthesized
ttccttccaagacggagtcttg

SEQ ID NO: 673174 - DNA, 22 bp, Artificial Sequence
  chemically synthesized
tttccttccaagacggagtctt

SEQ ID NO: 673175 - DNA, 22 bp, Artificial Sequence
  chemically synthesized
ggtgacagagcaagactccgtc

SEQ ID NO: 673176 - DNA, 22 bp, Artificial Sequence
  chemically synthesized
ttttccttccaagacggagtct

SEQ ID NO: 673177 - DNA, 22 bp, Artificial Sequence
  chemically synthesized
tttttccttccaagacggagtc

SEQ ID NO: 673178 - DNA, 22 bp, Artificial Sequence
  chemically synthesized
ttttttccttccaagacggagt

SEQ ID NO: 673179 - DNA, 22 bp, Artificial Sequence
  chemically synthesized
tttttttccttccaagacggag

SEQ ID NO: 673180 - DNA, 22 bp, Artificial Sequence
  chemically synthesized
ttttttttccttccaagacgga

SEQ ID NO: 673181 - DNA, 22 bp, Artificial Sequence
  chemically synthesized
tttttttttccttccaagacgg

SEQ ID NO: 673182 - DNA, 22 bp, Artificial Sequence
  chemically synthesized
ttttttttttccttccaagacg

SEQ ID NO: 673183 - DNA, 22 bp, Artificial Sequence
  chemically synthesized
cttttttttttttccttccaag

SEQ ID NO: 673184 - DNA, 22 bp, Artificial Sequence
  chemically synthesized
cgtcttggaaggaaaaaaaaaa

SEQ ID NO: 673185 - DNA, 22 bp, Artificial Sequence
  chemically synthesized
acataattcctttttttttttt

SEQ ID NO: 673186 - DNA, 22 bp, Artificial Sequence
  chemically synthesized
cacataattccttttttttttt

SEQ ID NO: 673187 - DNA, 22 bp, Artificial Sequence
  chemically synthesized
ggaaggaaaaaaaaaaaaggaa

SEQ ID NO: 673188 - DNA, 22 bp, Artificial Sequence
  chemically synthesized
gaaggaaaaaaaaaaaaggaat

SEQ ID NO: 673189 - DNA, 22 bp, Artificial Sequence
  chemically synthesized
tacagcacaggcaaagtagatt

SEQ ID NO: 673190 - DNA, 22 bp, Artificial Sequence
  chemically synthesized
atacagcacaggcaaagtagat

SEQ ID NO: 673191 - DNA, 22 bp, Artificial Sequence
  chemically synthesized
catttatacagcacaggcaaag

SEQ ID NO: 673192 - DNA, 22 bp, Artificial Sequence
  chemically synthesized
tgtgaaatctactttgcctgtg

SEQ ID NO: 673193 - DNA, 22 bp, Artificial Sequence
  chemically synthesized
ccatttatacagcacaggcaaa

SEQ ID NO: 673194 - DNA, 22 bp, Artificial Sequence
  chemically synthesized
tccatttatacagcacaggcaa

SEQ ID NO: 673195 - DNA, 22 bp, Artificial Sequence
  chemically synthesized
ttccatttatacagcacaggca

SEQ ID NO: 673196 - DNA, 22 bp, Artificial Sequence
  chemically synthesized
tttttccatttatacagcacag

SEQ ID NO: 673197 - DNA, 22 bp, Artificial Sequence
  chemically synthesized
gtttttccatttatacagcaca

SEQ ID NO: 673198 - DNA, 22 bp, Artificial Sequence
  chemically synthesized
tgtttttccatttatacagcac

SEQ ID NO: 673199 - DNA, 22 bp, Artificial Sequence
  chemically synthesized
ctttgcctgtgctgtataaatg

SEQ ID NO: 673200 - DNA, 22 bp, Artificial Sequence
  chemically synthesized
tgcctgtgctgtataaatggaa

SEQ ID NO: 673201 - DNA, 22 bp, Artificial Sequence
  chemically synthesized
gcctgtgctgtataaatggaaa

SEQ ID NO: 673202 - DNA, 22 bp, Artificial Sequence
  chemically synthesized
cctgtgctgtataaatggaaaa

SEQ ID NO: 673203 - DNA, 22 bp, Artificial Sequence
  chemically synthesized
tcatccaagctttgtttttcca

SEQ ID NO: 673204 - DNA, 22 bp, Artificial Sequence
  chemically synthesized
tgctgtataaatggaaaaacaa

SEQ ID NO: 673205 - DNA, 22 bp, Artificial Sequence
  chemically synthesized
tataaatggaaaaacaaagctt

SEQ ID NO: 673206 - DNA, 22 bp, Artificial Sequence
  chemically synthesized
ggatgacagcgtatctgtttac

SEQ ID NO: 673207 - DNA, 22 bp, Artificial Sequence
  chemically synthesized
gatgacagcgtatctgtttacg

SEQ ID NO: 673208 - DNA, 22 bp, Artificial Sequence
  chemically synthesized
agtaaaccatgccgtaaacaga

SEQ ID NO: 673209 - DNA, 22 bp, Artificial Sequence
  chemically synthesized
aaatattcagtaaaccatgccg

SEQ ID NO: 673210 - DNA, 22 bp, Artificial Sequence
  chemically synthesized
gaaatattcagtaaaccatgcc

SEQ ID NO: 673211 - DNA, 22 bp, Artificial Sequence
  chemically synthesized
tttacggcatggtttactgaat

SEQ ID NO: 673212 - DNA, 22 bp, Artificial Sequence
  chemically synthesized
acggcatggtttactgaatatt

SEQ ID NO: 673213 - DNA, 22 bp, Artificial Sequence
  chemically synthesized
cagtgagcttgaaatattcagt

SEQ ID NO: 673214 - DNA, 22 bp, Artificial Sequence
  chemically synthesized
cggcatggtttactgaatattt

SEQ ID NO: 673215 - DNA, 22 bp, Artificial Sequence
  chemically synthesized
acagtgagcttgaaatattcag

SEQ ID NO: 673216 - DNA, 22 bp, Artificial Sequence
  chemically synthesized
ggtcttacagtgagcttgaaat

SEQ ID NO: 673217 - DNA, 22 bp, Artificial Sequence
  chemically synthesized
actgaatatttcaagctcactg

SEQ ID NO: 673218 - DNA, 22 bp, Artificial Sequence
  chemically synthesized
ctgaatatttcaagctcactgt

SEQ ID NO: 673219 - DNA, 22 bp, Artificial Sequence
  chemically synthesized
aacactaggtcttacagtgagc

SEQ ID NO: 673220 - DNA, 22 bp, Artificial Sequence
  chemically synthesized
gaacactaggtcttacagtgag

SEQ ID NO: 673221 - DNA, 22 bp, Artificial Sequence
  chemically synthesized
aatatttcaagctcactgtaag

SEQ ID NO: 673222 - DNA, 22 bp, Artificial Sequence
  chemically synthesized
tgaacactaggtcttacagtga

SEQ ID NO: 673223 - DNA, 22 bp, Artificial Sequence
  chemically synthesized
ttttgaacactaggtcttacag

SEQ ID NO: 673224 - DNA, 22 bp, Artificial Sequence
  chemically synthesized
caagctcactgtaagacctagt

SEQ ID NO: 673225 - DNA, 22 bp, Artificial Sequence
  chemically synthesized
aagctcactgtaagacctagtg

SEQ ID NO: 673226 - DNA, 22 bp, Artificial Sequence
  chemically synthesized
actgtaagacctagtgttcaaa

SEQ ID NO: 673227 - DNA, 22 bp, Artificial Sequence
  chemically synthesized
aaaggaaacctattttgaacac

SEQ ID NO: 673228 - DNA, 22 bp, Artificial Sequence
  chemically synthesized
gaaaggaaacctattttgaaca

SEQ ID NO: 673229 - DNA, 22 bp, Artificial Sequence
  chemically synthesized
tgaaaggaaacctattttgaac

SEQ ID NO: 673230 - DNA, 22 bp, Artificial Sequence
  chemically synthesized
taagacctagtgttcaaaatag

SEQ ID NO: 673231 - DNA, 22 bp, Artificial Sequence
  chemically synthesized
tattttgaaaggaaacctattt

SEQ ID NO: 673232 - DNA, 22 bp, Artificial Sequence
  chemically synthesized
gtgttcaaaataggtttccttt

SEQ ID NO: 673233 - DNA, 22 bp, Artificial Sequence
  chemically synthesized
aaaataggtttcctttcaaaat

SEQ ID NO: 673234 - DNA, 22 bp, Artificial Sequence
  chemically synthesized
tcagtgagcagttatattttga

SEQ ID NO: 673235 - DNA, 22 bp, Artificial Sequence
  chemically synthesized
cctttcaaaatataactgctca

SEQ ID NO: 673236 - DNA, 22 bp, Artificial Sequence
  chemically synthesized
ctttcaaaatataactgctcac

SEQ ID NO: 673237 - DNA, 22 bp, Artificial Sequence
  chemically synthesized
tcaaaatataactgctcactga

SEQ ID NO: 673238 - DNA, 22 bp, Artificial Sequence
  chemically synthesized
caaaatataactgctcactgac

SEQ ID NO: 673239 - DNA, 22 bp, Artificial Sequence
  chemically synthesized
aaaatataactgctcactgaca

SEQ ID NO: 673240 - DNA, 22 bp, Artificial Sequence
  chemically synthesized
ggtgacaaggtgcattgtcagt

SEQ ID NO: 673241 - DNA, 22 bp, Artificial Sequence
  chemically synthesized
gggtgacaaggtgcattgtcag

SEQ ID NO: 673242 - DNA, 22 bp, Artificial Sequence
  chemically synthesized
tgggtgacaaggtgcattgtca

SEQ ID NO: 673243 - DNA, 22 bp, Artificial Sequence
  chemically synthesized
ttgggtgacaaggtgcattgtc

SEQ ID NO: 673244 - DNA, 22 bp, Artificial Sequence
  chemically synthesized
ctcactgacaatgcaccttgtc

SEQ ID NO: 673245 - DNA, 22 bp, Artificial Sequence
  chemically synthesized
actgacaatgcaccttgtcacc

SEQ ID NO: 673246 - DNA, 22 bp, Artificial Sequence
  chemically synthesized
catccaagcttttgggtgacaa

SEQ ID NO: 673247 - DNA, 22 bp, Artificial Sequence
  chemically synthesized
acaatgcaccttgtcacccaaa

SEQ ID NO: 673248 - DNA, 22 bp, Artificial Sequence
  chemically synthesized
tacatctccatccaagcttttg

SEQ ID NO: 673249 - DNA, 22 bp, Artificial Sequence
  chemically synthesized
gtacatctccatccaagctttt

SEQ ID NO: 673250 - DNA, 22 bp, Artificial Sequence
  chemically synthesized
tgtacatctccatccaagcttt

SEQ ID NO: 673251 - DNA, 22 bp, Artificial Sequence
  chemically synthesized
tttgtacatctccatccaagct

SEQ ID NO: 673252 - DNA, 22 bp, Artificial Sequence
  chemically synthesized
gtcacccaaaagcttggatgga

SEQ ID NO: 673253 - DNA, 22 bp, Artificial Sequence
  chemically synthesized
tcacccaaaagcttggatggag

SEQ ID NO: 673254 - DNA, 22 bp, Artificial Sequence
  chemically synthesized
ggatggagatgtacaaagagat

SEQ ID NO: 673255 - DNA, 22 bp, Artificial Sequence
  chemically synthesized
gatggagatgtacaaagagatt

SEQ ID NO: 673256 - DNA, 22 bp, Artificial Sequence
  chemically synthesized
tgtaagcgggcatgaaaacgtg

SEQ ID NO: 673257 - DNA, 22 bp, Artificial Sequence
  chemically synthesized
acgttttcatgcccgcttacac

SEQ ID NO: 673258 - DNA, 22 bp, Artificial Sequence
  chemically synthesized
cagaatggatgttgtgtaagcg

SEQ ID NO: 673259 - DNA, 22 bp, Artificial Sequence
  chemically synthesized
tcatgcccgcttacacaacatc

SEQ ID NO: 673260 - DNA, 22 bp, Artificial Sequence
  chemically synthesized
ggctacagaatggatgttgtgt

SEQ ID NO: 673261 - DNA, 22 bp, Artificial Sequence
  chemically synthesized
catgcccgcttacacaacatcc

SEQ ID NO: 673262 - DNA, 22 bp, Artificial Sequence
  chemically synthesized
gggctacagaatggatgttgtg

SEQ ID NO: 673263 - DNA, 22 bp, Artificial Sequence
  chemically synthesized
atgcccgcttacacaacatcca

SEQ ID NO: 673264 - DNA, 22 bp, Artificial Sequence
  chemically synthesized
atccttgggctacagaatggat

SEQ ID NO: 673265 - DNA, 22 bp, Artificial Sequence
  chemically synthesized
aatccttgggctacagaatgga

SEQ ID NO: 673266 - DNA, 22 bp, Artificial Sequence
  chemically synthesized
ttaatccttgggctacagaatg

SEQ ID NO: 673267 - DNA, 22 bp, Artificial Sequence
  chemically synthesized
cttaatccttgggctacagaat

SEQ ID NO: 673268 - DNA, 22 bp, Artificial Sequence
  chemically synthesized
acacaacatccattctgtagcc

SEQ ID NO: 673269 - DNA, 22 bp, Artificial Sequence
  chemically synthesized
tcttaatccttgggctacagaa

SEQ ID NO: 673270 - DNA, 22 bp, Artificial Sequence
  chemically synthesized
cacaacatccattctgtagccc

SEQ ID NO: 673271 - DNA, 22 bp, Artificial Sequence
  chemically synthesized
ttcttaatccttgggctacaga

SEQ ID NO: 673272 - DNA, 22 bp, Artificial Sequence
  chemically synthesized
tttcttaatccttgggctacag

SEQ ID NO: 673273 - DNA, 22 bp, Artificial Sequence
  chemically synthesized
tgtagcccaaggattaagaaaa

SEQ ID NO: 673274 - DNA, 22 bp, Artificial Sequence
  chemically synthesized
aaagtcacaattttttcttaat

SEQ ID NO: 673275 - DNA, 22 bp, Artificial Sequence
  chemically synthesized
tagcccaaggattaagaaaaaa

SEQ ID NO: 673276 - DNA, 22 bp, Artificial Sequence
  chemically synthesized
ataagagttgaaagtcacaatt

SEQ ID NO: 673277 - DNA, 22 bp, Artificial Sequence
  chemically synthesized
aactaataagagttgaaagtca

SEQ ID NO: 673278 - DNA, 22 bp, Artificial Sequence
  chemically synthesized
agaaaaaattgtgactttcaac

SEQ ID NO: 673279 - DNA, 22 bp, Artificial Sequence
  chemically synthesized
tcaactaataagagttgaaagt

SEQ ID NO: 673280 - DNA, 22 bp, Artificial Sequence
  chemically synthesized
ctcaactaataagagttgaaag

SEQ ID NO: 673281 - DNA, 22 bp, Artificial Sequence
  chemically synthesized
tgactttcaactcttattagtt

SEQ ID NO: 673282 - DNA, 22 bp, Artificial Sequence
  chemically synthesized
caaaatatttctcaactaataa

SEQ ID NO: 673283 - DNA, 22 bp, Artificial Sequence
  chemically synthesized
acaaaatatttctcaactaata

SEQ ID NO: 673284 - DNA, 22 bp, Artificial Sequence
  chemically synthesized
tcaactcttattagttgagaaa

SEQ ID NO: 673285 - DNA, 22 bp, Artificial Sequence
  chemically synthesized
caactcttattagttgagaaat

SEQ ID NO: 673286 - DNA, 22 bp, Artificial Sequence
  chemically synthesized
aactcttattagttgagaaata

SEQ ID NO: 673287 - DNA, 22 bp, Artificial Sequence
  chemically synthesized
tagccttacaaaatatttctca

SEQ ID NO: 673288 - DNA, 22 bp, Artificial Sequence
  chemically synthesized
ttattagttgagaaatattttg

SEQ ID NO: 673289 - DNA, 22 bp, Artificial Sequence
  chemically synthesized
attagttgagaaatattttgta

SEQ ID NO: 673290 - DNA, 22 bp, Artificial Sequence
  chemically synthesized
ttagttgagaaatattttgtaa

SEQ ID NO: 673291 - DNA, 22 bp, Artificial Sequence
  chemically synthesized
gttgagaaatattttgtaaggc

SEQ ID NO: 673292 - DNA, 22 bp, Artificial Sequence
  chemically synthesized
tgtcaagctatagccttacaaa

SEQ ID NO: 673293 - DNA, 22 bp, Artificial Sequence
  chemically synthesized
agaaatattttgtaaggctata

SEQ ID NO: 673294 - DNA, 22 bp, Artificial Sequence
  chemically synthesized
tctatgtcaagctatagcctta

SEQ ID NO: 673295 - DNA, 22 bp, Artificial Sequence
  chemically synthesized
tgtaaggctatagcttgacata

SEQ ID NO: 673296 - DNA, 22 bp, Artificial Sequence
  chemically synthesized
gtaaggctatagcttgacatag

SEQ ID NO: 673297 - DNA, 22 bp, Artificial Sequence
  chemically synthesized
taaggctatagcttgacataga

SEQ ID NO: 673298 - DNA, 22 bp, Artificial Sequence
  chemically synthesized
tagcttgacatagacagtgatt

SEQ ID NO: 673299 - DNA, 22 bp, Artificial Sequence
  chemically synthesized
cccagatccatcagaggaatca

SEQ ID NO: 673300 - DNA, 22 bp, Artificial Sequence
  chemically synthesized
gacatagacagtgattcctctg

SEQ ID NO: 673301 - DNA, 22 bp, Artificial Sequence
  chemically synthesized
gcccagatccatcagaggaatc

SEQ ID NO: 673302 - DNA, 22 bp, Artificial Sequence
  chemically synthesized
acatagacagtgattcctctga

SEQ ID NO: 673303 - DNA, 22 bp, Artificial Sequence
  chemically synthesized
tgcccagatccatcagaggaat

SEQ ID NO: 673304 - DNA, 22 bp, Artificial Sequence
  chemically synthesized
ctttgcccagatccatcagagg

SEQ ID NO: 673305 - DNA, 22 bp, Artificial Sequence
  chemically synthesized
actttgcccagatccatcagag

SEQ ID NO: 673306 - DNA, 22 bp, Artificial Sequence
  chemically synthesized
catttactttgcccagatccat

SEQ ID NO: 673307 - DNA, 22 bp, Artificial Sequence
  chemically synthesized
ccatttactttgcccagatcca

SEQ ID NO: 673308 - DNA, 22 bp, Artificial Sequence
  chemically synthesized
tccatttactttgcccagatcc

SEQ ID NO: 673309 - DNA, 22 bp, Artificial Sequence
  chemically synthesized
ctctgatggatctgggcaaagt

SEQ ID NO: 673310 - DNA, 22 bp, Artificial Sequence
  chemically synthesized
tgatggatctgggcaaagtaaa

SEQ ID NO: 673311 - DNA, 22 bp, Artificial Sequence
  chemically synthesized
cagagattttccatttactttg

SEQ ID NO: 673312 - DNA, 22 bp, Artificial Sequence
  chemically synthesized
atggatctgggcaaagtaaatg

SEQ ID NO: 673313 - DNA, 22 bp, Artificial Sequence
  chemically synthesized
ccagagattttccatttacttt

SEQ ID NO: 673314 - DNA, 22 bp, Artificial Sequence
  chemically synthesized
acttccagagattttccattta

SEQ ID NO: 673315 - DNA, 22 bp, Artificial Sequence
  chemically synthesized
ggcaaagtaaatggaaaatctc

SEQ ID NO: 673316 - DNA, 22 bp, Artificial Sequence
  chemically synthesized
cagccgtgagccaccacacctg

SEQ ID NO: 673317 - DNA, 22 bp, Artificial Sequence
  chemically synthesized
tggaagtcaggtgtggtggctc

SEQ ID NO: 673318 - DNA, 22 bp, Artificial Sequence
  chemically synthesized
ggattacagccgtgagccacca

SEQ ID NO: 673319 - DNA, 22 bp, Artificial Sequence
  chemically synthesized
gaagtcaggtgtggtggctcac

SEQ ID NO: 673320 - DNA, 22 bp, Artificial Sequence
  chemically synthesized
ccaaagtgctgggattacagcc

SEQ ID NO: 673321 - DNA, 22 bp, Artificial Sequence
  chemically synthesized
ggcctcccaaagtgctgggatt

SEQ ID NO: 673322 - DNA, 22 bp, Artificial Sequence
  chemically synthesized
acggctgtaatcccagcacttt

SEQ ID NO: 673323 - DNA, 22 bp, Artificial Sequence
  chemically synthesized
cctcggcctcccaaagtgctgg

SEQ ID NO: 673324 - DNA, 22 bp, Artificial Sequence
  chemically synthesized
taatcccagcactttgggaggc

SEQ ID NO: 673325 - DNA, 22 bp, Artificial Sequence
  chemically synthesized
atgatccacctgcctcggcctc

SEQ ID NO: 673326 - DNA, 22 bp, Artificial Sequence
  chemically synthesized
acctcatgatccacctgcctcg

SEQ ID NO: 673327 - DNA, 22 bp, Artificial Sequence
  chemically synthesized
ctgacctcatgatccacctgcc

SEQ ID NO: 673328 - DNA, 22 bp, Artificial Sequence
  chemically synthesized
tgggaggccgaggcaggtggat

SEQ ID NO: 673329 - DNA, 22 bp, Artificial Sequence
  chemically synthesized
gggaggccgaggcaggtggatc

SEQ ID NO: 673330 - DNA, 22 bp, Artificial Sequence
  chemically synthesized
ggaggccgaggcaggtggatca

SEQ ID NO: 673331 - DNA, 22 bp, Artificial Sequence
  chemically synthesized
aaactcctgacctcatgatcca

SEQ ID NO: 673332 - DNA, 22 bp, Artificial Sequence
  chemically synthesized
gtctcaaactcctgacctcatg

SEQ ID NO: 673333 - DNA, 22 bp, Artificial Sequence
  chemically synthesized
gccaggctggtctcaaactcct

SEQ ID NO: 673334 - DNA, 22 bp, Artificial Sequence
  chemically synthesized
ggccaggctggtctcaaactcc

SEQ ID NO: 673335 - DNA, 22 bp, Artificial Sequence
  chemically synthesized
tggccaggctggtctcaaactc

SEQ ID NO: 673336 - DNA, 22 bp, Artificial Sequence
  chemically synthesized
accattttggccaggctggtct

SEQ ID NO: 673337 - DNA, 22 bp, Artificial Sequence
  chemically synthesized
caccattttggccaggctggtc

SEQ ID NO: 673338 - DNA, 22 bp, Artificial Sequence
  chemically synthesized
gagaccagcctggccaaaatgg

SEQ ID NO: 673339 - DNA, 22 bp, Artificial Sequence
  chemically synthesized
agaccagcctggccaaaatggt

SEQ ID NO: 673340 - DNA, 22 bp, Artificial Sequence
  chemically synthesized
gtagagacggggtttcaccatt

SEQ ID NO: 673341 - DNA, 22 bp, Artificial Sequence
  chemically synthesized
agtagagacggggtttcaccat

SEQ ID NO: 673342 - DNA, 22 bp, Artificial Sequence
  chemically synthesized
tagtagagacggggtttcacca

SEQ ID NO: 673343 - DNA, 22 bp, Artificial Sequence
  chemically synthesized
ttagtagagacggggtttcacc

SEQ ID NO: 673344 - DNA, 22 bp, Artificial Sequence
  chemically synthesized
gccaaaatggtgaaaccccgtc

SEQ ID NO: 673345 - DNA, 22 bp, Artificial Sequence
  chemically synthesized
tatttttagtagagacggggtt

SEQ ID NO: 673346 - DNA, 22 bp, Artificial Sequence
  chemically synthesized
gtatttttagtagagacggggt

SEQ ID NO: 673347 - DNA, 22 bp, Artificial Sequence
  chemically synthesized
tgtatttttagtagagacgggg

SEQ ID NO: 673348 - DNA, 22 bp, Artificial Sequence
  chemically synthesized
ttgtatttttagtagagacggg

SEQ ID NO: 673349 - DNA, 22 bp, Artificial Sequence
  chemically synthesized
atttttgtatttttagtagaga

SEQ ID NO: 673350 - DNA, 22 bp, Artificial Sequence
  chemically synthesized
cgcccggctaatttttgtattt

SEQ ID NO: 673351 - DNA, 22 bp, Artificial Sequence
  chemically synthesized
tactaaaaatacaaaaattagc

SEQ ID NO: 673352 - DNA, 22 bp, Artificial Sequence
  chemically synthesized
ctaaaaatacaaaaattagccg

SEQ ID NO: 673353 - DNA, 22 bp, Artificial Sequence
  chemically synthesized
aaaatacaaaaattagccgggc

SEQ ID NO: 673354 - DNA, 22 bp, Artificial Sequence
  chemically synthesized
caggcgtgtgccactacgcccg

SEQ ID NO: 673355 - DNA, 22 bp, Artificial Sequence
  chemically synthesized
ggactacaggcgtgtgccacta

SEQ ID NO: 673356 - DNA, 22 bp, Artificial Sequence
  chemically synthesized
gccgggcgtagtggcacacgcc

SEQ ID NO: 673357 - DNA, 22 bp, Artificial Sequence
  chemically synthesized
ccgagtagctgggactacaggc

SEQ ID NO: 673358 - DNA, 22 bp, Artificial Sequence
  chemically synthesized
cccgagtagctgggactacagg

SEQ ID NO: 673359 - DNA, 22 bp, Artificial Sequence
  chemically synthesized
agcttcccgagtagctgggact

SEQ ID NO: 673360 - DNA, 22 bp, Artificial Sequence
  chemically synthesized
cctcagcttcccgagtagctgg

SEQ ID NO: 673361 - DNA, 22 bp, Artificial Sequence
  chemically synthesized
tgcctcagcttcccgagtagct

SEQ ID NO: 673362 - DNA, 22 bp, Artificial Sequence
  chemically synthesized
ctgcctcagcttcccgagtagc

SEQ ID NO: 673363 - DNA, 22 bp, Artificial Sequence
  chemically synthesized
ttctgcctcagcttcccgagta

SEQ ID NO: 673364 - DNA, 22 bp, Artificial Sequence
  chemically synthesized
tagtcccagctactcgggaagc

SEQ ID NO: 673365 - DNA, 22 bp, Artificial Sequence
  chemically synthesized
aagtgattcttctgcctcagct

SEQ ID NO: 673366 - DNA, 22 bp, Artificial Sequence
  chemically synthesized
ctcgggaagctgaggcagaaga

SEQ ID NO: 673367 - DNA, 22 bp, Artificial Sequence
  chemically synthesized
ggttcaagtgattcttctgcct

SEQ ID NO: 673368 - DNA, 22 bp, Artificial Sequence
  chemically synthesized
gggaagctgaggcagaagaatc

SEQ ID NO: 673369 - DNA, 22 bp, Artificial Sequence
  chemically synthesized
ctgggttcaagtgattcttctg

SEQ ID NO: 673370 - DNA, 22 bp, Artificial Sequence
  chemically synthesized
cctgggttcaagtgattcttct

SEQ ID NO: 673371 - DNA, 22 bp, Artificial Sequence
  chemically synthesized
ccttcctgggttcaagtgattc

SEQ ID NO: 673372 - DNA, 22 bp, Artificial Sequence
  chemically synthesized
tgccttcctgggttcaagtgat

SEQ ID NO: 673373 - DNA, 22 bp, Artificial Sequence
  chemically synthesized
aggcagaagaatcacttgaacc

SEQ ID NO: 673374 - DNA, 22 bp, Artificial Sequence
  chemically synthesized
caacctctgccttcctgggttc

SEQ ID NO: 673375 - DNA, 22 bp, Artificial Sequence
  chemically synthesized
actgcaacctctgccttcctgg

SEQ ID NO: 673376 - DNA, 22 bp, Artificial Sequence
  chemically synthesized
ggctcactgcaacctctgcctt

SEQ ID NO: 673377 - DNA, 22 bp, Artificial Sequence
  chemically synthesized
gaacccaggaaggcagaggttg

SEQ ID NO: 673378 - DNA, 22 bp, Artificial Sequence
  chemically synthesized
aacccaggaaggcagaggttgc

SEQ ID NO: 673379 - DNA, 22 bp, Artificial Sequence
  chemically synthesized
gagtgcagtggcgtgatctagg

SEQ ID NO: 673380 - DNA, 22 bp, Artificial Sequence
  chemically synthesized
cagtgagcctagatcacgccac

SEQ ID NO: 673381 - DNA, 22 bp, Artificial Sequence
  chemically synthesized
tccaggctggagtgcagtggcg

SEQ ID NO: 673382 - DNA, 22 bp, Artificial Sequence
  chemically synthesized
tgttgtccaggctggagtgcag

SEQ ID NO: 673383 - DNA, 22 bp, Artificial Sequence
  chemically synthesized
gatcacgccactgcactccagc

SEQ ID NO: 673384 - DNA, 22 bp, Artificial Sequence
  chemically synthesized
ctatgttgtccaggctggagtg

SEQ ID NO: 673385 - DNA, 22 bp, Artificial Sequence
  chemically synthesized
gctatgttgtccaggctggagt

SEQ ID NO: 673386 - DNA, 22 bp, Artificial Sequence
  chemically synthesized
cactccagcctggacaacatag

SEQ ID NO: 673387 - DNA, 22 bp, Artificial Sequence
  chemically synthesized
agacacagtcttgctatgttgt

SEQ ID NO: 673388 - DNA, 22 bp, Artificial Sequence
  chemically synthesized
gagacacagtcttgctatgttg

SEQ ID NO: 673389 - DNA, 22 bp, Artificial Sequence
  chemically synthesized
tgagacacagtcttgctatgtt

SEQ ID NO: 673390 - DNA, 22 bp, Artificial Sequence
  chemically synthesized
ttgagacacagtcttgctatgt

SEQ ID NO: 673391 - DNA, 22 bp, Artificial Sequence
  chemically synthesized
cagcctggacaacatagcaaga

SEQ ID NO: 673392 - DNA, 22 bp, Artificial Sequence
  chemically synthesized
tttgagacacagtcttgctatg

SEQ ID NO: 673393 - DNA, 22 bp, Artificial Sequence
  chemically synthesized
ttttgagacacagtcttgctat

SEQ ID NO: 673394 - DNA, 22 bp, Artificial Sequence
  chemically synthesized
tttttgagacacagtcttgcta

SEQ ID NO: 673395 - DNA, 22 bp, Artificial Sequence
  chemically synthesized
ttttttgagacacagtcttgct

SEQ ID NO: 673396 - DNA, 22 bp, Artificial Sequence
  chemically synthesized
tttttttgagacacagtcttgc

SEQ ID NO: 673397 - DNA, 22 bp, Artificial Sequence
  chemically synthesized
ttttttttgagacacagtcttg

SEQ ID NO: 673398 - DNA, 22 bp, Artificial Sequence
  chemically synthesized
tttttttttgagacacagtctt

SEQ ID NO: 673399 - DNA, 22 bp, Artificial Sequence
  chemically synthesized
gacaacatagcaagactgtgtc

SEQ ID NO: 673400 - DNA, 22 bp, Artificial Sequence
  chemically synthesized
ttttttttttgagacacagtct

SEQ ID NO: 673401 - DNA, 22 bp, Artificial Sequence
  chemically synthesized
tttttttttttgagacacagtc

SEQ ID NO: 673402 - DNA, 22 bp, Artificial Sequence
  chemically synthesized
ttttttttttttgagacacagt

SEQ ID NO: 673403 - DNA, 22 bp, Artificial Sequence
  chemically synthesized
tttttttttttttgagacacag

SEQ ID NO: 673404 - DNA, 22 bp, Artificial Sequence
  chemically synthesized
ttttttttttttttgagacaca

SEQ ID NO: 673405 - DNA, 22 bp, Artificial Sequence
  chemically synthesized
tttttttttttttttgagacac

SEQ ID NO: 673406 - DNA, 22 bp, Artificial Sequence
  chemically synthesized
ttttttttttttttttgagaca

SEQ ID NO: 673407 - DNA, 22 bp, Artificial Sequence
  chemically synthesized
tttttttttttttttttgagac

SEQ ID NO: 673408 - DNA, 22 bp, Artificial Sequence
  chemically synthesized
cagagatttttttttttttttt

SEQ ID NO: 673409 - DNA, 22 bp, Artificial Sequence
  chemically synthesized
ccagagattttttttttttttt

SEQ ID NO: 673410 - DNA, 22 bp, Artificial Sequence
  chemically synthesized
tgtctcaaaaaaaaaaaaaaaa

SEQ ID NO: 673411 - DNA, 22 bp, Artificial Sequence
  chemically synthesized
aaaaaaaaaaaaaaaaaaaatc

SEQ ID NO: 673412 - DNA, 22 bp, Artificial Sequence
  chemically synthesized
atggcatcaagaatcacttcca

SEQ ID NO: 673413 - DNA, 22 bp, Artificial Sequence
  chemically synthesized
aatggcatcaagaatcacttcc

SEQ ID NO: 673414 - DNA, 22 bp, Artificial Sequence
  chemically synthesized
ttaatggcatcaagaatcactt

SEQ ID NO: 673415 - DNA, 22 bp, Artificial Sequence
  chemically synthesized
tggaagtgattcttgatgccat

SEQ ID NO: 673416 - DNA, 22 bp, Artificial Sequence
  chemically synthesized
gaagtgattcttgatgccatta

SEQ ID NO: 673417 - DNA, 22 bp, Artificial Sequence
  chemically synthesized
tcaatcacaaatgttcttaatg

SEQ ID NO: 673418 - DNA, 22 bp, Artificial Sequence
  chemically synthesized
ctatcaatcacaaatgttctta

SEQ ID NO: 673419 - DNA, 22 bp, Artificial Sequence
  chemically synthesized
ttgatgccattaagaacatttg

SEQ ID NO: 673420 - DNA, 22 bp, Artificial Sequence
  chemically synthesized
gatgccattaagaacatttgtg

SEQ ID NO: 673421 - DNA, 22 bp, Artificial Sequence
  chemically synthesized
atgccattaagaacatttgtga

SEQ ID NO: 673422 - DNA, 22 bp, Artificial Sequence
  chemically synthesized
acgacctcctatcaatcacaaa

SEQ ID NO: 673423 - DNA, 22 bp, Artificial Sequence
  chemically synthesized
gacgacctcctatcaatcacaa

SEQ ID NO: 673424 - DNA, 22 bp, Artificial Sequence
  chemically synthesized
tgacgacctcctatcaatcaca

SEQ ID NO: 673425 - DNA, 22 bp, Artificial Sequence
  chemically synthesized
agaacatttgtgattgatagga

SEQ ID NO: 673426 - DNA, 22 bp, Artificial Sequence
  chemically synthesized
atattttgacgacctcctatca

SEQ ID NO: 673427 - DNA, 22 bp, Artificial Sequence
  chemically synthesized
gtgattgataggaggtcgtcaa

SEQ ID NO: 673428 - DNA, 22 bp, Artificial Sequence
  chemically synthesized
tgattgataggaggtcgtcaaa

SEQ ID NO: 673429 - DNA, 22 bp, Artificial Sequence
  chemically synthesized
gtaatgttgatattttgacgac

SEQ ID NO: 673430 - DNA, 22 bp, Artificial Sequence
  chemically synthesized
ctggtaatgttgatattttgac

SEQ ID NO: 673431 - DNA, 22 bp, Artificial Sequence
  chemically synthesized
ataggaggtcgtcaaaatatca

SEQ ID NO: 673432 - DNA, 22 bp, Artificial Sequence
  chemically synthesized
caaactcctggtaatgttgata

SEQ ID NO: 673433 - DNA, 22 bp, Artificial Sequence
  chemically synthesized
ccaaactcctggtaatgttgat

SEQ ID NO: 673434 - DNA, 22 bp, Artificial Sequence
  chemically synthesized
gaatcaacgtcttccaaactcc

SEQ ID NO: 673435 - DNA, 22 bp, Artificial Sequence
  chemically synthesized
ccaggagtttggaagacgttga

SEQ ID NO: 673436 - DNA, 22 bp, Artificial Sequence
  chemically synthesized
ggaagacgttgattccaaccct

SEQ ID NO: 673437 - DNA, 22 bp, Artificial Sequence
  chemically synthesized
gaagacgttgattccaaccctc

SEQ ID NO: 673438 - DNA, 22 bp, Artificial Sequence
  chemically synthesized
acagtcatccatgagggttgga

SEQ ID NO: 673439 - DNA, 22 bp, Artificial Sequence
  chemically synthesized
aacccctgacagtcatccatga

SEQ ID NO: 673440 - DNA, 22 bp, Artificial Sequence
  chemically synthesized
gaacccctgacagtcatccatg

SEQ ID NO: 673441 - DNA, 22 bp, Artificial Sequence
  chemically synthesized
attccaaccctcatggatgact

SEQ ID NO: 673442 - DNA, 22 bp, Artificial Sequence
  chemically synthesized
caaccctcatggatgactgtca

SEQ ID NO: 673443 - DNA, 22 bp, Artificial Sequence
  chemically synthesized
aagtcttgaacccctgacagtc

SEQ ID NO: 673444 - DNA, 22 bp, Artificial Sequence
  chemically synthesized
cactgaagtcttgaacccctga

SEQ ID NO: 673445 - DNA, 22 bp, Artificial Sequence
  chemically synthesized
atggatgactgtcaggggttca

SEQ ID NO: 673446 - DNA, 22 bp, Artificial Sequence
  chemically synthesized
catcctccactgaagtcttgaa

SEQ ID NO: 673447 - DNA, 22 bp, Artificial Sequence
  chemically synthesized
tcaggggttcaagacttcagtg

SEQ ID NO: 673448 - DNA, 22 bp, Artificial Sequence
  chemically synthesized
cagttacatcctccactgaagt

SEQ ID NO: 673449 - DNA, 22 bp, Artificial Sequence
  chemically synthesized
catctgcagttacatcctccac

SEQ ID NO: 673450 - DNA, 22 bp, Artificial Sequence
  chemically synthesized
aagacttcagtggaggatgtaa

SEQ ID NO: 673451 - DNA, 22 bp, Artificial Sequence
  chemically synthesized
cactacatctgcagttacatcc

SEQ ID NO: 673452 - DNA, 22 bp, Artificial Sequence
  chemically synthesized
ccactacatctgcagttacatc

SEQ ID NO: 673453 - DNA, 22 bp, Artificial Sequence
  chemically synthesized
tttccactacatctgcagttac

SEQ ID NO: 673454 - DNA, 22 bp, Artificial Sequence
  chemically synthesized
cagtggaggatgtaactgcaga

SEQ ID NO: 673455 - DNA, 22 bp, Artificial Sequence
  chemically synthesized
agtggaggatgtaactgcagat

SEQ ID NO: 673456 - DNA, 22 bp, Artificial Sequence
  chemically synthesized
ctgtttccactacatctgcagt

SEQ ID NO: 673457 - DNA, 22 bp, Artificial Sequence
  chemically synthesized
cctgtttccactacatctgcag

SEQ ID NO: 673458 - DNA, 22 bp, Artificial Sequence
  chemically synthesized
ttcctgtttccactacatctgc

SEQ ID NO: 673459 - DNA, 22 bp, Artificial Sequence
  chemically synthesized
cttcctgtttccactacatctg

SEQ ID NO: 673460 - DNA, 22 bp, Artificial Sequence
  chemically synthesized
tcttcctgtttccactacatct

SEQ ID NO: 673461 - DNA, 22 bp, Artificial Sequence
  chemically synthesized
aattttcttcctgtttccacta

SEQ ID NO: 673462 - DNA, 22 bp, Artificial Sequence
  chemically synthesized
caattttcttcctgtttccact

SEQ ID NO: 673463 - DNA, 22 bp, Artificial Sequence
  chemically synthesized
cagatgtagtggaaacaggaag

SEQ ID NO: 673464 - DNA, 22 bp, Artificial Sequence
  chemically synthesized
tgatttcaattttcttcctgtt

SEQ ID NO: 673465 - DNA, 22 bp, Artificial Sequence
  chemically synthesized
gtgatttcaattttcttcctgt

SEQ ID NO: 673466 - DNA, 22 bp, Artificial Sequence
  chemically synthesized
acgccccacttgtgatttcaat

SEQ ID NO: 673467 - DNA, 22 bp, Artificial Sequence
  chemically synthesized
cacgccccacttgtgatttcaa

SEQ ID NO: 673468 - DNA, 22 bp, Artificial Sequence
  chemically synthesized
agccatatcttcacgccccact

SEQ ID NO: 673469 - DNA, 22 bp, Artificial Sequence
  chemically synthesized
aaatcacaagtggggcgtgaag

SEQ ID NO: 673470 - DNA, 22 bp, Artificial Sequence
  chemically synthesized
cagcaattcagccatatcttca

SEQ ID NO: 673471 - DNA, 22 bp, Artificial Sequence
  chemically synthesized
atcatgaaattgcagcaattca

SEQ ID NO: 673472 - DNA, 22 bp, Artificial Sequence
  chemically synthesized
gatcatgaaattgcagcaattc

SEQ ID NO: 673473 - DNA, 22 bp, Artificial Sequence
  chemically synthesized
aagtttgatcatgaaattgcag

SEQ ID NO: 673474 - DNA, 22 bp, Artificial Sequence
  chemically synthesized
aattgctgcaatttcatgatca

SEQ ID NO: 673475 - DNA, 22 bp, Artificial Sequence
  chemically synthesized
tccattaaagtttgatcatgaa

SEQ ID NO: 673476 - DNA, 22 bp, Artificial Sequence
  chemically synthesized
cctatccattaaagtttgatca

SEQ ID NO: 673477 - DNA, 22 bp, Artificial Sequence
  chemically synthesized
ctgcaatttcatgatcaaactt

SEQ ID NO: 673478 - DNA, 22 bp, Artificial Sequence
  chemically synthesized
caatttcatgatcaaactttaa

SEQ ID NO: 673479 - DNA, 22 bp, Artificial Sequence
  chemically synthesized
catgatcaaactttaatggata

SEQ ID NO: 673480 - DNA, 22 bp, Artificial Sequence
  chemically synthesized
atgatcaaactttaatggatag

SEQ ID NO: 673481 - DNA, 22 bp, Artificial Sequence
  chemically synthesized
atccataagtagcaactcccta

SEQ ID NO: 673482 - DNA, 22 bp, Artificial Sequence
  chemically synthesized
ctcatccataagtagcaactcc

SEQ ID NO: 673483 - DNA, 22 bp, Artificial Sequence
  chemically synthesized
gctcatccataagtagcaactc

SEQ ID NO: 673484 - DNA, 22 bp, Artificial Sequence
  chemically synthesized
taatggatagggagttgctact

SEQ ID NO: 673485 - DNA, 22 bp, Artificial Sequence
  chemically synthesized
tgctcatccataagtagcaact

SEQ ID NO: 673486 - DNA, 22 bp, Artificial Sequence
  chemically synthesized
aatggatagggagttgctactt

SEQ ID NO: 673487 - DNA, 22 bp, Artificial Sequence
  chemically synthesized
atggatagggagttgctactta

SEQ ID NO: 673488 - DNA, 22 bp, Artificial Sequence
  chemically synthesized
ctttgctcatccataagtagca

SEQ ID NO: 673489 - DNA, 22 bp, Artificial Sequence
  chemically synthesized
actttgctcatccataagtagc

SEQ ID NO: 673490 - DNA, 22 bp, Artificial Sequence
  chemically synthesized
atgaaaccacttactttgctca

SEQ ID NO: 673491 - DNA, 22 bp, Artificial Sequence
  chemically synthesized
ctacttatggatgagcaaagta

SEQ ID NO: 673492 - DNA, 22 bp, Artificial Sequence
  chemically synthesized
cttatggatgagcaaagtaagt

SEQ ID NO: 673493 - DNA, 22 bp, Artificial Sequence
  chemically synthesized
tctcatgaaaccacttactttg

SEQ ID NO: 673494 - DNA, 22 bp, Artificial Sequence
  chemically synthesized
atggatgagcaaagtaagtggt

SEQ ID NO: 673495 - DNA, 22 bp, Artificial Sequence
  chemically synthesized
tggatgagcaaagtaagtggtt

SEQ ID NO: 673496 - DNA, 22 bp, Artificial Sequence
  chemically synthesized
tagaatgtgatactatctcatg

SEQ ID NO: 673497 - DNA, 22 bp, Artificial Sequence
  chemically synthesized
tgtagaatgtgatactatctca

SEQ ID NO: 673498 - DNA, 22 bp, Artificial Sequence
  chemically synthesized
tctgtagaatgtgatactatct

SEQ ID NO: 673499 - DNA, 22 bp, Artificial Sequence
  chemically synthesized
ctctgtagaatgtgatactatc

SEQ ID NO: 673500 - DNA, 22 bp, Artificial Sequence
  chemically synthesized
catgagatagtatcacattcta

SEQ ID NO: 673501 - DNA, 22 bp, Artificial Sequence
  chemically synthesized
atgagatagtatcacattctac

SEQ ID NO: 673502 - DNA, 22 bp, Artificial Sequence
  chemically synthesized
tgaaagatttctctgtagaatg

SEQ ID NO: 673503 - DNA, 22 bp, Artificial Sequence
  chemically synthesized
gtgaaagatttctctgtagaat

SEQ ID NO: 673504 - DNA, 22 bp, Artificial Sequence
  chemically synthesized
tgtgaaagatttctctgtagaa

SEQ ID NO: 673505 - DNA, 22 bp, Artificial Sequence
  chemically synthesized
ttgtgaaagatttctctgtaga

SEQ ID NO: 673506 - DNA, 22 bp, Artificial Sequence
  chemically synthesized
cttttgtgaaagatttctctgt

SEQ ID NO: 673507 - DNA, 22 bp, Artificial Sequence
  chemically synthesized
ccttttgtgaaagatttctctg

SEQ ID NO: 673508 - DNA, 22 bp, Artificial Sequence
  chemically synthesized
ttccttttgtgaaagatttctc

SEQ ID NO: 673509 - DNA, 22 bp, Artificial Sequence
  chemically synthesized
actcttccttttgtgaaagatt

SEQ ID NO: 673510 - DNA, 22 bp, Artificial Sequence
  chemically synthesized
tacagagaaatctttcacaaaa

SEQ ID NO: 673511 - DNA, 22 bp, Artificial Sequence
  chemically synthesized
agttgactcttccttttgtgaa

SEQ ID NO: 673512 - DNA, 22 bp, Artificial Sequence
  chemically synthesized
cagagaaatctttcacaaaagg

SEQ ID NO: 673513 - DNA, 22 bp, Artificial Sequence
  chemically synthesized
ccactcagttgactcttccttt

SEQ ID NO: 673514 - DNA, 22 bp, Artificial Sequence
  chemically synthesized
tcacaaaaggaagagtcaactg

SEQ ID NO: 673515 - DNA, 22 bp, Artificial Sequence
  chemically synthesized
cacaaaaggaagagtcaactga

SEQ ID NO: 673516 - DNA, 22 bp, Artificial Sequence
  chemically synthesized
acaaaaggaagagtcaactgag

SEQ ID NO: 673517 - DNA, 22 bp, Artificial Sequence
  chemically synthesized
aaataagacaacaatgaagact

SEQ ID NO: 673518 - DNA, 22 bp, Artificial Sequence
  chemically synthesized
aaaataagacaacaatgaagac

SEQ ID NO: 673519 - DNA, 22 bp, Artificial Sequence
  chemically synthesized
ttaaaataagacaacaatgaag

SEQ ID NO: 673520 - DNA, 22 bp, Artificial Sequence
  chemically synthesized
cttaaaataagacaacaatgaa

SEQ ID NO: 673521 - DNA, 22 bp, Artificial Sequence
  chemically synthesized
agtggcagtcttcattgttgtc

SEQ ID NO: 673522 - DNA, 22 bp, Artificial Sequence
  chemically synthesized
tggcaatttcttaaaataagac

SEQ ID NO: 673523 - DNA, 22 bp, Artificial Sequence
  chemically synthesized
cattgttgtcttattttaagaa

SEQ ID NO: 673524 - DNA, 22 bp, Artificial Sequence
  chemically synthesized
attgttgtcttattttaagaaa

SEQ ID NO: 673525 - DNA, 22 bp, Artificial Sequence
  chemically synthesized
gggtggctgtggcaatttctta

SEQ ID NO: 673526 - DNA, 22 bp, Artificial Sequence
  chemically synthesized
ttgtcttattttaagaaattgc

SEQ ID NO: 673527 - DNA, 22 bp, Artificial Sequence
  chemically synthesized
tcttattttaagaaattgccac

SEQ ID NO: 673528 - DNA, 22 bp, Artificial Sequence
  chemically synthesized
aaggttggggtggctgtggcaa

SEQ ID NO: 673529 - DNA, 22 bp, Artificial Sequence
  chemically synthesized
attttaagaaattgccacagcc

SEQ ID NO: 673530 - DNA, 22 bp, Artificial Sequence
  chemically synthesized
ttttaagaaattgccacagcca

SEQ ID NO: 673531 - DNA, 22 bp, Artificial Sequence
  chemically synthesized
ctgaaggttggggtggctgtgg

SEQ ID NO: 673532 - DNA, 22 bp, Artificial Sequence
  chemically synthesized
taagaaattgccacagccaccc

SEQ ID NO: 673533 - DNA, 22 bp, Artificial Sequence
  chemically synthesized
aagaaattgccacagccacccc

SEQ ID NO: 673534 - DNA, 22 bp, Artificial Sequence
  chemically synthesized
agaaattgccacagccacccca

SEQ ID NO: 673535 - DNA, 22 bp, Artificial Sequence
  chemically synthesized
ccacagccaccccaaccttcag

SEQ ID NO: 673536 - DNA, 22 bp, Artificial Sequence
  chemically synthesized
cacagcatggtggttgctgaag

SEQ ID NO: 673537 - DNA, 22 bp, Artificial Sequence
  chemically synthesized
atggctgcacagcatggtggtt

SEQ ID NO: 673538 - DNA, 22 bp, Artificial Sequence
  chemically synthesized
gatgttgatggctgcacagcat

SEQ ID NO: 673539 - DNA, 22 bp, Artificial Sequence
  chemically synthesized
cagcaaccaccatgctgtgcag

SEQ ID NO: 673540 - DNA, 22 bp, Artificial Sequence
  chemically synthesized
agcaaccaccatgctgtgcagc

SEQ ID NO: 673541 - DNA, 22 bp, Artificial Sequence
  chemically synthesized
cctcgatgttgatggctgcaca

SEQ ID NO: 673542 - DNA, 22 bp, Artificial Sequence
  chemically synthesized
gcctcgatgttgatggctgcac

SEQ ID NO: 673543 - DNA, 22 bp, Artificial Sequence
  chemically synthesized
gtggagggtcttgcctcgatgt

SEQ ID NO: 673544 - DNA, 22 bp, Artificial Sequence
  chemically synthesized
tgcagccatcaacatcgaggca

SEQ ID NO: 673545 - DNA, 22 bp, Artificial Sequence
  chemically synthesized
ctggtggagggtcttgcctcga

SEQ ID NO: 673546 - DNA, 22 bp, Artificial Sequence
  chemically synthesized
gctggtggagggtcttgcctcg

SEQ ID NO: 673547 - DNA, 22 bp, Artificial Sequence
  chemically synthesized
tgctggtggagggtcttgcctc

SEQ ID NO: 673548 - DNA, 22 bp, Artificial Sequence
  chemically synthesized
ttgctggtggagggtcttgcct

SEQ ID NO: 673549 - DNA, 22 bp, Artificial Sequence
  chemically synthesized
agccagtaatgatccttttgct

SEQ ID NO: 673550 - DNA, 22 bp, Artificial Sequence
  chemically synthesized
cagccagtaatgatccttttgc

SEQ ID NO: 673551 - DNA, 22 bp, Artificial Sequence
  chemically synthesized
agccttcagccagtaatgatcc

SEQ ID NO: 673552 - DNA, 22 bp, Artificial Sequence
  chemically synthesized
caccagcaaaaggatcattact

SEQ ID NO: 673553 - DNA, 22 bp, Artificial Sequence
  chemically synthesized
acgatcacctgagccttcagcc

SEQ ID NO: 673554 - DNA, 22 bp, Artificial Sequence
  chemically synthesized
aaaaagctaacgatcacctgag

SEQ ID NO: 673555 - DNA, 22 bp, Artificial Sequence
  chemically synthesized
ctggctgaaggctcaggtgatc

SEQ ID NO: 673556 - DNA, 22 bp, Artificial Sequence
  chemically synthesized
ttaaaaaagctaacgatcacct

SEQ ID NO: 673557 - DNA, 22 bp, Artificial Sequence
  chemically synthesized
gctgaaggctcaggtgatcgtt

SEQ ID NO: 673558 - DNA, 22 bp, Artificial Sequence
  chemically synthesized
ttgttaaaaaagctaacgatca

SEQ ID NO: 673559 - DNA, 22 bp, Artificial Sequence
  chemically synthesized
attgttaaaaaagctaacgatc

SEQ ID NO: 673560 - DNA, 22 bp, Artificial Sequence
  chemically synthesized
aaggctcaggtgatcgttagct

SEQ ID NO: 673561 - DNA, 22 bp, Artificial Sequence
  chemically synthesized
tattgttaaaaaagctaacgat

SEQ ID NO: 673562 - DNA, 22 bp, Artificial Sequence
  chemically synthesized
aggtgatcgttagcttttttaa

SEQ ID NO: 673563 - DNA, 22 bp, Artificial Sequence
  chemically synthesized
aaatactttattgttaaaaaag

SEQ ID NO: 673564 - DNA, 22 bp, Artificial Sequence
  chemically synthesized
aaaatactttattgttaaaaaa

SEQ ID NO: 673565 - DNA, 22 bp, Artificial Sequence
  chemically synthesized
atttaaaatactttattgttaa

SEQ ID NO: 673566 - DNA, 22 bp, Artificial Sequence
  chemically synthesized
aatttaaaatactttattgtta

SEQ ID NO: 673567 - DNA, 22 bp, Artificial Sequence
  chemically synthesized
gcttttttaacaataaagtatt

SEQ ID NO: 673568 - DNA, 22 bp, Artificial Sequence
  chemically synthesized
ttttaacaataaagtattttaa

SEQ ID NO: 673569 - DNA, 22 bp, Artificial Sequence
  chemically synthesized
tttaacaataaagtattttaaa

SEQ ID NO: 673570 - DNA, 22 bp, Artificial Sequence
  chemically synthesized
ttaacaataaagtattttaaat

SEQ ID NO: 673571 - DNA, 22 bp, Artificial Sequence
  chemically synthesized
taacaataaagtattttaaatt

SEQ ID NO: 673572 - DNA, 22 bp, Artificial Sequence
  chemically synthesized
aacaataaagtattttaaatta

SEQ ID NO: 673573 - DNA, 22 bp, Artificial Sequence
  chemically synthesized
acaataaagtattttaaattaa

SEQ ID NO: 673574 - DNA, 22 bp, Artificial Sequence
  chemically synthesized
aaaaacaatgtacataccttaa

SEQ ID NO: 673575 - DNA, 22 bp, Artificial Sequence
  chemically synthesized
aaaaaacaatgtacatacctta

SEQ ID NO: 673576 - DNA, 22 bp, Artificial Sequence
  chemically synthesized
tgtcttaaaaaacaatgtacat

SEQ ID NO: 673577 - DNA, 22 bp, Artificial Sequence
  chemically synthesized
taaattaaggtatgtacattgt

SEQ ID NO: 673578 - DNA, 22 bp, Artificial Sequence
  chemically synthesized
aaattaaggtatgtacattgtt

SEQ ID NO: 673579 - DNA, 22 bp, Artificial Sequence
  chemically synthesized
aattaaggtatgtacattgttt

SEQ ID NO: 673580 - DNA, 22 bp, Artificial Sequence
  chemically synthesized
aggtatgtacattgttttttaa

SEQ ID NO: 673581 - DNA, 22 bp, Artificial Sequence
  chemically synthesized
gtaagtgtgcaacagcattatg

SEQ ID NO: 673582 - DNA, 22 bp, Artificial Sequence
  chemically synthesized
ttttttaagacataatgctgtt

SEQ ID NO: 673583 - DNA, 22 bp, Artificial Sequence
  chemically synthesized
tttaagacataatgctgttgca

SEQ ID NO: 673584 - DNA, 22 bp, Artificial Sequence
  chemically synthesized
ttaagacataatgctgttgcac

SEQ ID NO: 673585 - DNA, 22 bp, Artificial Sequence
  chemically synthesized
taagacataatgctgttgcaca

SEQ ID NO: 673586 - DNA, 22 bp, Artificial Sequence
  chemically synthesized
aagacataatgctgttgcacac

SEQ ID NO: 673587 - DNA, 22 bp, Artificial Sequence
  chemically synthesized
agacataatgctgttgcacact

SEQ ID NO: 673588 - DNA, 22 bp, Artificial Sequence
  chemically synthesized
taatgtagtctagtaagtgtgc

SEQ ID NO: 673589 - DNA, 22 bp, Artificial Sequence
  chemically synthesized
tataatgtagtctagtaagtgt

SEQ ID NO: 673590 - DNA, 22 bp, Artificial Sequence
  chemically synthesized
ctctataatgtagtctagtaag

SEQ ID NO: 673591 - DNA, 22 bp, Artificial Sequence
  chemically synthesized
actctataatgtagtctagtaa

SEQ ID NO: 673592 - DNA, 22 bp, Artificial Sequence
  chemically synthesized
ttgcacacttactagactacat

SEQ ID NO: 673593 - DNA, 22 bp, Artificial Sequence
  chemically synthesized
tgtttactctataatgtagtct

SEQ ID NO: 673594 - DNA, 22 bp, Artificial Sequence
  chemically synthesized
cacacttactagactacattat

SEQ ID NO: 673595 - DNA, 22 bp, Artificial Sequence
  chemically synthesized
actagactacattatagagtaa

SEQ ID NO: 673596 - DNA, 22 bp, Artificial Sequence
  chemically synthesized
ctagactacattatagagtaaa

SEQ ID NO: 673597 - DNA, 22 bp, Artificial Sequence
  chemically synthesized
gactacattatagagtaaacat

SEQ ID NO: 673598 - DNA, 22 bp, Artificial Sequence
  chemically synthesized
gtacatataagttatgtttact

SEQ ID NO: 673599 - DNA, 22 bp, Artificial Sequence
  chemically synthesized
tagtacatataagttatgttta

SEQ ID NO: 673600 - DNA, 22 bp, Artificial Sequence
  chemically synthesized
ctagtacatataagttatgttt

SEQ ID NO: 673601 - DNA, 22 bp, Artificial Sequence
  chemically synthesized
cattatagagtaaacataactt

SEQ ID NO: 673602 - DNA, 22 bp, Artificial Sequence
  chemically synthesized
tctagtacatataagttatgtt

SEQ ID NO: 673603 - DNA, 22 bp, Artificial Sequence
  chemically synthesized
gttttctagtacatataagtta

SEQ ID NO: 673604 - DNA, 22 bp, Artificial Sequence
  chemically synthesized
tagagtaaacataacttatatg

SEQ ID NO: 673605 - DNA, 22 bp, Artificial Sequence
  chemically synthesized
ggttttctagtacatataagtt

SEQ ID NO: 673606 - DNA, 22 bp, Artificial Sequence
  chemically synthesized
tggttttctagtacatataagt

SEQ ID NO: 673607 - DNA, 22 bp, Artificial Sequence
  chemically synthesized
atatgtactagaaaaccaaaac

SEQ ID NO: 673608 - DNA, 22 bp, Artificial Sequence
  chemically synthesized
tatgtactagaaaaccaaaaca

SEQ ID NO: 673609 - DNA, 22 bp, Artificial Sequence
  chemically synthesized
gaaaaccaaaacacttgtgtga

SEQ ID NO: 673610 - DNA, 22 bp, Artificial Sequence
  chemically synthesized
gtgtgacttactttattgtgat

SEQ ID NO: 673611 - DNA, 22 bp, Artificial Sequence
  chemically synthesized
agtaaagcaaatatcacaataa

SEQ ID NO: 673612 - DNA, 22 bp, Artificial Sequence
  chemically synthesized
tgtgacttactttattgtgata

SEQ ID NO: 673613 - DNA, 22 bp, Artificial Sequence
  chemically synthesized
cagtaaagcaaatatcacaata

SEQ ID NO: 673614 - DNA, 22 bp, Artificial Sequence
  chemically synthesized
actttattgtgatatttgcttt

SEQ ID NO: 673615 - DNA, 22 bp, Artificial Sequence
  chemically synthesized
ctttattgtgatatttgcttta

SEQ ID NO: 673616 - DNA, 22 bp, Artificial Sequence
  chemically synthesized
cagaacacttcagtaaagcaaa

SEQ ID NO: 673617 - DNA, 22 bp, Artificial Sequence
  chemically synthesized
tattgtgatatttgctttactg

SEQ ID NO: 673618 - DNA, 22 bp, Artificial Sequence
  chemically synthesized
attgtgatatttgctttactga

SEQ ID NO: 673619 - DNA, 22 bp, Artificial Sequence
  chemically synthesized
ttgtgatatttgctttactgaa

SEQ ID NO: 673620 - DNA, 22 bp, Artificial Sequence
  chemically synthesized
agttccagaacacttcagtaaa

SEQ ID NO: 673621 - DNA, 22 bp, Artificial Sequence
  chemically synthesized
tgatatttgctttactgaagtg

SEQ ID NO: 673622 - DNA, 22 bp, Artificial Sequence
  chemically synthesized
caggttcagttccagaacactt

SEQ ID NO: 673623 - DNA, 22 bp, Artificial Sequence
  chemically synthesized
gcaggttcagttccagaacact

SEQ ID NO: 673624 - DNA, 22 bp, Artificial Sequence
  chemically synthesized
tgcaggttcagttccagaacac

SEQ ID NO: 673625 - DNA, 22 bp, Artificial Sequence
  chemically synthesized
gctttactgaagtgttctggaa

SEQ ID NO: 673626 - DNA, 22 bp, Artificial Sequence
  chemically synthesized
ctttactgaagtgttctggaac

SEQ ID NO: 673627 - DNA, 22 bp, Artificial Sequence
  chemically synthesized
tactgaagtgttctggaactga

SEQ ID NO: 673628 - DNA, 22 bp, Artificial Sequence
  chemically synthesized
actgaagtgttctggaactgaa

SEQ ID NO: 673629 - DNA, 22 bp, Artificial Sequence
  chemically synthesized
ctgaagtgttctggaactgaac

SEQ ID NO: 673630 - DNA, 22 bp, Artificial Sequence
  chemically synthesized
gagattttgcaggttcagttcc

SEQ ID NO: 673631 - DNA, 22 bp, Artificial Sequence
  chemically synthesized
ggagattttgcaggttcagttc

SEQ ID NO: 673632 - DNA, 22 bp, Artificial Sequence
  chemically synthesized
aagtgttctggaactgaacctg

SEQ ID NO: 673633 - DNA, 22 bp, Artificial Sequence
  chemically synthesized
tggaactgaacctgcaaaatct

SEQ ID NO: 673634 - DNA, 22 bp, Artificial Sequence
  chemically synthesized
gaactgaacctgcaaaatctcc

SEQ ID NO: 673635 - DNA, 22 bp, Artificial Sequence
  chemically synthesized
aatacagacataccttggagat

SEQ ID NO: 673636 - DNA, 22 bp, Artificial Sequence
  chemically synthesized
aacctgcaaaatctccaaggta

SEQ ID NO: 673637 - DNA, 22 bp, Artificial Sequence
  chemically synthesized
aagactaaatacagacatacct

SEQ ID NO: 673638 - DNA, 22 bp, Artificial Sequence
  chemically synthesized
caaaatctccaaggtatgtctg

SEQ ID NO: 673639 - DNA, 22 bp, Artificial Sequence
  chemically synthesized
tcaagactaaatacagacatac

SEQ ID NO: 673640 - DNA, 22 bp, Artificial Sequence
  chemically synthesized
atgactctcaagactaaataca

SEQ ID NO: 673641 - DNA, 22 bp, Artificial Sequence
  chemically synthesized
caaggtatgtctgtatttagtc

SEQ ID NO: 673642 - DNA, 22 bp, Artificial Sequence
  chemically synthesized
tgctcatgactctcaagactaa

SEQ ID NO: 673643 - DNA, 22 bp, Artificial Sequence
  chemically synthesized
atgctcatgactctcaagacta

SEQ ID NO: 673644 - DNA, 22 bp, Artificial Sequence
  chemically synthesized
tatttagtcttgagagtcatga

SEQ ID NO: 673645 - DNA, 22 bp, Artificial Sequence
  chemically synthesized
caggtgtttatgctcatgactc

SEQ ID NO: 673646 - DNA, 22 bp, Artificial Sequence
  chemically synthesized
acaggtgtttatgctcatgact

SEQ ID NO: 673647 - DNA, 22 bp, Artificial Sequence
  chemically synthesized
agtcttgagagtcatgagcata

SEQ ID NO: 673648 - DNA, 22 bp, Artificial Sequence
  chemically synthesized
gtcttgagagtcatgagcataa

SEQ ID NO: 673649 - DNA, 22 bp, Artificial Sequence
  chemically synthesized
cgacgtttacaggtgtttatgc

SEQ ID NO: 673650 - DNA, 22 bp, Artificial Sequence
  chemically synthesized
gagagtcatgagcataaacacc

SEQ ID NO: 673651 - DNA, 22 bp, Artificial Sequence
  chemically synthesized
gcgacgtttacaggtgtttatg

SEQ ID NO: 673652 - DNA, 22 bp, Artificial Sequence
  chemically synthesized
agagtcatgagcataaacacct

SEQ ID NO: 673653 - DNA, 22 bp, Artificial Sequence
  chemically synthesized
atgaaagtacttgcgacgttta

SEQ ID NO: 673654 - DNA, 22 bp, Artificial Sequence
  chemically synthesized
gatgaaagtacttgcgacgttt

SEQ ID NO: 673655 - DNA, 22 bp, Artificial Sequence
  chemically synthesized
catgcatttgatgaaagtactt

SEQ ID NO: 673656 - DNA, 22 bp, Artificial Sequence
  chemically synthesized
ccatgcatttgatgaaagtact

SEQ ID NO: 673657 - DNA, 22 bp, Artificial Sequence
  chemically synthesized
taaacgtcgcaagtactttcat

SEQ ID NO: 673658 - DNA, 22 bp, Artificial Sequence
  chemically synthesized
aggataagcttccatgcatttg

SEQ ID NO: 673659 - DNA, 22 bp, Artificial Sequence
  chemically synthesized
tcatcaaatgcatggaagctta

SEQ ID NO: 673660 - DNA, 22 bp, Artificial Sequence
  chemically synthesized
catcaaatgcatggaagcttat

SEQ ID NO: 673661 - DNA, 22 bp, Artificial Sequence
  chemically synthesized
atcaaatgcatggaagcttatc

SEQ ID NO: 673662 - DNA, 22 bp, Artificial Sequence
  chemically synthesized
cagagaagtccaaacactaagg

SEQ ID NO: 673663 - DNA, 22 bp, Artificial Sequence
  chemically synthesized
tctgcagagaagtccaaacact

SEQ ID NO: 673664 - DNA, 22 bp, Artificial Sequence
  chemically synthesized
atccttagtgtttggacttctc

SEQ ID NO: 673665 - DNA, 22 bp, Artificial Sequence
  chemically synthesized
tccttagtgtttggacttctct

SEQ ID NO: 673666 - DNA, 22 bp, Artificial Sequence
  chemically synthesized
aaacaaattatctgcagagaag

SEQ ID NO: 673667 - DNA, 22 bp, Artificial Sequence
  chemically synthesized
agtgtttggacttctctgcaga

SEQ ID NO: 673668 - DNA, 22 bp, Artificial Sequence
  chemically synthesized
gtgtttggacttctctgcagat

SEQ ID NO: 673669 - DNA, 22 bp, Artificial Sequence
  chemically synthesized
ggacttctctgcagataatttg

SEQ ID NO: 673670 - DNA, 22 bp, Artificial Sequence
  chemically synthesized
gacttctctgcagataatttgt

SEQ ID NO: 673671 - DNA, 22 bp, Artificial Sequence
  chemically synthesized
ctctgcagataatttgttttaa

SEQ ID NO: 673672 - DNA, 22 bp, Artificial Sequence
  chemically synthesized
tctgcagataatttgttttaat

SEQ ID NO: 673673 - DNA, 22 bp, Artificial Sequence
  chemically synthesized
tgcagataatttgttttaattg

SEQ ID NO: 673674 - DNA, 22 bp, Artificial Sequence
  chemically synthesized
cagataatttgttttaattgct

SEQ ID NO: 673675 - DNA, 22 bp, Artificial Sequence
  chemically synthesized
aaggagaggaggtagcaattaa

SEQ ID NO: 673676 - DNA, 22 bp, Artificial Sequence
  chemically synthesized
aaaggagaggaggtagcaatta

SEQ ID NO: 673677 - DNA, 22 bp, Artificial Sequence
  chemically synthesized
atcttaaaggagaggaggtagc

SEQ ID NO: 673678 - DNA, 22 bp, Artificial Sequence
  chemically synthesized
gttttaattgctacctcctctc

SEQ ID NO: 673679 - DNA, 22 bp, Artificial Sequence
  chemically synthesized
ttttaattgctacctcctctcc

SEQ ID NO: 673680 - DNA, 22 bp, Artificial Sequence
  chemically synthesized
taattgctacctcctctccttt

SEQ ID NO: 673681 - DNA, 22 bp, Artificial Sequence
  chemically synthesized
aattgctacctcctctccttta

SEQ ID NO: 673682 - DNA, 22 bp, Artificial Sequence
  chemically synthesized
attgctacctcctctcctttaa

SEQ ID NO: 673683 - DNA, 22 bp, Artificial Sequence
  chemically synthesized
aaaggaaactgatcttaaagga

SEQ ID NO: 673684 - DNA, 22 bp, Artificial Sequence
  chemically synthesized
ctacctcctctcctttaagatc

SEQ ID NO: 673685 - DNA, 22 bp, Artificial Sequence
  chemically synthesized
cctcctctcctttaagatcagt

SEQ ID NO: 673686 - DNA, 22 bp, Artificial Sequence
  chemically synthesized
ggttcaaaggaaactgatctta

SEQ ID NO: 673687 - DNA, 22 bp, Artificial Sequence
  chemically synthesized
ctctcctttaagatcagtttcc

SEQ ID NO: 673688 - DNA, 22 bp, Artificial Sequence
  chemically synthesized
tcctttaagatcagtttccttt

SEQ ID NO: 673689 - DNA, 22 bp, Artificial Sequence
  chemically synthesized
ctttaagatcagtttcctttga

SEQ ID NO: 673690 - DNA, 22 bp, Artificial Sequence
  chemically synthesized
taagatcagtttcctttgaacc

SEQ ID NO: 673691 - DNA, 22 bp, Artificial Sequence
  chemically synthesized
aagatcagtttcctttgaaccc

SEQ ID NO: 673692 - DNA, 22 bp, Artificial Sequence
  chemically synthesized
agatcagtttcctttgaaccca

SEQ ID NO: 673693 - DNA, 22 bp, Artificial Sequence
  chemically synthesized
cctttgaacccaggatgtcctt

SEQ ID NO: 673694 - DNA, 22 bp, Artificial Sequence
  chemically synthesized
ctttgaacccaggatgtccttc

SEQ ID NO: 673695 - DNA, 22 bp, Artificial Sequence
  chemically synthesized
tgaacccaggatgtccttctgg

SEQ ID NO: 673696 - DNA, 22 bp, Artificial Sequence
  chemically synthesized
gaacccaggatgtccttctggt

SEQ ID NO: 673697 - DNA, 22 bp, Artificial Sequence
  chemically synthesized
aacccaggatgtccttctggta

SEQ ID NO: 673698 - DNA, 22 bp, Artificial Sequence
  chemically synthesized
aggtgacatagataagatacca

SEQ ID NO: 673699 - DNA, 22 bp, Artificial Sequence
  chemically synthesized
gaggtgacatagataagatacc

SEQ ID NO: 673700 - DNA, 22 bp, Artificial Sequence
  chemically synthesized
ctggtatcttatctatgtcacc

SEQ ID NO: 673701 - DNA, 22 bp, Artificial Sequence
  chemically synthesized
ataggagtttgaggtgacatag

SEQ ID NO: 673702 - DNA, 22 bp, Artificial Sequence
  chemically synthesized
tggtatcttatctatgtcacct

SEQ ID NO: 673703 - DNA, 22 bp, Artificial Sequence
  chemically synthesized
cataggagtttgaggtgacata

SEQ ID NO: 673704 - DNA, 22 bp, Artificial Sequence
  chemically synthesized
tcataggagtttgaggtgacat

SEQ ID NO: 673705 - DNA, 22 bp, Artificial Sequence
  chemically synthesized
gtatcttatctatgtcacctca

SEQ ID NO: 673706 - DNA, 22 bp, Artificial Sequence
  chemically synthesized
atctatgtcacctcaaactcct

SEQ ID NO: 673707 - DNA, 22 bp, Artificial Sequence
  chemically synthesized
aaaagctttcataggagtttga

SEQ ID NO: 673708 - DNA, 22 bp, Artificial Sequence
  chemically synthesized
tctatgtcacctcaaactccta

SEQ ID NO: 673709 - DNA, 22 bp, Artificial Sequence
  chemically synthesized
tgtcacctcaaactcctatgaa

SEQ ID NO: 673710 - DNA, 22 bp, Artificial Sequence
  chemically synthesized
aaactcctatgaaagcttttta

SEQ ID NO: 673711 - DNA, 22 bp, Artificial Sequence
  chemically synthesized
ctatgaaagctttttagttttt

SEQ ID NO: 673712 - DNA, 22 bp, Artificial Sequence
  chemically synthesized
tgaaagctttttagttttttta

SEQ ID NO: 673713 - DNA, 22 bp, Artificial Sequence
  chemically synthesized
gggaacaagaaacataaaaaaa

SEQ ID NO: 673714 - DNA, 22 bp, Artificial Sequence
  chemically synthesized
cgggaacaagaaacataaaaaa

SEQ ID NO: 673715 - DNA, 22 bp, Artificial Sequence
  chemically synthesized
tttagtttttttatgtttcttg

SEQ ID NO: 673716 - DNA, 22 bp, Artificial Sequence
  chemically synthesized
ttagtttttttatgtttcttgt

SEQ ID NO: 673717 - DNA, 22 bp, Artificial Sequence
  chemically synthesized
tagtttttttatgtttcttgtt

SEQ ID NO: 673718 - DNA, 22 bp, Artificial Sequence
  chemically synthesized
agtttttttatgtttcttgttc

SEQ ID NO: 673719 - DNA, 22 bp, Artificial Sequence
  chemically synthesized
gtttttttatgtttcttgttcc

SEQ ID NO: 673720 - DNA, 22 bp, Artificial Sequence
  chemically synthesized
tgcagatatttcgggaacaaga

SEQ ID NO: 673721 - DNA, 22 bp, Artificial Sequence
  chemically synthesized
tatgcagatatttcgggaacaa

SEQ ID NO: 673722 - DNA, 22 bp, Artificial Sequence
  chemically synthesized
ttttatgtttcttgttcccgaa

SEQ ID NO: 673723 - DNA, 22 bp, Artificial Sequence
  chemically synthesized
tttatgtttcttgttcccgaaa

SEQ ID NO: 673724 - DNA, 22 bp, Artificial Sequence
  chemically synthesized
ttatgtttcttgttcccgaaat

SEQ ID NO: 673725 - DNA, 22 bp, Artificial Sequence
  chemically synthesized
tatgtttcttgttcccgaaata

SEQ ID NO: 673726 - DNA, 22 bp, Artificial Sequence
  chemically synthesized
atgtttcttgttcccgaaatat

SEQ ID NO: 673727 - DNA, 22 bp, Artificial Sequence
  chemically synthesized
tgtttcttgttcccgaaatatc

SEQ ID NO: 673728 - DNA, 22 bp, Artificial Sequence
  chemically synthesized
cttgttcccgaaatatctgcat

SEQ ID NO: 673729 - DNA, 22 bp, Artificial Sequence
  chemically synthesized
ttgttcccgaaatatctgcata

SEQ ID NO: 673730 - DNA, 22 bp, Artificial Sequence
  chemically synthesized
gttcccgaaatatctgcataga

SEQ ID NO: 673731 - DNA, 22 bp, Artificial Sequence
  chemically synthesized
ttcccgaaatatctgcatagag

SEQ ID NO: 673732 - DNA, 22 bp, Artificial Sequence
  chemically synthesized
ccgaaatatctgcatagagggt

SEQ ID NO: 673733 - DNA, 22 bp, Artificial Sequence
  chemically synthesized
catagagggttggttgccttac

SEQ ID NO: 673734 - DNA, 22 bp, Artificial Sequence
  chemically synthesized
aagtacaggagatcccatggac

SEQ ID NO: 673735 - DNA, 22 bp, Artificial Sequence
  chemically synthesized
gttgccttactgtccatgggat

SEQ ID NO: 673736 - DNA, 22 bp, Artificial Sequence
  chemically synthesized
ccttactgtccatgggatctcc

SEQ ID NO: 673737 - DNA, 22 bp, Artificial Sequence
  chemically synthesized
actgtccatgggatctcctgta

SEQ ID NO: 673738 - DNA, 22 bp, Artificial Sequence
  chemically synthesized
ctgtccatgggatctcctgtac

SEQ ID NO: 673739 - DNA, 22 bp, Artificial Sequence
  chemically synthesized
tccatgggatctcctgtacttc

SEQ ID NO: 673740 - DNA, 22 bp, Artificial Sequence
  chemically synthesized
ctgtacttcaatcatttgcttg

SEQ ID NO: 673741 - DNA, 22 bp, Artificial Sequence
  chemically synthesized
tacttcaatcatttgcttgttg

SEQ ID NO: 673742 - DNA, 22 bp, Artificial Sequence
  chemically synthesized
caatcatttgcttgttggtttt

SEQ ID NO: 673743 - DNA, 22 bp, Artificial Sequence
  chemically synthesized
aatcatttgcttgttggttttt

SEQ ID NO: 673744 - DNA, 22 bp, Artificial Sequence
  chemically synthesized
gcttgttggtttttgatacttt

SEQ ID NO: 673745 - DNA, 22 bp, Artificial Sequence
  chemically synthesized
cttgttggtttttgatactttc

SEQ ID NO: 673746 - DNA, 22 bp, Artificial Sequence
  chemically synthesized
gttggtttttgatactttctct

SEQ ID NO: 673747 - DNA, 22 bp, Artificial Sequence
  chemically synthesized
ttggtttttgatactttctctg

SEQ ID NO: 673748 - DNA, 22 bp, Artificial Sequence
  chemically synthesized
gtttttgatactttctctgcct

SEQ ID NO: 673749 - DNA, 22 bp, Artificial Sequence
  chemically synthesized
ttgatactttctctgccttttc

SEQ ID NO: 673750 - DNA, 22 bp, Artificial Sequence
  chemically synthesized
tgatactttctctgccttttct

SEQ ID NO: 673751 - DNA, 22 bp, Artificial Sequence
  chemically synthesized
gatactttctctgccttttctc

SEQ ID NO: 673752 - DNA, 22 bp, Artificial Sequence
  chemically synthesized
atactttctctgccttttctct

SEQ ID NO: 673753 - DNA, 22 bp, Artificial Sequence
  chemically synthesized
taataaacagcagagcagagaa

SEQ ID NO: 673754 - DNA, 22 bp, Artificial Sequence
  chemically synthesized
tctctgccttttctctgctctg

SEQ ID NO: 673755 - DNA, 22 bp, Artificial Sequence
  chemically synthesized
ctctgccttttctctgctctgc

SEQ ID NO: 673756 - DNA, 22 bp, Artificial Sequence
  chemically synthesized
tctgccttttctctgctctgct

SEQ ID NO: 673757 - DNA, 22 bp, Artificial Sequence
  chemically synthesized
tgccttttctctgctctgctgt

SEQ ID NO: 673758 - DNA, 22 bp, Artificial Sequence
  chemically synthesized
ccttttctctgctctgctgttt

SEQ ID NO: 673759 - DNA, 22 bp, Artificial Sequence
  chemically synthesized
ttctctgctctgctgtttatta

SEQ ID NO: 673760 - DNA, 22 bp, Artificial Sequence
  chemically synthesized
tctctgctctgctgtttattac

SEQ ID NO: 673761 - DNA, 22 bp, Artificial Sequence
  chemically synthesized
ctctgctctgctgtttattaca

SEQ ID NO: 673762 - DNA, 22 bp, Artificial Sequence
  chemically synthesized
tctgctctgctgtttattacag

SEQ ID NO: 673763 - DNA, 22 bp, Artificial Sequence
  chemically synthesized
tgctctgctgtttattacagta

SEQ ID NO: 673764 - DNA, 22 bp, Artificial Sequence
  chemically synthesized
ctctgctgtttattacagtaca

SEQ ID NO: 673765 - DNA, 22 bp, Artificial Sequence
  chemically synthesized
tgctgtttattacagtacattt

SEQ ID NO: 673766 - DNA, 22 bp, Artificial Sequence
  chemically synthesized
ctgtttattacagtacattttc

SEQ ID NO: 673767 - DNA, 22 bp, Artificial Sequence
  chemically synthesized
gtaagggagcaggaaaatgtac

SEQ ID NO: 673768 - DNA, 22 bp, Artificial Sequence
  chemically synthesized
tttattacagtacattttcctg

SEQ ID NO: 673769 - DNA, 22 bp, Artificial Sequence
  chemically synthesized
attacagtacattttcctgctc

SEQ ID NO: 673770 - DNA, 22 bp, Artificial Sequence
  chemically synthesized
ttacagtacattttcctgctcc

SEQ ID NO: 673771 - DNA, 22 bp, Artificial Sequence
  chemically synthesized
cagtacattttcctgctccctt

SEQ ID NO: 673772 - DNA, 22 bp, Artificial Sequence
  chemically synthesized
gaagccaattggtaagggagca

SEQ ID NO: 673773 - DNA, 22 bp, Artificial Sequence
  chemically synthesized
ggaagccaattggtaagggagc

SEQ ID NO: 673774 - DNA, 22 bp, Artificial Sequence
  chemically synthesized
cttggaagccaattggtaaggg

SEQ ID NO: 673775 - DNA, 22 bp, Artificial Sequence
  chemically synthesized
acttggaagccaattggtaagg

SEQ ID NO: 673776 - DNA, 22 bp, Artificial Sequence
  chemically synthesized
tcctgctcccttaccaattggc

SEQ ID NO: 673777 - DNA, 22 bp, Artificial Sequence
  chemically synthesized
cctgctcccttaccaattggct

SEQ ID NO: 673778 - DNA, 22 bp, Artificial Sequence
  chemically synthesized
ctgctcccttaccaattggctt

SEQ ID NO: 673779 - DNA, 22 bp, Artificial Sequence
  chemically synthesized
ctcccttaccaattggcttcca

SEQ ID NO: 673780 - DNA, 22 bp, Artificial Sequence
  chemically synthesized
gccaaacttacttggaagccaa

SEQ ID NO: 673781 - DNA, 22 bp, Artificial Sequence
  chemically synthesized
ccttaccaattggcttccaagt

SEQ ID NO: 673782 - DNA, 22 bp, Artificial Sequence
  chemically synthesized
ttggccaaacttacttggaagc

SEQ ID NO: 673783 - DNA, 22 bp, Artificial Sequence
  chemically synthesized
ctattggccaaacttacttgga

SEQ ID NO: 673784 - DNA, 22 bp, Artificial Sequence
  chemically synthesized
accaattggcttccaagtaagt

SEQ ID NO: 673785 - DNA, 22 bp, Artificial Sequence
  chemically synthesized
ccaattggcttccaagtaagtt

SEQ ID NO: 673786 - DNA, 22 bp, Artificial Sequence
  chemically synthesized
gcttccaagtaagtttggccaa

SEQ ID NO: 673787 - DNA, 22 bp, Artificial Sequence
  chemically synthesized
ccagtgactcctattggccaaa

SEQ ID NO: 673788 - DNA, 22 bp, Artificial Sequence
  chemically synthesized
tgccagtgactcctattggcca

SEQ ID NO: 673789 - DNA, 22 bp, Artificial Sequence
  chemically synthesized
ccaagtaagtttggccaatagg

SEQ ID NO: 673790 - DNA, 22 bp, Artificial Sequence
  chemically synthesized
ctgccagtgactcctattggcc

SEQ ID NO: 673791 - DNA, 22 bp, Artificial Sequence
  chemically synthesized
caagtaagtttggccaatagga

SEQ ID NO: 673792 - DNA, 22 bp, Artificial Sequence
  chemically synthesized
ggcttctgccagtgactcctat

SEQ ID NO: 673793 - DNA, 22 bp, Artificial Sequence
  chemically synthesized
taggcttctgccagtgactcct

SEQ ID NO: 673794 - DNA, 22 bp, Artificial Sequence
  chemically synthesized
ggccaataggagtcactggcag

SEQ ID NO: 673795 - DNA, 22 bp, Artificial Sequence
  chemically synthesized
ccctctaggcttctgccagtga

SEQ ID NO: 673796 - DNA, 22 bp, Artificial Sequence
  chemically synthesized
gccaataggagtcactggcaga

SEQ ID NO: 673797 - DNA, 22 bp, Artificial Sequence
  chemically synthesized
cgcctgccctctaggcttctgc

SEQ ID NO: 673798 - DNA, 22 bp, Artificial Sequence
  chemically synthesized
ccgcctgccctctaggcttctg

SEQ ID NO: 673799 - DNA, 22 bp, Artificial Sequence
  chemically synthesized
tccgcctgccctctaggcttct

SEQ ID NO: 673800 - DNA, 22 bp, Artificial Sequence
  chemically synthesized
ctttccgcctgccctctaggct

SEQ ID NO: 673801 - DNA, 22 bp, Artificial Sequence
  chemically synthesized
tcctttccgcctgccctctagg

SEQ ID NO: 673802 - DNA, 22 bp, Artificial Sequence
  chemically synthesized
ctcctttccgcctgccctctag

SEQ ID NO: 673803 - DNA, 22 bp, Artificial Sequence
  chemically synthesized
gcagaagcctagagggcaggcg

SEQ ID NO: 673804 - DNA, 22 bp, Artificial Sequence
  chemically synthesized
gagggcaggcggaaaggagaag

SEQ ID NO: 673805 - DNA, 22 bp, Artificial Sequence
  chemically synthesized
ccggaggtagaatgaaaaagga

SEQ ID NO: 673806 - DNA, 22 bp, Artificial Sequence
  chemically synthesized
ttgccggaggtagaatgaaaaa

SEQ ID NO: 673807 - DNA, 22 bp, Artificial Sequence
  chemically synthesized
cctttttcattctacctccggc

SEQ ID NO: 673808 - DNA, 22 bp, Artificial Sequence
  chemically synthesized
gccagacctattgccggaggta

SEQ ID NO: 673809 - DNA, 22 bp, Artificial Sequence
  chemically synthesized
ctttttcattctacctccggca

SEQ ID NO: 673810 - DNA, 22 bp, Artificial Sequence
  chemically synthesized
tttcattctacctccggcaata

SEQ ID NO: 673811 - DNA, 22 bp, Artificial Sequence
  chemically synthesized
ttcattctacctccggcaatag

SEQ ID NO: 673812 - DNA, 22 bp, Artificial Sequence
  chemically synthesized
tcattctacctccggcaatagg

SEQ ID NO: 673813 - DNA, 22 bp, Artificial Sequence
  chemically synthesized
cattctacctccggcaataggt

SEQ ID NO: 673814 - DNA, 22 bp, Artificial Sequence
  chemically synthesized
attctacctccggcaataggtc

SEQ ID NO: 673815 - DNA, 22 bp, Artificial Sequence
  chemically synthesized
tacctccggcaataggtctggc

SEQ ID NO: 673816 - DNA, 22 bp, Artificial Sequence
  chemically synthesized
cctccggcaataggtctggcta

SEQ ID NO: 673817 - DNA, 22 bp, Artificial Sequence
  chemically synthesized
cggcaataggtctggctaactg

SEQ ID NO: 673818 - DNA, 22 bp, Artificial Sequence
  chemically synthesized
gagccaggaaggagacacagtt

SEQ ID NO: 673819 - DNA, 22 bp, Artificial Sequence
  chemically synthesized
gctaactgtgtctccttcctgg

SEQ ID NO: 673820 - DNA, 22 bp, Artificial Sequence
  chemically synthesized
cgagggagctggagccaggaag

SEQ ID NO: 673821 - DNA, 22 bp, Artificial Sequence
  chemically synthesized
actgtgtctccttcctggctcc

SEQ ID NO: 673822 - DNA, 22 bp, Artificial Sequence
  chemically synthesized
tgtctccttcctggctccagct

SEQ ID NO: 673823 - DNA, 22 bp, Artificial Sequence
  chemically synthesized
cttcctggctccagctccctcg

SEQ ID NO: 673824 - DNA, 22 bp, Artificial Sequence
  chemically synthesized
cctggctccagctccctcggag

SEQ ID NO: 673825 - DNA, 22 bp, Artificial Sequence
  chemically synthesized
ctggctccagctccctcggagc

SEQ ID NO: 673826 - DNA, 22 bp, Artificial Sequence
  chemically synthesized
gctccagctccctcggagcccc

SEQ ID NO: 673827 - DNA, 22 bp, Artificial Sequence
  chemically synthesized
ggaccaatgagggaggggctcc

SEQ ID NO: 673828 - DNA, 22 bp, Artificial Sequence
  chemically synthesized
cagctccctcggagcccctccc

SEQ ID NO: 673829 - DNA, 22 bp, Artificial Sequence
  chemically synthesized
cctcggagcccctccctcattg

SEQ ID NO: 673830 - DNA, 22 bp, Artificial Sequence
  chemically synthesized
gccagctgggaccaatgaggga

SEQ ID NO: 673831 - DNA, 22 bp, Artificial Sequence
  chemically synthesized
ggccagctgggaccaatgaggg

SEQ ID NO: 673832 - DNA, 22 bp, Artificial Sequence
  chemically synthesized
tggccagctgggaccaatgagg

SEQ ID NO: 673833 - DNA, 22 bp, Artificial Sequence
  chemically synthesized
ggagcccctccctcattggtcc

SEQ ID NO: 673834 - DNA, 22 bp, Artificial Sequence
  chemically synthesized
gaacctttggccagctgggacc

SEQ ID NO: 673835 - DNA, 22 bp, Artificial Sequence
  chemically synthesized
cctcattggtcccagctggcca

SEQ ID NO: 673836 - DNA, 22 bp, Artificial Sequence
  chemically synthesized
attggtcccagctggccaaagg

SEQ ID NO: 673837 - DNA, 22 bp, Artificial Sequence
  chemically synthesized
gtcccagctggccaaaggttcc

SEQ ID NO: 673838 - DNA, 22 bp, Artificial Sequence
  chemically synthesized
gccaaaggttccaactccgcct

SEQ ID NO: 673839 - DNA, 22 bp, Artificial Sequence
  chemically synthesized
caactccgccttgatgcccatg

SEQ ID NO: 673840 - DNA, 22 bp, Artificial Sequence
  chemically synthesized
cgccttgatgcccatgacatct

SEQ ID NO: 673841 - DNA, 22 bp, Artificial Sequence
  chemically synthesized
gatgcccatgacatctggggct

SEQ ID NO: 673842 - DNA, 22 bp, Artificial Sequence
  chemically synthesized
atgcccatgacatctggggctc

SEQ ID NO: 673843 - DNA, 22 bp, Artificial Sequence
  chemically synthesized
gggctctggtgataccacctct

SEQ ID NO: 673844 - DNA, 22 bp, Artificial Sequence
  chemically synthesized
gagggacaatgacaagaggtgg

SEQ ID NO: 673845 - DNA, 22 bp, Artificial Sequence
  chemically synthesized
tggtgataccacctcttgtcat

SEQ ID NO: 673846 - DNA, 22 bp, Artificial Sequence
  chemically synthesized
gtgataccacctcttgtcattg

SEQ ID NO: 673847 - DNA, 22 bp, Artificial Sequence
  chemically synthesized
gggctggagggacaatgacaag

SEQ ID NO: 673848 - DNA, 22 bp, Artificial Sequence
  chemically synthesized
tacctagggctggagggacaat

SEQ ID NO: 673849 - DNA, 22 bp, Artificial Sequence
  chemically synthesized
ttatacctagggctggagggac

SEQ ID NO: 673850 - DNA, 22 bp, Artificial Sequence
  chemically synthesized
tgttatacctagggctggaggg

SEQ ID NO: 673851 - DNA, 22 bp, Artificial Sequence
  chemically synthesized
ctgttatacctagggctggagg

SEQ ID NO: 673852 - DNA, 22 bp, Artificial Sequence
  chemically synthesized
ttgtcattgtccctccagccct

SEQ ID NO: 673853 - DNA, 22 bp, Artificial Sequence
  chemically synthesized
gtcattgtccctccagccctag

SEQ ID NO: 673854 - DNA, 22 bp, Artificial Sequence
  chemically synthesized
tcattgtccctccagccctagg

SEQ ID NO: 673855 - DNA, 22 bp, Artificial Sequence
  chemically synthesized
tccctccagccctaggtataac

SEQ ID NO: 673856 - DNA, 22 bp, Artificial Sequence
  chemically synthesized
cagccctaggtataacagaaac

SEQ ID NO: 673857 - DNA, 22 bp, Artificial Sequence
  chemically synthesized
ggtataacagaaacttcatgct

SEQ ID NO: 673858 - DNA, 22 bp, Artificial Sequence
  chemically synthesized
agaagccacacacacagcatga

SEQ ID NO: 673859 - DNA, 22 bp, Artificial Sequence
  chemically synthesized
catgctgtgtgtgtggcttctc

SEQ ID NO: 673860 - DNA, 22 bp, Artificial Sequence
  chemically synthesized
atgctgtgtgtgtggcttctca

SEQ ID NO: 673861 - DNA, 22 bp, Artificial Sequence
  chemically synthesized
aagaatggaagtgctgagaagc

SEQ ID NO: 673862 - DNA, 22 bp, Artificial Sequence
  chemically synthesized
ctcaagaatggaagtgctgaga

SEQ ID NO: 673863 - DNA, 22 bp, Artificial Sequence
  chemically synthesized
tgtgtgtggcttctcagcactt

SEQ ID NO: 673864 - DNA, 22 bp, Artificial Sequence
  chemically synthesized
gttactcaagaatggaagtgct

SEQ ID NO: 673865 - DNA, 22 bp, Artificial Sequence
  chemically synthesized
ctcagcacttccattcttgagt

SEQ ID NO: 673866 - DNA, 22 bp, Artificial Sequence
  chemically synthesized
tcagcacttccattcttgagta

SEQ ID NO: 673867 - DNA, 22 bp, Artificial Sequence
  chemically synthesized
agcacttccattcttgagtaac

SEQ ID NO: 673868 - DNA, 22 bp, Artificial Sequence
  chemically synthesized
atgcgggaaattggttactcaa

SEQ ID NO: 673869 - DNA, 22 bp, Artificial Sequence
  chemically synthesized
aatgcgggaaattggttactca

SEQ ID NO: 673870 - DNA, 22 bp, Artificial Sequence
  chemically synthesized
ccattcttgagtaaccaatttc

SEQ ID NO: 673871 - DNA, 22 bp, Artificial Sequence
  chemically synthesized
cattcttgagtaaccaatttcc

SEQ ID NO: 673872 - DNA, 22 bp, Artificial Sequence
  chemically synthesized
ttgagtaaccaatttcccgcat

SEQ ID NO: 673873 - DNA, 22 bp, Artificial Sequence
  chemically synthesized
gagtaaccaatttcccgcatta

SEQ ID NO: 673874 - DNA, 22 bp, Artificial Sequence
  chemically synthesized
agtaaccaatttcccgcattaa

SEQ ID NO: 673875 - DNA, 22 bp, Artificial Sequence
  chemically synthesized
aaacaaagggaatttaatgcgg

SEQ ID NO: 673876 - DNA, 22 bp, Artificial Sequence
  chemically synthesized
caaacaaagggaatttaatgcg

SEQ ID NO: 673877 - DNA, 22 bp, Artificial Sequence
  chemically synthesized
tttcaaacaaagggaatttaat

SEQ ID NO: 673878 - DNA, 22 bp, Artificial Sequence
  chemically synthesized
gttatttcaaacaaagggaatt

SEQ ID NO: 673879 - DNA, 22 bp, Artificial Sequence
  chemically synthesized
tagttatttcaaacaaagggaa

SEQ ID NO: 673880 - DNA, 22 bp, Artificial Sequence
  chemically synthesized
cccgcattaaattccctttgtt

SEQ ID NO: 673881 - DNA, 22 bp, Artificial Sequence
  chemically synthesized
ccgcattaaattccctttgttt

SEQ ID NO: 673882 - DNA, 22 bp, Artificial Sequence
  chemically synthesized
aattccctttgtttgaaataac

SEQ ID NO: 673883 - DNA, 22 bp, Artificial Sequence
  chemically synthesized
cctttgtttgaaataactagag

SEQ ID NO: 673884 - DNA, 22 bp, Artificial Sequence
  chemically synthesized
tgtttgaaataactagagggtt

SEQ ID NO: 673885 - DNA, 22 bp, Artificial Sequence
  chemically synthesized
gtttgaaataactagagggttt

SEQ ID NO: 673886 - DNA, 22 bp, Artificial Sequence
  chemically synthesized
gtcagaaaacataaaccctcta

SEQ ID NO: 673887 - DNA, 22 bp, Artificial Sequence
  chemically synthesized
tttgaaataactagagggttta

SEQ ID NO: 673888 - DNA, 22 bp, Artificial Sequence
  chemically synthesized
gaaataactagagggtttatgt

SEQ ID NO: 673889 - DNA, 22 bp, Artificial Sequence
  chemically synthesized
cctggtcagaaaacataaaccc

SEQ ID NO: 673890 - DNA, 22 bp, Artificial Sequence
  chemically synthesized
aaataactagagggtttatgtt

SEQ ID NO: 673891 - DNA, 22 bp, Artificial Sequence
  chemically synthesized
gagggtttatgttttctgacca

SEQ ID NO: 673892 - DNA, 22 bp, Artificial Sequence
  chemically synthesized
atgttttctgaccaggcagacc

SEQ ID NO: 673893 - DNA, 22 bp, Artificial Sequence
  chemically synthesized
tgttttctgaccaggcagaccc

SEQ ID NO: 673894 - DNA, 22 bp, Artificial Sequence
  chemically synthesized
gaagatgtatcaatcagggtct

SEQ ID NO: 673895 - DNA, 22 bp, Artificial Sequence
  chemically synthesized
tctgaccaggcagaccctgatt

SEQ ID NO: 673896 - DNA, 22 bp, Artificial Sequence
  chemically synthesized
ggaagatgtatcaatcagggtc

SEQ ID NO: 673897 - DNA, 22 bp, Artificial Sequence
  chemically synthesized
ctgaccaggcagaccctgattg

SEQ ID NO: 673898 - DNA, 22 bp, Artificial Sequence
  chemically synthesized
tgaccaggcagaccctgattga

SEQ ID NO: 673899 - DNA, 22 bp, Artificial Sequence
  chemically synthesized
accaggcagaccctgattgata

SEQ ID NO: 673900 - DNA, 22 bp, Artificial Sequence
  chemically synthesized
atttggaagatgtatcaatcag

SEQ ID NO: 673901 - DNA, 22 bp, Artificial Sequence
  chemically synthesized
gatttggaagatgtatcaatca

SEQ ID NO: 673902 - DNA, 22 bp, Artificial Sequence
  chemically synthesized
tgatttggaagatgtatcaatc

SEQ ID NO: 673903 - DNA, 22 bp, Artificial Sequence
  chemically synthesized
ttgatttggaagatgtatcaat

SEQ ID NO: 673904 - DNA, 22 bp, Artificial Sequence
  chemically synthesized
aggtttttgatttggaagatgt

SEQ ID NO: 673905 - DNA, 22 bp, Artificial Sequence
  chemically synthesized
tactaaggtttttgatttggaa

SEQ ID NO: 673906 - DNA, 22 bp, Artificial Sequence
  chemically synthesized
attgatacatcttccaaatcaa

SEQ ID NO: 673907 - DNA, 22 bp, Artificial Sequence
  chemically synthesized
atactaaggtttttgatttgga

SEQ ID NO: 673908 - DNA, 22 bp, Artificial Sequence
  chemically synthesized
tatactaaggtttttgatttgg

SEQ ID NO: 673909 - DNA, 22 bp, Artificial Sequence
  chemically synthesized
ttatactaaggtttttgatttg

SEQ ID NO: 673910 - DNA, 22 bp, Artificial Sequence
  chemically synthesized
tttatactaaggtttttgattt

SEQ ID NO: 673911 - DNA, 22 bp, Artificial Sequence
  chemically synthesized
atacatcttccaaatcaaaaac

SEQ ID NO: 673912 - DNA, 22 bp, Artificial Sequence
  chemically synthesized
aaggttttttatactaaggttt

SEQ ID NO: 673913 - DNA, 22 bp, Artificial Sequence
  chemically synthesized
ccaaatcaaaaaccttagtata

SEQ ID NO: 673914 - DNA, 22 bp, Artificial Sequence
  chemically synthesized
caaatcaaaaaccttagtataa

SEQ ID NO: 673915 - DNA, 22 bp, Artificial Sequence
  chemically synthesized
tatggtatgttgaaggtttttt

SEQ ID NO: 673916 - DNA, 22 bp, Artificial Sequence
  chemically synthesized
atatggtatgttgaaggttttt

SEQ ID NO: 673917 - DNA, 22 bp, Artificial Sequence
  chemically synthesized
agtataaaaaaccttcaacata

SEQ ID NO: 673918 - DNA, 22 bp, Artificial Sequence
  chemically synthesized
gtataaaaaaccttcaacatac

SEQ ID NO: 673919 - DNA, 22 bp, Artificial Sequence
  chemically synthesized
tgaaaagccttatatggtatgt

SEQ ID NO: 673920 - DNA, 22 bp, Artificial Sequence
  chemically synthesized
aaactgtgaaaagccttatatg

SEQ ID NO: 673921 - DNA, 22 bp, Artificial Sequence
  chemically synthesized
caacataccatataaggctttt

SEQ ID NO: 673922 - DNA, 22 bp, Artificial Sequence
  chemically synthesized
aacataccatataaggcttttc

SEQ ID NO: 673923 - DNA, 22 bp, Artificial Sequence
  chemically synthesized
tagagatgaggagggctaaaac

SEQ ID NO: 673924 - DNA, 22 bp, Artificial Sequence
  chemically synthesized
ttcacagttttagccctcctca

SEQ ID NO: 673925 - DNA, 22 bp, Artificial Sequence
  chemically synthesized
tcacagttttagccctcctcat

SEQ ID NO: 673926 - DNA, 22 bp, Artificial Sequence
  chemically synthesized
cacagttttagccctcctcatc

SEQ ID NO: 673927 - DNA, 22 bp, Artificial Sequence
  chemically synthesized
acagttttagccctcctcatct

SEQ ID NO: 673928 - DNA, 22 bp, Artificial Sequence
  chemically synthesized
tagccctcctcatctctacagc

SEQ ID NO: 673929 - DNA, 22 bp, Artificial Sequence
  chemically synthesized
agccctcctcatctctacagcc

SEQ ID NO: 673930 - DNA, 22 bp, Artificial Sequence
  chemically synthesized
gccctcctcatctctacagcca

SEQ ID NO: 673931 - DNA, 22 bp, Artificial Sequence
  chemically synthesized
ctcatctctacagccattctgt

SEQ ID NO: 673932 - DNA, 22 bp, Artificial Sequence
  chemically synthesized
atctctacagccattctgtgat

SEQ ID NO: 673933 - DNA, 22 bp, Artificial Sequence
  chemically synthesized
tggtagtggaggtatcacagaa

SEQ ID NO: 673934 - DNA, 22 bp, Artificial Sequence
  chemically synthesized
tacagccattctgtgatacctc

SEQ ID NO: 673935 - DNA, 22 bp, Artificial Sequence
  chemically synthesized
gtctgtggtagtggaggtatca

SEQ ID NO: 673936 - DNA, 22 bp, Artificial Sequence
  chemically synthesized
cagccattctgtgatacctcca

SEQ ID NO: 673937 - DNA, 22 bp, Artificial Sequence
  chemically synthesized
tgtgatacctccactaccacag

SEQ ID NO: 673938 - DNA, 22 bp, Artificial Sequence
  chemically synthesized
tgatacctccactaccacagac

SEQ ID NO: 673939 - DNA, 22 bp, Artificial Sequence
  chemically synthesized
ataaatgatggtggtactagtc

SEQ ID NO: 673940 - DNA, 22 bp, Artificial Sequence
  chemically synthesized
cactaccacagactagtaccac

SEQ ID NO: 673941 - DNA, 22 bp, Artificial Sequence
  chemically synthesized
ccacagactagtaccaccatca

SEQ ID NO: 673942 - DNA, 22 bp, Artificial Sequence
  chemically synthesized
gtaccaccatcatttattagat

SEQ ID NO: 673943 - DNA, 22 bp, Artificial Sequence
  chemically synthesized
aaaaaagagcataaatatctaa

SEQ ID NO: 673944 - DNA, 22 bp, Artificial Sequence
  chemically synthesized
tctcaaaaaagagcataaatat

SEQ ID NO: 673945 - DNA, 22 bp, Artificial Sequence
  chemically synthesized
tgtctcaaaaaagagcataaat

SEQ ID NO: 673946 - DNA, 22 bp, Artificial Sequence
  chemically synthesized
attagatatttatgctcttttt

SEQ ID NO: 673947 - DNA, 22 bp, Artificial Sequence
  chemically synthesized
ttagatatttatgctctttttt

SEQ ID NO: 673948 - DNA, 22 bp, Artificial Sequence
  chemically synthesized
gatatttatgctcttttttgag

SEQ ID NO: 673949 - DNA, 22 bp, Artificial Sequence
  chemically synthesized
atgctcttttttgagacagagt

SEQ ID NO: 673950 - DNA, 22 bp, Artificial Sequence
  chemically synthesized
tgctcttttttgagacagagtc

SEQ ID NO: 673951 - DNA, 22 bp, Artificial Sequence
  chemically synthesized
ggcaacagagtgagactctgtc

SEQ ID NO: 673952 - DNA, 22 bp, Artificial Sequence
  chemically synthesized
ttttttgagacagagtctcact

SEQ ID NO: 673953 - DNA, 22 bp, Artificial Sequence
  chemically synthesized
ttttgagacagagtctcactct

SEQ ID NO: 673954 - DNA, 22 bp, Artificial Sequence
  chemically synthesized
agcctgggcaacagagtgagac

SEQ ID NO: 673955 - DNA, 22 bp, Artificial Sequence
  chemically synthesized
tttgagacagagtctcactctg

SEQ ID NO: 673956 - DNA, 22 bp, Artificial Sequence
  chemically synthesized
cagcctgggcaacagagtgaga

SEQ ID NO: 673957 - DNA, 22 bp, Artificial Sequence
  chemically synthesized
ttgagacagagtctcactctgt

SEQ ID NO: 673958 - DNA, 22 bp, Artificial Sequence
  chemically synthesized
tgagacagagtctcactctgtt

SEQ ID NO: 673959 - DNA, 22 bp, Artificial Sequence
  chemically synthesized
gagacagagtctcactctgttg

SEQ ID NO: 673960 - DNA, 22 bp, Artificial Sequence
  chemically synthesized
agacagagtctcactctgttgc

SEQ ID NO: 673961 - DNA, 22 bp, Artificial Sequence
  chemically synthesized
cacttcagcctgggcaacagag

SEQ ID NO: 673962 - DNA, 22 bp, Artificial Sequence
  chemically synthesized
actctgttgcccaggctgaagt

SEQ ID NO: 673963 - DNA, 22 bp, Artificial Sequence
  chemically synthesized
tgttgcccaggctgaagtgcag

SEQ ID NO: 673964 - DNA, 22 bp, Artificial Sequence
  chemically synthesized
ttgcccaggctgaagtgcagtg

SEQ ID NO: 673965 - DNA, 22 bp, Artificial Sequence
  chemically synthesized
cccaggctgaagtgcagtggtg

SEQ ID NO: 673966 - DNA, 22 bp, Artificial Sequence
  chemically synthesized
cagtgagccaagatcgcaccac

SEQ ID NO: 673967 - DNA, 22 bp, Artificial Sequence
  chemically synthesized
aagtgcagtggtgcgatcttgg

SEQ ID NO: 673968 - DNA, 22 bp, Artificial Sequence
  chemically synthesized
ggaggcacgggttgcagtgagc

SEQ ID NO: 673969 - DNA, 22 bp, Artificial Sequence
  chemically synthesized
aacctgggaggcacgggttgca

SEQ ID NO: 673970 - DNA, 22 bp, Artificial Sequence
  chemically synthesized
gaacctgggaggcacgggttgc

SEQ ID NO: 673971 - DNA, 22 bp, Artificial Sequence
  chemically synthesized
cttgaacctgggaggcacgggt

SEQ ID NO: 673972 - DNA, 22 bp, Artificial Sequence
  chemically synthesized
ggctcactgcaacccgtgcctc

SEQ ID NO: 673973 - DNA, 22 bp, Artificial Sequence
  chemically synthesized
gctcactgcaacccgtgcctcc

SEQ ID NO: 673974 - DNA, 22 bp, Artificial Sequence
  chemically synthesized
actgcaacccgtgcctcccagg

SEQ ID NO: 673975 - DNA, 22 bp, Artificial Sequence
  chemically synthesized
caacccgtgcctcccaggttca

SEQ ID NO: 673976 - DNA, 22 bp, Artificial Sequence
  chemically synthesized
aggcaggagaattgcttgaacc

SEQ ID NO: 673977 - DNA, 22 bp, Artificial Sequence
  chemically synthesized
ccaggttcaagcaattctcctg

SEQ ID NO: 673978 - DNA, 22 bp, Artificial Sequence
  chemically synthesized
gggaagctgaggcaggagaatt

SEQ ID NO: 673979 - DNA, 22 bp, Artificial Sequence
  chemically synthesized
aagcaattctcctgcctcagct

SEQ ID NO: 673980 - DNA, 22 bp, Artificial Sequence
  chemically synthesized
tagtaccagatactcgggaagc

SEQ ID NO: 673981 - DNA, 22 bp, Artificial Sequence
  chemically synthesized
tcctgcctcagcttcccgagta

SEQ ID NO: 673982 - DNA, 22 bp, Artificial Sequence
  chemically synthesized
ctgcctcagcttcccgagtatc

SEQ ID NO: 673983 - DNA, 22 bp, Artificial Sequence
  chemically synthesized
cctgtagtaccagatactcggg

SEQ ID NO: 673984 - DNA, 22 bp, Artificial Sequence
  chemically synthesized
cctcagcttcccgagtatctgg

SEQ ID NO: 673985 - DNA, 22 bp, Artificial Sequence
  chemically synthesized
agcttcccgagtatctggtact

SEQ ID NO: 673986 - DNA, 22 bp, Artificial Sequence
  chemically synthesized
cccgagtatctggtactacagg

SEQ ID NO: 673987 - DNA, 22 bp, Artificial Sequence
  chemically synthesized
ccgagtatctggtactacaggc

SEQ ID NO: 673988 - DNA, 22 bp, Artificial Sequence
  chemically synthesized
gtactacaggcagacgccacca

SEQ ID NO: 673989 - DNA, 22 bp, Artificial Sequence
  chemically synthesized
aaaaagccagaagtggtggcgt

SEQ ID NO: 673990 - DNA, 22 bp, Artificial Sequence
  chemically synthesized
aaaaaagccagaagtggtggcg

SEQ ID NO: 673991 - DNA, 22 bp, Artificial Sequence
  chemically synthesized
caggcagacgccaccacttctg

SEQ ID NO: 673992 - DNA, 22 bp, Artificial Sequence
  chemically synthesized
aaataaaaatttaaaaaagcca

SEQ ID NO: 673993 - DNA, 22 bp, Artificial Sequence
  chemically synthesized
ctaaaataaaaatttaaaaaag

SEQ ID NO: 673994 - DNA, 22 bp, Artificial Sequence
  chemically synthesized
tactaaaataaaaatttaaaaa

SEQ ID NO: 673995 - DNA, 22 bp, Artificial Sequence
  chemically synthesized
ctggcttttttaaatttttatt

SEQ ID NO: 673996 - DNA, 22 bp, Artificial Sequence
  chemically synthesized
tggcttttttaaatttttattt

SEQ ID NO: 673997 - DNA, 22 bp, Artificial Sequence
  chemically synthesized
gcttttttaaatttttatttta

SEQ ID NO: 673998 - DNA, 22 bp, Artificial Sequence
  chemically synthesized
ttttaaatttttattttagtag

SEQ ID NO: 673999 - DNA, 22 bp, Artificial Sequence
  chemically synthesized
tttaaatttttattttagtaga

SEQ ID NO: 674000 - DNA, 22 bp, Artificial Sequence
  chemically synthesized
ttaaatttttattttagtagag

SEQ ID NO: 674001 - DNA, 22 bp, Artificial Sequence
  chemically synthesized
taaatttttattttagtagaga

SEQ ID NO: 674002 - DNA, 22 bp, Artificial Sequence
  chemically synthesized
aaatttttattttagtagagat

SEQ ID NO: 674003 - DNA, 22 bp, Artificial Sequence
  chemically synthesized
aatttttattttagtagagatg

SEQ ID NO: 674004 - DNA, 22 bp, Artificial Sequence
  chemically synthesized
ttattttagtagagatggggtt

SEQ ID NO: 674005 - DNA, 22 bp, Artificial Sequence
  chemically synthesized
tattttagtagagatggggttt

SEQ ID NO: 674006 - DNA, 22 bp, Artificial Sequence
  chemically synthesized
ggcaacacggtgaaaccccatc

SEQ ID NO: 674007 - DNA, 22 bp, Artificial Sequence
  chemically synthesized
attttagtagagatggggtttc

SEQ ID NO: 674008 - DNA, 22 bp, Artificial Sequence
  chemically synthesized
ttttagtagagatggggtttca

SEQ ID NO: 674009 - DNA, 22 bp, Artificial Sequence
  chemically synthesized
tagtagagatggggtttcaccg

SEQ ID NO: 674010 - DNA, 22 bp, Artificial Sequence
  chemically synthesized
agtagagatggggtttcaccgt

SEQ ID NO: 674011 - DNA, 22 bp, Artificial Sequence
  chemically synthesized
gtagagatggggtttcaccgtg

SEQ ID NO: 674012 - DNA, 22 bp, Artificial Sequence
  chemically synthesized
gagaccagcctgggcaacacgg

SEQ ID NO: 674013 - DNA, 22 bp, Artificial Sequence
  chemically synthesized
caccgtgttgcccaggctggtc

SEQ ID NO: 674014 - DNA, 22 bp, Artificial Sequence
  chemically synthesized
accgtgttgcccaggctggtct

SEQ ID NO: 674015 - DNA, 22 bp, Artificial Sequence
  chemically synthesized
aggtcaggagttcgagaccagc

SEQ ID NO: 674016 - DNA, 22 bp, Artificial Sequence
  chemically synthesized
cccaggctggtctcgaactcct

SEQ ID NO: 674017 - DNA, 22 bp, Artificial Sequence
  chemically synthesized
gtctcgaactcctgacctcagg

SEQ ID NO: 674018 - DNA, 22 bp, Artificial Sequence
  chemically synthesized
gaactcctgacctcaggtgatc

SEQ ID NO: 674019 - DNA, 22 bp, Artificial Sequence
  chemically synthesized
ggaggccgaggcaggtggatca

SEQ ID NO: 674020 - DNA, 22 bp, Artificial Sequence
  chemically synthesized
ctgacctcaggtgatccacctg

SEQ ID NO: 674021 - DNA, 22 bp, Artificial Sequence
  chemically synthesized
gggaggccgaggcaggtggatc

SEQ ID NO: 674022 - DNA, 22 bp, Artificial Sequence
  chemically synthesized
tgggaggccgaggcaggtggat

SEQ ID NO: 674023 - DNA, 22 bp, Artificial Sequence
  chemically synthesized
acctcaggtgatccacctgcct

SEQ ID NO: 674024 - DNA, 22 bp, Artificial Sequence
  chemically synthesized
cactttgggaggccgaggcagg

SEQ ID NO: 674025 - DNA, 22 bp, Artificial Sequence
  chemically synthesized
aggtgatccacctgcctcggcc

SEQ ID NO: 674026 - DNA, 22 bp, Artificial Sequence
  chemically synthesized
cctcggcctcccaaagtgtagt

SEQ ID NO: 674027 - DNA, 22 bp, Artificial Sequence
  chemically synthesized
aggataaaaaagactacacttt

SEQ ID NO: 674028 - DNA, 22 bp, Artificial Sequence
  chemically synthesized
ggcctcccaaagtgtagtcttt

SEQ ID NO: 674029 - DNA, 22 bp, Artificial Sequence
  chemically synthesized
ccaaagtgtagtcttttttatc

SEQ ID NO: 674030 - DNA, 22 bp, Artificial Sequence
  chemically synthesized
aaataatatatcattcaggata

SEQ ID NO: 674031 - DNA, 22 bp, Artificial Sequence
  chemically synthesized
taaaataatatatcattcagga

SEQ ID NO: 674032 - DNA, 22 bp, Artificial Sequence
  chemically synthesized
ttttatcctgaatgatatatta

SEQ ID NO: 674033 - DNA, 22 bp, Artificial Sequence
  chemically synthesized
tttatcctgaatgatatattat

SEQ ID NO: 674034 - DNA, 22 bp, Artificial Sequence
  chemically synthesized
ttatcctgaatgatatattatt

SEQ ID NO: 674035 - DNA, 22 bp, Artificial Sequence
  chemically synthesized
ccccaattctaaaataatatat

SEQ ID NO: 674036 - DNA, 22 bp, Artificial Sequence
  chemically synthesized
tatcctgaatgatatattattt

SEQ ID NO: 674037 - DNA, 22 bp, Artificial Sequence
  chemically synthesized
atcctgaatgatatattatttt

SEQ ID NO: 674038 - DNA, 22 bp, Artificial Sequence
  chemically synthesized
tcctgaatgatatattatttta

SEQ ID NO: 674039 - DNA, 22 bp, Artificial Sequence
  chemically synthesized
ccctcccccaattctaaaataa

SEQ ID NO: 674040 - DNA, 22 bp, Artificial Sequence
  chemically synthesized
gccctcccccaattctaaaata

SEQ ID NO: 674041 - DNA, 22 bp, Artificial Sequence
  chemically synthesized
aatgatatattattttagaatt

SEQ ID NO: 674042 - DNA, 22 bp, Artificial Sequence
  chemically synthesized
tttgccctcccccaattctaaa

SEQ ID NO: 674043 - DNA, 22 bp, Artificial Sequence
  chemically synthesized
tgttgtttgccctcccccaatt

SEQ ID NO: 674044 - DNA, 22 bp, Artificial Sequence
  chemically synthesized
tactgtgttgtttgccctcccc

SEQ ID NO: 674045 - DNA, 22 bp, Artificial Sequence
  chemically synthesized
ttttagaattgggggagggcaa

SEQ ID NO: 674046 - DNA, 22 bp, Artificial Sequence
  chemically synthesized
gtactgtgttgtttgccctccc

SEQ ID NO: 674047 - DNA, 22 bp, Artificial Sequence
  chemically synthesized
tgtactgtgttgtttgccctcc

SEQ ID NO: 674048 - DNA, 22 bp, Artificial Sequence
  chemically synthesized
tagaattgggggagggcaaaca

SEQ ID NO: 674049 - DNA, 22 bp, Artificial Sequence
  chemically synthesized
agaattgggggagggcaaacaa

SEQ ID NO: 674050 - DNA, 22 bp, Artificial Sequence
  chemically synthesized
gaattgggggagggcaaacaac

SEQ ID NO: 674051 - DNA, 22 bp, Artificial Sequence
  chemically synthesized
ggggagggcaaacaacacagta

SEQ ID NO: 674052 - DNA, 22 bp, Artificial Sequence
  chemically synthesized
aaataatacattttgtactgtg

SEQ ID NO: 674053 - DNA, 22 bp, Artificial Sequence
  chemically synthesized
acatgcaaattaaaataataca

SEQ ID NO: 674054 - DNA, 22 bp, Artificial Sequence
  chemically synthesized
gacatgcaaattaaaataatac

SEQ ID NO: 674055 - DNA, 22 bp, Artificial Sequence
  chemically synthesized
atttgacatgcaaattaaaata

SEQ ID NO: 674056 - DNA, 22 bp, Artificial Sequence
  chemically synthesized
aatttgacatgcaaattaaaat

SEQ ID NO: 674057 - DNA, 22 bp, Artificial Sequence
  chemically synthesized
taatttgacatgcaaattaaaa

SEQ ID NO: 674058 - DNA, 22 bp, Artificial Sequence
  chemically synthesized
ttttaatttgcatgtcaaatta

SEQ ID NO: 674059 - DNA, 22 bp, Artificial Sequence
  chemically synthesized
taatttgcatgtcaaattaaag

SEQ ID NO: 674060 - DNA, 22 bp, Artificial Sequence
  chemically synthesized
aatttgcatgtcaaattaaagt

SEQ ID NO: 674061 - DNA, 22 bp, Artificial Sequence
  chemically synthesized
atttgcatgtcaaattaaagta

SEQ ID NO: 674062 - DNA, 22 bp, Artificial Sequence
  chemically synthesized
gaaagcatacacgtactttaat

SEQ ID NO: 674063 - DNA, 22 bp, Artificial Sequence
  chemically synthesized
ggaaagcatacacgtactttaa

SEQ ID NO: 674064 - DNA, 22 bp, Artificial Sequence
  chemically synthesized
tggaaagcatacacgtacttta

SEQ ID NO: 674065 - DNA, 22 bp, Artificial Sequence
  chemically synthesized
gcatgtcaaattaaagtacgtg

SEQ ID NO: 674066 - DNA, 22 bp, Artificial Sequence
  chemically synthesized
ttggaaagcatacacgtacttt

SEQ ID NO: 674067 - DNA, 22 bp, Artificial Sequence
  chemically synthesized
catgtcaaattaaagtacgtgt

SEQ ID NO: 674068 - DNA, 22 bp, Artificial Sequence
  chemically synthesized
acttttggaaagcatacacgta

SEQ ID NO: 674069 - DNA, 22 bp, Artificial Sequence
  chemically synthesized
tcctaacttttggaaagcatac

SEQ ID NO: 674070 - DNA, 22 bp, Artificial Sequence
  chemically synthesized
atcctaacttttggaaagcata

SEQ ID NO: 674071 - DNA, 22 bp, Artificial Sequence
  chemically synthesized
aagtacgtgtatgctttccaaa

SEQ ID NO: 674072 - DNA, 22 bp, Artificial Sequence
  chemically synthesized
atcacaatttatcctaactttt

SEQ ID NO: 674073 - DNA, 22 bp, Artificial Sequence
  chemically synthesized
tccaaaagttaggataaattgt

SEQ ID NO: 674074 - DNA, 22 bp, Artificial Sequence
  chemically synthesized
ccaaaagttaggataaattgtg

SEQ ID NO: 674075 - DNA, 22 bp, Artificial Sequence
  chemically synthesized
caaaagttaggataaattgtga

SEQ ID NO: 674076 - DNA, 22 bp, Artificial Sequence
  chemically synthesized
ggataaattgtgatcaggtgat

SEQ ID NO: 674077 - DNA, 22 bp, Artificial Sequence
  chemically synthesized
accaaggtgataaagatcacct

SEQ ID NO: 674078 - DNA, 22 bp, Artificial Sequence
  chemically synthesized
aaccaaggtgataaagatcacc

SEQ ID NO: 674079 - DNA, 22 bp, Artificial Sequence
  chemically synthesized
ttaaccaaggtgataaagatca

SEQ ID NO: 674080 - DNA, 22 bp, Artificial Sequence
  chemically synthesized
cttaaccaaggtgataaagatc

SEQ ID NO: 674081 - DNA, 22 bp, Artificial Sequence
  chemically synthesized
tgatcaggtgatctttatcacc

SEQ ID NO: 674082 - DNA, 22 bp, Artificial Sequence
  chemically synthesized
cttcttaaccaaggtgataaag

SEQ ID NO: 674083 - DNA, 22 bp, Artificial Sequence
  chemically synthesized
acttcttaaccaaggtgataaa

SEQ ID NO: 674084 - DNA, 22 bp, Artificial Sequence
  chemically synthesized
tacttcttaaccaaggtgataa

SEQ ID NO: 674085 - DNA, 22 bp, Artificial Sequence
  chemically synthesized
aagtattttacttcttaaccaa

SEQ ID NO: 674086 - DNA, 22 bp, Artificial Sequence
  chemically synthesized
tgaagtattttacttcttaacc

SEQ ID NO: 674087 - DNA, 22 bp, Artificial Sequence
  chemically synthesized
ctgaagtattttacttcttaac

SEQ ID NO: 674088 - DNA, 22 bp, Artificial Sequence
  chemically synthesized
tctgaagtattttacttcttaa

SEQ ID NO: 674089 - DNA, 22 bp, Artificial Sequence
  chemically synthesized
tatcaccttggttaagaagtaa

SEQ ID NO: 674090 - DNA, 22 bp, Artificial Sequence
  chemically synthesized
ttctgaagtattttacttctta

SEQ ID NO: 674091 - DNA, 22 bp, Artificial Sequence
  chemically synthesized
atcaccttggttaagaagtaaa

SEQ ID NO: 674092 - DNA, 22 bp, Artificial Sequence
  chemically synthesized
tcaccttggttaagaagtaaaa

SEQ ID NO: 674093 - DNA, 22 bp, Artificial Sequence
  chemically synthesized
aatttttctgaagtattttact

SEQ ID NO: 674094 - DNA, 22 bp, Artificial Sequence
  chemically synthesized
ggttaagaagtaaaatacttca

SEQ ID NO: 674095 - DNA, 22 bp, Artificial Sequence
  chemically synthesized
gttaagaagtaaaatacttcag

SEQ ID NO: 674096 - DNA, 22 bp, Artificial Sequence
  chemically synthesized
agaagtaaaatacttcagaaaa

SEQ ID NO: 674097 - DNA, 22 bp, Artificial Sequence
  chemically synthesized
aaggagccactaaatttttctg

SEQ ID NO: 674098 - DNA, 22 bp, Artificial Sequence
  chemically synthesized
acactcaaggagccactaaatt

SEQ ID NO: 674099 - DNA, 22 bp, Artificial Sequence
  chemically synthesized
gacactcaaggagccactaaat

SEQ ID NO: 674100 - DNA, 22 bp, Artificial Sequence
  chemically synthesized
cagaaaaatttagtggctcctt

SEQ ID NO: 674101 - DNA, 22 bp, Artificial Sequence
  chemically synthesized
agaaaaatttagtggctccttg

SEQ ID NO: 674102 - DNA, 22 bp, Artificial Sequence
  chemically synthesized
acatttgacactcaaggagcca

SEQ ID NO: 674103 - DNA, 22 bp, Artificial Sequence
  chemically synthesized
cacatttgacactcaaggagcc

SEQ ID NO: 674104 - DNA, 22 bp, Artificial Sequence
  chemically synthesized
ggtcttcacatttgacactcaa

SEQ ID NO: 674105 - DNA, 22 bp, Artificial Sequence
  chemically synthesized
aggtcttcacatttgacactca

SEQ ID NO: 674106 - DNA, 22 bp, Artificial Sequence
  chemically synthesized
agtggctccttgagtgtcaaat

SEQ ID NO: 674107 - DNA, 22 bp, Artificial Sequence
  chemically synthesized
gtggctccttgagtgtcaaatg

SEQ ID NO: 674108 - DNA, 22 bp, Artificial Sequence
  chemically synthesized
ggtttaggtcttcacatttgac

SEQ ID NO: 674109 - DNA, 22 bp, Artificial Sequence
  chemically synthesized
cttgagtgtcaaatgtgaagac

SEQ ID NO: 674110 - DNA, 22 bp, Artificial Sequence
  chemically synthesized
gagtgtcaaatgtgaagaccta

SEQ ID NO: 674111 - DNA, 22 bp, Artificial Sequence
  chemically synthesized
agtgtcaaatgtgaagacctaa

SEQ ID NO: 674112 - DNA, 22 bp, Artificial Sequence
  chemically synthesized
agatagtgagagacacctaggt

SEQ ID NO: 674113 - DNA, 22 bp, Artificial Sequence
  chemically synthesized
aacctaggtgtctctcactatc

SEQ ID NO: 674114 - DNA, 22 bp, Artificial Sequence
  chemically synthesized
agataccaagaattcagatagt

SEQ ID NO: 674115 - DNA, 22 bp, Artificial Sequence
  chemically synthesized
ggtgtctctcactatctgaatt

SEQ ID NO: 674116 - DNA, 22 bp, Artificial Sequence
  chemically synthesized
aattgagataccaagaattcag

SEQ ID NO: 674117 - DNA, 22 bp, Artificial Sequence
  chemically synthesized
ctgaattgagataccaagaatt

SEQ ID NO: 674118 - DNA, 22 bp, Artificial Sequence
  chemically synthesized
tcactatctgaattcttggtat

SEQ ID NO: 674119 - DNA, 22 bp, Artificial Sequence
  chemically synthesized
actatctgaattcttggtatct

SEQ ID NO: 674120 - DNA, 22 bp, Artificial Sequence
  chemically synthesized
ggttcctgaattgagataccaa

SEQ ID NO: 674121 - DNA, 22 bp, Artificial Sequence
  chemically synthesized
tctgaattcttggtatctcaat

SEQ ID NO: 674122 - DNA, 22 bp, Artificial Sequence
  chemically synthesized
ttgggttcctgaattgagatac

SEQ ID NO: 674123 - DNA, 22 bp, Artificial Sequence
  chemically synthesized
aattcttggtatctcaattcag

SEQ ID NO: 674124 - DNA, 22 bp, Artificial Sequence
  chemically synthesized
ataatctattgggttcctgaat

SEQ ID NO: 674125 - DNA, 22 bp, Artificial Sequence
  chemically synthesized
ttggtatctcaattcaggaacc

SEQ ID NO: 674126 - DNA, 22 bp, Artificial Sequence
  chemically synthesized
aataatctattgggttcctgaa

SEQ ID NO: 674127 - DNA, 22 bp, Artificial Sequence
  chemically synthesized
ggtatctcaattcaggaaccca

SEQ ID NO: 674128 - DNA, 22 bp, Artificial Sequence
  chemically synthesized
gtatctcaattcaggaacccaa

SEQ ID NO: 674129 - DNA, 22 bp, Artificial Sequence
  chemically synthesized
tttaataatctattgggttcct

SEQ ID NO: 674130 - DNA, 22 bp, Artificial Sequence
  chemically synthesized
atttaataatctattgggttcc

SEQ ID NO: 674131 - DNA, 22 bp, Artificial Sequence
  chemically synthesized
cttatttaataatctattgggt

SEQ ID NO: 674132 - DNA, 22 bp, Artificial Sequence
  chemically synthesized
tccttatttaataatctattgg

SEQ ID NO: 674133 - DNA, 22 bp, Artificial Sequence
  chemically synthesized
aattcaggaacccaatagatta

SEQ ID NO: 674134 - DNA, 22 bp, Artificial Sequence
  chemically synthesized
aggaacccaatagattattaaa

SEQ ID NO: 674135 - DNA, 22 bp, Artificial Sequence
  chemically synthesized
tcatataccagtgtctctcctt

SEQ ID NO: 674136 - DNA, 22 bp, Artificial Sequence
  chemically synthesized
ttatcatataccagtgtctctc

SEQ ID NO: 674137 - DNA, 22 bp, Artificial Sequence
  chemically synthesized
ttaaataaggagagacactggt

SEQ ID NO: 674138 - DNA, 22 bp, Artificial Sequence
  chemically synthesized
ttattatcatataccagtgtct

SEQ ID NO: 674139 - DNA, 22 bp, Artificial Sequence
  chemically synthesized
aataaggagagacactggtata

SEQ ID NO: 674140 - DNA, 22 bp, Artificial Sequence
  chemically synthesized
gttattattatcatataccagt

SEQ ID NO: 674141 - DNA, 22 bp, Artificial Sequence
  chemically synthesized
ttagttattattatcatatacc

SEQ ID NO: 674142 - DNA, 22 bp, Artificial Sequence
  chemically synthesized
ttattagttattattatcatat

SEQ ID NO: 674143 - DNA, 22 bp, Artificial Sequence
  chemically synthesized
ttattattagttattattatca

SEQ ID NO: 674144 - DNA, 22 bp, Artificial Sequence
  chemically synthesized
gtatatgataataataactaat

SEQ ID NO: 674145 - DNA, 22 bp, Artificial Sequence
  chemically synthesized
gtgatatgcattattattatta

SEQ ID NO: 674146 - DNA, 22 bp, Artificial Sequence
  chemically synthesized
ttagtgatatgcattattatta

SEQ ID NO: 674147 - DNA, 22 bp, Artificial Sequence
  chemically synthesized
ctattagtgatatgcattatta

SEQ ID NO: 674148 - DNA, 22 bp, Artificial Sequence
  chemically synthesized
taattgctattagtgatatgca

SEQ ID NO: 674149 - DNA, 22 bp, Artificial Sequence
  chemically synthesized
ataataataatgcatatcacta

SEQ ID NO: 674150 - DNA, 22 bp, Artificial Sequence
  chemically synthesized
aaggaattataattgctattag

SEQ ID NO: 674151 - DNA, 22 bp, Artificial Sequence
  chemically synthesized
ctcaaggaattataattgctat

SEQ ID NO: 674152 - DNA, 22 bp, Artificial Sequence
  chemically synthesized
atagcaattataattccttgag

SEQ ID NO: 674153 - DNA, 22 bp, Artificial Sequence
  chemically synthesized
atgtagtaactgctcaaggaat

SEQ ID NO: 674154 - DNA, 22 bp, Artificial Sequence
  chemically synthesized
taattccttgagcagttactac

SEQ ID NO: 674155 - DNA, 22 bp, Artificial Sequence
  chemically synthesized
cttgagcagttactacatcaga

SEQ ID NO: 674156 - DNA, 22 bp, Artificial Sequence
  chemically synthesized
gagcagttactacatcagacat

SEQ ID NO: 674157 - DNA, 22 bp, Artificial Sequence
  chemically synthesized
agcagttactacatcagacatt

SEQ ID NO: 674158 - DNA, 22 bp, Artificial Sequence
  chemically synthesized
ctacatcagacattctgttacc

SEQ ID NO: 674159 - DNA, 22 bp, Artificial Sequence
  chemically synthesized
catcagacattctgttacctta

SEQ ID NO: 674160 - DNA, 22 bp, Artificial Sequence
  chemically synthesized
gaatgacatatgtaaggtaaca

SEQ ID NO: 674161 - DNA, 22 bp, Artificial Sequence
  chemically synthesized
tgaggattagaatgacatatgt

SEQ ID NO: 674162 - DNA, 22 bp, Artificial Sequence
  chemically synthesized
tgttaccttacatatgtcattc

SEQ ID NO: 674163 - DNA, 22 bp, Artificial Sequence
  chemically synthesized
ttaccttacatatgtcattcta

SEQ ID NO: 674164 - DNA, 22 bp, Artificial Sequence
  chemically synthesized
tgttgtgaggattagaatgaca

SEQ ID NO: 674165 - DNA, 22 bp, Artificial Sequence
  chemically synthesized
gtgttgtgaggattagaatgac

SEQ ID NO: 674166 - DNA, 22 bp, Artificial Sequence
  chemically synthesized
ccttacatatgtcattctaatc

SEQ ID NO: 674167 - DNA, 22 bp, Artificial Sequence
  chemically synthesized
tcttgtgttgtgaggattagaa

SEQ ID NO: 674168 - DNA, 22 bp, Artificial Sequence
  chemically synthesized
atcttgtgttgtgaggattaga

SEQ ID NO: 674169 - DNA, 22 bp, Artificial Sequence
  chemically synthesized
acatatgtcattctaatcctca

SEQ ID NO: 674170 - DNA, 22 bp, Artificial Sequence
  chemically synthesized
catatgtcattctaatcctcac

SEQ ID NO: 674171 - DNA, 22 bp, Artificial Sequence
  chemically synthesized
tgatgagacttatcttgtgttg

SEQ ID NO: 674172 - DNA, 22 bp, Artificial Sequence
  chemically synthesized
taatcctcacaacacaagataa

SEQ ID NO: 674173 - DNA, 22 bp, Artificial Sequence
  chemically synthesized
atcctcacaacacaagataagt

SEQ ID NO: 674174 - DNA, 22 bp, Artificial Sequence
  chemically synthesized
aatagttatgatgagacttatc

SEQ ID NO: 674175 - DNA, 22 bp, Artificial Sequence
  chemically synthesized
acaacacaagataagtctcatc

SEQ ID NO: 674176 - DNA, 22 bp, Artificial Sequence
  chemically synthesized
tgtgatgtattaaatagttatg

SEQ ID NO: 674177 - DNA, 22 bp, Artificial Sequence
  chemically synthesized
agttatgtgatgtattaaatag

SEQ ID NO: 674178 - DNA, 22 bp, Artificial Sequence
  chemically synthesized
atcataactatttaatacatca

SEQ ID NO: 674179 - DNA, 22 bp, Artificial Sequence
  chemically synthesized
aacctcagttatgtgatgtatt

SEQ ID NO: 674180 - DNA, 22 bp, Artificial Sequence
  chemically synthesized
aaacctcagttatgtgatgtat

SEQ ID NO: 674181 - DNA, 22 bp, Artificial Sequence
  chemically synthesized
taaacctcagttatgtgatgta

SEQ ID NO: 674182 - DNA, 22 bp, Artificial Sequence
  chemically synthesized
tttaatacatcacataactgag

SEQ ID NO: 674183 - DNA, 22 bp, Artificial Sequence
  chemically synthesized
ataattttaaacctcagttatg

SEQ ID NO: 674184 - DNA, 22 bp, Artificial Sequence
  chemically synthesized
aatacatcacataactgaggtt

SEQ ID NO: 674185 - DNA, 22 bp, Artificial Sequence
  chemically synthesized
atacatcacataactgaggttt

SEQ ID NO: 674186 - DNA, 22 bp, Artificial Sequence
  chemically synthesized
aggtttaaaattattagtggct

SEQ ID NO: 674187 - DNA, 22 bp, Artificial Sequence
  chemically synthesized
tggtcaaaaaggaagccactaa

SEQ ID NO: 674188 - DNA, 22 bp, Artificial Sequence
  chemically synthesized
tgtggtcaaaaaggaagccact

SEQ ID NO: 674189 - DNA, 22 bp, Artificial Sequence
  chemically synthesized
tctgtggtcaaaaaggaagcca

SEQ ID NO: 674190 - DNA, 22 bp, Artificial Sequence
  chemically synthesized
aaaattattagtggcttccttt

SEQ ID NO: 674191 - DNA, 22 bp, Artificial Sequence
  chemically synthesized
aaattattagtggcttcctttt

SEQ ID NO: 674192 - DNA, 22 bp, Artificial Sequence
  chemically synthesized
ttagtggcttcctttttgacca

SEQ ID NO: 674193 - DNA, 22 bp, Artificial Sequence
  chemically synthesized
tcaccagttctctgtggtcaaa

SEQ ID NO: 674194 - DNA, 22 bp, Artificial Sequence
  chemically synthesized
gtggcttcctttttgaccacag

SEQ ID NO: 674195 - DNA, 22 bp, Artificial Sequence
  chemically synthesized
tgtcaccagttctctgtggtca

SEQ ID NO: 674196 - DNA, 22 bp, Artificial Sequence
  chemically synthesized
attctgtcaccagttctctgtg

SEQ ID NO: 674197 - DNA, 22 bp, Artificial Sequence
  chemically synthesized
cctttttgaccacagagaactg

SEQ ID NO: 674198 - DNA, 22 bp, Artificial Sequence
  chemically synthesized
tgattctgtcaccagttctctg

SEQ ID NO: 674199 - DNA, 22 bp, Artificial Sequence
  chemically synthesized
ctttttgaccacagagaactgg

SEQ ID NO: 674200 - DNA, 22 bp, Artificial Sequence
  chemically synthesized
tttgaccacagagaactggtga

SEQ ID NO: 674201 - DNA, 22 bp, Artificial Sequence
  chemically synthesized
ttgaccacagagaactggtgac

SEQ ID NO: 674202 - DNA, 22 bp, Artificial Sequence
  chemically synthesized
aattctgattctgtcaccagtt

SEQ ID NO: 674203 - DNA, 22 bp, Artificial Sequence
  chemically synthesized
tgaccacagagaactggtgaca

SEQ ID NO: 674204 - DNA, 22 bp, Artificial Sequence
  chemically synthesized
aaattctgattctgtcaccagt

SEQ ID NO: 674205 - DNA, 22 bp, Artificial Sequence
  chemically synthesized
gaccacagagaactggtgacag

SEQ ID NO: 674206 - DNA, 22 bp, Artificial Sequence
  chemically synthesized
accacagagaactggtgacaga

SEQ ID NO: 674207 - DNA, 22 bp, Artificial Sequence
  chemically synthesized
gatttaaattctgattctgtca

SEQ ID NO: 674208 - DNA, 22 bp, Artificial Sequence
  chemically synthesized
aggctggatttaaattctgatt

SEQ ID NO: 674209 - DNA, 22 bp, Artificial Sequence
  chemically synthesized
gaggctggatttaaattctgat

SEQ ID NO: 674210 - DNA, 22 bp, Artificial Sequence
  chemically synthesized
tgaggctggatttaaattctga

SEQ ID NO: 674211 - DNA, 22 bp, Artificial Sequence
  chemically synthesized
gtgacagaatcagaatttaaat

SEQ ID NO: 674212 - DNA, 22 bp, Artificial Sequence
  chemically synthesized
actttgaggctggatttaaatt

SEQ ID NO: 674213 - DNA, 22 bp, Artificial Sequence
  chemically synthesized
attgactttgaggctggattta

SEQ ID NO: 674214 - DNA, 22 bp, Artificial Sequence
  chemically synthesized
ttcattgactttgaggctggat

SEQ ID NO: 674215 - DNA, 22 bp, Artificial Sequence
  chemically synthesized
aaatccagcctcaaagtcaatg

SEQ ID NO: 674216 - DNA, 22 bp, Artificial Sequence
  chemically synthesized
aatccagcctcaaagtcaatga

SEQ ID NO: 674217 - DNA, 22 bp, Artificial Sequence
  chemically synthesized
cagcaacaaaattgttcattga

SEQ ID NO: 674218 - DNA, 22 bp, Artificial Sequence
  chemically synthesized
gcagcaacaaaattgttcattg

SEQ ID NO: 674219 - DNA, 22 bp, Artificial Sequence
  chemically synthesized
tgcagcaacaaaattgttcatt

SEQ ID NO: 674220 - DNA, 22 bp, Artificial Sequence
  chemically synthesized
aaagtcaatgaacaattttgtt

SEQ ID NO: 674221 - DNA, 22 bp, Artificial Sequence
  chemically synthesized
gaggcaatgttttgcagcaaca

SEQ ID NO: 674222 - DNA, 22 bp, Artificial Sequence
  chemically synthesized
ggaggcaatgttttgcagcaac

SEQ ID NO: 674223 - DNA, 22 bp, Artificial Sequence
  chemically synthesized
ggtttggaggcaatgttttgca

SEQ ID NO: 674224 - DNA, 22 bp, Artificial Sequence
  chemically synthesized
aggtttggaggcaatgttttgc

SEQ ID NO: 674225 - DNA, 22 bp, Artificial Sequence
  chemically synthesized
tgttgctgcaaaacattgcctc

SEQ ID NO: 674226 - DNA, 22 bp, Artificial Sequence
  chemically synthesized
gttgctgcaaaacattgcctcc

SEQ ID NO: 674227 - DNA, 22 bp, Artificial Sequence
  chemically synthesized
ttgctgcaaaacattgcctcca

SEQ ID NO: 674228 - DNA, 22 bp, Artificial Sequence
  chemically synthesized
tgagtttaggtttggaggcaat

SEQ ID NO: 674229 - DNA, 22 bp, Artificial Sequence
  chemically synthesized
atgagtttaggtttggaggcaa

SEQ ID NO: 674230 - DNA, 22 bp, Artificial Sequence
  chemically synthesized
tatgagtttaggtttggaggca

SEQ ID NO: 674231 - DNA, 22 bp, Artificial Sequence
  chemically synthesized
ctgcaaaacattgcctccaaac

SEQ ID NO: 674232 - DNA, 22 bp, Artificial Sequence
  chemically synthesized
caaaacattgcctccaaaccta

SEQ ID NO: 674233 - DNA, 22 bp, Artificial Sequence
  chemically synthesized
tcactttatgagtttaggtttg

SEQ ID NO: 674234 - DNA, 22 bp, Artificial Sequence
  chemically synthesized
ttgtcactttatgagtttaggt

SEQ ID NO: 674235 - DNA, 22 bp, Artificial Sequence
  chemically synthesized
ctattgtcactttatgagttta

SEQ ID NO: 674236 - DNA, 22 bp, Artificial Sequence
  chemically synthesized
cctattgtcactttatgagttt

SEQ ID NO: 674237 - DNA, 22 bp, Artificial Sequence
  chemically synthesized
cctccaaacctaaactcataaa

SEQ ID NO: 674238 - DNA, 22 bp, Artificial Sequence
  chemically synthesized
tcctattgtcactttatgagtt

SEQ ID NO: 674239 - DNA, 22 bp, Artificial Sequence
  chemically synthesized
caaacctaaactcataaagtga

SEQ ID NO: 674240 - DNA, 22 bp, Artificial Sequence
  chemically synthesized
tgactttcctattgtcacttta

SEQ ID NO: 674241 - DNA, 22 bp, Artificial Sequence
  chemically synthesized
tactgtgactttcctattgtca

SEQ ID NO: 674242 - DNA, 22 bp, Artificial Sequence
  chemically synthesized
aactcataaagtgacaatagga

SEQ ID NO: 674243 - DNA, 22 bp, Artificial Sequence
  chemically synthesized
attatactgtgactttcctatt

SEQ ID NO: 674244 - DNA, 22 bp, Artificial Sequence
  chemically synthesized
ataaagtgacaataggaaagtc

SEQ ID NO: 674245 - DNA, 22 bp, Artificial Sequence
  chemically synthesized
attgattatactgtgactttcc

SEQ ID NO: 674246 - DNA, 22 bp, Artificial Sequence
  chemically synthesized
agtgggggaactaattgattat

SEQ ID NO: 674247 - DNA, 22 bp, Artificial Sequence
  chemically synthesized
tggggtgcattcagtgggggaa

SEQ ID NO: 674248 - DNA, 22 bp, Artificial Sequence
  chemically synthesized
atggggtgcattcagtggggga

SEQ ID NO: 674249 - DNA, 22 bp, Artificial Sequence
  chemically synthesized
tatggggtgcattcagtggggg

SEQ ID NO: 674250 - DNA, 22 bp, Artificial Sequence
  chemically synthesized
tttatggggtgcattcagtggg

SEQ ID NO: 674251 - DNA, 22 bp, Artificial Sequence
  chemically synthesized
gttcccccactgaatgcacccc

SEQ ID NO: 674252 - DNA, 22 bp, Artificial Sequence
  chemically synthesized
ccccactgaatgcaccccataa

SEQ ID NO: 674253 - DNA, 22 bp, Artificial Sequence
  chemically synthesized
tgatatatgcactctttatggg

SEQ ID NO: 674254 - DNA, 22 bp, Artificial Sequence
  chemically synthesized
aatgcaccccataaagagtgca

SEQ ID NO: 674255 - DNA, 22 bp, Artificial Sequence
  chemically synthesized
gaatataaactgtgatatatgc

SEQ ID NO: 674256 - DNA, 22 bp, Artificial Sequence
  chemically synthesized
tctagaatataaactgtgatat

SEQ ID NO: 674257 - DNA, 22 bp, Artificial Sequence
  chemically synthesized
atctagaatataaactgtgata

SEQ ID NO: 674258 - DNA, 22 bp, Artificial Sequence
  chemically synthesized
tatctagaatataaactgtgat

SEQ ID NO: 674259 - DNA, 22 bp, Artificial Sequence
  chemically synthesized
ttatctagaatataaactgtga

SEQ ID NO: 674260 - DNA, 22 bp, Artificial Sequence
  chemically synthesized
cttttatctagaatataaactg

SEQ ID NO: 674261 - DNA, 22 bp, Artificial Sequence
  chemically synthesized
gcttttatctagaatataaact

SEQ ID NO: 674262 - DNA, 22 bp, Artificial Sequence
  chemically synthesized
aaatacaggtttgcttttatct

SEQ ID NO: 674263 - DNA, 22 bp, Artificial Sequence
  chemically synthesized
aaaatacaggtttgcttttatc

SEQ ID NO: 674264 - DNA, 22 bp, Artificial Sequence
  chemically synthesized
atattctagataaaagcaaacc

SEQ ID NO: 674265 - DNA, 22 bp, Artificial Sequence
  chemically synthesized
tattctagataaaagcaaacct

SEQ ID NO: 674266 - DNA, 22 bp, Artificial Sequence
  chemically synthesized
tagataaaagcaaacctgtatt

SEQ ID NO: 674267 - DNA, 22 bp, Artificial Sequence
  chemically synthesized
gataaaagcaaacctgtatttt

SEQ ID NO: 674268 - DNA, 22 bp, Artificial Sequence
  chemically synthesized
tattttaaacttatcacattat

SEQ ID NO: 674269 - DNA, 22 bp, Artificial Sequence
  chemically synthesized
aatataatgtatataatgtgat

SEQ ID NO: 674270 - DNA, 22 bp, Artificial Sequence
  chemically synthesized
taaacttatcacattatataca

SEQ ID NO: 674271 - DNA, 22 bp, Artificial Sequence
  chemically synthesized
aaacttatcacattatatacat

SEQ ID NO: 674272 - DNA, 22 bp, Artificial Sequence
  chemically synthesized
taattaaatataatgtatataa

SEQ ID NO: 674273 - DNA, 22 bp, Artificial Sequence
  chemically synthesized
aacttatcacattatatacatt

SEQ ID NO: 674274 - DNA, 22 bp, Artificial Sequence
  chemically synthesized
atcacattatatacattatatt

SEQ ID NO: 674275 - DNA, 22 bp, Artificial Sequence
  chemically synthesized
tcacattatatacattatattt

SEQ ID NO: 674276 - DNA, 22 bp, Artificial Sequence
  chemically synthesized
gcaccccctataattaaatata

SEQ ID NO: 674277 - DNA, 22 bp, Artificial Sequence
  chemically synthesized
tcgcaccccctataattaaata

SEQ ID NO: 674278 - DNA, 22 bp, Artificial Sequence
  chemically synthesized
tatacattatatttaattatag

SEQ ID NO: 674279 - DNA, 22 bp, Artificial Sequence
  chemically synthesized
atgtctctcgcaccccctataa

SEQ ID NO: 674280 - DNA, 22 bp, Artificial Sequence
  chemically synthesized
aatgtctctcgcaccccctata

SEQ ID NO: 674281 - DNA, 22 bp, Artificial Sequence
  chemically synthesized
tatttaattatagggggtgcga

SEQ ID NO: 674282 - DNA, 22 bp, Artificial Sequence
  chemically synthesized
gtttaatgtctctcgcaccccc

SEQ ID NO: 674283 - DNA, 22 bp, Artificial Sequence
  chemically synthesized
cctagtttaatgtctctcgcac

SEQ ID NO: 674284 - DNA, 22 bp, Artificial Sequence
  chemically synthesized
aattatagggggtgcgagagac

SEQ ID NO: 674285 - DNA, 22 bp, Artificial Sequence
  chemically synthesized
attatagggggtgcgagagaca

SEQ ID NO: 674286 - DNA, 22 bp, Artificial Sequence
  chemically synthesized
ctgcctagtttaatgtctctcg

SEQ ID NO: 674287 - DNA, 22 bp, Artificial Sequence
  chemically synthesized
tagggggtgcgagagacattaa

SEQ ID NO: 674288 - DNA, 22 bp, Artificial Sequence
  chemically synthesized
agcggcagagccactgctgcct

SEQ ID NO: 674289 - DNA, 22 bp, Artificial Sequence
  chemically synthesized
aactaggcagcagtggctctgc

SEQ ID NO: 674290 - DNA, 22 bp, Artificial Sequence
  chemically synthesized
ggcagcagtggctctgccgctt

SEQ ID NO: 674291 - DNA, 22 bp, Artificial Sequence
  chemically synthesized
caggaaggaaccagagattaag

SEQ ID NO: 674292 - DNA, 22 bp, Artificial Sequence
  chemically synthesized
tgttacaggaaggaaccagaga

SEQ ID NO: 674293 - DNA, 22 bp, Artificial Sequence
  chemically synthesized
tgccgcttaatctctggttcct

SEQ ID NO: 674294 - DNA, 22 bp, Artificial Sequence
  chemically synthesized
ccgcttaatctctggttccttc

SEQ ID NO: 674295 - DNA, 22 bp, Artificial Sequence
  chemically synthesized
aatctctggttccttcctgtaa

SEQ ID NO: 674296 - DNA, 22 bp, Artificial Sequence
  chemically synthesized
atctctggttccttcctgtaac

SEQ ID NO: 674297 - DNA, 22 bp, Artificial Sequence
  chemically synthesized
tggttccttcctgtaacacaat

SEQ ID NO: 674298 - DNA, 22 bp, Artificial Sequence
  chemically synthesized
gttccttcctgtaacacaatga

SEQ ID NO: 674299 - DNA, 22 bp, Artificial Sequence
  chemically synthesized
cttcctgtaacacaatgatttc

SEQ ID NO: 674300 - DNA, 22 bp, Artificial Sequence
  chemically synthesized
gaagacaaagcatagaaatcat

SEQ ID NO: 674301 - DNA, 22 bp, Artificial Sequence
  chemically synthesized
cctgtaacacaatgatttctat

SEQ ID NO: 674302 - DNA, 22 bp, Artificial Sequence
  chemically synthesized
agaagacaaagcatagaaatca

SEQ ID NO: 674303 - DNA, 22 bp, Artificial Sequence
  chemically synthesized
ctgtaacacaatgatttctatg

SEQ ID NO: 674304 - DNA, 22 bp, Artificial Sequence
  chemically synthesized
tagaagacaaagcatagaaatc

SEQ ID NO: 674305 - DNA, 22 bp, Artificial Sequence
  chemically synthesized
taacacaatgatttctatgctt

SEQ ID NO: 674306 - DNA, 22 bp, Artificial Sequence
  chemically synthesized
ttttagaagacaaagcatagaa

SEQ ID NO: 674307 - DNA, 22 bp, Artificial Sequence
  chemically synthesized
gcaattgttttagaagacaaag

SEQ ID NO: 674308 - DNA, 22 bp, Artificial Sequence
  chemically synthesized
agcaattgttttagaagacaaa

SEQ ID NO: 674309 - DNA, 22 bp, Artificial Sequence
  chemically synthesized
cttagcaattgttttagaagac

SEQ ID NO: 674310 - DNA, 22 bp, Artificial Sequence
  chemically synthesized
tccttagcaattgttttagaag

SEQ ID NO: 674311 - DNA, 22 bp, Artificial Sequence
  chemically synthesized
ctatgctttgtcttctaaaaca

SEQ ID NO: 674312 - DNA, 22 bp, Artificial Sequence
  chemically synthesized
tatgctttgtcttctaaaacaa

SEQ ID NO: 674313 - DNA, 22 bp, Artificial Sequence
  chemically synthesized
tgctttgtcttctaaaacaatt

SEQ ID NO: 674314 - DNA, 22 bp, Artificial Sequence
  chemically synthesized
gtagctctccttagcaattgtt

SEQ ID NO: 674315 - DNA, 22 bp, Artificial Sequence
  chemically synthesized
ggtagctctccttagcaattgt

SEQ ID NO: 674316 - DNA, 22 bp, Artificial Sequence
  chemically synthesized
tgtcttctaaaacaattgctaa

SEQ ID NO: 674317 - DNA, 22 bp, Artificial Sequence
  chemically synthesized
gtcttctaaaacaattgctaag

SEQ ID NO: 674318 - DNA, 22 bp, Artificial Sequence
  chemically synthesized
tcttctaaaacaattgctaagg

SEQ ID NO: 674319 - DNA, 22 bp, Artificial Sequence
  chemically synthesized
ccacttggtagctctccttagc

SEQ ID NO: 674320 - DNA, 22 bp, Artificial Sequence
  chemically synthesized
ctaaaacaattgctaaggagag

SEQ ID NO: 674321 - DNA, 22 bp, Artificial Sequence
  chemically synthesized
cccacttggtagctctccttag

SEQ ID NO: 674322 - DNA, 22 bp, Artificial Sequence
  chemically synthesized
taaaacaattgctaaggagagc

SEQ ID NO: 674323 - DNA, 22 bp, Artificial Sequence
  chemically synthesized
tcccacttggtagctctcctta

SEQ ID NO: 674324 - DNA, 22 bp, Artificial Sequence
  chemically synthesized
aaacaattgctaaggagagcta

SEQ ID NO: 674325 - DNA, 22 bp, Artificial Sequence
  chemically synthesized
tttcccacttggtagctctcct

SEQ ID NO: 674326 - DNA, 22 bp, Artificial Sequence
  chemically synthesized
ctttcccacttggtagctctcc

SEQ ID NO: 674327 - DNA, 22 bp, Artificial Sequence
  chemically synthesized
tctttcccacttggtagctctc

SEQ ID NO: 674328 - DNA, 22 bp, Artificial Sequence
  chemically synthesized
ttttctttcccacttggtagct

SEQ ID NO: 674329 - DNA, 22 bp, Artificial Sequence
  chemically synthesized
ctaaggagagctaccaagtggg

SEQ ID NO: 674330 - DNA, 22 bp, Artificial Sequence
  chemically synthesized
aggagagctaccaagtgggaaa

SEQ ID NO: 674331 - DNA, 22 bp, Artificial Sequence
  chemically synthesized
ccaagtgggaaagaaaatagat

SEQ ID NO: 674332 - DNA, 22 bp, Artificial Sequence
  chemically synthesized
aggcagaggagggatctatttt

SEQ ID NO: 674333 - DNA, 22 bp, Artificial Sequence
  chemically synthesized
agtcaagttcaggcagaggagg

SEQ ID NO: 674334 - DNA, 22 bp, Artificial Sequence
  chemically synthesized
ccagttgagtcaagttcaggca

SEQ ID NO: 674335 - DNA, 22 bp, Artificial Sequence
  chemically synthesized
gccagttgagtcaagttcaggc

SEQ ID NO: 674336 - DNA, 22 bp, Artificial Sequence
  chemically synthesized
tgccagttgagtcaagttcagg

SEQ ID NO: 674337 - DNA, 22 bp, Artificial Sequence
  chemically synthesized
atgttttgccagttgagtcaag

SEQ ID NO: 674338 - DNA, 22 bp, Artificial Sequence
  chemically synthesized
ctctgcctgaacttgactcaac

SEQ ID NO: 674339 - DNA, 22 bp, Artificial Sequence
  chemically synthesized
aatgttttgccagttgagtcaa

SEQ ID NO: 674340 - DNA, 22 bp, Artificial Sequence
  chemically synthesized
tgcctgaacttgactcaactgg

SEQ ID NO: 674341 - DNA, 22 bp, Artificial Sequence
  chemically synthesized
cctgaacttgactcaactggca

SEQ ID NO: 674342 - DNA, 22 bp, Artificial Sequence
  chemically synthesized
tgcggtttaatgttttgccagt

SEQ ID NO: 674343 - DNA, 22 bp, Artificial Sequence
  chemically synthesized
aacttgactcaactggcaaaac

SEQ ID NO: 674344 - DNA, 22 bp, Artificial Sequence
  chemically synthesized
atgcggtttaatgttttgccag

SEQ ID NO: 674345 - DNA, 22 bp, Artificial Sequence
  chemically synthesized
tttatgcggtttaatgttttgc

SEQ ID NO: 674346 - DNA, 22 bp, Artificial Sequence
  chemically synthesized
gactcaactggcaaaacattaa

SEQ ID NO: 674347 - DNA, 22 bp, Artificial Sequence
  chemically synthesized
actcaactggcaaaacattaaa

SEQ ID NO: 674348 - DNA, 22 bp, Artificial Sequence
  chemically synthesized
aactggcaaaacattaaaccgc

SEQ ID NO: 674349 - DNA, 22 bp, Artificial Sequence
  chemically synthesized
aaaatgttatttatgcggttta

SEQ ID NO: 674350 - DNA, 22 bp, Artificial Sequence
  chemically synthesized
gcaaaacattaaaccgcataaa

SEQ ID NO: 674351 - DNA, 22 bp, Artificial Sequence
  chemically synthesized
aaccgcataaataacattttca

SEQ ID NO: 674352 - DNA, 22 bp, Artificial Sequence
  chemically synthesized
accaaacaggaacacctgaaaa

SEQ ID NO: 674353 - DNA, 22 bp, Artificial Sequence
  chemically synthesized
tcaggtgttcctgtttggttaa

SEQ ID NO: 674354 - DNA, 22 bp, Artificial Sequence
  chemically synthesized
caggtgttcctgtttggttaat

SEQ ID NO: 674355 - DNA, 22 bp, Artificial Sequence
  chemically synthesized
aggtgttcctgtttggttaatt

SEQ ID NO: 674356 - DNA, 22 bp, Artificial Sequence
  chemically synthesized
aggtcgggggaggataattaac

SEQ ID NO: 674357 - DNA, 22 bp, Artificial Sequence
  chemically synthesized
ctgtttggttaattatcctccc

SEQ ID NO: 674358 - DNA, 22 bp, Artificial Sequence
  chemically synthesized
tttggttaattatcctcccccg

SEQ ID NO: 674359 - DNA, 22 bp, Artificial Sequence
  chemically synthesized
ggttaattatcctcccccgacc

SEQ ID NO: 674360 - DNA, 22 bp, Artificial Sequence
  chemically synthesized
gttaattatcctcccccgacct

SEQ ID NO: 674361 - DNA, 22 bp, Artificial Sequence
  chemically synthesized
aaatcaagtgactcaggtcggg

SEQ ID NO: 674362 - DNA, 22 bp, Artificial Sequence
  chemically synthesized
attatcctcccccgacctgagt

SEQ ID NO: 674363 - DNA, 22 bp, Artificial Sequence
  chemically synthesized
tcctcccccgacctgagtcact

SEQ ID NO: 674364 - DNA, 22 bp, Artificial Sequence
  chemically synthesized
ccccgacctgagtcacttgatt

SEQ ID NO: 674365 - DNA, 22 bp, Artificial Sequence
  chemically synthesized
aaagtataaatgtaaactcaaa

SEQ ID NO: 674366 - DNA, 22 bp, Artificial Sequence
  chemically synthesized
gaaagtataaatgtaaactcaa

SEQ ID NO: 674367 - DNA, 22 bp, Artificial Sequence
  chemically synthesized
agtcacttgatttgagtttaca

SEQ ID NO: 674368 - DNA, 22 bp, Artificial Sequence
  chemically synthesized
tgaaagtataaatgtaaactca

SEQ ID NO: 674369 - DNA, 22 bp, Artificial Sequence
  chemically synthesized
ttgaaagtataaatgtaaactc

SEQ ID NO: 674370 - DNA, 22 bp, Artificial Sequence
  chemically synthesized
atttttgaaagtataaatgtaa

SEQ ID NO: 674371 - DNA, 22 bp, Artificial Sequence
  chemically synthesized
aatttttgaaagtataaatgta

SEQ ID NO: 674372 - DNA, 22 bp, Artificial Sequence
  chemically synthesized
gatttgagtttacatttatact

SEQ ID NO: 674373 - DNA, 22 bp, Artificial Sequence
  chemically synthesized
atttgagtttacatttatactt

SEQ ID NO: 674374 - DNA, 22 bp, Artificial Sequence
  chemically synthesized
gagtttacatttatactttcaa

SEQ ID NO: 674375 - DNA, 22 bp, Artificial Sequence
  chemically synthesized
agtttacatttatactttcaaa

SEQ ID NO: 674376 - DNA, 22 bp, Artificial Sequence
  chemically synthesized
gagcacttaatttttgaaagta

SEQ ID NO: 674377 - DNA, 22 bp, Artificial Sequence
  chemically synthesized
tagagcacttaatttttgaaag

SEQ ID NO: 674378 - DNA, 22 bp, Artificial Sequence
  chemically synthesized
acatttatactttcaaaaatta

SEQ ID NO: 674379 - DNA, 22 bp, Artificial Sequence
  chemically synthesized
ttctagagcacttaatttttga

SEQ ID NO: 674380 - DNA, 22 bp, Artificial Sequence
  chemically synthesized
catttatactttcaaaaattaa

SEQ ID NO: 674381 - DNA, 22 bp, Artificial Sequence
  chemically synthesized
atactttcaaaaattaagtgct

SEQ ID NO: 674382 - DNA, 22 bp, Artificial Sequence
  chemically synthesized
tactttcaaaaattaagtgctc

SEQ ID NO: 674383 - DNA, 22 bp, Artificial Sequence
  chemically synthesized
agtagcactgttctagagcact

SEQ ID NO: 674384 - DNA, 22 bp, Artificial Sequence
  chemically synthesized
gagtagcactgttctagagcac

SEQ ID NO: 674385 - DNA, 22 bp, Artificial Sequence
  chemically synthesized
tcaaaaattaagtgctctagaa

SEQ ID NO: 674386 - DNA, 22 bp, Artificial Sequence
  chemically synthesized
tgagtagcactgttctagagca

SEQ ID NO: 674387 - DNA, 22 bp, Artificial Sequence
  chemically synthesized
caaaaattaagtgctctagaac

SEQ ID NO: 674388 - DNA, 22 bp, Artificial Sequence
  chemically synthesized
aaaaattaagtgctctagaaca

SEQ ID NO: 674389 - DNA, 22 bp, Artificial Sequence
  chemically synthesized
agtgctctagaacagtgctact

SEQ ID NO: 674390 - DNA, 22 bp, Artificial Sequence
  chemically synthesized
tgaaagaccatattttgagtag

SEQ ID NO: 674391 - DNA, 22 bp, Artificial Sequence
  chemically synthesized
gtgaaagaccatattttgagta

SEQ ID NO: 674392 - DNA, 22 bp, Artificial Sequence
  chemically synthesized
tagaacagtgctactcaaaata

SEQ ID NO: 674393 - DNA, 22 bp, Artificial Sequence
  chemically synthesized
gaacagtgctactcaaaatatg

SEQ ID NO: 674394 - DNA, 22 bp, Artificial Sequence
  chemically synthesized
tgcttgtgaaagaccatatttt

SEQ ID NO: 674395 - DNA, 22 bp, Artificial Sequence
  chemically synthesized
ctcaaaatatggtctttcacaa

SEQ ID NO: 674396 - DNA, 22 bp, Artificial Sequence
  chemically synthesized
tccatatctatgcttgtgaaag

SEQ ID NO: 674397 - DNA, 22 bp, Artificial Sequence
  chemically synthesized
aaaatatggtctttcacaagca

SEQ ID NO: 674398 - DNA, 22 bp, Artificial Sequence
  chemically synthesized
acacactgtccatatctatgct

SEQ ID NO: 674399 - DNA, 22 bp, Artificial Sequence
  chemically synthesized
aacacactgtccatatctatgc

SEQ ID NO: 674400 - DNA, 22 bp, Artificial Sequence
  chemically synthesized
cttaacacactgtccatatcta

SEQ ID NO: 674401 - DNA, 22 bp, Artificial Sequence
  chemically synthesized
tcacaagcatagatatggacag

SEQ ID NO: 674402 - DNA, 22 bp, Artificial Sequence
  chemically synthesized
cacaagcatagatatggacagt

SEQ ID NO: 674403 - DNA, 22 bp, Artificial Sequence
  chemically synthesized
acaagcatagatatggacagtg

SEQ ID NO: 674404 - DNA, 22 bp, Artificial Sequence
  chemically synthesized
tagaagttacttaacacactgt

SEQ ID NO: 674405 - DNA, 22 bp, Artificial Sequence
  chemically synthesized
ctatagaagttacttaacacac

SEQ ID NO: 674406 - DNA, 22 bp, Artificial Sequence
  chemically synthesized
agtaacttctatagcaatttga

SEQ ID NO: 674407 - DNA, 22 bp, Artificial Sequence
  chemically synthesized
gatgtcatggcaatgtcaaatt

SEQ ID NO: 674408 - DNA, 22 bp, Artificial Sequence
  chemically synthesized
ggatgtcatggcaatgtcaaat

SEQ ID NO: 674409 - DNA, 22 bp, Artificial Sequence
  chemically synthesized
ctatagcaatttgacattgcca

SEQ ID NO: 674410 - DNA, 22 bp, Artificial Sequence
  chemically synthesized
tatagcaatttgacattgccat

SEQ ID NO: 674411 - DNA, 22 bp, Artificial Sequence
  chemically synthesized
tagcaatttgacattgccatga

SEQ ID NO: 674412 - DNA, 22 bp, Artificial Sequence
  chemically synthesized
atcatgaatttggatgtcatgg

SEQ ID NO: 674413 - DNA, 22 bp, Artificial Sequence
  chemically synthesized
attgatcatgaatttggatgtc

SEQ ID NO: 674414 - DNA, 22 bp, Artificial Sequence
  chemically synthesized
gacattgccatgacatccaaat

SEQ ID NO: 674415 - DNA, 22 bp, Artificial Sequence
  chemically synthesized
acattgccatgacatccaaatt

SEQ ID NO: 674416 - DNA, 22 bp, Artificial Sequence
  chemically synthesized
ccatgacatccaaattcatgat

SEQ ID NO: 674417 - DNA, 22 bp, Artificial Sequence
  chemically synthesized
catgagatgaattcattgatca

SEQ ID NO: 674418 - DNA, 22 bp, Artificial Sequence
  chemically synthesized
ctccatgagatgaattcattga

SEQ ID NO: 674419 - DNA, 22 bp, Artificial Sequence
  chemically synthesized
taccctgctccatgagatgaat

SEQ ID NO: 674420 - DNA, 22 bp, Artificial Sequence
  chemically synthesized
atgatcaatgaattcatctcat

SEQ ID NO: 674421 - DNA, 22 bp, Artificial Sequence
  chemically synthesized
gtctgtaccctgctccatgaga

SEQ ID NO: 674422 - DNA, 22 bp, Artificial Sequence
  chemically synthesized
acctcgtctgtaccctgctcca

SEQ ID NO: 674423 - DNA, 22 bp, Artificial Sequence
  chemically synthesized
gacctcgtctgtaccctgctcc

SEQ ID NO: 674424 - DNA, 22 bp, Artificial Sequence
  chemically synthesized
atctcatggagcagggtacaga

SEQ ID NO: 674425 - DNA, 22 bp, Artificial Sequence
  chemically synthesized
atggagcagggtacagacgagg

SEQ ID NO: 674426 - DNA, 22 bp, Artificial Sequence
  chemically synthesized
aacaacacttgacctcgtctgt

SEQ ID NO: 674427 - DNA, 22 bp, Artificial Sequence
  chemically synthesized
aacagtcaagttcaacaacact

SEQ ID NO: 674428 - DNA, 22 bp, Artificial Sequence
  chemically synthesized
acaccacatgtaactcaacagt

SEQ ID NO: 674429 - DNA, 22 bp, Artificial Sequence
  chemically synthesized
ttgaacttgactgttgagttac

SEQ ID NO: 674430 - DNA, 22 bp, Artificial Sequence
  chemically synthesized
aacttgactgttgagttacatg

SEQ ID NO: 674431 - DNA, 22 bp, Artificial Sequence
  chemically synthesized
gactgttgagttacatgtggtg

SEQ ID NO: 674432 - DNA, 22 bp, Artificial Sequence
  chemically synthesized
actgttgagttacatgtggtgt

SEQ ID NO: 674433 - DNA, 22 bp, Artificial Sequence
  chemically synthesized
acaagtatgcattcacaccaca

SEQ ID NO: 674434 - DNA, 22 bp, Artificial Sequence
  chemically synthesized
ttgagttacatgtggtgtgaat

SEQ ID NO: 674435 - DNA, 22 bp, Artificial Sequence
  chemically synthesized
agttacatgtggtgtgaatgca

SEQ ID NO: 674436 - DNA, 22 bp, Artificial Sequence
  chemically synthesized
atgaaactgacaagtatgcatt

SEQ ID NO: 674437 - DNA, 22 bp, Artificial Sequence
  chemically synthesized
catgtggtgtgaatgcatactt

SEQ ID NO: 674438 - DNA, 22 bp, Artificial Sequence
  chemically synthesized
ggtggtgctaatgaaactgaca

SEQ ID NO: 674439 - DNA, 22 bp, Artificial Sequence
  chemically synthesized
aggtggtgctaatgaaactgac

SEQ ID NO: 674440 - DNA, 22 bp, Artificial Sequence
  chemically synthesized
taggtggtgctaatgaaactga

SEQ ID NO: 674441 - DNA, 22 bp, Artificial Sequence
  chemically synthesized
ttaggtggtgctaatgaaactg

SEQ ID NO: 674442 - DNA, 22 bp, Artificial Sequence
  chemically synthesized
gtcagtttcattagcaccacct

SEQ ID NO: 674443 - DNA, 22 bp, Artificial Sequence
  chemically synthesized
tcagtttcattagcaccaccta

SEQ ID NO: 674444 - DNA, 22 bp, Artificial Sequence
  chemically synthesized
cacatcacagatttttaggtgg

SEQ ID NO: 674445 - DNA, 22 bp, Artificial Sequence
  chemically synthesized
cattagcaccacctaaaaatct

SEQ ID NO: 674446 - DNA, 22 bp, Artificial Sequence
  chemically synthesized
attagcaccacctaaaaatctg

SEQ ID NO: 674447 - DNA, 22 bp, Artificial Sequence
  chemically synthesized
acatactacacatcacagattt

SEQ ID NO: 674448 - DNA, 22 bp, Artificial Sequence
  chemically synthesized
gcaccacctaaaaatctgtgat

SEQ ID NO: 674449 - DNA, 22 bp, Artificial Sequence
  chemically synthesized
aacatactacacatcacagatt

SEQ ID NO: 674450 - DNA, 22 bp, Artificial Sequence
  chemically synthesized
taacatactacacatcacagat

SEQ ID NO: 674451 - DNA, 22 bp, Artificial Sequence
  chemically synthesized
ttaacatactacacatcacaga

SEQ ID NO: 674452 - DNA, 22 bp, Artificial Sequence
  chemically synthesized
aaaatctgtgatgtgtagtatg

SEQ ID NO: 674453 - DNA, 22 bp, Artificial Sequence
  chemically synthesized
tgatgtgtagtatgttaaaaac

SEQ ID NO: 674454 - DNA, 22 bp, Artificial Sequence
  chemically synthesized
cacccagccgcggtggtggttt

SEQ ID NO: 674455 - DNA, 22 bp, Artificial Sequence
  chemically synthesized
aaaaccaccaccgcggctgggt

SEQ ID NO: 674456 - DNA, 22 bp, Artificial Sequence
  chemically synthesized
caggcgtgaaccactgcaccca

SEQ ID NO: 674457 - DNA, 22 bp, Artificial Sequence
  chemically synthesized
ggattacaggcgtgaaccactg

SEQ ID NO: 674458 - DNA, 22 bp, Artificial Sequence
  chemically synthesized
ctgggattacaggcgtgaacca

SEQ ID NO: 674459 - DNA, 22 bp, Artificial Sequence
  chemically synthesized
ggtgcagtggttcacgcctgta

SEQ ID NO: 674460 - DNA, 22 bp, Artificial Sequence
  chemically synthesized
ccaaactgctgggattacaggc

SEQ ID NO: 674461 - DNA, 22 bp, Artificial Sequence
  chemically synthesized
cgcctcccaaactgctgggatt

SEQ ID NO: 674462 - DNA, 22 bp, Artificial Sequence
  chemically synthesized
acgcctgtaatcccagcagttt

SEQ ID NO: 674463 - DNA, 22 bp, Artificial Sequence
  chemically synthesized
ccagcctccgcctcccaaactg

SEQ ID NO: 674464 - DNA, 22 bp, Artificial Sequence
  chemically synthesized
taatcccagcagtttgggaggc

SEQ ID NO: 674465 - DNA, 22 bp, Artificial Sequence
  chemically synthesized
atgatctgccagcctccgcctc

SEQ ID NO: 674466 - DNA, 22 bp, Artificial Sequence
  chemically synthesized
acctcatgatctgccagcctcc

SEQ ID NO: 674467 - DNA, 22 bp, Artificial Sequence
  chemically synthesized
gacctcatgatctgccagcctc

SEQ ID NO: 674468 - DNA, 22 bp, Artificial Sequence
  chemically synthesized
ttgacctcatgatctgccagcc

SEQ ID NO: 674469 - DNA, 22 bp, Artificial Sequence
  chemically synthesized
gggaggcggaggctggcagatc

SEQ ID NO: 674470 - DNA, 22 bp, Artificial Sequence
  chemically synthesized
ggaggcggaggctggcagatca

SEQ ID NO: 674471 - DNA, 22 bp, Artificial Sequence
  chemically synthesized
gatctcttgacctcatgatctg

SEQ ID NO: 674472 - DNA, 22 bp, Artificial Sequence
  chemically synthesized
ggatggtctcgatctcttgacc

SEQ ID NO: 674473 - DNA, 22 bp, Artificial Sequence
  chemically synthesized
gcagatcatgaggtcaagagat

SEQ ID NO: 674474 - DNA, 22 bp, Artificial Sequence
  chemically synthesized
gctaggatggtctcgatctctt

SEQ ID NO: 674475 - DNA, 22 bp, Artificial Sequence
  chemically synthesized
accatgttggctaggatggtct

SEQ ID NO: 674476 - DNA, 22 bp, Artificial Sequence
  chemically synthesized
caccatgttggctaggatggtc

SEQ ID NO: 674477 - DNA, 22 bp, Artificial Sequence
  chemically synthesized
gtagagacggggtttcaccatg

SEQ ID NO: 674478 - DNA, 22 bp, Artificial Sequence
  chemically synthesized
agtagagacggggtttcaccat

SEQ ID NO: 674479 - DNA, 22 bp, Artificial Sequence
  chemically synthesized
tagtagagacggggtttcacca

SEQ ID NO: 674480 - DNA, 22 bp, Artificial Sequence
  chemically synthesized
ttagtagagacggggtttcacc

SEQ ID NO: 674481 - DNA, 22 bp, Artificial Sequence
  chemically synthesized
gccaacatggtgaaaccccgtc

SEQ ID NO: 674482 - DNA, 22 bp, Artificial Sequence
  chemically synthesized
catttttagtagagacggggtt

SEQ ID NO: 674483 - DNA, 22 bp, Artificial Sequence
  chemically synthesized
gcatttttagtagagacggggt

SEQ ID NO: 674484 - DNA, 22 bp, Artificial Sequence
  chemically synthesized
tgcatttttagtagagacgggg

SEQ ID NO: 674485 - DNA, 22 bp, Artificial Sequence
  chemically synthesized
ttgcatttttagtagagacggg

SEQ ID NO: 674486 - DNA, 22 bp, Artificial Sequence
  chemically synthesized
atttttgcatttttagtagaga

SEQ ID NO: 674487 - DNA, 22 bp, Artificial Sequence
  chemically synthesized
tactaaaaatgcaaaaattagc

SEQ ID NO: 674488 - DNA, 22 bp, Artificial Sequence
  chemically synthesized
ctaaaaatgcaaaaattagctg

SEQ ID NO: 674489 - DNA, 22 bp, Artificial Sequence
  chemically synthesized
aaaatgcaaaaattagctgggt

SEQ ID NO: 674490 - DNA, 22 bp, Artificial Sequence
  chemically synthesized
caggtgtgcaccaccacaccca

SEQ ID NO: 674491 - DNA, 22 bp, Artificial Sequence
  chemically synthesized
ggattacaggtgtgcaccacca

SEQ ID NO: 674492 - DNA, 22 bp, Artificial Sequence
  chemically synthesized
gctgggtgtggtggtgcacacc

SEQ ID NO: 674493 - DNA, 22 bp, Artificial Sequence
  chemically synthesized
ggtgtggtggtgcacacctgta

SEQ ID NO: 674494 - DNA, 22 bp, Artificial Sequence
  chemically synthesized
ccgagtagctgggattacaggt

SEQ ID NO: 674495 - DNA, 22 bp, Artificial Sequence
  chemically synthesized
agcctcccgagtagctgggatt

SEQ ID NO: 674496 - DNA, 22 bp, Artificial Sequence
  chemically synthesized
cctcagcctcccgagtagctgg

SEQ ID NO: 674497 - DNA, 22 bp, Artificial Sequence
  chemically synthesized
ctgcctcagcctcccgagtagc

SEQ ID NO: 674498 - DNA, 22 bp, Artificial Sequence
  chemically synthesized
cctgcctcagcctcccgagtag

SEQ ID NO: 674499 - DNA, 22 bp, Artificial Sequence
  chemically synthesized
tcctgcctcagcctcccgagta

SEQ ID NO: 674500 - DNA, 22 bp, Artificial Sequence
  chemically synthesized
taatcccagctactcgggaggc

SEQ ID NO: 674501 - DNA, 22 bp, Artificial Sequence
  chemically synthesized
aagcgattttcctgcctcagcc

SEQ ID NO: 674502 - DNA, 22 bp, Artificial Sequence
  chemically synthesized
ctcgggaggctgaggcaggaaa

SEQ ID NO: 674503 - DNA, 22 bp, Artificial Sequence
  chemically synthesized
gggaggctgaggcaggaaaatc

SEQ ID NO: 674504 - DNA, 22 bp, Artificial Sequence
  chemically synthesized
ccgggttcaagcgattttcctg

SEQ ID NO: 674505 - DNA, 22 bp, Artificial Sequence
  chemically synthesized
cctcccgggttcaagcgatttt

SEQ ID NO: 674506 - DNA, 22 bp, Artificial Sequence
  chemically synthesized
tgcctcccgggttcaagcgatt

SEQ ID NO: 674507 - DNA, 22 bp, Artificial Sequence
  chemically synthesized
aggcaggaaaatcgcttgaacc

SEQ ID NO: 674508 - DNA, 22 bp, Artificial Sequence
  chemically synthesized
caaactctgcctcccgggttca

SEQ ID NO: 674509 - DNA, 22 bp, Artificial Sequence
  chemically synthesized
actgcaaactctgcctcccggg

SEQ ID NO: 674510 - DNA, 22 bp, Artificial Sequence
  chemically synthesized
gctcactgcaaactctgcctcc

SEQ ID NO: 674511 - DNA, 22 bp, Artificial Sequence
  chemically synthesized
agctcactgcaaactctgcctc

SEQ ID NO: 674512 - DNA, 22 bp, Artificial Sequence
  chemically synthesized
tagctcactgcaaactctgcct

SEQ ID NO: 674513 - DNA, 22 bp, Artificial Sequence
  chemically synthesized
gaacccgggaggcagagtttgc

SEQ ID NO: 674514 - DNA, 22 bp, Artificial Sequence
  chemically synthesized
aacccgggaggcagagtttgca

SEQ ID NO: 674515 - DNA, 22 bp, Artificial Sequence
  chemically synthesized
gagtgcagtggtgcgattttag

SEQ ID NO: 674516 - DNA, 22 bp, Artificial Sequence
  chemically synthesized
gcagtgagctaaaatcgcacca

SEQ ID NO: 674517 - DNA, 22 bp, Artificial Sequence
  chemically synthesized
cagtgagctaaaatcgcaccac

SEQ ID NO: 674518 - DNA, 22 bp, Artificial Sequence
  chemically synthesized
ccaggctggagtgcagtggtgc

SEQ ID NO: 674519 - DNA, 22 bp, Artificial Sequence
  chemically synthesized
ttgccaggctggagtgcagtgg

SEQ ID NO: 674520 - DNA, 22 bp, Artificial Sequence
  chemically synthesized
tgttgccaggctggagtgcagt

SEQ ID NO: 674521 - DNA, 22 bp, Artificial Sequence
  chemically synthesized
aaatcgcaccactgcactccag

SEQ ID NO: 674522 - DNA, 22 bp, Artificial Sequence
  chemically synthesized
ctctgttgccaggctggagtgc

SEQ ID NO: 674523 - DNA, 22 bp, Artificial Sequence
  chemically synthesized
gctctgttgccaggctggagtg

SEQ ID NO: 674524 - DNA, 22 bp, Artificial Sequence
  chemically synthesized
cactccagcctggcaacagagc

SEQ ID NO: 674525 - DNA, 22 bp, Artificial Sequence
  chemically synthesized
agacagagtcttgctctgttgc

SEQ ID NO: 674526 - DNA, 22 bp, Artificial Sequence
  chemically synthesized
gagacagagtcttgctctgttg

SEQ ID NO: 674527 - DNA, 22 bp, Artificial Sequence
  chemically synthesized
tgagacagagtcttgctctgtt

SEQ ID NO: 674528 - DNA, 22 bp, Artificial Sequence
  chemically synthesized
ttgagacagagtcttgctctgt

SEQ ID NO: 674529 - DNA, 22 bp, Artificial Sequence
  chemically synthesized
tttgagacagagtcttgctctg

SEQ ID NO: 674530 - DNA, 22 bp, Artificial Sequence
  chemically synthesized
cagcctggcaacagagcaagac

SEQ ID NO: 674531 - DNA, 22 bp, Artificial Sequence
  chemically synthesized
ttttgagacagagtcttgctct

SEQ ID NO: 674532 - DNA, 22 bp, Artificial Sequence
  chemically synthesized
tttttttgagacagagtcttgc

SEQ ID NO: 674533 - DNA, 22 bp, Artificial Sequence
  chemically synthesized
gtttttttgagacagagtcttg

SEQ ID NO: 674534 - DNA, 22 bp, Artificial Sequence
  chemically synthesized
tgtttttttgagacagagtctt

SEQ ID NO: 674535 - DNA, 22 bp, Artificial Sequence
  chemically synthesized
ttgtttttttgagacagagtct

SEQ ID NO: 674536 - DNA, 22 bp, Artificial Sequence
  chemically synthesized
gcaacagagcaagactctgtct

SEQ ID NO: 674537 - DNA, 22 bp, Artificial Sequence
  chemically synthesized
tttgtttttttgagacagagtc

SEQ ID NO: 674538 - DNA, 22 bp, Artificial Sequence
  chemically synthesized
ttttgtttttttgagacagagt

SEQ ID NO: 674539 - DNA, 22 bp, Artificial Sequence
  chemically synthesized
tttttgtttttttgagacagag

SEQ ID NO: 674540 - DNA, 22 bp, Artificial Sequence
  chemically synthesized
ttttttgtttttttgagacaga

SEQ ID NO: 674541 - DNA, 22 bp, Artificial Sequence
  chemically synthesized
tttttttgtttttttgagacag

SEQ ID NO: 674542 - DNA, 22 bp, Artificial Sequence
  chemically synthesized
ttttttttgtttttttgagaca

SEQ ID NO: 674543 - DNA, 22 bp, Artificial Sequence
  chemically synthesized
gtggtgggtttttttttttgtt

SEQ ID NO: 674544 - DNA, 22 bp, Artificial Sequence
  chemically synthesized
tgtctcaaaaaaacaaaaaaaa

SEQ ID NO: 674545 - DNA, 22 bp, Artificial Sequence
  chemically synthesized
tctcaaaaaaacaaaaaaaaaa

SEQ ID NO: 674546 - DNA, 22 bp, Artificial Sequence
  chemically synthesized
ttggtggtgggttttttttttt

SEQ ID NO: 674547 - DNA, 22 bp, Artificial Sequence
  chemically synthesized
gttggtggtgggtttttttttt

SEQ ID NO: 674548 - DNA, 22 bp, Artificial Sequence
  chemically synthesized
tgttggtggtgggttttttttt

SEQ ID NO: 674549 - DNA, 22 bp, Artificial Sequence
  chemically synthesized
ttgttggtggtgggtttttttt

SEQ ID NO: 674550 - DNA, 22 bp, Artificial Sequence
  chemically synthesized
aaaaaaacaaaaaaaaaaaccc

SEQ ID NO: 674551 - DNA, 22 bp, Artificial Sequence
  chemically synthesized
gtgaagggccaggtttttgttg

SEQ ID NO: 674552 - DNA, 22 bp, Artificial Sequence
  chemically synthesized
aaactggtgaagggccaggttt

SEQ ID NO: 674553 - DNA, 22 bp, Artificial Sequence
  chemically synthesized
tcaaactggtgaagggccaggt

SEQ ID NO: 674554 - DNA, 22 bp, Artificial Sequence
  chemically synthesized
ctcaaactggtgaagggccagg

SEQ ID NO: 674555 - DNA, 22 bp, Artificial Sequence
  chemically synthesized
aagagcagtgcttctcaaactg

SEQ ID NO: 674556 - DNA, 22 bp, Artificial Sequence
  chemically synthesized
gcccttcaccagtttgagaagc

SEQ ID NO: 674557 - DNA, 22 bp, Artificial Sequence
  chemically synthesized
tcactgaagagcagtgcttctc

SEQ ID NO: 674558 - DNA, 22 bp, Artificial Sequence
  chemically synthesized
caccagtttgagaagcactgct

SEQ ID NO: 674559 - DNA, 22 bp, Artificial Sequence
  chemically synthesized
accagtttgagaagcactgctc

SEQ ID NO: 674560 - DNA, 22 bp, Artificial Sequence
  chemically synthesized
gagaagcactgctcttcagtga

SEQ ID NO: 674561 - DNA, 22 bp, Artificial Sequence
  chemically synthesized
agaagcactgctcttcagtgat

SEQ ID NO: 674562 - DNA, 22 bp, Artificial Sequence
  chemically synthesized
gaaaaaaaaaaaaagaagctat

SEQ ID NO: 674563 - DNA, 22 bp, Artificial Sequence
  chemically synthesized
agaaaaaaaaaaaaagaagcta

SEQ ID NO: 674564 - DNA, 22 bp, Artificial Sequence
  chemically synthesized
ctcttcagtgatagcttctttt

SEQ ID NO: 674565 - DNA, 22 bp, Artificial Sequence
  chemically synthesized
ttcagtgatagcttcttttttt

SEQ ID NO: 674566 - DNA, 22 bp, Artificial Sequence
  chemically synthesized
tcttagaaaaaaaaaaaaagaa

SEQ ID NO: 674567 - DNA, 22 bp, Artificial Sequence
  chemically synthesized
cagtgatagcttcttttttttt

SEQ ID NO: 674568 - DNA, 22 bp, Artificial Sequence
  chemically synthesized
agtgatagcttctttttttttt

SEQ ID NO: 674569 - DNA, 22 bp, Artificial Sequence
  chemically synthesized
ctttttttttttttctaagaca

SEQ ID NO: 674570 - DNA, 22 bp, Artificial Sequence
  chemically synthesized
tttttttttttttctaagacaa

SEQ ID NO: 674571 - DNA, 22 bp, Artificial Sequence
  chemically synthesized
tttttttttttctaagacaacg

SEQ ID NO: 674572 - DNA, 22 bp, Artificial Sequence
  chemically synthesized
ttttttttttctaagacaacgt

SEQ ID NO: 674573 - DNA, 22 bp, Artificial Sequence
  chemically synthesized
tttttttttctaagacaacgtc

SEQ ID NO: 674574 - DNA, 22 bp, Artificial Sequence
  chemically synthesized
ttttttttctaagacaacgtct

SEQ ID NO: 674575 - DNA, 22 bp, Artificial Sequence
  chemically synthesized
ggcaatatagcaagacgttgtc

SEQ ID NO: 674576 - DNA, 22 bp, Artificial Sequence
  chemically synthesized
tttttttctaagacaacgtctt

SEQ ID NO: 674577 - DNA, 22 bp, Artificial Sequence
  chemically synthesized
ttttttctaagacaacgtcttg

SEQ ID NO: 674578 - DNA, 22 bp, Artificial Sequence
  chemically synthesized
tttttctaagacaacgtcttgc

SEQ ID NO: 674579 - DNA, 22 bp, Artificial Sequence
  chemically synthesized
ttttctaagacaacgtcttgct

SEQ ID NO: 674580 - DNA, 22 bp, Artificial Sequence
  chemically synthesized
tttctaagacaacgtcttgcta

SEQ ID NO: 674581 - DNA, 22 bp, Artificial Sequence
  chemically synthesized
ttctaagacaacgtcttgctat

SEQ ID NO: 674582 - DNA, 22 bp, Artificial Sequence
  chemically synthesized
tctaagacaacgtcttgctata

SEQ ID NO: 674583 - DNA, 22 bp, Artificial Sequence
  chemically synthesized
ctaagacaacgtcttgctatat

SEQ ID NO: 674584 - DNA, 22 bp, Artificial Sequence
  chemically synthesized
taagacaacgtcttgctatatt

SEQ ID NO: 674585 - DNA, 22 bp, Artificial Sequence
  chemically synthesized
agacaacgtcttgctatattgc

SEQ ID NO: 674586 - DNA, 22 bp, Artificial Sequence
  chemically synthesized
agtccagcctgggcaatatagc

SEQ ID NO: 674587 - DNA, 22 bp, Artificial Sequence
  chemically synthesized
gagtccagcctgggcaatatag

SEQ ID NO: 674588 - DNA, 22 bp, Artificial Sequence
  chemically synthesized
gctatattgcccaggctggact

SEQ ID NO: 674589 - DNA, 22 bp, Artificial Sequence
  chemically synthesized
ctatattgcccaggctggactc

SEQ ID NO: 674590 - DNA, 22 bp, Artificial Sequence
  chemically synthesized
agcccaggaatttgagtccagc

SEQ ID NO: 674591 - DNA, 22 bp, Artificial Sequence
  chemically synthesized
gagcccaggaatttgagtccag

SEQ ID NO: 674592 - DNA, 22 bp, Artificial Sequence
  chemically synthesized
tattgcccaggctggactcaaa

SEQ ID NO: 674593 - DNA, 22 bp, Artificial Sequence
  chemically synthesized
cccaggctggactcaaattcct

SEQ ID NO: 674594 - DNA, 22 bp, Artificial Sequence
  chemically synthesized
gactcaaattcctgggctcaag

SEQ ID NO: 674595 - DNA, 22 bp, Artificial Sequence
  chemically synthesized
aggcagaaggatcccttgagcc

SEQ ID NO: 674596 - DNA, 22 bp, Artificial Sequence
  chemically synthesized
aaattcctgggctcaagggatc

SEQ ID NO: 674597 - DNA, 22 bp, Artificial Sequence
  chemically synthesized
ctgggctcaagggatccttctg

SEQ ID NO: 674598 - DNA, 22 bp, Artificial Sequence
  chemically synthesized
cagaggctgaggcagaaggatc

SEQ ID NO: 674599 - DNA, 22 bp, Artificial Sequence
  chemically synthesized
ccagaggctgaggcagaaggat

SEQ ID NO: 674600 - DNA, 22 bp, Artificial Sequence
  chemically synthesized
ggctcaagggatccttctgcct

SEQ ID NO: 674601 - DNA, 22 bp, Artificial Sequence
  chemically synthesized
aagggatccttctgcctcagcc

SEQ ID NO: 674602 - DNA, 22 bp, Artificial Sequence
  chemically synthesized
tagtcccagcgcttccagaggc

SEQ ID NO: 674603 - DNA, 22 bp, Artificial Sequence
  chemically synthesized
ctgcctcagcctctggaagcgc

SEQ ID NO: 674604 - DNA, 22 bp, Artificial Sequence
  chemically synthesized
tgcctcagcctctggaagcgct

SEQ ID NO: 674605 - DNA, 22 bp, Artificial Sequence
  chemically synthesized
cctcagcctctggaagcgctgg

SEQ ID NO: 674606 - DNA, 22 bp, Artificial Sequence
  chemically synthesized
agcctctggaagcgctgggact

SEQ ID NO: 674607 - DNA, 22 bp, Artificial Sequence
  chemically synthesized
tggaagcgctgggactacaggt

SEQ ID NO: 674608 - DNA, 22 bp, Artificial Sequence
  chemically synthesized
gaagcgctgggactacaggtgc

SEQ ID NO: 674609 - DNA, 22 bp, Artificial Sequence
  chemically synthesized
aggccaggcatggtggcacgca

SEQ ID NO: 674610 - DNA, 22 bp, Artificial Sequence
  chemically synthesized
aaggccaggcatggtggcacgc

SEQ ID NO: 674611 - DNA, 22 bp, Artificial Sequence
  chemically synthesized
ggactacaggtgcgtgccacca

SEQ ID NO: 674612 - DNA, 22 bp, Artificial Sequence
  chemically synthesized
taaggccaggcatggtggcacg

SEQ ID NO: 674613 - DNA, 22 bp, Artificial Sequence
  chemically synthesized
caggtgcgtgccaccatgcctg

SEQ ID NO: 674614 - DNA, 22 bp, Artificial Sequence
  chemically synthesized
tcactttaaggccaggcatggt

SEQ ID NO: 674615 - DNA, 22 bp, Artificial Sequence
  chemically synthesized
taaagaggctatcactttaagg

SEQ ID NO: 674616 - DNA, 22 bp, Artificial Sequence
  chemically synthesized
gtctgtaaagaggctatcactt

SEQ ID NO: 674617 - DNA, 22 bp, Artificial Sequence
  chemically synthesized
ggtctgtaaagaggctatcact

SEQ ID NO: 674618 - DNA, 22 bp, Artificial Sequence
  chemically synthesized
ttggtctgtaaagaggctatca

SEQ ID NO: 674619 - DNA, 22 bp, Artificial Sequence
  chemically synthesized
cttggtctgtaaagaggctatc

SEQ ID NO: 674620 - DNA, 22 bp, Artificial Sequence
  chemically synthesized
tcttggtctgtaaagaggctat

SEQ ID NO: 674621 - DNA, 22 bp, Artificial Sequence
  chemically synthesized
gccttaaagtgatagcctcttt

SEQ ID NO: 674622 - DNA, 22 bp, Artificial Sequence
  chemically synthesized
ctttcttggtctgtaaagaggc

SEQ ID NO: 674623 - DNA, 22 bp, Artificial Sequence
  chemically synthesized
actttcttggtctgtaaagagg

SEQ ID NO: 674624 - DNA, 22 bp, Artificial Sequence
  chemically synthesized
tactttcttggtctgtaaagag

SEQ ID NO: 674625 - DNA, 22 bp, Artificial Sequence
  chemically synthesized
aaagtgatagcctctttacaga

SEQ ID NO: 674626 - DNA, 22 bp, Artificial Sequence
  chemically synthesized
aagtgatagcctctttacagac

SEQ ID NO: 674627 - DNA, 22 bp, Artificial Sequence
  chemically synthesized
tattttactttcttggtctgta

SEQ ID NO: 674628 - DNA, 22 bp, Artificial Sequence
  chemically synthesized
atattttactttcttggtctgt

SEQ ID NO: 674629 - DNA, 22 bp, Artificial Sequence
  chemically synthesized
tatattttactttcttggtctg

SEQ ID NO: 674630 - DNA, 22 bp, Artificial Sequence
  chemically synthesized
ttatattttactttcttggtct

SEQ ID NO: 674631 - DNA, 22 bp, Artificial Sequence
  chemically synthesized
tttttatattttactttcttgg

SEQ ID NO: 674632 - DNA, 22 bp, Artificial Sequence
  chemically synthesized
tttacagaccaagaaagtaaaa

SEQ ID NO: 674633 - DNA, 22 bp, Artificial Sequence
  chemically synthesized
tacagaccaagaaagtaaaata

SEQ ID NO: 674634 - DNA, 22 bp, Artificial Sequence
  chemically synthesized
acagaccaagaaagtaaaatat

SEQ ID NO: 674635 - DNA, 22 bp, Artificial Sequence
  chemically synthesized
cagaccaagaaagtaaaatata

SEQ ID NO: 674636 - DNA, 22 bp, Artificial Sequence
  chemically synthesized
gtaagaaagtgattgtttttat

SEQ ID NO: 674637 - DNA, 22 bp, Artificial Sequence
  chemically synthesized
ggtaagaaagtgattgttttta

SEQ ID NO: 674638 - DNA, 22 bp, Artificial Sequence
  chemically synthesized
tggtaagaaagtgattgttttt

SEQ ID NO: 674639 - DNA, 22 bp, Artificial Sequence
  chemically synthesized
attttggtaagaaagtgattgt

SEQ ID NO: 674640 - DNA, 22 bp, Artificial Sequence
  chemically synthesized
ccaagcattaattttggtaaga

SEQ ID NO: 674641 - DNA, 22 bp, Artificial Sequence
  chemically synthesized
accaagcattaattttggtaag

SEQ ID NO: 674642 - DNA, 22 bp, Artificial Sequence
  chemically synthesized
taccaagcattaattttggtaa

SEQ ID NO: 674643 - DNA, 22 bp, Artificial Sequence
  chemically synthesized
tttaccaagcattaattttggt

SEQ ID NO: 674644 - DNA, 22 bp, Artificial Sequence
  chemically synthesized
ctttaccaagcattaattttgg

SEQ ID NO: 674645 - DNA, 22 bp, Artificial Sequence
  chemically synthesized
tcttaccaaaattaatgcttgg

SEQ ID NO: 674646 - DNA, 22 bp, Artificial Sequence
  chemically synthesized
cttaccaaaattaatgcttggt

SEQ ID NO: 674647 - DNA, 22 bp, Artificial Sequence
  chemically synthesized
ttaccaaaattaatgcttggta

SEQ ID NO: 674648 - DNA, 22 bp, Artificial Sequence
  chemically synthesized
accaaaattaatgcttggtaaa

SEQ ID NO: 674649 - DNA, 22 bp, Artificial Sequence
  chemically synthesized
catacagatttctttaccaagc

SEQ ID NO: 674650 - DNA, 22 bp, Artificial Sequence
  chemically synthesized
ccaaaattaatgcttggtaaag

SEQ ID NO: 674651 - DNA, 22 bp, Artificial Sequence
  chemically synthesized
acatacagatttctttaccaag

SEQ ID NO: 674652 - DNA, 22 bp, Artificial Sequence
  chemically synthesized
atatatttacatacagatttct

SEQ ID NO: 674653 - DNA, 22 bp, Artificial Sequence
  chemically synthesized
atgcttggtaaagaaatctgta

SEQ ID NO: 674654 - DNA, 22 bp, Artificial Sequence
  chemically synthesized
tattgatatatttacatacaga

SEQ ID NO: 674655 - DNA, 22 bp, Artificial Sequence
  chemically synthesized
atattgatatatttacatacag

SEQ ID NO: 674656 - DNA, 22 bp, Artificial Sequence
  chemically synthesized
ggtaaagaaatctgtatgtaaa

SEQ ID NO: 674657 - DNA, 22 bp, Artificial Sequence
  chemically synthesized
gtaaagaaatctgtatgtaaat

SEQ ID NO: 674658 - DNA, 22 bp, Artificial Sequence
  chemically synthesized
cttatattgatatatttacata

SEQ ID NO: 674659 - DNA, 22 bp, Artificial Sequence
  chemically synthesized
tatgtaaatatatcaatataag

SEQ ID NO: 674660 - DNA, 22 bp, Artificial Sequence
  chemically synthesized
tataacggagacaaatgttgct

SEQ ID NO: 674661 - DNA, 22 bp, Artificial Sequence
  chemically synthesized
atataacggagacaaatgttgc

SEQ ID NO: 674662 - DNA, 22 bp, Artificial Sequence
  chemically synthesized
ataaatagaagcttatataacg

SEQ ID NO: 674663 - DNA, 22 bp, Artificial Sequence
  chemically synthesized
gtctccgttatataagcttcta

SEQ ID NO: 674664 - DNA, 22 bp, Artificial Sequence
  chemically synthesized
tctccgttatataagcttctat

SEQ ID NO: 674665 - DNA, 22 bp, Artificial Sequence
  chemically synthesized
caccccctcataaatagaagct

SEQ ID NO: 674666 - DNA, 22 bp, Artificial Sequence
  chemically synthesized
cgttatataagcttctatttat

SEQ ID NO: 674667 - DNA, 22 bp, Artificial Sequence
  chemically synthesized
tataagcttctatttatgaggg

SEQ ID NO: 674668 - DNA, 22 bp, Artificial Sequence
  chemically synthesized
caggaaagtcattacaccccct

SEQ ID NO: 674669 - DNA, 22 bp, Artificial Sequence
  chemically synthesized
ctatttatgagggggtgtaatg

SEQ ID NO: 674670 - DNA, 22 bp, Artificial Sequence
  chemically synthesized
tatttatgagggggtgtaatga

SEQ ID NO: 674671 - DNA, 22 bp, Artificial Sequence
  chemically synthesized
tttatgagggggtgtaatgact

SEQ ID NO: 674672 - DNA, 22 bp, Artificial Sequence
  chemically synthesized
cataactccaggaaagtcatta

SEQ ID NO: 674673 - DNA, 22 bp, Artificial Sequence
  chemically synthesized
atgagggggtgtaatgactttc

SEQ ID NO: 674674 - DNA, 22 bp, Artificial Sequence
  chemically synthesized
gcataactccaggaaagtcatt

SEQ ID NO: 674675 - DNA, 22 bp, Artificial Sequence
  chemically synthesized
tgagggggtgtaatgactttcc

SEQ ID NO: 674676 - DNA, 22 bp, Artificial Sequence
  chemically synthesized
atcgcttgcataactccaggaa

SEQ ID NO: 674677 - DNA, 22 bp, Artificial Sequence
  chemically synthesized
cacaaagcgttcatcgcttgca

SEQ ID NO: 674678 - DNA, 22 bp, Artificial Sequence
  chemically synthesized
tcctggagttatgcaagcgatg

SEQ ID NO: 674679 - DNA, 22 bp, Artificial Sequence
  chemically synthesized
cctggagttatgcaagcgatga

SEQ ID NO: 674680 - DNA, 22 bp, Artificial Sequence
  chemically synthesized
ctggagttatgcaagcgatgaa

SEQ ID NO: 674681 - DNA, 22 bp, Artificial Sequence
  chemically synthesized
ttccacaaagcgttcatcgctt

SEQ ID NO: 674682 - DNA, 22 bp, Artificial Sequence
  chemically synthesized
gagttatgcaagcgatgaacgc

SEQ ID NO: 674683 - DNA, 22 bp, Artificial Sequence
  chemically synthesized
ctattccacaaagcgttcatcg

SEQ ID NO: 674684 - DNA, 22 bp, Artificial Sequence
  chemically synthesized
gctattccacaaagcgttcatc

SEQ ID NO: 674685 - DNA, 22 bp, Artificial Sequence
  chemically synthesized
tgcaagcgatgaacgctttgtg

SEQ ID NO: 674686 - DNA, 22 bp, Artificial Sequence
  chemically synthesized
aaaatttgctattccacaaagc

SEQ ID NO: 674687 - DNA, 22 bp, Artificial Sequence
  chemically synthesized
caaaatttgctattccacaaag

SEQ ID NO: 674688 - DNA, 22 bp, Artificial Sequence
  chemically synthesized
tgggaatgtttcaaaatttgct

SEQ ID NO: 674689 - DNA, 22 bp, Artificial Sequence
  chemically synthesized
tgtgggaatgtttcaaaatttg

SEQ ID NO: 674690 - DNA, 22 bp, Artificial Sequence
  chemically synthesized
tgtggaatagcaaattttgaaa

SEQ ID NO: 674691 - DNA, 22 bp, Artificial Sequence
  chemically synthesized
gtggaatagcaaattttgaaac

SEQ ID NO: 674692 - DNA, 22 bp, Artificial Sequence
  chemically synthesized
tggaatagcaaattttgaaaca

SEQ ID NO: 674693 - DNA, 22 bp, Artificial Sequence
  chemically synthesized
gtgatattctgtgggaatgttt

SEQ ID NO: 674694 - DNA, 22 bp, Artificial Sequence
  chemically synthesized
tgaattggtgatattctgtggg

SEQ ID NO: 674695 - DNA, 22 bp, Artificial Sequence
  chemically synthesized
atgaattggtgatattctgtgg

SEQ ID NO: 674696 - DNA, 22 bp, Artificial Sequence
  chemically synthesized
tgaaacattcccacagaatatc

SEQ ID NO: 674697 - DNA, 22 bp, Artificial Sequence
  chemically synthesized
gaaacattcccacagaatatca

SEQ ID NO: 674698 - DNA, 22 bp, Artificial Sequence
  chemically synthesized
tttatgaattggtgatattctg

SEQ ID NO: 674699 - DNA, 22 bp, Artificial Sequence
  chemically synthesized
aaacattcccacagaatatcac

SEQ ID NO: 674700 - DNA, 22 bp, Artificial Sequence
  chemically synthesized
atttatgaattggtgatattct

SEQ ID NO: 674701 - DNA, 22 bp, Artificial Sequence
  chemically synthesized
gcttatttatgaattggtgata

SEQ ID NO: 674702 - DNA, 22 bp, Artificial Sequence
  chemically synthesized
ccacagaatatcaccaattcat

SEQ ID NO: 674703 - DNA, 22 bp, Artificial Sequence
  chemically synthesized
tgacatagtggatgaatcatta

SEQ ID NO: 674704 - DNA, 22 bp, Artificial Sequence
  chemically synthesized
atgacatagtggatgaatcatt

SEQ ID NO: 674705 - DNA, 22 bp, Artificial Sequence
  chemically synthesized
ataaataagctaatgattcatc

SEQ ID NO: 674706 - DNA, 22 bp, Artificial Sequence
  chemically synthesized
ttatgacatagtggatgaatca

SEQ ID NO: 674707 - DNA, 22 bp, Artificial Sequence
  chemically synthesized
tcttatgacatagtggatgaat

SEQ ID NO: 674708 - DNA, 22 bp, Artificial Sequence
  chemically synthesized
aaagtctctcttatgacatagt

SEQ ID NO: 674709 - DNA, 22 bp, Artificial Sequence
  chemically synthesized
atgattcatccactatgtcata

SEQ ID NO: 674710 - DNA, 22 bp, Artificial Sequence
  chemically synthesized
tgaaagtctctcttatgacata

SEQ ID NO: 674711 - DNA, 22 bp, Artificial Sequence
  chemically synthesized
atccactatgtcataagagaga

SEQ ID NO: 674712 - DNA, 22 bp, Artificial Sequence
  chemically synthesized
aaaatattctgaaagtctctct

SEQ ID NO: 674713 - DNA, 22 bp, Artificial Sequence
  chemically synthesized
tgtcataagagagactttcaga

SEQ ID NO: 674714 - DNA, 22 bp, Artificial Sequence
  chemically synthesized
cggtagtaataaaatgacctaa

SEQ ID NO: 674715 - DNA, 22 bp, Artificial Sequence
  chemically synthesized
tcagaatatttttaggtcattt

SEQ ID NO: 674716 - DNA, 22 bp, Artificial Sequence
  chemically synthesized
cagaatatttttaggtcatttt

SEQ ID NO: 674717 - DNA, 22 bp, Artificial Sequence
  chemically synthesized
tacggtagtaataaaatgacct

SEQ ID NO: 674718 - DNA, 22 bp, Artificial Sequence
  chemically synthesized
agaatatttttaggtcatttta

SEQ ID NO: 674719 - DNA, 22 bp, Artificial Sequence
  chemically synthesized
taccctctacggtagtaataaa

SEQ ID NO: 674720 - DNA, 22 bp, Artificial Sequence
  chemically synthesized
ttaggtcattttattactaccg

SEQ ID NO: 674721 - DNA, 22 bp, Artificial Sequence
  chemically synthesized
taggtcattttattactaccgt

SEQ ID NO: 674722 - DNA, 22 bp, Artificial Sequence
  chemically synthesized
aggtcattttattactaccgta

SEQ ID NO: 674723 - DNA, 22 bp, Artificial Sequence
  chemically synthesized
ggtcattttattactaccgtag

SEQ ID NO: 674724 - DNA, 22 bp, Artificial Sequence
  chemically synthesized
aagtctgtaccctctacggtag

SEQ ID NO: 674725 - DNA, 22 bp, Artificial Sequence
  chemically synthesized
aaagtctgtaccctctacggta

SEQ ID NO: 674726 - DNA, 22 bp, Artificial Sequence
  chemically synthesized
taaagtctgtaccctctacggt

SEQ ID NO: 674727 - DNA, 22 bp, Artificial Sequence
  chemically synthesized
ttaaagtctgtaccctctacgg

SEQ ID NO: 674728 - DNA, 22 bp, Artificial Sequence
  chemically synthesized
tattactaccgtagagggtaca

SEQ ID NO: 674729 - DNA, 22 bp, Artificial Sequence
  chemically synthesized
attactaccgtagagggtacag

SEQ ID NO: 674730 - DNA, 22 bp, Artificial Sequence
  chemically synthesized
ttactaccgtagagggtacaga

SEQ ID NO: 674731 - DNA, 22 bp, Artificial Sequence
  chemically synthesized
ctaccgtagagggtacagactt

SEQ ID NO: 674732 - DNA, 22 bp, Artificial Sequence
  chemically synthesized
ccgtagagggtacagactttaa

SEQ ID NO: 674733 - DNA, 22 bp, Artificial Sequence
  chemically synthesized
acataaaatagatagtttttaa

SEQ ID NO: 674734 - DNA, 22 bp, Artificial Sequence
  chemically synthesized
taaaaactatctattttatgtg

SEQ ID NO: 674735 - DNA, 22 bp, Artificial Sequence
  chemically synthesized
aaaaactatctattttatgtga

SEQ ID NO: 674736 - DNA, 22 bp, Artificial Sequence
  chemically synthesized
aaaactatctattttatgtgag

SEQ ID NO: 674737 - DNA, 22 bp, Artificial Sequence
  chemically synthesized
agaacagtcagagcactcacat

SEQ ID NO: 674738 - DNA, 22 bp, Artificial Sequence
  chemically synthesized
tctattttatgtgagtgctctg

SEQ ID NO: 674739 - DNA, 22 bp, Artificial Sequence
  chemically synthesized
ttttatgtgagtgctctgactg

SEQ ID NO: 674740 - DNA, 22 bp, Artificial Sequence
  chemically synthesized
tatgtgagtgctctgactgttc

SEQ ID NO: 674741 - DNA, 22 bp, Artificial Sequence
  chemically synthesized
gaaagagattcagaacagtcag

SEQ ID NO: 674742 - DNA, 22 bp, Artificial Sequence
  chemically synthesized
atgtgagtgctctgactgttct

SEQ ID NO: 674743 - DNA, 22 bp, Artificial Sequence
  chemically synthesized
tgtgagtgctctgactgttctg

SEQ ID NO: 674744 - DNA, 22 bp, Artificial Sequence
  chemically synthesized
ctggaaagagattcagaacagt

SEQ ID NO: 674745 - DNA, 22 bp, Artificial Sequence
  chemically synthesized
gctggaaagagattcagaacag

SEQ ID NO: 674746 - DNA, 22 bp, Artificial Sequence
  chemically synthesized
tgctggaaagagattcagaaca

SEQ ID NO: 674747 - DNA, 22 bp, Artificial Sequence
  chemically synthesized
caattttgctggaaagagattc

SEQ ID NO: 674748 - DNA, 22 bp, Artificial Sequence
  chemically synthesized
tgactgttctgaatctctttcc

SEQ ID NO: 674749 - DNA, 22 bp, Artificial Sequence
  chemically synthesized
actgttctgaatctctttccag

SEQ ID NO: 674750 - DNA, 22 bp, Artificial Sequence
  chemically synthesized
ggagctgcaattttgctggaaa

SEQ ID NO: 674751 - DNA, 22 bp, Artificial Sequence
  chemically synthesized
ttctgaatctctttccagcaaa

SEQ ID NO: 674752 - DNA, 22 bp, Artificial Sequence
  chemically synthesized
gggagctgcaattttgctggaa

SEQ ID NO: 674753 - DNA, 22 bp, Artificial Sequence
  chemically synthesized
ttgggagctgcaattttgctgg

SEQ ID NO: 674754 - DNA, 22 bp, Artificial Sequence
  chemically synthesized
tgaatctctttccagcaaaatt

SEQ ID NO: 674755 - DNA, 22 bp, Artificial Sequence
  chemically synthesized
aatctctttccagcaaaattgc

SEQ ID NO: 674756 - DNA, 22 bp, Artificial Sequence
  chemically synthesized
tatgtctcttgggagctgcaat

SEQ ID NO: 674757 - DNA, 22 bp, Artificial Sequence
  chemically synthesized
tttccagcaaaattgcagctcc

SEQ ID NO: 674758 - DNA, 22 bp, Artificial Sequence
  chemically synthesized
tgtatgtctcttgggagctgca

SEQ ID NO: 674759 - DNA, 22 bp, Artificial Sequence
  chemically synthesized
tccagcaaaattgcagctccca

SEQ ID NO: 674760 - DNA, 22 bp, Artificial Sequence
  chemically synthesized
ccagcaaaattgcagctcccaa

SEQ ID NO: 674761 - DNA, 22 bp, Artificial Sequence
  chemically synthesized
cagcaaaattgcagctcccaag

SEQ ID NO: 674762 - DNA, 22 bp, Artificial Sequence
  chemically synthesized
cctctgtatgtctcttgggagc

SEQ ID NO: 674763 - DNA, 22 bp, Artificial Sequence
  chemically synthesized
attacctctgtatgtctcttgg

SEQ ID NO: 674764 - DNA, 22 bp, Artificial Sequence
  chemically synthesized
cagctcccaagagacatacaga

SEQ ID NO: 674765 - DNA, 22 bp, Artificial Sequence
  chemically synthesized
ccaagagacatacagaggtaat

SEQ ID NO: 674766 - DNA, 22 bp, Artificial Sequence
  chemically synthesized
agcccacaagtctgattacctc

SEQ ID NO: 674767 - DNA, 22 bp, Artificial Sequence
  chemically synthesized
aagcccacaagtctgattacct

SEQ ID NO: 674768 - DNA, 22 bp, Artificial Sequence
  chemically synthesized
taagcccacaagtctgattacc

SEQ ID NO: 674769 - DNA, 22 bp, Artificial Sequence
  chemically synthesized
ttaagcccacaagtctgattac

SEQ ID NO: 674770 - DNA, 22 bp, Artificial Sequence
  chemically synthesized
tttaagcccacaagtctgatta

SEQ ID NO: 674771 - DNA, 22 bp, Artificial Sequence
  chemically synthesized
ttttaagcccacaagtctgatt

SEQ ID NO: 674772 - DNA, 22 bp, Artificial Sequence
  chemically synthesized
ttttttaagcccacaagtctga

SEQ ID NO: 674773 - DNA, 22 bp, Artificial Sequence
  chemically synthesized
cttttttaagcccacaagtctg

SEQ ID NO: 674774 - DNA, 22 bp, Artificial Sequence
  chemically synthesized
caatatttcttttttaagccca

SEQ ID NO: 674775 - DNA, 22 bp, Artificial Sequence
  chemically synthesized
ccaatatttcttttttaagccc

SEQ ID NO: 674776 - DNA, 22 bp, Artificial Sequence
  chemically synthesized
agacatttccaatatttctttt

SEQ ID NO: 674777 - DNA, 22 bp, Artificial Sequence
  chemically synthesized
gtgggcttaaaaaagaaatatt

SEQ ID NO: 674778 - DNA, 22 bp, Artificial Sequence
  chemically synthesized
tgggcttaaaaaagaaatattg

SEQ ID NO: 674779 - DNA, 22 bp, Artificial Sequence
  chemically synthesized
ttcagacatttccaatatttct

SEQ ID NO: 674780 - DNA, 22 bp, Artificial Sequence
  chemically synthesized
attcagacatttccaatatttc

SEQ ID NO: 674781 - DNA, 22 bp, Artificial Sequence
  chemically synthesized
ttattcagacatttccaatatt

SEQ ID NO: 674782 - DNA, 22 bp, Artificial Sequence
  chemically synthesized
ctcttattcagacatttccaat

SEQ ID NO: 674783 - DNA, 22 bp, Artificial Sequence
  chemically synthesized
aaaaaagaaatattggaaatgt

SEQ ID NO: 674784 - DNA, 22 bp, Artificial Sequence
  chemically synthesized
aaaaagaaatattggaaatgtc

SEQ ID NO: 674785 - DNA, 22 bp, Artificial Sequence
  chemically synthesized
aaaacgtgtctgctcttattca

SEQ ID NO: 674786 - DNA, 22 bp, Artificial Sequence
  chemically synthesized
gaaatgtctgaataagagcaga

SEQ ID NO: 674787 - DNA, 22 bp, Artificial Sequence
  chemically synthesized
aataagagcagacacgttttta

SEQ ID NO: 674788 - DNA, 22 bp, Artificial Sequence
  chemically synthesized
cacacagagtaaaggcatctaa

SEQ ID NO: 674789 - DNA, 22 bp, Artificial Sequence
  chemically synthesized
gcacacagagtaaaggcatcta

SEQ ID NO: 674790 - DNA, 22 bp, Artificial Sequence
  chemically synthesized
tgcacacagagtaaaggcatct

SEQ ID NO: 674791 - DNA, 22 bp, Artificial Sequence
  chemically synthesized
ttgcacacagagtaaaggcatc

SEQ ID NO: 674792 - DNA, 22 bp, Artificial Sequence
  chemically synthesized
ttagatgcctttactctgtgtg

SEQ ID NO: 674793 - DNA, 22 bp, Artificial Sequence
  chemically synthesized
tagatgcctttactctgtgtgc

SEQ ID NO: 674794 - DNA, 22 bp, Artificial Sequence
  chemically synthesized
agatgcctttactctgtgtgca

SEQ ID NO: 674795 - DNA, 22 bp, Artificial Sequence
  chemically synthesized
gatgcctttactctgtgtgcaa

SEQ ID NO: 674796 - DNA, 22 bp, Artificial Sequence
  chemically synthesized
cagaagatgatttttgcacaca

SEQ ID NO: 674797 - DNA, 22 bp, Artificial Sequence
  chemically synthesized
gatctgcagaagatgatttttg

SEQ ID NO: 674798 - DNA, 22 bp, Artificial Sequence
  chemically synthesized
tactctgtgtgcaaaaatcatc

SEQ ID NO: 674799 - DNA, 22 bp, Artificial Sequence
  chemically synthesized
actctgtgtgcaaaaatcatct

SEQ ID NO: 674800 - DNA, 22 bp, Artificial Sequence
  chemically synthesized
ctctgtgtgcaaaaatcatctt

SEQ ID NO: 674801 - DNA, 22 bp, Artificial Sequence
  chemically synthesized
tgtgtgcaaaaatcatcttctg

SEQ ID NO: 674802 - DNA, 22 bp, Artificial Sequence
  chemically synthesized
tgtgcaaaaatcatcttctgca

SEQ ID NO: 674803 - DNA, 22 bp, Artificial Sequence
  chemically synthesized
tgtagctggatctgcagaagat

SEQ ID NO: 674804 - DNA, 22 bp, Artificial Sequence
  chemically synthesized
atgtagctggatctgcagaaga

SEQ ID NO: 674805 - DNA, 22 bp, Artificial Sequence
  chemically synthesized
tatgtagctggatctgcagaag

SEQ ID NO: 674806 - DNA, 22 bp, Artificial Sequence
  chemically synthesized
gatatgtacaattttatgtagc

SEQ ID NO: 674807 - DNA, 22 bp, Artificial Sequence
  chemically synthesized
ctgcagatccagctacataaaa

SEQ ID NO: 674808 - DNA, 22 bp, Artificial Sequence
  chemically synthesized
tgcagatccagctacataaaat

SEQ ID NO: 674809 - DNA, 22 bp, Artificial Sequence
  chemically synthesized
cagatccagctacataaaattg

SEQ ID NO: 674810 - DNA, 22 bp, Artificial Sequence
  chemically synthesized
gaagaaaagtgctggatatgta

SEQ ID NO: 674811 - DNA, 22 bp, Artificial Sequence
  chemically synthesized
cataaaattgtacatatccagc

SEQ ID NO: 674812 - DNA, 22 bp, Artificial Sequence
  chemically synthesized
cagctagaagaaaagtgctgga

SEQ ID NO: 674813 - DNA, 22 bp, Artificial Sequence
  chemically synthesized
tacatatccagcacttttcttc

SEQ ID NO: 674814 - DNA, 22 bp, Artificial Sequence
  chemically synthesized
cacctgcagctagaagaaaagt

SEQ ID NO: 674815 - DNA, 22 bp, Artificial Sequence
  chemically synthesized
aggttacacctgcagctagaag

SEQ ID NO: 674816 - DNA, 22 bp, Artificial Sequence
  chemically synthesized
ttcttctagctgcaggtgtaac

SEQ ID NO: 674817 - DNA, 22 bp, Artificial Sequence
  chemically synthesized
tcttctagctgcaggtgtaacc

SEQ ID NO: 674818 - DNA, 22 bp, Artificial Sequence
  chemically synthesized
cttctagctgcaggtgtaacct

SEQ ID NO: 674819 - DNA, 22 bp, Artificial Sequence
  chemically synthesized
ttctagctgcaggtgtaacctt

SEQ ID NO: 674820 - DNA, 22 bp, Artificial Sequence
  chemically synthesized
ctagctgcaggtgtaaccttaa

SEQ ID NO: 674821 - DNA, 22 bp, Artificial Sequence
  chemically synthesized
tagctgcaggtgtaaccttaat

SEQ ID NO: 674822 - DNA, 22 bp, Artificial Sequence
  chemically synthesized
aataagaggaacattaaggtta

SEQ ID NO: 674823 - DNA, 22 bp, Artificial Sequence
  chemically synthesized
gctgcaggtgtaaccttaatgt

SEQ ID NO: 674824 - DNA, 22 bp, Artificial Sequence
  chemically synthesized
atctaaataagaggaacattaa

SEQ ID NO: 674825 - DNA, 22 bp, Artificial Sequence
  chemically synthesized
caggtgtaaccttaatgttcct

SEQ ID NO: 674826 - DNA, 22 bp, Artificial Sequence
  chemically synthesized
ctgatctaaataagaggaacat

SEQ ID NO: 674827 - DNA, 22 bp, Artificial Sequence
  chemically synthesized
actgatctaaataagaggaaca

SEQ ID NO: 674828 - DNA, 22 bp, Artificial Sequence
  chemically synthesized
tagtttactgatctaaataaga

SEQ ID NO: 674829 - DNA, 22 bp, Artificial Sequence
  chemically synthesized
aatgttcctcttatttagatca

SEQ ID NO: 674830 - DNA, 22 bp, Artificial Sequence
  chemically synthesized
atgttcctcttatttagatcag

SEQ ID NO: 674831 - DNA, 22 bp, Artificial Sequence
  chemically synthesized
ccaaattgtagtttactgatct

SEQ ID NO: 674832 - DNA, 22 bp, Artificial Sequence
  chemically synthesized
ctcttatttagatcagtaaact

SEQ ID NO: 674833 - DNA, 22 bp, Artificial Sequence
  chemically synthesized
ttatttagatcagtaaactaca

SEQ ID NO: 674834 - DNA, 22 bp, Artificial Sequence
  chemically synthesized
atttagatcagtaaactacaat

SEQ ID NO: 674835 - DNA, 22 bp, Artificial Sequence
  chemically synthesized
tttagatcagtaaactacaatt

SEQ ID NO: 674836 - DNA, 22 bp, Artificial Sequence
  chemically synthesized
aaagagctgccaaattgtagtt

SEQ ID NO: 674837 - DNA, 22 bp, Artificial Sequence
  chemically synthesized
aaaagagctgccaaattgtagt

SEQ ID NO: 674838 - DNA, 22 bp, Artificial Sequence
  chemically synthesized
taaaagagctgccaaattgtag

SEQ ID NO: 674839 - DNA, 22 bp, Artificial Sequence
  chemically synthesized
agatcagtaaactacaatttgg

SEQ ID NO: 674840 - DNA, 22 bp, Artificial Sequence
  chemically synthesized
gatcagtaaactacaatttggc

SEQ ID NO: 674841 - DNA, 22 bp, Artificial Sequence
  chemically synthesized
cagttttaaaagagctgccaaa

SEQ ID NO: 674842 - DNA, 22 bp, Artificial Sequence
  chemically synthesized
acagttttaaaagagctgccaa

SEQ ID NO: 674843 - DNA, 22 bp, Artificial Sequence
  chemically synthesized
gtttacagttttaaaagagctg

SEQ ID NO: 674844 - DNA, 22 bp, Artificial Sequence
  chemically synthesized
caatttggcagctcttttaaaa

SEQ ID NO: 674845 - DNA, 22 bp, Artificial Sequence
  chemically synthesized
actggtttacagttttaaaaga

SEQ ID NO: 674846 - DNA, 22 bp, Artificial Sequence
  chemically synthesized
gactggtttacagttttaaaag

SEQ ID NO: 674847 - DNA, 22 bp, Artificial Sequence
  chemically synthesized
tgactggtttacagttttaaaa

SEQ ID NO: 674848 - DNA, 22 bp, Artificial Sequence
  chemically synthesized
ggcagctcttttaaaactgtaa

SEQ ID NO: 674849 - DNA, 22 bp, Artificial Sequence
  chemically synthesized
gcagctcttttaaaactgtaaa

SEQ ID NO: 674850 - DNA, 22 bp, Artificial Sequence
  chemically synthesized
gactttgactggtttacagttt

SEQ ID NO: 674851 - DNA, 22 bp, Artificial Sequence
  chemically synthesized
agactttgactggtttacagtt

SEQ ID NO: 674852 - DNA, 22 bp, Artificial Sequence
  chemically synthesized
cttagactttgactggtttaca

SEQ ID NO: 674853 - DNA, 22 bp, Artificial Sequence
  chemically synthesized
ttttaaaactgtaaaccagtca

SEQ ID NO: 674854 - DNA, 22 bp, Artificial Sequence
  chemically synthesized
ttccttagactttgactggttt

SEQ ID NO: 674855 - DNA, 22 bp, Artificial Sequence
  chemically synthesized
ttaaaactgtaaaccagtcaaa

SEQ ID NO: 674856 - DNA, 22 bp, Artificial Sequence
  chemically synthesized
taaaactgtaaaccagtcaaag

SEQ ID NO: 674857 - DNA, 22 bp, Artificial Sequence
  chemically synthesized
aaaactgtaaaccagtcaaagt

SEQ ID NO: 674858 - DNA, 22 bp, Artificial Sequence
  chemically synthesized
aaactgtaaaccagtcaaagtc

SEQ ID NO: 674859 - DNA, 22 bp, Artificial Sequence
  chemically synthesized
taaaccagtcaaagtctaagga

SEQ ID NO: 674860 - DNA, 22 bp, Artificial Sequence
  chemically synthesized
aaaaagaattgttccttagact

SEQ ID NO: 674861 - DNA, 22 bp, Artificial Sequence
  chemically synthesized
agaaggaaactcaaaaagaatt

SEQ ID NO: 674862 - DNA, 22 bp, Artificial Sequence
  chemically synthesized
cagaaggaaactcaaaaagaat

SEQ ID NO: 674863 - DNA, 22 bp, Artificial Sequence
  chemically synthesized
tttcagaaggaaactcaaaaag

SEQ ID NO: 674864 - DNA, 22 bp, Artificial Sequence
  chemically synthesized
atttcagaaggaaactcaaaaa

SEQ ID NO: 674865 - DNA, 22 bp, Artificial Sequence
  chemically synthesized
aggaacaattctttttgagttt

SEQ ID NO: 674866 - DNA, 22 bp, Artificial Sequence
  chemically synthesized
caagcttatttcagaaggaaac

SEQ ID NO: 674867 - DNA, 22 bp, Artificial Sequence
  chemically synthesized
tccaagcttatttcagaaggaa

SEQ ID NO: 674868 - DNA, 22 bp, Artificial Sequence
  chemically synthesized
tttttgagtttccttctgaaat

SEQ ID NO: 674869 - DNA, 22 bp, Artificial Sequence
  chemically synthesized
tttgagtttccttctgaaataa

SEQ ID NO: 674870 - DNA, 22 bp, Artificial Sequence
  chemically synthesized
ttgagtttccttctgaaataag

SEQ ID NO: 674871 - DNA, 22 bp, Artificial Sequence
  chemically synthesized
catctctccaagcttatttcag

SEQ ID NO: 674872 - DNA, 22 bp, Artificial Sequence
  chemically synthesized
tgagtttccttctgaaataagc

SEQ ID NO: 674873 - DNA, 22 bp, Artificial Sequence
  chemically synthesized
gagtttccttctgaaataagct

SEQ ID NO: 674874 - DNA, 22 bp, Artificial Sequence
  chemically synthesized
agtttccttctgaaataagctt

SEQ ID NO: 674875 - DNA, 22 bp, Artificial Sequence
  chemically synthesized
aattgcatctctccaagcttat

SEQ ID NO: 674876 - DNA, 22 bp, Artificial Sequence
  chemically synthesized
tgaattgcatctctccaagctt

SEQ ID NO: 674877 - DNA, 22 bp, Artificial Sequence
  chemically synthesized
ccttctgaaataagcttggaga

SEQ ID NO: 674878 - DNA, 22 bp, Artificial Sequence
  chemically synthesized
ctgaattgcatctctccaagct

SEQ ID NO: 674879 - DNA, 22 bp, Artificial Sequence
  chemically synthesized
cttctgaaataagcttggagag

SEQ ID NO: 674880 - DNA, 22 bp, Artificial Sequence
  chemically synthesized
ctgaaataagcttggagagatg

SEQ ID NO: 674881 - DNA, 22 bp, Artificial Sequence
  chemically synthesized
tgaaataagcttggagagatgc

SEQ ID NO: 674882 - DNA, 22 bp, Artificial Sequence
  chemically synthesized
aaataagcttggagagatgcaa

SEQ ID NO: 674883 - DNA, 22 bp, Artificial Sequence
  chemically synthesized
ggagagatgcaattcagaaata

SEQ ID NO: 674884 - DNA, 22 bp, Artificial Sequence
  chemically synthesized
gagagatgcaattcagaaatat

SEQ ID NO: 674885 - DNA, 22 bp, Artificial Sequence
  chemically synthesized
aagaacataatagatatttctg

SEQ ID NO: 674886 - DNA, 22 bp, Artificial Sequence
  chemically synthesized
attgaagaacataatagatatt

SEQ ID NO: 674887 - DNA, 22 bp, Artificial Sequence
  chemically synthesized
taattgaagaacataatagata

SEQ ID NO: 674888 - DNA, 22 bp, Artificial Sequence
  chemically synthesized
ctaattgaagaacataatagat

SEQ ID NO: 674889 - DNA, 22 bp, Artificial Sequence
  chemically synthesized
agaaatatctattatgttcttc

SEQ ID NO: 674890 - DNA, 22 bp, Artificial Sequence
  chemically synthesized
aagcttctaattgaagaacata

SEQ ID NO: 674891 - DNA, 22 bp, Artificial Sequence
  chemically synthesized
aaagcttctaattgaagaacat

SEQ ID NO: 674892 - DNA, 22 bp, Artificial Sequence
  chemically synthesized
atttaaagcttctaattgaaga

SEQ ID NO: 674893 - DNA, 22 bp, Artificial Sequence
  chemically synthesized
gatttaaagcttctaattgaag

SEQ ID NO: 674894 - DNA, 22 bp, Artificial Sequence
  chemically synthesized
ttatgttcttcaattagaagct

SEQ ID NO: 674895 - DNA, 22 bp, Artificial Sequence
  chemically synthesized
tgttcttcaattagaagcttta

SEQ ID NO: 674896 - DNA, 22 bp, Artificial Sequence
  chemically synthesized
aaataacttgatttaaagcttc

SEQ ID NO: 674897 - DNA, 22 bp, Artificial Sequence
  chemically synthesized
ttcaaataacttgatttaaagc

SEQ ID NO: 674898 - DNA, 22 bp, Artificial Sequence
  chemically synthesized
ttcaattagaagctttaaatca

SEQ ID NO: 674899 - DNA, 22 bp, Artificial Sequence
  chemically synthesized
gttcaaataacttgatttaaag

SEQ ID NO: 674900 - DNA, 22 bp, Artificial Sequence
  chemically synthesized
caattagaagctttaaatcaag

SEQ ID NO: 674901 - DNA, 22 bp, Artificial Sequence
  chemically synthesized
ttgttcaaataacttgatttaa

SEQ ID NO: 674902 - DNA, 22 bp, Artificial Sequence
  chemically synthesized
aattagaagctttaaatcaagt

SEQ ID NO: 674903 - DNA, 22 bp, Artificial Sequence
  chemically synthesized
cttgttcaaataacttgattta

SEQ ID NO: 674904 - DNA, 22 bp, Artificial Sequence
  chemically synthesized
tcttgttcaaataacttgattt

SEQ ID NO: 674905 - DNA, 22 bp, Artificial Sequence
  chemically synthesized
ttcttgttcaaataacttgatt

SEQ ID NO: 674906 - DNA, 22 bp, Artificial Sequence
  chemically synthesized
tttcttgttcaaataacttgat

SEQ ID NO: 674907 - DNA, 22 bp, Artificial Sequence
  chemically synthesized
gaagctttaaatcaagttattt

SEQ ID NO: 674908 - DNA, 22 bp, Artificial Sequence
  chemically synthesized
taatattttttcttgttcaaat

SEQ ID NO: 674909 - DNA, 22 bp, Artificial Sequence
  chemically synthesized
taaatcaagttatttgaacaag

SEQ ID NO: 674910 - DNA, 22 bp, Artificial Sequence
  chemically synthesized
aaatcaagttatttgaacaaga

SEQ ID NO: 674911 - DNA, 22 bp, Artificial Sequence
  chemically synthesized
aatcaagttatttgaacaagaa

SEQ ID NO: 674912 - DNA, 22 bp, Artificial Sequence
  chemically synthesized
aatattataatattttttcttg

SEQ ID NO: 674913 - DNA, 22 bp, Artificial Sequence
  chemically synthesized
taaatattataatattttttct

SEQ ID NO: 674914 - DNA, 22 bp, Artificial Sequence
  chemically synthesized
ttctaaatattataatattttt

SEQ ID NO: 674915 - DNA, 22 bp, Artificial Sequence
  chemically synthesized
tttgaacaagaaaaaatattat

SEQ ID NO: 674916 - DNA, 22 bp, Artificial Sequence
  chemically synthesized
gaacaagaaaaaatattataat

SEQ ID NO: 674917 - DNA, 22 bp, Artificial Sequence
  chemically synthesized
aacaagaaaaaatattataata

SEQ ID NO: 674918 - DNA, 22 bp, Artificial Sequence
  chemically synthesized
atggactgttctaaatattata

SEQ ID NO: 674919 - DNA, 22 bp, Artificial Sequence
  chemically synthesized
aatggactgttctaaatattat

SEQ ID NO: 674920 - DNA, 22 bp, Artificial Sequence
  chemically synthesized
taatggactgttctaaatatta

SEQ ID NO: 674921 - DNA, 22 bp, Artificial Sequence
  chemically synthesized
tggcattttaatggactgttct

SEQ ID NO: 674922 - DNA, 22 bp, Artificial Sequence
  chemically synthesized
atggcattttaatggactgttc

SEQ ID NO: 674923 - DNA, 22 bp, Artificial Sequence
  chemically synthesized
taatatttagaacagtccatta

SEQ ID NO: 674924 - DNA, 22 bp, Artificial Sequence
  chemically synthesized
agaacagtccattaaaatgcca

SEQ ID NO: 674925 - DNA, 22 bp, Artificial Sequence
  chemically synthesized
gaacagtccattaaaatgccat

SEQ ID NO: 674926 - DNA, 22 bp, Artificial Sequence
  chemically synthesized
caaatcaaaatttatggcattt

SEQ ID NO: 674927 - DNA, 22 bp, Artificial Sequence
  chemically synthesized
ccaaatcaaaatttatggcatt

SEQ ID NO: 674928 - DNA, 22 bp, Artificial Sequence
  chemically synthesized
aaatgccataaattttgatttg

SEQ ID NO: 674929 - DNA, 22 bp, Artificial Sequence
  chemically synthesized
taaaatagaaatgtaacttcca

SEQ ID NO: 674930 - DNA, 22 bp, Artificial Sequence
  chemically synthesized
gtaaaatagaaatgtaacttcc

SEQ ID NO: 674931 - DNA, 22 bp, Artificial Sequence
  chemically synthesized
tgatttggaagttacatttcta

SEQ ID NO: 674932 - DNA, 22 bp, Artificial Sequence
  chemically synthesized
gatttggaagttacatttctat

SEQ ID NO: 674933 - DNA, 22 bp, Artificial Sequence
  chemically synthesized
cccatttgtaaaatagaaatgt

SEQ ID NO: 674934 - DNA, 22 bp, Artificial Sequence
  chemically synthesized
atttggaagttacatttctatt

SEQ ID NO: 674935 - DNA, 22 bp, Artificial Sequence
  chemically synthesized
ccccatttgtaaaatagaaatg

SEQ ID NO: 674936 - DNA, 22 bp, Artificial Sequence
  chemically synthesized
tccccatttgtaaaatagaaat

SEQ ID NO: 674937 - DNA, 22 bp, Artificial Sequence
  chemically synthesized
ggaagttacatttctattttac

SEQ ID NO: 674938 - DNA, 22 bp, Artificial Sequence
  chemically synthesized
gaagttacatttctattttaca

SEQ ID NO: 674939 - DNA, 22 bp, Artificial Sequence
  chemically synthesized
actttccccatttgtaaaatag

SEQ ID NO: 674940 - DNA, 22 bp, Artificial Sequence
  chemically synthesized
catttctattttacaaatgggg

SEQ ID NO: 674941 - DNA, 22 bp, Artificial Sequence
  chemically synthesized
ggatccattgactttccccatt

SEQ ID NO: 674942 - DNA, 22 bp, Artificial Sequence
  chemically synthesized
ctattttacaaatggggaaagt

SEQ ID NO: 674943 - DNA, 22 bp, Artificial Sequence
  chemically synthesized
tattttacaaatggggaaagtc

SEQ ID NO: 674944 - DNA, 22 bp, Artificial Sequence
  chemically synthesized
attaggatccattgactttccc

SEQ ID NO: 674945 - DNA, 22 bp, Artificial Sequence
  chemically synthesized
ttttacaaatggggaaagtcaa

SEQ ID NO: 674946 - DNA, 22 bp, Artificial Sequence
  chemically synthesized
gattaggatccattgactttcc

SEQ ID NO: 674947 - DNA, 22 bp, Artificial Sequence
  chemically synthesized
tgattaggatccattgactttc

SEQ ID NO: 674948 - DNA, 22 bp, Artificial Sequence
  chemically synthesized
tacaaatggggaaagtcaatgg

SEQ ID NO: 674949 - DNA, 22 bp, Artificial Sequence
  chemically synthesized
acaaatggggaaagtcaatgga

SEQ ID NO: 674950 - DNA, 22 bp, Artificial Sequence
  chemically synthesized
caaatggggaaagtcaatggat

SEQ ID NO: 674951 - DNA, 22 bp, Artificial Sequence
  chemically synthesized
actttgattaggatccattgac

SEQ ID NO: 674952 - DNA, 22 bp, Artificial Sequence
  chemically synthesized
aactttgattaggatccattga

SEQ ID NO: 674953 - DNA, 22 bp, Artificial Sequence
  chemically synthesized
taactttgattaggatccattg

SEQ ID NO: 674954 - DNA, 22 bp, Artificial Sequence
  chemically synthesized
ttaactttgattaggatccatt

SEQ ID NO: 674955 - DNA, 22 bp, Artificial Sequence
  chemically synthesized
ttttaactttgattaggatcca

SEQ ID NO: 674956 - DNA, 22 bp, Artificial Sequence
  chemically synthesized
ctcttttaactttgattaggat

SEQ ID NO: 674957 - DNA, 22 bp, Artificial Sequence
  chemically synthesized
atcaaagttaaaagagcagatt

SEQ ID NO: 674958 - DNA, 22 bp, Artificial Sequence
  chemically synthesized
taaaagaaaaaagaaaaataat

SEQ ID NO: 674959 - DNA, 22 bp, Artificial Sequence
  chemically synthesized
ataaaagaaaaaagaaaaataa

SEQ ID NO: 674960 - DNA, 22 bp, Artificial Sequence
  chemically synthesized
aaagagcagattatttttcttt

SEQ ID NO: 674961 - DNA, 22 bp, Artificial Sequence
  chemically synthesized
agcttataaaagaaaaaagaaa

SEQ ID NO: 674962 - DNA, 22 bp, Artificial Sequence
  chemically synthesized
ttcagcttataaaagaaaaaag

SEQ ID NO: 674963 - DNA, 22 bp, Artificial Sequence
  chemically synthesized
ctattcagcttataaaagaaaa

SEQ ID NO: 674964 - DNA, 22 bp, Artificial Sequence
  chemically synthesized
actattcagcttataaaagaaa

SEQ ID NO: 674965 - DNA, 22 bp, Artificial Sequence
  chemically synthesized
tactattcagcttataaaagaa

SEQ ID NO: 674966 - DNA, 22 bp, Artificial Sequence
  chemically synthesized
tttttcttttttcttttataag

SEQ ID NO: 674967 - DNA, 22 bp, Artificial Sequence
  chemically synthesized
ctttactattcagcttataaaa

SEQ ID NO: 674968 - DNA, 22 bp, Artificial Sequence
  chemically synthesized
cctttactattcagcttataaa

SEQ ID NO: 674969 - DNA, 22 bp, Artificial Sequence
  chemically synthesized
ttcttttttcttttataagctg

SEQ ID NO: 674970 - DNA, 22 bp, Artificial Sequence
  chemically synthesized
tcttttttcttttataagctga

SEQ ID NO: 674971 - DNA, 22 bp, Artificial Sequence
  chemically synthesized
ttcctttactattcagcttata

SEQ ID NO: 674972 - DNA, 22 bp, Artificial Sequence
  chemically synthesized
cttttttcttttataagctgaa

SEQ ID NO: 674973 - DNA, 22 bp, Artificial Sequence
  chemically synthesized
ttttttcttttataagctgaat

SEQ ID NO: 674974 - DNA, 22 bp, Artificial Sequence
  chemically synthesized
ttttcttttataagctgaatag

SEQ ID NO: 674975 - DNA, 22 bp, Artificial Sequence
  chemically synthesized
tttcttttataagctgaatagt

SEQ ID NO: 674976 - DNA, 22 bp, Artificial Sequence
  chemically synthesized
ttcttttataagctgaatagta

SEQ ID NO: 674977 - DNA, 22 bp, Artificial Sequence
  chemically synthesized
tcttttataagctgaatagtaa

SEQ ID NO: 674978 - DNA, 22 bp, Artificial Sequence
  chemically synthesized
cttttataagctgaatagtaaa

SEQ ID NO: 674979 - DNA, 22 bp, Artificial Sequence
  chemically synthesized
ttttataagctgaatagtaaag

SEQ ID NO: 674980 - DNA, 22 bp, Artificial Sequence
  chemically synthesized
taaatgttcttcctttactatt

SEQ ID NO: 674981 - DNA, 22 bp, Artificial Sequence
  chemically synthesized
ttataagctgaatagtaaagga

SEQ ID NO: 674982 - DNA, 22 bp, Artificial Sequence
  chemically synthesized
tataagctgaatagtaaaggaa

SEQ ID NO: 674983 - DNA, 22 bp, Artificial Sequence
  chemically synthesized
ttataaatgttcttcctttact

SEQ ID NO: 674984 - DNA, 22 bp, Artificial Sequence
  chemically synthesized
ataagctgaatagtaaaggaag

SEQ ID NO: 674985 - DNA, 22 bp, Artificial Sequence
  chemically synthesized
taagctgaatagtaaaggaaga

SEQ ID NO: 674986 - DNA, 22 bp, Artificial Sequence
  chemically synthesized
aggctgttataaatgttcttcc

SEQ ID NO: 674987 - DNA, 22 bp, Artificial Sequence
  chemically synthesized
aatagtaaaggaagaacattta

SEQ ID NO: 674988 - DNA, 22 bp, Artificial Sequence
  chemically synthesized
ttaaggctgttataaatgttct

SEQ ID NO: 674989 - DNA, 22 bp, Artificial Sequence
  chemically synthesized
ttattaaggctgttataaatgt

SEQ ID NO: 674990 - DNA, 22 bp, Artificial Sequence
  chemically synthesized
gttattaaggctgttataaatg

SEQ ID NO: 674991 - DNA, 22 bp, Artificial Sequence
  chemically synthesized
aaatttgttattaaggctgtta

SEQ ID NO: 674992 - DNA, 22 bp, Artificial Sequence
  chemically synthesized
ctcaaatttgttattaaggctg

SEQ ID NO: 674993 - DNA, 22 bp, Artificial Sequence
  chemically synthesized
actcaaatttgttattaaggct

SEQ ID NO: 674994 - DNA, 22 bp, Artificial Sequence
  chemically synthesized
ataacagccttaataacaaatt

SEQ ID NO: 674995 - DNA, 22 bp, Artificial Sequence
  chemically synthesized
taacagccttaataacaaattt

SEQ ID NO: 674996 - DNA, 22 bp, Artificial Sequence
  chemically synthesized
gcacaggagatttactcaaatt

SEQ ID NO: 674997 - DNA, 22 bp, Artificial Sequence
  chemically synthesized
aataacaaatttgagtaaatct

SEQ ID NO: 674998 - DNA, 22 bp, Artificial Sequence
  chemically synthesized
ataacaaatttgagtaaatctc

SEQ ID NO: 674999 - DNA, 22 bp, Artificial Sequence
  chemically synthesized
acaaaattagcacaggagattt

SEQ ID NO: 675000 - DNA, 22 bp, Artificial Sequence
  chemically synthesized
gctgacaaaattagcacaggag

SEQ ID NO: 675001 - DNA, 22 bp, Artificial Sequence
  chemically synthesized
gagtaaatctcctgtgctaatt

SEQ ID NO: 675002 - DNA, 22 bp, Artificial Sequence
  chemically synthesized
cctagctgacaaaattagcaca

SEQ ID NO: 675003 - DNA, 22 bp, Artificial Sequence
  chemically synthesized
agtaaatctcctgtgctaattt

SEQ ID NO: 675004 - DNA, 22 bp, Artificial Sequence
  chemically synthesized
ttccctagctgacaaaattagc

SEQ ID NO: 675005 - DNA, 22 bp, Artificial Sequence
  chemically synthesized
attccctagctgacaaaattag

SEQ ID NO: 675006 - DNA, 22 bp, Artificial Sequence
  chemically synthesized
tattccctagctgacaaaatta

SEQ ID NO: 675007 - DNA, 22 bp, Artificial Sequence
  chemically synthesized
tttattccctagctgacaaaat

SEQ ID NO: 675008 - DNA, 22 bp, Artificial Sequence
  chemically synthesized
ctgtgctaattttgtcagctag

SEQ ID NO: 675009 - DNA, 22 bp, Artificial Sequence
  chemically synthesized
tgctaattttgtcagctaggga

SEQ ID NO: 675010 - DNA, 22 bp, Artificial Sequence
  chemically synthesized
attttgtcagctagggaataaa

SEQ ID NO: 675011 - DNA, 22 bp, Artificial Sequence
  chemically synthesized
tgtcagctagggaataaagaat

SEQ ID NO: 675012 - DNA, 22 bp, Artificial Sequence
  chemically synthesized
gtcagctagggaataaagaatg

SEQ ID NO: 675013 - DNA, 22 bp, Artificial Sequence
  chemically synthesized
gaatccatatgacattctttat

SEQ ID NO: 675014 - DNA, 22 bp, Artificial Sequence
  chemically synthesized
tcagctagggaataaagaatgt

SEQ ID NO: 675015 - DNA, 22 bp, Artificial Sequence
  chemically synthesized
aactggaatccatatgacattc

SEQ ID NO: 675016 - DNA, 22 bp, Artificial Sequence
  chemically synthesized
gggaataaagaatgtcatatgg

SEQ ID NO: 675017 - DNA, 22 bp, Artificial Sequence
  chemically synthesized
tcggcataattaaactggaatc

SEQ ID NO: 675018 - DNA, 22 bp, Artificial Sequence
  chemically synthesized
atcggcataattaaactggaat

SEQ ID NO: 675019 - DNA, 22 bp, Artificial Sequence
  chemically synthesized
tatcggcataattaaactggaa

SEQ ID NO: 675020 - DNA, 22 bp, Artificial Sequence
  chemically synthesized
ctttatcggcataattaaactg

SEQ ID NO: 675021 - DNA, 22 bp, Artificial Sequence
  chemically synthesized
taaaactgctttatcggcataa

SEQ ID NO: 675022 - DNA, 22 bp, Artificial Sequence
  chemically synthesized
ataaaactgctttatcggcata

SEQ ID NO: 675023 - DNA, 22 bp, Artificial Sequence
  chemically synthesized
cagtttaattatgccgataaag

SEQ ID NO: 675024 - DNA, 22 bp, Artificial Sequence
  chemically synthesized
aattatgccgataaagcagttt

SEQ ID NO: 675025 - DNA, 22 bp, Artificial Sequence
  chemically synthesized
gcatgatttataaaactgcttt

SEQ ID NO: 675026 - DNA, 22 bp, Artificial Sequence
  chemically synthesized
attatgccgataaagcagtttt

SEQ ID NO: 675027 - DNA, 22 bp, Artificial Sequence
  chemically synthesized
agcatgatttataaaactgctt

SEQ ID NO: 675028 - DNA, 22 bp, Artificial Sequence
  chemically synthesized
ttagcatgatttataaaactgc

SEQ ID NO: 675029 - DNA, 22 bp, Artificial Sequence
  chemically synthesized
tgccgataaagcagttttataa

SEQ ID NO: 675030 - DNA, 22 bp, Artificial Sequence
  chemically synthesized
ctcttagcatgatttataaaac

SEQ ID NO: 675031 - DNA, 22 bp, Artificial Sequence
  chemically synthesized
tataaatcatgctaagagtaat

SEQ ID NO: 675032 - DNA, 22 bp, Artificial Sequence
  chemically synthesized
aaaggaacatccattactctta

SEQ ID NO: 675033 - DNA, 22 bp, Artificial Sequence
  chemically synthesized
ataaatcatgctaagagtaatg

SEQ ID NO: 675034 - DNA, 22 bp, Artificial Sequence
  chemically synthesized
taaatcatgctaagagtaatgg

SEQ ID NO: 675035 - DNA, 22 bp, Artificial Sequence
  chemically synthesized
tcaaaggaacatccattactct

SEQ ID NO: 675036 - DNA, 22 bp, Artificial Sequence
  chemically synthesized
ttctcaaaggaacatccattac

SEQ ID NO: 675037 - DNA, 22 bp, Artificial Sequence
  chemically synthesized
tgttctcaaaggaacatccatt

SEQ ID NO: 675038 - DNA, 22 bp, Artificial Sequence
  chemically synthesized
tctgttctcaaaggaacatcca

SEQ ID NO: 675039 - DNA, 22 bp, Artificial Sequence
  chemically synthesized
agagtaatggatgttcctttga

SEQ ID NO: 675040 - DNA, 22 bp, Artificial Sequence
  chemically synthesized
cgagttctctgttctcaaagga

SEQ ID NO: 675041 - DNA, 22 bp, Artificial Sequence
  chemically synthesized
caaactccgagttctctgttct

SEQ ID NO: 675042 - DNA, 22 bp, Artificial Sequence
  chemically synthesized
acaaactccgagttctctgttc

SEQ ID NO: 675043 - DNA, 22 bp, Artificial Sequence
  chemically synthesized
tacaaactccgagttctctgtt

SEQ ID NO: 675044 - DNA, 22 bp, Artificial Sequence
  chemically synthesized
ctttgagaacagagaactcgga

SEQ ID NO: 675045 - DNA, 22 bp, Artificial Sequence
  chemically synthesized
tgagaacagagaactcggagtt

SEQ ID NO: 675046 - DNA, 22 bp, Artificial Sequence
  chemically synthesized
gagaacagagaactcggagttt

SEQ ID NO: 675047 - DNA, 22 bp, Artificial Sequence
  chemically synthesized
agaacagagaactcggagtttg

SEQ ID NO: 675048 - DNA, 22 bp, Artificial Sequence
  chemically synthesized
ggagtttgtaaaatgtgtgttc

SEQ ID NO: 675049 - DNA, 22 bp, Artificial Sequence
  chemically synthesized
gtaaaatgtgtgttctggactt

SEQ ID NO: 675050 - DNA, 22 bp, Artificial Sequence
  chemically synthesized
taaaatgtgtgttctggacttg

SEQ ID NO: 675051 - DNA, 22 bp, Artificial Sequence
  chemically synthesized
tggtagaagataaggaaccaag

SEQ ID NO: 675052 - DNA, 22 bp, Artificial Sequence
  chemically synthesized
actatggtagaagataaggaac

SEQ ID NO: 675053 - DNA, 22 bp, Artificial Sequence
  chemically synthesized
tggacttggttccttatcttct

SEQ ID NO: 675054 - DNA, 22 bp, Artificial Sequence
  chemically synthesized
tactcactatggtagaagataa

SEQ ID NO: 675055 - DNA, 22 bp, Artificial Sequence
  chemically synthesized
gacttggttccttatcttctac

SEQ ID NO: 675056 - DNA, 22 bp, Artificial Sequence
  chemically synthesized
atactcactatggtagaagata

SEQ ID NO: 675057 - DNA, 22 bp, Artificial Sequence
  chemically synthesized
atttatactcactatggtagaa

SEQ ID NO: 675058 - DNA, 22 bp, Artificial Sequence
  chemically synthesized
ggttccttatcttctaccatag

SEQ ID NO: 675059 - DNA, 22 bp, Artificial Sequence
  chemically synthesized
gatttatactcactatggtaga

SEQ ID NO: 675060 - DNA, 22 bp, Artificial Sequence
  chemically synthesized
gttccttatcttctaccatagt

SEQ ID NO: 675061 - DNA, 22 bp, Artificial Sequence
  chemically synthesized
atttgatttatactcactatgg

SEQ ID NO: 675062 - DNA, 22 bp, Artificial Sequence
  chemically synthesized
cttatcttctaccatagtgagt

SEQ ID NO: 675063 - DNA, 22 bp, Artificial Sequence
  chemically synthesized
gatttgatttatactcactatg

SEQ ID NO: 675064 - DNA, 22 bp, Artificial Sequence
  chemically synthesized
atcttctaccatagtgagtata

SEQ ID NO: 675065 - DNA, 22 bp, Artificial Sequence
  chemically synthesized
tcttctaccatagtgagtataa

SEQ ID NO: 675066 - DNA, 22 bp, Artificial Sequence
  chemically synthesized
aagacttgatttgatttatact

SEQ ID NO: 675067 - DNA, 22 bp, Artificial Sequence
  chemically synthesized
ctaccatagtgagtataaatca

SEQ ID NO: 675068 - DNA, 22 bp, Artificial Sequence
  chemically synthesized
taccatagtgagtataaatcaa

SEQ ID NO: 675069 - DNA, 22 bp, Artificial Sequence
  chemically synthesized
ccatagtgagtataaatcaaat

SEQ ID NO: 675070 - DNA, 22 bp, Artificial Sequence
  chemically synthesized
agactcaagacttgatttgatt

SEQ ID NO: 675071 - DNA, 22 bp, Artificial Sequence
  chemically synthesized
agcagactgagactcaagactt

SEQ ID NO: 675072 - DNA, 22 bp, Artificial Sequence
  chemically synthesized
gagcagactgagactcaagact

SEQ ID NO: 675073 - DNA, 22 bp, Artificial Sequence
  chemically synthesized
gacttgagcagactgagactca

SEQ ID NO: 675074 - DNA, 22 bp, Artificial Sequence
  chemically synthesized
ggacttgagcagactgagactc

SEQ ID NO: 675075 - DNA, 22 bp, Artificial Sequence
  chemically synthesized
catttggacttgagcagactga

SEQ ID NO: 675076 - DNA, 22 bp, Artificial Sequence
  chemically synthesized
ccatttggacttgagcagactg

SEQ ID NO: 675077 - DNA, 22 bp, Artificial Sequence
  chemically synthesized
tccatttggacttgagcagact

SEQ ID NO: 675078 - DNA, 22 bp, Artificial Sequence
  chemically synthesized
tttccatttggacttgagcaga

SEQ ID NO: 675079 - DNA, 22 bp, Artificial Sequence
  chemically synthesized
ctttccatttggacttgagcag

SEQ ID NO: 675080 - DNA, 22 bp, Artificial Sequence
  chemically synthesized
gagtctcagtctgctcaagtcc

SEQ ID NO: 675081 - DNA, 22 bp, Artificial Sequence
  chemically synthesized
agtctcagtctgctcaagtcca

SEQ ID NO: 675082 - DNA, 22 bp, Artificial Sequence
  chemically synthesized
ccttctttccatttggacttga

SEQ ID NO: 675083 - DNA, 22 bp, Artificial Sequence
  chemically synthesized
cccttctttccatttggacttg

SEQ ID NO: 675084 - DNA, 22 bp, Artificial Sequence
  chemically synthesized
tcccttctttccatttggactt

SEQ ID NO: 675085 - DNA, 22 bp, Artificial Sequence
  chemically synthesized
ttcccttctttccatttggact

SEQ ID NO: 675086 - DNA, 22 bp, Artificial Sequence
  chemically synthesized
agtctgctcaagtccaaatgga

SEQ ID NO: 675087 - DNA, 22 bp, Artificial Sequence
  chemically synthesized
ctcaagtccaaatggaaagaag

SEQ ID NO: 675088 - DNA, 22 bp, Artificial Sequence
  chemically synthesized
aagtccaaatggaaagaaggga

SEQ ID NO: 675089 - DNA, 22 bp, Artificial Sequence
  chemically synthesized
ccataccggtggatggggcaac

SEQ ID NO: 675090 - DNA, 22 bp, Artificial Sequence
  chemically synthesized
ggaaataatgctaccataccgg

SEQ ID NO: 675091 - DNA, 22 bp, Artificial Sequence
  chemically synthesized
gggaaataatgctaccataccg

SEQ ID NO: 675092 - DNA, 22 bp, Artificial Sequence
  chemically synthesized
ccccatccaccggtatggtagc

SEQ ID NO: 675093 - DNA, 22 bp, Artificial Sequence
  chemically synthesized
atttgggaaataatgctaccat

SEQ ID NO: 675094 - DNA, 22 bp, Artificial Sequence
  chemically synthesized
gatttgggaaataatgctacca

SEQ ID NO: 675095 - DNA, 22 bp, Artificial Sequence
  chemically synthesized
tgatttgggaaataatgctacc

SEQ ID NO: 675096 - DNA, 22 bp, Artificial Sequence
  chemically synthesized
ttgatttgggaaataatgctac

SEQ ID NO: 675097 - DNA, 22 bp, Artificial Sequence
  chemically synthesized
cagtttttgatttgggaaataa

SEQ ID NO: 675098 - DNA, 22 bp, Artificial Sequence
  chemically synthesized
ccagtttttgatttgggaaata

SEQ ID NO: 675099 - DNA, 22 bp, Artificial Sequence
  chemically synthesized
agtgtccttccagtttttgatt

SEQ ID NO: 675100 - DNA, 22 bp, Artificial Sequence
  chemically synthesized
gagtgtccttccagtttttgat

SEQ ID NO: 675101 - DNA, 22 bp, Artificial Sequence
  chemically synthesized
tgagtgtccttccagtttttga

SEQ ID NO: 675102 - DNA, 22 bp, Artificial Sequence
  chemically synthesized
tttcccaaatcaaaaactggaa

SEQ ID NO: 675103 - DNA, 22 bp, Artificial Sequence
  chemically synthesized
cccaaatcaaaaactggaagga

SEQ ID NO: 675104 - DNA, 22 bp, Artificial Sequence
  chemically synthesized
ccaaatcaaaaactggaaggac

SEQ ID NO: 675105 - DNA, 22 bp, Artificial Sequence
  chemically synthesized
tcatccctttgagtgtccttcc

SEQ ID NO: 675106 - DNA, 22 bp, Artificial Sequence
  chemically synthesized
tcctgtcatccctttgagtgtc

SEQ ID NO: 675107 - DNA, 22 bp, Artificial Sequence
  chemically synthesized
gtcctgtcatccctttgagtgt

SEQ ID NO: 675108 - DNA, 22 bp, Artificial Sequence
  chemically synthesized
tgtcctgtcatccctttgagtg

SEQ ID NO: 675109 - DNA, 22 bp, Artificial Sequence
  chemically synthesized
ttgtcctgtcatccctttgagt

SEQ ID NO: 675110 - DNA, 22 bp, Artificial Sequence
  chemically synthesized
tttgtcctgtcatccctttgag

SEQ ID NO: 675111 - DNA, 22 bp, Artificial Sequence
  chemically synthesized
gaaggacactcaaagggatgac

SEQ ID NO: 675112 - DNA, 22 bp, Artificial Sequence
  chemically synthesized
agattttttgtcctgtcatccc

SEQ ID NO: 675113 - DNA, 22 bp, Artificial Sequence
  chemically synthesized
cagattttttgtcctgtcatcc

SEQ ID NO: 675114 - DNA, 22 bp, Artificial Sequence
  chemically synthesized
agtttcagattttttgtcctgt

SEQ ID NO: 675115 - DNA, 22 bp, Artificial Sequence
  chemically synthesized
cagtttcagattttttgtcctg

SEQ ID NO: 675116 - DNA, 22 bp, Artificial Sequence
  chemically synthesized
aaagggatgacaggacaaaaaa

SEQ ID NO: 675117 - DNA, 22 bp, Artificial Sequence
  chemically synthesized
tcaatttcagtttcagattttt

SEQ ID NO: 675118 - DNA, 22 bp, Artificial Sequence
  chemically synthesized
tatcaatttcagtttcagattt

SEQ ID NO: 675119 - DNA, 22 bp, Artificial Sequence
  chemically synthesized
ctatcaatttcagtttcagatt

SEQ ID NO: 675120 - DNA, 22 bp, Artificial Sequence
  chemically synthesized
tctatcaatttcagtttcagat

SEQ ID NO: 675121 - DNA, 22 bp, Artificial Sequence
  chemically synthesized
gattttctatcaatttcagttt

SEQ ID NO: 675122 - DNA, 22 bp, Artificial Sequence
  chemically synthesized
aaactgaaattgatagaaaatc

SEQ ID NO: 675123 - DNA, 22 bp, Artificial Sequence
  chemically synthesized
aaattgatagaaaatccaggtc

SEQ ID NO: 675124 - DNA, 22 bp, Artificial Sequence
  chemically synthesized
tagagtaggtggcatatgacct

SEQ ID NO: 675125 - DNA, 22 bp, Artificial Sequence
  chemically synthesized
atagaaaatccaggtcatatgc

SEQ ID NO: 675126 - DNA, 22 bp, Artificial Sequence
  chemically synthesized
acacagctatagagtaggtggc

SEQ ID NO: 675127 - DNA, 22 bp, Artificial Sequence
  chemically synthesized
atcctcacacagctatagagta

SEQ ID NO: 675128 - DNA, 22 bp, Artificial Sequence
  chemically synthesized
aatcctcacacagctatagagt

SEQ ID NO: 675129 - DNA, 22 bp, Artificial Sequence
  chemically synthesized
ctctatagctgtgtgaggatta

SEQ ID NO: 675130 - DNA, 22 bp, Artificial Sequence
  chemically synthesized
tatagctgtgtgaggattaaat

SEQ ID NO: 675131 - DNA, 22 bp, Artificial Sequence
  chemically synthesized
agaaataaccatatttaatcct

SEQ ID NO: 675132 - DNA, 22 bp, Artificial Sequence
  chemically synthesized
cagaaataaccatatttaatcc

SEQ ID NO: 675133 - DNA, 22 bp, Artificial Sequence
  chemically synthesized
tagctgtgtgaggattaaatat

SEQ ID NO: 675134 - DNA, 22 bp, Artificial Sequence
  chemically synthesized
tcagaaataaccatatttaatc

SEQ ID NO: 675135 - DNA, 22 bp, Artificial Sequence
  chemically synthesized
tgtgaggattaaatatggttat

SEQ ID NO: 675136 - DNA, 22 bp, Artificial Sequence
  chemically synthesized
caatggcgaagagttttcagaa

SEQ ID NO: 675137 - DNA, 22 bp, Artificial Sequence
  chemically synthesized
aatatggttatttctgaaaact

SEQ ID NO: 675138 - DNA, 22 bp, Artificial Sequence
  chemically synthesized
acaatggcgaagagttttcaga

SEQ ID NO: 675139 - DNA, 22 bp, Artificial Sequence
  chemically synthesized
tacaatggcgaagagttttcag

SEQ ID NO: 675140 - DNA, 22 bp, Artificial Sequence
  chemically synthesized
tttctgaaaactcttcgccatt

SEQ ID NO: 675141 - DNA, 22 bp, Artificial Sequence
  chemically synthesized
tgtagcactttacaatggcgaa

SEQ ID NO: 675142 - DNA, 22 bp, Artificial Sequence
  chemically synthesized
gtgtagcactttacaatggcga

SEQ ID NO: 675143 - DNA, 22 bp, Artificial Sequence
  chemically synthesized
ctgaaaactcttcgccattgta

SEQ ID NO: 675144 - DNA, 22 bp, Artificial Sequence
  chemically synthesized
tgaaaactcttcgccattgtaa

SEQ ID NO: 675145 - DNA, 22 bp, Artificial Sequence
  chemically synthesized
tttgtgtagcactttacaatgg

SEQ ID NO: 675146 - DNA, 22 bp, Artificial Sequence
  chemically synthesized
aaaactcttcgccattgtaaag

SEQ ID NO: 675147 - DNA, 22 bp, Artificial Sequence
  chemically synthesized
atttgtgtagcactttacaatg

SEQ ID NO: 675148 - DNA, 22 bp, Artificial Sequence
  chemically synthesized
tatttgtgtagcactttacaat

SEQ ID NO: 675149 - DNA, 22 bp, Artificial Sequence
  chemically synthesized
tactttatttgtgtagcacttt

SEQ ID NO: 675150 - DNA, 22 bp, Artificial Sequence
  chemically synthesized
ttcgccattgtaaagtgctaca

SEQ ID NO: 675151 - DNA, 22 bp, Artificial Sequence
  chemically synthesized
cgccattgtaaagtgctacaca

SEQ ID NO: 675152 - DNA, 22 bp, Artificial Sequence
  chemically synthesized
gccattgtaaagtgctacacaa

SEQ ID NO: 675153 - DNA, 22 bp, Artificial Sequence
  chemically synthesized
taataattgtactttatttgtg

SEQ ID NO: 675154 - DNA, 22 bp, Artificial Sequence
  chemically synthesized
gtaataattgtactttatttgt

SEQ ID NO: 675155 - DNA, 22 bp, Artificial Sequence
  chemically synthesized
taaagtgctacacaaataaagt

SEQ ID NO: 675156 - DNA, 22 bp, Artificial Sequence
  chemically synthesized
cacaaataaagtacaattatta

SEQ ID NO: 675157 - DNA, 22 bp, Artificial Sequence
  chemically synthesized
taatcatatttgtaataattgt

SEQ ID NO: 675158 - DNA, 22 bp, Artificial Sequence
  chemically synthesized
gcctataatcatatttgtaata

SEQ ID NO: 675159 - DNA, 22 bp, Artificial Sequence
  chemically synthesized
ctagcctataatcatatttgta

SEQ ID NO: 675160 - DNA, 22 bp, Artificial Sequence
  chemically synthesized
ttacaaatatgattataggcta

SEQ ID NO: 675161 - DNA, 22 bp, Artificial Sequence
  chemically synthesized
caaatatgattataggctagga

SEQ ID NO: 675162 - DNA, 22 bp, Artificial Sequence
  chemically synthesized
caggcgtgagccaccgctccta

SEQ ID NO: 675163 - DNA, 22 bp, Artificial Sequence
  chemically synthesized
agattacaggcgtgagccaccg

SEQ ID NO: 675164 - DNA, 22 bp, Artificial Sequence
  chemically synthesized
taggctaggagcggtggctcac

SEQ ID NO: 675165 - DNA, 22 bp, Artificial Sequence
  chemically synthesized
ggagcggtggctcacgcctgta

SEQ ID NO: 675166 - DNA, 22 bp, Artificial Sequence
  chemically synthesized
ccagagtgctgagattacaggc

SEQ ID NO: 675167 - DNA, 22 bp, Artificial Sequence
  chemically synthesized
ggcctcccagagtgctgagatt

SEQ ID NO: 675168 - DNA, 22 bp, Artificial Sequence
  chemically synthesized
acgcctgtaatctcagcactct

SEQ ID NO: 675169 - DNA, 22 bp, Artificial Sequence
  chemically synthesized
taatctcagcactctgggaggc

SEQ ID NO: 675170 - DNA, 22 bp, Artificial Sequence
  chemically synthesized
atgatccacccgcctcggcctc

SEQ ID NO: 675171 - DNA, 22 bp, Artificial Sequence
  chemically synthesized
agcactctgggaggccgaggcg

SEQ ID NO: 675172 - DNA, 22 bp, Artificial Sequence
  chemically synthesized
acctcatgatccacccgcctcg

SEQ ID NO: 675173 - DNA, 22 bp, Artificial Sequence
  chemically synthesized
gacctcatgatccacccgcctc

SEQ ID NO: 675174 - DNA, 22 bp, Artificial Sequence
  chemically synthesized
ttgacctcatgatccacccgcc

SEQ ID NO: 675175 - DNA, 22 bp, Artificial Sequence
  chemically synthesized
tgggaggccgaggcgggtggat

SEQ ID NO: 675176 - DNA, 22 bp, Artificial Sequence
  chemically synthesized
ggaggccgaggcgggtggatca

SEQ ID NO: 675177 - DNA, 22 bp, Artificial Sequence
  chemically synthesized
gatctcttgacctcatgatcca

SEQ ID NO: 675178 - DNA, 22 bp, Artificial Sequence
  chemically synthesized
gccaggatggtctcgatctctt

SEQ ID NO: 675179 - DNA, 22 bp, Artificial Sequence
  chemically synthesized
accatgttggccaggatggtct

SEQ ID NO: 675180 - DNA, 22 bp, Artificial Sequence
  chemically synthesized
caccatgttggccaggatggtc

SEQ ID NO: 675181 - DNA, 22 bp, Artificial Sequence
  chemically synthesized
gtagagacggggtttcaccatg

SEQ ID NO: 675182 - DNA, 22 bp, Artificial Sequence
  chemically synthesized
agtagagacggggtttcaccat

SEQ ID NO: 675183 - DNA, 22 bp, Artificial Sequence
  chemically synthesized
tagtagagacggggtttcacca

SEQ ID NO: 675184 - DNA, 22 bp, Artificial Sequence
  chemically synthesized
ttagtagagacggggtttcacc

SEQ ID NO: 675185 - DNA, 22 bp, Artificial Sequence
  chemically synthesized
gccaacatggtgaaaccccgtc

SEQ ID NO: 675186 - DNA, 22 bp, Artificial Sequence
  chemically synthesized
tatttttagtagagacggggtt

SEQ ID NO: 675187 - DNA, 22 bp, Artificial Sequence
  chemically synthesized
gtatttttagtagagacggggt

SEQ ID NO: 675188 - DNA, 22 bp, Artificial Sequence
  chemically synthesized
tgtatttttagtagagacgggg

SEQ ID NO: 675189 - DNA, 22 bp, Artificial Sequence
  chemically synthesized
ttgtatttttagtagagacggg

SEQ ID NO: 675190 - DNA, 22 bp, Artificial Sequence
  chemically synthesized
atttttgtatttttagtagaga

SEQ ID NO: 675191 - DNA, 22 bp, Artificial Sequence
  chemically synthesized
agctaatttttgtatttttagt

SEQ ID NO: 675192 - DNA, 22 bp, Artificial Sequence
  chemically synthesized
tactaaaaatacaaaaattagc

SEQ ID NO: 675193 - DNA, 22 bp, Artificial Sequence
  chemically synthesized
ctaaaaatacaaaaattagctg

SEQ ID NO: 675194 - DNA, 22 bp, Artificial Sequence
  chemically synthesized
ccgccaccatgctcagctaatt

SEQ ID NO: 675195 - DNA, 22 bp, Artificial Sequence
  chemically synthesized
aaaatacaaaaattagctgagc

SEQ ID NO: 675196 - DNA, 22 bp, Artificial Sequence
  chemically synthesized
agcagcctcccgccaccatgct

SEQ ID NO: 675197 - DNA, 22 bp, Artificial Sequence
  chemically synthesized
cctcagcagcctcccgccacca

SEQ ID NO: 675198 - DNA, 22 bp, Artificial Sequence
  chemically synthesized
ctgcctcagcagcctcccgcca

SEQ ID NO: 675199 - DNA, 22 bp, Artificial Sequence
  chemically synthesized
gctgagcatggtggcgggaggc

SEQ ID NO: 675200 - DNA, 22 bp, Artificial Sequence
  chemically synthesized
tcctgcctcagcagcctcccgc

SEQ ID NO: 675201 - DNA, 22 bp, Artificial Sequence
  chemically synthesized
agcatggtggcgggaggctgct

SEQ ID NO: 675202 - DNA, 22 bp, Artificial Sequence
  chemically synthesized
aagcgattctcctgcctcagca

SEQ ID NO: 675203 - DNA, 22 bp, Artificial Sequence
  chemically synthesized
ctgaggcaggagaatcgcttga

SEQ ID NO: 675204 - DNA, 22 bp, Artificial Sequence
  chemically synthesized
caccgcccgcgttcaagcgatt

SEQ ID NO: 675205 - DNA, 22 bp, Artificial Sequence
  chemically synthesized
aggcaggagaatcgcttgaacg

SEQ ID NO: 675206 - DNA, 22 bp, Artificial Sequence
  chemically synthesized
caacctccaccgcccgcgttca

SEQ ID NO: 675207 - DNA, 22 bp, Artificial Sequence
  chemically synthesized
actgcaacctccaccgcccgcg

SEQ ID NO: 675208 - DNA, 22 bp, Artificial Sequence
  chemically synthesized
atctcactgcaacctccaccgc

SEQ ID NO: 675209 - DNA, 22 bp, Artificial Sequence
  chemically synthesized
gaacgcgggcggtggaggttgc

SEQ ID NO: 675210 - DNA, 22 bp, Artificial Sequence
  chemically synthesized
aacgcgggcggtggaggttgca

SEQ ID NO: 675211 - DNA, 22 bp, Artificial Sequence
  chemically synthesized
cacgatctcatctcactgcaac

SEQ ID NO: 675212 - DNA, 22 bp, Artificial Sequence
  chemically synthesized
gagtgcagttgcacgatctcat

SEQ ID NO: 675213 - DNA, 22 bp, Artificial Sequence
  chemically synthesized
cagtgagatgagatcgtgcaac

SEQ ID NO: 675214 - DNA, 22 bp, Artificial Sequence
  chemically synthesized
tcgccaggctggagtgcagttg

SEQ ID NO: 675215 - DNA, 22 bp, Artificial Sequence
  chemically synthesized
tgtcgccaggctggagtgcagt

SEQ ID NO: 675216 - DNA, 22 bp, Artificial Sequence
  chemically synthesized
actctgtcgccaggctggagtg

SEQ ID NO: 675217 - DNA, 22 bp, Artificial Sequence
  chemically synthesized
cactccagcctggcgacagagt

SEQ ID NO: 675218 - DNA, 22 bp, Artificial Sequence
  chemically synthesized
agacggagtctcactctgtcgc

SEQ ID NO: 675219 - DNA, 22 bp, Artificial Sequence
  chemically synthesized
gagacggagtctcactctgtcg

SEQ ID NO: 675220 - DNA, 22 bp, Artificial Sequence
  chemically synthesized
tgagacggagtctcactctgtc

SEQ ID NO: 675221 - DNA, 22 bp, Artificial Sequence
  chemically synthesized
ttgagacggagtctcactctgt

SEQ ID NO: 675222 - DNA, 22 bp, Artificial Sequence
  chemically synthesized
tttgagacggagtctcactctg

SEQ ID NO: 675223 - DNA, 22 bp, Artificial Sequence
  chemically synthesized
cagcctggcgacagagtgagac

SEQ ID NO: 675224 - DNA, 22 bp, Artificial Sequence
  chemically synthesized
ttttgagacggagtctcactct

SEQ ID NO: 675225 - DNA, 22 bp, Artificial Sequence
  chemically synthesized
tttttgagacggagtctcactc

SEQ ID NO: 675226 - DNA, 22 bp, Artificial Sequence
  chemically synthesized
ttttttgagacggagtctcact

SEQ ID NO: 675227 - DNA, 22 bp, Artificial Sequence
  chemically synthesized
tttttttgagacggagtctcac

SEQ ID NO: 675228 - DNA, 22 bp, Artificial Sequence
  chemically synthesized
ttttttttgagacggagtctca

SEQ ID NO: 675229 - DNA, 22 bp, Artificial Sequence
  chemically synthesized
tttttttttgagacggagtctc

SEQ ID NO: 675230 - DNA, 22 bp, Artificial Sequence
  chemically synthesized
gcgacagagtgagactccgtct

SEQ ID NO: 675231 - DNA, 22 bp, Artificial Sequence
  chemically synthesized
attttttttttttgagacggag

SEQ ID NO: 675232 - DNA, 22 bp, Artificial Sequence
  chemically synthesized
aattttttttttttgagacgga

SEQ ID NO: 675233 - DNA, 22 bp, Artificial Sequence
  chemically synthesized
atttaattttttttttttgaga

SEQ ID NO: 675234 - DNA, 22 bp, Artificial Sequence
  chemically synthesized
ttaatttaattttttttttttg

SEQ ID NO: 675235 - DNA, 22 bp, Artificial Sequence
  chemically synthesized
attaatttaatttttttttttt

SEQ ID NO: 675236 - DNA, 22 bp, Artificial Sequence
  chemically synthesized
cgtctcaaaaaaaaaaaattaa

SEQ ID NO: 675237 - DNA, 22 bp, Artificial Sequence
  chemically synthesized
aaaaaaaaaaaattaaattaat

SEQ ID NO: 675238 - DNA, 22 bp, Artificial Sequence
  chemically synthesized
aattaataaatatgattatcct

SEQ ID NO: 675239 - DNA, 22 bp, Artificial Sequence
  chemically synthesized
aaggatatgaataataggataa

SEQ ID NO: 675240 - DNA, 22 bp, Artificial Sequence
  chemically synthesized
ataaatatgattatcctattat

SEQ ID NO: 675241 - DNA, 22 bp, Artificial Sequence
  chemically synthesized
tcaccaccaacctaaaggatat

SEQ ID NO: 675242 - DNA, 22 bp, Artificial Sequence
  chemically synthesized
tcctattattcatatcctttag

SEQ ID NO: 675243 - DNA, 22 bp, Artificial Sequence
  chemically synthesized
gtcaccaccaacctaaaggata

SEQ ID NO: 675244 - DNA, 22 bp, Artificial Sequence
  chemically synthesized
tgtcaccaccaacctaaaggat

SEQ ID NO: 675245 - DNA, 22 bp, Artificial Sequence
  chemically synthesized
tttgtcaccaccaacctaaagg

SEQ ID NO: 675246 - DNA, 22 bp, Artificial Sequence
  chemically synthesized
ttattcatatcctttaggttgg

SEQ ID NO: 675247 - DNA, 22 bp, Artificial Sequence
  chemically synthesized
ctctttgtcaccaccaacctaa

SEQ ID NO: 675248 - DNA, 22 bp, Artificial Sequence
  chemically synthesized
ttcatatcctttaggttggtgg

SEQ ID NO: 675249 - DNA, 22 bp, Artificial Sequence
  chemically synthesized
atatcctttaggttggtggtga

SEQ ID NO: 675250 - DNA, 22 bp, Artificial Sequence
  chemically synthesized
aacccccagttcctctttgtca

SEQ ID NO: 675251 - DNA, 22 bp, Artificial Sequence
  chemically synthesized
taggttggtggtgacaaagagg

SEQ ID NO: 675252 - DNA, 22 bp, Artificial Sequence
  chemically synthesized
aggttggtggtgacaaagagga

SEQ ID NO: 675253 - DNA, 22 bp, Artificial Sequence
  chemically synthesized
ggttggtggtgacaaagaggaa

SEQ ID NO: 675254 - DNA, 22 bp, Artificial Sequence
  chemically synthesized
gtggtgacaaagaggaactggg

SEQ ID NO: 675255 - DNA, 22 bp, Artificial Sequence
  chemically synthesized
tcagccctaaacccccagttcc

SEQ ID NO: 675256 - DNA, 22 bp, Artificial Sequence
  chemically synthesized
tatgaatgttgtcagccctaaa

SEQ ID NO: 675257 - DNA, 22 bp, Artificial Sequence
  chemically synthesized
gttgtatgaatgttgtcagccc

SEQ ID NO: 675258 - DNA, 22 bp, Artificial Sequence
  chemically synthesized
ggttgtatgaatgttgtcagcc

SEQ ID NO: 675259 - DNA, 22 bp, Artificial Sequence
  chemically synthesized
ggggtttagggctgacaacatt

SEQ ID NO: 675260 - DNA, 22 bp, Artificial Sequence
  chemically synthesized
agggctgacaacattcatacaa

SEQ ID NO: 675261 - DNA, 22 bp, Artificial Sequence
  chemically synthesized
gggctgacaacattcatacaac

SEQ ID NO: 675262 - DNA, 22 bp, Artificial Sequence
  chemically synthesized
gagtaaagcttggttgtatgaa

SEQ ID NO: 675263 - DNA, 22 bp, Artificial Sequence
  chemically synthesized
gctagagtaaagcttggttgta

SEQ ID NO: 675264 - DNA, 22 bp, Artificial Sequence
  chemically synthesized
acaacattcatacaaccaagct

SEQ ID NO: 675265 - DNA, 22 bp, Artificial Sequence
  chemically synthesized
acccctggctagagtaaagctt

SEQ ID NO: 675266 - DNA, 22 bp, Artificial Sequence
  chemically synthesized
aacccctggctagagtaaagct

SEQ ID NO: 675267 - DNA, 22 bp, Artificial Sequence
  chemically synthesized
taacccctggctagagtaaagc

SEQ ID NO: 675268 - DNA, 22 bp, Artificial Sequence
  chemically synthesized
atacaaccaagctttactctag

SEQ ID NO: 675269 - DNA, 22 bp, Artificial Sequence
  chemically synthesized
ttttaacccctggctagagtaa

SEQ ID NO: 675270 - DNA, 22 bp, Artificial Sequence
  chemically synthesized
gttttaacccctggctagagta

SEQ ID NO: 675271 - DNA, 22 bp, Artificial Sequence
  chemically synthesized
tgttttaacccctggctagagt

SEQ ID NO: 675272 - DNA, 22 bp, Artificial Sequence
  chemically synthesized
gttttgttttaacccctggcta

SEQ ID NO: 675273 - DNA, 22 bp, Artificial Sequence
  chemically synthesized
tactctagccaggggttaaaac

SEQ ID NO: 675274 - DNA, 22 bp, Artificial Sequence
  chemically synthesized
actctagccaggggttaaaaca

SEQ ID NO: 675275 - DNA, 22 bp, Artificial Sequence
  chemically synthesized
aatgactggttttgttttaacc

SEQ ID NO: 675276 - DNA, 22 bp, Artificial Sequence
  chemically synthesized
ctctagccaggggttaaaacaa

SEQ ID NO: 675277 - DNA, 22 bp, Artificial Sequence
  chemically synthesized
tagccaggggttaaaacaaaac

SEQ ID NO: 675278 - DNA, 22 bp, Artificial Sequence
  chemically synthesized
gccaggggttaaaacaaaacca

SEQ ID NO: 675279 - DNA, 22 bp, Artificial Sequence
  chemically synthesized
atcattaaatgactggttttgt

SEQ ID NO: 675280 - DNA, 22 bp, Artificial Sequence
  chemically synthesized
catcattaaatgactggttttg

SEQ ID NO: 675281 - DNA, 22 bp, Artificial Sequence
  chemically synthesized
tcatcattaaatgactggtttt

SEQ ID NO: 675282 - DNA, 22 bp, Artificial Sequence
  chemically synthesized
aaacaaaaccagtcatttaatg

SEQ ID NO: 675283 - DNA, 22 bp, Artificial Sequence
  chemically synthesized
gccagtgatctttcatcattaa

SEQ ID NO: 675284 - DNA, 22 bp, Artificial Sequence
  chemically synthesized
tatgtcatgttggccagtgatc

SEQ ID NO: 675285 - DNA, 22 bp, Artificial Sequence
  chemically synthesized
atatgtcatgttggccagtgat

SEQ ID NO: 675286 - DNA, 22 bp, Artificial Sequence
  chemically synthesized
aatgatgaaagatcactggcca

SEQ ID NO: 675287 - DNA, 22 bp, Artificial Sequence
  chemically synthesized
atgatgaaagatcactggccaa

SEQ ID NO: 675288 - DNA, 22 bp, Artificial Sequence
  chemically synthesized
ttatatgtcatgttggccagtg

SEQ ID NO: 675289 - DNA, 22 bp, Artificial Sequence
  chemically synthesized
cttatatgtcatgttggccagt

SEQ ID NO: 675290 - DNA, 22 bp, Artificial Sequence
  chemically synthesized
tcttatatgtcatgttggccag

SEQ ID NO: 675291 - DNA, 22 bp, Artificial Sequence
  chemically synthesized
attttcttatatgtcatgttgg

SEQ ID NO: 675292 - DNA, 22 bp, Artificial Sequence
  chemically synthesized
cattttcttatatgtcatgttg

SEQ ID NO: 675293 - DNA, 22 bp, Artificial Sequence
  chemically synthesized
gtcttcattttcttatatgtca

SEQ ID NO: 675294 - DNA, 22 bp, Artificial Sequence
  chemically synthesized
ttggtcttcattttcttatatg

SEQ ID NO: 675295 - DNA, 22 bp, Artificial Sequence
  chemically synthesized
gccaacatgacatataagaaaa

SEQ ID NO: 675296 - DNA, 22 bp, Artificial Sequence
  chemically synthesized
tattggtcttcattttcttata

SEQ ID NO: 675297 - DNA, 22 bp, Artificial Sequence
  chemically synthesized
ctattggtcttcattttcttat

SEQ ID NO: 675298 - DNA, 22 bp, Artificial Sequence
  chemically synthesized
tctattggtcttcattttctta

SEQ ID NO: 675299 - DNA, 22 bp, Artificial Sequence
  chemically synthesized
ctttctattggtcttcattttc

SEQ ID NO: 675300 - DNA, 22 bp, Artificial Sequence
  chemically synthesized
gctttctattggtcttcatttt

SEQ ID NO: 675301 - DNA, 22 bp, Artificial Sequence
  chemically synthesized
gggcaagtcccttgctttctat

SEQ ID NO: 675302 - DNA, 22 bp, Artificial Sequence
  chemically synthesized
gtgtgacctcgggcaagtccct

SEQ ID NO: 675303 - DNA, 22 bp, Artificial Sequence
  chemically synthesized
ggtgtgacctcgggcaagtccc

SEQ ID NO: 675304 - DNA, 22 bp, Artificial Sequence
  chemically synthesized
tggtgtgacctcgggcaagtcc

SEQ ID NO: 675305 - DNA, 22 bp, Artificial Sequence
  chemically synthesized
agatgccagctttggtgtgacc

SEQ ID NO: 675306 - DNA, 22 bp, Artificial Sequence
  chemically synthesized
gattcagatgccagctttggtg

SEQ ID NO: 675307 - DNA, 22 bp, Artificial Sequence
  chemically synthesized
gcccgaggtcacaccaaagctg

SEQ ID NO: 675308 - DNA, 22 bp, Artificial Sequence
  chemically synthesized
cccgaggtcacaccaaagctgg

SEQ ID NO: 675309 - DNA, 22 bp, Artificial Sequence
  chemically synthesized
gaaaggatagctagattcagat

SEQ ID NO: 675310 - DNA, 22 bp, Artificial Sequence
  chemically synthesized
aactggaaaggatagctagatt

SEQ ID NO: 675311 - DNA, 22 bp, Artificial Sequence
  chemically synthesized
gaactggaaaggatagctagat

SEQ ID NO: 675312 - DNA, 22 bp, Artificial Sequence
  chemically synthesized
tgaactggaaaggatagctaga

SEQ ID NO: 675313 - DNA, 22 bp, Artificial Sequence
  chemically synthesized
gcatctgaatctagctatcctt

SEQ ID NO: 675314 - DNA, 22 bp, Artificial Sequence
  chemically synthesized
aatctagctatcctttccagtt

SEQ ID NO: 675315 - DNA, 22 bp, Artificial Sequence
  chemically synthesized
ccataacgctttgaactggaaa

SEQ ID NO: 675316 - DNA, 22 bp, Artificial Sequence
  chemically synthesized
ctgccataacgctttgaactgg

SEQ ID NO: 675317 - DNA, 22 bp, Artificial Sequence
  chemically synthesized
actgccataacgctttgaactg

SEQ ID NO: 675318 - DNA, 22 bp, Artificial Sequence
  chemically synthesized
gctatcctttccagttcaaagc

SEQ ID NO: 675319 - DNA, 22 bp, Artificial Sequence
  chemically synthesized
tactgccataacgctttgaact

SEQ ID NO: 675320 - DNA, 22 bp, Artificial Sequence
  chemically synthesized
ttactgccataacgctttgaac

SEQ ID NO: 675321 - DNA, 22 bp, Artificial Sequence
  chemically synthesized
tttactgccataacgctttgaa

SEQ ID NO: 675322 - DNA, 22 bp, Artificial Sequence
  chemically synthesized
tcctttccagttcaaagcgtta

SEQ ID NO: 675323 - DNA, 22 bp, Artificial Sequence
  chemically synthesized
actttttactgccataacgctt

SEQ ID NO: 675324 - DNA, 22 bp, Artificial Sequence
  chemically synthesized
gactttttactgccataacgct

SEQ ID NO: 675325 - DNA, 22 bp, Artificial Sequence
  chemically synthesized
tgactttttactgccataacgc

SEQ ID NO: 675326 - DNA, 22 bp, Artificial Sequence
  chemically synthesized
tccagttcaaagcgttatggca

SEQ ID NO: 675327 - DNA, 22 bp, Artificial Sequence
  chemically synthesized
ttgactttttactgccataacg

SEQ ID NO: 675328 - DNA, 22 bp, Artificial Sequence
  chemically synthesized
ccagttcaaagcgttatggcag

SEQ ID NO: 675329 - DNA, 22 bp, Artificial Sequence
  chemically synthesized
cagttcaaagcgttatggcagt

SEQ ID NO: 675330 - DNA, 22 bp, Artificial Sequence
  chemically synthesized
ccttttgactttttactgccat

SEQ ID NO: 675331 - DNA, 22 bp, Artificial Sequence
  chemically synthesized
tgccttttgactttttactgcc

SEQ ID NO: 675332 - DNA, 22 bp, Artificial Sequence
  chemically synthesized
aaagcgttatggcagtaaaaag

SEQ ID NO: 675333 - DNA, 22 bp, Artificial Sequence
  chemically synthesized
aaacctctgccttttgactttt

SEQ ID NO: 675334 - DNA, 22 bp, Artificial Sequence
  chemically synthesized
tggcagtaaaaagtcaaaaggc

SEQ ID NO: 675335 - DNA, 22 bp, Artificial Sequence
  chemically synthesized
agtgttaaaacctctgcctttt

SEQ ID NO: 675336 - DNA, 22 bp, Artificial Sequence
  chemically synthesized
ctcagtgttaaaacctctgcct

SEQ ID NO: 675337 - DNA, 22 bp, Artificial Sequence
  chemically synthesized
atatattgctcagtgttaaaac

SEQ ID NO: 675338 - DNA, 22 bp, Artificial Sequence
  chemically synthesized
aatatattgctcagtgttaaaa

SEQ ID NO: 675339 - DNA, 22 bp, Artificial Sequence
  chemically synthesized
cttaatatattgctcagtgtta

SEQ ID NO: 675340 - DNA, 22 bp, Artificial Sequence
  chemically synthesized
gttccttaatatattgctcagt

SEQ ID NO: 675341 - DNA, 22 bp, Artificial Sequence
  chemically synthesized
tagttccttaatatattgctca

SEQ ID NO: 675342 - DNA, 22 bp, Artificial Sequence
  chemically synthesized
ctagttccttaatatattgctc

SEQ ID NO: 675343 - DNA, 22 bp, Artificial Sequence
  chemically synthesized
cttctagttccttaatatattg

SEQ ID NO: 675344 - DNA, 22 bp, Artificial Sequence
  chemically synthesized
gcttctagttccttaatatatt

SEQ ID NO: 675345 - DNA, 22 bp, Artificial Sequence
  chemically synthesized
taacactgagcaatatattaag

SEQ ID NO: 675346 - DNA, 22 bp, Artificial Sequence
  chemically synthesized
aacactgagcaatatattaagg

SEQ ID NO: 675347 - DNA, 22 bp, Artificial Sequence
  chemically synthesized
ttgcttctagttccttaatata

SEQ ID NO: 675348 - DNA, 22 bp, Artificial Sequence
  chemically synthesized
acactgagcaatatattaagga

SEQ ID NO: 675349 - DNA, 22 bp, Artificial Sequence
  chemically synthesized
gctcttgcttctagttccttaa

SEQ ID NO: 675350 - DNA, 22 bp, Artificial Sequence
  chemically synthesized
ggctcttgcttctagttcctta

SEQ ID NO: 675351 - DNA, 22 bp, Artificial Sequence
  chemically synthesized
agcaatatattaaggaactaga

SEQ ID NO: 675352 - DNA, 22 bp, Artificial Sequence
  chemically synthesized
cttggctcttgcttctagttcc

SEQ ID NO: 675353 - DNA, 22 bp, Artificial Sequence
  chemically synthesized
ccttggctcttgcttctagttc

SEQ ID NO: 675354 - DNA, 22 bp, Artificial Sequence
  chemically synthesized
tccttggctcttgcttctagtt

SEQ ID NO: 675355 - DNA, 22 bp, Artificial Sequence
  chemically synthesized
gctttccttggctcttgcttct

SEQ ID NO: 675356 - DNA, 22 bp, Artificial Sequence
  chemically synthesized
agctttccttggctcttgcttc

SEQ ID NO: 675357 - DNA, 22 bp, Artificial Sequence
  chemically synthesized
aggaactagaagcaagagccaa

SEQ ID NO: 675358 - DNA, 22 bp, Artificial Sequence
  chemically synthesized
aatatttagctttccttggctc

SEQ ID NO: 675359 - DNA, 22 bp, Artificial Sequence
  chemically synthesized
ctcaatatttagctttccttgg

SEQ ID NO: 675360 - DNA, 22 bp, Artificial Sequence
  chemically synthesized
gaagcaagagccaaggaaagct

SEQ ID NO: 675361 - DNA, 22 bp, Artificial Sequence
  chemically synthesized
agctactcaatatttagctttc

SEQ ID NO: 675362 - DNA, 22 bp, Artificial Sequence
  chemically synthesized
cactaagctactcaatatttag

SEQ ID NO: 675363 - DNA, 22 bp, Artificial Sequence
  chemically synthesized
tccactaagctactcaatattt

SEQ ID NO: 675364 - DNA, 22 bp, Artificial Sequence
  chemically synthesized
ttctccactaagctactcaata

SEQ ID NO: 675365 - DNA, 22 bp, Artificial Sequence
  chemically synthesized
aactgttctccactaagctact

SEQ ID NO: 675366 - DNA, 22 bp, Artificial Sequence
  chemically synthesized
aatattgagtagcttagtggag

SEQ ID NO: 675367 - DNA, 22 bp, Artificial Sequence
  chemically synthesized
tgaactaaactgttctccacta

SEQ ID NO: 675368 - DNA, 22 bp, Artificial Sequence
  chemically synthesized
gtgaactaaactgttctccact

SEQ ID NO: 675369 - DNA, 22 bp, Artificial Sequence
  chemically synthesized
tgtgaactaaactgttctccac

SEQ ID NO: 675370 - DNA, 22 bp, Artificial Sequence
  chemically synthesized
agtagcttagtggagaacagtt

SEQ ID NO: 675371 - DNA, 22 bp, Artificial Sequence
  chemically synthesized
agcatattttgtgaactaaact

SEQ ID NO: 675372 - DNA, 22 bp, Artificial Sequence
  chemically synthesized
agtggagaacagtttagttcac

SEQ ID NO: 675373 - DNA, 22 bp, Artificial Sequence
  chemically synthesized
tcagcatattttgtgaactaaa

SEQ ID NO: 675374 - DNA, 22 bp, Artificial Sequence
  chemically synthesized
gtggagaacagtttagttcaca

SEQ ID NO: 675375 - DNA, 22 bp, Artificial Sequence
  chemically synthesized
ctcagcatattttgtgaactaa

SEQ ID NO: 675376 - DNA, 22 bp, Artificial Sequence
  chemically synthesized
tctcagcatattttgtgaacta

SEQ ID NO: 675377 - DNA, 22 bp, Artificial Sequence
  chemically synthesized
ttctcagcatattttgtgaact

SEQ ID NO: 675378 - DNA, 22 bp, Artificial Sequence
  chemically synthesized
atgcttttctcagcatattttg

SEQ ID NO: 675379 - DNA, 22 bp, Artificial Sequence
  chemically synthesized
tcctaatgcttttctcagcata

SEQ ID NO: 675380 - DNA, 22 bp, Artificial Sequence
  chemically synthesized
agttcacaaaatatgctgagaa

SEQ ID NO: 675381 - DNA, 22 bp, Artificial Sequence
  chemically synthesized
gtcctaatgcttttctcagcat

SEQ ID NO: 675382 - DNA, 22 bp, Artificial Sequence
  chemically synthesized
gttcacaaaatatgctgagaaa

SEQ ID NO: 675383 - DNA, 22 bp, Artificial Sequence
  chemically synthesized
acaaaatatgctgagaaaagca

SEQ ID NO: 675384 - DNA, 22 bp, Artificial Sequence
  chemically synthesized
ggagcttgtcctaatgcttttc

SEQ ID NO: 675385 - DNA, 22 bp, Artificial Sequence
  chemically synthesized
cattaggagcttgtcctaatgc

SEQ ID NO: 675386 - DNA, 22 bp, Artificial Sequence
  chemically synthesized
gcattaggagcttgtcctaatg

SEQ ID NO: 675387 - DNA, 22 bp, Artificial Sequence
  chemically synthesized
tgcattaggagcttgtcctaat

SEQ ID NO: 675388 - DNA, 22 bp, Artificial Sequence
  chemically synthesized
ttgcattaggagcttgtcctaa

SEQ ID NO: 675389 - DNA, 22 bp, Artificial Sequence
  chemically synthesized
agaaaagcattaggacaagctc

SEQ ID NO: 675390 - DNA, 22 bp, Artificial Sequence
  chemically synthesized
cttttgcattaggagcttgtcc

SEQ ID NO: 675391 - DNA, 22 bp, Artificial Sequence
  chemically synthesized
ccttttgcattaggagcttgtc

SEQ ID NO: 675392 - DNA, 22 bp, Artificial Sequence
  chemically synthesized
cttccttttgcattaggagctt

SEQ ID NO: 675393 - DNA, 22 bp, Artificial Sequence
  chemically synthesized
tgaattccttccttttgcatta

SEQ ID NO: 675394 - DNA, 22 bp, Artificial Sequence
  chemically synthesized
ggacaagctcctaatgcaaaag

SEQ ID NO: 675395 - DNA, 22 bp, Artificial Sequence
  chemically synthesized
aatgactatgaattccttcctt

SEQ ID NO: 675396 - DNA, 22 bp, Artificial Sequence
  chemically synthesized
tgaatgactatgaattccttcc

SEQ ID NO: 675397 - DNA, 22 bp, Artificial Sequence
  chemically synthesized
ctaatgcaaaaggaaggaattc

SEQ ID NO: 675398 - DNA, 22 bp, Artificial Sequence
  chemically synthesized
atgcaaaaggaaggaattcata

SEQ ID NO: 675399 - DNA, 22 bp, Artificial Sequence
  chemically synthesized
caggattctgaatgactatgaa

SEQ ID NO: 675400 - DNA, 22 bp, Artificial Sequence
  chemically synthesized
gaaactgcaggattctgaatga

SEQ ID NO: 675401 - DNA, 22 bp, Artificial Sequence
  chemically synthesized
ggttagaaactgcaggattctg

SEQ ID NO: 675402 - DNA, 22 bp, Artificial Sequence
  chemically synthesized
gggttagaaactgcaggattct

SEQ ID NO: 675403 - DNA, 22 bp, Artificial Sequence
  chemically synthesized
atagtcattcagaatcctgcag

SEQ ID NO: 675404 - DNA, 22 bp, Artificial Sequence
  chemically synthesized
ttgggttagaaactgcaggatt

SEQ ID NO: 675405 - DNA, 22 bp, Artificial Sequence
  chemically synthesized
aggatgctcttgggttagaaac

SEQ ID NO: 675406 - DNA, 22 bp, Artificial Sequence
  chemically synthesized
agaatcctgcagtttctaaccc

SEQ ID NO: 675407 - DNA, 22 bp, Artificial Sequence
  chemically synthesized
ctgaggatgctcttgggttaga

SEQ ID NO: 675408 - DNA, 22 bp, Artificial Sequence
  chemically synthesized
cctcctgaggatgctcttgggt

SEQ ID NO: 675409 - DNA, 22 bp, Artificial Sequence
  chemically synthesized
cagtttctaacccaagagcatc

SEQ ID NO: 675410 - DNA, 22 bp, Artificial Sequence
  chemically synthesized
agtattccctcctgaggatgct

SEQ ID NO: 675411 - DNA, 22 bp, Artificial Sequence
  chemically synthesized
ctaacccaagagcatcctcagg

SEQ ID NO: 675412 - DNA, 22 bp, Artificial Sequence
  chemically synthesized
taacccaagagcatcctcagga

SEQ ID NO: 675413 - DNA, 22 bp, Artificial Sequence
  chemically synthesized
acccaagagcatcctcaggagg

SEQ ID NO: 675414 - DNA, 22 bp, Artificial Sequence
  chemically synthesized
cattaagtattccctcctgagg

SEQ ID NO: 675415 - DNA, 22 bp, Artificial Sequence
  chemically synthesized
cattccattaagtattccctcc

SEQ ID NO: 675416 - DNA, 22 bp, Artificial Sequence
  chemically synthesized
tacattccattaagtattccct

SEQ ID NO: 675417 - DNA, 22 bp, Artificial Sequence
  chemically synthesized
ctacattccattaagtattccc

SEQ ID NO: 675418 - DNA, 22 bp, Artificial Sequence
  chemically synthesized
tctacattccattaagtattcc

SEQ ID NO: 675419 - DNA, 22 bp, Artificial Sequence
  chemically synthesized
aggagggaatacttaatggaat

SEQ ID NO: 675420 - DNA, 22 bp, Artificial Sequence
  chemically synthesized
ataggctttctacattccatta

SEQ ID NO: 675421 - DNA, 22 bp, Artificial Sequence
  chemically synthesized
gataggctttctacattccatt

SEQ ID NO: 675422 - DNA, 22 bp, Artificial Sequence
  chemically synthesized
tgataggctttctacattccat

SEQ ID NO: 675423 - DNA, 22 bp, Artificial Sequence
  chemically synthesized
ttgataggctttctacattcca

SEQ ID NO: 675424 - DNA, 22 bp, Artificial Sequence
  chemically synthesized
ttttgataggctttctacattc

SEQ ID NO: 675425 - DNA, 22 bp, Artificial Sequence
  chemically synthesized
ctcttttgataggctttctaca

SEQ ID NO: 675426 - DNA, 22 bp, Artificial Sequence
  chemically synthesized
tcctcttttgataggctttcta

SEQ ID NO: 675427 - DNA, 22 bp, Artificial Sequence
  chemically synthesized
aatggaatgtagaaagcctatc

SEQ ID NO: 675428 - DNA, 22 bp, Artificial Sequence
  chemically synthesized
atggaatgtagaaagcctatca

SEQ ID NO: 675429 - DNA, 22 bp, Artificial Sequence
  chemically synthesized
actctcctcttttgataggctt

SEQ ID NO: 675430 - DNA, 22 bp, Artificial Sequence
  chemically synthesized
ttcactctcctcttttgatagg

SEQ ID NO: 675431 - DNA, 22 bp, Artificial Sequence
  chemically synthesized
gttcactctcctcttttgatag

SEQ ID NO: 675432 - DNA, 22 bp, Artificial Sequence
  chemically synthesized
tttgttcactctcctcttttga

SEQ ID NO: 675433 - DNA, 22 bp, Artificial Sequence
  chemically synthesized
tagttatttgttcactctcctc

SEQ ID NO: 675434 - DNA, 22 bp, Artificial Sequence
  chemically synthesized
tcaaaagaggagagtgaacaaa

SEQ ID NO: 675435 - DNA, 22 bp, Artificial Sequence
  chemically synthesized
cccaagaggaagggatattgta

SEQ ID NO: 675436 - DNA, 22 bp, Artificial Sequence
  chemically synthesized
gcccaagaggaagggatattgt

SEQ ID NO: 675437 - DNA, 22 bp, Artificial Sequence
  chemically synthesized
agcttgcccaagaggaagggat

SEQ ID NO: 675438 - DNA, 22 bp, Artificial Sequence
  chemically synthesized
ctcagcttgcccaagaggaagg

SEQ ID NO: 675439 - DNA, 22 bp, Artificial Sequence
  chemically synthesized
cctcagcttgcccaagaggaag

SEQ ID NO: 675440 - DNA, 22 bp, Artificial Sequence
  chemically synthesized
tcctcagcttgcccaagaggaa

SEQ ID NO: 675441 - DNA, 22 bp, Artificial Sequence
  chemically synthesized
tttcctcagcttgcccaagagg

SEQ ID NO: 675442 - DNA, 22 bp, Artificial Sequence
  chemically synthesized
caatatcccttcctcttgggca

SEQ ID NO: 675443 - DNA, 22 bp, Artificial Sequence
  chemically synthesized
tacctctttcctcagcttgccc

SEQ ID NO: 675444 - DNA, 22 bp, Artificial Sequence
  chemically synthesized
gtacctctttcctcagcttgcc

SEQ ID NO: 675445 - DNA, 22 bp, Artificial Sequence
  chemically synthesized
cctcttgggcaagctgaggaaa

SEQ ID NO: 675446 - DNA, 22 bp, Artificial Sequence
  chemically synthesized
ctcttgggcaagctgaggaaag

SEQ ID NO: 675447 - DNA, 22 bp, Artificial Sequence
  chemically synthesized
ttgggcaagctgaggaaagagg

SEQ ID NO: 675448 - DNA, 22 bp, Artificial Sequence
  chemically synthesized
gggcaagctgaggaaagaggta

SEQ ID NO: 675449 - DNA, 22 bp, Artificial Sequence
  chemically synthesized
tcaaaatccttgtacctctttc

SEQ ID NO: 675450 - DNA, 22 bp, Artificial Sequence
  chemically synthesized
ggcaagctgaggaaagaggtac

SEQ ID NO: 675451 - DNA, 22 bp, Artificial Sequence
  chemically synthesized
ctatcaaaatccttgtacctct

SEQ ID NO: 675452 - DNA, 22 bp, Artificial Sequence
  chemically synthesized
aggaaagaggtacaaggatttt

SEQ ID NO: 675453 - DNA, 22 bp, Artificial Sequence
  chemically synthesized
aaaacactgctatcaaaatcct

SEQ ID NO: 675454 - DNA, 22 bp, Artificial Sequence
  chemically synthesized
caagagagttaaaaacactgct

SEQ ID NO: 675455 - DNA, 22 bp, Artificial Sequence
  chemically synthesized
gcaagagagttaaaaacactgc

SEQ ID NO: 675456 - DNA, 22 bp, Artificial Sequence
  chemically synthesized
tgatagcagtgtttttaactct

SEQ ID NO: 675457 - DNA, 22 bp, Artificial Sequence
  chemically synthesized
gatagcagtgtttttaactctc

SEQ ID NO: 675458 - DNA, 22 bp, Artificial Sequence
  chemically synthesized
atagcagtgtttttaactctct

SEQ ID NO: 675459 - DNA, 22 bp, Artificial Sequence
  chemically synthesized
taaatcagcaatttgcaagaga

SEQ ID NO: 675460 - DNA, 22 bp, Artificial Sequence
  chemically synthesized
ttaactctcttgcaaattgctg

SEQ ID NO: 675461 - DNA, 22 bp, Artificial Sequence
  chemically synthesized
taactctcttgcaaattgctga

SEQ ID NO: 675462 - DNA, 22 bp, Artificial Sequence
  chemically synthesized
aactctcttgcaaattgctgat

SEQ ID NO: 675463 - DNA, 22 bp, Artificial Sequence
  chemically synthesized
actctcttgcaaattgctgatt

SEQ ID NO: 675464 - DNA, 22 bp, Artificial Sequence
  chemically synthesized
tcttgcaaattgctgatttata

SEQ ID NO: 675465 - DNA, 22 bp, Artificial Sequence
  chemically synthesized
ttgcaaattgctgatttataat

SEQ ID NO: 675466 - DNA, 22 bp, Artificial Sequence
  chemically synthesized
gcaaattgctgatttataatga

SEQ ID NO: 675467 - DNA, 22 bp, Artificial Sequence
  chemically synthesized
caaattgctgatttataatgat

SEQ ID NO: 675468 - DNA, 22 bp, Artificial Sequence
  chemically synthesized
aagatacatcaatatcattata

SEQ ID NO: 675469 - DNA, 22 bp, Artificial Sequence
  chemically synthesized
aaagatacatcaatatcattat

SEQ ID NO: 675470 - DNA, 22 bp, Artificial Sequence
  chemically synthesized
taaagatacatcaatatcatta

SEQ ID NO: 675471 - DNA, 22 bp, Artificial Sequence
  chemically synthesized
ttaaagatacatcaatatcatt

SEQ ID NO: 675472 - DNA, 22 bp, Artificial Sequence
  chemically synthesized
tttaaagatacatcaatatcat

SEQ ID NO: 675473 - DNA, 22 bp, Artificial Sequence
  chemically synthesized
ctgatttataatgatattgatg

SEQ ID NO: 675474 - DNA, 22 bp, Artificial Sequence
  chemically synthesized
atttataatgatattgatgtat

SEQ ID NO: 675475 - DNA, 22 bp, Artificial Sequence
  chemically synthesized
aaagctttttaaagatacatca

SEQ ID NO: 675476 - DNA, 22 bp, Artificial Sequence
  chemically synthesized
ataatgatattgatgtatcttt

SEQ ID NO: 675477 - DNA, 22 bp, Artificial Sequence
  chemically synthesized
taatgatattgatgtatcttta

SEQ ID NO: 675478 - DNA, 22 bp, Artificial Sequence
  chemically synthesized
atgtatctttaaaaagctttta

SEQ ID NO: 675479 - DNA, 22 bp, Artificial Sequence
  chemically synthesized
agtcaatggggctaaaagcttt

SEQ ID NO: 675480 - DNA, 22 bp, Artificial Sequence
  chemically synthesized
gttaagtcaatggggctaaaag

SEQ ID NO: 675481 - DNA, 22 bp, Artificial Sequence
  chemically synthesized
taaaaagcttttagccccattg

SEQ ID NO: 675482 - DNA, 22 bp, Artificial Sequence
  chemically synthesized
aaaaagcttttagccccattga

SEQ ID NO: 675483 - DNA, 22 bp, Artificial Sequence
  chemically synthesized
aaaagcttttagccccattgac

SEQ ID NO: 675484 - DNA, 22 bp, Artificial Sequence
  chemically synthesized
agtcctagttaagtcaatgggg

SEQ ID NO: 675485 - DNA, 22 bp, Artificial Sequence
  chemically synthesized
gttaagtcctagttaagtcaat

SEQ ID NO: 675486 - DNA, 22 bp, Artificial Sequence
  chemically synthesized
ttagccccattgacttaactag

SEQ ID NO: 675487 - DNA, 22 bp, Artificial Sequence
  chemically synthesized
tagccccattgacttaactagg

SEQ ID NO: 675488 - DNA, 22 bp, Artificial Sequence
  chemically synthesized
agccccattgacttaactagga

SEQ ID NO: 675489 - DNA, 22 bp, Artificial Sequence
  chemically synthesized
gccccattgacttaactaggac

SEQ ID NO: 675490 - DNA, 22 bp, Artificial Sequence
  chemically synthesized
ggagaactagttaagtcctagt

SEQ ID NO: 675491 - DNA, 22 bp, Artificial Sequence
  chemically synthesized
gttaggagaactagttaagtcc

SEQ ID NO: 675492 - DNA, 22 bp, Artificial Sequence
  chemically synthesized
tagttaggagaactagttaagt

SEQ ID NO: 675493 - DNA, 22 bp, Artificial Sequence
  chemically synthesized
acttaactaggacttaactagt

SEQ ID NO: 675494 - DNA, 22 bp, Artificial Sequence
  chemically synthesized
aactaggacttaactagttctc

SEQ ID NO: 675495 - DNA, 22 bp, Artificial Sequence
  chemically synthesized
actaggacttaactagttctcc

SEQ ID NO: 675496 - DNA, 22 bp, Artificial Sequence
  chemically synthesized
agcagttctagttaggagaact

SEQ ID NO: 675497 - DNA, 22 bp, Artificial Sequence
  chemically synthesized
cagcagttctagttaggagaac

SEQ ID NO: 675498 - DNA, 22 bp, Artificial Sequence
  chemically synthesized
ggacttaactagttctcctaac

SEQ ID NO: 675499 - DNA, 22 bp, Artificial Sequence
  chemically synthesized
ttcagcagttctagttaggaga

SEQ ID NO: 675500 - DNA, 22 bp, Artificial Sequence
  chemically synthesized
aactagttctcctaactagaac

SEQ ID NO: 675501 - DNA, 22 bp, Artificial Sequence
  chemically synthesized
actagttctcctaactagaact

SEQ ID NO: 675502 - DNA, 22 bp, Artificial Sequence
  chemically synthesized
gttctcctaactagaactgctg

SEQ ID NO: 675503 - DNA, 22 bp, Artificial Sequence
  chemically synthesized
ggggtgtgattcttcagcagtt

SEQ ID NO: 675504 - DNA, 22 bp, Artificial Sequence
  chemically synthesized
tcctaactagaactgctgaaga

SEQ ID NO: 675505 - DNA, 22 bp, Artificial Sequence
  chemically synthesized
ctaactagaactgctgaagaat

SEQ ID NO: 675506 - DNA, 22 bp, Artificial Sequence
  chemically synthesized
aggttaggggtgtgattcttca

SEQ ID NO: 675507 - DNA, 22 bp, Artificial Sequence
  chemically synthesized
actagaactgctgaagaatcac

SEQ ID NO: 675508 - DNA, 22 bp, Artificial Sequence
  chemically synthesized
gaactgctgaagaatcacaccc

SEQ ID NO: 675509 - DNA, 22 bp, Artificial Sequence
  chemically synthesized
ggcctgaggttaggggtgtgat

SEQ ID NO: 675510 - DNA, 22 bp, Artificial Sequence
  chemically synthesized
ctgggcctgaggttaggggtgt

SEQ ID NO: 675511 - DNA, 22 bp, Artificial Sequence
  chemically synthesized
ctgaagaatcacacccctaacc

SEQ ID NO: 675512 - DNA, 22 bp, Artificial Sequence
  chemically synthesized
aagaatcacacccctaacctca

SEQ ID NO: 675513 - DNA, 22 bp, Artificial Sequence
  chemically synthesized
gggtctgctgggcctgaggtta

SEQ ID NO: 675514 - DNA, 22 bp, Artificial Sequence
  chemically synthesized
agggtctgctgggcctgaggtt

SEQ ID NO: 675515 - DNA, 22 bp, Artificial Sequence
  chemically synthesized
tagggtctgctgggcctgaggt

SEQ ID NO: 675516 - DNA, 22 bp, Artificial Sequence
  chemically synthesized
attttagggtctgctgggcctg

SEQ ID NO: 675517 - DNA, 22 bp, Artificial Sequence
  chemically synthesized
aattttagggtctgctgggcct

SEQ ID NO: 675518 - DNA, 22 bp, Artificial Sequence
  chemically synthesized
acctcaggcccagcagacccta

SEQ ID NO: 675519 - DNA, 22 bp, Artificial Sequence
  chemically synthesized
aggcccagcagaccctaaaatt

SEQ ID NO: 675520 - DNA, 22 bp, Artificial Sequence
  chemically synthesized
aaatgagggtttaattttaggg

SEQ ID NO: 675521 - DNA, 22 bp, Artificial Sequence
  chemically synthesized
agaatgttaaaatgagggttta

SEQ ID NO: 675522 - DNA, 22 bp, Artificial Sequence
  chemically synthesized
cagaatgttaaaatgagggttt

SEQ ID NO: 675523 - DNA, 22 bp, Artificial Sequence
  chemically synthesized
aaattaaaccctcattttaaca

SEQ ID NO: 675524 - DNA, 22 bp, Artificial Sequence
  chemically synthesized
cagagagcttcagaatgttaaa

SEQ ID NO: 675525 - DNA, 22 bp, Artificial Sequence
  chemically synthesized
gcagagagcttcagaatgttaa

SEQ ID NO: 675526 - DNA, 22 bp, Artificial Sequence
  chemically synthesized
aaccctcattttaacattctga

SEQ ID NO: 675527 - DNA, 22 bp, Artificial Sequence
  chemically synthesized
tggtttgcagagagcttcagaa

SEQ ID NO: 675528 - DNA, 22 bp, Artificial Sequence
  chemically synthesized
attttaacattctgaagctctc

SEQ ID NO: 675529 - DNA, 22 bp, Artificial Sequence
  chemically synthesized
taacattctgaagctctctgca

SEQ ID NO: 675530 - DNA, 22 bp, Artificial Sequence
  chemically synthesized
atgtctatggtttgcagagagc

SEQ ID NO: 675531 - DNA, 22 bp, Artificial Sequence
  chemically synthesized
aacattctgaagctctctgcaa

SEQ ID NO: 675532 - DNA, 22 bp, Artificial Sequence
  chemically synthesized
catgtctatggtttgcagagag

SEQ ID NO: 675533 - DNA, 22 bp, Artificial Sequence
  chemically synthesized
acattctgaagctctctgcaaa

SEQ ID NO: 675534 - DNA, 22 bp, Artificial Sequence
  chemically synthesized
gcttcatgtctatggtttgcag

SEQ ID NO: 675535 - DNA, 22 bp, Artificial Sequence
  chemically synthesized
agcttcatgtctatggtttgca

SEQ ID NO: 675536 - DNA, 22 bp, Artificial Sequence
  chemically synthesized
tgaagctctctgcaaaccatag

SEQ ID NO: 675537 - DNA, 22 bp, Artificial Sequence
  chemically synthesized
aagctctctgcaaaccatagac

SEQ ID NO: 675538 - DNA, 22 bp, Artificial Sequence
  chemically synthesized
tctgcaaaccatagacatgaag

SEQ ID NO: 675539 - DNA, 22 bp, Artificial Sequence
  chemically synthesized
tgcaaaccatagacatgaagct

SEQ ID NO: 675540 - DNA, 22 bp, Artificial Sequence
  chemically synthesized
caaaccatagacatgaagctaa

SEQ ID NO: 675541 - DNA, 22 bp, Artificial Sequence
  chemically synthesized
tcagcacgtagcccttagcttc

SEQ ID NO: 675542 - DNA, 22 bp, Artificial Sequence
  chemically synthesized
aaggcagtctatcagcacgtag

SEQ ID NO: 675543 - DNA, 22 bp, Artificial Sequence
  chemically synthesized
gaaggcagtctatcagcacgta

SEQ ID NO: 675544 - DNA, 22 bp, Artificial Sequence
  chemically synthesized
agggctacgtgctgatagactg

SEQ ID NO: 675545 - DNA, 22 bp, Artificial Sequence
  chemically synthesized
cgtgctgatagactgccttcaa

SEQ ID NO: 675546 - DNA, 22 bp, Artificial Sequence
  chemically synthesized
aaaaccataagatttgaaggca

SEQ ID NO: 675547 - DNA, 22 bp, Artificial Sequence
  chemically synthesized
aaaaaccataagatttgaaggc

SEQ ID NO: 675548 - DNA, 22 bp, Artificial Sequence
  chemically synthesized
taaaaaccataagatttgaagg

SEQ ID NO: 675549 - DNA, 22 bp, Artificial Sequence
  chemically synthesized
atagactgccttcaaatcttat

SEQ ID NO: 675550 - DNA, 22 bp, Artificial Sequence
  chemically synthesized
ccttcaaatcttatggttttta

SEQ ID NO: 675551 - DNA, 22 bp, Artificial Sequence
  chemically synthesized
ggaaaagtggtctttaaaaacc

SEQ ID NO: 675552 - DNA, 22 bp, Artificial Sequence
  chemically synthesized
aggaaaagtggtctttaaaaac

SEQ ID NO: 675553 - DNA, 22 bp, Artificial Sequence
  chemically synthesized
caaatcttatggtttttaaaga

SEQ ID NO: 675554 - DNA, 22 bp, Artificial Sequence
  chemically synthesized
aaatcttatggtttttaaagac

SEQ ID NO: 675555 - DNA, 22 bp, Artificial Sequence
  chemically synthesized
ttaggaaaagtggtctttaaaa

SEQ ID NO: 675556 - DNA, 22 bp, Artificial Sequence
  chemically synthesized
gaattcttaggaaaagtggtct

SEQ ID NO: 675557 - DNA, 22 bp, Artificial Sequence
  chemically synthesized
atggtttttaaagaccactttt

SEQ ID NO: 675558 - DNA, 22 bp, Artificial Sequence
  chemically synthesized
ggaattcttaggaaaagtggtc

SEQ ID NO: 675559 - DNA, 22 bp, Artificial Sequence
  chemically synthesized
tggtttttaaagaccacttttc

SEQ ID NO: 675560 - DNA, 22 bp, Artificial Sequence
  chemically synthesized
tggaattcttaggaaaagtggt

SEQ ID NO: 675561 - DNA, 22 bp, Artificial Sequence
  chemically synthesized
ttggaattcttaggaaaagtgg

SEQ ID NO: 675562 - DNA, 22 bp, Artificial Sequence
  chemically synthesized
ttaaagaccacttttcctaaga

SEQ ID NO: 675563 - DNA, 22 bp, Artificial Sequence
  chemically synthesized
taaagaccacttttcctaagaa

SEQ ID NO: 675564 - DNA, 22 bp, Artificial Sequence
  chemically synthesized
aaagaccacttttcctaagaat

SEQ ID NO: 675565 - DNA, 22 bp, Artificial Sequence
  chemically synthesized
agtgtttttggaattcttagga

SEQ ID NO: 675566 - DNA, 22 bp, Artificial Sequence
  chemically synthesized
aagaccacttttcctaagaatt

SEQ ID NO: 675567 - DNA, 22 bp, Artificial Sequence
  chemically synthesized
tgagtgtttttggaattcttag

SEQ ID NO: 675568 - DNA, 22 bp, Artificial Sequence
  chemically synthesized
ctgagtgtttttggaattctta

SEQ ID NO: 675569 - DNA, 22 bp, Artificial Sequence
  chemically synthesized
ttcctaagaattccaaaaacac

SEQ ID NO: 675570 - DNA, 22 bp, Artificial Sequence
  chemically synthesized
tcctaagaattccaaaaacact

SEQ ID NO: 675571 - DNA, 22 bp, Artificial Sequence
  chemically synthesized
cctaagaattccaaaaacactc

SEQ ID NO: 675572 - DNA, 22 bp, Artificial Sequence
  chemically synthesized
ctaagaattccaaaaacactca

SEQ ID NO: 675573 - DNA, 22 bp, Artificial Sequence
  chemically synthesized
aaaaatggacttctgagtgttt

SEQ ID NO: 675574 - DNA, 22 bp, Artificial Sequence
  chemically synthesized
caaaaatggacttctgagtgtt

SEQ ID NO: 675575 - DNA, 22 bp, Artificial Sequence
  chemically synthesized
agaattccaaaaacactcagaa

SEQ ID NO: 675576 - DNA, 22 bp, Artificial Sequence
  chemically synthesized
tcaaaaatggacttctgagtgt

SEQ ID NO: 675577 - DNA, 22 bp, Artificial Sequence
  chemically synthesized
aattttcaaaaatggacttctg

SEQ ID NO: 675578 - DNA, 22 bp, Artificial Sequence
  chemically synthesized
caaaaacactcagaagtccatt

SEQ ID NO: 675579 - DNA, 22 bp, Artificial Sequence
  chemically synthesized
tcaattttcaaaaatggacttc

SEQ ID NO: 675580 - DNA, 22 bp, Artificial Sequence
  chemically synthesized
agaagtccatttttgaaaattg

SEQ ID NO: 675581 - DNA, 22 bp, Artificial Sequence
  chemically synthesized
aatgatgcgaaagctctcaatt

SEQ ID NO: 675582 - DNA, 22 bp, Artificial Sequence
  chemically synthesized
acctgaatgatgcgaaagctct

SEQ ID NO: 675583 - DNA, 22 bp, Artificial Sequence
  chemically synthesized
ttgaaaattgagagctttcgca

SEQ ID NO: 675584 - DNA, 22 bp, Artificial Sequence
  chemically synthesized
tgaaaattgagagctttcgcat

SEQ ID NO: 675585 - DNA, 22 bp, Artificial Sequence
  chemically synthesized
gaaaattgagagctttcgcatc

SEQ ID NO: 675586 - DNA, 22 bp, Artificial Sequence
  chemically synthesized
aaaattgagagctttcgcatca

SEQ ID NO: 675587 - DNA, 22 bp, Artificial Sequence
  chemically synthesized
agagctttcgcatcattcaggt

SEQ ID NO: 675588 - DNA, 22 bp, Artificial Sequence
  chemically synthesized
tccagcatgatgctcacctgaa

SEQ ID NO: 675589 - DNA, 22 bp, Artificial Sequence
  chemically synthesized
ctatccagcatgatgctcacct

SEQ ID NO: 675590 - DNA, 22 bp, Artificial Sequence
  chemically synthesized
tcgcatcattcaggtgagcatc

SEQ ID NO: 675591 - DNA, 22 bp, Artificial Sequence
  chemically synthesized
cgcatcattcaggtgagcatca

SEQ ID NO: 675592 - DNA, 22 bp, Artificial Sequence
  chemically synthesized
gcatcattcaggtgagcatcat

SEQ ID NO: 675593 - DNA, 22 bp, Artificial Sequence
  chemically synthesized
gatcctactatccagcatgatg

SEQ ID NO: 675594 - DNA, 22 bp, Artificial Sequence
  chemically synthesized
ggatcctactatccagcatgat

SEQ ID NO: 675595 - DNA, 22 bp, Artificial Sequence
  chemically synthesized
tggatcctactatccagcatga

SEQ ID NO: 675596 - DNA, 22 bp, Artificial Sequence
  chemically synthesized
ttggatcctactatccagcatg

SEQ ID NO: 675597 - DNA, 22 bp, Artificial Sequence
  chemically synthesized
aggtgagcatcatgctggatag

SEQ ID NO: 675598 - DNA, 22 bp, Artificial Sequence
  chemically synthesized
cccaatttttggatcctactat

SEQ ID NO: 675599 - DNA, 22 bp, Artificial Sequence
  chemically synthesized
ttgcccaatttttggatcctac

SEQ ID NO: 675600 - DNA, 22 bp, Artificial Sequence
  chemically synthesized
atctgttgcccaatttttggat

SEQ ID NO: 675601 - DNA, 22 bp, Artificial Sequence
  chemically synthesized
aatctgttgcccaatttttgga

SEQ ID NO: 675602 - DNA, 22 bp, Artificial Sequence
  chemically synthesized
taatctgttgcccaatttttgg

SEQ ID NO: 675603 - DNA, 22 bp, Artificial Sequence
  chemically synthesized
gatagtaggatccaaaaattgg

SEQ ID NO: 675604 - DNA, 22 bp, Artificial Sequence
  chemically synthesized
ttaatctgttgcccaatttttg

SEQ ID NO: 675605 - DNA, 22 bp, Artificial Sequence
  chemically synthesized
tttaatctgttgcccaattttt

SEQ ID NO: 675606 - DNA, 22 bp, Artificial Sequence
  chemically synthesized
gccctttttaatctgttgccca

SEQ ID NO: 675607 - DNA, 22 bp, Artificial Sequence
  chemically synthesized
agaaggatctagccctttttaa

SEQ ID NO: 675608 - DNA, 22 bp, Artificial Sequence
  chemically synthesized
cagaaggatctagcccttttta

SEQ ID NO: 675609 - DNA, 22 bp, Artificial Sequence
  chemically synthesized
ggcaacagattaaaaagggcta

SEQ ID NO: 675610 - DNA, 22 bp, Artificial Sequence
  chemically synthesized
ttcagaaggatctagccctttt

SEQ ID NO: 675611 - DNA, 22 bp, Artificial Sequence
  chemically synthesized
tagcgttcttcagaaggatcta

SEQ ID NO: 675612 - DNA, 22 bp, Artificial Sequence
  chemically synthesized
aaaagggctagatccttctgaa

SEQ ID NO: 675613 - DNA, 22 bp, Artificial Sequence
  chemically synthesized
agttatagcgttcttcagaagg

SEQ ID NO: 675614 - DNA, 22 bp, Artificial Sequence
  chemically synthesized
aagttatagcgttcttcagaag

SEQ ID NO: 675615 - DNA, 22 bp, Artificial Sequence
  chemically synthesized
ttaagttatagcgttcttcaga

SEQ ID NO: 675616 - DNA, 22 bp, Artificial Sequence
  chemically synthesized
cttaagttatagcgttcttcag

SEQ ID NO: 675617 - DNA, 22 bp, Artificial Sequence
  chemically synthesized
tcttaagttatagcgttcttca

SEQ ID NO: 675618 - DNA, 22 bp, Artificial Sequence
  chemically synthesized
ttcttaagttatagcgttcttc

SEQ ID NO: 675619 - DNA, 22 bp, Artificial Sequence
  chemically synthesized
gatccttctgaagaacgctata

SEQ ID NO: 675620 - DNA, 22 bp, Artificial Sequence
  chemically synthesized
cttttcttaagttatagcgttc

SEQ ID NO: 675621 - DNA, 22 bp, Artificial Sequence
  chemically synthesized
ccttttcttaagttatagcgtt

SEQ ID NO: 675622 - DNA, 22 bp, Artificial Sequence
  chemically synthesized
tccttttcttaagttatagcgt

SEQ ID NO: 675623 - DNA, 22 bp, Artificial Sequence
  chemically synthesized
gttttccttttcttaagttata

SEQ ID NO: 675624 - DNA, 22 bp, Artificial Sequence
  chemically synthesized
ctgaagaacgctataacttaag

SEQ ID NO: 675625 - DNA, 22 bp, Artificial Sequence
  chemically synthesized
tgaagaacgctataacttaaga

SEQ ID NO: 675626 - DNA, 22 bp, Artificial Sequence
  chemically synthesized
aagaacgctataacttaagaaa

SEQ ID NO: 675627 - DNA, 22 bp, Artificial Sequence
  chemically synthesized
aaggggtactggttttcctttt

SEQ ID NO: 675628 - DNA, 22 bp, Artificial Sequence
  chemically synthesized
tcaaggggtactggttttcctt

SEQ ID NO: 675629 - DNA, 22 bp, Artificial Sequence
  chemically synthesized
taacttaagaaaaggaaaacca

SEQ ID NO: 675630 - DNA, 22 bp, Artificial Sequence
  chemically synthesized
ctcaaggggtactggttttcct

SEQ ID NO: 675631 - DNA, 22 bp, Artificial Sequence
  chemically synthesized
tctcaaggggtactggttttcc

SEQ ID NO: 675632 - DNA, 22 bp, Artificial Sequence
  chemically synthesized
aagaaaaggaaaaccagtaccc

SEQ ID NO: 675633 - DNA, 22 bp, Artificial Sequence
  chemically synthesized
agaaaaggaaaaccagtacccc

SEQ ID NO: 675634 - DNA, 22 bp, Artificial Sequence
  chemically synthesized
accacaagtgttttctcaaggg

SEQ ID NO: 675635 - DNA, 22 bp, Artificial Sequence
  chemically synthesized
aaccacaagtgttttctcaagg

SEQ ID NO: 675636 - DNA, 22 bp, Artificial Sequence
  chemically synthesized
ttaaccacaagtgttttctcaa

SEQ ID NO: 675637 - DNA, 22 bp, Artificial Sequence
  chemically synthesized
aagccctcttaaccacaagtgt

SEQ ID NO: 675638 - DNA, 22 bp, Artificial Sequence
  chemically synthesized
attgaagccctcttaaccacaa

SEQ ID NO: 675639 - DNA, 22 bp, Artificial Sequence
  chemically synthesized
cattgaagccctcttaaccaca

SEQ ID NO: 675640 - DNA, 22 bp, Artificial Sequence
  chemically synthesized
gagaaaacacttgtggttaaga

SEQ ID NO: 675641 - DNA, 22 bp, Artificial Sequence
  chemically synthesized
agaaaacacttgtggttaagag

SEQ ID NO: 675642 - DNA, 22 bp, Artificial Sequence
  chemically synthesized
cttcattgaagccctcttaacc

SEQ ID NO: 675643 - DNA, 22 bp, Artificial Sequence
  chemically synthesized
ccttcattgaagccctcttaac

SEQ ID NO: 675644 - DNA, 22 bp, Artificial Sequence
  chemically synthesized
tccttcattgaagccctcttaa

SEQ ID NO: 675645 - DNA, 22 bp, Artificial Sequence
  chemically synthesized
ttccttcattgaagccctctta

SEQ ID NO: 675646 - DNA, 22 bp, Artificial Sequence
  chemically synthesized
cttttccttcattgaagccctc

SEQ ID NO: 675647 - DNA, 22 bp, Artificial Sequence
  chemically synthesized
ccttttccttcattgaagccct

SEQ ID NO: 675648 - DNA, 22 bp, Artificial Sequence
  chemically synthesized
gtggttaagagggcttcaatga

SEQ ID NO: 675649 - DNA, 22 bp, Artificial Sequence
  chemically synthesized
tggttaagagggcttcaatgaa

SEQ ID NO: 675650 - DNA, 22 bp, Artificial Sequence
  chemically synthesized
caatttccttttccttcattga

SEQ ID NO: 675651 - DNA, 22 bp, Artificial Sequence
  chemically synthesized
ttccaatttccttttccttcat

SEQ ID NO: 675652 - DNA, 22 bp, Artificial Sequence
  chemically synthesized
agagggcttcaatgaaggaaaa

SEQ ID NO: 675653 - DNA, 22 bp, Artificial Sequence
  chemically synthesized
attccaatttccttttccttca

SEQ ID NO: 675654 - DNA, 22 bp, Artificial Sequence
  chemically synthesized
cttattccaatttccttttcct

SEQ ID NO: 675655 - DNA, 22 bp, Artificial Sequence
  chemically synthesized
caatgaaggaaaaggaaattgg

SEQ ID NO: 675656 - DNA, 22 bp, Artificial Sequence
  chemically synthesized
gtgttacttattccaatttcct

SEQ ID NO: 675657 - DNA, 22 bp, Artificial Sequence
  chemically synthesized
aatgaaggaaaaggaaattgga

SEQ ID NO: 675658 - DNA, 22 bp, Artificial Sequence
  chemically synthesized
tggtgttacttattccaatttc

SEQ ID NO: 675659 - DNA, 22 bp, Artificial Sequence
  chemically synthesized
gatgcaccgtatgttctggtgt

SEQ ID NO: 675660 - DNA, 22 bp, Artificial Sequence
  chemically synthesized
gaataagtaacaccagaacata

SEQ ID NO: 675661 - DNA, 22 bp, Artificial Sequence
  chemically synthesized
aaatctagatgcaccgtatgtt

SEQ ID NO: 675662 - DNA, 22 bp, Artificial Sequence
  chemically synthesized
ttaaaatctagatgcaccgtat

SEQ ID NO: 675663 - DNA, 22 bp, Artificial Sequence
  chemically synthesized
attaaaatctagatgcaccgta

SEQ ID NO: 675664 - DNA, 22 bp, Artificial Sequence
  chemically synthesized
aagcagtttattaaaatctaga

SEQ ID NO: 675665 - DNA, 22 bp, Artificial Sequence
  chemically synthesized
caagcagtttattaaaatctag

SEQ ID NO: 675666 - DNA, 22 bp, Artificial Sequence
  chemically synthesized
tttcaagcagtttattaaaatc

SEQ ID NO: 675667 - DNA, 22 bp, Artificial Sequence
  chemically synthesized
atttcaagcagtttattaaaat

SEQ ID NO: 675668 - DNA, 22 bp, Artificial Sequence
  chemically synthesized
tatttcaagcagtttattaaaa

SEQ ID NO: 675669 - DNA, 22 bp, Artificial Sequence
  chemically synthesized
attttatttcaagcagtttatt

SEQ ID NO: 675670 - DNA, 22 bp, Artificial Sequence
  chemically synthesized
gattttaataaactgcttgaaa

SEQ ID NO: 675671 - DNA, 22 bp, Artificial Sequence
  chemically synthesized
agaaagctgattttatttcaag

SEQ ID NO: 675672 - DNA, 22 bp, Artificial Sequence
  chemically synthesized
cagaaagctgattttatttcaa

SEQ ID NO: 675673 - DNA, 22 bp, Artificial Sequence
  chemically synthesized
taataaactgcttgaaataaaa

SEQ ID NO: 675674 - DNA, 22 bp, Artificial Sequence
  chemically synthesized
aataaactgcttgaaataaaat

SEQ ID NO: 675675 - DNA, 22 bp, Artificial Sequence
  chemically synthesized
ataaactgcttgaaataaaatc

SEQ ID NO: 675676 - DNA, 22 bp, Artificial Sequence
  chemically synthesized
cacttcagaaagctgattttat

SEQ ID NO: 675677 - DNA, 22 bp, Artificial Sequence
  chemically synthesized
cttgaaataaaatcagctttct

SEQ ID NO: 675678 - DNA, 22 bp, Artificial Sequence
  chemically synthesized
gaaataaaatcagctttctgaa

SEQ ID NO: 675679 - DNA, 22 bp, Artificial Sequence
  chemically synthesized
aaataaaatcagctttctgaag

SEQ ID NO: 675680 - DNA, 22 bp, Artificial Sequence
  chemically synthesized
tctgaagtgcagcgattctctc

SEQ ID NO: 675681 - DNA, 22 bp, Artificial Sequence
  chemically synthesized
ctgaagtgcagcgattctctct

SEQ ID NO: 675682 - DNA, 22 bp, Artificial Sequence
  chemically synthesized
tgaagtgcagcgattctctctt

SEQ ID NO: 675683 - DNA, 22 bp, Artificial Sequence
  chemically synthesized
aagtgcagcgattctctcttca

SEQ ID NO: 675684 - DNA, 22 bp, Artificial Sequence
  chemically synthesized
tctcttcacattatcctatttt

SEQ ID NO: 675685 - DNA, 22 bp, Artificial Sequence
  chemically synthesized
tcttcacattatcctattttta

SEQ ID NO: 675686 - DNA, 22 bp, Artificial Sequence
  chemically synthesized
ttcacattatcctatttttacc

SEQ ID NO: 675687 - DNA, 22 bp, Artificial Sequence
  chemically synthesized
cacattatcctatttttaccta

SEQ ID NO: 675688 - DNA, 22 bp, Artificial Sequence
  chemically synthesized
acattatcctatttttacctac

SEQ ID NO: 675689 - DNA, 22 bp, Artificial Sequence
  chemically synthesized
tgaaggagacatgtaggtaaaa

SEQ ID NO: 675690 - DNA, 22 bp, Artificial Sequence
  chemically synthesized
atgaaggagacatgtaggtaaa

SEQ ID NO: 675691 - DNA, 22 bp, Artificial Sequence
  chemically synthesized
tcctatttttacctacatgtct

SEQ ID NO: 675692 - DNA, 22 bp, Artificial Sequence
  chemically synthesized
tttttacctacatgtctccttc

SEQ ID NO: 675693 - DNA, 22 bp, Artificial Sequence
  chemically synthesized
ttacctacatgtctccttcata

SEQ ID NO: 675694 - DNA, 22 bp, Artificial Sequence
  chemically synthesized
tacctacatgtctccttcataa

SEQ ID NO: 675695 - DNA, 22 bp, Artificial Sequence
  chemically synthesized
acctacatgtctccttcataaa

SEQ ID NO: 675696 - DNA, 22 bp, Artificial Sequence
  chemically synthesized
cctacatgtctccttcataaac

SEQ ID NO: 675697 - DNA, 22 bp, Artificial Sequence
  chemically synthesized
catgtctccttcataaactggt

SEQ ID NO: 675698 - DNA, 22 bp, Artificial Sequence
  chemically synthesized
tcagtatagtacaagaagacca

SEQ ID NO: 675699 - DNA, 22 bp, Artificial Sequence
  chemically synthesized
cttcataaactggtcttcttgt

SEQ ID NO: 675700 - DNA, 22 bp, Artificial Sequence
  chemically synthesized
cataaactggtcttcttgtact

SEQ ID NO: 675701 - DNA, 22 bp, Artificial Sequence
  chemically synthesized
ataaactggtcttcttgtacta

SEQ ID NO: 675702 - DNA, 22 bp, Artificial Sequence
  chemically synthesized
tgatactgtcagtatagtacaa

SEQ ID NO: 675703 - DNA, 22 bp, Artificial Sequence
  chemically synthesized
gtgatactgtcagtatagtaca

SEQ ID NO: 675704 - DNA, 22 bp, Artificial Sequence
  chemically synthesized
gtcttcttgtactatactgaca

SEQ ID NO: 675705 - DNA, 22 bp, Artificial Sequence
  chemically synthesized
catttgtgatactgtcagtata

SEQ ID NO: 675706 - DNA, 22 bp, Artificial Sequence
  chemically synthesized
gcatttgtgatactgtcagtat

SEQ ID NO: 675707 - DNA, 22 bp, Artificial Sequence
  chemically synthesized
tgcatttgtgatactgtcagta

SEQ ID NO: 675708 - DNA, 22 bp, Artificial Sequence
  chemically synthesized
ttgcatttgtgatactgtcagt

SEQ ID NO: 675709 - DNA, 22 bp, Artificial Sequence
  chemically synthesized
tttgcatttgtgatactgtcag

SEQ ID NO: 675710 - DNA, 22 bp, Artificial Sequence
  chemically synthesized
cttgtactatactgacagtatc

SEQ ID NO: 675711 - DNA, 22 bp, Artificial Sequence
  chemically synthesized
ttttgcatttgtgatactgtca

SEQ ID NO: 675712 - DNA, 22 bp, Artificial Sequence
  chemically synthesized
ttgtactatactgacagtatca

SEQ ID NO: 675713 - DNA, 22 bp, Artificial Sequence
  chemically synthesized
gtactatactgacagtatcaca

SEQ ID NO: 675714 - DNA, 22 bp, Artificial Sequence
  chemically synthesized
tactatactgacagtatcacaa

SEQ ID NO: 675715 - DNA, 22 bp, Artificial Sequence
  chemically synthesized
tactgacagtatcacaaatgca

SEQ ID NO: 675716 - DNA, 22 bp, Artificial Sequence
  chemically synthesized
caatgtgagtttttttgcattt

SEQ ID NO: 675717 - DNA, 22 bp, Artificial Sequence
  chemically synthesized
acagtatcacaaatgcaaaaaa

SEQ ID NO: 675718 - DNA, 22 bp, Artificial Sequence
  chemically synthesized
aattacaatgtgagtttttttg

SEQ ID NO: 675719 - DNA, 22 bp, Artificial Sequence
  chemically synthesized
aaattacaatgtgagttttttt

SEQ ID NO: 675720 - DNA, 22 bp, Artificial Sequence
  chemically synthesized
taaattacaatgtgagtttttt

SEQ ID NO: 675721 - DNA, 22 bp, Artificial Sequence
  chemically synthesized
ttaaattacaatgtgagttttt

SEQ ID NO: 675722 - DNA, 22 bp, Artificial Sequence
  chemically synthesized
tttaaattacaatgtgagtttt

SEQ ID NO: 675723 - DNA, 22 bp, Artificial Sequence
  chemically synthesized
ctttttaaattacaatgtgagt

SEQ ID NO: 675724 - DNA, 22 bp, Artificial Sequence
  chemically synthesized
cccaatggttcctttttaaatt

SEQ ID NO: 675725 - DNA, 22 bp, Artificial Sequence
  chemically synthesized
acattgtaatttaaaaaggaac

SEQ ID NO: 675726 - DNA, 22 bp, Artificial Sequence
  chemically synthesized
taatttaaaaaggaaccattgg

SEQ ID NO: 675727 - DNA, 22 bp, Artificial Sequence
  chemically synthesized
aaaaaggaaccattggggaacc

SEQ ID NO: 675728 - DNA, 22 bp, Artificial Sequence
  chemically synthesized
aaaaggaaccattggggaacca

SEQ ID NO: 675729 - DNA, 22 bp, Artificial Sequence
  chemically synthesized
taaatacaataaaatatgtggt

SEQ ID NO: 675730 - DNA, 22 bp, Artificial Sequence
  chemically synthesized
attataaatacaataaaatatg

SEQ ID NO: 675731 - DNA, 22 bp, Artificial Sequence
  chemically synthesized
aattataaatacaataaaatat

SEQ ID NO: 675732 - DNA, 22 bp, Artificial Sequence
  chemically synthesized
ttaattataaatacaataaaat

SEQ ID NO: 675733 - DNA, 22 bp, Artificial Sequence
  chemically synthesized
gggaaccacatattttattgta

SEQ ID NO: 675734 - DNA, 22 bp, Artificial Sequence
  chemically synthesized
ggggggggtctcttaattataa

SEQ ID NO: 675735 - DNA, 22 bp, Artificial Sequence
  chemically synthesized
ttgggggggggtctcttaatta

SEQ ID NO: 675736 - DNA, 22 bp, Artificial Sequence
  chemically synthesized
tattgtatttataattaagaga

SEQ ID NO: 675737 - DNA, 22 bp, Artificial Sequence
  chemically synthesized
attgggggggggtctcttaatt

SEQ ID NO: 675738 - DNA, 22 bp, Artificial Sequence
  chemically synthesized
attgtatttataattaagagac

SEQ ID NO: 675739 - DNA, 22 bp, Artificial Sequence
  chemically synthesized
ttgtatttataattaagagacc

SEQ ID NO: 675740 - DNA, 22 bp, Artificial Sequence
  chemically synthesized
tcttattgggggggggtctctt

SEQ ID NO: 675741 - DNA, 22 bp, Artificial Sequence
  chemically synthesized
tatttataattaagagaccccc

SEQ ID NO: 675742 - DNA, 22 bp, Artificial Sequence
  chemically synthesized
gcctgtcttattgggggggggt

SEQ ID NO: 675743 - DNA, 22 bp, Artificial Sequence
  chemically synthesized
ataattaagagaccccccccca

SEQ ID NO: 675744 - DNA, 22 bp, Artificial Sequence
  chemically synthesized
agcctgtcttattggggggggg

SEQ ID NO: 675745 - DNA, 22 bp, Artificial Sequence
  chemically synthesized
taattaagagacccccccccaa

SEQ ID NO: 675746 - DNA, 22 bp, Artificial Sequence
  chemically synthesized
ttagcctgtcttattggggggg

SEQ ID NO: 675747 - DNA, 22 bp, Artificial Sequence
  chemically synthesized
cttagcctgtcttattgggggg

SEQ ID NO: 675748 - DNA, 22 bp, Artificial Sequence
  chemically synthesized
tttcttagcctgtcttattggg

SEQ ID NO: 675749 - DNA, 22 bp, Artificial Sequence
  chemically synthesized
agagacccccccccaataagac

SEQ ID NO: 675750 - DNA, 22 bp, Artificial Sequence
  chemically synthesized
aaaacattatttcttagcctgt

SEQ ID NO: 675751 - DNA, 22 bp, Artificial Sequence
  chemically synthesized
aaaaacattatttcttagcctg

SEQ ID NO: 675752 - DNA, 22 bp, Artificial Sequence
  chemically synthesized
tttaaaaacattatttcttagc

SEQ ID NO: 675753 - DNA, 22 bp, Artificial Sequence
  chemically synthesized
agaaataatgtttttaaacagg

SEQ ID NO: 675754 - DNA, 22 bp, Artificial Sequence
  chemically synthesized
ggcaacagaacgagaccctgtt

SEQ ID NO: 675755 - DNA, 22 bp, Artificial Sequence
  chemically synthesized
cagcctgggcaacagaacgaga

SEQ ID NO: 675756 - DNA, 22 bp, Artificial Sequence
  chemically synthesized
ttaaacagggtctcgttctgtt

SEQ ID NO: 675757 - DNA, 22 bp, Artificial Sequence
  chemically synthesized
taaacagggtctcgttctgttg

SEQ ID NO: 675758 - DNA, 22 bp, Artificial Sequence
  chemically synthesized
aaacagggtctcgttctgttgc

SEQ ID NO: 675759 - DNA, 22 bp, Artificial Sequence
  chemically synthesized
aacagggtctcgttctgttgcc

SEQ ID NO: 675760 - DNA, 22 bp, Artificial Sequence
  chemically synthesized
cactccagcctgggcaacagaa

SEQ ID NO: 675761 - DNA, 22 bp, Artificial Sequence
  chemically synthesized
catcactgcactccagcctggg

SEQ ID NO: 675762 - DNA, 22 bp, Artificial Sequence
  chemically synthesized
gttctgttgcccaggctggagt

SEQ ID NO: 675763 - DNA, 22 bp, Artificial Sequence
  chemically synthesized
tgttgcccaggctggagtgcag

SEQ ID NO: 675764 - DNA, 22 bp, Artificial Sequence
  chemically synthesized
ttgcccaggctggagtgcagtg

SEQ ID NO: 675765 - DNA, 22 bp, Artificial Sequence
  chemically synthesized
cccaggctggagtgcagtgatg

SEQ ID NO: 675766 - DNA, 22 bp, Artificial Sequence
  chemically synthesized
cagtgagccgaggttacatcac

SEQ ID NO: 675767 - DNA, 22 bp, Artificial Sequence
  chemically synthesized
gagtgcagtgatgtaacctcgg

SEQ ID NO: 675768 - DNA, 22 bp, Artificial Sequence
  chemically synthesized
agcccgggaggacgagactgca

SEQ ID NO: 675769 - DNA, 22 bp, Artificial Sequence
  chemically synthesized
gagcccgggaggacgagactgc

SEQ ID NO: 675770 - DNA, 22 bp, Artificial Sequence
  chemically synthesized
ggctcactgcagtctcgtcctc

SEQ ID NO: 675771 - DNA, 22 bp, Artificial Sequence
  chemically synthesized
actgcagtctcgtcctcccggg

SEQ ID NO: 675772 - DNA, 22 bp, Artificial Sequence
  chemically synthesized
cagtctcgtcctcccgggctca

SEQ ID NO: 675773 - DNA, 22 bp, Artificial Sequence
  chemically synthesized
aggtgggagggtcgcttgagcc

SEQ ID NO: 675774 - DNA, 22 bp, Artificial Sequence
  chemically synthesized
gtcctcccgggctcaagcgacc

SEQ ID NO: 675775 - DNA, 22 bp, Artificial Sequence
  chemically synthesized
ccgggctcaagcgaccctccca

SEQ ID NO: 675776 - DNA, 22 bp, Artificial Sequence
  chemically synthesized
aggaggctgaggtgggagggtc

SEQ ID NO: 675777 - DNA, 22 bp, Artificial Sequence
  chemically synthesized
aagcgaccctcccacctcagcc

SEQ ID NO: 675778 - DNA, 22 bp, Artificial Sequence
  chemically synthesized
tagtcccagatactcaggaggc

SEQ ID NO: 675779 - DNA, 22 bp, Artificial Sequence
  chemically synthesized
ccacctcagcctcctgagtatc

SEQ ID NO: 675780 - DNA, 22 bp, Artificial Sequence
  chemically synthesized
agcctcctgagtatctgggact

SEQ ID NO: 675781 - DNA, 22 bp, Artificial Sequence
  chemically synthesized
ctgagtatctgggactacaggc

SEQ ID NO: 675782 - DNA, 22 bp, Artificial Sequence
  chemically synthesized
agtatctgggactacaggcaca

SEQ ID NO: 675783 - DNA, 22 bp, Artificial Sequence
  chemically synthesized
gccgagcatggtggcatgtgcc

SEQ ID NO: 675784 - DNA, 22 bp, Artificial Sequence
  chemically synthesized
ggactacaggcacatgccacca

SEQ ID NO: 675785 - DNA, 22 bp, Artificial Sequence
  chemically synthesized
caggcacatgccaccatgctcg

SEQ ID NO: 675786 - DNA, 22 bp, Artificial Sequence
  chemically synthesized
caaaaaatacaaaaattagccg

SEQ ID NO: 675787 - DNA, 22 bp, Artificial Sequence
  chemically synthesized
tacaaaaaatacaaaaattagc

SEQ ID NO: 675788 - DNA, 22 bp, Artificial Sequence
  chemically synthesized
cccatctctacaaaaaatacaa

SEQ ID NO: 675789 - DNA, 22 bp, Artificial Sequence
  chemically synthesized
ggctaatttttgtattttttgt

SEQ ID NO: 675790 - DNA, 22 bp, Artificial Sequence
  chemically synthesized
atttttgtattttttgtagaga

SEQ ID NO: 675791 - DNA, 22 bp, Artificial Sequence
  chemically synthesized
ttgtattttttgtagagatggg

SEQ ID NO: 675792 - DNA, 22 bp, Artificial Sequence
  chemically synthesized
tgtattttttgtagagatgggg

SEQ ID NO: 675793 - DNA, 22 bp, Artificial Sequence
  chemically synthesized
gtattttttgtagagatgggga

SEQ ID NO: 675794 - DNA, 22 bp, Artificial Sequence
  chemically synthesized
tattttttgtagagatggggag

SEQ ID NO: 675795 - DNA, 22 bp, Artificial Sequence
  chemically synthesized
tttgtagagatggggagacggg

SEQ ID NO: 675796 - DNA, 22 bp, Artificial Sequence
  chemically synthesized
ttgtagagatggggagacgggg

SEQ ID NO: 675797 - DNA, 22 bp, Artificial Sequence
  chemically synthesized
tgtagagatggggagacggggt

SEQ ID NO: 675798 - DNA, 22 bp, Artificial Sequence
  chemically synthesized
gtagagatggggagacggggtt

SEQ ID NO: 675799 - DNA, 22 bp, Artificial Sequence
  chemically synthesized
tagagatggggagacggggttt

SEQ ID NO: 675800 - DNA, 22 bp, Artificial Sequence
  chemically synthesized
ggcaacgtggtgaaaccccgtc

SEQ ID NO: 675801 - DNA, 22 bp, Artificial Sequence
  chemically synthesized
aagaccagcctgggcaacgtgg

SEQ ID NO: 675802 - DNA, 22 bp, Artificial Sequence
  chemically synthesized
aggagttcaagaccagcctggg

SEQ ID NO: 675803 - DNA, 22 bp, Artificial Sequence
  chemically synthesized
caccacgttgcccaggctggtc

SEQ ID NO: 675804 - DNA, 22 bp, Artificial Sequence
  chemically synthesized
accacgttgcccaggctggtct

SEQ ID NO: 675805 - DNA, 22 bp, Artificial Sequence
  chemically synthesized
agctcaggagttcaagaccagc

SEQ ID NO: 675806 - DNA, 22 bp, Artificial Sequence
  chemically synthesized
gagctcaggagttcaagaccag

SEQ ID NO: 675807 - DNA, 22 bp, Artificial Sequence
  chemically synthesized
acttgagctcaggagttcaaga

SEQ ID NO: 675808 - DNA, 22 bp, Artificial Sequence
  chemically synthesized
cccaggctggtcttgaactcct

SEQ ID NO: 675809 - DNA, 22 bp, Artificial Sequence
  chemically synthesized
gtcttgaactcctgagctcaag

SEQ ID NO: 675810 - DNA, 22 bp, Artificial Sequence
  chemically synthesized
gaactcctgagctcaagtgagc

SEQ ID NO: 675811 - DNA, 22 bp, Artificial Sequence
  chemically synthesized
aactcctgagctcaagtgagct

SEQ ID NO: 675812 - DNA, 22 bp, Artificial Sequence
  chemically synthesized
gaggccgaggcgagcagctcac

SEQ ID NO: 675813 - DNA, 22 bp, Artificial Sequence
  chemically synthesized
ggaggccgaggcgagcagctca

SEQ ID NO: 675814 - DNA, 22 bp, Artificial Sequence
  chemically synthesized
ctgagctcaagtgagctgctcg

SEQ ID NO: 675815 - DNA, 22 bp, Artificial Sequence
  chemically synthesized
tggaggccgaggcgagcagctc

SEQ ID NO: 675816 - DNA, 22 bp, Artificial Sequence
  chemically synthesized
ttggaggccgaggcgagcagct

SEQ ID NO: 675817 - DNA, 22 bp, Artificial Sequence
  chemically synthesized
agctcaagtgagctgctcgcct

SEQ ID NO: 675818 - DNA, 22 bp, Artificial Sequence
  chemically synthesized
gcacttttggaggccgaggcga

SEQ ID NO: 675819 - DNA, 22 bp, Artificial Sequence
  chemically synthesized
aagtgagctgctcgcctcggcc

SEQ ID NO: 675820 - DNA, 22 bp, Artificial Sequence
  chemically synthesized
taatcctagcacttttggaggc

SEQ ID NO: 675821 - DNA, 22 bp, Artificial Sequence
  chemically synthesized
gtaatcctagcacttttggagg

SEQ ID NO: 675822 - DNA, 22 bp, Artificial Sequence
  chemically synthesized
ctcgcctcggcctccaaaagtg

SEQ ID NO: 675823 - DNA, 22 bp, Artificial Sequence
  chemically synthesized
gcctcggcctccaaaagtgcta

SEQ ID NO: 675824 - DNA, 22 bp, Artificial Sequence
  chemically synthesized
acatttgtaatcctagcacttt

SEQ ID NO: 675825 - DNA, 22 bp, Artificial Sequence
  chemically synthesized
ggcctccaaaagtgctaggatt

SEQ ID NO: 675826 - DNA, 22 bp, Artificial Sequence
  chemically synthesized
caaaagtgctaggattacaaat

SEQ ID NO: 675827 - DNA, 22 bp, Artificial Sequence
  chemically synthesized
ggcacagtggctcacatttgta

SEQ ID NO: 675828 - DNA, 22 bp, Artificial Sequence
  chemically synthesized
ggctgggcacagtggctcacat

SEQ ID NO: 675829 - DNA, 22 bp, Artificial Sequence
  chemically synthesized
aggctgggcacagtggctcaca

SEQ ID NO: 675830 - DNA, 22 bp, Artificial Sequence
  chemically synthesized
ggattacaaatgtgagccactg

SEQ ID NO: 675831 - DNA, 22 bp, Artificial Sequence
  chemically synthesized
caaatgtgagccactgtgccca

SEQ ID NO: 675832 - DNA, 22 bp, Artificial Sequence
  chemically synthesized
accaacagagtagaatttaggc

SEQ ID NO: 675833 - DNA, 22 bp, Artificial Sequence
  chemically synthesized
tgcccagcctaaattctactct

SEQ ID NO: 675834 - DNA, 22 bp, Artificial Sequence
  chemically synthesized
aattctactctgttggtcagta

SEQ ID NO: 675835 - DNA, 22 bp, Artificial Sequence
  chemically synthesized
catatggacagatatactgacc

SEQ ID NO: 675836 - DNA, 22 bp, Artificial Sequence
  chemically synthesized
acatatggacagatatactgac

SEQ ID NO: 675837 - DNA, 22 bp, Artificial Sequence
  chemically synthesized
tactctgttggtcagtatatct

SEQ ID NO: 675838 - DNA, 22 bp, Artificial Sequence
  chemically synthesized
ctctgttggtcagtatatctgt

SEQ ID NO: 675839 - DNA, 22 bp, Artificial Sequence
  chemically synthesized
tgttggtcagtatatctgtcca

SEQ ID NO: 675840 - DNA, 22 bp, Artificial Sequence
  chemically synthesized
ttggtcagtatatctgtccata

SEQ ID NO: 675841 - DNA, 22 bp, Artificial Sequence
  chemically synthesized
gtcagtatatctgtccatatgt

SEQ ID NO: 675842 - DNA, 22 bp, Artificial Sequence
  chemically synthesized
agtaatcaagagtatttacata

SEQ ID NO: 675843 - DNA, 22 bp, Artificial Sequence
  chemically synthesized
aagtaatcaagagtatttacat

SEQ ID NO: 675844 - DNA, 22 bp, Artificial Sequence
  chemically synthesized
tccatatgtaaatactcttgat

SEQ ID NO: 675845 - DNA, 22 bp, Artificial Sequence
  chemically synthesized
caaatttaagtaatcaagagta

SEQ ID NO: 675846 - DNA, 22 bp, Artificial Sequence
  chemically synthesized
ctacaaatttaagtaatcaaga

SEQ ID NO: 675847 - DNA, 22 bp, Artificial Sequence
  chemically synthesized
actacaaatttaagtaatcaag

SEQ ID NO: 675848 - DNA, 22 bp, Artificial Sequence
  chemically synthesized
ttgattacttaaatttgtagta

SEQ ID NO: 675849 - DNA, 22 bp, Artificial Sequence
  chemically synthesized
caatgtcaaatcttactacaaa

SEQ ID NO: 675850 - DNA, 22 bp, Artificial Sequence
  chemically synthesized
gattacttaaatttgtagtaag

SEQ ID NO: 675851 - DNA, 22 bp, Artificial Sequence
  chemically synthesized
ccaatgtcaaatcttactacaa

SEQ ID NO: 675852 - DNA, 22 bp, Artificial Sequence
  chemically synthesized
attacttaaatttgtagtaaga

SEQ ID NO: 675853 - DNA, 22 bp, Artificial Sequence
  chemically synthesized
cttaaatttgtagtaagatttg

SEQ ID NO: 675854 - DNA, 22 bp, Artificial Sequence
  chemically synthesized
acaatttccaatgtcaaatctt

SEQ ID NO: 675855 - DNA, 22 bp, Artificial Sequence
  chemically synthesized
aaatttgtagtaagatttgaca

SEQ ID NO: 675856 - DNA, 22 bp, Artificial Sequence
  chemically synthesized
cacaatttccaatgtcaaatct

SEQ ID NO: 675857 - DNA, 22 bp, Artificial Sequence
  chemically synthesized
aatttgtagtaagatttgacat

SEQ ID NO: 675858 - DNA, 22 bp, Artificial Sequence
  chemically synthesized
gccttcacaatttccaatgtca

SEQ ID NO: 675859 - DNA, 22 bp, Artificial Sequence
  chemically synthesized
gtagtaagatttgacattggaa

SEQ ID NO: 675860 - DNA, 22 bp, Artificial Sequence
  chemically synthesized
tagtaagatttgacattggaaa

SEQ ID NO: 675861 - DNA, 22 bp, Artificial Sequence
  chemically synthesized
cacctggccttcacaatttcca

SEQ ID NO: 675862 - DNA, 22 bp, Artificial Sequence
  chemically synthesized
gacattggaaattgtgaaggcc

SEQ ID NO: 675863 - DNA, 22 bp, Artificial Sequence
  chemically synthesized
acattggaaattgtgaaggcca

SEQ ID NO: 675864 - DNA, 22 bp, Artificial Sequence
  chemically synthesized
gaaattgtgaaggccaggtgca

SEQ ID NO: 675865 - DNA, 22 bp, Artificial Sequence
  chemically synthesized
tgaaggccaggtgcagtggctc

SEQ ID NO: 675866 - DNA, 22 bp, Artificial Sequence
  chemically synthesized
agatcccaagggtgagccactg

SEQ ID NO: 675867 - DNA, 22 bp, Artificial Sequence
  chemically synthesized
tgagatcccaagggtgagccac

SEQ ID NO: 675868 - DNA, 22 bp, Artificial Sequence
  chemically synthesized
ccacagctctgagatcccaagg

SEQ ID NO: 675869 - DNA, 22 bp, Artificial Sequence
  chemically synthesized
gcctcccacagctctgagatcc

SEQ ID NO: 675870 - DNA, 22 bp, Artificial Sequence
  chemically synthesized
ggcctcccacagctctgagatc

SEQ ID NO: 675871 - DNA, 22 bp, Artificial Sequence
  chemically synthesized
acccttgggatctcagagctgt

SEQ ID NO: 675872 - DNA, 22 bp, Artificial Sequence
  chemically synthesized
ccaccttggcctcccacagctc

SEQ ID NO: 675873 - DNA, 22 bp, Artificial Sequence
  chemically synthesized
gggatctcagagctgtgggagg

SEQ ID NO: 675874 - DNA, 22 bp, Artificial Sequence
  chemically synthesized
ggatctcagagctgtgggaggc

SEQ ID NO: 675875 - DNA, 22 bp, Artificial Sequence
  chemically synthesized
agagctgtgggaggccaaggtg

SEQ ID NO: 675876 - DNA, 22 bp, Artificial Sequence
  chemically synthesized
aagcgatcctcccaccttggcc

SEQ ID NO: 675877 - DNA, 22 bp, Artificial Sequence
  chemically synthesized
ggctcaagcgatcctcccacct

SEQ ID NO: 675878 - DNA, 22 bp, Artificial Sequence
  chemically synthesized
gggctcaagcgatcctcccacc

SEQ ID NO: 675879 - DNA, 22 bp, Artificial Sequence
  chemically synthesized
tgggaggccaaggtgggaggat

SEQ ID NO: 675880 - DNA, 22 bp, Artificial Sequence
  chemically synthesized
ttgggctcaagcgatcctccca

SEQ ID NO: 675881 - DNA, 22 bp, Artificial Sequence
  chemically synthesized
aaactcttgggctcaagcgatc

SEQ ID NO: 675882 - DNA, 22 bp, Artificial Sequence
  chemically synthesized
gtctcaaactcttgggctcaag

SEQ ID NO: 675883 - DNA, 22 bp, Artificial Sequence
  chemically synthesized
cccagcctggtctcaaactctt

SEQ ID NO: 675884 - DNA, 22 bp, Artificial Sequence
  chemically synthesized
gagcccaagagtttgagaccag

SEQ ID NO: 675885 - DNA, 22 bp, Artificial Sequence
  chemically synthesized
agcccaagagtttgagaccagg

SEQ ID NO: 675886 - DNA, 22 bp, Artificial Sequence
  chemically synthesized
ccatgttgcccagcctggtctc

SEQ ID NO: 675887 - DNA, 22 bp, Artificial Sequence
  chemically synthesized
accatgttgcccagcctggtct

SEQ ID NO: 675888 - DNA, 22 bp, Artificial Sequence
  chemically synthesized
gagaccaggctgggcaacatgg

SEQ ID NO: 675889 - DNA, 22 bp, Artificial Sequence
  chemically synthesized
agaccaggctgggcaacatggt

SEQ ID NO: 675890 - DNA, 22 bp, Artificial Sequence
  chemically synthesized
tagagatggaggtcttaccatg

SEQ ID NO: 675891 - DNA, 22 bp, Artificial Sequence
  chemically synthesized
gtagagatggaggtcttaccat

SEQ ID NO: 675892 - DNA, 22 bp, Artificial Sequence
  chemically synthesized
tgtagagatggaggtcttacca

SEQ ID NO: 675893 - DNA, 22 bp, Artificial Sequence
  chemically synthesized
ttgtagagatggaggtcttacc

SEQ ID NO: 675894 - DNA, 22 bp, Artificial Sequence
  chemically synthesized
tttgtagagatggaggtcttac

SEQ ID NO: 675895 - DNA, 22 bp, Artificial Sequence
  chemically synthesized
ggcaacatggtaagacctccat

SEQ ID NO: 675896 - DNA, 22 bp, Artificial Sequence
  chemically synthesized
aattttttgtagagatggaggt

SEQ ID NO: 675897 - DNA, 22 bp, Artificial Sequence
  chemically synthesized
aaattttttgtagagatggagg

SEQ ID NO: 675898 - DNA, 22 bp, Artificial Sequence
  chemically synthesized
taaattttttgtagagatggag

SEQ ID NO: 675899 - DNA, 22 bp, Artificial Sequence
  chemically synthesized
ttaaattttttgtagagatgga

SEQ ID NO: 675900 - DNA, 22 bp, Artificial Sequence
  chemically synthesized
tttaaattttttgtagagatgg

SEQ ID NO: 675901 - DNA, 22 bp, Artificial Sequence
  chemically synthesized
ttttaaattttttgtagagatg

SEQ ID NO: 675902 - DNA, 22 bp, Artificial Sequence
  chemically synthesized
tttttaaattttttgtagagat

SEQ ID NO: 675903 - DNA, 22 bp, Artificial Sequence
  chemically synthesized
atctttttttaaattttttgta

SEQ ID NO: 675904 - DNA, 22 bp, Artificial Sequence
  chemically synthesized
gctaatctttttttaaattttt

SEQ ID NO: 675905 - DNA, 22 bp, Artificial Sequence
  chemically synthesized
catctctacaaaaaatttaaaa

SEQ ID NO: 675906 - DNA, 22 bp, Artificial Sequence
  chemically synthesized
tacaaaaaatttaaaaaaagat

SEQ ID NO: 675907 - DNA, 22 bp, Artificial Sequence
  chemically synthesized
caaaaaatttaaaaaaagatta

SEQ ID NO: 675908 - DNA, 22 bp, Artificial Sequence
  chemically synthesized
aaaaaaagattagccagacacg

SEQ ID NO: 675909 - DNA, 22 bp, Artificial Sequence
  chemically synthesized
aaaaaagattagccagacacgg

SEQ ID NO: 675910 - DNA, 22 bp, Artificial Sequence
  chemically synthesized
tagccgtgtgccaccgtgtctg

SEQ ID NO: 675911 - DNA, 22 bp, Artificial Sequence
  chemically synthesized
ggactatagccgtgtgccaccg

SEQ ID NO: 675912 - DNA, 22 bp, Artificial Sequence
  chemically synthesized
gccagacacggtggcacacggc

SEQ ID NO: 675913 - DNA, 22 bp, Artificial Sequence
  chemically synthesized
caagtagctgggactatagccg

SEQ ID NO: 675914 - DNA, 22 bp, Artificial Sequence
  chemically synthesized
ccaagtagctgggactatagcc

SEQ ID NO: 675915 - DNA, 22 bp, Artificial Sequence
  chemically synthesized
agccttccaagtagctgggact

SEQ ID NO: 675916 - DNA, 22 bp, Artificial Sequence
  chemically synthesized
ccacctcagccttccaagtagc

SEQ ID NO: 675917 - DNA, 22 bp, Artificial Sequence
  chemically synthesized
tagtcccagctacttggaaggc

SEQ ID NO: 675918 - DNA, 22 bp, Artificial Sequence
  chemically synthesized
aagtgaccctcccacctcagcc

SEQ ID NO: 675919 - DNA, 22 bp, Artificial Sequence
  chemically synthesized
cttggaaggctgaggtgggagg

SEQ ID NO: 675920 - DNA, 22 bp, Artificial Sequence
  chemically synthesized
ggaaggctgaggtgggagggtc

SEQ ID NO: 675921 - DNA, 22 bp, Artificial Sequence
  chemically synthesized
gaaggctgaggtgggagggtca

SEQ ID NO: 675922 - DNA, 22 bp, Artificial Sequence
  chemically synthesized
aacacccaggctcaagtgaccc

SEQ ID NO: 675923 - DNA, 22 bp, Artificial Sequence
  chemically synthesized
gaacacccaggctcaagtgacc

SEQ ID NO: 675924 - DNA, 22 bp, Artificial Sequence
  chemically synthesized
tgaacacccaggctcaagtgac

SEQ ID NO: 675925 - DNA, 22 bp, Artificial Sequence
  chemically synthesized
aggtgggagggtcacttgagcc

SEQ ID NO: 675926 - DNA, 22 bp, Artificial Sequence
  chemically synthesized
cagctttgaacacccaggctca

SEQ ID NO: 675927 - DNA, 22 bp, Artificial Sequence
  chemically synthesized
actgcagctttgaacacccagg

SEQ ID NO: 675928 - DNA, 22 bp, Artificial Sequence
  chemically synthesized
gagcctgggtgttcaaagctgc

SEQ ID NO: 675929 - DNA, 22 bp, Artificial Sequence
  chemically synthesized
agcctgggtgttcaaagctgca

SEQ ID NO: 675930 - DNA, 22 bp, Artificial Sequence
  chemically synthesized
atcatggctcactgcagctttg

SEQ ID NO: 675931 - DNA, 22 bp, Artificial Sequence
  chemically synthesized
ggtgttcaaagctgcagtgagc

SEQ ID NO: 675932 - DNA, 22 bp, Artificial Sequence
  chemically synthesized
aaagctgcagtgagccatgatc

SEQ ID NO: 675933 - DNA, 22 bp, Artificial Sequence
  chemically synthesized
gagtgcagtggcctgatcatgg

SEQ ID NO: 675934 - DNA, 22 bp, Artificial Sequence
  chemically synthesized
cagtgagccatgatcaggccac

SEQ ID NO: 675935 - DNA, 22 bp, Artificial Sequence
  chemically synthesized
tcacatagactggagtgcagtg

SEQ ID NO: 675936 - DNA, 22 bp, Artificial Sequence
  chemically synthesized
tgtcacatagactggagtgcag

SEQ ID NO: 675937 - DNA, 22 bp, Artificial Sequence
  chemically synthesized
ctctgtcacatagactggagtg

SEQ ID NO: 675938 - DNA, 22 bp, Artificial Sequence
  chemically synthesized
gctctgtcacatagactggagt

SEQ ID NO: 675939 - DNA, 22 bp, Artificial Sequence
  chemically synthesized
acagcatcttgctctgtcacat

SEQ ID NO: 675940 - DNA, 22 bp, Artificial Sequence
  chemically synthesized
cactccagtctatgtgacagag

SEQ ID NO: 675941 - DNA, 22 bp, Artificial Sequence
  chemically synthesized
gacagcatcttgctctgtcaca

SEQ ID NO: 675942 - DNA, 22 bp, Artificial Sequence
  chemically synthesized
tgacagcatcttgctctgtcac

SEQ ID NO: 675943 - DNA, 22 bp, Artificial Sequence
  chemically synthesized
ttgacagcatcttgctctgtca

SEQ ID NO: 675944 - DNA, 22 bp, Artificial Sequence
  chemically synthesized
tttgacagcatcttgctctgtc

SEQ ID NO: 675945 - DNA, 22 bp, Artificial Sequence
  chemically synthesized
ttttgacagcatcttgctctgt

SEQ ID NO: 675946 - DNA, 22 bp, Artificial Sequence
  chemically synthesized
cagtctatgtgacagagcaaga

SEQ ID NO: 675947 - DNA, 22 bp, Artificial Sequence
  chemically synthesized
tttttgacagcatcttgctctg

SEQ ID NO: 675948 - DNA, 22 bp, Artificial Sequence
  chemically synthesized
ttttttgacagcatcttgctct

SEQ ID NO: 675949 - DNA, 22 bp, Artificial Sequence
  chemically synthesized
tttttttgacagcatcttgctc

SEQ ID NO: 675950 - DNA, 22 bp, Artificial Sequence
  chemically synthesized
ttttttttgacagcatcttgct

SEQ ID NO: 675951 - DNA, 22 bp, Artificial Sequence
  chemically synthesized
tttttttttgacagcatcttgc

SEQ ID NO: 675952 - DNA, 22 bp, Artificial Sequence
  chemically synthesized
ttttttttttgacagcatcttg

SEQ ID NO: 675953 - DNA, 22 bp, Artificial Sequence
  chemically synthesized
tttttttttttgacagcatctt

SEQ ID NO: 675954 - DNA, 22 bp, Artificial Sequence
  chemically synthesized
tgtgacagagcaagatgctgtc

SEQ ID NO: 675955 - DNA, 22 bp, Artificial Sequence
  chemically synthesized
ttttttttttttgacagcatct

SEQ ID NO: 675956 - DNA, 22 bp, Artificial Sequence
  chemically synthesized
tttttttttttttgacagcatc

SEQ ID NO: 675957 - DNA, 22 bp, Artificial Sequence
  chemically synthesized
ttttttttttttttgacagcat

SEQ ID NO: 675958 - DNA, 22 bp, Artificial Sequence
  chemically synthesized
gggtttttttttttttttttga

SEQ ID NO: 675959 - DNA, 22 bp, Artificial Sequence
  chemically synthesized
ttggggtttttttttttttttt

SEQ ID NO: 675960 - DNA, 22 bp, Artificial Sequence
  chemically synthesized
attggggttttttttttttttt

SEQ ID NO: 675961 - DNA, 22 bp, Artificial Sequence
  chemically synthesized
tattggggtttttttttttttt

SEQ ID NO: 675962 - DNA, 22 bp, Artificial Sequence
  chemically synthesized
ttattggggttttttttttttt

SEQ ID NO: 675963 - DNA, 22 bp, Artificial Sequence
  chemically synthesized
tcaaaaaaaaaaaaaaaaaccc

SEQ ID NO: 675964 - DNA, 22 bp, Artificial Sequence
  chemically synthesized
gagatacttttattggggtttt

SEQ ID NO: 675965 - DNA, 22 bp, Artificial Sequence
  chemically synthesized
agagatacttttattggggttt

SEQ ID NO: 675966 - DNA, 22 bp, Artificial Sequence
  chemically synthesized
cttagagatacttttattgggg

SEQ ID NO: 675967 - DNA, 22 bp, Artificial Sequence
  chemically synthesized
cccccacacacataatatatgc

SEQ ID NO: 675968 - DNA, 22 bp, Artificial Sequence
  chemically synthesized
taagcagcatatattatgtgtg

SEQ ID NO: 675969 - DNA, 22 bp, Artificial Sequence
  chemically synthesized
accctgcccccacacacataat

SEQ ID NO: 675970 - DNA, 22 bp, Artificial Sequence
  chemically synthesized
agcagcatatattatgtgtgtg

SEQ ID NO: 675971 - DNA, 22 bp, Artificial Sequence
  chemically synthesized
aaaagctcaccctgcccccaca

SEQ ID NO: 675972 - DNA, 22 bp, Artificial Sequence
  chemically synthesized
aaaaagctcaccctgcccccac

SEQ ID NO: 675973 - DNA, 22 bp, Artificial Sequence
  chemically synthesized
taaaaagctcaccctgccccca

SEQ ID NO: 675974 - DNA, 22 bp, Artificial Sequence
  chemically synthesized
ttaaaaagctcaccctgccccc

SEQ ID NO: 675975 - DNA, 22 bp, Artificial Sequence
  chemically synthesized
tttaaaaagctcaccctgcccc

SEQ ID NO: 675976 - DNA, 22 bp, Artificial Sequence
  chemically synthesized
tgtgtgtgggggcagggtgagc

SEQ ID NO: 675977 - DNA, 22 bp, Artificial Sequence
  chemically synthesized
agaaaatattttttaaaaagct

SEQ ID NO: 675978 - DNA, 22 bp, Artificial Sequence
  chemically synthesized
aagaaaatattttttaaaaagc

SEQ ID NO: 675979 - DNA, 22 bp, Artificial Sequence
  chemically synthesized
taagaaaatattttttaaaaag

SEQ ID NO: 675980 - DNA, 22 bp, Artificial Sequence
  chemically synthesized
aaattttaagaaaatatttttt

SEQ ID NO: 675981 - DNA, 22 bp, Artificial Sequence
  chemically synthesized
ctgaaattttaagaaaatattt

SEQ ID NO: 675982 - DNA, 22 bp, Artificial Sequence
  chemically synthesized
attactgaaattttaagaaaat

SEQ ID NO: 675983 - DNA, 22 bp, Artificial Sequence
  chemically synthesized
tttaaaaaatattttcttaaaa

SEQ ID NO: 675984 - DNA, 22 bp, Artificial Sequence
  chemically synthesized
ttaaaaaatattttcttaaaat

SEQ ID NO: 675985 - DNA, 22 bp, Artificial Sequence
  chemically synthesized
taaaaaatattttcttaaaatt

SEQ ID NO: 675986 - DNA, 22 bp, Artificial Sequence
  chemically synthesized
aaaaaatattttcttaaaattt

SEQ ID NO: 675987 - DNA, 22 bp, Artificial Sequence
  chemically synthesized
agttcattactgaaattttaag

SEQ ID NO: 675988 - DNA, 22 bp, Artificial Sequence
  chemically synthesized
aaaaatattttcttaaaatttc

SEQ ID NO: 675989 - DNA, 22 bp, Artificial Sequence
  chemically synthesized
ggtccctaagttcattactgaa

SEQ ID NO: 675990 - DNA, 22 bp, Artificial Sequence
  chemically synthesized
tcttaaaatttcagtaatgaac

SEQ ID NO: 675991 - DNA, 22 bp, Artificial Sequence
  chemically synthesized
cttaaaatttcagtaatgaact

SEQ ID NO: 675992 - DNA, 22 bp, Artificial Sequence
  chemically synthesized
ttaaaatttcagtaatgaactt

SEQ ID NO: 675993 - DNA, 22 bp, Artificial Sequence
  chemically synthesized
tgtctaggtccctaagttcatt

SEQ ID NO: 675994 - DNA, 22 bp, Artificial Sequence
  chemically synthesized
aaaatttcagtaatgaacttag

SEQ ID NO: 675995 - DNA, 22 bp, Artificial Sequence
  chemically synthesized
atgtctaggtccctaagttcat

SEQ ID NO: 675996 - DNA, 22 bp, Artificial Sequence
  chemically synthesized
aaatttcagtaatgaacttagg

SEQ ID NO: 675997 - DNA, 22 bp, Artificial Sequence
  chemically synthesized
cagtaatgaacttagggaccta

SEQ ID NO: 675998 - DNA, 22 bp, Artificial Sequence
  chemically synthesized
acaatttatgtctaggtcccta

SEQ ID NO: 675999 - DNA, 22 bp, Artificial Sequence
  chemically synthesized
agtaatgaacttagggacctag

SEQ ID NO: 676000 - DNA, 22 bp, Artificial Sequence
  chemically synthesized
tcacaatttatgtctaggtccc

SEQ ID NO: 676001 - DNA, 22 bp, Artificial Sequence
  chemically synthesized
ctcacaatttatgtctaggtcc

SEQ ID NO: 676002 - DNA, 22 bp, Artificial Sequence
  chemically synthesized
tctcacaatttatgtctaggtc

SEQ ID NO: 676003 - DNA, 22 bp, Artificial Sequence
  chemically synthesized
ttctcacaatttatgtctaggt

SEQ ID NO: 676004 - DNA, 22 bp, Artificial Sequence
  chemically synthesized
tccttttctcacaatttatgtc

SEQ ID NO: 676005 - DNA, 22 bp, Artificial Sequence
  chemically synthesized
agggacctagacataaattgtg

SEQ ID NO: 676006 - DNA, 22 bp, Artificial Sequence
  chemically synthesized
gggacctagacataaattgtga

SEQ ID NO: 676007 - DNA, 22 bp, Artificial Sequence
  chemically synthesized
aaagcctgtccttttctcacaa

SEQ ID NO: 676008 - DNA, 22 bp, Artificial Sequence
  chemically synthesized
gacataaattgtgagaaaagga

SEQ ID NO: 676009 - DNA, 22 bp, Artificial Sequence
  chemically synthesized
tgtggttaaaagcctgtccttt

SEQ ID NO: 676010 - DNA, 22 bp, Artificial Sequence
  chemically synthesized
tgagaaaaggacaggcttttaa

SEQ ID NO: 676011 - DNA, 22 bp, Artificial Sequence
  chemically synthesized
catgaagtgcaattatgtggtt

SEQ ID NO: 676012 - DNA, 22 bp, Artificial Sequence
  chemically synthesized
acatgaagtgcaattatgtggt

SEQ ID NO: 676013 - DNA, 22 bp, Artificial Sequence
  chemically synthesized
atttacatgaagtgcaattatg

SEQ ID NO: 676014 - DNA, 22 bp, Artificial Sequence
  chemically synthesized
ttaaccacataattgcacttca

SEQ ID NO: 676015 - DNA, 22 bp, Artificial Sequence
  chemically synthesized
taaccacataattgcacttcat

SEQ ID NO: 676016 - DNA, 22 bp, Artificial Sequence
  chemically synthesized
aaccacataattgcacttcatg

SEQ ID NO: 676017 - DNA, 22 bp, Artificial Sequence
  chemically synthesized
accacataattgcacttcatgt

SEQ ID NO: 676018 - DNA, 22 bp, Artificial Sequence
  chemically synthesized
atataatattgatttacatgaa

SEQ ID NO: 676019 - DNA, 22 bp, Artificial Sequence
  chemically synthesized
aaatactaatataatattgatt

SEQ ID NO: 676020 - DNA, 22 bp, Artificial Sequence
  chemically synthesized
cacttcatgtaaatcaatatta

SEQ ID NO: 676021 - DNA, 22 bp, Artificial Sequence
  chemically synthesized
gaaatactaatataatattgat

SEQ ID NO: 676022 - DNA, 22 bp, Artificial Sequence
  chemically synthesized
tgaaatactaatataatattga

SEQ ID NO: 676023 - DNA, 22 bp, Artificial Sequence
  chemically synthesized
ttttgaaatactaatataatat

SEQ ID NO: 676024 - DNA, 22 bp, Artificial Sequence
  chemically synthesized
catgtaaatcaatattatatta

SEQ ID NO: 676025 - DNA, 22 bp, Artificial Sequence
  chemically synthesized
attttgaaatactaatataata

SEQ ID NO: 676026 - DNA, 22 bp, Artificial Sequence
  chemically synthesized
atgtaaatcaatattatattag

SEQ ID NO: 676027 - DNA, 22 bp, Artificial Sequence
  chemically synthesized
gaatttattttgaaatactaat

SEQ ID NO: 676028 - DNA, 22 bp, Artificial Sequence
  chemically synthesized
tggaatttattttgaaatacta

SEQ ID NO: 676029 - DNA, 22 bp, Artificial Sequence
  chemically synthesized
tattagtatttcaaaataaatt

SEQ ID NO: 676030 - DNA, 22 bp, Artificial Sequence
  chemically synthesized
gtatttcaaaataaattccaga

SEQ ID NO: 676031 - DNA, 22 bp, Artificial Sequence
  chemically synthesized
gatagtaatatgctctggaatt

SEQ ID NO: 676032 - DNA, 22 bp, Artificial Sequence
  chemically synthesized
caaaataaattccagagcatat

SEQ ID NO: 676033 - DNA, 22 bp, Artificial Sequence
  chemically synthesized
aaaataaattccagagcatatt

SEQ ID NO: 676034 - DNA, 22 bp, Artificial Sequence
  chemically synthesized
cagagcatattactatctaaca

SEQ ID NO: 676035 - DNA, 22 bp, Artificial Sequence
  chemically synthesized
caacatcagtagatgttagata

SEQ ID NO: 676036 - DNA, 22 bp, Artificial Sequence
  chemically synthesized
acaacatcagtagatgttagat

SEQ ID NO: 676037 - DNA, 22 bp, Artificial Sequence
  chemically synthesized
ctatctaacatctactgatgtt

SEQ ID NO: 676038 - DNA, 22 bp, Artificial Sequence
  chemically synthesized
cagaaagcatttacaacatcag

SEQ ID NO: 676039 - DNA, 22 bp, Artificial Sequence
  chemically synthesized
tctaacatctactgatgttgta

SEQ ID NO: 676040 - DNA, 22 bp, Artificial Sequence
  chemically synthesized
acatctactgatgttgtaaatg

SEQ ID NO: 676041 - DNA, 22 bp, Artificial Sequence
  chemically synthesized
aaggctccagaaagcatttaca

SEQ ID NO: 676042 - DNA, 22 bp, Artificial Sequence
  chemically synthesized
caaggctccagaaagcatttac

SEQ ID NO: 676043 - DNA, 22 bp, Artificial Sequence
  chemically synthesized
ttcaaggctccagaaagcattt

SEQ ID NO: 676044 - DNA, 22 bp, Artificial Sequence
  chemically synthesized
ctgatgttgtaaatgctttctg

SEQ ID NO: 676045 - DNA, 22 bp, Artificial Sequence
  chemically synthesized
atgttgtaaatgctttctggag

SEQ ID NO: 676046 - DNA, 22 bp, Artificial Sequence
  chemically synthesized
agctcttcaaggctccagaaag

SEQ ID NO: 676047 - DNA, 22 bp, Artificial Sequence
  chemically synthesized
tgagctcttcaaggctccagaa

SEQ ID NO: 676048 - DNA, 22 bp, Artificial Sequence
  chemically synthesized
taaatgctttctggagccttga

SEQ ID NO: 676049 - DNA, 22 bp, Artificial Sequence
  chemically synthesized
aaactctgagctcttcaaggct

SEQ ID NO: 676050 - DNA, 22 bp, Artificial Sequence
  chemically synthesized
aaaactctgagctcttcaaggc

SEQ ID NO: 676051 - DNA, 22 bp, Artificial Sequence
  chemically synthesized
tctggagccttgaagagctcag

SEQ ID NO: 676052 - DNA, 22 bp, Artificial Sequence
  chemically synthesized
ctggagccttgaagagctcaga

SEQ ID NO: 676053 - DNA, 22 bp, Artificial Sequence
  chemically synthesized
gtgatttaaaactctgagctct

SEQ ID NO: 676054 - DNA, 22 bp, Artificial Sequence
  chemically synthesized
tggagccttgaagagctcagag

SEQ ID NO: 676055 - DNA, 22 bp, Artificial Sequence
  chemically synthesized
ggtgatttaaaactctgagctc

SEQ ID NO: 676056 - DNA, 22 bp, Artificial Sequence
  chemically synthesized
gagccttgaagagctcagagtt

SEQ ID NO: 676057 - DNA, 22 bp, Artificial Sequence
  chemically synthesized
gcttggtgatttaaaactctga

SEQ ID NO: 676058 - DNA, 22 bp, Artificial Sequence
  chemically synthesized
gaagagctcagagttttaaatc

SEQ ID NO: 676059 - DNA, 22 bp, Artificial Sequence
  chemically synthesized
aagagctcagagttttaaatca

SEQ ID NO: 676060 - DNA, 22 bp, Artificial Sequence
  chemically synthesized
caataggttagcttggtgattt

SEQ ID NO: 676061 - DNA, 22 bp, Artificial Sequence
  chemically synthesized
ttccaataggttagcttggtga

SEQ ID NO: 676062 - DNA, 22 bp, Artificial Sequence
  chemically synthesized
agagttttaaatcaccaagcta

SEQ ID NO: 676063 - DNA, 22 bp, Artificial Sequence
  chemically synthesized
taaatcaccaagctaacctatt

SEQ ID NO: 676064 - DNA, 22 bp, Artificial Sequence
  chemically synthesized
aaatcaccaagctaacctattg

SEQ ID NO: 676065 - DNA, 22 bp, Artificial Sequence
  chemically synthesized
aatcaccaagctaacctattgg

SEQ ID NO: 676066 - DNA, 22 bp, Artificial Sequence
  chemically synthesized
caaatgtaatggaaagactgtt

SEQ ID NO: 676067 - DNA, 22 bp, Artificial Sequence
  chemically synthesized
acaaatgtaatggaaagactgt

SEQ ID NO: 676068 - DNA, 22 bp, Artificial Sequence
  chemically synthesized
tacaaatgtaatggaaagactg

SEQ ID NO: 676069 - DNA, 22 bp, Artificial Sequence
  chemically synthesized
acctattggaacagtctttcca

SEQ ID NO: 676070 - DNA, 22 bp, Artificial Sequence
  chemically synthesized
ttacaaatgtaatggaaagact

SEQ ID NO: 676071 - DNA, 22 bp, Artificial Sequence
  chemically synthesized
ttggaacagtctttccattaca

SEQ ID NO: 676072 - DNA, 22 bp, Artificial Sequence
  chemically synthesized
gcatttttacaaatgtaatgga

SEQ ID NO: 676073 - DNA, 22 bp, Artificial Sequence
  chemically synthesized
gaacagtctttccattacattt

SEQ ID NO: 676074 - DNA, 22 bp, Artificial Sequence
  chemically synthesized
ttagcatttttacaaatgtaat

SEQ ID NO: 676075 - DNA, 22 bp, Artificial Sequence
  chemically synthesized
tattagcatttttacaaatgta

SEQ ID NO: 676076 - DNA, 22 bp, Artificial Sequence
  chemically synthesized
ctattagcatttttacaaatgt

SEQ ID NO: 676077 - DNA, 22 bp, Artificial Sequence
  chemically synthesized
gatttctattagcatttttaca

SEQ ID NO: 676078 - DNA, 22 bp, Artificial Sequence
  chemically synthesized
tccattacatttgtaaaaatgc

SEQ ID NO: 676079 - DNA, 22 bp, Artificial Sequence
  chemically synthesized
agatttctattagcatttttac

SEQ ID NO: 676080 - DNA, 22 bp, Artificial Sequence
  chemically synthesized
ccattacatttgtaaaaatgct

SEQ ID NO: 676081 - DNA, 22 bp, Artificial Sequence
  chemically synthesized
tagatttctattagcattttta

SEQ ID NO: 676082 - DNA, 22 bp, Artificial Sequence
  chemically synthesized
cattacatttgtaaaaatgcta

SEQ ID NO: 676083 - DNA, 22 bp, Artificial Sequence
  chemically synthesized
catttgtaaaaatgctaataga

SEQ ID NO: 676084 - DNA, 22 bp, Artificial Sequence
  chemically synthesized
gtaaaaatgctaatagaaatct

SEQ ID NO: 676085 - DNA, 22 bp, Artificial Sequence
  chemically synthesized
taaaaatgctaatagaaatcta

SEQ ID NO: 676086 - DNA, 22 bp, Artificial Sequence
  chemically synthesized
atgaggtgagttttagatttct

SEQ ID NO: 676087 - DNA, 22 bp, Artificial Sequence
  chemically synthesized
attcatgaggtgagttttagat

SEQ ID NO: 676088 - DNA, 22 bp, Artificial Sequence
  chemically synthesized
gattcatgaggtgagttttaga

SEQ ID NO: 676089 - DNA, 22 bp, Artificial Sequence
  chemically synthesized
atagaaatctaaaactcacctc

SEQ ID NO: 676090 - DNA, 22 bp, Artificial Sequence
  chemically synthesized
aaactcacctcatgaatcaaac

SEQ ID NO: 676091 - DNA, 22 bp, Artificial Sequence
  chemically synthesized
gaagtaataatatgtttgattc

SEQ ID NO: 676092 - DNA, 22 bp, Artificial Sequence
  chemically synthesized
cctagaagtaataatatgtttg

SEQ ID NO: 676093 - DNA, 22 bp, Artificial Sequence
  chemically synthesized
acctcatgaatcaaacatatta

SEQ ID NO: 676094 - DNA, 22 bp, Artificial Sequence
  chemically synthesized
atgaatcaaacatattattact

SEQ ID NO: 676095 - DNA, 22 bp, Artificial Sequence
  chemically synthesized
gtcactccctagaagtaataat

SEQ ID NO: 676096 - DNA, 22 bp, Artificial Sequence
  chemically synthesized
cgtcactccctagaagtaataa

SEQ ID NO: 676097 - DNA, 22 bp, Artificial Sequence
  chemically synthesized
ttcgtcactccctagaagtaat

SEQ ID NO: 676098 - DNA, 22 bp, Artificial Sequence
  chemically synthesized
ttacttctagggagtgacgaag

SEQ ID NO: 676099 - DNA, 22 bp, Artificial Sequence
  chemically synthesized
agagggtacattcttcgtcact

SEQ ID NO: 676100 - DNA, 22 bp, Artificial Sequence
  chemically synthesized
cttctagggagtgacgaagaat

SEQ ID NO: 676101 - DNA, 22 bp, Artificial Sequence
  chemically synthesized
ttgagagggtacattcttcgtc

SEQ ID NO: 676102 - DNA, 22 bp, Artificial Sequence
  chemically synthesized
ctagggagtgacgaagaatgta

SEQ ID NO: 676103 - DNA, 22 bp, Artificial Sequence
  chemically synthesized
ttattgagagggtacattcttc

SEQ ID NO: 676104 - DNA, 22 bp, Artificial Sequence
  chemically synthesized
tagggagtgacgaagaatgtac

SEQ ID NO: 676105 - DNA, 22 bp, Artificial Sequence
  chemically synthesized
gttattgagagggtacattctt

SEQ ID NO: 676106 - DNA, 22 bp, Artificial Sequence
  chemically synthesized
gggagtgacgaagaatgtaccc

SEQ ID NO: 676107 - DNA, 22 bp, Artificial Sequence
  chemically synthesized
atttgttattgagagggtacat

SEQ ID NO: 676108 - DNA, 22 bp, Artificial Sequence
  chemically synthesized
ggtcattcatttgttattgaga

SEQ ID NO: 676109 - DNA, 22 bp, Artificial Sequence
  chemically synthesized
tgggtcattcatttgttattga

SEQ ID NO: 676110 - DNA, 22 bp, Artificial Sequence
  chemically synthesized
ctctgggtcattcatttgttat

SEQ ID NO: 676111 - DNA, 22 bp, Artificial Sequence
  chemically synthesized
gactcctctgggtcattcattt

SEQ ID NO: 676112 - DNA, 22 bp, Artificial Sequence
  chemically synthesized
tcaataacaaatgaatgaccca

SEQ ID NO: 676113 - DNA, 22 bp, Artificial Sequence
  chemically synthesized
aataacaaatgaatgacccaga

SEQ ID NO: 676114 - DNA, 22 bp, Artificial Sequence
  chemically synthesized
ccattagactcctctgggtcat

SEQ ID NO: 676115 - DNA, 22 bp, Artificial Sequence
  chemically synthesized
cccattagactcctctgggtca

SEQ ID NO: 676116 - DNA, 22 bp, Artificial Sequence
  chemically synthesized
agatatttcccattagactcct

SEQ ID NO: 676117 - DNA, 22 bp, Artificial Sequence
  chemically synthesized
gagatatttcccattagactcc

SEQ ID NO: 676118 - DNA, 22 bp, Artificial Sequence
  chemically synthesized
ttgagatatttcccattagact

SEQ ID NO: 676119 - DNA, 22 bp, Artificial Sequence
  chemically synthesized
tcaaatagagaggctcttgaga

SEQ ID NO: 676120 - DNA, 22 bp, Artificial Sequence
  chemically synthesized
atgggaaatatctcaagagcct

SEQ ID NO: 676121 - DNA, 22 bp, Artificial Sequence
  chemically synthesized
ttgtcaaatagagaggctcttg

SEQ ID NO: 676122 - DNA, 22 bp, Artificial Sequence
  chemically synthesized
aagagcctctctatttgacaac

SEQ ID NO: 676123 - DNA, 22 bp, Artificial Sequence
  chemically synthesized
agtgaggcaagctgttgtcaaa

SEQ ID NO: 676124 - DNA, 22 bp, Artificial Sequence
  chemically synthesized
caggctgagtgaggcaagctgt

SEQ ID NO: 676125 - DNA, 22 bp, Artificial Sequence
  chemically synthesized
tctatttgacaacagcttgcct

SEQ ID NO: 676126 - DNA, 22 bp, Artificial Sequence
  chemically synthesized
acaggctgagtgaggcaagctg

SEQ ID NO: 676127 - DNA, 22 bp, Artificial Sequence
  chemically synthesized
tatttgacaacagcttgcctca

SEQ ID NO: 676128 - DNA, 22 bp, Artificial Sequence
  chemically synthesized
tttgacaacagcttgcctcact

SEQ ID NO: 676129 - DNA, 22 bp, Artificial Sequence
  chemically synthesized
gacaacagcttgcctcactcag

SEQ ID NO: 676130 - DNA, 22 bp, Artificial Sequence
  chemically synthesized
acaacagcttgcctcactcagc

SEQ ID NO: 676131 - DNA, 22 bp, Artificial Sequence
  chemically synthesized
gcctcactcagcctgtaagaca

SEQ ID NO: 676132 - DNA, 22 bp, Artificial Sequence
  chemically synthesized
cctcactcagcctgtaagacac

SEQ ID NO: 676133 - DNA, 22 bp, Artificial Sequence
  chemically synthesized
tgccacccatccgtgtcttaca

SEQ ID NO: 676134 - DNA, 22 bp, Artificial Sequence
  chemically synthesized
actcagcctgtaagacacggat

SEQ ID NO: 676135 - DNA, 22 bp, Artificial Sequence
  chemically synthesized
agcctgtaagacacggatgggt

SEQ ID NO: 676136 - DNA, 22 bp, Artificial Sequence
  chemically synthesized
taagacacggatgggtggcata

SEQ ID NO: 676137 - DNA, 22 bp, Artificial Sequence
  chemically synthesized
agaaaacaaacaacaggagaag

SEQ ID NO: 676138 - DNA, 22 bp, Artificial Sequence
  chemically synthesized
tgagaaaacaaacaacaggaga

SEQ ID NO: 676139 - DNA, 22 bp, Artificial Sequence
  chemically synthesized
aaatgtacattctgagaaaaca

SEQ ID NO: 676140 - DNA, 22 bp, Artificial Sequence
  chemically synthesized
ctcctgttgtttgttttctcag

SEQ ID NO: 676141 - DNA, 22 bp, Artificial Sequence
  chemically synthesized
aaaatgtacattctgagaaaac

SEQ ID NO: 676142 - DNA, 22 bp, Artificial Sequence
  chemically synthesized
tcctgttgtttgttttctcaga

SEQ ID NO: 676143 - DNA, 22 bp, Artificial Sequence
  chemically synthesized
taaaatgtacattctgagaaaa

SEQ ID NO: 676144 - DNA, 22 bp, Artificial Sequence
  chemically synthesized
ctgttgtttgttttctcagaat

SEQ ID NO: 676145 - DNA, 22 bp, Artificial Sequence
  chemically synthesized
ttgtttgttttctcagaatgta

SEQ ID NO: 676146 - DNA, 22 bp, Artificial Sequence
  chemically synthesized
tgttttaaaatgtacattctga

SEQ ID NO: 676147 - DNA, 22 bp, Artificial Sequence
  chemically synthesized
tttgttttctcagaatgtacat

SEQ ID NO: 676148 - DNA, 22 bp, Artificial Sequence
  chemically synthesized
ctatgttttaaaatgtacattc

SEQ ID NO: 676149 - DNA, 22 bp, Artificial Sequence
  chemically synthesized
gttttctcagaatgtacatttt

SEQ ID NO: 676150 - DNA, 22 bp, Artificial Sequence
  chemically synthesized
ttttctcagaatgtacatttta

SEQ ID NO: 676151 - DNA, 22 bp, Artificial Sequence
  chemically synthesized
tctcagaatgtacattttaaaa

SEQ ID NO: 676152 - DNA, 22 bp, Artificial Sequence
  chemically synthesized
ctcagaatgtacattttaaaac

SEQ ID NO: 676153 - DNA, 22 bp, Artificial Sequence
  chemically synthesized
tcagaatgtacattttaaaaca

SEQ ID NO: 676154 - DNA, 22 bp, Artificial Sequence
  chemically synthesized
agaatgtacattttaaaacata

SEQ ID NO: 676155 - DNA, 22 bp, Artificial Sequence
  chemically synthesized
aaaatgtaatcattcctatgtt

SEQ ID NO: 676156 - DNA, 22 bp, Artificial Sequence
  chemically synthesized
taaaaatgtaatcattcctatg

SEQ ID NO: 676157 - DNA, 22 bp, Artificial Sequence
  chemically synthesized
ctaaaaatgtaatcattcctat

SEQ ID NO: 676158 - DNA, 22 bp, Artificial Sequence
  chemically synthesized
taaaacataggaatgattacat

SEQ ID NO: 676159 - DNA, 22 bp, Artificial Sequence
  chemically synthesized
aaaacataggaatgattacatt

SEQ ID NO: 676160 - DNA, 22 bp, Artificial Sequence
  chemically synthesized
aaacataggaatgattacattt

SEQ ID NO: 676161 - DNA, 22 bp, Artificial Sequence
  chemically synthesized
cagacaagtggatttctaaaaa

SEQ ID NO: 676162 - DNA, 22 bp, Artificial Sequence
  chemically synthesized
tgcagacaagtggatttctaaa

SEQ ID NO: 676163 - DNA, 22 bp, Artificial Sequence
  chemically synthesized
actctgcagacaagtggatttc

SEQ ID NO: 676164 - DNA, 22 bp, Artificial Sequence
  chemically synthesized
catttttagaaatccacttgtc

SEQ ID NO: 676165 - DNA, 22 bp, Artificial Sequence
  chemically synthesized
ggctaactctgcagacaagtgg

SEQ ID NO: 676166 - DNA, 22 bp, Artificial Sequence
  chemically synthesized
cggctaactctgcagacaagtg

SEQ ID NO: 676167 - DNA, 22 bp, Artificial Sequence
  chemically synthesized
tcggctaactctgcagacaagt

SEQ ID NO: 676168 - DNA, 22 bp, Artificial Sequence
  chemically synthesized
ttagaaatccacttgtctgcag

SEQ ID NO: 676169 - DNA, 22 bp, Artificial Sequence
  chemically synthesized
tagaaatccacttgtctgcaga

SEQ ID NO: 676170 - DNA, 22 bp, Artificial Sequence
  chemically synthesized
agaaatccacttgtctgcagag

SEQ ID NO: 676171 - DNA, 22 bp, Artificial Sequence
  chemically synthesized
gaaatccacttgtctgcagagt

SEQ ID NO: 676172 - DNA, 22 bp, Artificial Sequence
  chemically synthesized
aagaggtacctttcggctaact

SEQ ID NO: 676173 - DNA, 22 bp, Artificial Sequence
  chemically synthesized
caagaggtacctttcggctaac

SEQ ID NO: 676174 - DNA, 22 bp, Artificial Sequence
  chemically synthesized
tcaagaggtacctttcggctaa

SEQ ID NO: 676175 - DNA, 22 bp, Artificial Sequence
  chemically synthesized
ttcaagaggtacctttcggcta

SEQ ID NO: 676176 - DNA, 22 bp, Artificial Sequence
  chemically synthesized
gtctgcagagttagccgaaagg

SEQ ID NO: 676177 - DNA, 22 bp, Artificial Sequence
  chemically synthesized
tctgcagagttagccgaaaggt

SEQ ID NO: 676178 - DNA, 22 bp, Artificial Sequence
  chemically synthesized
tttttcaagaggtacctttcgg

SEQ ID NO: 676179 - DNA, 22 bp, Artificial Sequence
  chemically synthesized
cagagttagccgaaaggtacct

SEQ ID NO: 676180 - DNA, 22 bp, Artificial Sequence
  chemically synthesized
tgatcattatttttcaagaggt

SEQ ID NO: 676181 - DNA, 22 bp, Artificial Sequence
  chemically synthesized
gccgaaaggtacctcttgaaaa

SEQ ID NO: 676182 - DNA, 22 bp, Artificial Sequence
  chemically synthesized
ctgtgatcattatttttcaaga

SEQ ID NO: 676183 - DNA, 22 bp, Artificial Sequence
  chemically synthesized
gctgtgatcattatttttcaag

SEQ ID NO: 676184 - DNA, 22 bp, Artificial Sequence
  chemically synthesized
aacttgctgtgatcattatttt

SEQ ID NO: 676185 - DNA, 22 bp, Artificial Sequence
  chemically synthesized
taaacttgctgtgatcattatt

SEQ ID NO: 676186 - DNA, 22 bp, Artificial Sequence
  chemically synthesized
ctaaacttgctgtgatcattat

SEQ ID NO: 676187 - DNA, 22 bp, Artificial Sequence
  chemically synthesized
tttctaaacttgctgtgatcat

SEQ ID NO: 676188 - DNA, 22 bp, Artificial Sequence
  chemically synthesized
ttgaaaaataatgatcacagca

SEQ ID NO: 676189 - DNA, 22 bp, Artificial Sequence
  chemically synthesized
gaaaaataatgatcacagcaag

SEQ ID NO: 676190 - DNA, 22 bp, Artificial Sequence
  chemically synthesized
aaaaataatgatcacagcaagt

SEQ ID NO: 676191 - DNA, 22 bp, Artificial Sequence
  chemically synthesized
agggtggggcaggctgtttcta

SEQ ID NO: 676192 - DNA, 22 bp, Artificial Sequence
  chemically synthesized
ggctgagggtggggcaggctgt

SEQ ID NO: 676193 - DNA, 22 bp, Artificial Sequence
  chemically synthesized
gggctgagggtggggcaggctg

SEQ ID NO: 676194 - DNA, 22 bp, Artificial Sequence
  chemically synthesized
tgggctgagggtggggcaggct

SEQ ID NO: 676195 - DNA, 22 bp, Artificial Sequence
  chemically synthesized
ctttgggctgagggtggggcag

SEQ ID NO: 676196 - DNA, 22 bp, Artificial Sequence
  chemically synthesized
actttgggctgagggtggggca

SEQ ID NO: 676197 - DNA, 22 bp, Artificial Sequence
  chemically synthesized
tactttgggctgagggtggggc

SEQ ID NO: 676198 - DNA, 22 bp, Artificial Sequence
  chemically synthesized
agaaacagcctgccccaccctc

SEQ ID NO: 676199 - DNA, 22 bp, Artificial Sequence
  chemically synthesized
ttactttgggctgagggtgggg

SEQ ID NO: 676200 - DNA, 22 bp, Artificial Sequence
  chemically synthesized
gaaacagcctgccccaccctca

SEQ ID NO: 676201 - DNA, 22 bp, Artificial Sequence
  chemically synthesized
ttttactttgggctgagggtgg

SEQ ID NO: 676202 - DNA, 22 bp, Artificial Sequence
  chemically synthesized
cttttactttgggctgagggtg

SEQ ID NO: 676203 - DNA, 22 bp, Artificial Sequence
  chemically synthesized
tcttttactttgggctgagggt

SEQ ID NO: 676204 - DNA, 22 bp, Artificial Sequence
  chemically synthesized
ttcttttactttgggctgaggg

SEQ ID NO: 676205 - DNA, 22 bp, Artificial Sequence
  chemically synthesized
tttttcttttactttgggctga

SEQ ID NO: 676206 - DNA, 22 bp, Artificial Sequence
  chemically synthesized
gtttttcttttactttgggctg

SEQ ID NO: 676207 - DNA, 22 bp, Artificial Sequence
  chemically synthesized
tgtttttcttttactttgggct

SEQ ID NO: 676208 - DNA, 22 bp, Artificial Sequence
  chemically synthesized
ttgtttttcttttactttgggc

SEQ ID NO: 676209 - DNA, 22 bp, Artificial Sequence
  chemically synthesized
ccccaccctcagcccaaagtaa

SEQ ID NO: 676210 - DNA, 22 bp, Artificial Sequence
  chemically synthesized
agatttttgtttttcttttact

SEQ ID NO: 676211 - DNA, 22 bp, Artificial Sequence
  chemically synthesized
agcccaaagtaaaagaaaaaca

SEQ ID NO: 676212 - DNA, 22 bp, Artificial Sequence
  chemically synthesized
gacaagtgtctaagatttttgt

SEQ ID NO: 676213 - DNA, 22 bp, Artificial Sequence
  chemically synthesized
agacacttgtccaatatcgtta

SEQ ID NO: 676214 - DNA, 22 bp, Artificial Sequence
  chemically synthesized
gacacttgtccaatatcgttac

SEQ ID NO: 676215 - DNA, 22 bp, Artificial Sequence
  chemically synthesized
gtccaatatcgttacttttttt

SEQ ID NO: 676216 - DNA, 22 bp, Artificial Sequence
  chemically synthesized
tccaatatcgttactttttttt

SEQ ID NO: 676217 - DNA, 22 bp, Artificial Sequence
  chemically synthesized
aaaaaaaaaaaaaaaaaaaaaa

SEQ ID NO: 676218 - DNA, 22 bp, Artificial Sequence
  chemically synthesized
catctcaaaaaaaaaaaaaaaa

SEQ ID NO: 676219 - DNA, 22 bp, Artificial Sequence
  chemically synthesized
cttttttttttttttttttttt

SEQ ID NO: 676220 - DNA, 22 bp, Artificial Sequence
  chemically synthesized
tttttttttttttttttttttg

SEQ ID NO: 676221 - DNA, 22 bp, Artificial Sequence
  chemically synthesized
ttttttttttttttttttttga

SEQ ID NO: 676222 - DNA, 22 bp, Artificial Sequence
  chemically synthesized
tttttttttttttttttttgag

SEQ ID NO: 676223 - DNA, 22 bp, Artificial Sequence
  chemically synthesized
ttttttttttttttttttgaga

SEQ ID NO: 676224 - DNA, 22 bp, Artificial Sequence
  chemically synthesized
tttttttttttttttttgagat

SEQ ID NO: 676225 - DNA, 22 bp, Artificial Sequence
  chemically synthesized
ttttttttttttttttgagatg

SEQ ID NO: 676226 - DNA, 22 bp, Artificial Sequence
  chemically synthesized
tttttttttttttttgagatgg

SEQ ID NO: 676227 - DNA, 22 bp, Artificial Sequence
  chemically synthesized
ttttttttttttttgagatgga

SEQ ID NO: 676228 - DNA, 22 bp, Artificial Sequence
  chemically synthesized
tttttttttttttgagatggag

SEQ ID NO: 676229 - DNA, 22 bp, Artificial Sequence
  chemically synthesized
ttttttttttttgagatggagt

SEQ ID NO: 676230 - DNA, 22 bp, Artificial Sequence
  chemically synthesized
tttttttttttgagatggagtt

SEQ ID NO: 676231 - DNA, 22 bp, Artificial Sequence
  chemically synthesized
ttttttttttgagatggagttt

SEQ ID NO: 676232 - DNA, 22 bp, Artificial Sequence
  chemically synthesized
tttttttttgagatggagtttc

SEQ ID NO: 676233 - DNA, 22 bp, Artificial Sequence
  chemically synthesized
ggcaacaagagtgaaactccat

SEQ ID NO: 676234 - DNA, 22 bp, Artificial Sequence
  chemically synthesized
ttttttttgagatggagtttca

SEQ ID NO: 676235 - DNA, 22 bp, Artificial Sequence
  chemically synthesized
tttttttgagatggagtttcac

SEQ ID NO: 676236 - DNA, 22 bp, Artificial Sequence
  chemically synthesized
ttttttgagatggagtttcact

SEQ ID NO: 676237 - DNA, 22 bp, Artificial Sequence
  chemically synthesized
ctgggcaacaagagtgaaactc

SEQ ID NO: 676238 - DNA, 22 bp, Artificial Sequence
  chemically synthesized
tttttgagatggagtttcactc

SEQ ID NO: 676239 - DNA, 22 bp, Artificial Sequence
  chemically synthesized
ttttgagatggagtttcactct

SEQ ID NO: 676240 - DNA, 22 bp, Artificial Sequence
  chemically synthesized
tttgagatggagtttcactctt

SEQ ID NO: 676241 - DNA, 22 bp, Artificial Sequence
  chemically synthesized
ttgagatggagtttcactcttg

SEQ ID NO: 676242 - DNA, 22 bp, Artificial Sequence
  chemically synthesized
cctcctgggcaacaagagtgaa

SEQ ID NO: 676243 - DNA, 22 bp, Artificial Sequence
  chemically synthesized
tgagatggagtttcactcttgt

SEQ ID NO: 676244 - DNA, 22 bp, Artificial Sequence
  chemically synthesized
gagatggagtttcactcttgtt

SEQ ID NO: 676245 - DNA, 22 bp, Artificial Sequence
  chemically synthesized
agatggagtttcactcttgttg

SEQ ID NO: 676246 - DNA, 22 bp, Artificial Sequence
  chemically synthesized
tagcactccctcctgggcaaca

SEQ ID NO: 676247 - DNA, 22 bp, Artificial Sequence
  chemically synthesized
cactcttgttgcccaggaggga

SEQ ID NO: 676248 - DNA, 22 bp, Artificial Sequence
  chemically synthesized
actcttgttgcccaggagggag

SEQ ID NO: 676249 - DNA, 22 bp, Artificial Sequence
  chemically synthesized
ttgttgcccaggagggagtgct

SEQ ID NO: 676250 - DNA, 22 bp, Artificial Sequence
  chemically synthesized
agatcacgctgtagcactccct

SEQ ID NO: 676251 - DNA, 22 bp, Artificial Sequence
  chemically synthesized
gttgcccaggagggagtgctac

SEQ ID NO: 676252 - DNA, 22 bp, Artificial Sequence
  chemically synthesized
ttgcccaggagggagtgctaca

SEQ ID NO: 676253 - DNA, 22 bp, Artificial Sequence
  chemically synthesized
cccaggagggagtgctacagcg

SEQ ID NO: 676254 - DNA, 22 bp, Artificial Sequence
  chemically synthesized
caatgagctgagatcacgctgt

SEQ ID NO: 676255 - DNA, 22 bp, Artificial Sequence
  chemically synthesized
cagcgtgatctcagctcattgc

SEQ ID NO: 676256 - DNA, 22 bp, Artificial Sequence
  chemically synthesized
aacccaggagtcggaggttgca

SEQ ID NO: 676257 - DNA, 22 bp, Artificial Sequence
  chemically synthesized
gaacccaggagtcggaggttgc

SEQ ID NO: 676258 - DNA, 22 bp, Artificial Sequence
  chemically synthesized
agctcattgcaacctccgactc

SEQ ID NO: 676259 - DNA, 22 bp, Artificial Sequence
  chemically synthesized
attgcaacctccgactcctggg

SEQ ID NO: 676260 - DNA, 22 bp, Artificial Sequence
  chemically synthesized
aagaatcacttgaacccaggag

SEQ ID NO: 676261 - DNA, 22 bp, Artificial Sequence
  chemically synthesized
caacctccgactcctgggttca

SEQ ID NO: 676262 - DNA, 22 bp, Artificial Sequence
  chemically synthesized
cgactcctgggttcaagtgatt

SEQ ID NO: 676263 - DNA, 22 bp, Artificial Sequence
  chemically synthesized
ctgggttcaagtgattcttcag

SEQ ID NO: 676264 - DNA, 22 bp, Artificial Sequence
  chemically synthesized
aagaggccgaggctgaagaatc

SEQ ID NO: 676265 - DNA, 22 bp, Artificial Sequence
  chemically synthesized
ggttcaagtgattcttcagcct

SEQ ID NO: 676266 - DNA, 22 bp, Artificial Sequence
  chemically synthesized
ctcaagaggccgaggctgaaga

SEQ ID NO: 676267 - DNA, 22 bp, Artificial Sequence
  chemically synthesized
aagtgattcttcagcctcggcc

SEQ ID NO: 676268 - DNA, 22 bp, Artificial Sequence
  chemically synthesized
taatcccagctactcaagaggc

SEQ ID NO: 676269 - DNA, 22 bp, Artificial Sequence
  chemically synthesized
ttcagcctcggcctcttgagta

SEQ ID NO: 676270 - DNA, 22 bp, Artificial Sequence
  chemically synthesized
cagcctcggcctcttgagtagc

SEQ ID NO: 676271 - DNA, 22 bp, Artificial Sequence
  chemically synthesized
agcctcggcctcttgagtagct

SEQ ID NO: 676272 - DNA, 22 bp, Artificial Sequence
  chemically synthesized
ggcctcttgagtagctgggatt

SEQ ID NO: 676273 - DNA, 22 bp, Artificial Sequence
  chemically synthesized
ttgagtagctgggattacaggc

SEQ ID NO: 676274 - DNA, 22 bp, Artificial Sequence
  chemically synthesized
gagtagctgggattacaggcat

SEQ ID NO: 676275 - DNA, 22 bp, Artificial Sequence
  chemically synthesized
agtagctgggattacaggcatg

SEQ ID NO: 676276 - DNA, 22 bp, Artificial Sequence
  chemically synthesized
gccaggtgtggtggcacatgcc

SEQ ID NO: 676277 - DNA, 22 bp, Artificial Sequence
  chemically synthesized
ggattacaggcatgtgccacca

SEQ ID NO: 676278 - DNA, 22 bp, Artificial Sequence
  chemically synthesized
caggcatgtgccaccacacctg

SEQ ID NO: 676279 - DNA, 22 bp, Artificial Sequence
  chemically synthesized
aaaaaacaaaaaattagccagg

SEQ ID NO: 676280 - DNA, 22 bp, Artificial Sequence
  chemically synthesized
ctaaaaaaacaaaaaattagcc

SEQ ID NO: 676281 - DNA, 22 bp, Artificial Sequence
  chemically synthesized
actaaaaaaacaaaaaattagc

SEQ ID NO: 676282 - DNA, 22 bp, Artificial Sequence
  chemically synthesized
tactaaaaaaacaaaaaattag

SEQ ID NO: 676283 - DNA, 22 bp, Artificial Sequence
  chemically synthesized
gctaattttttgtttttttagt

SEQ ID NO: 676284 - DNA, 22 bp, Artificial Sequence
  chemically synthesized
attttttgtttttttagtaaag

SEQ ID NO: 676285 - DNA, 22 bp, Artificial Sequence
  chemically synthesized
tttgtttttttagtaaagatgg

SEQ ID NO: 676286 - DNA, 22 bp, Artificial Sequence
  chemically synthesized
ttgtttttttagtaaagatggg

SEQ ID NO: 676287 - DNA, 22 bp, Artificial Sequence
  chemically synthesized
acatggtgaaaccccatcttta

SEQ ID NO: 676288 - DNA, 22 bp, Artificial Sequence
  chemically synthesized
tgtttttttagtaaagatgggg

SEQ ID NO: 676289 - DNA, 22 bp, Artificial Sequence
  chemically synthesized
gtttttttagtaaagatggggt

SEQ ID NO: 676290 - DNA, 22 bp, Artificial Sequence
  chemically synthesized
tttttttagtaaagatggggtt

SEQ ID NO: 676291 - DNA, 22 bp, Artificial Sequence
  chemically synthesized
gctaacatggtgaaaccccatc

SEQ ID NO: 676292 - DNA, 22 bp, Artificial Sequence
  chemically synthesized
ttttagtaaagatggggtttca

SEQ ID NO: 676293 - DNA, 22 bp, Artificial Sequence
  chemically synthesized
tttagtaaagatggggtttcac

SEQ ID NO: 676294 - DNA, 22 bp, Artificial Sequence
  chemically synthesized
ctggctaacatggtgaaacccc

SEQ ID NO: 676295 - DNA, 22 bp, Artificial Sequence
  chemically synthesized
ttagtaaagatggggtttcacc

SEQ ID NO: 676296 - DNA, 22 bp, Artificial Sequence
  chemically synthesized
cctggctaacatggtgaaaccc

SEQ ID NO: 676297 - DNA, 22 bp, Artificial Sequence
  chemically synthesized
tagtaaagatggggtttcacca

SEQ ID NO: 676298 - DNA, 22 bp, Artificial Sequence
  chemically synthesized
agtaaagatggggtttcaccat

SEQ ID NO: 676299 - DNA, 22 bp, Artificial Sequence
  chemically synthesized
gtaaagatggggtttcaccatg

SEQ ID NO: 676300 - DNA, 22 bp, Artificial Sequence
  chemically synthesized
caccatgttagccaggaaggtc

SEQ ID NO: 676301 - DNA, 22 bp, Artificial Sequence
  chemically synthesized
accatgttagccaggaaggtct

SEQ ID NO: 676302 - DNA, 22 bp, Artificial Sequence
  chemically synthesized
agtcaggagatcaagaccttcc

SEQ ID NO: 676303 - DNA, 22 bp, Artificial Sequence
  chemically synthesized
gccaggaaggtcttgatctcct

SEQ ID NO: 676304 - DNA, 22 bp, Artificial Sequence
  chemically synthesized
gatctcctgactcaggtgatcc

SEQ ID NO: 676305 - DNA, 22 bp, Artificial Sequence
  chemically synthesized
atctcctgactcaggtgatccg

SEQ ID NO: 676306 - DNA, 22 bp, Artificial Sequence
  chemically synthesized
ggaggtcgaggtgggcggatca

SEQ ID NO: 676307 - DNA, 22 bp, Artificial Sequence
  chemically synthesized
gggaggtcgaggtgggcggatc

SEQ ID NO: 676308 - DNA, 22 bp, Artificial Sequence
  chemically synthesized
ctgactcaggtgatccgcccac

SEQ ID NO: 676309 - DNA, 22 bp, Artificial Sequence
  chemically synthesized
tgggaggtcgaggtgggcggat

SEQ ID NO: 676310 - DNA, 22 bp, Artificial Sequence
  chemically synthesized
actcaggtgatccgcccacctc

SEQ ID NO: 676311 - DNA, 22 bp, Artificial Sequence
  chemically synthesized
aggtgatccgcccacctcgacc

SEQ ID NO: 676312 - DNA, 22 bp, Artificial Sequence
  chemically synthesized
taatcccagcactttgggaggt

SEQ ID NO: 676313 - DNA, 22 bp, Artificial Sequence
  chemically synthesized
acgcctgtaatcccagcacttt

SEQ ID NO: 676314 - DNA, 22 bp, Artificial Sequence
  chemically synthesized
gacctcccaaagtgctgggatt

SEQ ID NO: 676315 - DNA, 22 bp, Artificial Sequence
  chemically synthesized
ccaaagtgctgggattacaggc

SEQ ID NO: 676316 - DNA, 22 bp, Artificial Sequence
  chemically synthesized
ggcacggtggctcacgcctgta

SEQ ID NO: 676317 - DNA, 22 bp, Artificial Sequence
  chemically synthesized
gggctgggcacggtggctcacg

SEQ ID NO: 676318 - DNA, 22 bp, Artificial Sequence
  chemically synthesized
ggattacaggcgtgagccaccg

SEQ ID NO: 676319 - DNA, 22 bp, Artificial Sequence
  chemically synthesized
caggcgtgagccaccgtgccca

SEQ ID NO: 676320 - DNA, 22 bp, Artificial Sequence
  chemically synthesized
aaatgtgaggatattggggctg

SEQ ID NO: 676321 - DNA, 22 bp, Artificial Sequence
  chemically synthesized
aaaatgtgaggatattggggct

SEQ ID NO: 676322 - DNA, 22 bp, Artificial Sequence
  chemically synthesized
taaaatgtgaggatattggggc

SEQ ID NO: 676323 - DNA, 22 bp, Artificial Sequence
  chemically synthesized
tctttaaaatgtgaggatattg

SEQ ID NO: 676324 - DNA, 22 bp, Artificial Sequence
  chemically synthesized
atctttaaaatgtgaggatatt

SEQ ID NO: 676325 - DNA, 22 bp, Artificial Sequence
  chemically synthesized
tatctttaaaatgtgaggatat

SEQ ID NO: 676326 - DNA, 22 bp, Artificial Sequence
  chemically synthesized
gtgctttatctttaaaatgtga

SEQ ID NO: 676327 - DNA, 22 bp, Artificial Sequence
  chemically synthesized
ggtgctttatctttaaaatgtg

SEQ ID NO: 676328 - DNA, 22 bp, Artificial Sequence
  chemically synthesized
tagaccttggtgctttatcttt

SEQ ID NO: 676329 - DNA, 22 bp, Artificial Sequence
  chemically synthesized
gtagaccttggtgctttatctt

SEQ ID NO: 676330 - DNA, 22 bp, Artificial Sequence
  chemically synthesized
tgtagaccttggtgctttatct

SEQ ID NO: 676331 - DNA, 22 bp, Artificial Sequence
  chemically synthesized
ttgtagaccttggtgctttatc

SEQ ID NO: 676332 - DNA, 22 bp, Artificial Sequence
  chemically synthesized
tttgtagaccttggtgctttat

SEQ ID NO: 676333 - DNA, 22 bp, Artificial Sequence
  chemically synthesized
acattttaaagataaagcacca

SEQ ID NO: 676334 - DNA, 22 bp, Artificial Sequence
  chemically synthesized
ttttttgtagaccttggtgctt

SEQ ID NO: 676335 - DNA, 22 bp, Artificial Sequence
  chemically synthesized
taaagataaagcaccaaggtct

SEQ ID NO: 676336 - DNA, 22 bp, Artificial Sequence
  chemically synthesized
aaagataaagcaccaaggtcta

SEQ ID NO: 676337 - DNA, 22 bp, Artificial Sequence
  chemically synthesized
aagataaagcaccaaggtctac

SEQ ID NO: 676338 - DNA, 22 bp, Artificial Sequence
  chemically synthesized
atgtctattttttgtagacctt

SEQ ID NO: 676339 - DNA, 22 bp, Artificial Sequence
  chemically synthesized
caaaaaatagacatgagacact

SEQ ID NO: 676340 - DNA, 22 bp, Artificial Sequence
  chemically synthesized
ggtctcttatatcccacttact

SEQ ID NO: 676341 - DNA, 22 bp, Artificial Sequence
  chemically synthesized
gtctcttatatcccacttactc

SEQ ID NO: 676342 - DNA, 22 bp, Artificial Sequence
  chemically synthesized
ttatatcccacttactccacta

SEQ ID NO: 676343 - DNA, 22 bp, Artificial Sequence
  chemically synthesized
atatcccacttactccactact

SEQ ID NO: 676344 - DNA, 22 bp, Artificial Sequence
  chemically synthesized
tatcccacttactccactacta

SEQ ID NO: 676345 - DNA, 22 bp, Artificial Sequence
  chemically synthesized
actccactactattctctacta

SEQ ID NO: 676346 - DNA, 22 bp, Artificial Sequence
  chemically synthesized
ctccactactattctctactac

SEQ ID NO: 676347 - DNA, 22 bp, Artificial Sequence
  chemically synthesized
cactactattctctactaccat

SEQ ID NO: 676348 - DNA, 22 bp, Artificial Sequence
  chemically synthesized
ctattctctactaccattctat

SEQ ID NO: 676349 - DNA, 22 bp, Artificial Sequence
  chemically synthesized
cccccaatagtcatagaatggt

SEQ ID NO: 676350 - DNA, 22 bp, Artificial Sequence
  chemically synthesized
ttctctactaccattctatgac

SEQ ID NO: 676351 - DNA, 22 bp, Artificial Sequence
  chemically synthesized
tctactaccattctatgactat

SEQ ID NO: 676352 - DNA, 22 bp, Artificial Sequence
  chemically synthesized
tgactacccccaatagtcatag

SEQ ID NO: 676353 - DNA, 22 bp, Artificial Sequence
  chemically synthesized
tactaccattctatgactattg

SEQ ID NO: 676354 - DNA, 22 bp, Artificial Sequence
  chemically synthesized
ctaccattctatgactattggg

SEQ ID NO: 676355 - DNA, 22 bp, Artificial Sequence
  chemically synthesized
tctgtgactacccccaatagtc

SEQ ID NO: 676356 - DNA, 22 bp, Artificial Sequence
  chemically synthesized
gtctgtgactacccccaatagt

SEQ ID NO: 676357 - DNA, 22 bp, Artificial Sequence
  chemically synthesized
ccattctatgactattgggggt

SEQ ID NO: 676358 - DNA, 22 bp, Artificial Sequence
  chemically synthesized
agcatttgtctgtgactacccc

SEQ ID NO: 676359 - DNA, 22 bp, Artificial Sequence
  chemically synthesized
tatgactattgggggtagtcac

SEQ ID NO: 676360 - DNA, 22 bp, Artificial Sequence
  chemically synthesized
cagcatttgtctgtgactaccc

SEQ ID NO: 676361 - DNA, 22 bp, Artificial Sequence
  chemically synthesized
tcagcatttgtctgtgactacc

SEQ ID NO: 676362 - DNA, 22 bp, Artificial Sequence
  chemically synthesized
tgactattgggggtagtcacag

SEQ ID NO: 676363 - DNA, 22 bp, Artificial Sequence
  chemically synthesized
tttcagcatttgtctgtgacta

SEQ ID NO: 676364 - DNA, 22 bp, Artificial Sequence
  chemically synthesized
ctttcagcatttgtctgtgact

SEQ ID NO: 676365 - DNA, 22 bp, Artificial Sequence
  chemically synthesized
tctttcagcatttgtctgtgac

SEQ ID NO: 676366 - DNA, 22 bp, Artificial Sequence
  chemically synthesized
ttgggggtagtcacagacaaat

SEQ ID NO: 676367 - DNA, 22 bp, Artificial Sequence
  chemically synthesized
ggggtagtcacagacaaatgct

SEQ ID NO: 676368 - DNA, 22 bp, Artificial Sequence
  chemically synthesized
gaaatcagttttctttcagcat

SEQ ID NO: 676369 - DNA, 22 bp, Artificial Sequence
  chemically synthesized
aaagcaactggaaatcagtttt

SEQ ID NO: 676370 - DNA, 22 bp, Artificial Sequence
  chemically synthesized
aaagaaaactgatttccagttg

SEQ ID NO: 676371 - DNA, 22 bp, Artificial Sequence
  chemically synthesized
acagggaataaatcactaaaag

SEQ ID NO: 676372 - DNA, 22 bp, Artificial Sequence
  chemically synthesized
atttccagttgcttttagtgat

SEQ ID NO: 676373 - DNA, 22 bp, Artificial Sequence
  chemically synthesized
cacagggaataaatcactaaaa

SEQ ID NO: 676374 - DNA, 22 bp, Artificial Sequence
  chemically synthesized
tcacagggaataaatcactaaa

SEQ ID NO: 676375 - DNA, 22 bp, Artificial Sequence
  chemically synthesized
ccagttgcttttagtgatttat

SEQ ID NO: 676376 - DNA, 22 bp, Artificial Sequence
  chemically synthesized
cagttgcttttagtgatttatt

SEQ ID NO: 676377 - DNA, 22 bp, Artificial Sequence
  chemically synthesized
gattttcacagggaataaatca

SEQ ID NO: 676378 - DNA, 22 bp, Artificial Sequence
  chemically synthesized
ggattttcacagggaataaatc

SEQ ID NO: 676379 - DNA, 22 bp, Artificial Sequence
  chemically synthesized
cttttagtgatttattccctgt

SEQ ID NO: 676380 - DNA, 22 bp, Artificial Sequence
  chemically synthesized
tcttggattttcacagggaata

SEQ ID NO: 676381 - DNA, 22 bp, Artificial Sequence
  chemically synthesized
ttagtgatttattccctgtgaa

SEQ ID NO: 676382 - DNA, 22 bp, Artificial Sequence
  chemically synthesized
tagtgatttattccctgtgaaa

SEQ ID NO: 676383 - DNA, 22 bp, Artificial Sequence
  chemically synthesized
agtgatttattccctgtgaaaa

SEQ ID NO: 676384 - DNA, 22 bp, Artificial Sequence
  chemically synthesized
gtgatttattccctgtgaaaat

SEQ ID NO: 676385 - DNA, 22 bp, Artificial Sequence
  chemically synthesized
acaaaagcattgtcttggattt

SEQ ID NO: 676386 - DNA, 22 bp, Artificial Sequence
  chemically synthesized
attccctgtgaaaatccaagac

SEQ ID NO: 676387 - DNA, 22 bp, Artificial Sequence
  chemically synthesized
gacaaaagcattgtcttggatt

SEQ ID NO: 676388 - DNA, 22 bp, Artificial Sequence
  chemically synthesized
ttccctgtgaaaatccaagaca

SEQ ID NO: 676389 - DNA, 22 bp, Artificial Sequence
  chemically synthesized
cctgtgaaaatccaagacaatg

SEQ ID NO: 676390 - DNA, 22 bp, Artificial Sequence
  chemically synthesized
atggtttgacaaaagcattgtc

SEQ ID NO: 676391 - DNA, 22 bp, Artificial Sequence
  chemically synthesized
tgaaaatccaagacaatgcttt

SEQ ID NO: 676392 - DNA, 22 bp, Artificial Sequence
  chemically synthesized
catcacattaatggtttgacaa

SEQ ID NO: 676393 - DNA, 22 bp, Artificial Sequence
  chemically synthesized
acatcacattaatggtttgaca

SEQ ID NO: 676394 - DNA, 22 bp, Artificial Sequence
  chemically synthesized
tacatcacattaatggtttgac

SEQ ID NO: 676395 - DNA, 22 bp, Artificial Sequence
  chemically synthesized
ttacatcacattaatggtttga

SEQ ID NO: 676396 - DNA, 22 bp, Artificial Sequence
  chemically synthesized
tttacatcacattaatggtttg

SEQ ID NO: 676397 - DNA, 22 bp, Artificial Sequence
  chemically synthesized
ttgtcaaaccattaatgtgatg

SEQ ID NO: 676398 - DNA, 22 bp, Artificial Sequence
  chemically synthesized
tgtcaaaccattaatgtgatgt

SEQ ID NO: 676399 - DNA, 22 bp, Artificial Sequence
  chemically synthesized
gtcaaaccattaatgtgatgta

SEQ ID NO: 676400 - DNA, 22 bp, Artificial Sequence
  chemically synthesized
tcaaaccattaatgtgatgtaa

SEQ ID NO: 676401 - DNA, 22 bp, Artificial Sequence
  chemically synthesized
agtccccagaaaattttttaca

SEQ ID NO: 676402 - DNA, 22 bp, Artificial Sequence
  chemically synthesized
gagtccccagaaaattttttac

SEQ ID NO: 676403 - DNA, 22 bp, Artificial Sequence
  chemically synthesized
atgtgatgtaaaaaattttctg

SEQ ID NO: 676404 - DNA, 22 bp, Artificial Sequence
  chemically synthesized
ggaatttgagtccccagaaaat

SEQ ID NO: 676405 - DNA, 22 bp, Artificial Sequence
  chemically synthesized
aacagtcattaggaatttgagt

SEQ ID NO: 676406 - DNA, 22 bp, Artificial Sequence
  chemically synthesized
tctggggactcaaattcctaat

SEQ ID NO: 676407 - DNA, 22 bp, Artificial Sequence
  chemically synthesized
ctggggactcaaattcctaatg

SEQ ID NO: 676408 - DNA, 22 bp, Artificial Sequence
  chemically synthesized
tggggactcaaattcctaatga

SEQ ID NO: 676409 - DNA, 22 bp, Artificial Sequence
  chemically synthesized
gggactcaaattcctaatgact

SEQ ID NO: 676410 - DNA, 22 bp, Artificial Sequence
  chemically synthesized
tgatgactgaacagtcattagg

SEQ ID NO: 676411 - DNA, 22 bp, Artificial Sequence
  chemically synthesized
actatgatgactgaacagtcat

SEQ ID NO: 676412 - DNA, 22 bp, Artificial Sequence
  chemically synthesized
aaattcctaatgactgttcagt

SEQ ID NO: 676413 - DNA, 22 bp, Artificial Sequence
  chemically synthesized
aaggttcactatgatgactgaa

SEQ ID NO: 676414 - DNA, 22 bp, Artificial Sequence
  chemically synthesized
aaaggttcactatgatgactga

SEQ ID NO: 676415 - DNA, 22 bp, Artificial Sequence
  chemically synthesized
ctaatgactgttcagtcatcat

SEQ ID NO: 676416 - DNA, 22 bp, Artificial Sequence
  chemically synthesized
atgactgttcagtcatcatagt

SEQ ID NO: 676417 - DNA, 22 bp, Artificial Sequence
  chemically synthesized
ttcagtcatcatagtgaacctt

SEQ ID NO: 676418 - DNA, 22 bp, Artificial Sequence
  chemically synthesized
agtcatcatagtgaacctttaa

SEQ ID NO: 676419 - DNA, 22 bp, Artificial Sequence
  chemically synthesized
taaattatttctttactatgtc

SEQ ID NO: 676420 - DNA, 22 bp, Artificial Sequence
  chemically synthesized
aaattatttctttactatgtct

SEQ ID NO: 676421 - DNA, 22 bp, Artificial Sequence
  chemically synthesized
aattatttctttactatgtctt

SEQ ID NO: 676422 - DNA, 22 bp, Artificial Sequence
  chemically synthesized
cacaaacaaagcaagacatagt

SEQ ID NO: 676423 - DNA, 22 bp, Artificial Sequence
  chemically synthesized
tttctttactatgtcttgcttt

SEQ ID NO: 676424 - DNA, 22 bp, Artificial Sequence
  chemically synthesized
ctttactatgtcttgctttgtt

SEQ ID NO: 676425 - DNA, 22 bp, Artificial Sequence
  chemically synthesized
tttactatgtcttgctttgttt

SEQ ID NO: 676426 - DNA, 22 bp, Artificial Sequence
  chemically synthesized
tactatgtcttgctttgtttgt

SEQ ID NO: 676427 - DNA, 22 bp, Artificial Sequence
  chemically synthesized
ccagagtcctacacaaacaaag

SEQ ID NO: 676428 - DNA, 22 bp, Artificial Sequence
  chemically synthesized
actatgtcttgctttgtttgtg

SEQ ID NO: 676429 - DNA, 22 bp, Artificial Sequence
  chemically synthesized
ctatgtcttgctttgtttgtgt

SEQ ID NO: 676430 - DNA, 22 bp, Artificial Sequence
  chemically synthesized
tgtcttgctttgtttgtgtagg

SEQ ID NO: 676431 - DNA, 22 bp, Artificial Sequence
  chemically synthesized
gctttgtttgtgtaggactctg

SEQ ID NO: 676432 - DNA, 22 bp, Artificial Sequence
  chemically synthesized
ctttgtttgtgtaggactctgg

SEQ ID NO: 676433 - DNA, 22 bp, Artificial Sequence
  chemically synthesized
agagaaaatattgccagagtcc

SEQ ID NO: 676434 - DNA, 22 bp, Artificial Sequence
  chemically synthesized
tgtttgtgtaggactctggcaa

SEQ ID NO: 676435 - DNA, 22 bp, Artificial Sequence
  chemically synthesized
gtttgtgtaggactctggcaat

SEQ ID NO: 676436 - DNA, 22 bp, Artificial Sequence
  chemically synthesized
tttgtgtaggactctggcaata

SEQ ID NO: 676437 - DNA, 22 bp, Artificial Sequence
  chemically synthesized
gtgtaggactctggcaatattt

SEQ ID NO: 676438 - DNA, 22 bp, Artificial Sequence
  chemically synthesized
tgtaggactctggcaatatttt

SEQ ID NO: 676439 - DNA, 22 bp, Artificial Sequence
  chemically synthesized
cacaaaaaattgagagaaaata

SEQ ID NO: 676440 - DNA, 22 bp, Artificial Sequence
  chemically synthesized
tggcaatattttctctcaattt

SEQ ID NO: 676441 - DNA, 22 bp, Artificial Sequence
  chemically synthesized
gcaatattttctctcaattttt

SEQ ID NO: 676442 - DNA, 22 bp, Artificial Sequence
  chemically synthesized
tgtacctacacaaaaaattgag

SEQ ID NO: 676443 - DNA, 22 bp, Artificial Sequence
  chemically synthesized
tcggctgtgtacctacacaaaa

SEQ ID NO: 676444 - DNA, 22 bp, Artificial Sequence
  chemically synthesized
atcggctgtgtacctacacaaa

SEQ ID NO: 676445 - DNA, 22 bp, Artificial Sequence
  chemically synthesized
tctctcaattttttgtgtaggt

SEQ ID NO: 676446 - DNA, 22 bp, Artificial Sequence
  chemically synthesized
ctctcaattttttgtgtaggta

SEQ ID NO: 676447 - DNA, 22 bp, Artificial Sequence
  chemically synthesized
tctcaattttttgtgtaggtac

SEQ ID NO: 676448 - DNA, 22 bp, Artificial Sequence
  chemically synthesized
atttatcggctgtgtacctaca

SEQ ID NO: 676449 - DNA, 22 bp, Artificial Sequence
  chemically synthesized
tcaattttttgtgtaggtacac

SEQ ID NO: 676450 - DNA, 22 bp, Artificial Sequence
  chemically synthesized
aattttttgtgtaggtacacag

SEQ ID NO: 676451 - DNA, 22 bp, Artificial Sequence
  chemically synthesized
cctcatttatcggctgtgtacc

SEQ ID NO: 676452 - DNA, 22 bp, Artificial Sequence
  chemically synthesized
ccctcatttatcggctgtgtac

SEQ ID NO: 676453 - DNA, 22 bp, Artificial Sequence
  chemically synthesized
tttgtgtaggtacacagccgat

SEQ ID NO: 676454 - DNA, 22 bp, Artificial Sequence
  chemically synthesized
ttgtgtaggtacacagccgata

SEQ ID NO: 676455 - DNA, 22 bp, Artificial Sequence
  chemically synthesized
tgtgtaggtacacagccgataa

SEQ ID NO: 676456 - DNA, 22 bp, Artificial Sequence
  chemically synthesized
tgtttccctcatttatcggctg

SEQ ID NO: 676457 - DNA, 22 bp, Artificial Sequence
  chemically synthesized
gtgtaggtacacagccgataaa

SEQ ID NO: 676458 - DNA, 22 bp, Artificial Sequence
  chemically synthesized
tgtaggtacacagccgataaat

SEQ ID NO: 676459 - DNA, 22 bp, Artificial Sequence
  chemically synthesized
gaaatattgtgtttccctcatt

SEQ ID NO: 676460 - DNA, 22 bp, Artificial Sequence
  chemically synthesized
catcaagtgttagaaatattgt

SEQ ID NO: 676461 - DNA, 22 bp, Artificial Sequence
  chemically synthesized
ccatcaagtgttagaaatattg

SEQ ID NO: 676462 - DNA, 22 bp, Artificial Sequence
  chemically synthesized
cagaggaggtttccatcaagtg

SEQ ID NO: 676463 - DNA, 22 bp, Artificial Sequence
  chemically synthesized
gcagaggaggtttccatcaagt

SEQ ID NO: 676464 - DNA, 22 bp, Artificial Sequence
  chemically synthesized
tgcagaggaggtttccatcaag

SEQ ID NO: 676465 - DNA, 22 bp, Artificial Sequence
  chemically synthesized
ctaacacttgatggaaacctcc

SEQ ID NO: 676466 - DNA, 22 bp, Artificial Sequence
  chemically synthesized
taacacttgatggaaacctcct

SEQ ID NO: 676467 - DNA, 22 bp, Artificial Sequence
  chemically synthesized
acacttgatggaaacctcctct

SEQ ID NO: 676468 - DNA, 22 bp, Artificial Sequence
  chemically synthesized
aaatggctttgcagaggaggtt

SEQ ID NO: 676469 - DNA, 22 bp, Artificial Sequence
  chemically synthesized
gatggaaacctcctctgcaaag

SEQ ID NO: 676470 - DNA, 22 bp, Artificial Sequence
  chemically synthesized
atggaaacctcctctgcaaagc

SEQ ID NO: 676471 - DNA, 22 bp, Artificial Sequence
  chemically synthesized
caacagatctaaaatggctttg

SEQ ID NO: 676472 - DNA, 22 bp, Artificial Sequence
  chemically synthesized
ccaacagatctaaaatggcttt

SEQ ID NO: 676473 - DNA, 22 bp, Artificial Sequence
  chemically synthesized
tttccaacagatctaaaatggc

SEQ ID NO: 676474 - DNA, 22 bp, Artificial Sequence
  chemically synthesized
ctctgcaaagccattttagatc

SEQ ID NO: 676475 - DNA, 22 bp, Artificial Sequence
  chemically synthesized
gattatttccaacagatctaaa

SEQ ID NO: 676476 - DNA, 22 bp, Artificial Sequence
  chemically synthesized
tgcaaagccattttagatctgt

SEQ ID NO: 676477 - DNA, 22 bp, Artificial Sequence
  chemically synthesized
agattatttccaacagatctaa

SEQ ID NO: 676478 - DNA, 22 bp, Artificial Sequence
  chemically synthesized
tagattatttccaacagatcta

SEQ ID NO: 676479 - DNA, 22 bp, Artificial Sequence
  chemically synthesized
caaagccattttagatctgttg

SEQ ID NO: 676480 - DNA, 22 bp, Artificial Sequence
  chemically synthesized
attttagattatttccaacaga

SEQ ID NO: 676481 - DNA, 22 bp, Artificial Sequence
  chemically synthesized
tagatctgttggaaataatcta

SEQ ID NO: 676482 - DNA, 22 bp, Artificial Sequence
  chemically synthesized
agatctgttggaaataatctaa

SEQ ID NO: 676483 - DNA, 22 bp, Artificial Sequence
  chemically synthesized
gatctgttggaaataatctaaa

SEQ ID NO: 676484 - DNA, 22 bp, Artificial Sequence
  chemically synthesized
ttggaaataatctaaaattaat

SEQ ID NO: 676485 - DNA, 22 bp, Artificial Sequence
  chemically synthesized
gaaataatctaaaattaattat

SEQ ID NO: 676486 - DNA, 22 bp, Artificial Sequence
  chemically synthesized
aaattaattatcttatattgtt

SEQ ID NO: 676487 - DNA, 22 bp, Artificial Sequence
  chemically synthesized
aaaaatagataaaaaacaatat

SEQ ID NO: 676488 - DNA, 22 bp, Artificial Sequence
  chemically synthesized
attatcttatattgttttttat

SEQ ID NO: 676489 - DNA, 22 bp, Artificial Sequence
  chemically synthesized
attaaaaaatagataaaaaaca

SEQ ID NO: 676490 - DNA, 22 bp, Artificial Sequence
  chemically synthesized
gattaaaaaatagataaaaaac

SEQ ID NO: 676491 - DNA, 22 bp, Artificial Sequence
  chemically synthesized
tgattaaaaaatagataaaaaa

SEQ ID NO: 676492 - DNA, 22 bp, Artificial Sequence
  chemically synthesized
ttgattaaaaaatagataaaaa

SEQ ID NO: 676493 - DNA, 22 bp, Artificial Sequence
  chemically synthesized
tcttatattgttttttatctat

SEQ ID NO: 676494 - DNA, 22 bp, Artificial Sequence
  chemically synthesized
tttgattaaaaaatagataaaa

SEQ ID NO: 676495 - DNA, 22 bp, Artificial Sequence
  chemically synthesized
ttttgattaaaaaatagataaa

SEQ ID NO: 676496 - DNA, 22 bp, Artificial Sequence
  chemically synthesized
atattgttttttatctattttt

SEQ ID NO: 676497 - DNA, 22 bp, Artificial Sequence
  chemically synthesized
tattgttttttatctatttttt

SEQ ID NO: 676498 - DNA, 22 bp, Artificial Sequence
  chemically synthesized
ttttttatctattttttaatca

SEQ ID NO: 676499 - DNA, 22 bp, Artificial Sequence
  chemically synthesized
tttatctattttttaatcaaaa

SEQ ID NO: 676500 - DNA, 22 bp, Artificial Sequence
  chemically synthesized
ttatctattttttaatcaaaaa

SEQ ID NO: 676501 - DNA, 22 bp, Artificial Sequence
  chemically synthesized
tatctattttttaatcaaaaaa

SEQ ID NO: 676502 - DNA, 22 bp, Artificial Sequence
  chemically synthesized
atctattttttaatcaaaaaag

SEQ ID NO: 676503 - DNA, 22 bp, Artificial Sequence
  chemically synthesized
tctattttttaatcaaaaaagt

SEQ ID NO: 676504 - DNA, 22 bp, Artificial Sequence
  chemically synthesized
ttttttaatcaaaaaagttcta

SEQ ID NO: 676505 - DNA, 22 bp, Artificial Sequence
  chemically synthesized
gtggtagagaaaatagaacttt

SEQ ID NO: 676506 - DNA, 22 bp, Artificial Sequence
  chemically synthesized
agtggtagagaaaatagaactt

SEQ ID NO: 676507 - DNA, 22 bp, Artificial Sequence
  chemically synthesized
tttaatcaaaaaagttctattt

SEQ ID NO: 676508 - DNA, 22 bp, Artificial Sequence
  chemically synthesized
tagtggtagagaaaatagaact

SEQ ID NO: 676509 - DNA, 22 bp, Artificial Sequence
  chemically synthesized
ttaatcaaaaaagttctatttt

SEQ ID NO: 676510 - DNA, 22 bp, Artificial Sequence
  chemically synthesized
taatcaaaaaagttctattttc

SEQ ID NO: 676511 - DNA, 22 bp, Artificial Sequence
  chemically synthesized
aatcaaaaaagttctattttct

SEQ ID NO: 676512 - DNA, 22 bp, Artificial Sequence
  chemically synthesized
atcaaaaaagttctattttctc

SEQ ID NO: 676513 - DNA, 22 bp, Artificial Sequence
  chemically synthesized
tattttctctaccactaaaatg

SEQ ID NO: 676514 - DNA, 22 bp, Artificial Sequence
  chemically synthesized
ttttctctaccactaaaatgtc

SEQ ID NO: 676515 - DNA, 22 bp, Artificial Sequence
  chemically synthesized
tctctaccactaaaatgtctac

SEQ ID NO: 676516 - DNA, 22 bp, Artificial Sequence
  chemically synthesized
ctctaccactaaaatgtctaca

SEQ ID NO: 676517 - DNA, 22 bp, Artificial Sequence
  chemically synthesized
tctaccactaaaatgtctacat

SEQ ID NO: 676518 - DNA, 22 bp, Artificial Sequence
  chemically synthesized
tgaaaaatgcagatgtagacat

SEQ ID NO: 676519 - DNA, 22 bp, Artificial Sequence
  chemically synthesized
taccactaaaatgtctacatct

SEQ ID NO: 676520 - DNA, 22 bp, Artificial Sequence
  chemically synthesized
ccactaaaatgtctacatctgc

SEQ ID NO: 676521 - DNA, 22 bp, Artificial Sequence
  chemically synthesized
aaatgtctacatctgcattttt

SEQ ID NO: 676522 - DNA, 22 bp, Artificial Sequence
  chemically synthesized
tatgtccagttgtgaaaaatgc

SEQ ID NO: 676523 - DNA, 22 bp, Artificial Sequence
  chemically synthesized
gtctgtatgtccagttgtgaaa

SEQ ID NO: 676524 - DNA, 22 bp, Artificial Sequence
  chemically synthesized
agtctgtatgtccagttgtgaa

SEQ ID NO: 676525 - DNA, 22 bp, Artificial Sequence
  chemically synthesized
catctgcatttttcacaactgg

SEQ ID NO: 676526 - DNA, 22 bp, Artificial Sequence
  chemically synthesized
tagtctgtatgtccagttgtga

SEQ ID NO: 676527 - DNA, 22 bp, Artificial Sequence
  chemically synthesized
ttagtctgtatgtccagttgtg

SEQ ID NO: 676528 - DNA, 22 bp, Artificial Sequence
  chemically synthesized
catttttcacaactggacatac

SEQ ID NO: 676529 - DNA, 22 bp, Artificial Sequence
  chemically synthesized
atgtatttttagtctgtatgtc

SEQ ID NO: 676530 - DNA, 22 bp, Artificial Sequence
  chemically synthesized
ttcacaactggacatacagact

SEQ ID NO: 676531 - DNA, 22 bp, Artificial Sequence
  chemically synthesized
tcacaactggacatacagacta

SEQ ID NO: 676532 - DNA, 22 bp, Artificial Sequence
  chemically synthesized
cacaactggacatacagactaa

SEQ ID NO: 676533 - DNA, 22 bp, Artificial Sequence
  chemically synthesized
acaactggacatacagactaaa

SEQ ID NO: 676534 - DNA, 22 bp, Artificial Sequence
  chemically synthesized
gacatacagactaaaaatacat

SEQ ID NO: 676535 - DNA, 22 bp, Artificial Sequence
  chemically synthesized
aaagagatcatctcatgtattt

SEQ ID NO: 676536 - DNA, 22 bp, Artificial Sequence
  chemically synthesized
aactcaaagagatcatctcatg

SEQ ID NO: 676537 - DNA, 22 bp, Artificial Sequence
  chemically synthesized
aaactcaaagagatcatctcat

SEQ ID NO: 676538 - DNA, 22 bp, Artificial Sequence
  chemically synthesized
taaactcaaagagatcatctca

SEQ ID NO: 676539 - DNA, 22 bp, Artificial Sequence
  chemically synthesized
aaaatacatgagatgatctctt

SEQ ID NO: 676540 - DNA, 22 bp, Artificial Sequence
  chemically synthesized
tcaggtaactttaaactcaaag

SEQ ID NO: 676541 - DNA, 22 bp, Artificial Sequence
  chemically synthesized
gtcaggtaactttaaactcaaa

SEQ ID NO: 676542 - DNA, 22 bp, Artificial Sequence
  chemically synthesized
tgtcaggtaactttaaactcaa

SEQ ID NO: 676543 - DNA, 22 bp, Artificial Sequence
  chemically synthesized
atggactttgtcaggtaacttt

SEQ ID NO: 676544 - DNA, 22 bp, Artificial Sequence
  chemically synthesized
tcatggactttgtcaggtaact

SEQ ID NO: 676545 - DNA, 22 bp, Artificial Sequence
  chemically synthesized
tttgagtttaaagttacctgac

SEQ ID NO: 676546 - DNA, 22 bp, Artificial Sequence
  chemically synthesized
tgagtttaaagttacctgacaa

SEQ ID NO: 676547 - DNA, 22 bp, Artificial Sequence
  chemically synthesized
gagtttaaagttacctgacaaa

SEQ ID NO: 676548 - DNA, 22 bp, Artificial Sequence
  chemically synthesized
attctcatggactttgtcaggt

SEQ ID NO: 676549 - DNA, 22 bp, Artificial Sequence
  chemically synthesized
agtttaaagttacctgacaaag

SEQ ID NO: 676550 - DNA, 22 bp, Artificial Sequence
  chemically synthesized
aaagttacctgacaaagtccat

SEQ ID NO: 676551 - DNA, 22 bp, Artificial Sequence
  chemically synthesized
aagttacctgacaaagtccatg

SEQ ID NO: 676552 - DNA, 22 bp, Artificial Sequence
  chemically synthesized
aggaccctgattctcatggact

SEQ ID NO: 676553 - DNA, 22 bp, Artificial Sequence
  chemically synthesized
aaggaccctgattctcatggac

SEQ ID NO: 676554 - DNA, 22 bp, Artificial Sequence
  chemically synthesized
cctgacaaagtccatgagaatc

SEQ ID NO: 676555 - DNA, 22 bp, Artificial Sequence
  chemically synthesized
tacttaaggaccctgattctca

SEQ ID NO: 676556 - DNA, 22 bp, Artificial Sequence
  chemically synthesized
atacttaaggaccctgattctc

SEQ ID NO: 676557 - DNA, 22 bp, Artificial Sequence
  chemically synthesized
acaaagtccatgagaatcaggg

SEQ ID NO: 676558 - DNA, 22 bp, Artificial Sequence
  chemically synthesized
aagtataaattatctacatata

SEQ ID NO: 676559 - DNA, 22 bp, Artificial Sequence
  chemically synthesized
agtataaattatctacatatat

SEQ ID NO: 676560 - DNA, 22 bp, Artificial Sequence
  chemically synthesized
tctacatatatgtggggcgtgt

SEQ ID NO: 676561 - DNA, 22 bp, Artificial Sequence
  chemically synthesized
catatatgtggggcgtgtgtgt

SEQ ID NO: 676562 - DNA, 22 bp, Artificial Sequence
  chemically synthesized
tgacagaaaagcagcagtagcc

SEQ ID NO: 676563 - DNA, 22 bp, Artificial Sequence
  chemically synthesized
atgacagaaaagcagcagtagc

SEQ ID NO: 676564 - DNA, 22 bp, Artificial Sequence
  chemically synthesized
atgagaacttatgacagaaaag

SEQ ID NO: 676565 - DNA, 22 bp, Artificial Sequence
  chemically synthesized
actaatgagaacttatgacaga

SEQ ID NO: 676566 - DNA, 22 bp, Artificial Sequence
  chemically synthesized
ctgctgcttttctgtcataagt

SEQ ID NO: 676567 - DNA, 22 bp, Artificial Sequence
  chemically synthesized
attaactaatgagaacttatga

SEQ ID NO: 676568 - DNA, 22 bp, Artificial Sequence
  chemically synthesized
ctgcttttctgtcataagttct

SEQ ID NO: 676569 - DNA, 22 bp, Artificial Sequence
  chemically synthesized
cttttctgtcataagttctcat

SEQ ID NO: 676570 - DNA, 22 bp, Artificial Sequence
  chemically synthesized
caattcattaactaatgagaac

SEQ ID NO: 676571 - DNA, 22 bp, Artificial Sequence
  chemically synthesized
ttctgtcataagttctcattag

SEQ ID NO: 676572 - DNA, 22 bp, Artificial Sequence
  chemically synthesized
tctgtcataagttctcattagt

SEQ ID NO: 676573 - DNA, 22 bp, Artificial Sequence
  chemically synthesized
ctgtcataagttctcattagtt

SEQ ID NO: 676574 - DNA, 22 bp, Artificial Sequence
  chemically synthesized
tgtcataagttctcattagtta

SEQ ID NO: 676575 - DNA, 22 bp, Artificial Sequence
  chemically synthesized
tcataagttctcattagttaat

SEQ ID NO: 676576 - DNA, 22 bp, Artificial Sequence
  chemically synthesized
tagctacaattcattaactaat

SEQ ID NO: 676577 - DNA, 22 bp, Artificial Sequence
  chemically synthesized
tatagctacaattcattaacta

SEQ ID NO: 676578 - DNA, 22 bp, Artificial Sequence
  chemically synthesized
gtgtctctatagctacaattca

SEQ ID NO: 676579 - DNA, 22 bp, Artificial Sequence
  chemically synthesized
tcattagttaatgaattgtagc

SEQ ID NO: 676580 - DNA, 22 bp, Artificial Sequence
  chemically synthesized
agtgtctctatagctacaattc

SEQ ID NO: 676581 - DNA, 22 bp, Artificial Sequence
  chemically synthesized
attagttaatgaattgtagcta

SEQ ID NO: 676582 - DNA, 22 bp, Artificial Sequence
  chemically synthesized
cttagtgtctctatagctacaa

SEQ ID NO: 676583 - DNA, 22 bp, Artificial Sequence
  chemically synthesized
acttagtgtctctatagctaca

SEQ ID NO: 676584 - DNA, 22 bp, Artificial Sequence
  chemically synthesized
gttaatgaattgtagctataga

SEQ ID NO: 676585 - DNA, 22 bp, Artificial Sequence
  chemically synthesized
ttacttagtgtctctatagcta

SEQ ID NO: 676586 - DNA, 22 bp, Artificial Sequence
  chemically synthesized
cttacttagtgtctctatagct

SEQ ID NO: 676587 - DNA, 22 bp, Artificial Sequence
  chemically synthesized
atgaattgtagctatagagaca

SEQ ID NO: 676588 - DNA, 22 bp, Artificial Sequence
  chemically synthesized
catttcttacttagtgtctcta

SEQ ID NO: 676589 - DNA, 22 bp, Artificial Sequence
  chemically synthesized
tagctatagagacactaagtaa

SEQ ID NO: 676590 - DNA, 22 bp, Artificial Sequence
  chemically synthesized
tagagacactaagtaagaaatg

SEQ ID NO: 676591 - DNA, 22 bp, Artificial Sequence
  chemically synthesized
gtcgatacccccattccatttc

SEQ ID NO: 676592 - DNA, 22 bp, Artificial Sequence
  chemically synthesized
cgtcgatacccccattccattt

SEQ ID NO: 676593 - DNA, 22 bp, Artificial Sequence
  chemically synthesized
ttcgtcgatacccccattccat

SEQ ID NO: 676594 - DNA, 22 bp, Artificial Sequence
  chemically synthesized
cttcgtcgatacccccattcca

SEQ ID NO: 676595 - DNA, 22 bp, Artificial Sequence
  chemically synthesized
agtaagaaatggaatgggggta

SEQ ID NO: 676596 - DNA, 22 bp, Artificial Sequence
  chemically synthesized
gtaaaaaagtttcttcgtcgat

SEQ ID NO: 676597 - DNA, 22 bp, Artificial Sequence
  chemically synthesized
ggtaaaaaagtttcttcgtcga

SEQ ID NO: 676598 - DNA, 22 bp, Artificial Sequence
  chemically synthesized
gatgtttggtaaaaaagtttct

SEQ ID NO: 676599 - DNA, 22 bp, Artificial Sequence
  chemically synthesized
cagttagatgtttggtaaaaaa

SEQ ID NO: 676600 - DNA, 22 bp, Artificial Sequence
  chemically synthesized
acagttagatgtttggtaaaaa

SEQ ID NO: 676601 - DNA, 22 bp, Artificial Sequence
  chemically synthesized
tttacagttagatgtttggtaa

SEQ ID NO: 676602 - DNA, 22 bp, Artificial Sequence
  chemically synthesized
tattatttacagttagatgttt

SEQ ID NO: 676603 - DNA, 22 bp, Artificial Sequence
  chemically synthesized
atattatttacagttagatgtt

SEQ ID NO: 676604 - DNA, 22 bp, Artificial Sequence
  chemically synthesized
ttttaccaaacatctaactgta

SEQ ID NO: 676605 - DNA, 22 bp, Artificial Sequence
  chemically synthesized
tttaccaaacatctaactgtaa

SEQ ID NO: 676606 - DNA, 22 bp, Artificial Sequence
  chemically synthesized
ttaccaaacatctaactgtaaa

SEQ ID NO: 676607 - DNA, 22 bp, Artificial Sequence
  chemically synthesized
taccaaacatctaactgtaaat

SEQ ID NO: 676608 - DNA, 22 bp, Artificial Sequence
  chemically synthesized
accaaacatctaactgtaaata

SEQ ID NO: 676609 - DNA, 22 bp, Artificial Sequence
  chemically synthesized
ccaaacatctaactgtaaataa

SEQ ID NO: 676610 - DNA, 22 bp, Artificial Sequence
  chemically synthesized
caatgaatttatattatttaca

SEQ ID NO: 676611 - DNA, 22 bp, Artificial Sequence
  chemically synthesized
tacaatgaatttatattattta

SEQ ID NO: 676612 - DNA, 22 bp, Artificial Sequence
  chemically synthesized
ctacaatgaatttatattattt

SEQ ID NO: 676613 - DNA, 22 bp, Artificial Sequence
  chemically synthesized
tctacaatgaatttatattatt

SEQ ID NO: 676614 - DNA, 22 bp, Artificial Sequence
  chemically synthesized
attttctacaatgaatttatat

SEQ ID NO: 676615 - DNA, 22 bp, Artificial Sequence
  chemically synthesized
actgtaaataatataaattcat

SEQ ID NO: 676616 - DNA, 22 bp, Artificial Sequence
  chemically synthesized
cactgattttctacaatgaatt

SEQ ID NO: 676617 - DNA, 22 bp, Artificial Sequence
  chemically synthesized
taaataatataaattcattgta

SEQ ID NO: 676618 - DNA, 22 bp, Artificial Sequence
  chemically synthesized
ccactgattttctacaatgaat

SEQ ID NO: 676619 - DNA, 22 bp, Artificial Sequence
  chemically synthesized
tccactgattttctacaatgaa

SEQ ID NO: 676620 - DNA, 22 bp, Artificial Sequence
  chemically synthesized
ttccactgattttctacaatga

SEQ ID NO: 676621 - DNA, 22 bp, Artificial Sequence
  chemically synthesized
cttttccactgattttctacaa

SEQ ID NO: 676622 - DNA, 22 bp, Artificial Sequence
  chemically synthesized
attccttttccactgattttct

SEQ ID NO: 676623 - DNA, 22 bp, Artificial Sequence
  chemically synthesized
cattccttttccactgattttc

SEQ ID NO: 676624 - DNA, 22 bp, Artificial Sequence
  chemically synthesized
tcattccttttccactgatttt

SEQ ID NO: 676625 - DNA, 22 bp, Artificial Sequence
  chemically synthesized
ttcattccttttccactgattt

SEQ ID NO: 676626 - DNA, 22 bp, Artificial Sequence
  chemically synthesized
tttcattccttttccactgatt

SEQ ID NO: 676627 - DNA, 22 bp, Artificial Sequence
  chemically synthesized
tttttcattccttttccactga

SEQ ID NO: 676628 - DNA, 22 bp, Artificial Sequence
  chemically synthesized
attgtagaaaatcagtggaaaa

SEQ ID NO: 676629 - DNA, 22 bp, Artificial Sequence
  chemically synthesized
ctttttcattccttttccactg

SEQ ID NO: 676630 - DNA, 22 bp, Artificial Sequence
  chemically synthesized
tctttttcattccttttccact

SEQ ID NO: 676631 - DNA, 22 bp, Artificial Sequence
  chemically synthesized
tagaaaatcagtggaaaaggaa

SEQ ID NO: 676632 - DNA, 22 bp, Artificial Sequence
  chemically synthesized
ggtggttttctttttcattcct

SEQ ID NO: 676633 - DNA, 22 bp, Artificial Sequence
  chemically synthesized
tgggtggttttctttttcattc

SEQ ID NO: 676634 - DNA, 22 bp, Artificial Sequence
  chemically synthesized
atacattctgggtggttttctt

SEQ ID NO: 676635 - DNA, 22 bp, Artificial Sequence
  chemically synthesized
taatacattctgggtggttttc

SEQ ID NO: 676636 - DNA, 22 bp, Artificial Sequence
  chemically synthesized
tctaatacattctgggtggttt

SEQ ID NO: 676637 - DNA, 22 bp, Artificial Sequence
  chemically synthesized
gagctctctaatacattctggg

SEQ ID NO: 676638 - DNA, 22 bp, Artificial Sequence
  chemically synthesized
ccattggagctctctaatacat

SEQ ID NO: 676639 - DNA, 22 bp, Artificial Sequence
  chemically synthesized
agatattaccattggagctctc

SEQ ID NO: 676640 - DNA, 22 bp, Artificial Sequence
  chemically synthesized
gagatattaccattggagctct

SEQ ID NO: 676641 - DNA, 22 bp, Artificial Sequence
  chemically synthesized
cttgagatattaccattggagc

SEQ ID NO: 676642 - DNA, 22 bp, Artificial Sequence
  chemically synthesized
gagagctccaatggtaatatct

SEQ ID NO: 676643 - DNA, 22 bp, Artificial Sequence
  chemically synthesized
taatattgcttgagatattacc

SEQ ID NO: 676644 - DNA, 22 bp, Artificial Sequence
  chemically synthesized
caatggtaatatctcaagcaat

SEQ ID NO: 676645 - DNA, 22 bp, Artificial Sequence
  chemically synthesized
atgaaaagctataatattgctt

SEQ ID NO: 676646 - DNA, 22 bp, Artificial Sequence
  chemically synthesized
ctgatgaaaagctataatattg

SEQ ID NO: 676647 - DNA, 22 bp, Artificial Sequence
  chemically synthesized
actgatgaaaagctataatatt

SEQ ID NO: 676648 - DNA, 22 bp, Artificial Sequence
  chemically synthesized
aagcaatattatagcttttcat

SEQ ID NO: 676649 - DNA, 22 bp, Artificial Sequence
  chemically synthesized
aaaaagtagcaagtatttactg

SEQ ID NO: 676650 - DNA, 22 bp, Artificial Sequence
  chemically synthesized
tagcttttcatcagtaaatact

SEQ ID NO: 676651 - DNA, 22 bp, Artificial Sequence
  chemically synthesized
gaactgaaaaagtagcaagtat

SEQ ID NO: 676652 - DNA, 22 bp, Artificial Sequence
  chemically synthesized
ttcatcagtaaatacttgctac

SEQ ID NO: 676653 - DNA, 22 bp, Artificial Sequence
  chemically synthesized
tcatcagtaaatacttgctact

SEQ ID NO: 676654 - DNA, 22 bp, Artificial Sequence
  chemically synthesized
catcagtaaatacttgctactt

SEQ ID NO: 676655 - DNA, 22 bp, Artificial Sequence
  chemically synthesized
ttagaactgaaaaagtagcaag

SEQ ID NO: 676656 - DNA, 22 bp, Artificial Sequence
  chemically synthesized
atcagtaaatacttgctacttt

SEQ ID NO: 676657 - DNA, 22 bp, Artificial Sequence
  chemically synthesized
gttagaactgaaaaagtagcaa

SEQ ID NO: 676658 - DNA, 22 bp, Artificial Sequence
  chemically synthesized
tgttagaactgaaaaagtagca

SEQ ID NO: 676659 - DNA, 22 bp, Artificial Sequence
  chemically synthesized
gctactttttcagttctaacaa

SEQ ID NO: 676660 - DNA, 22 bp, Artificial Sequence
  chemically synthesized
ctactttttcagttctaacaaa

SEQ ID NO: 676661 - DNA, 22 bp, Artificial Sequence
  chemically synthesized
gaaggtgaaaacattttgttag

SEQ ID NO: 676662 - DNA, 22 bp, Artificial Sequence
  chemically synthesized
ctttttcagttctaacaaaatg

SEQ ID NO: 676663 - DNA, 22 bp, Artificial Sequence
  chemically synthesized
tttcagttctaacaaaatgttt

SEQ ID NO: 676664 - DNA, 22 bp, Artificial Sequence
  chemically synthesized
ttcagttctaacaaaatgtttt

SEQ ID NO: 676665 - DNA, 22 bp, Artificial Sequence
  chemically synthesized
tcagttctaacaaaatgttttc

SEQ ID NO: 676666 - DNA, 22 bp, Artificial Sequence
  chemically synthesized
cagttctaacaaaatgttttca

SEQ ID NO: 676667 - DNA, 22 bp, Artificial Sequence
  chemically synthesized
agttctaacaaaatgttttcac

SEQ ID NO: 676668 - DNA, 22 bp, Artificial Sequence
  chemically synthesized
taacaaaatgttttcaccttct

SEQ ID NO: 676669 - DNA, 22 bp, Artificial Sequence
  chemically synthesized
acaaaatgttttcaccttctaa

SEQ ID NO: 676670 - DNA, 22 bp, Artificial Sequence
  chemically synthesized
aacacaataggattagaaggtg

SEQ ID NO: 676671 - DNA, 22 bp, Artificial Sequence
  chemically synthesized
gaacacaataggattagaaggt

SEQ ID NO: 676672 - DNA, 22 bp, Artificial Sequence
  chemically synthesized
tcaccttctaatcctattgtgt

SEQ ID NO: 676673 - DNA, 22 bp, Artificial Sequence
  chemically synthesized
caccttctaatcctattgtgtt

SEQ ID NO: 676674 - DNA, 22 bp, Artificial Sequence
  chemically synthesized
accttctaatcctattgtgttc

SEQ ID NO: 676675 - DNA, 22 bp, Artificial Sequence
  chemically synthesized
cacccagggtttgaacacaata

SEQ ID NO: 676676 - DNA, 22 bp, Artificial Sequence
  chemically synthesized
ctaatcctattgtgttcaaacc

SEQ ID NO: 676677 - DNA, 22 bp, Artificial Sequence
  chemically synthesized
ccctgcacccagggtttgaaca

SEQ ID NO: 676678 - DNA, 22 bp, Artificial Sequence
  chemically synthesized
taatcctattgtgttcaaaccc

SEQ ID NO: 676679 - DNA, 22 bp, Artificial Sequence
  chemically synthesized
atcctattgtgttcaaaccctg

SEQ ID NO: 676680 - DNA, 22 bp, Artificial Sequence
  chemically synthesized
aggtgttcccctgcacccaggg

SEQ ID NO: 676681 - DNA, 22 bp, Artificial Sequence
  chemically synthesized
ttgtgttcaaaccctgggtgca

SEQ ID NO: 676682 - DNA, 22 bp, Artificial Sequence
  chemically synthesized
tgttcaaaccctgggtgcaggg

SEQ ID NO: 676683 - DNA, 22 bp, Artificial Sequence
  chemically synthesized
aaaccctgggtgcaggggaaca

SEQ ID NO: 676684 - DNA, 22 bp, Artificial Sequence
  chemically synthesized
aaaagcattcaggtgttcccct

SEQ ID NO: 676685 - DNA, 22 bp, Artificial Sequence
  chemically synthesized
ccctcaaaagcattcaggtgtt

SEQ ID NO: 676686 - DNA, 22 bp, Artificial Sequence
  chemically synthesized
gccctcaaaagcattcaggtgt

SEQ ID NO: 676687 - DNA, 22 bp, Artificial Sequence
  chemically synthesized
ggtgcaggggaacacctgaatg

SEQ ID NO: 676688 - DNA, 22 bp, Artificial Sequence
  chemically synthesized
ccttgccctcaaaagcattcag

SEQ ID NO: 676689 - DNA, 22 bp, Artificial Sequence
  chemically synthesized
cctgccttgccctcaaaagcat

SEQ ID NO: 676690 - DNA, 22 bp, Artificial Sequence
  chemically synthesized
tgttacctgccttgccctcaaa

SEQ ID NO: 676691 - DNA, 22 bp, Artificial Sequence
  chemically synthesized
atgttacctgccttgccctcaa

SEQ ID NO: 676692 - DNA, 22 bp, Artificial Sequence
  chemically synthesized
aatgcttttgagggcaaggcag

SEQ ID NO: 676693 - DNA, 22 bp, Artificial Sequence
  chemically synthesized
aacacatgtttatgttacctgc

SEQ ID NO: 676694 - DNA, 22 bp, Artificial Sequence
  chemically synthesized
ttgagggcaaggcaggtaacat

SEQ ID NO: 676695 - DNA, 22 bp, Artificial Sequence
  chemically synthesized
tgagggcaaggcaggtaacata

SEQ ID NO: 676696 - DNA, 22 bp, Artificial Sequence
  chemically synthesized
gagggcaaggcaggtaacataa

SEQ ID NO: 676697 - DNA, 22 bp, Artificial Sequence
  chemically synthesized
ttcaacacatgtttatgttacc

SEQ ID NO: 676698 - DNA, 22 bp, Artificial Sequence
  chemically synthesized
agggcaaggcaggtaacataaa

SEQ ID NO: 676699 - DNA, 22 bp, Artificial Sequence
  chemically synthesized
ccaagcagcctgttcaacacat

SEQ ID NO: 676700 - DNA, 22 bp, Artificial Sequence
  chemically synthesized
ccaaagttcccaagcagcctgt

SEQ ID NO: 676701 - DNA, 22 bp, Artificial Sequence
  chemically synthesized
gccaaagttcccaagcagcctg

SEQ ID NO: 676702 - DNA, 22 bp, Artificial Sequence
  chemically synthesized
atttgccaaagttcccaagcag

SEQ ID NO: 676703 - DNA, 22 bp, Artificial Sequence
  chemically synthesized
taatttgccaaagttcccaagc

SEQ ID NO: 676704 - DNA, 22 bp, Artificial Sequence
  chemically synthesized
tctaatttgccaaagttcccaa

SEQ ID NO: 676705 - DNA, 22 bp, Artificial Sequence
  chemically synthesized
aacaggctgcttgggaactttg

SEQ ID NO: 676706 - DNA, 22 bp, Artificial Sequence
  chemically synthesized
cattctctaatttgccaaagtt

SEQ ID NO: 676707 - DNA, 22 bp, Artificial Sequence
  chemically synthesized
ccattctctaatttgccaaagt

SEQ ID NO: 676708 - DNA, 22 bp, Artificial Sequence
  chemically synthesized
cttgggaactttggcaaattag

SEQ ID NO: 676709 - DNA, 22 bp, Artificial Sequence
  chemically synthesized
gggaactttggcaaattagaga

SEQ ID NO: 676710 - DNA, 22 bp, Artificial Sequence
  chemically synthesized
ggaactttggcaaattagagaa

SEQ ID NO: 676711 - DNA, 22 bp, Artificial Sequence
  chemically synthesized
aggagatttccattctctaatt

SEQ ID NO: 676712 - DNA, 22 bp, Artificial Sequence
  chemically synthesized
taaggagatttccattctctaa

SEQ ID NO: 676713 - DNA, 22 bp, Artificial Sequence
  chemically synthesized
ctaaggagatttccattctcta

SEQ ID NO: 676714 - DNA, 22 bp, Artificial Sequence
  chemically synthesized
tggcaaattagagaatggaaat

SEQ ID NO: 676715 - DNA, 22 bp, Artificial Sequence
  chemically synthesized
ggcaaattagagaatggaaatc

SEQ ID NO: 676716 - DNA, 22 bp, Artificial Sequence
  chemically synthesized
gcaaattagagaatggaaatct

SEQ ID NO: 676717 - DNA, 22 bp, Artificial Sequence
  chemically synthesized
gagacgcccacttctaaggaga

SEQ ID NO: 676718 - DNA, 22 bp, Artificial Sequence
  chemically synthesized
gagaatggaaatctccttagaa

SEQ ID NO: 676719 - DNA, 22 bp, Artificial Sequence
  chemically synthesized
ctagagacgcccacttctaagg

SEQ ID NO: 676720 - DNA, 22 bp, Artificial Sequence
  chemically synthesized
cacattcctagagacgcccact

SEQ ID NO: 676721 - DNA, 22 bp, Artificial Sequence
  chemically synthesized
cttagaagtgggcgtctctagg

SEQ ID NO: 676722 - DNA, 22 bp, Artificial Sequence
  chemically synthesized
agaagtgggcgtctctaggaat

SEQ ID NO: 676723 - DNA, 22 bp, Artificial Sequence
  chemically synthesized
gaagtgggcgtctctaggaatg

SEQ ID NO: 676724 - DNA, 22 bp, Artificial Sequence
  chemically synthesized
acagtatgcatggtaggttaca

SEQ ID NO: 676725 - DNA, 22 bp, Artificial Sequence
  chemically synthesized
taggaatgtgtaacctaccatg

SEQ ID NO: 676726 - DNA, 22 bp, Artificial Sequence
  chemically synthesized
ggaatgtgtaacctaccatgca

SEQ ID NO: 676727 - DNA, 22 bp, Artificial Sequence
  chemically synthesized
cagtggttcacagtatgcatgg

SEQ ID NO: 676728 - DNA, 22 bp, Artificial Sequence
  chemically synthesized
ccatgcatactgtgaaccactg

SEQ ID NO: 676729 - DNA, 22 bp, Artificial Sequence
  chemically synthesized
ccgtggaagctacagtggttca

SEQ ID NO: 676730 - DNA, 22 bp, Artificial Sequence
  chemically synthesized
taccgtggaagctacagtggtt

SEQ ID NO: 676731 - DNA, 22 bp, Artificial Sequence
  chemically synthesized
tgaaccactgtagcttccacgg

SEQ ID NO: 676732 - DNA, 22 bp, Artificial Sequence
  chemically synthesized
caggcatactctaccgtggaag

SEQ ID NO: 676733 - DNA, 22 bp, Artificial Sequence
  chemically synthesized
tagcttccacggtagagtatgc

SEQ ID NO: 676734 - DNA, 22 bp, Artificial Sequence
  chemically synthesized
tacccccactccaggcatactc

SEQ ID NO: 676735 - DNA, 22 bp, Artificial Sequence
  chemically synthesized
tgtacccccactccaggcatac

SEQ ID NO: 676736 - DNA, 22 bp, Artificial Sequence
  chemically synthesized
ccacggtagagtatgcctggag

SEQ ID NO: 676737 - DNA, 22 bp, Artificial Sequence
  chemically synthesized
cacggtagagtatgcctggagt

SEQ ID NO: 676738 - DNA, 22 bp, Artificial Sequence
  chemically synthesized
cctctgtacccccactccaggc

SEQ ID NO: 676739 - DNA, 22 bp, Artificial Sequence
  chemically synthesized
ccctctgtacccccactccagg

SEQ ID NO: 676740 - DNA, 22 bp, Artificial Sequence
  chemically synthesized
tccctctgtacccccactccag

SEQ ID NO: 676741 - DNA, 22 bp, Artificial Sequence
  chemically synthesized
ttccctctgtacccccactcca

SEQ ID NO: 676742 - DNA, 22 bp, Artificial Sequence
  chemically synthesized
tttccctctgtacccccactcc

SEQ ID NO: 676743 - DNA, 22 bp, Artificial Sequence
  chemically synthesized
ctttttccctctgtacccccac

SEQ ID NO: 676744 - DNA, 22 bp, Artificial Sequence
  chemically synthesized
gagtgggggtacagagggaaaa

SEQ ID NO: 676745 - DNA, 22 bp, Artificial Sequence
  chemically synthesized
aaaatatcaagatgttgctttt

SEQ ID NO: 676746 - DNA, 22 bp, Artificial Sequence
  chemically synthesized
gtgaggtgctgaaaatatcaag

SEQ ID NO: 676747 - DNA, 22 bp, Artificial Sequence
  chemically synthesized
tggtgaggtgctgaaaatatca

SEQ ID NO: 676748 - DNA, 22 bp, Artificial Sequence
  chemically synthesized
atgtctctggtgaggtgctgaa

SEQ ID NO: 676749 - DNA, 22 bp, Artificial Sequence
  chemically synthesized
gatattttcagcacctcaccag

SEQ ID NO: 676750 - DNA, 22 bp, Artificial Sequence
  chemically synthesized
aacctcatgtctctggtgaggt

SEQ ID NO: 676751 - DNA, 22 bp, Artificial Sequence
  chemically synthesized
atattttcagcacctcaccaga

SEQ ID NO: 676752 - DNA, 22 bp, Artificial Sequence
  chemically synthesized
tcagcacctcaccagagacatg

SEQ ID NO: 676753 - DNA, 22 bp, Artificial Sequence
  chemically synthesized
cagcacctcaccagagacatga

SEQ ID NO: 676754 - DNA, 22 bp, Artificial Sequence
  chemically synthesized
agcacctcaccagagacatgag

SEQ ID NO: 676755 - DNA, 22 bp, Artificial Sequence
  chemically synthesized
atcgaacctgaacctcatgtct

SEQ ID NO: 676756 - DNA, 22 bp, Artificial Sequence
  chemically synthesized
ctaatcgaacctgaacctcatg

SEQ ID NO: 676757 - DNA, 22 bp, Artificial Sequence
  chemically synthesized
tcctaatcgaacctgaacctca

SEQ ID NO: 676758 - DNA, 22 bp, Artificial Sequence
  chemically synthesized
accagagacatgaggttcaggt

SEQ ID NO: 676759 - DNA, 22 bp, Artificial Sequence
  chemically synthesized
gccccctctcctaatcgaacct

SEQ ID NO: 676760 - DNA, 22 bp, Artificial Sequence
  chemically synthesized
aggttcgattaggagagggggc

SEQ ID NO: 676761 - DNA, 22 bp, Artificial Sequence
  chemically synthesized
agaccacatctagccccctctc

SEQ ID NO: 676762 - DNA, 22 bp, Artificial Sequence
  chemically synthesized
aagaccacatctagccccctct

SEQ ID NO: 676763 - DNA, 22 bp, Artificial Sequence
  chemically synthesized
gattaggagagggggctagatg

SEQ ID NO: 676764 - DNA, 22 bp, Artificial Sequence
  chemically synthesized
ggagagggggctagatgtggtc

SEQ ID NO: 676765 - DNA, 22 bp, Artificial Sequence
  chemically synthesized
gcgtgtcaaatgtttaagacca

SEQ ID NO: 676766 - DNA, 22 bp, Artificial Sequence
  chemically synthesized
tggtctggcgtgtcaaatgttt

SEQ ID NO: 676767 - DNA, 22 bp, Artificial Sequence
  chemically synthesized
gatgtggtcttaaacatttgac

SEQ ID NO: 676768 - DNA, 22 bp, Artificial Sequence
  chemically synthesized
aaacatttgacacgccagacca

SEQ ID NO: 676769 - DNA, 22 bp, Artificial Sequence
  chemically synthesized
aacatttgacacgccagaccac

SEQ ID NO: 676770 - DNA, 22 bp, Artificial Sequence
  chemically synthesized
aaagcagaaatggtgttgtggt

SEQ ID NO: 676771 - DNA, 22 bp, Artificial Sequence
  chemically synthesized
gaaagcagaaatggtgttgtgg

SEQ ID NO: 676772 - DNA, 22 bp, Artificial Sequence
  chemically synthesized
gacacgccagaccacaacacca

SEQ ID NO: 676773 - DNA, 22 bp, Artificial Sequence
  chemically synthesized
acacgccagaccacaacaccat

SEQ ID NO: 676774 - DNA, 22 bp, Artificial Sequence
  chemically synthesized
gtgaaaggtatcttgaaagcag

SEQ ID NO: 676775 - DNA, 22 bp, Artificial Sequence
  chemically synthesized
cagtcagttggtgaaaggtatc

SEQ ID NO: 676776 - DNA, 22 bp, Artificial Sequence
  chemically synthesized
ctgctttcaagatacctttcac

SEQ ID NO: 676777 - DNA, 22 bp, Artificial Sequence
  chemically synthesized
tgctttcaagatacctttcacc

SEQ ID NO: 676778 - DNA, 22 bp, Artificial Sequence
  chemically synthesized
ctttcaagatacctttcaccaa

SEQ ID NO: 676779 - DNA, 22 bp, Artificial Sequence
  chemically synthesized
aactacagtcagttggtgaaag

SEQ ID NO: 676780 - DNA, 22 bp, Artificial Sequence
  chemically synthesized
caactacagtcagttggtgaaa

SEQ ID NO: 676781 - DNA, 22 bp, Artificial Sequence
  chemically synthesized
tcaagatacctttcaccaactg

SEQ ID NO: 676782 - DNA, 22 bp, Artificial Sequence
  chemically synthesized
caagatacctttcaccaactga

SEQ ID NO: 676783 - DNA, 22 bp, Artificial Sequence
  chemically synthesized
aagatacctttcaccaactgac

SEQ ID NO: 676784 - DNA, 22 bp, Artificial Sequence
  chemically synthesized
tcaccaactgactgtagttgaa

SEQ ID NO: 676785 - DNA, 22 bp, Artificial Sequence
  chemically synthesized
caccaactgactgtagttgaag

SEQ ID NO: 676786 - DNA, 22 bp, Artificial Sequence
  chemically synthesized
accaactgactgtagttgaagg

SEQ ID NO: 676787 - DNA, 22 bp, Artificial Sequence
  chemically synthesized
gatgaaatggtcggaagccttc

SEQ ID NO: 676788 - DNA, 22 bp, Artificial Sequence
  chemically synthesized
actgtagttgaaggcttccgac

SEQ ID NO: 676789 - DNA, 22 bp, Artificial Sequence
  chemically synthesized
agctggatgaaatggtcggaag

SEQ ID NO: 676790 - DNA, 22 bp, Artificial Sequence
  chemically synthesized
gagctggatgaaatggtcggaa

SEQ ID NO: 676791 - DNA, 22 bp, Artificial Sequence
  chemically synthesized
tagttgaaggcttccgaccatt

SEQ ID NO: 676792 - DNA, 22 bp, Artificial Sequence
  chemically synthesized
tgagctggatgaaatggtcgga

SEQ ID NO: 676793 - DNA, 22 bp, Artificial Sequence
  chemically synthesized
tttgagctggatgaaatggtcg

SEQ ID NO: 676794 - DNA, 22 bp, Artificial Sequence
  chemically synthesized
ctctttgagctggatgaaatgg

SEQ ID NO: 676795 - DNA, 22 bp, Artificial Sequence
  chemically synthesized
aaggcttccgaccatttcatcc

SEQ ID NO: 676796 - DNA, 22 bp, Artificial Sequence
  chemically synthesized
ccgaccatttcatccagctcaa

SEQ ID NO: 676797 - DNA, 22 bp, Artificial Sequence
  chemically synthesized
cgaccatttcatccagctcaaa

SEQ ID NO: 676798 - DNA, 22 bp, Artificial Sequence
  chemically synthesized
ggtccaaattgctctttgagct

SEQ ID NO: 676799 - DNA, 22 bp, Artificial Sequence
  chemically synthesized
aggtccaaattgctctttgagc

SEQ ID NO: 676800 - DNA, 22 bp, Artificial Sequence
  chemically synthesized
taggtccaaattgctctttgag

SEQ ID NO: 676801 - DNA, 22 bp, Artificial Sequence
  chemically synthesized
catccagctcaaagagcaattt

SEQ ID NO: 676802 - DNA, 22 bp, Artificial Sequence
  chemically synthesized
atccagctcaaagagcaatttg

SEQ ID NO: 676803 - DNA, 22 bp, Artificial Sequence
  chemically synthesized
aagaggtatccctttaggtcca

SEQ ID NO: 676804 - DNA, 22 bp, Artificial Sequence
  chemically synthesized
aaagagcaatttggacctaaag

SEQ ID NO: 676805 - DNA, 22 bp, Artificial Sequence
  chemically synthesized
caagaggtatccctttaggtcc

SEQ ID NO: 676806 - DNA, 22 bp, Artificial Sequence
  chemically synthesized
ttcaagaggtatccctttaggt

SEQ ID NO: 676807 - DNA, 22 bp, Artificial Sequence
  chemically synthesized
cttcaagaggtatccctttagg

SEQ ID NO: 676808 - DNA, 22 bp, Artificial Sequence
  chemically synthesized
ttcttcaagaggtatcccttta

SEQ ID NO: 676809 - DNA, 22 bp, Artificial Sequence
  chemically synthesized
cttcttcaagaggtatcccttt

SEQ ID NO: 676810 - DNA, 22 bp, Artificial Sequence
  chemically synthesized
tcttcttcaagaggtatccctt

SEQ ID NO: 676811 - DNA, 22 bp, Artificial Sequence
  chemically synthesized
ttcttcttcaagaggtatccct

SEQ ID NO: 676812 - DNA, 22 bp, Artificial Sequence
  chemically synthesized
ggacctaaagggatacctcttg

SEQ ID NO: 676813 - DNA, 22 bp, Artificial Sequence
  chemically synthesized
gacctaaagggatacctcttga

SEQ ID NO: 676814 - DNA, 22 bp, Artificial Sequence
  chemically synthesized
tatttttcttcttcaagaggta

SEQ ID NO: 676815 - DNA, 22 bp, Artificial Sequence
  chemically synthesized
atatttttcttcttcaagaggt

SEQ ID NO: 676816 - DNA, 22 bp, Artificial Sequence
  chemically synthesized
gtttatatttttcttcttcaag

SEQ ID NO: 676817 - DNA, 22 bp, Artificial Sequence
  chemically synthesized
aagggatacctcttgaagaaga

SEQ ID NO: 676818 - DNA, 22 bp, Artificial Sequence
  chemically synthesized
ttagtttatatttttcttcttc

SEQ ID NO: 676819 - DNA, 22 bp, Artificial Sequence
  chemically synthesized
attagtttatatttttcttctt

SEQ ID NO: 676820 - DNA, 22 bp, Artificial Sequence
  chemically synthesized
cttattagtttatatttttctt

SEQ ID NO: 676821 - DNA, 22 bp, Artificial Sequence
  chemically synthesized
acttattagtttatatttttct

SEQ ID NO: 676822 - DNA, 22 bp, Artificial Sequence
  chemically synthesized
tacttattagtttatatttttc

SEQ ID NO: 676823 - DNA, 22 bp, Artificial Sequence
  chemically synthesized
ttacttattagtttatattttt

SEQ ID NO: 676824 - DNA, 22 bp, Artificial Sequence
  chemically synthesized
ttgaagaagaaaaatataaact

SEQ ID NO: 676825 - DNA, 22 bp, Artificial Sequence
  chemically synthesized
gtttttacttattagtttatat

SEQ ID NO: 676826 - DNA, 22 bp, Artificial Sequence
  chemically synthesized
gaagaagaaaaatataaactaa

SEQ ID NO: 676827 - DNA, 22 bp, Artificial Sequence
  chemically synthesized
agtttttacttattagtttata

SEQ ID NO: 676828 - DNA, 22 bp, Artificial Sequence
  chemically synthesized
aagaagaaaaatataaactaat

SEQ ID NO: 676829 - DNA, 22 bp, Artificial Sequence
  chemically synthesized
tagtttttacttattagtttat

SEQ ID NO: 676830 - DNA, 22 bp, Artificial Sequence
  chemically synthesized
attttagtttttacttattagt

SEQ ID NO: 676831 - DNA, 22 bp, Artificial Sequence
  chemically synthesized
attgattttagtttttacttat

SEQ ID NO: 676832 - DNA, 22 bp, Artificial Sequence
  chemically synthesized
cattgattttagtttttactta

SEQ ID NO: 676833 - DNA, 22 bp, Artificial Sequence
  chemically synthesized
tcattgattttagtttttactt

SEQ ID NO: 676834 - DNA, 22 bp, Artificial Sequence
  chemically synthesized
ttcattgattttagtttttact

SEQ ID NO: 676835 - DNA, 22 bp, Artificial Sequence
  chemically synthesized
ataagtaaaaactaaaatcaat

SEQ ID NO: 676836 - DNA, 22 bp, Artificial Sequence
  chemically synthesized
aaaagaaacttttcattgattt

SEQ ID NO: 676837 - DNA, 22 bp, Artificial Sequence
  chemically synthesized
aaatcaatgaaaagtttctttt

SEQ ID NO: 676838 - DNA, 22 bp, Artificial Sequence
  chemically synthesized
agagtcgaaacataagcataaa

SEQ ID NO: 676839 - DNA, 22 bp, Artificial Sequence
  chemically synthesized
cttttcagtattttatgcttat

SEQ ID NO: 676840 - DNA, 22 bp, Artificial Sequence
  chemically synthesized
cagagtcgaaacataagcataa

SEQ ID NO: 676841 - DNA, 22 bp, Artificial Sequence
  chemically synthesized
ttttcagtattttatgcttatg

SEQ ID NO: 676842 - DNA, 22 bp, Artificial Sequence
  chemically synthesized
ttcagtattttatgcttatgtt

SEQ ID NO: 676843 - DNA, 22 bp, Artificial Sequence
  chemically synthesized
tcagtattttatgcttatgttt

SEQ ID NO: 676844 - DNA, 22 bp, Artificial Sequence
  chemically synthesized
cagtattttatgcttatgtttc

SEQ ID NO: 676845 - DNA, 22 bp, Artificial Sequence
  chemically synthesized
agtattttatgcttatgtttcg

SEQ ID NO: 676846 - DNA, 22 bp, Artificial Sequence
  chemically synthesized
cagtgtttcagagtcgaaacat

SEQ ID NO: 676847 - DNA, 22 bp, Artificial Sequence
  chemically synthesized
tatgcttatgtttcgactctga

SEQ ID NO: 676848 - DNA, 22 bp, Artificial Sequence
  chemically synthesized
atgcttatgtttcgactctgaa

SEQ ID NO: 676849 - DNA, 22 bp, Artificial Sequence
  chemically synthesized
tgcttatgtttcgactctgaaa

SEQ ID NO: 676850 - DNA, 22 bp, Artificial Sequence
  chemically synthesized
caaaattacagtgtttcagagt

SEQ ID NO: 676851 - DNA, 22 bp, Artificial Sequence
  chemically synthesized
tccaaaattacagtgtttcaga

SEQ ID NO: 676852 - DNA, 22 bp, Artificial Sequence
  chemically synthesized
atgtttcgactctgaaacactg

SEQ ID NO: 676853 - DNA, 22 bp, Artificial Sequence
  chemically synthesized
tgtttcgactctgaaacactgt

SEQ ID NO: 676854 - DNA, 22 bp, Artificial Sequence
  chemically synthesized
cccctctccaaaattacagtgt

SEQ ID NO: 676855 - DNA, 22 bp, Artificial Sequence
  chemically synthesized
ccccctctccaaaattacagtg

SEQ ID NO: 676856 - DNA, 22 bp, Artificial Sequence
  chemically synthesized
cgactctgaaacactgtaattt

SEQ ID NO: 676857 - DNA, 22 bp, Artificial Sequence
  chemically synthesized
tccccctctccaaaattacagt

SEQ ID NO: 676858 - DNA, 22 bp, Artificial Sequence
  chemically synthesized
gactctgaaacactgtaatttt

SEQ ID NO: 676859 - DNA, 22 bp, Artificial Sequence
  chemically synthesized
cctttccccctctccaaaatta

SEQ ID NO: 676860 - DNA, 22 bp, Artificial Sequence
  chemically synthesized
tgaaacactgtaattttggaga

SEQ ID NO: 676861 - DNA, 22 bp, Artificial Sequence
  chemically synthesized
aaacactgtaattttggagagg

SEQ ID NO: 676862 - DNA, 22 bp, Artificial Sequence
  chemically synthesized
ccagcactgcctttccccctct

SEQ ID NO: 676863 - DNA, 22 bp, Artificial Sequence
  chemically synthesized
taattttggagagggggaaagg

SEQ ID NO: 676864 - DNA, 22 bp, Artificial Sequence
  chemically synthesized
actaccagcactgcctttcccc

SEQ ID NO: 676865 - DNA, 22 bp, Artificial Sequence
  chemically synthesized
tggagagggggaaaggcagtgc

SEQ ID NO: 676866 - DNA, 22 bp, Artificial Sequence
  chemically synthesized
ggagagggggaaaggcagtgct

SEQ ID NO: 676867 - DNA, 22 bp, Artificial Sequence
  chemically synthesized
gagagggggaaaggcagtgctg

SEQ ID NO: 676868 - DNA, 22 bp, Artificial Sequence
  chemically synthesized
agatcccatataagattaacta

SEQ ID NO: 676869 - DNA, 22 bp, Artificial Sequence
  chemically synthesized
gagatcccatataagattaact

SEQ ID NO: 676870 - DNA, 22 bp, Artificial Sequence
  chemically synthesized
catccttgagatcccatataag

SEQ ID NO: 676871 - DNA, 22 bp, Artificial Sequence
  chemically synthesized
gtagttaatcttatatgggatc

SEQ ID NO: 676872 - DNA, 22 bp, Artificial Sequence
  chemically synthesized
cctacatccttgagatcccata

SEQ ID NO: 676873 - DNA, 22 bp, Artificial Sequence
  chemically synthesized
atcttatatgggatctcaagga

SEQ ID NO: 676874 - DNA, 22 bp, Artificial Sequence
  chemically synthesized
atatgggatctcaaggatgtag

SEQ ID NO: 676875 - DNA, 22 bp, Artificial Sequence
  chemically synthesized
tatgggatctcaaggatgtagg

SEQ ID NO: 676876 - DNA, 22 bp, Artificial Sequence
  chemically synthesized
aaggatgtaggcaggctgggcg

SEQ ID NO: 676877 - DNA, 22 bp, Artificial Sequence
  chemically synthesized
caagcgtaagccacagcgccca

SEQ ID NO: 676878 - DNA, 22 bp, Artificial Sequence
  chemically synthesized
ggattacaagcgtaagccacag

SEQ ID NO: 676879 - DNA, 22 bp, Artificial Sequence
  chemically synthesized
ttaggattacaagcgtaagcca

SEQ ID NO: 676880 - DNA, 22 bp, Artificial Sequence
  chemically synthesized
ggcgctgtggcttacgcttgta

SEQ ID NO: 676881 - DNA, 22 bp, Artificial Sequence
  chemically synthesized
ccaaattgttaggattacaagc

SEQ ID NO: 676882 - DNA, 22 bp, Artificial Sequence
  chemically synthesized
tggcttacgcttgtaatcctaa

SEQ ID NO: 676883 - DNA, 22 bp, Artificial Sequence
  chemically synthesized
gcctcccaaattgttaggatta

SEQ ID NO: 676884 - DNA, 22 bp, Artificial Sequence
  chemically synthesized
ggcctcccaaattgttaggatt

SEQ ID NO: 676885 - DNA, 22 bp, Artificial Sequence
  chemically synthesized
acgcttgtaatcctaacaattt

SEQ ID NO: 676886 - DNA, 22 bp, Artificial Sequence
  chemically synthesized
cgcttgtaatcctaacaatttg

SEQ ID NO: 676887 - DNA, 22 bp, Artificial Sequence
  chemically synthesized
ccaccttggcctcccaaattgt

SEQ ID NO: 676888 - DNA, 22 bp, Artificial Sequence
  chemically synthesized
gtaatcctaacaatttgggagg

SEQ ID NO: 676889 - DNA, 22 bp, Artificial Sequence
  chemically synthesized
taatcctaacaatttgggaggc

SEQ ID NO: 676890 - DNA, 22 bp, Artificial Sequence
  chemically synthesized
aggtgatcctcccaccttggcc

SEQ ID NO: 676891 - DNA, 22 bp, Artificial Sequence
  chemically synthesized
acaatttgggaggccaaggtgg

SEQ ID NO: 676892 - DNA, 22 bp, Artificial Sequence
  chemically synthesized
acctcaggtgatcctcccacct

SEQ ID NO: 676893 - DNA, 22 bp, Artificial Sequence
  chemically synthesized
gggaggccaaggtgggaggatc

SEQ ID NO: 676894 - DNA, 22 bp, Artificial Sequence
  chemically synthesized
ctgacctcaggtgatcctccca

SEQ ID NO: 676895 - DNA, 22 bp, Artificial Sequence
  chemically synthesized
ggaggccaaggtgggaggatca

SEQ ID NO: 676896 - DNA, 22 bp, Artificial Sequence
  chemically synthesized
gaactcctgacctcaggtgatc

SEQ ID NO: 676897 - DNA, 22 bp, Artificial Sequence
  chemically synthesized
gtctcgaactcctgacctcagg

SEQ ID NO: 676898 - DNA, 22 bp, Artificial Sequence
  chemically synthesized
ggctggtctcgaactcctgacc

SEQ ID NO: 676899 - DNA, 22 bp, Artificial Sequence
  chemically synthesized
gctaggctggtctcgaactcct

SEQ ID NO: 676900 - DNA, 22 bp, Artificial Sequence
  chemically synthesized
aggtcaggagttcgagaccagc

SEQ ID NO: 676901 - DNA, 22 bp, Artificial Sequence
  chemically synthesized
ccatgttggctaggctggtctc

SEQ ID NO: 676902 - DNA, 22 bp, Artificial Sequence
  chemically synthesized
gccatgttggctaggctggtct

SEQ ID NO: 676903 - DNA, 22 bp, Artificial Sequence
  chemically synthesized
tgccatgttggctaggctggtc

SEQ ID NO: 676904 - DNA, 22 bp, Artificial Sequence
  chemically synthesized
gagaccagcctagccaacatgg

SEQ ID NO: 676905 - DNA, 22 bp, Artificial Sequence
  chemically synthesized
gggacggggttttgccatgttg

SEQ ID NO: 676906 - DNA, 22 bp, Artificial Sequence
  chemically synthesized
ctagggacggggttttgccatg

SEQ ID NO: 676907 - DNA, 22 bp, Artificial Sequence
  chemically synthesized
actagggacggggttttgccat

SEQ ID NO: 676908 - DNA, 22 bp, Artificial Sequence
  chemically synthesized
tactagggacggggttttgcca

SEQ ID NO: 676909 - DNA, 22 bp, Artificial Sequence
  chemically synthesized
ttactagggacggggttttgcc

SEQ ID NO: 676910 - DNA, 22 bp, Artificial Sequence
  chemically synthesized
gccaacatggcaaaaccccgtc

SEQ ID NO: 676911 - DNA, 22 bp, Artificial Sequence
  chemically synthesized
tatttttactagggacggggtt

SEQ ID NO: 676912 - DNA, 22 bp, Artificial Sequence
  chemically synthesized
gtatttttactagggacggggt

SEQ ID NO: 676913 - DNA, 22 bp, Artificial Sequence
  chemically synthesized
tgtatttttactagggacgggg

SEQ ID NO: 676914 - DNA, 22 bp, Artificial Sequence
  chemically synthesized
ttgtatttttactagggacggg

SEQ ID NO: 676915 - DNA, 22 bp, Artificial Sequence
  chemically synthesized
atttttgtatttttactaggga

SEQ ID NO: 676916 - DNA, 22 bp, Artificial Sequence
  chemically synthesized
gtaaaaatacaaaaattagctg

SEQ ID NO: 676917 - DNA, 22 bp, Artificial Sequence
  chemically synthesized
ggcacccgccaccatacccagc

SEQ ID NO: 676918 - DNA, 22 bp, Artificial Sequence
  chemically synthesized
ctaggcacccgccaccataccc

SEQ ID NO: 676919 - DNA, 22 bp, Artificial Sequence
  chemically synthesized
ggattactaggcacccgccacc

SEQ ID NO: 676920 - DNA, 22 bp, Artificial Sequence
  chemically synthesized
gctgggtatggtggcgggtgcc

SEQ ID NO: 676921 - DNA, 22 bp, Artificial Sequence
  chemically synthesized
ggtatggtggcgggtgcctagt

SEQ ID NO: 676922 - DNA, 22 bp, Artificial Sequence
  chemically synthesized
ccgagtagctgggattactagg

SEQ ID NO: 676923 - DNA, 22 bp, Artificial Sequence
  chemically synthesized
agcctcccgagtagctgggatt

SEQ ID NO: 676924 - DNA, 22 bp, Artificial Sequence
  chemically synthesized
cagcctcccgagtagctgggat

SEQ ID NO: 676925 - DNA, 22 bp, Artificial Sequence
  chemically synthesized
cttcagcctcccgagtagctgg

SEQ ID NO: 676926 - DNA, 22 bp, Artificial Sequence
  chemically synthesized
ctgcttcagcctcccgagtagc

SEQ ID NO: 676927 - DNA, 22 bp, Artificial Sequence
  chemically synthesized
tcctgcttcagcctcccgagta

SEQ ID NO: 676928 - DNA, 22 bp, Artificial Sequence
  chemically synthesized
gtaatcccagctactcgggagg

SEQ ID NO: 676929 - DNA, 22 bp, Artificial Sequence
  chemically synthesized
ctcgggaggctgaagcaggaga

SEQ ID NO: 676930 - DNA, 22 bp, Artificial Sequence
  chemically synthesized
gggaggctgaagcaggagaatc

SEQ ID NO: 676931 - DNA, 22 bp, Artificial Sequence
  chemically synthesized
cccaggatgaagtgattctcct

SEQ ID NO: 676932 - DNA, 22 bp, Artificial Sequence
  chemically synthesized
cgcctccccaggatgaagtgat

SEQ ID NO: 676933 - DNA, 22 bp, Artificial Sequence
  chemically synthesized
aagcaggagaatcacttcatcc

SEQ ID NO: 676934 - DNA, 22 bp, Artificial Sequence
  chemically synthesized
acggcaacctccgcctccccag

SEQ ID NO: 676935 - DNA, 22 bp, Artificial Sequence
  chemically synthesized
gctcacggcaacctccgcctcc

SEQ ID NO: 676936 - DNA, 22 bp, Artificial Sequence
  chemically synthesized
ggctcacggcaacctccgcctc

SEQ ID NO: 676937 - DNA, 22 bp, Artificial Sequence
  chemically synthesized
catcctggggaggcggaggttg

SEQ ID NO: 676938 - DNA, 22 bp, Artificial Sequence
  chemically synthesized
atcctggggaggcggaggttgc

SEQ ID NO: 676939 - DNA, 22 bp, Artificial Sequence
  chemically synthesized
gggaggcggaggttgccgtgag

SEQ ID NO: 676940 - DNA, 22 bp, Artificial Sequence
  chemically synthesized
gaatgcagtggcacgatcttgg

SEQ ID NO: 676941 - DNA, 22 bp, Artificial Sequence
  chemically synthesized
ccgtgagccaagatcgtgccac

SEQ ID NO: 676942 - DNA, 22 bp, Artificial Sequence
  chemically synthesized
tcacccaggctggaatgcagtg

SEQ ID NO: 676943 - DNA, 22 bp, Artificial Sequence
  chemically synthesized
tgtcacccaggctggaatgcag

SEQ ID NO: 676944 - DNA, 22 bp, Artificial Sequence
  chemically synthesized
actctgtcacccaggctggaat

SEQ ID NO: 676945 - DNA, 22 bp, Artificial Sequence
  chemically synthesized
tcactctgtcacccaggctgga

SEQ ID NO: 676946 - DNA, 22 bp, Artificial Sequence
  chemically synthesized
cattccagcctgggtgacagag

SEQ ID NO: 676947 - DNA, 22 bp, Artificial Sequence
  chemically synthesized
agacagattctcactctgtcac

SEQ ID NO: 676948 - DNA, 22 bp, Artificial Sequence
  chemically synthesized
gagacagattctcactctgtca

SEQ ID NO: 676949 - DNA, 22 bp, Artificial Sequence
  chemically synthesized
tgagacagattctcactctgtc

SEQ ID NO: 676950 - DNA, 22 bp, Artificial Sequence
  chemically synthesized
ttgagacagattctcactctgt

SEQ ID NO: 676951 - DNA, 22 bp, Artificial Sequence
  chemically synthesized
cagcctgggtgacagagtgaga

SEQ ID NO: 676952 - DNA, 22 bp, Artificial Sequence
  chemically synthesized
tttgagacagattctcactctg

SEQ ID NO: 676953 - DNA, 22 bp, Artificial Sequence
  chemically synthesized
ttttttgagacagattctcact

SEQ ID NO: 676954 - DNA, 22 bp, Artificial Sequence
  chemically synthesized
gttttttgagacagattctcac

SEQ ID NO: 676955 - DNA, 22 bp, Artificial Sequence
  chemically synthesized
ggtgacagagtgagaatctgtc

SEQ ID NO: 676956 - DNA, 22 bp, Artificial Sequence
  chemically synthesized
tttgttttttgagacagattct

SEQ ID NO: 676957 - DNA, 22 bp, Artificial Sequence
  chemically synthesized
gtttgttttttgagacagattc

SEQ ID NO: 676958 - DNA, 22 bp, Artificial Sequence
  chemically synthesized
tttgtttgttttttgagacaga

SEQ ID NO: 676959 - DNA, 22 bp, Artificial Sequence
  chemically synthesized
gtttgtttgttttttgagacag

SEQ ID NO: 676960 - DNA, 22 bp, Artificial Sequence
  chemically synthesized
tgtttgtttgttttttgagaca

SEQ ID NO: 676961 - DNA, 22 bp, Artificial Sequence
  chemically synthesized
ttgtttgtttgttttttgagac

SEQ ID NO: 676962 - DNA, 22 bp, Artificial Sequence
  chemically synthesized
tttgtttgtttgttttttgaga

SEQ ID NO: 676963 - DNA, 22 bp, Artificial Sequence
  chemically synthesized
ttttgtttgtttgttttttgag

SEQ ID NO: 676964 - DNA, 22 bp, Artificial Sequence
  chemically synthesized
catccttttttgtttgtttgtt

SEQ ID NO: 676965 - DNA, 22 bp, Artificial Sequence
  chemically synthesized
tctcaaaaaacaaacaaacaaa

SEQ ID NO: 676966 - DNA, 22 bp, Artificial Sequence
  chemically synthesized
aaaaaacaaacaaacaaaaaag

SEQ ID NO: 676967 - DNA, 22 bp, Artificial Sequence
  chemically synthesized
tatggctacatccttttttgtt

SEQ ID NO: 676968 - DNA, 22 bp, Artificial Sequence
  chemically synthesized
ttatatggctacatcctttttt

SEQ ID NO: 676969 - DNA, 22 bp, Artificial Sequence
  chemically synthesized
gcacatatagaatgattgttat

SEQ ID NO: 676970 - DNA, 22 bp, Artificial Sequence
  chemically synthesized
cctggcacatatagaatgattg

SEQ ID NO: 676971 - DNA, 22 bp, Artificial Sequence
  chemically synthesized
ttgcctggcacatatagaatga

SEQ ID NO: 676972 - DNA, 22 bp, Artificial Sequence
  chemically synthesized
actgttgcctggcacatataga

SEQ ID NO: 676973 - DNA, 22 bp, Artificial Sequence
  chemically synthesized
cactgttgcctggcacatatag

SEQ ID NO: 676974 - DNA, 22 bp, Artificial Sequence
  chemically synthesized
tcactgttgcctggcacatata

SEQ ID NO: 676975 - DNA, 22 bp, Artificial Sequence
  chemically synthesized
ctttcactgttgcctggcacat

SEQ ID NO: 676976 - DNA, 22 bp, Artificial Sequence
  chemically synthesized
tatatgtgccaggcaacagtga

SEQ ID NO: 676977 - DNA, 22 bp, Artificial Sequence
  chemically synthesized
tatgtgccaggcaacagtgaaa

SEQ ID NO: 676978 - DNA, 22 bp, Artificial Sequence
  chemically synthesized
aacaatgggcactcctttcact

SEQ ID NO: 676979 - DNA, 22 bp, Artificial Sequence
  chemically synthesized
gaaatggtatggtgggtcctaa

SEQ ID NO: 676980 - DNA, 22 bp, Artificial Sequence
  chemically synthesized
tggaaatggtatggtgggtcct

SEQ ID NO: 676981 - DNA, 22 bp, Artificial Sequence
  chemically synthesized
ctggaaatggtatggtgggtcc

SEQ ID NO: 676982 - DNA, 22 bp, Artificial Sequence
  chemically synthesized
tttaggacccaccataccattt

SEQ ID NO: 676983 - DNA, 22 bp, Artificial Sequence
  chemically synthesized
agtggtatttctggaaatggta

SEQ ID NO: 676984 - DNA, 22 bp, Artificial Sequence
  chemically synthesized
aggacccaccataccatttcca

SEQ ID NO: 676985 - DNA, 22 bp, Artificial Sequence
  chemically synthesized
gagtggtatttctggaaatggt

SEQ ID NO: 676986 - DNA, 22 bp, Artificial Sequence
  chemically synthesized
ggacccaccataccatttccag

SEQ ID NO: 676987 - DNA, 22 bp, Artificial Sequence
  chemically synthesized
cttgagtggtatttctggaaat

SEQ ID NO: 676988 - DNA, 22 bp, Artificial Sequence
  chemically synthesized
tgaatagtaagttacttgagtg

SEQ ID NO: 676989 - DNA, 22 bp, Artificial Sequence
  chemically synthesized
ccagaaataccactcaagtaac

SEQ ID NO: 676990 - DNA, 22 bp, Artificial Sequence
  chemically synthesized
cagaaataccactcaagtaact

SEQ ID NO: 676991 - DNA, 22 bp, Artificial Sequence
  chemically synthesized
cctatgaatagtaagttacttg

SEQ ID NO: 676992 - DNA, 22 bp, Artificial Sequence
  chemically synthesized
acctatgaatagtaagttactt

SEQ ID NO: 676993 - DNA, 22 bp, Artificial Sequence
  chemically synthesized
tacctatgaatagtaagttact

SEQ ID NO: 676994 - DNA, 22 bp, Artificial Sequence
  chemically synthesized
atagttttacctatgaatagta

SEQ ID NO: 676995 - DNA, 22 bp, Artificial Sequence
  chemically synthesized
aagtaacttactattcataggt

SEQ ID NO: 676996 - DNA, 22 bp, Artificial Sequence
  chemically synthesized
actattcataggtaaaactatc

SEQ ID NO: 676997 - DNA, 22 bp, Artificial Sequence
  chemically synthesized
ctattcataggtaaaactatca

SEQ ID NO: 676998 - DNA, 22 bp, Artificial Sequence
  chemically synthesized
ttcataggtaaaactatcaatt

SEQ ID NO: 676999 - DNA, 22 bp, Artificial Sequence
  chemically synthesized
cacgtatataggaattgatagt

SEQ ID NO: 677000 - DNA, 22 bp, Artificial Sequence
  chemically synthesized
ataggtaaaactatcaattcct

SEQ ID NO: 677001 - DNA, 22 bp, Artificial Sequence
  chemically synthesized
ctacacgtatataggaattgat

SEQ ID NO: 677002 - DNA, 22 bp, Artificial Sequence
  chemically synthesized
catacctgctacacgtatatag

SEQ ID NO: 677003 - DNA, 22 bp, Artificial Sequence
  chemically synthesized
ctacatacctgctacacgtata

SEQ ID NO: 677004 - DNA, 22 bp, Artificial Sequence
  chemically synthesized
tcaattcctatatacgtgtagc

SEQ ID NO: 677005 - DNA, 22 bp, Artificial Sequence
  chemically synthesized
gttactacatacctgctacacg

SEQ ID NO: 677006 - DNA, 22 bp, Artificial Sequence
  chemically synthesized
ctatatacgtgtagcaggtatg

SEQ ID NO: 677007 - DNA, 22 bp, Artificial Sequence
  chemically synthesized
tgttggttactacatacctgct

SEQ ID NO: 677008 - DNA, 22 bp, Artificial Sequence
  chemically synthesized
atgttggttactacatacctgc

SEQ ID NO: 677009 - DNA, 22 bp, Artificial Sequence
  chemically synthesized
tatacgtgtagcaggtatgtag

SEQ ID NO: 677010 - DNA, 22 bp, Artificial Sequence
  chemically synthesized
ggtaaagtatatttatgttggt

SEQ ID NO: 677011 - DNA, 22 bp, Artificial Sequence
  chemically synthesized
ctaggtaaagtatatttatgtt

SEQ ID NO: 677012 - DNA, 22 bp, Artificial Sequence
  chemically synthesized
actaggtaaagtatatttatgt

SEQ ID NO: 677013 - DNA, 22 bp, Artificial Sequence
  chemically synthesized
tttactaggtaaagtatattta

SEQ ID NO: 677014 - DNA, 22 bp, Artificial Sequence
  chemically synthesized
atttactaggtaaagtatattt

SEQ ID NO: 677015 - DNA, 22 bp, Artificial Sequence
  chemically synthesized
tatttactaggtaaagtatatt

SEQ ID NO: 677016 - DNA, 22 bp, Artificial Sequence
  chemically synthesized
attttatttactaggtaaagta

SEQ ID NO: 677017 - DNA, 22 bp, Artificial Sequence
  chemically synthesized
attgattttatttactaggtaa

SEQ ID NO: 677018 - DNA, 22 bp, Artificial Sequence
  chemically synthesized
tcattgattttatttactaggt

SEQ ID NO: 677019 - DNA, 22 bp, Artificial Sequence
  chemically synthesized
ttctcattgattttatttacta

SEQ ID NO: 677020 - DNA, 22 bp, Artificial Sequence
  chemically synthesized
actgttctcattgattttattt

SEQ ID NO: 677021 - DNA, 22 bp, Artificial Sequence
  chemically synthesized
cactgttctcattgattttatt

SEQ ID NO: 677022 - DNA, 22 bp, Artificial Sequence
  chemically synthesized
tcactgttctcattgattttat

SEQ ID NO: 677023 - DNA, 22 bp, Artificial Sequence
  chemically synthesized
tacctagtaaataaaatcaatg

SEQ ID NO: 677024 - DNA, 22 bp, Artificial Sequence
  chemically synthesized
acctagtaaataaaatcaatga

SEQ ID NO: 677025 - DNA, 22 bp, Artificial Sequence
  chemically synthesized
cctagtaaataaaatcaatgag

SEQ ID NO: 677026 - DNA, 22 bp, Artificial Sequence
  chemically synthesized
gtactttcactgttctcattga

SEQ ID NO: 677027 - DNA, 22 bp, Artificial Sequence
  chemically synthesized
gtaaataaaatcaatgagaaca

SEQ ID NO: 677028 - DNA, 22 bp, Artificial Sequence
  chemically synthesized
ttagtactttcactgttctcat

SEQ ID NO: 677029 - DNA, 22 bp, Artificial Sequence
  chemically synthesized
tgttagtactttcactgttctc

SEQ ID NO: 677030 - DNA, 22 bp, Artificial Sequence
  chemically synthesized
ctgttagtactttcactgttct

SEQ ID NO: 677031 - DNA, 22 bp, Artificial Sequence
  chemically synthesized
tctgttagtactttcactgttc

SEQ ID NO: 677032 - DNA, 22 bp, Artificial Sequence
  chemically synthesized
agttttctgttagtactttcac

SEQ ID NO: 677033 - DNA, 22 bp, Artificial Sequence
  chemically synthesized
tcctcagttttctgttagtact

SEQ ID NO: 677034 - DNA, 22 bp, Artificial Sequence
  chemically synthesized
gtcctcagttttctgttagtac

SEQ ID NO: 677035 - DNA, 22 bp, Artificial Sequence
  chemically synthesized
gatttgtcctcagttttctgtt

SEQ ID NO: 677036 - DNA, 22 bp, Artificial Sequence
  chemically synthesized
cacctggatttgtcctcagttt

SEQ ID NO: 677037 - DNA, 22 bp, Artificial Sequence
  chemically synthesized
acagaaaactgaggacaaatcc

SEQ ID NO: 677038 - DNA, 22 bp, Artificial Sequence
  chemically synthesized
tgtggggctacacctggatttg

SEQ ID NO: 677039 - DNA, 22 bp, Artificial Sequence
  chemically synthesized
aggacaaatccaggtgtagccc

SEQ ID NO: 677040 - DNA, 22 bp, Artificial Sequence
  chemically synthesized
cacagctatgtggggctacacc

SEQ ID NO: 677041 - DNA, 22 bp, Artificial Sequence
  chemically synthesized
atcagggctacacagctatgtg

SEQ ID NO: 677042 - DNA, 22 bp, Artificial Sequence
  chemically synthesized
agggaggaattgatcagggcta

SEQ ID NO: 677043 - DNA, 22 bp, Artificial Sequence
  chemically synthesized
tgtagccctgatcaattcctcc

SEQ ID NO: 677044 - DNA, 22 bp, Artificial Sequence
  chemically synthesized
atcaattcctccctgagcctgg

SEQ ID NO: 677045 - DNA, 22 bp, Artificial Sequence
  chemically synthesized
acaggacagcgaagccaggctc

SEQ ID NO: 677046 - DNA, 22 bp, Artificial Sequence
  chemically synthesized
cacaggacagcgaagccaggct

SEQ ID NO: 677047 - DNA, 22 bp, Artificial Sequence
  chemically synthesized
ctccctgagcctggcttcgctg

SEQ ID NO: 677048 - DNA, 22 bp, Artificial Sequence
  chemically synthesized
cctgagcctggcttcgctgtcc

SEQ ID NO: 677049 - DNA, 22 bp, Artificial Sequence
  chemically synthesized
agcctggcttcgctgtcctgtg

SEQ ID NO: 677050 - DNA, 22 bp, Artificial Sequence
  chemically synthesized
gcttcgctgtcctgtgaaatgt

SEQ ID NO: 677051 - DNA, 22 bp, Artificial Sequence
  chemically synthesized
cgctgtcctgtgaaatgtggat

SEQ ID NO: 677052 - DNA, 22 bp, Artificial Sequence
  chemically synthesized
gctgtcctgtgaaatgtggatg

SEQ ID NO: 677053 - DNA, 22 bp, Artificial Sequence
  chemically synthesized
tcctgtgaaatgtggatgttga

SEQ ID NO: 677054 - DNA, 22 bp, Artificial Sequence
  chemically synthesized
catggtggatggtatcaacatc

SEQ ID NO: 677055 - DNA, 22 bp, Artificial Sequence
  chemically synthesized
tgaaatgtggatgttgatacca

SEQ ID NO: 677056 - DNA, 22 bp, Artificial Sequence
  chemically synthesized
ataccatccaccatgcaggttg

SEQ ID NO: 677057 - DNA, 22 bp, Artificial Sequence
  chemically synthesized
cacatgggatgtgccagcaacc

SEQ ID NO: 677058 - DNA, 22 bp, Artificial Sequence
  chemically synthesized
ccacatgggatgtgccagcaac

SEQ ID NO: 677059 - DNA, 22 bp, Artificial Sequence
  chemically synthesized
tccacatgggatgtgccagcaa

SEQ ID NO: 677060 - DNA, 22 bp, Artificial Sequence
  chemically synthesized
tatgttttccacatgggatgtg

SEQ ID NO: 677061 - DNA, 22 bp, Artificial Sequence
  chemically synthesized
ttgtatgttttccacatgggat

SEQ ID NO: 677062 - DNA, 22 bp, Artificial Sequence
  chemically synthesized
gttgctggcacatcccatgtgg

SEQ ID NO: 677063 - DNA, 22 bp, Artificial Sequence
  chemically synthesized
ctggcacatcccatgtggaaaa

SEQ ID NO: 677064 - DNA, 22 bp, Artificial Sequence
  chemically synthesized
gcacatcccatgtggaaaacat

SEQ ID NO: 677065 - DNA, 22 bp, Artificial Sequence
  chemically synthesized
cgggcctattgtatgttttcca

SEQ ID NO: 677066 - DNA, 22 bp, Artificial Sequence
  chemically synthesized
ttgcgggcctattgtatgtttt

SEQ ID NO: 677067 - DNA, 22 bp, Artificial Sequence
  chemically synthesized
attgcgggcctattgtatgttt

SEQ ID NO: 677068 - DNA, 22 bp, Artificial Sequence
  chemically synthesized
ccatttattgcgggcctattgt

SEQ ID NO: 677069 - DNA, 22 bp, Artificial Sequence
  chemically synthesized
atcagataacatctcccattta

SEQ ID NO: 677070 - DNA, 22 bp, Artificial Sequence
  chemically synthesized
tccaagtggtgattcatcagat

SEQ ID NO: 677071 - DNA, 22 bp, Artificial Sequence
  chemically synthesized
atccaagtggtgattcatcaga

SEQ ID NO: 677072 - DNA, 22 bp, Artificial Sequence
  chemically synthesized
tatccaagtggtgattcatcag

SEQ ID NO: 677073 - DNA, 22 bp, Artificial Sequence
  chemically synthesized
ttatccaagtggtgattcatca

SEQ ID NO: 677074 - DNA, 22 bp, Artificial Sequence
  chemically synthesized
ggcttttatccaagtggtgatt

SEQ ID NO: 677075 - DNA, 22 bp, Artificial Sequence
  chemically synthesized
gttgggcttttatccaagtggt

SEQ ID NO: 677076 - DNA, 22 bp, Artificial Sequence
  chemically synthesized
tctgatgaatcaccacttggat

SEQ ID NO: 677077 - DNA, 22 bp, Artificial Sequence
  chemically synthesized
atgaatcaccacttggataaaa

SEQ ID NO: 677078 - DNA, 22 bp, Artificial Sequence
  chemically synthesized
taacaatcaaacattcgttggg

SEQ ID NO: 677079 - DNA, 22 bp, Artificial Sequence
  chemically synthesized
gtaacaatcaaacattcgttgg

SEQ ID NO: 677080 - DNA, 22 bp, Artificial Sequence
  chemically synthesized
tgtaacaatcaaacattcgttg

SEQ ID NO: 677081 - DNA, 22 bp, Artificial Sequence
  chemically synthesized
ggataaaagcccaacgaatgtt

SEQ ID NO: 677082 - DNA, 22 bp, Artificial Sequence
  chemically synthesized
gataaaagcccaacgaatgttt

SEQ ID NO: 677083 - DNA, 22 bp, Artificial Sequence
  chemically synthesized
caatagttttgtaacaatcaaa

SEQ ID NO: 677084 - DNA, 22 bp, Artificial Sequence
  chemically synthesized
ccaatagttttgtaacaatcaa

SEQ ID NO: 677085 - DNA, 22 bp, Artificial Sequence
  chemically synthesized
atatttccaatagttttgtaac

SEQ ID NO: 677086 - DNA, 22 bp, Artificial Sequence
  chemically synthesized
agagttaatatttccaatagtt

SEQ ID NO: 677087 - DNA, 22 bp, Artificial Sequence
  chemically synthesized
gattgttacaaaactattggaa

SEQ ID NO: 677088 - DNA, 22 bp, Artificial Sequence
  chemically synthesized
cagagttaatatttccaatagt

SEQ ID NO: 677089 - DNA, 22 bp, Artificial Sequence
  chemically synthesized
attgttacaaaactattggaaa

SEQ ID NO: 677090 - DNA, 22 bp, Artificial Sequence
  chemically synthesized
tcagagttaatatttccaatag

SEQ ID NO: 677091 - DNA, 22 bp, Artificial Sequence
  chemically synthesized
ttacaaaactattggaaatatt

SEQ ID NO: 677092 - DNA, 22 bp, Artificial Sequence
  chemically synthesized
acctttcagagttaatatttcc

SEQ ID NO: 677093 - DNA, 22 bp, Artificial Sequence
  chemically synthesized
cacctttcagagttaatatttc

SEQ ID NO: 677094 - DNA, 22 bp, Artificial Sequence
  chemically synthesized
caaaactattggaaatattaac

SEQ ID NO: 677095 - DNA, 22 bp, Artificial Sequence
  chemically synthesized
tcacctttcagagttaatattt

SEQ ID NO: 677096 - DNA, 22 bp, Artificial Sequence
  chemically synthesized
ttcacctttcagagttaatatt

SEQ ID NO: 677097 - DNA, 22 bp, Artificial Sequence
  chemically synthesized
cttttcacctttcagagttaat

SEQ ID NO: 677098 - DNA, 22 bp, Artificial Sequence
  chemically synthesized
gcttttcacctttcagagttaa

SEQ ID NO: 677099 - DNA, 22 bp, Artificial Sequence
  chemically synthesized
ttggaaatattaactctgaaag

SEQ ID NO: 677100 - DNA, 22 bp, Artificial Sequence
  chemically synthesized
gaaatattaactctgaaaggtg

SEQ ID NO: 677101 - DNA, 22 bp, Artificial Sequence
  chemically synthesized
aagtttgcttttcacctttcag

SEQ ID NO: 677102 - DNA, 22 bp, Artificial Sequence
  chemically synthesized
agtgttgaagtttgcttttcac

SEQ ID NO: 677103 - DNA, 22 bp, Artificial Sequence
  chemically synthesized
actctgaaaggtgaaaagcaaa

SEQ ID NO: 677104 - DNA, 22 bp, Artificial Sequence
  chemically synthesized
tgaaaggtgaaaagcaaacttc

SEQ ID NO: 677105 - DNA, 22 bp, Artificial Sequence
  chemically synthesized
aaaggtgaaaagcaaacttcaa

SEQ ID NO: 677106 - DNA, 22 bp, Artificial Sequence
  chemically synthesized
caagtgaactaagtgttgaagt

SEQ ID NO: 677107 - DNA, 22 bp, Artificial Sequence
  chemically synthesized
gcaagtgaactaagtgttgaag

SEQ ID NO: 677108 - DNA, 22 bp, Artificial Sequence
  chemically synthesized
caacacttagttcacttgcaag

SEQ ID NO: 677109 - DNA, 22 bp, Artificial Sequence
  chemically synthesized
aacacttagttcacttgcaagt

SEQ ID NO: 677110 - DNA, 22 bp, Artificial Sequence
  chemically synthesized
gcccaataacaaaccacttgca

SEQ ID NO: 677111 - DNA, 22 bp, Artificial Sequence
  chemically synthesized
ctagcccaataacaaaccactt

SEQ ID NO: 677112 - DNA, 22 bp, Artificial Sequence
  chemically synthesized
agttcacttgcaagtggtttgt

SEQ ID NO: 677113 - DNA, 22 bp, Artificial Sequence
  chemically synthesized
gctagcccaataacaaaccact

SEQ ID NO: 677114 - DNA, 22 bp, Artificial Sequence
  chemically synthesized
gttcacttgcaagtggtttgtt

SEQ ID NO: 677115 - DNA, 22 bp, Artificial Sequence
  chemically synthesized
ttgctagcccaataacaaacca

SEQ ID NO: 677116 - DNA, 22 bp, Artificial Sequence
  chemically synthesized
cttgctagcccaataacaaacc

SEQ ID NO: 677117 - DNA, 22 bp, Artificial Sequence
  chemically synthesized
acttgcaagtggtttgttattg

SEQ ID NO: 677118 - DNA, 22 bp, Artificial Sequence
  chemically synthesized
tttcttgctagcccaataacaa

SEQ ID NO: 677119 - DNA, 22 bp, Artificial Sequence
  chemically synthesized
tgtttcttgctagcccaataac

SEQ ID NO: 677120 - DNA, 22 bp, Artificial Sequence
  chemically synthesized
gcaagtggtttgttattgggct

SEQ ID NO: 677121 - DNA, 22 bp, Artificial Sequence
  chemically synthesized
caagtggtttgttattgggcta

SEQ ID NO: 677122 - DNA, 22 bp, Artificial Sequence
  chemically synthesized
aaattctgtttcttgctagccc

SEQ ID NO: 677123 - DNA, 22 bp, Artificial Sequence
  chemically synthesized
gaaattctgtttcttgctagcc

SEQ ID NO: 677124 - DNA, 22 bp, Artificial Sequence
  chemically synthesized
tgaaattctgtttcttgctagc

SEQ ID NO: 677125 - DNA, 22 bp, Artificial Sequence
  chemically synthesized
gttattgggctagcaagaaaca

SEQ ID NO: 677126 - DNA, 22 bp, Artificial Sequence
  chemically synthesized
ttattgggctagcaagaaacag

SEQ ID NO: 677127 - DNA, 22 bp, Artificial Sequence
  chemically synthesized
ttgggctagcaagaaacagaat

SEQ ID NO: 677128 - DNA, 22 bp, Artificial Sequence
  chemically synthesized
cagccccctttgaaattctgtt

SEQ ID NO: 677129 - DNA, 22 bp, Artificial Sequence
  chemically synthesized
ggctagcaagaaacagaatttc

SEQ ID NO: 677130 - DNA, 22 bp, Artificial Sequence
  chemically synthesized
gcaagaaacagaatttcaaagg

SEQ ID NO: 677131 - DNA, 22 bp, Artificial Sequence
  chemically synthesized
caaagggggctggaattgatca

SEQ ID NO: 677132 - DNA, 22 bp, Artificial Sequence
  chemically synthesized
aaagggggctggaattgatcac

SEQ ID NO: 677133 - DNA, 22 bp, Artificial Sequence
  chemically synthesized
gaattgatcacacacttacgat

SEQ ID NO: 677134 - DNA, 22 bp, Artificial Sequence
  chemically synthesized
tataataaaaggaagtcatcgt

SEQ ID NO: 677135 - DNA, 22 bp, Artificial Sequence
  chemically synthesized
atcacacacttacgatgacttc

SEQ ID NO: 677136 - DNA, 22 bp, Artificial Sequence
  chemically synthesized
atataataaaaggaagtcatcg

SEQ ID NO: 677137 - DNA, 22 bp, Artificial Sequence
  chemically synthesized
tatataataaaaggaagtcatc

SEQ ID NO: 677138 - DNA, 22 bp, Artificial Sequence
  chemically synthesized
ttatataataaaaggaagtcat

SEQ ID NO: 677139 - DNA, 22 bp, Artificial Sequence
  chemically synthesized
acgatgacttccttttattata

SEQ ID NO: 677140 - DNA, 22 bp, Artificial Sequence
  chemically synthesized
cgatgacttccttttattatat

SEQ ID NO: 677141 - DNA, 22 bp, Artificial Sequence
  chemically synthesized
aggtataatttttatataataa

SEQ ID NO: 677142 - DNA, 22 bp, Artificial Sequence
  chemically synthesized
caggtataatttttatataata

SEQ ID NO: 677143 - DNA, 22 bp, Artificial Sequence
  chemically synthesized
tcaggtataatttttatataat

SEQ ID NO: 677144 - DNA, 22 bp, Artificial Sequence
  chemically synthesized
ccttttattatataaaaattat

SEQ ID NO: 677145 - DNA, 22 bp, Artificial Sequence
  chemically synthesized
cttttattatataaaaattata

SEQ ID NO: 677146 - DNA, 22 bp, Artificial Sequence
  chemically synthesized
ttattatataaaaattatacct

SEQ ID NO: 677147 - DNA, 22 bp, Artificial Sequence
  chemically synthesized
tattatataaaaattatacctg

SEQ ID NO: 677148 - DNA, 22 bp, Artificial Sequence
  chemically synthesized
attatataaaaattatacctga

SEQ ID NO: 677149 - DNA, 22 bp, Artificial Sequence
  chemically synthesized
tgaaatcaactttcaggtataa

SEQ ID NO: 677150 - DNA, 22 bp, Artificial Sequence
  chemically synthesized
ttatataaaaattatacctgaa

SEQ ID NO: 677151 - DNA, 22 bp, Artificial Sequence
  chemically synthesized
atgaaatcaactttcaggtata

SEQ ID NO: 677152 - DNA, 22 bp, Artificial Sequence
  chemically synthesized
tatgaaatcaactttcaggtat

SEQ ID NO: 677153 - DNA, 22 bp, Artificial Sequence
  chemically synthesized
ttatgaaatcaactttcaggta

SEQ ID NO: 677154 - DNA, 22 bp, Artificial Sequence
  chemically synthesized
tataaaaattatacctgaaagt

SEQ ID NO: 677155 - DNA, 22 bp, Artificial Sequence
  chemically synthesized
ttttatgaaatcaactttcagg

SEQ ID NO: 677156 - DNA, 22 bp, Artificial Sequence
  chemically synthesized
tcttttatgaaatcaactttca

SEQ ID NO: 677157 - DNA, 22 bp, Artificial Sequence
  chemically synthesized
ctcttttatgaaatcaactttc

SEQ ID NO: 677158 - DNA, 22 bp, Artificial Sequence
  chemically synthesized
tctcttttatgaaatcaacttt

SEQ ID NO: 677159 - DNA, 22 bp, Artificial Sequence
  chemically synthesized
tacctgaaagttgatttcataa

SEQ ID NO: 677160 - DNA, 22 bp, Artificial Sequence
  chemically synthesized
caaactttctcttttatgaaat

SEQ ID NO: 677161 - DNA, 22 bp, Artificial Sequence
  chemically synthesized
ttgcaaactttctcttttatga

SEQ ID NO: 677162 - DNA, 22 bp, Artificial Sequence
  chemically synthesized
attgcaaactttctcttttatg

SEQ ID NO: 677163 - DNA, 22 bp, Artificial Sequence
  chemically synthesized
aaagttgatttcataaaagaga

SEQ ID NO: 677164 - DNA, 22 bp, Artificial Sequence
  chemically synthesized
atttattgcaaactttctcttt

SEQ ID NO: 677165 - DNA, 22 bp, Artificial Sequence
  chemically synthesized
atttcataaaagagaaagtttg

SEQ ID NO: 677166 - DNA, 22 bp, Artificial Sequence
  chemically synthesized
gaactcatttattgcaaacttt

SEQ ID NO: 677167 - DNA, 22 bp, Artificial Sequence
  chemically synthesized
agaactcatttattgcaaactt

SEQ ID NO: 677168 - DNA, 22 bp, Artificial Sequence
  chemically synthesized
cataaaagagaaagtttgcaat

SEQ ID NO: 677169 - DNA, 22 bp, Artificial Sequence
  chemically synthesized
tagaactcatttattgcaaact

SEQ ID NO: 677170 - DNA, 22 bp, Artificial Sequence
  chemically synthesized
ataaaagagaaagtttgcaata

SEQ ID NO: 677171 - DNA, 22 bp, Artificial Sequence
  chemically synthesized
caggggattttagaactcattt

SEQ ID NO: 677172 - DNA, 22 bp, Artificial Sequence
  chemically synthesized
cagttgcaggggattttagaac

SEQ ID NO: 677173 - DNA, 22 bp, Artificial Sequence
  chemically synthesized
gcaataaatgagttctaaaatc

SEQ ID NO: 677174 - DNA, 22 bp, Artificial Sequence
  chemically synthesized
acagttgcaggggattttagaa

SEQ ID NO: 677175 - DNA, 22 bp, Artificial Sequence
  chemically synthesized
caataaatgagttctaaaatcc

SEQ ID NO: 677176 - DNA, 22 bp, Artificial Sequence
  chemically synthesized
tacagttgcaggggattttaga

SEQ ID NO: 677177 - DNA, 22 bp, Artificial Sequence
  chemically synthesized
taacagaattttacagttgcag

SEQ ID NO: 677178 - DNA, 22 bp, Artificial Sequence
  chemically synthesized
taaaatcccctgcaactgtaaa

SEQ ID NO: 677179 - DNA, 22 bp, Artificial Sequence
  chemically synthesized
aaatcccctgcaactgtaaaat

SEQ ID NO: 677180 - DNA, 22 bp, Artificial Sequence
  chemically synthesized
aattataacagaattttacagt

SEQ ID NO: 677181 - DNA, 22 bp, Artificial Sequence
  chemically synthesized
gaattataacagaattttacag

SEQ ID NO: 677182 - DNA, 22 bp, Artificial Sequence
  chemically synthesized
tgaattataacagaattttaca

SEQ ID NO: 677183 - DNA, 22 bp, Artificial Sequence
  chemically synthesized
aattttgaattataacagaatt

SEQ ID NO: 677184 - DNA, 22 bp, Artificial Sequence
  chemically synthesized
caactgtaaaattctgttataa

SEQ ID NO: 677185 - DNA, 22 bp, Artificial Sequence
  chemically synthesized
taaaattctgttataattcaaa

SEQ ID NO: 677186 - DNA, 22 bp, Artificial Sequence
  chemically synthesized
tgacatcactcaattttgaatt

SEQ ID NO: 677187 - DNA, 22 bp, Artificial Sequence
  chemically synthesized
gtgacatcactcaattttgaat

SEQ ID NO: 677188 - DNA, 22 bp, Artificial Sequence
  chemically synthesized
tgttataattcaaaattgagtg

SEQ ID NO: 677189 - DNA, 22 bp, Artificial Sequence
  chemically synthesized
ggcttgtgacatcactcaattt

SEQ ID NO: 677190 - DNA, 22 bp, Artificial Sequence
  chemically synthesized
ttataattcaaaattgagtgat

SEQ ID NO: 677191 - DNA, 22 bp, Artificial Sequence
  chemically synthesized
taattcaaaattgagtgatgtc

SEQ ID NO: 677192 - DNA, 22 bp, Artificial Sequence
  chemically synthesized
tgacattgggcttgtgacatca

SEQ ID NO: 677193 - DNA, 22 bp, Artificial Sequence
  chemically synthesized
gtgacattgggcttgtgacatc

SEQ ID NO: 677194 - DNA, 22 bp, Artificial Sequence
  chemically synthesized
aaaattgagtgatgtcacaagc

SEQ ID NO: 677195 - DNA, 22 bp, Artificial Sequence
  chemically synthesized
atgacttgtgacattgggcttg

SEQ ID NO: 677196 - DNA, 22 bp, Artificial Sequence
  chemically synthesized
agtgatgtcacaagcccaatgt

SEQ ID NO: 677197 - DNA, 22 bp, Artificial Sequence
  chemically synthesized
tcatgacttgtgacattgggct

SEQ ID NO: 677198 - DNA, 22 bp, Artificial Sequence
  chemically synthesized
ataatctctcatgacttgtgac

SEQ ID NO: 677199 - DNA, 22 bp, Artificial Sequence
  chemically synthesized
aaaactgataatctctcatgac

SEQ ID NO: 677200 - DNA, 22 bp, Artificial Sequence
  chemically synthesized
gatgtggtgataaactcaaaac

SEQ ID NO: 677201 - DNA, 22 bp, Artificial Sequence
  chemically synthesized
agatgtggtgataaactcaaaa

SEQ ID NO: 677202 - DNA, 22 bp, Artificial Sequence
  chemically synthesized
tagatgtggtgataaactcaaa

SEQ ID NO: 677203 - DNA, 22 bp, Artificial Sequence
  chemically synthesized
tcagttttgagtttatcaccac

SEQ ID NO: 677204 - DNA, 22 bp, Artificial Sequence
  chemically synthesized
catactttagatgtggtgataa

SEQ ID NO: 677205 - DNA, 22 bp, Artificial Sequence
  chemically synthesized
tccatactttagatgtggtgat

SEQ ID NO: 677206 - DNA, 22 bp, Artificial Sequence
  chemically synthesized
ctccatactttagatgtggtga

SEQ ID NO: 677207 - DNA, 22 bp, Artificial Sequence
  chemically synthesized
tctccatactttagatgtggtg

SEQ ID NO: 677208 - DNA, 22 bp, Artificial Sequence
  chemically synthesized
tgagtttatcaccacatctaaa

SEQ ID NO: 677209 - DNA, 22 bp, Artificial Sequence
  chemically synthesized
gagtttatcaccacatctaaag

SEQ ID NO: 677210 - DNA, 22 bp, Artificial Sequence
  chemically synthesized
agtttatcaccacatctaaagt

SEQ ID NO: 677211 - DNA, 22 bp, Artificial Sequence
  chemically synthesized
aaattttctccatactttagat

SEQ ID NO: 677212 - DNA, 22 bp, Artificial Sequence
  chemically synthesized
taaaattttctccatactttag

SEQ ID NO: 677213 - DNA, 22 bp, Artificial Sequence
  chemically synthesized
ctaaaattttctccatacttta

SEQ ID NO: 677214 - DNA, 22 bp, Artificial Sequence
  chemically synthesized
atcaccacatctaaagtatgga

SEQ ID NO: 677215 - DNA, 22 bp, Artificial Sequence
  chemically synthesized
tcaccacatctaaagtatggag

SEQ ID NO: 677216 - DNA, 22 bp, Artificial Sequence
  chemically synthesized
tatttctaaaattttctccata

SEQ ID NO: 677217 - DNA, 22 bp, Artificial Sequence
  chemically synthesized
atcattatatttctaaaatttt

SEQ ID NO: 677218 - DNA, 22 bp, Artificial Sequence
  chemically synthesized
aatcattatatttctaaaattt

SEQ ID NO: 677219 - DNA, 22 bp, Artificial Sequence
  chemically synthesized
aagtatggagaaaattttagaa

SEQ ID NO: 677220 - DNA, 22 bp, Artificial Sequence
  chemically synthesized
aatatacatttaatcattatat

SEQ ID NO: 677221 - DNA, 22 bp, Artificial Sequence
  chemically synthesized
tagaaatataatgattaaatgt

SEQ ID NO: 677222 - DNA, 22 bp, Artificial Sequence
  chemically synthesized
agaaatataatgattaaatgta

SEQ ID NO: 677223 - DNA, 22 bp, Artificial Sequence
  chemically synthesized
gaaatataatgattaaatgtat

SEQ ID NO: 677224 - DNA, 22 bp, Artificial Sequence
  chemically synthesized
atacaaattaaatatacattta

SEQ ID NO: 677225 - DNA, 22 bp, Artificial Sequence
  chemically synthesized
aatacaaattaaatatacattt

SEQ ID NO: 677226 - DNA, 22 bp, Artificial Sequence
  chemically synthesized
taatacaaattaaatatacatt

SEQ ID NO: 677227 - DNA, 22 bp, Artificial Sequence
  chemically synthesized
ctttaatacaaattaaatatac

SEQ ID NO: 677228 - DNA, 22 bp, Artificial Sequence
  chemically synthesized
ctcctttaatacaaattaaata

SEQ ID NO: 677229 - DNA, 22 bp, Artificial Sequence
  chemically synthesized
gctcctttaatacaaattaaat

SEQ ID NO: 677230 - DNA, 22 bp, Artificial Sequence
  chemically synthesized
aatgtatatttaatttgtatta

SEQ ID NO: 677231 - DNA, 22 bp, Artificial Sequence
  chemically synthesized
aatttgtattaaaggagcaaac

SEQ ID NO: 677232 - DNA, 22 bp, Artificial Sequence
  chemically synthesized
atttgtattaaaggagcaaaca

SEQ ID NO: 677233 - DNA, 22 bp, Artificial Sequence
  chemically synthesized
tcaatgaatacatgtttgctcc

SEQ ID NO: 677234 - DNA, 22 bp, Artificial Sequence
  chemically synthesized
gtattaaaggagcaaacatgta

SEQ ID NO: 677235 - DNA, 22 bp, Artificial Sequence
  chemically synthesized
tattaaaggagcaaacatgtat

SEQ ID NO: 677236 - DNA, 22 bp, Artificial Sequence
  chemically synthesized
tggactatcaatgaatacatgt

SEQ ID NO: 677237 - DNA, 22 bp, Artificial Sequence
  chemically synthesized
aaggagcaaacatgtattcatt

SEQ ID NO: 677238 - DNA, 22 bp, Artificial Sequence
  chemically synthesized
attatggactatcaatgaatac

SEQ ID NO: 677239 - DNA, 22 bp, Artificial Sequence
  chemically synthesized
atgaaaagctaattatggacta

SEQ ID NO: 677240 - DNA, 22 bp, Artificial Sequence
  chemically synthesized
gatgaaaagctaattatggact

SEQ ID NO: 677241 - DNA, 22 bp, Artificial Sequence
  chemically synthesized
attgatagtccataattagctt

SEQ ID NO: 677242 - DNA, 22 bp, Artificial Sequence
  chemically synthesized
atagtccataattagcttttca

SEQ ID NO: 677243 - DNA, 22 bp, Artificial Sequence
  chemically synthesized
caaacatgtttgatgaaaagct

SEQ ID NO: 677244 - DNA, 22 bp, Artificial Sequence
  chemically synthesized
gcttttcatcaaacatgtttgc

SEQ ID NO: 677245 - DNA, 22 bp, Artificial Sequence
  chemically synthesized
taatgagaaattgcaaacatgt

SEQ ID NO: 677246 - DNA, 22 bp, Artificial Sequence
  chemically synthesized
tgtaatgagaaattgcaaacat

SEQ ID NO: 677247 - DNA, 22 bp, Artificial Sequence
  chemically synthesized
ttcatcaaacatgtttgcaatt

SEQ ID NO: 677248 - DNA, 22 bp, Artificial Sequence
  chemically synthesized
tcatcaaacatgtttgcaattt

SEQ ID NO: 677249 - DNA, 22 bp, Artificial Sequence
  chemically synthesized
ctctgtaatgagaaattgcaaa

SEQ ID NO: 677250 - DNA, 22 bp, Artificial Sequence
  chemically synthesized
catcaaacatgtttgcaatttc

SEQ ID NO: 677251 - DNA, 22 bp, Artificial Sequence
  chemically synthesized
atcaaacatgtttgcaatttct

SEQ ID NO: 677252 - DNA, 22 bp, Artificial Sequence
  chemically synthesized
aattactctgtaatgagaaatt

SEQ ID NO: 677253 - DNA, 22 bp, Artificial Sequence
  chemically synthesized
caattactctgtaatgagaaat

SEQ ID NO: 677254 - DNA, 22 bp, Artificial Sequence
  chemically synthesized
tcaattactctgtaatgagaaa

SEQ ID NO: 677255 - DNA, 22 bp, Artificial Sequence
  chemically synthesized
ccactttcaattactctgtaat

SEQ ID NO: 677256 - DNA, 22 bp, Artificial Sequence
  chemically synthesized
gcaatttctcattacagagtaa

SEQ ID NO: 677257 - DNA, 22 bp, Artificial Sequence
  chemically synthesized
taccactttcaattactctgta

SEQ ID NO: 677258 - DNA, 22 bp, Artificial Sequence
  chemically synthesized
caatttctcattacagagtaat

SEQ ID NO: 677259 - DNA, 22 bp, Artificial Sequence
  chemically synthesized
tctaccactttcaattactctg

SEQ ID NO: 677260 - DNA, 22 bp, Artificial Sequence
  chemically synthesized
ctcattacagagtaattgaaag

SEQ ID NO: 677261 - DNA, 22 bp, Artificial Sequence
  chemically synthesized
tcattacagagtaattgaaagt

SEQ ID NO: 677262 - DNA, 22 bp, Artificial Sequence
  chemically synthesized
attacagagtaattgaaagtgg

SEQ ID NO: 677263 - DNA, 22 bp, Artificial Sequence
  chemically synthesized
tatagtattctctaccactttc

SEQ ID NO: 677264 - DNA, 22 bp, Artificial Sequence
  chemically synthesized
cagagtaattgaaagtggtaga

SEQ ID NO: 677265 - DNA, 22 bp, Artificial Sequence
  chemically synthesized
ttgtatagtattctctaccact

SEQ ID NO: 677266 - DNA, 22 bp, Artificial Sequence
  chemically synthesized
gttgtatagtattctctaccac

SEQ ID NO: 677267 - DNA, 22 bp, Artificial Sequence
  chemically synthesized
tgttgtatagtattctctacca

SEQ ID NO: 677268 - DNA, 22 bp, Artificial Sequence
  chemically synthesized
cattttgttgtatagtattctc

SEQ ID NO: 677269 - DNA, 22 bp, Artificial Sequence
  chemically synthesized
ccattttgttgtatagtattct

SEQ ID NO: 677270 - DNA, 22 bp, Artificial Sequence
  chemically synthesized
aaagtggtagagaatactatac

SEQ ID NO: 677271 - DNA, 22 bp, Artificial Sequence
  chemically synthesized
ccatggccatatttccattttg

SEQ ID NO: 677272 - DNA, 22 bp, Artificial Sequence
  chemically synthesized
tacaacaaaatggaaatatggc

SEQ ID NO: 677273 - DNA, 22 bp, Artificial Sequence
  chemically synthesized
gaaagtaatgtattaccatggc

SEQ ID NO: 677274 - DNA, 22 bp, Artificial Sequence
  chemically synthesized
cactggaaagtaatgtattacc

SEQ ID NO: 677275 - DNA, 22 bp, Artificial Sequence
  chemically synthesized
ccactggaaagtaatgtattac

SEQ ID NO: 677276 - DNA, 22 bp, Artificial Sequence
  chemically synthesized
tccactggaaagtaatgtatta

SEQ ID NO: 677277 - DNA, 22 bp, Artificial Sequence
  chemically synthesized
ttccactggaaagtaatgtatt

SEQ ID NO: 677278 - DNA, 22 bp, Artificial Sequence
  chemically synthesized
tttccactggaaagtaatgtat

SEQ ID NO: 677279 - DNA, 22 bp, Artificial Sequence
  chemically synthesized
ttttccactggaaagtaatgta

SEQ ID NO: 677280 - DNA, 22 bp, Artificial Sequence
  chemically synthesized
tttttccactggaaagtaatgt

SEQ ID NO: 677281 - DNA, 22 bp, Artificial Sequence
  chemically synthesized
ttttttccactggaaagtaatg

SEQ ID NO: 677282 - DNA, 22 bp, Artificial Sequence
  chemically synthesized
tttttttccactggaaagtaat

SEQ ID NO: 677283 - DNA, 22 bp, Artificial Sequence
  chemically synthesized
ttttttttccactggaaagtaa

SEQ ID NO: 677284 - DNA, 22 bp, Artificial Sequence
  chemically synthesized
tttttttttccactggaaagta

SEQ ID NO: 677285 - DNA, 22 bp, Artificial Sequence
  chemically synthesized
ctttttttttttccactggaaa

SEQ ID NO: 677286 - DNA, 22 bp, Artificial Sequence
  chemically synthesized
gctttttttttttccactggaa

SEQ ID NO: 677287 - DNA, 22 bp, Artificial Sequence
  chemically synthesized
taacttgctttttttttttcca

SEQ ID NO: 677288 - DNA, 22 bp, Artificial Sequence
  chemically synthesized
ataacttgctttttttttttcc

SEQ ID NO: 677289 - DNA, 22 bp, Artificial Sequence
  chemically synthesized
ctttccagtggaaaaaaaaaaa

SEQ ID NO: 677290 - DNA, 22 bp, Artificial Sequence
  chemically synthesized
tcttataacttgcttttttttt

SEQ ID NO: 677291 - DNA, 22 bp, Artificial Sequence
  chemically synthesized
tccagtggaaaaaaaaaaagca

SEQ ID NO: 677292 - DNA, 22 bp, Artificial Sequence
  chemically synthesized
tgtcttataacttgcttttttt

SEQ ID NO: 677293 - DNA, 22 bp, Artificial Sequence
  chemically synthesized
ccagtggaaaaaaaaaaagcaa

SEQ ID NO: 677294 - DNA, 22 bp, Artificial Sequence
  chemically synthesized
cagtggaaaaaaaaaaagcaag

SEQ ID NO: 677295 - DNA, 22 bp, Artificial Sequence
  chemically synthesized
aatcattctgtcttataacttg

SEQ ID NO: 677296 - DNA, 22 bp, Artificial Sequence
  chemically synthesized
tagaagttgaatcattctgtct

SEQ ID NO: 677297 - DNA, 22 bp, Artificial Sequence
  chemically synthesized
atagaagttgaatcattctgtc

SEQ ID NO: 677298 - DNA, 22 bp, Artificial Sequence
  chemically synthesized
tatagaagttgaatcattctgt

SEQ ID NO: 677299 - DNA, 22 bp, Artificial Sequence
  chemically synthesized
ttatagaagttgaatcattctg

SEQ ID NO: 677300 - DNA, 22 bp, Artificial Sequence
  chemically synthesized
taagacagaatgattcaacttc

SEQ ID NO: 677301 - DNA, 22 bp, Artificial Sequence
  chemically synthesized
tacatatatttttatagaagtt

SEQ ID NO: 677302 - DNA, 22 bp, Artificial Sequence
  chemically synthesized
tatacatatatttttatagaag

SEQ ID NO: 677303 - DNA, 22 bp, Artificial Sequence
  chemically synthesized
ctatacatatatttttatagaa

SEQ ID NO: 677304 - DNA, 22 bp, Artificial Sequence
  chemically synthesized
tctatacatatatttttataga

SEQ ID NO: 677305 - DNA, 22 bp, Artificial Sequence
  chemically synthesized
aacttctataaaaatatatgta

SEQ ID NO: 677306 - DNA, 22 bp, Artificial Sequence
  chemically synthesized
aaaaatgtctttctatacatat

SEQ ID NO: 677307 - DNA, 22 bp, Artificial Sequence
  chemically synthesized
caaaaatgtctttctatacata

SEQ ID NO: 677308 - DNA, 22 bp, Artificial Sequence
  chemically synthesized
ctataaaaatatatgtatagaa

SEQ ID NO: 677309 - DNA, 22 bp, Artificial Sequence
  chemically synthesized
tataaaaatatatgtatagaaa

SEQ ID NO: 677310 - DNA, 22 bp, Artificial Sequence
  chemically synthesized
taaaaatatatgtatagaaaga

SEQ ID NO: 677311 - DNA, 22 bp, Artificial Sequence
  chemically synthesized
ggatcttcaaaaatgtctttct

SEQ ID NO: 677312 - DNA, 22 bp, Artificial Sequence
  chemically synthesized
atagtctaggatcttcaaaaat

SEQ ID NO: 677313 - DNA, 22 bp, Artificial Sequence
  chemically synthesized
aatagtctaggatcttcaaaaa

SEQ ID NO: 677314 - DNA, 22 bp, Artificial Sequence
  chemically synthesized
gtgtttaatagtctaggatctt

SEQ ID NO: 677315 - DNA, 22 bp, Artificial Sequence
  chemically synthesized
gctggtgtttaatagtctagga

SEQ ID NO: 677316 - DNA, 22 bp, Artificial Sequence
  chemically synthesized
ttgaagatcctagactattaaa

SEQ ID NO: 677317 - DNA, 22 bp, Artificial Sequence
  chemically synthesized
tgaagatcctagactattaaac

SEQ ID NO: 677318 - DNA, 22 bp, Artificial Sequence
  chemically synthesized
gagttagctggtgtttaatagt

SEQ ID NO: 677319 - DNA, 22 bp, Artificial Sequence
  chemically synthesized
gaagatcctagactattaaaca

SEQ ID NO: 677320 - DNA, 22 bp, Artificial Sequence
  chemically synthesized
agagttagctggtgtttaatag

SEQ ID NO: 677321 - DNA, 22 bp, Artificial Sequence
  chemically synthesized
aagatcctagactattaaacac

SEQ ID NO: 677322 - DNA, 22 bp, Artificial Sequence
  chemically synthesized
ttagagttagctggtgtttaat

SEQ ID NO: 677323 - DNA, 22 bp, Artificial Sequence
  chemically synthesized
cttagagttagctggtgtttaa

SEQ ID NO: 677324 - DNA, 22 bp, Artificial Sequence
  chemically synthesized
gactattaaacaccagctaact

SEQ ID NO: 677325 - DNA, 22 bp, Artificial Sequence
  chemically synthesized
ttaaacaccagctaactctaag

SEQ ID NO: 677326 - DNA, 22 bp, Artificial Sequence
  chemically synthesized
gtaaccccacttcttagagtta

SEQ ID NO: 677327 - DNA, 22 bp, Artificial Sequence
  chemically synthesized
aacaccagctaactctaagaag

SEQ ID NO: 677328 - DNA, 22 bp, Artificial Sequence
  chemically synthesized
actctaagaagtggggttacga

SEQ ID NO: 677329 - DNA, 22 bp, Artificial Sequence
  chemically synthesized
taagaagtggggttacgaatga

SEQ ID NO: 677330 - DNA, 22 bp, Artificial Sequence
  chemically synthesized
agaagtggggttacgaatgatt

SEQ ID NO: 677331 - DNA, 22 bp, Artificial Sequence
  chemically synthesized
acaataaagaagagacaaatca

SEQ ID NO: 677332 - DNA, 22 bp, Artificial Sequence
  chemically synthesized
cgaatgatttgtctcttcttta

SEQ ID NO: 677333 - DNA, 22 bp, Artificial Sequence
  chemically synthesized
aaaatatagacaggctaacaat

SEQ ID NO: 677334 - DNA, 22 bp, Artificial Sequence
  chemically synthesized
gtctcttctttattgttagcct

SEQ ID NO: 677335 - DNA, 22 bp, Artificial Sequence
  chemically synthesized
aaaaatatagacaggctaacaa

SEQ ID NO: 677336 - DNA, 22 bp, Artificial Sequence
  chemically synthesized
tctcttctttattgttagcctg

SEQ ID NO: 677337 - DNA, 22 bp, Artificial Sequence
  chemically synthesized
ttctttattgttagcctgtcta

SEQ ID NO: 677338 - DNA, 22 bp, Artificial Sequence
  chemically synthesized
aagtttaaaaatatagacaggc

SEQ ID NO: 677339 - DNA, 22 bp, Artificial Sequence
  chemically synthesized
ctttattgttagcctgtctata

SEQ ID NO: 677340 - DNA, 22 bp, Artificial Sequence
  chemically synthesized
gaagtttaaaaatatagacagg

SEQ ID NO: 677341 - DNA, 22 bp, Artificial Sequence
  chemically synthesized
tttattgttagcctgtctatat

SEQ ID NO: 677342 - DNA, 22 bp, Artificial Sequence
  chemically synthesized
tgaagtttaaaaatatagacag

SEQ ID NO: 677343 - DNA, 22 bp, Artificial Sequence
  chemically synthesized
ttgaagtttaaaaatatagaca

SEQ ID NO: 677344 - DNA, 22 bp, Artificial Sequence
  chemically synthesized
tattgttagcctgtctatattt

SEQ ID NO: 677345 - DNA, 22 bp, Artificial Sequence
  chemically synthesized
attgttagcctgtctatatttt

SEQ ID NO: 677346 - DNA, 22 bp, Artificial Sequence
  chemically synthesized
ttgttagcctgtctatattttt

SEQ ID NO: 677347 - DNA, 22 bp, Artificial Sequence
  chemically synthesized
ttagcctgtctatatttttaaa

SEQ ID NO: 677348 - DNA, 22 bp, Artificial Sequence
  chemically synthesized
atatttttgaagtttaaaaata

SEQ ID NO: 677349 - DNA, 22 bp, Artificial Sequence
  chemically synthesized
gcctgtctatatttttaaactt

SEQ ID NO: 677350 - DNA, 22 bp, Artificial Sequence
  chemically synthesized
ttcatatttttgaagtttaaaa

SEQ ID NO: 677351 - DNA, 22 bp, Artificial Sequence
  chemically synthesized
tctatatttttaaacttcaaaa

SEQ ID NO: 677352 - DNA, 22 bp, Artificial Sequence
  chemically synthesized
atacctattcatatttttgaag

SEQ ID NO: 677353 - DNA, 22 bp, Artificial Sequence
  chemically synthesized
tatttttaaacttcaaaaatat

SEQ ID NO: 677354 - DNA, 22 bp, Artificial Sequence
  chemically synthesized
ttaaacttcaaaaatatgaata

SEQ ID NO: 677355 - DNA, 22 bp, Artificial Sequence
  chemically synthesized
taaacttcaaaaatatgaatag

SEQ ID NO: 677356 - DNA, 22 bp, Artificial Sequence
  chemically synthesized
tagaattaatacctattcatat

SEQ ID NO: 677357 - DNA, 22 bp, Artificial Sequence
  chemically synthesized
aaacttcaaaaatatgaatagg

SEQ ID NO: 677358 - DNA, 22 bp, Artificial Sequence
  chemically synthesized
aacttcaaaaatatgaataggt

SEQ ID NO: 677359 - DNA, 22 bp, Artificial Sequence
  chemically synthesized
ttatagaattaatacctattca

SEQ ID NO: 677360 - DNA, 22 bp, Artificial Sequence
  chemically synthesized
ttattatagaattaatacctat

SEQ ID NO: 677361 - DNA, 22 bp, Artificial Sequence
  chemically synthesized
caaaaatatgaataggtattaa

SEQ ID NO: 677362 - DNA, 22 bp, Artificial Sequence
  chemically synthesized
aaaaatatgaataggtattaat

SEQ ID NO: 677363 - DNA, 22 bp, Artificial Sequence
  chemically synthesized
aaatcattattattatagaatt

SEQ ID NO: 677364 - DNA, 22 bp, Artificial Sequence
  chemically synthesized
aaaatcattattattatagaat

SEQ ID NO: 677365 - DNA, 22 bp, Artificial Sequence
  chemically synthesized
taaaatcattattattatagaa

SEQ ID NO: 677366 - DNA, 22 bp, Artificial Sequence
  chemically synthesized
ttttaaaatcattattattata

SEQ ID NO: 677367 - DNA, 22 bp, Artificial Sequence
  chemically synthesized
attttaaaatcattattattat

SEQ ID NO: 677368 - DNA, 22 bp, Artificial Sequence
  chemically synthesized
ttattttaaaatcattattatt

SEQ ID NO: 677369 - DNA, 22 bp, Artificial Sequence
  chemically synthesized
actcttattttaaaatcattat

SEQ ID NO: 677370 - DNA, 22 bp, Artificial Sequence
  chemically synthesized
attctataataataatgatttt

SEQ ID NO: 677371 - DNA, 22 bp, Artificial Sequence
  chemically synthesized
attcactcttattttaaaatca

SEQ ID NO: 677372 - DNA, 22 bp, Artificial Sequence
  chemically synthesized
tataataataatgattttaaaa

SEQ ID NO: 677373 - DNA, 22 bp, Artificial Sequence
  chemically synthesized
aattcactcttattttaaaatc

SEQ ID NO: 677374 - DNA, 22 bp, Artificial Sequence
  chemically synthesized
taattcactcttattttaaaat

SEQ ID NO: 677375 - DNA, 22 bp, Artificial Sequence
  chemically synthesized
taataataatgattttaaaata

SEQ ID NO: 677376 - DNA, 22 bp, Artificial Sequence
  chemically synthesized
taatattttaattcactcttat

SEQ ID NO: 677377 - DNA, 22 bp, Artificial Sequence
  chemically synthesized
gttgtaatattttaattcactc

SEQ ID NO: 677378 - DNA, 22 bp, Artificial Sequence
  chemically synthesized
tagttgtaatattttaattcac

SEQ ID NO: 677379 - DNA, 22 bp, Artificial Sequence
  chemically synthesized
ctagttgtaatattttaattca

SEQ ID NO: 677380 - DNA, 22 bp, Artificial Sequence
  chemically synthesized
taaaataagagtgaattaaaat

SEQ ID NO: 677381 - DNA, 22 bp, Artificial Sequence
  chemically synthesized
aaaataagagtgaattaaaata

SEQ ID NO: 677382 - DNA, 22 bp, Artificial Sequence
  chemically synthesized
aaataagagtgaattaaaatat

SEQ ID NO: 677383 - DNA, 22 bp, Artificial Sequence
  chemically synthesized
cagtaatttctagttgtaatat

SEQ ID NO: 677384 - DNA, 22 bp, Artificial Sequence
  chemically synthesized
attacagtaatttctagttgta

SEQ ID NO: 677385 - DNA, 22 bp, Artificial Sequence
  chemically synthesized
taattacagtaatttctagttg

SEQ ID NO: 677386 - DNA, 22 bp, Artificial Sequence
  chemically synthesized
ctctaattacagtaatttctag

SEQ ID NO: 677387 - DNA, 22 bp, Artificial Sequence
  chemically synthesized
aaatattacaactagaaattac

SEQ ID NO: 677388 - DNA, 22 bp, Artificial Sequence
  chemically synthesized
ctactctaattacagtaatttc

SEQ ID NO: 677389 - DNA, 22 bp, Artificial Sequence
  chemically synthesized
cctactctaattacagtaattt

SEQ ID NO: 677390 - DNA, 22 bp, Artificial Sequence
  chemically synthesized
caactagaaattactgtaatta

SEQ ID NO: 677391 - DNA, 22 bp, Artificial Sequence
  chemically synthesized
acatttcctactctaattacag

SEQ ID NO: 677392 - DNA, 22 bp, Artificial Sequence
  chemically synthesized
taacatttcctactctaattac

SEQ ID NO: 677393 - DNA, 22 bp, Artificial Sequence
  chemically synthesized
ctaacatttcctactctaatta

SEQ ID NO: 677394 - DNA, 22 bp, Artificial Sequence
  chemically synthesized
gaaattactgtaattagagtag

SEQ ID NO: 677395 - DNA, 22 bp, Artificial Sequence
  chemically synthesized
gcccacttctaacatttcctac

SEQ ID NO: 677396 - DNA, 22 bp, Artificial Sequence
  chemically synthesized
ctgtaattagagtaggaaatgt

SEQ ID NO: 677397 - DNA, 22 bp, Artificial Sequence
  chemically synthesized
agcccacttctaacatttccta

SEQ ID NO: 677398 - DNA, 22 bp, Artificial Sequence
  chemically synthesized
taattagagtaggaaatgttag

SEQ ID NO: 677399 - DNA, 22 bp, Artificial Sequence
  chemically synthesized
gagtaggaaatgttagaagtgg

SEQ ID NO: 677400 - DNA, 22 bp, Artificial Sequence
  chemically synthesized
cacagatttagcccacttctaa

SEQ ID NO: 677401 - DNA, 22 bp, Artificial Sequence
  chemically synthesized
acacagatttagcccacttcta

SEQ ID NO: 677402 - DNA, 22 bp, Artificial Sequence
  chemically synthesized
tggtttacacagatttagccca

SEQ ID NO: 677403 - DNA, 22 bp, Artificial Sequence
  chemically synthesized
gaagtgggctaaatctgtgtaa

SEQ ID NO: 677404 - DNA, 22 bp, Artificial Sequence
  chemically synthesized
atcgtaacctgtggtttacaca

SEQ ID NO: 677405 - DNA, 22 bp, Artificial Sequence
  chemically synthesized
ctgatcgtaacctgtggtttac

SEQ ID NO: 677406 - DNA, 22 bp, Artificial Sequence
  chemically synthesized
aatctgtgtaaaccacaggtta

SEQ ID NO: 677407 - DNA, 22 bp, Artificial Sequence
  chemically synthesized
tgggcctcctgatcgtaacctg

SEQ ID NO: 677408 - DNA, 22 bp, Artificial Sequence
  chemically synthesized
tgtaaaccacaggttacgatca

SEQ ID NO: 677409 - DNA, 22 bp, Artificial Sequence
  chemically synthesized
gtctgtgggcctcctgatcgta

SEQ ID NO: 677410 - DNA, 22 bp, Artificial Sequence
  chemically synthesized
aattagtctgtgggcctcctga

SEQ ID NO: 677411 - DNA, 22 bp, Artificial Sequence
  chemically synthesized
aaattagtctgtgggcctcctg

SEQ ID NO: 677412 - DNA, 22 bp, Artificial Sequence
  chemically synthesized
atttaaattagtctgtgggcct

SEQ ID NO: 677413 - DNA, 22 bp, Artificial Sequence
  chemically synthesized
cgatcaggaggcccacagacta

SEQ ID NO: 677414 - DNA, 22 bp, Artificial Sequence
  chemically synthesized
tccacaaagagctaatttaaat

SEQ ID NO: 677415 - DNA, 22 bp, Artificial Sequence
  chemically synthesized
gaaatctgtccacaaagagcta

SEQ ID NO: 677416 - DNA, 22 bp, Artificial Sequence
  chemically synthesized
atttaaattagctctttgtgga

SEQ ID NO: 677417 - DNA, 22 bp, Artificial Sequence
  chemically synthesized
aaattagctctttgtggacaga

SEQ ID NO: 677418 - DNA, 22 bp, Artificial Sequence
  chemically synthesized
aattagctctttgtggacagat

SEQ ID NO: 677419 - DNA, 22 bp, Artificial Sequence
  chemically synthesized
gctctttgtggacagatttcta

SEQ ID NO: 677420 - DNA, 22 bp, Artificial Sequence
  chemically synthesized
tacaagagaaaaactagaaatc

SEQ ID NO: 677421 - DNA, 22 bp, Artificial Sequence
  chemically synthesized
tttgtggacagatttctagttt

SEQ ID NO: 677422 - DNA, 22 bp, Artificial Sequence
  chemically synthesized
tgtggacagatttctagttttt

SEQ ID NO: 677423 - DNA, 22 bp, Artificial Sequence
  chemically synthesized
attgtacaagagaaaaactaga

SEQ ID NO: 677424 - DNA, 22 bp, Artificial Sequence
  chemically synthesized
gtggacagatttctagtttttc

SEQ ID NO: 677425 - DNA, 22 bp, Artificial Sequence
  chemically synthesized
tggacagatttctagtttttct

SEQ ID NO: 677426 - DNA, 22 bp, Artificial Sequence
  chemically synthesized
ccaggacccctgattgtacaag

SEQ ID NO: 677427 - DNA, 22 bp, Artificial Sequence
  chemically synthesized
ctagtttttctcttgtacaatc

SEQ ID NO: 677428 - DNA, 22 bp, Artificial Sequence
  chemically synthesized
tagtttttctcttgtacaatca

SEQ ID NO: 677429 - DNA, 22 bp, Artificial Sequence
  chemically synthesized
gtttttctcttgtacaatcagg

SEQ ID NO: 677430 - DNA, 22 bp, Artificial Sequence
  chemically synthesized
ttctcttgtacaatcaggggtc

SEQ ID NO: 677431 - DNA, 22 bp, Artificial Sequence
  chemically synthesized
tctcttgtacaatcaggggtcc

SEQ ID NO: 677432 - DNA, 22 bp, Artificial Sequence
  chemically synthesized
ctcttgtacaatcaggggtcct

SEQ ID NO: 677433 - DNA, 22 bp, Artificial Sequence
  chemically synthesized
tcttgtacaatcaggggtcctg

SEQ ID NO: 677434 - DNA, 22 bp, Artificial Sequence
  chemically synthesized
tcccagtactcccaggacccct

SEQ ID NO: 677435 - DNA, 22 bp, Artificial Sequence
  chemically synthesized
ttgtacaatcaggggtcctggg

SEQ ID NO: 677436 - DNA, 22 bp, Artificial Sequence
  chemically synthesized
tatcccagtactcccaggaccc

SEQ ID NO: 677437 - DNA, 22 bp, Artificial Sequence
  chemically synthesized
ctatcccagtactcccaggacc

SEQ ID NO: 677438 - DNA, 22 bp, Artificial Sequence
  chemically synthesized
gtacaatcaggggtcctgggag

SEQ ID NO: 677439 - DNA, 22 bp, Artificial Sequence
  chemically synthesized
tctatcccagtactcccaggac

SEQ ID NO: 677440 - DNA, 22 bp, Artificial Sequence
  chemically synthesized
tacaatcaggggtcctgggagt

SEQ ID NO: 677441 - DNA, 22 bp, Artificial Sequence
  chemically synthesized
gtctttctatcccagtactccc

SEQ ID NO: 677442 - DNA, 22 bp, Artificial Sequence
  chemically synthesized
ggcaagctggtctttctatccc

SEQ ID NO: 677443 - DNA, 22 bp, Artificial Sequence
  chemically synthesized
ggagtactgggatagaaagacc

SEQ ID NO: 677444 - DNA, 22 bp, Artificial Sequence
  chemically synthesized
tcctgggcaagctggtctttct

SEQ ID NO: 677445 - DNA, 22 bp, Artificial Sequence
  chemically synthesized
ggatagaaagaccagcttgccc

SEQ ID NO: 677446 - DNA, 22 bp, Artificial Sequence
  chemically synthesized
aagtgggcagcagctgtcctgg

SEQ ID NO: 677447 - DNA, 22 bp, Artificial Sequence
  chemically synthesized
atctgaagtgggcagcagctgt

SEQ ID NO: 677448 - DNA, 22 bp, Artificial Sequence
  chemically synthesized
catctgaagtgggcagcagctg

SEQ ID NO: 677449 - DNA, 22 bp, Artificial Sequence
  chemically synthesized
gcccaggacagctgctgcccac

SEQ ID NO: 677450 - DNA, 22 bp, Artificial Sequence
  chemically synthesized
cccaggacagctgctgcccact

SEQ ID NO: 677451 - DNA, 22 bp, Artificial Sequence
  chemically synthesized
ctgcccacttcagatgaagcct

SEQ ID NO: 677452 - DNA, 22 bp, Artificial Sequence
  chemically synthesized
cccacttcagatgaagcctttt

SEQ ID NO: 677453 - DNA, 22 bp, Artificial Sequence
  chemically synthesized
gcaaatgagagaatgaaaaggc

SEQ ID NO: 677454 - DNA, 22 bp, Artificial Sequence
  chemically synthesized
ggcaaatgagagaatgaaaagg

SEQ ID NO: 677455 - DNA, 22 bp, Artificial Sequence
  chemically synthesized
tggcaaatgagagaatgaaaag

SEQ ID NO: 677456 - DNA, 22 bp, Artificial Sequence
  chemically synthesized
ttggcaaatgagagaatgaaaa

SEQ ID NO: 677457 - DNA, 22 bp, Artificial Sequence
  chemically synthesized
cagatgaagccttttcattctc

SEQ ID NO: 677458 - DNA, 22 bp, Artificial Sequence
  chemically synthesized
agatgaagccttttcattctct

SEQ ID NO: 677459 - DNA, 22 bp, Artificial Sequence
  chemically synthesized
tcttttggcaaatgagagaatg

SEQ ID NO: 677460 - DNA, 22 bp, Artificial Sequence
  chemically synthesized
atcttttggcaaatgagagaat

SEQ ID NO: 677461 - DNA, 22 bp, Artificial Sequence
  chemically synthesized
ttcattctctcatttgccaaaa

SEQ ID NO: 677462 - DNA, 22 bp, Artificial Sequence
  chemically synthesized
tcattctctcatttgccaaaag

SEQ ID NO: 677463 - DNA, 22 bp, Artificial Sequence
  chemically synthesized
cattctctcatttgccaaaaga

SEQ ID NO: 677464 - DNA, 22 bp, Artificial Sequence
  chemically synthesized
attctctcatttgccaaaagat

SEQ ID NO: 677465 - DNA, 22 bp, Artificial Sequence
  chemically synthesized
tctcatttgccaaaagataagc

SEQ ID NO: 677466 - DNA, 22 bp, Artificial Sequence
  chemically synthesized
tcatttgccaaaagataagcat

SEQ ID NO: 677467 - DNA, 22 bp, Artificial Sequence
  chemically synthesized
atttgccaaaagataagcattc

SEQ ID NO: 677468 - DNA, 22 bp, Artificial Sequence
  chemically synthesized
gccaaaagataagcattcacgt

SEQ ID NO: 677469 - DNA, 22 bp, Artificial Sequence
  chemically synthesized
ccaaaagataagcattcacgtt

SEQ ID NO: 677470 - DNA, 22 bp, Artificial Sequence
  chemically synthesized
taccacaggtggaaaacgtgaa

SEQ ID NO: 677471 - DNA, 22 bp, Artificial Sequence
  chemically synthesized
ataccacaggtggaaaacgtga

SEQ ID NO: 677472 - DNA, 22 bp, Artificial Sequence
  chemically synthesized
tttataccacaggtggaaaacg

SEQ ID NO: 677473 - DNA, 22 bp, Artificial Sequence
  chemically synthesized
tggactgtttataccacaggtg

SEQ ID NO: 677474 - DNA, 22 bp, Artificial Sequence
  chemically synthesized
acgttttccacctgtggtataa

SEQ ID NO: 677475 - DNA, 22 bp, Artificial Sequence
  chemically synthesized
taattgtggactgtttatacca

SEQ ID NO: 677476 - DNA, 22 bp, Artificial Sequence
  chemically synthesized
ataattgtggactgtttatacc

SEQ ID NO: 677477 - DNA, 22 bp, Artificial Sequence
  chemically synthesized
tccacctgtggtataaacagtc

SEQ ID NO: 677478 - DNA, 22 bp, Artificial Sequence
  chemically synthesized
ccacctgtggtataaacagtcc

SEQ ID NO: 677479 - DNA, 22 bp, Artificial Sequence
  chemically synthesized
gcttataattgtggactgttta

SEQ ID NO: 677480 - DNA, 22 bp, Artificial Sequence
  chemically synthesized
cacctgtggtataaacagtcca

SEQ ID NO: 677481 - DNA, 22 bp, Artificial Sequence
  chemically synthesized
ggcttataattgtggactgttt

SEQ ID NO: 677482 - DNA, 22 bp, Artificial Sequence
  chemically synthesized
tggcttataattgtggactgtt

SEQ ID NO: 677483 - DNA, 22 bp, Artificial Sequence
  chemically synthesized
ttggcttataattgtggactgt

SEQ ID NO: 677484 - DNA, 22 bp, Artificial Sequence
  chemically synthesized
tggtataaacagtccacaatta

SEQ ID NO: 677485 - DNA, 22 bp, Artificial Sequence
  chemically synthesized
cagaatgtttttggcttataat

SEQ ID NO: 677486 - DNA, 22 bp, Artificial Sequence
  chemically synthesized
cagcccctacagaatgtttttg

SEQ ID NO: 677487 - DNA, 22 bp, Artificial Sequence
  chemically synthesized
ccagcccctacagaatgttttt

SEQ ID NO: 677488 - DNA, 22 bp, Artificial Sequence
  chemically synthesized
catttccagcccctacagaatg

SEQ ID NO: 677489 - DNA, 22 bp, Artificial Sequence
  chemically synthesized
taagccaaaaacattctgtagg

SEQ ID NO: 677490 - DNA, 22 bp, Artificial Sequence
  chemically synthesized
aagtgctacatttccagcccct

SEQ ID NO: 677491 - DNA, 22 bp, Artificial Sequence
  chemically synthesized
caagtgctacatttccagcccc

SEQ ID NO: 677492 - DNA, 22 bp, Artificial Sequence
  chemically synthesized
tcaagtgctacatttccagccc

SEQ ID NO: 677493 - DNA, 22 bp, Artificial Sequence
  chemically synthesized
attttcaagtgctacatttcca

SEQ ID NO: 677494 - DNA, 22 bp, Artificial Sequence
  chemically synthesized
tgtaggggctggaaatgtagca

SEQ ID NO: 677495 - DNA, 22 bp, Artificial Sequence
  chemically synthesized
taggggctggaaatgtagcact

SEQ ID NO: 677496 - DNA, 22 bp, Artificial Sequence
  chemically synthesized
ggatcagctaattttcaagtgc

SEQ ID NO: 677497 - DNA, 22 bp, Artificial Sequence
  chemically synthesized
gaaatgtagcacttgaaaatta

SEQ ID NO: 677498 - DNA, 22 bp, Artificial Sequence
  chemically synthesized
aataaaattgggatcagctaat

SEQ ID NO: 677499 - DNA, 22 bp, Artificial Sequence
  chemically synthesized
aaataaaattgggatcagctaa

SEQ ID NO: 677500 - DNA, 22 bp, Artificial Sequence
  chemically synthesized
taaataaaattgggatcagcta

SEQ ID NO: 677501 - DNA, 22 bp, Artificial Sequence
  chemically synthesized
gaaaattagctgatcccaattt

SEQ ID NO: 677502 - DNA, 22 bp, Artificial Sequence
  chemically synthesized
aaattttaaataaaattgggat

SEQ ID NO: 677503 - DNA, 22 bp, Artificial Sequence
  chemically synthesized
aaaattagctgatcccaatttt

SEQ ID NO: 677504 - DNA, 22 bp, Artificial Sequence
  chemically synthesized
aaaattttaaataaaattggga

SEQ ID NO: 677505 - DNA, 22 bp, Artificial Sequence
  chemically synthesized
gctgatcccaattttatttaaa

SEQ ID NO: 677506 - DNA, 22 bp, Artificial Sequence
  chemically synthesized
atcccaattttatttaaaattt

SEQ ID NO: 677507 - DNA, 22 bp, Artificial Sequence
  chemically synthesized
taagtgtgtaaacgtttaaaat

SEQ ID NO: 677508 - DNA, 22 bp, Artificial Sequence
  chemically synthesized
tatttaaaattttaaacgttta

SEQ ID NO: 677509 - DNA, 22 bp, Artificial Sequence
  chemically synthesized
gttataagtgtgtaaacgttta

SEQ ID NO: 677510 - DNA, 22 bp, Artificial Sequence
  chemically synthesized
atttaaaattttaaacgtttac

SEQ ID NO: 677511 - DNA, 22 bp, Artificial Sequence
  chemically synthesized
tttaaaattttaaacgtttaca

SEQ ID NO: 677512 - DNA, 22 bp, Artificial Sequence
  chemically synthesized
aaaattttaaacgtttacacac

SEQ ID NO: 677513 - DNA, 22 bp, Artificial Sequence
  chemically synthesized
aaattttaaacgtttacacact

SEQ ID NO: 677514 - DNA, 22 bp, Artificial Sequence
  chemically synthesized
agtctggttataagtgtgtaaa

SEQ ID NO: 677515 - DNA, 22 bp, Artificial Sequence
  chemically synthesized
cagtctggttataagtgtgtaa

SEQ ID NO: 677516 - DNA, 22 bp, Artificial Sequence
  chemically synthesized
taaacgtttacacacttataac

SEQ ID NO: 677517 - DNA, 22 bp, Artificial Sequence
  chemically synthesized
aaacgtttacacacttataacc

SEQ ID NO: 677518 - DNA, 22 bp, Artificial Sequence
  chemically synthesized
aacgtttacacacttataacca

SEQ ID NO: 677519 - DNA, 22 bp, Artificial Sequence
  chemically synthesized
tgtcatttcagtctggttataa

SEQ ID NO: 677520 - DNA, 22 bp, Artificial Sequence
  chemically synthesized
acacacttataaccagactgaa

SEQ ID NO: 677521 - DNA, 22 bp, Artificial Sequence
  chemically synthesized
cacacttataaccagactgaaa

SEQ ID NO: 677522 - DNA, 22 bp, Artificial Sequence
  chemically synthesized
gagtaatattatgtcatttcag

SEQ ID NO: 677523 - DNA, 22 bp, Artificial Sequence
  chemically synthesized
cgagtaatattatgtcatttca

SEQ ID NO: 677524 - DNA, 22 bp, Artificial Sequence
  chemically synthesized
ataaccagactgaaatgacata

SEQ ID NO: 677525 - DNA, 22 bp, Artificial Sequence
  chemically synthesized
taaccagactgaaatgacataa

SEQ ID NO: 677526 - DNA, 22 bp, Artificial Sequence
  chemically synthesized
aaatgacataatattactcgaa

SEQ ID NO: 677527 - DNA, 22 bp, Artificial Sequence
  chemically synthesized
gccagagagatccaatacattt

SEQ ID NO: 677528 - DNA, 22 bp, Artificial Sequence
  chemically synthesized
tactagccagagagatccaata

SEQ ID NO: 677529 - DNA, 22 bp, Artificial Sequence
  chemically synthesized
atactagccagagagatccaat

SEQ ID NO: 677530 - DNA, 22 bp, Artificial Sequence
  chemically synthesized
ctcgaaatgtattggatctctc

SEQ ID NO: 677531 - DNA, 22 bp, Artificial Sequence
  chemically synthesized
gaaatgtattggatctctctgg

SEQ ID NO: 677532 - DNA, 22 bp, Artificial Sequence
  chemically synthesized
gatctctctggctagtataagt

SEQ ID NO: 677533 - DNA, 22 bp, Artificial Sequence
  chemically synthesized
tctggctagtataagtgacttt

SEQ ID NO: 677534 - DNA, 22 bp, Artificial Sequence
  chemically synthesized
tggctagtataagtgactttgt

SEQ ID NO: 677535 - DNA, 22 bp, Artificial Sequence
  chemically synthesized
gctagtataagtgactttgttt

SEQ ID NO: 677536 - DNA, 22 bp, Artificial Sequence
  chemically synthesized
gtataagtgactttgtttttcc

SEQ ID NO: 677537 - DNA, 22 bp, Artificial Sequence
  chemically synthesized
tgtttttcctttttcatgtttt

SEQ ID NO: 677538 - DNA, 22 bp, Artificial Sequence
  chemically synthesized
gtttttcctttttcatgttttt

SEQ ID NO: 677539 - DNA, 22 bp, Artificial Sequence
  chemically synthesized
tttttcctttttcatgtttttt

SEQ ID NO: 677540 - DNA, 22 bp, Artificial Sequence
  chemically synthesized
aaaaatgtaaataaaaaacatg

SEQ ID NO: 677541 - DNA, 22 bp, Artificial Sequence
  chemically synthesized
ttcctttttcatgttttttatt

SEQ ID NO: 677542 - DNA, 22 bp, Artificial Sequence
  chemically synthesized
tcctttttcatgttttttattt

SEQ ID NO: 677543 - DNA, 22 bp, Artificial Sequence
  chemically synthesized
cctttttcatgttttttattta

SEQ ID NO: 677544 - DNA, 22 bp, Artificial Sequence
  chemically synthesized
ctttttcatgttttttatttac

SEQ ID NO: 677545 - DNA, 22 bp, Artificial Sequence
  chemically synthesized
tttcatgttttttatttacatt

SEQ ID NO: 677546 - DNA, 22 bp, Artificial Sequence
  chemically synthesized
gaaaacctgaaaaatgtaaata

SEQ ID NO: 677547 - DNA, 22 bp, Artificial Sequence
  chemically synthesized
ttcatgttttttatttacattt

SEQ ID NO: 677548 - DNA, 22 bp, Artificial Sequence
  chemically synthesized
tcatgttttttatttacatttt

SEQ ID NO: 677549 - DNA, 22 bp, Artificial Sequence
  chemically synthesized
tagaaaacctgaaaaatgtaaa

SEQ ID NO: 677550 - DNA, 22 bp, Artificial Sequence
  chemically synthesized
catgttttttatttacattttt

SEQ ID NO: 677551 - DNA, 22 bp, Artificial Sequence
  chemically synthesized
ctagaaaacctgaaaaatgtaa

SEQ ID NO: 677552 - DNA, 22 bp, Artificial Sequence
  chemically synthesized
atgttttttatttacatttttc

SEQ ID NO: 677553 - DNA, 22 bp, Artificial Sequence
  chemically synthesized
tttatttacatttttcaggttt

SEQ ID NO: 677554 - DNA, 22 bp, Artificial Sequence
  chemically synthesized
ttatttacatttttcaggtttt

SEQ ID NO: 677555 - DNA, 22 bp, Artificial Sequence
  chemically synthesized
aatgtcttctagaaaacctgaa

SEQ ID NO: 677556 - DNA, 22 bp, Artificial Sequence
  chemically synthesized
tatttacatttttcaggttttc

SEQ ID NO: 677557 - DNA, 22 bp, Artificial Sequence
  chemically synthesized
atttacatttttcaggttttct

SEQ ID NO: 677558 - DNA, 22 bp, Artificial Sequence
  chemically synthesized
tttacatttttcaggttttcta

SEQ ID NO: 677559 - DNA, 22 bp, Artificial Sequence
  chemically synthesized
acatttttcaggttttctagaa

SEQ ID NO: 677560 - DNA, 22 bp, Artificial Sequence
  chemically synthesized
catttttcaggttttctagaag

SEQ ID NO: 677561 - DNA, 22 bp, Artificial Sequence
  chemically synthesized
taaatgattaaatgtcttctag

SEQ ID NO: 677562 - DNA, 22 bp, Artificial Sequence
  chemically synthesized
ttcaggttttctagaagacatt

SEQ ID NO: 677563 - DNA, 22 bp, Artificial Sequence
  chemically synthesized
tcaggttttctagaagacattt

SEQ ID NO: 677564 - DNA, 22 bp, Artificial Sequence
  chemically synthesized
caggttttctagaagacattta

SEQ ID NO: 677565 - DNA, 22 bp, Artificial Sequence
  chemically synthesized
attataaatgattaaatgtctt

SEQ ID NO: 677566 - DNA, 22 bp, Artificial Sequence
  chemically synthesized
aggttttctagaagacatttaa

SEQ ID NO: 677567 - DNA, 22 bp, Artificial Sequence
  chemically synthesized
taattataaatgattaaatgtc

SEQ ID NO: 677568 - DNA, 22 bp, Artificial Sequence
  chemically synthesized
ctaattataaatgattaaatgt

SEQ ID NO: 677569 - DNA, 22 bp, Artificial Sequence
  chemically synthesized
tctaattataaatgattaaatg

SEQ ID NO: 677570 - DNA, 22 bp, Artificial Sequence
  chemically synthesized
ttctaattataaatgattaaat

SEQ ID NO: 677571 - DNA, 22 bp, Artificial Sequence
  chemically synthesized
tctagaagacatttaatcattt

SEQ ID NO: 677572 - DNA, 22 bp, Artificial Sequence
  chemically synthesized
ctagaagacatttaatcattta

SEQ ID NO: 677573 - DNA, 22 bp, Artificial Sequence
  chemically synthesized
tagaagacatttaatcatttat

SEQ ID NO: 677574 - DNA, 22 bp, Artificial Sequence
  chemically synthesized
gaagacatttaatcatttataa

SEQ ID NO: 677575 - DNA, 22 bp, Artificial Sequence
  chemically synthesized
aacatttttctaattataaatg

SEQ ID NO: 677576 - DNA, 22 bp, Artificial Sequence
  chemically synthesized
ttaaacatttttctaattataa

SEQ ID NO: 677577 - DNA, 22 bp, Artificial Sequence
  chemically synthesized
attaaacatttttctaattata

SEQ ID NO: 677578 - DNA, 22 bp, Artificial Sequence
  chemically synthesized
tattaaacatttttctaattat

SEQ ID NO: 677579 - DNA, 22 bp, Artificial Sequence
  chemically synthesized
aatcatttataattagaaaaat

SEQ ID NO: 677580 - DNA, 22 bp, Artificial Sequence
  chemically synthesized
atcatttataattagaaaaatg

SEQ ID NO: 677581 - DNA, 22 bp, Artificial Sequence
  chemically synthesized
ataattagaaaaatgtttaata

SEQ ID NO: 677582 - DNA, 22 bp, Artificial Sequence
  chemically synthesized
taattagaaaaatgtttaataa

SEQ ID NO: 677583 - DNA, 22 bp, Artificial Sequence
  chemically synthesized
gccaaaaaatggttttattaaa

SEQ ID NO: 677584 - DNA, 22 bp, Artificial Sequence
  chemically synthesized
gaaaaatgtttaataaaaccat

SEQ ID NO: 677585 - DNA, 22 bp, Artificial Sequence
  chemically synthesized
gagaagagatattagccaaaaa

SEQ ID NO: 677586 - DNA, 22 bp, Artificial Sequence
  chemically synthesized
aataaaaccattttttggctaa

SEQ ID NO: 677587 - DNA, 22 bp, Artificial Sequence
  chemically synthesized
ataaaaccattttttggctaat

SEQ ID NO: 677588 - DNA, 22 bp, Artificial Sequence
  chemically synthesized
tttggctaatatctcttctcta

SEQ ID NO: 677589 - DNA, 22 bp, Artificial Sequence
  chemically synthesized
ttggctaatatctcttctctag

SEQ ID NO: 677590 - DNA, 22 bp, Artificial Sequence
  chemically synthesized
tggctaatatctcttctctagt

SEQ ID NO: 677591 - DNA, 22 bp, Artificial Sequence
  chemically synthesized
ggctaatatctcttctctagtc

SEQ ID NO: 677592 - DNA, 22 bp, Artificial Sequence
  chemically synthesized
gctaatatctcttctctagtcc

SEQ ID NO: 677593 - DNA, 22 bp, Artificial Sequence
  chemically synthesized
tagagacaccaaggactagaga

SEQ ID NO: 677594 - DNA, 22 bp, Artificial Sequence
  chemically synthesized
atatctcttctctagtccttgg

SEQ ID NO: 677595 - DNA, 22 bp, Artificial Sequence
  chemically synthesized
cagctatagagacaccaaggac

SEQ ID NO: 677596 - DNA, 22 bp, Artificial Sequence
  chemically synthesized
ttctctagtccttggtgtctct

SEQ ID NO: 677597 - DNA, 22 bp, Artificial Sequence
  chemically synthesized
ctctagtccttggtgtctctat

SEQ ID NO: 677598 - DNA, 22 bp, Artificial Sequence
  chemically synthesized
tctagtccttggtgtctctata

SEQ ID NO: 677599 - DNA, 22 bp, Artificial Sequence
  chemically synthesized
tagtccttggtgtctctatagc

SEQ ID NO: 677600 - DNA, 22 bp, Artificial Sequence
  chemically synthesized
gtccttggtgtctctatagctg

SEQ ID NO: 677601 - DNA, 22 bp, Artificial Sequence
  chemically synthesized
acaaaatgaattgcagctatag

SEQ ID NO: 677602 - DNA, 22 bp, Artificial Sequence
  chemically synthesized
tcacaaaatgaattgcagctat

SEQ ID NO: 677603 - DNA, 22 bp, Artificial Sequence
  chemically synthesized
ggtgtctctatagctgcaattc

SEQ ID NO: 677604 - DNA, 22 bp, Artificial Sequence
  chemically synthesized
gtgtctctatagctgcaattca

SEQ ID NO: 677605 - DNA, 22 bp, Artificial Sequence
  chemically synthesized
tatagctgcaattcattttgtg

SEQ ID NO: 677606 - DNA, 22 bp, Artificial Sequence
  chemically synthesized
tgtcatagattctcacaaaatg

SEQ ID NO: 677607 - DNA, 22 bp, Artificial Sequence
  chemically synthesized
tagctgcaattcattttgtgag

SEQ ID NO: 677608 - DNA, 22 bp, Artificial Sequence
  chemically synthesized
gtgtcatagattctcacaaaat

SEQ ID NO: 677609 - DNA, 22 bp, Artificial Sequence
  chemically synthesized
tgtgtcatagattctcacaaaa

SEQ ID NO: 677610 - DNA, 22 bp, Artificial Sequence
  chemically synthesized
ttgtgtcatagattctcacaaa

SEQ ID NO: 677611 - DNA, 22 bp, Artificial Sequence
  chemically synthesized
cttttgtgtcatagattctcac

SEQ ID NO: 677612 - DNA, 22 bp, Artificial Sequence
  chemically synthesized
caattcattttgtgagaatcta

SEQ ID NO: 677613 - DNA, 22 bp, Artificial Sequence
  chemically synthesized
ctgcttttgtgtcatagattct

SEQ ID NO: 677614 - DNA, 22 bp, Artificial Sequence
  chemically synthesized
ttactgcttttgtgtcatagat

SEQ ID NO: 677615 - DNA, 22 bp, Artificial Sequence
  chemically synthesized
attttgtgagaatctatgacac

SEQ ID NO: 677616 - DNA, 22 bp, Artificial Sequence
  chemically synthesized
tgtgagaatctatgacacaaaa

SEQ ID NO: 677617 - DNA, 22 bp, Artificial Sequence
  chemically synthesized
gtgagaatctatgacacaaaag

SEQ ID NO: 677618 - DNA, 22 bp, Artificial Sequence
  chemically synthesized
tgagaatctatgacacaaaagc

SEQ ID NO: 677619 - DNA, 22 bp, Artificial Sequence
  chemically synthesized
tgacacaaaagcagtaatagct

SEQ ID NO: 677620 - DNA, 22 bp, Artificial Sequence
  chemically synthesized
cgtaccccctgacacacacaca

SEQ ID NO: 677621 - DNA, 22 bp, Artificial Sequence
  chemically synthesized
tgtaggtatacgtaagtggggt

SEQ ID NO: 677622 - DNA, 22 bp, Artificial Sequence
  chemically synthesized
acacacacacaccccacttacg

SEQ ID NO: 677623 - DNA, 22 bp, Artificial Sequence
  chemically synthesized
tgtgtaggtatacgtaagtggg

SEQ ID NO: 677624 - DNA, 22 bp, Artificial Sequence
  chemically synthesized
aacataaattctgtgtaggtat

SEQ ID NO: 677625 - DNA, 22 bp, Artificial Sequence
  chemically synthesized
aaacataaattctgtgtaggta

SEQ ID NO: 677626 - DNA, 22 bp, Artificial Sequence
  chemically synthesized
acgtatacctacacagaattta

SEQ ID NO: 677627 - DNA, 22 bp, Artificial Sequence
  chemically synthesized
cgtatacctacacagaatttat

SEQ ID NO: 677628 - DNA, 22 bp, Artificial Sequence
  chemically synthesized
tgggaatcagggtacttaaaca

SEQ ID NO: 677629 - DNA, 22 bp, Artificial Sequence
  chemically synthesized
cacagaatttatgtttaagtac

SEQ ID NO: 677630 - DNA, 22 bp, Artificial Sequence
  chemically synthesized
atgtttaagtaccctgattccc

SEQ ID NO: 677631 - DNA, 22 bp, Artificial Sequence
  chemically synthesized
tgtttaagtaccctgattccca

SEQ ID NO: 677632 - DNA, 22 bp, Artificial Sequence
  chemically synthesized
tgtgatgaacactgtgggaatc

SEQ ID NO: 677633 - DNA, 22 bp, Artificial Sequence
  chemically synthesized
aagtaccctgattcccacagtg

SEQ ID NO: 677634 - DNA, 22 bp, Artificial Sequence
  chemically synthesized
agtaccctgattcccacagtgt

SEQ ID NO: 677635 - DNA, 22 bp, Artificial Sequence
  chemically synthesized
aggttatgtgatgaacactgtg

SEQ ID NO: 677636 - DNA, 22 bp, Artificial Sequence
  chemically synthesized
aaggttatgtgatgaacactgt

SEQ ID NO: 677637 - DNA, 22 bp, Artificial Sequence
  chemically synthesized
gatttaaggttatgtgatgaac

SEQ ID NO: 677638 - DNA, 22 bp, Artificial Sequence
  chemically synthesized
attcccacagtgttcatcacat

SEQ ID NO: 677639 - DNA, 22 bp, Artificial Sequence
  chemically synthesized
ggatttaaggttatgtgatgaa

SEQ ID NO: 677640 - DNA, 22 bp, Artificial Sequence
  chemically synthesized
tggatttaaggttatgtgatga

SEQ ID NO: 677641 - DNA, 22 bp, Artificial Sequence
  chemically synthesized
tttggatttaaggttatgtgat

SEQ ID NO: 677642 - DNA, 22 bp, Artificial Sequence
  chemically synthesized
ccacagtgttcatcacataacc

SEQ ID NO: 677643 - DNA, 22 bp, Artificial Sequence
  chemically synthesized
atcacataaccttaaatccaaa

SEQ ID NO: 677644 - DNA, 22 bp, Artificial Sequence
  chemically synthesized
aaatccaaagagatcgccttat

SEQ ID NO: 677645 - DNA, 22 bp, Artificial Sequence
  chemically synthesized
atagaaaaacacataaggcgat

SEQ ID NO: 677646 - DNA, 22 bp, Artificial Sequence
  chemically synthesized
aatccaaagagatcgccttatg

SEQ ID NO: 677647 - DNA, 22 bp, Artificial Sequence
  chemically synthesized
tgaatggacatattgatagaaa

SEQ ID NO: 677648 - DNA, 22 bp, Artificial Sequence
  chemically synthesized
tgtgaatggacatattgataga

SEQ ID NO: 677649 - DNA, 22 bp, Artificial Sequence
  chemically synthesized
ctgtgaatggacatattgatag

SEQ ID NO: 677650 - DNA, 22 bp, Artificial Sequence
  chemically synthesized
atgtgtttttctatcaatatgt

SEQ ID NO: 677651 - DNA, 22 bp, Artificial Sequence
  chemically synthesized
tgtgtttttctatcaatatgtc

SEQ ID NO: 677652 - DNA, 22 bp, Artificial Sequence
  chemically synthesized
catttctgtgaatggacatatt

SEQ ID NO: 677653 - DNA, 22 bp, Artificial Sequence
  chemically synthesized
ttctatcaatatgtccattcac

SEQ ID NO: 677654 - DNA, 22 bp, Artificial Sequence
  chemically synthesized
tctatcaatatgtccattcaca

SEQ ID NO: 677655 - DNA, 22 bp, Artificial Sequence
  chemically synthesized
ctatcaatatgtccattcacag

SEQ ID NO: 677656 - DNA, 22 bp, Artificial Sequence
  chemically synthesized
aagcctgcatttctgtgaatgg

SEQ ID NO: 677657 - DNA, 22 bp, Artificial Sequence
  chemically synthesized
tatcaatatgtccattcacaga

SEQ ID NO: 677658 - DNA, 22 bp, Artificial Sequence
  chemically synthesized
caagcctgcatttctgtgaatg

SEQ ID NO: 677659 - DNA, 22 bp, Artificial Sequence
  chemically synthesized
tcaagcctgcatttctgtgaat

SEQ ID NO: 677660 - DNA, 22 bp, Artificial Sequence
  chemically synthesized
tcaatatgtccattcacagaaa

SEQ ID NO: 677661 - DNA, 22 bp, Artificial Sequence
  chemically synthesized
ttcaagcctgcatttctgtgaa

SEQ ID NO: 677662 - DNA, 22 bp, Artificial Sequence
  chemically synthesized
tttcaagcctgcatttctgtga

SEQ ID NO: 677663 - DNA, 22 bp, Artificial Sequence
  chemically synthesized
ctttttcaagcctgcatttctg

SEQ ID NO: 677664 - DNA, 22 bp, Artificial Sequence
  chemically synthesized
tactttttcaagcctgcatttc

SEQ ID NO: 677665 - DNA, 22 bp, Artificial Sequence
  chemically synthesized
ctactttttcaagcctgcattt

SEQ ID NO: 677666 - DNA, 22 bp, Artificial Sequence
  chemically synthesized
tctactttttcaagcctgcatt

SEQ ID NO: 677667 - DNA, 22 bp, Artificial Sequence
  chemically synthesized
ttctactttttcaagcctgcat

SEQ ID NO: 677668 - DNA, 22 bp, Artificial Sequence
  chemically synthesized
acagaaatgcaggcttgaaaaa

SEQ ID NO: 677669 - DNA, 22 bp, Artificial Sequence
  chemically synthesized
atataaaaacgtcatgtctttt

SEQ ID NO: 677670 - DNA, 22 bp, Artificial Sequence
  chemically synthesized
aatataaaaacgtcatgtcttt

SEQ ID NO: 677671 - DNA, 22 bp, Artificial Sequence
  chemically synthesized
gaaaaagtagaaaagacatgac

SEQ ID NO: 677672 - DNA, 22 bp, Artificial Sequence
  chemically synthesized
taatataaaaacgtcatgtctt

SEQ ID NO: 677673 - DNA, 22 bp, Artificial Sequence
  chemically synthesized
aaaaagtagaaaagacatgacg

SEQ ID NO: 677674 - DNA, 22 bp, Artificial Sequence
  chemically synthesized
ttaatataaaaacgtcatgtct

SEQ ID NO: 677675 - DNA, 22 bp, Artificial Sequence
  chemically synthesized
tttaatataaaaacgtcatgtc

SEQ ID NO: 677676 - DNA, 22 bp, Artificial Sequence
  chemically synthesized
ttttaatataaaaacgtcatgt

SEQ ID NO: 677677 - DNA, 22 bp, Artificial Sequence
  chemically synthesized
tgtatttttttaatataaaaac

SEQ ID NO: 677678 - DNA, 22 bp, Artificial Sequence
  chemically synthesized
atgtatttttttaatataaaaa

SEQ ID NO: 677679 - DNA, 22 bp, Artificial Sequence
  chemically synthesized
tatgtatttttttaatataaaa

SEQ ID NO: 677680 - DNA, 22 bp, Artificial Sequence
  chemically synthesized
ttatgtatttttttaatataaa

SEQ ID NO: 677681 - DNA, 22 bp, Artificial Sequence
  chemically synthesized
tgtttttatgtatttttttaat

SEQ ID NO: 677682 - DNA, 22 bp, Artificial Sequence
  chemically synthesized
ttatattaaaaaaatacataaa

SEQ ID NO: 677683 - DNA, 22 bp, Artificial Sequence
  chemically synthesized
tatattaaaaaaatacataaaa

SEQ ID NO: 677684 - DNA, 22 bp, Artificial Sequence
  chemically synthesized
cccaggctgtgtttttatgtat

SEQ ID NO: 677685 - DNA, 22 bp, Artificial Sequence
  chemically synthesized
atattaaaaaaatacataaaaa

SEQ ID NO: 677686 - DNA, 22 bp, Artificial Sequence
  chemically synthesized
tattaaaaaaatacataaaaac

SEQ ID NO: 677687 - DNA, 22 bp, Artificial Sequence
  chemically synthesized
tgttgcccaggctgtgttttta

SEQ ID NO: 677688 - DNA, 22 bp, Artificial Sequence
  chemically synthesized
aaaaaatacataaaaacacagc

SEQ ID NO: 677689 - DNA, 22 bp, Artificial Sequence
  chemically synthesized
actatgttgcccaggctgtgtt

SEQ ID NO: 677690 - DNA, 22 bp, Artificial Sequence
  chemically synthesized
tagagatgggtctcactatgtt

SEQ ID NO: 677691 - DNA, 22 bp, Artificial Sequence
  chemically synthesized
gtagagatgggtctcactatgt

SEQ ID NO: 677692 - DNA, 22 bp, Artificial Sequence
  chemically synthesized
tgtagagatgggtctcactatg

SEQ ID NO: 677693 - DNA, 22 bp, Artificial Sequence
  chemically synthesized
ttgtagagatgggtctcactat

SEQ ID NO: 677694 - DNA, 22 bp, Artificial Sequence
  chemically synthesized
tttttgtagagatgggtctcac

SEQ ID NO: 677695 - DNA, 22 bp, Artificial Sequence
  chemically synthesized
atttttgtagagatgggtctca

SEQ ID NO: 677696 - DNA, 22 bp, Artificial Sequence
  chemically synthesized
ggcaacatagtgagacccatct

SEQ ID NO: 677697 - DNA, 22 bp, Artificial Sequence
  chemically synthesized
tttatttttgtagagatgggtc

SEQ ID NO: 677698 - DNA, 22 bp, Artificial Sequence
  chemically synthesized
atttatttttgtagagatgggt

SEQ ID NO: 677699 - DNA, 22 bp, Artificial Sequence
  chemically synthesized
tatttatttttgtagagatggg

SEQ ID NO: 677700 - DNA, 22 bp, Artificial Sequence
  chemically synthesized
ttatttatttttgtagagatgg

SEQ ID NO: 677701 - DNA, 22 bp, Artificial Sequence
  chemically synthesized
tttttatttatttttgtagaga

SEQ ID NO: 677702 - DNA, 22 bp, Artificial Sequence
  chemically synthesized
atttttatttatttttgtagag

SEQ ID NO: 677703 - DNA, 22 bp, Artificial Sequence
  chemically synthesized
aaatttatttttatttattttt

SEQ ID NO: 677704 - DNA, 22 bp, Artificial Sequence
  chemically synthesized
aaaatttatttttatttatttt

SEQ ID NO: 677705 - DNA, 22 bp, Artificial Sequence
  chemically synthesized
taaaatttatttttatttattt

SEQ ID NO: 677706 - DNA, 22 bp, Artificial Sequence
  chemically synthesized
ttaaaatttatttttatttatt

SEQ ID NO: 677707 - DNA, 22 bp, Artificial Sequence
  chemically synthesized
atttttaaaatttatttttatt

SEQ ID NO: 677708 - DNA, 22 bp, Artificial Sequence
  chemically synthesized
tacaaaaataaataaaaataaa

SEQ ID NO: 677709 - DNA, 22 bp, Artificial Sequence
  chemically synthesized
caaaaataaataaaaataaatt

SEQ ID NO: 677710 - DNA, 22 bp, Artificial Sequence
  chemically synthesized
taaaaatgagctgggtgtggtg

SEQ ID NO: 677711 - DNA, 22 bp, Artificial Sequence
  chemically synthesized
aaaaatgagctgggtgtggtgg

SEQ ID NO: 677712 - DNA, 22 bp, Artificial Sequence
  chemically synthesized
aaaatgagctgggtgtggtggt

SEQ ID NO: 677713 - DNA, 22 bp, Artificial Sequence
  chemically synthesized
ggacaacaggaatgcaccacca

SEQ ID NO: 677714 - DNA, 22 bp, Artificial Sequence
  chemically synthesized
ggtgtggtggtgcattcctgtt

SEQ ID NO: 677715 - DNA, 22 bp, Artificial Sequence
  chemically synthesized
agtagctgggacaacaggaatg

SEQ ID NO: 677716 - DNA, 22 bp, Artificial Sequence
  chemically synthesized
ctgagtagctgggacaacagga

SEQ ID NO: 677717 - DNA, 22 bp, Artificial Sequence
  chemically synthesized
agcctcctgagtagctgggaca

SEQ ID NO: 677718 - DNA, 22 bp, Artificial Sequence
  chemically synthesized
cctcagcctcctgagtagctgg

SEQ ID NO: 677719 - DNA, 22 bp, Artificial Sequence
  chemically synthesized
tgcctcagcctcctgagtagct

SEQ ID NO: 677720 - DNA, 22 bp, Artificial Sequence
  chemically synthesized
ctgcctcagcctcctgagtagc

SEQ ID NO: 677721 - DNA, 22 bp, Artificial Sequence
  chemically synthesized
ctgttgtcccagctactcagga

SEQ ID NO: 677722 - DNA, 22 bp, Artificial Sequence
  chemically synthesized
ttctgcctcagcctcctgagta

SEQ ID NO: 677723 - DNA, 22 bp, Artificial Sequence
  chemically synthesized
ttgtcccagctactcaggaggc

SEQ ID NO: 677724 - DNA, 22 bp, Artificial Sequence
  chemically synthesized
tcccagctactcaggaggctga

SEQ ID NO: 677725 - DNA, 22 bp, Artificial Sequence
  chemically synthesized
atggcggttcttctgcctcagc

SEQ ID NO: 677726 - DNA, 22 bp, Artificial Sequence
  chemically synthesized
ctcaggaggctgaggcagaaga

SEQ ID NO: 677727 - DNA, 22 bp, Artificial Sequence
  chemically synthesized
ggctcatggcggttcttctgcc

SEQ ID NO: 677728 - DNA, 22 bp, Artificial Sequence
  chemically synthesized
aggaggctgaggcagaagaacc

SEQ ID NO: 677729 - DNA, 22 bp, Artificial Sequence
  chemically synthesized
gaacccctgggctcatggcggt

SEQ ID NO: 677730 - DNA, 22 bp, Artificial Sequence
  chemically synthesized
aggcagaagaaccgccatgagc

SEQ ID NO: 677731 - DNA, 22 bp, Artificial Sequence
  chemically synthesized
cagcctcgaacccctgggctca

SEQ ID NO: 677732 - DNA, 22 bp, Artificial Sequence
  chemically synthesized
ttgcagcctcgaacccctgggc

SEQ ID NO: 677733 - DNA, 22 bp, Artificial Sequence
  chemically synthesized
attgcagcctcgaacccctggg

SEQ ID NO: 677734 - DNA, 22 bp, Artificial Sequence
  chemically synthesized
tagcttattgcagcctcgaacc

SEQ ID NO: 677735 - DNA, 22 bp, Artificial Sequence
  chemically synthesized
gaggctgcaataagctataacc

SEQ ID NO: 677736 - DNA, 22 bp, Artificial Sequence
  chemically synthesized
gagtgcagtggtgcggttatag

SEQ ID NO: 677737 - DNA, 22 bp, Artificial Sequence
  chemically synthesized
caataagctataaccgcaccac

SEQ ID NO: 677738 - DNA, 22 bp, Artificial Sequence
  chemically synthesized
ccaggctggagtgcagtggtgc

SEQ ID NO: 677739 - DNA, 22 bp, Artificial Sequence
  chemically synthesized
tctcccaggctggagtgcagtg

SEQ ID NO: 677740 - DNA, 22 bp, Artificial Sequence
  chemically synthesized
tgtctcccaggctggagtgcag

SEQ ID NO: 677741 - DNA, 22 bp, Artificial Sequence
  chemically synthesized
taaccgcaccactgcactccag

SEQ ID NO: 677742 - DNA, 22 bp, Artificial Sequence
  chemically synthesized
ctctgtctcccaggctggagtg

SEQ ID NO: 677743 - DNA, 22 bp, Artificial Sequence
  chemically synthesized
gctctgtctcccaggctggagt

SEQ ID NO: 677744 - DNA, 22 bp, Artificial Sequence
  chemically synthesized
cactccagcctgggagacagag

SEQ ID NO: 677745 - DNA, 22 bp, Artificial Sequence
  chemically synthesized
ggacagggtcttgctctgtctc

SEQ ID NO: 677746 - DNA, 22 bp, Artificial Sequence
  chemically synthesized
gggacagggtcttgctctgtct

SEQ ID NO: 677747 - DNA, 22 bp, Artificial Sequence
  chemically synthesized
tgggacagggtcttgctctgtc

SEQ ID NO: 677748 - DNA, 22 bp, Artificial Sequence
  chemically synthesized
cagcctgggagacagagcaaga

SEQ ID NO: 677749 - DNA, 22 bp, Artificial Sequence
  chemically synthesized
ttttgggacagggtcttgctct

SEQ ID NO: 677750 - DNA, 22 bp, Artificial Sequence
  chemically synthesized
gttttgggacagggtcttgctc

SEQ ID NO: 677751 - DNA, 22 bp, Artificial Sequence
  chemically synthesized
tgttttgggacagggtcttgct

SEQ ID NO: 677752 - DNA, 22 bp, Artificial Sequence
  chemically synthesized
ggagacagagcaagaccctgtc

SEQ ID NO: 677753 - DNA, 22 bp, Artificial Sequence
  chemically synthesized
ggttttgttttgggacagggtc

SEQ ID NO: 677754 - DNA, 22 bp, Artificial Sequence
  chemically synthesized
gggttttgttttgggacagggt

SEQ ID NO: 677755 - DNA, 22 bp, Artificial Sequence
  chemically synthesized
tgggttttgttttgggacaggg

SEQ ID NO: 677756 - DNA, 22 bp, Artificial Sequence
  chemically synthesized
ttttgggttttgttttgggaca

SEQ ID NO: 677757 - DNA, 22 bp, Artificial Sequence
  chemically synthesized
gttttgggttttgttttgggac

SEQ ID NO: 677758 - DNA, 22 bp, Artificial Sequence
  chemically synthesized
cagcttgttttgggttttgttt

SEQ ID NO: 677759 - DNA, 22 bp, Artificial Sequence
  chemically synthesized
agttgcagcttgttttgggttt

SEQ ID NO: 677760 - DNA, 22 bp, Artificial Sequence
  chemically synthesized
aagttgcagcttgttttgggtt

SEQ ID NO: 677761 - DNA, 22 bp, Artificial Sequence
  chemically synthesized
tcccaaaacaaaacccaaaaca

SEQ ID NO: 677762 - DNA, 22 bp, Artificial Sequence
  chemically synthesized
tcttaagttgcagcttgttttg

SEQ ID NO: 677763 - DNA, 22 bp, Artificial Sequence
  chemically synthesized
aaatgagttatcttaagttgca

SEQ ID NO: 677764 - DNA, 22 bp, Artificial Sequence
  chemically synthesized
tgaaatgagttatcttaagttg

SEQ ID NO: 677765 - DNA, 22 bp, Artificial Sequence
  chemically synthesized
caacttaagataactcatttca

SEQ ID NO: 677766 - DNA, 22 bp, Artificial Sequence
  chemically synthesized
caaggaatattctgaaatgagt

SEQ ID NO: 677767 - DNA, 22 bp, Artificial Sequence
  chemically synthesized
aagataactcatttcagaatat

SEQ ID NO: 677768 - DNA, 22 bp, Artificial Sequence
  chemically synthesized
gatctacaaggaatattctgaa

SEQ ID NO: 677769 - DNA, 22 bp, Artificial Sequence
  chemically synthesized
agataactcatttcagaatatt

SEQ ID NO: 677770 - DNA, 22 bp, Artificial Sequence
  chemically synthesized
agatctacaaggaatattctga

SEQ ID NO: 677771 - DNA, 22 bp, Artificial Sequence
  chemically synthesized
tagatctacaaggaatattctg

SEQ ID NO: 677772 - DNA, 22 bp, Artificial Sequence
  chemically synthesized
tcgttttagatctacaaggaat

SEQ ID NO: 677773 - DNA, 22 bp, Artificial Sequence
  chemically synthesized
gtcgttttagatctacaaggaa

SEQ ID NO: 677774 - DNA, 22 bp, Artificial Sequence
  chemically synthesized
atttcagaatattccttgtaga

SEQ ID NO: 677775 - DNA, 22 bp, Artificial Sequence
  chemically synthesized
gtttgtcgttttagatctacaa

SEQ ID NO: 677776 - DNA, 22 bp, Artificial Sequence
  chemically synthesized
cagaatattccttgtagatcta

SEQ ID NO: 677777 - DNA, 22 bp, Artificial Sequence
  chemically synthesized
agaatattccttgtagatctaa

SEQ ID NO: 677778 - DNA, 22 bp, Artificial Sequence
  chemically synthesized
cttgtagatctaaaacgacaaa

SEQ ID NO: 677779 - DNA, 22 bp, Artificial Sequence
  chemically synthesized
gtagatctaaaacgacaaacca

SEQ ID NO: 677780 - DNA, 22 bp, Artificial Sequence
  chemically synthesized
tagatctaaaacgacaaaccag

SEQ ID NO: 677781 - DNA, 22 bp, Artificial Sequence
  chemically synthesized
gacaaatgtccagatgtctggt

SEQ ID NO: 677782 - DNA, 22 bp, Artificial Sequence
  chemically synthesized
aaacgacaaaccagacatctgg

SEQ ID NO: 677783 - DNA, 22 bp, Artificial Sequence
  chemically synthesized
cactggacaaatgtccagatgt

SEQ ID NO: 677784 - DNA, 22 bp, Artificial Sequence
  chemically synthesized
acactggacaaatgtccagatg

SEQ ID NO: 677785 - DNA, 22 bp, Artificial Sequence
  chemically synthesized
tacactggacaaatgtccagat

SEQ ID NO: 677786 - DNA, 22 bp, Artificial Sequence
  chemically synthesized
ttacactggacaaatgtccaga

SEQ ID NO: 677787 - DNA, 22 bp, Artificial Sequence
  chemically synthesized
tttacactggacaaatgtccag

SEQ ID NO: 677788 - DNA, 22 bp, Artificial Sequence
  chemically synthesized
aaaacaccagtctttttacact

SEQ ID NO: 677789 - DNA, 22 bp, Artificial Sequence
  chemically synthesized
gacatttgtccagtgtaaaaag

SEQ ID NO: 677790 - DNA, 22 bp, Artificial Sequence
  chemically synthesized
gaaaacaccagtctttttacac

SEQ ID NO: 677791 - DNA, 22 bp, Artificial Sequence
  chemically synthesized
gtccagtgtaaaaagactggtg

SEQ ID NO: 677792 - DNA, 22 bp, Artificial Sequence
  chemically synthesized
tccagtgtaaaaagactggtgt

SEQ ID NO: 677793 - DNA, 22 bp, Artificial Sequence
  chemically synthesized
gtgttttcaaacccttatttgt

SEQ ID NO: 677794 - DNA, 22 bp, Artificial Sequence
  chemically synthesized
aatgggtacagagcatacaaat

SEQ ID NO: 677795 - DNA, 22 bp, Artificial Sequence
  chemically synthesized
gaatgggtacagagcatacaaa

SEQ ID NO: 677796 - DNA, 22 bp, Artificial Sequence
  chemically synthesized
tcaaacccttatttgtatgctc

SEQ ID NO: 677797 - DNA, 22 bp, Artificial Sequence
  chemically synthesized
tgaatgggtacagagcatacaa

SEQ ID NO: 677798 - DNA, 22 bp, Artificial Sequence
  chemically synthesized
caaacccttatttgtatgctct

SEQ ID NO: 677799 - DNA, 22 bp, Artificial Sequence
  chemically synthesized
aaacccttatttgtatgctctg

SEQ ID NO: 677800 - DNA, 22 bp, Artificial Sequence
  chemically synthesized
ttttgaatgggtacagagcata

SEQ ID NO: 677801 - DNA, 22 bp, Artificial Sequence
  chemically synthesized
aattattttgaatgggtacaga

SEQ ID NO: 677802 - DNA, 22 bp, Artificial Sequence
  chemically synthesized
gaattattttgaatgggtacag

SEQ ID NO: 677803 - DNA, 22 bp, Artificial Sequence
  chemically synthesized
atttgtatgctctgtacccatt

SEQ ID NO: 677804 - DNA, 22 bp, Artificial Sequence
  chemically synthesized
tttgtatgctctgtacccattc

SEQ ID NO: 677805 - DNA, 22 bp, Artificial Sequence
  chemically synthesized
gtatgctctgtacccattcaaa

SEQ ID NO: 677806 - DNA, 22 bp, Artificial Sequence
  chemically synthesized
tatgctctgtacccattcaaaa

SEQ ID NO: 677807 - DNA, 22 bp, Artificial Sequence
  chemically synthesized
ataacttgaattattttgaatg

SEQ ID NO: 677808 - DNA, 22 bp, Artificial Sequence
  chemically synthesized
ccctcataacttgaattatttt

SEQ ID NO: 677809 - DNA, 22 bp, Artificial Sequence
  chemically synthesized
tgtacccattcaaaataattca

SEQ ID NO: 677810 - DNA, 22 bp, Artificial Sequence
  chemically synthesized
cccctcataacttgaattattt

SEQ ID NO: 677811 - DNA, 22 bp, Artificial Sequence
  chemically synthesized
tcccctcataacttgaattatt

SEQ ID NO: 677812 - DNA, 22 bp, Artificial Sequence
  chemically synthesized
tacccattcaaaataattcaag

SEQ ID NO: 677813 - DNA, 22 bp, Artificial Sequence
  chemically synthesized
tttcccctcataacttgaatta

SEQ ID NO: 677814 - DNA, 22 bp, Artificial Sequence
  chemically synthesized
ctttcccctcataacttgaatt

SEQ ID NO: 677815 - DNA, 22 bp, Artificial Sequence
  chemically synthesized
tctttcccctcataacttgaat

SEQ ID NO: 677816 - DNA, 22 bp, Artificial Sequence
  chemically synthesized
ttttctttcccctcataacttg

SEQ ID NO: 677817 - DNA, 22 bp, Artificial Sequence
  chemically synthesized
tgttttctttcccctcataact

SEQ ID NO: 677818 - DNA, 22 bp, Artificial Sequence
  chemically synthesized
aaaataattcaagttatgaggg

SEQ ID NO: 677819 - DNA, 22 bp, Artificial Sequence
  chemically synthesized
acagttctgttttctttcccct

SEQ ID NO: 677820 - DNA, 22 bp, Artificial Sequence
  chemically synthesized
aagttatgaggggaaagaaaac

SEQ ID NO: 677821 - DNA, 22 bp, Artificial Sequence
  chemically synthesized
tgaggggaaagaaaacagaact

SEQ ID NO: 677822 - DNA, 22 bp, Artificial Sequence
  chemically synthesized
tgtaagagcctgacagttctgt

SEQ ID NO: 677823 - DNA, 22 bp, Artificial Sequence
  chemically synthesized
atgtaagagcctgacagttctg

SEQ ID NO: 677824 - DNA, 22 bp, Artificial Sequence
  chemically synthesized
tgtttatgtaagagcctgacag

SEQ ID NO: 677825 - DNA, 22 bp, Artificial Sequence
  chemically synthesized
gtgtttatgtaagagcctgaca

SEQ ID NO: 677826 - DNA, 22 bp, Artificial Sequence
  chemically synthesized
tgtgtttatgtaagagcctgac

SEQ ID NO: 677827 - DNA, 22 bp, Artificial Sequence
  chemically synthesized
ttttgtgtttatgtaagagcct

SEQ ID NO: 677828 - DNA, 22 bp, Artificial Sequence
  chemically synthesized
gttttgtgtttatgtaagagcc

SEQ ID NO: 677829 - DNA, 22 bp, Artificial Sequence
  chemically synthesized
tcaggctcttacataaacacaa

SEQ ID NO: 677830 - DNA, 22 bp, Artificial Sequence
  chemically synthesized
gtatggcttgttttgtgtttat

SEQ ID NO: 677831 - DNA, 22 bp, Artificial Sequence
  chemically synthesized
agtatggcttgttttgtgttta

SEQ ID NO: 677832 - DNA, 22 bp, Artificial Sequence
  chemically synthesized
tagtatggcttgttttgtgttt

SEQ ID NO: 677833 - DNA, 22 bp, Artificial Sequence
  chemically synthesized
tttagtatggcttgttttgtgt

SEQ ID NO: 677834 - DNA, 22 bp, Artificial Sequence
  chemically synthesized
ctttagtatggcttgttttgtg

SEQ ID NO: 677835 - DNA, 22 bp, Artificial Sequence
  chemically synthesized
ttacataaacacaaaacaagcc

SEQ ID NO: 677836 - DNA, 22 bp, Artificial Sequence
  chemically synthesized
acataaacacaaaacaagccat

SEQ ID NO: 677837 - DNA, 22 bp, Artificial Sequence
  chemically synthesized
cataaacacaaaacaagccata

SEQ ID NO: 677838 - DNA, 22 bp, Artificial Sequence
  chemically synthesized
aatgatttctttagtatggctt

SEQ ID NO: 677839 - DNA, 22 bp, Artificial Sequence
  chemically synthesized
aaatgatttctttagtatggct

SEQ ID NO: 677840 - DNA, 22 bp, Artificial Sequence
  chemically synthesized
atgtgaacatttaaatgatttc

SEQ ID NO: 677841 - DNA, 22 bp, Artificial Sequence
  chemically synthesized
aagaaatcatttaaatgttcac

SEQ ID NO: 677842 - DNA, 22 bp, Artificial Sequence
  chemically synthesized
gcgggtcattaatgtgaacatt

SEQ ID NO: 677843 - DNA, 22 bp, Artificial Sequence
  chemically synthesized
aggcctggcgggtcattaatgt

SEQ ID NO: 677844 - DNA, 22 bp, Artificial Sequence
  chemically synthesized
ctaaggcctggcgggtcattaa

SEQ ID NO: 677845 - DNA, 22 bp, Artificial Sequence
  chemically synthesized
aaatgttcacattaatgacccg

SEQ ID NO: 677846 - DNA, 22 bp, Artificial Sequence
  chemically synthesized
aatgttcacattaatgacccgc

SEQ ID NO: 677847 - DNA, 22 bp, Artificial Sequence
  chemically synthesized
acaattcctaaggcctggcggg

SEQ ID NO: 677848 - DNA, 22 bp, Artificial Sequence
  chemically synthesized
acattaatgacccgccaggcct

SEQ ID NO: 677849 - DNA, 22 bp, Artificial Sequence
  chemically synthesized
atgacccgccaggccttaggaa

SEQ ID NO: 677850 - DNA, 22 bp, Artificial Sequence
  chemically synthesized
cggtgctcacaattcctaaggc

SEQ ID NO: 677851 - DNA, 22 bp, Artificial Sequence
  chemically synthesized
ccggtgctcacaattcctaagg

SEQ ID NO: 677852 - DNA, 22 bp, Artificial Sequence
  chemically synthesized
tccggtgctcacaattcctaag

SEQ ID NO: 677853 - DNA, 22 bp, Artificial Sequence
  chemically synthesized
ccgtctttccggtgctcacaat

SEQ ID NO: 677854 - DNA, 22 bp, Artificial Sequence
  chemically synthesized
tgccgtctttccggtgctcaca

SEQ ID NO: 677855 - DNA, 22 bp, Artificial Sequence
  chemically synthesized
ctgccgtctttccggtgctcac

SEQ ID NO: 677856 - DNA, 22 bp, Artificial Sequence
  chemically synthesized
tctgccgtctttccggtgctca

SEQ ID NO: 677857 - DNA, 22 bp, Artificial Sequence
  chemically synthesized
aggaattgtgagcaccggaaag

SEQ ID NO: 677858 - DNA, 22 bp, Artificial Sequence
  chemically synthesized
ggaattgtgagcaccggaaaga

SEQ ID NO: 677859 - DNA, 22 bp, Artificial Sequence
  chemically synthesized
tgagcaccggaaagacggcaga

SEQ ID NO: 677860 - DNA, 22 bp, Artificial Sequence
  chemically synthesized
tgtaaaggaattttctgccgtc

SEQ ID NO: 677861 - DNA, 22 bp, Artificial Sequence
  chemically synthesized
ccaaaccacaaatgttgtgtaa

SEQ ID NO: 677862 - DNA, 22 bp, Artificial Sequence
  chemically synthesized
gccaaaccacaaatgttgtgta

SEQ ID NO: 677863 - DNA, 22 bp, Artificial Sequence
  chemically synthesized
tgccaaaccacaaatgttgtgt

SEQ ID NO: 677864 - DNA, 22 bp, Artificial Sequence
  chemically synthesized
ttgccaaaccacaaatgttgtg

SEQ ID NO: 677865 - DNA, 22 bp, Artificial Sequence
  chemically synthesized
ctttacacaacatttgtggttt

SEQ ID NO: 677866 - DNA, 22 bp, Artificial Sequence
  chemically synthesized
tacacaacatttgtggtttggc

SEQ ID NO: 677867 - DNA, 22 bp, Artificial Sequence
  chemically synthesized
acacaacatttgtggtttggca

SEQ ID NO: 677868 - DNA, 22 bp, Artificial Sequence
  chemically synthesized
cacaacatttgtggtttggcaa

SEQ ID NO: 677869 - DNA, 22 bp, Artificial Sequence
  chemically synthesized
gtggtttggcaaaagggttgtc

SEQ ID NO: 677870 - DNA, 22 bp, Artificial Sequence
  chemically synthesized
tggtttggcaaaagggttgtct

SEQ ID NO: 677871 - DNA, 22 bp, Artificial Sequence
  chemically synthesized
cgtgtgaaaccaagacaaccct

SEQ ID NO: 677872 - DNA, 22 bp, Artificial Sequence
  chemically synthesized
ccgtgtgaaaccaagacaaccc

SEQ ID NO: 677873 - DNA, 22 bp, Artificial Sequence
  chemically synthesized
ttccgtgtgaaaccaagacaac

SEQ ID NO: 677874 - DNA, 22 bp, Artificial Sequence
  chemically synthesized
cttccgtgtgaaaccaagacaa

SEQ ID NO: 677875 - DNA, 22 bp, Artificial Sequence
  chemically synthesized
ggcaaaagggttgtcttggttt

SEQ ID NO: 677876 - DNA, 22 bp, Artificial Sequence
  chemically synthesized
gcaaaagggttgtcttggtttc

SEQ ID NO: 677877 - DNA, 22 bp, Artificial Sequence
  chemically synthesized
atttcttccgtgtgaaaccaag

SEQ ID NO: 677878 - DNA, 22 bp, Artificial Sequence
  chemically synthesized
ttgatttcttccgtgtgaaacc

SEQ ID NO: 677879 - DNA, 22 bp, Artificial Sequence
  chemically synthesized
gttgatttcttccgtgtgaaac

SEQ ID NO: 677880 - DNA, 22 bp, Artificial Sequence
  chemically synthesized
tcttggtttcacacggaagaaa

SEQ ID NO: 677881 - DNA, 22 bp, Artificial Sequence
  chemically synthesized
aggtgcttgttgatttcttccg

SEQ ID NO: 677882 - DNA, 22 bp, Artificial Sequence
  chemically synthesized
caggtgcttgttgatttcttcc

SEQ ID NO: 677883 - DNA, 22 bp, Artificial Sequence
  chemically synthesized
ggtttcacacggaagaaatcaa

SEQ ID NO: 677884 - DNA, 22 bp, Artificial Sequence
  chemically synthesized
gtttcacacggaagaaatcaac

SEQ ID NO: 677885 - DNA, 22 bp, Artificial Sequence
  chemically synthesized
tttcaggtgcttgttgatttct

SEQ ID NO: 677886 - DNA, 22 bp, Artificial Sequence
  chemically synthesized
cacacggaagaaatcaacaagc

SEQ ID NO: 677887 - DNA, 22 bp, Artificial Sequence
  chemically synthesized
acacggaagaaatcaacaagca

SEQ ID NO: 677888 - DNA, 22 bp, Artificial Sequence
  chemically synthesized
ccacgaagatagaaaactgttt

SEQ ID NO: 677889 - DNA, 22 bp, Artificial Sequence
  chemically synthesized
cccacgaagatagaaaactgtt

SEQ ID NO: 677890 - DNA, 22 bp, Artificial Sequence
  chemically synthesized
ttcccacgaagatagaaaactg

SEQ ID NO: 677891 - DNA, 22 bp, Artificial Sequence
  chemically synthesized
cttcccacgaagatagaaaact

SEQ ID NO: 677892 - DNA, 22 bp, Artificial Sequence
  chemically synthesized
tcttcccacgaagatagaaaac

SEQ ID NO: 677893 - DNA, 22 bp, Artificial Sequence
  chemically synthesized
ttcttcccacgaagatagaaaa

SEQ ID NO: 677894 - DNA, 22 bp, Artificial Sequence
  chemically synthesized
tttcttcccacgaagatagaaa

SEQ ID NO: 677895 - DNA, 22 bp, Artificial Sequence
  chemically synthesized
ttttcttcccacgaagatagaa

SEQ ID NO: 677896 - DNA, 22 bp, Artificial Sequence
  chemically synthesized
tttttcttcccacgaagataga

SEQ ID NO: 677897 - DNA, 22 bp, Artificial Sequence
  chemically synthesized
ttttttcttcccacgaagatag

SEQ ID NO: 677898 - DNA, 22 bp, Artificial Sequence
  chemically synthesized
tttttttcttcccacgaagata

SEQ ID NO: 677899 - DNA, 22 bp, Artificial Sequence
  chemically synthesized
aaacagttttctatcttcgtgg

SEQ ID NO: 677900 - DNA, 22 bp, Artificial Sequence
  chemically synthesized
ttttttttcttcccacgaagat

SEQ ID NO: 677901 - DNA, 22 bp, Artificial Sequence
  chemically synthesized
tttttttttttcttcccacgaa

SEQ ID NO: 677902 - DNA, 22 bp, Artificial Sequence
  chemically synthesized
tctatcttcgtgggaagaaaaa

SEQ ID NO: 677903 - DNA, 22 bp, Artificial Sequence
  chemically synthesized
tggctatttttttttttcttcc

SEQ ID NO: 677904 - DNA, 22 bp, Artificial Sequence
  chemically synthesized
ctatcttcgtgggaagaaaaaa

SEQ ID NO: 677905 - DNA, 22 bp, Artificial Sequence
  chemically synthesized
atggctatttttttttttcttc

SEQ ID NO: 677906 - DNA, 22 bp, Artificial Sequence
  chemically synthesized
tatcttcgtgggaagaaaaaaa

SEQ ID NO: 677907 - DNA, 22 bp, Artificial Sequence
  chemically synthesized
tcttcgtgggaagaaaaaaaaa

SEQ ID NO: 677908 - DNA, 22 bp, Artificial Sequence
  chemically synthesized
caatttatggctattttttttt

SEQ ID NO: 677909 - DNA, 22 bp, Artificial Sequence
  chemically synthesized
cgtgggaagaaaaaaaaaaata

SEQ ID NO: 677910 - DNA, 22 bp, Artificial Sequence
  chemically synthesized
gtgggaagaaaaaaaaaaatag

SEQ ID NO: 677911 - DNA, 22 bp, Artificial Sequence
  chemically synthesized
aaatgatggaaaaacagttgca

SEQ ID NO: 677912 - DNA, 22 bp, Artificial Sequence
  chemically synthesized
gtgcctaaaatgatggaaaaac

SEQ ID NO: 677913 - DNA, 22 bp, Artificial Sequence
  chemically synthesized
ggtgcctaaaatgatggaaaaa

SEQ ID NO: 677914 - DNA, 22 bp, Artificial Sequence
  chemically synthesized
tggtgcctaaaatgatggaaaa

SEQ ID NO: 677915 - DNA, 22 bp, Artificial Sequence
  chemically synthesized
tttggtgcctaaaatgatggaa

SEQ ID NO: 677916 - DNA, 22 bp, Artificial Sequence
  chemically synthesized
tctttggtgcctaaaatgatgg

SEQ ID NO: 677917 - DNA, 22 bp, Artificial Sequence
  chemically synthesized
caactgtttttccatcatttta

SEQ ID NO: 677918 - DNA, 22 bp, Artificial Sequence
  chemically synthesized
tagttctctttggtgcctaaaa

SEQ ID NO: 677919 - DNA, 22 bp, Artificial Sequence
  chemically synthesized
tttttccatcattttaggcacc

SEQ ID NO: 677920 - DNA, 22 bp, Artificial Sequence
  chemically synthesized
gtagttctctttggtgcctaaa

SEQ ID NO: 677921 - DNA, 22 bp, Artificial Sequence
  chemically synthesized
tgtagttctctttggtgcctaa

SEQ ID NO: 677922 - DNA, 22 bp, Artificial Sequence
  chemically synthesized
ttccatcattttaggcaccaaa

SEQ ID NO: 677923 - DNA, 22 bp, Artificial Sequence
  chemically synthesized
tccatcattttaggcaccaaag

SEQ ID NO: 677924 - DNA, 22 bp, Artificial Sequence
  chemically synthesized
ccatcattttaggcaccaaaga

SEQ ID NO: 677925 - DNA, 22 bp, Artificial Sequence
  chemically synthesized
catcattttaggcaccaaagag

SEQ ID NO: 677926 - DNA, 22 bp, Artificial Sequence
  chemically synthesized
taggtctttgtagttctctttg

SEQ ID NO: 677927 - DNA, 22 bp, Artificial Sequence
  chemically synthesized
taggcaccaaagagaactacaa

SEQ ID NO: 677928 - DNA, 22 bp, Artificial Sequence
  chemically synthesized
aggcaccaaagagaactacaaa

SEQ ID NO: 677929 - DNA, 22 bp, Artificial Sequence
  chemically synthesized
ggcaccaaagagaactacaaag

SEQ ID NO: 677930 - DNA, 22 bp, Artificial Sequence
  chemically synthesized
agagggcctataggtctttgta

SEQ ID NO: 677931 - DNA, 22 bp, Artificial Sequence
  chemically synthesized
aatatacctgagagggcctata

SEQ ID NO: 677932 - DNA, 22 bp, Artificial Sequence
  chemically synthesized
caaagacctataggccctctca

SEQ ID NO: 677933 - DNA, 22 bp, Artificial Sequence
  chemically synthesized
aaaattcaatatacctgagagg

SEQ ID NO: 677934 - DNA, 22 bp, Artificial Sequence
  chemically synthesized
ctaaaaattcaatatacctgag

SEQ ID NO: 677935 - DNA, 22 bp, Artificial Sequence
  chemically synthesized
taggccctctcaggtatattga

SEQ ID NO: 677936 - DNA, 22 bp, Artificial Sequence
  chemically synthesized
attcctaaaaattcaatatacc

SEQ ID NO: 677937 - DNA, 22 bp, Artificial Sequence
  chemically synthesized
attgattcctaaaaattcaata

SEQ ID NO: 677938 - DNA, 22 bp, Artificial Sequence
  chemically synthesized
tcaggtatattgaatttttagg

SEQ ID NO: 677939 - DNA, 22 bp, Artificial Sequence
  chemically synthesized
aggtatattgaatttttaggaa

SEQ ID NO: 677940 - DNA, 22 bp, Artificial Sequence
  chemically synthesized
gaagttgattgattcctaaaaa

SEQ ID NO: 677941 - DNA, 22 bp, Artificial Sequence
  chemically synthesized
agaagttgattgattcctaaaa

SEQ ID NO: 677942 - DNA, 22 bp, Artificial Sequence
  chemically synthesized
tagaagttgattgattcctaaa

SEQ ID NO: 677943 - DNA, 22 bp, Artificial Sequence
  chemically synthesized
aatttttaggaatcaatcaact

SEQ ID NO: 677944 - DNA, 22 bp, Artificial Sequence
  chemically synthesized
aaaacaagttttagaagttgat

SEQ ID NO: 677945 - DNA, 22 bp, Artificial Sequence
  chemically synthesized
aaaaacaagttttagaagttga

SEQ ID NO: 677946 - DNA, 22 bp, Artificial Sequence
  chemically synthesized
ttaggaatcaatcaacttctaa

SEQ ID NO: 677947 - DNA, 22 bp, Artificial Sequence
  chemically synthesized
taggaatcaatcaacttctaaa

SEQ ID NO: 677948 - DNA, 22 bp, Artificial Sequence
  chemically synthesized
aggaatcaatcaacttctaaaa

SEQ ID NO: 677949 - DNA, 22 bp, Artificial Sequence
  chemically synthesized
cttaaaaacaagttttagaagt

SEQ ID NO: 677950 - DNA, 22 bp, Artificial Sequence
  chemically synthesized
ggaatcaatcaacttctaaaac

SEQ ID NO: 677951 - DNA, 22 bp, Artificial Sequence
  chemically synthesized
tcagaggttccttaaaaacaag

SEQ ID NO: 677952 - DNA, 22 bp, Artificial Sequence
  chemically synthesized
atcagaggttccttaaaaacaa

SEQ ID NO: 677953 - DNA, 22 bp, Artificial Sequence
  chemically synthesized
tatcagaggttccttaaaaaca

SEQ ID NO: 677954 - DNA, 22 bp, Artificial Sequence
  chemically synthesized
ttatcagaggttccttaaaaac

SEQ ID NO: 677955 - DNA, 22 bp, Artificial Sequence
  chemically synthesized
tttatcagaggttccttaaaaa

SEQ ID NO: 677956 - DNA, 22 bp, Artificial Sequence
  chemically synthesized
ctaaaacttgtttttaaggaac

SEQ ID NO: 677957 - DNA, 22 bp, Artificial Sequence
  chemically synthesized
tttttatcagaggttccttaaa

SEQ ID NO: 677958 - DNA, 22 bp, Artificial Sequence
  chemically synthesized
taaaacttgtttttaaggaacc

SEQ ID NO: 677959 - DNA, 22 bp, Artificial Sequence
  chemically synthesized
ctttttatcagaggttccttaa

SEQ ID NO: 677960 - DNA, 22 bp, Artificial Sequence
  chemically synthesized
tctttttatcagaggttcctta

SEQ ID NO: 677961 - DNA, 22 bp, Artificial Sequence
  chemically synthesized
aaacttgtttttaaggaacctc

SEQ ID NO: 677962 - DNA, 22 bp, Artificial Sequence
  chemically synthesized
gtttttaaggaacctctgataa

SEQ ID NO: 677963 - DNA, 22 bp, Artificial Sequence
  chemically synthesized
tttttaaggaacctctgataaa

SEQ ID NO: 677964 - DNA, 22 bp, Artificial Sequence
  chemically synthesized
ttaaggaacctctgataaaaag

SEQ ID NO: 677965 - DNA, 22 bp, Artificial Sequence
  chemically synthesized
acagtcagctttctttttatca

SEQ ID NO: 677966 - DNA, 22 bp, Artificial Sequence
  chemically synthesized
taaggaacctctgataaaaaga

SEQ ID NO: 677967 - DNA, 22 bp, Artificial Sequence
  chemically synthesized
aaggaacctctgataaaaagaa

SEQ ID NO: 677968 - DNA, 22 bp, Artificial Sequence
  chemically synthesized
aggaacctctgataaaaagaaa

SEQ ID NO: 677969 - DNA, 22 bp, Artificial Sequence
  chemically synthesized
tccaaaattgacagtcagcttt

SEQ ID NO: 677970 - DNA, 22 bp, Artificial Sequence
  chemically synthesized
tgataaaaagaaagctgactgt

SEQ ID NO: 677971 - DNA, 22 bp, Artificial Sequence
  chemically synthesized
ctatccaaaattgacagtcagc

SEQ ID NO: 677972 - DNA, 22 bp, Artificial Sequence
  chemically synthesized
ataaaaagaaagctgactgtca

SEQ ID NO: 677973 - DNA, 22 bp, Artificial Sequence
  chemically synthesized
cctatccaaaattgacagtcag

SEQ ID NO: 677974 - DNA, 22 bp, Artificial Sequence
  chemically synthesized
actgtcaattttggataggaag

SEQ ID NO: 677975 - DNA, 22 bp, Artificial Sequence
  chemically synthesized
tcaattttggataggaaggtgc

SEQ ID NO: 677976 - DNA, 22 bp, Artificial Sequence
  chemically synthesized
aagggtgaaagcagtggcacct

SEQ ID NO: 677977 - DNA, 22 bp, Artificial Sequence
  chemically synthesized
caagggtgaaagcagtggcacc

SEQ ID NO: 677978 - DNA, 22 bp, Artificial Sequence
  chemically synthesized
tggataggaaggtgccactgct

SEQ ID NO: 677979 - DNA, 22 bp, Artificial Sequence
  chemically synthesized
ggataggaaggtgccactgctt

SEQ ID NO: 677980 - DNA, 22 bp, Artificial Sequence
  chemically synthesized
tttcaagggtgaaagcagtggc

SEQ ID NO: 677981 - DNA, 22 bp, Artificial Sequence
  chemically synthesized
gataggaaggtgccactgcttt

SEQ ID NO: 677982 - DNA, 22 bp, Artificial Sequence
  chemically synthesized
gattgtttcaagggtgaaagca

SEQ ID NO: 677983 - DNA, 22 bp, Artificial Sequence
  chemically synthesized
ctttcacccttgaaacaatcta

SEQ ID NO: 677984 - DNA, 22 bp, Artificial Sequence
  chemically synthesized
tataaatacatcactagattgt

SEQ ID NO: 677985 - DNA, 22 bp, Artificial Sequence
  chemically synthesized
tcacccttgaaacaatctagtg

SEQ ID NO: 677986 - DNA, 22 bp, Artificial Sequence
  chemically synthesized
cacccttgaaacaatctagtga

SEQ ID NO: 677987 - DNA, 22 bp, Artificial Sequence
  chemically synthesized
acccttgaaacaatctagtgat

SEQ ID NO: 677988 - DNA, 22 bp, Artificial Sequence
  chemically synthesized
ctatataaatacatcactagat

SEQ ID NO: 677989 - DNA, 22 bp, Artificial Sequence
  chemically synthesized
gctatataaatacatcactaga

SEQ ID NO: 677990 - DNA, 22 bp, Artificial Sequence
  chemically synthesized
cttgctatataaatacatcact

SEQ ID NO: 677991 - DNA, 22 bp, Artificial Sequence
  chemically synthesized
gaaacaatctagtgatgtattt

SEQ ID NO: 677992 - DNA, 22 bp, Artificial Sequence
  chemically synthesized
aaacaatctagtgatgtattta

SEQ ID NO: 677993 - DNA, 22 bp, Artificial Sequence
  chemically synthesized
gtgatgtatttatatagcaagt

SEQ ID NO: 677994 - DNA, 22 bp, Artificial Sequence
  chemically synthesized
cagtgtgaaagttacttgctat

SEQ ID NO: 677995 - DNA, 22 bp, Artificial Sequence
  chemically synthesized
gcagtgtgaaagttacttgcta

SEQ ID NO: 677996 - DNA, 22 bp, Artificial Sequence
  chemically synthesized
atatagcaagtaactttcacac

SEQ ID NO: 677997 - DNA, 22 bp, Artificial Sequence
  chemically synthesized
tatagcaagtaactttcacact

SEQ ID NO: 677998 - DNA, 22 bp, Artificial Sequence
  chemically synthesized
ggataaagtagtttgcagtgtg

SEQ ID NO: 677999 - DNA, 22 bp, Artificial Sequence
  chemically synthesized
aggataaagtagtttgcagtgt

SEQ ID NO: 678000 - DNA, 22 bp, Artificial Sequence
  chemically synthesized
taggataaagtagtttgcagtg

SEQ ID NO: 678001 - DNA, 22 bp, Artificial Sequence
  chemically synthesized
tcacactgcaaactactttatc

SEQ ID NO: 678002 - DNA, 22 bp, Artificial Sequence
  chemically synthesized
cacactgcaaactactttatcc

SEQ ID NO: 678003 - DNA, 22 bp, Artificial Sequence
  chemically synthesized
acactgcaaactactttatcct

SEQ ID NO: 678004 - DNA, 22 bp, Artificial Sequence
  chemically synthesized
aatgacaggtgacctttaggat

SEQ ID NO: 678005 - DNA, 22 bp, Artificial Sequence
  chemically synthesized
caaactactttatcctaaaggt

SEQ ID NO: 678006 - DNA, 22 bp, Artificial Sequence
  chemically synthesized
caagttaaatgacaggtgacct

SEQ ID NO: 678007 - DNA, 22 bp, Artificial Sequence
  chemically synthesized
ctttatcctaaaggtcacctgt

SEQ ID NO: 678008 - DNA, 22 bp, Artificial Sequence
  chemically synthesized
ctccaagttaaatgacaggtga

SEQ ID NO: 678009 - DNA, 22 bp, Artificial Sequence
  chemically synthesized
tatcctaaaggtcacctgtcat

SEQ ID NO: 678010 - DNA, 22 bp, Artificial Sequence
  chemically synthesized
cctccaagttaaatgacaggtg

SEQ ID NO: 678011 - DNA, 22 bp, Artificial Sequence
  chemically synthesized
atcctaaaggtcacctgtcatt

SEQ ID NO: 678012 - DNA, 22 bp, Artificial Sequence
  chemically synthesized
tcctaaaggtcacctgtcattt

SEQ ID NO: 678013 - DNA, 22 bp, Artificial Sequence
  chemically synthesized
aaggtcacctgtcatttaactt

SEQ ID NO: 678014 - DNA, 22 bp, Artificial Sequence
  chemically synthesized
tcatttaacttggaggaaacat

SEQ ID NO: 678015 - DNA, 22 bp, Artificial Sequence
  chemically synthesized
ggtaaggacatggccatgtttc

SEQ ID NO: 678016 - DNA, 22 bp, Artificial Sequence
  chemically synthesized
aggtaaggacatggccatgttt

SEQ ID NO: 678017 - DNA, 22 bp, Artificial Sequence
  chemically synthesized
taggtaaggacatggccatgtt

SEQ ID NO: 678018 - DNA, 22 bp, Artificial Sequence
  chemically synthesized
aacttggaggaaacatggccat

SEQ ID NO: 678019 - DNA, 22 bp, Artificial Sequence
  chemically synthesized
acttggaggaaacatggccatg

SEQ ID NO: 678020 - DNA, 22 bp, Artificial Sequence
  chemically synthesized
ggaggaaacatggccatgtcct

SEQ ID NO: 678021 - DNA, 22 bp, Artificial Sequence
  chemically synthesized
gaggaaacatggccatgtcctt

SEQ ID NO: 678022 - DNA, 22 bp, Artificial Sequence
  chemically synthesized
ccagtctttaggtaaggacatg

SEQ ID NO: 678023 - DNA, 22 bp, Artificial Sequence
  chemically synthesized
taccagtctttaggtaaggaca

SEQ ID NO: 678024 - DNA, 22 bp, Artificial Sequence
  chemically synthesized
acctaaagactggtagagctct

SEQ ID NO: 678025 - DNA, 22 bp, Artificial Sequence
  chemically synthesized
cctaaagactggtagagctctg

SEQ ID NO: 678026 - DNA, 22 bp, Artificial Sequence
  chemically synthesized
aagactggtagagctctgtcat

SEQ ID NO: 678027 - DNA, 22 bp, Artificial Sequence
  chemically synthesized
ggaccatcccaaaatgacagag

SEQ ID NO: 678028 - DNA, 22 bp, Artificial Sequence
  chemically synthesized
ctgggaccatcccaaaatgaca

SEQ ID NO: 678029 - DNA, 22 bp, Artificial Sequence
  chemically synthesized
gctgggaccatcccaaaatgac

SEQ ID NO: 678030 - DNA, 22 bp, Artificial Sequence
  chemically synthesized
gtagagctctgtcattttggga

SEQ ID NO: 678031 - DNA, 22 bp, Artificial Sequence
  chemically synthesized
aaacaacttgctgggaccatcc

SEQ ID NO: 678032 - DNA, 22 bp, Artificial Sequence
  chemically synthesized
tgtcattttgggatggtcccag

SEQ ID NO: 678033 - DNA, 22 bp, Artificial Sequence
  chemically synthesized
tcattttgggatggtcccagca

SEQ ID NO: 678034 - DNA, 22 bp, Artificial Sequence
  chemically synthesized
tgggatggtcccagcaagttgt

SEQ ID NO: 678035 - DNA, 22 bp, Artificial Sequence
  chemically synthesized
gggatggtcccagcaagttgtt

SEQ ID NO: 678036 - DNA, 22 bp, Artificial Sequence
  chemically synthesized
ggatggtcccagcaagttgttt

SEQ ID NO: 678037 - DNA, 22 bp, Artificial Sequence
  chemically synthesized
gccacgagactcaaacaacttg

SEQ ID NO: 678038 - DNA, 22 bp, Artificial Sequence
  chemically synthesized
agccacgagactcaaacaactt

SEQ ID NO: 678039 - DNA, 22 bp, Artificial Sequence
  chemically synthesized
tagccacgagactcaaacaact

SEQ ID NO: 678040 - DNA, 22 bp, Artificial Sequence
  chemically synthesized
tgttttagccacgagactcaaa

SEQ ID NO: 678041 - DNA, 22 bp, Artificial Sequence
  chemically synthesized
gtgttttagccacgagactcaa

SEQ ID NO: 678042 - DNA, 22 bp, Artificial Sequence
  chemically synthesized
tgtgttttagccacgagactca

SEQ ID NO: 678043 - DNA, 22 bp, Artificial Sequence
  chemically synthesized
tgttttgtgttttagccacgag

SEQ ID NO: 678044 - DNA, 22 bp, Artificial Sequence
  chemically synthesized
atgttttgtgttttagccacga

SEQ ID NO: 678045 - DNA, 22 bp, Artificial Sequence
  chemically synthesized
tatgttttgtgttttagccacg

SEQ ID NO: 678046 - DNA, 22 bp, Artificial Sequence
  chemically synthesized
tttatgttttgtgttttagcca

SEQ ID NO: 678047 - DNA, 22 bp, Artificial Sequence
  chemically synthesized
tttgagtctcgtggctaaaaca

SEQ ID NO: 678048 - DNA, 22 bp, Artificial Sequence
  chemically synthesized
ctttatgttttgtgttttagcc

SEQ ID NO: 678049 - DNA, 22 bp, Artificial Sequence
  chemically synthesized
tctttatgttttgtgttttagc

SEQ ID NO: 678050 - DNA, 22 bp, Artificial Sequence
  chemically synthesized
gagtctcgtggctaaaacacaa

SEQ ID NO: 678051 - DNA, 22 bp, Artificial Sequence
  chemically synthesized
agtctcgtggctaaaacacaaa

SEQ ID NO: 678052 - DNA, 22 bp, Artificial Sequence
  chemically synthesized
aagtctttctttatgttttgtg

SEQ ID NO: 678053 - DNA, 22 bp, Artificial Sequence
  chemically synthesized
gtggctaaaacacaaaacataa

SEQ ID NO: 678054 - DNA, 22 bp, Artificial Sequence
  chemically synthesized
aaacacaaaacataaagaaaga

SEQ ID NO: 678055 - DNA, 22 bp, Artificial Sequence
  chemically synthesized
taaatgctaaagtctttcttta

SEQ ID NO: 678056 - DNA, 22 bp, Artificial Sequence
  chemically synthesized
attgtaaatgctaaagtctttc

SEQ ID NO: 678057 - DNA, 22 bp, Artificial Sequence
  chemically synthesized
ctcattgtaaatgctaaagtct

SEQ ID NO: 678058 - DNA, 22 bp, Artificial Sequence
  chemically synthesized
actactcattgtaaatgctaaa

SEQ ID NO: 678059 - DNA, 22 bp, Artificial Sequence
  chemically synthesized
gactactcattgtaaatgctaa

SEQ ID NO: 678060 - DNA, 22 bp, Artificial Sequence
  chemically synthesized
ttgactactcattgtaaatgct

SEQ ID NO: 678061 - DNA, 22 bp, Artificial Sequence
  chemically synthesized
cttgactactcattgtaaatgc

SEQ ID NO: 678062 - DNA, 22 bp, Artificial Sequence
  chemically synthesized
tcttgactactcattgtaaatg

SEQ ID NO: 678063 - DNA, 22 bp, Artificial Sequence
  chemically synthesized
ttttcttgactactcattgtaa

SEQ ID NO: 678064 - DNA, 22 bp, Artificial Sequence
  chemically synthesized
ctgttttcttgactactcattg

SEQ ID NO: 678065 - DNA, 22 bp, Artificial Sequence
  chemically synthesized
cctgttttcttgactactcatt

SEQ ID NO: 678066 - DNA, 22 bp, Artificial Sequence
  chemically synthesized
tcctgttttcttgactactcat

SEQ ID NO: 678067 - DNA, 22 bp, Artificial Sequence
  chemically synthesized
tagcatttacaatgagtagtca

SEQ ID NO: 678068 - DNA, 22 bp, Artificial Sequence
  chemically synthesized
ttcctgttttcttgactactca

SEQ ID NO: 678069 - DNA, 22 bp, Artificial Sequence
  chemically synthesized
agcatttacaatgagtagtcaa

SEQ ID NO: 678070 - DNA, 22 bp, Artificial Sequence
  chemically synthesized
tttcctgttttcttgactactc

SEQ ID NO: 678071 - DNA, 22 bp, Artificial Sequence
  chemically synthesized
gcatttacaatgagtagtcaag

SEQ ID NO: 678072 - DNA, 22 bp, Artificial Sequence
  chemically synthesized
ttttcctgttttcttgactact

SEQ ID NO: 678073 - DNA, 22 bp, Artificial Sequence
  chemically synthesized
ttttttcctgttttcttgacta

SEQ ID NO: 678074 - DNA, 22 bp, Artificial Sequence
  chemically synthesized
cttttttcctgttttcttgact

SEQ ID NO: 678075 - DNA, 22 bp, Artificial Sequence
  chemically synthesized
tcttttttcctgttttcttgac

SEQ ID NO: 678076 - DNA, 22 bp, Artificial Sequence
  chemically synthesized
acaatgagtagtcaagaaaaca

SEQ ID NO: 678077 - DNA, 22 bp, Artificial Sequence
  chemically synthesized
caatgagtagtcaagaaaacag

SEQ ID NO: 678078 - DNA, 22 bp, Artificial Sequence
  chemically synthesized
ttttcttttttcctgttttctt

SEQ ID NO: 678079 - DNA, 22 bp, Artificial Sequence
  chemically synthesized
ttgttttcttttttcctgtttt

SEQ ID NO: 678080 - DNA, 22 bp, Artificial Sequence
  chemically synthesized
ttgttgttttcttttttcctgt

SEQ ID NO: 678081 - DNA, 22 bp, Artificial Sequence
  chemically synthesized
ttattgttgttttcttttttcc

SEQ ID NO: 678082 - DNA, 22 bp, Artificial Sequence
  chemically synthesized
ttgttattgttgttttcttttt

SEQ ID NO: 678083 - DNA, 22 bp, Artificial Sequence
  chemically synthesized
aaaagcaaaaatcatgttgttg

SEQ ID NO: 678084 - DNA, 22 bp, Artificial Sequence
  chemically synthesized
cgaatggttcaaaagcaaaaat

SEQ ID NO: 678085 - DNA, 22 bp, Artificial Sequence
  chemically synthesized
aaataaagattccgaatggttc

SEQ ID NO: 678086 - DNA, 22 bp, Artificial Sequence
  chemically synthesized
gaaataaagattccgaatggtt

SEQ ID NO: 678087 - DNA, 22 bp, Artificial Sequence
  chemically synthesized
tgaaataaagattccgaatggt

SEQ ID NO: 678088 - DNA, 22 bp, Artificial Sequence
  chemically synthesized
ttgcttttgaaccattcggaat

SEQ ID NO: 678089 - DNA, 22 bp, Artificial Sequence
  chemically synthesized
tgcttttgaaccattcggaatc

SEQ ID NO: 678090 - DNA, 22 bp, Artificial Sequence
  chemically synthesized
gcttttgaaccattcggaatct

SEQ ID NO: 678091 - DNA, 22 bp, Artificial Sequence
  chemically synthesized
cttttgaaccattcggaatctt

SEQ ID NO: 678092 - DNA, 22 bp, Artificial Sequence
  chemically synthesized
ttgaaccattcggaatctttat

SEQ ID NO: 678093 - DNA, 22 bp, Artificial Sequence
  chemically synthesized
tgaaccattcggaatctttatt

SEQ ID NO: 678094 - DNA, 22 bp, Artificial Sequence
  chemically synthesized
gaaccattcggaatctttattt

SEQ ID NO: 678095 - DNA, 22 bp, Artificial Sequence
  chemically synthesized
aaccattcggaatctttatttc

SEQ ID NO: 678096 - DNA, 22 bp, Artificial Sequence
  chemically synthesized
tggaagcgctttgaaataaaga

SEQ ID NO: 678097 - DNA, 22 bp, Artificial Sequence
  chemically synthesized
ggaatctttatttcaaagcgct

SEQ ID NO: 678098 - DNA, 22 bp, Artificial Sequence
  chemically synthesized
aatacactatggaagcgctttg

SEQ ID NO: 678099 - DNA, 22 bp, Artificial Sequence
  chemically synthesized
caatacactatggaagcgcttt

SEQ ID NO: 678100 - DNA, 22 bp, Artificial Sequence
  chemically synthesized
ttcaatacactatggaagcgct

SEQ ID NO: 678101 - DNA, 22 bp, Artificial Sequence
  chemically synthesized
cttcaatacactatggaagcgc

SEQ ID NO: 678102 - DNA, 22 bp, Artificial Sequence
  chemically synthesized
tatttcaaagcgcttccatagt

SEQ ID NO: 678103 - DNA, 22 bp, Artificial Sequence
  chemically synthesized
atttcaaagcgcttccatagtg

SEQ ID NO: 678104 - DNA, 22 bp, Artificial Sequence
  chemically synthesized
tttcaaagcgcttccatagtgt

SEQ ID NO: 678105 - DNA, 22 bp, Artificial Sequence
  chemically synthesized
caaagcgcttccatagtgtatt

SEQ ID NO: 678106 - DNA, 22 bp, Artificial Sequence
  chemically synthesized
aaagcgcttccatagtgtattg

SEQ ID NO: 678107 - DNA, 22 bp, Artificial Sequence
  chemically synthesized
taagataaacatttcttcaata

SEQ ID NO: 678108 - DNA, 22 bp, Artificial Sequence
  chemically synthesized
gtaagataaacatttcttcaat

SEQ ID NO: 678109 - DNA, 22 bp, Artificial Sequence
  chemically synthesized
ccatagtgtattgaagaaatgt

SEQ ID NO: 678110 - DNA, 22 bp, Artificial Sequence
  chemically synthesized
cttgtaagataaacatttcttc

SEQ ID NO: 678111 - DNA, 22 bp, Artificial Sequence
  chemically synthesized
catagtgtattgaagaaatgtt

SEQ ID NO: 678112 - DNA, 22 bp, Artificial Sequence
  chemically synthesized
tgcttgtaagataaacatttct

SEQ ID NO: 678113 - DNA, 22 bp, Artificial Sequence
  chemically synthesized
ctgcttgtaagataaacatttc

SEQ ID NO: 678114 - DNA, 22 bp, Artificial Sequence
  chemically synthesized
tctgcttgtaagataaacattt

SEQ ID NO: 678115 - DNA, 22 bp, Artificial Sequence
  chemically synthesized
aagaaatgtttatcttacaagc

SEQ ID NO: 678116 - DNA, 22 bp, Artificial Sequence
  chemically synthesized
atcttacaagcagaaaggcccc

SEQ ID NO: 678117 - DNA, 22 bp, Artificial Sequence
  chemically synthesized
tcttacaagcagaaaggcccct

SEQ ID NO: 678118 - DNA, 22 bp, Artificial Sequence
  chemically synthesized
gaaacaaagcagaaaggggcct

SEQ ID NO: 678119 - DNA, 22 bp, Artificial Sequence
  chemically synthesized
ggaaacaaagcagaaaggggcc

SEQ ID NO: 678120 - DNA, 22 bp, Artificial Sequence
  chemically synthesized
acaagcagaaaggcccctttct

SEQ ID NO: 678121 - DNA, 22 bp, Artificial Sequence
  chemically synthesized
tggaaacaaagcagaaaggggc

SEQ ID NO: 678122 - DNA, 22 bp, Artificial Sequence
  chemically synthesized
caagcagaaaggcccctttctg

SEQ ID NO: 678123 - DNA, 22 bp, Artificial Sequence
  chemically synthesized
tttggaaacaaagcagaaaggg

SEQ ID NO: 678124 - DNA, 22 bp, Artificial Sequence
  chemically synthesized
tctttggaaacaaagcagaaag

SEQ ID NO: 678125 - DNA, 22 bp, Artificial Sequence
  chemically synthesized
ctctttggaaacaaagcagaaa

SEQ ID NO: 678126 - DNA, 22 bp, Artificial Sequence
  chemically synthesized
tctctttggaaacaaagcagaa

SEQ ID NO: 678127 - DNA, 22 bp, Artificial Sequence
  chemically synthesized
ttctctttggaaacaaagcaga

SEQ ID NO: 678128 - DNA, 22 bp, Artificial Sequence
  chemically synthesized
cttttctctttggaaacaaagc

SEQ ID NO: 678129 - DNA, 22 bp, Artificial Sequence
  chemically synthesized
tattgcttttctctttggaaac

SEQ ID NO: 678130 - DNA, 22 bp, Artificial Sequence
  chemically synthesized
atattgcttttctctttggaaa

SEQ ID NO: 678131 - DNA, 22 bp, Artificial Sequence
  chemically synthesized
tctgctttgtttccaaagagaa

SEQ ID NO: 678132 - DNA, 22 bp, Artificial Sequence
  chemically synthesized
ctgctttgtttccaaagagaaa

SEQ ID NO: 678133 - DNA, 22 bp, Artificial Sequence
  chemically synthesized
tgctttgtttccaaagagaaaa

SEQ ID NO: 678134 - DNA, 22 bp, Artificial Sequence
  chemically synthesized
ctttgtttccaaagagaaaagc

SEQ ID NO: 678135 - DNA, 22 bp, Artificial Sequence
  chemically synthesized
tgtttccaaagagaaaagcaat

SEQ ID NO: 678136 - DNA, 22 bp, Artificial Sequence
  chemically synthesized
gtttccaaagagaaaagcaata

SEQ ID NO: 678137 - DNA, 22 bp, Artificial Sequence
  chemically synthesized
tttccaaagagaaaagcaatat

SEQ ID NO: 678138 - DNA, 22 bp, Artificial Sequence
  chemically synthesized
ccaaagagaaaagcaatataaa

SEQ ID NO: 678139 - DNA, 22 bp, Artificial Sequence
  chemically synthesized
caaagagaaaagcaatataaac

SEQ ID NO: 678140 - DNA, 22 bp, Artificial Sequence
  chemically synthesized
gaaccgaataatgtttatattg

SEQ ID NO: 678141 - DNA, 22 bp, Artificial Sequence
  chemically synthesized
tggaaccgaataatgtttatat

SEQ ID NO: 678142 - DNA, 22 bp, Artificial Sequence
  chemically synthesized
ttcggttccagaatttgtttct

SEQ ID NO: 678143 - DNA, 22 bp, Artificial Sequence
  chemically synthesized
tgggtgcaaagaagaaacaaat

SEQ ID NO: 678144 - DNA, 22 bp, Artificial Sequence
  chemically synthesized
gtgggtgcaaagaagaaacaaa

SEQ ID NO: 678145 - DNA, 22 bp, Artificial Sequence
  chemically synthesized
ggttccagaatttgtttcttct

SEQ ID NO: 678146 - DNA, 22 bp, Artificial Sequence
  chemically synthesized
cagaatttgtttcttctttgca

SEQ ID NO: 678147 - DNA, 22 bp, Artificial Sequence
  chemically synthesized
gtttcttctttgcacccacaaa

SEQ ID NO: 678148 - DNA, 22 bp, Artificial Sequence
  chemically synthesized
aagtgcgatcgatttgtgggtg

SEQ ID NO: 678149 - DNA, 22 bp, Artificial Sequence
  chemically synthesized
tttcttctttgcacccacaaat

SEQ ID NO: 678150 - DNA, 22 bp, Artificial Sequence
  chemically synthesized
cttctttgcacccacaaatcga

SEQ ID NO: 678151 - DNA, 22 bp, Artificial Sequence
  chemically synthesized
ttctttgcacccacaaatcgat

SEQ ID NO: 678152 - DNA, 22 bp, Artificial Sequence
  chemically synthesized
ctttgcacccacaaatcgatcg

SEQ ID NO: 678153 - DNA, 22 bp, Artificial Sequence
  chemically synthesized
tttgcacccacaaatcgatcgc

SEQ ID NO: 678154 - DNA, 22 bp, Artificial Sequence
  chemically synthesized
tcataactgaagtgcgatcgat

SEQ ID NO: 678155 - DNA, 22 bp, Artificial Sequence
  chemically synthesized
tgcacccacaaatcgatcgcac

SEQ ID NO: 678156 - DNA, 22 bp, Artificial Sequence
  chemically synthesized
atcataactgaagtgcgatcga

SEQ ID NO: 678157 - DNA, 22 bp, Artificial Sequence
  chemically synthesized
gcacccacaaatcgatcgcact

SEQ ID NO: 678158 - DNA, 22 bp, Artificial Sequence
  chemically synthesized
cacccacaaatcgatcgcactt

SEQ ID NO: 678159 - DNA, 22 bp, Artificial Sequence
  chemically synthesized
atcacataacaaggtcaattta

SEQ ID NO: 678160 - DNA, 22 bp, Artificial Sequence
  chemically synthesized
cagttatgataaattgaccttg

SEQ ID NO: 678161 - DNA, 22 bp, Artificial Sequence
  chemically synthesized
ttgatcacataacaaggtcaat

SEQ ID NO: 678162 - DNA, 22 bp, Artificial Sequence
  chemically synthesized
agttatgataaattgaccttgt

SEQ ID NO: 678163 - DNA, 22 bp, Artificial Sequence
  chemically synthesized
tgataaattgaccttgttatgt

SEQ ID NO: 678164 - DNA, 22 bp, Artificial Sequence
  chemically synthesized
atagtcgattattgatcacata

SEQ ID NO: 678165 - DNA, 22 bp, Artificial Sequence
  chemically synthesized
accttgttatgtgatcaataat

SEQ ID NO: 678166 - DNA, 22 bp, Artificial Sequence
  chemically synthesized
gttatgtgatcaataatcgact

SEQ ID NO: 678167 - DNA, 22 bp, Artificial Sequence
  chemically synthesized
ttatgtgatcaataatcgacta

SEQ ID NO: 678168 - DNA, 22 bp, Artificial Sequence
  chemically synthesized
tgtgatcaataatcgactatca

SEQ ID NO: 678169 - DNA, 22 bp, Artificial Sequence
  chemically synthesized
gatgggtgaagaagtcctgata

SEQ ID NO: 678170 - DNA, 22 bp, Artificial Sequence
  chemically synthesized
cacattggatgggtgaagaagt

SEQ ID NO: 678171 - DNA, 22 bp, Artificial Sequence
  chemically synthesized
tcaggacttcttcacccatcca

SEQ ID NO: 678172 - DNA, 22 bp, Artificial Sequence
  chemically synthesized
tagtgttccacattggatgggt

SEQ ID NO: 678173 - DNA, 22 bp, Artificial Sequence
  chemically synthesized
tgtagtgttccacattggatgg

SEQ ID NO: 678174 - DNA, 22 bp, Artificial Sequence
  chemically synthesized
ctgtagtgttccacattggatg

SEQ ID NO: 678175 - DNA, 22 bp, Artificial Sequence
  chemically synthesized
tctgtagtgttccacattggat

SEQ ID NO: 678176 - DNA, 22 bp, Artificial Sequence
  chemically synthesized
cttcacccatccaatgtggaac

SEQ ID NO: 678177 - DNA, 22 bp, Artificial Sequence
  chemically synthesized
ttcacccatccaatgtggaaca

SEQ ID NO: 678178 - DNA, 22 bp, Artificial Sequence
  chemically synthesized
cacccatccaatgtggaacact

SEQ ID NO: 678179 - DNA, 22 bp, Artificial Sequence
  chemically synthesized
acccatccaatgtggaacacta

SEQ ID NO: 678180 - DNA, 22 bp, Artificial Sequence
  chemically synthesized
tcggtgtcctttctgtagtgtt

SEQ ID NO: 678181 - DNA, 22 bp, Artificial Sequence
  chemically synthesized
aataataatcagttgtcggtgt

SEQ ID NO: 678182 - DNA, 22 bp, Artificial Sequence
  chemically synthesized
cagaaaggacaccgacaactga

SEQ ID NO: 678183 - DNA, 22 bp, Artificial Sequence
  chemically synthesized
acagagttgaataataatcagt

SEQ ID NO: 678184 - DNA, 22 bp, Artificial Sequence
  chemically synthesized
gacagagttgaataataatcag

SEQ ID NO: 678185 - DNA, 22 bp, Artificial Sequence
  chemically synthesized
tgacagagttgaataataatca

SEQ ID NO: 678186 - DNA, 22 bp, Artificial Sequence
  chemically synthesized
tttgacagagttgaataataat

SEQ ID NO: 678187 - DNA, 22 bp, Artificial Sequence
  chemically synthesized
attattattcaactctgtcaaa

SEQ ID NO: 678188 - DNA, 22 bp, Artificial Sequence
  chemically synthesized
atgtccggtatctctttgacag

SEQ ID NO: 678189 - DNA, 22 bp, Artificial Sequence
  chemically synthesized
ttattcaactctgtcaaagaga

SEQ ID NO: 678190 - DNA, 22 bp, Artificial Sequence
  chemically synthesized
ttcaactctgtcaaagagatac

SEQ ID NO: 678191 - DNA, 22 bp, Artificial Sequence
  chemically synthesized
aactaatgtccggtatctcttt

SEQ ID NO: 678192 - DNA, 22 bp, Artificial Sequence
  chemically synthesized
aactctgtcaaagagataccgg

SEQ ID NO: 678193 - DNA, 22 bp, Artificial Sequence
  chemically synthesized
ttgaactaatgtccggtatctc

SEQ ID NO: 678194 - DNA, 22 bp, Artificial Sequence
  chemically synthesized
attgaactaatgtccggtatct

SEQ ID NO: 678195 - DNA, 22 bp, Artificial Sequence
  chemically synthesized
tgtcaaagagataccggacatt

SEQ ID NO: 678196 - DNA, 22 bp, Artificial Sequence
  chemically synthesized
tatttattgaactaatgtccgg

SEQ ID NO: 678197 - DNA, 22 bp, Artificial Sequence
  chemically synthesized
tcaaagagataccggacattag

SEQ ID NO: 678198 - DNA, 22 bp, Artificial Sequence
  chemically synthesized
atatttattgaactaatgtccg

SEQ ID NO: 678199 - DNA, 22 bp, Artificial Sequence
  chemically synthesized
gttcaataaatataaatcatct

SEQ ID NO: 678200 - DNA, 22 bp, Artificial Sequence
  chemically synthesized
aataaatataaatcatctcact

SEQ ID NO: 678201 - DNA, 22 bp, Artificial Sequence
  chemically synthesized
acttctcatttgctttcactgc

SEQ ID NO: 678202 - DNA, 22 bp, Artificial Sequence
  chemically synthesized
ctcatttgctttcactgcccct

SEQ ID NO: 678203 - DNA, 22 bp, Artificial Sequence
  chemically synthesized
tcatttgctttcactgcccctg

SEQ ID NO: 678204 - DNA, 22 bp, Artificial Sequence
  chemically synthesized
atttgctttcactgcccctgac

SEQ ID NO: 678205 - DNA, 22 bp, Artificial Sequence
  chemically synthesized
gctttcactgcccctgacattt

SEQ ID NO: 678206 - DNA, 22 bp, Artificial Sequence
  chemically synthesized
ctttcactgcccctgacatttt

SEQ ID NO: 678207 - DNA, 22 bp, Artificial Sequence
  chemically synthesized
tcactgcccctgacatttttcc

SEQ ID NO: 678208 - DNA, 22 bp, Artificial Sequence
  chemically synthesized
cactgcccctgacatttttcca

SEQ ID NO: 678209 - DNA, 22 bp, Artificial Sequence
  chemically synthesized
actgcccctgacatttttccat

SEQ ID NO: 678210 - DNA, 22 bp, Artificial Sequence
  chemically synthesized
cccctgacatttttccattact

SEQ ID NO: 678211 - DNA, 22 bp, Artificial Sequence
  chemically synthesized
tatatgtagaggaaagagtaat

SEQ ID NO: 678212 - DNA, 22 bp, Artificial Sequence
  chemically synthesized
acatttttccattactctttcc

SEQ ID NO: 678213 - DNA, 22 bp, Artificial Sequence
  chemically synthesized
ttccattactctttcctctaca

SEQ ID NO: 678214 - DNA, 22 bp, Artificial Sequence
  chemically synthesized
tccattactctttcctctacat

SEQ ID NO: 678215 - DNA, 22 bp, Artificial Sequence
  chemically synthesized
ccattactctttcctctacata

SEQ ID NO: 678216 - DNA, 22 bp, Artificial Sequence
  chemically synthesized
cattactctttcctctacatat

SEQ ID NO: 678217 - DNA, 22 bp, Artificial Sequence
  chemically synthesized
ctctttcctctacatatacaga

SEQ ID NO: 678218 - DNA, 22 bp, Artificial Sequence
  chemically synthesized
tttcctctacatatacagatct

SEQ ID NO: 678219 - DNA, 22 bp, Artificial Sequence
  chemically synthesized
tcctctacatatacagatctca

SEQ ID NO: 678220 - DNA, 22 bp, Artificial Sequence
  chemically synthesized
cctctacatatacagatctcat

SEQ ID NO: 678221 - DNA, 22 bp, Artificial Sequence
  chemically synthesized
ctctacatatacagatctcata

SEQ ID NO: 678222 - DNA, 22 bp, Artificial Sequence
  chemically synthesized
tacatatacagatctcatatcc

SEQ ID NO: 678223 - DNA, 22 bp, Artificial Sequence
  chemically synthesized
catatacagatctcatatccat

SEQ ID NO: 678224 - DNA, 22 bp, Artificial Sequence
  chemically synthesized
aaatgaaatacaggtatcatgg

SEQ ID NO: 678225 - DNA, 22 bp, Artificial Sequence
  chemically synthesized
agctgaaatgaaatacaggtat

SEQ ID NO: 678226 - DNA, 22 bp, Artificial Sequence
  chemically synthesized
aagctgaaatgaaatacaggta

SEQ ID NO: 678227 - DNA, 22 bp, Artificial Sequence
  chemically synthesized
atatccatgatacctgtatttc

SEQ ID NO: 678228 - DNA, 22 bp, Artificial Sequence
  chemically synthesized
tatttcatttcagcttaaggta

SEQ ID NO: 678229 - DNA, 22 bp, Artificial Sequence
  chemically synthesized
gtcaggcagtagatatacctta

SEQ ID NO: 678230 - DNA, 22 bp, Artificial Sequence
  chemically synthesized
catttcagcttaaggtatatct

SEQ ID NO: 678231 - DNA, 22 bp, Artificial Sequence
  chemically synthesized
atttcagcttaaggtatatcta

SEQ ID NO: 678232 - DNA, 22 bp, Artificial Sequence
  chemically synthesized
cagcttaaggtatatctactgc

SEQ ID NO: 678233 - DNA, 22 bp, Artificial Sequence
  chemically synthesized
agcttaaggtatatctactgcc

SEQ ID NO: 678234 - DNA, 22 bp, Artificial Sequence
  chemically synthesized
tgatatattagtcaggcagtag

SEQ ID NO: 678235 - DNA, 22 bp, Artificial Sequence
  chemically synthesized
aaggtatatctactgcctgact

SEQ ID NO: 678236 - DNA, 22 bp, Artificial Sequence
  chemically synthesized
aggtatatctactgcctgacta

SEQ ID NO: 678237 - DNA, 22 bp, Artificial Sequence
  chemically synthesized
ctgcctgactaatatatcataa

SEQ ID NO: 678238 - DNA, 22 bp, Artificial Sequence
  chemically synthesized
cctgactaatatatcataactt

SEQ ID NO: 678239 - DNA, 22 bp, Artificial Sequence
  chemically synthesized
actaatatatcataacttcctt

SEQ ID NO: 678240 - DNA, 22 bp, Artificial Sequence
  chemically synthesized
aaataatgggaagaaggaagtt

SEQ ID NO: 678241 - DNA, 22 bp, Artificial Sequence
  chemically synthesized
tgaaataatgggaagaaggaag

SEQ ID NO: 678242 - DNA, 22 bp, Artificial Sequence
  chemically synthesized
atatatcataacttccttcttc

SEQ ID NO: 678243 - DNA, 22 bp, Artificial Sequence
  chemically synthesized
aagaaaaaacactctgaaataa

SEQ ID NO: 678244 - DNA, 22 bp, Artificial Sequence
  chemically synthesized
ccttcttcccattatttcagag

SEQ ID NO: 678245 - DNA, 22 bp, Artificial Sequence
  chemically synthesized
aaagaaaaaacactctgaaata

SEQ ID NO: 678246 - DNA, 22 bp, Artificial Sequence
  chemically synthesized
cttcttcccattatttcagagt

SEQ ID NO: 678247 - DNA, 22 bp, Artificial Sequence
  chemically synthesized
cttcccattatttcagagtgtt

SEQ ID NO: 678248 - DNA, 22 bp, Artificial Sequence
  chemically synthesized
ttcccattatttcagagtgttt

SEQ ID NO: 678249 - DNA, 22 bp, Artificial Sequence
  chemically synthesized
cgtttaaagaaaaaacactctg

SEQ ID NO: 678250 - DNA, 22 bp, Artificial Sequence
  chemically synthesized
cccattatttcagagtgttttt

SEQ ID NO: 678251 - DNA, 22 bp, Artificial Sequence
  chemically synthesized
ccattatttcagagtgtttttt

SEQ ID NO: 678252 - DNA, 22 bp, Artificial Sequence
  chemically synthesized
tttcagagtgttttttctttaa

SEQ ID NO: 678253 - DNA, 22 bp, Artificial Sequence
  chemically synthesized
cagagtgttttttctttaaacg

SEQ ID NO: 678254 - DNA, 22 bp, Artificial Sequence
  chemically synthesized
agagtgttttttctttaaacgc

SEQ ID NO: 678255 - DNA, 22 bp, Artificial Sequence
  chemically synthesized
tttctttaaacgcagtacgcta

SEQ ID NO: 678256 - DNA, 22 bp, Artificial Sequence
  chemically synthesized
ttctttaaacgcagtacgctat

SEQ ID NO: 678257 - DNA, 22 bp, Artificial Sequence
  chemically synthesized
tctttaaacgcagtacgctata

SEQ ID NO: 678258 - DNA, 22 bp, Artificial Sequence
  chemically synthesized
ctttaaacgcagtacgctatac

SEQ ID NO: 678259 - DNA, 22 bp, Artificial Sequence
  chemically synthesized
tttaaacgcagtacgctataca

SEQ ID NO: 678260 - DNA, 22 bp, Artificial Sequence
  chemically synthesized
taaacgcagtacgctatacacc

SEQ ID NO: 678261 - DNA, 22 bp, Artificial Sequence
  chemically synthesized
aaacgcagtacgctatacacca

SEQ ID NO: 678262 - DNA, 22 bp, Artificial Sequence
  chemically synthesized
aacgcagtacgctatacaccac

SEQ ID NO: 678263 - DNA, 22 bp, Artificial Sequence
  chemically synthesized
tacaccactacacctcttccta

SEQ ID NO: 678264 - DNA, 22 bp, Artificial Sequence
  chemically synthesized
aggcccaagtaaatataggaag

SEQ ID NO: 678265 - DNA, 22 bp, Artificial Sequence
  chemically synthesized
attcaggcccaagtaaatatag

SEQ ID NO: 678266 - DNA, 22 bp, Artificial Sequence
  chemically synthesized
cattcaggcccaagtaaatata

SEQ ID NO: 678267 - DNA, 22 bp, Artificial Sequence
  chemically synthesized
cacctcttcctatatttacttg

SEQ ID NO: 678268 - DNA, 22 bp, Artificial Sequence
  chemically synthesized
ttcctatatttacttgggcctg

SEQ ID NO: 678269 - DNA, 22 bp, Artificial Sequence
  chemically synthesized
tgaatgcttcattcaggcccaa

SEQ ID NO: 678270 - DNA, 22 bp, Artificial Sequence
  chemically synthesized
cctatatttacttgggcctgaa

SEQ ID NO: 678271 - DNA, 22 bp, Artificial Sequence
  chemically synthesized
ctatatttacttgggcctgaat

SEQ ID NO: 678272 - DNA, 22 bp, Artificial Sequence
  chemically synthesized
tatttacttgggcctgaatgaa

SEQ ID NO: 678273 - DNA, 22 bp, Artificial Sequence
  chemically synthesized
acttgggcctgaatgaagcatt

SEQ ID NO: 678274 - DNA, 22 bp, Artificial Sequence
  chemically synthesized
cttgggcctgaatgaagcattc

SEQ ID NO: 678275 - DNA, 22 bp, Artificial Sequence
  chemically synthesized
gggcctgaatgaagcattcaca

SEQ ID NO: 678276 - DNA, 22 bp, Artificial Sequence
  chemically synthesized
ggcctgaatgaagcattcacag

SEQ ID NO: 678277 - DNA, 22 bp, Artificial Sequence
  chemically synthesized
aagaaatggaagacagctgtga

SEQ ID NO: 678278 - DNA, 22 bp, Artificial Sequence
  chemically synthesized
caagaaatggaagacagctgtg

SEQ ID NO: 678279 - DNA, 22 bp, Artificial Sequence
  chemically synthesized
aatgaagcattcacagctgtct

SEQ ID NO: 678280 - DNA, 22 bp, Artificial Sequence
  chemically synthesized
acagctgtcttccatttcttga

SEQ ID NO: 678281 - DNA, 22 bp, Artificial Sequence
  chemically synthesized
atagccagcaaccacacttcaa

SEQ ID NO: 678282 - DNA, 22 bp, Artificial Sequence
  chemically synthesized
tcttccatttcttgaagtgtgg

SEQ ID NO: 678283 - DNA, 22 bp, Artificial Sequence
  chemically synthesized
ccatttcttgaagtgtggttgc

SEQ ID NO: 678284 - DNA, 22 bp, Artificial Sequence
  chemically synthesized
catttcttgaagtgtggttgct

SEQ ID NO: 678285 - DNA, 22 bp, Artificial Sequence
  chemically synthesized
cttgaagtgtggttgctggcta

SEQ ID NO: 678286 - DNA, 22 bp, Artificial Sequence
  chemically synthesized
ttgaagtgtggttgctggctat

SEQ ID NO: 678287 - DNA, 22 bp, Artificial Sequence
  chemically synthesized
tggcaggagctgatagccagca

SEQ ID NO: 678288 - DNA, 22 bp, Artificial Sequence
  chemically synthesized
gtggcaggagctgatagccagc

SEQ ID NO: 678289 - DNA, 22 bp, Artificial Sequence
  chemically synthesized
gaagtgtggttgctggctatca

SEQ ID NO: 678290 - DNA, 22 bp, Artificial Sequence
  chemically synthesized
tgtggcaggagctgatagccag

SEQ ID NO: 678291 - DNA, 22 bp, Artificial Sequence
  chemically synthesized
aagtgtggttgctggctatcag

SEQ ID NO: 678292 - DNA, 22 bp, Artificial Sequence
  chemically synthesized
ttgtggcaggagctgatagcca

SEQ ID NO: 678293 - DNA, 22 bp, Artificial Sequence
  chemically synthesized
tttgtggcaggagctgatagcc

SEQ ID NO: 678294 - DNA, 22 bp, Artificial Sequence
  chemically synthesized
tttttgtggcaggagctgatag

SEQ ID NO: 678295 - DNA, 22 bp, Artificial Sequence
  chemically synthesized
ttctttttgtggcaggagctga

SEQ ID NO: 678296 - DNA, 22 bp, Artificial Sequence
  chemically synthesized
gttctttttgtggcaggagctg

SEQ ID NO: 678297 - DNA, 22 bp, Artificial Sequence
  chemically synthesized
tgttctttttgtggcaggagct

SEQ ID NO: 678298 - DNA, 22 bp, Artificial Sequence
  chemically synthesized
ctggctatcagctcctgccaca

SEQ ID NO: 678299 - DNA, 22 bp, Artificial Sequence
  chemically synthesized
gctatcagctcctgccacaaaa

SEQ ID NO: 678300 - DNA, 22 bp, Artificial Sequence
  chemically synthesized
tcagctcctgccacaaaaagaa

SEQ ID NO: 678301 - DNA, 22 bp, Artificial Sequence
  chemically synthesized
ctgccacaaaaagaacaaaaca

SEQ ID NO: 678302 - DNA, 22 bp, Artificial Sequence
  chemically synthesized
ccacaaaaagaacaaaacacct

SEQ ID NO: 678303 - DNA, 22 bp, Artificial Sequence
  chemically synthesized
aatgaggaacaaaggtgttttg

SEQ ID NO: 678304 - DNA, 22 bp, Artificial Sequence
  chemically synthesized
atgtaattgaatgaggaacaaa

SEQ ID NO: 678305 - DNA, 22 bp, Artificial Sequence
  chemically synthesized
ttcatgtaattgaatgaggaac

SEQ ID NO: 678306 - DNA, 22 bp, Artificial Sequence
  chemically synthesized
attcatgtaattgaatgaggaa

SEQ ID NO: 678307 - DNA, 22 bp, Artificial Sequence
  chemically synthesized
cagggtttattcatgtaattga

SEQ ID NO: 678308 - DNA, 22 bp, Artificial Sequence
  chemically synthesized
tgttcctcattcaattacatga

SEQ ID NO: 678309 - DNA, 22 bp, Artificial Sequence
  chemically synthesized
tccagggtttattcatgtaatt

SEQ ID NO: 678310 - DNA, 22 bp, Artificial Sequence
  chemically synthesized
gttcctcattcaattacatgaa

SEQ ID NO: 678311 - DNA, 22 bp, Artificial Sequence
  chemically synthesized
ctccagggtttattcatgtaat

SEQ ID NO: 678312 - DNA, 22 bp, Artificial Sequence
  chemically synthesized
ttcctcattcaattacatgaat

SEQ ID NO: 678313 - DNA, 22 bp, Artificial Sequence
  chemically synthesized
tttctccagggtttattcatgt

SEQ ID NO: 678314 - DNA, 22 bp, Artificial Sequence
  chemically synthesized
ctcattcaattacatgaataaa

SEQ ID NO: 678315 - DNA, 22 bp, Artificial Sequence
  chemically synthesized
attcaattacatgaataaaccc

SEQ ID NO: 678316 - DNA, 22 bp, Artificial Sequence
  chemically synthesized
aattacatgaataaaccctgga

SEQ ID NO: 678317 - DNA, 22 bp, Artificial Sequence
  chemically synthesized
catgaataaaccctggagaaat

SEQ ID NO: 678318 - DNA, 22 bp, Artificial Sequence
  chemically synthesized
gagaaataactacatatacttt

SEQ ID NO: 678319 - DNA, 22 bp, Artificial Sequence
  chemically synthesized
tgtagatgggccaaagtaagga

SEQ ID NO: 678320 - DNA, 22 bp, Artificial Sequence
  chemically synthesized
atgtagatgggccaaagtaagg

SEQ ID NO: 678321 - DNA, 22 bp, Artificial Sequence
  chemically synthesized
catatacttttccttactttgg

SEQ ID NO: 678322 - DNA, 22 bp, Artificial Sequence
  chemically synthesized
tggtgatttatgtagatgggcc

SEQ ID NO: 678323 - DNA, 22 bp, Artificial Sequence
  chemically synthesized
ttccttactttggcccatctac

SEQ ID NO: 678324 - DNA, 22 bp, Artificial Sequence
  chemically synthesized
tccttactttggcccatctaca

SEQ ID NO: 678325 - DNA, 22 bp, Artificial Sequence
  chemically synthesized
ccttactttggcccatctacat

SEQ ID NO: 678326 - DNA, 22 bp, Artificial Sequence
  chemically synthesized
cttactttggcccatctacata

SEQ ID NO: 678327 - DNA, 22 bp, Artificial Sequence
  chemically synthesized
actttggcccatctacataaat

SEQ ID NO: 678328 - DNA, 22 bp, Artificial Sequence
  chemically synthesized
ctttggcccatctacataaatc

SEQ ID NO: 678329 - DNA, 22 bp, Artificial Sequence
  chemically synthesized
tggcccatctacataaatcacc

SEQ ID NO: 678330 - DNA, 22 bp, Artificial Sequence
  chemically synthesized
ggcccatctacataaatcacca

SEQ ID NO: 678331 - DNA, 22 bp, Artificial Sequence
  chemically synthesized
gcccatctacataaatcaccat

SEQ ID NO: 678332 - DNA, 22 bp, Artificial Sequence
  chemically synthesized
gaaatatgacgctatggtgatt

SEQ ID NO: 678333 - DNA, 22 bp, Artificial Sequence
  chemically synthesized
aaaactggaaatatgacgctat

SEQ ID NO: 678334 - DNA, 22 bp, Artificial Sequence
  chemically synthesized
cataaatcaccatagcgtcata

SEQ ID NO: 678335 - DNA, 22 bp, Artificial Sequence
  chemically synthesized
tcatgcaatccctgaaaactgg

SEQ ID NO: 678336 - DNA, 22 bp, Artificial Sequence
  chemically synthesized
ccagttttcagggattgcatga

SEQ ID NO: 678337 - DNA, 22 bp, Artificial Sequence
  chemically synthesized
tatcaaagcctgtcatgcaatc

SEQ ID NO: 678338 - DNA, 22 bp, Artificial Sequence
  chemically synthesized
cagttttcagggattgcatgac

SEQ ID NO: 678339 - DNA, 22 bp, Artificial Sequence
  chemically synthesized
ctgtatcaaagcctgtcatgca

SEQ ID NO: 678340 - DNA, 22 bp, Artificial Sequence
  chemically synthesized
actgtatcaaagcctgtcatgc

SEQ ID NO: 678341 - DNA, 22 bp, Artificial Sequence
  chemically synthesized
tactgtatcaaagcctgtcatg

SEQ ID NO: 678342 - DNA, 22 bp, Artificial Sequence
  chemically synthesized
tcagggattgcatgacaggctt

SEQ ID NO: 678343 - DNA, 22 bp, Artificial Sequence
  chemically synthesized
cagggattgcatgacaggcttt

SEQ ID NO: 678344 - DNA, 22 bp, Artificial Sequence
  chemically synthesized
agggattgcatgacaggctttg

SEQ ID NO: 678345 - DNA, 22 bp, Artificial Sequence
  chemically synthesized
cattttactgtatcaaagcctg

SEQ ID NO: 678346 - DNA, 22 bp, Artificial Sequence
  chemically synthesized
catgacaggctttgatacagta

SEQ ID NO: 678347 - DNA, 22 bp, Artificial Sequence
  chemically synthesized
agaactgcattttactgtatca

SEQ ID NO: 678348 - DNA, 22 bp, Artificial Sequence
  chemically synthesized
tgatacagtaaaatgcagttct

SEQ ID NO: 678349 - DNA, 22 bp, Artificial Sequence
  chemically synthesized
gatacagtaaaatgcagttctg

SEQ ID NO: 678350 - DNA, 22 bp, Artificial Sequence
  chemically synthesized
atacagtaaaatgcagttctga

SEQ ID NO: 678351 - DNA, 22 bp, Artificial Sequence
  chemically synthesized
catatgagtacccaaatatcat

SEQ ID NO: 678352 - DNA, 22 bp, Artificial Sequence
  chemically synthesized
tgcatatgagtacccaaatatc

SEQ ID NO: 678353 - DNA, 22 bp, Artificial Sequence
  chemically synthesized
tgaatgatatttgggtactcat

SEQ ID NO: 678354 - DNA, 22 bp, Artificial Sequence
  chemically synthesized
aatgatatttgggtactcatat

SEQ ID NO: 678355 - DNA, 22 bp, Artificial Sequence
  chemically synthesized
tgaataggctctgcatatgagt

SEQ ID NO: 678356 - DNA, 22 bp, Artificial Sequence
  chemically synthesized
atgaataggctctgcatatgag

SEQ ID NO: 678357 - DNA, 22 bp, Artificial Sequence
  chemically synthesized
gggtactcatatgcagagccta

SEQ ID NO: 678358 - DNA, 22 bp, Artificial Sequence
  chemically synthesized
ggtactcatatgcagagcctat

SEQ ID NO: 678359 - DNA, 22 bp, Artificial Sequence
  chemically synthesized
aaaagtttatgaataggctctg

SEQ ID NO: 678360 - DNA, 22 bp, Artificial Sequence
  chemically synthesized
ccctcaaaagtttatgaatagg

SEQ ID NO: 678361 - DNA, 22 bp, Artificial Sequence
  chemically synthesized
cccctcaaaagtttatgaatag

SEQ ID NO: 678362 - DNA, 22 bp, Artificial Sequence
  chemically synthesized
atatgcagagcctattcataaa

SEQ ID NO: 678363 - DNA, 22 bp, Artificial Sequence
  chemically synthesized
cccttcccctcaaaagtttatg

SEQ ID NO: 678364 - DNA, 22 bp, Artificial Sequence
  chemically synthesized
cctccccttcccctcaaaagtt

SEQ ID NO: 678365 - DNA, 22 bp, Artificial Sequence
  chemically synthesized
ccctccccttcccctcaaaagt

SEQ ID NO: 678366 - DNA, 22 bp, Artificial Sequence
  chemically synthesized
cttccctccccttcccctcaaa

SEQ ID NO: 678367 - DNA, 22 bp, Artificial Sequence
  chemically synthesized
ccttccctccccttcccctcaa

SEQ ID NO: 678368 - DNA, 22 bp, Artificial Sequence
  chemically synthesized
ttcataaacttttgaggggaag

SEQ ID NO: 678369 - DNA, 22 bp, Artificial Sequence
  chemically synthesized
tccttccctccccttcccctca

SEQ ID NO: 678370 - DNA, 22 bp, Artificial Sequence
  chemically synthesized
ttccttccctccccttcccctc

SEQ ID NO: 678371 - DNA, 22 bp, Artificial Sequence
  chemically synthesized
tttccttccctccccttcccct

SEQ ID NO: 678372 - DNA, 22 bp, Artificial Sequence
  chemically synthesized
ataaacttttgaggggaagggg

SEQ ID NO: 678373 - DNA, 22 bp, Artificial Sequence
  chemically synthesized
ttttccttccctccccttcccc

SEQ ID NO: 678374 - DNA, 22 bp, Artificial Sequence
  chemically synthesized
ttttttccttccctccccttcc

SEQ ID NO: 678375 - DNA, 22 bp, Artificial Sequence
  chemically synthesized
tcttttttccttccctcccctt

SEQ ID NO: 678376 - DNA, 22 bp, Artificial Sequence
  chemically synthesized
ctcttttttccttccctcccct

SEQ ID NO: 678377 - DNA, 22 bp, Artificial Sequence
  chemically synthesized
ttgaggggaaggggagggaagg

SEQ ID NO: 678378 - DNA, 22 bp, Artificial Sequence
  chemically synthesized
tgaggggaaggggagggaagga

SEQ ID NO: 678379 - DNA, 22 bp, Artificial Sequence
  chemically synthesized
gaggggaaggggagggaaggaa

SEQ ID NO: 678380 - DNA, 22 bp, Artificial Sequence
  chemically synthesized
aggggaaggggagggaaggaaa

SEQ ID NO: 678381 - DNA, 22 bp, Artificial Sequence
  chemically synthesized
agcgatttctcttttttccttc

SEQ ID NO: 678382 - DNA, 22 bp, Artificial Sequence
  chemically synthesized
aagcgatttctcttttttcctt

SEQ ID NO: 678383 - DNA, 22 bp, Artificial Sequence
  chemically synthesized
gaaatgccccagtttaagcgat

SEQ ID NO: 678384 - DNA, 22 bp, Artificial Sequence
  chemically synthesized
tggaaatgccccagtttaagcg

SEQ ID NO: 678385 - DNA, 22 bp, Artificial Sequence
  chemically synthesized
gtcctctggaaatgccccagtt

SEQ ID NO: 678386 - DNA, 22 bp, Artificial Sequence
  chemically synthesized
tggtcctctggaaatgccccag

SEQ ID NO: 678387 - DNA, 22 bp, Artificial Sequence
  chemically synthesized
ctggtcctctggaaatgcccca

SEQ ID NO: 678388 - DNA, 22 bp, Artificial Sequence
  chemically synthesized
tctggtcctctggaaatgcccc

SEQ ID NO: 678389 - DNA, 22 bp, Artificial Sequence
  chemically synthesized
tactttctggtcctctggaaat

SEQ ID NO: 678390 - DNA, 22 bp, Artificial Sequence
  chemically synthesized
aaactggggcatttccagagga

SEQ ID NO: 678391 - DNA, 22 bp, Artificial Sequence
  chemically synthesized
aactggggcatttccagaggac

SEQ ID NO: 678392 - DNA, 22 bp, Artificial Sequence
  chemically synthesized
gggcatttccagaggaccagaa

SEQ ID NO: 678393 - DNA, 22 bp, Artificial Sequence
  chemically synthesized
tgtgaggcccctgtactttctg

SEQ ID NO: 678394 - DNA, 22 bp, Artificial Sequence
  chemically synthesized
tgtgtgaggcccctgtactttc

SEQ ID NO: 678395 - DNA, 22 bp, Artificial Sequence
  chemically synthesized
ccagaggaccagaaagtacagg

SEQ ID NO: 678396 - DNA, 22 bp, Artificial Sequence
  chemically synthesized
ctgtgtgaggcccctgtacttt

SEQ ID NO: 678397 - DNA, 22 bp, Artificial Sequence
  chemically synthesized
cagaggaccagaaagtacaggg

SEQ ID NO: 678398 - DNA, 22 bp, Artificial Sequence
  chemically synthesized
tctgtgtgaggcccctgtactt

SEQ ID NO: 678399 - DNA, 22 bp, Artificial Sequence
  chemically synthesized
tttctgtgtgaggcccctgtac

SEQ ID NO: 678400 - DNA, 22 bp, Artificial Sequence
  chemically synthesized
ctctttctgtgtgaggcccctg

SEQ ID NO: 678401 - DNA, 22 bp, Artificial Sequence
  chemically synthesized
cagactcctctttctgtgtgag

SEQ ID NO: 678402 - DNA, 22 bp, Artificial Sequence
  chemically synthesized
tccagactcctctttctgtgtg

SEQ ID NO: 678403 - DNA, 22 bp, Artificial Sequence
  chemically synthesized
cctctccagactcctctttctg

SEQ ID NO: 678404 - DNA, 22 bp, Artificial Sequence
  chemically synthesized
ttgcctctccagactcctcttt

SEQ ID NO: 678405 - DNA, 22 bp, Artificial Sequence
  chemically synthesized
acacagaaagaggagtctggag

SEQ ID NO: 678406 - DNA, 22 bp, Artificial Sequence
  chemically synthesized
gacattgttgcctctccagact

SEQ ID NO: 678407 - DNA, 22 bp, Artificial Sequence
  chemically synthesized
aggccattcgacattgttgcct

SEQ ID NO: 678408 - DNA, 22 bp, Artificial Sequence
  chemically synthesized
gagaggcaacaatgtcgaatgg

SEQ ID NO: 678409 - DNA, 22 bp, Artificial Sequence
  chemically synthesized
aaaacatacgctaaggccattc

SEQ ID NO: 678410 - DNA, 22 bp, Artificial Sequence
  chemically synthesized
aaattcaaaacatacgctaagg

SEQ ID NO: 678411 - DNA, 22 bp, Artificial Sequence
  chemically synthesized
agcgtatgttttgaattttagg

SEQ ID NO: 678412 - DNA, 22 bp, Artificial Sequence
  chemically synthesized
gcgtatgttttgaattttaggg

SEQ ID NO: 678413 - DNA, 22 bp, Artificial Sequence
  chemically synthesized
accgccagtagggcgcagagcc

SEQ ID NO: 678414 - DNA, 22 bp, Artificial Sequence
  chemically synthesized
caccgccagtagggcgcagagc

SEQ ID NO: 678415 - DNA, 22 bp, Artificial Sequence
  chemically synthesized
tgaattttagggctctgcgccc

SEQ ID NO: 678416 - DNA, 22 bp, Artificial Sequence
  chemically synthesized
gaattttagggctctgcgccct

SEQ ID NO: 678417 - DNA, 22 bp, Artificial Sequence
  chemically synthesized
aattttagggctctgcgcccta

SEQ ID NO: 678418 - DNA, 22 bp, Artificial Sequence
  chemically synthesized
aatttcaccgccagtagggcgc

SEQ ID NO: 678419 - DNA, 22 bp, Artificial Sequence
  chemically synthesized
aaatttcaccgccagtagggcg

SEQ ID NO: 678420 - DNA, 22 bp, Artificial Sequence
  chemically synthesized
taaatttcaccgccagtagggc

SEQ ID NO: 678421 - DNA, 22 bp, Artificial Sequence
  chemically synthesized
tagggctctgcgccctactggc

SEQ ID NO: 678422 - DNA, 22 bp, Artificial Sequence
  chemically synthesized
agggctctgcgccctactggcg

SEQ ID NO: 678423 - DNA, 22 bp, Artificial Sequence
  chemically synthesized
gggctctgcgccctactggcgg

SEQ ID NO: 678424 - DNA, 22 bp, Artificial Sequence
  chemically synthesized
ctttaaatttcaccgccagtag

SEQ ID NO: 678425 - DNA, 22 bp, Artificial Sequence
  chemically synthesized
gctttaaatttcaccgccagta

SEQ ID NO: 678426 - DNA, 22 bp, Artificial Sequence
  chemically synthesized
tgcgccctactggcggtgaaat

SEQ ID NO: 678427 - DNA, 22 bp, Artificial Sequence
  chemically synthesized
cgccctactggcggtgaaattt

SEQ ID NO: 678428 - DNA, 22 bp, Artificial Sequence
  chemically synthesized
ctggcggtgaaatttaaagcaa

SEQ ID NO: 678429 - DNA, 22 bp, Artificial Sequence
  chemically synthesized
caaggtaggcaggcttgcttta

SEQ ID NO: 678430 - DNA, 22 bp, Artificial Sequence
  chemically synthesized
gcggtgaaatttaaagcaagcc

SEQ ID NO: 678431 - DNA, 22 bp, Artificial Sequence
  chemically synthesized
accctccaaggtaggcaggctt

SEQ ID NO: 678432 - DNA, 22 bp, Artificial Sequence
  chemically synthesized
aaccctccaaggtaggcaggct

SEQ ID NO: 678433 - DNA, 22 bp, Artificial Sequence
  chemically synthesized
taaccctccaaggtaggcaggc

SEQ ID NO: 678434 - DNA, 22 bp, Artificial Sequence
  chemically synthesized
aaagcaagcctgcctaccttgg

SEQ ID NO: 678435 - DNA, 22 bp, Artificial Sequence
  chemically synthesized
aagcaagcctgcctaccttgga

SEQ ID NO: 678436 - DNA, 22 bp, Artificial Sequence
  chemically synthesized
atcctttaaccctccaaggtag

SEQ ID NO: 678437 - DNA, 22 bp, Artificial Sequence
  chemically synthesized
aactaatcctttaaccctccaa

SEQ ID NO: 678438 - DNA, 22 bp, Artificial Sequence
  chemically synthesized
caactaatcctttaaccctcca

SEQ ID NO: 678439 - DNA, 22 bp, Artificial Sequence
  chemically synthesized
tttcaactaatcctttaaccct

SEQ ID NO: 678440 - DNA, 22 bp, Artificial Sequence
  chemically synthesized
cctaccttggagggttaaagga

SEQ ID NO: 678441 - DNA, 22 bp, Artificial Sequence
  chemically synthesized
cctatttcaactaatcctttaa

SEQ ID NO: 678442 - DNA, 22 bp, Artificial Sequence
  chemically synthesized
acctatttcaactaatccttta

SEQ ID NO: 678443 - DNA, 22 bp, Artificial Sequence
  chemically synthesized
ccttggagggttaaaggattag

SEQ ID NO: 678444 - DNA, 22 bp, Artificial Sequence
  chemically synthesized
ggagggttaaaggattagttga

SEQ ID NO: 678445 - DNA, 22 bp, Artificial Sequence
  chemically synthesized
gagggttaaaggattagttgaa

SEQ ID NO: 678446 - DNA, 22 bp, Artificial Sequence
  chemically synthesized
aaggattagttgaaataggtaa

SEQ ID NO: 678447 - DNA, 22 bp, Artificial Sequence
  chemically synthesized
gttgaaataggtaagtgaccgg

SEQ ID NO: 678448 - DNA, 22 bp, Artificial Sequence
  chemically synthesized
agcaccaaatggtgccggtcac

SEQ ID NO: 678449 - DNA, 22 bp, Artificial Sequence
  chemically synthesized
aaataggtaagtgaccggcacc

SEQ ID NO: 678450 - DNA, 22 bp, Artificial Sequence
  chemically synthesized
ggtgctcaatatgtggtcgctt

SEQ ID NO: 678451 - DNA, 22 bp, Artificial Sequence
  chemically synthesized
gtgctcaatatgtggtcgcttt

SEQ ID NO: 678452 - DNA, 22 bp, Artificial Sequence
  chemically synthesized
aggggcacatgataccaaaagc

SEQ ID NO: 678453 - DNA, 22 bp, Artificial Sequence
  chemically synthesized
aatatgtggtcgcttttggtat

SEQ ID NO: 678454 - DNA, 22 bp, Artificial Sequence
  chemically synthesized
gaggggcacatgataccaaaag

SEQ ID NO: 678455 - DNA, 22 bp, Artificial Sequence
  chemically synthesized
atagatgacaatttgaggggca

SEQ ID NO: 678456 - DNA, 22 bp, Artificial Sequence
  chemically synthesized
ttggtatcatgtgcccctcaaa

SEQ ID NO: 678457 - DNA, 22 bp, Artificial Sequence
  chemically synthesized
aatagatgacaatttgaggggc

SEQ ID NO: 678458 - DNA, 22 bp, Artificial Sequence
  chemically synthesized
tggtatcatgtgcccctcaaat

SEQ ID NO: 678459 - DNA, 22 bp, Artificial Sequence
  chemically synthesized
taatagatgacaatttgagggg

SEQ ID NO: 678460 - DNA, 22 bp, Artificial Sequence
  chemically synthesized
ggtatcatgtgcccctcaaatt

SEQ ID NO: 678461 - DNA, 22 bp, Artificial Sequence
  chemically synthesized
ttaatagatgacaatttgaggg

SEQ ID NO: 678462 - DNA, 22 bp, Artificial Sequence
  chemically synthesized
gtatcatgtgcccctcaaattg

SEQ ID NO: 678463 - DNA, 22 bp, Artificial Sequence
  chemically synthesized
cttttaatagatgacaatttga

SEQ ID NO: 678464 - DNA, 22 bp, Artificial Sequence
  chemically synthesized
gcttttaatagatgacaatttg

SEQ ID NO: 678465 - DNA, 22 bp, Artificial Sequence
  chemically synthesized
ataacagatttgcttttaatag

SEQ ID NO: 678466 - DNA, 22 bp, Artificial Sequence
  chemically synthesized
aaattgtcatctattaaaagca

SEQ ID NO: 678467 - DNA, 22 bp, Artificial Sequence
  chemically synthesized
tcatctattaaaagcaaatctg

SEQ ID NO: 678468 - DNA, 22 bp, Artificial Sequence
  chemically synthesized
taatcaactaataacagatttg

SEQ ID NO: 678469 - DNA, 22 bp, Artificial Sequence
  chemically synthesized
ttaaaagcaaatctgttattag

SEQ ID NO: 678470 - DNA, 22 bp, Artificial Sequence
  chemically synthesized
tattgtaatcaactaataacag

SEQ ID NO: 678471 - DNA, 22 bp, Artificial Sequence
  chemically synthesized
aaagcaaatctgttattagttg

SEQ ID NO: 678472 - DNA, 22 bp, Artificial Sequence
  chemically synthesized
gatccacatctatattgtaatc

SEQ ID NO: 678473 - DNA, 22 bp, Artificial Sequence
  chemically synthesized
ttattagttgattacaatatag

SEQ ID NO: 678474 - DNA, 22 bp, Artificial Sequence
  chemically synthesized
ttagttgattacaatatagatg

SEQ ID NO: 678475 - DNA, 22 bp, Artificial Sequence
  chemically synthesized
cagttggatccacatctatatt

SEQ ID NO: 678476 - DNA, 22 bp, Artificial Sequence
  chemically synthesized
gttgattacaatatagatgtgg

SEQ ID NO: 678477 - DNA, 22 bp, Artificial Sequence
  chemically synthesized
attacagttggatccacatcta

SEQ ID NO: 678478 - DNA, 22 bp, Artificial Sequence
  chemically synthesized
aattacagttggatccacatct

SEQ ID NO: 678479 - DNA, 22 bp, Artificial Sequence
  chemically synthesized
attacaatatagatgtggatcc

SEQ ID NO: 678480 - DNA, 22 bp, Artificial Sequence
  chemically synthesized
acttaattacagttggatccac

SEQ ID NO: 678481 - DNA, 22 bp, Artificial Sequence
  chemically synthesized
caatatagatgtggatccaact

SEQ ID NO: 678482 - DNA, 22 bp, Artificial Sequence
  chemically synthesized
attgacttaattacagttggat

SEQ ID NO: 678483 - DNA, 22 bp, Artificial Sequence
  chemically synthesized
gattgacttaattacagttgga

SEQ ID NO: 678484 - DNA, 22 bp, Artificial Sequence
  chemically synthesized
gccttgattgacttaattacag

SEQ ID NO: 678485 - DNA, 22 bp, Artificial Sequence
  chemically synthesized
cgccttgattgacttaattaca

SEQ ID NO: 678486 - DNA, 22 bp, Artificial Sequence
  chemically synthesized
ttcgccttgattgacttaatta

SEQ ID NO: 678487 - DNA, 22 bp, Artificial Sequence
  chemically synthesized
cttcgccttgattgacttaatt

SEQ ID NO: 678488 - DNA, 22 bp, Artificial Sequence
  chemically synthesized
tcttcgccttgattgacttaat

SEQ ID NO: 678489 - DNA, 22 bp, Artificial Sequence
  chemically synthesized
taattaagtcaatcaaggcgaa

SEQ ID NO: 678490 - DNA, 22 bp, Artificial Sequence
  chemically synthesized
ggaagggtctttcttcgccttg

SEQ ID NO: 678491 - DNA, 22 bp, Artificial Sequence
  chemically synthesized
taggaagggtctttcttcgcct

SEQ ID NO: 678492 - DNA, 22 bp, Artificial Sequence
  chemically synthesized
tctaggaagggtctttcttcgc

SEQ ID NO: 678493 - DNA, 22 bp, Artificial Sequence
  chemically synthesized
agtcaatcaaggcgaagaaaga

SEQ ID NO: 678494 - DNA, 22 bp, Artificial Sequence
  chemically synthesized
ctctctaggaagggtctttctt

SEQ ID NO: 678495 - DNA, 22 bp, Artificial Sequence
  chemically synthesized
gctctctaggaagggtctttct

SEQ ID NO: 678496 - DNA, 22 bp, Artificial Sequence
  chemically synthesized
tgctctctaggaagggtctttc

SEQ ID NO: 678497 - DNA, 22 bp, Artificial Sequence
  chemically synthesized
gttttgctctctaggaagggtc

SEQ ID NO: 678498 - DNA, 22 bp, Artificial Sequence
  chemically synthesized
cctagagagcaaaaccaacaca

SEQ ID NO: 678499 - DNA, 22 bp, Artificial Sequence
  chemically synthesized
ctagagagcaaaaccaacacac

SEQ ID NO: 678500 - DNA, 22 bp, Artificial Sequence
  chemically synthesized
gagagcaaaaccaacacactac

SEQ ID NO: 678501 - DNA, 22 bp, Artificial Sequence
  chemically synthesized
aacataggtgataacatgtagt

SEQ ID NO: 678502 - DNA, 22 bp, Artificial Sequence
  chemically synthesized
aaacataggtgataacatgtag

SEQ ID NO: 678503 - DNA, 22 bp, Artificial Sequence
  chemically synthesized
taaacataggtgataacatgta

SEQ ID NO: 678504 - DNA, 22 bp, Artificial Sequence
  chemically synthesized
ttaaacataggtgataacatgt

SEQ ID NO: 678505 - DNA, 22 bp, Artificial Sequence
  chemically synthesized
tttaaacataggtgataacatg

SEQ ID NO: 678506 - DNA, 22 bp, Artificial Sequence
  chemically synthesized
ttttaaacataggtgataacat

SEQ ID NO: 678507 - DNA, 22 bp, Artificial Sequence
  chemically synthesized
tttttaaacataggtgataaca

SEQ ID NO: 678508 - DNA, 22 bp, Artificial Sequence
  chemically synthesized
ttttttttaaacataggtgata

SEQ ID NO: 678509 - DNA, 22 bp, Artificial Sequence
  chemically synthesized
attttttttaaacataggtgat

SEQ ID NO: 678510 - DNA, 22 bp, Artificial Sequence
  chemically synthesized
acttattttttttaaacatagg

SEQ ID NO: 678511 - DNA, 22 bp, Artificial Sequence
  chemically synthesized
aacttattttttttaaacatag

SEQ ID NO: 678512 - DNA, 22 bp, Artificial Sequence
  chemically synthesized
catgttatcacctatgtttaaa

SEQ ID NO: 678513 - DNA, 22 bp, Artificial Sequence
  chemically synthesized
taacttattttttttaaacata

SEQ ID NO: 678514 - DNA, 22 bp, Artificial Sequence
  chemically synthesized
ttttaacttattttttttaaac

SEQ ID NO: 678515 - DNA, 22 bp, Artificial Sequence
  chemically synthesized
tcacctatgtttaaaaaaaata

SEQ ID NO: 678516 - DNA, 22 bp, Artificial Sequence
  chemically synthesized
aacggttgttttaacttatttt

SEQ ID NO: 678517 - DNA, 22 bp, Artificial Sequence
  chemically synthesized
aaacggttgttttaacttattt

SEQ ID NO: 678518 - DNA, 22 bp, Artificial Sequence
  chemically synthesized
tgtttaaaaaaaataagttaaa

SEQ ID NO: 678519 - DNA, 22 bp, Artificial Sequence
  chemically synthesized
aaaaaaaataagttaaaacaac

SEQ ID NO: 678520 - DNA, 22 bp, Artificial Sequence
  chemically synthesized
aaaaaaataagttaaaacaacc

SEQ ID NO: 678521 - DNA, 22 bp, Artificial Sequence
  chemically synthesized
aaccaacttaaacggttgtttt

SEQ ID NO: 678522 - DNA, 22 bp, Artificial Sequence
  chemically synthesized
aaaccaacttaaacggttgttt

SEQ ID NO: 678523 - DNA, 22 bp, Artificial Sequence
  chemically synthesized
ttaaaccaacttaaacggttgt

SEQ ID NO: 678524 - DNA, 22 bp, Artificial Sequence
  chemically synthesized
cttaaaccaacttaaacggttg

SEQ ID NO: 678525 - DNA, 22 bp, Artificial Sequence
  chemically synthesized
catttcttaaaccaacttaaac

SEQ ID NO: 678526 - DNA, 22 bp, Artificial Sequence
  chemically synthesized
aaacaaccgtttaagttggttt

SEQ ID NO: 678527 - DNA, 22 bp, Artificial Sequence
  chemically synthesized
tgttccatttcttaaaccaact

SEQ ID NO: 678528 - DNA, 22 bp, Artificial Sequence
  chemically synthesized
tgattgtgttccatttcttaaa

SEQ ID NO: 678529 - DNA, 22 bp, Artificial Sequence
  chemically synthesized
atgattgtgttccatttcttaa

SEQ ID NO: 678530 - DNA, 22 bp, Artificial Sequence
  chemically synthesized
aagttggtttaagaaatggaac

SEQ ID NO: 678531 - DNA, 22 bp, Artificial Sequence
  chemically synthesized
agttggtttaagaaatggaaca

SEQ ID NO: 678532 - DNA, 22 bp, Artificial Sequence
  chemically synthesized
tgaggtttatgattgtgttcca

SEQ ID NO: 678533 - DNA, 22 bp, Artificial Sequence
  chemically synthesized
atgaggtttatgattgtgttcc

SEQ ID NO: 678534 - DNA, 22 bp, Artificial Sequence
  chemically synthesized
gtttaagaaatggaacacaatc

SEQ ID NO: 678535 - DNA, 22 bp, Artificial Sequence
  chemically synthesized
tatgaggtttatgattgtgttc

SEQ ID NO: 678536 - DNA, 22 bp, Artificial Sequence
  chemically synthesized
aagaaatggaacacaatcataa

SEQ ID NO: 678537 - DNA, 22 bp, Artificial Sequence
  chemically synthesized
agaaatggaacacaatcataaa

SEQ ID NO: 678538 - DNA, 22 bp, Artificial Sequence
  chemically synthesized
catatgtctttatgaggtttat

SEQ ID NO: 678539 - DNA, 22 bp, Artificial Sequence
  chemically synthesized
ccatatgtctttatgaggttta

SEQ ID NO: 678540 - DNA, 22 bp, Artificial Sequence
  chemically synthesized
gatgatttccatatgtctttat

SEQ ID NO: 678541 - DNA, 22 bp, Artificial Sequence
  chemically synthesized
ggatgatttccatatgtcttta

SEQ ID NO: 678542 - DNA, 22 bp, Artificial Sequence
  chemically synthesized
tacagtttggatgatttccata

SEQ ID NO: 678543 - DNA, 22 bp, Artificial Sequence
  chemically synthesized
ataaagacatatggaaatcatc

SEQ ID NO: 678544 - DNA, 22 bp, Artificial Sequence
  chemically synthesized
aagttgtacagtttggatgatt

SEQ ID NO: 678545 - DNA, 22 bp, Artificial Sequence
  chemically synthesized
gaagttgtacagtttggatgat

SEQ ID NO: 678546 - DNA, 22 bp, Artificial Sequence
  chemically synthesized
tgaagttgtacagtttggatga

SEQ ID NO: 678547 - DNA, 22 bp, Artificial Sequence
  chemically synthesized
cagggatggtctttgaagttgt

SEQ ID NO: 678548 - DNA, 22 bp, Artificial Sequence
  chemically synthesized
gtaaatattacagggatggtct

SEQ ID NO: 678549 - DNA, 22 bp, Artificial Sequence
  chemically synthesized
tacaacttcaaagaccatccct

SEQ ID NO: 678550 - DNA, 22 bp, Artificial Sequence
  chemically synthesized
actagtaaatattacagggatg

SEQ ID NO: 678551 - DNA, 22 bp, Artificial Sequence
  chemically synthesized
caaagaccatccctgtaatatt

SEQ ID NO: 678552 - DNA, 22 bp, Artificial Sequence
  chemically synthesized
aaagaccatccctgtaatattt

SEQ ID NO: 678553 - DNA, 22 bp, Artificial Sequence
  chemically synthesized
aatcactgactagtaaatatta

SEQ ID NO: 678554 - DNA, 22 bp, Artificial Sequence
  chemically synthesized
ttcaatcactgactagtaaata

SEQ ID NO: 678555 - DNA, 22 bp, Artificial Sequence
  chemically synthesized
actgttcaatcactgactagta

SEQ ID NO: 678556 - DNA, 22 bp, Artificial Sequence
  chemically synthesized
taatatttactagtcagtgatt

SEQ ID NO: 678557 - DNA, 22 bp, Artificial Sequence
  chemically synthesized
agtagccctcactgttcaatca

SEQ ID NO: 678558 - DNA, 22 bp, Artificial Sequence
  chemically synthesized
cagtagccctcactgttcaatc

SEQ ID NO: 678559 - DNA, 22 bp, Artificial Sequence
  chemically synthesized
actagtcagtgattgaacagtg

SEQ ID NO: 678560 - DNA, 22 bp, Artificial Sequence
  chemically synthesized
ctagtcagtgattgaacagtga

SEQ ID NO: 678561 - DNA, 22 bp, Artificial Sequence
  chemically synthesized
atttcagtagccctcactgttc

SEQ ID NO: 678562 - DNA, 22 bp, Artificial Sequence
  chemically synthesized
gtcagtgattgaacagtgaggg

SEQ ID NO: 678563 - DNA, 22 bp, Artificial Sequence
  chemically synthesized
caaattgatttcagtagccctc

SEQ ID NO: 678564 - DNA, 22 bp, Artificial Sequence
  chemically synthesized
gcaaattgatttcagtagccct

SEQ ID NO: 678565 - DNA, 22 bp, Artificial Sequence
  chemically synthesized
ttgcaaattgatttcagtagcc

SEQ ID NO: 678566 - DNA, 22 bp, Artificial Sequence
  chemically synthesized
cttgcaaattgatttcagtagc

SEQ ID NO: 678567 - DNA, 22 bp, Artificial Sequence
  chemically synthesized
tcttgcaaattgatttcagtag

SEQ ID NO: 678568 - DNA, 22 bp, Artificial Sequence
  chemically synthesized
aacagtgagggctactgaaatc

SEQ ID NO: 678569 - DNA, 22 bp, Artificial Sequence
  chemically synthesized
acaagtgaacattttcttgcaa

SEQ ID NO: 678570 - DNA, 22 bp, Artificial Sequence
  chemically synthesized
ctgaaatcaatttgcaagaaaa

SEQ ID NO: 678571 - DNA, 22 bp, Artificial Sequence
  chemically synthesized
cacaagtgaacattttcttgca

SEQ ID NO: 678572 - DNA, 22 bp, Artificial Sequence
  chemically synthesized
aaatcaatttgcaagaaaatgt

SEQ ID NO: 678573 - DNA, 22 bp, Artificial Sequence
  chemically synthesized
gcaagaaaatgttcacttgtga

SEQ ID NO: 678574 - DNA, 22 bp, Artificial Sequence
  chemically synthesized
caagaaaatgttcacttgtgaa

SEQ ID NO: 678575 - DNA, 22 bp, Artificial Sequence
  chemically synthesized
gaagacagtgaaacagcacttc

SEQ ID NO: 678576 - DNA, 22 bp, Artificial Sequence
  chemically synthesized
ggaagacagtgaaacagcactt

SEQ ID NO: 678577 - DNA, 22 bp, Artificial Sequence
  chemically synthesized
acttgtgaagtgctgtttcact

SEQ ID NO: 678578 - DNA, 22 bp, Artificial Sequence
  chemically synthesized
gtgaagtgctgtttcactgtct

SEQ ID NO: 678579 - DNA, 22 bp, Artificial Sequence
  chemically synthesized
tgaagtgctgtttcactgtctt

SEQ ID NO: 678580 - DNA, 22 bp, Artificial Sequence
  chemically synthesized
aaataaacgtatttggaagaca

SEQ ID NO: 678581 - DNA, 22 bp, Artificial Sequence
  chemically synthesized
tttcactgtcttccaaatacgt

SEQ ID NO: 678582 - DNA, 22 bp, Artificial Sequence
  chemically synthesized
cactgtcttccaaatacgttta

SEQ ID NO: 678583 - DNA, 22 bp, Artificial Sequence
  chemically synthesized
actgtcttccaaatacgtttat

SEQ ID NO: 678584 - DNA, 22 bp, Artificial Sequence
  chemically synthesized
tcttccaaatacgtttatttca

SEQ ID NO: 678585 - DNA, 22 bp, Artificial Sequence
  chemically synthesized
tggaaaagtaaaactgaaataa

SEQ ID NO: 678586 - DNA, 22 bp, Artificial Sequence
  chemically synthesized
ccaaatacgtttatttcagttt

SEQ ID NO: 678587 - DNA, 22 bp, Artificial Sequence
  chemically synthesized
tatggaaaagtaaaactgaaat

SEQ ID NO: 678588 - DNA, 22 bp, Artificial Sequence
  chemically synthesized
caaatacgtttatttcagtttt

SEQ ID NO: 678589 - DNA, 22 bp, Artificial Sequence
  chemically synthesized
tctctatggaaaagtaaaactg

SEQ ID NO: 678590 - DNA, 22 bp, Artificial Sequence
  chemically synthesized
atttcagttttacttttccata

SEQ ID NO: 678591 - DNA, 22 bp, Artificial Sequence
  chemically synthesized
tttcagttttacttttccatag

SEQ ID NO: 678592 - DNA, 22 bp, Artificial Sequence
  chemically synthesized
cagttttacttttccatagaga

SEQ ID NO: 678593 - DNA, 22 bp, Artificial Sequence
  chemically synthesized
aaatgtgagttgtctctatgga

SEQ ID NO: 678594 - DNA, 22 bp, Artificial Sequence
  chemically synthesized
agttttacttttccatagagac

SEQ ID NO: 678595 - DNA, 22 bp, Artificial Sequence
  chemically synthesized
tacttttccatagagacaactc

SEQ ID NO: 678596 - DNA, 22 bp, Artificial Sequence
  chemically synthesized
acttttccatagagacaactca

SEQ ID NO: 678597 - DNA, 22 bp, Artificial Sequence
  chemically synthesized
cttttccatagagacaactcac

SEQ ID NO: 678598 - DNA, 22 bp, Artificial Sequence
  chemically synthesized
tagtcctcaaatgtgagttgtc

SEQ ID NO: 678599 - DNA, 22 bp, Artificial Sequence
  chemically synthesized
ttccatagagacaactcacatt

SEQ ID NO: 678600 - DNA, 22 bp, Artificial Sequence
  chemically synthesized
ttatagtcctcaaatgtgagtt

SEQ ID NO: 678601 - DNA, 22 bp, Artificial Sequence
  chemically synthesized
tccatagagacaactcacattt

SEQ ID NO: 678602 - DNA, 22 bp, Artificial Sequence
  chemically synthesized
gttatagtcctcaaatgtgagt

SEQ ID NO: 678603 - DNA, 22 bp, Artificial Sequence
  chemically synthesized
ccatagagacaactcacatttg

SEQ ID NO: 678604 - DNA, 22 bp, Artificial Sequence
  chemically synthesized
catagagacaactcacatttga

SEQ ID NO: 678605 - DNA, 22 bp, Artificial Sequence
  chemically synthesized
ataagcccttgttatagtcctc

SEQ ID NO: 678606 - DNA, 22 bp, Artificial Sequence
  chemically synthesized
aactgataagcccttgttatag

SEQ ID NO: 678607 - DNA, 22 bp, Artificial Sequence
  chemically synthesized
acatttgaggactataacaagg

SEQ ID NO: 678608 - DNA, 22 bp, Artificial Sequence
  chemically synthesized
cctcaactgataagcccttgtt

SEQ ID NO: 678609 - DNA, 22 bp, Artificial Sequence
  chemically synthesized
gaggactataacaagggcttat

SEQ ID NO: 678610 - DNA, 22 bp, Artificial Sequence
  chemically synthesized
aggactataacaagggcttatc

SEQ ID NO: 678611 - DNA, 22 bp, Artificial Sequence
  chemically synthesized
tattccctcaactgataagccc

SEQ ID NO: 678612 - DNA, 22 bp, Artificial Sequence
  chemically synthesized
ttatattccctcaactgataag

SEQ ID NO: 678613 - DNA, 22 bp, Artificial Sequence
  chemically synthesized
tgttatattccctcaactgata

SEQ ID NO: 678614 - DNA, 22 bp, Artificial Sequence
  chemically synthesized
taacaagggcttatcagttgag

SEQ ID NO: 678615 - DNA, 22 bp, Artificial Sequence
  chemically synthesized
aatgtcactctgttatattccc

SEQ ID NO: 678616 - DNA, 22 bp, Artificial Sequence
  chemically synthesized
gaatgtcactctgttatattcc

SEQ ID NO: 678617 - DNA, 22 bp, Artificial Sequence
  chemically synthesized
atcagttgagggaatataacag

SEQ ID NO: 678618 - DNA, 22 bp, Artificial Sequence
  chemically synthesized
tcagttgagggaatataacaga

SEQ ID NO: 678619 - DNA, 22 bp, Artificial Sequence
  chemically synthesized
agacttgaatgtcactctgtta

SEQ ID NO: 678620 - DNA, 22 bp, Artificial Sequence
  chemically synthesized
aagacttgaatgtcactctgtt

SEQ ID NO: 678621 - DNA, 22 bp, Artificial Sequence
  chemically synthesized
taagacttgaatgtcactctgt

SEQ ID NO: 678622 - DNA, 22 bp, Artificial Sequence
  chemically synthesized
agggaatataacagagtgacat

SEQ ID NO: 678623 - DNA, 22 bp, Artificial Sequence
  chemically synthesized
tttaagacttgaatgtcactct

SEQ ID NO: 678624 - DNA, 22 bp, Artificial Sequence
  chemically synthesized
ctctttaagacttgaatgtcac

SEQ ID NO: 678625 - DNA, 22 bp, Artificial Sequence
  chemically synthesized
gctctttaagacttgaatgtca

SEQ ID NO: 678626 - DNA, 22 bp, Artificial Sequence
  chemically synthesized
ttgctctttaagacttgaatgt

SEQ ID NO: 678627 - DNA, 22 bp, Artificial Sequence
  chemically synthesized
cttgctctttaagacttgaatg

SEQ ID NO: 678628 - DNA, 22 bp, Artificial Sequence
  chemically synthesized
ttcttgctctttaagacttgaa

SEQ ID NO: 678629 - DNA, 22 bp, Artificial Sequence
  chemically synthesized
ctcttcttgctctttaagactt

SEQ ID NO: 678630 - DNA, 22 bp, Artificial Sequence
  chemically synthesized
ctgctcttcttgctctttaaga

SEQ ID NO: 678631 - DNA, 22 bp, Artificial Sequence
  chemically synthesized
aagtcttaaagagcaagaagag

SEQ ID NO: 678632 - DNA, 22 bp, Artificial Sequence
  chemically synthesized
aaagagcaagaagagcaggaga

SEQ ID NO: 678633 - DNA, 22 bp, Artificial Sequence
  chemically synthesized
aagagcaagaagagcaggagat

SEQ ID NO: 678634 - DNA, 22 bp, Artificial Sequence
  chemically synthesized
aagcatagagaccatatctcct

SEQ ID NO: 678635 - DNA, 22 bp, Artificial Sequence
  chemically synthesized
aaagcatagagaccatatctcc

SEQ ID NO: 678636 - DNA, 22 bp, Artificial Sequence
  chemically synthesized
aaaccccttaaagcatagagac

SEQ ID NO: 678637 - DNA, 22 bp, Artificial Sequence
  chemically synthesized
gtcatggggtgtcctaaaaccc

SEQ ID NO: 678638 - DNA, 22 bp, Artificial Sequence
  chemically synthesized
tatgctttaaggggttttagga

SEQ ID NO: 678639 - DNA, 22 bp, Artificial Sequence
  chemically synthesized
ggtcatggggtgtcctaaaacc

SEQ ID NO: 678640 - DNA, 22 bp, Artificial Sequence
  chemically synthesized
tgctttaaggggttttaggaca

SEQ ID NO: 678641 - DNA, 22 bp, Artificial Sequence
  chemically synthesized
taaggggttttaggacacccca

SEQ ID NO: 678642 - DNA, 22 bp, Artificial Sequence
  chemically synthesized
aaggggttttaggacaccccat

SEQ ID NO: 678643 - DNA, 22 bp, Artificial Sequence
  chemically synthesized
aggggttttaggacaccccatg

SEQ ID NO: 678644 - DNA, 22 bp, Artificial Sequence
  chemically synthesized
taggacaccccatgaccaagcc

SEQ ID NO: 678645 - DNA, 22 bp, Artificial Sequence
  chemically synthesized
aggacaccccatgaccaagccg

SEQ ID NO: 678646 - DNA, 22 bp, Artificial Sequence
  chemically synthesized
cagatcataaaccggcttggtc

SEQ ID NO: 678647 - DNA, 22 bp, Artificial Sequence
  chemically synthesized
ggacaccccatgaccaagccgg

SEQ ID NO: 678648 - DNA, 22 bp, Artificial Sequence
  chemically synthesized
tccagatcataaaccggcttgg

SEQ ID NO: 678649 - DNA, 22 bp, Artificial Sequence
  chemically synthesized
ctccagatcataaaccggcttg

SEQ ID NO: 678650 - DNA, 22 bp, Artificial Sequence
  chemically synthesized
ccccttctccagatcataaacc

SEQ ID NO: 678651 - DNA, 22 bp, Artificial Sequence
  chemically synthesized
cctaccccttctccagatcata

SEQ ID NO: 678652 - DNA, 22 bp, Artificial Sequence
  chemically synthesized
atgatctggagaaggggtaggc

SEQ ID NO: 678653 - DNA, 22 bp, Artificial Sequence
  chemically synthesized
tgatctggagaaggggtaggca

SEQ ID NO: 678654 - DNA, 22 bp, Artificial Sequence
  chemically synthesized
gagaaggggtaggcaggactgg

SEQ ID NO: 678655 - DNA, 22 bp, Artificial Sequence
  chemically synthesized
tgcatgtaaagtaccagtcctg

SEQ ID NO: 678656 - DNA, 22 bp, Artificial Sequence
  chemically synthesized
tgctgtgcatgtaaagtaccag

SEQ ID NO: 678657 - DNA, 22 bp, Artificial Sequence
  chemically synthesized
gtgctgtgcatgtaaagtacca

SEQ ID NO: 678658 - DNA, 22 bp, Artificial Sequence
  chemically synthesized
cttgtgctgtgcatgtaaagta

SEQ ID NO: 678659 - DNA, 22 bp, Artificial Sequence
  chemically synthesized
cagcctccttgtgctgtgcatg

SEQ ID NO: 678660 - DNA, 22 bp, Artificial Sequence
  chemically synthesized
gtactttacatgcacagcacaa

SEQ ID NO: 678661 - DNA, 22 bp, Artificial Sequence
  chemically synthesized
caagctgcagcctccttgtgct

SEQ ID NO: 678662 - DNA, 22 bp, Artificial Sequence
  chemically synthesized
tacatgcacagcacaaggaggc

SEQ ID NO: 678663 - DNA, 22 bp, Artificial Sequence
  chemically synthesized
acatgcacagcacaaggaggct

SEQ ID NO: 678664 - DNA, 22 bp, Artificial Sequence
  chemically synthesized
catgcacagcacaaggaggctg

SEQ ID NO: 678665 - DNA, 22 bp, Artificial Sequence
  chemically synthesized
cacgaagctgcaagctgcagcc

SEQ ID NO: 678666 - DNA, 22 bp, Artificial Sequence
  chemically synthesized
ccacgaagctgcaagctgcagc

SEQ ID NO: 678667 - DNA, 22 bp, Artificial Sequence
  chemically synthesized
tccacgaagctgcaagctgcag

SEQ ID NO: 678668 - DNA, 22 bp, Artificial Sequence
  chemically synthesized
ttccacgaagctgcaagctgca

SEQ ID NO: 678669 - DNA, 22 bp, Artificial Sequence
  chemically synthesized
tttccacgaagctgcaagctgc

SEQ ID NO: 678670 - DNA, 22 bp, Artificial Sequence
  chemically synthesized
cagcttgcagcttcgtggaaaa

SEQ ID NO: 678671 - DNA, 22 bp, Artificial Sequence
  chemically synthesized
agaacaagcaacactttttcca

SEQ ID NO: 678672 - DNA, 22 bp, Artificial Sequence
  chemically synthesized
gcagcttcgtggaaaaagtgtt

SEQ ID NO: 678673 - DNA, 22 bp, Artificial Sequence
  chemically synthesized
cagcttcgtggaaaaagtgttg

SEQ ID NO: 678674 - DNA, 22 bp, Artificial Sequence
  chemically synthesized
cgtggaaaaagtgttgcttgtt

SEQ ID NO: 678675 - DNA, 22 bp, Artificial Sequence
  chemically synthesized
gtggaaaaagtgttgcttgttc

SEQ ID NO: 678676 - DNA, 22 bp, Artificial Sequence
  chemically synthesized
agaaatgcctgagaacaagcaa

SEQ ID NO: 678677 - DNA, 22 bp, Artificial Sequence
  chemically synthesized
cgagctgagaaatgcctgagaa

SEQ ID NO: 678678 - DNA, 22 bp, Artificial Sequence
  chemically synthesized
ccgagctgagaaatgcctgaga

SEQ ID NO: 678679 - DNA, 22 bp, Artificial Sequence
  chemically synthesized
tccgagctgagaaatgcctgag

SEQ ID NO: 678680 - DNA, 22 bp, Artificial Sequence
  chemically synthesized
actttccgagctgagaaatgcc

SEQ ID NO: 678681 - DNA, 22 bp, Artificial Sequence
  chemically synthesized
cttgttctcaggcatttctcag

SEQ ID NO: 678682 - DNA, 22 bp, Artificial Sequence
  chemically synthesized
gttctcaggcatttctcagctc

SEQ ID NO: 678683 - DNA, 22 bp, Artificial Sequence
  chemically synthesized
ttctcaggcatttctcagctcg

SEQ ID NO: 678684 - DNA, 22 bp, Artificial Sequence
  chemically synthesized
tcaggcatttctcagctcggaa

SEQ ID NO: 678685 - DNA, 22 bp, Artificial Sequence
  chemically synthesized
gtatacactcactttccgagct

SEQ ID NO: 678686 - DNA, 22 bp, Artificial Sequence
  chemically synthesized
aggcatttctcagctcggaaag

SEQ ID NO: 678687 - DNA, 22 bp, Artificial Sequence
  chemically synthesized
ctcagctcggaaagtgagtgta

SEQ ID NO: 678688 - DNA, 22 bp, Artificial Sequence
  chemically synthesized
tcagctcggaaagtgagtgtat

SEQ ID NO: 678689 - DNA, 22 bp, Artificial Sequence
  chemically synthesized
agctcggaaagtgagtgtatac

SEQ ID NO: 678690 - DNA, 22 bp, Artificial Sequence
  chemically synthesized
tatatggaattggtatacactc

SEQ ID NO: 678691 - DNA, 22 bp, Artificial Sequence
  chemically synthesized
atatatggaattggtatacact

SEQ ID NO: 678692 - DNA, 22 bp, Artificial Sequence
  chemically synthesized
ggaaagtgagtgtataccaatt

SEQ ID NO: 678693 - DNA, 22 bp, Artificial Sequence
  chemically synthesized
cacttatatatggaattggtat

SEQ ID NO: 678694 - DNA, 22 bp, Artificial Sequence
  chemically synthesized
tgcacttatatatggaattggt

SEQ ID NO: 678695 - DNA, 22 bp, Artificial Sequence
  chemically synthesized
ctctgcacttatatatggaatt

SEQ ID NO: 678696 - DNA, 22 bp, Artificial Sequence
  chemically synthesized
gctctgcacttatatatggaat

SEQ ID NO: 678697 - DNA, 22 bp, Artificial Sequence
  chemically synthesized
cttgctctgcacttatatatgg

SEQ ID NO: 678698 - DNA, 22 bp, Artificial Sequence
  chemically synthesized
ccttgctctgcacttatatatg

SEQ ID NO: 678699 - DNA, 22 bp, Artificial Sequence
  chemically synthesized
tccttgctctgcacttatatat

SEQ ID NO: 678700 - DNA, 22 bp, Artificial Sequence
  chemically synthesized
catatataagtgcagagcaagg

SEQ ID NO: 678701 - DNA, 22 bp, Artificial Sequence
  chemically synthesized
aatagaaggtaacctttccttg

SEQ ID NO: 678702 - DNA, 22 bp, Artificial Sequence
  chemically synthesized
aatgcagggtggtctcaataga

SEQ ID NO: 678703 - DNA, 22 bp, Artificial Sequence
  chemically synthesized
ccttctattgagaccaccctgc

SEQ ID NO: 678704 - DNA, 22 bp, Artificial Sequence
  chemically synthesized
ctattgagaccaccctgcattc

SEQ ID NO: 678705 - DNA, 22 bp, Artificial Sequence
  chemically synthesized
tattgagaccaccctgcattca

SEQ ID NO: 678706 - DNA, 22 bp, Artificial Sequence
  chemically synthesized
ttgagaccaccctgcattcagg

SEQ ID NO: 678707 - DNA, 22 bp, Artificial Sequence
  chemically synthesized
gaaatagaggaggcctgaatgc

SEQ ID NO: 678708 - DNA, 22 bp, Artificial Sequence
  chemically synthesized
ggaaatagaggaggcctgaatg

SEQ ID NO: 678709 - DNA, 22 bp, Artificial Sequence
  chemically synthesized
agaccaccctgcattcaggcct

SEQ ID NO: 678710 - DNA, 22 bp, Artificial Sequence
  chemically synthesized
tggaaatagaggaggcctgaat

SEQ ID NO: 678711 - DNA, 22 bp, Artificial Sequence
  chemically synthesized
gatgacctttggaaatagagga

SEQ ID NO: 678712 - DNA, 22 bp, Artificial Sequence
  chemically synthesized
cattcaggcctcctctatttcc

SEQ ID NO: 678713 - DNA, 22 bp, Artificial Sequence
  chemically synthesized
aggcctcctctatttccaaagg

SEQ ID NO: 678714 - DNA, 22 bp, Artificial Sequence
  chemically synthesized
tatcacatctggatgacctttg

SEQ ID NO: 678715 - DNA, 22 bp, Artificial Sequence
  chemically synthesized
atatcacatctggatgaccttt

SEQ ID NO: 678716 - DNA, 22 bp, Artificial Sequence
  chemically synthesized
ctctatttccaaaggtcatcca

SEQ ID NO: 678717 - DNA, 22 bp, Artificial Sequence
  chemically synthesized
tatttccaaaggtcatccagat

SEQ ID NO: 678718 - DNA, 22 bp, Artificial Sequence
  chemically synthesized
gtgcttatatcacatctggatg

SEQ ID NO: 678719 - DNA, 22 bp, Artificial Sequence
  chemically synthesized
tttccaaaggtcatccagatgt

SEQ ID NO: 678720 - DNA, 22 bp, Artificial Sequence
  chemically synthesized
ccaaaggtcatccagatgtgat

SEQ ID NO: 678721 - DNA, 22 bp, Artificial Sequence
  chemically synthesized
cctggtgcttatatcacatctg

SEQ ID NO: 678722 - DNA, 22 bp, Artificial Sequence
  chemically synthesized
caaaggtcatccagatgtgata

SEQ ID NO: 678723 - DNA, 22 bp, Artificial Sequence
  chemically synthesized
tccctggtgcttatatcacatc

SEQ ID NO: 678724 - DNA, 22 bp, Artificial Sequence
  chemically synthesized
ctccctggtgcttatatcacat

SEQ ID NO: 678725 - DNA, 22 bp, Artificial Sequence
  chemically synthesized
tctccctggtgcttatatcaca

SEQ ID NO: 678726 - DNA, 22 bp, Artificial Sequence
  chemically synthesized
ctttctccctggtgcttatatc

SEQ ID NO: 678727 - DNA, 22 bp, Artificial Sequence
  chemically synthesized
cctttctccctggtgcttatat

SEQ ID NO: 678728 - DNA, 22 bp, Artificial Sequence
  chemically synthesized
ttcctttctccctggtgcttat

SEQ ID NO: 678729 - DNA, 22 bp, Artificial Sequence
  chemically synthesized
gctcttcctttctccctggtgc

SEQ ID NO: 678730 - DNA, 22 bp, Artificial Sequence
  chemically synthesized
cgctcttcctttctccctggtg

SEQ ID NO: 678731 - DNA, 22 bp, Artificial Sequence
  chemically synthesized
ttcgctcttcctttctccctgg

SEQ ID NO: 678732 - DNA, 22 bp, Artificial Sequence
  chemically synthesized
tcttcgctcttcctttctccct

SEQ ID NO: 678733 - DNA, 22 bp, Artificial Sequence
  chemically synthesized
ctctcttcgctcttcctttctc

SEQ ID NO: 678734 - DNA, 22 bp, Artificial Sequence
  chemically synthesized
cctctcttcgctcttcctttct

SEQ ID NO: 678735 - DNA, 22 bp, Artificial Sequence
  chemically synthesized
tacatgtgggcacacatgtgtg

SEQ ID NO: 678736 - DNA, 22 bp, Artificial Sequence
  chemically synthesized
gtacatgtgggcacacatgtgt

SEQ ID NO: 678737 - DNA, 22 bp, Artificial Sequence
  chemically synthesized
tgtgagcccttgtacatgtggg

SEQ ID NO: 678738 - DNA, 22 bp, Artificial Sequence
  chemically synthesized
gtaagggcctgtgtgagccctt

SEQ ID NO: 678739 - DNA, 22 bp, Artificial Sequence
  chemically synthesized
cacagtgtgactagtaagggcc

SEQ ID NO: 678740 - DNA, 22 bp, Artificial Sequence
  chemically synthesized
ttacacagtgtgactagtaagg

SEQ ID NO: 678741 - DNA, 22 bp, Artificial Sequence
  chemically synthesized
ttgttacacagtgtgactagta

SEQ ID NO: 678742 - DNA, 22 bp, Artificial Sequence
  chemically synthesized
acacaggcccttactagtcaca

SEQ ID NO: 678743 - DNA, 22 bp, Artificial Sequence
  chemically synthesized
actagtcacactgtgtaacaac

SEQ ID NO: 678744 - DNA, 22 bp, Artificial Sequence
  chemically synthesized
ctagtcacactgtgtaacaaca

SEQ ID NO: 678745 - DNA, 22 bp, Artificial Sequence
  chemically synthesized
gagatgggacattgttgttaca

SEQ ID NO: 678746 - DNA, 22 bp, Artificial Sequence
  chemically synthesized
gtcacactgtgtaacaacaatg

SEQ ID NO: 678747 - DNA, 22 bp, Artificial Sequence
  chemically synthesized
caaatatcctggagatgggaca

SEQ ID NO: 678748 - DNA, 22 bp, Artificial Sequence
  chemically synthesized
tgtaacaacaatgtcccatctc

SEQ ID NO: 678749 - DNA, 22 bp, Artificial Sequence
  chemically synthesized
acaaatatcctggagatgggac

SEQ ID NO: 678750 - DNA, 22 bp, Artificial Sequence
  chemically synthesized
cggtccttacaaatatcctgga

SEQ ID NO: 678751 - DNA, 22 bp, Artificial Sequence
  chemically synthesized
tagaagatgctacggtccttac

SEQ ID NO: 678752 - DNA, 22 bp, Artificial Sequence
  chemically synthesized
caggatatttgtaaggaccgta

SEQ ID NO: 678753 - DNA, 22 bp, Artificial Sequence
  chemically synthesized
cagacctatagaagatgctacg

SEQ ID NO: 678754 - DNA, 22 bp, Artificial Sequence
  chemically synthesized
tgcagacctatagaagatgcta

SEQ ID NO: 678755 - DNA, 22 bp, Artificial Sequence
  chemically synthesized
ctgcagacctatagaagatgct

SEQ ID NO: 678756 - DNA, 22 bp, Artificial Sequence
  chemically synthesized
gtaaggaccgtagcatcttcta

SEQ ID NO: 678757 - DNA, 22 bp, Artificial Sequence
  chemically synthesized
tctgcagacctatagaagatgc

SEQ ID NO: 678758 - DNA, 22 bp, Artificial Sequence
  chemically synthesized
taaggaccgtagcatcttctat

SEQ ID NO: 678759 - DNA, 22 bp, Artificial Sequence
  chemically synthesized
ttctgcagacctatagaagatg

SEQ ID NO: 678760 - DNA, 22 bp, Artificial Sequence
  chemically synthesized
aatgtttttctgcagacctata

SEQ ID NO: 678761 - DNA, 22 bp, Artificial Sequence
  chemically synthesized
agctaaatgtttttctgcagac

SEQ ID NO: 678762 - DNA, 22 bp, Artificial Sequence
  chemically synthesized
ctataggtctgcagaaaaacat

SEQ ID NO: 678763 - DNA, 22 bp, Artificial Sequence
  chemically synthesized
tataggtctgcagaaaaacatt

SEQ ID NO: 678764 - DNA, 22 bp, Artificial Sequence
  chemically synthesized
tcagctcagctaaatgtttttc

SEQ ID NO: 678765 - DNA, 22 bp, Artificial Sequence
  chemically synthesized
atcagctcagctaaatgttttt

SEQ ID NO: 678766 - DNA, 22 bp, Artificial Sequence
  chemically synthesized
taggtctgcagaaaaacattta

SEQ ID NO: 678767 - DNA, 22 bp, Artificial Sequence
  chemically synthesized
cagaaaaacatttagctgagct

SEQ ID NO: 678768 - DNA, 22 bp, Artificial Sequence
  chemically synthesized
atcaggcttatcagctcagcta

SEQ ID NO: 678769 - DNA, 22 bp, Artificial Sequence
  chemically synthesized
tctgatcaggcttatcagctca

SEQ ID NO: 678770 - DNA, 22 bp, Artificial Sequence
  chemically synthesized
tgtctgatcaggcttatcagct

SEQ ID NO: 678771 - DNA, 22 bp, Artificial Sequence
  chemically synthesized
tctctgtctgatcaggcttatc

SEQ ID NO: 678772 - DNA, 22 bp, Artificial Sequence
  chemically synthesized
agctgagctgataagcctgatc

SEQ ID NO: 678773 - DNA, 22 bp, Artificial Sequence
  chemically synthesized
gctgagctgataagcctgatca

SEQ ID NO: 678774 - DNA, 22 bp, Artificial Sequence
  chemically synthesized
cctgtctctgtctgatcaggct

SEQ ID NO: 678775 - DNA, 22 bp, Artificial Sequence
  chemically synthesized
agctgataagcctgatcagaca

SEQ ID NO: 678776 - DNA, 22 bp, Artificial Sequence
  chemically synthesized
ataagcctgatcagacagagac

SEQ ID NO: 678777 - DNA, 22 bp, Artificial Sequence
  chemically synthesized
accgtggttccctgtctctgtc

SEQ ID NO: 678778 - DNA, 22 bp, Artificial Sequence
  chemically synthesized
caccgtggttccctgtctctgt

SEQ ID NO: 678779 - DNA, 22 bp, Artificial Sequence
  chemically synthesized
tcaccgtggttccctgtctctg

SEQ ID NO: 678780 - DNA, 22 bp, Artificial Sequence
  chemically synthesized
ttcaccgtggttccctgtctct

SEQ ID NO: 678781 - DNA, 22 bp, Artificial Sequence
  chemically synthesized
atcagacagagacagggaacca

SEQ ID NO: 678782 - DNA, 22 bp, Artificial Sequence
  chemically synthesized
cagatggtggcttttcaccgtg

SEQ ID NO: 678783 - DNA, 22 bp, Artificial Sequence
  chemically synthesized
aagtccattccagatggtggct

SEQ ID NO: 678784 - DNA, 22 bp, Artificial Sequence
  chemically synthesized
gaagtccattccagatggtggc

SEQ ID NO: 678785 - DNA, 22 bp, Artificial Sequence
  chemically synthesized
atttgaagtccattccagatgg

SEQ ID NO: 678786 - DNA, 22 bp, Artificial Sequence
  chemically synthesized
taatttgaagtccattccagat

SEQ ID NO: 678787 - DNA, 22 bp, Artificial Sequence
  chemically synthesized
ctctaatttgaagtccattcca

SEQ ID NO: 678788 - DNA, 22 bp, Artificial Sequence
  chemically synthesized
tgttcctctaatttgaagtcca

SEQ ID NO: 678789 - DNA, 22 bp, Artificial Sequence
  chemically synthesized
cctatgttcctctaatttgaag

SEQ ID NO: 678790 - DNA, 22 bp, Artificial Sequence
  chemically synthesized
gcctatgttcctctaatttgaa

SEQ ID NO: 678791 - DNA, 22 bp, Artificial Sequence
  chemically synthesized
ttgcctatgttcctctaatttg

SEQ ID NO: 678792 - DNA, 22 bp, Artificial Sequence
  chemically synthesized
cttgcctatgttcctctaattt

SEQ ID NO: 678793 - DNA, 22 bp, Artificial Sequence
  chemically synthesized
gaatggacttcaaattagagga

SEQ ID NO: 678794 - DNA, 22 bp, Artificial Sequence
  chemically synthesized
tttcttgcctatgttcctctaa

SEQ ID NO: 678795 - DNA, 22 bp, Artificial Sequence
  chemically synthesized
atttcttgcctatgttcctcta

SEQ ID NO: 678796 - DNA, 22 bp, Artificial Sequence
  chemically synthesized
caaattagaggaacataggcaa

SEQ ID NO: 678797 - DNA, 22 bp, Artificial Sequence
  chemically synthesized
aaattagaggaacataggcaag

SEQ ID NO: 678798 - DNA, 22 bp, Artificial Sequence
  chemically synthesized
gtacaggtttatttcttgccta

SEQ ID NO: 678799 - DNA, 22 bp, Artificial Sequence
  chemically synthesized
ggtacaggtttatttcttgcct

SEQ ID NO: 678800 - DNA, 22 bp, Artificial Sequence
  chemically synthesized
gaggaacataggcaagaaataa

SEQ ID NO: 678801 - DNA, 22 bp, Artificial Sequence
  chemically synthesized
tgtttggtacaggtttatttct

SEQ ID NO: 678802 - DNA, 22 bp, Artificial Sequence
  chemically synthesized
gaactgtgtttggtacaggttt

SEQ ID NO: 678803 - DNA, 22 bp, Artificial Sequence
  chemically synthesized
agaactgtgtttggtacaggtt

SEQ ID NO: 678804 - DNA, 22 bp, Artificial Sequence
  chemically synthesized
tagaactgtgtttggtacaggt

SEQ ID NO: 678805 - DNA, 22 bp, Artificial Sequence
  chemically synthesized
ttagaactgtgtttggtacagg

SEQ ID NO: 678806 - DNA, 22 bp, Artificial Sequence
  chemically synthesized
cttttagaactgtgtttggtac

SEQ ID NO: 678807 - DNA, 22 bp, Artificial Sequence
  chemically synthesized
ccttttagaactgtgtttggta

SEQ ID NO: 678808 - DNA, 22 bp, Artificial Sequence
  chemically synthesized
tccttttagaactgtgtttggt

SEQ ID NO: 678809 - DNA, 22 bp, Artificial Sequence
  chemically synthesized
cctttccttttagaactgtgtt

SEQ ID NO: 678810 - DNA, 22 bp, Artificial Sequence
  chemically synthesized
ccctttccttttagaactgtgt

SEQ ID NO: 678811 - DNA, 22 bp, Artificial Sequence
  chemically synthesized
tttccctttccttttagaactg

SEQ ID NO: 678812 - DNA, 22 bp, Artificial Sequence
  chemically synthesized
taccaaacacagttctaaaagg

SEQ ID NO: 678813 - DNA, 22 bp, Artificial Sequence
  chemically synthesized
tacacactgtttccctttcctt

SEQ ID NO: 678814 - DNA, 22 bp, Artificial Sequence
  chemically synthesized
taaattgtacacactgtttccc

SEQ ID NO: 678815 - DNA, 22 bp, Artificial Sequence
  chemically synthesized
taaaaggaaagggaaacagtgt

SEQ ID NO: 678816 - DNA, 22 bp, Artificial Sequence
  chemically synthesized
ctgtaaattgtacacactgttt

SEQ ID NO: 678817 - DNA, 22 bp, Artificial Sequence
  chemically synthesized
aaaggaaagggaaacagtgtgt

SEQ ID NO: 678818 - DNA, 22 bp, Artificial Sequence
  chemically synthesized
tcctgtaaattgtacacactgt

SEQ ID NO: 678819 - DNA, 22 bp, Artificial Sequence
  chemically synthesized
tgtgggattctcctgtaaattg

SEQ ID NO: 678820 - DNA, 22 bp, Artificial Sequence
  chemically synthesized
tatgtgggattctcctgtaaat

SEQ ID NO: 678821 - DNA, 22 bp, Artificial Sequence
  chemically synthesized
attctatgtgggattctcctgt

SEQ ID NO: 678822 - DNA, 22 bp, Artificial Sequence
  chemically synthesized
attcattctatgtgggattctc

SEQ ID NO: 678823 - DNA, 22 bp, Artificial Sequence
  chemically synthesized
acaggagaatcccacatagaat

SEQ ID NO: 678824 - DNA, 22 bp, Artificial Sequence
  chemically synthesized
caggagaatcccacatagaatg

SEQ ID NO: 678825 - DNA, 22 bp, Artificial Sequence
  chemically synthesized
catgaagccctcattcattcta

SEQ ID NO: 678826 - DNA, 22 bp, Artificial Sequence
  chemically synthesized
gaagatggggagctccatgaag

SEQ ID NO: 678827 - DNA, 22 bp, Artificial Sequence
  chemically synthesized
agaagatggggagctccatgaa

SEQ ID NO: 678828 - DNA, 22 bp, Artificial Sequence
  chemically synthesized
tagaagatggggagctccatga

SEQ ID NO: 678829 - DNA, 22 bp, Artificial Sequence
  chemically synthesized
tttagaagatggggagctccat

SEQ ID NO: 678830 - DNA, 22 bp, Artificial Sequence
  chemically synthesized
ctttagaagatggggagctcca

SEQ ID NO: 678831 - DNA, 22 bp, Artificial Sequence
  chemically synthesized
catggagctccccatcttctaa

SEQ ID NO: 678832 - DNA, 22 bp, Artificial Sequence
  chemically synthesized
atggagctccccatcttctaaa

SEQ ID NO: 678833 - DNA, 22 bp, Artificial Sequence
  chemically synthesized
cccatcttctaaagaaatttca

SEQ ID NO: 678834 - DNA, 22 bp, Artificial Sequence
  chemically synthesized
ctaaagaaatttcatgactgtt

SEQ ID NO: 678835 - DNA, 22 bp, Artificial Sequence
  chemically synthesized
taaagaaatttcatgactgttg

SEQ ID NO: 678836 - DNA, 22 bp, Artificial Sequence
  chemically synthesized
aagaaatttcatgactgttggc

SEQ ID NO: 678837 - DNA, 22 bp, Artificial Sequence
  chemically synthesized
catgactgttggcatacataca

SEQ ID NO: 678838 - DNA, 22 bp, Artificial Sequence
  chemically synthesized
aaaaggcaggaatgtatgtatg

SEQ ID NO: 678839 - DNA, 22 bp, Artificial Sequence
  chemically synthesized
atgactgttggcatacatacat

SEQ ID NO: 678840 - DNA, 22 bp, Artificial Sequence
  chemically synthesized
aaaaaggcaggaatgtatgtat

SEQ ID NO: 678841 - DNA, 22 bp, Artificial Sequence
  chemically synthesized
taaaaaggcaggaatgtatgta

SEQ ID NO: 678842 - DNA, 22 bp, Artificial Sequence
  chemically synthesized
tttaaaaaggcaggaatgtatg

SEQ ID NO: 678843 - DNA, 22 bp, Artificial Sequence
  chemically synthesized
ttggcatacatacattcctgcc

SEQ ID NO: 678844 - DNA, 22 bp, Artificial Sequence
  chemically synthesized
gcatacatacattcctgccttt

SEQ ID NO: 678845 - DNA, 22 bp, Artificial Sequence
  chemically synthesized
aaaataaattctttaaaaaggc

SEQ ID NO: 678846 - DNA, 22 bp, Artificial Sequence
  chemically synthesized
caaaataaattctttaaaaagg

SEQ ID NO: 678847 - DNA, 22 bp, Artificial Sequence
  chemically synthesized
accttcaaaataaattctttaa

SEQ ID NO: 678848 - DNA, 22 bp, Artificial Sequence
  chemically synthesized
aaccttcaaaataaattcttta

SEQ ID NO: 678849 - DNA, 22 bp, Artificial Sequence
  chemically synthesized
taaccttcaaaataaattcttt

SEQ ID NO: 678850 - DNA, 22 bp, Artificial Sequence
  chemically synthesized
ctgcctttttaaagaatttatt

SEQ ID NO: 678851 - DNA, 22 bp, Artificial Sequence
  chemically synthesized
cctttttaaagaatttattttg

SEQ ID NO: 678852 - DNA, 22 bp, Artificial Sequence
  chemically synthesized
ataattttaaccttcaaaataa

SEQ ID NO: 678853 - DNA, 22 bp, Artificial Sequence
  chemically synthesized
cataattttaaccttcaaaata

SEQ ID NO: 678854 - DNA, 22 bp, Artificial Sequence
  chemically synthesized
tttaaagaatttattttgaagg

SEQ ID NO: 678855 - DNA, 22 bp, Artificial Sequence
  chemically synthesized
tcataattttaaccttcaaaat

SEQ ID NO: 678856 - DNA, 22 bp, Artificial Sequence
  chemically synthesized
ttaaagaatttattttgaaggt

SEQ ID NO: 678857 - DNA, 22 bp, Artificial Sequence
  chemically synthesized
ttcataattttaaccttcaaaa

SEQ ID NO: 678858 - DNA, 22 bp, Artificial Sequence
  chemically synthesized
taaagaatttattttgaaggtt

SEQ ID NO: 678859 - DNA, 22 bp, Artificial Sequence
  chemically synthesized
aaagaatttattttgaaggtta

SEQ ID NO: 678860 - DNA, 22 bp, Artificial Sequence
  chemically synthesized
aagaatttattttgaaggttaa

SEQ ID NO: 678861 - DNA, 22 bp, Artificial Sequence
  chemically synthesized
aaacccttttcataattttaac

SEQ ID NO: 678862 - DNA, 22 bp, Artificial Sequence
  chemically synthesized
taaaacccttttcataatttta

SEQ ID NO: 678863 - DNA, 22 bp, Artificial Sequence
  chemically synthesized
attttgaaggttaaaattatga

SEQ ID NO: 678864 - DNA, 22 bp, Artificial Sequence
  chemically synthesized
ctaaaacccttttcataatttt

SEQ ID NO: 678865 - DNA, 22 bp, Artificial Sequence
  chemically synthesized
ttttgaaggttaaaattatgaa

SEQ ID NO: 678866 - DNA, 22 bp, Artificial Sequence
  chemically synthesized
tgaaggttaaaattatgaaaag

SEQ ID NO: 678867 - DNA, 22 bp, Artificial Sequence
  chemically synthesized
gaaggttaaaattatgaaaagg

SEQ ID NO: 678868 - DNA, 22 bp, Artificial Sequence
  chemically synthesized
aaggttaaaattatgaaaaggg

SEQ ID NO: 678869 - DNA, 22 bp, Artificial Sequence
  chemically synthesized
aaattatgaaaagggttttaga

SEQ ID NO: 678870 - DNA, 22 bp, Artificial Sequence
  chemically synthesized
aaaaaaaataatttctaaaacc

SEQ ID NO: 678871 - DNA, 22 bp, Artificial Sequence
  chemically synthesized
tgaaaagggttttagaaattat

SEQ ID NO: 678872 - DNA, 22 bp, Artificial Sequence
  chemically synthesized
atggattaaaaaaaaataattt

SEQ ID NO: 678873 - DNA, 22 bp, Artificial Sequence
  chemically synthesized
tagaaattatttttttttaatc

SEQ ID NO: 678874 - DNA, 22 bp, Artificial Sequence
  chemically synthesized
agaaattatttttttttaatcc

SEQ ID NO: 678875 - DNA, 22 bp, Artificial Sequence
  chemically synthesized
ccgaggactgatggattaaaaa

SEQ ID NO: 678876 - DNA, 22 bp, Artificial Sequence
  chemically synthesized
gaaattatttttttttaatcca

SEQ ID NO: 678877 - DNA, 22 bp, Artificial Sequence
  chemically synthesized
gccgaggactgatggattaaaa

SEQ ID NO: 678878 - DNA, 22 bp, Artificial Sequence
  chemically synthesized
tgccgaggactgatggattaaa

SEQ ID NO: 678879 - DNA, 22 bp, Artificial Sequence
  chemically synthesized
agttttgccgaggactgatgga

SEQ ID NO: 678880 - DNA, 22 bp, Artificial Sequence
  chemically synthesized
tttttttttaatccatcagtcc

SEQ ID NO: 678881 - DNA, 22 bp, Artificial Sequence
  chemically synthesized
cagttttgccgaggactgatgg

SEQ ID NO: 678882 - DNA, 22 bp, Artificial Sequence
  chemically synthesized
tcagttttgccgaggactgatg

SEQ ID NO: 678883 - DNA, 22 bp, Artificial Sequence
  chemically synthesized
ttttttaatccatcagtcctcg

SEQ ID NO: 678884 - DNA, 22 bp, Artificial Sequence
  chemically synthesized
tttttaatccatcagtcctcgg

SEQ ID NO: 678885 - DNA, 22 bp, Artificial Sequence
  chemically synthesized
ttttaatccatcagtcctcggc

SEQ ID NO: 678886 - DNA, 22 bp, Artificial Sequence
  chemically synthesized
tttaatccatcagtcctcggca

SEQ ID NO: 678887 - DNA, 22 bp, Artificial Sequence
  chemically synthesized
ttaatccatcagtcctcggcaa

SEQ ID NO: 678888 - DNA, 22 bp, Artificial Sequence
  chemically synthesized
taatccatcagtcctcggcaaa

SEQ ID NO: 678889 - DNA, 22 bp, Artificial Sequence
  chemically synthesized
aatccatcagtcctcggcaaaa

SEQ ID NO: 678890 - DNA, 22 bp, Artificial Sequence
  chemically synthesized
atccatcagtcctcggcaaaac

SEQ ID NO: 678891 - DNA, 22 bp, Artificial Sequence
  chemically synthesized
cagtaaaggagattttcagttt

SEQ ID NO: 678892 - DNA, 22 bp, Artificial Sequence
  chemically synthesized
ccagtaaaggagattttcagtt

SEQ ID NO: 678893 - DNA, 22 bp, Artificial Sequence
  chemically synthesized
ttccagtaaaggagattttcag

SEQ ID NO: 678894 - DNA, 22 bp, Artificial Sequence
  chemically synthesized
cttccagtaaaggagattttca

SEQ ID NO: 678895 - DNA, 22 bp, Artificial Sequence
  chemically synthesized
cttcttccagtaaaggagattt

SEQ ID NO: 678896 - DNA, 22 bp, Artificial Sequence
  chemically synthesized
ggcaaaactgaaaatctccttt

SEQ ID NO: 678897 - DNA, 22 bp, Artificial Sequence
  chemically synthesized
ctccttcttccagtaaaggaga

SEQ ID NO: 678898 - DNA, 22 bp, Artificial Sequence
  chemically synthesized
cctccttcttccagtaaaggag

SEQ ID NO: 678899 - DNA, 22 bp, Artificial Sequence
  chemically synthesized
gaatttcctccttcttccagta

SEQ ID NO: 678900 - DNA, 22 bp, Artificial Sequence
  chemically synthesized
aaaatctcctttactggaagaa

SEQ ID NO: 678901 - DNA, 22 bp, Artificial Sequence
  chemically synthesized
agaatttcctccttcttccagt

SEQ ID NO: 678902 - DNA, 22 bp, Artificial Sequence
  chemically synthesized
ggggcttagaatttcctccttc

SEQ ID NO: 678903 - DNA, 22 bp, Artificial Sequence
  chemically synthesized
ctttactggaagaaggaggaaa

SEQ ID NO: 678904 - DNA, 22 bp, Artificial Sequence
  chemically synthesized
tactggaagaaggaggaaattc

SEQ ID NO: 678905 - DNA, 22 bp, Artificial Sequence
  chemically synthesized
actggaagaaggaggaaattct

SEQ ID NO: 678906 - DNA, 22 bp, Artificial Sequence
  chemically synthesized
ctggaagaaggaggaaattcta

SEQ ID NO: 678907 - DNA, 22 bp, Artificial Sequence
  chemically synthesized
gaagaaggaggaaattctaagc

SEQ ID NO: 678908 - DNA, 22 bp, Artificial Sequence
  chemically synthesized
acaaatgggcaatggaattggg

SEQ ID NO: 678909 - DNA, 22 bp, Artificial Sequence
  chemically synthesized
actcacaaatgggcaatggaat

SEQ ID NO: 678910 - DNA, 22 bp, Artificial Sequence
  chemically synthesized
aactcacaaatgggcaatggaa

SEQ ID NO: 678911 - DNA, 22 bp, Artificial Sequence
  chemically synthesized
taagcccccaattccattgccc

SEQ ID NO: 678912 - DNA, 22 bp, Artificial Sequence
  chemically synthesized
agcccccaattccattgcccat

SEQ ID NO: 678913 - DNA, 22 bp, Artificial Sequence
  chemically synthesized
gtatcttaactcacaaatgggc

SEQ ID NO: 678914 - DNA, 22 bp, Artificial Sequence
  chemically synthesized
cattgcccatttgtgagttaag

SEQ ID NO: 678915 - DNA, 22 bp, Artificial Sequence
  chemically synthesized
tcaaggactagtatcttaactc

SEQ ID NO: 678916 - DNA, 22 bp, Artificial Sequence
  chemically synthesized
cccatttgtgagttaagatact

SEQ ID NO: 678917 - DNA, 22 bp, Artificial Sequence
  chemically synthesized
gtgagttaagatactagtcctt

SEQ ID NO: 678918 - DNA, 22 bp, Artificial Sequence
  chemically synthesized
tgagttaagatactagtccttg

SEQ ID NO: 678919 - DNA, 22 bp, Artificial Sequence
  chemically synthesized
ggagaatagtacctatcaagga

SEQ ID NO: 678920 - DNA, 22 bp, Artificial Sequence
  chemically synthesized
agatactagtccttgataggta

SEQ ID NO: 678921 - DNA, 22 bp, Artificial Sequence
  chemically synthesized
gtccttgataggtactattctc

SEQ ID NO: 678922 - DNA, 22 bp, Artificial Sequence
  chemically synthesized
gataggtactattctcccagtt

SEQ ID NO: 678923 - DNA, 22 bp, Artificial Sequence
  chemically synthesized
ataggtactattctcccagtta

SEQ ID NO: 678924 - DNA, 22 bp, Artificial Sequence
  chemically synthesized
aagtcccccagaatcacagata

SEQ ID NO: 678925 - DNA, 22 bp, Artificial Sequence
  chemically synthesized
ttctcccagttatctgtgattc

SEQ ID NO: 678926 - DNA, 22 bp, Artificial Sequence
  chemically synthesized
ttcaagtcccccagaatcacag

SEQ ID NO: 678927 - DNA, 22 bp, Artificial Sequence
  chemically synthesized
tcccagttatctgtgattctgg

SEQ ID NO: 678928 - DNA, 22 bp, Artificial Sequence
  chemically synthesized
ccagttatctgtgattctgggg

SEQ ID NO: 678929 - DNA, 22 bp, Artificial Sequence
  chemically synthesized
tgttattcaagtcccccagaat

SEQ ID NO: 678930 - DNA, 22 bp, Artificial Sequence
  chemically synthesized
tctatgttattcaagtccccca

SEQ ID NO: 678931 - DNA, 22 bp, Artificial Sequence
  chemically synthesized
atctatgttattcaagtccccc

SEQ ID NO: 678932 - DNA, 22 bp, Artificial Sequence
  chemically synthesized
tctgtgattctgggggacttga

SEQ ID NO: 678933 - DNA, 22 bp, Artificial Sequence
  chemically synthesized
atttatctatgttattcaagtc

SEQ ID NO: 678934 - DNA, 22 bp, Artificial Sequence
  chemically synthesized
tgattctgggggacttgaataa

SEQ ID NO: 678935 - DNA, 22 bp, Artificial Sequence
  chemically synthesized
tgggggacttgaataacataga

SEQ ID NO: 678936 - DNA, 22 bp, Artificial Sequence
  chemically synthesized
aggagttcatttatctatgtta

SEQ ID NO: 678937 - DNA, 22 bp, Artificial Sequence
  chemically synthesized
ggggacttgaataacatagata

SEQ ID NO: 678938 - DNA, 22 bp, Artificial Sequence
  chemically synthesized
gaggagttcatttatctatgtt

SEQ ID NO: 678939 - DNA, 22 bp, Artificial Sequence
  chemically synthesized
tttgaggagttcatttatctat

SEQ ID NO: 678940 - DNA, 22 bp, Artificial Sequence
  chemically synthesized
gaataacatagataaatgaact

SEQ ID NO: 678941 - DNA, 22 bp, Artificial Sequence
  chemically synthesized
aataacatagataaatgaactc

SEQ ID NO: 678942 - DNA, 22 bp, Artificial Sequence
  chemically synthesized
gaattgtttgaggagttcattt

SEQ ID NO: 678943 - DNA, 22 bp, Artificial Sequence
  chemically synthesized
tggaattgtttgaggagttcat

SEQ ID NO: 678944 - DNA, 22 bp, Artificial Sequence
  chemically synthesized
ctggaattgtttgaggagttca

SEQ ID NO: 678945 - DNA, 22 bp, Artificial Sequence
  chemically synthesized
gcttctggaattgtttgaggag

SEQ ID NO: 678946 - DNA, 22 bp, Artificial Sequence
  chemically synthesized
ctcaaacaattccagaagctaa

SEQ ID NO: 678947 - DNA, 22 bp, Artificial Sequence
  chemically synthesized
aaggtgagaaaggttagcttct

SEQ ID NO: 678948 - DNA, 22 bp, Artificial Sequence
  chemically synthesized
aaacaattccagaagctaacct

SEQ ID NO: 678949 - DNA, 22 bp, Artificial Sequence
  chemically synthesized
tgtgttgaaggtgagaaaggtt

SEQ ID NO: 678950 - DNA, 22 bp, Artificial Sequence
  chemically synthesized
gtgtgttgaaggtgagaaaggt

SEQ ID NO: 678951 - DNA, 22 bp, Artificial Sequence
  chemically synthesized
cagaagctaacctttctcacct

SEQ ID NO: 678952 - DNA, 22 bp, Artificial Sequence
  chemically synthesized
acctttctcaccttcaacacac

SEQ ID NO: 678953 - DNA, 22 bp, Artificial Sequence
  chemically synthesized
gaaataaaaggtttgtgtgttg

SEQ ID NO: 678954 - DNA, 22 bp, Artificial Sequence
  chemically synthesized
agaaataaaaggtttgtgtgtt

SEQ ID NO: 678955 - DNA, 22 bp, Artificial Sequence
  chemically synthesized
tctcaccttcaacacacaaacc

SEQ ID NO: 678956 - DNA, 22 bp, Artificial Sequence
  chemically synthesized
ctcaccttcaacacacaaacct

SEQ ID NO: 678957 - DNA, 22 bp, Artificial Sequence
  chemically synthesized
cttagaaataaaaggtttgtgt

SEQ ID NO: 678958 - DNA, 22 bp, Artificial Sequence
  chemically synthesized
tcaccttcaacacacaaacctt

SEQ ID NO: 678959 - DNA, 22 bp, Artificial Sequence
  chemically synthesized
accttcaacacacaaacctttt

SEQ ID NO: 678960 - DNA, 22 bp, Artificial Sequence
  chemically synthesized
cattgcttagaaataaaaggtt

SEQ ID NO: 678961 - DNA, 22 bp, Artificial Sequence
  chemically synthesized
gcattgcttagaaataaaaggt

SEQ ID NO: 678962 - DNA, 22 bp, Artificial Sequence
  chemically synthesized
tgcattgcttagaaataaaagg

SEQ ID NO: 678963 - DNA, 22 bp, Artificial Sequence
  chemically synthesized
caacacacaaaccttttatttc

SEQ ID NO: 678964 - DNA, 22 bp, Artificial Sequence
  chemically synthesized
ttgcattgcttagaaataaaag

SEQ ID NO: 678965 - DNA, 22 bp, Artificial Sequence
  chemically synthesized
aacacacaaaccttttatttct

SEQ ID NO: 678966 - DNA, 22 bp, Artificial Sequence
  chemically synthesized
ttttgcattgcttagaaataaa

SEQ ID NO: 678967 - DNA, 22 bp, Artificial Sequence
  chemically synthesized
gttcttttgcattgcttagaaa

SEQ ID NO: 678968 - DNA, 22 bp, Artificial Sequence
  chemically synthesized
tagttcttttgcattgcttaga

SEQ ID NO: 678969 - DNA, 22 bp, Artificial Sequence
  chemically synthesized
ctagttcttttgcattgcttag

SEQ ID NO: 678970 - DNA, 22 bp, Artificial Sequence
  chemically synthesized
tctagttcttttgcattgctta

SEQ ID NO: 678971 - DNA, 22 bp, Artificial Sequence
  chemically synthesized
ttctagttcttttgcattgctt

SEQ ID NO: 678972 - DNA, 22 bp, Artificial Sequence
  chemically synthesized
tttttctagttcttttgcattg

SEQ ID NO: 678973 - DNA, 22 bp, Artificial Sequence
  chemically synthesized
ttatttctaagcaatgcaaaag

SEQ ID NO: 678974 - DNA, 22 bp, Artificial Sequence
  chemically synthesized
tatttctaagcaatgcaaaaga

SEQ ID NO: 678975 - DNA, 22 bp, Artificial Sequence
  chemically synthesized
atttctaagcaatgcaaaagaa

SEQ ID NO: 678976 - DNA, 22 bp, Artificial Sequence
  chemically synthesized
tttctaagcaatgcaaaagaac

SEQ ID NO: 678977 - DNA, 22 bp, Artificial Sequence
  chemically synthesized
aatctgtttttctagttctttt

SEQ ID NO: 678978 - DNA, 22 bp, Artificial Sequence
  chemically synthesized
ctaagcaatgcaaaagaactag

SEQ ID NO: 678979 - DNA, 22 bp, Artificial Sequence
  chemically synthesized
taagcaatgcaaaagaactaga

SEQ ID NO: 678980 - DNA, 22 bp, Artificial Sequence
  chemically synthesized
agcaatgcaaaagaactagaaa

SEQ ID NO: 678981 - DNA, 22 bp, Artificial Sequence
  chemically synthesized
caaaggtgaaatctaaatctgt

SEQ ID NO: 678982 - DNA, 22 bp, Artificial Sequence
  chemically synthesized
agactgcaaaggtgaaatctaa

SEQ ID NO: 678983 - DNA, 22 bp, Artificial Sequence
  chemically synthesized
gaaaaacagatttagatttcac

SEQ ID NO: 678984 - DNA, 22 bp, Artificial Sequence
  chemically synthesized
aagtgaaactaagactgcaaag

SEQ ID NO: 678985 - DNA, 22 bp, Artificial Sequence
  chemically synthesized
agatttcacctttgcagtctta

SEQ ID NO: 678986 - DNA, 22 bp, Artificial Sequence
  chemically synthesized
gatttcacctttgcagtcttag

SEQ ID NO: 678987 - DNA, 22 bp, Artificial Sequence
  chemically synthesized
caattgaagtgaaactaagact

SEQ ID NO: 678988 - DNA, 22 bp, Artificial Sequence
  chemically synthesized
gcaattgaagtgaaactaagac

SEQ ID NO: 678989 - DNA, 22 bp, Artificial Sequence
  chemically synthesized
cacctttgcagtcttagtttca

SEQ ID NO: 678990 - DNA, 22 bp, Artificial Sequence
  chemically synthesized
acctttgcagtcttagtttcac

SEQ ID NO: 678991 - DNA, 22 bp, Artificial Sequence
  chemically synthesized
atttgcaattgaagtgaaacta

SEQ ID NO: 678992 - DNA, 22 bp, Artificial Sequence
  chemically synthesized
tgcagtcttagtttcacttcaa

SEQ ID NO: 678993 - DNA, 22 bp, Artificial Sequence
  chemically synthesized
gcagtcttagtttcacttcaat

SEQ ID NO: 678994 - DNA, 22 bp, Artificial Sequence
  chemically synthesized
cagtcttagtttcacttcaatt

SEQ ID NO: 678995 - DNA, 22 bp, Artificial Sequence
  chemically synthesized
gaactgatttgcaattgaagtg

SEQ ID NO: 678996 - DNA, 22 bp, Artificial Sequence
  chemically synthesized
agaactgatttgcaattgaagt

SEQ ID NO: 678997 - DNA, 22 bp, Artificial Sequence
  chemically synthesized
cttagaactgatttgcaattga

SEQ ID NO: 678998 - DNA, 22 bp, Artificial Sequence
  chemically synthesized
gcttagaactgatttgcaattg

SEQ ID NO: 678999 - DNA, 22 bp, Artificial Sequence
  chemically synthesized
tgcttagaactgatttgcaatt

SEQ ID NO: 679000 - DNA, 22 bp, Artificial Sequence
  chemically synthesized
agtttcacttcaattgcaaatc

SEQ ID NO: 679001 - DNA, 22 bp, Artificial Sequence
  chemically synthesized
ttgcttagaactgatttgcaat

SEQ ID NO: 679002 - DNA, 22 bp, Artificial Sequence
  chemically synthesized
gtttcacttcaattgcaaatca

SEQ ID NO: 679003 - DNA, 22 bp, Artificial Sequence
  chemically synthesized
ttttgcttagaactgatttgca

SEQ ID NO: 679004 - DNA, 22 bp, Artificial Sequence
  chemically synthesized
cttttgcttagaactgatttgc

SEQ ID NO: 679005 - DNA, 22 bp, Artificial Sequence
  chemically synthesized
cacttcaattgcaaatcagttc

SEQ ID NO: 679006 - DNA, 22 bp, Artificial Sequence
  chemically synthesized
acttcaattgcaaatcagttct

SEQ ID NO: 679007 - DNA, 22 bp, Artificial Sequence
  chemically synthesized
acttcttttgcttagaactgat

SEQ ID NO: 679008 - DNA, 22 bp, Artificial Sequence
  chemically synthesized
caattgcaaatcagttctaagc

SEQ ID NO: 679009 - DNA, 22 bp, Artificial Sequence
  chemically synthesized
aattgcaaatcagttctaagca

SEQ ID NO: 679010 - DNA, 22 bp, Artificial Sequence
  chemically synthesized
tgctcacttcttttgcttagaa

SEQ ID NO: 679011 - DNA, 22 bp, Artificial Sequence
  chemically synthesized
gtgctcacttcttttgcttaga

SEQ ID NO: 679012 - DNA, 22 bp, Artificial Sequence
  chemically synthesized
caaatcagttctaagcaaaaga

SEQ ID NO: 679013 - DNA, 22 bp, Artificial Sequence
  chemically synthesized
cacttgtgctcacttcttttgc

SEQ ID NO: 679014 - DNA, 22 bp, Artificial Sequence
  chemically synthesized
ccacttgtgctcacttcttttg

SEQ ID NO: 679015 - DNA, 22 bp, Artificial Sequence
  chemically synthesized
tccacttgtgctcacttctttt

SEQ ID NO: 679016 - DNA, 22 bp, Artificial Sequence
  chemically synthesized
tttccacttgtgctcacttctt

SEQ ID NO: 679017 - DNA, 22 bp, Artificial Sequence
  chemically synthesized
ctttccacttgtgctcacttct

SEQ ID NO: 679018 - DNA, 22 bp, Artificial Sequence
  chemically synthesized
ttctttccacttgtgctcactt

SEQ ID NO: 679019 - DNA, 22 bp, Artificial Sequence
  chemically synthesized
cttctttccacttgtgctcact

SEQ ID NO: 679020 - DNA, 22 bp, Artificial Sequence
  chemically synthesized
taagcaaaagaagtgagcacaa

SEQ ID NO: 679021 - DNA, 22 bp, Artificial Sequence
  chemically synthesized
tcttctttccacttgtgctcac

SEQ ID NO: 679022 - DNA, 22 bp, Artificial Sequence
  chemically synthesized
ttcttctttccacttgtgctca

SEQ ID NO: 679023 - DNA, 22 bp, Artificial Sequence
  chemically synthesized
agcaaaagaagtgagcacaagt

SEQ ID NO: 679024 - DNA, 22 bp, Artificial Sequence
  chemically synthesized
ttttcttctttccacttgtgct

SEQ ID NO: 679025 - DNA, 22 bp, Artificial Sequence
  chemically synthesized
ttcttttcttctttccacttgt

SEQ ID NO: 679026 - DNA, 22 bp, Artificial Sequence
  chemically synthesized
attcttttcttctttccacttg

SEQ ID NO: 679027 - DNA, 22 bp, Artificial Sequence
  chemically synthesized
tattcttttcttctttccactt

SEQ ID NO: 679028 - DNA, 22 bp, Artificial Sequence
  chemically synthesized
gtcacaccctttattcttttct

SEQ ID NO: 679029 - DNA, 22 bp, Artificial Sequence
  chemically synthesized
agaattagtcacaccctttatt

SEQ ID NO: 679030 - DNA, 22 bp, Artificial Sequence
  chemically synthesized
aagaattagtcacaccctttat

SEQ ID NO: 679031 - DNA, 22 bp, Artificial Sequence
  chemically synthesized
taagaattagtcacacccttta

SEQ ID NO: 679032 - DNA, 22 bp, Artificial Sequence
  chemically synthesized
gttttaagaattagtcacaccc

SEQ ID NO: 679033 - DNA, 22 bp, Artificial Sequence
  chemically synthesized
tcgttttaagaattagtcacac

SEQ ID NO: 679034 - DNA, 22 bp, Artificial Sequence
  chemically synthesized
ctcgttttaagaattagtcaca

SEQ ID NO: 679035 - DNA, 22 bp, Artificial Sequence
  chemically synthesized
tctcgttttaagaattagtcac

SEQ ID NO: 679036 - DNA, 22 bp, Artificial Sequence
  chemically synthesized
ttctcgttttaagaattagtca

SEQ ID NO: 679037 - DNA, 22 bp, Artificial Sequence
  chemically synthesized
tttttctcgttttaagaattag

SEQ ID NO: 679038 - DNA, 22 bp, Artificial Sequence
  chemically synthesized
aaagactatttttctcgtttta

SEQ ID NO: 679039 - DNA, 22 bp, Artificial Sequence
  chemically synthesized
attcttaaaacgagaaaaatag

SEQ ID NO: 679040 - DNA, 22 bp, Artificial Sequence
  chemically synthesized
aatgattaaaagactatttttc

SEQ ID NO: 679041 - DNA, 22 bp, Artificial Sequence
  chemically synthesized
ttaaaacgagaaaaatagtctt

SEQ ID NO: 679042 - DNA, 22 bp, Artificial Sequence
  chemically synthesized
aaaacgagaaaaatagtctttt

SEQ ID NO: 679043 - DNA, 22 bp, Artificial Sequence
  chemically synthesized
aaacgagaaaaatagtctttta

SEQ ID NO: 679044 - DNA, 22 bp, Artificial Sequence
  chemically synthesized
gcattaaatgattaaaagacta

SEQ ID NO: 679045 - DNA, 22 bp, Artificial Sequence
  chemically synthesized
agcattaaatgattaaaagact

SEQ ID NO: 679046 - DNA, 22 bp, Artificial Sequence
  chemically synthesized
tagcattaaatgattaaaagac

SEQ ID NO: 679047 - DNA, 22 bp, Artificial Sequence
  chemically synthesized
ttagcattaaatgattaaaaga

SEQ ID NO: 679048 - DNA, 22 bp, Artificial Sequence
  chemically synthesized
ccaagcatttttagcattaaat

SEQ ID NO: 679049 - DNA, 22 bp, Artificial Sequence
  chemically synthesized
cgttgccaagcatttttagcat

SEQ ID NO: 679050 - DNA, 22 bp, Artificial Sequence
  chemically synthesized
ttaatcatttaatgctaaaaat

SEQ ID NO: 679051 - DNA, 22 bp, Artificial Sequence
  chemically synthesized
taatcatttaatgctaaaaatg

SEQ ID NO: 679052 - DNA, 22 bp, Artificial Sequence
  chemically synthesized
aatcatttaatgctaaaaatgc

SEQ ID NO: 679053 - DNA, 22 bp, Artificial Sequence
  chemically synthesized
atcatttaatgctaaaaatgct

SEQ ID NO: 679054 - DNA, 22 bp, Artificial Sequence
  chemically synthesized
gctacgttgccaagcattttta

SEQ ID NO: 679055 - DNA, 22 bp, Artificial Sequence
  chemically synthesized
ggctacgttgccaagcattttt

SEQ ID NO: 679056 - DNA, 22 bp, Artificial Sequence
  chemically synthesized
tggctacgttgccaagcatttt

SEQ ID NO: 679057 - DNA, 22 bp, Artificial Sequence
  chemically synthesized
ttggctacgttgccaagcattt

SEQ ID NO: 679058 - DNA, 22 bp, Artificial Sequence
  chemically synthesized
tttggctacgttgccaagcatt

SEQ ID NO: 679059 - DNA, 22 bp, Artificial Sequence
  chemically synthesized
aatgctaaaaatgcttggcaac

SEQ ID NO: 679060 - DNA, 22 bp, Artificial Sequence
  chemically synthesized
atgctaaaaatgcttggcaacg

SEQ ID NO: 679061 - DNA, 22 bp, Artificial Sequence
  chemically synthesized
aaggttttttggctacgttgcc

SEQ ID NO: 679062 - DNA, 22 bp, Artificial Sequence
  chemically synthesized
aaaatgcttggcaacgtagcca

SEQ ID NO: 679063 - DNA, 22 bp, Artificial Sequence
  chemically synthesized
ggcaacgtagccaaaaaacctt

SEQ ID NO: 679064 - DNA, 22 bp, Artificial Sequence
  chemically synthesized
ccaaagaatctgaaggtttttt

SEQ ID NO: 679065 - DNA, 22 bp, Artificial Sequence
  chemically synthesized
gcaacgtagccaaaaaaccttc

SEQ ID NO: 679066 - DNA, 22 bp, Artificial Sequence
  chemically synthesized
gtcatatagttaccaaagaatc

SEQ ID NO: 679067 - DNA, 22 bp, Artificial Sequence
  chemically synthesized
gttcgtcatatagttaccaaag

SEQ ID NO: 679068 - DNA, 22 bp, Artificial Sequence
  chemically synthesized
ggttcgtcatatagttaccaaa

SEQ ID NO: 679069 - DNA, 22 bp, Artificial Sequence
  chemically synthesized
cagattctttggtaactatatg

SEQ ID NO: 679070 - DNA, 22 bp, Artificial Sequence
  chemically synthesized
agattctttggtaactatatga

SEQ ID NO: 679071 - DNA, 22 bp, Artificial Sequence
  chemically synthesized
tttggtaactatatgacgaacc

SEQ ID NO: 679072 - DNA, 22 bp, Artificial Sequence
  chemically synthesized
tggtaactatatgacgaaccaa

SEQ ID NO: 679073 - DNA, 22 bp, Artificial Sequence
  chemically synthesized
ggtaactatatgacgaaccaaa

SEQ ID NO: 679074 - DNA, 22 bp, Artificial Sequence
  chemically synthesized
gtaactatatgacgaaccaaat

SEQ ID NO: 679075 - DNA, 22 bp, Artificial Sequence
  chemically synthesized
tatgacgaaccaaatattcact

SEQ ID NO: 679076 - DNA, 22 bp, Artificial Sequence
  chemically synthesized
atcacaggtagaaaataacaag

SEQ ID NO: 679077 - DNA, 22 bp, Artificial Sequence
  chemically synthesized
acttcacggcttgttattttct

SEQ ID NO: 679078 - DNA, 22 bp, Artificial Sequence
  chemically synthesized
gattcatcacaggtagaaaata

SEQ ID NO: 679079 - DNA, 22 bp, Artificial Sequence
  chemically synthesized
cacggcttgttattttctacct

SEQ ID NO: 679080 - DNA, 22 bp, Artificial Sequence
  chemically synthesized
tggattcatcacaggtagaaaa

SEQ ID NO: 679081 - DNA, 22 bp, Artificial Sequence
  chemically synthesized
acggcttgttattttctacctg

SEQ ID NO: 679082 - DNA, 22 bp, Artificial Sequence
  chemically synthesized
gttattttctacctgtgatgaa

SEQ ID NO: 679083 - DNA, 22 bp, Artificial Sequence
  chemically synthesized
ttattttctacctgtgatgaat

SEQ ID NO: 679084 - DNA, 22 bp, Artificial Sequence
  chemically synthesized
ttttctacctgtgatgaatcca

SEQ ID NO: 679085 - DNA, 22 bp, Artificial Sequence
  chemically synthesized
tctacctgtgatgaatccagag

SEQ ID NO: 679086 - DNA, 22 bp, Artificial Sequence
  chemically synthesized
ctacctgtgatgaatccagagc

SEQ ID NO: 679087 - DNA, 22 bp, Artificial Sequence
  chemically synthesized
tacctgtgatgaatccagagcc

SEQ ID NO: 679088 - DNA, 22 bp, Artificial Sequence
  chemically synthesized
cctgtgatgaatccagagcccc

SEQ ID NO: 679089 - DNA, 22 bp, Artificial Sequence
  chemically synthesized
aatgtgtcccagtggggctctg

SEQ ID NO: 679090 - DNA, 22 bp, Artificial Sequence
  chemically synthesized
tgatgaatccagagccccactg

SEQ ID NO: 679091 - DNA, 22 bp, Artificial Sequence
  chemically synthesized
gagggttaaatgtgtcccagtg

SEQ ID NO: 679092 - DNA, 22 bp, Artificial Sequence
  chemically synthesized
ggagggttaaatgtgtcccagt

SEQ ID NO: 679093 - DNA, 22 bp, Artificial Sequence
  chemically synthesized
tggagggttaaatgtgtcccag

SEQ ID NO: 679094 - DNA, 22 bp, Artificial Sequence
  chemically synthesized
ttttggagggttaaatgtgtcc

SEQ ID NO: 679095 - DNA, 22 bp, Artificial Sequence
  chemically synthesized
tctattttggagggttaaatgt

SEQ ID NO: 679096 - DNA, 22 bp, Artificial Sequence
  chemically synthesized
ctatctattttggagggttaaa

SEQ ID NO: 679097 - DNA, 22 bp, Artificial Sequence
  chemically synthesized
ggacacatttaaccctccaaaa

SEQ ID NO: 679098 - DNA, 22 bp, Artificial Sequence
  chemically synthesized
atagttcctatctattttggag

SEQ ID NO: 679099 - DNA, 22 bp, Artificial Sequence
  chemically synthesized
aaccctccaaaatagataggaa

SEQ ID NO: 679100 - DNA, 22 bp, Artificial Sequence
  chemically synthesized
accctccaaaatagataggaac

SEQ ID NO: 679101 - DNA, 22 bp, Artificial Sequence
  chemically synthesized
caaaatagataggaactatgaa

SEQ ID NO: 679102 - DNA, 22 bp, Artificial Sequence
  chemically synthesized
atccagtccatattcatagttc

SEQ ID NO: 679103 - DNA, 22 bp, Artificial Sequence
  chemically synthesized
catccagtccatattcatagtt

SEQ ID NO: 679104 - DNA, 22 bp, Artificial Sequence
  chemically synthesized
cagtttcatccagtccatattc

SEQ ID NO: 679105 - DNA, 22 bp, Artificial Sequence
  chemically synthesized
acagtttcatccagtccatatt

SEQ ID NO: 679106 - DNA, 22 bp, Artificial Sequence
  chemically synthesized
tgcttacagtttcatccagtcc

SEQ ID NO: 679107 - DNA, 22 bp, Artificial Sequence
  chemically synthesized
gtgcttacagtttcatccagtc

SEQ ID NO: 679108 - DNA, 22 bp, Artificial Sequence
  chemically synthesized
tgaatatggactggatgaaact

SEQ ID NO: 679109 - DNA, 22 bp, Artificial Sequence
  chemically synthesized
tgcagatttgtgcttacagttt

SEQ ID NO: 679110 - DNA, 22 bp, Artificial Sequence
  chemically synthesized
gatgaaactgtaagcacaaatc

SEQ ID NO: 679111 - DNA, 22 bp, Artificial Sequence
  chemically synthesized
taagcacaaatctgcataactc

SEQ ID NO: 679112 - DNA, 22 bp, Artificial Sequence
  chemically synthesized
aaggtacaagatagatatgagt

SEQ ID NO: 679113 - DNA, 22 bp, Artificial Sequence
  chemically synthesized
caaggtacaagatagatatgag

SEQ ID NO: 679114 - DNA, 22 bp, Artificial Sequence
  chemically synthesized
tccttcaaggtacaagatagat

SEQ ID NO: 679115 - DNA, 22 bp, Artificial Sequence
  chemically synthesized
gtccttcaaggtacaagataga

SEQ ID NO: 679116 - DNA, 22 bp, Artificial Sequence
  chemically synthesized
cataactcatatctatcttgta

SEQ ID NO: 679117 - DNA, 22 bp, Artificial Sequence
  chemically synthesized
atatctatcttgtaccttgaag

SEQ ID NO: 679118 - DNA, 22 bp, Artificial Sequence
  chemically synthesized
tcttgtaccttgaaggacaaac

SEQ ID NO: 679119 - DNA, 22 bp, Artificial Sequence
  chemically synthesized
gtaccttgaaggacaaaccaca

SEQ ID NO: 679120 - DNA, 22 bp, Artificial Sequence
  chemically synthesized
taccttgaaggacaaaccacat

SEQ ID NO: 679121 - DNA, 22 bp, Artificial Sequence
  chemically synthesized
atcacagacaaaaatgtggttt

SEQ ID NO: 679122 - DNA, 22 bp, Artificial Sequence
  chemically synthesized
gaaggacaaaccacatttttgt

SEQ ID NO: 679123 - DNA, 22 bp, Artificial Sequence
  chemically synthesized
aaggacaaaccacatttttgtc

SEQ ID NO: 679124 - DNA, 22 bp, Artificial Sequence
  chemically synthesized
taaaatcggtattgatcacaga

SEQ ID NO: 679125 - DNA, 22 bp, Artificial Sequence
  chemically synthesized
ttgtctgtgatcaataccgatt

SEQ ID NO: 679126 - DNA, 22 bp, Artificial Sequence
  chemically synthesized
tgtctgtgatcaataccgattt

SEQ ID NO: 679127 - DNA, 22 bp, Artificial Sequence
  chemically synthesized
gtctgtgatcaataccgatttt

SEQ ID NO: 679128 - DNA, 22 bp, Artificial Sequence
  chemically synthesized
tctgtgatcaataccgatttta

SEQ ID NO: 679129 - DNA, 22 bp, Artificial Sequence
  chemically synthesized
tgatcaataccgattttacagc

SEQ ID NO: 679130 - DNA, 22 bp, Artificial Sequence
  chemically synthesized
gaaggcaggcacagagtaagaa

SEQ ID NO: 679131 - DNA, 22 bp, Artificial Sequence
  chemically synthesized
tacagcttcgtttcttactctg

SEQ ID NO: 679132 - DNA, 22 bp, Artificial Sequence
  chemically synthesized
agaaggcaggcacagagtaaga

SEQ ID NO: 679133 - DNA, 22 bp, Artificial Sequence
  chemically synthesized
acagcttcgtttcttactctgt

SEQ ID NO: 679134 - DNA, 22 bp, Artificial Sequence
  chemically synthesized
tagaaggcaggcacagagtaag

SEQ ID NO: 679135 - DNA, 22 bp, Artificial Sequence
  chemically synthesized
cagcttcgtttcttactctgtg

SEQ ID NO: 679136 - DNA, 22 bp, Artificial Sequence
  chemically synthesized
ttttagaaggcaggcacagagt

SEQ ID NO: 679137 - DNA, 22 bp, Artificial Sequence
  chemically synthesized
ctgttttagaaggcaggcacag

SEQ ID NO: 679138 - DNA, 22 bp, Artificial Sequence
  chemically synthesized
cgtttcttactctgtgcctgcc

SEQ ID NO: 679139 - DNA, 22 bp, Artificial Sequence
  chemically synthesized
gtttcttactctgtgcctgcct

SEQ ID NO: 679140 - DNA, 22 bp, Artificial Sequence
  chemically synthesized
tactgttttagaaggcaggcac

SEQ ID NO: 679141 - DNA, 22 bp, Artificial Sequence
  chemically synthesized
tctactgttttagaaggcaggc

SEQ ID NO: 679142 - DNA, 22 bp, Artificial Sequence
  chemically synthesized
cttactctgtgcctgccttcta

SEQ ID NO: 679143 - DNA, 22 bp, Artificial Sequence
  chemically synthesized
ttactctgtgcctgccttctaa

SEQ ID NO: 679144 - DNA, 22 bp, Artificial Sequence
  chemically synthesized
actctgtgcctgccttctaaaa

SEQ ID NO: 679145 - DNA, 22 bp, Artificial Sequence
  chemically synthesized
ctctgtgcctgccttctaaaac

SEQ ID NO: 679146 - DNA, 22 bp, Artificial Sequence
  chemically synthesized
agaattctctactgttttagaa

SEQ ID NO: 679147 - DNA, 22 bp, Artificial Sequence
  chemically synthesized
tgtgcctgccttctaaaacagt

SEQ ID NO: 679148 - DNA, 22 bp, Artificial Sequence
  chemically synthesized
ctgagaattctctactgtttta

SEQ ID NO: 679149 - DNA, 22 bp, Artificial Sequence
  chemically synthesized
tgcctgccttctaaaacagtag

SEQ ID NO: 679150 - DNA, 22 bp, Artificial Sequence
  chemically synthesized
ccttctaaaacagtagagaatt

SEQ ID NO: 679151 - DNA, 22 bp, Artificial Sequence
  chemically synthesized
atggagttactgagaattctct

SEQ ID NO: 679152 - DNA, 22 bp, Artificial Sequence
  chemically synthesized
ctaaaacagtagagaattctca

SEQ ID NO: 679153 - DNA, 22 bp, Artificial Sequence
  chemically synthesized
tcatggagttactgagaattct

SEQ ID NO: 679154 - DNA, 22 bp, Artificial Sequence
  chemically synthesized
taaaacagtagagaattctcag

SEQ ID NO: 679155 - DNA, 22 bp, Artificial Sequence
  chemically synthesized
ctcatggagttactgagaattc

SEQ ID NO: 679156 - DNA, 22 bp, Artificial Sequence
  chemically synthesized
aaacagtagagaattctcagta

SEQ ID NO: 679157 - DNA, 22 bp, Artificial Sequence
  chemically synthesized
ttctcatggagttactgagaat

SEQ ID NO: 679158 - DNA, 22 bp, Artificial Sequence
  chemically synthesized
tcagtaactccatgagaagagc

SEQ ID NO: 679159 - DNA, 22 bp, Artificial Sequence
  chemically synthesized
caggtaaatgtgggctcttctc

SEQ ID NO: 679160 - DNA, 22 bp, Artificial Sequence
  chemically synthesized
agtaactccatgagaagagccc

SEQ ID NO: 679161 - DNA, 22 bp, Artificial Sequence
  chemically synthesized
catattccaggtaaatgtgggc

SEQ ID NO: 679162 - DNA, 22 bp, Artificial Sequence
  chemically synthesized
catgagaagagcccacatttac

SEQ ID NO: 679163 - DNA, 22 bp, Artificial Sequence
  chemically synthesized
tatcgtctgcatattccaggta

SEQ ID NO: 679164 - DNA, 22 bp, Artificial Sequence
  chemically synthesized
tatatcgtctgcatattccagg

SEQ ID NO: 679165 - DNA, 22 bp, Artificial Sequence
  chemically synthesized
ctatatcgtctgcatattccag

SEQ ID NO: 679166 - DNA, 22 bp, Artificial Sequence
  chemically synthesized
tctatatcgtctgcatattcca

SEQ ID NO: 679167 - DNA, 22 bp, Artificial Sequence
  chemically synthesized
ttctatatcgtctgcatattcc

SEQ ID NO: 679168 - DNA, 22 bp, Artificial Sequence
  chemically synthesized
acctggaatatgcagacgatat

SEQ ID NO: 679169 - DNA, 22 bp, Artificial Sequence
  chemically synthesized
cctggaatatgcagacgatata

SEQ ID NO: 679170 - DNA, 22 bp, Artificial Sequence
  chemically synthesized
gaatatgcagacgatatagaaa

SEQ ID NO: 679171 - DNA, 22 bp, Artificial Sequence
  chemically synthesized
gcacaccgtgtttttctatatc

SEQ ID NO: 679172 - DNA, 22 bp, Artificial Sequence
  chemically synthesized
cctagcacaccgtgtttttcta

SEQ ID NO: 679173 - DNA, 22 bp, Artificial Sequence
  chemically synthesized
ctccctagcacaccgtgttttt

SEQ ID NO: 679174 - DNA, 22 bp, Artificial Sequence
  chemically synthesized
cctcctccctagcacaccgtgt

SEQ ID NO: 679175 - DNA, 22 bp, Artificial Sequence
  chemically synthesized
cactccctcctccctagcacac

SEQ ID NO: 679176 - DNA, 22 bp, Artificial Sequence
  chemically synthesized
ccactccctcctccctagcaca

SEQ ID NO: 679177 - DNA, 22 bp, Artificial Sequence
  chemically synthesized
gggaggagggagtggaagggtg

SEQ ID NO: 679178 - DNA, 22 bp, Artificial Sequence
  chemically synthesized
ccaaaacagtgccacccaccct

SEQ ID NO: 679179 - DNA, 22 bp, Artificial Sequence
  chemically synthesized
ttttggtaattgtctcttttct

SEQ ID NO: 679180 - DNA, 22 bp, Artificial Sequence
  chemically synthesized
tggtaattgtctcttttctgca

SEQ ID NO: 679181 - DNA, 22 bp, Artificial Sequence
  chemically synthesized
ggtaattgtctcttttctgcat

SEQ ID NO: 679182 - DNA, 22 bp, Artificial Sequence
  chemically synthesized
gtaattgtctcttttctgcatt

SEQ ID NO: 679183 - DNA, 22 bp, Artificial Sequence
  chemically synthesized
cgatgtggagagtgaaatgcag

SEQ ID NO: 679184 - DNA, 22 bp, Artificial Sequence
  chemically synthesized
ccgatgtggagagtgaaatgca

SEQ ID NO: 679185 - DNA, 22 bp, Artificial Sequence
  chemically synthesized
tctcttttctgcatttcactct

SEQ ID NO: 679186 - DNA, 22 bp, Artificial Sequence
  chemically synthesized
ttttctgcatttcactctccac

SEQ ID NO: 679187 - DNA, 22 bp, Artificial Sequence
  chemically synthesized
ttctgcatttcactctccacat

SEQ ID NO: 679188 - DNA, 22 bp, Artificial Sequence
  chemically synthesized
tctgcatttcactctccacatc

SEQ ID NO: 679189 - DNA, 22 bp, Artificial Sequence
  chemically synthesized
ctgcatttcactctccacatcg

SEQ ID NO: 679190 - DNA, 22 bp, Artificial Sequence
  chemically synthesized
tgcatttcactctccacatcgg

SEQ ID NO: 679191 - DNA, 22 bp, Artificial Sequence
  chemically synthesized
catttcactctccacatcggaa

SEQ ID NO: 679192 - DNA, 22 bp, Artificial Sequence
  chemically synthesized
cactctccacatcggaaataca

SEQ ID NO: 679193 - DNA, 22 bp, Artificial Sequence
  chemically synthesized
actctccacatcggaaatacac

SEQ ID NO: 679194 - DNA, 22 bp, Artificial Sequence
  chemically synthesized
atggtatatggggagtgtattt

SEQ ID NO: 679195 - DNA, 22 bp, Artificial Sequence
  chemically synthesized
tccacatcggaaatacactccc

SEQ ID NO: 679196 - DNA, 22 bp, Artificial Sequence
  chemically synthesized
ttcatggtatatggggagtgta

SEQ ID NO: 679197 - DNA, 22 bp, Artificial Sequence
  chemically synthesized
cacatcggaaatacactcccca

SEQ ID NO: 679198 - DNA, 22 bp, Artificial Sequence
  chemically synthesized
gttgttcatggtatatggggag

SEQ ID NO: 679199 - DNA, 22 bp, Artificial Sequence
  chemically synthesized
ggttgttcatggtatatgggga

SEQ ID NO: 679200 - DNA, 22 bp, Artificial Sequence
  chemically synthesized
tggttgttcatggtatatgggg

SEQ ID NO: 679201 - DNA, 22 bp, Artificial Sequence
  chemically synthesized
ttggttgttcatggtatatggg

SEQ ID NO: 679202 - DNA, 22 bp, Artificial Sequence
  chemically synthesized
ccttttggttgttcatggtata

SEQ ID NO: 679203 - DNA, 22 bp, Artificial Sequence
  chemically synthesized
cccttttggttgttcatggtat

SEQ ID NO: 679204 - DNA, 22 bp, Artificial Sequence
  chemically synthesized
cccatataccatgaacaaccaa

SEQ ID NO: 679205 - DNA, 22 bp, Artificial Sequence
  chemically synthesized
agaatttcccttttggttgttc

SEQ ID NO: 679206 - DNA, 22 bp, Artificial Sequence
  chemically synthesized
cagaatttcccttttggttgtt

SEQ ID NO: 679207 - DNA, 22 bp, Artificial Sequence
  chemically synthesized
acatgtgaacaggtttcagaat

SEQ ID NO: 679208 - DNA, 22 bp, Artificial Sequence
  chemically synthesized
tgaaacctgttcacatgttaat

SEQ ID NO: 679209 - DNA, 22 bp, Artificial Sequence
  chemically synthesized
aaacctgttcacatgttaatgg

SEQ ID NO: 679210 - DNA, 22 bp, Artificial Sequence
  chemically synthesized
ttcacatgttaatgggtacatc

SEQ ID NO: 679211 - DNA, 22 bp, Artificial Sequence
  chemically synthesized
acatgttaatgggtacatcttt

SEQ ID NO: 679212 - DNA, 22 bp, Artificial Sequence
  chemically synthesized
agaaaggccaaacaaagatgta

SEQ ID NO: 679213 - DNA, 22 bp, Artificial Sequence
  chemically synthesized
tcagaaaggccaaacaaagatg

SEQ ID NO: 679214 - DNA, 22 bp, Artificial Sequence
  chemically synthesized
ttctcagaaaggccaaacaaag

SEQ ID NO: 679215 - DNA, 22 bp, Artificial Sequence
  chemically synthesized
atgggtacatctttgtttggcc

SEQ ID NO: 679216 - DNA, 22 bp, Artificial Sequence
  chemically synthesized
ttgttctcagaaaggccaaaca

SEQ ID NO: 679217 - DNA, 22 bp, Artificial Sequence
  chemically synthesized
aacattgttgttctcagaaagg

SEQ ID NO: 679218 - DNA, 22 bp, Artificial Sequence
  chemically synthesized
tgtttggcctttctgagaacaa

SEQ ID NO: 679219 - DNA, 22 bp, Artificial Sequence
  chemically synthesized
tgttgaacattgttgttctcag

SEQ ID NO: 679220 - DNA, 22 bp, Artificial Sequence
  chemically synthesized
gtttggcctttctgagaacaac

SEQ ID NO: 679221 - DNA, 22 bp, Artificial Sequence
  chemically synthesized
tttggcctttctgagaacaaca

SEQ ID NO: 679222 - DNA, 22 bp, Artificial Sequence
  chemically synthesized
ggcctttctgagaacaacaatg

SEQ ID NO: 679223 - DNA, 22 bp, Artificial Sequence
  chemically synthesized
gcctttctgagaacaacaatgt

SEQ ID NO: 679224 - DNA, 22 bp, Artificial Sequence
  chemically synthesized
tgatctatgttgaacattgttg

SEQ ID NO: 679225 - DNA, 22 bp, Artificial Sequence
  chemically synthesized
gtgatctatgttgaacattgtt

SEQ ID NO: 679226 - DNA, 22 bp, Artificial Sequence
  chemically synthesized
tctgagaacaacaatgttcaac

SEQ ID NO: 679227 - DNA, 22 bp, Artificial Sequence
  chemically synthesized
ctgagaacaacaatgttcaaca

SEQ ID NO: 679228 - DNA, 22 bp, Artificial Sequence
  chemically synthesized
tgagaacaacaatgttcaacat

SEQ ID NO: 679229 - DNA, 22 bp, Artificial Sequence
  chemically synthesized
agaacaacaatgttcaacatag

SEQ ID NO: 679230 - DNA, 22 bp, Artificial Sequence
  chemically synthesized
atgtacgtacagacttgtgatc

SEQ ID NO: 679231 - DNA, 22 bp, Artificial Sequence
  chemically synthesized
tgttaatgtacgtacagacttg

SEQ ID NO: 679232 - DNA, 22 bp, Artificial Sequence
  chemically synthesized
aacatagatcacaagtctgtac

SEQ ID NO: 679233 - DNA, 22 bp, Artificial Sequence
  chemically synthesized
tgtgttaatgtacgtacagact

SEQ ID NO: 679234 - DNA, 22 bp, Artificial Sequence
  chemically synthesized
atctctgtgttaatgtacgtac

SEQ ID NO: 679235 - DNA, 22 bp, Artificial Sequence
  chemically synthesized
tgaagctgatctctgtgttaat

SEQ ID NO: 679236 - DNA, 22 bp, Artificial Sequence
  chemically synthesized
atgaagctgatctctgtgttaa

SEQ ID NO: 679237 - DNA, 22 bp, Artificial Sequence
  chemically synthesized
tttatgaagctgatctctgtgt

SEQ ID NO: 679238 - DNA, 22 bp, Artificial Sequence
  chemically synthesized
tacgtacattaacacagagatc

SEQ ID NO: 679239 - DNA, 22 bp, Artificial Sequence
  chemically synthesized
aggattatttatgaagctgatc

SEQ ID NO: 679240 - DNA, 22 bp, Artificial Sequence
  chemically synthesized
aaggattatttatgaagctgat

SEQ ID NO: 679241 - DNA, 22 bp, Artificial Sequence
  chemically synthesized
taaggattatttatgaagctga

SEQ ID NO: 679242 - DNA, 22 bp, Artificial Sequence
  chemically synthesized
acacagagatcagcttcataaa

SEQ ID NO: 679243 - DNA, 22 bp, Artificial Sequence
  chemically synthesized
aagatgtaaagagcgttttaag

SEQ ID NO: 679244 - DNA, 22 bp, Artificial Sequence
  chemically synthesized
cataaataatccttaaaacgct

SEQ ID NO: 679245 - DNA, 22 bp, Artificial Sequence
  chemically synthesized
aaagatgtaaagagcgttttaa

SEQ ID NO: 679246 - DNA, 22 bp, Artificial Sequence
  chemically synthesized
ataaataatccttaaaacgctc

SEQ ID NO: 679247 - DNA, 22 bp, Artificial Sequence
  chemically synthesized
taaagatgtaaagagcgtttta

SEQ ID NO: 679248 - DNA, 22 bp, Artificial Sequence
  chemically synthesized
ttaaagatgtaaagagcgtttt

SEQ ID NO: 679249 - DNA, 22 bp, Artificial Sequence
  chemically synthesized
tttaaagatgtaaagagcgttt

SEQ ID NO: 679250 - DNA, 22 bp, Artificial Sequence
  chemically synthesized
aaaacgctctttacatctttaa

SEQ ID NO: 679251 - DNA, 22 bp, Artificial Sequence
  chemically synthesized
aaacgctctttacatctttaaa

SEQ ID NO: 679252 - DNA, 22 bp, Artificial Sequence
  chemically synthesized
tttacatctttaaaaaatgtta

SEQ ID NO: 679253 - DNA, 22 bp, Artificial Sequence
  chemically synthesized
tacatctttaaaaaatgttatt

SEQ ID NO: 679254 - DNA, 22 bp, Artificial Sequence
  chemically synthesized
acatctttaaaaaatgttattg

SEQ ID NO: 679255 - DNA, 22 bp, Artificial Sequence
  chemically synthesized
catctttaaaaaatgttattga

SEQ ID NO: 679256 - DNA, 22 bp, Artificial Sequence
  chemically synthesized
taaaaaatgttattgattttgg

SEQ ID NO: 679257 - DNA, 22 bp, Artificial Sequence
  chemically synthesized
gaaccagcagggccaaaatcaa

SEQ ID NO: 679258 - DNA, 22 bp, Artificial Sequence
  chemically synthesized
aaaaaatgttattgattttggc

SEQ ID NO: 679259 - DNA, 22 bp, Artificial Sequence
  chemically synthesized
ggaaccagcagggccaaaatca

SEQ ID NO: 679260 - DNA, 22 bp, Artificial Sequence
  chemically synthesized
aaaaatgttattgattttggcc

SEQ ID NO: 679261 - DNA, 22 bp, Artificial Sequence
  chemically synthesized
tggaaccagcagggccaaaatc

SEQ ID NO: 679262 - DNA, 22 bp, Artificial Sequence
  chemically synthesized
ttgattttggccctgctggttc

SEQ ID NO: 679263 - DNA, 22 bp, Artificial Sequence
  chemically synthesized
atgccaggctttggaaccagca

SEQ ID NO: 679264 - DNA, 22 bp, Artificial Sequence
  chemically synthesized
attttggccctgctggttccaa

SEQ ID NO: 679265 - DNA, 22 bp, Artificial Sequence
  chemically synthesized
tggccctgctggttccaaagcc

SEQ ID NO: 679266 - DNA, 22 bp, Artificial Sequence
  chemically synthesized
ggccctgctggttccaaagcct

SEQ ID NO: 679267 - DNA, 22 bp, Artificial Sequence
  chemically synthesized
gccctgctggttccaaagcctg

SEQ ID NO: 679268 - DNA, 22 bp, Artificial Sequence
  chemically synthesized
ctggttccaaagcctggcatca

SEQ ID NO: 679269 - DNA, 22 bp, Artificial Sequence
  chemically synthesized
agagaggcatatctgatgccag

SEQ ID NO: 679270 - DNA, 22 bp, Artificial Sequence
  chemically synthesized
gttccaaagcctggcatcagat

SEQ ID NO: 679271 - DNA, 22 bp, Artificial Sequence
  chemically synthesized
ctcagagaggcatatctgatgc

SEQ ID NO: 679272 - DNA, 22 bp, Artificial Sequence
  chemically synthesized
caaagcctggcatcagatatgc

SEQ ID NO: 679273 - DNA, 22 bp, Artificial Sequence
  chemically synthesized
gcatcagatatgcctctctgag

SEQ ID NO: 679274 - DNA, 22 bp, Artificial Sequence
  chemically synthesized
gtataaatactgctcagagagg

SEQ ID NO: 679275 - DNA, 22 bp, Artificial Sequence
  chemically synthesized
cgtataaatactgctcagagag

SEQ ID NO: 679276 - DNA, 22 bp, Artificial Sequence
  chemically synthesized
tctgagcagtatttatacgaag

SEQ ID NO: 679277 - DNA, 22 bp, Artificial Sequence
  chemically synthesized
tgagcagtatttatacgaagat

SEQ ID NO: 679278 - DNA, 22 bp, Artificial Sequence
  chemically synthesized
agcagtatttatacgaagattt

SEQ ID NO: 679279 - DNA, 22 bp, Artificial Sequence
  chemically synthesized
tagaaagaagaaggagagggga

SEQ ID NO: 679280 - DNA, 22 bp, Artificial Sequence
  chemically synthesized
atacgaagatttcccctctcct

SEQ ID NO: 679281 - DNA, 22 bp, Artificial Sequence
  chemically synthesized
gtagaaagaagaaggagagggg

SEQ ID NO: 679282 - DNA, 22 bp, Artificial Sequence
  chemically synthesized
tacgaagatttcccctctcctt

SEQ ID NO: 679283 - DNA, 22 bp, Artificial Sequence
  chemically synthesized
tcatggtttgtagaaagaagaa

SEQ ID NO: 679284 - DNA, 22 bp, Artificial Sequence
  chemically synthesized
cccctctccttcttctttctac

SEQ ID NO: 679285 - DNA, 22 bp, Artificial Sequence
  chemically synthesized
ccctctccttcttctttctaca

SEQ ID NO: 679286 - DNA, 22 bp, Artificial Sequence
  chemically synthesized
tccttcttctttctacaaacca

SEQ ID NO: 679287 - DNA, 22 bp, Artificial Sequence
  chemically synthesized
cttcttctttctacaaaccatg

SEQ ID NO: 679288 - DNA, 22 bp, Artificial Sequence
  chemically synthesized
cttctttctacaaaccatgata

SEQ ID NO: 679289 - DNA, 22 bp, Artificial Sequence
  chemically synthesized
ttctttctacaaaccatgataa

SEQ ID NO: 679290 - DNA, 22 bp, Artificial Sequence
  chemically synthesized
ctttctacaaaccatgataatc

SEQ ID NO: 679291 - DNA, 22 bp, Artificial Sequence
  chemically synthesized
tttctacaaaccatgataatct

SEQ ID NO: 679292 - DNA, 22 bp, Artificial Sequence
  chemically synthesized
tctacaaaccatgataatcttt

SEQ ID NO: 679293 - DNA, 22 bp, Artificial Sequence
  chemically synthesized
ctacaaaccatgataatctttt

SEQ ID NO: 679294 - DNA, 22 bp, Artificial Sequence
  chemically synthesized
aaataaaagggaaaaagattat

SEQ ID NO: 679295 - DNA, 22 bp, Artificial Sequence
  chemically synthesized
tacaaaccatgataatcttttt

SEQ ID NO: 679296 - DNA, 22 bp, Artificial Sequence
  chemically synthesized
caaaccatgataatctttttcc

SEQ ID NO: 679297 - DNA, 22 bp, Artificial Sequence
  chemically synthesized
tcaccgcctcaaataaaaggga

SEQ ID NO: 679298 - DNA, 22 bp, Artificial Sequence
  chemically synthesized
tttcccttttatttgaggcggt

SEQ ID NO: 679299 - DNA, 22 bp, Artificial Sequence
  chemically synthesized
ttcccttttatttgaggcggtg

SEQ ID NO: 679300 - DNA, 22 bp, Artificial Sequence
  chemically synthesized
tcccttttatttgaggcggtga

SEQ ID NO: 679301 - DNA, 22 bp, Artificial Sequence
  chemically synthesized
cccttttatttgaggcggtgat

SEQ ID NO: 679302 - DNA, 22 bp, Artificial Sequence
  chemically synthesized
catcagggtcctatcaccgcct

SEQ ID NO: 679303 - DNA, 22 bp, Artificial Sequence
  chemically synthesized
ccttttatttgaggcggtgata

SEQ ID NO: 679304 - DNA, 22 bp, Artificial Sequence
  chemically synthesized
gcatcagggtcctatcaccgcc

SEQ ID NO: 679305 - DNA, 22 bp, Artificial Sequence
  chemically synthesized
ttatttgaggcggtgataggac

SEQ ID NO: 679306 - DNA, 22 bp, Artificial Sequence
  chemically synthesized
atttgcatcagggtcctatcac

SEQ ID NO: 679307 - DNA, 22 bp, Artificial Sequence
  chemically synthesized
tatttgaggcggtgataggacc

SEQ ID NO: 679308 - DNA, 22 bp, Artificial Sequence
  chemically synthesized
aatttgcatcagggtcctatca

SEQ ID NO: 679309 - DNA, 22 bp, Artificial Sequence
  chemically synthesized
atttgaggcggtgataggaccc

SEQ ID NO: 679310 - DNA, 22 bp, Artificial Sequence
  chemically synthesized
taatttgcatcagggtcctatc

SEQ ID NO: 679311 - DNA, 22 bp, Artificial Sequence
  chemically synthesized
tttgaggcggtgataggaccct

SEQ ID NO: 679312 - DNA, 22 bp, Artificial Sequence
  chemically synthesized
gaggcggtgataggaccctgat

SEQ ID NO: 679313 - DNA, 22 bp, Artificial Sequence
  chemically synthesized
aggcggtgataggaccctgatg

SEQ ID NO: 679314 - DNA, 22 bp, Artificial Sequence
  chemically synthesized
tattttaatttgcatcagggtc

SEQ ID NO: 679315 - DNA, 22 bp, Artificial Sequence
  chemically synthesized
atattttaatttgcatcagggt

SEQ ID NO: 679316 - DNA, 22 bp, Artificial Sequence
  chemically synthesized
tatattttaatttgcatcaggg

SEQ ID NO: 679317 - DNA, 22 bp, Artificial Sequence
  chemically synthesized
tcatagtcgatgactttatatt

SEQ ID NO: 679318 - DNA, 22 bp, Artificial Sequence
  chemically synthesized
atgcaaattaaaatataaagtc

SEQ ID NO: 679319 - DNA, 22 bp, Artificial Sequence
  chemically synthesized
gtcatagtcgatgactttatat

SEQ ID NO: 679320 - DNA, 22 bp, Artificial Sequence
  chemically synthesized
tgtcatagtcgatgactttata

SEQ ID NO: 679321 - DNA, 22 bp, Artificial Sequence
  chemically synthesized
ttgtcatagtcgatgactttat

SEQ ID NO: 679322 - DNA, 22 bp, Artificial Sequence
  chemically synthesized
gggtcttttgtcatagtcgatg

SEQ ID NO: 679323 - DNA, 22 bp, Artificial Sequence
  chemically synthesized
aaatataaagtcatcgactatg

SEQ ID NO: 679324 - DNA, 22 bp, Artificial Sequence
  chemically synthesized
ctggggtcttttgtcatagtcg

SEQ ID NO: 679325 - DNA, 22 bp, Artificial Sequence
  chemically synthesized
acaagtaggtgttgctggggtc

SEQ ID NO: 679326 - DNA, 22 bp, Artificial Sequence
  chemically synthesized
ttgacaagtaggtgttgctggg

SEQ ID NO: 679327 - DNA, 22 bp, Artificial Sequence
  chemically synthesized
tgacaaaagaccccagcaacac

SEQ ID NO: 679328 - DNA, 22 bp, Artificial Sequence
  chemically synthesized
ttattgacaagtaggtgttgct

SEQ ID NO: 679329 - DNA, 22 bp, Artificial Sequence
  chemically synthesized
attattgacaagtaggtgttgc

SEQ ID NO: 679330 - DNA, 22 bp, Artificial Sequence
  chemically synthesized
ttattattgacaagtaggtgtt

SEQ ID NO: 679331 - DNA, 22 bp, Artificial Sequence
  chemically synthesized
cttattattgacaagtaggtgt

SEQ ID NO: 679332 - DNA, 22 bp, Artificial Sequence
  chemically synthesized
atttcttattattgacaagtag

SEQ ID NO: 679333 - DNA, 22 bp, Artificial Sequence
  chemically synthesized
aatttcttattattgacaagta

SEQ ID NO: 679334 - DNA, 22 bp, Artificial Sequence
  chemically synthesized
taatttcttattattgacaagt

SEQ ID NO: 679335 - DNA, 22 bp, Artificial Sequence
  chemically synthesized
cttgtcaataataagaaattaa

SEQ ID NO: 679336 - DNA, 22 bp, Artificial Sequence
  chemically synthesized
agtagagtaatgctttaatttc

SEQ ID NO: 679337 - DNA, 22 bp, Artificial Sequence
  chemically synthesized
gtcaataataagaaattaaagc

SEQ ID NO: 679338 - DNA, 22 bp, Artificial Sequence
  chemically synthesized
tcaataataagaaattaaagca

SEQ ID NO: 679339 - DNA, 22 bp, Artificial Sequence
  chemically synthesized
tgctcagtagagtaatgcttta

SEQ ID NO: 679340 - DNA, 22 bp, Artificial Sequence
  chemically synthesized
gtgctcagtagagtaatgcttt

SEQ ID NO: 679341 - DNA, 22 bp, Artificial Sequence
  chemically synthesized
ggtcagccttgtgctcagtaga

SEQ ID NO: 679342 - DNA, 22 bp, Artificial Sequence
  chemically synthesized
aagcattactctactgagcaca

SEQ ID NO: 679343 - DNA, 22 bp, Artificial Sequence
  chemically synthesized
ctctactgagcacaaggctgac

SEQ ID NO: 679344 - DNA, 22 bp, Artificial Sequence
  chemically synthesized
tactgagcacaaggctgaccta

SEQ ID NO: 679345 - DNA, 22 bp, Artificial Sequence
  chemically synthesized
tatggtaggaaattaggtcagc

SEQ ID NO: 679346 - DNA, 22 bp, Artificial Sequence
  chemically synthesized
ctgagcacaaggctgacctaat

SEQ ID NO: 679347 - DNA, 22 bp, Artificial Sequence
  chemically synthesized
agcacaaggctgacctaatttc

SEQ ID NO: 679348 - DNA, 22 bp, Artificial Sequence
  chemically synthesized
aattgtatggtaggaaattagg

SEQ ID NO: 679349 - DNA, 22 bp, Artificial Sequence
  chemically synthesized
aaattgtatggtaggaaattag

SEQ ID NO: 679350 - DNA, 22 bp, Artificial Sequence
  chemically synthesized
acctaatttcctaccatacaat

SEQ ID NO: 679351 - DNA, 22 bp, Artificial Sequence
  chemically synthesized
atttcctaccatacaatttaaa

SEQ ID NO: 679352 - DNA, 22 bp, Artificial Sequence
  chemically synthesized
cctaccatacaatttaaatttt

SEQ ID NO: 679353 - DNA, 22 bp, Artificial Sequence
  chemically synthesized
ctaccatacaatttaaattttc

SEQ ID NO: 679354 - DNA, 22 bp, Artificial Sequence
  chemically synthesized
aagcaggtgagagaaaatttaa

SEQ ID NO: 679355 - DNA, 22 bp, Artificial Sequence
  chemically synthesized
ccatacaatttaaattttctct

SEQ ID NO: 679356 - DNA, 22 bp, Artificial Sequence
  chemically synthesized
aaactaaagcaggtgagagaaa

SEQ ID NO: 679357 - DNA, 22 bp, Artificial Sequence
  chemically synthesized
gaaactaaagcaggtgagagaa

SEQ ID NO: 679358 - DNA, 22 bp, Artificial Sequence
  chemically synthesized
cttgaaactaaagcaggtgaga

SEQ ID NO: 679359 - DNA, 22 bp, Artificial Sequence
  chemically synthesized
aaattttctctcacctgcttta

SEQ ID NO: 679360 - DNA, 22 bp, Artificial Sequence
  chemically synthesized
aattttctctcacctgctttag

SEQ ID NO: 679361 - DNA, 22 bp, Artificial Sequence
  chemically synthesized
cacactacttgaaactaaagca

SEQ ID NO: 679362 - DNA, 22 bp, Artificial Sequence
  chemically synthesized
gcacactacttgaaactaaagc

SEQ ID NO: 679363 - DNA, 22 bp, Artificial Sequence
  chemically synthesized
tctctcacctgctttagtttca

SEQ ID NO: 679364 - DNA, 22 bp, Artificial Sequence
  chemically synthesized
ctctcacctgctttagtttcaa

SEQ ID NO: 679365 - DNA, 22 bp, Artificial Sequence
  chemically synthesized
tctcacctgctttagtttcaag

SEQ ID NO: 679366 - DNA, 22 bp, Artificial Sequence
  chemically synthesized
tcacctgctttagtttcaagta

SEQ ID NO: 679367 - DNA, 22 bp, Artificial Sequence
  chemically synthesized
acctgctttagtttcaagtagt

SEQ ID NO: 679368 - DNA, 22 bp, Artificial Sequence
  chemically synthesized
taataaccttgcacactacttg

SEQ ID NO: 679369 - DNA, 22 bp, Artificial Sequence
  chemically synthesized
ctttagtttcaagtagtgtgca

SEQ ID NO: 679370 - DNA, 22 bp, Artificial Sequence
  chemically synthesized
tagtttcaagtagtgtgcaagg

SEQ ID NO: 679371 - DNA, 22 bp, Artificial Sequence
  chemically synthesized
agtttcaagtagtgtgcaaggt

SEQ ID NO: 679372 - DNA, 22 bp, Artificial Sequence
  chemically synthesized
gtttcaagtagtgtgcaaggtt

SEQ ID NO: 679373 - DNA, 22 bp, Artificial Sequence
  chemically synthesized
aggcagttataataaccttgca

SEQ ID NO: 679374 - DNA, 22 bp, Artificial Sequence
  chemically synthesized
tgaggcagttataataaccttg

SEQ ID NO: 679375 - DNA, 22 bp, Artificial Sequence
  chemically synthesized
caagtagtgtgcaaggttatta

SEQ ID NO: 679376 - DNA, 22 bp, Artificial Sequence
  chemically synthesized
aagtagtgtgcaaggttattat

SEQ ID NO: 679377 - DNA, 22 bp, Artificial Sequence
  chemically synthesized
acagcaggaacagctctgaggc

SEQ ID NO: 679378 - DNA, 22 bp, Artificial Sequence
  chemically synthesized
ttataactgcctcagagctgtt

SEQ ID NO: 679379 - DNA, 22 bp, Artificial Sequence
  chemically synthesized
taactgcctcagagctgttcct

SEQ ID NO: 679380 - DNA, 22 bp, Artificial Sequence
  chemically synthesized
cagcactgacagcaggaacagc

SEQ ID NO: 679381 - DNA, 22 bp, Artificial Sequence
  chemically synthesized
ttccagcactgacagcaggaac

SEQ ID NO: 679382 - DNA, 22 bp, Artificial Sequence
  chemically synthesized
cctcagagctgttcctgctgtc

SEQ ID NO: 679383 - DNA, 22 bp, Artificial Sequence
  chemically synthesized
attattccagcactgacagcag

SEQ ID NO: 679384 - DNA, 22 bp, Artificial Sequence
  chemically synthesized
agagctgttcctgctgtcagtg

SEQ ID NO: 679385 - DNA, 22 bp, Artificial Sequence
  chemically synthesized
ttcctgctgtcagtgctggaat

SEQ ID NO: 679386 - DNA, 22 bp, Artificial Sequence
  chemically synthesized
caataagtctgattattccagc

SEQ ID NO: 679387 - DNA, 22 bp, Artificial Sequence
  chemically synthesized
ctgctgtcagtgctggaataat

SEQ ID NO: 679388 - DNA, 22 bp, Artificial Sequence
  chemically synthesized
ctgtcagtgctggaataatcag

SEQ ID NO: 679389 - DNA, 22 bp, Artificial Sequence
  chemically synthesized
tcagtgctggaataatcagact

SEQ ID NO: 679390 - DNA, 22 bp, Artificial Sequence
  chemically synthesized
aaaaagcaattccaataagtct

SEQ ID NO: 679391 - DNA, 22 bp, Artificial Sequence
  chemically synthesized
gaataatcagacttattggaat

SEQ ID NO: 679392 - DNA, 22 bp, Artificial Sequence
  chemically synthesized
agaaactaaaaaagcaattcca

SEQ ID NO: 679393 - DNA, 22 bp, Artificial Sequence
  chemically synthesized
aagaaactaaaaaagcaattcc

SEQ ID NO: 679394 - DNA, 22 bp, Artificial Sequence
  chemically synthesized
taagaaactaaaaaagcaattc

SEQ ID NO: 679395 - DNA, 22 bp, Artificial Sequence
  chemically synthesized
ttaagaaactaaaaaagcaatt

SEQ ID NO: 679396 - DNA, 22 bp, Artificial Sequence
  chemically synthesized
tttttaagaaactaaaaaagca

SEQ ID NO: 679397 - DNA, 22 bp, Artificial Sequence
  chemically synthesized
gtttttaagaaactaaaaaagc

SEQ ID NO: 679398 - DNA, 22 bp, Artificial Sequence
  chemically synthesized
attggaattgcttttttagttt

SEQ ID NO: 679399 - DNA, 22 bp, Artificial Sequence
  chemically synthesized
ttggaattgcttttttagtttc

SEQ ID NO: 679400 - DNA, 22 bp, Artificial Sequence
  chemically synthesized
atgtttgtttttaagaaactaa

SEQ ID NO: 679401 - DNA, 22 bp, Artificial Sequence
  chemically synthesized
gaattgcttttttagtttctta

SEQ ID NO: 679402 - DNA, 22 bp, Artificial Sequence
  chemically synthesized
aatgtttgtttttaagaaacta

SEQ ID NO: 679403 - DNA, 22 bp, Artificial Sequence
  chemically synthesized
cttttttagtttcttaaaaaca

SEQ ID NO: 679404 - DNA, 22 bp, Artificial Sequence
  chemically synthesized
ttttagtttcttaaaaacaaac

SEQ ID NO: 679405 - DNA, 22 bp, Artificial Sequence
  chemically synthesized
taagtgtttaatgtttgttttt

SEQ ID NO: 679406 - DNA, 22 bp, Artificial Sequence
  chemically synthesized
tttagtttcttaaaaacaaaca

SEQ ID NO: 679407 - DNA, 22 bp, Artificial Sequence
  chemically synthesized
ataagtgtttaatgtttgtttt

SEQ ID NO: 679408 - DNA, 22 bp, Artificial Sequence
  chemically synthesized
ttagtttcttaaaaacaaacat

SEQ ID NO: 679409 - DNA, 22 bp, Artificial Sequence
  chemically synthesized
tataagtgtttaatgtttgttt

SEQ ID NO: 679410 - DNA, 22 bp, Artificial Sequence
  chemically synthesized
tagtttcttaaaaacaaacatt

SEQ ID NO: 679411 - DNA, 22 bp, Artificial Sequence
  chemically synthesized
ttataagtgtttaatgtttgtt

SEQ ID NO: 679412 - DNA, 22 bp, Artificial Sequence
  chemically synthesized
agtttcttaaaaacaaacatta

SEQ ID NO: 679413 - DNA, 22 bp, Artificial Sequence
  chemically synthesized
tttataagtgtttaatgtttgt

SEQ ID NO: 679414 - DNA, 22 bp, Artificial Sequence
  chemically synthesized
gtttcttaaaaacaaacattaa

SEQ ID NO: 679415 - DNA, 22 bp, Artificial Sequence
  chemically synthesized
ctttttataagtgtttaatgtt

SEQ ID NO: 679416 - DNA, 22 bp, Artificial Sequence
  chemically synthesized
cttaaaaacaaacattaaacac

SEQ ID NO: 679417 - DNA, 22 bp, Artificial Sequence
  chemically synthesized
ttaaaaacaaacattaaacact

SEQ ID NO: 679418 - DNA, 22 bp, Artificial Sequence
  chemically synthesized
ttactttttataagtgtttaat

SEQ ID NO: 679419 - DNA, 22 bp, Artificial Sequence
  chemically synthesized
gttactttttataagtgtttaa

SEQ ID NO: 679420 - DNA, 22 bp, Artificial Sequence
  chemically synthesized
aaaaacaaacattaaacactta

SEQ ID NO: 679421 - DNA, 22 bp, Artificial Sequence
  chemically synthesized
aaaacaaacattaaacacttat

SEQ ID NO: 679422 - DNA, 22 bp, Artificial Sequence
  chemically synthesized
aacacttataaaaagtaacaaa

SEQ ID NO: 679423 - DNA, 22 bp, Artificial Sequence
  chemically synthesized
ataaaaagtaacaaatatctac

SEQ ID NO: 679424 - DNA, 22 bp, Artificial Sequence
  chemically synthesized
ccagccacagcagtagatattt

SEQ ID NO: 679425 - DNA, 22 bp, Artificial Sequence
  chemically synthesized
taaaaagtaacaaatatctact

SEQ ID NO: 679426 - DNA, 22 bp, Artificial Sequence
  chemically synthesized
cccagccacagcagtagatatt

SEQ ID NO: 679427 - DNA, 22 bp, Artificial Sequence
  chemically synthesized
tcccagccacagcagtagatat

SEQ ID NO: 679428 - DNA, 22 bp, Artificial Sequence
  chemically synthesized
ccattttcccagccacagcagt

SEQ ID NO: 679429 - DNA, 22 bp, Artificial Sequence
  chemically synthesized
ggcaactgccattttcccagcc

SEQ ID NO: 679430 - DNA, 22 bp, Artificial Sequence
  chemically synthesized
attaggcaactgccattttccc

SEQ ID NO: 679431 - DNA, 22 bp, Artificial Sequence
  chemically synthesized
ctgctgtggctgggaaaatggc

SEQ ID NO: 679432 - DNA, 22 bp, Artificial Sequence
  chemically synthesized
aattaggcaactgccattttcc

SEQ ID NO: 679433 - DNA, 22 bp, Artificial Sequence
  chemically synthesized
taattaggcaactgccattttc

SEQ ID NO: 679434 - DNA, 22 bp, Artificial Sequence
  chemically synthesized
ctgtggctgggaaaatggcagt

SEQ ID NO: 679435 - DNA, 22 bp, Artificial Sequence
  chemically synthesized
ttttaattaggcaactgccatt

SEQ ID NO: 679436 - DNA, 22 bp, Artificial Sequence
  chemically synthesized
attttaattaggcaactgccat

SEQ ID NO: 679437 - DNA, 22 bp, Artificial Sequence
  chemically synthesized
tggctgggaaaatggcagttgc

SEQ ID NO: 679438 - DNA, 22 bp, Artificial Sequence
  chemically synthesized
ggaaaatggcagttgcctaatt

SEQ ID NO: 679439 - DNA, 22 bp, Artificial Sequence
  chemically synthesized
cctaattaaaataagatttctt

SEQ ID NO: 679440 - DNA, 22 bp, Artificial Sequence
  chemically synthesized
attaaaataagatttcttctgc

SEQ ID NO: 679441 - DNA, 22 bp, Artificial Sequence
  chemically synthesized
aaataagatttcttctgccacc

SEQ ID NO: 679442 - DNA, 22 bp, Artificial Sequence
  chemically synthesized
agtaccaaataacaatggtggc

SEQ ID NO: 679443 - DNA, 22 bp, Artificial Sequence
  chemically synthesized
cagtaccaaataacaatggtgg

SEQ ID NO: 679444 - DNA, 22 bp, Artificial Sequence
  chemically synthesized
tcagtaccaaataacaatggtg

SEQ ID NO: 679445 - DNA, 22 bp, Artificial Sequence
  chemically synthesized
cttctgccaccattgttatttg

SEQ ID NO: 679446 - DNA, 22 bp, Artificial Sequence
  chemically synthesized
ttctgccaccattgttatttgg

SEQ ID NO: 679447 - DNA, 22 bp, Artificial Sequence
  chemically synthesized
ctgccaccattgttatttggta

SEQ ID NO: 679448 - DNA, 22 bp, Artificial Sequence
  chemically synthesized
gaatattttcagtaccaaataa

SEQ ID NO: 679449 - DNA, 22 bp, Artificial Sequence
  chemically synthesized
tgccaccattgttatttggtac

SEQ ID NO: 679450 - DNA, 22 bp, Artificial Sequence
  chemically synthesized
ggaatattttcagtaccaaata

SEQ ID NO: 679451 - DNA, 22 bp, Artificial Sequence
  chemically synthesized
ccaccattgttatttggtactg

SEQ ID NO: 679452 - DNA, 22 bp, Artificial Sequence
  chemically synthesized
tttggaatattttcagtaccaa

SEQ ID NO: 679453 - DNA, 22 bp, Artificial Sequence
  chemically synthesized
ttatttggtactgaaaatattc

SEQ ID NO: 679454 - DNA, 22 bp, Artificial Sequence
  chemically synthesized
tttggtactgaaaatattccaa

SEQ ID NO: 679455 - DNA, 22 bp, Artificial Sequence
  chemically synthesized
aaaaggcaactgtttggaatat

SEQ ID NO: 679456 - DNA, 22 bp, Artificial Sequence
  chemically synthesized
aaaaaggcaactgtttggaata

SEQ ID NO: 679457 - DNA, 22 bp, Artificial Sequence
  chemically synthesized
ggtactgaaaatattccaaaca

SEQ ID NO: 679458 - DNA, 22 bp, Artificial Sequence
  chemically synthesized
taaaaaggcaactgtttggaat

SEQ ID NO: 679459 - DNA, 22 bp, Artificial Sequence
  chemically synthesized
gtactgaaaatattccaaacag

SEQ ID NO: 679460 - DNA, 22 bp, Artificial Sequence
  chemically synthesized
ttaaaaaggcaactgtttggaa

SEQ ID NO: 679461 - DNA, 22 bp, Artificial Sequence
  chemically synthesized
tttaaaaaggcaactgtttgga

SEQ ID NO: 679462 - DNA, 22 bp, Artificial Sequence
  chemically synthesized
aaaatattccaaacagttgcct

SEQ ID NO: 679463 - DNA, 22 bp, Artificial Sequence
  chemically synthesized
caaacagttgcctttttaaaaa

SEQ ID NO: 679464 - DNA, 22 bp, Artificial Sequence
  chemically synthesized
ggaagtagtggacagatagttt

SEQ ID NO: 679465 - DNA, 22 bp, Artificial Sequence
  chemically synthesized
cctttttaaaaaactatctgtc

SEQ ID NO: 679466 - DNA, 22 bp, Artificial Sequence
  chemically synthesized
cctgggaagtagtggacagata

SEQ ID NO: 679467 - DNA, 22 bp, Artificial Sequence
  chemically synthesized
tttaaaaaactatctgtccact

SEQ ID NO: 679468 - DNA, 22 bp, Artificial Sequence
  chemically synthesized
tccctgggaagtagtggacaga

SEQ ID NO: 679469 - DNA, 22 bp, Artificial Sequence
  chemically synthesized
ttaaaaaactatctgtccacta

SEQ ID NO: 679470 - DNA, 22 bp, Artificial Sequence
  chemically synthesized
ctccctgggaagtagtggacag

SEQ ID NO: 679471 - DNA, 22 bp, Artificial Sequence
  chemically synthesized
taaaaaactatctgtccactac

SEQ ID NO: 679472 - DNA, 22 bp, Artificial Sequence
  chemically synthesized
tctccctgggaagtagtggaca

SEQ ID NO: 679473 - DNA, 22 bp, Artificial Sequence
  chemically synthesized
aaaaaactatctgtccactact

SEQ ID NO: 679474 - DNA, 22 bp, Artificial Sequence
  chemically synthesized
aaaaactatctgtccactactt

SEQ ID NO: 679475 - DNA, 22 bp, Artificial Sequence
  chemically synthesized
gttttctccctgggaagtagtg

SEQ ID NO: 679476 - DNA, 22 bp, Artificial Sequence
  chemically synthesized
tctgtccactacttcccaggga

SEQ ID NO: 679477 - DNA, 22 bp, Artificial Sequence
  chemically synthesized
tccactacttcccagggagaaa

SEQ ID NO: 679478 - DNA, 22 bp, Artificial Sequence
  chemically synthesized
catagcgattagttttctccct

SEQ ID NO: 679479 - DNA, 22 bp, Artificial Sequence
  chemically synthesized
ctgcatagcgattagttttctc

SEQ ID NO: 679480 - DNA, 22 bp, Artificial Sequence
  chemically synthesized
cttcccagggagaaaactaatc

SEQ ID NO: 679481 - DNA, 22 bp, Artificial Sequence
  chemically synthesized
tattgctgcatagcgattagtt

SEQ ID NO: 679482 - DNA, 22 bp, Artificial Sequence
  chemically synthesized
cccagggagaaaactaatcgct

SEQ ID NO: 679483 - DNA, 22 bp, Artificial Sequence
  chemically synthesized
atattgctgcatagcgattagt

SEQ ID NO: 679484 - DNA, 22 bp, Artificial Sequence
  chemically synthesized
ccagggagaaaactaatcgcta

SEQ ID NO: 679485 - DNA, 22 bp, Artificial Sequence
  chemically synthesized
tatattgctgcatagcgattag

SEQ ID NO: 679486 - DNA, 22 bp, Artificial Sequence
  chemically synthesized
ttatattgctgcatagcgatta

SEQ ID NO: 679487 - DNA, 22 bp, Artificial Sequence
  chemically synthesized
tttatattgctgcatagcgatt

SEQ ID NO: 679488 - DNA, 22 bp, Artificial Sequence
  chemically synthesized
cctttttatattgctgcatagc

SEQ ID NO: 679489 - DNA, 22 bp, Artificial Sequence
  chemically synthesized
atcgctatgcagcaatataaaa

SEQ ID NO: 679490 - DNA, 22 bp, Artificial Sequence
  chemically synthesized
tgcagcaatataaaaagggagc

SEQ ID NO: 679491 - DNA, 22 bp, Artificial Sequence
  chemically synthesized
caaatcgcaagagaacgctccc

SEQ ID NO: 679492 - DNA, 22 bp, Artificial Sequence
  chemically synthesized
tgcaaatcgcaagagaacgctc

SEQ ID NO: 679493 - DNA, 22 bp, Artificial Sequence
  chemically synthesized
atcctctgcaaatcgcaagaga

SEQ ID NO: 679494 - DNA, 22 bp, Artificial Sequence
  chemically synthesized
taatcctctgcaaatcgcaaga

SEQ ID NO: 679495 - DNA, 22 bp, Artificial Sequence
  chemically synthesized
tcttgcgatttgcagaggatta

SEQ ID NO: 679496 - DNA, 22 bp, Artificial Sequence
  chemically synthesized
ttgcgatttgcagaggattaga

SEQ ID NO: 679497 - DNA, 22 bp, Artificial Sequence
  chemically synthesized
gcgatttgcagaggattagagt

SEQ ID NO: 679498 - DNA, 22 bp, Artificial Sequence
  chemically synthesized
cgatttgcagaggattagagtt

SEQ ID NO: 679499 - DNA, 22 bp, Artificial Sequence
  chemically synthesized
tatatgaaaccaaactctaatc

SEQ ID NO: 679500 - DNA, 22 bp, Artificial Sequence
  chemically synthesized
gcagaggattagagtttggttt

SEQ ID NO: 679501 - DNA, 22 bp, Artificial Sequence
  chemically synthesized
cagaggattagagtttggtttc

SEQ ID NO: 679502 - DNA, 22 bp, Artificial Sequence
  chemically synthesized
cagattatatatgaaaccaaac

SEQ ID NO: 679503 - DNA, 22 bp, Artificial Sequence
  chemically synthesized
gagtttggtttcatatataatc

SEQ ID NO: 679504 - DNA, 22 bp, Artificial Sequence
  chemically synthesized
ggtttcatatataatctggagc

SEQ ID NO: 679505 - DNA, 22 bp, Artificial Sequence
  chemically synthesized
gtttcatatataatctggagcc

SEQ ID NO: 679506 - DNA, 22 bp, Artificial Sequence
  chemically synthesized
catatataatctggagcccatt

SEQ ID NO: 679507 - DNA, 22 bp, Artificial Sequence
  chemically synthesized
tgtgtgtggatcaatgggctcc

SEQ ID NO: 679508 - DNA, 22 bp, Artificial Sequence
  chemically synthesized
atatataatctggagcccattg

SEQ ID NO: 679509 - DNA, 22 bp, Artificial Sequence
  chemically synthesized
gtgtgtgtggatcaatgggctc

SEQ ID NO: 679510 - DNA, 22 bp, Artificial Sequence
  chemically synthesized
gagcccattgatccacacacac

SEQ ID NO: 679511 - DNA, 22 bp, Artificial Sequence
  chemically synthesized
aagggaaatcatttgtgtgtgt

SEQ ID NO: 679512 - DNA, 22 bp, Artificial Sequence
  chemically synthesized
agattaaagggaaatcatttgt

SEQ ID NO: 679513 - DNA, 22 bp, Artificial Sequence
  chemically synthesized
atccacacacacaaatgatttc

SEQ ID NO: 679514 - DNA, 22 bp, Artificial Sequence
  chemically synthesized
atcctcagattaaagggaaatc

SEQ ID NO: 679515 - DNA, 22 bp, Artificial Sequence
  chemically synthesized
gaaaaagagtctgatcctcaga

SEQ ID NO: 679516 - DNA, 22 bp, Artificial Sequence
  chemically synthesized
tagaaaaagagtctgatcctca

SEQ ID NO: 679517 - DNA, 22 bp, Artificial Sequence
  chemically synthesized
ccctttaatctgaggatcagac

SEQ ID NO: 679518 - DNA, 22 bp, Artificial Sequence
  chemically synthesized
cctttaatctgaggatcagact

SEQ ID NO: 679519 - DNA, 22 bp, Artificial Sequence
  chemically synthesized
ctctagaaaaagagtctgatcc

SEQ ID NO: 679520 - DNA, 22 bp, Artificial Sequence
  chemically synthesized
taatctgaggatcagactcttt

SEQ ID NO: 679521 - DNA, 22 bp, Artificial Sequence
  chemically synthesized
aatctgaggatcagactctttt

SEQ ID NO: 679522 - DNA, 22 bp, Artificial Sequence
  chemically synthesized
atctgaggatcagactcttttt

SEQ ID NO: 679523 - DNA, 22 bp, Artificial Sequence
  chemically synthesized
aggatcagactctttttctaga

SEQ ID NO: 679524 - DNA, 22 bp, Artificial Sequence
  chemically synthesized
agcacgcaaatgccaaggttcc

SEQ ID NO: 679525 - DNA, 22 bp, Artificial Sequence
  chemically synthesized
tttttctagaggaaccttggca

SEQ ID NO: 679526 - DNA, 22 bp, Artificial Sequence
  chemically synthesized
tttctagaggaaccttggcatt

SEQ ID NO: 679527 - DNA, 22 bp, Artificial Sequence
  chemically synthesized
ttctagaggaaccttggcattt

SEQ ID NO: 679528 - DNA, 22 bp, Artificial Sequence
  chemically synthesized
tctagaggaaccttggcatttg

SEQ ID NO: 679529 - DNA, 22 bp, Artificial Sequence
  chemically synthesized
ctagaggaaccttggcatttgc

SEQ ID NO: 679530 - DNA, 22 bp, Artificial Sequence
  chemically synthesized
tagaggaaccttggcatttgcg

SEQ ID NO: 679531 - DNA, 22 bp, Artificial Sequence
  chemically synthesized
aacaattcagcacgcaaatgcc

SEQ ID NO: 679532 - DNA, 22 bp, Artificial Sequence
  chemically synthesized
gaggaaccttggcatttgcgtg

SEQ ID NO: 679533 - DNA, 22 bp, Artificial Sequence
  chemically synthesized
ggcatttgcgtgctgaattgtt

SEQ ID NO: 679534 - DNA, 22 bp, Artificial Sequence
  chemically synthesized
gcatttgcgtgctgaattgttg

SEQ ID NO: 679535 - DNA, 22 bp, Artificial Sequence
  chemically synthesized
gcgtgctgaattgttgaacttg

SEQ ID NO: 679536 - DNA, 22 bp, Artificial Sequence
  chemically synthesized
cgtgctgaattgttgaacttgg

SEQ ID NO: 679537 - DNA, 22 bp, Artificial Sequence
  chemically synthesized
cagcaatgcaagccaagttcaa

SEQ ID NO: 679538 - DNA, 22 bp, Artificial Sequence
  chemically synthesized
aattgttgaacttggcttgcat

SEQ ID NO: 679539 - DNA, 22 bp, Artificial Sequence
  chemically synthesized
ccagtattccagcaatgcaagc

SEQ ID NO: 679540 - DNA, 22 bp, Artificial Sequence
  chemically synthesized
ttgaacttggcttgcattgctg

SEQ ID NO: 679541 - DNA, 22 bp, Artificial Sequence
  chemically synthesized
aacttggcttgcattgctggaa

SEQ ID NO: 679542 - DNA, 22 bp, Artificial Sequence
  chemically synthesized
ggcttgcattgctggaatactg

SEQ ID NO: 679543 - DNA, 22 bp, Artificial Sequence
  chemically synthesized
gcttgcattgctggaatactgg

SEQ ID NO: 679544 - DNA, 22 bp, Artificial Sequence
  chemically synthesized
ccatccacaccctgccagtatt

SEQ ID NO: 679545 - DNA, 22 bp, Artificial Sequence
  chemically synthesized
accatccacaccctgccagtat

SEQ ID NO: 679546 - DNA, 22 bp, Artificial Sequence
  chemically synthesized
gcattgctggaatactggcagg

SEQ ID NO: 679547 - DNA, 22 bp, Artificial Sequence
  chemically synthesized
taccatccacaccctgccagta

SEQ ID NO: 679548 - DNA, 22 bp, Artificial Sequence
  chemically synthesized
cattgctggaatactggcaggg

SEQ ID NO: 679549 - DNA, 22 bp, Artificial Sequence
  chemically synthesized
ctggaatactggcagggtgtgg

SEQ ID NO: 679550 - DNA, 22 bp, Artificial Sequence
  chemically synthesized
gaatactggcagggtgtggatg

SEQ ID NO: 679551 - DNA, 22 bp, Artificial Sequence
  chemically synthesized
aaatatattttaccatccacac

SEQ ID NO: 679552 - DNA, 22 bp, Artificial Sequence
  chemically synthesized
aaaatatattttaccatccaca

SEQ ID NO: 679553 - DNA, 22 bp, Artificial Sequence
  chemically synthesized
taaaatatattttaccatccac

SEQ ID NO: 679554 - DNA, 22 bp, Artificial Sequence
  chemically synthesized
gcagggtgtggatggtaaaata

SEQ ID NO: 679555 - DNA, 22 bp, Artificial Sequence
  chemically synthesized
ccccacggtagcagaaacttta

SEQ ID NO: 679556 - DNA, 22 bp, Artificial Sequence
  chemically synthesized
caaacccctgccccacggtagc

SEQ ID NO: 679557 - DNA, 22 bp, Artificial Sequence
  chemically synthesized
taaagtttctgctaccgtgggg

SEQ ID NO: 679558 - DNA, 22 bp, Artificial Sequence
  chemically synthesized
aaagtttctgctaccgtggggc

SEQ ID NO: 679559 - DNA, 22 bp, Artificial Sequence
  chemically synthesized
aagtttctgctaccgtggggca

SEQ ID NO: 679560 - DNA, 22 bp, Artificial Sequence
  chemically synthesized
ctgctaccgtggggcaggggtt

SEQ ID NO: 679561 - DNA, 22 bp, Artificial Sequence
  chemically synthesized
tgctaccgtggggcaggggttt

SEQ ID NO: 679562 - DNA, 22 bp, Artificial Sequence
  chemically synthesized
ctaccgtggggcaggggtttgg

SEQ ID NO: 679563 - DNA, 22 bp, Artificial Sequence
  chemically synthesized
atgcccacccctccaaacccct

SEQ ID NO: 679564 - DNA, 22 bp, Artificial Sequence
  chemically synthesized
ccgtggggcaggggtttggagg

SEQ ID NO: 679565 - DNA, 22 bp, Artificial Sequence
  chemically synthesized
tattgatgcccacccctccaaa

SEQ ID NO: 679566 - DNA, 22 bp, Artificial Sequence
  chemically synthesized
atattgatgcccacccctccaa

SEQ ID NO: 679567 - DNA, 22 bp, Artificial Sequence
  chemically synthesized
atgcttatattgatgcccaccc

SEQ ID NO: 679568 - DNA, 22 bp, Artificial Sequence
  chemically synthesized
tgatgcttatattgatgcccac

SEQ ID NO: 679569 - DNA, 22 bp, Artificial Sequence
  chemically synthesized
ctgatgcttatattgatgccca

SEQ ID NO: 679570 - DNA, 22 bp, Artificial Sequence
  chemically synthesized
ggaggggtgggcatcaatataa

SEQ ID NO: 679571 - DNA, 22 bp, Artificial Sequence
  chemically synthesized
gaggggtgggcatcaatataag

SEQ ID NO: 679572 - DNA, 22 bp, Artificial Sequence
  chemically synthesized
gaatggatttctgatgcttata

SEQ ID NO: 679573 - DNA, 22 bp, Artificial Sequence
  chemically synthesized
tagttccccatttcttgttccc

SEQ ID NO: 679574 - DNA, 22 bp, Artificial Sequence
  chemically synthesized
gttccccatttcttgttccctg

SEQ ID NO: 679575 - DNA, 22 bp, Artificial Sequence
  chemically synthesized
cccatttcttgttccctgggat

SEQ ID NO: 679576 - DNA, 22 bp, Artificial Sequence
  chemically synthesized
cttgttccctgggatatttacc

SEQ ID NO: 679577 - DNA, 22 bp, Artificial Sequence
  chemically synthesized
ttgttccctgggatatttacca

SEQ ID NO: 679578 - DNA, 22 bp, Artificial Sequence
  chemically synthesized
gttccctgggatatttaccatt

SEQ ID NO: 679579 - DNA, 22 bp, Artificial Sequence
  chemically synthesized
ttccctgggatatttaccattt

SEQ ID NO: 679580 - DNA, 22 bp, Artificial Sequence
  chemically synthesized
gccagacagaataaaatggtaa

SEQ ID NO: 679581 - DNA, 22 bp, Artificial Sequence
  chemically synthesized
agccagacagaataaaatggta

SEQ ID NO: 679582 - DNA, 22 bp, Artificial Sequence
  chemically synthesized
cctgggatatttaccattttat

SEQ ID NO: 679583 - DNA, 22 bp, Artificial Sequence
  chemically synthesized
tagccagacagaataaaatggt

SEQ ID NO: 679584 - DNA, 22 bp, Artificial Sequence
  chemically synthesized
ggatatttaccattttattctg

SEQ ID NO: 679585 - DNA, 22 bp, Artificial Sequence
  chemically synthesized
gctttagccagacagaataaaa

SEQ ID NO: 679586 - DNA, 22 bp, Artificial Sequence
  chemically synthesized
ccctggctttagccagacagaa

SEQ ID NO: 679587 - DNA, 22 bp, Artificial Sequence
  chemically synthesized
gccctggctttagccagacaga

SEQ ID NO: 679588 - DNA, 22 bp, Artificial Sequence
  chemically synthesized
tgccctggctttagccagacag

SEQ ID NO: 679589 - DNA, 22 bp, Artificial Sequence
  chemically synthesized
accattttattctgtctggcta

SEQ ID NO: 679590 - DNA, 22 bp, Artificial Sequence
  chemically synthesized
ccattttattctgtctggctaa

SEQ ID NO: 679591 - DNA, 22 bp, Artificial Sequence
  chemically synthesized
tattctgtctggctaaagccag

SEQ ID NO: 679592 - DNA, 22 bp, Artificial Sequence
  chemically synthesized
attctgtctggctaaagccagg

SEQ ID NO: 679593 - DNA, 22 bp, Artificial Sequence
  chemically synthesized
ttctgtctggctaaagccaggg

SEQ ID NO: 679594 - DNA, 22 bp, Artificial Sequence
  chemically synthesized
tgtctggctaaagccagggcaa

SEQ ID NO: 679595 - DNA, 22 bp, Artificial Sequence
  chemically synthesized
tctggctaaagccagggcaaag

SEQ ID NO: 679596 - DNA, 22 bp, Artificial Sequence
  chemically synthesized
gctaaagccagggcaaagatga

SEQ ID NO: 679597 - DNA, 22 bp, Artificial Sequence
  chemically synthesized
aagccagggcaaagatgattgc

SEQ ID NO: 679598 - DNA, 22 bp, Artificial Sequence
  chemically synthesized
gaacagccaccgaggcaatcat

SEQ ID NO: 679599 - DNA, 22 bp, Artificial Sequence
  chemically synthesized
acagctggaacagccaccgagg

SEQ ID NO: 679600 - DNA, 22 bp, Artificial Sequence
  chemically synthesized
cctcggtggctgttccagctgt

SEQ ID NO: 679601 - DNA, 22 bp, Artificial Sequence
  chemically synthesized
ggtggctgttccagctgttagt

SEQ ID NO: 679602 - DNA, 22 bp, Artificial Sequence
  chemically synthesized
ttccagctgttagttgtcctcc

SEQ ID NO: 679603 - DNA, 22 bp, Artificial Sequence
  chemically synthesized
cagctgttagttgtcctccgtt

SEQ ID NO: 679604 - DNA, 22 bp, Artificial Sequence
  chemically synthesized
aaaagcaaataaaacggaggac

SEQ ID NO: 679605 - DNA, 22 bp, Artificial Sequence
  chemically synthesized
gaaaagcaaataaaacggagga

SEQ ID NO: 679606 - DNA, 22 bp, Artificial Sequence
  chemically synthesized
ttagttgtcctccgttttattt

SEQ ID NO: 679607 - DNA, 22 bp, Artificial Sequence
  chemically synthesized
aaccttgaaaagcaaataaaac

SEQ ID NO: 679608 - DNA, 22 bp, Artificial Sequence
  chemically synthesized
gttgtcctccgttttatttgct

SEQ ID NO: 679609 - DNA, 22 bp, Artificial Sequence
  chemically synthesized
tcctccgttttatttgcttttc

SEQ ID NO: 679610 - DNA, 22 bp, Artificial Sequence
  chemically synthesized
cgttttatttgcttttcaaggt

SEQ ID NO: 679611 - DNA, 22 bp, Artificial Sequence
  chemically synthesized
tatttgcttttcaaggtttaac

SEQ ID NO: 679612 - DNA, 22 bp, Artificial Sequence
  chemically synthesized
atttgcttttcaaggtttaact

SEQ ID NO: 679613 - DNA, 22 bp, Artificial Sequence
  chemically synthesized
agggtgggtaggagttaaacct

SEQ ID NO: 679614 - DNA, 22 bp, Artificial Sequence
  chemically synthesized
tttgcttttcaaggtttaactc

SEQ ID NO: 679615 - DNA, 22 bp, Artificial Sequence
  chemically synthesized
gcttttcaaggtttaactccta

SEQ ID NO: 679616 - DNA, 22 bp, Artificial Sequence
  chemically synthesized
cttttcaaggtttaactcctac

SEQ ID NO: 679617 - DNA, 22 bp, Artificial Sequence
  chemically synthesized
ttcaaggtttaactcctaccca

SEQ ID NO: 679618 - DNA, 22 bp, Artificial Sequence
  chemically synthesized
tcaaggtttaactcctacccac

SEQ ID NO: 679619 - DNA, 22 bp, Artificial Sequence
  chemically synthesized
caaggtttaactcctacccacc

SEQ ID NO: 679620 - DNA, 22 bp, Artificial Sequence
  chemically synthesized
accaaagttgagggtgggtagg

SEQ ID NO: 679621 - DNA, 22 bp, Artificial Sequence
  chemically synthesized
aaggtttaactcctacccaccc

SEQ ID NO: 679622 - DNA, 22 bp, Artificial Sequence
  chemically synthesized
gaccaaagttgagggtgggtag

SEQ ID NO: 679623 - DNA, 22 bp, Artificial Sequence
  chemically synthesized
tgaccaaagttgagggtgggta

SEQ ID NO: 679624 - DNA, 22 bp, Artificial Sequence
  chemically synthesized
ctttgaccaaagttgagggtgg

SEQ ID NO: 679625 - DNA, 22 bp, Artificial Sequence
  chemically synthesized
aactcctacccaccctcaactt

SEQ ID NO: 679626 - DNA, 22 bp, Artificial Sequence
  chemically synthesized
actcctacccaccctcaacttt

SEQ ID NO: 679627 - DNA, 22 bp, Artificial Sequence
  chemically synthesized
ctacccaccctcaactttggtc

SEQ ID NO: 679628 - DNA, 22 bp, Artificial Sequence
  chemically synthesized
cccaccctcaactttggtcaaa

SEQ ID NO: 679629 - DNA, 22 bp, Artificial Sequence
  chemically synthesized
aaaagaaattgctttgaccaaa

SEQ ID NO: 679630 - DNA, 22 bp, Artificial Sequence
  chemically synthesized
aactttggtcaaagcaatttct

SEQ ID NO: 679631 - DNA, 22 bp, Artificial Sequence
  chemically synthesized
gacacgaccctgaaaagaaatt

SEQ ID NO: 679632 - DNA, 22 bp, Artificial Sequence
  chemically synthesized
tggtcaaagcaatttcttttca

SEQ ID NO: 679633 - DNA, 22 bp, Artificial Sequence
  chemically synthesized
ggtcaaagcaatttcttttcag

SEQ ID NO: 679634 - DNA, 22 bp, Artificial Sequence
  chemically synthesized
gtcaaagcaatttcttttcagg

SEQ ID NO: 679635 - DNA, 22 bp, Artificial Sequence
  chemically synthesized
cgattggacacgaccctgaaaa

SEQ ID NO: 679636 - DNA, 22 bp, Artificial Sequence
  chemically synthesized
atctccgattggacacgaccct

SEQ ID NO: 679637 - DNA, 22 bp, Artificial Sequence
  chemically synthesized
gatctccgattggacacgaccc

SEQ ID NO: 679638 - DNA, 22 bp, Artificial Sequence
  chemically synthesized
tttgatctccgattggacacga

SEQ ID NO: 679639 - DNA, 22 bp, Artificial Sequence
  chemically synthesized
cttttcagggtcgtgtccaatc

SEQ ID NO: 679640 - DNA, 22 bp, Artificial Sequence
  chemically synthesized
ttttcagggtcgtgtccaatcg

SEQ ID NO: 679641 - DNA, 22 bp, Artificial Sequence
  chemically synthesized
ttcagggtcgtgtccaatcgga

SEQ ID NO: 679642 - DNA, 22 bp, Artificial Sequence
  chemically synthesized
tcagggtcgtgtccaatcggag

SEQ ID NO: 679643 - DNA, 22 bp, Artificial Sequence
  chemically synthesized
cagggtcgtgtccaatcggaga

SEQ ID NO: 679644 - DNA, 22 bp, Artificial Sequence
  chemically synthesized
agggtcgtgtccaatcggagat

SEQ ID NO: 679645 - DNA, 22 bp, Artificial Sequence
  chemically synthesized
agtcatcattgtttgatctccg

SEQ ID NO: 679646 - DNA, 22 bp, Artificial Sequence
  chemically synthesized
cagtcatcattgtttgatctcc

SEQ ID NO: 679647 - DNA, 22 bp, Artificial Sequence
  chemically synthesized
gtttcagtcatcattgtttgat

SEQ ID NO: 679648 - DNA, 22 bp, Artificial Sequence
  chemically synthesized
aacaccgtggaattggtttcag

SEQ ID NO: 679649 - DNA, 22 bp, Artificial Sequence
  chemically synthesized
gaacaccgtggaattggtttca

SEQ ID NO: 679650 - DNA, 22 bp, Artificial Sequence
  chemically synthesized
acccttgaacaccgtggaattg

SEQ ID NO: 679651 - DNA, 22 bp, Artificial Sequence
  chemically synthesized
tgacccttgaacaccgtggaat

SEQ ID NO: 679652 - DNA, 22 bp, Artificial Sequence
  chemically synthesized
aaaccaattccacggtgttcaa

SEQ ID NO: 679653 - DNA, 22 bp, Artificial Sequence
  chemically synthesized
tatgaaaggtctctgacccttg

SEQ ID NO: 679654 - DNA, 22 bp, Artificial Sequence
  chemically synthesized
cacggtgttcaagggtcagaga

SEQ ID NO: 679655 - DNA, 22 bp, Artificial Sequence
  chemically synthesized
aagggtcagagacctttcatat

SEQ ID NO: 679656 - DNA, 22 bp, Artificial Sequence
  chemically synthesized
tcatataaccgtgttgcttcat

SEQ ID NO: 679657 - DNA, 22 bp, Artificial Sequence
  chemically synthesized
catataaccgtgttgcttcatt

SEQ ID NO: 679658 - DNA, 22 bp, Artificial Sequence
  chemically synthesized
atataaccgtgttgcttcattt

SEQ ID NO: 679659 - DNA, 22 bp, Artificial Sequence
  chemically synthesized
gagaagcgagtggagcaaatga

SEQ ID NO: 679660 - DNA, 22 bp, Artificial Sequence
  chemically synthesized
ttggagaagcgagtggagcaaa

SEQ ID NO: 679661 - DNA, 22 bp, Artificial Sequence
  chemically synthesized
ctgttggagaagcgagtggagc

SEQ ID NO: 679662 - DNA, 22 bp, Artificial Sequence
  chemically synthesized
gctgttggagaagcgagtggag

SEQ ID NO: 679663 - DNA, 22 bp, Artificial Sequence
  chemically synthesized
cttcatttgctccactcgcttc

SEQ ID NO: 679664 - DNA, 22 bp, Artificial Sequence
  chemically synthesized
catttgctccactcgcttctcc

SEQ ID NO: 679665 - DNA, 22 bp, Artificial Sequence
  chemically synthesized
atttgctccactcgcttctcca

SEQ ID NO: 679666 - DNA, 22 bp, Artificial Sequence
  chemically synthesized
gctccactcgcttctccaacag

SEQ ID NO: 679667 - DNA, 22 bp, Artificial Sequence
  chemically synthesized
ctccactcgcttctccaacagc

SEQ ID NO: 679668 - DNA, 22 bp, Artificial Sequence
  chemically synthesized
gaggatacatttgctgttggag

SEQ ID NO: 679669 - DNA, 22 bp, Artificial Sequence
  chemically synthesized
ggaggatacatttgctgttgga

SEQ ID NO: 679670 - DNA, 22 bp, Artificial Sequence
  chemically synthesized
tggaggatacatttgctgttgg

SEQ ID NO: 679671 - DNA, 22 bp, Artificial Sequence
  chemically synthesized
cactcgcttctccaacagcaaa

SEQ ID NO: 679672 - DNA, 22 bp, Artificial Sequence
  chemically synthesized
tttggaggatacatttgctgtt

SEQ ID NO: 679673 - DNA, 22 bp, Artificial Sequence
  chemically synthesized
gcttctccaacagcaaatgtat

SEQ ID NO: 679674 - DNA, 22 bp, Artificial Sequence
  chemically synthesized
ctccaacagcaaatgtatcctc

SEQ ID NO: 679675 - DNA, 22 bp, Artificial Sequence
  chemically synthesized
tccaacagcaaatgtatcctcc

SEQ ID NO: 679676 - DNA, 22 bp, Artificial Sequence
  chemically synthesized
aagcccctctttggaggataca

SEQ ID NO: 679677 - DNA, 22 bp, Artificial Sequence
  chemically synthesized
caacagcaaatgtatcctccaa

SEQ ID NO: 679678 - DNA, 22 bp, Artificial Sequence
  chemically synthesized
ctcaagcccctctttggaggat

SEQ ID NO: 679679 - DNA, 22 bp, Artificial Sequence
  chemically synthesized
actcaagcccctctttggagga

SEQ ID NO: 679680 - DNA, 22 bp, Artificial Sequence
  chemically synthesized
tactcaagcccctctttggagg

SEQ ID NO: 679681 - DNA, 22 bp, Artificial Sequence
  chemically synthesized
ttactcaagcccctctttggag

SEQ ID NO: 679682 - DNA, 22 bp, Artificial Sequence
  chemically synthesized
ccttttactcaagcccctcttt

SEQ ID NO: 679683 - DNA, 22 bp, Artificial Sequence
  chemically synthesized
ttgccttttactcaagcccctc

SEQ ID NO: 679684 - DNA, 22 bp, Artificial Sequence
  chemically synthesized
attgccttttactcaagcccct

SEQ ID NO: 679685 - DNA, 22 bp, Artificial Sequence
  chemically synthesized
tattgccttttactcaagcccc

SEQ ID NO: 679686 - DNA, 22 bp, Artificial Sequence
  chemically synthesized
ttattgccttttactcaagccc

SEQ ID NO: 679687 - DNA, 22 bp, Artificial Sequence
  chemically synthesized
tttattgccttttactcaagcc

SEQ ID NO: 679688 - DNA, 22 bp, Artificial Sequence
  chemically synthesized
ttttattgccttttactcaagc

SEQ ID NO: 679689 - DNA, 22 bp, Artificial Sequence
  chemically synthesized
caaagaggggcttgagtaaaag

SEQ ID NO: 679690 - DNA, 22 bp, Artificial Sequence
  chemically synthesized
gcttttttattgccttttactc

SEQ ID NO: 679691 - DNA, 22 bp, Artificial Sequence
  chemically synthesized
cctagcttttttattgcctttt

SEQ ID NO: 679692 - DNA, 22 bp, Artificial Sequence
  chemically synthesized
gcctagcttttttattgccttt

SEQ ID NO: 679693 - DNA, 22 bp, Artificial Sequence
  chemically synthesized
tgcctagcttttttattgcctt

SEQ ID NO: 679694 - DNA, 22 bp, Artificial Sequence
  chemically synthesized
ttgcctagcttttttattgcct

SEQ ID NO: 679695 - DNA, 22 bp, Artificial Sequence
  chemically synthesized
tttgcctagcttttttattgcc

SEQ ID NO: 679696 - DNA, 22 bp, Artificial Sequence
  chemically synthesized
ttttgcctagcttttttattgc

SEQ ID NO: 679697 - DNA, 22 bp, Artificial Sequence
  chemically synthesized
tttttgcctagcttttttattg

SEQ ID NO: 679698 - DNA, 22 bp, Artificial Sequence
  chemically synthesized
gagtaaaaggcaataaaaaagc

SEQ ID NO: 679699 - DNA, 22 bp, Artificial Sequence
  chemically synthesized
tttttttgcctagcttttttat

SEQ ID NO: 679700 - DNA, 22 bp, Artificial Sequence
  chemically synthesized
agtaaaaggcaataaaaaagct

SEQ ID NO: 679701 - DNA, 22 bp, Artificial Sequence
  chemically synthesized
ctttttttgcctagctttttta

SEQ ID NO: 679702 - DNA, 22 bp, Artificial Sequence
  chemically synthesized
tctttttttgcctagctttttt

SEQ ID NO: 679703 - DNA, 22 bp, Artificial Sequence
  chemically synthesized
ggcaaaaaaagaaaggttgatt

SEQ ID NO: 679704 - DNA, 22 bp, Artificial Sequence
  chemically synthesized
tcacccacccccccccccccca

SEQ ID NO: 679705 - DNA, 22 bp, Artificial Sequence
  chemically synthesized
gtcacccacccccccccccccc

SEQ ID NO: 679706 - DNA, 22 bp, Artificial Sequence
  chemically synthesized
attgggggtgtggggggggggg

SEQ ID NO: 679707 - DNA, 22 bp, Artificial Sequence
  chemically synthesized
cttgtcacccaccccccccccc

SEQ ID NO: 679708 - DNA, 22 bp, Artificial Sequence
  chemically synthesized
ggggtgtggggggggggggggt

SEQ ID NO: 679709 - DNA, 22 bp, Artificial Sequence
  chemically synthesized
tccttgtcacccaccccccccc

SEQ ID NO: 679710 - DNA, 22 bp, Artificial Sequence
  chemically synthesized
tcatctctccttgtcacccacc

SEQ ID NO: 679711 - DNA, 22 bp, Artificial Sequence
  chemically synthesized
tccctgtcatctctccttgtca

SEQ ID NO: 679712 - DNA, 22 bp, Artificial Sequence
  chemically synthesized
atccctgtcatctctccttgtc

SEQ ID NO: 679713 - DNA, 22 bp, Artificial Sequence
  chemically synthesized
tatccctgtcatctctccttgt

SEQ ID NO: 679714 - DNA, 22 bp, Artificial Sequence
  chemically synthesized
ctttatccctgtcatctctcct

SEQ ID NO: 679715 - DNA, 22 bp, Artificial Sequence
  chemically synthesized
tgctttatccctgtcatctctc

SEQ ID NO: 679716 - DNA, 22 bp, Artificial Sequence
  chemically synthesized
ctgctttatccctgtcatctct

SEQ ID NO: 679717 - DNA, 22 bp, Artificial Sequence
  chemically synthesized
gtcttctgctttatccctgtca

SEQ ID NO: 679718 - DNA, 22 bp, Artificial Sequence
  chemically synthesized
ggtcttctgctttatccctgtc

SEQ ID NO: 679719 - DNA, 22 bp, Artificial Sequence
  chemically synthesized
ttggtcttctgctttatccctg

SEQ ID NO: 679720 - DNA, 22 bp, Artificial Sequence
  chemically synthesized
cttggtcttctgctttatccct

SEQ ID NO: 679721 - DNA, 22 bp, Artificial Sequence
  chemically synthesized
ttcttggtcttctgctttatcc

SEQ ID NO: 679722 - DNA, 22 bp, Artificial Sequence
  chemically synthesized
ggcaataaactcttcttggtct

SEQ ID NO: 679723 - DNA, 22 bp, Artificial Sequence
  chemically synthesized
gggcaataaactcttcttggtc

SEQ ID NO: 679724 - DNA, 22 bp, Artificial Sequence
  chemically synthesized
cttgggcaataaactcttcttg

SEQ ID NO: 679725 - DNA, 22 bp, Artificial Sequence
  chemically synthesized
ccttgggcaataaactcttctt

SEQ ID NO: 679726 - DNA, 22 bp, Artificial Sequence
  chemically synthesized
tccttgggcaataaactcttct

SEQ ID NO: 679727 - DNA, 22 bp, Artificial Sequence
  chemically synthesized
ttccttgggcaataaactcttc

SEQ ID NO: 679728 - DNA, 22 bp, Artificial Sequence
  chemically synthesized
catttttccttgggcaataaac

SEQ ID NO: 679729 - DNA, 22 bp, Artificial Sequence
  chemically synthesized
agtgaaatctacatttttcctt

SEQ ID NO: 679730 - DNA, 22 bp, Artificial Sequence
  chemically synthesized
aagtgaaatctacatttttcct

SEQ ID NO: 679731 - DNA, 22 bp, Artificial Sequence
  chemically synthesized
taagtgaaatctacatttttcc

SEQ ID NO: 679732 - DNA, 22 bp, Artificial Sequence
  chemically synthesized
attgcccaaggaaaaatgtaga

SEQ ID NO: 679733 - DNA, 22 bp, Artificial Sequence
  chemically synthesized
ttgcccaaggaaaaatgtagat

SEQ ID NO: 679734 - DNA, 22 bp, Artificial Sequence
  chemically synthesized
cccaaggaaaaatgtagatttc

SEQ ID NO: 679735 - DNA, 22 bp, Artificial Sequence
  chemically synthesized
agtggcgtctttaagtgaaatc

SEQ ID NO: 679736 - DNA, 22 bp, Artificial Sequence
  chemically synthesized
aagtggcgtctttaagtgaaat

SEQ ID NO: 679737 - DNA, 22 bp, Artificial Sequence
  chemically synthesized
taagtggcgtctttaagtgaaa

SEQ ID NO: 679738 - DNA, 22 bp, Artificial Sequence
  chemically synthesized
ttaagtggcgtctttaagtgaa

SEQ ID NO: 679739 - DNA, 22 bp, Artificial Sequence
  chemically synthesized
agtggtgaacttttaagtggcg

SEQ ID NO: 679740 - DNA, 22 bp, Artificial Sequence
  chemically synthesized
aagtggtgaacttttaagtggc

SEQ ID NO: 679741 - DNA, 22 bp, Artificial Sequence
  chemically synthesized
cacttaaagacgccacttaaaa

SEQ ID NO: 679742 - DNA, 22 bp, Artificial Sequence
  chemically synthesized
acttaaagacgccacttaaaag

SEQ ID NO: 679743 - DNA, 22 bp, Artificial Sequence
  chemically synthesized
aaagacgccacttaaaagttca

SEQ ID NO: 679744 - DNA, 22 bp, Artificial Sequence
  chemically synthesized
aagacgccacttaaaagttcac

SEQ ID NO: 679745 - DNA, 22 bp, Artificial Sequence
  chemically synthesized
aaaagttcaccacttaaatcgg

SEQ ID NO: 679746 - DNA, 22 bp, Artificial Sequence
  chemically synthesized
aaagttcaccacttaaatcgga

SEQ ID NO: 679747 - DNA, 22 bp, Artificial Sequence
  chemically synthesized
catcatgaaaaaaatccatccg

SEQ ID NO: 679748 - DNA, 22 bp, Artificial Sequence
  chemically synthesized
accacttaaatcggatggattt

SEQ ID NO: 679749 - DNA, 22 bp, Artificial Sequence
  chemically synthesized
acatcatgaaaaaaatccatcc

SEQ ID NO: 679750 - DNA, 22 bp, Artificial Sequence
  chemically synthesized
tacatcatgaaaaaaatccatc

SEQ ID NO: 679751 - DNA, 22 bp, Artificial Sequence
  chemically synthesized
ttacatcatgaaaaaaatccat

SEQ ID NO: 679752 - DNA, 22 bp, Artificial Sequence
  chemically synthesized
tttttacatcatgaaaaaaatc

SEQ ID NO: 679753 - DNA, 22 bp, Artificial Sequence
  chemically synthesized
aaatcggatggatttttttcat

SEQ ID NO: 679754 - DNA, 22 bp, Artificial Sequence
  chemically synthesized
aatcggatggatttttttcatg

SEQ ID NO: 679755 - DNA, 22 bp, Artificial Sequence
  chemically synthesized
taaactgtttttacatcatgaa

SEQ ID NO: 679756 - DNA, 22 bp, Artificial Sequence
  chemically synthesized
attataaactgtttttacatca

SEQ ID NO: 679757 - DNA, 22 bp, Artificial Sequence
  chemically synthesized
ttttcatgatgtaaaaacagtt

SEQ ID NO: 679758 - DNA, 22 bp, Artificial Sequence
  chemically synthesized
tttcatgatgtaaaaacagttt

SEQ ID NO: 679759 - DNA, 22 bp, Artificial Sequence
  chemically synthesized
ttcatgatgtaaaaacagttta

SEQ ID NO: 679760 - DNA, 22 bp, Artificial Sequence
  chemically synthesized
tcatgatgtaaaaacagtttat

SEQ ID NO: 679761 - DNA, 22 bp, Artificial Sequence
  chemically synthesized
catgatgtaaaaacagtttata

SEQ ID NO: 679762 - DNA, 22 bp, Artificial Sequence
  chemically synthesized
atgatgtaaaaacagtttataa

SEQ ID NO: 679763 - DNA, 22 bp, Artificial Sequence
  chemically synthesized
gagggaggcataatattaatta

SEQ ID NO: 679764 - DNA, 22 bp, Artificial Sequence
  chemically synthesized
ctcgagggaggcataatattaa

SEQ ID NO: 679765 - DNA, 22 bp, Artificial Sequence
  chemically synthesized
gttgctcgagggaggcataata

SEQ ID NO: 679766 - DNA, 22 bp, Artificial Sequence
  chemically synthesized
agttgctcgagggaggcataat

SEQ ID NO: 679767 - DNA, 22 bp, Artificial Sequence
  chemically synthesized
ataattaatattatgcctccct

SEQ ID NO: 679768 - DNA, 22 bp, Artificial Sequence
  chemically synthesized
taattaatattatgcctccctc

SEQ ID NO: 679769 - DNA, 22 bp, Artificial Sequence
  chemically synthesized
aaggggtttagttgctcgaggg

SEQ ID NO: 679770 - DNA, 22 bp, Artificial Sequence
  chemically synthesized
atattatgcctccctcgagcaa

SEQ ID NO: 679771 - DNA, 22 bp, Artificial Sequence
  chemically synthesized
aattgaaggggtttagttgctc

SEQ ID NO: 679772 - DNA, 22 bp, Artificial Sequence
  chemically synthesized
aaattgaaggggtttagttgct

SEQ ID NO: 679773 - DNA, 22 bp, Artificial Sequence
  chemically synthesized
tgcctccctcgagcaactaaac

SEQ ID NO: 679774 - DNA, 22 bp, Artificial Sequence
  chemically synthesized
taaattgaaggggtttagttgc

SEQ ID NO: 679775 - DNA, 22 bp, Artificial Sequence
  chemically synthesized
cctcgagcaactaaaccccttc

SEQ ID NO: 679776 - DNA, 22 bp, Artificial Sequence
  chemically synthesized
aagctttaaattgaaggggttt

SEQ ID NO: 679777 - DNA, 22 bp, Artificial Sequence
  chemically synthesized
gaagctttaaattgaaggggtt

SEQ ID NO: 679778 - DNA, 22 bp, Artificial Sequence
  chemically synthesized
gagcaactaaaccccttcaatt

SEQ ID NO: 679779 - DNA, 22 bp, Artificial Sequence
  chemically synthesized
agtttgaagctttaaattgaag

SEQ ID NO: 679780 - DNA, 22 bp, Artificial Sequence
  chemically synthesized
aagttaagtttgaagctttaaa

SEQ ID NO: 679781 - DNA, 22 bp, Artificial Sequence
  chemically synthesized
aaccccttcaatttaaagcttc

SEQ ID NO: 679782 - DNA, 22 bp, Artificial Sequence
  chemically synthesized
gaagttaagtttgaagctttaa

SEQ ID NO: 679783 - DNA, 22 bp, Artificial Sequence
  chemically synthesized
caatttaaagcttcaaacttaa

SEQ ID NO: 679784 - DNA, 22 bp, Artificial Sequence
  chemically synthesized
aatttaaagcttcaaacttaac

SEQ ID NO: 679785 - DNA, 22 bp, Artificial Sequence
  chemically synthesized
gtcaaatttgaagttaagtttg

SEQ ID NO: 679786 - DNA, 22 bp, Artificial Sequence
  chemically synthesized
aaagcttcaaacttaacttcaa

SEQ ID NO: 679787 - DNA, 22 bp, Artificial Sequence
  chemically synthesized
tattagtcaaatttgaagttaa

SEQ ID NO: 679788 - DNA, 22 bp, Artificial Sequence
  chemically synthesized
aagcttcaaacttaacttcaaa

SEQ ID NO: 679789 - DNA, 22 bp, Artificial Sequence
  chemically synthesized
atattagtcaaatttgaagtta

SEQ ID NO: 679790 - DNA, 22 bp, Artificial Sequence
  chemically synthesized
cttatattagtcaaatttgaag

SEQ ID NO: 679791 - DNA, 22 bp, Artificial Sequence
  chemically synthesized
gcttatattagtcaaatttgaa

SEQ ID NO: 679792 - DNA, 22 bp, Artificial Sequence
  chemically synthesized
tgcttatattagtcaaatttga

SEQ ID NO: 679793 - DNA, 22 bp, Artificial Sequence
  chemically synthesized
caaacttaacttcaaatttgac

SEQ ID NO: 679794 - DNA, 22 bp, Artificial Sequence
  chemically synthesized
aaacttaacttcaaatttgact

SEQ ID NO: 679795 - DNA, 22 bp, Artificial Sequence
  chemically synthesized
aacttcaaatttgactaatata

SEQ ID NO: 679796 - DNA, 22 bp, Artificial Sequence
  chemically synthesized
acttcaaatttgactaatataa

SEQ ID NO: 679797 - DNA, 22 bp, Artificial Sequence
  chemically synthesized
caaatttgactaatataagcaa

SEQ ID NO: 679798 - DNA, 22 bp, Artificial Sequence
  chemically synthesized
aaatttgactaatataagcaaa

SEQ ID NO: 679799 - DNA, 22 bp, Artificial Sequence
  chemically synthesized
gactaatataagcaaagtgttc

SEQ ID NO: 679800 - DNA, 22 bp, Artificial Sequence
  chemically synthesized
actaatataagcaaagtgttct

SEQ ID NO: 679801 - DNA, 22 bp, Artificial Sequence
  chemically synthesized
atataagcaaagtgttctgccc

SEQ ID NO: 679802 - DNA, 22 bp, Artificial Sequence
  chemically synthesized
ccaatcccagcacggcaataaa

SEQ ID NO: 679803 - DNA, 22 bp, Artificial Sequence
  chemically synthesized
tgccctttttattgccgtgctg

SEQ ID NO: 679804 - DNA, 22 bp, Artificial Sequence
  chemically synthesized
tcactcccaatcccagcacggc

SEQ ID NO: 679805 - DNA, 22 bp, Artificial Sequence
  chemically synthesized
ccctttttattgccgtgctggg

SEQ ID NO: 679806 - DNA, 22 bp, Artificial Sequence
  chemically synthesized
gtcactcccaatcccagcacgg

SEQ ID NO: 679807 - DNA, 22 bp, Artificial Sequence
  chemically synthesized
tttattgccgtgctgggattgg

SEQ ID NO: 679808 - DNA, 22 bp, Artificial Sequence
  chemically synthesized
ttattgccgtgctgggattggg

SEQ ID NO: 679809 - DNA, 22 bp, Artificial Sequence
  chemically synthesized
tattgccgtgctgggattggga

SEQ ID NO: 679810 - DNA, 22 bp, Artificial Sequence
  chemically synthesized
attgccgtgctgggattgggag

SEQ ID NO: 679811 - DNA, 22 bp, Artificial Sequence
  chemically synthesized
ttgccgtgctgggattgggagt

SEQ ID NO: 679812 - DNA, 22 bp, Artificial Sequence
  chemically synthesized
aagcaaagtttgtcactcccaa

SEQ ID NO: 679813 - DNA, 22 bp, Artificial Sequence
  chemically synthesized
ccgtgctgggattgggagtgac

SEQ ID NO: 679814 - DNA, 22 bp, Artificial Sequence
  chemically synthesized
caagcaaagtttgtcactccca

SEQ ID NO: 679815 - DNA, 22 bp, Artificial Sequence
  chemically synthesized
atcttcaagcaaagtttgtcac

SEQ ID NO: 679816 - DNA, 22 bp, Artificial Sequence
  chemically synthesized
ggattgggagtgacaaactttg

SEQ ID NO: 679817 - DNA, 22 bp, Artificial Sequence
  chemically synthesized
tgctcatcttcaagcaaagttt

SEQ ID NO: 679818 - DNA, 22 bp, Artificial Sequence
  chemically synthesized
ggagtgacaaactttgcttgaa

SEQ ID NO: 679819 - DNA, 22 bp, Artificial Sequence
  chemically synthesized
caggtgtctgtgctcatcttca

SEQ ID NO: 679820 - DNA, 22 bp, Artificial Sequence
  chemically synthesized
tccaggtgtctgtgctcatctt

SEQ ID NO: 679821 - DNA, 22 bp, Artificial Sequence
  chemically synthesized
ctccaggtgtctgtgctcatct

SEQ ID NO: 679822 - DNA, 22 bp, Artificial Sequence
  chemically synthesized
tgcttgaagatgagcacagaca

SEQ ID NO: 679823 - DNA, 22 bp, Artificial Sequence
  chemically synthesized
gcttgaagatgagcacagacac

SEQ ID NO: 679824 - DNA, 22 bp, Artificial Sequence
  chemically synthesized
gcatttctccaggtgtctgtgc

SEQ ID NO: 679825 - DNA, 22 bp, Artificial Sequence
  chemically synthesized
cttgaagatgagcacagacacc

SEQ ID NO: 679826 - DNA, 22 bp, Artificial Sequence
  chemically synthesized
tcgcatttctccaggtgtctgt

SEQ ID NO: 679827 - DNA, 22 bp, Artificial Sequence
  chemically synthesized
gaagatgagcacagacacctgg

SEQ ID NO: 679828 - DNA, 22 bp, Artificial Sequence
  chemically synthesized
tctcgcatttctccaggtgtct

SEQ ID NO: 679829 - DNA, 22 bp, Artificial Sequence
  chemically synthesized
aagatgagcacagacacctgga

SEQ ID NO: 679830 - DNA, 22 bp, Artificial Sequence
  chemically synthesized
gggtgttctctcgcatttctcc

SEQ ID NO: 679831 - DNA, 22 bp, Artificial Sequence
  chemically synthesized
tagggtgttctctcgcatttct

SEQ ID NO: 679832 - DNA, 22 bp, Artificial Sequence
  chemically synthesized
ctagggtgttctctcgcatttc

SEQ ID NO: 679833 - DNA, 22 bp, Artificial Sequence
  chemically synthesized
gagaaatgcgagagaacaccct

SEQ ID NO: 679834 - DNA, 22 bp, Artificial Sequence
  chemically synthesized
ggtgtggagtcatttctagggt

SEQ ID NO: 679835 - DNA, 22 bp, Artificial Sequence
  chemically synthesized
gggattgggtgtggagtcattt

SEQ ID NO: 679836 - DNA, 22 bp, Artificial Sequence
  chemically synthesized
cgggattgggtgtggagtcatt

SEQ ID NO: 679837 - DNA, 22 bp, Artificial Sequence
  chemically synthesized
cccttcgggattgggtgtggag

SEQ ID NO: 679838 - DNA, 22 bp, Artificial Sequence
  chemically synthesized
gcccttcgggattgggtgtgga

SEQ ID NO: 679839 - DNA, 22 bp, Artificial Sequence
  chemically synthesized
tgcccttcgggattgggtgtgg

SEQ ID NO: 679840 - DNA, 22 bp, Artificial Sequence
  chemically synthesized
ttgcccttcgggattgggtgtg

SEQ ID NO: 679841 - DNA, 22 bp, Artificial Sequence
  chemically synthesized
tttgcccttcgggattgggtgt

SEQ ID NO: 679842 - DNA, 22 bp, Artificial Sequence
  chemically synthesized
gaaatgactccacacccaatcc

SEQ ID NO: 679843 - DNA, 22 bp, Artificial Sequence
  chemically synthesized
ttttgcccttcgggattgggtg

SEQ ID NO: 679844 - DNA, 22 bp, Artificial Sequence
  chemically synthesized
tttttgcccttcgggattgggt

SEQ ID NO: 679845 - DNA, 22 bp, Artificial Sequence
  chemically synthesized
ttttttgcccttcgggattggg

SEQ ID NO: 679846 - DNA, 22 bp, Artificial Sequence
  chemically synthesized
tttttttgcccttcgggattgg

SEQ ID NO: 679847 - DNA, 22 bp, Artificial Sequence
  chemically synthesized
ttttttttgcccttcgggattg

SEQ ID NO: 679848 - DNA, 22 bp, Artificial Sequence
  chemically synthesized
tttttttttgcccttcgggatt

SEQ ID NO: 679849 - DNA, 22 bp, Artificial Sequence
  chemically synthesized
ttttttttttgcccttcgggat

SEQ ID NO: 679850 - DNA, 22 bp, Artificial Sequence
  chemically synthesized
tttttttttttgcccttcggga

SEQ ID NO: 679851 - DNA, 22 bp, Artificial Sequence
  chemically synthesized
ttttttttttttgcccttcggg

SEQ ID NO: 679852 - DNA, 22 bp, Artificial Sequence
  chemically synthesized
tttttttttttttgcccttcgg

SEQ ID NO: 679853 - DNA, 22 bp, Artificial Sequence
  chemically synthesized
cacacccaatcccgaagggcaa

SEQ ID NO: 679854 - DNA, 22 bp, Artificial Sequence
  chemically synthesized
ttttttttttttttgcccttcg

SEQ ID NO: 679855 - DNA, 22 bp, Artificial Sequence
  chemically synthesized
tttttttttttttttgcccttc

SEQ ID NO: 679856 - DNA, 22 bp, Artificial Sequence
  chemically synthesized
ttttttttttttttttgccctt

SEQ ID NO: 679857 - DNA, 22 bp, Artificial Sequence
  chemically synthesized
tttttttttttttttttgccct

SEQ ID NO: 679858 - DNA, 22 bp, Artificial Sequence
  chemically synthesized
ttttttttttttttttttgccc

SEQ ID NO: 679859 - DNA, 22 bp, Artificial Sequence
  chemically synthesized
tttttttttttttttttttgcc

SEQ ID NO: 679860 - DNA, 22 bp, Artificial Sequence
  chemically synthesized
ttttttttttttttttttttgc

SEQ ID NO: 679861 - DNA, 22 bp, Artificial Sequence
  chemically synthesized
tttttttttttttttttttttg

SEQ ID NO: 679862 - DNA, 22 bp, Artificial Sequence
  chemically synthesized
tttttttttttttttttttttt

SEQ ID NO: 679863 - DNA, 22 bp, Artificial Sequence
  chemically synthesized
ggcttttttttttttttttttt

SEQ ID NO: 679864 - DNA, 22 bp, Artificial Sequence
  chemically synthesized
gggctttttttttttttttttt

SEQ ID NO: 679865 - DNA, 22 bp, Artificial Sequence
  chemically synthesized
tttgggcttttttttttttttt

SEQ ID NO: 679866 - DNA, 22 bp, Artificial Sequence
  chemically synthesized
gtttgggctttttttttttttt

SEQ ID NO: 679867 - DNA, 22 bp, Artificial Sequence
  chemically synthesized
tttgtttgggcttttttttttt

SEQ ID NO: 679868 - DNA, 22 bp, Artificial Sequence
  chemically synthesized
gtttgtttgggctttttttttt

SEQ ID NO: 679869 - DNA, 22 bp, Artificial Sequence
  chemically synthesized
tgtttgtttgggcttttttttt

SEQ ID NO: 679870 - DNA, 22 bp, Artificial Sequence
  chemically synthesized
ttgtttgtttgggctttttttt

SEQ ID NO: 679871 - DNA, 22 bp, Artificial Sequence
  chemically synthesized
agggggtggggatttttgtttg

SEQ ID NO: 679872 - DNA, 22 bp, Artificial Sequence
  chemically synthesized
cagggggtggggatttttgttt

SEQ ID NO: 679873 - DNA, 22 bp, Artificial Sequence
  chemically synthesized
aagcccagaagtcaaagatttc

SEQ ID NO: 679874 - DNA, 22 bp, Artificial Sequence
  chemically synthesized
aaatctttgacttctgggcttt

SEQ ID NO: 679875 - DNA, 22 bp, Artificial Sequence
  chemically synthesized
tgacttctgggctttagttgtt

SEQ ID NO: 679876 - DNA, 22 bp, Artificial Sequence
  chemically synthesized
gacttctgggctttagttgttt

SEQ ID NO: 679877 - DNA, 22 bp, Artificial Sequence
  chemically synthesized
acttctgggctttagttgtttg

SEQ ID NO: 679878 - DNA, 22 bp, Artificial Sequence
  chemically synthesized
ctgggctttagttgtttgttct

SEQ ID NO: 679879 - DNA, 22 bp, Artificial Sequence
  chemically synthesized
tgggctttagttgtttgttctt

SEQ ID NO: 679880 - DNA, 22 bp, Artificial Sequence
  chemically synthesized
ggctttagttgtttgttctttc

SEQ ID NO: 679881 - DNA, 22 bp, Artificial Sequence
  chemically synthesized
cagaaatcaggaaagaaagaac

SEQ ID NO: 679882 - DNA, 22 bp, Artificial Sequence
  chemically synthesized
tagttgtttgttctttctttcc

SEQ ID NO: 679883 - DNA, 22 bp, Artificial Sequence
  chemically synthesized
agttgtttgttctttctttcct

SEQ ID NO: 679884 - DNA, 22 bp, Artificial Sequence
  chemically synthesized
gttgtttgttctttctttcctg

SEQ ID NO: 679885 - DNA, 22 bp, Artificial Sequence
  chemically synthesized
tttgttctttctttcctgattt

SEQ ID NO: 679886 - DNA, 22 bp, Artificial Sequence
  chemically synthesized
gttctttctttcctgatttctg

SEQ ID NO: 679887 - DNA, 22 bp, Artificial Sequence
  chemically synthesized
ttctttctttcctgatttctgc

SEQ ID NO: 679888 - DNA, 22 bp, Artificial Sequence
  chemically synthesized
tttctttcctgatttctgcagg

SEQ ID NO: 679889 - DNA, 22 bp, Artificial Sequence
  chemically synthesized
catgccccaagacctgcagaaa

SEQ ID NO: 679890 - DNA, 22 bp, Artificial Sequence
  chemically synthesized
tctttcctgatttctgcaggtc

SEQ ID NO: 679891 - DNA, 22 bp, Artificial Sequence
  chemically synthesized
ctttcctgatttctgcaggtct

SEQ ID NO: 679892 - DNA, 22 bp, Artificial Sequence
  chemically synthesized
tttcctgatttctgcaggtctt

SEQ ID NO: 679893 - DNA, 22 bp, Artificial Sequence
  chemically synthesized
attccatgccccaagacctgca

SEQ ID NO: 679894 - DNA, 22 bp, Artificial Sequence
  chemically synthesized
tcctgatttctgcaggtcttgg

SEQ ID NO: 679895 - DNA, 22 bp, Artificial Sequence
  chemically synthesized
cctgatttctgcaggtcttggg

SEQ ID NO: 679896 - DNA, 22 bp, Artificial Sequence
  chemically synthesized
ctgatttctgcaggtcttgggg

SEQ ID NO: 679897 - DNA, 22 bp, Artificial Sequence
  chemically synthesized
atttctgcaggtcttggggcat

SEQ ID NO: 679898 - DNA, 22 bp, Artificial Sequence
  chemically synthesized
ccgtgctcattccatgccccaa

SEQ ID NO: 679899 - DNA, 22 bp, Artificial Sequence
  chemically synthesized
taccgtgctcattccatgcccc

SEQ ID NO: 679900 - DNA, 22 bp, Artificial Sequence
  chemically synthesized
ctgcaggtcttggggcatggaa

SEQ ID NO: 679901 - DNA, 22 bp, Artificial Sequence
  chemically synthesized
ctaccgtgctcattccatgccc

SEQ ID NO: 679902 - DNA, 22 bp, Artificial Sequence
  chemically synthesized
tgcaggtcttggggcatggaat

SEQ ID NO: 679903 - DNA, 22 bp, Artificial Sequence
  chemically synthesized
tctaccgtgctcattccatgcc

SEQ ID NO: 679904 - DNA, 22 bp, Artificial Sequence
  chemically synthesized
caggtcttggggcatggaatga

SEQ ID NO: 679905 - DNA, 22 bp, Artificial Sequence
  chemically synthesized
cattttctaccgtgctcattcc

SEQ ID NO: 679906 - DNA, 22 bp, Artificial Sequence
  chemically synthesized
gctgcattttctaccgtgctca

SEQ ID NO: 679907 - DNA, 22 bp, Artificial Sequence
  chemically synthesized
ggggcatggaatgagcacggta

SEQ ID NO: 679908 - DNA, 22 bp, Artificial Sequence
  chemically synthesized
gggcatggaatgagcacggtag

SEQ ID NO: 679909 - DNA, 22 bp, Artificial Sequence
  chemically synthesized
cctcgctgcattttctaccgtg

SEQ ID NO: 679910 - DNA, 22 bp, Artificial Sequence
  chemically synthesized
ccctcgctgcattttctaccgt

SEQ ID NO: 679911 - DNA, 22 bp, Artificial Sequence
  chemically synthesized
acatttccctcgctgcattttc

SEQ ID NO: 679912 - DNA, 22 bp, Artificial Sequence
  chemically synthesized
caactgacatttccctcgctgc

SEQ ID NO: 679913 - DNA, 22 bp, Artificial Sequence
  chemically synthesized
cgaggattccaactgacatttc

SEQ ID NO: 679914 - DNA, 22 bp, Artificial Sequence
  chemically synthesized
ccgaggattccaactgacattt

SEQ ID NO: 679915 - DNA, 22 bp, Artificial Sequence
  chemically synthesized
ttccgaggattccaactgacat

SEQ ID NO: 679916 - DNA, 22 bp, Artificial Sequence
  chemically synthesized
cttccgaggattccaactgaca

SEQ ID NO: 679917 - DNA, 22 bp, Artificial Sequence
  chemically synthesized
atttcttccgaggattccaact

SEQ ID NO: 679918 - DNA, 22 bp, Artificial Sequence
  chemically synthesized
cctgatttcttccgaggattcc

SEQ ID NO: 679919 - DNA, 22 bp, Artificial Sequence
  chemically synthesized
tgcctgatttcttccgaggatt

SEQ ID NO: 679920 - DNA, 22 bp, Artificial Sequence
  chemically synthesized
ctgcctgatttcttccgaggat

SEQ ID NO: 679921 - DNA, 22 bp, Artificial Sequence
  chemically synthesized
tctgcctgatttcttccgagga

SEQ ID NO: 679922 - DNA, 22 bp, Artificial Sequence
  chemically synthesized
gaatcctcggaagaaatcaggc

SEQ ID NO: 679923 - DNA, 22 bp, Artificial Sequence
  chemically synthesized
ggaagaaatcaggcagaaagtt

SEQ ID NO: 679924 - DNA, 22 bp, Artificial Sequence
  chemically synthesized
caagtgccaaaaggtcaacttt

SEQ ID NO: 679925 - DNA, 22 bp, Artificial Sequence
  chemically synthesized
cactgcaagtgccaaaaggtca

SEQ ID NO: 679926 - DNA, 22 bp, Artificial Sequence
  chemically synthesized
cattgcactgcaagtgccaaaa

SEQ ID NO: 679927 - DNA, 22 bp, Artificial Sequence
  chemically synthesized
ccattgcactgcaagtgccaaa

SEQ ID NO: 679928 - DNA, 22 bp, Artificial Sequence
  chemically synthesized
ccttccattgcactgcaagtgc

SEQ ID NO: 679929 - DNA, 22 bp, Artificial Sequence
  chemically synthesized
accttttggcacttgcagtgca

SEQ ID NO: 679930 - DNA, 22 bp, Artificial Sequence
  chemically synthesized
ttggcacttgcagtgcaatgga

SEQ ID NO: 679931 - DNA, 22 bp, Artificial Sequence
  chemically synthesized
tggcacttgcagtgcaatggaa

SEQ ID NO: 679932 - DNA, 22 bp, Artificial Sequence
  chemically synthesized
ggcacttgcagtgcaatggaag

SEQ ID NO: 679933 - DNA, 22 bp, Artificial Sequence
  chemically synthesized
gcacttgcagtgcaatggaagg

SEQ ID NO: 679934 - DNA, 22 bp, Artificial Sequence
  chemically synthesized
gcagtgcaatggaaggtagcgc

SEQ ID NO: 679935 - DNA, 22 bp, Artificial Sequence
  chemically synthesized
cagtgcaatggaaggtagcgcc

SEQ ID NO: 679936 - DNA, 22 bp, Artificial Sequence
  chemically synthesized
gtagaaggaaggggcgcacgcg

SEQ ID NO: 679937 - DNA, 22 bp, Artificial Sequence
  chemically synthesized
ctcgtagaaggaaggggcgcac

SEQ ID NO: 679938 - DNA, 22 bp, Artificial Sequence
  chemically synthesized
actcgtagaaggaaggggcgca

SEQ ID NO: 679939 - DNA, 22 bp, Artificial Sequence
  chemically synthesized
ttactcgtagaaggaaggggcg

SEQ ID NO: 679940 - DNA, 22 bp, Artificial Sequence
  chemically synthesized
aatcgtcgctcttactcgtaga

SEQ ID NO: 679941 - DNA, 22 bp, Artificial Sequence
  chemically synthesized
ctaaatcgtcgctcttactcgt

SEQ ID NO: 679942 - DNA, 22 bp, Artificial Sequence
  chemically synthesized
ttcctaaatcgtcgctcttact

SEQ ID NO: 679943 - DNA, 22 bp, Artificial Sequence
  chemically synthesized
ccttctacgagtaagagcgacg

SEQ ID NO: 679944 - DNA, 22 bp, Artificial Sequence
  chemically synthesized
cttctacgagtaagagcgacga

SEQ ID NO: 679945 - DNA, 22 bp, Artificial Sequence
  chemically synthesized
gctgttcctaaatcgtcgctct

SEQ ID NO: 679946 - DNA, 22 bp, Artificial Sequence
  chemically synthesized
ctacgagtaagagcgacgattt

SEQ ID NO: 679947 - DNA, 22 bp, Artificial Sequence
  chemically synthesized
tacgagtaagagcgacgattta

SEQ ID NO: 679948 - DNA, 22 bp, Artificial Sequence
  chemically synthesized
cgagtaagagcgacgatttagg

SEQ ID NO: 679949 - DNA, 22 bp, Artificial Sequence
  chemically synthesized
ccagtgtggacgtgagcaaggc

SEQ ID NO: 679950 - DNA, 22 bp, Artificial Sequence
  chemically synthesized
aggaacagccagccttgctcac

SEQ ID NO: 679951 - DNA, 22 bp, Artificial Sequence
  chemically synthesized
ggaacagccagccttgctcacg

SEQ ID NO: 679952 - DNA, 22 bp, Artificial Sequence
  chemically synthesized
caggctgccagtgtggacgtga

SEQ ID NO: 679953 - DNA, 22 bp, Artificial Sequence
  chemically synthesized
ccaggctgccagtgtggacgtg

SEQ ID NO: 679954 - DNA, 22 bp, Artificial Sequence
  chemically synthesized
tccaggctgccagtgtggacgt

SEQ ID NO: 679955 - DNA, 22 bp, Artificial Sequence
  chemically synthesized
ctttccaggctgccagtgtgga

SEQ ID NO: 679956 - DNA, 22 bp, Artificial Sequence
  chemically synthesized
actcctttccaggctgccagtg

SEQ ID NO: 679957 - DNA, 22 bp, Artificial Sequence
  chemically synthesized
gctcacgtccacactggcagcc

SEQ ID NO: 679958 - DNA, 22 bp, Artificial Sequence
  chemically synthesized
cactcctttccaggctgccagt

SEQ ID NO: 679959 - DNA, 22 bp, Artificial Sequence
  chemically synthesized
ctcacgtccacactggcagcct

SEQ ID NO: 679960 - DNA, 22 bp, Artificial Sequence
  chemically synthesized
tcactcctttccaggctgccag

SEQ ID NO: 679961 - DNA, 22 bp, Artificial Sequence
  chemically synthesized
ttcactcctttccaggctgcca

SEQ ID NO: 679962 - DNA, 22 bp, Artificial Sequence
  chemically synthesized
acgtccacactggcagcctgga

SEQ ID NO: 679963 - DNA, 22 bp, Artificial Sequence
  chemically synthesized
gcagcctggaaaggagtgaaaa

SEQ ID NO: 679964 - DNA, 22 bp, Artificial Sequence
  chemically synthesized
gggccgggggagcttttcactc

SEQ ID NO: 679965 - DNA, 22 bp, Artificial Sequence
  chemically synthesized
gaaaggagtgaaaagctccccc

SEQ ID NO: 679966 - DNA, 22 bp, Artificial Sequence
  chemically synthesized
acgcggggattggggccggggg

SEQ ID NO: 679967 - DNA, 22 bp, Artificial Sequence
  chemically synthesized
ctcacgcggggattggggccgg

SEQ ID NO: 679968 - DNA, 22 bp, Artificial Sequence
  chemically synthesized
ccccggccccaatccccgcgtg

SEQ ID NO: 679969 - DNA, 22 bp, Artificial Sequence
  chemically synthesized
cccgtccccagaggggataacg

SEQ ID NO: 679970 - DNA, 22 bp, Artificial Sequence
  chemically synthesized
tccccgtccccagaggggataa

SEQ ID NO: 679971 - DNA, 22 bp, Artificial Sequence
  chemically synthesized
ctccccgtccccagaggggata

SEQ ID NO: 679972 - DNA, 22 bp, Artificial Sequence
  chemically synthesized
atttctccccgtccccagaggg

SEQ ID NO: 679973 - DNA, 22 bp, Artificial Sequence
  chemically synthesized
tcccctctggggacggggagaa

SEQ ID NO: 679974 - DNA, 22 bp, Artificial Sequence
  chemically synthesized
ggagagaaaaagctgatttctc

SEQ ID NO: 679975 - DNA, 22 bp, Artificial Sequence
  chemically synthesized
tggggacggggagaaatcagct

SEQ ID NO: 679976 - DNA, 22 bp, Artificial Sequence
  chemically synthesized
gggacggggagaaatcagcttt

SEQ ID NO: 679977 - DNA, 22 bp, Artificial Sequence
  chemically synthesized
ggacgggctcggagagaaaaag

SEQ ID NO: 679978 - DNA, 22 bp, Artificial Sequence
  chemically synthesized
gggacgggctcggagagaaaaa

SEQ ID NO: 679979 - DNA, 22 bp, Artificial Sequence
  chemically synthesized
tgggacgggctcggagagaaaa

SEQ ID NO: 679980 - DNA, 22 bp, Artificial Sequence
  chemically synthesized
ggctttgggacgggctcggaga

SEQ ID NO: 679981 - DNA, 22 bp, Artificial Sequence
  chemically synthesized
cctcggctttgggacgggctcg

SEQ ID NO: 679982 - DNA, 22 bp, Artificial Sequence
  chemically synthesized
ccctcggctttgggacgggctc

SEQ ID NO: 679983 - DNA, 22 bp, Artificial Sequence
  chemically synthesized
ttccctcggctttgggacgggc

SEQ ID NO: 679984 - DNA, 22 bp, Artificial Sequence
  chemically synthesized
tttctctccgagcccgtcccaa

SEQ ID NO: 679985 - DNA, 22 bp, Artificial Sequence
  chemically synthesized
ttctctccgagcccgtcccaaa

SEQ ID NO: 679986 - DNA, 22 bp, Artificial Sequence
  chemically synthesized
tctctccgagcccgtcccaaag

SEQ ID NO: 679987 - DNA, 22 bp, Artificial Sequence
  chemically synthesized
ctctccgagcccgtcccaaagc

SEQ ID NO: 679988 - DNA, 22 bp, Artificial Sequence
  chemically synthesized
tctccgagcccgtcccaaagcc

SEQ ID NO: 679989 - DNA, 22 bp, Artificial Sequence
  chemically synthesized
tccgagcccgtcccaaagccga

SEQ ID NO: 679990 - DNA, 22 bp, Artificial Sequence
  chemically synthesized
cgagcccgtcccaaagccgagg

SEQ ID NO: 679991 - DNA, 22 bp, Artificial Sequence
  chemically synthesized
gtgggggaacctcttccctcgg

SEQ ID NO: 679992 - DNA, 22 bp, Artificial Sequence
  chemically synthesized
cccaggcgccgggctagtgggg

SEQ ID NO: 679993 - DNA, 22 bp, Artificial Sequence
  chemically synthesized
tccccaggcgccgggctagtgg

SEQ ID NO: 679994 - DNA, 22 bp, Artificial Sequence
  chemically synthesized
ctccccaggcgccgggctagtg

SEQ ID NO: 679995 - DNA, 22 bp, Artificial Sequence
  chemically synthesized
ccccactagcccggcgcctggg

SEQ ID NO: 679996 - DNA, 22 bp, Artificial Sequence
  chemically synthesized
gcccggcgcctggggagaaacc

SEQ ID NO: 679997 - DNA, 22 bp, Artificial Sequence
  chemically synthesized
caggtgcgcccccggggtttct

SEQ ID NO: 679998 - DNA, 22 bp, Artificial Sequence
  chemically synthesized
gggagaaaccccgggggcgcac

SEQ ID NO: 679999 - DNA, 22 bp, Artificial Sequence
  chemically synthesized
ccgcggcgcggctgcaggtgcg

SEQ ID NO: 680000 - DNA, 22 bp, Artificial Sequence
  chemically synthesized
ccgcgggttcccgcggcgcggc

SEQ ID NO: 680001 - DNA, 22 bp, Artificial Sequence
  chemically synthesized
tcccgcgggttcccgcggcgcg

SEQ ID NO: 680002 - DNA, 22 bp, Artificial Sequence
  chemically synthesized
cagccgcgccgcgggaacccgc

SEQ ID NO: 680003 - DNA, 22 bp, Artificial Sequence
  chemically synthesized
ggaacctctcccgcgggttccc

SEQ ID NO: 680004 - DNA, 22 bp, Artificial Sequence
  chemically synthesized
ggcgtctaggaacctctcccgc

SEQ ID NO: 680005 - DNA, 22 bp, Artificial Sequence
  chemically synthesized
gacccggggcgccgggcggctg

SEQ ID NO: 680006 - DNA, 22 bp, Artificial Sequence
  chemically synthesized
ctagacgcccagccgcccggcg

SEQ ID NO: 680007 - DNA, 22 bp, Artificial Sequence
  chemically synthesized
gacgcccagccgcccggcgccc

SEQ ID NO: 680008 - DNA, 22 bp, Artificial Sequence
  chemically synthesized
gacaggcgcggcggctggaccc

SEQ ID NO: 680009 - DNA, 22 bp, Artificial Sequence
  chemically synthesized
ggacaggcgcggcggctggacc

SEQ ID NO: 680010 - DNA, 22 bp, Artificial Sequence
  chemically synthesized
aggcggtcaaaacttggacagg

SEQ ID NO: 680011 - DNA, 22 bp, Artificial Sequence
  chemically synthesized
tccaagttttgaccgcctcagc

SEQ ID NO: 680012 - DNA, 22 bp, Artificial Sequence
  chemically synthesized
tggcgcgagcagggggcaagct

SEQ ID NO: 680013 - DNA, 22 bp, Artificial Sequence
  chemically synthesized
gtggcgcgagcagggggcaagc

SEQ ID NO: 680014 - DNA, 22 bp, Artificial Sequence
  chemically synthesized
tgaccgcctcagcttgccccct

SEQ ID NO: 680015 - DNA, 22 bp, Artificial Sequence
  chemically synthesized
gaccgcctcagcttgccccctg

SEQ ID NO: 680016 - DNA, 22 bp, Artificial Sequence
  chemically synthesized
accgcctcagcttgccccctgc

SEQ ID NO: 680017 - DNA, 22 bp, Artificial Sequence
  chemically synthesized
agcttgccccctgctcgcgcca

SEQ ID NO: 680018 - DNA, 22 bp, Artificial Sequence
  chemically synthesized
gccccctgctcgcgccacaagt

SEQ ID NO: 680019 - DNA, 22 bp, Artificial Sequence
  chemically synthesized
ccccctgctcgcgccacaagtg

SEQ ID NO: 680020 - DNA, 22 bp, Artificial Sequence
  chemically synthesized
atggccgcaatccgtgcacttg

SEQ ID NO: 680021 - DNA, 22 bp, Artificial Sequence
  chemically synthesized
ctcgcgccacaagtgcacggat

SEQ ID NO: 680022 - DNA, 22 bp, Artificial Sequence
  chemically synthesized
gcgccacaagtgcacggattgc

SEQ ID NO: 680023 - DNA, 22 bp, Artificial Sequence
  chemically synthesized
cggccatcagacggggccgggg

SEQ ID NO: 680024 - DNA, 22 bp, Artificial Sequence
  chemically synthesized
aaagggtaagtggatcgcggcc

SEQ ID NO: 680025 - DNA, 22 bp, Artificial Sequence
  chemically synthesized
cagccatgagggaacagctcaa

SEQ ID NO: 680026 - DNA, 22 bp, Artificial Sequence
  chemically synthesized
gcagccatgagggaacagctca

SEQ ID NO: 680027 - DNA, 22 bp, Artificial Sequence
  chemically synthesized
accctttgagctgttccctcat

SEQ ID NO: 680028 - DNA, 22 bp, Artificial Sequence
  chemically synthesized
ccctttgagctgttccctcatg

SEQ ID NO: 680029 - DNA, 22 bp, Artificial Sequence
  chemically synthesized
tgagctgttccctcatggctgc

SEQ ID NO: 680030 - DNA, 22 bp, Artificial Sequence
  chemically synthesized
gagctgttccctcatggctgca

SEQ ID NO: 680031 - DNA, 22 bp, Artificial Sequence
  chemically synthesized
agctgttccctcatggctgcaa

SEQ ID NO: 680032 - DNA, 22 bp, Artificial Sequence
  chemically synthesized
gaccgcggagcccttgcagcca

SEQ ID NO: 680033 - DNA, 22 bp, Artificial Sequence
  chemically synthesized
ttccctcatggctgcaagggct

SEQ ID NO: 680034 - DNA, 22 bp, Artificial Sequence
  chemically synthesized
cctcatggctgcaagggctccg

SEQ ID NO: 680035 - DNA, 22 bp, Artificial Sequence
  chemically synthesized
atggctgcaagggctccgcggt

SEQ ID NO: 680036 - DNA, 22 bp, Artificial Sequence
  chemically synthesized
gtacccacactcgaccgcggag

SEQ ID NO: 680037 - DNA, 22 bp, Artificial Sequence
  chemically synthesized
cactcgtacccacactcgaccg

SEQ ID NO: 680038 - DNA, 22 bp, Artificial Sequence
  chemically synthesized
caagggctccgcggtcgagtgt

SEQ ID NO: 680039 - DNA, 22 bp, Artificial Sequence
  chemically synthesized
ctccactcgtacccacactcga

SEQ ID NO: 680040 - DNA, 22 bp, Artificial Sequence
  chemically synthesized
actcctccactcgtacccacac

SEQ ID NO: 680041 - DNA, 22 bp, Artificial Sequence
  chemically synthesized
cgcggtcgagtgtgggtacgag

SEQ ID NO: 680042 - DNA, 22 bp, Artificial Sequence
  chemically synthesized
ggaagctcactcctccactcgt

SEQ ID NO: 680043 - DNA, 22 bp, Artificial Sequence
  chemically synthesized
tgggaagctcactcctccactc

SEQ ID NO: 680044 - DNA, 22 bp, Artificial Sequence
  chemically synthesized
ggggagcccggcggctctggga

SEQ ID NO: 680045 - DNA, 22 bp, Artificial Sequence
  chemically synthesized
cggggagcccggcggctctggg

SEQ ID NO: 680046 - DNA, 22 bp, Artificial Sequence
  chemically synthesized
tcggggagcccggcggctctgg

SEQ ID NO: 680047 - DNA, 22 bp, Artificial Sequence
  chemically synthesized
cactttcggggagcccggcggc

SEQ ID NO: 680048 - DNA, 22 bp, Artificial Sequence
  chemically synthesized
cccagagccgccgggctccccg

SEQ ID NO: 680049 - DNA, 22 bp, Artificial Sequence
  chemically synthesized
ccagagccgccgggctccccga

SEQ ID NO: 680050 - DNA, 22 bp, Artificial Sequence
  chemically synthesized
ggcggcggcggcggcggcgctc

SEQ ID NO: 680051 - DNA, 22 bp, Artificial Sequence
  chemically synthesized
gggcggcggcggcggcggcgct

SEQ ID NO: 680052 - DNA, 22 bp, Artificial Sequence
  chemically synthesized
cccgaaagtggagcgccgccgc

SEQ ID NO: 680053 - DNA, 22 bp, Artificial Sequence
  chemically synthesized
tgagcttgggcggcggcggcgg

SEQ ID NO: 680054 - DNA, 22 bp, Artificial Sequence
  chemically synthesized
agctgtgagcttgggcggcggc

SEQ ID NO: 680055 - DNA, 22 bp, Artificial Sequence
  chemically synthesized
cagctgtgagcttgggcggcgg

SEQ ID NO: 680056 - DNA, 22 bp, Artificial Sequence
  chemically synthesized
tcagctgtgagcttgggcggcg

SEQ ID NO: 680057 - DNA, 22 bp, Artificial Sequence
  chemically synthesized
cgcagtgctttcagctgtgagc

SEQ ID NO: 680058 - DNA, 22 bp, Artificial Sequence
  chemically synthesized
ctccgcagtgctttcagctgtg

SEQ ID NO: 680059 - DNA, 22 bp, Artificial Sequence
  chemically synthesized
acagctgaaagcactgcggagg

SEQ ID NO: 680060 - DNA, 22 bp, Artificial Sequence
  chemically synthesized
aaagcactgcggaggagccggc

SEQ ID NO: 680061 - DNA, 22 bp, Artificial Sequence
  chemically synthesized
cccggcccgcccgcgccggctc

SEQ ID NO: 680062 - DNA, 22 bp, Artificial Sequence
  chemically synthesized
cggaggagccggcgcgggcggg

SEQ ID NO: 680063 - DNA, 22 bp, Artificial Sequence
  chemically synthesized
cccgcagcgccccctccccggc

SEQ ID NO: 680064 - DNA, 22 bp, Artificial Sequence
  chemically synthesized
cgggcagacggggcggggccgt

SEQ ID NO: 680065 - DNA, 22 bp, Artificial Sequence
  chemically synthesized
ggtgggggcggagcccgacacg

SEQ ID NO: 680066 - DNA, 22 bp, Artificial Sequence
  chemically synthesized
ccaggtccctaggtgggggcgg

SEQ ID NO: 680067 - DNA, 22 bp, Artificial Sequence
  chemically synthesized
cgcccccacctagggacctggg

SEQ ID NO: 680068 - DNA, 22 bp, Artificial Sequence
  chemically synthesized
ggtgtccgggttcccaggtccc

SEQ ID NO: 680069 - DNA, 22 bp, Artificial Sequence
  chemically synthesized
tgggtgtccgggttcccaggtc

SEQ ID NO: 680070 - DNA, 22 bp, Artificial Sequence
  chemically synthesized
cccagtctctgggtgtccgggt

SEQ ID NO: 680071 - DNA, 22 bp, Artificial Sequence
  chemically synthesized
gggacctgggaacccggacacc

SEQ ID NO: 680072 - DNA, 22 bp, Artificial Sequence
  chemically synthesized
ggaacccggacacccagagact

SEQ ID NO: 680073 - DNA, 22 bp, Artificial Sequence
  chemically synthesized
aaagccccaactgcccagtctc

SEQ ID NO: 680074 - DNA, 22 bp, Artificial Sequence
  chemically synthesized
gaaagccccaactgcccagtct

SEQ ID NO: 680075 - DNA, 22 bp, Artificial Sequence
  chemically synthesized
tgaaagccccaactgcccagtc

SEQ ID NO: 680076 - DNA, 22 bp, Artificial Sequence
  chemically synthesized
cgttttgaaagccccaactgcc

SEQ ID NO: 680077 - DNA, 22 bp, Artificial Sequence
  chemically synthesized
ccgttttgaaagccccaactgc

SEQ ID NO: 680078 - DNA, 22 bp, Artificial Sequence
  chemically synthesized
tccgttttgaaagccccaactg

SEQ ID NO: 680079 - DNA, 22 bp, Artificial Sequence
  chemically synthesized
ctttccgttttgaaagccccaa

SEQ ID NO: 680080 - DNA, 22 bp, Artificial Sequence
  chemically synthesized
cctttccgttttgaaagcccca

SEQ ID NO: 680081 - DNA, 22 bp, Artificial Sequence
  chemically synthesized
tcctttccgttttgaaagcccc

SEQ ID NO: 680082 - DNA, 22 bp, Artificial Sequence
  chemically synthesized
ttcctttccgttttgaaagccc

SEQ ID NO: 680083 - DNA, 22 bp, Artificial Sequence
  chemically synthesized
tttcctttccgttttgaaagcc

SEQ ID NO: 680084 - DNA, 22 bp, Artificial Sequence
  chemically synthesized
tttttcctttccgttttgaaag

SEQ ID NO: 680085 - DNA, 22 bp, Artificial Sequence
  chemically synthesized
ggcagttggggctttcaaaacg

SEQ ID NO: 680086 - DNA, 22 bp, Artificial Sequence
  chemically synthesized
ctttttcctttccgttttgaaa

SEQ ID NO: 680087 - DNA, 22 bp, Artificial Sequence
  chemically synthesized
tctttttcctttccgttttgaa

SEQ ID NO: 680088 - DNA, 22 bp, Artificial Sequence
  chemically synthesized
ttctttttcctttccgttttga

SEQ ID NO: 680089 - DNA, 22 bp, Artificial Sequence
  chemically synthesized
ttttctttttcctttccgtttt

SEQ ID NO: 680090 - DNA, 22 bp, Artificial Sequence
  chemically synthesized
tcttttctttttcctttccgtt

SEQ ID NO: 680091 - DNA, 22 bp, Artificial Sequence
  chemically synthesized
ctcttttctttttcctttccgt

SEQ ID NO: 680092 - DNA, 22 bp, Artificial Sequence
  chemically synthesized
gggctttcaaaacggaaaggaa

SEQ ID NO: 680093 - DNA, 22 bp, Artificial Sequence
  chemically synthesized
tctcttttctttttcctttccg

SEQ ID NO: 680094 - DNA, 22 bp, Artificial Sequence
  chemically synthesized
tttctcttttctttttcctttc

SEQ ID NO: 680095 - DNA, 22 bp, Artificial Sequence
  chemically synthesized
ctttctcttttctttttccttt

SEQ ID NO: 680096 - DNA, 22 bp, Artificial Sequence
  chemically synthesized
tctttctcttttctttttcctt

SEQ ID NO: 680097 - DNA, 22 bp, Artificial Sequence
  chemically synthesized
tcaaaacggaaaggaaaaagaa

SEQ ID NO: 680098 - DNA, 22 bp, Artificial Sequence
  chemically synthesized
tttctttctcttttctttttcc

SEQ ID NO: 680099 - DNA, 22 bp, Artificial Sequence
  chemically synthesized
caaaacggaaaggaaaaagaaa

SEQ ID NO: 680100 - DNA, 22 bp, Artificial Sequence
  chemically synthesized
ctttctttctcttttctttttc

SEQ ID NO: 680101 - DNA, 22 bp, Artificial Sequence
  chemically synthesized
aaaacggaaaggaaaaagaaaa

SEQ ID NO: 680102 - DNA, 22 bp, Artificial Sequence
  chemically synthesized
tctttctttctcttttcttttt

SEQ ID NO: 680103 - DNA, 22 bp, Artificial Sequence
  chemically synthesized
tttctttctttctcttttcttt

SEQ ID NO: 680104 - DNA, 22 bp, Artificial Sequence
  chemically synthesized
ctttctttctttctcttttctt

SEQ ID NO: 680105 - DNA, 22 bp, Artificial Sequence
  chemically synthesized
tctttctttctttctcttttct

SEQ ID NO: 680106 - DNA, 22 bp, Artificial Sequence
  chemically synthesized
tttctttctttctttctctttt

SEQ ID NO: 680107 - DNA, 22 bp, Artificial Sequence
  chemically synthesized
ctttctttctttctttctcttt

SEQ ID NO: 680108 - DNA, 22 bp, Artificial Sequence
  chemically synthesized
tctttctttctttctttctctt

SEQ ID NO: 680109 - DNA, 22 bp, Artificial Sequence
  chemically synthesized
tttctttctttctttctttctc

SEQ ID NO: 680110 - DNA, 22 bp, Artificial Sequence
  chemically synthesized
ctttctttctttctttctttct

SEQ ID NO: 680111 - DNA, 22 bp, Artificial Sequence
  chemically synthesized
tctttctttctttctttctttc

SEQ ID NO: 680112 - DNA, 22 bp, Artificial Sequence
  chemically synthesized
tttctttctttctttctttctt

SEQ ID NO: 680113 - DNA, 22 bp, Artificial Sequence
  chemically synthesized
ctttctttctttctttctttct

SEQ ID NO: 680114 - DNA, 22 bp, Artificial Sequence
  chemically synthesized
tctttctttctttctttctttc

SEQ ID NO: 680115 - DNA, 22 bp, Artificial Sequence
  chemically synthesized
tttctttctttctttctttctt

SEQ ID NO: 680116 - DNA, 22 bp, Artificial Sequence
  chemically synthesized
aatccccatcctctttctttct

SEQ ID NO: 680117 - DNA, 22 bp, Artificial Sequence
  chemically synthesized
aaatccccatcctctttctttc

SEQ ID NO: 680118 - DNA, 22 bp, Artificial Sequence
  chemically synthesized
ccttaaatccccatcctctttc

SEQ ID NO: 680119 - DNA, 22 bp, Artificial Sequence
  chemically synthesized
ggtctaccttaaatccccatcc

SEQ ID NO: 680120 - DNA, 22 bp, Artificial Sequence
  chemically synthesized
ctgggtctaccttaaatcccca

SEQ ID NO: 680121 - DNA, 22 bp, Artificial Sequence
  chemically synthesized
caggttcctgggtctaccttaa

SEQ ID NO: 680122 - DNA, 22 bp, Artificial Sequence
  chemically synthesized
ccaggttcctgggtctacctta

SEQ ID NO: 680123 - DNA, 22 bp, Artificial Sequence
  chemically synthesized
aaggtagacccaggaacctgga

SEQ ID NO: 680124 - DNA, 22 bp, Artificial Sequence
  chemically synthesized
aggtagacccaggaacctggaa

SEQ ID NO: 680125 - DNA, 22 bp, Artificial Sequence
  chemically synthesized
gcagagcggtgtgtggcttcca

SEQ ID NO: 680126 - DNA, 22 bp, Artificial Sequence
  chemically synthesized
aggaggtgttagcagagcggtg

SEQ ID NO: 680127 - DNA, 22 bp, Artificial Sequence
  chemically synthesized
aaggaggtgttagcagagcggt

SEQ ID NO: 680128 - DNA, 22 bp, Artificial Sequence
  chemically synthesized
taaggaggtgttagcagagcgg

SEQ ID NO: 680129 - DNA, 22 bp, Artificial Sequence
  chemically synthesized
gaagccacacaccgctctgcta

SEQ ID NO: 680130 - DNA, 22 bp, Artificial Sequence
  chemically synthesized
gaggctttaaggaggtgttagc

SEQ ID NO: 680131 - DNA, 22 bp, Artificial Sequence
  chemically synthesized
ctagaggctttaaggaggtgtt

SEQ ID NO: 680132 - DNA, 22 bp, Artificial Sequence
  chemically synthesized
gctagaggctttaaggaggtgt

SEQ ID NO: 680133 - DNA, 22 bp, Artificial Sequence
  chemically synthesized
tgctaacacctccttaaagcct

SEQ ID NO: 680134 - DNA, 22 bp, Artificial Sequence
  chemically synthesized
ctaacacctccttaaagcctct

SEQ ID NO: 680135 - DNA, 22 bp, Artificial Sequence
  chemically synthesized
acacctccttaaagcctctagc

SEQ ID NO: 680136 - DNA, 22 bp, Artificial Sequence
  chemically synthesized
gacaacaagtagtcttgctaga

SEQ ID NO: 680137 - DNA, 22 bp, Artificial Sequence
  chemically synthesized
agacaacaagtagtcttgctag

SEQ ID NO: 680138 - DNA, 22 bp, Artificial Sequence
  chemically synthesized
cttaaagcctctagcaagacta

SEQ ID NO: 680139 - DNA, 22 bp, Artificial Sequence
  chemically synthesized
tttagacaacaagtagtcttgc

SEQ ID NO: 680140 - DNA, 22 bp, Artificial Sequence
  chemically synthesized
atttagacaacaagtagtcttg

SEQ ID NO: 680141 - DNA, 22 bp, Artificial Sequence
  chemically synthesized
aaagcctctagcaagactactt

SEQ ID NO: 680142 - DNA, 22 bp, Artificial Sequence
  chemically synthesized
aagcctctagcaagactacttg

SEQ ID NO: 680143 - DNA, 22 bp, Artificial Sequence
  chemically synthesized
ggtcatttatttagacaacaag

SEQ ID NO: 680144 - DNA, 22 bp, Artificial Sequence
  chemically synthesized
tagcaagactacttgttgtcta

SEQ ID NO: 680145 - DNA, 22 bp, Artificial Sequence
  chemically synthesized
gcaagactacttgttgtctaaa

SEQ ID NO: 680146 - DNA, 22 bp, Artificial Sequence
  chemically synthesized
cacctgggtcatttatttagac

SEQ ID NO: 680147 - DNA, 22 bp, Artificial Sequence
  chemically synthesized
gcacctgggtcatttatttaga

SEQ ID NO: 680148 - DNA, 22 bp, Artificial Sequence
  chemically synthesized
cttgttgtctaaataaatgacc

SEQ ID NO: 680149 - DNA, 22 bp, Artificial Sequence
  chemically synthesized
gttgtctaaataaatgacccag

SEQ ID NO: 680150 - DNA, 22 bp, Artificial Sequence
  chemically synthesized
ttgtctaaataaatgacccagg

SEQ ID NO: 680151 - DNA, 22 bp, Artificial Sequence
  chemically synthesized
tctaaataaatgacccaggtgc

SEQ ID NO: 680152 - DNA, 22 bp, Artificial Sequence
  chemically synthesized
ggatgaggtcatttgcacctgg

SEQ ID NO: 680153 - DNA, 22 bp, Artificial Sequence
  chemically synthesized
aataaatgacccaggtgcaaat

SEQ ID NO: 680154 - DNA, 22 bp, Artificial Sequence
  chemically synthesized
tctgggatgaggtcatttgcac

SEQ ID NO: 680155 - DNA, 22 bp, Artificial Sequence
  chemically synthesized
attatctgggatgaggtcattt

SEQ ID NO: 680156 - DNA, 22 bp, Artificial Sequence
  chemically synthesized
aattatctgggatgaggtcatt

SEQ ID NO: 680157 - DNA, 22 bp, Artificial Sequence
  chemically synthesized
ttaattatctgggatgaggtca

SEQ ID NO: 680158 - DNA, 22 bp, Artificial Sequence
  chemically synthesized
caagcccacactcttaattatc

SEQ ID NO: 680159 - DNA, 22 bp, Artificial Sequence
  chemically synthesized
atcccagataattaagagtgtg

SEQ ID NO: 680160 - DNA, 22 bp, Artificial Sequence
  chemically synthesized
aaaagaaaactccaagcccaca

SEQ ID NO: 680161 - DNA, 22 bp, Artificial Sequence
  chemically synthesized
aaaaagaaaactccaagcccac

SEQ ID NO: 680162 - DNA, 22 bp, Artificial Sequence
  chemically synthesized
taaaaagaaaactccaagccca

SEQ ID NO: 680163 - DNA, 22 bp, Artificial Sequence
  chemically synthesized
ttaaaaagaaaactccaagccc

SEQ ID NO: 680164 - DNA, 22 bp, Artificial Sequence
  chemically synthesized
tttaaaaagaaaactccaagcc

SEQ ID NO: 680165 - DNA, 22 bp, Artificial Sequence
  chemically synthesized
ttttttaaaaagaaaactccaa

SEQ ID NO: 680166 - DNA, 22 bp, Artificial Sequence
  chemically synthesized
agagtgtgggcttggagttttc

SEQ ID NO: 680167 - DNA, 22 bp, Artificial Sequence
  chemically synthesized
attttttaaaaagaaaactcca

SEQ ID NO: 680168 - DNA, 22 bp, Artificial Sequence
  chemically synthesized
tattttttaaaaagaaaactcc

SEQ ID NO: 680169 - DNA, 22 bp, Artificial Sequence
  chemically synthesized
ttattttttaaaaagaaaactc

SEQ ID NO: 680170 - DNA, 22 bp, Artificial Sequence
  chemically synthesized
ttttattttttaaaaagaaaac

SEQ ID NO: 680171 - DNA, 22 bp, Artificial Sequence
  chemically synthesized
cttttattttttaaaaagaaaa

SEQ ID NO: 680172 - DNA, 22 bp, Artificial Sequence
  chemically synthesized
tcttttattttttaaaaagaaa

SEQ ID NO: 680173 - DNA, 22 bp, Artificial Sequence
  chemically synthesized
ttcttttattttttaaaaagaa

SEQ ID NO: 680174 - DNA, 22 bp, Artificial Sequence
  chemically synthesized
tttcttttattttttaaaaaga

SEQ ID NO: 680175 - DNA, 22 bp, Artificial Sequence
  chemically synthesized
ttttcttttattttttaaaaag

SEQ ID NO: 680176 - DNA, 22 bp, Artificial Sequence
  chemically synthesized
ggagttttctttttaaaaaata

SEQ ID NO: 680177 - DNA, 22 bp, Artificial Sequence
  chemically synthesized
gagttttctttttaaaaaataa

SEQ ID NO: 680178 - DNA, 22 bp, Artificial Sequence
  chemically synthesized
tctttttaaaaaataaaagaaa

SEQ ID NO: 680179 - DNA, 22 bp, Artificial Sequence
  chemically synthesized
ctttttaaaaaataaaagaaaa

SEQ ID NO: 680180 - DNA, 22 bp, Artificial Sequence
  chemically synthesized
tgtatataatttttttctttta

SEQ ID NO: 680181 - DNA, 22 bp, Artificial Sequence
  chemically synthesized
tttttaaaaaataaaagaaaaa

SEQ ID NO: 680182 - DNA, 22 bp, Artificial Sequence
  chemically synthesized
tttaaaaaataaaagaaaaaaa

SEQ ID NO: 680183 - DNA, 22 bp, Artificial Sequence
  chemically synthesized
ttaaaaaataaaagaaaaaaat

SEQ ID NO: 680184 - DNA, 22 bp, Artificial Sequence
  chemically synthesized
taaaaaataaaagaaaaaaatt

SEQ ID NO: 680185 - DNA, 22 bp, Artificial Sequence
  chemically synthesized
aaaaaataaaagaaaaaaatta

SEQ ID NO: 680186 - DNA, 22 bp, Artificial Sequence
  chemically synthesized
aaaaataaaagaaaaaaattat

SEQ ID NO: 680187 - DNA, 22 bp, Artificial Sequence
  chemically synthesized
aggaggaagggagagtgagaat

SEQ ID NO: 680188 - DNA, 22 bp, Artificial Sequence
  chemically synthesized
tatacataattctcactctccc

SEQ ID NO: 680189 - DNA, 22 bp, Artificial Sequence
  chemically synthesized
aactgaggaggaagggagagtg

SEQ ID NO: 680190 - DNA, 22 bp, Artificial Sequence
  chemically synthesized
caactgaggaggaagggagagt

SEQ ID NO: 680191 - DNA, 22 bp, Artificial Sequence
  chemically synthesized
atcttcaactgaggaggaaggg

SEQ ID NO: 680192 - DNA, 22 bp, Artificial Sequence
  chemically synthesized
aatcttcaactgaggaggaagg

SEQ ID NO: 680193 - DNA, 22 bp, Artificial Sequence
  chemically synthesized
taatcttcaactgaggaggaag

SEQ ID NO: 680194 - DNA, 22 bp, Artificial Sequence
  chemically synthesized
tcactctcccttcctcctcagt

SEQ ID NO: 680195 - DNA, 22 bp, Artificial Sequence
  chemically synthesized
actctcccttcctcctcagttg

SEQ ID NO: 680196 - DNA, 22 bp, Artificial Sequence
  chemically synthesized
tcccttcctcctcagttgaaga

SEQ ID NO: 680197 - DNA, 22 bp, Artificial Sequence
  chemically synthesized
ccttcctcctcagttgaagatt

SEQ ID NO: 680198 - DNA, 22 bp, Artificial Sequence
  chemically synthesized
tcgccggccactttaatcttca

SEQ ID NO: 680199 - DNA, 22 bp, Artificial Sequence
  chemically synthesized
atcgccggccactttaatcttc

SEQ ID NO: 680200 - DNA, 22 bp, Artificial Sequence
  chemically synthesized
cctcctcagttgaagattaaag

SEQ ID NO: 680201 - DNA, 22 bp, Artificial Sequence
  chemically synthesized
ctcctcagttgaagattaaagt

SEQ ID NO: 680202 - DNA, 22 bp, Artificial Sequence
  chemically synthesized
ctcagttgaagattaaagtggc

SEQ ID NO: 680203 - DNA, 22 bp, Artificial Sequence
  chemically synthesized
agttgaagattaaagtggccgg

SEQ ID NO: 680204 - DNA, 22 bp, Artificial Sequence
  chemically synthesized
acgtccttatcgccggccactt

SEQ ID NO: 680205 - DNA, 22 bp, Artificial Sequence
  chemically synthesized
cacgtccttatcgccggccact

SEQ ID NO: 680206 - DNA, 22 bp, Artificial Sequence
  chemically synthesized
aagattaaagtggccggcgata

SEQ ID NO: 680207 - DNA, 22 bp, Artificial Sequence
  chemically synthesized
acggcaatttcacgtccttatc

SEQ ID NO: 680208 - DNA, 22 bp, Artificial Sequence
  chemically synthesized
aagtggccggcgataaggacgt

SEQ ID NO: 680209 - DNA, 22 bp, Artificial Sequence
  chemically synthesized
gcccaggatgagcctaacggca

SEQ ID NO: 680210 - DNA, 22 bp, Artificial Sequence
  chemically synthesized
agcccaggatgagcctaacggc

SEQ ID NO: 680211 - DNA, 22 bp, Artificial Sequence
  chemically synthesized
tagcccaggatgagcctaacgg

SEQ ID NO: 680212 - DNA, 22 bp, Artificial Sequence
  chemically synthesized
ttagcccaggatgagcctaacg

SEQ ID NO: 680213 - DNA, 22 bp, Artificial Sequence
  chemically synthesized
acaatcccttttagcccaggat

SEQ ID NO: 680214 - DNA, 22 bp, Artificial Sequence
  chemically synthesized
ccgttaggctcatcctgggcta

SEQ ID NO: 680215 - DNA, 22 bp, Artificial Sequence
  chemically synthesized
aacaatcccttttagcccagga

SEQ ID NO: 680216 - DNA, 22 bp, Artificial Sequence
  chemically synthesized
taacaatcccttttagcccagg

SEQ ID NO: 680217 - DNA, 22 bp, Artificial Sequence
  chemically synthesized
ttaacaatcccttttagcccag

SEQ ID NO: 680218 - DNA, 22 bp, Artificial Sequence
  chemically synthesized
tttaacaatcccttttagccca

SEQ ID NO: 680219 - DNA, 22 bp, Artificial Sequence
  chemically synthesized
ggctcatcctgggctaaaaggg

SEQ ID NO: 680220 - DNA, 22 bp, Artificial Sequence
  chemically synthesized
atcctgggctaaaagggattgt

SEQ ID NO: 680221 - DNA, 22 bp, Artificial Sequence
  chemically synthesized
ggctaaaagggattgttaaaaa

SEQ ID NO: 680222 - DNA, 22 bp, Artificial Sequence
  chemically synthesized
aaagggattgttaaaaagactt

SEQ ID NO: 680223 - DNA, 22 bp, Artificial Sequence
  chemically synthesized
tgtcacaaatccaaatccaaag

SEQ ID NO: 680224 - DNA, 22 bp, Artificial Sequence
  chemically synthesized
ttaaaaagactttggatttgga

SEQ ID NO: 680225 - DNA, 22 bp, Artificial Sequence
  chemically synthesized
ctatgtcacaaatccaaatcca

SEQ ID NO: 680226 - DNA, 22 bp, Artificial Sequence
  chemically synthesized
aaaagactttggatttggattt

SEQ ID NO: 680227 - DNA, 22 bp, Artificial Sequence
  chemically synthesized
agatccgctgctatgtcacaaa

SEQ ID NO: 680228 - DNA, 22 bp, Artificial Sequence
  chemically synthesized
gagatccgctgctatgtcacaa

SEQ ID NO: 680229 - DNA, 22 bp, Artificial Sequence
  chemically synthesized
tggatttggatttgtgacatag

SEQ ID NO: 680230 - DNA, 22 bp, Artificial Sequence
  chemically synthesized
tgagatccgctgctatgtcaca

SEQ ID NO: 680231 - DNA, 22 bp, Artificial Sequence
  chemically synthesized
ggatttggatttgtgacatagc

SEQ ID NO: 680232 - DNA, 22 bp, Artificial Sequence
  chemically synthesized
gatttggatttgtgacatagca

SEQ ID NO: 680233 - DNA, 22 bp, Artificial Sequence
  chemically synthesized
cattttgagatccgctgctatg

SEQ ID NO: 680234 - DNA, 22 bp, Artificial Sequence
  chemically synthesized
ggatttgtgacatagcagcgga

SEQ ID NO: 680235 - DNA, 22 bp, Artificial Sequence
  chemically synthesized
gatttgtgacatagcagcggat

SEQ ID NO: 680236 - DNA, 22 bp, Artificial Sequence
  chemically synthesized
gtgacatagcagcggatctcaa

SEQ ID NO: 680237 - DNA, 22 bp, Artificial Sequence
  chemically synthesized
tgacatagcagcggatctcaaa

SEQ ID NO: 680238 - DNA, 22 bp, Artificial Sequence
  chemically synthesized
ccagggtctacattttgagatc

SEQ ID NO: 680239 - DNA, 22 bp, Artificial Sequence
  chemically synthesized
ttcccagggtctacattttgag

SEQ ID NO: 680240 - DNA, 22 bp, Artificial Sequence
  chemically synthesized
ctgttcccagggtctacatttt

SEQ ID NO: 680241 - DNA, 22 bp, Artificial Sequence
  chemically synthesized
ataactgctgttcccagggtct

SEQ ID NO: 680242 - DNA, 22 bp, Artificial Sequence
  chemically synthesized
aaaatgtagaccctgggaacag

SEQ ID NO: 680243 - DNA, 22 bp, Artificial Sequence
  chemically synthesized
gcaggtgatactgataactgct

SEQ ID NO: 680244 - DNA, 22 bp, Artificial Sequence
  chemically synthesized
ggaacagcagttatcagtatca

SEQ ID NO: 680245 - DNA, 22 bp, Artificial Sequence
  chemically synthesized
agaagttcgcaggtgatactga

SEQ ID NO: 680246 - DNA, 22 bp, Artificial Sequence
  chemically synthesized
taagaagttcgcaggtgatact

SEQ ID NO: 680247 - DNA, 22 bp, Artificial Sequence
  chemically synthesized
ctaagaagttcgcaggtgatac

SEQ ID NO: 680248 - DNA, 22 bp, Artificial Sequence
  chemically synthesized
atttctaagaagttcgcaggtg

SEQ ID NO: 680249 - DNA, 22 bp, Artificial Sequence
  chemically synthesized
catttctaagaagttcgcaggt

SEQ ID NO: 680250 - DNA, 22 bp, Artificial Sequence
  chemically synthesized
tcatttctaagaagttcgcagg

SEQ ID NO: 680251 - DNA, 22 bp, Artificial Sequence
  chemically synthesized
tcagtatcacctgcgaacttct

SEQ ID NO: 680252 - DNA, 22 bp, Artificial Sequence
  chemically synthesized
cgaacttcttagaaatgaaaat

SEQ ID NO: 680253 - DNA, 22 bp, Artificial Sequence
  chemically synthesized
ggccgggcccagggaattttca

SEQ ID NO: 680254 - DNA, 22 bp, Artificial Sequence
  chemically synthesized
cttagaaatgaaaattccctgg

SEQ ID NO: 680255 - DNA, 22 bp, Artificial Sequence
  chemically synthesized
ttagaaatgaaaattccctggg

SEQ ID NO: 680256 - DNA, 22 bp, Artificial Sequence
  chemically synthesized
agaaatgaaaattccctgggcc

SEQ ID NO: 680257 - DNA, 22 bp, Artificial Sequence
  chemically synthesized
gaaatgaaaattccctgggccc

SEQ ID NO: 680258 - DNA, 22 bp, Artificial Sequence
  chemically synthesized
aataggtctgggccgggcccag

SEQ ID NO: 680259 - DNA, 22 bp, Artificial Sequence
  chemically synthesized
gttcaataggtctgggccgggc

SEQ ID NO: 680260 - DNA, 22 bp, Artificial Sequence
  chemically synthesized
tggttcaataggtctgggccgg

SEQ ID NO: 680261 - DNA, 22 bp, Artificial Sequence
  chemically synthesized
ctggttcaataggtctgggccg

SEQ ID NO: 680262 - DNA, 22 bp, Artificial Sequence
  chemically synthesized
cctgggcccggcccagacctat

SEQ ID NO: 680263 - DNA, 22 bp, Artificial Sequence
  chemically synthesized
agagtttctggttcaataggtc

SEQ ID NO: 680264 - DNA, 22 bp, Artificial Sequence
  chemically synthesized
ggcccggcccagacctattgaa

SEQ ID NO: 680265 - DNA, 22 bp, Artificial Sequence
  chemically synthesized
gtatgctcagagtttctggttc

SEQ ID NO: 680266 - DNA, 22 bp, Artificial Sequence
  chemically synthesized
aaacattagtatgctcagagtt

SEQ ID NO: 680267 - DNA, 22 bp, Artificial Sequence
  chemically synthesized
ttgaaccagaaactctgagcat

SEQ ID NO: 680268 - DNA, 22 bp, Artificial Sequence
  chemically synthesized
tcaaacattagtatgctcagag

SEQ ID NO: 680269 - DNA, 22 bp, Artificial Sequence
  chemically synthesized
aaccagaaactctgagcatact

SEQ ID NO: 680270 - DNA, 22 bp, Artificial Sequence
  chemically synthesized
tgagcatactaatgtttgagaa

SEQ ID NO: 680271 - DNA, 22 bp, Artificial Sequence
  chemically synthesized
agcatactaatgtttgagaatc

SEQ ID NO: 680272 - DNA, 22 bp, Artificial Sequence
  chemically synthesized
gagagtccataccagtgattct

SEQ ID NO: 680273 - DNA, 22 bp, Artificial Sequence
  chemically synthesized
agagagtccataccagtgattc

SEQ ID NO: 680274 - DNA, 22 bp, Artificial Sequence
  chemically synthesized
atgtttgagaatcactggtatg

SEQ ID NO: 680275 - DNA, 22 bp, Artificial Sequence
  chemically synthesized
atttagagagtccataccagtg

SEQ ID NO: 680276 - DNA, 22 bp, Artificial Sequence
  chemically synthesized
aatttagagagtccataccagt

SEQ ID NO: 680277 - DNA, 22 bp, Artificial Sequence
  chemically synthesized
tcttaatttagagagtccatac

SEQ ID NO: 680278 - DNA, 22 bp, Artificial Sequence
  chemically synthesized
gagaatcactggtatggactct

SEQ ID NO: 680279 - DNA, 22 bp, Artificial Sequence
  chemically synthesized
agaatcactggtatggactctc

SEQ ID NO: 680280 - DNA, 22 bp, Artificial Sequence
  chemically synthesized
gtggtattgtcttaatttagag

SEQ ID NO: 680281 - DNA, 22 bp, Artificial Sequence
  chemically synthesized
gtatggactctctaaattaaga

SEQ ID NO: 680282 - DNA, 22 bp, Artificial Sequence
  chemically synthesized
tctaaattaagacaataccacc

SEQ ID NO: 680283 - DNA, 22 bp, Artificial Sequence
  chemically synthesized
taaattaagacaataccaccag

SEQ ID NO: 680284 - DNA, 22 bp, Artificial Sequence
  chemically synthesized
aattaagacaataccaccagtg

SEQ ID NO: 680285 - DNA, 22 bp, Artificial Sequence
  chemically synthesized
agacaataccaccagtgctgtt

SEQ ID NO: 680286 - DNA, 22 bp, Artificial Sequence
  chemically synthesized
aaggaccaaaccgtgcaacagc

SEQ ID NO: 680287 - DNA, 22 bp, Artificial Sequence
  chemically synthesized
aaagaatactaaaggaccaaac

SEQ ID NO: 680288 - DNA, 22 bp, Artificial Sequence
  chemically synthesized
ctaaaagaatactaaaggacca

SEQ ID NO: 680289 - DNA, 22 bp, Artificial Sequence
  chemically synthesized
cctaaaagaatactaaaggacc

SEQ ID NO: 680290 - DNA, 22 bp, Artificial Sequence
  chemically synthesized
ttgcacggtttggtcctttagt

SEQ ID NO: 680291 - DNA, 22 bp, Artificial Sequence
  chemically synthesized
cacggtttggtcctttagtatt

SEQ ID NO: 680292 - DNA, 22 bp, Artificial Sequence
  chemically synthesized
gatcttcctaaaagaatactaa

SEQ ID NO: 680293 - DNA, 22 bp, Artificial Sequence
  chemically synthesized
tagatcttcctaaaagaatact

SEQ ID NO: 680294 - DNA, 22 bp, Artificial Sequence
  chemically synthesized
ctagatcttcctaaaagaatac

SEQ ID NO: 680295 - DNA, 22 bp, Artificial Sequence
  chemically synthesized
ggtcctttagtattcttttagg

SEQ ID NO: 680296 - DNA, 22 bp, Artificial Sequence
  chemically synthesized
cttctagatcttcctaaaagaa

SEQ ID NO: 680297 - DNA, 22 bp, Artificial Sequence
  chemically synthesized
gtcctttagtattcttttagga

SEQ ID NO: 680298 - DNA, 22 bp, Artificial Sequence
  chemically synthesized
tagtattcttttaggaagatct

SEQ ID NO: 680299 - DNA, 22 bp, Artificial Sequence
  chemically synthesized
agtattcttttaggaagatcta

SEQ ID NO: 680300 - DNA, 22 bp, Artificial Sequence
  chemically synthesized
gtattcttttaggaagatctag

SEQ ID NO: 680301 - DNA, 22 bp, Artificial Sequence
  chemically synthesized
gaaacaagttccttctagatct

SEQ ID NO: 680302 - DNA, 22 bp, Artificial Sequence
  chemically synthesized
ttagaaacaagttccttctaga

SEQ ID NO: 680303 - DNA, 22 bp, Artificial Sequence
  chemically synthesized
ttttaggaagatctagaaggaa

SEQ ID NO: 680304 - DNA, 22 bp, Artificial Sequence
  chemically synthesized
tattagaaacaagttccttcta

SEQ ID NO: 680305 - DNA, 22 bp, Artificial Sequence
  chemically synthesized
ttaggaagatctagaaggaact

SEQ ID NO: 680306 - DNA, 22 bp, Artificial Sequence
  chemically synthesized
taggaagatctagaaggaactt

SEQ ID NO: 680307 - DNA, 22 bp, Artificial Sequence
  chemically synthesized
aggaagatctagaaggaacttg

SEQ ID NO: 680308 - DNA, 22 bp, Artificial Sequence
  chemically synthesized
ggaagatctagaaggaacttgt

SEQ ID NO: 680309 - DNA, 22 bp, Artificial Sequence
  chemically synthesized
caataaaatattctattagaaa

SEQ ID NO: 680310 - DNA, 22 bp, Artificial Sequence
  chemically synthesized
gaaggaacttgtttctaataga

SEQ ID NO: 680311 - DNA, 22 bp, Artificial Sequence
  chemically synthesized
ccaataaaatattctattagaa

SEQ ID NO: 680312 - DNA, 22 bp, Artificial Sequence
  chemically synthesized
tccaataaaatattctattaga

SEQ ID NO: 680313 - DNA, 22 bp, Artificial Sequence
  chemically synthesized
ttccaataaaatattctattag

SEQ ID NO: 680314 - DNA, 22 bp, Artificial Sequence
  chemically synthesized
taacttttccaataaaatattc

SEQ ID NO: 680315 - DNA, 22 bp, Artificial Sequence
  chemically synthesized
gtttctaatagaatattttatt

SEQ ID NO: 680316 - DNA, 22 bp, Artificial Sequence
  chemically synthesized
tttctaatagaatattttattg

SEQ ID NO: 680317 - DNA, 22 bp, Artificial Sequence
  chemically synthesized
ctaatagaatattttattggaa

SEQ ID NO: 680318 - DNA, 22 bp, Artificial Sequence
  chemically synthesized
taatagaatattttattggaaa

SEQ ID NO: 680319 - DNA, 22 bp, Artificial Sequence
  chemically synthesized
aggccctgtaacttttccaata

SEQ ID NO: 680320 - DNA, 22 bp, Artificial Sequence
  chemically synthesized
atagaatattttattggaaaag

SEQ ID NO: 680321 - DNA, 22 bp, Artificial Sequence
  chemically synthesized
ttcaggccctgtaacttttcca

SEQ ID NO: 680322 - DNA, 22 bp, Artificial Sequence
  chemically synthesized
aactgttcaggccctgtaactt

SEQ ID NO: 680323 - DNA, 22 bp, Artificial Sequence
  chemically synthesized
gaactgttcaggccctgtaact

SEQ ID NO: 680324 - DNA, 22 bp, Artificial Sequence
  chemically synthesized
tattggaaaagttacagggcct

SEQ ID NO: 680325 - DNA, 22 bp, Artificial Sequence
  chemically synthesized
tttgaactgttcaggccctgta

SEQ ID NO: 680326 - DNA, 22 bp, Artificial Sequence
  chemically synthesized
attggaaaagttacagggcctg

SEQ ID NO: 680327 - DNA, 22 bp, Artificial Sequence
  chemically synthesized
ttggaaaagttacagggcctga

SEQ ID NO: 680328 - DNA, 22 bp, Artificial Sequence
  chemically synthesized
gaaaagttacagggcctgaaca

SEQ ID NO: 680329 - DNA, 22 bp, Artificial Sequence
  chemically synthesized
gaattatttgaactgttcaggc

SEQ ID NO: 680330 - DNA, 22 bp, Artificial Sequence
  chemically synthesized
aaattagaattatttgaactgt

SEQ ID NO: 680331 - DNA, 22 bp, Artificial Sequence
  chemically synthesized
cagggcctgaacagttcaaata

SEQ ID NO: 680332 - DNA, 22 bp, Artificial Sequence
  chemically synthesized
taaaattagaattatttgaact

SEQ ID NO: 680333 - DNA, 22 bp, Artificial Sequence
  chemically synthesized
caaactctaaaattagaattat

SEQ ID NO: 680334 - DNA, 22 bp, Artificial Sequence
  chemically synthesized
aacagttcaaataattctaatt

SEQ ID NO: 680335 - DNA, 22 bp, Artificial Sequence
  chemically synthesized
aaataattctaattttagagtt

SEQ ID NO: 680336 - DNA, 22 bp, Artificial Sequence
  chemically synthesized
tcatcatactgcaaactctaaa

SEQ ID NO: 680337 - DNA, 22 bp, Artificial Sequence
  chemically synthesized
tatcatcatactgcaaactcta

SEQ ID NO: 680338 - DNA, 22 bp, Artificial Sequence
  chemically synthesized
ctatcatcatactgcaaactct

SEQ ID NO: 680339 - DNA, 22 bp, Artificial Sequence
  chemically synthesized
acttctatcatcatactgcaaa

SEQ ID NO: 680340 - DNA, 22 bp, Artificial Sequence
  chemically synthesized
taattttagagtttgcagtatg

SEQ ID NO: 680341 - DNA, 22 bp, Artificial Sequence
  chemically synthesized
attttagagtttgcagtatgat

SEQ ID NO: 680342 - DNA, 22 bp, Artificial Sequence
  chemically synthesized
tagagtttgcagtatgatgata

SEQ ID NO: 680343 - DNA, 22 bp, Artificial Sequence
  chemically synthesized
agagtttgcagtatgatgatag

SEQ ID NO: 680344 - DNA, 22 bp, Artificial Sequence
  chemically synthesized
gagtttgcagtatgatgataga

SEQ ID NO: 680345 - DNA, 22 bp, Artificial Sequence
  chemically synthesized
tgtgtagttaacttctatcatc

SEQ ID NO: 680346 - DNA, 22 bp, Artificial Sequence
  chemically synthesized
gcagtatgatgatagaagttaa

SEQ ID NO: 680347 - DNA, 22 bp, Artificial Sequence
  chemically synthesized
cagtatgatgatagaagttaac

SEQ ID NO: 680348 - DNA, 22 bp, Artificial Sequence
  chemically synthesized
aaataattgtgtgtagttaact

SEQ ID NO: 680349 - DNA, 22 bp, Artificial Sequence
  chemically synthesized
gaaataattgtgtgtagttaac

SEQ ID NO: 680350 - DNA, 22 bp, Artificial Sequence
  chemically synthesized
caagcttgaaataattgtgtgt

SEQ ID NO: 680351 - DNA, 22 bp, Artificial Sequence
  chemically synthesized
ccaagcttgaaataattgtgtg

SEQ ID NO: 680352 - DNA, 22 bp, Artificial Sequence
  chemically synthesized
agtatttccaagcttgaaataa

SEQ ID NO: 680353 - DNA, 22 bp, Artificial Sequence
  chemically synthesized
actacacacaattatttcaagc

SEQ ID NO: 680354 - DNA, 22 bp, Artificial Sequence
  chemically synthesized
gagtatttccaagcttgaaata

SEQ ID NO: 680355 - DNA, 22 bp, Artificial Sequence
  chemically synthesized
tgagtatttccaagcttgaaat

SEQ ID NO: 680356 - DNA, 22 bp, Artificial Sequence
  chemically synthesized
ttgagtatttccaagcttgaaa

SEQ ID NO: 680357 - DNA, 22 bp, Artificial Sequence
  chemically synthesized
cacacaattatttcaagcttgg

SEQ ID NO: 680358 - DNA, 22 bp, Artificial Sequence
  chemically synthesized
ttttgagtatttccaagcttga

SEQ ID NO: 680359 - DNA, 22 bp, Artificial Sequence
  chemically synthesized
cttttgagtatttccaagcttg

SEQ ID NO: 680360 - DNA, 22 bp, Artificial Sequence
  chemically synthesized
ttcttttgagtatttccaagct

SEQ ID NO: 680361 - DNA, 22 bp, Artificial Sequence
  chemically synthesized
cttcttttgagtatttccaagc

SEQ ID NO: 680362 - DNA, 22 bp, Artificial Sequence
  chemically synthesized
ttcttcttttgagtatttccaa

SEQ ID NO: 680363 - DNA, 22 bp, Artificial Sequence
  chemically synthesized
cttcttcttttgagtatttcca

SEQ ID NO: 680364 - DNA, 22 bp, Artificial Sequence
  chemically synthesized
tcttcttcttttgagtatttcc

SEQ ID NO: 680365 - DNA, 22 bp, Artificial Sequence
  chemically synthesized
tttcaagcttggaaatactcaa

SEQ ID NO: 680366 - DNA, 22 bp, Artificial Sequence
  chemically synthesized
caagcttggaaatactcaaaag

SEQ ID NO: 680367 - DNA, 22 bp, Artificial Sequence
  chemically synthesized
aagcttggaaatactcaaaaga

SEQ ID NO: 680368 - DNA, 22 bp, Artificial Sequence
  chemically synthesized
atgaaggctttcttcttctttt

SEQ ID NO: 680369 - DNA, 22 bp, Artificial Sequence
  chemically synthesized
ggaaatactcaaaagaagaaga

SEQ ID NO: 680370 - DNA, 22 bp, Artificial Sequence
  chemically synthesized
gaaatactcaaaagaagaagaa

SEQ ID NO: 680371 - DNA, 22 bp, Artificial Sequence
  chemically synthesized
tgctaatgaaggctttcttctt

SEQ ID NO: 680372 - DNA, 22 bp, Artificial Sequence
  chemically synthesized
gtgctaatgaaggctttcttct

SEQ ID NO: 680373 - DNA, 22 bp, Artificial Sequence
  chemically synthesized
ttgtgctaatgaaggctttctt

SEQ ID NO: 680374 - DNA, 22 bp, Artificial Sequence
  chemically synthesized
aaaagaagaagaaagccttcat

SEQ ID NO: 680375 - DNA, 22 bp, Artificial Sequence
  chemically synthesized
cagaaaattcttgtgctaatga

SEQ ID NO: 680376 - DNA, 22 bp, Artificial Sequence
  chemically synthesized
gcagaaaattcttgtgctaatg

SEQ ID NO: 680377 - DNA, 22 bp, Artificial Sequence
  chemically synthesized
tgtgaagtttgcagaaaattct

SEQ ID NO: 680378 - DNA, 22 bp, Artificial Sequence
  chemically synthesized
cattagcacaagaattttctgc

SEQ ID NO: 680379 - DNA, 22 bp, Artificial Sequence
  chemically synthesized
attagcacaagaattttctgca

SEQ ID NO: 680380 - DNA, 22 bp, Artificial Sequence
  chemically synthesized
gcacaagaattttctgcaaact

SEQ ID NO: 680381 - DNA, 22 bp, Artificial Sequence
  chemically synthesized
aggtgttatgtgaagtttgcag

SEQ ID NO: 680382 - DNA, 22 bp, Artificial Sequence
  chemically synthesized
atctaaggtgttatgtgaagtt

SEQ ID NO: 680383 - DNA, 22 bp, Artificial Sequence
  chemically synthesized
tctgcaaacttcacataacacc

SEQ ID NO: 680384 - DNA, 22 bp, Artificial Sequence
  chemically synthesized
ctgcaaacttcacataacacct

SEQ ID NO: 680385 - DNA, 22 bp, Artificial Sequence
  chemically synthesized
gatgctaatctaaggtgttatg

SEQ ID NO: 680386 - DNA, 22 bp, Artificial Sequence
  chemically synthesized
tgcaaacttcacataacacctt

SEQ ID NO: 680387 - DNA, 22 bp, Artificial Sequence
  chemically synthesized
ggatgctaatctaaggtgttat

SEQ ID NO: 680388 - DNA, 22 bp, Artificial Sequence
  chemically synthesized
tggatgctaatctaaggtgtta

SEQ ID NO: 680389 - DNA, 22 bp, Artificial Sequence
  chemically synthesized
caaacttcacataacaccttag

SEQ ID NO: 680390 - DNA, 22 bp, Artificial Sequence
  chemically synthesized
tttggatgctaatctaaggtgt

SEQ ID NO: 680391 - DNA, 22 bp, Artificial Sequence
  chemically synthesized
cacataacaccttagattagca

SEQ ID NO: 680392 - DNA, 22 bp, Artificial Sequence
  chemically synthesized
acataacaccttagattagcat

SEQ ID NO: 680393 - DNA, 22 bp, Artificial Sequence
  chemically synthesized
tcgtaagatgctctttggatgc

SEQ ID NO: 680394 - DNA, 22 bp, Artificial Sequence
  chemically synthesized
atcgtaagatgctctttggatg

SEQ ID NO: 680395 - DNA, 22 bp, Artificial Sequence
  chemically synthesized
agattagcatccaaagagcatc

SEQ ID NO: 680396 - DNA, 22 bp, Artificial Sequence
  chemically synthesized
gattagcatccaaagagcatct

SEQ ID NO: 680397 - DNA, 22 bp, Artificial Sequence
  chemically synthesized
acagtttatcgtaagatgctct

SEQ ID NO: 680398 - DNA, 22 bp, Artificial Sequence
  chemically synthesized
gcatccaaagagcatcttacga

SEQ ID NO: 680399 - DNA, 22 bp, Artificial Sequence
  chemically synthesized
acgataaactgttagtgatatt

SEQ ID NO: 680400 - DNA, 22 bp, Artificial Sequence
  chemically synthesized
cgataaactgttagtgatattt

SEQ ID NO: 680401 - DNA, 22 bp, Artificial Sequence
  chemically synthesized
ttagtgatattttcactgccct

SEQ ID NO: 680402 - DNA, 22 bp, Artificial Sequence
  chemically synthesized
gtgatattttcactgcccttct

SEQ ID NO: 680403 - DNA, 22 bp, Artificial Sequence
  chemically synthesized
tcactgcccttctttgtccatt

SEQ ID NO: 680404 - DNA, 22 bp, Artificial Sequence
  chemically synthesized
cactgcccttctttgtccattt

SEQ ID NO: 680405 - DNA, 22 bp, Artificial Sequence
  chemically synthesized
actgcccttctttgtccattta

SEQ ID NO: 680406 - DNA, 22 bp, Artificial Sequence
  chemically synthesized
cccttctttgtccatttatttt

SEQ ID NO: 680407 - DNA, 22 bp, Artificial Sequence
  chemically synthesized
ctttgtccatttattttgttgg

SEQ ID NO: 680408 - DNA, 22 bp, Artificial Sequence
  chemically synthesized
tttgtccatttattttgttggc

SEQ ID NO: 680409 - DNA, 22 bp, Artificial Sequence
  chemically synthesized
tgtccatttattttgttggctt

SEQ ID NO: 680410 - DNA, 22 bp, Artificial Sequence
  chemically synthesized
gtccatttattttgttggcttg

SEQ ID NO: 680411 - DNA, 22 bp, Artificial Sequence
  chemically synthesized
tccatttattttgttggcttgc

SEQ ID NO: 680412 - DNA, 22 bp, Artificial Sequence
  chemically synthesized
attttgttggcttgcttttctt

SEQ ID NO: 680413 - DNA, 22 bp, Artificial Sequence
  chemically synthesized
aaagaaaataaaaagaaaagca

SEQ ID NO: 680414 - DNA, 22 bp, Artificial Sequence
  chemically synthesized
ttttgttggcttgcttttcttt

SEQ ID NO: 680415 - DNA, 22 bp, Artificial Sequence
  chemically synthesized
gaaagaaaataaaaagaaaagc

SEQ ID NO: 680416 - DNA, 22 bp, Artificial Sequence
  chemically synthesized
tgttggcttgcttttcttttta

SEQ ID NO: 680417 - DNA, 22 bp, Artificial Sequence
  chemically synthesized
gttggcttgcttttctttttat

SEQ ID NO: 680418 - DNA, 22 bp, Artificial Sequence
  chemically synthesized
ttggcttgcttttctttttatt

SEQ ID NO: 680419 - DNA, 22 bp, Artificial Sequence
  chemically synthesized
gcttgcttttctttttattttc

SEQ ID NO: 680420 - DNA, 22 bp, Artificial Sequence
  chemically synthesized
gcttttctttttattttctttc

SEQ ID NO: 680421 - DNA, 22 bp, Artificial Sequence
  chemically synthesized
cttttctttttattttctttca

SEQ ID NO: 680422 - DNA, 22 bp, Artificial Sequence
  chemically synthesized
ttctttttattttctttcaaac

SEQ ID NO: 680423 - DNA, 22 bp, Artificial Sequence
  chemically synthesized
tctttttattttctttcaaaca

SEQ ID NO: 680424 - DNA, 22 bp, Artificial Sequence
  chemically synthesized
ctttttattttctttcaaacat

SEQ ID NO: 680425 - DNA, 22 bp, Artificial Sequence
  chemically synthesized
tttttattttctttcaaacatt

SEQ ID NO: 680426 - DNA, 22 bp, Artificial Sequence
  chemically synthesized
tttattttctttcaaacatttg

SEQ ID NO: 680427 - DNA, 22 bp, Artificial Sequence
  chemically synthesized
ttattttctttcaaacatttgc

SEQ ID NO: 680428 - DNA, 22 bp, Artificial Sequence
  chemically synthesized
tattttctttcaaacatttgct

SEQ ID NO: 680429 - DNA, 22 bp, Artificial Sequence
  chemically synthesized
attttctttcaaacatttgctt

SEQ ID NO: 680430 - DNA, 22 bp, Artificial Sequence
  chemically synthesized
ttttctttcaaacatttgcttt

SEQ ID NO: 680431 - DNA, 22 bp, Artificial Sequence
  chemically synthesized
tctttcaaacatttgctttcca

SEQ ID NO: 680432 - DNA, 22 bp, Artificial Sequence
  chemically synthesized
ctttcaaacatttgctttccac

SEQ ID NO: 680433 - DNA, 22 bp, Artificial Sequence
  chemically synthesized
tttcaaacatttgctttccact

SEQ ID NO: 680434 - DNA, 22 bp, Artificial Sequence
  chemically synthesized
tcaaacatttgctttccactct

SEQ ID NO: 680435 - DNA, 22 bp, Artificial Sequence
  chemically synthesized
caaacatttgctttccactctc

SEQ ID NO: 680436 - DNA, 22 bp, Artificial Sequence
  chemically synthesized
aaacatttgctttccactctcc

SEQ ID NO: 680437 - DNA, 22 bp, Artificial Sequence
  chemically synthesized
gctttccactctcctttccgat

SEQ ID NO: 680438 - DNA, 22 bp, Artificial Sequence
  chemically synthesized
ctttccactctcctttccgatt

SEQ ID NO: 680439 - DNA, 22 bp, Artificial Sequence
  chemically synthesized
tccactctcctttccgattgat

SEQ ID NO: 680440 - DNA, 22 bp, Artificial Sequence
  chemically synthesized
ccactctcctttccgattgatt

SEQ ID NO: 680441 - DNA, 22 bp, Artificial Sequence
  chemically synthesized
cactctcctttccgattgattc

SEQ ID NO: 680442 - DNA, 22 bp, Artificial Sequence
  chemically synthesized
tagaccgaagtggaatgaatca

SEQ ID NO: 680443 - DNA, 22 bp, Artificial Sequence
  chemically synthesized
tcctttccgattgattcattcc

SEQ ID NO: 680444 - DNA, 22 bp, Artificial Sequence
  chemically synthesized
ctttccgattgattcattccac

SEQ ID NO: 680445 - DNA, 22 bp, Artificial Sequence
  chemically synthesized
aactgtagaccgaagtggaatg

SEQ ID NO: 680446 - DNA, 22 bp, Artificial Sequence
  chemically synthesized
tccgattgattcattccacttc

SEQ ID NO: 680447 - DNA, 22 bp, Artificial Sequence
  chemically synthesized
aaactgtagaccgaagtggaat

SEQ ID NO: 680448 - DNA, 22 bp, Artificial Sequence
  chemically synthesized
ccgattgattcattccacttcg

SEQ ID NO: 680449 - DNA, 22 bp, Artificial Sequence
  chemically synthesized
cgattgattcattccacttcgg

SEQ ID NO: 680450 - DNA, 22 bp, Artificial Sequence
  chemically synthesized
attcattccacttcggtctaca

SEQ ID NO: 680451 - DNA, 22 bp, Artificial Sequence
  chemically synthesized
attccacttcggtctacagttt

SEQ ID NO: 680452 - DNA, 22 bp, Artificial Sequence
  chemically synthesized
cacttcggtctacagtttaaat

SEQ ID NO: 680453 - DNA, 22 bp, Artificial Sequence
  chemically synthesized
aaaaggggaccacatttaaact

SEQ ID NO: 680454 - DNA, 22 bp, Artificial Sequence
  chemically synthesized
aaaaaggggaccacatttaaac

SEQ ID NO: 680455 - DNA, 22 bp, Artificial Sequence
  chemically synthesized
taaaaaggggaccacatttaaa

SEQ ID NO: 680456 - DNA, 22 bp, Artificial Sequence
  chemically synthesized
cggtctacagtttaaatgtggt

SEQ ID NO: 680457 - DNA, 22 bp, Artificial Sequence
  chemically synthesized
ggtctacagtttaaatgtggtc

SEQ ID NO: 680458 - DNA, 22 bp, Artificial Sequence
  chemically synthesized
cagtttaaatgtggtccccttt

SEQ ID NO: 680459 - DNA, 22 bp, Artificial Sequence
  chemically synthesized
agaaataaattttaaaaagggg

SEQ ID NO: 680460 - DNA, 22 bp, Artificial Sequence
  chemically synthesized
aagaaataaattttaaaaaggg

SEQ ID NO: 680461 - DNA, 22 bp, Artificial Sequence
  chemically synthesized
aaatgtggtcccctttttaaaa

SEQ ID NO: 680462 - DNA, 22 bp, Artificial Sequence
  chemically synthesized
aatgtggtcccctttttaaaat

SEQ ID NO: 680463 - DNA, 22 bp, Artificial Sequence
  chemically synthesized
tttaaaatttatttcttaaggg

SEQ ID NO: 680464 - DNA, 22 bp, Artificial Sequence
  chemically synthesized
ttaaaatttatttcttaaggga

SEQ ID NO: 680465 - DNA, 22 bp, Artificial Sequence
  chemically synthesized
taaaatttatttcttaagggat

SEQ ID NO: 680466 - DNA, 22 bp, Artificial Sequence
  chemically synthesized
aaaatttatttcttaagggatg

SEQ ID NO: 680467 - DNA, 22 bp, Artificial Sequence
  chemically synthesized
aaatttatttcttaagggatgg

SEQ ID NO: 680468 - DNA, 22 bp, Artificial Sequence
  chemically synthesized
atttcttaagggatgggggtct

SEQ ID NO: 680469 - DNA, 22 bp, Artificial Sequence
  chemically synthesized
ggcaacacagtgagacccccat

SEQ ID NO: 680470 - DNA, 22 bp, Artificial Sequence
  chemically synthesized
tttcttaagggatgggggtctc

SEQ ID NO: 680471 - DNA, 22 bp, Artificial Sequence
  chemically synthesized
cttaagggatgggggtctcact

SEQ ID NO: 680472 - DNA, 22 bp, Artificial Sequence
  chemically synthesized
ttaagggatgggggtctcactg

SEQ ID NO: 680473 - DNA, 22 bp, Artificial Sequence
  chemically synthesized
aagggatgggggtctcactgtg

SEQ ID NO: 680474 - DNA, 22 bp, Artificial Sequence
  chemically synthesized
agggatgggggtctcactgtgt

SEQ ID NO: 680475 - DNA, 22 bp, Artificial Sequence
  chemically synthesized
ggagaccagcctgggcaacaca

SEQ ID NO: 680476 - DNA, 22 bp, Artificial Sequence
  chemically synthesized
actgtgttgcccaggctggtct

SEQ ID NO: 680477 - DNA, 22 bp, Artificial Sequence
  chemically synthesized
agcccaggagttgggagaccag

SEQ ID NO: 680478 - DNA, 22 bp, Artificial Sequence
  chemically synthesized
tgttgcccaggctggtctccca

SEQ ID NO: 680479 - DNA, 22 bp, Artificial Sequence
  chemically synthesized
gagcccaggagttgggagacca

SEQ ID NO: 680480 - DNA, 22 bp, Artificial Sequence
  chemically synthesized
cttgagcccaggagttgggaga

SEQ ID NO: 680481 - DNA, 22 bp, Artificial Sequence
  chemically synthesized
cccaggctggtctcccaactcc

SEQ ID NO: 680482 - DNA, 22 bp, Artificial Sequence
  chemically synthesized
gtctcccaactcctgggctcaa

SEQ ID NO: 680483 - DNA, 22 bp, Artificial Sequence
  chemically synthesized
aagtgggaggattgcttgagcc

SEQ ID NO: 680484 - DNA, 22 bp, Artificial Sequence
  chemically synthesized
ccaactcctgggctcaagcaat

SEQ ID NO: 680485 - DNA, 22 bp, Artificial Sequence
  chemically synthesized
gaggctgaagtgggaggattgc

SEQ ID NO: 680486 - DNA, 22 bp, Artificial Sequence
  chemically synthesized
ggaggctgaagtgggaggattg

SEQ ID NO: 680487 - DNA, 22 bp, Artificial Sequence
  chemically synthesized
ctgggctcaagcaatcctccca

SEQ ID NO: 680488 - DNA, 22 bp, Artificial Sequence
  chemically synthesized
ggctcaagcaatcctcccactt

SEQ ID NO: 680489 - DNA, 22 bp, Artificial Sequence
  chemically synthesized
aagcaatcctcccacttcagcc

SEQ ID NO: 680490 - DNA, 22 bp, Artificial Sequence
  chemically synthesized
tcatcgcaggcacttggaggct

SEQ ID NO: 680491 - DNA, 22 bp, Artificial Sequence
  chemically synthesized
ccacttcagcctccaagtgcct

SEQ ID NO: 680492 - DNA, 22 bp, Artificial Sequence
  chemically synthesized
cagcctccaagtgcctgcgatg

SEQ ID NO: 680493 - DNA, 22 bp, Artificial Sequence
  chemically synthesized
agcctccaagtgcctgcgatga

SEQ ID NO: 680494 - DNA, 22 bp, Artificial Sequence
  chemically synthesized
caagtgcctgcgatgacaggtg

SEQ ID NO: 680495 - DNA, 22 bp, Artificial Sequence
  chemically synthesized
cgatgacaggtgcatgccacca

SEQ ID NO: 680496 - DNA, 22 bp, Artificial Sequence
  chemically synthesized
aaaagaagccggatatggtggc

SEQ ID NO: 680497 - DNA, 22 bp, Artificial Sequence
  chemically synthesized
caaaagaagccggatatggtgg

SEQ ID NO: 680498 - DNA, 22 bp, Artificial Sequence
  chemically synthesized
tttcaaaagaagccggatatgg

SEQ ID NO: 680499 - DNA, 22 bp, Artificial Sequence
  chemically synthesized
agcagaaaaggattatttcaaa

SEQ ID NO: 680500 - DNA, 22 bp, Artificial Sequence
  chemically synthesized
cttttgaaataatccttttctg

SEQ ID NO: 680501 - DNA, 22 bp, Artificial Sequence
  chemically synthesized
ttttgaaataatccttttctgc

SEQ ID NO: 680502 - DNA, 22 bp, Artificial Sequence
  chemically synthesized
ttgaaataatccttttctgctc

SEQ ID NO: 680503 - DNA, 22 bp, Artificial Sequence
  chemically synthesized
tgaaataatccttttctgctca

SEQ ID NO: 680504 - DNA, 22 bp, Artificial Sequence
  chemically synthesized
gaaataatccttttctgctcaa

SEQ ID NO: 680505 - DNA, 22 bp, Artificial Sequence
  chemically synthesized
gggggaaaaatgttgagcagaa

SEQ ID NO: 680506 - DNA, 22 bp, Artificial Sequence
  chemically synthesized
aaataatccttttctgctcaac

SEQ ID NO: 680507 - DNA, 22 bp, Artificial Sequence
  chemically synthesized
tagggggaaaaatgttgagcag

SEQ ID NO: 680508 - DNA, 22 bp, Artificial Sequence
  chemically synthesized
aaacattctagggggaaaaatg

SEQ ID NO: 680509 - DNA, 22 bp, Artificial Sequence
  chemically synthesized
ttctgctcaacatttttccccc

SEQ ID NO: 680510 - DNA, 22 bp, Artificial Sequence
  chemically synthesized
tctgctcaacatttttccccct

SEQ ID NO: 680511 - DNA, 22 bp, Artificial Sequence
  chemically synthesized
ctgctcaacatttttcccccta

SEQ ID NO: 680512 - DNA, 22 bp, Artificial Sequence
  chemically synthesized
tgctcaacatttttccccctag

SEQ ID NO: 680513 - DNA, 22 bp, Artificial Sequence
  chemically synthesized
cacctaaaacattctaggggga

SEQ ID NO: 680514 - DNA, 22 bp, Artificial Sequence
  chemically synthesized
ctcaacatttttccccctagaa

SEQ ID NO: 680515 - DNA, 22 bp, Artificial Sequence
  chemically synthesized
ccacctaaaacattctaggggg

SEQ ID NO: 680516 - DNA, 22 bp, Artificial Sequence
  chemically synthesized
aacatttttccccctagaatgt

SEQ ID NO: 680517 - DNA, 22 bp, Artificial Sequence
  chemically synthesized
ttccccctagaatgttttaggt

SEQ ID NO: 680518 - DNA, 22 bp, Artificial Sequence
  chemically synthesized
tccccctagaatgttttaggtg

SEQ ID NO: 680519 - DNA, 22 bp, Artificial Sequence
  chemically synthesized
ccccctagaatgttttaggtgg

SEQ ID NO: 680520 - DNA, 22 bp, Artificial Sequence
  chemically synthesized
cccctagaatgttttaggtgga

SEQ ID NO: 680521 - DNA, 22 bp, Artificial Sequence
  chemically synthesized
gaatgttttaggtggaagcaca

SEQ ID NO: 680522 - DNA, 22 bp, Artificial Sequence
  chemically synthesized
gataaagcaaaacgggtgtgct

SEQ ID NO: 680523 - DNA, 22 bp, Artificial Sequence
  chemically synthesized
taggtggaagcacacccgtttt

SEQ ID NO: 680524 - DNA, 22 bp, Artificial Sequence
  chemically synthesized
aggtggaagcacacccgttttg

SEQ ID NO: 680525 - DNA, 22 bp, Artificial Sequence
  chemically synthesized
ggtggaagcacacccgttttgc

SEQ ID NO: 680526 - DNA, 22 bp, Artificial Sequence
  chemically synthesized
tagcattagataaagcaaaacg

SEQ ID NO: 680527 - DNA, 22 bp, Artificial Sequence
  chemically synthesized
ccatgctatagcattagataaa

SEQ ID NO: 680528 - DNA, 22 bp, Artificial Sequence
  chemically synthesized
gccatgctatagcattagataa

SEQ ID NO: 680529 - DNA, 22 bp, Artificial Sequence
  chemically synthesized
tgccatgctatagcattagata

SEQ ID NO: 680530 - DNA, 22 bp, Artificial Sequence
  chemically synthesized
ttgccatgctatagcattagat

SEQ ID NO: 680531 - DNA, 22 bp, Artificial Sequence
  chemically synthesized
ttttgccatgctatagcattag

SEQ ID NO: 680532 - DNA, 22 bp, Artificial Sequence
  chemically synthesized
tgctttatctaatgctatagca

SEQ ID NO: 680533 - DNA, 22 bp, Artificial Sequence
  chemically synthesized
cctcttttgccatgctatagca

SEQ ID NO: 680534 - DNA, 22 bp, Artificial Sequence
  chemically synthesized
gctttatctaatgctatagcat

SEQ ID NO: 680535 - DNA, 22 bp, Artificial Sequence
  chemically synthesized
gcctcttttgccatgctatagc

SEQ ID NO: 680536 - DNA, 22 bp, Artificial Sequence
  chemically synthesized
ctttatctaatgctatagcatg

SEQ ID NO: 680537 - DNA, 22 bp, Artificial Sequence
  chemically synthesized
tgcctcttttgccatgctatag

SEQ ID NO: 680538 - DNA, 22 bp, Artificial Sequence
  chemically synthesized
ttgcctcttttgccatgctata

SEQ ID NO: 680539 - DNA, 22 bp, Artificial Sequence
  chemically synthesized
tatctaatgctatagcatggca

SEQ ID NO: 680540 - DNA, 22 bp, Artificial Sequence
  chemically synthesized
atctaatgctatagcatggcaa

SEQ ID NO: 680541 - DNA, 22 bp, Artificial Sequence
  chemically synthesized
tttttgcctcttttgccatgct

SEQ ID NO: 680542 - DNA, 22 bp, Artificial Sequence
  chemically synthesized
tctaatgctatagcatggcaaa

SEQ ID NO: 680543 - DNA, 22 bp, Artificial Sequence
  chemically synthesized
atttttgcctcttttgccatgc

SEQ ID NO: 680544 - DNA, 22 bp, Artificial Sequence
  chemically synthesized
tatttttgcctcttttgccatg

SEQ ID NO: 680545 - DNA, 22 bp, Artificial Sequence
  chemically synthesized
atgctatagcatggcaaaagag

SEQ ID NO: 680546 - DNA, 22 bp, Artificial Sequence
  chemically synthesized
tagcatggcaaaagaggcaaaa

SEQ ID NO: 680547 - DNA, 22 bp, Artificial Sequence
  chemically synthesized
tccagatactttatttttgcct

SEQ ID NO: 680548 - DNA, 22 bp, Artificial Sequence
  chemically synthesized
gtccagatactttatttttgcc

SEQ ID NO: 680549 - DNA, 22 bp, Artificial Sequence
  chemically synthesized
tgtccagatactttatttttgc

SEQ ID NO: 680550 - DNA, 22 bp, Artificial Sequence
  chemically synthesized
ttgtccagatactttatttttg

SEQ ID NO: 680551 - DNA, 22 bp, Artificial Sequence
  chemically synthesized
cttttgtccagatactttattt

SEQ ID NO: 680552 - DNA, 22 bp, Artificial Sequence
  chemically synthesized
gcttttgtccagatactttatt

SEQ ID NO: 680553 - DNA, 22 bp, Artificial Sequence
  chemically synthesized
tgcttttgtccagatactttat

SEQ ID NO: 680554 - DNA, 22 bp, Artificial Sequence
  chemically synthesized
ttgcttttgtccagatacttta

SEQ ID NO: 680555 - DNA, 22 bp, Artificial Sequence
  chemically synthesized
ccttttgcttttgtccagatac

SEQ ID NO: 680556 - DNA, 22 bp, Artificial Sequence
  chemically synthesized
gcattcccttttgcttttgtcc

SEQ ID NO: 680557 - DNA, 22 bp, Artificial Sequence
  chemically synthesized
gacaaaagcaaaagggaatgcc

SEQ ID NO: 680558 - DNA, 22 bp, Artificial Sequence
  chemically synthesized
aaggtaataaagaatcctggca

SEQ ID NO: 680559 - DNA, 22 bp, Artificial Sequence
  chemically synthesized
ttaaaggtaataaagaatcctg

SEQ ID NO: 680560 - DNA, 22 bp, Artificial Sequence
  chemically synthesized
gttaaaggtaataaagaatcct

SEQ ID NO: 680561 - DNA, 22 bp, Artificial Sequence
  chemically synthesized
gtttgttaaaggtaataaagaa

SEQ ID NO: 680562 - DNA, 22 bp, Artificial Sequence
  chemically synthesized
ggtttgttaaaggtaataaaga

SEQ ID NO: 680563 - DNA, 22 bp, Artificial Sequence
  chemically synthesized
tatttggtttgttaaaggtaat

SEQ ID NO: 680564 - DNA, 22 bp, Artificial Sequence
  chemically synthesized
atatttggtttgttaaaggtaa

SEQ ID NO: 680565 - DNA, 22 bp, Artificial Sequence
  chemically synthesized
tatatttggtttgttaaaggta

SEQ ID NO: 680566 - DNA, 22 bp, Artificial Sequence
  chemically synthesized
cctttatatttggtttgttaaa

SEQ ID NO: 680567 - DNA, 22 bp, Artificial Sequence
  chemically synthesized
acctttatatttggtttgttaa

SEQ ID NO: 680568 - DNA, 22 bp, Artificial Sequence
  chemically synthesized
tttattacctttaacaaaccaa

SEQ ID NO: 680569 - DNA, 22 bp, Artificial Sequence
  chemically synthesized
tattacctttaacaaaccaaat

SEQ ID NO: 680570 - DNA, 22 bp, Artificial Sequence
  chemically synthesized
attacctttaacaaaccaaata

SEQ ID NO: 680571 - DNA, 22 bp, Artificial Sequence
  chemically synthesized
ttacctttaacaaaccaaatat

SEQ ID NO: 680572 - DNA, 22 bp, Artificial Sequence
  chemically synthesized
cctttaacaaaccaaatataaa

SEQ ID NO: 680573 - DNA, 22 bp, Artificial Sequence
  chemically synthesized
gtgataacatttacctttatat

SEQ ID NO: 680574 - DNA, 22 bp, Artificial Sequence
  chemically synthesized
taacaaaccaaatataaaggta

SEQ ID NO: 680575 - DNA, 22 bp, Artificial Sequence
  chemically synthesized
agtgataacatttacctttata

SEQ ID NO: 680576 - DNA, 22 bp, Artificial Sequence
  chemically synthesized
aacaaaccaaatataaaggtaa

SEQ ID NO: 680577 - DNA, 22 bp, Artificial Sequence
  chemically synthesized
tagtgataacatttacctttat

SEQ ID NO: 680578 - DNA, 22 bp, Artificial Sequence
  chemically synthesized
acaaaccaaatataaaggtaaa

SEQ ID NO: 680579 - DNA, 22 bp, Artificial Sequence
  chemically synthesized
catgcacatatctttagtgata

SEQ ID NO: 680580 - DNA, 22 bp, Artificial Sequence
  chemically synthesized
acatgcacatatctttagtgat

SEQ ID NO: 680581 - DNA, 22 bp, Artificial Sequence
  chemically synthesized
tcactaaagatatgtgcatgta

SEQ ID NO: 680582 - DNA, 22 bp, Artificial Sequence
  chemically synthesized
aagatatgtgcatgtaagtatg

SEQ ID NO: 680583 - DNA, 22 bp, Artificial Sequence
  chemically synthesized
aaaatagcaataccgatcatac

SEQ ID NO: 680584 - DNA, 22 bp, Artificial Sequence
  chemically synthesized
aaaaatagcaataccgatcata

SEQ ID NO: 680585 - DNA, 22 bp, Artificial Sequence
  chemically synthesized
cttaaaaatagcaataccgatc

SEQ ID NO: 680586 - DNA, 22 bp, Artificial Sequence
  chemically synthesized
gcttaaaaatagcaataccgat

SEQ ID NO: 680587 - DNA, 22 bp, Artificial Sequence
  chemically synthesized
ctatttttaagcaaatatggca

SEQ ID NO: 680588 - DNA, 22 bp, Artificial Sequence
  chemically synthesized
tttttaagcaaatatggcactt

SEQ ID NO: 680589 - DNA, 22 bp, Artificial Sequence
  chemically synthesized
ttaagcaaatatggcacttctt

SEQ ID NO: 680590 - DNA, 22 bp, Artificial Sequence
  chemically synthesized
taagcaaatatggcacttcttc

SEQ ID NO: 680591 - DNA, 22 bp, Artificial Sequence
  chemically synthesized
aagcaaatatggcacttcttct

SEQ ID NO: 680592 - DNA, 22 bp, Artificial Sequence
  chemically synthesized
agcaaatatggcacttcttctg

SEQ ID NO: 680593 - DNA, 22 bp, Artificial Sequence
  chemically synthesized
agtgtatgagccagaatgccag

SEQ ID NO: 680594 - DNA, 22 bp, Artificial Sequence
  chemically synthesized
cttctggcattctggctcatac

SEQ ID NO: 680595 - DNA, 22 bp, Artificial Sequence
  chemically synthesized
agtaatctcagtgtatgagcca

SEQ ID NO: 680596 - DNA, 22 bp, Artificial Sequence
  chemically synthesized
ttctggcattctggctcataca

SEQ ID NO: 680597 - DNA, 22 bp, Artificial Sequence
  chemically synthesized
ctggcattctggctcatacact

SEQ ID NO: 680598 - DNA, 22 bp, Artificial Sequence
  chemically synthesized
tggcattctggctcatacactg

SEQ ID NO: 680599 - DNA, 22 bp, Artificial Sequence
  chemically synthesized
gcattctggctcatacactgag

SEQ ID NO: 680600 - DNA, 22 bp, Artificial Sequence
  chemically synthesized
tggctcatacactgagattact

SEQ ID NO: 680601 - DNA, 22 bp, Artificial Sequence
  chemically synthesized
aagggcaacactaagtaatctc

SEQ ID NO: 680602 - DNA, 22 bp, Artificial Sequence
  chemically synthesized
gctcatacactgagattactta

SEQ ID NO: 680603 - DNA, 22 bp, Artificial Sequence
  chemically synthesized
ctaaagggcaacactaagtaat

SEQ ID NO: 680604 - DNA, 22 bp, Artificial Sequence
  chemically synthesized
atacactgagattacttagtgt

SEQ ID NO: 680605 - DNA, 22 bp, Artificial Sequence
  chemically synthesized
aaattgctaaagggcaacacta

SEQ ID NO: 680606 - DNA, 22 bp, Artificial Sequence
  chemically synthesized
aaaattgctaaagggcaacact

SEQ ID NO: 680607 - DNA, 22 bp, Artificial Sequence
  chemically synthesized
agattacttagtgttgcccttt

SEQ ID NO: 680608 - DNA, 22 bp, Artificial Sequence
  chemically synthesized
gcttaaaattgctaaagggcaa

SEQ ID NO: 680609 - DNA, 22 bp, Artificial Sequence
  chemically synthesized
actagcttaaaattgctaaagg

SEQ ID NO: 680610 - DNA, 22 bp, Artificial Sequence
  chemically synthesized
cttagtgttgccctttagcaat

SEQ ID NO: 680611 - DNA, 22 bp, Artificial Sequence
  chemically synthesized
agtgttgccctttagcaatttt

SEQ ID NO: 680612 - DNA, 22 bp, Artificial Sequence
  chemically synthesized
gtgttgccctttagcaatttta

SEQ ID NO: 680613 - DNA, 22 bp, Artificial Sequence
  chemically synthesized
cacaactcactagcttaaaatt

SEQ ID NO: 680614 - DNA, 22 bp, Artificial Sequence
  chemically synthesized
ccctttagcaattttaagctag

SEQ ID NO: 680615 - DNA, 22 bp, Artificial Sequence
  chemically synthesized
cctccacaactcactagcttaa

SEQ ID NO: 680616 - DNA, 22 bp, Artificial Sequence
  chemically synthesized
tagcaattttaagctagtgagt

SEQ ID NO: 680617 - DNA, 22 bp, Artificial Sequence
  chemically synthesized
agcaattttaagctagtgagtt

SEQ ID NO: 680618 - DNA, 22 bp, Artificial Sequence
  chemically synthesized
gcaattttaagctagtgagttg

SEQ ID NO: 680619 - DNA, 22 bp, Artificial Sequence
  chemically synthesized
taagctagtgagttgtggaggc

SEQ ID NO: 680620 - DNA, 22 bp, Artificial Sequence
  chemically synthesized
aagctagtgagttgtggaggca

SEQ ID NO: 680621 - DNA, 22 bp, Artificial Sequence
  chemically synthesized
agctagtgagttgtggaggcag

SEQ ID NO: 680622 - DNA, 22 bp, Artificial Sequence
  chemically synthesized
agaccgtaatagcagctgcctc

SEQ ID NO: 680623 - DNA, 22 bp, Artificial Sequence
  chemically synthesized
gtgagttgtggaggcagctgct

SEQ ID NO: 680624 - DNA, 22 bp, Artificial Sequence
  chemically synthesized
tggaggcagctgctattacggt

SEQ ID NO: 680625 - DNA, 22 bp, Artificial Sequence
  chemically synthesized
gtgtgcccccctcagaccgtaa

SEQ ID NO: 680626 - DNA, 22 bp, Artificial Sequence
  chemically synthesized
agtgtgcccccctcagaccgta

SEQ ID NO: 680627 - DNA, 22 bp, Artificial Sequence
  chemically synthesized
ctattacggtctgaggggggca

SEQ ID NO: 680628 - DNA, 22 bp, Artificial Sequence
  chemically synthesized
ttacggtctgaggggggcacac

SEQ ID NO: 680629 - DNA, 22 bp, Artificial Sequence
  chemically synthesized
cggtctgaggggggcacactaa

SEQ ID NO: 680630 - DNA, 22 bp, Artificial Sequence
  chemically synthesized
agccaaagcaaatcttagtgtg

SEQ ID NO: 680631 - DNA, 22 bp, Artificial Sequence
  chemically synthesized
cagccaaagcaaatcttagtgt

SEQ ID NO: 680632 - DNA, 22 bp, Artificial Sequence
  chemically synthesized
aggggggcacactaagatttgc

SEQ ID NO: 680633 - DNA, 22 bp, Artificial Sequence
  chemically synthesized
gaccaagggacaacttcagcca

SEQ ID NO: 680634 - DNA, 22 bp, Artificial Sequence
  chemically synthesized
agatttgctttggctgaagttg

SEQ ID NO: 680635 - DNA, 22 bp, Artificial Sequence
  chemically synthesized
ttagaccaagggacaacttcag

SEQ ID NO: 680636 - DNA, 22 bp, Artificial Sequence
  chemically synthesized
gctttggctgaagttgtccctt

SEQ ID NO: 680637 - DNA, 22 bp, Artificial Sequence
  chemically synthesized
ctttggctgaagttgtcccttg

SEQ ID NO: 680638 - DNA, 22 bp, Artificial Sequence
  chemically synthesized
tggctgaagttgtcccttggtc

SEQ ID NO: 680639 - DNA, 22 bp, Artificial Sequence
  chemically synthesized
ggctgaagttgtcccttggtct

SEQ ID NO: 680640 - DNA, 22 bp, Artificial Sequence
  chemically synthesized
gaatatactattagaccaaggg

SEQ ID NO: 680641 - DNA, 22 bp, Artificial Sequence
  chemically synthesized
gctgaagttgtcccttggtcta

SEQ ID NO: 680642 - DNA, 22 bp, Artificial Sequence
  chemically synthesized
aagttgtcccttggtctaatag

SEQ ID NO: 680643 - DNA, 22 bp, Artificial Sequence
  chemically synthesized
tcccttggtctaatagtatatt

SEQ ID NO: 680644 - DNA, 22 bp, Artificial Sequence
  chemically synthesized
ggtctaatagtatattctaggt

SEQ ID NO: 680645 - DNA, 22 bp, Artificial Sequence
  chemically synthesized
gtctaatagtatattctaggtc

SEQ ID NO: 680646 - DNA, 22 bp, Artificial Sequence
  chemically synthesized
cccaaggatcggagcagaccta

SEQ ID NO: 680647 - DNA, 22 bp, Artificial Sequence
  chemically synthesized
atagtatattctaggtctgctc

SEQ ID NO: 680648 - DNA, 22 bp, Artificial Sequence
  chemically synthesized
ccccaaggatcggagcagacct

SEQ ID NO: 680649 - DNA, 22 bp, Artificial Sequence
  chemically synthesized
ttccccaaggatcggagcagac

SEQ ID NO: 680650 - DNA, 22 bp, Artificial Sequence
  chemically synthesized
atccctcttccccaaggatcgg

SEQ ID NO: 680651 - DNA, 22 bp, Artificial Sequence
  chemically synthesized
taggtctgctccgatccttggg

SEQ ID NO: 680652 - DNA, 22 bp, Artificial Sequence
  chemically synthesized
ggtctgctccgatccttgggga

SEQ ID NO: 680653 - DNA, 22 bp, Artificial Sequence
  chemically synthesized
ctccgatccttggggaagaggg

SEQ ID NO: 680654 - DNA, 22 bp, Artificial Sequence
  chemically synthesized
caggacactaatccctcttccc

SEQ ID NO: 680655 - DNA, 22 bp, Artificial Sequence
  chemically synthesized
cgatccttggggaagagggatt

SEQ ID NO: 680656 - DNA, 22 bp, Artificial Sequence
  chemically synthesized
attacaggacactaatccctct

SEQ ID NO: 680657 - DNA, 22 bp, Artificial Sequence
  chemically synthesized
ctcattacaggacactaatccc

SEQ ID NO: 680658 - DNA, 22 bp, Artificial Sequence
  chemically synthesized
cctcattacaggacactaatcc

SEQ ID NO: 680659 - DNA, 22 bp, Artificial Sequence
  chemically synthesized
ggggaagagggattagtgtcct

SEQ ID NO: 680660 - DNA, 22 bp, Artificial Sequence
  chemically synthesized
cttcctcattacaggacactaa

SEQ ID NO: 680661 - DNA, 22 bp, Artificial Sequence
  chemically synthesized
gggaagagggattagtgtcctg

SEQ ID NO: 680662 - DNA, 22 bp, Artificial Sequence
  chemically synthesized
caaagggcactacttcctcatt

SEQ ID NO: 680663 - DNA, 22 bp, Artificial Sequence
  chemically synthesized
gtgtcctgtaatgaggaagtag

SEQ ID NO: 680664 - DNA, 22 bp, Artificial Sequence
  chemically synthesized
ctgcaaagggcactacttcctc

SEQ ID NO: 680665 - DNA, 22 bp, Artificial Sequence
  chemically synthesized
actgcaaagggcactacttcct

SEQ ID NO: 680666 - DNA, 22 bp, Artificial Sequence
  chemically synthesized
atttactgcaaagggcactact

SEQ ID NO: 680667 - DNA, 22 bp, Artificial Sequence
  chemically synthesized
tgatttactgcaaagggcacta

SEQ ID NO: 680668 - DNA, 22 bp, Artificial Sequence
  chemically synthesized
taatgaggaagtagtgcccttt

SEQ ID NO: 680669 - DNA, 22 bp, Artificial Sequence
  chemically synthesized
gtgtctctgatttactgcaaag

SEQ ID NO: 680670 - DNA, 22 bp, Artificial Sequence
  chemically synthesized
acacagagattggtgtctctga

SEQ ID NO: 680671 - DNA, 22 bp, Artificial Sequence
  chemically synthesized
tgcagtaaatcagagacaccaa

SEQ ID NO: 680672 - DNA, 22 bp, Artificial Sequence
  chemically synthesized
gcagtaaatcagagacaccaat

SEQ ID NO: 680673 - DNA, 22 bp, Artificial Sequence
  chemically synthesized
cagtaaatcagagacaccaatc

SEQ ID NO: 680674 - DNA, 22 bp, Artificial Sequence
  chemically synthesized
ccacactgacacagagattggt

SEQ ID NO: 680675 - DNA, 22 bp, Artificial Sequence
  chemically synthesized
gccacactgacacagagattgg

SEQ ID NO: 680676 - DNA, 22 bp, Artificial Sequence
  chemically synthesized
agtgatttgccacactgacaca

SEQ ID NO: 680677 - DNA, 22 bp, Artificial Sequence
  chemically synthesized
tgtgtcagtgtggcaaatcact

SEQ ID NO: 680678 - DNA, 22 bp, Artificial Sequence
  chemically synthesized
tgtcagtgtggcaaatcactta

SEQ ID NO: 680679 - DNA, 22 bp, Artificial Sequence
  chemically synthesized
aaataaacataaacagtagtta

SEQ ID NO: 680680 - DNA, 22 bp, Artificial Sequence
  chemically synthesized
gttgaaataaacataaacagta

SEQ ID NO: 680681 - DNA, 22 bp, Artificial Sequence
  chemically synthesized
cgttgaaataaacataaacagt

SEQ ID NO: 680682 - DNA, 22 bp, Artificial Sequence
  chemically synthesized
tcgttgaaataaacataaacag

SEQ ID NO: 680683 - DNA, 22 bp, Artificial Sequence
  chemically synthesized
ttcgttgaaataaacataaaca

SEQ ID NO: 680684 - DNA, 22 bp, Artificial Sequence
  chemically synthesized
tcttttcgttgaaataaacata

SEQ ID NO: 680685 - DNA, 22 bp, Artificial Sequence
  chemically synthesized
aactactgtttatgtttatttc

SEQ ID NO: 680686 - DNA, 22 bp, Artificial Sequence
  chemically synthesized
tgtcttttcgttgaaataaaca

SEQ ID NO: 680687 - DNA, 22 bp, Artificial Sequence
  chemically synthesized
actactgtttatgtttatttca

SEQ ID NO: 680688 - DNA, 22 bp, Artificial Sequence
  chemically synthesized
ctgtcttttcgttgaaataaac

SEQ ID NO: 680689 - DNA, 22 bp, Artificial Sequence
  chemically synthesized
ctgtttatgtttatttcaacga

SEQ ID NO: 680690 - DNA, 22 bp, Artificial Sequence
  chemically synthesized
aggcttctgtcttttcgttgaa

SEQ ID NO: 680691 - DNA, 22 bp, Artificial Sequence
  chemically synthesized
tttatgtttatttcaacgaaaa

SEQ ID NO: 680692 - DNA, 22 bp, Artificial Sequence
  chemically synthesized
tgaggcttctgtcttttcgttg

SEQ ID NO: 680693 - DNA, 22 bp, Artificial Sequence
  chemically synthesized
atgtttatttcaacgaaaagac

SEQ ID NO: 680694 - DNA, 22 bp, Artificial Sequence
  chemically synthesized
tgtttatttcaacgaaaagaca

SEQ ID NO: 680695 - DNA, 22 bp, Artificial Sequence
  chemically synthesized
atttcaacgaaaagacagaagc

SEQ ID NO: 680696 - DNA, 22 bp, Artificial Sequence
  chemically synthesized
tttcaacgaaaagacagaagcc

SEQ ID NO: 680697 - DNA, 22 bp, Artificial Sequence
  chemically synthesized
caacgaaaagacagaagcctca

SEQ ID NO: 680698 - DNA, 22 bp, Artificial Sequence
  chemically synthesized
aacgaaaagacagaagcctcag

SEQ ID NO: 680699 - DNA, 22 bp, Artificial Sequence
  chemically synthesized
caaatgtccatgctctgaggct

SEQ ID NO: 680700 - DNA, 22 bp, Artificial Sequence
  chemically synthesized
acaaatgtccatgctctgaggc

SEQ ID NO: 680701 - DNA, 22 bp, Artificial Sequence
  chemically synthesized
taatatttacaaatgtccatgc

SEQ ID NO: 680702 - DNA, 22 bp, Artificial Sequence
  chemically synthesized
gtaatatttacaaatgtccatg

SEQ ID NO: 680703 - DNA, 22 bp, Artificial Sequence
  chemically synthesized
tcgatttgtaatatttacaaat

SEQ ID NO: 680704 - DNA, 22 bp, Artificial Sequence
  chemically synthesized
agagcatggacatttgtaaata

SEQ ID NO: 680705 - DNA, 22 bp, Artificial Sequence
  chemically synthesized
atcgatttgtaatatttacaaa

SEQ ID NO: 680706 - DNA, 22 bp, Artificial Sequence
  chemically synthesized
gtttatcgatttgtaatattta

SEQ ID NO: 680707 - DNA, 22 bp, Artificial Sequence
  chemically synthesized
agtttatcgatttgtaatattt

SEQ ID NO: 680708 - DNA, 22 bp, Artificial Sequence
  chemically synthesized
caaatccttagtttatcgattt

SEQ ID NO: 680709 - DNA, 22 bp, Artificial Sequence
  chemically synthesized
gtaaatattacaaatcgataaa

SEQ ID NO: 680710 - DNA, 22 bp, Artificial Sequence
  chemically synthesized
taaatattacaaatcgataaac

SEQ ID NO: 680711 - DNA, 22 bp, Artificial Sequence
  chemically synthesized
caaatcgataaactaaggattt

SEQ ID NO: 680712 - DNA, 22 bp, Artificial Sequence
  chemically synthesized
tccaggtgttacaaatccttag

SEQ ID NO: 680713 - DNA, 22 bp, Artificial Sequence
  chemically synthesized
ctatccaggtgttacaaatcct

SEQ ID NO: 680714 - DNA, 22 bp, Artificial Sequence
  chemically synthesized
actatccaggtgttacaaatcc

SEQ ID NO: 680715 - DNA, 22 bp, Artificial Sequence
  chemically synthesized
aggatttgtaacacctggatag

SEQ ID NO: 680716 - DNA, 22 bp, Artificial Sequence
  chemically synthesized
gtaacacctggatagtaagaca

SEQ ID NO: 680717 - DNA, 22 bp, Artificial Sequence
  chemically synthesized
taacacctggatagtaagacat

SEQ ID NO: 680718 - DNA, 22 bp, Artificial Sequence
  chemically synthesized
gatagtaagacatttgtcactc

SEQ ID NO: 680719 - DNA, 22 bp, Artificial Sequence
  chemically synthesized
gtcactctcttcctttcctgtt

SEQ ID NO: 680720 - DNA, 22 bp, Artificial Sequence
  chemically synthesized
tcactctcttcctttcctgttt

SEQ ID NO: 680721 - DNA, 22 bp, Artificial Sequence
  chemically synthesized
tcttcctttcctgttttttgtt

SEQ ID NO: 680722 - DNA, 22 bp, Artificial Sequence
  chemically synthesized
ttcctttcctgttttttgtttg

SEQ ID NO: 680723 - DNA, 22 bp, Artificial Sequence
  chemically synthesized
cctttcctgttttttgtttgtt

SEQ ID NO: 680724 - DNA, 22 bp, Artificial Sequence
  chemically synthesized
ctttcctgttttttgtttgttt

SEQ ID NO: 680725 - DNA, 22 bp, Artificial Sequence
  chemically synthesized
aaagtgtaaaacaaacaaacaa

SEQ ID NO: 680726 - DNA, 22 bp, Artificial Sequence
  chemically synthesized
aaaagtgtaaaacaaacaaaca

SEQ ID NO: 680727 - DNA, 22 bp, Artificial Sequence
  chemically synthesized
tcctgttttttgtttgtttgtt

SEQ ID NO: 680728 - DNA, 22 bp, Artificial Sequence
  chemically synthesized
cctgttttttgtttgtttgttt

SEQ ID NO: 680729 - DNA, 22 bp, Artificial Sequence
  chemically synthesized
ctgttttttgtttgtttgtttt

SEQ ID NO: 680730 - DNA, 22 bp, Artificial Sequence
  chemically synthesized
ttttttgtttgtttgttttaca

SEQ ID NO: 680731 - DNA, 22 bp, Artificial Sequence
  chemically synthesized
tttgtttgtttgttttacactt

SEQ ID NO: 680732 - DNA, 22 bp, Artificial Sequence
  chemically synthesized
ttgtttgtttgttttacacttt

SEQ ID NO: 680733 - DNA, 22 bp, Artificial Sequence
  chemically synthesized
tgtttgtttgttttacactttt

SEQ ID NO: 680734 - DNA, 22 bp, Artificial Sequence
  chemically synthesized
agcaggtaatttaaaagtgtaa

SEQ ID NO: 680735 - DNA, 22 bp, Artificial Sequence
  chemically synthesized
gtttgtttgttttacactttta

SEQ ID NO: 680736 - DNA, 22 bp, Artificial Sequence
  chemically synthesized
gagcaggtaatttaaaagtgta

SEQ ID NO: 680737 - DNA, 22 bp, Artificial Sequence
  chemically synthesized
tttgtttgttttacacttttaa

SEQ ID NO: 680738 - DNA, 22 bp, Artificial Sequence
  chemically synthesized
tgagcaggtaatttaaaagtgt

SEQ ID NO: 680739 - DNA, 22 bp, Artificial Sequence
  chemically synthesized
gtttgttttacacttttaaatt

SEQ ID NO: 680740 - DNA, 22 bp, Artificial Sequence
  chemically synthesized
tttgttttacacttttaaatta

SEQ ID NO: 680741 - DNA, 22 bp, Artificial Sequence
  chemically synthesized
aattttgagcaggtaatttaaa

SEQ ID NO: 680742 - DNA, 22 bp, Artificial Sequence
  chemically synthesized
gttttacacttttaaattacct

SEQ ID NO: 680743 - DNA, 22 bp, Artificial Sequence
  chemically synthesized
ttttacacttttaaattacctg

SEQ ID NO: 680744 - DNA, 22 bp, Artificial Sequence
  chemically synthesized
ctgaattttgagcaggtaattt

SEQ ID NO: 680745 - DNA, 22 bp, Artificial Sequence
  chemically synthesized
tacacttttaaattacctgctc

SEQ ID NO: 680746 - DNA, 22 bp, Artificial Sequence
  chemically synthesized
acacttttaaattacctgctca

SEQ ID NO: 680747 - DNA, 22 bp, Artificial Sequence
  chemically synthesized
cacttttaaattacctgctcaa

SEQ ID NO: 680748 - DNA, 22 bp, Artificial Sequence
  chemically synthesized
ttaaattacctgctcaaaattc

SEQ ID NO: 680749 - DNA, 22 bp, Artificial Sequence
  chemically synthesized
taaattacctgctcaaaattca

SEQ ID NO: 680750 - DNA, 22 bp, Artificial Sequence
  chemically synthesized
aaattacctgctcaaaattcag

SEQ ID NO: 680751 - DNA, 22 bp, Artificial Sequence
  chemically synthesized
aattacctgctcaaaattcagg

SEQ ID NO: 680752 - DNA, 22 bp, Artificial Sequence
  chemically synthesized
cctgctcaaaattcaggagttc

SEQ ID NO: 680753 - DNA, 22 bp, Artificial Sequence
  chemically synthesized
tagagaagcgtgtcagaactcc

SEQ ID NO: 680754 - DNA, 22 bp, Artificial Sequence
  chemically synthesized
ctcaaaattcaggagttctgac

SEQ ID NO: 680755 - DNA, 22 bp, Artificial Sequence
  chemically synthesized
atagagaagcgtgtcagaactc

SEQ ID NO: 680756 - DNA, 22 bp, Artificial Sequence
  chemically synthesized
aaaattcaggagttctgacacg

SEQ ID NO: 680757 - DNA, 22 bp, Artificial Sequence
  chemically synthesized
agcatttatagagaagcgtgtc

SEQ ID NO: 680758 - DNA, 22 bp, Artificial Sequence
  chemically synthesized
aagcatttatagagaagcgtgt

SEQ ID NO: 680759 - DNA, 22 bp, Artificial Sequence
  chemically synthesized
aggagttctgacacgcttctct

SEQ ID NO: 680760 - DNA, 22 bp, Artificial Sequence
  chemically synthesized
tgacacgcttctctataaatgc

SEQ ID NO: 680761 - DNA, 22 bp, Artificial Sequence
  chemically synthesized
acacgcttctctataaatgctt

SEQ ID NO: 680762 - DNA, 22 bp, Artificial Sequence
  chemically synthesized
agaaaagagacttaagcattta

SEQ ID NO: 680763 - DNA, 22 bp, Artificial Sequence
  chemically synthesized
ctctataaatgcttaagtctct

SEQ ID NO: 680764 - DNA, 22 bp, Artificial Sequence
  chemically synthesized
gacactgagaaaagagacttaa

SEQ ID NO: 680765 - DNA, 22 bp, Artificial Sequence
  chemically synthesized
tctataaatgcttaagtctctt

SEQ ID NO: 680766 - DNA, 22 bp, Artificial Sequence
  chemically synthesized
tataaatgcttaagtctctttt

SEQ ID NO: 680767 - DNA, 22 bp, Artificial Sequence
  chemically synthesized
attggacactgagaaaagagac

SEQ ID NO: 680768 - DNA, 22 bp, Artificial Sequence
  chemically synthesized
taaatgcttaagtctcttttct

SEQ ID NO: 680769 - DNA, 22 bp, Artificial Sequence
  chemically synthesized
taattggacactgagaaaagag

SEQ ID NO: 680770 - DNA, 22 bp, Artificial Sequence
  chemically synthesized
ctaattggacactgagaaaaga

SEQ ID NO: 680771 - DNA, 22 bp, Artificial Sequence
  chemically synthesized
tctaattggacactgagaaaag

SEQ ID NO: 680772 - DNA, 22 bp, Artificial Sequence
  chemically synthesized
aagtctcttttctcagtgtcca

SEQ ID NO: 680773 - DNA, 22 bp, Artificial Sequence
  chemically synthesized
agtctcttttctcagtgtccaa

SEQ ID NO: 680774 - DNA, 22 bp, Artificial Sequence
  chemically synthesized
gtagttttctaattggacactg

SEQ ID NO: 680775 - DNA, 22 bp, Artificial Sequence
  chemically synthesized
agtagttttctaattggacact

SEQ ID NO: 680776 - DNA, 22 bp, Artificial Sequence
  chemically synthesized
ttagtagttttctaattggaca

SEQ ID NO: 680777 - DNA, 22 bp, Artificial Sequence
  chemically synthesized
ttttctcagtgtccaattagaa

SEQ ID NO: 680778 - DNA, 22 bp, Artificial Sequence
  chemically synthesized
ttcttagtagttttctaattgg

SEQ ID NO: 680779 - DNA, 22 bp, Artificial Sequence
  chemically synthesized
ttctcagtgtccaattagaaaa

SEQ ID NO: 680780 - DNA, 22 bp, Artificial Sequence
  chemically synthesized
tctcagtgtccaattagaaaac

SEQ ID NO: 680781 - DNA, 22 bp, Artificial Sequence
  chemically synthesized
ctcagtgtccaattagaaaact

SEQ ID NO: 680782 - DNA, 22 bp, Artificial Sequence
  chemically synthesized
tcagtgtccaattagaaaacta

SEQ ID NO: 680783 - DNA, 22 bp, Artificial Sequence
  chemically synthesized
agtgtccaattagaaaactact

SEQ ID NO: 680784 - DNA, 22 bp, Artificial Sequence
  chemically synthesized
tcaacagattattcttagtagt

SEQ ID NO: 680785 - DNA, 22 bp, Artificial Sequence
  chemically synthesized
gtcaacagattattcttagtag

SEQ ID NO: 680786 - DNA, 22 bp, Artificial Sequence
  chemically synthesized
ttgtcaacagattattcttagt

SEQ ID NO: 680787 - DNA, 22 bp, Artificial Sequence
  chemically synthesized
cttgtcaacagattattcttag

SEQ ID NO: 680788 - DNA, 22 bp, Artificial Sequence
  chemically synthesized
tcttgtcaacagattattctta

SEQ ID NO: 680789 - DNA, 22 bp, Artificial Sequence
  chemically synthesized
ttcttgtcaacagattattctt

SEQ ID NO: 680790 - DNA, 22 bp, Artificial Sequence
  chemically synthesized
tttcttgtcaacagattattct

SEQ ID NO: 680791 - DNA, 22 bp, Artificial Sequence
  chemically synthesized
gaaaactactaagaataatctg

SEQ ID NO: 680792 - DNA, 22 bp, Artificial Sequence
  chemically synthesized
ttttcttgtcaacagattattc

SEQ ID NO: 680793 - DNA, 22 bp, Artificial Sequence
  chemically synthesized
ttttttcttgtcaacagattat

SEQ ID NO: 680794 - DNA, 22 bp, Artificial Sequence
  chemically synthesized
cattcttttttcttgtcaacag

SEQ ID NO: 680795 - DNA, 22 bp, Artificial Sequence
  chemically synthesized
ctaagaataatctgttgacaag

SEQ ID NO: 680796 - DNA, 22 bp, Artificial Sequence
  chemically synthesized
ttccattcttttttcttgtcaa

SEQ ID NO: 680797 - DNA, 22 bp, Artificial Sequence
  chemically synthesized
agaataatctgttgacaagaaa

SEQ ID NO: 680798 - DNA, 22 bp, Artificial Sequence
  chemically synthesized
attccattcttttttcttgtca

SEQ ID NO: 680799 - DNA, 22 bp, Artificial Sequence
  chemically synthesized
ttattccattcttttttcttgt

SEQ ID NO: 680800 - DNA, 22 bp, Artificial Sequence
  chemically synthesized
cttattccattcttttttcttg

SEQ ID NO: 680801 - DNA, 22 bp, Artificial Sequence
  chemically synthesized
ttgacaagaaaaaagaatggaa

SEQ ID NO: 680802 - DNA, 22 bp, Artificial Sequence
  chemically synthesized
acaagaaaaaagaatggaataa

SEQ ID NO: 680803 - DNA, 22 bp, Artificial Sequence
  chemically synthesized
aatagtgatttcttattccatt

SEQ ID NO: 680804 - DNA, 22 bp, Artificial Sequence
  chemically synthesized
aaaagtctgaatagtgatttct

SEQ ID NO: 680805 - DNA, 22 bp, Artificial Sequence
  chemically synthesized
aaaaagtctgaatagtgatttc

SEQ ID NO: 680806 - DNA, 22 bp, Artificial Sequence
  chemically synthesized
taaaaagtctgaatagtgattt

SEQ ID NO: 680807 - DNA, 22 bp, Artificial Sequence
  chemically synthesized
ttaaaaagtctgaatagtgatt

SEQ ID NO: 680808 - DNA, 22 bp, Artificial Sequence
  chemically synthesized
tttaaaaagtctgaatagtgat

SEQ ID NO: 680809 - DNA, 22 bp, Artificial Sequence
  chemically synthesized
ttttaaaaagtctgaatagtga

SEQ ID NO: 680810 - DNA, 22 bp, Artificial Sequence
  chemically synthesized
tcaatttttttaaaaagtctga

SEQ ID NO: 680811 - DNA, 22 bp, Artificial Sequence
  chemically synthesized
ccatctgtcaatttttttaaaa

SEQ ID NO: 680812 - DNA, 22 bp, Artificial Sequence
  chemically synthesized
ttcagactttttaaaaaaattg

SEQ ID NO: 680813 - DNA, 22 bp, Artificial Sequence
  chemically synthesized
agactttttaaaaaaattgaca

SEQ ID NO: 680814 - DNA, 22 bp, Artificial Sequence
  chemically synthesized
aggattgccatctgtcaatttt

SEQ ID NO: 680815 - DNA, 22 bp, Artificial Sequence
  chemically synthesized
gaggattgccatctgtcaattt

SEQ ID NO: 680816 - DNA, 22 bp, Artificial Sequence
  chemically synthesized
tgaggattgccatctgtcaatt

SEQ ID NO: 680817 - DNA, 22 bp, Artificial Sequence
  chemically synthesized
ttgaggattgccatctgtcaat

SEQ ID NO: 680818 - DNA, 22 bp, Artificial Sequence
  chemically synthesized
tttaaaaaaattgacagatggc

SEQ ID NO: 680819 - DNA, 22 bp, Artificial Sequence
  chemically synthesized
ttaaaaaaattgacagatggca

SEQ ID NO: 680820 - DNA, 22 bp, Artificial Sequence
  chemically synthesized
taaaaaaattgacagatggcaa

SEQ ID NO: 680821 - DNA, 22 bp, Artificial Sequence
  chemically synthesized
aaaaaaattgacagatggcaat

SEQ ID NO: 680822 - DNA, 22 bp, Artificial Sequence
  chemically synthesized
aaaaaattgacagatggcaatc

SEQ ID NO: 680823 - DNA, 22 bp, Artificial Sequence
  chemically synthesized
aagatgtatttttgaggattgc

SEQ ID NO: 680824 - DNA, 22 bp, Artificial Sequence
  chemically synthesized
aaagatgtatttttgaggattg

SEQ ID NO: 680825 - DNA, 22 bp, Artificial Sequence
  chemically synthesized
acagatggcaatcctcaaaaat

SEQ ID NO: 680826 - DNA, 22 bp, Artificial Sequence
  chemically synthesized
aaaaagaacttaaagatgtatt

SEQ ID NO: 680827 - DNA, 22 bp, Artificial Sequence
  chemically synthesized
cagtctaaaaaagaacttaaag

SEQ ID NO: 680828 - DNA, 22 bp, Artificial Sequence
  chemically synthesized
aaaaatacatctttaagttctt

SEQ ID NO: 680829 - DNA, 22 bp, Artificial Sequence
  chemically synthesized
taactccagtctaaaaaagaac

SEQ ID NO: 680830 - DNA, 22 bp, Artificial Sequence
  chemically synthesized
taagttcttttttagactggag

SEQ ID NO: 680831 - DNA, 22 bp, Artificial Sequence
  chemically synthesized
aagtgcctataactccagtcta

SEQ ID NO: 680832 - DNA, 22 bp, Artificial Sequence
  chemically synthesized
aagttcttttttagactggagt

SEQ ID NO: 680833 - DNA, 22 bp, Artificial Sequence
  chemically synthesized
caagtgcctataactccagtct

SEQ ID NO: 680834 - DNA, 22 bp, Artificial Sequence
  chemically synthesized
agttcttttttagactggagtt

SEQ ID NO: 680835 - DNA, 22 bp, Artificial Sequence
  chemically synthesized
ttttttagactggagttatagg

SEQ ID NO: 680836 - DNA, 22 bp, Artificial Sequence
  chemically synthesized
ttttagactggagttataggca

SEQ ID NO: 680837 - DNA, 22 bp, Artificial Sequence
  chemically synthesized
tttagactggagttataggcac

SEQ ID NO: 680838 - DNA, 22 bp, Artificial Sequence
  chemically synthesized
ttagactggagttataggcact

SEQ ID NO: 680839 - DNA, 22 bp, Artificial Sequence
  chemically synthesized
tagactggagttataggcactt

SEQ ID NO: 680840 - DNA, 22 bp, Artificial Sequence
  chemically synthesized
agactggagttataggcacttg

SEQ ID NO: 680841 - DNA, 22 bp, Artificial Sequence
  chemically synthesized
ggaacaagtcttcaagtgccta

SEQ ID NO: 680842 - DNA, 22 bp, Artificial Sequence
  chemically synthesized
gactggagttataggcacttga

SEQ ID NO: 680843 - DNA, 22 bp, Artificial Sequence
  chemically synthesized
gggaacaagtcttcaagtgcct

SEQ ID NO: 680844 - DNA, 22 bp, Artificial Sequence
  chemically synthesized
gagttataggcacttgaagact

SEQ ID NO: 680845 - DNA, 22 bp, Artificial Sequence
  chemically synthesized
taggcacttgaagacttgttcc

SEQ ID NO: 680846 - DNA, 22 bp, Artificial Sequence
  chemically synthesized
taatatgacgtcaagatttggg

SEQ ID NO: 680847 - DNA, 22 bp, Artificial Sequence
  chemically synthesized
gaagacttgttcccaaatcttg

SEQ ID NO: 680848 - DNA, 22 bp, Artificial Sequence
  chemically synthesized
aagacttgttcccaaatcttga

SEQ ID NO: 680849 - DNA, 22 bp, Artificial Sequence
  chemically synthesized
attataatatgacgtcaagatt

SEQ ID NO: 680850 - DNA, 22 bp, Artificial Sequence
  chemically synthesized
aattataatatgacgtcaagat

SEQ ID NO: 680851 - DNA, 22 bp, Artificial Sequence
  chemically synthesized
gttcccaaatcttgacgtcata

SEQ ID NO: 680852 - DNA, 22 bp, Artificial Sequence
  chemically synthesized
ttcccaaatcttgacgtcatat

SEQ ID NO: 680853 - DNA, 22 bp, Artificial Sequence
  chemically synthesized
agtatttaattataatatgacg

SEQ ID NO: 680854 - DNA, 22 bp, Artificial Sequence
  chemically synthesized
ccaaatcttgacgtcatattat

SEQ ID NO: 680855 - DNA, 22 bp, Artificial Sequence
  chemically synthesized
cagtatttaattataatatgac

SEQ ID NO: 680856 - DNA, 22 bp, Artificial Sequence
  chemically synthesized
tcagtatttaattataatatga

SEQ ID NO: 680857 - DNA, 22 bp, Artificial Sequence
  chemically synthesized
atactttcagtatttaattata

SEQ ID NO: 680858 - DNA, 22 bp, Artificial Sequence
  chemically synthesized
aatactttcagtatttaattat

SEQ ID NO: 680859 - DNA, 22 bp, Artificial Sequence
  chemically synthesized
gacgtcatattataattaaata

SEQ ID NO: 680860 - DNA, 22 bp, Artificial Sequence
  chemically synthesized
acgtcatattataattaaatac

SEQ ID NO: 680861 - DNA, 22 bp, Artificial Sequence
  chemically synthesized
ttaatactttcagtatttaatt

SEQ ID NO: 680862 - DNA, 22 bp, Artificial Sequence
  chemically synthesized
cttaatactttcagtatttaat

SEQ ID NO: 680863 - DNA, 22 bp, Artificial Sequence
  chemically synthesized
taattaaatactgaaagtatta

SEQ ID NO: 680864 - DNA, 22 bp, Artificial Sequence
  chemically synthesized
aatactgaaagtattaagaaat

SEQ ID NO: 680865 - DNA, 22 bp, Artificial Sequence
  chemically synthesized
tgatgcccgcgtcatttcttaa

SEQ ID NO: 680866 - DNA, 22 bp, Artificial Sequence
  chemically synthesized
tgtgatgcccgcgtcatttctt

SEQ ID NO: 680867 - DNA, 22 bp, Artificial Sequence
  chemically synthesized
aaagtattaagaaatgacgcgg

SEQ ID NO: 680868 - DNA, 22 bp, Artificial Sequence
  chemically synthesized
agaaatgacgcgggcatcacag

SEQ ID NO: 680869 - DNA, 22 bp, Artificial Sequence
  chemically synthesized
aacaacaaaacagtctctgtga

SEQ ID NO: 680870 - DNA, 22 bp, Artificial Sequence
  chemically synthesized
caattgaacaacaaaacagtct

SEQ ID NO: 680871 - DNA, 22 bp, Artificial Sequence
  chemically synthesized
actgcaattgaacaacaaaaca

SEQ ID NO: 680872 - DNA, 22 bp, Artificial Sequence
  chemically synthesized
ataatctgactgcaattgaaca

SEQ ID NO: 680873 - DNA, 22 bp, Artificial Sequence
  chemically synthesized
ttttgttgttcaattgcagtca

SEQ ID NO: 680874 - DNA, 22 bp, Artificial Sequence
  chemically synthesized
tgttgttcaattgcagtcagat

SEQ ID NO: 680875 - DNA, 22 bp, Artificial Sequence
  chemically synthesized
gttgttcaattgcagtcagatt

SEQ ID NO: 680876 - DNA, 22 bp, Artificial Sequence
  chemically synthesized
ttgttcaattgcagtcagatta

SEQ ID NO: 680877 - DNA, 22 bp, Artificial Sequence
  chemically synthesized
ataagcaaaattcataatctga

SEQ ID NO: 680878 - DNA, 22 bp, Artificial Sequence
  chemically synthesized
ttcaattgcagtcagattatga

SEQ ID NO: 680879 - DNA, 22 bp, Artificial Sequence
  chemically synthesized
taataagcaaaattcataatct

SEQ ID NO: 680880 - DNA, 22 bp, Artificial Sequence
  chemically synthesized
aattgcagtcagattatgaatt

SEQ ID NO: 680881 - DNA, 22 bp, Artificial Sequence
  chemically synthesized
ctctaataagcaaaattcataa

SEQ ID NO: 680882 - DNA, 22 bp, Artificial Sequence
  chemically synthesized
cctctaataagcaaaattcata

SEQ ID NO: 680883 - DNA, 22 bp, Artificial Sequence
  chemically synthesized
tcctctaataagcaaaattcat

SEQ ID NO: 680884 - DNA, 22 bp, Artificial Sequence
  chemically synthesized
cagtcagattatgaattttgct

SEQ ID NO: 680885 - DNA, 22 bp, Artificial Sequence
  chemically synthesized
caaatgctttcctctaataagc

SEQ ID NO: 680886 - DNA, 22 bp, Artificial Sequence
  chemically synthesized
ccaaatgctttcctctaataag

SEQ ID NO: 680887 - DNA, 22 bp, Artificial Sequence
  chemically synthesized
tccaaatgctttcctctaataa

SEQ ID NO: 680888 - DNA, 22 bp, Artificial Sequence
  chemically synthesized
ttccaaatgctttcctctaata

SEQ ID NO: 680889 - DNA, 22 bp, Artificial Sequence
  chemically synthesized
tgaattttgcttattagaggaa

SEQ ID NO: 680890 - DNA, 22 bp, Artificial Sequence
  chemically synthesized
ttttccaaatgctttcctctaa

SEQ ID NO: 680891 - DNA, 22 bp, Artificial Sequence
  chemically synthesized
tgttcttttccaaatgctttcc

SEQ ID NO: 680892 - DNA, 22 bp, Artificial Sequence
  chemically synthesized
tgcttattagaggaaagcattt

SEQ ID NO: 680893 - DNA, 22 bp, Artificial Sequence
  chemically synthesized
gcttattagaggaaagcatttg

SEQ ID NO: 680894 - DNA, 22 bp, Artificial Sequence
  chemically synthesized
cttattagaggaaagcatttgg

SEQ ID NO: 680895 - DNA, 22 bp, Artificial Sequence
  chemically synthesized
attagaggaaagcatttggaaa

SEQ ID NO: 680896 - DNA, 22 bp, Artificial Sequence
  chemically synthesized
ttagaggaaagcatttggaaaa

SEQ ID NO: 680897 - DNA, 22 bp, Artificial Sequence
  chemically synthesized
gaggaaagcatttggaaaagaa

SEQ ID NO: 680898 - DNA, 22 bp, Artificial Sequence
  chemically synthesized
ggaaaagaacataattgatata

SEQ ID NO: 680899 - DNA, 22 bp, Artificial Sequence
  chemically synthesized
gaaaagaacataattgatatac

SEQ ID NO: 680900 - DNA, 22 bp, Artificial Sequence
  chemically synthesized
catatgacacgaaggtatatca

SEQ ID NO: 680901 - DNA, 22 bp, Artificial Sequence
  chemically synthesized
acatatgacacgaaggtatatc

SEQ ID NO: 680902 - DNA, 22 bp, Artificial Sequence
  chemically synthesized
cataatttacatatgacacgaa

SEQ ID NO: 680903 - DNA, 22 bp, Artificial Sequence
  chemically synthesized
atataccttcgtgtcatatgta

SEQ ID NO: 680904 - DNA, 22 bp, Artificial Sequence
  chemically synthesized
cgtgtcatatgtaaattatgta

SEQ ID NO: 680905 - DNA, 22 bp, Artificial Sequence
  chemically synthesized
gtgtcatatgtaaattatgtag

SEQ ID NO: 680906 - DNA, 22 bp, Artificial Sequence
  chemically synthesized
tcatacatggcatcactacata

SEQ ID NO: 680907 - DNA, 22 bp, Artificial Sequence
  chemically synthesized
tgtagtgatgccatgtatgata

SEQ ID NO: 680908 - DNA, 22 bp, Artificial Sequence
  chemically synthesized
taaacaaacaatatattatcat

SEQ ID NO: 680909 - DNA, 22 bp, Artificial Sequence
  chemically synthesized
ctataaacaaacaatatattat

SEQ ID NO: 680910 - DNA, 22 bp, Artificial Sequence
  chemically synthesized
tttgtttatagtagatgtttct

SEQ ID NO: 680911 - DNA, 22 bp, Artificial Sequence
  chemically synthesized
gtttatagtagatgtttcttct

SEQ ID NO: 680912 - DNA, 22 bp, Artificial Sequence
  chemically synthesized
tttatagtagatgtttcttctt

SEQ ID NO: 680913 - DNA, 22 bp, Artificial Sequence
  chemically synthesized
atagtagatgtttcttcttctc

SEQ ID NO: 680914 - DNA, 22 bp, Artificial Sequence
  chemically synthesized
tagtagatgtttcttcttctcc

SEQ ID NO: 680915 - DNA, 22 bp, Artificial Sequence
  chemically synthesized
cttcttctcctccttctgatta

SEQ ID NO: 680916 - DNA, 22 bp, Artificial Sequence
  chemically synthesized
ttcttctcctccttctgattat

SEQ ID NO: 680917 - DNA, 22 bp, Artificial Sequence
  chemically synthesized
cttctcctccttctgattatat

SEQ ID NO: 680918 - DNA, 22 bp, Artificial Sequence
  chemically synthesized
ttctcctccttctgattatatt

SEQ ID NO: 680919 - DNA, 22 bp, Artificial Sequence
  chemically synthesized
ctcctccttctgattatattat

SEQ ID NO: 680920 - DNA, 22 bp, Artificial Sequence
  chemically synthesized
tcctccttctgattatattatt

SEQ ID NO: 680921 - DNA, 22 bp, Artificial Sequence
  chemically synthesized
ctccttctgattatattattat

SEQ ID NO: 680922 - DNA, 22 bp, Artificial Sequence
  chemically synthesized
cttctgattatattattattat

SEQ ID NO: 680923 - DNA, 22 bp, Artificial Sequence
  chemically synthesized
ctgattatattattattattat

SEQ ID NO: 680924 - DNA, 22 bp, Artificial Sequence
  chemically synthesized
tgattatattattattattatt

SEQ ID NO: 680925 - DNA, 22 bp, Artificial Sequence
  chemically synthesized
attatattattattattattat

SEQ ID NO: 680926 - DNA, 22 bp, Artificial Sequence
  chemically synthesized
atatcaaaacagtaataataat

SEQ ID NO: 680927 - DNA, 22 bp, Artificial Sequence
  chemically synthesized
tattattattattattattact

SEQ ID NO: 680928 - DNA, 22 bp, Artificial Sequence
  chemically synthesized
ttattattattattactgtttt

SEQ ID NO: 680929 - DNA, 22 bp, Artificial Sequence
  chemically synthesized
ttattattattactgttttgat

SEQ ID NO: 680930 - DNA, 22 bp, Artificial Sequence
  chemically synthesized
ttattattactgttttgatatg

SEQ ID NO: 680931 - DNA, 22 bp, Artificial Sequence
  chemically synthesized
atgtccgtggttcatatcaaaa

SEQ ID NO: 680932 - DNA, 22 bp, Artificial Sequence
  chemically synthesized
catgtccgtggttcatatcaaa

SEQ ID NO: 680933 - DNA, 22 bp, Artificial Sequence
  chemically synthesized
tcatgtccgtggttcatatcaa

SEQ ID NO: 680934 - DNA, 22 bp, Artificial Sequence
  chemically synthesized
ttattactgttttgatatgaac

SEQ ID NO: 680935 - DNA, 22 bp, Artificial Sequence
  chemically synthesized
ttcatgtccgtggttcatatca

SEQ ID NO: 680936 - DNA, 22 bp, Artificial Sequence
  chemically synthesized
ttttcatgtccgtggttcatat

SEQ ID NO: 680937 - DNA, 22 bp, Artificial Sequence
  chemically synthesized
ttactgttttgatatgaaccac

SEQ ID NO: 680938 - DNA, 22 bp, Artificial Sequence
  chemically synthesized
ctgttttgatatgaaccacgga

SEQ ID NO: 680939 - DNA, 22 bp, Artificial Sequence
  chemically synthesized
aggctcttttcatgtccgtggt

SEQ ID NO: 680940 - DNA, 22 bp, Artificial Sequence
  chemically synthesized
ttttgatatgaaccacggacat

SEQ ID NO: 680941 - DNA, 22 bp, Artificial Sequence
  chemically synthesized
caggctcttttcatgtccgtgg

SEQ ID NO: 680942 - DNA, 22 bp, Artificial Sequence
  chemically synthesized
tgatatgaaccacggacatgaa

SEQ ID NO: 680943 - DNA, 22 bp, Artificial Sequence
  chemically synthesized
gatatgaaccacggacatgaaa

SEQ ID NO: 680944 - DNA, 22 bp, Artificial Sequence
  chemically synthesized
atatgaaccacggacatgaaaa

SEQ ID NO: 680945 - DNA, 22 bp, Artificial Sequence
  chemically synthesized
gtagcagagcttcaggctcttt

SEQ ID NO: 680946 - DNA, 22 bp, Artificial Sequence
  chemically synthesized
tggtagcagagcttcaggctct

SEQ ID NO: 680947 - DNA, 22 bp, Artificial Sequence
  chemically synthesized
ttctggtagcagagcttcaggc

SEQ ID NO: 680948 - DNA, 22 bp, Artificial Sequence
  chemically synthesized
gttctggtagcagagcttcagg

SEQ ID NO: 680949 - DNA, 22 bp, Artificial Sequence
  chemically synthesized
aagtttgttctggtagcagagc

SEQ ID NO: 680950 - DNA, 22 bp, Artificial Sequence
  chemically synthesized
gctgaagtttgttctggtagca

SEQ ID NO: 680951 - DNA, 22 bp, Artificial Sequence
  chemically synthesized
agctgaagtttgttctggtagc

SEQ ID NO: 680952 - DNA, 22 bp, Artificial Sequence
  chemically synthesized
tagctgaagtttgttctggtag

SEQ ID NO: 680953 - DNA, 22 bp, Artificial Sequence
  chemically synthesized
aagctctgctaccagaacaaac

SEQ ID NO: 680954 - DNA, 22 bp, Artificial Sequence
  chemically synthesized
tgctaccagaacaaacttcagc

SEQ ID NO: 680955 - DNA, 22 bp, Artificial Sequence
  chemically synthesized
ctaccagaacaaacttcagcta

SEQ ID NO: 680956 - DNA, 22 bp, Artificial Sequence
  chemically synthesized
aagtcaaaattttagctgaagt

SEQ ID NO: 680957 - DNA, 22 bp, Artificial Sequence
  chemically synthesized
tgaagtcaaaattttagctgaa

SEQ ID NO: 680958 - DNA, 22 bp, Artificial Sequence
  chemically synthesized
ccagaacaaacttcagctaaaa

SEQ ID NO: 680959 - DNA, 22 bp, Artificial Sequence
  chemically synthesized
attctgaagtcaaaattttagc

SEQ ID NO: 680960 - DNA, 22 bp, Artificial Sequence
  chemically synthesized
cagctaaaattttgacttcaga

SEQ ID NO: 680961 - DNA, 22 bp, Artificial Sequence
  chemically synthesized
agctaaaattttgacttcagaa

SEQ ID NO: 680962 - DNA, 22 bp, Artificial Sequence
  chemically synthesized
aaattttgacttcagaatcagc

SEQ ID NO: 680963 - DNA, 22 bp, Artificial Sequence
  chemically synthesized
ggaacaagtaggtcatggctga

SEQ ID NO: 680964 - DNA, 22 bp, Artificial Sequence
  chemically synthesized
tgacttcagaatcagccatgac

SEQ ID NO: 680965 - DNA, 22 bp, Artificial Sequence
  chemically synthesized
gacttcagaatcagccatgacc

SEQ ID NO: 680966 - DNA, 22 bp, Artificial Sequence
  chemically synthesized
acttcagaatcagccatgacct

SEQ ID NO: 680967 - DNA, 22 bp, Artificial Sequence
  chemically synthesized
cagaatcagccatgacctactt

SEQ ID NO: 680968 - DNA, 22 bp, Artificial Sequence
  chemically synthesized
agaatcagccatgacctacttg

SEQ ID NO: 680969 - DNA, 22 bp, Artificial Sequence
  chemically synthesized
gacagtggtactgggaacaagt

SEQ ID NO: 680970 - DNA, 22 bp, Artificial Sequence
  chemically synthesized
tagacagtggtactgggaacaa

SEQ ID NO: 680971 - DNA, 22 bp, Artificial Sequence
  chemically synthesized
caccattctagacagtggtact

SEQ ID NO: 680972 - DNA, 22 bp, Artificial Sequence
  chemically synthesized
gcaccattctagacagtggtac

SEQ ID NO: 680973 - DNA, 22 bp, Artificial Sequence
  chemically synthesized
cttgttcccagtaccactgtct

SEQ ID NO: 680974 - DNA, 22 bp, Artificial Sequence
  chemically synthesized
gttcccagtaccactgtctaga

SEQ ID NO: 680975 - DNA, 22 bp, Artificial Sequence
  chemically synthesized
ttcccagtaccactgtctagaa

SEQ ID NO: 680976 - DNA, 22 bp, Artificial Sequence
  chemically synthesized
caatccttgcaccattctagac

SEQ ID NO: 680977 - DNA, 22 bp, Artificial Sequence
  chemically synthesized
ccagtaccactgtctagaatgg

SEQ ID NO: 680978 - DNA, 22 bp, Artificial Sequence
  chemically synthesized
cccaattccaatccttgcacca

SEQ ID NO: 680979 - DNA, 22 bp, Artificial Sequence
  chemically synthesized
tctagaatggtgcaaggattgg

SEQ ID NO: 680980 - DNA, 22 bp, Artificial Sequence
  chemically synthesized
gattccccaattccaatccttg

SEQ ID NO: 680981 - DNA, 22 bp, Artificial Sequence
  chemically synthesized
gaatggtgcaaggattggaatt

SEQ ID NO: 680982 - DNA, 22 bp, Artificial Sequence
  chemically synthesized
gagctggattccccaattccaa

SEQ ID NO: 680983 - DNA, 22 bp, Artificial Sequence
  chemically synthesized
cgagctggattccccaattcca

SEQ ID NO: 680984 - DNA, 22 bp, Artificial Sequence
  chemically synthesized
gaattggggaatccagctcgaa

SEQ ID NO: 680985 - DNA, 22 bp, Artificial Sequence
  chemically synthesized
agcgcatgagtcttcgagctgg

SEQ ID NO: 680986 - DNA, 22 bp, Artificial Sequence
  chemically synthesized
gggaatccagctcgaagactca

SEQ ID NO: 680987 - DNA, 22 bp, Artificial Sequence
  chemically synthesized
gaagactcatgcgcttagctat

SEQ ID NO: 680988 - DNA, 22 bp, Artificial Sequence
  chemically synthesized
atggcagcatagcagaatagct

SEQ ID NO: 680989 - DNA, 22 bp, Artificial Sequence
  chemically synthesized
catggcagcatagcagaatagc

SEQ ID NO: 680990 - DNA, 22 bp, Artificial Sequence
  chemically synthesized
ttcatggcagcatagcagaata

SEQ ID NO: 680991 - DNA, 22 bp, Artificial Sequence
  chemically synthesized
atgcgcttagctattctgctat

SEQ ID NO: 680992 - DNA, 22 bp, Artificial Sequence
  chemically synthesized
agctattctgctatgctgccat

SEQ ID NO: 680993 - DNA, 22 bp, Artificial Sequence
  chemically synthesized
gctattctgctatgctgccatg

SEQ ID NO: 680994 - DNA, 22 bp, Artificial Sequence
  chemically synthesized
ttctgctatgctgccatgaaga

SEQ ID NO: 680995 - DNA, 22 bp, Artificial Sequence
  chemically synthesized
tgctatgctgccatgaagagac

SEQ ID NO: 680996 - DNA, 22 bp, Artificial Sequence
  chemically synthesized
ctatgctgccatgaagagacat

SEQ ID NO: 680997 - DNA, 22 bp, Artificial Sequence
  chemically synthesized
tgctgccatgaagagacatggc

SEQ ID NO: 680998 - DNA, 22 bp, Artificial Sequence
  chemically synthesized
acaggaaaagaagccatgtctc

SEQ ID NO: 680999 - DNA, 22 bp, Artificial Sequence
  chemically synthesized
tcacaggaaaagaagccatgtc

SEQ ID NO: 681000 - DNA, 22 bp, Artificial Sequence
  chemically synthesized
ctcacaggaaaagaagccatgt

SEQ ID NO: 681001 - DNA, 22 bp, Artificial Sequence
  chemically synthesized
tctcacaggaaaagaagccatg

SEQ ID NO: 681002 - DNA, 22 bp, Artificial Sequence
  chemically synthesized
ccatgaagagacatggcttctt

SEQ ID NO: 681003 - DNA, 22 bp, Artificial Sequence
  chemically synthesized
gaaaaaacacagacctttctca

SEQ ID NO: 681004 - DNA, 22 bp, Artificial Sequence
  chemically synthesized
cttttcctgtgagaaaggtctg

SEQ ID NO: 681005 - DNA, 22 bp, Artificial Sequence
  chemically synthesized
ttttcctgtgagaaaggtctgt

SEQ ID NO: 681006 - DNA, 22 bp, Artificial Sequence
  chemically synthesized
ttcctgtgagaaaggtctgtgt

SEQ ID NO: 681007 - DNA, 22 bp, Artificial Sequence
  chemically synthesized
tcctgtgagaaaggtctgtgtt

SEQ ID NO: 681008 - DNA, 22 bp, Artificial Sequence
  chemically synthesized
cctgtgagaaaggtctgtgttt

SEQ ID NO: 681009 - DNA, 22 bp, Artificial Sequence
  chemically synthesized
ctgtgagaaaggtctgtgtttt

SEQ ID NO: 681010 - DNA, 22 bp, Artificial Sequence
  chemically synthesized
tgagtatactagaaaaaacaca

SEQ ID NO: 681011 - DNA, 22 bp, Artificial Sequence
  chemically synthesized
tgagaaaggtctgtgttttttc

SEQ ID NO: 681012 - DNA, 22 bp, Artificial Sequence
  chemically synthesized
tctatgagtatactagaaaaaa

SEQ ID NO: 681013 - DNA, 22 bp, Artificial Sequence
  chemically synthesized
tgttttttctagtatactcata

SEQ ID NO: 681014 - DNA, 22 bp, Artificial Sequence
  chemically synthesized
tttctagtatactcatagacaa

SEQ ID NO: 681015 - DNA, 22 bp, Artificial Sequence
  chemically synthesized
ttctagtatactcatagacaat

SEQ ID NO: 681016 - DNA, 22 bp, Artificial Sequence
  chemically synthesized
tctagtatactcatagacaatc

SEQ ID NO: 681017 - DNA, 22 bp, Artificial Sequence
  chemically synthesized
agccatcagtgagattgtctat

SEQ ID NO: 681018 - DNA, 22 bp, Artificial Sequence
  chemically synthesized
ctagtatactcatagacaatct

SEQ ID NO: 681019 - DNA, 22 bp, Artificial Sequence
  chemically synthesized
tagtatactcatagacaatctc

SEQ ID NO: 681020 - DNA, 22 bp, Artificial Sequence
  chemically synthesized
tgagccatcagtgagattgtct

SEQ ID NO: 681021 - DNA, 22 bp, Artificial Sequence
  chemically synthesized
gtatactcatagacaatctcac

SEQ ID NO: 681022 - DNA, 22 bp, Artificial Sequence
  chemically synthesized
ctctgagccatcagtgagattg

SEQ ID NO: 681023 - DNA, 22 bp, Artificial Sequence
  chemically synthesized
tgctctgagccatcagtgagat

SEQ ID NO: 681024 - DNA, 22 bp, Artificial Sequence
  chemically synthesized
tctgctctgagccatcagtgag

SEQ ID NO: 681025 - DNA, 22 bp, Artificial Sequence
  chemically synthesized
ctctgctctgagccatcagtga

SEQ ID NO: 681026 - DNA, 22 bp, Artificial Sequence
  chemically synthesized
atagacaatctcactgatggct

SEQ ID NO: 681027 - DNA, 22 bp, Artificial Sequence
  chemically synthesized
ttctctgctctgagccatcagt

SEQ ID NO: 681028 - DNA, 22 bp, Artificial Sequence
  chemically synthesized
ctcttctctgctctgagccatc

SEQ ID NO: 681029 - DNA, 22 bp, Artificial Sequence
  chemically synthesized
actcttctctgctctgagccat

SEQ ID NO: 681030 - DNA, 22 bp, Artificial Sequence
  chemically synthesized
actgatggctcagagcagagaa

SEQ ID NO: 681031 - DNA, 22 bp, Artificial Sequence
  chemically synthesized
gcaaatttactcttctctgctc

SEQ ID NO: 681032 - DNA, 22 bp, Artificial Sequence
  chemically synthesized
tagcaaatttactcttctctgc

SEQ ID NO: 681033 - DNA, 22 bp, Artificial Sequence
  chemically synthesized
ctagcaaatttactcttctctg

SEQ ID NO: 681034 - DNA, 22 bp, Artificial Sequence
  chemically synthesized
atggctcagagcagagaagagt

SEQ ID NO: 681035 - DNA, 22 bp, Artificial Sequence
  chemically synthesized
tttctagcaaatttactcttct

SEQ ID NO: 681036 - DNA, 22 bp, Artificial Sequence
  chemically synthesized
tatttctagcaaatttactctt

SEQ ID NO: 681037 - DNA, 22 bp, Artificial Sequence
  chemically synthesized
agagcagagaagagtaaatttg

SEQ ID NO: 681038 - DNA, 22 bp, Artificial Sequence
  chemically synthesized
tctctatttctagcaaatttac

SEQ ID NO: 681039 - DNA, 22 bp, Artificial Sequence
  chemically synthesized
atctctatttctagcaaattta

SEQ ID NO: 681040 - DNA, 22 bp, Artificial Sequence
  chemically synthesized
tatctctatttctagcaaattt

SEQ ID NO: 681041 - DNA, 22 bp, Artificial Sequence
  chemically synthesized
tttatctctatttctagcaaat

SEQ ID NO: 681042 - DNA, 22 bp, Artificial Sequence
  chemically synthesized
ctttatctctatttctagcaaa

SEQ ID NO: 681043 - DNA, 22 bp, Artificial Sequence
  chemically synthesized
ttctttatctctatttctagca

SEQ ID NO: 681044 - DNA, 22 bp, Artificial Sequence
  chemically synthesized
cttctttatctctatttctagc

SEQ ID NO: 681045 - DNA, 22 bp, Artificial Sequence
  chemically synthesized
atttcttctttatctctatttc

SEQ ID NO: 681046 - DNA, 22 bp, Artificial Sequence
  chemically synthesized
catttcttctttatctctattt

SEQ ID NO: 681047 - DNA, 22 bp, Artificial Sequence
  chemically synthesized
gctagaaatagagataaagaag

SEQ ID NO: 681048 - DNA, 22 bp, Artificial Sequence
  chemically synthesized
ctagaaatagagataaagaaga

SEQ ID NO: 681049 - DNA, 22 bp, Artificial Sequence
  chemically synthesized
atcccatttcatttcttcttta

SEQ ID NO: 681050 - DNA, 22 bp, Artificial Sequence
  chemically synthesized
gaaatagagataaagaagaaat

SEQ ID NO: 681051 - DNA, 22 bp, Artificial Sequence
  chemically synthesized
acctcatcccatttcatttctt

SEQ ID NO: 681052 - DNA, 22 bp, Artificial Sequence
  chemically synthesized
gacctcatcccatttcatttct

SEQ ID NO: 681053 - DNA, 22 bp, Artificial Sequence
  chemically synthesized
tgacctcatcccatttcatttc

SEQ ID NO: 681054 - DNA, 22 bp, Artificial Sequence
  chemically synthesized
tttgacctcatcccatttcatt

SEQ ID NO: 681055 - DNA, 22 bp, Artificial Sequence
  chemically synthesized
ctttgacctcatcccatttcat

SEQ ID NO: 681056 - DNA, 22 bp, Artificial Sequence
  chemically synthesized
ggtcgccttctttgacctcatc

SEQ ID NO: 681057 - DNA, 22 bp, Artificial Sequence
  chemically synthesized
cgggaaaatgtactgggtcgcc

SEQ ID NO: 681058 - DNA, 22 bp, Artificial Sequence
  chemically synthesized
gctacgggaaaatgtactgggt

SEQ ID NO: 681059 - DNA, 22 bp, Artificial Sequence
  chemically synthesized
ggctacgggaaaatgtactggg

SEQ ID NO: 681060 - DNA, 22 bp, Artificial Sequence
  chemically synthesized
tggctacgggaaaatgtactgg

SEQ ID NO: 681061 - DNA, 22 bp, Artificial Sequence
  chemically synthesized
aaagaccagagttttggctacg

SEQ ID NO: 681062 - DNA, 22 bp, Artificial Sequence
  chemically synthesized
agtggttcaaagaccagagttt

SEQ ID NO: 681063 - DNA, 22 bp, Artificial Sequence
  chemically synthesized
tcccgtagccaaaactctggtc

SEQ ID NO: 681064 - DNA, 22 bp, Artificial Sequence
  chemically synthesized
aagtggttcaaagaccagagtt

SEQ ID NO: 681065 - DNA, 22 bp, Artificial Sequence
  chemically synthesized
cccgtagccaaaactctggtct

SEQ ID NO: 681066 - DNA, 22 bp, Artificial Sequence
  chemically synthesized
ccgtagccaaaactctggtctt

SEQ ID NO: 681067 - DNA, 22 bp, Artificial Sequence
  chemically synthesized
aaagtttaagtggttcaaagac

SEQ ID NO: 681068 - DNA, 22 bp, Artificial Sequence
  chemically synthesized
tggtctttgaaccacttaaact

SEQ ID NO: 681069 - DNA, 22 bp, Artificial Sequence
  chemically synthesized
aagataccctcaaagtttaagt

SEQ ID NO: 681070 - DNA, 22 bp, Artificial Sequence
  chemically synthesized
gtctttgaaccacttaaacttt

SEQ ID NO: 681071 - DNA, 22 bp, Artificial Sequence
  chemically synthesized
taaagataccctcaaagtttaa

SEQ ID NO: 681072 - DNA, 22 bp, Artificial Sequence
  chemically synthesized
tctaaagataccctcaaagttt

SEQ ID NO: 681073 - DNA, 22 bp, Artificial Sequence
  chemically synthesized
tgaaccacttaaactttgaggg

SEQ ID NO: 681074 - DNA, 22 bp, Artificial Sequence
  chemically synthesized
gaaccacttaaactttgagggt

SEQ ID NO: 681075 - DNA, 22 bp, Artificial Sequence
  chemically synthesized
ttctctaaagataccctcaaag

SEQ ID NO: 681076 - DNA, 22 bp, Artificial Sequence
  chemically synthesized
aaccacttaaactttgagggta

SEQ ID NO: 681077 - DNA, 22 bp, Artificial Sequence
  chemically synthesized
attctctaaagataccctcaaa

SEQ ID NO: 681078 - DNA, 22 bp, Artificial Sequence
  chemically synthesized
aaactttgagggtatctttaga

SEQ ID NO: 681079 - DNA, 22 bp, Artificial Sequence
  chemically synthesized
aactttgagggtatctttagag

SEQ ID NO: 681080 - DNA, 22 bp, Artificial Sequence
  chemically synthesized
tgagggtatctttagagaataa

SEQ ID NO: 681081 - DNA, 22 bp, Artificial Sequence
  chemically synthesized
gagggtatctttagagaataag

SEQ ID NO: 681082 - DNA, 22 bp, Artificial Sequence
  chemically synthesized
agggtatctttagagaataagg

SEQ ID NO: 681083 - DNA, 22 bp, Artificial Sequence
  chemically synthesized
ggtcagagatgcccttattctc

SEQ ID NO: 681084 - DNA, 22 bp, Artificial Sequence
  chemically synthesized
aggtcagagatgcccttattct

SEQ ID NO: 681085 - DNA, 22 bp, Artificial Sequence
  chemically synthesized
tagagaataagggcatctctga

SEQ ID NO: 681086 - DNA, 22 bp, Artificial Sequence
  chemically synthesized
agagaataagggcatctctgac

SEQ ID NO: 681087 - DNA, 22 bp, Artificial Sequence
  chemically synthesized
gagaataagggcatctctgacc

SEQ ID NO: 681088 - DNA, 22 bp, Artificial Sequence
  chemically synthesized
cacagtcccttaggtcagagat

SEQ ID NO: 681089 - DNA, 22 bp, Artificial Sequence
  chemically synthesized
tgacctaagggactgtgcagga

SEQ ID NO: 681090 - DNA, 22 bp, Artificial Sequence
  chemically synthesized
acctaagggactgtgcaggatg

SEQ ID NO: 681091 - DNA, 22 bp, Artificial Sequence
  chemically synthesized
agggactgtgcaggatgcttcc

SEQ ID NO: 681092 - DNA, 22 bp, Artificial Sequence
  chemically synthesized
tgcaggatgcttccccattctc

SEQ ID NO: 681093 - DNA, 22 bp, Artificial Sequence
  chemically synthesized
ccccattctcccatccatctct

SEQ ID NO: 681094 - DNA, 22 bp, Artificial Sequence
  chemically synthesized
cccattctcccatccatctcta

SEQ ID NO: 681095 - DNA, 22 bp, Artificial Sequence
  chemically synthesized
tcccatccatctctattctttg

SEQ ID NO: 681096 - DNA, 22 bp, Artificial Sequence
  chemically synthesized
ccatccatctctattctttgtc

SEQ ID NO: 681097 - DNA, 22 bp, Artificial Sequence
  chemically synthesized
tattctttgtccttctccattc

SEQ ID NO: 681098 - DNA, 22 bp, Artificial Sequence
  chemically synthesized
ggccacagagcagaatggagaa

SEQ ID NO: 681099 - DNA, 22 bp, Artificial Sequence
  chemically synthesized
ttctttgtccttctccattctg

SEQ ID NO: 681100 - DNA, 22 bp, Artificial Sequence
  chemically synthesized
ctgggccacagagcagaatgga

SEQ ID NO: 681101 - DNA, 22 bp, Artificial Sequence
  chemically synthesized
tttgtccttctccattctgctc

SEQ ID NO: 681102 - DNA, 22 bp, Artificial Sequence
  chemically synthesized
tgtccttctccattctgctctg

SEQ ID NO: 681103 - DNA, 22 bp, Artificial Sequence
  chemically synthesized
gtccttctccattctgctctgt

SEQ ID NO: 681104 - DNA, 22 bp, Artificial Sequence
  chemically synthesized
tccttctccattctgctctgtg

SEQ ID NO: 681105 - DNA, 22 bp, Artificial Sequence
  chemically synthesized
ctccattctgctctgtggccca

SEQ ID NO: 681106 - DNA, 22 bp, Artificial Sequence
  chemically synthesized
tccattctgctctgtggcccag

SEQ ID NO: 681107 - DNA, 22 bp, Artificial Sequence
  chemically synthesized
cattctgctctgtggcccagga

SEQ ID NO: 681108 - DNA, 22 bp, Artificial Sequence
  chemically synthesized
tgctctgtggcccaggaggttg

SEQ ID NO: 681109 - DNA, 22 bp, Artificial Sequence
  chemically synthesized
ctctgtggcccaggaggttgga

SEQ ID NO: 681110 - DNA, 22 bp, Artificial Sequence
  chemically synthesized
tgtggcccaggaggttggacct

SEQ ID NO: 681111 - DNA, 22 bp, Artificial Sequence
  chemically synthesized
atgtccccacagaggtccaacc

SEQ ID NO: 681112 - DNA, 22 bp, Artificial Sequence
  chemically synthesized
tggcccaggaggttggacctct

SEQ ID NO: 681113 - DNA, 22 bp, Artificial Sequence
  chemically synthesized
attgatgtccccacagaggtcc

SEQ ID NO: 681114 - DNA, 22 bp, Artificial Sequence
  chemically synthesized
gacctctgtggggacatcaatc

SEQ ID NO: 681115 - DNA, 22 bp, Artificial Sequence
  chemically synthesized
tgtggggacatcaatcaggctt

SEQ ID NO: 681116 - DNA, 22 bp, Artificial Sequence
  chemically synthesized
tggggacatcaatcaggctttc

SEQ ID NO: 681117 - DNA, 22 bp, Artificial Sequence
  chemically synthesized
aaagcaaaaggaagccaaacgg

SEQ ID NO: 681118 - DNA, 22 bp, Artificial Sequence
  chemically synthesized
gctgaaagcaaaaggaagccaa

SEQ ID NO: 681119 - DNA, 22 bp, Artificial Sequence
  chemically synthesized
tcctgccgtttggcttcctttt

SEQ ID NO: 681120 - DNA, 22 bp, Artificial Sequence
  chemically synthesized
cctgccgtttggcttccttttg

SEQ ID NO: 681121 - DNA, 22 bp, Artificial Sequence
  chemically synthesized
ctgccgtttggcttccttttgc

SEQ ID NO: 681122 - DNA, 22 bp, Artificial Sequence
  chemically synthesized
ccaattggctgaaagcaaaagg

SEQ ID NO: 681123 - DNA, 22 bp, Artificial Sequence
  chemically synthesized
ccgtttggcttccttttgcttt

SEQ ID NO: 681124 - DNA, 22 bp, Artificial Sequence
  chemically synthesized
cctcccaattggctgaaagcaa

SEQ ID NO: 681125 - DNA, 22 bp, Artificial Sequence
  chemically synthesized
ggcttccttttgctttcagcca

SEQ ID NO: 681126 - DNA, 22 bp, Artificial Sequence
  chemically synthesized
gcttccttttgctttcagccaa

SEQ ID NO: 681127 - DNA, 22 bp, Artificial Sequence
  chemically synthesized
atcactgcctcccaattggctg

SEQ ID NO: 681128 - DNA, 22 bp, Artificial Sequence
  chemically synthesized
ccttttgctttcagccaattgg

SEQ ID NO: 681129 - DNA, 22 bp, Artificial Sequence
  chemically synthesized
catcactgcctcccaattggct

SEQ ID NO: 681130 - DNA, 22 bp, Artificial Sequence
  chemically synthesized
cttttgctttcagccaattggg

SEQ ID NO: 681131 - DNA, 22 bp, Artificial Sequence
  chemically synthesized
tcatcactgcctcccaattggc

SEQ ID NO: 681132 - DNA, 22 bp, Artificial Sequence
  chemically synthesized
ttgctttcagccaattgggagg

SEQ ID NO: 681133 - DNA, 22 bp, Artificial Sequence
  chemically synthesized
tgctttcagccaattgggaggc

SEQ ID NO: 681134 - DNA, 22 bp, Artificial Sequence
  chemically synthesized
gctttcagccaattgggaggca

SEQ ID NO: 681135 - DNA, 22 bp, Artificial Sequence
  chemically synthesized
ctttcagccaattgggaggcag

SEQ ID NO: 681136 - DNA, 22 bp, Artificial Sequence
  chemically synthesized
taggcctttcatcactgcctcc

SEQ ID NO: 681137 - DNA, 22 bp, Artificial Sequence
  chemically synthesized
tcagccaattgggaggcagtga

SEQ ID NO: 681138 - DNA, 22 bp, Artificial Sequence
  chemically synthesized
cagccaattgggaggcagtgat

SEQ ID NO: 681139 - DNA, 22 bp, Artificial Sequence
  chemically synthesized
tgtaggcctttcatcactgcct

SEQ ID NO: 681140 - DNA, 22 bp, Artificial Sequence
  chemically synthesized
agccaattgggaggcagtgatg

SEQ ID NO: 681141 - DNA, 22 bp, Artificial Sequence
  chemically synthesized
ctgtaggcctttcatcactgcc

SEQ ID NO: 681142 - DNA, 22 bp, Artificial Sequence
  chemically synthesized
cttctgtaggcctttcatcact

SEQ ID NO: 681143 - DNA, 22 bp, Artificial Sequence
  chemically synthesized
tccttctgtaggcctttcatca

SEQ ID NO: 681144 - DNA, 22 bp, Artificial Sequence
  chemically synthesized
ctctccttctgtaggcctttca

SEQ ID NO: 681145 - DNA, 22 bp, Artificial Sequence
  chemically synthesized
ggaggcagtgatgaaaggccta

SEQ ID NO: 681146 - DNA, 22 bp, Artificial Sequence
  chemically synthesized
cctctccttctgtaggcctttc

SEQ ID NO: 681147 - DNA, 22 bp, Artificial Sequence
  chemically synthesized
tcctctccttctgtaggccttt

SEQ ID NO: 681148 - DNA, 22 bp, Artificial Sequence
  chemically synthesized
tcctttcctctccttctgtagg

SEQ ID NO: 681149 - DNA, 22 bp, Artificial Sequence
  chemically synthesized
ctgtcctttcctctccttctgt

SEQ ID NO: 681150 - DNA, 22 bp, Artificial Sequence
  chemically synthesized
ctcctgtcctttcctctccttc

SEQ ID NO: 681151 - DNA, 22 bp, Artificial Sequence
  chemically synthesized
cctcctgtcctttcctctcctt

SEQ ID NO: 681152 - DNA, 22 bp, Artificial Sequence
  chemically synthesized
cagaaggagaggaaaggacagg

SEQ ID NO: 681153 - DNA, 22 bp, Artificial Sequence
  chemically synthesized
aagaataaatacccaaacatca

SEQ ID NO: 681154 - DNA, 22 bp, Artificial Sequence
  chemically synthesized
gggtatttattcttcaggttcc

SEQ ID NO: 681155 - DNA, 22 bp, Artificial Sequence
  chemically synthesized
ggtatttattcttcaggttccc

SEQ ID NO: 681156 - DNA, 22 bp, Artificial Sequence
  chemically synthesized
attcttcaggttccctcctact

SEQ ID NO: 681157 - DNA, 22 bp, Artificial Sequence
  chemically synthesized
ttcttcaggttccctcctactg

SEQ ID NO: 681158 - DNA, 22 bp, Artificial Sequence
  chemically synthesized
ccaggccagagatcagtaggag

SEQ ID NO: 681159 - DNA, 22 bp, Artificial Sequence
  chemically synthesized
ttcaggttccctcctactgatc

SEQ ID NO: 681160 - DNA, 22 bp, Artificial Sequence
  chemically synthesized
caggttccctcctactgatctc

SEQ ID NO: 681161 - DNA, 22 bp, Artificial Sequence
  chemically synthesized
aggttccctcctactgatctct

SEQ ID NO: 681162 - DNA, 22 bp, Artificial Sequence
  chemically synthesized
agcagctgccaggccagagatc

SEQ ID NO: 681163 - DNA, 22 bp, Artificial Sequence
  chemically synthesized
cctcctactgatctctggcctg

SEQ ID NO: 681164 - DNA, 22 bp, Artificial Sequence
  chemically synthesized
ctactgatctctggcctggcag

SEQ ID NO: 681165 - DNA, 22 bp, Artificial Sequence
  chemically synthesized
ctgatctctggcctggcagctg

SEQ ID NO: 681166 - DNA, 22 bp, Artificial Sequence
  chemically synthesized
atctctggcctggcagctgctg

SEQ ID NO: 681167 - DNA, 22 bp, Artificial Sequence
  chemically synthesized
caggtcaaggaactcagcagct

SEQ ID NO: 681168 - DNA, 22 bp, Artificial Sequence
  chemically synthesized
tggcctggcagctgctgagttc

SEQ ID NO: 681169 - DNA, 22 bp, Artificial Sequence
  chemically synthesized
gcctggcagctgctgagttcct

SEQ ID NO: 681170 - DNA, 22 bp, Artificial Sequence
  chemically synthesized
tggctgcaggtcaaggaactca

SEQ ID NO: 681171 - DNA, 22 bp, Artificial Sequence
  chemically synthesized
gtggctgcaggtcaaggaactc

SEQ ID NO: 681172 - DNA, 22 bp, Artificial Sequence
  chemically synthesized
gcagctgctgagttccttgacc

SEQ ID NO: 681173 - DNA, 22 bp, Artificial Sequence
  chemically synthesized
ctgagttccttgacctgcagcc

SEQ ID NO: 681174 - DNA, 22 bp, Artificial Sequence
  chemically synthesized
agttccttgacctgcagccaca

SEQ ID NO: 681175 - DNA, 22 bp, Artificial Sequence
  chemically synthesized
gccaacaagacttgtggctgca

SEQ ID NO: 681176 - DNA, 22 bp, Artificial Sequence
  chemically synthesized
cttgacctgcagccacaagtct

SEQ ID NO: 681177 - DNA, 22 bp, Artificial Sequence
  chemically synthesized
gacctgcagccacaagtcttgt

SEQ ID NO: 681178 - DNA, 22 bp, Artificial Sequence
  chemically synthesized
acctgcagccacaagtcttgtt

SEQ ID NO: 681179 - DNA, 22 bp, Artificial Sequence
  chemically synthesized
taggaaaggactggccaacaag

SEQ ID NO: 681180 - DNA, 22 bp, Artificial Sequence
  chemically synthesized
cagccacaagtcttgttggcca

SEQ ID NO: 681181 - DNA, 22 bp, Artificial Sequence
  chemically synthesized
ctgtaggaaaggactggccaac

SEQ ID NO: 681182 - DNA, 22 bp, Artificial Sequence
  chemically synthesized
ttgctgtaggaaaggactggcc

SEQ ID NO: 681183 - DNA, 22 bp, Artificial Sequence
  chemically synthesized
gttggccagtcctttcctacag

SEQ ID NO: 681184 - DNA, 22 bp, Artificial Sequence
  chemically synthesized
ttggccagtcctttcctacagc

SEQ ID NO: 681185 - DNA, 22 bp, Artificial Sequence
  chemically synthesized
gtggaatgctattgctgtagga

SEQ ID NO: 681186 - DNA, 22 bp, Artificial Sequence
  chemically synthesized
gccagtcctttcctacagcaat

SEQ ID NO: 681187 - DNA, 22 bp, Artificial Sequence
  chemically synthesized
cgtaactggtggaatgctattg

SEQ ID NO: 681188 - DNA, 22 bp, Artificial Sequence
  chemically synthesized
gcgtaactggtggaatgctatt

SEQ ID NO: 681189 - DNA, 22 bp, Artificial Sequence
  chemically synthesized
tcctacagcaatagcattccac

SEQ ID NO: 681190 - DNA, 22 bp, Artificial Sequence
  chemically synthesized
cctacagcaatagcattccacc

SEQ ID NO: 681191 - DNA, 22 bp, Artificial Sequence
  chemically synthesized
ctacagcaatagcattccacca

SEQ ID NO: 681192 - DNA, 22 bp, Artificial Sequence
  chemically synthesized
cagcaatagcattccaccagtt

SEQ ID NO: 681193 - DNA, 22 bp, Artificial Sequence
  chemically synthesized
caccagttacgcaaaccattcc

SEQ ID NO: 681194 - DNA, 22 bp, Artificial Sequence
  chemically synthesized
cccaaagggataaagggaggaa

SEQ ID NO: 681195 - DNA, 22 bp, Artificial Sequence
  chemically synthesized
gcccaaagggataaagggagga

SEQ ID NO: 681196 - DNA, 22 bp, Artificial Sequence
  chemically synthesized
tgcccaaagggataaagggagg

SEQ ID NO: 681197 - DNA, 22 bp, Artificial Sequence
  chemically synthesized
cgcaaaccattcctccctttat

SEQ ID NO: 681198 - DNA, 22 bp, Artificial Sequence
  chemically synthesized
ttgcccaaagggataaagggag

SEQ ID NO: 681199 - DNA, 22 bp, Artificial Sequence
  chemically synthesized
ctccctttatccctttgggcaa

SEQ ID NO: 681200 - DNA, 22 bp, Artificial Sequence
  chemically synthesized
cctttatccctttgggcaaaag

SEQ ID NO: 681201 - DNA, 22 bp, Artificial Sequence
  chemically synthesized
tatccctttgggcaaaagttta

SEQ ID NO: 681202 - DNA, 22 bp, Artificial Sequence
  chemically synthesized
atccctttgggcaaaagtttac

SEQ ID NO: 681203 - DNA, 22 bp, Artificial Sequence
  chemically synthesized
tccctttgggcaaaagtttacc

SEQ ID NO: 681204 - DNA, 22 bp, Artificial Sequence
  chemically synthesized
tgggcaaaagtttaccattcct

SEQ ID NO: 681205 - DNA, 22 bp, Artificial Sequence
  chemically synthesized
gggcaaaagtttaccattcctt

SEQ ID NO: 681206 - DNA, 22 bp, Artificial Sequence
  chemically synthesized
ggcaaaagtttaccattccttg

SEQ ID NO: 681207 - DNA, 22 bp, Artificial Sequence
  chemically synthesized
ggagaaaaaaaaaaaaacaagg

SEQ ID NO: 681208 - DNA, 22 bp, Artificial Sequence
  chemically synthesized
accattccttgttttttttttt

SEQ ID NO: 681209 - DNA, 22 bp, Artificial Sequence
  chemically synthesized
ccattccttgtttttttttttt

SEQ ID NO: 681210 - DNA, 22 bp, Artificial Sequence
  chemically synthesized
ggcaggctaggagaaaaaaaaa

SEQ ID NO: 681211 - DNA, 22 bp, Artificial Sequence
  chemically synthesized
taggcaggctaggagaaaaaaa

SEQ ID NO: 681212 - DNA, 22 bp, Artificial Sequence
  chemically synthesized
cttgtttttttttttttctcct

SEQ ID NO: 681213 - DNA, 22 bp, Artificial Sequence
  chemically synthesized
gtttttttttttttctcctagc

SEQ ID NO: 681214 - DNA, 22 bp, Artificial Sequence
  chemically synthesized
tttttttttttttctcctagcc

SEQ ID NO: 681215 - DNA, 22 bp, Artificial Sequence
  chemically synthesized
caaggctctaggcaggctagga

SEQ ID NO: 681216 - DNA, 22 bp, Artificial Sequence
  chemically synthesized
ttttttttttctcctagcctgc

SEQ ID NO: 681217 - DNA, 22 bp, Artificial Sequence
  chemically synthesized
acaaggctctaggcaggctagg

SEQ ID NO: 681218 - DNA, 22 bp, Artificial Sequence
  chemically synthesized
tttttttttctcctagcctgcc

SEQ ID NO: 681219 - DNA, 22 bp, Artificial Sequence
  chemically synthesized
ttttttttctcctagcctgcct

SEQ ID NO: 681220 - DNA, 22 bp, Artificial Sequence
  chemically synthesized
tttttttctcctagcctgccta

SEQ ID NO: 681221 - DNA, 22 bp, Artificial Sequence
  chemically synthesized
tttacaaggctctaggcaggct

SEQ ID NO: 681222 - DNA, 22 bp, Artificial Sequence
  chemically synthesized
ttttttctcctagcctgcctag

SEQ ID NO: 681223 - DNA, 22 bp, Artificial Sequence
  chemically synthesized
tttttctcctagcctgcctaga

SEQ ID NO: 681224 - DNA, 22 bp, Artificial Sequence
  chemically synthesized
ttttctcctagcctgcctagag

SEQ ID NO: 681225 - DNA, 22 bp, Artificial Sequence
  chemically synthesized
tttctcctagcctgcctagagc

SEQ ID NO: 681226 - DNA, 22 bp, Artificial Sequence
  chemically synthesized
ttctcctagcctgcctagagcc

SEQ ID NO: 681227 - DNA, 22 bp, Artificial Sequence
  chemically synthesized
tctcctagcctgcctagagcct

SEQ ID NO: 681228 - DNA, 22 bp, Artificial Sequence
  chemically synthesized
ctcctagcctgcctagagcctt

SEQ ID NO: 681229 - DNA, 22 bp, Artificial Sequence
  chemically synthesized
tcctagcctgcctagagccttg

SEQ ID NO: 681230 - DNA, 22 bp, Artificial Sequence
  chemically synthesized
ctagcctgcctagagccttgta

SEQ ID NO: 681231 - DNA, 22 bp, Artificial Sequence
  chemically synthesized
gcctgcctagagccttgtaaat

SEQ ID NO: 681232 - DNA, 22 bp, Artificial Sequence
  chemically synthesized
cctagagccttgtaaatagcct

SEQ ID NO: 681233 - DNA, 22 bp, Artificial Sequence
  chemically synthesized
gagccttgtaaatagccttttc

SEQ ID NO: 681234 - DNA, 22 bp, Artificial Sequence
  chemically synthesized
aagagagtataatgaaaaggct

SEQ ID NO: 681235 - DNA, 22 bp, Artificial Sequence
  chemically synthesized
gaagagagtataatgaaaaggc

SEQ ID NO: 681236 - DNA, 22 bp, Artificial Sequence
  chemically synthesized
gtaaatagccttttcattatac

SEQ ID NO: 681237 - DNA, 22 bp, Artificial Sequence
  chemically synthesized
taaatagccttttcattatact

SEQ ID NO: 681238 - DNA, 22 bp, Artificial Sequence
  chemically synthesized
aaacggaacacttgaagagagt

SEQ ID NO: 681239 - DNA, 22 bp, Artificial Sequence
  chemically synthesized
ttcattatactctcttcaagtg

SEQ ID NO: 681240 - DNA, 22 bp, Artificial Sequence
  chemically synthesized
tcattatactctcttcaagtgt

SEQ ID NO: 681241 - DNA, 22 bp, Artificial Sequence
  chemically synthesized
cattatactctcttcaagtgtt

SEQ ID NO: 681242 - DNA, 22 bp, Artificial Sequence
  chemically synthesized
attatactctcttcaagtgttc

SEQ ID NO: 681243 - DNA, 22 bp, Artificial Sequence
  chemically synthesized
tactctcttcaagtgttccgtt

SEQ ID NO: 681244 - DNA, 22 bp, Artificial Sequence
  chemically synthesized
tcttcaagtgttccgtttgaat

SEQ ID NO: 681245 - DNA, 22 bp, Artificial Sequence
  chemically synthesized
ttcaagtgttccgtttgaatgt

SEQ ID NO: 681246 - DNA, 22 bp, Artificial Sequence
  chemically synthesized
caagtgttccgtttgaatgtac

SEQ ID NO: 681247 - DNA, 22 bp, Artificial Sequence
  chemically synthesized
aagtgttccgtttgaatgtacc

SEQ ID NO: 681248 - DNA, 22 bp, Artificial Sequence
  chemically synthesized
ggagaaacagatggtacattca

SEQ ID NO: 681249 - DNA, 22 bp, Artificial Sequence
  chemically synthesized
cgtttgaatgtaccatctgttt

SEQ ID NO: 681250 - DNA, 22 bp, Artificial Sequence
  chemically synthesized
gtcagggtcctgggagaaacag

SEQ ID NO: 681251 - DNA, 22 bp, Artificial Sequence
  chemically synthesized
gaatgtaccatctgtttctccc

SEQ ID NO: 681252 - DNA, 22 bp, Artificial Sequence
  chemically synthesized
ggtcagggtcctgggagaaaca

SEQ ID NO: 681253 - DNA, 22 bp, Artificial Sequence
  chemically synthesized
aatgtaccatctgtttctccca

SEQ ID NO: 681254 - DNA, 22 bp, Artificial Sequence
  chemically synthesized
agtttggtcagggtcctgggag

SEQ ID NO: 681255 - DNA, 22 bp, Artificial Sequence
  chemically synthesized
tttctcccaggaccctgaccaa

SEQ ID NO: 681256 - DNA, 22 bp, Artificial Sequence
  chemically synthesized
gatgggtctcagtttggtcagg

SEQ ID NO: 681257 - DNA, 22 bp, Artificial Sequence
  chemically synthesized
ctcccaggaccctgaccaaact

SEQ ID NO: 681258 - DNA, 22 bp, Artificial Sequence
  chemically synthesized
tcccaggaccctgaccaaactg

SEQ ID NO: 681259 - DNA, 22 bp, Artificial Sequence
  chemically synthesized
gctggatgggtctcagtttggt

SEQ ID NO: 681260 - DNA, 22 bp, Artificial Sequence
  chemically synthesized
ccaggaccctgaccaaactgag

SEQ ID NO: 681261 - DNA, 22 bp, Artificial Sequence
  chemically synthesized
ggctggatgggtctcagtttgg

SEQ ID NO: 681262 - DNA, 22 bp, Artificial Sequence
  chemically synthesized
tggctggatgggtctcagtttg

SEQ ID NO: 681263 - DNA, 22 bp, Artificial Sequence
  chemically synthesized
accaaactgagacccatccagc

SEQ ID NO: 681264 - DNA, 22 bp, Artificial Sequence
  chemically synthesized
ccccagagggtggctttggctg

SEQ ID NO: 681265 - DNA, 22 bp, Artificial Sequence
  chemically synthesized
agacccatccagccaaagccac

SEQ ID NO: 681266 - DNA, 22 bp, Artificial Sequence
  chemically synthesized
ttgccccagagggtggctttgg

SEQ ID NO: 681267 - DNA, 22 bp, Artificial Sequence
  chemically synthesized
agcatcaagtctattgccccag

SEQ ID NO: 681268 - DNA, 22 bp, Artificial Sequence
  chemically synthesized
tggggcaatagacttgatgctg

SEQ ID NO: 681269 - DNA, 22 bp, Artificial Sequence
  chemically synthesized
gggcaatagacttgatgctgag

SEQ ID NO: 681270 - DNA, 22 bp, Artificial Sequence
  chemically synthesized
tcagtagtccccactcagcatc

SEQ ID NO: 681271 - DNA, 22 bp, Artificial Sequence
  chemically synthesized
tatcagtagtccccactcagca

SEQ ID NO: 681272 - DNA, 22 bp, Artificial Sequence
  chemically synthesized
ctctatcagtagtccccactca

SEQ ID NO: 681273 - DNA, 22 bp, Artificial Sequence
  chemically synthesized
tcctctatcagtagtccccact

SEQ ID NO: 681274 - DNA, 22 bp, Artificial Sequence
  chemically synthesized
ctcctctatcagtagtccccac

SEQ ID NO: 681275 - DNA, 22 bp, Artificial Sequence
  chemically synthesized
tctcctctatcagtagtcccca

SEQ ID NO: 681276 - DNA, 22 bp, Artificial Sequence
  chemically synthesized
gatgctgagtggggactactga

SEQ ID NO: 681277 - DNA, 22 bp, Artificial Sequence
  chemically synthesized
atgctgagtggggactactgat

SEQ ID NO: 681278 - DNA, 22 bp, Artificial Sequence
  chemically synthesized
actttctcctctatcagtagtc

SEQ ID NO: 681279 - DNA, 22 bp, Artificial Sequence
  chemically synthesized
agtggggactactgatagagga

SEQ ID NO: 681280 - DNA, 22 bp, Artificial Sequence
  chemically synthesized
ctgatagaggagaaagtcagat

SEQ ID NO: 681281 - DNA, 22 bp, Artificial Sequence
  chemically synthesized
atagaggagaaagtcagatccc

SEQ ID NO: 681282 - DNA, 22 bp, Artificial Sequence
  chemically synthesized
gccccagagtggggggatctga

SEQ ID NO: 681283 - DNA, 22 bp, Artificial Sequence
  chemically synthesized
agccccagagtggggggatctg

SEQ ID NO: 681284 - DNA, 22 bp, Artificial Sequence
  chemically synthesized
tagccccagagtggggggatct

SEQ ID NO: 681285 - DNA, 22 bp, Artificial Sequence
  chemically synthesized
ttagccccagagtggggggatc

SEQ ID NO: 681286 - DNA, 22 bp, Artificial Sequence
  chemically synthesized
tttagccccagagtggggggat

SEQ ID NO: 681287 - DNA, 22 bp, Artificial Sequence
  chemically synthesized
ctttttagccccagagtggggg

SEQ ID NO: 681288 - DNA, 22 bp, Artificial Sequence
  chemically synthesized
atctgctttttagccccagagt

SEQ ID NO: 681289 - DNA, 22 bp, Artificial Sequence
  chemically synthesized
agtctcatctgctttttagccc

SEQ ID NO: 681290 - DNA, 22 bp, Artificial Sequence
  chemically synthesized
tggggctaaaaagcagatgaga

SEQ ID NO: 681291 - DNA, 22 bp, Artificial Sequence
  chemically synthesized
tccaatgactgagtctcatctg

SEQ ID NO: 681292 - DNA, 22 bp, Artificial Sequence
  chemically synthesized
gggctaaaaagcagatgagact

SEQ ID NO: 681293 - DNA, 22 bp, Artificial Sequence
  chemically synthesized
atccaatgactgagtctcatct

SEQ ID NO: 681294 - DNA, 22 bp, Artificial Sequence
  chemically synthesized
aaaagcagatgagactcagtca

SEQ ID NO: 681295 - DNA, 22 bp, Artificial Sequence
  chemically synthesized
aatatttatccaatgactgagt

SEQ ID NO: 681296 - DNA, 22 bp, Artificial Sequence
  chemically synthesized
tgaatatttatccaatgactga

SEQ ID NO: 681297 - DNA, 22 bp, Artificial Sequence
  chemically synthesized
tctgaatatttatccaatgact

SEQ ID NO: 681298 - DNA, 22 bp, Artificial Sequence
  chemically synthesized
ctctgaatatttatccaatgac

SEQ ID NO: 681299 - DNA, 22 bp, Artificial Sequence
  chemically synthesized
agtcattggataaatattcaga

SEQ ID NO: 681300 - DNA, 22 bp, Artificial Sequence
  chemically synthesized
cagaggaggcttctctgaatat

SEQ ID NO: 681301 - DNA, 22 bp, Artificial Sequence
  chemically synthesized
gataaatattcagagaagcctc

SEQ ID NO: 681302 - DNA, 22 bp, Artificial Sequence
  chemically synthesized
tgggcctacagaggaggcttct

SEQ ID NO: 681303 - DNA, 22 bp, Artificial Sequence
  chemically synthesized
gtgggcctacagaggaggcttc

SEQ ID NO: 681304 - DNA, 22 bp, Artificial Sequence
  chemically synthesized
tgtgggcctacagaggaggctt

SEQ ID NO: 681305 - DNA, 22 bp, Artificial Sequence
  chemically synthesized
tttgtgggcctacagaggaggc

SEQ ID NO: 681306 - DNA, 22 bp, Artificial Sequence
  chemically synthesized
agagaagcctcctctgtaggcc

SEQ ID NO: 681307 - DNA, 22 bp, Artificial Sequence
  chemically synthesized
aaaaggccagaagctctttgtg

SEQ ID NO: 681308 - DNA, 22 bp, Artificial Sequence
  chemically synthesized
ctctgtaggcccacaaagagct

SEQ ID NO: 681309 - DNA, 22 bp, Artificial Sequence
  chemically synthesized
tgtaggcccacaaagagcttct

SEQ ID NO: 681310 - DNA, 22 bp, Artificial Sequence
  chemically synthesized
ccctcaaaaggccagaagctct

SEQ ID NO: 681311 - DNA, 22 bp, Artificial Sequence
  chemically synthesized
taggcccacaaagagcttctgg

SEQ ID NO: 681312 - DNA, 22 bp, Artificial Sequence
  chemically synthesized
accctcaaaaggccagaagctc

SEQ ID NO: 681313 - DNA, 22 bp, Artificial Sequence
  chemically synthesized
taccctcaaaaggccagaagct

SEQ ID NO: 681314 - DNA, 22 bp, Artificial Sequence
  chemically synthesized
atatgcctttaccctcaaaagg

SEQ ID NO: 681315 - DNA, 22 bp, Artificial Sequence
  chemically synthesized
ttgatatgcctttaccctcaaa

SEQ ID NO: 681316 - DNA, 22 bp, Artificial Sequence
  chemically synthesized
ctggccttttgagggtaaaggc

SEQ ID NO: 681317 - DNA, 22 bp, Artificial Sequence
  chemically synthesized
tggccttttgagggtaaaggca

SEQ ID NO: 681318 - DNA, 22 bp, Artificial Sequence
  chemically synthesized
gccttttgagggtaaaggcata

SEQ ID NO: 681319 - DNA, 22 bp, Artificial Sequence
  chemically synthesized
ttgagggtaaaggcatatcaac

SEQ ID NO: 681320 - DNA, 22 bp, Artificial Sequence
  chemically synthesized
tgagggtaaaggcatatcaaca

SEQ ID NO: 681321 - DNA, 22 bp, Artificial Sequence
  chemically synthesized
gagggtaaaggcatatcaacaa

SEQ ID NO: 681322 - DNA, 22 bp, Artificial Sequence
  chemically synthesized
tcaccatcataattgttgatat

SEQ ID NO: 681323 - DNA, 22 bp, Artificial Sequence
  chemically synthesized
agggtaaaggcatatcaacaat

SEQ ID NO: 681324 - DNA, 22 bp, Artificial Sequence
  chemically synthesized
ttgtcaccatcataattgttga

SEQ ID NO: 681325 - DNA, 22 bp, Artificial Sequence
  chemically synthesized
ctgttgtcaccatcataattgt

SEQ ID NO: 681326 - DNA, 22 bp, Artificial Sequence
  chemically synthesized
acatctgctgttgtcaccatca

SEQ ID NO: 681327 - DNA, 22 bp, Artificial Sequence
  chemically synthesized
ccctcacatctgctgttgtcac

SEQ ID NO: 681328 - DNA, 22 bp, Artificial Sequence
  chemically synthesized
accctcacatctgctgttgtca

SEQ ID NO: 681329 - DNA, 22 bp, Artificial Sequence
  chemically synthesized
taccctcacatctgctgttgtc

SEQ ID NO: 681330 - DNA, 22 bp, Artificial Sequence
  chemically synthesized
ttaccctcacatctgctgttgt

SEQ ID NO: 681331 - DNA, 22 bp, Artificial Sequence
  chemically synthesized
tttaccctcacatctgctgttg

SEQ ID NO: 681332 - DNA, 22 bp, Artificial Sequence
  chemically synthesized
tgatggtgacaacagcagatgt

SEQ ID NO: 681333 - DNA, 22 bp, Artificial Sequence
  chemically synthesized
catcctttttaccctcacatct

SEQ ID NO: 681334 - DNA, 22 bp, Artificial Sequence
  chemically synthesized
gttgcatcctttttaccctcac

SEQ ID NO: 681335 - DNA, 22 bp, Artificial Sequence
  chemically synthesized
taaagaacaagctggttgcatc

SEQ ID NO: 681336 - DNA, 22 bp, Artificial Sequence
  chemically synthesized
gtaaagaacaagctggttgcat

SEQ ID NO: 681337 - DNA, 22 bp, Artificial Sequence
  chemically synthesized
ttgtaaagaacaagctggttgc

SEQ ID NO: 681338 - DNA, 22 bp, Artificial Sequence
  chemically synthesized
aagctcttgtaaagaacaagct

SEQ ID NO: 681339 - DNA, 22 bp, Artificial Sequence
  chemically synthesized
gttctttacaagagcttcaacg

SEQ ID NO: 681340 - DNA, 22 bp, Artificial Sequence
  chemically synthesized
ttctttacaagagcttcaacgg

SEQ ID NO: 681341 - DNA, 22 bp, Artificial Sequence
  chemically synthesized
tttacaagagcttcaacggtct

SEQ ID NO: 681342 - DNA, 22 bp, Artificial Sequence
  chemically synthesized
caaaagatcaagcagaccgttg

SEQ ID NO: 681343 - DNA, 22 bp, Artificial Sequence
  chemically synthesized
tacaagagcttcaacggtctgc

SEQ ID NO: 681344 - DNA, 22 bp, Artificial Sequence
  chemically synthesized
acaagagcttcaacggtctgct

SEQ ID NO: 681345 - DNA, 22 bp, Artificial Sequence
  chemically synthesized
tccaaaagatcaagcagaccgt

SEQ ID NO: 681346 - DNA, 22 bp, Artificial Sequence
  chemically synthesized
caagagcttcaacggtctgctt

SEQ ID NO: 681347 - DNA, 22 bp, Artificial Sequence
  chemically synthesized
tctccaaaagatcaagcagacc

SEQ ID NO: 681348 - DNA, 22 bp, Artificial Sequence
  chemically synthesized
acattctctccaaaagatcaag

SEQ ID NO: 681349 - DNA, 22 bp, Artificial Sequence
  chemically synthesized
gacattctctccaaaagatcaa

SEQ ID NO: 681350 - DNA, 22 bp, Artificial Sequence
  chemically synthesized
caacggtctgcttgatcttttg

SEQ ID NO: 681351 - DNA, 22 bp, Artificial Sequence
  chemically synthesized
aacggtctgcttgatcttttgg

SEQ ID NO: 681352 - DNA, 22 bp, Artificial Sequence
  chemically synthesized
tcttgacattctctccaaaaga

SEQ ID NO: 681353 - DNA, 22 bp, Artificial Sequence
  chemically synthesized
atcttgacattctctccaaaag

SEQ ID NO: 681354 - DNA, 22 bp, Artificial Sequence
  chemically synthesized
cttgatcttttggagagaatgt

SEQ ID NO: 681355 - DNA, 22 bp, Artificial Sequence
  chemically synthesized
acccttatcttgacattctctc

SEQ ID NO: 681356 - DNA, 22 bp, Artificial Sequence
  chemically synthesized
taacccttatcttgacattctc

SEQ ID NO: 681357 - DNA, 22 bp, Artificial Sequence
  chemically synthesized
gatcttttggagagaatgtcaa

SEQ ID NO: 681358 - DNA, 22 bp, Artificial Sequence
  chemically synthesized
atcttttggagagaatgtcaag

SEQ ID NO: 681359 - DNA, 22 bp, Artificial Sequence
  chemically synthesized
tctaacccttatcttgacattc

SEQ ID NO: 681360 - DNA, 22 bp, Artificial Sequence
  chemically synthesized
ctctaacccttatcttgacatt

SEQ ID NO: 681361 - DNA, 22 bp, Artificial Sequence
  chemically synthesized
ttggagagaatgtcaagataag

SEQ ID NO: 681362 - DNA, 22 bp, Artificial Sequence
  chemically synthesized
tggagagaatgtcaagataagg

SEQ ID NO: 681363 - DNA, 22 bp, Artificial Sequence
  chemically synthesized
ggagagaatgtcaagataaggg

SEQ ID NO: 681364 - DNA, 22 bp, Artificial Sequence
  chemically synthesized
gagagaatgtcaagataagggt

SEQ ID NO: 681365 - DNA, 22 bp, Artificial Sequence
  chemically synthesized
cccatttctctaacccttatct

SEQ ID NO: 681366 - DNA, 22 bp, Artificial Sequence
  chemically synthesized
gcccatttctctaacccttatc

SEQ ID NO: 681367 - DNA, 22 bp, Artificial Sequence
  chemically synthesized
cagtttgcccatttctctaacc

SEQ ID NO: 681368 - DNA, 22 bp, Artificial Sequence
  chemically synthesized
ccagtttgcccatttctctaac

SEQ ID NO: 681369 - DNA, 22 bp, Artificial Sequence
  chemically synthesized
tccagtttgcccatttctctaa

SEQ ID NO: 681370 - DNA, 22 bp, Artificial Sequence
  chemically synthesized
agccctttccagtttgcccatt

SEQ ID NO: 681371 - DNA, 22 bp, Artificial Sequence
  chemically synthesized
gagaaatgggcaaactggaaag

SEQ ID NO: 681372 - DNA, 22 bp, Artificial Sequence
  chemically synthesized
tcacactaagccctttccagtt

SEQ ID NO: 681373 - DNA, 22 bp, Artificial Sequence
  chemically synthesized
cagattgtcacactaagccctt

SEQ ID NO: 681374 - DNA, 22 bp, Artificial Sequence
  chemically synthesized
gaaagggcttagtgtgacaatc

SEQ ID NO: 681375 - DNA, 22 bp, Artificial Sequence
  chemically synthesized
aggatacaagtcaaactccaga

SEQ ID NO: 681376 - DNA, 22 bp, Artificial Sequence
  chemically synthesized
caggatacaagtcaaactccag

SEQ ID NO: 681377 - DNA, 22 bp, Artificial Sequence
  chemically synthesized
agtgtgacaatctggagtttga

SEQ ID NO: 681378 - DNA, 22 bp, Artificial Sequence
  chemically synthesized
tcaggatacaagtcaaactcca

SEQ ID NO: 681379 - DNA, 22 bp, Artificial Sequence
  chemically synthesized
gtgtgacaatctggagtttgac

SEQ ID NO: 681380 - DNA, 22 bp, Artificial Sequence
  chemically synthesized
atacctttcaggatacaagtca

SEQ ID NO: 681381 - DNA, 22 bp, Artificial Sequence
  chemically synthesized
cctcatacctttcaggatacaa

SEQ ID NO: 681382 - DNA, 22 bp, Artificial Sequence
  chemically synthesized
gagtttgacttgtatcctgaaa

SEQ ID NO: 681383 - DNA, 22 bp, Artificial Sequence
  chemically synthesized
aaaagctccctcatacctttca

SEQ ID NO: 681384 - DNA, 22 bp, Artificial Sequence
  chemically synthesized
gacttgtatcctgaaaggtatg

SEQ ID NO: 681385 - DNA, 22 bp, Artificial Sequence
  chemically synthesized
aaaaagctccctcatacctttc

SEQ ID NO: 681386 - DNA, 22 bp, Artificial Sequence
  chemically synthesized
acttgtatcctgaaaggtatga

SEQ ID NO: 681387 - DNA, 22 bp, Artificial Sequence
  chemically synthesized
cttaaaaagctccctcatacct

SEQ ID NO: 681388 - DNA, 22 bp, Artificial Sequence
  chemically synthesized
ccttaaaaagctccctcatacc

SEQ ID NO: 681389 - DNA, 22 bp, Artificial Sequence
  chemically synthesized
gtatcctgaaaggtatgaggga

SEQ ID NO: 681390 - DNA, 22 bp, Artificial Sequence
  chemically synthesized
tatcctgaaaggtatgagggag

SEQ ID NO: 681391 - DNA, 22 bp, Artificial Sequence
  chemically synthesized
ttccttaaaaagctccctcata

SEQ ID NO: 681392 - DNA, 22 bp, Artificial Sequence
  chemically synthesized
cttccttaaaaagctccctcat

SEQ ID NO: 681393 - DNA, 22 bp, Artificial Sequence
  chemically synthesized
tcttccttaaaaagctccctca

SEQ ID NO: 681394 - DNA, 22 bp, Artificial Sequence
  chemically synthesized
tttcttccttaaaaagctccct

SEQ ID NO: 681395 - DNA, 22 bp, Artificial Sequence
  chemically synthesized
aaaggtatgagggagcttttta

SEQ ID NO: 681396 - DNA, 22 bp, Artificial Sequence
  chemically synthesized
attctttcttccttaaaaagct

SEQ ID NO: 681397 - DNA, 22 bp, Artificial Sequence
  chemically synthesized
aattctttcttccttaaaaagc

SEQ ID NO: 681398 - DNA, 22 bp, Artificial Sequence
  chemically synthesized
taattctttcttccttaaaaag

SEQ ID NO: 681399 - DNA, 22 bp, Artificial Sequence
  chemically synthesized
atgctttaattctttcttcctt

SEQ ID NO: 681400 - DNA, 22 bp, Artificial Sequence
  chemically synthesized
tttaaggaagaaagaattaaag

SEQ ID NO: 681401 - DNA, 22 bp, Artificial Sequence
  chemically synthesized
ttaaggaagaaagaattaaagc

SEQ ID NO: 681402 - DNA, 22 bp, Artificial Sequence
  chemically synthesized
taaggaagaaagaattaaagca

SEQ ID NO: 681403 - DNA, 22 bp, Artificial Sequence
  chemically synthesized
aaggaagaaagaattaaagcat

SEQ ID NO: 681404 - DNA, 22 bp, Artificial Sequence
  chemically synthesized
aggaagaaagaattaaagcatg

SEQ ID NO: 681405 - DNA, 22 bp, Artificial Sequence
  chemically synthesized
aaagacaaaccggacagagcca

SEQ ID NO: 681406 - DNA, 22 bp, Artificial Sequence
  chemically synthesized
aagcatgagtgtggctctgtcc

SEQ ID NO: 681407 - DNA, 22 bp, Artificial Sequence
  chemically synthesized
taaaagacaaaccggacagagc

SEQ ID NO: 681408 - DNA, 22 bp, Artificial Sequence
  chemically synthesized
ctaaaagacaaaccggacagag

SEQ ID NO: 681409 - DNA, 22 bp, Artificial Sequence
  chemically synthesized
tctaaaagacaaaccggacaga

SEQ ID NO: 681410 - DNA, 22 bp, Artificial Sequence
  chemically synthesized
ttctaaaagacaaaccggacag

SEQ ID NO: 681411 - DNA, 22 bp, Artificial Sequence
  chemically synthesized
agtgatttttctaaaagacaaa

SEQ ID NO: 681412 - DNA, 22 bp, Artificial Sequence
  chemically synthesized
cctgagtgatttttctaaaaga

SEQ ID NO: 681413 - DNA, 22 bp, Artificial Sequence
  chemically synthesized
tgtccggtttgtcttttagaaa

SEQ ID NO: 681414 - DNA, 22 bp, Artificial Sequence
  chemically synthesized
tccggtttgtcttttagaaaaa

SEQ ID NO: 681415 - DNA, 22 bp, Artificial Sequence
  chemically synthesized
gtcttttagaaaaatcactcag

SEQ ID NO: 681416 - DNA, 22 bp, Artificial Sequence
  chemically synthesized
tcttttagaaaaatcactcagg

SEQ ID NO: 681417 - DNA, 22 bp, Artificial Sequence
  chemically synthesized
ttagaaaaatcactcaggcaat

SEQ ID NO: 681418 - DNA, 22 bp, Artificial Sequence
  chemically synthesized
tagaaaaatcactcaggcaatg

SEQ ID NO: 681419 - DNA, 22 bp, Artificial Sequence
  chemically synthesized
agaaaaatcactcaggcaatgg

SEQ ID NO: 681420 - DNA, 22 bp, Artificial Sequence
  chemically synthesized
gaaaaatcactcaggcaatggt

SEQ ID NO: 681421 - DNA, 22 bp, Artificial Sequence
  chemically synthesized
atcaagcccccataccattgcc

SEQ ID NO: 681422 - DNA, 22 bp, Artificial Sequence
  chemically synthesized
tgatcaagcccccataccattg

SEQ ID NO: 681423 - DNA, 22 bp, Artificial Sequence
  chemically synthesized
ctgatcaagcccccataccatt

SEQ ID NO: 681424 - DNA, 22 bp, Artificial Sequence
  chemically synthesized
tcttctgatcaagcccccatac

SEQ ID NO: 681425 - DNA, 22 bp, Artificial Sequence
  chemically synthesized
gtcttctgatcaagcccccata

SEQ ID NO: 681426 - DNA, 22 bp, Artificial Sequence
  chemically synthesized
ttgtcttctgatcaagccccca

SEQ ID NO: 681427 - DNA, 22 bp, Artificial Sequence
  chemically synthesized
aggcaatggtatgggggcttga

SEQ ID NO: 681428 - DNA, 22 bp, Artificial Sequence
  chemically synthesized
agactcttgtcttctgatcaag

SEQ ID NO: 681429 - DNA, 22 bp, Artificial Sequence
  chemically synthesized
cagactcttgtcttctgatcaa

SEQ ID NO: 681430 - DNA, 22 bp, Artificial Sequence
  chemically synthesized
aatttcagactcttgtcttctg

SEQ ID NO: 681431 - DNA, 22 bp, Artificial Sequence
  chemically synthesized
atgtctgaatttcagactcttg

SEQ ID NO: 681432 - DNA, 22 bp, Artificial Sequence
  chemically synthesized
gatcagaagacaagagtctgaa

SEQ ID NO: 681433 - DNA, 22 bp, Artificial Sequence
  chemically synthesized
atcagaagacaagagtctgaaa

SEQ ID NO: 681434 - DNA, 22 bp, Artificial Sequence
  chemically synthesized
tacctgatgtctgaatttcaga

SEQ ID NO: 681435 - DNA, 22 bp, Artificial Sequence
  chemically synthesized
gtacctgatgtctgaatttcag

SEQ ID NO: 681436 - DNA, 22 bp, Artificial Sequence
  chemically synthesized
cttgtacctgatgtctgaattt

SEQ ID NO: 681437 - DNA, 22 bp, Artificial Sequence
  chemically synthesized
caatctccttgtacctgatgtc

SEQ ID NO: 681438 - DNA, 22 bp, Artificial Sequence
  chemically synthesized
aaattcagacatcaggtacaag

SEQ ID NO: 681439 - DNA, 22 bp, Artificial Sequence
  chemically synthesized
atactgcaatctccttgtacct

SEQ ID NO: 681440 - DNA, 22 bp, Artificial Sequence
  chemically synthesized
ctcatactgcaatctccttgta

SEQ ID NO: 681441 - DNA, 22 bp, Artificial Sequence
  chemically synthesized
agacatcaggtacaaggagatt

SEQ ID NO: 681442 - DNA, 22 bp, Artificial Sequence
  chemically synthesized
agatcctcctcatactgcaatc

SEQ ID NO: 681443 - DNA, 22 bp, Artificial Sequence
  chemically synthesized
taattcagatcctcctcatact

SEQ ID NO: 681444 - DNA, 22 bp, Artificial Sequence
  chemically synthesized
ctgtaattcagatcctcctcat

SEQ ID NO: 681445 - DNA, 22 bp, Artificial Sequence
  chemically synthesized
ccactgctgtaattcagatcct

SEQ ID NO: 681446 - DNA, 22 bp, Artificial Sequence
  chemically synthesized
cagtatgaggaggatctgaatt

SEQ ID NO: 681447 - DNA, 22 bp, Artificial Sequence
  chemically synthesized
tgccactgctgtaattcagatc

SEQ ID NO: 681448 - DNA, 22 bp, Artificial Sequence
  chemically synthesized
ctctgccactgctgtaattcag

SEQ ID NO: 681449 - DNA, 22 bp, Artificial Sequence
  chemically synthesized
cacctcctctgccactgctgta

SEQ ID NO: 681450 - DNA, 22 bp, Artificial Sequence
  chemically synthesized
tccacctcctctgccactgctg

SEQ ID NO: 681451 - DNA, 22 bp, Artificial Sequence
  chemically synthesized
ctccacctcctctgccactgct

SEQ ID NO: 681452 - DNA, 22 bp, Artificial Sequence
  chemically synthesized
aattacagcagtggcagaggag

SEQ ID NO: 681453 - DNA, 22 bp, Artificial Sequence
  chemically synthesized
tatcatttctccacctcctctg

SEQ ID NO: 681454 - DNA, 22 bp, Artificial Sequence
  chemically synthesized
cagcagtggcagaggaggtgga

SEQ ID NO: 681455 - DNA, 22 bp, Artificial Sequence
  chemically synthesized
ttgtatcatttctccacctcct

SEQ ID NO: 681456 - DNA, 22 bp, Artificial Sequence
  chemically synthesized
attgtatcatttctccacctcc

SEQ ID NO: 681457 - DNA, 22 bp, Artificial Sequence
  chemically synthesized
gaaccttattgtatcatttctc

SEQ ID NO: 681458 - DNA, 22 bp, Artificial Sequence
  chemically synthesized
tagttggaaccttattgtatca

SEQ ID NO: 681459 - DNA, 22 bp, Artificial Sequence
  chemically synthesized
ctgtagttggaaccttattgta

SEQ ID NO: 681460 - DNA, 22 bp, Artificial Sequence
  chemically synthesized
atacatccagtcagtcaagact

SEQ ID NO: 681461 - DNA, 22 bp, Artificial Sequence
  chemically synthesized
caactacaggagtcttgactga

SEQ ID NO: 681462 - DNA, 22 bp, Artificial Sequence
  chemically synthesized
cattcatacatccagtcagtca

SEQ ID NO: 681463 - DNA, 22 bp, Artificial Sequence
  chemically synthesized
ccattcatacatccagtcagtc

SEQ ID NO: 681464 - DNA, 22 bp, Artificial Sequence
  chemically synthesized
caggagtcttgactgactggat

SEQ ID NO: 681465 - DNA, 22 bp, Artificial Sequence
  chemically synthesized
ttccattcatacatccagtcag

SEQ ID NO: 681466 - DNA, 22 bp, Artificial Sequence
  chemically synthesized
tcttccattcatacatccagtc

SEQ ID NO: 681467 - DNA, 22 bp, Artificial Sequence
  chemically synthesized
cctctcttccattcatacatcc

SEQ ID NO: 681468 - DNA, 22 bp, Artificial Sequence
  chemically synthesized
ccctctcttccattcatacatc

SEQ ID NO: 681469 - DNA, 22 bp, Artificial Sequence
  chemically synthesized
ttccctctcttccattcataca

SEQ ID NO: 681470 - DNA, 22 bp, Artificial Sequence
  chemically synthesized
gactgactggatgtatgaatgg

SEQ ID NO: 681471 - DNA, 22 bp, Artificial Sequence
  chemically synthesized
cttccctctcttccattcatac

SEQ ID NO: 681472 - DNA, 22 bp, Artificial Sequence
  chemically synthesized
actgactggatgtatgaatgga

SEQ ID NO: 681473 - DNA, 22 bp, Artificial Sequence
  chemically synthesized
cttcttccctctcttccattca

SEQ ID NO: 681474 - DNA, 22 bp, Artificial Sequence
  chemically synthesized
acttcttccctctcttccattc

SEQ ID NO: 681475 - DNA, 22 bp, Artificial Sequence
  chemically synthesized
actggatgtatgaatggaagag

SEQ ID NO: 681476 - DNA, 22 bp, Artificial Sequence
  chemically synthesized
tacttcttccctctcttccatt

SEQ ID NO: 681477 - DNA, 22 bp, Artificial Sequence
  chemically synthesized
ctttacttcttccctctcttcc

SEQ ID NO: 681478 - DNA, 22 bp, Artificial Sequence
  chemically synthesized
gatgtatgaatggaagagaggg

SEQ ID NO: 681479 - DNA, 22 bp, Artificial Sequence
  chemically synthesized
ttgctttacttcttccctctct

SEQ ID NO: 681480 - DNA, 22 bp, Artificial Sequence
  chemically synthesized
aggactattgctttacttcttc

SEQ ID NO: 681481 - DNA, 22 bp, Artificial Sequence
  chemically synthesized
gaggactattgctttacttctt

SEQ ID NO: 681482 - DNA, 22 bp, Artificial Sequence
  chemically synthesized
caaagggcggccaagcttgagg

SEQ ID NO: 681483 - DNA, 22 bp, Artificial Sequence
  chemically synthesized
agtgattccaaagggcggccaa

SEQ ID NO: 681484 - DNA, 22 bp, Artificial Sequence
  chemically synthesized
aagcttggccgccctttggaat

SEQ ID NO: 681485 - DNA, 22 bp, Artificial Sequence
  chemically synthesized
acaatccctgagtgattccaaa

SEQ ID NO: 681486 - DNA, 22 bp, Artificial Sequence
  chemically synthesized
ttaacaatccctgagtgattcc

SEQ ID NO: 681487 - DNA, 22 bp, Artificial Sequence
  chemically synthesized
ggccgccctttggaatcactca

SEQ ID NO: 681488 - DNA, 22 bp, Artificial Sequence
  chemically synthesized
attaacaatccctgagtgattc

SEQ ID NO: 681489 - DNA, 22 bp, Artificial Sequence
  chemically synthesized
gccgccctttggaatcactcag

SEQ ID NO: 681490 - DNA, 22 bp, Artificial Sequence
  chemically synthesized
aatttattaacaatccctgagt

SEQ ID NO: 681491 - DNA, 22 bp, Artificial Sequence
  chemically synthesized
tggaatcactcagggattgtta

SEQ ID NO: 681492 - DNA, 22 bp, Artificial Sequence
  chemically synthesized
ggaatcactcagggattgttaa

SEQ ID NO: 681493 - DNA, 22 bp, Artificial Sequence
  chemically synthesized
gaatcactcagggattgttaat

SEQ ID NO: 681494 - DNA, 22 bp, Artificial Sequence
  chemically synthesized
agggattgttaataaatttaga

SEQ ID NO: 681495 - DNA, 22 bp, Artificial Sequence
  chemically synthesized
ttaataaatttagatgtttggg

SEQ ID NO: 681496 - DNA, 22 bp, Artificial Sequence
  chemically synthesized
agggtggtgagacccaaacatc

SEQ ID NO: 681497 - DNA, 22 bp, Artificial Sequence
  chemically synthesized
ataaatttagatgtttgggtct

SEQ ID NO: 681498 - DNA, 22 bp, Artificial Sequence
  chemically synthesized
gaatctcagggtggtgagaccc

SEQ ID NO: 681499 - DNA, 22 bp, Artificial Sequence
  chemically synthesized
agatgtttgggtctcaccaccc

SEQ ID NO: 681500 - DNA, 22 bp, Artificial Sequence
  chemically synthesized
gatgtttgggtctcaccaccct

SEQ ID NO: 681501 - DNA, 22 bp, Artificial Sequence
  chemically synthesized
aattagaatctcagggtggtga

SEQ ID NO: 681502 - DNA, 22 bp, Artificial Sequence
  chemically synthesized
gggtctcaccaccctgagattc

SEQ ID NO: 681503 - DNA, 22 bp, Artificial Sequence
  chemically synthesized
ggtctcaccaccctgagattct

SEQ ID NO: 681504 - DNA, 22 bp, Artificial Sequence
  chemically synthesized
accaccctgagattctaattta

SEQ ID NO: 681505 - DNA, 22 bp, Artificial Sequence
  chemically synthesized
atgtccaagaccaattaaatta

SEQ ID NO: 681506 - DNA, 22 bp, Artificial Sequence
  chemically synthesized
agattctaatttaattggtctt

SEQ ID NO: 681507 - DNA, 22 bp, Artificial Sequence
  chemically synthesized
gaaatcctaatgtccaagacca

SEQ ID NO: 681508 - DNA, 22 bp, Artificial Sequence
  chemically synthesized
agaaatcctaatgtccaagacc

SEQ ID NO: 681509 - DNA, 22 bp, Artificial Sequence
  chemically synthesized
taatttaattggtcttggacat

SEQ ID NO: 681510 - DNA, 22 bp, Artificial Sequence
  chemically synthesized
atttaattggtcttggacatta

SEQ ID NO: 681511 - DNA, 22 bp, Artificial Sequence
  chemically synthesized
aattggtcttggacattaggat

SEQ ID NO: 681512 - DNA, 22 bp, Artificial Sequence
  chemically synthesized
attggtcttggacattaggatt

SEQ ID NO: 681513 - DNA, 22 bp, Artificial Sequence
  chemically synthesized
gagagtcttagaaatcctaatg

SEQ ID NO: 681514 - DNA, 22 bp, Artificial Sequence
  chemically synthesized
ggagagtcttagaaatcctaat

SEQ ID NO: 681515 - DNA, 22 bp, Artificial Sequence
  chemically synthesized
gtcttggacattaggatttcta

SEQ ID NO: 681516 - DNA, 22 bp, Artificial Sequence
  chemically synthesized
ggacattaggatttctaagact

SEQ ID NO: 681517 - DNA, 22 bp, Artificial Sequence
  chemically synthesized
gacattaggatttctaagactc

SEQ ID NO: 681518 - DNA, 22 bp, Artificial Sequence
  chemically synthesized
gaatcacttggagagtcttaga

SEQ ID NO: 681519 - DNA, 22 bp, Artificial Sequence
  chemically synthesized
ggatttctaagactctccaagt

SEQ ID NO: 681520 - DNA, 22 bp, Artificial Sequence
  chemically synthesized
catattagaatcacttggagag

SEQ ID NO: 681521 - DNA, 22 bp, Artificial Sequence
  chemically synthesized
actgcatattagaatcacttgg

SEQ ID NO: 681522 - DNA, 22 bp, Artificial Sequence
  chemically synthesized
cactgcatattagaatcacttg

SEQ ID NO: 681523 - DNA, 22 bp, Artificial Sequence
  chemically synthesized
ctaagactctccaagtgattct

SEQ ID NO: 681524 - DNA, 22 bp, Artificial Sequence
  chemically synthesized
taagactctccaagtgattcta

SEQ ID NO: 681525 - DNA, 22 bp, Artificial Sequence
  chemically synthesized
agactctccaagtgattctaat

SEQ ID NO: 681526 - DNA, 22 bp, Artificial Sequence
  chemically synthesized
accttcactgcatattagaatc

SEQ ID NO: 681527 - DNA, 22 bp, Artificial Sequence
  chemically synthesized
aaccttcactgcatattagaat

SEQ ID NO: 681528 - DNA, 22 bp, Artificial Sequence
  chemically synthesized
tccaagtgattctaatatgcag

SEQ ID NO: 681529 - DNA, 22 bp, Artificial Sequence
  chemically synthesized
caagtgattctaatatgcagtg

SEQ ID NO: 681530 - DNA, 22 bp, Artificial Sequence
  chemically synthesized
taatatgcagtgaaggttaagg

SEQ ID NO: 681531 - DNA, 22 bp, Artificial Sequence
  chemically synthesized
aaggacaatggtccttaacctt

SEQ ID NO: 681532 - DNA, 22 bp, Artificial Sequence
  chemically synthesized
atatgcagtgaaggttaaggac

SEQ ID NO: 681533 - DNA, 22 bp, Artificial Sequence
  chemically synthesized
tcactcaaggacaatggtcctt

SEQ ID NO: 681534 - DNA, 22 bp, Artificial Sequence
  chemically synthesized
ttgtcactcaaggacaatggtc

SEQ ID NO: 681535 - DNA, 22 bp, Artificial Sequence
  chemically synthesized
gttgtcactcaaggacaatggt

SEQ ID NO: 681536 - DNA, 22 bp, Artificial Sequence
  chemically synthesized
tgttgtcactcaaggacaatgg

SEQ ID NO: 681537 - DNA, 22 bp, Artificial Sequence
  chemically synthesized
aggaccattgtccttgagtgac

SEQ ID NO: 681538 - DNA, 22 bp, Artificial Sequence
  chemically synthesized
atccaatctttgttgtcactca

SEQ ID NO: 681539 - DNA, 22 bp, Artificial Sequence
  chemically synthesized
ctcatccaatctttgttgtcac

SEQ ID NO: 681540 - DNA, 22 bp, Artificial Sequence
  chemically synthesized
tccttgagtgacaacaaagatt

SEQ ID NO: 681541 - DNA, 22 bp, Artificial Sequence
  chemically synthesized
gagtgacaacaaagattggatg

SEQ ID NO: 681542 - DNA, 22 bp, Artificial Sequence
  chemically synthesized
agtgacaacaaagattggatga

SEQ ID NO: 681543 - DNA, 22 bp, Artificial Sequence
  chemically synthesized
ggagaatgctactcatccaatc

SEQ ID NO: 681544 - DNA, 22 bp, Artificial Sequence
  chemically synthesized
gctcggagaatgctactcatcc

SEQ ID NO: 681545 - DNA, 22 bp, Artificial Sequence
  chemically synthesized
ctagctcggagaatgctactca

SEQ ID NO: 681546 - DNA, 22 bp, Artificial Sequence
  chemically synthesized
aaattcctagctcggagaatgc

SEQ ID NO: 681547 - DNA, 22 bp, Artificial Sequence
  chemically synthesized
ctgaaattcctagctcggagaa

SEQ ID NO: 681548 - DNA, 22 bp, Artificial Sequence
  chemically synthesized
gatgagtagcattctccgagct

SEQ ID NO: 681549 - DNA, 22 bp, Artificial Sequence
  chemically synthesized
ctcctgaaattcctagctcgga

SEQ ID NO: 681550 - DNA, 22 bp, Artificial Sequence
  chemically synthesized
ccccctcctcctgaaattccta

SEQ ID NO: 681551 - DNA, 22 bp, Artificial Sequence
  chemically synthesized
tgccccctcctcctgaaattcc

SEQ ID NO: 681552 - DNA, 22 bp, Artificial Sequence
  chemically synthesized
ctgccccctcctcctgaaattc

SEQ ID NO: 681553 - DNA, 22 bp, Artificial Sequence
  chemically synthesized
tccgagctaggaatttcaggag

SEQ ID NO: 681554 - DNA, 22 bp, Artificial Sequence
  chemically synthesized
ttctgccccctcctcctgaaat

SEQ ID NO: 681555 - DNA, 22 bp, Artificial Sequence
  chemically synthesized
cgagctaggaatttcaggagga

SEQ ID NO: 681556 - DNA, 22 bp, Artificial Sequence
  chemically synthesized
accctcttctgccccctcctcc

SEQ ID NO: 681557 - DNA, 22 bp, Artificial Sequence
  chemically synthesized
ggaatttcaggaggagggggca

SEQ ID NO: 681558 - DNA, 22 bp, Artificial Sequence
  chemically synthesized
ctaaccctcttctgccccctcc

SEQ ID NO: 681559 - DNA, 22 bp, Artificial Sequence
  chemically synthesized
cctaaccctcttctgccccctc

SEQ ID NO: 681560 - DNA, 22 bp, Artificial Sequence
  chemically synthesized
tcctaaccctcttctgccccct

SEQ ID NO: 681561 - DNA, 22 bp, Artificial Sequence
  chemically synthesized
tttcctaaccctcttctgcccc

SEQ ID NO: 681562 - DNA, 22 bp, Artificial Sequence
  chemically synthesized
caggaggagggggcagaagagg

SEQ ID NO: 681563 - DNA, 22 bp, Artificial Sequence
  chemically synthesized
aggaggagggggcagaagaggg

SEQ ID NO: 681564 - DNA, 22 bp, Artificial Sequence
  chemically synthesized
atcatctctttcctaaccctct

SEQ ID NO: 681565 - DNA, 22 bp, Artificial Sequence
  chemically synthesized
gattcatcatctctttcctaac

SEQ ID NO: 681566 - DNA, 22 bp, Artificial Sequence
  chemically synthesized
aagactggattcatcatctctt

SEQ ID NO: 681567 - DNA, 22 bp, Artificial Sequence
  chemically synthesized
tgttcaagactggattcatcat

SEQ ID NO: 681568 - DNA, 22 bp, Artificial Sequence
  chemically synthesized
ggaaagagatgatgaatccagt

SEQ ID NO: 681569 - DNA, 22 bp, Artificial Sequence
  chemically synthesized
attatgttcaagactggattca

SEQ ID NO: 681570 - DNA, 22 bp, Artificial Sequence
  chemically synthesized
caattcattatgttcaagactg

SEQ ID NO: 681571 - DNA, 22 bp, Artificial Sequence
  chemically synthesized
catcaccacctccaattcatta

SEQ ID NO: 681572 - DNA, 22 bp, Artificial Sequence
  chemically synthesized
acatcaccacctccaattcatt

SEQ ID NO: 681573 - DNA, 22 bp, Artificial Sequence
  chemically synthesized
tacatcaccacctccaattcat

SEQ ID NO: 681574 - DNA, 22 bp, Artificial Sequence
  chemically synthesized
ttacatcaccacctccaattca

SEQ ID NO: 681575 - DNA, 22 bp, Artificial Sequence
  chemically synthesized
gaacataatgaattggaggtgg

SEQ ID NO: 681576 - DNA, 22 bp, Artificial Sequence
  chemically synthesized
aacataatgaattggaggtggt

SEQ ID NO: 681577 - DNA, 22 bp, Artificial Sequence
  chemically synthesized
cacttttacatcaccacctcca

SEQ ID NO: 681578 - DNA, 22 bp, Artificial Sequence
  chemically synthesized
gatacctgcacttttacatcac

SEQ ID NO: 681579 - DNA, 22 bp, Artificial Sequence
  chemically synthesized
ggatacctgcacttttacatca

SEQ ID NO: 681580 - DNA, 22 bp, Artificial Sequence
  chemically synthesized
ttggatacctgcacttttacat

SEQ ID NO: 681581 - DNA, 22 bp, Artificial Sequence
  chemically synthesized
gaggtggtgatgtaaaagtgca

SEQ ID NO: 681582 - DNA, 22 bp, Artificial Sequence
  chemically synthesized
tctcttggatacctgcactttt

SEQ ID NO: 681583 - DNA, 22 bp, Artificial Sequence
  chemically synthesized
agatgtccaactgtctcttgga

SEQ ID NO: 681584 - DNA, 22 bp, Artificial Sequence
  chemically synthesized
aagactcagatgtccaactgtc

SEQ ID NO: 681585 - DNA, 22 bp, Artificial Sequence
  chemically synthesized
agctcaagactcagatgtccaa

SEQ ID NO: 681586 - DNA, 22 bp, Artificial Sequence
  chemically synthesized
tgagctcaagactcagatgtcc

SEQ ID NO: 681587 - DNA, 22 bp, Artificial Sequence
  chemically synthesized
cctctgagctcaagactcagat

SEQ ID NO: 681588 - DNA, 22 bp, Artificial Sequence
  chemically synthesized
ccctctgagctcaagactcaga

SEQ ID NO: 681589 - DNA, 22 bp, Artificial Sequence
  chemically synthesized
gacatctgagtcttgagctcag

SEQ ID NO: 681590 - DNA, 22 bp, Artificial Sequence
  chemically synthesized
agacatcttccctctgagctca

SEQ ID NO: 681591 - DNA, 22 bp, Artificial Sequence
  chemically synthesized
caattcagacatcttccctctg

SEQ ID NO: 681592 - DNA, 22 bp, Artificial Sequence
  chemically synthesized
agtcttgagctcagagggaaga

SEQ ID NO: 681593 - DNA, 22 bp, Artificial Sequence
  chemically synthesized
gagctcagagggaagatgtctg

SEQ ID NO: 681594 - DNA, 22 bp, Artificial Sequence
  chemically synthesized
agctcagagggaagatgtctga

SEQ ID NO: 681595 - DNA, 22 bp, Artificial Sequence
  chemically synthesized
agagggaagatgtctgaattgg

SEQ ID NO: 681596 - DNA, 22 bp, Artificial Sequence
  chemically synthesized
caaatccatagctccaattcag

SEQ ID NO: 681597 - DNA, 22 bp, Artificial Sequence
  chemically synthesized
caacagtacactgcaaatccat

SEQ ID NO: 681598 - DNA, 22 bp, Artificial Sequence
  chemically synthesized
ccaacagtacactgcaaatcca

SEQ ID NO: 681599 - DNA, 22 bp, Artificial Sequence
  chemically synthesized
aattggagctatggatttgcag

SEQ ID NO: 681600 - DNA, 22 bp, Artificial Sequence
  chemically synthesized
gagctatggatttgcagtgtac

SEQ ID NO: 681601 - DNA, 22 bp, Artificial Sequence
  chemically synthesized
tggatttgcagtgtactgttgg

SEQ ID NO: 681602 - DNA, 22 bp, Artificial Sequence
  chemically synthesized
gaacccaagacccttccaacag

SEQ ID NO: 681603 - DNA, 22 bp, Artificial Sequence
  chemically synthesized
gcagtgtactgttggaagggtc

SEQ ID NO: 681604 - DNA, 22 bp, Artificial Sequence
  chemically synthesized
attcgaacccaagacccttcca

SEQ ID NO: 681605 - DNA, 22 bp, Artificial Sequence
  chemically synthesized
cagtgtactgttggaagggtct

SEQ ID NO: 681606 - DNA, 22 bp, Artificial Sequence
  chemically synthesized
gatgggctcattcgaacccaag

SEQ ID NO: 681607 - DNA, 22 bp, Artificial Sequence
  chemically synthesized
ttggaagggtcttgggttcgaa

SEQ ID NO: 681608 - DNA, 22 bp, Artificial Sequence
  chemically synthesized
gaagggtcttgggttcgaatga

SEQ ID NO: 681609 - DNA, 22 bp, Artificial Sequence
  chemically synthesized
cactagatgggctcattcgaac

SEQ ID NO: 681610 - DNA, 22 bp, Artificial Sequence
  chemically synthesized
acagcctccactagatgggctc

SEQ ID NO: 681611 - DNA, 22 bp, Artificial Sequence
  chemically synthesized
cacagcctccactagatgggct

SEQ ID NO: 681612 - DNA, 22 bp, Artificial Sequence
  chemically synthesized
gggttcgaatgagcccatctag

SEQ ID NO: 681613 - DNA, 22 bp, Artificial Sequence
  chemically synthesized
ggttcgaatgagcccatctagt

SEQ ID NO: 681614 - DNA, 22 bp, Artificial Sequence
  chemically synthesized
gcccttcacagcctccactaga

SEQ ID NO: 681615 - DNA, 22 bp, Artificial Sequence
  chemically synthesized
gaatgagcccatctagtggagg

SEQ ID NO: 681616 - DNA, 22 bp, Artificial Sequence
  chemically synthesized
ttggcccttcacagcctccact

SEQ ID NO: 681617 - DNA, 22 bp, Artificial Sequence
  chemically synthesized
agctgttggcccttcacagcct

SEQ ID NO: 681618 - DNA, 22 bp, Artificial Sequence
  chemically synthesized
cagctgttggcccttcacagcc

SEQ ID NO: 681619 - DNA, 22 bp, Artificial Sequence
  chemically synthesized
gtttcagctgttggcccttcac

SEQ ID NO: 681620 - DNA, 22 bp, Artificial Sequence
  chemically synthesized
gtggaggctgtgaagggccaac

SEQ ID NO: 681621 - DNA, 22 bp, Artificial Sequence
  chemically synthesized
tgaagggccaacagctgaaact

SEQ ID NO: 681622 - DNA, 22 bp, Artificial Sequence
  chemically synthesized
tggaaggtaggaacagcctagt

SEQ ID NO: 681623 - DNA, 22 bp, Artificial Sequence
  chemically synthesized
gtggaaggtaggaacagcctag

SEQ ID NO: 681624 - DNA, 22 bp, Artificial Sequence
  chemically synthesized
aaactaggctgttcctaccttc

SEQ ID NO: 681625 - DNA, 22 bp, Artificial Sequence
  chemically synthesized
ggctgttcctaccttccacaaa

SEQ ID NO: 681626 - DNA, 22 bp, Artificial Sequence
  chemically synthesized
ttcctaccttccacaaacacat

SEQ ID NO: 681627 - DNA, 22 bp, Artificial Sequence
  chemically synthesized
ctaccttccacaaacacatctt

SEQ ID NO: 681628 - DNA, 22 bp, Artificial Sequence
  chemically synthesized
ccttccacaaacacatcttttt

SEQ ID NO: 681629 - DNA, 22 bp, Artificial Sequence
  chemically synthesized
ccacaaacacatctttttcctt

SEQ ID NO: 681630 - DNA, 22 bp, Artificial Sequence
  chemically synthesized
cacaaacacatctttttccttt

SEQ ID NO: 681631 - DNA, 22 bp, Artificial Sequence
  chemically synthesized
aaaccacatgcaacccagaaag

SEQ ID NO: 681632 - DNA, 22 bp, Artificial Sequence
  chemically synthesized
tttcctttctgggttgcatgtg

SEQ ID NO: 681633 - DNA, 22 bp, Artificial Sequence
  chemically synthesized
ttcctttctgggttgcatgtgg

SEQ ID NO: 681634 - DNA, 22 bp, Artificial Sequence
  chemically synthesized
tcctttctgggttgcatgtggt

SEQ ID NO: 681635 - DNA, 22 bp, Artificial Sequence
  chemically synthesized
cctttctgggttgcatgtggtt

SEQ ID NO: 681636 - DNA, 22 bp, Artificial Sequence
  chemically synthesized
ctttctgggttgcatgtggttt

SEQ ID NO: 681637 - DNA, 22 bp, Artificial Sequence
  chemically synthesized
tctgggttgcatgtggtttcaa

SEQ ID NO: 681638 - DNA, 22 bp, Artificial Sequence
  chemically synthesized
ctgggttgcatgtggtttcaat

SEQ ID NO: 681639 - DNA, 22 bp, Artificial Sequence
  chemically synthesized
tgggttgcatgtggtttcaatg

SEQ ID NO: 681640 - DNA, 22 bp, Artificial Sequence
  chemically synthesized
gcatcaggccaacattgaaacc

SEQ ID NO: 681641 - DNA, 22 bp, Artificial Sequence
  chemically synthesized
ggttgcatgtggtttcaatgtt

SEQ ID NO: 681642 - DNA, 22 bp, Artificial Sequence
  chemically synthesized
catgtggtttcaatgttggcct

SEQ ID NO: 681643 - DNA, 22 bp, Artificial Sequence
  chemically synthesized
cacagctagcatcaggccaaca

SEQ ID NO: 681644 - DNA, 22 bp, Artificial Sequence
  chemically synthesized
acacagctagcatcaggccaac

SEQ ID NO: 681645 - DNA, 22 bp, Artificial Sequence
  chemically synthesized
tacacagctagcatcaggccaa

SEQ ID NO: 681646 - DNA, 22 bp, Artificial Sequence
  chemically synthesized
ttacacagctagcatcaggcca

SEQ ID NO: 681647 - DNA, 22 bp, Artificial Sequence
  chemically synthesized
catttttacacagctagcatca

SEQ ID NO: 681648 - DNA, 22 bp, Artificial Sequence
  chemically synthesized
caatgttggcctgatgctagct

SEQ ID NO: 681649 - DNA, 22 bp, Artificial Sequence
  chemically synthesized
aatgttggcctgatgctagctg

SEQ ID NO: 681650 - DNA, 22 bp, Artificial Sequence
  chemically synthesized
tgcatttttacacagctagcat

SEQ ID NO: 681651 - DNA, 22 bp, Artificial Sequence
  chemically synthesized
gcctgatgctagctgtgtaaaa

SEQ ID NO: 681652 - DNA, 22 bp, Artificial Sequence
  chemically synthesized
tgccactctgcatttttacaca

SEQ ID NO: 681653 - DNA, 22 bp, Artificial Sequence
  chemically synthesized
ctatgccactctgcatttttac

SEQ ID NO: 681654 - DNA, 22 bp, Artificial Sequence
  chemically synthesized
atgctagctgtgtaaaaatgca

SEQ ID NO: 681655 - DNA, 22 bp, Artificial Sequence
  chemically synthesized
cctatgccactctgcattttta

SEQ ID NO: 681656 - DNA, 22 bp, Artificial Sequence
  chemically synthesized
tcctatgccactctgcattttt

SEQ ID NO: 681657 - DNA, 22 bp, Artificial Sequence
  chemically synthesized
gctgtgtaaaaatgcagagtgg

SEQ ID NO: 681658 - DNA, 22 bp, Artificial Sequence
  chemically synthesized
tcctttcctatgccactctgca

SEQ ID NO: 681659 - DNA, 22 bp, Artificial Sequence
  chemically synthesized
gtcctttcctatgccactctgc

SEQ ID NO: 681660 - DNA, 22 bp, Artificial Sequence
  chemically synthesized
tgtcctttcctatgccactctg

SEQ ID NO: 681661 - DNA, 22 bp, Artificial Sequence
  chemically synthesized
tgtaaaaatgcagagtggcata

SEQ ID NO: 681662 - DNA, 22 bp, Artificial Sequence
  chemically synthesized
tctttgtcctttcctatgccac

SEQ ID NO: 681663 - DNA, 22 bp, Artificial Sequence
  chemically synthesized
gtctttgtcctttcctatgcca

SEQ ID NO: 681664 - DNA, 22 bp, Artificial Sequence
  chemically synthesized
cttgtctttgtcctttcctatg

SEQ ID NO: 681665 - DNA, 22 bp, Artificial Sequence
  chemically synthesized
aaaccattccttgtctttgtcc

SEQ ID NO: 681666 - DNA, 22 bp, Artificial Sequence
  chemically synthesized
caggcaagtacccagttcaaac

SEQ ID NO: 681667 - DNA, 22 bp, Artificial Sequence
  chemically synthesized
gggaccatccctccaggcaagt

SEQ ID NO: 681668 - DNA, 22 bp, Artificial Sequence
  chemically synthesized
tcgggaccatccctccaggcaa

SEQ ID NO: 681669 - DNA, 22 bp, Artificial Sequence
  chemically synthesized
gaactgggtacttgcctggagg

SEQ ID NO: 681670 - DNA, 22 bp, Artificial Sequence
  chemically synthesized
aactgggtacttgcctggaggg

SEQ ID NO: 681671 - DNA, 22 bp, Artificial Sequence
  chemically synthesized
ggtacttgcctggagggatggt

SEQ ID NO: 681672 - DNA, 22 bp, Artificial Sequence
  chemically synthesized
gtgaagtctctcgggaccatcc

SEQ ID NO: 681673 - DNA, 22 bp, Artificial Sequence
  chemically synthesized
gcctggagggatggtcccgaga

SEQ ID NO: 681674 - DNA, 22 bp, Artificial Sequence
  chemically synthesized
cctggagggatggtcccgagag

SEQ ID NO: 681675 - DNA, 22 bp, Artificial Sequence
  chemically synthesized
ggagttggtgaagtctctcggg

SEQ ID NO: 681676 - DNA, 22 bp, Artificial Sequence
  chemically synthesized
gagggatggtcccgagagactt

SEQ ID NO: 681677 - DNA, 22 bp, Artificial Sequence
  chemically synthesized
aaccctaggagttggtgaagtc

SEQ ID NO: 681678 - DNA, 22 bp, Artificial Sequence
  chemically synthesized
caccaactcctagggttcagct

SEQ ID NO: 681679 - DNA, 22 bp, Artificial Sequence
  chemically synthesized
tagatagagagaagctgaaccc

SEQ ID NO: 681680 - DNA, 22 bp, Artificial Sequence
  chemically synthesized
accaactcctagggttcagctt

SEQ ID NO: 681681 - DNA, 22 bp, Artificial Sequence
  chemically synthesized
ctagggttcagcttctctctat

SEQ ID NO: 681682 - DNA, 22 bp, Artificial Sequence
  chemically synthesized
gggcgcactatagatagagaga

SEQ ID NO: 681683 - DNA, 22 bp, Artificial Sequence
  chemically synthesized
agggcgcactatagatagagag

SEQ ID NO: 681684 - DNA, 22 bp, Artificial Sequence
  chemically synthesized
gggttcagcttctctctatcta

SEQ ID NO: 681685 - DNA, 22 bp, Artificial Sequence
  chemically synthesized
aaacttagggcgcactatagat

SEQ ID NO: 681686 - DNA, 22 bp, Artificial Sequence
  chemically synthesized
agcttctctctatctatagtgc

SEQ ID NO: 681687 - DNA, 22 bp, Artificial Sequence
  chemically synthesized
tactaaaacttagggcgcacta

SEQ ID NO: 681688 - DNA, 22 bp, Artificial Sequence
  chemically synthesized
ctctctatctatagtgcgccct

SEQ ID NO: 681689 - DNA, 22 bp, Artificial Sequence
  chemically synthesized
tctctatctatagtgcgcccta

SEQ ID NO: 681690 - DNA, 22 bp, Artificial Sequence
  chemically synthesized
tctatctatagtgcgccctaag

SEQ ID NO: 681691 - DNA, 22 bp, Artificial Sequence
  chemically synthesized
tatctatagtgcgccctaagtt

SEQ ID NO: 681692 - DNA, 22 bp, Artificial Sequence
  chemically synthesized
tctatagtgcgccctaagtttt

SEQ ID NO: 681693 - DNA, 22 bp, Artificial Sequence
  chemically synthesized
tagtgcgccctaagttttagta

SEQ ID NO: 681694 - DNA, 22 bp, Artificial Sequence
  chemically synthesized
taaagtgatgcaggttatacta

SEQ ID NO: 681695 - DNA, 22 bp, Artificial Sequence
  chemically synthesized
ataaagtgatgcaggttatact

SEQ ID NO: 681696 - DNA, 22 bp, Artificial Sequence
  chemically synthesized
tataaagtgatgcaggttatac

SEQ ID NO: 681697 - DNA, 22 bp, Artificial Sequence
  chemically synthesized
ttataaagtgatgcaggttata

SEQ ID NO: 681698 - DNA, 22 bp, Artificial Sequence
  chemically synthesized
agttttagtataacctgcatca

SEQ ID NO: 681699 - DNA, 22 bp, Artificial Sequence
  chemically synthesized
tagtataacctgcatcacttta

SEQ ID NO: 681700 - DNA, 22 bp, Artificial Sequence
  chemically synthesized
aatgaatttttataaagtgatg

SEQ ID NO: 681701 - DNA, 22 bp, Artificial Sequence
  chemically synthesized
agtataacctgcatcactttat

SEQ ID NO: 681702 - DNA, 22 bp, Artificial Sequence
  chemically synthesized
gtataacctgcatcactttata

SEQ ID NO: 681703 - DNA, 22 bp, Artificial Sequence
  chemically synthesized
taaatgaatttttataaagtga

SEQ ID NO: 681704 - DNA, 22 bp, Artificial Sequence
  chemically synthesized
tactctaaatgaatttttataa

SEQ ID NO: 681705 - DNA, 22 bp, Artificial Sequence
  chemically synthesized
catcactttataaaaattcatt

SEQ ID NO: 681706 - DNA, 22 bp, Artificial Sequence
  chemically synthesized
aagtgatacctatactctaaat

SEQ ID NO: 681707 - DNA, 22 bp, Artificial Sequence
  chemically synthesized
tataaaaattcatttagagtat

SEQ ID NO: 681708 - DNA, 22 bp, Artificial Sequence
  chemically synthesized
ataaaaattcatttagagtata

SEQ ID NO: 681709 - DNA, 22 bp, Artificial Sequence
  chemically synthesized
taaaaattcatttagagtatag

SEQ ID NO: 681710 - DNA, 22 bp, Artificial Sequence
  chemically synthesized
attgaagtgatacctatactct

SEQ ID NO: 681711 - DNA, 22 bp, Artificial Sequence
  chemically synthesized
gagttaattgaagtgataccta

SEQ ID NO: 681712 - DNA, 22 bp, Artificial Sequence
  chemically synthesized
atttagagtataggtatcactt

SEQ ID NO: 681713 - DNA, 22 bp, Artificial Sequence
  chemically synthesized
agagtataggtatcacttcaat

SEQ ID NO: 681714 - DNA, 22 bp, Artificial Sequence
  chemically synthesized
gagtataggtatcacttcaatt

SEQ ID NO: 681715 - DNA, 22 bp, Artificial Sequence
  chemically synthesized
tagaatatgtattcgagttaat

SEQ ID NO: 681716 - DNA, 22 bp, Artificial Sequence
  chemically synthesized
ctatagaatatgtattcgagtt

SEQ ID NO: 681717 - DNA, 22 bp, Artificial Sequence
  chemically synthesized
actatagaatatgtattcgagt

SEQ ID NO: 681718 - DNA, 22 bp, Artificial Sequence
  chemically synthesized
tactatagaatatgtattcgag

SEQ ID NO: 681719 - DNA, 22 bp, Artificial Sequence
  chemically synthesized
caattaactcgaatacatattc

SEQ ID NO: 681720 - DNA, 22 bp, Artificial Sequence
  chemically synthesized
aattaactcgaatacatattct

SEQ ID NO: 681721 - DNA, 22 bp, Artificial Sequence
  chemically synthesized
acattttactatagaatatgta

SEQ ID NO: 681722 - DNA, 22 bp, Artificial Sequence
  chemically synthesized
actcgaatacatattctatagt

SEQ ID NO: 681723 - DNA, 22 bp, Artificial Sequence
  chemically synthesized
gaatacatattctatagtaaaa

SEQ ID NO: 681724 - DNA, 22 bp, Artificial Sequence
  chemically synthesized
tatacccaaatgctgacatttt

SEQ ID NO: 681725 - DNA, 22 bp, Artificial Sequence
  chemically synthesized
ttgtatacccaaatgctgacat

SEQ ID NO: 681726 - DNA, 22 bp, Artificial Sequence
  chemically synthesized
attgtatacccaaatgctgaca

SEQ ID NO: 681727 - DNA, 22 bp, Artificial Sequence
  chemically synthesized
tattgtatacccaaatgctgac

SEQ ID NO: 681728 - DNA, 22 bp, Artificial Sequence
  chemically synthesized
tatagtaaaatgtcagcatttg

SEQ ID NO: 681729 - DNA, 22 bp, Artificial Sequence
  chemically synthesized
tagtaaaatgtcagcatttggg

SEQ ID NO: 681730 - DNA, 22 bp, Artificial Sequence
  chemically synthesized
tgtctttattgtatacccaaat

SEQ ID NO: 681731 - DNA, 22 bp, Artificial Sequence
  chemically synthesized
atgtctttattgtatacccaaa

SEQ ID NO: 681732 - DNA, 22 bp, Artificial Sequence
  chemically synthesized
ttatgtctttattgtataccca

SEQ ID NO: 681733 - DNA, 22 bp, Artificial Sequence
  chemically synthesized
gggtatacaataaagacataag

SEQ ID NO: 681734 - DNA, 22 bp, Artificial Sequence
  chemically synthesized
ggtatacaataaagacataaga

SEQ ID NO: 681735 - DNA, 22 bp, Artificial Sequence
  chemically synthesized
tgcaaagaggaatatggaattc

SEQ ID NO: 681736 - DNA, 22 bp, Artificial Sequence
  chemically synthesized
tactatgcaaagaggaatatgg

SEQ ID NO: 681737 - DNA, 22 bp, Artificial Sequence
  chemically synthesized
gtactatgcaaagaggaatatg

SEQ ID NO: 681738 - DNA, 22 bp, Artificial Sequence
  chemically synthesized
gtacttgtactatgcaaagagg

SEQ ID NO: 681739 - DNA, 22 bp, Artificial Sequence
  chemically synthesized
catattcctctttgcatagtac

SEQ ID NO: 681740 - DNA, 22 bp, Artificial Sequence
  chemically synthesized
atggttagtacttgtactatgc

SEQ ID NO: 681741 - DNA, 22 bp, Artificial Sequence
  chemically synthesized
ttcatggttagtacttgtacta

SEQ ID NO: 681742 - DNA, 22 bp, Artificial Sequence
  chemically synthesized
ctctttgcatagtacaagtact

SEQ ID NO: 681743 - DNA, 22 bp, Artificial Sequence
  chemically synthesized
tttgcatagtacaagtactaac

SEQ ID NO: 681744 - DNA, 22 bp, Artificial Sequence
  chemically synthesized
tgcatagtacaagtactaacca

SEQ ID NO: 681745 - DNA, 22 bp, Artificial Sequence
  chemically synthesized
agtcactgttcatggttagtac

SEQ ID NO: 681746 - DNA, 22 bp, Artificial Sequence
  chemically synthesized
gcatagtacaagtactaaccat

SEQ ID NO: 681747 - DNA, 22 bp, Artificial Sequence
  chemically synthesized
catagtacaagtactaaccatg

SEQ ID NO: 681748 - DNA, 22 bp, Artificial Sequence
  chemically synthesized
gatgtctgagtcactgttcatg

SEQ ID NO: 681749 - DNA, 22 bp, Artificial Sequence
  chemically synthesized
ttagatgtctgagtcactgttc

SEQ ID NO: 681750 - DNA, 22 bp, Artificial Sequence
  chemically synthesized
gttagatgtctgagtcactgtt

SEQ ID NO: 681751 - DNA, 22 bp, Artificial Sequence
  chemically synthesized
accatgaacagtgactcagaca

SEQ ID NO: 681752 - DNA, 22 bp, Artificial Sequence
  chemically synthesized
accatacaccaacccatttgtt

SEQ ID NO: 681753 - DNA, 22 bp, Artificial Sequence
  chemically synthesized
agacatctaacaaatgggttgg

SEQ ID NO: 681754 - DNA, 22 bp, Artificial Sequence
  chemically synthesized
acaaatgggttggtgtatggtg

SEQ ID NO: 681755 - DNA, 22 bp, Artificial Sequence
  chemically synthesized
accagcaatgattcaccataca

SEQ ID NO: 681756 - DNA, 22 bp, Artificial Sequence
  chemically synthesized
ccctaaccagcaatgattcacc

SEQ ID NO: 681757 - DNA, 22 bp, Artificial Sequence
  chemically synthesized
gccctaaccagcaatgattcac

SEQ ID NO: 681758 - DNA, 22 bp, Artificial Sequence
  chemically synthesized
gtgtatggtgaatcattgctgg

SEQ ID NO: 681759 - DNA, 22 bp, Artificial Sequence
  chemically synthesized
taatatttgccctaaccagcaa

SEQ ID NO: 681760 - DNA, 22 bp, Artificial Sequence
  chemically synthesized
gtatgctataatatttgcccta

SEQ ID NO: 681761 - DNA, 22 bp, Artificial Sequence
  chemically synthesized
aattagtatgctataatatttg

SEQ ID NO: 681762 - DNA, 22 bp, Artificial Sequence
  chemically synthesized
caattagtatgctataatattt

SEQ ID NO: 681763 - DNA, 22 bp, Artificial Sequence
  chemically synthesized
ctggttagggcaaatattatag

SEQ ID NO: 681764 - DNA, 22 bp, Artificial Sequence
  chemically synthesized
gttagggcaaatattatagcat

SEQ ID NO: 681765 - DNA, 22 bp, Artificial Sequence
  chemically synthesized
gggcaaatattatagcatacta

SEQ ID NO: 681766 - DNA, 22 bp, Artificial Sequence
  chemically synthesized
tatatatatttcaattagtatg

SEQ ID NO: 681767 - DNA, 22 bp, Artificial Sequence
  chemically synthesized
ttatatatatatttcaattagt

SEQ ID NO: 681768 - DNA, 22 bp, Artificial Sequence
  chemically synthesized
tagcatactaattgaaatatat

SEQ ID NO: 681769 - DNA, 22 bp, Artificial Sequence
  chemically synthesized
gggggattgttatatatatatt

SEQ ID NO: 681770 - DNA, 22 bp, Artificial Sequence
  chemically synthesized
atctagggggattgttatatat

SEQ ID NO: 681771 - DNA, 22 bp, Artificial Sequence
  chemically synthesized
attgaaatatatatataacaat

SEQ ID NO: 681772 - DNA, 22 bp, Artificial Sequence
  chemically synthesized
aaatatatatataacaatcccc

SEQ ID NO: 681773 - DNA, 22 bp, Artificial Sequence
  chemically synthesized
agattgatctagggggattgtt

SEQ ID NO: 681774 - DNA, 22 bp, Artificial Sequence
  chemically synthesized
cagattgatctagggggattgt

SEQ ID NO: 681775 - DNA, 22 bp, Artificial Sequence
  chemically synthesized
gtttcagattgatctaggggga

SEQ ID NO: 681776 - DNA, 22 bp, Artificial Sequence
  chemically synthesized
catccagaagatgttggtttca

SEQ ID NO: 681777 - DNA, 22 bp, Artificial Sequence
  chemically synthesized
acatccagaagatgttggtttc

SEQ ID NO: 681778 - DNA, 22 bp, Artificial Sequence
  chemically synthesized
ttacatccagaagatgttggtt

SEQ ID NO: 681779 - DNA, 22 bp, Artificial Sequence
  chemically synthesized
gatcaatctgaaaccaacatct

SEQ ID NO: 681780 - DNA, 22 bp, Artificial Sequence
  chemically synthesized
gatattcttacatccagaagat

SEQ ID NO: 681781 - DNA, 22 bp, Artificial Sequence
  chemically synthesized
aaaccaacatcttctggatgta

SEQ ID NO: 681782 - DNA, 22 bp, Artificial Sequence
  chemically synthesized
gctggatattcttacatccaga

SEQ ID NO: 681783 - DNA, 22 bp, Artificial Sequence
  chemically synthesized
atgtgacctggctggatattct

SEQ ID NO: 681784 - DNA, 22 bp, Artificial Sequence
  chemically synthesized
ctggatgtaagaatatccagcc

SEQ ID NO: 681785 - DNA, 22 bp, Artificial Sequence
  chemically synthesized
tggatgtaagaatatccagcca

SEQ ID NO: 681786 - DNA, 22 bp, Artificial Sequence
  chemically synthesized
gttaatgtgacctggctggata

SEQ ID NO: 681787 - DNA, 22 bp, Artificial Sequence
  chemically synthesized
gatgtaagaatatccagccagg

SEQ ID NO: 681788 - DNA, 22 bp, Artificial Sequence
  chemically synthesized
ctggttaatgtgacctggctgg

SEQ ID NO: 681789 - DNA, 22 bp, Artificial Sequence
  chemically synthesized
gctggttaatgtgacctggctg

SEQ ID NO: 681790 - DNA, 22 bp, Artificial Sequence
  chemically synthesized
atttgctggttaatgtgacctg

SEQ ID NO: 681791 - DNA, 22 bp, Artificial Sequence
  chemically synthesized
catttgctggttaatgtgacct

SEQ ID NO: 681792 - DNA, 22 bp, Artificial Sequence
  chemically synthesized
ttcatttgctggttaatgtgac

SEQ ID NO: 681793 - DNA, 22 bp, Artificial Sequence
  chemically synthesized
gaggcctcttcatttgctggtt

SEQ ID NO: 681794 - DNA, 22 bp, Artificial Sequence
  chemically synthesized
agaggcctcttcatttgctggt

SEQ ID NO: 681795 - DNA, 22 bp, Artificial Sequence
  chemically synthesized
aacttagaggcctcttcatttg

SEQ ID NO: 681796 - DNA, 22 bp, Artificial Sequence
  chemically synthesized
tgtctgaacttagaggcctctt

SEQ ID NO: 681797 - DNA, 22 bp, Artificial Sequence
  chemically synthesized
accagcaaatgaagaggcctct

SEQ ID NO: 681798 - DNA, 22 bp, Artificial Sequence
  chemically synthesized
tgtgtctgaacttagaggcctc

SEQ ID NO: 681799 - DNA, 22 bp, Artificial Sequence
  chemically synthesized
tgtgggtgtgaagtgctctgtg

SEQ ID NO: 681800 - DNA, 22 bp, Artificial Sequence
  chemically synthesized
gtgtgggtgtgaagtgctctgt

SEQ ID NO: 681801 - DNA, 22 bp, Artificial Sequence
  chemically synthesized
taagttcagacacagagcactt

SEQ ID NO: 681802 - DNA, 22 bp, Artificial Sequence
  chemically synthesized
tgtgtgggtgtgaagtgctctg

SEQ ID NO: 681803 - DNA, 22 bp, Artificial Sequence
  chemically synthesized
ttgtgtgggtgtgaagtgctct

SEQ ID NO: 681804 - DNA, 22 bp, Artificial Sequence
  chemically synthesized
agttcagacacagagcacttca

SEQ ID NO: 681805 - DNA, 22 bp, Artificial Sequence
  chemically synthesized
agacacagagcacttcacaccc

SEQ ID NO: 681806 - DNA, 22 bp, Artificial Sequence
  chemically synthesized
gaaaaataggcttttgtgtggg

SEQ ID NO: 681807 - DNA, 22 bp, Artificial Sequence
  chemically synthesized
cacacccacacaaaagcctatt

SEQ ID NO: 681808 - DNA, 22 bp, Artificial Sequence
  chemically synthesized
acacccacacaaaagcctattt

SEQ ID NO: 681809 - DNA, 22 bp, Artificial Sequence
  chemically synthesized
aagagacagggcctggaaaaat

SEQ ID NO: 681810 - DNA, 22 bp, Artificial Sequence
  chemically synthesized
cctaaagagacagggcctggaa

SEQ ID NO: 681811 - DNA, 22 bp, Artificial Sequence
  chemically synthesized
cctccctaaagagacagggcct

SEQ ID NO: 681812 - DNA, 22 bp, Artificial Sequence
  chemically synthesized
tgcctccctaaagagacagggc

SEQ ID NO: 681813 - DNA, 22 bp, Artificial Sequence
  chemically synthesized
tttttccaggccctgtctcttt

SEQ ID NO: 681814 - DNA, 22 bp, Artificial Sequence
  chemically synthesized
ctctgcctccctaaagagacag

SEQ ID NO: 681815 - DNA, 22 bp, Artificial Sequence
  chemically synthesized
actctgcctccctaaagagaca

SEQ ID NO: 681816 - DNA, 22 bp, Artificial Sequence
  chemically synthesized
ttccaggccctgtctctttagg

SEQ ID NO: 681817 - DNA, 22 bp, Artificial Sequence
  chemically synthesized
tccaggccctgtctctttaggg

SEQ ID NO: 681818 - DNA, 22 bp, Artificial Sequence
  chemically synthesized
ccaggccctgtctctttaggga

SEQ ID NO: 681819 - DNA, 22 bp, Artificial Sequence
  chemically synthesized
gcttactctgcctccctaaaga

SEQ ID NO: 681820 - DNA, 22 bp, Artificial Sequence
  chemically synthesized
caggccctgtctctttagggag

SEQ ID NO: 681821 - DNA, 22 bp, Artificial Sequence
  chemically synthesized
agtctggcttactctgcctccc

SEQ ID NO: 681822 - DNA, 22 bp, Artificial Sequence
  chemically synthesized
ctgagtctggcttactctgcct

SEQ ID NO: 681823 - DNA, 22 bp, Artificial Sequence
  chemically synthesized
tctctttagggaggcagagtaa

SEQ ID NO: 681824 - DNA, 22 bp, Artificial Sequence
  chemically synthesized
cctgagtctggcttactctgcc

SEQ ID NO: 681825 - DNA, 22 bp, Artificial Sequence
  chemically synthesized
tcctgagtctggcttactctgc

SEQ ID NO: 681826 - DNA, 22 bp, Artificial Sequence
  chemically synthesized
tttagggaggcagagtaagcca

SEQ ID NO: 681827 - DNA, 22 bp, Artificial Sequence
  chemically synthesized
tagggaggcagagtaagccaga

SEQ ID NO: 681828 - DNA, 22 bp, Artificial Sequence
  chemically synthesized
agggaggcagagtaagccagac

SEQ ID NO: 681829 - DNA, 22 bp, Artificial Sequence
  chemically synthesized
gggaggcagagtaagccagact

SEQ ID NO: 681830 - DNA, 22 bp, Artificial Sequence
  chemically synthesized
acagagaactttcctgagtctg

SEQ ID NO: 681831 - DNA, 22 bp, Artificial Sequence
  chemically synthesized
gctcacagagaactttcctgag

SEQ ID NO: 681832 - DNA, 22 bp, Artificial Sequence
  chemically synthesized
gatggcagctggctcacagaga

SEQ ID NO: 681833 - DNA, 22 bp, Artificial Sequence
  chemically synthesized
agatggcagctggctcacagag

SEQ ID NO: 681834 - DNA, 22 bp, Artificial Sequence
  chemically synthesized
aggaaagttctctgtgagccag

SEQ ID NO: 681835 - DNA, 22 bp, Artificial Sequence
  chemically synthesized
gtttagatggcagctggctcac

SEQ ID NO: 681836 - DNA, 22 bp, Artificial Sequence
  chemically synthesized
tggtttagatggcagctggctc

SEQ ID NO: 681837 - DNA, 22 bp, Artificial Sequence
  chemically synthesized
tctgtgagccagctgccatcta

SEQ ID NO: 681838 - DNA, 22 bp, Artificial Sequence
  chemically synthesized
tgtgagccagctgccatctaaa

SEQ ID NO: 681839 - DNA, 22 bp, Artificial Sequence
  chemically synthesized
gtgaaatctctggtttagatgg

SEQ ID NO: 681840 - DNA, 22 bp, Artificial Sequence
  chemically synthesized
tgagccagctgccatctaaacc

SEQ ID NO: 681841 - DNA, 22 bp, Artificial Sequence
  chemically synthesized
tctggtgaaatctctggtttag

SEQ ID NO: 681842 - DNA, 22 bp, Artificial Sequence
  chemically synthesized
gaacctgtctggtgaaatctct

SEQ ID NO: 681843 - DNA, 22 bp, Artificial Sequence
  chemically synthesized
ccatctaaaccagagatttcac

SEQ ID NO: 681844 - DNA, 22 bp, Artificial Sequence
  chemically synthesized
tctggaacctgtctggtgaaat

SEQ ID NO: 681845 - DNA, 22 bp, Artificial Sequence
  chemically synthesized
atctggaacctgtctggtgaaa

SEQ ID NO: 681846 - DNA, 22 bp, Artificial Sequence
  chemically synthesized
tatctggaacctgtctggtgaa

SEQ ID NO: 681847 - DNA, 22 bp, Artificial Sequence
  chemically synthesized
aaccagagatttcaccagacag

SEQ ID NO: 681848 - DNA, 22 bp, Artificial Sequence
  chemically synthesized
gactttatctggaacctgtctg

SEQ ID NO: 681849 - DNA, 22 bp, Artificial Sequence
  chemically synthesized
caccagacaggttccagataaa

SEQ ID NO: 681850 - DNA, 22 bp, Artificial Sequence
  chemically synthesized
accagacaggttccagataaag

SEQ ID NO: 681851 - DNA, 22 bp, Artificial Sequence
  chemically synthesized
tgtgagagtgaagcagagctcg

SEQ ID NO: 681852 - DNA, 22 bp, Artificial Sequence
  chemically synthesized
cagataaagtcgagctctgctt

SEQ ID NO: 681853 - DNA, 22 bp, Artificial Sequence
  chemically synthesized
aaagaaaactgtgtgagagtga

SEQ ID NO: 681854 - DNA, 22 bp, Artificial Sequence
  chemically synthesized
ttaaaagaaaactgtgtgagag

SEQ ID NO: 681855 - DNA, 22 bp, Artificial Sequence
  chemically synthesized
attaaaagaaaactgtgtgaga

SEQ ID NO: 681856 - DNA, 22 bp, Artificial Sequence
  chemically synthesized
tgcttcactctcacacagtttt

SEQ ID NO: 681857 - DNA, 22 bp, Artificial Sequence
  chemically synthesized
cttcactctcacacagttttct

SEQ ID NO: 681858 - DNA, 22 bp, Artificial Sequence
  chemically synthesized
cactctcacacagttttctttt

SEQ ID NO: 681859 - DNA, 22 bp, Artificial Sequence
  chemically synthesized
agaaatcttattaaaagaaaac

SEQ ID NO: 681860 - DNA, 22 bp, Artificial Sequence
  chemically synthesized
actctcacacagttttctttta

SEQ ID NO: 681861 - DNA, 22 bp, Artificial Sequence
  chemically synthesized
gagaaatcttattaaaagaaaa

SEQ ID NO: 681862 - DNA, 22 bp, Artificial Sequence
  chemically synthesized
tgagaaatcttattaaaagaaa

SEQ ID NO: 681863 - DNA, 22 bp, Artificial Sequence
  chemically synthesized
tcacacagttttcttttaataa

SEQ ID NO: 681864 - DNA, 22 bp, Artificial Sequence
  chemically synthesized
acacagttttcttttaataaga

SEQ ID NO: 681865 - DNA, 22 bp, Artificial Sequence
  chemically synthesized
tgaagctttgagaaatcttatt

SEQ ID NO: 681866 - DNA, 22 bp, Artificial Sequence
  chemically synthesized
tgtgaagctttgagaaatctta

SEQ ID NO: 681867 - DNA, 22 bp, Artificial Sequence
  chemically synthesized
tcttttaataagatttctcaaa

SEQ ID NO: 681868 - DNA, 22 bp, Artificial Sequence
  chemically synthesized
cttttaataagatttctcaaag

SEQ ID NO: 681869 - DNA, 22 bp, Artificial Sequence
  chemically synthesized
ttttaataagatttctcaaagc

SEQ ID NO: 681870 - DNA, 22 bp, Artificial Sequence
  chemically synthesized
ttaataagatttctcaaagctt

SEQ ID NO: 681871 - DNA, 22 bp, Artificial Sequence
  chemically synthesized
taataagatttctcaaagcttc

SEQ ID NO: 681872 - DNA, 22 bp, Artificial Sequence
  chemically synthesized
aataagatttctcaaagcttca

SEQ ID NO: 681873 - DNA, 22 bp, Artificial Sequence
  chemically synthesized
ataagatttctcaaagcttcac

SEQ ID NO: 681874 - DNA, 22 bp, Artificial Sequence
  chemically synthesized
atataggtggctctgtgaagct

SEQ ID NO: 681875 - DNA, 22 bp, Artificial Sequence
  chemically synthesized
gatataggtggctctgtgaagc

SEQ ID NO: 681876 - DNA, 22 bp, Artificial Sequence
  chemically synthesized
ggcttgatataggtggctctgt

SEQ ID NO: 681877 - DNA, 22 bp, Artificial Sequence
  chemically synthesized
ctcaaagcttcacagagccacc

SEQ ID NO: 681878 - DNA, 22 bp, Artificial Sequence
  chemically synthesized
tcaaagcttcacagagccacct

SEQ ID NO: 681879 - DNA, 22 bp, Artificial Sequence
  chemically synthesized
aaagcttcacagagccacctat

SEQ ID NO: 681880 - DNA, 22 bp, Artificial Sequence
  chemically synthesized
gatgttcggcttgatataggtg

SEQ ID NO: 681881 - DNA, 22 bp, Artificial Sequence
  chemically synthesized
agatgttcggcttgatataggt

SEQ ID NO: 681882 - DNA, 22 bp, Artificial Sequence
  chemically synthesized
tagatgttcggcttgatatagg

SEQ ID NO: 681883 - DNA, 22 bp, Artificial Sequence
  chemically synthesized
ttagatgttcggcttgatatag

SEQ ID NO: 681884 - DNA, 22 bp, Artificial Sequence
  chemically synthesized
cacagagccacctatatcaagc

SEQ ID NO: 681885 - DNA, 22 bp, Artificial Sequence
  chemically synthesized
tttagatgttcggcttgatata

SEQ ID NO: 681886 - DNA, 22 bp, Artificial Sequence
  chemically synthesized
acagagccacctatatcaagcc

SEQ ID NO: 681887 - DNA, 22 bp, Artificial Sequence
  chemically synthesized
acatctttttagatgttcggct

SEQ ID NO: 681888 - DNA, 22 bp, Artificial Sequence
  chemically synthesized
aaattcacatctttttagatgt

SEQ ID NO: 681889 - DNA, 22 bp, Artificial Sequence
  chemically synthesized
tatcaagccgaacatctaaaaa

SEQ ID NO: 681890 - DNA, 22 bp, Artificial Sequence
  chemically synthesized
gtgaagatgctaaaattcacat

SEQ ID NO: 681891 - DNA, 22 bp, Artificial Sequence
  chemically synthesized
agtgaagatgctaaaattcaca

SEQ ID NO: 681892 - DNA, 22 bp, Artificial Sequence
  chemically synthesized
tagtgaagatgctaaaattcac

SEQ ID NO: 681893 - DNA, 22 bp, Artificial Sequence
  chemically synthesized
ttttagtgaagatgctaaaatt

SEQ ID NO: 681894 - DNA, 22 bp, Artificial Sequence
  chemically synthesized
attttagtgaagatgctaaaat

SEQ ID NO: 681895 - DNA, 22 bp, Artificial Sequence
  chemically synthesized
aaaagatgtgaattttagcatc

SEQ ID NO: 681896 - DNA, 22 bp, Artificial Sequence
  chemically synthesized
tattttagtgaagatgctaaaa

SEQ ID NO: 681897 - DNA, 22 bp, Artificial Sequence
  chemically synthesized
atgaagtatggctttattttag

SEQ ID NO: 681898 - DNA, 22 bp, Artificial Sequence
  chemically synthesized
tagcatcttcactaaaataaag

SEQ ID NO: 681899 - DNA, 22 bp, Artificial Sequence
  chemically synthesized
agcatcttcactaaaataaagc

SEQ ID NO: 681900 - DNA, 22 bp, Artificial Sequence
  chemically synthesized
gcatcttcactaaaataaagcc

SEQ ID NO: 681901 - DNA, 22 bp, Artificial Sequence
  chemically synthesized
tgaggttaatgaagtatggctt

SEQ ID NO: 681902 - DNA, 22 bp, Artificial Sequence
  chemically synthesized
cactaaaataaagccatacttc

SEQ ID NO: 681903 - DNA, 22 bp, Artificial Sequence
  chemically synthesized
actaaaataaagccatacttca

SEQ ID NO: 681904 - DNA, 22 bp, Artificial Sequence
  chemically synthesized
aaataaagccatacttcattaa

SEQ ID NO: 681905 - DNA, 22 bp, Artificial Sequence
  chemically synthesized
ccatgaagcaaccgtcggcctg

SEQ ID NO: 681906 - DNA, 22 bp, Artificial Sequence
  chemically synthesized
cattaacctcacaggccgacgg

SEQ ID NO: 681907 - DNA, 22 bp, Artificial Sequence
  chemically synthesized
cccatgaagcaaccgtcggcct

SEQ ID NO: 681908 - DNA, 22 bp, Artificial Sequence
  chemically synthesized
attaacctcacaggccgacggt

SEQ ID NO: 681909 - DNA, 22 bp, Artificial Sequence
  chemically synthesized
tcccatgaagcaaccgtcggcc

SEQ ID NO: 681910 - DNA, 22 bp, Artificial Sequence
  chemically synthesized
tttcccatgaagcaaccgtcgg

SEQ ID NO: 681911 - DNA, 22 bp, Artificial Sequence
  chemically synthesized
acctcacaggccgacggttgct

SEQ ID NO: 681912 - DNA, 22 bp, Artificial Sequence
  chemically synthesized
acaggccgacggttgcttcatg

SEQ ID NO: 681913 - DNA, 22 bp, Artificial Sequence
  chemically synthesized
caaattctttcccatgaagcaa

SEQ ID NO: 681914 - DNA, 22 bp, Artificial Sequence
  chemically synthesized
ataggtactccaaattctttcc

SEQ ID NO: 681915 - DNA, 22 bp, Artificial Sequence
  chemically synthesized
cttcatgggaaagaatttggag

SEQ ID NO: 681916 - DNA, 22 bp, Artificial Sequence
  chemically synthesized
catgggaaagaatttggagtac

SEQ ID NO: 681917 - DNA, 22 bp, Artificial Sequence
  chemically synthesized
gcaggctaataggtactccaaa

SEQ ID NO: 681918 - DNA, 22 bp, Artificial Sequence
  chemically synthesized
atgggaaagaatttggagtacc

SEQ ID NO: 681919 - DNA, 22 bp, Artificial Sequence
  chemically synthesized
tagctggcaggctaataggtac

SEQ ID NO: 681920 - DNA, 22 bp, Artificial Sequence
  chemically synthesized
tcgctatagctggcaggctaat

SEQ ID NO: 681921 - DNA, 22 bp, Artificial Sequence
  chemically synthesized
ggagtacctattagcctgccag

SEQ ID NO: 681922 - DNA, 22 bp, Artificial Sequence
  chemically synthesized
gagtacctattagcctgccagc

SEQ ID NO: 681923 - DNA, 22 bp, Artificial Sequence
  chemically synthesized
ttagcctgccagctatagcgat

SEQ ID NO: 681924 - DNA, 22 bp, Artificial Sequence
  chemically synthesized
gcctgccagctatagcgataac

SEQ ID NO: 681925 - DNA, 22 bp, Artificial Sequence
  chemically synthesized
ccagctatagcgataacccatg

SEQ ID NO: 681926 - DNA, 22 bp, Artificial Sequence
  chemically synthesized
tagcgataacccatgtatatga

SEQ ID NO: 681927 - DNA, 22 bp, Artificial Sequence
  chemically synthesized
gcaggaggtggtgtgggtcata

SEQ ID NO: 681928 - DNA, 22 bp, Artificial Sequence
  chemically synthesized
agcaggaggtggtgtgggtcat

SEQ ID NO: 681929 - DNA, 22 bp, Artificial Sequence
  chemically synthesized
tagcaggaggtggtgtgggtca

SEQ ID NO: 681930 - DNA, 22 bp, Artificial Sequence
  chemically synthesized
ttagcaggaggtggtgtgggtc

SEQ ID NO: 681931 - DNA, 22 bp, Artificial Sequence
  chemically synthesized
accagtgatccatttttagcag

SEQ ID NO: 681932 - DNA, 22 bp, Artificial Sequence
  chemically synthesized
aaccacattaaccagtgatcca

SEQ ID NO: 681933 - DNA, 22 bp, Artificial Sequence
  chemically synthesized
gaaccacattaaccagtgatcc

SEQ ID NO: 681934 - DNA, 22 bp, Artificial Sequence
  chemically synthesized
ctgctaaaaatggatcactggt

SEQ ID NO: 681935 - DNA, 22 bp, Artificial Sequence
  chemically synthesized
ctaaaaatggatcactggttaa

SEQ ID NO: 681936 - DNA, 22 bp, Artificial Sequence
  chemically synthesized
aaaatggatcactggttaatgt

SEQ ID NO: 681937 - DNA, 22 bp, Artificial Sequence
  chemically synthesized
tagtcagatatacttgaaccac

SEQ ID NO: 681938 - DNA, 22 bp, Artificial Sequence
  chemically synthesized
gttaatgtggttcaagtatatc

SEQ ID NO: 681939 - DNA, 22 bp, Artificial Sequence
  chemically synthesized
atgtggttcaagtatatctgac

SEQ ID NO: 681940 - DNA, 22 bp, Artificial Sequence
  chemically synthesized
aagtatatctgactacagcatt

SEQ ID NO: 681941 - DNA, 22 bp, Artificial Sequence
  chemically synthesized
aggtagaccaggaatgctgtag

SEQ ID NO: 681942 - DNA, 22 bp, Artificial Sequence
  chemically synthesized
ttaaggtagaccaggaatgctg

SEQ ID NO: 681943 - DNA, 22 bp, Artificial Sequence
  chemically synthesized
agctgttaaggtagaccaggaa

SEQ ID NO: 681944 - DNA, 22 bp, Artificial Sequence
  chemically synthesized
gagctgttaaggtagaccagga

SEQ ID NO: 681945 - DNA, 22 bp, Artificial Sequence
  chemically synthesized
actacagcattcctggtctacc

SEQ ID NO: 681946 - DNA, 22 bp, Artificial Sequence
  chemically synthesized
cagcattcctggtctaccttaa

SEQ ID NO: 681947 - DNA, 22 bp, Artificial Sequence
  chemically synthesized
caagtttgagctgttaaggtag

SEQ ID NO: 681948 - DNA, 22 bp, Artificial Sequence
  chemically synthesized
ctggtctaccttaacagctcaa

SEQ ID NO: 681949 - DNA, 22 bp, Artificial Sequence
  chemically synthesized
gtctaccttaacagctcaaact

SEQ ID NO: 681950 - DNA, 22 bp, Artificial Sequence
  chemically synthesized
ccttaacagctcaaacttgtaa

SEQ ID NO: 681951 - DNA, 22 bp, Artificial Sequence
  chemically synthesized
aacagctcaaacttgtaactat

SEQ ID NO: 681952 - DNA, 22 bp, Artificial Sequence
  chemically synthesized
acagctcaaacttgtaactatt

SEQ ID NO: 681953 - DNA, 22 bp, Artificial Sequence
  chemically synthesized
aaacttgtaactatttgtctgc

SEQ ID NO: 681954 - DNA, 22 bp, Artificial Sequence
  chemically synthesized
gtaactatttgtctgcctttcc

SEQ ID NO: 681955 - DNA, 22 bp, Artificial Sequence
  chemically synthesized
taactatttgtctgcctttccc

SEQ ID NO: 681956 - DNA, 22 bp, Artificial Sequence
  chemically synthesized
gcacaatcggtggggaaaggca

SEQ ID NO: 681957 - DNA, 22 bp, Artificial Sequence
  chemically synthesized
ggcacaatcggtggggaaaggc

SEQ ID NO: 681958 - DNA, 22 bp, Artificial Sequence
  chemically synthesized
tttggcacaatcggtggggaaa

SEQ ID NO: 681959 - DNA, 22 bp, Artificial Sequence
  chemically synthesized
atttggcacaatcggtggggaa

SEQ ID NO: 681960 - DNA, 22 bp, Artificial Sequence
  chemically synthesized
tttgtctgcctttccccaccga

SEQ ID NO: 681961 - DNA, 22 bp, Artificial Sequence
  chemically synthesized
gtctgcctttccccaccgattg

SEQ ID NO: 681962 - DNA, 22 bp, Artificial Sequence
  chemically synthesized
tctgcctttccccaccgattgt

SEQ ID NO: 681963 - DNA, 22 bp, Artificial Sequence
  chemically synthesized
cgcttatttggcacaatcggtg

SEQ ID NO: 681964 - DNA, 22 bp, Artificial Sequence
  chemically synthesized
cctttccccaccgattgtgcca

SEQ ID NO: 681965 - DNA, 22 bp, Artificial Sequence
  chemically synthesized
aaattccgcttatttggcacaa

SEQ ID NO: 681966 - DNA, 22 bp, Artificial Sequence
  chemically synthesized
gaaattccgcttatttggcaca

SEQ ID NO: 681967 - DNA, 22 bp, Artificial Sequence
  chemically synthesized
tccccaccgattgtgccaaata

SEQ ID NO: 681968 - DNA, 22 bp, Artificial Sequence
  chemically synthesized
tgaaattccgcttatttggcac

SEQ ID NO: 681969 - DNA, 22 bp, Artificial Sequence
  chemically synthesized
ccccaccgattgtgccaaataa

SEQ ID NO: 681970 - DNA, 22 bp, Artificial Sequence
  chemically synthesized
cccaccgattgtgccaaataag

SEQ ID NO: 681971 - DNA, 22 bp, Artificial Sequence
  chemically synthesized
cccagttttgaaattccgctta

SEQ ID NO: 681972 - DNA, 22 bp, Artificial Sequence
  chemically synthesized
tgcccagttttgaaattccgct

SEQ ID NO: 681973 - DNA, 22 bp, Artificial Sequence
  chemically synthesized
ctgcccagttttgaaattccgc

SEQ ID NO: 681974 - DNA, 22 bp, Artificial Sequence
  chemically synthesized
tgccaaataagcggaatttcaa

SEQ ID NO: 681975 - DNA, 22 bp, Artificial Sequence
  chemically synthesized
tgcagagtgtaagaatttctgc

SEQ ID NO: 681976 - DNA, 22 bp, Artificial Sequence
  chemically synthesized
caaaactgggcagaaattctta

SEQ ID NO: 681977 - DNA, 22 bp, Artificial Sequence
  chemically synthesized
aaaactgggcagaaattcttac

SEQ ID NO: 681978 - DNA, 22 bp, Artificial Sequence
  chemically synthesized
ggcagaaattcttacactctgc

SEQ ID NO: 681979 - DNA, 22 bp, Artificial Sequence
  chemically synthesized
aagaggaagagagattatgcag

SEQ ID NO: 681980 - DNA, 22 bp, Artificial Sequence
  chemically synthesized
ttacactctgcataatctctct

SEQ ID NO: 681981 - DNA, 22 bp, Artificial Sequence
  chemically synthesized
tagctgaagaggaagagagatt

SEQ ID NO: 681982 - DNA, 22 bp, Artificial Sequence
  chemically synthesized
acactctgcataatctctcttc

SEQ ID NO: 681983 - DNA, 22 bp, Artificial Sequence
  chemically synthesized
gtagctgaagaggaagagagat

SEQ ID NO: 681984 - DNA, 22 bp, Artificial Sequence
  chemically synthesized
cactctgcataatctctcttcc

SEQ ID NO: 681985 - DNA, 22 bp, Artificial Sequence
  chemically synthesized
tttgtagctgaagaggaagaga

SEQ ID NO: 681986 - DNA, 22 bp, Artificial Sequence
  chemically synthesized
atttgtagctgaagaggaagag

SEQ ID NO: 681987 - DNA, 22 bp, Artificial Sequence
  chemically synthesized
tgcataatctctcttcctcttc

SEQ ID NO: 681988 - DNA, 22 bp, Artificial Sequence
  chemically synthesized
cataatctctcttcctcttcag

SEQ ID NO: 681989 - DNA, 22 bp, Artificial Sequence
  chemically synthesized
tcttcctcttcagctacaaata

SEQ ID NO: 681990 - DNA, 22 bp, Artificial Sequence
  chemically synthesized
ttcctcttcagctacaaataag

SEQ ID NO: 681991 - DNA, 22 bp, Artificial Sequence
  chemically synthesized
cctcttcagctacaaataaggc

SEQ ID NO: 681992 - DNA, 22 bp, Artificial Sequence
  chemically synthesized
atcgaatacaaagccttatttg

SEQ ID NO: 681993 - DNA, 22 bp, Artificial Sequence
  chemically synthesized
ctcttcagctacaaataaggct

SEQ ID NO: 681994 - DNA, 22 bp, Artificial Sequence
  chemically synthesized
ttcagctacaaataaggctttg

SEQ ID NO: 681995 - DNA, 22 bp, Artificial Sequence
  chemically synthesized
cagctacaaataaggctttgta

SEQ ID NO: 681996 - DNA, 22 bp, Artificial Sequence
  chemically synthesized
agctacaaataaggctttgtat

SEQ ID NO: 681997 - DNA, 22 bp, Artificial Sequence
  chemically synthesized
tgagtctaatcgaatacaaagc

SEQ ID NO: 681998 - DNA, 22 bp, Artificial Sequence
  chemically synthesized
ctgtgagtctaatcgaatacaa

SEQ ID NO: 681999 - DNA, 22 bp, Artificial Sequence
  chemically synthesized
caaataaggctttgtattcgat

SEQ ID NO: 682000 - DNA, 22 bp, Artificial Sequence
  chemically synthesized
acctgctgtgagtctaatcgaa

SEQ ID NO: 682001 - DNA, 22 bp, Artificial Sequence
  chemically synthesized
cacctgctgtgagtctaatcga

SEQ ID NO: 682002 - DNA, 22 bp, Artificial Sequence
  chemically synthesized
tcacctgctgtgagtctaatcg

SEQ ID NO: 682003 - DNA, 22 bp, Artificial Sequence
  chemically synthesized
tgtattcgattagactcacagc

SEQ ID NO: 682004 - DNA, 22 bp, Artificial Sequence
  chemically synthesized
gggttttcacctgctgtgagtc

SEQ ID NO: 682005 - DNA, 22 bp, Artificial Sequence
  chemically synthesized
gtattcgattagactcacagca

SEQ ID NO: 682006 - DNA, 22 bp, Artificial Sequence
  chemically synthesized
tattcgattagactcacagcag

SEQ ID NO: 682007 - DNA, 22 bp, Artificial Sequence
  chemically synthesized
attggggttttcacctgctgtg

SEQ ID NO: 682008 - DNA, 22 bp, Artificial Sequence
  chemically synthesized
gattagactcacagcaggtgaa

SEQ ID NO: 682009 - DNA, 22 bp, Artificial Sequence
  chemically synthesized
actaattggggttttcacctgc

SEQ ID NO: 682010 - DNA, 22 bp, Artificial Sequence
  chemically synthesized
gactcacagcaggtgaaaaccc

SEQ ID NO: 682011 - DNA, 22 bp, Artificial Sequence
  chemically synthesized
acagcaggtgaaaaccccaatt

SEQ ID NO: 682012 - DNA, 22 bp, Artificial Sequence
  chemically synthesized
agaatgaattcactaattgggg

SEQ ID NO: 682013 - DNA, 22 bp, Artificial Sequence
  chemically synthesized
gtgaattcattctgaggcctct

SEQ ID NO: 682014 - DNA, 22 bp, Artificial Sequence
  chemically synthesized
tgtgggaggaaggtagaggcct

SEQ ID NO: 682015 - DNA, 22 bp, Artificial Sequence
  chemically synthesized
attctgaggcctctaccttcct

SEQ ID NO: 682016 - DNA, 22 bp, Artificial Sequence
  chemically synthesized
tgaggcctctaccttcctccca

SEQ ID NO: 682017 - DNA, 22 bp, Artificial Sequence
  chemically synthesized
aggcctctaccttcctcccaca

SEQ ID NO: 682018 - DNA, 22 bp, Artificial Sequence
  chemically synthesized
caaaaatgtgttgtgtgggagg

SEQ ID NO: 682019 - DNA, 22 bp, Artificial Sequence
  chemically synthesized
acaaaaatgtgttgtgtgggag

SEQ ID NO: 682020 - DNA, 22 bp, Artificial Sequence
  chemically synthesized
tacaaaaatgtgttgtgtggga

SEQ ID NO: 682021 - DNA, 22 bp, Artificial Sequence
  chemically synthesized
ttacaaaaatgtgttgtgtggg

SEQ ID NO: 682022 - DNA, 22 bp, Artificial Sequence
  chemically synthesized
tttacaaaaatgtgttgtgtgg

SEQ ID NO: 682023 - DNA, 22 bp, Artificial Sequence
  chemically synthesized
ttttacaaaaatgtgttgtgtg

SEQ ID NO: 682024 - DNA, 22 bp, Artificial Sequence
  chemically synthesized
taccttcctcccacacaacaca

SEQ ID NO: 682025 - DNA, 22 bp, Artificial Sequence
  chemically synthesized
ccttcctcccacacaacacatt

SEQ ID NO: 682026 - DNA, 22 bp, Artificial Sequence
  chemically synthesized
atttttttacaaaaatgtgttg

SEQ ID NO: 682027 - DNA, 22 bp, Artificial Sequence
  chemically synthesized
cctcccacacaacacatttttg

SEQ ID NO: 682028 - DNA, 22 bp, Artificial Sequence
  chemically synthesized
ctcccacacaacacatttttgt

SEQ ID NO: 682029 - DNA, 22 bp, Artificial Sequence
  chemically synthesized
cctgatttttttacaaaaatgt

SEQ ID NO: 682030 - DNA, 22 bp, Artificial Sequence
  chemically synthesized
ccctgatttttttacaaaaatg

SEQ ID NO: 682031 - DNA, 22 bp, Artificial Sequence
  chemically synthesized
ccacacaacacatttttgtaaa

SEQ ID NO: 682032 - DNA, 22 bp, Artificial Sequence
  chemically synthesized
ttgtaaaaaaatcagggaagtc

SEQ ID NO: 682033 - DNA, 22 bp, Artificial Sequence
  chemically synthesized
agaagagacgcagacttccctg

SEQ ID NO: 682034 - DNA, 22 bp, Artificial Sequence
  chemically synthesized
tgtaaaaaaatcagggaagtct

SEQ ID NO: 682035 - DNA, 22 bp, Artificial Sequence
  chemically synthesized
gagaagagacgcagacttccct

SEQ ID NO: 682036 - DNA, 22 bp, Artificial Sequence
  chemically synthesized
gtaaaaaaatcagggaagtctg

SEQ ID NO: 682037 - DNA, 22 bp, Artificial Sequence
  chemically synthesized
taaaaaaatcagggaagtctgc

SEQ ID NO: 682038 - DNA, 22 bp, Artificial Sequence
  chemically synthesized
atttgagaagagacgcagactt

SEQ ID NO: 682039 - DNA, 22 bp, Artificial Sequence
  chemically synthesized
tgatttgagaagagacgcagac

SEQ ID NO: 682040 - DNA, 22 bp, Artificial Sequence
  chemically synthesized
ctgatttgagaagagacgcaga

SEQ ID NO: 682041 - DNA, 22 bp, Artificial Sequence
  chemically synthesized
cttctgatttgagaagagacgc

SEQ ID NO: 682042 - DNA, 22 bp, Artificial Sequence
  chemically synthesized
acttctgatttgagaagagacg

SEQ ID NO: 682043 - DNA, 22 bp, Artificial Sequence
  chemically synthesized
atttacttctgatttgagaaga

SEQ ID NO: 682044 - DNA, 22 bp, Artificial Sequence
  chemically synthesized
cgtctcttctcaaatcagaagt

SEQ ID NO: 682045 - DNA, 22 bp, Artificial Sequence
  chemically synthesized
ttctcaaatcagaagtaaatta

SEQ ID NO: 682046 - DNA, 22 bp, Artificial Sequence
  chemically synthesized
ctcaaatcagaagtaaattaac

SEQ ID NO: 682047 - DNA, 22 bp, Artificial Sequence
  chemically synthesized
tcaaatcagaagtaaattaacc

SEQ ID NO: 682048 - DNA, 22 bp, Artificial Sequence
  chemically synthesized
ggtagatcaaagggttaattta

SEQ ID NO: 682049 - DNA, 22 bp, Artificial Sequence
  chemically synthesized
gggtagatcaaagggttaattt

SEQ ID NO: 682050 - DNA, 22 bp, Artificial Sequence
  chemically synthesized
aaatcagaagtaaattaaccct

SEQ ID NO: 682051 - DNA, 22 bp, Artificial Sequence
  chemically synthesized
cttgggtagatcaaagggttaa

SEQ ID NO: 682052 - DNA, 22 bp, Artificial Sequence
  chemically synthesized
gcttgggtagatcaaagggtta

SEQ ID NO: 682053 - DNA, 22 bp, Artificial Sequence
  chemically synthesized
accctttgatctacccaagcaa

SEQ ID NO: 682054 - DNA, 22 bp, Artificial Sequence
  chemically synthesized
atgcagtaaatagtttgcttgg

SEQ ID NO: 682055 - DNA, 22 bp, Artificial Sequence
  chemically synthesized
catgcagtaaatagtttgcttg

SEQ ID NO: 682056 - DNA, 22 bp, Artificial Sequence
  chemically synthesized
tgatctacccaagcaaactatt

SEQ ID NO: 682057 - DNA, 22 bp, Artificial Sequence
  chemically synthesized
gatctacccaagcaaactattt

SEQ ID NO: 682058 - DNA, 22 bp, Artificial Sequence
  chemically synthesized
atctacccaagcaaactattta

SEQ ID NO: 682059 - DNA, 22 bp, Artificial Sequence
  chemically synthesized
cccaagcaaactatttactgca

SEQ ID NO: 682060 - DNA, 22 bp, Artificial Sequence
  chemically synthesized
cagtgaaaagtcttcatgcagt

SEQ ID NO: 682061 - DNA, 22 bp, Artificial Sequence
  chemically synthesized
gcagtgaaaagtcttcatgcag

SEQ ID NO: 682062 - DNA, 22 bp, Artificial Sequence
  chemically synthesized
tgcagtgaaaagtcttcatgca

SEQ ID NO: 682063 - DNA, 22 bp, Artificial Sequence
  chemically synthesized
ccattttgcagtgaaaagtctt

SEQ ID NO: 682064 - DNA, 22 bp, Artificial Sequence
  chemically synthesized
tttactgcatgaagacttttca

SEQ ID NO: 682065 - DNA, 22 bp, Artificial Sequence
  chemically synthesized
actgcatgaagacttttcactg

SEQ ID NO: 682066 - DNA, 22 bp, Artificial Sequence
  chemically synthesized
ctgcatgaagacttttcactgc

SEQ ID NO: 682067 - DNA, 22 bp, Artificial Sequence
  chemically synthesized
catgaagacttttcactgcaaa

SEQ ID NO: 682068 - DNA, 22 bp, Artificial Sequence
  chemically synthesized
aacatcctcccattttgcagtg

SEQ ID NO: 682069 - DNA, 22 bp, Artificial Sequence
  chemically synthesized
caacatcctcccattttgcagt

SEQ ID NO: 682070 - DNA, 22 bp, Artificial Sequence
  chemically synthesized
tcaacatcctcccattttgcag

SEQ ID NO: 682071 - DNA, 22 bp, Artificial Sequence
  chemically synthesized
ttcactgcaaaatgggaggatg

SEQ ID NO: 682072 - DNA, 22 bp, Artificial Sequence
  chemically synthesized
tcactgcaaaatgggaggatgt

SEQ ID NO: 682073 - DNA, 22 bp, Artificial Sequence
  chemically synthesized
cactgcaaaatgggaggatgtt

SEQ ID NO: 682074 - DNA, 22 bp, Artificial Sequence
  chemically synthesized
actgcaaaatgggaggatgttg

SEQ ID NO: 682075 - DNA, 22 bp, Artificial Sequence
  chemically synthesized
caaaatgggaggatgttgaaag

SEQ ID NO: 682076 - DNA, 22 bp, Artificial Sequence
  chemically synthesized
tggagtcaagaaggaggaatct

SEQ ID NO: 682077 - DNA, 22 bp, Artificial Sequence
  chemically synthesized
atggagtcaagaaggaggaatc

SEQ ID NO: 682078 - DNA, 22 bp, Artificial Sequence
  chemically synthesized
ccttatggagtcaagaaggagg

SEQ ID NO: 682079 - DNA, 22 bp, Artificial Sequence
  chemically synthesized
aaagattcctccttcttgactc

SEQ ID NO: 682080 - DNA, 22 bp, Artificial Sequence
  chemically synthesized
taacctcccttatggagtcaag

SEQ ID NO: 682081 - DNA, 22 bp, Artificial Sequence
  chemically synthesized
tgtaacctcccttatggagtca

SEQ ID NO: 682082 - DNA, 22 bp, Artificial Sequence
  chemically synthesized
ctgtaacctcccttatggagtc

SEQ ID NO: 682083 - DNA, 22 bp, Artificial Sequence
  chemically synthesized
tctgtaacctcccttatggagt

SEQ ID NO: 682084 - DNA, 22 bp, Artificial Sequence
  chemically synthesized
ctccttcttgactccataaggg

SEQ ID NO: 682085 - DNA, 22 bp, Artificial Sequence
  chemically synthesized
cttcttgactccataagggagg

SEQ ID NO: 682086 - DNA, 22 bp, Artificial Sequence
  chemically synthesized
cttgactccataagggaggtta

SEQ ID NO: 682087 - DNA, 22 bp, Artificial Sequence
  chemically synthesized
ttgactccataagggaggttac

SEQ ID NO: 682088 - DNA, 22 bp, Artificial Sequence
  chemically synthesized
gactccataagggaggttacag

SEQ ID NO: 682089 - DNA, 22 bp, Artificial Sequence
  chemically synthesized
actccataagggaggttacaga

SEQ ID NO: 682090 - DNA, 22 bp, Artificial Sequence
  chemically synthesized
ataaaatagaattttctgtaac

SEQ ID NO: 682091 - DNA, 22 bp, Artificial Sequence
  chemically synthesized
cataagggaggttacagaaaat

SEQ ID NO: 682092 - DNA, 22 bp, Artificial Sequence
  chemically synthesized
cagaaaattctattttatcaga

SEQ ID NO: 682093 - DNA, 22 bp, Artificial Sequence
  chemically synthesized
aagaaaacaataaagtctgata

SEQ ID NO: 682094 - DNA, 22 bp, Artificial Sequence
  chemically synthesized
gaagaaaacaataaagtctgat

SEQ ID NO: 682095 - DNA, 22 bp, Artificial Sequence
  chemically synthesized
tattttatcagactttattgtt

SEQ ID NO: 682096 - DNA, 22 bp, Artificial Sequence
  chemically synthesized
tggatttgaagaaaacaataaa

SEQ ID NO: 682097 - DNA, 22 bp, Artificial Sequence
  chemically synthesized
ttttatcagactttattgtttt

SEQ ID NO: 682098 - DNA, 22 bp, Artificial Sequence
  chemically synthesized
atggatttgaagaaaacaataa

SEQ ID NO: 682099 - DNA, 22 bp, Artificial Sequence
  chemically synthesized
tatcagactttattgttttctt

SEQ ID NO: 682100 - DNA, 22 bp, Artificial Sequence
  chemically synthesized
atcagactttattgttttcttc

SEQ ID NO: 682101 - DNA, 22 bp, Artificial Sequence
  chemically synthesized
tcagactttattgttttcttca

SEQ ID NO: 682102 - DNA, 22 bp, Artificial Sequence
  chemically synthesized
tattgttttcttcaaatccata

SEQ ID NO: 682103 - DNA, 22 bp, Artificial Sequence
  chemically synthesized
attgttttcttcaaatccataa

SEQ ID NO: 682104 - DNA, 22 bp, Artificial Sequence
  chemically synthesized
ttgttttcttcaaatccataaa

SEQ ID NO: 682105 - DNA, 22 bp, Artificial Sequence
  chemically synthesized
ttttcttcaaatccataaatac

SEQ ID NO: 682106 - DNA, 22 bp, Artificial Sequence
  chemically synthesized
atcagaaaatgtgagtatttat

SEQ ID NO: 682107 - DNA, 22 bp, Artificial Sequence
  chemically synthesized
tcttcaaatccataaatactca

SEQ ID NO: 682108 - DNA, 22 bp, Artificial Sequence
  chemically synthesized
cttcaaatccataaatactcac

SEQ ID NO: 682109 - DNA, 22 bp, Artificial Sequence
  chemically synthesized
ttcaaatccataaatactcaca

SEQ ID NO: 682110 - DNA, 22 bp, Artificial Sequence
  chemically synthesized
caaatccataaatactcacatt

SEQ ID NO: 682111 - DNA, 22 bp, Artificial Sequence
  chemically synthesized
gattgatcagaaaatgtgagta

SEQ ID NO: 682112 - DNA, 22 bp, Artificial Sequence
  chemically synthesized
aaatccataaatactcacattt

SEQ ID NO: 682113 - DNA, 22 bp, Artificial Sequence
  chemically synthesized
tagattgatcagaaaatgtgag

SEQ ID NO: 682114 - DNA, 22 bp, Artificial Sequence
  chemically synthesized
ctagattgatcagaaaatgtga

SEQ ID NO: 682115 - DNA, 22 bp, Artificial Sequence
  chemically synthesized
taatttctagattgatcagaaa

SEQ ID NO: 682116 - DNA, 22 bp, Artificial Sequence
  chemically synthesized
acattttctgatcaatctagaa

SEQ ID NO: 682117 - DNA, 22 bp, Artificial Sequence
  chemically synthesized
tctgatcaatctagaaattaca

SEQ ID NO: 682118 - DNA, 22 bp, Artificial Sequence
  chemically synthesized
ctgatcaatctagaaattacag

SEQ ID NO: 682119 - DNA, 22 bp, Artificial Sequence
  chemically synthesized
tgatcaatctagaaattacagt

SEQ ID NO: 682120 - DNA, 22 bp, Artificial Sequence
  chemically synthesized
atcaatctagaaattacagttt

SEQ ID NO: 682121 - DNA, 22 bp, Artificial Sequence
  chemically synthesized
tgagtgtcaggtagaaagaaaa

SEQ ID NO: 682122 - DNA, 22 bp, Artificial Sequence
  chemically synthesized
gaaattacagtttttctttcta

SEQ ID NO: 682123 - DNA, 22 bp, Artificial Sequence
  chemically synthesized
gcattgtgagtgtcaggtagaa

SEQ ID NO: 682124 - DNA, 22 bp, Artificial Sequence
  chemically synthesized
cagtttttctttctacctgaca

SEQ ID NO: 682125 - DNA, 22 bp, Artificial Sequence
  chemically synthesized
ttctttctacctgacactcaca

SEQ ID NO: 682126 - DNA, 22 bp, Artificial Sequence
  chemically synthesized
tctttctacctgacactcacaa

SEQ ID NO: 682127 - DNA, 22 bp, Artificial Sequence
  chemically synthesized
ctttctacctgacactcacaat

SEQ ID NO: 682128 - DNA, 22 bp, Artificial Sequence
  chemically synthesized
gataatattagcattgtgagtg

SEQ ID NO: 682129 - DNA, 22 bp, Artificial Sequence
  chemically synthesized
tttctacctgacactcacaatg

SEQ ID NO: 682130 - DNA, 22 bp, Artificial Sequence
  chemically synthesized
tctacctgacactcacaatgct

SEQ ID NO: 682131 - DNA, 22 bp, Artificial Sequence
  chemically synthesized
ttagataatattagcattgtga

SEQ ID NO: 682132 - DNA, 22 bp, Artificial Sequence
  chemically synthesized
ctacctgacactcacaatgcta

SEQ ID NO: 682133 - DNA, 22 bp, Artificial Sequence
  chemically synthesized
gttagataatattagcattgtg

SEQ ID NO: 682134 - DNA, 22 bp, Artificial Sequence
  chemically synthesized
tacctgacactcacaatgctaa

SEQ ID NO: 682135 - DNA, 22 bp, Artificial Sequence
  chemically synthesized
tgttagataatattagcattgt

SEQ ID NO: 682136 - DNA, 22 bp, Artificial Sequence
  chemically synthesized
ttgttagataatattagcattg

SEQ ID NO: 682137 - DNA, 22 bp, Artificial Sequence
  chemically synthesized
cctgacactcacaatgctaata

SEQ ID NO: 682138 - DNA, 22 bp, Artificial Sequence
  chemically synthesized
acactcacaatgctaatattat

SEQ ID NO: 682139 - DNA, 22 bp, Artificial Sequence
  chemically synthesized
atcttttgttagataatattag

SEQ ID NO: 682140 - DNA, 22 bp, Artificial Sequence
  chemically synthesized
acaatgctaatattatctaaca

SEQ ID NO: 682141 - DNA, 22 bp, Artificial Sequence
  chemically synthesized
tccattaatcttttgttagata

SEQ ID NO: 682142 - DNA, 22 bp, Artificial Sequence
  chemically synthesized
atattatctaacaaaagattaa

SEQ ID NO: 682143 - DNA, 22 bp, Artificial Sequence
  chemically synthesized
tagtagactgtccattaatctt

SEQ ID NO: 682144 - DNA, 22 bp, Artificial Sequence
  chemically synthesized
gtagtagactgtccattaatct

SEQ ID NO: 682145 - DNA, 22 bp, Artificial Sequence
  chemically synthesized
ttgtagtagactgtccattaat

SEQ ID NO: 682146 - DNA, 22 bp, Artificial Sequence
  chemically synthesized
tctaacaaaagattaatggaca

SEQ ID NO: 682147 - DNA, 22 bp, Artificial Sequence
  chemically synthesized
tcttgtagtagactgtccatta

SEQ ID NO: 682148 - DNA, 22 bp, Artificial Sequence
  chemically synthesized
tctcttgtagtagactgtccat

SEQ ID NO: 682149 - DNA, 22 bp, Artificial Sequence
  chemically synthesized
acaaaagattaatggacagtct

SEQ ID NO: 682150 - DNA, 22 bp, Artificial Sequence
  chemically synthesized
attctctcttgtagtagactgt

SEQ ID NO: 682151 - DNA, 22 bp, Artificial Sequence
  chemically synthesized
aaaattaattctctcttgtagt

SEQ ID NO: 682152 - DNA, 22 bp, Artificial Sequence
  chemically synthesized
atggacagtctactacaagaga

SEQ ID NO: 682153 - DNA, 22 bp, Artificial Sequence
  chemically synthesized
ctacaagagagaattaattttt

SEQ ID NO: 682154 - DNA, 22 bp, Artificial Sequence
  chemically synthesized
caagagagaattaatttttagt

SEQ ID NO: 682155 - DNA, 22 bp, Artificial Sequence
  chemically synthesized
aaatacaccaaaataagaacat

SEQ ID NO: 682156 - DNA, 22 bp, Artificial Sequence
  chemically synthesized
atttttagttatgttcttattt

SEQ ID NO: 682157 - DNA, 22 bp, Artificial Sequence
  chemically synthesized
acctcaaatacaccaaaataag

SEQ ID NO: 682158 - DNA, 22 bp, Artificial Sequence
  chemically synthesized
ttagttatgttcttattttggt

SEQ ID NO: 682159 - DNA, 22 bp, Artificial Sequence
  chemically synthesized
tagttatgttcttattttggtg

SEQ ID NO: 682160 - DNA, 22 bp, Artificial Sequence
  chemically synthesized
tcacctcaaatacaccaaaata

SEQ ID NO: 682161 - DNA, 22 bp, Artificial Sequence
  chemically synthesized
agttatgttcttattttggtgt

SEQ ID NO: 682162 - DNA, 22 bp, Artificial Sequence
  chemically synthesized
ctcacctcaaatacaccaaaat

SEQ ID NO: 682163 - DNA, 22 bp, Artificial Sequence
  chemically synthesized
gttatgttcttattttggtgta

SEQ ID NO: 682164 - DNA, 22 bp, Artificial Sequence
  chemically synthesized
tctcacctcaaatacaccaaaa

SEQ ID NO: 682165 - DNA, 22 bp, Artificial Sequence
  chemically synthesized
ttctcacctcaaatacaccaaa

SEQ ID NO: 682166 - DNA, 22 bp, Artificial Sequence
  chemically synthesized
tttctcacctcaaatacaccaa

SEQ ID NO: 682167 - DNA, 22 bp, Artificial Sequence
  chemically synthesized
ttttctcacctcaaatacacca

SEQ ID NO: 682168 - DNA, 22 bp, Artificial Sequence
  chemically synthesized
tgttcttattttggtgtatttg

SEQ ID NO: 682169 - DNA, 22 bp, Artificial Sequence
  chemically synthesized
tttttctcacctcaaatacacc

SEQ ID NO: 682170 - DNA, 22 bp, Artificial Sequence
  chemically synthesized
attttttttctcacctcaaata

SEQ ID NO: 682171 - DNA, 22 bp, Artificial Sequence
  chemically synthesized
ttattttggtgtatttgaggtg

SEQ ID NO: 682172 - DNA, 22 bp, Artificial Sequence
  chemically synthesized
aattttttttctcacctcaaat

SEQ ID NO: 682173 - DNA, 22 bp, Artificial Sequence
  chemically synthesized
attttggtgtatttgaggtgag

SEQ ID NO: 682174 - DNA, 22 bp, Artificial Sequence
  chemically synthesized
ttttggtgtatttgaggtgaga

SEQ ID NO: 682175 - DNA, 22 bp, Artificial Sequence
  chemically synthesized
tggtgtatttgaggtgagaaaa

SEQ ID NO: 682176 - DNA, 22 bp, Artificial Sequence
  chemically synthesized
aaatttaattttttttctcacc

SEQ ID NO: 682177 - DNA, 22 bp, Artificial Sequence
  chemically synthesized
ggtgtatttgaggtgagaaaaa

SEQ ID NO: 682178 - DNA, 22 bp, Artificial Sequence
  chemically synthesized
gtgtatttgaggtgagaaaaaa

SEQ ID NO: 682179 - DNA, 22 bp, Artificial Sequence
  chemically synthesized
aactaaaatttaattttttttc

SEQ ID NO: 682180 - DNA, 22 bp, Artificial Sequence
  chemically synthesized
aaactaaaatttaatttttttt

SEQ ID NO: 682181 - DNA, 22 bp, Artificial Sequence
  chemically synthesized
tttaaactaaaatttaattttt

SEQ ID NO: 682182 - DNA, 22 bp, Artificial Sequence
  chemically synthesized
gaggtgagaaaaaaaattaaat

SEQ ID NO: 682183 - DNA, 22 bp, Artificial Sequence
  chemically synthesized
aggtgagaaaaaaaattaaatt

SEQ ID NO: 682184 - DNA, 22 bp, Artificial Sequence
  chemically synthesized
aggccaaagcatactgtttaaa

SEQ ID NO: 682185 - DNA, 22 bp, Artificial Sequence
  chemically synthesized
ctaaggccaaagcatactgttt

SEQ ID NO: 682186 - DNA, 22 bp, Artificial Sequence
  chemically synthesized
aattttagtttaaacagtatgc

SEQ ID NO: 682187 - DNA, 22 bp, Artificial Sequence
  chemically synthesized
cctaaggccaaagcatactgtt

SEQ ID NO: 682188 - DNA, 22 bp, Artificial Sequence
  chemically synthesized
tcctaaggccaaagcatactgt

SEQ ID NO: 682189 - DNA, 22 bp, Artificial Sequence
  chemically synthesized
tagtttaaacagtatgctttgg

SEQ ID NO: 682190 - DNA, 22 bp, Artificial Sequence
  chemically synthesized
agtttaaacagtatgctttggc

SEQ ID NO: 682191 - DNA, 22 bp, Artificial Sequence
  chemically synthesized
gtttaaacagtatgctttggcc

SEQ ID NO: 682192 - DNA, 22 bp, Artificial Sequence
  chemically synthesized
tgcctttcctaaggccaaagca

SEQ ID NO: 682193 - DNA, 22 bp, Artificial Sequence
  chemically synthesized
tgtgcctttcctaaggccaaag

SEQ ID NO: 682194 - DNA, 22 bp, Artificial Sequence
  chemically synthesized
aaacagtatgctttggccttag

SEQ ID NO: 682195 - DNA, 22 bp, Artificial Sequence
  chemically synthesized
aacagtatgctttggccttagg

SEQ ID NO: 682196 - DNA, 22 bp, Artificial Sequence
  chemically synthesized
tggccttaggaaaggcacagag

SEQ ID NO: 682197 - DNA, 22 bp, Artificial Sequence
  chemically synthesized
ggccttaggaaaggcacagagt

SEQ ID NO: 682198 - DNA, 22 bp, Artificial Sequence
  chemically synthesized
gccttaggaaaggcacagagtc

SEQ ID NO: 682199 - DNA, 22 bp, Artificial Sequence
  chemically synthesized
caaagtatgaaatatagactct

SEQ ID NO: 682200 - DNA, 22 bp, Artificial Sequence
  chemically synthesized
aggaaaggcacagagtctatat

SEQ ID NO: 682201 - DNA, 22 bp, Artificial Sequence
  chemically synthesized
acaaagtatgaaatatagactc

SEQ ID NO: 682202 - DNA, 22 bp, Artificial Sequence
  chemically synthesized
ggaaaggcacagagtctatatt

SEQ ID NO: 682203 - DNA, 22 bp, Artificial Sequence
  chemically synthesized
acaaataaatatttacaaagta

SEQ ID NO: 682204 - DNA, 22 bp, Artificial Sequence
  chemically synthesized
gacaaataaatatttacaaagt

SEQ ID NO: 682205 - DNA, 22 bp, Artificial Sequence
  chemically synthesized
tgacaaataaatatttacaaag

SEQ ID NO: 682206 - DNA, 22 bp, Artificial Sequence
  chemically synthesized
tttgacaaataaatatttacaa

SEQ ID NO: 682207 - DNA, 22 bp, Artificial Sequence
  chemically synthesized
tatttcatactttgtaaatatt

SEQ ID NO: 682208 - DNA, 22 bp, Artificial Sequence
  chemically synthesized
ctttgacaaataaatatttaca

SEQ ID NO: 682209 - DNA, 22 bp, Artificial Sequence
  chemically synthesized
tctttgacaaataaatatttac

SEQ ID NO: 682210 - DNA, 22 bp, Artificial Sequence
  chemically synthesized
catactttgtaaatatttattt

SEQ ID NO: 682211 - DNA, 22 bp, Artificial Sequence
  chemically synthesized
atactttgtaaatatttatttg

SEQ ID NO: 682212 - DNA, 22 bp, Artificial Sequence
  chemically synthesized
tgtaaatatttatttgtcaaag

SEQ ID NO: 682213 - DNA, 22 bp, Artificial Sequence
  chemically synthesized
gtaaatatttatttgtcaaaga

SEQ ID NO: 682214 - DNA, 22 bp, Artificial Sequence
  chemically synthesized
taaatatttatttgtcaaagaa

SEQ ID NO: 682215 - DNA, 22 bp, Artificial Sequence
  chemically synthesized
tccaatgatgaattttctttga

SEQ ID NO: 682216 - DNA, 22 bp, Artificial Sequence
  chemically synthesized
gtccaatgatgaattttctttg

SEQ ID NO: 682217 - DNA, 22 bp, Artificial Sequence
  chemically synthesized
tccttgtccaatgatgaatttt

SEQ ID NO: 682218 - DNA, 22 bp, Artificial Sequence
  chemically synthesized
atttgtcaaagaaaattcatca

SEQ ID NO: 682219 - DNA, 22 bp, Artificial Sequence
  chemically synthesized
tttgtcaaagaaaattcatcat

SEQ ID NO: 682220 - DNA, 22 bp, Artificial Sequence
  chemically synthesized
gtcaaagaaaattcatcattgg

SEQ ID NO: 682221 - DNA, 22 bp, Artificial Sequence
  chemically synthesized
tcaaagaaaattcatcattgga

SEQ ID NO: 682222 - DNA, 22 bp, Artificial Sequence
  chemically synthesized
aaccaaacatctatccttgtcc

SEQ ID NO: 682223 - DNA, 22 bp, Artificial Sequence
  chemically synthesized
atcattggacaaggatagatgt

SEQ ID NO: 682224 - DNA, 22 bp, Artificial Sequence
  chemically synthesized
atgttcaaccaaacatctatcc

SEQ ID NO: 682225 - DNA, 22 bp, Artificial Sequence
  chemically synthesized
aatgttcaaccaaacatctatc

SEQ ID NO: 682226 - DNA, 22 bp, Artificial Sequence
  chemically synthesized
taatgttcaaccaaacatctat

SEQ ID NO: 682227 - DNA, 22 bp, Artificial Sequence
  chemically synthesized
ttaatgttcaaccaaacatcta

SEQ ID NO: 682228 - DNA, 22 bp, Artificial Sequence
  chemically synthesized
tttaatgttcaaccaaacatct

SEQ ID NO: 682229 - DNA, 22 bp, Artificial Sequence
  chemically synthesized
ttttaatgttcaaccaaacatc

SEQ ID NO: 682230 - DNA, 22 bp, Artificial Sequence
  chemically synthesized
tttttaatgttcaaccaaacat

SEQ ID NO: 682231 - DNA, 22 bp, Artificial Sequence
  chemically synthesized
gacaaggatagatgtttggttg

SEQ ID NO: 682232 - DNA, 22 bp, Artificial Sequence
  chemically synthesized
attttttttaatgttcaaccaa

SEQ ID NO: 682233 - DNA, 22 bp, Artificial Sequence
  chemically synthesized
cgttgattttttttaatgttca

SEQ ID NO: 682234 - DNA, 22 bp, Artificial Sequence
  chemically synthesized
aagctgcgttgattttttttaa

SEQ ID NO: 682235 - DNA, 22 bp, Artificial Sequence
  chemically synthesized
ggttgaacattaaaaaaaatca

SEQ ID NO: 682236 - DNA, 22 bp, Artificial Sequence
  chemically synthesized
gttgaacattaaaaaaaatcaa

SEQ ID NO: 682237 - DNA, 22 bp, Artificial Sequence
  chemically synthesized
agaactaaagctgcgttgattt

SEQ ID NO: 682238 - DNA, 22 bp, Artificial Sequence
  chemically synthesized
aacattaaaaaaaatcaacgca

SEQ ID NO: 682239 - DNA, 22 bp, Artificial Sequence
  chemically synthesized
taagaactaaagctgcgttgat

SEQ ID NO: 682240 - DNA, 22 bp, Artificial Sequence
  chemically synthesized
aaaaaaatcaacgcagctttag

SEQ ID NO: 682241 - DNA, 22 bp, Artificial Sequence
  chemically synthesized
acaaagtatgagtaaatcactc

SEQ ID NO: 682242 - DNA, 22 bp, Artificial Sequence
  chemically synthesized
tagttcttagagtgatttactc

SEQ ID NO: 682243 - DNA, 22 bp, Artificial Sequence
  chemically synthesized
agttcttagagtgatttactca

SEQ ID NO: 682244 - DNA, 22 bp, Artificial Sequence
  chemically synthesized
gttcttagagtgatttactcat

SEQ ID NO: 682245 - DNA, 22 bp, Artificial Sequence
  chemically synthesized
ttagagtgatttactcatactt

SEQ ID NO: 682246 - DNA, 22 bp, Artificial Sequence
  chemically synthesized
agagtgatttactcatactttg

SEQ ID NO: 682247 - DNA, 22 bp, Artificial Sequence
  chemically synthesized
gagtgatttactcatactttgt

SEQ ID NO: 682248 - DNA, 22 bp, Artificial Sequence
  chemically synthesized
cagagaagcaattgacaaagta

SEQ ID NO: 682249 - DNA, 22 bp, Artificial Sequence
  chemically synthesized
ccagagaagcaattgacaaagt

SEQ ID NO: 682250 - DNA, 22 bp, Artificial Sequence
  chemically synthesized
tttccagagaagcaattgacaa

SEQ ID NO: 682251 - DNA, 22 bp, Artificial Sequence
  chemically synthesized
actcatactttgtcaattgctt

SEQ ID NO: 682252 - DNA, 22 bp, Artificial Sequence
  chemically synthesized
ctcatactttgtcaattgcttc

SEQ ID NO: 682253 - DNA, 22 bp, Artificial Sequence
  chemically synthesized
atactttgtcaattgcttctct

SEQ ID NO: 682254 - DNA, 22 bp, Artificial Sequence
  chemically synthesized
tgaattgtttccagagaagcaa

SEQ ID NO: 682255 - DNA, 22 bp, Artificial Sequence
  chemically synthesized
ggttgtgaattgtttccagaga

SEQ ID NO: 682256 - DNA, 22 bp, Artificial Sequence
  chemically synthesized
tgtcaattgcttctctggaaac

SEQ ID NO: 682257 - DNA, 22 bp, Artificial Sequence
  chemically synthesized
gtcaattgcttctctggaaaca

SEQ ID NO: 682258 - DNA, 22 bp, Artificial Sequence
  chemically synthesized
tcaattgcttctctggaaacaa

SEQ ID NO: 682259 - DNA, 22 bp, Artificial Sequence
  chemically synthesized
cttctctggaaacaattcacaa

SEQ ID NO: 682260 - DNA, 22 bp, Artificial Sequence
  chemically synthesized
ctctggaaacaattcacaacct

SEQ ID NO: 682261 - DNA, 22 bp, Artificial Sequence
  chemically synthesized
ataaataaaactaggttgtgaa

SEQ ID NO: 682262 - DNA, 22 bp, Artificial Sequence
  chemically synthesized
tctggaaacaattcacaaccta

SEQ ID NO: 682263 - DNA, 22 bp, Artificial Sequence
  chemically synthesized
tggaaacaattcacaacctagt

SEQ ID NO: 682264 - DNA, 22 bp, Artificial Sequence
  chemically synthesized
gaaacaattcacaacctagttt

SEQ ID NO: 682265 - DNA, 22 bp, Artificial Sequence
  chemically synthesized
atcatatgttcataaataaaac

SEQ ID NO: 682266 - DNA, 22 bp, Artificial Sequence
  chemically synthesized
aatcatatgttcataaataaaa

SEQ ID NO: 682267 - DNA, 22 bp, Artificial Sequence
  chemically synthesized
taatcatatgttcataaataaa

SEQ ID NO: 682268 - DNA, 22 bp, Artificial Sequence
  chemically synthesized
ttaatcatatgttcataaataa

SEQ ID NO: 682269 - DNA, 22 bp, Artificial Sequence
  chemically synthesized
acaacctagttttatttatgaa

SEQ ID NO: 682270 - DNA, 22 bp, Artificial Sequence
  chemically synthesized
tttaatcatatgttcataaata

SEQ ID NO: 682271 - DNA, 22 bp, Artificial Sequence
  chemically synthesized
ttttttaatcatatgttcataa

SEQ ID NO: 682272 - DNA, 22 bp, Artificial Sequence
  chemically synthesized
ctgttttttaatcatatgttca

SEQ ID NO: 682273 - DNA, 22 bp, Artificial Sequence
  chemically synthesized
gttttatttatgaacatatgat

SEQ ID NO: 682274 - DNA, 22 bp, Artificial Sequence
  chemically synthesized
tatttatgaacatatgattaaa

SEQ ID NO: 682275 - DNA, 22 bp, Artificial Sequence
  chemically synthesized
atttatgaacatatgattaaaa

SEQ ID NO: 682276 - DNA, 22 bp, Artificial Sequence
  chemically synthesized
tttatgaacatatgattaaaaa

SEQ ID NO: 682277 - DNA, 22 bp, Artificial Sequence
  chemically synthesized
atgaacatatgattaaaaaaca

SEQ ID NO: 682278 - DNA, 22 bp, Artificial Sequence
  chemically synthesized
tgaacatatgattaaaaaacag

SEQ ID NO: 682279 - DNA, 22 bp, Artificial Sequence
  chemically synthesized
aaaaagacaaagctgctgtttt

SEQ ID NO: 682280 - DNA, 22 bp, Artificial Sequence
  chemically synthesized
aaacaattaaaaaagacaaagc

SEQ ID NO: 682281 - DNA, 22 bp, Artificial Sequence
  chemically synthesized
aaaaacagcagctttgtctttt

SEQ ID NO: 682282 - DNA, 22 bp, Artificial Sequence
  chemically synthesized
tgtcttttttaattgttttagt

SEQ ID NO: 682283 - DNA, 22 bp, Artificial Sequence
  chemically synthesized
gtcttttttaattgttttagtc

SEQ ID NO: 682284 - DNA, 22 bp, Artificial Sequence
  chemically synthesized
tcttttttaattgttttagtcc

SEQ ID NO: 682285 - DNA, 22 bp, Artificial Sequence
  chemically synthesized
aagaaaagtgacaggactaaaa

SEQ ID NO: 682286 - DNA, 22 bp, Artificial Sequence
  chemically synthesized
caagaaaagtgacaggactaaa

SEQ ID NO: 682287 - DNA, 22 bp, Artificial Sequence
  chemically synthesized
ttttaattgttttagtcctgtc

SEQ ID NO: 682288 - DNA, 22 bp, Artificial Sequence
  chemically synthesized
tttaattgttttagtcctgtca

SEQ ID NO: 682289 - DNA, 22 bp, Artificial Sequence
  chemically synthesized
tttcaagaaaagtgacaggact

SEQ ID NO: 682290 - DNA, 22 bp, Artificial Sequence
  chemically synthesized
ttaattgttttagtcctgtcac

SEQ ID NO: 682291 - DNA, 22 bp, Artificial Sequence
  chemically synthesized
gtttcaagaaaagtgacaggac

SEQ ID NO: 682292 - DNA, 22 bp, Artificial Sequence
  chemically synthesized
taattgttttagtcctgtcact

SEQ ID NO: 682293 - DNA, 22 bp, Artificial Sequence
  chemically synthesized
aattgttttagtcctgtcactt

SEQ ID NO: 682294 - DNA, 22 bp, Artificial Sequence
  chemically synthesized
attgttttagtcctgtcacttt

SEQ ID NO: 682295 - DNA, 22 bp, Artificial Sequence
  chemically synthesized
cgacttgtttcaagaaaagtga

SEQ ID NO: 682296 - DNA, 22 bp, Artificial Sequence
  chemically synthesized
ttttagtcctgtcacttttctt

SEQ ID NO: 682297 - DNA, 22 bp, Artificial Sequence
  chemically synthesized
tagtcctgtcacttttcttgaa

SEQ ID NO: 682298 - DNA, 22 bp, Artificial Sequence
  chemically synthesized
agtcctgtcacttttcttgaaa

SEQ ID NO: 682299 - DNA, 22 bp, Artificial Sequence
  chemically synthesized
gtcctgtcacttttcttgaaac

SEQ ID NO: 682300 - DNA, 22 bp, Artificial Sequence
  chemically synthesized
tcacttttcttgaaacaagtcg

SEQ ID NO: 682301 - DNA, 22 bp, Artificial Sequence
  chemically synthesized
tgggtaagtcctacgacttgtt

SEQ ID NO: 682302 - DNA, 22 bp, Artificial Sequence
  chemically synthesized
gtgggtaagtcctacgacttgt

SEQ ID NO: 682303 - DNA, 22 bp, Artificial Sequence
  chemically synthesized
ttgtgggtaagtcctacgactt

SEQ ID NO: 682304 - DNA, 22 bp, Artificial Sequence
  chemically synthesized
cttgtgggtaagtcctacgact

SEQ ID NO: 682305 - DNA, 22 bp, Artificial Sequence
  chemically synthesized
ttcttgaaacaagtcgtaggac

SEQ ID NO: 682306 - DNA, 22 bp, Artificial Sequence
  chemically synthesized
tcttgtgggtaagtcctacgac

SEQ ID NO: 682307 - DNA, 22 bp, Artificial Sequence
  chemically synthesized
tcttgaaacaagtcgtaggact

SEQ ID NO: 682308 - DNA, 22 bp, Artificial Sequence
  chemically synthesized
cttgaaacaagtcgtaggactt

SEQ ID NO: 682309 - DNA, 22 bp, Artificial Sequence
  chemically synthesized
ttgaaacaagtcgtaggactta

SEQ ID NO: 682310 - DNA, 22 bp, Artificial Sequence
  chemically synthesized
gaaacaagtcgtaggacttacc

SEQ ID NO: 682311 - DNA, 22 bp, Artificial Sequence
  chemically synthesized
aaacaagtcgtaggacttaccc

SEQ ID NO: 682312 - DNA, 22 bp, Artificial Sequence
  chemically synthesized
agtattttcttgtgggtaagtc

SEQ ID NO: 682313 - DNA, 22 bp, Artificial Sequence
  chemically synthesized
atatatgctcagtattttcttg

SEQ ID NO: 682314 - DNA, 22 bp, Artificial Sequence
  chemically synthesized
gatatatgctcagtattttctt

SEQ ID NO: 682315 - DNA, 22 bp, Artificial Sequence
  chemically synthesized
cttgatatatgctcagtatttt

SEQ ID NO: 682316 - DNA, 22 bp, Artificial Sequence
  chemically synthesized
acccacaagaaaatactgagca

SEQ ID NO: 682317 - DNA, 22 bp, Artificial Sequence
  chemically synthesized
ctacttgatatatgctcagtat

SEQ ID NO: 682318 - DNA, 22 bp, Artificial Sequence
  chemically synthesized
cccacaagaaaatactgagcat

SEQ ID NO: 682319 - DNA, 22 bp, Artificial Sequence
  chemically synthesized
cattactacttgatatatgctc

SEQ ID NO: 682320 - DNA, 22 bp, Artificial Sequence
  chemically synthesized
aaagctgcattactacttgata

SEQ ID NO: 682321 - DNA, 22 bp, Artificial Sequence
  chemically synthesized
taaaagctgcattactacttga

SEQ ID NO: 682322 - DNA, 22 bp, Artificial Sequence
  chemically synthesized
ctaaaagctgcattactacttg

SEQ ID NO: 682323 - DNA, 22 bp, Artificial Sequence
  chemically synthesized
agcatatatcaagtagtaatgc

SEQ ID NO: 682324 - DNA, 22 bp, Artificial Sequence
  chemically synthesized
cttctaaaagctgcattactac

SEQ ID NO: 682325 - DNA, 22 bp, Artificial Sequence
  chemically synthesized
acagtaacagatgactacttct

SEQ ID NO: 682326 - DNA, 22 bp, Artificial Sequence
  chemically synthesized
tgacagtaacagatgactactt

SEQ ID NO: 682327 - DNA, 22 bp, Artificial Sequence
  chemically synthesized
ttagaagtagtcatctgttact

SEQ ID NO: 682328 - DNA, 22 bp, Artificial Sequence
  chemically synthesized
tagaagtagtcatctgttactg

SEQ ID NO: 682329 - DNA, 22 bp, Artificial Sequence
  chemically synthesized
agaagtagtcatctgttactgt

SEQ ID NO: 682330 - DNA, 22 bp, Artificial Sequence
  chemically synthesized
gaagtagtcatctgttactgtc

SEQ ID NO: 682331 - DNA, 22 bp, Artificial Sequence
  chemically synthesized
aaaatgaaatgaacctctgaca

SEQ ID NO: 682332 - DNA, 22 bp, Artificial Sequence
  chemically synthesized
ttactgtcagaggttcatttca

SEQ ID NO: 682333 - DNA, 22 bp, Artificial Sequence
  chemically synthesized
aaaagactcaaaatgaaatgaa

SEQ ID NO: 682334 - DNA, 22 bp, Artificial Sequence
  chemically synthesized
ctgtcagaggttcatttcattt

SEQ ID NO: 682335 - DNA, 22 bp, Artificial Sequence
  chemically synthesized
attaaaaagactcaaaatgaaa

SEQ ID NO: 682336 - DNA, 22 bp, Artificial Sequence
  chemically synthesized
tcagaggttcatttcattttga

SEQ ID NO: 682337 - DNA, 22 bp, Artificial Sequence
  chemically synthesized
aattaaaaagactcaaaatgaa

SEQ ID NO: 682338 - DNA, 22 bp, Artificial Sequence
  chemically synthesized
taattaaaaagactcaaaatga

SEQ ID NO: 682339 - DNA, 22 bp, Artificial Sequence
  chemically synthesized
cattttaattaaaaagactcaa

SEQ ID NO: 682340 - DNA, 22 bp, Artificial Sequence
  chemically synthesized
gcattttaattaaaaagactca

SEQ ID NO: 682341 - DNA, 22 bp, Artificial Sequence
  chemically synthesized
tgcattttaattaaaaagactc

SEQ ID NO: 682342 - DNA, 22 bp, Artificial Sequence
  chemically synthesized
atttcattttgagtctttttaa

SEQ ID NO: 682343 - DNA, 22 bp, Artificial Sequence
  chemically synthesized
cattttgagtctttttaattaa

SEQ ID NO: 682344 - DNA, 22 bp, Artificial Sequence
  chemically synthesized
attttgagtctttttaattaaa

SEQ ID NO: 682345 - DNA, 22 bp, Artificial Sequence
  chemically synthesized
tgagtctttttaattaaaatgc

SEQ ID NO: 682346 - DNA, 22 bp, Artificial Sequence
  chemically synthesized
gagtctttttaattaaaatgca

SEQ ID NO: 682347 - DNA, 22 bp, Artificial Sequence
  chemically synthesized
agtctttttaattaaaatgcaa

SEQ ID NO: 682348 - DNA, 22 bp, Artificial Sequence
  chemically synthesized
tttaattaaaatgcaaagttct

SEQ ID NO: 682349 - DNA, 22 bp, Artificial Sequence
  chemically synthesized
ttaattaaaatgcaaagttcta

SEQ ID NO: 682350 - DNA, 22 bp, Artificial Sequence
  chemically synthesized
taattaaaatgcaaagttctac

SEQ ID NO: 682351 - DNA, 22 bp, Artificial Sequence
  chemically synthesized
aattaaaatgcaaagttctaca

SEQ ID NO: 682352 - DNA, 22 bp, Artificial Sequence
  chemically synthesized
ggcaggcatgtatgtagaactt

SEQ ID NO: 682353 - DNA, 22 bp, Artificial Sequence
  chemically synthesized
attaaaatgcaaagttctacat

SEQ ID NO: 682354 - DNA, 22 bp, Artificial Sequence
  chemically synthesized
aggcaggcatgtatgtagaact

SEQ ID NO: 682355 - DNA, 22 bp, Artificial Sequence
  chemically synthesized
aaatgcaaagttctacatacat

SEQ ID NO: 682356 - DNA, 22 bp, Artificial Sequence
  chemically synthesized
agaaaggggtaatttaggcagg

SEQ ID NO: 682357 - DNA, 22 bp, Artificial Sequence
  chemically synthesized
cagaaaggggtaatttaggcag

SEQ ID NO: 682358 - DNA, 22 bp, Artificial Sequence
  chemically synthesized
tacatacatgcctgcctaaatt

SEQ ID NO: 682359 - DNA, 22 bp, Artificial Sequence
  chemically synthesized
catacatgcctgcctaaattac

SEQ ID NO: 682360 - DNA, 22 bp, Artificial Sequence
  chemically synthesized
agtatttcagaaaggggtaatt

SEQ ID NO: 682361 - DNA, 22 bp, Artificial Sequence
  chemically synthesized
gagtatttcagaaaggggtaat

SEQ ID NO: 682362 - DNA, 22 bp, Artificial Sequence
  chemically synthesized
aaatttgagtatttcagaaagg

SEQ ID NO: 682363 - DNA, 22 bp, Artificial Sequence
  chemically synthesized
cctaaattacccctttctgaaa

SEQ ID NO: 682364 - DNA, 22 bp, Artificial Sequence
  chemically synthesized
gaaatttgagtatttcagaaag

SEQ ID NO: 682365 - DNA, 22 bp, Artificial Sequence
  chemically synthesized
tgaaatttgagtatttcagaaa

SEQ ID NO: 682366 - DNA, 22 bp, Artificial Sequence
  chemically synthesized
ttgaaatttgagtatttcagaa

SEQ ID NO: 682367 - DNA, 22 bp, Artificial Sequence
  chemically synthesized
tttgaaatttgagtatttcaga

SEQ ID NO: 682368 - DNA, 22 bp, Artificial Sequence
  chemically synthesized
aattacccctttctgaaatact

SEQ ID NO: 682369 - DNA, 22 bp, Artificial Sequence
  chemically synthesized
ttttgaaatttgagtatttcag

SEQ ID NO: 682370 - DNA, 22 bp, Artificial Sequence
  chemically synthesized
tttttgaaatttgagtatttca

SEQ ID NO: 682371 - DNA, 22 bp, Artificial Sequence
  chemically synthesized
ttttttgaaatttgagtatttc

SEQ ID NO: 682372 - DNA, 22 bp, Artificial Sequence
  chemically synthesized
cccctttctgaaatactcaaat

SEQ ID NO: 682373 - DNA, 22 bp, Artificial Sequence
  chemically synthesized
aaatttttttttgaaatttgag

SEQ ID NO: 682374 - DNA, 22 bp, Artificial Sequence
  chemically synthesized
aaaatttttttttgaaatttga

SEQ ID NO: 682375 - DNA, 22 bp, Artificial Sequence
  chemically synthesized
tctgaaatactcaaatttcaaa

SEQ ID NO: 682376 - DNA, 22 bp, Artificial Sequence
  chemically synthesized
ctgaaatactcaaatttcaaaa

SEQ ID NO: 682377 - DNA, 22 bp, Artificial Sequence
  chemically synthesized
tgaaatactcaaatttcaaaaa

SEQ ID NO: 682378 - DNA, 22 bp, Artificial Sequence
  chemically synthesized
aaatactcaaatttcaaaaaaa

SEQ ID NO: 682379 - DNA, 22 bp, Artificial Sequence
  chemically synthesized
gcatttaaaatttttttttgaa

SEQ ID NO: 682380 - DNA, 22 bp, Artificial Sequence
  chemically synthesized
cattagcatttaaaattttttt

SEQ ID NO: 682381 - DNA, 22 bp, Artificial Sequence
  chemically synthesized
aaatttcaaaaaaaaattttaa

SEQ ID NO: 682382 - DNA, 22 bp, Artificial Sequence
  chemically synthesized
caaaaaaaaattttaaatgcta

SEQ ID NO: 682383 - DNA, 22 bp, Artificial Sequence
  chemically synthesized
aaaaaaaaattttaaatgctaa

SEQ ID NO: 682384 - DNA, 22 bp, Artificial Sequence
  chemically synthesized
acaatggttacattagcattta

SEQ ID NO: 682385 - DNA, 22 bp, Artificial Sequence
  chemically synthesized
gagtattaacaatggttacatt

SEQ ID NO: 682386 - DNA, 22 bp, Artificial Sequence
  chemically synthesized
taaatgctaatgtaaccattgt

SEQ ID NO: 682387 - DNA, 22 bp, Artificial Sequence
  chemically synthesized
aaatgctaatgtaaccattgtt

SEQ ID NO: 682388 - DNA, 22 bp, Artificial Sequence
  chemically synthesized
aatgctaatgtaaccattgtta

SEQ ID NO: 682389 - DNA, 22 bp, Artificial Sequence
  chemically synthesized
atgtaaccattgttaatactct

SEQ ID NO: 682390 - DNA, 22 bp, Artificial Sequence
  chemically synthesized
aagaagcaagtctagagtatta

SEQ ID NO: 682391 - DNA, 22 bp, Artificial Sequence
  chemically synthesized
caaatctcaagaagcaagtcta

SEQ ID NO: 682392 - DNA, 22 bp, Artificial Sequence
  chemically synthesized
ccaaatctcaagaagcaagtct

SEQ ID NO: 682393 - DNA, 22 bp, Artificial Sequence
  chemically synthesized
tccaaatctcaagaagcaagtc

SEQ ID NO: 682394 - DNA, 22 bp, Artificial Sequence
  chemically synthesized
ttaatactctagacttgcttct

SEQ ID NO: 682395 - DNA, 22 bp, Artificial Sequence
  chemically synthesized
ttccaaatctcaagaagcaagt

SEQ ID NO: 682396 - DNA, 22 bp, Artificial Sequence
  chemically synthesized
tttccaaatctcaagaagcaag

SEQ ID NO: 682397 - DNA, 22 bp, Artificial Sequence
  chemically synthesized
ttttccaaatctcaagaagcaa

SEQ ID NO: 682398 - DNA, 22 bp, Artificial Sequence
  chemically synthesized
atactctagacttgcttcttga

SEQ ID NO: 682399 - DNA, 22 bp, Artificial Sequence
  chemically synthesized
cttttttccaaatctcaagaag

SEQ ID NO: 682400 - DNA, 22 bp, Artificial Sequence
  chemically synthesized
acttttttccaaatctcaagaa

SEQ ID NO: 682401 - DNA, 22 bp, Artificial Sequence
  chemically synthesized
tagacttgcttcttgagatttg

SEQ ID NO: 682402 - DNA, 22 bp, Artificial Sequence
  chemically synthesized
tttacttttttccaaatctcaa

SEQ ID NO: 682403 - DNA, 22 bp, Artificial Sequence
  chemically synthesized
gtttacttttttccaaatctca

SEQ ID NO: 682404 - DNA, 22 bp, Artificial Sequence
  chemically synthesized
gacttgcttcttgagatttgga

SEQ ID NO: 682405 - DNA, 22 bp, Artificial Sequence
  chemically synthesized
tgtttacttttttccaaatctc

SEQ ID NO: 682406 - DNA, 22 bp, Artificial Sequence
  chemically synthesized
ctttgtttacttttttccaaat

SEQ ID NO: 682407 - DNA, 22 bp, Artificial Sequence
  chemically synthesized
gcttcttgagatttggaaaaaa

SEQ ID NO: 682408 - DNA, 22 bp, Artificial Sequence
  chemically synthesized
cttcttgagatttggaaaaaag

SEQ ID NO: 682409 - DNA, 22 bp, Artificial Sequence
  chemically synthesized
cttgagatttggaaaaaagtaa

SEQ ID NO: 682410 - DNA, 22 bp, Artificial Sequence
  chemically synthesized
ttgagatttggaaaaaagtaaa

SEQ ID NO: 682411 - DNA, 22 bp, Artificial Sequence
  chemically synthesized
gtaattcctttgtttacttttt

SEQ ID NO: 682412 - DNA, 22 bp, Artificial Sequence
  chemically synthesized
gagatttggaaaaaagtaaaca

SEQ ID NO: 682413 - DNA, 22 bp, Artificial Sequence
  chemically synthesized
agatttggaaaaaagtaaacaa

SEQ ID NO: 682414 - DNA, 22 bp, Artificial Sequence
  chemically synthesized
actggtaattcctttgtttact

SEQ ID NO: 682415 - DNA, 22 bp, Artificial Sequence
  chemically synthesized
attgactggtaattcctttgtt

SEQ ID NO: 682416 - DNA, 22 bp, Artificial Sequence
  chemically synthesized
ggaaaaaagtaaacaaaggaat

SEQ ID NO: 682417 - DNA, 22 bp, Artificial Sequence
  chemically synthesized
aattgactggtaattcctttgt

SEQ ID NO: 682418 - DNA, 22 bp, Artificial Sequence
  chemically synthesized
gaaaaaagtaaacaaaggaatt

SEQ ID NO: 682419 - DNA, 22 bp, Artificial Sequence
  chemically synthesized
gcttaattgactggtaattcct

SEQ ID NO: 682420 - DNA, 22 bp, Artificial Sequence
  chemically synthesized
ttcgcttaattgactggtaatt

SEQ ID NO: 682421 - DNA, 22 bp, Artificial Sequence
  chemically synthesized
gttcgcttaattgactggtaat

SEQ ID NO: 682422 - DNA, 22 bp, Artificial Sequence
  chemically synthesized
cttgttcgcttaattgactggt

SEQ ID NO: 682423 - DNA, 22 bp, Artificial Sequence
  chemically synthesized
ccttgttcgcttaattgactgg

SEQ ID NO: 682424 - DNA, 22 bp, Artificial Sequence
  chemically synthesized
ggatgacttccttgttcgctta

SEQ ID NO: 682425 - DNA, 22 bp, Artificial Sequence
  chemically synthesized
aggatgacttccttgttcgctt

SEQ ID NO: 682426 - DNA, 22 bp, Artificial Sequence
  chemically synthesized
ccagtcaattaagcgaacaagg

SEQ ID NO: 682427 - DNA, 22 bp, Artificial Sequence
  chemically synthesized
aacttaggatgacttccttgtt

SEQ ID NO: 682428 - DNA, 22 bp, Artificial Sequence
  chemically synthesized
caacttaggatgacttccttgt

SEQ ID NO: 682429 - DNA, 22 bp, Artificial Sequence
  chemically synthesized
tttcaacttaggatgacttcct

SEQ ID NO: 682430 - DNA, 22 bp, Artificial Sequence
  chemically synthesized
agcgaacaaggaagtcatccta

SEQ ID NO: 682431 - DNA, 22 bp, Artificial Sequence
  chemically synthesized
tctgtttcaacttaggatgact

SEQ ID NO: 682432 - DNA, 22 bp, Artificial Sequence
  chemically synthesized
atctgtttcaacttaggatgac

SEQ ID NO: 682433 - DNA, 22 bp, Artificial Sequence
  chemically synthesized
cttatctgtttcaacttaggat

SEQ ID NO: 682434 - DNA, 22 bp, Artificial Sequence
  chemically synthesized
ccttatctgtttcaacttagga

SEQ ID NO: 682435 - DNA, 22 bp, Artificial Sequence
  chemically synthesized
tccttatctgtttcaacttagg

SEQ ID NO: 682436 - DNA, 22 bp, Artificial Sequence
  chemically synthesized
cattttccttatctgtttcaac

SEQ ID NO: 682437 - DNA, 22 bp, Artificial Sequence
  chemically synthesized
ttacattttccttatctgtttc

SEQ ID NO: 682438 - DNA, 22 bp, Artificial Sequence
  chemically synthesized
attattacattttccttatctg

SEQ ID NO: 682439 - DNA, 22 bp, Artificial Sequence
  chemically synthesized
gattattacattttccttatct

SEQ ID NO: 682440 - DNA, 22 bp, Artificial Sequence
  chemically synthesized
agttgaaacagataaggaaaat

SEQ ID NO: 682441 - DNA, 22 bp, Artificial Sequence
  chemically synthesized
aaacagataaggaaaatgtaat

SEQ ID NO: 682442 - DNA, 22 bp, Artificial Sequence
  chemically synthesized
tagcatttgattattacatttt

SEQ ID NO: 682443 - DNA, 22 bp, Artificial Sequence
  chemically synthesized
atctgtagcatttgattattac

SEQ ID NO: 682444 - DNA, 22 bp, Artificial Sequence
  chemically synthesized
catctgtagcatttgattatta

SEQ ID NO: 682445 - DNA, 22 bp, Artificial Sequence
  chemically synthesized
gtgtcttcatctgtagcatttg

SEQ ID NO: 682446 - DNA, 22 bp, Artificial Sequence
  chemically synthesized
cagatgaagacaccagcgtttt

SEQ ID NO: 682447 - DNA, 22 bp, Artificial Sequence
  chemically synthesized
aggaaaaaaaaaaagaaaaacg

SEQ ID NO: 682448 - DNA, 22 bp, Artificial Sequence
  chemically synthesized
atctcaggaaaaaaaaaaagaa

SEQ ID NO: 682449 - DNA, 22 bp, Artificial Sequence
  chemically synthesized
tagatattcatctcaggaaaaa

SEQ ID NO: 682450 - DNA, 22 bp, Artificial Sequence
  chemically synthesized
gtagatattcatctcaggaaaa

SEQ ID NO: 682451 - DNA, 22 bp, Artificial Sequence
  chemically synthesized
ttctttttttttttcctgagat

SEQ ID NO: 682452 - DNA, 22 bp, Artificial Sequence
  chemically synthesized
ttgtagatattcatctcaggaa

SEQ ID NO: 682453 - DNA, 22 bp, Artificial Sequence
  chemically synthesized
tctttttttttttcctgagatg

SEQ ID NO: 682454 - DNA, 22 bp, Artificial Sequence
  chemically synthesized
ctttttttttttcctgagatga

SEQ ID NO: 682455 - DNA, 22 bp, Artificial Sequence
  chemically synthesized
tttttttttttcctgagatgaa

SEQ ID NO: 682456 - DNA, 22 bp, Artificial Sequence
  chemically synthesized
tttttttttcctgagatgaata

SEQ ID NO: 682457 - DNA, 22 bp, Artificial Sequence
  chemically synthesized
ttttttttcctgagatgaatat

SEQ ID NO: 682458 - DNA, 22 bp, Artificial Sequence
  chemically synthesized
tttttttcctgagatgaatatc

SEQ ID NO: 682459 - DNA, 22 bp, Artificial Sequence
  chemically synthesized
ttttttcctgagatgaatatct

SEQ ID NO: 682460 - DNA, 22 bp, Artificial Sequence
  chemically synthesized
tttttcctgagatgaatatcta

SEQ ID NO: 682461 - DNA, 22 bp, Artificial Sequence
  chemically synthesized
ttttcctgagatgaatatctac

SEQ ID NO: 682462 - DNA, 22 bp, Artificial Sequence
  chemically synthesized
tttcctgagatgaatatctaca

SEQ ID NO: 682463 - DNA, 22 bp, Artificial Sequence
  chemically synthesized
ttcctgagatgaatatctacaa

SEQ ID NO: 682464 - DNA, 22 bp, Artificial Sequence
  chemically synthesized
tcctgagatgaatatctacaag

SEQ ID NO: 682465 - DNA, 22 bp, Artificial Sequence
  chemically synthesized
cctgagatgaatatctacaaga

SEQ ID NO: 682466 - DNA, 22 bp, Artificial Sequence
  chemically synthesized
ataaagcgtgattcttgtagat

SEQ ID NO: 682467 - DNA, 22 bp, Artificial Sequence
  chemically synthesized
ctgagatgaatatctacaagaa

SEQ ID NO: 682468 - DNA, 22 bp, Artificial Sequence
  chemically synthesized
gataaagcgtgattcttgtaga

SEQ ID NO: 682469 - DNA, 22 bp, Artificial Sequence
  chemically synthesized
tgataaagcgtgattcttgtag

SEQ ID NO: 682470 - DNA, 22 bp, Artificial Sequence
  chemically synthesized
ttgataaagcgtgattcttgta

SEQ ID NO: 682471 - DNA, 22 bp, Artificial Sequence
  chemically synthesized
agatgaatatctacaagaatca

SEQ ID NO: 682472 - DNA, 22 bp, Artificial Sequence
  chemically synthesized
cttttgataaagcgtgattctt

SEQ ID NO: 682473 - DNA, 22 bp, Artificial Sequence
  chemically synthesized
aggaagctgcttttgataaagc

SEQ ID NO: 682474 - DNA, 22 bp, Artificial Sequence
  chemically synthesized
caagaatcacgctttatcaaaa

SEQ ID NO: 682475 - DNA, 22 bp, Artificial Sequence
  chemically synthesized
aagattaaggaagctgcttttg

SEQ ID NO: 682476 - DNA, 22 bp, Artificial Sequence
  chemically synthesized
ctgaagattaaggaagctgctt

SEQ ID NO: 682477 - DNA, 22 bp, Artificial Sequence
  chemically synthesized
gctgaagattaaggaagctgct

SEQ ID NO: 682478 - DNA, 22 bp, Artificial Sequence
  chemically synthesized
tatcaaaagcagcttccttaat

SEQ ID NO: 682479 - DNA, 22 bp, Artificial Sequence
  chemically synthesized
cgcttgctgaagattaaggaag

SEQ ID NO: 682480 - DNA, 22 bp, Artificial Sequence
  chemically synthesized
atcaaaagcagcttccttaatc

SEQ ID NO: 682481 - DNA, 22 bp, Artificial Sequence
  chemically synthesized
tcaaaagcagcttccttaatct

SEQ ID NO: 682482 - DNA, 22 bp, Artificial Sequence
  chemically synthesized
taatacacagctacgcttgctg

SEQ ID NO: 682483 - DNA, 22 bp, Artificial Sequence
  chemically synthesized
ccttaatcttcagcaagcgtag

SEQ ID NO: 682484 - DNA, 22 bp, Artificial Sequence
  chemically synthesized
cttaatcttcagcaagcgtagc

SEQ ID NO: 682485 - DNA, 22 bp, Artificial Sequence
  chemically synthesized
ctataatacacagctacgcttg

SEQ ID NO: 682486 - DNA, 22 bp, Artificial Sequence
  chemically synthesized
gctataatacacagctacgctt

SEQ ID NO: 682487 - DNA, 22 bp, Artificial Sequence
  chemically synthesized
tgctataatacacagctacgct

SEQ ID NO: 682488 - DNA, 22 bp, Artificial Sequence
  chemically synthesized
aatcttcagcaagcgtagctgt

SEQ ID NO: 682489 - DNA, 22 bp, Artificial Sequence
  chemically synthesized
atcttcagcaagcgtagctgtg

SEQ ID NO: 682490 - DNA, 22 bp, Artificial Sequence
  chemically synthesized
cagcaagcgtagctgtgtatta

SEQ ID NO: 682491 - DNA, 22 bp, Artificial Sequence
  chemically synthesized
atgcctttgctataatacacag

SEQ ID NO: 682492 - DNA, 22 bp, Artificial Sequence
  chemically synthesized
agcaagcgtagctgtgtattat

SEQ ID NO: 682493 - DNA, 22 bp, Artificial Sequence
  chemically synthesized
catgcctttgctataatacaca

SEQ ID NO: 682494 - DNA, 22 bp, Artificial Sequence
  chemically synthesized
tcttcatgcctttgctataata

SEQ ID NO: 682495 - DNA, 22 bp, Artificial Sequence
  chemically synthesized
tatcttcatgcctttgctataa

SEQ ID NO: 682496 - DNA, 22 bp, Artificial Sequence
  chemically synthesized
cccctctatcttcatgcctttg

SEQ ID NO: 682497 - DNA, 22 bp, Artificial Sequence
  chemically synthesized
tgtattatagcaaaggcatgaa

SEQ ID NO: 682498 - DNA, 22 bp, Artificial Sequence
  chemically synthesized
tgcccctctatcttcatgcctt

SEQ ID NO: 682499 - DNA, 22 bp, Artificial Sequence
  chemically synthesized
tagcaaaggcatgaagatagag

SEQ ID NO: 682500 - DNA, 22 bp, Artificial Sequence
  chemically synthesized
gacactctgcccctctatcttc

SEQ ID NO: 682501 - DNA, 22 bp, Artificial Sequence
  chemically synthesized
gtctggacactctgcccctcta

SEQ ID NO: 682502 - DNA, 22 bp, Artificial Sequence
  chemically synthesized
aggggtagaattggtctggaca

SEQ ID NO: 682503 - DNA, 22 bp, Artificial Sequence
  chemically synthesized
taaggggtagaattggtctgga

SEQ ID NO: 682504 - DNA, 22 bp, Artificial Sequence
  chemically synthesized
agtgacccacctctaaggggta

SEQ ID NO: 682505 - DNA, 22 bp, Artificial Sequence
  chemically synthesized
taaagggttaagtgacccacct

SEQ ID NO: 682506 - DNA, 22 bp, Artificial Sequence
  chemically synthesized
taccccttagaggtgggtcact

SEQ ID NO: 682507 - DNA, 22 bp, Artificial Sequence
  chemically synthesized
ccccttagaggtgggtcactta

SEQ ID NO: 682508 - DNA, 22 bp, Artificial Sequence
  chemically synthesized
cctgtaaagggttaagtgaccc

SEQ ID NO: 682509 - DNA, 22 bp, Artificial Sequence
  chemically synthesized
gcctgtaaagggttaagtgacc

SEQ ID NO: 682510 - DNA, 22 bp, Artificial Sequence
  chemically synthesized
agaggtgggtcacttaaccctt

SEQ ID NO: 682511 - DNA, 22 bp, Artificial Sequence
  chemically synthesized
gaggtgggtcacttaacccttt

SEQ ID NO: 682512 - DNA, 22 bp, Artificial Sequence
  chemically synthesized
agtgacttgcctgtaaagggtt

SEQ ID NO: 682513 - DNA, 22 bp, Artificial Sequence
  chemically synthesized
caagtggttaagtgacttgcct

SEQ ID NO: 682514 - DNA, 22 bp, Artificial Sequence
  chemically synthesized
ccaagtggttaagtgacttgcc

SEQ ID NO: 682515 - DNA, 22 bp, Artificial Sequence
  chemically synthesized
aaccctttacaggcaagtcact

SEQ ID NO: 682516 - DNA, 22 bp, Artificial Sequence
  chemically synthesized
accctttacaggcaagtcactt

SEQ ID NO: 682517 - DNA, 22 bp, Artificial Sequence
  chemically synthesized
tacaggcaagtcacttaaccac

SEQ ID NO: 682518 - DNA, 22 bp, Artificial Sequence
  chemically synthesized
acaggcaagtcacttaaccact

SEQ ID NO: 682519 - DNA, 22 bp, Artificial Sequence
  chemically synthesized
caggcaagtcacttaaccactt

SEQ ID NO: 682520 - DNA, 22 bp, Artificial Sequence
  chemically synthesized
acaaaagcttccaagtggttaa

SEQ ID NO: 682521 - DNA, 22 bp, Artificial Sequence
  chemically synthesized
tagatgagttaacaaaagcttc

SEQ ID NO: 682522 - DNA, 22 bp, Artificial Sequence
  chemically synthesized
tatagatgagttaacaaaagct

SEQ ID NO: 682523 - DNA, 22 bp, Artificial Sequence
  chemically synthesized
aaccacttggaagcttttgtta

SEQ ID NO: 682524 - DNA, 22 bp, Artificial Sequence
  chemically synthesized
accacttggaagcttttgttaa

SEQ ID NO: 682525 - DNA, 22 bp, Artificial Sequence
  chemically synthesized
ggaagcttttgttaactcatct

SEQ ID NO: 682526 - DNA, 22 bp, Artificial Sequence
  chemically synthesized
tccacattctatagatgagtta

SEQ ID NO: 682527 - DNA, 22 bp, Artificial Sequence
  chemically synthesized
gaagcttttgttaactcatcta

SEQ ID NO: 682528 - DNA, 22 bp, Artificial Sequence
  chemically synthesized
ttgttaactcatctatagaatg

SEQ ID NO: 682529 - DNA, 22 bp, Artificial Sequence
  chemically synthesized
tgttaactcatctatagaatgt

SEQ ID NO: 682530 - DNA, 22 bp, Artificial Sequence
  chemically synthesized
gttaactcatctatagaatgtg

SEQ ID NO: 682531 - DNA, 22 bp, Artificial Sequence
  chemically synthesized
ttaactcatctatagaatgtgg

SEQ ID NO: 682532 - DNA, 22 bp, Artificial Sequence
  chemically synthesized
actcatctatagaatgtggata

SEQ ID NO: 682533 - DNA, 22 bp, Artificial Sequence
  chemically synthesized
atctatagaatgtggataatac

SEQ ID NO: 682534 - DNA, 22 bp, Artificial Sequence
  chemically synthesized
acccacaatatggcagtattat

SEQ ID NO: 682535 - DNA, 22 bp, Artificial Sequence
  chemically synthesized
gacccacaatatggcagtatta

SEQ ID NO: 682536 - DNA, 22 bp, Artificial Sequence
  chemically synthesized
tagaatgtggataatactgcca

SEQ ID NO: 682537 - DNA, 22 bp, Artificial Sequence
  chemically synthesized
tgacccacaatatggcagtatt

SEQ ID NO: 682538 - DNA, 22 bp, Artificial Sequence
  chemically synthesized
tgtcattttgacccacaatatg

SEQ ID NO: 682539 - DNA, 22 bp, Artificial Sequence
  chemically synthesized
ccatattgtgggtcaaaatgac

SEQ ID NO: 682540 - DNA, 22 bp, Artificial Sequence
  chemically synthesized
tcagagccgttgtgtcattttg

SEQ ID NO: 682541 - DNA, 22 bp, Artificial Sequence
  chemically synthesized
ctgtcagagccgttgtgtcatt

SEQ ID NO: 682542 - DNA, 22 bp, Artificial Sequence
  chemically synthesized
tgggtcaaaatgacacaacggc

SEQ ID NO: 682543 - DNA, 22 bp, Artificial Sequence
  chemically synthesized
aaattgctgtcagagccgttgt

SEQ ID NO: 682544 - DNA, 22 bp, Artificial Sequence
  chemically synthesized
caaattgctgtcagagccgttg

SEQ ID NO: 682545 - DNA, 22 bp, Artificial Sequence
  chemically synthesized
cccagccttcaaattgctgtca

SEQ ID NO: 682546 - DNA, 22 bp, Artificial Sequence
  chemically synthesized
tgacagcaatttgaaggctggg

SEQ ID NO: 682547 - DNA, 22 bp, Artificial Sequence
  chemically synthesized
acagcaatttgaaggctgggga

SEQ ID NO: 682548 - DNA, 22 bp, Artificial Sequence
  chemically synthesized
catgaacacagcattccccagc

SEQ ID NO: 682549 - DNA, 22 bp, Artificial Sequence
  chemically synthesized
gcatgaacacagcattccccag

SEQ ID NO: 682550 - DNA, 22 bp, Artificial Sequence
  chemically synthesized
tgcatgaacacagcattcccca

SEQ ID NO: 682551 - DNA, 22 bp, Artificial Sequence
  chemically synthesized
ctttgcatgaacacagcattcc

SEQ ID NO: 682552 - DNA, 22 bp, Artificial Sequence
  chemically synthesized
gaaggctggggaatgctgtgtt

SEQ ID NO: 682553 - DNA, 22 bp, Artificial Sequence
  chemically synthesized
aaggctggggaatgctgtgttc

SEQ ID NO: 682554 - DNA, 22 bp, Artificial Sequence
  chemically synthesized
acaggctgctttgcatgaacac

SEQ ID NO: 682555 - DNA, 22 bp, Artificial Sequence
  chemically synthesized
gggaatgctgtgttcatgcaaa

SEQ ID NO: 682556 - DNA, 22 bp, Artificial Sequence
  chemically synthesized
cctgacaggctgctttgcatga

SEQ ID NO: 682557 - DNA, 22 bp, Artificial Sequence
  chemically synthesized
tgttcatgcaaagcagcctgtc

SEQ ID NO: 682558 - DNA, 22 bp, Artificial Sequence
  chemically synthesized
atgcaaagcagcctgtcaggca

SEQ ID NO: 682559 - DNA, 22 bp, Artificial Sequence
  chemically synthesized
agaaatcatacctgcctgacag

SEQ ID NO: 682560 - DNA, 22 bp, Artificial Sequence
  chemically synthesized
aagaaatcatacctgcctgaca

SEQ ID NO: 682561 - DNA, 22 bp, Artificial Sequence
  chemically synthesized
taagaaatcatacctgcctgac

SEQ ID NO: 682562 - DNA, 22 bp, Artificial Sequence
  chemically synthesized
ttaagaaatcatacctgcctga

SEQ ID NO: 682563 - DNA, 22 bp, Artificial Sequence
  chemically synthesized
ttttaagaaatcatacctgcct

SEQ ID NO: 682564 - DNA, 22 bp, Artificial Sequence
  chemically synthesized
tcttttaagaaatcatacctgc

SEQ ID NO: 682565 - DNA, 22 bp, Artificial Sequence
  chemically synthesized
agttctcttttaagaaatcata

SEQ ID NO: 682566 - DNA, 22 bp, Artificial Sequence
  chemically synthesized
tcaggcaggtatgatttcttaa

SEQ ID NO: 682567 - DNA, 22 bp, Artificial Sequence
  chemically synthesized
aacatactgagttctcttttaa

SEQ ID NO: 682568 - DNA, 22 bp, Artificial Sequence
  chemically synthesized
ctgaacatactgagttctcttt

SEQ ID NO: 682569 - DNA, 22 bp, Artificial Sequence
  chemically synthesized
ttcctgaacatactgagttctc

SEQ ID NO: 682570 - DNA, 22 bp, Artificial Sequence
  chemically synthesized
actattcctgaacatactgagt

SEQ ID NO: 682571 - DNA, 22 bp, Artificial Sequence
  chemically synthesized
cttaaaagagaactcagtatgt

SEQ ID NO: 682572 - DNA, 22 bp, Artificial Sequence
  chemically synthesized
ttaaaagagaactcagtatgtt

SEQ ID NO: 682573 - DNA, 22 bp, Artificial Sequence
  chemically synthesized
aaaagagaactcagtatgttca

SEQ ID NO: 682574 - DNA, 22 bp, Artificial Sequence
  chemically synthesized
aaagagaactcagtatgttcag

SEQ ID NO: 682575 - DNA, 22 bp, Artificial Sequence
  chemically synthesized
tatacctaactattcctgaaca

SEQ ID NO: 682576 - DNA, 22 bp, Artificial Sequence
  chemically synthesized
tgtatacctaactattcctgaa

SEQ ID NO: 682577 - DNA, 22 bp, Artificial Sequence
  chemically synthesized
gttctgtatacctaactattcc

SEQ ID NO: 682578 - DNA, 22 bp, Artificial Sequence
  chemically synthesized
ggttctgtatacctaactattc

SEQ ID NO: 682579 - DNA, 22 bp, Artificial Sequence
  chemically synthesized
agtatgttcaggaatagttagg

SEQ ID NO: 682580 - DNA, 22 bp, Artificial Sequence
  chemically synthesized
tttggttctgtatacctaacta

SEQ ID NO: 682581 - DNA, 22 bp, Artificial Sequence
  chemically synthesized
atttggttctgtatacctaact

SEQ ID NO: 682582 - DNA, 22 bp, Artificial Sequence
  chemically synthesized
aggaatagttaggtatacagaa

SEQ ID NO: 682583 - DNA, 22 bp, Artificial Sequence
  chemically synthesized
aagtgaatttatttggttctgt

SEQ ID NO: 682584 - DNA, 22 bp, Artificial Sequence
  chemically synthesized
ggtatacagaaccaaataaatt

SEQ ID NO: 682585 - DNA, 22 bp, Artificial Sequence
  chemically synthesized
aaacagaatgttaaagtgaatt

SEQ ID NO: 682586 - DNA, 22 bp, Artificial Sequence
  chemically synthesized
acacgacaatctaaaacagaat

SEQ ID NO: 682587 - DNA, 22 bp, Artificial Sequence
  chemically synthesized
actttaacattctgttttagat

SEQ ID NO: 682588 - DNA, 22 bp, Artificial Sequence
  chemically synthesized
cctcacacgacaatctaaaaca

SEQ ID NO: 682589 - DNA, 22 bp, Artificial Sequence
  chemically synthesized
ccctcacacgacaatctaaaac

SEQ ID NO: 682590 - DNA, 22 bp, Artificial Sequence
  chemically synthesized
tccctcacacgacaatctaaaa

SEQ ID NO: 682591 - DNA, 22 bp, Artificial Sequence
  chemically synthesized
taacattctgttttagattgtc

SEQ ID NO: 682592 - DNA, 22 bp, Artificial Sequence
  chemically synthesized
aacattctgttttagattgtcg

SEQ ID NO: 682593 - DNA, 22 bp, Artificial Sequence
  chemically synthesized
acattctgttttagattgtcgt

SEQ ID NO: 682594 - DNA, 22 bp, Artificial Sequence
  chemically synthesized
attttccctcacacgacaatct

SEQ ID NO: 682595 - DNA, 22 bp, Artificial Sequence
  chemically synthesized
tcattttccctcacacgacaat

SEQ ID NO: 682596 - DNA, 22 bp, Artificial Sequence
  chemically synthesized
tgttttagattgtcgtgtgagg

SEQ ID NO: 682597 - DNA, 22 bp, Artificial Sequence
  chemically synthesized
ttttagattgtcgtgtgaggga

SEQ ID NO: 682598 - DNA, 22 bp, Artificial Sequence
  chemically synthesized
agacctctcattttccctcaca

SEQ ID NO: 682599 - DNA, 22 bp, Artificial Sequence
  chemically synthesized
tagattgtcgtgtgagggaaaa

SEQ ID NO: 682600 - DNA, 22 bp, Artificial Sequence
  chemically synthesized
agattgtcgtgtgagggaaaat

SEQ ID NO: 682601 - DNA, 22 bp, Artificial Sequence
  chemically synthesized
gattgtcgtgtgagggaaaatg

SEQ ID NO: 682602 - DNA, 22 bp, Artificial Sequence
  chemically synthesized
aactcagacctctcattttccc

SEQ ID NO: 682603 - DNA, 22 bp, Artificial Sequence
  chemically synthesized
ctaaactcagacctctcatttt

SEQ ID NO: 682604 - DNA, 22 bp, Artificial Sequence
  chemically synthesized
tcgtgtgagggaaaatgagagg

SEQ ID NO: 682605 - DNA, 22 bp, Artificial Sequence
  chemically synthesized
actaaactcagacctctcattt

SEQ ID NO: 682606 - DNA, 22 bp, Artificial Sequence
  chemically synthesized
cagaagagcagtttactaaact

SEQ ID NO: 682607 - DNA, 22 bp, Artificial Sequence
  chemically synthesized
acagaagagcagtttactaaac

SEQ ID NO: 682608 - DNA, 22 bp, Artificial Sequence
  chemically synthesized
agtttagtaaactgctcttctg

SEQ ID NO: 682609 - DNA, 22 bp, Artificial Sequence
  chemically synthesized
aagagcagtttacagaagagca

SEQ ID NO: 682610 - DNA, 22 bp, Artificial Sequence
  chemically synthesized
ctaaagagcagtttacagaaga

SEQ ID NO: 682611 - DNA, 22 bp, Artificial Sequence
  chemically synthesized
agtaaactgctcttctgtaaac

SEQ ID NO: 682612 - DNA, 22 bp, Artificial Sequence
  chemically synthesized
gtaaactgctcttctgtaaact

SEQ ID NO: 682613 - DNA, 22 bp, Artificial Sequence
  chemically synthesized
taaactgctaaagagcagttta

SEQ ID NO: 682614 - DNA, 22 bp, Artificial Sequence
  chemically synthesized
gtaaactgctaaagagcagttt

SEQ ID NO: 682615 - DNA, 22 bp, Artificial Sequence
  chemically synthesized
tgtaaactgctaaagagcagtt

SEQ ID NO: 682616 - DNA, 22 bp, Artificial Sequence
  chemically synthesized
ttgtaaactgctaaagagcagt

SEQ ID NO: 682617 - DNA, 22 bp, Artificial Sequence
  chemically synthesized
ctcttctgtaaactgctcttta

SEQ ID NO: 682618 - DNA, 22 bp, Artificial Sequence
  chemically synthesized
ttctgtaaactgctctttagca

SEQ ID NO: 682619 - DNA, 22 bp, Artificial Sequence
  chemically synthesized
ctgtaaactgctctttagcagt

SEQ ID NO: 682620 - DNA, 22 bp, Artificial Sequence
  chemically synthesized
tgtaaactgctctttagcagtt

SEQ ID NO: 682621 - DNA, 22 bp, Artificial Sequence
  chemically synthesized
taaactgctctttagcagttta

SEQ ID NO: 682622 - DNA, 22 bp, Artificial Sequence
  chemically synthesized
ctctttagcagtttacaaaagg

SEQ ID NO: 682623 - DNA, 22 bp, Artificial Sequence
  chemically synthesized
tttagcagtttacaaaaggcac

SEQ ID NO: 682624 - DNA, 22 bp, Artificial Sequence
  chemically synthesized
tagcagtttacaaaaggcacct

SEQ ID NO: 682625 - DNA, 22 bp, Artificial Sequence
  chemically synthesized
agcagtttacaaaaggcacctt

SEQ ID NO: 682626 - DNA, 22 bp, Artificial Sequence
  chemically synthesized
gcagtttacaaaaggcaccttt

SEQ ID NO: 682627 - DNA, 22 bp, Artificial Sequence
  chemically synthesized
acaaaaggcacctttcctcttt

SEQ ID NO: 682628 - DNA, 22 bp, Artificial Sequence
  chemically synthesized
caaaaggcacctttcctctttt

SEQ ID NO: 682629 - DNA, 22 bp, Artificial Sequence
  chemically synthesized
agtgtaaaaagcaaaaagagga

SEQ ID NO: 682630 - DNA, 22 bp, Artificial Sequence
  chemically synthesized
aagtgtaaaaagcaaaaagagg

SEQ ID NO: 682631 - DNA, 22 bp, Artificial Sequence
  chemically synthesized
ttaagtgtaaaaagcaaaaaga

SEQ ID NO: 682632 - DNA, 22 bp, Artificial Sequence
  chemically synthesized
cttaagtgtaaaaagcaaaaag

SEQ ID NO: 682633 - DNA, 22 bp, Artificial Sequence
  chemically synthesized
cttcttaagtgtaaaaagcaaa

SEQ ID NO: 682634 - DNA, 22 bp, Artificial Sequence
  chemically synthesized
ccttcttaagtgtaaaaagcaa

SEQ ID NO: 682635 - DNA, 22 bp, Artificial Sequence
  chemically synthesized
cttccttcttaagtgtaaaaag

SEQ ID NO: 682636 - DNA, 22 bp, Artificial Sequence
  chemically synthesized
tcctctttttgctttttacact

SEQ ID NO: 682637 - DNA, 22 bp, Artificial Sequence
  chemically synthesized
gcttccttcttaagtgtaaaaa

SEQ ID NO: 682638 - DNA, 22 bp, Artificial Sequence
  chemically synthesized
cctctttttgctttttacactt

SEQ ID NO: 682639 - DNA, 22 bp, Artificial Sequence
  chemically synthesized
ctctttttgctttttacactta

SEQ ID NO: 682640 - DNA, 22 bp, Artificial Sequence
  chemically synthesized
cttgcttccttcttaagtgtaa

SEQ ID NO: 682641 - DNA, 22 bp, Artificial Sequence
  chemically synthesized
tttttgctttttacacttaaga

SEQ ID NO: 682642 - DNA, 22 bp, Artificial Sequence
  chemically synthesized
ctacttgcttccttcttaagtg

SEQ ID NO: 682643 - DNA, 22 bp, Artificial Sequence
  chemically synthesized
tttgctttttacacttaagaag

SEQ ID NO: 682644 - DNA, 22 bp, Artificial Sequence
  chemically synthesized
cctacttgcttccttcttaagt

SEQ ID NO: 682645 - DNA, 22 bp, Artificial Sequence
  chemically synthesized
ttgctttttacacttaagaagg

SEQ ID NO: 682646 - DNA, 22 bp, Artificial Sequence
  chemically synthesized
tcctacttgcttccttcttaag

SEQ ID NO: 682647 - DNA, 22 bp, Artificial Sequence
  chemically synthesized
tgctttttacacttaagaagga

SEQ ID NO: 682648 - DNA, 22 bp, Artificial Sequence
  chemically synthesized
ttcctacttgcttccttcttaa

SEQ ID NO: 682649 - DNA, 22 bp, Artificial Sequence
  chemically synthesized
gctttttacacttaagaaggaa

SEQ ID NO: 682650 - DNA, 22 bp, Artificial Sequence
  chemically synthesized
ctttttacacttaagaaggaag

SEQ ID NO: 682651 - DNA, 22 bp, Artificial Sequence
  chemically synthesized
cttttcctacttgcttccttct

SEQ ID NO: 682652 - DNA, 22 bp, Artificial Sequence
  chemically synthesized
acttttcctacttgcttccttc

SEQ ID NO: 682653 - DNA, 22 bp, Artificial Sequence
  chemically synthesized
tttacacttaagaaggaagcaa

SEQ ID NO: 682654 - DNA, 22 bp, Artificial Sequence
  chemically synthesized
ttacacttaagaaggaagcaag

SEQ ID NO: 682655 - DNA, 22 bp, Artificial Sequence
  chemically synthesized
tacacttaagaaggaagcaagt

SEQ ID NO: 682656 - DNA, 22 bp, Artificial Sequence
  chemically synthesized
acacttaagaaggaagcaagta

SEQ ID NO: 682657 - DNA, 22 bp, Artificial Sequence
  chemically synthesized
cacttaagaaggaagcaagtag

SEQ ID NO: 682658 - DNA, 22 bp, Artificial Sequence
  chemically synthesized
aagaaggaagcaagtaggaaaa

SEQ ID NO: 682659 - DNA, 22 bp, Artificial Sequence
  chemically synthesized
agaaggaagcaagtaggaaaag

SEQ ID NO: 682660 - DNA, 22 bp, Artificial Sequence
  chemically synthesized
cacacacacaaaaaaaatctta

SEQ ID NO: 682661 - DNA, 22 bp, Artificial Sequence
  chemically synthesized
gcacacacacaaaaaaaatctt

SEQ ID NO: 682662 - DNA, 22 bp, Artificial Sequence
  chemically synthesized
tcttgcacacacacaaaaaaaa

SEQ ID NO: 682663 - DNA, 22 bp, Artificial Sequence
  chemically synthesized
atcttgcacacacacaaaaaaa

SEQ ID NO: 682664 - DNA, 22 bp, Artificial Sequence
  chemically synthesized
gtgccttatcttgcacacacac

SEQ ID NO: 682665 - DNA, 22 bp, Artificial Sequence
  chemically synthesized
cagctagtgccttatcttgcac

SEQ ID NO: 682666 - DNA, 22 bp, Artificial Sequence
  chemically synthesized
tttttgtgtgtgtgcaagataa

SEQ ID NO: 682667 - DNA, 22 bp, Artificial Sequence
  chemically synthesized
ttttgtgtgtgtgcaagataag

SEQ ID NO: 682668 - DNA, 22 bp, Artificial Sequence
  chemically synthesized
tttgtgtgtgtgcaagataagg

SEQ ID NO: 682669 - DNA, 22 bp, Artificial Sequence
  chemically synthesized
ttgtgtgtgtgcaagataaggc

SEQ ID NO: 682670 - DNA, 22 bp, Artificial Sequence
  chemically synthesized
tgtgtgtgtgcaagataaggca

SEQ ID NO: 682671 - DNA, 22 bp, Artificial Sequence
  chemically synthesized
gtgtgtgtgcaagataaggcac

SEQ ID NO: 682672 - DNA, 22 bp, Artificial Sequence
  chemically synthesized
aggctacagctagtgccttatc

SEQ ID NO: 682673 - DNA, 22 bp, Artificial Sequence
  chemically synthesized
tgtgtgtgcaagataaggcact

SEQ ID NO: 682674 - DNA, 22 bp, Artificial Sequence
  chemically synthesized
tctcaggctacagctagtgcct

SEQ ID NO: 682675 - DNA, 22 bp, Artificial Sequence
  chemically synthesized
tgcctatctcaggctacagcta

SEQ ID NO: 682676 - DNA, 22 bp, Artificial Sequence
  chemically synthesized
atgcctatctcaggctacagct

SEQ ID NO: 682677 - DNA, 22 bp, Artificial Sequence
  chemically synthesized
tatgcctatctcaggctacagc

SEQ ID NO: 682678 - DNA, 22 bp, Artificial Sequence
  chemically synthesized
tgaattttatgcctatctcagg

SEQ ID NO: 682679 - DNA, 22 bp, Artificial Sequence
  chemically synthesized
gctgtagcctgagataggcata

SEQ ID NO: 682680 - DNA, 22 bp, Artificial Sequence
  chemically synthesized
tagcctgagataggcataaaat

SEQ ID NO: 682681 - DNA, 22 bp, Artificial Sequence
  chemically synthesized
agataggcataaaattcacagc

SEQ ID NO: 682682 - DNA, 22 bp, Artificial Sequence
  chemically synthesized
aatgatagcaaacgctgtgaat

SEQ ID NO: 682683 - DNA, 22 bp, Artificial Sequence
  chemically synthesized
ggccccactgaatgatagcaaa

SEQ ID NO: 682684 - DNA, 22 bp, Artificial Sequence
  chemically synthesized
atctcggccccactgaatgata

SEQ ID NO: 682685 - DNA, 22 bp, Artificial Sequence
  chemically synthesized
acagcgtttgctatcattcagt

SEQ ID NO: 682686 - DNA, 22 bp, Artificial Sequence
  chemically synthesized
aatctcggccccactgaatgat

SEQ ID NO: 682687 - DNA, 22 bp, Artificial Sequence
  chemically synthesized
taatctcggccccactgaatga

SEQ ID NO: 682688 - DNA, 22 bp, Artificial Sequence
  chemically synthesized
atattttaatctcggccccact

SEQ ID NO: 682689 - DNA, 22 bp, Artificial Sequence
  chemically synthesized
gctatcattcagtggggccgag

SEQ ID NO: 682690 - DNA, 22 bp, Artificial Sequence
  chemically synthesized
ctatcattcagtggggccgaga

SEQ ID NO: 682691 - DNA, 22 bp, Artificial Sequence
  chemically synthesized
ttcatattttaatctcggcccc

SEQ ID NO: 682692 - DNA, 22 bp, Artificial Sequence
  chemically synthesized
tcattcagtggggccgagatta

SEQ ID NO: 682693 - DNA, 22 bp, Artificial Sequence
  chemically synthesized
agtggggccgagattaaaatat

SEQ ID NO: 682694 - DNA, 22 bp, Artificial Sequence
  chemically synthesized
acatgcgtgaatactattcata

SEQ ID NO: 682695 - DNA, 22 bp, Artificial Sequence
  chemically synthesized
aacatgcgtgaatactattcat

SEQ ID NO: 682696 - DNA, 22 bp, Artificial Sequence
  chemically synthesized
taacatgcgtgaatactattca

SEQ ID NO: 682697 - DNA, 22 bp, Artificial Sequence
  chemically synthesized
ttaacatgcgtgaatactattc

SEQ ID NO: 682698 - DNA, 22 bp, Artificial Sequence
  chemically synthesized
aaatatgaatagtattcacgca

SEQ ID NO: 682699 - DNA, 22 bp, Artificial Sequence
  chemically synthesized
acgcatgttaaaaggtatatcc

SEQ ID NO: 682700 - DNA, 22 bp, Artificial Sequence
  chemically synthesized
agaatatgaacatggatatacc

SEQ ID NO: 682701 - DNA, 22 bp, Artificial Sequence
  chemically synthesized
tctgagaatatgaacatggata

SEQ ID NO: 682702 - DNA, 22 bp, Artificial Sequence
  chemically synthesized
ctgtctgagaatatgaacatgg

SEQ ID NO: 682703 - DNA, 22 bp, Artificial Sequence
  chemically synthesized
aaaggtatatccatgttcatat

SEQ ID NO: 682704 - DNA, 22 bp, Artificial Sequence
  chemically synthesized
tgctgtctgagaatatgaacat

SEQ ID NO: 682705 - DNA, 22 bp, Artificial Sequence
  chemically synthesized
ctgctgtctgagaatatgaaca

SEQ ID NO: 682706 - DNA, 22 bp, Artificial Sequence
  chemically synthesized
caggtttctgctgtctgagaat

SEQ ID NO: 682707 - DNA, 22 bp, Artificial Sequence
  chemically synthesized
ctccaggtttctgctgtctgag

SEQ ID NO: 682708 - DNA, 22 bp, Artificial Sequence
  chemically synthesized
actactccaggtttctgctgtc

SEQ ID NO: 682709 - DNA, 22 bp, Artificial Sequence
  chemically synthesized
tgactactccaggtttctgctg

SEQ ID NO: 682710 - DNA, 22 bp, Artificial Sequence
  chemically synthesized
atattctcagacagcagaaacc

SEQ ID NO: 682711 - DNA, 22 bp, Artificial Sequence
  chemically synthesized
tctgactactccaggtttctgc

SEQ ID NO: 682712 - DNA, 22 bp, Artificial Sequence
  chemically synthesized
ctctctgactactccaggtttc

SEQ ID NO: 682713 - DNA, 22 bp, Artificial Sequence
  chemically synthesized
gctctctgactactccaggttt

SEQ ID NO: 682714 - DNA, 22 bp, Artificial Sequence
  chemically synthesized
tcagacagcagaaacctggagt

SEQ ID NO: 682715 - DNA, 22 bp, Artificial Sequence
  chemically synthesized
agacagcagaaacctggagtag

SEQ ID NO: 682716 - DNA, 22 bp, Artificial Sequence
  chemically synthesized
acttgctctctgactactccag

SEQ ID NO: 682717 - DNA, 22 bp, Artificial Sequence
  chemically synthesized
gagtagtcagagagcaagtgaa

SEQ ID NO: 682718 - DNA, 22 bp, Artificial Sequence
  chemically synthesized
tcccccaccaaatcaatattca

SEQ ID NO: 682719 - DNA, 22 bp, Artificial Sequence
  chemically synthesized
actgtcccccaccaaatcaata

SEQ ID NO: 682720 - DNA, 22 bp, Artificial Sequence
  chemically synthesized
cctcactgtcccccaccaaatc

SEQ ID NO: 682721 - DNA, 22 bp, Artificial Sequence
  chemically synthesized
tccctcactgtcccccaccaaa

SEQ ID NO: 682722 - DNA, 22 bp, Artificial Sequence
  chemically synthesized
ctccctcactgtcccccaccaa

SEQ ID NO: 682723 - DNA, 22 bp, Artificial Sequence
  chemically synthesized
atttggtgggggacagtgaggg

SEQ ID NO: 682724 - DNA, 22 bp, Artificial Sequence
  chemically synthesized
ggggatatttctccctcactgt

SEQ ID NO: 682725 - DNA, 22 bp, Artificial Sequence
  chemically synthesized
ggtgggggacagtgagggagaa

SEQ ID NO: 682726 - DNA, 22 bp, Artificial Sequence
  chemically synthesized
gtgggggacagtgagggagaaa

SEQ ID NO: 682727 - DNA, 22 bp, Artificial Sequence
  chemically synthesized
catcaagctaggggatatttct

SEQ ID NO: 682728 - DNA, 22 bp, Artificial Sequence
  chemically synthesized
tccatcaagctaggggatattt

SEQ ID NO: 682729 - DNA, 22 bp, Artificial Sequence
  chemically synthesized
ctccatcaagctaggggatatt

SEQ ID NO: 682730 - DNA, 22 bp, Artificial Sequence
  chemically synthesized
tctccatcaagctaggggatat

SEQ ID NO: 682731 - DNA, 22 bp, Artificial Sequence
  chemically synthesized
ccaccaggagactttctccatc

SEQ ID NO: 682732 - DNA, 22 bp, Artificial Sequence
  chemically synthesized
gccaccaggagactttctccat

SEQ ID NO: 682733 - DNA, 22 bp, Artificial Sequence
  chemically synthesized
gcttgatggagaaagtctcctg

SEQ ID NO: 682734 - DNA, 22 bp, Artificial Sequence
  chemically synthesized
aaggcttgccaccaggagactt

SEQ ID NO: 682735 - DNA, 22 bp, Artificial Sequence
  chemically synthesized
ttcaaggcttgccaccaggaga

SEQ ID NO: 682736 - DNA, 22 bp, Artificial Sequence
  chemically synthesized
gatggagaaagtctcctggtgg

SEQ ID NO: 682737 - DNA, 22 bp, Artificial Sequence
  chemically synthesized
atggagaaagtctcctggtggc

SEQ ID NO: 682738 - DNA, 22 bp, Artificial Sequence
  chemically synthesized
gctgttcaaggcttgccaccag

SEQ ID NO: 682739 - DNA, 22 bp, Artificial Sequence
  chemically synthesized
ctggctgttcaaggcttgccac

SEQ ID NO: 682740 - DNA, 22 bp, Artificial Sequence
  chemically synthesized
gctggctgttcaaggcttgcca

SEQ ID NO: 682741 - DNA, 22 bp, Artificial Sequence
  chemically synthesized
ccacttgctggctgttcaaggc

SEQ ID NO: 682742 - DNA, 22 bp, Artificial Sequence
  chemically synthesized
ctggtggcaagccttgaacagc

SEQ ID NO: 682743 - DNA, 22 bp, Artificial Sequence
  chemically synthesized
ctgccacttgctggctgttcaa

SEQ ID NO: 682744 - DNA, 22 bp, Artificial Sequence
  chemically synthesized
gtggcaagccttgaacagccag

SEQ ID NO: 682745 - DNA, 22 bp, Artificial Sequence
  chemically synthesized
tgtggaattcctgccacttgct

SEQ ID NO: 682746 - DNA, 22 bp, Artificial Sequence
  chemically synthesized
gtgtggaattcctgccacttgc

SEQ ID NO: 682747 - DNA, 22 bp, Artificial Sequence
  chemically synthesized
tgtgtggaattcctgccacttg

SEQ ID NO: 682748 - DNA, 22 bp, Artificial Sequence
  chemically synthesized
gaacagccagcaagtggcagga

SEQ ID NO: 682749 - DNA, 22 bp, Artificial Sequence
  chemically synthesized
aacagccagcaagtggcaggaa

SEQ ID NO: 682750 - DNA, 22 bp, Artificial Sequence
  chemically synthesized
tctttgtgtggaattcctgcca

SEQ ID NO: 682751 - DNA, 22 bp, Artificial Sequence
  chemically synthesized
tggatccctgtctttgtgtgga

SEQ ID NO: 682752 - DNA, 22 bp, Artificial Sequence
  chemically synthesized
atggatccctgtctttgtgtgg

SEQ ID NO: 682753 - DNA, 22 bp, Artificial Sequence
  chemically synthesized
tatggatccctgtctttgtgtg

SEQ ID NO: 682754 - DNA, 22 bp, Artificial Sequence
  chemically synthesized
ttatggatccctgtctttgtgt

SEQ ID NO: 682755 - DNA, 22 bp, Artificial Sequence
  chemically synthesized
cccttttatggatccctgtctt

SEQ ID NO: 682756 - DNA, 22 bp, Artificial Sequence
  chemically synthesized
ccccttttatggatccctgtct

SEQ ID NO: 682757 - DNA, 22 bp, Artificial Sequence
  chemically synthesized
tttccccttttatggatccctg

SEQ ID NO: 682758 - DNA, 22 bp, Artificial Sequence
  chemically synthesized
atttccccttttatggatccct

SEQ ID NO: 682759 - DNA, 22 bp, Artificial Sequence
  chemically synthesized
cacacaaagacagggatccata

SEQ ID NO: 682760 - DNA, 22 bp, Artificial Sequence
  chemically synthesized
tcttatttccccttttatggat

SEQ ID NO: 682761 - DNA, 22 bp, Artificial Sequence
  chemically synthesized
atcttatttccccttttatgga

SEQ ID NO: 682762 - DNA, 22 bp, Artificial Sequence
  chemically synthesized
tatcttatttccccttttatgg

SEQ ID NO: 682763 - DNA, 22 bp, Artificial Sequence
  chemically synthesized
gattttatcttatttccccttt

SEQ ID NO: 682764 - DNA, 22 bp, Artificial Sequence
  chemically synthesized
aactggattttatcttatttcc

SEQ ID NO: 682765 - DNA, 22 bp, Artificial Sequence
  chemically synthesized
gttaaactggattttatcttat

SEQ ID NO: 682766 - DNA, 22 bp, Artificial Sequence
  chemically synthesized
attggttaaactggattttatc

SEQ ID NO: 682767 - DNA, 22 bp, Artificial Sequence
  chemically synthesized
gtagatcattaattggttaaac

SEQ ID NO: 682768 - DNA, 22 bp, Artificial Sequence
  chemically synthesized
agacattggtagatcattaatt

SEQ ID NO: 682769 - DNA, 22 bp, Artificial Sequence
  chemically synthesized
aaccaattaatgatctaccaat

SEQ ID NO: 682770 - DNA, 22 bp, Artificial Sequence
  chemically synthesized
accaattaatgatctaccaatg

SEQ ID NO: 682771 - DNA, 22 bp, Artificial Sequence
  chemically synthesized
gagtacaagattcagacattgg

SEQ ID NO: 682772 - DNA, 22 bp, Artificial Sequence
  chemically synthesized
atgatctaccaatgtctgaatc

SEQ ID NO: 682773 - DNA, 22 bp, Artificial Sequence
  chemically synthesized
ccaatgtctgaatcttgtactc

SEQ ID NO: 682774 - DNA, 22 bp, Artificial Sequence
  chemically synthesized
acaaaagtaagccagagctgga

SEQ ID NO: 682775 - DNA, 22 bp, Artificial Sequence
  chemically synthesized
gacaaaagtaagccagagctgg

SEQ ID NO: 682776 - DNA, 22 bp, Artificial Sequence
  chemically synthesized
aatcttgtactccagctctggc

SEQ ID NO: 682777 - DNA, 22 bp, Artificial Sequence
  chemically synthesized
gtactccagctctggcttactt

SEQ ID NO: 682778 - DNA, 22 bp, Artificial Sequence
  chemically synthesized
tactccagctctggcttacttt

SEQ ID NO: 682779 - DNA, 22 bp, Artificial Sequence
  chemically synthesized
aaaacatgccttgacaaaagta

SEQ ID NO: 682780 - DNA, 22 bp, Artificial Sequence
  chemically synthesized
cagctctggcttacttttgtca

SEQ ID NO: 682781 - DNA, 22 bp, Artificial Sequence
  chemically synthesized
gaaaacatgccttgacaaaagt

SEQ ID NO: 682782 - DNA, 22 bp, Artificial Sequence
  chemically synthesized
atcttgaaaacatgccttgaca

SEQ ID NO: 682783 - DNA, 22 bp, Artificial Sequence
  chemically synthesized
tggcttacttttgtcaaggcat

SEQ ID NO: 682784 - DNA, 22 bp, Artificial Sequence
  chemically synthesized
catcttgaaaacatgccttgac

SEQ ID NO: 682785 - DNA, 22 bp, Artificial Sequence
  chemically synthesized
tcatcttgaaaacatgccttga

SEQ ID NO: 682786 - DNA, 22 bp, Artificial Sequence
  chemically synthesized
gcttacttttgtcaaggcatgt

SEQ ID NO: 682787 - DNA, 22 bp, Artificial Sequence
  chemically synthesized
ctttcatcttgaaaacatgcct

SEQ ID NO: 682788 - DNA, 22 bp, Artificial Sequence
  chemically synthesized
cctttcatcttgaaaacatgcc

SEQ ID NO: 682789 - DNA, 22 bp, Artificial Sequence
  chemically synthesized
acttttgtcaaggcatgttttc

SEQ ID NO: 682790 - DNA, 22 bp, Artificial Sequence
  chemically synthesized
tcctttcatcttgaaaacatgc

SEQ ID NO: 682791 - DNA, 22 bp, Artificial Sequence
  chemically synthesized
cttttgtcaaggcatgttttca

SEQ ID NO: 682792 - DNA, 22 bp, Artificial Sequence
  chemically synthesized
ttgtcaaggcatgttttcaaga

SEQ ID NO: 682793 - DNA, 22 bp, Artificial Sequence
  chemically synthesized
tgtcaaggcatgttttcaagat

SEQ ID NO: 682794 - DNA, 22 bp, Artificial Sequence
  chemically synthesized
tattttcctttcatcttgaaaa

SEQ ID NO: 682795 - DNA, 22 bp, Artificial Sequence
  chemically synthesized
gtcaaggcatgttttcaagatg

SEQ ID NO: 682796 - DNA, 22 bp, Artificial Sequence
  chemically synthesized
tcaaggcatgttttcaagatga

SEQ ID NO: 682797 - DNA, 22 bp, Artificial Sequence
  chemically synthesized
catctgtattttcctttcatct

SEQ ID NO: 682798 - DNA, 22 bp, Artificial Sequence
  chemically synthesized
gcatctgtattttcctttcatc

SEQ ID NO: 682799 - DNA, 22 bp, Artificial Sequence
  chemically synthesized
cttgcatctgtattttcctttc

SEQ ID NO: 682800 - DNA, 22 bp, Artificial Sequence
  chemically synthesized
tcaagatgaaaggaaaatacag

SEQ ID NO: 682801 - DNA, 22 bp, Artificial Sequence
  chemically synthesized
caagatgaaaggaaaatacaga

SEQ ID NO: 682802 - DNA, 22 bp, Artificial Sequence
  chemically synthesized
aagatgaaaggaaaatacagat

SEQ ID NO: 682803 - DNA, 22 bp, Artificial Sequence
  chemically synthesized
tggataaataaaagttccttgc

SEQ ID NO: 682804 - DNA, 22 bp, Artificial Sequence
  chemically synthesized
gtggataaataaaagttccttg

SEQ ID NO: 682805 - DNA, 22 bp, Artificial Sequence
  chemically synthesized
gaaatttgtggataaataaaag

SEQ ID NO: 682806 - DNA, 22 bp, Artificial Sequence
  chemically synthesized
ggaaatttgtggataaataaaa

SEQ ID NO: 682807 - DNA, 22 bp, Artificial Sequence
  chemically synthesized
ttggaaatttgtggataaataa

SEQ ID NO: 682808 - DNA, 22 bp, Artificial Sequence
  chemically synthesized
ttatttatccacaaatttccaa

SEQ ID NO: 682809 - DNA, 22 bp, Artificial Sequence
  chemically synthesized
tatttatccacaaatttccaag

SEQ ID NO: 682810 - DNA, 22 bp, Artificial Sequence
  chemically synthesized
atttatccacaaatttccaaga

SEQ ID NO: 682811 - DNA, 22 bp, Artificial Sequence
  chemically synthesized
tttatccacaaatttccaagaa

SEQ ID NO: 682812 - DNA, 22 bp, Artificial Sequence
  chemically synthesized
atccacaaatttccaagaatgt

SEQ ID NO: 682813 - DNA, 22 bp, Artificial Sequence
  chemically synthesized
tccacaaatttccaagaatgtt

SEQ ID NO: 682814 - DNA, 22 bp, Artificial Sequence
  chemically synthesized
gatagagcacataaaaaacatt

SEQ ID NO: 682815 - DNA, 22 bp, Artificial Sequence
  chemically synthesized
gtctagatagagcacataaaaa

SEQ ID NO: 682816 - DNA, 22 bp, Artificial Sequence
  chemically synthesized
agtctagatagagcacataaaa

SEQ ID NO: 682817 - DNA, 22 bp, Artificial Sequence
  chemically synthesized
ccaagaatgttttttatgtgct

SEQ ID NO: 682818 - DNA, 22 bp, Artificial Sequence
  chemically synthesized
caagaatgttttttatgtgctc

SEQ ID NO: 682819 - DNA, 22 bp, Artificial Sequence
  chemically synthesized
atagagaaacttagtctagata

SEQ ID NO: 682820 - DNA, 22 bp, Artificial Sequence
  chemically synthesized
tttatgtgctctatctagacta

SEQ ID NO: 682821 - DNA, 22 bp, Artificial Sequence
  chemically synthesized
aatagagaaacttagtctagat

SEQ ID NO: 682822 - DNA, 22 bp, Artificial Sequence
  chemically synthesized
ttatgtgctctatctagactaa

SEQ ID NO: 682823 - DNA, 22 bp, Artificial Sequence
  chemically synthesized
tatgtgctctatctagactaag

SEQ ID NO: 682824 - DNA, 22 bp, Artificial Sequence
  chemically synthesized
atgtgctctatctagactaagt

SEQ ID NO: 682825 - DNA, 22 bp, Artificial Sequence
  chemically synthesized
tgtgctctatctagactaagtt

SEQ ID NO: 682826 - DNA, 22 bp, Artificial Sequence
  chemically synthesized
tatctagactaagtttctctat

SEQ ID NO: 682827 - DNA, 22 bp, Artificial Sequence
  chemically synthesized
tctagactaagtttctctatta

SEQ ID NO: 682828 - DNA, 22 bp, Artificial Sequence
  chemically synthesized
atataggataatatttaataga

SEQ ID NO: 682829 - DNA, 22 bp, Artificial Sequence
  chemically synthesized
gactaagtttctctattaaata

SEQ ID NO: 682830 - DNA, 22 bp, Artificial Sequence
  chemically synthesized
aatataggataatatttaatag

SEQ ID NO: 682831 - DNA, 22 bp, Artificial Sequence
  chemically synthesized
agtttctctattaaatattatc

SEQ ID NO: 682832 - DNA, 22 bp, Artificial Sequence
  chemically synthesized
aagaacttaatataggataata

SEQ ID NO: 682833 - DNA, 22 bp, Artificial Sequence
  chemically synthesized
aaagaacttaatataggataat

SEQ ID NO: 682834 - DNA, 22 bp, Artificial Sequence
  chemically synthesized
ctctattaaatattatcctata

SEQ ID NO: 682835 - DNA, 22 bp, Artificial Sequence
  chemically synthesized
tctattaaatattatcctatat

SEQ ID NO: 682836 - DNA, 22 bp, Artificial Sequence
  chemically synthesized
tttaaagaacttaatataggat

SEQ ID NO: 682837 - DNA, 22 bp, Artificial Sequence
  chemically synthesized
tattaaatattatcctatatta

SEQ ID NO: 682838 - DNA, 22 bp, Artificial Sequence
  chemically synthesized
ttaaatattatcctatattaag

SEQ ID NO: 682839 - DNA, 22 bp, Artificial Sequence
  chemically synthesized
aatattatcctatattaagttc

SEQ ID NO: 682840 - DNA, 22 bp, Artificial Sequence
  chemically synthesized
aagttatttaaagaacttaata

SEQ ID NO: 682841 - DNA, 22 bp, Artificial Sequence
  chemically synthesized
gaagttatttaaagaacttaat

SEQ ID NO: 682842 - DNA, 22 bp, Artificial Sequence
  chemically synthesized
tgtttgaagttatttaaagaac

SEQ ID NO: 682843 - DNA, 22 bp, Artificial Sequence
  chemically synthesized
tcctatattaagttctttaaat

SEQ ID NO: 682844 - DNA, 22 bp, Artificial Sequence
  chemically synthesized
tattaagttctttaaataactt

SEQ ID NO: 682845 - DNA, 22 bp, Artificial Sequence
  chemically synthesized
agttctttaaataacttcaaac

SEQ ID NO: 682846 - DNA, 22 bp, Artificial Sequence
  chemically synthesized
cataaatacactatgtttgaag

SEQ ID NO: 682847 - DNA, 22 bp, Artificial Sequence
  chemically synthesized
tttaaataacttcaaacatagt

SEQ ID NO: 682848 - DNA, 22 bp, Artificial Sequence
  chemically synthesized
taaataacttcaaacatagtgt

SEQ ID NO: 682849 - DNA, 22 bp, Artificial Sequence
  chemically synthesized
aaataacttcaaacatagtgta

SEQ ID NO: 682850 - DNA, 22 bp, Artificial Sequence
  chemically synthesized
aataacttcaaacatagtgtat

SEQ ID NO: 682851 - DNA, 22 bp, Artificial Sequence
  chemically synthesized
caaacatagtgtatttatggaa

SEQ ID NO: 682852 - DNA, 22 bp, Artificial Sequence
  chemically synthesized
aaacatagtgtatttatggaac

SEQ ID NO: 682853 - DNA, 22 bp, Artificial Sequence
  chemically synthesized
aatgataagcaaatacatatgt

SEQ ID NO: 682854 - DNA, 22 bp, Artificial Sequence
  chemically synthesized
atggaacacttacatatgtatt

SEQ ID NO: 682855 - DNA, 22 bp, Artificial Sequence
  chemically synthesized
aaatgataagcaaatacatatg

SEQ ID NO: 682856 - DNA, 22 bp, Artificial Sequence
  chemically synthesized
tggaacacttacatatgtattt

SEQ ID NO: 682857 - DNA, 22 bp, Artificial Sequence
  chemically synthesized
acatatgtatttgcttatcatt

SEQ ID NO: 682858 - DNA, 22 bp, Artificial Sequence
  chemically synthesized
catatgtatttgcttatcattt

SEQ ID NO: 682859 - DNA, 22 bp, Artificial Sequence
  chemically synthesized
gcttatcatttaaactcttctc

SEQ ID NO: 682860 - DNA, 22 bp, Artificial Sequence
  chemically synthesized
cttatcatttaaactcttctca

SEQ ID NO: 682861 - DNA, 22 bp, Artificial Sequence
  chemically synthesized
atcatttaaactcttctcattt

SEQ ID NO: 682862 - DNA, 22 bp, Artificial Sequence
  chemically synthesized
tcatttaaactcttctcatttt

SEQ ID NO: 682863 - DNA, 22 bp, Artificial Sequence
  chemically synthesized
ccaaccataaagaaaaaatgag

SEQ ID NO: 682864 - DNA, 22 bp, Artificial Sequence
  chemically synthesized
accaaccataaagaaaaaatga

SEQ ID NO: 682865 - DNA, 22 bp, Artificial Sequence
  chemically synthesized
taccaaccataaagaaaaaatg

SEQ ID NO: 682866 - DNA, 22 bp, Artificial Sequence
  chemically synthesized
ttaccaaccataaagaaaaaat

SEQ ID NO: 682867 - DNA, 22 bp, Artificial Sequence
  chemically synthesized
aaactcttctcattttttcttt

SEQ ID NO: 682868 - DNA, 22 bp, Artificial Sequence
  chemically synthesized
aactcttctcattttttcttta

SEQ ID NO: 682869 - DNA, 22 bp, Artificial Sequence
  chemically synthesized
ttctcattttttctttatggtt

SEQ ID NO: 682870 - DNA, 22 bp, Artificial Sequence
  chemically synthesized
cccagtttttaccaaccataaa

SEQ ID NO: 682871 - DNA, 22 bp, Artificial Sequence
  chemically synthesized
ctcattttttctttatggttgg

SEQ ID NO: 682872 - DNA, 22 bp, Artificial Sequence
  chemically synthesized
tcattttttctttatggttggt

SEQ ID NO: 682873 - DNA, 22 bp, Artificial Sequence
  chemically synthesized
attttttctttatggttggtaa

SEQ ID NO: 682874 - DNA, 22 bp, Artificial Sequence
  chemically synthesized
tttctttatggttggtaaaaac

SEQ ID NO: 682875 - DNA, 22 bp, Artificial Sequence
  chemically synthesized
ttctttatggttggtaaaaact

SEQ ID NO: 682876 - DNA, 22 bp, Artificial Sequence
  chemically synthesized
caaacactccccagtttttacc

SEQ ID NO: 682877 - DNA, 22 bp, Artificial Sequence
  chemically synthesized
tctttatggttggtaaaaactg

SEQ ID NO: 682878 - DNA, 22 bp, Artificial Sequence
  chemically synthesized
ctttatggttggtaaaaactgg

SEQ ID NO: 682879 - DNA, 22 bp, Artificial Sequence
  chemically synthesized
tccaaacactccccagttttta

SEQ ID NO: 682880 - DNA, 22 bp, Artificial Sequence
  chemically synthesized
tttatggttggtaaaaactggg

SEQ ID NO: 682881 - DNA, 22 bp, Artificial Sequence
  chemically synthesized
tatggttggtaaaaactgggga

SEQ ID NO: 682882 - DNA, 22 bp, Artificial Sequence
  chemically synthesized
atggttggtaaaaactggggag

SEQ ID NO: 682883 - DNA, 22 bp, Artificial Sequence
  chemically synthesized
tggttggtaaaaactggggagt

SEQ ID NO: 682884 - DNA, 22 bp, Artificial Sequence
  chemically synthesized
catgtcattctccaaacactcc

SEQ ID NO: 682885 - DNA, 22 bp, Artificial Sequence
  chemically synthesized
gtaaaaactggggagtgtttgg

SEQ ID NO: 682886 - DNA, 22 bp, Artificial Sequence
  chemically synthesized
ccatgtcattctccaaacactc

SEQ ID NO: 682887 - DNA, 22 bp, Artificial Sequence
  chemically synthesized
tatatttccatgtcattctcca

SEQ ID NO: 682888 - DNA, 22 bp, Artificial Sequence
  chemically synthesized
atatatttccatgtcattctcc

SEQ ID NO: 682889 - DNA, 22 bp, Artificial Sequence
  chemically synthesized
tatatatttccatgtcattctc

SEQ ID NO: 682890 - DNA, 22 bp, Artificial Sequence
  chemically synthesized
gggagtgtttggagaatgacat

SEQ ID NO: 682891 - DNA, 22 bp, Artificial Sequence
  chemically synthesized
ttatatatttccatgtcattct

SEQ ID NO: 682892 - DNA, 22 bp, Artificial Sequence
  chemically synthesized
aaatttttatatatttccatgt

SEQ ID NO: 682893 - DNA, 22 bp, Artificial Sequence
  chemically synthesized
ggagaatgacatggaaatatat

SEQ ID NO: 682894 - DNA, 22 bp, Artificial Sequence
  chemically synthesized
gagaatgacatggaaatatata

SEQ ID NO: 682895 - DNA, 22 bp, Artificial Sequence
  chemically synthesized
caatgttgaaatttttatatat

SEQ ID NO: 682896 - DNA, 22 bp, Artificial Sequence
  chemically synthesized
gattacaatgttgaaattttta

SEQ ID NO: 682897 - DNA, 22 bp, Artificial Sequence
  chemically synthesized
aaaaaaaactggattacaatgt

SEQ ID NO: 682898 - DNA, 22 bp, Artificial Sequence
  chemically synthesized
aaaaaaaaactggattacaatg

SEQ ID NO: 682899 - DNA, 22 bp, Artificial Sequence
  chemically synthesized
caacattgtaatccagtttttt

SEQ ID NO: 682900 - DNA, 22 bp, Artificial Sequence
  chemically synthesized
aacattgtaatccagttttttt

SEQ ID NO: 682901 - DNA, 22 bp, Artificial Sequence
  chemically synthesized
ggatcccacttaaaaaaaaact

SEQ ID NO: 682902 - DNA, 22 bp, Artificial Sequence
  chemically synthesized
gggatcccacttaaaaaaaaac

SEQ ID NO: 682903 - DNA, 22 bp, Artificial Sequence
  chemically synthesized
cttgggatcccacttaaaaaaa

SEQ ID NO: 682904 - DNA, 22 bp, Artificial Sequence
  chemically synthesized
ccttgggatcccacttaaaaaa

SEQ ID NO: 682905 - DNA, 22 bp, Artificial Sequence
  chemically synthesized
taatccagtttttttttaagtg

SEQ ID NO: 682906 - DNA, 22 bp, Artificial Sequence
  chemically synthesized
ttttttaagtgggatcccaagg

SEQ ID NO: 682907 - DNA, 22 bp, Artificial Sequence
  chemically synthesized
tttttaagtgggatcccaagga

SEQ ID NO: 682908 - DNA, 22 bp, Artificial Sequence
  chemically synthesized
ttttaagtgggatcccaaggaa

SEQ ID NO: 682909 - DNA, 22 bp, Artificial Sequence
  chemically synthesized
tttaagtgggatcccaaggaaa

SEQ ID NO: 682910 - DNA, 22 bp, Artificial Sequence
  chemically synthesized
ttaagtgggatcccaaggaaat

SEQ ID NO: 682911 - DNA, 22 bp, Artificial Sequence
  chemically synthesized
taagtgggatcccaaggaaata

SEQ ID NO: 682912 - DNA, 22 bp, Artificial Sequence
  chemically synthesized
aggaaaaggccatatttccttg

SEQ ID NO: 682913 - DNA, 22 bp, Artificial Sequence
  chemically synthesized
aagtgggatcccaaggaaatat

SEQ ID NO: 682914 - DNA, 22 bp, Artificial Sequence
  chemically synthesized
aaggaaaaggccatatttcctt

SEQ ID NO: 682915 - DNA, 22 bp, Artificial Sequence
  chemically synthesized
agtgggatcccaaggaaatatg

SEQ ID NO: 682916 - DNA, 22 bp, Artificial Sequence
  chemically synthesized
cttaaggaaaaggccatatttc

SEQ ID NO: 682917 - DNA, 22 bp, Artificial Sequence
  chemically synthesized
gatcataagctccttaaggaaa

SEQ ID NO: 682918 - DNA, 22 bp, Artificial Sequence
  chemically synthesized
attagatcataagctccttaag

SEQ ID NO: 682919 - DNA, 22 bp, Artificial Sequence
  chemically synthesized
tcattagatcataagctcctta

SEQ ID NO: 682920 - DNA, 22 bp, Artificial Sequence
  chemically synthesized
tctcattagatcataagctcct

SEQ ID NO: 682921 - DNA, 22 bp, Artificial Sequence
  chemically synthesized
ctctcattagatcataagctcc

SEQ ID NO: 682922 - DNA, 22 bp, Artificial Sequence
  chemically synthesized
ttccttaaggagcttatgatct

SEQ ID NO: 682923 - DNA, 22 bp, Artificial Sequence
  chemically synthesized
tcttctctcattagatcataag

SEQ ID NO: 682924 - DNA, 22 bp, Artificial Sequence
  chemically synthesized
tccttaaggagcttatgatcta

SEQ ID NO: 682925 - DNA, 22 bp, Artificial Sequence
  chemically synthesized
ccttaaggagcttatgatctaa

SEQ ID NO: 682926 - DNA, 22 bp, Artificial Sequence
  chemically synthesized
cttaaggagcttatgatctaat

SEQ ID NO: 682927 - DNA, 22 bp, Artificial Sequence
  chemically synthesized
aaggagcttatgatctaatgag

SEQ ID NO: 682928 - DNA, 22 bp, Artificial Sequence
  chemically synthesized
aggagcttatgatctaatgaga

SEQ ID NO: 682929 - DNA, 22 bp, Artificial Sequence
  chemically synthesized
tatatgggtctatcttctctca

SEQ ID NO: 682930 - DNA, 22 bp, Artificial Sequence
  chemically synthesized
atgatctaatgagagaagatag

SEQ ID NO: 682931 - DNA, 22 bp, Artificial Sequence
  chemically synthesized
tgatctaatgagagaagataga

SEQ ID NO: 682932 - DNA, 22 bp, Artificial Sequence
  chemically synthesized
gctatatatgggtctatcttct

SEQ ID NO: 682933 - DNA, 22 bp, Artificial Sequence
  chemically synthesized
agctatatatgggtctatcttc

SEQ ID NO: 682934 - DNA, 22 bp, Artificial Sequence
  chemically synthesized
tgtttagctatatatgggtcta

SEQ ID NO: 682935 - DNA, 22 bp, Artificial Sequence
  chemically synthesized
atgagagaagatagacccatat

SEQ ID NO: 682936 - DNA, 22 bp, Artificial Sequence
  chemically synthesized
atactgtgtttagctatatatg

SEQ ID NO: 682937 - DNA, 22 bp, Artificial Sequence
  chemically synthesized
tctgatactgtgtttagctata

SEQ ID NO: 682938 - DNA, 22 bp, Artificial Sequence
  chemically synthesized
taatctgtctgatactgtgttt

SEQ ID NO: 682939 - DNA, 22 bp, Artificial Sequence
  chemically synthesized
ttataatctgtctgatactgtg

SEQ ID NO: 682940 - DNA, 22 bp, Artificial Sequence
  chemically synthesized
taattattataatctgtctgat

SEQ ID NO: 682941 - DNA, 22 bp, Artificial Sequence
  chemically synthesized
tgtaattattataatctgtctg

SEQ ID NO: 682942 - DNA, 22 bp, Artificial Sequence
  chemically synthesized
ctgtaattattataatctgtct

SEQ ID NO: 682943 - DNA, 22 bp, Artificial Sequence
  chemically synthesized
aacacagtatcagacagattat

SEQ ID NO: 682944 - DNA, 22 bp, Artificial Sequence
  chemically synthesized
tttctgtaattattataatctg

SEQ ID NO: 682945 - DNA, 22 bp, Artificial Sequence
  chemically synthesized
tatttctgtaattattataatc

SEQ ID NO: 682946 - DNA, 22 bp, Artificial Sequence
  chemically synthesized
tctatttctgtaattattataa

SEQ ID NO: 682947 - DNA, 22 bp, Artificial Sequence
  chemically synthesized
tctctatttctgtaattattat

SEQ ID NO: 682948 - DNA, 22 bp, Artificial Sequence
  chemically synthesized
ctctctatttctgtaattatta

SEQ ID NO: 682949 - DNA, 22 bp, Artificial Sequence
  chemically synthesized
tctctctatttctgtaattatt

SEQ ID NO: 682950 - DNA, 22 bp, Artificial Sequence
  chemically synthesized
ttctctctatttctgtaattat

SEQ ID NO: 682951 - DNA, 22 bp, Artificial Sequence
  chemically synthesized
tttctctctatttctgtaatta

SEQ ID NO: 682952 - DNA, 22 bp, Artificial Sequence
  chemically synthesized
ttttctctctatttctgtaatt

SEQ ID NO: 682953 - DNA, 22 bp, Artificial Sequence
  chemically synthesized
tttttctctctatttctgtaat

SEQ ID NO: 682954 - DNA, 22 bp, Artificial Sequence
  chemically synthesized
ctttttttctctctatttctgt

SEQ ID NO: 682955 - DNA, 22 bp, Artificial Sequence
  chemically synthesized
ctgctttttttctctctatttc

SEQ ID NO: 682956 - DNA, 22 bp, Artificial Sequence
  chemically synthesized
taataattacagaaatagagag

SEQ ID NO: 682957 - DNA, 22 bp, Artificial Sequence
  chemically synthesized
gctgctttttttctctctattt

SEQ ID NO: 682958 - DNA, 22 bp, Artificial Sequence
  chemically synthesized
tgctgctttttttctctctatt

SEQ ID NO: 682959 - DNA, 22 bp, Artificial Sequence
  chemically synthesized
ttgctgctttttttctctctat

SEQ ID NO: 682960 - DNA, 22 bp, Artificial Sequence
  chemically synthesized
tttgctgctttttttctctcta

SEQ ID NO: 682961 - DNA, 22 bp, Artificial Sequence
  chemically synthesized
cctttttgctgctttttttctc

SEQ ID NO: 682962 - DNA, 22 bp, Artificial Sequence
  chemically synthesized
ccctttttgctgctttttttct

SEQ ID NO: 682963 - DNA, 22 bp, Artificial Sequence
  chemically synthesized
cagaaatagagagaaaaaaagc

SEQ ID NO: 682964 - DNA, 22 bp, Artificial Sequence
  chemically synthesized
tccctttttgctgctttttttc

SEQ ID NO: 682965 - DNA, 22 bp, Artificial Sequence
  chemically synthesized
atcacctttccctttttgctgc

SEQ ID NO: 682966 - DNA, 22 bp, Artificial Sequence
  chemically synthesized
atcccaagaggccaaactaatc

SEQ ID NO: 682967 - DNA, 22 bp, Artificial Sequence
  chemically synthesized
taatcccaagaggccaaactaa

SEQ ID NO: 682968 - DNA, 22 bp, Artificial Sequence
  chemically synthesized
tctaatcccaagaggccaaact

SEQ ID NO: 682969 - DNA, 22 bp, Artificial Sequence
  chemically synthesized
aagtgcatattctctaatccca

SEQ ID NO: 682970 - DNA, 22 bp, Artificial Sequence
  chemically synthesized
gtttggcctcttgggattagag

SEQ ID NO: 682971 - DNA, 22 bp, Artificial Sequence
  chemically synthesized
attgaagtgcatattctctaat

SEQ ID NO: 682972 - DNA, 22 bp, Artificial Sequence
  chemically synthesized
ggcctcttgggattagagaata

SEQ ID NO: 682973 - DNA, 22 bp, Artificial Sequence
  chemically synthesized
aattgaagtgcatattctctaa

SEQ ID NO: 682974 - DNA, 22 bp, Artificial Sequence
  chemically synthesized
gcctcttgggattagagaatat

SEQ ID NO: 682975 - DNA, 22 bp, Artificial Sequence
  chemically synthesized
taattgaagtgcatattctcta

SEQ ID NO: 682976 - DNA, 22 bp, Artificial Sequence
  chemically synthesized
ttaattgaagtgcatattctct

SEQ ID NO: 682977 - DNA, 22 bp, Artificial Sequence
  chemically synthesized
ttgggattagagaatatgcact

SEQ ID NO: 682978 - DNA, 22 bp, Artificial Sequence
  chemically synthesized
gtttttaattgaagtgcatatt

SEQ ID NO: 682979 - DNA, 22 bp, Artificial Sequence
  chemically synthesized
agtttttaattgaagtgcatat

SEQ ID NO: 682980 - DNA, 22 bp, Artificial Sequence
  chemically synthesized
gggattagagaatatgcacttc

SEQ ID NO: 682981 - DNA, 22 bp, Artificial Sequence
  chemically synthesized
ggattagagaatatgcacttca

SEQ ID NO: 682982 - DNA, 22 bp, Artificial Sequence
  chemically synthesized
cttagtttttaattgaagtgca

SEQ ID NO: 682983 - DNA, 22 bp, Artificial Sequence
  chemically synthesized
gagaatatgcacttcaattaaa

SEQ ID NO: 682984 - DNA, 22 bp, Artificial Sequence
  chemically synthesized
aagcctacttagtttttaattg

SEQ ID NO: 682985 - DNA, 22 bp, Artificial Sequence
  chemically synthesized
ggtgattaaagcctacttagtt

SEQ ID NO: 682986 - DNA, 22 bp, Artificial Sequence
  chemically synthesized
caattaaaaactaagtaggctt

SEQ ID NO: 682987 - DNA, 22 bp, Artificial Sequence
  chemically synthesized
actaggtgattaaagcctactt

SEQ ID NO: 682988 - DNA, 22 bp, Artificial Sequence
  chemically synthesized
aattaaaaactaagtaggcttt

SEQ ID NO: 682989 - DNA, 22 bp, Artificial Sequence
  chemically synthesized
aaaactaagtaggctttaatca

SEQ ID NO: 682990 - DNA, 22 bp, Artificial Sequence
  chemically synthesized
agaactaactaggtgattaaag

SEQ ID NO: 682991 - DNA, 22 bp, Artificial Sequence
  chemically synthesized
aagaactaactaggtgattaaa

SEQ ID NO: 682992 - DNA, 22 bp, Artificial Sequence
  chemically synthesized
atttaagaactaactaggtgat

SEQ ID NO: 682993 - DNA, 22 bp, Artificial Sequence
  chemically synthesized
agtaggctttaatcacctagtt

SEQ ID NO: 682994 - DNA, 22 bp, Artificial Sequence
  chemically synthesized
taatcacctagttagttcttaa

SEQ ID NO: 682995 - DNA, 22 bp, Artificial Sequence
  chemically synthesized
aatcacctagttagttcttaaa

SEQ ID NO: 682996 - DNA, 22 bp, Artificial Sequence
  chemically synthesized
atcacctagttagttcttaaat

SEQ ID NO: 682997 - DNA, 22 bp, Artificial Sequence
  chemically synthesized
gttagttcttaaatcaggtttt

SEQ ID NO: 682998 - DNA, 22 bp, Artificial Sequence
  chemically synthesized
gttcttaaatcaggttttgtgt

SEQ ID NO: 682999 - DNA, 22 bp, Artificial Sequence
  chemically synthesized
ttaaatcaggttttgtgtgtgt

SEQ ID NO: 683000 - DNA, 22 bp, Artificial Sequence
  chemically synthesized
aaatcaggttttgtgtgtgtgt

SEQ ID NO: 683001 - DNA, 22 bp, Artificial Sequence
  chemically synthesized
aatcaggttttgtgtgtgtgtg

SEQ ID NO: 683002 - DNA, 22 bp, Artificial Sequence
  chemically synthesized
tgtgtgtgtgtgtgtgtgtgtg

SEQ ID NO: 683003 - DNA, 22 bp, Artificial Sequence
  chemically synthesized
gtgtgtgtgtgtgtgtgtgtgt

SEQ ID NO: 683004 - DNA, 22 bp, Artificial Sequence
  chemically synthesized
tgtgtgtgtgtgtgtgtgtgtg

SEQ ID NO: 683005 - DNA, 22 bp, Artificial Sequence
  chemically synthesized
gcaaaaagaacacacacacaca

SEQ ID NO: 683006 - DNA, 22 bp, Artificial Sequence
  chemically synthesized
tagcaaaaagaacacacacaca

SEQ ID NO: 683007 - DNA, 22 bp, Artificial Sequence
  chemically synthesized
atattctagcaaaaagaacaca

SEQ ID NO: 683008 - DNA, 22 bp, Artificial Sequence
  chemically synthesized
catattctagcaaaaagaacac

SEQ ID NO: 683009 - DNA, 22 bp, Artificial Sequence
  chemically synthesized
ttcatattctagcaaaaagaac

SEQ ID NO: 683010 - DNA, 22 bp, Artificial Sequence
  chemically synthesized
aactcttcatattctagcaaaa

SEQ ID NO: 683011 - DNA, 22 bp, Artificial Sequence
  chemically synthesized
caactcttcatattctagcaaa

SEQ ID NO: 683012 - DNA, 22 bp, Artificial Sequence
  chemically synthesized
tttcaactcttcatattctagc

SEQ ID NO: 683013 - DNA, 22 bp, Artificial Sequence
  chemically synthesized
gtttcaactcttcatattctag

SEQ ID NO: 683014 - DNA, 22 bp, Artificial Sequence
  chemically synthesized
tttttgctagaatatgaagagt

SEQ ID NO: 683015 - DNA, 22 bp, Artificial Sequence
  chemically synthesized
tttgctagaatatgaagagttg

SEQ ID NO: 683016 - DNA, 22 bp, Artificial Sequence
  chemically synthesized
ttgctagaatatgaagagttga

SEQ ID NO: 683017 - DNA, 22 bp, Artificial Sequence
  chemically synthesized
tgctagaatatgaagagttgaa

SEQ ID NO: 683018 - DNA, 22 bp, Artificial Sequence
  chemically synthesized
gctagaatatgaagagttgaaa

SEQ ID NO: 683019 - DNA, 22 bp, Artificial Sequence
  chemically synthesized
ctagaatatgaagagttgaaac

SEQ ID NO: 683020 - DNA, 22 bp, Artificial Sequence
  chemically synthesized
gaatatgaagagttgaaacaag

SEQ ID NO: 683021 - DNA, 22 bp, Artificial Sequence
  chemically synthesized
acagagtcaatgtaagaaactt

SEQ ID NO: 683022 - DNA, 22 bp, Artificial Sequence
  chemically synthesized
gctcacagagtcaatgtaagaa

SEQ ID NO: 683023 - DNA, 22 bp, Artificial Sequence
  chemically synthesized
aaacaagtttcttacattgact

SEQ ID NO: 683024 - DNA, 22 bp, Artificial Sequence
  chemically synthesized
atatgagcgattagctcacaga

SEQ ID NO: 683025 - DNA, 22 bp, Artificial Sequence
  chemically synthesized
cttacattgactctgtgagcta

SEQ ID NO: 683026 - DNA, 22 bp, Artificial Sequence
  chemically synthesized
ttacattgactctgtgagctaa

SEQ ID NO: 683027 - DNA, 22 bp, Artificial Sequence
  chemically synthesized
ttaatatgagcgattagctcac

SEQ ID NO: 683028 - DNA, 22 bp, Artificial Sequence
  chemically synthesized
acattgactctgtgagctaatc

SEQ ID NO: 683029 - DNA, 22 bp, Artificial Sequence
  chemically synthesized
cattgactctgtgagctaatcg

SEQ ID NO: 683030 - DNA, 22 bp, Artificial Sequence
  chemically synthesized
actctgtgagctaatcgctcat

SEQ ID NO: 683031 - DNA, 22 bp, Artificial Sequence
  chemically synthesized
gtaaattattaatatgagcgat

SEQ ID NO: 683032 - DNA, 22 bp, Artificial Sequence
  chemically synthesized
agtaaattattaatatgagcga

SEQ ID NO: 683033 - DNA, 22 bp, Artificial Sequence
  chemically synthesized
tgtgagctaatcgctcatatta

SEQ ID NO: 683034 - DNA, 22 bp, Artificial Sequence
  chemically synthesized
tgagctaatcgctcatattaat

SEQ ID NO: 683035 - DNA, 22 bp, Artificial Sequence
  chemically synthesized
taccttagtaaattattaatat

SEQ ID NO: 683036 - DNA, 22 bp, Artificial Sequence
  chemically synthesized
tgtaccttagtaaattattaat

SEQ ID NO: 683037 - DNA, 22 bp, Artificial Sequence
  chemically synthesized
atcgctcatattaataatttac

SEQ ID NO: 683038 - DNA, 22 bp, Artificial Sequence
  chemically synthesized
atattaataatttactaaggta

SEQ ID NO: 683039 - DNA, 22 bp, Artificial Sequence
  chemically synthesized
acataaaaactctgtaccttag

SEQ ID NO: 683040 - DNA, 22 bp, Artificial Sequence
  chemically synthesized
ataatttactaaggtacagagt

SEQ ID NO: 683041 - DNA, 22 bp, Artificial Sequence
  chemically synthesized
tatattaacataaaaactctgt

SEQ ID NO: 683042 - DNA, 22 bp, Artificial Sequence
  chemically synthesized
actaaggtacagagtttttatg

SEQ ID NO: 683043 - DNA, 22 bp, Artificial Sequence
  chemically synthesized
ctaaggtacagagtttttatgt

SEQ ID NO: 683044 - DNA, 22 bp, Artificial Sequence
  chemically synthesized
aggtacagagtttttatgttaa

SEQ ID NO: 683045 - DNA, 22 bp, Artificial Sequence
  chemically synthesized
atgtcgtaacacagctgtatat

SEQ ID NO: 683046 - DNA, 22 bp, Artificial Sequence
  chemically synthesized
ttatgttaatatacagctgtgt

SEQ ID NO: 683047 - DNA, 22 bp, Artificial Sequence
  chemically synthesized
tatgttaatatacagctgtgtt

SEQ ID NO: 683048 - DNA, 22 bp, Artificial Sequence
  chemically synthesized
aactgatgtcgtaacacagctg

SEQ ID NO: 683049 - DNA, 22 bp, Artificial Sequence
  chemically synthesized
atgttaatatacagctgtgtta

SEQ ID NO: 683050 - DNA, 22 bp, Artificial Sequence
  chemically synthesized
tgttaatatacagctgtgttac

SEQ ID NO: 683051 - DNA, 22 bp, Artificial Sequence
  chemically synthesized
atatacagctgtgttacgacat

SEQ ID NO: 683052 - DNA, 22 bp, Artificial Sequence
  chemically synthesized
aaaagcctaaactgatgtcgta

SEQ ID NO: 683053 - DNA, 22 bp, Artificial Sequence
  chemically synthesized
ctaaaaagcctaaactgatgtc

SEQ ID NO: 683054 - DNA, 22 bp, Artificial Sequence
  chemically synthesized
aattcctaaaaagcctaaactg

SEQ ID NO: 683055 - DNA, 22 bp, Artificial Sequence
  chemically synthesized
tgttacgacatcagtttaggct

SEQ ID NO: 683056 - DNA, 22 bp, Artificial Sequence
  chemically synthesized
gaattcctaaaaagcctaaact

SEQ ID NO: 683057 - DNA, 22 bp, Artificial Sequence
  chemically synthesized
tgaattcctaaaaagcctaaac

SEQ ID NO: 683058 - DNA, 22 bp, Artificial Sequence
  chemically synthesized
ttgaattcctaaaaagcctaaa

SEQ ID NO: 683059 - DNA, 22 bp, Artificial Sequence
  chemically synthesized
cgacatcagtttaggcttttta

SEQ ID NO: 683060 - DNA, 22 bp, Artificial Sequence
  chemically synthesized
gccaaatacatttttgaattcc

SEQ ID NO: 683061 - DNA, 22 bp, Artificial Sequence
  chemically synthesized
aggctttttaggaattcaaaaa

SEQ ID NO: 683062 - DNA, 22 bp, Artificial Sequence
  chemically synthesized
ggctttttaggaattcaaaaat

SEQ ID NO: 683063 - DNA, 22 bp, Artificial Sequence
  chemically synthesized
tttaggaattcaaaaatgtatt

SEQ ID NO: 683064 - DNA, 22 bp, Artificial Sequence
  chemically synthesized
ttaggaattcaaaaatgtattt

SEQ ID NO: 683065 - DNA, 22 bp, Artificial Sequence
  chemically synthesized
taggaattcaaaaatgtatttg

SEQ ID NO: 683066 - DNA, 22 bp, Artificial Sequence
  chemically synthesized
aggaattcaaaaatgtatttgg

SEQ ID NO: 683067 - DNA, 22 bp, Artificial Sequence
  chemically synthesized
ggaattcaaaaatgtatttggc

SEQ ID NO: 683068 - DNA, 22 bp, Artificial Sequence
  chemically synthesized
aaaaatgtatttggccaatatt

SEQ ID NO: 683069 - DNA, 22 bp, Artificial Sequence
  chemically synthesized
ccaagatatcaaatccaatatt

SEQ ID NO: 683070 - DNA, 22 bp, Artificial Sequence
  chemically synthesized
cccaagatatcaaatccaatat

SEQ ID NO: 683071 - DNA, 22 bp, Artificial Sequence
  chemically synthesized
gccttcccaagatatcaaatcc

SEQ ID NO: 683072 - DNA, 22 bp, Artificial Sequence
  chemically synthesized
ggccaatattggatttgatatc

SEQ ID NO: 683073 - DNA, 22 bp, Artificial Sequence
  chemically synthesized
gccaatattggatttgatatct

SEQ ID NO: 683074 - DNA, 22 bp, Artificial Sequence
  chemically synthesized
ccagttagccttcccaagatat

SEQ ID NO: 683075 - DNA, 22 bp, Artificial Sequence
  chemically synthesized
tgccagttagccttcccaagat

SEQ ID NO: 683076 - DNA, 22 bp, Artificial Sequence
  chemically synthesized
ctgccagttagccttcccaaga

SEQ ID NO: 683077 - DNA, 22 bp, Artificial Sequence
  chemically synthesized
tctgccagttagccttcccaag

SEQ ID NO: 683078 - DNA, 22 bp, Artificial Sequence
  chemically synthesized
gatttgatatcttgggaaggct

SEQ ID NO: 683079 - DNA, 22 bp, Artificial Sequence
  chemically synthesized
gatatcttgggaaggctaactg

SEQ ID NO: 683080 - DNA, 22 bp, Artificial Sequence
  chemically synthesized
atatcttgggaaggctaactgg

SEQ ID NO: 683081 - DNA, 22 bp, Artificial Sequence
  chemically synthesized
gggaaggctaactggcagaaaa

SEQ ID NO: 683082 - DNA, 22 bp, Artificial Sequence
  chemically synthesized
ggaaggctaactggcagaaaat

SEQ ID NO: 683083 - DNA, 22 bp, Artificial Sequence
  chemically synthesized
atggggaaagtagtattttctg

SEQ ID NO: 683084 - DNA, 22 bp, Artificial Sequence
  chemically synthesized
actggcagaaaatactactttc

SEQ ID NO: 683085 - DNA, 22 bp, Artificial Sequence
  chemically synthesized
atgtcctaatggggaaagtagt

SEQ ID NO: 683086 - DNA, 22 bp, Artificial Sequence
  chemically synthesized
gatgtcctaatggggaaagtag

SEQ ID NO: 683087 - DNA, 22 bp, Artificial Sequence
  chemically synthesized
tgatgtcctaatggggaaagta

SEQ ID NO: 683088 - DNA, 22 bp, Artificial Sequence
  chemically synthesized
gcagaaaatactactttcccca

SEQ ID NO: 683089 - DNA, 22 bp, Artificial Sequence
  chemically synthesized
aataatgtgctttgatgtccta

SEQ ID NO: 683090 - DNA, 22 bp, Artificial Sequence
  chemically synthesized
ctttccccattaggacatcaaa

SEQ ID NO: 683091 - DNA, 22 bp, Artificial Sequence
  chemically synthesized
actcaataatgtgctttgatgt

SEQ ID NO: 683092 - DNA, 22 bp, Artificial Sequence
  chemically synthesized
tccccattaggacatcaaagca

SEQ ID NO: 683093 - DNA, 22 bp, Artificial Sequence
  chemically synthesized
ccccattaggacatcaaagcac

SEQ ID NO: 683094 - DNA, 22 bp, Artificial Sequence
  chemically synthesized
cccattaggacatcaaagcaca

SEQ ID NO: 683095 - DNA, 22 bp, Artificial Sequence
  chemically synthesized
atattaactcaataatgtgctt

SEQ ID NO: 683096 - DNA, 22 bp, Artificial Sequence
  chemically synthesized
ttcatattaactcaataatgtg

SEQ ID NO: 683097 - DNA, 22 bp, Artificial Sequence
  chemically synthesized
ggacatcaaagcacattattga

SEQ ID NO: 683098 - DNA, 22 bp, Artificial Sequence
  chemically synthesized
gttcatattaactcaataatgt

SEQ ID NO: 683099 - DNA, 22 bp, Artificial Sequence
  chemically synthesized
ccacgtgaaggtcttgttcata

SEQ ID NO: 683100 - DNA, 22 bp, Artificial Sequence
  chemically synthesized
ttgagttaatatgaacaagacc

SEQ ID NO: 683101 - DNA, 22 bp, Artificial Sequence
  chemically synthesized
aattcccacgtgaaggtcttgt

SEQ ID NO: 683102 - DNA, 22 bp, Artificial Sequence
  chemically synthesized
agttaatatgaacaagaccttc

SEQ ID NO: 683103 - DNA, 22 bp, Artificial Sequence
  chemically synthesized
caattcccacgtgaaggtcttg

SEQ ID NO: 683104 - DNA, 22 bp, Artificial Sequence
  chemically synthesized
atatgaacaagaccttcacgtg

SEQ ID NO: 683105 - DNA, 22 bp, Artificial Sequence
  chemically synthesized
tgaggacttcaattcccacgtg

SEQ ID NO: 683106 - DNA, 22 bp, Artificial Sequence
  chemically synthesized
cacgtgggaattgaagtcctca

SEQ ID NO: 683107 - DNA, 22 bp, Artificial Sequence
  chemically synthesized
acgtgggaattgaagtcctcac

SEQ ID NO: 683108 - DNA, 22 bp, Artificial Sequence
  chemically synthesized
agggatgagagtaggtcaagct

SEQ ID NO: 683109 - DNA, 22 bp, Artificial Sequence
  chemically synthesized
aagtcctcacagcttgacctac

SEQ ID NO: 683110 - DNA, 22 bp, Artificial Sequence
  chemically synthesized
taagggatgagagtaggtcaag

SEQ ID NO: 683111 - DNA, 22 bp, Artificial Sequence
  chemically synthesized
ctaagggatgagagtaggtcaa

SEQ ID NO: 683112 - DNA, 22 bp, Artificial Sequence
  chemically synthesized
tttctaagggatgagagtaggt

SEQ ID NO: 683113 - DNA, 22 bp, Artificial Sequence
  chemically synthesized
acagcttgacctactctcatcc

SEQ ID NO: 683114 - DNA, 22 bp, Artificial Sequence
  chemically synthesized
tcgacctgtttctaagggatga

SEQ ID NO: 683115 - DNA, 22 bp, Artificial Sequence
  chemically synthesized
gtcgacctgtttctaagggatg

SEQ ID NO: 683116 - DNA, 22 bp, Artificial Sequence
  chemically synthesized
tgtcgacctgtttctaagggat

SEQ ID NO: 683117 - DNA, 22 bp, Artificial Sequence
  chemically synthesized
gacctactctcatcccttagaa

SEQ ID NO: 683118 - DNA, 22 bp, Artificial Sequence
  chemically synthesized
acctactctcatcccttagaaa

SEQ ID NO: 683119 - DNA, 22 bp, Artificial Sequence
  chemically synthesized
tttgtcgacctgtttctaaggg

SEQ ID NO: 683120 - DNA, 22 bp, Artificial Sequence
  chemically synthesized
ctctcatcccttagaaacaggt

SEQ ID NO: 683121 - DNA, 22 bp, Artificial Sequence
  chemically synthesized
caattctttgtcgacctgtttc

SEQ ID NO: 683122 - DNA, 22 bp, Artificial Sequence
  chemically synthesized
ccaattctttgtcgacctgttt

SEQ ID NO: 683123 - DNA, 22 bp, Artificial Sequence
  chemically synthesized
tcatcccttagaaacaggtcga

SEQ ID NO: 683124 - DNA, 22 bp, Artificial Sequence
  chemically synthesized
atcccttagaaacaggtcgaca

SEQ ID NO: 683125 - DNA, 22 bp, Artificial Sequence
  chemically synthesized
agaaacaggtcgacaaagaatt

SEQ ID NO: 683126 - DNA, 22 bp, Artificial Sequence
  chemically synthesized
gaaacaggtcgacaaagaattg

SEQ ID NO: 683127 - DNA, 22 bp, Artificial Sequence
  chemically synthesized
tccatcatatgcaaagaggctt

SEQ ID NO: 683128 - DNA, 22 bp, Artificial Sequence
  chemically synthesized
tatccatcatatgcaaagaggc

SEQ ID NO: 683129 - DNA, 22 bp, Artificial Sequence
  chemically synthesized
tctatccatcatatgcaaagag

SEQ ID NO: 683130 - DNA, 22 bp, Artificial Sequence
  chemically synthesized
ctctatccatcatatgcaaaga

SEQ ID NO: 683131 - DNA, 22 bp, Artificial Sequence
  chemically synthesized
ttctctatccatcatatgcaaa

SEQ ID NO: 683132 - DNA, 22 bp, Artificial Sequence
  chemically synthesized
cttctctatccatcatatgcaa

SEQ ID NO: 683133 - DNA, 22 bp, Artificial Sequence
  chemically synthesized
tcttctctatccatcatatgca

SEQ ID NO: 683134 - DNA, 22 bp, Artificial Sequence
  chemically synthesized
ttcttctctatccatcatatgc

SEQ ID NO: 683135 - DNA, 22 bp, Artificial Sequence
  chemically synthesized
gaagcctctttgcatatgatgg

SEQ ID NO: 683136 - DNA, 22 bp, Artificial Sequence
  chemically synthesized
tttcttctctatccatcatatg

SEQ ID NO: 683137 - DNA, 22 bp, Artificial Sequence
  chemically synthesized
tttgcatatgatggatagagaa

SEQ ID NO: 683138 - DNA, 22 bp, Artificial Sequence
  chemically synthesized
tgcatatgatggatagagaaga

SEQ ID NO: 683139 - DNA, 22 bp, Artificial Sequence
  chemically synthesized
gcatatgatggatagagaagaa

SEQ ID NO: 683140 - DNA, 22 bp, Artificial Sequence
  chemically synthesized
catatgatggatagagaagaaa

SEQ ID NO: 683141 - DNA, 22 bp, Artificial Sequence
  chemically synthesized
aaaagtacaggtggtgccaatt

SEQ ID NO: 683142 - DNA, 22 bp, Artificial Sequence
  chemically synthesized
aaaagaaagatattcaaaagta

SEQ ID NO: 683143 - DNA, 22 bp, Artificial Sequence
  chemically synthesized
aaaaagaaagatattcaaaagt

SEQ ID NO: 683144 - DNA, 22 bp, Artificial Sequence
  chemically synthesized
gcaccacctgtacttttgaata

SEQ ID NO: 683145 - DNA, 22 bp, Artificial Sequence
  chemically synthesized
taaaaagaaagatattcaaaag

SEQ ID NO: 683146 - DNA, 22 bp, Artificial Sequence
  chemically synthesized
ttttaaaaagaaagatattcaa

SEQ ID NO: 683147 - DNA, 22 bp, Artificial Sequence
  chemically synthesized
tattttaaaaagaaagatattc

SEQ ID NO: 683148 - DNA, 22 bp, Artificial Sequence
  chemically synthesized
attctattttaaaaagaaagat

SEQ ID NO: 683149 - DNA, 22 bp, Artificial Sequence
  chemically synthesized
tacttttgaatatctttctttt

SEQ ID NO: 683150 - DNA, 22 bp, Artificial Sequence
  chemically synthesized
aattctattttaaaaagaaaga

SEQ ID NO: 683151 - DNA, 22 bp, Artificial Sequence
  chemically synthesized
ttgaatatctttctttttaaaa

SEQ ID NO: 683152 - DNA, 22 bp, Artificial Sequence
  chemically synthesized
tgaatatctttctttttaaaat

SEQ ID NO: 683153 - DNA, 22 bp, Artificial Sequence
  chemically synthesized
aaatttaattctattttaaaaa

SEQ ID NO: 683154 - DNA, 22 bp, Artificial Sequence
  chemically synthesized
gaatatctttctttttaaaata

SEQ ID NO: 683155 - DNA, 22 bp, Artificial Sequence
  chemically synthesized
aatatctttctttttaaaatag

SEQ ID NO: 683156 - DNA, 22 bp, Artificial Sequence
  chemically synthesized
ccacctcaaatttaattctatt

SEQ ID NO: 683157 - DNA, 22 bp, Artificial Sequence
  chemically synthesized
cccacctcaaatttaattctat

SEQ ID NO: 683158 - DNA, 22 bp, Artificial Sequence
  chemically synthesized
tctttttaaaatagaattaaat

SEQ ID NO: 683159 - DNA, 22 bp, Artificial Sequence
  chemically synthesized
ttcccacctcaaatttaattct

SEQ ID NO: 683160 - DNA, 22 bp, Artificial Sequence
  chemically synthesized
ctttttaaaatagaattaaatt

SEQ ID NO: 683161 - DNA, 22 bp, Artificial Sequence
  chemically synthesized
cttcccacctcaaatttaattc

SEQ ID NO: 683162 - DNA, 22 bp, Artificial Sequence
  chemically synthesized
tttttaaaatagaattaaattt

SEQ ID NO: 683163 - DNA, 22 bp, Artificial Sequence
  chemically synthesized
tttaaaatagaattaaatttga

SEQ ID NO: 683164 - DNA, 22 bp, Artificial Sequence
  chemically synthesized
tttcttcccacctcaaatttaa

SEQ ID NO: 683165 - DNA, 22 bp, Artificial Sequence
  chemically synthesized
ttaaaatagaattaaatttgag

SEQ ID NO: 683166 - DNA, 22 bp, Artificial Sequence
  chemically synthesized
gtttcttcccacctcaaattta

SEQ ID NO: 683167 - DNA, 22 bp, Artificial Sequence
  chemically synthesized
taaaatagaattaaatttgagg

SEQ ID NO: 683168 - DNA, 22 bp, Artificial Sequence
  chemically synthesized
aaaatagaattaaatttgaggt

SEQ ID NO: 683169 - DNA, 22 bp, Artificial Sequence
  chemically synthesized
aaatagaattaaatttgaggtg

SEQ ID NO: 683170 - DNA, 22 bp, Artificial Sequence
  chemically synthesized
cacccttgtttcttcccacctc

SEQ ID NO: 683171 - DNA, 22 bp, Artificial Sequence
  chemically synthesized
ccacccttgtttcttcccacct

SEQ ID NO: 683172 - DNA, 22 bp, Artificial Sequence
  chemically synthesized
tccacccttgtttcttcccacc

SEQ ID NO: 683173 - DNA, 22 bp, Artificial Sequence
  chemically synthesized
ttccacccttgtttcttcccac

SEQ ID NO: 683174 - DNA, 22 bp, Artificial Sequence
  chemically synthesized
ttttccacccttgtttcttccc

SEQ ID NO: 683175 - DNA, 22 bp, Artificial Sequence
  chemically synthesized
aatttgaggtgggaagaaacaa

SEQ ID NO: 683176 - DNA, 22 bp, Artificial Sequence
  chemically synthesized
ccctcttttccacccttgtttc

SEQ ID NO: 683177 - DNA, 22 bp, Artificial Sequence
  chemically synthesized
gaggtgggaagaaacaagggtg

SEQ ID NO: 683178 - DNA, 22 bp, Artificial Sequence
  chemically synthesized
aggtgggaagaaacaagggtgg

SEQ ID NO: 683179 - DNA, 22 bp, Artificial Sequence
  chemically synthesized
atccctaccctcttttccaccc

SEQ ID NO: 683180 - DNA, 22 bp, Artificial Sequence
  chemically synthesized
tgatccctaccctcttttccac

SEQ ID NO: 683181 - DNA, 22 bp, Artificial Sequence
  chemically synthesized
cattctgatccctaccctcttt

SEQ ID NO: 683182 - DNA, 22 bp, Artificial Sequence
  chemically synthesized
ccattctgatccctaccctctt

SEQ ID NO: 683183 - DNA, 22 bp, Artificial Sequence
  chemically synthesized
gcatacatttccattctgatcc

SEQ ID NO: 683184 - DNA, 22 bp, Artificial Sequence
  chemically synthesized
ggcatacatttccattctgatc

SEQ ID NO: 683185 - DNA, 22 bp, Artificial Sequence
  chemically synthesized
cttggcatacatttccattctg

SEQ ID NO: 683186 - DNA, 22 bp, Artificial Sequence
  chemically synthesized
tcatcatctacttggcatacat

SEQ ID NO: 683187 - DNA, 22 bp, Artificial Sequence
  chemically synthesized
ttgtcatcatctacttggcata

SEQ ID NO: 683188 - DNA, 22 bp, Artificial Sequence
  chemically synthesized
ggctgttgtcatcatctacttg

SEQ ID NO: 683189 - DNA, 22 bp, Artificial Sequence
  chemically synthesized
actgggctgttgtcatcatcta

SEQ ID NO: 683190 - DNA, 22 bp, Artificial Sequence
  chemically synthesized
aactgggctgttgtcatcatct

SEQ ID NO: 683191 - DNA, 22 bp, Artificial Sequence
  chemically synthesized
ttaactgggctgttgtcatcat

SEQ ID NO: 683192 - DNA, 22 bp, Artificial Sequence
  chemically synthesized
atccactcttaactgggctgtt

SEQ ID NO: 683193 - DNA, 22 bp, Artificial Sequence
  chemically synthesized
catccactcttaactgggctgt

SEQ ID NO: 683194 - DNA, 22 bp, Artificial Sequence
  chemically synthesized
tcatccactcttaactgggctg

SEQ ID NO: 683195 - DNA, 22 bp, Artificial Sequence
  chemically synthesized
agactttcatccactcttaact

SEQ ID NO: 683196 - DNA, 22 bp, Artificial Sequence
  chemically synthesized
gttcagactttcatccactctt

SEQ ID NO: 683197 - DNA, 22 bp, Artificial Sequence
  chemically synthesized
agttcagactttcatccactct

SEQ ID NO: 683198 - DNA, 22 bp, Artificial Sequence
  chemically synthesized
ttagttcagactttcatccact

SEQ ID NO: 683199 - DNA, 22 bp, Artificial Sequence
  chemically synthesized
cttagttcagactttcatccac

SEQ ID NO: 683200 - DNA, 22 bp, Artificial Sequence
  chemically synthesized
tcttagttcagactttcatcca

SEQ ID NO: 683201 - DNA, 22 bp, Artificial Sequence
  chemically synthesized
ctttcttagttcagactttcat

SEQ ID NO: 683202 - DNA, 22 bp, Artificial Sequence
  chemically synthesized
agagtggatgaaagtctgaact

SEQ ID NO: 683203 - DNA, 22 bp, Artificial Sequence
  chemically synthesized
ccagtgctcctttcttagttca

SEQ ID NO: 683204 - DNA, 22 bp, Artificial Sequence
  chemically synthesized
cacaaattcccagtgctccttt

SEQ ID NO: 683205 - DNA, 22 bp, Artificial Sequence
  chemically synthesized
tccacaaattcccagtgctcct

SEQ ID NO: 683206 - DNA, 22 bp, Artificial Sequence
  chemically synthesized
aactaagaaaggagcactggga

SEQ ID NO: 683207 - DNA, 22 bp, Artificial Sequence
  chemically synthesized
agcctctccacaaattcccagt

SEQ ID NO: 683208 - DNA, 22 bp, Artificial Sequence
  chemically synthesized
agaaaggagcactgggaatttg

SEQ ID NO: 683209 - DNA, 22 bp, Artificial Sequence
  chemically synthesized
tcatgaattcagcctctccaca

SEQ ID NO: 683210 - DNA, 22 bp, Artificial Sequence
  chemically synthesized
ggaatttgtggagaggctgaat

SEQ ID NO: 683211 - DNA, 22 bp, Artificial Sequence
  chemically synthesized
taacctgtcatgaattcagcct

SEQ ID NO: 683212 - DNA, 22 bp, Artificial Sequence
  chemically synthesized
tataacctgtcatgaattcagc

SEQ ID NO: 683213 - DNA, 22 bp, Artificial Sequence
  chemically synthesized
ttctataacctgtcatgaattc

SEQ ID NO: 683214 - DNA, 22 bp, Artificial Sequence
  chemically synthesized
gtggagaggctgaattcatgac

SEQ ID NO: 683215 - DNA, 22 bp, Artificial Sequence
  chemically synthesized
attctataacctgtcatgaatt

SEQ ID NO: 683216 - DNA, 22 bp, Artificial Sequence
  chemically synthesized
tggagaggctgaattcatgaca

SEQ ID NO: 683217 - DNA, 22 bp, Artificial Sequence
  chemically synthesized
tattctataacctgtcatgaat

SEQ ID NO: 683218 - DNA, 22 bp, Artificial Sequence
  chemically synthesized
attttattctataacctgtcat

SEQ ID NO: 683219 - DNA, 22 bp, Artificial Sequence
  chemically synthesized
aattcatgacaggttatagaat

SEQ ID NO: 683220 - DNA, 22 bp, Artificial Sequence
  chemically synthesized
atgacaggttatagaataaaat

SEQ ID NO: 683221 - DNA, 22 bp, Artificial Sequence
  chemically synthesized
aaaagtagcattgattttattc

SEQ ID NO: 683222 - DNA, 22 bp, Artificial Sequence
  chemically synthesized
gctcaaaagtagcattgatttt

SEQ ID NO: 683223 - DNA, 22 bp, Artificial Sequence
  chemically synthesized
aattggctcaaaagtagcattg

SEQ ID NO: 683224 - DNA, 22 bp, Artificial Sequence
  chemically synthesized
tagaataaaatcaatgctactt

SEQ ID NO: 683225 - DNA, 22 bp, Artificial Sequence
  chemically synthesized
acattcaattggctcaaaagta

SEQ ID NO: 683226 - DNA, 22 bp, Artificial Sequence
  chemically synthesized
gccctcacattcaattggctca

SEQ ID NO: 683227 - DNA, 22 bp, Artificial Sequence
  chemically synthesized
tagccctcacattcaattggct

SEQ ID NO: 683228 - DNA, 22 bp, Artificial Sequence
  chemically synthesized
ctctagccctcacattcaattg

SEQ ID NO: 683229 - DNA, 22 bp, Artificial Sequence
  chemically synthesized
cctctagccctcacattcaatt

SEQ ID NO: 683230 - DNA, 22 bp, Artificial Sequence
  chemically synthesized
tcctctagccctcacattcaat

SEQ ID NO: 683231 - DNA, 22 bp, Artificial Sequence
  chemically synthesized
cttttgagccaattgaatgtga

SEQ ID NO: 683232 - DNA, 22 bp, Artificial Sequence
  chemically synthesized
ttcctctagccctcacattcaa

SEQ ID NO: 683233 - DNA, 22 bp, Artificial Sequence
  chemically synthesized
ttgagccaattgaatgtgaggg

SEQ ID NO: 683234 - DNA, 22 bp, Artificial Sequence
  chemically synthesized
cttttcctctagccctcacatt

SEQ ID NO: 683235 - DNA, 22 bp, Artificial Sequence
  chemically synthesized
tgagccaattgaatgtgagggc

SEQ ID NO: 683236 - DNA, 22 bp, Artificial Sequence
  chemically synthesized
ccttttcctctagccctcacat

SEQ ID NO: 683237 - DNA, 22 bp, Artificial Sequence
  chemically synthesized
gagccaattgaatgtgagggct

SEQ ID NO: 683238 - DNA, 22 bp, Artificial Sequence
  chemically synthesized
tccttttcctctagccctcaca

SEQ ID NO: 683239 - DNA, 22 bp, Artificial Sequence
  chemically synthesized
agccaattgaatgtgagggcta

SEQ ID NO: 683240 - DNA, 22 bp, Artificial Sequence
  chemically synthesized
ttccttttcctctagccctcac

SEQ ID NO: 683241 - DNA, 22 bp, Artificial Sequence
  chemically synthesized
cacttttccttttcctctagcc

SEQ ID NO: 683242 - DNA, 22 bp, Artificial Sequence
  chemically synthesized
aatgtgagggctagaggaaaag

SEQ ID NO: 683243 - DNA, 22 bp, Artificial Sequence
  chemically synthesized
tcaaaaatcctacacttttcct

SEQ ID NO: 683244 - DNA, 22 bp, Artificial Sequence
  chemically synthesized
gaggaaaaggaaaagtgtagga

SEQ ID NO: 683245 - DNA, 22 bp, Artificial Sequence
  chemically synthesized
atagggccattatcaaaaatcc

SEQ ID NO: 683246 - DNA, 22 bp, Artificial Sequence
  chemically synthesized
ttgataatggccctattagctg

SEQ ID NO: 683247 - DNA, 22 bp, Artificial Sequence
  chemically synthesized
tgataatggccctattagctgt

SEQ ID NO: 683248 - DNA, 22 bp, Artificial Sequence
  chemically synthesized
gataatggccctattagctgtg

SEQ ID NO: 683249 - DNA, 22 bp, Artificial Sequence
  chemically synthesized
ataatggccctattagctgtgc

SEQ ID NO: 683250 - DNA, 22 bp, Artificial Sequence
  chemically synthesized
ttagctgtgcattcatggattc

SEQ ID NO: 683251 - DNA, 22 bp, Artificial Sequence
  chemically synthesized
gctgtgcattcatggattcata

SEQ ID NO: 683252 - DNA, 22 bp, Artificial Sequence
  chemically synthesized
tgcattcatggattcatatttg

SEQ ID NO: 683253 - DNA, 22 bp, Artificial Sequence
  chemically synthesized
atggattcatatttgtgtatat

SEQ ID NO: 683254 - DNA, 22 bp, Artificial Sequence
  chemically synthesized
atatttgtgtatatactatgta

SEQ ID NO: 683255 - DNA, 22 bp, Artificial Sequence
  chemically synthesized
gtgtatatactatgtacatatt

SEQ ID NO: 683256 - DNA, 22 bp, Artificial Sequence
  chemically synthesized
tgtatatactatgtacatattt

SEQ ID NO: 683257 - DNA, 22 bp, Artificial Sequence
  chemically synthesized
cagaacaatgcacagtataaat

SEQ ID NO: 683258 - DNA, 22 bp, Artificial Sequence
  chemically synthesized
acagaacaatgcacagtataaa

SEQ ID NO: 683259 - DNA, 22 bp, Artificial Sequence
  chemically synthesized
tacagaacaatgcacagtataa

SEQ ID NO: 683260 - DNA, 22 bp, Artificial Sequence
  chemically synthesized
tgtacatatttatactgtgcat

SEQ ID NO: 683261 - DNA, 22 bp, Artificial Sequence
  chemically synthesized
aagcctttacagaacaatgcac

SEQ ID NO: 683262 - DNA, 22 bp, Artificial Sequence
  chemically synthesized
ccctaaagcctttacagaacaa

SEQ ID NO: 683263 - DNA, 22 bp, Artificial Sequence
  chemically synthesized
atactgtgcattgttctgtaaa

SEQ ID NO: 683264 - DNA, 22 bp, Artificial Sequence
  chemically synthesized
tactgtgcattgttctgtaaag

SEQ ID NO: 683265 - DNA, 22 bp, Artificial Sequence
  chemically synthesized
taagttgccctaaagcctttac

SEQ ID NO: 683266 - DNA, 22 bp, Artificial Sequence
  chemically synthesized
tgcattgttctgtaaaggcttt

SEQ ID NO: 683267 - DNA, 22 bp, Artificial Sequence
  chemically synthesized
ttataagttgccctaaagcctt

SEQ ID NO: 683268 - DNA, 22 bp, Artificial Sequence
  chemically synthesized
ttctgtaaaggctttagggcaa

SEQ ID NO: 683269 - DNA, 22 bp, Artificial Sequence
  chemically synthesized
tacattgttataagttgcccta

SEQ ID NO: 683270 - DNA, 22 bp, Artificial Sequence
  chemically synthesized
tgtaaaggctttagggcaactt

SEQ ID NO: 683271 - DNA, 22 bp, Artificial Sequence
  chemically synthesized
taaaggctttagggcaacttat

SEQ ID NO: 683272 - DNA, 22 bp, Artificial Sequence
  chemically synthesized
agagttatacattgttataagt

SEQ ID NO: 683273 - DNA, 22 bp, Artificial Sequence
  chemically synthesized
aagagttatacattgttataag

SEQ ID NO: 683274 - DNA, 22 bp, Artificial Sequence
  chemically synthesized
taagagttatacattgttataa

SEQ ID NO: 683275 - DNA, 22 bp, Artificial Sequence
  chemically synthesized
ttaagagttatacattgttata

SEQ ID NO: 683276 - DNA, 22 bp, Artificial Sequence
  chemically synthesized
tagggcaacttataacaatgta

SEQ ID NO: 683277 - DNA, 22 bp, Artificial Sequence
  chemically synthesized
agggcaacttataacaatgtat

SEQ ID NO: 683278 - DNA, 22 bp, Artificial Sequence
  chemically synthesized
gggcaacttataacaatgtata

SEQ ID NO: 683279 - DNA, 22 bp, Artificial Sequence
  chemically synthesized
atttttaagagttatacattgt

SEQ ID NO: 683280 - DNA, 22 bp, Artificial Sequence
  chemically synthesized
ttaatttttaagagttatacat

SEQ ID NO: 683281 - DNA, 22 bp, Artificial Sequence
  chemically synthesized
attaatttttaagagttataca

SEQ ID NO: 683282 - DNA, 22 bp, Artificial Sequence
  chemically synthesized
tattaatttttaagagttatac

SEQ ID NO: 683283 - DNA, 22 bp, Artificial Sequence
  chemically synthesized
ataacaatgtataactcttaaa

SEQ ID NO: 683284 - DNA, 22 bp, Artificial Sequence
  chemically synthesized
taacaatgtataactcttaaaa

SEQ ID NO: 683285 - DNA, 22 bp, Artificial Sequence
  chemically synthesized
ggttttattaatttttaagagt

SEQ ID NO: 683286 - DNA, 22 bp, Artificial Sequence
  chemically synthesized
gtgctgggttttattaattttt

SEQ ID NO: 683287 - DNA, 22 bp, Artificial Sequence
  chemically synthesized
agtgctgggttttattaatttt

SEQ ID NO: 683288 - DNA, 22 bp, Artificial Sequence
  chemically synthesized
cttagtgctgggttttattaat

SEQ ID NO: 683289 - DNA, 22 bp, Artificial Sequence
  chemically synthesized
ccttagtgctgggttttattaa

SEQ ID NO: 683290 - DNA, 22 bp, Artificial Sequence
  chemically synthesized
ttaaaaattaataaaacccagc

SEQ ID NO: 683291 - DNA, 22 bp, Artificial Sequence
  chemically synthesized
tatttccttagtgctgggtttt

SEQ ID NO: 683292 - DNA, 22 bp, Artificial Sequence
  chemically synthesized
atatttccttagtgctgggttt

SEQ ID NO: 683293 - DNA, 22 bp, Artificial Sequence
  chemically synthesized
aaaaattaataaaacccagcac

SEQ ID NO: 683294 - DNA, 22 bp, Artificial Sequence
  chemically synthesized
aaaattaataaaacccagcact

SEQ ID NO: 683295 - DNA, 22 bp, Artificial Sequence
  chemically synthesized
tttatatttccttagtgctggg

SEQ ID NO: 683296 - DNA, 22 bp, Artificial Sequence
  chemically synthesized
tgctatttatatttccttagtg

SEQ ID NO: 683297 - DNA, 22 bp, Artificial Sequence
  chemically synthesized
ataaaacccagcactaaggaaa

SEQ ID NO: 683298 - DNA, 22 bp, Artificial Sequence
  chemically synthesized
atgctatttatatttccttagt

SEQ ID NO: 683299 - DNA, 22 bp, Artificial Sequence
  chemically synthesized
tatgctatttatatttccttag

SEQ ID NO: 683300 - DNA, 22 bp, Artificial Sequence
  chemically synthesized
aagttttatgctatttatattt

SEQ ID NO: 683301 - DNA, 22 bp, Artificial Sequence
  chemically synthesized
aaagttttatgctatttatatt

SEQ ID NO: 683302 - DNA, 22 bp, Artificial Sequence
  chemically synthesized
ttaaagttttatgctatttata

SEQ ID NO: 683303 - DNA, 22 bp, Artificial Sequence
  chemically synthesized
cttaaagttttatgctatttat

SEQ ID NO: 683304 - DNA, 22 bp, Artificial Sequence
  chemically synthesized
gcttcttaaagttttatgctat

SEQ ID NO: 683305 - DNA, 22 bp, Artificial Sequence
  chemically synthesized
aggaaatataaatagcataaaa

SEQ ID NO: 683306 - DNA, 22 bp, Artificial Sequence
  chemically synthesized
ctcgcttcttaaagttttatgc

SEQ ID NO: 683307 - DNA, 22 bp, Artificial Sequence
  chemically synthesized
cctcgcttcttaaagttttatg

SEQ ID NO: 683308 - DNA, 22 bp, Artificial Sequence
  chemically synthesized
tcctcgcttcttaaagttttat

SEQ ID NO: 683309 - DNA, 22 bp, Artificial Sequence
  chemically synthesized
aattttcctcgcttcttaaagt

SEQ ID NO: 683310 - DNA, 22 bp, Artificial Sequence
  chemically synthesized
taaattttcctcgcttcttaaa

SEQ ID NO: 683311 - DNA, 22 bp, Artificial Sequence
  chemically synthesized
tgttctaaattttcctcgcttc

SEQ ID NO: 683312 - DNA, 22 bp, Artificial Sequence
  chemically synthesized
taagaagcgaggaaaatttaga

SEQ ID NO: 683313 - DNA, 22 bp, Artificial Sequence
  chemically synthesized
aagaagcgaggaaaatttagaa

SEQ ID NO: 683314 - DNA, 22 bp, Artificial Sequence
  chemically synthesized
agaagcgaggaaaatttagaac

SEQ ID NO: 683315 - DNA, 22 bp, Artificial Sequence
  chemically synthesized
aaaacaaaaaacaaaaaacaaa

SEQ ID NO: 683316 - DNA, 22 bp, Artificial Sequence
  chemically synthesized
agaacacagatttgttttttgt

SEQ ID NO: 683317 - DNA, 22 bp, Artificial Sequence
  chemically synthesized
gaacacagatttgttttttgtt

SEQ ID NO: 683318 - DNA, 22 bp, Artificial Sequence
  chemically synthesized
cgtctcaaaacaaaaaacaaaa

SEQ ID NO: 683319 - DNA, 22 bp, Artificial Sequence
  chemically synthesized
gttttttgttttttgttttgag

SEQ ID NO: 683320 - DNA, 22 bp, Artificial Sequence
  chemically synthesized
ttttttgttttttgttttgaga

SEQ ID NO: 683321 - DNA, 22 bp, Artificial Sequence
  chemically synthesized
tttgttttttgttttgagacgg

SEQ ID NO: 683322 - DNA, 22 bp, Artificial Sequence
  chemically synthesized
ttgttttttgttttgagacgga

SEQ ID NO: 683323 - DNA, 22 bp, Artificial Sequence
  chemically synthesized
tgttttttgttttgagacggag

SEQ ID NO: 683324 - DNA, 22 bp, Artificial Sequence
  chemically synthesized
gttttttgttttgagacggagt

SEQ ID NO: 683325 - DNA, 22 bp, Artificial Sequence
  chemically synthesized
ttttttgttttgagacggagtc

SEQ ID NO: 683326 - DNA, 22 bp, Artificial Sequence
  chemically synthesized
ggtgacagagtgagactccgtc

SEQ ID NO: 683327 - DNA, 22 bp, Artificial Sequence
  chemically synthesized
tttgttttgagacggagtctca

SEQ ID NO: 683328 - DNA, 22 bp, Artificial Sequence
  chemically synthesized
ttgttttgagacggagtctcac

SEQ ID NO: 683329 - DNA, 22 bp, Artificial Sequence
  chemically synthesized
tgttttgagacggagtctcact

SEQ ID NO: 683330 - DNA, 22 bp, Artificial Sequence
  chemically synthesized
gttttgagacggagtctcactc

SEQ ID NO: 683331 - DNA, 22 bp, Artificial Sequence
  chemically synthesized
ttttgagacggagtctcactct

SEQ ID NO: 683332 - DNA, 22 bp, Artificial Sequence
  chemically synthesized
cgacctgggtgacagagtgaga

SEQ ID NO: 683333 - DNA, 22 bp, Artificial Sequence
  chemically synthesized
tgagacggagtctcactctgtc

SEQ ID NO: 683334 - DNA, 22 bp, Artificial Sequence
  chemically synthesized
tccgacctgggtgacagagtga

SEQ ID NO: 683335 - DNA, 22 bp, Artificial Sequence
  chemically synthesized
gagacggagtctcactctgtca

SEQ ID NO: 683336 - DNA, 22 bp, Artificial Sequence
  chemically synthesized
agacggagtctcactctgtcac

SEQ ID NO: 683337 - DNA, 22 bp, Artificial Sequence
  chemically synthesized
ctctccgacctgggtgacagag

SEQ ID NO: 683338 - DNA, 22 bp, Artificial Sequence
  chemically synthesized
actctgtcacccaggtcggaga

SEQ ID NO: 683339 - DNA, 22 bp, Artificial Sequence
  chemically synthesized
tgtcacccaggtcggagagcag

SEQ ID NO: 683340 - DNA, 22 bp, Artificial Sequence
  chemically synthesized
tcacccaggtcggagagcagtg

SEQ ID NO: 683341 - DNA, 22 bp, Artificial Sequence
  chemically synthesized
cagtgagccgagatcgtgccac

SEQ ID NO: 683342 - DNA, 22 bp, Artificial Sequence
  chemically synthesized
gcagtgagccgagatcgtgcca

SEQ ID NO: 683343 - DNA, 22 bp, Artificial Sequence
  chemically synthesized
ggaggcagagtttgcagtgagc

SEQ ID NO: 683344 - DNA, 22 bp, Artificial Sequence
  chemically synthesized
aagctgggaggcagagtttgca

SEQ ID NO: 683345 - DNA, 22 bp, Artificial Sequence
  chemically synthesized
gaagctgggaggcagagtttgc

SEQ ID NO: 683346 - DNA, 22 bp, Artificial Sequence
  chemically synthesized
cttgaagctgggaggcagagtt

SEQ ID NO: 683347 - DNA, 22 bp, Artificial Sequence
  chemically synthesized
ggctcactgcaaactctgcctc

SEQ ID NO: 683348 - DNA, 22 bp, Artificial Sequence
  chemically synthesized
actgcaaactctgcctcccagc

SEQ ID NO: 683349 - DNA, 22 bp, Artificial Sequence
  chemically synthesized
caaactctgcctcccagcttca

SEQ ID NO: 683350 - DNA, 22 bp, Artificial Sequence
  chemically synthesized
aggcacgagaattgcttgaagc

SEQ ID NO: 683351 - DNA, 22 bp, Artificial Sequence
  chemically synthesized
tgcctcccagcttcaagcaatt

SEQ ID NO: 683352 - DNA, 22 bp, Artificial Sequence
  chemically synthesized
cctcccagcttcaagcaattct

SEQ ID NO: 683353 - DNA, 22 bp, Artificial Sequence
  chemically synthesized
ggaggctgaggcacgagaattg

SEQ ID NO: 683354 - DNA, 22 bp, Artificial Sequence
  chemically synthesized
ccagcttcaagcaattctcgtg

SEQ ID NO: 683355 - DNA, 22 bp, Artificial Sequence
  chemically synthesized
gggaggctgaggcacgagaatt

SEQ ID NO: 683356 - DNA, 22 bp, Artificial Sequence
  chemically synthesized
cttgggaggctgaggcacgaga

SEQ ID NO: 683357 - DNA, 22 bp, Artificial Sequence
  chemically synthesized
caagcaattctcgtgcctcagc

SEQ ID NO: 683358 - DNA, 22 bp, Artificial Sequence
  chemically synthesized
aagcaattctcgtgcctcagcc

SEQ ID NO: 683359 - DNA, 22 bp, Artificial Sequence
  chemically synthesized
taatcccagctacttgggaggc

SEQ ID NO: 683360 - DNA, 22 bp, Artificial Sequence
  chemically synthesized
tcgtgcctcagcctcccaagta

SEQ ID NO: 683361 - DNA, 22 bp, Artificial Sequence
  chemically synthesized
gtgcctcagcctcccaagtagc

SEQ ID NO: 683362 - DNA, 22 bp, Artificial Sequence
  chemically synthesized
agcctcccaagtagctgggatt

SEQ ID NO: 683363 - DNA, 22 bp, Artificial Sequence
  chemically synthesized
ccaagtagctgggattacaggt

SEQ ID NO: 683364 - DNA, 22 bp, Artificial Sequence
  chemically synthesized
gccgggcgtggtggcaggcacc

SEQ ID NO: 683365 - DNA, 22 bp, Artificial Sequence
  chemically synthesized
ggattacaggtgcctgccacca

SEQ ID NO: 683366 - DNA, 22 bp, Artificial Sequence
  chemically synthesized
caggtgcctgccaccacgcccg

SEQ ID NO: 683367 - DNA, 22 bp, Artificial Sequence
  chemically synthesized
ccaccacgcccggctaattttt

SEQ ID NO: 683368 - DNA, 22 bp, Artificial Sequence
  chemically synthesized
ccaaaaatacaaaaaaattagc

SEQ ID NO: 683369 - DNA, 22 bp, Artificial Sequence
  chemically synthesized
taccaaaaatacaaaaaaatta

SEQ ID NO: 683370 - DNA, 22 bp, Artificial Sequence
  chemically synthesized
atttttttgtatttttggtaga

SEQ ID NO: 683371 - DNA, 22 bp, Artificial Sequence
  chemically synthesized
ttttgtatttttggtagagacg

SEQ ID NO: 683372 - DNA, 22 bp, Artificial Sequence
  chemically synthesized
tttgtatttttggtagagacgg

SEQ ID NO: 683373 - DNA, 22 bp, Artificial Sequence
  chemically synthesized
ttgtatttttggtagagacggg

SEQ ID NO: 683374 - DNA, 22 bp, Artificial Sequence
  chemically synthesized
tgtatttttggtagagacgggg

SEQ ID NO: 683375 - DNA, 22 bp, Artificial Sequence
  chemically synthesized
gtatttttggtagagacggggt

SEQ ID NO: 683376 - DNA, 22 bp, Artificial Sequence
  chemically synthesized
tatttttggtagagacggggtt

SEQ ID NO: 683377 - DNA, 22 bp, Artificial Sequence
  chemically synthesized
ttggtagagacggggtttcacc

SEQ ID NO: 683378 - DNA, 22 bp, Artificial Sequence
  chemically synthesized
tggtagagacggggtttcacca

SEQ ID NO: 683379 - DNA, 22 bp, Artificial Sequence
  chemically synthesized
ggtagagacggggtttcaccat

SEQ ID NO: 683380 - DNA, 22 bp, Artificial Sequence
  chemically synthesized
gtagagacggggtttcaccatg

SEQ ID NO: 683381 - DNA, 22 bp, Artificial Sequence
  chemically synthesized
gacaccagcccggccaacatgg

SEQ ID NO: 683382 - DNA, 22 bp, Artificial Sequence
  chemically synthesized
caccatgttggccgggctggtg

SEQ ID NO: 683383 - DNA, 22 bp, Artificial Sequence
  chemically synthesized
accatgttggccgggctggtgt

SEQ ID NO: 683384 - DNA, 22 bp, Artificial Sequence
  chemically synthesized
gaggtcaggagttcgacaccag

SEQ ID NO: 683385 - DNA, 22 bp, Artificial Sequence
  chemically synthesized
gccgggctggtgtcgaactcct

SEQ ID NO: 683386 - DNA, 22 bp, Artificial Sequence
  chemically synthesized
atcactagaggtcaggagttcg

SEQ ID NO: 683387 - DNA, 22 bp, Artificial Sequence
  chemically synthesized
gtgtcgaactcctgacctctag

SEQ ID NO: 683388 - DNA, 22 bp, Artificial Sequence
  chemically synthesized
ggaggccaaggtgggctgatca

SEQ ID NO: 683389 - DNA, 22 bp, Artificial Sequence
  chemically synthesized
ctgacctctagtgatcagccca

SEQ ID NO: 683390 - DNA, 22 bp, Artificial Sequence
  chemically synthesized
gggaggccaaggtgggctgatc

SEQ ID NO: 683391 - DNA, 22 bp, Artificial Sequence
  chemically synthesized
tgggaggccaaggtgggctgat

SEQ ID NO: 683392 - DNA, 22 bp, Artificial Sequence
  chemically synthesized
acctctagtgatcagcccacct

SEQ ID NO: 683393 - DNA, 22 bp, Artificial Sequence
  chemically synthesized
cactttgggaggccaaggtggg

SEQ ID NO: 683394 - DNA, 22 bp, Artificial Sequence
  chemically synthesized
tagtgatcagcccaccttggcc

SEQ ID NO: 683395 - DNA, 22 bp, Artificial Sequence
  chemically synthesized
gtgatcagcccaccttggcctc

SEQ ID NO: 683396 - DNA, 22 bp, Artificial Sequence
  chemically synthesized
taatccctacactttgggaggc

SEQ ID NO: 683397 - DNA, 22 bp, Artificial Sequence
  chemically synthesized
acacctgtaatccctacacttt

SEQ ID NO: 683398 - DNA, 22 bp, Artificial Sequence
  chemically synthesized
ggcctcccaaagtgtagggatt

SEQ ID NO: 683399 - DNA, 22 bp, Artificial Sequence
  chemically synthesized
gcctcccaaagtgtagggatta

SEQ ID NO: 683400 - DNA, 22 bp, Artificial Sequence
  chemically synthesized
ccaaagtgtagggattacaggt

SEQ ID NO: 683401 - DNA, 22 bp, Artificial Sequence
  chemically synthesized
ggcatggtggctcacacctgta

SEQ ID NO: 683402 - DNA, 22 bp, Artificial Sequence
  chemically synthesized
gctgggcatggtggctcacacc

SEQ ID NO: 683403 - DNA, 22 bp, Artificial Sequence
  chemically synthesized
tggctgggcatggtggctcaca

SEQ ID NO: 683404 - DNA, 22 bp, Artificial Sequence
  chemically synthesized
tgttctggctgggcatggtggc

SEQ ID NO: 683405 - DNA, 22 bp, Artificial Sequence
  chemically synthesized
caggtgtgagccaccatgccca

SEQ ID NO: 683406 - DNA, 22 bp, Artificial Sequence
  chemically synthesized
aaagctgtgttctggctgggca

SEQ ID NO: 683407 - DNA, 22 bp, Artificial Sequence
  chemically synthesized
caaagctgtgttctggctgggc

SEQ ID NO: 683408 - DNA, 22 bp, Artificial Sequence
  chemically synthesized
tgatcttcaaagctgtgttctg

SEQ ID NO: 683409 - DNA, 22 bp, Artificial Sequence
  chemically synthesized
ataaccacatcatgcactgtga

SEQ ID NO: 683410 - DNA, 22 bp, Artificial Sequence
  chemically synthesized
cataaccacatcatgcactgtg

SEQ ID NO: 683411 - DNA, 22 bp, Artificial Sequence
  chemically synthesized
tcataaccacatcatgcactgt

SEQ ID NO: 683412 - DNA, 22 bp, Artificial Sequence
  chemically synthesized
tgaagatcacagtgcatgatgt

SEQ ID NO: 683413 - DNA, 22 bp, Artificial Sequence
  chemically synthesized
gaagatcacagtgcatgatgtg

SEQ ID NO: 683414 - DNA, 22 bp, Artificial Sequence
  chemically synthesized
aagatcacagtgcatgatgtgg

SEQ ID NO: 683415 - DNA, 22 bp, Artificial Sequence
  chemically synthesized
gtgggtatgcatagcaaaattt

SEQ ID NO: 683416 - DNA, 22 bp, Artificial Sequence
  chemically synthesized
tggtgggtatgcatagcaaaat

SEQ ID NO: 683417 - DNA, 22 bp, Artificial Sequence
  chemically synthesized
attctggtgggtatgcatagca

SEQ ID NO: 683418 - DNA, 22 bp, Artificial Sequence
  chemically synthesized
tgaaaattttgctatgcatacc

SEQ ID NO: 683419 - DNA, 22 bp, Artificial Sequence
  chemically synthesized
ctcattctggtgggtatgcata

SEQ ID NO: 683420 - DNA, 22 bp, Artificial Sequence
  chemically synthesized
gctcattctggtgggtatgcat

SEQ ID NO: 683421 - DNA, 22 bp, Artificial Sequence
  chemically synthesized
tcttgctcattctggtgggtat

SEQ ID NO: 683422 - DNA, 22 bp, Artificial Sequence
  chemically synthesized
gtcttgctcattctggtgggta

SEQ ID NO: 683423 - DNA, 22 bp, Artificial Sequence
  chemically synthesized
tgctatgcatacccaccagaat

SEQ ID NO: 683424 - DNA, 22 bp, Artificial Sequence
  chemically synthesized
tttgtcttgctcattctggtgg

SEQ ID NO: 683425 - DNA, 22 bp, Artificial Sequence
  chemically synthesized
gctatgcatacccaccagaatg

SEQ ID NO: 683426 - DNA, 22 bp, Artificial Sequence
  chemically synthesized
ctatgcatacccaccagaatga

SEQ ID NO: 683427 - DNA, 22 bp, Artificial Sequence
  chemically synthesized
tgcatacccaccagaatgagca

SEQ ID NO: 683428 - DNA, 22 bp, Artificial Sequence
  chemically synthesized
tgttgtttgtcttgctcattct

SEQ ID NO: 683429 - DNA, 22 bp, Artificial Sequence
  chemically synthesized
accctgtgttgtttgtcttgct

SEQ ID NO: 683430 - DNA, 22 bp, Artificial Sequence
  chemically synthesized
taaccctgtgttgtttgtcttg

SEQ ID NO: 683431 - DNA, 22 bp, Artificial Sequence
  chemically synthesized
ctaaccctgtgttgtttgtctt

SEQ ID NO: 683432 - DNA, 22 bp, Artificial Sequence
  chemically synthesized
tctaaccctgtgttgtttgtct

SEQ ID NO: 683433 - DNA, 22 bp, Artificial Sequence
  chemically synthesized
cacatcctttctaaccctgtgt

SEQ ID NO: 683434 - DNA, 22 bp, Artificial Sequence
  chemically synthesized
ctccacatcctttctaaccctg

SEQ ID NO: 683435 - DNA, 22 bp, Artificial Sequence
  chemically synthesized
tagttgctccacatcctttcta

SEQ ID NO: 683436 - DNA, 22 bp, Artificial Sequence
  chemically synthesized
gaaaggatgtggagcaactaca

SEQ ID NO: 683437 - DNA, 22 bp, Artificial Sequence
  chemically synthesized
acagagcatgagagttgtagtt

SEQ ID NO: 683438 - DNA, 22 bp, Artificial Sequence
  chemically synthesized
ctaacagagcatgagagttgta

SEQ ID NO: 683439 - DNA, 22 bp, Artificial Sequence
  chemically synthesized
ctactaacagagcatgagagtt

SEQ ID NO: 683440 - DNA, 22 bp, Artificial Sequence
  chemically synthesized
cactcctactaacagagcatga

SEQ ID NO: 683441 - DNA, 22 bp, Artificial Sequence
  chemically synthesized
gcactcctactaacagagcatg

SEQ ID NO: 683442 - DNA, 22 bp, Artificial Sequence
  chemically synthesized
caactctcatgctctgttagta

SEQ ID NO: 683443 - DNA, 22 bp, Artificial Sequence
  chemically synthesized
taccagtttgcactcctactaa

SEQ ID NO: 683444 - DNA, 22 bp, Artificial Sequence
  chemically synthesized
tcatgctctgttagtaggagtg

SEQ ID NO: 683445 - DNA, 22 bp, Artificial Sequence
  chemically synthesized
atgctctgttagtaggagtgca

SEQ ID NO: 683446 - DNA, 22 bp, Artificial Sequence
  chemically synthesized
tgttagtaggagtgcaaactgg

SEQ ID NO: 683447 - DNA, 22 bp, Artificial Sequence
  chemically synthesized
caatgtggttgtaccagtttgc

SEQ ID NO: 683448 - DNA, 22 bp, Artificial Sequence
  chemically synthesized
ttagtaggagtgcaaactggta

SEQ ID NO: 683449 - DNA, 22 bp, Artificial Sequence
  chemically synthesized
ccaatgtggttgtaccagtttg

SEQ ID NO: 683450 - DNA, 22 bp, Artificial Sequence
  chemically synthesized
tccaatgtggttgtaccagttt

SEQ ID NO: 683451 - DNA, 22 bp, Artificial Sequence
  chemically synthesized
gtaggagtgcaaactggtacaa

SEQ ID NO: 683452 - DNA, 22 bp, Artificial Sequence
  chemically synthesized
caaacagttttccaatgtggtt

SEQ ID NO: 683453 - DNA, 22 bp, Artificial Sequence
  chemically synthesized
ccaaacagttttccaatgtggt

SEQ ID NO: 683454 - DNA, 22 bp, Artificial Sequence
  chemically synthesized
ttccaaacagttttccaatgtg

SEQ ID NO: 683455 - DNA, 22 bp, Artificial Sequence
  chemically synthesized
gtacaaccacattggaaaactg

SEQ ID NO: 683456 - DNA, 22 bp, Artificial Sequence
  chemically synthesized
tacattcttccaaacagttttc

SEQ ID NO: 683457 - DNA, 22 bp, Artificial Sequence
  chemically synthesized
tgtacattcttccaaacagttt

SEQ ID NO: 683458 - DNA, 22 bp, Artificial Sequence
  chemically synthesized
ctgtacattcttccaaacagtt

SEQ ID NO: 683459 - DNA, 22 bp, Artificial Sequence
  chemically synthesized
agcttctgtacattcttccaaa

SEQ ID NO: 683460 - DNA, 22 bp, Artificial Sequence
  chemically synthesized
gaaaactgtttggaagaatgta

SEQ ID NO: 683461 - DNA, 22 bp, Artificial Sequence
  chemically synthesized
tgtgtgttcagcttctgtacat

SEQ ID NO: 683462 - DNA, 22 bp, Artificial Sequence
  chemically synthesized
tttggaagaatgtacagaagct

SEQ ID NO: 683463 - DNA, 22 bp, Artificial Sequence
  chemically synthesized
ggaagaatgtacagaagctgaa

SEQ ID NO: 683464 - DNA, 22 bp, Artificial Sequence
  chemically synthesized
gaagaatgtacagaagctgaac

SEQ ID NO: 683465 - DNA, 22 bp, Artificial Sequence
  chemically synthesized
tagggtctgtgtgtgttcagct

SEQ ID NO: 683466 - DNA, 22 bp, Artificial Sequence
  chemically synthesized
ggttatagggtctgtgtgtgtt

SEQ ID NO: 683467 - DNA, 22 bp, Artificial Sequence
  chemically synthesized
tgggttatagggtctgtgtgtg

SEQ ID NO: 683468 - DNA, 22 bp, Artificial Sequence
  chemically synthesized
ctgggttatagggtctgtgtgt

SEQ ID NO: 683469 - DNA, 22 bp, Artificial Sequence
  chemically synthesized
aacacacacagaccctataacc

SEQ ID NO: 683470 - DNA, 22 bp, Artificial Sequence
  chemically synthesized
tatcaaggggtagaatttctgg

SEQ ID NO: 683471 - DNA, 22 bp, Artificial Sequence
  chemically synthesized
aggactatatcaaggggtagaa

SEQ ID NO: 683472 - DNA, 22 bp, Artificial Sequence
  chemically synthesized
taacccagaaattctacccctt

SEQ ID NO: 683473 - DNA, 22 bp, Artificial Sequence
  chemically synthesized
gaggactatatcaaggggtaga

SEQ ID NO: 683474 - DNA, 22 bp, Artificial Sequence
  chemically synthesized
tgaggactatatcaaggggtag

SEQ ID NO: 683475 - DNA, 22 bp, Artificial Sequence
  chemically synthesized
ctttgaggactatatcaagggg

SEQ ID NO: 683476 - DNA, 22 bp, Artificial Sequence
  chemically synthesized
taccccttgatatagtcctcaa

SEQ ID NO: 683477 - DNA, 22 bp, Artificial Sequence
  chemically synthesized
ccccttgatatagtcctcaaag

SEQ ID NO: 683478 - DNA, 22 bp, Artificial Sequence
  chemically synthesized
gatatagtcctcaaaggaatgc

SEQ ID NO: 683479 - DNA, 22 bp, Artificial Sequence
  chemically synthesized
atatagtcctcaaaggaatgca

SEQ ID NO: 683480 - DNA, 22 bp, Artificial Sequence
  chemically synthesized
atgaatatatgtatgcattcct

SEQ ID NO: 683481 - DNA, 22 bp, Artificial Sequence
  chemically synthesized
gatgaatatatgtatgcattcc

SEQ ID NO: 683482 - DNA, 22 bp, Artificial Sequence
  chemically synthesized
aaaggaatgcatacatatattc

SEQ ID NO: 683483 - DNA, 22 bp, Artificial Sequence
  chemically synthesized
agacatgccatttgatgaatat

SEQ ID NO: 683484 - DNA, 22 bp, Artificial Sequence
  chemically synthesized
taagacatgccatttgatgaat

SEQ ID NO: 683485 - DNA, 22 bp, Artificial Sequence
  chemically synthesized
taaacattctaagacatgccat

SEQ ID NO: 683486 - DNA, 22 bp, Artificial Sequence
  chemically synthesized
atcaaatggcatgtcttagaat

SEQ ID NO: 683487 - DNA, 22 bp, Artificial Sequence
  chemically synthesized
gtagaaaaaaatgatgttataa

SEQ ID NO: 683488 - DNA, 22 bp, Artificial Sequence
  chemically synthesized
ggtagaaaaaaatgatgttata

SEQ ID NO: 683489 - DNA, 22 bp, Artificial Sequence
  chemically synthesized
agaatgtttataacatcatttt

SEQ ID NO: 683490 - DNA, 22 bp, Artificial Sequence
  chemically synthesized
gaatgtttataacatcattttt

SEQ ID NO: 683491 - DNA, 22 bp, Artificial Sequence
  chemically synthesized
ataacatcatttttttctacca

SEQ ID NO: 683492 - DNA, 22 bp, Artificial Sequence
  chemically synthesized
tggatgggcatttggtagaaaa

SEQ ID NO: 683493 - DNA, 22 bp, Artificial Sequence
  chemically synthesized
taacatcatttttttctaccaa

SEQ ID NO: 683494 - DNA, 22 bp, Artificial Sequence
  chemically synthesized
ctgtggatgggcatttggtaga

SEQ ID NO: 683495 - DNA, 22 bp, Artificial Sequence
  chemically synthesized
tactgtggatgggcatttggta

SEQ ID NO: 683496 - DNA, 22 bp, Artificial Sequence
  chemically synthesized
ttttctaccaaatgcccatcca

SEQ ID NO: 683497 - DNA, 22 bp, Artificial Sequence
  chemically synthesized
tatactctactgtggatgggca

SEQ ID NO: 683498 - DNA, 22 bp, Artificial Sequence
  chemically synthesized
tttctaccaaatgcccatccac

SEQ ID NO: 683499 - DNA, 22 bp, Artificial Sequence
  chemically synthesized
ttctaccaaatgcccatccaca

SEQ ID NO: 683500 - DNA, 22 bp, Artificial Sequence
  chemically synthesized
tctaccaaatgcccatccacag

SEQ ID NO: 683501 - DNA, 22 bp, Artificial Sequence
  chemically synthesized
ctaccaaatgcccatccacagt

SEQ ID NO: 683502 - DNA, 22 bp, Artificial Sequence
  chemically synthesized
taccaaatgcccatccacagta

SEQ ID NO: 683503 - DNA, 22 bp, Artificial Sequence
  chemically synthesized
ccaaatgcccatccacagtaga

SEQ ID NO: 683504 - DNA, 22 bp, Artificial Sequence
  chemically synthesized
cagtatattatatactctactg

SEQ ID NO: 683505 - DNA, 22 bp, Artificial Sequence
  chemically synthesized
tgtcaatatcctgcagtatatt

SEQ ID NO: 683506 - DNA, 22 bp, Artificial Sequence
  chemically synthesized
tgtaatatcccattgtgtcaat

SEQ ID NO: 683507 - DNA, 22 bp, Artificial Sequence
  chemically synthesized
ctatgtaatatcccattgtgtc

SEQ ID NO: 683508 - DNA, 22 bp, Artificial Sequence
  chemically synthesized
caggatattgacacaatgggat

SEQ ID NO: 683509 - DNA, 22 bp, Artificial Sequence
  chemically synthesized
attgctatgtaatatcccattg

SEQ ID NO: 683510 - DNA, 22 bp, Artificial Sequence
  chemically synthesized
taattgctatgtaatatcccat

SEQ ID NO: 683511 - DNA, 22 bp, Artificial Sequence
  chemically synthesized
attctaattgctatgtaatatc

SEQ ID NO: 683512 - DNA, 22 bp, Artificial Sequence
  chemically synthesized
acacaatgggatattacatagc

SEQ ID NO: 683513 - DNA, 22 bp, Artificial Sequence
  chemically synthesized
ttcattctaattgctatgtaat

SEQ ID NO: 683514 - DNA, 22 bp, Artificial Sequence
  chemically synthesized
catagcaattagaatgaacaat

SEQ ID NO: 683515 - DNA, 22 bp, Artificial Sequence
  chemically synthesized
tatgaagtggtggattgttcat

SEQ ID NO: 683516 - DNA, 22 bp, Artificial Sequence
  chemically synthesized
ttgtatgaagtggtggattgtt

SEQ ID NO: 683517 - DNA, 22 bp, Artificial Sequence
  chemically synthesized
gaatgaacaatccaccacttca

SEQ ID NO: 683518 - DNA, 22 bp, Artificial Sequence
  chemically synthesized
atccatgctgttgtatgaagtg

SEQ ID NO: 683519 - DNA, 22 bp, Artificial Sequence
  chemically synthesized
gattcatccatgctgttgtatg

SEQ ID NO: 683520 - DNA, 22 bp, Artificial Sequence
  chemically synthesized
aacctggattcatccatgctgt

SEQ ID NO: 683521 - DNA, 22 bp, Artificial Sequence
  chemically synthesized
aaacctggattcatccatgctg

SEQ ID NO: 683522 - DNA, 22 bp, Artificial Sequence
  chemically synthesized
taaacctggattcatccatgct

SEQ ID NO: 683523 - DNA, 22 bp, Artificial Sequence
  chemically synthesized
tttaaacctggattcatccatg

SEQ ID NO: 683524 - DNA, 22 bp, Artificial Sequence
  chemically synthesized
ctttaaacctggattcatccat

SEQ ID NO: 683525 - DNA, 22 bp, Artificial Sequence
  chemically synthesized
catacaacagcatggatgaatc

SEQ ID NO: 683526 - DNA, 22 bp, Artificial Sequence
  chemically synthesized
atacaacagcatggatgaatcc

SEQ ID NO: 683527 - DNA, 22 bp, Artificial Sequence
  chemically synthesized
acttctttaaacctggattcat

SEQ ID NO: 683528 - DNA, 22 bp, Artificial Sequence
  chemically synthesized
tgtctgacttctttaaacctgg

SEQ ID NO: 683529 - DNA, 22 bp, Artificial Sequence
  chemically synthesized
gtgtctgacttctttaaacctg

SEQ ID NO: 683530 - DNA, 22 bp, Artificial Sequence
  chemically synthesized
tgtgtctgacttctttaaacct

SEQ ID NO: 683531 - DNA, 22 bp, Artificial Sequence
  chemically synthesized
ttgtgtctgacttctttaaacc

SEQ ID NO: 683532 - DNA, 22 bp, Artificial Sequence
  chemically synthesized
ttttgtgtctgacttctttaaa

SEQ ID NO: 683533 - DNA, 22 bp, Artificial Sequence
  chemically synthesized
cacagcatgtactcttttgtgt

SEQ ID NO: 683534 - DNA, 22 bp, Artificial Sequence
  chemically synthesized
aaagaagtcagacacaaaagag

SEQ ID NO: 683535 - DNA, 22 bp, Artificial Sequence
  chemically synthesized
aagaagtcagacacaaaagagt

SEQ ID NO: 683536 - DNA, 22 bp, Artificial Sequence
  chemically synthesized
tataaatgaaattgcacagcat

SEQ ID NO: 683537 - DNA, 22 bp, Artificial Sequence
  chemically synthesized
atataaatgaaattgcacagca

SEQ ID NO: 683538 - DNA, 22 bp, Artificial Sequence
  chemically synthesized
tatataaatgaaattgcacagc

SEQ ID NO: 683539 - DNA, 22 bp, Artificial Sequence
  chemically synthesized
tcctttatataaatgaaattgc

SEQ ID NO: 683540 - DNA, 22 bp, Artificial Sequence
  chemically synthesized
gtcctttatataaatgaaattg

SEQ ID NO: 683541 - DNA, 22 bp, Artificial Sequence
  chemically synthesized
ttgtcctttatataaatgaaat

SEQ ID NO: 683542 - DNA, 22 bp, Artificial Sequence
  chemically synthesized
ttcttgtcctttatataaatga

SEQ ID NO: 683543 - DNA, 22 bp, Artificial Sequence
  chemically synthesized
tgcaatttcatttatataaagg

SEQ ID NO: 683544 - DNA, 22 bp, Artificial Sequence
  chemically synthesized
gcctgttcttgtcctttatata

SEQ ID NO: 683545 - DNA, 22 bp, Artificial Sequence
  chemically synthesized
tggcctgttcttgtcctttata

SEQ ID NO: 683546 - DNA, 22 bp, Artificial Sequence
  chemically synthesized
catttatataaaggacaagaac

SEQ ID NO: 683547 - DNA, 22 bp, Artificial Sequence
  chemically synthesized
atttatataaaggacaagaaca

SEQ ID NO: 683548 - DNA, 22 bp, Artificial Sequence
  chemically synthesized
aatattctggcctgttcttgtc

SEQ ID NO: 683549 - DNA, 22 bp, Artificial Sequence
  chemically synthesized
atataaaggacaagaacaggcc

SEQ ID NO: 683550 - DNA, 22 bp, Artificial Sequence
  chemically synthesized
tataaaggacaagaacaggcca

SEQ ID NO: 683551 - DNA, 22 bp, Artificial Sequence
  chemically synthesized
aacaccattaaatattctggcc

SEQ ID NO: 683552 - DNA, 22 bp, Artificial Sequence
  chemically synthesized
gaacaccattaaatattctggc

SEQ ID NO: 683553 - DNA, 22 bp, Artificial Sequence
  chemically synthesized
tgaacaccattaaatattctgg

SEQ ID NO: 683554 - DNA, 22 bp, Artificial Sequence
  chemically synthesized
attttgaacaccattaaatatt

SEQ ID NO: 683555 - DNA, 22 bp, Artificial Sequence
  chemically synthesized
gattttgaacaccattaaatat

SEQ ID NO: 683556 - DNA, 22 bp, Artificial Sequence
  chemically synthesized
aatggtgttcaaaatcaagatt

SEQ ID NO: 683557 - DNA, 22 bp, Artificial Sequence
  chemically synthesized
atggtgttcaaaatcaagattg

SEQ ID NO: 683558 - DNA, 22 bp, Artificial Sequence
  chemically synthesized
caagggtaaccacaatcttgat

SEQ ID NO: 683559 - DNA, 22 bp, Artificial Sequence
  chemically synthesized
tcctccaagggtaaccacaatc

SEQ ID NO: 683560 - DNA, 22 bp, Artificial Sequence
  chemically synthesized
aaaatcaagattgtggttaccc

SEQ ID NO: 683561 - DNA, 22 bp, Artificial Sequence
  chemically synthesized
cctgtcctccaagggtaaccac

SEQ ID NO: 683562 - DNA, 22 bp, Artificial Sequence
  chemically synthesized
atagttacctgtcctccaaggg

SEQ ID NO: 683563 - DNA, 22 bp, Artificial Sequence
  chemically synthesized
tgatagttacctgtcctccaag

SEQ ID NO: 683564 - DNA, 22 bp, Artificial Sequence
  chemically synthesized
ctgatagttacctgtcctccaa

SEQ ID NO: 683565 - DNA, 22 bp, Artificial Sequence
  chemically synthesized
tggttacccttggaggacaggt

SEQ ID NO: 683566 - DNA, 22 bp, Artificial Sequence
  chemically synthesized
cccttggaggacaggtaactat

SEQ ID NO: 683567 - DNA, 22 bp, Artificial Sequence
  chemically synthesized
tgtgcccttctgatagttacct

SEQ ID NO: 683568 - DNA, 22 bp, Artificial Sequence
  chemically synthesized
gtgtgcccttctgatagttacc

SEQ ID NO: 683569 - DNA, 22 bp, Artificial Sequence
  chemically synthesized
tgtgtgcccttctgatagttac

SEQ ID NO: 683570 - DNA, 22 bp, Artificial Sequence
  chemically synthesized
ggaggacaggtaactatcagaa

SEQ ID NO: 683571 - DNA, 22 bp, Artificial Sequence
  chemically synthesized
gaggacaggtaactatcagaag

SEQ ID NO: 683572 - DNA, 22 bp, Artificial Sequence
  chemically synthesized
gaaggccctttgtgtgcccttc

SEQ ID NO: 683573 - DNA, 22 bp, Artificial Sequence
  chemically synthesized
agaaggccctttgtgtgccctt

SEQ ID NO: 683574 - DNA, 22 bp, Artificial Sequence
  chemically synthesized
tagaaggccctttgtgtgccct

SEQ ID NO: 683575 - DNA, 22 bp, Artificial Sequence
  chemically synthesized
tcagaagggcacacaaagggcc

SEQ ID NO: 683576 - DNA, 22 bp, Artificial Sequence
  chemically synthesized
ccaacctttagaaggccctttg

SEQ ID NO: 683577 - DNA, 22 bp, Artificial Sequence
  chemically synthesized
ctaaaggttggtaatgttctgt

SEQ ID NO: 683578 - DNA, 22 bp, Artificial Sequence
  chemically synthesized
taaaggttggtaatgttctgtt

SEQ ID NO: 683579 - DNA, 22 bp, Artificial Sequence
  chemically synthesized
aaggttggtaatgttctgtttc

SEQ ID NO: 683580 - DNA, 22 bp, Artificial Sequence
  chemically synthesized
accagcatccaaataaagaaac

SEQ ID NO: 683581 - DNA, 22 bp, Artificial Sequence
  chemically synthesized
aaccagcatccaaataaagaaa

SEQ ID NO: 683582 - DNA, 22 bp, Artificial Sequence
  chemically synthesized
gtaatgttctgtttctttattt

SEQ ID NO: 683583 - DNA, 22 bp, Artificial Sequence
  chemically synthesized
atttaaccagcatccaaataaa

SEQ ID NO: 683584 - DNA, 22 bp, Artificial Sequence
  chemically synthesized
tgtttctttatttggatgctgg

SEQ ID NO: 683585 - DNA, 22 bp, Artificial Sequence
  chemically synthesized
tttctttatttggatgctggtt

SEQ ID NO: 683586 - DNA, 22 bp, Artificial Sequence
  chemically synthesized
aacacactcatttaaccagcat

SEQ ID NO: 683587 - DNA, 22 bp, Artificial Sequence
  chemically synthesized
ctttatttggatgctggttaaa

SEQ ID NO: 683588 - DNA, 22 bp, Artificial Sequence
  chemically synthesized
tttatttggatgctggttaaat

SEQ ID NO: 683589 - DNA, 22 bp, Artificial Sequence
  chemically synthesized
tatttggatgctggttaaatga

SEQ ID NO: 683590 - DNA, 22 bp, Artificial Sequence
  chemically synthesized
atttggatgctggttaaatgag

SEQ ID NO: 683591 - DNA, 22 bp, Artificial Sequence
  chemically synthesized
tttggatgctggttaaatgagt

SEQ ID NO: 683592 - DNA, 22 bp, Artificial Sequence
  chemically synthesized
acaatctgaacacactcattta

SEQ ID NO: 683593 - DNA, 22 bp, Artificial Sequence
  chemically synthesized
cacaatctgaacacactcattt

SEQ ID NO: 683594 - DNA, 22 bp, Artificial Sequence
  chemically synthesized
ggatgctggttaaatgagtgtg

SEQ ID NO: 683595 - DNA, 22 bp, Artificial Sequence
  chemically synthesized
tcacaatctgaacacactcatt

SEQ ID NO: 683596 - DNA, 22 bp, Artificial Sequence
  chemically synthesized
gatgctggttaaatgagtgtgt

SEQ ID NO: 683597 - DNA, 22 bp, Artificial Sequence
  chemically synthesized
gttaaatgagtgtgttcagatt

SEQ ID NO: 683598 - DNA, 22 bp, Artificial Sequence
  chemically synthesized
agtgaattttcacaatctgaac

SEQ ID NO: 683599 - DNA, 22 bp, Artificial Sequence
  chemically synthesized
aatgagtgtgttcagattgtga

SEQ ID NO: 683600 - DNA, 22 bp, Artificial Sequence
  chemically synthesized
tacagttcagtgaattttcaca

SEQ ID NO: 683601 - DNA, 22 bp, Artificial Sequence
  chemically synthesized
atacagttcagtgaattttcac

SEQ ID NO: 683602 - DNA, 22 bp, Artificial Sequence
  chemically synthesized
aacttatacagttcagtgaatt

SEQ ID NO: 683603 - DNA, 22 bp, Artificial Sequence
  chemically synthesized
aaacttatacagttcagtgaat

SEQ ID NO: 683604 - DNA, 22 bp, Artificial Sequence
  chemically synthesized
agattgtgaaaattcactgaac

SEQ ID NO: 683605 - DNA, 22 bp, Artificial Sequence
  chemically synthesized
tgaaaattcactgaactgtata

SEQ ID NO: 683606 - DNA, 22 bp, Artificial Sequence
  chemically synthesized
actgaactgtataagtttaagc

SEQ ID NO: 683607 - DNA, 22 bp, Artificial Sequence
  chemically synthesized
aactgtataagtttaagccatt

SEQ ID NO: 683608 - DNA, 22 bp, Artificial Sequence
  chemically synthesized
aaaaaaaagaaaaaatggctta

SEQ ID NO: 683609 - DNA, 22 bp, Artificial Sequence
  chemically synthesized
tataagtttaagccattttttc

SEQ ID NO: 683610 - DNA, 22 bp, Artificial Sequence
  chemically synthesized
tcaattaaaaaaaaagaaaaaa

SEQ ID NO: 683611 - DNA, 22 bp, Artificial Sequence
  chemically synthesized
gtcaattaaaaaaaaagaaaaa

SEQ ID NO: 683612 - DNA, 22 bp, Artificial Sequence
  chemically synthesized
tttgtcaattaaaaaaaaagaa

SEQ ID NO: 683613 - DNA, 22 bp, Artificial Sequence
  chemically synthesized
atttgtcaattaaaaaaaaaga

SEQ ID NO: 683614 - DNA, 22 bp, Artificial Sequence
  chemically synthesized
aagccattttttcttttttttt

SEQ ID NO: 683615 - DNA, 22 bp, Artificial Sequence
  chemically synthesized
tatttgtcaattaaaaaaaaag

SEQ ID NO: 683616 - DNA, 22 bp, Artificial Sequence
  chemically synthesized
agccattttttcttttttttta

SEQ ID NO: 683617 - DNA, 22 bp, Artificial Sequence
  chemically synthesized
ttatttgtcaattaaaaaaaaa

SEQ ID NO: 683618 - DNA, 22 bp, Artificial Sequence
  chemically synthesized
tttctttttttttaattgacaa

SEQ ID NO: 683619 - DNA, 22 bp, Artificial Sequence
  chemically synthesized
ttctttttttttaattgacaaa

SEQ ID NO: 683620 - DNA, 22 bp, Artificial Sequence
  chemically synthesized
tctttttttttaattgacaaat

SEQ ID NO: 683621 - DNA, 22 bp, Artificial Sequence
  chemically synthesized
ctttttttttaattgacaaata

SEQ ID NO: 683622 - DNA, 22 bp, Artificial Sequence
  chemically synthesized
tttttttttaattgacaaataa

SEQ ID NO: 683623 - DNA, 22 bp, Artificial Sequence
  chemically synthesized
tttttttaattgacaaataaaa

SEQ ID NO: 683624 - DNA, 22 bp, Artificial Sequence
  chemically synthesized
ttttttaattgacaaataaaaa

SEQ ID NO: 683625 - DNA, 22 bp, Artificial Sequence
  chemically synthesized
tttttaattgacaaataaaaat

SEQ ID NO: 683626 - DNA, 22 bp, Artificial Sequence
  chemically synthesized
ttttaattgacaaataaaaatt

SEQ ID NO: 683627 - DNA, 22 bp, Artificial Sequence
  chemically synthesized
tttaattgacaaataaaaattg

SEQ ID NO: 683628 - DNA, 22 bp, Artificial Sequence
  chemically synthesized
ttaattgacaaataaaaattgt

SEQ ID NO: 683629 - DNA, 22 bp, Artificial Sequence
  chemically synthesized
taattgacaaataaaaattgta

SEQ ID NO: 683630 - DNA, 22 bp, Artificial Sequence
  chemically synthesized
aattgacaaataaaaattgtat

SEQ ID NO: 683631 - DNA, 22 bp, Artificial Sequence
  chemically synthesized
attgacaaataaaaattgtata

SEQ ID NO: 683632 - DNA, 22 bp, Artificial Sequence
  chemically synthesized
tacatgataaagatatacaatt

SEQ ID NO: 683633 - DNA, 22 bp, Artificial Sequence
  chemically synthesized
acaaataaaaattgtatatctt

SEQ ID NO: 683634 - DNA, 22 bp, Artificial Sequence
  chemically synthesized
aaaacatgttatacatgataaa

SEQ ID NO: 683635 - DNA, 22 bp, Artificial Sequence
  chemically synthesized
caaaacatgttatacatgataa

SEQ ID NO: 683636 - DNA, 22 bp, Artificial Sequence
  chemically synthesized
tatatctttatcatgtataaca

SEQ ID NO: 683637 - DNA, 22 bp, Artificial Sequence
  chemically synthesized
tatcatgtataacatgttttga

SEQ ID NO: 683638 - DNA, 22 bp, Artificial Sequence
  chemically synthesized
atcatgtataacatgttttgaa

SEQ ID NO: 683639 - DNA, 22 bp, Artificial Sequence
  chemically synthesized
tcatgtataacatgttttgaaa

SEQ ID NO: 683640 - DNA, 22 bp, Artificial Sequence
  chemically synthesized
cacagtgtatacatatttcaaa

SEQ ID NO: 683641 - DNA, 22 bp, Artificial Sequence
  chemically synthesized
gccattccacagtgtatacata

SEQ ID NO: 683642 - DNA, 22 bp, Artificial Sequence
  chemically synthesized
agccattccacagtgtatacat

SEQ ID NO: 683643 - DNA, 22 bp, Artificial Sequence
  chemically synthesized
gtttagccattccacagtgtat

SEQ ID NO: 683644 - DNA, 22 bp, Artificial Sequence
  chemically synthesized
ggtttagccattccacagtgta

SEQ ID NO: 683645 - DNA, 22 bp, Artificial Sequence
  chemically synthesized
tgaaatatgtatacactgtgga

SEQ ID NO: 683646 - DNA, 22 bp, Artificial Sequence
  chemically synthesized
gaaatatgtatacactgtggaa

SEQ ID NO: 683647 - DNA, 22 bp, Artificial Sequence
  chemically synthesized
aaatatgtatacactgtggaat

SEQ ID NO: 683648 - DNA, 22 bp, Artificial Sequence
  chemically synthesized
gcttggtttagccattccacag

SEQ ID NO: 683649 - DNA, 22 bp, Artificial Sequence
  chemically synthesized
agcttggtttagccattccaca

SEQ ID NO: 683650 - DNA, 22 bp, Artificial Sequence
  chemically synthesized
cttagcttggtttagccattcc

SEQ ID NO: 683651 - DNA, 22 bp, Artificial Sequence
  chemically synthesized
tggaatggctaaaccaagctaa

SEQ ID NO: 683652 - DNA, 22 bp, Artificial Sequence
  chemically synthesized
aaccaagctaagtaacatatgc

SEQ ID NO: 683653 - DNA, 22 bp, Artificial Sequence
  chemically synthesized
agtaacatatgcattacctcat

SEQ ID NO: 683654 - DNA, 22 bp, Artificial Sequence
  chemically synthesized
tcaccataagaaatgataagta

SEQ ID NO: 683655 - DNA, 22 bp, Artificial Sequence
  chemically synthesized
cctcatatacttatcatttctt

SEQ ID NO: 683656 - DNA, 22 bp, Artificial Sequence
  chemically synthesized
agtattatcaccataagaaatg

SEQ ID NO: 683657 - DNA, 22 bp, Artificial Sequence
  chemically synthesized
aagtattatcaccataagaaat

SEQ ID NO: 683658 - DNA, 22 bp, Artificial Sequence
  chemically synthesized
atatacttatcatttcttatgg

SEQ ID NO: 683659 - DNA, 22 bp, Artificial Sequence
  chemically synthesized
atcatttcttatggtgataata

SEQ ID NO: 683660 - DNA, 22 bp, Artificial Sequence
  chemically synthesized
tcatttcttatggtgataatac

SEQ ID NO: 683661 - DNA, 22 bp, Artificial Sequence
  chemically synthesized
agagagtagatttaagtattat

SEQ ID NO: 683662 - DNA, 22 bp, Artificial Sequence
  chemically synthesized
cttatggtgataatacttaaat

SEQ ID NO: 683663 - DNA, 22 bp, Artificial Sequence
  chemically synthesized
ctaagagagtagatttaagtat

SEQ ID NO: 683664 - DNA, 22 bp, Artificial Sequence
  chemically synthesized
ttatggtgataatacttaaatc

SEQ ID NO: 683665 - DNA, 22 bp, Artificial Sequence
  chemically synthesized
atggtgataatacttaaatcta

SEQ ID NO: 683666 - DNA, 22 bp, Artificial Sequence
  chemically synthesized
tggtgataatacttaaatctac

SEQ ID NO: 683667 - DNA, 22 bp, Artificial Sequence
  chemically synthesized
aaaattgctaagagagtagatt

SEQ ID NO: 683668 - DNA, 22 bp, Artificial Sequence
  chemically synthesized
gaaaattgctaagagagtagat

SEQ ID NO: 683669 - DNA, 22 bp, Artificial Sequence
  chemically synthesized
aaatctactctcttagcaattt

SEQ ID NO: 683670 - DNA, 22 bp, Artificial Sequence
  chemically synthesized
gtatagtcttgaaaattgctaa

SEQ ID NO: 683671 - DNA, 22 bp, Artificial Sequence
  chemically synthesized
aatctactctcttagcaatttt

SEQ ID NO: 683672 - DNA, 22 bp, Artificial Sequence
  chemically synthesized
ctctcttagcaattttcaagac

SEQ ID NO: 683673 - DNA, 22 bp, Artificial Sequence
  chemically synthesized
tcttagcaattttcaagactat

SEQ ID NO: 683674 - DNA, 22 bp, Artificial Sequence
  chemically synthesized
ttagcaattttcaagactatac

SEQ ID NO: 683675 - DNA, 22 bp, Artificial Sequence
  chemically synthesized
agcaattttcaagactatacta

SEQ ID NO: 683676 - DNA, 22 bp, Artificial Sequence
  chemically synthesized
gcaattttcaagactatactag

SEQ ID NO: 683677 - DNA, 22 bp, Artificial Sequence
  chemically synthesized
taggtaatgaaaatctagtata

SEQ ID NO: 683678 - DNA, 22 bp, Artificial Sequence
  chemically synthesized
tcaagactatactagattttca

SEQ ID NO: 683679 - DNA, 22 bp, Artificial Sequence
  chemically synthesized
caagactatactagattttcat

SEQ ID NO: 683680 - DNA, 22 bp, Artificial Sequence
  chemically synthesized
aagactatactagattttcatt

SEQ ID NO: 683681 - DNA, 22 bp, Artificial Sequence
  chemically synthesized
tactagattttcattacctata

SEQ ID NO: 683682 - DNA, 22 bp, Artificial Sequence
  chemically synthesized
tacaccatggtgactataggta

SEQ ID NO: 683683 - DNA, 22 bp, Artificial Sequence
  chemically synthesized
gattttcattacctatagtcac

SEQ ID NO: 683684 - DNA, 22 bp, Artificial Sequence
  chemically synthesized
ttgtacaccatggtgactatag

SEQ ID NO: 683685 - DNA, 22 bp, Artificial Sequence
  chemically synthesized
tattgtacaccatggtgactat

SEQ ID NO: 683686 - DNA, 22 bp, Artificial Sequence
  chemically synthesized
tcattacctatagtcaccatgg

SEQ ID NO: 683687 - DNA, 22 bp, Artificial Sequence
  chemically synthesized
cattacctatagtcaccatggt

SEQ ID NO: 683688 - DNA, 22 bp, Artificial Sequence
  chemically synthesized
attacctatagtcaccatggtg

SEQ ID NO: 683689 - DNA, 22 bp, Artificial Sequence
  chemically synthesized
aagagctctattgtacaccatg

SEQ ID NO: 683690 - DNA, 22 bp, Artificial Sequence
  chemically synthesized
cctatagtcaccatggtgtaca

SEQ ID NO: 683691 - DNA, 22 bp, Artificial Sequence
  chemically synthesized
tagtcaccatggtgtacaatag

SEQ ID NO: 683692 - DNA, 22 bp, Artificial Sequence
  chemically synthesized
ggaggaataagttcaagagctc

SEQ ID NO: 683693 - DNA, 22 bp, Artificial Sequence
  chemically synthesized
ggttaggaggaataagttcaag

SEQ ID NO: 683694 - DNA, 22 bp, Artificial Sequence
  chemically synthesized
cggttaggaggaataagttcaa

SEQ ID NO: 683695 - DNA, 22 bp, Artificial Sequence
  chemically synthesized
ttgaacttattcctcctaaccg

SEQ ID NO: 683696 - DNA, 22 bp, Artificial Sequence
  chemically synthesized
gaacttattcctcctaaccgaa

SEQ ID NO: 683697 - DNA, 22 bp, Artificial Sequence
  chemically synthesized
aacttattcctcctaaccgaag

SEQ ID NO: 683698 - DNA, 22 bp, Artificial Sequence
  chemically synthesized
aaggatatgaaacttcggttag

SEQ ID NO: 683699 - DNA, 22 bp, Artificial Sequence
  chemically synthesized
gttaaaggatatgaaacttcgg

SEQ ID NO: 683700 - DNA, 22 bp, Artificial Sequence
  chemically synthesized
attcctcctaaccgaagtttca

SEQ ID NO: 683701 - DNA, 22 bp, Artificial Sequence
  chemically synthesized
ttcctcctaaccgaagtttcat

SEQ ID NO: 683702 - DNA, 22 bp, Artificial Sequence
  chemically synthesized
ctcctaaccgaagtttcatatc

SEQ ID NO: 683703 - DNA, 22 bp, Artificial Sequence
  chemically synthesized
ctaaccgaagtttcatatcctt

SEQ ID NO: 683704 - DNA, 22 bp, Artificial Sequence
  chemically synthesized
accgaagtttcatatcctttaa

SEQ ID NO: 683705 - DNA, 22 bp, Artificial Sequence
  chemically synthesized
catatcctttaaccagcatctc

SEQ ID NO: 683706 - DNA, 22 bp, Artificial Sequence
  chemically synthesized
atatcctttaaccagcatctcc

SEQ ID NO: 683707 - DNA, 22 bp, Artificial Sequence
  chemically synthesized
ggcatgtagaaaataagggaga

SEQ ID NO: 683708 - DNA, 22 bp, Artificial Sequence
  chemically synthesized
taaccagcatctcccttatttt

SEQ ID NO: 683709 - DNA, 22 bp, Artificial Sequence
  chemically synthesized
aaccagcatctcccttattttc

SEQ ID NO: 683710 - DNA, 22 bp, Artificial Sequence
  chemically synthesized
accagcatctcccttattttct

SEQ ID NO: 683711 - DNA, 22 bp, Artificial Sequence
  chemically synthesized
aaatatattaggcatgtagaaa

SEQ ID NO: 683712 - DNA, 22 bp, Artificial Sequence
  chemically synthesized
ctgaaatatattaggcatgtag

SEQ ID NO: 683713 - DNA, 22 bp, Artificial Sequence
  chemically synthesized
actgaaatatattaggcatgta

SEQ ID NO: 683714 - DNA, 22 bp, Artificial Sequence
  chemically synthesized
tactgaaatatattaggcatgt

SEQ ID NO: 683715 - DNA, 22 bp, Artificial Sequence
  chemically synthesized
ccttattttctacatgcctaat

SEQ ID NO: 683716 - DNA, 22 bp, Artificial Sequence
  chemically synthesized
ttactgaaatatattaggcatg

SEQ ID NO: 683717 - DNA, 22 bp, Artificial Sequence
  chemically synthesized
tttactgaaatatattaggcat

SEQ ID NO: 683718 - DNA, 22 bp, Artificial Sequence
  chemically synthesized
ttttactgaaatatattaggca

SEQ ID NO: 683719 - DNA, 22 bp, Artificial Sequence
  chemically synthesized
attttctacatgcctaatatat

SEQ ID NO: 683720 - DNA, 22 bp, Artificial Sequence
  chemically synthesized
ttttctacatgcctaatatatt

SEQ ID NO: 683721 - DNA, 22 bp, Artificial Sequence
  chemically synthesized
tctacatgcctaatatatttca

SEQ ID NO: 683722 - DNA, 22 bp, Artificial Sequence
  chemically synthesized
ctacatgcctaatatatttcag

SEQ ID NO: 683723 - DNA, 22 bp, Artificial Sequence
  chemically synthesized
tacatgcctaatatatttcagt

SEQ ID NO: 683724 - DNA, 22 bp, Artificial Sequence
  chemically synthesized
aaacacttttttactgaaatat

SEQ ID NO: 683725 - DNA, 22 bp, Artificial Sequence
  chemically synthesized
aaaacacttttttactgaaata

SEQ ID NO: 683726 - DNA, 22 bp, Artificial Sequence
  chemically synthesized
catgcctaatatatttcagtaa

SEQ ID NO: 683727 - DNA, 22 bp, Artificial Sequence
  chemically synthesized
taaaacacttttttactgaaat

SEQ ID NO: 683728 - DNA, 22 bp, Artificial Sequence
  chemically synthesized
ttaaaacacttttttactgaaa

SEQ ID NO: 683729 - DNA, 22 bp, Artificial Sequence
  chemically synthesized
atatatttcagtaaaaaagtgt

SEQ ID NO: 683730 - DNA, 22 bp, Artificial Sequence
  chemically synthesized
tacccaccttttaaaacacttt

SEQ ID NO: 683731 - DNA, 22 bp, Artificial Sequence
  chemically synthesized
cagtaaaaaagtgttttaaaag

SEQ ID NO: 683732 - DNA, 22 bp, Artificial Sequence
  chemically synthesized
agtaaaaaagtgttttaaaagg

SEQ ID NO: 683733 - DNA, 22 bp, Artificial Sequence
  chemically synthesized
caaaggccacaaccaaattata

SEQ ID NO: 683734 - DNA, 22 bp, Artificial Sequence
  chemically synthesized
taaaaggtgggtataatttggt

SEQ ID NO: 683735 - DNA, 22 bp, Artificial Sequence
  chemically synthesized
aaaaggtgggtataatttggtt

SEQ ID NO: 683736 - DNA, 22 bp, Artificial Sequence
  chemically synthesized
aaaggtgggtataatttggttg

SEQ ID NO: 683737 - DNA, 22 bp, Artificial Sequence
  chemically synthesized
acatctacaaaggccacaacca

SEQ ID NO: 683738 - DNA, 22 bp, Artificial Sequence
  chemically synthesized
gacatctacaaaggccacaacc

SEQ ID NO: 683739 - DNA, 22 bp, Artificial Sequence
  chemically synthesized
tgacatctacaaaggccacaac

SEQ ID NO: 683740 - DNA, 22 bp, Artificial Sequence
  chemically synthesized
ctttgacatctacaaaggccac

SEQ ID NO: 683741 - DNA, 22 bp, Artificial Sequence
  chemically synthesized
gctttgacatctacaaaggcca

SEQ ID NO: 683742 - DNA, 22 bp, Artificial Sequence
  chemically synthesized
tgctttgacatctacaaaggcc

SEQ ID NO: 683743 - DNA, 22 bp, Artificial Sequence
  chemically synthesized
ttgctttgacatctacaaaggc

SEQ ID NO: 683744 - DNA, 22 bp, Artificial Sequence
  chemically synthesized
ttttgctttgacatctacaaag

SEQ ID NO: 683745 - DNA, 22 bp, Artificial Sequence
  chemically synthesized
cttttgctttgacatctacaaa

SEQ ID NO: 683746 - DNA, 22 bp, Artificial Sequence
  chemically synthesized
tcttttgctttgacatctacaa

SEQ ID NO: 683747 - DNA, 22 bp, Artificial Sequence
  chemically synthesized
ggttgtggcctttgtagatgtc

SEQ ID NO: 683748 - DNA, 22 bp, Artificial Sequence
  chemically synthesized
ttcttttgctttgacatctaca

SEQ ID NO: 683749 - DNA, 22 bp, Artificial Sequence
  chemically synthesized
gttgtggcctttgtagatgtca

SEQ ID NO: 683750 - DNA, 22 bp, Artificial Sequence
  chemically synthesized
tttcttttgctttgacatctac

SEQ ID NO: 683751 - DNA, 22 bp, Artificial Sequence
  chemically synthesized
tggcctttgtagatgtcaaagc

SEQ ID NO: 683752 - DNA, 22 bp, Artificial Sequence
  chemically synthesized
tattttttcttttgctttgaca

SEQ ID NO: 683753 - DNA, 22 bp, Artificial Sequence
  chemically synthesized
atattttttcttttgctttgac

SEQ ID NO: 683754 - DNA, 22 bp, Artificial Sequence
  chemically synthesized
tatattttttcttttgctttga

SEQ ID NO: 683755 - DNA, 22 bp, Artificial Sequence
  chemically synthesized
ttatattttttcttttgctttg

SEQ ID NO: 683756 - DNA, 22 bp, Artificial Sequence
  chemically synthesized
tgtagatgtcaaagcaaaagaa

SEQ ID NO: 683757 - DNA, 22 bp, Artificial Sequence
  chemically synthesized
cttttatattttttcttttgct

SEQ ID NO: 683758 - DNA, 22 bp, Artificial Sequence
  chemically synthesized
gtagatgtcaaagcaaaagaaa

SEQ ID NO: 683759 - DNA, 22 bp, Artificial Sequence
  chemically synthesized
ccttttatattttttcttttgc

SEQ ID NO: 683760 - DNA, 22 bp, Artificial Sequence
  chemically synthesized
tagatgtcaaagcaaaagaaaa

SEQ ID NO: 683761 - DNA, 22 bp, Artificial Sequence
  chemically synthesized
tcaataatccaaataataaaat

SEQ ID NO: 683762 - DNA, 22 bp, Artificial Sequence
  chemically synthesized
atcaataatccaaataataaaa

SEQ ID NO: 683763 - DNA, 22 bp, Artificial Sequence
  chemically synthesized
cttatcaataatccaaataata

SEQ ID NO: 683764 - DNA, 22 bp, Artificial Sequence
  chemically synthesized
ctccttatcaataatccaaata

SEQ ID NO: 683765 - DNA, 22 bp, Artificial Sequence
  chemically synthesized
cctccttatcaataatccaaat

SEQ ID NO: 683766 - DNA, 22 bp, Artificial Sequence
  chemically synthesized
tcctccttatcaataatccaaa

SEQ ID NO: 683767 - DNA, 22 bp, Artificial Sequence
  chemically synthesized
tttcctccttatcaataatcca

SEQ ID NO: 683768 - DNA, 22 bp, Artificial Sequence
  chemically synthesized
tattatttggattattgataag

SEQ ID NO: 683769 - DNA, 22 bp, Artificial Sequence
  chemically synthesized
cactctttcctccttatcaata

SEQ ID NO: 683770 - DNA, 22 bp, Artificial Sequence
  chemically synthesized
attatttggattattgataagg

SEQ ID NO: 683771 - DNA, 22 bp, Artificial Sequence
  chemically synthesized
acactctttcctccttatcaat

SEQ ID NO: 683772 - DNA, 22 bp, Artificial Sequence
  chemically synthesized
ttatttggattattgataagga

SEQ ID NO: 683773 - DNA, 22 bp, Artificial Sequence
  chemically synthesized
tttggattattgataaggagga

SEQ ID NO: 683774 - DNA, 22 bp, Artificial Sequence
  chemically synthesized
acttacactctttcctccttat

SEQ ID NO: 683775 - DNA, 22 bp, Artificial Sequence
  chemically synthesized
cacttacactctttcctcctta

SEQ ID NO: 683776 - DNA, 22 bp, Artificial Sequence
  chemically synthesized
ggattattgataaggaggaaag

SEQ ID NO: 683777 - DNA, 22 bp, Artificial Sequence
  chemically synthesized
gattattgataaggaggaaaga

SEQ ID NO: 683778 - DNA, 22 bp, Artificial Sequence
  chemically synthesized
tttcacttacactctttcctcc

SEQ ID NO: 683779 - DNA, 22 bp, Artificial Sequence
  chemically synthesized
gtttcacttacactctttcctc

SEQ ID NO: 683780 - DNA, 22 bp, Artificial Sequence
  chemically synthesized
tgtttcacttacactctttcct

SEQ ID NO: 683781 - DNA, 22 bp, Artificial Sequence
  chemically synthesized
ttgataaggaggaaagagtgta

SEQ ID NO: 683782 - DNA, 22 bp, Artificial Sequence
  chemically synthesized
ctttgtttcacttacactcttt

SEQ ID NO: 683783 - DNA, 22 bp, Artificial Sequence
  chemically synthesized
cctttgtttcacttacactctt

SEQ ID NO: 683784 - DNA, 22 bp, Artificial Sequence
  chemically synthesized
tcctttgtttcacttacactct

SEQ ID NO: 683785 - DNA, 22 bp, Artificial Sequence
  chemically synthesized
ataaggaggaaagagtgtaagt

SEQ ID NO: 683786 - DNA, 22 bp, Artificial Sequence
  chemically synthesized
gattttcctttgtttcacttac

SEQ ID NO: 683787 - DNA, 22 bp, Artificial Sequence
  chemically synthesized
ggattttcctttgtttcactta

SEQ ID NO: 683788 - DNA, 22 bp, Artificial Sequence
  chemically synthesized
cagacttggattttcctttgtt

SEQ ID NO: 683789 - DNA, 22 bp, Artificial Sequence
  chemically synthesized
agtcattccagacttggatttt

SEQ ID NO: 683790 - DNA, 22 bp, Artificial Sequence
  chemically synthesized
aatctaagtcattccagacttg

SEQ ID NO: 683791 - DNA, 22 bp, Artificial Sequence
  chemically synthesized
ttcaatctaagtcattccagac

SEQ ID NO: 683792 - DNA, 22 bp, Artificial Sequence
  chemically synthesized
attcaatctaagtcattccaga

SEQ ID NO: 683793 - DNA, 22 bp, Artificial Sequence
  chemically synthesized
tttattcaatctaagtcattcc

SEQ ID NO: 683794 - DNA, 22 bp, Artificial Sequence
  chemically synthesized
gaatgacttagattgaataaac

SEQ ID NO: 683795 - DNA, 22 bp, Artificial Sequence
  chemically synthesized
gatcccatgcagatctgtttat

SEQ ID NO: 683796 - DNA, 22 bp, Artificial Sequence
  chemically synthesized
agatcccatgcagatctgttta

SEQ ID NO: 683797 - DNA, 22 bp, Artificial Sequence
  chemically synthesized
agattgaataaacagatctgca

SEQ ID NO: 683798 - DNA, 22 bp, Artificial Sequence
  chemically synthesized
gattgaataaacagatctgcat

SEQ ID NO: 683799 - DNA, 22 bp, Artificial Sequence
  chemically synthesized
ccaccttagatcccatgcagat

SEQ ID NO: 683800 - DNA, 22 bp, Artificial Sequence
  chemically synthesized
aataaacagatctgcatgggat

SEQ ID NO: 683801 - DNA, 22 bp, Artificial Sequence
  chemically synthesized
catgggatctaaggtgggagac

SEQ ID NO: 683802 - DNA, 22 bp, Artificial Sequence
  chemically synthesized
aaagtcgacaccatgcagtgtc

SEQ ID NO: 683803 - DNA, 22 bp, Artificial Sequence
  chemically synthesized
tgaaagtcgacaccatgcagtg

SEQ ID NO: 683804 - DNA, 22 bp, Artificial Sequence
  chemically synthesized
ctgaaagtcgacaccatgcagt

SEQ ID NO: 683805 - DNA, 22 bp, Artificial Sequence
  chemically synthesized
aggtgggagacactgcatggtg

SEQ ID NO: 683806 - DNA, 22 bp, Artificial Sequence
  chemically synthesized
tctgaaagtcgacaccatgcag

SEQ ID NO: 683807 - DNA, 22 bp, Artificial Sequence
  chemically synthesized
ttctgaaagtcgacaccatgca

SEQ ID NO: 683808 - DNA, 22 bp, Artificial Sequence
  chemically synthesized
aagggatttttctgaaagtcga

SEQ ID NO: 683809 - DNA, 22 bp, Artificial Sequence
  chemically synthesized
ctgaagggatttttctgaaagt

SEQ ID NO: 683810 - DNA, 22 bp, Artificial Sequence
  chemically synthesized
catggtgtcgactttcagaaaa

SEQ ID NO: 683811 - DNA, 22 bp, Artificial Sequence
  chemically synthesized
aaaactgctgaagggatttttc

SEQ ID NO: 683812 - DNA, 22 bp, Artificial Sequence
  chemically synthesized
tcagaaaaatcccttcagcagt

SEQ ID NO: 683813 - DNA, 22 bp, Artificial Sequence
  chemically synthesized
cagaaaaatcccttcagcagtt

SEQ ID NO: 683814 - DNA, 22 bp, Artificial Sequence
  chemically synthesized
agaaaaatcccttcagcagttt

SEQ ID NO: 683815 - DNA, 22 bp, Artificial Sequence
  chemically synthesized
tgtcgaggggcactgaaaactg

SEQ ID NO: 683816 - DNA, 22 bp, Artificial Sequence
  chemically synthesized
atgtcgaggggcactgaaaact

SEQ ID NO: 683817 - DNA, 22 bp, Artificial Sequence
  chemically synthesized
gcttatgtcgaggggcactgaa

SEQ ID NO: 683818 - DNA, 22 bp, Artificial Sequence
  chemically synthesized
ctggcttatgtcgaggggcact

SEQ ID NO: 683819 - DNA, 22 bp, Artificial Sequence
  chemically synthesized
cagcagttttcagtgcccctcg

SEQ ID NO: 683820 - DNA, 22 bp, Artificial Sequence
  chemically synthesized
agcagttttcagtgcccctcga

SEQ ID NO: 683821 - DNA, 22 bp, Artificial Sequence
  chemically synthesized
tcagtgcccctcgacataagcc

SEQ ID NO: 683822 - DNA, 22 bp, Artificial Sequence
  chemically synthesized
cagtgcccctcgacataagcca

SEQ ID NO: 683823 - DNA, 22 bp, Artificial Sequence
  chemically synthesized
agtgcccctcgacataagccag

SEQ ID NO: 683824 - DNA, 22 bp, Artificial Sequence
  chemically synthesized
ggcatcatgttcctggcttatg

SEQ ID NO: 683825 - DNA, 22 bp, Artificial Sequence
  chemically synthesized
gacataagccaggaacatgatg

SEQ ID NO: 683826 - DNA, 22 bp, Artificial Sequence
  chemically synthesized
aggtgtacctcggcatcatgtt

SEQ ID NO: 683827 - DNA, 22 bp, Artificial Sequence
  chemically synthesized
aactcaggtgtacctcggcatc

SEQ ID NO: 683828 - DNA, 22 bp, Artificial Sequence
  chemically synthesized
cctcaactcaggtgtacctcgg

SEQ ID NO: 683829 - DNA, 22 bp, Artificial Sequence
  chemically synthesized
gcccccataagattgcctcaac

SEQ ID NO: 683830 - DNA, 22 bp, Artificial Sequence
  chemically synthesized
ggcccccataagattgcctcaa

SEQ ID NO: 683831 - DNA, 22 bp, Artificial Sequence
  chemically synthesized
ccttggcccccataagattgcc

SEQ ID NO: 683832 - DNA, 22 bp, Artificial Sequence
  chemically synthesized
gccttggcccccataagattgc

SEQ ID NO: 683833 - DNA, 22 bp, Artificial Sequence
  chemically synthesized
tgccttggcccccataagattg

SEQ ID NO: 683834 - DNA, 22 bp, Artificial Sequence
  chemically synthesized
agttgaggcaatcttatggggg

SEQ ID NO: 683835 - DNA, 22 bp, Artificial Sequence
  chemically synthesized
gaccactttgccttggccccca

SEQ ID NO: 683836 - DNA, 22 bp, Artificial Sequence
  chemically synthesized
aggcaatcttatgggggccaag

SEQ ID NO: 683837 - DNA, 22 bp, Artificial Sequence
  chemically synthesized
agaccactttgccttggccccc

SEQ ID NO: 683838 - DNA, 22 bp, Artificial Sequence
  chemically synthesized
ttagaccactttgccttggccc

SEQ ID NO: 683839 - DNA, 22 bp, Artificial Sequence
  chemically synthesized
cattcttagaccactttgcctt

SEQ ID NO: 683840 - DNA, 22 bp, Artificial Sequence
  chemically synthesized
atgggggccaaggcaaagtggt

SEQ ID NO: 683841 - DNA, 22 bp, Artificial Sequence
  chemically synthesized
tgggggccaaggcaaagtggtc

SEQ ID NO: 683842 - DNA, 22 bp, Artificial Sequence
  chemically synthesized
aggccaggtcatcagaaagctg

SEQ ID NO: 683843 - DNA, 22 bp, Artificial Sequence
  chemically synthesized
agaatgcagctttctgatgacc

SEQ ID NO: 683844 - DNA, 22 bp, Artificial Sequence
  chemically synthesized
cacctcaggccaggtcatcaga

SEQ ID NO: 683845 - DNA, 22 bp, Artificial Sequence
  chemically synthesized
tctccacctcaggccaggtcat

SEQ ID NO: 683846 - DNA, 22 bp, Artificial Sequence
  chemically synthesized
atctccacctcaggccaggtca

SEQ ID NO: 683847 - DNA, 22 bp, Artificial Sequence
  chemically synthesized
tatctccacctcaggccaggtc

SEQ ID NO: 683848 - DNA, 22 bp, Artificial Sequence
  chemically synthesized
gttttatctccacctcaggcca

SEQ ID NO: 683849 - DNA, 22 bp, Artificial Sequence
  chemically synthesized
tctgatgacctggcctgaggtg

SEQ ID NO: 683850 - DNA, 22 bp, Artificial Sequence
  chemically synthesized
ctgatgacctggcctgaggtgg

SEQ ID NO: 683851 - DNA, 22 bp, Artificial Sequence
  chemically synthesized
tgatgacctggcctgaggtgga

SEQ ID NO: 683852 - DNA, 22 bp, Artificial Sequence
  chemically synthesized
atgacctggcctgaggtggaga

SEQ ID NO: 683853 - DNA, 22 bp, Artificial Sequence
  chemically synthesized
tagttagttttatctccacctc

SEQ ID NO: 683854 - DNA, 22 bp, Artificial Sequence
  chemically synthesized
gcctgaggtggagataaaacta

SEQ ID NO: 683855 - DNA, 22 bp, Artificial Sequence
  chemically synthesized
aaaaacactgtagttagtttta

SEQ ID NO: 683856 - DNA, 22 bp, Artificial Sequence
  chemically synthesized
gaaaaacactgtagttagtttt

SEQ ID NO: 683857 - DNA, 22 bp, Artificial Sequence
  chemically synthesized
aggtggagataaaactaactac

SEQ ID NO: 683858 - DNA, 22 bp, Artificial Sequence
  chemically synthesized
cagtttgaaaaacactgtagtt

SEQ ID NO: 683859 - DNA, 22 bp, Artificial Sequence
  chemically synthesized
atgacctgcagtttgaaaaaca

SEQ ID NO: 683860 - DNA, 22 bp, Artificial Sequence
  chemically synthesized
actacagtgtttttcaaactgc

SEQ ID NO: 683861 - DNA, 22 bp, Artificial Sequence
  chemically synthesized
agggttcatgacctgcagtttg

SEQ ID NO: 683862 - DNA, 22 bp, Artificial Sequence
  chemically synthesized
cagtgtttttcaaactgcaggt

SEQ ID NO: 683863 - DNA, 22 bp, Artificial Sequence
  chemically synthesized
ttcaaactgcaggtcatgaacc

SEQ ID NO: 683864 - DNA, 22 bp, Artificial Sequence
  chemically synthesized
tcaaactgcaggtcatgaaccc

SEQ ID NO: 683865 - DNA, 22 bp, Artificial Sequence
  chemically synthesized
atgacgtactaagggttcatga

SEQ ID NO: 683866 - DNA, 22 bp, Artificial Sequence
  chemically synthesized
caaactgcaggtcatgaaccct

SEQ ID NO: 683867 - DNA, 22 bp, Artificial Sequence
  chemically synthesized
catgacgtactaagggttcatg

SEQ ID NO: 683868 - DNA, 22 bp, Artificial Sequence
  chemically synthesized
aaactgcaggtcatgaaccctt

SEQ ID NO: 683869 - DNA, 22 bp, Artificial Sequence
  chemically synthesized
caggtcatgaacccttagtacg

SEQ ID NO: 683870 - DNA, 22 bp, Artificial Sequence
  chemically synthesized
tatagatttcatgacgtactaa

SEQ ID NO: 683871 - DNA, 22 bp, Artificial Sequence
  chemically synthesized
agtacgtcatgaaatctatata

SEQ ID NO: 683872 - DNA, 22 bp, Artificial Sequence
  chemically synthesized
gtaatgatccactatatagatt

SEQ ID NO: 683873 - DNA, 22 bp, Artificial Sequence
  chemically synthesized
gtacgtcatgaaatctatatag

SEQ ID NO: 683874 - DNA, 22 bp, Artificial Sequence
  chemically synthesized
agaacaatactggtaatgatcc

SEQ ID NO: 683875 - DNA, 22 bp, Artificial Sequence
  chemically synthesized
attaagaacaatactggtaatg

SEQ ID NO: 683876 - DNA, 22 bp, Artificial Sequence
  chemically synthesized
cattaagaacaatactggtaat

SEQ ID NO: 683877 - DNA, 22 bp, Artificial Sequence
  chemically synthesized
tatagtggatcattaccagtat

SEQ ID NO: 683878 - DNA, 22 bp, Artificial Sequence
  chemically synthesized
tttcattaagaacaatactggt

SEQ ID NO: 683879 - DNA, 22 bp, Artificial Sequence
  chemically synthesized
tgtttcattaagaacaatactg

SEQ ID NO: 683880 - DNA, 22 bp, Artificial Sequence
  chemically synthesized
ctgtttcattaagaacaatact

SEQ ID NO: 683881 - DNA, 22 bp, Artificial Sequence
  chemically synthesized
tctgtttcattaagaacaatac

SEQ ID NO: 683882 - DNA, 22 bp, Artificial Sequence
  chemically synthesized
ttctgtttcattaagaacaata

SEQ ID NO: 683883 - DNA, 22 bp, Artificial Sequence
  chemically synthesized
ttttctgtttcattaagaacaa

SEQ ID NO: 683884 - DNA, 22 bp, Artificial Sequence
  chemically synthesized
ttcttttctgtttcattaagaa

SEQ ID NO: 683885 - DNA, 22 bp, Artificial Sequence
  chemically synthesized
tattcttttctgtttcattaag

SEQ ID NO: 683886 - DNA, 22 bp, Artificial Sequence
  chemically synthesized
ccagtattgttcttaatgaaac

SEQ ID NO: 683887 - DNA, 22 bp, Artificial Sequence
  chemically synthesized
ctattcttttctgtttcattaa

SEQ ID NO: 683888 - DNA, 22 bp, Artificial Sequence
  chemically synthesized
tctattcttttctgtttcatta

SEQ ID NO: 683889 - DNA, 22 bp, Artificial Sequence
  chemically synthesized
ttcttaatgaaacagaaaagaa

SEQ ID NO: 683890 - DNA, 22 bp, Artificial Sequence
  chemically synthesized
tcatattttctattcttttctg

SEQ ID NO: 683891 - DNA, 22 bp, Artificial Sequence
  chemically synthesized
ttaatgaaacagaaaagaatag

SEQ ID NO: 683892 - DNA, 22 bp, Artificial Sequence
  chemically synthesized
aatgaaacagaaaagaatagaa

SEQ ID NO: 683893 - DNA, 22 bp, Artificial Sequence
  chemically synthesized
cactgtcatattttctattctt

SEQ ID NO: 683894 - DNA, 22 bp, Artificial Sequence
  chemically synthesized
atgaaacagaaaagaatagaaa

SEQ ID NO: 683895 - DNA, 22 bp, Artificial Sequence
  chemically synthesized
tacactgtcatattttctattc

SEQ ID NO: 683896 - DNA, 22 bp, Artificial Sequence
  chemically synthesized
caacctctacactgtcatattt

SEQ ID NO: 683897 - DNA, 22 bp, Artificial Sequence
  chemically synthesized
cccactccaacctctacactgt

SEQ ID NO: 683898 - DNA, 22 bp, Artificial Sequence
  chemically synthesized
ccccactccaacctctacactg

SEQ ID NO: 683899 - DNA, 22 bp, Artificial Sequence
  chemically synthesized
tccccactccaacctctacact

SEQ ID NO: 683900 - DNA, 22 bp, Artificial Sequence
  chemically synthesized
taacccattttccccactccaa

SEQ ID NO: 683901 - DNA, 22 bp, Artificial Sequence
  chemically synthesized
ataacccattttccccactcca

SEQ ID NO: 683902 - DNA, 22 bp, Artificial Sequence
  chemically synthesized
tataacccattttccccactcc

SEQ ID NO: 683903 - DNA, 22 bp, Artificial Sequence
  chemically synthesized
gagtggggaaaatgggttataa

SEQ ID NO: 683904 - DNA, 22 bp, Artificial Sequence
  chemically synthesized
tgagcatagtacccaataggta

SEQ ID NO: 683905 - DNA, 22 bp, Artificial Sequence
  chemically synthesized
taaaactacctattgggtacta

SEQ ID NO: 683906 - DNA, 22 bp, Artificial Sequence
  chemically synthesized
cccagattgtgagcatagtacc

SEQ ID NO: 683907 - DNA, 22 bp, Artificial Sequence
  chemically synthesized
ttacccagattgtgagcatagt

SEQ ID NO: 683908 - DNA, 22 bp, Artificial Sequence
  chemically synthesized
cctattgggtactatgctcaca

SEQ ID NO: 683909 - DNA, 22 bp, Artificial Sequence
  chemically synthesized
ttgggtactatgctcacaatct

SEQ ID NO: 683910 - DNA, 22 bp, Artificial Sequence
  chemically synthesized
atgacctgttacccagattgtg

SEQ ID NO: 683911 - DNA, 22 bp, Artificial Sequence
  chemically synthesized
ggtactatgctcacaatctggg

SEQ ID NO: 683912 - DNA, 22 bp, Artificial Sequence
  chemically synthesized
tgctcacaatctgggtaacagg

SEQ ID NO: 683913 - DNA, 22 bp, Artificial Sequence
  chemically synthesized
acaatctgggtaacaggtcatg

SEQ ID NO: 683914 - DNA, 22 bp, Artificial Sequence
  chemically synthesized
aggtgtggggctcatgacctgt

SEQ ID NO: 683915 - DNA, 22 bp, Artificial Sequence
  chemically synthesized
ggtaacaggtcatgagccccac

SEQ ID NO: 683916 - DNA, 22 bp, Artificial Sequence
  chemically synthesized
catgatgctaaggtgtggggct

SEQ ID NO: 683917 - DNA, 22 bp, Artificial Sequence
  chemically synthesized
catgggaacattgcatgatgct

SEQ ID NO: 683918 - DNA, 22 bp, Artificial Sequence
  chemically synthesized
ttacatgggaacattgcatgat

SEQ ID NO: 683919 - DNA, 22 bp, Artificial Sequence
  chemically synthesized
gttacatgggaacattgcatga

SEQ ID NO: 683920 - DNA, 22 bp, Artificial Sequence
  chemically synthesized
agcatcatgcaatgttcccatg

SEQ ID NO: 683921 - DNA, 22 bp, Artificial Sequence
  chemically synthesized
gcatcatgcaatgttcccatgt

SEQ ID NO: 683922 - DNA, 22 bp, Artificial Sequence
  chemically synthesized
ccatgtaacaaacctgtacatg

SEQ ID NO: 683923 - DNA, 22 bp, Artificial Sequence
  chemically synthesized
gatacaggaggtacatgtacag

SEQ ID NO: 683924 - DNA, 22 bp, Artificial Sequence
  chemically synthesized
agatacaggaggtacatgtaca

SEQ ID NO: 683925 - DNA, 22 bp, Artificial Sequence
  chemically synthesized
tagatacaggaggtacatgtac

SEQ ID NO: 683926 - DNA, 22 bp, Artificial Sequence
  chemically synthesized
ttttagatacaggaggtacatg

SEQ ID NO: 683927 - DNA, 22 bp, Artificial Sequence
  chemically synthesized
tattttagatacaggaggtaca

SEQ ID NO: 683928 - DNA, 22 bp, Artificial Sequence
  chemically synthesized
ctattttagatacaggaggtac

SEQ ID NO: 683929 - DNA, 22 bp, Artificial Sequence
  chemically synthesized
aacttctattttagatacagga

SEQ ID NO: 683930 - DNA, 22 bp, Artificial Sequence
  chemically synthesized
caacttctattttagatacagg

SEQ ID NO: 683931 - DNA, 22 bp, Artificial Sequence
  chemically synthesized
tacatgtacctcctgtatctaa

SEQ ID NO: 683932 - DNA, 22 bp, Artificial Sequence
  chemically synthesized
atttcaacttctattttagata

SEQ ID NO: 683933 - DNA, 22 bp, Artificial Sequence
  chemically synthesized
aatttcaacttctattttagat

SEQ ID NO: 683934 - DNA, 22 bp, Artificial Sequence
  chemically synthesized
taatttcaacttctattttaga

SEQ ID NO: 683935 - DNA, 22 bp, Artificial Sequence
  chemically synthesized
ttaatttcaacttctattttag

SEQ ID NO: 683936 - DNA, 22 bp, Artificial Sequence
  chemically synthesized
tttaatttcaacttctatttta

SEQ ID NO: 683937 - DNA, 22 bp, Artificial Sequence
  chemically synthesized
ttttaatttcaacttctatttt

SEQ ID NO: 683938 - DNA, 22 bp, Artificial Sequence
  chemically synthesized
tttttaatttcaacttctattt

SEQ ID NO: 683939 - DNA, 22 bp, Artificial Sequence
  chemically synthesized
ttttttaatttcaacttctatt

SEQ ID NO: 683940 - DNA, 22 bp, Artificial Sequence
  chemically synthesized
tttttttaatttcaacttctat

SEQ ID NO: 683941 - DNA, 22 bp, Artificial Sequence
  chemically synthesized
ctgtatctaaaatagaagttga

SEQ ID NO: 683942 - DNA, 22 bp, Artificial Sequence
  chemically synthesized
ttttttttaatttcaacttcta

SEQ ID NO: 683943 - DNA, 22 bp, Artificial Sequence
  chemically synthesized
tttttttttaatttcaacttct

SEQ ID NO: 683944 - DNA, 22 bp, Artificial Sequence
  chemically synthesized
ttttttttttaatttcaacttc

SEQ ID NO: 683945 - DNA, 22 bp, Artificial Sequence
  chemically synthesized
tatctaaaatagaagttgaaat

SEQ ID NO: 683946 - DNA, 22 bp, Artificial Sequence
  chemically synthesized
tttttttttttaatttcaactt

SEQ ID NO: 683947 - DNA, 22 bp, Artificial Sequence
  chemically synthesized
ttttttttttttaatttcaact

SEQ ID NO: 683948 - DNA, 22 bp, Artificial Sequence
  chemically synthesized
tttttttttttttaatttcaac

SEQ ID NO: 683949 - DNA, 22 bp, Artificial Sequence
  chemically synthesized
aaatagaagttgaaattaaaaa

SEQ ID NO: 683950 - DNA, 22 bp, Artificial Sequence
  chemically synthesized
atattttttttttttttttaat

SEQ ID NO: 683951 - DNA, 22 bp, Artificial Sequence
  chemically synthesized
catattttttttttttttttaa

SEQ ID NO: 683952 - DNA, 22 bp, Artificial Sequence
  chemically synthesized
tcatatttttttttttttttta

SEQ ID NO: 683953 - DNA, 22 bp, Artificial Sequence
  chemically synthesized
aaattaaaaaaaaaaaaaaaat

SEQ ID NO: 683954 - DNA, 22 bp, Artificial Sequence
  chemically synthesized
aaaaaaaaaaaaaaatatgaaa

SEQ ID NO: 683955 - DNA, 22 bp, Artificial Sequence
  chemically synthesized
cccataccaaatagtacacttt

SEQ ID NO: 683956 - DNA, 22 bp, Artificial Sequence
  chemically synthesized
acccataccaaatagtacactt

SEQ ID NO: 683957 - DNA, 22 bp, Artificial Sequence
  chemically synthesized
cttacccataccaaatagtaca

SEQ ID NO: 683958 - DNA, 22 bp, Artificial Sequence
  chemically synthesized
acaaaacattacttacccatac

SEQ ID NO: 683959 - DNA, 22 bp, Artificial Sequence
  chemically synthesized
cacaaaacattacttacccata

SEQ ID NO: 683960 - DNA, 22 bp, Artificial Sequence
  chemically synthesized
tttggtatgggtaagtaatgtt

SEQ ID NO: 683961 - DNA, 22 bp, Artificial Sequence
  chemically synthesized
ggtatgggtaagtaatgttttg

SEQ ID NO: 683962 - DNA, 22 bp, Artificial Sequence
  chemically synthesized
gtatgggtaagtaatgttttgt

SEQ ID NO: 683963 - DNA, 22 bp, Artificial Sequence
  chemically synthesized
aaagaaaagtttcacaaaacat

SEQ ID NO: 683964 - DNA, 22 bp, Artificial Sequence
  chemically synthesized
tatgattgaaagaaaagtttca

SEQ ID NO: 683965 - DNA, 22 bp, Artificial Sequence
  chemically synthesized
gtatgattgaaagaaaagtttc

SEQ ID NO: 683966 - DNA, 22 bp, Artificial Sequence
  chemically synthesized
atgcttgtatgattgaaagaaa

SEQ ID NO: 683967 - DNA, 22 bp, Artificial Sequence
  chemically synthesized
tgtgaaacttttctttcaatca

SEQ ID NO: 683968 - DNA, 22 bp, Artificial Sequence
  chemically synthesized
ttcatgcttgtatgattgaaag

SEQ ID NO: 683969 - DNA, 22 bp, Artificial Sequence
  chemically synthesized
gtgaaacttttctttcaatcat

SEQ ID NO: 683970 - DNA, 22 bp, Artificial Sequence
  chemically synthesized
tgaaacttttctttcaatcata

SEQ ID NO: 683971 - DNA, 22 bp, Artificial Sequence
  chemically synthesized
tctattcatgcttgtatgattg

SEQ ID NO: 683972 - DNA, 22 bp, Artificial Sequence
  chemically synthesized
tgtctattcatgcttgtatgat

SEQ ID NO: 683973 - DNA, 22 bp, Artificial Sequence
  chemically synthesized
ctgtctattcatgcttgtatga

SEQ ID NO: 683974 - DNA, 22 bp, Artificial Sequence
  chemically synthesized
tctgtctattcatgcttgtatg

SEQ ID NO: 683975 - DNA, 22 bp, Artificial Sequence
  chemically synthesized
ttctgtctattcatgcttgtat

SEQ ID NO: 683976 - DNA, 22 bp, Artificial Sequence
  chemically synthesized
ttctttcaatcatacaagcatg

SEQ ID NO: 683977 - DNA, 22 bp, Artificial Sequence
  chemically synthesized
tttctgtctattcatgcttgta

SEQ ID NO: 683978 - DNA, 22 bp, Artificial Sequence
  chemically synthesized
tctttcaatcatacaagcatga

SEQ ID NO: 683979 - DNA, 22 bp, Artificial Sequence
  chemically synthesized
ctttcaatcatacaagcatgaa

SEQ ID NO: 683980 - DNA, 22 bp, Artificial Sequence
  chemically synthesized
tttcaatcatacaagcatgaat

SEQ ID NO: 683981 - DNA, 22 bp, Artificial Sequence
  chemically synthesized
tcaatcatacaagcatgaatag

SEQ ID NO: 683982 - DNA, 22 bp, Artificial Sequence
  chemically synthesized
caatcatacaagcatgaataga

SEQ ID NO: 683983 - DNA, 22 bp, Artificial Sequence
  chemically synthesized
aatcatacaagcatgaatagac

SEQ ID NO: 683984 - DNA, 22 bp, Artificial Sequence
  chemically synthesized
taaatctttttctgtctattca

SEQ ID NO: 683985 - DNA, 22 bp, Artificial Sequence
  chemically synthesized
tatctgtaaatctttttctgtc

SEQ ID NO: 683986 - DNA, 22 bp, Artificial Sequence
  chemically synthesized
acagatatagatgcgtgtgtgc

SEQ ID NO: 683987 - DNA, 22 bp, Artificial Sequence
  chemically synthesized
cagatatagatgcgtgtgtgcg

SEQ ID NO: 683988 - DNA, 22 bp, Artificial Sequence
  chemically synthesized
gtacacacacacacgcacacac

SEQ ID NO: 683989 - DNA, 22 bp, Artificial Sequence
  chemically synthesized
tatgtcatcctggtacacacac

SEQ ID NO: 683990 - DNA, 22 bp, Artificial Sequence
  chemically synthesized
atatgtcatcctggtacacaca

SEQ ID NO: 683991 - DNA, 22 bp, Artificial Sequence
  chemically synthesized
tatatgtcatcctggtacacac

SEQ ID NO: 683992 - DNA, 22 bp, Artificial Sequence
  chemically synthesized
attttatatgtcatcctggtac

SEQ ID NO: 683993 - DNA, 22 bp, Artificial Sequence
  chemically synthesized
taaaaattaattttatatgtca

SEQ ID NO: 683994 - DNA, 22 bp, Artificial Sequence
  chemically synthesized
ccaatccactataaaaattaat

SEQ ID NO: 683995 - DNA, 22 bp, Artificial Sequence
  chemically synthesized
gccaatccactataaaaattaa

SEQ ID NO: 683996 - DNA, 22 bp, Artificial Sequence
  chemically synthesized
tgccaatccactataaaaatta

SEQ ID NO: 683997 - DNA, 22 bp, Artificial Sequence
  chemically synthesized
ttgccaatccactataaaaatt

SEQ ID NO: 683998 - DNA, 22 bp, Artificial Sequence
  chemically synthesized
tttgccaatccactataaaaat

SEQ ID NO: 683999 - DNA, 22 bp, Artificial Sequence
  chemically synthesized
ttttgccaatccactataaaaa

SEQ ID NO: 684000 - DNA, 22 bp, Artificial Sequence
  chemically synthesized
atcttttttgccaatccactat

SEQ ID NO: 684001 - DNA, 22 bp, Artificial Sequence
  chemically synthesized
catcttttttgccaatccacta

SEQ ID NO: 684002 - DNA, 22 bp, Artificial Sequence
  chemically synthesized
tcatcttttttgccaatccact

SEQ ID NO: 684003 - DNA, 22 bp, Artificial Sequence
  chemically synthesized
atttttatagtggattggcaaa

SEQ ID NO: 684004 - DNA, 22 bp, Artificial Sequence
  chemically synthesized
tagctttcatcttttttgccaa

SEQ ID NO: 684005 - DNA, 22 bp, Artificial Sequence
  chemically synthesized
ttatagtggattggcaaaaaag

SEQ ID NO: 684006 - DNA, 22 bp, Artificial Sequence
  chemically synthesized
tatagtggattggcaaaaaaga

SEQ ID NO: 684007 - DNA, 22 bp, Artificial Sequence
  chemically synthesized
atagtggattggcaaaaaagat

SEQ ID NO: 684008 - DNA, 22 bp, Artificial Sequence
  chemically synthesized
tagtggattggcaaaaaagatg

SEQ ID NO: 684009 - DNA, 22 bp, Artificial Sequence
  chemically synthesized
tgtagtaaagcctgtagctttc

SEQ ID NO: 684010 - DNA, 22 bp, Artificial Sequence
  chemically synthesized
gcaaaaaagatgaaagctacag

SEQ ID NO: 684011 - DNA, 22 bp, Artificial Sequence
  chemically synthesized
atgtagtaaagcctgtagcttt

SEQ ID NO: 684012 - DNA, 22 bp, Artificial Sequence
  chemically synthesized
tatgtagtaaagcctgtagctt

SEQ ID NO: 684013 - DNA, 22 bp, Artificial Sequence
  chemically synthesized
tttatgtagtaaagcctgtagc

SEQ ID NO: 684014 - DNA, 22 bp, Artificial Sequence
  chemically synthesized
ctttatgtagtaaagcctgtag

SEQ ID NO: 684015 - DNA, 22 bp, Artificial Sequence
  chemically synthesized
tccatttctttatgtagtaaag

SEQ ID NO: 684016 - DNA, 22 bp, Artificial Sequence
  chemically synthesized
gtccatttctttatgtagtaaa

SEQ ID NO: 684017 - DNA, 22 bp, Artificial Sequence
  chemically synthesized
caggctttactacataaagaaa

SEQ ID NO: 684018 - DNA, 22 bp, Artificial Sequence
  chemically synthesized
tactacataaagaaatggacaa

SEQ ID NO: 684019 - DNA, 22 bp, Artificial Sequence
  chemically synthesized
actacataaagaaatggacaaa

SEQ ID NO: 684020 - DNA, 22 bp, Artificial Sequence
  chemically synthesized
ctacataaagaaatggacaaac

SEQ ID NO: 684021 - DNA, 22 bp, Artificial Sequence
  chemically synthesized
cataaagaaatggacaaactat

SEQ ID NO: 684022 - DNA, 22 bp, Artificial Sequence
  chemically synthesized
tccagtgggcatgtatagtttg

SEQ ID NO: 684023 - DNA, 22 bp, Artificial Sequence
  chemically synthesized
taatgatgcatgattgtccagt

SEQ ID NO: 684024 - DNA, 22 bp, Artificial Sequence
  chemically synthesized
tacatgcccactggacaatcat

SEQ ID NO: 684025 - DNA, 22 bp, Artificial Sequence
  chemically synthesized
gagaaattataatgatgcatga

SEQ ID NO: 684026 - DNA, 22 bp, Artificial Sequence
  chemically synthesized
gtctagagaaattataatgatg

SEQ ID NO: 684027 - DNA, 22 bp, Artificial Sequence
  chemically synthesized
gacaatcatgcatcattataat

SEQ ID NO: 684028 - DNA, 22 bp, Artificial Sequence
  chemically synthesized
caaatcctagtctagagaaatt

SEQ ID NO: 684029 - DNA, 22 bp, Artificial Sequence
  chemically synthesized
ccaaatcctagtctagagaaat

SEQ ID NO: 684030 - DNA, 22 bp, Artificial Sequence
  chemically synthesized
tccaaatcctagtctagagaaa

SEQ ID NO: 684031 - DNA, 22 bp, Artificial Sequence
  chemically synthesized
tttccaaatcctagtctagaga

SEQ ID NO: 684032 - DNA, 22 bp, Artificial Sequence
  chemically synthesized
ctttccaaatcctagtctagag

SEQ ID NO: 684033 - DNA, 22 bp, Artificial Sequence
  chemically synthesized
taatttctctagactaggattt

SEQ ID NO: 684034 - DNA, 22 bp, Artificial Sequence
  chemically synthesized
cgtcaacttctttccaaatcct

SEQ ID NO: 684035 - DNA, 22 bp, Artificial Sequence
  chemically synthesized
ccgtcaacttctttccaaatcc

SEQ ID NO: 684036 - DNA, 22 bp, Artificial Sequence
  chemically synthesized
ctctagactaggatttggaaag

SEQ ID NO: 684037 - DNA, 22 bp, Artificial Sequence
  chemically synthesized
tctagactaggatttggaaaga

SEQ ID NO: 684038 - DNA, 22 bp, Artificial Sequence
  chemically synthesized
tcttccgtcaacttctttccaa

SEQ ID NO: 684039 - DNA, 22 bp, Artificial Sequence
  chemically synthesized
tagactaggatttggaaagaag

SEQ ID NO: 684040 - DNA, 22 bp, Artificial Sequence
  chemically synthesized
gactaggatttggaaagaagtt

SEQ ID NO: 684041 - DNA, 22 bp, Artificial Sequence
  chemically synthesized
caaactgtcttccgtcaacttc

SEQ ID NO: 684042 - DNA, 22 bp, Artificial Sequence
  chemically synthesized
ggatttggaaagaagttgacgg

SEQ ID NO: 684043 - DNA, 22 bp, Artificial Sequence
  chemically synthesized
ggaaagaagttgacggaagaca

SEQ ID NO: 684044 - DNA, 22 bp, Artificial Sequence
  chemically synthesized
gaaagaagttgacggaagacag

SEQ ID NO: 684045 - DNA, 22 bp, Artificial Sequence
  chemically synthesized
ccagggaataagactgcaaact

SEQ ID NO: 684046 - DNA, 22 bp, Artificial Sequence
  chemically synthesized
accagggaataagactgcaaac

SEQ ID NO: 684047 - DNA, 22 bp, Artificial Sequence
  chemically synthesized
acggaagacagtttgcagtctt

SEQ ID NO: 684048 - DNA, 22 bp, Artificial Sequence
  chemically synthesized
cagcccttaccagggaataaga

SEQ ID NO: 684049 - DNA, 22 bp, Artificial Sequence
  chemically synthesized
gcagtcttattccctggtaagg

SEQ ID NO: 684050 - DNA, 22 bp, Artificial Sequence
  chemically synthesized
taatgttccagcccttaccagg

SEQ ID NO: 684051 - DNA, 22 bp, Artificial Sequence
  chemically synthesized
cagtcttattccctggtaaggg

SEQ ID NO: 684052 - DNA, 22 bp, Artificial Sequence
  chemically synthesized
gtaatgttccagcccttaccag

SEQ ID NO: 684053 - DNA, 22 bp, Artificial Sequence
  chemically synthesized
ttgtaatgttccagcccttacc

SEQ ID NO: 684054 - DNA, 22 bp, Artificial Sequence
  chemically synthesized
attccctggtaagggctggaac

SEQ ID NO: 684055 - DNA, 22 bp, Artificial Sequence
  chemically synthesized
ttccctggtaagggctggaaca

SEQ ID NO: 684056 - DNA, 22 bp, Artificial Sequence
  chemically synthesized
cagtctcttgtaatgttccagc

SEQ ID NO: 684057 - DNA, 22 bp, Artificial Sequence
  chemically synthesized
cctggtaagggctggaacatta

SEQ ID NO: 684058 - DNA, 22 bp, Artificial Sequence
  chemically synthesized
ctccagtctcttgtaatgttcc

SEQ ID NO: 684059 - DNA, 22 bp, Artificial Sequence
  chemically synthesized
gtaagggctggaacattacaag

SEQ ID NO: 684060 - DNA, 22 bp, Artificial Sequence
  chemically synthesized
atcctcctccagtctcttgtaa

SEQ ID NO: 684061 - DNA, 22 bp, Artificial Sequence
  chemically synthesized
aatcctcctccagtctcttgta

SEQ ID NO: 684062 - DNA, 22 bp, Artificial Sequence
  chemically synthesized
taatcctcctccagtctcttgt

SEQ ID NO: 684063 - DNA, 22 bp, Artificial Sequence
  chemically synthesized
ttaatcctcctccagtctcttg

SEQ ID NO: 684064 - DNA, 22 bp, Artificial Sequence
  chemically synthesized
gaacattacaagagactggagg

SEQ ID NO: 684065 - DNA, 22 bp, Artificial Sequence
  chemically synthesized
aatcttttaatcctcctccagt

SEQ ID NO: 684066 - DNA, 22 bp, Artificial Sequence
  chemically synthesized
ctgaatcttttaatcctcctcc

SEQ ID NO: 684067 - DNA, 22 bp, Artificial Sequence
  chemically synthesized
caagagactggaggaggattaa

SEQ ID NO: 684068 - DNA, 22 bp, Artificial Sequence
  chemically synthesized
cccctcctgaatcttttaatcc

SEQ ID NO: 684069 - DNA, 22 bp, Artificial Sequence
  chemically synthesized
ctccccctcctgaatcttttaa

SEQ ID NO: 684070 - DNA, 22 bp, Artificial Sequence
  chemically synthesized
gctccccctcctgaatctttta

SEQ ID NO: 684071 - DNA, 22 bp, Artificial Sequence
  chemically synthesized
gaggaggattaaaagattcagg

SEQ ID NO: 684072 - DNA, 22 bp, Artificial Sequence
  chemically synthesized
cccaacttgctccccctcctga

SEQ ID NO: 684073 - DNA, 22 bp, Artificial Sequence
  chemically synthesized
aaagattcaggagggggagcaa

SEQ ID NO: 684074 - DNA, 22 bp, Artificial Sequence
  chemically synthesized
atgaacgcctccccaacttgct

SEQ ID NO: 684075 - DNA, 22 bp, Artificial Sequence
  chemically synthesized
gatgaacgcctccccaacttgc

SEQ ID NO: 684076 - DNA, 22 bp, Artificial Sequence
  chemically synthesized
aggagggggagcaagttgggga

SEQ ID NO: 684077 - DNA, 22 bp, Artificial Sequence
  chemically synthesized
agacttgatgaacgcctcccca

SEQ ID NO: 684078 - DNA, 22 bp, Artificial Sequence
  chemically synthesized
cagacttgatgaacgcctcccc

SEQ ID NO: 684079 - DNA, 22 bp, Artificial Sequence
  chemically synthesized
gaacttcagacttgatgaacgc

SEQ ID NO: 684080 - DNA, 22 bp, Artificial Sequence
  chemically synthesized
gggaggcgttcatcaagtctga

SEQ ID NO: 684081 - DNA, 22 bp, Artificial Sequence
  chemically synthesized
atgtggttagaacttcagactt

SEQ ID NO: 684082 - DNA, 22 bp, Artificial Sequence
  chemically synthesized
atcaagtctgaagttctaacca

SEQ ID NO: 684083 - DNA, 22 bp, Artificial Sequence
  chemically synthesized
cagcatctcatgtggttagaac

SEQ ID NO: 684084 - DNA, 22 bp, Artificial Sequence
  chemically synthesized
agcccctgcagcatctcatgtg

SEQ ID NO: 684085 - DNA, 22 bp, Artificial Sequence
  chemically synthesized
aagttctaaccacatgagatgc

SEQ ID NO: 684086 - DNA, 22 bp, Artificial Sequence
  chemically synthesized
tcagcccctgcagcatctcatg

SEQ ID NO: 684087 - DNA, 22 bp, Artificial Sequence
  chemically synthesized
taaccacatgagatgctgcagg

SEQ ID NO: 684088 - DNA, 22 bp, Artificial Sequence
  chemically synthesized
accacatgagatgctgcagggg

SEQ ID NO: 684089 - DNA, 22 bp, Artificial Sequence
  chemically synthesized
gagcagattctcagcccctgca

SEQ ID NO: 684090 - DNA, 22 bp, Artificial Sequence
  chemically synthesized
ggagcagattctcagcccctgc

SEQ ID NO: 684091 - DNA, 22 bp, Artificial Sequence
  chemically synthesized
aaacttggagcagattctcagc

SEQ ID NO: 684092 - DNA, 22 bp, Artificial Sequence
  chemically synthesized
caggggctgagaatctgctcca

SEQ ID NO: 684093 - DNA, 22 bp, Artificial Sequence
  chemically synthesized
agaatctgctccaagttttagg

SEQ ID NO: 684094 - DNA, 22 bp, Artificial Sequence
  chemically synthesized
gcagagaagacaccccctaaaa

SEQ ID NO: 684095 - DNA, 22 bp, Artificial Sequence
  chemically synthesized
ctccaagttttagggggtgtct

SEQ ID NO: 684096 - DNA, 22 bp, Artificial Sequence
  chemically synthesized
caagttttagggggtgtcttct

SEQ ID NO: 684097 - DNA, 22 bp, Artificial Sequence
  chemically synthesized
tagggggtgtcttctctgccag

SEQ ID NO: 684098 - DNA, 22 bp, Artificial Sequence
  chemically synthesized
agggggtgtcttctctgccagc

SEQ ID NO: 684099 - DNA, 22 bp, Artificial Sequence
  chemically synthesized
gggggtgtcttctctgccagct

SEQ ID NO: 684100 - DNA, 22 bp, Artificial Sequence
  chemically synthesized
ccaaacagccacccaaacgaac

SEQ ID NO: 684101 - DNA, 22 bp, Artificial Sequence
  chemically synthesized
ctctgccagctgttcgtttggg

SEQ ID NO: 684102 - DNA, 22 bp, Artificial Sequence
  chemically synthesized
tctgccagctgttcgtttgggt

SEQ ID NO: 684103 - DNA, 22 bp, Artificial Sequence
  chemically synthesized
tgccagctgttcgtttgggtgg

SEQ ID NO: 684104 - DNA, 22 bp, Artificial Sequence
  chemically synthesized
ccagctgttcgtttgggtggct

SEQ ID NO: 684105 - DNA, 22 bp, Artificial Sequence
  chemically synthesized
gtatactcccaaacagccaccc

SEQ ID NO: 684106 - DNA, 22 bp, Artificial Sequence
  chemically synthesized
ctggtatactcccaaacagcca

SEQ ID NO: 684107 - DNA, 22 bp, Artificial Sequence
  chemically synthesized
ttcgtttgggtggctgtttggg

SEQ ID NO: 684108 - DNA, 22 bp, Artificial Sequence
  chemically synthesized
gtttgggtggctgtttgggagt

SEQ ID NO: 684109 - DNA, 22 bp, Artificial Sequence
  chemically synthesized
agtgattcctggtatactccca

SEQ ID NO: 684110 - DNA, 22 bp, Artificial Sequence
  chemically synthesized
gggtggctgtttgggagtatac

SEQ ID NO: 684111 - DNA, 22 bp, Artificial Sequence
  chemically synthesized
ggtggctgtttgggagtatacc

SEQ ID NO: 684112 - DNA, 22 bp, Artificial Sequence
  chemically synthesized
tttgggagtataccaggaatca

SEQ ID NO: 684113 - DNA, 22 bp, Artificial Sequence
  chemically synthesized
gggagtataccaggaatcactc

SEQ ID NO: 684114 - DNA, 22 bp, Artificial Sequence
  chemically synthesized
ggagtataccaggaatcactca

SEQ ID NO: 684115 - DNA, 22 bp, Artificial Sequence
  chemically synthesized
gaagaaaacaaaaaggctgagt

SEQ ID NO: 684116 - DNA, 22 bp, Artificial Sequence
  chemically synthesized
ggaagaaaacaaaaaggctgag

SEQ ID NO: 684117 - DNA, 22 bp, Artificial Sequence
  chemically synthesized
agcctttttgttttcttccaaa

SEQ ID NO: 684118 - DNA, 22 bp, Artificial Sequence
  chemically synthesized
tttgttttcttccaaatggcat

SEQ ID NO: 684119 - DNA, 22 bp, Artificial Sequence
  chemically synthesized
ttgttttcttccaaatggcatg

SEQ ID NO: 684120 - DNA, 22 bp, Artificial Sequence
  chemically synthesized
tgttttcttccaaatggcatgg

SEQ ID NO: 684121 - DNA, 22 bp, Artificial Sequence
  chemically synthesized
gttttcttccaaatggcatggt

SEQ ID NO: 684122 - DNA, 22 bp, Artificial Sequence
  chemically synthesized
ttttcttccaaatggcatggtg

SEQ ID NO: 684123 - DNA, 22 bp, Artificial Sequence
  chemically synthesized
caatgtgacaatatcaccatgc

SEQ ID NO: 684124 - DNA, 22 bp, Artificial Sequence
  chemically synthesized
tcttccaaatggcatggtgata

SEQ ID NO: 684125 - DNA, 22 bp, Artificial Sequence
  chemically synthesized
cttccaaatggcatggtgatat

SEQ ID NO: 684126 - DNA, 22 bp, Artificial Sequence
  chemically synthesized
ttccaaatggcatggtgatatt

SEQ ID NO: 684127 - DNA, 22 bp, Artificial Sequence
  chemically synthesized
ctgcaatgtgacaatatcacca

SEQ ID NO: 684128 - DNA, 22 bp, Artificial Sequence
  chemically synthesized
ccaaatggcatggtgatattgt

SEQ ID NO: 684129 - DNA, 22 bp, Artificial Sequence
  chemically synthesized
caaatggcatggtgatattgtc

SEQ ID NO: 684130 - DNA, 22 bp, Artificial Sequence
  chemically synthesized
ctcctgcaatgtgacaatatca

SEQ ID NO: 684131 - DNA, 22 bp, Artificial Sequence
  chemically synthesized
cctcctgcaatgtgacaatatc

SEQ ID NO: 684132 - DNA, 22 bp, Artificial Sequence
  chemically synthesized
tcctcctgcaatgtgacaatat

SEQ ID NO: 684133 - DNA, 22 bp, Artificial Sequence
  chemically synthesized
ttcctcctgcaatgtgacaata

SEQ ID NO: 684134 - DNA, 22 bp, Artificial Sequence
  chemically synthesized
gcagcaatgtttttcctcctgc

SEQ ID NO: 684135 - DNA, 22 bp, Artificial Sequence
  chemically synthesized
agcagcaatgtttttcctcctg

SEQ ID NO: 684136 - DNA, 22 bp, Artificial Sequence
  chemically synthesized
tagcagcaatgtttttcctcct

SEQ ID NO: 684137 - DNA, 22 bp, Artificial Sequence
  chemically synthesized
ttagcagcaatgtttttcctcc

SEQ ID NO: 684138 - DNA, 22 bp, Artificial Sequence
  chemically synthesized
tcacattgcaggaggaaaaaca

SEQ ID NO: 684139 - DNA, 22 bp, Artificial Sequence
  chemically synthesized
acaatacttttagcagcaatgt

SEQ ID NO: 684140 - DNA, 22 bp, Artificial Sequence
  chemically synthesized
caggaggaaaaacattgctgct

SEQ ID NO: 684141 - DNA, 22 bp, Artificial Sequence
  chemically synthesized
aacaatacttttagcagcaatg

SEQ ID NO: 684142 - DNA, 22 bp, Artificial Sequence
  chemically synthesized
cccttaacaatacttttagcag

SEQ ID NO: 684143 - DNA, 22 bp, Artificial Sequence
  chemically synthesized
ctccccttaacaatacttttag

SEQ ID NO: 684144 - DNA, 22 bp, Artificial Sequence
  chemically synthesized
ttactccccttaacaatacttt

SEQ ID NO: 684145 - DNA, 22 bp, Artificial Sequence
  chemically synthesized
cctgttactccccttaacaata

SEQ ID NO: 684146 - DNA, 22 bp, Artificial Sequence
  chemically synthesized
ctgctaaaagtattgttaaggg

SEQ ID NO: 684147 - DNA, 22 bp, Artificial Sequence
  chemically synthesized
ctaaaagtattgttaaggggag

SEQ ID NO: 684148 - DNA, 22 bp, Artificial Sequence
  chemically synthesized
aaagtattgttaaggggagtaa

SEQ ID NO: 684149 - DNA, 22 bp, Artificial Sequence
  chemically synthesized
ttaaggggagtaacaggtagct

SEQ ID NO: 684150 - DNA, 22 bp, Artificial Sequence
  chemically synthesized
tgtatagtagtgtgagctacct

SEQ ID NO: 684151 - DNA, 22 bp, Artificial Sequence
  chemically synthesized
aggggagtaacaggtagctcac

SEQ ID NO: 684152 - DNA, 22 bp, Artificial Sequence
  chemically synthesized
agacaggcaacgtgcagttgtg

SEQ ID NO: 684153 - DNA, 22 bp, Artificial Sequence
  chemically synthesized
acactactatacacaactgcac

SEQ ID NO: 684154 - DNA, 22 bp, Artificial Sequence
  chemically synthesized
ttcagacaggcaacgtgcagtt

SEQ ID NO: 684155 - DNA, 22 bp, Artificial Sequence
  chemically synthesized
gttcagacaggcaacgtgcagt

SEQ ID NO: 684156 - DNA, 22 bp, Artificial Sequence
  chemically synthesized
tgttcagacaggcaacgtgcag

SEQ ID NO: 684157 - DNA, 22 bp, Artificial Sequence
  chemically synthesized
ctatacacaactgcacgttgcc

SEQ ID NO: 684158 - DNA, 22 bp, Artificial Sequence
  chemically synthesized
tacacaactgcacgttgcctgt

SEQ ID NO: 684159 - DNA, 22 bp, Artificial Sequence
  chemically synthesized
aagtgttttgttcagacaggca

SEQ ID NO: 684160 - DNA, 22 bp, Artificial Sequence
  chemically synthesized
gaagtgttttgttcagacaggc

SEQ ID NO: 684161 - DNA, 22 bp, Artificial Sequence
  chemically synthesized
tgaagtgttttgttcagacagg

SEQ ID NO: 684162 - DNA, 22 bp, Artificial Sequence
  chemically synthesized
cacgttgcctgtctgaacaaaa

SEQ ID NO: 684163 - DNA, 22 bp, Artificial Sequence
  chemically synthesized
tgttttgaagtgttttgttcag

SEQ ID NO: 684164 - DNA, 22 bp, Artificial Sequence
  chemically synthesized
atgttttgaagtgttttgttca

SEQ ID NO: 684165 - DNA, 22 bp, Artificial Sequence
  chemically synthesized
agtttatgttttgaagtgtttt

SEQ ID NO: 684166 - DNA, 22 bp, Artificial Sequence
  chemically synthesized
cctgtctgaacaaaacacttca

SEQ ID NO: 684167 - DNA, 22 bp, Artificial Sequence
  chemically synthesized
tcagtttatgttttgaagtgtt

SEQ ID NO: 684168 - DNA, 22 bp, Artificial Sequence
  chemically synthesized
ctcagtttatgttttgaagtgt

SEQ ID NO: 684169 - DNA, 22 bp, Artificial Sequence
  chemically synthesized
tctgaacaaaacacttcaaaac

SEQ ID NO: 684170 - DNA, 22 bp, Artificial Sequence
  chemically synthesized
aacaaaacacttcaaaacataa

SEQ ID NO: 684171 - DNA, 22 bp, Artificial Sequence
  chemically synthesized
caaaacataaactgagaaatgc

SEQ ID NO: 684172 - DNA, 22 bp, Artificial Sequence
  chemically synthesized
aaaacataaactgagaaatgcc

SEQ ID NO: 684173 - DNA, 22 bp, Artificial Sequence
  chemically synthesized
caagatggaagcagaagggcat

SEQ ID NO: 684174 - DNA, 22 bp, Artificial Sequence
  chemically synthesized
actgcaagatggaagcagaagg

SEQ ID NO: 684175 - DNA, 22 bp, Artificial Sequence
  chemically synthesized
agaaatgcccttctgcttccat

SEQ ID NO: 684176 - DNA, 22 bp, Artificial Sequence
  chemically synthesized
ggtctcactgcaagatggaagc

SEQ ID NO: 684177 - DNA, 22 bp, Artificial Sequence
  chemically synthesized
aattaggtctcactgcaagatg

SEQ ID NO: 684178 - DNA, 22 bp, Artificial Sequence
  chemically synthesized
gaattaggtctcactgcaagat

SEQ ID NO: 684179 - DNA, 22 bp, Artificial Sequence
  chemically synthesized
tgaattaggtctcactgcaaga

SEQ ID NO: 684180 - DNA, 22 bp, Artificial Sequence
  chemically synthesized
ctgcttccatcttgcagtgaga

SEQ ID NO: 684181 - DNA, 22 bp, Artificial Sequence
  chemically synthesized
tgcttccatcttgcagtgagac

SEQ ID NO: 684182 - DNA, 22 bp, Artificial Sequence
  chemically synthesized
cttccatcttgcagtgagacct

SEQ ID NO: 684183 - DNA, 22 bp, Artificial Sequence
  chemically synthesized
ccatcttgcagtgagacctaat

SEQ ID NO: 684184 - DNA, 22 bp, Artificial Sequence
  chemically synthesized
catcttgcagtgagacctaatt

SEQ ID NO: 684185 - DNA, 22 bp, Artificial Sequence
  chemically synthesized
gcaaggactttgaattaggtct

SEQ ID NO: 684186 - DNA, 22 bp, Artificial Sequence
  chemically synthesized
gcagtgagacctaattcaaagt

SEQ ID NO: 684187 - DNA, 22 bp, Artificial Sequence
  chemically synthesized
cagtgagacctaattcaaagtc

SEQ ID NO: 684188 - DNA, 22 bp, Artificial Sequence
  chemically synthesized
agcacactagcaaggactttga

SEQ ID NO: 684189 - DNA, 22 bp, Artificial Sequence
  chemically synthesized
attcaaagtccttgctagtgtg

SEQ ID NO: 684190 - DNA, 22 bp, Artificial Sequence
  chemically synthesized
gcgtggacctgagcacactagc

SEQ ID NO: 684191 - DNA, 22 bp, Artificial Sequence
  chemically synthesized
aaagtccttgctagtgtgctca

SEQ ID NO: 684192 - DNA, 22 bp, Artificial Sequence
  chemically synthesized
ttggcgtggacctgagcacact

SEQ ID NO: 684193 - DNA, 22 bp, Artificial Sequence
  chemically synthesized
gttggcgtggacctgagcacac

SEQ ID NO: 684194 - DNA, 22 bp, Artificial Sequence
  chemically synthesized
ccaatttgttggcgtggacctg

SEQ ID NO: 684195 - DNA, 22 bp, Artificial Sequence
  chemically synthesized
gctagtgtgctcaggtccacgc

SEQ ID NO: 684196 - DNA, 22 bp, Artificial Sequence
  chemically synthesized
gccaatttgttggcgtggacct

SEQ ID NO: 684197 - DNA, 22 bp, Artificial Sequence
  chemically synthesized
ctagtgtgctcaggtccacgcc

SEQ ID NO: 684198 - DNA, 22 bp, Artificial Sequence
  chemically synthesized
gtgtgctcaggtccacgccaac

SEQ ID NO: 684199 - DNA, 22 bp, Artificial Sequence
  chemically synthesized
aggtccacgccaacaaattggc

SEQ ID NO: 684200 - DNA, 22 bp, Artificial Sequence
  chemically synthesized
tcaggcacacacttgccaattt

SEQ ID NO: 684201 - DNA, 22 bp, Artificial Sequence
  chemically synthesized
tgtcaggcacacacttgccaat

SEQ ID NO: 684202 - DNA, 22 bp, Artificial Sequence
  chemically synthesized
aaatgtgaccattctgtcaggc

SEQ ID NO: 684203 - DNA, 22 bp, Artificial Sequence
  chemically synthesized
gcaagtgtgtgcctgacagaat

SEQ ID NO: 684204 - DNA, 22 bp, Artificial Sequence
  chemically synthesized
acagaatggtcacattttaggg

SEQ ID NO: 684205 - DNA, 22 bp, Artificial Sequence
  chemically synthesized
aatagaatggggaccatccagc

SEQ ID NO: 684206 - DNA, 22 bp, Artificial Sequence
  chemically synthesized
tagggctggatggtccccattc

SEQ ID NO: 684207 - DNA, 22 bp, Artificial Sequence
  chemically synthesized
agggctggatggtccccattct

SEQ ID NO: 684208 - DNA, 22 bp, Artificial Sequence
  chemically synthesized
taagcattaaatagaatgggga

SEQ ID NO: 684209 - DNA, 22 bp, Artificial Sequence
  chemically synthesized
gggctggatggtccccattcta

SEQ ID NO: 684210 - DNA, 22 bp, Artificial Sequence
  chemically synthesized
ataagcattaaatagaatgggg

SEQ ID NO: 684211 - DNA, 22 bp, Artificial Sequence
  chemically synthesized
gatggtccccattctatttaat

SEQ ID NO: 684212 - DNA, 22 bp, Artificial Sequence
  chemically synthesized
ataggatgaatttataagcatt

SEQ ID NO: 684213 - DNA, 22 bp, Artificial Sequence
  chemically synthesized
aataggatgaatttataagcat

SEQ ID NO: 684214 - DNA, 22 bp, Artificial Sequence
  chemically synthesized
tatttaatgcttataaattcat

SEQ ID NO: 684215 - DNA, 22 bp, Artificial Sequence
  chemically synthesized
tttaatgcttataaattcatcc

SEQ ID NO: 684216 - DNA, 22 bp, Artificial Sequence
  chemically synthesized
aatgcttataaattcatcctat

SEQ ID NO: 684217 - DNA, 22 bp, Artificial Sequence
  chemically synthesized
cccaagcacttaataggatgaa

SEQ ID NO: 684218 - DNA, 22 bp, Artificial Sequence
  chemically synthesized
atgcttataaattcatcctatt

SEQ ID NO: 684219 - DNA, 22 bp, Artificial Sequence
  chemically synthesized
ccccaagcacttaataggatga

SEQ ID NO: 684220 - DNA, 22 bp, Artificial Sequence
  chemically synthesized
atttccccaagcacttaatagg

SEQ ID NO: 684221 - DNA, 22 bp, Artificial Sequence
  chemically synthesized
ataaattcatcctattaagtgc

SEQ ID NO: 684222 - DNA, 22 bp, Artificial Sequence
  chemically synthesized
taaattcatcctattaagtgct

SEQ ID NO: 684223 - DNA, 22 bp, Artificial Sequence
  chemically synthesized
agattaatttccccaagcactt

SEQ ID NO: 684224 - DNA, 22 bp, Artificial Sequence
  chemically synthesized
ttcagattaatttccccaagca

SEQ ID NO: 684225 - DNA, 22 bp, Artificial Sequence
  chemically synthesized
atcctattaagtgcttggggaa

SEQ ID NO: 684226 - DNA, 22 bp, Artificial Sequence
  chemically synthesized
attcagattaatttccccaagc

SEQ ID NO: 684227 - DNA, 22 bp, Artificial Sequence
  chemically synthesized
ttaagtgcttggggaaattaat

SEQ ID NO: 684228 - DNA, 22 bp, Artificial Sequence
  chemically synthesized
agtgcttggggaaattaatctg

SEQ ID NO: 684229 - DNA, 22 bp, Artificial Sequence
  chemically synthesized
atggacacttattcagattaat

SEQ ID NO: 684230 - DNA, 22 bp, Artificial Sequence
  chemically synthesized
catggacacttattcagattaa

SEQ ID NO: 684231 - DNA, 22 bp, Artificial Sequence
  chemically synthesized
ggggaaattaatctgaataagt

SEQ ID NO: 684232 - DNA, 22 bp, Artificial Sequence
  chemically synthesized
gggaaattaatctgaataagtg

SEQ ID NO: 684233 - DNA, 22 bp, Artificial Sequence
  chemically synthesized
tcagtcttcatggacacttatt

SEQ ID NO: 684234 - DNA, 22 bp, Artificial Sequence
  chemically synthesized
atctgaataagtgtccatgaag

SEQ ID NO: 684235 - DNA, 22 bp, Artificial Sequence
  chemically synthesized
aataagtgtccatgaagactga

SEQ ID NO: 684236 - DNA, 22 bp, Artificial Sequence
  chemically synthesized
aaaatcatgataattatcagtc

SEQ ID NO: 684237 - DNA, 22 bp, Artificial Sequence
  chemically synthesized
aaaaatcatgataattatcagt

SEQ ID NO: 684238 - DNA, 22 bp, Artificial Sequence
  chemically synthesized
taaaaatcatgataattatcag

SEQ ID NO: 684239 - DNA, 22 bp, Artificial Sequence
  chemically synthesized
ttaaaaatcatgataattatca

SEQ ID NO: 684240 - DNA, 22 bp, Artificial Sequence
  chemically synthesized
tatgagaatacttttaaaaatc

SEQ ID NO: 684241 - DNA, 22 bp, Artificial Sequence
  chemically synthesized
ataattatcatgatttttaaaa

SEQ ID NO: 684242 - DNA, 22 bp, Artificial Sequence
  chemically synthesized
caattatatgagaatactttta

SEQ ID NO: 684243 - DNA, 22 bp, Artificial Sequence
  chemically synthesized
tcatgatttttaaaagtattct

SEQ ID NO: 684244 - DNA, 22 bp, Artificial Sequence
  chemically synthesized
ctacaattatatgagaatactt

SEQ ID NO: 684245 - DNA, 22 bp, Artificial Sequence
  chemically synthesized
ttaaaagtattctcatataatt

SEQ ID NO: 684246 - DNA, 22 bp, Artificial Sequence
  chemically synthesized
aaatgttcctacaattatatga

SEQ ID NO: 684247 - DNA, 22 bp, Artificial Sequence
  chemically synthesized
taaaagtattctcatataattg

SEQ ID NO: 684248 - DNA, 22 bp, Artificial Sequence
  chemically synthesized
aaaagtattctcatataattgt

SEQ ID NO: 684249 - DNA, 22 bp, Artificial Sequence
  chemically synthesized
aaagtattctcatataattgta

SEQ ID NO: 684250 - DNA, 22 bp, Artificial Sequence
  chemically synthesized
tctaaaatgttcctacaattat

SEQ ID NO: 684251 - DNA, 22 bp, Artificial Sequence
  chemically synthesized
cagactgtctaaaatgttccta

SEQ ID NO: 684252 - DNA, 22 bp, Artificial Sequence
  chemically synthesized
tcatataattgtaggaacattt

SEQ ID NO: 684253 - DNA, 22 bp, Artificial Sequence
  chemically synthesized
atataattgtaggaacatttta

SEQ ID NO: 684254 - DNA, 22 bp, Artificial Sequence
  chemically synthesized
taggaacattttagacagtctg

SEQ ID NO: 684255 - DNA, 22 bp, Artificial Sequence
  chemically synthesized
atacccccatggctgcagactg

SEQ ID NO: 684256 - DNA, 22 bp, Artificial Sequence
  chemically synthesized
aatacccccatggctgcagact

SEQ ID NO: 684257 - DNA, 22 bp, Artificial Sequence
  chemically synthesized
tagacagtctgcagccatgggg

SEQ ID NO: 684258 - DNA, 22 bp, Artificial Sequence
  chemically synthesized
agacagtctgcagccatggggg

SEQ ID NO: 684259 - DNA, 22 bp, Artificial Sequence
  chemically synthesized
gacagtctgcagccatgggggt

SEQ ID NO: 684260 - DNA, 22 bp, Artificial Sequence
  chemically synthesized
ataatatgcttaatacccccat

SEQ ID NO: 684261 - DNA, 22 bp, Artificial Sequence
  chemically synthesized
ctcataatatgcttaatacccc

SEQ ID NO: 684262 - DNA, 22 bp, Artificial Sequence
  chemically synthesized
actcataatatgcttaataccc

SEQ ID NO: 684263 - DNA, 22 bp, Artificial Sequence
  chemically synthesized
tactcataatatgcttaatacc

SEQ ID NO: 684264 - DNA, 22 bp, Artificial Sequence
  chemically synthesized
ttactcataatatgcttaatac

SEQ ID NO: 684265 - DNA, 22 bp, Artificial Sequence
  chemically synthesized
cagccatgggggtattaagcat

SEQ ID NO: 684266 - DNA, 22 bp, Artificial Sequence
  chemically synthesized
tttttactcataatatgcttaa

SEQ ID NO: 684267 - DNA, 22 bp, Artificial Sequence
  chemically synthesized
ttatttttactcataatatgct

SEQ ID NO: 684268 - DNA, 22 bp, Artificial Sequence
  chemically synthesized
aagctgttatttttactcataa

SEQ ID NO: 684269 - DNA, 22 bp, Artificial Sequence
  chemically synthesized
aaagctgttatttttactcata

SEQ ID NO: 684270 - DNA, 22 bp, Artificial Sequence
  chemically synthesized
ttaaagctgttatttttactca

SEQ ID NO: 684271 - DNA, 22 bp, Artificial Sequence
  chemically synthesized
agcatattatgagtaaaaataa

SEQ ID NO: 684272 - DNA, 22 bp, Artificial Sequence
  chemically synthesized
ttcttaaagctgttatttttac

SEQ ID NO: 684273 - DNA, 22 bp, Artificial Sequence
  chemically synthesized
attcttaaagctgttattttta

SEQ ID NO: 684274 - DNA, 22 bp, Artificial Sequence
  chemically synthesized
tattcttaaagctgttattttt

SEQ ID NO: 684275 - DNA, 22 bp, Artificial Sequence
  chemically synthesized
tgagtaaaaataacagctttaa

SEQ ID NO: 684276 - DNA, 22 bp, Artificial Sequence
  chemically synthesized
aaaggaattttattcttaaagc

SEQ ID NO: 684277 - DNA, 22 bp, Artificial Sequence
  chemically synthesized
gaaaggaattttattcttaaag

SEQ ID NO: 684278 - DNA, 22 bp, Artificial Sequence
  chemically synthesized
tgaaaggaattttattcttaaa

SEQ ID NO: 684279 - DNA, 22 bp, Artificial Sequence
  chemically synthesized
ttgaaaggaattttattcttaa

SEQ ID NO: 684280 - DNA, 22 bp, Artificial Sequence
  chemically synthesized
ttttgaaaggaattttattctt

SEQ ID NO: 684281 - DNA, 22 bp, Artificial Sequence
  chemically synthesized
gtcactcttttgaaaggaattt

SEQ ID NO: 684282 - DNA, 22 bp, Artificial Sequence
  chemically synthesized
taagaataaaattcctttcaaa

SEQ ID NO: 684283 - DNA, 22 bp, Artificial Sequence
  chemically synthesized
aagaataaaattcctttcaaaa

SEQ ID NO: 684284 - DNA, 22 bp, Artificial Sequence
  chemically synthesized
agaataaaattcctttcaaaag

SEQ ID NO: 684285 - DNA, 22 bp, Artificial Sequence
  chemically synthesized
aaagctggtcactcttttgaaa

SEQ ID NO: 684286 - DNA, 22 bp, Artificial Sequence
  chemically synthesized
caaagctggtcactcttttgaa

SEQ ID NO: 684287 - DNA, 22 bp, Artificial Sequence
  chemically synthesized
tcaaagctggtcactcttttga

SEQ ID NO: 684288 - DNA, 22 bp, Artificial Sequence
  chemically synthesized
gtaactttcaaagctggtcact

SEQ ID NO: 684289 - DNA, 22 bp, Artificial Sequence
  chemically synthesized
ctttcaaaagagtgaccagctt

SEQ ID NO: 684290 - DNA, 22 bp, Artificial Sequence
  chemically synthesized
tggtaactttcaaagctggtca

SEQ ID NO: 684291 - DNA, 22 bp, Artificial Sequence
  chemically synthesized
ctggtaactttcaaagctggtc

SEQ ID NO: 684292 - DNA, 22 bp, Artificial Sequence
  chemically synthesized
tcaaaagagtgaccagctttga

SEQ ID NO: 684293 - DNA, 22 bp, Artificial Sequence
  chemically synthesized
caaaagagtgaccagctttgaa

SEQ ID NO: 684294 - DNA, 22 bp, Artificial Sequence
  chemically synthesized
cttctggtaactttcaaagctg

SEQ ID NO: 684295 - DNA, 22 bp, Artificial Sequence
  chemically synthesized
aaaagagtgaccagctttgaaa

SEQ ID NO: 684296 - DNA, 22 bp, Artificial Sequence
  chemically synthesized
ccttctggtaactttcaaagct

SEQ ID NO: 684297 - DNA, 22 bp, Artificial Sequence
  chemically synthesized
tgggtttccttctggtaacttt

SEQ ID NO: 684298 - DNA, 22 bp, Artificial Sequence
  chemically synthesized
tgaaagttaccagaaggaaacc

SEQ ID NO: 684299 - DNA, 22 bp, Artificial Sequence
  chemically synthesized
gaaagttaccagaaggaaaccc

SEQ ID NO: 684300 - DNA, 22 bp, Artificial Sequence
  chemically synthesized
aaagttaccagaaggaaaccca

SEQ ID NO: 684301 - DNA, 22 bp, Artificial Sequence
  chemically synthesized
aaaaaagaaagattgtgggttt

SEQ ID NO: 684302 - DNA, 22 bp, Artificial Sequence
  chemically synthesized
ccagaaggaaacccacaatctt

SEQ ID NO: 684303 - DNA, 22 bp, Artificial Sequence
  chemically synthesized
aatactgaaaaaagaaagattg

SEQ ID NO: 684304 - DNA, 22 bp, Artificial Sequence
  chemically synthesized
tgattaaatactgaaaaaagaa

SEQ ID NO: 684305 - DNA, 22 bp, Artificial Sequence
  chemically synthesized
ctgtgattaaatactgaaaaaa

SEQ ID NO: 684306 - DNA, 22 bp, Artificial Sequence
  chemically synthesized
tcttttttcagtatttaatcac

SEQ ID NO: 684307 - DNA, 22 bp, Artificial Sequence
  chemically synthesized
atgaaagctgctgtgattaaat

SEQ ID NO: 684308 - DNA, 22 bp, Artificial Sequence
  chemically synthesized
cttttttcagtatttaatcaca

SEQ ID NO: 684309 - DNA, 22 bp, Artificial Sequence
  chemically synthesized
aatgaaagctgctgtgattaaa

SEQ ID NO: 684310 - DNA, 22 bp, Artificial Sequence
  chemically synthesized
ttttttcagtatttaatcacag

SEQ ID NO: 684311 - DNA, 22 bp, Artificial Sequence
  chemically synthesized
ttttcagtatttaatcacagca

SEQ ID NO: 684312 - DNA, 22 bp, Artificial Sequence
  chemically synthesized
tttcagtatttaatcacagcag

SEQ ID NO: 684313 - DNA, 22 bp, Artificial Sequence
  chemically synthesized
ttcagtatttaatcacagcagc

SEQ ID NO: 684314 - DNA, 22 bp, Artificial Sequence
  chemically synthesized
tcagtatttaatcacagcagct

SEQ ID NO: 684315 - DNA, 22 bp, Artificial Sequence
  chemically synthesized
cagtatttaatcacagcagctt

SEQ ID NO: 684316 - DNA, 22 bp, Artificial Sequence
  chemically synthesized
ggaatttaatgaaagctgctgt

SEQ ID NO: 684317 - DNA, 22 bp, Artificial Sequence
  chemically synthesized
agtatttaatcacagcagcttt

SEQ ID NO: 684318 - DNA, 22 bp, Artificial Sequence
  chemically synthesized
gtactgggaatttaatgaaagc

SEQ ID NO: 684319 - DNA, 22 bp, Artificial Sequence
  chemically synthesized
aatcacagcagctttcattaaa

SEQ ID NO: 684320 - DNA, 22 bp, Artificial Sequence
  chemically synthesized
atcacagcagctttcattaaat

SEQ ID NO: 684321 - DNA, 22 bp, Artificial Sequence
  chemically synthesized
ttagtactgggaatttaatgaa

SEQ ID NO: 684322 - DNA, 22 bp, Artificial Sequence
  chemically synthesized
attagtactgggaatttaatga

SEQ ID NO: 684323 - DNA, 22 bp, Artificial Sequence
  chemically synthesized
accacttattagtactgggaat

SEQ ID NO: 684324 - DNA, 22 bp, Artificial Sequence
  chemically synthesized
tcattaaattcccagtactaat

SEQ ID NO: 684325 - DNA, 22 bp, Artificial Sequence
  chemically synthesized
cattaaattcccagtactaata

SEQ ID NO: 684326 - DNA, 22 bp, Artificial Sequence
  chemically synthesized
attaaattcccagtactaataa

SEQ ID NO: 684327 - DNA, 22 bp, Artificial Sequence
  chemically synthesized
aattcccagtactaataagtgg

SEQ ID NO: 684328 - DNA, 22 bp, Artificial Sequence
  chemically synthesized
caaacatagttaaccacttatt

SEQ ID NO: 684329 - DNA, 22 bp, Artificial Sequence
  chemically synthesized
ccagtactaataagtggttaac

SEQ ID NO: 684330 - DNA, 22 bp, Artificial Sequence
  chemically synthesized
attacaaacatagttaaccact

SEQ ID NO: 684331 - DNA, 22 bp, Artificial Sequence
  chemically synthesized
ataagtggttaactatgtttgt

SEQ ID NO: 684332 - DNA, 22 bp, Artificial Sequence
  chemically synthesized
aaaatataagaaatactgatta

SEQ ID NO: 684333 - DNA, 22 bp, Artificial Sequence
  chemically synthesized
aaaaatataagaaatactgatt

SEQ ID NO: 684334 - DNA, 22 bp, Artificial Sequence
  chemically synthesized
actatgtttgtaatcagtattt

SEQ ID NO: 684335 - DNA, 22 bp, Artificial Sequence
  chemically synthesized
taaaaatataagaaatactgat

SEQ ID NO: 684336 - DNA, 22 bp, Artificial Sequence
  chemically synthesized
ttaaaaatataagaaatactga

SEQ ID NO: 684337 - DNA, 22 bp, Artificial Sequence
  chemically synthesized
tgtttgtaatcagtatttctta

SEQ ID NO: 684338 - DNA, 22 bp, Artificial Sequence
  chemically synthesized
gtgcttttaaaaatataagaaa

SEQ ID NO: 684339 - DNA, 22 bp, Artificial Sequence
  chemically synthesized
gtaatcagtatttcttatattt

SEQ ID NO: 684340 - DNA, 22 bp, Artificial Sequence
  chemically synthesized
taatcagtatttcttatatttt

SEQ ID NO: 684341 - DNA, 22 bp, Artificial Sequence
  chemically synthesized
cttatatttttaaaagcactag

SEQ ID NO: 684342 - DNA, 22 bp, Artificial Sequence
  chemically synthesized
ttatatttttaaaagcactaga

SEQ ID NO: 684343 - DNA, 22 bp, Artificial Sequence
  chemically synthesized
atatttttaaaagcactagatt

SEQ ID NO: 684344 - DNA, 22 bp, Artificial Sequence
  chemically synthesized
tatttttaaaagcactagatta

SEQ ID NO: 684345 - DNA, 22 bp, Artificial Sequence
  chemically synthesized
ttaaaagcactagattatggat

SEQ ID NO: 684346 - DNA, 22 bp, Artificial Sequence
  chemically synthesized
taaaagcactagattatggatg

SEQ ID NO: 684347 - DNA, 22 bp, Artificial Sequence
  chemically synthesized
aaaagcactagattatggatgc

SEQ ID NO: 684348 - DNA, 22 bp, Artificial Sequence
  chemically synthesized
aaagcactagattatggatgct

SEQ ID NO: 684349 - DNA, 22 bp, Artificial Sequence
  chemically synthesized
acagccaatggtagacatacag

SEQ ID NO: 684350 - DNA, 22 bp, Artificial Sequence
  chemically synthesized
gattatggatgctgtatgtcta

SEQ ID NO: 684351 - DNA, 22 bp, Artificial Sequence
  chemically synthesized
cacagccaatggtagacataca

SEQ ID NO: 684352 - DNA, 22 bp, Artificial Sequence
  chemically synthesized
tggatgctgtatgtctaccatt

SEQ ID NO: 684353 - DNA, 22 bp, Artificial Sequence
  chemically synthesized
tggcttcacagccaatggtaga

SEQ ID NO: 684354 - DNA, 22 bp, Artificial Sequence
  chemically synthesized
gtggcttcacagccaatggtag

SEQ ID NO: 684355 - DNA, 22 bp, Artificial Sequence
  chemically synthesized
tttgtggcttcacagccaatgg

SEQ ID NO: 684356 - DNA, 22 bp, Artificial Sequence
  chemically synthesized
tatgtctaccattggctgtgaa

SEQ ID NO: 684357 - DNA, 22 bp, Artificial Sequence
  chemically synthesized
aactgtttgtggcttcacagcc

SEQ ID NO: 684358 - DNA, 22 bp, Artificial Sequence
  chemically synthesized
ggctaaactgtttgtggcttca

SEQ ID NO: 684359 - DNA, 22 bp, Artificial Sequence
  chemically synthesized
ccattggctgtgaagccacaaa

SEQ ID NO: 684360 - DNA, 22 bp, Artificial Sequence
  chemically synthesized
ctaggctaaactgtttgtggct

SEQ ID NO: 684361 - DNA, 22 bp, Artificial Sequence
  chemically synthesized
gctgtgaagccacaaacagttt

SEQ ID NO: 684362 - DNA, 22 bp, Artificial Sequence
  chemically synthesized
tgaagccacaaacagtttagcc

SEQ ID NO: 684363 - DNA, 22 bp, Artificial Sequence
  chemically synthesized
tgagtaatcattgctaggctaa

SEQ ID NO: 684364 - DNA, 22 bp, Artificial Sequence
  chemically synthesized
gtgagtaatcattgctaggcta

SEQ ID NO: 684365 - DNA, 22 bp, Artificial Sequence
  chemically synthesized
tgtgagtaatcattgctaggct

SEQ ID NO: 684366 - DNA, 22 bp, Artificial Sequence
  chemically synthesized
atgctttgtgagtaatcattgc

SEQ ID NO: 684367 - DNA, 22 bp, Artificial Sequence
  chemically synthesized
agcctagcaatgattactcaca

SEQ ID NO: 684368 - DNA, 22 bp, Artificial Sequence
  chemically synthesized
aaattcatgctttgtgagtaat

SEQ ID NO: 684369 - DNA, 22 bp, Artificial Sequence
  chemically synthesized
gcctagcaatgattactcacaa

SEQ ID NO: 684370 - DNA, 22 bp, Artificial Sequence
  chemically synthesized
ttaaaattcatgctttgtgagt

SEQ ID NO: 684371 - DNA, 22 bp, Artificial Sequence
  chemically synthesized
gcaatgattactcacaaagcat

SEQ ID NO: 684372 - DNA, 22 bp, Artificial Sequence
  chemically synthesized
ctcacaaagcatgaattttaac

SEQ ID NO: 684373 - DNA, 22 bp, Artificial Sequence
  chemically synthesized
acaaagcatgaattttaacagc

SEQ ID NO: 684374 - DNA, 22 bp, Artificial Sequence
  chemically synthesized
gatgtaggtaaaatggagtgtg

SEQ ID NO: 684375 - DNA, 22 bp, Artificial Sequence
  chemically synthesized
agatgtaggtaaaatggagtgt

SEQ ID NO: 684376 - DNA, 22 bp, Artificial Sequence
  chemically synthesized
taacagcacactccattttacc

SEQ ID NO: 684377 - DNA, 22 bp, Artificial Sequence
  chemically synthesized
aatttagatgtaggtaaaatgg

SEQ ID NO: 684378 - DNA, 22 bp, Artificial Sequence
  chemically synthesized
aacagcacactccattttacct

SEQ ID NO: 684379 - DNA, 22 bp, Artificial Sequence
  chemically synthesized
acagcacactccattttaccta

SEQ ID NO: 684380 - DNA, 22 bp, Artificial Sequence
  chemically synthesized
tgaatttagatgtaggtaaaat

SEQ ID NO: 684381 - DNA, 22 bp, Artificial Sequence
  chemically synthesized
ctgaatttagatgtaggtaaaa

SEQ ID NO: 684382 - DNA, 22 bp, Artificial Sequence
  chemically synthesized
ttctgaatttagatgtaggtaa

SEQ ID NO: 684383 - DNA, 22 bp, Artificial Sequence
  chemically synthesized
tcttctgaatttagatgtaggt

SEQ ID NO: 684384 - DNA, 22 bp, Artificial Sequence
  chemically synthesized
aattctcttctgaatttagatg

SEQ ID NO: 684385 - DNA, 22 bp, Artificial Sequence
  chemically synthesized
cattttacctacatctaaattc

SEQ ID NO: 684386 - DNA, 22 bp, Artificial Sequence
  chemically synthesized
tacctacatctaaattcagaag

SEQ ID NO: 684387 - DNA, 22 bp, Artificial Sequence
  chemically synthesized
acctacatctaaattcagaaga

SEQ ID NO: 684388 - DNA, 22 bp, Artificial Sequence
  chemically synthesized
tggactaaattctcttctgaat

SEQ ID NO: 684389 - DNA, 22 bp, Artificial Sequence
  chemically synthesized
cctacatctaaattcagaagag

SEQ ID NO: 684390 - DNA, 22 bp, Artificial Sequence
  chemically synthesized
tgtggactaaattctcttctga

SEQ ID NO: 684391 - DNA, 22 bp, Artificial Sequence
  chemically synthesized
catctaaattcagaagagaatt

SEQ ID NO: 684392 - DNA, 22 bp, Artificial Sequence
  chemically synthesized
ctctgtggactaaattctcttc

SEQ ID NO: 684393 - DNA, 22 bp, Artificial Sequence
  chemically synthesized
aattcagaagagaatttagtcc

SEQ ID NO: 684394 - DNA, 22 bp, Artificial Sequence
  chemically synthesized
agaagagaatttagtccacaga

SEQ ID NO: 684395 - DNA, 22 bp, Artificial Sequence
  chemically synthesized
caggaaggttcctctgtggact

SEQ ID NO: 684396 - DNA, 22 bp, Artificial Sequence
  chemically synthesized
aagaaaagttacaggaaggttc

SEQ ID NO: 684397 - DNA, 22 bp, Artificial Sequence
  chemically synthesized
agtccacagaggaaccttcctg

SEQ ID NO: 684398 - DNA, 22 bp, Artificial Sequence
  chemically synthesized
gtccacagaggaaccttcctgt

SEQ ID NO: 684399 - DNA, 22 bp, Artificial Sequence
  chemically synthesized
cctgtaacttttcttgaatatt

SEQ ID NO: 684400 - DNA, 22 bp, Artificial Sequence
  chemically synthesized
ctgtaacttttcttgaatattt

SEQ ID NO: 684401 - DNA, 22 bp, Artificial Sequence
  chemically synthesized
caagatatcacaaaatattcaa

SEQ ID NO: 684402 - DNA, 22 bp, Artificial Sequence
  chemically synthesized
taacttttcttgaatattttgt

SEQ ID NO: 684403 - DNA, 22 bp, Artificial Sequence
  chemically synthesized
ttcttgaatattttgtgatatc

SEQ ID NO: 684404 - DNA, 22 bp, Artificial Sequence
  chemically synthesized
gccatgttgcaagatatcacaa

SEQ ID NO: 684405 - DNA, 22 bp, Artificial Sequence
  chemically synthesized
tcttgaatattttgtgatatct

SEQ ID NO: 684406 - DNA, 22 bp, Artificial Sequence
  chemically synthesized
ggccatgttgcaagatatcaca

SEQ ID NO: 684407 - DNA, 22 bp, Artificial Sequence
  chemically synthesized
cttgaatattttgtgatatctt

SEQ ID NO: 684408 - DNA, 22 bp, Artificial Sequence
  chemically synthesized
tggccatgttgcaagatatcac

SEQ ID NO: 684409 - DNA, 22 bp, Artificial Sequence
  chemically synthesized
ttgaatattttgtgatatcttg

SEQ ID NO: 684410 - DNA, 22 bp, Artificial Sequence
  chemically synthesized
ttggccatgttgcaagatatca

SEQ ID NO: 684411 - DNA, 22 bp, Artificial Sequence
  chemically synthesized
gaatattttgtgatatcttgca

SEQ ID NO: 684412 - DNA, 22 bp, Artificial Sequence
  chemically synthesized
aatattttgtgatatcttgcaa

SEQ ID NO: 684413 - DNA, 22 bp, Artificial Sequence
  chemically synthesized
gaacttttggccatgttgcaag

SEQ ID NO: 684414 - DNA, 22 bp, Artificial Sequence
  chemically synthesized
tgtgatatcttgcaacatggcc

SEQ ID NO: 684415 - DNA, 22 bp, Artificial Sequence
  chemically synthesized
gtgatatcttgcaacatggcca

SEQ ID NO: 684416 - DNA, 22 bp, Artificial Sequence
  chemically synthesized
tgatatcttgcaacatggccaa

SEQ ID NO: 684417 - DNA, 22 bp, Artificial Sequence
  chemically synthesized
gcaacatggccaaaagttctag

SEQ ID NO: 684418 - DNA, 22 bp, Artificial Sequence
  chemically synthesized
caacatggccaaaagttctagc

SEQ ID NO: 684419 - DNA, 22 bp, Artificial Sequence
  chemically synthesized
gacaccaaggagagggctagaa

SEQ ID NO: 684420 - DNA, 22 bp, Artificial Sequence
  chemically synthesized
caagagctggacaccaaggaga

SEQ ID NO: 684421 - DNA, 22 bp, Artificial Sequence
  chemically synthesized
tagccctctccttggtgtccag

SEQ ID NO: 684422 - DNA, 22 bp, Artificial Sequence
  chemically synthesized
gccctctccttggtgtccagct

SEQ ID NO: 684423 - DNA, 22 bp, Artificial Sequence
  chemically synthesized
tccttggtgtccagctcttgca

SEQ ID NO: 684424 - DNA, 22 bp, Artificial Sequence
  chemically synthesized
cttggtgtccagctcttgcagt

SEQ ID NO: 684425 - DNA, 22 bp, Artificial Sequence
  chemically synthesized
ggtgtccagctcttgcagtgtg

SEQ ID NO: 684426 - DNA, 22 bp, Artificial Sequence
  chemically synthesized
gtgtccagctcttgcagtgtgc

SEQ ID NO: 684427 - DNA, 22 bp, Artificial Sequence
  chemically synthesized
gtgggaagagatacaaaggcac

SEQ ID NO: 684428 - DNA, 22 bp, Artificial Sequence
  chemically synthesized
ttggtgggaagagatacaaagg

SEQ ID NO: 684429 - DNA, 22 bp, Artificial Sequence
  chemically synthesized
ttgcagtgtgcctttgtatctc

SEQ ID NO: 684430 - DNA, 22 bp, Artificial Sequence
  chemically synthesized
gcagtgtgcctttgtatctctt

SEQ ID NO: 684431 - DNA, 22 bp, Artificial Sequence
  chemically synthesized
cagtgtgcctttgtatctcttc

SEQ ID NO: 684432 - DNA, 22 bp, Artificial Sequence
  chemically synthesized
cacctgttggtgggaagagata

SEQ ID NO: 684433 - DNA, 22 bp, Artificial Sequence
  chemically synthesized
tgtatctcttcccaccaacagg

SEQ ID NO: 684434 - DNA, 22 bp, Artificial Sequence
  chemically synthesized
gtatctcttcccaccaacaggt

SEQ ID NO: 684435 - DNA, 22 bp, Artificial Sequence
  chemically synthesized
tatctcttcccaccaacaggtg

SEQ ID NO: 684436 - DNA, 22 bp, Artificial Sequence
  chemically synthesized
ttcccaccaacaggtggagtct

SEQ ID NO: 684437 - DNA, 22 bp, Artificial Sequence
  chemically synthesized
cccaccaacaggtggagtcttt

SEQ ID NO: 684438 - DNA, 22 bp, Artificial Sequence
  chemically synthesized
ccaccaacaggtggagtctttc

SEQ ID NO: 684439 - DNA, 22 bp, Artificial Sequence
  chemically synthesized
tccccactccttacatctggga

SEQ ID NO: 684440 - DNA, 22 bp, Artificial Sequence
  chemically synthesized
ccccactccttacatctgggat

SEQ ID NO: 684441 - DNA, 22 bp, Artificial Sequence
  chemically synthesized
cccactccttacatctgggatg

SEQ ID NO: 684442 - DNA, 22 bp, Artificial Sequence
  chemically synthesized
cttacatctgggatggccctat

SEQ ID NO: 684443 - DNA, 22 bp, Artificial Sequence
  chemically synthesized
acatctgggatggccctatgac

SEQ ID NO: 684444 - DNA, 22 bp, Artificial Sequence
  chemically synthesized
catctgggatggccctatgaca

SEQ ID NO: 684445 - DNA, 22 bp, Artificial Sequence
  chemically synthesized
gccgaagcaagtcatgtcatag

SEQ ID NO: 684446 - DNA, 22 bp, Artificial Sequence
  chemically synthesized
ggatggccctatgacatgactt

SEQ ID NO: 684447 - DNA, 22 bp, Artificial Sequence
  chemically synthesized
gtagtgtccattagccgaagca

SEQ ID NO: 684448 - DNA, 22 bp, Artificial Sequence
  chemically synthesized
ggtagtgtccattagccgaagc

SEQ ID NO: 684449 - DNA, 22 bp, Artificial Sequence
  chemically synthesized
tgacatgacttgcttcggctaa

SEQ ID NO: 684450 - DNA, 22 bp, Artificial Sequence
  chemically synthesized
tgtcatgtttggtagtgtccat

SEQ ID NO: 684451 - DNA, 22 bp, Artificial Sequence
  chemically synthesized
gtgtcatgtttggtagtgtcca

SEQ ID NO: 684452 - DNA, 22 bp, Artificial Sequence
  chemically synthesized
gcttcggctaatggacactacc

SEQ ID NO: 684453 - DNA, 22 bp, Artificial Sequence
  chemically synthesized
cttcggctaatggacactacca

SEQ ID NO: 684454 - DNA, 22 bp, Artificial Sequence
  chemically synthesized
cttgtgtcatgtttggtagtgt

SEQ ID NO: 684455 - DNA, 22 bp, Artificial Sequence
  chemically synthesized
cggctaatggacactaccaaac

SEQ ID NO: 684456 - DNA, 22 bp, Artificial Sequence
  chemically synthesized
tgcttgtgtcatgtttggtagt

SEQ ID NO: 684457 - DNA, 22 bp, Artificial Sequence
  chemically synthesized
ggctaatggacactaccaaaca

SEQ ID NO: 684458 - DNA, 22 bp, Artificial Sequence
  chemically synthesized
ctgcttgtgtcatgtttggtag

SEQ ID NO: 684459 - DNA, 22 bp, Artificial Sequence
  chemically synthesized
atggacactaccaaacatgaca

SEQ ID NO: 684460 - DNA, 22 bp, Artificial Sequence
  chemically synthesized
aggtttctgcttgtgtcatgtt

SEQ ID NO: 684461 - DNA, 22 bp, Artificial Sequence
  chemically synthesized
tcaggtttctgcttgtgtcatg

SEQ ID NO: 684462 - DNA, 22 bp, Artificial Sequence
  chemically synthesized
ctcaggtttctgcttgtgtcat

SEQ ID NO: 684463 - DNA, 22 bp, Artificial Sequence
  chemically synthesized
ccaaacatgacacaagcagaaa

SEQ ID NO: 684464 - DNA, 22 bp, Artificial Sequence
  chemically synthesized
acatggaaacttctcaggtttc

SEQ ID NO: 684465 - DNA, 22 bp, Artificial Sequence
  chemically synthesized
gttcacatggaaacttctcagg

SEQ ID NO: 684466 - DNA, 22 bp, Artificial Sequence
  chemically synthesized
aggctagttcacatggaaactt

SEQ ID NO: 684467 - DNA, 22 bp, Artificial Sequence
  chemically synthesized
gttcaggctagttcacatggaa

SEQ ID NO: 684468 - DNA, 22 bp, Artificial Sequence
  chemically synthesized
agaagtttccatgtgaactagc

SEQ ID NO: 684469 - DNA, 22 bp, Artificial Sequence
  chemically synthesized
ccatgtgaactagcctgaacta

SEQ ID NO: 684470 - DNA, 22 bp, Artificial Sequence
  chemically synthesized
catgtgaactagcctgaactag

SEQ ID NO: 684471 - DNA, 22 bp, Artificial Sequence
  chemically synthesized
atcatccaacatgctagttcag

SEQ ID NO: 684472 - DNA, 22 bp, Artificial Sequence
  chemically synthesized
gcctgaactagcatgttggatg

SEQ ID NO: 684473 - DNA, 22 bp, Artificial Sequence
  chemically synthesized
tgtgtatctcatcatccaacat

SEQ ID NO: 684474 - DNA, 22 bp, Artificial Sequence
  chemically synthesized
gtgtgtatctcatcatccaaca

SEQ ID NO: 684475 - DNA, 22 bp, Artificial Sequence
  chemically synthesized
aactagcatgttggatgatgag

SEQ ID NO: 684476 - DNA, 22 bp, Artificial Sequence
  chemically synthesized
ggtttgtgtgtatctcatcatc

SEQ ID NO: 684477 - DNA, 22 bp, Artificial Sequence
  chemically synthesized
gcatgttggatgatgagataca

SEQ ID NO: 684478 - DNA, 22 bp, Artificial Sequence
  chemically synthesized
gatgatgagatacacacaaacc

SEQ ID NO: 684479 - DNA, 22 bp, Artificial Sequence
  chemically synthesized
ggaacagatgcaactaggtttg

SEQ ID NO: 684480 - DNA, 22 bp, Artificial Sequence
  chemically synthesized
tcatctaggaacagatgcaact

SEQ ID NO: 684481 - DNA, 22 bp, Artificial Sequence
  chemically synthesized
acaggctgtcatctaggaacag

SEQ ID NO: 684482 - DNA, 22 bp, Artificial Sequence
  chemically synthesized
gttgcatctgttcctagatgac

SEQ ID NO: 684483 - DNA, 22 bp, Artificial Sequence
  chemically synthesized
atggttgacaggctgtcatcta

SEQ ID NO: 684484 - DNA, 22 bp, Artificial Sequence
  chemically synthesized
catctgttcctagatgacagcc

SEQ ID NO: 684485 - DNA, 22 bp, Artificial Sequence
  chemically synthesized
ttcctagatgacagcctgtcaa

SEQ ID NO: 684486 - DNA, 22 bp, Artificial Sequence
  chemically synthesized
atatgtctgatggttgacaggc

SEQ ID NO: 684487 - DNA, 22 bp, Artificial Sequence
  chemically synthesized
ctagatgacagcctgtcaacca

SEQ ID NO: 684488 - DNA, 22 bp, Artificial Sequence
  chemically synthesized
actcatatgtctgatggttgac

SEQ ID NO: 684489 - DNA, 22 bp, Artificial Sequence
  chemically synthesized
gatgacagcctgtcaaccatca

SEQ ID NO: 684490 - DNA, 22 bp, Artificial Sequence
  chemically synthesized
tcgtgacctgactcatatgtct

SEQ ID NO: 684491 - DNA, 22 bp, Artificial Sequence
  chemically synthesized
tcaaccatcagacatatgagtc

SEQ ID NO: 684492 - DNA, 22 bp, Artificial Sequence
  chemically synthesized
gataagctatcgtgacctgact

SEQ ID NO: 684493 - DNA, 22 bp, Artificial Sequence
  chemically synthesized
gcagctggataagctatcgtga

SEQ ID NO: 684494 - DNA, 22 bp, Artificial Sequence
  chemically synthesized
tagtcagctggcagctggataa

SEQ ID NO: 684495 - DNA, 22 bp, Artificial Sequence
  chemically synthesized
tgcatctgtagtcagctggcag

SEQ ID NO: 684496 - DNA, 22 bp, Artificial Sequence
  chemically synthesized
atgcatctgtagtcagctggca

SEQ ID NO: 684497 - DNA, 22 bp, Artificial Sequence
  chemically synthesized
atccagctgccagctgactaca

SEQ ID NO: 684498 - DNA, 22 bp, Artificial Sequence
  chemically synthesized
tccagctgccagctgactacag

SEQ ID NO: 684499 - DNA, 22 bp, Artificial Sequence
  chemically synthesized
ccaggcatgcttatgcatctgt

SEQ ID NO: 684500 - DNA, 22 bp, Artificial Sequence
  chemically synthesized
gccaggcatgcttatgcatctg

SEQ ID NO: 684501 - DNA, 22 bp, Artificial Sequence
  chemically synthesized
ccagctgactacagatgcataa

SEQ ID NO: 684502 - DNA, 22 bp, Artificial Sequence
  chemically synthesized
tttgccaggcatgcttatgcat

SEQ ID NO: 684503 - DNA, 22 bp, Artificial Sequence
  chemically synthesized
ctgtttgccaggcatgcttatg

SEQ ID NO: 684504 - DNA, 22 bp, Artificial Sequence
  chemically synthesized
actacagatgcataagcatgcc

SEQ ID NO: 684505 - DNA, 22 bp, Artificial Sequence
  chemically synthesized
tactactgtttgccaggcatgc

SEQ ID NO: 684506 - DNA, 22 bp, Artificial Sequence
  chemically synthesized
cagatgcataagcatgcctggc

SEQ ID NO: 684507 - DNA, 22 bp, Artificial Sequence
  chemically synthesized
tgtggtgtgaccagttgtacta

SEQ ID NO: 684508 - DNA, 22 bp, Artificial Sequence
  chemically synthesized
atgtggtgtgaccagttgtact

SEQ ID NO: 684509 - DNA, 22 bp, Artificial Sequence
  chemically synthesized
gcaaacagtagtacaactggtc

SEQ ID NO: 684510 - DNA, 22 bp, Artificial Sequence
  chemically synthesized
ggccatttatgtggtgtgacca

SEQ ID NO: 684511 - DNA, 22 bp, Artificial Sequence
  chemically synthesized
atgggtggattgggccatttat

SEQ ID NO: 684512 - DNA, 22 bp, Artificial Sequence
  chemically synthesized
gatgggtggattgggccattta

SEQ ID NO: 684513 - DNA, 22 bp, Artificial Sequence
  chemically synthesized
gtcacaccacataaatggccca

SEQ ID NO: 684514 - DNA, 22 bp, Artificial Sequence
  chemically synthesized
tttgatgggtggattgggccat

SEQ ID NO: 684515 - DNA, 22 bp, Artificial Sequence
  chemically synthesized
actatttgatgggtggattggg

SEQ ID NO: 684516 - DNA, 22 bp, Artificial Sequence
  chemically synthesized
gctcactatttgatgggtggat

SEQ ID NO: 684517 - DNA, 22 bp, Artificial Sequence
  chemically synthesized
agctcactatttgatgggtgga

SEQ ID NO: 684518 - DNA, 22 bp, Artificial Sequence
  chemically synthesized
cttagctcactatttgatgggt

SEQ ID NO: 684519 - DNA, 22 bp, Artificial Sequence
  chemically synthesized
acttagctcactatttgatggg

SEQ ID NO: 684520 - DNA, 22 bp, Artificial Sequence
  chemically synthesized
taacacaatggccagccattta

SEQ ID NO: 684521 - DNA, 22 bp, Artificial Sequence
  chemically synthesized
tataacacaatggccagccatt

SEQ ID NO: 684522 - DNA, 22 bp, Artificial Sequence
  chemically synthesized
agtaaatggctggccattgtgt

SEQ ID NO: 684523 - DNA, 22 bp, Artificial Sequence
  chemically synthesized
ataaactctataacacaatggc

SEQ ID NO: 684524 - DNA, 22 bp, Artificial Sequence
  chemically synthesized
aacaatagttcataaactctat

SEQ ID NO: 684525 - DNA, 22 bp, Artificial Sequence
  chemically synthesized
gccattgtgttatagagtttat

SEQ ID NO: 684526 - DNA, 22 bp, Artificial Sequence
  chemically synthesized
gaacaatagttcataaactcta

SEQ ID NO: 684527 - DNA, 22 bp, Artificial Sequence
  chemically synthesized
tgttatagagtttatgaactat

SEQ ID NO: 684528 - DNA, 22 bp, Artificial Sequence
  chemically synthesized
tagagtttatgaactattgttc

SEQ ID NO: 684529 - DNA, 22 bp, Artificial Sequence
  chemically synthesized
atgaactattgttcaaatttgg

SEQ ID NO: 684530 - DNA, 22 bp, Artificial Sequence
  chemically synthesized
tgaactattgttcaaatttggt

SEQ ID NO: 684531 - DNA, 22 bp, Artificial Sequence
  chemically synthesized
tacagaagcaggccatagacca

SEQ ID NO: 684532 - DNA, 22 bp, Artificial Sequence
  chemically synthesized
ttgttcaaatttggtctatggc

SEQ ID NO: 684533 - DNA, 22 bp, Artificial Sequence
  chemically synthesized
ttcaaatttggtctatggcctg

SEQ ID NO: 684534 - DNA, 22 bp, Artificial Sequence
  chemically synthesized
aaatttggtctatggcctgctt

SEQ ID NO: 684535 - DNA, 22 bp, Artificial Sequence
  chemically synthesized
agaggctgtacagaagcaggcc

SEQ ID NO: 684536 - DNA, 22 bp, Artificial Sequence
  chemically synthesized
gctgagaggctgtacagaagca

SEQ ID NO: 684537 - DNA, 22 bp, Artificial Sequence
  chemically synthesized
ggtctatggcctgcttctgtac

SEQ ID NO: 684538 - DNA, 22 bp, Artificial Sequence
  chemically synthesized
agctgagaggctgtacagaagc

SEQ ID NO: 684539 - DNA, 22 bp, Artificial Sequence
  chemically synthesized
gtctatggcctgcttctgtaca

SEQ ID NO: 684540 - DNA, 22 bp, Artificial Sequence
  chemically synthesized
tggcctgcttctgtacagcctc

SEQ ID NO: 684541 - DNA, 22 bp, Artificial Sequence
  chemically synthesized
cttctgtacagcctctcagcta

SEQ ID NO: 684542 - DNA, 22 bp, Artificial Sequence
  chemically synthesized
ctgtacagcctctcagctaagt

SEQ ID NO: 684543 - DNA, 22 bp, Artificial Sequence
  chemically synthesized
tgtacagcctctcagctaagta

SEQ ID NO: 684544 - DNA, 22 bp, Artificial Sequence
  chemically synthesized
aaaatgtagtcatacttagctg

SEQ ID NO: 684545 - DNA, 22 bp, Artificial Sequence
  chemically synthesized
tacagcctctcagctaagtatg

SEQ ID NO: 684546 - DNA, 22 bp, Artificial Sequence
  chemically synthesized
taaaaatgtagtcatacttagc

SEQ ID NO: 684547 - DNA, 22 bp, Artificial Sequence
  chemically synthesized
caactctaaaaatgtagtcata

SEQ ID NO: 684548 - DNA, 22 bp, Artificial Sequence
  chemically synthesized
acaactctaaaaatgtagtcat

SEQ ID NO: 684549 - DNA, 22 bp, Artificial Sequence
  chemically synthesized
tacaactctaaaaatgtagtca

SEQ ID NO: 684550 - DNA, 22 bp, Artificial Sequence
  chemically synthesized
tcagctaagtatgactacattt

SEQ ID NO: 684551 - DNA, 22 bp, Artificial Sequence
  chemically synthesized
ttacaactctaaaaatgtagtc

SEQ ID NO: 684552 - DNA, 22 bp, Artificial Sequence
  chemically synthesized
tttacaactctaaaaatgtagt

SEQ ID NO: 684553 - DNA, 22 bp, Artificial Sequence
  chemically synthesized
agctaagtatgactacattttt

SEQ ID NO: 684554 - DNA, 22 bp, Artificial Sequence
  chemically synthesized
tttttacaactctaaaaatgta

SEQ ID NO: 684555 - DNA, 22 bp, Artificial Sequence
  chemically synthesized
ctttttacaactctaaaaatgt

SEQ ID NO: 684556 - DNA, 22 bp, Artificial Sequence
  chemically synthesized
tctttttacaactctaaaaatg

SEQ ID NO: 684557 - DNA, 22 bp, Artificial Sequence
  chemically synthesized
ttctttttacaactctaaaaat

SEQ ID NO: 684558 - DNA, 22 bp, Artificial Sequence
  chemically synthesized
agtatgactacatttttagagt

SEQ ID NO: 684559 - DNA, 22 bp, Artificial Sequence
  chemically synthesized
tttctttttacaactctaaaaa

SEQ ID NO: 684560 - DNA, 22 bp, Artificial Sequence
  chemically synthesized
tttttctttttacaactctaaa

SEQ ID NO: 684561 - DNA, 22 bp, Artificial Sequence
  chemically synthesized
cacattctttttctttttacaa

SEQ ID NO: 684562 - DNA, 22 bp, Artificial Sequence
  chemically synthesized
catttttagagttgtaaaaaga

SEQ ID NO: 684563 - DNA, 22 bp, Artificial Sequence
  chemically synthesized
ttgcacattctttttcttttta

SEQ ID NO: 684564 - DNA, 22 bp, Artificial Sequence
  chemically synthesized
gttgcacattctttttcttttt

SEQ ID NO: 684565 - DNA, 22 bp, Artificial Sequence
  chemically synthesized
tgttgcacattctttttctttt

SEQ ID NO: 684566 - DNA, 22 bp, Artificial Sequence
  chemically synthesized
ttagagttgtaaaaagaaaaag

SEQ ID NO: 684567 - DNA, 22 bp, Artificial Sequence
  chemically synthesized
tagagttgtaaaaagaaaaaga

SEQ ID NO: 684568 - DNA, 22 bp, Artificial Sequence
  chemically synthesized
agagttgtaaaaagaaaaagaa

SEQ ID NO: 684569 - DNA, 22 bp, Artificial Sequence
  chemically synthesized
gagttgtaaaaagaaaaagaat

SEQ ID NO: 684570 - DNA, 22 bp, Artificial Sequence
  chemically synthesized
catctttgttgcacattctttt

SEQ ID NO: 684571 - DNA, 22 bp, Artificial Sequence
  chemically synthesized
gcatctttgttgcacattcttt

SEQ ID NO: 684572 - DNA, 22 bp, Artificial Sequence
  chemically synthesized
tgcatctttgttgcacattctt

SEQ ID NO: 684573 - DNA, 22 bp, Artificial Sequence
  chemically synthesized
taaaaagaaaaagaatgtgcaa

SEQ ID NO: 684574 - DNA, 22 bp, Artificial Sequence
  chemically synthesized
tggagcactttgcatctttgtt

SEQ ID NO: 684575 - DNA, 22 bp, Artificial Sequence
  chemically synthesized
gtggagcactttgcatctttgt

SEQ ID NO: 684576 - DNA, 22 bp, Artificial Sequence
  chemically synthesized
tgtggagcactttgcatctttg

SEQ ID NO: 684577 - DNA, 22 bp, Artificial Sequence
  chemically synthesized
taggctttgtggagcactttgc

SEQ ID NO: 684578 - DNA, 22 bp, Artificial Sequence
  chemically synthesized
cacaaagcctatagtgtttact

SEQ ID NO: 684579 - DNA, 22 bp, Artificial Sequence
  chemically synthesized
taaaggacaacatagtaaacac

SEQ ID NO: 684580 - DNA, 22 bp, Artificial Sequence
  chemically synthesized
tgtaaaggacaacatagtaaac

SEQ ID NO: 684581 - DNA, 22 bp, Artificial Sequence
  chemically synthesized
ctgtaaaggacaacatagtaaa

SEQ ID NO: 684582 - DNA, 22 bp, Artificial Sequence
  chemically synthesized
tctgtaaaggacaacatagtaa

SEQ ID NO: 684583 - DNA, 22 bp, Artificial Sequence
  chemically synthesized
tagtgtttactatgttgtcctt

SEQ ID NO: 684584 - DNA, 22 bp, Artificial Sequence
  chemically synthesized
actatgttgtcctttacagaaa

SEQ ID NO: 684585 - DNA, 22 bp, Artificial Sequence
  chemically synthesized
ctatgttgtcctttacagaaaa

SEQ ID NO: 684586 - DNA, 22 bp, Artificial Sequence
  chemically synthesized
aggtcagcaaacattttctgta

SEQ ID NO: 684587 - DNA, 22 bp, Artificial Sequence
  chemically synthesized
tgttgtcctttacagaaaatgt

SEQ ID NO: 684588 - DNA, 22 bp, Artificial Sequence
  chemically synthesized
acactgaggtcagcaaacattt

SEQ ID NO: 684589 - DNA, 22 bp, Artificial Sequence
  chemically synthesized
tcctttacagaaaatgtttgct

SEQ ID NO: 684590 - DNA, 22 bp, Artificial Sequence
  chemically synthesized
aacactgaggtcagcaaacatt

SEQ ID NO: 684591 - DNA, 22 bp, Artificial Sequence
  chemically synthesized
gcttaacactgaggtcagcaaa

SEQ ID NO: 684592 - DNA, 22 bp, Artificial Sequence
  chemically synthesized
tacagaaaatgtttgctgacct

SEQ ID NO: 684593 - DNA, 22 bp, Artificial Sequence
  chemically synthesized
acagaaaatgtttgctgacctc

SEQ ID NO: 684594 - DNA, 22 bp, Artificial Sequence
  chemically synthesized
cagaaaatgtttgctgacctca

SEQ ID NO: 684595 - DNA, 22 bp, Artificial Sequence
  chemically synthesized
ctggcttaacactgaggtcagc

SEQ ID NO: 684596 - DNA, 22 bp, Artificial Sequence
  chemically synthesized
actggcttaacactgaggtcag

SEQ ID NO: 684597 - DNA, 22 bp, Artificial Sequence
  chemically synthesized
gctgacctcagtgttaagccag

SEQ ID NO: 684598 - DNA, 22 bp, Artificial Sequence
  chemically synthesized
ctgacctcagtgttaagccagt

SEQ ID NO: 684599 - DNA, 22 bp, Artificial Sequence
  chemically synthesized
acctcagtgttaagccagtaag

SEQ ID NO: 684600 - DNA, 22 bp, Artificial Sequence
  chemically synthesized
agtgttaagccagtaagttttg

SEQ ID NO: 684601 - DNA, 22 bp, Artificial Sequence
  chemically synthesized
tataacagaccaaccccaaaac

SEQ ID NO: 684602 - DNA, 22 bp, Artificial Sequence
  chemically synthesized
agccagtaagttttggggttgg

SEQ ID NO: 684603 - DNA, 22 bp, Artificial Sequence
  chemically synthesized
ctgtataacagaccaaccccaa

SEQ ID NO: 684604 - DNA, 22 bp, Artificial Sequence
  chemically synthesized
gctgtataacagaccaacccca

SEQ ID NO: 684605 - DNA, 22 bp, Artificial Sequence
  chemically synthesized
tgctgtataacagaccaacccc

SEQ ID NO: 684606 - DNA, 22 bp, Artificial Sequence
  chemically synthesized
ttgctgtataacagaccaaccc

SEQ ID NO: 684607 - DNA, 22 bp, Artificial Sequence
  chemically synthesized
cttttgctgtataacagaccaa

SEQ ID NO: 684608 - DNA, 22 bp, Artificial Sequence
  chemically synthesized
tggggttggtctgttatacagc

SEQ ID NO: 684609 - DNA, 22 bp, Artificial Sequence
  chemically synthesized
ggggttggtctgttatacagca

SEQ ID NO: 684610 - DNA, 22 bp, Artificial Sequence
  chemically synthesized
gggttggtctgttatacagcaa

SEQ ID NO: 684611 - DNA, 22 bp, Artificial Sequence
  chemically synthesized
gtctgttatacagcaaaagtag

SEQ ID NO: 684612 - DNA, 22 bp, Artificial Sequence
  chemically synthesized
ttatacagcaaaagtagctgtt

SEQ ID NO: 684613 - DNA, 22 bp, Artificial Sequence
  chemically synthesized
ggagcagatgtgtaacagctac

SEQ ID NO: 684614 - DNA, 22 bp, Artificial Sequence
  chemically synthesized
gggagcagatgtgtaacagcta

SEQ ID NO: 684615 - DNA, 22 bp, Artificial Sequence
  chemically synthesized
tacagcaaaagtagctgttaca

SEQ ID NO: 684616 - DNA, 22 bp, Artificial Sequence
  chemically synthesized
ttgggagcagatgtgtaacagc

SEQ ID NO: 684617 - DNA, 22 bp, Artificial Sequence
  chemically synthesized
cttgggagcagatgtgtaacag

SEQ ID NO: 684618 - DNA, 22 bp, Artificial Sequence
  chemically synthesized
tcttgggagcagatgtgtaaca

SEQ ID NO: 684619 - DNA, 22 bp, Artificial Sequence
  chemically synthesized
tttcttgggagcagatgtgtaa

SEQ ID NO: 684620 - DNA, 22 bp, Artificial Sequence
  chemically synthesized
acgttctttcttgggagcagat

SEQ ID NO: 684621 - DNA, 22 bp, Artificial Sequence
  chemically synthesized
taacgttctttcttgggagcag

SEQ ID NO: 684622 - DNA, 22 bp, Artificial Sequence
  chemically synthesized
ctaacgttctttcttgggagca

SEQ ID NO: 684623 - DNA, 22 bp, Artificial Sequence
  chemically synthesized
ttacacatctgctcccaagaaa

SEQ ID NO: 684624 - DNA, 22 bp, Artificial Sequence
  chemically synthesized
gtttctaacgttctttcttggg

SEQ ID NO: 684625 - DNA, 22 bp, Artificial Sequence
  chemically synthesized
cacatctgctcccaagaaagaa

SEQ ID NO: 684626 - DNA, 22 bp, Artificial Sequence
  chemically synthesized
ctcccaagaaagaacgttagaa

SEQ ID NO: 684627 - DNA, 22 bp, Artificial Sequence
  chemically synthesized
ccaagaaagaacgttagaaact

SEQ ID NO: 684628 - DNA, 22 bp, Artificial Sequence
  chemically synthesized
tgagaaaggcctagtttctaac

SEQ ID NO: 684629 - DNA, 22 bp, Artificial Sequence
  chemically synthesized
gtgagaaaggcctagtttctaa

SEQ ID NO: 684630 - DNA, 22 bp, Artificial Sequence
  chemically synthesized
aatttgtgagaaaggcctagtt

SEQ ID NO: 684631 - DNA, 22 bp, Artificial Sequence
  chemically synthesized
actgaatttgtgagaaaggcct

SEQ ID NO: 684632 - DNA, 22 bp, Artificial Sequence
  chemically synthesized
gaaactaggcctttctcacaaa

SEQ ID NO: 684633 - DNA, 22 bp, Artificial Sequence
  chemically synthesized
ggtgctaactgaatttgtgaga

SEQ ID NO: 684634 - DNA, 22 bp, Artificial Sequence
  chemically synthesized
actaggtgctaactgaatttgt

SEQ ID NO: 684635 - DNA, 22 bp, Artificial Sequence
  chemically synthesized
ggcctttctcacaaattcagtt

SEQ ID NO: 684636 - DNA, 22 bp, Artificial Sequence
  chemically synthesized
tctcacaaattcagttagcacc

SEQ ID NO: 684637 - DNA, 22 bp, Artificial Sequence
  chemically synthesized
ctcacaaattcagttagcacct

SEQ ID NO: 684638 - DNA, 22 bp, Artificial Sequence
  chemically synthesized
tcacaaattcagttagcaccta

SEQ ID NO: 684639 - DNA, 22 bp, Artificial Sequence
  chemically synthesized
acaaattcagttagcacctagt

SEQ ID NO: 684640 - DNA, 22 bp, Artificial Sequence
  chemically synthesized
agttagcacctagtcaatttat

SEQ ID NO: 684641 - DNA, 22 bp, Artificial Sequence
  chemically synthesized
gcacctagtcaatttatccttg

SEQ ID NO: 684642 - DNA, 22 bp, Artificial Sequence
  chemically synthesized
gaggacatgcaccaaggataaa

SEQ ID NO: 684643 - DNA, 22 bp, Artificial Sequence
  chemically synthesized
gtcaatttatccttggtgcatg

SEQ ID NO: 684644 - DNA, 22 bp, Artificial Sequence
  chemically synthesized
acaagcaactggaggacatgca

SEQ ID NO: 684645 - DNA, 22 bp, Artificial Sequence
  chemically synthesized
ttaacaagcaactggaggacat

SEQ ID NO: 684646 - DNA, 22 bp, Artificial Sequence
  chemically synthesized
atccttggtgcatgtcctccag

SEQ ID NO: 684647 - DNA, 22 bp, Artificial Sequence
  chemically synthesized
attaacaagcaactggaggaca

SEQ ID NO: 684648 - DNA, 22 bp, Artificial Sequence
  chemically synthesized
tccttggtgcatgtcctccagt

SEQ ID NO: 684649 - DNA, 22 bp, Artificial Sequence
  chemically synthesized
tcttattaacaagcaactggag

SEQ ID NO: 684650 - DNA, 22 bp, Artificial Sequence
  chemically synthesized
ggtgcatgtcctccagttgctt

SEQ ID NO: 684651 - DNA, 22 bp, Artificial Sequence
  chemically synthesized
gtgcatgtcctccagttgcttg

SEQ ID NO: 684652 - DNA, 22 bp, Artificial Sequence
  chemically synthesized
agcattatcttattaacaagca

SEQ ID NO: 684653 - DNA, 22 bp, Artificial Sequence
  chemically synthesized
cagcattatcttattaacaagc

SEQ ID NO: 684654 - DNA, 22 bp, Artificial Sequence
  chemically synthesized
atttcagcattatcttattaac

SEQ ID NO: 684655 - DNA, 22 bp, Artificial Sequence
  chemically synthesized
cagttgcttgttaataagataa

SEQ ID NO: 684656 - DNA, 22 bp, Artificial Sequence
  chemically synthesized
ttcatttcagcattatcttatt

SEQ ID NO: 684657 - DNA, 22 bp, Artificial Sequence
  chemically synthesized
tgttcatttcagcattatctta

SEQ ID NO: 684658 - DNA, 22 bp, Artificial Sequence
  chemically synthesized
ctgttcatttcagcattatctt

SEQ ID NO: 684659 - DNA, 22 bp, Artificial Sequence
  chemically synthesized
tctgttcatttcagcattatct

SEQ ID NO: 684660 - DNA, 22 bp, Artificial Sequence
  chemically synthesized
cttgttaataagataatgctga

SEQ ID NO: 684661 - DNA, 22 bp, Artificial Sequence
  chemically synthesized
tttctgttcatttcagcattat

SEQ ID NO: 684662 - DNA, 22 bp, Artificial Sequence
  chemically synthesized
gttaataagataatgctgaaat

SEQ ID NO: 684663 - DNA, 22 bp, Artificial Sequence
  chemically synthesized
ttctttctgttcatttcagcat

SEQ ID NO: 684664 - DNA, 22 bp, Artificial Sequence
  chemically synthesized
ttaataagataatgctgaaatg

SEQ ID NO: 684665 - DNA, 22 bp, Artificial Sequence
  chemically synthesized
gttctttctgttcatttcagca

SEQ ID NO: 684666 - DNA, 22 bp, Artificial Sequence
  chemically synthesized
ataagataatgctgaaatgaac

SEQ ID NO: 684667 - DNA, 22 bp, Artificial Sequence
  chemically synthesized
tatgtgtatttgttctttctgt

SEQ ID NO: 684668 - DNA, 22 bp, Artificial Sequence
  chemically synthesized
aaatgaacagaaagaacaaata

SEQ ID NO: 684669 - DNA, 22 bp, Artificial Sequence
  chemically synthesized
ccaggttatatgtgtatttgtt

SEQ ID NO: 684670 - DNA, 22 bp, Artificial Sequence
  chemically synthesized
cccaggttatatgtgtatttgt

SEQ ID NO: 684671 - DNA, 22 bp, Artificial Sequence
  chemically synthesized
aaataacttcccaggttatatg

SEQ ID NO: 684672 - DNA, 22 bp, Artificial Sequence
  chemically synthesized
ctaaaataacttcccaggttat

SEQ ID NO: 684673 - DNA, 22 bp, Artificial Sequence
  chemically synthesized
agaagcatattactaaaataac

SEQ ID NO: 684674 - DNA, 22 bp, Artificial Sequence
  chemically synthesized
gagaagcatattactaaaataa

SEQ ID NO: 684675 - DNA, 22 bp, Artificial Sequence
  chemically synthesized
tgagaagcatattactaaaata

SEQ ID NO: 684676 - DNA, 22 bp, Artificial Sequence
  chemically synthesized
ttgagaagcatattactaaaat

SEQ ID NO: 684677 - DNA, 22 bp, Artificial Sequence
  chemically synthesized
cttttgagaagcatattactaa

SEQ ID NO: 684678 - DNA, 22 bp, Artificial Sequence
  chemically synthesized
acttttgagaagcatattacta

SEQ ID NO: 684679 - DNA, 22 bp, Artificial Sequence
  chemically synthesized
ggaagttattttagtaatatgc

SEQ ID NO: 684680 - DNA, 22 bp, Artificial Sequence
  chemically synthesized
ttttagtaatatgcttctcaaa

SEQ ID NO: 684681 - DNA, 22 bp, Artificial Sequence
  chemically synthesized
taaaatcttacttttgagaagc

SEQ ID NO: 684682 - DNA, 22 bp, Artificial Sequence
  chemically synthesized
ataaaatcttacttttgagaag

SEQ ID NO: 684683 - DNA, 22 bp, Artificial Sequence
  chemically synthesized
tagtaatatgcttctcaaaagt

SEQ ID NO: 684684 - DNA, 22 bp, Artificial Sequence
  chemically synthesized
agtaatatgcttctcaaaagta

SEQ ID NO: 684685 - DNA, 22 bp, Artificial Sequence
  chemically synthesized
gtaatatgcttctcaaaagtaa

SEQ ID NO: 684686 - DNA, 22 bp, Artificial Sequence
  chemically synthesized
aataccccttataaaatcttac

SEQ ID NO: 684687 - DNA, 22 bp, Artificial Sequence
  chemically synthesized
taaataccccttataaaatctt

SEQ ID NO: 684688 - DNA, 22 bp, Artificial Sequence
  chemically synthesized
ctaaataccccttataaaatct

SEQ ID NO: 684689 - DNA, 22 bp, Artificial Sequence
  chemically synthesized
tctaaataccccttataaaatc

SEQ ID NO: 684690 - DNA, 22 bp, Artificial Sequence
  chemically synthesized
ctcaaaagtaagattttataag

SEQ ID NO: 684691 - DNA, 22 bp, Artificial Sequence
  chemically synthesized
ttctaaataccccttataaaat

SEQ ID NO: 684692 - DNA, 22 bp, Artificial Sequence
  chemically synthesized
tcaaaagtaagattttataagg

SEQ ID NO: 684693 - DNA, 22 bp, Artificial Sequence
  chemically synthesized
aaaagtaagattttataagggg

SEQ ID NO: 684694 - DNA, 22 bp, Artificial Sequence
  chemically synthesized
tttttctaaataccccttataa

SEQ ID NO: 684695 - DNA, 22 bp, Artificial Sequence
  chemically synthesized
gtttttctaaataccccttata

SEQ ID NO: 684696 - DNA, 22 bp, Artificial Sequence
  chemically synthesized
tatacttgtttttctaaatacc

SEQ ID NO: 684697 - DNA, 22 bp, Artificial Sequence
  chemically synthesized
tataaggggtatttagaaaaac

SEQ ID NO: 684698 - DNA, 22 bp, Artificial Sequence
  chemically synthesized
ataaggggtatttagaaaaaca

SEQ ID NO: 684699 - DNA, 22 bp, Artificial Sequence
  chemically synthesized
taaggggtatttagaaaaacaa

SEQ ID NO: 684700 - DNA, 22 bp, Artificial Sequence
  chemically synthesized
aaaattgtatacttgtttttct

SEQ ID NO: 684701 - DNA, 22 bp, Artificial Sequence
  chemically synthesized
ctaaaaattgtatacttgtttt

SEQ ID NO: 684702 - DNA, 22 bp, Artificial Sequence
  chemically synthesized
agaaaaacaagtatacaatttt

SEQ ID NO: 684703 - DNA, 22 bp, Artificial Sequence
  chemically synthesized
gaaaaacaagtatacaattttt

SEQ ID NO: 684704 - DNA, 22 bp, Artificial Sequence
  chemically synthesized
tgaataagactgctaaaaattg

SEQ ID NO: 684705 - DNA, 22 bp, Artificial Sequence
  chemically synthesized
aggatattatgaataagactgc

SEQ ID NO: 684706 - DNA, 22 bp, Artificial Sequence
  chemically synthesized
gaggatattatgaataagactg

SEQ ID NO: 684707 - DNA, 22 bp, Artificial Sequence
  chemically synthesized
cagcttgaggatattatgaata

SEQ ID NO: 684708 - DNA, 22 bp, Artificial Sequence
  chemically synthesized
ccagcttgaggatattatgaat

SEQ ID NO: 684709 - DNA, 22 bp, Artificial Sequence
  chemically synthesized
ttagcagtcttattcataatat

SEQ ID NO: 684710 - DNA, 22 bp, Artificial Sequence
  chemically synthesized
tagcagtcttattcataatatc

SEQ ID NO: 684711 - DNA, 22 bp, Artificial Sequence
  chemically synthesized
agcagtcttattcataatatcc

SEQ ID NO: 684712 - DNA, 22 bp, Artificial Sequence
  chemically synthesized
tttccagcttgaggatattatg

SEQ ID NO: 684713 - DNA, 22 bp, Artificial Sequence
  chemically synthesized
gcagtcttattcataatatcct

SEQ ID NO: 684714 - DNA, 22 bp, Artificial Sequence
  chemically synthesized
gtttccagcttgaggatattat

SEQ ID NO: 684715 - DNA, 22 bp, Artificial Sequence
  chemically synthesized
tgtttccagcttgaggatatta

SEQ ID NO: 684716 - DNA, 22 bp, Artificial Sequence
  chemically synthesized
attcataatatcctcaagctgg

SEQ ID NO: 684717 - DNA, 22 bp, Artificial Sequence
  chemically synthesized
ttcataatatcctcaagctgga

SEQ ID NO: 684718 - DNA, 22 bp, Artificial Sequence
  chemically synthesized
ataatatcctcaagctggaaac

SEQ ID NO: 684719 - DNA, 22 bp, Artificial Sequence
  chemically synthesized
agcataatgattttgtttccag

SEQ ID NO: 684720 - DNA, 22 bp, Artificial Sequence
  chemically synthesized
tattcagcataatgattttgtt

SEQ ID NO: 684721 - DNA, 22 bp, Artificial Sequence
  chemically synthesized
atattcagcataatgattttgt

SEQ ID NO: 684722 - DNA, 22 bp, Artificial Sequence
  chemically synthesized
ttatattcagcataatgatttt

SEQ ID NO: 684723 - DNA, 22 bp, Artificial Sequence
  chemically synthesized
aagctggaaacaaaatcattat

SEQ ID NO: 684724 - DNA, 22 bp, Artificial Sequence
  chemically synthesized
gtctcttatattcagcataatg

SEQ ID NO: 684725 - DNA, 22 bp, Artificial Sequence
  chemically synthesized
gaaacaaaatcattatgctgaa

SEQ ID NO: 684726 - DNA, 22 bp, Artificial Sequence
  chemically synthesized
tatgtatctggtctcttatatt

SEQ ID NO: 684727 - DNA, 22 bp, Artificial Sequence
  chemically synthesized
gtatgtatctggtctcttatat

SEQ ID NO: 684728 - DNA, 22 bp, Artificial Sequence
  chemically synthesized
tgtatgtatctggtctcttata

SEQ ID NO: 684729 - DNA, 22 bp, Artificial Sequence
  chemically synthesized
ttgtatgtatctggtctcttat

SEQ ID NO: 684730 - DNA, 22 bp, Artificial Sequence
  chemically synthesized
tgctgaatataagagaccagat

SEQ ID NO: 684731 - DNA, 22 bp, Artificial Sequence
  chemically synthesized
aatataagagaccagatacata

SEQ ID NO: 684732 - DNA, 22 bp, Artificial Sequence
  chemically synthesized
taaatagaatcatacagtattt

SEQ ID NO: 684733 - DNA, 22 bp, Artificial Sequence
  chemically synthesized
tataaatagaatcatacagtat

SEQ ID NO: 684734 - DNA, 22 bp, Artificial Sequence
  chemically synthesized
ctataaatagaatcatacagta

SEQ ID NO: 684735 - DNA, 22 bp, Artificial Sequence
  chemically synthesized
tctataaatagaatcatacagt

SEQ ID NO: 684736 - DNA, 22 bp, Artificial Sequence
  chemically synthesized
aagaattttctataaatagaat

SEQ ID NO: 684737 - DNA, 22 bp, Artificial Sequence
  chemically synthesized
caagaattttctataaatagaa

SEQ ID NO: 684738 - DNA, 22 bp, Artificial Sequence
  chemically synthesized
tcaagaattttctataaataga

SEQ ID NO: 684739 - DNA, 22 bp, Artificial Sequence
  chemically synthesized
cattttcaagaattttctataa

SEQ ID NO: 684740 - DNA, 22 bp, Artificial Sequence
  chemically synthesized
tatgattctatttatagaaaat

SEQ ID NO: 684741 - DNA, 22 bp, Artificial Sequence
  chemically synthesized
gcattttcaagaattttctata

SEQ ID NO: 684742 - DNA, 22 bp, Artificial Sequence
  chemically synthesized
tgcattttcaagaattttctat

SEQ ID NO: 684743 - DNA, 22 bp, Artificial Sequence
  chemically synthesized
ctttgcattttcaagaattttc

SEQ ID NO: 684744 - DNA, 22 bp, Artificial Sequence
  chemically synthesized
tatttatagaaaattcttgaaa

SEQ ID NO: 684745 - DNA, 22 bp, Artificial Sequence
  chemically synthesized
tttatagaaaattcttgaaaat

SEQ ID NO: 684746 - DNA, 22 bp, Artificial Sequence
  chemically synthesized
tgtattactttgcattttcaag

SEQ ID NO: 684747 - DNA, 22 bp, Artificial Sequence
  chemically synthesized
atagaaaattcttgaaaatgca

SEQ ID NO: 684748 - DNA, 22 bp, Artificial Sequence
  chemically synthesized
tagaaaattcttgaaaatgcaa

SEQ ID NO: 684749 - DNA, 22 bp, Artificial Sequence
  chemically synthesized
actgtgtattactttgcatttt

SEQ ID NO: 684750 - DNA, 22 bp, Artificial Sequence
  chemically synthesized
tcactgtgtattactttgcatt

SEQ ID NO: 684751 - DNA, 22 bp, Artificial Sequence
  chemically synthesized
tctcactgtgtattactttgca

SEQ ID NO: 684752 - DNA, 22 bp, Artificial Sequence
  chemically synthesized
ctctcactgtgtattactttgc

SEQ ID NO: 684753 - DNA, 22 bp, Artificial Sequence
  chemically synthesized
tctctcactgtgtattactttg

SEQ ID NO: 684754 - DNA, 22 bp, Artificial Sequence
  chemically synthesized
ttgaaaatgcaaagtaatacac

SEQ ID NO: 684755 - DNA, 22 bp, Artificial Sequence
  chemically synthesized
gaaaatgcaaagtaatacacag

SEQ ID NO: 684756 - DNA, 22 bp, Artificial Sequence
  chemically synthesized
aaaatgcaaagtaatacacagt

SEQ ID NO: 684757 - DNA, 22 bp, Artificial Sequence
  chemically synthesized
atcgtctttctctcactgtgta

SEQ ID NO: 684758 - DNA, 22 bp, Artificial Sequence
  chemically synthesized
ggcaaccactgatcgtctttct

SEQ ID NO: 684759 - DNA, 22 bp, Artificial Sequence
  chemically synthesized
taggcaaccactgatcgtcttt

SEQ ID NO: 684760 - DNA, 22 bp, Artificial Sequence
  chemically synthesized
attctaggcaaccactgatcgt

SEQ ID NO: 684761 - DNA, 22 bp, Artificial Sequence
  chemically synthesized
acccctgattctaggcaaccac

SEQ ID NO: 684762 - DNA, 22 bp, Artificial Sequence
  chemically synthesized
cacccctgattctaggcaacca

SEQ ID NO: 684763 - DNA, 22 bp, Artificial Sequence
  chemically synthesized
tcacccctgattctaggcaacc

SEQ ID NO: 684764 - DNA, 22 bp, Artificial Sequence
  chemically synthesized
ctttcacccctgattctaggca

SEQ ID NO: 684765 - DNA, 22 bp, Artificial Sequence
  chemically synthesized
cctttcacccctgattctaggc

SEQ ID NO: 684766 - DNA, 22 bp, Artificial Sequence
  chemically synthesized
tcctttcacccctgattctagg

SEQ ID NO: 684767 - DNA, 22 bp, Artificial Sequence
  chemically synthesized
ttcctttcacccctgattctag

SEQ ID NO: 684768 - DNA, 22 bp, Artificial Sequence
  chemically synthesized
caggtcatttttcctttcaccc

SEQ ID NO: 684769 - DNA, 22 bp, Artificial Sequence
  chemically synthesized
cctagaatcaggggtgaaagga

SEQ ID NO: 684770 - DNA, 22 bp, Artificial Sequence
  chemically synthesized
gcaggtcatttttcctttcacc

SEQ ID NO: 684771 - DNA, 22 bp, Artificial Sequence
  chemically synthesized
tgcaggtcatttttcctttcac

SEQ ID NO: 684772 - DNA, 22 bp, Artificial Sequence
  chemically synthesized
gaatcaggggtgaaaggaaaaa

SEQ ID NO: 684773 - DNA, 22 bp, Artificial Sequence
  chemically synthesized
tgcccctttgcaggtcattttt

SEQ ID NO: 684774 - DNA, 22 bp, Artificial Sequence
  chemically synthesized
gtgcccctttgcaggtcatttt

SEQ ID NO: 684775 - DNA, 22 bp, Artificial Sequence
  chemically synthesized
cttgtgcccctttgcaggtcat

SEQ ID NO: 684776 - DNA, 22 bp, Artificial Sequence
  chemically synthesized
ccccaaaagcctccttgtgccc

SEQ ID NO: 684777 - DNA, 22 bp, Artificial Sequence
  chemically synthesized
ctcccccaaaagcctccttgtg

SEQ ID NO: 684778 - DNA, 22 bp, Artificial Sequence
  chemically synthesized
actcccccaaaagcctccttgt

SEQ ID NO: 684779 - DNA, 22 bp, Artificial Sequence
  chemically synthesized
ttactcccccaaaagcctcctt

SEQ ID NO: 684780 - DNA, 22 bp, Artificial Sequence
  chemically synthesized
caaaggggcacaaggaggcttt

SEQ ID NO: 684781 - DNA, 22 bp, Artificial Sequence
  chemically synthesized
cagtcaaatgacagaacgttct

SEQ ID NO: 684782 - DNA, 22 bp, Artificial Sequence
  chemically synthesized
ttgggggagtaagaacgttctg

SEQ ID NO: 684783 - DNA, 22 bp, Artificial Sequence
  chemically synthesized
tgggggagtaagaacgttctgt

SEQ ID NO: 684784 - DNA, 22 bp, Artificial Sequence
  chemically synthesized
gggggagtaagaacgttctgtc

SEQ ID NO: 684785 - DNA, 22 bp, Artificial Sequence
  chemically synthesized
ggggagtaagaacgttctgtca

SEQ ID NO: 684786 - DNA, 22 bp, Artificial Sequence
  chemically synthesized
tgaaaccaccactgcagtcaaa

SEQ ID NO: 684787 - DNA, 22 bp, Artificial Sequence
  chemically synthesized
gtgaaaccaccactgcagtcaa

SEQ ID NO: 684788 - DNA, 22 bp, Artificial Sequence
  chemically synthesized
tgtcatttgactgcagtggtgg

SEQ ID NO: 684789 - DNA, 22 bp, Artificial Sequence
  chemically synthesized
tcatttgactgcagtggtggtt

SEQ ID NO: 684790 - DNA, 22 bp, Artificial Sequence
  chemically synthesized
gactgcagtggtggtttcacaa

SEQ ID NO: 684791 - DNA, 22 bp, Artificial Sequence
  chemically synthesized
gcagatgtgtacttgtgaaacc

SEQ ID NO: 684792 - DNA, 22 bp, Artificial Sequence
  chemically synthesized
actgcagtggtggtttcacaag

SEQ ID NO: 684793 - DNA, 22 bp, Artificial Sequence
  chemically synthesized
ggcagatgtgtacttgtgaaac

SEQ ID NO: 684794 - DNA, 22 bp, Artificial Sequence
  chemically synthesized
tggcagatgtgtacttgtgaaa

SEQ ID NO: 684795 - DNA, 22 bp, Artificial Sequence
  chemically synthesized
ttggcagatgtgtacttgtgaa

SEQ ID NO: 684796 - DNA, 22 bp, Artificial Sequence
  chemically synthesized
cagtggtggtttcacaagtaca

SEQ ID NO: 684797 - DNA, 22 bp, Artificial Sequence
  chemically synthesized
agcgatttttggcagatgtgta

SEQ ID NO: 684798 - DNA, 22 bp, Artificial Sequence
  chemically synthesized
cacaagtacacatctgccaaaa

SEQ ID NO: 684799 - DNA, 22 bp, Artificial Sequence
  chemically synthesized
acaagtacacatctgccaaaaa

SEQ ID NO: 684800 - DNA, 22 bp, Artificial Sequence
  chemically synthesized
aagtggttcagcgatttttggc

SEQ ID NO: 684801 - DNA, 22 bp, Artificial Sequence
  chemically synthesized
aaagtggttcagcgatttttgg

SEQ ID NO: 684802 - DNA, 22 bp, Artificial Sequence
  chemically synthesized
catttaaagtggttcagcgatt

SEQ ID NO: 684803 - DNA, 22 bp, Artificial Sequence
  chemically synthesized
cctccatttaaagtggttcagc

SEQ ID NO: 684804 - DNA, 22 bp, Artificial Sequence
  chemically synthesized
ccaaaaatcgctgaaccacttt

SEQ ID NO: 684805 - DNA, 22 bp, Artificial Sequence
  chemically synthesized
cacacagtaaactgcctccatt

SEQ ID NO: 684806 - DNA, 22 bp, Artificial Sequence
  chemically synthesized
acacacagtaaactgcctccat

SEQ ID NO: 684807 - DNA, 22 bp, Artificial Sequence
  chemically synthesized
aaccactttaaatggaggcagt

SEQ ID NO: 684808 - DNA, 22 bp, Artificial Sequence
  chemically synthesized
taaatggaggcagtttactgtg

SEQ ID NO: 684809 - DNA, 22 bp, Artificial Sequence
  chemically synthesized
aaatggaggcagtttactgtgt

SEQ ID NO: 684810 - DNA, 22 bp, Artificial Sequence
  chemically synthesized
aatggaggcagtttactgtgtg

SEQ ID NO: 684811 - DNA, 22 bp, Artificial Sequence
  chemically synthesized
aataaaaatttacacacagtaa

SEQ ID NO: 684812 - DNA, 22 bp, Artificial Sequence
  chemically synthesized
ttaaataaaaatttacacacag

SEQ ID NO: 684813 - DNA, 22 bp, Artificial Sequence
  chemically synthesized
attaaataaaaatttacacaca

SEQ ID NO: 684814 - DNA, 22 bp, Artificial Sequence
  chemically synthesized
tattaaataaaaatttacacac

SEQ ID NO: 684815 - DNA, 22 bp, Artificial Sequence
  chemically synthesized
actgtgtgtaaatttttattta

SEQ ID NO: 684816 - DNA, 22 bp, Artificial Sequence
  chemically synthesized
ctgtgtgtaaatttttatttaa

SEQ ID NO: 684817 - DNA, 22 bp, Artificial Sequence
  chemically synthesized
aaataaactttattaaataaaa

SEQ ID NO: 684818 - DNA, 22 bp, Artificial Sequence
  chemically synthesized
aaaataaactttattaaataaa

SEQ ID NO: 684819 - DNA, 22 bp, Artificial Sequence
  chemically synthesized
taaaataaactttattaaataa

SEQ ID NO: 684820 - DNA, 22 bp, Artificial Sequence
  chemically synthesized
tgtgtaaatttttatttaataa

SEQ ID NO: 684821 - DNA, 22 bp, Artificial Sequence
  chemically synthesized
aaaaaattttaaaataaacttt

SEQ ID NO: 684822 - DNA, 22 bp, Artificial Sequence
  chemically synthesized
aaaaaaattttaaaataaactt

SEQ ID NO: 684823 - DNA, 22 bp, Artificial Sequence
  chemically synthesized
taaaaaaattttaaaataaact

SEQ ID NO: 684824 - DNA, 22 bp, Artificial Sequence
  chemically synthesized
ttatttaataaagtttatttta

SEQ ID NO: 684825 - DNA, 22 bp, Artificial Sequence
  chemically synthesized
ttaaaaaaattttaaaataaac

SEQ ID NO: 684826 - DNA, 22 bp, Artificial Sequence
  chemically synthesized
tatttaataaagtttattttaa

SEQ ID NO: 684827 - DNA, 22 bp, Artificial Sequence
  chemically synthesized
tttaaaaaaattttaaaataaa

SEQ ID NO: 684828 - DNA, 22 bp, Artificial Sequence
  chemically synthesized
atttaataaagtttattttaaa

SEQ ID NO: 684829 - DNA, 22 bp, Artificial Sequence
  chemically synthesized
ttttaaaaaaattttaaaataa

SEQ ID NO: 684830 - DNA, 22 bp, Artificial Sequence
  chemically synthesized
tttaataaagtttattttaaaa

SEQ ID NO: 684831 - DNA, 22 bp, Artificial Sequence
  chemically synthesized
aataaagtttattttaaaattt

SEQ ID NO: 684832 - DNA, 22 bp, Artificial Sequence
  chemically synthesized
ataaagtttattttaaaatttt

SEQ ID NO: 684833 - DNA, 22 bp, Artificial Sequence
  chemically synthesized
gggcaaacgcttttttaaaaaa

SEQ ID NO: 684834 - DNA, 22 bp, Artificial Sequence
  chemically synthesized
agggcaaacgcttttttaaaaa

SEQ ID NO: 684835 - DNA, 22 bp, Artificial Sequence
  chemically synthesized
attttaaaatttttttaaaaaa

SEQ ID NO: 684836 - DNA, 22 bp, Artificial Sequence
  chemically synthesized
tagggcaaacgcttttttaaaa

SEQ ID NO: 684837 - DNA, 22 bp, Artificial Sequence
  chemically synthesized
ttttaaaatttttttaaaaaag

SEQ ID NO: 684838 - DNA, 22 bp, Artificial Sequence
  chemically synthesized
taaaatttttttaaaaaagcgt

SEQ ID NO: 684839 - DNA, 22 bp, Artificial Sequence
  chemically synthesized
attttagggcaaacgctttttt

SEQ ID NO: 684840 - DNA, 22 bp, Artificial Sequence
  chemically synthesized
aaaatttttttaaaaaagcgtt

SEQ ID NO: 684841 - DNA, 22 bp, Artificial Sequence
  chemically synthesized
gattttagggcaaacgcttttt

SEQ ID NO: 684842 - DNA, 22 bp, Artificial Sequence
  chemically synthesized
aaatttttttaaaaaagcgttt

SEQ ID NO: 684843 - DNA, 22 bp, Artificial Sequence
  chemically synthesized
aatttgattttagggcaaacgc

SEQ ID NO: 684844 - DNA, 22 bp, Artificial Sequence
  chemically synthesized
ttttaaaaaagcgtttgcccta

SEQ ID NO: 684845 - DNA, 22 bp, Artificial Sequence
  chemically synthesized
tttaaaaaagcgtttgccctaa

SEQ ID NO: 684846 - DNA, 22 bp, Artificial Sequence
  chemically synthesized
ttaaaaaagcgtttgccctaaa

SEQ ID NO: 684847 - DNA, 22 bp, Artificial Sequence
  chemically synthesized
taaaaaagcgtttgccctaaaa

SEQ ID NO: 684848 - DNA, 22 bp, Artificial Sequence
  chemically synthesized
aaaaaagcgtttgccctaaaat

SEQ ID NO: 684849 - DNA, 22 bp, Artificial Sequence
  chemically synthesized
aaaaagcgtttgccctaaaatc

SEQ ID NO: 684850 - DNA, 22 bp, Artificial Sequence
  chemically synthesized
aatgttaaatttgattttaggg

SEQ ID NO: 684851 - DNA, 22 bp, Artificial Sequence
  chemically synthesized
gaatgttaaatttgattttagg

SEQ ID NO: 684852 - DNA, 22 bp, Artificial Sequence
  chemically synthesized
tgaatgttaaatttgattttag

SEQ ID NO: 684853 - DNA, 22 bp, Artificial Sequence
  chemically synthesized
ttgaatgttaaatttgatttta

SEQ ID NO: 684854 - DNA, 22 bp, Artificial Sequence
  chemically synthesized
gccctaaaatcaaatttaacat

SEQ ID NO: 684855 - DNA, 22 bp, Artificial Sequence
  chemically synthesized
ccctaaaatcaaatttaacatt

SEQ ID NO: 684856 - DNA, 22 bp, Artificial Sequence
  chemically synthesized
tatgcatttttgaatgttaaat

SEQ ID NO: 684857 - DNA, 22 bp, Artificial Sequence
  chemically synthesized
aaatcaaatttaacattcaaaa

SEQ ID NO: 684858 - DNA, 22 bp, Artificial Sequence
  chemically synthesized
tgcagttgtatgcatttttgaa

SEQ ID NO: 684859 - DNA, 22 bp, Artificial Sequence
  chemically synthesized
gtgcagttgtatgcatttttga

SEQ ID NO: 684860 - DNA, 22 bp, Artificial Sequence
  chemically synthesized
tgtgcagttgtatgcatttttg

SEQ ID NO: 684861 - DNA, 22 bp, Artificial Sequence
  chemically synthesized
tttgtgcagttgtatgcatttt

SEQ ID NO: 684862 - DNA, 22 bp, Artificial Sequence
  chemically synthesized
aacattcaaaaatgcatacaac

SEQ ID NO: 684863 - DNA, 22 bp, Artificial Sequence
  chemically synthesized
attctttgtgcagttgtatgca

SEQ ID NO: 684864 - DNA, 22 bp, Artificial Sequence
  chemically synthesized
acattcaaaaatgcatacaact

SEQ ID NO: 684865 - DNA, 22 bp, Artificial Sequence
  chemically synthesized
aaaaatgcatacaactgcacaa

SEQ ID NO: 684866 - DNA, 22 bp, Artificial Sequence
  chemically synthesized
tgtgatgcacctcattctttgt

SEQ ID NO: 684867 - DNA, 22 bp, Artificial Sequence
  chemically synthesized
cacaaagaatgaggtgcatcac

SEQ ID NO: 684868 - DNA, 22 bp, Artificial Sequence
  chemically synthesized
tgtaaacatcctgtgtgatgca

SEQ ID NO: 684869 - DNA, 22 bp, Artificial Sequence
  chemically synthesized
atgtaaacatcctgtgtgatgc

SEQ ID NO: 684870 - DNA, 22 bp, Artificial Sequence
  chemically synthesized
tatttatgtaaacatcctgtgt

SEQ ID NO: 684871 - DNA, 22 bp, Artificial Sequence
  chemically synthesized
tcctatatttatgtaaacatcc

SEQ ID NO: 684872 - DNA, 22 bp, Artificial Sequence
  chemically synthesized
aatctgtcctatatttatgtaa

SEQ ID NO: 684873 - DNA, 22 bp, Artificial Sequence
  chemically synthesized
acagcatgacctgaatctgtcc

SEQ ID NO: 684874 - DNA, 22 bp, Artificial Sequence
  chemically synthesized
acataaatataggacagattca

SEQ ID NO: 684875 - DNA, 22 bp, Artificial Sequence
  chemically synthesized
cataaatataggacagattcag

SEQ ID NO: 684876 - DNA, 22 bp, Artificial Sequence
  chemically synthesized
atcagaagggaactgacagcat

SEQ ID NO: 684877 - DNA, 22 bp, Artificial Sequence
  chemically synthesized
aggtcatgctgtcagttccctt

SEQ ID NO: 684878 - DNA, 22 bp, Artificial Sequence
  chemically synthesized
ggaattaatcagaagggaactg

SEQ ID NO: 684879 - DNA, 22 bp, Artificial Sequence
  chemically synthesized
cggaattaatcagaagggaact

SEQ ID NO: 684880 - DNA, 22 bp, Artificial Sequence
  chemically synthesized
tcggaattaatcagaagggaac

SEQ ID NO: 684881 - DNA, 22 bp, Artificial Sequence
  chemically synthesized
atattttcggaattaatcagaa

SEQ ID NO: 684882 - DNA, 22 bp, Artificial Sequence
  chemically synthesized
gatattttcggaattaatcaga

SEQ ID NO: 684883 - DNA, 22 bp, Artificial Sequence
  chemically synthesized
tgatattttcggaattaatcag

SEQ ID NO: 684884 - DNA, 22 bp, Artificial Sequence
  chemically synthesized
tcagttcccttctgattaattc

SEQ ID NO: 684885 - DNA, 22 bp, Artificial Sequence
  chemically synthesized
atgttttgatattttcggaatt

SEQ ID NO: 684886 - DNA, 22 bp, Artificial Sequence
  chemically synthesized
ccttctgattaattccgaaaat

SEQ ID NO: 684887 - DNA, 22 bp, Artificial Sequence
  chemically synthesized
ctgattaattccgaaaatatca

SEQ ID NO: 684888 - DNA, 22 bp, Artificial Sequence
  chemically synthesized
tgattaattccgaaaatatcaa

SEQ ID NO: 684889 - DNA, 22 bp, Artificial Sequence
  chemically synthesized
tgaatctaatgttttgatattt

SEQ ID NO: 684890 - DNA, 22 bp, Artificial Sequence
  chemically synthesized
attaattccgaaaatatcaaaa

SEQ ID NO: 684891 - DNA, 22 bp, Artificial Sequence
  chemically synthesized
gtgaatctaatgttttgatatt

SEQ ID NO: 684892 - DNA, 22 bp, Artificial Sequence
  chemically synthesized
attccgaaaatatcaaaacatt

SEQ ID NO: 684893 - DNA, 22 bp, Artificial Sequence
  chemically synthesized
cgaaaatatcaaaacattagat

SEQ ID NO: 684894 - DNA, 22 bp, Artificial Sequence
  chemically synthesized
aggtcacttgtgaatctaatgt

SEQ ID NO: 684895 - DNA, 22 bp, Artificial Sequence
  chemically synthesized
aaggtcacttgtgaatctaatg

SEQ ID NO: 684896 - DNA, 22 bp, Artificial Sequence
  chemically synthesized
taaggtcacttgtgaatctaat

SEQ ID NO: 684897 - DNA, 22 bp, Artificial Sequence
  chemically synthesized
acctttaaggtcacttgtgaat

SEQ ID NO: 684898 - DNA, 22 bp, Artificial Sequence
  chemically synthesized
attaacctttaaggtcacttgt

SEQ ID NO: 684899 - DNA, 22 bp, Artificial Sequence
  chemically synthesized
gattcacaagtgaccttaaagg

SEQ ID NO: 684900 - DNA, 22 bp, Artificial Sequence
  chemically synthesized
acaagtgaccttaaaggttaat

SEQ ID NO: 684901 - DNA, 22 bp, Artificial Sequence
  chemically synthesized
gatgagaggatataattcatta

SEQ ID NO: 684902 - DNA, 22 bp, Artificial Sequence
  chemically synthesized
tattggatgagaggatataatt

SEQ ID NO: 684903 - DNA, 22 bp, Artificial Sequence
  chemically synthesized
aaaggttaatgaattatatcct

SEQ ID NO: 684904 - DNA, 22 bp, Artificial Sequence
  chemically synthesized
aaggttaatgaattatatcctc

SEQ ID NO: 684905 - DNA, 22 bp, Artificial Sequence
  chemically synthesized
tgtattggatgagaggatataa

SEQ ID NO: 684906 - DNA, 22 bp, Artificial Sequence
  chemically synthesized
ctgtattggatgagaggatata

SEQ ID NO: 684907 - DNA, 22 bp, Artificial Sequence
  chemically synthesized
atgaattatatcctctcatcca

SEQ ID NO: 684908 - DNA, 22 bp, Artificial Sequence
  chemically synthesized
aaggcaatttctgtattggatg

SEQ ID NO: 684909 - DNA, 22 bp, Artificial Sequence
  chemically synthesized
tatcctctcatccaatacagaa

SEQ ID NO: 684910 - DNA, 22 bp, Artificial Sequence
  chemically synthesized
acccctaaaggcaatttctgta

SEQ ID NO: 684911 - DNA, 22 bp, Artificial Sequence
  chemically synthesized
tcatccaatacagaaattgcct

SEQ ID NO: 684912 - DNA, 22 bp, Artificial Sequence
  chemically synthesized
tctcacccctaaaggcaatttc

SEQ ID NO: 684913 - DNA, 22 bp, Artificial Sequence
  chemically synthesized
atccaatacagaaattgccttt

SEQ ID NO: 684914 - DNA, 22 bp, Artificial Sequence
  chemically synthesized
aaatgactgtctcacccctaaa

SEQ ID NO: 684915 - DNA, 22 bp, Artificial Sequence
  chemically synthesized
aagactgaaatgactgtctcac

SEQ ID NO: 684916 - DNA, 22 bp, Artificial Sequence
  chemically synthesized
caagactgaaatgactgtctca

SEQ ID NO: 684917 - DNA, 22 bp, Artificial Sequence
  chemically synthesized
tcaagactgaaatgactgtctc

SEQ ID NO: 684918 - DNA, 22 bp, Artificial Sequence
  chemically synthesized
cctttaggggtgagacagtcat

SEQ ID NO: 684919 - DNA, 22 bp, Artificial Sequence
  chemically synthesized
taggggtgagacagtcatttca

SEQ ID NO: 684920 - DNA, 22 bp, Artificial Sequence
  chemically synthesized
aggggtgagacagtcatttcag

SEQ ID NO: 684921 - DNA, 22 bp, Artificial Sequence
  chemically synthesized
ggggtgagacagtcatttcagt

SEQ ID NO: 684922 - DNA, 22 bp, Artificial Sequence
  chemically synthesized
tacagtagattttcaagactga

SEQ ID NO: 684923 - DNA, 22 bp, Artificial Sequence
  chemically synthesized
cctgtacagtagattttcaaga

SEQ ID NO: 684924 - DNA, 22 bp, Artificial Sequence
  chemically synthesized
aactccctgtacagtagatttt

SEQ ID NO: 684925 - DNA, 22 bp, Artificial Sequence
  chemically synthesized
cagtcttgaaaatctactgtac

SEQ ID NO: 684926 - DNA, 22 bp, Artificial Sequence
  chemically synthesized
agtcttgaaaatctactgtaca

SEQ ID NO: 684927 - DNA, 22 bp, Artificial Sequence
  chemically synthesized
aaaagcattaaactccctgtac

SEQ ID NO: 684928 - DNA, 22 bp, Artificial Sequence
  chemically synthesized
gaaaatctactgtacagggagt

SEQ ID NO: 684929 - DNA, 22 bp, Artificial Sequence
  chemically synthesized
gaaaagcattaaactccctgta

SEQ ID NO: 684930 - DNA, 22 bp, Artificial Sequence
  chemically synthesized
aaaatctactgtacagggagtt

SEQ ID NO: 684931 - DNA, 22 bp, Artificial Sequence
  chemically synthesized
tgaaaagcattaaactccctgt

SEQ ID NO: 684932 - DNA, 22 bp, Artificial Sequence
  chemically synthesized
ctgtacagggagtttaatgctt

SEQ ID NO: 684933 - DNA, 22 bp, Artificial Sequence
  chemically synthesized
tacagggagtttaatgcttttc

SEQ ID NO: 684934 - DNA, 22 bp, Artificial Sequence
  chemically synthesized
caaaaaataaaatccgccactt

SEQ ID NO: 684935 - DNA, 22 bp, Artificial Sequence
  chemically synthesized
aatgcttttcaaagtggcggat

SEQ ID NO: 684936 - DNA, 22 bp, Artificial Sequence
  chemically synthesized
atgcttttcaaagtggcggatt

SEQ ID NO: 684937 - DNA, 22 bp, Artificial Sequence
  chemically synthesized
tccaaaaaataaaatccgccac

SEQ ID NO: 684938 - DNA, 22 bp, Artificial Sequence
  chemically synthesized
ttcaaagtggcggattttattt

SEQ ID NO: 684939 - DNA, 22 bp, Artificial Sequence
  chemically synthesized
tcaaagtggcggattttatttt

SEQ ID NO: 684940 - DNA, 22 bp, Artificial Sequence
  chemically synthesized
caaagtggcggattttattttt

SEQ ID NO: 684941 - DNA, 22 bp, Artificial Sequence
  chemically synthesized
aaagtggcggattttatttttt

SEQ ID NO: 684942 - DNA, 22 bp, Artificial Sequence
  chemically synthesized
taatcgagctctccaaaaaata

SEQ ID NO: 684943 - DNA, 22 bp, Artificial Sequence
  chemically synthesized
gtaatcgagctctccaaaaaat

SEQ ID NO: 684944 - DNA, 22 bp, Artificial Sequence
  chemically synthesized
tgtaatcgagctctccaaaaaa

SEQ ID NO: 684945 - DNA, 22 bp, Artificial Sequence
  chemically synthesized
ttgtaatcgagctctccaaaaa

SEQ ID NO: 684946 - DNA, 22 bp, Artificial Sequence
  chemically synthesized
tattttttggagagctcgatta

SEQ ID NO: 684947 - DNA, 22 bp, Artificial Sequence
  chemically synthesized
aagaaacttttgtaatcgagct

SEQ ID NO: 684948 - DNA, 22 bp, Artificial Sequence
  chemically synthesized
attttttggagagctcgattac

SEQ ID NO: 684949 - DNA, 22 bp, Artificial Sequence
  chemically synthesized
ttttttggagagctcgattaca

SEQ ID NO: 684950 - DNA, 22 bp, Artificial Sequence
  chemically synthesized
tttggagagctcgattacaaaa

SEQ ID NO: 684951 - DNA, 22 bp, Artificial Sequence
  chemically synthesized
ttggagagctcgattacaaaag

SEQ ID NO: 684952 - DNA, 22 bp, Artificial Sequence
  chemically synthesized
tggagagctcgattacaaaagt

SEQ ID NO: 684953 - DNA, 22 bp, Artificial Sequence
  chemically synthesized
aatattaaagaaacttttgtaa

SEQ ID NO: 684954 - DNA, 22 bp, Artificial Sequence
  chemically synthesized
ggagagctcgattacaaaagtt

SEQ ID NO: 684955 - DNA, 22 bp, Artificial Sequence
  chemically synthesized
gagagctcgattacaaaagttt

SEQ ID NO: 684956 - DNA, 22 bp, Artificial Sequence
  chemically synthesized
actaaatattaaagaaactttt

SEQ ID NO: 684957 - DNA, 22 bp, Artificial Sequence
  chemically synthesized
aactaaatattaaagaaacttt

SEQ ID NO: 684958 - DNA, 22 bp, Artificial Sequence
  chemically synthesized
taactaaatattaaagaaactt

SEQ ID NO: 684959 - DNA, 22 bp, Artificial Sequence
  chemically synthesized
gattacaaaagtttctttaata

SEQ ID NO: 684960 - DNA, 22 bp, Artificial Sequence
  chemically synthesized
caaaagtttctttaatatttag

SEQ ID NO: 684961 - DNA, 22 bp, Artificial Sequence
  chemically synthesized
tgggaaagcatattttaactaa

SEQ ID NO: 684962 - DNA, 22 bp, Artificial Sequence
  chemically synthesized
ctttaatatttagttaaaatat

SEQ ID NO: 684963 - DNA, 22 bp, Artificial Sequence
  chemically synthesized
tttaatatttagttaaaatatg

SEQ ID NO: 684964 - DNA, 22 bp, Artificial Sequence
  chemically synthesized
taatatttagttaaaatatgct

SEQ ID NO: 684965 - DNA, 22 bp, Artificial Sequence
  chemically synthesized
aatatttagttaaaatatgctt

SEQ ID NO: 684966 - DNA, 22 bp, Artificial Sequence
  chemically synthesized
atatttagttaaaatatgcttt

SEQ ID NO: 684967 - DNA, 22 bp, Artificial Sequence
  chemically synthesized
agttaaaatatgctttcccata

SEQ ID NO: 684968 - DNA, 22 bp, Artificial Sequence
  chemically synthesized
gttaaaatatgctttcccataa

SEQ ID NO: 684969 - DNA, 22 bp, Artificial Sequence
  chemically synthesized
gatatgtggaagttatgggaaa

SEQ ID NO: 684970 - DNA, 22 bp, Artificial Sequence
  chemically synthesized
aaatatgctttcccataacttc

SEQ ID NO: 684971 - DNA, 22 bp, Artificial Sequence
  chemically synthesized
agctagatatgtggaagttatg

SEQ ID NO: 684972 - DNA, 22 bp, Artificial Sequence
  chemically synthesized
tcccataacttccacatatcta

SEQ ID NO: 684973 - DNA, 22 bp, Artificial Sequence
  chemically synthesized
cccataacttccacatatctag

SEQ ID NO: 684974 - DNA, 22 bp, Artificial Sequence
  chemically synthesized
ccataacttccacatatctagc

SEQ ID NO: 684975 - DNA, 22 bp, Artificial Sequence
  chemically synthesized
agaatggattgagctagatatg

SEQ ID NO: 684976 - DNA, 22 bp, Artificial Sequence
  chemically synthesized
tgagaatggattgagctagata

SEQ ID NO: 684977 - DNA, 22 bp, Artificial Sequence
  chemically synthesized
ttctgagaatggattgagctag

SEQ ID NO: 684978 - DNA, 22 bp, Artificial Sequence
  chemically synthesized
attctgagaatggattgagcta

SEQ ID NO: 684979 - DNA, 22 bp, Artificial Sequence
  chemically synthesized
tattctgagaatggattgagct

SEQ ID NO: 684980 - DNA, 22 bp, Artificial Sequence
  chemically synthesized
ccacatatctagctcaatccat

SEQ ID NO: 684981 - DNA, 22 bp, Artificial Sequence
  chemically synthesized
cacatatctagctcaatccatt

SEQ ID NO: 684982 - DNA, 22 bp, Artificial Sequence
  chemically synthesized
ttttattctgagaatggattga

SEQ ID NO: 684983 - DNA, 22 bp, Artificial Sequence
  chemically synthesized
ctgttttattctgagaatggat

SEQ ID NO: 684984 - DNA, 22 bp, Artificial Sequence
  chemically synthesized
cctgttttattctgagaatgga

SEQ ID NO: 684985 - DNA, 22 bp, Artificial Sequence
  chemically synthesized
tcctgttttattctgagaatgg

SEQ ID NO: 684986 - DNA, 22 bp, Artificial Sequence
  chemically synthesized
ttcctgttttattctgagaatg

SEQ ID NO: 684987 - DNA, 22 bp, Artificial Sequence
  chemically synthesized
tttcctgttttattctgagaat

SEQ ID NO: 684988 - DNA, 22 bp, Artificial Sequence
  chemically synthesized
ttttcctgttttattctgagaa

SEQ ID NO: 684989 - DNA, 22 bp, Artificial Sequence
  chemically synthesized
gctcaatccattctcagaataa

SEQ ID NO: 684990 - DNA, 22 bp, Artificial Sequence
  chemically synthesized
tttttttcctgttttattctga

SEQ ID NO: 684991 - DNA, 22 bp, Artificial Sequence
  chemically synthesized
aatccattctcagaataaaaca

SEQ ID NO: 684992 - DNA, 22 bp, Artificial Sequence
  chemically synthesized
ttatttttttcctgttttattc

SEQ ID NO: 684993 - DNA, 22 bp, Artificial Sequence
  chemically synthesized
gttatttttttcctgttttatt

SEQ ID NO: 684994 - DNA, 22 bp, Artificial Sequence
  chemically synthesized
tgttatttttttcctgttttat

SEQ ID NO: 684995 - DNA, 22 bp, Artificial Sequence
  chemically synthesized
ttgttatttttttcctgtttta

SEQ ID NO: 684996 - DNA, 22 bp, Artificial Sequence
  chemically synthesized
ttttgttatttttttcctgttt

SEQ ID NO: 684997 - DNA, 22 bp, Artificial Sequence
  chemically synthesized
tcttttgttatttttttcctgt

SEQ ID NO: 684998 - DNA, 22 bp, Artificial Sequence
  chemically synthesized
tcagaataaaacaggaaaaaaa

SEQ ID NO: 684999 - DNA, 22 bp, Artificial Sequence
  chemically synthesized
agaataaaacaggaaaaaaata

SEQ ID NO: 685000 - DNA, 22 bp, Artificial Sequence
  chemically synthesized
tgaactctcttttgttattttt

SEQ ID NO: 685001 - DNA, 22 bp, Artificial Sequence
  chemically synthesized
ctgtgaactctcttttgttatt

SEQ ID NO: 685002 - DNA, 22 bp, Artificial Sequence
  chemically synthesized
ctactgtgaactctcttttgtt

SEQ ID NO: 685003 - DNA, 22 bp, Artificial Sequence
  chemically synthesized
attactactgtgaactctcttt

SEQ ID NO: 685004 - DNA, 22 bp, Artificial Sequence
  chemically synthesized
cccattcattactactgtgaac

SEQ ID NO: 685005 - DNA, 22 bp, Artificial Sequence
  chemically synthesized
gcccattcattactactgtgaa

SEQ ID NO: 685006 - DNA, 22 bp, Artificial Sequence
  chemically synthesized
tgcccattcattactactgtga

SEQ ID NO: 685007 - DNA, 22 bp, Artificial Sequence
  chemically synthesized
gccagttttgcccattcattac

SEQ ID NO: 685008 - DNA, 22 bp, Artificial Sequence
  chemically synthesized
ggccagttttgcccattcatta

SEQ ID NO: 685009 - DNA, 22 bp, Artificial Sequence
  chemically synthesized
atttggccagttttgcccattc

SEQ ID NO: 685010 - DNA, 22 bp, Artificial Sequence
  chemically synthesized
acagtagtaatgaatgggcaaa

SEQ ID NO: 685011 - DNA, 22 bp, Artificial Sequence
  chemically synthesized
aagacctcatttggccagtttt

SEQ ID NO: 685012 - DNA, 22 bp, Artificial Sequence
  chemically synthesized
cctgaagacctcatttggccag

SEQ ID NO: 685013 - DNA, 22 bp, Artificial Sequence
  chemically synthesized
tgcctgaagacctcatttggcc

SEQ ID NO: 685014 - DNA, 22 bp, Artificial Sequence
  chemically synthesized
agccctctgcctgaagacctca

SEQ ID NO: 685015 - DNA, 22 bp, Artificial Sequence
  chemically synthesized
aactcagccctctgcctgaaga

SEQ ID NO: 685016 - DNA, 22 bp, Artificial Sequence
  chemically synthesized
gccaaatgaggtcttcaggcag

SEQ ID NO: 685017 - DNA, 22 bp, Artificial Sequence
  chemically synthesized
agctcaactcagccctctgcct

SEQ ID NO: 685018 - DNA, 22 bp, Artificial Sequence
  chemically synthesized
aagctcaactcagccctctgcc

SEQ ID NO: 685019 - DNA, 22 bp, Artificial Sequence
  chemically synthesized
ttaagctcaactcagccctctg

SEQ ID NO: 685020 - DNA, 22 bp, Artificial Sequence
  chemically synthesized
caggcagagggctgagttgagc

SEQ ID NO: 685021 - DNA, 22 bp, Artificial Sequence
  chemically synthesized
aggcagagggctgagttgagct

SEQ ID NO: 685022 - DNA, 22 bp, Artificial Sequence
  chemically synthesized
agtcatctcttaagctcaactc

SEQ ID NO: 685023 - DNA, 22 bp, Artificial Sequence
  chemically synthesized
cagtcatctcttaagctcaact

SEQ ID NO: 685024 - DNA, 22 bp, Artificial Sequence
  chemically synthesized
ttcagtcatctcttaagctcaa

SEQ ID NO: 685025 - DNA, 22 bp, Artificial Sequence
  chemically synthesized
cttcagtcatctcttaagctca

SEQ ID NO: 685026 - DNA, 22 bp, Artificial Sequence
  chemically synthesized
ttcttcagtcatctcttaagct

SEQ ID NO: 685027 - DNA, 22 bp, Artificial Sequence
  chemically synthesized
cttcttcagtcatctcttaagc

SEQ ID NO: 685028 - DNA, 22 bp, Artificial Sequence
  chemically synthesized
tttcttcttcagtcatctctta

SEQ ID NO: 685029 - DNA, 22 bp, Artificial Sequence
  chemically synthesized
agttgagcttaagagatgactg

SEQ ID NO: 685030 - DNA, 22 bp, Artificial Sequence
  chemically synthesized
agcttaagagatgactgaagaa

SEQ ID NO: 685031 - DNA, 22 bp, Artificial Sequence
  chemically synthesized
cacatggctgtttcttcttcag

SEQ ID NO: 685032 - DNA, 22 bp, Artificial Sequence
  chemically synthesized
gcacatggctgtttcttcttca

SEQ ID NO: 685033 - DNA, 22 bp, Artificial Sequence
  chemically synthesized
tgcacatggctgtttcttcttc

SEQ ID NO: 685034 - DNA, 22 bp, Artificial Sequence
  chemically synthesized
aagagatgactgaagaagaaac

SEQ ID NO: 685035 - DNA, 22 bp, Artificial Sequence
  chemically synthesized
agagatgactgaagaagaaaca

SEQ ID NO: 685036 - DNA, 22 bp, Artificial Sequence
  chemically synthesized
cctttgcacatggctgtttctt

SEQ ID NO: 685037 - DNA, 22 bp, Artificial Sequence
  chemically synthesized
gccctgcctttgcacatggctg

SEQ ID NO: 685038 - DNA, 22 bp, Artificial Sequence
  chemically synthesized
aagaagaaacagccatgtgcaa

SEQ ID NO: 685039 - DNA, 22 bp, Artificial Sequence
  chemically synthesized
tcgttggccctgcctttgcaca

SEQ ID NO: 685040 - DNA, 22 bp, Artificial Sequence
  chemically synthesized
tgtcgttggccctgcctttgca

SEQ ID NO: 685041 - DNA, 22 bp, Artificial Sequence
  chemically synthesized
gatcaacacaaaatagagtctc

SEQ ID NO: 685042 - DNA, 22 bp, Artificial Sequence
  chemically synthesized
atagatctagatcaacacaaaa

SEQ ID NO: 685043 - DNA, 22 bp, Artificial Sequence
  chemically synthesized
tattttgtgttgatctagatct

SEQ ID NO: 685044 - DNA, 22 bp, Artificial Sequence
  chemically synthesized
ttttgtgttgatctagatctat

SEQ ID NO: 685045 - DNA, 22 bp, Artificial Sequence
  chemically synthesized
aagaatgtcaattaatagatct

SEQ ID NO: 685046 - DNA, 22 bp, Artificial Sequence
  chemically synthesized
tgtgttgatctagatctattaa

SEQ ID NO: 685047 - DNA, 22 bp, Artificial Sequence
  chemically synthesized
gtgttgatctagatctattaat

SEQ ID NO: 685048 - DNA, 22 bp, Artificial Sequence
  chemically synthesized
tgttgatctagatctattaatt

SEQ ID NO: 685049 - DNA, 22 bp, Artificial Sequence
  chemically synthesized
atctagatctattaattgacat

SEQ ID NO: 685050 - DNA, 22 bp, Artificial Sequence
  chemically synthesized
gatctattaattgacattcttt

SEQ ID NO: 685051 - DNA, 22 bp, Artificial Sequence
  chemically synthesized
aataatgacatctaaagaatgt

SEQ ID NO: 685052 - DNA, 22 bp, Artificial Sequence
  chemically synthesized
attaaataatgacatctaaaga

SEQ ID NO: 685053 - DNA, 22 bp, Artificial Sequence
  chemically synthesized
ttaattgacattctttagatgt

SEQ ID NO: 685054 - DNA, 22 bp, Artificial Sequence
  chemically synthesized
attgacattctttagatgtcat

SEQ ID NO: 685055 - DNA, 22 bp, Artificial Sequence
  chemically synthesized
aagctgattaaataatgacatc

SEQ ID NO: 685056 - DNA, 22 bp, Artificial Sequence
  chemically synthesized
gaagctgattaaataatgacat

SEQ ID NO: 685057 - DNA, 22 bp, Artificial Sequence
  chemically synthesized
acattctttagatgtcattatt

SEQ ID NO: 685058 - DNA, 22 bp, Artificial Sequence
  chemically synthesized
aatttgaagctgattaaataat

SEQ ID NO: 685059 - DNA, 22 bp, Artificial Sequence
  chemically synthesized
tttagatgtcattatttaatca

SEQ ID NO: 685060 - DNA, 22 bp, Artificial Sequence
  chemically synthesized
tagatgtcattatttaatcagc

SEQ ID NO: 685061 - DNA, 22 bp, Artificial Sequence
  chemically synthesized
agatgtcattatttaatcagct

SEQ ID NO: 685062 - DNA, 22 bp, Artificial Sequence
  chemically synthesized
gatgtcattatttaatcagctt

SEQ ID NO: 685063 - DNA, 22 bp, Artificial Sequence
  chemically synthesized
ataggctgaatttgaagctgat

SEQ ID NO: 685064 - DNA, 22 bp, Artificial Sequence
  chemically synthesized
gctaataggctgaatttgaagc

SEQ ID NO: 685065 - DNA, 22 bp, Artificial Sequence
  chemically synthesized
tttaatcagcttcaaattcagc

SEQ ID NO: 685066 - DNA, 22 bp, Artificial Sequence
  chemically synthesized
aatcagcttcaaattcagccta

SEQ ID NO: 685067 - DNA, 22 bp, Artificial Sequence
  chemically synthesized
atcagcttcaaattcagcctat

SEQ ID NO: 685068 - DNA, 22 bp, Artificial Sequence
  chemically synthesized
caaattcagcctattagccagc

SEQ ID NO: 685069 - DNA, 22 bp, Artificial Sequence
  chemically synthesized
aaattcagcctattagccagcc

SEQ ID NO: 685070 - DNA, 22 bp, Artificial Sequence
  chemically synthesized
agcctattagccagccccactg

SEQ ID NO: 685071 - DNA, 22 bp, Artificial Sequence
  chemically synthesized
ggtacaagataaagaacagtgg

SEQ ID NO: 685072 - DNA, 22 bp, Artificial Sequence
  chemically synthesized
ttagccagccccactgttcttt

SEQ ID NO: 685073 - DNA, 22 bp, Artificial Sequence
  chemically synthesized
gccagccccactgttctttatc

SEQ ID NO: 685074 - DNA, 22 bp, Artificial Sequence
  chemically synthesized
agaatattgggtacaagataaa

SEQ ID NO: 685075 - DNA, 22 bp, Artificial Sequence
  chemically synthesized
gagaatattgggtacaagataa

SEQ ID NO: 685076 - DNA, 22 bp, Artificial Sequence
  chemically synthesized
tgagaatattgggtacaagata

SEQ ID NO: 685077 - DNA, 22 bp, Artificial Sequence
  chemically synthesized
ttgagaatattgggtacaagat

SEQ ID NO: 685078 - DNA, 22 bp, Artificial Sequence
  chemically synthesized
ttttgagaatattgggtacaag

SEQ ID NO: 685079 - DNA, 22 bp, Artificial Sequence
  chemically synthesized
tcttttgagaatattgggtaca

SEQ ID NO: 685080 - DNA, 22 bp, Artificial Sequence
  chemically synthesized
ttctttatcttgtacccaatat

SEQ ID NO: 685081 - DNA, 22 bp, Artificial Sequence
  chemically synthesized
tttatcttgtacccaatattct

SEQ ID NO: 685082 - DNA, 22 bp, Artificial Sequence
  chemically synthesized
aagttctcttttgagaatattg

SEQ ID NO: 685083 - DNA, 22 bp, Artificial Sequence
  chemically synthesized
tatcttgtacccaatattctca

SEQ ID NO: 685084 - DNA, 22 bp, Artificial Sequence
  chemically synthesized
caagttctcttttgagaatatt

SEQ ID NO: 685085 - DNA, 22 bp, Artificial Sequence
  chemically synthesized
atcttgtacccaatattctcaa

SEQ ID NO: 685086 - DNA, 22 bp, Artificial Sequence
  chemically synthesized
tcaagttctcttttgagaatat

SEQ ID NO: 685087 - DNA, 22 bp, Artificial Sequence
  chemically synthesized
tcttgtacccaatattctcaaa

SEQ ID NO: 685088 - DNA, 22 bp, Artificial Sequence
  chemically synthesized
ttcaagttctcttttgagaata

SEQ ID NO: 685089 - DNA, 22 bp, Artificial Sequence
  chemically synthesized
gtacccaatattctcaaaagag

SEQ ID NO: 685090 - DNA, 22 bp, Artificial Sequence
  chemically synthesized
tacccaatattctcaaaagaga

SEQ ID NO: 685091 - DNA, 22 bp, Artificial Sequence
  chemically synthesized
caccacatttttcaagttctct

SEQ ID NO: 685092 - DNA, 22 bp, Artificial Sequence
  chemically synthesized
acaccacatttttcaagttctc

SEQ ID NO: 685093 - DNA, 22 bp, Artificial Sequence
  chemically synthesized
tacaccacatttttcaagttct

SEQ ID NO: 685094 - DNA, 22 bp, Artificial Sequence
  chemically synthesized
tcaaaagagaacttgaaaaatg

SEQ ID NO: 685095 - DNA, 22 bp, Artificial Sequence
  chemically synthesized
ggattttacaccacatttttca

SEQ ID NO: 685096 - DNA, 22 bp, Artificial Sequence
  chemically synthesized
aaaagagaacttgaaaaatgtg

SEQ ID NO: 685097 - DNA, 22 bp, Artificial Sequence
  chemically synthesized
aggattttacaccacatttttc

SEQ ID NO: 685098 - DNA, 22 bp, Artificial Sequence
  chemically synthesized
gaaaaatgtggtgtaaaatcct

SEQ ID NO: 685099 - DNA, 22 bp, Artificial Sequence
  chemically synthesized
aaaaatgtggtgtaaaatccta

SEQ ID NO: 685100 - DNA, 22 bp, Artificial Sequence
  chemically synthesized
gagacagcataacttaggattt

SEQ ID NO: 685101 - DNA, 22 bp, Artificial Sequence
  chemically synthesized
ttagagacagcataacttagga

SEQ ID NO: 685102 - DNA, 22 bp, Artificial Sequence
  chemically synthesized
gatgagaagactgttagagaca

SEQ ID NO: 685103 - DNA, 22 bp, Artificial Sequence
  chemically synthesized
agttatgctgtctctaacagtc

SEQ ID NO: 685104 - DNA, 22 bp, Artificial Sequence
  chemically synthesized
atggttagatgagaagactgtt

SEQ ID NO: 685105 - DNA, 22 bp, Artificial Sequence
  chemically synthesized
gatggttagatgagaagactgt

SEQ ID NO: 685106 - DNA, 22 bp, Artificial Sequence
  chemically synthesized
tgctgtctctaacagtcttctc

SEQ ID NO: 685107 - DNA, 22 bp, Artificial Sequence
  chemically synthesized
cttgatggttagatgagaagac

SEQ ID NO: 685108 - DNA, 22 bp, Artificial Sequence
  chemically synthesized
tctctaacagtcttctcatcta

SEQ ID NO: 685109 - DNA, 22 bp, Artificial Sequence
  chemically synthesized
tggctgcttgatggttagatga

SEQ ID NO: 685110 - DNA, 22 bp, Artificial Sequence
  chemically synthesized
taacagtcttctcatctaacca

SEQ ID NO: 685111 - DNA, 22 bp, Artificial Sequence
  chemically synthesized
atggctgcttgatggttagatg

SEQ ID NO: 685112 - DNA, 22 bp, Artificial Sequence
  chemically synthesized
tatggctgcttgatggttagat

SEQ ID NO: 685113 - DNA, 22 bp, Artificial Sequence
  chemically synthesized
acagtcttctcatctaaccatc

SEQ ID NO: 685114 - DNA, 22 bp, Artificial Sequence
  chemically synthesized
ttatggctgcttgatggttaga

SEQ ID NO: 685115 - DNA, 22 bp, Artificial Sequence
  chemically synthesized
tttatggctgcttgatggttag

SEQ ID NO: 685116 - DNA, 22 bp, Artificial Sequence
  chemically synthesized
ttttatggctgcttgatggtta

SEQ ID NO: 685117 - DNA, 22 bp, Artificial Sequence
  chemically synthesized
tttttatggctgcttgatggtt

SEQ ID NO: 685118 - DNA, 22 bp, Artificial Sequence
  chemically synthesized
attttttttatggctgcttgat

SEQ ID NO: 685119 - DNA, 22 bp, Artificial Sequence
  chemically synthesized
ctcatctaaccatcaagcagcc

SEQ ID NO: 685120 - DNA, 22 bp, Artificial Sequence
  chemically synthesized
cattttttttatggctgcttga

SEQ ID NO: 685121 - DNA, 22 bp, Artificial Sequence
  chemically synthesized
tcatctaaccatcaagcagcca

SEQ ID NO: 685122 - DNA, 22 bp, Artificial Sequence
  chemically synthesized
tcattttttttatggctgcttg

SEQ ID NO: 685123 - DNA, 22 bp, Artificial Sequence
  chemically synthesized
atctaaccatcaagcagccata

SEQ ID NO: 685124 - DNA, 22 bp, Artificial Sequence
  chemically synthesized
attttcattttttttatggctg

SEQ ID NO: 685125 - DNA, 22 bp, Artificial Sequence
  chemically synthesized
accatcaagcagccataaaaaa

SEQ ID NO: 685126 - DNA, 22 bp, Artificial Sequence
  chemically synthesized
ccatgtcacatgcacctcattt

SEQ ID NO: 685127 - DNA, 22 bp, Artificial Sequence
  chemically synthesized
aaaatctgccatgtcacatgca

SEQ ID NO: 685128 - DNA, 22 bp, Artificial Sequence
  chemically synthesized
tcaaaatctgccatgtcacatg

SEQ ID NO: 685129 - DNA, 22 bp, Artificial Sequence
  chemically synthesized
ggaatcagcgtgatactctcaa

SEQ ID NO: 685130 - DNA, 22 bp, Artificial Sequence
  chemically synthesized
ctgggaatcagcgtgatactct

SEQ ID NO: 685131 - DNA, 22 bp, Artificial Sequence
  chemically synthesized
tgagagtatcacgctgattccc

SEQ ID NO: 685132 - DNA, 22 bp, Artificial Sequence
  chemically synthesized
gagagtatcacgctgattccca

SEQ ID NO: 685133 - DNA, 22 bp, Artificial Sequence
  chemically synthesized
agagtatcacgctgattcccag

SEQ ID NO: 685134 - DNA, 22 bp, Artificial Sequence
  chemically synthesized
cataggataacatgctgctggg

SEQ ID NO: 685135 - DNA, 22 bp, Artificial Sequence
  chemically synthesized
atgattacataggataacatgc

SEQ ID NO: 685136 - DNA, 22 bp, Artificial Sequence
  chemically synthesized
attcccagcagcatgttatcct

SEQ ID NO: 685137 - DNA, 22 bp, Artificial Sequence
  chemically synthesized
ttaatgattacataggataaca

SEQ ID NO: 685138 - DNA, 22 bp, Artificial Sequence
  chemically synthesized
ccagcagcatgttatcctatgt

SEQ ID NO: 685139 - DNA, 22 bp, Artificial Sequence
  chemically synthesized
attattaatgattacataggat

SEQ ID NO: 685140 - DNA, 22 bp, Artificial Sequence
  chemically synthesized
tcctatgtaatcattaataatc

SEQ ID NO: 685141 - DNA, 22 bp, Artificial Sequence
  chemically synthesized
tgtaatcattaataatcagtac

SEQ ID NO: 685142 - DNA, 22 bp, Artificial Sequence
  chemically synthesized
gaaaatgacatcgtactgatta

SEQ ID NO: 685143 - DNA, 22 bp, Artificial Sequence
  chemically synthesized
ataatcagtacgatgtcatttt

SEQ ID NO: 685144 - DNA, 22 bp, Artificial Sequence
  chemically synthesized
atgagcaacaaaatcctggaaa

SEQ ID NO: 685145 - DNA, 22 bp, Artificial Sequence
  chemically synthesized
atgttgatgagcaacaaaatcc

SEQ ID NO: 685146 - DNA, 22 bp, Artificial Sequence
  chemically synthesized
gatgttgatgagcaacaaaatc

SEQ ID NO: 685147 - DNA, 22 bp, Artificial Sequence
  chemically synthesized
tccaggattttgttgctcatca

SEQ ID NO: 685148 - DNA, 22 bp, Artificial Sequence
  chemically synthesized
ccaggattttgttgctcatcaa

SEQ ID NO: 685149 - DNA, 22 bp, Artificial Sequence
  chemically synthesized
caggattttgttgctcatcaac

SEQ ID NO: 685150 - DNA, 22 bp, Artificial Sequence
  chemically synthesized
caaaccaataagtttgatgttg

SEQ ID NO: 685151 - DNA, 22 bp, Artificial Sequence
  chemically synthesized
acaaaccaataagtttgatgtt

SEQ ID NO: 685152 - DNA, 22 bp, Artificial Sequence
  chemically synthesized
tgttgctcatcaacatcaaact

SEQ ID NO: 685153 - DNA, 22 bp, Artificial Sequence
  chemically synthesized
gttgctcatcaacatcaaactt

SEQ ID NO: 685154 - DNA, 22 bp, Artificial Sequence
  chemically synthesized
ttgctcatcaacatcaaactta

SEQ ID NO: 685155 - DNA, 22 bp, Artificial Sequence
  chemically synthesized
ctcatcaacatcaaacttattg

SEQ ID NO: 685156 - DNA, 22 bp, Artificial Sequence
  chemically synthesized
aaatttacaaaccaataagttt

SEQ ID NO: 685157 - DNA, 22 bp, Artificial Sequence
  chemically synthesized
aaaatttacaaaccaataagtt

SEQ ID NO: 685158 - DNA, 22 bp, Artificial Sequence
  chemically synthesized
taaaatttacaaaccaataagt

SEQ ID NO: 685159 - DNA, 22 bp, Artificial Sequence
  chemically synthesized
atcaacatcaaacttattggtt

SEQ ID NO: 685160 - DNA, 22 bp, Artificial Sequence
  chemically synthesized
attggtttgtaaattttaaaat

SEQ ID NO: 685161 - DNA, 22 bp, Artificial Sequence
  chemically synthesized
ttggtttgtaaattttaaaatt

SEQ ID NO: 685162 - DNA, 22 bp, Artificial Sequence
  chemically synthesized
gtttgtaaattttaaaattcat

SEQ ID NO: 685163 - DNA, 22 bp, Artificial Sequence
  chemically synthesized
aaaagtaaagagatgaatttta

SEQ ID NO: 685164 - DNA, 22 bp, Artificial Sequence
  chemically synthesized
aaaaagtaaagagatgaatttt

SEQ ID NO: 685165 - DNA, 22 bp, Artificial Sequence
  chemically synthesized
gtaaattttaaaattcatctct

SEQ ID NO: 685166 - DNA, 22 bp, Artificial Sequence
  chemically synthesized
taaattttaaaattcatctctt

SEQ ID NO: 685167 - DNA, 22 bp, Artificial Sequence
  chemically synthesized
acgtttaaaaagtaaagagatg

SEQ ID NO: 685168 - DNA, 22 bp, Artificial Sequence
  chemically synthesized
aacgtttaaaaagtaaagagat

SEQ ID NO: 685169 - DNA, 22 bp, Artificial Sequence
  chemically synthesized
taacgtttaaaaagtaaagaga

SEQ ID NO: 685170 - DNA, 22 bp, Artificial Sequence
  chemically synthesized
ttaacgtttaaaaagtaaagag

SEQ ID NO: 685171 - DNA, 22 bp, Artificial Sequence
  chemically synthesized
tttaacgtttaaaaagtaaaga

SEQ ID NO: 685172 - DNA, 22 bp, Artificial Sequence
  chemically synthesized
taaaattcatctctttactttt

SEQ ID NO: 685173 - DNA, 22 bp, Artificial Sequence
  chemically synthesized
ttttaacgtttaaaaagtaaag

SEQ ID NO: 685174 - DNA, 22 bp, Artificial Sequence
  chemically synthesized
aaaattcatctctttacttttt

SEQ ID NO: 685175 - DNA, 22 bp, Artificial Sequence
  chemically synthesized
aaattcatctctttacttttta

SEQ ID NO: 685176 - DNA, 22 bp, Artificial Sequence
  chemically synthesized
atctctttactttttaaacgtt

SEQ ID NO: 685177 - DNA, 22 bp, Artificial Sequence
  chemically synthesized
gaaaacatttttttaacgttta

SEQ ID NO: 685178 - DNA, 22 bp, Artificial Sequence
  chemically synthesized
tttactttttaaacgttaaaaa

SEQ ID NO: 685179 - DNA, 22 bp, Artificial Sequence
  chemically synthesized
tactttttaaacgttaaaaaaa

SEQ ID NO: 685180 - DNA, 22 bp, Artificial Sequence
  chemically synthesized
actttttaaacgttaaaaaaat

SEQ ID NO: 685181 - DNA, 22 bp, Artificial Sequence
  chemically synthesized
ctttttaaacgttaaaaaaatg

SEQ ID NO: 685182 - DNA, 22 bp, Artificial Sequence
  chemically synthesized
tttaaacgttaaaaaaatgttt

SEQ ID NO: 685183 - DNA, 22 bp, Artificial Sequence
  chemically synthesized
ttaaacgttaaaaaaatgtttt

SEQ ID NO: 685184 - DNA, 22 bp, Artificial Sequence
  chemically synthesized
taaacgttaaaaaaatgttttc

SEQ ID NO: 685185 - DNA, 22 bp, Artificial Sequence
  chemically synthesized
aaacgttaaaaaaatgttttct

SEQ ID NO: 685186 - DNA, 22 bp, Artificial Sequence
  chemically synthesized
aacgttaaaaaaatgttttcta

SEQ ID NO: 685187 - DNA, 22 bp, Artificial Sequence
  chemically synthesized
aaaaaatgttttctaatctcct

SEQ ID NO: 685188 - DNA, 22 bp, Artificial Sequence
  chemically synthesized
gtgatgtcatataaggagatta

SEQ ID NO: 685189 - DNA, 22 bp, Artificial Sequence
  chemically synthesized
tctaatctccttatatgacatc

SEQ ID NO: 685190 - DNA, 22 bp, Artificial Sequence
  chemically synthesized
ctaatctccttatatgacatca

SEQ ID NO: 685191 - DNA, 22 bp, Artificial Sequence
  chemically synthesized
taatctccttatatgacatcac

SEQ ID NO: 685192 - DNA, 22 bp, Artificial Sequence
  chemically synthesized
atctccttatatgacatcacca

SEQ ID NO: 685193 - DNA, 22 bp, Artificial Sequence
  chemically synthesized
cttatatgacatcaccaatccc

SEQ ID NO: 685194 - DNA, 22 bp, Artificial Sequence
  chemically synthesized
atatgacatcaccaatcccttc

SEQ ID NO: 685195 - DNA, 22 bp, Artificial Sequence
  chemically synthesized
tatgacatcaccaatcccttcc

SEQ ID NO: 685196 - DNA, 22 bp, Artificial Sequence
  chemically synthesized
agagaaaacatgggaagggatt

SEQ ID NO: 685197 - DNA, 22 bp, Artificial Sequence
  chemically synthesized
ccagtggaaaactcagagaaaa

SEQ ID NO: 685198 - DNA, 22 bp, Artificial Sequence
  chemically synthesized
cccatgttttctctgagttttc

SEQ ID NO: 685199 - DNA, 22 bp, Artificial Sequence
  chemically synthesized
ccatgttttctctgagttttcc

SEQ ID NO: 685200 - DNA, 22 bp, Artificial Sequence
  chemically synthesized
tctctgagttttccactggcaa

SEQ ID NO: 685201 - DNA, 22 bp, Artificial Sequence
  chemically synthesized
ccatgaaaagagttgccagtgg

SEQ ID NO: 685202 - DNA, 22 bp, Artificial Sequence
  chemically synthesized
ctctgagttttccactggcaac

SEQ ID NO: 685203 - DNA, 22 bp, Artificial Sequence
  chemically synthesized
tctgagttttccactggcaact

SEQ ID NO: 685204 - DNA, 22 bp, Artificial Sequence
  chemically synthesized
ctcccatgaaaagagttgccag

SEQ ID NO: 685205 - DNA, 22 bp, Artificial Sequence
  chemically synthesized
tgagttttccactggcaactct

SEQ ID NO: 685206 - DNA, 22 bp, Artificial Sequence
  chemically synthesized
agttttccactggcaactcttt

SEQ ID NO: 685207 - DNA, 22 bp, Artificial Sequence
  chemically synthesized
ctcctcccatgaaaagagttgc

SEQ ID NO: 685208 - DNA, 22 bp, Artificial Sequence
  chemically synthesized
tccactggcaactcttttcatg

SEQ ID NO: 685209 - DNA, 22 bp, Artificial Sequence
  chemically synthesized
ccactggcaactcttttcatgg

SEQ ID NO: 685210 - DNA, 22 bp, Artificial Sequence
  chemically synthesized
cactggcaactcttttcatggg

SEQ ID NO: 685211 - DNA, 22 bp, Artificial Sequence
  chemically synthesized
aaagtcactcctcctcccatga

SEQ ID NO: 685212 - DNA, 22 bp, Artificial Sequence
  chemically synthesized
gcaactcttttcatgggaggag

SEQ ID NO: 685213 - DNA, 22 bp, Artificial Sequence
  chemically synthesized
ttttcatgggaggaggagtgac

SEQ ID NO: 685214 - DNA, 22 bp, Artificial Sequence
  chemically synthesized
ttcatgggaggaggagtgactt

SEQ ID NO: 685215 - DNA, 22 bp, Artificial Sequence
  chemically synthesized
tcatgggaggaggagtgacttt

SEQ ID NO: 685216 - DNA, 22 bp, Artificial Sequence
  chemically synthesized
catgggaggaggagtgactttt

SEQ ID NO: 685217 - DNA, 22 bp, Artificial Sequence
  chemically synthesized
atgggaggaggagtgactttta

SEQ ID NO: 685218 - DNA, 22 bp, Artificial Sequence
  chemically synthesized
tccagtatccactaaaagtcac

SEQ ID NO: 685219 - DNA, 22 bp, Artificial Sequence
  chemically synthesized
atccagtatccactaaaagtca

SEQ ID NO: 685220 - DNA, 22 bp, Artificial Sequence
  chemically synthesized
ttatccagtatccactaaaagt

SEQ ID NO: 685221 - DNA, 22 bp, Artificial Sequence
  chemically synthesized
cttatccagtatccactaaaag

SEQ ID NO: 685222 - DNA, 22 bp, Artificial Sequence
  chemically synthesized
ttcttatccagtatccactaaa

SEQ ID NO: 685223 - DNA, 22 bp, Artificial Sequence
  chemically synthesized
ttagtggatactggataagaag

SEQ ID NO: 685224 - DNA, 22 bp, Artificial Sequence
  chemically synthesized
tagtggatactggataagaaga

SEQ ID NO: 685225 - DNA, 22 bp, Artificial Sequence
  chemically synthesized
agtggatactggataagaagaa

SEQ ID NO: 685226 - DNA, 22 bp, Artificial Sequence
  chemically synthesized
aacaggagtgcattcttcttat

SEQ ID NO: 685227 - DNA, 22 bp, Artificial Sequence
  chemically synthesized
gtggatactggataagaagaat

SEQ ID NO: 685228 - DNA, 22 bp, Artificial Sequence
  chemically synthesized
ctcaacaggagtgcattcttct

SEQ ID NO: 685229 - DNA, 22 bp, Artificial Sequence
  chemically synthesized
tactcaacaggagtgcattctt

SEQ ID NO: 685230 - DNA, 22 bp, Artificial Sequence
  chemically synthesized
attctactcaacaggagtgcat

SEQ ID NO: 685231 - DNA, 22 bp, Artificial Sequence
  chemically synthesized
gataagaagaatgcactcctgt

SEQ ID NO: 685232 - DNA, 22 bp, Artificial Sequence
  chemically synthesized
ccatgggatctcattctactca

SEQ ID NO: 685233 - DNA, 22 bp, Artificial Sequence
  chemically synthesized
ctgttgagtagaatgagatccc

SEQ ID NO: 685234 - DNA, 22 bp, Artificial Sequence
  chemically synthesized
gaagtgctgccatgggatctca

SEQ ID NO: 685235 - DNA, 22 bp, Artificial Sequence
  chemically synthesized
ttgagtagaatgagatcccatg

SEQ ID NO: 685236 - DNA, 22 bp, Artificial Sequence
  chemically synthesized
ttagaagtgctgccatgggatc

SEQ ID NO: 685237 - DNA, 22 bp, Artificial Sequence
  chemically synthesized
gttagaagtgctgccatgggat

SEQ ID NO: 685238 - DNA, 22 bp, Artificial Sequence
  chemically synthesized
agtagaatgagatcccatggca

SEQ ID NO: 685239 - DNA, 22 bp, Artificial Sequence
  chemically synthesized
atttgttagaagtgctgccatg

SEQ ID NO: 685240 - DNA, 22 bp, Artificial Sequence
  chemically synthesized
ggtctaatttgttagaagtgct

SEQ ID NO: 685241 - DNA, 22 bp, Artificial Sequence
  chemically synthesized
agagactaggtctaatttgtta

SEQ ID NO: 685242 - DNA, 22 bp, Artificial Sequence
  chemically synthesized
ttcagagactaggtctaatttg

SEQ ID NO: 685243 - DNA, 22 bp, Artificial Sequence
  chemically synthesized
gttcagagactaggtctaattt

SEQ ID NO: 685244 - DNA, 22 bp, Artificial Sequence
  chemically synthesized
tgttcagagactaggtctaatt

SEQ ID NO: 685245 - DNA, 22 bp, Artificial Sequence
  chemically synthesized
ttgttcagagactaggtctaat

SEQ ID NO: 685246 - DNA, 22 bp, Artificial Sequence
  chemically synthesized
tttttgttcagagactaggtct

SEQ ID NO: 685247 - DNA, 22 bp, Artificial Sequence
  chemically synthesized
ctaacaaattagacctagtctc

SEQ ID NO: 685248 - DNA, 22 bp, Artificial Sequence
  chemically synthesized
taacaaattagacctagtctct

SEQ ID NO: 685249 - DNA, 22 bp, Artificial Sequence
  chemically synthesized
acaaattagacctagtctctga

SEQ ID NO: 685250 - DNA, 22 bp, Artificial Sequence
  chemically synthesized
atattgtttttgttcagagact

SEQ ID NO: 685251 - DNA, 22 bp, Artificial Sequence
  chemically synthesized
actcatattgtttttgttcaga

SEQ ID NO: 685252 - DNA, 22 bp, Artificial Sequence
  chemically synthesized
aactcatattgtttttgttcag

SEQ ID NO: 685253 - DNA, 22 bp, Artificial Sequence
  chemically synthesized
gacctagtctctgaacaaaaac

SEQ ID NO: 685254 - DNA, 22 bp, Artificial Sequence
  chemically synthesized
gtctctgaacaaaaacaatatg

SEQ ID NO: 685255 - DNA, 22 bp, Artificial Sequence
  chemically synthesized
gggacgatcttaactcatattg

SEQ ID NO: 685256 - DNA, 22 bp, Artificial Sequence
  chemically synthesized
agggacgatcttaactcatatt

SEQ ID NO: 685257 - DNA, 22 bp, Artificial Sequence
  chemically synthesized
tgaacaaaaacaatatgagtta

SEQ ID NO: 685258 - DNA, 22 bp, Artificial Sequence
  chemically synthesized
aacaaaaacaatatgagttaag

SEQ ID NO: 685259 - DNA, 22 bp, Artificial Sequence
  chemically synthesized
gataatcttagggacgatctta

SEQ ID NO: 685260 - DNA, 22 bp, Artificial Sequence
  chemically synthesized
tagataatcttagggacgatct

SEQ ID NO: 685261 - DNA, 22 bp, Artificial Sequence
  chemically synthesized
ctagataatcttagggacgatc

SEQ ID NO: 685262 - DNA, 22 bp, Artificial Sequence
  chemically synthesized
tctagataatcttagggacgat

SEQ ID NO: 685263 - DNA, 22 bp, Artificial Sequence
  chemically synthesized
ttctagataatcttagggacga

SEQ ID NO: 685264 - DNA, 22 bp, Artificial Sequence
  chemically synthesized
ttttctagataatcttagggac

SEQ ID NO: 685265 - DNA, 22 bp, Artificial Sequence
  chemically synthesized
agatcgtccctaagattatcta

SEQ ID NO: 685266 - DNA, 22 bp, Artificial Sequence
  chemically synthesized
tgggaacgggattcttttctag

SEQ ID NO: 685267 - DNA, 22 bp, Artificial Sequence
  chemically synthesized
atgggaacgggattcttttcta

SEQ ID NO: 685268 - DNA, 22 bp, Artificial Sequence
  chemically synthesized
tatgggaacgggattcttttct

SEQ ID NO: 685269 - DNA, 22 bp, Artificial Sequence
  chemically synthesized
agattatctagaaaagaatccc

SEQ ID NO: 685270 - DNA, 22 bp, Artificial Sequence
  chemically synthesized
agctttatgggaacgggattct

SEQ ID NO: 685271 - DNA, 22 bp, Artificial Sequence
  chemically synthesized
ctcagctttatgggaacgggat

SEQ ID NO: 685272 - DNA, 22 bp, Artificial Sequence
  chemically synthesized
tctagaaaagaatcccgttccc

SEQ ID NO: 685273 - DNA, 22 bp, Artificial Sequence
  chemically synthesized
gaaaagaatcccgttcccataa

SEQ ID NO: 685274 - DNA, 22 bp, Artificial Sequence
  chemically synthesized
accaaaatgttactcagcttta

SEQ ID NO: 685275 - DNA, 22 bp, Artificial Sequence
  chemically synthesized
ccataaagctgagtaacatttt

SEQ ID NO: 685276 - DNA, 22 bp, Artificial Sequence
  chemically synthesized
aaatgacacaaatctgaccaaa

SEQ ID NO: 685277 - DNA, 22 bp, Artificial Sequence
  chemically synthesized
aaaatgacacaaatctgaccaa

SEQ ID NO: 685278 - DNA, 22 bp, Artificial Sequence
  chemically synthesized
taaaatgacacaaatctgacca

SEQ ID NO: 685279 - DNA, 22 bp, Artificial Sequence
  chemically synthesized
ttaaaatgacacaaatctgacc

SEQ ID NO: 685280 - DNA, 22 bp, Artificial Sequence
  chemically synthesized
agtaacattttggtcagatttg

SEQ ID NO: 685281 - DNA, 22 bp, Artificial Sequence
  chemically synthesized
gcttttaaaatgacacaaatct

SEQ ID NO: 685282 - DNA, 22 bp, Artificial Sequence
  chemically synthesized
ggcttttaaaatgacacaaatc

SEQ ID NO: 685283 - DNA, 22 bp, Artificial Sequence
  chemically synthesized
tggcttttaaaatgacacaaat

SEQ ID NO: 685284 - DNA, 22 bp, Artificial Sequence
  chemically synthesized
tggtcagatttgtgtcatttta

SEQ ID NO: 685285 - DNA, 22 bp, Artificial Sequence
  chemically synthesized
ggtcagatttgtgtcattttaa

SEQ ID NO: 685286 - DNA, 22 bp, Artificial Sequence
  chemically synthesized
gtcagatttgtgtcattttaaa

SEQ ID NO: 685287 - DNA, 22 bp, Artificial Sequence
  chemically synthesized
ggtaaatattttggcttttaaa

SEQ ID NO: 685288 - DNA, 22 bp, Artificial Sequence
  chemically synthesized
aggtaaatattttggcttttaa

SEQ ID NO: 685289 - DNA, 22 bp, Artificial Sequence
  chemically synthesized
taggtaaatattttggctttta

SEQ ID NO: 685290 - DNA, 22 bp, Artificial Sequence
  chemically synthesized
ttaggtaaatattttggctttt

SEQ ID NO: 685291 - DNA, 22 bp, Artificial Sequence
  chemically synthesized
tttaggtaaatattttggcttt

SEQ ID NO: 685292 - DNA, 22 bp, Artificial Sequence
  chemically synthesized
gtgtcattttaaaagccaaaat

SEQ ID NO: 685293 - DNA, 22 bp, Artificial Sequence
  chemically synthesized
tgtcattttaaaagccaaaata

SEQ ID NO: 685294 - DNA, 22 bp, Artificial Sequence
  chemically synthesized
ctttttaggtaaatattttggc

SEQ ID NO: 685295 - DNA, 22 bp, Artificial Sequence
  chemically synthesized
gctttttaggtaaatattttgg

SEQ ID NO: 685296 - DNA, 22 bp, Artificial Sequence
  chemically synthesized
taaaagccaaaatatttaccta

SEQ ID NO: 685297 - DNA, 22 bp, Artificial Sequence
  chemically synthesized
aaaagccaaaatatttacctaa

SEQ ID NO: 685298 - DNA, 22 bp, Artificial Sequence
  chemically synthesized
aaagccaaaatatttacctaaa

SEQ ID NO: 685299 - DNA, 22 bp, Artificial Sequence
  chemically synthesized
aaatcacttgctttttaggtaa

SEQ ID NO: 685300 - DNA, 22 bp, Artificial Sequence
  chemically synthesized
agacattcaaatcacttgcttt

SEQ ID NO: 685301 - DNA, 22 bp, Artificial Sequence
  chemically synthesized
gtctgagacattcaaatcactt

SEQ ID NO: 685302 - DNA, 22 bp, Artificial Sequence
  chemically synthesized
acctaaaaagcaagtgatttga

SEQ ID NO: 685303 - DNA, 22 bp, Artificial Sequence
  chemically synthesized
agtctgagacattcaaatcact

SEQ ID NO: 685304 - DNA, 22 bp, Artificial Sequence
  chemically synthesized
cctaaaaagcaagtgatttgaa

SEQ ID NO: 685305 - DNA, 22 bp, Artificial Sequence
  chemically synthesized
aaaagcaagtgatttgaatgtc

SEQ ID NO: 685306 - DNA, 22 bp, Artificial Sequence
  chemically synthesized
gaatgtctcagactaagttatt

SEQ ID NO: 685307 - DNA, 22 bp, Artificial Sequence
  chemically synthesized
aatgtctcagactaagttattt

SEQ ID NO: 685308 - DNA, 22 bp, Artificial Sequence
  chemically synthesized
agggccatagatcagtaaaaaa

SEQ ID NO: 685309 - DNA, 22 bp, Artificial Sequence
  chemically synthesized
agactaagttattttttactga

SEQ ID NO: 685310 - DNA, 22 bp, Artificial Sequence
  chemically synthesized
gagggccatagatcagtaaaaa

SEQ ID NO: 685311 - DNA, 22 bp, Artificial Sequence
  chemically synthesized
atttgagggccatagatcagta

SEQ ID NO: 685312 - DNA, 22 bp, Artificial Sequence
  chemically synthesized
agttattttttactgatctatg

SEQ ID NO: 685313 - DNA, 22 bp, Artificial Sequence
  chemically synthesized
ttttttactgatctatggccct

SEQ ID NO: 685314 - DNA, 22 bp, Artificial Sequence
  chemically synthesized
tttactgatctatggccctcaa

SEQ ID NO: 685315 - DNA, 22 bp, Artificial Sequence
  chemically synthesized
ttactgatctatggccctcaaa

SEQ ID NO: 685316 - DNA, 22 bp, Artificial Sequence
  chemically synthesized
tactgatctatggccctcaaat

SEQ ID NO: 685317 - DNA, 22 bp, Artificial Sequence
  chemically synthesized
actgatctatggccctcaaatg

SEQ ID NO: 685318 - DNA, 22 bp, Artificial Sequence
  chemically synthesized
ctgatctatggccctcaaatga

SEQ ID NO: 685319 - DNA, 22 bp, Artificial Sequence
  chemically synthesized
aaggtcatcaactcatttgagg

SEQ ID NO: 685320 - DNA, 22 bp, Artificial Sequence
  chemically synthesized
atctatggccctcaaatgagtt

SEQ ID NO: 685321 - DNA, 22 bp, Artificial Sequence
  chemically synthesized
ctgaaggtcatcaactcatttg

SEQ ID NO: 685322 - DNA, 22 bp, Artificial Sequence
  chemically synthesized
tactgaaggtcatcaactcatt

SEQ ID NO: 685323 - DNA, 22 bp, Artificial Sequence
  chemically synthesized
tctactgaaggtcatcaactca

SEQ ID NO: 685324 - DNA, 22 bp, Artificial Sequence
  chemically synthesized
tggccctcaaatgagttgatga

SEQ ID NO: 685325 - DNA, 22 bp, Artificial Sequence
  chemically synthesized
ctctactgaaggtcatcaactc

SEQ ID NO: 685326 - DNA, 22 bp, Artificial Sequence
  chemically synthesized
aaatgagttgatgaccttcagt

SEQ ID NO: 685327 - DNA, 22 bp, Artificial Sequence
  chemically synthesized
atgaccttcagtagagaaatgg

SEQ ID NO: 685328 - DNA, 22 bp, Artificial Sequence
  chemically synthesized
acaaatcagaaataaagaacca

SEQ ID NO: 685329 - DNA, 22 bp, Artificial Sequence
  chemically synthesized
cagtagagaaatggttctttat

SEQ ID NO: 685330 - DNA, 22 bp, Artificial Sequence
  chemically synthesized
agtagagaaatggttctttatt

SEQ ID NO: 685331 - DNA, 22 bp, Artificial Sequence
  chemically synthesized
tcacaaatcagaaataaagaac

SEQ ID NO: 685332 - DNA, 22 bp, Artificial Sequence
  chemically synthesized
tcgcatgactctcacaaatcag

SEQ ID NO: 685333 - DNA, 22 bp, Artificial Sequence
  chemically synthesized
ctgtcgcatgactctcacaaat

SEQ ID NO: 685334 - DNA, 22 bp, Artificial Sequence
  chemically synthesized
tttatttctgatttgtgagagt

SEQ ID NO: 685335 - DNA, 22 bp, Artificial Sequence
  chemically synthesized
tatttctgatttgtgagagtca

SEQ ID NO: 685336 - DNA, 22 bp, Artificial Sequence
  chemically synthesized
atttctgatttgtgagagtcat

SEQ ID NO: 685337 - DNA, 22 bp, Artificial Sequence
  chemically synthesized
tttctgatttgtgagagtcatg

SEQ ID NO: 685338 - DNA, 22 bp, Artificial Sequence
  chemically synthesized
ctgatttgtgagagtcatgcga

SEQ ID NO: 685339 - DNA, 22 bp, Artificial Sequence
  chemically synthesized
tgatttgtgagagtcatgcgac

SEQ ID NO: 685340 - DNA, 22 bp, Artificial Sequence
  chemically synthesized
atttgtgagagtcatgcgacag

SEQ ID NO: 685341 - DNA, 22 bp, Artificial Sequence
  chemically synthesized
acccatccactgctgtcgcatg

SEQ ID NO: 685342 - DNA, 22 bp, Artificial Sequence
  chemically synthesized
aacccatccactgctgtcgcat

SEQ ID NO: 685343 - DNA, 22 bp, Artificial Sequence
  chemically synthesized
ttaacccatccactgctgtcgc

SEQ ID NO: 685344 - DNA, 22 bp, Artificial Sequence
  chemically synthesized
gtgagagtcatgcgacagcagt

SEQ ID NO: 685345 - DNA, 22 bp, Artificial Sequence
  chemically synthesized
cttaacccatccactgctgtcg

SEQ ID NO: 685346 - DNA, 22 bp, Artificial Sequence
  chemically synthesized
tgagagtcatgcgacagcagtg

SEQ ID NO: 685347 - DNA, 22 bp, Artificial Sequence
  chemically synthesized
accttcttaacccatccactgc

SEQ ID NO: 685348 - DNA, 22 bp, Artificial Sequence
  chemically synthesized
taaccttcttaacccatccact

SEQ ID NO: 685349 - DNA, 22 bp, Artificial Sequence
  chemically synthesized
ctctaaccttcttaacccatcc

SEQ ID NO: 685350 - DNA, 22 bp, Artificial Sequence
  chemically synthesized
cctctaaccttcttaacccatc

SEQ ID NO: 685351 - DNA, 22 bp, Artificial Sequence
  chemically synthesized
aaaagcaatgtaacaaatttcc

SEQ ID NO: 685352 - DNA, 22 bp, Artificial Sequence
  chemically synthesized
agaaggttagaggaaatttgtt

SEQ ID NO: 685353 - DNA, 22 bp, Artificial Sequence
  chemically synthesized
gaggaaatttgttacattgctt

SEQ ID NO: 685354 - DNA, 22 bp, Artificial Sequence
  chemically synthesized
aaaaacaacagctaaaaagcaa

SEQ ID NO: 685355 - DNA, 22 bp, Artificial Sequence
  chemically synthesized
gttacattgctttttagctgtt

SEQ ID NO: 685356 - DNA, 22 bp, Artificial Sequence
  chemically synthesized
ttacattgctttttagctgttg

SEQ ID NO: 685357 - DNA, 22 bp, Artificial Sequence
  chemically synthesized
accaaactaaaaaacaacagct

SEQ ID NO: 685358 - DNA, 22 bp, Artificial Sequence
  chemically synthesized
cattgctttttagctgttgttt

SEQ ID NO: 685359 - DNA, 22 bp, Artificial Sequence
  chemically synthesized
ttcaccaaactaaaaaacaaca

SEQ ID NO: 685360 - DNA, 22 bp, Artificial Sequence
  chemically synthesized
gttcaccaaactaaaaaacaac

SEQ ID NO: 685361 - DNA, 22 bp, Artificial Sequence
  chemically synthesized
ctttttagctgttgttttttag

SEQ ID NO: 685362 - DNA, 22 bp, Artificial Sequence
  chemically synthesized
gtttgttcaccaaactaaaaaa

SEQ ID NO: 685363 - DNA, 22 bp, Artificial Sequence
  chemically synthesized
tttagctgttgttttttagttt

SEQ ID NO: 685364 - DNA, 22 bp, Artificial Sequence
  chemically synthesized
ttagctgttgttttttagtttg

SEQ ID NO: 685365 - DNA, 22 bp, Artificial Sequence
  chemically synthesized
tagctgttgttttttagtttgg

SEQ ID NO: 685366 - DNA, 22 bp, Artificial Sequence
  chemically synthesized
agctgttgttttttagtttggt

SEQ ID NO: 685367 - DNA, 22 bp, Artificial Sequence
  chemically synthesized
tctcgtttgttcaccaaactaa

SEQ ID NO: 685368 - DNA, 22 bp, Artificial Sequence
  chemically synthesized
gctgttgttttttagtttggtg

SEQ ID NO: 685369 - DNA, 22 bp, Artificial Sequence
  chemically synthesized
ttgttttttagtttggtgaaca

SEQ ID NO: 685370 - DNA, 22 bp, Artificial Sequence
  chemically synthesized
tgttatctcgtttgttcaccaa

SEQ ID NO: 685371 - DNA, 22 bp, Artificial Sequence
  chemically synthesized
ttttttagtttggtgaacaaac

SEQ ID NO: 685372 - DNA, 22 bp, Artificial Sequence
  chemically synthesized
gctatgttatctcgtttgttca

SEQ ID NO: 685373 - DNA, 22 bp, Artificial Sequence
  chemically synthesized
tttagtttggtgaacaaacgag

SEQ ID NO: 685374 - DNA, 22 bp, Artificial Sequence
  chemically synthesized
ttagtttggtgaacaaacgaga

SEQ ID NO: 685375 - DNA, 22 bp, Artificial Sequence
  chemically synthesized
tagtttggtgaacaaacgagat

SEQ ID NO: 685376 - DNA, 22 bp, Artificial Sequence
  chemically synthesized
agtttggtgaacaaacgagata

SEQ ID NO: 685377 - DNA, 22 bp, Artificial Sequence
  chemically synthesized
gtttggtgaacaaacgagataa

SEQ ID NO: 685378 - DNA, 22 bp, Artificial Sequence
  chemically synthesized
ggtgaacaaacgagataacata

SEQ ID NO: 685379 - DNA, 22 bp, Artificial Sequence
  chemically synthesized
aaaggcactagctatgttatct

SEQ ID NO: 685380 - DNA, 22 bp, Artificial Sequence
  chemically synthesized
gtgaacaaacgagataacatag

SEQ ID NO: 685381 - DNA, 22 bp, Artificial Sequence
  chemically synthesized
tgactaaaaggcactagctatg

SEQ ID NO: 685382 - DNA, 22 bp, Artificial Sequence
  chemically synthesized
atgactaaaaggcactagctat

SEQ ID NO: 685383 - DNA, 22 bp, Artificial Sequence
  chemically synthesized
tatgactaaaaggcactagcta

SEQ ID NO: 685384 - DNA, 22 bp, Artificial Sequence
  chemically synthesized
ctttatgactaaaaggcactag

SEQ ID NO: 685385 - DNA, 22 bp, Artificial Sequence
  chemically synthesized
gctttatgactaaaaggcacta

SEQ ID NO: 685386 - DNA, 22 bp, Artificial Sequence
  chemically synthesized
tgctttatgactaaaaggcact

SEQ ID NO: 685387 - DNA, 22 bp, Artificial Sequence
  chemically synthesized
ttgctttatgactaaaaggcac

SEQ ID NO: 685388 - DNA, 22 bp, Artificial Sequence
  chemically synthesized
tttttgctttatgactaaaagg

SEQ ID NO: 685389 - DNA, 22 bp, Artificial Sequence
  chemically synthesized
atttttgctttatgactaaaag

SEQ ID NO: 685390 - DNA, 22 bp, Artificial Sequence
  chemically synthesized
tatttttgctttatgactaaaa

SEQ ID NO: 685391 - DNA, 22 bp, Artificial Sequence
  chemically synthesized
tagttttatttttgctttatga

SEQ ID NO: 685392 - DNA, 22 bp, Artificial Sequence
  chemically synthesized
gtgccttttagtcataaagcaa

SEQ ID NO: 685393 - DNA, 22 bp, Artificial Sequence
  chemically synthesized
ttagtcataaagcaaaaataaa

SEQ ID NO: 685394 - DNA, 22 bp, Artificial Sequence
  chemically synthesized
tagtcataaagcaaaaataaaa

SEQ ID NO: 685395 - DNA, 22 bp, Artificial Sequence
  chemically synthesized
agtcataaagcaaaaataaaac

SEQ ID NO: 685396 - DNA, 22 bp, Artificial Sequence
  chemically synthesized
gaaaacactgtagttttatttt

SEQ ID NO: 685397 - DNA, 22 bp, Artificial Sequence
  chemically synthesized
gtcataaagcaaaaataaaact

SEQ ID NO: 685398 - DNA, 22 bp, Artificial Sequence
  chemically synthesized
gggtacaatattagaaaacact

SEQ ID NO: 685399 - DNA, 22 bp, Artificial Sequence
  chemically synthesized
agggtacaatattagaaaacac

SEQ ID NO: 685400 - DNA, 22 bp, Artificial Sequence
  chemically synthesized
cataggtttagggtacaatatt

SEQ ID NO: 685401 - DNA, 22 bp, Artificial Sequence
  chemically synthesized
cagtgttttctaatattgtacc

SEQ ID NO: 685402 - DNA, 22 bp, Artificial Sequence
  chemically synthesized
gcataggtttagggtacaatat

SEQ ID NO: 685403 - DNA, 22 bp, Artificial Sequence
  chemically synthesized
gagatttgcataggtttagggt

SEQ ID NO: 685404 - DNA, 22 bp, Artificial Sequence
  chemically synthesized
tctaatattgtaccctaaacct

SEQ ID NO: 685405 - DNA, 22 bp, Artificial Sequence
  chemically synthesized
ctaatattgtaccctaaaccta

SEQ ID NO: 685406 - DNA, 22 bp, Artificial Sequence
  chemically synthesized
taatattgtaccctaaacctat

SEQ ID NO: 685407 - DNA, 22 bp, Artificial Sequence
  chemically synthesized
atattgtaccctaaacctatgc

SEQ ID NO: 685408 - DNA, 22 bp, Artificial Sequence
  chemically synthesized
taccctaaacctatgcaaatct

SEQ ID NO: 685409 - DNA, 22 bp, Artificial Sequence
  chemically synthesized
tgggtgatgtaaattggagatt

SEQ ID NO: 685410 - DNA, 22 bp, Artificial Sequence
  chemically synthesized
gtgggtgatgtaaattggagat

SEQ ID NO: 685411 - DNA, 22 bp, Artificial Sequence
  chemically synthesized
aacctatgcaaatctccaattt

SEQ ID NO: 685412 - DNA, 22 bp, Artificial Sequence
  chemically synthesized
tgcaaatctccaatttacatca

SEQ ID NO: 685413 - DNA, 22 bp, Artificial Sequence
  chemically synthesized
caatttacatcacccacaagcc

SEQ ID NO: 685414 - DNA, 22 bp, Artificial Sequence
  chemically synthesized
caaaaatatagaaggcttgtgg

SEQ ID NO: 685415 - DNA, 22 bp, Artificial Sequence
  chemically synthesized
acatcacccacaagccttctat

SEQ ID NO: 685416 - DNA, 22 bp, Artificial Sequence
  chemically synthesized
catcacccacaagccttctata

SEQ ID NO: 685417 - DNA, 22 bp, Artificial Sequence
  chemically synthesized
aaatctgcaaaaatatagaagg

SEQ ID NO: 685418 - DNA, 22 bp, Artificial Sequence
  chemically synthesized
gttaaaatctgcaaaaatatag

SEQ ID NO: 685419 - DNA, 22 bp, Artificial Sequence
  chemically synthesized
tagttaaaatctgcaaaaatat

SEQ ID NO: 685420 - DNA, 22 bp, Artificial Sequence
  chemically synthesized
gctctagttaaaatctgcaaaa

SEQ ID NO: 685421 - DNA, 22 bp, Artificial Sequence
  chemically synthesized
agctctagttaaaatctgcaaa

SEQ ID NO: 685422 - DNA, 22 bp, Artificial Sequence
  chemically synthesized
tttagctctagttaaaatctgc

SEQ ID NO: 685423 - DNA, 22 bp, Artificial Sequence
  chemically synthesized
ctatatttttgcagattttaac

SEQ ID NO: 685424 - DNA, 22 bp, Artificial Sequence
  chemically synthesized
tatatttttgcagattttaact

SEQ ID NO: 685425 - DNA, 22 bp, Artificial Sequence
  chemically synthesized
ttatttagctctagttaaaatc

SEQ ID NO: 685426 - DNA, 22 bp, Artificial Sequence
  chemically synthesized
tatttttgcagattttaactag

SEQ ID NO: 685427 - DNA, 22 bp, Artificial Sequence
  chemically synthesized
ttgcagattttaactagagcta

SEQ ID NO: 685428 - DNA, 22 bp, Artificial Sequence
  chemically synthesized
tgcagattttaactagagctaa

SEQ ID NO: 685429 - DNA, 22 bp, Artificial Sequence
  chemically synthesized
gcagattttaactagagctaaa

SEQ ID NO: 685430 - DNA, 22 bp, Artificial Sequence
  chemically synthesized
cagattttaactagagctaaat

SEQ ID NO: 685431 - DNA, 22 bp, Artificial Sequence
  chemically synthesized
taactagagctaaataataggc

SEQ ID NO: 685432 - DNA, 22 bp, Artificial Sequence
  chemically synthesized
aactagagctaaataataggca

SEQ ID NO: 685433 - DNA, 22 bp, Artificial Sequence
  chemically synthesized
agtataaatatatgcctattat

SEQ ID NO: 685434 - DNA, 22 bp, Artificial Sequence
  chemically synthesized
actagagctaaataataggcat

SEQ ID NO: 685435 - DNA, 22 bp, Artificial Sequence
  chemically synthesized
gagctaaataataggcatatat

SEQ ID NO: 685436 - DNA, 22 bp, Artificial Sequence
  chemically synthesized
caattaagtataaatatatgcc

SEQ ID NO: 685437 - DNA, 22 bp, Artificial Sequence
  chemically synthesized
attacaattaagtataaatata

SEQ ID NO: 685438 - DNA, 22 bp, Artificial Sequence
  chemically synthesized
aataataggcatatatttatac

SEQ ID NO: 685439 - DNA, 22 bp, Artificial Sequence
  chemically synthesized
gattacaattaagtataaatat

SEQ ID NO: 685440 - DNA, 22 bp, Artificial Sequence
  chemically synthesized
catttgattacaattaagtata

SEQ ID NO: 685441 - DNA, 22 bp, Artificial Sequence
  chemically synthesized
cacacgtcattacatttgatta

SEQ ID NO: 685442 - DNA, 22 bp, Artificial Sequence
  chemically synthesized
atacttaattgtaatcaaatgt

SEQ ID NO: 685443 - DNA, 22 bp, Artificial Sequence
  chemically synthesized
gcacacgtcattacatttgatt

SEQ ID NO: 685444 - DNA, 22 bp, Artificial Sequence
  chemically synthesized
tacttaattgtaatcaaatgta

SEQ ID NO: 685445 - DNA, 22 bp, Artificial Sequence
  chemically synthesized
tgcacacgtcattacatttgat

SEQ ID NO: 685446 - DNA, 22 bp, Artificial Sequence
  chemically synthesized
ttttgcacacgtcattacattt

SEQ ID NO: 685447 - DNA, 22 bp, Artificial Sequence
  chemically synthesized
aattgtaatcaaatgtaatgac

SEQ ID NO: 685448 - DNA, 22 bp, Artificial Sequence
  chemically synthesized
attgtaatcaaatgtaatgacg

SEQ ID NO: 685449 - DNA, 22 bp, Artificial Sequence
  chemically synthesized
taatcaaatgtaatgacgtgtg

SEQ ID NO: 685450 - DNA, 22 bp, Artificial Sequence
  chemically synthesized
agcaaagcctgttttgcacacg

SEQ ID NO: 685451 - DNA, 22 bp, Artificial Sequence
  chemically synthesized
gagcaaagcctgttttgcacac

SEQ ID NO: 685452 - DNA, 22 bp, Artificial Sequence
  chemically synthesized
tgagcaaagcctgttttgcaca

SEQ ID NO: 685453 - DNA, 22 bp, Artificial Sequence
  chemically synthesized
taaagagcactttgagcaaagc

SEQ ID NO: 685454 - DNA, 22 bp, Artificial Sequence
  chemically synthesized
atctataaagagcactttgagc

SEQ ID NO: 685455 - DNA, 22 bp, Artificial Sequence
  chemically synthesized
catctataaagagcactttgag

SEQ ID NO: 685456 - DNA, 22 bp, Artificial Sequence
  chemically synthesized
tgctcaaagtgctctttataga

SEQ ID NO: 685457 - DNA, 22 bp, Artificial Sequence
  chemically synthesized
gctcaaagtgctctttatagat

SEQ ID NO: 685458 - DNA, 22 bp, Artificial Sequence
  chemically synthesized
ctcaaagtgctctttatagatg

SEQ ID NO: 685459 - DNA, 22 bp, Artificial Sequence
  chemically synthesized
aataatcatatttcatctataa

SEQ ID NO: 685460 - DNA, 22 bp, Artificial Sequence
  chemically synthesized
aaagtgctctttatagatgaaa

SEQ ID NO: 685461 - DNA, 22 bp, Artificial Sequence
  chemically synthesized
tcaagttcaataatcatatttc

SEQ ID NO: 685462 - DNA, 22 bp, Artificial Sequence
  chemically synthesized
tttatagatgaaatatgattat

SEQ ID NO: 685463 - DNA, 22 bp, Artificial Sequence
  chemically synthesized
ctgtcaagttcaataatcatat

SEQ ID NO: 685464 - DNA, 22 bp, Artificial Sequence
  chemically synthesized
tatagatgaaatatgattattg

SEQ ID NO: 685465 - DNA, 22 bp, Artificial Sequence
  chemically synthesized
atagatgaaatatgattattga

SEQ ID NO: 685466 - DNA, 22 bp, Artificial Sequence
  chemically synthesized
tagatgaaatatgattattgaa

SEQ ID NO: 685467 - DNA, 22 bp, Artificial Sequence
  chemically synthesized
caatgaatgatctactgtcaag

SEQ ID NO: 685468 - DNA, 22 bp, Artificial Sequence
  chemically synthesized
cctccaatgaatgatctactgt

SEQ ID NO: 685469 - DNA, 22 bp, Artificial Sequence
  chemically synthesized
ccctccaatgaatgatctactg

SEQ ID NO: 685470 - DNA, 22 bp, Artificial Sequence
  chemically synthesized
tccctccaatgaatgatctact

SEQ ID NO: 685471 - DNA, 22 bp, Artificial Sequence
  chemically synthesized
ttgaacttgacagtagatcatt

SEQ ID NO: 685472 - DNA, 22 bp, Artificial Sequence
  chemically synthesized
ttccctccaatgaatgatctac

SEQ ID NO: 685473 - DNA, 22 bp, Artificial Sequence
  chemically synthesized
aacttgacagtagatcattcat

SEQ ID NO: 685474 - DNA, 22 bp, Artificial Sequence
  chemically synthesized
atcacttttccctccaatgaat

SEQ ID NO: 685475 - DNA, 22 bp, Artificial Sequence
  chemically synthesized
gacagtagatcattcattggag

SEQ ID NO: 685476 - DNA, 22 bp, Artificial Sequence
  chemically synthesized
acagtagatcattcattggagg

SEQ ID NO: 685477 - DNA, 22 bp, Artificial Sequence
  chemically synthesized
attggagggaaaagtgattaat

SEQ ID NO: 685478 - DNA, 22 bp, Artificial Sequence
  chemically synthesized
gagggaaaagtgattaatcact

SEQ ID NO: 685479 - DNA, 22 bp, Artificial Sequence
  chemically synthesized
atcacttctctgtgcctctacc

SEQ ID NO: 685480 - DNA, 22 bp, Artificial Sequence
  chemically synthesized
ctctgtgcctctaccttcctac

SEQ ID NO: 685481 - DNA, 22 bp, Artificial Sequence
  chemically synthesized
tctgtgcctctaccttcctacc

SEQ ID NO: 685482 - DNA, 22 bp, Artificial Sequence
  chemically synthesized
tgtgcctctaccttcctaccct

SEQ ID NO: 685483 - DNA, 22 bp, Artificial Sequence
  chemically synthesized
tgcctctaccttcctacccttt

SEQ ID NO: 685484 - DNA, 22 bp, Artificial Sequence
  chemically synthesized
taccttcctaccctttgatgac

SEQ ID NO: 685485 - DNA, 22 bp, Artificial Sequence
  chemically synthesized
aaatataaccggtgtcatcaaa

SEQ ID NO: 685486 - DNA, 22 bp, Artificial Sequence
  chemically synthesized
ccttcctaccctttgatgacac

SEQ ID NO: 685487 - DNA, 22 bp, Artificial Sequence
  chemically synthesized
gaaatataaccggtgtcatcaa

SEQ ID NO: 685488 - DNA, 22 bp, Artificial Sequence
  chemically synthesized
cctaccctttgatgacaccggt

SEQ ID NO: 685489 - DNA, 22 bp, Artificial Sequence
  chemically synthesized
ctaccctttgatgacaccggtt

SEQ ID NO: 685490 - DNA, 22 bp, Artificial Sequence
  chemically synthesized
ccctttgatgacaccggttata

SEQ ID NO: 685491 - DNA, 22 bp, Artificial Sequence
  chemically synthesized
agaatcttgaaatataaccggt

SEQ ID NO: 685492 - DNA, 22 bp, Artificial Sequence
  chemically synthesized
tgatgacaccggttatatttca

SEQ ID NO: 685493 - DNA, 22 bp, Artificial Sequence
  chemically synthesized
gatgacaccggttatatttcaa

SEQ ID NO: 685494 - DNA, 22 bp, Artificial Sequence
  chemically synthesized
atgacaccggttatatttcaag

SEQ ID NO: 685495 - DNA, 22 bp, Artificial Sequence
  chemically synthesized
tagcattgagaatcttgaaata

SEQ ID NO: 685496 - DNA, 22 bp, Artificial Sequence
  chemically synthesized
atagcattgagaatcttgaaat

SEQ ID NO: 685497 - DNA, 22 bp, Artificial Sequence
  chemically synthesized
atttatagcattgagaatcttg

SEQ ID NO: 685498 - DNA, 22 bp, Artificial Sequence
  chemically synthesized
tatttcaagattctcaatgcta

SEQ ID NO: 685499 - DNA, 22 bp, Artificial Sequence
  chemically synthesized
caagattctcaatgctataaat

SEQ ID NO: 685500 - DNA, 22 bp, Artificial Sequence
  chemically synthesized
agtaaagtgttcatttatagca

SEQ ID NO: 685501 - DNA, 22 bp, Artificial Sequence
  chemically synthesized
aagattctcaatgctataaatg

SEQ ID NO: 685502 - DNA, 22 bp, Artificial Sequence
  chemically synthesized
cagtaaagtgttcatttatagc

SEQ ID NO: 685503 - DNA, 22 bp, Artificial Sequence
  chemically synthesized
ttcagtaaagtgttcatttata

SEQ ID NO: 685504 - DNA, 22 bp, Artificial Sequence
  chemically synthesized
cttcagtaaagtgttcatttat

SEQ ID NO: 685505 - DNA, 22 bp, Artificial Sequence
  chemically synthesized
tcaatgctataaatgaacactt

SEQ ID NO: 685506 - DNA, 22 bp, Artificial Sequence
  chemically synthesized
aatgctataaatgaacacttta

SEQ ID NO: 685507 - DNA, 22 bp, Artificial Sequence
  chemically synthesized
taaatgaacactttactgaaga

SEQ ID NO: 685508 - DNA, 22 bp, Artificial Sequence
  chemically synthesized
gataaagatgcttcttcagtaa

SEQ ID NO: 685509 - DNA, 22 bp, Artificial Sequence
  chemically synthesized
cattggataaagatgcttcttc

SEQ ID NO: 685510 - DNA, 22 bp, Artificial Sequence
  chemically synthesized
gcattggataaagatgcttctt

SEQ ID NO: 685511 - DNA, 22 bp, Artificial Sequence
  chemically synthesized
tgcattggataaagatgcttct

SEQ ID NO: 685512 - DNA, 22 bp, Artificial Sequence
  chemically synthesized
attttgcattggataaagatgc

SEQ ID NO: 685513 - DNA, 22 bp, Artificial Sequence
  chemically synthesized
cattttgcattggataaagatg

SEQ ID NO: 685514 - DNA, 22 bp, Artificial Sequence
  chemically synthesized
tactgaagaagcatctttatcc

SEQ ID NO: 685515 - DNA, 22 bp, Artificial Sequence
  chemically synthesized
actgaagaagcatctttatcca

SEQ ID NO: 685516 - DNA, 22 bp, Artificial Sequence
  chemically synthesized
ctgaagaagcatctttatccaa

SEQ ID NO: 685517 - DNA, 22 bp, Artificial Sequence
  chemically synthesized
aagaagcatctttatccaatgc

SEQ ID NO: 685518 - DNA, 22 bp, Artificial Sequence
  chemically synthesized
ggcaacacatttcattttgcat

SEQ ID NO: 685519 - DNA, 22 bp, Artificial Sequence
  chemically synthesized
aggcaacacatttcattttgca

SEQ ID NO: 685520 - DNA, 22 bp, Artificial Sequence
  chemically synthesized
tatccaatgcaaaatgaaatgt

SEQ ID NO: 685521 - DNA, 22 bp, Artificial Sequence
  chemically synthesized
gtcttaggcaacacatttcatt

SEQ ID NO: 685522 - DNA, 22 bp, Artificial Sequence
  chemically synthesized
atccaatgcaaaatgaaatgtg

SEQ ID NO: 685523 - DNA, 22 bp, Artificial Sequence
  chemically synthesized
tccaatgcaaaatgaaatgtgt

SEQ ID NO: 685524 - DNA, 22 bp, Artificial Sequence
  chemically synthesized
ttagtcttaggcaacacatttc

SEQ ID NO: 685525 - DNA, 22 bp, Artificial Sequence
  chemically synthesized
attagtcttaggcaacacattt

SEQ ID NO: 685526 - DNA, 22 bp, Artificial Sequence
  chemically synthesized
tattagtcttaggcaacacatt

SEQ ID NO: 685527 - DNA, 22 bp, Artificial Sequence
  chemically synthesized
taaatgactttattagtcttag

SEQ ID NO: 685528 - DNA, 22 bp, Artificial Sequence
  chemically synthesized
gtaaatgactttattagtctta

SEQ ID NO: 685529 - DNA, 22 bp, Artificial Sequence
  chemically synthesized
aaacttgtaaatgactttatta

SEQ ID NO: 685530 - DNA, 22 bp, Artificial Sequence
  chemically synthesized
cctaagactaataaagtcattt

SEQ ID NO: 685531 - DNA, 22 bp, Artificial Sequence
  chemically synthesized
attgaaacttgtaaatgacttt

SEQ ID NO: 685532 - DNA, 22 bp, Artificial Sequence
  chemically synthesized
ctcattgaaacttgtaaatgac

SEQ ID NO: 685533 - DNA, 22 bp, Artificial Sequence
  chemically synthesized
agactaataaagtcatttacaa

SEQ ID NO: 685534 - DNA, 22 bp, Artificial Sequence
  chemically synthesized
ctcctcattgaaacttgtaaat

SEQ ID NO: 685535 - DNA, 22 bp, Artificial Sequence
  chemically synthesized
gctcctcattgaaacttgtaaa

SEQ ID NO: 685536 - DNA, 22 bp, Artificial Sequence
  chemically synthesized
ataaagtcatttacaagtttca

SEQ ID NO: 685537 - DNA, 22 bp, Artificial Sequence
  chemically synthesized
tatttgctcctcattgaaactt

SEQ ID NO: 685538 - DNA, 22 bp, Artificial Sequence
  chemically synthesized
atatttgctcctcattgaaact

SEQ ID NO: 685539 - DNA, 22 bp, Artificial Sequence
  chemically synthesized
tttatatttgctcctcattgaa

SEQ ID NO: 685540 - DNA, 22 bp, Artificial Sequence
  chemically synthesized
ctatttatatttgctcctcatt

SEQ ID NO: 685541 - DNA, 22 bp, Artificial Sequence
  chemically synthesized
actatttatatttgctcctcat

SEQ ID NO: 685542 - DNA, 22 bp, Artificial Sequence
  chemically synthesized
tactatttatatttgctcctca

SEQ ID NO: 685543 - DNA, 22 bp, Artificial Sequence
  chemically synthesized
acaagtttcaatgaggagcaaa

SEQ ID NO: 685544 - DNA, 22 bp, Artificial Sequence
  chemically synthesized
ttactatttatatttgctcctc

SEQ ID NO: 685545 - DNA, 22 bp, Artificial Sequence
  chemically synthesized
caagtttcaatgaggagcaaat

SEQ ID NO: 685546 - DNA, 22 bp, Artificial Sequence
  chemically synthesized
tttactatttatatttgctcct

SEQ ID NO: 685547 - DNA, 22 bp, Artificial Sequence
  chemically synthesized
ttttactatttatatttgctcc

SEQ ID NO: 685548 - DNA, 22 bp, Artificial Sequence
  chemically synthesized
tttttactatttatatttgctc

SEQ ID NO: 685549 - DNA, 22 bp, Artificial Sequence
  chemically synthesized
ttttttactatttatatttgct

SEQ ID NO: 685550 - DNA, 22 bp, Artificial Sequence
  chemically synthesized
tttttttactatttatatttgc

SEQ ID NO: 685551 - DNA, 22 bp, Artificial Sequence
  chemically synthesized
ttttttttactatttatatttg

SEQ ID NO: 685552 - DNA, 22 bp, Artificial Sequence
  chemically synthesized
tttttttttactatttatattt

SEQ ID NO: 685553 - DNA, 22 bp, Artificial Sequence
  chemically synthesized
caatgaggagcaaatataaata

SEQ ID NO: 685554 - DNA, 22 bp, Artificial Sequence
  chemically synthesized
ttttttttttactatttatatt

SEQ ID NO: 685555 - DNA, 22 bp, Artificial Sequence
  chemically synthesized
aatgaggagcaaatataaatag

SEQ ID NO: 685556 - DNA, 22 bp, Artificial Sequence
  chemically synthesized
aataatggattttttttttttt

SEQ ID NO: 685557 - DNA, 22 bp, Artificial Sequence
  chemically synthesized
ttaaataatggatttttttttt

SEQ ID NO: 685558 - DNA, 22 bp, Artificial Sequence
  chemically synthesized
ctgttaaataatggattttttt

SEQ ID NO: 685559 - DNA, 22 bp, Artificial Sequence
  chemically synthesized
ctgctgttaaataatggatttt

SEQ ID NO: 685560 - DNA, 22 bp, Artificial Sequence
  chemically synthesized
actgctgttaaataatggattt

SEQ ID NO: 685561 - DNA, 22 bp, Artificial Sequence
  chemically synthesized
gatttactgctgttaaataatg

SEQ ID NO: 685562 - DNA, 22 bp, Artificial Sequence
  chemically synthesized
ccaaaacatactggatttactg

SEQ ID NO: 685563 - DNA, 22 bp, Artificial Sequence
  chemically synthesized
accaaaacatactggatttact

SEQ ID NO: 685564 - DNA, 22 bp, Artificial Sequence
  chemically synthesized
taccaaaacatactggatttac

SEQ ID NO: 685565 - DNA, 22 bp, Artificial Sequence
  chemically synthesized
tttaacagcagtaaatccagta

SEQ ID NO: 685566 - DNA, 22 bp, Artificial Sequence
  chemically synthesized
ttttaccaaaacatactggatt

SEQ ID NO: 685567 - DNA, 22 bp, Artificial Sequence
  chemically synthesized
aacagcagtaaatccagtatgt

SEQ ID NO: 685568 - DNA, 22 bp, Artificial Sequence
  chemically synthesized
acagcagtaaatccagtatgtt

SEQ ID NO: 685569 - DNA, 22 bp, Artificial Sequence
  chemically synthesized
aaaactgttttaccaaaacata

SEQ ID NO: 685570 - DNA, 22 bp, Artificial Sequence
  chemically synthesized
tgaaaactgttttaccaaaaca

SEQ ID NO: 685571 - DNA, 22 bp, Artificial Sequence
  chemically synthesized
tctgaaaactgttttaccaaaa

SEQ ID NO: 685572 - DNA, 22 bp, Artificial Sequence
  chemically synthesized
ctctgaaaactgttttaccaaa

SEQ ID NO: 685573 - DNA, 22 bp, Artificial Sequence
  chemically synthesized
tggtaaaacagttttcagagaa

SEQ ID NO: 685574 - DNA, 22 bp, Artificial Sequence
  chemically synthesized
ggtaaaacagttttcagagaag

SEQ ID NO: 685575 - DNA, 22 bp, Artificial Sequence
  chemically synthesized
acgtaagtagagcttctctgaa

SEQ ID NO: 685576 - DNA, 22 bp, Artificial Sequence
  chemically synthesized
gtaaaacagttttcagagaagc

SEQ ID NO: 685577 - DNA, 22 bp, Artificial Sequence
  chemically synthesized
ggaaaagctaacgtaagtagag

SEQ ID NO: 685578 - DNA, 22 bp, Artificial Sequence
  chemically synthesized
aggaaaagctaacgtaagtaga

SEQ ID NO: 685579 - DNA, 22 bp, Artificial Sequence
  chemically synthesized
tcagagaagctctacttacgtt

SEQ ID NO: 685580 - DNA, 22 bp, Artificial Sequence
  chemically synthesized
cagagaagctctacttacgtta

SEQ ID NO: 685581 - DNA, 22 bp, Artificial Sequence
  chemically synthesized
agagaagctctacttacgttag

SEQ ID NO: 685582 - DNA, 22 bp, Artificial Sequence
  chemically synthesized
cagcaaggtttaggaaaagcta

SEQ ID NO: 685583 - DNA, 22 bp, Artificial Sequence
  chemically synthesized
gcagcaaggtttaggaaaagct

SEQ ID NO: 685584 - DNA, 22 bp, Artificial Sequence
  chemically synthesized
tgcagcaaggtttaggaaaagc

SEQ ID NO: 685585 - DNA, 22 bp, Artificial Sequence
  chemically synthesized
tacttacgttagcttttcctaa

SEQ ID NO: 685586 - DNA, 22 bp, Artificial Sequence
  chemically synthesized
cttacgttagcttttcctaaac

SEQ ID NO: 685587 - DNA, 22 bp, Artificial Sequence
  chemically synthesized
acgttagcttttcctaaacctt

SEQ ID NO: 685588 - DNA, 22 bp, Artificial Sequence
  chemically synthesized
acactttgcagcaaggtttagg

SEQ ID NO: 685589 - DNA, 22 bp, Artificial Sequence
  chemically synthesized
cgttagcttttcctaaaccttg

SEQ ID NO: 685590 - DNA, 22 bp, Artificial Sequence
  chemically synthesized
gcttttcctaaaccttgctgca

SEQ ID NO: 685591 - DNA, 22 bp, Artificial Sequence
  chemically synthesized
ttcctaaaccttgctgcaaagt

SEQ ID NO: 685592 - DNA, 22 bp, Artificial Sequence
  chemically synthesized
gaaagaactgacactttgcagc

SEQ ID NO: 685593 - DNA, 22 bp, Artificial Sequence
  chemically synthesized
tcctaaaccttgctgcaaagtg

SEQ ID NO: 685594 - DNA, 22 bp, Artificial Sequence
  chemically synthesized
cctaaaccttgctgcaaagtgt

SEQ ID NO: 685595 - DNA, 22 bp, Artificial Sequence
  chemically synthesized
ctaaaccttgctgcaaagtgtc

SEQ ID NO: 685596 - DNA, 22 bp, Artificial Sequence
  chemically synthesized
aaccttgctgcaaagtgtcagt

SEQ ID NO: 685597 - DNA, 22 bp, Artificial Sequence
  chemically synthesized
tatattagaaagaactgacact

SEQ ID NO: 685598 - DNA, 22 bp, Artificial Sequence
  chemically synthesized
attgtatattagaaagaactga

SEQ ID NO: 685599 - DNA, 22 bp, Artificial Sequence
  chemically synthesized
gctgcaaagtgtcagttctttc

SEQ ID NO: 685600 - DNA, 22 bp, Artificial Sequence
  chemically synthesized
gattgtatattagaaagaactg

SEQ ID NO: 685601 - DNA, 22 bp, Artificial Sequence
  chemically synthesized
ctgcaaagtgtcagttctttct

SEQ ID NO: 685602 - DNA, 22 bp, Artificial Sequence
  chemically synthesized
tgattgtatattagaaagaact

SEQ ID NO: 685603 - DNA, 22 bp, Artificial Sequence
  chemically synthesized
caaagtgtcagttctttctaat

SEQ ID NO: 685604 - DNA, 22 bp, Artificial Sequence
  chemically synthesized
ctttgattgtatattagaaaga

SEQ ID NO: 685605 - DNA, 22 bp, Artificial Sequence
  chemically synthesized
tttctaatatacaatcaaagga

SEQ ID NO: 685606 - DNA, 22 bp, Artificial Sequence
  chemically synthesized
ccaacacaaaattcctttgatt

SEQ ID NO: 685607 - DNA, 22 bp, Artificial Sequence
  chemically synthesized
cccaacacaaaattcctttgat

SEQ ID NO: 685608 - DNA, 22 bp, Artificial Sequence
  chemically synthesized
tctaatatacaatcaaaggaat

SEQ ID NO: 685609 - DNA, 22 bp, Artificial Sequence
  chemically synthesized
ctaatatacaatcaaaggaatt

SEQ ID NO: 685610 - DNA, 22 bp, Artificial Sequence
  chemically synthesized
ttcccaacacaaaattcctttg

SEQ ID NO: 685611 - DNA, 22 bp, Artificial Sequence
  chemically synthesized
taatatacaatcaaaggaattt

SEQ ID NO: 685612 - DNA, 22 bp, Artificial Sequence
  chemically synthesized
atatacaatcaaaggaattttg

SEQ ID NO: 685613 - DNA, 22 bp, Artificial Sequence
  chemically synthesized
caaagatgagaaatgttcttcc

SEQ ID NO: 685614 - DNA, 22 bp, Artificial Sequence
  chemically synthesized
acaaagatgagaaatgttcttc

SEQ ID NO: 685615 - DNA, 22 bp, Artificial Sequence
  chemically synthesized
tacaaagatgagaaatgttctt

SEQ ID NO: 685616 - DNA, 22 bp, Artificial Sequence
  chemically synthesized
tgtgttgggaagaacatttctc

SEQ ID NO: 685617 - DNA, 22 bp, Artificial Sequence
  chemically synthesized
gtgttgggaagaacatttctca

SEQ ID NO: 685618 - DNA, 22 bp, Artificial Sequence
  chemically synthesized
tgttgggaagaacatttctcat

SEQ ID NO: 685619 - DNA, 22 bp, Artificial Sequence
  chemically synthesized
aatgtcctttacaaagatgaga

SEQ ID NO: 685620 - DNA, 22 bp, Artificial Sequence
  chemically synthesized
ggaagaacatttctcatctttg

SEQ ID NO: 685621 - DNA, 22 bp, Artificial Sequence
  chemically synthesized
taaatgtcctttacaaagatga

SEQ ID NO: 685622 - DNA, 22 bp, Artificial Sequence
  chemically synthesized
ctctaaatgtcctttacaaaga

SEQ ID NO: 685623 - DNA, 22 bp, Artificial Sequence
  chemically synthesized
tcctctaaatgtcctttacaaa

SEQ ID NO: 685624 - DNA, 22 bp, Artificial Sequence
  chemically synthesized
tctctcctctaaatgtccttta

SEQ ID NO: 685625 - DNA, 22 bp, Artificial Sequence
  chemically synthesized
ctcatctttgtaaaggacattt

SEQ ID NO: 685626 - DNA, 22 bp, Artificial Sequence
  chemically synthesized
tcatctttgtaaaggacattta

SEQ ID NO: 685627 - DNA, 22 bp, Artificial Sequence
  chemically synthesized
cctatctctcctctaaatgtcc

SEQ ID NO: 685628 - DNA, 22 bp, Artificial Sequence
  chemically synthesized
atctttgtaaaggacatttaga

SEQ ID NO: 685629 - DNA, 22 bp, Artificial Sequence
  chemically synthesized
ccctatctctcctctaaatgtc

SEQ ID NO: 685630 - DNA, 22 bp, Artificial Sequence
  chemically synthesized
tccctatctctcctctaaatgt

SEQ ID NO: 685631 - DNA, 22 bp, Artificial Sequence
  chemically synthesized
ttccctatctctcctctaaatg

SEQ ID NO: 685632 - DNA, 22 bp, Artificial Sequence
  chemically synthesized
tgtaaaggacatttagaggaga

SEQ ID NO: 685633 - DNA, 22 bp, Artificial Sequence
  chemically synthesized
tttttccctatctctcctctaa

SEQ ID NO: 685634 - DNA, 22 bp, Artificial Sequence
  chemically synthesized
gtaaaggacatttagaggagag

SEQ ID NO: 685635 - DNA, 22 bp, Artificial Sequence
  chemically synthesized
gtttttccctatctctcctcta

SEQ ID NO: 685636 - DNA, 22 bp, Artificial Sequence
  chemically synthesized
taaaggacatttagaggagaga

SEQ ID NO: 685637 - DNA, 22 bp, Artificial Sequence
  chemically synthesized
tgtttttccctatctctcctct

SEQ ID NO: 685638 - DNA, 22 bp, Artificial Sequence
  chemically synthesized
agaggagagatagggaaaaaca

SEQ ID NO: 685639 - DNA, 22 bp, Artificial Sequence
  chemically synthesized
atgcatgatctttgtttttccc

SEQ ID NO: 685640 - DNA, 22 bp, Artificial Sequence
  chemically synthesized
gaggagagatagggaaaaacaa

SEQ ID NO: 685641 - DNA, 22 bp, Artificial Sequence
  chemically synthesized
acacataatcctcatgcatgat

SEQ ID NO: 685642 - DNA, 22 bp, Artificial Sequence
  chemically synthesized
aaatccagtcaatccataccct

SEQ ID NO: 685643 - DNA, 22 bp, Artificial Sequence
  chemically synthesized
tgtgtgagggtatggattgact

SEQ ID NO: 685644 - DNA, 22 bp, Artificial Sequence
  chemically synthesized
aaataatgattgaaatccagtc

SEQ ID NO: 685645 - DNA, 22 bp, Artificial Sequence
  chemically synthesized
aaaataatgattgaaatccagt

SEQ ID NO: 685646 - DNA, 22 bp, Artificial Sequence
  chemically synthesized
taaaataatgattgaaatccag

SEQ ID NO: 685647 - DNA, 22 bp, Artificial Sequence
  chemically synthesized
ttaaaataatgattgaaatcca

SEQ ID NO: 685648 - DNA, 22 bp, Artificial Sequence
  chemically synthesized
actggatttcaatcattatttt

SEQ ID NO: 685649 - DNA, 22 bp, Artificial Sequence
  chemically synthesized
gataagccttttaaaataatga

SEQ ID NO: 685650 - DNA, 22 bp, Artificial Sequence
  chemically synthesized
agataagccttttaaaataatg

SEQ ID NO: 685651 - DNA, 22 bp, Artificial Sequence
  chemically synthesized
tagataagccttttaaaataat

SEQ ID NO: 685652 - DNA, 22 bp, Artificial Sequence
  chemically synthesized
gatttcaatcattattttaaaa

SEQ ID NO: 685653 - DNA, 22 bp, Artificial Sequence
  chemically synthesized
ttttagataagccttttaaaat

SEQ ID NO: 685654 - DNA, 22 bp, Artificial Sequence
  chemically synthesized
attttagataagccttttaaaa

SEQ ID NO: 685655 - DNA, 22 bp, Artificial Sequence
  chemically synthesized
caatcattattttaaaaggctt

SEQ ID NO: 685656 - DNA, 22 bp, Artificial Sequence
  chemically synthesized
aatcattattttaaaaggctta

SEQ ID NO: 685657 - DNA, 22 bp, Artificial Sequence
  chemically synthesized
ttttaaaaggcttatctaaaat

SEQ ID NO: 685658 - DNA, 22 bp, Artificial Sequence
  chemically synthesized
aaagaacaccttattttagata

SEQ ID NO: 685659 - DNA, 22 bp, Artificial Sequence
  chemically synthesized
taaaaggcttatctaaaataag

SEQ ID NO: 685660 - DNA, 22 bp, Artificial Sequence
  chemically synthesized
aaaaggcttatctaaaataagg

SEQ ID NO: 685661 - DNA, 22 bp, Artificial Sequence
  chemically synthesized
gttcaaagaacaccttatttta

SEQ ID NO: 685662 - DNA, 22 bp, Artificial Sequence
  chemically synthesized
aaaggcttatctaaaataaggt

SEQ ID NO: 685663 - DNA, 22 bp, Artificial Sequence
  chemically synthesized
ggttcaaagaacaccttatttt

SEQ ID NO: 685664 - DNA, 22 bp, Artificial Sequence
  chemically synthesized
cacttggttcaaagaacacctt

SEQ ID NO: 685665 - DNA, 22 bp, Artificial Sequence
  chemically synthesized
atctaaaataaggtgttctttg

SEQ ID NO: 685666 - DNA, 22 bp, Artificial Sequence
  chemically synthesized
tctaaaataaggtgttctttga

SEQ ID NO: 685667 - DNA, 22 bp, Artificial Sequence
  chemically synthesized
aaataaggtgttctttgaacca

SEQ ID NO: 685668 - DNA, 22 bp, Artificial Sequence
  chemically synthesized
gaaatcagactccacttggttc

SEQ ID NO: 685669 - DNA, 22 bp, Artificial Sequence
  chemically synthesized
aaattggaaatcagactccact

SEQ ID NO: 685670 - DNA, 22 bp, Artificial Sequence
  chemically synthesized
taaaattggaaatcagactcca

SEQ ID NO: 685671 - DNA, 22 bp, Artificial Sequence
  chemically synthesized
tttgaaccaagtggagtctgat

SEQ ID NO: 685672 - DNA, 22 bp, Artificial Sequence
  chemically synthesized
tgaaccaagtggagtctgattt

SEQ ID NO: 685673 - DNA, 22 bp, Artificial Sequence
  chemically synthesized
gaaccaagtggagtctgatttc

SEQ ID NO: 685674 - DNA, 22 bp, Artificial Sequence
  chemically synthesized
aaccaagtggagtctgatttcc

SEQ ID NO: 685675 - DNA, 22 bp, Artificial Sequence
  chemically synthesized
aatgtggaaacattctaaaatt

SEQ ID NO: 685676 - DNA, 22 bp, Artificial Sequence
  chemically synthesized
atttccaattttagaatgtttc

SEQ ID NO: 685677 - DNA, 22 bp, Artificial Sequence
  chemically synthesized
ccaattttagaatgtttccaca

SEQ ID NO: 685678 - DNA, 22 bp, Artificial Sequence
  chemically synthesized
caattttagaatgtttccacat

SEQ ID NO: 685679 - DNA, 22 bp, Artificial Sequence
  chemically synthesized
tagaatgtttccacatttaaca

SEQ ID NO: 685680 - DNA, 22 bp, Artificial Sequence
  chemically synthesized
agaatgtttccacatttaacac

SEQ ID NO: 685681 - DNA, 22 bp, Artificial Sequence
  chemically synthesized
gaatgtttccacatttaacact

SEQ ID NO: 685682 - DNA, 22 bp, Artificial Sequence
  chemically synthesized
aggataatgaatgtcagtgtta

SEQ ID NO: 685683 - DNA, 22 bp, Artificial Sequence
  chemically synthesized
caggataatgaatgtcagtgtt

SEQ ID NO: 685684 - DNA, 22 bp, Artificial Sequence
  chemically synthesized
tcaggataatgaatgtcagtgt

SEQ ID NO: 685685 - DNA, 22 bp, Artificial Sequence
  chemically synthesized
ccacatttaacactgacattca

SEQ ID NO: 685686 - DNA, 22 bp, Artificial Sequence
  chemically synthesized
cacatttaacactgacattcat

SEQ ID NO: 685687 - DNA, 22 bp, Artificial Sequence
  chemically synthesized
attttcaggataatgaatgtca

SEQ ID NO: 685688 - DNA, 22 bp, Artificial Sequence
  chemically synthesized
cattttcaggataatgaatgtc

SEQ ID NO: 685689 - DNA, 22 bp, Artificial Sequence
  chemically synthesized
ccttcattttcaggataatgaa

SEQ ID NO: 685690 - DNA, 22 bp, Artificial Sequence
  chemically synthesized
aacactgacattcattatcctg

SEQ ID NO: 685691 - DNA, 22 bp, Artificial Sequence
  chemically synthesized
acactgacattcattatcctga

SEQ ID NO: 685692 - DNA, 22 bp, Artificial Sequence
  chemically synthesized
acattcattatcctgaaaatga

SEQ ID NO: 685693 - DNA, 22 bp, Artificial Sequence
  chemically synthesized
tgtgtatctgccttcattttca

SEQ ID NO: 685694 - DNA, 22 bp, Artificial Sequence
  chemically synthesized
attatcctgaaaatgaaggcag

SEQ ID NO: 685695 - DNA, 22 bp, Artificial Sequence
  chemically synthesized
tcctgaaaatgaaggcagatac

SEQ ID NO: 685696 - DNA, 22 bp, Artificial Sequence
  chemically synthesized
aaaatgaaggcagatacacata

SEQ ID NO: 685697 - DNA, 22 bp, Artificial Sequence
  chemically synthesized
aaatacatatagatattatgtg

SEQ ID NO: 685698 - DNA, 22 bp, Artificial Sequence
  chemically synthesized
aaaatacatatagatattatgt

SEQ ID NO: 685699 - DNA, 22 bp, Artificial Sequence
  chemically synthesized
tttaaaatacatatagatatta

SEQ ID NO: 685700 - DNA, 22 bp, Artificial Sequence
  chemically synthesized
atttaaaatacatatagatatt

SEQ ID NO: 685701 - DNA, 22 bp, Artificial Sequence
  chemically synthesized
tatttaaaatacatatagatat

SEQ ID NO: 685702 - DNA, 22 bp, Artificial Sequence
  chemically synthesized
aaccaattttatttaaaataca

SEQ ID NO: 685703 - DNA, 22 bp, Artificial Sequence
  chemically synthesized
ttgaaccaattttatttaaaat

SEQ ID NO: 685704 - DNA, 22 bp, Artificial Sequence
  chemically synthesized
tatgtattttaaataaaattgg

SEQ ID NO: 685705 - DNA, 22 bp, Artificial Sequence
  chemically synthesized
agaaaaattattgaaccaattt

SEQ ID NO: 685706 - DNA, 22 bp, Artificial Sequence
  chemically synthesized
gagaaaaattattgaaccaatt

SEQ ID NO: 685707 - DNA, 22 bp, Artificial Sequence
  chemically synthesized
taaataaaattggttcaataat

SEQ ID NO: 685708 - DNA, 22 bp, Artificial Sequence
  chemically synthesized
aaataaaattggttcaataatt

SEQ ID NO: 685709 - DNA, 22 bp, Artificial Sequence
  chemically synthesized
aataaaattggttcaataattt

SEQ ID NO: 685710 - DNA, 22 bp, Artificial Sequence
  chemically synthesized
tgaaatttgagaaaaattattg

SEQ ID NO: 685711 - DNA, 22 bp, Artificial Sequence
  chemically synthesized
gttcaataatttttctcaaatt

SEQ ID NO: 685712 - DNA, 22 bp, Artificial Sequence
  chemically synthesized
aataatttttctcaaatttcat

SEQ ID NO: 685713 - DNA, 22 bp, Artificial Sequence
  chemically synthesized
atagaaaaagttatgaaatttg

SEQ ID NO: 685714 - DNA, 22 bp, Artificial Sequence
  chemically synthesized
attcatagaaaaagttatgaaa

SEQ ID NO: 685715 - DNA, 22 bp, Artificial Sequence
  chemically synthesized
ttctcaaatttcataacttttt

SEQ ID NO: 685716 - DNA, 22 bp, Artificial Sequence
  chemically synthesized
tctcaaatttcataactttttc

SEQ ID NO: 685717 - DNA, 22 bp, Artificial Sequence
  chemically synthesized
ctcaaatttcataactttttct

SEQ ID NO: 685718 - DNA, 22 bp, Artificial Sequence
  chemically synthesized
tcaaatttcataactttttcta

SEQ ID NO: 685719 - DNA, 22 bp, Artificial Sequence
  chemically synthesized
acacattgattcatagaaaaag

SEQ ID NO: 685720 - DNA, 22 bp, Artificial Sequence
  chemically synthesized
aaatttcataactttttctatg

SEQ ID NO: 685721 - DNA, 22 bp, Artificial Sequence
  chemically synthesized
cataactttttctatgaatcaa

SEQ ID NO: 685722 - DNA, 22 bp, Artificial Sequence
  chemically synthesized
ataactttttctatgaatcaat

SEQ ID NO: 685723 - DNA, 22 bp, Artificial Sequence
  chemically synthesized
aaaaaatgagttgacacattga

SEQ ID NO: 685724 - DNA, 22 bp, Artificial Sequence
  chemically synthesized
tttctatgaatcaatgtgtcaa

SEQ ID NO: 685725 - DNA, 22 bp, Artificial Sequence
  chemically synthesized
ttctatgaatcaatgtgtcaac

SEQ ID NO: 685726 - DNA, 22 bp, Artificial Sequence
  chemically synthesized
tctatgaatcaatgtgtcaact

SEQ ID NO: 685727 - DNA, 22 bp, Artificial Sequence
  chemically synthesized
ctatgaatcaatgtgtcaactc

SEQ ID NO: 685728 - DNA, 22 bp, Artificial Sequence
  chemically synthesized
tatgaatcaatgtgtcaactca

SEQ ID NO: 685729 - DNA, 22 bp, Artificial Sequence
  chemically synthesized
tgaatcaatgtgtcaactcatt

SEQ ID NO: 685730 - DNA, 22 bp, Artificial Sequence
  chemically synthesized
aaaagttgaaaaaatgagttga

SEQ ID NO: 685731 - DNA, 22 bp, Artificial Sequence
  chemically synthesized
gaaaagttgaaaaaatgagttg

SEQ ID NO: 685732 - DNA, 22 bp, Artificial Sequence
  chemically synthesized
agtttgaaaagttgaaaaaatg

SEQ ID NO: 685733 - DNA, 22 bp, Artificial Sequence
  chemically synthesized
cagtttgaaaagttgaaaaaat

SEQ ID NO: 685734 - DNA, 22 bp, Artificial Sequence
  chemically synthesized
tcagtttgaaaagttgaaaaaa

SEQ ID NO: 685735 - DNA, 22 bp, Artificial Sequence
  chemically synthesized
tttcagtttgaaaagttgaaaa

SEQ ID NO: 685736 - DNA, 22 bp, Artificial Sequence
  chemically synthesized
ctttcagtttgaaaagttgaaa

SEQ ID NO: 685737 - DNA, 22 bp, Artificial Sequence
  chemically synthesized
attttttcaacttttcaaactg

SEQ ID NO: 685738 - DNA, 22 bp, Artificial Sequence
  chemically synthesized
tttcaacttttcaaactgaaag

SEQ ID NO: 685739 - DNA, 22 bp, Artificial Sequence
  chemically synthesized
ttcaacttttcaaactgaaaga

SEQ ID NO: 685740 - DNA, 22 bp, Artificial Sequence
  chemically synthesized
tcaacttttcaaactgaaagaa

SEQ ID NO: 685741 - DNA, 22 bp, Artificial Sequence
  chemically synthesized
caacttttcaaactgaaagaaa

SEQ ID NO: 685742 - DNA, 22 bp, Artificial Sequence
  chemically synthesized
aacttttcaaactgaaagaaat

SEQ ID NO: 685743 - DNA, 22 bp, Artificial Sequence
  chemically synthesized
aagatcaatggaatttctttca

SEQ ID NO: 685744 - DNA, 22 bp, Artificial Sequence
  chemically synthesized
ttaaagatcaatggaatttctt

SEQ ID NO: 685745 - DNA, 22 bp, Artificial Sequence
  chemically synthesized
ttcaaactgaaagaaattccat

SEQ ID NO: 685746 - DNA, 22 bp, Artificial Sequence
  chemically synthesized
tcaaactgaaagaaattccatt

SEQ ID NO: 685747 - DNA, 22 bp, Artificial Sequence
  chemically synthesized
ttattaaagatcaatggaattt

SEQ ID NO: 685748 - DNA, 22 bp, Artificial Sequence
  chemically synthesized
caaactgaaagaaattccattg

SEQ ID NO: 685749 - DNA, 22 bp, Artificial Sequence
  chemically synthesized
aaactgaaagaaattccattga

SEQ ID NO: 685750 - DNA, 22 bp, Artificial Sequence
  chemically synthesized
attattattaaagatcaatgga

SEQ ID NO: 685751 - DNA, 22 bp, Artificial Sequence
  chemically synthesized
aaagaaattccattgatcttta

SEQ ID NO: 685752 - DNA, 22 bp, Artificial Sequence
  chemically synthesized
aattcattattattaaagatca

SEQ ID NO: 685753 - DNA, 22 bp, Artificial Sequence
  chemically synthesized
attaaattcattattattaaag

SEQ ID NO: 685754 - DNA, 22 bp, Artificial Sequence
  chemically synthesized
gattaaattcattattattaaa

SEQ ID NO: 685755 - DNA, 22 bp, Artificial Sequence
  chemically synthesized
cattgatctttaataataatga

SEQ ID NO: 685756 - DNA, 22 bp, Artificial Sequence
  chemically synthesized
atatttgattaaattcattatt

SEQ ID NO: 685757 - DNA, 22 bp, Artificial Sequence
  chemically synthesized
atctttaataataatgaattta

SEQ ID NO: 685758 - DNA, 22 bp, Artificial Sequence
  chemically synthesized
cctaatatttgattaaattcat

SEQ ID NO: 685759 - DNA, 22 bp, Artificial Sequence
  chemically synthesized
gcctaatatttgattaaattca

SEQ ID NO: 685760 - DNA, 22 bp, Artificial Sequence
  chemically synthesized
tgcctaatatttgattaaattc

SEQ ID NO: 685761 - DNA, 22 bp, Artificial Sequence
  chemically synthesized
taataataatgaatttaatcaa

SEQ ID NO: 685762 - DNA, 22 bp, Artificial Sequence
  chemically synthesized
aataataatgaatttaatcaaa

SEQ ID NO: 685763 - DNA, 22 bp, Artificial Sequence
  chemically synthesized
ataataatgaatttaatcaaat

SEQ ID NO: 685764 - DNA, 22 bp, Artificial Sequence
  chemically synthesized
aagaattttgcctaatatttga

SEQ ID NO: 685765 - DNA, 22 bp, Artificial Sequence
  chemically synthesized
actaaagaattttgcctaatat

SEQ ID NO: 685766 - DNA, 22 bp, Artificial Sequence
  chemically synthesized
cactaaagaattttgcctaata

SEQ ID NO: 685767 - DNA, 22 bp, Artificial Sequence
  chemically synthesized
tcactaaagaattttgcctaat

SEQ ID NO: 685768 - DNA, 22 bp, Artificial Sequence
  chemically synthesized
tttcactaaagaattttgccta

SEQ ID NO: 685769 - DNA, 22 bp, Artificial Sequence
  chemically synthesized
aatcaaatattaggcaaaattc

SEQ ID NO: 685770 - DNA, 22 bp, Artificial Sequence
  chemically synthesized
atcaaatattaggcaaaattct

SEQ ID NO: 685771 - DNA, 22 bp, Artificial Sequence
  chemically synthesized
agttctttcactaaagaatttt

SEQ ID NO: 685772 - DNA, 22 bp, Artificial Sequence
  chemically synthesized
tgagttctttcactaaagaatt

SEQ ID NO: 685773 - DNA, 22 bp, Artificial Sequence
  chemically synthesized
tctgagttctttcactaaagaa

SEQ ID NO: 685774 - DNA, 22 bp, Artificial Sequence
  chemically synthesized
ggcaaaattctttagtgaaaga

SEQ ID NO: 685775 - DNA, 22 bp, Artificial Sequence
  chemically synthesized
atcaaattctctgagttctttc

SEQ ID NO: 685776 - DNA, 22 bp, Artificial Sequence
  chemically synthesized
tttagtgaaagaactcagagaa

SEQ ID NO: 685777 - DNA, 22 bp, Artificial Sequence
  chemically synthesized
tagtgaaagaactcagagaatt

SEQ ID NO: 685778 - DNA, 22 bp, Artificial Sequence
  chemically synthesized
ggcacctaatcaaattctctga

SEQ ID NO: 685779 - DNA, 22 bp, Artificial Sequence
  chemically synthesized
agtgaaagaactcagagaattt

SEQ ID NO: 685780 - DNA, 22 bp, Artificial Sequence
  chemically synthesized
aggcacctaatcaaattctctg

SEQ ID NO: 685781 - DNA, 22 bp, Artificial Sequence
  chemically synthesized
gtgaaagaactcagagaatttg

SEQ ID NO: 685782 - DNA, 22 bp, Artificial Sequence
  chemically synthesized
taggcacctaatcaaattctct

SEQ ID NO: 685783 - DNA, 22 bp, Artificial Sequence
  chemically synthesized
agagaatttgattaggtgccta

SEQ ID NO: 685784 - DNA, 22 bp, Artificial Sequence
  chemically synthesized
aaaatgacattttaggcaccta

SEQ ID NO: 685785 - DNA, 22 bp, Artificial Sequence
  chemically synthesized
tgttaaaaatgacattttaggc

SEQ ID NO: 685786 - DNA, 22 bp, Artificial Sequence
  chemically synthesized
atgttaaaaatgacattttagg

SEQ ID NO: 685787 - DNA, 22 bp, Artificial Sequence
  chemically synthesized
tatgttaaaaatgacattttag

SEQ ID NO: 685788 - DNA, 22 bp, Artificial Sequence
  chemically synthesized
ttatgttaaaaatgacatttta

SEQ ID NO: 685789 - DNA, 22 bp, Artificial Sequence
  chemically synthesized
gattaggtgcctaaaatgtcat

SEQ ID NO: 685790 - DNA, 22 bp, Artificial Sequence
  chemically synthesized
attaggtgcctaaaatgtcatt

SEQ ID NO: 685791 - DNA, 22 bp, Artificial Sequence
  chemically synthesized
atttttatgttaaaaatgacat

SEQ ID NO: 685792 - DNA, 22 bp, Artificial Sequence
  chemically synthesized
ggtgcctaaaatgtcattttta

SEQ ID NO: 685793 - DNA, 22 bp, Artificial Sequence
  chemically synthesized
ttaatttttatgttaaaaatga

SEQ ID NO: 685794 - DNA, 22 bp, Artificial Sequence
  chemically synthesized
gttaatttttatgttaaaaatg

SEQ ID NO: 685795 - DNA, 22 bp, Artificial Sequence
  chemically synthesized
tgttaatttttatgttaaaaat

SEQ ID NO: 685796 - DNA, 22 bp, Artificial Sequence
  chemically synthesized
ttgttaatttttatgttaaaaa

SEQ ID NO: 685797 - DNA, 22 bp, Artificial Sequence
  chemically synthesized
aaatgtcatttttaacataaaa

SEQ ID NO: 685798 - DNA, 22 bp, Artificial Sequence
  chemically synthesized
tgcttttgttaatttttatgtt

SEQ ID NO: 685799 - DNA, 22 bp, Artificial Sequence
  chemically synthesized
gtgcttttgttaatttttatgt

SEQ ID NO: 685800 - DNA, 22 bp, Artificial Sequence
  chemically synthesized
tgtgcttttgttaatttttatg

SEQ ID NO: 685801 - DNA, 22 bp, Artificial Sequence
  chemically synthesized
ttgtgcttttgttaatttttat

SEQ ID NO: 685802 - DNA, 22 bp, Artificial Sequence
  chemically synthesized
ttaacataaaaattaacaaaag

SEQ ID NO: 685803 - DNA, 22 bp, Artificial Sequence
  chemically synthesized
taacataaaaattaacaaaagc

SEQ ID NO: 685804 - DNA, 22 bp, Artificial Sequence
  chemically synthesized
aacataaaaattaacaaaagca

SEQ ID NO: 685805 - DNA, 22 bp, Artificial Sequence
  chemically synthesized
acataaaaattaacaaaagcac

SEQ ID NO: 685806 - DNA, 22 bp, Artificial Sequence
  chemically synthesized
agataaaatggaaatatttttg

SEQ ID NO: 685807 - DNA, 22 bp, Artificial Sequence
  chemically synthesized
aagataaaatggaaatattttt

SEQ ID NO: 685808 - DNA, 22 bp, Artificial Sequence
  chemically synthesized
taagataaaatggaaatatttt

SEQ ID NO: 685809 - DNA, 22 bp, Artificial Sequence
  chemically synthesized
acaaaagcacaaaaatatttcc

SEQ ID NO: 685810 - DNA, 22 bp, Artificial Sequence
  chemically synthesized
ttaagataaaatggaaatattt

SEQ ID NO: 685811 - DNA, 22 bp, Artificial Sequence
  chemically synthesized
atttttaagataaaatggaaat

SEQ ID NO: 685812 - DNA, 22 bp, Artificial Sequence
  chemically synthesized
taacatagcatgttaattttta

SEQ ID NO: 685813 - DNA, 22 bp, Artificial Sequence
  chemically synthesized
ccattttatcttaaaaattaac

SEQ ID NO: 685814 - DNA, 22 bp, Artificial Sequence
  chemically synthesized
cattttatcttaaaaattaaca

SEQ ID NO: 685815 - DNA, 22 bp, Artificial Sequence
  chemically synthesized
tattataacatagcatgttaat

SEQ ID NO: 685816 - DNA, 22 bp, Artificial Sequence
  chemically synthesized
gtattataacatagcatgttaa

SEQ ID NO: 685817 - DNA, 22 bp, Artificial Sequence
  chemically synthesized
tatcttaaaaattaacatgcta

SEQ ID NO: 685818 - DNA, 22 bp, Artificial Sequence
  chemically synthesized
tgtattataacatagcatgtta

SEQ ID NO: 685819 - DNA, 22 bp, Artificial Sequence
  chemically synthesized
atcttaaaaattaacatgctat

SEQ ID NO: 685820 - DNA, 22 bp, Artificial Sequence
  chemically synthesized
ttgtattataacatagcatgtt

SEQ ID NO: 685821 - DNA, 22 bp, Artificial Sequence
  chemically synthesized
tcttaaaaattaacatgctatg

SEQ ID NO: 685822 - DNA, 22 bp, Artificial Sequence
  chemically synthesized
tttgtattataacatagcatgt

SEQ ID NO: 685823 - DNA, 22 bp, Artificial Sequence
  chemically synthesized
ttttgtattataacatagcatg

SEQ ID NO: 685824 - DNA, 22 bp, Artificial Sequence
  chemically synthesized
tttttgtattataacatagcat

SEQ ID NO: 685825 - DNA, 22 bp, Artificial Sequence
  chemically synthesized
aaaaattaacatgctatgttat

SEQ ID NO: 685826 - DNA, 22 bp, Artificial Sequence
  chemically synthesized
aaaattaacatgctatgttata

SEQ ID NO: 685827 - DNA, 22 bp, Artificial Sequence
  chemically synthesized
acatgctatgttataatacaaa

SEQ ID NO: 685828 - DNA, 22 bp, Artificial Sequence
  chemically synthesized
gggtaggggagggctttttttg

SEQ ID NO: 685829 - DNA, 22 bp, Artificial Sequence
  chemically synthesized
tgttataatacaaaaaaagccc

SEQ ID NO: 685830 - DNA, 22 bp, Artificial Sequence
  chemically synthesized
tggggtaggggagggctttttt

SEQ ID NO: 685831 - DNA, 22 bp, Artificial Sequence
  chemically synthesized
taatacaaaaaaagccctcccc

SEQ ID NO: 685832 - DNA, 22 bp, Artificial Sequence
  chemically synthesized
tgcaggattctggggtagggga

SEQ ID NO: 685833 - DNA, 22 bp, Artificial Sequence
  chemically synthesized
atgcaggattctggggtagggg

SEQ ID NO: 685834 - DNA, 22 bp, Artificial Sequence
  chemically synthesized
ttatgcaggattctggggtagg

SEQ ID NO: 685835 - DNA, 22 bp, Artificial Sequence
  chemically synthesized
acattcttatgcaggattctgg

SEQ ID NO: 685836 - DNA, 22 bp, Artificial Sequence
  chemically synthesized
ccctaccccagaatcctgcata

SEQ ID NO: 685837 - DNA, 22 bp, Artificial Sequence
  chemically synthesized
ccccagaatcctgcataagaat

SEQ ID NO: 685838 - DNA, 22 bp, Artificial Sequence
  chemically synthesized
cgcaaacaaacataaccattca

SEQ ID NO: 685839 - DNA, 22 bp, Artificial Sequence
  chemically synthesized
cataagaatgtgaatggttatg

SEQ ID NO: 685840 - DNA, 22 bp, Artificial Sequence
  chemically synthesized
tgtttgtttgcgcagatggggt

SEQ ID NO: 685841 - DNA, 22 bp, Artificial Sequence
  chemically synthesized
gtttgcgcagatggggtttata

SEQ ID NO: 685842 - DNA, 22 bp, Artificial Sequence
  chemically synthesized
tttgcgcagatggggtttatat

SEQ ID NO: 685843 - DNA, 22 bp, Artificial Sequence
  chemically synthesized
gcgcagatggggtttatattta

SEQ ID NO: 685844 - DNA, 22 bp, Artificial Sequence
  chemically synthesized
cgcagatggggtttatatttat

SEQ ID NO: 685845 - DNA, 22 bp, Artificial Sequence
  chemically synthesized
gatggaaaagaaacacataaat

SEQ ID NO: 685846 - DNA, 22 bp, Artificial Sequence
  chemically synthesized
ctagatggaaaagaaacacata

SEQ ID NO: 685847 - DNA, 22 bp, Artificial Sequence
  chemically synthesized
gctagatggaaaagaaacacat

SEQ ID NO: 685848 - DNA, 22 bp, Artificial Sequence
  chemically synthesized
aatttgctagatggaaaagaaa

SEQ ID NO: 685849 - DNA, 22 bp, Artificial Sequence
  chemically synthesized
atatttatgtgtttcttttcca

SEQ ID NO: 685850 - DNA, 22 bp, Artificial Sequence
  chemically synthesized
aaatttgctagatggaaaagaa

SEQ ID NO: 685851 - DNA, 22 bp, Artificial Sequence
  chemically synthesized
tatttatgtgtttcttttccat

SEQ ID NO: 685852 - DNA, 22 bp, Artificial Sequence
  chemically synthesized
gatttaaatttgctagatggaa

SEQ ID NO: 685853 - DNA, 22 bp, Artificial Sequence
  chemically synthesized
atgtgtttcttttccatctagc

SEQ ID NO: 685854 - DNA, 22 bp, Artificial Sequence
  chemically synthesized
tgtgtttcttttccatctagca

SEQ ID NO: 685855 - DNA, 22 bp, Artificial Sequence
  chemically synthesized
tatcctagatttaaatttgcta

SEQ ID NO: 685856 - DNA, 22 bp, Artificial Sequence
  chemically synthesized
gtatcctagatttaaatttgct

SEQ ID NO: 685857 - DNA, 22 bp, Artificial Sequence
  chemically synthesized
cttttccatctagcaaatttaa

SEQ ID NO: 685858 - DNA, 22 bp, Artificial Sequence
  chemically synthesized
ttttccatctagcaaatttaaa

SEQ ID NO: 685859 - DNA, 22 bp, Artificial Sequence
  chemically synthesized
ttccatctagcaaatttaaatc

SEQ ID NO: 685860 - DNA, 22 bp, Artificial Sequence
  chemically synthesized
tccatctagcaaatttaaatct

SEQ ID NO: 685861 - DNA, 22 bp, Artificial Sequence
  chemically synthesized
catttgtatcctagatttaaat

SEQ ID NO: 685862 - DNA, 22 bp, Artificial Sequence
  chemically synthesized
ccatctagcaaatttaaatcta

SEQ ID NO: 685863 - DNA, 22 bp, Artificial Sequence
  chemically synthesized
catctagcaaatttaaatctag

SEQ ID NO: 685864 - DNA, 22 bp, Artificial Sequence
  chemically synthesized
gcaaatttaaatctaggataca

SEQ ID NO: 685865 - DNA, 22 bp, Artificial Sequence
  chemically synthesized
aaatctaggatacaaatgtagt

SEQ ID NO: 685866 - DNA, 22 bp, Artificial Sequence
  chemically synthesized
aatctaggatacaaatgtagtc

SEQ ID NO: 685867 - DNA, 22 bp, Artificial Sequence
  chemically synthesized
agacacgataatgactacattt

SEQ ID NO: 685868 - DNA, 22 bp, Artificial Sequence
  chemically synthesized
ggatacaaatgtagtcattatc

SEQ ID NO: 685869 - DNA, 22 bp, Artificial Sequence
  chemically synthesized
accaattcagacacgataatga

SEQ ID NO: 685870 - DNA, 22 bp, Artificial Sequence
  chemically synthesized
caccaattcagacacgataatg

SEQ ID NO: 685871 - DNA, 22 bp, Artificial Sequence
  chemically synthesized
ttcaccaattcagacacgataa

SEQ ID NO: 685872 - DNA, 22 bp, Artificial Sequence
  chemically synthesized
cttcaccaattcagacacgata

SEQ ID NO: 685873 - DNA, 22 bp, Artificial Sequence
  chemically synthesized
tcttcaccaattcagacacgat

SEQ ID NO: 685874 - DNA, 22 bp, Artificial Sequence
  chemically synthesized
ggctttcttcaccaattcagac

SEQ ID NO: 685875 - DNA, 22 bp, Artificial Sequence
  chemically synthesized
gggctttcttcaccaattcaga

SEQ ID NO: 685876 - DNA, 22 bp, Artificial Sequence
  chemically synthesized
tgggctttcttcaccaattcag

SEQ ID NO: 685877 - DNA, 22 bp, Artificial Sequence
  chemically synthesized
tcgtgtctgaattggtgaagaa

SEQ ID NO: 685878 - DNA, 22 bp, Artificial Sequence
  chemically synthesized
gccatattttgggctttcttca

SEQ ID NO: 685879 - DNA, 22 bp, Artificial Sequence
  chemically synthesized
ggccatattttgggctttcttc

SEQ ID NO: 685880 - DNA, 22 bp, Artificial Sequence
  chemically synthesized
aattggtgaagaaagcccaaaa

SEQ ID NO: 685881 - DNA, 22 bp, Artificial Sequence
  chemically synthesized
gtgaagaaagcccaaaatatgg

SEQ ID NO: 685882 - DNA, 22 bp, Artificial Sequence
  chemically synthesized
aggtagggggcaagtagatttg

SEQ ID NO: 685883 - DNA, 22 bp, Artificial Sequence
  chemically synthesized
aaggtagggggcaagtagattt

SEQ ID NO: 685884 - DNA, 22 bp, Artificial Sequence
  chemically synthesized
ataatttaaggtagggggcaag

SEQ ID NO: 685885 - DNA, 22 bp, Artificial Sequence
  chemically synthesized
aaaactcataatttaaggtagg

SEQ ID NO: 685886 - DNA, 22 bp, Artificial Sequence
  chemically synthesized
aaaaactcataatttaaggtag

SEQ ID NO: 685887 - DNA, 22 bp, Artificial Sequence
  chemically synthesized
taaaaactcataatttaaggta

SEQ ID NO: 685888 - DNA, 22 bp, Artificial Sequence
  chemically synthesized
ttaaaaactcataatttaaggt

SEQ ID NO: 685889 - DNA, 22 bp, Artificial Sequence
  chemically synthesized
cttgccccctaccttaaattat

SEQ ID NO: 685890 - DNA, 22 bp, Artificial Sequence
  chemically synthesized
gccccctaccttaaattatgag

SEQ ID NO: 685891 - DNA, 22 bp, Artificial Sequence
  chemically synthesized
ccccctaccttaaattatgagt

SEQ ID NO: 685892 - DNA, 22 bp, Artificial Sequence
  chemically synthesized
aaaatatatttttaaaaactca

SEQ ID NO: 685893 - DNA, 22 bp, Artificial Sequence
  chemically synthesized
ccttaaattatgagtttttaaa

SEQ ID NO: 685894 - DNA, 22 bp, Artificial Sequence
  chemically synthesized
acctgaaaatatatttttaaaa

SEQ ID NO: 685895 - DNA, 22 bp, Artificial Sequence
  chemically synthesized
aaattatgagtttttaaaaata

SEQ ID NO: 685896 - DNA, 22 bp, Artificial Sequence
  chemically synthesized
aattatgagtttttaaaaatat

SEQ ID NO: 685897 - DNA, 22 bp, Artificial Sequence
  chemically synthesized
taacctgaaaatatatttttaa

SEQ ID NO: 685898 - DNA, 22 bp, Artificial Sequence
  chemically synthesized
tgagtttttaaaaatatatttt

SEQ ID NO: 685899 - DNA, 22 bp, Artificial Sequence
  chemically synthesized
ttaaaaatatattttcaggtta

SEQ ID NO: 685900 - DNA, 22 bp, Artificial Sequence
  chemically synthesized
taaaaatatattttcaggttag

SEQ ID NO: 685901 - DNA, 22 bp, Artificial Sequence
  chemically synthesized
aaaaatatattttcaggttaga

SEQ ID NO: 685902 - DNA, 22 bp, Artificial Sequence
  chemically synthesized
aaaatatattttcaggttagaa

SEQ ID NO: 685903 - DNA, 22 bp, Artificial Sequence
  chemically synthesized
agaaaaaagagaaatattctaa

SEQ ID NO: 685904 - DNA, 22 bp, Artificial Sequence
  chemically synthesized
aactcagaaaaaagagaaatat

SEQ ID NO: 685905 - DNA, 22 bp, Artificial Sequence
  chemically synthesized
tcaggttagaatatttctcttt

SEQ ID NO: 685906 - DNA, 22 bp, Artificial Sequence
  chemically synthesized
caggttagaatatttctctttt

SEQ ID NO: 685907 - DNA, 22 bp, Artificial Sequence
  chemically synthesized
aggttagaatatttctcttttt

SEQ ID NO: 685908 - DNA, 22 bp, Artificial Sequence
  chemically synthesized
agagagctaaactcagaaaaaa

SEQ ID NO: 685909 - DNA, 22 bp, Artificial Sequence
  chemically synthesized
gaatatttctcttttttctgag

SEQ ID NO: 685910 - DNA, 22 bp, Artificial Sequence
  chemically synthesized
cagagagctaaactcagaaaaa

SEQ ID NO: 685911 - DNA, 22 bp, Artificial Sequence
  chemically synthesized
cttcagagagctaaactcagaa

SEQ ID NO: 685912 - DNA, 22 bp, Artificial Sequence
  chemically synthesized
gcttcagagagctaaactcaga

SEQ ID NO: 685913 - DNA, 22 bp, Artificial Sequence
  chemically synthesized
ctcttttttctgagtttagctc

SEQ ID NO: 685914 - DNA, 22 bp, Artificial Sequence
  chemically synthesized
tcttttttctgagtttagctct

SEQ ID NO: 685915 - DNA, 22 bp, Artificial Sequence
  chemically synthesized
ttttttctgagtttagctctct

SEQ ID NO: 685916 - DNA, 22 bp, Artificial Sequence
  chemically synthesized
ttttctgagtttagctctctga

SEQ ID NO: 685917 - DNA, 22 bp, Artificial Sequence
  chemically synthesized
atagcacttgcttcagagagct

SEQ ID NO: 685918 - DNA, 22 bp, Artificial Sequence
  chemically synthesized
tttctgagtttagctctctgaa

SEQ ID NO: 685919 - DNA, 22 bp, Artificial Sequence
  chemically synthesized
ttctgagtttagctctctgaag

SEQ ID NO: 685920 - DNA, 22 bp, Artificial Sequence
  chemically synthesized
tctgagtttagctctctgaagc

SEQ ID NO: 685921 - DNA, 22 bp, Artificial Sequence
  chemically synthesized
ctgagtttagctctctgaagca

SEQ ID NO: 685922 - DNA, 22 bp, Artificial Sequence
  chemically synthesized
tgagtttagctctctgaagcaa

SEQ ID NO: 685923 - DNA, 22 bp, Artificial Sequence
  chemically synthesized
agtttagctctctgaagcaagt

SEQ ID NO: 685924 - DNA, 22 bp, Artificial Sequence
  chemically synthesized
atgaattgatagcacttgcttc

SEQ ID NO: 685925 - DNA, 22 bp, Artificial Sequence
  chemically synthesized
catgaattgatagcacttgctt

SEQ ID NO: 685926 - DNA, 22 bp, Artificial Sequence
  chemically synthesized
tcatgaattgatagcacttgct

SEQ ID NO: 685927 - DNA, 22 bp, Artificial Sequence
  chemically synthesized
agctctctgaagcaagtgctat

SEQ ID NO: 685928 - DNA, 22 bp, Artificial Sequence
  chemically synthesized
gctctctgaagcaagtgctatc

SEQ ID NO: 685929 - DNA, 22 bp, Artificial Sequence
  chemically synthesized
atattttcatgaattgatagca

SEQ ID NO: 685930 - DNA, 22 bp, Artificial Sequence
  chemically synthesized
tctgaagcaagtgctatcaatt

SEQ ID NO: 685931 - DNA, 22 bp, Artificial Sequence
  chemically synthesized
tgaagcaagtgctatcaattca

SEQ ID NO: 685932 - DNA, 22 bp, Artificial Sequence
  chemically synthesized
aagcaagtgctatcaattcatg

SEQ ID NO: 685933 - DNA, 22 bp, Artificial Sequence
  chemically synthesized
taattaatattttcatgaattg

SEQ ID NO: 685934 - DNA, 22 bp, Artificial Sequence
  chemically synthesized
ataattaatattttcatgaatt

SEQ ID NO: 685935 - DNA, 22 bp, Artificial Sequence
  chemically synthesized
tataattaatattttcatgaat

SEQ ID NO: 685936 - DNA, 22 bp, Artificial Sequence
  chemically synthesized
ttataattaatattttcatgaa

SEQ ID NO: 685937 - DNA, 22 bp, Artificial Sequence
  chemically synthesized
tcaattcatgaaaatattaatt

SEQ ID NO: 685938 - DNA, 22 bp, Artificial Sequence
  chemically synthesized
atgaaaatattaattataaaag

SEQ ID NO: 685939 - DNA, 22 bp, Artificial Sequence
  chemically synthesized
attataaaagttttatactgac

SEQ ID NO: 685940 - DNA, 22 bp, Artificial Sequence
  chemically synthesized
tgaggaccaaatcgtcagtata

SEQ ID NO: 685941 - DNA, 22 bp, Artificial Sequence
  chemically synthesized
taaaagttttatactgacgatt

SEQ ID NO: 685942 - DNA, 22 bp, Artificial Sequence
  chemically synthesized
tatactgacgatttggtcctca

SEQ ID NO: 685943 - DNA, 22 bp, Artificial Sequence
  chemically synthesized
atactgacgatttggtcctcat

SEQ ID NO: 685944 - DNA, 22 bp, Artificial Sequence
  chemically synthesized
tactgacgatttggtcctcata

SEQ ID NO: 685945 - DNA, 22 bp, Artificial Sequence
  chemically synthesized
acgatttggtcctcataactgc

SEQ ID NO: 685946 - DNA, 22 bp, Artificial Sequence
  chemically synthesized
ggtcctcataactgcccctgct

SEQ ID NO: 685947 - DNA, 22 bp, Artificial Sequence
  chemically synthesized
gtcctcataactgcccctgctt

SEQ ID NO: 685948 - DNA, 22 bp, Artificial Sequence
  chemically synthesized
ataactgcccctgcttggtcta

SEQ ID NO: 685949 - DNA, 22 bp, Artificial Sequence
  chemically synthesized
cccctgcttggtctatatttca

SEQ ID NO: 685950 - DNA, 22 bp, Artificial Sequence
  chemically synthesized
cttggtctatatttcaccttca

SEQ ID NO: 685951 - DNA, 22 bp, Artificial Sequence
  chemically synthesized
ggtctatatttcaccttcatca

SEQ ID NO: 685952 - DNA, 22 bp, Artificial Sequence
  chemically synthesized
gaaaataaatcatgatgaaggt

SEQ ID NO: 685953 - DNA, 22 bp, Artificial Sequence
  chemically synthesized
gtctatatttcaccttcatcat

SEQ ID NO: 685954 - DNA, 22 bp, Artificial Sequence
  chemically synthesized
tatttcaccttcatcatgattt

SEQ ID NO: 685955 - DNA, 22 bp, Artificial Sequence
  chemically synthesized
atattagaaaataaatcatgat

SEQ ID NO: 685956 - DNA, 22 bp, Artificial Sequence
  chemically synthesized
caccttcatcatgatttatttt

SEQ ID NO: 685957 - DNA, 22 bp, Artificial Sequence
  chemically synthesized
atctcatattagaaaataaatc

SEQ ID NO: 685958 - DNA, 22 bp, Artificial Sequence
  chemically synthesized
accttcatcatgatttattttc

SEQ ID NO: 685959 - DNA, 22 bp, Artificial Sequence
  chemically synthesized
catcatgatttattttctaata

SEQ ID NO: 685960 - DNA, 22 bp, Artificial Sequence
  chemically synthesized
acattaatctcatattagaaaa

SEQ ID NO: 685961 - DNA, 22 bp, Artificial Sequence
  chemically synthesized
atcatgatttattttctaatat

SEQ ID NO: 685962 - DNA, 22 bp, Artificial Sequence
  chemically synthesized
aacattaatctcatattagaaa

SEQ ID NO: 685963 - DNA, 22 bp, Artificial Sequence
  chemically synthesized
tggtccttaacattaatctcat

SEQ ID NO: 685964 - DNA, 22 bp, Artificial Sequence
  chemically synthesized
atggtccttaacattaatctca

SEQ ID NO: 685965 - DNA, 22 bp, Artificial Sequence
  chemically synthesized
attttctaatatgagattaatg

SEQ ID NO: 685966 - DNA, 22 bp, Artificial Sequence
  chemically synthesized
ttttctaatatgagattaatgt

SEQ ID NO: 685967 - DNA, 22 bp, Artificial Sequence
  chemically synthesized
tctaatatgagattaatgttaa

SEQ ID NO: 685968 - DNA, 22 bp, Artificial Sequence
  chemically synthesized
ctaatatgagattaatgttaag

SEQ ID NO: 685969 - DNA, 22 bp, Artificial Sequence
  chemically synthesized
taatatgagattaatgttaagg

SEQ ID NO: 685970 - DNA, 22 bp, Artificial Sequence
  chemically synthesized
atatgagattaatgttaaggac

SEQ ID NO: 685971 - DNA, 22 bp, Artificial Sequence
  chemically synthesized
aacataacgtttatggtcctta

SEQ ID NO: 685972 - DNA, 22 bp, Artificial Sequence
  chemically synthesized
tcaacataacgtttatggtcct

SEQ ID NO: 685973 - DNA, 22 bp, Artificial Sequence
  chemically synthesized
atgttaaggaccataaacgtta

SEQ ID NO: 685974 - DNA, 22 bp, Artificial Sequence
  chemically synthesized
tgattctcaacataacgtttat

SEQ ID NO: 685975 - DNA, 22 bp, Artificial Sequence
  chemically synthesized
atgattctcaacataacgttta

SEQ ID NO: 685976 - DNA, 22 bp, Artificial Sequence
  chemically synthesized
tatgattctcaacataacgttt

SEQ ID NO: 685977 - DNA, 22 bp, Artificial Sequence
  chemically synthesized
aggaccataaacgttatgttga

SEQ ID NO: 685978 - DNA, 22 bp, Artificial Sequence
  chemically synthesized
gcacacatgttttatgattctc

SEQ ID NO: 685979 - DNA, 22 bp, Artificial Sequence
  chemically synthesized
agcacacatgttttatgattct

SEQ ID NO: 685980 - DNA, 22 bp, Artificial Sequence
  chemically synthesized
tgttgagaatcataaaacatgt

SEQ ID NO: 685981 - DNA, 22 bp, Artificial Sequence
  chemically synthesized
ccaaaatttagcacacatgttt

SEQ ID NO: 685982 - DNA, 22 bp, Artificial Sequence
  chemically synthesized
agaatcataaaacatgtgtgct

SEQ ID NO: 685983 - DNA, 22 bp, Artificial Sequence
  chemically synthesized
ttcccaaaatttagcacacatg

SEQ ID NO: 685984 - DNA, 22 bp, Artificial Sequence
  chemically synthesized
tatacgtgagctgttcccaaaa

SEQ ID NO: 685985 - DNA, 22 bp, Artificial Sequence
  chemically synthesized
tgtatacgtgagctgttcccaa

SEQ ID NO: 685986 - DNA, 22 bp, Artificial Sequence
  chemically synthesized
tctgtatacgtgagctgttccc

SEQ ID NO: 685987 - DNA, 22 bp, Artificial Sequence
  chemically synthesized
ctctgtatacgtgagctgttcc

SEQ ID NO: 685988 - DNA, 22 bp, Artificial Sequence
  chemically synthesized
tctctgtatacgtgagctgttc

SEQ ID NO: 685989 - DNA, 22 bp, Artificial Sequence
  chemically synthesized
tttctctgtatacgtgagctgt

SEQ ID NO: 685990 - DNA, 22 bp, Artificial Sequence
  chemically synthesized
ctttctctgtatacgtgagctg

SEQ ID NO: 685991 - DNA, 22 bp, Artificial Sequence
  chemically synthesized
aattttgggaacagctcacgta

SEQ ID NO: 685992 - DNA, 22 bp, Artificial Sequence
  chemically synthesized
ttctttctctgtatacgtgagc

SEQ ID NO: 685993 - DNA, 22 bp, Artificial Sequence
  chemically synthesized
cttctttctctgtatacgtgag

SEQ ID NO: 685994 - DNA, 22 bp, Artificial Sequence
  chemically synthesized
tcttctttctctgtatacgtga

SEQ ID NO: 685995 - DNA, 22 bp, Artificial Sequence
  chemically synthesized
tgggaacagctcacgtatacag

SEQ ID NO: 685996 - DNA, 22 bp, Artificial Sequence
  chemically synthesized
gggaacagctcacgtatacaga

SEQ ID NO: 685997 - DNA, 22 bp, Artificial Sequence
  chemically synthesized
ttttcttctttctctgtatacg

SEQ ID NO: 685998 - DNA, 22 bp, Artificial Sequence
  chemically synthesized
ggaacagctcacgtatacagag

SEQ ID NO: 685999 - DNA, 22 bp, Artificial Sequence
  chemically synthesized
attttcttctttctctgtatac

SEQ ID NO: 686000 - DNA, 22 bp, Artificial Sequence
  chemically synthesized
tattttcttctttctctgtata

SEQ ID NO: 686001 - DNA, 22 bp, Artificial Sequence
  chemically synthesized
ttattttcttctttctctgtat

SEQ ID NO: 686002 - DNA, 22 bp, Artificial Sequence
  chemically synthesized
tttattttcttctttctctgta

SEQ ID NO: 686003 - DNA, 22 bp, Artificial Sequence
  chemically synthesized
gatctttttattttcttctttc

SEQ ID NO: 686004 - DNA, 22 bp, Artificial Sequence
  chemically synthesized
acgtatacagagaaagaagaaa

SEQ ID NO: 686005 - DNA, 22 bp, Artificial Sequence
  chemically synthesized
ctagatctttttattttcttct

SEQ ID NO: 686006 - DNA, 22 bp, Artificial Sequence
  chemically synthesized
tctgctagatctttttattttc

SEQ ID NO: 686007 - DNA, 22 bp, Artificial Sequence
  chemically synthesized
atctgctagatctttttatttt

SEQ ID NO: 686008 - DNA, 22 bp, Artificial Sequence
  chemically synthesized
tatctgctagatctttttattt

SEQ ID NO: 686009 - DNA, 22 bp, Artificial Sequence
  chemically synthesized
tttatctgctagatctttttat

SEQ ID NO: 686010 - DNA, 22 bp, Artificial Sequence
  chemically synthesized
ctttatctgctagatcttttta

SEQ ID NO: 686011 - DNA, 22 bp, Artificial Sequence
  chemically synthesized
tctttatctgctagatcttttt

SEQ ID NO: 686012 - DNA, 22 bp, Artificial Sequence
  chemically synthesized
aatgggaccaaaaacagtattt

SEQ ID NO: 686013 - DNA, 22 bp, Artificial Sequence
  chemically synthesized
gcagataaagaaaatactgttt

SEQ ID NO: 686014 - DNA, 22 bp, Artificial Sequence
  chemically synthesized
taaatgggaccaaaaacagtat

SEQ ID NO: 686015 - DNA, 22 bp, Artificial Sequence
  chemically synthesized
ctaaatgggaccaaaaacagta

SEQ ID NO: 686016 - DNA, 22 bp, Artificial Sequence
  chemically synthesized
ataacatttctaaatgggacca

SEQ ID NO: 686017 - DNA, 22 bp, Artificial Sequence
  chemically synthesized
ccgttaataacatttctaaatg

SEQ ID NO: 686018 - DNA, 22 bp, Artificial Sequence
  chemically synthesized
tttttggtcccatttagaaatg

SEQ ID NO: 686019 - DNA, 22 bp, Artificial Sequence
  chemically synthesized
ttggtcccatttagaaatgtta

SEQ ID NO: 686020 - DNA, 22 bp, Artificial Sequence
  chemically synthesized
tggtcccatttagaaatgttat

SEQ ID NO: 686021 - DNA, 22 bp, Artificial Sequence
  chemically synthesized
ggtcccatttagaaatgttatt

SEQ ID NO: 686022 - DNA, 22 bp, Artificial Sequence
  chemically synthesized
gtcccatttagaaatgttatta

SEQ ID NO: 686023 - DNA, 22 bp, Artificial Sequence
  chemically synthesized
cagcattgccgttaataacatt

SEQ ID NO: 686024 - DNA, 22 bp, Artificial Sequence
  chemically synthesized
agaaatgttattaacggcaatg

SEQ ID NO: 686025 - DNA, 22 bp, Artificial Sequence
  chemically synthesized
gaaatgttattaacggcaatgc

SEQ ID NO: 686026 - DNA, 22 bp, Artificial Sequence
  chemically synthesized
gaaaggaaggtgttacagcatt

SEQ ID NO: 686027 - DNA, 22 bp, Artificial Sequence
  chemically synthesized
ttaacggcaatgctgtaacacc

SEQ ID NO: 686028 - DNA, 22 bp, Artificial Sequence
  chemically synthesized
tgttggaaaggaaggtgttaca

SEQ ID NO: 686029 - DNA, 22 bp, Artificial Sequence
  chemically synthesized
acggcaatgctgtaacaccttc

SEQ ID NO: 686030 - DNA, 22 bp, Artificial Sequence
  chemically synthesized
ccattgtgttggaaaggaaggt

SEQ ID NO: 686031 - DNA, 22 bp, Artificial Sequence
  chemically synthesized
gccattgtgttggaaaggaagg

SEQ ID NO: 686032 - DNA, 22 bp, Artificial Sequence
  chemically synthesized
taacaccttcctttccaacaca

SEQ ID NO: 686033 - DNA, 22 bp, Artificial Sequence
  chemically synthesized
atcccatggcttgccattgtgt

SEQ ID NO: 686034 - DNA, 22 bp, Artificial Sequence
  chemically synthesized
ttcatcccatggcttgccattg

SEQ ID NO: 686035 - DNA, 22 bp, Artificial Sequence
  chemically synthesized
cctttccaacacaatggcaagc

SEQ ID NO: 686036 - DNA, 22 bp, Artificial Sequence
  chemically synthesized
gttcatcccatggcttgccatt

SEQ ID NO: 686037 - DNA, 22 bp, Artificial Sequence
  chemically synthesized
ctttccaacacaatggcaagcc

SEQ ID NO: 686038 - DNA, 22 bp, Artificial Sequence
  chemically synthesized
tccaacacaatggcaagccatg

SEQ ID NO: 686039 - DNA, 22 bp, Artificial Sequence
  chemically synthesized
ccaacacaatggcaagccatgg

SEQ ID NO: 686040 - DNA, 22 bp, Artificial Sequence
  chemically synthesized
agcttgttcatcccatggcttg

SEQ ID NO: 686041 - DNA, 22 bp, Artificial Sequence
  chemically synthesized
caacacaatggcaagccatggg

SEQ ID NO: 686042 - DNA, 22 bp, Artificial Sequence
  chemically synthesized
gagcttgttcatcccatggctt

SEQ ID NO: 686043 - DNA, 22 bp, Artificial Sequence
  chemically synthesized
ccacacatgtcttgagcttgtt

SEQ ID NO: 686044 - DNA, 22 bp, Artificial Sequence
  chemically synthesized
gtatgctaccacacatgtcttg

SEQ ID NO: 686045 - DNA, 22 bp, Artificial Sequence
  chemically synthesized
attggtatgctaccacacatgt

SEQ ID NO: 686046 - DNA, 22 bp, Artificial Sequence
  chemically synthesized
aattggtatgctaccacacatg

SEQ ID NO: 686047 - DNA, 22 bp, Artificial Sequence
  chemically synthesized
cttaattggtatgctaccacac

SEQ ID NO: 686048 - DNA, 22 bp, Artificial Sequence
  chemically synthesized
gcttaattggtatgctaccaca

SEQ ID NO: 686049 - DNA, 22 bp, Artificial Sequence
  chemically synthesized
tttgcttaattggtatgctacc

SEQ ID NO: 686050 - DNA, 22 bp, Artificial Sequence
  chemically synthesized
aagacatgtgtggtagcatacc

SEQ ID NO: 686051 - DNA, 22 bp, Artificial Sequence
  chemically synthesized
gtaatgcatccatgagtcaact

SEQ ID NO: 686052 - DNA, 22 bp, Artificial Sequence
  chemically synthesized
ctagtaatgcatccatgagtca

SEQ ID NO: 686053 - DNA, 22 bp, Artificial Sequence
  chemically synthesized
agcaaacagttgactcatggat

SEQ ID NO: 686054 - DNA, 22 bp, Artificial Sequence
  chemically synthesized
actcatggatgcattactagca

SEQ ID NO: 686055 - DNA, 22 bp, Artificial Sequence
  chemically synthesized
gagcagaagtattgctagtaat

SEQ ID NO: 686056 - DNA, 22 bp, Artificial Sequence
  chemically synthesized
atggatgcattactagcaatac

SEQ ID NO: 686057 - DNA, 22 bp, Artificial Sequence
  chemically synthesized
ggttggagcagaagtattgcta

SEQ ID NO: 686058 - DNA, 22 bp, Artificial Sequence
  chemically synthesized
tatctgggttggagcagaagta

SEQ ID NO: 686059 - DNA, 22 bp, Artificial Sequence
  chemically synthesized
ctagcaatacttctgctccaac

SEQ ID NO: 686060 - DNA, 22 bp, Artificial Sequence
  chemically synthesized
gcaatacttctgctccaaccca

SEQ ID NO: 686061 - DNA, 22 bp, Artificial Sequence
  chemically synthesized
aagagcatctgtatctgggttg

SEQ ID NO: 686062 - DNA, 22 bp, Artificial Sequence
  chemically synthesized
ctgctccaacccagatacagat

SEQ ID NO: 686063 - DNA, 22 bp, Artificial Sequence
  chemically synthesized
tgctccaacccagatacagatg

SEQ ID NO: 686064 - DNA, 22 bp, Artificial Sequence
  chemically synthesized
taagttgaagagcatctgtatc

SEQ ID NO: 686065 - DNA, 22 bp, Artificial Sequence
  chemically synthesized
ctccaacccagatacagatgct

SEQ ID NO: 686066 - DNA, 22 bp, Artificial Sequence
  chemically synthesized
attgtaagttgaagagcatctg

SEQ ID NO: 686067 - DNA, 22 bp, Artificial Sequence
  chemically synthesized
caacccagatacagatgctctt

SEQ ID NO: 686068 - DNA, 22 bp, Artificial Sequence
  chemically synthesized
gtacataacctcattgtaagtt

SEQ ID NO: 686069 - DNA, 22 bp, Artificial Sequence
  chemically synthesized
ttggtacataacctcattgtaa

SEQ ID NO: 686070 - DNA, 22 bp, Artificial Sequence
  chemically synthesized
attggtacataacctcattgta

SEQ ID NO: 686071 - DNA, 22 bp, Artificial Sequence
  chemically synthesized
ttcaacttacaatgaggttatg

SEQ ID NO: 686072 - DNA, 22 bp, Artificial Sequence
  chemically synthesized
caacttacaatgaggttatgta

SEQ ID NO: 686073 - DNA, 22 bp, Artificial Sequence
  chemically synthesized
aacttacaatgaggttatgtac

SEQ ID NO: 686074 - DNA, 22 bp, Artificial Sequence
  chemically synthesized
tgatgagtttattggtacataa

SEQ ID NO: 686075 - DNA, 22 bp, Artificial Sequence
  chemically synthesized
atgatgagtttattggtacata

SEQ ID NO: 686076 - DNA, 22 bp, Artificial Sequence
  chemically synthesized
acaatgaggttatgtaccaata

SEQ ID NO: 686077 - DNA, 22 bp, Artificial Sequence
  chemically synthesized
caatgaggttatgtaccaataa

SEQ ID NO: 686078 - DNA, 22 bp, Artificial Sequence
  chemically synthesized
aacttatgatgagtttattggt

SEQ ID NO: 686079 - DNA, 22 bp, Artificial Sequence
  chemically synthesized
caacttatgatgagtttattgg

SEQ ID NO: 686080 - DNA, 22 bp, Artificial Sequence
  chemically synthesized
tcaacttatgatgagtttattg

SEQ ID NO: 686081 - DNA, 22 bp, Artificial Sequence
  chemically synthesized
tgtaccaataaactcatcataa

SEQ ID NO: 686082 - DNA, 22 bp, Artificial Sequence
  chemically synthesized
gaatattttcaacttatgatga

SEQ ID NO: 686083 - DNA, 22 bp, Artificial Sequence
  chemically synthesized
agaatattttcaacttatgatg

SEQ ID NO: 686084 - DNA, 22 bp, Artificial Sequence
  chemically synthesized
acttagaatattttcaacttat

SEQ ID NO: 686085 - DNA, 22 bp, Artificial Sequence
  chemically synthesized
gacttagaatattttcaactta

SEQ ID NO: 686086 - DNA, 22 bp, Artificial Sequence
  chemically synthesized
tgacttagaatattttcaactt

SEQ ID NO: 686087 - DNA, 22 bp, Artificial Sequence
  chemically synthesized
ttgacttagaatattttcaact

SEQ ID NO: 686088 - DNA, 22 bp, Artificial Sequence
  chemically synthesized
atcataagttgaaaatattcta

SEQ ID NO: 686089 - DNA, 22 bp, Artificial Sequence
  chemically synthesized
aatgcatttttgacttagaata

SEQ ID NO: 686090 - DNA, 22 bp, Artificial Sequence
  chemically synthesized
aaaatattctaagtcaaaaatg

SEQ ID NO: 686091 - DNA, 22 bp, Artificial Sequence
  chemically synthesized
ggtatgttaaatgcatttttga

SEQ ID NO: 686092 - DNA, 22 bp, Artificial Sequence
  chemically synthesized
taagtcaaaaatgcatttaaca

SEQ ID NO: 686093 - DNA, 22 bp, Artificial Sequence
  chemically synthesized
agtagattaggtatgttaaatg

SEQ ID NO: 686094 - DNA, 22 bp, Artificial Sequence
  chemically synthesized
agtcaaaaatgcatttaacata

SEQ ID NO: 686095 - DNA, 22 bp, Artificial Sequence
  chemically synthesized
tgatgttgagtagattaggtat

SEQ ID NO: 686096 - DNA, 22 bp, Artificial Sequence
  chemically synthesized
agctatgatgttgagtagatta

SEQ ID NO: 686097 - DNA, 22 bp, Artificial Sequence
  chemically synthesized
aacatacctaatctactcaaca

SEQ ID NO: 686098 - DNA, 22 bp, Artificial Sequence
  chemically synthesized
acatacctaatctactcaacat

SEQ ID NO: 686099 - DNA, 22 bp, Artificial Sequence
  chemically synthesized
ggctgagctatgatgttgagta

SEQ ID NO: 686100 - DNA, 22 bp, Artificial Sequence
  chemically synthesized
atctactcaacatcatagctca

SEQ ID NO: 686101 - DNA, 22 bp, Artificial Sequence
  chemically synthesized
aggtaggctaggctgagctatg

SEQ ID NO: 686102 - DNA, 22 bp, Artificial Sequence
  chemically synthesized
aaggtaggctaggctgagctat

SEQ ID NO: 686103 - DNA, 22 bp, Artificial Sequence
  chemically synthesized
ctcaacatcatagctcagccta

SEQ ID NO: 686104 - DNA, 22 bp, Artificial Sequence
  chemically synthesized
aacatcatagctcagcctagcc

SEQ ID NO: 686105 - DNA, 22 bp, Artificial Sequence
  chemically synthesized
agtaagtttaaggtaggctagg

SEQ ID NO: 686106 - DNA, 22 bp, Artificial Sequence
  chemically synthesized
tgagtaagtttaaggtaggcta

SEQ ID NO: 686107 - DNA, 22 bp, Artificial Sequence
  chemically synthesized
agcctagcctaccttaaactta

SEQ ID NO: 686108 - DNA, 22 bp, Artificial Sequence
  chemically synthesized
acgtaagtgttctgagtaagtt

SEQ ID NO: 686109 - DNA, 22 bp, Artificial Sequence
  chemically synthesized
gcctaccttaaacttactcaga

SEQ ID NO: 686110 - DNA, 22 bp, Artificial Sequence
  chemically synthesized
ccttaaacttactcagaacact

SEQ ID NO: 686111 - DNA, 22 bp, Artificial Sequence
  chemically synthesized
taggctaacgtaagtgttctga

SEQ ID NO: 686112 - DNA, 22 bp, Artificial Sequence
  chemically synthesized
aaacttactcagaacacttacg

SEQ ID NO: 686113 - DNA, 22 bp, Artificial Sequence
  chemically synthesized
aacttactcagaacacttacgt

SEQ ID NO: 686114 - DNA, 22 bp, Artificial Sequence
  chemically synthesized
cccaactgtaggctaacgtaag

SEQ ID NO: 686115 - DNA, 22 bp, Artificial Sequence
  chemically synthesized
gcccaactgtaggctaacgtaa

SEQ ID NO: 686116 - DNA, 22 bp, Artificial Sequence
  chemically synthesized
actcagaacacttacgttagcc

SEQ ID NO: 686117 - DNA, 22 bp, Artificial Sequence
  chemically synthesized
tgcccaactgtaggctaacgta

SEQ ID NO: 686118 - DNA, 22 bp, Artificial Sequence
  chemically synthesized
ctcagaacacttacgttagcct

SEQ ID NO: 686119 - DNA, 22 bp, Artificial Sequence
  chemically synthesized
agaacacttacgttagcctaca

SEQ ID NO: 686120 - DNA, 22 bp, Artificial Sequence
  chemically synthesized
gatgattttgcccaactgtagg

SEQ ID NO: 686121 - DNA, 22 bp, Artificial Sequence
  chemically synthesized
acgttagcctacagttgggcaa

SEQ ID NO: 686122 - DNA, 22 bp, Artificial Sequence
  chemically synthesized
tgttagatgattttgcccaact

SEQ ID NO: 686123 - DNA, 22 bp, Artificial Sequence
  chemically synthesized
cgttagcctacagttgggcaaa

SEQ ID NO: 686124 - DNA, 22 bp, Artificial Sequence
  chemically synthesized
gtgttagatgattttgcccaac

SEQ ID NO: 686125 - DNA, 22 bp, Artificial Sequence
  chemically synthesized
tgtgttagatgattttgcccaa

SEQ ID NO: 686126 - DNA, 22 bp, Artificial Sequence
  chemically synthesized
gcctacagttgggcaaaatcat

SEQ ID NO: 686127 - DNA, 22 bp, Artificial Sequence
  chemically synthesized
cagttgggcaaaatcatctaac

SEQ ID NO: 686128 - DNA, 22 bp, Artificial Sequence
  chemically synthesized
ggcaaaatcatctaacacaaag

SEQ ID NO: 686129 - DNA, 22 bp, Artificial Sequence
  chemically synthesized
gtataaaataggctttgtgtta

SEQ ID NO: 686130 - DNA, 22 bp, Artificial Sequence
  chemically synthesized
agtataaaataggctttgtgtt

SEQ ID NO: 686131 - DNA, 22 bp, Artificial Sequence
  chemically synthesized
tagtataaaataggctttgtgt

SEQ ID NO: 686132 - DNA, 22 bp, Artificial Sequence
  chemically synthesized
aatgctttagtataaaataggc

SEQ ID NO: 686133 - DNA, 22 bp, Artificial Sequence
  chemically synthesized
ttcaatgctttagtataaaata

SEQ ID NO: 686134 - DNA, 22 bp, Artificial Sequence
  chemically synthesized
acacaaagcctattttatacta

SEQ ID NO: 686135 - DNA, 22 bp, Artificial Sequence
  chemically synthesized
catgagctattcaatgctttag

SEQ ID NO: 686136 - DNA, 22 bp, Artificial Sequence
  chemically synthesized
ttttatactaaagcattgaata

SEQ ID NO: 686137 - DNA, 22 bp, Artificial Sequence
  chemically synthesized
tatactaaagcattgaatagct

SEQ ID NO: 686138 - DNA, 22 bp, Artificial Sequence
  chemically synthesized
atactaaagcattgaatagctc

SEQ ID NO: 686139 - DNA, 22 bp, Artificial Sequence
  chemically synthesized
aataaattacatgagctattca

SEQ ID NO: 686140 - DNA, 22 bp, Artificial Sequence
  chemically synthesized
tactaaagcattgaatagctca

SEQ ID NO: 686141 - DNA, 22 bp, Artificial Sequence
  chemically synthesized
aagcattgaatagctcatgtaa

SEQ ID NO: 686142 - DNA, 22 bp, Artificial Sequence
  chemically synthesized
agtacagtattcaataaattac

SEQ ID NO: 686143 - DNA, 22 bp, Artificial Sequence
  chemically synthesized
cagtacagtattcaataaatta

SEQ ID NO: 686144 - DNA, 22 bp, Artificial Sequence
  chemically synthesized
aatagctcatgtaatttattga

SEQ ID NO: 686145 - DNA, 22 bp, Artificial Sequence
  chemically synthesized
tcagtacagtattcaataaatt

SEQ ID NO: 686146 - DNA, 22 bp, Artificial Sequence
  chemically synthesized
actttcagtacagtattcaata

SEQ ID NO: 686147 - DNA, 22 bp, Artificial Sequence
  chemically synthesized
cactttcagtacagtattcaat

SEQ ID NO: 686148 - DNA, 22 bp, Artificial Sequence
  chemically synthesized
tcactttcagtacagtattcaa

SEQ ID NO: 686149 - DNA, 22 bp, Artificial Sequence
  chemically synthesized
ttcactttcagtacagtattca

SEQ ID NO: 686150 - DNA, 22 bp, Artificial Sequence
  chemically synthesized
atgtaatttattgaatactgta

SEQ ID NO: 686151 - DNA, 22 bp, Artificial Sequence
  chemically synthesized
tttttcactttcagtacagtat

SEQ ID NO: 686152 - DNA, 22 bp, Artificial Sequence
  chemically synthesized
tgtttttcactttcagtacagt

SEQ ID NO: 686153 - DNA, 22 bp, Artificial Sequence
  chemically synthesized
attgaatactgtactgaaagtg

SEQ ID NO: 686154 - DNA, 22 bp, Artificial Sequence
  chemically synthesized
ttgaatactgtactgaaagtga

SEQ ID NO: 686155 - DNA, 22 bp, Artificial Sequence
  chemically synthesized
aatactgtactgaaagtgaaaa

SEQ ID NO: 686156 - DNA, 22 bp, Artificial Sequence
  chemically synthesized
tactgaaagtgaaaaacagagg

SEQ ID NO: 686157 - DNA, 22 bp, Artificial Sequence
  chemically synthesized
aggtatccacacaacccctctg

SEQ ID NO: 686158 - DNA, 22 bp, Artificial Sequence
  chemically synthesized
aaagtgaaaaacagaggggttg

SEQ ID NO: 686159 - DNA, 22 bp, Artificial Sequence
  chemically synthesized
caggtatccacacaacccctct

SEQ ID NO: 686160 - DNA, 22 bp, Artificial Sequence
  chemically synthesized
agtagaaaccatacttcaggta

SEQ ID NO: 686161 - DNA, 22 bp, Artificial Sequence
  chemically synthesized
tgtggatacctgaagtatggtt

SEQ ID NO: 686162 - DNA, 22 bp, Artificial Sequence
  chemically synthesized
aagtatggtttctactgaatgt

SEQ ID NO: 686163 - DNA, 22 bp, Artificial Sequence
  chemically synthesized
caaaagtgatacacattcagta

SEQ ID NO: 686164 - DNA, 22 bp, Artificial Sequence
  chemically synthesized
ataatgctgcaaaagtgataca

SEQ ID NO: 686165 - DNA, 22 bp, Artificial Sequence
  chemically synthesized
gataatgctgcaaaagtgatac

SEQ ID NO: 686166 - DNA, 22 bp, Artificial Sequence
  chemically synthesized
ctactgaatgtgtatcactttt

SEQ ID NO: 686167 - DNA, 22 bp, Artificial Sequence
  chemically synthesized
tactgaatgtgtatcacttttg

SEQ ID NO: 686168 - DNA, 22 bp, Artificial Sequence
  chemically synthesized
cttgataatgctgcaaaagtga

SEQ ID NO: 686169 - DNA, 22 bp, Artificial Sequence
  chemically synthesized
ctgaatgtgtatcacttttgca

SEQ ID NO: 686170 - DNA, 22 bp, Artificial Sequence
  chemically synthesized
acttgataatgctgcaaaagtg

SEQ ID NO: 686171 - DNA, 22 bp, Artificial Sequence
  chemically synthesized
tacttgataatgctgcaaaagt

SEQ ID NO: 686172 - DNA, 22 bp, Artificial Sequence
  chemically synthesized
ttacttgataatgctgcaaaag
